United States Patent 7,374,927 (METHODS OF ANALYSIS OF DEGRADED NUCLEIC ACID SAMPLES) - sequence listing, part 2

SEQ ID NO: 39677 - DNA, 25 bp, Homo sapien
tattagtaccaccactgtggagaac

SEQ ID NO: 39678 - DNA, 25 bp, Homo sapien
gagaacagcttgggtgttcctcaca

SEQ ID NO: 39679 - DNA, 25 bp, Homo sapien
agcttgggtgttcctcacaaaactc

SEQ ID NO: 39680 - DNA, 25 bp, Homo sapien
gggtgttcctcacaaaactcaaaat

SEQ ID NO: 39681 - DNA, 25 bp, Homo sapien
actgtatgaaccagcaattccactg

SEQ ID NO: 39682 - DNA, 25 bp, Homo sapien
agccaagatctagaagcaacctgca

SEQ ID NO: 39683 - DNA, 25 bp, Homo sapien
gatctagaagcaacctgcatgtcca

SEQ ID NO: 39684 - DNA, 25 bp, Homo sapien
gtggaatgacgctacacagttgaca

SEQ ID NO: 39685 - DNA, 25 bp, Homo sapien
actgcaactcaggaaccttgtactc

SEQ ID NO: 39686 - DNA, 25 bp, Homo sapien
aactcaggaaccttgtactcagcca

SEQ ID NO: 39687 - DNA, 25 bp, Homo sapien
cagtagatcagtctcactaatataa

SEQ ID NO: 39688 - DNA, 25 bp, Homo sapien
gaaatctgtcaacataatttattct

SEQ ID NO: 39689 - DNA, 25 bp, Homo sapien
aatcatagaagctattctcatgaga

SEQ ID NO: 39690 - DNA, 25 bp, Homo sapien
actttgggagggcgaggcagttgga

SEQ ID NO: 39691 - DNA, 25 bp, Homo sapien
ggcgaggcagttggattgcttgagc

SEQ ID NO: 39692 - DNA, 25 bp, Homo sapien
gagcctggtaggtggagtttgcaat

SEQ ID NO: 39693 - DNA, 25 bp, Homo sapien
gtttgcaatgagccaagactgtgtc

SEQ ID NO: 39694 - DNA, 25 bp, Homo sapien
agactgtgtcactgtacttgagcct

SEQ ID NO: 39695 - DNA, 25 bp, Homo sapien
tggctggcctctgcaaacaaacata

SEQ ID NO: 39696 - DNA, 25 bp, Homo sapien
aatcccagtgctacacctgaggttc

SEQ ID NO: 39697 - DNA, 25 bp, Homo sapien
gagctcagaatctgacagcctctcc

SEQ ID NO: 39698 - DNA, 25 bp, Homo sapien
ctcccccattctgtgtgtgtcgggg

SEQ ID NO: 39699 - DNA, 25 bp, Homo sapien
tggctataggcgtggtggctcatgc

SEQ ID NO: 39700 - DNA, 25 bp, Homo sapien
cagcactttgggaagccggggtagg

SEQ ID NO: 39701 - DNA, 25 bp, Homo sapien
gtaggaggatcaccagaggccagca

SEQ ID NO: 39702 - DNA, 25 bp, Homo sapien
acagcaagacaccgcatctacaaaa

SEQ ID NO: 39703 - DNA, 25 bp, Homo sapien
tacctgtaggcctagctgctcagga

SEQ ID NO: 39704 - DNA, 25 bp, Homo sapien
gagcctgagttcaacactgcagtga

SEQ ID NO: 39705 - DNA, 25 bp, Homo sapien
gagctatggtggcaccactgcactc

SEQ ID NO: 39706 - DNA, 25 bp, Homo sapien
gtttgtgtgttgattacctatgaag

SEQ ID NO: 39707 - DNA, 25 bp, Homo sapien
gtgttgattacctatgaaggagcaa

SEQ ID NO: 39708 - DNA, 25 bp, Homo sapien
gaaggagcaagtgggctgtttcctt

SEQ ID NO: 39709 - DNA, 25 bp, Homo sapien
ctgctggaggcggttgctgggaatt

SEQ ID NO: 39710 - DNA, 25 bp, Homo sapien
gaggcggttgctgggaattatttgg

SEQ ID NO: 39711 - DNA, 25 bp, Homo sapien
tgctgggaattatttggtgtcctgt

SEQ ID NO: 39712 - DNA, 25 bp, Homo sapien
ggcttgcctttcaggatttgcagaa

SEQ ID NO: 39713 - DNA, 25 bp, Homo sapien
gcctttcaggatttgcagaacccct

SEQ ID NO: 39714 - DNA, 25 bp, Homo sapien
cagaaccccttctcctttagaagtg

SEQ ID NO: 39715 - DNA, 25 bp, Homo sapien
ttctcctttagaagtgtcaactggg

SEQ ID NO: 39716 - DNA, 25 bp, Homo sapien
agaagtgtcaactggggctgggtgt

SEQ ID NO: 39717 - DNA, 25 bp, Homo sapien
ctcccccatctcaataaaaaataca

SEQ ID NO: 39718 - DNA, 25 bp, Homo sapien
gtgggggcatgtgccagtagcccca

SEQ ID NO: 39719 - DNA, 25 bp, Homo sapien
gagtccaggaggttgaggctgcagt

SEQ ID NO: 39720 - DNA, 25 bp, Homo sapien
gaacaaagactgtgccactgcactc

SEQ ID NO: 39721 - DNA, 25 bp, Homo sapien
ggcaacagagggagcccttgtctca

SEQ ID NO: 39722 - DNA, 25 bp, Homo sapien
gaatattttaatcatctcccaggtt

SEQ ID NO: 39723 - DNA, 25 bp, Homo sapien
atcatctcccaggttctcattggaa

SEQ ID NO: 39724 - DNA, 25 bp, Homo sapien
ggttctcattggaaaggcagggtta

SEQ ID NO: 39725 - DNA, 25 bp, Homo sapien
ggaaatggaccaggccaggtgcggt

SEQ ID NO: 39726 - DNA, 25 bp, Homo sapien
ggaggctgagtcaggcggatcacct

SEQ ID NO: 39727 - DNA, 25 bp, Homo sapien
catggtagcatgtgcctgtaatccc

SEQ ID NO: 39728 - DNA, 25 bp, Homo sapien
gggtttccaaggttgagcactaggt

SEQ ID NO: 39729 - DNA, 25 bp, Homo sapien
gcactaggtgagggacagtggccag

SEQ ID NO: 39730 - DNA, 25 bp, Homo sapien
gggacaaaagcttctcgtcttcaac

SEQ ID NO: 39731 - DNA, 25 bp, Homo sapien
tcttcaaccctgagtcgcactcagc

SEQ ID NO: 39732 - DNA, 25 bp, Homo sapien
tcagccctgaaacacccattaagag

SEQ ID NO: 39733 - DNA, 25 bp, Homo sapien
gacacaggaaactaagtccgaccta

SEQ ID NO: 39734 - DNA, 25 bp, Homo sapien
ggagaagcatccaatctcccatctc

SEQ ID NO: 39735 - DNA, 25 bp, Homo sapien
caggccacatgctttgatacacttg

SEQ ID NO: 39736 - DNA, 25 bp, Homo sapien
cacttgcactattttaattcccttc

SEQ ID NO: 39737 - DNA, 25 bp, Homo sapien
gtaagcacagtgaactttgttgtag

SEQ ID NO: 39738 - DNA, 25 bp, Homo sapien
atgatgggacttcactctatcttct

SEQ ID NO: 39739 - DNA, 25 bp, Homo sapien
atattactcaatgattatttttttc

SEQ ID NO: 39740 - DNA, 25 bp, Homo sapien
tctcatcttaaaaggggtattttca

SEQ ID NO: 39741 - DNA, 25 bp, Homo sapien
tagttgggtgagttatgcaggctgc

SEQ ID NO: 39742 - DNA, 25 bp, Homo sapien
gttatgcaggctgcttttaaatttt

SEQ ID NO: 39743 - DNA, 25 bp, Homo sapien
agtgtaatacaaccaagagaatcaa

SEQ ID NO: 39744 - DNA, 25 bp, Homo sapien
aaatgttaagattggcctggcgcag

SEQ ID NO: 39745 - DNA, 25 bp, Homo sapien
tgttaagattggcctggcgcagtgg

SEQ ID NO: 39746 - DNA, 25 bp, Homo sapien
aatactttcttagatcactcgtgta

SEQ ID NO: 39747 - DNA, 25 bp, Homo sapien
gatcactcgtgtattcatgagcaat

SEQ ID NO: 39748 - DNA, 25 bp, Homo sapien
atgagcaattcgatggtttttagtc

SEQ ID NO: 39749 - DNA, 25 bp, Homo sapien
attcgatggtttttagtcatattac

SEQ ID NO: 39750 - DNA, 25 bp, Homo sapien
atgcaggaggagggattgcctttcc

SEQ ID NO: 39751 - DNA, 25 bp, Homo sapien
ttcaaggttgcagatgtcactcctg

SEQ ID NO: 39752 - DNA, 25 bp, Homo sapien
ggcaagaacttggtcacgtggccac

SEQ ID NO: 39753 - DNA, 25 bp, Homo sapien
cacctaatcacagggaggctgggag

SEQ ID NO: 39754 - DNA, 25 bp, Homo sapien
gatgtaatcttacctgggcagttgt

SEQ ID NO: 39755 - DNA, 25 bp, Homo sapien
tcggggagctgctagcagtcttctc

SEQ ID NO: 39756 - DNA, 25 bp, Homo sapien
agctctaacacattagctgcctcag

SEQ ID NO: 39757 - DNA, 25 bp, Homo sapien
gcctcagcaagctggagttttgggc

SEQ ID NO: 39758 - DNA, 25 bp, Homo sapien
gctggagttttgggctttatagtca

SEQ ID NO: 39759 - DNA, 25 bp, Homo sapien
gatcgtttgagtcctggagaccatc

SEQ ID NO: 39760 - DNA, 25 bp, Homo sapien
atagcaaaaccttgtgtttacataa

SEQ ID NO: 39761 - DNA, 25 bp, Homo sapien
agtgattctcctaaggcaagaaata

SEQ ID NO: 39762 - DNA, 25 bp, Homo sapien
ggcaagaaatagtgaaaaccctaga

SEQ ID NO: 39763 - DNA, 25 bp, Homo sapien
cctagaacagcagggtttaatccca

SEQ ID NO: 39764 - DNA, 25 bp, Homo sapien
atcccaagattctgcgctgattagc

SEQ ID NO: 39765 - DNA, 25 bp, Homo sapien
gattctgcgctgattagctctgtga

SEQ ID NO: 39766 - DNA, 25 bp, Homo sapien
tctgcgctgattagctctgtgacct

SEQ ID NO: 39767 - DNA, 25 bp, Homo sapien
ttgcaaagcatgtatcaggcagacc

SEQ ID NO: 39768 - DNA, 25 bp, Homo sapien
ccaagccagagatgatcttactccc

SEQ ID NO: 39769 - DNA, 25 bp, Homo sapien
ccagagatgatcttactcccatttc

SEQ ID NO: 39770 - DNA, 25 bp, Homo sapien
cttactcccatttcttagcataaag

SEQ ID NO: 39771 - DNA, 25 bp, Homo sapien
ctcccatttcttagcataaagcatt

SEQ ID NO: 39772 - DNA, 25 bp, Homo sapien
tgtatactggtaccagcagctccca

SEQ ID NO: 39773 - DNA, 25 bp, Homo sapien
cccccaaactcctcatctataggaa

SEQ ID NO: 39774 - DNA, 25 bp, Homo sapien
ataggaataatcagcggccctcagg

SEQ ID NO: 39775 - DNA, 25 bp, Homo sapien
ctccggtccgaggatgaggctgatt

SEQ ID NO: 39776 - DNA, 25 bp, Homo sapien
ggatgaggctgattattactgtgca

SEQ ID NO: 39777 - DNA, 25 bp, Homo sapien
tattactgtgcagcatgggatgaca

SEQ ID NO: 39778 - DNA, 25 bp, Homo sapien
gggatgacagattgagtggttttat

SEQ ID NO: 39779 - DNA, 25 bp, Homo sapien
gtcaccatctcttgttctggaagca

SEQ ID NO: 39780 - DNA, 25 bp, Homo sapien
catctcttgttctggaagcagctcc

SEQ ID NO: 39781 - DNA, 25 bp, Homo sapien
ggaagcagctccaacatcggaagta

SEQ ID NO: 39782 - DNA, 25 bp, Homo sapien
gctccaacatcggaagtaattatgt

SEQ ID NO: 39783 - DNA, 25 bp, Homo sapien
aatgaagtgtttcgaagcttcgaga

SEQ ID NO: 39784 - DNA, 25 bp, Homo sapien
gaatcgtgaacattatctcaatatt

SEQ ID NO: 39785 - DNA, 25 bp, Homo sapien
gttaggatctgaatcatgttctggg

SEQ ID NO: 39786 - DNA, 25 bp, Homo sapien
atcatgttctgggtaaggggacgag

SEQ ID NO: 39787 - DNA, 25 bp, Homo sapien
aggggacgaggagcgaacactgcac

SEQ ID NO: 39788 - DNA, 25 bp, Homo sapien
gacgaggagcgaacactgcactaag

SEQ ID NO: 39789 - DNA, 25 bp, Homo sapien
ggagcgaacactgcactaagatttg

SEQ ID NO: 39790 - DNA, 25 bp, Homo sapien
acactgcactaagatttggtttgcc

SEQ ID NO: 39791 - DNA, 25 bp, Homo sapien
tttggtttgccaaatcagattcttt

SEQ ID NO: 39792 - DNA, 25 bp, Homo sapien
aaatcagattctttggtcaagagtc

SEQ ID NO: 39793 - DNA, 25 bp, Homo sapien
gtcaagagtcagtttggggccaggc

SEQ ID NO: 39794 - DNA, 25 bp, Homo sapien
ttctcctgcagaatatctgagtcag

SEQ ID NO: 39795 - DNA, 25 bp, Homo sapien
atctgagtcagtggatttgggtggg

SEQ ID NO: 39796 - DNA, 25 bp, Homo sapien
gccactccctggggttattctgata

SEQ ID NO: 39797 - DNA, 25 bp, Homo sapien
ggggttattctgatactgatggtcc

SEQ ID NO: 39798 - DNA, 25 bp, Homo sapien
atactgatggtccagggtccacact

SEQ ID NO: 39799 - DNA, 25 bp, Homo sapien
gtttaatggttctgagcatgtgctg

SEQ ID NO: 39800 - DNA, 25 bp, Homo sapien
gcatgtgctgagggctcagagatgc

SEQ ID NO: 39801 - DNA, 25 bp, Homo sapien
ccaccctagctttgaccttggtaag

SEQ ID NO: 39802 - DNA, 25 bp, Homo sapien
gaccttggtaagtagctttgctttt

SEQ ID NO: 39803 - DNA, 25 bp, Homo sapien
taagtagctttgcttttcagagcct

SEQ ID NO: 39804 - DNA, 25 bp, Homo sapien
gcagacctgagactattctcctgca

SEQ ID NO: 39805 - DNA, 25 bp, Homo sapien
tacttagcttactgttttgaggttc

SEQ ID NO: 39806 - DNA, 25 bp, Homo sapien
tttgaggttcattcacgttgttaca

SEQ ID NO: 39807 - DNA, 25 bp, Homo sapien
cattcacgttgttacatggcttagt

SEQ ID NO: 39808 - DNA, 25 bp, Homo sapien
gttgatgggcatctggattatttcc

SEQ ID NO: 39809 - DNA, 25 bp, Homo sapien
ggattatttccagttcgaggtcatt

SEQ ID NO: 39810 - DNA, 25 bp, Homo sapien
tatggacatttgtgtactagtcttt

SEQ ID NO: 39811 - DNA, 25 bp, Homo sapien
gtgtactagtctttatgcttttatt

SEQ ID NO: 39812 - DNA, 25 bp, Homo sapien
atgcttttattctctttgataatta

SEQ ID NO: 39813 - DNA, 25 bp, Homo sapien
aattaactatctgtggaatggctga

SEQ ID NO: 39814 - DNA, 25 bp, Homo sapien
ttaagtggtaagaaactgcccagct

SEQ ID NO: 39815 - DNA, 25 bp, Homo sapien
tgggtgacaaatggggactccgtct

SEQ ID NO: 39816 - DNA, 25 bp, Homo sapien
aagaactatatgaccatttggatat

SEQ ID NO: 39817 - DNA, 25 bp, Homo sapien
aatgcagtataagttacggggctct

SEQ ID NO: 39818 - DNA, 25 bp, Homo sapien
gtataagttacggggctctgtagga

SEQ ID NO: 39819 - DNA, 25 bp, Homo sapien
ttaaaattaagagcggggccaggca

SEQ ID NO: 39820 - DNA, 25 bp, Homo sapien
attatgttgagattgtagccttggg

SEQ ID NO: 39821 - DNA, 25 bp, Homo sapien
agattgtagccttgggaaattttct

SEQ ID NO: 39822 - DNA, 25 bp, Homo sapien
aaaatcccaacacagcaatgaacat

SEQ ID NO: 39823 - DNA, 25 bp, Homo sapien
ttaacacactaatctactggaaaaa

SEQ ID NO: 39824 - DNA, 25 bp, Homo sapien
aaatgggctctctattggaaagtcc

SEQ ID NO: 39825 - DNA, 25 bp, Homo sapien
tattggaaagtcccaactctacttc

SEQ ID NO: 39826 - DNA, 25 bp, Homo sapien
aactctacttcccaataaatccaat

SEQ ID NO: 39827 - DNA, 25 bp, Homo sapien
gcaggtgacctgaatgccagtattg

SEQ ID NO: 39828 - DNA, 25 bp, Homo sapien
tgccagtattgaaaacaggtccatt

SEQ ID NO: 39829 - DNA, 25 bp, Homo sapien
caggtccatttaaagcccaagtcat

SEQ ID NO: 39830 - DNA, 25 bp, Homo sapien
cccaagtcatggcagagtaggctag

SEQ ID NO: 39831 - DNA, 25 bp, Homo sapien
ggctaggaggattccttccttttgg

SEQ ID NO: 39832 - DNA, 25 bp, Homo sapien
ttcactttcagggatggtcatttta

SEQ ID NO: 39833 - DNA, 25 bp, Homo sapien
atgtggttcacatttcagtcaaaca

SEQ ID NO: 39834 - DNA, 25 bp, Homo sapien
ataattagcttttccctgcttagcg

SEQ ID NO: 39835 - DNA, 25 bp, Homo sapien
tttccctgcttagcgccatttataa

SEQ ID NO: 39836 - DNA, 25 bp, Homo sapien
aacaaacaatgttgctttactctta

SEQ ID NO: 39837 - DNA, 25 bp, Homo sapien
tgttgctttactcttaatagccaaa

SEQ ID NO: 39838 - DNA, 25 bp, Homo sapien
cccactgcacgatcctcaggaagaa

SEQ ID NO: 39839 - DNA, 25 bp, Homo sapien
gaagaattcctttattgaaaccatt

SEQ ID NO: 39840 - DNA, 25 bp, Homo sapien
gaatagggtagatttaggcacggga

SEQ ID NO: 39841 - DNA, 25 bp, Homo sapien
taggcacgggaaatgtaaacagcaa

SEQ ID NO: 39842 - DNA, 25 bp, Homo sapien
aaagtgcgttaatgtcacgcctgta

SEQ ID NO: 39843 - DNA, 25 bp, Homo sapien
ctctcagccctaacataatatgatt

SEQ ID NO: 39844 - DNA, 25 bp, Homo sapien
gagaagagcaggacttgatcccccc

SEQ ID NO: 39845 - DNA, 25 bp, Homo sapien
gatccccccatcacttgggggcatc

SEQ ID NO: 39846 - DNA, 25 bp, Homo sapien
cccatcacttgggggcatccccaag

SEQ ID NO: 39847 - DNA, 25 bp, Homo sapien
ggcagccaaggctaattaggaatct

SEQ ID NO: 39848 - DNA, 25 bp, Homo sapien
aggggcagtacaggacatacattct

SEQ ID NO: 39849 - DNA, 25 bp, Homo sapien
cagatagcatgtgtcctgtcgctgt

SEQ ID NO: 39850 - DNA, 25 bp, Homo sapien
tcctgtcgctgtcacaactttttaa

SEQ ID NO: 39851 - DNA, 25 bp, Homo sapien
ctgggggtcctcttgaagagcccag

SEQ ID NO: 39852 - DNA, 25 bp, Homo sapien
tgaagagcccaggaactgcagtccc

SEQ ID NO: 39853 - DNA, 25 bp, Homo sapien
ttctgagggctgacactgcctgagc

SEQ ID NO: 39854 - DNA, 25 bp, Homo sapien
ctttgccctcaatttcattgagatg

SEQ ID NO: 39855 - DNA, 25 bp, Homo sapien
gagatgggccgtgagtgactaaagt

SEQ ID NO: 39856 - DNA, 25 bp, Homo sapien
tatgagatggaaacccttctttcct

SEQ ID NO: 39857 - DNA, 25 bp, Homo sapien
accccgccgcagtggagattgtggc

SEQ ID NO: 39858 - DNA, 25 bp, Homo sapien
gagattgtggcagatgggtcagata

SEQ ID NO: 39859 - DNA, 25 bp, Homo sapien
gggtcagatagcatgtgtcctgtcg

SEQ ID NO: 39860 - DNA, 25 bp, Homo sapien
aaacgggagcgtgtgaggaattgaa

SEQ ID NO: 39861 - DNA, 25 bp, Homo sapien
ggcaacattctgattctgagtctgg

SEQ ID NO: 39862 - DNA, 25 bp, Homo sapien
agaagtcccagagatcaaaatagta

SEQ ID NO: 39863 - DNA, 25 bp, Homo sapien
agaagtcactgttatgggcttagtt

SEQ ID NO: 39864 - DNA, 25 bp, Homo sapien
atgggcttagttgtatcctcttaaa

SEQ ID NO: 39865 - DNA, 25 bp, Homo sapien
attcatataatgaagccctaaccct

SEQ ID NO: 39866 - DNA, 25 bp, Homo sapien
ggaggaagtgtctttcaagaggtaa

SEQ ID NO: 39867 - DNA, 25 bp, Homo sapien
gaggtaattaccgcctgtaatccca

SEQ ID NO: 39868 - DNA, 25 bp, Homo sapien
gcaagggctggacgcagcaggaccg

SEQ ID NO: 39869 - DNA, 25 bp, Homo sapien
gaccgtggtctgttctgtgatggat

SEQ ID NO: 39870 - DNA, 25 bp, Homo sapien
gtctgttctgtgatggattgtcggg

SEQ ID NO: 39871 - DNA, 25 bp, Homo sapien
accggatgccttactggtaacataa

SEQ ID NO: 39872 - DNA, 25 bp, Homo sapien
attttgtatgccagcaatccccaac

SEQ ID NO: 39873 - DNA, 25 bp, Homo sapien
ttgtcaccagggaccagtttcatgg

SEQ ID NO: 39874 - DNA, 25 bp, Homo sapien
gacagaggtcggtgggaggatggtt

SEQ ID NO: 39875 - DNA, 25 bp, Homo sapien
gttctaacaggctatgggctggtag

SEQ ID NO: 39876 - DNA, 25 bp, Homo sapien
gctatgggctggtagtggtctgtag

SEQ ID NO: 39877 - DNA, 25 bp, Homo sapien
tctgtagcctgggggttgcagaccc

SEQ ID NO: 39878 - DNA, 25 bp, Homo sapien
gacccctgctgtatgctgtatgtat

SEQ ID NO: 39879 - DNA, 25 bp, Homo sapien
atcataaggtccgtgtgtggcgtcc

SEQ ID NO: 39880 - DNA, 25 bp, Homo sapien
cccagcactttagggggccgaggcg

SEQ ID NO: 39881 - DNA, 25 bp, Homo sapien
gattgagaccatcctgactaacatg

SEQ ID NO: 39882 - DNA, 25 bp, Homo sapien
tcaactctttgttcacctgatggga

SEQ ID NO: 39883 - DNA, 25 bp, Homo sapien
ttcacctgatgggaagttcttcgtt

SEQ ID NO: 39884 - DNA, 25 bp, Homo sapien
agcccaggacgcctttatatgctgt

SEQ ID NO: 39885 - DNA, 25 bp, Homo sapien
tatatgctgttagtttccttacctg

SEQ ID NO: 39886 - DNA, 25 bp, Homo sapien
ttccttacctgctgatagagattct

SEQ ID NO: 39887 - DNA, 25 bp, Homo sapien
aaatcatacatgggctgtcagagct

SEQ ID NO: 39888 - DNA, 25 bp, Homo sapien
ttagaaggctggcctctaggcttct

SEQ ID NO: 39889 - DNA, 25 bp, Homo sapien
ttctcctctgtggcttatagccagt

SEQ ID NO: 39890 - DNA, 25 bp, Homo sapien
atacatgcattcctatactctagag

SEQ ID NO: 39891 - DNA, 25 bp, Homo sapien
catatgaacactgctctgaactcct

SEQ ID NO: 39892 - DNA, 25 bp, Homo sapien
tctgaactcctctgacttagcattc

SEQ ID NO: 39893 - DNA, 25 bp, Homo sapien
ggttaattagcctctttgtgtatac

SEQ ID NO: 39894 - DNA, 25 bp, Homo sapien
acccctagaaccctgtagaattgat

SEQ ID NO: 39895 - DNA, 25 bp, Homo sapien
gaattgattttactttggatctttt

SEQ ID NO: 39896 - DNA, 25 bp, Homo sapien
ggatctttttgataactttgagaat

SEQ ID NO: 39897 - DNA, 25 bp, Homo sapien
aattagaaagctatctcagagatgc

SEQ ID NO: 39898 - DNA, 25 bp, Homo sapien
aatagggccaggtgcggtggctcac

SEQ ID NO: 39899 - DNA, 25 bp, Homo sapien
ggtgggcggatcatttgacatcagg

SEQ ID NO: 39900 - DNA, 25 bp, Homo sapien
ggagtttgaaaccagcctgaccaac

SEQ ID NO: 39901 - DNA, 25 bp, Homo sapien
aattagccgggcacggtgatgcctg

SEQ ID NO: 39902 - DNA, 25 bp, Homo sapien
gcaagacggaggttatgtgagtgga

SEQ ID NO: 39903 - DNA, 25 bp, Homo sapien
gtggagattgagccactgcactcca

SEQ ID NO: 39904 - DNA, 25 bp, Homo sapien
gcccgtgaaggcactggcttagcag

SEQ ID NO: 39905 - DNA, 25 bp, Homo sapien
tggcttagcaggggtgctggcctgg

SEQ ID NO: 39906 - DNA, 25 bp, Homo sapien
cacccacagagccaacgattgactg

SEQ ID NO: 39907 - DNA, 25 bp, Homo sapien
ttgactgcacggcagaggcgcagct

SEQ ID NO: 39908 - DNA, 25 bp, Homo sapien
ggcagagggcagtatggctttgctg

SEQ ID NO: 39909 - DNA, 25 bp, Homo sapien
gtatggctttgctgccaatagtttc

SEQ ID NO: 39910 - DNA, 25 bp, Homo sapien
caatagtttcttctcacaggggcag

SEQ ID NO: 39911 - DNA, 25 bp, Homo sapien
ataacccaaagtaaccctacatgat

SEQ ID NO: 39912 - DNA, 25 bp, Homo sapien
cctacatgatggggctctgtgctga

SEQ ID NO: 39913 - DNA, 25 bp, Homo sapien
ggctctgtgctgagatgcaatgatg

SEQ ID NO: 39914 - DNA, 25 bp, Homo sapien
gtgtaaactgaggcatgtggagatg

SEQ ID NO: 39915 - DNA, 25 bp, Homo sapien
tttttccataggggctatctgtcat

SEQ ID NO: 39916 - DNA, 25 bp, Homo sapien
aggggctatctgtcatttttgtaag

SEQ ID NO: 39917 - DNA, 25 bp, Homo sapien
gtaggagttctttatatatgctaga

SEQ ID NO: 39918 - DNA, 25 bp, Homo sapien
aagtatgtgggcttatttatttata

SEQ ID NO: 39919 - DNA, 25 bp, Homo sapien
gatctggtgcaggcgtaataacaac

SEQ ID NO: 39920 - DNA, 25 bp, Homo sapien
gacattatttcaagatatctgcaac

SEQ ID NO: 39921 - DNA, 25 bp, Homo sapien
gcaacaaaaatatctggtttccact

SEQ ID NO: 39922 - DNA, 25 bp, Homo sapien
tggtttccacttgtgacaacgccac

SEQ ID NO: 39923 - DNA, 25 bp, Homo sapien
gacaacgccacaggtactattaaca

SEQ ID NO: 39924 - DNA, 25 bp, Homo sapien
ttaacattatgtactgtgggccagg

SEQ ID NO: 39925 - DNA, 25 bp, Homo sapien
tgtactgtgggccaggcgtggtggc

SEQ ID NO: 39926 - DNA, 25 bp, Homo sapien
taaggcgattagtcagaggcaagaa

SEQ ID NO: 39927 - DNA, 25 bp, Homo sapien
gtccaggctggaagtataaggtgat

SEQ ID NO: 39928 - DNA, 25 bp, Homo sapien
aagacctagggattgccttggtgca

SEQ ID NO: 39929 - DNA, 25 bp, Homo sapien
gggattgccttggtgcaggaatgag

SEQ ID NO: 39930 - DNA, 25 bp, Homo sapien
aatgaggtagggcactgccttccct

SEQ ID NO: 39931 - DNA, 25 bp, Homo sapien
ctgatggagtcttttcatttgcttc

SEQ ID NO: 39932 - DNA, 25 bp, Homo sapien
cattgtccctccattacatgtaaaa

SEQ ID NO: 39933 - DNA, 25 bp, Homo sapien
acatgtaaaacctcactggctctga

SEQ ID NO: 39934 - DNA, 25 bp, Homo sapien
gcactacactccctgtagagtgctt

SEQ ID NO: 39935 - DNA, 25 bp, Homo sapien
gcttaagagtgtggcttcttggccg

SEQ ID NO: 39936 - DNA, 25 bp, Homo sapien
gcccaggagggctcaagtggagatt

SEQ ID NO: 39937 - DNA, 25 bp, Homo sapien
cccgatgcagagcggtagccacact

SEQ ID NO: 39938 - DNA, 25 bp, Homo sapien
gtagccacactaaaggggccacagc

SEQ ID NO: 39939 - DNA, 25 bp, Homo sapien
ctgccacagaggctcaggggaccgt

SEQ ID NO: 39940 - DNA, 25 bp, Homo sapien
ggggaccgtgtgaagagctggagga

SEQ ID NO: 39941 - DNA, 25 bp, Homo sapien
attttattactatcccacatgggct

SEQ ID NO: 39942 - DNA, 25 bp, Homo sapien
gggagatggaatgccacccctaaac

SEQ ID NO: 39943 - DNA, 25 bp, Homo sapien
aaagctaagatgacctcatcctctg

SEQ ID NO: 39944 - DNA, 25 bp, Homo sapien
acaggcagctgtgccagcaactttc

SEQ ID NO: 39945 - DNA, 25 bp, Homo sapien
gccagcaactttccctaagagagtg

SEQ ID NO: 39946 - DNA, 25 bp, Homo sapien
gagtgttaacccaatatatcgagac

SEQ ID NO: 39947 - DNA, 25 bp, Homo sapien
atcgagacagatcttactcagtgta

SEQ ID NO: 39948 - DNA, 25 bp, Homo sapien
ggcatggcatcgaacagcatcttcg

SEQ ID NO: 39949 - DNA, 25 bp, Homo sapien
gcatcgaacagcatcttcgactcct

SEQ ID NO: 39950 - DNA, 25 bp, Homo sapien
gtacccaccagagcctgggctctgt

SEQ ID NO: 39951 - DNA, 25 bp, Homo sapien
gcctgggctctgtcaaggagcgggg

SEQ ID NO: 39952 - DNA, 25 bp, Homo sapien
ctgggctctgtcaaggagcggggca

SEQ ID NO: 39953 - DNA, 25 bp, Homo sapien
gggctctgtcaaggagcggggcatg

SEQ ID NO: 39954 - DNA, 25 bp, Homo sapien
ctctgtcaaggagcggggcatggca

SEQ ID NO: 39955 - DNA, 25 bp, Homo sapien
ctgtcaaggagcggggcatggcatc

SEQ ID NO: 39956 - DNA, 25 bp, Homo sapien
gtcaaggagcggggcatggcatcga

SEQ ID NO: 39957 - DNA, 25 bp, Homo sapien
tcaaggagcggggcatggcatcgaa

SEQ ID NO: 39958 - DNA, 25 bp, Homo sapien
caaggagcggggcatggcatcgaac

SEQ ID NO: 39959 - DNA, 25 bp, Homo sapien
gatactgaggaagtgtcggtgaccg

SEQ ID NO: 39960 - DNA, 25 bp, Homo sapien
tgtcggtgaccggaagaggggtggc

SEQ ID NO: 39961 - DNA, 25 bp, Homo sapien
gaggggtggtgtgacctgaggatgc

SEQ ID NO: 39962 - DNA, 25 bp, Homo sapien
gtggtgtcacctgtggatactgagg

SEQ ID NO: 39963 - DNA, 25 bp, Homo sapien
ggatactgaggaaaggctggtgaca

SEQ ID NO: 39964 - DNA, 25 bp, Homo sapien
ggaagcgtcggtgacaggaagaggg

SEQ ID NO: 39965 - DNA, 25 bp, Homo sapien
aggaagaggggtggcgtgacctgtg

SEQ ID NO: 39966 - DNA, 25 bp, Homo sapien
tggcgtgacctgtggacactgagaa

SEQ ID NO: 39967 - DNA, 25 bp, Homo sapien
gacactgagaaagcgtcggtgacag

SEQ ID NO: 39968 - DNA, 25 bp, Homo sapien
agaaaggtggcgtgacctgtggacc

SEQ ID NO: 39969 - DNA, 25 bp, Homo sapien
gacctgtggaccctgaggaagcgtc

SEQ ID NO: 39970 - DNA, 25 bp, Homo sapien
ccacctggggagctcttaaaattat

SEQ ID NO: 39971 - DNA, 25 bp, Homo sapien
ggagctcttaaaattatcagtgcct

SEQ ID NO: 39972 - DNA, 25 bp, Homo sapien
ttaaaattatcagtgcctaccccac

SEQ ID NO: 39973 - DNA, 25 bp, Homo sapien
ccccaccttccaagattctgattta

SEQ ID NO: 39974 - DNA, 25 bp, Homo sapien
ttctgatttaaatcctgtagtgttt

SEQ ID NO: 39975 - DNA, 25 bp, Homo sapien
ctgtagtgtttttaaggcaccccag

SEQ ID NO: 39976 - DNA, 25 bp, Homo sapien
aaatgctggatgtcagcacaacatc

SEQ ID NO: 39977 - DNA, 25 bp, Homo sapien
aagaggactcaattattttctaaga

SEQ ID NO: 39978 - DNA, 25 bp, Homo sapien
gagattatgaaagctatacatgttc

SEQ ID NO: 39979 - DNA, 25 bp, Homo sapien
ataatatagaaatgttggccaggca

SEQ ID NO: 39980 - DNA, 25 bp, Homo sapien
gctgagcggggaggacttcttgagc

SEQ ID NO: 39981 - DNA, 25 bp, Homo sapien
acaatcacagaattccagagctaga

SEQ ID NO: 39982 - DNA, 25 bp, Homo sapien
taatgttaccttttatcctacttca

SEQ ID NO: 39983 - DNA, 25 bp, Homo sapien
aagaagcatctttaattcgtatgta

SEQ ID NO: 39984 - DNA, 25 bp, Homo sapien
aacttttcctgggccaggtgcagtg

SEQ ID NO: 39985 - DNA, 25 bp, Homo sapien
gacaccagcaggaccaacatggaga

SEQ ID NO: 39986 - DNA, 25 bp, Homo sapien
cgtagtgacaaagcctgtaattcca

SEQ ID NO: 39987 - DNA, 25 bp, Homo sapien
gagtgaagtgaaattccgtctcaaa

SEQ ID NO: 39988 - DNA, 25 bp, Homo sapien
aaacctttcctgatgtgacaaattg

SEQ ID NO: 39989 - DNA, 25 bp, Homo sapien
caaattgtattgagtttctggcaac

SEQ ID NO: 39990 - DNA, 25 bp, Homo sapien
aattgtatatgtaacttctttgact

SEQ ID NO: 39991 - DNA, 25 bp, Homo sapien
cttctttgactactgtgagagatga

SEQ ID NO: 39992 - DNA, 25 bp, Homo sapien
gactttccggaggacaggaggccca

SEQ ID NO: 39993 - DNA, 25 bp, Homo sapien
gtgtccccagtgaaggtgacagccc

SEQ ID NO: 39994 - DNA, 25 bp, Homo sapien
gtgacagccctgggcggtgggaact

SEQ ID NO: 39995 - DNA, 25 bp, Homo sapien
gccacgttcaccttcatgagggagg

SEQ ID NO: 39996 - DNA, 25 bp, Homo sapien
ggagcctggcaaattcagcgcctat

SEQ ID NO: 39997 - DNA, 25 bp, Homo sapien
ggacgactacgtcttttactgcaaa

SEQ ID NO: 39998 - DNA, 25 bp, Homo sapien
gccacctcacctgcaggtaggaatc

SEQ ID NO: 39999 - DNA, 25 bp, Homo sapien
taccaacctggaggccctggaagaa

SEQ ID NO: 40000 - DNA, 25 bp, Homo sapien
cggaggaggacattttcatgcccct

SEQ ID NO: 40001 - DNA, 25 bp, Homo sapien
tcatgcccctgcagacgggaagctg

SEQ ID NO: 40002 - DNA, 25 bp, Homo sapien
gaagctgcgttctcgaacactaggc

SEQ ID NO: 40003 - DNA, 25 bp, Homo sapien
accatttgactcagcaatccattac

SEQ ID NO: 40004 - DNA, 25 bp, Homo sapien
gacacatgcacgtgtgtgcttattg

SEQ ID NO: 40005 - DNA, 25 bp, Homo sapien
ataatagcagacttggggccaaccc

SEQ ID NO: 40006 - DNA, 25 bp, Homo sapien
cccaaatgcccatcagtgatcgact

SEQ ID NO: 40007 - DNA, 25 bp, Homo sapien
ccatcattctcagcacagtaacaca

SEQ ID NO: 40008 - DNA, 25 bp, Homo sapien
gagaggggaacatcacagaccaggg

SEQ ID NO: 40009 - DNA, 25 bp, Homo sapien
ggctgggggcaaggggaggcatagc

SEQ ID NO: 40010 - DNA, 25 bp, Homo sapien
gaggcatagcattaggacaataccc

SEQ ID NO: 40011 - DNA, 25 bp, Homo sapien
ggacaatacccatgcatctggggct

SEQ ID NO: 40012 - DNA, 25 bp, Homo sapien
ccatgcatctggggcttataacgag

SEQ ID NO: 40013 - DNA, 25 bp, Homo sapien
aacctgcatgttctgcacacgtatc

SEQ ID NO: 40014 - DNA, 25 bp, Homo sapien
gatatttctagtctatgtgtttcat

SEQ ID NO: 40015 - DNA, 25 bp, Homo sapien
gtctatgtgtttcatctgcaggttt

SEQ ID NO: 40016 - DNA, 25 bp, Homo sapien
aaacctgtgttcaagggtcagctgt

SEQ ID NO: 40017 - DNA, 25 bp, Homo sapien
gaaagtagaactgtacccttgggca

SEQ ID NO: 40018 - DNA, 25 bp, Homo sapien
actgtacccttgggcaggggtgtgt

SEQ ID NO: 40019 - DNA, 25 bp, Homo sapien
aggggtgtgtgtgtgtagttaaaga

SEQ ID NO: 40020 - DNA, 25 bp, Homo sapien
gaataaaactggcccttattagctt

SEQ ID NO: 40021 - DNA, 25 bp, Homo sapien
tcaggcctgtaatcccttaactttg

SEQ ID NO: 40022 - DNA, 25 bp, Homo sapien
gggagaccaaggggagtggatcact

SEQ ID NO: 40023 - DNA, 25 bp, Homo sapien
tcacccttccctactgaaaatacaa

SEQ ID NO: 40024 - DNA, 25 bp, Homo sapien
aaatacaaaagttagccaggcgcag

SEQ ID NO: 40025 - DNA, 25 bp, Homo sapien
gtgtttttactaatagatcctctct

SEQ ID NO: 40026 - DNA, 25 bp, Homo sapien
actaatagatcctctctcatttcat

SEQ ID NO: 40027 - DNA, 25 bp, Homo sapien
gatcctctctcatttcatggtttat

SEQ ID NO: 40028 - DNA, 25 bp, Homo sapien
aatgaactggaggtcttaattttag

SEQ ID NO: 40029 - DNA, 25 bp, Homo sapien
ggaaactaagagaaaggccagacat

SEQ ID NO: 40030 - DNA, 25 bp, Homo sapien
aaggccagacatggacatagccatt

SEQ ID NO: 40031 - DNA, 25 bp, Homo sapien
ggacatagccatttttggacataac

SEQ ID NO: 40032 - DNA, 25 bp, Homo sapien
acataacatatgtggatcggtgtaa

SEQ ID NO: 40033 - DNA, 25 bp, Homo sapien
tgtttgagacaattgggtatccata

SEQ ID NO: 40034 - DNA, 25 bp, Homo sapien
attgggtatccatatggtaagtatt

SEQ ID NO: 40035 - DNA, 25 bp, Homo sapien
aggcaaaactgtaaagcttctaaag

SEQ ID NO: 40036 - DNA, 25 bp, Homo sapien
gaggcagaggatttggacgaggaag

SEQ ID NO: 40037 - DNA, 25 bp, Homo sapien
ggacgaggaagatttcaaagctgga

SEQ ID NO: 40038 - DNA, 25 bp, Homo sapien
aagaggtggtgggaacttctcagga

SEQ ID NO: 40039 - DNA, 25 bp, Homo sapien
ggtgggaacttctcaggaaaatgga

SEQ ID NO: 40040 - DNA, 25 bp, Homo sapien
gagaaagagaacacagacctgatct

SEQ ID NO: 40041 - DNA, 25 bp, Homo sapien
agccggcccagttgtgaactaggag

SEQ ID NO: 40042 - DNA, 25 bp, Homo sapien
ggcccagttgtgaactaggagagct

SEQ ID NO: 40043 - DNA, 25 bp, Homo sapien
taggagagctttgggacctctgtcc

SEQ ID NO: 40044 - DNA, 25 bp, Homo sapien
gagctttgggacctctgtcccaagc

SEQ ID NO: 40045 - DNA, 25 bp, Homo sapien
ggacctctgtcccaagcaagagaga

SEQ ID NO: 40046 - DNA, 25 bp, Homo sapien
ctgtcccaagcaagagagatgaatg

SEQ ID NO: 40047 - DNA, 25 bp, Homo sapien
ggtggtgacgggaggcagacacact

SEQ ID NO: 40048 - DNA, 25 bp, Homo sapien
cagacacactccaggggagtccctc

SEQ ID NO: 40049 - DNA, 25 bp, Homo sapien
ttgcgcctcacgtttagaaccaggg

SEQ ID NO: 40050 - DNA, 25 bp, Homo sapien
ggagactcctgggatcttttgacaa

SEQ ID NO: 40051 - DNA, 25 bp, Homo sapien
tgacaaaatttctctccaatctcta

SEQ ID NO: 40052 - DNA, 25 bp, Homo sapien
aatttctctccaatctctaagtaca

SEQ ID NO: 40053 - DNA, 25 bp, Homo sapien
ggatgctcctacaaagggccagatg

SEQ ID NO: 40054 - DNA, 25 bp, Homo sapien
actgctctttcataactgtgggctc

SEQ ID NO: 40055 - DNA, 25 bp, Homo sapien
tcataactgtgggctcttccgaaag

SEQ ID NO: 40056 - DNA, 25 bp, Homo sapien
gggctcttccgaaagtgacttcatg

SEQ ID NO: 40057 - DNA, 25 bp, Homo sapien
tgacttcatggctcagtgcctcagt

SEQ ID NO: 40058 - DNA, 25 bp, Homo sapien
ccatgctgtactgtggactccacat

SEQ ID NO: 40059 - DNA, 25 bp, Homo sapien
ggactccacatcagacctgggaggc

SEQ ID NO: 40060 - DNA, 25 bp, Homo sapien
ggcaggactcagtggatgaggctgt

SEQ ID NO: 40061 - DNA, 25 bp, Homo sapien
ggctgtgttttgcatttctgagtac

SEQ ID NO: 40062 - DNA, 25 bp, Homo sapien
ttgcatttctgagtacagtccacaa

SEQ ID NO: 40063 - DNA, 25 bp, Homo sapien
cagtccacaaaatggtttgcttctg

SEQ ID NO: 40064 - DNA, 25 bp, Homo sapien
aaagcagtagtagtcttacatccaa

SEQ ID NO: 40065 - DNA, 25 bp, Homo sapien
gtcttacatccaagattattcctaa

SEQ ID NO: 40066 - DNA, 25 bp, Homo sapien
taaagtttcgacccacatatataat

SEQ ID NO: 40067 - DNA, 25 bp, Homo sapien
gaaactgcctacattggcaaagcca

SEQ ID NO: 40068 - DNA, 25 bp, Homo sapien
agatggggtaggccagttgcggtgg

SEQ ID NO: 40069 - DNA, 25 bp, Homo sapien
gtaatatgtcatgatttttcccctg

SEQ ID NO: 40070 - DNA, 25 bp, Homo sapien
atttttcccctggcagttgtgccat

SEQ ID NO: 40071 - DNA, 25 bp, Homo sapien
gtgccatctttgtcagcataacctt

SEQ ID NO: 40072 - DNA, 25 bp, Homo sapien
gcataacctttgctgccatagtgca

SEQ ID NO: 40073 - DNA, 25 bp, Homo sapien
gccatagtgcactgcgtttgtgctg

SEQ ID NO: 40074 - DNA, 25 bp, Homo sapien
gcgtttgtgctggaaggctggggga

SEQ ID NO: 40075 - DNA, 25 bp, Homo sapien
catgagctagtgacctgcttggggc

SEQ ID NO: 40076 - DNA, 25 bp, Homo sapien
gcttggggccaggcattgtatccag

SEQ ID NO: 40077 - DNA, 25 bp, Homo sapien
ttgtatccagtgctgcaggtatcac

SEQ ID NO: 40078 - DNA, 25 bp, Homo sapien
ttgcagccttttacaggtgtttgtt

SEQ ID NO: 40079 - DNA, 25 bp, Homo sapien
tgtttgtttaaaacctccttgccag

SEQ ID NO: 40080 - DNA, 25 bp, Homo sapien
atagcctagctaaatatccatcact

SEQ ID NO: 40081 - DNA, 25 bp, Homo sapien
gcctagctaaatatccatcactggt

SEQ ID NO: 40082 - DNA, 25 bp, Homo sapien
agcacagtagaaggaaatcggagta

SEQ ID NO: 40083 - DNA, 25 bp, Homo sapien
gtttgaggaaatatcacttgctaaa

SEQ ID NO: 40084 - DNA, 25 bp, Homo sapien
attcttttttctggatgaagcctgg

SEQ ID NO: 40085 - DNA, 25 bp, Homo sapien
tttttctggatgaagcctggcttga

SEQ ID NO: 40086 - DNA, 25 bp, Homo sapien
gaggccgaggcaggcagatcatttg

SEQ ID NO: 40087 - DNA, 25 bp, Homo sapien
gaggtcaggatttcaaaaccagcct

SEQ ID NO: 40088 - DNA, 25 bp, Homo sapien
aaaaccagcctgatcaacatggtga

SEQ ID NO: 40089 - DNA, 25 bp, Homo sapien
gcatggtagcaggcgcctgtaaccc

SEQ ID NO: 40090 - DNA, 25 bp, Homo sapien
tgtaaccccagctattcaggaggct

SEQ ID NO: 40091 - DNA, 25 bp, Homo sapien
atgccctgccaagcattgggtttat

SEQ ID NO: 40092 - DNA, 25 bp, Homo sapien
gccaagcattgggtttatttggttt

SEQ ID NO: 40093 - DNA, 25 bp, Homo sapien
tggttatctgatcaaatatttattt

SEQ ID NO: 40094 - DNA, 25 bp, Homo sapien
ttattttgtccttggtgcaattgtt

SEQ ID NO: 40095 - DNA, 25 bp, Homo sapien
tgcaattgttttctgtccttctaca

SEQ ID NO: 40096 - DNA, 25 bp, Homo sapien
tccttctacactcattcctatggtg

SEQ ID NO: 40097 - DNA, 25 bp, Homo sapien
cattcctatggtgttttcttgtcta

SEQ ID NO: 40098 - DNA, 25 bp, Homo sapien
ggtgttttcttgtctagtattttga

SEQ ID NO: 40099 - DNA, 25 bp, Homo sapien
gtattttgaatattgtttgtctata

SEQ ID NO: 40100 - DNA, 25 bp, Homo sapien
ttgtctataagaggcaaagtcgata

SEQ ID NO: 40101 - DNA, 25 bp, Homo sapien
ataaaaaggatggatgtaggctggg

SEQ ID NO: 40102 - DNA, 25 bp, Homo sapien
aatagcactcacttccaaaagattg

SEQ ID NO: 40103 - DNA, 25 bp, Homo sapien
atccacattgattttaactgctttg

SEQ ID NO: 40104 - DNA, 25 bp, Homo sapien
gctcccagccttctaataattttgc

SEQ ID NO: 40105 - DNA, 25 bp, Homo sapien
cttctaataattttgcctctgggaa

SEQ ID NO: 40106 - DNA, 25 bp, Homo sapien
ttgcctctgggaattttgtcaagat

SEQ ID NO: 40107 - DNA, 25 bp, Homo sapien
ttgtcaagatttacaggctgggcgt

SEQ ID NO: 40108 - DNA, 25 bp, Homo sapien
aaccgggcgtggtggcacacgccta

SEQ ID NO: 40109 - DNA, 25 bp, Homo sapien
tggtggcacacgcctaatagtccca

SEQ ID NO: 40110 - DNA, 25 bp, Homo sapien
gcctaatagtcccagctactttgga

SEQ ID NO: 40111 - DNA, 25 bp, Homo sapien
gctactttggaggctaaggcagaag

SEQ ID NO: 40112 - DNA, 25 bp, Homo sapien
ggcagaaggatcgcttaaacccggg

SEQ ID NO: 40113 - DNA, 25 bp, Homo sapien
agaacaactggctatcaaatactta

SEQ ID NO: 40114 - DNA, 25 bp, Homo sapien
tatctgctgtaacttcttgtatata

SEQ ID NO: 40115 - DNA, 25 bp, Homo sapien
tcagttggaaacagtagcactttga

SEQ ID NO: 40116 - DNA, 25 bp, Homo sapien
ccagctttaatttaatggccctact

SEQ ID NO: 40117 - DNA, 25 bp, Homo sapien
taatggccctactgatattcacatc

SEQ ID NO: 40118 - DNA, 25 bp, Homo sapien
ggtgactaacaatgacaaaggcctt

SEQ ID NO: 40119 - DNA, 25 bp, Homo sapien
atgacaaaggccttatgaactgtac

SEQ ID NO: 40120 - DNA, 25 bp, Homo sapien
tattcttatcctcattgcatttcta

SEQ ID NO: 40121 - DNA, 25 bp, Homo sapien
aaaatatctgtcaaaccatttctgt

SEQ ID NO: 40122 - DNA, 25 bp, Homo sapien
gaaggagcatagcatttagattacg

SEQ ID NO: 40123 - DNA, 25 bp, Homo sapien
tggcttcttttgatagtagtggaaa

SEQ ID NO: 40124 - DNA, 25 bp, Homo sapien
attaactcatgatcccattaactat

SEQ ID NO: 40125 - DNA, 25 bp, Homo sapien
ggtaatggttaggcttatttctctc

SEQ ID NO: 40126 - DNA, 25 bp, Homo sapien
gttaggcttatttctctctacattt

SEQ ID NO: 40127 - DNA, 25 bp, Homo sapien
ctctacatttttccctttgcgaagt

SEQ ID NO: 40128 - DNA, 25 bp, Homo sapien
ttccctttgcgaagtgtatttaaat

SEQ ID NO: 40129 - DNA, 25 bp, Homo sapien
attttgagctttatgactaatgatt

SEQ ID NO: 40130 - DNA, 25 bp, Homo sapien
gattattgtgtacattttgtcagta

SEQ ID NO: 40131 - DNA, 25 bp, Homo sapien
agttgctgcttttaatgatcattca

SEQ ID NO: 40132 - DNA, 25 bp, Homo sapien
gatcattcagtgttctgtcatatga

SEQ ID NO: 40133 - DNA, 25 bp, Homo sapien
acaggttatatttaggacagttagg

SEQ ID NO: 40134 - DNA, 25 bp, Homo sapien
agttaggttacatttcattattcat

SEQ ID NO: 40135 - DNA, 25 bp, Homo sapien
gacacagagtgctgattggtgcgtt

SEQ ID NO: 40136 - DNA, 25 bp, Homo sapien
tggtgcgtttacaatcctttagcta

SEQ ID NO: 40137 - DNA, 25 bp, Homo sapien
tagctagacagaaaagttccccaag

SEQ ID NO: 40138 - DNA, 25 bp, Homo sapien
caagcccagcaggcacttgctgagc

SEQ ID NO: 40139 - DNA, 25 bp, Homo sapien
ccacagcggcagctgcgagctgaag

SEQ ID NO: 40140 - DNA, 25 bp, Homo sapien
agctgaagggctccttgagcgtggc

SEQ ID NO: 40141 - DNA, 25 bp, Homo sapien
gagcgtggccagagtggacgccaat

SEQ ID NO: 40142 - DNA, 25 bp, Homo sapien
ggacgccaatgccaaagaggcaccg

SEQ ID NO: 40143 - DNA, 25 bp, Homo sapien
gaggcaccgagagtgagcgagggct

SEQ ID NO: 40144 - DNA, 25 bp, Homo sapien
agtgagcgagggctgctagcacgtt

SEQ ID NO: 40145 - DNA, 25 bp, Homo sapien
tgcagtgagccgagaccataccact

SEQ ID NO: 40146 - DNA, 25 bp, Homo sapien
gagaggcttgtaagtgcagcccacg

SEQ ID NO: 40147 - DNA, 25 bp, Homo sapien
gcagcccacgtgtgacttgagctgg

SEQ ID NO: 40148 - DNA, 25 bp, Homo sapien
gacttgagctgggaacgcaacttca

SEQ ID NO: 40149 - DNA, 25 bp, Homo sapien
acagcatttaacagcagctgcgtcc

SEQ ID NO: 40150 - DNA, 25 bp, Homo sapien
ctgcgtccaagtcgtgtggcatttg

SEQ ID NO: 40151 - DNA, 25 bp, Homo sapien
tggcagcgtgtttccaagtggacct

SEQ ID NO: 40152 - DNA, 25 bp, Homo sapien
ggacctgtggtaatcactttgctct

SEQ ID NO: 40153 - DNA, 25 bp, Homo sapien
cactttgctcttggggaaccgtggc

SEQ ID NO: 40154 - DNA, 25 bp, Homo sapien
ggctagaagtcctgtgggctggcca

SEQ ID NO: 40155 - DNA, 25 bp, Homo sapien
taatccctgcatttttgggtggcag

SEQ ID NO: 40156 - DNA, 25 bp, Homo sapien
tgggtggcagaggtgcgtggatcac

SEQ ID NO: 40157 - DNA, 25 bp, Homo sapien
atcactggaaagattcaacaaggcc

SEQ ID NO: 40158 - DNA, 25 bp, Homo sapien
tcactggaaagattcaacaaggcca

SEQ ID NO: 40159 - DNA, 25 bp, Homo sapien
ggaaagattcaacaaggccaggcat

SEQ ID NO: 40160 - DNA, 25 bp, Homo sapien
gaaagattcaacaaggccaggcatg

SEQ ID NO: 40161 - DNA, 25 bp, Homo sapien
aaagattcaacaaggccaggcatgg

SEQ ID NO: 40162 - DNA, 25 bp, Homo sapien
aagattcaacaaggccaggcatggt

SEQ ID NO: 40163 - DNA, 25 bp, Homo sapien
agattcaacaaggccaggcatggtg

SEQ ID NO: 40164 - DNA, 25 bp, Homo sapien
gattcaacaaggccaggcatggtgg

SEQ ID NO: 40165 - DNA, 25 bp, Homo sapien
gtcctggagtttgagatcagcctgg

SEQ ID NO: 40166 - DNA, 25 bp, Homo sapien
tcctggagtttgagatcagcctggg

SEQ ID NO: 40167 - DNA, 25 bp, Homo sapien
agaaaaaataggctggatgtggtga

SEQ ID NO: 40168 - DNA, 25 bp, Homo sapien
aaacaagcctggctggtattgccac

SEQ ID NO: 40169 - DNA, 25 bp, Homo sapien
attgccacccactggttgtagagcc

SEQ ID NO: 40170 - DNA, 25 bp, Homo sapien
cctcagcgccttgagcaaacacagg

SEQ ID NO: 40171 - DNA, 25 bp, Homo sapien
gagcaaacacaggtggtagccaggt

SEQ ID NO: 40172 - DNA, 25 bp, Homo sapien
gtggtagccaggtagtggttacagc

SEQ ID NO: 40173 - DNA, 25 bp, Homo sapien
gtggttacagcaggccttgggtaag

SEQ ID NO: 40174 - DNA, 25 bp, Homo sapien
gccttgggtaagacccactgctgtg

SEQ ID NO: 40175 - DNA, 25 bp, Homo sapien
tgctcacttcaggtctgacctggca

SEQ ID NO: 40176 - DNA, 25 bp, Homo sapien
ggtctgacctggcataatctcagtg

SEQ ID NO: 40177 - DNA, 25 bp, Homo sapien
agtgatggtggccaccagggtgctt

SEQ ID NO: 40178 - DNA, 25 bp, Homo sapien
gagagagacatgctgtttggagtaa

SEQ ID NO: 40179 - DNA, 25 bp, Homo sapien
agctcttgctgtgccatgatggtgt

SEQ ID NO: 40180 - DNA, 25 bp, Homo sapien
atgatggtgtagagtggcccctgtt

SEQ ID NO: 40181 - DNA, 25 bp, Homo sapien
gaggtccctgcgggatgggggacaa

SEQ ID NO: 40182 - DNA, 25 bp, Homo sapien
acaagctgtgtggacttagagtcag

SEQ ID NO: 40183 - DNA, 25 bp, Homo sapien
agtcctagctctatcacctaaaggc

SEQ ID NO: 40184 - DNA, 25 bp, Homo sapien
acctaaaggcacgttgtctctggac

SEQ ID NO: 40185 - DNA, 25 bp, Homo sapien
aagagagcctttgctctgtgatatg

SEQ ID NO: 40186 - DNA, 25 bp, Homo sapien
aaatgctagctgtgacactgaacct

SEQ ID NO: 40187 - DNA, 25 bp, Homo sapien
aaacagcaatgatgacacgaggtcg

SEQ ID NO: 40188 - DNA, 25 bp, Homo sapien
acacgaggtcgtcacaaggattaaa

SEQ ID NO: 40189 - DNA, 25 bp, Homo sapien
atactgaacctacatagcccagctc

SEQ ID NO: 40190 - DNA, 25 bp, Homo sapien
aaaagcacaaaatgtcctagttgat

SEQ ID NO: 40191 - DNA, 25 bp, Homo sapien
caaagcttaagtttagggtcacact

SEQ ID NO: 40192 - DNA, 25 bp, Homo sapien
tctcctatcttcttgacattttgtc

SEQ ID NO: 40193 - DNA, 25 bp, Homo sapien
acagagtagctttcattgctcctga

SEQ ID NO: 40194 - DNA, 25 bp, Homo sapien
aaggggaaaggcaccagtcagaaat

SEQ ID NO: 40195 - DNA, 25 bp, Homo sapien
atgatggaggatgggcgtagtggct

SEQ ID NO: 40196 - DNA, 25 bp, Homo sapien
gtagtggcttacacatgtaatccca

SEQ ID NO: 40197 - DNA, 25 bp, Homo sapien
ccatcccggccaacacggtgaaact

SEQ ID NO: 40198 - DNA, 25 bp, Homo sapien
gtgaaactccatctctaccaaaaat

SEQ ID NO: 40199 - DNA, 25 bp, Homo sapien
gaggccgaggcggaagaactacccg

SEQ ID NO: 40200 - DNA, 25 bp, Homo sapien
gcagcaagctgagatagcaccattg

SEQ ID NO: 40201 - DNA, 25 bp, Homo sapien
gacagctagctctagggttcttccc

SEQ ID NO: 40202 - DNA, 25 bp, Homo sapien
gggttcttccctcaggagatactta

SEQ ID NO: 40203 - DNA, 25 bp, Homo sapien
agaaaatcttctactaatggcctaa

SEQ ID NO: 40204 - DNA, 25 bp, Homo sapien
gagcagctatatgaatccaatggtt

SEQ ID NO: 40205 - DNA, 25 bp, Homo sapien
gagttgtgtctaggcctgttgaatg

SEQ ID NO: 40206 - DNA, 25 bp, Homo sapien
ttgaatgcactgctttgctctacct

SEQ ID NO: 40207 - DNA, 25 bp, Homo sapien
gaaagactttgcgttatccttgacc

SEQ ID NO: 40208 - DNA, 25 bp, Homo sapien
atccttgacctagcttgattttttt

SEQ ID NO: 40209 - DNA, 25 bp, Homo sapien
aggtactgcctctggatttgttcct

SEQ ID NO: 40210 - DNA, 25 bp, Homo sapien
tagagcgacagctccagtcagttgc

SEQ ID NO: 40211 - DNA, 25 bp, Homo sapien
gtaagcgtagatgtggctgggcgcg

SEQ ID NO: 40212 - DNA, 25 bp, Homo sapien
ctggggctcagacaacttcaggcct

SEQ ID NO: 40213 - DNA, 25 bp, Homo sapien
tgcgcccggccaaatgtgggtttta

SEQ ID NO: 40214 - DNA, 25 bp, Homo sapien
tgggaacgtggctgacccagcaatg

SEQ ID NO: 40215 - DNA, 25 bp, Homo sapien
gaattactatgtgagcccgaggggc

SEQ ID NO: 40216 - DNA, 25 bp, Homo sapien
gcccgaggggctctgttaggggcct

SEQ ID NO: 40217 - DNA, 25 bp, Homo sapien
gtgcctgtttccacatgggtggggg

SEQ ID NO: 40218 - DNA, 25 bp, Homo sapien
gtgggggagctgaggagcaccccag

SEQ ID NO: 40219 - DNA, 25 bp, Homo sapien
accccaggactcaactcacatggaa

SEQ ID NO: 40220 - DNA, 25 bp, Homo sapien
gaggcgtcgctgaaagatgcggtct

SEQ ID NO: 40221 - DNA, 25 bp, Homo sapien
agaatacagtgttccttttcatccc

SEQ ID NO: 40222 - DNA, 25 bp, Homo sapien
catcccatatttgactgaacctaag

SEQ ID NO: 40223 - DNA, 25 bp, Homo sapien
caactgagactcccccaagagagtt

SEQ ID NO: 40224 - DNA, 25 bp, Homo sapien
cccccaagagagtttcaaggcggca

SEQ ID NO: 40225 - DNA, 25 bp, Homo sapien
tcaaggcggcagaactgacctcact

SEQ ID NO: 40226 - DNA, 25 bp, Homo sapien
gaactgacctcactgtcggatgagg

SEQ ID NO: 40227 - DNA, 25 bp, Homo sapien
ctcactgtcggatgaggacagcggg

SEQ ID NO: 40228 - DNA, 25 bp, Homo sapien
ggacagcgggaaaggctcccagtcc

SEQ ID NO: 40229 - DNA, 25 bp, Homo sapien
gaggccaaggattcccagtttcaaa

SEQ ID NO: 40230 - DNA, 25 bp, Homo sapien
gtttcaaaaagccttcaactgccaa

SEQ ID NO: 40231 - DNA, 25 bp, Homo sapien
ccttcaactgccaatactgcaataa

SEQ ID NO: 40232 - DNA, 25 bp, Homo sapien
gcaataaggaatgcctcagcctggg

SEQ ID NO: 40233 - DNA, 25 bp, Homo sapien
cccacttggacgtcaagaagtacca

SEQ ID NO: 40234 - DNA, 25 bp, Homo sapien
gagaaattgtgatactgatgtggtt

SEQ ID NO: 40235 - DNA, 25 bp, Homo sapien
gatgtggttatgcatttcagtaaga

SEQ ID NO: 40236 - DNA, 25 bp, Homo sapien
attcaagacagttctcggaaatcta

SEQ ID NO: 40237 - DNA, 25 bp, Homo sapien
gacagttctcggaaatctaaattat

SEQ ID NO: 40238 - DNA, 25 bp, Homo sapien
atgtcacacagagcactatttctag

SEQ ID NO: 40239 - DNA, 25 bp, Homo sapien
agaattagtctgtgaaaatgtcttc

SEQ ID NO: 40240 - DNA, 25 bp, Homo sapien
gagtactagtacgatcccaaaataa

SEQ ID NO: 40241 - DNA, 25 bp, Homo sapien
aacggtaaactgaccagatctaatt

SEQ ID NO: 40242 - DNA, 25 bp, Homo sapien
gaggcagagctagctgggcatggtg

SEQ ID NO: 40243 - DNA, 25 bp, Homo sapien
ggaggtggaaggttgcagttagccg

SEQ ID NO: 40244 - DNA, 25 bp, Homo sapien
ggaaggttgcagttagccgagattg

SEQ ID NO: 40245 - DNA, 25 bp, Homo sapien
tgtgacctaggacatcattgccctc

SEQ ID NO: 40246 - DNA, 25 bp, Homo sapien
cctccctgaaactcagagccttatt

SEQ ID NO: 40247 - DNA, 25 bp, Homo sapien
aaactcagagccttatttgtgtatc

SEQ ID NO: 40248 - DNA, 25 bp, Homo sapien
gtgtatctgaaaacatgcactgtga

SEQ ID NO: 40249 - DNA, 25 bp, Homo sapien
catgcactgtgagagggtactgaga

SEQ ID NO: 40250 - DNA, 25 bp, Homo sapien
atgccttactgggcctgtcagagaa

SEQ ID NO: 40251 - DNA, 25 bp, Homo sapien
gggcctgtcagagaacgagcactca

SEQ ID NO: 40252 - DNA, 25 bp, Homo sapien
gagcactcaagcaaataccaacccc

SEQ ID NO: 40253 - DNA, 25 bp, Homo sapien
ggctgatgactgtcttgtactggcc

SEQ ID NO: 40254 - DNA, 25 bp, Homo sapien
ctgtcttgtactggcctagttgccc

SEQ ID NO: 40255 - DNA, 25 bp, Homo sapien
tggtaggggggaacgcggtgaggag

SEQ ID NO: 40256 - DNA, 25 bp, Homo sapien
ggatctacctctgcagtataggtgt

SEQ ID NO: 40257 - DNA, 25 bp, Homo sapien
ataggtgtaggtgaccccagaaggg

SEQ ID NO: 40258 - DNA, 25 bp, Homo sapien
tcaggggtacccttttatccttgag

SEQ ID NO: 40259 - DNA, 25 bp, Homo sapien
cccttttatccttgaggctgcagcc

SEQ ID NO: 40260 - DNA, 25 bp, Homo sapien
ggactgttcttactgagcactgatg

SEQ ID NO: 40261 - DNA, 25 bp, Homo sapien
gaagtgaaggagtgtgccacgccct

SEQ ID NO: 40262 - DNA, 25 bp, Homo sapien
gtgccacgccctgtaaaggcatgag

SEQ ID NO: 40263 - DNA, 25 bp, Homo sapien
aaggcatgagggataccgtggtgaa

SEQ ID NO: 40264 - DNA, 25 bp, Homo sapien
agtcatgacagacagggagcctgcc

SEQ ID NO: 40265 - DNA, 25 bp, Homo sapien
ggagcctgcccttaacaaaggtcac

SEQ ID NO: 40266 - DNA, 25 bp, Homo sapien
aggtcacaagctaggctgggcgtgg

SEQ ID NO: 40267 - DNA, 25 bp, Homo sapien
actgctgatgttttgggcaccaaac

SEQ ID NO: 40268 - DNA, 25 bp, Homo sapien
tgggcaccaaactggaacaaaacct

SEQ ID NO: 40269 - DNA, 25 bp, Homo sapien
tttaccactaagcatctgccggtta

SEQ ID NO: 40270 - DNA, 25 bp, Homo sapien
accactaagcatctgccggttaaaa

SEQ ID NO: 40271 - DNA, 25 bp, Homo sapien
ttaccttaagaatgtccatccatga

SEQ ID NO: 40272 - DNA, 25 bp, Homo sapien
aaatctcaatcctgaaattcttaag

SEQ ID NO: 40273 - DNA, 25 bp, Homo sapien
gatttctttttgatgttctgtgtga

SEQ ID NO: 40274 - DNA, 25 bp, Homo sapien
aagtattcctactacatatcaaagt

SEQ ID NO: 40275 - DNA, 25 bp, Homo sapien
agtgagaaactgtgcttgtgctatt

SEQ ID NO: 40276 - DNA, 25 bp, Homo sapien
ctgtgcttgtgctattgagttgcaa

SEQ ID NO: 40277 - DNA, 25 bp, Homo sapien
gagttgcaagttaaactagcctttt

SEQ ID NO: 40278 - DNA, 25 bp, Homo sapien
atgcaacaatgcttgaagttgtata

SEQ ID NO: 40279 - DNA, 25 bp, Homo sapien
gcaacaatgcttgaagttgtataca

SEQ ID NO: 40280 - DNA, 25 bp, Homo sapien
caatgcttgaagttgtatacagtct

SEQ ID NO: 40281 - DNA, 25 bp, Homo sapien
atgcttgaagttgtatacagtctgc

SEQ ID NO: 40282 - DNA, 25 bp, Homo sapien
gcttgaagttgtatacagtctgctc

SEQ ID NO: 40283 - DNA, 25 bp, Homo sapien
aagttgtatacagtctgctctttcc

SEQ ID NO: 40284 - DNA, 25 bp, Homo sapien
agttgtatacagtctgctctttcct

SEQ ID NO: 40285 - DNA, 25 bp, Homo sapien
gttgtatacagtctgctctttcctg

SEQ ID NO: 40286 - DNA, 25 bp, Homo sapien
aaagcagttgaagagatgaagggaa

SEQ ID NO: 40287 - DNA, 25 bp, Homo sapien
aagaaatgcaacaatgcttgaagtt

SEQ ID NO: 40288 - DNA, 25 bp, Homo sapien
gaaatgcaacaatgcttgaagttgt

SEQ ID NO: 40289 - DNA, 25 bp, Homo sapien
gggtatgaactgcatgaacaaagac

SEQ ID NO: 40290 - DNA, 25 bp, Homo sapien
tatgaactgcatgaacaaagaccat

SEQ ID NO: 40291 - DNA, 25 bp, Homo sapien
gaactgcatgaacaaagaccatggc

SEQ ID NO: 40292 - DNA, 25 bp, Homo sapien
gcatgaacaaagaccatggctgtgc

SEQ ID NO: 40293 - DNA, 25 bp, Homo sapien
catgaacaaagaccatggctgtgcc

SEQ ID NO: 40294 - DNA, 25 bp, Homo sapien
tgccgggagacgcccaaaggtgggg

SEQ ID NO: 40295 - DNA, 25 bp, Homo sapien
gagacgcccaaaggtggggtggcct

SEQ ID NO: 40296 - DNA, 25 bp, Homo sapien
agacgcccaaaggtggggtggcctg

SEQ ID NO: 40297 - DNA, 25 bp, Homo sapien
gacgcccaaaggtggggtggcctgc

SEQ ID NO: 40298 - DNA, 25 bp, Homo sapien
acgcccaaaggtggggtggcctgcg

SEQ ID NO: 40299 - DNA, 25 bp, Homo sapien
cgcccaaaggtggggtggcctgcga

SEQ ID NO: 40300 - DNA, 25 bp, Homo sapien
agcagattaaagtcctgataaccta

SEQ ID NO: 40301 - DNA, 25 bp, Homo sapien
aagatggcaaccctaaattacactg

SEQ ID NO: 40302 - DNA, 25 bp, Homo sapien
gaaacctgatctggcagtcttacta

SEQ ID NO: 40303 - DNA, 25 bp, Homo sapien
aatttcacccttgtgtatttctggg

SEQ ID NO: 40304 - DNA, 25 bp, Homo sapien
gtatttctgggagggtctagcactt

SEQ ID NO: 40305 - DNA, 25 bp, Homo sapien
gggagggtctagcacttctaaaaat

SEQ ID NO: 40306 - DNA, 25 bp, Homo sapien
tttgagatctttgcttccatcatca

SEQ ID NO: 40307 - DNA, 25 bp, Homo sapien
gaatcaggaatttgtgcttgtgtca

SEQ ID NO: 40308 - DNA, 25 bp, Homo sapien
aatttgtgcttgtgtcacccagttc

SEQ ID NO: 40309 - DNA, 25 bp, Homo sapien
tcttgtatacaaggagccatgataa

SEQ ID NO: 40310 - DNA, 25 bp, Homo sapien
aacaaagcttctaggccaggcatgg

SEQ ID NO: 40311 - DNA, 25 bp, Homo sapien
gaaataaccacatgtcagtctgcac

SEQ ID NO: 40312 - DNA, 25 bp, Homo sapien
gtcagtctgcacagaaatttgcagc

SEQ ID NO: 40313 - DNA, 25 bp, Homo sapien
aggcaaacatatattccctcttcag

SEQ ID NO: 40314 - DNA, 25 bp, Homo sapien
gcaaacatatattccctcttcagga

SEQ ID NO: 40315 - DNA, 25 bp, Homo sapien
attccctcttcaggaaatcaccttc

SEQ ID NO: 40316 - DNA, 25 bp, Homo sapien
cctcttcaggaaatcaccttcagcc

SEQ ID NO: 40317 - DNA, 25 bp, Homo sapien
ttcagccaggcatcaaataattctt

SEQ ID NO: 40318 - DNA, 25 bp, Homo sapien
ggcatcaaataattcttccagctaa

SEQ ID NO: 40319 - DNA, 25 bp, Homo sapien
caaataattcttccagctaaaattc

SEQ ID NO: 40320 - DNA, 25 bp, Homo sapien
gagaaaattattagatcctagcaac

SEQ ID NO: 40321 - DNA, 25 bp, Homo sapien
tagatcctagcaacaggtacctgta

SEQ ID NO: 40322 - DNA, 25 bp, Homo sapien
tatttacacgatttgtgactctgtc

SEQ ID NO: 40323 - DNA, 25 bp, Homo sapien
gtgactctgtcttttggactatcag

SEQ ID NO: 40324 - DNA, 25 bp, Homo sapien
ggactatcagtcgtcaaccatgatt

SEQ ID NO: 40325 - DNA, 25 bp, Homo sapien
ctatcagtcgtcaaccatgattttt

SEQ ID NO: 40326 - DNA, 25 bp, Homo sapien
tttttaattaagcttgactctctta

SEQ ID NO: 40327 - DNA, 25 bp, Homo sapien
agcttgactctcttaatttcagtct

SEQ ID NO: 40328 - DNA, 25 bp, Homo sapien
ttcagtctttctatctatgatcccc

SEQ ID NO: 40329 - DNA, 25 bp, Homo sapien
tctttctatctatgatcccccaaat

SEQ ID NO: 40330 - DNA, 25 bp, Homo sapien
ctatctatgatcccccaaattttga

SEQ ID NO: 40331 - DNA, 25 bp, Homo sapien
atgatcccccaaattttgatatact

SEQ ID NO: 40332 - DNA, 25 bp, Homo sapien
aaattattgatgtctgaggccaggc

SEQ ID NO: 40333 - DNA, 25 bp, Homo sapien
gcctggtcaacatgatgaaacccca

SEQ ID NO: 40334 - DNA, 25 bp, Homo sapien
ccccgctactcaggaggctaaggca

SEQ ID NO: 40335 - DNA, 25 bp, Homo sapien
gagctagagaaaaagcctcaatctt

SEQ ID NO: 40336 - DNA, 25 bp, Homo sapien
aatacctaagtaaccatgaacagac

SEQ ID NO: 40337 - DNA, 25 bp, Homo sapien
aatatgaggtaaagtccattctgat

SEQ ID NO: 40338 - DNA, 25 bp, Homo sapien
aaacaatccttgttacagagtggta

SEQ ID NO: 40339 - DNA, 25 bp, Homo sapien
cttgttgaactgtatttgtggtcta

SEQ ID NO: 40340 - DNA, 25 bp, Homo sapien
ttgtggtctaggattctgtggaaag

SEQ ID NO: 40341 - DNA, 25 bp, Homo sapien
gaaattgcatatttagctggagcta

SEQ ID NO: 40342 - DNA, 25 bp, Homo sapien
gctggagctatttctaagcaaagta

SEQ ID NO: 40343 - DNA, 25 bp, Homo sapien
ttaaaggtgcagcttggctcttcct

SEQ ID NO: 40344 - DNA, 25 bp, Homo sapien
ccccttcccttctcaaagcaagaag

SEQ ID NO: 40345 - DNA, 25 bp, Homo sapien
gcaagaagggagcgctgaggcatga

SEQ ID NO: 40346 - DNA, 25 bp, Homo sapien
agcgctgaggcatgaagccctgggg

SEQ ID NO: 40347 - DNA, 25 bp, Homo sapien
gaagccctggggaaactggcagtag

SEQ ID NO: 40348 - DNA, 25 bp, Homo sapien
gcaatgttgcaatcatggctcactg

SEQ ID NO: 40349 - DNA, 25 bp, Homo sapien
tcatggctcactgcagctttgaact

SEQ ID NO: 40350 - DNA, 25 bp, Homo sapien
cacaggccaccaaacctggctaatg

SEQ ID NO: 40351 - DNA, 25 bp, Homo sapien
ttatgtagagatggcggggggggcg

SEQ ID NO: 40352 - DNA, 25 bp, Homo sapien
cctgccccagcattccaaagtgctg

SEQ ID NO: 40353 - DNA, 25 bp, Homo sapien
tgcctggcctggccgtaggtttgta

SEQ ID NO: 40354 - DNA, 25 bp, Homo sapien
gtaggtttgtaactgtttcatagaa

SEQ ID NO: 40355 - DNA, 25 bp, Homo sapien
ggtgaacccaacagaaactagtata

SEQ ID NO: 40356 - DNA, 25 bp, Homo sapien
agtcagttgcgacccaaggggctta

SEQ ID NO: 40357 - DNA, 25 bp, Homo sapien
tgcgacccaaggggcttagggtagg

SEQ ID NO: 40358 - DNA, 25 bp, Homo sapien
ggcttagggtaggagtgtttctcca

SEQ ID NO: 40359 - DNA, 25 bp, Homo sapien
ggagtgtttctccataggggaagag

SEQ ID NO: 40360 - DNA, 25 bp, Homo sapien
ggggaagagtaacagcctgcaccca

SEQ ID NO: 40361 - DNA, 25 bp, Homo sapien
cacactgagacctcacttcatttgg

SEQ ID NO: 40362 - DNA, 25 bp, Homo sapien
gacctcacttcatttgggcgggtcc

SEQ ID NO: 40363 - DNA, 25 bp, Homo sapien
cctgtcccaaatactcaagtctctc

SEQ ID NO: 40364 - DNA, 25 bp, Homo sapien
aatactcaagtctctctcattaaaa

SEQ ID NO: 40365 - DNA, 25 bp, Homo sapien
catctgggcatggaggcacacgcct

SEQ ID NO: 40366 - DNA, 25 bp, Homo sapien
gcaggtggccagggaacttcgaggc

SEQ ID NO: 40367 - DNA, 25 bp, Homo sapien
aagtggagtccatttttcggtcctg

SEQ ID NO: 40368 - DNA, 25 bp, Homo sapien
agggctcctagcctgagaaagcttg

SEQ ID NO: 40369 - DNA, 25 bp, Homo sapien
gcctgagaaagcttgacctgtgggt

SEQ ID NO: 40370 - DNA, 25 bp, Homo sapien
gacctgtgggtcagtgaagcccttg

SEQ ID NO: 40371 - DNA, 25 bp, Homo sapien
gtcagtgaagcccttgcttgagcca

SEQ ID NO: 40372 - DNA, 25 bp, Homo sapien
gagagttaggacctctgattctcaa

SEQ ID NO: 40373 - DNA, 25 bp, Homo sapien
ctccgctcacacaattgcagtcaag

SEQ ID NO: 40374 - DNA, 25 bp, Homo sapien
gactagaggtttcagtccctactgc

SEQ ID NO: 40375 - DNA, 25 bp, Homo sapien
ctgcacttccagcaatggactggga

SEQ ID NO: 40376 - DNA, 25 bp, Homo sapien
actgggaaaatcaggctcaagtcat

SEQ ID NO: 40377 - DNA, 25 bp, Homo sapien
gggccaccaagggggtggcctgcag

SEQ ID NO: 40378 - DNA, 25 bp, Homo sapien
ccccttcacggagaaaccttgctca

SEQ ID NO: 40379 - DNA, 25 bp, Homo sapien
aaccttgctcagaattcctgcgggt

SEQ ID NO: 40380 - DNA, 25 bp, Homo sapien
cttttcgcctttggggcattctgga

SEQ ID NO: 40381 - DNA, 25 bp, Homo sapien
ctttggggcattctggactcagctt

SEQ ID NO: 40382 - DNA, 25 bp, Homo sapien
cctgctgtgtgtagtgggagatctc

SEQ ID NO: 40383 - DNA, 25 bp, Homo sapien
tgtagtgggagatctctctgtgcct

SEQ ID NO: 40384 - DNA, 25 bp, Homo sapien
agggagctcaggctgagccaggcac

SEQ ID NO: 40385 - DNA, 25 bp, Homo sapien
caggcactgcaggggagctgggaaa

SEQ ID NO: 40386 - DNA, 25 bp, Homo sapien
gggcaaggaaacccttctatggcca

SEQ ID NO: 40387 - DNA, 25 bp, Homo sapien
aaacccttctatggccaggagtggt

SEQ ID NO: 40388 - DNA, 25 bp, Homo sapien
gattccgtttgtataaaatatccag

SEQ ID NO: 40389 - DNA, 25 bp, Homo sapien
gacaaaacacttagtggttgcttag

SEQ ID NO: 40390 - DNA, 25 bp, Homo sapien
tggttgcttaggggtgggggttcag

SEQ ID NO: 40391 - DNA, 25 bp, Homo sapien
gggtgggggttcaggagaatggtag

SEQ ID NO: 40392 - DNA, 25 bp, Homo sapien
ggagaatggtagtgtctgctaatgg

SEQ ID NO: 40393 - DNA, 25 bp, Homo sapien
gtagtgtctgctaatggggatgggg

SEQ ID NO: 40394 - DNA, 25 bp, Homo sapien
tgctagaaagcatcgaattgtacac

SEQ ID NO: 40395 - DNA, 25 bp, Homo sapien
gaatgaagtgtatggtatgtgagtt

SEQ ID NO: 40396 - DNA, 25 bp, Homo sapien
aacaaatacaatggaccaggcatgg

SEQ ID NO: 40397 - DNA, 25 bp, Homo sapien
aatgcaggagggttggctggacttg

SEQ ID NO: 40398 - DNA, 25 bp, Homo sapien
caggagggttggctggacttggtgg

SEQ ID NO: 40399 - DNA, 25 bp, Homo sapien
acagggctgcggcatgaacccctgt

SEQ ID NO: 40400 - DNA, 25 bp, Homo sapien
gcggcatgaacccctgtagggttag

SEQ ID NO: 40401 - DNA, 25 bp, Homo sapien
gtagggttagtttatgagtgcgtag

SEQ ID NO: 40402 - DNA, 25 bp, Homo sapien
gagtgcgtagggaagtgctccccag

SEQ ID NO: 40403 - DNA, 25 bp, Homo sapien
gtagggaagtgctccccagaaagca

SEQ ID NO: 40404 - DNA, 25 bp, Homo sapien
gcaggagaaacacggatggccagat

SEQ ID NO: 40405 - DNA, 25 bp, Homo sapien
tggccagatacacgtttgagcctct

SEQ ID NO: 40406 - DNA, 25 bp, Homo sapien
cgtttgagcctctgacaactacagt

SEQ ID NO: 40407 - DNA, 25 bp, Homo sapien
ctacagtcactgtgtactaactagt

SEQ ID NO: 40408 - DNA, 25 bp, Homo sapien
actagtggtgaggttggcaatttgt

SEQ ID NO: 40409 - DNA, 25 bp, Homo sapien
cagaagaatccttgaacccgtgagg

SEQ ID NO: 40410 - DNA, 25 bp, Homo sapien
ttcttgtctcttgtcccaaagattt

SEQ ID NO: 40411 - DNA, 25 bp, Homo sapien
ctgccccattttgacttctgagatg

SEQ ID NO: 40412 - DNA, 25 bp, Homo sapien
caaacctttagctcactaactttat

SEQ ID NO: 40413 - DNA, 25 bp, Homo sapien
gctcactaactttatgggtttctga

SEQ ID NO: 40414 - DNA, 25 bp, Homo sapien
gatgttaatgtgatcttttcctgac

SEQ ID NO: 40415 - DNA, 25 bp, Homo sapien
gtgatcttttcctgacagattatga

SEQ ID NO: 40416 - DNA, 25 bp, Homo sapien
gaaagcattatgacttgtaacaagt

SEQ ID NO: 40417 - DNA, 25 bp, Homo sapien
gacttgtaacaagtttccttgtata

SEQ ID NO: 40418 - DNA, 25 bp, Homo sapien
aatattagtgtgttttgcctacatg

SEQ ID NO: 40419 - DNA, 25 bp, Homo sapien
gtgtgttttgcctacatggtgtatt

SEQ ID NO: 40420 - DNA, 25 bp, Homo sapien
tgtgtacagatgaaacatttttgtc

SEQ ID NO: 40421 - DNA, 25 bp, Homo sapien
ccttgctgccatgcgaagaaggatg

SEQ ID NO: 40422 - DNA, 25 bp, Homo sapien
ccccagccatgttaaactttgagtt

SEQ ID NO: 40423 - DNA, 25 bp, Homo sapien
tctctgggactacctgtcaactcag

SEQ ID NO: 40424 - DNA, 25 bp, Homo sapien
acctgtcaactcagcaggtgcagcc

SEQ ID NO: 40425 - DNA, 25 bp, Homo sapien
tgccctcccagtaggctgggctatc

SEQ ID NO: 40426 - DNA, 25 bp, Homo sapien
ggctatcagttcctgggaggggtcc

SEQ ID NO: 40427 - DNA, 25 bp, Homo sapien
gggtcctgtccccatgtaaggggat

SEQ ID NO: 40428 - DNA, 25 bp, Homo sapien
tgctgagtacgctgatatctttttc

SEQ ID NO: 40429 - DNA, 25 bp, Homo sapien
gaaagctaaatggttctcgtgtaac

SEQ ID NO: 40430 - DNA, 25 bp, Homo sapien
atggttctcgtgtaacgtaactgat

SEQ ID NO: 40431 - DNA, 25 bp, Homo sapien
aatcttatcttgaactgcagctccc

SEQ ID NO: 40432 - DNA, 25 bp, Homo sapien
ggaagaaataggccgggcgcggtgg

SEQ ID NO: 40433 - DNA, 25 bp, Homo sapien
aacaaaatgacaaaccttcagacca

SEQ ID NO: 40434 - DNA, 25 bp, Homo sapien
acaaaccttcagaccagccaagaaa

SEQ ID NO: 40435 - DNA, 25 bp, Homo sapien
aaggctgaaatttctgaaagcaagc

SEQ ID NO: 40436 - DNA, 25 bp, Homo sapien
gagactattatgagtaactatgtgc

SEQ ID NO: 40437 - DNA, 25 bp, Homo sapien
aactatgtgctaatacctgaggtaa

SEQ ID NO: 40438 - DNA, 25 bp, Homo sapien
acctgaggtaacttagatgaaattg

SEQ ID NO: 40439 - DNA, 25 bp, Homo sapien
gaaattgacagattgctagaaagac

SEQ ID NO: 40440 - DNA, 25 bp, Homo sapien
gacataaactaccacttctaatcag

SEQ ID NO: 40441 - DNA, 25 bp, Homo sapien
actaccacttctaatcagtgttata

SEQ ID NO: 40442 - DNA, 25 bp, Homo sapien
tagttgagattctatccagggcaat

SEQ ID NO: 40443 - DNA, 25 bp, Homo sapien
ttttttgggacagggtctctcgctc

SEQ ID NO: 40444 - DNA, 25 bp, Homo sapien
tgagctcaaaagttcttcccacctc

SEQ ID NO: 40445 - DNA, 25 bp, Homo sapien
taccaccacacttggctacttttta

SEQ ID NO: 40446 - DNA, 25 bp, Homo sapien
atatggtttggttctgtatccccac

SEQ ID NO: 40447 - DNA, 25 bp, Homo sapien
atcctcaggtatcaagggtgggacc

SEQ ID NO: 40448 - DNA, 25 bp, Homo sapien
gagtcctcatgagatgtgatggttt

SEQ ID NO: 40449 - DNA, 25 bp, Homo sapien
tctcctgccaccctgtgaagaggtg

SEQ ID NO: 40450 - DNA, 25 bp, Homo sapien
gaagaggtgccttccaccatgatta

SEQ ID NO: 40451 - DNA, 25 bp, Homo sapien
ttataagtttcctcaggccttctca

SEQ ID NO: 40452 - DNA, 25 bp, Homo sapien
ttctttacaaattactcagtctcgg

SEQ ID NO: 40453 - DNA, 25 bp, Homo sapien
agtctcgggtatttcttcatagcac

SEQ ID NO: 40454 - DNA, 25 bp, Homo sapien
aaagattccatgtccatctggtttt

SEQ ID NO: 40455 - DNA, 25 bp, Homo sapien
ccatgtccatctggtttttattact

SEQ ID NO: 40456 - DNA, 25 bp, Homo sapien
atagcagaagctgttggtgtcccgg

SEQ ID NO: 40457 - DNA, 25 bp, Homo sapien
tcccttggtctgccacagaggtcac

SEQ ID NO: 40458 - DNA, 25 bp, Homo sapien
agaggtcactcccagaatacactta

SEQ ID NO: 40459 - DNA, 25 bp, Homo sapien
aatacacttaggactccctgtgtct

SEQ ID NO: 40460 - DNA, 25 bp, Homo sapien
tgtctccttctgagggtgacctgag

SEQ ID NO: 40461 - DNA, 25 bp, Homo sapien
gtgacctgagccacgatgttatggg

SEQ ID NO: 40462 - DNA, 25 bp, Homo sapien
atggaggctaacacctggtaggccc

SEQ ID NO: 40463 - DNA, 25 bp, Homo sapien
ctggtaggccccacatttttgacaa

SEQ ID NO: 40464 - DNA, 25 bp, Homo sapien
ctcataggtatggccacacgtggtg

SEQ ID NO: 40465 - DNA, 25 bp, Homo sapien
agttctccaaatatccacatgtcct

SEQ ID NO: 40466 - DNA, 25 bp, Homo sapien
ccaaatatccacatgtcctcttata

SEQ ID NO: 40467 - DNA, 25 bp, Homo sapien
gtcctcttatattttggggcttctc

SEQ ID NO: 40468 - DNA, 25 bp, Homo sapien
ttggggcttctctttgcaattagat

SEQ ID NO: 40469 - DNA, 25 bp, Homo sapien
tgcaattagattgagcccatgtgac

SEQ ID NO: 40470 - DNA, 25 bp, Homo sapien
gagcccatgtgactactggacaata

SEQ ID NO: 40471 - DNA, 25 bp, Homo sapien
gacatttttggaaccacttccagac

SEQ ID NO: 40472 - DNA, 25 bp, Homo sapien
tggttaaaagctgttgtgccctcct

SEQ ID NO: 40473 - DNA, 25 bp, Homo sapien
gttgcattgttcttggaaactaggt

SEQ ID NO: 40474 - DNA, 25 bp, Homo sapien
gaaactaggtattacagatggttgt

SEQ ID NO: 40475 - DNA, 25 bp, Homo sapien
agaattcttattggacttgacatga

SEQ ID NO: 40476 - DNA, 25 bp, Homo sapien
ggccttcataactacattactttgc

SEQ ID NO: 40477 - DNA, 25 bp, Homo sapien
aaagcattgcaattgtgtgtttcac

SEQ ID NO: 40478 - DNA, 25 bp, Homo sapien
gaaagcactcaggcctagacttttg

SEQ ID NO: 40479 - DNA, 25 bp, Homo sapien
gacttttggagacccagatttctct

SEQ ID NO: 40480 - DNA, 25 bp, Homo sapien
gtttggatctttagttttaggcagc

SEQ ID NO: 40481 - DNA, 25 bp, Homo sapien
atactgccaaggcaatttctcccac

SEQ ID NO: 40482 - DNA, 25 bp, Homo sapien
atttctcccactgcatattgtttaa

SEQ ID NO: 40483 - DNA, 25 bp, Homo sapien
tgtactgtatttccaaactcccaag

SEQ ID NO: 40484 - DNA, 25 bp, Homo sapien
ttccaaactcccaagcttttaaatg

SEQ ID NO: 40485 - DNA, 25 bp, Homo sapien
actatcacgttaggttgggcacagt

SEQ ID NO: 40486 - DNA, 25 bp, Homo sapien
gggcacagtgcatcacgactgtaat

SEQ ID NO: 40487 - DNA, 25 bp, Homo sapien
ttctagggctctatgacccagtctc

SEQ ID NO: 40488 - DNA, 25 bp, Homo sapien
ctctatgacccagtctctgttgaaa

SEQ ID NO: 40489 - DNA, 25 bp, Homo sapien
gacccagtctctgttgaaacacgaa

SEQ ID NO: 40490 - DNA, 25 bp, Homo sapien
gaaacacgaaggaatcaatgaggaa

SEQ ID NO: 40491 - DNA, 25 bp, Homo sapien
aatagttatagtatttctcccaata

SEQ ID NO: 40492 - DNA, 25 bp, Homo sapien
gttatagtatttctcccaataaagg

SEQ ID NO: 40493 - DNA, 25 bp, Homo sapien
agagaaattttgagctttaagcgtg

SEQ ID NO: 40494 - DNA, 25 bp, Homo sapien
tttgagctttaagcgtgtggtggca

SEQ ID NO: 40495 - DNA, 25 bp, Homo sapien
gtggcatcttggtttgaggtggagt

SEQ ID NO: 40496 - DNA, 25 bp, Homo sapien
gaggtggagtaattagttgtgaaaa

SEQ ID NO: 40497 - DNA, 25 bp, Homo sapien
gaataaggaatggacaggcgcagtg

SEQ ID NO: 40498 - DNA, 25 bp, Homo sapien
aatgcacctttcacagtgcgcaaga

SEQ ID NO: 40499 - DNA, 25 bp, Homo sapien
gtgcgcaagaagggcattatttccc

SEQ ID NO: 40500 - DNA, 25 bp, Homo sapien
acaagtgattccccgattatgatct

SEQ ID NO: 40501 - DNA, 25 bp, Homo sapien
catattattatgcctccctaagtgc

SEQ ID NO: 40502 - DNA, 25 bp, Homo sapien
gcctcatggcattgtagcaggtaaa

SEQ ID NO: 40503 - DNA, 25 bp, Homo sapien
agcaggtaaactttcatgtgggcag

SEQ ID NO: 40504 - DNA, 25 bp, Homo sapien
atgtatacattatcagtactcctgt

SEQ ID NO: 40505 - DNA, 25 bp, Homo sapien
gtactcctgtggatgtgtttttatg

SEQ ID NO: 40506 - DNA, 25 bp, Homo sapien
atggctaattctaatacagctttta

SEQ ID NO: 40507 - DNA, 25 bp, Homo sapien
taggggtctgcaatctattcttaaa

SEQ ID NO: 40508 - DNA, 25 bp, Homo sapien
gactagccagagcaatattgagacc

SEQ ID NO: 40509 - DNA, 25 bp, Homo sapien
aaaaatgagttagctaccaatataa

SEQ ID NO: 40510 - DNA, 25 bp, Homo sapien
tagctaccaatataaagatttttca

SEQ ID NO: 40511 - DNA, 25 bp, Homo sapien
gatttttcaaaatcctaagactgat

SEQ ID NO: 40512 - DNA, 25 bp, Homo sapien
gactgattcatacctatctttgggc

SEQ ID NO: 40513 - DNA, 25 bp, Homo sapien
gattcatacctatctttgggcaata

SEQ ID NO: 40514 - DNA, 25 bp, Homo sapien
gaaagattatgtaataccctaaaat

SEQ ID NO: 40515 - DNA, 25 bp, Homo sapien
atgtaataccctaaaatttgagagt

SEQ ID NO: 40516 - DNA, 25 bp, Homo sapien
aagattgcagattacctaaaaatgg

SEQ ID NO: 40517 - DNA, 25 bp, Homo sapien
aaatccttcttataatgaaacagta

SEQ ID NO: 40518 - DNA, 25 bp, Homo sapien
tattttactggttaagtcaaacttg

SEQ ID NO: 40519 - DNA, 25 bp, Homo sapien
tacaccaggacaaatgaattgtgca

SEQ ID NO: 40520 - DNA, 25 bp, Homo sapien
aggctgaggcacaagaatcaataga

SEQ ID NO: 40521 - DNA, 25 bp, Homo sapien
aagaatcaatagaacccaggaggtg

SEQ ID NO: 40522 - DNA, 25 bp, Homo sapien
tactgtactctagcctgggcagcag

SEQ ID NO: 40523 - DNA, 25 bp, Homo sapien
actctagcctgggcagcagagtgag

SEQ ID NO: 40524 - DNA, 25 bp, Homo sapien
ggtcagtacctggagaatttgaatg

SEQ ID NO: 40525 - DNA, 25 bp, Homo sapien
gccaacatggtgaaagccccattct

SEQ ID NO: 40526 - DNA, 25 bp, Homo sapien
tgaaagccccattctctactaaaaa

SEQ ID NO: 40527 - DNA, 25 bp, Homo sapien
atataaaaatcagcgggccatggtg

SEQ ID NO: 40528 - DNA, 25 bp, Homo sapien
atcagcgggccatggtggcatgtgc

SEQ ID NO: 40529 - DNA, 25 bp, Homo sapien
gtaatccccagctactcaaggagtc

SEQ ID NO: 40530 - DNA, 25 bp, Homo sapien
atccccagctactcaaggagtctga

SEQ ID NO: 40531 - DNA, 25 bp, Homo sapien
tcagttgggccttctatcagcaagt

SEQ ID NO: 40532 - DNA, 25 bp, Homo sapien
agcaagtatataatgagcacctgtt

SEQ ID NO: 40533 - DNA, 25 bp, Homo sapien
tgagcacctgttacttgccaggcac

SEQ ID NO: 40534 - DNA, 25 bp, Homo sapien
acctgttacttgccaggcactgcta

SEQ ID NO: 40535 - DNA, 25 bp, Homo sapien
ggcactgctaggtcttgcgagatac

SEQ ID NO: 40536 - DNA, 25 bp, Homo sapien
aggtcttgcgagatacaaagttgta

SEQ ID NO: 40537 - DNA, 25 bp, Homo sapien
gggacaaccaaatgttttaactgtg

SEQ ID NO: 40538 - DNA, 25 bp, Homo sapien
tgagtagagtaatagttggcttttt

SEQ ID NO: 40539 - DNA, 25 bp, Homo sapien
caccactccgagctatttttttgtt

SEQ ID NO: 40540 - DNA, 25 bp, Homo sapien
taaatggatcgttattcactttgta

SEQ ID NO: 40541 - DNA, 25 bp, Homo sapien
ttattcactttgtaaattctggtca

SEQ ID NO: 40542 - DNA, 25 bp, Homo sapien
aaagattacctatcgttctacaata

SEQ ID NO: 40543 - DNA, 25 bp, Homo sapien
gtaagagtcaatgattctgttcgac

SEQ ID NO: 40544 - DNA, 25 bp, Homo sapien
gttcgactaaatagctgtcctttcc

SEQ ID NO: 40545 - DNA, 25 bp, Homo sapien
actaaatagctgtcctttccaacac

SEQ ID NO: 40546 - DNA, 25 bp, Homo sapien
tgtatcataagttcagcctgtcata

SEQ ID NO: 40547 - DNA, 25 bp, Homo sapien
cataagttcagcctgtcatactttt

SEQ ID NO: 40548 - DNA, 25 bp, Homo sapien
gaataccagaccatttgtaagtgtg

SEQ ID NO: 40549 - DNA, 25 bp, Homo sapien
aaaatgctaattgacatctctagta

SEQ ID NO: 40550 - DNA, 25 bp, Homo sapien
actgttacaggattcatgaacttga

SEQ ID NO: 40551 - DNA, 25 bp, Homo sapien
gaataattctacagtttgaaactct

SEQ ID NO: 40552 - DNA, 25 bp, Homo sapien
ttgaaactctgatgctatatataca

SEQ ID NO: 40553 - DNA, 25 bp, Homo sapien
accagaaccaggcaaaggaggctca

SEQ ID NO: 40554 - DNA, 25 bp, Homo sapien
ggcccttgctatggtgtaaatgctt

SEQ ID NO: 40555 - DNA, 25 bp, Homo sapien
ctatggtgtaaatgcttaggccccc

SEQ ID NO: 40556 - DNA, 25 bp, Homo sapien
cttaggcccccctagaattcatatg

SEQ ID NO: 40557 - DNA, 25 bp, Homo sapien
attcatatgctgacatcctaacccc

SEQ ID NO: 40558 - DNA, 25 bp, Homo sapien
ggtggggccttgggaggcaattagg

SEQ ID NO: 40559 - DNA, 25 bp, Homo sapien
gggaggcaattaggtcagacaacag

SEQ ID NO: 40560 - DNA, 25 bp, Homo sapien
gcaattaggtcagacaacagagccc

SEQ ID NO: 40561 - DNA, 25 bp, Homo sapien
acccacagaatcaccacactgaagc

SEQ ID NO: 40562 - DNA, 25 bp, Homo sapien
atcaccacactgaagccttctcagt

SEQ ID NO: 40563 - DNA, 25 bp, Homo sapien
cacactgaagccttctcagtggaaa

SEQ ID NO: 40564 - DNA, 25 bp, Homo sapien
ccctttgccacaggataccttgtaa

SEQ ID NO: 40565 - DNA, 25 bp, Homo sapien
gtaaagttcctgccccagtataggg

SEQ ID NO: 40566 - DNA, 25 bp, Homo sapien
gagacagggttgcccagggtggagt

SEQ ID NO: 40567 - DNA, 25 bp, Homo sapien
ggtggagtgcagtggcaggatcaca

SEQ ID NO: 40568 - DNA, 25 bp, Homo sapien
caggatcacagcttactgcagcctt

SEQ ID NO: 40569 - DNA, 25 bp, Homo sapien
aggctcaggtcccatctgagcctcc

SEQ ID NO: 40570 - DNA, 25 bp, Homo sapien
agctggggctacaggtgtgtgccac

SEQ ID NO: 40571 - DNA, 25 bp, Homo sapien
ccaccctgccagctaattttttata

SEQ ID NO: 40572 - DNA, 25 bp, Homo sapien
tatttttttttcccatgttgctcat

SEQ ID NO: 40573 - DNA, 25 bp, Homo sapien
atgttgctcatgctggtctcaaact

SEQ ID NO: 40574 - DNA, 25 bp, Homo sapien
ggagaatctctagatcccgggagtt

SEQ ID NO: 40575 - DNA, 25 bp, Homo sapien
tgtagtttctctaaaaattccactt

SEQ ID NO: 40576 - DNA, 25 bp, Homo sapien
atttttggaagactgctatgtatta

SEQ ID NO: 40577 - DNA, 25 bp, Homo sapien
agggtgtcttcctgtatttgaacca

SEQ ID NO: 40578 - DNA, 25 bp, Homo sapien
gtcttcctgtatttgaaccaaccaa

SEQ ID NO: 40579 - DNA, 25 bp, Homo sapien
accaaccaaaaacacacatctgaac

SEQ ID NO: 40580 - DNA, 25 bp, Homo sapien
aacacacatctgaactgtcagctaa

SEQ ID NO: 40581 - DNA, 25 bp, Homo sapien
gaactgtcagctaaggggtaggctt

SEQ ID NO: 40582 - DNA, 25 bp, Homo sapien
aggggtaggcttggtgttatgatca

SEQ ID NO: 40583 - DNA, 25 bp, Homo sapien
attagaggagtcttgcttctagaac

SEQ ID NO: 40584 - DNA, 25 bp, Homo sapien
tgcttctagaacaatacccactaga

SEQ ID NO: 40585 - DNA, 25 bp, Homo sapien
tccaagtctttttttagaactgttg

SEQ ID NO: 40586 - DNA, 25 bp, Homo sapien
aatggggttctttatagaatgtgga

SEQ ID NO: 40587 - DNA, 25 bp, Homo sapien
gtggatttttcctacaagagacttt

SEQ ID NO: 40588 - DNA, 25 bp, Homo sapien
gcagggcaatttcaaggtatggcaa

SEQ ID NO: 40589 - DNA, 25 bp, Homo sapien
attttgattttcttcttgttatgcc

SEQ ID NO: 40590 - DNA, 25 bp, Homo sapien
ttcttcttgttatgccagagtctga

SEQ ID NO: 40591 - DNA, 25 bp, Homo sapien
aagtaagtcttgatatacagggtta

SEQ ID NO: 40592 - DNA, 25 bp, Homo sapien
tgtagggcataactccctaagcccc

SEQ ID NO: 40593 - DNA, 25 bp, Homo sapien
taactccctaagccccttagatagg

SEQ ID NO: 40594 - DNA, 25 bp, Homo sapien
aaaaattagagcttaggccaggcac

SEQ ID NO: 40595 - DNA, 25 bp, Homo sapien
aggcatggaagtgcctgcctgtagt

SEQ ID NO: 40596 - DNA, 25 bp, Homo sapien
gggcaacagagcaaaattccgtctc

SEQ ID NO: 40597 - DNA, 25 bp, Homo sapien
acatgacaagaccctgtctcgacaa

SEQ ID NO: 40598 - DNA, 25 bp, Homo sapien
acttagccagacatggtgacacacg

SEQ ID NO: 40599 - DNA, 25 bp, Homo sapien
gtgacacacgtttatggtcccagct

SEQ ID NO: 40600 - DNA, 25 bp, Homo sapien
tcaaggtcggcccaggaggtcaaga

SEQ ID NO: 40601 - DNA, 25 bp, Homo sapien
aggaggtcaagacccaggcgatcaa

SEQ ID NO: 40602 - DNA, 25 bp, Homo sapien
aggcgatcaaggcccaggaggtcaa

SEQ ID NO: 40603 - DNA, 25 bp, Homo sapien
gtcaagactgcagtgagctgtgctc

SEQ ID NO: 40604 - DNA, 25 bp, Homo sapien
cagcccagtcatcagagcaaaacct

SEQ ID NO: 40605 - DNA, 25 bp, Homo sapien
agagtaaatcatggccggacgcggt

SEQ ID NO: 40606 - DNA, 25 bp, Homo sapien
ggtgctgggcctgtagcccagctac

SEQ ID NO: 40607 - DNA, 25 bp, Homo sapien
ttgcagtgagctgacatcgtgccac

SEQ ID NO: 40608 - DNA, 25 bp, Homo sapien
tggggtccataaaccaaaccaggag

SEQ ID NO: 40609 - DNA, 25 bp, Homo sapien
gagtgggcagaaatctgacagctct

SEQ ID NO: 40610 - DNA, 25 bp, Homo sapien
atctgacagctcttaggtttcttct

SEQ ID NO: 40611 - DNA, 25 bp, Homo sapien
ggtttcttctatttgtgttaatact

SEQ ID NO: 40612 - DNA, 25 bp, Homo sapien
tagtgggaagacattcatcaaagta

SEQ ID NO: 40613 - DNA, 25 bp, Homo sapien
gaagtagttaatttgggccaggtgc

SEQ ID NO: 40614 - DNA, 25 bp, Homo sapien
ctactggggcggctgaggcacaaga

SEQ ID NO: 40615 - DNA, 25 bp, Homo sapien
ggcggaggctgcaatcagtcaagat

SEQ ID NO: 40616 - DNA, 25 bp, Homo sapien
ggctgcaatcagtcaagatcgcgcc

SEQ ID NO: 40617 - DNA, 25 bp, Homo sapien
ttttcacccaacatcttgttgcatc

SEQ ID NO: 40618 - DNA, 25 bp, Homo sapien
ccaacatcttgttgcatcttccaga

SEQ ID NO: 40619 - DNA, 25 bp, Homo sapien
caggctttgagagtgccctcaacct

SEQ ID NO: 40620 - DNA, 25 bp, Homo sapien
gtttagcctccctgtagatctggct

SEQ ID NO: 40621 - DNA, 25 bp, Homo sapien
cctgtagatctggctgtgcgccagc

SEQ ID NO: 40622 - DNA, 25 bp, Homo sapien
gtgcgccagctcaaaaacatcaaag

SEQ ID NO: 40623 - DNA, 25 bp, Homo sapien
tgccttttgatgagagtgccctaac

SEQ ID NO: 40624 - DNA, 25 bp, Homo sapien
cttttgatgagagtgccctaacccc

SEQ ID NO: 40625 - DNA, 25 bp, Homo sapien
gacaagctccttgttcagtagggat

SEQ ID NO: 40626 - DNA, 25 bp, Homo sapien
gtagggatagatgtgctagtcttct

SEQ ID NO: 40627 - DNA, 25 bp, Homo sapien
ctagtcttctagcataggagcaagg

SEQ ID NO: 40628 - DNA, 25 bp, Homo sapien
atcagaggtggggttaaaggcattt

SEQ ID NO: 40629 - DNA, 25 bp, Homo sapien
ttagctctcggaaagatgtgctgga

SEQ ID NO: 40630 - DNA, 25 bp, Homo sapien
gtatgagagatatgttgccctacac

SEQ ID NO: 40631 - DNA, 25 bp, Homo sapien
tatgttgccctacacttaggccact

SEQ ID NO: 40632 - DNA, 25 bp, Homo sapien
cattcccgcttaagtgccaggattg

SEQ ID NO: 40633 - DNA, 25 bp, Homo sapien
ccgcttaagtgccaggattgtgtca

SEQ ID NO: 40634 - DNA, 25 bp, Homo sapien
gattgtgtcagcaacaggatggcct

SEQ ID NO: 40635 - DNA, 25 bp, Homo sapien
aggatggcctaaacaatctcagtct

SEQ ID NO: 40636 - DNA, 25 bp, Homo sapien
aaacaatctcagtcttgtctcctgc

SEQ ID NO: 40637 - DNA, 25 bp, Homo sapien
ccccctaaatcttccagaattgcaa

SEQ ID NO: 40638 - DNA, 25 bp, Homo sapien
gaattgcaagaataggccaggtgtg

SEQ ID NO: 40639 - DNA, 25 bp, Homo sapien
tgccggtaatctcagtttcttggga

SEQ ID NO: 40640 - DNA, 25 bp, Homo sapien
tcagtttcttgggaggttcgggtgg

SEQ ID NO: 40641 - DNA, 25 bp, Homo sapien
aaaaaatcactagcatccctgtata

SEQ ID NO: 40642 - DNA, 25 bp, Homo sapien
atcactagcatccctgtataaaaag

SEQ ID NO: 40643 - DNA, 25 bp, Homo sapien
aaagaacatacaagctgagagccaa

SEQ ID NO: 40644 - DNA, 25 bp, Homo sapien
gagagccaaataaggaacaccatcc

SEQ ID NO: 40645 - DNA, 25 bp, Homo sapien
aaataaggaacaccatcccattcac

SEQ ID NO: 40646 - DNA, 25 bp, Homo sapien
gaacaccatcccattcacaatatgt

SEQ ID NO: 40647 - DNA, 25 bp, Homo sapien
accatcccattcacaatatgtacaa

SEQ ID NO: 40648 - DNA, 25 bp, Homo sapien
agaaatacagctaaccagggaggtg

SEQ ID NO: 40649 - DNA, 25 bp, Homo sapien
gggaggtgaaagctctctataatga

SEQ ID NO: 40650 - DNA, 25 bp, Homo sapien
gaggattacaaaacactgctgaaag

SEQ ID NO: 40651 - DNA, 25 bp, Homo sapien
aatgaaaaagtattatgcagccata

SEQ ID NO: 40652 - DNA, 25 bp, Homo sapien
tactcaacctgtactacttactctc

SEQ ID NO: 40653 - DNA, 25 bp, Homo sapien
aaggttacagagctggtaagtggca

SEQ ID NO: 40654 - DNA, 25 bp, Homo sapien
ccccaggcagccttgctgtatagct

SEQ ID NO: 40655 - DNA, 25 bp, Homo sapien
tgtatagcttactgtctcctaacca

SEQ ID NO: 40656 - DNA, 25 bp, Homo sapien
actgtctcctaaccattattctatg

SEQ ID NO: 40657 - DNA, 25 bp, Homo sapien
tattctatgctacctttcatgggcc

SEQ ID NO: 40658 - DNA, 25 bp, Homo sapien
tacctttcatgggccctcatgttaa

SEQ ID NO: 40659 - DNA, 25 bp, Homo sapien
gggccctcatgttaagagtaactct

SEQ ID NO: 40660 - DNA, 25 bp, Homo sapien
aactcttcagtttagcaaattattc

SEQ ID NO: 40661 - DNA, 25 bp, Homo sapien
ataatagaccagaagcggtggctca

SEQ ID NO: 40662 - DNA, 25 bp, Homo sapien
gattgcttgagttcatgtgttcaag

SEQ ID NO: 40663 - DNA, 25 bp, Homo sapien
agactatgatgaggccctaggccgc

SEQ ID NO: 40664 - DNA, 25 bp, Homo sapien
ctatgatgaggccctaggccgcctg

SEQ ID NO: 40665 - DNA, 25 bp, Homo sapien
ccggcgggtcctggacgtagaggtg

SEQ ID NO: 40666 - DNA, 25 bp, Homo sapien
ggatgaggcccgggagcagggccgg

SEQ ID NO: 40667 - DNA, 25 bp, Homo sapien
gtgatggcaaaacgtgtgtttgaca

SEQ ID NO: 40668 - DNA, 25 bp, Homo sapien
cgtgtgtttgacacgtactcacctc

SEQ ID NO: 40669 - DNA, 25 bp, Homo sapien
tttgacacgtactcacctcatgagg

SEQ ID NO: 40670 - DNA, 25 bp, Homo sapien
gacacgtactcacctcatgaggatg

SEQ ID NO: 40671 - DNA, 25 bp, Homo sapien
actcacctcatgaggatgaggccat

SEQ ID NO: 40672 - DNA, 25 bp, Homo sapien
gccatggtgctattcctcaacatgg

SEQ ID NO: 40673 - DNA, 25 bp, Homo sapien
gctattcctcaacatggtagcgccc

SEQ ID NO: 40674 - DNA, 25 bp, Homo sapien
aagctgtatatatttgcaaaaacac

SEQ ID NO: 40675 - DNA, 25 bp, Homo sapien
aacactatagtagacataccagacc

SEQ ID NO: 40676 - DNA, 25 bp, Homo sapien
agtagacataccagaccatcagctc

SEQ ID NO: 40677 - DNA, 25 bp, Homo sapien
ccatcagctccctagggctttttat

SEQ ID NO: 40678 - DNA, 25 bp, Homo sapien
atcagctccctagggctttttatga

SEQ ID NO: 40679 - DNA, 25 bp, Homo sapien
cagctccctagggctttttatgaaa

SEQ ID NO: 40680 - DNA, 25 bp, Homo sapien
ccagttccttttggtatatctctct

SEQ ID NO: 40681 - DNA, 25 bp, Homo sapien
agttccttttggtatatctctctaa

SEQ ID NO: 40682 - DNA, 25 bp, Homo sapien
tccttttggtatatctctctaaata

SEQ ID NO: 40683 - DNA, 25 bp, Homo sapien
atctctctaaataataagcctcttt

SEQ ID NO: 40684 - DNA, 25 bp, Homo sapien
taataagcctcttttgctttacagt

SEQ ID NO: 40685 - DNA, 25 bp, Homo sapien
ggaattcaaatagttagctcatcat

SEQ ID NO: 40686 - DNA, 25 bp, Homo sapien
atagttagctcatcattcttttatt

SEQ ID NO: 40687 - DNA, 25 bp, Homo sapien
gcagtggcacgatcttggcttactg

SEQ ID NO: 40688 - DNA, 25 bp, Homo sapien
gcacgatcttggcttactgcagcct

SEQ ID NO: 40689 - DNA, 25 bp, Homo sapien
ctcctggattcaagcgattctccca

SEQ ID NO: 40690 - DNA, 25 bp, Homo sapien
gctgtgattacaggcatgtgccacc

SEQ ID NO: 40691 - DNA, 25 bp, Homo sapien
tgccaccatgccgagctaattttgt

SEQ ID NO: 40692 - DNA, 25 bp, Homo sapien
gatggggattctccatgttgctcac

SEQ ID NO: 40693 - DNA, 25 bp, Homo sapien
agaccatcctagctaacactgtgaa

SEQ ID NO: 40694 - DNA, 25 bp, Homo sapien
tcctagctaacactgtgaaaccccg

SEQ ID NO: 40695 - DNA, 25 bp, Homo sapien
catggtggcacgcacctatagtccc

SEQ ID NO: 40696 - DNA, 25 bp, Homo sapien
gacagagggtaaaccatggccatcc

SEQ ID NO: 40697 - DNA, 25 bp, Homo sapien
ccatggccatccctaagtaaattat

SEQ ID NO: 40698 - DNA, 25 bp, Homo sapien
atggccatccctaagtaaattattt

SEQ ID NO: 40699 - DNA, 25 bp, Homo sapien
gggtgttggaagaggtcggtgatag

SEQ ID NO: 40700 - DNA, 25 bp, Homo sapien
gaggtcggtgatagggaaaacaaga

SEQ ID NO: 40701 - DNA, 25 bp, Homo sapien
aaagaatatgggggcccagagtgct

SEQ ID NO: 40702 - DNA, 25 bp, Homo sapien
gggcccagagtgcttgtgtctggag

SEQ ID NO: 40703 - DNA, 25 bp, Homo sapien
agtgcttgtgtctggagcaggtcac

SEQ ID NO: 40704 - DNA, 25 bp, Homo sapien
aaatagatggtgtgtgtcaggcctc

SEQ ID NO: 40705 - DNA, 25 bp, Homo sapien
atacatccagatggtctgaagtaac

SEQ ID NO: 40706 - DNA, 25 bp, Homo sapien
gaactaataataatccaccactctt

SEQ ID NO: 40707 - DNA, 25 bp, Homo sapien
ggagctggtggaaagactgcaggcc

SEQ ID NO: 40708 - DNA, 25 bp, Homo sapien
agactgcaggccatgctgcaggccc

SEQ ID NO: 40709 - DNA, 25 bp, Homo sapien
gctgcaggcccactgggatgaggcc

SEQ ID NO: 40710 - DNA, 25 bp, Homo sapien
actgggatgaggccaaccagctgct

SEQ ID NO: 40711 - DNA, 25 bp, Homo sapien
cccgggcctcaggagcccgagaagg

SEQ ID NO: 40712 - DNA, 25 bp, Homo sapien
gtggcctgaagcctgtattgcagca

SEQ ID NO: 40713 - DNA, 25 bp, Homo sapien
gcagcagagccgggaagcaagggac

SEQ ID NO: 40714 - DNA, 25 bp, Homo sapien
agcaagggacgagctacctggagcg

SEQ ID NO: 40715 - DNA, 25 bp, Homo sapien
agcgcgagtgtgcgaactgcagagt

SEQ ID NO: 40716 - DNA, 25 bp, Homo sapien
gcagagtgggaaccagcagctggag

SEQ ID NO: 40717 - DNA, 25 bp, Homo sapien
ggaggagcagcgggtggagctggtg

SEQ ID NO: 40718 - DNA, 25 bp, Homo sapien
gggtacaagtgcgggtttctgatgt

SEQ ID NO: 40719 - DNA, 25 bp, Homo sapien
aagtgcgggtttctgatgtgcagct

SEQ ID NO: 40720 - DNA, 25 bp, Homo sapien
gctatactgcagtgatgacatccgt

SEQ ID NO: 40721 - DNA, 25 bp, Homo sapien
gatgacatccgtctgggcttttagt

SEQ ID NO: 40722 - DNA, 25 bp, Homo sapien
gggcttttagtggaccttccactca

SEQ ID NO: 40723 - DNA, 25 bp, Homo sapien
gtggaccttccactcaaatagtgaa

SEQ ID NO: 40724 - DNA, 25 bp, Homo sapien
tggaatccccagtgtctgtgtttcc

SEQ ID NO: 40725 - DNA, 25 bp, Homo sapien
gtctgtgtttccactcagtatgtcc

SEQ ID NO: 40726 - DNA, 25 bp, Homo sapien
cactcagtatgtccatgtttaccca

SEQ ID NO: 40727 - DNA, 25 bp, Homo sapien
tgtccatgtttacccattgtttagc

SEQ ID NO: 40728 - DNA, 25 bp, Homo sapien
aaccagatgtggtagcggcgggcac

SEQ ID NO: 40729 - DNA, 25 bp, Homo sapien
aaggcctgtatacgaggggtggact

SEQ ID NO: 40730 - DNA, 25 bp, Homo sapien
tacgaggggtggacttttcttctgt

SEQ ID NO: 40731 - DNA, 25 bp, Homo sapien
gacttttcttctgtaagtgtccaga

SEQ ID NO: 40732 - DNA, 25 bp, Homo sapien
gaccaggcctcctgaagagggcatg

SEQ ID NO: 40733 - DNA, 25 bp, Homo sapien
gaagagggcatgggggcttaactta

SEQ ID NO: 40734 - DNA, 25 bp, Homo sapien
gggcttaacttacctggactactgt

SEQ ID NO: 40735 - DNA, 25 bp, Homo sapien
acttacctggactactgtgtttaca

SEQ ID NO: 40736 - DNA, 25 bp, Homo sapien
tgtgtttacaatactcatttatctt

SEQ ID NO: 40737 - DNA, 25 bp, Homo sapien
cctaacccctgagaattgctacatt

SEQ ID NO: 40738 - DNA, 25 bp, Homo sapien
gctacatttagtatttgctgagtac

SEQ ID NO: 40739 - DNA, 25 bp, Homo sapien
gtacttcctagcatcctagggaatc

SEQ ID NO: 40740 - DNA, 25 bp, Homo sapien
gacaggcgactgggtgttactatga

SEQ ID NO: 40741 - DNA, 25 bp, Homo sapien
gtgtgtacttgacaggttgtattgg

SEQ ID NO: 40742 - DNA, 25 bp, Homo sapien
attgggtaattgcatgccaccgtga

SEQ ID NO: 40743 - DNA, 25 bp, Homo sapien
attgcatgccaccgtgagacacaga

SEQ ID NO: 40744 - DNA, 25 bp, Homo sapien
gtgtgagactgggacagggtgtgag

SEQ ID NO: 40745 - DNA, 25 bp, Homo sapien
taaatggcatgcaaggccaggcgcg

SEQ ID NO: 40746 - DNA, 25 bp, Homo sapien
gtgagacactgagccatcgtgggta

SEQ ID NO: 40747 - DNA, 25 bp, Homo sapien
gagccatcgtgggtagctaggtatg

SEQ ID NO: 40748 - DNA, 25 bp, Homo sapien
gggtagctaggtatgacaccaggag

SEQ ID NO: 40749 - DNA, 25 bp, Homo sapien
gacaccaggagatgggttgcgtgcg

SEQ ID NO: 40750 - DNA, 25 bp, Homo sapien
gtcagatgcgtgtgacaccaggaga

SEQ ID NO: 40751 - DNA, 25 bp, Homo sapien
ggggccaaacgttcattaagtgctt

SEQ ID NO: 40752 - DNA, 25 bp, Homo sapien
cattaagtgctttcatgtgccctgc

SEQ ID NO: 40753 - DNA, 25 bp, Homo sapien
atgtgccctgcatttgaatttattc

SEQ ID NO: 40754 - DNA, 25 bp, Homo sapien
tttattcatgatagcttcaacattc

SEQ ID NO: 40755 - DNA, 25 bp, Homo sapien
actgtgctaactgtgtattatcttg

SEQ ID NO: 40756 - DNA, 25 bp, Homo sapien
gtgtattatcttgtatacttttcag

SEQ ID NO: 40757 - DNA, 25 bp, Homo sapien
caggacaagtgaaagtgatgacccc

SEQ ID NO: 40758 - DNA, 25 bp, Homo sapien
agagctcaggttggctggactctag

SEQ ID NO: 40759 - DNA, 25 bp, Homo sapien
aggttggctggactctaggacatcc

SEQ ID NO: 40760 - DNA, 25 bp, Homo sapien
cttgtcagcagcagcacgcagagct

SEQ ID NO: 40761 - DNA, 25 bp, Homo sapien
agcacgcagagctggttgcaaagga

SEQ ID NO: 40762 - DNA, 25 bp, Homo sapien
gtaatttaacaatgtcctttttatg

SEQ ID NO: 40763 - DNA, 25 bp, Homo sapien
gacataccaaaagaaataccacaga

SEQ ID NO: 40764 - DNA, 25 bp, Homo sapien
aaatagcattgatcattatgttata

SEQ ID NO: 40765 - DNA, 25 bp, Homo sapien
ggatcaactgtgtaatctttcctta

SEQ ID NO: 40766 - DNA, 25 bp, Homo sapien
gtaatctttccttaagacataccac

SEQ ID NO: 40767 - DNA, 25 bp, Homo sapien
tctttccttaagacataccacaaat

SEQ ID NO: 40768 - DNA, 25 bp, Homo sapien
gacataccacaaatgaatttttcta

SEQ ID NO: 40769 - DNA, 25 bp, Homo sapien
tgaatttttctatccaatgacttgg

SEQ ID NO: 40770 - DNA, 25 bp, Homo sapien
atgacttggaatcaacattgcaaat

SEQ ID NO: 40771 - DNA, 25 bp, Homo sapien
catccttgctaacacggtgaacccc

SEQ ID NO: 40772 - DNA, 25 bp, Homo sapien
cagtgagcagagatcgctccactgc

SEQ ID NO: 40773 - DNA, 25 bp, Homo sapien
aaggttctcgtgtggcacactcgga

SEQ ID NO: 40774 - DNA, 25 bp, Homo sapien
ttctcgtgtggcacactcggacaga

SEQ ID NO: 40775 - DNA, 25 bp, Homo sapien
caggaagtctggagcgtgggctgct

SEQ ID NO: 40776 - DNA, 25 bp, Homo sapien
tgcccattcaggtactgttcctttg

SEQ ID NO: 40777 - DNA, 25 bp, Homo sapien
cattcaggtactgttcctttgcctt

SEQ ID NO: 40778 - DNA, 25 bp, Homo sapien
ctttccttaccgccgatggacggcg

SEQ ID NO: 40779 - DNA, 25 bp, Homo sapien
cgccgatggacggcgtttcgacagc

SEQ ID NO: 40780 - DNA, 25 bp, Homo sapien
attgtgttgtcttcattgtgtctgg

SEQ ID NO: 40781 - DNA, 25 bp, Homo sapien
tgttgtcttcattgtgtctggattg

SEQ ID NO: 40782 - DNA, 25 bp, Homo sapien
attgtgtttctgaactggaagagtt

SEQ ID NO: 40783 - DNA, 25 bp, Homo sapien
aagagtttgtaggagtgaaggccac

SEQ ID NO: 40784 - DNA, 25 bp, Homo sapien
ttcctgctcagcgtgagctacagcg

SEQ ID NO: 40785 - DNA, 25 bp, Homo sapien
ctgctcagcgtgagctacagcgccg

SEQ ID NO: 40786 - DNA, 25 bp, Homo sapien
gtaaatcccgagctggacgtgtgcg

SEQ ID NO: 40787 - DNA, 25 bp, Homo sapien
taaatcccgagctggacgtgtgcgt

SEQ ID NO: 40788 - DNA, 25 bp, Homo sapien
ccgagctggacgtgtgcgtggagga

SEQ ID NO: 40789 - DNA, 25 bp, Homo sapien
cgagctggacgtgtgcgtggaggag

SEQ ID NO: 40790 - DNA, 25 bp, Homo sapien
agctggacgtgtgcgtggaggaggc

SEQ ID NO: 40791 - DNA, 25 bp, Homo sapien
tggacgtgtgcgtggaggaggccga

SEQ ID NO: 40792 - DNA, 25 bp, Homo sapien
tgcgtggaggaggccgagggcgagg

SEQ ID NO: 40793 - DNA, 25 bp, Homo sapien
ctcttcctgctcagcgtgagctaca

SEQ ID NO: 40794 - DNA, 25 bp, Homo sapien
cttcctgctcagcgtgagctacagc

SEQ ID NO: 40795 - DNA, 25 bp, Homo sapien
aggcaggagaacaacgtgaacccag

SEQ ID NO: 40796 - DNA, 25 bp, Homo sapien
gcagtgagcggagatggcgccactg

SEQ ID NO: 40797 - DNA, 25 bp, Homo sapien
gcctggacgagagtgctagatgcca

SEQ ID NO: 40798 - DNA, 25 bp, Homo sapien
tatctttactctcaaattttagggt

SEQ ID NO: 40799 - DNA, 25 bp, Homo sapien
ttacataatctttctttctcaccat

SEQ ID NO: 40800 - DNA, 25 bp, Homo sapien
ttctcaccatctgttacttttactt

SEQ ID NO: 40801 - DNA, 25 bp, Homo sapien
ataccattgtattctgataattcag

SEQ ID NO: 40802 - DNA, 25 bp, Homo sapien
aattcagcctatacaactgtggttt

SEQ ID NO: 40803 - DNA, 25 bp, Homo sapien
aaaaaagatccttctcttgcggaga

SEQ ID NO: 40804 - DNA, 25 bp, Homo sapien
cttgcggagaattacaggctttgaa

SEQ ID NO: 40805 - DNA, 25 bp, Homo sapien
aaactactgataggtcggccgggtg

SEQ ID NO: 40806 - DNA, 25 bp, Homo sapien
aaagattacccaggttctgagagct

SEQ ID NO: 40807 - DNA, 25 bp, Homo sapien
gagcttgggggagcttgaggaaggg

SEQ ID NO: 40808 - DNA, 25 bp, Homo sapien
ttgaggaagggagtcaatccctcac

SEQ ID NO: 40809 - DNA, 25 bp, Homo sapien
caataggatatattcagcctttagg

SEQ ID NO: 40810 - DNA, 25 bp, Homo sapien
cttctgctctctttagagtcattct

SEQ ID NO: 40811 - DNA, 25 bp, Homo sapien
tggaagagtgttgccattgcccaat

SEQ ID NO: 40812 - DNA, 25 bp, Homo sapien
gcccaatccaggaatggtccaatcc

SEQ ID NO: 40813 - DNA, 25 bp, Homo sapien
ggtccaatccaagaatggtctatca

SEQ ID NO: 40814 - DNA, 25 bp, Homo sapien
agaatggtctatcagtctaggaata

SEQ ID NO: 40815 - DNA, 25 bp, Homo sapien
agaatgactttgtagagggactgag

SEQ ID NO: 40816 - DNA, 25 bp, Homo sapien
gggactgagttcaaacccaactgag

SEQ ID NO: 40817 - DNA, 25 bp, Homo sapien
ggctgcagggagctgtgatcacacc

SEQ ID NO: 40818 - DNA, 25 bp, Homo sapien
ggtgacagagcaaaacccagtctat

SEQ ID NO: 40819 - DNA, 25 bp, Homo sapien
tatttttatttctgtgttaattgtt

SEQ ID NO: 40820 - DNA, 25 bp, Homo sapien
aatatgagtaccttaaattctgtaa

SEQ ID NO: 40821 - DNA, 25 bp, Homo sapien
gtaactgcccttcatactggtaatc

SEQ ID NO: 40822 - DNA, 25 bp, Homo sapien
gcccttcatactggtaatcttgata

SEQ ID NO: 40823 - DNA, 25 bp, Homo sapien
gtgacttgttataagatagaggcca

SEQ ID NO: 40824 - DNA, 25 bp, Homo sapien
atagaggccaggtatggtggctcat

SEQ ID NO: 40825 - DNA, 25 bp, Homo sapien
ggaggatgactcaggaggattgctt

SEQ ID NO: 40826 - DNA, 25 bp, Homo sapien
gattgcttgagcctcctaggatgtc

SEQ ID NO: 40827 - DNA, 25 bp, Homo sapien
gagcctcctaggatgtcaaggctgc

SEQ ID NO: 40828 - DNA, 25 bp, Homo sapien
ggcttttaggggtaggcagttatat

SEQ ID NO: 40829 - DNA, 25 bp, Homo sapien
gcttttaggggtaggcagttatatc

SEQ ID NO: 40830 - DNA, 25 bp, Homo sapien
ttttaggggtaggcagttatatcaa

SEQ ID NO: 40831 - DNA, 25 bp, Homo sapien
ttaggggtaggcagttatatcaagt

SEQ ID NO: 40832 - DNA, 25 bp, Homo sapien
aggggtaggcagttatatcaagtgc

SEQ ID NO: 40833 - DNA, 25 bp, Homo sapien
ggcagttatatcaagtgcaacagca

SEQ ID NO: 40834 - DNA, 25 bp, Homo sapien
tatcaagtgcaacagcagacacagc

SEQ ID NO: 40835 - DNA, 25 bp, Homo sapien
caagtgcaacagcagacacagcaac

SEQ ID NO: 40836 - DNA, 25 bp, Homo sapien
gtgcaacagcagacacagcaacaag

SEQ ID NO: 40837 - DNA, 25 bp, Homo sapien
agcagacacagcaacaagtggccca

SEQ ID NO: 40838 - DNA, 25 bp, Homo sapien
agacacagcaacaagtggcccagcc

SEQ ID NO: 40839 - DNA, 25 bp, Homo sapien
tcaccacgccagtctaatttttttg

SEQ ID NO: 40840 - DNA, 25 bp, Homo sapien
taagggaggagaccacccctcatat

SEQ ID NO: 40841 - DNA, 25 bp, Homo sapien
cccctcatattgtcttatgcccaat

SEQ ID NO: 40842 - DNA, 25 bp, Homo sapien
tgaaatccacaagcagacagcccgg

SEQ ID NO: 40843 - DNA, 25 bp, Homo sapien
cgacccctgacctaatcggttatgt

SEQ ID NO: 40844 - DNA, 25 bp, Homo sapien
agcactgtgaaaatccctatcctgt

SEQ ID NO: 40845 - DNA, 25 bp, Homo sapien
atccctatcctgttttgttcagatc

SEQ ID NO: 40846 - DNA, 25 bp, Homo sapien
gttcagatcgaattaccggtgcatg

SEQ ID NO: 40847 - DNA, 25 bp, Homo sapien
aaagggacaggaattgctcactcgg

SEQ ID NO: 40848 - DNA, 25 bp, Homo sapien
ctcactcggggagcttggcttttga

SEQ ID NO: 40849 - DNA, 25 bp, Homo sapien
ggagcttggcttttgagacaggagt

SEQ ID NO: 40850 - DNA, 25 bp, Homo sapien
gttcaagtaaaatcttatccccaag

SEQ ID NO: 40851 - DNA, 25 bp, Homo sapien
cttatccccaagtgtcatgtgtatg

SEQ ID NO: 40852 - DNA, 25 bp, Homo sapien
gatggtggtagtgtagtatatgtgc

SEQ ID NO: 40853 - DNA, 25 bp, Homo sapien
tatgtgcacatgtgcctttgtatgt

SEQ ID NO: 40854 - DNA, 25 bp, Homo sapien
gtgttggggatatagcagagctttt

SEQ ID NO: 40855 - DNA, 25 bp, Homo sapien
gcagagcttttttgctgacttggat

SEQ ID NO: 40856 - DNA, 25 bp, Homo sapien
ctgacttggattcctattcccattc

SEQ ID NO: 40857 - DNA, 25 bp, Homo sapien
attccttgagggctttatagcccaa

SEQ ID NO: 40858 - DNA, 25 bp, Homo sapien
tatagcccaatttgaaagtcactaa

SEQ ID NO: 40859 - DNA, 25 bp, Homo sapien
taagccagttattagttacagagga

SEQ ID NO: 40860 - DNA, 25 bp, Homo sapien
agctcagtcttataagaagtctcag

SEQ ID NO: 40861 - DNA, 25 bp, Homo sapien
gtgtgggcgcacaatggcgaggggc

SEQ ID NO: 40862 - DNA, 25 bp, Homo sapien
gcggccaagcacaggctggtggtgc

SEQ ID NO: 40863 - DNA, 25 bp, Homo sapien
gctggtggtgctggtcaaggacaat

SEQ ID NO: 40864 - DNA, 25 bp, Homo sapien
tcaaggacaatggcgagcctccgcg

SEQ ID NO: 40865 - DNA, 25 bp, Homo sapien
caccgtctacctggtggtggcgttg

SEQ ID NO: 40866 - DNA, 25 bp, Homo sapien
gcggctgtgcaggaggagcagggcg

SEQ ID NO: 40867 - DNA, 25 bp, Homo sapien
gtccctttccagggcatctggtaga

SEQ ID NO: 40868 - DNA, 25 bp, Homo sapien
atctggtagacgtgagcggcaccgg

SEQ ID NO: 40869 - DNA, 25 bp, Homo sapien
ctatcccagagctaccagtacgagg

SEQ ID NO: 40870 - DNA, 25 bp, Homo sapien
tgacgggaggctcaggggcaaatga

SEQ ID NO: 40871 - DNA, 25 bp, Homo sapien
tcaagttcctgaagccggtgattcc

SEQ ID NO: 40872 - DNA, 25 bp, Homo sapien
cctctggtcatggccatggggggcc

SEQ ID NO: 40873 - DNA, 25 bp, Homo sapien
ttgcaaaatgcatcttggcctccac

SEQ ID NO: 40874 - DNA, 25 bp, Homo sapien
tccatttgtcctgcacagtttgctt

SEQ ID NO: 40875 - DNA, 25 bp, Homo sapien
catttgtcctgcacagtttgctttg

SEQ ID NO: 40876 - DNA, 25 bp, Homo sapien
ccttgcacctcagactactgggagc

SEQ ID NO: 40877 - DNA, 25 bp, Homo sapien
tgcacctcagactactgggagcact

SEQ ID NO: 40878 - DNA, 25 bp, Homo sapien
cacctcagactactgggagcactgt

SEQ ID NO: 40879 - DNA, 25 bp, Homo sapien
gagccaaaccctagggctcaatgaa

SEQ ID NO: 40880 - DNA, 25 bp, Homo sapien
gccaaaccctagggctcaatgaaaa

SEQ ID NO: 40881 - DNA, 25 bp, Homo sapien
gaaaaccagacgtaaggctgggtgc

SEQ ID NO: 40882 - DNA, 25 bp, Homo sapien
accagacgtaaggctgggtgcattg

SEQ ID NO: 40883 - DNA, 25 bp, Homo sapien
tcttctccctatatctctactggag

SEQ ID NO: 40884 - DNA, 25 bp, Homo sapien
tctactggagattttgtcttgtggg

SEQ ID NO: 40885 - DNA, 25 bp, Homo sapien
atatgcttaagtttaccatatctta

SEQ ID NO: 40886 - DNA, 25 bp, Homo sapien
atcactcctctctatactaatactt

SEQ ID NO: 40887 - DNA, 25 bp, Homo sapien
tactaatactttgcctcttggtctc

SEQ ID NO: 40888 - DNA, 25 bp, Homo sapien
gccctgtctctggggtcaagggtaa

SEQ ID NO: 40889 - DNA, 25 bp, Homo sapien
ggggtcaagggtaagagctcacata

SEQ ID NO: 40890 - DNA, 25 bp, Homo sapien
gggtaagagctcacatagaggcaca

SEQ ID NO: 40891 - DNA, 25 bp, Homo sapien
gaggcacaccatatatctacatatt

SEQ ID NO: 40892 - DNA, 25 bp, Homo sapien
tgctctcttagctcttcaaggatgc

SEQ ID NO: 40893 - DNA, 25 bp, Homo sapien
gctcttcaaggatgctctattgtta

SEQ ID NO: 40894 - DNA, 25 bp, Homo sapien
atcggttataccacgagatacttat

SEQ ID NO: 40895 - DNA, 25 bp, Homo sapien
ataccacgagatacttatggagggt

SEQ ID NO: 40896 - DNA, 25 bp, Homo sapien
gaaagttagatgatcaacccaggaa

SEQ ID NO: 40897 - DNA, 25 bp, Homo sapien
gatgatcaacccaggaagtacaaaa

SEQ ID NO: 40898 - DNA, 25 bp, Homo sapien
gaagtacaaaatctgcctaaagtta

SEQ ID NO: 40899 - DNA, 25 bp, Homo sapien
aaaacagtagtctcttggttgaatg

SEQ ID NO: 40900 - DNA, 25 bp, Homo sapien
gaaaaagaacccatactactgagtg

SEQ ID NO: 40901 - DNA, 25 bp, Homo sapien
gaacccatactactgagtgaaattt

SEQ ID NO: 40902 - DNA, 25 bp, Homo sapien
atttcagactatctggacaagtcac

SEQ ID NO: 40903 - DNA, 25 bp, Homo sapien
gacaagtcacttagctatttaatcg

SEQ ID NO: 40904 - DNA, 25 bp, Homo sapien
tagctatttaatcggttataccacg

SEQ ID NO: 40905 - DNA, 25 bp, Homo sapien
aaccaaacattgcatgttatcactc

SEQ ID NO: 40906 - DNA, 25 bp, Homo sapien
aacattgcatgttatcactcatagg

SEQ ID NO: 40907 - DNA, 25 bp, Homo sapien
cattgcatgttatcactcataggtg

SEQ ID NO: 40908 - DNA, 25 bp, Homo sapien
ttgcatgttatcactcataggtggg

SEQ ID NO: 40909 - DNA, 25 bp, Homo sapien
aacacttggacacagaagggggaat

SEQ ID NO: 40910 - DNA, 25 bp, Homo sapien
gacacagaagggggaatatcacaca

SEQ ID NO: 40911 - DNA, 25 bp, Homo sapien
gaagggggaatatcacacaccgggg

SEQ ID NO: 40912 - DNA, 25 bp, Homo sapien
ttgggggagtggggagggttagcat

SEQ ID NO: 40913 - DNA, 25 bp, Homo sapien
ggagtggggagggttagcattagga

SEQ ID NO: 40914 - DNA, 25 bp, Homo sapien
tatacatatataacaaacctacacg

SEQ ID NO: 40915 - DNA, 25 bp, Homo sapien
atataacaaacctacacgttgtgca

SEQ ID NO: 40916 - DNA, 25 bp, Homo sapien
gaataagtacacagagtccccaaag

SEQ ID NO: 40917 - DNA, 25 bp, Homo sapien
gtccccaaagactagtgaggccaag

SEQ ID NO: 40918 - DNA, 25 bp, Homo sapien
aagactagtgaggccaagatgtgtg

SEQ ID NO: 40919 - DNA, 25 bp, Homo sapien
gccaagatgtgtgagtcattttcca

SEQ ID NO: 40920 - DNA, 25 bp, Homo sapien
gatgtgtgagtcattttccatcaca

SEQ ID NO: 40921 - DNA, 25 bp, Homo sapien
aacccaattgttctaagtatgtatt

SEQ ID NO: 40922 - DNA, 25 bp, Homo sapien
aagtatgtattttaccaagcagctt

SEQ ID NO: 40923 - DNA, 25 bp, Homo sapien
ggagattcaggcgggtggatccttt

SEQ ID NO: 40924 - DNA, 25 bp, Homo sapien
agattcaggcgggtggatcctttga

SEQ ID NO: 40925 - DNA, 25 bp, Homo sapien
tgtatcactgcacaactgttgcctg

SEQ ID NO: 40926 - DNA, 25 bp, Homo sapien
tcactgcacaactgttgcctgggca

SEQ ID NO: 40927 - DNA, 25 bp, Homo sapien
gcctcgtaccgtaggtttcggacat

SEQ ID NO: 40928 - DNA, 25 bp, Homo sapien
tcgtaccgtaggtttcggacatggc

SEQ ID NO: 40929 - DNA, 25 bp, Homo sapien
cgtaggtttcggacatggccgtctg

SEQ ID NO: 40930 - DNA, 25 bp, Homo sapien
ccgtctgcgacatcttgggagcggc

SEQ ID NO: 40931 - DNA, 25 bp, Homo sapien
gtctgcgacatcttgggagcggcgc

SEQ ID NO: 40932 - DNA, 25 bp, Homo sapien
tctcggtggggaaggacctggggcg

SEQ ID NO: 40933 - DNA, 25 bp, Homo sapien
gccgcgaccgcgaggaggaagagga

SEQ ID NO: 40934 - DNA, 25 bp, Homo sapien
ggaagaggagatgggctacgcgagg

SEQ ID NO: 40935 - DNA, 25 bp, Homo sapien
agaggagatgggctacgcgaggccc

SEQ ID NO: 40936 - DNA, 25 bp, Homo sapien
ggtgtgcgctgaggtgggcagagcg

SEQ ID NO: 40937 - DNA, 25 bp, Homo sapien
ctgaggtgggcagagcggcaggtgg

SEQ ID NO: 40938 - DNA, 25 bp, Homo sapien
aaaacccaacaccgcatgttgtcac

SEQ ID NO: 40939 - DNA, 25 bp, Homo sapien
aacccaacaccgcatgttgtcactc

SEQ ID NO: 40940 - DNA, 25 bp, Homo sapien
caccagggcctgtcatggggtggag

SEQ ID NO: 40941 - DNA, 25 bp, Homo sapien
ccagggcctgtcatggggtggaggg

SEQ ID NO: 40942 - DNA, 25 bp, Homo sapien
agggcctgtcatggggtggagggat

SEQ ID NO: 40943 - DNA, 25 bp, Homo sapien
gcctgtcatggggtggagggatggg

SEQ ID NO: 40944 - DNA, 25 bp, Homo sapien
ggtggagggatgggggagggatagc

SEQ ID NO: 40945 - DNA, 25 bp, Homo sapien
aatgacgagttaattggtgcaacac

SEQ ID NO: 40946 - DNA, 25 bp, Homo sapien
gacgagttaattggtgcaacacaac

SEQ ID NO: 40947 - DNA, 25 bp, Homo sapien
attggtgcaacacaacaacatggca

SEQ ID NO: 40948 - DNA, 25 bp, Homo sapien
tgcaacacaacaacatggcacatgt

SEQ ID NO: 40949 - DNA, 25 bp, Homo sapien
tttgtatgattgaaacttgcaccga

SEQ ID NO: 40950 - DNA, 25 bp, Homo sapien
ataatttaacttgtgaactccttgg

SEQ ID NO: 40951 - DNA, 25 bp, Homo sapien
ggctttgtgtgctcactctagcaca

SEQ ID NO: 40952 - DNA, 25 bp, Homo sapien
gctcactctagcacagcatacaagt

SEQ ID NO: 40953 - DNA, 25 bp, Homo sapien
cgcccaggtctccatggttagttga

SEQ ID NO: 40954 - DNA, 25 bp, Homo sapien
ggtctccatggttagttgaagccaa

SEQ ID NO: 40955 - DNA, 25 bp, Homo sapien
gccaatttctggcttgacttttatg

SEQ ID NO: 40956 - DNA, 25 bp, Homo sapien
gtctcctaagcattagagtttttct

SEQ ID NO: 40957 - DNA, 25 bp, Homo sapien
agtttttctattactctatgtagtt

SEQ ID NO: 40958 - DNA, 25 bp, Homo sapien
agaagtacctgtgtgtatctgttaa

SEQ ID NO: 40959 - DNA, 25 bp, Homo sapien
gtatctgttaataaccacaggggtt

SEQ ID NO: 40960 - DNA, 25 bp, Homo sapien
gcactagtgcagtgggtgtgggctg

SEQ ID NO: 40961 - DNA, 25 bp, Homo sapien
agtgcagtgggtgtgggctggatcc

SEQ ID NO: 40962 - DNA, 25 bp, Homo sapien
gggtgtgggctggatccgtcagccc

SEQ ID NO: 40963 - DNA, 25 bp, Homo sapien
gatcaccttgaaggagtctggtcct

SEQ ID NO: 40964 - DNA, 25 bp, Homo sapien
tgaaggagtctggtcctacgctgat

SEQ ID NO: 40965 - DNA, 25 bp, Homo sapien
gtctggtcctacgctgatgaaaccc

SEQ ID NO: 40966 - DNA, 25 bp, Homo sapien
tggtcctacgctgatgaaacccaca

SEQ ID NO: 40967 - DNA, 25 bp, Homo sapien
tcctacgctgatgaaacccacacag

SEQ ID NO: 40968 - DNA, 25 bp, Homo sapien
acgctgatgaaacccacacagaccc

SEQ ID NO: 40969 - DNA, 25 bp, Homo sapien
ggttctcactcagcactagtgcagt

SEQ ID NO: 40970 - DNA, 25 bp, Homo sapien
ctcactcagcactagtgcagtgggt

SEQ ID NO: 40971 - DNA, 25 bp, Homo sapien
tgcgcctgggggctggggtaggcga

SEQ ID NO: 40972 - DNA, 25 bp, Homo sapien
atagctggggaaacaggctccgaga

SEQ ID NO: 40973 - DNA, 25 bp, Homo sapien
gtcctctggggcctcagagaggcag

SEQ ID NO: 40974 - DNA, 25 bp, Homo sapien
ctcagagaggcaggtcctaaaggag

SEQ ID NO: 40975 - DNA, 25 bp, Homo sapien
tcctgggggcagaccgagggtctcg

SEQ ID NO: 40976 - DNA, 25 bp, Homo sapien
gagaggtttccagggctggcagagt

SEQ ID NO: 40977 - DNA, 25 bp, Homo sapien
ggctggcagagtgtgtgcgtgtgtg

SEQ ID NO: 40978 - DNA, 25 bp, Homo sapien
gcagtaggacctgggttggaaccca

SEQ ID NO: 40979 - DNA, 25 bp, Homo sapien
ggttggaacccaggggagcagactg

SEQ ID NO: 40980 - DNA, 25 bp, Homo sapien
ccaccaggggagggggctggcctgg

SEQ ID NO: 40981 - DNA, 25 bp, Homo sapien
gctggcctgggggtcttgggaaggc

SEQ ID NO: 40982 - DNA, 25 bp, Homo sapien
cagttatgtcttatgcagatgaatt

SEQ ID NO: 40983 - DNA, 25 bp, Homo sapien
gcagatgaattaggggctacctgtt

SEQ ID NO: 40984 - DNA, 25 bp, Homo sapien
taggggctacctgtttttatgcact

SEQ ID NO: 40985 - DNA, 25 bp, Homo sapien
ggctacctgtttttatgcactggtc

SEQ ID NO: 40986 - DNA, 25 bp, Homo sapien
acctgtttttatgcactggtctttg

SEQ ID NO: 40987 - DNA, 25 bp, Homo sapien
ctggtctttggggtgcttttgaaca

SEQ ID NO: 40988 - DNA, 25 bp, Homo sapien
gtctttggggtgcttttgaacagta

SEQ ID NO: 40989 - DNA, 25 bp, Homo sapien
agtagtgtctgatgttttaattgtc

SEQ ID NO: 40990 - DNA, 25 bp, Homo sapien
cttcctcttctgaagtccaggaaac

SEQ ID NO: 40991 - DNA, 25 bp, Homo sapien
aaactggttattttctcatgcatat

SEQ ID NO: 40992 - DNA, 25 bp, Homo sapien
aagatcgcgctcttggctgcgatcc

SEQ ID NO: 40993 - DNA, 25 bp, Homo sapien
tgctcgccaagaactatatcctcat

SEQ ID NO: 40994 - DNA, 25 bp, Homo sapien
gccaagaactatatcctcatgcagg

SEQ ID NO: 40995 - DNA, 25 bp, Homo sapien
aactatatcctcatgcaggcgcagg

SEQ ID NO: 40996 - DNA, 25 bp, Homo sapien
ctcaaccagggccagggcctggccg

SEQ ID NO: 40997 - DNA, 25 bp, Homo sapien
caaccagggccagggcctggccgcg

SEQ ID NO: 40998 - DNA, 25 bp, Homo sapien
tgtctctctgcccggacaggaaagg

SEQ ID NO: 40999 - DNA, 25 bp, Homo sapien
ctctctgcccggacaggaaaggcct

SEQ ID NO: 41000 - DNA, 25 bp, Homo sapien
ctctgcccggacaggaaaggcctgg

SEQ ID NO: 41001 - DNA, 25 bp, Homo sapien
caggaaaggcctggagggaccctgc

SEQ ID NO: 41002 - DNA, 25 bp, Homo sapien
gcgcatgcacgacctaaacgacgcg

SEQ ID NO: 41003 - DNA, 25 bp, Homo sapien
cgcatgcacgacctaaacgacgcgc

SEQ ID NO: 41004 - DNA, 25 bp, Homo sapien
gaggagctggaccatgctcaggagc

SEQ ID NO: 41005 - DNA, 25 bp, Homo sapien
aggaaatatgaagaggtgcctcgta

SEQ ID NO: 41006 - DNA, 25 bp, Homo sapien
gacagatgagcagatcagactgatg

SEQ ID NO: 41007 - DNA, 25 bp, Homo sapien
gaagtgaagtgcaagatccaggttc

SEQ ID NO: 41008 - DNA, 25 bp, Homo sapien
gaggaagagatcaagattctcactg

SEQ ID NO: 41009 - DNA, 25 bp, Homo sapien
agattctcactgacaaactcaagga

SEQ ID NO: 41010 - DNA, 25 bp, Homo sapien
gtgctgagtttactgagagattggt

SEQ ID NO: 41011 - DNA, 25 bp, Homo sapien
tttactgagagattggtagccaagc

SEQ ID NO: 41012 - DNA, 25 bp, Homo sapien
aactgatgacttggaatataaactg

SEQ ID NO: 41013 - DNA, 25 bp, Homo sapien
ctgagcgcctccagtttgaagagga

SEQ ID NO: 41014 - DNA, 25 bp, Homo sapien
gcgcctccagtttgaagaggagctg

SEQ ID NO: 41015 - DNA, 25 bp, Homo sapien
ctcaaacctacctgttgggaaccag

SEQ ID NO: 41016 - DNA, 25 bp, Homo sapien
gttgggaaccagatcagcccagcag

SEQ ID NO: 41017 - DNA, 25 bp, Homo sapien
accagatcagcccagcaggctggta

SEQ ID NO: 41018 - DNA, 25 bp, Homo sapien
ggctggtagcagagccatggcctgg

SEQ ID NO: 41019 - DNA, 25 bp, Homo sapien
ttgcaatgctgtgctgtgtagtggt

SEQ ID NO: 41020 - DNA, 25 bp, Homo sapien
gtagtggtaaagcctgcacacgcta

SEQ ID NO: 41021 - DNA, 25 bp, Homo sapien
ttcttcctgcttgtgtgacctcagg

SEQ ID NO: 41022 - DNA, 25 bp, Homo sapien
ccccaaacagccttgtgactcaatg

SEQ ID NO: 41023 - DNA, 25 bp, Homo sapien
agccttgtgactcaatgttctcatc

SEQ ID NO: 41024 - DNA, 25 bp, Homo sapien
atggcacctatcgcatagggtcctt

SEQ ID NO: 41025 - DNA, 25 bp, Homo sapien
ctatcgcatagggtccttgtgagga

SEQ ID NO: 41026 - DNA, 25 bp, Homo sapien
gagggcaggaaacagggtatgaatc

SEQ ID NO: 41027 - DNA, 25 bp, Homo sapien
ttaagtttcaaaacatggcctgatg

SEQ ID NO: 41028 - DNA, 25 bp, Homo sapien
catggcctgatgttgttcgtttatt

SEQ ID NO: 41029 - DNA, 25 bp, Homo sapien
tggcctgatgttgttcgtttatttc

SEQ ID NO: 41030 - DNA, 25 bp, Homo sapien
cctgatgttgttcgtttatttccca

SEQ ID NO: 41031 - DNA, 25 bp, Homo sapien
tgttgttcgtttatttcccatttca

SEQ ID NO: 41032 - DNA, 25 bp, Homo sapien
ttcgtttatttcccatttcaagttg

SEQ ID NO: 41033 - DNA, 25 bp, Homo sapien
ttatttcccatttcaagttgtcctt

SEQ ID NO: 41034 - DNA, 25 bp, Homo sapien
agttgtccttaaatgagtgggtgca

SEQ ID NO: 41035 - DNA, 25 bp, Homo sapien
gtccttaaatgagtgggtgcagtgg

SEQ ID NO: 41036 - DNA, 25 bp, Homo sapien
tactcggggtaggagtgggggcctg

SEQ ID NO: 41037 - DNA, 25 bp, Homo sapien
ttcagtctccatctgctcagaaaag

SEQ ID NO: 41038 - DNA, 25 bp, Homo sapien
cagtctccatctgctcagaaaagag

SEQ ID NO: 41039 - DNA, 25 bp, Homo sapien
cctcctgccagcaagtccaagaagc

SEQ ID NO: 41040 - DNA, 25 bp, Homo sapien
tcctgccagcaagtccaagaagcga

SEQ ID NO: 41041 - DNA, 25 bp, Homo sapien
gccagcaagtccaagaagcgacctc

SEQ ID NO: 41042 - DNA, 25 bp, Homo sapien
aaaagtggggctctgaagtctcgga

SEQ ID NO: 41043 - DNA, 25 bp, Homo sapien
ggagggagaaggtggctgaacgggg

SEQ ID NO: 41044 - DNA, 25 bp, Homo sapien
gaaggtggctgaacggggagggcag

SEQ ID NO: 41045 - DNA, 25 bp, Homo sapien
tgccttgggggccttgtgtgtaaat

SEQ ID NO: 41046 - DNA, 25 bp, Homo sapien
ttgggggccttgtgtgtaaatgtga

SEQ ID NO: 41047 - DNA, 25 bp, Homo sapien
gggccttgtgtgtaaatgtgaataa

SEQ ID NO: 41048 - DNA, 25 bp, Homo sapien
ctccccacctgagagccaggaagtc

SEQ ID NO: 41049 - DNA, 25 bp, Homo sapien
gagccaggaagtctgagtgggtgtg

SEQ ID NO: 41050 - DNA, 25 bp, Homo sapien
gtgaaaaaaacagcacctggcggtg

SEQ ID NO: 41051 - DNA, 25 bp, Homo sapien
gtttgagaatatatctccttgccca

SEQ ID NO: 41052 - DNA, 25 bp, Homo sapien
cccaggcgtacatccagggtgtcag

SEQ ID NO: 41053 - DNA, 25 bp, Homo sapien
gggtgtcagggcacacgaagattcc

SEQ ID NO: 41054 - DNA, 25 bp, Homo sapien
ggcacacgaagattccggatgagga

SEQ ID NO: 41055 - DNA, 25 bp, Homo sapien
gagagtgaggtgacatcctccgcca

SEQ ID NO: 41056 - DNA, 25 bp, Homo sapien
acatcctccgccagcgaaaagctgg

SEQ ID NO: 41057 - DNA, 25 bp, Homo sapien
cagcgaaaagctgggcagacagccc

SEQ ID NO: 41058 - DNA, 25 bp, Homo sapien
ggctcaggatccgaggagcagccct

SEQ ID NO: 41059 - DNA, 25 bp, Homo sapien
tgactcagttcttcatacatgcaaa

SEQ ID NO: 41060 - DNA, 25 bp, Homo sapien
tttgctgttgtttgtgctgaaagaa

SEQ ID NO: 41061 - DNA, 25 bp, Homo sapien
aataaatcactcaataggcttaaga

SEQ ID NO: 41062 - DNA, 25 bp, Homo sapien
gttcatagttcattgatctgacgtt

SEQ ID NO: 41063 - DNA, 25 bp, Homo sapien
atgccaagaaactggctttggccat

SEQ ID NO: 41064 - DNA, 25 bp, Homo sapien
gctttggccataatacttgctgtcc

SEQ ID NO: 41065 - DNA, 25 bp, Homo sapien
atacttgctgtccaacaaaatcaca

SEQ ID NO: 41066 - DNA, 25 bp, Homo sapien
cagctgttaatatgcaattgcttgc

SEQ ID NO: 41067 - DNA, 25 bp, Homo sapien
ttagctaaacagcattatttgacaa

SEQ ID NO: 41068 - DNA, 25 bp, Homo sapien
atttgacaaattcccttgaaagaga

SEQ ID NO: 41069 - DNA, 25 bp, Homo sapien
gtgtctagcacactgaatcaagtaa

SEQ ID NO: 41070 - DNA, 25 bp, Homo sapien
aaagacatctcagctatatctcagt

SEQ ID NO: 41071 - DNA, 25 bp, Homo sapien
atctcagctatatctcagttgcata

SEQ ID NO: 41072 - DNA, 25 bp, Homo sapien
ataattgagtgggaacatcttaaat

SEQ ID NO: 41073 - DNA, 25 bp, Homo sapien
taacgtatttggggtttgtgtgtgt

SEQ ID NO: 41074 - DNA, 25 bp, Homo sapien
tagaattgtgtgcagtgtgctgagg

SEQ ID NO: 41075 - DNA, 25 bp, Homo sapien
gcccaaagaattaacaggacaggtg

SEQ ID NO: 41076 - DNA, 25 bp, Homo sapien
aggacaggtgttcatatttaagcct

SEQ ID NO: 41077 - DNA, 25 bp, Homo sapien
agtatttcaagaagtcttactcaat

SEQ ID NO: 41078 - DNA, 25 bp, Homo sapien
agtcttactcaatagttacttggac

SEQ ID NO: 41079 - DNA, 25 bp, Homo sapien
gttacttggacatctggaagaggca

SEQ ID NO: 41080 - DNA, 25 bp, Homo sapien
taaatcacttctttatatgcattat

SEQ ID NO: 41081 - DNA, 25 bp, Homo sapien
gctgtttgccgatgatatgattgtt

SEQ ID NO: 41082 - DNA, 25 bp, Homo sapien
tagaaaaccctaaaggctccttcag

SEQ ID NO: 41083 - DNA, 25 bp, Homo sapien
aaaggctccttcagaaagctcctgg

SEQ ID NO: 41084 - DNA, 25 bp, Homo sapien
aataattctgcaaagtttctggata

SEQ ID NO: 41085 - DNA, 25 bp, Homo sapien
aatgtacacaaatcagtagctcttc

SEQ ID NO: 41086 - DNA, 25 bp, Homo sapien
gtagctcttctatacaccaacagcg

SEQ ID NO: 41087 - DNA, 25 bp, Homo sapien
ttctatacaccaacagcgaccaagc

SEQ ID NO: 41088 - DNA, 25 bp, Homo sapien
tgaaatcaacaactcaggccgggca

SEQ ID NO: 41089 - DNA, 25 bp, Homo sapien
caacaactcaggccgggcattgtct

SEQ ID NO: 41090 - DNA, 25 bp, Homo sapien
gggcattgtctctcatgcctataat

SEQ ID NO: 41091 - DNA, 25 bp, Homo sapien
ttagcggggctgtgatggcgtgcct

SEQ ID NO: 41092 - DNA, 25 bp, Homo sapien
gggacacaggctttattgaacaggt

SEQ ID NO: 41093 - DNA, 25 bp, Homo sapien
gaacaggttaaggtcaaacatttca

SEQ ID NO: 41094 - DNA, 25 bp, Homo sapien
cactcggcctgaagttggatattct

SEQ ID NO: 41095 - DNA, 25 bp, Homo sapien
gttggatattcttgagagcaattct

SEQ ID NO: 41096 - DNA, 25 bp, Homo sapien
gagcaattctgaacctttaccaaca

SEQ ID NO: 41097 - DNA, 25 bp, Homo sapien
gaacctttaccaacattctacatgt

SEQ ID NO: 41098 - DNA, 25 bp, Homo sapien
acattctacatgtttgtcagtataa

SEQ ID NO: 41099 - DNA, 25 bp, Homo sapien
tttgtcagtataaacgattccatat

SEQ ID NO: 41100 - DNA, 25 bp, Homo sapien
atgtaagtggtctatcccatgtgaa

SEQ ID NO: 41101 - DNA, 25 bp, Homo sapien
gtgaattttttgatgctgggtaagc

SEQ ID NO: 41102 - DNA, 25 bp, Homo sapien
gctgggtaagccttgagctacgatt

SEQ ID NO: 41103 - DNA, 25 bp, Homo sapien
tcaagaattgtgtgagcagcggctc

SEQ ID NO: 41104 - DNA, 25 bp, Homo sapien
tgtgagcagcggctcactcctgtaa

SEQ ID NO: 41105 - DNA, 25 bp, Homo sapien
gccaaggcaggcaggtcgcttgagc

SEQ ID NO: 41106 - DNA, 25 bp, Homo sapien
acaagacaaaaccctgttgctccaa

SEQ ID NO: 41107 - DNA, 25 bp, Homo sapien
gcaggaggacagcttgaatccagaa

SEQ ID NO: 41108 - DNA, 25 bp, Homo sapien
gacagcttgaatccagaaggtcagg

SEQ ID NO: 41109 - DNA, 25 bp, Homo sapien
gaaggtcaggaggtcgagactgcag

SEQ ID NO: 41110 - DNA, 25 bp, Homo sapien
gaggtcgagactgcagtgagctgag

SEQ ID NO: 41111 - DNA, 25 bp, Homo sapien
ggcagatcactggaggtcaggggtt

SEQ ID NO: 41112 - DNA, 25 bp, Homo sapien
gtcaggggttcgacatcagcctggc

SEQ ID NO: 41113 - DNA, 25 bp, Homo sapien
aggctgacgcaggagaatcatttga

SEQ ID NO: 41114 - DNA, 25 bp, Homo sapien
gttatgttggactgatattttgaaa

SEQ ID NO: 41115 - DNA, 25 bp, Homo sapien
aagacatttaaactactgactatgc

SEQ ID NO: 41116 - DNA, 25 bp, Homo sapien
aaaatagctgggtgtggcggcgtgc

SEQ ID NO: 41117 - DNA, 25 bp, Homo sapien
gcaggaggatggcatgaacccggga

SEQ ID NO: 41118 - DNA, 25 bp, Homo sapien
catgcccagctaatttagtgatttt

SEQ ID NO: 41119 - DNA, 25 bp, Homo sapien
aaactgagctggtaattataaattc

SEQ ID NO: 41120 - DNA, 25 bp, Homo sapien
agctggtaattataaattctcttcc

SEQ ID NO: 41121 - DNA, 25 bp, Homo sapien
tttttcctcccatcagtgtgataga

SEQ ID NO: 41122 - DNA, 25 bp, Homo sapien
tcctcccatcagtgtgatagatatg

SEQ ID NO: 41123 - DNA, 25 bp, Homo sapien
agatatgattggagttatgttggac

SEQ ID NO: 41124 - DNA, 25 bp, Homo sapien
ggagttatgttggactgatattttg

SEQ ID NO: 41125 - DNA, 25 bp, Homo sapien
ctaggtattgagcctttgtgccctc

SEQ ID NO: 41126 - DNA, 25 bp, Homo sapien
cagaggggaggatccttcagggagg

SEQ ID NO: 41127 - DNA, 25 bp, Homo sapien
gacgggtagcattttcagacacatt

SEQ ID NO: 41128 - DNA, 25 bp, Homo sapien
cgagactcaactgtgtaggctgggc

SEQ ID NO: 41129 - DNA, 25 bp, Homo sapien
gatatctgagtcaatttgtcctaaa

SEQ ID NO: 41130 - DNA, 25 bp, Homo sapien
aactcaaactactattatcttctca

SEQ ID NO: 41131 - DNA, 25 bp, Homo sapien
ttatcttctcagaggccatctcaga

SEQ ID NO: 41132 - DNA, 25 bp, Homo sapien
gccatctcagaggtcacctctgccc

SEQ ID NO: 41133 - DNA, 25 bp, Homo sapien
ttcccctccaggcagagtaaagcat

SEQ ID NO: 41134 - DNA, 25 bp, Homo sapien
aagcattccgtatacttctgtttcc

SEQ ID NO: 41135 - DNA, 25 bp, Homo sapien
tatacttctgtttcctattaaccct

SEQ ID NO: 41136 - DNA, 25 bp, Homo sapien
tattttgttaattcctgtctctcca

SEQ ID NO: 41137 - DNA, 25 bp, Homo sapien
attctagttatttgcaacctccctt

SEQ ID NO: 41138 - DNA, 25 bp, Homo sapien
gtttggccctggagtcctagtagag

SEQ ID NO: 41139 - DNA, 25 bp, Homo sapien
ctagtagagtggaccctccattcct

SEQ ID NO: 41140 - DNA, 25 bp, Homo sapien
tcctttctgagcccaacactaatta

SEQ ID NO: 41141 - DNA, 25 bp, Homo sapien
actaattaattttatgctcctgctg

SEQ ID NO: 41142 - DNA, 25 bp, Homo sapien
gggacttaggtatgcctgctagaca

SEQ ID NO: 41143 - DNA, 25 bp, Homo sapien
tgtcatggatggacacacctctcca

SEQ ID NO: 41144 - DNA, 25 bp, Homo sapien
ctctccacaattccttcaggcatgg

SEQ ID NO: 41145 - DNA, 25 bp, Homo sapien
ggatgagtcctgtcaagggggccac

SEQ ID NO: 41146 - DNA, 25 bp, Homo sapien
aggaggggacaggctctcaggaatc

SEQ ID NO: 41147 - DNA, 25 bp, Homo sapien
tagtatggatgttttaacactatta

SEQ ID NO: 41148 - DNA, 25 bp, Homo sapien
aacactattaattctcccaatccat

SEQ ID NO: 41149 - DNA, 25 bp, Homo sapien
cactattaattctcccaatccatga

SEQ ID NO: 41150 - DNA, 25 bp, Homo sapien
aaatatctttccattcacttgtgtc

SEQ ID NO: 41151 - DNA, 25 bp, Homo sapien
atctttccattcacttgtgtcttct

SEQ ID NO: 41152 - DNA, 25 bp, Homo sapien
atagttttcattgtgcagatctttc

SEQ ID NO: 41153 - DNA, 25 bp, Homo sapien
tcattgtgcagatctttcacttacc

SEQ ID NO: 41154 - DNA, 25 bp, Homo sapien
tgtgcagatctttcacttacctggt

SEQ ID NO: 41155 - DNA, 25 bp, Homo sapien
cagatctttcacttacctggttaaa

SEQ ID NO: 41156 - DNA, 25 bp, Homo sapien
gatctttcacttacctggttaaatt

SEQ ID NO: 41157 - DNA, 25 bp, Homo sapien
ttcattctttttgatattagggtaa

SEQ ID NO: 41158 - DNA, 25 bp, Homo sapien
gaagaaagccaaaatgccgttcaca

SEQ ID NO: 41159 - DNA, 25 bp, Homo sapien
tgccgttcacaagagaatatgtacc

SEQ ID NO: 41160 - DNA, 25 bp, Homo sapien
agagaatatgtaccatgtgcttcca

SEQ ID NO: 41161 - DNA, 25 bp, Homo sapien
aaagagtacatcatgttgcctgggc

SEQ ID NO: 41162 - DNA, 25 bp, Homo sapien
tattctttactttgattggcgtggt

SEQ ID NO: 41163 - DNA, 25 bp, Homo sapien
ttactttgattggcgtggtggtgaa

SEQ ID NO: 41164 - DNA, 25 bp, Homo sapien
tggcgtggtggtgaagggggtatgt

SEQ ID NO: 41165 - DNA, 25 bp, Homo sapien
gggggtatgttcatttgtcaaactc

SEQ ID NO: 41166 - DNA, 25 bp, Homo sapien
gtatgttcatttgtcaaactcatca

SEQ ID NO: 41167 - DNA, 25 bp, Homo sapien
gtcaaactcatcaatttatatacat

SEQ ID NO: 41168 - DNA, 25 bp, Homo sapien
gtaaattcaacctcaataaagtata

SEQ ID NO: 41169 - DNA, 25 bp, Homo sapien
tcagaatttgccatccaaagccctg

SEQ ID NO: 41170 - DNA, 25 bp, Homo sapien
catccaaagccctgtgagacacaag

SEQ ID NO: 41171 - DNA, 25 bp, Homo sapien
ttgacattgtgaggggcgcaccttg

SEQ ID NO: 41172 - DNA, 25 bp, Homo sapien
cgcaccttgggaacttggagcacag

SEQ ID NO: 41173 - DNA, 25 bp, Homo sapien
gggatcttccctggaaatagtctca

SEQ ID NO: 41174 - DNA, 25 bp, Homo sapien
agtctcaggtgtcacttgtcaccct

SEQ ID NO: 41175 - DNA, 25 bp, Homo sapien
ttgtcaccctgcattgggacttcat

SEQ ID NO: 41176 - DNA, 25 bp, Homo sapien
gcattgggacttcatgagactgtga

SEQ ID NO: 41177 - DNA, 25 bp, Homo sapien
gtgcaagaagccagagtctaggtta

SEQ ID NO: 41178 - DNA, 25 bp, Homo sapien
ggttatagttacttcagactctgta

SEQ ID NO: 41179 - DNA, 25 bp, Homo sapien
acgccattctcctcaactggaggat

SEQ ID NO: 41180 - DNA, 25 bp, Homo sapien
gcctggcgggccggagaaggagcgt

SEQ ID NO: 41181 - DNA, 25 bp, Homo sapien
ggagcgttggcgggaggtagcagtc

SEQ ID NO: 41182 - DNA, 25 bp, Homo sapien
aggtagcagtcaattctcaagcaac

SEQ ID NO: 41183 - DNA, 25 bp, Homo sapien
gagtcaactcagggacagggttaga

SEQ ID NO: 41184 - DNA, 25 bp, Homo sapien
gggaggctcagaatgacaggcgtgg

SEQ ID NO: 41185 - DNA, 25 bp, Homo sapien
tgacaggcgtggtcaactccagagg

SEQ ID NO: 41186 - DNA, 25 bp, Homo sapien
actccagaggcggggccatactgaa

SEQ ID NO: 41187 - DNA, 25 bp, Homo sapien
gcggggccatactgaagatctggac

SEQ ID NO: 41188 - DNA, 25 bp, Homo sapien
gaggcggaggcgggaatcatcgctt

SEQ ID NO: 41189 - DNA, 25 bp, Homo sapien
ggcgggaatcatcgcttgagctcag

SEQ ID NO: 41190 - DNA, 25 bp, Homo sapien
gaaaataaattaggcctggcgcggt

SEQ ID NO: 41191 - DNA, 25 bp, Homo sapien
cgactgccgtctggagtggctgagg

SEQ ID NO: 41192 - DNA, 25 bp, Homo sapien
gccgtctggagtggctgagggactg

SEQ ID NO: 41193 - DNA, 25 bp, Homo sapien
gtggctgagggactggatggagggc

SEQ ID NO: 41194 - DNA, 25 bp, Homo sapien
ggactggatggagggctccggacgt

SEQ ID NO: 41195 - DNA, 25 bp, Homo sapien
tggatggagggctccggacgtgtca

SEQ ID NO: 41196 - DNA, 25 bp, Homo sapien
ccaccaccgtgagcaggttcagcag

SEQ ID NO: 41197 - DNA, 25 bp, Homo sapien
ggccaacaccactggggggctggcc

SEQ ID NO: 41198 - DNA, 25 bp, Homo sapien
ctctcctcccgtggggtgggaggcg

SEQ ID NO: 41199 - DNA, 25 bp, Homo sapien
tcctcccgtggggtgggaggcgcgg

SEQ ID NO: 41200 - DNA, 25 bp, Homo sapien
cagcatcgccttcgtggaggagggc

SEQ ID NO: 41201 - DNA, 25 bp, Homo sapien
cgccttcgtggaggagggcgccttc

SEQ ID NO: 41202 - DNA, 25 bp, Homo sapien
gtgtgaggatattccacctgttctt

SEQ ID NO: 41203 - DNA, 25 bp, Homo sapien
ttgagctggtccagtgttgctggag

SEQ ID NO: 41204 - DNA, 25 bp, Homo sapien
ttgctgccttggtctgcagtggcag

SEQ ID NO: 41205 - DNA, 25 bp, Homo sapien
ctgccttggtctgcagtggcagctg

SEQ ID NO: 41206 - DNA, 25 bp, Homo sapien
tttcctacaagcccaacttcatata

SEQ ID NO: 41207 - DNA, 25 bp, Homo sapien
caagcccaacttcatatattctgtg

SEQ ID NO: 41208 - DNA, 25 bp, Homo sapien
gcccaacttcatatattctgtggtt

SEQ ID NO: 41209 - DNA, 25 bp, Homo sapien
aaaattacaagtttccaggaatcag

SEQ ID NO: 41210 - DNA, 25 bp, Homo sapien
agtttccaggaatcagttctgaaat

SEQ ID NO: 41211 - DNA, 25 bp, Homo sapien
tattttgcatctttgaagtgtctta

SEQ ID NO: 41212 - DNA, 25 bp, Homo sapien
aaaaattggtcttggccaggtgcgg

SEQ ID NO: 41213 - DNA, 25 bp, Homo sapien
agtctgaaagctcactctactgatt

SEQ ID NO: 41214 - DNA, 25 bp, Homo sapien
atatgcttaattttattgtccttac

SEQ ID NO: 41215 - DNA, 25 bp, Homo sapien
ttgtccttacatttattgcttctga

SEQ ID NO: 41216 - DNA, 25 bp, Homo sapien
gcttctgagagacaccttttttttt

SEQ ID NO: 41217 - DNA, 25 bp, Homo sapien
aaggcaaggtcttgctctgttgccc

SEQ ID NO: 41218 - DNA, 25 bp, Homo sapien
ttgccccatgctgcagtgaggtggt

SEQ ID NO: 41219 - DNA, 25 bp, Homo sapien
ggtgcaatcatagctcactacagcc

SEQ ID NO: 41220 - DNA, 25 bp, Homo sapien
agcctcctgagtagacatgagagtc

SEQ ID NO: 41221 - DNA, 25 bp, Homo sapien
agacatgagagtctccctgtgtggc

SEQ ID NO: 41222 - DNA, 25 bp, Homo sapien
gctgcctggcctcaggagttcaaga

SEQ ID NO: 41223 - DNA, 25 bp, Homo sapien
acatggcaaaacctcgtttctacta

SEQ ID NO: 41224 - DNA, 25 bp, Homo sapien
caacaccaacacgctcaacaggaaa

SEQ ID NO: 41225 - DNA, 25 bp, Homo sapien
aacaccaacacgctcaacaggaaaa

SEQ ID NO: 41226 - DNA, 25 bp, Homo sapien
caccaacacgctcaacaggaaaacc

SEQ ID NO: 41227 - DNA, 25 bp, Homo sapien
ccaacacgctcaacaggaaaaccac

SEQ ID NO: 41228 - DNA, 25 bp, Homo sapien
aacacgctcaacaggaaaaccacgc

SEQ ID NO: 41229 - DNA, 25 bp, Homo sapien
acacgctcaacaggaaaaccacgcc

SEQ ID NO: 41230 - DNA, 25 bp, Homo sapien
cacgctcaacaggaaaaccacgcct

SEQ ID NO: 41231 - DNA, 25 bp, Homo sapien
gctcaacaggaaaaccacgcctgtg

SEQ ID NO: 41232 - DNA, 25 bp, Homo sapien
tcaacaggaaaaccacgcctgtgta

SEQ ID NO: 41233 - DNA, 25 bp, Homo sapien
caggaaaaccacgcctgtgtagggg

SEQ ID NO: 41234 - DNA, 25 bp, Homo sapien
gaaaaccacgcctgtgtaggggcgc

SEQ ID NO: 41235 - DNA, 25 bp, Homo sapien
gtgagcctatggaagaggagccagc

SEQ ID NO: 41236 - DNA, 25 bp, Homo sapien
ggagccagccttgtgaagtgccaag

SEQ ID NO: 41237 - DNA, 25 bp, Homo sapien
cccctctgatatttcctgtgtgtga

SEQ ID NO: 41238 - DNA, 25 bp, Homo sapien
cctctgatatttcctgtgtgtgaca

SEQ ID NO: 41239 - DNA, 25 bp, Homo sapien
gatatttcctgtgtgtgacatcatt

SEQ ID NO: 41240 - DNA, 25 bp, Homo sapien
atttcctgtgtgtgacatcattgtg

SEQ ID NO: 41241 - DNA, 25 bp, Homo sapien
tgtgtgacatcattgtgtatccccc

SEQ ID NO: 41242 - DNA, 25 bp, Homo sapien
taccctcagacatgtcttgtctgct

SEQ ID NO: 41243 - DNA, 25 bp, Homo sapien
ttcaaaaactgctggtgagcctatg

SEQ ID NO: 41244 - DNA, 25 bp, Homo sapien
aaaactgctggtgagcctatggaag

SEQ ID NO: 41245 - DNA, 25 bp, Homo sapien
actgctggtgagcctatggaagagg

SEQ ID NO: 41246 - DNA, 25 bp, Homo sapien
gtaaatccagtcaacgcgagtgtgt

SEQ ID NO: 41247 - DNA, 25 bp, Homo sapien
ccagtcaacgcgagtgtgtcattcc

SEQ ID NO: 41248 - DNA, 25 bp, Homo sapien
caagcctcgcggtggacagtgggct

SEQ ID NO: 41249 - DNA, 25 bp, Homo sapien
gacagtgggctgatgtttttgccgt

SEQ ID NO: 41250 - DNA, 25 bp, Homo sapien
gctgatgtttttgccgtggaagcgc

SEQ ID NO: 41251 - DNA, 25 bp, Homo sapien
gtggaagcgcacggacgggagaagg

SEQ ID NO: 41252 - DNA, 25 bp, Homo sapien
gatgtcaactaataacaggctaact

SEQ ID NO: 41253 - DNA, 25 bp, Homo sapien
aaggcgttggcgaatatgcggtgcc

SEQ ID NO: 41254 - DNA, 25 bp, Homo sapien
gcggtgccatagtaaaacgatttgc

SEQ ID NO: 41255 - DNA, 25 bp, Homo sapien
aacgatttgcgcatcagaaagtaat

SEQ ID NO: 41256 - DNA, 25 bp, Homo sapien
gaacagtagcaagtgtactcccggc

SEQ ID NO: 41257 - DNA, 25 bp, Homo sapien
gctcctcctcctaagtaactgggat

SEQ ID NO: 41258 - DNA, 25 bp, Homo sapien
gtaactgggattgcaggtgcctgcc

SEQ ID NO: 41259 - DNA, 25 bp, Homo sapien
ccaccacgctcagctaattttttat

SEQ ID NO: 41260 - DNA, 25 bp, Homo sapien
tagaggcggaggtttcaccatgttg

SEQ ID NO: 41261 - DNA, 25 bp, Homo sapien
gaaaacactgtataaaacattctgt

SEQ ID NO: 41262 - DNA, 25 bp, Homo sapien
aaaacactgtattaaacactgtata

SEQ ID NO: 41263 - DNA, 25 bp, Homo sapien
ttttgtgccaaatttgatattcaat

SEQ ID NO: 41264 - DNA, 25 bp, Homo sapien
atttgatttctgaagttgcttttta

SEQ ID NO: 41265 - DNA, 25 bp, Homo sapien
gtgcagttcatttttttgagtgttc

SEQ ID NO: 41266 - DNA, 25 bp, Homo sapien
gtgttctagagagcactcaaataat

SEQ ID NO: 41267 - DNA, 25 bp, Homo sapien
ggagtatgttatttttggattatgc

SEQ ID NO: 41268 - DNA, 25 bp, Homo sapien
aaattagttgaattcacctttcatt

SEQ ID NO: 41269 - DNA, 25 bp, Homo sapien
agttgaattcacctttcatttattt

SEQ ID NO: 41270 - DNA, 25 bp, Homo sapien
tttgtagtaaatatctatttcactt

SEQ ID NO: 41271 - DNA, 25 bp, Homo sapien
aaagtaaccaactattgttcagctt

SEQ ID NO: 41272 - DNA, 25 bp, Homo sapien
taaccaactattgttcagcttttta

SEQ ID NO: 41273 - DNA, 25 bp, Homo sapien
taaaattcacggggtgtacttgcaa

SEQ ID NO: 41274 - DNA, 25 bp, Homo sapien
ttcacggggtgtacttgcaaaacag

SEQ ID NO: 41275 - DNA, 25 bp, Homo sapien
gcaaaacagttcatgcacacctggg

SEQ ID NO: 41276 - DNA, 25 bp, Homo sapien
aacagttcatgcacacctgggaaga

SEQ ID NO: 41277 - DNA, 25 bp, Homo sapien
gaaataagaatgcacagggccgggc

SEQ ID NO: 41278 - DNA, 25 bp, Homo sapien
ccagctagtggggagtctgagggag

SEQ ID NO: 41279 - DNA, 25 bp, Homo sapien
accacccaaggtctgaggagtgcaa

SEQ ID NO: 41280 - DNA, 25 bp, Homo sapien
ggagtgcaagcgcatggcgtgggac

SEQ ID NO: 41281 - DNA, 25 bp, Homo sapien
cgcatggcgtgggactggtaggcag

SEQ ID NO: 41282 - DNA, 25 bp, Homo sapien
cagtgcgcgatccatgggtgaagcc

SEQ ID NO: 41283 - DNA, 25 bp, Homo sapien
catgggtgaagccagctagtctcct

SEQ ID NO: 41284 - DNA, 25 bp, Homo sapien
agaacctttatatatagctcaggga

SEQ ID NO: 41285 - DNA, 25 bp, Homo sapien
ctaactcaaggtttgtacacacacc

SEQ ID NO: 41286 - DNA, 25 bp, Homo sapien
aggtttgtgagtgcagcaatgacac

SEQ ID NO: 41287 - DNA, 25 bp, Homo sapien
agtgcagcaatgacactctgtatct

SEQ ID NO: 41288 - DNA, 25 bp, Homo sapien
ttatgtccatactctgtatctaact

SEQ ID NO: 41289 - DNA, 25 bp, Homo sapien
cagcaggatgtgggttgggtcagat

SEQ ID NO: 41290 - DNA, 25 bp, Homo sapien
ctgattttaatgcttcgttaacttc

SEQ ID NO: 41291 - DNA, 25 bp, Homo sapien
taatgcttcgttaacttcaaaagga

SEQ ID NO: 41292 - DNA, 25 bp, Homo sapien
cattgacacttgaatttttgtcacc

SEQ ID NO: 41293 - DNA, 25 bp, Homo sapien
ttgtcacctttttcctcattagaag

SEQ ID NO: 41294 - DNA, 25 bp, Homo sapien
gtagaaagccttactgtaggatttt

SEQ ID NO: 41295 - DNA, 25 bp, Homo sapien
catctcaccccatattggtcttaaa

SEQ ID NO: 41296 - DNA, 25 bp, Homo sapien
tagactaattaacctaagctacctt

SEQ ID NO: 41297 - DNA, 25 bp, Homo sapien
taagctacctttaacaacgtagaat

SEQ ID NO: 41298 - DNA, 25 bp, Homo sapien
gaatttagatgggttcatatatgtg

SEQ ID NO: 41299 - DNA, 25 bp, Homo sapien
gaatataggacaggggtcctacttt

SEQ ID NO: 41300 - DNA, 25 bp, Homo sapien
caagtgatccaccagagaggagatc

SEQ ID NO: 41301 - DNA, 25 bp, Homo sapien
catcgcccaccaaggcctgggtggg

SEQ ID NO: 41302 - DNA, 25 bp, Homo sapien
ggcctgggtgggtgagaacagtgcc

SEQ ID NO: 41303 - DNA, 25 bp, Homo sapien
agaacagtgcccacaaggagaccct

SEQ ID NO: 41304 - DNA, 25 bp, Homo sapien
gagtaacagagactcacagcccatc

SEQ ID NO: 41305 - DNA, 25 bp, Homo sapien
gcccatccaggtctctgggcaggaa

SEQ ID NO: 41306 - DNA, 25 bp, Homo sapien
gaaggaatcatcacattttacagag

SEQ ID NO: 41307 - DNA, 25 bp, Homo sapien
ggagactgcagctcagagtggggga

SEQ ID NO: 41308 - DNA, 25 bp, Homo sapien
tgggggaagtgtgtgcaccaggcca

SEQ ID NO: 41309 - DNA, 25 bp, Homo sapien
gccacaggcaagtctgtccagagca

SEQ ID NO: 41310 - DNA, 25 bp, Homo sapien
aagtctgtccagagcactggtagga

SEQ ID NO: 41311 - DNA, 25 bp, Homo sapien
aagaatttcaaggccgggcgcggtg

SEQ ID NO: 41312 - DNA, 25 bp, Homo sapien
aatttggtgattgggaggcagttgg

SEQ ID NO: 41313 - DNA, 25 bp, Homo sapien
gggaggcagttggtacctttcaaga

SEQ ID NO: 41314 - DNA, 25 bp, Homo sapien
gtacctttcaagataccaattaaat

SEQ ID NO: 41315 - DNA, 25 bp, Homo sapien
aaaggtttgctcagtatatctatct

SEQ ID NO: 41316 - DNA, 25 bp, Homo sapien
gctcagtatatctatctttaacaca

SEQ ID NO: 41317 - DNA, 25 bp, Homo sapien
cttttctccccttaccataatggat

SEQ ID NO: 41318 - DNA, 25 bp, Homo sapien
cttaccataatggatgctctgtgaa

SEQ ID NO: 41319 - DNA, 25 bp, Homo sapien
tgctctgtgaaaacaagggctttgt

SEQ ID NO: 41320 - DNA, 25 bp, Homo sapien
ctacatctgccatcaccgagagcag

SEQ ID NO: 41321 - DNA, 25 bp, Homo sapien
agagcagtatgtgtagcaggcttac

SEQ ID NO: 41322 - DNA, 25 bp, Homo sapien
acaagaaatacttgtggccgggcgc

SEQ ID NO: 41323 - DNA, 25 bp, Homo sapien
gctgccagtttaactcgagcttctt

SEQ ID NO: 41324 - DNA, 25 bp, Homo sapien
gccagtttaactcgagcttcttact

SEQ ID NO: 41325 - DNA, 25 bp, Homo sapien
cagtttaactcgagcttcttactaa

SEQ ID NO: 41326 - DNA, 25 bp, Homo sapien
ttactaaccctttcactgttcagaa

SEQ ID NO: 41327 - DNA, 25 bp, Homo sapien
aatggatttggcatgatgtggtgga

SEQ ID NO: 41328 - DNA, 25 bp, Homo sapien
tttggcatgatgtggtggagaaaac

SEQ ID NO: 41329 - DNA, 25 bp, Homo sapien
gaaaacattgtattgggaagagagc

SEQ ID NO: 41330 - DNA, 25 bp, Homo sapien
agcagcctggggaaagtcacttacc

SEQ ID NO: 41331 - DNA, 25 bp, Homo sapien
gcctggggaaagtcacttacctact

SEQ ID NO: 41332 - DNA, 25 bp, Homo sapien
gaaagtcacttacctacttgacctc

SEQ ID NO: 41333 - DNA, 25 bp, Homo sapien
gttcaagtagaattcttaagtggta

SEQ ID NO: 41334 - DNA, 25 bp, Homo sapien
gatgttgtattttttcaggaaccaa

SEQ ID NO: 41335 - DNA, 25 bp, Homo sapien
gaggttacataagttaacactagag

SEQ ID NO: 41336 - DNA, 25 bp, Homo sapien
gagattttagtacacactatacata

SEQ ID NO: 41337 - DNA, 25 bp, Homo sapien
tattttgatagttatttctttgata

SEQ ID NO: 41338 - DNA, 25 bp, Homo sapien
ttctttgatacattgcttacgggga

SEQ ID NO: 41339 - DNA, 25 bp, Homo sapien
gcttacggggaatcaactgtttact

SEQ ID NO: 41340 - DNA, 25 bp, Homo sapien
aactgtttactatattacctgaaat

SEQ ID NO: 41341 - DNA, 25 bp, Homo sapien
ttattcactttgcttattcactttt

SEQ ID NO: 41342 - DNA, 25 bp, Homo sapien
ttgcttattcactttttacctatcc

SEQ ID NO: 41343 - DNA, 25 bp, Homo sapien
ttacctatccctaatgcttacattt

SEQ ID NO: 41344 - DNA, 25 bp, Homo sapien
aaatcaatgtgtaagctgaacttta

SEQ ID NO: 41345 - DNA, 25 bp, Homo sapien
taatctgacaatttatcccatactt

SEQ ID NO: 41346 - DNA, 25 bp, Homo sapien
tcccatactttgctagattctctgt

SEQ ID NO: 41347 - DNA, 25 bp, Homo sapien
gattctctgtagtttattaccacct

SEQ ID NO: 41348 - DNA, 25 bp, Homo sapien
accacctttctaaatattctgtcta

SEQ ID NO: 41349 - DNA, 25 bp, Homo sapien
ctgtctaggtaacccagagagtcaa

SEQ ID NO: 41350 - DNA, 25 bp, Homo sapien
ggattctgttaatttcacactctat

SEQ ID NO: 41351 - DNA, 25 bp, Homo sapien
taggctggatgttctgccatcatca

SEQ ID NO: 41352 - DNA, 25 bp, Homo sapien
atcaatttgcattccaagattttgt

SEQ ID NO: 41353 - DNA, 25 bp, Homo sapien
aaggtataaaggttggccaggcatg

SEQ ID NO: 41354 - DNA, 25 bp, Homo sapien
ggaccattggagcccggagggttga

SEQ ID NO: 41355 - DNA, 25 bp, Homo sapien
tggagcccggagggttgaagctgca

SEQ ID NO: 41356 - DNA, 25 bp, Homo sapien
tctgaagtcctttacaacagggtcc

SEQ ID NO: 41357 - DNA, 25 bp, Homo sapien
ggtcatggactgctatcgggccatg

SEQ ID NO: 41358 - DNA, 25 bp, Homo sapien
ggccatggtctgtctgttagaaacc

SEQ ID NO: 41359 - DNA, 25 bp, Homo sapien
gaaaccatgagccctatcgggtcac

SEQ ID NO: 41360 - DNA, 25 bp, Homo sapien
tgagccctatcgggtcacagagcag

SEQ ID NO: 41361 - DNA, 25 bp, Homo sapien
atgagtggcaggcaagcgagcccga

SEQ ID NO: 41362 - DNA, 25 bp, Homo sapien
tcgggggcgccattagattatcaca

SEQ ID NO: 41363 - DNA, 25 bp, Homo sapien
ggatcgcaaaccctgttgtgaactg

SEQ ID NO: 41364 - DNA, 25 bp, Homo sapien
acacgagggatccaggttgcatgct

SEQ ID NO: 41365 - DNA, 25 bp, Homo sapien
ggttgcatgctgcttatgacaatct

SEQ ID NO: 41366 - DNA, 25 bp, Homo sapien
aagagatagaaacgatcctggccaa

SEQ ID NO: 41367 - DNA, 25 bp, Homo sapien
aaatttagagaccttctagctcagt

SEQ ID NO: 41368 - DNA, 25 bp, Homo sapien
gaccttctagctcagtaaaacttcc

SEQ ID NO: 41369 - DNA, 25 bp, Homo sapien
tccagtggtccaaggcctgtcaaga

SEQ ID NO: 41370 - DNA, 25 bp, Homo sapien
ggtccaaggcctgtcaagatagtcc

SEQ ID NO: 41371 - DNA, 25 bp, Homo sapien
ggcctgtcaagatagtccttctaag

SEQ ID NO: 41372 - DNA, 25 bp, Homo sapien
tcctggtacctgtggtccattacat

SEQ ID NO: 41373 - DNA, 25 bp, Homo sapien
ctggtacctgtggtccattacattg

SEQ ID NO: 41374 - DNA, 25 bp, Homo sapien
acattatgctgattgaatccagtaa

SEQ ID NO: 41375 - DNA, 25 bp, Homo sapien
gaaatagcaaacacaccagacttat

SEQ ID NO: 41376 - DNA, 25 bp, Homo sapien
caaacacaccagacttattcatgag

SEQ ID NO: 41377 - DNA, 25 bp, Homo sapien
tcatgagacgtttgcatgccagagg

SEQ ID NO: 41378 - DNA, 25 bp, Homo sapien
aatgagcgagttcacgagatctgat

SEQ ID NO: 41379 - DNA, 25 bp, Homo sapien
tatgtgtttggtagttcctcctgca

SEQ ID NO: 41380 - DNA, 25 bp, Homo sapien
tcctcctgcattaattttccttcat

SEQ ID NO: 41381 - DNA, 25 bp, Homo sapien
attttccttcatgctgccttatgaa

SEQ ID NO: 41382 - DNA, 25 bp, Homo sapien
tgtgagtcagttaacctgtttcctt

SEQ ID NO: 41383 - DNA, 25 bp, Homo sapien
gacagactaatacagtgggcttgtt

SEQ ID NO: 41384 - DNA, 25 bp, Homo sapien
tacagtgggcttgttgacatagttt

SEQ ID NO: 41385 - DNA, 25 bp, Homo sapien
gttgacatagttttgcccttttatg

SEQ ID NO: 41386 - DNA, 25 bp, Homo sapien
gttttgcccttttatgaatgtgatt

SEQ ID NO: 41387 - DNA, 25 bp, Homo sapien
gttaaggaaggacacagtggcccac

SEQ ID NO: 41388 - DNA, 25 bp, Homo sapien
gaccaggctgggccacaaagtgaga

SEQ ID NO: 41389 - DNA, 25 bp, Homo sapien
accggtgatccttaccagtggaagc

SEQ ID NO: 41390 - DNA, 25 bp, Homo sapien
gatccttaccagtggaagcgagcca

SEQ ID NO: 41391 - DNA, 25 bp, Homo sapien
ggaagcgagccatcgagccattggc

SEQ ID NO: 41392 - DNA, 25 bp, Homo sapien
gcgagccatcgagccattggcagaa

SEQ ID NO: 41393 - DNA, 25 bp, Homo sapien
gagccattggcagaaatcctgctga

SEQ ID NO: 41394 - DNA, 25 bp, Homo sapien
ccggaaagccctgcaacattctagg

SEQ ID NO: 41395 - DNA, 25 bp, Homo sapien
tgcaacattctagggttgggggcag

SEQ ID NO: 41396 - DNA, 25 bp, Homo sapien
gccatccacggtttctgggcagagc

SEQ ID NO: 41397 - DNA, 25 bp, Homo sapien
tttctgggcagagccatggtggcag

SEQ ID NO: 41398 - DNA, 25 bp, Homo sapien
tgggcagagccatggtggcaggaga

SEQ ID NO: 41399 - DNA, 25 bp, Homo sapien
gagagagatggctgaagcctgagca

SEQ ID NO: 41400 - DNA, 25 bp, Homo sapien
ggatgagggagtagggcacaaggag

SEQ ID NO: 41401 - DNA, 25 bp, Homo sapien
ggagtagggcacaaggagagttttt

SEQ ID NO: 41402 - DNA, 25 bp, Homo sapien
tggaatcatgggctgcgggtggtgg

SEQ ID NO: 41403 - DNA, 25 bp, Homo sapien
gctcatgcctgtcatatgaacactt

SEQ ID NO: 41404 - DNA, 25 bp, Homo sapien
gcctaagcagcataggaagaccctg

SEQ ID NO: 41405 - DNA, 25 bp, Homo sapien
tgaatggggtgaccctctcagtact

SEQ ID NO: 41406 - DNA, 25 bp, Homo sapien
gaatcaagttgcaagatgttaccct

SEQ ID NO: 41407 - DNA, 25 bp, Homo sapien
gttgcaagatgttaccctttatgcg

SEQ ID NO: 41408 - DNA, 25 bp, Homo sapien
gatgttaccctttatgcgaagaaaa

SEQ ID NO: 41409 - DNA, 25 bp, Homo sapien
aaaagtctggaagcatgtatactaa

SEQ ID NO: 41410 - DNA, 25 bp, Homo sapien
atgcagagtagcattacttcaggga

SEQ ID NO: 41411 - DNA, 25 bp, Homo sapien
gggccgtgtagcatgggcccatgca

SEQ ID NO: 41412 - DNA, 25 bp, Homo sapien
cgtgtagcatgggcccatgcacctc

SEQ ID NO: 41413 - DNA, 25 bp, Homo sapien
cccacagtgcagtgttgtggcccct

SEQ ID NO: 41414 - DNA, 25 bp, Homo sapien
cccctttgccaggctgtgagttgac

SEQ ID NO: 41415 - DNA, 25 bp, Homo sapien
cagcagactccccgggaggggtgaa

SEQ ID NO: 41416 - DNA, 25 bp, Homo sapien
gactccccgggaggggtgaaatgcg

SEQ ID NO: 41417 - DNA, 25 bp, Homo sapien
gtgaaatgcggagggcacagggcct

SEQ ID NO: 41418 - DNA, 25 bp, Homo sapien
gcacagggcctgtgtgagacgcagg

SEQ ID NO: 41419 - DNA, 25 bp, Homo sapien
tggagaggccaaaccaggggcccca

SEQ ID NO: 41420 - DNA, 25 bp, Homo sapien
gtaggtcggaggtgaagtcgggcca

SEQ ID NO: 41421 - DNA, 25 bp, Homo sapien
ttgggcaatacagcaaaaccgtgtc

SEQ ID NO: 41422 - DNA, 25 bp, Homo sapien
gttttttgctctatgtactatactt

SEQ ID NO: 41423 - DNA, 25 bp, Homo sapien
tatacttttttaatagcagtcactg

SEQ ID NO: 41424 - DNA, 25 bp, Homo sapien
aatagcagtcactgaactcacccct

SEQ ID NO: 41425 - DNA, 25 bp, Homo sapien
cccctctcagttatcggatctttgt

SEQ ID NO: 41426 - DNA, 25 bp, Homo sapien
agttatcggatctttgttggttgta

SEQ ID NO: 41427 - DNA, 25 bp, Homo sapien
ctttgttggttgtagtgcacacata

SEQ ID NO: 41428 - DNA, 25 bp, Homo sapien
gtatttctctttgtgtaggtgtccg

SEQ ID NO: 41429 - DNA, 25 bp, Homo sapien
ctctttgtgtaggtgtccgccacca

SEQ ID NO: 41430 - DNA, 25 bp, Homo sapien
accatggttcatttcacaaattaat

SEQ ID NO: 41431 - DNA, 25 bp, Homo sapien
aattaattttcatcacttactttga

SEQ ID NO: 41432 - DNA, 25 bp, Homo sapien
attacttcatacatgcatacagttc

SEQ ID NO: 41433 - DNA, 25 bp, Homo sapien
ctgcagttatccttttccttatgat

SEQ ID NO: 41434 - DNA, 25 bp, Homo sapien
aagtctttagcagctgagcacggtg

SEQ ID NO: 41435 - DNA, 25 bp, Homo sapien
aaagtcaggagttcaccgtcaggag

SEQ ID NO: 41436 - DNA, 25 bp, Homo sapien
gttcaccgtcaggagatcacaggag

SEQ ID NO: 41437 - DNA, 25 bp, Homo sapien
gattgcctgttcctgaagtgacttg

SEQ ID NO: 41438 - DNA, 25 bp, Homo sapien
gaagtgacttgcaatgaacccctca

SEQ ID NO: 41439 - DNA, 25 bp, Homo sapien
gacttgcaatgaacccctcaatatc

SEQ ID NO: 41440 - DNA, 25 bp, Homo sapien
tgaacccctcaatatcagggatcag

SEQ ID NO: 41441 - DNA, 25 bp, Homo sapien
tcagggatcagagtgcctctcttca

SEQ ID NO: 41442 - DNA, 25 bp, Homo sapien
gcctctcttcatgggtagtgagaaa

SEQ ID NO: 41443 - DNA, 25 bp, Homo sapien
gaaaggcagtgccctattctgcagc

SEQ ID NO: 41444 - DNA, 25 bp, Homo sapien
ctagagtcagagttcggcagctgcg

SEQ ID NO: 41445 - DNA, 25 bp, Homo sapien
ttggggttgggggtacacctcagag

SEQ ID NO: 41446 - DNA, 25 bp, Homo sapien
tgggcctaggagggcctgcaggtcc

SEQ ID NO: 41447 - DNA, 25 bp, Homo sapien
tagaagctggggtgttgctctcccc

SEQ ID NO: 41448 - DNA, 25 bp, Homo sapien
tccccgctttctcatagacacagag

SEQ ID NO: 41449 - DNA, 25 bp, Homo sapien
tactgtctgcctgttgtcacacagt

SEQ ID NO: 41450 - DNA, 25 bp, Homo sapien
gtcacacagttcatatgctcgcttg

SEQ ID NO: 41451 - DNA, 25 bp, Homo sapien
gaatctgaaccttggtcccaggatc

SEQ ID NO: 41452 - DNA, 25 bp, Homo sapien
ccactttgccacactgtctaaggtg

SEQ ID NO: 41453 - DNA, 25 bp, Homo sapien
ggtggctttgaactggaacccaagt

SEQ ID NO: 41454 - DNA, 25 bp, Homo sapien
taaaggttggtattcgctcctgaaa

SEQ ID NO: 41455 - DNA, 25 bp, Homo sapien
gcaagactttctaaggacagcagca

SEQ ID NO: 41456 - DNA, 25 bp, Homo sapien
cacctgcccataattaccctagtgt

SEQ ID NO: 41457 - DNA, 25 bp, Homo sapien
taattaccctagtgtttgtcctcat

SEQ ID NO: 41458 - DNA, 25 bp, Homo sapien
caaagcctattaactggcttccctg

SEQ ID NO: 41459 - DNA, 25 bp, Homo sapien
ttaactggcttccctgagttccagc

SEQ ID NO: 41460 - DNA, 25 bp, Homo sapien
gagttccagcatactgtacttggat

SEQ ID NO: 41461 - DNA, 25 bp, Homo sapien
cagcatactgtacttggatctgtcc

SEQ ID NO: 41462 - DNA, 25 bp, Homo sapien
cccactaatctcctatctttaacta

SEQ ID NO: 41463 - DNA, 25 bp, Homo sapien
ttaactaggcttttattgtgtcttt

SEQ ID NO: 41464 - DNA, 25 bp, Homo sapien
gacctttcattagctccttatttaa

SEQ ID NO: 41465 - DNA, 25 bp, Homo sapien
ctccttatttaatcatgtctgtaaa

SEQ ID NO: 41466 - DNA, 25 bp, Homo sapien
aaacgattattatctgcaatgtgtg

SEQ ID NO: 41467 - DNA, 25 bp, Homo sapien
ttatctgcaatgtgtgtgggcctca

SEQ ID NO: 41468 - DNA, 25 bp, Homo sapien
gcaatgtgtgtgggcctcatctaat

SEQ ID NO: 41469 - DNA, 25 bp, Homo sapien
ggagagtaaaaaactctgcctcagg

SEQ ID NO: 41470 - DNA, 25 bp, Homo sapien
actctgcctcaggattacagtgcca

SEQ ID NO: 41471 - DNA, 25 bp, Homo sapien
tgcctcaggattacagtgccaactc

SEQ ID NO: 41472 - DNA, 25 bp, Homo sapien
accttatggatttgggacttgccag

SEQ ID NO: 41473 - DNA, 25 bp, Homo sapien
ccacagtagcatgacccggttattt

SEQ ID NO: 41474 - DNA, 25 bp, Homo sapien
gtagcatgacccggttatttaaatt

SEQ ID NO: 41475 - DNA, 25 bp, Homo sapien
tataaaagtatacatatgccatatg

SEQ ID NO: 41476 - DNA, 25 bp, Homo sapien
atatagggtagggcatggtgaccca

SEQ ID NO: 41477 - DNA, 25 bp, Homo sapien
gataagtgagtctaaaccaggaaaa

SEQ ID NO: 41478 - DNA, 25 bp, Homo sapien
tacctagtattttacaaagccttct

SEQ ID NO: 41479 - DNA, 25 bp, Homo sapien
ttacaaagccttctcttgtcacttt

SEQ ID NO: 41480 - DNA, 25 bp, Homo sapien
tcttgtcactttcatagctactcta

SEQ ID NO: 41481 - DNA, 25 bp, Homo sapien
agctactctaagtgatgggtcctgt

SEQ ID NO: 41482 - DNA, 25 bp, Homo sapien
gtgatgggtcctgtaaccctgatct

SEQ ID NO: 41483 - DNA, 25 bp, Homo sapien
ggtcctgtaaccctgatctattgga

SEQ ID NO: 41484 - DNA, 25 bp, Homo sapien
gattcagagttaacttgtccagggt

SEQ ID NO: 41485 - DNA, 25 bp, Homo sapien
aaaatgtcatatgaggccgggtgta

SEQ ID NO: 41486 - DNA, 25 bp, Homo sapien
agcctgcagtgaaccgtaagcgagc

SEQ ID NO: 41487 - DNA, 25 bp, Homo sapien
gaaccgtaagcgagccactgtactc

SEQ ID NO: 41488 - DNA, 25 bp, Homo sapien
tgcagccatgtaagacaggcctttc

SEQ ID NO: 41489 - DNA, 25 bp, Homo sapien
gacacttcagaatttctcgaactta

SEQ ID NO: 41490 - DNA, 25 bp, Homo sapien
atttaaggcaagtctctacgattat

SEQ ID NO: 41491 - DNA, 25 bp, Homo sapien
aagggctggtatacagaaccaccta

SEQ ID NO: 41492 - DNA, 25 bp, Homo sapien
agaaccacctagactttatcagatt

SEQ ID NO: 41493 - DNA, 25 bp, Homo sapien
tatcagattctgtacctaagatcta

SEQ ID NO: 41494 - DNA, 25 bp, Homo sapien
acaactcagctttctctatggctgg

SEQ ID NO: 41495 - DNA, 25 bp, Homo sapien
ctatggctgggagggacaaactatt

SEQ ID NO: 41496 - DNA, 25 bp, Homo sapien
aagtatagtatgttagtcctgttta

SEQ ID NO: 41497 - DNA, 25 bp, Homo sapien
ttcagaacacagtaggctttccttg

SEQ ID NO: 41498 - DNA, 25 bp, Homo sapien
ggctttccttgggatacctagcaaa

SEQ ID NO: 41499 - DNA, 25 bp, Homo sapien
tctcttctgtgggatgatctcagat

SEQ ID NO: 41500 - DNA, 25 bp, Homo sapien
tgggatgatctcagatgcaggggct

SEQ ID NO: 41501 - DNA, 25 bp, Homo sapien
ctcagatgcaggggctggttttggg

SEQ ID NO: 41502 - DNA, 25 bp, Homo sapien
tgctggggggctggaaagcccctcc

SEQ ID NO: 41503 - DNA, 25 bp, Homo sapien
ttccgcagttaggggtggaccgagc

SEQ ID NO: 41504 - DNA, 25 bp, Homo sapien
gagagatgagatttagggggtgcct

SEQ ID NO: 41505 - DNA, 25 bp, Homo sapien
atttagggggtgcctcatggggtgg

SEQ ID NO: 41506 - DNA, 25 bp, Homo sapien
ggggaagtgtcctgagtgaaggagg

SEQ ID NO: 41507 - DNA, 25 bp, Homo sapien
catcatccctccctgatattgtatt

SEQ ID NO: 41508 - DNA, 25 bp, Homo sapien
tcatccctccctgatattgtattga

SEQ ID NO: 41509 - DNA, 25 bp, Homo sapien
tccctccctgatattgtattgaaaa

SEQ ID NO: 41510 - DNA, 25 bp, Homo sapien
gataatcacatctgacaacttccat

SEQ ID NO: 41511 - DNA, 25 bp, Homo sapien
acatctgacaacttccattaggtac

SEQ ID NO: 41512 - DNA, 25 bp, Homo sapien
gacaacttccattaggtacctatta

SEQ ID NO: 41513 - DNA, 25 bp, Homo sapien
ggtacctattagagcattttttctg

SEQ ID NO: 41514 - DNA, 25 bp, Homo sapien
tagagcattttttctgttaataact

SEQ ID NO: 41515 - DNA, 25 bp, Homo sapien
taatggctccagttatttcttgcac

SEQ ID NO: 41516 - DNA, 25 bp, Homo sapien
ctccagttatttcttgcacgtcatt

SEQ ID NO: 41517 - DNA, 25 bp, Homo sapien
agttatttcttgcacgtcatttttc

SEQ ID NO: 41518 - DNA, 25 bp, Homo sapien
aagcctattatgagccagaggaatc

SEQ ID NO: 41519 - DNA, 25 bp, Homo sapien
atgggtcagacacggtggcttacgc

SEQ ID NO: 41520 - DNA, 25 bp, Homo sapien
tattcatttcaacttgataatcaca

SEQ ID NO: 41521 - DNA, 25 bp, Homo sapien
tggggtttgaaactcccaccaggtg

SEQ ID NO: 41522 - DNA, 25 bp, Homo sapien
aggtgatgagaaggctgactgtgtc

SEQ ID NO: 41523 - DNA, 25 bp, Homo sapien
tgactgtgtcatcagctgttggtga

SEQ ID NO: 41524 - DNA, 25 bp, Homo sapien
agcaaacagtctgggttcagcctct

SEQ ID NO: 41525 - DNA, 25 bp, Homo sapien
gcagagatgcaagccaggtagaagg

SEQ ID NO: 41526 - DNA, 25 bp, Homo sapien
gaaaaaaatgttctagccacttagc

SEQ ID NO: 41527 - DNA, 25 bp, Homo sapien
agccacttagccattaaatagctca

SEQ ID NO: 41528 - DNA, 25 bp, Homo sapien
aaatagctcatcaaacagcctttga

SEQ ID NO: 41529 - DNA, 25 bp, Homo sapien
cagcctttgaggaccaactgtgctc

SEQ ID NO: 41530 - DNA, 25 bp, Homo sapien
aaagagcttatccttgcactatcac

SEQ ID NO: 41531 - DNA, 25 bp, Homo sapien
atccttgcactatcacacatacata

SEQ ID NO: 41532 - DNA, 25 bp, Homo sapien
aaatcttgacctttgtacacacacc

SEQ ID NO: 41533 - DNA, 25 bp, Homo sapien
tgtacacacacctttttaacactct

SEQ ID NO: 41534 - DNA, 25 bp, Homo sapien
ttttaacactctctactgaaatgga

SEQ ID NO: 41535 - DNA, 25 bp, Homo sapien
aaacatttctgctaagtactgtagt

SEQ ID NO: 41536 - DNA, 25 bp, Homo sapien
gtagtacagtgcttgcctaaaggga

SEQ ID NO: 41537 - DNA, 25 bp, Homo sapien
gggaaagcatgtgtgcagttgtttg

SEQ ID NO: 41538 - DNA, 25 bp, Homo sapien
gtgcagttgtttgagttgtgagcta

SEQ ID NO: 41539 - DNA, 25 bp, Homo sapien
gtgagctaaattagctgcttttttt

SEQ ID NO: 41540 - DNA, 25 bp, Homo sapien
tttggcagacatttttcttgaaaag

SEQ ID NO: 41541 - DNA, 25 bp, Homo sapien
ggatgaagtgagcctatcactttaa

SEQ ID NO: 41542 - DNA, 25 bp, Homo sapien
aaaacaactgaggctaggcacagtg

SEQ ID NO: 41543 - DNA, 25 bp, Homo sapien
cccatctgtgaagttctagtctgtg

SEQ ID NO: 41544 - DNA, 25 bp, Homo sapien
gaagttctagtctgtgcagtcacaa

SEQ ID NO: 41545 - DNA, 25 bp, Homo sapien
gtctgtgcagtcacaattgaccact

SEQ ID NO: 41546 - DNA, 25 bp, Homo sapien
acaattgaccactgcaggttttaac

SEQ ID NO: 41547 - DNA, 25 bp, Homo sapien
ctgcaggttttaacaagaggaccct

SEQ ID NO: 41548 - DNA, 25 bp, Homo sapien
gtggggacacaacagacttcaattc

SEQ ID NO: 41549 - DNA, 25 bp, Homo sapien
caacagacttcaattctttagccag

SEQ ID NO: 41550 - DNA, 25 bp, Homo sapien
gtaagtttcaaaggccaagtgtagt

SEQ ID NO: 41551 - DNA, 25 bp, Homo sapien
ggaagctgaggtatgagaactgctt

SEQ ID NO: 41552 - DNA, 25 bp, Homo sapien
tctcaacccctgcattacatgatta

SEQ ID NO: 41553 - DNA, 25 bp, Homo sapien
acccctgcattacatgattaggaca

SEQ ID NO: 41554 - DNA, 25 bp, Homo sapien
actataagcttgctggtcttatctc

SEQ ID NO: 41555 - DNA, 25 bp, Homo sapien
cttatctcagacatttaactcttca

SEQ ID NO: 41556 - DNA, 25 bp, Homo sapien
taactcttcattgtatttttctgtg

SEQ ID NO: 41557 - DNA, 25 bp, Homo sapien
tatttttctgtgatagtctaagtgc

SEQ ID NO: 41558 - DNA, 25 bp, Homo sapien
gtctaagtgcttctgtagtagatac

SEQ ID NO: 41559 - DNA, 25 bp, Homo sapien
gtagtagatacttttcaagtttgtt

SEQ ID NO: 41560 - DNA, 25 bp, Homo sapien
gacaaaaatcaggcacttctaatat

SEQ ID NO: 41561 - DNA, 25 bp, Homo sapien
taagaaaagggtgtgcttgctgggc

SEQ ID NO: 41562 - DNA, 25 bp, Homo sapien
tgggcacggtggcttgtgcctgtac

SEQ ID NO: 41563 - DNA, 25 bp, Homo sapien
agcctgacgaacatggtgaagcccc

SEQ ID NO: 41564 - DNA, 25 bp, Homo sapien
acgaacatggtgaagccccatctct

SEQ ID NO: 41565 - DNA, 25 bp, Homo sapien
agggcagggtgaacagcttagaact

SEQ ID NO: 41566 - DNA, 25 bp, Homo sapien
ctataggagcggcgcctagttgcct

SEQ ID NO: 41567 - DNA, 25 bp, Homo sapien
ggaatattgtctcctgtggtgtaca

SEQ ID NO: 41568 - DNA, 25 bp, Homo sapien
ctgtggtgtacaggcctgctagagg

SEQ ID NO: 41569 - DNA, 25 bp, Homo sapien
gcctgctagaggcggcatggagtct

SEQ ID NO: 41570 - DNA, 25 bp, Homo sapien
gcggcatggagtctctggattggtc

SEQ ID NO: 41571 - DNA, 25 bp, Homo sapien
ggattggtcagtttgcagatcaagg

SEQ ID NO: 41572 - DNA, 25 bp, Homo sapien
tcaagggcatactcctggctgagcc

SEQ ID NO: 41573 - DNA, 25 bp, Homo sapien
gctgagcccttgctatgcataagac

SEQ ID NO: 41574 - DNA, 25 bp, Homo sapien
taagacttggctaaccccaggaggg

SEQ ID NO: 41575 - DNA, 25 bp, Homo sapien
cccaggaggggcagtcattccccag

SEQ ID NO: 41576 - DNA, 25 bp, Homo sapien
gcctccagctcaattgtcaacctgg

SEQ ID NO: 41577 - DNA, 25 bp, Homo sapien
ggatcttacaagtccacaaggtcat

SEQ ID NO: 41578 - DNA, 25 bp, Homo sapien
gatgccagggaaaaacttccccctg

SEQ ID NO: 41579 - DNA, 25 bp, Homo sapien
tccccctgaaaggcgcacaagcagg

SEQ ID NO: 41580 - DNA, 25 bp, Homo sapien
aaggcgcacaagcaggcggaaccca

SEQ ID NO: 41581 - DNA, 25 bp, Homo sapien
caggcggaacccagccaataatgta

SEQ ID NO: 41582 - DNA, 25 bp, Homo sapien
acattaggatgcaaccagaaggtac

SEQ ID NO: 41583 - DNA, 25 bp, Homo sapien
gaaggtacattgcaaacccactgct

SEQ ID NO: 41584 - DNA, 25 bp, Homo sapien
gcaaacccactgcttgaaaggtaat

SEQ ID NO: 41585 - DNA, 25 bp, Homo sapien
ggcttttgaaagtctgcgagaggct

SEQ ID NO: 41586 - DNA, 25 bp, Homo sapien
ggatcacttaagtgcagtgagccgt

SEQ ID NO: 41587 - DNA, 25 bp, Homo sapien
ctccgcagctcagcaaagctactgt

SEQ ID NO: 41588 - DNA, 25 bp, Homo sapien
gcagctcagcaaagctactgtagct

SEQ ID NO: 41589 - DNA, 25 bp, Homo sapien
aagctactgtagctagactgcctct

SEQ ID NO: 41590 - DNA, 25 bp, Homo sapien
gggacagatcacctggggcaaatgc

SEQ ID NO: 41591 - DNA, 25 bp, Homo sapien
gacagatcacctggggcaaatgctg

SEQ ID NO: 41592 - DNA, 25 bp, Homo sapien
ttcagcagtctcaaaggtccctgcc

SEQ ID NO: 41593 - DNA, 25 bp, Homo sapien
gtctcctgaccaggagacacccccc

SEQ ID NO: 41594 - DNA, 25 bp, Homo sapien
gcaggggccaaaagataccccatac

SEQ ID NO: 41595 - DNA, 25 bp, Homo sapien
gccaaaagataccccatacaagaga

SEQ ID NO: 41596 - DNA, 25 bp, Homo sapien
agataccccatacaagagagctctg

SEQ ID NO: 41597 - DNA, 25 bp, Homo sapien
gaaaggtatagcatcaatatcaaca

SEQ ID NO: 41598 - DNA, 25 bp, Homo sapien
ccccacggagtctggaccatggagg

SEQ ID NO: 41599 - DNA, 25 bp, Homo sapien
accatggaggagcgaggtctggccc

SEQ ID NO: 41600 - DNA, 25 bp, Homo sapien
cacatggcgctggtgcagctggagc

SEQ ID NO: 41601 - DNA, 25 bp, Homo sapien
ccgcttcctggtcagccagaacgtg

SEQ ID NO: 41602 - DNA, 25 bp, Homo sapien
ccagaacgtggacgggctccatgtg

SEQ ID NO: 41603 - DNA, 25 bp, Homo sapien
tcctccatgggccctgcaggagggg

SEQ ID NO: 41604 - DNA, 25 bp, Homo sapien
gcaggaggggagacccaccttgaag

SEQ ID NO: 41605 - DNA, 25 bp, Homo sapien
gggatcagtagaggcttgcactgcc

SEQ ID NO: 41606 - DNA, 25 bp, Homo sapien
tgcactgcctttggggctggaggga

SEQ ID NO: 41607 - DNA, 25 bp, Homo sapien
ggctggagggagacgtgggtccacc

SEQ ID NO: 41608 - DNA, 25 bp, Homo sapien
tgggtccaccaggcttctggaaaag

SEQ ID NO: 41609 - DNA, 25 bp, Homo sapien
tgcctcctgcgattaaccagttcac

SEQ ID NO: 41610 - DNA, 25 bp, Homo sapien
gaccgccaaacagctactcagctgc

SEQ ID NO: 41611 - DNA, 25 bp, Homo sapien
gctgcttaagctggcccacaagtac

SEQ ID NO: 41612 - DNA, 25 bp, Homo sapien
gagaagaagtctgttgtcccaggcc

SEQ ID NO: 41613 - DNA, 25 bp, Homo sapien
aaagctgctgtcaaaggggacgccc

SEQ ID NO: 41614 - DNA, 25 bp, Homo sapien
accacctgtccttcgagcaggagtt

SEQ ID NO: 41615 - DNA, 25 bp, Homo sapien
gagcaggagttaacaccatcaccac

SEQ ID NO: 41616 - DNA, 25 bp, Homo sapien
aaatgggggtcccttactgcattat

SEQ ID NO: 41617 - DNA, 25 bp, Homo sapien
cacaggaagacctgcaccactgtcg

SEQ ID NO: 41618 - DNA, 25 bp, Homo sapien
ccactgtcggcttcacacaggtgaa

SEQ ID NO: 41619 - DNA, 25 bp, Homo sapien
cgatgagatccactgtcactggggc

SEQ ID NO: 41620 - DNA, 25 bp, Homo sapien
gtgttacccttctgcagtgtgaatc

SEQ ID NO: 41621 - DNA, 25 bp, Homo sapien
cagtgtgaatctggacaggccaccc

SEQ ID NO: 41622 - DNA, 25 bp, Homo sapien
tcacaagccactcaattcacacatg

SEQ ID NO: 41623 - DNA, 25 bp, Homo sapien
atcgagacataattcttcctcctgg

SEQ ID NO: 41624 - DNA, 25 bp, Homo sapien
tgggccctgggagtctcagggatga

SEQ ID NO: 41625 - DNA, 25 bp, Homo sapien
gaacagacagggtcacatgtcacac

SEQ ID NO: 41626 - DNA, 25 bp, Homo sapien
catgtcacactgtgctcagtcaagc

SEQ ID NO: 41627 - DNA, 25 bp, Homo sapien
tcagtcaagctgtgtggagcccacc

SEQ ID NO: 41628 - DNA, 25 bp, Homo sapien
gccatctgtgcaggtgggcttttgc

SEQ ID NO: 41629 - DNA, 25 bp, Homo sapien
gggcttttgcatcaatctaaggcag

SEQ ID NO: 41630 - DNA, 25 bp, Homo sapien
ggcaggaatcagctggtaagagcat

SEQ ID NO: 41631 - DNA, 25 bp, Homo sapien
aatacagtcttataatcccatagga

SEQ ID NO: 41632 - DNA, 25 bp, Homo sapien
atcccataggaccaccatcatatat

SEQ ID NO: 41633 - DNA, 25 bp, Homo sapien
atatataggtgcatcgttgacggaa

SEQ ID NO: 41634 - DNA, 25 bp, Homo sapien
gacggaaacgtcattatgcaacaca

SEQ ID NO: 41635 - DNA, 25 bp, Homo sapien
aacacatgactgtacctagtttacc

SEQ ID NO: 41636 - DNA, 25 bp, Homo sapien
gtcctgtggatcttaatttccagac

SEQ ID NO: 41637 - DNA, 25 bp, Homo sapien
tccagacttgctagtgaaagccatc

SEQ ID NO: 41638 - DNA, 25 bp, Homo sapien
gaagcccagaggttgggccttattg

SEQ ID NO: 41639 - DNA, 25 bp, Homo sapien
gggccttattgcttagcctgtttgg

SEQ ID NO: 41640 - DNA, 25 bp, Homo sapien
attgcttagcctgtttgggataaag

SEQ ID NO: 41641 - DNA, 25 bp, Homo sapien
aagagtcaacttgaggccgagcacg

SEQ ID NO: 41642 - DNA, 25 bp, Homo sapien
aacactaggtaattatgctttttat

SEQ ID NO: 41643 - DNA, 25 bp, Homo sapien
ggcactctgcctgattttattacaa

SEQ ID NO: 41644 - DNA, 25 bp, Homo sapien
atgtttctgtattatgtgtgtgtgt

SEQ ID NO: 41645 - DNA, 25 bp, Homo sapien
tatatatatgcattttccgtcccac

SEQ ID NO: 41646 - DNA, 25 bp, Homo sapien
gcactgaacgtaggggcattagagt

SEQ ID NO: 41647 - DNA, 25 bp, Homo sapien
ggttgcctcaggttagttttgtgtg

SEQ ID NO: 41648 - DNA, 25 bp, Homo sapien
gttttgtgtggggttgaatgccttt

SEQ ID NO: 41649 - DNA, 25 bp, Homo sapien
ggttgaatgccttttatttctgact

SEQ ID NO: 41650 - DNA, 25 bp, Homo sapien
gacttcatttctatctgccaatgga

SEQ ID NO: 41651 - DNA, 25 bp, Homo sapien
gaagtggatcctggctaggtgcagt

SEQ ID NO: 41652 - DNA, 25 bp, Homo sapien
gtgtcatgagacacacctgtagtcc

SEQ ID NO: 41653 - DNA, 25 bp, Homo sapien
ttcagtctaccagaaaagttaaatc

SEQ ID NO: 41654 - DNA, 25 bp, Homo sapien
aatctgttgttggacgtagggggct

SEQ ID NO: 41655 - DNA, 25 bp, Homo sapien
ggacgtagggggctttcagaaacat

SEQ ID NO: 41656 - DNA, 25 bp, Homo sapien
aaacatgcctcttatatcaatttcc

SEQ ID NO: 41657 - DNA, 25 bp, Homo sapien
atatcaatttccactatctttcaag

SEQ ID NO: 41658 - DNA, 25 bp, Homo sapien
tttccactatctttcaagttaccta

SEQ ID NO: 41659 - DNA, 25 bp, Homo sapien
ttcaagttacctaaaggcaccaggc

SEQ ID NO: 41660 - DNA, 25 bp, Homo sapien
aaaggcctagagtgcaaattatgtg

SEQ ID NO: 41661 - DNA, 25 bp, Homo sapien
ttaaatcacactgttcagtctttaa

SEQ ID NO: 41662 - DNA, 25 bp, Homo sapien
aaatttgtctcattgtgatagccag

SEQ ID NO: 41663 - DNA, 25 bp, Homo sapien
tgtctcattgtgatagccagaaaca

SEQ ID NO: 41664 - DNA, 25 bp, Homo sapien
ttggatacggagtctcactctgttg

SEQ ID NO: 41665 - DNA, 25 bp, Homo sapien
gggataggtttgtctgttttggctt

SEQ ID NO: 41666 - DNA, 25 bp, Homo sapien
taggtttgtctgttttggcttttgg

SEQ ID NO: 41667 - DNA, 25 bp, Homo sapien
ttttggcttttggctttcatgcgag

SEQ ID NO: 41668 - DNA, 25 bp, Homo sapien
ggcttttggctttcatgcgagcaga

SEQ ID NO: 41669 - DNA, 25 bp, Homo sapien
ggctttcatgcgagcagaagtagct

SEQ ID NO: 41670 - DNA, 25 bp, Homo sapien
gcagaagtagctcctgctctaggca

SEQ ID NO: 41671 - DNA, 25 bp, Homo sapien
tcctgctctaggcagcttgaggcag

SEQ ID NO: 41672 - DNA, 25 bp, Homo sapien
tgctctaggcagcttgaggcagaaa

SEQ ID NO: 41673 - DNA, 25 bp, Homo sapien
ctaggcagcttgaggcagaaagaga

SEQ ID NO: 41674 - DNA, 25 bp, Homo sapien
acaattgagttgacctacctccgtc

SEQ ID NO: 41675 - DNA, 25 bp, Homo sapien
tcaagaagcgctacgtctggctcag

SEQ ID NO: 41676 - DNA, 25 bp, Homo sapien
aagagtcctgagtggcagatgtgtc

SEQ ID NO: 41677 - DNA, 25 bp, Homo sapien
gagtggcagatgtgtcactccatcc

SEQ ID NO: 41678 - DNA, 25 bp, Homo sapien
gcgccgtggagcgcgtagacgaggg

SEQ ID NO: 41679 - DNA, 25 bp, Homo sapien
tggagcgcgtagacgagggcgcctt

SEQ ID NO: 41680 - DNA, 25 bp, Homo sapien
caactgccccacgtgatgcaggtgg

SEQ ID NO: 41681 - DNA, 25 bp, Homo sapien
tgccccacgtgatgcaggtggtgac

SEQ ID NO: 41682 - DNA, 25 bp, Homo sapien
tgcaggtggtgacgcaggacggcac

SEQ ID NO: 41683 - DNA, 25 bp, Homo sapien
ccacctacctccagtgcaagaatgt

SEQ ID NO: 41684 - DNA, 25 bp, Homo sapien
tacctccagtgcaagaatgtgaatg

SEQ ID NO: 41685 - DNA, 25 bp, Homo sapien
gctctcggccttgcgcaaggccagc

SEQ ID NO: 41686 - DNA, 25 bp, Homo sapien
gggtatcaacacaatatcagaactc

SEQ ID NO: 41687 - DNA, 25 bp, Homo sapien
atcagaactcaattagcttccaacc

SEQ ID NO: 41688 - DNA, 25 bp, Homo sapien
aattagcttccaaccatcagcaggt

SEQ ID NO: 41689 - DNA, 25 bp, Homo sapien
ttggcacctcagcgacataagcagt

SEQ ID NO: 41690 - DNA, 25 bp, Homo sapien
gcagtttcaggtgtgcatacaatga

SEQ ID NO: 41691 - DNA, 25 bp, Homo sapien
atgacgagtcaagggtcccagtccc

SEQ ID NO: 41692 - DNA, 25 bp, Homo sapien
gtgagggcttcagctgaatctttgt

SEQ ID NO: 41693 - DNA, 25 bp, Homo sapien
tcagctgaatctttgttgctcctcc

SEQ ID NO: 41694 - DNA, 25 bp, Homo sapien
aaggaccaccaggaagcacctgggc

SEQ ID NO: 41695 - DNA, 25 bp, Homo sapien
atataaaacttaaccggcattcctg

SEQ ID NO: 41696 - DNA, 25 bp, Homo sapien
ttaaccggcattcctgggtgtggtg

SEQ ID NO: 41697 - DNA, 25 bp, Homo sapien
agtgactactacatgacctggatcc

SEQ ID NO: 41698 - DNA, 25 bp, Homo sapien
gtgactactacatgacctggatccg

SEQ ID NO: 41699 - DNA, 25 bp, Homo sapien
actacatgacctggatccgccaggc

SEQ ID NO: 41700 - DNA, 25 bp, Homo sapien
tacatgacctggatccgccaggctc

SEQ ID NO: 41701 - DNA, 25 bp, Homo sapien
gccaggctccagggaaggggctgaa

SEQ ID NO: 41702 - DNA, 25 bp, Homo sapien
caggctccagggaaggggctgaaat

SEQ ID NO: 41703 - DNA, 25 bp, Homo sapien
ggctccagggaaggggctgaaatgg

SEQ ID NO: 41704 - DNA, 25 bp, Homo sapien
ggaaggggctgaaatggtttcatac

SEQ ID NO: 41705 - DNA, 25 bp, Homo sapien
ggggctgaaatggtttcatacatta

SEQ ID NO: 41706 - DNA, 25 bp, Homo sapien
gaaatggtttcatacattagtagta

SEQ ID NO: 41707 - DNA, 25 bp, Homo sapien
atggtttcatacattagtagtagtg

SEQ ID NO: 41708 - DNA, 25 bp, Homo sapien
tacgatgaggcatccagggacccta

SEQ ID NO: 41709 - DNA, 25 bp, Homo sapien
ccctcaaatcccactctgttgagac

SEQ ID NO: 41710 - DNA, 25 bp, Homo sapien
gacagcatctttatcatctctgcat

SEQ ID NO: 41711 - DNA, 25 bp, Homo sapien
caggagggaaaggttcccttctgct

SEQ ID NO: 41712 - DNA, 25 bp, Homo sapien
ggttcccttctgcttaattgtcaga

SEQ ID NO: 41713 - DNA, 25 bp, Homo sapien
aattgtcagacaagcagttgagtta

SEQ ID NO: 41714 - DNA, 25 bp, Homo sapien
tattgttgactatacacagcacatt

SEQ ID NO: 41715 - DNA, 25 bp, Homo sapien
cacagcacattttagggctctatca

SEQ ID NO: 41716 - DNA, 25 bp, Homo sapien
gttagagacctggactgggcaaaat

SEQ ID NO: 41717 - DNA, 25 bp, Homo sapien
tgtggtaatgtgcaccagtggtccc

SEQ ID NO: 41718 - DNA, 25 bp, Homo sapien
gtctctaaatacatcaatcaaataa

SEQ ID NO: 41719 - DNA, 25 bp, Homo sapien
ggccaggacatcttagccattctct

SEQ ID NO: 41720 - DNA, 25 bp, Homo sapien
ttagccattctctccattgttatgt

SEQ ID NO: 41721 - DNA, 25 bp, Homo sapien
attctctccattgttatgtgttttg

SEQ ID NO: 41722 - DNA, 25 bp, Homo sapien
tgtgttttggtccatttccattctt

SEQ ID NO: 41723 - DNA, 25 bp, Homo sapien
catttccattcttccctggtaaagt

SEQ ID NO: 41724 - DNA, 25 bp, Homo sapien
tcttccctggtaaagtctgatctca

SEQ ID NO: 41725 - DNA, 25 bp, Homo sapien
aaacattagaaaacagctccacctg

SEQ ID NO: 41726 - DNA, 25 bp, Homo sapien
aaaacagctccacctgatacaggat

SEQ ID NO: 41727 - DNA, 25 bp, Homo sapien
aaagcgtatagatatcctgctagtt

SEQ ID NO: 41728 - DNA, 25 bp, Homo sapien
agatatcctgctagttggaaggacc

SEQ ID NO: 41729 - DNA, 25 bp, Homo sapien
atatgtttctaaatcatgaggcatt

SEQ ID NO: 41730 - DNA, 25 bp, Homo sapien
actgtttcatctaagaggggaagct

SEQ ID NO: 41731 - DNA, 25 bp, Homo sapien
tcatctaagaggggaagctcgggaa

SEQ ID NO: 41732 - DNA, 25 bp, Homo sapien
tgggtttgaggacttaaggggccag

SEQ ID NO: 41733 - DNA, 25 bp, Homo sapien
agtgaatggcacagcgaggcgaagc

SEQ ID NO: 41734 - DNA, 25 bp, Homo sapien
ggcacagcgaggcgaagctgtgcag

SEQ ID NO: 41735 - DNA, 25 bp, Homo sapien
cccaggtggcgtctgacacaaggtg

SEQ ID NO: 41736 - DNA, 25 bp, Homo sapien
ctcccatagcctccgtggggaaagc

SEQ ID NO: 41737 - DNA, 25 bp, Homo sapien
tagcctccgtggggaaagcactgag

SEQ ID NO: 41738 - DNA, 25 bp, Homo sapien
tggggaaagcactgaggcaggatca

SEQ ID NO: 41739 - DNA, 25 bp, Homo sapien
tgaggcaggatcagatggaaccaga

SEQ ID NO: 41740 - DNA, 25 bp, Homo sapien
ttaaagacatcagtctcggccgggc

SEQ ID NO: 41741 - DNA, 25 bp, Homo sapien
ctgtccttcaccctggaggaggagg

SEQ ID NO: 41742 - DNA, 25 bp, Homo sapien
ggagcctggcaaattcagcgcctat

SEQ ID NO: 41743 - DNA, 25 bp, Homo sapien
ggacgactacgtcttttactgcaaa

SEQ ID NO: 41744 - DNA, 25 bp, Homo sapien
gggaaagcttgtggcatctgctccc

SEQ ID NO: 41745 - DNA, 25 bp, Homo sapien
gccacctcacctgcaggtaggaatc

SEQ ID NO: 41746 - DNA, 25 bp, Homo sapien
taccaacctggaggccctggaagaa

SEQ ID NO: 41747 - DNA, 25 bp, Homo sapien
attggtgcagcgcaagggactctcg

SEQ ID NO: 41748 - DNA, 25 bp, Homo sapien
cggaggaggacattttcatgcccct

SEQ ID NO: 41749 - DNA, 25 bp, Homo sapien
tcatgcccctgcagacgggaagctg

SEQ ID NO: 41750 - DNA, 25 bp, Homo sapien
gaagctgcgttctcgaacactaggc

SEQ ID NO: 41751 - DNA, 25 bp, Homo sapien
tgaagaccctgttcctgggtgtcac

SEQ ID NO: 41752 - DNA, 25 bp, Homo sapien
ggagctttggcctttgtgttcaagc

SEQ ID NO: 41753 - DNA, 25 bp, Homo sapien
tggcctttgtgttcaagctaatgga

SEQ ID NO: 41754 - DNA, 25 bp, Homo sapien
gtgttcaagctaatggagggtgagc

SEQ ID NO: 41755 - DNA, 25 bp, Homo sapien
ctgggcttctggaatatcttgctaa

SEQ ID NO: 41756 - DNA, 25 bp, Homo sapien
ggcttctggaatatcttgctaatgg

SEQ ID NO: 41757 - DNA, 25 bp, Homo sapien
gaatatcttgctaatggtagtgtct

SEQ ID NO: 41758 - DNA, 25 bp, Homo sapien
agatctgtgatctatgataggccag

SEQ ID NO: 41759 - DNA, 25 bp, Homo sapien
gtggacctaagatcagccacatagg

SEQ ID NO: 41760 - DNA, 25 bp, Homo sapien
aagatcagccacataggtcatctgt

SEQ ID NO: 41761 - DNA, 25 bp, Homo sapien
tcagccacataggtcatctgtgatt

SEQ ID NO: 41762 - DNA, 25 bp, Homo sapien
tgtgattgtgtcccagtaaagtaag

SEQ ID NO: 41763 - DNA, 25 bp, Homo sapien
gattcagattagatcctggagctct

SEQ ID NO: 41764 - DNA, 25 bp, Homo sapien
cctggagctcttaacactgtgcttt

SEQ ID NO: 41765 - DNA, 25 bp, Homo sapien
ttgctgcccagatcttctatgttaa

SEQ ID NO: 41766 - DNA, 25 bp, Homo sapien
gtatgttagtaaatcctggaggagg

SEQ ID NO: 41767 - DNA, 25 bp, Homo sapien
gaaggccattgactggtgacatggc

SEQ ID NO: 41768 - DNA, 25 bp, Homo sapien
actggtgacatggcggtggcatcag

SEQ ID NO: 41769 - DNA, 25 bp, Homo sapien
ggcggtggcatcagtcatagtaaat

SEQ ID NO: 41770 - DNA, 25 bp, Homo sapien
tgataccaactgattgcttcccatg

SEQ ID NO: 41771 - DNA, 25 bp, Homo sapien
gctggtgaagtgtgatagtttaagt

SEQ ID NO: 41772 - DNA, 25 bp, Homo sapien
gtattctttaccactactctaagaa

SEQ ID NO: 41773 - DNA, 25 bp, Homo sapien
gaagtaggtactgggccaggcgcag

SEQ ID NO: 41774 - DNA, 25 bp, Homo sapien
ttagatcatctataggggtacccaa

SEQ ID NO: 41775 - DNA, 25 bp, Homo sapien
ggggtacccaacacacagtgggagc

SEQ ID NO: 41776 - DNA, 25 bp, Homo sapien
acacacagtgggagcacttggtcaa

SEQ ID NO: 41777 - DNA, 25 bp, Homo sapien
tggtcaacaatattagtttcctttc

SEQ ID NO: 41778 - DNA, 25 bp, Homo sapien
agaataccaagacagagattacagt

SEQ ID NO: 41779 - DNA, 25 bp, Homo sapien
gattacagtagtatgttatttcatt

SEQ ID NO: 41780 - DNA, 25 bp, Homo sapien
tatttaattcacaaacacttgagtt

SEQ ID NO: 41781 - DNA, 25 bp, Homo sapien
aaacacttgagttatctattataag

SEQ ID NO: 41782 - DNA, 25 bp, Homo sapien
ttgattgagggttaagtgagccatg

SEQ ID NO: 41783 - DNA, 25 bp, Homo sapien
gagccatgatcccagttctgtagga

SEQ ID NO: 41784 - DNA, 25 bp, Homo sapien
gatcccagttctgtaggaattttga

SEQ ID NO: 41785 - DNA, 25 bp, Homo sapien
tttaaattctctggccccaatttat

SEQ ID NO: 41786 - DNA, 25 bp, Homo sapien
aattctctggccccaatttattgaa

SEQ ID NO: 41787 - DNA, 25 bp, Homo sapien
ctctggccccaatttattgaacaca

SEQ ID NO: 41788 - DNA, 25 bp, Homo sapien
tttattgaacacatgcctttgacaa

SEQ ID NO: 41789 - DNA, 25 bp, Homo sapien
gttattgtgcctgtatgtgtgcagt

SEQ ID NO: 41790 - DNA, 25 bp, Homo sapien
ttgtgcctgtatgtgtgcagtatga

SEQ ID NO: 41791 - DNA, 25 bp, Homo sapien
tagagacctttaaaaggatctgggg

SEQ ID NO: 41792 - DNA, 25 bp, Homo sapien
gtgtgtcaatattctctgcttcaca

SEQ ID NO: 41793 - DNA, 25 bp, Homo sapien
tgtcaatattctctgcttcacaaac

SEQ ID NO: 41794 - DNA, 25 bp, Homo sapien
gaaaccagtggtaaactttagatca

SEQ ID NO: 41795 - DNA, 25 bp, Homo sapien
aagaactggccatgagcagtggctc

SEQ ID NO: 41796 - DNA, 25 bp, Homo sapien
gcctcccagccactcaggaggctga

SEQ ID NO: 41797 - DNA, 25 bp, Homo sapien
gagcccaggaggtcaaggttgcagt

SEQ ID NO: 41798 - DNA, 25 bp, Homo sapien
ctccatccttggtgacagagtgaga

SEQ ID NO: 41799 - DNA, 25 bp, Homo sapien
gacagagtgagacatcgtttccaaa

SEQ ID NO: 41800 - DNA, 25 bp, Homo sapien
tgagacatcgtttccaaaaaaattc

SEQ ID NO: 41801 - DNA, 25 bp, Homo sapien
ttctacagaaatgctctatttacaa

SEQ ID NO: 41802 - DNA, 25 bp, Homo sapien
gaaatgctctatttacaaatttaca

SEQ ID NO: 41803 - DNA, 25 bp, Homo sapien
tacaaatttacataatttcctttgg

SEQ ID NO: 41804 - DNA, 25 bp, Homo sapien
ttaaggatgaggtaggtaggcagga

SEQ ID NO: 41805 - DNA, 25 bp, Homo sapien
tgaggtaggtaggcaggaaaacggg

SEQ ID NO: 41806 - DNA, 25 bp, Homo sapien
taaaaaaattcacatggccgggtgt

SEQ ID NO: 41807 - DNA, 25 bp, Homo sapien
aaagatatcctttaggccttggctg

SEQ ID NO: 41808 - DNA, 25 bp, Homo sapien
gatatcctttaggccttggctgaac

SEQ ID NO: 41809 - DNA, 25 bp, Homo sapien
atcctttaggccttggctgaacaca

SEQ ID NO: 41810 - DNA, 25 bp, Homo sapien
ggccttggctgaacacaggatctct

SEQ ID NO: 41811 - DNA, 25 bp, Homo sapien
ggctgaacacaggatctctttaaaa

SEQ ID NO: 41812 - DNA, 25 bp, Homo sapien
aaagataccattttaggctaagtgc

SEQ ID NO: 41813 - DNA, 25 bp, Homo sapien
ggctaagtgcgttaaaattcctaca

SEQ ID NO: 41814 - DNA, 25 bp, Homo sapien
agtgcgttaaaattcctacagtcag

SEQ ID NO: 41815 - DNA, 25 bp, Homo sapien
aattcctacagtcagatttacaata

SEQ ID NO: 41816 - DNA, 25 bp, Homo sapien
ttagtatttttagagacagggtctc

SEQ ID NO: 41817 - DNA, 25 bp, Homo sapien
ggagtgcagtggcacaatcataact

SEQ ID NO: 41818 - DNA, 25 bp, Homo sapien
ggtgtttataagcaatagttctcta

SEQ ID NO: 41819 - DNA, 25 bp, Homo sapien
gttctctattttctagttgatataa

SEQ ID NO: 41820 - DNA, 25 bp, Homo sapien
taaactgttcaggaaacatcgtaaa

SEQ ID NO: 41821 - DNA, 25 bp, Homo sapien
catcgtaaaggctttaggctccctt

SEQ ID NO: 41822 - DNA, 25 bp, Homo sapien
tataccaattaatctcatgggttct

SEQ ID NO: 41823 - DNA, 25 bp, Homo sapien
catgggttctagagtggttagttct

SEQ ID NO: 41824 - DNA, 25 bp, Homo sapien
gagtggttagttctacgggaattgt

SEQ ID NO: 41825 - DNA, 25 bp, Homo sapien
gatgctgaaaactactctcaatcaa

SEQ ID NO: 41826 - DNA, 25 bp, Homo sapien
ctctcaatcaaattagtaccatcat

SEQ ID NO: 41827 - DNA, 25 bp, Homo sapien
aattagtaccatcatttaagctttg

SEQ ID NO: 41828 - DNA, 25 bp, Homo sapien
ttaagctttgaatacttggcagtaa

SEQ ID NO: 41829 - DNA, 25 bp, Homo sapien
ccacctcagcctcacaaagtactgg

SEQ ID NO: 41830 - DNA, 25 bp, Homo sapien
gcctggccccacaaagtgttttgta

SEQ ID NO: 41831 - DNA, 25 bp, Homo sapien
tcttgttttgtctcctaggttggtc

SEQ ID NO: 41832 - DNA, 25 bp, Homo sapien
tttgtctcctaggttggtcttgaac

SEQ ID NO: 41833 - DNA, 25 bp, Homo sapien
gtcttgaactcttcaccttaagcga

SEQ ID NO: 41834 - DNA, 25 bp, Homo sapien
ccacctcagcctcacaaagtgctgg

SEQ ID NO: 41835 - DNA, 25 bp, Homo sapien
gctgggattacaggtataagccact

SEQ ID NO: 41836 - DNA, 25 bp, Homo sapien
taagccactggcacgggacatagaa

SEQ ID NO: 41837 - DNA, 25 bp, Homo sapien
ggcacgggacatagaatttaagggg

SEQ ID NO: 41838 - DNA, 25 bp, Homo sapien
tcagttattttgttttccctgttct

SEQ ID NO: 41839 - DNA, 25 bp, Homo sapien
tgttctttcattcccagaggtagct

SEQ ID NO: 41840 - DNA, 25 bp, Homo sapien
cgggctcccgaggagggggatgcag

SEQ ID NO: 41841 - DNA, 25 bp, Homo sapien
ggctcccgaggagggggatgcagag

SEQ ID NO: 41842 - DNA, 25 bp, Homo sapien
cgaggagggggatgcagaggtgatg

SEQ ID NO: 41843 - DNA, 25 bp, Homo sapien
ggagggggatgcagaggtgatgcag

SEQ ID NO: 41844 - DNA, 25 bp, Homo sapien
gcagaggtgatgcagctggggtcca

SEQ ID NO: 41845 - DNA, 25 bp, Homo sapien
gaggtgatgcagctggggtccagct

SEQ ID NO: 41846 - DNA, 25 bp, Homo sapien
gtgatgcagctggggtccagctccc

SEQ ID NO: 41847 - DNA, 25 bp, Homo sapien
ctccgggacacgtacaagctgtggg

SEQ ID NO: 41848 - DNA, 25 bp, Homo sapien
ccgggacacgtacaagctgtgggtg

SEQ ID NO: 41849 - DNA, 25 bp, Homo sapien
gggacacgtacaagctgtgggtgcc

SEQ ID NO: 41850 - DNA, 25 bp, Homo sapien
ggacacgtacaagctgtgggtgccc

SEQ ID NO: 41851 - DNA, 25 bp, Homo sapien
aacaattcttaatggctggcctctc

SEQ ID NO: 41852 - DNA, 25 bp, Homo sapien
tggcctctcttgtgtacaatgagcc

SEQ ID NO: 41853 - DNA, 25 bp, Homo sapien
gagccaatattcttttttgttctat

SEQ ID NO: 41854 - DNA, 25 bp, Homo sapien
gttctatatttttgtatcttcccct

SEQ ID NO: 41855 - DNA, 25 bp, Homo sapien
tcttcccctttcctgaacaaagcat

SEQ ID NO: 41856 - DNA, 25 bp, Homo sapien
gagtctcaaagaaatcctctccaca

SEQ ID NO: 41857 - DNA, 25 bp, Homo sapien
tcctctccacaaagacatgttcctc

SEQ ID NO: 41858 - DNA, 25 bp, Homo sapien
ttcctccctctggtgtgggtagaca

SEQ ID NO: 41859 - DNA, 25 bp, Homo sapien
taggtattttttgccaagataacaa

SEQ ID NO: 41860 - DNA, 25 bp, Homo sapien
ccttatctgttttggacaagtccaa

SEQ ID NO: 41861 - DNA, 25 bp, Homo sapien
ttatcagcaccttaattggtggtaa

SEQ ID NO: 41862 - DNA, 25 bp, Homo sapien
agagggatcaacttgtgcttgccag

SEQ ID NO: 41863 - DNA, 25 bp, Homo sapien
gcttgccagaggacgccaatgaagt

SEQ ID NO: 41864 - DNA, 25 bp, Homo sapien
ttgtttctgttcctcattaaatcat

SEQ ID NO: 41865 - DNA, 25 bp, Homo sapien
gactttcgagccagcataggtgcaa

SEQ ID NO: 41866 - DNA, 25 bp, Homo sapien
gatattctctacgcccggcaaaaga

SEQ ID NO: 41867 - DNA, 25 bp, Homo sapien
tagcgaaagcctttggtctccaagc

SEQ ID NO: 41868 - DNA, 25 bp, Homo sapien
cagtcacgagaaggagccgccatgg

SEQ ID NO: 41869 - DNA, 25 bp, Homo sapien
gattcaccctaaccaaattgccgtg

SEQ ID NO: 41870 - DNA, 25 bp, Homo sapien
tggtccaggagcagttttctccttc

SEQ ID NO: 41871 - DNA, 25 bp, Homo sapien
gaactgattgctgcctttaaagaac

SEQ ID NO: 41872 - DNA, 25 bp, Homo sapien
gacatgccattactgaagcaggccc

SEQ ID NO: 41873 - DNA, 25 bp, Homo sapien
tccaacagcttcctttgcagggaaa

SEQ ID NO: 41874 - DNA, 25 bp, Homo sapien
gccagccaaacctgtaaacaacttt

SEQ ID NO: 41875 - DNA, 25 bp, Homo sapien
tgagtctttgatggcagctcatgcc

SEQ ID NO: 41876 - DNA, 25 bp, Homo sapien
gctcatgccagtagagacagagtca

SEQ ID NO: 41877 - DNA, 25 bp, Homo sapien
gtatagcccagacttcagcagtagt

SEQ ID NO: 41878 - DNA, 25 bp, Homo sapien
cagcagtagtaaaaaacctccgaga

SEQ ID NO: 41879 - DNA, 25 bp, Homo sapien
ggaaggtgtttaatgaacgctgccg

SEQ ID NO: 41880 - DNA, 25 bp, Homo sapien
tgaacgctgccgaattcacttcaag

SEQ ID NO: 41881 - DNA, 25 bp, Homo sapien
aaggactgggtcatctcataagagc

SEQ ID NO: 41882 - DNA, 25 bp, Homo sapien
tcaacagggcgggctttctaggatg

SEQ ID NO: 41883 - DNA, 25 bp, Homo sapien
tttctaggatgatttctgagccaac

SEQ ID NO: 41884 - DNA, 25 bp, Homo sapien
aggccactgcactggatgtttgggc

SEQ ID NO: 41885 - DNA, 25 bp, Homo sapien
gccactgcactggatgtttgggcaa

SEQ ID NO: 41886 - DNA, 25 bp, Homo sapien
gtttgggcaaggctgcttacttcca

SEQ ID NO: 41887 - DNA, 25 bp, Homo sapien
ttgggcaaggctgcttacttccaac

SEQ ID NO: 41888 - DNA, 25 bp, Homo sapien
gatcttctgctgcaggtgagcaatg

SEQ ID NO: 41889 - DNA, 25 bp, Homo sapien
ttctgctgcaggtgagcaatggcag

SEQ ID NO: 41890 - DNA, 25 bp, Homo sapien
caatggcagcctttgtgcgctgagg

SEQ ID NO: 41891 - DNA, 25 bp, Homo sapien
cctttgtgcgctgagggtctggtgt

SEQ ID NO: 41892 - DNA, 25 bp, Homo sapien
tgtggatgctgccatcggtactgga

SEQ ID NO: 41893 - DNA, 25 bp, Homo sapien
gatgctgccatcggtactggaggcc

SEQ ID NO: 41894 - DNA, 25 bp, Homo sapien
tgccatcggtactggaggccactgc

SEQ ID NO: 41895 - DNA, 25 bp, Homo sapien
ggtgtgtctatgagagagaggatat

SEQ ID NO: 41896 - DNA, 25 bp, Homo sapien
ggatattgcttgttactgatggaag

SEQ ID NO: 41897 - DNA, 25 bp, Homo sapien
ctgatggaagccagaatcctcccca

SEQ ID NO: 41898 - DNA, 25 bp, Homo sapien
cgcaatccagactctcactagaata

SEQ ID NO: 41899 - DNA, 25 bp, Homo sapien
atccagactctcactagaatatcta

SEQ ID NO: 41900 - DNA, 25 bp, Homo sapien
ctagaatatctaaatgatgtcctct

SEQ ID NO: 41901 - DNA, 25 bp, Homo sapien
tgatgtcctctgaacttaagtcctt

SEQ ID NO: 41902 - DNA, 25 bp, Homo sapien
gtcctctgaacttaagtcctttatt

SEQ ID NO: 41903 - DNA, 25 bp, Homo sapien
gaaatagatgacatttggcttccat

SEQ ID NO: 41904 - DNA, 25 bp, Homo sapien
tatttaagttccagataacaaggcc

SEQ ID NO: 41905 - DNA, 25 bp, Homo sapien
atgacatttggcttccatctcattc

SEQ ID NO: 41906 - DNA, 25 bp, Homo sapien
ccagcccagcaagttatcctttaag

SEQ ID NO: 41907 - DNA, 25 bp, Homo sapien
agttatcctttaagaaatctcctag

SEQ ID NO: 41908 - DNA, 25 bp, Homo sapien
acaaatcttacatgaaactctcata

SEQ ID NO: 41909 - DNA, 25 bp, Homo sapien
gaaatctcctaggaattctggagtt

SEQ ID NO: 41910 - DNA, 25 bp, Homo sapien
attgctctatgttattcctgcttcc

SEQ ID NO: 41911 - DNA, 25 bp, Homo sapien
tcctgcttccagtctctaagtaaca

SEQ ID NO: 41912 - DNA, 25 bp, Homo sapien
tccagtctctaagtaacaagggcat

SEQ ID NO: 41913 - DNA, 25 bp, Homo sapien
gtctcttaaggtccactatagtggt

SEQ ID NO: 41914 - DNA, 25 bp, Homo sapien
tccactatagtggttctttatttaa

SEQ ID NO: 41915 - DNA, 25 bp, Homo sapien
taaggaataactcagctgggtgcag

SEQ ID NO: 41916 - DNA, 25 bp, Homo sapien
gaggaacatattcccctaacttcta

SEQ ID NO: 41917 - DNA, 25 bp, Homo sapien
catttcagtagttgttttttgtgtt

SEQ ID NO: 41918 - DNA, 25 bp, Homo sapien
gccccagcattagtttcacatgata

SEQ ID NO: 41919 - DNA, 25 bp, Homo sapien
ttcacatgatataccctttaaaccc

SEQ ID NO: 41920 - DNA, 25 bp, Homo sapien
tataccctttaaacccgaatcattg

SEQ ID NO: 41921 - DNA, 25 bp, Homo sapien
acccgaatcattgttttatttcctg

SEQ ID NO: 41922 - DNA, 25 bp, Homo sapien
ggggaaaggggctagtatatcagta

SEQ ID NO: 41923 - DNA, 25 bp, Homo sapien
gggatgtatatatatcattgctgtt

SEQ ID NO: 41924 - DNA, 25 bp, Homo sapien
taaaatggggctgggctcagtggct

SEQ ID NO: 41925 - DNA, 25 bp, Homo sapien
gtagagtgggtgtagtgagtgtata

SEQ ID NO: 41926 - DNA, 25 bp, Homo sapien
atataatgtgatttggccctgtgta

SEQ ID NO: 41927 - DNA, 25 bp, Homo sapien
gatttggccctgtgtattatgatat

SEQ ID NO: 41928 - DNA, 25 bp, Homo sapien
gaaaattttcagagtattctagttt

SEQ ID NO: 41929 - DNA, 25 bp, Homo sapien
tattacaactcattacaactaccta

SEQ ID NO: 41930 - DNA, 25 bp, Homo sapien
caactcattacaactacctaaattt

SEQ ID NO: 41931 - DNA, 25 bp, Homo sapien
tatttttgcatttcatagccagaaa

SEQ ID NO: 41932 - DNA, 25 bp, Homo sapien
gatgttcacttaaagatattcagca

SEQ ID NO: 41933 - DNA, 25 bp, Homo sapien
tgttgtgcttatgtttagcaatttt

SEQ ID NO: 41934 - DNA, 25 bp, Homo sapien
atagaagcaattccctctggctaca

SEQ ID NO: 41935 - DNA, 25 bp, Homo sapien
gttttcattgcattgagcaccatcc

SEQ ID NO: 41936 - DNA, 25 bp, Homo sapien
tcattgcattgagcaccatccagag

SEQ ID NO: 41937 - DNA, 25 bp, Homo sapien
ccatccagagctatctgccatctag

SEQ ID NO: 41938 - DNA, 25 bp, Homo sapien
gagctatctgccatctagaaagtac

SEQ ID NO: 41939 - DNA, 25 bp, Homo sapien
ccatatattattacttggggggcta

SEQ ID NO: 41940 - DNA, 25 bp, Homo sapien
tattattacttggggggctaaggtg

SEQ ID NO: 41941 - DNA, 25 bp, Homo sapien
agtacaggaagcggaggctgcagtg

SEQ ID NO: 41942 - DNA, 25 bp, Homo sapien
ccagcctgggcaactgagtaagacc

SEQ ID NO: 41943 - DNA, 25 bp, Homo sapien
gggcaactgagtaagaccttgcctc

SEQ ID NO: 41944 - DNA, 25 bp, Homo sapien
aggcagaagctggagatgaggaaag

SEQ ID NO: 41945 - DNA, 25 bp, Homo sapien
gatgaggaaaggtagcctcctactg

SEQ ID NO: 41946 - DNA, 25 bp, Homo sapien
atgaggaaaggtagcctcctactgt

SEQ ID NO: 41947 - DNA, 25 bp, Homo sapien
caagtcccaccagaatatctcatcc

SEQ ID NO: 41948 - DNA, 25 bp, Homo sapien
gaaggtacagctataggctgggcat

SEQ ID NO: 41949 - DNA, 25 bp, Homo sapien
gctataggctgggcatggtggctca

SEQ ID NO: 41950 - DNA, 25 bp, Homo sapien
tgaactttaatatagacctttgtct

SEQ ID NO: 41951 - DNA, 25 bp, Homo sapien
gtttgtcttgtaaactgtcttactt

SEQ ID NO: 41952 - DNA, 25 bp, Homo sapien
gtaaactgtcttacttatgtgtgta

SEQ ID NO: 41953 - DNA, 25 bp, Homo sapien
gggacaggactgaaattattctaca

SEQ ID NO: 41954 - DNA, 25 bp, Homo sapien
agaataagattcggccgggcacggt

SEQ ID NO: 41955 - DNA, 25 bp, Homo sapien
aaaattgttaacccatgtgcccatt

SEQ ID NO: 41956 - DNA, 25 bp, Homo sapien
tagccaggcgtggtagcgggcatct

SEQ ID NO: 41957 - DNA, 25 bp, Homo sapien
gtagcgggcatctgtaatcccagct

SEQ ID NO: 41958 - DNA, 25 bp, Homo sapien
cccatgtgcccattcctgagtaggg

SEQ ID NO: 41959 - DNA, 25 bp, Homo sapien
cccattcctgagtagggcagactct

SEQ ID NO: 41960 - DNA, 25 bp, Homo sapien
ggcagactcttcacaaaggcccatg

SEQ ID NO: 41961 - DNA, 25 bp, Homo sapien
gttttcatagagcttgctttagtgg

SEQ ID NO: 41962 - DNA, 25 bp, Homo sapien
tgtgctgagcttacccacaatgcaa

SEQ ID NO: 41963 - DNA, 25 bp, Homo sapien
ctgagcttacccacaatgcaagcca

SEQ ID NO: 41964 - DNA, 25 bp, Homo sapien
aatgcaagccaaggcatcagctccc

SEQ ID NO: 41965 - DNA, 25 bp, Homo sapien
ccccaagggacctgcaggaaaccag

SEQ ID NO: 41966 - DNA, 25 bp, Homo sapien
gcaggaaaccaggctgcatttcaac

SEQ ID NO: 41967 - DNA, 25 bp, Homo sapien
aaccaggctgcatttcaacaacaag

SEQ ID NO: 41968 - DNA, 25 bp, Homo sapien
caacaacaagcagaaagcacagagc

SEQ ID NO: 41969 - DNA, 25 bp, Homo sapien
agcacagagctttacacacaaccta

SEQ ID NO: 41970 - DNA, 25 bp, Homo sapien
gagctttacacacaacctaaataca

SEQ ID NO: 41971 - DNA, 25 bp, Homo sapien
caacctaaatacatcaaccatttga

SEQ ID NO: 41972 - DNA, 25 bp, Homo sapien
gggagggtgaggtgggcagactgcc

SEQ ID NO: 41973 - DNA, 25 bp, Homo sapien
cctgagcccatcagttcatgaccag

SEQ ID NO: 41974 - DNA, 25 bp, Homo sapien
gtccatggtggtcagtttgcaaagc

SEQ ID NO: 41975 - DNA, 25 bp, Homo sapien
actgcttctcgtattttctctgaaa

SEQ ID NO: 41976 - DNA, 25 bp, Homo sapien
gaaagccacagtgcctcttagtgtt

SEQ ID NO: 41977 - DNA, 25 bp, Homo sapien
aggccggatgcagtgattcctgcct

SEQ ID NO: 41978 - DNA, 25 bp, Homo sapien
gaggcgggcaaatcgcctgagctca

SEQ ID NO: 41979 - DNA, 25 bp, Homo sapien
tggggcaacgtggtgagaccctgtc

SEQ ID NO: 41980 - DNA, 25 bp, Homo sapien
tgtactcctggctactcaagaggct

SEQ ID NO: 41981 - DNA, 25 bp, Homo sapien
ggaggatcacttgaccccaagagtt

SEQ ID NO: 41982 - DNA, 25 bp, Homo sapien
gtaattgcagcaccctgggagggtg

SEQ ID NO: 41983 - DNA, 25 bp, Homo sapien
gtggtggcagcaaacttctagtagt

SEQ ID NO: 41984 - DNA, 25 bp, Homo sapien
gtagttttgatatgtccttgataga

SEQ ID NO: 41985 - DNA, 25 bp, Homo sapien
attaaatgttgacctagccagcgca

SEQ ID NO: 41986 - DNA, 25 bp, Homo sapien
tgttgacctagccagcgcagtggct

SEQ ID NO: 41987 - DNA, 25 bp, Homo sapien
ctggaagcatgcataaagccctctg

SEQ ID NO: 41988 - DNA, 25 bp, Homo sapien
catgcataaagccctctgctgtgca

SEQ ID NO: 41989 - DNA, 25 bp, Homo sapien
cactgaagtatgggtgccttgagga

SEQ ID NO: 41990 - DNA, 25 bp, Homo sapien
gcagttacacagttgagttgcaagc

SEQ ID NO: 41991 - DNA, 25 bp, Homo sapien
ctgtgttccagggcatgccctttag

SEQ ID NO: 41992 - DNA, 25 bp, Homo sapien
gggcatgccctttagaattgcacag

SEQ ID NO: 41993 - DNA, 25 bp, Homo sapien
gaacttagcagattacggtatttag

SEQ ID NO: 41994 - DNA, 25 bp, Homo sapien
aaatcctatttagtacaaggtacat

SEQ ID NO: 41995 - DNA, 25 bp, Homo sapien
gagtccattaaaagccaacactttc

SEQ ID NO: 41996 - DNA, 25 bp, Homo sapien
cactttccccactacactatatgtg

SEQ ID NO: 41997 - DNA, 25 bp, Homo sapien
gtgtatgtaacacaactgcccttgt

SEQ ID NO: 41998 - DNA, 25 bp, Homo sapien
gtaacacaactgcccttgtaacttc

SEQ ID NO: 41999 - DNA, 25 bp, Homo sapien
ttgacgtgggagtactggatattgt

SEQ ID NO: 42000 - DNA, 25 bp, Homo sapien
gagacagatatcatcagggcaagga

SEQ ID NO: 42001 - DNA, 25 bp, Homo sapien
gatttttgcattgacggtttgacac

SEQ ID NO: 42002 - DNA, 25 bp, Homo sapien
gacggtttgacactatattgtggta

SEQ ID NO: 42003 - DNA, 25 bp, Homo sapien
gaacaggaaacatcttccctggaat

SEQ ID NO: 42004 - DNA, 25 bp, Homo sapien
atttcatttctatttctatgttatg

SEQ ID NO: 42005 - DNA, 25 bp, Homo sapien
atgttaaatactatcatgaattcaa

SEQ ID NO: 42006 - DNA, 25 bp, Homo sapien
tgccagtaactttaacctattccac

SEQ ID NO: 42007 - DNA, 25 bp, Homo sapien
gataatggactgacatctctagtga

SEQ ID NO: 42008 - DNA, 25 bp, Homo sapien
taatggactgacatctctagtgatt

SEQ ID NO: 42009 - DNA, 25 bp, Homo sapien
tgattttttttgccagtgagtttta

SEQ ID NO: 42010 - DNA, 25 bp, Homo sapien
tttgccagtgagttttaattgccat

SEQ ID NO: 42011 - DNA, 25 bp, Homo sapien
tgtggatacctaatatgtgtacata

SEQ ID NO: 42012 - DNA, 25 bp, Homo sapien
ttttgatacggacacacaatatata

SEQ ID NO: 42013 - DNA, 25 bp, Homo sapien
aatatataacaatcgcattagacta

SEQ ID NO: 42014 - DNA, 25 bp, Homo sapien
gactaaatgcggtctccattacctc

SEQ ID NO: 42015 - DNA, 25 bp, Homo sapien
aattgttgttgactacaggattatt

SEQ ID NO: 42016 - DNA, 25 bp, Homo sapien
catactgggatttgggaacttcttt

SEQ ID NO: 42017 - DNA, 25 bp, Homo sapien
cattgatagtcttgtgtgtctcaca

SEQ ID NO: 42018 - DNA, 25 bp, Homo sapien
tatttgcttttatctgagaatttct

SEQ ID NO: 42019 - DNA, 25 bp, Homo sapien
cccctctttttgtcagtgcattggg

SEQ ID NO: 42020 - DNA, 25 bp, Homo sapien
accattctgggatttgcaaagttta

SEQ ID NO: 42021 - DNA, 25 bp, Homo sapien
gggatagactttacagatttatgga

SEQ ID NO: 42022 - DNA, 25 bp, Homo sapien
atattacttatagctgagtcagaat

SEQ ID NO: 42023 - DNA, 25 bp, Homo sapien
gagggaattgtattgatactccaat

SEQ ID NO: 42024 - DNA, 25 bp, Homo sapien
tgatactccaatacctaaatttcac

SEQ ID NO: 42025 - DNA, 25 bp, Homo sapien
atttcacaataccacttaggaaagc

SEQ ID NO: 42026 - DNA, 25 bp, Homo sapien
aaaccattctgggatttgcaaagtt

SEQ ID NO: 42027 - DNA, 25 bp, Homo sapien
acatatgtacagtatcagtagggaa

SEQ ID NO: 42028 - DNA, 25 bp, Homo sapien
tttcttttgtcatttaattaggcca

SEQ ID NO: 42029 - DNA, 25 bp, Homo sapien
ttaattaggccatctgtcctgtttt

SEQ ID NO: 42030 - DNA, 25 bp, Homo sapien
atattaactaatacccatatttata

SEQ ID NO: 42031 - DNA, 25 bp, Homo sapien
gtgatttacacagtgactaggaaca

SEQ ID NO: 42032 - DNA, 25 bp, Homo sapien
cacagtgactaggaacatttgtatt

SEQ ID NO: 42033 - DNA, 25 bp, Homo sapien
gtatttattgtttcttctctgcact

SEQ ID NO: 42034 - DNA, 25 bp, Homo sapien
acttttcatcatctgataaatacaa

SEQ ID NO: 42035 - DNA, 25 bp, Homo sapien
caagagctcaagtaactgtcttttc

SEQ ID NO: 42036 - DNA, 25 bp, Homo sapien
atggcttctatacttgaaatcagtt

SEQ ID NO: 42037 - DNA, 25 bp, Homo sapien
cagttaatacaatagtttttccagt

SEQ ID NO: 42038 - DNA, 25 bp, Homo sapien
gaacattggaaattcttgagatata

SEQ ID NO: 42039 - DNA, 25 bp, Homo sapien
gtatgatctcaatatgtcctgatga

SEQ ID NO: 42040 - DNA, 25 bp, Homo sapien
gatctcaatatgtcctgatgaataa

SEQ ID NO: 42041 - DNA, 25 bp, Homo sapien
ataaaatacatcaaaatctttccat

SEQ ID NO: 42042 - DNA, 25 bp, Homo sapien
atctttccattttatttgtatactt

SEQ ID NO: 42043 - DNA, 25 bp, Homo sapien
agcactatgggagactgaggcaggt

SEQ ID NO: 42044 - DNA, 25 bp, Homo sapien
aaaaattaagctgtgtgtgatggtg

SEQ ID NO: 42045 - DNA, 25 bp, Homo sapien
tgtgatggtgcacacctgcaatccc

SEQ ID NO: 42046 - DNA, 25 bp, Homo sapien
cacctgcaatcccaggtactcagga

SEQ ID NO: 42047 - DNA, 25 bp, Homo sapien
ggtactcaggaggcttatgcgggag

SEQ ID NO: 42048 - DNA, 25 bp, Homo sapien
ggaggcttatgcgggagaatcgctt

SEQ ID NO: 42049 - DNA, 25 bp, Homo sapien
caactaatatttccctttacatcca

SEQ ID NO: 42050 - DNA, 25 bp, Homo sapien
taatatttccctttacatccaaaca

SEQ ID NO: 42051 - DNA, 25 bp, Homo sapien
atatttccctttacatccaaacatc

SEQ ID NO: 42052 - DNA, 25 bp, Homo sapien
tatttccctttacatccaaacatcc

SEQ ID NO: 42053 - DNA, 25 bp, Homo sapien
cctttacatccaaacatccctttgg

SEQ ID NO: 42054 - DNA, 25 bp, Homo sapien
tcctccaagcctcagagtacttcga

SEQ ID NO: 42055 - DNA, 25 bp, Homo sapien
cctccaagcctcagagtacttcgag

SEQ ID NO: 42056 - DNA, 25 bp, Homo sapien
tccaagcctcagagtacttcgagtc

SEQ ID NO: 42057 - DNA, 25 bp, Homo sapien
aagcctcagagtacttcgagtctcc

SEQ ID NO: 42058 - DNA, 25 bp, Homo sapien
ggctcaacattttttgtagccccag

SEQ ID NO: 42059 - DNA, 25 bp, Homo sapien
tcaacattttttgtagccccaggct

SEQ ID NO: 42060 - DNA, 25 bp, Homo sapien
aatctatgactgtattaccaagctt

SEQ ID NO: 42061 - DNA, 25 bp, Homo sapien
accatgttggtgtgctgcacccatt

SEQ ID NO: 42062 - DNA, 25 bp, Homo sapien
gcacccattaactcgtcatttacat

SEQ ID NO: 42063 - DNA, 25 bp, Homo sapien
gtatatatcctaatgctatccctcc

SEQ ID NO: 42064 - DNA, 25 bp, Homo sapien
tgacaggtcccggtgtgtgatgttc

SEQ ID NO: 42065 - DNA, 25 bp, Homo sapien
cccactctgtgtccaagtgttctca

SEQ ID NO: 42066 - DNA, 25 bp, Homo sapien
ctcattgttcaattcccacctatga

SEQ ID NO: 42067 - DNA, 25 bp, Homo sapien
tgcggtgtttggttttttgtccttg

SEQ ID NO: 42068 - DNA, 25 bp, Homo sapien
aaagatggtgtccagcttcatccat

SEQ ID NO: 42069 - DNA, 25 bp, Homo sapien
gaactcatccttttttatggctgca

SEQ ID NO: 42070 - DNA, 25 bp, Homo sapien
tgtgccacattttcttaatccagtc

SEQ ID NO: 42071 - DNA, 25 bp, Homo sapien
ttttctacccaaattactaatctat

SEQ ID NO: 42072 - DNA, 25 bp, Homo sapien
attactaatctatgccattaaggaa

SEQ ID NO: 42073 - DNA, 25 bp, Homo sapien
aaaggaataagaacctccatatgta

SEQ ID NO: 42074 - DNA, 25 bp, Homo sapien
aagaacctccatatgtattattatc

SEQ ID NO: 42075 - DNA, 25 bp, Homo sapien
tgtattattatctccacagtcctgc

SEQ ID NO: 42076 - DNA, 25 bp, Homo sapien
tccacagtcctgcagaagtacaatc

SEQ ID NO: 42077 - DNA, 25 bp, Homo sapien
agtacaatctgatctttaactttca

SEQ ID NO: 42078 - DNA, 25 bp, Homo sapien
aactttcatgctacaaataataatt

SEQ ID NO: 42079 - DNA, 25 bp, Homo sapien
aaattattgccatatgatgtatcat

SEQ ID NO: 42080 - DNA, 25 bp, Homo sapien
gatgtatcatttctgtgtttgaaca

SEQ ID NO: 42081 - DNA, 25 bp, Homo sapien
gtgtttgaacaaagcatcgtaatgc

SEQ ID NO: 42082 - DNA, 25 bp, Homo sapien
tcagattatgacacagattttgata

SEQ ID NO: 42083 - DNA, 25 bp, Homo sapien
atgacacagattttgatattatcaa

SEQ ID NO: 42084 - DNA, 25 bp, Homo sapien
atacgtccagcctccaaaaaaaatg

SEQ ID NO: 42085 - DNA, 25 bp, Homo sapien
tccagcctccaaaaaaaatgacata

SEQ ID NO: 42086 - DNA, 25 bp, Homo sapien
gaagaatatctttgctgttctaata

SEQ ID NO: 42087 - DNA, 25 bp, Homo sapien
tgctgttctaataagtagacttgac

SEQ ID NO: 42088 - DNA, 25 bp, Homo sapien
taagtagacttgacatagccaagga

SEQ ID NO: 42089 - DNA, 25 bp, Homo sapien
gtagacttgacatagccaaggaaaa

SEQ ID NO: 42090 - DNA, 25 bp, Homo sapien
aacatctaagaaatgtgagaccatt

SEQ ID NO: 42091 - DNA, 25 bp, Homo sapien
ttataagcaaaacacagtctgaaga

SEQ ID NO: 42092 - DNA, 25 bp, Homo sapien
aagcaaaacacagtctgaagagaca

SEQ ID NO: 42093 - DNA, 25 bp, Homo sapien
gttgcccaggctgggctcgaactcc

SEQ ID NO: 42094 - DNA, 25 bp, Homo sapien
gctgtgattataggtgtgagccact

SEQ ID NO: 42095 - DNA, 25 bp, Homo sapien
cgcccagccatgcctaaaatatttc

SEQ ID NO: 42096 - DNA, 25 bp, Homo sapien
aatatttctaattaccactttcaat

SEQ ID NO: 42097 - DNA, 25 bp, Homo sapien
aggacaaatttgagttctgaataca

SEQ ID NO: 42098 - DNA, 25 bp, Homo sapien
gagttctgaatacaattttcataca

SEQ ID NO: 42099 - DNA, 25 bp, Homo sapien
ttttcatacaaatagtgtttttgca

SEQ ID NO: 42100 - DNA, 25 bp, Homo sapien
tttttgcaaataatggccagctcca

SEQ ID NO: 42101 - DNA, 25 bp, Homo sapien
gattctcctcactttgtttttgtat

SEQ ID NO: 42102 - DNA, 25 bp, Homo sapien
tcctcactttgtttttgtattttgt

SEQ ID NO: 42103 - DNA, 25 bp, Homo sapien
agatgtggttttgccatgttgccca

SEQ ID NO: 42104 - DNA, 25 bp, Homo sapien
ttcattctgactggcaagccctgtc

SEQ ID NO: 42105 - DNA, 25 bp, Homo sapien
gtccctggagtttctgaagacagtg

SEQ ID NO: 42106 - DNA, 25 bp, Homo sapien
ctgaagacagtgtctccctcactgc

SEQ ID NO: 42107 - DNA, 25 bp, Homo sapien
aaatcatctggagttgccactcctg

SEQ ID NO: 42108 - DNA, 25 bp, Homo sapien
ccaatgtccccaggtcactaagaga

SEQ ID NO: 42109 - DNA, 25 bp, Homo sapien
agagaatgaccttccactgtattcc

SEQ ID NO: 42110 - DNA, 25 bp, Homo sapien
ttccctttgtgaggctgacctgtgg

SEQ ID NO: 42111 - DNA, 25 bp, Homo sapien
ggctgacctgtggacaagaccatgg

SEQ ID NO: 42112 - DNA, 25 bp, Homo sapien
tgggacagggataggcagttcctcc

SEQ ID NO: 42113 - DNA, 25 bp, Homo sapien
tcactgctcactgccatggtgtatc

SEQ ID NO: 42114 - DNA, 25 bp, Homo sapien
tgctcactgccatggtgtatctgcc

SEQ ID NO: 42115 - DNA, 25 bp, Homo sapien
tggtgattggtttaaaactgatttt

SEQ ID NO: 42116 - DNA, 25 bp, Homo sapien
aatgctagcataaattagattgact

SEQ ID NO: 42117 - DNA, 25 bp, Homo sapien
gtgactgtagtagttaatgtaacac

SEQ ID NO: 42118 - DNA, 25 bp, Homo sapien
atgtaacacattttgtataaagtac

SEQ ID NO: 42119 - DNA, 25 bp, Homo sapien
attcagatgaagttttatttcttga

SEQ ID NO: 42120 - DNA, 25 bp, Homo sapien
ttttcctctttttggatatggggtg

SEQ ID NO: 42121 - DNA, 25 bp, Homo sapien
tatttcttgaaaacagttatttcct

SEQ ID NO: 42122 - DNA, 25 bp, Homo sapien
ttatttcctttttgtttattagcat

SEQ ID NO: 42123 - DNA, 25 bp, Homo sapien
tcctttttgtttattagcatgtgta

SEQ ID NO: 42124 - DNA, 25 bp, Homo sapien
tcctctttttggatatggggtgttt

SEQ ID NO: 42125 - DNA, 25 bp, Homo sapien
tagcatgtgtataaacacaaatcac

SEQ ID NO: 42126 - DNA, 25 bp, Homo sapien
gcctctgatcgcctcaagagagcgg

SEQ ID NO: 42127 - DNA, 25 bp, Homo sapien
ctctgatcgcctcaagagagcgggg

SEQ ID NO: 42128 - DNA, 25 bp, Homo sapien
ctgatcgcctcaagagagcggggag

SEQ ID NO: 42129 - DNA, 25 bp, Homo sapien
gatcgcctcaagagagcggggaggg

SEQ ID NO: 42130 - DNA, 25 bp, Homo sapien
cgcctcaagagagcggggagggggc

SEQ ID NO: 42131 - DNA, 25 bp, Homo sapien
caagagagcggggagggggctcggg

SEQ ID NO: 42132 - DNA, 25 bp, Homo sapien
gggcggctgagggcgagggaggccc

SEQ ID NO: 42133 - DNA, 25 bp, Homo sapien
ggctgagggcgagggaggccctccc

SEQ ID NO: 42134 - DNA, 25 bp, Homo sapien
gccctcccttctggcgaggggaggg

SEQ ID NO: 42135 - DNA, 25 bp, Homo sapien
cttctggcgaggggagggagggtgg

SEQ ID NO: 42136 - DNA, 25 bp, Homo sapien
tggcgaggggagggagggtgggtca

SEQ ID NO: 42137 - DNA, 25 bp, Homo sapien
tggcctcacctggagcggaggggac

SEQ ID NO: 42138 - DNA, 25 bp, Homo sapien
aaggtggatggggacacagctcctg

SEQ ID NO: 42139 - DNA, 25 bp, Homo sapien
gggtctgagacttcaaggggtggtg

SEQ ID NO: 42140 - DNA, 25 bp, Homo sapien
taaagggggtactgagcctcctgtg

SEQ ID NO: 42141 - DNA, 25 bp, Homo sapien
tcctgtggcccgcagcagtgagggc

SEQ ID NO: 42142 - DNA, 25 bp, Homo sapien
gtgagggcacagctgtgggttgcag

SEQ ID NO: 42143 - DNA, 25 bp, Homo sapien
gtgggttgcaggggagacagccagc

SEQ ID NO: 42144 - DNA, 25 bp, Homo sapien
cctggcagactggggagctgggggc

SEQ ID NO: 42145 - DNA, 25 bp, Homo sapien
ctgggggcagagggcggtgccaagt

SEQ ID NO: 42146 - DNA, 25 bp, Homo sapien
ccaagtgccacatcttgccatagtg

SEQ ID NO: 42147 - DNA, 25 bp, Homo sapien
ctttgagggggattctgtgccacag

SEQ ID NO: 42148 - DNA, 25 bp, Homo sapien
gccaaagatcaagactaccacaagg

SEQ ID NO: 42149 - DNA, 25 bp, Homo sapien
tgccacaggcatatgagaggataag

SEQ ID NO: 42150 - DNA, 25 bp, Homo sapien
cctatcaaggcctcacagacaaacc

SEQ ID NO: 42151 - DNA, 25 bp, Homo sapien
aactgtcagacataggagcaaggcc

SEQ ID NO: 42152 - DNA, 25 bp, Homo sapien
caaggccatcttagacgacccaatt

SEQ ID NO: 42153 - DNA, 25 bp, Homo sapien
agacgacccaattacaatcaggcct

SEQ ID NO: 42154 - DNA, 25 bp, Homo sapien
tacaatcaggcctgcaggtgactgc

SEQ ID NO: 42155 - DNA, 25 bp, Homo sapien
actgcagaagcatgagacacaccaa

SEQ ID NO: 42156 - DNA, 25 bp, Homo sapien
agcatgagacacaccaagagaaatc

SEQ ID NO: 42157 - DNA, 25 bp, Homo sapien
agaaatcagtgaagaactctcgctg

SEQ ID NO: 42158 - DNA, 25 bp, Homo sapien
gtgaagaactctcgctgagttccac

SEQ ID NO: 42159 - DNA, 25 bp, Homo sapien
gaaatgggggcagtgggttattaga

SEQ ID NO: 42160 - DNA, 25 bp, Homo sapien
aatggctggtatggtttgtctgtgt

SEQ ID NO: 42161 - DNA, 25 bp, Homo sapien
cctcacccaaatttcatctcgaatt

SEQ ID NO: 42162 - DNA, 25 bp, Homo sapien
atctcgaattgtaatccccataatc

SEQ ID NO: 42163 - DNA, 25 bp, Homo sapien
ccccataatccccatgtgtctaggg

SEQ ID NO: 42164 - DNA, 25 bp, Homo sapien
gtgtctagggagagacctggtggga

SEQ ID NO: 42165 - DNA, 25 bp, Homo sapien
tcatgggggtggtttcccctacgat

SEQ ID NO: 42166 - DNA, 25 bp, Homo sapien
cccctacgatgttctcctgatagtg

SEQ ID NO: 42167 - DNA, 25 bp, Homo sapien
tataaagggctctgcccctttaact

SEQ ID NO: 42168 - DNA, 25 bp, Homo sapien
ctctttctcctgaagccttgtgaag

SEQ ID NO: 42169 - DNA, 25 bp, Homo sapien
tgtgaagaaggtgctttgcttcccc

SEQ ID NO: 42170 - DNA, 25 bp, Homo sapien
ggattgcatgagtccaggagtttga

SEQ ID NO: 42171 - DNA, 25 bp, Homo sapien
gaggatcagttgaacccagtggttc

SEQ ID NO: 42172 - DNA, 25 bp, Homo sapien
ccagtggttctgggttgcagtgagc

SEQ ID NO: 42173 - DNA, 25 bp, Homo sapien
ggttgcagtgagctgtggtcacacc

SEQ ID NO: 42174 - DNA, 25 bp, Homo sapien
ctgtggtcacaccactgaactccag

SEQ ID NO: 42175 - DNA, 25 bp, Homo sapien
ctccagcctgtgcgactgagtgaga

SEQ ID NO: 42176 - DNA, 25 bp, Homo sapien
gcgactgagtgagaccctgtgtcta

SEQ ID NO: 42177 - DNA, 25 bp, Homo sapien
aaatctataatatggctggaggcag

SEQ ID NO: 42178 - DNA, 25 bp, Homo sapien
tggaggcagtgggcagtggttcatg

SEQ ID NO: 42179 - DNA, 25 bp, Homo sapien
tgggcagtggttcatgcctgtaatc

SEQ ID NO: 42180 - DNA, 25 bp, Homo sapien
gaggccgaagtgggaggattgcatg

SEQ ID NO: 42181 - DNA, 25 bp, Homo sapien
tgctctgtcactcaggctggagtac

SEQ ID NO: 42182 - DNA, 25 bp, Homo sapien
gagctcctgagctcaaaggatcctc

SEQ ID NO: 42183 - DNA, 25 bp, Homo sapien
cctcagcctccagagtagctcagat

SEQ ID NO: 42184 - DNA, 25 bp, Homo sapien
gaagtttcctgacttaacataagca

SEQ ID NO: 42185 - DNA, 25 bp, Homo sapien
ttcactgattgctgtagtcattcta

SEQ ID NO: 42186 - DNA, 25 bp, Homo sapien
gagacaggatctccatctgtcaccc

SEQ ID NO: 42187 - DNA, 25 bp, Homo sapien
gtcacccaggctggtgtgcaggggt

SEQ ID NO: 42188 - DNA, 25 bp, Homo sapien
ggtcatgggctcatgggattctcct

SEQ ID NO: 42189 - DNA, 25 bp, Homo sapien
gtgagctgagattgcaccactggac

SEQ ID NO: 42190 - DNA, 25 bp, Homo sapien
accactggactacagcctgggtgac

SEQ ID NO: 42191 - DNA, 25 bp, Homo sapien
ggctgtctgctttttgtaacttgaa

SEQ ID NO: 42192 - DNA, 25 bp, Homo sapien
ggaaggcaggaagagtcatagagga

SEQ ID NO: 42193 - DNA, 25 bp, Homo sapien
atcaagcacaaggcagtttcggaca

SEQ ID NO: 42194 - DNA, 25 bp, Homo sapien
gtttcggacagggacagaggtgagc

SEQ ID NO: 42195 - DNA, 25 bp, Homo sapien
ttttgtgagccagtgggaaaaccaa

SEQ ID NO: 42196 - DNA, 25 bp, Homo sapien
gaaaaccaaggaggctaaaccatag

SEQ ID NO: 42197 - DNA, 25 bp, Homo sapien
taaaccatagagcctggagatgtga

SEQ ID NO: 42198 - DNA, 25 bp, Homo sapien
gccagatcacaagcaccttgaaacc

SEQ ID NO: 42199 - DNA, 25 bp, Homo sapien
gaaaccagacactggtttggggtct

SEQ ID NO: 42200 - DNA, 25 bp, Homo sapien
tcttcagcagtcctctgtcgaaata

SEQ ID NO: 42201 - DNA, 25 bp, Homo sapien
gcagtcctctgtcgaaatacatata

SEQ ID NO: 42202 - DNA, 25 bp, Homo sapien
tacatatattcaggggctgggtgtg

SEQ ID NO: 42203 - DNA, 25 bp, Homo sapien
aggcaggcggaagaacgcgggctgg

SEQ ID NO: 42204 - DNA, 25 bp, Homo sapien
gcggaagaacgcgggctgggaagca

SEQ ID NO: 42205 - DNA, 25 bp, Homo sapien
ggctgggaagcaagcgggaagattc

SEQ ID NO: 42206 - DNA, 25 bp, Homo sapien
gcaagcgggaagattctagaatgga

SEQ ID NO: 42207 - DNA, 25 bp, Homo sapien
tagaatggaagggagcccgccgagc

SEQ ID NO: 42208 - DNA, 25 bp, Homo sapien
ccgatggagcaggcggggattcctc

SEQ ID NO: 42209 - DNA, 25 bp, Homo sapien
cccagcgaacgactcggggaagctc

SEQ ID NO: 42210 - DNA, 25 bp, Homo sapien
ccatctgtgctgacggttcacacca

SEQ ID NO: 42211 - DNA, 25 bp, Homo sapien
gctgacggttcacaccagacaggac

SEQ ID NO: 42212 - DNA, 25 bp, Homo sapien
ttcacaccagacaggaccacttgca

SEQ ID NO: 42213 - DNA, 25 bp, Homo sapien
gacaggaccacttgcaaggacaaaa

SEQ ID NO: 42214 - DNA, 25 bp, Homo sapien
aaacctgcacacagggcgtgcgagg

SEQ ID NO: 42215 - DNA, 25 bp, Homo sapien
agggcgtgcgagggtgggtagagct

SEQ ID NO: 42216 - DNA, 25 bp, Homo sapien
gagggtgggtagagctgaggaggga

SEQ ID NO: 42217 - DNA, 25 bp, Homo sapien
gccatggcgtggcactgtgtgtaca

SEQ ID NO: 42218 - DNA, 25 bp, Homo sapien
gtgtgtacacagcaggtcactgttg

SEQ ID NO: 42219 - DNA, 25 bp, Homo sapien
gcaggtcactgttggggacatcgca

SEQ ID NO: 42220 - DNA, 25 bp, Homo sapien
gttggggacatcgcatacattcagg

SEQ ID NO: 42221 - DNA, 25 bp, Homo sapien
gacatcgcatacattcagggtacgc

SEQ ID NO: 42222 - DNA, 25 bp, Homo sapien
ttcagggtacgcaggatctctctat

SEQ ID NO: 42223 - DNA, 25 bp, Homo sapien
cgcaggatctctctatattatttct

SEQ ID NO: 42224 - DNA, 25 bp, Homo sapien
tattatttctaacaaccgcactcaa

SEQ ID NO: 42225 - DNA, 25 bp, Homo sapien
gaataggaacaactgggcatggtca

SEQ ID NO: 42226 - DNA, 25 bp, Homo sapien
gaatttaatgtctccagttgggctg

SEQ ID NO: 42227 - DNA, 25 bp, Homo sapien
gggcatggtcagtgataccctgagc

SEQ ID NO: 42228 - DNA, 25 bp, Homo sapien
taccctgagcaatcacattacttcg

SEQ ID NO: 42229 - DNA, 25 bp, Homo sapien
acattacttcgctagatcctgcact

SEQ ID NO: 42230 - DNA, 25 bp, Homo sapien
atcctgcactttttctctgaacaaa

SEQ ID NO: 42231 - DNA, 25 bp, Homo sapien
gagcatgtctttttattatttttgt

SEQ ID NO: 42232 - DNA, 25 bp, Homo sapien
gtactttccatatctcctgagttgg

SEQ ID NO: 42233 - DNA, 25 bp, Homo sapien
gtacagttctactttattcctgaag

SEQ ID NO: 42234 - DNA, 25 bp, Homo sapien
cagagacacttgactgagtcctcag

SEQ ID NO: 42235 - DNA, 25 bp, Homo sapien
gagtcctcagagacacttgacgaac

SEQ ID NO: 42236 - DNA, 25 bp, Homo sapien
ctctgcggccgtagatggagcaagt

SEQ ID NO: 42237 - DNA, 25 bp, Homo sapien
gatggagcaagttggggcggagact

SEQ ID NO: 42238 - DNA, 25 bp, Homo sapien
gacccaagagcgagggcaccgtata

SEQ ID NO: 42239 - DNA, 25 bp, Homo sapien
aagagcgagggcaccgtataggccg

SEQ ID NO: 42240 - DNA, 25 bp, Homo sapien
cccagtttcggggagcaatggtgtg

SEQ ID NO: 42241 - DNA, 25 bp, Homo sapien
cggggagcaatggtgtgccgaggcg

SEQ ID NO: 42242 - DNA, 25 bp, Homo sapien
agcaatggtgtgccgaggcgcactg

SEQ ID NO: 42243 - DNA, 25 bp, Homo sapien
tccgggaagtacctgccaggtcccg

SEQ ID NO: 42244 - DNA, 25 bp, Homo sapien
cggcgtgggcggccgtagatggagt

SEQ ID NO: 42245 - DNA, 25 bp, Homo sapien
gggcggccgtagatggagtaggcgg

SEQ ID NO: 42246 - DNA, 25 bp, Homo sapien
agatggagtaggcgggggcgccgtc

SEQ ID NO: 42247 - DNA, 25 bp, Homo sapien
gggttagacaagtactcccctgtgg

SEQ ID NO: 42248 - DNA, 25 bp, Homo sapien
aagtactcccctgtggagtttctgc

SEQ ID NO: 42249 - DNA, 25 bp, Homo sapien
ttcttcgttcttctgttaattcttc

SEQ ID NO: 42250 - DNA, 25 bp, Homo sapien
agaacacagacctgccgaaacgaca

SEQ ID NO: 42251 - DNA, 25 bp, Homo sapien
gaaacgacacaggatggcgctttgc

SEQ ID NO: 42252 - DNA, 25 bp, Homo sapien
gcgctttgctttttgttagttctcc

SEQ ID NO: 42253 - DNA, 25 bp, Homo sapien
aacccttggggcacatgcaagcact

SEQ ID NO: 42254 - DNA, 25 bp, Homo sapien
aaaccaagagtcatcttactccaga

SEQ ID NO: 42255 - DNA, 25 bp, Homo sapien
ggaagttggacatgcatattcccaa

SEQ ID NO: 42256 - DNA, 25 bp, Homo sapien
gagacaggagagcagctcgggggtt

SEQ ID NO: 42257 - DNA, 25 bp, Homo sapien
aagagccggtccaaggcaacacaaa

SEQ ID NO: 42258 - DNA, 25 bp, Homo sapien
tttttggtggacagaatattttgga

SEQ ID NO: 42259 - DNA, 25 bp, Homo sapien
atattttggaggtctccgtcgctgt

SEQ ID NO: 42260 - DNA, 25 bp, Homo sapien
gtctccgtcgctgtttagaatgtgg

SEQ ID NO: 42261 - DNA, 25 bp, Homo sapien
cgtcgctgtttagaatgtggccact

SEQ ID NO: 42262 - DNA, 25 bp, Homo sapien
gtaaatacacatcaatacatatata

SEQ ID NO: 42263 - DNA, 25 bp, Homo sapien
tgggccctgtgtagtcagtgcatga

SEQ ID NO: 42264 - DNA, 25 bp, Homo sapien
gtcagtgcatgaggcttgcatagcc

SEQ ID NO: 42265 - DNA, 25 bp, Homo sapien
gtgcatgaggcttgcatagcccaaa

SEQ ID NO: 42266 - DNA, 25 bp, Homo sapien
cagtttttggactgtgacccatgca

SEQ ID NO: 42267 - DNA, 25 bp, Homo sapien
ttacatattcagaaacttcgtgttt

SEQ ID NO: 42268 - DNA, 25 bp, Homo sapien
tcagaaacttcgtgtttttttggtg

SEQ ID NO: 42269 - DNA, 25 bp, Homo sapien
cttcctctatctgattctctaacaa

SEQ ID NO: 42270 - DNA, 25 bp, Homo sapien
cagaccttccatgagtcaagctttg

SEQ ID NO: 42271 - DNA, 25 bp, Homo sapien
gacctataaatggcaccacccagcc

SEQ ID NO: 42272 - DNA, 25 bp, Homo sapien
agcccaatggacagatgccccaggc

SEQ ID NO: 42273 - DNA, 25 bp, Homo sapien
ccccaggctgcagattctgtcagtg

SEQ ID NO: 42274 - DNA, 25 bp, Homo sapien
gattctgtcagtgctgttctcgaag

SEQ ID NO: 42275 - DNA, 25 bp, Homo sapien
tgttctcgaagaggcccaggcacat

SEQ ID NO: 42276 - DNA, 25 bp, Homo sapien
tgcagaggtcctgtgacaccagtgg

SEQ ID NO: 42277 - DNA, 25 bp, Homo sapien
ccccaaggccaagggcacaggcagc

SEQ ID NO: 42278 - DNA, 25 bp, Homo sapien
ccaagggcacaggcagcgtggtctt

SEQ ID NO: 42279 - DNA, 25 bp, Homo sapien
caggcacgaagcatcaatgttcaca

SEQ ID NO: 42280 - DNA, 25 bp, Homo sapien
aggatgacctgagtgcgggaggttg

SEQ ID NO: 42281 - DNA, 25 bp, Homo sapien
gagtgcgggaggttggggttgcagt

SEQ ID NO: 42282 - DNA, 25 bp, Homo sapien
tagctcatggagttaggaacaagta

SEQ ID NO: 42283 - DNA, 25 bp, Homo sapien
tatcagagtgtgcctgacagtgagt

SEQ ID NO: 42284 - DNA, 25 bp, Homo sapien
gaaaatatctactctctttggatga

SEQ ID NO: 42285 - DNA, 25 bp, Homo sapien
atttaacacttcactctcagatata

SEQ ID NO: 42286 - DNA, 25 bp, Homo sapien
ttagctgactttttagattcttttt

SEQ ID NO: 42287 - DNA, 25 bp, Homo sapien
gatgtagttctcagatatatacggg

SEQ ID NO: 42288 - DNA, 25 bp, Homo sapien
tatatacgggatttctagttcttaa

SEQ ID NO: 42289 - DNA, 25 bp, Homo sapien
aactcaggatcatacccataaaccc

SEQ ID NO: 42290 - DNA, 25 bp, Homo sapien
tcatacccataaacccactgtttag

SEQ ID NO: 42291 - DNA, 25 bp, Homo sapien
ggagttccaagctaactcctcttct

SEQ ID NO: 42292 - DNA, 25 bp, Homo sapien
taccagctccaaaaaatcacaatta

SEQ ID NO: 42293 - DNA, 25 bp, Homo sapien
tacctccaaccaacaaaacctgttg

SEQ ID NO: 42294 - DNA, 25 bp, Homo sapien
gattttccaggaccaacatcatttc

SEQ ID NO: 42295 - DNA, 25 bp, Homo sapien
ggaccaacatcatttctgacctaga

SEQ ID NO: 42296 - DNA, 25 bp, Homo sapien
gagcaaatctcagagctgacagcaa

SEQ ID NO: 42297 - DNA, 25 bp, Homo sapien
gaccaccagtctgcccagaaattgc

SEQ ID NO: 42298 - DNA, 25 bp, Homo sapien
tgcccagaaattgctctccagtgaa

SEQ ID NO: 42299 - DNA, 25 bp, Homo sapien
agtgaaatggatctccgctgtgctg

SEQ ID NO: 42300 - DNA, 25 bp, Homo sapien
ggatctccgctgtgctgagatgaaa

SEQ ID NO: 42301 - DNA, 25 bp, Homo sapien
ctaccacgcaagaactccacaggga

SEQ ID NO: 42302 - DNA, 25 bp, Homo sapien
tgataaacggtgttgtttttgttgt

SEQ ID NO: 42303 - DNA, 25 bp, Homo sapien
tttttgttgttgttgtttgagacgg

SEQ ID NO: 42304 - DNA, 25 bp, Homo sapien
gttgttgttgtttgagacggagtct

SEQ ID NO: 42305 - DNA, 25 bp, Homo sapien
tgagacggagtctgtgtcacacagg

SEQ ID NO: 42306 - DNA, 25 bp, Homo sapien
ctgtgtcacacaggctggagtgcaa

SEQ ID NO: 42307 - DNA, 25 bp, Homo sapien
ggcctccacagggctgggaaaggtg

SEQ ID NO: 42308 - DNA, 25 bp, Homo sapien
gctgggaaaggtggccagggcctcc

SEQ ID NO: 42309 - DNA, 25 bp, Homo sapien
cttcagccagcctgcgggagagaaa

SEQ ID NO: 42310 - DNA, 25 bp, Homo sapien
tcagccagcctgcgggagagaaaga

SEQ ID NO: 42311 - DNA, 25 bp, Homo sapien
gccagcctgcgggagagaaagatga

SEQ ID NO: 42312 - DNA, 25 bp, Homo sapien
gagaaagatgataaacggtgttgtt

SEQ ID NO: 42313 - DNA, 25 bp, Homo sapien
gaactatgccctggttattctaatc

SEQ ID NO: 42314 - DNA, 25 bp, Homo sapien
tgccctggttattctaatcccaatt

SEQ ID NO: 42315 - DNA, 25 bp, Homo sapien
aatcccaattacatgtacttagcaa

SEQ ID NO: 42316 - DNA, 25 bp, Homo sapien
gcaaagtgttatactgatcttgagg

SEQ ID NO: 42317 - DNA, 25 bp, Homo sapien
ctttattgcttcctactgttaccaa

SEQ ID NO: 42318 - DNA, 25 bp, Homo sapien
acgaatttactcttcaacaaatcag

SEQ ID NO: 42319 - DNA, 25 bp, Homo sapien
agttgtgcttttattatccttcatt

SEQ ID NO: 42320 - DNA, 25 bp, Homo sapien
tattatccttcatttttgatgtaag

SEQ ID NO: 42321 - DNA, 25 bp, Homo sapien
gggtattgtgcttagatttgaaggt

SEQ ID NO: 42322 - DNA, 25 bp, Homo sapien
gaatgcattccactagtagcactac

SEQ ID NO: 42323 - DNA, 25 bp, Homo sapien
aaactgcagccttaagaatatttct

SEQ ID NO: 42324 - DNA, 25 bp, Homo sapien
tgcccaaattcagcatgccaggatt

SEQ ID NO: 42325 - DNA, 25 bp, Homo sapien
gaaggggcccaaatttaagatgcct

SEQ ID NO: 42326 - DNA, 25 bp, Homo sapien
ggggcccaaatttaagatgcctgag

SEQ ID NO: 42327 - DNA, 25 bp, Homo sapien
gcctgagatgaacatcaaagctccc

SEQ ID NO: 42328 - DNA, 25 bp, Homo sapien
gaacatcaaagctcccaaaatctct

SEQ ID NO: 42329 - DNA, 25 bp, Homo sapien
tcaaagctcccaaaatctctatgcc

SEQ ID NO: 42330 - DNA, 25 bp, Homo sapien
atctctatgcctgactttgatttgc

SEQ ID NO: 42331 - DNA, 25 bp, Homo sapien
atgcctgactttgatttgcacctga

SEQ ID NO: 42332 - DNA, 25 bp, Homo sapien
gatttgcacctgaaaggtcccaagg

SEQ ID NO: 42333 - DNA, 25 bp, Homo sapien
gaaaggtcccaaggtgaagggtgat

SEQ ID NO: 42334 - DNA, 25 bp, Homo sapien
aaggtgaagggtgatgtggatgttt

SEQ ID NO: 42335 - DNA, 25 bp, Homo sapien
aattctctctctaaagtcgagagct

SEQ ID NO: 42336 - DNA, 25 bp, Homo sapien
ctctaaagtcgagagctcaccaccc

SEQ ID NO: 42337 - DNA, 25 bp, Homo sapien
agagacggccattatgcagcctcac

SEQ ID NO: 42338 - DNA, 25 bp, Homo sapien
gtcactcctgggggcggtaggatat

SEQ ID NO: 42339 - DNA, 25 bp, Homo sapien
tgggggcggtaggatattttatcct

SEQ ID NO: 42340 - DNA, 25 bp, Homo sapien
aaaacaccttaaattctcacatcag

SEQ ID NO: 42341 - DNA, 25 bp, Homo sapien
caccttaaattctcacatcagccac

SEQ ID NO: 42342 - DNA, 25 bp, Homo sapien
actcttaacaccttaatgtagcacc

SEQ ID NO: 42343 - DNA, 25 bp, Homo sapien
aacaccttaatgtagcaccttccaa

SEQ ID NO: 42344 - DNA, 25 bp, Homo sapien
accttaatgtagcaccttccaactt

SEQ ID NO: 42345 - DNA, 25 bp, Homo sapien
acttttcctgggcatttatgtacaa

SEQ ID NO: 42346 - DNA, 25 bp, Homo sapien
gggaatagtttttcattttatgcca

SEQ ID NO: 42347 - DNA, 25 bp, Homo sapien
agtttttcattttatgccaagtgat

SEQ ID NO: 42348 - DNA, 25 bp, Homo sapien
tatgccaagtgatttttctgtttta

SEQ ID NO: 42349 - DNA, 25 bp, Homo sapien
gatttttctgttttattagctagtg

SEQ ID NO: 42350 - DNA, 25 bp, Homo sapien
ttattagctagtgaaaccaatgttg

SEQ ID NO: 42351 - DNA, 25 bp, Homo sapien
taacaattttagagtttgtgctaga

SEQ ID NO: 42352 - DNA, 25 bp, Homo sapien
aagatattctgaggccggatgtggt

SEQ ID NO: 42353 - DNA, 25 bp, Homo sapien
tctgaggccggatgtggtggctcac

SEQ ID NO: 42354 - DNA, 25 bp, Homo sapien
tataaatacaaaaatcgtccgggcg

SEQ ID NO: 42355 - DNA, 25 bp, Homo sapien
tcgcttgagcccggaaggcggaggc

SEQ ID NO: 42356 - DNA, 25 bp, Homo sapien
tgagctgagatggcaccactgcact

SEQ ID NO: 42357 - DNA, 25 bp, Homo sapien
tccacaatccccttaaaaactgtag

SEQ ID NO: 42358 - DNA, 25 bp, Homo sapien
aatttgaaggtttgctcctgtctcc

SEQ ID NO: 42359 - DNA, 25 bp, Homo sapien
ctcagaagcctgtaatcattaaact

SEQ ID NO: 42360 - DNA, 25 bp, Homo sapien
caggtcctgcatgccagtaaaacta

SEQ ID NO: 42361 - DNA, 25 bp, Homo sapien
gtcctgcatgccagtaaaactactc

SEQ ID NO: 42362 - DNA, 25 bp, Homo sapien
gtaaaactactcatgtcagctgttc

SEQ ID NO: 42363 - DNA, 25 bp, Homo sapien
aaactactcatgtcagctgttctgc

SEQ ID NO: 42364 - DNA, 25 bp, Homo sapien
tactcatgtcagctgttctgcagga

SEQ ID NO: 42365 - DNA, 25 bp, Homo sapien
catgtcagctgttctgcaggatccc

SEQ ID NO: 42366 - DNA, 25 bp, Homo sapien
tcagctgttctgcaggatcccatga

SEQ ID NO: 42367 - DNA, 25 bp, Homo sapien
gctgttctgcaggatcccatgagaa

SEQ ID NO: 42368 - DNA, 25 bp, Homo sapien
cgacgtgatcgtggacctgtgggag

SEQ ID NO: 42369 - DNA, 25 bp, Homo sapien
acgtgatcgtggacctgtgggaggg

SEQ ID NO: 42370 - DNA, 25 bp, Homo sapien
tgatcgtggacctgtgggaggggag

SEQ ID NO: 42371 - DNA, 25 bp, Homo sapien
gtggacctgtgggaggggaggcacg

SEQ ID NO: 42372 - DNA, 25 bp, Homo sapien
acctgtgggaggggaggcacgtggc

SEQ ID NO: 42373 - DNA, 25 bp, Homo sapien
tgtgcagccggctcgaacgagaggc

SEQ ID NO: 42374 - DNA, 25 bp, Homo sapien
gcagccggctcgaacgagaggccgc

SEQ ID NO: 42375 - DNA, 25 bp, Homo sapien
cccgacttgcagacctaggttgagc

SEQ ID NO: 42376 - DNA, 25 bp, Homo sapien
acttgcagacctaggttgagcagag

SEQ ID NO: 42377 - DNA, 25 bp, Homo sapien
ggacgcgcgtagcgcgggagcaggg

SEQ ID NO: 42378 - DNA, 25 bp, Homo sapien
gacgcgcgtagcgcgggagcagggc

SEQ ID NO: 42379 - DNA, 25 bp, Homo sapien
cacacgtgcatcttggatatctctt

SEQ ID NO: 42380 - DNA, 25 bp, Homo sapien
atcttggatatctcttgttaatgtc

SEQ ID NO: 42381 - DNA, 25 bp, Homo sapien
tgtaggtaatcaagttttctggtta

SEQ ID NO: 42382 - DNA, 25 bp, Homo sapien
caaagagaggcgttcctgccaggat

SEQ ID NO: 42383 - DNA, 25 bp, Homo sapien
agagaaataatcccagccaacagtt

SEQ ID NO: 42384 - DNA, 25 bp, Homo sapien
atcccagccaacagttagtaagctc

SEQ ID NO: 42385 - DNA, 25 bp, Homo sapien
tagtaagctcttatgtgtcaggcct

SEQ ID NO: 42386 - DNA, 25 bp, Homo sapien
gtgtcaggccttatccaaacagttc

SEQ ID NO: 42387 - DNA, 25 bp, Homo sapien
ggccttatccaaacagttcacacga

SEQ ID NO: 42388 - DNA, 25 bp, Homo sapien
ttatccaaacagttcacacgaagac

SEQ ID NO: 42389 - DNA, 25 bp, Homo sapien
cgttcctgccaggataggttgcatc

SEQ ID NO: 42390 - DNA, 25 bp, Homo sapien
agccacacatcctcttggatttgat

SEQ ID NO: 42391 - DNA, 25 bp, Homo sapien
ttggatttgatgatgttgtacgatt

SEQ ID NO: 42392 - DNA, 25 bp, Homo sapien
gatgatgttgtacgattagaaattg

SEQ ID NO: 42393 - DNA, 25 bp, Homo sapien
gaaattgaatccaatatctgcaggg

SEQ ID NO: 42394 - DNA, 25 bp, Homo sapien
tgaatccaatatctgcagggaaggt

SEQ ID NO: 42395 - DNA, 25 bp, Homo sapien
cccaactgtttcacaactccattac

SEQ ID NO: 42396 - DNA, 25 bp, Homo sapien
actgtttcacaactccattacgtca

SEQ ID NO: 42397 - DNA, 25 bp, Homo sapien
actccattacgtcaggcctggacaa

SEQ ID NO: 42398 - DNA, 25 bp, Homo sapien
ccattacgtcaggcctggacaacca

SEQ ID NO: 42399 - DNA, 25 bp, Homo sapien
ttacgtcaggcctggacaaccatgg

SEQ ID NO: 42400 - DNA, 25 bp, Homo sapien
cagaatgatgccatgattttatatg

SEQ ID NO: 42401 - DNA, 25 bp, Homo sapien
tccttcaatgctatcattccctttg

SEQ ID NO: 42402 - DNA, 25 bp, Homo sapien
cattccctttgatattggaccatat

SEQ ID NO: 42403 - DNA, 25 bp, Homo sapien
aggtattgctgttagatatccccga

SEQ ID NO: 42404 - DNA, 25 bp, Homo sapien
gaccatatgcatagtaccgagaaac

SEQ ID NO: 42405 - DNA, 25 bp, Homo sapien
ccttcaatgctatcattccctttga

SEQ ID NO: 42406 - DNA, 25 bp, Homo sapien
ttccctttgatattggaccatatgc

SEQ ID NO: 42407 - DNA, 25 bp, Homo sapien
ggtattgctgttagatatccccgag

SEQ ID NO: 42408 - DNA, 25 bp, Homo sapien
cgagtccttcaatgctatcattccc

SEQ ID NO: 42409 - DNA, 25 bp, Homo sapien
tatcattccctttgatattggacca

SEQ ID NO: 42410 - DNA, 25 bp, Homo sapien
attggaccatatgcatagtaccgag

SEQ ID NO: 42411 - DNA, 25 bp, Homo sapien
caatgctatcattccctttgatatt

SEQ ID NO: 42412 - DNA, 25 bp, Homo sapien
taacaggggcatcccaagaagaggg

SEQ ID NO: 42413 - DNA, 25 bp, Homo sapien
agagctggcatgaggctctgctgca

SEQ ID NO: 42414 - DNA, 25 bp, Homo sapien
tctgctgcagaggccactgaggcaa

SEQ ID NO: 42415 - DNA, 25 bp, Homo sapien
gacagaagggggttgctgtgggggc

SEQ ID NO: 42416 - DNA, 25 bp, Homo sapien
gcaaagcgcggctggagtgagaccc

SEQ ID NO: 42417 - DNA, 25 bp, Homo sapien
agtgagacccagtgaggcagcacgc

SEQ ID NO: 42418 - DNA, 25 bp, Homo sapien
cctcctgggtcactccaagtgtgag

SEQ ID NO: 42419 - DNA, 25 bp, Homo sapien
cactccaagtgtgagggcaggccct

SEQ ID NO: 42420 - DNA, 25 bp, Homo sapien
gtgggggcaagtcagcagtctagga

SEQ ID NO: 42421 - DNA, 25 bp, Homo sapien
gtcagcagtctaggaggtggcacag

SEQ ID NO: 42422 - DNA, 25 bp, Homo sapien
aataatgaccaaggagccggccctc

SEQ ID NO: 42423 - DNA, 25 bp, Homo sapien
aacctgtgagagtacaccagtgccc

SEQ ID NO: 42424 - DNA, 25 bp, Homo sapien
tgtgagagtacaccagtgcccagag

SEQ ID NO: 42425 - DNA, 25 bp, Homo sapien
agagtacaccagtgcccagaggcac

SEQ ID NO: 42426 - DNA, 25 bp, Homo sapien
cttcgtgacattctgcatattttct

SEQ ID NO: 42427 - DNA, 25 bp, Homo sapien
gcccagaggcacatacacgaaaaga

SEQ ID NO: 42428 - DNA, 25 bp, Homo sapien
cgaagttgatgtgagaatactgatt

SEQ ID NO: 42429 - DNA, 25 bp, Homo sapien
ggcacatacacgaaaagaagggaga

SEQ ID NO: 42430 - DNA, 25 bp, Homo sapien
gggagaaatggcttacatctcttct

SEQ ID NO: 42431 - DNA, 25 bp, Homo sapien
gaaatggcttacatctcttctatgg

SEQ ID NO: 42432 - DNA, 25 bp, Homo sapien
ggcttacatctcttctatggataca

SEQ ID NO: 42433 - DNA, 25 bp, Homo sapien
ttacatctcttctatggatacaggg

SEQ ID NO: 42434 - DNA, 25 bp, Homo sapien
aaatgcaaattagctggacaggggt

SEQ ID NO: 42435 - DNA, 25 bp, Homo sapien
cgcacatgggcgtgtgccagggaga

SEQ ID NO: 42436 - DNA, 25 bp, Homo sapien
ggcgtgtgccagggagagtcggggc

SEQ ID NO: 42437 - DNA, 25 bp, Homo sapien
tgttgcggggggcgcatgtagctgc

SEQ ID NO: 42438 - DNA, 25 bp, Homo sapien
acgcccctctgtaattgctgaaata

SEQ ID NO: 42439 - DNA, 25 bp, Homo sapien
gaatggtgtccccttaaaagatata

SEQ ID NO: 42440 - DNA, 25 bp, Homo sapien
tggtgtccccttaaaagatatattc

SEQ ID NO: 42441 - DNA, 25 bp, Homo sapien
gatatattcaggtgctgaccctcag

SEQ ID NO: 42442 - DNA, 25 bp, Homo sapien
atattcaggtgctgaccctcagtca

SEQ ID NO: 42443 - DNA, 25 bp, Homo sapien
cctcagtcactgggaatgggaccta

SEQ ID NO: 42444 - DNA, 25 bp, Homo sapien
agtcactgggaatgggacctatctg

SEQ ID NO: 42445 - DNA, 25 bp, Homo sapien
tcgctcctgaagaaaaccgggctcg

SEQ ID NO: 42446 - DNA, 25 bp, Homo sapien
gctcctgaagaaaaccgggctcgga

SEQ ID NO: 42447 - DNA, 25 bp, Homo sapien
ggctcggaaaagcggcgcgtgtggg

SEQ ID NO: 42448 - DNA, 25 bp, Homo sapien
cggaaaagcggcgcgtgtggggcct

SEQ ID NO: 42449 - DNA, 25 bp, Homo sapien
gcgacagggccccgagaagggagag

SEQ ID NO: 42450 - DNA, 25 bp, Homo sapien
agggccccgagaagggagagagcga

SEQ ID NO: 42451 - DNA, 25 bp, Homo sapien
gagagagcgaggagtcctgagccgg

SEQ ID NO: 42452 - DNA, 25 bp, Homo sapien
ttgtcggctcaggtgtcggtgaaaa

SEQ ID NO: 42453 - DNA, 25 bp, Homo sapien
gtcggctcaggtgtcggtgaaaatg

SEQ ID NO: 42454 - DNA, 25 bp, Homo sapien
ggctcaggtgtcggtgaaaatgtga

SEQ ID NO: 42455 - DNA, 25 bp, Homo sapien
ggtgtcggtgaaaatgtgatcagga

SEQ ID NO: 42456 - DNA, 25 bp, Homo sapien
taacttcattcctcatgttgttcct

SEQ ID NO: 42457 - DNA, 25 bp, Homo sapien
tcattcctcatgttgttcctggata

SEQ ID NO: 42458 - DNA, 25 bp, Homo sapien
tcatgttgttcctggataagtcatt

SEQ ID NO: 42459 - DNA, 25 bp, Homo sapien
aagtcatttcatctttcttagcctt

SEQ ID NO: 42460 - DNA, 25 bp, Homo sapien
tcatttcatctttcttagccttaaa

SEQ ID NO: 42461 - DNA, 25 bp, Homo sapien
gaaataatgtccatctcctagggtt

SEQ ID NO: 42462 - DNA, 25 bp, Homo sapien
atgtccatctcctagggttgatatg

SEQ ID NO: 42463 - DNA, 25 bp, Homo sapien
ccttggacagttaaatctggaggtg

SEQ ID NO: 42464 - DNA, 25 bp, Homo sapien
ctagaagttccatgtttgctttaga

SEQ ID NO: 42465 - DNA, 25 bp, Homo sapien
gttccatgtttgctttagaagcctt

SEQ ID NO: 42466 - DNA, 25 bp, Homo sapien
gaagccttagtttagaccaggtgca

SEQ ID NO: 42467 - DNA, 25 bp, Homo sapien
aagtcgtatttatattgacctttgt

SEQ ID NO: 42468 - DNA, 25 bp, Homo sapien
tgacctttgtaagagctcaattatt

SEQ ID NO: 42469 - DNA, 25 bp, Homo sapien
ggaagcaaggaatatcaccattctg

SEQ ID NO: 42470 - DNA, 25 bp, Homo sapien
atcaccattctgagtaatacaattt

SEQ ID NO: 42471 - DNA, 25 bp, Homo sapien
caatttcaactaatctttatttctt

SEQ ID NO: 42472 - DNA, 25 bp, Homo sapien
atttcttctacttgaagtcagtgcc

SEQ ID NO: 42473 - DNA, 25 bp, Homo sapien
gaagtcagtgcctatctaccacaaa

SEQ ID NO: 42474 - DNA, 25 bp, Homo sapien
cagtgcctatctaccacaaacattc

SEQ ID NO: 42475 - DNA, 25 bp, Homo sapien
aacattcctatatcagtgtgcaaat

SEQ ID NO: 42476 - DNA, 25 bp, Homo sapien
ggagacaataggctttttacgacaa

SEQ ID NO: 42477 - DNA, 25 bp, Homo sapien
taggctttttacgacaatgaattgg

SEQ ID NO: 42478 - DNA, 25 bp, Homo sapien
gtcttggcgcggggagcggagggaa

SEQ ID NO: 42479 - DNA, 25 bp, Homo sapien
ttggcgcggggagcggagggaaggg

SEQ ID NO: 42480 - DNA, 25 bp, Homo sapien
ggagcggagggaagggacgaaggag

SEQ ID NO: 42481 - DNA, 25 bp, Homo sapien
gcggagggaagggacgaaggaggag

SEQ ID NO: 42482 - DNA, 25 bp, Homo sapien
ggaagggacgaaggaggagtaggtg

SEQ ID NO: 42483 - DNA, 25 bp, Homo sapien
ggaggagtaggtgaaagcggggtga

SEQ ID NO: 42484 - DNA, 25 bp, Homo sapien
ggagtaggtgaaagcggggtgaggg

SEQ ID NO: 42485 - DNA, 25 bp, Homo sapien
tgaaagcggggtgaggggcggaagg

SEQ ID NO: 42486 - DNA, 25 bp, Homo sapien
acccgcactatgcaggcagactgcc

SEQ ID NO: 42487 - DNA, 25 bp, Homo sapien
cgcactatgcaggcagactgccggc

SEQ ID NO: 42488 - DNA, 25 bp, Homo sapien
actatgcaggcagactgccggccgc

SEQ ID NO: 42489 - DNA, 25 bp, Homo sapien
gttcatacaagtacttcacgtggtt

SEQ ID NO: 42490 - DNA, 25 bp, Homo sapien
cacgtggttaaagaagcccatcccg

SEQ ID NO: 42491 - DNA, 25 bp, Homo sapien
gcccatcccggctgtgagaatagcg

SEQ ID NO: 42492 - DNA, 25 bp, Homo sapien
gaatagcgtgcagtagctcgcgcgt

SEQ ID NO: 42493 - DNA, 25 bp, Homo sapien
gcagtagctcgcgcgttaagaacgg

SEQ ID NO: 42494 - DNA, 25 bp, Homo sapien
aagaacgggcagaacgccactcaaa

SEQ ID NO: 42495 - DNA, 25 bp, Homo sapien
gaacgccactcaaaagcacgtcggg

SEQ ID NO: 42496 - DNA, 25 bp, Homo sapien
gcacgtcgggatggtgggtttcgga

SEQ ID NO: 42497 - DNA, 25 bp, Homo sapien
tgcccttaccgcgtgagagtgcgtg

SEQ ID NO: 42498 - DNA, 25 bp, Homo sapien
tgagagtgcgtggctttttctccac

SEQ ID NO: 42499 - DNA, 25 bp, Homo sapien
aattaggtgcttgaacttcctcaga

SEQ ID NO: 42500 - DNA, 25 bp, Homo sapien
atgacagcggaatgagccgggaaag

SEQ ID NO: 42501 - DNA, 25 bp, Homo sapien
gaaaggaaagaggccccgtgggatg

SEQ ID NO: 42502 - DNA, 25 bp, Homo sapien
aaagaggccccgtgggatgctgggg

SEQ ID NO: 42503 - DNA, 25 bp, Homo sapien
cccgtgggatgctgggggtcgagtc

SEQ ID NO: 42504 - DNA, 25 bp, Homo sapien
ctcactcaccggcggggaggggagg

SEQ ID NO: 42505 - DNA, 25 bp, Homo sapien
cggcggggaggggaggagcagccgg

SEQ ID NO: 42506 - DNA, 25 bp, Homo sapien
ctcggccctgggatgctgggaaggg

SEQ ID NO: 42507 - DNA, 25 bp, Homo sapien
gggatgctgggaagggaacgaggcg

SEQ ID NO: 42508 - DNA, 25 bp, Homo sapien
gaagggaacgaggcgaggggctgga

SEQ ID NO: 42509 - DNA, 25 bp, Homo sapien
gcgaggggctggaggggaaccccag

SEQ ID NO: 42510 - DNA, 25 bp, Homo sapien
ggggaaccccaggtcaaaatgacag

SEQ ID NO: 42511 - DNA, 25 bp, Homo sapien
gggcccacagaggctgctggggcct

SEQ ID NO: 42512 - DNA, 25 bp, Homo sapien
tgagcttgccagccaggctgcagct

SEQ ID NO: 42513 - DNA, 25 bp, Homo sapien
gcagctgagggcctggacatagcca

SEQ ID NO: 42514 - DNA, 25 bp, Homo sapien
cacaatgactcacataccttcttct

SEQ ID NO: 42515 - DNA, 25 bp, Homo sapien
gctgcacacagggatgacaggtacc

SEQ ID NO: 42516 - DNA, 25 bp, Homo sapien
gtaccaatgtcatggacacccacct

SEQ ID NO: 42517 - DNA, 25 bp, Homo sapien
cggcctcggtgatggcataggtcac

SEQ ID NO: 42518 - DNA, 25 bp, Homo sapien
ggcataggtcacattttgggagttc

SEQ ID NO: 42519 - DNA, 25 bp, Homo sapien
aagggcaaggtcagatggcagagca

SEQ ID NO: 42520 - DNA, 25 bp, Homo sapien
cccctacccctgaggatgaggacaa

SEQ ID NO: 42521 - DNA, 25 bp, Homo sapien
ctcaccctgtttctttctgtgaagc

SEQ ID NO: 42522 - DNA, 25 bp, Homo sapien
gaatatttacttcatgtccacatca

SEQ ID NO: 42523 - DNA, 25 bp, Homo sapien
gtccacatcatgaaaaaaattacca

SEQ ID NO: 42524 - DNA, 25 bp, Homo sapien
attaccatgtatcaaatgggtgacg

SEQ ID NO: 42525 - DNA, 25 bp, Homo sapien
atgggtgacgaattaatactagata

SEQ ID NO: 42526 - DNA, 25 bp, Homo sapien
aaatgtagacgggcatatatgacta

SEQ ID NO: 42527 - DNA, 25 bp, Homo sapien
gacgggcatatatgactaagaagac

SEQ ID NO: 42528 - DNA, 25 bp, Homo sapien
gactaagaagacatttttaagcata

SEQ ID NO: 42529 - DNA, 25 bp, Homo sapien
tacataatcatttacaacttgtgtg

SEQ ID NO: 42530 - DNA, 25 bp, Homo sapien
atcatttacaacttgtgtgttacaa

SEQ ID NO: 42531 - DNA, 25 bp, Homo sapien
aacattattcaaagtcttaaagaca

SEQ ID NO: 42532 - DNA, 25 bp, Homo sapien
gtatatattggatagagttcttgaa

SEQ ID NO: 42533 - DNA, 25 bp, Homo sapien
cccacaacccgccaggatttaatct

SEQ ID NO: 42534 - DNA, 25 bp, Homo sapien
cacaacccgccaggatttaatcttt

SEQ ID NO: 42535 - DNA, 25 bp, Homo sapien
acccgccaggatttaatcttttatg

SEQ ID NO: 42536 - DNA, 25 bp, Homo sapien
ccaggaggaaagtcttgtaacgctt

SEQ ID NO: 42537 - DNA, 25 bp, Homo sapien
tcttgtaacgctttactttttctct

SEQ ID NO: 42538 - DNA, 25 bp, Homo sapien
aagtgagtgtcagtagatgtgtttt

SEQ ID NO: 42539 - DNA, 25 bp, Homo sapien
gtagatgtgttttttacagtctgga

SEQ ID NO: 42540 - DNA, 25 bp, Homo sapien
gatgtgttttttacagtctggattt

SEQ ID NO: 42541 - DNA, 25 bp, Homo sapien
gaaatacagtttgtggctctgagcg

SEQ ID NO: 42542 - DNA, 25 bp, Homo sapien
acagtttgtggctctgagcgatgcc

SEQ ID NO: 42543 - DNA, 25 bp, Homo sapien
ttgtggctctgagcgatgccaccgg

SEQ ID NO: 42544 - DNA, 25 bp, Homo sapien
cctgtggcccagggaagtgccaggg

SEQ ID NO: 42545 - DNA, 25 bp, Homo sapien
ggcccagggaagtgccagggatccc

SEQ ID NO: 42546 - DNA, 25 bp, Homo sapien
gcccagggaagtgccagggatccct

SEQ ID NO: 42547 - DNA, 25 bp, Homo sapien
cagggaagtgccagggatccctggg

SEQ ID NO: 42548 - DNA, 25 bp, Homo sapien
gggaagtgccagggatccctgggaa

SEQ ID NO: 42549 - DNA, 25 bp, Homo sapien
gaagtgccagggatccctgggaagg

SEQ ID NO: 42550 - DNA, 25 bp, Homo sapien
agtgccagggatccctgggaaggcg

SEQ ID NO: 42551 - DNA, 25 bp, Homo sapien
ccagggatccctgggaaggcgggag

SEQ ID NO: 42552 - DNA, 25 bp, Homo sapien
gggatccctgggaaggcgggagatg

SEQ ID NO: 42553 - DNA, 25 bp, Homo sapien
cctgggaaggcgggagatggggaag

SEQ ID NO: 42554 - DNA, 25 bp, Homo sapien
ggcgggagatggggaaggggcaggg

SEQ ID NO: 42555 - DNA, 25 bp, Homo sapien
agtgcaccagatatgcgggtagcat

SEQ ID NO: 42556 - DNA, 25 bp, Homo sapien
acaagcacacccatcacattaaata

SEQ ID NO: 42557 - DNA, 25 bp, Homo sapien
gcacacccatcacattaaatacaaa

SEQ ID NO: 42558 - DNA, 25 bp, Homo sapien
aacattattgcaacacatcgaagag

SEQ ID NO: 42559 - DNA, 25 bp, Homo sapien
gcaacacatcgaagagaacattatt

SEQ ID NO: 42560 - DNA, 25 bp, Homo sapien
attgagttaaacttggagcctgaag

SEQ ID NO: 42561 - DNA, 25 bp, Homo sapien
tcagttcatcattcacactaaagaa

SEQ ID NO: 42562 - DNA, 25 bp, Homo sapien
agagtatattgctgttactaccatt

SEQ ID NO: 42563 - DNA, 25 bp, Homo sapien
gaactaggattttcaatcttgacac

SEQ ID NO: 42564 - DNA, 25 bp, Homo sapien
ttcaatcttgacacggttaaaaaca

SEQ ID NO: 42565 - DNA, 25 bp, Homo sapien
aaataggctcaatagtgcaccagat

SEQ ID NO: 42566 - DNA, 25 bp, Homo sapien
ggaaataataacacctcagaaggtt

SEQ ID NO: 42567 - DNA, 25 bp, Homo sapien
cctcagaaggtttttgtgaagatca

SEQ ID NO: 42568 - DNA, 25 bp, Homo sapien
agaagctaaatatatgtggcatgat

SEQ ID NO: 42569 - DNA, 25 bp, Homo sapien
atatgtggcatgatttgtaaagtgt

SEQ ID NO: 42570 - DNA, 25 bp, Homo sapien
gtaaagtgttatgcatatgtatgtt

SEQ ID NO: 42571 - DNA, 25 bp, Homo sapien
ccttgcctgctatgacttatctgag

SEQ ID NO: 42572 - DNA, 25 bp, Homo sapien
acttatctgagagccatgttcccat

SEQ ID NO: 42573 - DNA, 25 bp, Homo sapien
ccatttatctttttgccaactatgt

SEQ ID NO: 42574 - DNA, 25 bp, Homo sapien
ttgccaactatgttactgttgtcac

SEQ ID NO: 42575 - DNA, 25 bp, Homo sapien
actgttgtcacacctgaaatggctt

SEQ ID NO: 42576 - DNA, 25 bp, Homo sapien
ttgtcacacctgaaatggctttgtt

SEQ ID NO: 42577 - DNA, 25 bp, Homo sapien
taggatacagtgaattcctcttcaa

SEQ ID NO: 42578 - DNA, 25 bp, Homo sapien
gattttagcctgtaaacatccttta

SEQ ID NO: 42579 - DNA, 25 bp, Homo sapien
tgagttctgagttcctcatcaaaga

SEQ ID NO: 42580 - DNA, 25 bp, Homo sapien
ccttctagcctctaaaacctgcttt

SEQ ID NO: 42581 - DNA, 25 bp, Homo sapien
aacctgctttgtctttagtcattct

SEQ ID NO: 42582 - DNA, 25 bp, Homo sapien
tgtctttagtcattcttagtaacct

SEQ ID NO: 42583 - DNA, 25 bp, Homo sapien
ctctgtccttagtcatccttagaca

SEQ ID NO: 42584 - DNA, 25 bp, Homo sapien
ttagtcatccttagacacctgctct

SEQ ID NO: 42585 - DNA, 25 bp, Homo sapien
tggcttagagtgtgcagtccaaccc

SEQ ID NO: 42586 - DNA, 25 bp, Homo sapien
tgcagtccaaccctatccaataggg

SEQ ID NO: 42587 - DNA, 25 bp, Homo sapien
aacagtagggactagctgcgttaga

SEQ ID NO: 42588 - DNA, 25 bp, Homo sapien
gtctcccgtctgggactaaaacgtg

SEQ ID NO: 42589 - DNA, 25 bp, Homo sapien
gtctgggactaaaacgtgaactctg

SEQ ID NO: 42590 - DNA, 25 bp, Homo sapien
gggactaaaacgtgaactctgtaat

SEQ ID NO: 42591 - DNA, 25 bp, Homo sapien
gtgaactctgtaattctatgtgtta

SEQ ID NO: 42592 - DNA, 25 bp, Homo sapien
tgttactagcaaccggaaaagccca

SEQ ID NO: 42593 - DNA, 25 bp, Homo sapien
tagcaaccggaaaagcccactgtgt

SEQ ID NO: 42594 - DNA, 25 bp, Homo sapien
tcctacatgtctcccgttggggagg

SEQ ID NO: 42595 - DNA, 25 bp, Homo sapien
acatgtctcccgttggggaggcaag

SEQ ID NO: 42596 - DNA, 25 bp, Homo sapien
gtctcccgttggggaggcaagaggc

SEQ ID NO: 42597 - DNA, 25 bp, Homo sapien
aagaggctgaggggcttccgagccc

SEQ ID NO: 42598 - DNA, 25 bp, Homo sapien
tcacacagaggcacaacctggaccc

SEQ ID NO: 42599 - DNA, 25 bp, Homo sapien
gtaaaacaagatcacaccctggaac

SEQ ID NO: 42600 - DNA, 25 bp, Homo sapien
agatcacaccctggaacaattggag

SEQ ID NO: 42601 - DNA, 25 bp, Homo sapien
aattggaggattgcttgctgccctg

SEQ ID NO: 42602 - DNA, 25 bp, Homo sapien
ttgctgccctgcatcttaaggcgta

SEQ ID NO: 42603 - DNA, 25 bp, Homo sapien
ttaaggcgtattctagcagcaaagc

SEQ ID NO: 42604 - DNA, 25 bp, Homo sapien
gcttgtgatgcactgacttggggca

SEQ ID NO: 42605 - DNA, 25 bp, Homo sapien
agatgttcctcgcccagggaaatga

SEQ ID NO: 42606 - DNA, 25 bp, Homo sapien
acttttcttattcaccttgcttgtg

SEQ ID NO: 42607 - DNA, 25 bp, Homo sapien
tattcaccttgcttgtgcttaaaca

SEQ ID NO: 42608 - DNA, 25 bp, Homo sapien
gtgcttaaacacttatgttcatcta

SEQ ID NO: 42609 - DNA, 25 bp, Homo sapien
acatggctacttgtttgtaattttt

SEQ ID NO: 42610 - DNA, 25 bp, Homo sapien
ttttttctcatatcagattctactt

SEQ ID NO: 42611 - DNA, 25 bp, Homo sapien
gaattaccttatgaacagctgcttt

SEQ ID NO: 42612 - DNA, 25 bp, Homo sapien
agctgctttacccaggaacaaatgt

SEQ ID NO: 42613 - DNA, 25 bp, Homo sapien
aactgtgttctcaagtagaccactt

SEQ ID NO: 42614 - DNA, 25 bp, Homo sapien
tcataacatctcaagtcctgctcta

SEQ ID NO: 42615 - DNA, 25 bp, Homo sapien
aagtcctgctctacatagaatgacc

SEQ ID NO: 42616 - DNA, 25 bp, Homo sapien
caagaaaagttctccattccctgta

SEQ ID NO: 42617 - DNA, 25 bp, Homo sapien
acaggaactgcgacaaccttgcatc

SEQ ID NO: 42618 - DNA, 25 bp, Homo sapien
gacaaccttgcatcagacacattcg

SEQ ID NO: 42619 - DNA, 25 bp, Homo sapien
acacattcgatctctctattcatag

SEQ ID NO: 42620 - DNA, 25 bp, Homo sapien
ctattcatagttgcattctcttttt

SEQ ID NO: 42621 - DNA, 25 bp, Homo sapien
aggctgagatgggcgcatcgcatga

SEQ ID NO: 42622 - DNA, 25 bp, Homo sapien
atgggcgcatcgcatgaggtcggga

SEQ ID NO: 42623 - DNA, 25 bp, Homo sapien
attctggtcctttgttcatttaaca

SEQ ID NO: 42624 - DNA, 25 bp, Homo sapien
acatcttacaagtatttgtccatgt

SEQ ID NO: 42625 - DNA, 25 bp, Homo sapien
gtgtattagcttacactccttgcct

SEQ ID NO: 42626 - DNA, 25 bp, Homo sapien
acactccttgcctgttcaaaatgtc

SEQ ID NO: 42627 - DNA, 25 bp, Homo sapien
aatgtctttcaggcacagcactggc

SEQ ID NO: 42628 - DNA, 25 bp, Homo sapien
agcactggcctttaagcctgtgtcg

SEQ ID NO: 42629 - DNA, 25 bp, Homo sapien
aagcctgtgtcgtagggatttccag

SEQ ID NO: 42630 - DNA, 25 bp, Homo sapien
tgtttctgtccctaggtttaaggct

SEQ ID NO: 42631 - DNA, 25 bp, Homo sapien
ggtttaaggcttcatgtcatggagg

SEQ ID NO: 42632 - DNA, 25 bp, Homo sapien
gcagtggggtgatggctatccatgc

SEQ ID NO: 42633 - DNA, 25 bp, Homo sapien
gggtgatggctatccatgcttgaac

SEQ ID NO: 42634 - DNA, 25 bp, Homo sapien
tgatggctatccatgcttgaacatt

SEQ ID NO: 42635 - DNA, 25 bp, Homo sapien
ggaatgttctccaagcaaaagctca

SEQ ID NO: 42636 - DNA, 25 bp, Homo sapien
gagaaatgaaggtcatgttcaggga

SEQ ID NO: 42637 - DNA, 25 bp, Homo sapien
gttcagggaacagtgaggtcagaat

SEQ ID NO: 42638 - DNA, 25 bp, Homo sapien
gaaaggcgagggtcagattaggaaa

SEQ ID NO: 42639 - DNA, 25 bp, Homo sapien
ggaaatatctgaaacttcagcctaa

SEQ ID NO: 42640 - DNA, 25 bp, Homo sapien
acttcagcctaagtaatgtgccttc

SEQ ID NO: 42641 - DNA, 25 bp, Homo sapien
gtaatgtgccttcaaggaagctata

SEQ ID NO: 42642 - DNA, 25 bp, Homo sapien
gccttcaaggaagctatagattgta

SEQ ID NO: 42643 - DNA, 25 bp, Homo sapien
cccacactcagccctggaagatgag

SEQ ID NO: 42644 - DNA, 25 bp, Homo sapien
ggaagatgagggtcctggaaacctg

SEQ ID NO: 42645 - DNA, 25 bp, Homo sapien
gatgagggtcctggaaacctggggg

SEQ ID NO: 42646 - DNA, 25 bp, Homo sapien
gtcctggaaacctggggggcaggtg

SEQ ID NO: 42647 - DNA, 25 bp, Homo sapien
aacctggggggcaggtgtggcggcg

SEQ ID NO: 42648 - DNA, 25 bp, Homo sapien
aggtgtggcggcgccaggactttag

SEQ ID NO: 42649 - DNA, 25 bp, Homo sapien
cctgagaagctgcaagtcctgcctt

SEQ ID NO: 42650 - DNA, 25 bp, Homo sapien
tgagaagctgcaagtcctgcctttc

SEQ ID NO: 42651 - DNA, 25 bp, Homo sapien
tgcctttctgtttctgttgtagtga

SEQ ID NO: 42652 - DNA, 25 bp, Homo sapien
tgttgtagtgaaaccttccaccgtt

SEQ ID NO: 42653 - DNA, 25 bp, Homo sapien
ccgtttccttctcggaccatgaagg

SEQ ID NO: 42654 - DNA, 25 bp, Homo sapien
ccccctttctctgttggagacaggg

SEQ ID NO: 42655 - DNA, 25 bp, Homo sapien
ttctctgttggagacagggtagcag

SEQ ID NO: 42656 - DNA, 25 bp, Homo sapien
gttggagacagggtagcagaagaat

SEQ ID NO: 42657 - DNA, 25 bp, Homo sapien
ggagaaccgattgctaaatccttct

SEQ ID NO: 42658 - DNA, 25 bp, Homo sapien
aaccgattgctaaatccttcttagg

SEQ ID NO: 42659 - DNA, 25 bp, Homo sapien
cttgttctccctcttggaatatggg

SEQ ID NO: 42660 - DNA, 25 bp, Homo sapien
tgttctccctcttggaatatgggga

SEQ ID NO: 42661 - DNA, 25 bp, Homo sapien
tctccccagtccttagattaaaagg

SEQ ID NO: 42662 - DNA, 25 bp, Homo sapien
ttagattaaaaggcccaggccccag

SEQ ID NO: 42663 - DNA, 25 bp, Homo sapien
tccatttcttggaatgtggccatgc

SEQ ID NO: 42664 - DNA, 25 bp, Homo sapien
ccatgtattagcttccatggccccc

SEQ ID NO: 42665 - DNA, 25 bp, Homo sapien
ctgcaattcccagagccagatcttc

SEQ ID NO: 42666 - DNA, 25 bp, Homo sapien
agatcttcctcatccaagcaataac

SEQ ID NO: 42667 - DNA, 25 bp, Homo sapien
gatcttcctcatccaagcaataacg

SEQ ID NO: 42668 - DNA, 25 bp, Homo sapien
tcttcctcatccaagcaataacggg

SEQ ID NO: 42669 - DNA, 25 bp, Homo sapien
tcctcatccaagcaataacgggacg

SEQ ID NO: 42670 - DNA, 25 bp, Homo sapien
caataacgggacgagggagccaggg

SEQ ID NO: 42671 - DNA, 25 bp, Homo sapien
ccagggccaaggacactcagggaca

SEQ ID NO: 42672 - DNA, 25 bp, Homo sapien
cagggccaaggacactcagggacac

SEQ ID NO: 42673 - DNA, 25 bp, Homo sapien
cggccccacatggtaatgttttctt

SEQ ID NO: 42674 - DNA, 25 bp, Homo sapien
gccccacatggtaatgttttcttta

SEQ ID NO: 42675 - DNA, 25 bp, Homo sapien
acatggtaatgttttctttagagag

SEQ ID NO: 42676 - DNA, 25 bp, Homo sapien
agcacagctgtaattggggctgagg

SEQ ID NO: 42677 - DNA, 25 bp, Homo sapien
ggggctgagggtaacgaccagcgcc

SEQ ID NO: 42678 - DNA, 25 bp, Homo sapien
tgcggagggcctggcatgtgtggga

SEQ ID NO: 42679 - DNA, 25 bp, Homo sapien
gcatgtgtgggaaaaagccggaaaa

SEQ ID NO: 42680 - DNA, 25 bp, Homo sapien
agacttgtaagaaaattctcactga

SEQ ID NO: 42681 - DNA, 25 bp, Homo sapien
ttaccccaagctttcacagcactaa

SEQ ID NO: 42682 - DNA, 25 bp, Homo sapien
ggagggagcagaggatggagctgcc

SEQ ID NO: 42683 - DNA, 25 bp, Homo sapien
cagcactaaatatgccacacttagt

SEQ ID NO: 42684 - DNA, 25 bp, Homo sapien
gccacacttagtaattttacgagca

SEQ ID NO: 42685 - DNA, 25 bp, Homo sapien
caaaccaaactatacatcacacggt

SEQ ID NO: 42686 - DNA, 25 bp, Homo sapien
ctatacatcacacggttttatgttc

SEQ ID NO: 42687 - DNA, 25 bp, Homo sapien
ggaatcactctgtagtagttgtgtt

SEQ ID NO: 42688 - DNA, 25 bp, Homo sapien
gtagttgtgttcattttcttttctt

SEQ ID NO: 42689 - DNA, 25 bp, Homo sapien
ctcatcctcccgagtagctaagact

SEQ ID NO: 42690 - DNA, 25 bp, Homo sapien
accatgcccagctaatttttatatt

SEQ ID NO: 42691 - DNA, 25 bp, Homo sapien
tggccttgttcatcttctaattaaa

SEQ ID NO: 42692 - DNA, 25 bp, Homo sapien
gccttgttcatcttctaattaaata

SEQ ID NO: 42693 - DNA, 25 bp, Homo sapien
tttggactgtatttagatttctctt

SEQ ID NO: 42694 - DNA, 25 bp, Homo sapien
agatttctctttaattttgctgtag

SEQ ID NO: 42695 - DNA, 25 bp, Homo sapien
gatttaaagtggttatgatgtgttt

SEQ ID NO: 42696 - DNA, 25 bp, Homo sapien
gatgtgttttatgaaggcttactat

SEQ ID NO: 42697 - DNA, 25 bp, Homo sapien
ggcttactattttatattgtactta

SEQ ID NO: 42698 - DNA, 25 bp, Homo sapien
ggactacaggtgtgtgccactatgc

SEQ ID NO: 42699 - DNA, 25 bp, Homo sapien
tgccactatgcccagctaattttaa

SEQ ID NO: 42700 - DNA, 25 bp, Homo sapien
gtagagtagaggtcttgctatgttg

SEQ ID NO: 42701 - DNA, 25 bp, Homo sapien
acagattatcagacaatgttccagc

SEQ ID NO: 42702 - DNA, 25 bp, Homo sapien
caatgttccagcaaatgtactaatt

SEQ ID NO: 42703 - DNA, 25 bp, Homo sapien
gtactaatttacactgtcactgtat

SEQ ID NO: 42704 - DNA, 25 bp, Homo sapien
tacactgtcactgtatacttctccc

SEQ ID NO: 42705 - DNA, 25 bp, Homo sapien
ggcctgatcatagctcactgtaacc

SEQ ID NO: 42706 - DNA, 25 bp, Homo sapien
cactgtaaccttgaactctgggctc

SEQ ID NO: 42707 - DNA, 25 bp, Homo sapien
gaactctgggctcaagtgacctgcc

SEQ ID NO: 42708 - DNA, 25 bp, Homo sapien
ctgcctcagctgcctaagtaagcta

SEQ ID NO: 42709 - DNA, 25 bp, Homo sapien
accaatcatattttctctctgtctc

SEQ ID NO: 42710 - DNA, 25 bp, Homo sapien
tcagagctggttgggttcaccacct

SEQ ID NO: 42711 - DNA, 25 bp, Homo sapien
gtaccatttttccttgagtgtgctt

SEQ ID NO: 42712 - DNA, 25 bp, Homo sapien
tgaataggtttctgctccttgacaa

SEQ ID NO: 42713 - DNA, 25 bp, Homo sapien
gttccgtcattttgcattacttgta

SEQ ID NO: 42714 - DNA, 25 bp, Homo sapien
acttgtatccactcatgtttgtttc

SEQ ID NO: 42715 - DNA, 25 bp, Homo sapien
ttgtcagtcattgcatctgcccata

SEQ ID NO: 42716 - DNA, 25 bp, Homo sapien
atcagccatacctaagacctgcacc

SEQ ID NO: 42717 - DNA, 25 bp, Homo sapien
gacctgcacctaagtggccatgttt

SEQ ID NO: 42718 - DNA, 25 bp, Homo sapien
atgtttgctcaaatgtcctcatcac

SEQ ID NO: 42719 - DNA, 25 bp, Homo sapien
tcatcaccttggcctcaactaatta

SEQ ID NO: 42720 - DNA, 25 bp, Homo sapien
ttccgctgcctgtgtcgaagtgcag

SEQ ID NO: 42721 - DNA, 25 bp, Homo sapien
cgctgcctgtgtcgaagtgcaggag

SEQ ID NO: 42722 - DNA, 25 bp, Homo sapien
atcttgtagccccagcaggagctat

SEQ ID NO: 42723 - DNA, 25 bp, Homo sapien
gtagccccagcaggagctattttcc

SEQ ID NO: 42724 - DNA, 25 bp, Homo sapien
agcaggagctattttccgaaaagtg

SEQ ID NO: 42725 - DNA, 25 bp, Homo sapien
aaagctctgaaggtcccacaattca

SEQ ID NO: 42726 - DNA, 25 bp, Homo sapien
gaaggtcccacaattcatggtatgt

SEQ ID NO: 42727 - DNA, 25 bp, Homo sapien
catggtatgtacaggggctcggagg

SEQ ID NO: 42728 - DNA, 25 bp, Homo sapien
gggctcggaggagggaaactgccca

SEQ ID NO: 42729 - DNA, 25 bp, Homo sapien
gcacagctgcaggggtagggggtat

SEQ ID NO: 42730 - DNA, 25 bp, Homo sapien
gggtatagataagaggagcaggcct

SEQ ID NO: 42731 - DNA, 25 bp, Homo sapien
aatctcagctatttgggaggccgag

SEQ ID NO: 42732 - DNA, 25 bp, Homo sapien
agagcaagactttgtctcaaaaata

SEQ ID NO: 42733 - DNA, 25 bp, Homo sapien
gtttagacattccaagagttaacta

SEQ ID NO: 42734 - DNA, 25 bp, Homo sapien
tcagcaattataaactgttccttac

SEQ ID NO: 42735 - DNA, 25 bp, Homo sapien
tgttccttacagacagtgtacttga

SEQ ID NO: 42736 - DNA, 25 bp, Homo sapien
gacagtgtacttgaagtcttttggt

SEQ ID NO: 42737 - DNA, 25 bp, Homo sapien
gaagtcttttggtagttctgagaat

SEQ ID NO: 42738 - DNA, 25 bp, Homo sapien
agttctgagaatgtggtcattgaag

SEQ ID NO: 42739 - DNA, 25 bp, Homo sapien
gtcattgaagttggatctaagagga

SEQ ID NO: 42740 - DNA, 25 bp, Homo sapien
aagaggaaagtggttatcggttgct

SEQ ID NO: 42741 - DNA, 25 bp, Homo sapien
tggttatcggttgctttttatttat

SEQ ID NO: 42742 - DNA, 25 bp, Homo sapien
ctgccaaaatattctctctctgtcc

SEQ ID NO: 42743 - DNA, 25 bp, Homo sapien
ctccctgctcaggatatcagcacag

SEQ ID NO: 42744 - DNA, 25 bp, Homo sapien
ggacgaaggcaattgcctaccctgc

SEQ ID NO: 42745 - DNA, 25 bp, Homo sapien
ttgcctaccctgcttgagagatgca

SEQ ID NO: 42746 - DNA, 25 bp, Homo sapien
gagagatgcagaggcctggtgtgga

SEQ ID NO: 42747 - DNA, 25 bp, Homo sapien
ggcctggtgtggagttagcagtatt

SEQ ID NO: 42748 - DNA, 25 bp, Homo sapien
gagattggatcagcctggatcactg

SEQ ID NO: 42749 - DNA, 25 bp, Homo sapien
agcctggatcactgaatcactgcat

SEQ ID NO: 42750 - DNA, 25 bp, Homo sapien
atcactgaatcactgcatgtaggac

SEQ ID NO: 42751 - DNA, 25 bp, Homo sapien
actgcatgtaggacacactatggag

SEQ ID NO: 42752 - DNA, 25 bp, Homo sapien
gagtttcttgtgccaagatcagaca

SEQ ID NO: 42753 - DNA, 25 bp, Homo sapien
cacacaagcagagtgcctttgcagg

SEQ ID NO: 42754 - DNA, 25 bp, Homo sapien
cacaagcagagtgcctttgcaggtt

SEQ ID NO: 42755 - DNA, 25 bp, Homo sapien
gtagcatgtagaggaaagtgcactg

SEQ ID NO: 42756 - DNA, 25 bp, Homo sapien
agtgcactgggataatccaaggcca

SEQ ID NO: 42757 - DNA, 25 bp, Homo sapien
tttgaggttccaccgctacattatg

SEQ ID NO: 42758 - DNA, 25 bp, Homo sapien
aggttccaccgctacattatgtgac

SEQ ID NO: 42759 - DNA, 25 bp, Homo sapien
tccaccgctacattatgtgactctt

SEQ ID NO: 42760 - DNA, 25 bp, Homo sapien
cgctacattatgtgactcttagtct

SEQ ID NO: 42761 - DNA, 25 bp, Homo sapien
cattatgtgactcttagtctaaacc

SEQ ID NO: 42762 - DNA, 25 bp, Homo sapien
cttttggtgtaatttctttggtctg

SEQ ID NO: 42763 - DNA, 25 bp, Homo sapien
atttctttggtctgattatttataa

SEQ ID NO: 42764 - DNA, 25 bp, Homo sapien
gtagtcctaactattcagattcctt

SEQ ID NO: 42765 - DNA, 25 bp, Homo sapien
cctaactattcagattccttgagcc

SEQ ID NO: 42766 - DNA, 25 bp, Homo sapien
gatgctaagatgacatccagacagg

SEQ ID NO: 42767 - DNA, 25 bp, Homo sapien
gatgacatccagacaggtcagaaat

SEQ ID NO: 42768 - DNA, 25 bp, Homo sapien
gatgaggaaggataaaccctatctt

SEQ ID NO: 42769 - DNA, 25 bp, Homo sapien
ggataaaccctatcttataagacaa

SEQ ID NO: 42770 - DNA, 25 bp, Homo sapien
aagacaaattcctggcactcatttc

SEQ ID NO: 42771 - DNA, 25 bp, Homo sapien
acaaattcctggcactcatttcttt

SEQ ID NO: 42772 - DNA, 25 bp, Homo sapien
ttccctagtcctgcatttttgttga

SEQ ID NO: 42773 - DNA, 25 bp, Homo sapien
tagtcctgcatttttgttgaaggca

SEQ ID NO: 42774 - DNA, 25 bp, Homo sapien
aaggcagaagattagagagagacaa

SEQ ID NO: 42775 - DNA, 25 bp, Homo sapien
aaatagccgggcgtcatggctcttg

SEQ ID NO: 42776 - DNA, 25 bp, Homo sapien
tcacttgagtgcagggggttgaggc

SEQ ID NO: 42777 - DNA, 25 bp, Homo sapien
tatacaggtcacctttgtatgcctt

SEQ ID NO: 42778 - DNA, 25 bp, Homo sapien
caccttcctcagaaatcaattgtaa

SEQ ID NO: 42779 - DNA, 25 bp, Homo sapien
gaggtcatttggtggtgtggatagg

SEQ ID NO: 42780 - DNA, 25 bp, Homo sapien
agggcagtgacttcctgctttattt

SEQ ID NO: 42781 - DNA, 25 bp, Homo sapien
atcaacaggagggacagctaggcta

SEQ ID NO: 42782 - DNA, 25 bp, Homo sapien
gacagctaggctaattcaaattcca

SEQ ID NO: 42783 - DNA, 25 bp, Homo sapien
aattccattaacaatccatcttccc

SEQ ID NO: 42784 - DNA, 25 bp, Homo sapien
ccctagctgggttcctcagcatgtt

SEQ ID NO: 42785 - DNA, 25 bp, Homo sapien
tggtcaccattagtaaccccatcta

SEQ ID NO: 42786 - DNA, 25 bp, Homo sapien
atgaacccaggaaagacccatcctc

SEQ ID NO: 42787 - DNA, 25 bp, Homo sapien
ctttctctgaggccccatgaggcca

SEQ ID NO: 42788 - DNA, 25 bp, Homo sapien
gccccatgaggccaagcagaagcaa

SEQ ID NO: 42789 - DNA, 25 bp, Homo sapien
ggccaacatggcgaaacactgtttc

SEQ ID NO: 42790 - DNA, 25 bp, Homo sapien
ttagctgggtgtgctggtaggcgcc

SEQ ID NO: 42791 - DNA, 25 bp, Homo sapien
ggtaggcgcctgtaatcacagctac

SEQ ID NO: 42792 - DNA, 25 bp, Homo sapien
gttgcagtgggctgagatctcgcca

SEQ ID NO: 42793 - DNA, 25 bp, Homo sapien
caaagtgctgggatcagttgtgagc

SEQ ID NO: 42794 - DNA, 25 bp, Homo sapien
tacccagccaaactccagttttagt

SEQ ID NO: 42795 - DNA, 25 bp, Homo sapien
cagagtcctgaaaatcaaactatac

SEQ ID NO: 42796 - DNA, 25 bp, Homo sapien
gtaggaagtccattaagctgtttag

SEQ ID NO: 42797 - DNA, 25 bp, Homo sapien
gggcaacatggcgagatcctgtctc

SEQ ID NO: 42798 - DNA, 25 bp, Homo sapien
gagatcctgtctctgcaaaatatac

SEQ ID NO: 42799 - DNA, 25 bp, Homo sapien
tgtggtgtcagatgcctgtagtccc

SEQ ID NO: 42800 - DNA, 25 bp, Homo sapien
gtgggaggatcgtttgagcctgcaa

SEQ ID NO: 42801 - DNA, 25 bp, Homo sapien
tgagctcagatggtgccactgcact

SEQ ID NO: 42802 - DNA, 25 bp, Homo sapien
gtgacagagtcagaccctatctcaa

SEQ ID NO: 42803 - DNA, 25 bp, Homo sapien
gaaacttctgtacctgtgtcaacgg

SEQ ID NO: 42804 - DNA, 25 bp, Homo sapien
gtgtcaacggtgcatcttatctaat

SEQ ID NO: 42805 - DNA, 25 bp, Homo sapien
aatcccaccactttgggtggccgag

SEQ ID NO: 42806 - DNA, 25 bp, Homo sapien
gaggggggcagattacttgggctca

SEQ ID NO: 42807 - DNA, 25 bp, Homo sapien
ttgggctcaggagtcggagaccagc

SEQ ID NO: 42808 - DNA, 25 bp, Homo sapien
ggaggtagggacgatagcagggcgc

SEQ ID NO: 42809 - DNA, 25 bp, Homo sapien
gcatggcgagttcctgctgggaaac

SEQ ID NO: 42810 - DNA, 25 bp, Homo sapien
gagatcctgcaatgagcaatccttt

SEQ ID NO: 42811 - DNA, 25 bp, Homo sapien
agcaatcctttaagcactttcttcc

SEQ ID NO: 42812 - DNA, 25 bp, Homo sapien
gttatgctccaaagtacgggtccca

SEQ ID NO: 42813 - DNA, 25 bp, Homo sapien
gtacgggtcccaagtttgacgacag

SEQ ID NO: 42814 - DNA, 25 bp, Homo sapien
acagaacccgctctggtcatttgta

SEQ ID NO: 42815 - DNA, 25 bp, Homo sapien
tggtcatttgtagccacatcctgtc

SEQ ID NO: 42816 - DNA, 25 bp, Homo sapien
cctgtcaggtgctgccaacgtgaat

SEQ ID NO: 42817 - DNA, 25 bp, Homo sapien
caacgtgaatctgaccagccagtga

SEQ ID NO: 42818 - DNA, 25 bp, Homo sapien
gatatctgggactgagcaggcaggg

SEQ ID NO: 42819 - DNA, 25 bp, Homo sapien
gaagtggatcaccatgaaagttttc

SEQ ID NO: 42820 - DNA, 25 bp, Homo sapien
gaaagttttcattgtcatcatcttc

SEQ ID NO: 42821 - DNA, 25 bp, Homo sapien
tgagtataacttttgactcccttaa

SEQ ID NO: 42822 - DNA, 25 bp, Homo sapien
gtcatcatcttcatgtttagactga

SEQ ID NO: 42823 - DNA, 25 bp, Homo sapien
gaggagggattggtcttgtgtcttg

SEQ ID NO: 42824 - DNA, 25 bp, Homo sapien
tgtcttgggggtggcggaagcagaa

SEQ ID NO: 42825 - DNA, 25 bp, Homo sapien
agaatctgcatataattgcactgtt

SEQ ID NO: 42826 - DNA, 25 bp, Homo sapien
aacaacttcagtgtaaatacttact

SEQ ID NO: 42827 - DNA, 25 bp, Homo sapien
aaatacttgattcctaatgttttag

SEQ ID NO: 42828 - DNA, 25 bp, Homo sapien
ttagtgaaaccctactagcacccat

SEQ ID NO: 42829 - DNA, 25 bp, Homo sapien
cttaactacttataactactgttat

SEQ ID NO: 42830 - DNA, 25 bp, Homo sapien
cctgccagtatctttggggctgtgt

SEQ ID NO: 42831 - DNA, 25 bp, Homo sapien
ggggctgtgtccttcaaggacatgt

SEQ ID NO: 42832 - DNA, 25 bp, Homo sapien
cttcaaggacatgtccccagactgc

SEQ ID NO: 42833 - DNA, 25 bp, Homo sapien
tcaacctcttatcaccacttgttgg

SEQ ID NO: 42834 - DNA, 25 bp, Homo sapien
cacttgttggtgtcagaactaactg

SEQ ID NO: 42835 - DNA, 25 bp, Homo sapien
gaactaactgcttctggtctggaga

SEQ ID NO: 42836 - DNA, 25 bp, Homo sapien
tctggagagggactgaccgatgcct

SEQ ID NO: 42837 - DNA, 25 bp, Homo sapien
actgaccgatgcctttgggtagaga

SEQ ID NO: 42838 - DNA, 25 bp, Homo sapien
cgatgcctttgggtagagagaatta

SEQ ID NO: 42839 - DNA, 25 bp, Homo sapien
ctttatattttctgaggtttctgta

SEQ ID NO: 42840 - DNA, 25 bp, Homo sapien
ctgtaataagcatatttcacttttc

SEQ ID NO: 42841 - DNA, 25 bp, Homo sapien
ccctggggctgaagagctggctgtg

SEQ ID NO: 42842 - DNA, 25 bp, Homo sapien
tacaacctggggttccttctcaggg

SEQ ID NO: 42843 - DNA, 25 bp, Homo sapien
cactttcctgatgatccatggggcc

SEQ ID NO: 42844 - DNA, 25 bp, Homo sapien
tttcctgatgatccatggggcccag

SEQ ID NO: 42845 - DNA, 25 bp, Homo sapien
ttcctgatgatccatggggcccagg

SEQ ID NO: 42846 - DNA, 25 bp, Homo sapien
tcctgatgatccatggggcccaggc

SEQ ID NO: 42847 - DNA, 25 bp, Homo sapien
catggggcccaggcctagagggcat

SEQ ID NO: 42848 - DNA, 25 bp, Homo sapien
atggggcccaggcctagagggcatc

SEQ ID NO: 42849 - DNA, 25 bp, Homo sapien
gcccaggcctagagggcatccgagg

SEQ ID NO: 42850 - DNA, 25 bp, Homo sapien
cccatcaacgagtcttggcccaggg

SEQ ID NO: 42851 - DNA, 25 bp, Homo sapien
gagcaaaggggggtgggctccaggc

SEQ ID NO: 42852 - DNA, 25 bp, Homo sapien
tctgcccctccatcccaaggggcag

SEQ ID NO: 42853 - DNA, 25 bp, Homo sapien
ccctccatcccaaggggcagagaaa

SEQ ID NO: 42854 - DNA, 25 bp, Homo sapien
ccaaggggcagagaaattgtctttc

SEQ ID NO: 42855 - DNA, 25 bp, Homo sapien
aaattgtctttctttgctgactcct

SEQ ID NO: 42856 - DNA, 25 bp, Homo sapien
tcccctagcttggggtccagacagc

SEQ ID NO: 42857 - DNA, 25 bp, Homo sapien
tagcttggggtccagacagcccagt

SEQ ID NO: 42858 - DNA, 25 bp, Homo sapien
gggtccagacagcccagtggaccca

SEQ ID NO: 42859 - DNA, 25 bp, Homo sapien
cccaggcgcctgagcaggagggtaa

SEQ ID NO: 42860 - DNA, 25 bp, Homo sapien
ggcgcctgagcaggagggtaaccca

SEQ ID NO: 42861 - DNA, 25 bp, Homo sapien
gagcaggagggtaacccaggccacc

SEQ ID NO: 42862 - DNA, 25 bp, Homo sapien
taatctaataatctttatctgttct

SEQ ID NO: 42863 - DNA, 25 bp, Homo sapien
tacgtaggacctacattcattcatt

SEQ ID NO: 42864 - DNA, 25 bp, Homo sapien
attcattcattgactcagcagtcta

SEQ ID NO: 42865 - DNA, 25 bp, Homo sapien
ttcattgactcagcagtctatatca

SEQ ID NO: 42866 - DNA, 25 bp, Homo sapien
agtctatatcaagcacttaactctg

SEQ ID NO: 42867 - DNA, 25 bp, Homo sapien
tcaagcacttaactctgccaggcac

SEQ ID NO: 42868 - DNA, 25 bp, Homo sapien
gcacttaactctgccaggcactatg

SEQ ID NO: 42869 - DNA, 25 bp, Homo sapien
gccaggcactatgattttaaggata

SEQ ID NO: 42870 - DNA, 25 bp, Homo sapien
aaggcaaacatgatccttgcttgtt

SEQ ID NO: 42871 - DNA, 25 bp, Homo sapien
gcaaacatgatccttgcttgttttg

SEQ ID NO: 42872 - DNA, 25 bp, Homo sapien
ggacatggactctattgacacacta

SEQ ID NO: 42873 - DNA, 25 bp, Homo sapien
aacgacgccttcccagaggaatacg

SEQ ID NO: 42874 - DNA, 25 bp, Homo sapien
gaggaatacgtgcccactgtgtttg

SEQ ID NO: 42875 - DNA, 25 bp, Homo sapien
cactatgcagttactgtgactgtgg

SEQ ID NO: 42876 - DNA, 25 bp, Homo sapien
aggaggactacaaccagctgaggcc

SEQ ID NO: 42877 - DNA, 25 bp, Homo sapien
ctcctaccccaacacggatgtgttt

SEQ ID NO: 42878 - DNA, 25 bp, Homo sapien
ggatgtgtttttgatctgcttctct

SEQ ID NO: 42879 - DNA, 25 bp, Homo sapien
cctgcctcttaccacaatgtccagg

SEQ ID NO: 42880 - DNA, 25 bp, Homo sapien
gtgccttatgtcctcatagggaccc

SEQ ID NO: 42881 - DNA, 25 bp, Homo sapien
tagggacccagattgatctccgtga

SEQ ID NO: 42882 - DNA, 25 bp, Homo sapien
atctccgtgatgacccaaaaacctt

SEQ ID NO: 42883 - DNA, 25 bp, Homo sapien
tgatgacccaaaaaccttggcccgt

SEQ ID NO: 42884 - DNA, 25 bp, Homo sapien
gttaattattcctcgatacacctcg

SEQ ID NO: 42885 - DNA, 25 bp, Homo sapien
atacacctcgccatcacttgtgtat

SEQ ID NO: 42886 - DNA, 25 bp, Homo sapien
acatctgctactctctttgagcatg

SEQ ID NO: 42887 - DNA, 25 bp, Homo sapien
gagcatgatgcctctactgtattct

SEQ ID NO: 42888 - DNA, 25 bp, Homo sapien
actgtattctattccagagctcatt

SEQ ID NO: 42889 - DNA, 25 bp, Homo sapien
gagctcattgttttgtcagtttttt

SEQ ID NO: 42890 - DNA, 25 bp, Homo sapien
ttcccttctcagtctttgggtaact

SEQ ID NO: 42891 - DNA, 25 bp, Homo sapien
gtcacctatcaccgcgtgtatttta

SEQ ID NO: 42892 - DNA, 25 bp, Homo sapien
ggagtcagatattctcgaaactgtt

SEQ ID NO: 42893 - DNA, 25 bp, Homo sapien
taatatatgacactcaaccggctcc

SEQ ID NO: 42894 - DNA, 25 bp, Homo sapien
tcaaccggctcctgtaccagaaaaa

SEQ ID NO: 42895 - DNA, 25 bp, Homo sapien
tgcgaagggaatcccatccacacat

SEQ ID NO: 42896 - DNA, 25 bp, Homo sapien
cccagacagctggggccatatccgg

SEQ ID NO: 42897 - DNA, 25 bp, Homo sapien
gctgccagccttcaggaatgctggg

SEQ ID NO: 42898 - DNA, 25 bp, Homo sapien
gaatgctgggggtgttgggggtggc

SEQ ID NO: 42899 - DNA, 25 bp, Homo sapien
ggattgatggatgtggcctgccagg

SEQ ID NO: 42900 - DNA, 25 bp, Homo sapien
gcctggcacggggctgcatagtgcc

SEQ ID NO: 42901 - DNA, 25 bp, Homo sapien
gggctgcatagtgcctggagtcacc

SEQ ID NO: 42902 - DNA, 25 bp, Homo sapien
tagtgcctggagtcaccagcaccta

SEQ ID NO: 42903 - DNA, 25 bp, Homo sapien
cacacagctcagagcacgggttccc

SEQ ID NO: 42904 - DNA, 25 bp, Homo sapien
tccctgtcgctaacaaccgttgcga

SEQ ID NO: 42905 - DNA, 25 bp, Homo sapien
acaaccgttgcgaagggaatcccat

SEQ ID NO: 42906 - DNA, 25 bp, Homo sapien
gaccccaggtgagaggccggagggt

SEQ ID NO: 42907 - DNA, 25 bp, Homo sapien
caggtgagaggccggagggtcctgg

SEQ ID NO: 42908 - DNA, 25 bp, Homo sapien
tgagaggcgcaggggatcggcggga

SEQ ID NO: 42909 - DNA, 25 bp, Homo sapien
gtagatggagctgtctgggttccgg

SEQ ID NO: 42910 - DNA, 25 bp, Homo sapien
agcctccgacgagcctcggagtgtt

SEQ ID NO: 42911 - DNA, 25 bp, Homo sapien
gagcctcggagtgtttctctttaaa

SEQ ID NO: 42912 - DNA, 25 bp, Homo sapien
gatcggcgggaggaaggctgtcgga

SEQ ID NO: 42913 - DNA, 25 bp, Homo sapien
aacggcctgagagggacatgcctcc

SEQ ID NO: 42914 - DNA, 25 bp, Homo sapien
tgcagctcccctgctaaagaggcgc

SEQ ID NO: 42915 - DNA, 25 bp, Homo sapien
taaagaggcgccgggacggcagcgc

SEQ ID NO: 42916 - DNA, 25 bp, Homo sapien
aggctgtcggagccaatcaagccgc

SEQ ID NO: 42917 - DNA, 25 bp, Homo sapien
tcacatacctgttttggggtcctcc

SEQ ID NO: 42918 - DNA, 25 bp, Homo sapien
ccatttttcctaactctgcacagaa

SEQ ID NO: 42919 - DNA, 25 bp, Homo sapien
taacataacacacatcacttctttt

SEQ ID NO: 42920 - DNA, 25 bp, Homo sapien
tcttttaatttggcatccttcctcc

SEQ ID NO: 42921 - DNA, 25 bp, Homo sapien
tccttcctccctttatgtaattgac

SEQ ID NO: 42922 - DNA, 25 bp, Homo sapien
cactgaccagttctgtccttttaac

SEQ ID NO: 42923 - DNA, 25 bp, Homo sapien
ttaacgggactctctctacttaagg

SEQ ID NO: 42924 - DNA, 25 bp, Homo sapien
ggagctgctaatttcaaatcacctt

SEQ ID NO: 42925 - DNA, 25 bp, Homo sapien
acctttggcgtctttctttgagcat

SEQ ID NO: 42926 - DNA, 25 bp, Homo sapien
gatcctgctggaattcacggcacac

SEQ ID NO: 42927 - DNA, 25 bp, Homo sapien
ttcacggcacacctaaaccttattt

SEQ ID NO: 42928 - DNA, 25 bp, Homo sapien
gcccaggacccagaacgggcatctc

SEQ ID NO: 42929 - DNA, 25 bp, Homo sapien
gggtgctaaggttacaacagcaaac

SEQ ID NO: 42930 - DNA, 25 bp, Homo sapien
acaagactgactcattccttttctc

SEQ ID NO: 42931 - DNA, 25 bp, Homo sapien
gggacttactgtcttatcatcccct

SEQ ID NO: 42932 - DNA, 25 bp, Homo sapien
tcttatcatcccctggactcaagat

SEQ ID NO: 42933 - DNA, 25 bp, Homo sapien
aggggacacacaggtccacagatcc

SEQ ID NO: 42934 - DNA, 25 bp, Homo sapien
gagtaagacagtgcaggggtccaca

SEQ ID NO: 42935 - DNA, 25 bp, Homo sapien
cagtgcaggggtccacaaacatttc

SEQ ID NO: 42936 - DNA, 25 bp, Homo sapien
gccagagagtaaatacttcaggctt

SEQ ID NO: 42937 - DNA, 25 bp, Homo sapien
aaacgcaattctgctattgtagctc

SEQ ID NO: 42938 - DNA, 25 bp, Homo sapien
aaccctgtgagaggccacagagcag

SEQ ID NO: 42939 - DNA, 25 bp, Homo sapien
ccagctgctccatgccaggaggagg

SEQ ID NO: 42940 - DNA, 25 bp, Homo sapien
ctggctgctgggtgctagagcttgt

SEQ ID NO: 42941 - DNA, 25 bp, Homo sapien
gaggaggagacacctagagcctgcg

SEQ ID NO: 42942 - DNA, 25 bp, Homo sapien
actcgcacaaggttcgaggccgagc

SEQ ID NO: 42943 - DNA, 25 bp, Homo sapien
gcagaagctgagtgcgctgcagtcc

SEQ ID NO: 42944 - DNA, 25 bp, Homo sapien
agagcttgtggaccactggcttgct

SEQ ID NO: 42945 - DNA, 25 bp, Homo sapien
cgccgtggacctgtacgagtatgca

SEQ ID NO: 42946 - DNA, 25 bp, Homo sapien
tgcggggatgaggacctggagccac

SEQ ID NO: 42947 - DNA, 25 bp, Homo sapien
gcttgctcactgtggttggtggtgg

SEQ ID NO: 42948 - DNA, 25 bp, Homo sapien
ggtggcggtgacagagtgtgcagca

SEQ ID NO: 42949 - DNA, 25 bp, Homo sapien
gcagcacgaccagagtggcttttct

SEQ ID NO: 42950 - DNA, 25 bp, Homo sapien
gaaaaatactcgtacggcctctgaa

SEQ ID NO: 42951 - DNA, 25 bp, Homo sapien
cctctgaaccatcagctcaactaag

SEQ ID NO: 42952 - DNA, 25 bp, Homo sapien
gctcaactaagctatgccagcactg

SEQ ID NO: 42953 - DNA, 25 bp, Homo sapien
atgccagcactggacgagagtttgc

SEQ ID NO: 42954 - DNA, 25 bp, Homo sapien
acgagagtttgcagccttttttgcc

SEQ ID NO: 42955 - DNA, 25 bp, Homo sapien
gccaagaagaaacctcaaaggccaa

SEQ ID NO: 42956 - DNA, 25 bp, Homo sapien
ttttcaagttcgaatcgtcctccca

SEQ ID NO: 42957 - DNA, 25 bp, Homo sapien
ccatgccatcagtatgagcgcctat

SEQ ID NO: 42958 - DNA, 25 bp, Homo sapien
gtatgagcgcctatctgcgagaaca

SEQ ID NO: 42959 - DNA, 25 bp, Homo sapien
gaagggagctctatagtcggagtgg

SEQ ID NO: 42960 - DNA, 25 bp, Homo sapien
tagtcggagtggagaactgcaaggg

SEQ ID NO: 42961 - DNA, 25 bp, Homo sapien
gcctggggaggagtcgaagggggct

SEQ ID NO: 42962 - DNA, 25 bp, Homo sapien
ttgcaggtgaatggctggggcccca

SEQ ID NO: 42963 - DNA, 25 bp, Homo sapien
gtgggtgggtgttcacaatatttat

SEQ ID NO: 42964 - DNA, 25 bp, Homo sapien
gaggagtttagagttgcagctgggg

SEQ ID NO: 42965 - DNA, 25 bp, Homo sapien
gtctcagaaatggaccagctggatg

SEQ ID NO: 42966 - DNA, 25 bp, Homo sapien
ggggactgagggtgcttgagtagga

SEQ ID NO: 42967 - DNA, 25 bp, Homo sapien
agggtgcttgagtaggatgtgagac

SEQ ID NO: 42968 - DNA, 25 bp, Homo sapien
ttttcagtatcaatttcttaaacca

SEQ ID NO: 42969 - DNA, 25 bp, Homo sapien
aaacaaggtgggggggtgctcatct

SEQ ID NO: 42970 - DNA, 25 bp, Homo sapien
ccttcacaaactccatgtttcagtg

SEQ ID NO: 42971 - DNA, 25 bp, Homo sapien
ttcagtgtttgagtccatgtttatt

SEQ ID NO: 42972 - DNA, 25 bp, Homo sapien
gagctaacaatcattcttcagatca

SEQ ID NO: 42973 - DNA, 25 bp, Homo sapien
aacaatcattcttcagatcacccac

SEQ ID NO: 42974 - DNA, 25 bp, Homo sapien
gatcacccacaccggatggaatctc

SEQ ID NO: 42975 - DNA, 25 bp, Homo sapien
ggatggaatctctagctattttatc

SEQ ID NO: 42976 - DNA, 25 bp, Homo sapien
aaaagcagtagggcctggggctagc

SEQ ID NO: 42977 - DNA, 25 bp, Homo sapien
gcctggggctagcactgagttcaga

SEQ ID NO: 42978 - DNA, 25 bp, Homo sapien
gcactgagttcagatccagctttca

SEQ ID NO: 42979 - DNA, 25 bp, Homo sapien
gtggaaagagtgcagagcctctgcc

SEQ ID NO: 42980 - DNA, 25 bp, Homo sapien
agagtgcagagcctctgcctaggcc

SEQ ID NO: 42981 - DNA, 25 bp, Homo sapien
gcagagcccagggtactgttggcat

SEQ ID NO: 42982 - DNA, 25 bp, Homo sapien
ccagggtactgttggcatctctgtc

SEQ ID NO: 42983 - DNA, 25 bp, Homo sapien
gaatccacaactaaagctgtttttg

SEQ ID NO: 42984 - DNA, 25 bp, Homo sapien
ttgaaagtgtacttgtttcttgaaa

SEQ ID NO: 42985 - DNA, 25 bp, Homo sapien
acaactttcaaatttctttacgctg

SEQ ID NO: 42986 - DNA, 25 bp, Homo sapien
ctttcaaatttctttacgctgttat

SEQ ID NO: 42987 - DNA, 25 bp, Homo sapien
attttattcctattgtggtcacatg

SEQ ID NO: 42988 - DNA, 25 bp, Homo sapien
gttgctgcatcagggatattacaga

SEQ ID NO: 42989 - DNA, 25 bp, Homo sapien
ttattgggtattatgaccttttcta

SEQ ID NO: 42990 - DNA, 25 bp, Homo sapien
aggctctttgtagttaacttatatt

SEQ ID NO: 42991 - DNA, 25 bp, Homo sapien
taaggtgggggttctcatttgtata

SEQ ID NO: 42992 - DNA, 25 bp, Homo sapien
ggcctaacctacattaacatgttgg

SEQ ID NO: 42993 - DNA, 25 bp, Homo sapien
taacatgttggcagaccattttaaa

SEQ ID NO: 42994 - DNA, 25 bp, Homo sapien
aagtcaatcagaactctttcttcat

SEQ ID NO: 42995 - DNA, 25 bp, Homo sapien
aatcagaactctttcttcatctcgt

SEQ ID NO: 42996 - DNA, 25 bp, Homo sapien
ggagagttctccgttatgttctatc

SEQ ID NO: 42997 - DNA, 25 bp, Homo sapien
agttctccgttatgttctatctgag

SEQ ID NO: 42998 - DNA, 25 bp, Homo sapien
ccgttatgttctatctgagagtcag

SEQ ID NO: 42999 - DNA, 25 bp, Homo sapien
acatacgtagcagtacaagtgcata

SEQ ID NO: 43000 - DNA, 25 bp, Homo sapien
caagtgcatataaatcctgtaagag

SEQ ID NO: 43001 - DNA, 25 bp, Homo sapien
aatcctgtaagagtataaatcctat

SEQ ID NO: 43002 - DNA, 25 bp, Homo sapien
gttgcaacaaataggcctcatttcc

SEQ ID NO: 43003 - DNA, 25 bp, Homo sapien
caaataggcctcatttcctaagttg

SEQ ID NO: 43004 - DNA, 25 bp, Homo sapien
tgagacttgtggtgtggaatttcaa

SEQ ID NO: 43005 - DNA, 25 bp, Homo sapien
ggacacagagaggggtcctgtgaag

SEQ ID NO: 43006 - DNA, 25 bp, Homo sapien
ggggtcctgtgaagtcaggccttga

SEQ ID NO: 43007 - DNA, 25 bp, Homo sapien
ggccttgaaggagtgggcgtctctc

SEQ ID NO: 43008 - DNA, 25 bp, Homo sapien
tgaaggagtgggcgtctctcagccc

SEQ ID NO: 43009 - DNA, 25 bp, Homo sapien
ccgcagagcattcaggaccagcagc

SEQ ID NO: 43010 - DNA, 25 bp, Homo sapien
tgcagtctccagacctggttctggg

SEQ ID NO: 43011 - DNA, 25 bp, Homo sapien
cagacctggttctggggagcttggg

SEQ ID NO: 43012 - DNA, 25 bp, Homo sapien
gctggggaggtgggtcaggacccag

SEQ ID NO: 43013 - DNA, 25 bp, Homo sapien
tcaggacccagacacctttgattgg

SEQ ID NO: 43014 - DNA, 25 bp, Homo sapien
agacacctttgattgggacccattt

SEQ ID NO: 43015 - DNA, 25 bp, Homo sapien
ttgattgggacccatttgacatgag

SEQ ID NO: 43016 - DNA, 25 bp, Homo sapien
gaaagcattgtacgtttaaacatat

SEQ ID NO: 43017 - DNA, 25 bp, Homo sapien
gtataattttggggtaacatatctt

SEQ ID NO: 43018 - DNA, 25 bp, Homo sapien
gggagggggtggaagactatattgc

SEQ ID NO: 43019 - DNA, 25 bp, Homo sapien
ggaagactatattgccaacaaaatg

SEQ ID NO: 43020 - DNA, 25 bp, Homo sapien
ttaccccctaaacatgtcaaacaat

SEQ ID NO: 43021 - DNA, 25 bp, Homo sapien
attcagcagctgataattacattta

SEQ ID NO: 43022 - DNA, 25 bp, Homo sapien
gaaatgttgatgtgactggcctgag

SEQ ID NO: 43023 - DNA, 25 bp, Homo sapien
gaaacttctgtttcatccactaagg

SEQ ID NO: 43024 - DNA, 25 bp, Homo sapien
gtttcatccactaaggagtcagcag

SEQ ID NO: 43025 - DNA, 25 bp, Homo sapien
gtgactggcctgagtttcagtctga

SEQ ID NO: 43026 - DNA, 25 bp, Homo sapien
ttcagtctgaaaactttgggtgcta

SEQ ID NO: 43027 - DNA, 25 bp, Homo sapien
gacgtgacccagggcagactggtag

SEQ ID NO: 43028 - DNA, 25 bp, Homo sapien
cgtcctctctcaggagtgcacgaag

SEQ ID NO: 43029 - DNA, 25 bp, Homo sapien
cgaagttcaaggtcagcagctgccg

SEQ ID NO: 43030 - DNA, 25 bp, Homo sapien
gcagctgccgggaatgcatcgagtc

SEQ ID NO: 43031 - DNA, 25 bp, Homo sapien
ggctgcacctggtgccagaagctgg

SEQ ID NO: 43032 - DNA, 25 bp, Homo sapien
agaagctgggagcggctttgggtcc

SEQ ID NO: 43033 - DNA, 25 bp, Homo sapien
cgagcagtccccggaggagaagccg

SEQ ID NO: 43034 - DNA, 25 bp, Homo sapien
cgtctgtcctcggactgagcagggt

SEQ ID NO: 43035 - DNA, 25 bp, Homo sapien
tcctcggactgagcagggtggccag

SEQ ID NO: 43036 - DNA, 25 bp, Homo sapien
caggccccaggtggaaactaccttg

SEQ ID NO: 43037 - DNA, 25 bp, Homo sapien
gaaactaccttggtcaggctgggtt

SEQ ID NO: 43038 - DNA, 25 bp, Homo sapien
ggccttcttctcaaacacatgcagg

SEQ ID NO: 43039 - DNA, 25 bp, Homo sapien
cttcttctcaaacacatgcaggatg

SEQ ID NO: 43040 - DNA, 25 bp, Homo sapien
tgcaggatgtgagagtcctcctcgg

SEQ ID NO: 43041 - DNA, 25 bp, Homo sapien
gagttgagggaattatctggccacc

SEQ ID NO: 43042 - DNA, 25 bp, Homo sapien
tgggaccacaaaggctactgctgaa

SEQ ID NO: 43043 - DNA, 25 bp, Homo sapien
ggaccacaaaggctactgctgaata

SEQ ID NO: 43044 - DNA, 25 bp, Homo sapien
acaaaggctactgctgaatagaagt

SEQ ID NO: 43045 - DNA, 25 bp, Homo sapien
agttcatccatgatctcacttaacc

SEQ ID NO: 43046 - DNA, 25 bp, Homo sapien
tcatccatgatctcacttaaccacc

SEQ ID NO: 43047 - DNA, 25 bp, Homo sapien
cctcatctgtatcaccagatgggcc

SEQ ID NO: 43048 - DNA, 25 bp, Homo sapien
tcatctgtatcaccagatgggcctt

SEQ ID NO: 43049 - DNA, 25 bp, Homo sapien
gtgagggcggcgatgagagcgaaag

SEQ ID NO: 43050 - DNA, 25 bp, Homo sapien
gagggcggcgatgagagcgaaagtt

SEQ ID NO: 43051 - DNA, 25 bp, Homo sapien
gggcggcgatgagagcgaaagttgc

SEQ ID NO: 43052 - DNA, 25 bp, Homo sapien
ggcggcgatgagagcgaaagttgcg

SEQ ID NO: 43053 - DNA, 25 bp, Homo sapien
gcggcgatgagagcgaaagttgcgc

SEQ ID NO: 43054 - DNA, 25 bp, Homo sapien
cccaccgatgccggccatggtggag

SEQ ID NO: 43055 - DNA, 25 bp, Homo sapien
ccaccgatgccggccatggtggaga

SEQ ID NO: 43056 - DNA, 25 bp, Homo sapien
caccgatgccggccatggtggagaa

SEQ ID NO: 43057 - DNA, 25 bp, Homo sapien
gagagcgaaagttgcgctcggctcg

SEQ ID NO: 43058 - DNA, 25 bp, Homo sapien
gagcgaaagttgcgctcggctcgtc

SEQ ID NO: 43059 - DNA, 25 bp, Homo sapien
ctcgtcgctgggggcttgaagcggc

SEQ ID NO: 43060 - DNA, 25 bp, Homo sapien
ggcagaagtggggcctgtagctgag

SEQ ID NO: 43061 - DNA, 25 bp, Homo sapien
gggcctgtagctgagtcaccagggt

SEQ ID NO: 43062 - DNA, 25 bp, Homo sapien
gtagctgagtcaccagggtagcctt

SEQ ID NO: 43063 - DNA, 25 bp, Homo sapien
gagtcaccagggtagccttggagac

SEQ ID NO: 43064 - DNA, 25 bp, Homo sapien
gtagccttggagacagaccagccac

SEQ ID NO: 43065 - DNA, 25 bp, Homo sapien
gccccacagtcaacagcgggagagg

SEQ ID NO: 43066 - DNA, 25 bp, Homo sapien
cacagtcaacagcgggagaggagga

SEQ ID NO: 43067 - DNA, 25 bp, Homo sapien
gaggaggaagtgtttatggctggtt

SEQ ID NO: 43068 - DNA, 25 bp, Homo sapien
agtgtttatggctggttctccatcc

SEQ ID NO: 43069 - DNA, 25 bp, Homo sapien
tccatcctaactggtcaatgcctga

SEQ ID NO: 43070 - DNA, 25 bp, Homo sapien
atcctaactggtcaatgcctgagcc

SEQ ID NO: 43071 - DNA, 25 bp, Homo sapien
cggttcatacactccggggcaagat

SEQ ID NO: 43072 - DNA, 25 bp, Homo sapien
gttcatacactccggggcaagatgc

SEQ ID NO: 43073 - DNA, 25 bp, Homo sapien
catacactccggggcaagatgctac

SEQ ID NO: 43074 - DNA, 25 bp, Homo sapien
cactccggggcaagatgctacggcc

SEQ ID NO: 43075 - DNA, 25 bp, Homo sapien
ctccggggcaagatgctacggcccc

SEQ ID NO: 43076 - DNA, 25 bp, Homo sapien
cggggcaagatgctacggccccggg

SEQ ID NO: 43077 - DNA, 25 bp, Homo sapien
gccgagtcggcggcaaggcgaggga

SEQ ID NO: 43078 - DNA, 25 bp, Homo sapien
gccccacgggacgaggcagaagctc

SEQ ID NO: 43079 - DNA, 25 bp, Homo sapien
cccacgggacgaggcagaagctctg

SEQ ID NO: 43080 - DNA, 25 bp, Homo sapien
gacgaggcagaagctctggcgcctc

SEQ ID NO: 43081 - DNA, 25 bp, Homo sapien
gccccggttcatacactccggggca

SEQ ID NO: 43082 - DNA, 25 bp, Homo sapien
ggccgtgtcagtttcaacttgggga

SEQ ID NO: 43083 - DNA, 25 bp, Homo sapien
gtgtcagtttcaacttggggatgga

SEQ ID NO: 43084 - DNA, 25 bp, Homo sapien
aacttggggatggaggccgagggcg

SEQ ID NO: 43085 - DNA, 25 bp, Homo sapien
cctgctggggacggaagggctccag

SEQ ID NO: 43086 - DNA, 25 bp, Homo sapien
tggggacggaagggctccagagagc

SEQ ID NO: 43087 - DNA, 25 bp, Homo sapien
gaagggctccagagagccgtgcacg

SEQ ID NO: 43088 - DNA, 25 bp, Homo sapien
ccctggggcgtgctgtaggagatct

SEQ ID NO: 43089 - DNA, 25 bp, Homo sapien
tggggcgtgctgtaggagatcttga

SEQ ID NO: 43090 - DNA, 25 bp, Homo sapien
gcgtgctgtaggagatcttgatgac

SEQ ID NO: 43091 - DNA, 25 bp, Homo sapien
gtaggagatcttgatgaccgggctc

SEQ ID NO: 43092 - DNA, 25 bp, Homo sapien
aggagatcttgatgaccgggctccg

SEQ ID NO: 43093 - DNA, 25 bp, Homo sapien
tgcagctgaaggcggcgcagggggc

SEQ ID NO: 43094 - DNA, 25 bp, Homo sapien
gcgcctggtggagagcacggaggtg

SEQ ID NO: 43095 - DNA, 25 bp, Homo sapien
aggtggagtgttacgactccctcac

SEQ ID NO: 43096 - DNA, 25 bp, Homo sapien
acgagcgcgtgcgcgagtactgtct

SEQ ID NO: 43097 - DNA, 25 bp, Homo sapien
gtgcgcgagtactgtctcaaggtac

SEQ ID NO: 43098 - DNA, 25 bp, Homo sapien
gaacccacagacaccaatgtgctcc

SEQ ID NO: 43099 - DNA, 25 bp, Homo sapien
ccgctacatccagctgactcagctg

SEQ ID NO: 43100 - DNA, 25 bp, Homo sapien
tgaagatgaatcgttgcagcctcca

SEQ ID NO: 43101 - DNA, 25 bp, Homo sapien
gacagtggggctgggtcccagactc

SEQ ID NO: 43102 - DNA, 25 bp, Homo sapien
gctgaggccaatccagggggacctc

SEQ ID NO: 43103 - DNA, 25 bp, Homo sapien
cccccgactcatgtgtttgttggta

SEQ ID NO: 43104 - DNA, 25 bp, Homo sapien
ttgctttcttaaagactttggtcgg

SEQ ID NO: 43105 - DNA, 25 bp, Homo sapien
ctttggtcgggtatttgtgttgttg

SEQ ID NO: 43106 - DNA, 25 bp, Homo sapien
gttgagtattgtgtctgggtgtggg

SEQ ID NO: 43107 - DNA, 25 bp, Homo sapien
tgggtgtgggtatttgattcttttt

SEQ ID NO: 43108 - DNA, 25 bp, Homo sapien
gtttttggctgtcctgtctattgga

SEQ ID NO: 43109 - DNA, 25 bp, Homo sapien
gtgatgtgttagtgtcgagcgtgct

SEQ ID NO: 43110 - DNA, 25 bp, Homo sapien
cgagcgtgctgtagaatctcccatt

SEQ ID NO: 43111 - DNA, 25 bp, Homo sapien
gaatctcccatttctgaaacaggcg

SEQ ID NO: 43112 - DNA, 25 bp, Homo sapien
gtgaaaacctgtactgattcccacg

SEQ ID NO: 43113 - DNA, 25 bp, Homo sapien
atttgtctgtttctcatttacttcc

SEQ ID NO: 43114 - DNA, 25 bp, Homo sapien
tacttcctcttatagcgtggcttta

SEQ ID NO: 43115 - DNA, 25 bp, Homo sapien
aaaatttctttttgttggtcatgat

SEQ ID NO: 43116 - DNA, 25 bp, Homo sapien
gattgcttgaggctaggagtttgtg

SEQ ID NO: 43117 - DNA, 25 bp, Homo sapien
gagtttgtgactagatgggcaatat

SEQ ID NO: 43118 - DNA, 25 bp, Homo sapien
tgggcaatatagtaagatgtcatct

SEQ ID NO: 43119 - DNA, 25 bp, Homo sapien
attagctggccactgtggcacacgc

SEQ ID NO: 43120 - DNA, 25 bp, Homo sapien
gcagtgagctatgattgtgcttatg

SEQ ID NO: 43121 - DNA, 25 bp, Homo sapien
gattgtgcttatgaatagccactgc

SEQ ID NO: 43122 - DNA, 25 bp, Homo sapien
tccagtctgggcaatagtgagtcgg

SEQ ID NO: 43123 - DNA, 25 bp, Homo sapien
tagtgagtcggtcaaattccatttc

SEQ ID NO: 43124 - DNA, 25 bp, Homo sapien
aaatctatttaactcaatatattca

SEQ ID NO: 43125 - DNA, 25 bp, Homo sapien
attcaaaatatttcatcatgcaatc

SEQ ID NO: 43126 - DNA, 25 bp, Homo sapien
ccttgactttagcctggtgagatcc

SEQ ID NO: 43127 - DNA, 25 bp, Homo sapien
gactttagcctggtgagatcctctt

SEQ ID NO: 43128 - DNA, 25 bp, Homo sapien
agcctggtgagatcctcttaggact

SEQ ID NO: 43129 - DNA, 25 bp, Homo sapien
atcctcttaggacttttggcaatca

SEQ ID NO: 43130 - DNA, 25 bp, Homo sapien
aggacttttggcaatcagaactata

SEQ ID NO: 43131 - DNA, 25 bp, Homo sapien
tgcagggcccaagaaatcactggtg

SEQ ID NO: 43132 - DNA, 25 bp, Homo sapien
gggcccaagaaatcactggtgatga

SEQ ID NO: 43133 - DNA, 25 bp, Homo sapien
ggtgatgagatcgggaaagtgggct

SEQ ID NO: 43134 - DNA, 25 bp, Homo sapien
gatgggggaagtgggctcaggaggt

SEQ ID NO: 43135 - DNA, 25 bp, Homo sapien
tggagtggaaggggaattcatttgt

SEQ ID NO: 43136 - DNA, 25 bp, Homo sapien
attgtctatccttttgtattgattg

SEQ ID NO: 43137 - DNA, 25 bp, Homo sapien
gagatacacgagaaatccaaattag

SEQ ID NO: 43138 - DNA, 25 bp, Homo sapien
agaagaagggagtagcatgtgcaaa

SEQ ID NO: 43139 - DNA, 25 bp, Homo sapien
cctactactactatacggctgcgag

SEQ ID NO: 43140 - DNA, 25 bp, Homo sapien
aagacgacagaagggcaacatttga

SEQ ID NO: 43141 - DNA, 25 bp, Homo sapien
aagggcaacatttgagctgattctt

SEQ ID NO: 43142 - DNA, 25 bp, Homo sapien
actactatacggctgcgagaagacg

SEQ ID NO: 43143 - DNA, 25 bp, Homo sapien
agagatacacgagaaatccaaatta

SEQ ID NO: 43144 - DNA, 25 bp, Homo sapien
atacggctgcgagaagacgacagaa

SEQ ID NO: 43145 - DNA, 25 bp, Homo sapien
cagaagaagggagtagcatgtgcaa

SEQ ID NO: 43146 - DNA, 25 bp, Homo sapien
gacgacagaagggcaacatttgagc

SEQ ID NO: 43147 - DNA, 25 bp, Homo sapien
gggcaacatttgagctgattcttaa

SEQ ID NO: 43148 - DNA, 25 bp, Homo sapien
acagccctctcagggaaaattcccg

SEQ ID NO: 43149 - DNA, 25 bp, Homo sapien
aaaattcccgaattgcagttcttga

SEQ ID NO: 43150 - DNA, 25 bp, Homo sapien
gaatctgggagcttgaggattcata

SEQ ID NO: 43151 - DNA, 25 bp, Homo sapien
tgaggattcataacgtacaaaagga

SEQ ID NO: 43152 - DNA, 25 bp, Homo sapien
ggaagatgcaggacagtatcgatgt

SEQ ID NO: 43153 - DNA, 25 bp, Homo sapien
gcaggacagtatcgatgtgtggcaa

SEQ ID NO: 43154 - DNA, 25 bp, Homo sapien
gtgtggcaaaaaacagcctcgggac

SEQ ID NO: 43155 - DNA, 25 bp, Homo sapien
agcatattccaaagtggtgaagctg

SEQ ID NO: 43156 - DNA, 25 bp, Homo sapien
gattaaaagcagtcctaccatgtac

SEQ ID NO: 43157 - DNA, 25 bp, Homo sapien
agcagtcctaccatgtactacaatg

SEQ ID NO: 43158 - DNA, 25 bp, Homo sapien
ctacaatgggtaatcccaaaccatc

SEQ ID NO: 43159 - DNA, 25 bp, Homo sapien
aactctgaaaagctgatggcaaatc

SEQ ID NO: 43160 - DNA, 25 bp, Homo sapien
agtaggattattatttctttggtat

SEQ ID NO: 43161 - DNA, 25 bp, Homo sapien
ttctttggtataccgaactttgcaa

SEQ ID NO: 43162 - DNA, 25 bp, Homo sapien
ctttgcttctagacagggttggcca

SEQ ID NO: 43163 - DNA, 25 bp, Homo sapien
ggccataaaccaactacactgatag

SEQ ID NO: 43164 - DNA, 25 bp, Homo sapien
aactacactgatagaggtctctcca

SEQ ID NO: 43165 - DNA, 25 bp, Homo sapien
ggtctctccagattgtctcagaaga

SEQ ID NO: 43166 - DNA, 25 bp, Homo sapien
tttaccctgaaacttaatgacatga

SEQ ID NO: 43167 - DNA, 25 bp, Homo sapien
cctgtttactgaaatttttattgca

SEQ ID NO: 43168 - DNA, 25 bp, Homo sapien
taacgttaaaagtttctgctggagt

SEQ ID NO: 43169 - DNA, 25 bp, Homo sapien
gtgggagacaattccacacacaggg

SEQ ID NO: 43170 - DNA, 25 bp, Homo sapien
aggctttgggggccattgagacagc

SEQ ID NO: 43171 - DNA, 25 bp, Homo sapien
tcctgcctgccctgagtgggagggc

SEQ ID NO: 43172 - DNA, 25 bp, Homo sapien
gtgggagggcaagacatgactggct

SEQ ID NO: 43173 - DNA, 25 bp, Homo sapien
tgactggctcaggatggcctgtcac

SEQ ID NO: 43174 - DNA, 25 bp, Homo sapien
gtcacccaagttgcctcaaagaagc

SEQ ID NO: 43175 - DNA, 25 bp, Homo sapien
ggacatcagtgcagtcggatgcaca

SEQ ID NO: 43176 - DNA, 25 bp, Homo sapien
agtgcacacgtgtgtgtacctgccc

SEQ ID NO: 43177 - DNA, 25 bp, Homo sapien
aacctcacaggagagaccaacccac

SEQ ID NO: 43178 - DNA, 25 bp, Homo sapien
tggcccctgtcaccagagattaatt

SEQ ID NO: 43179 - DNA, 25 bp, Homo sapien
gattaattttgccctttctgaaact

SEQ ID NO: 43180 - DNA, 25 bp, Homo sapien
cctgtaactctacccactgtgggtt

SEQ ID NO: 43181 - DNA, 25 bp, Homo sapien
ggtaacctgaactgatgccatgtag

SEQ ID NO: 43182 - DNA, 25 bp, Homo sapien
acctgaactgatgccatgtagaatg

SEQ ID NO: 43183 - DNA, 25 bp, Homo sapien
taaaggctgtgggcataatgagtat

SEQ ID NO: 43184 - DNA, 25 bp, Homo sapien
atagaaatgccttccaccaacattt

SEQ ID NO: 43185 - DNA, 25 bp, Homo sapien
aatgccttccaccaacatttaatct

SEQ ID NO: 43186 - DNA, 25 bp, Homo sapien
gaacttgagatatcttattctcgtt

SEQ ID NO: 43187 - DNA, 25 bp, Homo sapien
gatatcttattctcgttaaaatatt

SEQ ID NO: 43188 - DNA, 25 bp, Homo sapien
tgaaagtaaggaattcctttccagt

SEQ ID NO: 43189 - DNA, 25 bp, Homo sapien
aaaaacagataccctagaccaggtg

SEQ ID NO: 43190 - DNA, 25 bp, Homo sapien
acagataccctagaccaggtgaggt

SEQ ID NO: 43191 - DNA, 25 bp, Homo sapien
gggaggccaagtaaggacgattgct

SEQ ID NO: 43192 - DNA, 25 bp, Homo sapien
tacataatctgtttaatccccaatt

SEQ ID NO: 43193 - DNA, 25 bp, Homo sapien
atctgtttaatccccaattatatat

SEQ ID NO: 43194 - DNA, 25 bp, Homo sapien
tctttggtgcctggtgtttagtttt

SEQ ID NO: 43195 - DNA, 25 bp, Homo sapien
ggtgcctggtgtttagttttaatat

SEQ ID NO: 43196 - DNA, 25 bp, Homo sapien
agttgttccatttccatgggttact

SEQ ID NO: 43197 - DNA, 25 bp, Homo sapien
ccatttccatgggttactgagtaaa

SEQ ID NO: 43198 - DNA, 25 bp, Homo sapien
tgagtaaagactcaccagttcgcca

SEQ ID NO: 43199 - DNA, 25 bp, Homo sapien
ctcaccagttcgccataacagacat

SEQ ID NO: 43200 - DNA, 25 bp, Homo sapien
gttcgccataacagacataagagtg

SEQ ID NO: 43201 - DNA, 25 bp, Homo sapien
aatcatcccagtttggtggtgcaca

SEQ ID NO: 43202 - DNA, 25 bp, Homo sapien
gaaccttggaaggggcagttgcagt

SEQ ID NO: 43203 - DNA, 25 bp, Homo sapien
gattctgggctttactaagacttcc

SEQ ID NO: 43204 - DNA, 25 bp, Homo sapien
aagacttcctactctcagaatctct

SEQ ID NO: 43205 - DNA, 25 bp, Homo sapien
gaatctctggactataaacgctggg

SEQ ID NO: 43206 - DNA, 25 bp, Homo sapien
aagaaaatcaactctaagactccag

SEQ ID NO: 43207 - DNA, 25 bp, Homo sapien
ggcagaacatgactggccttcattc

SEQ ID NO: 43208 - DNA, 25 bp, Homo sapien
gcagtcccttaaatacagttgcttc

SEQ ID NO: 43209 - DNA, 25 bp, Homo sapien
tacagttgcttctcaagaaaaccac

SEQ ID NO: 43210 - DNA, 25 bp, Homo sapien
tgtcccgtttcacctgtaatttgga

SEQ ID NO: 43211 - DNA, 25 bp, Homo sapien
aattctgtttgttgtcacacacatc

SEQ ID NO: 43212 - DNA, 25 bp, Homo sapien
atggcagctctatatatgacaactt

SEQ ID NO: 43213 - DNA, 25 bp, Homo sapien
ggtatgatgccaagctttggtttta

SEQ ID NO: 43214 - DNA, 25 bp, Homo sapien
ataataataactaccaggcagccaa

SEQ ID NO: 43215 - DNA, 25 bp, Homo sapien
aggcagccaaccagctgaaaacctc

SEQ ID NO: 43216 - DNA, 25 bp, Homo sapien
accagctgaaaacctctacattgcc

SEQ ID NO: 43217 - DNA, 25 bp, Homo sapien
aagataagggcaggactctccagcg

SEQ ID NO: 43218 - DNA, 25 bp, Homo sapien
tgcccttgacctcacttgggaggaa

SEQ ID NO: 43219 - DNA, 25 bp, Homo sapien
gacagatgccaagggaaaccctgcc

SEQ ID NO: 43220 - DNA, 25 bp, Homo sapien
ctgccagctccgctagcaaaggaaa

SEQ ID NO: 43221 - DNA, 25 bp, Homo sapien
cggacctccacaagtaacgaatcgg

SEQ ID NO: 43222 - DNA, 25 bp, Homo sapien
gtaacgaatcgggggatcaactgaa

SEQ ID NO: 43223 - DNA, 25 bp, Homo sapien
cttttggagcctttcgatctatcat

SEQ ID NO: 43224 - DNA, 25 bp, Homo sapien
gcctttcgatctatcatggagacac

SEQ ID NO: 43225 - DNA, 25 bp, Homo sapien
atgtgtagtgtctagcacggtgcct

SEQ ID NO: 43226 - DNA, 25 bp, Homo sapien
tgtctagcacggtgcctgacagctc

SEQ ID NO: 43227 - DNA, 25 bp, Homo sapien
gcctgacagctcacagaaaatcccc

SEQ ID NO: 43228 - DNA, 25 bp, Homo sapien
gatgaacatctctactgggagggga

SEQ ID NO: 43229 - DNA, 25 bp, Homo sapien
gagggaagaaatgctggcaccttga

SEQ ID NO: 43230 - DNA, 25 bp, Homo sapien
ctggcaccttgacatttggggaaag

SEQ ID NO: 43231 - DNA, 25 bp, Homo sapien
gttttccaagtatctactttgtgcc

SEQ ID NO: 43232 - DNA, 25 bp, Homo sapien
ctactttgtgccagaaatggtgttg

SEQ ID NO: 43233 - DNA, 25 bp, Homo sapien
aatggtgttgggcaatttactgatt

SEQ ID NO: 43234 - DNA, 25 bp, Homo sapien
aatcctttgacgtatcctaggagtt

SEQ ID NO: 43235 - DNA, 25 bp, Homo sapien
gtatcctaggagttaggtattctca

SEQ ID NO: 43236 - DNA, 25 bp, Homo sapien
aaatctaagcaaactatctttgagt

SEQ ID NO: 43237 - DNA, 25 bp, Homo sapien
aaagttggataactcatctatattt

SEQ ID NO: 43238 - DNA, 25 bp, Homo sapien
ggataactcatctatatttgaaata

SEQ ID NO: 43239 - DNA, 25 bp, Homo sapien
gaaataatgctgtctgaatggccaa

SEQ ID NO: 43240 - DNA, 25 bp, Homo sapien
aatgctgtctgaatggccaacatcc

SEQ ID NO: 43241 - DNA, 25 bp, Homo sapien
tgctgtctgaatggccaacatccca

SEQ ID NO: 43242 - DNA, 25 bp, Homo sapien
ctgtctgaatggccaacatcccaag

SEQ ID NO: 43243 - DNA, 25 bp, Homo sapien
tgtctgaatggccaacatcccaaga

SEQ ID NO: 43244 - DNA, 25 bp, Homo sapien
gaatggccaacatcccaagaatgta

SEQ ID NO: 43245 - DNA, 25 bp, Homo sapien
ggccaacatcccaagaatgtattaa

SEQ ID NO: 43246 - DNA, 25 bp, Homo sapien
gaatgtattaaaaacagcaacctgc

SEQ ID NO: 43247 - DNA, 25 bp, Homo sapien
ccaccacacagaatgcatctggagc

SEQ ID NO: 43248 - DNA, 25 bp, Homo sapien
tcaactaacttaatcccttgatttt

SEQ ID NO: 43249 - DNA, 25 bp, Homo sapien
aaataatctaaaattccttgctgaa

SEQ ID NO: 43250 - DNA, 25 bp, Homo sapien
aattccttgctgaaattctaatcca

SEQ ID NO: 43251 - DNA, 25 bp, Homo sapien
aattctaatccagctctatggagca

SEQ ID NO: 43252 - DNA, 25 bp, Homo sapien
gctctatggagcaagacttctttgg

SEQ ID NO: 43253 - DNA, 25 bp, Homo sapien
gagcaagacttctttggtgcttaag

SEQ ID NO: 43254 - DNA, 25 bp, Homo sapien
gcttaagaacagtctgatgggctgg

SEQ ID NO: 43255 - DNA, 25 bp, Homo sapien
ctcttaaaatgatccctactacaac

SEQ ID NO: 43256 - DNA, 25 bp, Homo sapien
gatccctactacaactgttcagtta

SEQ ID NO: 43257 - DNA, 25 bp, Homo sapien
ataggcaatgcacatatggcccagc

SEQ ID NO: 43258 - DNA, 25 bp, Homo sapien
aagaaaaatagctcagatcagtctg

SEQ ID NO: 43259 - DNA, 25 bp, Homo sapien
agatcagtctgagctatgcgaaatg

SEQ ID NO: 43260 - DNA, 25 bp, Homo sapien
gctatgcgaaatgtatcaggcccag

SEQ ID NO: 43261 - DNA, 25 bp, Homo sapien
atgcgaaatgtatcaggcccaggga

SEQ ID NO: 43262 - DNA, 25 bp, Homo sapien
gaaatgtatcaggcccagggagact

SEQ ID NO: 43263 - DNA, 25 bp, Homo sapien
ggcccagggagactgtacagtgaat

SEQ ID NO: 43264 - DNA, 25 bp, Homo sapien
gtacagtgaataggggacttcggtc

SEQ ID NO: 43265 - DNA, 25 bp, Homo sapien
tgaataggggacttcggtcacacgc

SEQ ID NO: 43266 - DNA, 25 bp, Homo sapien
aaaatccacttgcagactgggtgcg

SEQ ID NO: 43267 - DNA, 25 bp, Homo sapien
atccacttgcagactgggtgcgttg

SEQ ID NO: 43268 - DNA, 25 bp, Homo sapien
cacttgcagactgggtgcgttggct

SEQ ID NO: 43269 - DNA, 25 bp, Homo sapien
gctggggtatgagttgtgccctcta

SEQ ID NO: 43270 - DNA, 25 bp, Homo sapien
gagttgtgccctctatatagctgtg

SEQ ID NO: 43271 - DNA, 25 bp, Homo sapien
gacgacttaacttcccatagaattc

SEQ ID NO: 43272 - DNA, 25 bp, Homo sapien
ggataatgaatcttgccagttctag

SEQ ID NO: 43273 - DNA, 25 bp, Homo sapien
atgctctgtgttgacattcatgcta

SEQ ID NO: 43274 - DNA, 25 bp, Homo sapien
tgctaaagccagtctgcattttcaa

SEQ ID NO: 43275 - DNA, 25 bp, Homo sapien
atttcttcactatttaaggctttca

SEQ ID NO: 43276 - DNA, 25 bp, Homo sapien
aatatttgtccaccaacttagccct

SEQ ID NO: 43277 - DNA, 25 bp, Homo sapien
cttagccctacagtaatgttcccaa

SEQ ID NO: 43278 - DNA, 25 bp, Homo sapien
tgggagcaaactggtctgcctttac

SEQ ID NO: 43279 - DNA, 25 bp, Homo sapien
ggataacacctgtgtctcattcctc

SEQ ID NO: 43280 - DNA, 25 bp, Homo sapien
gagaagccgcggaaggaggagagac

SEQ ID NO: 43281 - DNA, 25 bp, Homo sapien
gccgcggaaggaggagagacctaag

SEQ ID NO: 43282 - DNA, 25 bp, Homo sapien
gaaagagaggccgcggaaagaggag

SEQ ID NO: 43283 - DNA, 25 bp, Homo sapien
gaaagaggagaggccacgggccgcc

SEQ ID NO: 43284 - DNA, 25 bp, Homo sapien
taccccagcgctgggagtcacgcga

SEQ ID NO: 43285 - DNA, 25 bp, Homo sapien
ccagcgctgggagtcacgcgaaggg

SEQ ID NO: 43286 - DNA, 25 bp, Homo sapien
cgctgggagtcacgcgaagggggcc

SEQ ID NO: 43287 - DNA, 25 bp, Homo sapien
ccaaggagaggcctcggagagaggg

SEQ ID NO: 43288 - DNA, 25 bp, Homo sapien
ggcctcggagagaggggaagccgcg

SEQ ID NO: 43289 - DNA, 25 bp, Homo sapien
gagaggggaagccgcggaaggagaa

SEQ ID NO: 43290 - DNA, 25 bp, Homo sapien
gggaagccgcggaaggagaagccgc

SEQ ID NO: 43291 - DNA, 25 bp, Homo sapien
cgcgcagatggccactcaggtggag

SEQ ID NO: 43292 - DNA, 25 bp, Homo sapien
agatggccactcaggtggagccgct

SEQ ID NO: 43293 - DNA, 25 bp, Homo sapien
ccacgctcttgcaggccgaagagca

SEQ ID NO: 43294 - DNA, 25 bp, Homo sapien
ggctagtgggcctcggatttacggc

SEQ ID NO: 43295 - DNA, 25 bp, Homo sapien
tgcaggccgaagagcacggggggct

SEQ ID NO: 43296 - DNA, 25 bp, Homo sapien
gagcacggggggctggtgaggaaga

SEQ ID NO: 43297 - DNA, 25 bp, Homo sapien
ggctggtgaggaagaagccgccgcc

SEQ ID NO: 43298 - DNA, 25 bp, Homo sapien
cggcgcccgagggcaagggcgagcc

SEQ ID NO: 43299 - DNA, 25 bp, Homo sapien
ctgcgccaagccgcacaaggagggc

SEQ ID NO: 43300 - DNA, 25 bp, Homo sapien
cgccaagccgcacaaggagggcacc

SEQ ID NO: 43301 - DNA, 25 bp, Homo sapien
gctgcatctaactgggagggggccg

SEQ ID NO: 43302 - DNA, 25 bp, Homo sapien
attcctgatttatccaccaattatt

SEQ ID NO: 43303 - DNA, 25 bp, Homo sapien
aatgtatttaaacctgaattcagag

SEQ ID NO: 43304 - DNA, 25 bp, Homo sapien
aatatattagctttactctctcctc

SEQ ID NO: 43305 - DNA, 25 bp, Homo sapien
tccactgccaaacctttaaaaactg

SEQ ID NO: 43306 - DNA, 25 bp, Homo sapien
tgtttttatttcatcttttctcttt

SEQ ID NO: 43307 - DNA, 25 bp, Homo sapien
ttctctctctctaaggtgattgcca

SEQ ID NO: 43308 - DNA, 25 bp, Homo sapien
tctctctaaggtgattgccaagact

SEQ ID NO: 43309 - DNA, 25 bp, Homo sapien
ggtgattgccaagactaaagaaaca

SEQ ID NO: 43310 - DNA, 25 bp, Homo sapien
gaaacagctagaagggcaaaagaca

SEQ ID NO: 43311 - DNA, 25 bp, Homo sapien
gattatccaaagtagagcacggctc

SEQ ID NO: 43312 - DNA, 25 bp, Homo sapien
aagtagagcacggctcaggtgcagt

SEQ ID NO: 43313 - DNA, 25 bp, Homo sapien
atgcagctcatatttaaagggaaaa

SEQ ID NO: 43314 - DNA, 25 bp, Homo sapien
tttcaaattaaccatcatatcacag

SEQ ID NO: 43315 - DNA, 25 bp, Homo sapien
aaccatcatatcacagatctcttca

SEQ ID NO: 43316 - DNA, 25 bp, Homo sapien
agggatgctttatatgttaggtatt

SEQ ID NO: 43317 - DNA, 25 bp, Homo sapien
tgtacgtttgttctggtttgtccag

SEQ ID NO: 43318 - DNA, 25 bp, Homo sapien
gttctggtttgtccagttgcagaga

SEQ ID NO: 43319 - DNA, 25 bp, Homo sapien
atatgtcaacattgcttaaatgcta

SEQ ID NO: 43320 - DNA, 25 bp, Homo sapien
aatgctaagcagttatggggaacat

SEQ ID NO: 43321 - DNA, 25 bp, Homo sapien
aattccatgagggggttgagtgaga

SEQ ID NO: 43322 - DNA, 25 bp, Homo sapien
gaaattcgagcttgaaatctccatt

SEQ ID NO: 43323 - DNA, 25 bp, Homo sapien
atctccatttggatgtagaattgat

SEQ ID NO: 43324 - DNA, 25 bp, Homo sapien
agccgttggtctttgaaatttcctg

SEQ ID NO: 43325 - DNA, 25 bp, Homo sapien
aatttcctgtgatgtgtttcaatct

SEQ ID NO: 43326 - DNA, 25 bp, Homo sapien
gtgatgtgtttcaatctagatgcaa

SEQ ID NO: 43327 - DNA, 25 bp, Homo sapien
gaaaaatcaaagtgctcgagtggtt

SEQ ID NO: 43328 - DNA, 25 bp, Homo sapien
tatgttttgggtattcctgtttata

SEQ ID NO: 43329 - DNA, 25 bp, Homo sapien
tatagactataatacttttccaatt

SEQ ID NO: 43330 - DNA, 25 bp, Homo sapien
attaaaatcctcagttgtcacgcag

SEQ ID NO: 43331 - DNA, 25 bp, Homo sapien
aatcctcagttgtcacgcagaagaa

SEQ ID NO: 43332 - DNA, 25 bp, Homo sapien
tgtatttgattgccagttttactga

SEQ ID NO: 43333 - DNA, 25 bp, Homo sapien
agtattttacagtatcaccaaatat

SEQ ID NO: 43334 - DNA, 25 bp, Homo sapien
tattttgtttagccaaggtatagga

SEQ ID NO: 43335 - DNA, 25 bp, Homo sapien
gagcaacagagcgagagtcagtctc

SEQ ID NO: 43336 - DNA, 25 bp, Homo sapien
aatattatgttctaattaccttgaa

SEQ ID NO: 43337 - DNA, 25 bp, Homo sapien
aggcttgaattgatcaataccagtt

SEQ ID NO: 43338 - DNA, 25 bp, Homo sapien
gaacaagcattctcaacattattat

SEQ ID NO: 43339 - DNA, 25 bp, Homo sapien
actactcagtttacagaatgggatc

SEQ ID NO: 43340 - DNA, 25 bp, Homo sapien
gatctgaaactacagctttttgcta

SEQ ID NO: 43341 - DNA, 25 bp, Homo sapien
actacagctttttgctattaaacca

SEQ ID NO: 43342 - DNA, 25 bp, Homo sapien
aaaccaaatacttgtgatctacttt

SEQ ID NO: 43343 - DNA, 25 bp, Homo sapien
acttgtgatctactttgtttgagca

SEQ ID NO: 43344 - DNA, 25 bp, Homo sapien
gcaaaacagcattatttgttatgtt

SEQ ID NO: 43345 - DNA, 25 bp, Homo sapien
tgtatgtgaactatatttacctatt

SEQ ID NO: 43346 - DNA, 25 bp, Homo sapien
attttttaaatggcactatgtagta

SEQ ID NO: 43347 - DNA, 25 bp, Homo sapien
tgagaatagaagagtacctgtacct

SEQ ID NO: 43348 - DNA, 25 bp, Homo sapien
gaagagtacctgtacctacaagggg

SEQ ID NO: 43349 - DNA, 25 bp, Homo sapien
atgaatgcaattctttatttgataa

SEQ ID NO: 43350 - DNA, 25 bp, Homo sapien
catggggaaaagctacctttcctga

SEQ ID NO: 43351 - DNA, 25 bp, Homo sapien
tgaaaggggaggagggcactgtcct

SEQ ID NO: 43352 - DNA, 25 bp, Homo sapien
gggcactgtcctttcagacaaagct

SEQ ID NO: 43353 - DNA, 25 bp, Homo sapien
aagcttgtacaaattcctgaaccgc

SEQ ID NO: 43354 - DNA, 25 bp, Homo sapien
caaattcctgaaccgcaaatttgct

SEQ ID NO: 43355 - DNA, 25 bp, Homo sapien
ggtagacatgaaaggcaggtgagga

SEQ ID NO: 43356 - DNA, 25 bp, Homo sapien
aaggtctctttgcagatatatattt

SEQ ID NO: 43357 - DNA, 25 bp, Homo sapien
ttcgagaccagccttaccaatatgg

SEQ ID NO: 43358 - DNA, 25 bp, Homo sapien
gccttaccaatatggtgaagcccca

SEQ ID NO: 43359 - DNA, 25 bp, Homo sapien
aattagccctgcatggtggcaggtg

SEQ ID NO: 43360 - DNA, 25 bp, Homo sapien
tgcactccagcttgggcaatagcaa

SEQ ID NO: 43361 - DNA, 25 bp, Homo sapien
gcttgggcaatagcaagactccatc

SEQ ID NO: 43362 - DNA, 25 bp, Homo sapien
gagtattcatattaagtgttttatt

SEQ ID NO: 43363 - DNA, 25 bp, Homo sapien
aagtgttttattttccatattagag

SEQ ID NO: 43364 - DNA, 25 bp, Homo sapien
gagatgggaagggaaccttatgtgt

SEQ ID NO: 43365 - DNA, 25 bp, Homo sapien
ggaaccttatgtgtattttattttg

SEQ ID NO: 43366 - DNA, 25 bp, Homo sapien
gaggctgagggaggtagatcacctg

SEQ ID NO: 43367 - DNA, 25 bp, Homo sapien
tgagggaggtagatcacctgaggtc

SEQ ID NO: 43368 - DNA, 25 bp, Homo sapien
gaagacagacagtaccaacggaaat

SEQ ID NO: 43369 - DNA, 25 bp, Homo sapien
acggaaatactgtagctcctcctgc

SEQ ID NO: 43370 - DNA, 25 bp, Homo sapien
tccccctctttcaaaatctaacttg

SEQ ID NO: 43371 - DNA, 25 bp, Homo sapien
aaaatctaacttgagactcgcattt

SEQ ID NO: 43372 - DNA, 25 bp, Homo sapien
tgtttgactttgccatcactttgaa

SEQ ID NO: 43373 - DNA, 25 bp, Homo sapien
ttgactttgccatcactttgaaaaa

SEQ ID NO: 43374 - DNA, 25 bp, Homo sapien
ttagtacaaactatatgtggcaaga

SEQ ID NO: 43375 - DNA, 25 bp, Homo sapien
ttcttctggacattttgggcctttc

SEQ ID NO: 43376 - DNA, 25 bp, Homo sapien
aagaatgaacactatgtctggaaga

SEQ ID NO: 43377 - DNA, 25 bp, Homo sapien
gaacactatgtctggaagatatttt

SEQ ID NO: 43378 - DNA, 25 bp, Homo sapien
gagacagtcaaggacttgggggtca

SEQ ID NO: 43379 - DNA, 25 bp, Homo sapien
tgagggaggtagattgcctgagctc

SEQ ID NO: 43380 - DNA, 25 bp, Homo sapien
gtctaggaagtgttatgtttttctc

SEQ ID NO: 43381 - DNA, 25 bp, Homo sapien
ctttcatatggctgcaaacacttta

SEQ ID NO: 43382 - DNA, 25 bp, Homo sapien
atatggctgcaaacactttaaattt

SEQ ID NO: 43383 - DNA, 25 bp, Homo sapien
ttgtgccctcccaacatagatatga

SEQ ID NO: 43384 - DNA, 25 bp, Homo sapien
gagaagacctatggaatactgctga

SEQ ID NO: 43385 - DNA, 25 bp, Homo sapien
gacctatggaatactgctgaagcct

SEQ ID NO: 43386 - DNA, 25 bp, Homo sapien
tactgctgaagcctaatttaaccca

SEQ ID NO: 43387 - DNA, 25 bp, Homo sapien
gctgaagcctaatttaacccaaagt

SEQ ID NO: 43388 - DNA, 25 bp, Homo sapien
taacccaaagtttaggtggagcact

SEQ ID NO: 43389 - DNA, 25 bp, Homo sapien
agtttaggtggagcactttgtgctt

SEQ ID NO: 43390 - DNA, 25 bp, Homo sapien
tggggtacagattgggggttgtgcc

SEQ ID NO: 43391 - DNA, 25 bp, Homo sapien
atatgttttgtagtattcattgatt

SEQ ID NO: 43392 - DNA, 25 bp, Homo sapien
agattgggggttgtgccatactgtt

SEQ ID NO: 43393 - DNA, 25 bp, Homo sapien
tcccatttaaaataggctcagccag

SEQ ID NO: 43394 - DNA, 25 bp, Homo sapien
aaataggctcagccagttcaatgtc

SEQ ID NO: 43395 - DNA, 25 bp, Homo sapien
atattatacctcttggtatctagaa

SEQ ID NO: 43396 - DNA, 25 bp, Homo sapien
aatatatctttagccacagcaaacc

SEQ ID NO: 43397 - DNA, 25 bp, Homo sapien
tatctttagccacagcaaaccacac

SEQ ID NO: 43398 - DNA, 25 bp, Homo sapien
caaaccacacttaacctatctataa

SEQ ID NO: 43399 - DNA, 25 bp, Homo sapien
accacacttaacctatctataataa

SEQ ID NO: 43400 - DNA, 25 bp, Homo sapien
tcatctggaatgatacttagtgtat

SEQ ID NO: 43401 - DNA, 25 bp, Homo sapien
tgttgcctaggctggtttcgaactc

SEQ ID NO: 43402 - DNA, 25 bp, Homo sapien
tttcgaactcctggcctcaggtgat

SEQ ID NO: 43403 - DNA, 25 bp, Homo sapien
atcctcttgcctaagcctgtagaag

SEQ ID NO: 43404 - DNA, 25 bp, Homo sapien
gcctaagcctgtagaagtgctagat

SEQ ID NO: 43405 - DNA, 25 bp, Homo sapien
gaactcctgggctcaggagatcctc

SEQ ID NO: 43406 - DNA, 25 bp, Homo sapien
ataggcatgagtcaccaggcctggc

SEQ ID NO: 43407 - DNA, 25 bp, Homo sapien
aggcctggcccttttaataagctag

SEQ ID NO: 43408 - DNA, 25 bp, Homo sapien
tgcaaggcttttgaaaatgttctct

SEQ ID NO: 43409 - DNA, 25 bp, Homo sapien
aatgttctctttggtttttgaatgt

SEQ ID NO: 43410 - DNA, 25 bp, Homo sapien
gggacaggtgtgtgtcaccacatcc

SEQ ID NO: 43411 - DNA, 25 bp, Homo sapien
gtcaccacatccagctaaatttttt

SEQ ID NO: 43412 - DNA, 25 bp, Homo sapien
ttcagtgctgtcttgaacgtcccaa

SEQ ID NO: 43413 - DNA, 25 bp, Homo sapien
ctgtcttgaacgtcccaatggagcc

SEQ ID NO: 43414 - DNA, 25 bp, Homo sapien
cttgaacgtcccaatggagccacca

SEQ ID NO: 43415 - DNA, 25 bp, Homo sapien
gtcccaatggagccaccagagtgac

SEQ ID NO: 43416 - DNA, 25 bp, Homo sapien
ggagccaccagagtgactttcctaa

SEQ ID NO: 43417 - DNA, 25 bp, Homo sapien
aaggtttgagttggagctagtctga

SEQ ID NO: 43418 - DNA, 25 bp, Homo sapien
ccaccagagtgactttcctaacaga

SEQ ID NO: 43419 - DNA, 25 bp, Homo sapien
gagtgactttcctaacagaagatat

SEQ ID NO: 43420 - DNA, 25 bp, Homo sapien
acagaagatatgatctgccttgagg

SEQ ID NO: 43421 - DNA, 25 bp, Homo sapien
gttggagctagtctgatgcagcagg

SEQ ID NO: 43422 - DNA, 25 bp, Homo sapien
ctagtctgatgcagcagggagccct

SEQ ID NO: 43423 - DNA, 25 bp, Homo sapien
gggttttgattttgggtagcaattg

SEQ ID NO: 43424 - DNA, 25 bp, Homo sapien
ccctgagaagaagccctgttgtttt

SEQ ID NO: 43425 - DNA, 25 bp, Homo sapien
gccctgttgtttttcttaagagtct

SEQ ID NO: 43426 - DNA, 25 bp, Homo sapien
acttttctagtaattgcatcaggga

SEQ ID NO: 43427 - DNA, 25 bp, Homo sapien
ccctcaccccccagagaatagtgag

SEQ ID NO: 43428 - DNA, 25 bp, Homo sapien
gagtgactcgtttagattctctgct

SEQ ID NO: 43429 - DNA, 25 bp, Homo sapien
gactcgtttagattctctgcttttt

SEQ ID NO: 43430 - DNA, 25 bp, Homo sapien
ctctgctttttttcagttatgtaca

SEQ ID NO: 43431 - DNA, 25 bp, Homo sapien
tacaagacttcagcatacattaatg

SEQ ID NO: 43432 - DNA, 25 bp, Homo sapien
atttgccaatgctttaatttccata

SEQ ID NO: 43433 - DNA, 25 bp, Homo sapien
aaattttaaacacatcacatactct

SEQ ID NO: 43434 - DNA, 25 bp, Homo sapien
aagacaagctgaacaaaggaagaat

SEQ ID NO: 43435 - DNA, 25 bp, Homo sapien
aaggaagaatttatctgtgcctctg

SEQ ID NO: 43436 - DNA, 25 bp, Homo sapien
agaatttatctgtgcctctgagact

SEQ ID NO: 43437 - DNA, 25 bp, Homo sapien
aatttatctgtgcctctgagactag

SEQ ID NO: 43438 - DNA, 25 bp, Homo sapien
ctaccactggactgttttttcaaag

SEQ ID NO: 43439 - DNA, 25 bp, Homo sapien
ctggactgttttttcaaaggcaaag

SEQ ID NO: 43440 - DNA, 25 bp, Homo sapien
gttgcttgataagtgtttaacaaat

SEQ ID NO: 43441 - DNA, 25 bp, Homo sapien
ggttttaggggagtgggagtgagtg

SEQ ID NO: 43442 - DNA, 25 bp, Homo sapien
aggggagtgggagtgagtgaaggag

SEQ ID NO: 43443 - DNA, 25 bp, Homo sapien
agtgggagtgagtgaaggaggaggt

SEQ ID NO: 43444 - DNA, 25 bp, Homo sapien
gaaggaggaggttgtagaagagaat

SEQ ID NO: 43445 - DNA, 25 bp, Homo sapien
gcagtgggcagccatgcgagtcatg

SEQ ID NO: 43446 - DNA, 25 bp, Homo sapien
atgaaggtggcatgcagggatggga

SEQ ID NO: 43447 - DNA, 25 bp, Homo sapien
gatgcttgcctacgttgctgagaat

SEQ ID NO: 43448 - DNA, 25 bp, Homo sapien
ggacactcctggacagtgatcctga

SEQ ID NO: 43449 - DNA, 25 bp, Homo sapien
gatcctgatgtctgttgtgagctgc

SEQ ID NO: 43450 - DNA, 25 bp, Homo sapien
gtgagctgcacactcaagggtgtga

SEQ ID NO: 43451 - DNA, 25 bp, Homo sapien
aagggtgtgataaccagccccagtc

SEQ ID NO: 43452 - DNA, 25 bp, Homo sapien
ccacggctacttctgcgaggtgatg

SEQ ID NO: 43453 - DNA, 25 bp, Homo sapien
gctacttctgcgaggtgatgttcac

SEQ ID NO: 43454 - DNA, 25 bp, Homo sapien
tgaactggaagttccctggggtcac

SEQ ID NO: 43455 - DNA, 25 bp, Homo sapien
tccctggggtcacgagcgtgtgggc

SEQ ID NO: 43456 - DNA, 25 bp, Homo sapien
cgcgcccagagctctctggagggtg

SEQ ID NO: 43457 - DNA, 25 bp, Homo sapien
ccagagctctctggagggtggggta

SEQ ID NO: 43458 - DNA, 25 bp, Homo sapien
gtggggtatgcgggagaggggtgga

SEQ ID NO: 43459 - DNA, 25 bp, Homo sapien
gtggaggccaaacgcaagggccctc

SEQ ID NO: 43460 - DNA, 25 bp, Homo sapien
gccctacttcggagccaggggaggg

SEQ ID NO: 43461 - DNA, 25 bp, Homo sapien
ccaggggagggggcaccaagtgaga

SEQ ID NO: 43462 - DNA, 25 bp, Homo sapien
agtgagagaaattgggcacccccgc

SEQ ID NO: 43463 - DNA, 25 bp, Homo sapien
gcccctggaccggaataatttccag

SEQ ID NO: 43464 - DNA, 25 bp, Homo sapien
gaataatttccagggggcaagagct

SEQ ID NO: 43465 - DNA, 25 bp, Homo sapien
cgcacgccgtactgcgggcgtggag

SEQ ID NO: 43466 - DNA, 25 bp, Homo sapien
ctgcgggcgtggaggcgcaagcccg

SEQ ID NO: 43467 - DNA, 25 bp, Homo sapien
ttgacttcaaaatcatggcttatat

SEQ ID NO: 43468 - DNA, 25 bp, Homo sapien
gcttatatgtactttctctatttcc

SEQ ID NO: 43469 - DNA, 25 bp, Homo sapien
gaaatgttactcatatcttaattgt

SEQ ID NO: 43470 - DNA, 25 bp, Homo sapien
atcttaattgtagtcattggcttga

SEQ ID NO: 43471 - DNA, 25 bp, Homo sapien
attggcttgagtgacgggttttggt

SEQ ID NO: 43472 - DNA, 25 bp, Homo sapien
tgagtgacgggttttggtaattcaa

SEQ ID NO: 43473 - DNA, 25 bp, Homo sapien
tttggtaattcaactactattactt

SEQ ID NO: 43474 - DNA, 25 bp, Homo sapien
gggtgttaaaggaagcaattcatta

SEQ ID NO: 43475 - DNA, 25 bp, Homo sapien
tatgtaatctattgggagactgagg

SEQ ID NO: 43476 - DNA, 25 bp, Homo sapien
ggaggttgcagcgagtcaggatcgc

SEQ ID NO: 43477 - DNA, 25 bp, Homo sapien
gagtcaggatcgcagcactacactc

SEQ ID NO: 43478 - DNA, 25 bp, Homo sapien
ggccaccagaggattctcagggctc

SEQ ID NO: 43479 - DNA, 25 bp, Homo sapien
cagaggattctcagggctcctttgt

SEQ ID NO: 43480 - DNA, 25 bp, Homo sapien
gctcctttgtcctggactgtggaac

SEQ ID NO: 43481 - DNA, 25 bp, Homo sapien
tgtggaactgggggcagctggtccc

SEQ ID NO: 43482 - DNA, 25 bp, Homo sapien
ccctggggtctctgaagtcagtgtc

SEQ ID NO: 43483 - DNA, 25 bp, Homo sapien
tctgaagtcagtgtctccctcactg

SEQ ID NO: 43484 - DNA, 25 bp, Homo sapien
ttcattctgactggcaagccctgtc

SEQ ID NO: 43485 - DNA, 25 bp, Homo sapien
gagaatgagcttccactgtattccc

SEQ ID NO: 43486 - DNA, 25 bp, Homo sapien
gaggctgacctgtggacaagacaat

SEQ ID NO: 43487 - DNA, 25 bp, Homo sapien
gacagggataggcagttcctccatc

SEQ ID NO: 43488 - DNA, 25 bp, Homo sapien
ttcaagggtagtttcaggagcacag

SEQ ID NO: 43489 - DNA, 25 bp, Homo sapien
aagggcagcctttcaactgtttttg

SEQ ID NO: 43490 - DNA, 25 bp, Homo sapien
gttaacatgtatatccagattctga

SEQ ID NO: 43491 - DNA, 25 bp, Homo sapien
agatcttcccaaactatcattccac

SEQ ID NO: 43492 - DNA, 25 bp, Homo sapien
actatcattccacacatttaacctc

SEQ ID NO: 43493 - DNA, 25 bp, Homo sapien
tccttccataccaaatctttctcat

SEQ ID NO: 43494 - DNA, 25 bp, Homo sapien
ttccctaatttcttgctatgaagga

SEQ ID NO: 43495 - DNA, 25 bp, Homo sapien
gaaggattggatacttatcacacta

SEQ ID NO: 43496 - DNA, 25 bp, Homo sapien
cttaaggggcattttaatttctcat

SEQ ID NO: 43497 - DNA, 25 bp, Homo sapien
ttaaagccagcccatagtgaataca

SEQ ID NO: 43498 - DNA, 25 bp, Homo sapien
gaatacagtgctacatcaagaggaa

SEQ ID NO: 43499 - DNA, 25 bp, Homo sapien
tcaagaggaaaacggccgggcgcgg

SEQ ID NO: 43500 - DNA, 25 bp, Homo sapien
ttaggtatatctcccaatgctatcc

SEQ ID NO: 43501 - DNA, 25 bp, Homo sapien
tattcagattatactttgttcttga

SEQ ID NO: 43502 - DNA, 25 bp, Homo sapien
gtaactcaactcattattttctgct

SEQ ID NO: 43503 - DNA, 25 bp, Homo sapien
ttattttctgctgtttcttcattct

SEQ ID NO: 43504 - DNA, 25 bp, Homo sapien
gtttcttcattcttattcacttgtg

SEQ ID NO: 43505 - DNA, 25 bp, Homo sapien
gcttgtgatcatttgttgctgcatc

SEQ ID NO: 43506 - DNA, 25 bp, Homo sapien
gagattcttcttcattagatgggca

SEQ ID NO: 43507 - DNA, 25 bp, Homo sapien
gtggagaggttctttgtggttaact

SEQ ID NO: 43508 - DNA, 25 bp, Homo sapien
aacttatactattgagtgatgcaca

SEQ ID NO: 43509 - DNA, 25 bp, Homo sapien
tatacatgtgccatgctggtgcgct

SEQ ID NO: 43510 - DNA, 25 bp, Homo sapien
ccactaactcgtcatctagcattag

SEQ ID NO: 43511 - DNA, 25 bp, Homo sapien
aaggttttaattatactgctgaagc

SEQ ID NO: 43512 - DNA, 25 bp, Homo sapien
aatgtatgtaattctagagggtaaa

SEQ ID NO: 43513 - DNA, 25 bp, Homo sapien
aggtttggacaatatttgcaccctt

SEQ ID NO: 43514 - DNA, 25 bp, Homo sapien
acaatatttgcacccttgtttgtgt

SEQ ID NO: 43515 - DNA, 25 bp, Homo sapien
agagaaagatgtttggcatgccaaa

SEQ ID NO: 43516 - DNA, 25 bp, Homo sapien
tttggcatgccaaattaacttgcat

SEQ ID NO: 43517 - DNA, 25 bp, Homo sapien
aacttagggggcttgcagaacataa

SEQ ID NO: 43518 - DNA, 25 bp, Homo sapien
gggcttgcagaacataattcctttt

SEQ ID NO: 43519 - DNA, 25 bp, Homo sapien
taaacaaacaggggccgcatttatc

SEQ ID NO: 43520 - DNA, 25 bp, Homo sapien
aggggccgcatttatcaaacttgcc

SEQ ID NO: 43521 - DNA, 25 bp, Homo sapien
caaacttgccaacaggaaaacacct

SEQ ID NO: 43522 - DNA, 25 bp, Homo sapien
gtggctcttggggaaaagcaattta

SEQ ID NO: 43523 - DNA, 25 bp, Homo sapien
gtaccacgatgaatagctaactgtt

SEQ ID NO: 43524 - DNA, 25 bp, Homo sapien
gctaactgttcccaagtgtttgcta

SEQ ID NO: 43525 - DNA, 25 bp, Homo sapien
ttgctatgtgcaacacaccgcgtga

SEQ ID NO: 43526 - DNA, 25 bp, Homo sapien
caccgcgtgagcagtgttacctgca

SEQ ID NO: 43527 - DNA, 25 bp, Homo sapien
gttacctgcattattacattaggct

SEQ ID NO: 43528 - DNA, 25 bp, Homo sapien
tgcccgaagacatacagctagtgac

SEQ ID NO: 43529 - DNA, 25 bp, Homo sapien
gacgaatggactgatggtttgaact

SEQ ID NO: 43530 - DNA, 25 bp, Homo sapien
gtttgaacttaacgtctatttgact

SEQ ID NO: 43531 - DNA, 25 bp, Homo sapien
tatttgacttaaggtcctgcaccct

SEQ ID NO: 43532 - DNA, 25 bp, Homo sapien
gcaccctgccacttgtaattttcag

SEQ ID NO: 43533 - DNA, 25 bp, Homo sapien
aaggcgacacggcagagaggcagaa

SEQ ID NO: 43534 - DNA, 25 bp, Homo sapien
gcagaaaaagatgggccttaccggt

SEQ ID NO: 43535 - DNA, 25 bp, Homo sapien
aaaacggcaatgagctcagtaaaca

SEQ ID NO: 43536 - DNA, 25 bp, Homo sapien
ctgtccctctagctttgaactacaa

SEQ ID NO: 43537 - DNA, 25 bp, Homo sapien
agtggaggggaagtttgtctggatt

SEQ ID NO: 43538 - DNA, 25 bp, Homo sapien
gtttgtctggattttcctgtagaac

SEQ ID NO: 43539 - DNA, 25 bp, Homo sapien
tgtctggattttcctgtagaactga

SEQ ID NO: 43540 - DNA, 25 bp, Homo sapien
gtagaactgagggcaggacatgagg

SEQ ID NO: 43541 - DNA, 25 bp, Homo sapien
cgcccagacgtgtgaccaagatagc

SEQ ID NO: 43542 - DNA, 25 bp, Homo sapien
tgaccaagatagcaaggagcagtct

SEQ ID NO: 43543 - DNA, 25 bp, Homo sapien
ggagcagtctttaaggcgacacggc

SEQ ID NO: 43544 - DNA, 25 bp, Homo sapien
cgacgcagagtccggagaaggcagc

SEQ ID NO: 43545 - DNA, 25 bp, Homo sapien
ggacccacgtcagagaagatgcttg

SEQ ID NO: 43546 - DNA, 25 bp, Homo sapien
ccacaccacaatacggtctggaaga

SEQ ID NO: 43547 - DNA, 25 bp, Homo sapien
gggagatggcaacagtccctgtcac

SEQ ID NO: 43548 - DNA, 25 bp, Homo sapien
cagtccctgtcactggaatgctggc

SEQ ID NO: 43549 - DNA, 25 bp, Homo sapien
gagaaggcagcatggaatccctccc

SEQ ID NO: 43550 - DNA, 25 bp, Homo sapien
atcccttatgaccctggcagtggaa

SEQ ID NO: 43551 - DNA, 25 bp, Homo sapien
ctgacgcccaatgtcttcaacaaag

SEQ ID NO: 43552 - DNA, 25 bp, Homo sapien
cctctctggacggtgttggtggggg

SEQ ID NO: 43553 - DNA, 25 bp, Homo sapien
ggatcaagatgaacacactgcagac

SEQ ID NO: 43554 - DNA, 25 bp, Homo sapien
acactgcagacgaggacacgagccc

SEQ ID NO: 43555 - DNA, 25 bp, Homo sapien
cttttcaggaatctttcaaaatggg

SEQ ID NO: 43556 - DNA, 25 bp, Homo sapien
ggatttggggatcagaactccttct

SEQ ID NO: 43557 - DNA, 25 bp, Homo sapien
ggggatcagaactccttctgatcaa

SEQ ID NO: 43558 - DNA, 25 bp, Homo sapien
cagaactccttctgatcaaatggaa

SEQ ID NO: 43559 - DNA, 25 bp, Homo sapien
accattattgggaagcatgcctccc

SEQ ID NO: 43560 - DNA, 25 bp, Homo sapien
acatatgattttgcatgagctatct

SEQ ID NO: 43561 - DNA, 25 bp, Homo sapien
tgattttgcatgagctatctggaaa

SEQ ID NO: 43562 - DNA, 25 bp, Homo sapien
aggaatgcatttttggatataaaac

SEQ ID NO: 43563 - DNA, 25 bp, Homo sapien
ttgtgcaattttaaactatgttttc

SEQ ID NO: 43564 - DNA, 25 bp, Homo sapien
aaataaactttgtctgcggcttcga

SEQ ID NO: 43565 - DNA, 25 bp, Homo sapien
ataaactttgtctgcggcttcgagg

SEQ ID NO: 43566 - DNA, 25 bp, Homo sapien
gacttcctgccacaaggttttatct

SEQ ID NO: 43567 - DNA, 25 bp, Homo sapien
acactttattggtttgcgttttgat

SEQ ID NO: 43568 - DNA, 25 bp, Homo sapien
gaggaaaatctcacttagaaatcag

SEQ ID NO: 43569 - DNA, 25 bp, Homo sapien
gacacacaagactatgttttaagat

SEQ ID NO: 43570 - DNA, 25 bp, Homo sapien
aaactggaaggatgtggtatgcatt

SEQ ID NO: 43571 - DNA, 25 bp, Homo sapien
gaaagatactttgtttgctcctgct

SEQ ID NO: 43572 - DNA, 25 bp, Homo sapien
ctcctgctttcatttctgttgacaa

SEQ ID NO: 43573 - DNA, 25 bp, Homo sapien
tgttgacaagttgccagaattattt

SEQ ID NO: 43574 - DNA, 25 bp, Homo sapien
agaattatttgtatagggcctctat

SEQ ID NO: 43575 - DNA, 25 bp, Homo sapien
tatagggcctctattttcggaacca

SEQ ID NO: 43576 - DNA, 25 bp, Homo sapien
gaggatttattttactttgtcacaa

SEQ ID NO: 43577 - DNA, 25 bp, Homo sapien
ctccttcctgaccttaggtctgggc

SEQ ID NO: 43578 - DNA, 25 bp, Homo sapien
ctgaccttaggtctgggcacaggag

SEQ ID NO: 43579 - DNA, 25 bp, Homo sapien
ctgggcacaggaggaggggcttgga

SEQ ID NO: 43580 - DNA, 25 bp, Homo sapien
gaggaggggcttggaggtggaggct

SEQ ID NO: 43581 - DNA, 25 bp, Homo sapien
ggcttggaggtggaggctggagctt

SEQ ID NO: 43582 - DNA, 25 bp, Homo sapien
gccctggtagcgtatccacagaagt

SEQ ID NO: 43583 - DNA, 25 bp, Homo sapien
ggtagcgtatccacagaagttatta

SEQ ID NO: 43584 - DNA, 25 bp, Homo sapien
gtatccacagaagttattatgaggt

SEQ ID NO: 43585 - DNA, 25 bp, Homo sapien
tggttggggggacactttgaggcct

SEQ ID NO: 43586 - DNA, 25 bp, Homo sapien
tgaggtaattttatttctttccatt

SEQ ID NO: 43587 - DNA, 25 bp, Homo sapien
cctccccttcctttcacatggagga

SEQ ID NO: 43588 - DNA, 25 bp, Homo sapien
agtaatacatttctgcccaagtaag

SEQ ID NO: 43589 - DNA, 25 bp, Homo sapien
atttctgcccaagtaagagccttcc

SEQ ID NO: 43590 - DNA, 25 bp, Homo sapien
tccattgcctggatcacatctgatt

SEQ ID NO: 43591 - DNA, 25 bp, Homo sapien
gatcacatctgattgtcctggtaat

SEQ ID NO: 43592 - DNA, 25 bp, Homo sapien
atctgattgtcctggtaatttgaga

SEQ ID NO: 43593 - DNA, 25 bp, Homo sapien
gaaatagggtagccccttggtatgg

SEQ ID NO: 43594 - DNA, 25 bp, Homo sapien
gtagccccttggtatggatagtagc

SEQ ID NO: 43595 - DNA, 25 bp, Homo sapien
ggatagtagcttgatgacatggaat

SEQ ID NO: 43596 - DNA, 25 bp, Homo sapien
gatggtgtcacttgtaactgctttt

SEQ ID NO: 43597 - DNA, 25 bp, Homo sapien
aactgcttttgtgctgtataaattg

SEQ ID NO: 43598 - DNA, 25 bp, Homo sapien
aagagagttggtctgggtgcgatct

SEQ ID NO: 43599 - DNA, 25 bp, Homo sapien
aaaccaactcaatagtctaaggaat

SEQ ID NO: 43600 - DNA, 25 bp, Homo sapien
ggaatttgactggggagaatctgga

SEQ ID NO: 43601 - DNA, 25 bp, Homo sapien
aaacctgaagtaattgcctttgaga

SEQ ID NO: 43602 - DNA, 25 bp, Homo sapien
tgattgcctactgtgtgtcaaatta

SEQ ID NO: 43603 - DNA, 25 bp, Homo sapien
atgtgtttcatgtcaaagactccaa

SEQ ID NO: 43604 - DNA, 25 bp, Homo sapien
gtagataagatataggcccagcctt

SEQ ID NO: 43605 - DNA, 25 bp, Homo sapien
ccagccttggggagctcattgagtc

SEQ ID NO: 43606 - DNA, 25 bp, Homo sapien
ggggagctcattgagtcacagagaa

SEQ ID NO: 43607 - DNA, 25 bp, Homo sapien
gaacaggggatcagcaatctattat

SEQ ID NO: 43608 - DNA, 25 bp, Homo sapien
attttaattgcgtcttttcatgatt

SEQ ID NO: 43609 - DNA, 25 bp, Homo sapien
caatgcgtgcgtgctgaagagaatt

SEQ ID NO: 43610 - DNA, 25 bp, Homo sapien
gaaattgacttttgtttggagtttg

SEQ ID NO: 43611 - DNA, 25 bp, Homo sapien
tcaaacagccggttttgtccagggc

SEQ ID NO: 43612 - DNA, 25 bp, Homo sapien
ttttgtccagggcagttcgagcgga

SEQ ID NO: 43613 - DNA, 25 bp, Homo sapien
ggcagttcgagcggaagtttctcac

SEQ ID NO: 43614 - DNA, 25 bp, Homo sapien
gttcgagcggaagtttctcactgac

SEQ ID NO: 43615 - DNA, 25 bp, Homo sapien
aagtttctcactgacaatttgcccc

SEQ ID NO: 43616 - DNA, 25 bp, Homo sapien
ttctcactgacaatttgccccaaat

SEQ ID NO: 43617 - DNA, 25 bp, Homo sapien
gacaatttgccccaaatagatagat

SEQ ID NO: 43618 - DNA, 25 bp, Homo sapien
ccatgcggcaagagcgagtcgcagg

SEQ ID NO: 43619 - DNA, 25 bp, Homo sapien
agagcgagtcgcaggaacaagtggg

SEQ ID NO: 43620 - DNA, 25 bp, Homo sapien
acaagtggggaatcttggccgcggc

SEQ ID NO: 43621 - DNA, 25 bp, Homo sapien
aactggttaccaagcatcaagaaaa

SEQ ID NO: 43622 - DNA, 25 bp, Homo sapien
gcatgtattgttgctgaaggtgaag

SEQ ID NO: 43623 - DNA, 25 bp, Homo sapien
gaaggtgaagcaactttttgattct

SEQ ID NO: 43624 - DNA, 25 bp, Homo sapien
aactttttgattctgttctgttcca

SEQ ID NO: 43625 - DNA, 25 bp, Homo sapien
tctgttccactctgggttctaagat

SEQ ID NO: 43626 - DNA, 25 bp, Homo sapien
taagatgtgtgtcagataccggcca

SEQ ID NO: 43627 - DNA, 25 bp, Homo sapien
gtgtgtcagataccggccacacacc

SEQ ID NO: 43628 - DNA, 25 bp, Homo sapien
cagcactctagtctgcaggtgggca

SEQ ID NO: 43629 - DNA, 25 bp, Homo sapien
caggtgggcatctaaggccctgcca

SEQ ID NO: 43630 - DNA, 25 bp, Homo sapien
tatttacttagttctcagcacctct

SEQ ID NO: 43631 - DNA, 25 bp, Homo sapien
cacctctgcccatctttaaatgact

SEQ ID NO: 43632 - DNA, 25 bp, Homo sapien
aacttagcttttcaattcaacattt

SEQ ID NO: 43633 - DNA, 25 bp, Homo sapien
atgaagtgttcttatgccagtaact

SEQ ID NO: 43634 - DNA, 25 bp, Homo sapien
gccagtaactttaagctattccctt

SEQ ID NO: 43635 - DNA, 25 bp, Homo sapien
actttaagctattcccttactcaag

SEQ ID NO: 43636 - DNA, 25 bp, Homo sapien
gaatattgttcctatgggttaaatt

SEQ ID NO: 43637 - DNA, 25 bp, Homo sapien
tatatggtatattttgatgcaggca

SEQ ID NO: 43638 - DNA, 25 bp, Homo sapien
gatgcaggcatactctatataataa

SEQ ID NO: 43639 - DNA, 25 bp, Homo sapien
aggaaatgagatatccattacctct

SEQ ID NO: 43640 - DNA, 25 bp, Homo sapien
attacctctagcatttattcttttt

SEQ ID NO: 43641 - DNA, 25 bp, Homo sapien
tcaattgtacacttttagttatttt

SEQ ID NO: 43642 - DNA, 25 bp, Homo sapien
attacagggtcatttttatggtcat

SEQ ID NO: 43643 - DNA, 25 bp, Homo sapien
gaaaggggccacttaattccattag

SEQ ID NO: 43644 - DNA, 25 bp, Homo sapien
gccacttaattccattagtcctctt

SEQ ID NO: 43645 - DNA, 25 bp, Homo sapien
tccattagtcctctttttatactga

SEQ ID NO: 43646 - DNA, 25 bp, Homo sapien
tattagatacatgttattccctttt

SEQ ID NO: 43647 - DNA, 25 bp, Homo sapien
gtaaaatctaaactgcatgctctgg

SEQ ID NO: 43648 - DNA, 25 bp, Homo sapien
aactgcatgctctggaaacactttt

SEQ ID NO: 43649 - DNA, 25 bp, Homo sapien
aaacacttttttcagatgcatctgg

SEQ ID NO: 43650 - DNA, 25 bp, Homo sapien
cacttttcagaatccaaaacggcca

SEQ ID NO: 43651 - DNA, 25 bp, Homo sapien
tgttttcccgttttatgtgggcaat

SEQ ID NO: 43652 - DNA, 25 bp, Homo sapien
tgtgctatgcagccaggttaacatt

SEQ ID NO: 43653 - DNA, 25 bp, Homo sapien
taaactgttacaatgcacactgatt

SEQ ID NO: 43654 - DNA, 25 bp, Homo sapien
tagggagctcaagtacccggacaca

SEQ ID NO: 43655 - DNA, 25 bp, Homo sapien
ggagcaccccaggatcgaagagggc

SEQ ID NO: 43656 - DNA, 25 bp, Homo sapien
agaacaaagggccggacatgctcca

SEQ ID NO: 43657 - DNA, 25 bp, Homo sapien
ccaggatcgaagagggcgcacgggc

SEQ ID NO: 43658 - DNA, 25 bp, Homo sapien
cctgcgcagagccagctgtgatgta

SEQ ID NO: 43659 - DNA, 25 bp, Homo sapien
aaagggaagggcctgctgtcttcca

SEQ ID NO: 43660 - DNA, 25 bp, Homo sapien
gtgaagccatcttgcatctttagcc

SEQ ID NO: 43661 - DNA, 25 bp, Homo sapien
atctttagccccagtcaagttacct

SEQ ID NO: 43662 - DNA, 25 bp, Homo sapien
cagcaaagactagctgaccctgcca

SEQ ID NO: 43663 - DNA, 25 bp, Homo sapien
caagccctgcccaagttacagaatc

SEQ ID NO: 43664 - DNA, 25 bp, Homo sapien
ggacaggcggaccgctagggagctc

SEQ ID NO: 43665 - DNA, 25 bp, Homo sapien
gttgccctgggctttaattatttca

SEQ ID NO: 43666 - DNA, 25 bp, Homo sapien
cagggttggcaggccggatcttgat

SEQ ID NO: 43667 - DNA, 25 bp, Homo sapien
gggatgctggtgactcacatgacgg

SEQ ID NO: 43668 - DNA, 25 bp, Homo sapien
ggtgttgatgtgtggagtccggtgc

SEQ ID NO: 43669 - DNA, 25 bp, Homo sapien
gtgcctggtttggggagtgttcatg

SEQ ID NO: 43670 - DNA, 25 bp, Homo sapien
gactgacggacctatcaggtactgg

SEQ ID NO: 43671 - DNA, 25 bp, Homo sapien
gaatggtcaagtctgatctcagggc

SEQ ID NO: 43672 - DNA, 25 bp, Homo sapien
agttgacgttggactcattggctga

SEQ ID NO: 43673 - DNA, 25 bp, Homo sapien
attggctgaggttgcttgggaccca

SEQ ID NO: 43674 - DNA, 25 bp, Homo sapien
acccagggagcaacgtgtgccagga

SEQ ID NO: 43675 - DNA, 25 bp, Homo sapien
ggcttgggacgcatcccaggtagac

SEQ ID NO: 43676 - DNA, 25 bp, Homo sapien
ccaaaaccattagggctcagaggaa

SEQ ID NO: 43677 - DNA, 25 bp, Homo sapien
ggctcagaggaaggtatcccaatga

SEQ ID NO: 43678 - DNA, 25 bp, Homo sapien
gaaggtatcccaatgaatatcaatt

SEQ ID NO: 43679 - DNA, 25 bp, Homo sapien
gtcaaaacgacatttaagtcatgtt

SEQ ID NO: 43680 - DNA, 25 bp, Homo sapien
tgggcagttctggaaactagtttta

SEQ ID NO: 43681 - DNA, 25 bp, Homo sapien
gttaaaaattgtccaatctggtgaa

SEQ ID NO: 43682 - DNA, 25 bp, Homo sapien
atctggtgaatgtctaaccctaaag

SEQ ID NO: 43683 - DNA, 25 bp, Homo sapien
ctgcctcctaagtttatgtaccttg

SEQ ID NO: 43684 - DNA, 25 bp, Homo sapien
ttatgtaccttgtttccatccattt

SEQ ID NO: 43685 - DNA, 25 bp, Homo sapien
tttccatccatttaccacatatttc

SEQ ID NO: 43686 - DNA, 25 bp, Homo sapien
ccatccatttaccacatatttccat

SEQ ID NO: 43687 - DNA, 25 bp, Homo sapien
tggagcccagcaatgtgtgtcctga

SEQ ID NO: 43688 - DNA, 25 bp, Homo sapien
aatgtgtgtcctgacaagtccacgc

SEQ ID NO: 43689 - DNA, 25 bp, Homo sapien
gaccccagtgctggctagggttgca

SEQ ID NO: 43690 - DNA, 25 bp, Homo sapien
tagggttgcaaagccactgctctac

SEQ ID NO: 43691 - DNA, 25 bp, Homo sapien
caaagccactgctctacggagcgag

SEQ ID NO: 43692 - DNA, 25 bp, Homo sapien
tctacggagcgagcgagatccatca

SEQ ID NO: 43693 - DNA, 25 bp, Homo sapien
gagatccatcatagtgggacaagcg

SEQ ID NO: 43694 - DNA, 25 bp, Homo sapien
gcgagaggatgaggccatacagacc

SEQ ID NO: 43695 - DNA, 25 bp, Homo sapien
gtctcaggactagcagcgtcgaaaa

SEQ ID NO: 43696 - DNA, 25 bp, Homo sapien
gcgtcgaaaatgctgggaactcgtt

SEQ ID NO: 43697 - DNA, 25 bp, Homo sapien
cctcgccccagaatcagaaactcgg

SEQ ID NO: 43698 - DNA, 25 bp, Homo sapien
gagagcaggtgtgaccacggtgtag

SEQ ID NO: 43699 - DNA, 25 bp, Homo sapien
agaagagcgatacgaacttgccccg

SEQ ID NO: 43700 - DNA, 25 bp, Homo sapien
ggtaggtgtagatggccgagccgta

SEQ ID NO: 43701 - DNA, 25 bp, Homo sapien
caggcagacggctgtcaggtgggac

SEQ ID NO: 43702 - DNA, 25 bp, Homo sapien
tgtcaggtgggacccacacgtgccc

SEQ ID NO: 43703 - DNA, 25 bp, Homo sapien
tgaaccgcatgcaacagacagctcg

SEQ ID NO: 43704 - DNA, 25 bp, Homo sapien
ccacggcaccgtaggaggccaggat

SEQ ID NO: 43705 - DNA, 25 bp, Homo sapien
aaacggcagcagcaggatgaccacg

SEQ ID NO: 43706 - DNA, 25 bp, Homo sapien
atctggttctcggtagtgtctccgt

SEQ ID NO: 43707 - DNA, 25 bp, Homo sapien
acgccggcagctcacagatgaagtg

SEQ ID NO: 43708 - DNA, 25 bp, Homo sapien
ccttcactttcttattcctgagggt

SEQ ID NO: 43709 - DNA, 25 bp, Homo sapien
gagaggtgtagacagggtcaggctg

SEQ ID NO: 43710 - DNA, 25 bp, Homo sapien
ggaagcgatcatatggggagtgtct

SEQ ID NO: 43711 - DNA, 25 bp, Homo sapien
gagtgtctggcaagagtagactggc

SEQ ID NO: 43712 - DNA, 25 bp, Homo sapien
gtctagggagtgcagcggggagagg

SEQ ID NO: 43713 - DNA, 25 bp, Homo sapien
aaggggagccggaaatggaggagag

SEQ ID NO: 43714 - DNA, 25 bp, Homo sapien
gaggaagggacgggatgtaggaggg

SEQ ID NO: 43715 - DNA, 25 bp, Homo sapien
aaatgtgtgggagacgggtagagac

SEQ ID NO: 43716 - DNA, 25 bp, Homo sapien
gacgaaatgcaaggggcgtggtttt

SEQ ID NO: 43717 - DNA, 25 bp, Homo sapien
tccaagacctggagacatcgacccc

SEQ ID NO: 43718 - DNA, 25 bp, Homo sapien
cccccatcgccttctgaagagagag

SEQ ID NO: 43719 - DNA, 25 bp, Homo sapien
gcaggggaggggaattgtttggact

SEQ ID NO: 43720 - DNA, 25 bp, Homo sapien
taacaggggcatcccaagaagaggg

SEQ ID NO: 43721 - DNA, 25 bp, Homo sapien
agagctggcatgaggctctgctgca

SEQ ID NO: 43722 - DNA, 25 bp, Homo sapien
tctgctgcagaggccactgaggcaa

SEQ ID NO: 43723 - DNA, 25 bp, Homo sapien
gcaaagcgcggctggagtgagaccc

SEQ ID NO: 43724 - DNA, 25 bp, Homo sapien
agtgagacccagtgaggcagcacgc

SEQ ID NO: 43725 - DNA, 25 bp, Homo sapien
cctcctgggtcactccaagtgtgag

SEQ ID NO: 43726 - DNA, 25 bp, Homo sapien
gacagaagggggttgctgtgggggc

SEQ ID NO: 43727 - DNA, 25 bp, Homo sapien
agtgtgagggcaggccctggcacac

SEQ ID NO: 43728 - DNA, 25 bp, Homo sapien
gtgggggcaagtcagcagtctagga

SEQ ID NO: 43729 - DNA, 25 bp, Homo sapien
gtcagcagtctaggaggtggcacag

SEQ ID NO: 43730 - DNA, 25 bp, Homo sapien
aataatgaccaaggagccggccctc

SEQ ID NO: 43731 - DNA, 25 bp, Homo sapien
cctttctatacgtgtggtgatgtcc

SEQ ID NO: 43732 - DNA, 25 bp, Homo sapien
tgaattttcgttgtttctaagacaa

SEQ ID NO: 43733 - DNA, 25 bp, Homo sapien
atacaggatctcagaaattactttt

SEQ ID NO: 43734 - DNA, 25 bp, Homo sapien
ttgattgtactttttttcttttgag

SEQ ID NO: 43735 - DNA, 25 bp, Homo sapien
tgatgtccaccatctctacatatca

SEQ ID NO: 43736 - DNA, 25 bp, Homo sapien
gagacagggcctagctttgtcttcc

SEQ ID NO: 43737 - DNA, 25 bp, Homo sapien
cctagctttgtcttccagactggag

SEQ ID NO: 43738 - DNA, 25 bp, Homo sapien
ggagtgtggtggtgtgatcatggct

SEQ ID NO: 43739 - DNA, 25 bp, Homo sapien
cctcctcagtctcctgaatagctgg

SEQ ID NO: 43740 - DNA, 25 bp, Homo sapien
agtattcagaatttccagatgtgct

SEQ ID NO: 43741 - DNA, 25 bp, Homo sapien
agatgtgctgagttttagtaattta

SEQ ID NO: 43742 - DNA, 25 bp, Homo sapien
ggggcagaattgggctaggggtcgc

SEQ ID NO: 43743 - DNA, 25 bp, Homo sapien
agaattgggctaggggtcgcctgga

SEQ ID NO: 43744 - DNA, 25 bp, Homo sapien
ttgggctaggggtcgcctggagccc

SEQ ID NO: 43745 - DNA, 25 bp, Homo sapien
cggctgcagggggtggggccgagag

SEQ ID NO: 43746 - DNA, 25 bp, Homo sapien
ctgggtccactgggctgtctggacc

SEQ ID NO: 43747 - DNA, 25 bp, Homo sapien
tgtctggaccccaagctaggggact

SEQ ID NO: 43748 - DNA, 25 bp, Homo sapien
ctggaccccaagctaggggactggg

SEQ ID NO: 43749 - DNA, 25 bp, Homo sapien
ccaagctaggggactggggaggaga

SEQ ID NO: 43750 - DNA, 25 bp, Homo sapien
aagaaagacaatttctctgcccctt

SEQ ID NO: 43751 - DNA, 25 bp, Homo sapien
tttctctgccccttgggatggaggg

SEQ ID NO: 43752 - DNA, 25 bp, Homo sapien
gggatggaggggcagaattgggcta

SEQ ID NO: 43753 - DNA, 25 bp, Homo sapien
accctcaacaaaccatgatgtaatg

SEQ ID NO: 43754 - DNA, 25 bp, Homo sapien
gatgtaatgaagcacgaatcacacc

SEQ ID NO: 43755 - DNA, 25 bp, Homo sapien
cacgaatcacaccattttgtctctt

SEQ ID NO: 43756 - DNA, 25 bp, Homo sapien
gaatcacaccattttgtctctttcc

SEQ ID NO: 43757 - DNA, 25 bp, Homo sapien
ttcctaattcaaataggtccctggc

SEQ ID NO: 43758 - DNA, 25 bp, Homo sapien
aaataggtccctggcattagttcat

SEQ ID NO: 43759 - DNA, 25 bp, Homo sapien
ggtccctggcattagttcatgccga

SEQ ID NO: 43760 - DNA, 25 bp, Homo sapien
gcattagttcatgccgagactagaa

SEQ ID NO: 43761 - DNA, 25 bp, Homo sapien
gttcatgccgagactagaaaactga

SEQ ID NO: 43762 - DNA, 25 bp, Homo sapien
tagaaaactgaaccctagtactgtt

SEQ ID NO: 43763 - DNA, 25 bp, Homo sapien
gtcttgaaatggaagatattcacct

SEQ ID NO: 43764 - DNA, 25 bp, Homo sapien
gatcgcccggaggctggacaagatg

SEQ ID NO: 43765 - DNA, 25 bp, Homo sapien
ccggaggctggacaagatggtgacc

SEQ ID NO: 43766 - DNA, 25 bp, Homo sapien
agatggtgaccaagaagagcgcgca

SEQ ID NO: 43767 - DNA, 25 bp, Homo sapien
caagaagagcgcgcatttgtcgccg

SEQ ID NO: 43768 - DNA, 25 bp, Homo sapien
catttgtcgccggcaacagtttgga

SEQ ID NO: 43769 - DNA, 25 bp, Homo sapien
gtcgccggcaacagtttggagtctg

SEQ ID NO: 43770 - DNA, 25 bp, Homo sapien
ttggagtctgaggttggatcccctt

SEQ ID NO: 43771 - DNA, 25 bp, Homo sapien
ccttcacaggccagccagatacctg

SEQ ID NO: 43772 - DNA, 25 bp, Homo sapien
acaggccagccagatacctgtcttg

SEQ ID NO: 43773 - DNA, 25 bp, Homo sapien
gctgctcctgaggcgatgatgggca

SEQ ID NO: 43774 - DNA, 25 bp, Homo sapien
aagaggagattgcgcggatcgcccg

SEQ ID NO: 43775 - DNA, 25 bp, Homo sapien
cccccattgtgcagaggtggagact

SEQ ID NO: 43776 - DNA, 25 bp, Homo sapien
cattgtgcagaggtggagactgagg

SEQ ID NO: 43777 - DNA, 25 bp, Homo sapien
ccattcccggagcggtgatgcgtct

SEQ ID NO: 43778 - DNA, 25 bp, Homo sapien
gtgcgcgtggggtttccacgtggaa

SEQ ID NO: 43779 - DNA, 25 bp, Homo sapien
gaaaagaccgaaagcagcgccgtcc

SEQ ID NO: 43780 - DNA, 25 bp, Homo sapien
tccccattctcccgacggagaaact

SEQ ID NO: 43781 - DNA, 25 bp, Homo sapien
ctcccgacggagaaactgagtccca

SEQ ID NO: 43782 - DNA, 25 bp, Homo sapien
ggagaaactgagtcccaacgaggga

SEQ ID NO: 43783 - DNA, 25 bp, Homo sapien
tgagtcccaacgagggacagggacc

SEQ ID NO: 43784 - DNA, 25 bp, Homo sapien
cacacaaatcccagacagaaagcct

SEQ ID NO: 43785 - DNA, 25 bp, Homo sapien
caaatcccagacagaaagcctcacc

SEQ ID NO: 43786 - DNA, 25 bp, Homo sapien
ctgccacttaggatgtgacagcaca

SEQ ID NO: 43787 - DNA, 25 bp, Homo sapien
gaagggggatgatgtctctgtcagt

SEQ ID NO: 43788 - DNA, 25 bp, Homo sapien
gggatgatgtctctgtcagttctgc

SEQ ID NO: 43789 - DNA, 25 bp, Homo sapien
ggatgtgacagcacagccagtggcc

SEQ ID NO: 43790 - DNA, 25 bp, Homo sapien
agaagcagagcccagaagcagggcc

SEQ ID NO: 43791 - DNA, 25 bp, Homo sapien
gagcccagaagcagggcctggtacc

SEQ ID NO: 43792 - DNA, 25 bp, Homo sapien
tacccagcctgcctaacaagggaga

SEQ ID NO: 43793 - DNA, 25 bp, Homo sapien
gggagaatttgtaggctttgtggac

SEQ ID NO: 43794 - DNA, 25 bp, Homo sapien
aaagatctgggactccatgtcaccc

SEQ ID NO: 43795 - DNA, 25 bp, Homo sapien
tacccctgagaagacacccagacac

SEQ ID NO: 43796 - DNA, 25 bp, Homo sapien
acccagacactgggagtgctgccac

SEQ ID NO: 43797 - DNA, 25 bp, Homo sapien
gtatttactgcagcatgtgttttca

SEQ ID NO: 43798 - DNA, 25 bp, Homo sapien
gtgtgatggttcatctaggtaccct

SEQ ID NO: 43799 - DNA, 25 bp, Homo sapien
gtgatggttcatctaggtaccctag

SEQ ID NO: 43800 - DNA, 25 bp, Homo sapien
gttcatctaggtaccctagcctgtc

SEQ ID NO: 43801 - DNA, 25 bp, Homo sapien
atctaggtaccctagcctgtcattg

SEQ ID NO: 43802 - DNA, 25 bp, Homo sapien
cctgtcattgctggagttggaaatc

SEQ ID NO: 43803 - DNA, 25 bp, Homo sapien
ttgctggagttggaaatctctgttg

SEQ ID NO: 43804 - DNA, 25 bp, Homo sapien
cacactaaccacatttccctaagtt

SEQ ID NO: 43805 - DNA, 25 bp, Homo sapien
taaccacatttccctaagttttgat

SEQ ID NO: 43806 - DNA, 25 bp, Homo sapien
catttccctaagttttgatgtgtag

SEQ ID NO: 43807 - DNA, 25 bp, Homo sapien
ctaagttttgatgtgtagtgttttc

SEQ ID NO: 43808 - DNA, 25 bp, Homo sapien
caggggttcaaaaccagcctggcca

SEQ ID NO: 43809 - DNA, 25 bp, Homo sapien
cagctactggggagactggaggcag

SEQ ID NO: 43810 - DNA, 25 bp, Homo sapien
actactttcattaattacccattat

SEQ ID NO: 43811 - DNA, 25 bp, Homo sapien
ttggagttcataaagggcaccctaa

SEQ ID NO: 43812 - DNA, 25 bp, Homo sapien
gaaagttgggtatgatctaaggtta

SEQ ID NO: 43813 - DNA, 25 bp, Homo sapien
atagagattattttccctcacccta

SEQ ID NO: 43814 - DNA, 25 bp, Homo sapien
tttccctcaccctattggtggcaat

SEQ ID NO: 43815 - DNA, 25 bp, Homo sapien
gtaacgtacagaggggtagatccaa

SEQ ID NO: 43816 - DNA, 25 bp, Homo sapien
ggggtagatccaaacacagtatgtc

SEQ ID NO: 43817 - DNA, 25 bp, Homo sapien
cagtatgtctaaattctagcactct

SEQ ID NO: 43818 - DNA, 25 bp, Homo sapien
attctagcactctaatggtgcttag

SEQ ID NO: 43819 - DNA, 25 bp, Homo sapien
accccaaagtctgccagcaacaggc

SEQ ID NO: 43820 - DNA, 25 bp, Homo sapien
tgccagcaacaggccctttgcctgg

SEQ ID NO: 43821 - DNA, 25 bp, Homo sapien
ccagcaacaggccctttgcctgggt

SEQ ID NO: 43822 - DNA, 25 bp, Homo sapien
agcaacaggccctttgcctgggtga

SEQ ID NO: 43823 - DNA, 25 bp, Homo sapien
caggccctttgcctgggtgagacgg

SEQ ID NO: 43824 - DNA, 25 bp, Homo sapien
tgggtgagacgggggtcagggtggc

SEQ ID NO: 43825 - DNA, 25 bp, Homo sapien
ggcccagatgggggtgatggcgacc

SEQ ID NO: 43826 - DNA, 25 bp, Homo sapien
cccagatgggggtgatggcgaccaa

SEQ ID NO: 43827 - DNA, 25 bp, Homo sapien
atgggggtgatggcgaccaaggtgc

SEQ ID NO: 43828 - DNA, 25 bp, Homo sapien
ggcagcctcccctggaggggagtgc

SEQ ID NO: 43829 - DNA, 25 bp, Homo sapien
ctcccctggaggggagtgctcggcc

SEQ ID NO: 43830 - DNA, 25 bp, Homo sapien
gcctaataccgtacctaggaaagtg

SEQ ID NO: 43831 - DNA, 25 bp, Homo sapien
gaatcagtttatgcctatgctagcc

SEQ ID NO: 43832 - DNA, 25 bp, Homo sapien
atgcctatgctagccataaagttct

SEQ ID NO: 43833 - DNA, 25 bp, Homo sapien
attacatgctacagcaggagaggtc

SEQ ID NO: 43834 - DNA, 25 bp, Homo sapien
agaggtcagagcagccggtgaggtt

SEQ ID NO: 43835 - DNA, 25 bp, Homo sapien
gtcagagcagccggtgaggttaggg

SEQ ID NO: 43836 - DNA, 25 bp, Homo sapien
tgaggttagggcttgggcgtgggtc

SEQ ID NO: 43837 - DNA, 25 bp, Homo sapien
catcttctcccacagcttattgagg

SEQ ID NO: 43838 - DNA, 25 bp, Homo sapien
ccacagcttattgaggtctcctttt

SEQ ID NO: 43839 - DNA, 25 bp, Homo sapien
ataaaacataccatagttaacttca

SEQ ID NO: 43840 - DNA, 25 bp, Homo sapien
tagttaacttcatgattagagcaga

SEQ ID NO: 43841 - DNA, 25 bp, Homo sapien
ggagtgagagagacaggggcgtgcg

SEQ ID NO: 43842 - DNA, 25 bp, Homo sapien
agagacaggggcgtgcgtgagttcc

SEQ ID NO: 43843 - DNA, 25 bp, Homo sapien
catccaggccggtcaatgtcattga

SEQ ID NO: 43844 - DNA, 25 bp, Homo sapien
ggccggtcaatgtcattgagtcacc

SEQ ID NO: 43845 - DNA, 25 bp, Homo sapien
ccctggagtcccgagaatccgaagt

SEQ ID NO: 43846 - DNA, 25 bp, Homo sapien
agtcccgagaatccgaagttccaga

SEQ ID NO: 43847 - DNA, 25 bp, Homo sapien
tccgaagttccagacaaatgcccaa

SEQ ID NO: 43848 - DNA, 25 bp, Homo sapien
aaatgcccaaactacattcctgcat

SEQ ID NO: 43849 - DNA, 25 bp, Homo sapien
cattcctgcatgttcgaaagcgtaa

SEQ ID NO: 43850 - DNA, 25 bp, Homo sapien
agttgtagattgtggccgggagcag

SEQ ID NO: 43851 - DNA, 25 bp, Homo sapien
ccggccgctagctgagctggaggcc

SEQ ID NO: 43852 - DNA, 25 bp, Homo sapien
aacacacaattcatggaagagtcat

SEQ ID NO: 43853 - DNA, 25 bp, Homo sapien
aagagtcatgcactgggattagccc

SEQ ID NO: 43854 - DNA, 25 bp, Homo sapien
gcactgggattagcccagctctaca

SEQ ID NO: 43855 - DNA, 25 bp, Homo sapien
agctctacagctgatggtcttaggc

SEQ ID NO: 43856 - DNA, 25 bp, Homo sapien
ggtcttaggcaagtgcatctctctt

SEQ ID NO: 43857 - DNA, 25 bp, Homo sapien
agtgcatctctcttggagtaaatca

SEQ ID NO: 43858 - DNA, 25 bp, Homo sapien
ggagtaaatcattctaacccataaa

SEQ ID NO: 43859 - DNA, 25 bp, Homo sapien
gggtgtaacagtttgtcttgcctgc

SEQ ID NO: 43860 - DNA, 25 bp, Homo sapien
tcttgcctgcttcttttggtaattg

SEQ ID NO: 43861 - DNA, 25 bp, Homo sapien
tgcctgcttcttttggtaattggaa

SEQ ID NO: 43862 - DNA, 25 bp, Homo sapien
aggattgaatgagacaaggtcctgt

SEQ ID NO: 43863 - DNA, 25 bp, Homo sapien
atgctaccctctagactagacacat

SEQ ID NO: 43864 - DNA, 25 bp, Homo sapien
ctaccctctagactagacacatttc

SEQ ID NO: 43865 - DNA, 25 bp, Homo sapien
gacacatttcatggagacaagcaaa

SEQ ID NO: 43866 - DNA, 25 bp, Homo sapien
tgggctgactgtgggatgggatttg

SEQ ID NO: 43867 - DNA, 25 bp, Homo sapien
gggatgggatttggtactgcagaca

SEQ ID NO: 43868 - DNA, 25 bp, Homo sapien
ggatttggtactgcagacagatttt

SEQ ID NO: 43869 - DNA, 25 bp, Homo sapien
attttgatttccacagttgagctgg

SEQ ID NO: 43870 - DNA, 25 bp, Homo sapien
gagctggaaacaaactgtgccttca

SEQ ID NO: 43871 - DNA, 25 bp, Homo sapien
aaacaaactgtgccttcaaaaaatg

SEQ ID NO: 43872 - DNA, 25 bp, Homo sapien
ggttatatgttaagtgtgctactaa

SEQ ID NO: 43873 - DNA, 25 bp, Homo sapien
ggatcgacaaaaaaatgctaccctc

SEQ ID NO: 43874 - DNA, 25 bp, Homo sapien
gaagggttcagggagtctggaggga

SEQ ID NO: 43875 - DNA, 25 bp, Homo sapien
ggaggcaggctagacatcagggaag

SEQ ID NO: 43876 - DNA, 25 bp, Homo sapien
ggcagagggaagtccagagaccaag

SEQ ID NO: 43877 - DNA, 25 bp, Homo sapien
gaccaaggtggaggctggaaaggcc

SEQ ID NO: 43878 - DNA, 25 bp, Homo sapien
ggaaaggccagtgaggatagagggg

SEQ ID NO: 43879 - DNA, 25 bp, Homo sapien
gggggaagccaagagacaaaagtca

SEQ ID NO: 43880 - DNA, 25 bp, Homo sapien
ggctgacagtatggaggctaaaggt

SEQ ID NO: 43881 - DNA, 25 bp, Homo sapien
ggaagcccaggtagaagctggaagg

SEQ ID NO: 43882 - DNA, 25 bp, Homo sapien
gggacgtagagcaaggggcccagga

SEQ ID NO: 43883 - DNA, 25 bp, Homo sapien
gagcaaggggcccaggaagatcaag

SEQ ID NO: 43884 - DNA, 25 bp, Homo sapien
gagggagaaggggtaccatgaagca

SEQ ID NO: 43885 - DNA, 25 bp, Homo sapien
ttttcattggctttaagttgagggt

SEQ ID NO: 43886 - DNA, 25 bp, Homo sapien
ggatagataatggtacttctggctt

SEQ ID NO: 43887 - DNA, 25 bp, Homo sapien
taatggtacttctggctttatttaa

SEQ ID NO: 43888 - DNA, 25 bp, Homo sapien
ttagggaaaccattgtatttataca

SEQ ID NO: 43889 - DNA, 25 bp, Homo sapien
atacgtatatatattgcaccctact

SEQ ID NO: 43890 - DNA, 25 bp, Homo sapien
atatattgcaccctactttaaaatt

SEQ ID NO: 43891 - DNA, 25 bp, Homo sapien
gcaccctactttaaaattgactgat

SEQ ID NO: 43892 - DNA, 25 bp, Homo sapien
attttgtataaaatgcccaactgtg

SEQ ID NO: 43893 - DNA, 25 bp, Homo sapien
gtttttgtttttgtattggagatgg

SEQ ID NO: 43894 - DNA, 25 bp, Homo sapien
ggagatgggttcttactatgttgcc

SEQ ID NO: 43895 - DNA, 25 bp, Homo sapien
tgggttcttactatgttgcccaggc

SEQ ID NO: 43896 - DNA, 25 bp, Homo sapien
gagtgtactaagacttctgaattat

SEQ ID NO: 43897 - DNA, 25 bp, Homo sapien
gacttctgaattataacaatcccac

SEQ ID NO: 43898 - DNA, 25 bp, Homo sapien
gaattataacaatcccactattagg

SEQ ID NO: 43899 - DNA, 25 bp, Homo sapien
atcccactattaggtaatgtgcacc

SEQ ID NO: 43900 - DNA, 25 bp, Homo sapien
gtaatgtgcacctgtccttttagca

SEQ ID NO: 43901 - DNA, 25 bp, Homo sapien
aatgtgcacctgtccttttagcata

SEQ ID NO: 43902 - DNA, 25 bp, Homo sapien
gtgcacctgtccttttagcatatct

SEQ ID NO: 43903 - DNA, 25 bp, Homo sapien
cacctgtccttttagcatatctgtt

SEQ ID NO: 43904 - DNA, 25 bp, Homo sapien
gtccttttagcatatctgttactta

SEQ ID NO: 43905 - DNA, 25 bp, Homo sapien
ctaaggaagtggagattctaatctt

SEQ ID NO: 43906 - DNA, 25 bp, Homo sapien
ttctaatcttaagcatgttcatcta

SEQ ID NO: 43907 - DNA, 25 bp, Homo sapien
atacatgtacaataaactgaaccta

SEQ ID NO: 43908 - DNA, 25 bp, Homo sapien
gacagatgtatataccacagtcaag

SEQ ID NO: 43909 - DNA, 25 bp, Homo sapien
aacattcccatcactccaagagatt

SEQ ID NO: 43910 - DNA, 25 bp, Homo sapien
caagagattctttgtgtccctttgt

SEQ ID NO: 43911 - DNA, 25 bp, Homo sapien
cccctaggtaaccgctgatctgttt

SEQ ID NO: 43912 - DNA, 25 bp, Homo sapien
taggtaaccgctgatctgttttcca

SEQ ID NO: 43913 - DNA, 25 bp, Homo sapien
tccatcacaatagattagtctgcat

SEQ ID NO: 43914 - DNA, 25 bp, Homo sapien
gtttctccatgcttcatgggtgact

SEQ ID NO: 43915 - DNA, 25 bp, Homo sapien
agaccatgctgctgctaagcaaaat

SEQ ID NO: 43916 - DNA, 25 bp, Homo sapien
atgaggattctgctagtgaggatga

SEQ ID NO: 43917 - DNA, 25 bp, Homo sapien
atgtgtaatcagttttcttgaagta

SEQ ID NO: 43918 - DNA, 25 bp, Homo sapien
tctagattgtgaaagctgtcagaga

SEQ ID NO: 43919 - DNA, 25 bp, Homo sapien
agctgtcagagaatggagtcaggga

SEQ ID NO: 43920 - DNA, 25 bp, Homo sapien
gttctcactaataattgcctgatat

SEQ ID NO: 43921 - DNA, 25 bp, Homo sapien
ctgaatacacctatagtttactatg

SEQ ID NO: 43922 - DNA, 25 bp, Homo sapien
agtttactatgacaccatattctac

SEQ ID NO: 43923 - DNA, 25 bp, Homo sapien
tactatgacaccatattctacattg

SEQ ID NO: 43924 - DNA, 25 bp, Homo sapien
ccacgtgcaggtgtaagcttccgcc

SEQ ID NO: 43925 - DNA, 25 bp, Homo sapien
gcacttcttgtctgaatctgccaag

SEQ ID NO: 43926 - DNA, 25 bp, Homo sapien
gaagaaactgcatctttcagctaaa

SEQ ID NO: 43927 - DNA, 25 bp, Homo sapien
aattcttttcactgatcagggtaga

SEQ ID NO: 43928 - DNA, 25 bp, Homo sapien
gatcagggtagagtttagcggtttt

SEQ ID NO: 43929 - DNA, 25 bp, Homo sapien
ttccccattgcagcctggcatgaaa

SEQ ID NO: 43930 - DNA, 25 bp, Homo sapien
ttgcagcctggcatgaaatctttgc

SEQ ID NO: 43931 - DNA, 25 bp, Homo sapien
cttttagtggggatcactcctgccc

SEQ ID NO: 43932 - DNA, 25 bp, Homo sapien
tggtggggactctgcaagttgctaa

SEQ ID NO: 43933 - DNA, 25 bp, Homo sapien
gggactctgcaagttgctaacccag

SEQ ID NO: 43934 - DNA, 25 bp, Homo sapien
actctgcaagttgctaacccagcgt

SEQ ID NO: 43935 - DNA, 25 bp, Homo sapien
tctctttcctccgtactaacagaac

SEQ ID NO: 43936 - DNA, 25 bp, Homo sapien
cctctgcccagttccaatagcgggc

SEQ ID NO: 43937 - DNA, 25 bp, Homo sapien
ccagttccaatagcgggcagacgag

SEQ ID NO: 43938 - DNA, 25 bp, Homo sapien
ggcagacgagagccatgtcctgggc

SEQ ID NO: 43939 - DNA, 25 bp, Homo sapien
agacgagagccatgtcctgggctcc

SEQ ID NO: 43940 - DNA, 25 bp, Homo sapien
tgtatttgaagttgtaatggtgtca

SEQ ID NO: 43941 - DNA, 25 bp, Homo sapien
aagtcacgactgactgacagccgtc

SEQ ID NO: 43942 - DNA, 25 bp, Homo sapien
gtcacgactgactgacagccgtcag

SEQ ID NO: 43943 - DNA, 25 bp, Homo sapien
gactgactgacagccgtcagtccca

SEQ ID NO: 43944 - DNA, 25 bp, Homo sapien
tgactgacagccgtcagtcccagag

SEQ ID NO: 43945 - DNA, 25 bp, Homo sapien
aaggaaataattgcgcattgccagc

SEQ ID NO: 43946 - DNA, 25 bp, Homo sapien
ataattgcgcattgccagcaacttg

SEQ ID NO: 43947 - DNA, 25 bp, Homo sapien
ttgcgcattgccagcaacttggcgc

SEQ ID NO: 43948 - DNA, 25 bp, Homo sapien
gccagcaacttggcgcctgtttaga

SEQ ID NO: 43949 - DNA, 25 bp, Homo sapien
caacttggcgcctgtttagacgttt

SEQ ID NO: 43950 - DNA, 25 bp, Homo sapien
tggcgcctgtttagacgtttttatt

SEQ ID NO: 43951 - DNA, 25 bp, Homo sapien
tacttaacattcatatcataccttc

SEQ ID NO: 43952 - DNA, 25 bp, Homo sapien
acattcatatcataccttcccaaat

SEQ ID NO: 43953 - DNA, 25 bp, Homo sapien
ttcatatcataccttcccaaatata

SEQ ID NO: 43954 - DNA, 25 bp, Homo sapien
aattttatggtagtatcagcttgta

SEQ ID NO: 43955 - DNA, 25 bp, Homo sapien
taggataacctggtttccaagcctt

SEQ ID NO: 43956 - DNA, 25 bp, Homo sapien
gtacatgtggaagactggcatgcca

SEQ ID NO: 43957 - DNA, 25 bp, Homo sapien
ggaagactggcatgccatataccaa

SEQ ID NO: 43958 - DNA, 25 bp, Homo sapien
tgccatataccaaatgccattcagc

SEQ ID NO: 43959 - DNA, 25 bp, Homo sapien
taacagtatacacagattttctctt

SEQ ID NO: 43960 - DNA, 25 bp, Homo sapien
catcataaccaatgaccactcatat

SEQ ID NO: 43961 - DNA, 25 bp, Homo sapien
atgaccactcatataaagtcttatt

SEQ ID NO: 43962 - DNA, 25 bp, Homo sapien
atttattccatgctgttgacaccaa

SEQ ID NO: 43963 - DNA, 25 bp, Homo sapien
ttccatgctgttgacaccaatttaa

SEQ ID NO: 43964 - DNA, 25 bp, Homo sapien
gtaaagattagatttttgactcaat

SEQ ID NO: 43965 - DNA, 25 bp, Homo sapien
ggaacttagagcagaattaccagga

SEQ ID NO: 43966 - DNA, 25 bp, Homo sapien
tcaagctaaggtagggggcccggca

SEQ ID NO: 43967 - DNA, 25 bp, Homo sapien
taaggtagggggcccggcatgttgg

SEQ ID NO: 43968 - DNA, 25 bp, Homo sapien
gcctgaccaacatgaggttgaagcg

SEQ ID NO: 43969 - DNA, 25 bp, Homo sapien
aacatgaggttgaagcgggcagatc

SEQ ID NO: 43970 - DNA, 25 bp, Homo sapien
gagcagaattaccaggatagtggga

SEQ ID NO: 43971 - DNA, 25 bp, Homo sapien
ggaaaatggtgaaggctctagtaat

SEQ ID NO: 43972 - DNA, 25 bp, Homo sapien
gaaggctctagtaatatttattcca

SEQ ID NO: 43973 - DNA, 25 bp, Homo sapien
gagggtcctaatctgagaactccaa

SEQ ID NO: 43974 - DNA, 25 bp, Homo sapien
gacatctccagattaagacctccgc

SEQ ID NO: 43975 - DNA, 25 bp, Homo sapien
ggagctcctaagagaatttcccagt

SEQ ID NO: 43976 - DNA, 25 bp, Homo sapien
atttcccagtaaaatcgcctcaact

SEQ ID NO: 43977 - DNA, 25 bp, Homo sapien
gcggtaaataggctgttccccgcgc

SEQ ID NO: 43978 - DNA, 25 bp, Homo sapien
ccccgcgccagcatttgagaagagc

SEQ ID NO: 43979 - DNA, 25 bp, Homo sapien
ggaggaaggatgtgtcgccggatga

SEQ ID NO: 43980 - DNA, 25 bp, Homo sapien
gacagaagtgatgcggctgcaagcc

SEQ ID NO: 43981 - DNA, 25 bp, Homo sapien
gccaccaccggaagctaggggagac

SEQ ID NO: 43982 - DNA, 25 bp, Homo sapien
ctaggggagacgccagcacagattc

SEQ ID NO: 43983 - DNA, 25 bp, Homo sapien
gcacagattctccctgagagtatcc

SEQ ID NO: 43984 - DNA, 25 bp, Homo sapien
aagaaattacttggccaggcatagt

SEQ ID NO: 43985 - DNA, 25 bp, Homo sapien
ttccaagtagctgggaccacaccca

SEQ ID NO: 43986 - DNA, 25 bp, Homo sapien
ccaggcatagtggggcctttgtaga

SEQ ID NO: 43987 - DNA, 25 bp, Homo sapien
agctgggaccacacccagtcatttt

SEQ ID NO: 43988 - DNA, 25 bp, Homo sapien
ttaccattttggaactgttgtcaac

SEQ ID NO: 43989 - DNA, 25 bp, Homo sapien
atcagaatgcttcctagtatattat

SEQ ID NO: 43990 - DNA, 25 bp, Homo sapien
tataatggaacaagcaaccctgcaa

SEQ ID NO: 43991 - DNA, 25 bp, Homo sapien
tataccatctgggaatttctgataa

SEQ ID NO: 43992 - DNA, 25 bp, Homo sapien
attgaaatctgttcacacagtctaa

SEQ ID NO: 43993 - DNA, 25 bp, Homo sapien
ttcttttgatgtatcgtagttttga

SEQ ID NO: 43994 - DNA, 25 bp, Homo sapien
ttgtagagagagggtttcgccatgt

SEQ ID NO: 43995 - DNA, 25 bp, Homo sapien
cttcgttgtgttgaatatatcaaat

SEQ ID NO: 43996 - DNA, 25 bp, Homo sapien
gaacgaactatgaaccagagcttta

SEQ ID NO: 43997 - DNA, 25 bp, Homo sapien
gaactatgaaccagagctttaaaat

SEQ ID NO: 43998 - DNA, 25 bp, Homo sapien
gaaccagagctttaaaatagtgatt

SEQ ID NO: 43999 - DNA, 25 bp, Homo sapien
aatagtgatttgtaagactttgtta

SEQ ID NO: 44000 - DNA, 25 bp, Homo sapien
taagactttgttacaatggtactta

SEQ ID NO: 44001 - DNA, 25 bp, Homo sapien
tggtacttaaaaaattgctttgtat

SEQ ID NO: 44002 - DNA, 25 bp, Homo sapien
gctttgtataatttacacactgtaa

SEQ ID NO: 44003 - DNA, 25 bp, Homo sapien
ttacacactgtaaaattcacccatt

SEQ ID NO: 44004 - DNA, 25 bp, Homo sapien
aaaattcacccattgtacatgtaca

SEQ ID NO: 44005 - DNA, 25 bp, Homo sapien
aaattcacccattgtacatgtacaa

SEQ ID NO: 44006 - DNA, 25 bp, Homo sapien
tctcgcaccagcagtgctgggccag

SEQ ID NO: 44007 - DNA, 25 bp, Homo sapien
tgagagtcgccctggactacgaggc

SEQ ID NO: 44008 - DNA, 25 bp, Homo sapien
ttcactgcctctttctccggcaaag

SEQ ID NO: 44009 - DNA, 25 bp, Homo sapien
actgcctctttctccggcaaagtct

SEQ ID NO: 44010 - DNA, 25 bp, Homo sapien
tccggcaaagtcttccctttctttg

SEQ ID NO: 44011 - DNA, 25 bp, Homo sapien
tcttccctttctttgccgtctggaa

SEQ ID NO: 44012 - DNA, 25 bp, Homo sapien
aaggttcctgccttacgctgaaagg

SEQ ID NO: 44013 - DNA, 25 bp, Homo sapien
aggttcctgccttacgctgaaaggc

SEQ ID NO: 44014 - DNA, 25 bp, Homo sapien
cctgccttacgctgaaaggctgaag

SEQ ID NO: 44015 - DNA, 25 bp, Homo sapien
ccttacgctgaaaggctgaagtggg

SEQ ID NO: 44016 - DNA, 25 bp, Homo sapien
aacaggggacttgagtctcgaacag

SEQ ID NO: 44017 - DNA, 25 bp, Homo sapien
cttgagtctcgaacagcggttgttt

SEQ ID NO: 44018 - DNA, 25 bp, Homo sapien
ttgagtctcgaacagcggttgtttt

SEQ ID NO: 44019 - DNA, 25 bp, Homo sapien
tgtgcctagggcaacagccaaccta

SEQ ID NO: 44020 - DNA, 25 bp, Homo sapien
caacagccaacctaggagccagcgg

SEQ ID NO: 44021 - DNA, 25 bp, Homo sapien
aacctaggagccagcgggctttcgg

SEQ ID NO: 44022 - DNA, 25 bp, Homo sapien
gaatgattcattattccaccccgag

SEQ ID NO: 44023 - DNA, 25 bp, Homo sapien
tgattcattattccaccccgaggtt

SEQ ID NO: 44024 - DNA, 25 bp, Homo sapien
ttcattattccaccccgaggtttgc

SEQ ID NO: 44025 - DNA, 25 bp, Homo sapien
gaagaatcgatgctgctttgggaac

SEQ ID NO: 44026 - DNA, 25 bp, Homo sapien
aatcgatgctgctttgggaactgaa

SEQ ID NO: 44027 - DNA, 25 bp, Homo sapien
gctgctttgggaactgaaggttttt

SEQ ID NO: 44028 - DNA, 25 bp, Homo sapien
agttatgagtagctgctaccctgga

SEQ ID NO: 44029 - DNA, 25 bp, Homo sapien
tgagtagctgctaccctggaacggt

SEQ ID NO: 44030 - DNA, 25 bp, Homo sapien
ctgctaccctggaacggtgggcaga

SEQ ID NO: 44031 - DNA, 25 bp, Homo sapien
gggcagagagcctactaggaaatgt

SEQ ID NO: 44032 - DNA, 25 bp, Homo sapien
gagcctactaggaaatgtgcagaat

SEQ ID NO: 44033 - DNA, 25 bp, Homo sapien
gaggatcttgcatttttttagggaa

SEQ ID NO: 44034 - DNA, 25 bp, Homo sapien
tgtgtttttgccttggtccccatta

SEQ ID NO: 44035 - DNA, 25 bp, Homo sapien
ctcctgacaatcctacgttggtggc

SEQ ID NO: 44036 - DNA, 25 bp, Homo sapien
tcctgacaatcctacgttggtggca

SEQ ID NO: 44037 - DNA, 25 bp, Homo sapien
cctgacaatcctacgttggtggcag

SEQ ID NO: 44038 - DNA, 25 bp, Homo sapien
ctgacaatcctacgttggtggcagc

SEQ ID NO: 44039 - DNA, 25 bp, Homo sapien
tgacaatcctacgttggtggcagca

SEQ ID NO: 44040 - DNA, 25 bp, Homo sapien
gacaatcctacgttggtggcagcag

SEQ ID NO: 44041 - DNA, 25 bp, Homo sapien
acaatcctacgttggtggcagcagc

SEQ ID NO: 44042 - DNA, 25 bp, Homo sapien
aatcctacgttggtggcagcagcag

SEQ ID NO: 44043 - DNA, 25 bp, Homo sapien
gcagcagcagcaggcaaatcaaaaa

SEQ ID NO: 44044 - DNA, 25 bp, Homo sapien
gaagaaggggccatcacaggatgcc

SEQ ID NO: 44045 - DNA, 25 bp, Homo sapien
agaaggggccatcacaggatgccac

SEQ ID NO: 44046 - DNA, 25 bp, Homo sapien
gaaggggccatcacaggatgccacc

SEQ ID NO: 44047 - DNA, 25 bp, Homo sapien
aaggggccatcacaggatgccaccc

SEQ ID NO: 44048 - DNA, 25 bp, Homo sapien
tagaggctccccagggctcccttat

SEQ ID NO: 44049 - DNA, 25 bp, Homo sapien
cacagccgcctttgggttccatctt

SEQ ID NO: 44050 - DNA, 25 bp, Homo sapien
gccgcctttgggttccatcttgcta

SEQ ID NO: 44051 - DNA, 25 bp, Homo sapien
ccgcctttgggttccatcttgctaa

SEQ ID NO: 44052 - DNA, 25 bp, Homo sapien
cgcctttgggttccatcttgctaat

SEQ ID NO: 44053 - DNA, 25 bp, Homo sapien
tttgggttccatcttgctaataaac

SEQ ID NO: 44054 - DNA, 25 bp, Homo sapien
ttgggttccatcttgctaataaaca

SEQ ID NO: 44055 - DNA, 25 bp, Homo sapien
ggttccatcttgctaataaacactg

SEQ ID NO: 44056 - DNA, 25 bp, Homo sapien
gttccatcttgctaataaacactgg

SEQ ID NO: 44057 - DNA, 25 bp, Homo sapien
atcttgctaataaacactggctctg

SEQ ID NO: 44058 - DNA, 25 bp, Homo sapien
gctaataaacactggctctgggact

SEQ ID NO: 44059 - DNA, 25 bp, Homo sapien
taaacactggctctgggactagaaa

SEQ ID NO: 44060 - DNA, 25 bp, Homo sapien
cttttgctgaggttttctctgaggt

SEQ ID NO: 44061 - DNA, 25 bp, Homo sapien
ccctgactccagcagggcaaggaat

SEQ ID NO: 44062 - DNA, 25 bp, Homo sapien
tccagcagggcaaggaatgtagccg

SEQ ID NO: 44063 - DNA, 25 bp, Homo sapien
tcctgattcccttggcaccttgtct

SEQ ID NO: 44064 - DNA, 25 bp, Homo sapien
gcaccttgtctttctgtctgtttac

SEQ ID NO: 44065 - DNA, 25 bp, Homo sapien
ttctgtctgtttacctgtctccctg

SEQ ID NO: 44066 - DNA, 25 bp, Homo sapien
tctgtctgtttacctgtctccctgc

SEQ ID NO: 44067 - DNA, 25 bp, Homo sapien
tgcctgcccatctgcatcttttgca

SEQ ID NO: 44068 - DNA, 25 bp, Homo sapien
gcctgcccatctgcatcttttgcag

SEQ ID NO: 44069 - DNA, 25 bp, Homo sapien
tctgcatcttttgcagcccactctg

SEQ ID NO: 44070 - DNA, 25 bp, Homo sapien
ctgcatcttttgcagcccactctga

SEQ ID NO: 44071 - DNA, 25 bp, Homo sapien
agcccactctgacttccatctgggg

SEQ ID NO: 44072 - DNA, 25 bp, Homo sapien
gcccactctgacttccatctggggg

SEQ ID NO: 44073 - DNA, 25 bp, Homo sapien
ccactctgacttccatctgggggct

SEQ ID NO: 44074 - DNA, 25 bp, Homo sapien
ttctgccttaagaatgtccttttag

SEQ ID NO: 44075 - DNA, 25 bp, Homo sapien
tctgccttaagaatgtccttttagg

SEQ ID NO: 44076 - DNA, 25 bp, Homo sapien
gatgggaagccttcctggtgccgtc

SEQ ID NO: 44077 - DNA, 25 bp, Homo sapien
aagccttcctggtgccgtctctatt

SEQ ID NO: 44078 - DNA, 25 bp, Homo sapien
ttcctggtgccgtctctattactcc

SEQ ID NO: 44079 - DNA, 25 bp, Homo sapien
gtgccgtctctattactccaggaat

SEQ ID NO: 44080 - DNA, 25 bp, Homo sapien
aaagccttggatcactcactcatgg

SEQ ID NO: 44081 - DNA, 25 bp, Homo sapien
aggcttaccatgcagggctgaaggc

SEQ ID NO: 44082 - DNA, 25 bp, Homo sapien
accatgcagggctgaaggcctctga

SEQ ID NO: 44083 - DNA, 25 bp, Homo sapien
atgcagggctgaaggcctctgaaag

SEQ ID NO: 44084 - DNA, 25 bp, Homo sapien
gggctgaaggcctctgaaagaacgc

SEQ ID NO: 44085 - DNA, 25 bp, Homo sapien
gcctctgaaagaacgctggtgcaga

SEQ ID NO: 44086 - DNA, 25 bp, Homo sapien
ctgaaagaacgctggtgcagaacga

SEQ ID NO: 44087 - DNA, 25 bp, Homo sapien
gaaagaacgctggtgcagaacgact

SEQ ID NO: 44088 - DNA, 25 bp, Homo sapien
agaacgctggtgcagaacgactgga

SEQ ID NO: 44089 - DNA, 25 bp, Homo sapien
aacgctggtgcagaacgactggatg

SEQ ID NO: 44090 - DNA, 25 bp, Homo sapien
ggagaaggtccctgtaattgttgca

SEQ ID NO: 44091 - DNA, 25 bp, Homo sapien
ctgtaattgttgcaaccattagttt

SEQ ID NO: 44092 - DNA, 25 bp, Homo sapien
cctgatgatcggtcactgtgttcca

SEQ ID NO: 44093 - DNA, 25 bp, Homo sapien
gatgatcggtcactgtgttccatca

SEQ ID NO: 44094 - DNA, 25 bp, Homo sapien
ccactgattctaccttataatgaat

SEQ ID NO: 44095 - DNA, 25 bp, Homo sapien
gtttaccaggatgcatagcatgggt

SEQ ID NO: 44096 - DNA, 25 bp, Homo sapien
agcatgggtttatgaattccctatc

SEQ ID NO: 44097 - DNA, 25 bp, Homo sapien
tgggtttatgaattccctatctttg

SEQ ID NO: 44098 - DNA, 25 bp, Homo sapien
tctttgcagcacatcctttatttct

SEQ ID NO: 44099 - DNA, 25 bp, Homo sapien
ttatttctggcttgcatgggacttg

SEQ ID NO: 44100 - DNA, 25 bp, Homo sapien
cttgcatgggacttgaaagcctaaa

SEQ ID NO: 44101 - DNA, 25 bp, Homo sapien
agatgtatagatctgcaatccagaa

SEQ ID NO: 44102 - DNA, 25 bp, Homo sapien
gatctgcaatccagaaactatgaat

SEQ ID NO: 44103 - DNA, 25 bp, Homo sapien
tgtaaaaatcactggcattcgtggg

SEQ ID NO: 44104 - DNA, 25 bp, Homo sapien
aaatcactggcattcgtggggccac

SEQ ID NO: 44105 - DNA, 25 bp, Homo sapien
tcactggcattcgtggggccactcc

SEQ ID NO: 44106 - DNA, 25 bp, Homo sapien
ccaagctccacgtgtgtccgtctgt

SEQ ID NO: 44107 - DNA, 25 bp, Homo sapien
gctccacgtgtgtccgtctgtgctc

SEQ ID NO: 44108 - DNA, 25 bp, Homo sapien
cacgtgtgtccgtctgtgctcctgg

SEQ ID NO: 44109 - DNA, 25 bp, Homo sapien
ccgtctgtgctcctggcctctgggg

SEQ ID NO: 44110 - DNA, 25 bp, Homo sapien
tgctcctggcctctgggggaccagc

SEQ ID NO: 44111 - DNA, 25 bp, Homo sapien
gctcctggcctctgggggaccagct

SEQ ID NO: 44112 - DNA, 25 bp, Homo sapien
ggaccagctgggacatgaacttgtc

SEQ ID NO: 44113 - DNA, 25 bp, Homo sapien
cagctgggacatgaacttgtctgcc

SEQ ID NO: 44114 - DNA, 25 bp, Homo sapien
ggacatgaacttgtctgccaggccc

SEQ ID NO: 44115 - DNA, 25 bp, Homo sapien
gacatgaacttgtctgccaggcccc

SEQ ID NO: 44116 - DNA, 25 bp, Homo sapien
ccccgtcgcgtgctgaacggtgtta

SEQ ID NO: 44117 - DNA, 25 bp, Homo sapien
gtcgcgtgctgaacggtgttagttt

SEQ ID NO: 44118 - DNA, 25 bp, Homo sapien
gtgctcgctggctgtcgtgactgtc

SEQ ID NO: 44119 - DNA, 25 bp, Homo sapien
gagtgtcgccttgtgggttcctgtt

SEQ ID NO: 44120 - DNA, 25 bp, Homo sapien
gtgggttcctgttgctgagacttcc

SEQ ID NO: 44121 - DNA, 25 bp, Homo sapien
tgagacttcctggatggagccgccc

SEQ ID NO: 44122 - DNA, 25 bp, Homo sapien
ggccctgcgcggagctgtgtccaat

SEQ ID NO: 44123 - DNA, 25 bp, Homo sapien
tgctcggcctctacggtctcatcgt

SEQ ID NO: 44124 - DNA, 25 bp, Homo sapien
gcccaccagccacagaatattatgt

SEQ ID NO: 44125 - DNA, 25 bp, Homo sapien
tcctcattccagaacgaacagcctg

SEQ ID NO: 44126 - DNA, 25 bp, Homo sapien
ttccagaacgaacagcctgacacat

SEQ ID NO: 44127 - DNA, 25 bp, Homo sapien
ccccagtagttggtcttgtacatgc

SEQ ID NO: 44128 - DNA, 25 bp, Homo sapien
agttggtcttgtacatgcgcagtgt

SEQ ID NO: 44129 - DNA, 25 bp, Homo sapien
tagtgcccatcgtctgtttccccgg

SEQ ID NO: 44130 - DNA, 25 bp, Homo sapien
cgtgccgtggacatctgggcccact

SEQ ID NO: 44131 - DNA, 25 bp, Homo sapien
tgccgtggacatctgggcccactca

SEQ ID NO: 44132 - DNA, 25 bp, Homo sapien
gccgtggacatctgggcccactcat

SEQ ID NO: 44133 - DNA, 25 bp, Homo sapien
accccctagagtgctctgtgtatgc

SEQ ID NO: 44134 - DNA, 25 bp, Homo sapien
gaattgtcatttctctttactggat

SEQ ID NO: 44135 - DNA, 25 bp, Homo sapien
gggggtggtaagtctatggattttg

SEQ ID NO: 44136 - DNA, 25 bp, Homo sapien
aactggctgggggtggtagcccaca

SEQ ID NO: 44137 - DNA, 25 bp, Homo sapien
gattttgatttcctttttgctgttt

SEQ ID NO: 44138 - DNA, 25 bp, Homo sapien
tcctttttgctgttttctatttttg

SEQ ID NO: 44139 - DNA, 25 bp, Homo sapien
aacatgtttatgtaacttcattttt

SEQ ID NO: 44140 - DNA, 25 bp, Homo sapien
acaagttagttcatatacaagttag

SEQ ID NO: 44141 - DNA, 25 bp, Homo sapien
taaaataccccataagacacatcaa

SEQ ID NO: 44142 - DNA, 25 bp, Homo sapien
aatggtaccagaaccctacagagaa

SEQ ID NO: 44143 - DNA, 25 bp, Homo sapien
gaatgtaaggtaccaaaggatgtta

SEQ ID NO: 44144 - DNA, 25 bp, Homo sapien
gctggggcaggtggattgtttgagg

SEQ ID NO: 44145 - DNA, 25 bp, Homo sapien
gaggccaggaggtagaagttgcagt

SEQ ID NO: 44146 - DNA, 25 bp, Homo sapien
aagtgcaagccaggtgaccccagca

SEQ ID NO: 44147 - DNA, 25 bp, Homo sapien
acgactggatcatccacctggctgg

SEQ ID NO: 44148 - DNA, 25 bp, Homo sapien
gcaggtcatgaacacccacttcaac

SEQ ID NO: 44149 - DNA, 25 bp, Homo sapien
tccgaggagagcactacaggtacaa

SEQ ID NO: 44150 - DNA, 25 bp, Homo sapien
gagagcactacaggtacaagttcag

SEQ ID NO: 44151 - DNA, 25 bp, Homo sapien
agagcactacaggtacaagttcagc

SEQ ID NO: 44152 - DNA, 25 bp, Homo sapien
agcactacaggtacaagttcagccg

SEQ ID NO: 44153 - DNA, 25 bp, Homo sapien
actacaggtacaagttcagccgtcc

SEQ ID NO: 44154 - DNA, 25 bp, Homo sapien
acaggtacaagttcagccgtcctgg

SEQ ID NO: 44155 - DNA, 25 bp, Homo sapien
gctgaggccctacttcagggaccgt

SEQ ID NO: 44156 - DNA, 25 bp, Homo sapien
gcccctctagacgtgcaccagaaat

SEQ ID NO: 44157 - DNA, 25 bp, Homo sapien
cctctagacgtgcaccagaaataaa

SEQ ID NO: 44158 - DNA, 25 bp, Homo sapien
tagacgtgcaccagaaataaaggcg

SEQ ID NO: 44159 - DNA, 25 bp, Homo sapien
agacgtgcaccagaaataaaggcga

SEQ ID NO: 44160 - DNA, 25 bp, Homo sapien
gacgtgcaccagaaataaaggcgaa

SEQ ID NO: 44161 - DNA, 25 bp, Homo sapien
acgtgcaccagaaataaaggcgaag

SEQ ID NO: 44162 - DNA, 25 bp, Homo sapien
tttcccactaaacagatcaaccctc

SEQ ID NO: 44163 - DNA, 25 bp, Homo sapien
tcaaccctctccataactatttgat

SEQ ID NO: 44164 - DNA, 25 bp, Homo sapien
aaccctctccataactatttgattt

SEQ ID NO: 44165 - DNA, 25 bp, Homo sapien
agtgtcagtgcagtttgtgtaaaca

SEQ ID NO: 44166 - DNA, 25 bp, Homo sapien
gtttgtgtaaacatctctatggggt

SEQ ID NO: 44167 - DNA, 25 bp, Homo sapien
aacatctctatggggtgatgcatgc

SEQ ID NO: 44168 - DNA, 25 bp, Homo sapien
gtgggtgaacactccacatcaggtc

SEQ ID NO: 44169 - DNA, 25 bp, Homo sapien
cacatcaggtcattgtccatcatta

SEQ ID NO: 44170 - DNA, 25 bp, Homo sapien
atcaggtcattgtccatcattacat

SEQ ID NO: 44171 - DNA, 25 bp, Homo sapien
gtcattgtccatcattacatatctg

SEQ ID NO: 44172 - DNA, 25 bp, Homo sapien
tcattacatatctgtggtgtctggc

SEQ ID NO: 44173 - DNA, 25 bp, Homo sapien
gaaataaagataacttttccctgct

SEQ ID NO: 44174 - DNA, 25 bp, Homo sapien
cagacatcactgcctgcagggcatg

SEQ ID NO: 44175 - DNA, 25 bp, Homo sapien
gacaacataaacaagacccagggac

SEQ ID NO: 44176 - DNA, 25 bp, Homo sapien
gcagggcatgcacagtgcagcccat

SEQ ID NO: 44177 - DNA, 25 bp, Homo sapien
tgcagcccattgcacacaaactaca

SEQ ID NO: 44178 - DNA, 25 bp, Homo sapien
ggtgatgacaatttgtgtttgggac

SEQ ID NO: 44179 - DNA, 25 bp, Homo sapien
gtgtttgggacgtctgattgtgaaa

SEQ ID NO: 44180 - DNA, 25 bp, Homo sapien
actggaacgtgatggaacggggctg

SEQ ID NO: 44181 - DNA, 25 bp, Homo sapien
aacggggctggaacgtgatggagct

SEQ ID NO: 44182 - DNA, 25 bp, Homo sapien
gtgaaatgtgcagatccatgtggaa

SEQ ID NO: 44183 - DNA, 25 bp, Homo sapien
tgtgccccagagtcagggtcctggg

SEQ ID NO: 44184 - DNA, 25 bp, Homo sapien
agcagggataccaaggcaggcctgt

SEQ ID NO: 44185 - DNA, 25 bp, Homo sapien
cctccttggactgcaaacaatctag

SEQ ID NO: 44186 - DNA, 25 bp, Homo sapien
gactgcaaacaatctaggacacctc

SEQ ID NO: 44187 - DNA, 25 bp, Homo sapien
cctcccagccttccttggtttggat

SEQ ID NO: 44188 - DNA, 25 bp, Homo sapien
cccagccttccttggtttggatgtt

SEQ ID NO: 44189 - DNA, 25 bp, Homo sapien
agccttccttggtttggatgttttg

SEQ ID NO: 44190 - DNA, 25 bp, Homo sapien
ttaagtcaagtcacgaagatagagc

SEQ ID NO: 44191 - DNA, 25 bp, Homo sapien
gtcaagtcacgaagatagagctttg

SEQ ID NO: 44192 - DNA, 25 bp, Homo sapien
atagagggagtttgtcctgtggccc

SEQ ID NO: 44193 - DNA, 25 bp, Homo sapien
gagtttgtcctgtggcccttctatt

SEQ ID NO: 44194 - DNA, 25 bp, Homo sapien
gtcctgtggcccttctattttctgc

SEQ ID NO: 44195 - DNA, 25 bp, Homo sapien
tcctgtggcccttctattttctgct

SEQ ID NO: 44196 - DNA, 25 bp, Homo sapien
ttctattttctgctctgtgaggaca

SEQ ID NO: 44197 - DNA, 25 bp, Homo sapien
tattttctgctctgtgaggacacaa

SEQ ID NO: 44198 - DNA, 25 bp, Homo sapien
attttctgctctgtgaggacacaat

SEQ ID NO: 44199 - DNA, 25 bp, Homo sapien
ttttctgctctgtgaggacacaatg

SEQ ID NO: 44200 - DNA, 25 bp, Homo sapien
tccactagcatctacctggaggcca

SEQ ID NO: 44201 - DNA, 25 bp, Homo sapien
ccactagcatctacctggaggccaa

SEQ ID NO: 44202 - DNA, 25 bp, Homo sapien
agcatctacctggaggccaagggga

SEQ ID NO: 44203 - DNA, 25 bp, Homo sapien
tggggctgacagctgcctacaccac

SEQ ID NO: 44204 - DNA, 25 bp, Homo sapien
cccagctctggctggtgcttctgta

SEQ ID NO: 44205 - DNA, 25 bp, Homo sapien
ttctgtatgggcacaagcgtctcag

SEQ ID NO: 44206 - DNA, 25 bp, Homo sapien
ctgtatgggcacaagcgtctcagct

SEQ ID NO: 44207 - DNA, 25 bp, Homo sapien
agacggtgttcctggccctctgtct

SEQ ID NO: 44208 - DNA, 25 bp, Homo sapien
tgttcctggccctctgtctgctctg

SEQ ID NO: 44209 - DNA, 25 bp, Homo sapien
ttcctggccctctgtctgctctggg

SEQ ID NO: 44210 - DNA, 25 bp, Homo sapien
tgcccttctggcttctctactgctg

SEQ ID NO: 44211 - DNA, 25 bp, Homo sapien
ttgacgcttatgaacctctactttg

SEQ ID NO: 44212 - DNA, 25 bp, Homo sapien
gcttatgaacctctactttgcccag

SEQ ID NO: 44213 - DNA, 25 bp, Homo sapien
tttgcccaggtggtgttcaaggcca

SEQ ID NO: 44214 - DNA, 25 bp, Homo sapien
tgttcaaggccaaggtgaagcgtcg

SEQ ID NO: 44215 - DNA, 25 bp, Homo sapien
gcttgctcgctgtccgaggggcctt

SEQ ID NO: 44216 - DNA, 25 bp, Homo sapien
atggatacagttctttttgcttttt

SEQ ID NO: 44217 - DNA, 25 bp, Homo sapien
atttataacttgcaggcacgtgcct

SEQ ID NO: 44218 - DNA, 25 bp, Homo sapien
ttgcaggcacgtgcctgtaatccca

SEQ ID NO: 44219 - DNA, 25 bp, Homo sapien
aaatctctatgacaagaaactccta

SEQ ID NO: 44220 - DNA, 25 bp, Homo sapien
gcagaaggattgcatgagcccagga

SEQ ID NO: 44221 - DNA, 25 bp, Homo sapien
gagcccaggagtttgggaccaacct

SEQ ID NO: 44222 - DNA, 25 bp, Homo sapien
ttgggaccaacctgggcaacatagt

SEQ ID NO: 44223 - DNA, 25 bp, Homo sapien
gatattagcacttcaatttaattac

SEQ ID NO: 44224 - DNA, 25 bp, Homo sapien
gtaagtaaactgaccactgtgattc

SEQ ID NO: 44225 - DNA, 25 bp, Homo sapien
aactgaccactgtgattcttactta

SEQ ID NO: 44226 - DNA, 25 bp, Homo sapien
gtgattcttacttaaatggatacag

SEQ ID NO: 44227 - DNA, 25 bp, Homo sapien
ggaggcgcagaagattgatcgcatg

SEQ ID NO: 44228 - DNA, 25 bp, Homo sapien
acacgtgctacgtgctgtcattcgc

SEQ ID NO: 44229 - DNA, 25 bp, Homo sapien
ctccacaaccacaacgtgcgtgaca

SEQ ID NO: 44230 - DNA, 25 bp, Homo sapien
caaccacaacgtgcgtgacaagccc

SEQ ID NO: 44231 - DNA, 25 bp, Homo sapien
acaacgtgcgtgacaagcccacggc

SEQ ID NO: 44232 - DNA, 25 bp, Homo sapien
gacaagcccacggcagaacggttca

SEQ ID NO: 44233 - DNA, 25 bp, Homo sapien
ccacggcagaacggttcatcgccat

SEQ ID NO: 44234 - DNA, 25 bp, Homo sapien
cggcagaacggttcatcgccatgaa

SEQ ID NO: 44235 - DNA, 25 bp, Homo sapien
cggttcatcgccatgaaccgcggca

SEQ ID NO: 44236 - DNA, 25 bp, Homo sapien
gatcgcatgatggaggctttcgctt

SEQ ID NO: 44237 - DNA, 25 bp, Homo sapien
cgcatgatggaggctttcgcttctc

SEQ ID NO: 44238 - DNA, 25 bp, Homo sapien
gtcccgggagatgtccgaggacctc

SEQ ID NO: 44239 - DNA, 25 bp, Homo sapien
gagggctggtggacgggatgtcccc

SEQ ID NO: 44240 - DNA, 25 bp, Homo sapien
tcttgaaccagttgctgacctgcgt

SEQ ID NO: 44241 - DNA, 25 bp, Homo sapien
tgctgacctgcgtgagcgacaggcc

SEQ ID NO: 44242 - DNA, 25 bp, Homo sapien
caggccggtgagtgtggccaggcgg

SEQ ID NO: 44243 - DNA, 25 bp, Homo sapien
cttgagcgctgcgcgggagcgctcc

SEQ ID NO: 44244 - DNA, 25 bp, Homo sapien
ggaaggagctcggaatggagccgct

SEQ ID NO: 44245 - DNA, 25 bp, Homo sapien
tgaagcagtagactgtctcctcgcc

SEQ ID NO: 44246 - DNA, 25 bp, Homo sapien
gccgtcccagatggtcttgggcagc

SEQ ID NO: 44247 - DNA, 25 bp, Homo sapien
cagcgggaacttcttgcgcagtcga

SEQ ID NO: 44248 - DNA, 25 bp, Homo sapien
aggagacgcgtgcggggagagggcc

SEQ ID NO: 44249 - DNA, 25 bp, Homo sapien
tcaactgtcaaaaacttcaaccctt

SEQ ID NO: 44250 - DNA, 25 bp, Homo sapien
gaagctaagcagtgggtacctggga

SEQ ID NO: 44251 - DNA, 25 bp, Homo sapien
aagatctattttgccttaccagaaa

SEQ ID NO: 44252 - DNA, 25 bp, Homo sapien
tctattttgccttaccagaaaagaa

SEQ ID NO: 44253 - DNA, 25 bp, Homo sapien
ttttccctaggaagtcaaaaatgct

SEQ ID NO: 44254 - DNA, 25 bp, Homo sapien
tctttctatggtagtggggtttact

SEQ ID NO: 44255 - DNA, 25 bp, Homo sapien
ggtagtggggtttacttctgaggat

SEQ ID NO: 44256 - DNA, 25 bp, Homo sapien
tggggtttacttctgaggataaaat

SEQ ID NO: 44257 - DNA, 25 bp, Homo sapien
aaaagctctgtcccttgacatggta

SEQ ID NO: 44258 - DNA, 25 bp, Homo sapien
agctctgtcccttgacatggtagtt

SEQ ID NO: 44259 - DNA, 25 bp, Homo sapien
tgtcccttgacatggtagttctccc

SEQ ID NO: 44260 - DNA, 25 bp, Homo sapien
gctactcgggaggcttagacatgag

SEQ ID NO: 44261 - DNA, 25 bp, Homo sapien
ggaggcttagacatgagaatcactt

SEQ ID NO: 44262 - DNA, 25 bp, Homo sapien
ggttgcagtgagtcaagatggcacc

SEQ ID NO: 44263 - DNA, 25 bp, Homo sapien
gagtcaagatggcaccactgcactc

SEQ ID NO: 44264 - DNA, 25 bp, Homo sapien
tgacagagcaagacttcctctcaaa

SEQ ID NO: 44265 - DNA, 25 bp, Homo sapien
gagcaagacttcctctcaaaaaata

SEQ ID NO: 44266 - DNA, 25 bp, Homo sapien
tagtgactgtaataattggaatgtt

SEQ ID NO: 44267 - DNA, 25 bp, Homo sapien
ggaatgtttgaaatttgtcacagca

SEQ ID NO: 44268 - DNA, 25 bp, Homo sapien
tgaaatttgtcacagcaataattga

SEQ ID NO: 44269 - DNA, 25 bp, Homo sapien
attattcagttttcagtttgttgta

SEQ ID NO: 44270 - DNA, 25 bp, Homo sapien
ggattgactatcctaggaaaaagat

SEQ ID NO: 44271 - DNA, 25 bp, Homo sapien
gcttaatccgtacctcacatgtgta

SEQ ID NO: 44272 - DNA, 25 bp, Homo sapien
ccgtacctcacatgtgtattttcag

SEQ ID NO: 44273 - DNA, 25 bp, Homo sapien
ctcacatgtgtattttcaggtggga

SEQ ID NO: 44274 - DNA, 25 bp, Homo sapien
ttttcaggtgggaaagcagtgccac

SEQ ID NO: 44275 - DNA, 25 bp, Homo sapien
tttcaggtgggaaagcagtgccact

SEQ ID NO: 44276 - DNA, 25 bp, Homo sapien
gaaagcagtgccactctccgcttca

SEQ ID NO: 44277 - DNA, 25 bp, Homo sapien
cgaggactgctctcagtctctgagt

SEQ ID NO: 44278 - DNA, 25 bp, Homo sapien
gctctcagtctctgagtctcagcac

SEQ ID NO: 44279 - DNA, 25 bp, Homo sapien
caatgcaggaggacatggagtcttc

SEQ ID NO: 44280 - DNA, 25 bp, Homo sapien
ggggcagataccttctgaacgggaa

SEQ ID NO: 44281 - DNA, 25 bp, Homo sapien
ttctgaacgggaagagacagccagc

SEQ ID NO: 44282 - DNA, 25 bp, Homo sapien
gaagagacagccagcacagtgttta

SEQ ID NO: 44283 - DNA, 25 bp, Homo sapien
tgtttatgccactggttttaaagtc

SEQ ID NO: 44284 - DNA, 25 bp, Homo sapien
tgccactggttttaaagtcatttta

SEQ ID NO: 44285 - DNA, 25 bp, Homo sapien
ggcttaaaaccctctctcagactgt

SEQ ID NO: 44286 - DNA, 25 bp, Homo sapien
cttagaatcctgagatagcatagag

SEQ ID NO: 44287 - DNA, 25 bp, Homo sapien
aagaagcagccatatggtatctgtt

SEQ ID NO: 44288 - DNA, 25 bp, Homo sapien
ggtatctgtttagaactggaagtgc

SEQ ID NO: 44289 - DNA, 25 bp, Homo sapien
ctggaagtgcagaatctgttttcaa

SEQ ID NO: 44290 - DNA, 25 bp, Homo sapien
aacttttacagctagtacattaaat

SEQ ID NO: 44291 - DNA, 25 bp, Homo sapien
gaggagtcgtcagccagaaggaggt

SEQ ID NO: 44292 - DNA, 25 bp, Homo sapien
agattcttttattgtgaactttcta

SEQ ID NO: 44293 - DNA, 25 bp, Homo sapien
gaaagaattgtaaggccggtgcggt

SEQ ID NO: 44294 - DNA, 25 bp, Homo sapien
cagaaggaggtagaattcacttttt

SEQ ID NO: 44295 - DNA, 25 bp, Homo sapien
ttcacttttttacaagcttctaaag

SEQ ID NO: 44296 - DNA, 25 bp, Homo sapien
acaagcttctaaagtctcttcatag

SEQ ID NO: 44297 - DNA, 25 bp, Homo sapien
gtctcttcatagatgattgctggaa

SEQ ID NO: 44298 - DNA, 25 bp, Homo sapien
acggacctgcgagtcacacaactgg

SEQ ID NO: 44299 - DNA, 25 bp, Homo sapien
ctgcgagtcacacaactggtgaccc

SEQ ID NO: 44300 - DNA, 25 bp, Homo sapien
cccctcatcaaagtcctcggtgttt

SEQ ID NO: 44301 - DNA, 25 bp, Homo sapien
agctgggactcctcggtccttgcct

SEQ ID NO: 44302 - DNA, 25 bp, Homo sapien
tcggtccttgcctcctagtttctca

SEQ ID NO: 44303 - DNA, 25 bp, Homo sapien
ggtccttgcctcctagtttctcagg

SEQ ID NO: 44304 - DNA, 25 bp, Homo sapien
cttgcctcctagtttctcaggcctg

SEQ ID NO: 44305 - DNA, 25 bp, Homo sapien
gtttctcaggcctggccctctcaag

SEQ ID NO: 44306 - DNA, 25 bp, Homo sapien
tggagaaccgtccaccctggaaaga

SEQ ID NO: 44307 - DNA, 25 bp, Homo sapien
accgtccaccctggaaagaagagct

SEQ ID NO: 44308 - DNA, 25 bp, Homo sapien
tcagattcctcttggctctcggagc

SEQ ID NO: 44309 - DNA, 25 bp, Homo sapien
ttcctcttggctctcggagccgcag

SEQ ID NO: 44310 - DNA, 25 bp, Homo sapien
agccgcagggagtgtgtcttcccgc

SEQ ID NO: 44311 - DNA, 25 bp, Homo sapien
ggccaaggagctattttggggtctc

SEQ ID NO: 44312 - DNA, 25 bp, Homo sapien
ccaaggagctattttggggtctcgt

SEQ ID NO: 44313 - DNA, 25 bp, Homo sapien
gctattttggggtctcgtttgccca

SEQ ID NO: 44314 - DNA, 25 bp, Homo sapien
gaacttattttttgttaactgtgat

SEQ ID NO: 44315 - DNA, 25 bp, Homo sapien
ggaggttaaatcacttacacaggct

SEQ ID NO: 44316 - DNA, 25 bp, Homo sapien
ttaaatcacttacacaggctgggca

SEQ ID NO: 44317 - DNA, 25 bp, Homo sapien
tacacaggctgggcacggtgactca

SEQ ID NO: 44318 - DNA, 25 bp, Homo sapien
ccagcactctgggaagccaaggcag

SEQ ID NO: 44319 - DNA, 25 bp, Homo sapien
accagcctgcctctacaaaaaaata

SEQ ID NO: 44320 - DNA, 25 bp, Homo sapien
aaatcactgcccaaagttccaaagc

SEQ ID NO: 44321 - DNA, 25 bp, Homo sapien
ctgcccaaagttccaaagctagtca

SEQ ID NO: 44322 - DNA, 25 bp, Homo sapien
caaagctagtcaacaaagaaaccgg

SEQ ID NO: 44323 - DNA, 25 bp, Homo sapien
aaccggttacaaatttgctcttcat

SEQ ID NO: 44324 - DNA, 25 bp, Homo sapien
aatttgctcttcatttagtgtaaaa

SEQ ID NO: 44325 - DNA, 25 bp, Homo sapien
gccagaagtcataaaggaaaaggtt

SEQ ID NO: 44326 - DNA, 25 bp, Homo sapien
ttttatgttatgtgtatttcatcac

SEQ ID NO: 44327 - DNA, 25 bp, Homo sapien
gaatcggggaaaatatttgctacat

SEQ ID NO: 44328 - DNA, 25 bp, Homo sapien
ggggaaaatatttgctacataacta

SEQ ID NO: 44329 - DNA, 25 bp, Homo sapien
tacataactaagaatgaaggccctt

SEQ ID NO: 44330 - DNA, 25 bp, Homo sapien
tgaaggcccttaataaaatctgtaa

SEQ ID NO: 44331 - DNA, 25 bp, Homo sapien
aaatctgtaaaactatacacacttt

SEQ ID NO: 44332 - DNA, 25 bp, Homo sapien
aaaactatacacacttttaggaatg

SEQ ID NO: 44333 - DNA, 25 bp, Homo sapien
tacacacttttaggaatgaatcaac

SEQ ID NO: 44334 - DNA, 25 bp, Homo sapien
gaatgaatcaacaaataatttctat

SEQ ID NO: 44335 - DNA, 25 bp, Homo sapien
agggatataagcaatgtgtttcaca

SEQ ID NO: 44336 - DNA, 25 bp, Homo sapien
gcaatccatactcattcagtaacac

SEQ ID NO: 44337 - DNA, 25 bp, Homo sapien
tccatactcattcagtaacacaggc

SEQ ID NO: 44338 - DNA, 25 bp, Homo sapien
atactcattcagtaacacaggctca

SEQ ID NO: 44339 - DNA, 25 bp, Homo sapien
actcattcagtaacacaggctcatt

SEQ ID NO: 44340 - DNA, 25 bp, Homo sapien
taacacaggctcatttatttaacca

SEQ ID NO: 44341 - DNA, 25 bp, Homo sapien
ggctcatttatttaaccagctaatc

SEQ ID NO: 44342 - DNA, 25 bp, Homo sapien
tttaaccagctaatcatttatccaa

SEQ ID NO: 44343 - DNA, 25 bp, Homo sapien
gaatctaaagcaaaaactggacagg

SEQ ID NO: 44344 - DNA, 25 bp, Homo sapien
aaactggacaggaagaatctaaagc

SEQ ID NO: 44345 - DNA, 25 bp, Homo sapien
gcaaacattgaaagtaaacgaccca

SEQ ID NO: 44346 - DNA, 25 bp, Homo sapien
gtaaacgacccaaagcaaagagtgt

SEQ ID NO: 44347 - DNA, 25 bp, Homo sapien
ccttccttaggctcctgaactcgtt

SEQ ID NO: 44348 - DNA, 25 bp, Homo sapien
gaactcgtttgctcctaaatcttgt

SEQ ID NO: 44349 - DNA, 25 bp, Homo sapien
ttccccatgtctttctggctgtctc

SEQ ID NO: 44350 - DNA, 25 bp, Homo sapien
gtctttctggctgtctctatgttcc

SEQ ID NO: 44351 - DNA, 25 bp, Homo sapien
ctggctgtctctatgttcctcttct

SEQ ID NO: 44352 - DNA, 25 bp, Homo sapien
atcctcaactttctgtccattcggg

SEQ ID NO: 44353 - DNA, 25 bp, Homo sapien
aactttctgtccattcgggcctcct

SEQ ID NO: 44354 - DNA, 25 bp, Homo sapien
ttggtctccttttcgatatgccaaa

SEQ ID NO: 44355 - DNA, 25 bp, Homo sapien
tggtctccttttcgatatgccaaac

SEQ ID NO: 44356 - DNA, 25 bp, Homo sapien
tcgatatgccaaaccaattttgggt

SEQ ID NO: 44357 - DNA, 25 bp, Homo sapien
atatgccaaaccaattttgggtcga

SEQ ID NO: 44358 - DNA, 25 bp, Homo sapien
accaattttgggtcgagtgcattta

SEQ ID NO: 44359 - DNA, 25 bp, Homo sapien
ggtcgagtgcatttaacgagaacaa

SEQ ID NO: 44360 - DNA, 25 bp, Homo sapien
aaaggctcataacaacaagaacgtt

SEQ ID NO: 44361 - DNA, 25 bp, Homo sapien
aaggctcataacaacaagaacgttt

SEQ ID NO: 44362 - DNA, 25 bp, Homo sapien
accccagctgggacggtacagagaa

SEQ ID NO: 44363 - DNA, 25 bp, Homo sapien
tgctggggcgctacgtggtggagcg

SEQ ID NO: 44364 - DNA, 25 bp, Homo sapien
tggggcgctacgtggtggagcgact

SEQ ID NO: 44365 - DNA, 25 bp, Homo sapien
ctcagcctgatgggcgttctggtgc

SEQ ID NO: 44366 - DNA, 25 bp, Homo sapien
cctgatgggcgttctggtgcagtgg

SEQ ID NO: 44367 - DNA, 25 bp, Homo sapien
ggcgttctggtgcagtggagggtga

SEQ ID NO: 44368 - DNA, 25 bp, Homo sapien
gagggtgacagctgagggggactcc

SEQ ID NO: 44369 - DNA, 25 bp, Homo sapien
gggactcccacacggaagtggtcat

SEQ ID NO: 44370 - DNA, 25 bp, Homo sapien
ctcccacacggaagtggtcatcagc

SEQ ID NO: 44371 - DNA, 25 bp, Homo sapien
ccgacgcgtgcaactgatgcggatt

SEQ ID NO: 44372 - DNA, 25 bp, Homo sapien
cgtgcaactgatgcggattcggcag

SEQ ID NO: 44373 - DNA, 25 bp, Homo sapien
cgcttcaatggagacgtcctctccc

SEQ ID NO: 44374 - DNA, 25 bp, Homo sapien
ttatcaaagccaattcaaccacccg

SEQ ID NO: 44375 - DNA, 25 bp, Homo sapien
ataggaatctgcccatggtatttgt

SEQ ID NO: 44376 - DNA, 25 bp, Homo sapien
tgcccatggtatttgtttacttgga

SEQ ID NO: 44377 - DNA, 25 bp, Homo sapien
atcaaggctcagttgatcggtcctc

SEQ ID NO: 44378 - DNA, 25 bp, Homo sapien
actgtctgaatctagagcagttaag

SEQ ID NO: 44379 - DNA, 25 bp, Homo sapien
gagcagttaagacggacttggagga

SEQ ID NO: 44380 - DNA, 25 bp, Homo sapien
ttgctgtcttcagtgcagagctctg

SEQ ID NO: 44381 - DNA, 25 bp, Homo sapien
tgtcttcagtgcagagctctgtccc

SEQ ID NO: 44382 - DNA, 25 bp, Homo sapien
cgattccaagggtgactgaggctgc

SEQ ID NO: 44383 - DNA, 25 bp, Homo sapien
ccaagggtgactgaggctgcagctg

SEQ ID NO: 44384 - DNA, 25 bp, Homo sapien
taaaaccagctattggtatggcaaa

SEQ ID NO: 44385 - DNA, 25 bp, Homo sapien
agaccgccttgtaccggaaaatgct

SEQ ID NO: 44386 - DNA, 25 bp, Homo sapien
gcaagggtgcctggtccatcccatg

SEQ ID NO: 44387 - DNA, 25 bp, Homo sapien
gtgcctggtccatcccatggaagtg

SEQ ID NO: 44388 - DNA, 25 bp, Homo sapien
ccatcccatggaagtggctgtttgg

SEQ ID NO: 44389 - DNA, 25 bp, Homo sapien
tgtttggggcgactgctgttgcctt

SEQ ID NO: 44390 - DNA, 25 bp, Homo sapien
actgaggccctctaggaggaaagcc

SEQ ID NO: 44391 - DNA, 25 bp, Homo sapien
ctgaggccctctaggaggaaagccc

SEQ ID NO: 44392 - DNA, 25 bp, Homo sapien
gaggccctctaggaggaaagcccag

SEQ ID NO: 44393 - DNA, 25 bp, Homo sapien
aggccctctaggaggaaagcccaga

SEQ ID NO: 44394 - DNA, 25 bp, Homo sapien
ggccctctaggaggaaagcccagag

SEQ ID NO: 44395 - DNA, 25 bp, Homo sapien
gccctctaggaggaaagcccagagg

SEQ ID NO: 44396 - DNA, 25 bp, Homo sapien
cctctaggaggaaagcccagaggga

SEQ ID NO: 44397 - DNA, 25 bp, Homo sapien
taggtctccgccagggctggcctca

SEQ ID NO: 44398 - DNA, 25 bp, Homo sapien
agggctggcctcagtttctcctcaa

SEQ ID NO: 44399 - DNA, 25 bp, Homo sapien
ggctggcctcagtttctcctcaaca

SEQ ID NO: 44400 - DNA, 25 bp, Homo sapien
agtttctcctcaacaggcctggggg

SEQ ID NO: 44401 - DNA, 25 bp, Homo sapien
ccagtgtggggttccccattcatcc

SEQ ID NO: 44402 - DNA, 25 bp, Homo sapien
ccattcatccgccttttggagtagg

SEQ ID NO: 44403 - DNA, 25 bp, Homo sapien
cattcatccgccttttggagtaggg

SEQ ID NO: 44404 - DNA, 25 bp, Homo sapien
ggcaggggaatgggagaagtttgaa

SEQ ID NO: 44405 - DNA, 25 bp, Homo sapien
gggagagagtaaaaggaagccctgg

SEQ ID NO: 44406 - DNA, 25 bp, Homo sapien
ccctgacagctttgacagtccatca

SEQ ID NO: 44407 - DNA, 25 bp, Homo sapien
gacagctttgacagtccatcagggg

SEQ ID NO: 44408 - DNA, 25 bp, Homo sapien
cagctttgacagtccatcaggggaa

SEQ ID NO: 44409 - DNA, 25 bp, Homo sapien
gctttgacagtccatcaggggaata

SEQ ID NO: 44410 - DNA, 25 bp, Homo sapien
gacagtccatcaggggaataggttg

SEQ ID NO: 44411 - DNA, 25 bp, Homo sapien
tcaggggaataggttgtagcaaata

SEQ ID NO: 44412 - DNA, 25 bp, Homo sapien
accggatctgctctgaccgcacttg

SEQ ID NO: 44413 - DNA, 25 bp, Homo sapien
gctctgaccgcacttgaaggctggg

SEQ ID NO: 44414 - DNA, 25 bp, Homo sapien
tgtgccggccattcgttttctctct

SEQ ID NO: 44415 - DNA, 25 bp, Homo sapien
tgccggccattcgttttctctctct

SEQ ID NO: 44416 - DNA, 25 bp, Homo sapien
caccctcgaggcagggaaaagccat

SEQ ID NO: 44417 - DNA, 25 bp, Homo sapien
ccagttgaaagacacccagtgcaca

SEQ ID NO: 44418 - DNA, 25 bp, Homo sapien
acatctgggccgtggactatctgat

SEQ ID NO: 44419 - DNA, 25 bp, Homo sapien
cgtggactatctgatcttggtcctg

SEQ ID NO: 44420 - DNA, 25 bp, Homo sapien
ctatctgatcttggtcctggccgag

SEQ ID NO: 44421 - DNA, 25 bp, Homo sapien
cagcccggagtaaggttcagaaagt

SEQ ID NO: 44422 - DNA, 25 bp, Homo sapien
cgagaaacccagttctcctgggcca

SEQ ID NO: 44423 - DNA, 25 bp, Homo sapien
tcctgggccaaggatcccttctggc

SEQ ID NO: 44424 - DNA, 25 bp, Homo sapien
ttctggcaaagctgctgctccgccg

SEQ ID NO: 44425 - DNA, 25 bp, Homo sapien
gcaaagctgctgctccgccgcttgg

SEQ ID NO: 44426 - DNA, 25 bp, Homo sapien
caaagctgctgctccgccgcttggt

SEQ ID NO: 44427 - DNA, 25 bp, Homo sapien
gtaagggctcccaggtcttcatctg

SEQ ID NO: 44428 - DNA, 25 bp, Homo sapien
cacttggccaagcagggaggaagaa

SEQ ID NO: 44429 - DNA, 25 bp, Homo sapien
ttaggcagggctctctttccttctt

SEQ ID NO: 44430 - DNA, 25 bp, Homo sapien
ggggaccctaagactcctcggcctg

SEQ ID NO: 44431 - DNA, 25 bp, Homo sapien
gggaccctaagactcctcggcctgg

SEQ ID NO: 44432 - DNA, 25 bp, Homo sapien
gttggccacgtcttccttctgcctg

SEQ ID NO: 44433 - DNA, 25 bp, Homo sapien
tggccacgtcttccttctgcctgag

SEQ ID NO: 44434 - DNA, 25 bp, Homo sapien
cacaggccctttcctcaggcaaggt

SEQ ID NO: 44435 - DNA, 25 bp, Homo sapien
ctttcctcaggcaaggtctggcctc

SEQ ID NO: 44436 - DNA, 25 bp, Homo sapien
ctcaggcaaggtctggcctcaggtg

SEQ ID NO: 44437 - DNA, 25 bp, Homo sapien
agcccttggccagaagtcaagccca

SEQ ID NO: 44438 - DNA, 25 bp, Homo sapien
ttggccagaagtcaagcccagccac

SEQ ID NO: 44439 - DNA, 25 bp, Homo sapien
caagcccagccacgtggagcctaga

SEQ ID NO: 44440 - DNA, 25 bp, Homo sapien
ccagccacgtggagcctagagtgag

SEQ ID NO: 44441 - DNA, 25 bp, Homo sapien
tctcaacatcacttgaatcctaggg

SEQ ID NO: 44442 - DNA, 25 bp, Homo sapien
aatcctagggcctgggttttcatgt

SEQ ID NO: 44443 - DNA, 25 bp, Homo sapien
tgaaacagaaccataaagcatatgt

SEQ ID NO: 44444 - DNA, 25 bp, Homo sapien
catatgccctctatagctgtcattc

SEQ ID NO: 44445 - DNA, 25 bp, Homo sapien
aataaaatccctctgagtcccagtt

SEQ ID NO: 44446 - DNA, 25 bp, Homo sapien
aatgcaaggcatgttcacggcaggt

SEQ ID NO: 44447 - DNA, 25 bp, Homo sapien
gcatgttcacggcaggtggtagtgg

SEQ ID NO: 44448 - DNA, 25 bp, Homo sapien
tggtagtgggagaccttgggggcca

SEQ ID NO: 44449 - DNA, 25 bp, Homo sapien
tgggggccatcttagaattccatct

SEQ ID NO: 44450 - DNA, 25 bp, Homo sapien
tatagctgtcattcctttaagtgca

SEQ ID NO: 44451 - DNA, 25 bp, Homo sapien
gaattccatctaccacaggcagtag

SEQ ID NO: 44452 - DNA, 25 bp, Homo sapien
aaacacctatacacattttacatct

SEQ ID NO: 44453 - DNA, 25 bp, Homo sapien
atatagccacgtttattttactatt

SEQ ID NO: 44454 - DNA, 25 bp, Homo sapien
agtgcagcaagaagcctcgtcaggc

SEQ ID NO: 44455 - DNA, 25 bp, Homo sapien
cctcatctggtggacggctgcctgc

SEQ ID NO: 44456 - DNA, 25 bp, Homo sapien
ctcatctggtggacggctgcctgcc

SEQ ID NO: 44457 - DNA, 25 bp, Homo sapien
tacttccaccagcacttggcaggct

SEQ ID NO: 44458 - DNA, 25 bp, Homo sapien
ccagcacttggcaggctcctagctg

SEQ ID NO: 44459 - DNA, 25 bp, Homo sapien
cttggcaggctcctagctgcctgca

SEQ ID NO: 44460 - DNA, 25 bp, Homo sapien
tcctggggccctgaggtctgttcct

SEQ ID NO: 44461 - DNA, 25 bp, Homo sapien
ccctgaggtctgttcctggggcagc

SEQ ID NO: 44462 - DNA, 25 bp, Homo sapien
cccgtgtccccagctgcaaggtggg

SEQ ID NO: 44463 - DNA, 25 bp, Homo sapien
tggacgccgagtttctgcctcagaa

SEQ ID NO: 44464 - DNA, 25 bp, Homo sapien
gtttctgcctcagaactgtctctcc

SEQ ID NO: 44465 - DNA, 25 bp, Homo sapien
cattgtctccgaagcgtatgtgcca

SEQ ID NO: 44466 - DNA, 25 bp, Homo sapien
ctccgaagcgtatgtgccaggtttg

SEQ ID NO: 44467 - DNA, 25 bp, Homo sapien
ccgaagcgtatgtgccaggtttgag

SEQ ID NO: 44468 - DNA, 25 bp, Homo sapien
cgagggtgatgctggctgctcttct

SEQ ID NO: 44469 - DNA, 25 bp, Homo sapien
tgatgctggctgctcttctgaacaa

SEQ ID NO: 44470 - DNA, 25 bp, Homo sapien
tggctgctcttctgaacaaataaag

SEQ ID NO: 44471 - DNA, 25 bp, Homo sapien
gcagaggaggaaaggcttcgcctag

SEQ ID NO: 44472 - DNA, 25 bp, Homo sapien
ggaggaaaggcttcgcctagaagag

SEQ ID NO: 44473 - DNA, 25 bp, Homo sapien
cggccgcctactactactatacggc

SEQ ID NO: 44474 - DNA, 25 bp, Homo sapien
gcctagaagaggaagcccgaaagca

SEQ ID NO: 44475 - DNA, 25 bp, Homo sapien
gaggaagcccgaaagcaggaagaag

SEQ ID NO: 44476 - DNA, 25 bp, Homo sapien
cctactactactatacggctgcgag

SEQ ID NO: 44477 - DNA, 25 bp, Homo sapien
actactatacggctgcgagaagacg

SEQ ID NO: 44478 - DNA, 25 bp, Homo sapien
atacggctgcgagaagacgacagaa

SEQ ID NO: 44479 - DNA, 25 bp, Homo sapien
gacagaaggggcaagaacgactgga

SEQ ID NO: 44480 - DNA, 25 bp, Homo sapien
ggggcaagaacgactggagaaggaa

SEQ ID NO: 44481 - DNA, 25 bp, Homo sapien
ggaagaacaagataggctggagaga

SEQ ID NO: 44482 - DNA, 25 bp, Homo sapien
atatctttagtctctcataagccaa

SEQ ID NO: 44483 - DNA, 25 bp, Homo sapien
tttatatctccacatagcccattat

SEQ ID NO: 44484 - DNA, 25 bp, Homo sapien
tagcccattattaccattgaaaagg

SEQ ID NO: 44485 - DNA, 25 bp, Homo sapien
aaaggcatgcaattcttctatttga

SEQ ID NO: 44486 - DNA, 25 bp, Homo sapien
tctatttgaagcttgttcccttttt

SEQ ID NO: 44487 - DNA, 25 bp, Homo sapien
aagagcaggtcaggtgtcactaata

SEQ ID NO: 44488 - DNA, 25 bp, Homo sapien
taataacagtttacctcagcttcat

SEQ ID NO: 44489 - DNA, 25 bp, Homo sapien
gttttacttctaatcccagagtctc

SEQ ID NO: 44490 - DNA, 25 bp, Homo sapien
gctactcggtcgggggttgaggtga

SEQ ID NO: 44491 - DNA, 25 bp, Homo sapien
atgatcctattattgggttggtgtg

SEQ ID NO: 44492 - DNA, 25 bp, Homo sapien
attattgggttggtgtgtgatcgaa

SEQ ID NO: 44493 - DNA, 25 bp, Homo sapien
aactgcttgcaggggacatgagaaa

SEQ ID NO: 44494 - DNA, 25 bp, Homo sapien
aaggttgtggtagaaggatgtgttt

SEQ ID NO: 44495 - DNA, 25 bp, Homo sapien
attctgaatttctgaattcttggct

SEQ ID NO: 44496 - DNA, 25 bp, Homo sapien
ttcttggctattgcattcttgacaa

SEQ ID NO: 44497 - DNA, 25 bp, Homo sapien
gctattgcattcttgacaatttttc

SEQ ID NO: 44498 - DNA, 25 bp, Homo sapien
ttttagagaacacaccaccttatcc

SEQ ID NO: 44499 - DNA, 25 bp, Homo sapien
caccttatcccacccatgatatatg

SEQ ID NO: 44500 - DNA, 25 bp, Homo sapien
gcagcagggcatagggggcttacgc

SEQ ID NO: 44501 - DNA, 25 bp, Homo sapien
cagggcatagggggcttacgcctgt

SEQ ID NO: 44502 - DNA, 25 bp, Homo sapien
gaggtggggaggatcaccttaggtc

SEQ ID NO: 44503 - DNA, 25 bp, Homo sapien
aaaatttagccagccatgggggcac

SEQ ID NO: 44504 - DNA, 25 bp, Homo sapien
gtagtcctagctactggagaggctg

SEQ ID NO: 44505 - DNA, 25 bp, Homo sapien
gcgggagattagcttgagccccaga

SEQ ID NO: 44506 - DNA, 25 bp, Homo sapien
attagcttgagccccagagtttgag

SEQ ID NO: 44507 - DNA, 25 bp, Homo sapien
gccccagagtttgaggctgcagtga

SEQ ID NO: 44508 - DNA, 25 bp, Homo sapien
gctgcagtgagctatcatcacacca

SEQ ID NO: 44509 - DNA, 25 bp, Homo sapien
agtgagctatcatcacaccactgca

SEQ ID NO: 44510 - DNA, 25 bp, Homo sapien
gaaaagttgtcagatctggtgccca

SEQ ID NO: 44511 - DNA, 25 bp, Homo sapien
gagtttgtagttattattgctgctt

SEQ ID NO: 44512 - DNA, 25 bp, Homo sapien
attattgctgcttggtgttaggtga

SEQ ID NO: 44513 - DNA, 25 bp, Homo sapien
gctgcttggtgttaggtgaagatga

SEQ ID NO: 44514 - DNA, 25 bp, Homo sapien
atcatagctgagtgtagtgctgtgc

SEQ ID NO: 44515 - DNA, 25 bp, Homo sapien
ccagccttattttcttgactcatag

SEQ ID NO: 44516 - DNA, 25 bp, Homo sapien
agccttattttcttgactcatagga

SEQ ID NO: 44517 - DNA, 25 bp, Homo sapien
tattttcttgactcataggaataaa

SEQ ID NO: 44518 - DNA, 25 bp, Homo sapien
ccctcgataaatacttactgaatta

SEQ ID NO: 44519 - DNA, 25 bp, Homo sapien
agaaacttgatgtcttatttgttaa

SEQ ID NO: 44520 - DNA, 25 bp, Homo sapien
gatgtcttatttgttaaagggccaa

SEQ ID NO: 44521 - DNA, 25 bp, Homo sapien
ccttcccctcacataaatttggtca

SEQ ID NO: 44522 - DNA, 25 bp, Homo sapien
tcccctcacataaatttggtcaaca

SEQ ID NO: 44523 - DNA, 25 bp, Homo sapien
taaatttggtcaacatacttcttag

SEQ ID NO: 44524 - DNA, 25 bp, Homo sapien
gatggggtttcactatgttgaccag

SEQ ID NO: 44525 - DNA, 25 bp, Homo sapien
actatgttgaccaggctagtcttga

SEQ ID NO: 44526 - DNA, 25 bp, Homo sapien
gatgacctgtgctagaagatggggg

SEQ ID NO: 44527 - DNA, 25 bp, Homo sapien
gaagatgggggctagggtgttgggg

SEQ ID NO: 44528 - DNA, 25 bp, Homo sapien
ggggaagacttcagggacttgggag

SEQ ID NO: 44529 - DNA, 25 bp, Homo sapien
cctcggtgtcctcatctgtgagaac

SEQ ID NO: 44530 - DNA, 25 bp, Homo sapien
gtcctcatctgtgagaaccgaccta

SEQ ID NO: 44531 - DNA, 25 bp, Homo sapien
gaaccgacctaagaagtgtctgtct

SEQ ID NO: 44532 - DNA, 25 bp, Homo sapien
aaagctgttgtgatgagttagtgaa

SEQ ID NO: 44533 - DNA, 25 bp, Homo sapien
gaattcgtacacatagaacctttag

SEQ ID NO: 44534 - DNA, 25 bp, Homo sapien
gaacctttagaactgtctttgacat

SEQ ID NO: 44535 - DNA, 25 bp, Homo sapien
gtagtaagtcagctgtgtagatggt

SEQ ID NO: 44536 - DNA, 25 bp, Homo sapien
gtgtagatggtgggtttctccagtg

SEQ ID NO: 44537 - DNA, 25 bp, Homo sapien
gtggactgtagttctggacaaggtg

SEQ ID NO: 44538 - DNA, 25 bp, Homo sapien
gaagtattggggcaagtgctctgac

SEQ ID NO: 44539 - DNA, 25 bp, Homo sapien
gtgctctgacaggctaggatggtgc

SEQ ID NO: 44540 - DNA, 25 bp, Homo sapien
gttaacagttcagactcaaaccttg

SEQ ID NO: 44541 - DNA, 25 bp, Homo sapien
aaaggaaatccctcacagcaactgg

SEQ ID NO: 44542 - DNA, 25 bp, Homo sapien
aaatggagttacctgctttcagccc

SEQ ID NO: 44543 - DNA, 25 bp, Homo sapien
caggtcgtagctattgtctgccctg

SEQ ID NO: 44544 - DNA, 25 bp, Homo sapien
gtctgccctgctgatatgtgataat

SEQ ID NO: 44545 - DNA, 25 bp, Homo sapien
aaaatggggtcactcatctccagta

SEQ ID NO: 44546 - DNA, 25 bp, Homo sapien
acgtgataacaactactgctgcctg

SEQ ID NO: 44547 - DNA, 25 bp, Homo sapien
gaatagacccatctgcagaggatca

SEQ ID NO: 44548 - DNA, 25 bp, Homo sapien
caggcacgaagcatcaatgttcaca

SEQ ID NO: 44549 - DNA, 25 bp, Homo sapien
cccaggctgcagattctgtcagtgc

SEQ ID NO: 44550 - DNA, 25 bp, Homo sapien
gtcagtgctgttctcgaagaggccc

SEQ ID NO: 44551 - DNA, 25 bp, Homo sapien
gaagaggcccaggcacatgctgaaa

SEQ ID NO: 44552 - DNA, 25 bp, Homo sapien
gcaagcagctggcatacattccacc

SEQ ID NO: 44553 - DNA, 25 bp, Homo sapien
gcagctggcatacattccacccagc

SEQ ID NO: 44554 - DNA, 25 bp, Homo sapien
agaattgcttgagctccggagttcc

SEQ ID NO: 44555 - DNA, 25 bp, Homo sapien
gggcaacagaacaagggctcatctc

SEQ ID NO: 44556 - DNA, 25 bp, Homo sapien
agaacaagggctcatctctactaga

SEQ ID NO: 44557 - DNA, 25 bp, Homo sapien
ccaggataagaagccagccctcggg

SEQ ID NO: 44558 - DNA, 25 bp, Homo sapien
tgcagaggtcctgtgacaccagtgg

SEQ ID NO: 44559 - DNA, 25 bp, Homo sapien
gggtaggaaccagaaggccaatagg

SEQ ID NO: 44560 - DNA, 25 bp, Homo sapien
taggaaggaggacaaaagtgcccaa

SEQ ID NO: 44561 - DNA, 25 bp, Homo sapien
gggattagaattgggtgacagtgat

SEQ ID NO: 44562 - DNA, 25 bp, Homo sapien
gggtgacagtgattagtagtttcag

SEQ ID NO: 44563 - DNA, 25 bp, Homo sapien
gaagtatctcttcccaattcaaaag

SEQ ID NO: 44564 - DNA, 25 bp, Homo sapien
gtccctttctcaattcctgttggga

SEQ ID NO: 44565 - DNA, 25 bp, Homo sapien
ttctcaattcctgttgggagtggga

SEQ ID NO: 44566 - DNA, 25 bp, Homo sapien
taacaaagactgcattggtcaaatc

SEQ ID NO: 44567 - DNA, 25 bp, Homo sapien
gcattggtcaaatctggacaatttg

SEQ ID NO: 44568 - DNA, 25 bp, Homo sapien
ggagttcttcttcaatgaaataatg

SEQ ID NO: 44569 - DNA, 25 bp, Homo sapien
gaaataatgccagctagtaaatgta

SEQ ID NO: 44570 - DNA, 25 bp, Homo sapien
ctcagccatcccaaataggtcattt

SEQ ID NO: 44571 - DNA, 25 bp, Homo sapien
gccatcccaaataggtcatttgtca

SEQ ID NO: 44572 - DNA, 25 bp, Homo sapien
ggaaacaatttggtataagtgggtg

SEQ ID NO: 44573 - DNA, 25 bp, Homo sapien
taagtgggtgtgccataacctctct

SEQ ID NO: 44574 - DNA, 25 bp, Homo sapien
gtagccattcattcccggatacata

SEQ ID NO: 44575 - DNA, 25 bp, Homo sapien
ttcattcccggatacataccctaga

SEQ ID NO: 44576 - DNA, 25 bp, Homo sapien
tcccggatacataccctagagaaac

SEQ ID NO: 44577 - DNA, 25 bp, Homo sapien
cggatacataccctagagaaactct

SEQ ID NO: 44578 - DNA, 25 bp, Homo sapien
gaaactcttacacatgcgtaccagg

SEQ ID NO: 44579 - DNA, 25 bp, Homo sapien
actcttacacatgcgtaccagggga

SEQ ID NO: 44580 - DNA, 25 bp, Homo sapien
tacacatgcgtaccaggggatggat

SEQ ID NO: 44581 - DNA, 25 bp, Homo sapien
gctccaggccaaagtgccggtgaga

SEQ ID NO: 44582 - DNA, 25 bp, Homo sapien
ccatggctgtgttggtgtggcccat

SEQ ID NO: 44583 - DNA, 25 bp, Homo sapien
ggactcgtggctgtcaatgggacct

SEQ ID NO: 44584 - DNA, 25 bp, Homo sapien
ctgtcaatgggacctgtggctgtcg

SEQ ID NO: 44585 - DNA, 25 bp, Homo sapien
tcggtgggaccctggttattgatgt

SEQ ID NO: 44586 - DNA, 25 bp, Homo sapien
ttgatgtggccctggctgccggcac

SEQ ID NO: 44587 - DNA, 25 bp, Homo sapien
acggcccgtggctgttgacgcacct

SEQ ID NO: 44588 - DNA, 25 bp, Homo sapien
ttgacgcacctgtggttgttagtgg

SEQ ID NO: 44589 - DNA, 25 bp, Homo sapien
aaggccggcaggtcaacctcgcgct

SEQ ID NO: 44590 - DNA, 25 bp, Homo sapien
ggcaggtcaacctcgcgcttgctgg

SEQ ID NO: 44591 - DNA, 25 bp, Homo sapien
cggcagtattgaagctcgtgacaag

SEQ ID NO: 44592 - DNA, 25 bp, Homo sapien
attgaagctcgtgacaagtgccttc

SEQ ID NO: 44593 - DNA, 25 bp, Homo sapien
gctcgtgacaagtgccttcacacag

SEQ ID NO: 44594 - DNA, 25 bp, Homo sapien
gtgacaagtgccttcacacagaccc

SEQ ID NO: 44595 - DNA, 25 bp, Homo sapien
tcgcaactgtccacgcgtgccgtgg

SEQ ID NO: 44596 - DNA, 25 bp, Homo sapien
cctcctcgtgaaagtgcatttttgt

SEQ ID NO: 44597 - DNA, 25 bp, Homo sapien
tcgcagctgggcgaggggacttgga

SEQ ID NO: 44598 - DNA, 25 bp, Homo sapien
ctgggcgaggggacttggaggacag

SEQ ID NO: 44599 - DNA, 25 bp, Homo sapien
ggggacttggaggacagggtgaagc

SEQ ID NO: 44600 - DNA, 25 bp, Homo sapien
acttggaggacagggtgaagctgca

SEQ ID NO: 44601 - DNA, 25 bp, Homo sapien
tgaagctgcagaagacctggggtgg

SEQ ID NO: 44602 - DNA, 25 bp, Homo sapien
gctgcagaagacctggggtgggatg

SEQ ID NO: 44603 - DNA, 25 bp, Homo sapien
attctgaagccagaccgtctttcct

SEQ ID NO: 44604 - DNA, 25 bp, Homo sapien
tagagaggacgccaaggactgggga

SEQ ID NO: 44605 - DNA, 25 bp, Homo sapien
agaggacgccaaggactggggaagg

SEQ ID NO: 44606 - DNA, 25 bp, Homo sapien
ggaagttaggaataccttacatcca

SEQ ID NO: 44607 - DNA, 25 bp, Homo sapien
aggaataccttacatccaatgccca

SEQ ID NO: 44608 - DNA, 25 bp, Homo sapien
tcgacgctccggaactcggggaaga

SEQ ID NO: 44609 - DNA, 25 bp, Homo sapien
tccggaactcggggaagagcgtccg

SEQ ID NO: 44610 - DNA, 25 bp, Homo sapien
ctccctccagataacacaagtgtga

SEQ ID NO: 44611 - DNA, 25 bp, Homo sapien
acacaagtgtgaagagaggggagag

SEQ ID NO: 44612 - DNA, 25 bp, Homo sapien
cccttccagactttccagataactt

SEQ ID NO: 44613 - DNA, 25 bp, Homo sapien
cagactttccagataactttgcccc

SEQ ID NO: 44614 - DNA, 25 bp, Homo sapien
gccccacggaggacaaggaaagcca

SEQ ID NO: 44615 - DNA, 25 bp, Homo sapien
gaagccaggattgttagtcttggaa

SEQ ID NO: 44616 - DNA, 25 bp, Homo sapien
gtcttggaaaatgcctccatataga

SEQ ID NO: 44617 - DNA, 25 bp, Homo sapien
gcctccatatagaaacatgagccgg

SEQ ID NO: 44618 - DNA, 25 bp, Homo sapien
gagccggagaataaatcacttgcct

SEQ ID NO: 44619 - DNA, 25 bp, Homo sapien
catgggcatgggagacctgctcagt

SEQ ID NO: 44620 - DNA, 25 bp, Homo sapien
tctggccccctgagccttcttgtaa

SEQ ID NO: 44621 - DNA, 25 bp, Homo sapien
gccccctgagccttcttgtaaatac

SEQ ID NO: 44622 - DNA, 25 bp, Homo sapien
ccctgagccttcttgtaaatacctg

SEQ ID NO: 44623 - DNA, 25 bp, Homo sapien
cctgagccttcttgtaaatacctgc

SEQ ID NO: 44624 - DNA, 25 bp, Homo sapien
ctgagccttcttgtaaatacctgcc

SEQ ID NO: 44625 - DNA, 25 bp, Homo sapien
tcccctggccctctgatttgttctg

SEQ ID NO: 44626 - DNA, 25 bp, Homo sapien
cccctggccctctgatttgttctgt

SEQ ID NO: 44627 - DNA, 25 bp, Homo sapien
ccctggccctctgatttgttctgtt

SEQ ID NO: 44628 - DNA, 25 bp, Homo sapien
cctggccctctgatttgttctgttc

SEQ ID NO: 44629 - DNA, 25 bp, Homo sapien
ctggccctctgatttgttctgttcc

SEQ ID NO: 44630 - DNA, 25 bp, Homo sapien
tggccctctgatttgttctgttcct

SEQ ID NO: 44631 - DNA, 25 bp, Homo sapien
ggccctctgatttgttctgttcctg

SEQ ID NO: 44632 - DNA, 25 bp, Homo sapien
gccctctgatttgttctgttcctgt

SEQ ID NO: 44633 - DNA, 25 bp, Homo sapien
ccctctgatttgttctgttcctgtc

SEQ ID NO: 44634 - DNA, 25 bp, Homo sapien
ctgatttgttctgttcctgtctcaa

SEQ ID NO: 44635 - DNA, 25 bp, Homo sapien
cactgtacgagtgaggcctgtgaga

SEQ ID NO: 44636 - DNA, 25 bp, Homo sapien
gcctgtgagagctgtgtcctgcacc

SEQ ID NO: 44637 - DNA, 25 bp, Homo sapien
agctgtgtcctgcaccgctcatgct

SEQ ID NO: 44638 - DNA, 25 bp, Homo sapien
tgctcgcccggctttggggtcaagc

SEQ ID NO: 44639 - DNA, 25 bp, Homo sapien
tcaagcagattgctacaggggtttc

SEQ ID NO: 44640 - DNA, 25 bp, Homo sapien
ttctgataccatctgcgagccctgc

SEQ ID NO: 44641 - DNA, 25 bp, Homo sapien
gcccagtcggcttcttctccaatgt

SEQ ID NO: 44642 - DNA, 25 bp, Homo sapien
ttctccaatgtgtcatctgctttcg

SEQ ID NO: 44643 - DNA, 25 bp, Homo sapien
atgtgtcatctgctttcgaaaaatg

SEQ ID NO: 44644 - DNA, 25 bp, Homo sapien
ttcgaaaaatgtcacccttggacaa

SEQ ID NO: 44645 - DNA, 25 bp, Homo sapien
ggcacaaacaagactgatgttgtct

SEQ ID NO: 44646 - DNA, 25 bp, Homo sapien
agactgatgttgtctgtggtcccca

SEQ ID NO: 44647 - DNA, 25 bp, Homo sapien
gactgatgttgtctgtggtccccag

SEQ ID NO: 44648 - DNA, 25 bp, Homo sapien
gctgagagccctggtggtgatcccc

SEQ ID NO: 44649 - DNA, 25 bp, Homo sapien
ccctggtggtgatccccatcatctt

SEQ ID NO: 44650 - DNA, 25 bp, Homo sapien
tcctgtttgccatcctcttggtgct

SEQ ID NO: 44651 - DNA, 25 bp, Homo sapien
attctaaacactcgtgcttgcgttt

SEQ ID NO: 44652 - DNA, 25 bp, Homo sapien
taaacactcgtgcttgcgtttgaag

SEQ ID NO: 44653 - DNA, 25 bp, Homo sapien
aacactcgtgcttgcgtttgaagcc

SEQ ID NO: 44654 - DNA, 25 bp, Homo sapien
ctcgtgcttgcgtttgaagcctcgc

SEQ ID NO: 44655 - DNA, 25 bp, Homo sapien
gtgcttgcgtttgaagcctcgcgtc

SEQ ID NO: 44656 - DNA, 25 bp, Homo sapien
tgcttgcgtttgaagcctcgcgtca

SEQ ID NO: 44657 - DNA, 25 bp, Homo sapien
gcttgcgtttgaagcctcgcgtcac

SEQ ID NO: 44658 - DNA, 25 bp, Homo sapien
gcgtttgaagcctcgcgtcactcag

SEQ ID NO: 44659 - DNA, 25 bp, Homo sapien
tgaagcctcgcgtcactcagtcgcg

SEQ ID NO: 44660 - DNA, 25 bp, Homo sapien
aagcctcgcgtcactcagtcgcgtg

SEQ ID NO: 44661 - DNA, 25 bp, Homo sapien
tgttgtctgccttggccgaaagatg

SEQ ID NO: 44662 - DNA, 25 bp, Homo sapien
ctgccttggccgaaagatgaaaaaa

SEQ ID NO: 44663 - DNA, 25 bp, Homo sapien
attcaccggggatctcctgggctgg

SEQ ID NO: 44664 - DNA, 25 bp, Homo sapien
gctctccttggaagtgaggcctttt

SEQ ID NO: 44665 - DNA, 25 bp, Homo sapien
tctccttggaagtgaggccttttat

SEQ ID NO: 44666 - DNA, 25 bp, Homo sapien
tccttggaagtgaggccttttatta

SEQ ID NO: 44667 - DNA, 25 bp, Homo sapien
gcaaaattatcctaaacactagttt

SEQ ID NO: 44668 - DNA, 25 bp, Homo sapien
tggccatctataacattttctcaag

SEQ ID NO: 44669 - DNA, 25 bp, Homo sapien
aagaacatgtagctgttcaagcaca

SEQ ID NO: 44670 - DNA, 25 bp, Homo sapien
agatacaaggtctgggctggggcac

SEQ ID NO: 44671 - DNA, 25 bp, Homo sapien
ccagatacttggggcaggcggagaa

SEQ ID NO: 44672 - DNA, 25 bp, Homo sapien
ggcaggcggagaacaggcggatcac

SEQ ID NO: 44673 - DNA, 25 bp, Homo sapien
ggcggagaacaggcggatcaccgtg

SEQ ID NO: 44674 - DNA, 25 bp, Homo sapien
agaacaggcggatcaccgtgaggtt

SEQ ID NO: 44675 - DNA, 25 bp, Homo sapien
ggcggatcaccgtgaggttgcagtt

SEQ ID NO: 44676 - DNA, 25 bp, Homo sapien
tcaccgtgaggttgcagttggagac

SEQ ID NO: 44677 - DNA, 25 bp, Homo sapien
ttaacccagaagggggaggttgcag

SEQ ID NO: 44678 - DNA, 25 bp, Homo sapien
ctttcgtcttggatttggctcatac

SEQ ID NO: 44679 - DNA, 25 bp, Homo sapien
gtcttggatttggctcatacgttga

SEQ ID NO: 44680 - DNA, 25 bp, Homo sapien
gtttcaccatacattagcatccacc

SEQ ID NO: 44681 - DNA, 25 bp, Homo sapien
agcatccaccccgaaaggattcata

SEQ ID NO: 44682 - DNA, 25 bp, Homo sapien
aggattcataatcaatgcaggtatc

SEQ ID NO: 44683 - DNA, 25 bp, Homo sapien
agggtttgatgtggatatgctaaat

SEQ ID NO: 44684 - DNA, 25 bp, Homo sapien
gatgtctcagcatcaatgcacaata

SEQ ID NO: 44685 - DNA, 25 bp, Homo sapien
gaggtggggaggtttcttcatatct

SEQ ID NO: 44686 - DNA, 25 bp, Homo sapien
gggaggtttcttcatatctgaaaac

SEQ ID NO: 44687 - DNA, 25 bp, Homo sapien
tgagatgaactgtagattgggcttt

SEQ ID NO: 44688 - DNA, 25 bp, Homo sapien
gtagattgggctttttattttatat

SEQ ID NO: 44689 - DNA, 25 bp, Homo sapien
ggaggccaagagttcaagtccagcc

SEQ ID NO: 44690 - DNA, 25 bp, Homo sapien
gcttgagccaggaggcagaggctgc

SEQ ID NO: 44691 - DNA, 25 bp, Homo sapien
gagccaggaggcagaggctgcggtg

SEQ ID NO: 44692 - DNA, 25 bp, Homo sapien
ccaggaggcagaggctgcggtgagc

SEQ ID NO: 44693 - DNA, 25 bp, Homo sapien
ggccaagagttcaagtccagcctgt

SEQ ID NO: 44694 - DNA, 25 bp, Homo sapien
tcaagtccagcctgtccaacatgga

SEQ ID NO: 44695 - DNA, 25 bp, Homo sapien
gagagagagataaggtgagactgaa

SEQ ID NO: 44696 - DNA, 25 bp, Homo sapien
tgagactgaaaagaagagcaccaac

SEQ ID NO: 44697 - DNA, 25 bp, Homo sapien
gaagagcaccaactaaagtcattta

SEQ ID NO: 44698 - DNA, 25 bp, Homo sapien
gagcaccaactaaagtcatttaaag

SEQ ID NO: 44699 - DNA, 25 bp, Homo sapien
taaagtcatttaaagaagtgggtat

SEQ ID NO: 44700 - DNA, 25 bp, Homo sapien
ggccccgtattcattttttatactg

SEQ ID NO: 44701 - DNA, 25 bp, Homo sapien
aagggacacggtactatgatttaat

SEQ ID NO: 44702 - DNA, 25 bp, Homo sapien
tatgatttaattactgtcttgtctt

SEQ ID NO: 44703 - DNA, 25 bp, Homo sapien
tactgtcttgtctttttaaaatgtc

SEQ ID NO: 44704 - DNA, 25 bp, Homo sapien
aaaatgtcatctcttgttttaccct

SEQ ID NO: 44705 - DNA, 25 bp, Homo sapien
tctttgggtattattctggaggtat

SEQ ID NO: 44706 - DNA, 25 bp, Homo sapien
gtattattctggaggtatgtttctt

SEQ ID NO: 44707 - DNA, 25 bp, Homo sapien
tctggaggtatgtttcttttatata

SEQ ID NO: 44708 - DNA, 25 bp, Homo sapien
tttgtttttaagaatgccatactac

SEQ ID NO: 44709 - DNA, 25 bp, Homo sapien
gaatgccatactacaaatgatgtta

SEQ ID NO: 44710 - DNA, 25 bp, Homo sapien
tatttggttttaatggtgttttgtg

SEQ ID NO: 44711 - DNA, 25 bp, Homo sapien
tgtggttccagctacttgacaggct

SEQ ID NO: 44712 - DNA, 25 bp, Homo sapien
gaggatcacctgagcccagggaggt

SEQ ID NO: 44713 - DNA, 25 bp, Homo sapien
gagcccagggaggttaaggttgcag

SEQ ID NO: 44714 - DNA, 25 bp, Homo sapien
tgagctttgattacaccactgcact

SEQ ID NO: 44715 - DNA, 25 bp, Homo sapien
ctccaccctggccaacagagtgaga

SEQ ID NO: 44716 - DNA, 25 bp, Homo sapien
agctttttcctgtttactactcaga

SEQ ID NO: 44717 - DNA, 25 bp, Homo sapien
actactcagattattagtgatcctg

SEQ ID NO: 44718 - DNA, 25 bp, Homo sapien
agtgatcctgtttttgggtagcatg

SEQ ID NO: 44719 - DNA, 25 bp, Homo sapien
gatgaacatcaaaacactgggggaa

SEQ ID NO: 44720 - DNA, 25 bp, Homo sapien
atatgtcacttgatagtctgtatgc

SEQ ID NO: 44721 - DNA, 25 bp, Homo sapien
gtctgtatgctaaggtctctatgaa

SEQ ID NO: 44722 - DNA, 25 bp, Homo sapien
ttcattcatgactccagacaggtat

SEQ ID NO: 44723 - DNA, 25 bp, Homo sapien
atgactccagacaggtattgttatt

SEQ ID NO: 44724 - DNA, 25 bp, Homo sapien
tattgttattcattgtttatacttg

SEQ ID NO: 44725 - DNA, 25 bp, Homo sapien
cctaggtctgcttccaaatttcgtg

SEQ ID NO: 44726 - DNA, 25 bp, Homo sapien
gcttccaaatttcgtggtttcggat

SEQ ID NO: 44727 - DNA, 25 bp, Homo sapien
gtggtttcggatttagtgccttcat

SEQ ID NO: 44728 - DNA, 25 bp, Homo sapien
tcattgtgtttcacctacaggttaa

SEQ ID NO: 44729 - DNA, 25 bp, Homo sapien
atatttaagacgctgggagaatcca

SEQ ID NO: 44730 - DNA, 25 bp, Homo sapien
gggagaatccaaaaaattgtctagt

SEQ ID NO: 44731 - DNA, 25 bp, Homo sapien
gtctagttgtgtgtaacatagtctc

SEQ ID NO: 44732 - DNA, 25 bp, Homo sapien
gttgtgtgtaacatagtctcaggat

SEQ ID NO: 44733 - DNA, 25 bp, Homo sapien
taatcctgtttttagtgctgactgg

SEQ ID NO: 44734 - DNA, 25 bp, Homo sapien
tagtgctgactgggtcagccttccg

SEQ ID NO: 44735 - DNA, 25 bp, Homo sapien
cggcctcagtgccttttttaacttg

SEQ ID NO: 44736 - DNA, 25 bp, Homo sapien
gtcagccttccgggaactggagtct

SEQ ID NO: 44737 - DNA, 25 bp, Homo sapien
tgagggtgtagaggtcctccacgct

SEQ ID NO: 44738 - DNA, 25 bp, Homo sapien
ctccacgcttgtttgcctgaaagta

SEQ ID NO: 44739 - DNA, 25 bp, Homo sapien
agtaatataatgatgctgtctgaac

SEQ ID NO: 44740 - DNA, 25 bp, Homo sapien
gtctgaacaggttttactgcttgct

SEQ ID NO: 44741 - DNA, 25 bp, Homo sapien
ggttttactgcttgctttccaagta

SEQ ID NO: 44742 - DNA, 25 bp, Homo sapien
ggaactggagtctgtctctttcagt

SEQ ID NO: 44743 - DNA, 25 bp, Homo sapien
gtctctttcagtgcttttttgtttg

SEQ ID NO: 44744 - DNA, 25 bp, Homo sapien
tagacaggttttcaccatattggtc

SEQ ID NO: 44745 - DNA, 25 bp, Homo sapien
gaaatgggggaatacccacagtgag

SEQ ID NO: 44746 - DNA, 25 bp, Homo sapien
aggttttcaccatattggtcaggct

SEQ ID NO: 44747 - DNA, 25 bp, Homo sapien
tcggggtgcccacctgtggtgggta

SEQ ID NO: 44748 - DNA, 25 bp, Homo sapien
tgtggtgggtagttaggtagctgtt

SEQ ID NO: 44749 - DNA, 25 bp, Homo sapien
aggtagctgttacaaagtgccccag

SEQ ID NO: 44750 - DNA, 25 bp, Homo sapien
ttacaaagtgccccagcagagaccc

SEQ ID NO: 44751 - DNA, 25 bp, Homo sapien
gactaacttttattcttccatcttt

SEQ ID NO: 44752 - DNA, 25 bp, Homo sapien
tccatcttttcccacaggtggcagc

SEQ ID NO: 44753 - DNA, 25 bp, Homo sapien
ttttcccacaggtggcagctgccaa

SEQ ID NO: 44754 - DNA, 25 bp, Homo sapien
gtggcagctgccaacaagaagcatt

SEQ ID NO: 44755 - DNA, 25 bp, Homo sapien
gaagactgtgatcctcatgcactca

SEQ ID NO: 44756 - DNA, 25 bp, Homo sapien
cctcatgcactcagaggcacttccc

SEQ ID NO: 44757 - DNA, 25 bp, Homo sapien
ggcacttcccttctaagtcaaagac

SEQ ID NO: 44758 - DNA, 25 bp, Homo sapien
agaaagctgcagtgccacctgagtt

SEQ ID NO: 44759 - DNA, 25 bp, Homo sapien
caaagaccattctcactgactatgt

SEQ ID NO: 44760 - DNA, 25 bp, Homo sapien
tgactatgtgccaaggcctcacttc

SEQ ID NO: 44761 - DNA, 25 bp, Homo sapien
aaggcctcacttcaggcttgtgact

SEQ ID NO: 44762 - DNA, 25 bp, Homo sapien
cttcttcgatagttacctgcatgtc

SEQ ID NO: 44763 - DNA, 25 bp, Homo sapien
cctgcatgtccattgctggcagctg

SEQ ID NO: 44764 - DNA, 25 bp, Homo sapien
ctggcagctgacttcagtcattaaa

SEQ ID NO: 44765 - DNA, 25 bp, Homo sapien
ggttaagggagctacactgtggttt

SEQ ID NO: 44766 - DNA, 25 bp, Homo sapien
tcgacggaggctggacccaggtaag

SEQ ID NO: 44767 - DNA, 25 bp, Homo sapien
ggctggacccaggtaagaagtcatt

SEQ ID NO: 44768 - DNA, 25 bp, Homo sapien
agaagtcattgcaggggtccaagcc

SEQ ID NO: 44769 - DNA, 25 bp, Homo sapien
tcattgcaggggtccaagccaggag

SEQ ID NO: 44770 - DNA, 25 bp, Homo sapien
aggggtccaagccaggagaggacaa

SEQ ID NO: 44771 - DNA, 25 bp, Homo sapien
gagaggacaaatctgatggaggttt

SEQ ID NO: 44772 - DNA, 25 bp, Homo sapien
gaggtttaaaaggctcagttgtctg

SEQ ID NO: 44773 - DNA, 25 bp, Homo sapien
gaagagacgaaggggcagaggggga

SEQ ID NO: 44774 - DNA, 25 bp, Homo sapien
gactaaggatagattttggaggcag

SEQ ID NO: 44775 - DNA, 25 bp, Homo sapien
gagcaaacaggagagcatgaaagaa

SEQ ID NO: 44776 - DNA, 25 bp, Homo sapien
agatgatgtttaggccaggggcggt

SEQ ID NO: 44777 - DNA, 25 bp, Homo sapien
atgcctttgggcaatatattttttt

SEQ ID NO: 44778 - DNA, 25 bp, Homo sapien
catgccctgtctggatttttaaagg

SEQ ID NO: 44779 - DNA, 25 bp, Homo sapien
ttcaggaggctggaggatcacttga

SEQ ID NO: 44780 - DNA, 25 bp, Homo sapien
agctgggtgtggtgacacatgtctc

SEQ ID NO: 44781 - DNA, 25 bp, Homo sapien
tgtggtgacacatgtctctagtccc

SEQ ID NO: 44782 - DNA, 25 bp, Homo sapien
tggtgacacatgtctctagtcccaa

SEQ ID NO: 44783 - DNA, 25 bp, Homo sapien
cgcttgagcccaggaatacaaggct

SEQ ID NO: 44784 - DNA, 25 bp, Homo sapien
gcccaggaatacaaggcttcagtga

SEQ ID NO: 44785 - DNA, 25 bp, Homo sapien
acaaggcttcagtgagccataattg

SEQ ID NO: 44786 - DNA, 25 bp, Homo sapien
gaaattggctctgtccgtttattta

SEQ ID NO: 44787 - DNA, 25 bp, Homo sapien
aattggctctgtccgtttatttata

SEQ ID NO: 44788 - DNA, 25 bp, Homo sapien
gctcctgacactgctggagaggccc

SEQ ID NO: 44789 - DNA, 25 bp, Homo sapien
ggaggcatggtctgccctctgcatc

SEQ ID NO: 44790 - DNA, 25 bp, Homo sapien
tctgcatcctctggagccagccgag

SEQ ID NO: 44791 - DNA, 25 bp, Homo sapien
taggagggtcctctgagactccaga

SEQ ID NO: 44792 - DNA, 25 bp, Homo sapien
agactccagacctgaggcgagaagg

SEQ ID NO: 44793 - DNA, 25 bp, Homo sapien
actccagacctgaggcgagaagggc

SEQ ID NO: 44794 - DNA, 25 bp, Homo sapien
agaagggctgcttccctgaagctcc

SEQ ID NO: 44795 - DNA, 25 bp, Homo sapien
ccgccttggcctgtgttcttcctgg

SEQ ID NO: 44796 - DNA, 25 bp, Homo sapien
cgccttggcctgtgttcttcctggc

SEQ ID NO: 44797 - DNA, 25 bp, Homo sapien
tggcctgtgttcttcctggccgcct

SEQ ID NO: 44798 - DNA, 25 bp, Homo sapien
ctgtgttcttcctggccgcctgggt

SEQ ID NO: 44799 - DNA, 25 bp, Homo sapien
ttcctggccgcctgggtccaatgct

SEQ ID NO: 44800 - DNA, 25 bp, Homo sapien
tggccgcctgggtccaatgctcagg

SEQ ID NO: 44801 - DNA, 25 bp, Homo sapien
cctgggtccaatgctcaggtgctgg

SEQ ID NO: 44802 - DNA, 25 bp, Homo sapien
ccagagcacctgctgtctgggtggc

SEQ ID NO: 44803 - DNA, 25 bp, Homo sapien
cagagcacctgctgtctgggtggct

SEQ ID NO: 44804 - DNA, 25 bp, Homo sapien
agttatgttttgtgtttttgtctca

SEQ ID NO: 44805 - DNA, 25 bp, Homo sapien
tgttttgtgtttttgtctcattgtg

SEQ ID NO: 44806 - DNA, 25 bp, Homo sapien
ttttgtgtttttgtctcattgtgtt

SEQ ID NO: 44807 - DNA, 25 bp, Homo sapien
tttgtctcattgtgttattgtctga

SEQ ID NO: 44808 - DNA, 25 bp, Homo sapien
gtctcattgtgttattgtctgacta

SEQ ID NO: 44809 - DNA, 25 bp, Homo sapien
tcattgtgttattgtctgactaaat

SEQ ID NO: 44810 - DNA, 25 bp, Homo sapien
tgtctgactaaatctaaaaccaaac

SEQ ID NO: 44811 - DNA, 25 bp, Homo sapien
atgtatactcaacaatgtcattttg

SEQ ID NO: 44812 - DNA, 25 bp, Homo sapien
atactcaacaatgtcattttgtgac

SEQ ID NO: 44813 - DNA, 25 bp, Homo sapien
ctcaacaatgtcattttgtgacttt

SEQ ID NO: 44814 - DNA, 25 bp, Homo sapien
gtcattttgtgactttggaaacaag

SEQ ID NO: 44815 - DNA, 25 bp, Homo sapien
tgggtttgggagtaggtgctaacct

SEQ ID NO: 44816 - DNA, 25 bp, Homo sapien
gggtttgggagtaggtgctaacctg

SEQ ID NO: 44817 - DNA, 25 bp, Homo sapien
ggtttgggagtaggtgctaacctgg

SEQ ID NO: 44818 - DNA, 25 bp, Homo sapien
gggagtaggtgctaacctggataac

SEQ ID NO: 44819 - DNA, 25 bp, Homo sapien
ggagtaggtgctaacctggataact

SEQ ID NO: 44820 - DNA, 25 bp, Homo sapien
gtaggtgctaacctggataactgta

SEQ ID NO: 44821 - DNA, 25 bp, Homo sapien
ggtgctaacctggataactgtaaaa

SEQ ID NO: 44822 - DNA, 25 bp, Homo sapien
ggataactgtaaaagggctctctct

SEQ ID NO: 44823 - DNA, 25 bp, Homo sapien
gataactgtaaaagggctctctctc

SEQ ID NO: 44824 - DNA, 25 bp, Homo sapien
ataactgtaaaagggctctctctcc

SEQ ID NO: 44825 - DNA, 25 bp, Homo sapien
taactgtaaaagggctctctctccc

SEQ ID NO: 44826 - DNA, 25 bp, Homo sapien
gggaagactcaatttgttgttgtca

SEQ ID NO: 44827 - DNA, 25 bp, Homo sapien
tgtactatttcttttctgtctgcag

SEQ ID NO: 44828 - DNA, 25 bp, Homo sapien
gagagaattgttgatagccggtaaa

SEQ ID NO: 44829 - DNA, 25 bp, Homo sapien
gatagccggtaaaattatagactac

SEQ ID NO: 44830 - DNA, 25 bp, Homo sapien
atagactaccaaacctagctgggcg

SEQ ID NO: 44831 - DNA, 25 bp, Homo sapien
gtgcagtggcaatctcagcttactg

SEQ ID NO: 44832 - DNA, 25 bp, Homo sapien
aatctcagcttactgcaatctccac

SEQ ID NO: 44833 - DNA, 25 bp, Homo sapien
cggccgcgaatttagtagtagtagg

SEQ ID NO: 44834 - DNA, 25 bp, Homo sapien
gtagtagtaggcggccgctctagag

SEQ ID NO: 44835 - DNA, 25 bp, Homo sapien
gccgctctagaggatccaagcttac

SEQ ID NO: 44836 - DNA, 25 bp, Homo sapien
ccaagcttacgtacgcgtgcatgcg

SEQ ID NO: 44837 - DNA, 25 bp, Homo sapien
aaattgattctttgaaccttgatga

SEQ ID NO: 44838 - DNA, 25 bp, Homo sapien
accttgatgagttctgcaactgctc

SEQ ID NO: 44839 - DNA, 25 bp, Homo sapien
tgcaactgctcagagcacattccct

SEQ ID NO: 44840 - DNA, 25 bp, Homo sapien
ttccctctacgattgctgtggtggg

SEQ ID NO: 44841 - DNA, 25 bp, Homo sapien
ccaacttgacgctgggatacaggat

SEQ ID NO: 44842 - DNA, 25 bp, Homo sapien
attgctgtggtgggagcaactggct

SEQ ID NO: 44843 - DNA, 25 bp, Homo sapien
gcgtctccacggcagtggcaaatct

SEQ ID NO: 44844 - DNA, 25 bp, Homo sapien
cagtggcaaatctgctggggctctt

SEQ ID NO: 44845 - DNA, 25 bp, Homo sapien
ggatacaggatatttgacacttgca

SEQ ID NO: 44846 - DNA, 25 bp, Homo sapien
ttgacacttgcaacaccgtttctaa

SEQ ID NO: 44847 - DNA, 25 bp, Homo sapien
ttgcaacaccgtttctaaggccttg

SEQ ID NO: 44848 - DNA, 25 bp, Homo sapien
gccatgcttcagtgcgcaggaagtg

SEQ ID NO: 44849 - DNA, 25 bp, Homo sapien
cgctgcgtgccgtgttccggagcca

SEQ ID NO: 44850 - DNA, 25 bp, Homo sapien
tgttccggagccagcagcaggagac

SEQ ID NO: 44851 - DNA, 25 bp, Homo sapien
tccggagccagcagcaggagactgt

SEQ ID NO: 44852 - DNA, 25 bp, Homo sapien
ccagcagcaggagactgtgggcctt

SEQ ID NO: 44853 - DNA, 25 bp, Homo sapien
gccttgaggatgtggtagtgacctc

SEQ ID NO: 44854 - DNA, 25 bp, Homo sapien
ccttgaggatgtggtagtgacctca

SEQ ID NO: 44855 - DNA, 25 bp, Homo sapien
atgtggtagtgacctcaccagagga

SEQ ID NO: 44856 - DNA, 25 bp, Homo sapien
ctgccacatggcagtgctgggtaag

SEQ ID NO: 44857 - DNA, 25 bp, Homo sapien
acatggcagtgctgggtaagacccc

SEQ ID NO: 44858 - DNA, 25 bp, Homo sapien
cagtgctgggtaagacccctctgtc

SEQ ID NO: 44859 - DNA, 25 bp, Homo sapien
gtgctgggtaagacccctctgtccc

SEQ ID NO: 44860 - DNA, 25 bp, Homo sapien
ccaccagtgcccttgaggttatggg

SEQ ID NO: 44861 - DNA, 25 bp, Homo sapien
cagtgcccttgaggttatgggtgtt

SEQ ID NO: 44862 - DNA, 25 bp, Homo sapien
aggtctgtggcctccatttccatga

SEQ ID NO: 44863 - DNA, 25 bp, Homo sapien
gtggcctccatttccatgacgatgg

SEQ ID NO: 44864 - DNA, 25 bp, Homo sapien
acatgcctgtattcctagctactag

SEQ ID NO: 44865 - DNA, 25 bp, Homo sapien
tgtattcctagctactagggaggcc

SEQ ID NO: 44866 - DNA, 25 bp, Homo sapien
gcttgagctcagtaggttgaggcta

SEQ ID NO: 44867 - DNA, 25 bp, Homo sapien
gtaggttgaggctacagtgagccat

SEQ ID NO: 44868 - DNA, 25 bp, Homo sapien
tgagaccctgtacccaaagcaaaaa

SEQ ID NO: 44869 - DNA, 25 bp, Homo sapien
gaagcctatgtaaaaatatactgtt

SEQ ID NO: 44870 - DNA, 25 bp, Homo sapien
gagtctataaaatattcttccaata

SEQ ID NO: 44871 - DNA, 25 bp, Homo sapien
aatattcttccaatatgtaggggaa

SEQ ID NO: 44872 - DNA, 25 bp, Homo sapien
gcatatggtggggaaattatcgcta

SEQ ID NO: 44873 - DNA, 25 bp, Homo sapien
tggtggggaaattatcgctaaaata

SEQ ID NO: 44874 - DNA, 25 bp, Homo sapien
gacccccatctctacgaagatttta

SEQ ID NO: 44875 - DNA, 25 bp, Homo sapien
cggacttggcccaaaacgtgcttct

SEQ ID NO: 44876 - DNA, 25 bp, Homo sapien
ctgggtcctgcgggagcagtacgag

SEQ ID NO: 44877 - DNA, 25 bp, Homo sapien
ggagcagtacgaggaacagggtccc

SEQ ID NO: 44878 - DNA, 25 bp, Homo sapien
gcagtacgaggaacagggtccctat

SEQ ID NO: 44879 - DNA, 25 bp, Homo sapien
gaacagggtccctatatcgtgtacc

SEQ ID NO: 44880 - DNA, 25 bp, Homo sapien
aacagggtccctatatcgtgtaccg

SEQ ID NO: 44881 - DNA, 25 bp, Homo sapien
gtccctatatcgtgtaccgcaaatg

SEQ ID NO: 44882 - DNA, 25 bp, Homo sapien
ccctatatcgtgtaccgcaaatgct

SEQ ID NO: 44883 - DNA, 25 bp, Homo sapien
atcgtgtaccgcaaatgctactgac

SEQ ID NO: 44884 - DNA, 25 bp, Homo sapien
gtgtaccgcaaatgctactgaccag

SEQ ID NO: 44885 - DNA, 25 bp, Homo sapien
accgcaaatgctactgaccagggca

SEQ ID NO: 44886 - DNA, 25 bp, Homo sapien
gaatgtggggaagggagtgagggga

SEQ ID NO: 44887 - DNA, 25 bp, Homo sapien
tgtcctgcagacctgaagccaagat

SEQ ID NO: 44888 - DNA, 25 bp, Homo sapien
gcagacctgaagccaagatcaaggg

SEQ ID NO: 44889 - DNA, 25 bp, Homo sapien
gaaagaaaaggacaggatggggact

SEQ ID NO: 44890 - DNA, 25 bp, Homo sapien
attgttccttaaaccttcatgtcct

SEQ ID NO: 44891 - DNA, 25 bp, Homo sapien
acgatgatctaaatcagtgttctgc

SEQ ID NO: 44892 - DNA, 25 bp, Homo sapien
tcagtgttctgcaacttttctaccc

SEQ ID NO: 44893 - DNA, 25 bp, Homo sapien
aacttttctacccagtcatcagtgg

SEQ ID NO: 44894 - DNA, 25 bp, Homo sapien
ttctacccagtcatcagtgggagtg

SEQ ID NO: 44895 - DNA, 25 bp, Homo sapien
cagtcatcagtgggagtgaatcagt

SEQ ID NO: 44896 - DNA, 25 bp, Homo sapien
ggagtgaatcagtaggaatgtgggg

SEQ ID NO: 44897 - DNA, 25 bp, Homo sapien
atgagagaatcgtcctttaatagaa

SEQ ID NO: 44898 - DNA, 25 bp, Homo sapien
agaaaatttctattgctgcatcaga

SEQ ID NO: 44899 - DNA, 25 bp, Homo sapien
acacaaaaaacatacctcagtcctt

SEQ ID NO: 44900 - DNA, 25 bp, Homo sapien
tacctcagtccttagtgtgtcctaa

SEQ ID NO: 44901 - DNA, 25 bp, Homo sapien
aaattaacacatattcacttattag

SEQ ID NO: 44902 - DNA, 25 bp, Homo sapien
gttgcactggaattggatggcttat

SEQ ID NO: 44903 - DNA, 25 bp, Homo sapien
tcagagcaaccgcagttttccagga

SEQ ID NO: 44904 - DNA, 25 bp, Homo sapien
ggaaattccaatggccatgcggttg

SEQ ID NO: 44905 - DNA, 25 bp, Homo sapien
atggccatgcggttggaaaattccc

SEQ ID NO: 44906 - DNA, 25 bp, Homo sapien
aatcccagatagcatcacatcattt

SEQ ID NO: 44907 - DNA, 25 bp, Homo sapien
ttcacccccaccataggatttcaaa

SEQ ID NO: 44908 - DNA, 25 bp, Homo sapien
gaaagccgccaaagactcttatcct

SEQ ID NO: 44909 - DNA, 25 bp, Homo sapien
caaagactcttatccttattggtgc

SEQ ID NO: 44910 - DNA, 25 bp, Homo sapien
gccaccccagccataggtgtgtgct

SEQ ID NO: 44911 - DNA, 25 bp, Homo sapien
tgtgctgttggtgggaaatggtctc

SEQ ID NO: 44912 - DNA, 25 bp, Homo sapien
cttcctcagcgttgtgtttgggtta

SEQ ID NO: 44913 - DNA, 25 bp, Homo sapien
gtgtttgggttactggtgaggccag

SEQ ID NO: 44914 - DNA, 25 bp, Homo sapien
tcatggtcaccagtacatgtcgctg

SEQ ID NO: 44915 - DNA, 25 bp, Homo sapien
gtcgctggagtaaaatcttgccttt

SEQ ID NO: 44916 - DNA, 25 bp, Homo sapien
gaaactaggttgagctgttcagaaa

SEQ ID NO: 44917 - DNA, 25 bp, Homo sapien
tgttcagaaaggtcaattctcttct

SEQ ID NO: 44918 - DNA, 25 bp, Homo sapien
atctgggtctaaagctcagcactga

SEQ ID NO: 44919 - DNA, 25 bp, Homo sapien
gatttatggatatttcccctgctgc

SEQ ID NO: 44920 - DNA, 25 bp, Homo sapien
atttcccctgctgcaaaaagttcta

SEQ ID NO: 44921 - DNA, 25 bp, Homo sapien
attgaatagcacttgtctacactaa

SEQ ID NO: 44922 - DNA, 25 bp, Homo sapien
tctacactaaattgtctctcttcct

SEQ ID NO: 44923 - DNA, 25 bp, Homo sapien
ctctcttccttttgttcttcaaata

SEQ ID NO: 44924 - DNA, 25 bp, Homo sapien
atcagcctcaggtagcacaggagct

SEQ ID NO: 44925 - DNA, 25 bp, Homo sapien
aggttgtatggatctgttctcaggt

SEQ ID NO: 44926 - DNA, 25 bp, Homo sapien
gatttttatttttttccctgcagat

SEQ ID NO: 44927 - DNA, 25 bp, Homo sapien
acttcagttccttagttgtgccagc

SEQ ID NO: 44928 - DNA, 25 bp, Homo sapien
gtgccagcttcatttcaattgctca

SEQ ID NO: 44929 - DNA, 25 bp, Homo sapien
tgctcagcagctgtctgtggctagt

SEQ ID NO: 44930 - DNA, 25 bp, Homo sapien
gagacgcccggcctagcgggaggct

SEQ ID NO: 44931 - DNA, 25 bp, Homo sapien
ccggcctagcgggaggctgctggct

SEQ ID NO: 44932 - DNA, 25 bp, Homo sapien
gctggtggcggccagggcccggagc

SEQ ID NO: 44933 - DNA, 25 bp, Homo sapien
ggagggacccgtccacggcggagag

SEQ ID NO: 44934 - DNA, 25 bp, Homo sapien
gggacccgtccacggcggagaggct

SEQ ID NO: 44935 - DNA, 25 bp, Homo sapien
tgcccgaggaccggaataaaccctg

SEQ ID NO: 44936 - DNA, 25 bp, Homo sapien
ggaccggaataaaccctgccgcctg

SEQ ID NO: 44937 - DNA, 25 bp, Homo sapien
gaccggaataaaccctgccgcctgg

SEQ ID NO: 44938 - DNA, 25 bp, Homo sapien
cggaataaaccctgccgcctggact

SEQ ID NO: 44939 - DNA, 25 bp, Homo sapien
ggaataaaccctgccgcctggactc

SEQ ID NO: 44940 - DNA, 25 bp, Homo sapien
ttccgccgcctgtggccgtgcggcc

SEQ ID NO: 44941 - DNA, 25 bp, Homo sapien
tgccaaaaccaagattttgaaggaa

SEQ ID NO: 44942 - DNA, 25 bp, Homo sapien
tgtggcctgcccagcctcaatgtca

SEQ ID NO: 44943 - DNA, 25 bp, Homo sapien
cagcagcatcccagccttgagatgc

SEQ ID NO: 44944 - DNA, 25 bp, Homo sapien
cccagccttgagatgcttcactttc

SEQ ID NO: 44945 - DNA, 25 bp, Homo sapien
gccttgagatgcttcactttccttc

SEQ ID NO: 44946 - DNA, 25 bp, Homo sapien
tctgtaaccagactttgaaaaattg

SEQ ID NO: 44947 - DNA, 25 bp, Homo sapien
ctgtaaccagactttgaaaaattgt

SEQ ID NO: 44948 - DNA, 25 bp, Homo sapien
taaccagactttgaaaaattgttcg

SEQ ID NO: 44949 - DNA, 25 bp, Homo sapien
aaattgttcgtttcatcaggctctg

SEQ ID NO: 44950 - DNA, 25 bp, Homo sapien
gttcgtttcatcaggctctgttcct

SEQ ID NO: 44951 - DNA, 25 bp, Homo sapien
tcatcaggctctgttcctcaatggc

SEQ ID NO: 44952 - DNA, 25 bp, Homo sapien
tcaggctctgttcctcaatggcctt

SEQ ID NO: 44953 - DNA, 25 bp, Homo sapien
tcctcaatggccttttgctacgtgc

SEQ ID NO: 44954 - DNA, 25 bp, Homo sapien
ccttttgctacgtgcctcccgagaa

SEQ ID NO: 44955 - DNA, 25 bp, Homo sapien
ttgctacgtgcctcccgagaaattt

SEQ ID NO: 44956 - DNA, 25 bp, Homo sapien
tgcctcccgagaaatttgtcttttt

SEQ ID NO: 44957 - DNA, 25 bp, Homo sapien
gaacatccgcttcgtgttcgcggcc

SEQ ID NO: 44958 - DNA, 25 bp, Homo sapien
tgttcgcggccgtgaaggacaccat

SEQ ID NO: 44959 - DNA, 25 bp, Homo sapien
tcgcggccgtgaaggacaccatcct

SEQ ID NO: 44960 - DNA, 25 bp, Homo sapien
gcagctcaacctcaaggagtacaac

SEQ ID NO: 44961 - DNA, 25 bp, Homo sapien
tcaaggagtacaacctggtctgagc

SEQ ID NO: 44962 - DNA, 25 bp, Homo sapien
caaggagtacaacctggtctgagcg

SEQ ID NO: 44963 - DNA, 25 bp, Homo sapien
tacaacctggtctgagcgcccaggc

SEQ ID NO: 44964 - DNA, 25 bp, Homo sapien
gcaccttctcaccttttgtcaacgg

SEQ ID NO: 44965 - DNA, 25 bp, Homo sapien
caccttttgtcaacggcaaaggcag

SEQ ID NO: 44966 - DNA, 25 bp, Homo sapien
ttgtcaacggcaaaggcagcctttt

SEQ ID NO: 44967 - DNA, 25 bp, Homo sapien
aaggcagcctttttctggccttgac

SEQ ID NO: 44968 - DNA, 25 bp, Homo sapien
ttctggccttgacttatggctcgct

SEQ ID NO: 44969 - DNA, 25 bp, Homo sapien
ggccttgacttatggctcgcttttt

SEQ ID NO: 44970 - DNA, 25 bp, Homo sapien
acataaaacacacaagcgccccgtg

SEQ ID NO: 44971 - DNA, 25 bp, Homo sapien
tcacaaaaggcgtggagactcggag

SEQ ID NO: 44972 - DNA, 25 bp, Homo sapien
tggagactcggagacggacgttttt

SEQ ID NO: 44973 - DNA, 25 bp, Homo sapien
gggattagaagcatgagccgctgtg

SEQ ID NO: 44974 - DNA, 25 bp, Homo sapien
tgacggggccttttagtgggaggag

SEQ ID NO: 44975 - DNA, 25 bp, Homo sapien
ttgccattacactacgtccagtaag

SEQ ID NO: 44976 - DNA, 25 bp, Homo sapien
gtccagtaagctccagactttcgga

SEQ ID NO: 44977 - DNA, 25 bp, Homo sapien
ggtggacgggaatgctgtcatggat

SEQ ID NO: 44978 - DNA, 25 bp, Homo sapien
tgtcatggatgggatcttgccaaga

SEQ ID NO: 44979 - DNA, 25 bp, Homo sapien
atcttgccaagaaccatcacgtgtt

SEQ ID NO: 44980 - DNA, 25 bp, Homo sapien
aaccatcacgtgttaatttagttgc

SEQ ID NO: 44981 - DNA, 25 bp, Homo sapien
aatattcttttctgggtttatatga

SEQ ID NO: 44982 - DNA, 25 bp, Homo sapien
tatatgagacagttttcactcctgt

SEQ ID NO: 44983 - DNA, 25 bp, Homo sapien
ggctgaggctgaaagtgcggtggcg

SEQ ID NO: 44984 - DNA, 25 bp, Homo sapien
ccagccgggttctcatggtgctcaa

SEQ ID NO: 44985 - DNA, 25 bp, Homo sapien
cagccgggttctcatggtgctcaaa

SEQ ID NO: 44986 - DNA, 25 bp, Homo sapien
agccgggttctcatggtgctcaaac

SEQ ID NO: 44987 - DNA, 25 bp, Homo sapien
gccgggttctcatggtgctcaaacc

SEQ ID NO: 44988 - DNA, 25 bp, Homo sapien
ccgggttctcatggtgctcaaaccc

SEQ ID NO: 44989 - DNA, 25 bp, Homo sapien
gggttctcatggtgctcaaacccgc

SEQ ID NO: 44990 - DNA, 25 bp, Homo sapien
ggttctcatggtgctcaaacccgct

SEQ ID NO: 44991 - DNA, 25 bp, Homo sapien
gttctcatggtgctcaaacccgctc

SEQ ID NO: 44992 - DNA, 25 bp, Homo sapien
tacgtcctgcactttctcggaccag

SEQ ID NO: 44993 - DNA, 25 bp, Homo sapien
acgtcctgcactttctcggaccagt

SEQ ID NO: 44994 - DNA, 25 bp, Homo sapien
taagtgtgaaacaacccagggccag

SEQ ID NO: 44995 - DNA, 25 bp, Homo sapien
aagtgtgaaacaacccagggccagg

SEQ ID NO: 44996 - DNA, 25 bp, Homo sapien
gtgaaacaacccagggccagggcct

SEQ ID NO: 44997 - DNA, 25 bp, Homo sapien
ggcacccaaccgaggggctagaatc

SEQ ID NO: 44998 - DNA, 25 bp, Homo sapien
ggggctagaatcgggacaaagcagc

SEQ ID NO: 44999 - DNA, 25 bp, Homo sapien
tcaggccagaggtcatcaggggaga

SEQ ID NO: 45000 - DNA, 25 bp, Homo sapien
gccagaggtcatcaggggagatggg

SEQ ID NO: 45001 - DNA, 25 bp, Homo sapien
atagaaagcaaagcgtggagacgaa

SEQ ID NO: 45002 - DNA, 25 bp, Homo sapien
gcgtggagacgaagggatgggtgtg

SEQ ID NO: 45003 - DNA, 25 bp, Homo sapien
gatgggtgtgtgtatctatatatct

SEQ ID NO: 45004 - DNA, 25 bp, Homo sapien
ggagatgggagaagacaagggcctg

SEQ ID NO: 45005 - DNA, 25 bp, Homo sapien
ccggggagccagcacagaaagccgg

SEQ ID NO: 45006 - DNA, 25 bp, Homo sapien
cagcacagaaagccggcctgggtgt

SEQ ID NO: 45007 - DNA, 25 bp, Homo sapien
ccggcctgggtgtcgagggtgccgg

SEQ ID NO: 45008 - DNA, 25 bp, Homo sapien
ggatgtctcttcagtttatgacaca

SEQ ID NO: 45009 - DNA, 25 bp, Homo sapien
tgacacaatagcttcctgggcaaca

SEQ ID NO: 45010 - DNA, 25 bp, Homo sapien
gctctctattgcattcattgtactg

SEQ ID NO: 45011 - DNA, 25 bp, Homo sapien
agctttgatgagcttcctcacaggc

SEQ ID NO: 45012 - DNA, 25 bp, Homo sapien
gatgagcttcctcacaggccaatta

SEQ ID NO: 45013 - DNA, 25 bp, Homo sapien
cacaggccaattattccagaagtct

SEQ ID NO: 45014 - DNA, 25 bp, Homo sapien
ccaattattccagaagtctgtggat

SEQ ID NO: 45015 - DNA, 25 bp, Homo sapien
attccagaagtctgtggatgccgct

SEQ ID NO: 45016 - DNA, 25 bp, Homo sapien
tcccacacagcaagaggactcatgg

SEQ ID NO: 45017 - DNA, 25 bp, Homo sapien
acagcaagaggactcatggacgtct

SEQ ID NO: 45018 - DNA, 25 bp, Homo sapien
agaggactcatggacgtctctagaa

SEQ ID NO: 45019 - DNA, 25 bp, Homo sapien
tctagaacatatcttgtggccattt

SEQ ID NO: 45020 - DNA, 25 bp, Homo sapien
taccagactccgacacaatgggcca

SEQ ID NO: 45021 - DNA, 25 bp, Homo sapien
gttctcagaatgactgtaagatagc

SEQ ID NO: 45022 - DNA, 25 bp, Homo sapien
ttctcagaatgactgtaagatagct

SEQ ID NO: 45023 - DNA, 25 bp, Homo sapien
tctccccaactaaaatacaatgggg

SEQ ID NO: 45024 - DNA, 25 bp, Homo sapien
gcgctggtggcggaggtagcggggc

SEQ ID NO: 45025 - DNA, 25 bp, Homo sapien
gacctccaccagcaacgaatgtgag

SEQ ID NO: 45026 - DNA, 25 bp, Homo sapien
cctccaccagcaacgaatgtgagac

SEQ ID NO: 45027 - DNA, 25 bp, Homo sapien
gaatgtgagacatcggttgtgtggc

SEQ ID NO: 45028 - DNA, 25 bp, Homo sapien
gtgagacatcggttgtgtggcacga

SEQ ID NO: 45029 - DNA, 25 bp, Homo sapien
gacatcggttgtgtggcacgataat

SEQ ID NO: 45030 - DNA, 25 bp, Homo sapien
cggttgtgtggcacgataataccaa

SEQ ID NO: 45031 - DNA, 25 bp, Homo sapien
taacccagattatgactgcaatcgg

SEQ ID NO: 45032 - DNA, 25 bp, Homo sapien
atgactgcaatcgggcagggcctga

SEQ ID NO: 45033 - DNA, 25 bp, Homo sapien
actgcaatcgggcagggcctgacat

SEQ ID NO: 45034 - DNA, 25 bp, Homo sapien
caatcgggcagggcctgacataatg

SEQ ID NO: 45035 - DNA, 25 bp, Homo sapien
tggaggactttctttccctttatgg

SEQ ID NO: 45036 - DNA, 25 bp, Homo sapien
ttttagagccaagttaacaagtact

SEQ ID NO: 45037 - DNA, 25 bp, Homo sapien
tttagagccaagttaacaagtactt

SEQ ID NO: 45038 - DNA, 25 bp, Homo sapien
caagtacttcagcaaaacatgctag

SEQ ID NO: 45039 - DNA, 25 bp, Homo sapien
catgctagttttatgcaggggattc

SEQ ID NO: 45040 - DNA, 25 bp, Homo sapien
tatgcaggggattctgtattccaaa

SEQ ID NO: 45041 - DNA, 25 bp, Homo sapien
tgtattccaaatggatacaatccga

SEQ ID NO: 45042 - DNA, 25 bp, Homo sapien
gtattccaaatggatacaatccgac

SEQ ID NO: 45043 - DNA, 25 bp, Homo sapien
gactcttatttagcaaatgcaacag

SEQ ID NO: 45044 - DNA, 25 bp, Homo sapien
tttagcaaatgcaacagacaagaat

SEQ ID NO: 45045 - DNA, 25 bp, Homo sapien
gcaaatgcaacagacaagaatatcc

SEQ ID NO: 45046 - DNA, 25 bp, Homo sapien
gcaacagacaagaatatccaacttg

SEQ ID NO: 45047 - DNA, 25 bp, Homo sapien
gactttttccaaaagtgtataagct

SEQ ID NO: 45048 - DNA, 25 bp, Homo sapien
tgcttggcctttaagaataatcaca

SEQ ID NO: 45049 - DNA, 25 bp, Homo sapien
tatacaaatttgttgcagaagtgcc

SEQ ID NO: 45050 - DNA, 25 bp, Homo sapien
ttttgtctgactcatctgagttata

SEQ ID NO: 45051 - DNA, 25 bp, Homo sapien
aaaaactggctttaaagcaggagct

SEQ ID NO: 45052 - DNA, 25 bp, Homo sapien
ggcccctaagccagacggggactag

SEQ ID NO: 45053 - DNA, 25 bp, Homo sapien
aagccagacggggactagctttggc

SEQ ID NO: 45054 - DNA, 25 bp, Homo sapien
tgagacggagtcttgctctgtggct

SEQ ID NO: 45055 - DNA, 25 bp, Homo sapien
gctctgtggctcaggctggagtaca

SEQ ID NO: 45056 - DNA, 25 bp, Homo sapien
ctcctggctgtgttcaagtggttct

SEQ ID NO: 45057 - DNA, 25 bp, Homo sapien
agctggggttagagcaccctgtcac

SEQ ID NO: 45058 - DNA, 25 bp, Homo sapien
cgccccgctaattttgtatttctag

SEQ ID NO: 45059 - DNA, 25 bp, Homo sapien
gatgaagtttcactatgttggccag

SEQ ID NO: 45060 - DNA, 25 bp, Homo sapien
tagtgtgtaggtctgtaggcttttg

SEQ ID NO: 45061 - DNA, 25 bp, Homo sapien
tgtaggcttttgatggtaaccacaa

SEQ ID NO: 45062 - DNA, 25 bp, Homo sapien
gggcagcctaggaggccgaccctct

SEQ ID NO: 45063 - DNA, 25 bp, Homo sapien
cctaggaggccgaccctctttggag

SEQ ID NO: 45064 - DNA, 25 bp, Homo sapien
ggaggccgaccctctttggagtcct

SEQ ID NO: 45065 - DNA, 25 bp, Homo sapien
ccctctttggagtcctgctgtctgg

SEQ ID NO: 45066 - DNA, 25 bp, Homo sapien
ctctttggagtcctgctgtctgggt

SEQ ID NO: 45067 - DNA, 25 bp, Homo sapien
tctttggagtcctgctgtctgggtg

SEQ ID NO: 45068 - DNA, 25 bp, Homo sapien
tttggagtcctgctgtctgggtgcc

SEQ ID NO: 45069 - DNA, 25 bp, Homo sapien
aggtagtggccatctcatacctact

SEQ ID NO: 45070 - DNA, 25 bp, Homo sapien
gtagtggccatctcatacctactct

SEQ ID NO: 45071 - DNA, 25 bp, Homo sapien
agtggccatctcatacctactctga

SEQ ID NO: 45072 - DNA, 25 bp, Homo sapien
gtggccatctcatacctactctgaa

SEQ ID NO: 45073 - DNA, 25 bp, Homo sapien
gaaatgcaaaacttctattctgttg

SEQ ID NO: 45074 - DNA, 25 bp, Homo sapien
aatgcaaaacttctattctgttgag

SEQ ID NO: 45075 - DNA, 25 bp, Homo sapien
atgcaaaacttctattctgttgagt

SEQ ID NO: 45076 - DNA, 25 bp, Homo sapien
tgcaaaacttctattctgttgagtg

SEQ ID NO: 45077 - DNA, 25 bp, Homo sapien
gcaaaacttctattctgttgagtga

SEQ ID NO: 45078 - DNA, 25 bp, Homo sapien
gatgactgcctcatcttcctcagtt

SEQ ID NO: 45079 - DNA, 25 bp, Homo sapien
tcccctgtgccgtagtttgtctcct

SEQ ID NO: 45080 - DNA, 25 bp, Homo sapien
ccgtagtttgtctcctgggactggg

SEQ ID NO: 45081 - DNA, 25 bp, Homo sapien
accctgtccgggtccttgctcggag

SEQ ID NO: 45082 - DNA, 25 bp, Homo sapien
ccctgtccgggtccttgctcggaga

SEQ ID NO: 45083 - DNA, 25 bp, Homo sapien
agggggcatcttctgaacagcctgc

SEQ ID NO: 45084 - DNA, 25 bp, Homo sapien
gggggcatcttctgaacagcctgcc

SEQ ID NO: 45085 - DNA, 25 bp, Homo sapien
ggggcatcttctgaacagcctgcct

SEQ ID NO: 45086 - DNA, 25 bp, Homo sapien
aagggatcccggactctgtatgatt

SEQ ID NO: 45087 - DNA, 25 bp, Homo sapien
agggatcccggactctgtatgattg

SEQ ID NO: 45088 - DNA, 25 bp, Homo sapien
gggatcccggactctgtatgattga

SEQ ID NO: 45089 - DNA, 25 bp, Homo sapien
ggatcccggactctgtatgattgaa

SEQ ID NO: 45090 - DNA, 25 bp, Homo sapien
gatcccggactctgtatgattgaaa

SEQ ID NO: 45091 - DNA, 25 bp, Homo sapien
atcccggactctgtatgattgaaat

SEQ ID NO: 45092 - DNA, 25 bp, Homo sapien
tcccggactctgtatgattgaaata

SEQ ID NO: 45093 - DNA, 25 bp, Homo sapien
ccggactctgtatgattgaaataaa

SEQ ID NO: 45094 - DNA, 25 bp, Homo sapien
catcatcatcatggatttgctggtg

SEQ ID NO: 45095 - DNA, 25 bp, Homo sapien
atcatcatggatttgctggtgcagt

SEQ ID NO: 45096 - DNA, 25 bp, Homo sapien
atggatttgctggtgcagtacaact

SEQ ID NO: 45097 - DNA, 25 bp, Homo sapien
ttgctggtgcagtacaactaggctt

SEQ ID NO: 45098 - DNA, 25 bp, Homo sapien
gctggtgcagtacaactaggcttaa

SEQ ID NO: 45099 - DNA, 25 bp, Homo sapien
ggtgcagtacaactaggcttaatag

SEQ ID NO: 45100 - DNA, 25 bp, Homo sapien
acaactaggcttaatagggactcga

SEQ ID NO: 45101 - DNA, 25 bp, Homo sapien
ttaatagggactcgaattcaagctt

SEQ ID NO: 45102 - DNA, 25 bp, Homo sapien
agggactcgaattcaagcttctaac

SEQ ID NO: 45103 - DNA, 25 bp, Homo sapien
gactcgaattcaagcttctaacgtt

SEQ ID NO: 45104 - DNA, 25 bp, Homo sapien
tcgaattcaagcttctaacgttaga

SEQ ID NO: 45105 - DNA, 25 bp, Homo sapien
tgaaggctcagaagcatcctcctgc

SEQ ID NO: 45106 - DNA, 25 bp, Homo sapien
gaaggctcagaagcatcctcctgct

SEQ ID NO: 45107 - DNA, 25 bp, Homo sapien
aaggctcagaagcatcctcctgctc

SEQ ID NO: 45108 - DNA, 25 bp, Homo sapien
aggctcagaagcatcctcctgctca

SEQ ID NO: 45109 - DNA, 25 bp, Homo sapien
ggctcagaagcatcctcctgctcat

SEQ ID NO: 45110 - DNA, 25 bp, Homo sapien
gctcagaagcatcctcctgctcatc

SEQ ID NO: 45111 - DNA, 25 bp, Homo sapien
ctcagaagcatcctcctgctcatct

SEQ ID NO: 45112 - DNA, 25 bp, Homo sapien
tcagaagcatcctcctgctcatctg

SEQ ID NO: 45113 - DNA, 25 bp, Homo sapien
cagaagcatcctcctgctcatctgc

SEQ ID NO: 45114 - DNA, 25 bp, Homo sapien
agaagcatcctcctgctcatctgct

SEQ ID NO: 45115 - DNA, 25 bp, Homo sapien
atcctcctgctcatctgctttggct

SEQ ID NO: 45116 - DNA, 25 bp, Homo sapien
gaccgtgcagtctgcgctttcctct

SEQ ID NO: 45117 - DNA, 25 bp, Homo sapien
cctgcctagcccaggatgaagggct

SEQ ID NO: 45118 - DNA, 25 bp, Homo sapien
ctgcctagcccaggatgaagggctg

SEQ ID NO: 45119 - DNA, 25 bp, Homo sapien
ctcttttggggtagatgcggccccg

SEQ ID NO: 45120 - DNA, 25 bp, Homo sapien
ttttggggtagatgcggccccgatc

SEQ ID NO: 45121 - DNA, 25 bp, Homo sapien
cgatcaggcctgactcgctgctctt

SEQ ID NO: 45122 - DNA, 25 bp, Homo sapien
gatcaggcctgactcgctgctcttt

SEQ ID NO: 45123 - DNA, 25 bp, Homo sapien
atcaggcctgactcgctgctctttt

SEQ ID NO: 45124 - DNA, 25 bp, Homo sapien
ttttgttcccttctgtctgctcgaa

SEQ ID NO: 45125 - DNA, 25 bp, Homo sapien
tgttcccttctgtctgctcgaacca

SEQ ID NO: 45126 - DNA, 25 bp, Homo sapien
tgtctgctcgaaccacttgcctcgg

SEQ ID NO: 45127 - DNA, 25 bp, Homo sapien
gctcgaaccacttgcctcgggctaa

SEQ ID NO: 45128 - DNA, 25 bp, Homo sapien
tccacccggcactggggaagtcaag

SEQ ID NO: 45129 - DNA, 25 bp, Homo sapien
gggctctcagggagaactgcttccc

SEQ ID NO: 45130 - DNA, 25 bp, Homo sapien
gggagaactgcttcccctggcagag

SEQ ID NO: 45131 - DNA, 25 bp, Homo sapien
gagctgggtggcagctcttcctccc

SEQ ID NO: 45132 - DNA, 25 bp, Homo sapien
ctttttcattgtcatataaagctgg

SEQ ID NO: 45133 - DNA, 25 bp, Homo sapien
tctcgttgcctccttggtttcagaa

SEQ ID NO: 45134 - DNA, 25 bp, Homo sapien
ctcgttgcctccttggtttcagaag

SEQ ID NO: 45135 - DNA, 25 bp, Homo sapien
tcgttgcctccttggtttcagaaga

SEQ ID NO: 45136 - DNA, 25 bp, Homo sapien
cgttgcctccttggtttcagaagag

SEQ ID NO: 45137 - DNA, 25 bp, Homo sapien
gttgcctccttggtttcagaagaga

SEQ ID NO: 45138 - DNA, 25 bp, Homo sapien
ttgcctccttggtttcagaagagag

SEQ ID NO: 45139 - DNA, 25 bp, Homo sapien
tgcctccttggtttcagaagagagt

SEQ ID NO: 45140 - DNA, 25 bp, Homo sapien
gcctccttggtttcagaagagagta

SEQ ID NO: 45141 - DNA, 25 bp, Homo sapien
cctccttggtttcagaagagagtag

SEQ ID NO: 45142 - DNA, 25 bp, Homo sapien
aagtacctagtcctaattgcagaaa

SEQ ID NO: 45143 - DNA, 25 bp, Homo sapien
ctagtcctaattgcagaaagagcgg

SEQ ID NO: 45144 - DNA, 25 bp, Homo sapien
ctaattgcagaaagagcggtcagtt

SEQ ID NO: 45145 - DNA, 25 bp, Homo sapien
tccccacgagcacttcagatcagta

SEQ ID NO: 45146 - DNA, 25 bp, Homo sapien
gagcacttcagatcagtattgtatt

SEQ ID NO: 45147 - DNA, 25 bp, Homo sapien
gcacttcagatcagtattgtattca

SEQ ID NO: 45148 - DNA, 25 bp, Homo sapien
gctgggattccaggtgtaagccacc

SEQ ID NO: 45149 - DNA, 25 bp, Homo sapien
gattccaggtgtaagccaccgtgcc

SEQ ID NO: 45150 - DNA, 25 bp, Homo sapien
atacttattatttttgcttagtgca

SEQ ID NO: 45151 - DNA, 25 bp, Homo sapien
aatagtccattaactaatcacccag

SEQ ID NO: 45152 - DNA, 25 bp, Homo sapien
actaatcacccagaaataaccattg

SEQ ID NO: 45153 - DNA, 25 bp, Homo sapien
tgctatgcattttcttttggccttt

SEQ ID NO: 45154 - DNA, 25 bp, Homo sapien
tttggccttttttctaagtacatat

SEQ ID NO: 45155 - DNA, 25 bp, Homo sapien
gctattgtattttttaacttcatgt

SEQ ID NO: 45156 - DNA, 25 bp, Homo sapien
aacttcatgttttgtatcatgagca

SEQ ID NO: 45157 - DNA, 25 bp, Homo sapien
atgggaggtcagttaaagtacgaga

SEQ ID NO: 45158 - DNA, 25 bp, Homo sapien
aagtacgagataggtttggctgggt

SEQ ID NO: 45159 - DNA, 25 bp, Homo sapien
tatacggctgcgagaagacgacaga

SEQ ID NO: 45160 - DNA, 25 bp, Homo sapien
gacgacagaagggggaaattaatat

SEQ ID NO: 45161 - DNA, 25 bp, Homo sapien
gaaaggtcagggatagcaagcagag

SEQ ID NO: 45162 - DNA, 25 bp, Homo sapien
ggtcagggatagcaagcagagagag

SEQ ID NO: 45163 - DNA, 25 bp, Homo sapien
aagcagagagagggagcgagccggc

SEQ ID NO: 45164 - DNA, 25 bp, Homo sapien
cagagagagggagcgagccggctgc

SEQ ID NO: 45165 - DNA, 25 bp, Homo sapien
ctgccacacacgccaggtaaacaaa

SEQ ID NO: 45166 - DNA, 25 bp, Homo sapien
gccacacacgccaggtaaacaaaag

SEQ ID NO: 45167 - DNA, 25 bp, Homo sapien
cacacacgccaggtaaacaaaagcc

SEQ ID NO: 45168 - DNA, 25 bp, Homo sapien
cacacgccaggtaaacaaaagccaa

SEQ ID NO: 45169 - DNA, 25 bp, Homo sapien
cacgccaggtaaacaaaagccaaca

SEQ ID NO: 45170 - DNA, 25 bp, Homo sapien
cagaagacattggaagacctgtttt

SEQ ID NO: 45171 - DNA, 25 bp, Homo sapien
aaatcagcaattcaaggggagggta

SEQ ID NO: 45172 - DNA, 25 bp, Homo sapien
gaccaactaatatatgtaaagatgc

SEQ ID NO: 45173 - DNA, 25 bp, Homo sapien
aattaacaacgttggcctctcggat

SEQ ID NO: 45174 - DNA, 25 bp, Homo sapien
tccagtattggttgggattataagc

SEQ ID NO: 45175 - DNA, 25 bp, Homo sapien
atttcactgatagagaccagcatga

SEQ ID NO: 45176 - DNA, 25 bp, Homo sapien
gaccagcatgactgtctcaattgtt

SEQ ID NO: 45177 - DNA, 25 bp, Homo sapien
gcatgactgtctcaattgttaaact

SEQ ID NO: 45178 - DNA, 25 bp, Homo sapien
taaactattgaaatgcatctgtgtc

SEQ ID NO: 45179 - DNA, 25 bp, Homo sapien
gaaatgcatctgtgtcaatggtaaa

SEQ ID NO: 45180 - DNA, 25 bp, Homo sapien
aatattggtaggacttatgtagaca

SEQ ID NO: 45181 - DNA, 25 bp, Homo sapien
ccaaaaagatacaggtcaatagctt

SEQ ID NO: 45182 - DNA, 25 bp, Homo sapien
attctgaacaaaacaccaggcccag

SEQ ID NO: 45183 - DNA, 25 bp, Homo sapien
aaacaccaggcccagataatttcaa

SEQ ID NO: 45184 - DNA, 25 bp, Homo sapien
gcccagataatttcaaagttgtgcc

SEQ ID NO: 45185 - DNA, 25 bp, Homo sapien
gttgtgccaaactttaaagaaatga

SEQ ID NO: 45186 - DNA, 25 bp, Homo sapien
aaatgatcatttccagttttcaaac

SEQ ID NO: 45187 - DNA, 25 bp, Homo sapien
gatcatttccagttttcaaacagtt

SEQ ID NO: 45188 - DNA, 25 bp, Homo sapien
gtaagcttccaaattatcttgaggc

SEQ ID NO: 45189 - DNA, 25 bp, Homo sapien
gcttccaaattatcttgaggctagc

SEQ ID NO: 45190 - DNA, 25 bp, Homo sapien
caaattatcttgaggctagcacagc

SEQ ID NO: 45191 - DNA, 25 bp, Homo sapien
atcttgaggctagcacagccccgat

SEQ ID NO: 45192 - DNA, 25 bp, Homo sapien
tttggccaggtgtagggggcacgcc

SEQ ID NO: 45193 - DNA, 25 bp, Homo sapien
gtgtagggggcacgccagtaatccc

SEQ ID NO: 45194 - DNA, 25 bp, Homo sapien
gtttgtctgttatacatagcactgg

SEQ ID NO: 45195 - DNA, 25 bp, Homo sapien
acatagcactggtaccgcaaacatt

SEQ ID NO: 45196 - DNA, 25 bp, Homo sapien
cactggtaccgcaaacattttactt

SEQ ID NO: 45197 - DNA, 25 bp, Homo sapien
ttacttaaactcttaatagcatttc

SEQ ID NO: 45198 - DNA, 25 bp, Homo sapien
atagcatttctttcgccagatactt

SEQ ID NO: 45199 - DNA, 25 bp, Homo sapien
catttctttcgccagatactttaat

SEQ ID NO: 45200 - DNA, 25 bp, Homo sapien
atactttaatatttcaccttacatt

SEQ ID NO: 45201 - DNA, 25 bp, Homo sapien
atatttcaccttacattaatcctgg

SEQ ID NO: 45202 - DNA, 25 bp, Homo sapien
ggattcacatttctttaattgaaat

SEQ ID NO: 45203 - DNA, 25 bp, Homo sapien
ccactttgacgaaaagaaggagatc

SEQ ID NO: 45204 - DNA, 25 bp, Homo sapien
ggaaggaccctgacctggaggccaa

SEQ ID NO: 45205 - DNA, 25 bp, Homo sapien
aaggaccctgacctggaggccaagc

SEQ ID NO: 45206 - DNA, 25 bp, Homo sapien
agaaccggcgcttcaaggagaaggt

SEQ ID NO: 45207 - DNA, 25 bp, Homo sapien
acgctgaagcgacagaaggctggca

SEQ ID NO: 45208 - DNA, 25 bp, Homo sapien
tgcccagtccttgactcgtccatgg

SEQ ID NO: 45209 - DNA, 25 bp, Homo sapien
cccagtccttgactcgtccatggag

SEQ ID NO: 45210 - DNA, 25 bp, Homo sapien
ctgagggtcggaggaaccttccttg

SEQ ID NO: 45211 - DNA, 25 bp, Homo sapien
agtgccccacagcagaacccgtggg

SEQ ID NO: 45212 - DNA, 25 bp, Homo sapien
cagcagaacccgtgggcgctcgtgt

SEQ ID NO: 45213 - DNA, 25 bp, Homo sapien
ttccctgagccctggccaagattca

SEQ ID NO: 45214 - DNA, 25 bp, Homo sapien
gccctggccaagattcaggctgcag

SEQ ID NO: 45215 - DNA, 25 bp, Homo sapien
caagattcaggctgcaggggaagaa

SEQ ID NO: 45216 - DNA, 25 bp, Homo sapien
acatgaccgggaggttgtgacccca

SEQ ID NO: 45217 - DNA, 25 bp, Homo sapien
catgaccgggaggttgtgaccccaa

SEQ ID NO: 45218 - DNA, 25 bp, Homo sapien
ggtgccgcatacaggaggtgcttaa

SEQ ID NO: 45219 - DNA, 25 bp, Homo sapien
tgggagctttcctcagcaccttcac

SEQ ID NO: 45220 - DNA, 25 bp, Homo sapien
ccagtgtagcctcctgtcagtgggg

SEQ ID NO: 45221 - DNA, 25 bp, Homo sapien
gggctggacccttctaattcagagg

SEQ ID NO: 45222 - DNA, 25 bp, Homo sapien
attcagaggtctcatgcctgccctt

SEQ ID NO: 45223 - DNA, 25 bp, Homo sapien
tcagaggtctcatgcctgcccttgc

SEQ ID NO: 45224 - DNA, 25 bp, Homo sapien
gcccagatgcccagggtcgtgcact

SEQ ID NO: 45225 - DNA, 25 bp, Homo sapien
agatgcccagggtcgtgcactctct

SEQ ID NO: 45226 - DNA, 25 bp, Homo sapien
atgcccagggtcgtgcactctctgg

SEQ ID NO: 45227 - DNA, 25 bp, Homo sapien
ccagggtcgtgcactctctgggata

SEQ ID NO: 45228 - DNA, 25 bp, Homo sapien
cagggtcgtgcactctctgggatac

SEQ ID NO: 45229 - DNA, 25 bp, Homo sapien
agggtcgtgcactctctgggatacc

SEQ ID NO: 45230 - DNA, 25 bp, Homo sapien
accagttcagtctccacatttctgg

SEQ ID NO: 45231 - DNA, 25 bp, Homo sapien
ccagttcagtctccacatttctggt

SEQ ID NO: 45232 - DNA, 25 bp, Homo sapien
gttcagtctccacatttctggtttt

SEQ ID NO: 45233 - DNA, 25 bp, Homo sapien
agtctccacatttctggttttctgt

SEQ ID NO: 45234 - DNA, 25 bp, Homo sapien
agaagcagacatcaggtgctgcact

SEQ ID NO: 45235 - DNA, 25 bp, Homo sapien
ccacccataggtacacacaaaaaag

SEQ ID NO: 45236 - DNA, 25 bp, Homo sapien
tacacacaaaaaaggggggatcgag

SEQ ID NO: 45237 - DNA, 25 bp, Homo sapien
gatcgaggccagacacggtggctca

SEQ ID NO: 45238 - DNA, 25 bp, Homo sapien
cccacccagcagccgaggcaaaagg

SEQ ID NO: 45239 - DNA, 25 bp, Homo sapien
ggtggaacacttgaggtcaggggtt

SEQ ID NO: 45240 - DNA, 25 bp, Homo sapien
gaacacttgaggtcaggggtttgag

SEQ ID NO: 45241 - DNA, 25 bp, Homo sapien
gcagccgaggcaaaagggttcccaa

SEQ ID NO: 45242 - DNA, 25 bp, Homo sapien
aggaggattgggagcctgtcagccc

SEQ ID NO: 45243 - DNA, 25 bp, Homo sapien
ccccgtcctcatttctgtaatgatg

SEQ ID NO: 45244 - DNA, 25 bp, Homo sapien
ttctgtaatgatggatctcgctccc

SEQ ID NO: 45245 - DNA, 25 bp, Homo sapien
ggttcccaaagtggagaggagtaag

SEQ ID NO: 45246 - DNA, 25 bp, Homo sapien
gatcatgcagctgcttcgtgagatg

SEQ ID NO: 45247 - DNA, 25 bp, Homo sapien
tgcttcgtgagatgcagaacccccg

SEQ ID NO: 45248 - DNA, 25 bp, Homo sapien
aggcttgggcagcaacccctgcatt

SEQ ID NO: 45249 - DNA, 25 bp, Homo sapien
tttttaccgggctgacgagaatgat

SEQ ID NO: 45250 - DNA, 25 bp, Homo sapien
ttaccgggctgacgagaatgatgag

SEQ ID NO: 45251 - DNA, 25 bp, Homo sapien
tttacccttacagtagcaagcatag

SEQ ID NO: 45252 - DNA, 25 bp, Homo sapien
cccttacagtagcaagcatagaccc

SEQ ID NO: 45253 - DNA, 25 bp, Homo sapien
cttacagtagcaagcatagacccct

SEQ ID NO: 45254 - DNA, 25 bp, Homo sapien
agtagcaagcatagacccctgtcta

SEQ ID NO: 45255 - DNA, 25 bp, Homo sapien
gtagcaagcatagacccctgtctaa

SEQ ID NO: 45256 - DNA, 25 bp, Homo sapien
tagcaagcatagacccctgtctaac

SEQ ID NO: 45257 - DNA, 25 bp, Homo sapien
agcatagacccctgtctaacggggg

SEQ ID NO: 45258 - DNA, 25 bp, Homo sapien
gcatagacccctgtctaacgggggt

SEQ ID NO: 45259 - DNA, 25 bp, Homo sapien
gtgaagatcactgtcatctaaaagc

SEQ ID NO: 45260 - DNA, 25 bp, Homo sapien
ctgtcatctaaaagctggccactaa

SEQ ID NO: 45261 - DNA, 25 bp, Homo sapien
gtcatctaaaagctggccactaaat

SEQ ID NO: 45262 - DNA, 25 bp, Homo sapien
gttttagtgcgagttaccgttactg

SEQ ID NO: 45263 - DNA, 25 bp, Homo sapien
gtgcgagttaccgttactgtatttg

SEQ ID NO: 45264 - DNA, 25 bp, Homo sapien
gttaccgttactgtatttgtgtatt

SEQ ID NO: 45265 - DNA, 25 bp, Homo sapien
gtatttgtgtattgtaaaggtggac

SEQ ID NO: 45266 - DNA, 25 bp, Homo sapien
aaaggtggacattctaattacatta

SEQ ID NO: 45267 - DNA, 25 bp, Homo sapien
gtataagtacattcctgtttttgtg

SEQ ID NO: 45268 - DNA, 25 bp, Homo sapien
agtacattcctgtttttgtgacaaa

SEQ ID NO: 45269 - DNA, 25 bp, Homo sapien
aagaatattagaagtgatgcatgaa

SEQ ID NO: 45270 - DNA, 25 bp, Homo sapien
taatggctatcagaagtatgctttg

SEQ ID NO: 45271 - DNA, 25 bp, Homo sapien
agtatgctttgttttagtgcgagtt

SEQ ID NO: 45272 - DNA, 25 bp, Homo sapien
tatgctttgttttagtgcgagttac

SEQ ID NO: 45273 - DNA, 25 bp, Homo sapien
gtatacttttctctcaacattgttt

SEQ ID NO: 45274 - DNA, 25 bp, Homo sapien
tatacttttctctcaacattgtttt

SEQ ID NO: 45275 - DNA, 25 bp, Homo sapien
tacttttctctcaacattgttttgg

SEQ ID NO: 45276 - DNA, 25 bp, Homo sapien
acttttctctcaacattgttttggt

SEQ ID NO: 45277 - DNA, 25 bp, Homo sapien
ttttctctcaacattgttttggttt

SEQ ID NO: 45278 - DNA, 25 bp, Homo sapien
ttctctcaacattgttttggtttat

SEQ ID NO: 45279 - DNA, 25 bp, Homo sapien
tcaacattgttttggtttatttagg

SEQ ID NO: 45280 - DNA, 25 bp, Homo sapien
cttttgatataactagtttctgagg

SEQ ID NO: 45281 - DNA, 25 bp, Homo sapien
gatataactagtttctgaggtattt

SEQ ID NO: 45282 - DNA, 25 bp, Homo sapien
tataactagtttctgaggtatttaa

SEQ ID NO: 45283 - DNA, 25 bp, Homo sapien
aaaaatattaagcttttggctcatt

SEQ ID NO: 45284 - DNA, 25 bp, Homo sapien
cgagacagccccttcaggatttcca

SEQ ID NO: 45285 - DNA, 25 bp, Homo sapien
ttccactggaccttgcccaaatagc

SEQ ID NO: 45286 - DNA, 25 bp, Homo sapien
tggaccttgcccaaatagcacctta

SEQ ID NO: 45287 - DNA, 25 bp, Homo sapien
ggaccttgcccaaatagcaccttag

SEQ ID NO: 45288 - DNA, 25 bp, Homo sapien
agacagggaggcagcctgtccatct

SEQ ID NO: 45289 - DNA, 25 bp, Homo sapien
gcagcctgtccatctgtgcataagg

SEQ ID NO: 45290 - DNA, 25 bp, Homo sapien
ctgtccatctgtgcataaggagagg

SEQ ID NO: 45291 - DNA, 25 bp, Homo sapien
ttttcaggggccttcacatggagga

SEQ ID NO: 45292 - DNA, 25 bp, Homo sapien
tgatcggctgccacctggagcagcc

SEQ ID NO: 45293 - DNA, 25 bp, Homo sapien
accctccaacgaggaagagaatgtg

SEQ ID NO: 45294 - DNA, 25 bp, Homo sapien
ctccaacgaggaagagaatgtgaag

SEQ ID NO: 45295 - DNA, 25 bp, Homo sapien
tgaagctggcccatgtgaagcacaa

SEQ ID NO: 45296 - DNA, 25 bp, Homo sapien
tgtgaagcacaaggagcagatctga

SEQ ID NO: 45297 - DNA, 25 bp, Homo sapien
tgccctggccttgagcatccactga

SEQ ID NO: 45298 - DNA, 25 bp, Homo sapien
gccttgagcatccactgactgtcca

SEQ ID NO: 45299 - DNA, 25 bp, Homo sapien
atccactgactgtccaagggccact

SEQ ID NO: 45300 - DNA, 25 bp, Homo sapien
tctgggtctccagagtttgccccgc

SEQ ID NO: 45301 - DNA, 25 bp, Homo sapien
acattccagactctagccatctcgg

SEQ ID NO: 45302 - DNA, 25 bp, Homo sapien
attccagactctagccatctcggca

SEQ ID NO: 45303 - DNA, 25 bp, Homo sapien
gactctagccatctcggcaggatct

SEQ ID NO: 45304 - DNA, 25 bp, Homo sapien
agccatctcggcaggatctcctggc

SEQ ID NO: 45305 - DNA, 25 bp, Homo sapien
aatagggatcggtgtgccccgctgc

SEQ ID NO: 45306 - DNA, 25 bp, Homo sapien
cctggctgggactgaaccacccaga

SEQ ID NO: 45307 - DNA, 25 bp, Homo sapien
tttcagccttgtgagtcacctggca

SEQ ID NO: 45308 - DNA, 25 bp, Homo sapien
ttgtgagtcacctggcaggccccag

SEQ ID NO: 45309 - DNA, 25 bp, Homo sapien
ccccagctgggctggctgtccgtgt

SEQ ID NO: 45310 - DNA, 25 bp, Homo sapien
ctcagcctggctggtgattccttgc

SEQ ID NO: 45311 - DNA, 25 bp, Homo sapien
ttgcaggccagaaatgaagagtccc

SEQ ID NO: 45312 - DNA, 25 bp, Homo sapien
aaagtccctgtggagtgtacttatt

SEQ ID NO: 45313 - DNA, 25 bp, Homo sapien
aagtccctgtggagtgtacttattt

SEQ ID NO: 45314 - DNA, 25 bp, Homo sapien
agtccctgtggagtgtacttattta

SEQ ID NO: 45315 - DNA, 25 bp, Homo sapien
gtccctgtggagtgtacttatttat

SEQ ID NO: 45316 - DNA, 25 bp, Homo sapien
cccttggtgctgtgtggtcccagtg

SEQ ID NO: 45317 - DNA, 25 bp, Homo sapien
gattttggaaacctggtagccacca

SEQ ID NO: 45318 - DNA, 25 bp, Homo sapien
tctctgccctgttggggcctaaatt

SEQ ID NO: 45319 - DNA, 25 bp, Homo sapien
gggcttttgggcaacctctccgtgt

SEQ ID NO: 45320 - DNA, 25 bp, Homo sapien
tccacactcgattgggccccaggtg

SEQ ID NO: 45321 - DNA, 25 bp, Homo sapien
ttttaagctgcttccttggcatttg

SEQ ID NO: 45322 - DNA, 25 bp, Homo sapien
gagcatggatcttttgtcctcactg

SEQ ID NO: 45323 - DNA, 25 bp, Homo sapien
ggatcttttgtcctcactgctttct

SEQ ID NO: 45324 - DNA, 25 bp, Homo sapien
tgtcctcactgctttctaatgggga

SEQ ID NO: 45325 - DNA, 25 bp, Homo sapien
gtcctcactgctttctaatggggag

SEQ ID NO: 45326 - DNA, 25 bp, Homo sapien
ccacacttgctctgaaaaccaagtg

SEQ ID NO: 45327 - DNA, 25 bp, Homo sapien
acttgctctgaaaaccaagtgtcag

SEQ ID NO: 45328 - DNA, 25 bp, Homo sapien
ttgctctgaaaaccaagtgtcagag

SEQ ID NO: 45329 - DNA, 25 bp, Homo sapien
ctctgaaaaccaagtgtcagagccc

SEQ ID NO: 45330 - DNA, 25 bp, Homo sapien
tctgaaaaccaagtgtcagagcccc

SEQ ID NO: 45331 - DNA, 25 bp, Homo sapien
tgaaaaccaagtgtcagagcccctt

SEQ ID NO: 45332 - DNA, 25 bp, Homo sapien
gcagcccagcggcacggagaaagac

SEQ ID NO: 45333 - DNA, 25 bp, Homo sapien
cagcccagcggcacggagaaagacg

SEQ ID NO: 45334 - DNA, 25 bp, Homo sapien
agcccagcggcacggagaaagacgc

SEQ ID NO: 45335 - DNA, 25 bp, Homo sapien
gcccagcggcacggagaaagacgcg

SEQ ID NO: 45336 - DNA, 25 bp, Homo sapien
cccagcggcacggagaaagacgcgg

SEQ ID NO: 45337 - DNA, 25 bp, Homo sapien
ccagcggcacggagaaagacgcggc

SEQ ID NO: 45338 - DNA, 25 bp, Homo sapien
gcggcacggagaaagacgcggctga

SEQ ID NO: 45339 - DNA, 25 bp, Homo sapien
cggcacggagaaagacgcggctgag

SEQ ID NO: 45340 - DNA, 25 bp, Homo sapien
gcacggagaaagacgcggctgaggc

SEQ ID NO: 45341 - DNA, 25 bp, Homo sapien
cacggagaaagacgcggctgaggcc

SEQ ID NO: 45342 - DNA, 25 bp, Homo sapien
cggagaaagacgcggctgaggcccg

SEQ ID NO: 45343 - DNA, 25 bp, Homo sapien
atgtatacgggttcttcgaatgtgt

SEQ ID NO: 45344 - DNA, 25 bp, Homo sapien
atacgggttcttcgaatgtgtggta

SEQ ID NO: 45345 - DNA, 25 bp, Homo sapien
gggttcttcgaatgtgtggtagggg

SEQ ID NO: 45346 - DNA, 25 bp, Homo sapien
tgggagggttcttctactattagga

SEQ ID NO: 45347 - DNA, 25 bp, Homo sapien
gagggttcttctactattaggactt

SEQ ID NO: 45348 - DNA, 25 bp, Homo sapien
gttcttctactattaggacttttcg

SEQ ID NO: 45349 - DNA, 25 bp, Homo sapien
tggaaaaagtcagggaggccagggg

SEQ ID NO: 45350 - DNA, 25 bp, Homo sapien
ggccagggggtgggcttgaaaccag

SEQ ID NO: 45351 - DNA, 25 bp, Homo sapien
agggggtgggcttgaaaccagcttg

SEQ ID NO: 45352 - DNA, 25 bp, Homo sapien
gtgggcttgaaaccagcttgggggg

SEQ ID NO: 45353 - DNA, 25 bp, Homo sapien
tgggcttgaaaccagcttggggggg

SEQ ID NO: 45354 - DNA, 25 bp, Homo sapien
ggaggaaatttgacctcttcccatt

SEQ ID NO: 45355 - DNA, 25 bp, Homo sapien
ttttttggcattaacatggactgta

SEQ ID NO: 45356 - DNA, 25 bp, Homo sapien
tggactgtattcatcaaggtattat

SEQ ID NO: 45357 - DNA, 25 bp, Homo sapien
aggtattataccacagcactctatg

SEQ ID NO: 45358 - DNA, 25 bp, Homo sapien
attataccacagcactctatggaaa

SEQ ID NO: 45359 - DNA, 25 bp, Homo sapien
cacagcactctatggaaatctcaag

SEQ ID NO: 45360 - DNA, 25 bp, Homo sapien
gcactctatggaaatctcaagatta

SEQ ID NO: 45361 - DNA, 25 bp, Homo sapien
gcacttcgtcatgacagtatagagt

SEQ ID NO: 45362 - DNA, 25 bp, Homo sapien
taaaactcattctattttttctcta

SEQ ID NO: 45363 - DNA, 25 bp, Homo sapien
ccctgttctctggttgaccattgga

SEQ ID NO: 45364 - DNA, 25 bp, Homo sapien
gttctctggttgaccattggataat

SEQ ID NO: 45365 - DNA, 25 bp, Homo sapien
tggttagcttgcgtttcttctgaaa

SEQ ID NO: 45366 - DNA, 25 bp, Homo sapien
ctgaaaagacattccacttggtggg

SEQ ID NO: 45367 - DNA, 25 bp, Homo sapien
tcggaggccctgactggtggggatt

SEQ ID NO: 45368 - DNA, 25 bp, Homo sapien
ggaagtgtgtgttagttggtcatct

SEQ ID NO: 45369 - DNA, 25 bp, Homo sapien
gttggtcatcttgtcagtcatggtg

SEQ ID NO: 45370 - DNA, 25 bp, Homo sapien
caaagtggctgtggtggggctactg

SEQ ID NO: 45371 - DNA, 25 bp, Homo sapien
cagcgggggcatctgaagacaccac

SEQ ID NO: 45372 - DNA, 25 bp, Homo sapien
gacaccactttgcagtgatgcagac

SEQ ID NO: 45373 - DNA, 25 bp, Homo sapien
tccttacttgctgtgtcctatcagg

SEQ ID NO: 45374 - DNA, 25 bp, Homo sapien
gtgtcctatcaggcaagttactttg

SEQ ID NO: 45375 - DNA, 25 bp, Homo sapien
tacggtgtgctgtgatcgtgcactc

SEQ ID NO: 45376 - DNA, 25 bp, Homo sapien
ccagccgcacacaggcctagaggta

SEQ ID NO: 45377 - DNA, 25 bp, Homo sapien
cgcacacaggcctagaggtaaccaa

SEQ ID NO: 45378 - DNA, 25 bp, Homo sapien
gcacacaggcctagaggtaaccaat

SEQ ID NO: 45379 - DNA, 25 bp, Homo sapien
cacaggcctagaggtaaccaataaa

SEQ ID NO: 45380 - DNA, 25 bp, Homo sapien
acaggcctagaggtaaccaataaag

SEQ ID NO: 45381 - DNA, 25 bp, Homo sapien
caggcctagaggtaaccaataaagt

SEQ ID NO: 45382 - DNA, 25 bp, Homo sapien
acacaattaggctggctaacggata

SEQ ID NO: 45383 - DNA, 25 bp, Homo sapien
ttaggctggctaacggatagtgagc

SEQ ID NO: 45384 - DNA, 25 bp, Homo sapien
gctggctaacggatagtgagcttgt

SEQ ID NO: 45385 - DNA, 25 bp, Homo sapien
ctggctaacggatagtgagcttgtg

SEQ ID NO: 45386 - DNA, 25 bp, Homo sapien
gctaacggatagtgagcttgtgccc

SEQ ID NO: 45387 - DNA, 25 bp, Homo sapien
taacggatagtgagcttgtgcccct

SEQ ID NO: 45388 - DNA, 25 bp, Homo sapien
tccaaactccacagtatgggaccct

SEQ ID NO: 45389 - DNA, 25 bp, Homo sapien
ccaaactccacagtatgggaccctg

SEQ ID NO: 45390 - DNA, 25 bp, Homo sapien
caaactccacagtatgggaccctgg

SEQ ID NO: 45391 - DNA, 25 bp, Homo sapien
aactccacagtatgggaccctggag

SEQ ID NO: 45392 - DNA, 25 bp, Homo sapien
gttataaaatattccaagatgagcc

SEQ ID NO: 45393 - DNA, 25 bp, Homo sapien
ttataaaatattccaagatgagcct

SEQ ID NO: 45394 - DNA, 25 bp, Homo sapien
ctcccctatttaaaccactctgtct

SEQ ID NO: 45395 - DNA, 25 bp, Homo sapien
tcccctatttaaaccactctgtctc

SEQ ID NO: 45396 - DNA, 25 bp, Homo sapien
tatttaaaccactctgtctccccca

SEQ ID NO: 45397 - DNA, 25 bp, Homo sapien
ttaaaccactctgtctcccccacaa

SEQ ID NO: 45398 - DNA, 25 bp, Homo sapien
ggccctctgatttgttctgttcctg

SEQ ID NO: 45399 - DNA, 25 bp, Homo sapien
cctgtctcaaatccaatagttcaca

SEQ ID NO: 45400 - DNA, 25 bp, Homo sapien
ctgtctcaaatccaatagttcacag

SEQ ID NO: 45401 - DNA, 25 bp, Homo sapien
tgtctcaaatccaatagttcacagc

SEQ ID NO: 45402 - DNA, 25 bp, Homo sapien
gtctcaaatccaatagttcacagct

SEQ ID NO: 45403 - DNA, 25 bp, Homo sapien
ccaaagtgtttgcttctccctttct

SEQ ID NO: 45404 - DNA, 25 bp, Homo sapien
gtgtttgcttctccctttctgcggc

SEQ ID NO: 45405 - DNA, 25 bp, Homo sapien
tgtttgcttctccctttctgcggcc

SEQ ID NO: 45406 - DNA, 25 bp, Homo sapien
gtttgcttctccctttctgcggcct

SEQ ID NO: 45407 - DNA, 25 bp, Homo sapien
ttgcttctccctttctgcggccttc

SEQ ID NO: 45408 - DNA, 25 bp, Homo sapien
cttctccctttctgcggccttcgcc

SEQ ID NO: 45409 - DNA, 25 bp, Homo sapien
ttctgcggccttcgccagcccaggc

SEQ ID NO: 45410 - DNA, 25 bp, Homo sapien
tctgcggccttcgccagcccaggct

SEQ ID NO: 45411 - DNA, 25 bp, Homo sapien
tgcggccttcgccagcccaggctcg

SEQ ID NO: 45412 - DNA, 25 bp, Homo sapien
cttcgccagcccaggctcggctgcc

SEQ ID NO: 45413 - DNA, 25 bp, Homo sapien
tcgccagcccaggctcggctgccac

SEQ ID NO: 45414 - DNA, 25 bp, Homo sapien
cgccagcccaggctcggctgccacc

SEQ ID NO: 45415 - DNA, 25 bp, Homo sapien
agcccaggctcggctgccacccagt

SEQ ID NO: 45416 - DNA, 25 bp, Homo sapien
cccaggctcggctgccacccagtgg

SEQ ID NO: 45417 - DNA, 25 bp, Homo sapien
aagggtggggtggaactgggcacat

SEQ ID NO: 45418 - DNA, 25 bp, Homo sapien
gtggaactgggcacatgccagcacc

SEQ ID NO: 45419 - DNA, 25 bp, Homo sapien
accactgtactccagactggataac

SEQ ID NO: 45420 - DNA, 25 bp, Homo sapien
gactggataacagcaagagcccatc

SEQ ID NO: 45421 - DNA, 25 bp, Homo sapien
aacagcaagagcccatcttttaaaa

SEQ ID NO: 45422 - DNA, 25 bp, Homo sapien
acttcatggttcatgtcatagccct

SEQ ID NO: 45423 - DNA, 25 bp, Homo sapien
tcatgtcatagccctagagaatgaa

SEQ ID NO: 45424 - DNA, 25 bp, Homo sapien
aaatattccttaaagtcaactgtat

SEQ ID NO: 45425 - DNA, 25 bp, Homo sapien
aagtcaactgtatttcattgtgatt

SEQ ID NO: 45426 - DNA, 25 bp, Homo sapien
ttcattgtgatttttgttttctttt

SEQ ID NO: 45427 - DNA, 25 bp, Homo sapien
tgttttctttttatcattgtatcaa

SEQ ID NO: 45428 - DNA, 25 bp, Homo sapien
gttagtccatttgaatccattttag

SEQ ID NO: 45429 - DNA, 25 bp, Homo sapien
ggctgaagcaggaggatagcttgag

SEQ ID NO: 45430 - DNA, 25 bp, Homo sapien
aaaggcttcacaatatgcatgtttt

SEQ ID NO: 45431 - DNA, 25 bp, Homo sapien
aatgtgggtgccatcttgagcgtgt

SEQ ID NO: 45432 - DNA, 25 bp, Homo sapien
atactgtattttcctgttatctact

SEQ ID NO: 45433 - DNA, 25 bp, Homo sapien
gttatctacttaagtctagttctac

SEQ ID NO: 45434 - DNA, 25 bp, Homo sapien
ttctactttttcccaataatttcag

SEQ ID NO: 45435 - DNA, 25 bp, Homo sapien
gcttgagatattatactatctccct

SEQ ID NO: 45436 - DNA, 25 bp, Homo sapien
tgatcatttctccatcataaaggaa

SEQ ID NO: 45437 - DNA, 25 bp, Homo sapien
aagaagagacttcattgtgtgtgtg

SEQ ID NO: 45438 - DNA, 25 bp, Homo sapien
tagagtttcactgttgtcacccagg

SEQ ID NO: 45439 - DNA, 25 bp, Homo sapien
ttcctggggtacaagcgattctcct

SEQ ID NO: 45440 - DNA, 25 bp, Homo sapien
gcctcagcttcctgtgtagctgggg

SEQ ID NO: 45441 - DNA, 25 bp, Homo sapien
agtctgtgtgtggcctggtaggatg

SEQ ID NO: 45442 - DNA, 25 bp, Homo sapien
ccctgtccacctctataagaactgg

SEQ ID NO: 45443 - DNA, 25 bp, Homo sapien
cagccatctcccatatgatgtcacc

SEQ ID NO: 45444 - DNA, 25 bp, Homo sapien
caccccgaggtccagagacgactgg

SEQ ID NO: 45445 - DNA, 25 bp, Homo sapien
tcctcgccatgactgataagttcct

SEQ ID NO: 45446 - DNA, 25 bp, Homo sapien
tgataagttccttttagccatcacc

SEQ ID NO: 45447 - DNA, 25 bp, Homo sapien
tcacctcatctgtggaccaaattcc

SEQ ID NO: 45448 - DNA, 25 bp, Homo sapien
accccagcctacgcatgggatttca

SEQ ID NO: 45449 - DNA, 25 bp, Homo sapien
gccaggggtactcagaggggttcct

SEQ ID NO: 45450 - DNA, 25 bp, Homo sapien
aatgctcgaagctcctgctagagag

SEQ ID NO: 45451 - DNA, 25 bp, Homo sapien
gagagctgagctgagagacggcgtg

SEQ ID NO: 45452 - DNA, 25 bp, Homo sapien
aagaattcggcacgaggcttcagcg

SEQ ID NO: 45453 - DNA, 25 bp, Homo sapien
gctcccggctcgtatgttgtgggga

SEQ ID NO: 45454 - DNA, 25 bp, Homo sapien
tccccaacctgaatctccagaattc

SEQ ID NO: 45455 - DNA, 25 bp, Homo sapien
tgctgaagccacacagaacacctcc

SEQ ID NO: 45456 - DNA, 25 bp, Homo sapien
cggccccggtgactgaagagatgct

SEQ ID NO: 45457 - DNA, 25 bp, Homo sapien
tgcaagtacagccacatggagcccc

SEQ ID NO: 45458 - DNA, 25 bp, Homo sapien
gcgcttcttctcaacacaatacaag

SEQ ID NO: 45459 - DNA, 25 bp, Homo sapien
ggacgagtttcctttcaagtaccag

SEQ ID NO: 45460 - DNA, 25 bp, Homo sapien
taccagggcccagcagccctgagac

SEQ ID NO: 45461 - DNA, 25 bp, Homo sapien
ctcaccagcgcggctgcagggagaa

SEQ ID NO: 45462 - DNA, 25 bp, Homo sapien
ggagaagatagaccctctggtcccc

SEQ ID NO: 45463 - DNA, 25 bp, Homo sapien
ttgtccttcatcgagacctcagcct

SEQ ID NO: 45464 - DNA, 25 bp, Homo sapien
gagacctcagccttggattccacta

SEQ ID NO: 45465 - DNA, 25 bp, Homo sapien
agacctcagccttggattccactaa

SEQ ID NO: 45466 - DNA, 25 bp, Homo sapien
tcagccttggattccactaacgtag

SEQ ID NO: 45467 - DNA, 25 bp, Homo sapien
ttggattccactaacgtagaggaag

SEQ ID NO: 45468 - DNA, 25 bp, Homo sapien
tccactaacgtagaggaagcattca

SEQ ID NO: 45469 - DNA, 25 bp, Homo sapien
ccactaacgtagaggaagcattcaa

SEQ ID NO: 45470 - DNA, 25 bp, Homo sapien
gaagcattcaagaacatcctcacag

SEQ ID NO: 45471 - DNA, 25 bp, Homo sapien
gcattcaagaacatcctcacagaga

SEQ ID NO: 45472 - DNA, 25 bp, Homo sapien
agaacatcctcacagagatctaccg

SEQ ID NO: 45473 - DNA, 25 bp, Homo sapien
tcctcacagagatctaccgcatcgt

SEQ ID NO: 45474 - DNA, 25 bp, Homo sapien
tcacagagatctaccgcatcgtgtc

SEQ ID NO: 45475 - DNA, 25 bp, Homo sapien
gagatctaccgcatcgtgtcacaga

SEQ ID NO: 45476 - DNA, 25 bp, Homo sapien
cgcatcgtgtcacagaaacagatcg

SEQ ID NO: 45477 - DNA, 25 bp, Homo sapien
tgtcacagaaacagatcgcagaccg

SEQ ID NO: 45478 - DNA, 25 bp, Homo sapien
tcccagtgagctctgcacggccggg

SEQ ID NO: 45479 - DNA, 25 bp, Homo sapien
gaatataatatttccatttaggtaa

SEQ ID NO: 45480 - DNA, 25 bp, Homo sapien
gaatgtcataatttcaatttaatgt

SEQ ID NO: 45481 - DNA, 25 bp, Homo sapien
gaagtagaatggtgtagtctaattc

SEQ ID NO: 45482 - DNA, 25 bp, Homo sapien
aatgtgacaaaatctattctcttac

SEQ ID NO: 45483 - DNA, 25 bp, Homo sapien
gtgacaaaatctattctcttacact

SEQ ID NO: 45484 - DNA, 25 bp, Homo sapien
ggtgtagtctaattcaataaagtca

SEQ ID NO: 45485 - DNA, 25 bp, Homo sapien
gtagtctaattcaataaagtcatca

SEQ ID NO: 45486 - DNA, 25 bp, Homo sapien
aaagtcatcatttctttgctatgac

SEQ ID NO: 45487 - DNA, 25 bp, Homo sapien
aagtcatcatttctttgctatgaca

SEQ ID NO: 45488 - DNA, 25 bp, Homo sapien
tcatcatttctttgctatgacaaaa

SEQ ID NO: 45489 - DNA, 25 bp, Homo sapien
tgtttaaaacttaatatctttggca

SEQ ID NO: 45490 - DNA, 25 bp, Homo sapien
atgcgcaacaacctctcgctggggg

SEQ ID NO: 45491 - DNA, 25 bp, Homo sapien
ccgaagctctgcgcatgcgcgcacc

SEQ ID NO: 45492 - DNA, 25 bp, Homo sapien
ccccgcggacccagcatccccgcag

SEQ ID NO: 45493 - DNA, 25 bp, Homo sapien
ccgcggacccagcatccccgcagca

SEQ ID NO: 45494 - DNA, 25 bp, Homo sapien
cctgctcccgaggcccggcccgtga

SEQ ID NO: 45495 - DNA, 25 bp, Homo sapien
ggaaccctgcctgagacgcctccat

SEQ ID NO: 45496 - DNA, 25 bp, Homo sapien
gagacgcctccattaccactgcgca

SEQ ID NO: 45497 - DNA, 25 bp, Homo sapien
acgcctccattaccactgcgcagtg

SEQ ID NO: 45498 - DNA, 25 bp, Homo sapien
ccactgcgcagtgagatgaggggac

SEQ ID NO: 45499 - DNA, 25 bp, Homo sapien
aggggactcacagttgccaagaggg

SEQ ID NO: 45500 - DNA, 25 bp, Homo sapien
actcacagttgccaagaggggtctt

SEQ ID NO: 45501 - DNA, 25 bp, Homo sapien
cctcccctgggccgctgaggccccg

SEQ ID NO: 45502 - DNA, 25 bp, Homo sapien
gtgctgcccgagcacctcccccgcc

SEQ ID NO: 45503 - DNA, 25 bp, Homo sapien
gaactttgcagctgcccttccctcc

SEQ ID NO: 45504 - DNA, 25 bp, Homo sapien
tttgcagctgcccttccctccccgt

SEQ ID NO: 45505 - DNA, 25 bp, Homo sapien
agaattatttattttcgccaaagca

SEQ ID NO: 45506 - DNA, 25 bp, Homo sapien
tatttgagccttactttaaaaatat

SEQ ID NO: 45507 - DNA, 25 bp, Homo sapien
gagatttaagctctgtcagtatttt

SEQ ID NO: 45508 - DNA, 25 bp, Homo sapien
aagctctgtcagtattttcatttac

SEQ ID NO: 45509 - DNA, 25 bp, Homo sapien
gtattttcatttactgatagcattt

SEQ ID NO: 45510 - DNA, 25 bp, Homo sapien
gtatatttcattattatccttcata

SEQ ID NO: 45511 - DNA, 25 bp, Homo sapien
atttcattattatccttcataacag

SEQ ID NO: 45512 - DNA, 25 bp, Homo sapien
tattatccttcataacagaattata

SEQ ID NO: 45513 - DNA, 25 bp, Homo sapien
tggtcttgaaataaattcttttgca

SEQ ID NO: 45514 - DNA, 25 bp, Homo sapien
atgaatttgttatttttcttgttgg

SEQ ID NO: 45515 - DNA, 25 bp, Homo sapien
gttatttttcttgttggtagatgtg

SEQ ID NO: 45516 - DNA, 25 bp, Homo sapien
aattcttttgcattcatttaaatat

SEQ ID NO: 45517 - DNA, 25 bp, Homo sapien
ctcccatctctttatagaaataaat

SEQ ID NO: 45518 - DNA, 25 bp, Homo sapien
aatgctaatattcaacataaacttc

SEQ ID NO: 45519 - DNA, 25 bp, Homo sapien
gtgagattttagcattaactctgtt

SEQ ID NO: 45520 - DNA, 25 bp, Homo sapien
atcttgaatttaaaacttctacctg

SEQ ID NO: 45521 - DNA, 25 bp, Homo sapien
gaatttaaaacttctacctgtagat

SEQ ID NO: 45522 - DNA, 25 bp, Homo sapien
acctgtagatattaagtttagcttc

SEQ ID NO: 45523 - DNA, 25 bp, Homo sapien
agtttagcttcttagtattttatgt

SEQ ID NO: 45524 - DNA, 25 bp, Homo sapien
agcttcttagtattttatgtgtgca

SEQ ID NO: 45525 - DNA, 25 bp, Homo sapien
gcttcttagtattttatgtgtgcac

SEQ ID NO: 45526 - DNA, 25 bp, Homo sapien
tcttagtattttatgtgtgcacagt

SEQ ID NO: 45527 - DNA, 25 bp, Homo sapien
agtattttatgtgtgcacagtggcc

SEQ ID NO: 45528 - DNA, 25 bp, Homo sapien
agggtgacactaagactctaagaga

SEQ ID NO: 45529 - DNA, 25 bp, Homo sapien
agagaaagaataacccctgccacta

SEQ ID NO: 45530 - DNA, 25 bp, Homo sapien
tcctgggagccagacagcataagga

SEQ ID NO: 45531 - DNA, 25 bp, Homo sapien
gatctaattccaagttgcatatgtg

SEQ ID NO: 45532 - DNA, 25 bp, Homo sapien
gaagtatagcaagctggccaggcat

SEQ ID NO: 45533 - DNA, 25 bp, Homo sapien
gccagtctgttatgaagctgcacta

SEQ ID NO: 45534 - DNA, 25 bp, Homo sapien
agagcagccttggcaatgtggtgaa

SEQ ID NO: 45535 - DNA, 25 bp, Homo sapien
aattagctgggcatactctggggct

SEQ ID NO: 45536 - DNA, 25 bp, Homo sapien
tgcactactgaggcagcacatctga

SEQ ID NO: 45537 - DNA, 25 bp, Homo sapien
agcctaagagaaacctgtccttctg

SEQ ID NO: 45538 - DNA, 25 bp, Homo sapien
tgtccttctgtcctgagaaacggga

SEQ ID NO: 45539 - DNA, 25 bp, Homo sapien
aacgaattaatttggcatgcagttt

SEQ ID NO: 45540 - DNA, 25 bp, Homo sapien
ccatgtttctcgcacagcagagttc

SEQ ID NO: 45541 - DNA, 25 bp, Homo sapien
ttctcgcacagcagagttcttggaa

SEQ ID NO: 45542 - DNA, 25 bp, Homo sapien
gttcttggaagagcctgtggagtca

SEQ ID NO: 45543 - DNA, 25 bp, Homo sapien
ctgtggagtcagaatcccagggacg

SEQ ID NO: 45544 - DNA, 25 bp, Homo sapien
aatcccagggacgggcgtgagagtt

SEQ ID NO: 45545 - DNA, 25 bp, Homo sapien
gggcgtgagagtttggggaaaggct

SEQ ID NO: 45546 - DNA, 25 bp, Homo sapien
ttttgatgaactattcggttacgaa

SEQ ID NO: 45547 - DNA, 25 bp, Homo sapien
ttcggttacgaatcacagctctaaa

SEQ ID NO: 45548 - DNA, 25 bp, Homo sapien
acagctctaaaaattgcacaactct

SEQ ID NO: 45549 - DNA, 25 bp, Homo sapien
actgcttatcatactttggtttttt

SEQ ID NO: 45550 - DNA, 25 bp, Homo sapien
cagattggggggggagaggtggtgt

SEQ ID NO: 45551 - DNA, 25 bp, Homo sapien
gaatcttatggctttgtttttactt

SEQ ID NO: 45552 - DNA, 25 bp, Homo sapien
gaagtttaacttccattgttcagat

SEQ ID NO: 45553 - DNA, 25 bp, Homo sapien
gaaattgtgccaggtagttgtctaa

SEQ ID NO: 45554 - DNA, 25 bp, Homo sapien
gattctagataatcctttactcaaa

SEQ ID NO: 45555 - DNA, 25 bp, Homo sapien
gattcacatcattaagagttatcta

SEQ ID NO: 45556 - DNA, 25 bp, Homo sapien
gagttatctaacttttatgttgtca

SEQ ID NO: 45557 - DNA, 25 bp, Homo sapien
tttactttttgacatgctcttagca

SEQ ID NO: 45558 - DNA, 25 bp, Homo sapien
atgtggatgatattcagcattctat

SEQ ID NO: 45559 - DNA, 25 bp, Homo sapien
cagcattctatctatgaatttcctt

SEQ ID NO: 45560 - DNA, 25 bp, Homo sapien
gctagtcattctggatcttatgttt

SEQ ID NO: 45561 - DNA, 25 bp, Homo sapien
tgcctccatttcgcgaggtgggcgc

SEQ ID NO: 45562 - DNA, 25 bp, Homo sapien
ctgctggagcgcttccacggcgcct

SEQ ID NO: 45563 - DNA, 25 bp, Homo sapien
tccacggcgcctcacgcgtcatggg

SEQ ID NO: 45564 - DNA, 25 bp, Homo sapien
gcgtcatgggcaccaacgacggcaa

SEQ ID NO: 45565 - DNA, 25 bp, Homo sapien
caccaacgacggcaaggccctgctg

SEQ ID NO: 45566 - DNA, 25 bp, Homo sapien
ccgcacgctcaagccgccgggccga

SEQ ID NO: 45567 - DNA, 25 bp, Homo sapien
cgggccgagcggacctcctctacgc

SEQ ID NO: 45568 - DNA, 25 bp, Homo sapien
tctacgccgccgattcgcccgactt

SEQ ID NO: 45569 - DNA, 25 bp, Homo sapien
cgcggtcgcgcctgcaatagcagcg

SEQ ID NO: 45570 - DNA, 25 bp, Homo sapien
gcgcctgcaatagcagcgccccgga

SEQ ID NO: 45571 - DNA, 25 bp, Homo sapien
agcagcgccccggacctcagcggct

SEQ ID NO: 45572 - DNA, 25 bp, Homo sapien
gtaaattctggtaattggttacagg

SEQ ID NO: 45573 - DNA, 25 bp, Homo sapien
ccttcccaagacatcttgacctctg

SEQ ID NO: 45574 - DNA, 25 bp, Homo sapien
ttcccaagacatcttgacctctgcc

SEQ ID NO: 45575 - DNA, 25 bp, Homo sapien
ctgtcagccatccagcagcgatggg

SEQ ID NO: 45576 - DNA, 25 bp, Homo sapien
cagccatccagcagcgatgggtctt

SEQ ID NO: 45577 - DNA, 25 bp, Homo sapien
atccagcagcgatgggtctttgctc

SEQ ID NO: 45578 - DNA, 25 bp, Homo sapien
ttgctccctacagaactctgtggat

SEQ ID NO: 45579 - DNA, 25 bp, Homo sapien
gaactctgtggattctatttcttcc

SEQ ID NO: 45580 - DNA, 25 bp, Homo sapien
taaaatgctatatgctgaataagta

SEQ ID NO: 45581 - DNA, 25 bp, Homo sapien
gggtgaagtagacacaatgacaatg

SEQ ID NO: 45582 - DNA, 25 bp, Homo sapien
ttggaaagaagctatccacactagc

SEQ ID NO: 45583 - DNA, 25 bp, Homo sapien
acgtgaggagtgtcacttccgtcag

SEQ ID NO: 45584 - DNA, 25 bp, Homo sapien
gagtgtcacttccgtcaggagaggt

SEQ ID NO: 45585 - DNA, 25 bp, Homo sapien
cacttccgtcaggagaggtgaggca

SEQ ID NO: 45586 - DNA, 25 bp, Homo sapien
agaggtgaggcaggctcgagtgcac

SEQ ID NO: 45587 - DNA, 25 bp, Homo sapien
tgaggcaggctcgagtgcacggagc

SEQ ID NO: 45588 - DNA, 25 bp, Homo sapien
cgtcccttccatcaggagaggtgca

SEQ ID NO: 45589 - DNA, 25 bp, Homo sapien
agaggtgcagaggccaagaccgttt

SEQ ID NO: 45590 - DNA, 25 bp, Homo sapien
gcaatggttgcagaaaatcgaagcc

SEQ ID NO: 45591 - DNA, 25 bp, Homo sapien
atcgaagccataaaactggctgagc

SEQ ID NO: 45592 - DNA, 25 bp, Homo sapien
aactggctgagcagaagcacaggga

SEQ ID NO: 45593 - DNA, 25 bp, Homo sapien
gcacagggaggagcggaggcggagg

SEQ ID NO: 45594 - DNA, 25 bp, Homo sapien
cttggctggactgaggtctgggggt

SEQ ID NO: 45595 - DNA, 25 bp, Homo sapien
aggtctgggggtgcacttattatcc

SEQ ID NO: 45596 - DNA, 25 bp, Homo sapien
gggtgcacttattatccctggggac

SEQ ID NO: 45597 - DNA, 25 bp, Homo sapien
cttattatccctggggacacctgct

SEQ ID NO: 45598 - DNA, 25 bp, Homo sapien
gggaggttgtctgaacagggattat

SEQ ID NO: 45599 - DNA, 25 bp, Homo sapien
gtgggcctgatgtggtgctggggcc

SEQ ID NO: 45600 - DNA, 25 bp, Homo sapien
attagtttacatacatactccttaa

SEQ ID NO: 45601 - DNA, 25 bp, Homo sapien
gataaatacattacacctttcaaag

SEQ ID NO: 45602 - DNA, 25 bp, Homo sapien
ctcttcttctctttcagaatctggg

SEQ ID NO: 45603 - DNA, 25 bp, Homo sapien
agaatctggggctccaggctatgcc

SEQ ID NO: 45604 - DNA, 25 bp, Homo sapien
ctccaggctatgccttggctggact

SEQ ID NO: 45605 - DNA, 25 bp, Homo sapien
aacagaggtgccaggcctcagcctc

SEQ ID NO: 45606 - DNA, 25 bp, Homo sapien
ccccatcgccaaaggatggaagtaa

SEQ ID NO: 45607 - DNA, 25 bp, Homo sapien
atttgaatagctcaggtgtgctgac

SEQ ID NO: 45608 - DNA, 25 bp, Homo sapien
ccccagtgaagacaccagataggac

SEQ ID NO: 45609 - DNA, 25 bp, Homo sapien
gggatctcagagcttacaggctgag

SEQ ID NO: 45610 - DNA, 25 bp, Homo sapien
gctgggctgtggattcctgatcccc

SEQ ID NO: 45611 - DNA, 25 bp, Homo sapien
tgggctgtggattcctgatcccctc

SEQ ID NO: 45612 - DNA, 25 bp, Homo sapien
tccacccagcagtagacacagtgca

SEQ ID NO: 45613 - DNA, 25 bp, Homo sapien
cacccagcagtagacacagtgcaca

SEQ ID NO: 45614 - DNA, 25 bp, Homo sapien
acccagcagtagacacagtgcacag

SEQ ID NO: 45615 - DNA, 25 bp, Homo sapien
cagtagacacagtgcacaggggaga

SEQ ID NO: 45616 - DNA, 25 bp, Homo sapien
tagacacagtgcacaggggagaaga

SEQ ID NO: 45617 - DNA, 25 bp, Homo sapien
ttgggggcctgtatgccttgcttct

SEQ ID NO: 45618 - DNA, 25 bp, Homo sapien
gcctgtatgccttgcttctaccatg

SEQ ID NO: 45619 - DNA, 25 bp, Homo sapien
tgtatgccttgcttctaccatgagc

SEQ ID NO: 45620 - DNA, 25 bp, Homo sapien
ccttgcttctaccatgagcagagac

SEQ ID NO: 45621 - DNA, 25 bp, Homo sapien
tattgccacagttcttatactataa

SEQ ID NO: 45622 - DNA, 25 bp, Homo sapien
tataaccatatatcatacctggata

SEQ ID NO: 45623 - DNA, 25 bp, Homo sapien
gacacacatagagatttctttgttc

SEQ ID NO: 45624 - DNA, 25 bp, Homo sapien
aaaaatggctcaaacgatatatacg

SEQ ID NO: 45625 - DNA, 25 bp, Homo sapien
gatatatacgttcttcaacttcctt

SEQ ID NO: 45626 - DNA, 25 bp, Homo sapien
ttcaacttcctttattcatgtgaac

SEQ ID NO: 45627 - DNA, 25 bp, Homo sapien
gtgaacatatcatgggcatatttcc

SEQ ID NO: 45628 - DNA, 25 bp, Homo sapien
gggcatatttccatggtatgactta

SEQ ID NO: 45629 - DNA, 25 bp, Homo sapien
tttctcccactttttccattataag

SEQ ID NO: 45630 - DNA, 25 bp, Homo sapien
aaaatagctcacaccaaaatcccat

SEQ ID NO: 45631 - DNA, 25 bp, Homo sapien
tcacaccaaaatcccatcgcttgaa

SEQ ID NO: 45632 - DNA, 25 bp, Homo sapien
gcatgctcccagctaggaagaagcc

SEQ ID NO: 45633 - DNA, 25 bp, Homo sapien
gccggggacataaagctagcagctg

SEQ ID NO: 45634 - DNA, 25 bp, Homo sapien
agctagcagctgtggtgaggatacc

SEQ ID NO: 45635 - DNA, 25 bp, Homo sapien
gaggataccagggtgagtgctgagg

SEQ ID NO: 45636 - DNA, 25 bp, Homo sapien
gtgctgagggtgagggacctgggct

SEQ ID NO: 45637 - DNA, 25 bp, Homo sapien
ctgggcttcctgtttttaatgatta

SEQ ID NO: 45638 - DNA, 25 bp, Homo sapien
ttaatgattaagcctcagcctcaaa

SEQ ID NO: 45639 - DNA, 25 bp, Homo sapien
aagcctcagcctcaaaaagcttttg

SEQ ID NO: 45640 - DNA, 25 bp, Homo sapien
aaaaagcttttgacagcctggacaa

SEQ ID NO: 45641 - DNA, 25 bp, Homo sapien
ctggacaacatggccagaccctatc

SEQ ID NO: 45642 - DNA, 25 bp, Homo sapien
ggcactgggaacaggcatgctccca

SEQ ID NO: 45643 - DNA, 25 bp, Homo sapien
ggaacctgaagcgaggagggcccgc

SEQ ID NO: 45644 - DNA, 25 bp, Homo sapien
gggctacttccggagactgaagtac

SEQ ID NO: 45645 - DNA, 25 bp, Homo sapien
ttccggagactgaagtacctgatgg

SEQ ID NO: 45646 - DNA, 25 bp, Homo sapien
gaagtacctgatggagcggcgcttc

SEQ ID NO: 45647 - DNA, 25 bp, Homo sapien
gcgtgtgccagaagtccttcaagca

SEQ ID NO: 45648 - DNA, 25 bp, Homo sapien
cgcacctggtccagcacatgctggt

SEQ ID NO: 45649 - DNA, 25 bp, Homo sapien
cacctggtccagcacatgctggtgc

SEQ ID NO: 45650 - DNA, 25 bp, Homo sapien
cctggtccagcacatgctggtgcac

SEQ ID NO: 45651 - DNA, 25 bp, Homo sapien
ctttccccactccgcagtggggcat

SEQ ID NO: 45652 - DNA, 25 bp, Homo sapien
ttccccactccgcagtggggcatcg

SEQ ID NO: 45653 - DNA, 25 bp, Homo sapien
ccactccgcagtggggcatcgtgga

SEQ ID NO: 45654 - DNA, 25 bp, Homo sapien
aatatgcaaatccagtcatttccca

SEQ ID NO: 45655 - DNA, 25 bp, Homo sapien
aacaagattttttcaagcacaagtc

SEQ ID NO: 45656 - DNA, 25 bp, Homo sapien
tgggctctgtggtgggatcaactaa

SEQ ID NO: 45657 - DNA, 25 bp, Homo sapien
tccttctccccaggataagtccaga

SEQ ID NO: 45658 - DNA, 25 bp, Homo sapien
taaccagaatacttcctgtaacaac

SEQ ID NO: 45659 - DNA, 25 bp, Homo sapien
aattttagataagctggccaggaat

SEQ ID NO: 45660 - DNA, 25 bp, Homo sapien
ggggtttttttggcatctgaactgg

SEQ ID NO: 45661 - DNA, 25 bp, Homo sapien
gaagactttgaatgcttcctcctag

SEQ ID NO: 45662 - DNA, 25 bp, Homo sapien
cctcctagactgagccgtattggag

SEQ ID NO: 45663 - DNA, 25 bp, Homo sapien
gtaatacaggataccctccctgtca

SEQ ID NO: 45664 - DNA, 25 bp, Homo sapien
tccctgtcaaactacaagacccaag

SEQ ID NO: 45665 - DNA, 25 bp, Homo sapien
tcatgcgcacagagggaagccatgt

SEQ ID NO: 45666 - DNA, 25 bp, Homo sapien
ggcaggaaagccacatcttgctctg

SEQ ID NO: 45667 - DNA, 25 bp, Homo sapien
gaaagccacatcttgctctgcattt

SEQ ID NO: 45668 - DNA, 25 bp, Homo sapien
tggtacccctaaaaagattgccaat

SEQ ID NO: 45669 - DNA, 25 bp, Homo sapien
ttttcttcatctttgccatatggag

SEQ ID NO: 45670 - DNA, 25 bp, Homo sapien
tttcttcatctttgccatatggagg

SEQ ID NO: 45671 - DNA, 25 bp, Homo sapien
ttgccatatggaggactgtgacaga

SEQ ID NO: 45672 - DNA, 25 bp, Homo sapien
tgccatatggaggactgtgacagac

SEQ ID NO: 45673 - DNA, 25 bp, Homo sapien
ggactgtgacagactttggacagtg

SEQ ID NO: 45674 - DNA, 25 bp, Homo sapien
ggcctcttgagttcctctgcagttt

SEQ ID NO: 45675 - DNA, 25 bp, Homo sapien
ttgagttcctctgcagttttgacat

SEQ ID NO: 45676 - DNA, 25 bp, Homo sapien
ctctgcagttttgacatttaggatt

SEQ ID NO: 45677 - DNA, 25 bp, Homo sapien
ttgtctgcagctgtttgttgcccca

SEQ ID NO: 45678 - DNA, 25 bp, Homo sapien
tgtctgcagctgtttgttgccccat

SEQ ID NO: 45679 - DNA, 25 bp, Homo sapien
tgccccattcctaagaggagtttat

SEQ ID NO: 45680 - DNA, 25 bp, Homo sapien
cattcctaagaggagtttatccatc

SEQ ID NO: 45681 - DNA, 25 bp, Homo sapien
ggaaacggaactgcaggagagggaa

SEQ ID NO: 45682 - DNA, 25 bp, Homo sapien
aaatctcagtttgaacaccaccatg

SEQ ID NO: 45683 - DNA, 25 bp, Homo sapien
aaaaccaaacatgcaagtatatcta

SEQ ID NO: 45684 - DNA, 25 bp, Homo sapien
aatacattctggtgttaattcaagg

SEQ ID NO: 45685 - DNA, 25 bp, Homo sapien
gaacaccaccatgaacaccaaggaa

SEQ ID NO: 45686 - DNA, 25 bp, Homo sapien
tctgggccaggtgtggtggatcacg

SEQ ID NO: 45687 - DNA, 25 bp, Homo sapien
cagcactcgggaggccaagacagga

SEQ ID NO: 45688 - DNA, 25 bp, Homo sapien
gttcaagaccaacctgggcaatgcg

SEQ ID NO: 45689 - DNA, 25 bp, Homo sapien
aacctgggcaatgcggtgaaaccct

SEQ ID NO: 45690 - DNA, 25 bp, Homo sapien
gaagaatcctatgcaatagctggaa

SEQ ID NO: 45691 - DNA, 25 bp, Homo sapien
atggggtgcagggatttatagggaa

SEQ ID NO: 45692 - DNA, 25 bp, Homo sapien
aaaatctgtagaacactgtaaacta

SEQ ID NO: 45693 - DNA, 25 bp, Homo sapien
gtaaactacacaggctatgagggaa

SEQ ID NO: 45694 - DNA, 25 bp, Homo sapien
gggaatagcctggttgggccagctt

SEQ ID NO: 45695 - DNA, 25 bp, Homo sapien
ggttgggccagcttggaaatcgggc

SEQ ID NO: 45696 - DNA, 25 bp, Homo sapien
agcttggaaatcgggcacaggcagg

SEQ ID NO: 45697 - DNA, 25 bp, Homo sapien
acttcttaggtcctgcctggagaga

SEQ ID NO: 45698 - DNA, 25 bp, Homo sapien
gaatggctgggctatattttcttcc

SEQ ID NO: 45699 - DNA, 25 bp, Homo sapien
tctgaatttcccttgatttgtataa

SEQ ID NO: 45700 - DNA, 25 bp, Homo sapien
agtgacagtgtctactgattgtaaa

SEQ ID NO: 45701 - DNA, 25 bp, Homo sapien
gtaaaatgaagcttgaaggccaggc

SEQ ID NO: 45702 - DNA, 25 bp, Homo sapien
ggccaaggttgtgaaaccgcgtctc

SEQ ID NO: 45703 - DNA, 25 bp, Homo sapien
cctcggggcgacttgaggttcgcga

SEQ ID NO: 45704 - DNA, 25 bp, Homo sapien
gacttgaggttcgcgaagggcacgt

SEQ ID NO: 45705 - DNA, 25 bp, Homo sapien
tgaggttcgcgaagggcacgtcgac

SEQ ID NO: 45706 - DNA, 25 bp, Homo sapien
tgtgggagcaaaaccaacgcctggc

SEQ ID NO: 45707 - DNA, 25 bp, Homo sapien
gccgggctgaggctggggcccggcc

SEQ ID NO: 45708 - DNA, 25 bp, Homo sapien
cggagcagcagcctctgaggtgagg

SEQ ID NO: 45709 - DNA, 25 bp, Homo sapien
gcagcctctgaggtgagggcgaggg

SEQ ID NO: 45710 - DNA, 25 bp, Homo sapien
tctgaggtgagggcgaggggcgcgg

SEQ ID NO: 45711 - DNA, 25 bp, Homo sapien
tgtgggccgcagagacgttggagcc

SEQ ID NO: 45712 - DNA, 25 bp, Homo sapien
gggccgcagagacgttggagccggc

SEQ ID NO: 45713 - DNA, 25 bp, Homo sapien
ccgcagagacgttggagccggcggg

SEQ ID NO: 45714 - DNA, 25 bp, Homo sapien
tgtagaagtatttcttctgttattt

SEQ ID NO: 45715 - DNA, 25 bp, Homo sapien
tagaagtatttcttctgttatttgt

SEQ ID NO: 45716 - DNA, 25 bp, Homo sapien
tatcttcttaatttgttccaaagaa

SEQ ID NO: 45717 - DNA, 25 bp, Homo sapien
ttcttaatttgttccaaagaaaatg

SEQ ID NO: 45718 - DNA, 25 bp, Homo sapien
tgttccaaagaaaatgctgccatac

SEQ ID NO: 45719 - DNA, 25 bp, Homo sapien
aaagaaaatgctgccatactgcatt

SEQ ID NO: 45720 - DNA, 25 bp, Homo sapien
aatgctgccatactgcattccctct

SEQ ID NO: 45721 - DNA, 25 bp, Homo sapien
tttccaagtcagactttcttacatt

SEQ ID NO: 45722 - DNA, 25 bp, Homo sapien
caagtcagactttcttacattcctg

SEQ ID NO: 45723 - DNA, 25 bp, Homo sapien
tcagactttcttacattcctggaat

SEQ ID NO: 45724 - DNA, 25 bp, Homo sapien
tcctggaatttactttgatatacca

SEQ ID NO: 45725 - DNA, 25 bp, Homo sapien
gaatttactttgatataccaagaat

SEQ ID NO: 45726 - DNA, 25 bp, Homo sapien
ctttgatataccaagaataataatg

SEQ ID NO: 45727 - DNA, 25 bp, Homo sapien
ataaaatgtttgctttgattactgt

SEQ ID NO: 45728 - DNA, 25 bp, Homo sapien
ttactgtggggggaaagatgaaatg

SEQ ID NO: 45729 - DNA, 25 bp, Homo sapien
tattaaaacaaacaagcttttcaga

SEQ ID NO: 45730 - DNA, 25 bp, Homo sapien
gagagaacctagttctgactgcaga

SEQ ID NO: 45731 - DNA, 25 bp, Homo sapien
gcagaatccctggagcacagatgct

SEQ ID NO: 45732 - DNA, 25 bp, Homo sapien
tccctggagcacagatgctcgctag

SEQ ID NO: 45733 - DNA, 25 bp, Homo sapien
gcacagccacagaatctgccaagct

SEQ ID NO: 45734 - DNA, 25 bp, Homo sapien
ccacagaatctgccaagctccagac

SEQ ID NO: 45735 - DNA, 25 bp, Homo sapien
atctgccaagctccagacacaggca

SEQ ID NO: 45736 - DNA, 25 bp, Homo sapien
gcagggttatgtgggcagagccagc

SEQ ID NO: 45737 - DNA, 25 bp, Homo sapien
ttatgtgggcagagccagcctcaga

SEQ ID NO: 45738 - DNA, 25 bp, Homo sapien
ccagcctcagaggagttagtgtgat

SEQ ID NO: 45739 - DNA, 25 bp, Homo sapien
gtcatcccagttcacagatgtgaaa

SEQ ID NO: 45740 - DNA, 25 bp, Homo sapien
tgtgaaaactgtccaggtgcagtgg

SEQ ID NO: 45741 - DNA, 25 bp, Homo sapien
gaggtcaagactgcaacgagctatg

SEQ ID NO: 45742 - DNA, 25 bp, Homo sapien
gagctgggtagctggagtatacagg

SEQ ID NO: 45743 - DNA, 25 bp, Homo sapien
ggagtatacaggcagggatttaaat

SEQ ID NO: 45744 - DNA, 25 bp, Homo sapien
gagataatgcggggttcatggtatt

SEQ ID NO: 45745 - DNA, 25 bp, Homo sapien
gcggggttcatggtattaagagttt

SEQ ID NO: 45746 - DNA, 25 bp, Homo sapien
taagagtttggcagcaatccccaga

SEQ ID NO: 45747 - DNA, 25 bp, Homo sapien
gagtttggcagcaatccccagaagt

SEQ ID NO: 45748 - DNA, 25 bp, Homo sapien
gaaatttcaaacaaaggctgacagg

SEQ ID NO: 45749 - DNA, 25 bp, Homo sapien
aggctgacaggagacagttggctgg

SEQ ID NO: 45750 - DNA, 25 bp, Homo sapien
aagtctggtagagttgaagtatatc

SEQ ID NO: 45751 - DNA, 25 bp, Homo sapien
tattaggatcaacaccattgcaatg

SEQ ID NO: 45752 - DNA, 25 bp, Homo sapien
agtccctaccagtttaggctggtgg

SEQ ID NO: 45753 - DNA, 25 bp, Homo sapien
ttttccattggctgaagctctttgc

SEQ ID NO: 45754 - DNA, 25 bp, Homo sapien
ttccattggctgaagctctttgcaa

SEQ ID NO: 45755 - DNA, 25 bp, Homo sapien
gcaattcctattctgttaatcgctg

SEQ ID NO: 45756 - DNA, 25 bp, Homo sapien
gttttccttgtgttgacctaatcat

SEQ ID NO: 45757 - DNA, 25 bp, Homo sapien
ctctaggatttctgaaagttactga

SEQ ID NO: 45758 - DNA, 25 bp, Homo sapien
attcagcatcttttgcagtactctg

SEQ ID NO: 45759 - DNA, 25 bp, Homo sapien
ttcagcatcttttgcagtactctgt

SEQ ID NO: 45760 - DNA, 25 bp, Homo sapien
cagcatcttttgcagtactctgtag

SEQ ID NO: 45761 - DNA, 25 bp, Homo sapien
catcttttgcagtactctgtagaca

SEQ ID NO: 45762 - DNA, 25 bp, Homo sapien
tcttttgcagtactctgtagacatt

SEQ ID NO: 45763 - DNA, 25 bp, Homo sapien
tttgcagtactctgtagacattagt

SEQ ID NO: 45764 - DNA, 25 bp, Homo sapien
tgcagtactctgtagacattagtca

SEQ ID NO: 45765 - DNA, 25 bp, Homo sapien
tactctgtagacattagtcagtaat

SEQ ID NO: 45766 - DNA, 25 bp, Homo sapien
tctgtagacattagtcagtaataca

SEQ ID NO: 45767 - DNA, 25 bp, Homo sapien
tatttctaggctctgaaatagccac

SEQ ID NO: 45768 - DNA, 25 bp, Homo sapien
tcccatccttgtctacctaattagg

SEQ ID NO: 45769 - DNA, 25 bp, Homo sapien
catccttgtctacctaattaggctt

SEQ ID NO: 45770 - DNA, 25 bp, Homo sapien
aattaggctttgtgtaactcagtgt

SEQ ID NO: 45771 - DNA, 25 bp, Homo sapien
ggctttgtgtaactcagtgttgcaa

SEQ ID NO: 45772 - DNA, 25 bp, Homo sapien
gtaactcagtgttgcaaagctttga

SEQ ID NO: 45773 - DNA, 25 bp, Homo sapien
aaagctttgacatctgtttgagtta

SEQ ID NO: 45774 - DNA, 25 bp, Homo sapien
tatatgttgttacttaagggtttca

SEQ ID NO: 45775 - DNA, 25 bp, Homo sapien
aacaagtcatgttggggcatactca

SEQ ID NO: 45776 - DNA, 25 bp, Homo sapien
tcatgttggggcatactcattagga

SEQ ID NO: 45777 - DNA, 25 bp, Homo sapien
cattaggattgagtgctttcttaca

SEQ ID NO: 45778 - DNA, 25 bp, Homo sapien
gattgagtgctttcttacaccaaaa

SEQ ID NO: 45779 - DNA, 25 bp, Homo sapien
cccaggaggtcaaaaccagctgggc

SEQ ID NO: 45780 - DNA, 25 bp, Homo sapien
aatatttggatgaccaggctagcat

SEQ ID NO: 45781 - DNA, 25 bp, Homo sapien
ggatgaccaggctagcattacacca

SEQ ID NO: 45782 - DNA, 25 bp, Homo sapien
accaggctagcattacaccatttgt

SEQ ID NO: 45783 - DNA, 25 bp, Homo sapien
ggctagcattacaccatttgtttgt

SEQ ID NO: 45784 - DNA, 25 bp, Homo sapien
gcattacaccatttgtttgtgtgac

SEQ ID NO: 45785 - DNA, 25 bp, Homo sapien
gtgtgacattaggcatgacatctgt

SEQ ID NO: 45786 - DNA, 25 bp, Homo sapien
gacattaggcatgacatctgtgcaa

SEQ ID NO: 45787 - DNA, 25 bp, Homo sapien
gacatctgtgcaaagtacagcagcc

SEQ ID NO: 45788 - DNA, 25 bp, Homo sapien
gcaaagtacagcagccagaagggga

SEQ ID NO: 45789 - DNA, 25 bp, Homo sapien
attttaatatctggggccgggcgtg

SEQ ID NO: 45790 - DNA, 25 bp, Homo sapien
tccggcgcgtggtacaagcacgtgg

SEQ ID NO: 45791 - DNA, 25 bp, Homo sapien
ccggcgcgtggtacaagcacgtggc

SEQ ID NO: 45792 - DNA, 25 bp, Homo sapien
cggcgcgtggtacaagcacgtggcg

SEQ ID NO: 45793 - DNA, 25 bp, Homo sapien
ggcgcgtggtacaagcacgtggcga

SEQ ID NO: 45794 - DNA, 25 bp, Homo sapien
gcgcgtggtacaagcacgtggcgag

SEQ ID NO: 45795 - DNA, 25 bp, Homo sapien
gtggtacaagcacgtggcgagtccc

SEQ ID NO: 45796 - DNA, 25 bp, Homo sapien
cctggacttcagcggagctggccag

SEQ ID NO: 45797 - DNA, 25 bp, Homo sapien
ctggacttcagcggagctggccaga

SEQ ID NO: 45798 - DNA, 25 bp, Homo sapien
tggacttcagcggagctggccagag

SEQ ID NO: 45799 - DNA, 25 bp, Homo sapien
gacttcagcggagctggccagagac

SEQ ID NO: 45800 - DNA, 25 bp, Homo sapien
gagctggccagagacttcggagaga

SEQ ID NO: 45801 - DNA, 25 bp, Homo sapien
ggaatatgagacttgaacattttga

SEQ ID NO: 45802 - DNA, 25 bp, Homo sapien
aatttaatttagtgctcatttgaaa

SEQ ID NO: 45803 - DNA, 25 bp, Homo sapien
gtaacatggggagagtggtatcaac

SEQ ID NO: 45804 - DNA, 25 bp, Homo sapien
atattttatcctcatgtttacattt

SEQ ID NO: 45805 - DNA, 25 bp, Homo sapien
gtaataccttaattttatgtggagt

SEQ ID NO: 45806 - DNA, 25 bp, Homo sapien
attaggccgaatttgtatgtattgt

SEQ ID NO: 45807 - DNA, 25 bp, Homo sapien
gtatgtattgttggatgggtatgtg

SEQ ID NO: 45808 - DNA, 25 bp, Homo sapien
tggtatcaaccactaagaggattaa

SEQ ID NO: 45809 - DNA, 25 bp, Homo sapien
gggtatgtgtattgacctgatttat

SEQ ID NO: 45810 - DNA, 25 bp, Homo sapien
acttccaggtagagtcacatttaag

SEQ ID NO: 45811 - DNA, 25 bp, Homo sapien
atttgtaaaacacgtagcctagaat

SEQ ID NO: 45812 - DNA, 25 bp, Homo sapien
gcaggtaacacctgctgctactcca

SEQ ID NO: 45813 - DNA, 25 bp, Homo sapien
tgattcagagaccatggggcccaca

SEQ ID NO: 45814 - DNA, 25 bp, Homo sapien
aatctgcagctctacattttgtatc

SEQ ID NO: 45815 - DNA, 25 bp, Homo sapien
aaatgcaagtccttttggttatcaa

SEQ ID NO: 45816 - DNA, 25 bp, Homo sapien
ttctcctcctttgaaatatgtattc

SEQ ID NO: 45817 - DNA, 25 bp, Homo sapien
gggcccacaaacctaatcagagtaa

SEQ ID NO: 45818 - DNA, 25 bp, Homo sapien
attggacactgtatctcatacccta

SEQ ID NO: 45819 - DNA, 25 bp, Homo sapien
cactgtatctcataccctaaaccat

SEQ ID NO: 45820 - DNA, 25 bp, Homo sapien
atgtccaatcaataaccaatgttac

SEQ ID NO: 45821 - DNA, 25 bp, Homo sapien
gagtaacgttttcattgagtacaca

SEQ ID NO: 45822 - DNA, 25 bp, Homo sapien
gacatgagaatcttcactttcccct

SEQ ID NO: 45823 - DNA, 25 bp, Homo sapien
gttataggtggagagggtggggtgc

SEQ ID NO: 45824 - DNA, 25 bp, Homo sapien
cctatctctcacccacgtaagtggg

SEQ ID NO: 45825 - DNA, 25 bp, Homo sapien
atctctcacccacgtaagtggggtg

SEQ ID NO: 45826 - DNA, 25 bp, Homo sapien
ctctcacccacgtaagtggggtgat

SEQ ID NO: 45827 - DNA, 25 bp, Homo sapien
gtggggtgatgctgatttagtctct

SEQ ID NO: 45828 - DNA, 25 bp, Homo sapien
ggggtgatgctgatttagtctctgc

SEQ ID NO: 45829 - DNA, 25 bp, Homo sapien
ggtgatgctgatttagtctctgctt

SEQ ID NO: 45830 - DNA, 25 bp, Homo sapien
gatgctgatttagtctctgcttttc

SEQ ID NO: 45831 - DNA, 25 bp, Homo sapien
tgcttttcccttgagggattgggga

SEQ ID NO: 45832 - DNA, 25 bp, Homo sapien
agtccaggcctttctaagatactcc

SEQ ID NO: 45833 - DNA, 25 bp, Homo sapien
ccaggcctttctaagatactcctcc

SEQ ID NO: 45834 - DNA, 25 bp, Homo sapien
gcactcctgcctgggcaacagaatg

SEQ ID NO: 45835 - DNA, 25 bp, Homo sapien
cactcctgcctgggcaacagaatga

SEQ ID NO: 45836 - DNA, 25 bp, Homo sapien
acgttttacagtcttgctattgttt

SEQ ID NO: 45837 - DNA, 25 bp, Homo sapien
gttttacagtcttgctattgtttct

SEQ ID NO: 45838 - DNA, 25 bp, Homo sapien
ttacagtcttgctattgtttcttga

SEQ ID NO: 45839 - DNA, 25 bp, Homo sapien
cagtcttgctattgtttcttgagtc

SEQ ID NO: 45840 - DNA, 25 bp, Homo sapien
agtcttgctattgtttcttgagtcc

SEQ ID NO: 45841 - DNA, 25 bp, Homo sapien
tggtggcaggcgcctgtaattccag

SEQ ID NO: 45842 - DNA, 25 bp, Homo sapien
tggcaggcgcctgtaattccaggag

SEQ ID NO: 45843 - DNA, 25 bp, Homo sapien
gctgaggcacaagaatcgcttacac

SEQ ID NO: 45844 - DNA, 25 bp, Homo sapien
tgaggcacaagaatcgcttacaccc

SEQ ID NO: 45845 - DNA, 25 bp, Homo sapien
aggaccgctggaggacgcagcgtcc

SEQ ID NO: 45846 - DNA, 25 bp, Homo sapien
tggaggacgcagcgtccagggccag

SEQ ID NO: 45847 - DNA, 25 bp, Homo sapien
cgccagggacaccaggaattcgggg

SEQ ID NO: 45848 - DNA, 25 bp, Homo sapien
gccagggacaccaggaattcggggg

SEQ ID NO: 45849 - DNA, 25 bp, Homo sapien
gtctgaaggctgtcgtcggttacag

SEQ ID NO: 45850 - DNA, 25 bp, Homo sapien
gtcgtcggttacagcgggaatgggc

SEQ ID NO: 45851 - DNA, 25 bp, Homo sapien
gttacagcgggaatgggcgggccaa

SEQ ID NO: 45852 - DNA, 25 bp, Homo sapien
gaatgggcgggccaacatggtctgg

SEQ ID NO: 45853 - DNA, 25 bp, Homo sapien
ggcgggccaacatggtctggaggcc

SEQ ID NO: 45854 - DNA, 25 bp, Homo sapien
aacatggtctggaggccggacacag

SEQ ID NO: 45855 - DNA, 25 bp, Homo sapien
tactgagagcgaccaaagcttcccc

SEQ ID NO: 45856 - DNA, 25 bp, Homo sapien
cccatcgtgcccttaaatgccagat

SEQ ID NO: 45857 - DNA, 25 bp, Homo sapien
cccttaaatgccagatctggtggag

SEQ ID NO: 45858 - DNA, 25 bp, Homo sapien
gtgatgaaaactcctggtcattcct

SEQ ID NO: 45859 - DNA, 25 bp, Homo sapien
acaatcgccgggagctgacggacaa

SEQ ID NO: 45860 - DNA, 25 bp, Homo sapien
gacaagcttctcatcttccttgcgc

SEQ ID NO: 45861 - DNA, 25 bp, Homo sapien
ggtcctctatattgtgaaaaagcgg

SEQ ID NO: 45862 - DNA, 25 bp, Homo sapien
tcctctatattgtgaaaaagcggct

SEQ ID NO: 45863 - DNA, 25 bp, Homo sapien
tgaaaaagcggctctttccattttt

SEQ ID NO: 45864 - DNA, 25 bp, Homo sapien
tgagctctaggctgctaagctgagc

SEQ ID NO: 45865 - DNA, 25 bp, Homo sapien
aggctgctaagctgagccacacacc

SEQ ID NO: 45866 - DNA, 25 bp, Homo sapien
ctccgtttgcaccagttgcctgcag

SEQ ID NO: 45867 - DNA, 25 bp, Homo sapien
cctgcaggttggatggaacacagtg

SEQ ID NO: 45868 - DNA, 25 bp, Homo sapien
cacagtgccccacttttctgcaagt

SEQ ID NO: 45869 - DNA, 25 bp, Homo sapien
cttttctgcaagtagctggcttgta

SEQ ID NO: 45870 - DNA, 25 bp, Homo sapien
tctgcaagtagctggcttgtaaagg

SEQ ID NO: 45871 - DNA, 25 bp, Homo sapien
aaggtctggcattgggatgccgccc

SEQ ID NO: 45872 - DNA, 25 bp, Homo sapien
ggcaggtaaatgccttcagtttgtt

SEQ ID NO: 45873 - DNA, 25 bp, Homo sapien
tagaggctgatggataccgagaaga

SEQ ID NO: 45874 - DNA, 25 bp, Homo sapien
ggagcagaaggaagcgtggttctgg

SEQ ID NO: 45875 - DNA, 25 bp, Homo sapien
ctgcgtgctttactgttgtggaaat

SEQ ID NO: 45876 - DNA, 25 bp, Homo sapien
gctttactgttgtggaaattcatgt

SEQ ID NO: 45877 - DNA, 25 bp, Homo sapien
ttccaagtctatcctttccttttgg

SEQ ID NO: 45878 - DNA, 25 bp, Homo sapien
tccttttggaattctccttgcttcc

SEQ ID NO: 45879 - DNA, 25 bp, Homo sapien
ttttggaattctccttgcttcctta

SEQ ID NO: 45880 - DNA, 25 bp, Homo sapien
tccttatctagtccctgcttatgga

SEQ ID NO: 45881 - DNA, 25 bp, Homo sapien
ctagtccctgcttatggaccagaag

SEQ ID NO: 45882 - DNA, 25 bp, Homo sapien
ggaccagaagttttgaagctttgca

SEQ ID NO: 45883 - DNA, 25 bp, Homo sapien
gagtgtcttttcttatgtgattttt

SEQ ID NO: 45884 - DNA, 25 bp, Homo sapien
tgatatggtttggctatatgtcccc

SEQ ID NO: 45885 - DNA, 25 bp, Homo sapien
tcttgaattataatccccatgtgtc

SEQ ID NO: 45886 - DNA, 25 bp, Homo sapien
ccccatgtgtcaagggagggacctg

SEQ ID NO: 45887 - DNA, 25 bp, Homo sapien
tggatcacgggggcagttgtcccca

SEQ ID NO: 45888 - DNA, 25 bp, Homo sapien
ttgtccccatgctgttcttgggata

SEQ ID NO: 45889 - DNA, 25 bp, Homo sapien
gtgagttagttctcatgagatctga

SEQ ID NO: 45890 - DNA, 25 bp, Homo sapien
ataagtgtttgacaattcctccttt

SEQ ID NO: 45891 - DNA, 25 bp, Homo sapien
tgtttgacaattcctcctttacaca

SEQ ID NO: 45892 - DNA, 25 bp, Homo sapien
tctctcatctgctgccatgtaagac

SEQ ID NO: 45893 - DNA, 25 bp, Homo sapien
ctgctgccatgtaagacttgcctgc

SEQ ID NO: 45894 - DNA, 25 bp, Homo sapien
ggctgagtgggaggatcgattgaac

SEQ ID NO: 45895 - DNA, 25 bp, Homo sapien
gaggatcgattgaacacaggaatta

SEQ ID NO: 45896 - DNA, 25 bp, Homo sapien
gcagtgcagctatgattgcaccact

SEQ ID NO: 45897 - DNA, 25 bp, Homo sapien
tgcagctatgattgcaccactgtcc

SEQ ID NO: 45898 - DNA, 25 bp, Homo sapien
gtgcagtggctcacatctgtaaacc

SEQ ID NO: 45899 - DNA, 25 bp, Homo sapien
gcagtggctcacatctgtaaacccc

SEQ ID NO: 45900 - DNA, 25 bp, Homo sapien
aggtatttaagacttctaggaagag

SEQ ID NO: 45901 - DNA, 25 bp, Homo sapien
ggaagagactagctgattaattcaa

SEQ ID NO: 45902 - DNA, 25 bp, Homo sapien
gagactagctgattaattcaaatta

SEQ ID NO: 45903 - DNA, 25 bp, Homo sapien
ttcaaattaggtactctccaataaa

SEQ ID NO: 45904 - DNA, 25 bp, Homo sapien
ggtactctccaataaagcatttgaa

SEQ ID NO: 45905 - DNA, 25 bp, Homo sapien
gttggaatatagtgatttttgtctg

SEQ ID NO: 45906 - DNA, 25 bp, Homo sapien
tagtgatttttgtctgttcttttac

SEQ ID NO: 45907 - DNA, 25 bp, Homo sapien
tgatttttgtctgttcttttactgc

SEQ ID NO: 45908 - DNA, 25 bp, Homo sapien
gtcaaaattttaattctcccactat

SEQ ID NO: 45909 - DNA, 25 bp, Homo sapien
taattctcccactattaatcctcaa

SEQ ID NO: 45910 - DNA, 25 bp, Homo sapien
attctcccactattaatcctcaaat

SEQ ID NO: 45911 - DNA, 25 bp, Homo sapien
ttctcccactattaatcctcaaatc

SEQ ID NO: 45912 - DNA, 25 bp, Homo sapien
ctcccactattaatcctcaaatcta

SEQ ID NO: 45913 - DNA, 25 bp, Homo sapien
tcccactattaatcctcaaatctaa

SEQ ID NO: 45914 - DNA, 25 bp, Homo sapien
ccactattaatcctcaaatctaatt

SEQ ID NO: 45915 - DNA, 25 bp, Homo sapien
taatcctcaaatctaatttaatttc

SEQ ID NO: 45916 - DNA, 25 bp, Homo sapien
taggaagaagcagtccctgttctcc

SEQ ID NO: 45917 - DNA, 25 bp, Homo sapien
taagccattttttttcagcaaggag

SEQ ID NO: 45918 - DNA, 25 bp, Homo sapien
tcagcaaggagtcattctgccagaa

SEQ ID NO: 45919 - DNA, 25 bp, Homo sapien
agaaaatcattcacatattggttca

SEQ ID NO: 45920 - DNA, 25 bp, Homo sapien
agtaattttacatctcacctcattc

SEQ ID NO: 45921 - DNA, 25 bp, Homo sapien
ctcacctcattcttatgatgctcag

SEQ ID NO: 45922 - DNA, 25 bp, Homo sapien
gatgctcagtttgcttaattattgg

SEQ ID NO: 45923 - DNA, 25 bp, Homo sapien
cacatattggttcactcaacaagca

SEQ ID NO: 45924 - DNA, 25 bp, Homo sapien
attagagctttactgttcgattatt

SEQ ID NO: 45925 - DNA, 25 bp, Homo sapien
gagatgctggacttcaattttcctt

SEQ ID NO: 45926 - DNA, 25 bp, Homo sapien
gacttcaattttccttattttatct

SEQ ID NO: 45927 - DNA, 25 bp, Homo sapien
tgctcccacatctcatgtatattca

SEQ ID NO: 45928 - DNA, 25 bp, Homo sapien
gctcccacatctcatgtatattcag

SEQ ID NO: 45929 - DNA, 25 bp, Homo sapien
ctcccacatctcatgtatattcaga

SEQ ID NO: 45930 - DNA, 25 bp, Homo sapien
tcccacatctcatgtatattcagat

SEQ ID NO: 45931 - DNA, 25 bp, Homo sapien
tgtatattcagatgtcccaaataat

SEQ ID NO: 45932 - DNA, 25 bp, Homo sapien
gtatattcagatgtcccaaataata

SEQ ID NO: 45933 - DNA, 25 bp, Homo sapien
gttaatttataacatcaagcatata

SEQ ID NO: 45934 - DNA, 25 bp, Homo sapien
catcaagcatatagtaaatgatcac

SEQ ID NO: 45935 - DNA, 25 bp, Homo sapien
aaatgatcacattttgcttactatt

SEQ ID NO: 45936 - DNA, 25 bp, Homo sapien
aatgatcacattttgcttactattg

SEQ ID NO: 45937 - DNA, 25 bp, Homo sapien
atgatcacattttgcttactattgt

SEQ ID NO: 45938 - DNA, 25 bp, Homo sapien
gttgtgaacataactattgtgaata

SEQ ID NO: 45939 - DNA, 25 bp, Homo sapien
aatgtaaatagctttcacaattgtg

SEQ ID NO: 45940 - DNA, 25 bp, Homo sapien
atagttgttatgctgattagggaat

SEQ ID NO: 45941 - DNA, 25 bp, Homo sapien
atacatattcagtacagatgcagtc

SEQ ID NO: 45942 - DNA, 25 bp, Homo sapien
cagatgcagtcatctttttttcccc

SEQ ID NO: 45943 - DNA, 25 bp, Homo sapien
tttcccctcgaacatttttgatcca

SEQ ID NO: 45944 - DNA, 25 bp, Homo sapien
cccctcgaacatttttgatccacaa

SEQ ID NO: 45945 - DNA, 25 bp, Homo sapien
gaacatttttgatccacaattggtt

SEQ ID NO: 45946 - DNA, 25 bp, Homo sapien
gatccacaattggttgaatccacag

SEQ ID NO: 45947 - DNA, 25 bp, Homo sapien
ttgaatccacagatggggaacacac

SEQ ID NO: 45948 - DNA, 25 bp, Homo sapien
gatggggaacacacagtcttggtaa

SEQ ID NO: 45949 - DNA, 25 bp, Homo sapien
aggatatcctgagtctaagccctgg

SEQ ID NO: 45950 - DNA, 25 bp, Homo sapien
cctggtttctgccaatggcaaatag

SEQ ID NO: 45951 - DNA, 25 bp, Homo sapien
ggttatttggtttgacaaggcactt

SEQ ID NO: 45952 - DNA, 25 bp, Homo sapien
ttgacaaggcacttaggctccctga

SEQ ID NO: 45953 - DNA, 25 bp, Homo sapien
tccctgagctttgccttagctggaa

SEQ ID NO: 45954 - DNA, 25 bp, Homo sapien
gtattacttgctattctatcaaccc

SEQ ID NO: 45955 - DNA, 25 bp, Homo sapien
acttgctattctatcaaccctgtaa

SEQ ID NO: 45956 - DNA, 25 bp, Homo sapien
aaccctgtaagatatttgcggccac

SEQ ID NO: 45957 - DNA, 25 bp, Homo sapien
tgtaagatatttgcggccacgcgcg

SEQ ID NO: 45958 - DNA, 25 bp, Homo sapien
atctgtgaggttaaaaggctgtgtg

SEQ ID NO: 45959 - DNA, 25 bp, Homo sapien
ggctgtgtgtgtgaaaatatcttgg

SEQ ID NO: 45960 - DNA, 25 bp, Homo sapien
gggagagggaggagtaatggaggag

SEQ ID NO: 45961 - DNA, 25 bp, Homo sapien
gagggaggagtaatggaggaggagt

SEQ ID NO: 45962 - DNA, 25 bp, Homo sapien
gggaggagtaatggaggaggagttg

SEQ ID NO: 45963 - DNA, 25 bp, Homo sapien
ggaggaggagttggaaactggggag

SEQ ID NO: 45964 - DNA, 25 bp, Homo sapien
gagttggaaactggggagagatgga

SEQ ID NO: 45965 - DNA, 25 bp, Homo sapien
gagagatggaaggaatgtgactgga

SEQ ID NO: 45966 - DNA, 25 bp, Homo sapien
gatggaaggaatgtgactggagggt

SEQ ID NO: 45967 - DNA, 25 bp, Homo sapien
gaaggaatgtgactggagggtagag

SEQ ID NO: 45968 - DNA, 25 bp, Homo sapien
gtgactggagggtagagaacttgga

SEQ ID NO: 45969 - DNA, 25 bp, Homo sapien
gactggagggtagagaacttggaga

SEQ ID NO: 45970 - DNA, 25 bp, Homo sapien
actggagggtagagaacttggagaa

SEQ ID NO: 45971 - DNA, 25 bp, Homo sapien
aggtgtactttatcttaagaaaatg

SEQ ID NO: 45972 - DNA, 25 bp, Homo sapien
tgtcccatatttttgcttaaatatc

SEQ ID NO: 45973 - DNA, 25 bp, Homo sapien
gatttgatctatatacaacttttca

SEQ ID NO: 45974 - DNA, 25 bp, Homo sapien
gaatacttttgattgtgtgttggac

SEQ ID NO: 45975 - DNA, 25 bp, Homo sapien
gattgtgtgttggacatatctaaaa

SEQ ID NO: 45976 - DNA, 25 bp, Homo sapien
ttatctggcagaattaaacctaaat

SEQ ID NO: 45977 - DNA, 25 bp, Homo sapien
gagtcccctttctaaaattcataca

SEQ ID NO: 45978 - DNA, 25 bp, Homo sapien
aattcatacagtgcccttgtattca

SEQ ID NO: 45979 - DNA, 25 bp, Homo sapien
gtgcccttgtattcatttatgcagt

SEQ ID NO: 45980 - DNA, 25 bp, Homo sapien
aatatgagcatttactaatttttta

SEQ ID NO: 45981 - DNA, 25 bp, Homo sapien
aagattattcttatttacactctaa

SEQ ID NO: 45982 - DNA, 25 bp, Homo sapien
atatcaaggcacttaatttttagtt

SEQ ID NO: 45983 - DNA, 25 bp, Homo sapien
gttagtgatataccatccaaaaggc

SEQ ID NO: 45984 - DNA, 25 bp, Homo sapien
aaaggcatctgaggctgggcacgtt

SEQ ID NO: 45985 - DNA, 25 bp, Homo sapien
gcacgttggttcatgcctataatcc

SEQ ID NO: 45986 - DNA, 25 bp, Homo sapien
tggtctcagatgcctgggctcaagc

SEQ ID NO: 45987 - DNA, 25 bp, Homo sapien
ggatcgcttgatcccaggagttcaa

SEQ ID NO: 45988 - DNA, 25 bp, Homo sapien
cagatgcctgggctcaagcagtcct

SEQ ID NO: 45989 - DNA, 25 bp, Homo sapien
ggcaatgtaacaagatcccatctct

SEQ ID NO: 45990 - DNA, 25 bp, Homo sapien
ggcatctgaaacataggaacctaat

SEQ ID NO: 45991 - DNA, 25 bp, Homo sapien
aaatatcatctagaccaatgtttta

SEQ ID NO: 45992 - DNA, 25 bp, Homo sapien
caacctcccaaagtgctgtatgatt

SEQ ID NO: 45993 - DNA, 25 bp, Homo sapien
acttcggtcagaaggaggagccctt

SEQ ID NO: 45994 - DNA, 25 bp, Homo sapien
tgttcattcatgctgtgcctgttga

SEQ ID NO: 45995 - DNA, 25 bp, Homo sapien
tcatgctgtgcctgttgaggagcgt

SEQ ID NO: 45996 - DNA, 25 bp, Homo sapien
tgcctgttgaggagcgtgtacgcac

SEQ ID NO: 45997 - DNA, 25 bp, Homo sapien
ggagcgtgtacgcactgcagtccct

SEQ ID NO: 45998 - DNA, 25 bp, Homo sapien
gattctgatggtgggactacccgga

SEQ ID NO: 45999 - DNA, 25 bp, Homo sapien
gactacccggatctggaaagaccca

SEQ ID NO: 46000 - DNA, 25 bp, Homo sapien
gatctggaaagacccagtgggcact

SEQ ID NO: 46001 - DNA, 25 bp, Homo sapien
cccagtgggcactgaaatatgcaaa

SEQ ID NO: 46002 - DNA, 25 bp, Homo sapien
aaaagatacaatgtcctgggagctg

SEQ ID NO: 46003 - DNA, 25 bp, Homo sapien
ggagctgagactgtgctcaatcaaa

SEQ ID NO: 46004 - DNA, 25 bp, Homo sapien
accaaagggtgaggctcagacggcg

SEQ ID NO: 46005 - DNA, 25 bp, Homo sapien
ccaaagggtgaggctcagacggcgg

SEQ ID NO: 46006 - DNA, 25 bp, Homo sapien
caaagggtgaggctcagacggcggc

SEQ ID NO: 46007 - DNA, 25 bp, Homo sapien
aaagggtgaggctcagacggcggct

SEQ ID NO: 46008 - DNA, 25 bp, Homo sapien
aagggtgaggctcagacggcggctt

SEQ ID NO: 46009 - DNA, 25 bp, Homo sapien
agggtgaggctcagacggcggcttt

SEQ ID NO: 46010 - DNA, 25 bp, Homo sapien
gggtgaggctcagacggcggctttc

SEQ ID NO: 46011 - DNA, 25 bp, Homo sapien
ggtgaggctcagacggcggctttct

SEQ ID NO: 46012 - DNA, 25 bp, Homo sapien
gtgaggctcagacggcggctttctg

SEQ ID NO: 46013 - DNA, 25 bp, Homo sapien
tagcctgatgtggtgttgtgtgcct

SEQ ID NO: 46014 - DNA, 25 bp, Homo sapien
tgatgtggtgttgtgtgcctgtagt

SEQ ID NO: 46015 - DNA, 25 bp, Homo sapien
gttgcagtgagccaaaattacgcca

SEQ ID NO: 46016 - DNA, 25 bp, Homo sapien
gtgagccaaaattacgccactgcac

SEQ ID NO: 46017 - DNA, 25 bp, Homo sapien
ctttaagttctggggtacacgtgca

SEQ ID NO: 46018 - DNA, 25 bp, Homo sapien
ctggggtacacgtgcagaatgtgca

SEQ ID NO: 46019 - DNA, 25 bp, Homo sapien
acacgtgcagaatgtgcaggtttgt

SEQ ID NO: 46020 - DNA, 25 bp, Homo sapien
gtgcaggtttgttacataggtatgc

SEQ ID NO: 46021 - DNA, 25 bp, Homo sapien
ttacataggtatgcacgtgccatgg

SEQ ID NO: 46022 - DNA, 25 bp, Homo sapien
ccatcaacctgtcacctacattagg

SEQ ID NO: 46023 - DNA, 25 bp, Homo sapien
gtcacctacattaggtatttcccct

SEQ ID NO: 46024 - DNA, 25 bp, Homo sapien
cctgttttactttcaagcctacaca

SEQ ID NO: 46025 - DNA, 25 bp, Homo sapien
gcctacacacaatagacgttattcc

SEQ ID NO: 46026 - DNA, 25 bp, Homo sapien
tccaattttaaatcctcttttccat

SEQ ID NO: 46027 - DNA, 25 bp, Homo sapien
tttaaatcctcttttccattacttg

SEQ ID NO: 46028 - DNA, 25 bp, Homo sapien
ttccattacttgctaaactctatcc

SEQ ID NO: 46029 - DNA, 25 bp, Homo sapien
tacttgctaaactctatccaactaa

SEQ ID NO: 46030 - DNA, 25 bp, Homo sapien
tctatccaactaagttcctcactct

SEQ ID NO: 46031 - DNA, 25 bp, Homo sapien
tcctcactctcctatcaatagttta

SEQ ID NO: 46032 - DNA, 25 bp, Homo sapien
atagtttatgtacagagttgcccac

SEQ ID NO: 46033 - DNA, 25 bp, Homo sapien
ttcattaatatcgttcctggccggg

SEQ ID NO: 46034 - DNA, 25 bp, Homo sapien
atctccgttgagaaatccacaatgg

SEQ ID NO: 46035 - DNA, 25 bp, Homo sapien
gctactcaggaggccgaggcaagag

SEQ ID NO: 46036 - DNA, 25 bp, Homo sapien
gagaattgctggaacctggaggcag

SEQ ID NO: 46037 - DNA, 25 bp, Homo sapien
cctggaggcagaggttgccgtgagc

SEQ ID NO: 46038 - DNA, 25 bp, Homo sapien
atcacactactgcactgcagcctag

SEQ ID NO: 46039 - DNA, 25 bp, Homo sapien
actgcactgcagcctagacaataga

SEQ ID NO: 46040 - DNA, 25 bp, Homo sapien
tagaatgagtcttcgtctccaagaa

SEQ ID NO: 46041 - DNA, 25 bp, Homo sapien
gtcaggtactgcggaatcaatatta

SEQ ID NO: 46042 - DNA, 25 bp, Homo sapien
gtcaattctccctttaataatctat

SEQ ID NO: 46043 - DNA, 25 bp, Homo sapien
ataattctaataaaacttccaacag

SEQ ID NO: 46044 - DNA, 25 bp, Homo sapien
gaatttatttgccctttgtaagtgg

SEQ ID NO: 46045 - DNA, 25 bp, Homo sapien
tgctgtggccacatttgaagagagg

SEQ ID NO: 46046 - DNA, 25 bp, Homo sapien
ccgcatcggtgacgtgatccagaag

SEQ ID NO: 46047 - DNA, 25 bp, Homo sapien
ggaaagttgctttgggggattcagg

SEQ ID NO: 46048 - DNA, 25 bp, Homo sapien
agttgctttgggggattcagggagc

SEQ ID NO: 46049 - DNA, 25 bp, Homo sapien
gttctcactcgcatccaggtgaggc

SEQ ID NO: 46050 - DNA, 25 bp, Homo sapien
tctcactcgcatccaggtgaggctg

SEQ ID NO: 46051 - DNA, 25 bp, Homo sapien
gggctggagtcagcattgccactcc

SEQ ID NO: 46052 - DNA, 25 bp, Homo sapien
aggttgccttgagtgattccgggca

SEQ ID NO: 46053 - DNA, 25 bp, Homo sapien
tgccttgagtgattccgggcatctc

SEQ ID NO: 46054 - DNA, 25 bp, Homo sapien
cacctgccctatctagagtcgagag

SEQ ID NO: 46055 - DNA, 25 bp, Homo sapien
agagtcgagaggaggtctctaggct

SEQ ID NO: 46056 - DNA, 25 bp, Homo sapien
ctaggctgagggcaatccctgtgcc

SEQ ID NO: 46057 - DNA, 25 bp, Homo sapien
agaggctgcccgaggaccggaataa

SEQ ID NO: 46058 - DNA, 25 bp, Homo sapien
gaggctgcccgaggaccggaataaa

SEQ ID NO: 46059 - DNA, 25 bp, Homo sapien
tggacgtggccaccttcgctgccgg

SEQ ID NO: 46060 - DNA, 25 bp, Homo sapien
tgagcctggcctacgggcgcacgct

SEQ ID NO: 46061 - DNA, 25 bp, Homo sapien
gctctacgcgctctgctggggtccg

SEQ ID NO: 46062 - DNA, 25 bp, Homo sapien
tctacgcgctctgctggggtccgca

SEQ ID NO: 46063 - DNA, 25 bp, Homo sapien
tcatcctgtgcttctggtacggccg

SEQ ID NO: 46064 - DNA, 25 bp, Homo sapien
catcctgtgcttctggtacggccgc

SEQ ID NO: 46065 - DNA, 25 bp, Homo sapien
atcctgtgcttctggtacggccgct

SEQ ID NO: 46066 - DNA, 25 bp, Homo sapien
tcctgtgcttctggtacggccgctt

SEQ ID NO: 46067 - DNA, 25 bp, Homo sapien
cctgtgcttctggtacggccgcttc

SEQ ID NO: 46068 - DNA, 25 bp, Homo sapien
ctgtgcttctggtacggccgcttcg

SEQ ID NO: 46069 - DNA, 25 bp, Homo sapien
tgtgcttctggtacggccgcttcgc

SEQ ID NO: 46070 - DNA, 25 bp, Homo sapien
gccacctcaactggggtcagaagga

SEQ ID NO: 46071 - DNA, 25 bp, Homo sapien
aggacctctaccgagatgtgatgtt

SEQ ID NO: 46072 - DNA, 25 bp, Homo sapien
aacatggtcttgctggtttatttcc

SEQ ID NO: 46073 - DNA, 25 bp, Homo sapien
ttgatgctgcaataccactgtgctg

SEQ ID NO: 46074 - DNA, 25 bp, Homo sapien
ccactgtgctgaacgtctctggcac

SEQ ID NO: 46075 - DNA, 25 bp, Homo sapien
tctctggcacattcatcttggttgc

SEQ ID NO: 46076 - DNA, 25 bp, Homo sapien
accaccgcttttgattattgtcctt

SEQ ID NO: 46077 - DNA, 25 bp, Homo sapien
catgtctctgtaactcactaacggc

SEQ ID NO: 46078 - DNA, 25 bp, Homo sapien
cccatttacttccccatgagtagga

SEQ ID NO: 46079 - DNA, 25 bp, Homo sapien
gtaggatttcagtttcccaaacctg

SEQ ID NO: 46080 - DNA, 25 bp, Homo sapien
ggatcttggatctaccgagaactgg

SEQ ID NO: 46081 - DNA, 25 bp, Homo sapien
tataaattggcagatggttgtgtac

SEQ ID NO: 46082 - DNA, 25 bp, Homo sapien
atggttcccattgcttatatttctc

SEQ ID NO: 46083 - DNA, 25 bp, Homo sapien
ttcccattgcttatatttctcctgc

SEQ ID NO: 46084 - DNA, 25 bp, Homo sapien
tgaggccggacctgatatggccctg

SEQ ID NO: 46085 - DNA, 25 bp, Homo sapien
cttgtttcctcattaccactaaaat

SEQ ID NO: 46086 - DNA, 25 bp, Homo sapien
tcattaccactaaaatctttcccct

SEQ ID NO: 46087 - DNA, 25 bp, Homo sapien
ccgcccaatttttctggctctgagt

SEQ ID NO: 46088 - DNA, 25 bp, Homo sapien
ctctgagtccttgttcatactgttc

SEQ ID NO: 46089 - DNA, 25 bp, Homo sapien
tcttaacaccttcggattctttctt

SEQ ID NO: 46090 - DNA, 25 bp, Homo sapien
tctttgagaactttccagattccca

SEQ ID NO: 46091 - DNA, 25 bp, Homo sapien
ttcccatgcctttttggaatcaatc

SEQ ID NO: 46092 - DNA, 25 bp, Homo sapien
cgggcaacggcgttggggcaagcct

SEQ ID NO: 46093 - DNA, 25 bp, Homo sapien
cagaagtccccaggcaggagtgtgg

SEQ ID NO: 46094 - DNA, 25 bp, Homo sapien
gaagtccccaggcaggagtgtggtg

SEQ ID NO: 46095 - DNA, 25 bp, Homo sapien
aagtccccaggcaggagtgtggtgg

SEQ ID NO: 46096 - DNA, 25 bp, Homo sapien
gcaggagtgtggtgggacatccggc

SEQ ID NO: 46097 - DNA, 25 bp, Homo sapien
tgggacatccggctggggtaaggac

SEQ ID NO: 46098 - DNA, 25 bp, Homo sapien
tccggctggggtaaggacaggcacc

SEQ ID NO: 46099 - DNA, 25 bp, Homo sapien
gctggggtaaggacaggcaccctcc

SEQ ID NO: 46100 - DNA, 25 bp, Homo sapien
ccactgtgtcagggcccagagagtg

SEQ ID NO: 46101 - DNA, 25 bp, Homo sapien
gtggataacacttggggagccctgg

SEQ ID NO: 46102 - DNA, 25 bp, Homo sapien
ggataacacttggggagccctggcc

SEQ ID NO: 46103 - DNA, 25 bp, Homo sapien
taatcctcaaaacttcttacaccta

SEQ ID NO: 46104 - DNA, 25 bp, Homo sapien
acttcttacacctaaaattcatgca

SEQ ID NO: 46105 - DNA, 25 bp, Homo sapien
gcaggagagaaaccccacaaatgtg

SEQ ID NO: 46106 - DNA, 25 bp, Homo sapien
ttcatactggagagaaaccccacaa

SEQ ID NO: 46107 - DNA, 25 bp, Homo sapien
ggtaatgcttttaaccaattctcaa

SEQ ID NO: 46108 - DNA, 25 bp, Homo sapien
accaattctcaaatcttactaaaca

SEQ ID NO: 46109 - DNA, 25 bp, Homo sapien
aaagcctttaaatggttgtcacact

SEQ ID NO: 46110 - DNA, 25 bp, Homo sapien
ggttgtcacacttgattgtaggtaa

SEQ ID NO: 46111 - DNA, 25 bp, Homo sapien
attcatactggcagaaactcccaga

SEQ ID NO: 46112 - DNA, 25 bp, Homo sapien
tttaattcctataccttattgcaca

SEQ ID NO: 46113 - DNA, 25 bp, Homo sapien
atatgtgcttacatcttattcaaca

SEQ ID NO: 46114 - DNA, 25 bp, Homo sapien
ggaaactaaggctttactcatcagt

SEQ ID NO: 46115 - DNA, 25 bp, Homo sapien
gaaactaaggctttactcatcagtc

SEQ ID NO: 46116 - DNA, 25 bp, Homo sapien
taaggctttactcatcagtcttaag

SEQ ID NO: 46117 - DNA, 25 bp, Homo sapien
aaggctttactcatcagtcttaagt

SEQ ID NO: 46118 - DNA, 25 bp, Homo sapien
aggctttactcatcagtcttaagta

SEQ ID NO: 46119 - DNA, 25 bp, Homo sapien
ggctttactcatcagtcttaagtat

SEQ ID NO: 46120 - DNA, 25 bp, Homo sapien
tttactcatcagtcttaagtatggt

SEQ ID NO: 46121 - DNA, 25 bp, Homo sapien
ttactcatcagtcttaagtatggtt

SEQ ID NO: 46122 - DNA, 25 bp, Homo sapien
tactcatcagtcttaagtatggttg

SEQ ID NO: 46123 - DNA, 25 bp, Homo sapien
actcatcagtcttaagtatggttgt

SEQ ID NO: 46124 - DNA, 25 bp, Homo sapien
ctcatcagtcttaagtatggttgtt

SEQ ID NO: 46125 - DNA, 25 bp, Homo sapien
agaagtaactgttactcaagccacc

SEQ ID NO: 46126 - DNA, 25 bp, Homo sapien
gaagtaactgttactcaagccacca

SEQ ID NO: 46127 - DNA, 25 bp, Homo sapien
ctataattggagcacgaccatgggt

SEQ ID NO: 46128 - DNA, 25 bp, Homo sapien
tggagcacgaccatgggtcccctgc

SEQ ID NO: 46129 - DNA, 25 bp, Homo sapien
tgccaccctttgctgtggcccaggg

SEQ ID NO: 46130 - DNA, 25 bp, Homo sapien
gctcctgatccgtcctgtggacaaa

SEQ ID NO: 46131 - DNA, 25 bp, Homo sapien
ccgtcctgtggacaaaccaatcaac

SEQ ID NO: 46132 - DNA, 25 bp, Homo sapien
catgtctcctattcagctgtgagca

SEQ ID NO: 46133 - DNA, 25 bp, Homo sapien
tcagctgtgagcagagagaacagct

SEQ ID NO: 46134 - DNA, 25 bp, Homo sapien
ctggagagccagtgcccatggcccg

SEQ ID NO: 46135 - DNA, 25 bp, Homo sapien
ggatgcccaatacgagccaggtgcc

SEQ ID NO: 46136 - DNA, 25 bp, Homo sapien
atacgagccaggtgccagggttcct

SEQ ID NO: 46137 - DNA, 25 bp, Homo sapien
atattggtgccctcaagccaggtgg

SEQ ID NO: 46138 - DNA, 25 bp, Homo sapien
tgccctcaagccaggtggacggcaa

SEQ ID NO: 46139 - DNA, 25 bp, Homo sapien
gagcacgagagctttgagaagcctc

SEQ ID NO: 46140 - DNA, 25 bp, Homo sapien
actgtgaacctcaccgtgtactacc

SEQ ID NO: 46141 - DNA, 25 bp, Homo sapien
ccccagaggtatccatctctggcta

SEQ ID NO: 46142 - DNA, 25 bp, Homo sapien
ttggccagaatgaggccaccctgac

SEQ ID NO: 46143 - DNA, 25 bp, Homo sapien
aaacttaaagtatttctgaatgaat

SEQ ID NO: 46144 - DNA, 25 bp, Homo sapien
aggagtaaaagatatttgctgcata

SEQ ID NO: 46145 - DNA, 25 bp, Homo sapien
gtgttttatcactgctcttaactgc

SEQ ID NO: 46146 - DNA, 25 bp, Homo sapien
atcactgctcttaactgcctttgat

SEQ ID NO: 46147 - DNA, 25 bp, Homo sapien
actgctcttaactgcctttgataat

SEQ ID NO: 46148 - DNA, 25 bp, Homo sapien
ctcttaactgcctttgataatttct

SEQ ID NO: 46149 - DNA, 25 bp, Homo sapien
atttctcataaaccattgctgccac

SEQ ID NO: 46150 - DNA, 25 bp, Homo sapien
taaaccattgctgccacctagtttt

SEQ ID NO: 46151 - DNA, 25 bp, Homo sapien
ccattgctgccacctagttttggaa

SEQ ID NO: 46152 - DNA, 25 bp, Homo sapien
ttgctgccacctagttttggaaact

SEQ ID NO: 46153 - DNA, 25 bp, Homo sapien
ttaaaatcctgctagtttgatgaag

SEQ ID NO: 46154 - DNA, 25 bp, Homo sapien
gaagctataatatcccattggtgtc

SEQ ID NO: 46155 - DNA, 25 bp, Homo sapien
ggtgtcatgtattagatcagcctta

SEQ ID NO: 46156 - DNA, 25 bp, Homo sapien
tcagccttatactgttaaattgtta

SEQ ID NO: 46157 - DNA, 25 bp, Homo sapien
gtgagtcagtataaccatgtggata

SEQ ID NO: 46158 - DNA, 25 bp, Homo sapien
aaatgccagacatctttttattcga

SEQ ID NO: 46159 - DNA, 25 bp, Homo sapien
tacttttcatgcttctgtacttaca

SEQ ID NO: 46160 - DNA, 25 bp, Homo sapien
gtacttacatttttatctcaacctt

SEQ ID NO: 46161 - DNA, 25 bp, Homo sapien
tatctcaaccttaatttttctttct

SEQ ID NO: 46162 - DNA, 25 bp, Homo sapien
tttcccccagaaagaatctcactct

SEQ ID NO: 46163 - DNA, 25 bp, Homo sapien
ggactcacactggagagaagcccta

SEQ ID NO: 46164 - DNA, 25 bp, Homo sapien
ttcagacctgacaagattctttgaa

SEQ ID NO: 46165 - DNA, 25 bp, Homo sapien
catgcctgcttggcccaaagagacc

SEQ ID NO: 46166 - DNA, 25 bp, Homo sapien
gagctatgacgtcgcatgcacgcgt

SEQ ID NO: 46167 - DNA, 25 bp, Homo sapien
aagtgagacgcagagagcgccttcc

SEQ ID NO: 46168 - DNA, 25 bp, Homo sapien
cgccttccagtgatctcattgactg

SEQ ID NO: 46169 - DNA, 25 bp, Homo sapien
atttagagacggcatctcgctccgt

SEQ ID NO: 46170 - DNA, 25 bp, Homo sapien
cggcagtggtgccgtcgtaactcac

SEQ ID NO: 46171 - DNA, 25 bp, Homo sapien
tggacgctcctggactcgagcgatc

SEQ ID NO: 46172 - DNA, 25 bp, Homo sapien
ctccgtcgacgcggtcgcgaattta

SEQ ID NO: 46173 - DNA, 25 bp, Homo sapien
gcacgcgtacgtaagcttggatcct

SEQ ID NO: 46174 - DNA, 25 bp, Homo sapien
taagcttggatcctctagagcggcc

SEQ ID NO: 46175 - DNA, 25 bp, Homo sapien
ctactaaattcgcggccgcgtcgac

SEQ ID NO: 46176 - DNA, 25 bp, Homo sapien
caacccattttgtgccacatgcaag

SEQ ID NO: 46177 - DNA, 25 bp, Homo sapien
ccattttgtgccacatgcaagtttt

SEQ ID NO: 46178 - DNA, 25 bp, Homo sapien
ttttgtgccacatgcaagttttgaa

SEQ ID NO: 46179 - DNA, 25 bp, Homo sapien
gtgccacatgcaagttttgaataag

SEQ ID NO: 46180 - DNA, 25 bp, Homo sapien
acaacgctgcatatacaggtaccat

SEQ ID NO: 46181 - DNA, 25 bp, Homo sapien
acgctgcatatacaggtaccattta

SEQ ID NO: 46182 - DNA, 25 bp, Homo sapien
gaaacagggctgattcttgattccc

SEQ ID NO: 46183 - DNA, 25 bp, Homo sapien
acagggctgattcttgattcccaat

SEQ ID NO: 46184 - DNA, 25 bp, Homo sapien
gggctgattcttgattcccaattct

SEQ ID NO: 46185 - DNA, 25 bp, Homo sapien
tgctcattctcatccatccaggatg

SEQ ID NO: 46186 - DNA, 25 bp, Homo sapien
ttgtgtacagttctatactgttatc

SEQ ID NO: 46187 - DNA, 25 bp, Homo sapien
gtacagttctatactgttatctgtg

SEQ ID NO: 46188 - DNA, 25 bp, Homo sapien
gttctatactgttatctgtgtccat

SEQ ID NO: 46189 - DNA, 25 bp, Homo sapien
gtccatttccaaaacttgcacgtgt

SEQ ID NO: 46190 - DNA, 25 bp, Homo sapien
tttccaaaacttgcacgtgtccctg

SEQ ID NO: 46191 - DNA, 25 bp, Homo sapien
aaacttgcacgtgtccctgaattcc

SEQ ID NO: 46192 - DNA, 25 bp, Homo sapien
tgcaatttagttctctaggcttttc

SEQ ID NO: 46193 - DNA, 25 bp, Homo sapien
aatagttttatatcctcctgtttct

SEQ ID NO: 46194 - DNA, 25 bp, Homo sapien
tatatcctcctgtttctaaatctgg

SEQ ID NO: 46195 - DNA, 25 bp, Homo sapien
aatctggatgacagtgtaacactcc

SEQ ID NO: 46196 - DNA, 25 bp, Homo sapien
acagtgtaacactccagtaaggtga

SEQ ID NO: 46197 - DNA, 25 bp, Homo sapien
gtaaggtgaattgtgaattgctgaa

SEQ ID NO: 46198 - DNA, 25 bp, Homo sapien
ttcctcatgttagaattaatgcaga

SEQ ID NO: 46199 - DNA, 25 bp, Homo sapien
attatatcctttgaactagttacat

SEQ ID NO: 46200 - DNA, 25 bp, Homo sapien
ttctggcctgaggctcttggggatt

SEQ ID NO: 46201 - DNA, 25 bp, Homo sapien
ggcctgaggctcttggggattatgt

SEQ ID NO: 46202 - DNA, 25 bp, Homo sapien
ggctcttggggattatgtgacatat

SEQ ID NO: 46203 - DNA, 25 bp, Homo sapien
gttgtgtacaggtggtatctcactg

SEQ ID NO: 46204 - DNA, 25 bp, Homo sapien
caggtggtatctcactgtgttatcc

SEQ ID NO: 46205 - DNA, 25 bp, Homo sapien
tcactgtgttatccagactggactc

SEQ ID NO: 46206 - DNA, 25 bp, Homo sapien
gaagaacgtgatatctccagagcta

SEQ ID NO: 46207 - DNA, 25 bp, Homo sapien
tctccagagctaacacttaactact

SEQ ID NO: 46208 - DNA, 25 bp, Homo sapien
ttaactactatagtgtaccacacaa

SEQ ID NO: 46209 - DNA, 25 bp, Homo sapien
gagcagcattagagaggggtgccac

SEQ ID NO: 46210 - DNA, 25 bp, Homo sapien
gggtgccacttcctctgatggaaga

SEQ ID NO: 46211 - DNA, 25 bp, Homo sapien
aaaaagaaagattgccagcctgggc

SEQ ID NO: 46212 - DNA, 25 bp, Homo sapien
ccccatgcccaggacctgaggacaa

SEQ ID NO: 46213 - DNA, 25 bp, Homo sapien
gacaaaggtctagcgattgtccatc

SEQ ID NO: 46214 - DNA, 25 bp, Homo sapien
ggagcacgggtgggcattggatgta

SEQ ID NO: 46215 - DNA, 25 bp, Homo sapien
gcacgggtgggcattggatgtaagg

SEQ ID NO: 46216 - DNA, 25 bp, Homo sapien
ggtgggcattggatgtaaggtattc

SEQ ID NO: 46217 - DNA, 25 bp, Homo sapien
tggatgtaaggtattcctaacttcc

SEQ ID NO: 46218 - DNA, 25 bp, Homo sapien
ggagacggcaggagcagctcaggta

SEQ ID NO: 46219 - DNA, 25 bp, Homo sapien
ggagcagctcaggtaaccaggggaa

SEQ ID NO: 46220 - DNA, 25 bp, Homo sapien
gcagctcaggtaaccaggggaagct

SEQ ID NO: 46221 - DNA, 25 bp, Homo sapien
ggtaaccaggggaagcttgcgtgcc

SEQ ID NO: 46222 - DNA, 25 bp, Homo sapien
ttgcctgcggagcacgggtgggcat

SEQ ID NO: 46223 - DNA, 25 bp, Homo sapien
tgcctgcggagcacgggtgggcatt

SEQ ID NO: 46224 - DNA, 25 bp, Homo sapien
ctgcggagcacgggtgggcattgga

SEQ ID NO: 46225 - DNA, 25 bp, Homo sapien
gaaagcatgtctgctgggtgtgacc

SEQ ID NO: 46226 - DNA, 25 bp, Homo sapien
aaagcatgtctgctgggtgtgacca

SEQ ID NO: 46227 - DNA, 25 bp, Homo sapien
aagcatgtctgctgggtgtgaccat

SEQ ID NO: 46228 - DNA, 25 bp, Homo sapien
atgtctgctgggtgtgaccatgttt

SEQ ID NO: 46229 - DNA, 25 bp, Homo sapien
tgtctgctgggtgtgaccatgtttc

SEQ ID NO: 46230 - DNA, 25 bp, Homo sapien
gtctgctgggtgtgaccatgtttcc

SEQ ID NO: 46231 - DNA, 25 bp, Homo sapien
tctgctgggtgtgaccatgtttcct

SEQ ID NO: 46232 - DNA, 25 bp, Homo sapien
ctgctgggtgtgaccatgtttcctc

SEQ ID NO: 46233 - DNA, 25 bp, Homo sapien
tgctgggtgtgaccatgtttcctct

SEQ ID NO: 46234 - DNA, 25 bp, Homo sapien
tgggtgtgaccatgtttcctctcaa

SEQ ID NO: 46235 - DNA, 25 bp, Homo sapien
gggtgtgaccatgtttcctctcaat

SEQ ID NO: 46236 - DNA, 25 bp, Homo sapien
ggtgtgaccatgtttcctctcaata

SEQ ID NO: 46237 - DNA, 25 bp, Homo sapien
gtgtgaccatgtttcctctcaataa

SEQ ID NO: 46238 - DNA, 25 bp, Homo sapien
gtgaccatgtttcctctcaataaag

SEQ ID NO: 46239 - DNA, 25 bp, Homo sapien
aaaagttagctgggtgtgatgatgc

SEQ ID NO: 46240 - DNA, 25 bp, Homo sapien
gaaaggatgaaggtgaagcggagga

SEQ ID NO: 46241 - DNA, 25 bp, Homo sapien
tagcagttttccttgtctgtaaagc

SEQ ID NO: 46242 - DNA, 25 bp, Homo sapien
gttttccttgtctgtaaagcattta

SEQ ID NO: 46243 - DNA, 25 bp, Homo sapien
gtgatgatgcacaccttaagtctca

SEQ ID NO: 46244 - DNA, 25 bp, Homo sapien
tgatgcacaccttaagtctcagcta

SEQ ID NO: 46245 - DNA, 25 bp, Homo sapien
acaccttaagtctcagctactcagg

SEQ ID NO: 46246 - DNA, 25 bp, Homo sapien
gaggctggtgggaggatcgcctgac

SEQ ID NO: 46247 - DNA, 25 bp, Homo sapien
tcgcctgaccccaagtagtcatggc

SEQ ID NO: 46248 - DNA, 25 bp, Homo sapien
gaccccaagtagtcatggcaccatc

SEQ ID NO: 46249 - DNA, 25 bp, Homo sapien
caagtagtcatggcaccatcatgca

SEQ ID NO: 46250 - DNA, 25 bp, Homo sapien
caagtaccactgtgttacagttgcc

SEQ ID NO: 46251 - DNA, 25 bp, Homo sapien
tacagttgcctatagtactcagtac

SEQ ID NO: 46252 - DNA, 25 bp, Homo sapien
agtactcagtacagtaacacacttt

SEQ ID NO: 46253 - DNA, 25 bp, Homo sapien
aacacactttacaagcttatagcct

SEQ ID NO: 46254 - DNA, 25 bp, Homo sapien
cactttacaagcttatagcctagga

SEQ ID NO: 46255 - DNA, 25 bp, Homo sapien
caagcttatagcctaggaacaatag

SEQ ID NO: 46256 - DNA, 25 bp, Homo sapien
aatgcatgactgtataatggtttta

SEQ ID NO: 46257 - DNA, 25 bp, Homo sapien
gtgtaccatttttttaatccattat

SEQ ID NO: 46258 - DNA, 25 bp, Homo sapien
ttttttaatccattataccatattt

SEQ ID NO: 46259 - DNA, 25 bp, Homo sapien
tataccatatttttattgtaccttt

SEQ ID NO: 46260 - DNA, 25 bp, Homo sapien
tgtttagatacacaagtaccactgt

SEQ ID NO: 46261 - DNA, 25 bp, Homo sapien
tgtgagccactgcaactggcctaac

SEQ ID NO: 46262 - DNA, 25 bp, Homo sapien
caactggcctaacgtctacttttga

SEQ ID NO: 46263 - DNA, 25 bp, Homo sapien
tggcctaacgtctacttttgaaatg

SEQ ID NO: 46264 - DNA, 25 bp, Homo sapien
gagaatgggaaatacacaattgcca

SEQ ID NO: 46265 - DNA, 25 bp, Homo sapien
gcccttccaaattctttctctagaa

SEQ ID NO: 46266 - DNA, 25 bp, Homo sapien
tgggcaacatggcaaaatcctgtct

SEQ ID NO: 46267 - DNA, 25 bp, Homo sapien
tagccgggtgtggtgatgtgcacct

SEQ ID NO: 46268 - DNA, 25 bp, Homo sapien
caagctactcagaaggctatggtgg

SEQ ID NO: 46269 - DNA, 25 bp, Homo sapien
gagcttcagaggttgaggctgtggt

SEQ ID NO: 46270 - DNA, 25 bp, Homo sapien
gctgtggtgagccatgttggtgtca

SEQ ID NO: 46271 - DNA, 25 bp, Homo sapien
atgttggtgtcactgcactcaagcc

SEQ ID NO: 46272 - DNA, 25 bp, Homo sapien
ccaacagaaccaagtggcagtggac

SEQ ID NO: 46273 - DNA, 25 bp, Homo sapien
aagtggcagtggacgcaccctcaga

SEQ ID NO: 46274 - DNA, 25 bp, Homo sapien
gacgcaccctcagagcatggggtct

SEQ ID NO: 46275 - DNA, 25 bp, Homo sapien
gcaccctcagagcatggggtctatt

SEQ ID NO: 46276 - DNA, 25 bp, Homo sapien
catggggtctattctttccagttca

SEQ ID NO: 46277 - DNA, 25 bp, Homo sapien
ggtctattctttccagttcaacaag

SEQ ID NO: 46278 - DNA, 25 bp, Homo sapien
ctgctaaggactaacacttagccat

SEQ ID NO: 46279 - DNA, 25 bp, Homo sapien
ggactaacacttagccatcgttttt

SEQ ID NO: 46280 - DNA, 25 bp, Homo sapien
acgttcctgccctttactattgctg

SEQ ID NO: 46281 - DNA, 25 bp, Homo sapien
tttgtgtgctacattcaaggagatc

SEQ ID NO: 46282 - DNA, 25 bp, Homo sapien
gtgtgctacattcaaggagatcaaa

SEQ ID NO: 46283 - DNA, 25 bp, Homo sapien
tgctacattcaaggagatcaaaaaa

SEQ ID NO: 46284 - DNA, 25 bp, Homo sapien
cttcttttgcaaagaaagctttttg

SEQ ID NO: 46285 - DNA, 25 bp, Homo sapien
ccctaccttgaagagacatggtggt

SEQ ID NO: 46286 - DNA, 25 bp, Homo sapien
ctaccttgaagagacatggtggtcg

SEQ ID NO: 46287 - DNA, 25 bp, Homo sapien
cagaaaggtgtggtgctggaacatc

SEQ ID NO: 46288 - DNA, 25 bp, Homo sapien
caatggagaaaccctgaaaacactt

SEQ ID NO: 46289 - DNA, 25 bp, Homo sapien
taaggaaaacctgaggccttctata

SEQ ID NO: 46290 - DNA, 25 bp, Homo sapien
tttataaatctctttcctgggtgga

SEQ ID NO: 46291 - DNA, 25 bp, Homo sapien
gtgctccaggaaagtacctgattga

SEQ ID NO: 46292 - DNA, 25 bp, Homo sapien
gtacctgattgacaagatctacatc

SEQ ID NO: 46293 - DNA, 25 bp, Homo sapien
caagatctacatccaatgcccagaa

SEQ ID NO: 46294 - DNA, 25 bp, Homo sapien
acatccaatgcccagaaaacacatc

SEQ ID NO: 46295 - DNA, 25 bp, Homo sapien
aaacacatcctacacaggcacagtg

SEQ ID NO: 46296 - DNA, 25 bp, Homo sapien
caggcacagtgaagcgtggagttga

SEQ ID NO: 46297 - DNA, 25 bp, Homo sapien
gaagaattttccagtgagttccatc

SEQ ID NO: 46298 - DNA, 25 bp, Homo sapien
tttccagtgagttccatcaaagtaa

SEQ ID NO: 46299 - DNA, 25 bp, Homo sapien
ccgcgtcgacgtttaaatcatactg

SEQ ID NO: 46300 - DNA, 25 bp, Homo sapien
gtcgacgtttaaatcatactgctaa

SEQ ID NO: 46301 - DNA, 25 bp, Homo sapien
gagaattccacagatgattttgtat

SEQ ID NO: 46302 - DNA, 25 bp, Homo sapien
aattggttgatctaactcacttatt

SEQ ID NO: 46303 - DNA, 25 bp, Homo sapien
aactcacttattaacatgttcgggg

SEQ ID NO: 46304 - DNA, 25 bp, Homo sapien
acatgttcggggtgtgacctgactg

SEQ ID NO: 46305 - DNA, 25 bp, Homo sapien
ggggtgtgacctgactgtttatggg

SEQ ID NO: 46306 - DNA, 25 bp, Homo sapien
gtgacctgactgtttatgggtaaga

SEQ ID NO: 46307 - DNA, 25 bp, Homo sapien
tatgggtaagatcatgatgcatgtt

SEQ ID NO: 46308 - DNA, 25 bp, Homo sapien
gatgcatgtttgcttgaaatgtcac

SEQ ID NO: 46309 - DNA, 25 bp, Homo sapien
gaaatgtcaccttactagggagaat

SEQ ID NO: 46310 - DNA, 25 bp, Homo sapien
ctacagattgttatttatcatttag

SEQ ID NO: 46311 - DNA, 25 bp, Homo sapien
ggttgtttgtaagccaatgacatcc

SEQ ID NO: 46312 - DNA, 25 bp, Homo sapien
gttatttatcatttaggtatctatt

SEQ ID NO: 46313 - DNA, 25 bp, Homo sapien
gttgtttgtaagccaatgacatccc

SEQ ID NO: 46314 - DNA, 25 bp, Homo sapien
atcatttaggtatctattttaaagg

SEQ ID NO: 46315 - DNA, 25 bp, Homo sapien
tgtttgtaagccaatgacatcccct

SEQ ID NO: 46316 - DNA, 25 bp, Homo sapien
ggaagagtttattgtttctgtgtta

SEQ ID NO: 46317 - DNA, 25 bp, Homo sapien
gtttgtaagccaatgacatcccctc

SEQ ID NO: 46318 - DNA, 25 bp, Homo sapien
gagtttattgtttctgtgttaaaat

SEQ ID NO: 46319 - DNA, 25 bp, Homo sapien
attgtttctgtgttaaaataatgca

SEQ ID NO: 46320 - DNA, 25 bp, Homo sapien
agaaaaaatatattctcattttcag

SEQ ID NO: 46321 - DNA, 25 bp, Homo sapien
aatatgggagggtaccactgatgta

SEQ ID NO: 46322 - DNA, 25 bp, Homo sapien
ctggaaatttccttgagtcatgcat

SEQ ID NO: 46323 - DNA, 25 bp, Homo sapien
atttccttgagtcatgcattttgta

SEQ ID NO: 46324 - DNA, 25 bp, Homo sapien
ttgtaaaaccttacattactgctat

SEQ ID NO: 46325 - DNA, 25 bp, Homo sapien
ttaaaccactcccctcaggatagta

SEQ ID NO: 46326 - DNA, 25 bp, Homo sapien
cactcccctcaggatagtaagactg

SEQ ID NO: 46327 - DNA, 25 bp, Homo sapien
gcccacacagttatagctacagcct

SEQ ID NO: 46328 - DNA, 25 bp, Homo sapien
agcctaggttaaatgattcctcatc

SEQ ID NO: 46329 - DNA, 25 bp, Homo sapien
attcctcatcctggtgtttttattc

SEQ ID NO: 46330 - DNA, 25 bp, Homo sapien
caggactatgtgatgatacttaagc

SEQ ID NO: 46331 - DNA, 25 bp, Homo sapien
aattcatgttaactgtactatttta

SEQ ID NO: 46332 - DNA, 25 bp, Homo sapien
gtttagtaagtctgggcacatctgc

SEQ ID NO: 46333 - DNA, 25 bp, Homo sapien
taagtctgggcacatctgctttctt

SEQ ID NO: 46334 - DNA, 25 bp, Homo sapien
cacatctgctttcttttcactaata

SEQ ID NO: 46335 - DNA, 25 bp, Homo sapien
tctgctttcttttcactaatacata

SEQ ID NO: 46336 - DNA, 25 bp, Homo sapien
aacacagaaacgttatctcatgagt

SEQ ID NO: 46337 - DNA, 25 bp, Homo sapien
gttatctcatgagtaaccagatgta

SEQ ID NO: 46338 - DNA, 25 bp, Homo sapien
acacattagccacagtagtgtgcgc

SEQ ID NO: 46339 - DNA, 25 bp, Homo sapien
gtcaaggtttttgaaccctccagtg

SEQ ID NO: 46340 - DNA, 25 bp, Homo sapien
gtgactggatctacagaagtctgct

SEQ ID NO: 46341 - DNA, 25 bp, Homo sapien
gaagtctgcttttggtgtagactcc

SEQ ID NO: 46342 - DNA, 25 bp, Homo sapien
agaattctaagttgtttaactgcct

SEQ ID NO: 46343 - DNA, 25 bp, Homo sapien
ggtcttcatttccagatatcatctc

SEQ ID NO: 46344 - DNA, 25 bp, Homo sapien
ctcttcttttgatcactgttcctga

SEQ ID NO: 46345 - DNA, 25 bp, Homo sapien
cactgttcctgattgtgacattgtg

SEQ ID NO: 46346 - DNA, 25 bp, Homo sapien
gattgtgacattgtgcaagtgttaa

SEQ ID NO: 46347 - DNA, 25 bp, Homo sapien
taaattgtgtgccttttgttcctga

SEQ ID NO: 46348 - DNA, 25 bp, Homo sapien
gtatcccaaatccaaaaatccagaa

SEQ ID NO: 46349 - DNA, 25 bp, Homo sapien
ttttttgagtgctgacatgatggtc

SEQ ID NO: 46350 - DNA, 25 bp, Homo sapien
tgctctttggaacattttggatttt

SEQ ID NO: 46351 - DNA, 25 bp, Homo sapien
gagatgctcaactggtataatgcaa

SEQ ID NO: 46352 - DNA, 25 bp, Homo sapien
taatgcaaatactctaaaatcctaa

SEQ ID NO: 46353 - DNA, 25 bp, Homo sapien
aagaatgaaacccttctgtcgtctt

SEQ ID NO: 46354 - DNA, 25 bp, Homo sapien
gggaagatttgaattccattgaatt

SEQ ID NO: 46355 - DNA, 25 bp, Homo sapien
attccattgaattcatggaagcagg

SEQ ID NO: 46356 - DNA, 25 bp, Homo sapien
ggaagcaggaatccatctggtcata

SEQ ID NO: 46357 - DNA, 25 bp, Homo sapien
gaagcaggaatccatctggtcatat

SEQ ID NO: 46358 - DNA, 25 bp, Homo sapien
aagcaggaatccatctggtcatatt

SEQ ID NO: 46359 - DNA, 25 bp, Homo sapien
agcaggaatccatctggtcatattt

SEQ ID NO: 46360 - DNA, 25 bp, Homo sapien
gcaggaatccatctggtcatatttt

SEQ ID NO: 46361 - DNA, 25 bp, Homo sapien
caggaatccatctggtcatatttta

SEQ ID NO: 46362 - DNA, 25 bp, Homo sapien
aggaatccatctggtcatattttaa

SEQ ID NO: 46363 - DNA, 25 bp, Homo sapien
ggaatccatctggtcatattttaaa

SEQ ID NO: 46364 - DNA, 25 bp, Homo sapien
atccatctggtcatattttaaataa

SEQ ID NO: 46365 - DNA, 25 bp, Homo sapien
caaacacatccttcacatggtggca

SEQ ID NO: 46366 - DNA, 25 bp, Homo sapien
catcagatctcgtgggaactcactc

SEQ ID NO: 46367 - DNA, 25 bp, Homo sapien
gatctcgtgggaactcactcattat

SEQ ID NO: 46368 - DNA, 25 bp, Homo sapien
ggagaacagcactgggggactgccc

SEQ ID NO: 46369 - DNA, 25 bp, Homo sapien
tccaccccagcacctgggaatcaca

SEQ ID NO: 46370 - DNA, 25 bp, Homo sapien
gggaatcacaacttggtttacaatt

SEQ ID NO: 46371 - DNA, 25 bp, Homo sapien
gattttgggtggggacacagccaga

SEQ ID NO: 46372 - DNA, 25 bp, Homo sapien
cacagccagaccatatcatcatttc

SEQ ID NO: 46373 - DNA, 25 bp, Homo sapien
gatttatttttactatctgaatttt

SEQ ID NO: 46374 - DNA, 25 bp, Homo sapien
agagttctgcatggctgggaggccc

SEQ ID NO: 46375 - DNA, 25 bp, Homo sapien
gaggccccaggaaacttataatcat

SEQ ID NO: 46376 - DNA, 25 bp, Homo sapien
ggaactatactttgcatccttcaat

SEQ ID NO: 46377 - DNA, 25 bp, Homo sapien
gacactcaatattaaccatcacatt

SEQ ID NO: 46378 - DNA, 25 bp, Homo sapien
atcatttcacattgtatacatacat

SEQ ID NO: 46379 - DNA, 25 bp, Homo sapien
gtatcatcacactgtacatctcaaa

SEQ ID NO: 46380 - DNA, 25 bp, Homo sapien
cacactgtacatctcaaatatatgc

SEQ ID NO: 46381 - DNA, 25 bp, Homo sapien
tatttgtcaatcatacttcagtata

SEQ ID NO: 46382 - DNA, 25 bp, Homo sapien
aaaccatgctttcaaaggagccttg

SEQ ID NO: 46383 - DNA, 25 bp, Homo sapien
aggagccttggctaccaaaattcaa

SEQ ID NO: 46384 - DNA, 25 bp, Homo sapien
acatatatatacttgactactcatt

SEQ ID NO: 46385 - DNA, 25 bp, Homo sapien
tgactactcatttaagccttctgtg

SEQ ID NO: 46386 - DNA, 25 bp, Homo sapien
tctcccagtccactgactcaaatgt

SEQ ID NO: 46387 - DNA, 25 bp, Homo sapien
aggaagcctttattggttgggctag

SEQ ID NO: 46388 - DNA, 25 bp, Homo sapien
cctttattggttgggctaggctggg

SEQ ID NO: 46389 - DNA, 25 bp, Homo sapien
gggctaggctgggctagctgtggaa

SEQ ID NO: 46390 - DNA, 25 bp, Homo sapien
gaagatagacttctatgtccctgcc

SEQ ID NO: 46391 - DNA, 25 bp, Homo sapien
tgtaattagtgaatcgatgtctgtc

SEQ ID NO: 46392 - DNA, 25 bp, Homo sapien
agtgaatcgatgtctgtcaccgtct

SEQ ID NO: 46393 - DNA, 25 bp, Homo sapien
tctgtcaccgtctgtagatgctgag

SEQ ID NO: 46394 - DNA, 25 bp, Homo sapien
gtcaccgtctgtagatgctgaggtc

SEQ ID NO: 46395 - DNA, 25 bp, Homo sapien
gtctgtagatgctgaggtcttgttc

SEQ ID NO: 46396 - DNA, 25 bp, Homo sapien
gatgctgaggtcttgttcatctctt

SEQ ID NO: 46397 - DNA, 25 bp, Homo sapien
tgctgaggtcttgttcatctcttta

SEQ ID NO: 46398 - DNA, 25 bp, Homo sapien
catgttttaatataagtgttgtggt

SEQ ID NO: 46399 - DNA, 25 bp, Homo sapien
taagtgttgtggtaatacaataacc

SEQ ID NO: 46400 - DNA, 25 bp, Homo sapien
tgaacacacagttttaaagcttttt

SEQ ID NO: 46401 - DNA, 25 bp, Homo sapien
ttaaagctttttatatttagtagca

SEQ ID NO: 46402 - DNA, 25 bp, Homo sapien
tgaatatatatggcatgttttacat

SEQ ID NO: 46403 - DNA, 25 bp, Homo sapien
atatggcatgttttacatagattaa

SEQ ID NO: 46404 - DNA, 25 bp, Homo sapien
catagattaattttactatttttct

SEQ ID NO: 46405 - DNA, 25 bp, Homo sapien
agaaccaaattgaaagccgacagat

SEQ ID NO: 46406 - DNA, 25 bp, Homo sapien
aaattgaaagccgacagatactgca

SEQ ID NO: 46407 - DNA, 25 bp, Homo sapien
gcccttaggcaacatttattgaata

SEQ ID NO: 46408 - DNA, 25 bp, Homo sapien
tataagattagaatccattttttat

SEQ ID NO: 46409 - DNA, 25 bp, Homo sapien
gaatacaattgtgggagactttaat

SEQ ID NO: 46410 - DNA, 25 bp, Homo sapien
gtatgtatttggccatcttttataa

SEQ ID NO: 46411 - DNA, 25 bp, Homo sapien
gagaaatggtgtccagatcctggtt

SEQ ID NO: 46412 - DNA, 25 bp, Homo sapien
tggtgtccagatcctggtttctaaa

SEQ ID NO: 46413 - DNA, 25 bp, Homo sapien
aaatggctgattctggggttgtgat

SEQ ID NO: 46414 - DNA, 25 bp, Homo sapien
aagagtgcccacttcaaaagcacct

SEQ ID NO: 46415 - DNA, 25 bp, Homo sapien
tgcccacttcaaaagcacctgtact

SEQ ID NO: 46416 - DNA, 25 bp, Homo sapien
aagcacctgtactaaaattggaaca

SEQ ID NO: 46417 - DNA, 25 bp, Homo sapien
gatgattagcatggatgacacacga

SEQ ID NO: 46418 - DNA, 25 bp, Homo sapien
ggatgacacacgaattagtaaagca

SEQ ID NO: 46419 - DNA, 25 bp, Homo sapien
agtgggccaggatagtgccactgca

SEQ ID NO: 46420 - DNA, 25 bp, Homo sapien
cccgggaggctgacattgtagtgag

SEQ ID NO: 46421 - DNA, 25 bp, Homo sapien
gcactctggcctaggcaacgagtga

SEQ ID NO: 46422 - DNA, 25 bp, Homo sapien
aaactgaacacatctaaatacctga

SEQ ID NO: 46423 - DNA, 25 bp, Homo sapien
taaatacctgatggggatttggggg

SEQ ID NO: 46424 - DNA, 25 bp, Homo sapien
ggggaagatggcatatgcttaaggc

SEQ ID NO: 46425 - DNA, 25 bp, Homo sapien
atgcttaaggcatgatgagggatgg

SEQ ID NO: 46426 - DNA, 25 bp, Homo sapien
gacatcaaagagtctggctacccaa

SEQ ID NO: 46427 - DNA, 25 bp, Homo sapien
gtctggctacccaaagaaatctagt

SEQ ID NO: 46428 - DNA, 25 bp, Homo sapien
aaatctagttagttgtctgcatgtc

SEQ ID NO: 46429 - DNA, 25 bp, Homo sapien
ttagttgtctgcatgtctgtctacc

SEQ ID NO: 46430 - DNA, 25 bp, Homo sapien
tctgcatgtctgtctacctgactag

SEQ ID NO: 46431 - DNA, 25 bp, Homo sapien
ttcttggaagccgagacgcgggcca

SEQ ID NO: 46432 - DNA, 25 bp, Homo sapien
gaaagctttgagagtgtaccttttc

SEQ ID NO: 46433 - DNA, 25 bp, Homo sapien
cacttttacgactttgaatttacag

SEQ ID NO: 46434 - DNA, 25 bp, Homo sapien
tacagtgttgctatttagtagtgga

SEQ ID NO: 46435 - DNA, 25 bp, Homo sapien
tagtagtggatggcaatcccgcctg

SEQ ID NO: 46436 - DNA, 25 bp, Homo sapien
tcatctccaccctgaaggacaagcg

SEQ ID NO: 46437 - DNA, 25 bp, Homo sapien
caagcgcaaatgaagcagctgtcca

SEQ ID NO: 46438 - DNA, 25 bp, Homo sapien
aggacaagcgcgggacccgctatga

SEQ ID NO: 46439 - DNA, 25 bp, Homo sapien
gggacccgctatgaggtgcgtgaag

SEQ ID NO: 46440 - DNA, 25 bp, Homo sapien
gtgcgtgaagtgggcaggccctgtc

SEQ ID NO: 46441 - DNA, 25 bp, Homo sapien
tgaagtgggcaggccctgtcagtct

SEQ ID NO: 46442 - DNA, 25 bp, Homo sapien
agaaatagtctctgtttcccaggct

SEQ ID NO: 46443 - DNA, 25 bp, Homo sapien
gtctctgtttcccaggctggagtac

SEQ ID NO: 46444 - DNA, 25 bp, Homo sapien
gtttcccaggctggagtacagtggc

SEQ ID NO: 46445 - DNA, 25 bp, Homo sapien
caggctggagtacagtggcgcaatc

SEQ ID NO: 46446 - DNA, 25 bp, Homo sapien
ggagtacagtggcgcaatcttggct

SEQ ID NO: 46447 - DNA, 25 bp, Homo sapien
caccactcccgactaatatatctgc

SEQ ID NO: 46448 - DNA, 25 bp, Homo sapien
cactcccgactaatatatctgctat

SEQ ID NO: 46449 - DNA, 25 bp, Homo sapien
tcccgactaatatatctgctatcaa

SEQ ID NO: 46450 - DNA, 25 bp, Homo sapien
atatatctgctatcaataacataat

SEQ ID NO: 46451 - DNA, 25 bp, Homo sapien
ataacataattgtttccctttgtgc

SEQ ID NO: 46452 - DNA, 25 bp, Homo sapien
acataattgtttccctttgtgctta

SEQ ID NO: 46453 - DNA, 25 bp, Homo sapien
taaaagccttggatcactcactcat

SEQ ID NO: 46454 - DNA, 25 bp, Homo sapien
aaaagccttggatcactcactcatg

SEQ ID NO: 46455 - DNA, 25 bp, Homo sapien
agccttggatcactcactcatggaa

SEQ ID NO: 46456 - DNA, 25 bp, Homo sapien
attcatgggcccattgaaccggcat

SEQ ID NO: 46457 - DNA, 25 bp, Homo sapien
ttcatgggcccattgaaccggcatt

SEQ ID NO: 46458 - DNA, 25 bp, Homo sapien
tcatgggcccattgaaccggcattg

SEQ ID NO: 46459 - DNA, 25 bp, Homo sapien
catgggcccattgaaccggcattgt

SEQ ID NO: 46460 - DNA, 25 bp, Homo sapien
atgggcccattgaaccggcattgtt

SEQ ID NO: 46461 - DNA, 25 bp, Homo sapien
tgggcccattgaaccggcattgttt

SEQ ID NO: 46462 - DNA, 25 bp, Homo sapien
gggcccattgaaccggcattgtttt

SEQ ID NO: 46463 - DNA, 25 bp, Homo sapien
ggcccattgaaccggcattgttttt

SEQ ID NO: 46464 - DNA, 25 bp, Homo sapien
gtgtgtctgcatggcaccacagggc

SEQ ID NO: 46465 - DNA, 25 bp, Homo sapien
tgtgtctgcatggcaccacagggct

SEQ ID NO: 46466 - DNA, 25 bp, Homo sapien
tctgcatggcaccacagggctggaa

SEQ ID NO: 46467 - DNA, 25 bp, Homo sapien
catggcaccacagggctggaagacc

SEQ ID NO: 46468 - DNA, 25 bp, Homo sapien
gcaccacagggctggaagacccttg

SEQ ID NO: 46469 - DNA, 25 bp, Homo sapien
gaaggcaggaattcaaggaaatgta

SEQ ID NO: 46470 - DNA, 25 bp, Homo sapien
acaggcatggaaaacttgggtgagt

SEQ ID NO: 46471 - DNA, 25 bp, Homo sapien
ggtgagtgggcgagacaacctcctc

SEQ ID NO: 46472 - DNA, 25 bp, Homo sapien
ggagggatttgtgtccactgcagtg

SEQ ID NO: 46473 - DNA, 25 bp, Homo sapien
agggatttgtgtccactgcagtggg

SEQ ID NO: 46474 - DNA, 25 bp, Homo sapien
tgtggtgctctttggaggaatgaat

SEQ ID NO: 46475 - DNA, 25 bp, Homo sapien
ccagagtctgtttcctcacctgctg

SEQ ID NO: 46476 - DNA, 25 bp, Homo sapien
aagggacttgttctcccttgaccag

SEQ ID NO: 46477 - DNA, 25 bp, Homo sapien
agggacttgttctcccttgaccagt

SEQ ID NO: 46478 - DNA, 25 bp, Homo sapien
gggacttgttctcccttgaccagtt

SEQ ID NO: 46479 - DNA, 25 bp, Homo sapien
gacttgttctcccttgaccagtttt

SEQ ID NO: 46480 - DNA, 25 bp, Homo sapien
cttgttctcccttgaccagttttct

SEQ ID NO: 46481 - DNA, 25 bp, Homo sapien
ttgttctcccttgaccagttttcta

SEQ ID NO: 46482 - DNA, 25 bp, Homo sapien
tgttctcccttgaccagttttctag

SEQ ID NO: 46483 - DNA, 25 bp, Homo sapien
gttctcccttgaccagttttctagt

SEQ ID NO: 46484 - DNA, 25 bp, Homo sapien
ttctcccttgaccagttttctagtt

SEQ ID NO: 46485 - DNA, 25 bp, Homo sapien
tctcccttgaccagttttctagttt

SEQ ID NO: 46486 - DNA, 25 bp, Homo sapien
gcccacccattgaagtctccttggg

SEQ ID NO: 46487 - DNA, 25 bp, Homo sapien
cacccattgaagtctccttgggcca

SEQ ID NO: 46488 - DNA, 25 bp, Homo sapien
attgaagtctccttgggccaccaaa

SEQ ID NO: 46489 - DNA, 25 bp, Homo sapien
tgaagtctccttgggccaccaaagg

SEQ ID NO: 46490 - DNA, 25 bp, Homo sapien
gtctccttgggccaccaaaggtggt

SEQ ID NO: 46491 - DNA, 25 bp, Homo sapien
tctccttgggccaccaaaggtggtg

SEQ ID NO: 46492 - DNA, 25 bp, Homo sapien
aacggtgctggcagttcggctagat

SEQ ID NO: 46493 - DNA, 25 bp, Homo sapien
cggtgctggcagttcggctagattt

SEQ ID NO: 46494 - DNA, 25 bp, Homo sapien
gtgctggcagttcggctagatttct

SEQ ID NO: 46495 - DNA, 25 bp, Homo sapien
ctggcagttcggctagatttctgtc

SEQ ID NO: 46496 - DNA, 25 bp, Homo sapien
tggcagttcggctagatttctgtct

SEQ ID NO: 46497 - DNA, 25 bp, Homo sapien
ttaatttatggtttctgcgtgcttt

SEQ ID NO: 46498 - DNA, 25 bp, Homo sapien
aatttatggtttctgcgtgctttat

SEQ ID NO: 46499 - DNA, 25 bp, Homo sapien
gtttctgcgtgctttatttatggct

SEQ ID NO: 46500 - DNA, 25 bp, Homo sapien
ttctttacttggcttacaaaatata

SEQ ID NO: 46501 - DNA, 25 bp, Homo sapien
atatacaggcttggaaattatttca

SEQ ID NO: 46502 - DNA, 25 bp, Homo sapien
agggataccctgtctggttgcaggt

SEQ ID NO: 46503 - DNA, 25 bp, Homo sapien
ataccctgtctggttgcaggttgta

SEQ ID NO: 46504 - DNA, 25 bp, Homo sapien
gtctggttgcaggttgtattttatt

SEQ ID NO: 46505 - DNA, 25 bp, Homo sapien
ttgtattttattttggcccagggag

SEQ ID NO: 46506 - DNA, 25 bp, Homo sapien
ttttggcccagggagtgttgctgtt

SEQ ID NO: 46507 - DNA, 25 bp, Homo sapien
ggcccagggagtgttgctgttttcc

SEQ ID NO: 46508 - DNA, 25 bp, Homo sapien
gtgtcatttcaaccaacaactgttg

SEQ ID NO: 46509 - DNA, 25 bp, Homo sapien
ccaacaactgttgaagaggacgtgg

SEQ ID NO: 46510 - DNA, 25 bp, Homo sapien
acaactgttgaagaggacgtggcat

SEQ ID NO: 46511 - DNA, 25 bp, Homo sapien
tggtggttggtccaagcatctctcc

SEQ ID NO: 46512 - DNA, 25 bp, Homo sapien
ttggtccaagcatctctccttcatg

SEQ ID NO: 46513 - DNA, 25 bp, Homo sapien
tggtccaagcatctctccttcatgc

SEQ ID NO: 46514 - DNA, 25 bp, Homo sapien
atgccatcactcctttcaagagctg

SEQ ID NO: 46515 - DNA, 25 bp, Homo sapien
tgccatcactcctttcaagagctgc

SEQ ID NO: 46516 - DNA, 25 bp, Homo sapien
gagctgcctctattttctaatttag

SEQ ID NO: 46517 - DNA, 25 bp, Homo sapien
caggaatttagatgcccctaaataa

SEQ ID NO: 46518 - DNA, 25 bp, Homo sapien
tttagatgcccctaaataagtaggc

SEQ ID NO: 46519 - DNA, 25 bp, Homo sapien
tagatgcccctaaataagtaggcat

SEQ ID NO: 46520 - DNA, 25 bp, Homo sapien
gcccctaaataagtaggcatccagt

SEQ ID NO: 46521 - DNA, 25 bp, Homo sapien
ataagtaggcatccagtatctgccc

SEQ ID NO: 46522 - DNA, 25 bp, Homo sapien
taagtaggcatccagtatctgccca

SEQ ID NO: 46523 - DNA, 25 bp, Homo sapien
gtaggcatccagtatctgcccacac

SEQ ID NO: 46524 - DNA, 25 bp, Homo sapien
gcacagctacacagaggaaataact

SEQ ID NO: 46525 - DNA, 25 bp, Homo sapien
agctacacagaggaaataacttagg

SEQ ID NO: 46526 - DNA, 25 bp, Homo sapien
gcccaccaatcagagaagctggttg

SEQ ID NO: 46527 - DNA, 25 bp, Homo sapien
ccaccaatcagagaagctggttgtt

SEQ ID NO: 46528 - DNA, 25 bp, Homo sapien
ccaatcagagaagctggttgttatt

SEQ ID NO: 46529 - DNA, 25 bp, Homo sapien
agctggttgttattaaccaagctac

SEQ ID NO: 46530 - DNA, 25 bp, Homo sapien
gttgttattaaccaagctacagatt

SEQ ID NO: 46531 - DNA, 25 bp, Homo sapien
gttattaaccaagctacagattcac

SEQ ID NO: 46532 - DNA, 25 bp, Homo sapien
ctaaaccctaatgggatgaggcttt

SEQ ID NO: 46533 - DNA, 25 bp, Homo sapien
aaccctaatgggatgaggcttttca

SEQ ID NO: 46534 - DNA, 25 bp, Homo sapien
accctaatgggatgaggcttttcac

SEQ ID NO: 46535 - DNA, 25 bp, Homo sapien
tcccacatcatccattgtcttgctg

SEQ ID NO: 46536 - DNA, 25 bp, Homo sapien
cctagaggagtttttccaggctgtc

SEQ ID NO: 46537 - DNA, 25 bp, Homo sapien
ctagaggagtttttccaggctgtct

SEQ ID NO: 46538 - DNA, 25 bp, Homo sapien
agaggagtttttccaggctgtctgt

SEQ ID NO: 46539 - DNA, 25 bp, Homo sapien
ggaacacaacggcaactgggagatt

SEQ ID NO: 46540 - DNA, 25 bp, Homo sapien
aacacaacggcaactgggagatttg

SEQ ID NO: 46541 - DNA, 25 bp, Homo sapien
aacggcaactgggagatttgtgagt

SEQ ID NO: 46542 - DNA, 25 bp, Homo sapien
aactgggagatttgtgagtgaacac

SEQ ID NO: 46543 - DNA, 25 bp, Homo sapien
gtgagtgaacactgtttcatcttaa

SEQ ID NO: 46544 - DNA, 25 bp, Homo sapien
tttcatgtactaaatagatcagctc

SEQ ID NO: 46545 - DNA, 25 bp, Homo sapien
gtactaaatagatcagctcatcaaa

SEQ ID NO: 46546 - DNA, 25 bp, Homo sapien
gagatcctaccccatcagacaaggg

SEQ ID NO: 46547 - DNA, 25 bp, Homo sapien
accccatcagacaagggcagtgagc

SEQ ID NO: 46548 - DNA, 25 bp, Homo sapien
ggattagggtagatgattgcaactg

SEQ ID NO: 46549 - DNA, 25 bp, Homo sapien
attgcaactgaaacacaatcttctt

SEQ ID NO: 46550 - DNA, 25 bp, Homo sapien
ttctttctttgccagggtattttgg

SEQ ID NO: 46551 - DNA, 25 bp, Homo sapien
tttgccccaaaatataccctgggca

SEQ ID NO: 46552 - DNA, 25 bp, Homo sapien
ataccctgggcatagcattactgca

SEQ ID NO: 46553 - DNA, 25 bp, Homo sapien
gcatagcattactgcagtcttggat

SEQ ID NO: 46554 - DNA, 25 bp, Homo sapien
attactgcagtcttggatgtctacc

SEQ ID NO: 46555 - DNA, 25 bp, Homo sapien
tgcagtcttggatgtctaccccaaa

SEQ ID NO: 46556 - DNA, 25 bp, Homo sapien
cttggatgtctaccccaaacttcca

SEQ ID NO: 46557 - DNA, 25 bp, Homo sapien
caggagggcccgtgtggaggcagcc

SEQ ID NO: 46558 - DNA, 25 bp, Homo sapien
ccgtgtggaggcagccgcgccagtc

SEQ ID NO: 46559 - DNA, 25 bp, Homo sapien
agagtgccttaggaattctctgatt

SEQ ID NO: 46560 - DNA, 25 bp, Homo sapien
attctctgattttgatttgctgacg

SEQ ID NO: 46561 - DNA, 25 bp, Homo sapien
ttctctgattttgatttgctgacgt

SEQ ID NO: 46562 - DNA, 25 bp, Homo sapien
ctctgattttgatttgctgacgtgt

SEQ ID NO: 46563 - DNA, 25 bp, Homo sapien
ctgattttgatttgctgacgtgtta

SEQ ID NO: 46564 - DNA, 25 bp, Homo sapien
gattttgatttgctgacgtgttaat

SEQ ID NO: 46565 - DNA, 25 bp, Homo sapien
gatttgctgacgtgttaatcttttc

SEQ ID NO: 46566 - DNA, 25 bp, Homo sapien
atttgctgacgtgttaatcttttca

SEQ ID NO: 46567 - DNA, 25 bp, Homo sapien
gttaatcttttcatctgtgagtaaa

SEQ ID NO: 46568 - DNA, 25 bp, Homo sapien
cctggggctctcagggagaactgct

SEQ ID NO: 46569 - DNA, 25 bp, Homo sapien
agggagaactgcttcccctggcaga

SEQ ID NO: 46570 - DNA, 25 bp, Homo sapien
gggagaactgcttcccctggcagag

SEQ ID NO: 46571 - DNA, 25 bp, Homo sapien
gaactgcttcccctggcagagctgg

SEQ ID NO: 46572 - DNA, 25 bp, Homo sapien
actgcttcccctggcagagctgggt

SEQ ID NO: 46573 - DNA, 25 bp, Homo sapien
agagctgggtggcagctcttcctcc

SEQ ID NO: 46574 - DNA, 25 bp, Homo sapien
gagctgggtggcagctcttcctccc

SEQ ID NO: 46575 - DNA, 25 bp, Homo sapien
ggtggcagctcttcctcccaccgga

SEQ ID NO: 46576 - DNA, 25 bp, Homo sapien
cgcccgctgctgtgccctgggagtg

SEQ ID NO: 46577 - DNA, 25 bp, Homo sapien
cgctgctgtgccctgggagtgctgc

SEQ ID NO: 46578 - DNA, 25 bp, Homo sapien
gctgctgtgccctgggagtgctgcc

SEQ ID NO: 46579 - DNA, 25 bp, Homo sapien
gaccgttccgctcttccggccaggt

SEQ ID NO: 46580 - DNA, 25 bp, Homo sapien
cttttctgtcaatttctatggaatg

SEQ ID NO: 46581 - DNA, 25 bp, Homo sapien
ttctgtcaatttctatggaatgcaa

SEQ ID NO: 46582 - DNA, 25 bp, Homo sapien
tgtcaatttctatggaatgcaaaag

SEQ ID NO: 46583 - DNA, 25 bp, Homo sapien
aaaatctacatcttatacttgagcc

SEQ ID NO: 46584 - DNA, 25 bp, Homo sapien
aatctacatcttatacttgagcctc

SEQ ID NO: 46585 - DNA, 25 bp, Homo sapien
ctacatcttatacttgagcctccat

SEQ ID NO: 46586 - DNA, 25 bp, Homo sapien
tacatcttatacttgagcctccata

SEQ ID NO: 46587 - DNA, 25 bp, Homo sapien
acatcttatacttgagcctccatac

SEQ ID NO: 46588 - DNA, 25 bp, Homo sapien
catcttatacttgagcctccatact

SEQ ID NO: 46589 - DNA, 25 bp, Homo sapien
atcttatacttgagcctccatactt

SEQ ID NO: 46590 - DNA, 25 bp, Homo sapien
tggaatcccccaaggctggttttct

SEQ ID NO: 46591 - DNA, 25 bp, Homo sapien
tggagacccccatgggcaacttggc

SEQ ID NO: 46592 - DNA, 25 bp, Homo sapien
ccatgggcaacttggcaggagagat

SEQ ID NO: 46593 - DNA, 25 bp, Homo sapien
gatggtgccgtaggaggtcgtggat

SEQ ID NO: 46594 - DNA, 25 bp, Homo sapien
ggaggtcgtggatggttgatgccaa

SEQ ID NO: 46595 - DNA, 25 bp, Homo sapien
ccgtggtgggcaaatgtccaggcct

SEQ ID NO: 46596 - DNA, 25 bp, Homo sapien
ccagggctgtttctgggtgctccct

SEQ ID NO: 46597 - DNA, 25 bp, Homo sapien
ggctgtttctgggtgctccctggcc

SEQ ID NO: 46598 - DNA, 25 bp, Homo sapien
cccagggtggcgtctggttaccatg

SEQ ID NO: 46599 - DNA, 25 bp, Homo sapien
cagggtggcgtctggttaccatggc

SEQ ID NO: 46600 - DNA, 25 bp, Homo sapien
ttaccatggctgtgtgtgtccatgt

SEQ ID NO: 46601 - DNA, 25 bp, Homo sapien
ctgtctttggcagcgacaccttttg

SEQ ID NO: 46602 - DNA, 25 bp, Homo sapien
tttggcagcgacaccttttgtgaac

SEQ ID NO: 46603 - DNA, 25 bp, Homo sapien
gcagcgacaccttttgtgaaccctt

SEQ ID NO: 46604 - DNA, 25 bp, Homo sapien
gcgacaccttttgtgaacccttcga

SEQ ID NO: 46605 - DNA, 25 bp, Homo sapien
gactcactgctggaggaggacttcc

SEQ ID NO: 46606 - DNA, 25 bp, Homo sapien
tgctggaggaggacttccctgacac

SEQ ID NO: 46607 - DNA, 25 bp, Homo sapien
ggaggaggacttccctgacacccag

SEQ ID NO: 46608 - DNA, 25 bp, Homo sapien
aggacttccctgacacccagaggat

SEQ ID NO: 46609 - DNA, 25 bp, Homo sapien
ccagaggatcctcacagtcaagtga

SEQ ID NO: 46610 - DNA, 25 bp, Homo sapien
aggatcctcacagtcaagtgacgag

SEQ ID NO: 46611 - DNA, 25 bp, Homo sapien
ctcacagtcaagtgacgaggctggg

SEQ ID NO: 46612 - DNA, 25 bp, Homo sapien
ggacagacctggtgtcaccagtttt

SEQ ID NO: 46613 - DNA, 25 bp, Homo sapien
tggtgtcaccagtttttcctagcat

SEQ ID NO: 46614 - DNA, 25 bp, Homo sapien
tttcctagcatcagtccgaaccatg

SEQ ID NO: 46615 - DNA, 25 bp, Homo sapien
ctgccccaactgtgtgctggtcctg

SEQ ID NO: 46616 - DNA, 25 bp, Homo sapien
aactgtgtgctggtcctgctgtggc

SEQ ID NO: 46617 - DNA, 25 bp, Homo sapien
gtgtgtttggctctttatgcccctc

SEQ ID NO: 46618 - DNA, 25 bp, Homo sapien
ctcccgctgtggtcctggaactctt

SEQ ID NO: 46619 - DNA, 25 bp, Homo sapien
gtcctggaactcttcaccagggagg

SEQ ID NO: 46620 - DNA, 25 bp, Homo sapien
ctggaactcttcaccagggagggag

SEQ ID NO: 46621 - DNA, 25 bp, Homo sapien
cctttcttgcgtctccctgtgatgg

SEQ ID NO: 46622 - DNA, 25 bp, Homo sapien
tctccctgtgatgggcccttaggcc

SEQ ID NO: 46623 - DNA, 25 bp, Homo sapien
gaagggtggactggatcctcaagca

SEQ ID NO: 46624 - DNA, 25 bp, Homo sapien
gggtggactggatcctcaagcagaa

SEQ ID NO: 46625 - DNA, 25 bp, Homo sapien
gactggatcctcaagcagaaggtca

SEQ ID NO: 46626 - DNA, 25 bp, Homo sapien
gatcctcaagcagaaggtcacttct

SEQ ID NO: 46627 - DNA, 25 bp, Homo sapien
tcctcaagcagaaggtcacttctcc

SEQ ID NO: 46628 - DNA, 25 bp, Homo sapien
cacctgggaaatggcctcaacggtc

SEQ ID NO: 46629 - DNA, 25 bp, Homo sapien
ctgggaaatggcctcaacggtcttc

SEQ ID NO: 46630 - DNA, 25 bp, Homo sapien
ggaaatggcctcaacggtcttccct

SEQ ID NO: 46631 - DNA, 25 bp, Homo sapien
aaatggcctcaacggtcttccctct

SEQ ID NO: 46632 - DNA, 25 bp, Homo sapien
cagaatgggtgtcccgctctgcctt

SEQ ID NO: 46633 - DNA, 25 bp, Homo sapien
ggtgtcccgctctgccttcagagat

SEQ ID NO: 46634 - DNA, 25 bp, Homo sapien
caaaaggtgatgctgtctcgataat

SEQ ID NO: 46635 - DNA, 25 bp, Homo sapien
gatgctgtctcgataatttctgaaa

SEQ ID NO: 46636 - DNA, 25 bp, Homo sapien
agctgttcttggtgcacttgataaa

SEQ ID NO: 46637 - DNA, 25 bp, Homo sapien
cttggtgcacttgataaaattagac

SEQ ID NO: 46638 - DNA, 25 bp, Homo sapien
agacaaagttcattccagcagagac

SEQ ID NO: 46639 - DNA, 25 bp, Homo sapien
agtaattcatattggttttcctgtc

SEQ ID NO: 46640 - DNA, 25 bp, Homo sapien
atattggttttcctgtctgtctgga

SEQ ID NO: 46641 - DNA, 25 bp, Homo sapien
cctgtctgtctggaaaagcctgacc

SEQ ID NO: 46642 - DNA, 25 bp, Homo sapien
gcctgacctttctatttgattccaa

SEQ ID NO: 46643 - DNA, 25 bp, Homo sapien
gattccaaatcaaacctatatcagg

SEQ ID NO: 46644 - DNA, 25 bp, Homo sapien
tcaaacctatatcaggaagctagcg

SEQ ID NO: 46645 - DNA, 25 bp, Homo sapien
aggccaagcccatttgtgtaatcac

SEQ ID NO: 46646 - DNA, 25 bp, Homo sapien
ggccaagcccatttgtgtaatcacc

SEQ ID NO: 46647 - DNA, 25 bp, Homo sapien
gccaagcccatttgtgtaatcaccc

SEQ ID NO: 46648 - DNA, 25 bp, Homo sapien
caagcccatttgtgtaatcacccaa

SEQ ID NO: 46649 - DNA, 25 bp, Homo sapien
aagcccatttgtgtaatcacccaaa

SEQ ID NO: 46650 - DNA, 25 bp, Homo sapien
agcccatttgtgtaatcacccaaaa

SEQ ID NO: 46651 - DNA, 25 bp, Homo sapien
gcccatttgtgtaatcacccaaaac

SEQ ID NO: 46652 - DNA, 25 bp, Homo sapien
gttggagcacttgatacatcacaga

SEQ ID NO: 46653 - DNA, 25 bp, Homo sapien
tggagcacttgatacatcacagact

SEQ ID NO: 46654 - DNA, 25 bp, Homo sapien
ggagcacttgatacatcacagactc

SEQ ID NO: 46655 - DNA, 25 bp, Homo sapien
gagcacttgatacatcacagactca

SEQ ID NO: 46656 - DNA, 25 bp, Homo sapien
ggactcaggcttatgctggaagaat

SEQ ID NO: 46657 - DNA, 25 bp, Homo sapien
caagtggtatagtttgtttttctag

SEQ ID NO: 46658 - DNA, 25 bp, Homo sapien
tactgatgagtcacataacttgcat

SEQ ID NO: 46659 - DNA, 25 bp, Homo sapien
acttgcatgtaatattaggttctca

SEQ ID NO: 46660 - DNA, 25 bp, Homo sapien
ttaggttctcattttttagcttcga

SEQ ID NO: 46661 - DNA, 25 bp, Homo sapien
tttagcttcgaaactgtgtccatgc

SEQ ID NO: 46662 - DNA, 25 bp, Homo sapien
gcttcgaaactgtgtccatgcaaag

SEQ ID NO: 46663 - DNA, 25 bp, Homo sapien
ccatgcaaagactctataactgtta

SEQ ID NO: 46664 - DNA, 25 bp, Homo sapien
taagacttgtgtggttgaattttga

SEQ ID NO: 46665 - DNA, 25 bp, Homo sapien
atagtgctgtgtataattccatggt

SEQ ID NO: 46666 - DNA, 25 bp, Homo sapien
aattccatggtttcttcaacatctt

SEQ ID NO: 46667 - DNA, 25 bp, Homo sapien
tttgctggacttgcactaattttta

SEQ ID NO: 46668 - DNA, 25 bp, Homo sapien
ttgctggacttgcactaatttttac

SEQ ID NO: 46669 - DNA, 25 bp, Homo sapien
tgctggacttgcactaatttttacg

SEQ ID NO: 46670 - DNA, 25 bp, Homo sapien
gctggacttgcactaatttttacga

SEQ ID NO: 46671 - DNA, 25 bp, Homo sapien
ctggacttgcactaatttttacgag

SEQ ID NO: 46672 - DNA, 25 bp, Homo sapien
tggacttgcactaatttttacgagt

SEQ ID NO: 46673 - DNA, 25 bp, Homo sapien
ggacttgcactaatttttacgagta

SEQ ID NO: 46674 - DNA, 25 bp, Homo sapien
gacttgcactaatttttacgagtaa

SEQ ID NO: 46675 - DNA, 25 bp, Homo sapien
cttgcactaatttttacgagtaact

SEQ ID NO: 46676 - DNA, 25 bp, Homo sapien
ttgcactaatttttacgagtaactt

SEQ ID NO: 46677 - DNA, 25 bp, Homo sapien
tgcactaatttttacgagtaacttc

SEQ ID NO: 46678 - DNA, 25 bp, Homo sapien
tggagggatggcgttggcagtgcca

SEQ ID NO: 46679 - DNA, 25 bp, Homo sapien
ccctcctcaggaagctggtatgagt

SEQ ID NO: 46680 - DNA, 25 bp, Homo sapien
gaagctggtatgagtaaggccttga

SEQ ID NO: 46681 - DNA, 25 bp, Homo sapien
cacccacatagactatactgtacat

SEQ ID NO: 46682 - DNA, 25 bp, Homo sapien
tatactgtacatacagattttgcag

SEQ ID NO: 46683 - DNA, 25 bp, Homo sapien
ggcagctgggtttgtccttgatgta

SEQ ID NO: 46684 - DNA, 25 bp, Homo sapien
cagctgggtttgtccttgatgtatg

SEQ ID NO: 46685 - DNA, 25 bp, Homo sapien
gctgggtttgtccttgatgtatgat

SEQ ID NO: 46686 - DNA, 25 bp, Homo sapien
gggtttgtccttgatgtatgatact

SEQ ID NO: 46687 - DNA, 25 bp, Homo sapien
gtttgtccttgatgtatgatactgt

SEQ ID NO: 46688 - DNA, 25 bp, Homo sapien
gtccttgatgtatgatactgttatt

SEQ ID NO: 46689 - DNA, 25 bp, Homo sapien
aatttacaccacaagagacaaacat

SEQ ID NO: 46690 - DNA, 25 bp, Homo sapien
tcagtgtgtgtggtcataatttgtt

SEQ ID NO: 46691 - DNA, 25 bp, Homo sapien
cataatttgtttgaacgagcccttt

SEQ ID NO: 46692 - DNA, 25 bp, Homo sapien
agcccttttaaacttctagatatca

SEQ ID NO: 46693 - DNA, 25 bp, Homo sapien
gatatcattgaaactcctatgttga

SEQ ID NO: 46694 - DNA, 25 bp, Homo sapien
agatctttccagtgagaaggatgaa

SEQ ID NO: 46695 - DNA, 25 bp, Homo sapien
tgaagtatcactatttcatgtatgt

SEQ ID NO: 46696 - DNA, 25 bp, Homo sapien
tcatgtatgtgcctgtatgtgctta

SEQ ID NO: 46697 - DNA, 25 bp, Homo sapien
tatgtgcttatataacatgctgtaa

SEQ ID NO: 46698 - DNA, 25 bp, Homo sapien
aacatgctgtaatacaaggtgacat

SEQ ID NO: 46699 - DNA, 25 bp, Homo sapien
ctgactgtaccttgctatttgtaac

SEQ ID NO: 46700 - DNA, 25 bp, Homo sapien
gcgtcccgtgctttgggtttcttgg

SEQ ID NO: 46701 - DNA, 25 bp, Homo sapien
ttaatgccagttctcagtacataag

SEQ ID NO: 46702 - DNA, 25 bp, Homo sapien
taatgccagttctcagtacataagt

SEQ ID NO: 46703 - DNA, 25 bp, Homo sapien
atgccagttctcagtacataagtgc

SEQ ID NO: 46704 - DNA, 25 bp, Homo sapien
agttctcagtacataagtgcatttt

SEQ ID NO: 46705 - DNA, 25 bp, Homo sapien
tctcagtacataagtgcattttgaa

SEQ ID NO: 46706 - DNA, 25 bp, Homo sapien
cattttgaaagaggttccagctatc

SEQ ID NO: 46707 - DNA, 25 bp, Homo sapien
attttgaaagaggttccagctatca

SEQ ID NO: 46708 - DNA, 25 bp, Homo sapien
aagaggttccagctatcacttgtaa

SEQ ID NO: 46709 - DNA, 25 bp, Homo sapien
agaggttccagctatcacttgtaac

SEQ ID NO: 46710 - DNA, 25 bp, Homo sapien
aggttccagctatcacttgtaacca

SEQ ID NO: 46711 - DNA, 25 bp, Homo sapien
tctatctacaaagtgtttatttgcg

SEQ ID NO: 46712 - DNA, 25 bp, Homo sapien
ctatctacaaagtgtttatttgcga

SEQ ID NO: 46713 - DNA, 25 bp, Homo sapien
tgcgagatgtttcaacggtgagttc

SEQ ID NO: 46714 - DNA, 25 bp, Homo sapien
cgagatgtttcaacggtgagttcgg

SEQ ID NO: 46715 - DNA, 25 bp, Homo sapien
ggacgggccatcactgtatgtatta

SEQ ID NO: 46716 - DNA, 25 bp, Homo sapien
agaggtggatacaggagacacttct

SEQ ID NO: 46717 - DNA, 25 bp, Homo sapien
gaggtggatacaggagacacttctc

SEQ ID NO: 46718 - DNA, 25 bp, Homo sapien
aggtggatacaggagacacttctca

SEQ ID NO: 46719 - DNA, 25 bp, Homo sapien
tcatctcatctcagaccctagaggg

SEQ ID NO: 46720 - DNA, 25 bp, Homo sapien
catctcatctcagaccctagagggg

SEQ ID NO: 46721 - DNA, 25 bp, Homo sapien
atctcatctcagaccctagaggggt

SEQ ID NO: 46722 - DNA, 25 bp, Homo sapien
tctcatctcagaccctagaggggtc

SEQ ID NO: 46723 - DNA, 25 bp, Homo sapien
atctcagaccctagaggggtccaca

SEQ ID NO: 46724 - DNA, 25 bp, Homo sapien
agatggggacacaagacccagccag

SEQ ID NO: 46725 - DNA, 25 bp, Homo sapien
gatggggacacaagacccagccagc

SEQ ID NO: 46726 - DNA, 25 bp, Homo sapien
atggggacacaagacccagccagcc

SEQ ID NO: 46727 - DNA, 25 bp, Homo sapien
agaccacgcccttgagccaagctgt

SEQ ID NO: 46728 - DNA, 25 bp, Homo sapien
ctggacctcagtgggaggcgtggct

SEQ ID NO: 46729 - DNA, 25 bp, Homo sapien
aggcgtggctgagaccaactggttt

SEQ ID NO: 46730 - DNA, 25 bp, Homo sapien
gtggctgagaccaactggtttgcct

SEQ ID NO: 46731 - DNA, 25 bp, Homo sapien
ggctgagaccaactggtttgcctat

SEQ ID NO: 46732 - DNA, 25 bp, Homo sapien
gctgagaccaactggtttgcctata

SEQ ID NO: 46733 - DNA, 25 bp, Homo sapien
gagaccaactggtttgcctataatt

SEQ ID NO: 46734 - DNA, 25 bp, Homo sapien
gaccaactggtttgcctataattta

SEQ ID NO: 46735 - DNA, 25 bp, Homo sapien
caactggtttgcctataatttatta

SEQ ID NO: 46736 - DNA, 25 bp, Homo sapien
ggtttgcctataatttattaactat

SEQ ID NO: 46737 - DNA, 25 bp, Homo sapien
tctaagtgtgggtttatataaggaa

SEQ ID NO: 46738 - DNA, 25 bp, Homo sapien
ggagtgagcgctggcagtatttcct

SEQ ID NO: 46739 - DNA, 25 bp, Homo sapien
agtgagcgctggcagtatttccttt

SEQ ID NO: 46740 - DNA, 25 bp, Homo sapien
tgagcgctggcagtatttcctttca

SEQ ID NO: 46741 - DNA, 25 bp, Homo sapien
ttatcagtgtggaaataatgcttca

SEQ ID NO: 46742 - DNA, 25 bp, Homo sapien
ttcagaactgtgctctgtagccctc

SEQ ID NO: 46743 - DNA, 25 bp, Homo sapien
cagaactgtgctctgtagccctcct

SEQ ID NO: 46744 - DNA, 25 bp, Homo sapien
gcgtgaaccttgttaggtatacttt

SEQ ID NO: 46745 - DNA, 25 bp, Homo sapien
taggtatactttacctgatgctgct

SEQ ID NO: 46746 - DNA, 25 bp, Homo sapien
tttacctgatgctgcttccatcctc

SEQ ID NO: 46747 - DNA, 25 bp, Homo sapien
tgatgctgcttccatcctcgcagtc

SEQ ID NO: 46748 - DNA, 25 bp, Homo sapien
tccatcctcgcagtctgtctgaggt

SEQ ID NO: 46749 - DNA, 25 bp, Homo sapien
gaattccatctgactctaattttat

SEQ ID NO: 46750 - DNA, 25 bp, Homo sapien
aattccatctgactctaattttatg

SEQ ID NO: 46751 - DNA, 25 bp, Homo sapien
attccatctgactctaattttatga

SEQ ID NO: 46752 - DNA, 25 bp, Homo sapien
tctaattttatgagaattgcagaac

SEQ ID NO: 46753 - DNA, 25 bp, Homo sapien
ctaattttatgagaattgcagaact

SEQ ID NO: 46754 - DNA, 25 bp, Homo sapien
atgagaattgcagaactctgatggc

SEQ ID NO: 46755 - DNA, 25 bp, Homo sapien
tgagaattgcagaactctgatggca

SEQ ID NO: 46756 - DNA, 25 bp, Homo sapien
gagaattgcagaactctgatggcaa

SEQ ID NO: 46757 - DNA, 25 bp, Homo sapien
gcccacggctcagtgaagaactcta

SEQ ID NO: 46758 - DNA, 25 bp, Homo sapien
acggctcagtgaagaactctaccac

SEQ ID NO: 46759 - DNA, 25 bp, Homo sapien
gggccgtgcccagctggctatggct

SEQ ID NO: 46760 - DNA, 25 bp, Homo sapien
tggctatggctctctttgagcagga

SEQ ID NO: 46761 - DNA, 25 bp, Homo sapien
tatggctctctttgagcaggagcag

SEQ ID NO: 46762 - DNA, 25 bp, Homo sapien
gctctctttgagcaggagcaggcca

SEQ ID NO: 46763 - DNA, 25 bp, Homo sapien
gcaggagcaggccaatagcacttag

SEQ ID NO: 46764 - DNA, 25 bp, Homo sapien
gagcaggccaatagcacttagcccg

SEQ ID NO: 46765 - DNA, 25 bp, Homo sapien
gccaatagcacttagcccgcctggg

SEQ ID NO: 46766 - DNA, 25 bp, Homo sapien
cagatagagaattgttgctgtattt

SEQ ID NO: 46767 - DNA, 25 bp, Homo sapien
gttattaaacatgtcttctgccaaa

SEQ ID NO: 46768 - DNA, 25 bp, Homo sapien
tcttctgacagatttcagtctggct

SEQ ID NO: 46769 - DNA, 25 bp, Homo sapien
gacagatttcagtctggcttgaaat

SEQ ID NO: 46770 - DNA, 25 bp, Homo sapien
tctgttattggagtctggccagggt

SEQ ID NO: 46771 - DNA, 25 bp, Homo sapien
ttattggagtctggccagggttgac

SEQ ID NO: 46772 - DNA, 25 bp, Homo sapien
tctggccagggttgacttgagctga

SEQ ID NO: 46773 - DNA, 25 bp, Homo sapien
ggttgacttgagctgagacaccaga

SEQ ID NO: 46774 - DNA, 25 bp, Homo sapien
gacttgagctgagacaccagatgct

SEQ ID NO: 46775 - DNA, 25 bp, Homo sapien
gagctgagacaccagatgctcacgg

SEQ ID NO: 46776 - DNA, 25 bp, Homo sapien
atgctcacggagatgctggacacat

SEQ ID NO: 46777 - DNA, 25 bp, Homo sapien
ctcacggagatgctggacacataaa

SEQ ID NO: 46778 - DNA, 25 bp, Homo sapien
tggacacataaagcaagttacagcc

SEQ ID NO: 46779 - DNA, 25 bp, Homo sapien
gttaggcaatcattctagggcagaa

SEQ ID NO: 46780 - DNA, 25 bp, Homo sapien
ggcaatcattctagggcagaaagaa

SEQ ID NO: 46781 - DNA, 25 bp, Homo sapien
tcattctagggcagaaagaagtaca

SEQ ID NO: 46782 - DNA, 25 bp, Homo sapien
cattctagggcagaaagaagtacag

SEQ ID NO: 46783 - DNA, 25 bp, Homo sapien
atacactgtttttctcaacaaggag

SEQ ID NO: 46784 - DNA, 25 bp, Homo sapien
tacacagtcataatgatgtgactgc

SEQ ID NO: 46785 - DNA, 25 bp, Homo sapien
acacagtcataatgatgtgactgct

SEQ ID NO: 46786 - DNA, 25 bp, Homo sapien
cataatgatgtgactgcttagcccc

SEQ ID NO: 46787 - DNA, 25 bp, Homo sapien
ataatgatgtgactgcttagcccct

SEQ ID NO: 46788 - DNA, 25 bp, Homo sapien
taatgatgtgactgcttagccccta

SEQ ID NO: 46789 - DNA, 25 bp, Homo sapien
gatgtgactgcttagcccctaaata

SEQ ID NO: 46790 - DNA, 25 bp, Homo sapien
atgtgactgcttagcccctaaatat

SEQ ID NO: 46791 - DNA, 25 bp, Homo sapien
aatatggtaactactctgggacaat

SEQ ID NO: 46792 - DNA, 25 bp, Homo sapien
atggtaactactctgggacaatatg

SEQ ID NO: 46793 - DNA, 25 bp, Homo sapien
tggtaactactctgggacaatatgg

SEQ ID NO: 46794 - DNA, 25 bp, Homo sapien
aactactctgggacaatatgggagg

SEQ ID NO: 46795 - DNA, 25 bp, Homo sapien
tcactgccttctgttcccgggggag

SEQ ID NO: 46796 - DNA, 25 bp, Homo sapien
actgccttctgttcccgggggagca

SEQ ID NO: 46797 - DNA, 25 bp, Homo sapien
ggatcttttgtcctcactgctttct

SEQ ID NO: 46798 - DNA, 25 bp, Homo sapien
gatcttttgtcctcactgctttcta

SEQ ID NO: 46799 - DNA, 25 bp, Homo sapien
atcttttgtcctcactgctttctaa

SEQ ID NO: 46800 - DNA, 25 bp, Homo sapien
tcttttgtcctcactgctttctaat

SEQ ID NO: 46801 - DNA, 25 bp, Homo sapien
cttttgtcctcactgctttctaatg

SEQ ID NO: 46802 - DNA, 25 bp, Homo sapien
ttttgtcctcactgctttctaatgg

SEQ ID NO: 46803 - DNA, 25 bp, Homo sapien
tttgtcctcactgctttctaatggg

SEQ ID NO: 46804 - DNA, 25 bp, Homo sapien
gtcctcactgctttctaatggggag

SEQ ID NO: 46805 - DNA, 25 bp, Homo sapien
tcactgctttctaatggggagggct

SEQ ID NO: 46806 - DNA, 25 bp, Homo sapien
accagggttcatgtcagtgcacacc

SEQ ID NO: 46807 - DNA, 25 bp, Homo sapien
ttcatgtcagtgcacaccccatgtg

SEQ ID NO: 46808 - DNA, 25 bp, Homo sapien
accccatgtgccctggcgaagctgg

SEQ ID NO: 46809 - DNA, 25 bp, Homo sapien
ggtgctgtgagtgatgtttcccata

SEQ ID NO: 46810 - DNA, 25 bp, Homo sapien
agtgatgtttcccatacaactcagg

SEQ ID NO: 46811 - DNA, 25 bp, Homo sapien
tgtttcccatacaactcagggatgc

SEQ ID NO: 46812 - DNA, 25 bp, Homo sapien
ggtggcttaccctgagatagtcatt

SEQ ID NO: 46813 - DNA, 25 bp, Homo sapien
gagatagtcattttgggcacataac

SEQ ID NO: 46814 - DNA, 25 bp, Homo sapien
attttgggcacataacagtgtagga

SEQ ID NO: 46815 - DNA, 25 bp, Homo sapien
aaatctgtcaatttcattttttgtt

SEQ ID NO: 46816 - DNA, 25 bp, Homo sapien
gttttcccctgatgactttttagca

SEQ ID NO: 46817 - DNA, 25 bp, Homo sapien
ttatttctttttctgttgaggcttc

SEQ ID NO: 46818 - DNA, 25 bp, Homo sapien
tatttctttttctgttgaggcttcc

SEQ ID NO: 46819 - DNA, 25 bp, Homo sapien
tctttttctgttgaggcttccccct

SEQ ID NO: 46820 - DNA, 25 bp, Homo sapien
tttttctgttgaggcttccccctct

SEQ ID NO: 46821 - DNA, 25 bp, Homo sapien
tttctgttgaggcttccccctctct

SEQ ID NO: 46822 - DNA, 25 bp, Homo sapien
tctgttgaggcttccccctctctga

SEQ ID NO: 46823 - DNA, 25 bp, Homo sapien
ggtggcattagccactccctgcctc

SEQ ID NO: 46824 - DNA, 25 bp, Homo sapien
tccctgcctctcactccagacctgt

SEQ ID NO: 46825 - DNA, 25 bp, Homo sapien
actccagacctgttcccacaactgg

SEQ ID NO: 46826 - DNA, 25 bp, Homo sapien
cagacctgttcccacaactggggag

SEQ ID NO: 46827 - DNA, 25 bp, Homo sapien
gacctgttcccacaactggggaggt

SEQ ID NO: 46828 - DNA, 25 bp, Homo sapien
ttacatggatgccaaccggtcaccc

SEQ ID NO: 46829 - DNA, 25 bp, Homo sapien
tacatggatgccaaccggtcaccca

SEQ ID NO: 46830 - DNA, 25 bp, Homo sapien
acatggatgccaaccggtcacccag

SEQ ID NO: 46831 - DNA, 25 bp, Homo sapien
catggatgccaaccggtcacccagg

SEQ ID NO: 46832 - DNA, 25 bp, Homo sapien
cccacccaggagtgtggccacgtgg

SEQ ID NO: 46833 - DNA, 25 bp, Homo sapien
caggagtgtggccacgtgggcaaac

SEQ ID NO: 46834 - DNA, 25 bp, Homo sapien
gcaaacaggcagttggccagagagc

SEQ ID NO: 46835 - DNA, 25 bp, Homo sapien
caaacaggcagttggccagagagcc

SEQ ID NO: 46836 - DNA, 25 bp, Homo sapien
aaacaggcagttggccagagagcct

SEQ ID NO: 46837 - DNA, 25 bp, Homo sapien
aggcagttggccagagagcctggtg

SEQ ID NO: 46838 - DNA, 25 bp, Homo sapien
gcagttggccagagagcctggtgct

SEQ ID NO: 46839 - DNA, 25 bp, Homo sapien
ataaatgtgtgcagaatcctaattc

SEQ ID NO: 46840 - DNA, 25 bp, Homo sapien
tttctgagctccactcagtgaggat

SEQ ID NO: 46841 - DNA, 25 bp, Homo sapien
agtgaggatatgcaccctctactgt

SEQ ID NO: 46842 - DNA, 25 bp, Homo sapien
ctgtccagcctgtggtttgcagtaa

SEQ ID NO: 46843 - DNA, 25 bp, Homo sapien
tggtttgcagtaagctcactcttct

SEQ ID NO: 46844 - DNA, 25 bp, Homo sapien
gtaagctcactcttctgttcagaat

SEQ ID NO: 46845 - DNA, 25 bp, Homo sapien
ttcagaatgaccacaggagggcctt

SEQ ID NO: 46846 - DNA, 25 bp, Homo sapien
cacaggagggcctttacctaggaat

SEQ ID NO: 46847 - DNA, 25 bp, Homo sapien
gggcctttacctaggaatagcagga

SEQ ID NO: 46848 - DNA, 25 bp, Homo sapien
aacttccctcccagtaagcatgaat

SEQ ID NO: 46849 - DNA, 25 bp, Homo sapien
gaattgcttcagatgtaaagcttac

SEQ ID NO: 46850 - DNA, 25 bp, Homo sapien
cctcatcattctctcacagtcatat

SEQ ID NO: 46851 - DNA, 25 bp, Homo sapien
ctcatcattctctcacagtcatatc

SEQ ID NO: 46852 - DNA, 25 bp, Homo sapien
tcatcattctctcacagtcatatct

SEQ ID NO: 46853 - DNA, 25 bp, Homo sapien
catcattctctcacagtcatatctg

SEQ ID NO: 46854 - DNA, 25 bp, Homo sapien
atcattctctcacagtcatatctgg

SEQ ID NO: 46855 - DNA, 25 bp, Homo sapien
tcattctctcacagtcatatctgga

SEQ ID NO: 46856 - DNA, 25 bp, Homo sapien
cattctctcacagtcatatctggaa

SEQ ID NO: 46857 - DNA, 25 bp, Homo sapien
attctctcacagtcatatctggaaa

SEQ ID NO: 46858 - DNA, 25 bp, Homo sapien
ttctctcacagtcatatctggaaat

SEQ ID NO: 46859 - DNA, 25 bp, Homo sapien
ctctcacagtcatatctggaaataa

SEQ ID NO: 46860 - DNA, 25 bp, Homo sapien
agtcatatctggaaataaaatctct

SEQ ID NO: 46861 - DNA, 25 bp, Homo sapien
ggaggccaaggggaccagtgtgtgc

SEQ ID NO: 46862 - DNA, 25 bp, Homo sapien
gaggccaaggggaccagtgtgtgcc

SEQ ID NO: 46863 - DNA, 25 bp, Homo sapien
aggccaaggggaccagtgtgtgcca

SEQ ID NO: 46864 - DNA, 25 bp, Homo sapien
ggccaaggggaccagtgtgtgccag

SEQ ID NO: 46865 - DNA, 25 bp, Homo sapien
gccaaggggaccagtgtgtgccagg

SEQ ID NO: 46866 - DNA, 25 bp, Homo sapien
ccaaggggaccagtgtgtgccaggc

SEQ ID NO: 46867 - DNA, 25 bp, Homo sapien
caaggggaccagtgtgtgccaggcg

SEQ ID NO: 46868 - DNA, 25 bp, Homo sapien
aaggggaccagtgtgtgccaggcgg

SEQ ID NO: 46869 - DNA, 25 bp, Homo sapien
aggggaccagtgtgtgccaggcggc

SEQ ID NO: 46870 - DNA, 25 bp, Homo sapien
gggaccagtgtgtgccaggcggccg

SEQ ID NO: 46871 - DNA, 25 bp, Homo sapien
ggaccagtgtgtgccaggcggccgc

SEQ ID NO: 46872 - DNA, 25 bp, Homo sapien
tgtatgttttctgttccttggcaaa

SEQ ID NO: 46873 - DNA, 25 bp, Homo sapien
atgttttctgttccttggcaaataa

SEQ ID NO: 46874 - DNA, 25 bp, Homo sapien
aatgtattgtcctaacggtgtccct

SEQ ID NO: 46875 - DNA, 25 bp, Homo sapien
ttgtcctaacggtgtccctttaatg

SEQ ID NO: 46876 - DNA, 25 bp, Homo sapien
cggtgtccctttaatgtttcatatg

SEQ ID NO: 46877 - DNA, 25 bp, Homo sapien
atgaaaaattatgttgacccactaa

SEQ ID NO: 46878 - DNA, 25 bp, Homo sapien
gacccactaaaatatccttgctcaa

SEQ ID NO: 46879 - DNA, 25 bp, Homo sapien
atatccttgctcaatgtctggtcag

SEQ ID NO: 46880 - DNA, 25 bp, Homo sapien
gctcaatgtctggtcagttgaattt

SEQ ID NO: 46881 - DNA, 25 bp, Homo sapien
gtgtctattaaatgtgactaagcag

SEQ ID NO: 46882 - DNA, 25 bp, Homo sapien
taagcaggattactgaaaattccct

SEQ ID NO: 46883 - DNA, 25 bp, Homo sapien
tttactttttacctcttgtgtatat

SEQ ID NO: 46884 - DNA, 25 bp, Homo sapien
actttttacctcttgtgtatatgta

SEQ ID NO: 46885 - DNA, 25 bp, Homo sapien
tagggaaatatgtactttatggaat

SEQ ID NO: 46886 - DNA, 25 bp, Homo sapien
taatggacctttaatcttacacagc

SEQ ID NO: 46887 - DNA, 25 bp, Homo sapien
ggacctttaatcttacacagctaaa

SEQ ID NO: 46888 - DNA, 25 bp, Homo sapien
taatcttacacagctaaattactga

SEQ ID NO: 46889 - DNA, 25 bp, Homo sapien
ctgattatatatttgctgagctgat

SEQ ID NO: 46890 - DNA, 25 bp, Homo sapien
tttgctgagctgatttaagggttaa

SEQ ID NO: 46891 - DNA, 25 bp, Homo sapien
tattttttgacttcaaagccttctt

SEQ ID NO: 46892 - DNA, 25 bp, Homo sapien
ataaagcctcttttctacatgtgaa

SEQ ID NO: 46893 - DNA, 25 bp, Homo sapien
taaagcctcttttctacatgtgaaa

SEQ ID NO: 46894 - DNA, 25 bp, Homo sapien
gcctgggcgagtatcagtgcttgct

SEQ ID NO: 46895 - DNA, 25 bp, Homo sapien
cctgggcgagtatcagtgcttgctg

SEQ ID NO: 46896 - DNA, 25 bp, Homo sapien
gcgagtatcagtgcttgctggagct

SEQ ID NO: 46897 - DNA, 25 bp, Homo sapien
agtatcagtgcttgctggagctgca

SEQ ID NO: 46898 - DNA, 25 bp, Homo sapien
gtatcagtgcttgctggagctgcac

SEQ ID NO: 46899 - DNA, 25 bp, Homo sapien
atcagtgcttgctggagctgcacgg

SEQ ID NO: 46900 - DNA, 25 bp, Homo sapien
gtgcttgctggagctgcacggcttc

SEQ ID NO: 46901 - DNA, 25 bp, Homo sapien
tgcacggcttccaccaggtgcaggt

SEQ ID NO: 46902 - DNA, 25 bp, Homo sapien
acggcttccaccaggtgcaggtggt

SEQ ID NO: 46903 - DNA, 25 bp, Homo sapien
gaagcccaggcagcatgttcattat

SEQ ID NO: 46904 - DNA, 25 bp, Homo sapien
agcccaggcagcatgttcattatag

SEQ ID NO: 46905 - DNA, 25 bp, Homo sapien
cgactgtgttcaggagtcccacctt

SEQ ID NO: 46906 - DNA, 25 bp, Homo sapien
tgtgttcaggagtcccaccttgcat

SEQ ID NO: 46907 - DNA, 25 bp, Homo sapien
caccttgcatttcagacctgggctg

SEQ ID NO: 46908 - DNA, 25 bp, Homo sapien
cttgcatttcagacctgggctggca

SEQ ID NO: 46909 - DNA, 25 bp, Homo sapien
ctgggctggcagtctgttggacttc

SEQ ID NO: 46910 - DNA, 25 bp, Homo sapien
tggcagtctgttggacttctcttca

SEQ ID NO: 46911 - DNA, 25 bp, Homo sapien
cagtctgttggacttctcttcagga

SEQ ID NO: 46912 - DNA, 25 bp, Homo sapien
ggtctcagttggcttcccccagatt

SEQ ID NO: 46913 - DNA, 25 bp, Homo sapien
ccccagattctgattctacagctgc

SEQ ID NO: 46914 - DNA, 25 bp, Homo sapien
cagattctgattctacagctgcaga

SEQ ID NO: 46915 - DNA, 25 bp, Homo sapien
gattctacagctgcagaatgtatat

SEQ ID NO: 46916 - DNA, 25 bp, Homo sapien
cctggcttagacaccttctcaaggg

SEQ ID NO: 46917 - DNA, 25 bp, Homo sapien
ctggcttagacaccttctcaagggc

SEQ ID NO: 46918 - DNA, 25 bp, Homo sapien
gcttagacaccttctcaagggctgg

SEQ ID NO: 46919 - DNA, 25 bp, Homo sapien
ttagacaccttctcaagggctggcc

SEQ ID NO: 46920 - DNA, 25 bp, Homo sapien
ggcatgccctcctggggccaagagt

SEQ ID NO: 46921 - DNA, 25 bp, Homo sapien
aagagtgggcctgcaacccacccac

SEQ ID NO: 46922 - DNA, 25 bp, Homo sapien
ccaggccttgagtgtccacattaaa

SEQ ID NO: 46923 - DNA, 25 bp, Homo sapien
aggccttgagtgtccacattaaatg

SEQ ID NO: 46924 - DNA, 25 bp, Homo sapien
gagtgtccacattaaatgggtctcc

SEQ ID NO: 46925 - DNA, 25 bp, Homo sapien
gtgtccacattaaatgggtctccca

SEQ ID NO: 46926 - DNA, 25 bp, Homo sapien
tgtccacattaaatgggtctcccac

SEQ ID NO: 46927 - DNA, 25 bp, Homo sapien
ggagttcacaagactacgcattcaa

SEQ ID NO: 46928 - DNA, 25 bp, Homo sapien
aggaaaggactttggcttgcttgag

SEQ ID NO: 46929 - DNA, 25 bp, Homo sapien
ttggcttgcttgaggctgctggcct

SEQ ID NO: 46930 - DNA, 25 bp, Homo sapien
aggctgctggcctttttggaaggaa

SEQ ID NO: 46931 - DNA, 25 bp, Homo sapien
gggaagacaccctagttctcagtgt

SEQ ID NO: 46932 - DNA, 25 bp, Homo sapien
agttctcagtgtttgggactcttat

SEQ ID NO: 46933 - DNA, 25 bp, Homo sapien
actcttatgcagaatcgaggcagtt

SEQ ID NO: 46934 - DNA, 25 bp, Homo sapien
gaggcagttaactcttccaagaaca

SEQ ID NO: 46935 - DNA, 25 bp, Homo sapien
ttccaagaacagaagcggcatgttg

SEQ ID NO: 46936 - DNA, 25 bp, Homo sapien
atttttcctccactaaatctgcagg

SEQ ID NO: 46937 - DNA, 25 bp, Homo sapien
aatctgcaggaaacatgttgaacat

SEQ ID NO: 46938 - DNA, 25 bp, Homo sapien
ttttttagtgcatcgtccatgccaa

SEQ ID NO: 46939 - DNA, 25 bp, Homo sapien
tagtgcatcgtccatgccaaagtgt

SEQ ID NO: 46940 - DNA, 25 bp, Homo sapien
tgcatcgtccatgccaaagtgtgcg

SEQ ID NO: 46941 - DNA, 25 bp, Homo sapien
gtccatgccaaagtgtgcggccctt

SEQ ID NO: 46942 - DNA, 25 bp, Homo sapien
atgccaaagtgtgcggcccttcctg

SEQ ID NO: 46943 - DNA, 25 bp, Homo sapien
ttcctgacatcaccacagtctgagc

SEQ ID NO: 46944 - DNA, 25 bp, Homo sapien
agcctcccgcgtcctgcagggtagt

SEQ ID NO: 46945 - DNA, 25 bp, Homo sapien
acctccttaactttgtactagactg

SEQ ID NO: 46946 - DNA, 25 bp, Homo sapien
ttaactttgtactagactggcctgg

SEQ ID NO: 46947 - DNA, 25 bp, Homo sapien
aactttgtactagactggcctgggc

SEQ ID NO: 46948 - DNA, 25 bp, Homo sapien
ctttgtactagactggcctgggcct

SEQ ID NO: 46949 - DNA, 25 bp, Homo sapien
cgggagggacagatttcagagtctt

SEQ ID NO: 46950 - DNA, 25 bp, Homo sapien
gggacagatttcagagtcttaacca

SEQ ID NO: 46951 - DNA, 25 bp, Homo sapien
gacagatttcagagtcttaaccaac

SEQ ID NO: 46952 - DNA, 25 bp, Homo sapien
gatttcagagtcttaaccaaccttg

SEQ ID NO: 46953 - DNA, 25 bp, Homo sapien
tttcagagtcttaaccaaccttgct

SEQ ID NO: 46954 - DNA, 25 bp, Homo sapien
ttcagagtcttaaccaaccttgctt

SEQ ID NO: 46955 - DNA, 25 bp, Homo sapien
tcagagtcttaaccaaccttgcttc

SEQ ID NO: 46956 - DNA, 25 bp, Homo sapien
cagagtcttaaccaaccttgcttcc

SEQ ID NO: 46957 - DNA, 25 bp, Homo sapien
gagtcttaaccaaccttgcttccca

SEQ ID NO: 46958 - DNA, 25 bp, Homo sapien
acagcccgagcagacagcctttttg

SEQ ID NO: 46959 - DNA, 25 bp, Homo sapien
agcccgagcagacagcctttttgtt

SEQ ID NO: 46960 - DNA, 25 bp, Homo sapien
attcatgggcccattgaaccggcat

SEQ ID NO: 46961 - DNA, 25 bp, Homo sapien
ttcatgggcccattgaaccggcatt

SEQ ID NO: 46962 - DNA, 25 bp, Homo sapien
tcatgggcccattgaaccggcattg

SEQ ID NO: 46963 - DNA, 25 bp, Homo sapien
catgggcccattgaaccggcattgt

SEQ ID NO: 46964 - DNA, 25 bp, Homo sapien
atgggcccattgaaccggcattgtt

SEQ ID NO: 46965 - DNA, 25 bp, Homo sapien
tgggcccattgaaccggcattgttt

SEQ ID NO: 46966 - DNA, 25 bp, Homo sapien
gggcccattgaaccggcattgtttt

SEQ ID NO: 46967 - DNA, 25 bp, Homo sapien
ggcccattgaaccggcattgttttt

SEQ ID NO: 46968 - DNA, 25 bp, Homo sapien
tggcagctgggacgttttaaaattg

SEQ ID NO: 46969 - DNA, 25 bp, Homo sapien
ttgggacaccaatttcaaatgtaac

SEQ ID NO: 46970 - DNA, 25 bp, Homo sapien
aatttcaaatgtaaccctccagtgg

SEQ ID NO: 46971 - DNA, 25 bp, Homo sapien
gtaaccctccagtggtggaaggcac

SEQ ID NO: 46972 - DNA, 25 bp, Homo sapien
ggtggaaggcacaccatggcttcct

SEQ ID NO: 46973 - DNA, 25 bp, Homo sapien
catggcttcctctgcttggtttgag

SEQ ID NO: 46974 - DNA, 25 bp, Homo sapien
tctgcttggtttgagggtctgttca

SEQ ID NO: 46975 - DNA, 25 bp, Homo sapien
ggtctgttcaaaagctttgggccaa

SEQ ID NO: 46976 - DNA, 25 bp, Homo sapien
gggcctatccattccattgtggaag

SEQ ID NO: 46977 - DNA, 25 bp, Homo sapien
aagctgggccaggtgccagggacac

SEQ ID NO: 46978 - DNA, 25 bp, Homo sapien
gtggaggaggacgaataaatttatt

SEQ ID NO: 46979 - DNA, 25 bp, Homo sapien
caaaggcccctacttgatggttttg

SEQ ID NO: 46980 - DNA, 25 bp, Homo sapien
aaggcccctacttgatggttttgag

SEQ ID NO: 46981 - DNA, 25 bp, Homo sapien
ggcaacattgactcatttgcccctt

SEQ ID NO: 46982 - DNA, 25 bp, Homo sapien
gcaacattgactcatttgccccttc

SEQ ID NO: 46983 - DNA, 25 bp, Homo sapien
gaacgttttgggaaggtgccctgat

SEQ ID NO: 46984 - DNA, 25 bp, Homo sapien
acgttttgggaaggtgccctgatga

SEQ ID NO: 46985 - DNA, 25 bp, Homo sapien
aggtgccctgatgagcggtgagaag

SEQ ID NO: 46986 - DNA, 25 bp, Homo sapien
tgagcggtgagaagcccggaatccc

SEQ ID NO: 46987 - DNA, 25 bp, Homo sapien
gtgagaagcccggaatccccttctg

SEQ ID NO: 46988 - DNA, 25 bp, Homo sapien
gagaagcccggaatccccttctgga

SEQ ID NO: 46989 - DNA, 25 bp, Homo sapien
attaattgtgacaagccaggaccat

SEQ ID NO: 46990 - DNA, 25 bp, Homo sapien
ctattaaaagtccagctacctccct

SEQ ID NO: 46991 - DNA, 25 bp, Homo sapien
ggagggaggtgtgcataccatttta

SEQ ID NO: 46992 - DNA, 25 bp, Homo sapien
gagggaggtgtgcataccattttat

SEQ ID NO: 46993 - DNA, 25 bp, Homo sapien
gggaggtgtgcataccattttatat

SEQ ID NO: 46994 - DNA, 25 bp, Homo sapien
ggaggtgtgcataccattttatatg

SEQ ID NO: 46995 - DNA, 25 bp, Homo sapien
aggtgtgcataccattttatatggt

SEQ ID NO: 46996 - DNA, 25 bp, Homo sapien
ttatatggtgtgagagctttcagac

SEQ ID NO: 46997 - DNA, 25 bp, Homo sapien
tatggtgtgagagctttcagaccaa

SEQ ID NO: 46998 - DNA, 25 bp, Homo sapien
ggtgtgagagctttcagaccaagga

SEQ ID NO: 46999 - DNA, 25 bp, Homo sapien
gtgtgagagctttcagaccaaggag

SEQ ID NO: 47000 - DNA, 25 bp, Homo sapien
ttcagaccaaggagacatttcacca

SEQ ID NO: 47001 - DNA, 25 bp, Homo sapien
tagaatcctgagatagcatagagta

SEQ ID NO: 47002 - DNA, 25 bp, Homo sapien
agaatcctgagatagcatagagtag

SEQ ID NO: 47003 - DNA, 25 bp, Homo sapien
gaatcctgagatagcatagagtagt

SEQ ID NO: 47004 - DNA, 25 bp, Homo sapien
aatcctgagatagcatagagtagtg

SEQ ID NO: 47005 - DNA, 25 bp, Homo sapien
atcctgagatagcatagagtagtga

SEQ ID NO: 47006 - DNA, 25 bp, Homo sapien
tcctgagatagcatagagtagtgaa

SEQ ID NO: 47007 - DNA, 25 bp, Homo sapien
cctgagatagcatagagtagtgaaa

SEQ ID NO: 47008 - DNA, 25 bp, Homo sapien
atagcatagagtagtgaaagggcat

SEQ ID NO: 47009 - DNA, 25 bp, Homo sapien
catagagtagtgaaagggcatggct

SEQ ID NO: 47010 - DNA, 25 bp, Homo sapien
agagtagtgaaagggcatggctttt

SEQ ID NO: 47011 - DNA, 25 bp, Homo sapien
agtgaaagggcatggcttttgacat

SEQ ID NO: 47012 - DNA, 25 bp, Homo sapien
tggcccttctattttctgctctgtg

SEQ ID NO: 47013 - DNA, 25 bp, Homo sapien
cctcatcattctctcacagtcatat

SEQ ID NO: 47014 - DNA, 25 bp, Homo sapien
tcatcattctctcacagtcatatct

SEQ ID NO: 47015 - DNA, 25 bp, Homo sapien
catcattctctcacagtcatatctg

SEQ ID NO: 47016 - DNA, 25 bp, Homo sapien
atcattctctcacagtcatatctgg

SEQ ID NO: 47017 - DNA, 25 bp, Homo sapien
cattctctcacagtcatatctggaa

SEQ ID NO: 47018 - DNA, 25 bp, Homo sapien
attctctcacagtcatatctggaaa

SEQ ID NO: 47019 - DNA, 25 bp, Homo sapien
ttctctcacagtcatatctggaaat

SEQ ID NO: 47020 - DNA, 25 bp, Homo sapien
ctctcacagtcatatctggaaataa

SEQ ID NO: 47021 - DNA, 25 bp, Homo sapien
agtcatatctggaaataaaatctct

SEQ ID NO: 47022 - DNA, 25 bp, Homo sapien
ataaaatctctgtatatgcaaaaaa

SEQ ID NO: 47023 - DNA, 25 bp, Homo sapien
tctcttccagccctaggaggagggc

SEQ ID NO: 47024 - DNA, 25 bp, Homo sapien
tccagccctaggaggagggctccta

SEQ ID NO: 47025 - DNA, 25 bp, Homo sapien
agccctaggaggagggctcctaaca

SEQ ID NO: 47026 - DNA, 25 bp, Homo sapien
gaggagggctcctaacagtgtaact

SEQ ID NO: 47027 - DNA, 25 bp, Homo sapien
aggagggctcctaacagtgtaactt

SEQ ID NO: 47028 - DNA, 25 bp, Homo sapien
ggagggctcctaacagtgtaactta

SEQ ID NO: 47029 - DNA, 25 bp, Homo sapien
gagggctcctaacagtgtaacttat

SEQ ID NO: 47030 - DNA, 25 bp, Homo sapien
agggctcctaacagtgtaacttatt

SEQ ID NO: 47031 - DNA, 25 bp, Homo sapien
gggctcctaacagtgtaacttattg

SEQ ID NO: 47032 - DNA, 25 bp, Homo sapien
gctcctaacagtgtaacttattgtg

SEQ ID NO: 47033 - DNA, 25 bp, Homo sapien
cctaacagtgtaacttattgtgtcc

SEQ ID NO: 47034 - DNA, 25 bp, Homo sapien
tgttgtctgccttggccgaaagatg

SEQ ID NO: 47035 - DNA, 25 bp, Homo sapien
gttgtctgccttggccgaaagatga

SEQ ID NO: 47036 - DNA, 25 bp, Homo sapien
ttgtctgccttggccgaaagatgaa

SEQ ID NO: 47037 - DNA, 25 bp, Homo sapien
tgtctgccttggccgaaagatgaaa

SEQ ID NO: 47038 - DNA, 25 bp, Homo sapien
gtctgccttggccgaaagatgaaaa

SEQ ID NO: 47039 - DNA, 25 bp, Homo sapien
tctgccttggccgaaagatgaaaaa

SEQ ID NO: 47040 - DNA, 25 bp, Homo sapien
ctgccttggccgaaagatgaaaaaa

SEQ ID NO: 47041 - DNA, 25 bp, Homo sapien
tgccttggccgaaagatgaaaaaaa

SEQ ID NO: 47042 - DNA, 25 bp, Homo sapien
ccccagctggttgagagcaccctgc

SEQ ID NO: 47043 - DNA, 25 bp, Homo sapien
attcaccggggatctcctgggctgg

SEQ ID NO: 47044 - DNA, 25 bp, Homo sapien
ttcaccggggatctcctgggctggg

SEQ ID NO: 47045 - DNA, 25 bp, Homo sapien
accagtagagtttctttgtctctca

SEQ ID NO: 47046 - DNA, 25 bp, Homo sapien
gagtttctttgtctctcatctaaag

SEQ ID NO: 47047 - DNA, 25 bp, Homo sapien
tctttgtctctcatctaaagtatat

SEQ ID NO: 47048 - DNA, 25 bp, Homo sapien
taaagtatataacctcccaaagtag

SEQ ID NO: 47049 - DNA, 25 bp, Homo sapien
gagagaagcttatctatcaaactgt

SEQ ID NO: 47050 - DNA, 25 bp, Homo sapien
gaagcttatctatcaaactgtctgc

SEQ ID NO: 47051 - DNA, 25 bp, Homo sapien
caaactgtctgcattagtgcaatta

SEQ ID NO: 47052 - DNA, 25 bp, Homo sapien
aagctttcagctgtattgtaatact

SEQ ID NO: 47053 - DNA, 25 bp, Homo sapien
tgctaaccacatttcatggaatatg

SEQ ID NO: 47054 - DNA, 25 bp, Homo sapien
ttcatggaatatggctacattgcat

SEQ ID NO: 47055 - DNA, 25 bp, Homo sapien
tggctacattgcatcttgcattaaa

SEQ ID NO: 47056 - DNA, 25 bp, Homo sapien
gtactttttcagatctgtggattag

SEQ ID NO: 47057 - DNA, 25 bp, Homo sapien
agatctgtggattagtggcacttgt

SEQ ID NO: 47058 - DNA, 25 bp, Homo sapien
gggaaaaactccttgtctgtgtctc

SEQ ID NO: 47059 - DNA, 25 bp, Homo sapien
aaaactccttgtctgtgtctcttct

SEQ ID NO: 47060 - DNA, 25 bp, Homo sapien
gtctgtgtctcttctgacatgagaa

SEQ ID NO: 47061 - DNA, 25 bp, Homo sapien
acagtgatactgttacagcagaggt

SEQ ID NO: 47062 - DNA, 25 bp, Homo sapien
ctgttacagcagaggtgaagtgtca

SEQ ID NO: 47063 - DNA, 25 bp, Homo sapien
catcgacgttctgtccccgattggt

SEQ ID NO: 47064 - DNA, 25 bp, Homo sapien
gttctgtccccgattggtctgtggg

SEQ ID NO: 47065 - DNA, 25 bp, Homo sapien
tgtcctgcttctgcgacagtaacca

SEQ ID NO: 47066 - DNA, 25 bp, Homo sapien
acagtaaccaggctcaggttttgcc

SEQ ID NO: 47067 - DNA, 25 bp, Homo sapien
gccccggtctgtccggtttgcagta

SEQ ID NO: 47068 - DNA, 25 bp, Homo sapien
ccggtctgtccggtttgcagtactt

SEQ ID NO: 47069 - DNA, 25 bp, Homo sapien
cggtctgtccggtttgcagtacttg

SEQ ID NO: 47070 - DNA, 25 bp, Homo sapien
gtctgtccggtttgcagtacttgca

SEQ ID NO: 47071 - DNA, 25 bp, Homo sapien
tctgtccggtttgcagtacttgcac

SEQ ID NO: 47072 - DNA, 25 bp, Homo sapien
ctgtccggtttgcagtacttgcaca

SEQ ID NO: 47073 - DNA, 25 bp, Homo sapien
tgtccggtttgcagtacttgcacac

SEQ ID NO: 47074 - DNA, 25 bp, Homo sapien
gtccggtttgcagtacttgcacaca

SEQ ID NO: 47075 - DNA, 25 bp, Homo sapien
gtattttctagacaattctctattt

SEQ ID NO: 47076 - DNA, 25 bp, Homo sapien
tttctagacaattctctattttact

SEQ ID NO: 47077 - DNA, 25 bp, Homo sapien
aaagtgcatagatttctatcttaaa

SEQ ID NO: 47078 - DNA, 25 bp, Homo sapien
agaagtcaagcccagccacgtggag

SEQ ID NO: 47079 - DNA, 25 bp, Homo sapien
gccacgtggagcctagagtgagggc

SEQ ID NO: 47080 - DNA, 25 bp, Homo sapien
tttttgaaacagaaccataaagcat

SEQ ID NO: 47081 - DNA, 25 bp, Homo sapien
ttttgaaacagaaccataaagcata

SEQ ID NO: 47082 - DNA, 25 bp, Homo sapien
tttgaaacagaaccataaagcatat

SEQ ID NO: 47083 - DNA, 25 bp, Homo sapien
ttgaaacagaaccataaagcatatg

SEQ ID NO: 47084 - DNA, 25 bp, Homo sapien
tgaaacagaaccataaagcatatgt

SEQ ID NO: 47085 - DNA, 25 bp, Homo sapien
gaaacagaaccataaagcatatgtg

SEQ ID NO: 47086 - DNA, 25 bp, Homo sapien
aaacagaaccataaagcatatgtgt

SEQ ID NO: 47087 - DNA, 25 bp, Homo sapien
aacagaaccataaagcatatgtgtt

SEQ ID NO: 47088 - DNA, 25 bp, Homo sapien
gtgaagaattagtacagctgtgttt

SEQ ID NO: 47089 - DNA, 25 bp, Homo sapien
gaattagtacagctgtgttttttaa

SEQ ID NO: 47090 - DNA, 25 bp, Homo sapien
gttttttaaagccacctctctgtct

SEQ ID NO: 47091 - DNA, 25 bp, Homo sapien
ttttttaaagccacctctctgtctc

SEQ ID NO: 47092 - DNA, 25 bp, Homo sapien
ttttaaagccacctctctgtctcca

SEQ ID NO: 47093 - DNA, 25 bp, Homo sapien
ggaggaagccactgcatctgttggc

SEQ ID NO: 47094 - DNA, 25 bp, Homo sapien
ggaagccactgcatctgttggctca

SEQ ID NO: 47095 - DNA, 25 bp, Homo sapien
aagccactgcatctgttggctcagg

SEQ ID NO: 47096 - DNA, 25 bp, Homo sapien
cactgcatctgttggctcagggccc

SEQ ID NO: 47097 - DNA, 25 bp, Homo sapien
ttgtgtctcctgtctgtgccgatct

SEQ ID NO: 47098 - DNA, 25 bp, Homo sapien
cctgtctgtgccgatctctattaaa

SEQ ID NO: 47099 - DNA, 25 bp, Homo sapien
gctgcctgagggagtcacttgtatg

SEQ ID NO: 47100 - DNA, 25 bp, Homo sapien
gagtcacttgtatggtccccagggt

SEQ ID NO: 47101 - DNA, 25 bp, Homo sapien
gccccatcctgttctatggaataaa

SEQ ID NO: 47102 - DNA, 25 bp, Homo sapien
atggaataaagcgtcgcctctctgc

SEQ ID NO: 47103 - DNA, 25 bp, Homo sapien
tctctgcctcgaaccagtcaaatgg

SEQ ID NO: 47104 - DNA, 25 bp, Homo sapien
aaatggagtattgcggctgcacgtc

SEQ ID NO: 47105 - DNA, 25 bp, Homo sapien
gctgcacgtcacactagggtggcca

SEQ ID NO: 47106 - DNA, 25 bp, Homo sapien
gcgagccacatgtctgcactgagaa

SEQ ID NO: 47107 - DNA, 25 bp, Homo sapien
catttgtcatccagccggaagttaa

SEQ ID NO: 47108 - DNA, 25 bp, Homo sapien
atccagccggaagttaaagcacact

SEQ ID NO: 47109 - DNA, 25 bp, Homo sapien
ataataaacgttcttgctgctgtga

SEQ ID NO: 47110 - DNA, 25 bp, Homo sapien
ctcagtctacacagccgatgctcag

SEQ ID NO: 47111 - DNA, 25 bp, Homo sapien
agcaccgcatctcactcggagtaaa

SEQ ID NO: 47112 - DNA, 25 bp, Homo sapien
tcactcggagtaaacgcaagtcctt

SEQ ID NO: 47113 - DNA, 25 bp, Homo sapien
taaacgcaagtccttagtgtgctgc

SEQ ID NO: 47114 - DNA, 25 bp, Homo sapien
caagtccttagtgtgctgcgcggtg

SEQ ID NO: 47115 - DNA, 25 bp, Homo sapien
tccttagtgtgctgcgcggtggtcc

SEQ ID NO: 47116 - DNA, 25 bp, Homo sapien
tgtgctgcgcggtggtcctgccttt

SEQ ID NO: 47117 - DNA, 25 bp, Homo sapien
actccttcccagacgaccttattat

SEQ ID NO: 47118 - DNA, 25 bp, Homo sapien
agacgaccttattatccacgcggta

SEQ ID NO: 47119 - DNA, 25 bp, Homo sapien
accttattatccacgcggtacttct

SEQ ID NO: 47120 - DNA, 25 bp, Homo sapien
cgcggtacttctcgccctacaataa

SEQ ID NO: 47121 - DNA, 25 bp, Homo sapien
gcatcggactagtcaggtccatttt

SEQ ID NO: 47122 - DNA, 25 bp, Homo sapien
gaatgttttcatgttttctggtgac

SEQ ID NO: 47123 - DNA, 25 bp, Homo sapien
gacatgtagggtctgtagtcacccc

SEQ ID NO: 47124 - DNA, 25 bp, Homo sapien
tgtagtcacccctgcatattgagaa

SEQ ID NO: 47125 - DNA, 25 bp, Homo sapien
gaaactaggaccacactgcatcgga

SEQ ID NO: 47126 - DNA, 25 bp, Homo sapien
gcatcggactagtcaggtccattta

SEQ ID NO: 47127 - DNA, 25 bp, Homo sapien
tccatttacatgtccaagaatcttt

SEQ ID NO: 47128 - DNA, 25 bp, Homo sapien
tcttaaattccttactttgttcatt

SEQ ID NO: 47129 - DNA, 25 bp, Homo sapien
ttgttcattcattggctgttcaggc

SEQ ID NO: 47130 - DNA, 25 bp, Homo sapien
attcattggctgttcaggctgaaaa

SEQ ID NO: 47131 - DNA, 25 bp, Homo sapien
aaatggaaacaggtagcttttatgt

SEQ ID NO: 47132 - DNA, 25 bp, Homo sapien
gaaccagacaagcagacaatcagcg

SEQ ID NO: 47133 - DNA, 25 bp, Homo sapien
aaccagacaagcagacaatcagcgg

SEQ ID NO: 47134 - DNA, 25 bp, Homo sapien
ccagacaagcagacaatcagcggac

SEQ ID NO: 47135 - DNA, 25 bp, Homo sapien
cagacaagcagacaatcagcggaca

SEQ ID NO: 47136 - DNA, 25 bp, Homo sapien
acaagcagacaatcagcggacaatc

SEQ ID NO: 47137 - DNA, 25 bp, Homo sapien
caagcagacaatcagcggacaatcg

SEQ ID NO: 47138 - DNA, 25 bp, Homo sapien
aagcagacaatcagcggacaatcgg

SEQ ID NO: 47139 - DNA, 25 bp, Homo sapien
gacaatcagcggacaatcggttttg

SEQ ID NO: 47140 - DNA, 25 bp, Homo sapien
gcggacaatcggttttggactcacc

SEQ ID NO: 47141 - DNA, 25 bp, Homo sapien
ggtgttgggaaccatgcctgccagc

SEQ ID NO: 47142 - DNA, 25 bp, Homo sapien
tgttgggaaccatgcctgccagccc

SEQ ID NO: 47143 - DNA, 25 bp, Homo sapien
aaagcgggcagcaggccccgattcc

SEQ ID NO: 47144 - DNA, 25 bp, Homo sapien
gattccgggaagagccgacccagcc

SEQ ID NO: 47145 - DNA, 25 bp, Homo sapien
agccccgaaccagacaagcagacaa

SEQ ID NO: 47146 - DNA, 25 bp, Homo sapien
cccgaaccagacaagcagacaatca

SEQ ID NO: 47147 - DNA, 25 bp, Homo sapien
cgaaccagacaagcagacaatcagc

SEQ ID NO: 47148 - DNA, 25 bp, Homo sapien
ttttgcccaggcttcctttacttct

SEQ ID NO: 47149 - DNA, 25 bp, Homo sapien
tgcccaggcttcctttacttcttgg

SEQ ID NO: 47150 - DNA, 25 bp, Homo sapien
tacttcttggtcctgtataatctct

SEQ ID NO: 47151 - DNA, 25 bp, Homo sapien
ttcttggtcctgtataatctctttg

SEQ ID NO: 47152 - DNA, 25 bp, Homo sapien
ggtcctgtataatctctttggtctc

SEQ ID NO: 47153 - DNA, 25 bp, Homo sapien
tcctgtataatctctttggtctcta

SEQ ID NO: 47154 - DNA, 25 bp, Homo sapien
tgtataatctctttggtctctataa

SEQ ID NO: 47155 - DNA, 25 bp, Homo sapien
tctttggtctctataacccccgatt

SEQ ID NO: 47156 - DNA, 25 bp, Homo sapien
gattccagccaacaccttgaaccct

SEQ ID NO: 47157 - DNA, 25 bp, Homo sapien
ttgaaccctcaaactcataccttct

SEQ ID NO: 47158 - DNA, 25 bp, Homo sapien
ttctgcctccaacagccctgatttc

SEQ ID NO: 47159 - DNA, 25 bp, Homo sapien
tggtctgcatgacactaagacgctt

SEQ ID NO: 47160 - DNA, 25 bp, Homo sapien
gtctgcatgacactaagacgcttgt

SEQ ID NO: 47161 - DNA, 25 bp, Homo sapien
tgcatgacactaagacgcttgtcca

SEQ ID NO: 47162 - DNA, 25 bp, Homo sapien
atgacactaagacgcttgtccacag

SEQ ID NO: 47163 - DNA, 25 bp, Homo sapien
gacactaagacgcttgtccacagcg

SEQ ID NO: 47164 - DNA, 25 bp, Homo sapien
actaagacgcttgtccacagcggcg

SEQ ID NO: 47165 - DNA, 25 bp, Homo sapien
taagacgcttgtccacagcggcgac

SEQ ID NO: 47166 - DNA, 25 bp, Homo sapien
aagacgcttgtccacagcggcgacc

SEQ ID NO: 47167 - DNA, 25 bp, Homo sapien
gcaaggccagacttttccgtcgttt

SEQ ID NO: 47168 - DNA, 25 bp, Homo sapien
tcaataaataagcagctcagcgcaa

SEQ ID NO: 47169 - DNA, 25 bp, Homo sapien
taaataagcagctcagcgcaaaaaa

SEQ ID NO: 47170 - DNA, 25 bp, Homo sapien
ggcctgggaccctctccacagaggg

SEQ ID NO: 47171 - DNA, 25 bp, Homo sapien
ggatgtggtccctggtcatgacata

SEQ ID NO: 47172 - DNA, 25 bp, Homo sapien
tggtccctggtcatgacataaccta

SEQ ID NO: 47173 - DNA, 25 bp, Homo sapien
gtcatgacataacctagcagcagta

SEQ ID NO: 47174 - DNA, 25 bp, Homo sapien
agcagactgggccataaggaaacag

SEQ ID NO: 47175 - DNA, 25 bp, Homo sapien
tgggccataaggaaacagcaggact

SEQ ID NO: 47176 - DNA, 25 bp, Homo sapien
agcaggactggctcaagtgcccaag

SEQ ID NO: 47177 - DNA, 25 bp, Homo sapien
ggctcaagtgcccaaggtttgttta

SEQ ID NO: 47178 - DNA, 25 bp, Homo sapien
tttagggcctgggaattggccatgt

SEQ ID NO: 47179 - DNA, 25 bp, Homo sapien
attggccatgtgttaatttattgag

SEQ ID NO: 47180 - DNA, 25 bp, Homo sapien
taatttattgagtggagtaggtggc

SEQ ID NO: 47181 - DNA, 25 bp, Homo sapien
tttgtttctgaagtggtgcctgtac

SEQ ID NO: 47182 - DNA, 25 bp, Homo sapien
ttgtttctgaagtggtgcctgtacc

SEQ ID NO: 47183 - DNA, 25 bp, Homo sapien
tgtttctgaagtggtgcctgtacct

SEQ ID NO: 47184 - DNA, 25 bp, Homo sapien
gtttctgaagtggtgcctgtacctc

SEQ ID NO: 47185 - DNA, 25 bp, Homo sapien
tttctgaagtggtgcctgtacctcc

SEQ ID NO: 47186 - DNA, 25 bp, Homo sapien
ttctgaagtggtgcctgtacctcca

SEQ ID NO: 47187 - DNA, 25 bp, Homo sapien
ctgaatgtacctgagtgtatgtatt

SEQ ID NO: 47188 - DNA, 25 bp, Homo sapien
aatgtacctgagtgtatgtatttaa

SEQ ID NO: 47189 - DNA, 25 bp, Homo sapien
gagaatttatggctctgtatccaat

SEQ ID NO: 47190 - DNA, 25 bp, Homo sapien
gaatttatggctctgtatccaataa

SEQ ID NO: 47191 - DNA, 25 bp, Homo sapien
ttatggctctgtatccaataaaaaa

SEQ ID NO: 47192 - DNA, 25 bp, Homo sapien
ccatccttcccatttcctttgatgt

SEQ ID NO: 47193 - DNA, 25 bp, Homo sapien
catccttcccatttcctttgatgtt

SEQ ID NO: 47194 - DNA, 25 bp, Homo sapien
atccttcccatttcctttgatgtta

SEQ ID NO: 47195 - DNA, 25 bp, Homo sapien
tccttcccatttcctttgatgttat

SEQ ID NO: 47196 - DNA, 25 bp, Homo sapien
ccttcccatttcctttgatgttatt

SEQ ID NO: 47197 - DNA, 25 bp, Homo sapien
cttcccatttcctttgatgttattt

SEQ ID NO: 47198 - DNA, 25 bp, Homo sapien
ttcccatttcctttgatgttatttt

SEQ ID NO: 47199 - DNA, 25 bp, Homo sapien
ggactctgtatgattgaaataaaga

SEQ ID NO: 47200 - DNA, 25 bp, Homo sapien
ataagtaatattgacggtgatatga

SEQ ID NO: 47201 - DNA, 25 bp, Homo sapien
taagtaatattgacggtgatatgaa

SEQ ID NO: 47202 - DNA, 25 bp, Homo sapien
aagtaatattgacggtgatatgaaa

SEQ ID NO: 47203 - DNA, 25 bp, Homo sapien
gtaatattgacggtgatatgaaaac

SEQ ID NO: 47204 - DNA, 25 bp, Homo sapien
taatattgacggtgatatgaaaact

SEQ ID NO: 47205 - DNA, 25 bp, Homo sapien
aatattgacggtgatatgaaaactt

SEQ ID NO: 47206 - DNA, 25 bp, Homo sapien
gatatgaaaacttttgttatgtgaa

SEQ ID NO: 47207 - DNA, 25 bp, Homo sapien
atatgaaaacttttgttatgtgaag

SEQ ID NO: 47208 - DNA, 25 bp, Homo sapien
tatgaaaacttttgttatgtgaaga

SEQ ID NO: 47209 - DNA, 25 bp, Homo sapien
atgaaaacttttgttatgtgaagat

SEQ ID NO: 47210 - DNA, 25 bp, Homo sapien
aacttttgttatgtgaagatattta

SEQ ID NO: 47211 - DNA, 25 bp, Homo sapien
ttctttattgtcctgatttgtcctc

SEQ ID NO: 47212 - DNA, 25 bp, Homo sapien
tttattgtcctgatttgtcctcttt

SEQ ID NO: 47213 - DNA, 25 bp, Homo sapien
tcctgatttgtcctctttgttggtt

SEQ ID NO: 47214 - DNA, 25 bp, Homo sapien
tgatttgtcctctttgttggttttt

SEQ ID NO: 47215 - DNA, 25 bp, Homo sapien
gggtcagaaattctgccctttgcct

SEQ ID NO: 47216 - DNA, 25 bp, Homo sapien
tttgcctccaccacatggcattctg

SEQ ID NO: 47217 - DNA, 25 bp, Homo sapien
cacatggcattctggttttggtttc

SEQ ID NO: 47218 - DNA, 25 bp, Homo sapien
catggcattctggttttggtttctg

SEQ ID NO: 47219 - DNA, 25 bp, Homo sapien
tgggtctttctatgctggttgtatt

SEQ ID NO: 47220 - DNA, 25 bp, Homo sapien
gtctttctatgctggttgtatttat

SEQ ID NO: 47221 - DNA, 25 bp, Homo sapien
tctatgctggttgtatttatattaa

SEQ ID NO: 47222 - DNA, 25 bp, Homo sapien
ctgagtcctcgtctcctttccagtg

SEQ ID NO: 47223 - DNA, 25 bp, Homo sapien
gagtcctcgtctcctttccagtgct

SEQ ID NO: 47224 - DNA, 25 bp, Homo sapien
cacagcactttgtgtctcgctttga

SEQ ID NO: 47225 - DNA, 25 bp, Homo sapien
ctttgtgtctcgctttgagcacttg

SEQ ID NO: 47226 - DNA, 25 bp, Homo sapien
tttgtgtctcgctttgagcacttgc

SEQ ID NO: 47227 - DNA, 25 bp, Homo sapien
tgtgtctcgctttgagcacttgcca

SEQ ID NO: 47228 - DNA, 25 bp, Homo sapien
tgtctcgctttgagcacttgccact

SEQ ID NO: 47229 - DNA, 25 bp, Homo sapien
tcgctttgagcacttgccactctgg

SEQ ID NO: 47230 - DNA, 25 bp, Homo sapien
ctttgagcacttgccactctggctg

SEQ ID NO: 47231 - DNA, 25 bp, Homo sapien
tgagcacttgccactctggctggtg

SEQ ID NO: 47232 - DNA, 25 bp, Homo sapien
gcacttgccactctggctggtgctg

SEQ ID NO: 47233 - DNA, 25 bp, Homo sapien
cttgaacctctgctgacctgacagt

SEQ ID NO: 47234 - DNA, 25 bp, Homo sapien
gagggccgcaccatgctgactgcct

SEQ ID NO: 47235 - DNA, 25 bp, Homo sapien
atgctgactgcctgaatctctgctg

SEQ ID NO: 47236 - DNA, 25 bp, Homo sapien
gctgactgcctgaatctctgctgag

SEQ ID NO: 47237 - DNA, 25 bp, Homo sapien
cagtgtccagcccagtgttgaacag

SEQ ID NO: 47238 - DNA, 25 bp, Homo sapien
tgtccagcccagtgttgaacagatt

SEQ ID NO: 47239 - DNA, 25 bp, Homo sapien
cagcccagtgttgaacagattgtag

SEQ ID NO: 47240 - DNA, 25 bp, Homo sapien
agattgtagcgttctgtctcattac

SEQ ID NO: 47241 - DNA, 25 bp, Homo sapien
gtagcgttctgtctcattacgagca

SEQ ID NO: 47242 - DNA, 25 bp, Homo sapien
gcgttctgtctcattacgagcaaat

SEQ ID NO: 47243 - DNA, 25 bp, Homo sapien
tgtctcattacgagcaaataaatag

SEQ ID NO: 47244 - DNA, 25 bp, Homo sapien
cgcttggcgtctctgggattgggat

SEQ ID NO: 47245 - DNA, 25 bp, Homo sapien
attgggatgagtgcctggctcccat

SEQ ID NO: 47246 - DNA, 25 bp, Homo sapien
tcctcaccttttgttgctatcggca

SEQ ID NO: 47247 - DNA, 25 bp, Homo sapien
accttttgttgctatcggcagctgc

SEQ ID NO: 47248 - DNA, 25 bp, Homo sapien
tgttgctatcggcagctgctggctc

SEQ ID NO: 47249 - DNA, 25 bp, Homo sapien
tctgggttcctctgccctggaaggg

SEQ ID NO: 47250 - DNA, 25 bp, Homo sapien
tggaagggctccaggacccgtccca

SEQ ID NO: 47251 - DNA, 25 bp, Homo sapien
caataaccacccacggccaggaggg

SEQ ID NO: 47252 - DNA, 25 bp, Homo sapien
ccgtgctggatatttaaatttaggg

SEQ ID NO: 47253 - DNA, 25 bp, Homo sapien
tctccagggcgcgtagataaataaa

SEQ ID NO: 47254 - DNA, 25 bp, Homo sapien
gataaataaatacactcagcgtcaa

SEQ ID NO: 47255 - DNA, 25 bp, Homo sapien
aaaactcaagttcgatactctcagt

SEQ ID NO: 47256 - DNA, 25 bp, Homo sapien
agttcgatactctcagtacatgaaa

SEQ ID NO: 47257 - DNA, 25 bp, Homo sapien
ttgccgggtcctttggttcttcctg

SEQ ID NO: 47258 - DNA, 25 bp, Homo sapien
ctttggttcttcctgggtctgggct

SEQ ID NO: 47259 - DNA, 25 bp, Homo sapien
tgggtctgggctcgcctagggacct

SEQ ID NO: 47260 - DNA, 25 bp, Homo sapien
tagggacctcgggatggccgcctat

SEQ ID NO: 47261 - DNA, 25 bp, Homo sapien
ggacctcgggatggccgcctatcga

SEQ ID NO: 47262 - DNA, 25 bp, Homo sapien
gatggccgcctatcgagggctcgcg

SEQ ID NO: 47263 - DNA, 25 bp, Homo sapien
ggtgtttgcccagggtccaaggtct

SEQ ID NO: 47264 - DNA, 25 bp, Homo sapien
gtttgcccagggtccaaggtctgtc

SEQ ID NO: 47265 - DNA, 25 bp, Homo sapien
ccagggtccaaggtctgtccgcttg

SEQ ID NO: 47266 - DNA, 25 bp, Homo sapien
gacaggagagtcattaagaagcatt

SEQ ID NO: 47267 - DNA, 25 bp, Homo sapien
gagagtcattaagaagcatttcact

SEQ ID NO: 47268 - DNA, 25 bp, Homo sapien
actgtagcattctatcacaatatca

SEQ ID NO: 47269 - DNA, 25 bp, Homo sapien
gtagcattctatcacaatatcatct

SEQ ID NO: 47270 - DNA, 25 bp, Homo sapien
gcattctatcacaatatcatctgga

SEQ ID NO: 47271 - DNA, 25 bp, Homo sapien
ttctatcacaatatcatctggaatt

SEQ ID NO: 47272 - DNA, 25 bp, Homo sapien
ccagaaagccttaacttgcctctag

SEQ ID NO: 47273 - DNA, 25 bp, Homo sapien
cagaaagccttaacttgcctctaga

SEQ ID NO: 47274 - DNA, 25 bp, Homo sapien
tcttctgctgtggaagtttgaagcg

SEQ ID NO: 47275 - DNA, 25 bp, Homo sapien
acccctccctcaacaatatgagtga

SEQ ID NO: 47276 - DNA, 25 bp, Homo sapien
cccctccctcaacaatatgagtgat

SEQ ID NO: 47277 - DNA, 25 bp, Homo sapien
aaatcctagggcctcaacctcgcat

SEQ ID NO: 47278 - DNA, 25 bp, Homo sapien
tcgcatcctgaaccttagcatcgtg

SEQ ID NO: 47279 - DNA, 25 bp, Homo sapien
gaaccttagcatcgtggaacacaga

SEQ ID NO: 47280 - DNA, 25 bp, Homo sapien
ggaacacagaagcttccactgtcag

SEQ ID NO: 47281 - DNA, 25 bp, Homo sapien
tgagctcgaaccacccatttgagat

SEQ ID NO: 47282 - DNA, 25 bp, Homo sapien
gaaccacccatttgagatgtcactg

SEQ ID NO: 47283 - DNA, 25 bp, Homo sapien
ccatttgagatgtcactgtggcccc

SEQ ID NO: 47284 - DNA, 25 bp, Homo sapien
agggctgggagcattctccaggagc

SEQ ID NO: 47285 - DNA, 25 bp, Homo sapien
cagaggttcagtctgcttcatggtc

SEQ ID NO: 47286 - DNA, 25 bp, Homo sapien
agtctgcttcatggtctcttggacc

SEQ ID NO: 47287 - DNA, 25 bp, Homo sapien
gtctcttggaccagttttgactaca

SEQ ID NO: 47288 - DNA, 25 bp, Homo sapien
acagagggctcaaccacctttggag

SEQ ID NO: 47289 - DNA, 25 bp, Homo sapien
agagggctcaaccacctttggagtg

SEQ ID NO: 47290 - DNA, 25 bp, Homo sapien
ttggagtgactccatagcactggcc

SEQ ID NO: 47291 - DNA, 25 bp, Homo sapien
agcagacgggctttgagggcattta

SEQ ID NO: 47292 - DNA, 25 bp, Homo sapien
cagacgggctttgagggcatttagt

SEQ ID NO: 47293 - DNA, 25 bp, Homo sapien
gacgggctttgagggcatttagtct

SEQ ID NO: 47294 - DNA, 25 bp, Homo sapien
ggctttgagggcatttagtctcaga

SEQ ID NO: 47295 - DNA, 25 bp, Homo sapien
tgagggcatttagtctcagaaaaaa

SEQ ID NO: 47296 - DNA, 25 bp, Homo sapien
ggatttcggaattagaattttgtgt

SEQ ID NO: 47297 - DNA, 25 bp, Homo sapien
gaattttgtgtattgtatctgtagt

SEQ ID NO: 47298 - DNA, 25 bp, Homo sapien
gtgtattgtatctgtagttttgtaa

SEQ ID NO: 47299 - DNA, 25 bp, Homo sapien
acccagccgcacacaggcctagagg

SEQ ID NO: 47300 - DNA, 25 bp, Homo sapien
cagccgcacacaggcctagaggtaa

SEQ ID NO: 47301 - DNA, 25 bp, Homo sapien
ccgcacacaggcctagaggtaacca

SEQ ID NO: 47302 - DNA, 25 bp, Homo sapien
gcacacaggcctagaggtaaccaat

SEQ ID NO: 47303 - DNA, 25 bp, Homo sapien
acacaggcctagaggtaaccaataa

SEQ ID NO: 47304 - DNA, 25 bp, Homo sapien
caggcctagaggtaaccaataaagt

SEQ ID NO: 47305 - DNA, 25 bp, Homo sapien
ggcctagaggtaaccaataaagtat

SEQ ID NO: 47306 - DNA, 25 bp, Homo sapien
caaactccacagtatgggaccctgg

SEQ ID NO: 47307 - DNA, 25 bp, Homo sapien
aaactccacagtatgggaccctgga

SEQ ID NO: 47308 - DNA, 25 bp, Homo sapien
aactccacagtatgggaccctggag

SEQ ID NO: 47309 - DNA, 25 bp, Homo sapien
actccacagtatgggaccctggagg

SEQ ID NO: 47310 - DNA, 25 bp, Homo sapien
ggcccgcggaagttaagcaaccaag

SEQ ID NO: 47311 - DNA, 25 bp, Homo sapien
cgcagcctgtcgtacggtccttctg

SEQ ID NO: 47312 - DNA, 25 bp, Homo sapien
ccttctgtgggtctgtcggtgccga

SEQ ID NO: 47313 - DNA, 25 bp, Homo sapien
agaagctgcggctcctgggcctccg

SEQ ID NO: 47314 - DNA, 25 bp, Homo sapien
gctgcacttgctcagcctgggcctg

SEQ ID NO: 47315 - DNA, 25 bp, Homo sapien
tcagaggtcgtggaaaccctggctc

SEQ ID NO: 47316 - DNA, 25 bp, Homo sapien
aaccctggctcttggctggtgttgt

SEQ ID NO: 47317 - DNA, 25 bp, Homo sapien
tacgaccgcttctccgaggccagga

SEQ ID NO: 47318 - DNA, 25 bp, Homo sapien
tcacaaggccgctcatggattactt

SEQ ID NO: 47319 - DNA, 25 bp, Homo sapien
aaggccgctcatggattacttgccc

SEQ ID NO: 47320 - DNA, 25 bp, Homo sapien
gctcatggattacttgcccacctgg

SEQ ID NO: 47321 - DNA, 25 bp, Homo sapien
ttacttgcccacctggcagaaaatc

SEQ ID NO: 47322 - DNA, 25 bp, Homo sapien
agttggggctgacagacctcccgga

SEQ ID NO: 47323 - DNA, 25 bp, Homo sapien
gcagggagcccctcttccctaataa

SEQ ID NO: 47324 - DNA, 25 bp, Homo sapien
tccctaataaaactgactccggcag

SEQ ID NO: 47325 - DNA, 25 bp, Homo sapien
ccctaataaaactgactccggcagc

SEQ ID NO: 47326 - DNA, 25 bp, Homo sapien
tctatatatcaagttttgtatcata

SEQ ID NO: 47327 - DNA, 25 bp, Homo sapien
ctatatatcaagttttgtatcatat

SEQ ID NO: 47328 - DNA, 25 bp, Homo sapien
atatatcaagttttgtatcatatgt

SEQ ID NO: 47329 - DNA, 25 bp, Homo sapien
tatatcaagttttgtatcatatgta

SEQ ID NO: 47330 - DNA, 25 bp, Homo sapien
atatcaagttttgtatcatatgtat

SEQ ID NO: 47331 - DNA, 25 bp, Homo sapien
tatcaagttttgtatcatatgtatt

SEQ ID NO: 47332 - DNA, 25 bp, Homo sapien
atcaagttttgtatcatatgtattg

SEQ ID NO: 47333 - DNA, 25 bp, Homo sapien
tcaagttttgtatcatatgtattgc

SEQ ID NO: 47334 - DNA, 25 bp, Homo sapien
caagttttgtatcatatgtattgct

SEQ ID NO: 47335 - DNA, 25 bp, Homo sapien
aagttttgtatcatatgtattgctc

SEQ ID NO: 47336 - DNA, 25 bp, Homo sapien
agttttgtatcatatgtattgctct

SEQ ID NO: 47337 - DNA, 25 bp, Homo sapien
ggccgagaaacagcccggagtaagg

SEQ ID NO: 47338 - DNA, 25 bp, Homo sapien
gccgagaaacagcccggagtaaggt

SEQ ID NO: 47339 - DNA, 25 bp, Homo sapien
gggtgcagggtaagggctcccaggt

SEQ ID NO: 47340 - DNA, 25 bp, Homo sapien
ggtgcagggtaagggctcccaggtc

SEQ ID NO: 47341 - DNA, 25 bp, Homo sapien
gtgcagggtaagggctcccaggtct

SEQ ID NO: 47342 - DNA, 25 bp, Homo sapien
tgcagggtaagggctcccaggtctt

SEQ ID NO: 47343 - DNA, 25 bp, Homo sapien
gcagggtaagggctcccaggtcttc

SEQ ID NO: 47344 - DNA, 25 bp, Homo sapien
cagggtaagggctcccaggtcttca

SEQ ID NO: 47345 - DNA, 25 bp, Homo sapien
ctcccaggtcttcatctggccagca

SEQ ID NO: 47346 - DNA, 25 bp, Homo sapien
tcccaggtcttcatctggccagcag

SEQ ID NO: 47347 - DNA, 25 bp, Homo sapien
cccaggtcttcatctggccagcagg

SEQ ID NO: 47348 - DNA, 25 bp, Homo sapien
agagctgacgggaggccccagctct

SEQ ID NO: 47349 - DNA, 25 bp, Homo sapien
gggtgtggatgtaattagctctggg

SEQ ID NO: 47350 - DNA, 25 bp, Homo sapien
gatgtaattagctctggggggcagt

SEQ ID NO: 47351 - DNA, 25 bp, Homo sapien
gatgggtgggggctcctggtggcct

SEQ ID NO: 47352 - DNA, 25 bp, Homo sapien
ggccacagccgcctttgggttccat

SEQ ID NO: 47353 - DNA, 25 bp, Homo sapien
gccacagccgcctttgggttccatc

SEQ ID NO: 47354 - DNA, 25 bp, Homo sapien
gggttccatcttgctaataaacact

SEQ ID NO: 47355 - DNA, 25 bp, Homo sapien
ggttccatcttgctaataaacactg

SEQ ID NO: 47356 - DNA, 25 bp, Homo sapien
gttccatcttgctaataaacactgg

SEQ ID NO: 47357 - DNA, 25 bp, Homo sapien
ttccatcttgctaataaacactggc

SEQ ID NO: 47358 - DNA, 25 bp, Homo sapien
tccatcttgctaataaacactggct

SEQ ID NO: 47359 - DNA, 25 bp, Homo sapien
cacgtcccacggcagaagccctgag

SEQ ID NO: 47360 - DNA, 25 bp, Homo sapien
gggagaacagcattcccgccgcctc

SEQ ID NO: 47361 - DNA, 25 bp, Homo sapien
tctggcaggcgcacccaggagatgg

SEQ ID NO: 47362 - DNA, 25 bp, Homo sapien
gctcaggcccagctgtcctaggttg

SEQ ID NO: 47363 - DNA, 25 bp, Homo sapien
tcaggcccagctgtcctaggttggg

SEQ ID NO: 47364 - DNA, 25 bp, Homo sapien
gtgggtggacccaagcttgtctgct

SEQ ID NO: 47365 - DNA, 25 bp, Homo sapien
gggtggacccaagcttgtctgctgc

SEQ ID NO: 47366 - DNA, 25 bp, Homo sapien
agcttgtctgctgcctgagttccag

SEQ ID NO: 47367 - DNA, 25 bp, Homo sapien
ttgtctgctgcctgagttccagaga

SEQ ID NO: 47368 - DNA, 25 bp, Homo sapien
gtctgctgcctgagttccagagagg

SEQ ID NO: 47369 - DNA, 25 bp, Homo sapien
gggattctgtggaagtttgtaaata

SEQ ID NO: 47370 - DNA, 25 bp, Homo sapien
tgcctagatcagtccttctccaaaa

SEQ ID NO: 47371 - DNA, 25 bp, Homo sapien
cctagatcagtccttctccaaaagg

SEQ ID NO: 47372 - DNA, 25 bp, Homo sapien
tagatcagtccttctccaaaaggac

SEQ ID NO: 47373 - DNA, 25 bp, Homo sapien
tccaaaaggacctgggagctggcag

SEQ ID NO: 47374 - DNA, 25 bp, Homo sapien
aaaaggacctgggagctggcagcct

SEQ ID NO: 47375 - DNA, 25 bp, Homo sapien
ggctgaggcacgtggtagccctctt

SEQ ID NO: 47376 - DNA, 25 bp, Homo sapien
gtggtagccctctttctgtgaatgg

SEQ ID NO: 47377 - DNA, 25 bp, Homo sapien
agagatgcatcagctcgcctgggac

SEQ ID NO: 47378 - DNA, 25 bp, Homo sapien
cctgggactggctctgtgataaaaa

SEQ ID NO: 47379 - DNA, 25 bp, Homo sapien
tgggttttcagaccccatgttgttg

SEQ ID NO: 47380 - DNA, 25 bp, Homo sapien
agaccccatgttgttggtcaatgaa

SEQ ID NO: 47381 - DNA, 25 bp, Homo sapien
gtttgaccagcgtctcaccttcact

SEQ ID NO: 47382 - DNA, 25 bp, Homo sapien
ttgaccagcgtctcaccttcactat

SEQ ID NO: 47383 - DNA, 25 bp, Homo sapien
agcgtctcaccttcactatcggcac

SEQ ID NO: 47384 - DNA, 25 bp, Homo sapien
ggaacgacatccaccacaagaccag

SEQ ID NO: 47385 - DNA, 25 bp, Homo sapien
ctgacccgggtgcaagaggagctga

SEQ ID NO: 47386 - DNA, 25 bp, Homo sapien
gacccgggtgcaagaggagctgaga

SEQ ID NO: 47387 - DNA, 25 bp, Homo sapien
agctgagagcgaagggtatcacaga

SEQ ID NO: 47388 - DNA, 25 bp, Homo sapien
gctgagagcgaagggtatcacagat

SEQ ID NO: 47389 - DNA, 25 bp, Homo sapien
gagagcgaagggtatcacagatgac

SEQ ID NO: 47390 - DNA, 25 bp, Homo sapien
gagcgaagggtatcacagatgactg

SEQ ID NO: 47391 - DNA, 25 bp, Homo sapien
agcgaagggtatcacagatgactga

SEQ ID NO: 47392 - DNA, 25 bp, Homo sapien
ttttttgtgtgctacattcaaggag

SEQ ID NO: 47393 - DNA, 25 bp, Homo sapien
tttttgtgtgctacattcaaggaga

SEQ ID NO: 47394 - DNA, 25 bp, Homo sapien
ttttgtgtgctacattcaaggagat

SEQ ID NO: 47395 - DNA, 25 bp, Homo sapien
tttgtgtgctacattcaaggagatc

SEQ ID NO: 47396 - DNA, 25 bp, Homo sapien
ttgtgtgctacattcaaggagatca

SEQ ID NO: 47397 - DNA, 25 bp, Homo sapien
tgtgtgctacattcaaggagatcaa

SEQ ID NO: 47398 - DNA, 25 bp, Homo sapien
gtgtgctacattcaaggagatcaaa

SEQ ID NO: 47399 - DNA, 25 bp, Homo sapien
tgtgctacattcaaggagatcaaaa

SEQ ID NO: 47400 - DNA, 25 bp, Homo sapien
gtgctacattcaaggagatcaaaaa

SEQ ID NO: 47401 - DNA, 25 bp, Homo sapien
tgctacattcaaggagatcaaaaaa

SEQ ID NO: 47402 - DNA, 25 bp, Homo sapien
tcaaggagatcaaaaaaacttttct

SEQ ID NO: 47403 - DNA, 25 bp, Homo sapien
ttgggcctggtgagggttaggactt

SEQ ID NO: 47404 - DNA, 25 bp, Homo sapien
gttaggacttcagaaaccagagcac

SEQ ID NO: 47405 - DNA, 25 bp, Homo sapien
aaaccagagcacaagccccacagag

SEQ ID NO: 47406 - DNA, 25 bp, Homo sapien
aaccagagcacaagccccacagagg

SEQ ID NO: 47407 - DNA, 25 bp, Homo sapien
agccagcaccgctctagctggttgt

SEQ ID NO: 47408 - DNA, 25 bp, Homo sapien
gcaccgctctagctggttgttgcca

SEQ ID NO: 47409 - DNA, 25 bp, Homo sapien
ctggttgttgccatgccggaatgtg

SEQ ID NO: 47410 - DNA, 25 bp, Homo sapien
gttgccatgccggaatgtgggccta

SEQ ID NO: 47411 - DNA, 25 bp, Homo sapien
tgccatgccggaatgtgggcctagt

SEQ ID NO: 47412 - DNA, 25 bp, Homo sapien
catgccggaatgtgggcctagtgtt

SEQ ID NO: 47413 - DNA, 25 bp, Homo sapien
cggaatgtgggcctagtgttgccag

SEQ ID NO: 47414 - DNA, 25 bp, Homo sapien
ggaggacataaggtatagccataaa

SEQ ID NO: 47415 - DNA, 25 bp, Homo sapien
tagccataaatcataacccagggac

SEQ ID NO: 47416 - DNA, 25 bp, Homo sapien
ggaccacactcaaccctagggaaat

SEQ ID NO: 47417 - DNA, 25 bp, Homo sapien
agggaaattgtcttcctgatcagtt

SEQ ID NO: 47418 - DNA, 25 bp, Homo sapien
gtcttcctgatcagttgattaccat

SEQ ID NO: 47419 - DNA, 25 bp, Homo sapien
agttgattaccatctgaggtcaaga

SEQ ID NO: 47420 - DNA, 25 bp, Homo sapien
gatagtgggagcaaatgggtcacaa

SEQ ID NO: 47421 - DNA, 25 bp, Homo sapien
aaatgggtcacaaatagctcagctg

SEQ ID NO: 47422 - DNA, 25 bp, Homo sapien
cacaaatagctcagctgtgggctca

SEQ ID NO: 47423 - DNA, 25 bp, Homo sapien
ggatgacctatgaactttagtctaa

SEQ ID NO: 47424 - DNA, 25 bp, Homo sapien
ttcctcctggtgttgccacttctgg

SEQ ID NO: 47425 - DNA, 25 bp, Homo sapien
gtggtcctgagctatctggggtccc

SEQ ID NO: 47426 - DNA, 25 bp, Homo sapien
tggtcctgagctatctggggtccct

SEQ ID NO: 47427 - DNA, 25 bp, Homo sapien
ggtcctgagctatctggggtccctc

SEQ ID NO: 47428 - DNA, 25 bp, Homo sapien
tcctgagctatctggggtccctcga

SEQ ID NO: 47429 - DNA, 25 bp, Homo sapien
cctgagctatctggggtccctcgag

SEQ ID NO: 47430 - DNA, 25 bp, Homo sapien
agctatctggggtccctcgaggaga

SEQ ID NO: 47431 - DNA, 25 bp, Homo sapien
atctggggtccctcgaggagagagc

SEQ ID NO: 47432 - DNA, 25 bp, Homo sapien
ctggggtccctcgaggagagagcga

SEQ ID NO: 47433 - DNA, 25 bp, Homo sapien
agagcgaggagacaggaagctccga

SEQ ID NO: 47434 - DNA, 25 bp, Homo sapien
gagacaggaagctccgagggtgccc

SEQ ID NO: 47435 - DNA, 25 bp, Homo sapien
tgcttccagccacacgggcccctga

SEQ ID NO: 47436 - DNA, 25 bp, Homo sapien
agcagcagatggctctcggttccag

SEQ ID NO: 47437 - DNA, 25 bp, Homo sapien
tctcggttccaggtgtgggactatg

SEQ ID NO: 47438 - DNA, 25 bp, Homo sapien
gatacttcgaggctgatcctccagg

SEQ ID NO: 47439 - DNA, 25 bp, Homo sapien
cttcgaggctgatcctccagggcag

SEQ ID NO: 47440 - DNA, 25 bp, Homo sapien
tgacccaaccacttgacttaatctc

SEQ ID NO: 47441 - DNA, 25 bp, Homo sapien
ccaaccacttgacttaatctcactt

SEQ ID NO: 47442 - DNA, 25 bp, Homo sapien
gacttaatctcactttcttaaattc

SEQ ID NO: 47443 - DNA, 25 bp, Homo sapien
attcttctattctcagacactgctc

SEQ ID NO: 47444 - DNA, 25 bp, Homo sapien
agacactgctctagtaccattcctt

SEQ ID NO: 47445 - DNA, 25 bp, Homo sapien
tctagtaccattccttcctcttagc

SEQ ID NO: 47446 - DNA, 25 bp, Homo sapien
cctcttagccccaggagcaaattaa

SEQ ID NO: 47447 - DNA, 25 bp, Homo sapien
acaagtggattgagggtctgccaat

SEQ ID NO: 47448 - DNA, 25 bp, Homo sapien
gtctgccaatgaaagcgacccatac

SEQ ID NO: 47449 - DNA, 25 bp, Homo sapien
atgaaagcgacccatactgaagtcc

SEQ ID NO: 47450 - DNA, 25 bp, Homo sapien
ctggctctggttgagacccagaaga

SEQ ID NO: 47451 - DNA, 25 bp, Homo sapien
acccagaagagtcatgcatcagaat

SEQ ID NO: 47452 - DNA, 25 bp, Homo sapien
gtggacaggaaataccctggccttt

SEQ ID NO: 47453 - DNA, 25 bp, Homo sapien
caggaaataccctggcctttgtagg

SEQ ID NO: 47454 - DNA, 25 bp, Homo sapien
catctcttctgcagcaagataacat

SEQ ID NO: 47455 - DNA, 25 bp, Homo sapien
aagataacatgctactaggcctcaa

SEQ ID NO: 47456 - DNA, 25 bp, Homo sapien
gctactaggcctcaattcattgcta

SEQ ID NO: 47457 - DNA, 25 bp, Homo sapien
acattttttaacaagtatctcacat

SEQ ID NO: 47458 - DNA, 25 bp, Homo sapien
aagatggccccagtgagttcgcact

SEQ ID NO: 47459 - DNA, 25 bp, Homo sapien
agtgagttcgcactctacatcgttc

SEQ ID NO: 47460 - DNA, 25 bp, Homo sapien
ttcgcactctacatcgttcacgagt

SEQ ID NO: 47461 - DNA, 25 bp, Homo sapien
actctacatcgttcacgagtctggg

SEQ ID NO: 47462 - DNA, 25 bp, Homo sapien
gagcggacaaaattaaaagactgcg

SEQ ID NO: 47463 - DNA, 25 bp, Homo sapien
aaagactgcgagtacccgctgattt

SEQ ID NO: 47464 - DNA, 25 bp, Homo sapien
gccatgtgagaagatcgccaggatc

SEQ ID NO: 47465 - DNA, 25 bp, Homo sapien
aagatcgccaggatcttcctgatgg

SEQ ID NO: 47466 - DNA, 25 bp, Homo sapien
ttcctgatggaagctgacttgggcg

SEQ ID NO: 47467 - DNA, 25 bp, Homo sapien
tgacttgggcgtggaagtcccccat

SEQ ID NO: 47468 - DNA, 25 bp, Homo sapien
aagtcccccatgaagtcgctcagta

SEQ ID NO: 47469 - DNA, 25 bp, Homo sapien
cagcttcaagcagaggcctcggggt

SEQ ID NO: 47470 - DNA, 25 bp, Homo sapien
tgtagaaacactaacagctgggaga

SEQ ID NO: 47471 - DNA, 25 bp, Homo sapien
atcagggaggaacctccaatgggtg

SEQ ID NO: 47472 - DNA, 25 bp, Homo sapien
aggaggaagccactgcatctgttgg

SEQ ID NO: 47473 - DNA, 25 bp, Homo sapien
gcatctgttggctcagggccccagc

SEQ ID NO: 47474 - DNA, 25 bp, Homo sapien
cgcctgggctgttgtgtctcctgtc

SEQ ID NO: 47475 - DNA, 25 bp, Homo sapien
ctgttgtgtctcctgtctgtgccga

SEQ ID NO: 47476 - DNA, 25 bp, Homo sapien
gttgtgtctcctgtctgtgccgatc

SEQ ID NO: 47477 - DNA, 25 bp, Homo sapien
tgtctcctgtctgtgccgatctcta

SEQ ID NO: 47478 - DNA, 25 bp, Homo sapien
ctgtctgtgccgatctctattaaag

SEQ ID NO: 47479 - DNA, 25 bp, Homo sapien
gtctgtgccgatctctattaaagga

SEQ ID NO: 47480 - DNA, 25 bp, Homo sapien
ctgtgccgatctctattaaaggact

SEQ ID NO: 47481 - DNA, 25 bp, Homo sapien
gtgccgatctctattaaaggactcc

SEQ ID NO: 47482 - DNA, 25 bp, Homo sapien
gccgatctctattaaaggactccct

SEQ ID NO: 47483 - DNA, 25 bp, Homo sapien
ctctattaaaggactccctcttggt

SEQ ID NO: 47484 - DNA, 25 bp, Homo sapien
ctattaaaggactccctcttggtgg

SEQ ID NO: 47485 - DNA, 25 bp, Homo sapien
tgacatccccactcacgaatattat

SEQ ID NO: 47486 - DNA, 25 bp, Homo sapien
cccactcacgaatattatgcccagt

SEQ ID NO: 47487 - DNA, 25 bp, Homo sapien
cacgaatattatgcccagtttctgc

SEQ ID NO: 47488 - DNA, 25 bp, Homo sapien
gcccagaaaaggacagaaacgaagt

SEQ ID NO: 47489 - DNA, 25 bp, Homo sapien
ctcctttggaagtgaggcattgcac

SEQ ID NO: 47490 - DNA, 25 bp, Homo sapien
ggagacgtacgtatcagcggcccct

SEQ ID NO: 47491 - DNA, 25 bp, Homo sapien
gacgtacgtatcagcggccccttga

SEQ ID NO: 47492 - DNA, 25 bp, Homo sapien
gtatcagcggccccttgactctggg

SEQ ID NO: 47493 - DNA, 25 bp, Homo sapien
gggactccgggtttgagatggacac

SEQ ID NO: 47494 - DNA, 25 bp, Homo sapien
gctcacaataaaaatggctcagatg

SEQ ID NO: 47495 - DNA, 25 bp, Homo sapien
ggctcagatgccacttcaaagaaaa

SEQ ID NO: 47496 - DNA, 25 bp, Homo sapien
caagaaaaagtgatgccgcctggca

SEQ ID NO: 47497 - DNA, 25 bp, Homo sapien
aagtgatgccgcctggcagactcgc

SEQ ID NO: 47498 - DNA, 25 bp, Homo sapien
caacgacacagggcaggacagcaga

SEQ ID NO: 47499 - DNA, 25 bp, Homo sapien
cagaggacgtgctgggattaaacac

SEQ ID NO: 47500 - DNA, 25 bp, Homo sapien
gacgtgctgggattaaacacattcc

SEQ ID NO: 47501 - DNA, 25 bp, Homo sapien
ccctccccagatatggtgacctggg

SEQ ID NO: 47502 - DNA, 25 bp, Homo sapien
gggcattcactctttcagctcagag

SEQ ID NO: 47503 - DNA, 25 bp, Homo sapien
ttcactctttcagctcagagtttct

SEQ ID NO: 47504 - DNA, 25 bp, Homo sapien
ttcagctcagagtttctcttccttt

SEQ ID NO: 47505 - DNA, 25 bp, Homo sapien
ctcttcctttccaatacaggctcta

SEQ ID NO: 47506 - DNA, 25 bp, Homo sapien
tcctttccaatacaggctctacatg

SEQ ID NO: 47507 - DNA, 25 bp, Homo sapien
gcggtgacttctaaaatcatcaggc

SEQ ID NO: 47508 - DNA, 25 bp, Homo sapien
ttctaaaatcatcaggcgggctcct

SEQ ID NO: 47509 - DNA, 25 bp, Homo sapien
atcaggcgggctcctaaaatcctca

SEQ ID NO: 47510 - DNA, 25 bp, Homo sapien
ctaaaatcctcaccaggaggtctaa

SEQ ID NO: 47511 - DNA, 25 bp, Homo sapien
ggaggtctaaaattgtcaggaagtc

SEQ ID NO: 47512 - DNA, 25 bp, Homo sapien
ggagcttccctaaggtcttcctctg

SEQ ID NO: 47513 - DNA, 25 bp, Homo sapien
ccctaaggtcttcctctgggagctg

SEQ ID NO: 47514 - DNA, 25 bp, Homo sapien
gctgcctgaagtcctcatcagaagg

SEQ ID NO: 47515 - DNA, 25 bp, Homo sapien
agtcttcatcaggagggcccctgaa

SEQ ID NO: 47516 - DNA, 25 bp, Homo sapien
aggagggcccctgaagtcttcatct

SEQ ID NO: 47517 - DNA, 25 bp, Homo sapien
gaagtcttcatctggtgggtgcctg

SEQ ID NO: 47518 - DNA, 25 bp, Homo sapien
gagggccacattcggagcctccgtc

SEQ ID NO: 47519 - DNA, 25 bp, Homo sapien
tccgtccactccagttttatcagct

SEQ ID NO: 47520 - DNA, 25 bp, Homo sapien
gctaaacaaattctagctctgtgtt

SEQ ID NO: 47521 - DNA, 25 bp, Homo sapien
tttcccattcccagatttactatca

SEQ ID NO: 47522 - DNA, 25 bp, Homo sapien
tttactatcagttctccttaaaaag

SEQ ID NO: 47523 - DNA, 25 bp, Homo sapien
agctgttacagtagctttcccttca

SEQ ID NO: 47524 - DNA, 25 bp, Homo sapien
tagctttcccttcacttgattctat

SEQ ID NO: 47525 - DNA, 25 bp, Homo sapien
tcccttcacttgattctattgtgtg

SEQ ID NO: 47526 - DNA, 25 bp, Homo sapien
ctattgtgtgttttctatgtttgga

SEQ ID NO: 47527 - DNA, 25 bp, Homo sapien
atctagatattttctcttcaccgca

SEQ ID NO: 47528 - DNA, 25 bp, Homo sapien
attttctcttcaccgcattttgtaa

SEQ ID NO: 47529 - DNA, 25 bp, Homo sapien
ggaatactggagatatttgtacaga

SEQ ID NO: 47530 - DNA, 25 bp, Homo sapien
gcagatttgctgcttgtgccataaa

SEQ ID NO: 47531 - DNA, 25 bp, Homo sapien
cagatttgctgcttgtgccataaaa

SEQ ID NO: 47532 - DNA, 25 bp, Homo sapien
aactaaatacacaaagcatgcctta

SEQ ID NO: 47533 - DNA, 25 bp, Homo sapien
tacacaaagcatgccttaaacccag

SEQ ID NO: 47534 - DNA, 25 bp, Homo sapien
aaagcatgccttaaacccagtgaag

SEQ ID NO: 47535 - DNA, 25 bp, Homo sapien
gcatgccttaaacccagtgaagcaa

SEQ ID NO: 47536 - DNA, 25 bp, Homo sapien
atgccttaaacccagtgaagcaact

SEQ ID NO: 47537 - DNA, 25 bp, Homo sapien
aaacccagtgaagcaactgagtaca

SEQ ID NO: 47538 - DNA, 25 bp, Homo sapien
gaatatctgggctttattgatacca

SEQ ID NO: 47539 - DNA, 25 bp, Homo sapien
atctgggctttattgataccaaaaa

SEQ ID NO: 47540 - DNA, 25 bp, Homo sapien
ggaggaaacagcacaactcacagtt

SEQ ID NO: 47541 - DNA, 25 bp, Homo sapien
agcacaactcacagtttgagctggg

SEQ ID NO: 47542 - DNA, 25 bp, Homo sapien
ccttctcaaaagaggtgcacagcct

SEQ ID NO: 47543 - DNA, 25 bp, Homo sapien
aaagaggtgcacagcctctcgggtg

SEQ ID NO: 47544 - DNA, 25 bp, Homo sapien
acagcctctcgggtgacttggaaac

SEQ ID NO: 47545 - DNA, 25 bp, Homo sapien
ctctcgggtgacttggaaactcctg

SEQ ID NO: 47546 - DNA, 25 bp, Homo sapien
gaaactcctggacaaattccattct

SEQ ID NO: 47547 - DNA, 25 bp, Homo sapien
tgacatgtatacaaaccaactgttt

SEQ ID NO: 47548 - DNA, 25 bp, Homo sapien
aaccaactgtttagagattccactt

SEQ ID NO: 47549 - DNA, 25 bp, Homo sapien
gagattccacttgtgcaaagcccta

SEQ ID NO: 47550 - DNA, 25 bp, Homo sapien
gtgcaaagccctactgtgtttttat

SEQ ID NO: 47551 - DNA, 25 bp, Homo sapien
cacctgctttccctcctatggctcc

SEQ ID NO: 47552 - DNA, 25 bp, Homo sapien
ctatggctcccctggaacaggaggg

SEQ ID NO: 47553 - DNA, 25 bp, Homo sapien
tatggctcccctggaacaggaggga

SEQ ID NO: 47554 - DNA, 25 bp, Homo sapien
ccagcctggacagcgcccgctcctg

SEQ ID NO: 47555 - DNA, 25 bp, Homo sapien
tcctgcctgggtgcacacacggcgg

SEQ ID NO: 47556 - DNA, 25 bp, Homo sapien
tgggtgcacacacggcgggcctgag

SEQ ID NO: 47557 - DNA, 25 bp, Homo sapien
ctgagctccagcatctgagtttggg

SEQ ID NO: 47558 - DNA, 25 bp, Homo sapien
gctccagcatctgagtttgggggta

SEQ ID NO: 47559 - DNA, 25 bp, Homo sapien
tcagagaatttatataaaggcgggc

SEQ ID NO: 47560 - DNA, 25 bp, Homo sapien
agagaatttatataaaggcgggcga

SEQ ID NO: 47561 - DNA, 25 bp, Homo sapien
agaatttatataaaggcgggcgagg

SEQ ID NO: 47562 - DNA, 25 bp, Homo sapien
gccatgattatgtggaagaggtacg

SEQ ID NO: 47563 - DNA, 25 bp, Homo sapien
attatgcgagtgcagctttaatgat

SEQ ID NO: 47564 - DNA, 25 bp, Homo sapien
gcgagtgcagctttaatgatcccaa

SEQ ID NO: 47565 - DNA, 25 bp, Homo sapien
cgagtgcagctttaatgatcccaat

SEQ ID NO: 47566 - DNA, 25 bp, Homo sapien
aatgatcccaatgctaaggagatgc

SEQ ID NO: 47567 - DNA, 25 bp, Homo sapien
gatcccaatgctaaggagatgcact

SEQ ID NO: 47568 - DNA, 25 bp, Homo sapien
cccaatgctaaggagatgcacttaa

SEQ ID NO: 47569 - DNA, 25 bp, Homo sapien
gatgcacttaaaagggcgaagacac

SEQ ID NO: 47570 - DNA, 25 bp, Homo sapien
cttaaaagggcgaagacacagactt

SEQ ID NO: 47571 - DNA, 25 bp, Homo sapien
taaatccagatttgcaagtagaagt

SEQ ID NO: 47572 - DNA, 25 bp, Homo sapien
gatttgcaagtagaagtaaagccta

SEQ ID NO: 47573 - DNA, 25 bp, Homo sapien
gtttatttataaagatctggcctgt

SEQ ID NO: 47574 - DNA, 25 bp, Homo sapien
tttatttataaagatctggcctgtt

SEQ ID NO: 47575 - DNA, 25 bp, Homo sapien
cccaccccctagagtgctctgtgta

SEQ ID NO: 47576 - DNA, 25 bp, Homo sapien
ccaccccctagagtgctctgtgtat

SEQ ID NO: 47577 - DNA, 25 bp, Homo sapien
caccccctagagtgctctgtgtatg

SEQ ID NO: 47578 - DNA, 25 bp, Homo sapien
accccctagagtgctctgtgtatgc

SEQ ID NO: 47579 - DNA, 25 bp, Homo sapien
ccccctagagtgctctgtgtatgcg

SEQ ID NO: 47580 - DNA, 25 bp, Homo sapien
cccctagagtgctctgtgtatgcgg

SEQ ID NO: 47581 - DNA, 25 bp, Homo sapien
ccctagagtgctctgtgtatgcgga

SEQ ID NO: 47582 - DNA, 25 bp, Homo sapien
cctagagtgctctgtgtatgcggat

SEQ ID NO: 47583 - DNA, 25 bp, Homo sapien
ctagagtgctctgtgtatgcggatg

SEQ ID NO: 47584 - DNA, 25 bp, Homo sapien
cgcctccttaccatgaagccagtaa

SEQ ID NO: 47585 - DNA, 25 bp, Homo sapien
gaagccagtaagtcgtcgcacgctg

SEQ ID NO: 47586 - DNA, 25 bp, Homo sapien
tcgcacgctggactggatttattca

SEQ ID NO: 47587 - DNA, 25 bp, Homo sapien
atttattcagtgttgctgcttgcca

SEQ ID NO: 47588 - DNA, 25 bp, Homo sapien
tgcttgccatcgttttaatctcctg

SEQ ID NO: 47589 - DNA, 25 bp, Homo sapien
gggctgcatcatctatgcttcgatg

SEQ ID NO: 47590 - DNA, 25 bp, Homo sapien
tatgcttcgatggtgtctgcaagac

SEQ ID NO: 47591 - DNA, 25 bp, Homo sapien
gatggtgtctgcaagacgacagcta

SEQ ID NO: 47592 - DNA, 25 bp, Homo sapien
tgaaaatttgtaactcttctggatt

SEQ ID NO: 47593 - DNA, 25 bp, Homo sapien
aaaatacagttctttccctcatgct

SEQ ID NO: 47594 - DNA, 25 bp, Homo sapien
gttctttccctcatgcttatgtaga

SEQ ID NO: 47595 - DNA, 25 bp, Homo sapien
tgtggatggtggcaggagtgtccca

SEQ ID NO: 47596 - DNA, 25 bp, Homo sapien
gtggcaggagtgtcccagcaagaaa

SEQ ID NO: 47597 - DNA, 25 bp, Homo sapien
tggcaggagtgtcccagcaagaaag

SEQ ID NO: 47598 - DNA, 25 bp, Homo sapien
tgcctcttttggttgttgttcttaa

SEQ ID NO: 47599 - DNA, 25 bp, Homo sapien
tgttgttcttaatctcctctccatg

SEQ ID NO: 47600 - DNA, 25 bp, Homo sapien
ttgttcttaatctcctctccatgta

SEQ ID NO: 47601 - DNA, 25 bp, Homo sapien
tgttcttaatctcctctccatgtag

SEQ ID NO: 47602 - DNA, 25 bp, Homo sapien
ttcttaatctcctctccatgtagtt

SEQ ID NO: 47603 - DNA, 25 bp, Homo sapien
tcttaatctcctctccatgtagttc

SEQ ID NO: 47604 - DNA, 25 bp, Homo sapien
cttaatctcctctccatgtagttcc

SEQ ID NO: 47605 - DNA, 25 bp, Homo sapien
taatctcctctccatgtagttccca

SEQ ID NO: 47606 - DNA, 25 bp, Homo sapien
tagaactgttctggttgtgtttggc

SEQ ID NO: 47607 - DNA, 25 bp, Homo sapien
agaactgttctggttgtgtttggcg

SEQ ID NO: 47608 - DNA, 25 bp, Homo sapien
actgttctggttgtgtttggcggga

SEQ ID NO: 47609 - DNA, 25 bp, Homo sapien
ataaattttgttcagtccttcttag

SEQ ID NO: 47610 - DNA, 25 bp, Homo sapien
aaattttgttcagtccttcttagtg

SEQ ID NO: 47611 - DNA, 25 bp, Homo sapien
aggaaaggagttctgtgttgctcac

SEQ ID NO: 47612 - DNA, 25 bp, Homo sapien
ggaaaggagttctgtgttgctcaca

SEQ ID NO: 47613 - DNA, 25 bp, Homo sapien
gtgttgctcacatgttaaagcttgc

SEQ ID NO: 47614 - DNA, 25 bp, Homo sapien
gttgctcacatgttaaagcttgctc

SEQ ID NO: 47615 - DNA, 25 bp, Homo sapien
agcagaggaatacctatctacagat

SEQ ID NO: 47616 - DNA, 25 bp, Homo sapien
cagaggaatacctatctacagatat

SEQ ID NO: 47617 - DNA, 25 bp, Homo sapien
tcactcagcacttggtgtggccttc

SEQ ID NO: 47618 - DNA, 25 bp, Homo sapien
cactcagcacttggtgtggccttcc

SEQ ID NO: 47619 - DNA, 25 bp, Homo sapien
actcagcacttggtgtggccttccc

SEQ ID NO: 47620 - DNA, 25 bp, Homo sapien
ctcagcacttggtgtggccttccct

SEQ ID NO: 47621 - DNA, 25 bp, Homo sapien
tcagcacttggtgtggccttccctt

SEQ ID NO: 47622 - DNA, 25 bp, Homo sapien
cagcacttggtgtggccttcccttc

SEQ ID NO: 47623 - DNA, 25 bp, Homo sapien
agcacttggtgtggccttcccttct

SEQ ID NO: 47624 - DNA, 25 bp, Homo sapien
gcacttggtgtggccttcccttcta

SEQ ID NO: 47625 - DNA, 25 bp, Homo sapien
gtgtggccttcccttctacctagcg

SEQ ID NO: 47626 - DNA, 25 bp, Homo sapien
gtatgagaattaggcgcgggcggga

SEQ ID NO: 47627 - DNA, 25 bp, Homo sapien
ggcgcgggcgggagttttgtgggtg

SEQ ID NO: 47628 - DNA, 25 bp, Homo sapien
tttgtgggtgtatgtaccgcgtgat

SEQ ID NO: 47629 - DNA, 25 bp, Homo sapien
ttgtgggtgtatgtaccgcgtgatt

SEQ ID NO: 47630 - DNA, 25 bp, Homo sapien
gtgggtgtatgtaccgcgtgatttc

SEQ ID NO: 47631 - DNA, 25 bp, Homo sapien
tgggtgtatgtaccgcgtgatttcc

SEQ ID NO: 47632 - DNA, 25 bp, Homo sapien
tgtatgtaccgcgtgatttccggcc

SEQ ID NO: 47633 - DNA, 25 bp, Homo sapien
gtatgtaccgcgtgatttccggccg

SEQ ID NO: 47634 - DNA, 25 bp, Homo sapien
tatgtaccgcgtgatttccggccgt

SEQ ID NO: 47635 - DNA, 25 bp, Homo sapien
atgtaccgcgtgatttccggccgtt

SEQ ID NO: 47636 - DNA, 25 bp, Homo sapien
tgtaccgcgtgatttccggccgttt

SEQ ID NO: 47637 - DNA, 25 bp, Homo sapien
ccaagtaagacatctcaaatacagt

SEQ ID NO: 47638 - DNA, 25 bp, Homo sapien
aagacatctcaaatacagtagtata

SEQ ID NO: 47639 - DNA, 25 bp, Homo sapien
ctcttactttttgtaaatgctgtaa

SEQ ID NO: 47640 - DNA, 25 bp, Homo sapien
ataaattaacaaagtgtcactccat

SEQ ID NO: 47641 - DNA, 25 bp, Homo sapien
aaagtgtcactccataaaaagaaag

SEQ ID NO: 47642 - DNA, 25 bp, Homo sapien
actaatagcctaaaagattttgtga

SEQ ID NO: 47643 - DNA, 25 bp, Homo sapien
aatggcaataatgactaaagacctg

SEQ ID NO: 47644 - DNA, 25 bp, Homo sapien
caataatgactaaagacctgctgta

SEQ ID NO: 47645 - DNA, 25 bp, Homo sapien
ataatgactaaagacctgctgtaat

SEQ ID NO: 47646 - DNA, 25 bp, Homo sapien
aatgactaaagacctgctgtaataa

SEQ ID NO: 47647 - DNA, 25 bp, Homo sapien
gactaaagacctgctgtaataaatg

SEQ ID NO: 47648 - DNA, 25 bp, Homo sapien
gaaccttctaatgaaaactccatgc

SEQ ID NO: 47649 - DNA, 25 bp, Homo sapien
tctaatgaaaactccatgcctctgg

SEQ ID NO: 47650 - DNA, 25 bp, Homo sapien
ctaatgaaaactccatgcctctggt

SEQ ID NO: 47651 - DNA, 25 bp, Homo sapien
catgcctctggtccttggactcttg

SEQ ID NO: 47652 - DNA, 25 bp, Homo sapien
tggactcttgtccatggttcctgag

SEQ ID NO: 47653 - DNA, 25 bp, Homo sapien
ggactcttgtccatggttcctgagc

SEQ ID NO: 47654 - DNA, 25 bp, Homo sapien
gactcttgtccatggttcctgagct

SEQ ID NO: 47655 - DNA, 25 bp, Homo sapien
actcttgtccatggttcctgagctg

SEQ ID NO: 47656 - DNA, 25 bp, Homo sapien
tcttgtccatggttcctgagctgtg

SEQ ID NO: 47657 - DNA, 25 bp, Homo sapien
gctgtggaccgggatagaataatgc

SEQ ID NO: 47658 - DNA, 25 bp, Homo sapien
ggaccgggatagaataatgcaaaaa

SEQ ID NO: 47659 - DNA, 25 bp, Homo sapien
ttttttgtgtgctacattcaaggag

SEQ ID NO: 47660 - DNA, 25 bp, Homo sapien
tgtgtgctacattcaaggagatcaa

SEQ ID NO: 47661 - DNA, 25 bp, Homo sapien
gtgctacattcaaggagatcaaaaa

SEQ ID NO: 47662 - DNA, 25 bp, Homo sapien
tcttttgcaaagaaagctttttgtt

SEQ ID NO: 47663 - DNA, 25 bp, Homo sapien
tgcaacgtacttttcccctaccttg

SEQ ID NO: 47664 - DNA, 25 bp, Homo sapien
agcttctcatctatatgaaaaagtt

SEQ ID NO: 47665 - DNA, 25 bp, Homo sapien
gaaaaagttttcgatgtattggaat

SEQ ID NO: 47666 - DNA, 25 bp, Homo sapien
tgggaatgcttttaaaacaatttgt

SEQ ID NO: 47667 - DNA, 25 bp, Homo sapien
aacagaacagaaaggtgtggtgctg

SEQ ID NO: 47668 - DNA, 25 bp, Homo sapien
acagaaaggtgtggtgctggaacat

SEQ ID NO: 47669 - DNA, 25 bp, Homo sapien
cagaaaggtgtggtgctggaacatc

SEQ ID NO: 47670 - DNA, 25 bp, Homo sapien
gcaaacattctaggcgggaaggaca

SEQ ID NO: 47671 - DNA, 25 bp, Homo sapien
tctaggcgggaaggacatgttttac

SEQ ID NO: 47672 - DNA, 25 bp, Homo sapien
ggacatgttttacaccctgggaatg

SEQ ID NO: 47673 - DNA, 25 bp, Homo sapien
aatggcggtgaatggttcgtacaac

SEQ ID NO: 47674 - DNA, 25 bp, Homo sapien
ggtgaatggttcgtacaactccaaa

SEQ ID NO: 47675 - DNA, 25 bp, Homo sapien
atatcgagcctcttgttatttgggt

SEQ ID NO: 47676 - DNA, 25 bp, Homo sapien
tttgggttatgtggaagctatttgc

SEQ ID NO: 47677 - DNA, 25 bp, Homo sapien
agctatttgcatcgtgtaggccttc

SEQ ID NO: 47678 - DNA, 25 bp, Homo sapien
tcgtgtaggccttctgtacgcgaga

SEQ ID NO: 47679 - DNA, 25 bp, Homo sapien
ttctgtacgcgagaggctgcacact

SEQ ID NO: 47680 - DNA, 25 bp, Homo sapien
aggctgcacacttcggaggcgtgaa

SEQ ID NO: 47681 - DNA, 25 bp, Homo sapien
gccaaagcacattcccacagagaaa

SEQ ID NO: 47682 - DNA, 25 bp, Homo sapien
tcaaggctgtggataccacgggtgc

SEQ ID NO: 47683 - DNA, 25 bp, Homo sapien
tttgtgggagctctggccttctacc

SEQ ID NO: 47684 - DNA, 25 bp, Homo sapien
gagctctggccttctacctggctta

SEQ ID NO: 47685 - DNA, 25 bp, Homo sapien
tccttggaagacatgctcaacagat

SEQ ID NO: 47686 - DNA, 25 bp, Homo sapien
tccaatttcattgcagcagtcagtg

SEQ ID NO: 47687 - DNA, 25 bp, Homo sapien
tcattgcagcagtcagtgtccaggc

SEQ ID NO: 47688 - DNA, 25 bp, Homo sapien
cagtcagtgtccaggctgcaggaac

SEQ ID NO: 47689 - DNA, 25 bp, Homo sapien
tgtccaggctgcaggaacacagtca

SEQ ID NO: 47690 - DNA, 25 bp, Homo sapien
ctgcaggaacacagtcatcttaccc

SEQ ID NO: 47691 - DNA, 25 bp, Homo sapien
gcaggaacacagtcatcttaccctt

SEQ ID NO: 47692 - DNA, 25 bp, Homo sapien
aagaccttccgcttactctgttttg

SEQ ID NO: 47693 - DNA, 25 bp, Homo sapien
ccttccgcttactctgttttgattg

SEQ ID NO: 47694 - DNA, 25 bp, Homo sapien
ctgttttgattgctattagtcccaa

SEQ ID NO: 47695 - DNA, 25 bp, Homo sapien
gttttgattgctattagtcccaaaa

SEQ ID NO: 47696 - DNA, 25 bp, Homo sapien
aacgatgattcttttgctttccatg

SEQ ID NO: 47697 - DNA, 25 bp, Homo sapien
gactcacccctcatccgggccccca

SEQ ID NO: 47698 - DNA, 25 bp, Homo sapien
actcacccctcatccgggcccccag

SEQ ID NO: 47699 - DNA, 25 bp, Homo sapien
gccacactgtctccccaggggcgtc

SEQ ID NO: 47700 - DNA, 25 bp, Homo sapien
ccacactgtctccccaggggcgtcg

SEQ ID NO: 47701 - DNA, 25 bp, Homo sapien
cacactgtctccccaggggcgtcga

SEQ ID NO: 47702 - DNA, 25 bp, Homo sapien
acactgtctccccaggggcgtcgac

SEQ ID NO: 47703 - DNA, 25 bp, Homo sapien
cactgtctccccaggggcgtcgacc

SEQ ID NO: 47704 - DNA, 25 bp, Homo sapien
actgtctccccaggggcgtcgacct

SEQ ID NO: 47705 - DNA, 25 bp, Homo sapien
atggaataaaatagccagggccaca

SEQ ID NO: 47706 - DNA, 25 bp, Homo sapien
tggaataaaatagccagggccacac

SEQ ID NO: 47707 - DNA, 25 bp, Homo sapien
gaataaaatagccagggccacactc

SEQ ID NO: 47708 - DNA, 25 bp, Homo sapien
tttgcgcccccgtgtccccagctgc

SEQ ID NO: 47709 - DNA, 25 bp, Homo sapien
gggtcccgaggccattgtctccgaa

SEQ ID NO: 47710 - DNA, 25 bp, Homo sapien
ggtcccgaggccattgtctccgaag

SEQ ID NO: 47711 - DNA, 25 bp, Homo sapien
gtcccgaggccattgtctccgaagc

SEQ ID NO: 47712 - DNA, 25 bp, Homo sapien
tcccgaggccattgtctccgaagcg

SEQ ID NO: 47713 - DNA, 25 bp, Homo sapien
ccgaggccattgtctccgaagcgta

SEQ ID NO: 47714 - DNA, 25 bp, Homo sapien
cgaggccattgtctccgaagcgtat

SEQ ID NO: 47715 - DNA, 25 bp, Homo sapien
gaggccattgtctccgaagcgtatg

SEQ ID NO: 47716 - DNA, 25 bp, Homo sapien
aggccattgtctccgaagcgtatgt

SEQ ID NO: 47717 - DNA, 25 bp, Homo sapien
tgtgccaggtttgagtggcgagggt

SEQ ID NO: 47718 - DNA, 25 bp, Homo sapien
gtgccaggtttgagtggcgagggtg

SEQ ID NO: 47719 - DNA, 25 bp, Homo sapien
tcagtggccacattttggttatcga

SEQ ID NO: 47720 - DNA, 25 bp, Homo sapien
ggccacattttggttatcgatgtac

SEQ ID NO: 47721 - DNA, 25 bp, Homo sapien
gttatcgatgtacctagaagtatgt

SEQ ID NO: 47722 - DNA, 25 bp, Homo sapien
aaattagattaaatttctcttctgg

SEQ ID NO: 47723 - DNA, 25 bp, Homo sapien
gttgctttctatgtatagctcccta

SEQ ID NO: 47724 - DNA, 25 bp, Homo sapien
ttctatgtatagctccctagacctt

SEQ ID NO: 47725 - DNA, 25 bp, Homo sapien
tgtatagctccctagacctttcact

SEQ ID NO: 47726 - DNA, 25 bp, Homo sapien
gaataaggaacgtggatctttttat

SEQ ID NO: 47727 - DNA, 25 bp, Homo sapien
ctttttattttgcaatcctgggcca

SEQ ID NO: 47728 - DNA, 25 bp, Homo sapien
ttattttgcaatcctgggccagcta

SEQ ID NO: 47729 - DNA, 25 bp, Homo sapien
caatcctgggccagctagaagccag

SEQ ID NO: 47730 - DNA, 25 bp, Homo sapien
cttttctttttctgatctcatggca

SEQ ID NO: 47731 - DNA, 25 bp, Homo sapien
cttttatgtattttgtacaggaggc

SEQ ID NO: 47732 - DNA, 25 bp, Homo sapien
gaaactgaacagaattgcatacatt

SEQ ID NO: 47733 - DNA, 25 bp, Homo sapien
attgcatacattgggttgttttttc

SEQ ID NO: 47734 - DNA, 25 bp, Homo sapien
gctgtctgtacattgcttctgctgc

SEQ ID NO: 47735 - DNA, 25 bp, Homo sapien
gcttctgctgctgtgatttctaaac

SEQ ID NO: 47736 - DNA, 25 bp, Homo sapien
ttctgctgctgtgatttctaaacct

SEQ ID NO: 47737 - DNA, 25 bp, Homo sapien
gctgtgatttctaaacctgtgctgt

SEQ ID NO: 47738 - DNA, 25 bp, Homo sapien
gtgatttctaaacctgtgctgttat

SEQ ID NO: 47739 - DNA, 25 bp, Homo sapien
ctgtgctgttattcaactgactttt

SEQ ID NO: 47740 - DNA, 25 bp, Homo sapien
gtgctgttattcaactgactttttt

SEQ ID NO: 47741 - DNA, 25 bp, Homo sapien
tagggccagaattccccagttcccg

SEQ ID NO: 47742 - DNA, 25 bp, Homo sapien
cagttcccgctcctctgagggttga

SEQ ID NO: 47743 - DNA, 25 bp, Homo sapien
cctctgagggttgatactgctggga

SEQ ID NO: 47744 - DNA, 25 bp, Homo sapien
agggttgatactgctgggaatgcca

SEQ ID NO: 47745 - DNA, 25 bp, Homo sapien
gatactgctgggaatgccaaccact

SEQ ID NO: 47746 - DNA, 25 bp, Homo sapien
gctgggaatgccaaccactccacaa

SEQ ID NO: 47747 - DNA, 25 bp, Homo sapien
gggctctctgaaagtccctaacttc

SEQ ID NO: 47748 - DNA, 25 bp, Homo sapien
tctgaaagtccctaacttcctgagg

SEQ ID NO: 47749 - DNA, 25 bp, Homo sapien
gggtacgcaaatactgttctatttc

SEQ ID NO: 47750 - DNA, 25 bp, Homo sapien
acgcaaatactgttctatttcacta

SEQ ID NO: 47751 - DNA, 25 bp, Homo sapien
gttctatttcactatcagaaatgtt

SEQ ID NO: 47752 - DNA, 25 bp, Homo sapien
ctggatttttgctctgcccctgacc

SEQ ID NO: 47753 - DNA, 25 bp, Homo sapien
tggatttttgctctgcccctgaccc

SEQ ID NO: 47754 - DNA, 25 bp, Homo sapien
ggatttttgctctgcccctgacccc

SEQ ID NO: 47755 - DNA, 25 bp, Homo sapien
gatttttgctctgcccctgacccct

SEQ ID NO: 47756 - DNA, 25 bp, Homo sapien
atttttgctctgcccctgacccctt

SEQ ID NO: 47757 - DNA, 25 bp, Homo sapien
gaggggagctatgctaggactccaa

SEQ ID NO: 47758 - DNA, 25 bp, Homo sapien
gcctgcgctagcttcttttgatact

SEQ ID NO: 47759 - DNA, 25 bp, Homo sapien
cctgcgctagcttcttttgatactg

SEQ ID NO: 47760 - DNA, 25 bp, Homo sapien
ctgcgctagcttcttttgatactga

SEQ ID NO: 47761 - DNA, 25 bp, Homo sapien
agcaacgaaacataaaacacacaag

SEQ ID NO: 47762 - DNA, 25 bp, Homo sapien
gaaacataaaacacacaagcgcccc

SEQ ID NO: 47763 - DNA, 25 bp, Homo sapien
aaacataaaacacacaagcgccccg

SEQ ID NO: 47764 - DNA, 25 bp, Homo sapien
aacataaaacacacaagcgccccgt

SEQ ID NO: 47765 - DNA, 25 bp, Homo sapien
acataaaacacacaagcgccccgtg

SEQ ID NO: 47766 - DNA, 25 bp, Homo sapien
ataaaacacacaagcgccccgtgcc

SEQ ID NO: 47767 - DNA, 25 bp, Homo sapien
ttcatcacaaaaggcgtggagactc

SEQ ID NO: 47768 - DNA, 25 bp, Homo sapien
atcacaaaaggcgtggagactcgga

SEQ ID NO: 47769 - DNA, 25 bp, Homo sapien
tcacaaaaggcgtggagactcggag

SEQ ID NO: 47770 - DNA, 25 bp, Homo sapien
acaaaaggcgtggagactcggagac

SEQ ID NO: 47771 - DNA, 25 bp, Homo sapien
tggagactcggagacggacgttttt

SEQ ID NO: 47772 - DNA, 25 bp, Homo sapien
tggactatctgatcttggtcctggc

SEQ ID NO: 47773 - DNA, 25 bp, Homo sapien
gactatctgatcttggtcctggccg

SEQ ID NO: 47774 - DNA, 25 bp, Homo sapien
ctatctgatcttggtcctggccgag

SEQ ID NO: 47775 - DNA, 25 bp, Homo sapien
tctcctgggccaaggatcccttctg

SEQ ID NO: 47776 - DNA, 25 bp, Homo sapien
tgggccaaggatcccttctggcaaa

SEQ ID NO: 47777 - DNA, 25 bp, Homo sapien
caaggatcccttctggcaaagctgc

SEQ ID NO: 47778 - DNA, 25 bp, Homo sapien
aggatcccttctggcaaagctgctg

SEQ ID NO: 47779 - DNA, 25 bp, Homo sapien
gatcccttctggcaaagctgctgct

SEQ ID NO: 47780 - DNA, 25 bp, Homo sapien
ttctggcaaagctgctgctccgccg

SEQ ID NO: 47781 - DNA, 25 bp, Homo sapien
aaagctgctgctccgccgcttggtt

SEQ ID NO: 47782 - DNA, 25 bp, Homo sapien
ttggttccccggcaccagacatcgc

SEQ ID NO: 47783 - DNA, 25 bp, Homo sapien
cctcgccagccactcaccagctgca

SEQ ID NO: 47784 - DNA, 25 bp, Homo sapien
acacccctcccctgggccgctgagg

SEQ ID NO: 47785 - DNA, 25 bp, Homo sapien
tgaggccccgcgcacctgtgcctta

SEQ ID NO: 47786 - DNA, 25 bp, Homo sapien
gaggccccgcgcacctgtgccttaa

SEQ ID NO: 47787 - DNA, 25 bp, Homo sapien
aggccccgcgcacctgtgccttaat

SEQ ID NO: 47788 - DNA, 25 bp, Homo sapien
gcgcacctgtgccttaatcttccct

SEQ ID NO: 47789 - DNA, 25 bp, Homo sapien
gcacctgtgccttaatcttccctcc

SEQ ID NO: 47790 - DNA, 25 bp, Homo sapien
cacctgtgccttaatcttccctccc

SEQ ID NO: 47791 - DNA, 25 bp, Homo sapien
ttattttcgccaaagcacatgtaat

SEQ ID NO: 47792 - DNA, 25 bp, Homo sapien
tattttcgccaaagcacatgtaata

SEQ ID NO: 47793 - DNA, 25 bp, Homo sapien
attttcgccaaagcacatgtaataa

SEQ ID NO: 47794 - DNA, 25 bp, Homo sapien
tggtggtcgtgtagaggtccttctc

SEQ ID NO: 47795 - DNA, 25 bp, Homo sapien
gtccttctcctttcacatggtgcag

SEQ ID NO: 47796 - DNA, 25 bp, Homo sapien
agagagcgaggacctctcctcctcg

SEQ ID NO: 47797 - DNA, 25 bp, Homo sapien
ctcctcctcgttcagttgcacttca

SEQ ID NO: 47798 - DNA, 25 bp, Homo sapien
gttgcacttcagtattttcacggat

SEQ ID NO: 47799 - DNA, 25 bp, Homo sapien
ggctttaacaactgtaatacaacct

SEQ ID NO: 47800 - DNA, 25 bp, Homo sapien
gctttaacaactgtaatacaacctt

SEQ ID NO: 47801 - DNA, 25 bp, Homo sapien
caactgtaatacaaccttttgaatt

SEQ ID NO: 47802 - DNA, 25 bp, Homo sapien
ccttttgaattagttccgtgtatag

SEQ ID NO: 47803 - DNA, 25 bp, Homo sapien
ttagttccgtgtatagataattaaa

SEQ ID NO: 47804 - DNA, 25 bp, Homo sapien
tagataattaaattcttcatacaaa

SEQ ID NO: 47805 - DNA, 25 bp, Homo sapien
tgttgtctgccttggccgaaagatg

SEQ ID NO: 47806 - DNA, 25 bp, Homo sapien
gttgtctgccttggccgaaagatga

SEQ ID NO: 47807 - DNA, 25 bp, Homo sapien
tctgccttggccgaaagatgaaaaa

SEQ ID NO: 47808 - DNA, 25 bp, Homo sapien
ctgccttggccgaaagatgaaaaaa

SEQ ID NO: 47809 - DNA, 25 bp, Homo sapien
tgccttggccgaaagatgaaaaaaa

SEQ ID NO: 47810 - DNA, 25 bp, Homo sapien
ccccagctggttgagagcaccctgc

SEQ ID NO: 47811 - DNA, 25 bp, Homo sapien
attcaccggggatctcctgggctgg

SEQ ID NO: 47812 - DNA, 25 bp, Homo sapien
cctgggctgggctctccttggaagt

SEQ ID NO: 47813 - DNA, 25 bp, Homo sapien
gggctctccttggaagtgaggcctt

SEQ ID NO: 47814 - DNA, 25 bp, Homo sapien
ctctccttggaagtgaggcctttta

SEQ ID NO: 47815 - DNA, 25 bp, Homo sapien
tccttggaagtgaggccttttatta

SEQ ID NO: 47816 - DNA, 25 bp, Homo sapien
aatcgatgctgctttgggaactgaa

SEQ ID NO: 47817 - DNA, 25 bp, Homo sapien
atcgatgctgctttgggaactgaag

SEQ ID NO: 47818 - DNA, 25 bp, Homo sapien
tcgatgctgctttgggaactgaagg

SEQ ID NO: 47819 - DNA, 25 bp, Homo sapien
gttatgagtagctgctaccctggaa

SEQ ID NO: 47820 - DNA, 25 bp, Homo sapien
ttatgagtagctgctaccctggaac

SEQ ID NO: 47821 - DNA, 25 bp, Homo sapien
tatgagtagctgctaccctggaacg

SEQ ID NO: 47822 - DNA, 25 bp, Homo sapien
tgagtagctgctaccctggaacggt

SEQ ID NO: 47823 - DNA, 25 bp, Homo sapien
tagctgctaccctggaacggtgggc

SEQ ID NO: 47824 - DNA, 25 bp, Homo sapien
ctgctaccctggaacggtgggcaga

SEQ ID NO: 47825 - DNA, 25 bp, Homo sapien
gggcagagagcctactaggaaatgt

SEQ ID NO: 47826 - DNA, 25 bp, Homo sapien
ggcagagagcctactaggaaatgtg

SEQ ID NO: 47827 - DNA, 25 bp, Homo sapien
cagagagcctactaggaaatgtgca

SEQ ID NO: 47828 - DNA, 25 bp, Homo sapien
gagcctactaggaaatgtgcagaat

SEQ ID NO: 47829 - DNA, 25 bp, Homo sapien
gaagaatcgatgctgctttgggaac

SEQ ID NO: 47830 - DNA, 25 bp, Homo sapien
agaatcgatgctgctttgggaactg

SEQ ID NO: 47831 - DNA, 25 bp, Homo sapien
gaatcgatgctgctttgggaactga

SEQ ID NO: 47832 - DNA, 25 bp, Homo sapien
ttaagtgtgaaacaacccagggcca

SEQ ID NO: 47833 - DNA, 25 bp, Homo sapien
gacaccccggggtgagtttctctgg

SEQ ID NO: 47834 - DNA, 25 bp, Homo sapien
tctctggggctttattttcgttttg

SEQ ID NO: 47835 - DNA, 25 bp, Homo sapien
tttttctccacgctggggctgcgga

SEQ ID NO: 47836 - DNA, 25 bp, Homo sapien
ttttctccacgctggggctgcggag

SEQ ID NO: 47837 - DNA, 25 bp, Homo sapien
tttacagtcccgcaccctcgcactg

SEQ ID NO: 47838 - DNA, 25 bp, Homo sapien
gtcccgcaccctcgcactgcactgt

SEQ ID NO: 47839 - DNA, 25 bp, Homo sapien
ccctattttcggtgatttttgtgtg

SEQ ID NO: 47840 - DNA, 25 bp, Homo sapien
cctattttcggtgatttttgtgtga

SEQ ID NO: 47841 - DNA, 25 bp, Homo sapien
ctattttcggtgatttttgtgtgag

SEQ ID NO: 47842 - DNA, 25 bp, Homo sapien
tattttcggtgatttttgtgtgaga

SEQ ID NO: 47843 - DNA, 25 bp, Homo sapien
cccgccacggtatcctctggcccct

SEQ ID NO: 47844 - DNA, 25 bp, Homo sapien
ccacggtatcctctggcccctccct

SEQ ID NO: 47845 - DNA, 25 bp, Homo sapien
cggctcgttccagccctcccagtga

SEQ ID NO: 47846 - DNA, 25 bp, Homo sapien
ggctcgttccagccctcccagtgag

SEQ ID NO: 47847 - DNA, 25 bp, Homo sapien
ctcgttccagccctcccagtgagct

SEQ ID NO: 47848 - DNA, 25 bp, Homo sapien
tcgttccagccctcccagtgagctc

SEQ ID NO: 47849 - DNA, 25 bp, Homo sapien
cgttccagccctcccagtgagctct

SEQ ID NO: 47850 - DNA, 25 bp, Homo sapien
ttccagccctcccagtgagctctgc

SEQ ID NO: 47851 - DNA, 25 bp, Homo sapien
tccagccctcccagtgagctctgca

SEQ ID NO: 47852 - DNA, 25 bp, Homo sapien
ccagccctcccagtgagctctgcac

SEQ ID NO: 47853 - DNA, 25 bp, Homo sapien
agtgagctctgcacggccgggccgg

SEQ ID NO: 47854 - DNA, 25 bp, Homo sapien
catgcttctagggagcgcctctttt

SEQ ID NO: 47855 - DNA, 25 bp, Homo sapien
atgcttctagggagcgcctcttttc

SEQ ID NO: 47856 - DNA, 25 bp, Homo sapien
tctagggagcgcctcttttccgttc

SEQ ID NO: 47857 - DNA, 25 bp, Homo sapien
tagggagcgcctcttttccgttctt

SEQ ID NO: 47858 - DNA, 25 bp, Homo sapien
ggagcgcctcttttccgttcttgag

SEQ ID NO: 47859 - DNA, 25 bp, Homo sapien
agcgcctcttttccgttcttgagga

SEQ ID NO: 47860 - DNA, 25 bp, Homo sapien
gcctcttttccgttcttgaggaatt

SEQ ID NO: 47861 - DNA, 25 bp, Homo sapien
tcttttccgttcttgaggaatttct

SEQ ID NO: 47862 - DNA, 25 bp, Homo sapien
tttccgttcttgaggaatttctgtt

SEQ ID NO: 47863 - DNA, 25 bp, Homo sapien
tctggggcttgtccttcctttgcag

SEQ ID NO: 47864 - DNA, 25 bp, Homo sapien
tccttttctatttatttgcacatta

SEQ ID NO: 47865 - DNA, 25 bp, Homo sapien
cacagcagaacccgtgggcgctcgt

SEQ ID NO: 47866 - DNA, 25 bp, Homo sapien
ggtgccgcatacaggaggtgcttaa

SEQ ID NO: 47867 - DNA, 25 bp, Homo sapien
gtgccgcatacaggaggtgcttaat

SEQ ID NO: 47868 - DNA, 25 bp, Homo sapien
tgccgcatacaggaggtgcttaata

SEQ ID NO: 47869 - DNA, 25 bp, Homo sapien
gccgcatacaggaggtgcttaataa

SEQ ID NO: 47870 - DNA, 25 bp, Homo sapien
ccgcatacaggaggtgcttaataaa

SEQ ID NO: 47871 - DNA, 25 bp, Homo sapien
cgcatacaggaggtgcttaataaac

SEQ ID NO: 47872 - DNA, 25 bp, Homo sapien
gcatacaggaggtgcttaataaacg

SEQ ID NO: 47873 - DNA, 25 bp, Homo sapien
tcagcgggccggagctgatcgctct

SEQ ID NO: 47874 - DNA, 25 bp, Homo sapien
gggccggagctgatcgctctcactg

SEQ ID NO: 47875 - DNA, 25 bp, Homo sapien
ggagctgatcgctctcactggcctg

SEQ ID NO: 47876 - DNA, 25 bp, Homo sapien
gctctcactggcctgctgcagatga

SEQ ID NO: 47877 - DNA, 25 bp, Homo sapien
tctcactggcctgctgcagatgagc

SEQ ID NO: 47878 - DNA, 25 bp, Homo sapien
agaccccagacacccattgtccata

SEQ ID NO: 47879 - DNA, 25 bp, Homo sapien
attgtccatagccttctcagggcag

SEQ ID NO: 47880 - DNA, 25 bp, Homo sapien
gtccatagccttctcagggcagagt

SEQ ID NO: 47881 - DNA, 25 bp, Homo sapien
atagccttctcagggcagagtgggc

SEQ ID NO: 47882 - DNA, 25 bp, Homo sapien
agtgggctggttgtgttgacaataa

SEQ ID NO: 47883 - DNA, 25 bp, Homo sapien
gttgacaataaaacagtgttggttt

SEQ ID NO: 47884 - DNA, 25 bp, Homo sapien
gggaaattcatatcccctgttcgtc

SEQ ID NO: 47885 - DNA, 25 bp, Homo sapien
ggaaattcatatcccctgttcgtct

SEQ ID NO: 47886 - DNA, 25 bp, Homo sapien
aattcatatcccctgttcgtctcat

SEQ ID NO: 47887 - DNA, 25 bp, Homo sapien
atatcccctgttcgtctcatgcgcg

SEQ ID NO: 47888 - DNA, 25 bp, Homo sapien
ctccgtccccaatctaaaaagcaat

SEQ ID NO: 47889 - DNA, 25 bp, Homo sapien
cgtccccaatctaaaaagcaattga

SEQ ID NO: 47890 - DNA, 25 bp, Homo sapien
aagcaattgaaaaggtctatgcaat

SEQ ID NO: 47891 - DNA, 25 bp, Homo sapien
atgcaataaaggcagtcgcttcatt

SEQ ID NO: 47892 - DNA, 25 bp, Homo sapien
aataaaggcagtcgcttcattcctc

SEQ ID NO: 47893 - DNA, 25 bp, Homo sapien
taaaggcagtcgcttcattcctctc

SEQ ID NO: 47894 - DNA, 25 bp, Homo sapien
aaggcagtcgcttcattcctctcaa

SEQ ID NO: 47895 - DNA, 25 bp, Homo sapien
agtcttcccaaggattgagttatgg

SEQ ID NO: 47896 - DNA, 25 bp, Homo sapien
attgagttatggactttgggagtga

SEQ ID NO: 47897 - DNA, 25 bp, Homo sapien
gggagtgagacatcttcttgctgct

SEQ ID NO: 47898 - DNA, 25 bp, Homo sapien
ttcttgctgctggatttccaagctg

SEQ ID NO: 47899 - DNA, 25 bp, Homo sapien
tttccaagctgagaggacgtgaacc

SEQ ID NO: 47900 - DNA, 25 bp, Homo sapien
ggagccaagggattgacaaacaaca

SEQ ID NO: 47901 - DNA, 25 bp, Homo sapien
gtggagtctctgaatcagccttgtc

SEQ ID NO: 47902 - DNA, 25 bp, Homo sapien
gaatcagccttgtctggaaccagat

SEQ ID NO: 47903 - DNA, 25 bp, Homo sapien
tggactgcccaggtctataagccaa

SEQ ID NO: 47904 - DNA, 25 bp, Homo sapien
actgcccaggtctataagccaataa

SEQ ID NO: 47905 - DNA, 25 bp, Homo sapien
aggtctataagccaataaagcccct

SEQ ID NO: 47906 - DNA, 25 bp, Homo sapien
gggcttggctccaccactttcctcc

SEQ ID NO: 47907 - DNA, 25 bp, Homo sapien
cccagcctttgggcagcaggtcacc

SEQ ID NO: 47908 - DNA, 25 bp, Homo sapien
aggtcacccctgttcaggctctgag

SEQ ID NO: 47909 - DNA, 25 bp, Homo sapien
ggtcacccctgttcaggctctgagg

SEQ ID NO: 47910 - DNA, 25 bp, Homo sapien
gtcacccctgttcaggctctgaggg

SEQ ID NO: 47911 - DNA, 25 bp, Homo sapien
tcacccctgttcaggctctgagggt

SEQ ID NO: 47912 - DNA, 25 bp, Homo sapien
cacccctgttcaggctctgagggtg

SEQ ID NO: 47913 - DNA, 25 bp, Homo sapien
cccctgttcaggctctgagggtgcc

SEQ ID NO: 47914 - DNA, 25 bp, Homo sapien
cctgttcaggctctgagggtgcccc

SEQ ID NO: 47915 - DNA, 25 bp, Homo sapien
tgttcaggctctgagggtgccccct

SEQ ID NO: 47916 - DNA, 25 bp, Homo sapien
aggctctgagggtgccccctcctgg

SEQ ID NO: 47917 - DNA, 25 bp, Homo sapien
cagcctgggacaaggctccgagggt

SEQ ID NO: 47918 - DNA, 25 bp, Homo sapien
gacaaggctccgagggtcggctggc

SEQ ID NO: 47919 - DNA, 25 bp, Homo sapien
gtcggctggccggagctatttttac

SEQ ID NO: 47920 - DNA, 25 bp, Homo sapien
ggctggccggagctatttttacctc

SEQ ID NO: 47921 - DNA, 25 bp, Homo sapien
tggccggagctatttttacctcccg

SEQ ID NO: 47922 - DNA, 25 bp, Homo sapien
gtcttgctgcagagtctgacactgg

SEQ ID NO: 47923 - DNA, 25 bp, Homo sapien
gctgcagagtctgacactggattcc

SEQ ID NO: 47924 - DNA, 25 bp, Homo sapien
tgcagagtctgacactggattcccc

SEQ ID NO: 47925 - DNA, 25 bp, Homo sapien
accccatcatctgtggacactggag

SEQ ID NO: 47926 - DNA, 25 bp, Homo sapien
ccatcatctgtggacactggagtct

SEQ ID NO: 47927 - DNA, 25 bp, Homo sapien
atcatctgtggacactggagtctgg

SEQ ID NO: 47928 - DNA, 25 bp, Homo sapien
tttgagttccactaacacttcaaaa

SEQ ID NO: 47929 - DNA, 25 bp, Homo sapien
cactaacacttcaaaatcagaacta

SEQ ID NO: 47930 - DNA, 25 bp, Homo sapien
atgttctttatatctaacttaaatc

SEQ ID NO: 47931 - DNA, 25 bp, Homo sapien
tatatctaacttaaatcatttcctg

SEQ ID NO: 47932 - DNA, 25 bp, Homo sapien
atatctaacttaaatcatttcctga

SEQ ID NO: 47933 - DNA, 25 bp, Homo sapien
atctaacttaaatcatttcctgaaa

SEQ ID NO: 47934 - DNA, 25 bp, Homo sapien
tctaacttaaatcatttcctgaaac

SEQ ID NO: 47935 - DNA, 25 bp, Homo sapien
taacttaaatcatttcctgaaacat

SEQ ID NO: 47936 - DNA, 25 bp, Homo sapien
cctgaaacattttgacatgattcct

SEQ ID NO: 47937 - DNA, 25 bp, Homo sapien
ctgaaacattttgacatgattcctt

SEQ ID NO: 47938 - DNA, 25 bp, Homo sapien
tttccttttaaacaatgtatgaaag

SEQ ID NO: 47939 - DNA, 25 bp, Homo sapien
aaagattccacaaccaagatctgta

SEQ ID NO: 47940 - DNA, 25 bp, Homo sapien
aagattccacaaccaagatctgtac

SEQ ID NO: 47941 - DNA, 25 bp, Homo sapien
agattccacaaccaagatctgtaca

SEQ ID NO: 47942 - DNA, 25 bp, Homo sapien
gattccacaaccaagatctgtacaa

SEQ ID NO: 47943 - DNA, 25 bp, Homo sapien
attccacaaccaagatctgtacaaa

SEQ ID NO: 47944 - DNA, 25 bp, Homo sapien
tccacaaccaagatctgtacaaact

SEQ ID NO: 47945 - DNA, 25 bp, Homo sapien
cacaaccaagatctgtacaaactta

SEQ ID NO: 47946 - DNA, 25 bp, Homo sapien
acaaccaagatctgtacaaacttaa

SEQ ID NO: 47947 - DNA, 25 bp, Homo sapien
aaccaagatctgtacaaacttaaat

SEQ ID NO: 47948 - DNA, 25 bp, Homo sapien
ccaagatctgtacaaacttaaatac

SEQ ID NO: 47949 - DNA, 25 bp, Homo sapien
tgtacaaacttaaatacaattccct

SEQ ID NO: 47950 - DNA, 25 bp, Homo sapien
ggagctctggatgtacatacataag

SEQ ID NO: 47951 - DNA, 25 bp, Homo sapien
catacataagtaggagcagtgggac

SEQ ID NO: 47952 - DNA, 25 bp, Homo sapien
gcagtgggacgtgtttctgtcataa

SEQ ID NO: 47953 - DNA, 25 bp, Homo sapien
cgtgtttctgtcataatgcaggcat

SEQ ID NO: 47954 - DNA, 25 bp, Homo sapien
gaagtcaggtcataagtttcatgtt

SEQ ID NO: 47955 - DNA, 25 bp, Homo sapien
gtatgtagcagatgttacagtctta

SEQ ID NO: 47956 - DNA, 25 bp, Homo sapien
gatgttacagtcttagggatccggg

SEQ ID NO: 47957 - DNA, 25 bp, Homo sapien
tccgggatgggagaccccactttag

SEQ ID NO: 47958 - DNA, 25 bp, Homo sapien
gatgggagaccccactttagaaagg

SEQ ID NO: 47959 - DNA, 25 bp, Homo sapien
tagaaagggtcgtcactcctttaat

SEQ ID NO: 47960 - DNA, 25 bp, Homo sapien
ctctactcaacaatgtactctttta

SEQ ID NO: 47961 - DNA, 25 bp, Homo sapien
actttgtttacagttatcagtagtt

SEQ ID NO: 47962 - DNA, 25 bp, Homo sapien
tacagttatcagtagtttaaatatt

SEQ ID NO: 47963 - DNA, 25 bp, Homo sapien
gatgtttgtctaagggtttgagccc

SEQ ID NO: 47964 - DNA, 25 bp, Homo sapien
gtctaagggtttgagccctagacaa

SEQ ID NO: 47965 - DNA, 25 bp, Homo sapien
gggtttgagccctagacaaatcagt

SEQ ID NO: 47966 - DNA, 25 bp, Homo sapien
gtttgagccctagacaaatcagtat

SEQ ID NO: 47967 - DNA, 25 bp, Homo sapien
gagccctagacaaatcagtatgatc

SEQ ID NO: 47968 - DNA, 25 bp, Homo sapien
gccctagacaaatcagtatgatcat

SEQ ID NO: 47969 - DNA, 25 bp, Homo sapien
atgatcattacttttcacaggttaa

SEQ ID NO: 47970 - DNA, 25 bp, Homo sapien
attacttttcacaggttaatggaat

SEQ ID NO: 47971 - DNA, 25 bp, Homo sapien
acttttcacaggttaatggaattat

SEQ ID NO: 47972 - DNA, 25 bp, Homo sapien
acaatggggaagaagtctgcctatg

SEQ ID NO: 47973 - DNA, 25 bp, Homo sapien
agtctgcctatgatctttgaatgag

SEQ ID NO: 47974 - DNA, 25 bp, Homo sapien
gtctgcctatgatctttgaatgagc

SEQ ID NO: 47975 - DNA, 25 bp, Homo sapien
tctgcctatgatctttgaatgagct

SEQ ID NO: 47976 - DNA, 25 bp, Homo sapien
ctgcctatgatctttgaatgagctt

SEQ ID NO: 47977 - DNA, 25 bp, Homo sapien
tgcctatgatctttgaatgagcttt

SEQ ID NO: 47978 - DNA, 25 bp, Homo sapien
gcctatgatctttgaatgagctttt

SEQ ID NO: 47979 - DNA, 25 bp, Homo sapien
cctatgatctttgaatgagcttttt

SEQ ID NO: 47980 - DNA, 25 bp, Homo sapien
tatgatctttgaatgagctttttaa

SEQ ID NO: 47981 - DNA, 25 bp, Homo sapien
gatctttgaatgagctttttaagga

SEQ ID NO: 47982 - DNA, 25 bp, Homo sapien
tctttgaatgagctttttaaggaag

SEQ ID NO: 47983 - DNA, 25 bp, Homo sapien
gtatttgtacttgagaccacctcac

SEQ ID NO: 47984 - DNA, 25 bp, Homo sapien
tatttgtacttgagaccacctcaca

SEQ ID NO: 47985 - DNA, 25 bp, Homo sapien
accacctcacacaatctgtatgggc

SEQ ID NO: 47986 - DNA, 25 bp, Homo sapien
acctcacacaatctgtatgggccca

SEQ ID NO: 47987 - DNA, 25 bp, Homo sapien
cctcacacaatctgtatgggcccaa

SEQ ID NO: 47988 - DNA, 25 bp, Homo sapien
tcacacaatctgtatgggcccaacc

SEQ ID NO: 47989 - DNA, 25 bp, Homo sapien
acacaatctgtatgggcccaaccct

SEQ ID NO: 47990 - DNA, 25 bp, Homo sapien
tgggcccaaccctgatctcaaacct

SEQ ID NO: 47991 - DNA, 25 bp, Homo sapien
tgatctcaaacctccttccctctgc

SEQ ID NO: 47992 - DNA, 25 bp, Homo sapien
acgcgaggggcctgtatcttgaatt

SEQ ID NO: 47993 - DNA, 25 bp, Homo sapien
cgaggggcctgtatcttgaattaaa

SEQ ID NO: 47994 - DNA, 25 bp, Homo sapien
gcaagcacgtttccagttctaaaat

SEQ ID NO: 47995 - DNA, 25 bp, Homo sapien
gacacgcacttccatctttattagt

SEQ ID NO: 47996 - DNA, 25 bp, Homo sapien
tttattagtgaaagcccattggagc

SEQ ID NO: 47997 - DNA, 25 bp, Homo sapien
aaagcccattggagcttgctacagg

SEQ ID NO: 47998 - DNA, 25 bp, Homo sapien
ttcctgtgcttcttggcctggactt

SEQ ID NO: 47999 - DNA, 25 bp, Homo sapien
tggcctggactttgtagtggctcca

SEQ ID NO: 48000 - DNA, 25 bp, Homo sapien
ggttcttccctgtaaaaatcactct

SEQ ID NO: 48001 - DNA, 25 bp, Homo sapien
taaaaatcactctaccactctgtac

SEQ ID NO: 48002 - DNA, 25 bp, Homo sapien
actctaccactctgtacctgagttt

SEQ ID NO: 48003 - DNA, 25 bp, Homo sapien
tgtacctgagtttcctctaccataa

SEQ ID NO: 48004 - DNA, 25 bp, Homo sapien
aggtgaccagcaagcacgtttccag

SEQ ID NO: 48005 - DNA, 25 bp, Homo sapien
tggtggagccggtcagacccaacag

SEQ ID NO: 48006 - DNA, 25 bp, Homo sapien
gagccggtcagacccaacagtcttg

SEQ ID NO: 48007 - DNA, 25 bp, Homo sapien
gtcagacccaacagtcttgggtgga

SEQ ID NO: 48008 - DNA, 25 bp, Homo sapien
acagtcttgggtggaagtcctggac

SEQ ID NO: 48009 - DNA, 25 bp, Homo sapien
ggaagtcctggacgtagcgggccat

SEQ ID NO: 48010 - DNA, 25 bp, Homo sapien
acgtagcgggccatggcttcaacgt

SEQ ID NO: 48011 - DNA, 25 bp, Homo sapien
agcgggccatggcttcaacgtcgtc

SEQ ID NO: 48012 - DNA, 25 bp, Homo sapien
atggcttcaacgtcgtcccgctcgg

SEQ ID NO: 48013 - DNA, 25 bp, Homo sapien
cgctcggggtccacagtgatgaaga

SEQ ID NO: 48014 - DNA, 25 bp, Homo sapien
tgcactggaggcaaaccaggctctg

SEQ ID NO: 48015 - DNA, 25 bp, Homo sapien
tggaggcaaaccaggctctgcttcc

SEQ ID NO: 48016 - DNA, 25 bp, Homo sapien
ctatcgtcgcacagaagcctagaac

SEQ ID NO: 48017 - DNA, 25 bp, Homo sapien
tatcgtcgcacagaagcctagaaca

SEQ ID NO: 48018 - DNA, 25 bp, Homo sapien
atcgtcgcacagaagcctagaacaa

SEQ ID NO: 48019 - DNA, 25 bp, Homo sapien
cgtcgcacagaagcctagaacaaaa

SEQ ID NO: 48020 - DNA, 25 bp, Homo sapien
tcgcacagaagcctagaacaaaaat

SEQ ID NO: 48021 - DNA, 25 bp, Homo sapien
gcacagaagcctagaacaaaaatat

SEQ ID NO: 48022 - DNA, 25 bp, Homo sapien
gaaatatctgacatttgtaaagaaa

SEQ ID NO: 48023 - DNA, 25 bp, Homo sapien
gaacagaaaacattcactactttag

SEQ ID NO: 48024 - DNA, 25 bp, Homo sapien
gaaaacattcactactttagaaaca

SEQ ID NO: 48025 - DNA, 25 bp, Homo sapien
ctttagaaacactttatgcatggct

SEQ ID NO: 48026 - DNA, 25 bp, Homo sapien
gatggccctaataaagcagattatt

SEQ ID NO: 48027 - DNA, 25 bp, Homo sapien
ggacagacctggtgtcaccagtttt

SEQ ID NO: 48028 - DNA, 25 bp, Homo sapien
acagacctggtgtcaccagtttttc

SEQ ID NO: 48029 - DNA, 25 bp, Homo sapien
tttcctagcatcagtccgaaccatg

SEQ ID NO: 48030 - DNA, 25 bp, Homo sapien
tcctagcatcagtccgaaccatgcg

SEQ ID NO: 48031 - DNA, 25 bp, Homo sapien
ctgccccaactgtgtgctggtcctg

SEQ ID NO: 48032 - DNA, 25 bp, Homo sapien
gtgtgtttggctctttatgcccctc

SEQ ID NO: 48033 - DNA, 25 bp, Homo sapien
ctcccgctgtggtcctggaactctt

SEQ ID NO: 48034 - DNA, 25 bp, Homo sapien
gtcctggaactcttcaccagggagg

SEQ ID NO: 48035 - DNA, 25 bp, Homo sapien
ctggaactcttcaccagggagggag

SEQ ID NO: 48036 - DNA, 25 bp, Homo sapien
cctttcttgcgtctccctgtgatgg

SEQ ID NO: 48037 - DNA, 25 bp, Homo sapien
tctccctgtgatgggcccttaggcc

SEQ ID NO: 48038 - DNA, 25 bp, Homo sapien
ccctcggaggcagaggaaggaaaat

SEQ ID NO: 48039 - DNA, 25 bp, Homo sapien
agcccctttgccatagcctgatttt

SEQ ID NO: 48040 - DNA, 25 bp, Homo sapien
aaagcttatggctgggtctggtttc

SEQ ID NO: 48041 - DNA, 25 bp, Homo sapien
actgttccagggtggccccagggca

SEQ ID NO: 48042 - DNA, 25 bp, Homo sapien
ctgccccacaggaatagaatggagg

SEQ ID NO: 48043 - DNA, 25 bp, Homo sapien
gactggatttttgctctgcccctga

SEQ ID NO: 48044 - DNA, 25 bp, Homo sapien
gagctatgctaggactccaacctca

SEQ ID NO: 48045 - DNA, 25 bp, Homo sapien
gctatgctaggactccaacctcagg

SEQ ID NO: 48046 - DNA, 25 bp, Homo sapien
ctaggactccaacctcagggactcg

SEQ ID NO: 48047 - DNA, 25 bp, Homo sapien
aggactccaacctcagggactcggg

SEQ ID NO: 48048 - DNA, 25 bp, Homo sapien
gactccaacctcagggactcgggtg

SEQ ID NO: 48049 - DNA, 25 bp, Homo sapien
actcgggtggcctgcgctagcttct

SEQ ID NO: 48050 - DNA, 25 bp, Homo sapien
gtggcctgcgctagcttcttttgat

SEQ ID NO: 48051 - DNA, 25 bp, Homo sapien
cctgcgctagcttcttttgatactg

SEQ ID NO: 48052 - DNA, 25 bp, Homo sapien
tgcgctagcttcttttgatactgaa

SEQ ID NO: 48053 - DNA, 25 bp, Homo sapien
cgctagcttcttttgatactgaaaa

SEQ ID NO: 48054 - DNA, 25 bp, Homo sapien
tagttgtctgtgcttccttggttca

SEQ ID NO: 48055 - DNA, 25 bp, Homo sapien
agttgtctgtgcttccttggttcat

SEQ ID NO: 48056 - DNA, 25 bp, Homo sapien
ttgtctgtgcttccttggttcatgc

SEQ ID NO: 48057 - DNA, 25 bp, Homo sapien
gtctgtgcttccttggttcatgctt

SEQ ID NO: 48058 - DNA, 25 bp, Homo sapien
tgtgcttccttggttcatgcttcta

SEQ ID NO: 48059 - DNA, 25 bp, Homo sapien
tgcttccttggttcatgcttctact

SEQ ID NO: 48060 - DNA, 25 bp, Homo sapien
cttccttggttcatgcttctactgt

SEQ ID NO: 48061 - DNA, 25 bp, Homo sapien
tccttggttcatgcttctactgtga

SEQ ID NO: 48062 - DNA, 25 bp, Homo sapien
cttggttcatgcttctactgtgaca

SEQ ID NO: 48063 - DNA, 25 bp, Homo sapien
ttggttcatgcttctactgtgacac

SEQ ID NO: 48064 - DNA, 25 bp, Homo sapien
tggttcatgcttctactgtgacact

SEQ ID NO: 48065 - DNA, 25 bp, Homo sapien
tatgcacactggaggcaagatgaga

SEQ ID NO: 48066 - DNA, 25 bp, Homo sapien
agatgagaattcctgacagattgtc

SEQ ID NO: 48067 - DNA, 25 bp, Homo sapien
ctgacagattgtccttcctgagaag

SEQ ID NO: 48068 - DNA, 25 bp, Homo sapien
acagattgtccttcctgagaagaca

SEQ ID NO: 48069 - DNA, 25 bp, Homo sapien
tccttcctgagaagacagccctctg

SEQ ID NO: 48070 - DNA, 25 bp, Homo sapien
ttcctgagaagacagccctctgcct

SEQ ID NO: 48071 - DNA, 25 bp, Homo sapien
tcctgagaagacagccctctgcctt

SEQ ID NO: 48072 - DNA, 25 bp, Homo sapien
agaagacagccctctgccttggagc

SEQ ID NO: 48073 - DNA, 25 bp, Homo sapien
gaagacagccctctgccttggagct

SEQ ID NO: 48074 - DNA, 25 bp, Homo sapien
agccctctgccttggagctccagag

SEQ ID NO: 48075 - DNA, 25 bp, Homo sapien
gccctctgccttggagctccagaga

SEQ ID NO: 48076 - DNA, 25 bp, Homo sapien
agctccagagagagggagccctgta

SEQ ID NO: 48077 - DNA, 25 bp, Homo sapien
gagagggagccctgtattcttggct

SEQ ID NO: 48078 - DNA, 25 bp, Homo sapien
ggagccctgtattcttggctgtacc

SEQ ID NO: 48079 - DNA, 25 bp, Homo sapien
gccctgtattcttggctgtacccgt

SEQ ID NO: 48080 - DNA, 25 bp, Homo sapien
tgtattcttggctgtacccgtcgaa

SEQ ID NO: 48081 - DNA, 25 bp, Homo sapien
aaagaaaaaatgcaacctgtcaatt

SEQ ID NO: 48082 - DNA, 25 bp, Homo sapien
gaaaaaatgcaacctgtcaattaat

SEQ ID NO: 48083 - DNA, 25 bp, Homo sapien
aaaaatgcaacctgtcaattaatat

SEQ ID NO: 48084 - DNA, 25 bp, Homo sapien
aatgcaacctgtcaattaatatata

SEQ ID NO: 48085 - DNA, 25 bp, Homo sapien
gcaacctgtcaattaatatatacta

SEQ ID NO: 48086 - DNA, 25 bp, Homo sapien
atattattgtgtatttatgattagc

SEQ ID NO: 48087 - DNA, 25 bp, Homo sapien
ttttttgtctgactcatctgagtta

SEQ ID NO: 48088 - DNA, 25 bp, Homo sapien
tttttgtctgactcatctgagttat

SEQ ID NO: 48089 - DNA, 25 bp, Homo sapien
tttgtctgactcatctgagttatat

SEQ ID NO: 48090 - DNA, 25 bp, Homo sapien
tgtctgactcatctgagttatattt

SEQ ID NO: 48091 - DNA, 25 bp, Homo sapien
tatatttagttttcaagtggcaata

SEQ ID NO: 48092 - DNA, 25 bp, Homo sapien
gtttatttataaagatctggcctgt

SEQ ID NO: 48093 - DNA, 25 bp, Homo sapien
tttatttataaagatctggcctgtt

SEQ ID NO: 48094 - DNA, 25 bp, Homo sapien
tttataaagatctggcctgttcctg

SEQ ID NO: 48095 - DNA, 25 bp, Homo sapien
gtctcccagctatctataaccttag

SEQ ID NO: 48096 - DNA, 25 bp, Homo sapien
aaccttagctagagtgtcgccttgt

SEQ ID NO: 48097 - DNA, 25 bp, Homo sapien
agagtgtcgccttgtgggttcctgt

SEQ ID NO: 48098 - DNA, 25 bp, Homo sapien
gggttcctgttgctgagacttcctg

SEQ ID NO: 48099 - DNA, 25 bp, Homo sapien
cccctagagtgctctgtgtatgcgg

SEQ ID NO: 48100 - DNA, 25 bp, Homo sapien
cctagagtgctctgtgtatgcggat

SEQ ID NO: 48101 - DNA, 25 bp, Homo sapien
ctagagtgctctgtgtatgcggatg

SEQ ID NO: 48102 - DNA, 25 bp, Homo sapien
gaattgtcatttctctttactggat

SEQ ID NO: 48103 - DNA, 25 bp, Homo sapien
tatatgaagaattcccatccattgg

SEQ ID NO: 48104 - DNA, 25 bp, Homo sapien
tgaagaattcccatccattgggccc

SEQ ID NO: 48105 - DNA, 25 bp, Homo sapien
ggccccttctaaccccagaatgtga

SEQ ID NO: 48106 - DNA, 25 bp, Homo sapien
gggttaggcatcctagacagcagcc

SEQ ID NO: 48107 - DNA, 25 bp, Homo sapien
taggcatcctagacagcagcctgag

SEQ ID NO: 48108 - DNA, 25 bp, Homo sapien
gagatttgggccatgtagctgcctt

SEQ ID NO: 48109 - DNA, 25 bp, Homo sapien
tgggccatgtagctgcctttgttac

SEQ ID NO: 48110 - DNA, 25 bp, Homo sapien
atgtagctgcctttgttactctatt

SEQ ID NO: 48111 - DNA, 25 bp, Homo sapien
agctgcctttgttactctatttatt

SEQ ID NO: 48112 - DNA, 25 bp, Homo sapien
ttgttactctatttattttagtcac

SEQ ID NO: 48113 - DNA, 25 bp, Homo sapien
tttagtcacttgtataaaacaccaa

SEQ ID NO: 48114 - DNA, 25 bp, Homo sapien
tacgctcaccctaaacttttggtgg

SEQ ID NO: 48115 - DNA, 25 bp, Homo sapien
tcaccctaaacttttggtggcctgg

SEQ ID NO: 48116 - DNA, 25 bp, Homo sapien
tgctggcctgtttactcgtcaccac

SEQ ID NO: 48117 - DNA, 25 bp, Homo sapien
tccactatctccctgtgacgggtga

SEQ ID NO: 48118 - DNA, 25 bp, Homo sapien
ccctgtgacgggtgaacttcgtgta

SEQ ID NO: 48119 - DNA, 25 bp, Homo sapien
gggtgaacttcgtgtactgtgtctc

SEQ ID NO: 48120 - DNA, 25 bp, Homo sapien
aacttcgtgtactgtgtctcgggtc

SEQ ID NO: 48121 - DNA, 25 bp, Homo sapien
gtgtactgtgtctcgggtccatata

SEQ ID NO: 48122 - DNA, 25 bp, Homo sapien
gtgtctcgggtccatatatgaattg

SEQ ID NO: 48123 - DNA, 25 bp, Homo sapien
gaattgtgagcagggttcatctatt

SEQ ID NO: 48124 - DNA, 25 bp, Homo sapien
tgagcagggttcatctattttaaac

SEQ ID NO: 48125 - DNA, 25 bp, Homo sapien
ggacccagagacagggaggcagcct

SEQ ID NO: 48126 - DNA, 25 bp, Homo sapien
gacccagagacagggaggcagcctg

SEQ ID NO: 48127 - DNA, 25 bp, Homo sapien
gaggcagcctgtccatctgtgcata

SEQ ID NO: 48128 - DNA, 25 bp, Homo sapien
aggcagcctgtccatctgtgcataa

SEQ ID NO: 48129 - DNA, 25 bp, Homo sapien
gtatgttttcaggggccttcacatg

SEQ ID NO: 48130 - DNA, 25 bp, Homo sapien
tatgttttcaggggccttcacatgg

SEQ ID NO: 48131 - DNA, 25 bp, Homo sapien
atgttttcaggggccttcacatgga

SEQ ID NO: 48132 - DNA, 25 bp, Homo sapien
ttttcaggggccttcacatggagga

SEQ ID NO: 48133 - DNA, 25 bp, Homo sapien
tttcaggggccttcacatggaggag

SEQ ID NO: 48134 - DNA, 25 bp, Homo sapien
tcaggggccttcacatggaggagct

SEQ ID NO: 48135 - DNA, 25 bp, Homo sapien
caggggccttcacatggaggagctg

SEQ ID NO: 48136 - DNA, 25 bp, Homo sapien
acttgcgctgctctcggagccccag

SEQ ID NO: 48137 - DNA, 25 bp, Homo sapien
ccgcttcggcggtttggatatttat

SEQ ID NO: 48138 - DNA, 25 bp, Homo sapien
gcggtttggatatttattgacctcg

SEQ ID NO: 48139 - DNA, 25 bp, Homo sapien
ggtttggatatttattgacctcgtc

SEQ ID NO: 48140 - DNA, 25 bp, Homo sapien
gtttggatatttattgacctcgtcc

SEQ ID NO: 48141 - DNA, 25 bp, Homo sapien
tttggatatttattgacctcgtcct

SEQ ID NO: 48142 - DNA, 25 bp, Homo sapien
tggatatttattgacctcgtcctcc

SEQ ID NO: 48143 - DNA, 25 bp, Homo sapien
tatttattgacctcgtcctccgact

SEQ ID NO: 48144 - DNA, 25 bp, Homo sapien
tccgactcgctgacaggctacagga

SEQ ID NO: 48145 - DNA, 25 bp, Homo sapien
ataaaaggccctccatctgcccaaa

SEQ ID NO: 48146 - DNA, 25 bp, Homo sapien
tcgcgaataaaaggccctccatctg

SEQ ID NO: 48147 - DNA, 25 bp, Homo sapien
gggaacatgaaaagagactaggtga

SEQ ID NO: 48148 - DNA, 25 bp, Homo sapien
ggaacatgaaaagagactaggtgaa

SEQ ID NO: 48149 - DNA, 25 bp, Homo sapien
gaacatgaaaagagactaggtgaag

SEQ ID NO: 48150 - DNA, 25 bp, Homo sapien
aacatgaaaagagactaggtgaaga

SEQ ID NO: 48151 - DNA, 25 bp, Homo sapien
acatgaaaagagactaggtgaagag

SEQ ID NO: 48152 - DNA, 25 bp, Homo sapien
catgaaaagagactaggtgaagaga

SEQ ID NO: 48153 - DNA, 25 bp, Homo sapien
aaagagactaggtgaagagagggca

SEQ ID NO: 48154 - DNA, 25 bp, Homo sapien
agagactaggtgaagagagggcagg

SEQ ID NO: 48155 - DNA, 25 bp, Homo sapien
ctggggctggcccacaatacctgct

SEQ ID NO: 48156 - DNA, 25 bp, Homo sapien
tggggctggcccacaatacctgctc

SEQ ID NO: 48157 - DNA, 25 bp, Homo sapien
ggctggcccacaatacctgctcccc

SEQ ID NO: 48158 - DNA, 25 bp, Homo sapien
tgcctcagcacagcccagccggccc

SEQ ID NO: 48159 - DNA, 25 bp, Homo sapien
gcctcagcacagcccagccggccca

SEQ ID NO: 48160 - DNA, 25 bp, Homo sapien
agccggcccacatgcaggccatgag

SEQ ID NO: 48161 - DNA, 25 bp, Homo sapien
gccggcccacatgcaggccatgagg

SEQ ID NO: 48162 - DNA, 25 bp, Homo sapien
ccggcccacatgcaggccatgaggc

SEQ ID NO: 48163 - DNA, 25 bp, Homo sapien
cggcccacatgcaggccatgaggca

SEQ ID NO: 48164 - DNA, 25 bp, Homo sapien
ggcccacatgcaggccatgaggcag

SEQ ID NO: 48165 - DNA, 25 bp, Homo sapien
gcccacatgcaggccatgaggcagg

SEQ ID NO: 48166 - DNA, 25 bp, Homo sapien
tgagggagatgcccacccgacccca

SEQ ID NO: 48167 - DNA, 25 bp, Homo sapien
atgggagaaacagctgctgaggaaa

SEQ ID NO: 48168 - DNA, 25 bp, Homo sapien
gggagaaacagctgctgaggaaata

SEQ ID NO: 48169 - DNA, 25 bp, Homo sapien
catctggatcgtaggaggatatagg

SEQ ID NO: 48170 - DNA, 25 bp, Homo sapien
atctggatcgtaggaggatataggt

SEQ ID NO: 48171 - DNA, 25 bp, Homo sapien
tctggatcgtaggaggatataggtg

SEQ ID NO: 48172 - DNA, 25 bp, Homo sapien
ctggatcgtaggaggatataggtgt

SEQ ID NO: 48173 - DNA, 25 bp, Homo sapien
atcgtaggaggatataggtgtgttc

SEQ ID NO: 48174 - DNA, 25 bp, Homo sapien
tcgtaggaggatataggtgtgttct

SEQ ID NO: 48175 - DNA, 25 bp, Homo sapien
cgtaggaggatataggtgtgttctg

SEQ ID NO: 48176 - DNA, 25 bp, Homo sapien
gtaggaggatataggtgtgttctgg

SEQ ID NO: 48177 - DNA, 25 bp, Homo sapien
taggaggatataggtgtgttctgga

SEQ ID NO: 48178 - DNA, 25 bp, Homo sapien
aggaggatataggtgtgttctggac

SEQ ID NO: 48179 - DNA, 25 bp, Homo sapien
ggaggatataggtgtgttctggacc

SEQ ID NO: 48180 - DNA, 25 bp, Homo sapien
aagaaaggcatattcctgagggtcc

SEQ ID NO: 48181 - DNA, 25 bp, Homo sapien
ttcctgagggtccatttcctattat

SEQ ID NO: 48182 - DNA, 25 bp, Homo sapien
tgagggtccatttcctattattacc

SEQ ID NO: 48183 - DNA, 25 bp, Homo sapien
attaccacaggaaaagtcactgacg

SEQ ID NO: 48184 - DNA, 25 bp, Homo sapien
gtcactgacgaatcttccagtaaag

SEQ ID NO: 48185 - DNA, 25 bp, Homo sapien
gtttcttcaactaatggcatcgctt

SEQ ID NO: 48186 - DNA, 25 bp, Homo sapien
aactaatggcatcgctttaactttt

SEQ ID NO: 48187 - DNA, 25 bp, Homo sapien
ttcgccccaagttgtcaccaaagta

SEQ ID NO: 48188 - DNA, 25 bp, Homo sapien
gtttcagtgtcactatagtttctga

SEQ ID NO: 48189 - DNA, 25 bp, Homo sapien
tagtttctgaaatgaccggccaggg

SEQ ID NO: 48190 - DNA, 25 bp, Homo sapien
agcggcagcaccacacgggcatgga

SEQ ID NO: 48191 - DNA, 25 bp, Homo sapien
agatgagaattcctgacagattgtc

SEQ ID NO: 48192 - DNA, 25 bp, Homo sapien
atgagaattcctgacagattgtcct

SEQ ID NO: 48193 - DNA, 25 bp, Homo sapien
tgagaattcctgacagattgtcctt

SEQ ID NO: 48194 - DNA, 25 bp, Homo sapien
gagaattcctgacagattgtccttc

SEQ ID NO: 48195 - DNA, 25 bp, Homo sapien
agaattcctgacagattgtccttcc

SEQ ID NO: 48196 - DNA, 25 bp, Homo sapien
gaattcctgacagattgtccttcct

SEQ ID NO: 48197 - DNA, 25 bp, Homo sapien
aattcctgacagattgtccttcctg

SEQ ID NO: 48198 - DNA, 25 bp, Homo sapien
attcctgacagattgtccttcctga

SEQ ID NO: 48199 - DNA, 25 bp, Homo sapien
tccttcctgagaagacagccctctg

SEQ ID NO: 48200 - DNA, 25 bp, Homo sapien
ttcctgagaagacagccctctgcct

SEQ ID NO: 48201 - DNA, 25 bp, Homo sapien
tcctgagaagacagccctctgcctt

SEQ ID NO: 48202 - DNA, 25 bp, Homo sapien
tcttccaagtagtttgatcaaagaa

SEQ ID NO: 48203 - DNA, 25 bp, Homo sapien
gttttcaaaacacagtccggagtgt

SEQ ID NO: 48204 - DNA, 25 bp, Homo sapien
gtatgaagtgtaaatctggttttgt

SEQ ID NO: 48205 - DNA, 25 bp, Homo sapien
tgttttgttttgaagatcagacagt

SEQ ID NO: 48206 - DNA, 25 bp, Homo sapien
aagatcagacagtgatcactctgaa

SEQ ID NO: 48207 - DNA, 25 bp, Homo sapien
gacagtgatcactctgaaagattga

SEQ ID NO: 48208 - DNA, 25 bp, Homo sapien
gattgaagccaagaatttgtaacta

SEQ ID NO: 48209 - DNA, 25 bp, Homo sapien
gccaagaatttgtaactatggtatt

SEQ ID NO: 48210 - DNA, 25 bp, Homo sapien
taactatggtatttactgtaagctg

SEQ ID NO: 48211 - DNA, 25 bp, Homo sapien
tactgtaagctgtagaacactcaat

SEQ ID NO: 48212 - DNA, 25 bp, Homo sapien
agctgtagaacactcaataactatt

SEQ ID NO: 48213 - DNA, 25 bp, Homo sapien
gatgaaatttcagtttcattcaaat

SEQ ID NO: 48214 - DNA, 25 bp, Homo sapien
gttacctaaaatttatggtgtcaga

SEQ ID NO: 48215 - DNA, 25 bp, Homo sapien
gggagatcatagtgagttaatttga

SEQ ID NO: 48216 - DNA, 25 bp, Homo sapien
tttccaaagttttatatgcaggttt

SEQ ID NO: 48217 - DNA, 25 bp, Homo sapien
tgcaggtttttgttgtacctgtatc

SEQ ID NO: 48218 - DNA, 25 bp, Homo sapien
gttgtacctgtatccagatcttctt

SEQ ID NO: 48219 - DNA, 25 bp, Homo sapien
acctgtatccagatcttcttttcac

SEQ ID NO: 48220 - DNA, 25 bp, Homo sapien
gtatccagatcttcttttcactgtt

SEQ ID NO: 48221 - DNA, 25 bp, Homo sapien
ccagatcttcttttcactgttctaa

SEQ ID NO: 48222 - DNA, 25 bp, Homo sapien
gatcttcttttcactgttctaacaa

SEQ ID NO: 48223 - DNA, 25 bp, Homo sapien
tcttttcactgttctaacaatctaa

SEQ ID NO: 48224 - DNA, 25 bp, Homo sapien
ctctgtctgccctgtcctggggtga

SEQ ID NO: 48225 - DNA, 25 bp, Homo sapien
tggacaaacagatgaccacaggcag

SEQ ID NO: 48226 - DNA, 25 bp, Homo sapien
ccacaggcaggagaatctgagattg

SEQ ID NO: 48227 - DNA, 25 bp, Homo sapien
ccatctcctgttcattctcagctgg

SEQ ID NO: 48228 - DNA, 25 bp, Homo sapien
tgttcattctcagctggcctgccag

SEQ ID NO: 48229 - DNA, 25 bp, Homo sapien
ggggtgcctagagctttcaagaagt

SEQ ID NO: 48230 - DNA, 25 bp, Homo sapien
ggtgcctagagctttcaagaagtga

SEQ ID NO: 48231 - DNA, 25 bp, Homo sapien
ctagagctttcaagaagtgagagca

SEQ ID NO: 48232 - DNA, 25 bp, Homo sapien
tagagctttcaagaagtgagagcac

SEQ ID NO: 48233 - DNA, 25 bp, Homo sapien
gagcaccaacctgaggagtggacag

SEQ ID NO: 48234 - DNA, 25 bp, Homo sapien
ccaacctgaggagtggacagggacc

SEQ ID NO: 48235 - DNA, 25 bp, Homo sapien
caacctgaggagtggacagggacca

SEQ ID NO: 48236 - DNA, 25 bp, Homo sapien
gatacaggagacacttctcatctca

SEQ ID NO: 48237 - DNA, 25 bp, Homo sapien
ggagacacttctcatctcatctcag

SEQ ID NO: 48238 - DNA, 25 bp, Homo sapien
aatgctgtgatgtcccccaggctga

SEQ ID NO: 48239 - DNA, 25 bp, Homo sapien
gaagctaggctctggggcccccagt

SEQ ID NO: 48240 - DNA, 25 bp, Homo sapien
agacccagaattctcagggctctac

SEQ ID NO: 48241 - DNA, 25 bp, Homo sapien
gacccagaattctcagggctctacc

SEQ ID NO: 48242 - DNA, 25 bp, Homo sapien
cctggtcctaggtggccagtgggta

SEQ ID NO: 48243 - DNA, 25 bp, Homo sapien
gtcctaggtggccagtgggtatgag

SEQ ID NO: 48244 - DNA, 25 bp, Homo sapien
ctttgggccaaaagcaggcgttggg

SEQ ID NO: 48245 - DNA, 25 bp, Homo sapien
cctcaagtttggagccgtttccgtg

SEQ ID NO: 48246 - DNA, 25 bp, Homo sapien
ctcaagtttggagccgtttccgtgg

SEQ ID NO: 48247 - DNA, 25 bp, Homo sapien
gagccgtttccgtggttgtagcaga

SEQ ID NO: 48248 - DNA, 25 bp, Homo sapien
agccgtttccgtggttgtagcagag

SEQ ID NO: 48249 - DNA, 25 bp, Homo sapien
ccgtttccgtggttgtagcagagga

SEQ ID NO: 48250 - DNA, 25 bp, Homo sapien
tttccgtggttgtagcagaggaccg

SEQ ID NO: 48251 - DNA, 25 bp, Homo sapien
aaattatttaccagccctcagttgt

SEQ ID NO: 48252 - DNA, 25 bp, Homo sapien
tatttaccagccctcagttgtgttt

SEQ ID NO: 48253 - DNA, 25 bp, Homo sapien
atgggttttgctgggtcattttgcc

SEQ ID NO: 48254 - DNA, 25 bp, Homo sapien
attttgccctgtgtgctaagccttg

SEQ ID NO: 48255 - DNA, 25 bp, Homo sapien
taagccttgggtggctgcattcccc

SEQ ID NO: 48256 - DNA, 25 bp, Homo sapien
attcccctcctgtcatagatctgac

SEQ ID NO: 48257 - DNA, 25 bp, Homo sapien
tctgacccccagcatgattgtattt

SEQ ID NO: 48258 - DNA, 25 bp, Homo sapien
tgattgtatttctttcccctccagt

SEQ ID NO: 48259 - DNA, 25 bp, Homo sapien
ccctccagtcaaaccgtaatacagt

SEQ ID NO: 48260 - DNA, 25 bp, Homo sapien
gaaaattcgacagtctgcaatgcca

SEQ ID NO: 48261 - DNA, 25 bp, Homo sapien
gacagtctgcaatgccaaaagggta

SEQ ID NO: 48262 - DNA, 25 bp, Homo sapien
cctctaggaggaaagcccagaggga

SEQ ID NO: 48263 - DNA, 25 bp, Homo sapien
tctaggaggaaagcccagagggagg

SEQ ID NO: 48264 - DNA, 25 bp, Homo sapien
gagggggccctcattccttcagacc

SEQ ID NO: 48265 - DNA, 25 bp, Homo sapien
ctccttaccccgctgggctaggtct

SEQ ID NO: 48266 - DNA, 25 bp, Homo sapien
tccttaccccgctgggctaggtctc

SEQ ID NO: 48267 - DNA, 25 bp, Homo sapien
gctgggctaggtctccgccagggct

SEQ ID NO: 48268 - DNA, 25 bp, Homo sapien
ctgggctaggtctccgccagggctg

SEQ ID NO: 48269 - DNA, 25 bp, Homo sapien
tgggctaggtctccgccagggctgg

SEQ ID NO: 48270 - DNA, 25 bp, Homo sapien
gggctaggtctccgccagggctggc

SEQ ID NO: 48271 - DNA, 25 bp, Homo sapien
ctaggtctccgccagggctggcctc

SEQ ID NO: 48272 - DNA, 25 bp, Homo sapien
ttccctccccgccacagtgaaataa

SEQ ID NO: 48273 - DNA, 25 bp, Homo sapien
tctaccttctcttagggtacttaga

SEQ ID NO: 48274 - DNA, 25 bp, Homo sapien
ggtacttagatggatcccctgttct

SEQ ID NO: 48275 - DNA, 25 bp, Homo sapien
gatggatcccctgttctacaaactg

SEQ ID NO: 48276 - DNA, 25 bp, Homo sapien
acaaactgccagtcagcaagggaag

SEQ ID NO: 48277 - DNA, 25 bp, Homo sapien
gcaatgaccctcaatgggccatttg

SEQ ID NO: 48278 - DNA, 25 bp, Homo sapien
catttgagggatctggcctggaaat

SEQ ID NO: 48279 - DNA, 25 bp, Homo sapien
tcttctcacacctcactggctggaa

SEQ ID NO: 48280 - DNA, 25 bp, Homo sapien
ggaaacagtcacatgaccccagtca

SEQ ID NO: 48281 - DNA, 25 bp, Homo sapien
gggcaaagctgtttaagggccacta

SEQ ID NO: 48282 - DNA, 25 bp, Homo sapien
tttaagggccactagctagtctctg

SEQ ID NO: 48283 - DNA, 25 bp, Homo sapien
actagctagtctctgccactaataa

SEQ ID NO: 48284 - DNA, 25 bp, Homo sapien
tccccgcggccagctgggtctccgg

SEQ ID NO: 48285 - DNA, 25 bp, Homo sapien
ccccgcggccagctgggtctccggg

SEQ ID NO: 48286 - DNA, 25 bp, Homo sapien
ctggccctcccgctgcatctcagac

SEQ ID NO: 48287 - DNA, 25 bp, Homo sapien
tggccctcccgctgcatctcagacc

SEQ ID NO: 48288 - DNA, 25 bp, Homo sapien
ggccctcccgctgcatctcagacct

SEQ ID NO: 48289 - DNA, 25 bp, Homo sapien
ctcccgctgcatctcagacctgaca

SEQ ID NO: 48290 - DNA, 25 bp, Homo sapien
tcccgctgcatctcagacctgacac

SEQ ID NO: 48291 - DNA, 25 bp, Homo sapien
cccgctgcatctcagacctgacacc

SEQ ID NO: 48292 - DNA, 25 bp, Homo sapien
ccgctgcatctcagacctgacaccc

SEQ ID NO: 48293 - DNA, 25 bp, Homo sapien
cagacctgacacccaacggggggat

SEQ ID NO: 48294 - DNA, 25 bp, Homo sapien
cctgtgcccaccttctctccctcct

SEQ ID NO: 48295 - DNA, 25 bp, Homo sapien
tcctcgtaagccaagcgacctgcct

SEQ ID NO: 48296 - DNA, 25 bp, Homo sapien
ctcgtaagccaagcgacctgcctaa

SEQ ID NO: 48297 - DNA, 25 bp, Homo sapien
tcgtaagccaagcgacctgcctaaa

SEQ ID NO: 48298 - DNA, 25 bp, Homo sapien
agccaagcgacctgcctaaagcttg

SEQ ID NO: 48299 - DNA, 25 bp, Homo sapien
gccaagcgacctgcctaaagcttgg

SEQ ID NO: 48300 - DNA, 25 bp, Homo sapien
ccaagcgacctgcctaaagcttggg

SEQ ID NO: 48301 - DNA, 25 bp, Homo sapien
aagcgacctgcctaaagcttggggc

SEQ ID NO: 48302 - DNA, 25 bp, Homo sapien
agcgacctgcctaaagcttggggct

SEQ ID NO: 48303 - DNA, 25 bp, Homo sapien
gcgacctgcctaaagcttggggctg

SEQ ID NO: 48304 - DNA, 25 bp, Homo sapien
gacctgcctaaagcttggggctgtg

SEQ ID NO: 48305 - DNA, 25 bp, Homo sapien
acctgcctaaagcttggggctgtgc

SEQ ID NO: 48306 - DNA, 25 bp, Homo sapien
gtgatgaaaactcctggtcattcct

SEQ ID NO: 48307 - DNA, 25 bp, Homo sapien
tgatgaaaactcctggtcattcctt

SEQ ID NO: 48308 - DNA, 25 bp, Homo sapien
gatgaaaactcctggtcattccttg

SEQ ID NO: 48309 - DNA, 25 bp, Homo sapien
atgaaaactcctggtcattccttga

SEQ ID NO: 48310 - DNA, 25 bp, Homo sapien
tgaaaactcctggtcattccttgaa

SEQ ID NO: 48311 - DNA, 25 bp, Homo sapien
gaaaactcctggtcattccttgaat

SEQ ID NO: 48312 - DNA, 25 bp, Homo sapien
aaaactcctggtcattccttgaata

SEQ ID NO: 48313 - DNA, 25 bp, Homo sapien
aaactcctggtcattccttgaataa

SEQ ID NO: 48314 - DNA, 25 bp, Homo sapien
aactcctggtcattccttgaataaa

SEQ ID NO: 48315 - DNA, 25 bp, Homo sapien
ataactgtatcttcctgagagatgg

SEQ ID NO: 48316 - DNA, 25 bp, Homo sapien
taactgtatcttcctgagagatgga

SEQ ID NO: 48317 - DNA, 25 bp, Homo sapien
ggatttcactttcatacgttaatgg

SEQ ID NO: 48318 - DNA, 25 bp, Homo sapien
tttcactttcatacgttaatggatg

SEQ ID NO: 48319 - DNA, 25 bp, Homo sapien
cactttcatacgttaatggatggag

SEQ ID NO: 48320 - DNA, 25 bp, Homo sapien
atacgttaatggatggagtctacaa

SEQ ID NO: 48321 - DNA, 25 bp, Homo sapien
atggatggagtctacaaatcagtga

SEQ ID NO: 48322 - DNA, 25 bp, Homo sapien
atggagtctacaaatcagtgaaaaa

SEQ ID NO: 48323 - DNA, 25 bp, Homo sapien
aattgtaatcactgattctagaatg

SEQ ID NO: 48324 - DNA, 25 bp, Homo sapien
tgctctgtttcattgaagtaatgaa

SEQ ID NO: 48325 - DNA, 25 bp, Homo sapien
agtaatgaagtttcagtacgtggcc

SEQ ID NO: 48326 - DNA, 25 bp, Homo sapien
ggtccctctctgtcctgctcgatga

SEQ ID NO: 48327 - DNA, 25 bp, Homo sapien
tgcaggacctgagtgaagccatttc

SEQ ID NO: 48328 - DNA, 25 bp, Homo sapien
caggacctgagtgaagccatttcca

SEQ ID NO: 48329 - DNA, 25 bp, Homo sapien
gccatttccaaagaggaagctgttt

SEQ ID NO: 48330 - DNA, 25 bp, Homo sapien
atttccaaagaggaagctgtttgtc

SEQ ID NO: 48331 - DNA, 25 bp, Homo sapien
agctgtttgtcaaggagacaacctt

SEQ ID NO: 48332 - DNA, 25 bp, Homo sapien
taagcagctgacagttggagggaaa

SEQ ID NO: 48333 - DNA, 25 bp, Homo sapien
gacagttggagggaaagccagcctg

SEQ ID NO: 48334 - DNA, 25 bp, Homo sapien
gggataccagctgagtctgaattct

SEQ ID NO: 48335 - DNA, 25 bp, Homo sapien
taccagctgagtctgaattctgctc

SEQ ID NO: 48336 - DNA, 25 bp, Homo sapien
agctgagtctgaattctgctctaaa

SEQ ID NO: 48337 - DNA, 25 bp, Homo sapien
ctagtacattaacatccccttttca

SEQ ID NO: 48338 - DNA, 25 bp, Homo sapien
tagtacattaacatccccttttcat

SEQ ID NO: 48339 - DNA, 25 bp, Homo sapien
agtacattaacatccccttttcatt

SEQ ID NO: 48340 - DNA, 25 bp, Homo sapien
gtacattaacatccccttttcatta

SEQ ID NO: 48341 - DNA, 25 bp, Homo sapien
catccccttttcattaccccattgg

SEQ ID NO: 48342 - DNA, 25 bp, Homo sapien
aaggattcacactttattacagtta

SEQ ID NO: 48343 - DNA, 25 bp, Homo sapien
ggattcacactttattacagttaaa

SEQ ID NO: 48344 - DNA, 25 bp, Homo sapien
gaaagaaactttgctaatttcaagt

SEQ ID NO: 48345 - DNA, 25 bp, Homo sapien
gaaactttgctaatttcaagttcga

SEQ ID NO: 48346 - DNA, 25 bp, Homo sapien
atttcaagttcgaattacagttgtg

SEQ ID NO: 48347 - DNA, 25 bp, Homo sapien
tcaagttcgaattacagttgtgaga

SEQ ID NO: 48348 - DNA, 25 bp, Homo sapien
gactgggattgggtttgactgaaat

SEQ ID NO: 48349 - DNA, 25 bp, Homo sapien
ggatgggacggtggacttccattct

SEQ ID NO: 48350 - DNA, 25 bp, Homo sapien
gacttccattctccctaaactggag

SEQ ID NO: 48351 - DNA, 25 bp, Homo sapien
tctccctaaactggagttttggtcg

SEQ ID NO: 48352 - DNA, 25 bp, Homo sapien
gaaacctctgggagactggaaacct

SEQ ID NO: 48353 - DNA, 25 bp, Homo sapien
gactggaaacctgattggagcactg

SEQ ID NO: 48354 - DNA, 25 bp, Homo sapien
acctgattggagcactgaggaacaa

SEQ ID NO: 48355 - DNA, 25 bp, Homo sapien
gcagactctctgaacgtttgatgaa

SEQ ID NO: 48356 - DNA, 25 bp, Homo sapien
cgtttgatgaaatggactcttgtga

SEQ ID NO: 48357 - DNA, 25 bp, Homo sapien
gaatattcactgttgcactgtacga

SEQ ID NO: 48358 - DNA, 25 bp, Homo sapien
gttgcactgtacgaagtctctgaaa

SEQ ID NO: 48359 - DNA, 25 bp, Homo sapien
agttcctgagctgaacatggagcaa

SEQ ID NO: 48360 - DNA, 25 bp, Homo sapien
agggtgacttctctccacataggga

SEQ ID NO: 48361 - DNA, 25 bp, Homo sapien
ggagggcttagagctcacagccttg

SEQ ID NO: 48362 - DNA, 25 bp, Homo sapien
acagccttgggaagtgagactagaa

SEQ ID NO: 48363 - DNA, 25 bp, Homo sapien
ttgagtagacaaaggccacacacat

SEQ ID NO: 48364 - DNA, 25 bp, Homo sapien
ggccacacacatcattgtcattact

SEQ ID NO: 48365 - DNA, 25 bp, Homo sapien
ctgttttaattgtctggcttctctc

SEQ ID NO: 48366 - DNA, 25 bp, Homo sapien
ggcttctctctggactgggagctca

SEQ ID NO: 48367 - DNA, 25 bp, Homo sapien
ggattctgaccagtgacttacacaa

SEQ ID NO: 48368 - DNA, 25 bp, Homo sapien
gtgacttacacaaaaggcgctctat

SEQ ID NO: 48369 - DNA, 25 bp, Homo sapien
aaaggcgctctatacatattataat

SEQ ID NO: 48370 - DNA, 25 bp, Homo sapien
atccaggaggagcagcacccgagcc

SEQ ID NO: 48371 - DNA, 25 bp, Homo sapien
tggagtggcccagtacccttccaag

SEQ ID NO: 48372 - DNA, 25 bp, Homo sapien
agtacccttccaagaggccacagtc

SEQ ID NO: 48373 - DNA, 25 bp, Homo sapien
aggacaaagtatgcggcccatcctg

SEQ ID NO: 48374 - DNA, 25 bp, Homo sapien
tcctggtgcgacagcgtgggacaat

SEQ ID NO: 48375 - DNA, 25 bp, Homo sapien
gcgacagcgtgggacaatgtgaaca

SEQ ID NO: 48376 - DNA, 25 bp, Homo sapien
atggactcgaagacatggccctttc

SEQ ID NO: 48377 - DNA, 25 bp, Homo sapien
actcgaagacatggccctttctctg

SEQ ID NO: 48378 - DNA, 25 bp, Homo sapien
ggccctttctctgtagttgattttt

SEQ ID NO: 48379 - DNA, 25 bp, Homo sapien
ttaaatgtgccattattgtttttaa

SEQ ID NO: 48380 - DNA, 25 bp, Homo sapien
aacacctttaagaggcttgaaagag

SEQ ID NO: 48381 - DNA, 25 bp, Homo sapien
tgtacccgaagtccagactcccagg

SEQ ID NO: 48382 - DNA, 25 bp, Homo sapien
gtacccgaagtccagactcccaggg

SEQ ID NO: 48383 - DNA, 25 bp, Homo sapien
gactcccaggggaatcagcagccag

SEQ ID NO: 48384 - DNA, 25 bp, Homo sapien
cagccaggacagacatcctagcagc

SEQ ID NO: 48385 - DNA, 25 bp, Homo sapien
gccaggacagacatcctagcagccg

SEQ ID NO: 48386 - DNA, 25 bp, Homo sapien
aggacagacatcctagcagccgcct

SEQ ID NO: 48387 - DNA, 25 bp, Homo sapien
gcctaggaaccgtacatcccatctg

SEQ ID NO: 48388 - DNA, 25 bp, Homo sapien
ctaggaaccgtacatcccatctgct

SEQ ID NO: 48389 - DNA, 25 bp, Homo sapien
aggaaccgtacatcccatctgctct

SEQ ID NO: 48390 - DNA, 25 bp, Homo sapien
gtacatcccatctgctctctggcca

SEQ ID NO: 48391 - DNA, 25 bp, Homo sapien
tgctctctggccaacggcttcacac

SEQ ID NO: 48392 - DNA, 25 bp, Homo sapien
tgggcgccgagctggaatacgactc

SEQ ID NO: 48393 - DNA, 25 bp, Homo sapien
gggcgccgagctggaatacgactca

SEQ ID NO: 48394 - DNA, 25 bp, Homo sapien
ggcgccgagctggaatacgactcag

SEQ ID NO: 48395 - DNA, 25 bp, Homo sapien
gcgccgagctggaatacgactcaga

SEQ ID NO: 48396 - DNA, 25 bp, Homo sapien
cgccgagctggaatacgactcagag

SEQ ID NO: 48397 - DNA, 25 bp, Homo sapien
agctggaatacgactcagagcacag

SEQ ID NO: 48398 - DNA, 25 bp, Homo sapien
actggcacggctttgactgaggccc

SEQ ID NO: 48399 - DNA, 25 bp, Homo sapien
ctggcacggctttgactgaggcccg

SEQ ID NO: 48400 - DNA, 25 bp, Homo sapien
tggcacggctttgactgaggcccga

SEQ ID NO: 48401 - DNA, 25 bp, Homo sapien
acatgctgcgtgatggtgtggcttc

SEQ ID NO: 48402 - DNA, 25 bp, Homo sapien
atgctgcgtgatggtgtggcttcct

SEQ ID NO: 48403 - DNA, 25 bp, Homo sapien
tgctgcgtgatggtgtggcttcctc

SEQ ID NO: 48404 - DNA, 25 bp, Homo sapien
ctgcgtgatggtgtggcttcctcgc

SEQ ID NO: 48405 - DNA, 25 bp, Homo sapien
tgcgtgatggtgtggcttcctcgcc

SEQ ID NO: 48406 - DNA, 25 bp, Homo sapien
tgccttcatttgtgctgccaccctg

SEQ ID NO: 48407 - DNA, 25 bp, Homo sapien
ggtccgaggagagcactacaggtac

SEQ ID NO: 48408 - DNA, 25 bp, Homo sapien
gtccgaggagagcactacaggtaca

SEQ ID NO: 48409 - DNA, 25 bp, Homo sapien
tccgaggagagcactacaggtacaa

SEQ ID NO: 48410 - DNA, 25 bp, Homo sapien
cgaggagagcactacaggtacaagt

SEQ ID NO: 48411 - DNA, 25 bp, Homo sapien
aggagagcactacaggtacaagttc

SEQ ID NO: 48412 - DNA, 25 bp, Homo sapien
gagagcactacaggtacaagttcag

SEQ ID NO: 48413 - DNA, 25 bp, Homo sapien
gagcactacaggtacaagttcagcc

SEQ ID NO: 48414 - DNA, 25 bp, Homo sapien
gcactacaggtacaagttcagccgt

SEQ ID NO: 48415 - DNA, 25 bp, Homo sapien
actacaggtacaagttcagccgtcc

SEQ ID NO: 48416 - DNA, 25 bp, Homo sapien
caagtggtgggtgcggaagaggatc

SEQ ID NO: 48417 - DNA, 25 bp, Homo sapien
ggaccgtgggtggcctctgcccggg

SEQ ID NO: 48418 - DNA, 25 bp, Homo sapien
agcattttcaagaatccctcaattc

SEQ ID NO: 48419 - DNA, 25 bp, Homo sapien
gaatccctcaattctatcctgaaat

SEQ ID NO: 48420 - DNA, 25 bp, Homo sapien
ctcaattctatcctgaaatgatgtt

SEQ ID NO: 48421 - DNA, 25 bp, Homo sapien
gacaatttataggaacagtatcttt

SEQ ID NO: 48422 - DNA, 25 bp, Homo sapien
agtatctttcaacatactccctaca

SEQ ID NO: 48423 - DNA, 25 bp, Homo sapien
tctttcaacatactccctacattat

SEQ ID NO: 48424 - DNA, 25 bp, Homo sapien
tactccctacattatccttcaatat

SEQ ID NO: 48425 - DNA, 25 bp, Homo sapien
ccctacattatccttcaatatctgc

SEQ ID NO: 48426 - DNA, 25 bp, Homo sapien
tccttcaatatctgcaatacttgtc

SEQ ID NO: 48427 - DNA, 25 bp, Homo sapien
tagtaactgtatttctggtaagatt

SEQ ID NO: 48428 - DNA, 25 bp, Homo sapien
ttctggtaagattatgatttcatga

SEQ ID NO: 48429 - DNA, 25 bp, Homo sapien
aaagacaagacaagcacttattttt

SEQ ID NO: 48430 - DNA, 25 bp, Homo sapien
tgcgaatgctctatctccagtctgt

SEQ ID NO: 48431 - DNA, 25 bp, Homo sapien
atctccagtctgtctctgtgtactg

SEQ ID NO: 48432 - DNA, 25 bp, Homo sapien
tcttctgtctgtcatcttgcaggat

SEQ ID NO: 48433 - DNA, 25 bp, Homo sapien
gccagatgggcttagctaggccaaa

SEQ ID NO: 48434 - DNA, 25 bp, Homo sapien
tgggcttagctaggccaaagtaaca

SEQ ID NO: 48435 - DNA, 25 bp, Homo sapien
cagactcaagagttattgtacatta

SEQ ID NO: 48436 - DNA, 25 bp, Homo sapien
attgtacattactgaccacgctcat

SEQ ID NO: 48437 - DNA, 25 bp, Homo sapien
tactgaccacgctcatttgttcaaa

SEQ ID NO: 48438 - DNA, 25 bp, Homo sapien
aaagttagaacatctggctgcacca

SEQ ID NO: 48439 - DNA, 25 bp, Homo sapien
agaacatctggctgcaccaggaaaa

SEQ ID NO: 48440 - DNA, 25 bp, Homo sapien
caataatttggaaaaacccatgaag

SEQ ID NO: 48441 - DNA, 25 bp, Homo sapien
ttctttaataagaacaattccatct

SEQ ID NO: 48442 - DNA, 25 bp, Homo sapien
gaacaattccatcttaataaagagt

SEQ ID NO: 48443 - DNA, 25 bp, Homo sapien
aacaattccatcttaataaagagtt

SEQ ID NO: 48444 - DNA, 25 bp, Homo sapien
acaattccatcttaataaagagtta

SEQ ID NO: 48445 - DNA, 25 bp, Homo sapien
caattccatcttaataaagagttac

SEQ ID NO: 48446 - DNA, 25 bp, Homo sapien
tccatcttaataaagagttacactt

SEQ ID NO: 48447 - DNA, 25 bp, Homo sapien
ccatcttaataaagagttacacttg

SEQ ID NO: 48448 - DNA, 25 bp, Homo sapien
catcttaataaagagttacacttgt

SEQ ID NO: 48449 - DNA, 25 bp, Homo sapien
atcttaataaagagttacacttgtt

SEQ ID NO: 48450 - DNA, 25 bp, Homo sapien
tcttaataaagagttacacttgtta

SEQ ID NO: 48451 - DNA, 25 bp, Homo sapien
ccacaggctataattggagcacgac

SEQ ID NO: 48452 - DNA, 25 bp, Homo sapien
cacaggctataattggagcacgacc

SEQ ID NO: 48453 - DNA, 25 bp, Homo sapien
acaggctataattggagcacgacca

SEQ ID NO: 48454 - DNA, 25 bp, Homo sapien
caggctataattggagcacgaccat

SEQ ID NO: 48455 - DNA, 25 bp, Homo sapien
aggctataattggagcacgaccatg

SEQ ID NO: 48456 - DNA, 25 bp, Homo sapien
ggctataattggagcacgaccatgg

SEQ ID NO: 48457 - DNA, 25 bp, Homo sapien
gctataattggagcacgaccatggg

SEQ ID NO: 48458 - DNA, 25 bp, Homo sapien
ctataattggagcacgaccatgggt

SEQ ID NO: 48459 - DNA, 25 bp, Homo sapien
agctcctgatccgtcctgtggacaa

SEQ ID NO: 48460 - DNA, 25 bp, Homo sapien
gctcctgatccgtcctgtggacaaa

SEQ ID NO: 48461 - DNA, 25 bp, Homo sapien
tcctgatccgtcctgtggacaaacc

SEQ ID NO: 48462 - DNA, 25 bp, Homo sapien
aagatcacccttcctggacgggact

SEQ ID NO: 48463 - DNA, 25 bp, Homo sapien
cacccttcctggacgggactattga

SEQ ID NO: 48464 - DNA, 25 bp, Homo sapien
cttcctggacgggactattgaagga

SEQ ID NO: 48465 - DNA, 25 bp, Homo sapien
aggagaatgggagagcctcccctgg

SEQ ID NO: 48466 - DNA, 25 bp, Homo sapien
tcccctgggcctgaaaacttggagc

SEQ ID NO: 48467 - DNA, 25 bp, Homo sapien
cctgggcctgaaaacttggagcaat

SEQ ID NO: 48468 - DNA, 25 bp, Homo sapien
gggcctgaaaacttggagcaattaa

SEQ ID NO: 48469 - DNA, 25 bp, Homo sapien
aacacagtggcaagacaacattacc

SEQ ID NO: 48470 - DNA, 25 bp, Homo sapien
ggcaagacaacattacccaactata

SEQ ID NO: 48471 - DNA, 25 bp, Homo sapien
attacccaactatagaagagaggct

SEQ ID NO: 48472 - DNA, 25 bp, Homo sapien
tagaagagaggctaactagcaacaa

SEQ ID NO: 48473 - DNA, 25 bp, Homo sapien
aaggcactttttgttgtacatatgt

SEQ ID NO: 48474 - DNA, 25 bp, Homo sapien
tgttgtacatatgtcctgttgcccc

SEQ ID NO: 48475 - DNA, 25 bp, Homo sapien
ctgcatttttatctgccaaactgta

SEQ ID NO: 48476 - DNA, 25 bp, Homo sapien
atctgccaaactgtactgatggagt

SEQ ID NO: 48477 - DNA, 25 bp, Homo sapien
gccaaactgtactgatggagtaacc

SEQ ID NO: 48478 - DNA, 25 bp, Homo sapien
tggagtaaccattgacttttccctt

SEQ ID NO: 48479 - DNA, 25 bp, Homo sapien
cctaaattaaggaagacgtctatga

SEQ ID NO: 48480 - DNA, 25 bp, Homo sapien
gacgtctatgatggagtgtacaata

SEQ ID NO: 48481 - DNA, 25 bp, Homo sapien
gtacaataaaatcagtgtcccaatg

SEQ ID NO: 48482 - DNA, 25 bp, Homo sapien
tcagagcttctgatcagcatgagat

SEQ ID NO: 48483 - DNA, 25 bp, Homo sapien
gcttctgatcagcatgagataatca

SEQ ID NO: 48484 - DNA, 25 bp, Homo sapien
gagagagactcttaaacgtaaataa

SEQ ID NO: 48485 - DNA, 25 bp, Homo sapien
taaaaatgcaattcactcacaactc

SEQ ID NO: 48486 - DNA, 25 bp, Homo sapien
aaaatgcaattcactcacaactcta

SEQ ID NO: 48487 - DNA, 25 bp, Homo sapien
aatgcaattcactcacaactctaaa

SEQ ID NO: 48488 - DNA, 25 bp, Homo sapien
cagcaagtggaaaatttcaggatac

SEQ ID NO: 48489 - DNA, 25 bp, Homo sapien
ggaaaatttcaggatacaaagcaca

SEQ ID NO: 48490 - DNA, 25 bp, Homo sapien
cacataacaccccataagagatgat

SEQ ID NO: 48491 - DNA, 25 bp, Homo sapien
ataacaccccataagagatgattat

SEQ ID NO: 48492 - DNA, 25 bp, Homo sapien
caccccataagagatgattatgttt

SEQ ID NO: 48493 - DNA, 25 bp, Homo sapien
gattatgtttttagaagcaagagca

SEQ ID NO: 48494 - DNA, 25 bp, Homo sapien
aagcaagagcaaaattatgaaacct

SEQ ID NO: 48495 - DNA, 25 bp, Homo sapien
ctgctaagccctctggaggagaagg

SEQ ID NO: 48496 - DNA, 25 bp, Homo sapien
aacccccagaccatctggtttgagc

SEQ ID NO: 48497 - DNA, 25 bp, Homo sapien
agaccatctggtttgagctgccaca

SEQ ID NO: 48498 - DNA, 25 bp, Homo sapien
ggagctgctatacaccactgtcttc

SEQ ID NO: 48499 - DNA, 25 bp, Homo sapien
gctgctatacaccactgtcttcctg

SEQ ID NO: 48500 - DNA, 25 bp, Homo sapien
acaccactgtcttcctgatagacag

SEQ ID NO: 48501 - DNA, 25 bp, Homo sapien
ctgtcttcctgatagacagcagtgc

SEQ ID NO: 48502 - DNA, 25 bp, Homo sapien
gacagcagtgcctcttgcactgagt

SEQ ID NO: 48503 - DNA, 25 bp, Homo sapien
tcttgcactgagtggcccagcatca

SEQ ID NO: 48504 - DNA, 25 bp, Homo sapien
actgagtggcccagcatcaactgag

SEQ ID NO: 48505 - DNA, 25 bp, Homo sapien
catcaactgagaggagtgcaggccg

SEQ ID NO: 48506 - DNA, 25 bp, Homo sapien
tcacccacatggtctgccttggatg

SEQ ID NO: 48507 - DNA, 25 bp, Homo sapien
acatggtctgccttggatgctatca

SEQ ID NO: 48508 - DNA, 25 bp, Homo sapien
gccttggatgctatcagatcactgt

SEQ ID NO: 48509 - DNA, 25 bp, Homo sapien
ccttggatgctatcagatcactgtt

SEQ ID NO: 48510 - DNA, 25 bp, Homo sapien
gccggcccacatgcaggccatgagg

SEQ ID NO: 48511 - DNA, 25 bp, Homo sapien
acaaatacatcgtgacaggctcggg

SEQ ID NO: 48512 - DNA, 25 bp, Homo sapien
accgtgtatgaggtggtctactgag

SEQ ID NO: 48513 - DNA, 25 bp, Homo sapien
tgtacccgaagtccagactcccagg

SEQ ID NO: 48514 - DNA, 25 bp, Homo sapien
gtacccgaagtccagactcccaggg

SEQ ID NO: 48515 - DNA, 25 bp, Homo sapien
gactcccaggggaatcagcagccag

SEQ ID NO: 48516 - DNA, 25 bp, Homo sapien
cagccaggacagacatcctagcagc

SEQ ID NO: 48517 - DNA, 25 bp, Homo sapien
aggacagacatcctagcagccgcct

SEQ ID NO: 48518 - DNA, 25 bp, Homo sapien
gcctaggaaccgtacatcccatctg

SEQ ID NO: 48519 - DNA, 25 bp, Homo sapien
aggaaccgtacatcccatctgctct

SEQ ID NO: 48520 - DNA, 25 bp, Homo sapien
tgctctctggccaacggcttcacac

SEQ ID NO: 48521 - DNA, 25 bp, Homo sapien
ggacctcggtggaaataaaatgtat

SEQ ID NO: 48522 - DNA, 25 bp, Homo sapien
gacccctcgcaactgtccacgcgtg

SEQ ID NO: 48523 - DNA, 25 bp, Homo sapien
cgcaactgtccacgcgtgccgtggc

SEQ ID NO: 48524 - DNA, 25 bp, Homo sapien
aaatgtgtacatattaaaggaagca

SEQ ID NO: 48525 - DNA, 25 bp, Homo sapien
gtacatattaaaggaagcactctgt

SEQ ID NO: 48526 - DNA, 25 bp, Homo sapien
acatattaaaggaagcactctgtat

SEQ ID NO: 48527 - DNA, 25 bp, Homo sapien
atattaaaggaagcactctgtatat

SEQ ID NO: 48528 - DNA, 25 bp, Homo sapien
tattaaaggaagcactctgtatatt

SEQ ID NO: 48529 - DNA, 25 bp, Homo sapien
attaaaggaagcactctgtatattt

SEQ ID NO: 48530 - DNA, 25 bp, Homo sapien
ttaaaggaagcactctgtatatttg

SEQ ID NO: 48531 - DNA, 25 bp, Homo sapien
taaaggaagcactctgtatatttga

SEQ ID NO: 48532 - DNA, 25 bp, Homo sapien
aaaggaagcactctgtatatttgat

SEQ ID NO: 48533 - DNA, 25 bp, Homo sapien
ttttttccacgtactccacagccaa

SEQ ID NO: 48534 - DNA, 25 bp, Homo sapien
cacagccaacatcacgaggtgtaat

SEQ ID NO: 48535 - DNA, 25 bp, Homo sapien
gccaacatcacgaggtgtaattttt

SEQ ID NO: 48536 - DNA, 25 bp, Homo sapien
taatttgatcagaactgttaccaaa

SEQ ID NO: 48537 - DNA, 25 bp, Homo sapien
aaacaactgtcagttttattgagat

SEQ ID NO: 48538 - DNA, 25 bp, Homo sapien
tattacttaagactttatgggagag

SEQ ID NO: 48539 - DNA, 25 bp, Homo sapien
gactttatgggagagattagacact

SEQ ID NO: 48540 - DNA, 25 bp, Homo sapien
gattagacactggaggtttttaaca

SEQ ID NO: 48541 - DNA, 25 bp, Homo sapien
gacactggaggtttttaacagaacg

SEQ ID NO: 48542 - DNA, 25 bp, Homo sapien
tggaggtttttaacagaacgtgtat

SEQ ID NO: 48543 - DNA, 25 bp, Homo sapien
gaacgtgtatttattaatgttcaaa

SEQ ID NO: 48544 - DNA, 25 bp, Homo sapien
acctggaccacaaggagcggatcgc

SEQ ID NO: 48545 - DNA, 25 bp, Homo sapien
tggaccacaaggagcggatcgccct

SEQ ID NO: 48546 - DNA, 25 bp, Homo sapien
ggaccacaaggagcggatcgccctg

SEQ ID NO: 48547 - DNA, 25 bp, Homo sapien
ccacaaggagcggatcgccctggag

SEQ ID NO: 48548 - DNA, 25 bp, Homo sapien
acaaggagcggatcgccctggagga

SEQ ID NO: 48549 - DNA, 25 bp, Homo sapien
ctggagcgcggcctggaacagcggc

SEQ ID NO: 48550 - DNA, 25 bp, Homo sapien
tggagcgcggcctggaacagcggcg

SEQ ID NO: 48551 - DNA, 25 bp, Homo sapien
gcggcctggaacagcggcgccgcaa

SEQ ID NO: 48552 - DNA, 25 bp, Homo sapien
ggaacagcggcgccgcaagctgagc

SEQ ID NO: 48553 - DNA, 25 bp, Homo sapien
ttgagccggcgggagcgctgcgtgc

SEQ ID NO: 48554 - DNA, 25 bp, Homo sapien
gagccggcgggagcgctgcgtgctg

SEQ ID NO: 48555 - DNA, 25 bp, Homo sapien
tgtatctaaccgcatgtgctgttgt

SEQ ID NO: 48556 - DNA, 25 bp, Homo sapien
gtatctaaccgcatgtgctgttgtg

SEQ ID NO: 48557 - DNA, 25 bp, Homo sapien
gtgctgttgtgcctaatgctctata

SEQ ID NO: 48558 - DNA, 25 bp, Homo sapien
tgctgttgtgcctaatgctctataa

SEQ ID NO: 48559 - DNA, 25 bp, Homo sapien
gctgttgtgcctaatgctctataaa

SEQ ID NO: 48560 - DNA, 25 bp, Homo sapien
ctgttgtgcctaatgctctataaag

SEQ ID NO: 48561 - DNA, 25 bp, Homo sapien
tgttgtgcctaatgctctataaagc

SEQ ID NO: 48562 - DNA, 25 bp, Homo sapien
gttgtgcctaatgctctataaagca

SEQ ID NO: 48563 - DNA, 25 bp, Homo sapien
gtgcctaatgctctataaagcatgt

SEQ ID NO: 48564 - DNA, 25 bp, Homo sapien
gcctaatgctctataaagcatgtta

SEQ ID NO: 48565 - DNA, 25 bp, Homo sapien
gctctataaagcatgttaaacagaa

SEQ ID NO: 48566 - DNA, 25 bp, Homo sapien
gaaacataatacttgattataactt

SEQ ID NO: 48567 - DNA, 25 bp, Homo sapien
aacttgaaaactgtgcttttaattg

SEQ ID NO: 48568 - DNA, 25 bp, Homo sapien
acttgaaaactgtgcttttaattga

SEQ ID NO: 48569 - DNA, 25 bp, Homo sapien
cttgaaaactgtgcttttaattgaa

SEQ ID NO: 48570 - DNA, 25 bp, Homo sapien
ttgaaaactgtgcttttaattgaaa

SEQ ID NO: 48571 - DNA, 25 bp, Homo sapien
tgaaaactgtgcttttaattgaaat

SEQ ID NO: 48572 - DNA, 25 bp, Homo sapien
gaaaactgtgcttttaattgaaata

SEQ ID NO: 48573 - DNA, 25 bp, Homo sapien
atattggatgaatgaaactgaattc

SEQ ID NO: 48574 - DNA, 25 bp, Homo sapien
tattggatgaatgaaactgaattca

SEQ ID NO: 48575 - DNA, 25 bp, Homo sapien
attggatgaatgaaactgaattcag

SEQ ID NO: 48576 - DNA, 25 bp, Homo sapien
taaaatttgactgttagaaatgaaa

SEQ ID NO: 48577 - DNA, 25 bp, Homo sapien
tccatttacatgtccaagaatcttt

SEQ ID NO: 48578 - DNA, 25 bp, Homo sapien
tttacatgtccaagaatcttttctt

SEQ ID NO: 48579 - DNA, 25 bp, Homo sapien
ttcttaaattccttactttgttcat

SEQ ID NO: 48580 - DNA, 25 bp, Homo sapien
ctttgttcattcattggctgttcag

SEQ ID NO: 48581 - DNA, 25 bp, Homo sapien
ttgttcattcattggctgttcaggc

SEQ ID NO: 48582 - DNA, 25 bp, Homo sapien
tgttcattcattggctgttcaggct

SEQ ID NO: 48583 - DNA, 25 bp, Homo sapien
ttcattcattggctgttcaggctga

SEQ ID NO: 48584 - DNA, 25 bp, Homo sapien
cattcattggctgttcaggctgaaa

SEQ ID NO: 48585 - DNA, 25 bp, Homo sapien
ttcattggctgttcaggctgaaaat

SEQ ID NO: 48586 - DNA, 25 bp, Homo sapien
ggctgttcaggctgaaaatggaaac

SEQ ID NO: 48587 - DNA, 25 bp, Homo sapien
aaatggaaacaggtagcttttatgt

SEQ ID NO: 48588 - DNA, 25 bp, Homo sapien
taaggcctttagattttgaggtact

SEQ ID NO: 48589 - DNA, 25 bp, Homo sapien
gcctttagattttgaggtactgtaa

SEQ ID NO: 48590 - DNA, 25 bp, Homo sapien
cagccctatccttttctgtatcaaa

SEQ ID NO: 48591 - DNA, 25 bp, Homo sapien
gccctatccttttctgtatcaaaca

SEQ ID NO: 48592 - DNA, 25 bp, Homo sapien
gtatcaaacaaaatccttgaggttg

SEQ ID NO: 48593 - DNA, 25 bp, Homo sapien
acaaaatccttgaggttggtataca

SEQ ID NO: 48594 - DNA, 25 bp, Homo sapien
aaatccttgaggttggtatacaagt

SEQ ID NO: 48595 - DNA, 25 bp, Homo sapien
gttggtatacaagttaaggctgaaa

SEQ ID NO: 48596 - DNA, 25 bp, Homo sapien
ccttaaattcccagtaaagaatgtg

SEQ ID NO: 48597 - DNA, 25 bp, Homo sapien
aagaatgtgaaagcaagcatgtaaa

SEQ ID NO: 48598 - DNA, 25 bp, Homo sapien
agcatgtaaaataaactggtcttca

SEQ ID NO: 48599 - DNA, 25 bp, Homo sapien
attttgaaagaggttccagctatca

SEQ ID NO: 48600 - DNA, 25 bp, Homo sapien
ttttgaaagaggttccagctatcac

SEQ ID NO: 48601 - DNA, 25 bp, Homo sapien
tttgaaagaggttccagctatcact

SEQ ID NO: 48602 - DNA, 25 bp, Homo sapien
ttccagctatcacttgtaaccatat

SEQ ID NO: 48603 - DNA, 25 bp, Homo sapien
tccagctatcacttgtaaccatata

SEQ ID NO: 48604 - DNA, 25 bp, Homo sapien
ccagctatcacttgtaaccatatat

SEQ ID NO: 48605 - DNA, 25 bp, Homo sapien
cagctatcacttgtaaccatatata

SEQ ID NO: 48606 - DNA, 25 bp, Homo sapien
agctatcacttgtaaccatatatat

SEQ ID NO: 48607 - DNA, 25 bp, Homo sapien
gctatcacttgtaaccatatatata

SEQ ID NO: 48608 - DNA, 25 bp, Homo sapien
ctatcacttgtaaccatatatatat

SEQ ID NO: 48609 - DNA, 25 bp, Homo sapien
tatcacttgtaaccatatatatata

SEQ ID NO: 48610 - DNA, 25 bp, Homo sapien
gggcatccctctctgtcgctggctt

SEQ ID NO: 48611 - DNA, 25 bp, Homo sapien
ctgtcgctggcttccagaggcagga

SEQ ID NO: 48612 - DNA, 25 bp, Homo sapien
aggacaggcctcctggtaagcccgc

SEQ ID NO: 48613 - DNA, 25 bp, Homo sapien
gcctcctggtaagcccgcaaagttg

SEQ ID NO: 48614 - DNA, 25 bp, Homo sapien
tggtaagcccgcaaagttgctgacc

SEQ ID NO: 48615 - DNA, 25 bp, Homo sapien
aaagttgctgacctcctgacttcgt

SEQ ID NO: 48616 - DNA, 25 bp, Homo sapien
ctgacttcgtctgccttttattaat

SEQ ID NO: 48617 - DNA, 25 bp, Homo sapien
gacttcgtctgccttttattaatat

SEQ ID NO: 48618 - DNA, 25 bp, Homo sapien
gtctgccttttattaatatctgtat

SEQ ID NO: 48619 - DNA, 25 bp, Homo sapien
aatatctgtattgctgataaccgtg

SEQ ID NO: 48620 - DNA, 25 bp, Homo sapien
cttgactatgtgtcccaggtcatgt

SEQ ID NO: 48621 - DNA, 25 bp, Homo sapien
atctgggaacgagaatgttgagtaa

SEQ ID NO: 48622 - DNA, 25 bp, Homo sapien
tctgggaacgagaatgttgagtaat

SEQ ID NO: 48623 - DNA, 25 bp, Homo sapien
aacgagaatgttgagtaatggaggg

SEQ ID NO: 48624 - DNA, 25 bp, Homo sapien
gatttccgtgccgttgatgagggtt

SEQ ID NO: 48625 - DNA, 25 bp, Homo sapien
atttccgtgccgttgatgagggttt

SEQ ID NO: 48626 - DNA, 25 bp, Homo sapien
tttccgtgccgttgatgagggtttg

SEQ ID NO: 48627 - DNA, 25 bp, Homo sapien
ttccgtgccgttgatgagggtttgt

SEQ ID NO: 48628 - DNA, 25 bp, Homo sapien
tccgtgccgttgatgagggtttgtc

SEQ ID NO: 48629 - DNA, 25 bp, Homo sapien
ccgtgccgttgatgagggtttgtcc

SEQ ID NO: 48630 - DNA, 25 bp, Homo sapien
cgtgccgttgatgagggtttgtcct

SEQ ID NO: 48631 - DNA, 25 bp, Homo sapien
gtgccgttgatgagggtttgtcctg

SEQ ID NO: 48632 - DNA, 25 bp, Homo sapien
cacagggactcccaccagggtctgg

SEQ ID NO: 48633 - DNA, 25 bp, Homo sapien
acagggactcccaccagggtctggg

SEQ ID NO: 48634 - DNA, 25 bp, Homo sapien
cagggactcccaccagggtctggga

SEQ ID NO: 48635 - DNA, 25 bp, Homo sapien
agggactcccaccagggtctgggag

SEQ ID NO: 48636 - DNA, 25 bp, Homo sapien
ggactcccaccagggtctgggagag

SEQ ID NO: 48637 - DNA, 25 bp, Homo sapien
gtggccccattactgctgccttgct

SEQ ID NO: 48638 - DNA, 25 bp, Homo sapien
tggccccattactgctgccttgctt

SEQ ID NO: 48639 - DNA, 25 bp, Homo sapien
cattactgctgccttgcttcagcca

SEQ ID NO: 48640 - DNA, 25 bp, Homo sapien
attactgctgccttgcttcagccac

SEQ ID NO: 48641 - DNA, 25 bp, Homo sapien
tactgctgccttgcttcagccacct

SEQ ID NO: 48642 - DNA, 25 bp, Homo sapien
tgctgccttgcttcagccacctctc

SEQ ID NO: 48643 - DNA, 25 bp, Homo sapien
cacctggcagaaaatctacttctac

SEQ ID NO: 48644 - DNA, 25 bp, Homo sapien
acctggcagaaaatctacttctaca

SEQ ID NO: 48645 - DNA, 25 bp, Homo sapien
atctacttctacagttggggctgac

SEQ ID NO: 48646 - DNA, 25 bp, Homo sapien
tctacttctacagttggggctgaca

SEQ ID NO: 48647 - DNA, 25 bp, Homo sapien
acttctacagttggggctgacagac

SEQ ID NO: 48648 - DNA, 25 bp, Homo sapien
ctacagttggggctgacagacctcc

SEQ ID NO: 48649 - DNA, 25 bp, Homo sapien
acagttggggctgacagacctcccg

SEQ ID NO: 48650 - DNA, 25 bp, Homo sapien
gttggggctgacagacctcccggaa

SEQ ID NO: 48651 - DNA, 25 bp, Homo sapien
ttggggctgacagacctcccggaag

SEQ ID NO: 48652 - DNA, 25 bp, Homo sapien
gggctgacagacctcccggaaggag

SEQ ID NO: 48653 - DNA, 25 bp, Homo sapien
ggctgacagacctcccggaaggagg

SEQ ID NO: 48654 - DNA, 25 bp, Homo sapien
ccccagggacagtggcgacaggaca

SEQ ID NO: 48655 - DNA, 25 bp, Homo sapien
acagtggcgacaggacagcatgcga

SEQ ID NO: 48656 - DNA, 25 bp, Homo sapien
gcgacaggacagcatgcgaacctat

SEQ ID NO: 48657 - DNA, 25 bp, Homo sapien
gacagcatgcgaacctatgaacggg

SEQ ID NO: 48658 - DNA, 25 bp, Homo sapien
gcgaacctatgaacgggaagccctg

SEQ ID NO: 48659 - DNA, 25 bp, Homo sapien
catgatgcggagtcctccgatgaag

SEQ ID NO: 48660 - DNA, 25 bp, Homo sapien
ggagtcctccgatgaagacggctat

SEQ ID NO: 48661 - DNA, 25 bp, Homo sapien
tcctccgatgaagacggctatgact

SEQ ID NO: 48662 - DNA, 25 bp, Homo sapien
gggtccggccactgacctgtgacct

SEQ ID NO: 48663 - DNA, 25 bp, Homo sapien
cctccgcctggtctttaataaacag

SEQ ID NO: 48664 - DNA, 25 bp, Homo sapien
tccgcctggtctttaataaacagag

SEQ ID NO: 48665 - DNA, 25 bp, Homo sapien
gtgattccttgcaggccagaaatga

SEQ ID NO: 48666 - DNA, 25 bp, Homo sapien
gccagaaatgaagagtccctgtagg

SEQ ID NO: 48667 - DNA, 25 bp, Homo sapien
ccagaaatgaagagtccctgtaggt

SEQ ID NO: 48668 - DNA, 25 bp, Homo sapien
cagaaatgaagagtccctgtaggtt

SEQ ID NO: 48669 - DNA, 25 bp, Homo sapien
agaaatgaagagtccctgtaggttt

SEQ ID NO: 48670 - DNA, 25 bp, Homo sapien
gaaatgaagagtccctgtaggtttt

SEQ ID NO: 48671 - DNA, 25 bp, Homo sapien
aaatgaagagtccctgtaggttttg

SEQ ID NO: 48672 - DNA, 25 bp, Homo sapien
aatgaagagtccctgtaggttttgg

SEQ ID NO: 48673 - DNA, 25 bp, Homo sapien
atgaagagtccctgtaggttttggt

SEQ ID NO: 48674 - DNA, 25 bp, Homo sapien
tgaagagtccctgtaggttttggtt

SEQ ID NO: 48675 - DNA, 25 bp, Homo sapien
ttcatttctccagctaccatgtact

SEQ ID NO: 48676 - DNA, 25 bp, Homo sapien
tttctccagctaccatgtactattg

SEQ ID NO: 48677 - DNA, 25 bp, Homo sapien
tccagctaccatgtactattgttta

SEQ ID NO: 48678 - DNA, 25 bp, Homo sapien
agctaccatgtactattgtttaatg

SEQ ID NO: 48679 - DNA, 25 bp, Homo sapien
ttgtttaatgttcagtttggtttca

SEQ ID NO: 48680 - DNA, 25 bp, Homo sapien
taattttatggttctgtgcgtcccc

SEQ ID NO: 48681 - DNA, 25 bp, Homo sapien
tgtgcgtcccccatatttaatattt

SEQ ID NO: 48682 - DNA, 25 bp, Homo sapien
aatatttattattcaaacgcatgca

SEQ ID NO: 48683 - DNA, 25 bp, Homo sapien
tattcaaacgcatgcatatagacag

SEQ ID NO: 48684 - DNA, 25 bp, Homo sapien
aaacgcatgcatatagacagagcat

SEQ ID NO: 48685 - DNA, 25 bp, Homo sapien
cagaacctaaaaatgcaagatgttt

SEQ ID NO: 48686 - DNA, 25 bp, Homo sapien
gacatcatgctttctggaaacttcc

SEQ ID NO: 48687 - DNA, 25 bp, Homo sapien
tggagcaccttccggcctctacatg

SEQ ID NO: 48688 - DNA, 25 bp, Homo sapien
ggagcaccttccggcctctacatgc

SEQ ID NO: 48689 - DNA, 25 bp, Homo sapien
gagcaccttccggcctctacatgct

SEQ ID NO: 48690 - DNA, 25 bp, Homo sapien
agcaccttccggcctctacatgctg

SEQ ID NO: 48691 - DNA, 25 bp, Homo sapien
gcaccttccggcctctacatgctgt

SEQ ID NO: 48692 - DNA, 25 bp, Homo sapien
caccttccggcctctacatgctgta

SEQ ID NO: 48693 - DNA, 25 bp, Homo sapien
accttccggcctctacatgctgtac

SEQ ID NO: 48694 - DNA, 25 bp, Homo sapien
cttccggcctctacatgctgtacgt

SEQ ID NO: 48695 - DNA, 25 bp, Homo sapien
ttccggcctctacatgctgtacgtt

SEQ ID NO: 48696 - DNA, 25 bp, Homo sapien
tccggcctctacatgctgtacgttc

SEQ ID NO: 48697 - DNA, 25 bp, Homo sapien
ggtgattgtaatttcaggtctgtca

SEQ ID NO: 48698 - DNA, 25 bp, Homo sapien
aggtctgtcactcttgttacattgt

SEQ ID NO: 48699 - DNA, 25 bp, Homo sapien
gttacattgtgtacattcaaaagga

SEQ ID NO: 48700 - DNA, 25 bp, Homo sapien
taactaatttttacttctagcaggt

SEQ ID NO: 48701 - DNA, 25 bp, Homo sapien
gcttcctgtaccttgacatgcaaaa

SEQ ID NO: 48702 - DNA, 25 bp, Homo sapien
cttgacatgcaaaaggctctcctaa

SEQ ID NO: 48703 - DNA, 25 bp, Homo sapien
aaaaggctctcctaatactccacat

SEQ ID NO: 48704 - DNA, 25 bp, Homo sapien
atactccacattcaaactgaagagg

SEQ ID NO: 48705 - DNA, 25 bp, Homo sapien
gaaatctctaatgaagctgctgtgt

SEQ ID NO: 48706 - DNA, 25 bp, Homo sapien
gaagctgctgtgtgtatttatgaat

SEQ ID NO: 48707 - DNA, 25 bp, Homo sapien
taaaaactgcttggatggtttacct

SEQ ID NO: 48708 - DNA, 25 bp, Homo sapien
aggtttacgcaatagcgacgcgctg

SEQ ID NO: 48709 - DNA, 25 bp, Homo sapien
cgcaatagcgacgcgctggcgttac

SEQ ID NO: 48710 - DNA, 25 bp, Homo sapien
gcgacgcgctggcgttacagcgcaa

SEQ ID NO: 48711 - DNA, 25 bp, Homo sapien
gcgctggcgttacagcgcaacagca

SEQ ID NO: 48712 - DNA, 25 bp, Homo sapien
cgttacagcgcaacagcagcctgca

SEQ ID NO: 48713 - DNA, 25 bp, Homo sapien
agcgcaacagcagcctgcagctgga

SEQ ID NO: 48714 - DNA, 25 bp, Homo sapien
cagcagcctgcagctggattacgca

SEQ ID NO: 48715 - DNA, 25 bp, Homo sapien
ctgcagctggattacgcaacagtaa

SEQ ID NO: 48716 - DNA, 25 bp, Homo sapien
catcagcgcgcaagagggcagaccg

SEQ ID NO: 48717 - DNA, 25 bp, Homo sapien
cgcaagagggcagaccgatagaatc

SEQ ID NO: 48718 - DNA, 25 bp, Homo sapien
gggcagaccgatagaatcattggta

SEQ ID NO: 48719 - DNA, 25 bp, Homo sapien
gaccgatagaatcattggtaatgag

SEQ ID NO: 48720 - DNA, 25 bp, Homo sapien
agaatcattggtaatgagcgccgga

SEQ ID NO: 48721 - DNA, 25 bp, Homo sapien
ttggtaatgagcgccggattacgcg

SEQ ID NO: 48722 - DNA, 25 bp, Homo sapien
atgagcgccggattacgcgcgcttg

SEQ ID NO: 48723 - DNA, 25 bp, Homo sapien
gggaaaactgtcgccagttgtgcac

SEQ ID NO: 48724 - DNA, 25 bp, Homo sapien
cgccagttgtgcacttttacaagcc

SEQ ID NO: 48725 - DNA, 25 bp, Homo sapien
cacttttacaagccgcaaaggcagc

SEQ ID NO: 48726 - DNA, 25 bp, Homo sapien
caagccgcaaaggcagcaggctacc

SEQ ID NO: 48727 - DNA, 25 bp, Homo sapien
gcaaaggcagcaggctaccggacgg

SEQ ID NO: 48728 - DNA, 25 bp, Homo sapien
aggctgtgtgtatccccaccaagct

SEQ ID NO: 48729 - DNA, 25 bp, Homo sapien
aagctgtctcccatttccatgctct

SEQ ID NO: 48730 - DNA, 25 bp, Homo sapien
atttccatgctctaccaggacaata

SEQ ID NO: 48731 - DNA, 25 bp, Homo sapien
tgtcattctacgacattatgaagac

SEQ ID NO: 48732 - DNA, 25 bp, Homo sapien
gaaggagtgttcttagggtaaatct

SEQ ID NO: 48733 - DNA, 25 bp, Homo sapien
aaattactgccatggagagtgtccc

SEQ ID NO: 48734 - DNA, 25 bp, Homo sapien
gagagtgtcccttctcactgaccat

SEQ ID NO: 48735 - DNA, 25 bp, Homo sapien
atctctctcaacagctccaattatg

SEQ ID NO: 48736 - DNA, 25 bp, Homo sapien
agctccaattatgctttcatgcaag

SEQ ID NO: 48737 - DNA, 25 bp, Homo sapien
atgcaagccctgatgcatgccgttg

SEQ ID NO: 48738 - DNA, 25 bp, Homo sapien
tgatgcatgccgttgacccagagat

SEQ ID NO: 48739 - DNA, 25 bp, Homo sapien
agccagcagcccaggaggagtcact

SEQ ID NO: 48740 - DNA, 25 bp, Homo sapien
agcccaggaggagtcactctcccag

SEQ ID NO: 48741 - DNA, 25 bp, Homo sapien
cagcaagggcagtcctgcagcctgg

SEQ ID NO: 48742 - DNA, 25 bp, Homo sapien
agtcctgcagcctggtgcatcacca

SEQ ID NO: 48743 - DNA, 25 bp, Homo sapien
agcctggtgcatcaccacttcctga

SEQ ID NO: 48744 - DNA, 25 bp, Homo sapien
ggtgcatcaccacttcctgatggag

SEQ ID NO: 48745 - DNA, 25 bp, Homo sapien
ttcctgatggagagtcagaagcttc

SEQ ID NO: 48746 - DNA, 25 bp, Homo sapien
gagagtcagaagcttccaggcctcc

SEQ ID NO: 48747 - DNA, 25 bp, Homo sapien
cttccaggcctccaagggtccatgg

SEQ ID NO: 48748 - DNA, 25 bp, Homo sapien
tccaagggtccatggaccacctact

SEQ ID NO: 48749 - DNA, 25 bp, Homo sapien
gtccatggaccacctactgagactc

SEQ ID NO: 48750 - DNA, 25 bp, Homo sapien
gagaggaacctagcatccccatcac

SEQ ID NO: 48751 - DNA, 25 bp, Homo sapien
catcaccttccactctggttgaggc

SEQ ID NO: 48752 - DNA, 25 bp, Homo sapien
ccactctggttgaggcaagagaggt

SEQ ID NO: 48753 - DNA, 25 bp, Homo sapien
gaggcaactggtggtcctgagctat

SEQ ID NO: 48754 - DNA, 25 bp, Homo sapien
agctatctggggtccctcgaggaga

SEQ ID NO: 48755 - DNA, 25 bp, Homo sapien
ccacaccatggtctctacgaaaaag

SEQ ID NO: 48756 - DNA, 25 bp, Homo sapien
atagttagtcaccttctgaccttct

SEQ ID NO: 48757 - DNA, 25 bp, Homo sapien
tcaaagccttctgtccctggttttt

SEQ ID NO: 48758 - DNA, 25 bp, Homo sapien
gtccctggtttttgcaagtgctgca

SEQ ID NO: 48759 - DNA, 25 bp, Homo sapien
aagtgctgcatttccgccgagaatc

SEQ ID NO: 48760 - DNA, 25 bp, Homo sapien
gagaatccgcgttgcctactgctgc

SEQ ID NO: 48761 - DNA, 25 bp, Homo sapien
gccacctcctgttcatttagaacta

SEQ ID NO: 48762 - DNA, 25 bp, Homo sapien
agaactatgcaaagactccgcttcc

SEQ ID NO: 48763 - DNA, 25 bp, Homo sapien
aagactccgcttccgttttcctgag

SEQ ID NO: 48764 - DNA, 25 bp, Homo sapien
tgccaaaaattctcctcttcaactt

SEQ ID NO: 48765 - DNA, 25 bp, Homo sapien
ctcttcaacttatagaatgcaccta

SEQ ID NO: 48766 - DNA, 25 bp, Homo sapien
gaagcagctgatcacaaaggaactt

SEQ ID NO: 48767 - DNA, 25 bp, Homo sapien
gaacaccaaagatcaacctaccatt

SEQ ID NO: 48768 - DNA, 25 bp, Homo sapien
atattccaagacctggatgccgata

SEQ ID NO: 48769 - DNA, 25 bp, Homo sapien
gacggagccgtcagctttgaggaat

SEQ ID NO: 48770 - DNA, 25 bp, Homo sapien
gaggaattcgtagtcctggtgtcca

SEQ ID NO: 48771 - DNA, 25 bp, Homo sapien
tccagggtgctgaaaacagcccaca

SEQ ID NO: 48772 - DNA, 25 bp, Homo sapien
acagcccacatagatatccacaaag

SEQ ID NO: 48773 - DNA, 25 bp, Homo sapien
gtaggaagctctttccagcaatgtc

SEQ ID NO: 48774 - DNA, 25 bp, Homo sapien
agcaatgtccccaagaagacttacc

SEQ ID NO: 48775 - DNA, 25 bp, Homo sapien
ctccctgaggctgggttacccgagg

SEQ ID NO: 48776 - DNA, 25 bp, Homo sapien
gacaccctcaacaagcgtgagctga

SEQ ID NO: 48777 - DNA, 25 bp, Homo sapien
tgccaacctcttacgtgcgcctttc

SEQ ID NO: 48778 - DNA, 25 bp, Homo sapien
caacctcttacgtgcgcctttctgc

SEQ ID NO: 48779 - DNA, 25 bp, Homo sapien
gaacagactcaggcgatgtgcttta

SEQ ID NO: 48780 - DNA, 25 bp, Homo sapien
agactcaggcgatgtgctttatggc

SEQ ID NO: 48781 - DNA, 25 bp, Homo sapien
tatggcaggcgcaaactcgattttc

SEQ ID NO: 48782 - DNA, 25 bp, Homo sapien
gcaaactcgattttctacggttgca

SEQ ID NO: 48783 - DNA, 25 bp, Homo sapien
tttctacggttgcaaactgctgacc

SEQ ID NO: 48784 - DNA, 25 bp, Homo sapien
gcaaactggggctaaatccgcagca

SEQ ID NO: 48785 - DNA, 25 bp, Homo sapien
actggggctaaatccgcagcaaact

SEQ ID NO: 48786 - DNA, 25 bp, Homo sapien
gggataacgaacaacagcaacgtct

SEQ ID NO: 48787 - DNA, 25 bp, Homo sapien
acaacagcaacgtcttgaacaggcg

SEQ ID NO: 48788 - DNA, 25 bp, Homo sapien
ggaaggaattgttatgtttgttgag

SEQ ID NO: 48789 - DNA, 25 bp, Homo sapien
gtttgttgagggttttgtcacctga

SEQ ID NO: 48790 - DNA, 25 bp, Homo sapien
gagggttttgtcacctgaactcagc

SEQ ID NO: 48791 - DNA, 25 bp, Homo sapien
ggttttgtcacctgaactcagcaca

SEQ ID NO: 48792 - DNA, 25 bp, Homo sapien
gtcacctgaactcagcacaatgctg

SEQ ID NO: 48793 - DNA, 25 bp, Homo sapien
gcacaatgctggtatatagttgggt

SEQ ID NO: 48794 - DNA, 25 bp, Homo sapien
atgctggtatatagttgggtttaat

SEQ ID NO: 48795 - DNA, 25 bp, Homo sapien
acttactggaagaagcgagaaggat

SEQ ID NO: 48796 - DNA, 25 bp, Homo sapien
gggaaggagggtgttctcatagaat

SEQ ID NO: 48797 - DNA, 25 bp, Homo sapien
ggatgtgttgaaatcatacaaggct

SEQ ID NO: 48798 - DNA, 25 bp, Homo sapien
gaaatcatacaaggctaggtgcagt

SEQ ID NO: 48799 - DNA, 25 bp, Homo sapien
ctctgccaaagaggaaaccaagttt

SEQ ID NO: 48800 - DNA, 25 bp, Homo sapien
aagtttgcacaggttgtactccagg

SEQ ID NO: 48801 - DNA, 25 bp, Homo sapien
gcacaggttgtactccaggatttag

SEQ ID NO: 48802 - DNA, 25 bp, Homo sapien
ggttgtactccaggatttagataaa

SEQ ID NO: 48803 - DNA, 25 bp, Homo sapien
ttacgtgatatattagctgttctta

SEQ ID NO: 48804 - DNA, 25 bp, Homo sapien
ttagctgttcttactatgaaaaggg

SEQ ID NO: 48805 - DNA, 25 bp, Homo sapien
ggaaaatgtgaagcaatctctattg

SEQ ID NO: 48806 - DNA, 25 bp, Homo sapien
atctctattgagatagcatcttagt

SEQ ID NO: 48807 - DNA, 25 bp, Homo sapien
gatagcatcttagtgttttagagaa

SEQ ID NO: 48808 - DNA, 25 bp, Homo sapien
caagaatatcaacatttggttttgt

SEQ ID NO: 48809 - DNA, 25 bp, Homo sapien
catttggttttgtgtataagtggtg

SEQ ID NO: 48810 - DNA, 25 bp, Homo sapien
ggaattctgtcaagatgactgctct

SEQ ID NO: 48811 - DNA, 25 bp, Homo sapien
gatgactgctctatatcacttgaga

SEQ ID NO: 48812 - DNA, 25 bp, Homo sapien
atatcacttgagaatggcattattt

SEQ ID NO: 48813 - DNA, 25 bp, Homo sapien
agcattttttggtagtgcctgtcca

SEQ ID NO: 48814 - DNA, 25 bp, Homo sapien
tagtgcctgtccatacctattgtca

SEQ ID NO: 48815 - DNA, 25 bp, Homo sapien
cctgtccatacctattgtcattgtt

SEQ ID NO: 48816 - DNA, 25 bp, Homo sapien
gtcattgtttgccttgtaatctgtt

SEQ ID NO: 48817 - DNA, 25 bp, Homo sapien
tttgaattcattttgggctgatagt

SEQ ID NO: 48818 - DNA, 25 bp, Homo sapien
gcactttaaaacaaactggtgtgtt

SEQ ID NO: 48819 - DNA, 25 bp, Homo sapien
aaatgcgtggtttttgcattcaaac

SEQ ID NO: 48820 - DNA, 25 bp, Homo sapien
ggtttttgcattcaaacacatccaa

SEQ ID NO: 48821 - DNA, 25 bp, Homo sapien
cccttgaattgctttaactcctaag

SEQ ID NO: 48822 - DNA, 25 bp, Homo sapien
aactcctaagtgtttcagtcctcat

SEQ ID NO: 48823 - DNA, 25 bp, Homo sapien
gtgtttcagtcctcattccggtaaa

SEQ ID NO: 48824 - DNA, 25 bp, Homo sapien
ttccggtaaactccccatgctgatt

SEQ ID NO: 48825 - DNA, 25 bp, Homo sapien
tgaaccataggtacagtttcctttt

SEQ ID NO: 48826 - DNA, 25 bp, Homo sapien
ttgccaaatgtcaaaacaggtacaa

SEQ ID NO: 48827 - DNA, 25 bp, Homo sapien
gtgaatatcatctgcatatctctgt

SEQ ID NO: 48828 - DNA, 25 bp, Homo sapien
atcatctgcatatctctgtaagttc

SEQ ID NO: 48829 - DNA, 25 bp, Homo sapien
atctctgtaagttcaattgtgtttc

SEQ ID NO: 48830 - DNA, 25 bp, Homo sapien
aattgtgtttcttacagtccctgtc

SEQ ID NO: 48831 - DNA, 25 bp, Homo sapien
tcttacagtccctgtcatattacca

SEQ ID NO: 48832 - DNA, 25 bp, Homo sapien
ctgaacttgcggtctccttttgtct

SEQ ID NO: 48833 - DNA, 25 bp, Homo sapien
tgaacttgcggtctccttttgtctg

SEQ ID NO: 48834 - DNA, 25 bp, Homo sapien
gaacttgcggtctccttttgtctgc

SEQ ID NO: 48835 - DNA, 25 bp, Homo sapien
aacttgcggtctccttttgtctgca

SEQ ID NO: 48836 - DNA, 25 bp, Homo sapien
acttgcggtctccttttgtctgcat

SEQ ID NO: 48837 - DNA, 25 bp, Homo sapien
cttgcggtctccttttgtctgcatt

SEQ ID NO: 48838 - DNA, 25 bp, Homo sapien
gcggtctccttttgtctgcattttc

SEQ ID NO: 48839 - DNA, 25 bp, Homo sapien
cggtctccttttgtctgcattttcc

SEQ ID NO: 48840 - DNA, 25 bp, Homo sapien
cgcggtcgcgcctgcaatagcagcg

SEQ ID NO: 48841 - DNA, 25 bp, Homo sapien
gcggtcgcgcctgcaatagcagcgc

SEQ ID NO: 48842 - DNA, 25 bp, Homo sapien
atcttattttctgtccatccgctgg

SEQ ID NO: 48843 - DNA, 25 bp, Homo sapien
tcttattttctgtccatccgctggg

SEQ ID NO: 48844 - DNA, 25 bp, Homo sapien
cttattttctgtccatccgctgggc

SEQ ID NO: 48845 - DNA, 25 bp, Homo sapien
ttattttctgtccatccgctgggcc

SEQ ID NO: 48846 - DNA, 25 bp, Homo sapien
tattttctgtccatccgctgggccc

SEQ ID NO: 48847 - DNA, 25 bp, Homo sapien
attttctgtccatccgctgggccct

SEQ ID NO: 48848 - DNA, 25 bp, Homo sapien
catgtaacttttatgtctggactac

SEQ ID NO: 48849 - DNA, 25 bp, Homo sapien
tgtctggactacagttcaagtggac

SEQ ID NO: 48850 - DNA, 25 bp, Homo sapien
gttgaactgagcaatacctcctcct

SEQ ID NO: 48851 - DNA, 25 bp, Homo sapien
atacctcctcctgtgttgtattaca

SEQ ID NO: 48852 - DNA, 25 bp, Homo sapien
attacacatattagccacgagtttt

SEQ ID NO: 48853 - DNA, 25 bp, Homo sapien
agccacgagtttttgcagtgaccag

SEQ ID NO: 48854 - DNA, 25 bp, Homo sapien
ttttgcagtgaccagataaacttga

SEQ ID NO: 48855 - DNA, 25 bp, Homo sapien
taaacttgaattgacacgtggtgta

SEQ ID NO: 48856 - DNA, 25 bp, Homo sapien
ggacaaattctgtagagtagacaca

SEQ ID NO: 48857 - DNA, 25 bp, Homo sapien
gacacagtgagtatgtggacctctt

SEQ ID NO: 48858 - DNA, 25 bp, Homo sapien
gtgagtatgtggacctcttttataa

SEQ ID NO: 48859 - DNA, 25 bp, Homo sapien
aaaacactctttcctaatctggttg

SEQ ID NO: 48860 - DNA, 25 bp, Homo sapien
tcctaatctggttgtcatgccatga

SEQ ID NO: 48861 - DNA, 25 bp, Homo sapien
acaatcacagcaacagactctcctg

SEQ ID NO: 48862 - DNA, 25 bp, Homo sapien
atcatggtcctggtgagctcctttt

SEQ ID NO: 48863 - DNA, 25 bp, Homo sapien
gttttctattcagtccatagttttc

SEQ ID NO: 48864 - DNA, 25 bp, Homo sapien
catagttttctgacaatttggacaa

SEQ ID NO: 48865 - DNA, 25 bp, Homo sapien
tgtagttgcaaacccaggccagtgg

SEQ ID NO: 48866 - DNA, 25 bp, Homo sapien
gtggatagtgaccaactctgtgttg

SEQ ID NO: 48867 - DNA, 25 bp, Homo sapien
tgtgttggtcgcctcatgtttccca

SEQ ID NO: 48868 - DNA, 25 bp, Homo sapien
agcccttttgtcctcatcatgagtg

SEQ ID NO: 48869 - DNA, 25 bp, Homo sapien
gatactcatatctctcagttctgtt

SEQ ID NO: 48870 - DNA, 25 bp, Homo sapien
aaggacaaagtcatccatcccttca

SEQ ID NO: 48871 - DNA, 25 bp, Homo sapien
aaagtcatccatcccttcagctgaa

SEQ ID NO: 48872 - DNA, 25 bp, Homo sapien
atgaagctggctgcccaaaaggaat

SEQ ID NO: 48873 - DNA, 25 bp, Homo sapien
aaaaggaatcagcacgccggccctt

SEQ ID NO: 48874 - DNA, 25 bp, Homo sapien
gccggcccttcatcttttatagggc

SEQ ID NO: 48875 - DNA, 25 bp, Homo sapien
ttttatagggctcaggtgggctcct

SEQ ID NO: 48876 - DNA, 25 bp, Homo sapien
gctcaccccggatggttcatctgca

SEQ ID NO: 48877 - DNA, 25 bp, Homo sapien
tctgcacctcctgcaattgtaatga

SEQ ID NO: 48878 - DNA, 25 bp, Homo sapien
cctgcaattgtaatgagcctgttgg

SEQ ID NO: 48879 - DNA, 25 bp, Homo sapien
gaattttcatttcaaccagtttgca

SEQ ID NO: 48880 - DNA, 25 bp, Homo sapien
gcaaagctgaaatgagccccagtga

SEQ ID NO: 48881 - DNA, 25 bp, Homo sapien
ccgggccttctcagccttctccccg

SEQ ID NO: 48882 - DNA, 25 bp, Homo sapien
gggccttctcagccttctccccgcg

SEQ ID NO: 48883 - DNA, 25 bp, Homo sapien
tctccccgcggccagctgggtctcc

SEQ ID NO: 48884 - DNA, 25 bp, Homo sapien
gcggccagctgggtctccggggacc

SEQ ID NO: 48885 - DNA, 25 bp, Homo sapien
ggccagctgggtctccggggaccct

SEQ ID NO: 48886 - DNA, 25 bp, Homo sapien
gccctgggccgcccattcctggccc

SEQ ID NO: 48887 - DNA, 25 bp, Homo sapien
tgggccgcccattcctggccctccc

SEQ ID NO: 48888 - DNA, 25 bp, Homo sapien
ccctcccgctgcatctcagacctga

SEQ ID NO: 48889 - DNA, 25 bp, Homo sapien
gctgcatctcagacctgacacccaa

SEQ ID NO: 48890 - DNA, 25 bp, Homo sapien
tgcatctcagacctgacacccaacg

SEQ ID NO: 48891 - DNA, 25 bp, Homo sapien
gcatctcagacctgacacccaacgg

SEQ ID NO: 48892 - DNA, 25 bp, Homo sapien
tggcctgtgcccaccttctctccct

SEQ ID NO: 48893 - DNA, 25 bp, Homo sapien
cctccctggcctccagaggtggcgt

SEQ ID NO: 48894 - DNA, 25 bp, Homo sapien
ccccacccctgtgtgtttcgccagt

SEQ ID NO: 48895 - DNA, 25 bp, Homo sapien
tactggttttgggttggttgttctg

SEQ ID NO: 48896 - DNA, 25 bp, Homo sapien
tgtgctgggagaccggacccggggc

SEQ ID NO: 48897 - DNA, 25 bp, Homo sapien
cggagcccgccgtgcagaaactggc

SEQ ID NO: 48898 - DNA, 25 bp, Homo sapien
agccccggttgctgcgttgggactt

SEQ ID NO: 48899 - DNA, 25 bp, Homo sapien
tgctgcgttgggacttgaccttctc

SEQ ID NO: 48900 - DNA, 25 bp, Homo sapien
agaaatccttgcctgtcgctctaga

SEQ ID NO: 48901 - DNA, 25 bp, Homo sapien
tcgctctagagtccgacgaggagaa

SEQ ID NO: 48902 - DNA, 25 bp, Homo sapien
gatgagctcaagtccagtacgggct

SEQ ID NO: 48903 - DNA, 25 bp, Homo sapien
tcagcgcctatcctggtggtcatgg

SEQ ID NO: 48904 - DNA, 25 bp, Homo sapien
gtggtcatggtgatcttgctcaaca

SEQ ID NO: 48905 - DNA, 25 bp, Homo sapien
tgatcttgctcaacatcggagtcgc

SEQ ID NO: 48906 - DNA, 25 bp, Homo sapien
tcggagtcgccattctgtttattaa

SEQ ID NO: 48907 - DNA, 25 bp, Homo sapien
atctgatgagatgtcgcggtagcaa

SEQ ID NO: 48908 - DNA, 25 bp, Homo sapien
agctgcaggcctacatcgcacagtg

SEQ ID NO: 48909 - DNA, 25 bp, Homo sapien
tacatcgcacagtgccaggacagcc

SEQ ID NO: 48910 - DNA, 25 bp, Homo sapien
cctcggaggagcattcgctgctggt

SEQ ID NO: 48911 - DNA, 25 bp, Homo sapien
cgctgctggtgaattgattcgacct

SEQ ID NO: 48912 - DNA, 25 bp, Homo sapien
ttgattcgacctgactgccgttgga

SEQ ID NO: 48913 - DNA, 25 bp, Homo sapien
gacctgactgccgttggaccgtagg

SEQ ID NO: 48914 - DNA, 25 bp, Homo sapien
gaccgtaggccctggactgcagaga

SEQ ID NO: 48915 - DNA, 25 bp, Homo sapien
cgcttatttatttgtagggtttgct

SEQ ID NO: 48916 - DNA, 25 bp, Homo sapien
gtttgcttttaaggatcggctccct

SEQ ID NO: 48917 - DNA, 25 bp, Homo sapien
tttaaggatcggctccctgtcgcgc

SEQ ID NO: 48918 - DNA, 25 bp, Homo sapien
tggacctttcgtgtcggacccttgg

SEQ ID NO: 48919 - DNA, 25 bp, Homo sapien
gcatcctggagatccgctctgtaca

SEQ ID NO: 48920 - DNA, 25 bp, Homo sapien
agatccgctctgtacacgtgggcgt

SEQ ID NO: 48921 - DNA, 25 bp, Homo sapien
tgggcgtcgtggtcatcaaagcagt

SEQ ID NO: 48922 - DNA, 25 bp, Homo sapien
gtggtcatcaaagcagtgtcctcag

SEQ ID NO: 48923 - DNA, 25 bp, Homo sapien
tcaggcttctacgtggccatgaacc

SEQ ID NO: 48924 - DNA, 25 bp, Homo sapien
ttctacgtggccatgaaccgccggg

SEQ ID NO: 48925 - DNA, 25 bp, Homo sapien
acgggtcgcgactctacaccgtgga

SEQ ID NO: 48926 - DNA, 25 bp, Homo sapien
acaccgtggactgcaggttccggga

SEQ ID NO: 48927 - DNA, 25 bp, Homo sapien
ttccgggagcgcatcgaagagaacg

SEQ ID NO: 48928 - DNA, 25 bp, Homo sapien
gaagagaacggccacaacacctacg

SEQ ID NO: 48929 - DNA, 25 bp, Homo sapien
agcccatgttcctggcgctggacag

SEQ ID NO: 48930 - DNA, 25 bp, Homo sapien
gatggcgcttgagcaccgcatcggc

SEQ ID NO: 48931 - DNA, 25 bp, Homo sapien
cgcttgagcaccgcatcggctgcat

SEQ ID NO: 48932 - DNA, 25 bp, Homo sapien
gcaccgcatcggctgcattgtggtg

SEQ ID NO: 48933 - DNA, 25 bp, Homo sapien
gcatcggctgcattgtggtggataa

SEQ ID NO: 48934 - DNA, 25 bp, Homo sapien
ggataatttctatgaaatcgcgctt

SEQ ID NO: 48935 - DNA, 25 bp, Homo sapien
atttctatgaaatcgcgcttcttga

SEQ ID NO: 48936 - DNA, 25 bp, Homo sapien
ctatgaaatcgcgcttcttgaagac

SEQ ID NO: 48937 - DNA, 25 bp, Homo sapien
aatcgcgcttcttgaagacctatgt

SEQ ID NO: 48938 - DNA, 25 bp, Homo sapien
gtcactccatcgatgttcttcttcg

SEQ ID NO: 48939 - DNA, 25 bp, Homo sapien
ttcggatcacgcccggagtagaagc

SEQ ID NO: 48940 - DNA, 25 bp, Homo sapien
gatcacgcccggagtagaagcgcat

SEQ ID NO: 48941 - DNA, 25 bp, Homo sapien
tagaagcgcatacgcatgactacat

SEQ ID NO: 48942 - DNA, 25 bp, Homo sapien
agcgcatacgcatgactacattaca

SEQ ID NO: 48943 - DNA, 25 bp, Homo sapien
atacgcatgactacattacaacggg

SEQ ID NO: 48944 - DNA, 25 bp, Homo sapien
tcgatcttcataacggacaaactga

SEQ ID NO: 48945 - DNA, 25 bp, Homo sapien
attacaatcggaacacattcagctg

SEQ ID NO: 48946 - DNA, 25 bp, Homo sapien
aatcggaacacattcagctgctggg

SEQ ID NO: 48947 - DNA, 25 bp, Homo sapien
aacacattcagctgctgggtgtcca

SEQ ID NO: 48948 - DNA, 25 bp, Homo sapien
cattcagctgctgggtgtccattgc

SEQ ID NO: 48949 - DNA, 25 bp, Homo sapien
agctgctgggtgtccattgccatat

SEQ ID NO: 48950 - DNA, 25 bp, Homo sapien
gcaaggaaagctcacgaaccccaaa

SEQ ID NO: 48951 - DNA, 25 bp, Homo sapien
gaaagctcacgaaccccaaacctgg

SEQ ID NO: 48952 - DNA, 25 bp, Homo sapien
tggcaagtcacctgcagcccatggt

SEQ ID NO: 48953 - DNA, 25 bp, Homo sapien
tgcagcccatggtgagctctgggaa

SEQ ID NO: 48954 - DNA, 25 bp, Homo sapien
ctctgggaagtgtggttgaggcctt

SEQ ID NO: 48955 - DNA, 25 bp, Homo sapien
ggtcactccttttttgcatgtgcaa

SEQ ID NO: 48956 - DNA, 25 bp, Homo sapien
atgtgcaaatgtgctggtcaccctt

SEQ ID NO: 48957 - DNA, 25 bp, Homo sapien
aatgtgctggtcacccttcaacgct

SEQ ID NO: 48958 - DNA, 25 bp, Homo sapien
tcaacgctcccagacggtcaggaaa

SEQ ID NO: 48959 - DNA, 25 bp, Homo sapien
gtggtcttcaagacgacagctctgt

SEQ ID NO: 48960 - DNA, 25 bp, Homo sapien
aagacgacagctctgtatctgccat

SEQ ID NO: 48961 - DNA, 25 bp, Homo sapien
gcctggccaacatggtgaaaccccg

SEQ ID NO: 48962 - DNA, 25 bp, Homo sapien
gcgcgcgcctgtaatcccagctact

SEQ ID NO: 48963 - DNA, 25 bp, Homo sapien
gcgcgcctgtaatcccagctactcg

SEQ ID NO: 48964 - DNA, 25 bp, Homo sapien
cgcgcctgtaatcccagctactcgg

SEQ ID NO: 48965 - DNA, 25 bp, Homo sapien
gcgcctgtaatcccagctactcggg

SEQ ID NO: 48966 - DNA, 25 bp, Homo sapien
cgcctgtaatcccagctactcggga

SEQ ID NO: 48967 - DNA, 25 bp, Homo sapien
gcctgtaatcccagctactcgggag

SEQ ID NO: 48968 - DNA, 25 bp, Homo sapien
cctgtaatcccagctactcgggagg

SEQ ID NO: 48969 - DNA, 25 bp, Homo sapien
ctgtaatcccagctactcgggaggc

SEQ ID NO: 48970 - DNA, 25 bp, Homo sapien
tgtaatcccagctactcgggaggct

SEQ ID NO: 48971 - DNA, 25 bp, Homo sapien
gtaatcccagctactcgggaggctg

SEQ ID NO: 48972 - DNA, 25 bp, Homo sapien
taatcccagctactcgggaggctga

SEQ ID NO: 48973 - DNA, 25 bp, Homo sapien
aatcccagctactcgggaggctgag

SEQ ID NO: 48974 - DNA, 25 bp, Homo sapien
atcccagctactcgggaggctgagg

SEQ ID NO: 48975 - DNA, 25 bp, Homo sapien
tcccagctactcgggaggctgaggc

SEQ ID NO: 48976 - DNA, 25 bp, Homo sapien
cccagctactcgggaggctgaggca

SEQ ID NO: 48977 - DNA, 25 bp, Homo sapien
ccagctactcgggaggctgaggcag

SEQ ID NO: 48978 - DNA, 25 bp, Homo sapien
tggtggctcacgcctgtaatcccag

SEQ ID NO: 48979 - DNA, 25 bp, Homo sapien
gagccgagatcgcgccactgcactc

SEQ ID NO: 48980 - DNA, 25 bp, Homo sapien
gtggctcacgcctgtaatcccagca

SEQ ID NO: 48981 - DNA, 25 bp, Homo sapien
tggctcacgcctgtaatcccagcac

SEQ ID NO: 48982 - DNA, 25 bp, Homo sapien
cactgcactccagcctgggcgacag

SEQ ID NO: 48983 - DNA, 25 bp, Homo sapien
actgcactccagcctgggcgacaga

SEQ ID NO: 48984 - DNA, 25 bp, Homo sapien
ctgcactccagcctgggcgacagag

SEQ ID NO: 48985 - DNA, 25 bp, Homo sapien
tgcactccagcctgggcgacagagc

SEQ ID NO: 48986 - DNA, 25 bp, Homo sapien
gcactccagcctgggcgacagagcg

SEQ ID NO: 48987 - DNA, 25 bp, Homo sapien
cactccagcctgggcgacagagcga

SEQ ID NO: 48988 - DNA, 25 bp, Homo sapien
ggctcacgcctgtaatcccagcact

SEQ ID NO: 48989 - DNA, 25 bp, Homo sapien
actccagcctgggcgacagagcgag

SEQ ID NO: 48990 - DNA, 25 bp, Homo sapien
ctccagcctgggcgacagagcgaga

SEQ ID NO: 48991 - DNA, 25 bp, Homo sapien
tccagcctgggcgacagagcgagac

SEQ ID NO: 48992 - DNA, 25 bp, Homo sapien
ccagcctgggcgacagagcgagact

SEQ ID NO: 48993 - DNA, 25 bp, Homo sapien
cagcctgggcgacagagcgagactc

SEQ ID NO: 48994 - DNA, 25 bp, Homo sapien
agcctgggcgacagagcgagactcc

SEQ ID NO: 48995 - DNA, 25 bp, Homo sapien
gctcacgcctgtaatcccagcactt

SEQ ID NO: 48996 - DNA, 25 bp, Homo sapien
ctcacgcctgtaatcccagcacttt

SEQ ID NO: 48997 - DNA, 25 bp, Homo sapien
tcacgcctgtaatcccagcactttg

SEQ ID NO: 48998 - DNA, 25 bp, Homo sapien
cacgcctgtaatcccagcactttgg

SEQ ID NO: 48999 - DNA, 25 bp, Homo sapien
acgcctgtaatcccagcactttggg

SEQ ID NO: 49000 - DNA, 25 bp, Homo sapien
cgcctgtaatcccagcactttggga

SEQ ID NO: 49001 - DNA, 25 bp, Homo sapien
gcctgtaatcccagcactttgggag

SEQ ID NO: 49002 - DNA, 25 bp, Homo sapien
cctgtaatcccagcactttgggagg

SEQ ID NO: 49003 - DNA, 25 bp, Homo sapien
ctgtaatcccagcactttgggaggc

SEQ ID NO: 49004 - DNA, 25 bp, Homo sapien
tgtaatcccagcactttgggaggcc

SEQ ID NO: 49005 - DNA, 25 bp, Homo sapien
gtaatcccagcactttgggaggccg

SEQ ID NO: 49006 - DNA, 25 bp, Homo sapien
taatcccagcactttgggaggccga

SEQ ID NO: 49007 - DNA, 25 bp, Homo sapien
aatcccagcactttgggaggccgag

SEQ ID NO: 49008 - DNA, 25 bp, Homo sapien
atcccagcactttgggaggccgagg

SEQ ID NO: 49009 - DNA, 25 bp, Homo sapien
tcccagcactttgggaggccgaggt

SEQ ID NO: 49010 - DNA, 25 bp, Homo sapien
cccagcactttgggaggccgaggtg

SEQ ID NO: 49011 - DNA, 25 bp, Homo sapien
gtggatcacctgaggtcaggagttc

SEQ ID NO: 49012 - DNA, 25 bp, Homo sapien
ggatcacctgaggtcaggagttcaa

SEQ ID NO: 49013 - DNA, 25 bp, Homo sapien
gatcacctgaggtcaggagttcaag

SEQ ID NO: 49014 - DNA, 25 bp, Homo sapien
atcacctgaggtcaggagttcaaga

SEQ ID NO: 49015 - DNA, 25 bp, Homo sapien
tcacctgaggtcaggagttcaagac

SEQ ID NO: 49016 - DNA, 25 bp, Homo sapien
aggagttcaagaccagcctggccaa

SEQ ID NO: 49017 - DNA, 25 bp, Homo sapien
ggagttcaagaccagcctggccaac

SEQ ID NO: 49018 - DNA, 25 bp, Homo sapien
gagttcaagaccagcctggccaaca

SEQ ID NO: 49019 - DNA, 25 bp, Homo sapien
agttcaagaccagcctggccaacat

SEQ ID NO: 49020 - DNA, 25 bp, Homo sapien
gttcaagaccagcctggccaacatg

SEQ ID NO: 49021 - DNA, 25 bp, Homo sapien
ttcaagaccagcctggccaacatgg

SEQ ID NO: 49022 - DNA, 25 bp, Homo sapien
tcaagaccagcctggccaacatggt

SEQ ID NO: 49023 - DNA, 25 bp, Homo sapien
caagaccagcctggccaacatggtg

SEQ ID NO: 49024 - DNA, 25 bp, Homo sapien
aagaccagcctggccaacatggtga

SEQ ID NO: 49025 - DNA, 25 bp, Homo sapien
agaccagcctggccaacatggtgaa

SEQ ID NO: 49026 - DNA, 25 bp, Homo sapien
gaccagcctggccaacatggtgaaa

SEQ ID NO: 49027 - DNA, 25 bp, Homo sapien
accagcctggccaacatggtgaaac

SEQ ID NO: 49028 - DNA, 25 bp, Homo sapien
ccagcctggccaacatggtgaaacc

SEQ ID NO: 49029 - DNA, 25 bp, Homo sapien
cagcctggccaacatggtgaaaccc

SEQ ID NO: 49030 - DNA, 25 bp, Homo sapien
gagactctagcagaaatggcctgtt

SEQ ID NO: 49031 - DNA, 25 bp, Homo sapien
gaaatggcctgtttgtacatttata

SEQ ID NO: 49032 - DNA, 25 bp, Homo sapien
tatatctcttccttctagttggctg

SEQ ID NO: 49033 - DNA, 25 bp, Homo sapien
ctcttccttctagttggctgtattt

SEQ ID NO: 49034 - DNA, 25 bp, Homo sapien
cttcatttttggcacctcacagaac

SEQ ID NO: 49035 - DNA, 25 bp, Homo sapien
gcacctcacagaacaaattagccca

SEQ ID NO: 49036 - DNA, 25 bp, Homo sapien
tagcccataaattcaacacctggag

SEQ ID NO: 49037 - DNA, 25 bp, Homo sapien
ggcaatgtgcctaacgattttgatg

SEQ ID NO: 49038 - DNA, 25 bp, Homo sapien
aagtttcccaagctacttcctacag

SEQ ID NO: 49039 - DNA, 25 bp, Homo sapien
agctacttcctacagtattttggtc

SEQ ID NO: 49040 - DNA, 25 bp, Homo sapien
gaatgcgttttagttcttcaccttt

SEQ ID NO: 49041 - DNA, 25 bp, Homo sapien
aaggaagttcagtcttgtctttgat

SEQ ID NO: 49042 - DNA, 25 bp, Homo sapien
ttgtctttgatatcagcccctgcaa

SEQ ID NO: 49043 - DNA, 25 bp, Homo sapien
cctgcaaggcgctcaatgggaaggt

SEQ ID NO: 49044 - DNA, 25 bp, Homo sapien
atgggaaggttgttcttggctcacc

SEQ ID NO: 49045 - DNA, 25 bp, Homo sapien
ttggctcacctgaagcatgaaactg

SEQ ID NO: 49046 - DNA, 25 bp, Homo sapien
gaaactgtgtattatttggacgtca

SEQ ID NO: 49047 - DNA, 25 bp, Homo sapien
attatttggacgtcagcctgtggat

SEQ ID NO: 49048 - DNA, 25 bp, Homo sapien
cagcctgtggatttgatacgactta

SEQ ID NO: 49049 - DNA, 25 bp, Homo sapien
tacgacttaaccacgtcagaggaag

SEQ ID NO: 49050 - DNA, 25 bp, Homo sapien
ctttggcaagtgatattgtcttcat

SEQ ID NO: 49051 - DNA, 25 bp, Homo sapien
aacagatgtcttcttgcaatatttt

SEQ ID NO: 49052 - DNA, 25 bp, Homo sapien
tacccgaacgtcatcaggcgtggca

SEQ ID NO: 49053 - DNA, 25 bp, Homo sapien
ggtggacgagcgtccgcatgctaat

SEQ ID NO: 49054 - DNA, 25 bp, Homo sapien
cgtccgcatgctaatcgctttttac

SEQ ID NO: 49055 - DNA, 25 bp, Homo sapien
tttaccgccagatgaaatcgaacag

SEQ ID NO: 49056 - DNA, 25 bp, Homo sapien
gatgaaatcgaacagtcgctgaacg

SEQ ID NO: 49057 - DNA, 25 bp, Homo sapien
aacagtcgctgaacggcgtgcatta

SEQ ID NO: 49058 - DNA, 25 bp, Homo sapien
acatcatattcagcccatcacgctg

SEQ ID NO: 49059 - DNA, 25 bp, Homo sapien
ttcagcccatcacgctgtggtttga

SEQ ID NO: 49060 - DNA, 25 bp, Homo sapien
atcacgctgtggtttgatgatgcgc

SEQ ID NO: 49061 - DNA, 25 bp, Homo sapien
ggtttgatgatgcgctcagtgccat

SEQ ID NO: 49062 - DNA, 25 bp, Homo sapien
atgatgcgctcagtgccatgcgttc

SEQ ID NO: 49063 - DNA, 25 bp, Homo sapien
ctcagtgccatgcgttcgctgaaag

SEQ ID NO: 49064 - DNA, 25 bp, Homo sapien
catgcgttcgctgaaaggcatcggt

SEQ ID NO: 49065 - DNA, 25 bp, Homo sapien
ctgaaaggcatcggtgccacgcatc

SEQ ID NO: 49066 - DNA, 25 bp, Homo sapien
ggcatcggtgccacgcatcttcatg

SEQ ID NO: 49067 - DNA, 25 bp, Homo sapien
tgccacgcatcttcatgaagggcgc

SEQ ID NO: 49068 - DNA, 25 bp, Homo sapien
atcttcatgaagggcgcgacccgcg

SEQ ID NO: 49069 - DNA, 25 bp, Homo sapien
attaacgcgttcgcagttgcagcga

SEQ ID NO: 49070 - DNA, 25 bp, Homo sapien
gcgttcgcagttgcagcgattgcaa

SEQ ID NO: 49071 - DNA, 25 bp, Homo sapien
agttgcagcgattgcaactggcctg

SEQ ID NO: 49072 - DNA, 25 bp, Homo sapien
catgctctgcgtgtatttggcttct

SEQ ID NO: 49073 - DNA, 25 bp, Homo sapien
gcttctgatgaatctgcttatgtaa

SEQ ID NO: 49074 - DNA, 25 bp, Homo sapien
tgcttatgtaactggtaaccctgtc

SEQ ID NO: 49075 - DNA, 25 bp, Homo sapien
actggtaaccctgtcatcattgatg

SEQ ID NO: 49076 - DNA, 25 bp, Homo sapien
ggctggagcttgtgattttaggatc

SEQ ID NO: 49077 - DNA, 25 bp, Homo sapien
gattttaggatctccatggtgggaa

SEQ ID NO: 49078 - DNA, 25 bp, Homo sapien
aaggcaggcccttcctatccacagt

SEQ ID NO: 49079 - DNA, 25 bp, Homo sapien
ctatccacagtgaacctggttacga

SEQ ID NO: 49080 - DNA, 25 bp, Homo sapien
atcatctccttcctgttaatcacat

SEQ ID NO: 49081 - DNA, 25 bp, Homo sapien
gatgtcactgtttgcaagagtctga

SEQ ID NO: 49082 - DNA, 25 bp, Homo sapien
gtaatctcttctgaaatcattgtaa

SEQ ID NO: 49083 - DNA, 25 bp, Homo sapien
cagtccctgaccctggcgatcgatt

SEQ ID NO: 49084 - DNA, 25 bp, Homo sapien
tggcgatcgattcttgtcatggcac

SEQ ID NO: 49085 - DNA, 25 bp, Homo sapien
atcgattcttgtcatggcactgtgg

SEQ ID NO: 49086 - DNA, 25 bp, Homo sapien
gtcatggcactgtggttgctctccg

SEQ ID NO: 49087 - DNA, 25 bp, Homo sapien
tctccgctatgcttggaccacgtgg

SEQ ID NO: 49088 - DNA, 25 bp, Homo sapien
ggaccacgtggccttgtgaatataa

SEQ ID NO: 49089 - DNA, 25 bp, Homo sapien
aatataagcagtgtcccctatacca

SEQ ID NO: 49090 - DNA, 25 bp, Homo sapien
ctcccttcattgctttcattacaga

SEQ ID NO: 49091 - DNA, 25 bp, Homo sapien
tgctttcattacagaccagggtcct

SEQ ID NO: 49092 - DNA, 25 bp, Homo sapien
gcaatgttgctaaatgactgtttca

SEQ ID NO: 49093 - DNA, 25 bp, Homo sapien
aggatgggtccttcagattttagca

SEQ ID NO: 49094 - DNA, 25 bp, Homo sapien
tgaagattgatcagcttgtgtatgg

SEQ ID NO: 49095 - DNA, 25 bp, Homo sapien
gaaaattgctttgatcgcgcatgac

SEQ ID NO: 49096 - DNA, 25 bp, Homo sapien
aaagaatcatgatctatacgcaacc

SEQ ID NO: 49097 - DNA, 25 bp, Homo sapien
gtcatttttttgcgcgacccgctga

SEQ ID NO: 49098 - DNA, 25 bp, Homo sapien
tgaaccggatgtctcggcattaatc

SEQ ID NO: 49099 - DNA, 25 bp, Homo sapien
ccgtttatgtgatgtgtattccatt

SEQ ID NO: 49100 - DNA, 25 bp, Homo sapien
ctgcggaaattcttgtgcgcacact

SEQ ID NO: 49101 - DNA, 25 bp, Homo sapien
gcggaaattcttgtgcgcacacttg

SEQ ID NO: 49102 - DNA, 25 bp, Homo sapien
atgaaggtgttttcgaattccgtga

SEQ ID NO: 49103 - DNA, 25 bp, Homo sapien
ccgaatgtataatgctgacgttctt

SEQ ID NO: 49104 - DNA, 25 bp, Homo sapien
cccacagtgatgatgtcgagatcgg

SEQ ID NO: 49105 - DNA, 25 bp, Homo sapien
tgccccatggtcaagggtgtcctgc

SEQ ID NO: 49106 - DNA, 25 bp, Homo sapien
tggtcaagggtgtcctgcctgcctg

SEQ ID NO: 49107 - DNA, 25 bp, Homo sapien
agggagccacatggatcccgagact

SEQ ID NO: 49108 - DNA, 25 bp, Homo sapien
tcttggctgaaaacactgaggtgct

SEQ ID NO: 49109 - DNA, 25 bp, Homo sapien
aaaacactgaggtgctcccatctgt

SEQ ID NO: 49110 - DNA, 25 bp, Homo sapien
atggtcctccagctgcccacaaggt

SEQ ID NO: 49111 - DNA, 25 bp, Homo sapien
gtctctgcaccacctgtttgcataa

SEQ ID NO: 49112 - DNA, 25 bp, Homo sapien
gcaccacctgtttgcataaacacac

SEQ ID NO: 49113 - DNA, 25 bp, Homo sapien
acacactttgctacaatcttgctag

SEQ ID NO: 49114 - DNA, 25 bp, Homo sapien
aatcttgctagtgcgttttcttaaa

SEQ ID NO: 49115 - DNA, 25 bp, Homo sapien
aattggactttgcaaaagcttttag

SEQ ID NO: 49116 - DNA, 25 bp, Homo sapien
tggcagaacgaacaccacattttga

SEQ ID NO: 49117 - DNA, 25 bp, Homo sapien
tatctgatgtgatgcctgttgagtc

SEQ ID NO: 49118 - DNA, 25 bp, Homo sapien
gtgatgcctgttgagtcagatgctt

SEQ ID NO: 49119 - DNA, 25 bp, Homo sapien
ttgagtcagatgctttcatttacac

SEQ ID NO: 49120 - DNA, 25 bp, Homo sapien
tgctttcatttacacagatatccat

SEQ ID NO: 49121 - DNA, 25 bp, Homo sapien
tacacagatatccatgcctgtttta

SEQ ID NO: 49122 - DNA, 25 bp, Homo sapien
gatatccatgcctgttttacagaaa

SEQ ID NO: 49123 - DNA, 25 bp, Homo sapien
aaaaattgcattagagcacggagtc

SEQ ID NO: 49124 - DNA, 25 bp, Homo sapien
agggatcggagccatcatcgcgcca

SEQ ID NO: 49125 - DNA, 25 bp, Homo sapien
gagccatcatcgcgccaaattttgc

SEQ ID NO: 49126 - DNA, 25 bp, Homo sapien
tcatcgcgccaaattttgcgctcgg

SEQ ID NO: 49127 - DNA, 25 bp, Homo sapien
aaattttgcgctcggtgcgatactg

SEQ ID NO: 49128 - DNA, 25 bp, Homo sapien
cgctcggtgcgatactgatgatgaa

SEQ ID NO: 49129 - DNA, 25 bp, Homo sapien
tgccaactattttgaggatgttgag

SEQ ID NO: 49130 - DNA, 25 bp, Homo sapien
gagattattgagcttcatcatgacc

SEQ ID NO: 49131 - DNA, 25 bp, Homo sapien
agcttcatcatgaccagaagcttga

SEQ ID NO: 49132 - DNA, 25 bp, Homo sapien
catgaccagaagcttgacgcaccaa

SEQ ID NO: 49133 - DNA, 25 bp, Homo sapien
gaagcttgacgcaccaagcggaact

SEQ ID NO: 49134 - DNA, 25 bp, Homo sapien
caagcggaactgcgcttaaaacagc

SEQ ID NO: 49135 - DNA, 25 bp, Homo sapien
agcagcaaggacatccggatgaaaa

SEQ ID NO: 49136 - DNA, 25 bp, Homo sapien
aactatcgcattcagtgctgcacta

SEQ ID NO: 49137 - DNA, 25 bp, Homo sapien
tgctgcactagcacagtcaaccaag

SEQ ID NO: 49138 - DNA, 25 bp, Homo sapien
cacagtcaaccaagcccaggtctgg

SEQ ID NO: 49139 - DNA, 25 bp, Homo sapien
cctgtggaagcggttttgctggact

SEQ ID NO: 49140 - DNA, 25 bp, Homo sapien
ggactgatgggagccactggaattt

SEQ ID NO: 49141 - DNA, 25 bp, Homo sapien
tggaattttgcttactggtccccag

SEQ ID NO: 49142 - DNA, 25 bp, Homo sapien
aatgggcaaggctcctgtgtggccc

SEQ ID NO: 49143 - DNA, 25 bp, Homo sapien
tgtgtggccctatgcaccaaaggag

SEQ ID NO: 49144 - DNA, 25 bp, Homo sapien
tattggcgacgagctcaatgcgaca

SEQ ID NO: 49145 - DNA, 25 bp, Homo sapien
aatgcgacaagcaactgcccttcgt

SEQ ID NO: 49146 - DNA, 25 bp, Homo sapien
tccttctaagccagcggcacggaga

SEQ ID NO: 49147 - DNA, 25 bp, Homo sapien
agcagtaactgacaacttgaataat

SEQ ID NO: 49148 - DNA, 25 bp, Homo sapien
agatcatttcaaaactcatttccta

SEQ ID NO: 49149 - DNA, 25 bp, Homo sapien
aactcatttcctatgtaactgcatt

SEQ ID NO: 49150 - DNA, 25 bp, Homo sapien
atgtaactgcattgagaactgcata

SEQ ID NO: 49151 - DNA, 25 bp, Homo sapien
gaactgcatatgtttcgctgatata

SEQ ID NO: 49152 - DNA, 25 bp, Homo sapien
tgtttttcacatttgcgaatggttc

SEQ ID NO: 49153 - DNA, 25 bp, Homo sapien
gttccattctctctcctgtactttt

SEQ ID NO: 49154 - DNA, 25 bp, Homo sapien
ctcctgtactttttccagacacttt

SEQ ID NO: 49155 - DNA, 25 bp, Homo sapien
tccttatcactgacacaaaaagtag

SEQ ID NO: 49156 - DNA, 25 bp, Homo sapien
ttcttcccttttacatactgctgtc

SEQ ID NO: 49157 - DNA, 25 bp, Homo sapien
ccttttacatactgctgtctatgtg

SEQ ID NO: 49158 - DNA, 25 bp, Homo sapien
ttccactactgctaccacaactata

SEQ ID NO: 49159 - DNA, 25 bp, Homo sapien
tgctaccacaactatattatcatgc

SEQ ID NO: 49160 - DNA, 25 bp, Homo sapien
atcatgcaaatgctgtattcttctt

SEQ ID NO: 49161 - DNA, 25 bp, Homo sapien
taaagtatctgtattgcattaaata

SEQ ID NO: 49162 - DNA, 25 bp, Homo sapien
ataatatcgacacagtgctttccgt

SEQ ID NO: 49163 - DNA, 25 bp, Homo sapien
tgctttccgtggcactgcatacaat

SEQ ID NO: 49164 - DNA, 25 bp, Homo sapien
tggcactgcatacaatctgaggcct

SEQ ID NO: 49165 - DNA, 25 bp, Homo sapien
atacaatctgaggcctcctctctca

SEQ ID NO: 49166 - DNA, 25 bp, Homo sapien
gaggcctcctctctcagtttttata

SEQ ID NO: 49167 - DNA, 25 bp, Homo sapien
gaccatcccgagctgaatatcgggg

SEQ ID NO: 49168 - DNA, 25 bp, Homo sapien
atcggggtcattgccaatgatatgg

SEQ ID NO: 49169 - DNA, 25 bp, Homo sapien
ctgtctcccgatgaaaacatatctt

SEQ ID NO: 49170 - DNA, 25 bp, Homo sapien
gagctctaggcccaaaacgacctta

SEQ ID NO: 49171 - DNA, 25 bp, Homo sapien
atggtcatgctgccgcaggatgatc

SEQ ID NO: 49172 - DNA, 25 bp, Homo sapien
tccggggcgctgcatagagtgctgt

SEQ ID NO: 49173 - DNA, 25 bp, Homo sapien
gtctgcattttcttggagaaattta

SEQ ID NO: 49174 - DNA, 25 bp, Homo sapien
cctgtcaaaaattgagtcacgtccg

SEQ ID NO: 49175 - DNA, 25 bp, Homo sapien
ctgtcaaaaattgagtcacgtccga

SEQ ID NO: 49176 - DNA, 25 bp, Homo sapien
tcaaaaattgagtcacgtccgacta

SEQ ID NO: 49177 - DNA, 25 bp, Homo sapien
gagtcacgtccgactaaaaccggat

SEQ ID NO: 49178 - DNA, 25 bp, Homo sapien
gcgaccgtggcctccccaggaaagt

SEQ ID NO: 49179 - DNA, 25 bp, Homo sapien
tccccaggaaagttgggaaactgtg

SEQ ID NO: 49180 - DNA, 25 bp, Homo sapien
actgtggttgcttttgagctccctg

SEQ ID NO: 49181 - DNA, 25 bp, Homo sapien
tggttgcttttgagctccctgtggc

SEQ ID NO: 49182 - DNA, 25 bp, Homo sapien
tccctgtggccgtcttcagagtatg

SEQ ID NO: 49183 - DNA, 25 bp, Homo sapien
gtggcagggcctggccgacctaatt

SEQ ID NO: 49184 - DNA, 25 bp, Homo sapien
ggcctggccgacctaattcaattag

SEQ ID NO: 49185 - DNA, 25 bp, Homo sapien
taattcaattagctgggccgccgcc

SEQ ID NO: 49186 - DNA, 25 bp, Homo sapien
gctgctctttgtgcacgaagaccat

SEQ ID NO: 49187 - DNA, 25 bp, Homo sapien
ttgtgcacgaagaccatgcatatgg

SEQ ID NO: 49188 - DNA, 25 bp, Homo sapien
atgcatatggatgcggttcctcccc

SEQ ID NO: 49189 - DNA, 25 bp, Homo sapien
gatcgccaggcgttttctgagcata

SEQ ID NO: 49190 - DNA, 25 bp, Homo sapien
tctgtccgtttgccggtcgtgggcg

SEQ ID NO: 49191 - DNA, 25 bp, Homo sapien
cggaaatggtttcccgcagaacctg

SEQ ID NO: 49192 - DNA, 25 bp, Homo sapien
gatgttcgcgattatcttctatatc

SEQ ID NO: 49193 - DNA, 25 bp, Homo sapien
ttgggccagctaaacatgcttcatc

SEQ ID NO: 49194 - DNA, 25 bp, Homo sapien
gctgtttcactggttatgcggcgga

SEQ ID NO: 49195 - DNA, 25 bp, Homo sapien
gccggtgaacgtgcaaaacaggctc

SEQ ID NO: 49196 - DNA, 25 bp, Homo sapien
gcaaaacaggctctagcgttcgaac

SEQ ID NO: 49197 - DNA, 25 bp, Homo sapien
gcactgatttcgaccaggttcgttc

SEQ ID NO: 49198 - DNA, 25 bp, Homo sapien
atcgctgccaggatatacgtaatct

SEQ ID NO: 49199 - DNA, 25 bp, Homo sapien
gggattgcttataacaccctgttac

SEQ ID NO: 49200 - DNA, 25 bp, Homo sapien
gatgtttatgaagctgttcgaaccc

SEQ ID NO: 49201 - DNA, 25 bp, Homo sapien
tatgaagctgttcgaacccaatccc

SEQ ID NO: 49202 - DNA, 25 bp, Homo sapien
aagctgttcgaacccaatcccagtt

SEQ ID NO: 49203 - DNA, 25 bp, Homo sapien
gaacccaatcccagttggcagtgca

SEQ ID NO: 49204 - DNA, 25 bp, Homo sapien
atcccagttggcagtgcagatccgg

SEQ ID NO: 49205 - DNA, 25 bp, Homo sapien
gggacgagaaacactgaccttatat

SEQ ID NO: 49206 - DNA, 25 bp, Homo sapien
cgagaaacactgaccttatatgtga

SEQ ID NO: 49207 - DNA, 25 bp, Homo sapien
gtcacagaatgaatagatcaccaag

SEQ ID NO: 49208 - DNA, 25 bp, Homo sapien
tttctggctgaggttctgagggcac

SEQ ID NO: 49209 - DNA, 25 bp, Homo sapien
ggcaccgagacagagggttaaatga

SEQ ID NO: 49210 - DNA, 25 bp, Homo sapien
gatggtacaaaatgctgaagatgtt

SEQ ID NO: 49211 - DNA, 25 bp, Homo sapien
gtactgaagagcagctaaggcgcct

SEQ ID NO: 49212 - DNA, 25 bp, Homo sapien
aggcgcctgcaagaggagaagcttt

SEQ ID NO: 49213 - DNA, 25 bp, Homo sapien
gagaagctttgcaaaatctgtatgg

SEQ ID NO: 49214 - DNA, 25 bp, Homo sapien
attgctatcgtttttgttccttgtg

SEQ ID NO: 49215 - DNA, 25 bp, Homo sapien
gttccttgtggacatctagtcactt

SEQ ID NO: 49216 - DNA, 25 bp, Homo sapien
ggacatctagtcacttgtaaacaat

SEQ ID NO: 49217 - DNA, 25 bp, Homo sapien
gtgctgaagcagttgacaagtgtcc

SEQ ID NO: 49218 - DNA, 25 bp, Homo sapien
gttgacaagtgtcccatgtgctaca

SEQ ID NO: 49219 - DNA, 25 bp, Homo sapien
gtgctacacagtcattactttcaag

SEQ ID NO: 49220 - DNA, 25 bp, Homo sapien
aatctaactctatagtaggcatgtt

SEQ ID NO: 49221 - DNA, 25 bp, Homo sapien
atgttgttcttattaccctgattga

SEQ ID NO: 49222 - DNA, 25 bp, Homo sapien
gatcattcactgttcctatggttct

SEQ ID NO: 49223 - DNA, 25 bp, Homo sapien
gttcctatggttctatgtatctttc

SEQ ID NO: 49224 - DNA, 25 bp, Homo sapien
tctttcaaaccgatacctttactat

SEQ ID NO: 49225 - DNA, 25 bp, Homo sapien
agatggtcatacttactgactttat

SEQ ID NO: 49226 - DNA, 25 bp, Homo sapien
atacttactgactttatctatttaa

SEQ ID NO: 49227 - DNA, 25 bp, Homo sapien
aaactatatcttggctagtggctac

SEQ ID NO: 49228 - DNA, 25 bp, Homo sapien
tagtggctactgtgtctgtgaatgt

SEQ ID NO: 49229 - DNA, 25 bp, Homo sapien
gtctgtgaatgtaaccagtacttct

SEQ ID NO: 49230 - DNA, 25 bp, Homo sapien
cagtacttctttaagctctattcag

SEQ ID NO: 49231 - DNA, 25 bp, Homo sapien
aagctctattcagtagggttccagc

SEQ ID NO: 49232 - DNA, 25 bp, Homo sapien
ttccagccactgcttttttgttgtt

SEQ ID NO: 49233 - DNA, 25 bp, Homo sapien
atacggccggttttgtgttagcagc

SEQ ID NO: 49234 - DNA, 25 bp, Homo sapien
ggccggttttgtgttagcagcggaa

SEQ ID NO: 49235 - DNA, 25 bp, Homo sapien
gttttgtgttagcagcggaaaaaat

SEQ ID NO: 49236 - DNA, 25 bp, Homo sapien
tattcatttgtatccaaggtgctga

SEQ ID NO: 49237 - DNA, 25 bp, Homo sapien
ttcatttgtatccaaggtgctgaat

SEQ ID NO: 49238 - DNA, 25 bp, Homo sapien
ttgtatccaaggtgctgaatcttgg

SEQ ID NO: 49239 - DNA, 25 bp, Homo sapien
gtgctgaatcttggaggaggtttcg

SEQ ID NO: 49240 - DNA, 25 bp, Homo sapien
tcatgccactgaatacgttgaaaaa

SEQ ID NO: 49241 - DNA, 25 bp, Homo sapien
atgccactgaatacgttgaaaaaat

SEQ ID NO: 49242 - DNA, 25 bp, Homo sapien
gaaccgggccgttctctcgtgggag

SEQ ID NO: 49243 - DNA, 25 bp, Homo sapien
cgggccgttctctcgtgggagacgc

SEQ ID NO: 49244 - DNA, 25 bp, Homo sapien
cccgcgggcgtgagactcagccgct

SEQ ID NO: 49245 - DNA, 25 bp, Homo sapien
cgtgagactcagccgctgtctcgcc

SEQ ID NO: 49246 - DNA, 25 bp, Homo sapien
gtgagactcagccgctgtctcgccg

SEQ ID NO: 49247 - DNA, 25 bp, Homo sapien
tgagactcagccgctgtctcgccgt

SEQ ID NO: 49248 - DNA, 25 bp, Homo sapien
agactcagccgctgtctcgccgtgt

SEQ ID NO: 49249 - DNA, 25 bp, Homo sapien
tctccaccgagcggcgtgtaggagt

SEQ ID NO: 49250 - DNA, 25 bp, Homo sapien
tccaccgagcggcgtgtaggagtgc

SEQ ID NO: 49251 - DNA, 25 bp, Homo sapien
ggacttagccggcgcctgcacgtgt

SEQ ID NO: 49252 - DNA, 25 bp, Homo sapien
tgcacgtgtcccgggtcgaccagca

SEQ ID NO: 49253 - DNA, 25 bp, Homo sapien
gtagcagagcagctccctcgctgcg

SEQ ID NO: 49254 - DNA, 25 bp, Homo sapien
tagcagagcagctccctcgctgcga

SEQ ID NO: 49255 - DNA, 25 bp, Homo sapien
gcagagcagctccctcgctgcgatc

SEQ ID NO: 49256 - DNA, 25 bp, Homo sapien
agctccctcgctgcgatctattgaa

SEQ ID NO: 49257 - DNA, 25 bp, Homo sapien
gctccctcgctgcgatctattgaaa

SEQ ID NO: 49258 - DNA, 25 bp, Homo sapien
tccctcgctgcgatctattgaaagt

SEQ ID NO: 49259 - DNA, 25 bp, Homo sapien
ccctcgctgcgatctattgaaagtc

SEQ ID NO: 49260 - DNA, 25 bp, Homo sapien
cctcgctgcgatctattgaaagtca

SEQ ID NO: 49261 - DNA, 25 bp, Homo sapien
ctcgctgcgatctattgaaagtcag

SEQ ID NO: 49262 - DNA, 25 bp, Homo sapien
tattgaaagtcagccctcgacacaa

SEQ ID NO: 49263 - DNA, 25 bp, Homo sapien
tcctccgcacgggtcgaccagcaga

SEQ ID NO: 49264 - DNA, 25 bp, Homo sapien
gccaggcgttttctgagcatacctg

SEQ ID NO: 49265 - DNA, 25 bp, Homo sapien
gcggcatggtgcaagttgaataacc

SEQ ID NO: 49266 - DNA, 25 bp, Homo sapien
gaagatgttcgcgattatcttctat

SEQ ID NO: 49267 - DNA, 25 bp, Homo sapien
tctatatcttcaggcgcgcggtctg

SEQ ID NO: 49268 - DNA, 25 bp, Homo sapien
gcaacatttgggccagctaaacatg

SEQ ID NO: 49269 - DNA, 25 bp, Homo sapien
ccagctaaacatgcttcatcgtcgg

SEQ ID NO: 49270 - DNA, 25 bp, Homo sapien
ccgggctgccacgaccaagtgacag

SEQ ID NO: 49271 - DNA, 25 bp, Homo sapien
gaccaagtgacagcaatgctgtttc

SEQ ID NO: 49272 - DNA, 25 bp, Homo sapien
aatgctgtttcactggttatgcggc

SEQ ID NO: 49273 - DNA, 25 bp, Homo sapien
atgccggtgaacgtgcaaaacaggc

SEQ ID NO: 49274 - DNA, 25 bp, Homo sapien
acgtgcaaaacaggctctagcgttc

SEQ ID NO: 49275 - DNA, 25 bp, Homo sapien
atttgcctgcattaccggtcgatgc

SEQ ID NO: 49276 - DNA, 25 bp, Homo sapien
ctctagcgttcgaacgcactgattt

SEQ ID NO: 49277 - DNA, 25 bp, Homo sapien
tcgttcactcatggaaaatagcgat

SEQ ID NO: 49278 - DNA, 25 bp, Homo sapien
atggaaaatagcgatcgctgccagg

SEQ ID NO: 49279 - DNA, 25 bp, Homo sapien
taccggtcgatgcaacgagtgatga

SEQ ID NO: 49280 - DNA, 25 bp, Homo sapien
tcagggttaaagatatctcacgtac

SEQ ID NO: 49281 - DNA, 25 bp, Homo sapien
gagtgatgaggttcgcaagaacctg

SEQ ID NO: 49282 - DNA, 25 bp, Homo sapien
gcaagaacctgatggacatgttcag

SEQ ID NO: 49283 - DNA, 25 bp, Homo sapien
gacatgttcagggatcgccaggcgt

SEQ ID NO: 49284 - DNA, 25 bp, Homo sapien
tcttggccatggacagcctgcacag

SEQ ID NO: 49285 - DNA, 25 bp, Homo sapien
ttggccatggacagcctgcacagga

SEQ ID NO: 49286 - DNA, 25 bp, Homo sapien
atggacagcctgcacaggaccgcct

SEQ ID NO: 49287 - DNA, 25 bp, Homo sapien
actgtgctcccatttctgtccttgg

SEQ ID NO: 49288 - DNA, 25 bp, Homo sapien
atttctgtccttggccttgggagta

SEQ ID NO: 49289 - DNA, 25 bp, Homo sapien
ggcagactagggagtagggctggca

SEQ ID NO: 49290 - DNA, 25 bp, Homo sapien
cggtcccatccttggagggactaag

SEQ ID NO: 49291 - DNA, 25 bp, Homo sapien
gatctcaactcgtggcactaacttg

SEQ ID NO: 49292 - DNA, 25 bp, Homo sapien
ctcaactcgtggcactaacttggaa

SEQ ID NO: 49293 - DNA, 25 bp, Homo sapien
aactcgtggcactaacttggaaaag

SEQ ID NO: 49294 - DNA, 25 bp, Homo sapien
ggcactaacttggaaaagggttgat

SEQ ID NO: 49295 - DNA, 25 bp, Homo sapien
agtggcactcccagctcggatgccg

SEQ ID NO: 49296 - DNA, 25 bp, Homo sapien
ggcactcccagctcggatgccgtgt

SEQ ID NO: 49297 - DNA, 25 bp, Homo sapien
aagcgcttggacaggctggaggaga

SEQ ID NO: 49298 - DNA, 25 bp, Homo sapien
tggaggagacagtccaggccaagta

SEQ ID NO: 49299 - DNA, 25 bp, Homo sapien
aggagacagtccaggccaagtagag

SEQ ID NO: 49300 - DNA, 25 bp, Homo sapien
ggagacagtccaggccaagtagagc

SEQ ID NO: 49301 - DNA, 25 bp, Homo sapien
gacagtccaggccaagtagagcccc

SEQ ID NO: 49302 - DNA, 25 bp, Homo sapien
acagtccaggccaagtagagccccg

SEQ ID NO: 49303 - DNA, 25 bp, Homo sapien
gtccaggccaagtagagccccgcag

SEQ ID NO: 49304 - DNA, 25 bp, Homo sapien
tccaggccaagtagagccccgcagg

SEQ ID NO: 49305 - DNA, 25 bp, Homo sapien
caggccaagtagagccccgcagggc

SEQ ID NO: 49306 - DNA, 25 bp, Homo sapien
atgaatgtggatagctgcctttttt

SEQ ID NO: 49307 - DNA, 25 bp, Homo sapien
ttaaggtgttggtgtatttgccagc

SEQ ID NO: 49308 - DNA, 25 bp, Homo sapien
ctttatttgtatttgccattcagtc

SEQ ID NO: 49309 - DNA, 25 bp, Homo sapien
ttatttgtatttgccattcagtcta

SEQ ID NO: 49310 - DNA, 25 bp, Homo sapien
attcagtctagcttttaagtatatt

SEQ ID NO: 49311 - DNA, 25 bp, Homo sapien
gcacattagttttgcatctgttttg

SEQ ID NO: 49312 - DNA, 25 bp, Homo sapien
gttttgcatctgttttgtgacctgt

SEQ ID NO: 49313 - DNA, 25 bp, Homo sapien
ttgcatctgttttgtgacctgttag

SEQ ID NO: 49314 - DNA, 25 bp, Homo sapien
ctgttttgtgacctgttagatgtga

SEQ ID NO: 49315 - DNA, 25 bp, Homo sapien
gtgacctgttagatgtgacacattc

SEQ ID NO: 49316 - DNA, 25 bp, Homo sapien
agatgtgacacattctctttttgtt

SEQ ID NO: 49317 - DNA, 25 bp, Homo sapien
aagttggaatgggagttggcgggca

SEQ ID NO: 49318 - DNA, 25 bp, Homo sapien
gagttggcgggcagtgaacgagtgt

SEQ ID NO: 49319 - DNA, 25 bp, Homo sapien
gggccgtttggctgcactaactttg

SEQ ID NO: 49320 - DNA, 25 bp, Homo sapien
ccgtttggctgcactaactttggta

SEQ ID NO: 49321 - DNA, 25 bp, Homo sapien
tttggctgcactaactttggtagct

SEQ ID NO: 49322 - DNA, 25 bp, Homo sapien
agggagctaagcttgggctgggctg

SEQ ID NO: 49323 - DNA, 25 bp, Homo sapien
cttggcatagggtggaaagggctac

SEQ ID NO: 49324 - DNA, 25 bp, Homo sapien
tagtatgtgtggagggtgccctccc

SEQ ID NO: 49325 - DNA, 25 bp, Homo sapien
atgtgtggagggtgccctcccgtct

SEQ ID NO: 49326 - DNA, 25 bp, Homo sapien
tcccacaacttctgctataacaata

SEQ ID NO: 49327 - DNA, 25 bp, Homo sapien
cacaacttctgctataacaataaac

SEQ ID NO: 49328 - DNA, 25 bp, Homo sapien
aaaatctatgttgaatccttttata

SEQ ID NO: 49329 - DNA, 25 bp, Homo sapien
aaccagtatcactttgtaatataaa

SEQ ID NO: 49330 - DNA, 25 bp, Homo sapien
gtaatataaacacctatttgtactt

SEQ ID NO: 49331 - DNA, 25 bp, Homo sapien
attttcttaattcattggacacatt

SEQ ID NO: 49332 - DNA, 25 bp, Homo sapien
ttcattggacacatttgacttactg

SEQ ID NO: 49333 - DNA, 25 bp, Homo sapien
tactgcacagtatattgatcatttt

SEQ ID NO: 49334 - DNA, 25 bp, Homo sapien
taatgggaaactttagctttctact

SEQ ID NO: 49335 - DNA, 25 bp, Homo sapien
ggtttttcactttctatgccattat

SEQ ID NO: 49336 - DNA, 25 bp, Homo sapien
tttcactttctatgccattattttt

SEQ ID NO: 49337 - DNA, 25 bp, Homo sapien
tctttttcttagtgtgagctctaaa

SEQ ID NO: 49338 - DNA, 25 bp, Homo sapien
gtgagctctaaaatcaatgttcttg

SEQ ID NO: 49339 - DNA, 25 bp, Homo sapien
ggagtggagcctgcggcttaatttg

SEQ ID NO: 49340 - DNA, 25 bp, Homo sapien
cccggacacggacaggattgacaga

SEQ ID NO: 49341 - DNA, 25 bp, Homo sapien
gtggtggtgcatggccgttcttagt

SEQ ID NO: 49342 - DNA, 25 bp, Homo sapien
agcgatttgtctggttaattccgat

SEQ ID NO: 49343 - DNA, 25 bp, Homo sapien
taattccgataacgaacgagactct

SEQ ID NO: 49344 - DNA, 25 bp, Homo sapien
cgaacgagactctggcatgctaact

SEQ ID NO: 49345 - DNA, 25 bp, Homo sapien
ctctggcatgctaactagttacgcg

SEQ ID NO: 49346 - DNA, 25 bp, Homo sapien
gggacaagtggcgttcagccacccg

SEQ ID NO: 49347 - DNA, 25 bp, Homo sapien
gttcagccacccgagattgagcaat

SEQ ID NO: 49348 - DNA, 25 bp, Homo sapien
caggtctgtgatgcccttagatgtc

SEQ ID NO: 49349 - DNA, 25 bp, Homo sapien
gcccttagatgtccggggctgcacg

SEQ ID NO: 49350 - DNA, 25 bp, Homo sapien
cacgcgcgctacactgactggctca

SEQ ID NO: 49351 - DNA, 25 bp, Homo sapien
actgactggctcagcgtgtgcctac

SEQ ID NO: 49352 - DNA, 25 bp, Homo sapien
agcgtgtgcctaccctacgccggca

SEQ ID NO: 49353 - DNA, 25 bp, Homo sapien
attgcaattattccccatgaacgag

SEQ ID NO: 49354 - DNA, 25 bp, Homo sapien
ggaattcccagtaagtgcgggtcat

SEQ ID NO: 49355 - DNA, 25 bp, Homo sapien
aagtgcgggtcataagcttgcgttg

SEQ ID NO: 49356 - DNA, 25 bp, Homo sapien
gggtcataagcttgcgttgattaag

SEQ ID NO: 49357 - DNA, 25 bp, Homo sapien
ccgtcgctactaccgattggatggt

SEQ ID NO: 49358 - DNA, 25 bp, Homo sapien
tgagaagacggtcgaacttgactat

SEQ ID NO: 49359 - DNA, 25 bp, Homo sapien
gtccatagcacagtacatgcagcat

SEQ ID NO: 49360 - DNA, 25 bp, Homo sapien
atagcacagtacatgcagcatctaa

SEQ ID NO: 49361 - DNA, 25 bp, Homo sapien
gcacagtacatgcagcatctaataa

SEQ ID NO: 49362 - DNA, 25 bp, Homo sapien
agtacatgcagcatctaataagagt

SEQ ID NO: 49363 - DNA, 25 bp, Homo sapien
aataagagtttccattgtagaatgt

SEQ ID NO: 49364 - DNA, 25 bp, Homo sapien
taaactatcaatggcatttcaagtc

SEQ ID NO: 49365 - DNA, 25 bp, Homo sapien
actatcaatggcatttcaagtcttc

SEQ ID NO: 49366 - DNA, 25 bp, Homo sapien
tgaaacagcatggctgtatgtgcgt

SEQ ID NO: 49367 - DNA, 25 bp, Homo sapien
tgcgtggtccatagcacagtacatg

SEQ ID NO: 49368 - DNA, 25 bp, Homo sapien
gcgtggtccatagcacagtacatgc

SEQ ID NO: 49369 - DNA, 25 bp, Homo sapien
gtggtccatagcacagtacatgcag

SEQ ID NO: 49370 - DNA, 25 bp, Homo sapien
ttgccgcgactgtgaagataaagtt

SEQ ID NO: 49371 - DNA, 25 bp, Homo sapien
tgccgcgactgtgaagataaagttc

SEQ ID NO: 49372 - DNA, 25 bp, Homo sapien
ataatagttctactgcccgtgtctc

SEQ ID NO: 49373 - DNA, 25 bp, Homo sapien
taatagttctactgcccgtgtctcc

SEQ ID NO: 49374 - DNA, 25 bp, Homo sapien
ttctactgcccgtgtctccagaatg

SEQ ID NO: 49375 - DNA, 25 bp, Homo sapien
tactgcccgtgtctccagaatgtag

SEQ ID NO: 49376 - DNA, 25 bp, Homo sapien
actgcccgtgtctccagaatgtaga

SEQ ID NO: 49377 - DNA, 25 bp, Homo sapien
ctgcccgtgtctccagaatgtagag

SEQ ID NO: 49378 - DNA, 25 bp, Homo sapien
tgcccgtgtctccagaatgtagagc

SEQ ID NO: 49379 - DNA, 25 bp, Homo sapien
cgtgtctccagaatgtagagcccat

SEQ ID NO: 49380 - DNA, 25 bp, Homo sapien
gtgtctccagaatgtagagcccatc

SEQ ID NO: 49381 - DNA, 25 bp, Homo sapien
tgtctccagaatgtagagcccatca

SEQ ID NO: 49382 - DNA, 25 bp, Homo sapien
tctccagaatgtagagcccatcaat

SEQ ID NO: 49383 - DNA, 25 bp, Homo sapien
ctccagaatgtagagcccatcaata

SEQ ID NO: 49384 - DNA, 25 bp, Homo sapien
tatcaccacaactgaagtgaggaac

SEQ ID NO: 49385 - DNA, 25 bp, Homo sapien
caccacaactgaagtgaggaacgga

SEQ ID NO: 49386 - DNA, 25 bp, Homo sapien
gtcttcttggacagcttgtacagca

SEQ ID NO: 49387 - DNA, 25 bp, Homo sapien
cagggcagccagatgaatggttctc

SEQ ID NO: 49388 - DNA, 25 bp, Homo sapien
acttggaccctttctagtctcaagg

SEQ ID NO: 49389 - DNA, 25 bp, Homo sapien
ggattccagccttcagaaggttctt

SEQ ID NO: 49390 - DNA, 25 bp, Homo sapien
ttgggatatggaacaggccgtgcac

SEQ ID NO: 49391 - DNA, 25 bp, Homo sapien
ggccgtgcacaactttgacatctgg

SEQ ID NO: 49392 - DNA, 25 bp, Homo sapien
tgacatctggtcttgctccatagag

SEQ ID NO: 49393 - DNA, 25 bp, Homo sapien
gatagaccatgagacagcttgagcc

SEQ ID NO: 49394 - DNA, 25 bp, Homo sapien
gagcctcaggattcttgttcttcct

SEQ ID NO: 49395 - DNA, 25 bp, Homo sapien
tcctcttatcttccttttgtggttt

SEQ ID NO: 49396 - DNA, 25 bp, Homo sapien
aagaccccagagaattccattacat

SEQ ID NO: 49397 - DNA, 25 bp, Homo sapien
atttccgtgccgttgatgagggttt

SEQ ID NO: 49398 - DNA, 25 bp, Homo sapien
caaacagctctcacaggacctggct

SEQ ID NO: 49399 - DNA, 25 bp, Homo sapien
gctctcacaggacctggctgtcaac

SEQ ID NO: 49400 - DNA, 25 bp, Homo sapien
tctcacaggacctggctgtcaacct

SEQ ID NO: 49401 - DNA, 25 bp, Homo sapien
acctggctgtcaacctccttgttgc

SEQ ID NO: 49402 - DNA, 25 bp, Homo sapien
cccactgttgccttgagaattgaag

SEQ ID NO: 49403 - DNA, 25 bp, Homo sapien
ccactgttgccttgagaattgaaga

SEQ ID NO: 49404 - DNA, 25 bp, Homo sapien
agacatgtaggtgactcacaaactt

SEQ ID NO: 49405 - DNA, 25 bp, Homo sapien
acatgtaggtgactcacaaacttct

SEQ ID NO: 49406 - DNA, 25 bp, Homo sapien
ttcttggaaagagaccctgtgtgaa

SEQ ID NO: 49407 - DNA, 25 bp, Homo sapien
tcttggaaagagaccctgtgtgaat

SEQ ID NO: 49408 - DNA, 25 bp, Homo sapien
ctttggaccacagatacccaagtca

SEQ ID NO: 49409 - DNA, 25 bp, Homo sapien
tggaccacagatacccaagtcagtc

SEQ ID NO: 49410 - DNA, 25 bp, Homo sapien
gtttcagagtattggccagtgtact

SEQ ID NO: 49411 - DNA, 25 bp, Homo sapien
ttggccagtgtactttccttcttcc

SEQ ID NO: 49412 - DNA, 25 bp, Homo sapien
ggccagtgtactttccttcttcctc

SEQ ID NO: 49413 - DNA, 25 bp, Homo sapien
gattttccggattattttcaggcct

SEQ ID NO: 49414 - DNA, 25 bp, Homo sapien
ttattttcaggcctaattcctcgct

SEQ ID NO: 49415 - DNA, 25 bp, Homo sapien
caggcctaattcctcgcttaattaa

SEQ ID NO: 49416 - DNA, 25 bp, Homo sapien
ttaaaattgctcctgcttgtgccat

SEQ ID NO: 49417 - DNA, 25 bp, Homo sapien
gcttgtgccattatgatcagtacat

SEQ ID NO: 49418 - DNA, 25 bp, Homo sapien
caaaatgttcgaaggcagcaatact

SEQ ID NO: 49419 - DNA, 25 bp, Homo sapien
gcaatactagtgatgctggttcaac

SEQ ID NO: 49420 - DNA, 25 bp, Homo sapien
gatgctggttcaacttggaacaaca

SEQ ID NO: 49421 - DNA, 25 bp, Homo sapien
ggaacaacactatgcccaagaagat

SEQ ID NO: 49422 - DNA, 25 bp, Homo sapien
ggttttcaccattattctctccaat

SEQ ID NO: 49423 - DNA, 25 bp, Homo sapien
tctctccaatgatttatgtctttct

SEQ ID NO: 49424 - DNA, 25 bp, Homo sapien
acagctcatagctcgtcatctcggc

SEQ ID NO: 49425 - DNA, 25 bp, Homo sapien
ttgtccacactctccaagcacatta

SEQ ID NO: 49426 - DNA, 25 bp, Homo sapien
gggacctgattgctacacgttcaga

SEQ ID NO: 49427 - DNA, 25 bp, Homo sapien
cacgttcagaatgcgtttgctgtca

SEQ ID NO: 49428 - DNA, 25 bp, Homo sapien
aatgcgtttgctgtcatcctgcttg

SEQ ID NO: 49429 - DNA, 25 bp, Homo sapien
gcacgagttagttgtagtccggctt

SEQ ID NO: 49430 - DNA, 25 bp, Homo sapien
agttagttgtagtccggcttgcggt

SEQ ID NO: 49431 - DNA, 25 bp, Homo sapien
gggctgacttcctgttggtttgagc

SEQ ID NO: 49432 - DNA, 25 bp, Homo sapien
gacttcctgttggtttgagcccctt

SEQ ID NO: 49433 - DNA, 25 bp, Homo sapien
ttgccctctgggtgttttctttggt

SEQ ID NO: 49434 - DNA, 25 bp, Homo sapien
gtgttttctttggtcccgcaggagg

SEQ ID NO: 49435 - DNA, 25 bp, Homo sapien
tcttggccatggacagcctgcacag

SEQ ID NO: 49436 - DNA, 25 bp, Homo sapien
ttggccatggacagcctgcacagga

SEQ ID NO: 49437 - DNA, 25 bp, Homo sapien
tggccatggacagcctgcacaggac

SEQ ID NO: 49438 - DNA, 25 bp, Homo sapien
atggacagcctgcacaggaccgcct

SEQ ID NO: 49439 - DNA, 25 bp, Homo sapien
actgtgctcccatttctgtccttgg

SEQ ID NO: 49440 - DNA, 25 bp, Homo sapien
ggcagactagggagtagggctggca

SEQ ID NO: 49441 - DNA, 25 bp, Homo sapien
gatctcaactcgtggcactaacttg

SEQ ID NO: 49442 - DNA, 25 bp, Homo sapien
atctcaactcgtggcactaacttgg

SEQ ID NO: 49443 - DNA, 25 bp, Homo sapien
ctcaactcgtggcactaacttggaa

SEQ ID NO: 49444 - DNA, 25 bp, Homo sapien
tcaactcgtggcactaacttggaaa

SEQ ID NO: 49445 - DNA, 25 bp, Homo sapien
aactcgtggcactaacttggaaaag

SEQ ID NO: 49446 - DNA, 25 bp, Homo sapien
aaggcagcgggtgaaatgtgtcaat

SEQ ID NO: 49447 - DNA, 25 bp, Homo sapien
gtcaatgaaggctatgcccagctcc

SEQ ID NO: 49448 - DNA, 25 bp, Homo sapien
tccgccatcatctgccagaggagta

SEQ ID NO: 49449 - DNA, 25 bp, Homo sapien
gtatttggagaagcgactcagcaaa

SEQ ID NO: 49450 - DNA, 25 bp, Homo sapien
aagtggaaaccctcagagctgcgat

SEQ ID NO: 49451 - DNA, 25 bp, Homo sapien
cagagctgcgatcaagtacattaac

SEQ ID NO: 49452 - DNA, 25 bp, Homo sapien
gtacattaactacctgcagtctctt

SEQ ID NO: 49453 - DNA, 25 bp, Homo sapien
cagtctcttctgtaccctgataaag

SEQ ID NO: 49454 - DNA, 25 bp, Homo sapien
gtaccctgataaagctgagaccaag

SEQ ID NO: 49455 - DNA, 25 bp, Homo sapien
gaaaagtttcctccatgatagcaac

SEQ ID NO: 49456 - DNA, 25 bp, Homo sapien
gaattgtttgagttgctgtttccaa

SEQ ID NO: 49457 - DNA, 25 bp, Homo sapien
gagcacgagagacccgagttcatcg

SEQ ID NO: 49458 - DNA, 25 bp, Homo sapien
gtaaccatactctattccataaccc

SEQ ID NO: 49459 - DNA, 25 bp, Homo sapien
ctctattccataaccctcatgtgaa

SEQ ID NO: 49460 - DNA, 25 bp, Homo sapien
ctcatgtgaatccacttccaactgg

SEQ ID NO: 49461 - DNA, 25 bp, Homo sapien
acttccaactggctacgaagatgaa

SEQ ID NO: 49462 - DNA, 25 bp, Homo sapien
aagagaatctggaccactacccggg

SEQ ID NO: 49463 - DNA, 25 bp, Homo sapien
agcactggtttggaccgttactctg

SEQ ID NO: 49464 - DNA, 25 bp, Homo sapien
gtttggaccgttactctgcacatgg

SEQ ID NO: 49465 - DNA, 25 bp, Homo sapien
gtatatgggaccttaagctaacctt

SEQ ID NO: 49466 - DNA, 25 bp, Homo sapien
taagctaaccttctttacttgtatc

SEQ ID NO: 49467 - DNA, 25 bp, Homo sapien
gatgactggtatactggtctcccat

SEQ ID NO: 49468 - DNA, 25 bp, Homo sapien
cgctggtgcagggatcgttacccga

SEQ ID NO: 49469 - DNA, 25 bp, Homo sapien
gtggacgagcgtccgcatgctaatc

SEQ ID NO: 49470 - DNA, 25 bp, Homo sapien
accgccagatgaaatcgaacagtcg

SEQ ID NO: 49471 - DNA, 25 bp, Homo sapien
gaacggcgtgcattatcaacatcat

SEQ ID NO: 49472 - DNA, 25 bp, Homo sapien
atcaacatcatattcagcccatcac

SEQ ID NO: 49473 - DNA, 25 bp, Homo sapien
tcatattcagcccatcacgctgtgg

SEQ ID NO: 49474 - DNA, 25 bp, Homo sapien
cacgctgtggtttgatgatgcgctc

SEQ ID NO: 49475 - DNA, 25 bp, Homo sapien
agtgccatgcgttcgctgaaaggca

SEQ ID NO: 49476 - DNA, 25 bp, Homo sapien
cggtgccacgcatcttcatgaaggg

SEQ ID NO: 49477 - DNA, 25 bp, Homo sapien
tattaacgcgttcgcagttgcagcg

SEQ ID NO: 49478 - DNA, 25 bp, Homo sapien
cagcgattgcaactggcctggccgc

SEQ ID NO: 49479 - DNA, 25 bp, Homo sapien
tccgggattttgtggatgccctgga

SEQ ID NO: 49480 - DNA, 25 bp, Homo sapien
tggctgtgcaacagacaggtgatga

SEQ ID NO: 49481 - DNA, 25 bp, Homo sapien
tgcaacagacaggtgatgatgatga

SEQ ID NO: 49482 - DNA, 25 bp, Homo sapien
aagtagatgactttgaggacttcat

SEQ ID NO: 49483 - DNA, 25 bp, Homo sapien
gactttgaggacttcatcttcagcc

SEQ ID NO: 49484 - DNA, 25 bp, Homo sapien
ttcagccacttctttggagacaaag

SEQ ID NO: 49485 - DNA, 25 bp, Homo sapien
acttctttggagacaaagcactgaa

SEQ ID NO: 49486 - DNA, 25 bp, Homo sapien
gggaagaaggacaagcactcacaga

SEQ ID NO: 49487 - DNA, 25 bp, Homo sapien
ggacaagcactcacagagcccaaga

SEQ ID NO: 49488 - DNA, 25 bp, Homo sapien
gggaggggcacagccatagccacca

SEQ ID NO: 49489 - DNA, 25 bp, Homo sapien
tgccccacagggaatggccttggcc

SEQ ID NO: 49490 - DNA, 25 bp, Homo sapien
ctgggagtccccatcagaggcagtg

SEQ ID NO: 49491 - DNA, 25 bp, Homo sapien
tgggagtccccatcagaggcagtga

SEQ ID NO: 49492 - DNA, 25 bp, Homo sapien
tggtctgcatgacactaagacgctt

SEQ ID NO: 49493 - DNA, 25 bp, Homo sapien
ggtctgcatgacactaagacgcttg

SEQ ID NO: 49494 - DNA, 25 bp, Homo sapien
gtctgcatgacactaagacgcttgt

SEQ ID NO: 49495 - DNA, 25 bp, Homo sapien
tctgcatgacactaagacgcttgtc

SEQ ID NO: 49496 - DNA, 25 bp, Homo sapien
ctgcatgacactaagacgcttgtcc

SEQ ID NO: 49497 - DNA, 25 bp, Homo sapien
tgcatgacactaagacgcttgtcca

SEQ ID NO: 49498 - DNA, 25 bp, Homo sapien
catgacactaagacgcttgtccaca

SEQ ID NO: 49499 - DNA, 25 bp, Homo sapien
acactaagacgcttgtccacagcgg

SEQ ID NO: 49500 - DNA, 25 bp, Homo sapien
cactaagacgcttgtccacagcggc

SEQ ID NO: 49501 - DNA, 25 bp, Homo sapien
actaagacgcttgtccacagcggcg

SEQ ID NO: 49502 - DNA, 25 bp, Homo sapien
ctaagacgcttgtccacagcggcga

SEQ ID NO: 49503 - DNA, 25 bp, Homo sapien
taagacgcttgtccacagcggcgac

SEQ ID NO: 49504 - DNA, 25 bp, Homo sapien
aagacgcttgtccacagcggcgacc

SEQ ID NO: 49505 - DNA, 25 bp, Homo sapien
gcaaggccagacttttccgtcgttt

SEQ ID NO: 49506 - DNA, 25 bp, Homo sapien
tcttgacaaaacctaacttgcgcag

SEQ ID NO: 49507 - DNA, 25 bp, Homo sapien
atgagattggcatggctttatttgt

SEQ ID NO: 49508 - DNA, 25 bp, Homo sapien
gcagtcggttggagcgagcatcccc

SEQ ID NO: 49509 - DNA, 25 bp, Homo sapien
ccaaagttcacaatgtggccgagga

SEQ ID NO: 49510 - DNA, 25 bp, Homo sapien
aagttcacaatgtggccgaggactt

SEQ ID NO: 49511 - DNA, 25 bp, Homo sapien
atgtggccgaggactttgattgcac

SEQ ID NO: 49512 - DNA, 25 bp, Homo sapien
ccgaggactttgattgcacattgtt

SEQ ID NO: 49513 - DNA, 25 bp, Homo sapien
tttaatagtcattccaaatatgaga

SEQ ID NO: 49514 - DNA, 25 bp, Homo sapien
agtcattccaaatatgagatgcatt

SEQ ID NO: 49515 - DNA, 25 bp, Homo sapien
tgttacaggaagtcccttgccatcc

SEQ ID NO: 49516 - DNA, 25 bp, Homo sapien
tacaggaagtcccttgccatcctaa

SEQ ID NO: 49517 - DNA, 25 bp, Homo sapien
tcccttgccatcctaaaagccaccc

SEQ ID NO: 49518 - DNA, 25 bp, Homo sapien
cttctctctaaggagaatggcccag

SEQ ID NO: 49519 - DNA, 25 bp, Homo sapien
gaggtgatagcattgctttcgtgta

SEQ ID NO: 49520 - DNA, 25 bp, Homo sapien
tattttgaatgatgagccttcgtgc

SEQ ID NO: 49521 - DNA, 25 bp, Homo sapien
tttgaatgatgagccttcgtgcccc

SEQ ID NO: 49522 - DNA, 25 bp, Homo sapien
gtatgaaggcttttggtctccctgg

SEQ ID NO: 49523 - DNA, 25 bp, Homo sapien
ggtggaggcagccagggcttacctg

SEQ ID NO: 49524 - DNA, 25 bp, Homo sapien
cagggcttacctgtacactgacttg

SEQ ID NO: 49525 - DNA, 25 bp, Homo sapien
ttacctgtacactgacttgagacca

SEQ ID NO: 49526 - DNA, 25 bp, Homo sapien
gcatcgccagcatttcgatcctcgt

SEQ ID NO: 49527 - DNA, 25 bp, Homo sapien
gcatttcgatcctcgtcaggtgcag

SEQ ID NO: 49528 - DNA, 25 bp, Homo sapien
cgatcctcgtcaggtgcaggtcagc

SEQ ID NO: 49529 - DNA, 25 bp, Homo sapien
tcgtcaggtgcaggtcagcacgttg

SEQ ID NO: 49530 - DNA, 25 bp, Homo sapien
gcaggtcagcacgttgctgtcgatt

SEQ ID NO: 49531 - DNA, 25 bp, Homo sapien
cagcacgttgctgtcgattaagacc

SEQ ID NO: 49532 - DNA, 25 bp, Homo sapien
gctgtcgattaagaccggagcttgt

SEQ ID NO: 49533 - DNA, 25 bp, Homo sapien
agcttgtccggaagattgcaaatac

SEQ ID NO: 49534 - DNA, 25 bp, Homo sapien
agattgcaaatactgcccgcaaacg

SEQ ID NO: 49535 - DNA, 25 bp, Homo sapien
caaatactgcccgcaaacgtcgcgc

SEQ ID NO: 49536 - DNA, 25 bp, Homo sapien
tgaacaggtgctggagtcggcgcgc

SEQ ID NO: 49537 - DNA, 25 bp, Homo sapien
ggagtcggcgcgcaaagcgaaagcg

SEQ ID NO: 49538 - DNA, 25 bp, Homo sapien
caaagcgaaagcggcaggatcgacg

SEQ ID NO: 49539 - DNA, 25 bp, Homo sapien
ggcaggatcgacgcgcttctgtatg

SEQ ID NO: 49540 - DNA, 25 bp, Homo sapien
gacattgtcgcaagtcacagaatta

SEQ ID NO: 49541 - DNA, 25 bp, Homo sapien
attgtcgcaagtcacagaattattt

SEQ ID NO: 49542 - DNA, 25 bp, Homo sapien
gttgctggatctgctgtttgaagcg

SEQ ID NO: 49543 - DNA, 25 bp, Homo sapien
ggatctgctgtttgaagcgcagcag

SEQ ID NO: 49544 - DNA, 25 bp, Homo sapien
gcgcagcaggtgcatcgccagcatt

SEQ ID NO: 49545 - DNA, 25 bp, Homo sapien
gcaggtgcatcgccagcatttcgat

SEQ ID NO: 49546 - DNA, 25 bp, Homo sapien
gctgaagggattggtgtcaatcaaa

SEQ ID NO: 49547 - DNA, 25 bp, Homo sapien
aatcaaagacaaatcacaacaagtg

SEQ ID NO: 49548 - DNA, 25 bp, Homo sapien
aagtgattgtccagggtgtccatga

SEQ ID NO: 49549 - DNA, 25 bp, Homo sapien
attgtccagggtgtccatgagctct

SEQ ID NO: 49550 - DNA, 25 bp, Homo sapien
tccagtgagctggaaggatgacact

SEQ ID NO: 49551 - DNA, 25 bp, Homo sapien
agctggaaggatgacactgagagaa

SEQ ID NO: 49552 - DNA, 25 bp, Homo sapien
ctgagagaacaaatcgattggtcct

SEQ ID NO: 49553 - DNA, 25 bp, Homo sapien
aaggatatccttaaacagctgttta

SEQ ID NO: 49554 - DNA, 25 bp, Homo sapien
aacagctgtttatagctactgtgac

SEQ ID NO: 49555 - DNA, 25 bp, Homo sapien
gctgtttatagctactgtgacagaa

SEQ ID NO: 49556 - DNA, 25 bp, Homo sapien
agatcaagtttgtacataacactag

SEQ ID NO: 49557 - DNA, 25 bp, Homo sapien
taatggagttggtcttagccgctgc

SEQ ID NO: 49558 - DNA, 25 bp, Homo sapien
tggtcttagccgctgcaggagccct

SEQ ID NO: 49559 - DNA, 25 bp, Homo sapien
ggagcccttcttttctgtggattca

SEQ ID NO: 49560 - DNA, 25 bp, Homo sapien
atcatctatgacacacactcactga

SEQ ID NO: 49561 - DNA, 25 bp, Homo sapien
actcactgatgcataaactgtcacc

SEQ ID NO: 49562 - DNA, 25 bp, Homo sapien
aagagtacgtattagctgccatcag

SEQ ID NO: 49563 - DNA, 25 bp, Homo sapien
catcagcctctacttggatatcatc

SEQ ID NO: 49564 - DNA, 25 bp, Homo sapien
gatatcatcaatctattcctgcacc

SEQ ID NO: 49565 - DNA, 25 bp, Homo sapien
tattcctgcacctgttacggtttct

SEQ ID NO: 49566 - DNA, 25 bp, Homo sapien
gcacctgttacggtttctggaagca

SEQ ID NO: 49567 - DNA, 25 bp, Homo sapien
attaaaagtatctcagctcaactga

SEQ ID NO: 49568 - DNA, 25 bp, Homo sapien
gaatgaggtttttcatacctgaaga

SEQ ID NO: 49569 - DNA, 25 bp, Homo sapien
caaactgagaggtatacatgaggct

SEQ ID NO: 49570 - DNA, 25 bp, Homo sapien
tacatgaggctagtgcttgcattcc

SEQ ID NO: 49571 - DNA, 25 bp, Homo sapien
ctagtgcttgcattcctggttatat

SEQ ID NO: 49572 - DNA, 25 bp, Homo sapien
gcttgcattcctggttatatgtaat

SEQ ID NO: 49573 - DNA, 25 bp, Homo sapien
aactgatcagagtaaattcattagc

SEQ ID NO: 49574 - DNA, 25 bp, Homo sapien
aattcattagcaattatcacattta

SEQ ID NO: 49575 - DNA, 25 bp, Homo sapien
ttttttcacacatactgactgtaga

SEQ ID NO: 49576 - DNA, 25 bp, Homo sapien
aaagctacaatttgccctcatacac

SEQ ID NO: 49577 - DNA, 25 bp, Homo sapien
aatttgccctcatacacactgcttc

SEQ ID NO: 49578 - DNA, 25 bp, Homo sapien
acacactgcttccacagcttgctag

SEQ ID NO: 49579 - DNA, 25 bp, Homo sapien
ttttgttttttcaatcatggccata

SEQ ID NO: 49580 - DNA, 25 bp, Homo sapien
gttttttcaatcatggccatattat

SEQ ID NO: 49581 - DNA, 25 bp, Homo sapien
tactaacaggatataggacaaggtg

SEQ ID NO: 49582 - DNA, 25 bp, Homo sapien
aaagatatgatttatcctgagtgct

SEQ ID NO: 49583 - DNA, 25 bp, Homo sapien
gtgctgtatctattactcttttact

SEQ ID NO: 49584 - DNA, 25 bp, Homo sapien
tatctattactcttttactttggtt

SEQ ID NO: 49585 - DNA, 25 bp, Homo sapien
aaaatagatatatggcacttggagt

SEQ ID NO: 49586 - DNA, 25 bp, Homo sapien
atatggcacttggagtgcatcatag

SEQ ID NO: 49587 - DNA, 25 bp, Homo sapien
gctgtaagagaattatctgcaactt

SEQ ID NO: 49588 - DNA, 25 bp, Homo sapien
gagaattatctgcaacttgattctt

SEQ ID NO: 49589 - DNA, 25 bp, Homo sapien
gcaacttgattcttggcaggaaata

SEQ ID NO: 49590 - DNA, 25 bp, Homo sapien
catgtcaggcgttaaactgtcagtc

SEQ ID NO: 49591 - DNA, 25 bp, Homo sapien
atgaagattgatcagcttgtgtatg

SEQ ID NO: 49592 - DNA, 25 bp, Homo sapien
tgaaaattgctttgatcgcgcatga

SEQ ID NO: 49593 - DNA, 25 bp, Homo sapien
aggatatggttcaatttacgactgc

SEQ ID NO: 49594 - DNA, 25 bp, Homo sapien
tcaatttacgactgcctatcgggat

SEQ ID NO: 49595 - DNA, 25 bp, Homo sapien
tcatgatctatacgcaaccggaacc

SEQ ID NO: 49596 - DNA, 25 bp, Homo sapien
ttcatgaggcgacaggtcttcaaat

SEQ ID NO: 49597 - DNA, 25 bp, Homo sapien
agcaaatcggtgcactgatcgctgc

SEQ ID NO: 49598 - DNA, 25 bp, Homo sapien
tgcactgatcgctgccaatgcactc

SEQ ID NO: 49599 - DNA, 25 bp, Homo sapien
gctgccaatgcactcgatcttgtca

SEQ ID NO: 49600 - DNA, 25 bp, Homo sapien
cccgctgaccgcgcagccgcatgaa

SEQ ID NO: 49601 - DNA, 25 bp, Homo sapien
gatgtctcggcattaatccgtttat

SEQ ID NO: 49602 - DNA, 25 bp, Homo sapien
cattaatccgtttatgtgatgtgta

SEQ ID NO: 49603 - DNA, 25 bp, Homo sapien
tgatgtgtattccattccgctcgcc

SEQ ID NO: 49604 - DNA, 25 bp, Homo sapien
gctcgccacaaatatgggtactgcg

SEQ ID NO: 49605 - DNA, 25 bp, Homo sapien
aaattcttgtgcgcacacttgatga

SEQ ID NO: 49606 - DNA, 25 bp, Homo sapien
gcgcacacttgatgaaggtgttttc

SEQ ID NO: 49607 - DNA, 25 bp, Homo sapien
atgctgacgttcttgcttttggcgc

SEQ ID NO: 49608 - DNA, 25 bp, Homo sapien
gcttttggcgcccacagtgatgatg

SEQ ID NO: 49609 - DNA, 25 bp, Homo sapien
cacagtgatgatgtcgagatcggaa

SEQ ID NO: 49610 - DNA, 25 bp, Homo sapien
cggtgttgcatcgatacaggcaggt

SEQ ID NO: 49611 - DNA, 25 bp, Homo sapien
tacaggcaggtgctggcattgttgc

SEQ ID NO: 49612 - DNA, 25 bp, Homo sapien
cattgttgctgattctgttccggaa

SEQ ID NO: 49613 - DNA, 25 bp, Homo sapien
aagccggtgcgctgctgaaaacgat

SEQ ID NO: 49614 - DNA, 25 bp, Homo sapien
gaaaacgattcatattgcagaagac

SEQ ID NO: 49615 - DNA, 25 bp, Homo sapien
ctgatgaacagatttctacaattgt

SEQ ID NO: 49616 - DNA, 25 bp, Homo sapien
tactgccggtgaggctgaaacgctg

SEQ ID NO: 49617 - DNA, 25 bp, Homo sapien
tatgatgatggcagcggaaatgact

SEQ ID NO: 49618 - DNA, 25 bp, Homo sapien
gatattgtcaattcttgctcatcgg

SEQ ID NO: 49619 - DNA, 25 bp, Homo sapien
gttttgtgaaggcaatgcgggcaca

SEQ ID NO: 49620 - DNA, 25 bp, Homo sapien
caatgcgggcacacgctcttacagt

SEQ ID NO: 49621 - DNA, 25 bp, Homo sapien
acacgctcttacagtcgatggactt

SEQ ID NO: 49622 - DNA, 25 bp, Homo sapien
tggacttcctgatattgttgataca

SEQ ID NO: 49623 - DNA, 25 bp, Homo sapien
tatctcaacggcctcggcaattgtt

SEQ ID NO: 49624 - DNA, 25 bp, Homo sapien
ctcggcaattgttgcctcggcagct

SEQ ID NO: 49625 - DNA, 25 bp, Homo sapien
gttgcctcggcagctggtgcgaaaa

SEQ ID NO: 49626 - DNA, 25 bp, Homo sapien
cgctaagcatggcaatcgctctgtc

SEQ ID NO: 49627 - DNA, 25 bp, Homo sapien
caatcgctctgtctcttctaaaagc

SEQ ID NO: 49628 - DNA, 25 bp, Homo sapien
cttgtattacgattcgcacgatgag

SEQ ID NO: 49629 - DNA, 25 bp, Homo sapien
gattcgcacgatgagtgtaaagaac

SEQ ID NO: 49630 - DNA, 25 bp, Homo sapien
gtaacagatcaaacaccggcgctaa

SEQ ID NO: 49631 - DNA, 25 bp, Homo sapien
gtcaacaggtaacacttccgctgct

SEQ ID NO: 49632 - DNA, 25 bp, Homo sapien
gcatatgcagcccgtgctaacatga

SEQ ID NO: 49633 - DNA, 25 bp, Homo sapien
gaaatgcattgtcatcatcccgaac

SEQ ID NO: 49634 - DNA, 25 bp, Homo sapien
aactcgctcaagctgtcatgtacgg

SEQ ID NO: 49635 - DNA, 25 bp, Homo sapien
gacggaaactttgacgatgcgctta

SEQ ID NO: 49636 - DNA, 25 bp, Homo sapien
gatgcgcttaaaattgtccgttcca

SEQ ID NO: 49637 - DNA, 25 bp, Homo sapien
gtcaacccttaccgcattgaaggcc

SEQ ID NO: 49638 - DNA, 25 bp, Homo sapien
aaactgctgccttcgaagtgtgcga

SEQ ID NO: 49639 - DNA, 25 bp, Homo sapien
agcgcctgatgttttagcgatcccg

SEQ ID NO: 49640 - DNA, 25 bp, Homo sapien
caggccttccgaaaatgcgcggctt

SEQ ID NO: 49641 - DNA, 25 bp, Homo sapien
agcctcgtaacttcactgtcacctg

SEQ ID NO: 49642 - DNA, 25 bp, Homo sapien
tgtcccatagggtgccttctgaata

SEQ ID NO: 49643 - DNA, 25 bp, Homo sapien
agggtgccttctgaatactgttatt

SEQ ID NO: 49644 - DNA, 25 bp, Homo sapien
taagtttgttgcagaacgtgaccct

SEQ ID NO: 49645 - DNA, 25 bp, Homo sapien
agaacgtgaccctgcgtgcaaacat

SEQ ID NO: 49646 - DNA, 25 bp, Homo sapien
cgtgcaaacatgtaccgtggcctgg

SEQ ID NO: 49647 - DNA, 25 bp, Homo sapien
ccgtggcctggtatatgatagagat

SEQ ID NO: 49648 - DNA, 25 bp, Homo sapien
aatctgtgggcaggatacttttcca

SEQ ID NO: 49649 - DNA, 25 bp, Homo sapien
tccaagctgttgaaactggctatgt

SEQ ID NO: 49650 - DNA, 25 bp, Homo sapien
gtgcctttactgttgtgtggactgc

SEQ ID NO: 49651 - DNA, 25 bp, Homo sapien
gcgtgagggacaagaagttccattt

SEQ ID NO: 49652 - DNA, 25 bp, Homo sapien
aatgaatcatttactcttgaaatgc

SEQ ID NO: 49653 - DNA, 25 bp, Homo sapien
gaaatgccagtcattgactgatgta

SEQ ID NO: 49654 - DNA, 25 bp, Homo sapien
gaaatacattcactgtctctgttgg

SEQ ID NO: 49655 - DNA, 25 bp, Homo sapien
attcactgtctctgttggtggtaca

SEQ ID NO: 49656 - DNA, 25 bp, Homo sapien
gtctctgttggtggtacatcttgtt

SEQ ID NO: 49657 - DNA, 25 bp, Homo sapien
ggtggtacatcttgttgaattcaat

SEQ ID NO: 49658 - DNA, 25 bp, Homo sapien
aatccctgtttctctatgtagtctg

SEQ ID NO: 49659 - DNA, 25 bp, Homo sapien
ccctgtttctctatgtagtctggca

SEQ ID NO: 49660 - DNA, 25 bp, Homo sapien
ttctctatgtagtctggcagtataa

SEQ ID NO: 49661 - DNA, 25 bp, Homo sapien
aatatttaccatataatcttggaat

SEQ ID NO: 49662 - DNA, 25 bp, Homo sapien
attagttaatgttaccaaaatctgt

SEQ ID NO: 49663 - DNA, 25 bp, Homo sapien
gcgcctggtcaccagggctgctttt

SEQ ID NO: 49664 - DNA, 25 bp, Homo sapien
ggtcaccagggctgcttttaactct

SEQ ID NO: 49665 - DNA, 25 bp, Homo sapien
tgcttttaactctggtaaagtggat

SEQ ID NO: 49666 - DNA, 25 bp, Homo sapien
ggatattgttgccatcaatgacccc

SEQ ID NO: 49667 - DNA, 25 bp, Homo sapien
catcaatgaccccttcattgacctc

SEQ ID NO: 49668 - DNA, 25 bp, Homo sapien
cttcattgacctcaactacatggtt

SEQ ID NO: 49669 - DNA, 25 bp, Homo sapien
caactacatggtttacatgttccaa

SEQ ID NO: 49670 - DNA, 25 bp, Homo sapien
ggtttacatgttccaatatgattcc

SEQ ID NO: 49671 - DNA, 25 bp, Homo sapien
ccaatatgattccacccatggcaaa

SEQ ID NO: 49672 - DNA, 25 bp, Homo sapien
tgattccacccatggcaaattccat

SEQ ID NO: 49673 - DNA, 25 bp, Homo sapien
attccatggcaccgtcaaggctgag

SEQ ID NO: 49674 - DNA, 25 bp, Homo sapien
tggcaccgtcaaggctgagaacggg

SEQ ID NO: 49675 - DNA, 25 bp, Homo sapien
catcaatggaaatcccatcaccatc

SEQ ID NO: 49676 - DNA, 25 bp, Homo sapien
tcccatcaccatcttccaggagcga

SEQ ID NO: 49677 - DNA, 25 bp, Homo sapien
cttccaggagcgagatccctccaaa

SEQ ID NO: 49678 - DNA, 25 bp, Homo sapien
gcgagatccctccaaaatcaagtgg

SEQ ID NO: 49679 - DNA, 25 bp, Homo sapien
cgatgctggcgctgagtacgtcgtg

SEQ ID NO: 49680 - DNA, 25 bp, Homo sapien
cgtggagtccactggcgtcttcacc

SEQ ID NO: 49681 - DNA, 25 bp, Homo sapien
cttcaccaccatggagaaggctggg

SEQ ID NO: 49682 - DNA, 25 bp, Homo sapien
cggatttggtcgtattgggcgcctg

SEQ ID NO: 49683 - DNA, 25 bp, Homo sapien
atgctgactcggtttcccctcagag

SEQ ID NO: 49684 - DNA, 25 bp, Homo sapien
agccattgttgtctgggctcgagtt

SEQ ID NO: 49685 - DNA, 25 bp, Homo sapien
tgttgtctgggctcgagtttctgcc

SEQ ID NO: 49686 - DNA, 25 bp, Homo sapien
tgggctcgagtttctgccccaggtt

SEQ ID NO: 49687 - DNA, 25 bp, Homo sapien
agtttctgccccaggttgtgtgctg

SEQ ID NO: 49688 - DNA, 25 bp, Homo sapien
ggagcgccaggagaggagggtcatg

SEQ ID NO: 49689 - DNA, 25 bp, Homo sapien
tggaggccctgccttcacagagatg

SEQ ID NO: 49690 - DNA, 25 bp, Homo sapien
tgccttcacagagatgccgcgtgct

SEQ ID NO: 49691 - DNA, 25 bp, Homo sapien
cttcacagagatgccgcgtgctggg

SEQ ID NO: 49692 - DNA, 25 bp, Homo sapien
agatgccgcgtgctgggaaggctct

SEQ ID NO: 49693 - DNA, 25 bp, Homo sapien
ggtcccctgagcgtcttccagggtg

SEQ ID NO: 49694 - DNA, 25 bp, Homo sapien
gacattttatcttgtccgtgaagat

SEQ ID NO: 49695 - DNA, 25 bp, Homo sapien
atcttgtccgtgaagatgtattgcc

SEQ ID NO: 49696 - DNA, 25 bp, Homo sapien
aagatgtattgcccgatgcaatgag

SEQ ID NO: 49697 - DNA, 25 bp, Homo sapien
gtattgcccgatgcaatgagaaaaa

SEQ ID NO: 49698 - DNA, 25 bp, Homo sapien
agcagattcagtagcagatgccgtt

SEQ ID NO: 49699 - DNA, 25 bp, Homo sapien
cagtagcagatgccgttcaaaaggt

SEQ ID NO: 49700 - DNA, 25 bp, Homo sapien
tacagggatgctgtttttccattct

SEQ ID NO: 49701 - DNA, 25 bp, Homo sapien
ggaggataggtcaggtgcgttatct

SEQ ID NO: 49702 - DNA, 25 bp, Homo sapien
taggtcaggtgcgttatctcagctt

SEQ ID NO: 49703 - DNA, 25 bp, Homo sapien
gcgttatctcagcttcttcaggcgg

SEQ ID NO: 49704 - DNA, 25 bp, Homo sapien
ctcagcttcttcaggcggtagctga

SEQ ID NO: 49705 - DNA, 25 bp, Homo sapien
tcttcaggcggtagctgattctgga

SEQ ID NO: 49706 - DNA, 25 bp, Homo sapien
ggcggtagctgattctggaagcaac

SEQ ID NO: 49707 - DNA, 25 bp, Homo sapien
ctgattctggaagcaacgttctttc

SEQ ID NO: 49708 - DNA, 25 bp, Homo sapien
tctttccattcaccagaccattccg

SEQ ID NO: 49709 - DNA, 25 bp, Homo sapien
accagaccattccgcttcaaggcag

SEQ ID NO: 49710 - DNA, 25 bp, Homo sapien
ccattccgcttcaaggcagagcaaa

SEQ ID NO: 49711 - DNA, 25 bp, Homo sapien
cgcttcaaggcagagcaaatgtgac

SEQ ID NO: 49712 - DNA, 25 bp, Homo sapien
gcaaatgtgacactgtctatcagta

SEQ ID NO: 49713 - DNA, 25 bp, Homo sapien
cactgtctatcagtacgtcggcaat

SEQ ID NO: 49714 - DNA, 25 bp, Homo sapien
ctgtaacagatcaaacaccggcgct

SEQ ID NO: 49715 - DNA, 25 bp, Homo sapien
acacctcttattcacctgccgaagc

SEQ ID NO: 49716 - DNA, 25 bp, Homo sapien
gaattgagcttcatgtcaaaacgga

SEQ ID NO: 49717 - DNA, 25 bp, Homo sapien
gggatcatttaaagatcgcggaatg

SEQ ID NO: 49718 - DNA, 25 bp, Homo sapien
gaaggcaatgacacgattatgtgcg

SEQ ID NO: 49719 - DNA, 25 bp, Homo sapien
acacgattatgtgcgcgtcaacagg

SEQ ID NO: 49720 - DNA, 25 bp, Homo sapien
gcgtcaacaggtaacacttccgctg

SEQ ID NO: 49721 - DNA, 25 bp, Homo sapien
cacttccgctgctgcggcagcatat

SEQ ID NO: 49722 - DNA, 25 bp, Homo sapien
cggcagcatatgcagcccgtgctaa

SEQ ID NO: 49723 - DNA, 25 bp, Homo sapien
cagcccgtgctaacatgaaatgcat

SEQ ID NO: 49724 - DNA, 25 bp, Homo sapien
tgcattgtcatcatcccgaacggaa

SEQ ID NO: 49725 - DNA, 25 bp, Homo sapien
ggaaaactcgctcaagctgtcatgt

SEQ ID NO: 49726 - DNA, 25 bp, Homo sapien
gtccgttccatctgtgagaaatcac

SEQ ID NO: 49727 - DNA, 25 bp, Homo sapien
tgtgagaaatcaccgattgcccttg

SEQ ID NO: 49728 - DNA, 25 bp, Homo sapien
tcagtcaacccttaccgcattgaag

SEQ ID NO: 49729 - DNA, 25 bp, Homo sapien
ctgctgccttcgaagtgtgcgaaca

SEQ ID NO: 49730 - DNA, 25 bp, Homo sapien
gctggaaacatcactgcgtactgga

SEQ ID NO: 49731 - DNA, 25 bp, Homo sapien
catgagaaaaacggcacaggccttc

SEQ ID NO: 49732 - DNA, 25 bp, Homo sapien
gcggcggcaatcgtgcgcaatgaag

SEQ ID NO: 49733 - DNA, 25 bp, Homo sapien
gcaatcgtgcgcaatgaagtgattg

SEQ ID NO: 49734 - DNA, 25 bp, Homo sapien
gttataatctcttcctagctaatgg

SEQ ID NO: 49735 - DNA, 25 bp, Homo sapien
ctcttcctagctaatgggcttactc

SEQ ID NO: 49736 - DNA, 25 bp, Homo sapien
cttcctagctaatgggcttactcaa

SEQ ID NO: 49737 - DNA, 25 bp, Homo sapien
tagctaatgggcttactcaaagatt

SEQ ID NO: 49738 - DNA, 25 bp, Homo sapien
tgggcttactcaaagattcaccacc

SEQ ID NO: 49739 - DNA, 25 bp, Homo sapien
ctagcaatgatattctcagttgttt

SEQ ID NO: 49740 - DNA, 25 bp, Homo sapien
agcaatgatattctcagttgtttct

SEQ ID NO: 49741 - DNA, 25 bp, Homo sapien
gcaatgatattctcagttgtttctc

SEQ ID NO: 49742 - DNA, 25 bp, Homo sapien
ctcagttgtttctctcttgtggtgc

SEQ ID NO: 49743 - DNA, 25 bp, Homo sapien
ttctctcttgtggtgcagagttgca

SEQ ID NO: 49744 - DNA, 25 bp, Homo sapien
tctcttgtggtgcagagttgcattg

SEQ ID NO: 49745 - DNA, 25 bp, Homo sapien
ctcttgtggtgcagagttgcattgg

SEQ ID NO: 49746 - DNA, 25 bp, Homo sapien
tgcagagttgcattgggttttctac

SEQ ID NO: 49747 - DNA, 25 bp, Homo sapien
tgcattgggttttctacattttccc

SEQ ID NO: 49748 - DNA, 25 bp, Homo sapien
gcattgggttttctacattttccca

SEQ ID NO: 49749 - DNA, 25 bp, Homo sapien
cccactgagtcttccctgttgtaaa

SEQ ID NO: 49750 - DNA, 25 bp, Homo sapien
acatacataacattgaaacagaagg

SEQ ID NO: 49751 - DNA, 25 bp, Homo sapien
gctgtggaccacagaactccaagaa

SEQ ID NO: 49752 - DNA, 25 bp, Homo sapien
tgtggaccacagaactccaagaatt

SEQ ID NO: 49753 - DNA, 25 bp, Homo sapien
ggaccacagaactccaagaattgtt

SEQ ID NO: 49754 - DNA, 25 bp, Homo sapien
ctcttaatatctcttgaaatcttta

SEQ ID NO: 49755 - DNA, 25 bp, Homo sapien
gaaatctttagagcaactttaaggc

SEQ ID NO: 49756 - DNA, 25 bp, Homo sapien
atctttagagcaactttaaggcttg

SEQ ID NO: 49757 - DNA, 25 bp, Homo sapien
tagagcaactttaaggcttgtaaat

SEQ ID NO: 49758 - DNA, 25 bp, Homo sapien
gcaactttaaggcttgtaaatacat

SEQ ID NO: 49759 - DNA, 25 bp, Homo sapien
aattgactcagtactatttcttttc

SEQ ID NO: 49760 - DNA, 25 bp, Homo sapien
gactcagtactatttcttttcactt

SEQ ID NO: 49761 - DNA, 25 bp, Homo sapien
gggctgtcatagtcccagaggataa

SEQ ID NO: 49762 - DNA, 25 bp, Homo sapien
gtcatagtcccagaggataagcaat

SEQ ID NO: 49763 - DNA, 25 bp, Homo sapien
gaggataagcaatacctatttctga

SEQ ID NO: 49764 - DNA, 25 bp, Homo sapien
gataagcaatacctatttctgactg

SEQ ID NO: 49765 - DNA, 25 bp, Homo sapien
agcaatacctatttctgactgagtc

SEQ ID NO: 49766 - DNA, 25 bp, Homo sapien
gcaatacctatttctgactgagtct

SEQ ID NO: 49767 - DNA, 25 bp, Homo sapien
aatacctatttctgactgagtctcc

SEQ ID NO: 49768 - DNA, 25 bp, Homo sapien
atacctatttctgactgagtctccc

SEQ ID NO: 49769 - DNA, 25 bp, Homo sapien
acctatttctgactgagtctcccag

SEQ ID NO: 49770 - DNA, 25 bp, Homo sapien
tatttctgactgagtctcccagccc

SEQ ID NO: 49771 - DNA, 25 bp, Homo sapien
ttctgactgagtctcccagcccaga

SEQ ID NO: 49772 - DNA, 25 bp, Homo sapien
gaaaatgccaagacctttggaaaga

SEQ ID NO: 49773 - DNA, 25 bp, Homo sapien
ggaaagatgaaacctcgttatgaaa

SEQ ID NO: 49774 - DNA, 25 bp, Homo sapien
aacctcgttatgaaatcaactccct

SEQ ID NO: 49775 - DNA, 25 bp, Homo sapien
gcaaagatggtttcattcaacgtca

SEQ ID NO: 49776 - DNA, 25 bp, Homo sapien
gatggtttcattcaacgtcaccttc

SEQ ID NO: 49777 - DNA, 25 bp, Homo sapien
aacgtcaccttccaactatccggtg

SEQ ID NO: 49778 - DNA, 25 bp, Homo sapien
accttccaactatccggtgcttagg

SEQ ID NO: 49779 - DNA, 25 bp, Homo sapien
tccaactatccggtgcttaggaaat

SEQ ID NO: 49780 - DNA, 25 bp, Homo sapien
gaaatggaagatgggctatacctaa

SEQ ID NO: 49781 - DNA, 25 bp, Homo sapien
gggctatacctaaaattacctgcat

SEQ ID NO: 49782 - DNA, 25 bp, Homo sapien
atacctaaaattacctgcatgaacc

SEQ ID NO: 49783 - DNA, 25 bp, Homo sapien
gaagagctttagtcacggccatcag

SEQ ID NO: 49784 - DNA, 25 bp, Homo sapien
ggccatcagcttacacaacatcaga

SEQ ID NO: 49785 - DNA, 25 bp, Homo sapien
acaacatcagaaaacgcacagtggg

SEQ ID NO: 49786 - DNA, 25 bp, Homo sapien
ggcatgtaaccacctaaaccatctc

SEQ ID NO: 49787 - DNA, 25 bp, Homo sapien
taaaccatctccgagaacatcagag

SEQ ID NO: 49788 - DNA, 25 bp, Homo sapien
atcagaggatccacaacagttgaag

SEQ ID NO: 49789 - DNA, 25 bp, Homo sapien
aacagttgaagagccttttgaacgc

SEQ ID NO: 49790 - DNA, 25 bp, Homo sapien
agagccttttgaacgcagtagcccg

SEQ ID NO: 49791 - DNA, 25 bp, Homo sapien
agtagcccgctcgtatctatggttt

SEQ ID NO: 49792 - DNA, 25 bp, Homo sapien
gtatctatggtttcgctttccacag

SEQ ID NO: 49793 - DNA, 25 bp, Homo sapien
ttcgctttccacagtttgttacctg

SEQ ID NO: 49794 - DNA, 25 bp, Homo sapien
gttttgatgctgtgtgcttttggct

SEQ ID NO: 49795 - DNA, 25 bp, Homo sapien
ctgcacctctcctgttcggtttaga

SEQ ID NO: 49796 - DNA, 25 bp, Homo sapien
tgcacctctcctgttcggtttagac

SEQ ID NO: 49797 - DNA, 25 bp, Homo sapien
gcacctctcctgttcggtttagacc

SEQ ID NO: 49798 - DNA, 25 bp, Homo sapien
catggagaaccgtagagcgcaggaa

SEQ ID NO: 49799 - DNA, 25 bp, Homo sapien
tggagaaccgtagagcgcaggaacg

SEQ ID NO: 49800 - DNA, 25 bp, Homo sapien
gagaaccgtagagcgcaggaacggg

SEQ ID NO: 49801 - DNA, 25 bp, Homo sapien
tagagcgcaggaacgggtgggtaat

SEQ ID NO: 49802 - DNA, 25 bp, Homo sapien
gcgcaggaacgggtgggtaattcta

SEQ ID NO: 49803 - DNA, 25 bp, Homo sapien
gaacgggtgggtaattctagagaca

SEQ ID NO: 49804 - DNA, 25 bp, Homo sapien
gggtgggtaattctagagacaaaag

SEQ ID NO: 49805 - DNA, 25 bp, Homo sapien
ctgggcctgcaattgtctaagaaat

SEQ ID NO: 49806 - DNA, 25 bp, Homo sapien
agcaatcctacttgggatgtcgtca

SEQ ID NO: 49807 - DNA, 25 bp, Homo sapien
acttgggatgtcgtcatgcttactt

SEQ ID NO: 49808 - DNA, 25 bp, Homo sapien
gggatgtcgtcatgcttacttcagc

SEQ ID NO: 49809 - DNA, 25 bp, Homo sapien
gtcgtcatgcttacttcagcctgaa

SEQ ID NO: 49810 - DNA, 25 bp, Homo sapien
gtcatgcttacttcagcctgaatca

SEQ ID NO: 49811 - DNA, 25 bp, Homo sapien
tacttcagcctgaatcacacagaag

SEQ ID NO: 49812 - DNA, 25 bp, Homo sapien
gaagaaagccttcaagcatggacct

SEQ ID NO: 49813 - DNA, 25 bp, Homo sapien
gaaagccttcaagcatggacctgaa

SEQ ID NO: 49814 - DNA, 25 bp, Homo sapien
gcatggacctgaagcaatgctgtaa

SEQ ID NO: 49815 - DNA, 25 bp, Homo sapien
gaagcaatgctgtaaacacaaacat

SEQ ID NO: 49816 - DNA, 25 bp, Homo sapien
cctctgagtgccaagcgacgtggcg

SEQ ID NO: 49817 - DNA, 25 bp, Homo sapien
tgccaagcgacgtggcgggctccac

SEQ ID NO: 49818 - DNA, 25 bp, Homo sapien
acgtggcgggctccacgttagccca

SEQ ID NO: 49819 - DNA, 25 bp, Homo sapien
tccacgttagcccagctctgagatg

SEQ ID NO: 49820 - DNA, 25 bp, Homo sapien
gttagcccagctctgagatgccagc

SEQ ID NO: 49821 - DNA, 25 bp, Homo sapien
gggcggcgctgctcagcttgggctg

SEQ ID NO: 49822 - DNA, 25 bp, Homo sapien
ctcagcttgggctggtccagggcct

SEQ ID NO: 49823 - DNA, 25 bp, Homo sapien
acctttgcctcctgagggcagcgca

SEQ ID NO: 49824 - DNA, 25 bp, Homo sapien
ctttgcctcctgagggcagcgcact

SEQ ID NO: 49825 - DNA, 25 bp, Homo sapien
gggatcaaacagaagccagccgtgg

SEQ ID NO: 49826 - DNA, 25 bp, Homo sapien
aaacagaagccagccgtgggcaaaa

SEQ ID NO: 49827 - DNA, 25 bp, Homo sapien
gatatgaggcaacacaagcacagac

SEQ ID NO: 49828 - DNA, 25 bp, Homo sapien
caagcacagacagttgcatagattt

SEQ ID NO: 49829 - DNA, 25 bp, Homo sapien
gaaaagtgcaatttcatgctgaatg

SEQ ID NO: 49830 - DNA, 25 bp, Homo sapien
gcaatttcatgctgaatgaagcgta

SEQ ID NO: 49831 - DNA, 25 bp, Homo sapien
tgaagcgtaggaacttgacaagccc

SEQ ID NO: 49832 - DNA, 25 bp, Homo sapien
acttgacaagcccataggtagctat

SEQ ID NO: 49833 - DNA, 25 bp, Homo sapien
aggtagctatagttctttgtcagta

SEQ ID NO: 49834 - DNA, 25 bp, Homo sapien
gttctttgtcagtatagggaattat

SEQ ID NO: 49835 - DNA, 25 bp, Homo sapien
gtattaaccttacaacagactctgt

SEQ ID NO: 49836 - DNA, 25 bp, Homo sapien
cagactctgtaagtttgagctttaa

SEQ ID NO: 49837 - DNA, 25 bp, Homo sapien
gacataaccttatttcttgtatttg

SEQ ID NO: 49838 - DNA, 25 bp, Homo sapien
ttcctgagctcaagactttgaaggt

SEQ ID NO: 49839 - DNA, 25 bp, Homo sapien
gaaatcggagatcccagaagcttct

SEQ ID NO: 49840 - DNA, 25 bp, Homo sapien
tccactgccctatgcatttatgtta

SEQ ID NO: 49841 - DNA, 25 bp, Homo sapien
atttatgttagatgccccgatccca

SEQ ID NO: 49842 - DNA, 25 bp, Homo sapien
gatcccactggcatttgagtgtgca

SEQ ID NO: 49843 - DNA, 25 bp, Homo sapien
gtgcaaaccttgacattaacagctg

SEQ ID NO: 49844 - DNA, 25 bp, Homo sapien
caagccttcgttcttccttgagcat

SEQ ID NO: 49845 - DNA, 25 bp, Homo sapien
ctgtcaaaagactggtggtaggctg

SEQ ID NO: 49846 - DNA, 25 bp, Homo sapien
gtggtaggctggtgaaaacttgaca

SEQ ID NO: 49847 - DNA, 25 bp, Homo sapien
gaaaacttgacagctagacttgatg

SEQ ID NO: 49848 - DNA, 25 bp, Homo sapien
gctagacttgatgcttgctgaaatg

SEQ ID NO: 49849 - DNA, 25 bp, Homo sapien
catttcgatcctcgtcaggtgcagg

SEQ ID NO: 49850 - DNA, 25 bp, Homo sapien
tttcgatcctcgtcaggtgcaggtc

SEQ ID NO: 49851 - DNA, 25 bp, Homo sapien
ttcgatcctcgtcaggtgcaggtca

SEQ ID NO: 49852 - DNA, 25 bp, Homo sapien
tcgatcctcgtcaggtgcaggtcag

SEQ ID NO: 49853 - DNA, 25 bp, Homo sapien
tcgcgctacaaaaccgggctggaag

SEQ ID NO: 49854 - DNA, 25 bp, Homo sapien
cgcgctacaaaaccgggctggaagc

SEQ ID NO: 49855 - DNA, 25 bp, Homo sapien
aagccgagcggttgatggaagttga

SEQ ID NO: 49856 - DNA, 25 bp, Homo sapien
gagcggttgatggaagttgaacagg

SEQ ID NO: 49857 - DNA, 25 bp, Homo sapien
cggcaggatcgacgcgcttctgtat

SEQ ID NO: 49858 - DNA, 25 bp, Homo sapien
gctggatctgctgtttgaagcgcag

SEQ ID NO: 49859 - DNA, 25 bp, Homo sapien
ctggatctgctgtttgaagcgcagc

SEQ ID NO: 49860 - DNA, 25 bp, Homo sapien
tggagagattcatattcatttgtat

SEQ ID NO: 49861 - DNA, 25 bp, Homo sapien
attcatattcatttgtatccaaggt

SEQ ID NO: 49862 - DNA, 25 bp, Homo sapien
catattcatttgtatccaaggtgct

SEQ ID NO: 49863 - DNA, 25 bp, Homo sapien
catttgtatccaaggtgctgaatct

SEQ ID NO: 49864 - DNA, 25 bp, Homo sapien
tttgtatccaaggtgctgaatcttg

SEQ ID NO: 49865 - DNA, 25 bp, Homo sapien
tatccaaggtgctgaatcttggagg

SEQ ID NO: 49866 - DNA, 25 bp, Homo sapien
tattcgttatacggaagatgatgaa

SEQ ID NO: 49867 - DNA, 25 bp, Homo sapien
aagatgatgaaccgcttcatgccac

SEQ ID NO: 49868 - DNA, 25 bp, Homo sapien
atgatgaaccgcttcatgccactga

SEQ ID NO: 49869 - DNA, 25 bp, Homo sapien
tgaaccgcttcatgccactgaatac

SEQ ID NO: 49870 - DNA, 25 bp, Homo sapien
accgcttcatgccactgaatacgtt

SEQ ID NO: 49871 - DNA, 25 bp, Homo sapien
tgggagacgcaggcacaactcttta

SEQ ID NO: 49872 - DNA, 25 bp, Homo sapien
gagacgcaggcacaactctttatac

SEQ ID NO: 49873 - DNA, 25 bp, Homo sapien
gcacaactctttatacggttggctc

SEQ ID NO: 49874 - DNA, 25 bp, Homo sapien
ataagctgtacaatcgtttcatcat

SEQ ID NO: 49875 - DNA, 25 bp, Homo sapien
agctgtacaatcgtttcatcattcg

SEQ ID NO: 49876 - DNA, 25 bp, Homo sapien
ctgtacaatcgtttcatcattcggc

SEQ ID NO: 49877 - DNA, 25 bp, Homo sapien
tacaatcgtttcatcattcggcgtg

SEQ ID NO: 49878 - DNA, 25 bp, Homo sapien
aatcgtttcatcattcggcgtgcga

SEQ ID NO: 49879 - DNA, 25 bp, Homo sapien
cgtttcatcattcggcgtgcgaatt

SEQ ID NO: 49880 - DNA, 25 bp, Homo sapien
gaagatcctgattccggccctgatg

SEQ ID NO: 49881 - DNA, 25 bp, Homo sapien
ggagaaggacttcgtgctcgttcct

SEQ ID NO: 49882 - DNA, 25 bp, Homo sapien
agcacatggaggactggattcccca

SEQ ID NO: 49883 - DNA, 25 bp, Homo sapien
gactggattccccacctgaaaaggg

SEQ ID NO: 49884 - DNA, 25 bp, Homo sapien
attgaggactgtgggcactggacac

SEQ ID NO: 49885 - DNA, 25 bp, Homo sapien
gatggacaagccaaccgaggtgaat

SEQ ID NO: 49886 - DNA, 25 bp, Homo sapien
tgaatcagatcctcattaagtggct

SEQ ID NO: 49887 - DNA, 25 bp, Homo sapien
aagtggctggattctgatgcccgga

SEQ ID NO: 49888 - DNA, 25 bp, Homo sapien
aacccaccggtggtctcaaagatgt

SEQ ID NO: 49889 - DNA, 25 bp, Homo sapien
atgtagaacgcagcgtgtgcccacg

SEQ ID NO: 49890 - DNA, 25 bp, Homo sapien
gtgtgcccacgctcagcaggtgtgc

SEQ ID NO: 49891 - DNA, 25 bp, Homo sapien
tggtgtgcgtggtgccggacgtggc

SEQ ID NO: 49892 - DNA, 25 bp, Homo sapien
ttctgcagcgactggcgctggctgc

SEQ ID NO: 49893 - DNA, 25 bp, Homo sapien
gccgacgggctcttctaccctagtg

SEQ ID NO: 49894 - DNA, 25 bp, Homo sapien
acgggctcttctaccctagtgcctt

SEQ ID NO: 49895 - DNA, 25 bp, Homo sapien
tacaccccggaatacagcgtgcggc

SEQ ID NO: 49896 - DNA, 25 bp, Homo sapien
ggaatacagcgtgcggccgggtcac

SEQ ID NO: 49897 - DNA, 25 bp, Homo sapien
acgccgacgcgctcctggagagcat

SEQ ID NO: 49898 - DNA, 25 bp, Homo sapien
gcgctcctggagagcatccatcagg

SEQ ID NO: 49899 - DNA, 25 bp, Homo sapien
gagagcatccatcaggagttcacgc

SEQ ID NO: 49900 - DNA, 25 bp, Homo sapien
agcatccatcaggagttcacgcgca

SEQ ID NO: 49901 - DNA, 25 bp, Homo sapien
atcaggagttcacgcgcaccaactt

SEQ ID NO: 49902 - DNA, 25 bp, Homo sapien
ttattacacaggcaggacttcagtg

SEQ ID NO: 49903 - DNA, 25 bp, Homo sapien
gacttcagtgtcagtatccctgcct

SEQ ID NO: 49904 - DNA, 25 bp, Homo sapien
gagtgtatttttcctgttccacgaa

SEQ ID NO: 49905 - DNA, 25 bp, Homo sapien
cacgaagaggactttttgttcacaa

SEQ ID NO: 49906 - DNA, 25 bp, Homo sapien
attggatcacaatgcagaggagtct

SEQ ID NO: 49907 - DNA, 25 bp, Homo sapien
agggtgacctgtcccagatgactca

SEQ ID NO: 49908 - DNA, 25 bp, Homo sapien
agatgactcatcaccctgacatgct

SEQ ID NO: 49909 - DNA, 25 bp, Homo sapien
tcaccctgacatgctcttgacaaag

SEQ ID NO: 49910 - DNA, 25 bp, Homo sapien
tgctcttgacaaaggacaccaccaa

SEQ ID NO: 49911 - DNA, 25 bp, Homo sapien
acaccaccaagaggagatggcagct

SEQ ID NO: 49912 - DNA, 25 bp, Homo sapien
agatggcagctgtaccggtgcagcc

SEQ ID NO: 49913 - DNA, 25 bp, Homo sapien
gccggagttttacggcaatatcatc

SEQ ID NO: 49914 - DNA, 25 bp, Homo sapien
gttttacggcaatatcatcaccaca

SEQ ID NO: 49915 - DNA, 25 bp, Homo sapien
gcaatatcatcaccacacgcactta

SEQ ID NO: 49916 - DNA, 25 bp, Homo sapien
atcaccacacgcacttatcaggaac

SEQ ID NO: 49917 - DNA, 25 bp, Homo sapien
acgcacttatcaggaacgcctcgat

SEQ ID NO: 49918 - DNA, 25 bp, Homo sapien
atacgctggaaaaagtgcgcgatgc

SEQ ID NO: 49919 - DNA, 25 bp, Homo sapien
ggaaaaagtgcgcgatgccgggatc

SEQ ID NO: 49920 - DNA, 25 bp, Homo sapien
agtgcgcgatgccgggatcaaagtc

SEQ ID NO: 49921 - DNA, 25 bp, Homo sapien
gccgggatcaaagtctgttctggcg

SEQ ID NO: 49922 - DNA, 25 bp, Homo sapien
aagtctgttctggcggcattgtggg

SEQ ID NO: 49923 - DNA, 25 bp, Homo sapien
aagatcgcgccggattattgctgca

SEQ ID NO: 49924 - DNA, 25 bp, Homo sapien
gccggattattgctgcaactggcaa

SEQ ID NO: 49925 - DNA, 25 bp, Homo sapien
attgctgcaactggcaaacctgccg

SEQ ID NO: 49926 - DNA, 25 bp, Homo sapien
cgccggaaagcgtgccaatcaacat

SEQ ID NO: 49927 - DNA, 25 bp, Homo sapien
aagcgtgccaatcaacatgctggtg

SEQ ID NO: 49928 - DNA, 25 bp, Homo sapien
caatcaacatgctggtgaaggtgaa

SEQ ID NO: 49929 - DNA, 25 bp, Homo sapien
tggtgaaggtgaaaggcacgccgct

SEQ ID NO: 49930 - DNA, 25 bp, Homo sapien
acgccgcttgccgataacgatgatg

SEQ ID NO: 49931 - DNA, 25 bp, Homo sapien
ttgccgataacgatgatgtcgatgc

SEQ ID NO: 49932 - DNA, 25 bp, Homo sapien
acgatgatgtcgatgcctttgattt

SEQ ID NO: 49933 - DNA, 25 bp, Homo sapien
gatttgacagaagcggaactctctt

SEQ ID NO: 49934 - DNA, 25 bp, Homo sapien
gtacggtcagtttgcgtaaagaaga

SEQ ID NO: 49935 - DNA, 25 bp, Homo sapien
gctgaagcagcccgcatattaggcg

SEQ ID NO: 49936 - DNA, 25 bp, Homo sapien
aagaattcagctaacgcttccagac

SEQ ID NO: 49937 - DNA, 25 bp, Homo sapien
caattcggtcaattgtcactgtcat

SEQ ID NO: 49938 - DNA, 25 bp, Homo sapien
gaagcgatcttttccgccggaatcc

SEQ ID NO: 49939 - DNA, 25 bp, Homo sapien
ttccggcgcataaagtcagcaaggt

SEQ ID NO: 49940 - DNA, 25 bp, Homo sapien
ttcatcagccggattttgttattga

SEQ ID NO: 49941 - DNA, 25 bp, Homo sapien
tcatcagccggattttgttattgat

SEQ ID NO: 49942 - DNA, 25 bp, Homo sapien
atctcggatacaatagaggcaaaga

SEQ ID NO: 49943 - DNA, 25 bp, Homo sapien
tatcccgtcaaaggattccgtttct

SEQ ID NO: 49944 - DNA, 25 bp, Homo sapien
gggtgtcacttaggttttgtccatc

SEQ ID NO: 49945 - DNA, 25 bp, Homo sapien
aggttttgtccatcagattctgtga

SEQ ID NO: 49946 - DNA, 25 bp, Homo sapien
ttctgtgagacaccaggcatcgttt

SEQ ID NO: 49947 - DNA, 25 bp, Homo sapien
gagtgcttctggaactatcagccca

SEQ ID NO: 49948 - DNA, 25 bp, Homo sapien
ttgaccacccagtttgtggaagcac

SEQ ID NO: 49949 - DNA, 25 bp, Homo sapien
agtgttcttttctggtgattctcca

SEQ ID NO: 49950 - DNA, 25 bp, Homo sapien
ggtgattctccaggccatttaatac

SEQ ID NO: 49951 - DNA, 25 bp, Homo sapien
tgcaatgtaattgtccctctgtggc

SEQ ID NO: 49952 - DNA, 25 bp, Homo sapien
ctctgtggctcacatttcattagtg

SEQ ID NO: 49953 - DNA, 25 bp, Homo sapien
ctcagtgggacatagccagcatttt

SEQ ID NO: 49954 - DNA, 25 bp, Homo sapien
cagcatttttgcataccaggttggg

SEQ ID NO: 49955 - DNA, 25 bp, Homo sapien
gaggtcaacttattcctggtaccct

SEQ ID NO: 49956 - DNA, 25 bp, Homo sapien
cctggtacccttcatggacagtgaa

SEQ ID NO: 49957 - DNA, 25 bp, Homo sapien
agagtgaaaacccaccaagagcagg

SEQ ID NO: 49958 - DNA, 25 bp, Homo sapien
accaagagcaggacctggttccagc

SEQ ID NO: 49959 - DNA, 25 bp, Homo sapien
tgctgcctgggtatcgtggccaccc

SEQ ID NO: 49960 - DNA, 25 bp, Homo sapien
ccagtttccagtccttggtgagcaa

SEQ ID NO: 49961 - DNA, 25 bp, Homo sapien
tggtgagcaagctccggagccaagt

SEQ ID NO: 49962 - DNA, 25 bp, Homo sapien
ctccggagccaagtgatgtccatgg

SEQ ID NO: 49963 - DNA, 25 bp, Homo sapien
aagtgatgtccatggcccggccaca

SEQ ID NO: 49964 - DNA, 25 bp, Homo sapien
tgtcacacacgatcctcaccgagaa

SEQ ID NO: 49965 - DNA, 25 bp, Homo sapien
acacgatcctcaccgagaagaactg

SEQ ID NO: 49966 - DNA, 25 bp, Homo sapien
accattcaaaatgaggcacagcgat

SEQ ID NO: 49967 - DNA, 25 bp, Homo sapien
ggcacagcgataacttcttcacatg

SEQ ID NO: 49968 - DNA, 25 bp, Homo sapien
atgctatttcaaaaagcctgtttaa

SEQ ID NO: 49969 - DNA, 25 bp, Homo sapien
aggttattgcaggaactttaggaat

SEQ ID NO: 49970 - DNA, 25 bp, Homo sapien
tattcttcgattatctcctaagtga

SEQ ID NO: 49971 - DNA, 25 bp, Homo sapien
gattatctcctaagtgacagtgaag

SEQ ID NO: 49972 - DNA, 25 bp, Homo sapien
atgagaatttactggcaagtcacat

SEQ ID NO: 49973 - DNA, 25 bp, Homo sapien
ggcaagtcacatgttatcacctact

SEQ ID NO: 49974 - DNA, 25 bp, Homo sapien
tgttatcacctactactatttcaag

SEQ ID NO: 49975 - DNA, 25 bp, Homo sapien
tttcaaggtcatgaatttgctttct

SEQ ID NO: 49976 - DNA, 25 bp, Homo sapien
gctttctaccaaacccatagatgtg

SEQ ID NO: 49977 - DNA, 25 bp, Homo sapien
tgatcgagcgctcctggaatccatg

SEQ ID NO: 49978 - DNA, 25 bp, Homo sapien
gatcgagcgctcctggaatccatgc

SEQ ID NO: 49979 - DNA, 25 bp, Homo sapien
tctcaaggacaacctctggaaatgc

SEQ ID NO: 49980 - DNA, 25 bp, Homo sapien
ctcaaggacaacctctggaaatgca

SEQ ID NO: 49981 - DNA, 25 bp, Homo sapien
tcaaggacaacctctggaaatgcaa

SEQ ID NO: 49982 - DNA, 25 bp, Homo sapien
caaggacaacctctggaaatgcaat

SEQ ID NO: 49983 - DNA, 25 bp, Homo sapien
aaggacaacctctggaaatgcaatt

SEQ ID NO: 49984 - DNA, 25 bp, Homo sapien
aggacaacctctggaaatgcaattg

SEQ ID NO: 49985 - DNA, 25 bp, Homo sapien
ggacaacctctggaaatgcaattgc

SEQ ID NO: 49986 - DNA, 25 bp, Homo sapien
gacaacctctggaaatgcaattgcc

SEQ ID NO: 49987 - DNA, 25 bp, Homo sapien
acaacctctggaaatgcaattgcca

SEQ ID NO: 49988 - DNA, 25 bp, Homo sapien
caacctctggaaatgcaattgccac

SEQ ID NO: 49989 - DNA, 25 bp, Homo sapien
aacctctggaaatgcaattgccact

SEQ ID NO: 49990 - DNA, 25 bp, Homo sapien
acctctggaaatgcaattgccactt

SEQ ID NO: 49991 - DNA, 25 bp, Homo sapien
tgctcctgatccagtgtcctcgcag

SEQ ID NO: 49992 - DNA, 25 bp, Homo sapien
gctcctgatccagtgtcctcgcagg

SEQ ID NO: 49993 - DNA, 25 bp, Homo sapien
agcgcatccggcacgagttccggga

SEQ ID NO: 49994 - DNA, 25 bp, Homo sapien
agttccgggatgatctggatgagca

SEQ ID NO: 49995 - DNA, 25 bp, Homo sapien
tggatgagcagatccgtcacatgct

SEQ ID NO: 49996 - DNA, 25 bp, Homo sapien
agcagatccgtcacatgctcttctc

SEQ ID NO: 49997 - DNA, 25 bp, Homo sapien
tggagcagagtgaccggcaggacgt

SEQ ID NO: 49998 - DNA, 25 bp, Homo sapien
tggctgaagaggtgcgcgcagtctt

SEQ ID NO: 49999 - DNA, 25 bp, Homo sapien
cagtcttggagctcggccgccgcaa

SEQ ID NO: 50000 - DNA, 25 bp, Homo sapien
tcggccgccgcaagtaccaggacag

SEQ ID NO: 50001 - DNA, 25 bp, Homo sapien
aagtaccaggacagcatccgacgca

SEQ ID NO: 50002 - DNA, 25 bp, Homo sapien
aggacagcatccgacgcatgggctt

SEQ ID NO: 50003 - DNA, 25 bp, Homo sapien
agcatccgacgcatgggcttggccc

SEQ ID NO: 50004 - DNA, 25 bp, Homo sapien
ttacctgcatgaacccatctgcata

SEQ ID NO: 50005 - DNA, 25 bp, Homo sapien
tgcatgaacccatctgcataccaaa

SEQ ID NO: 50006 - DNA, 25 bp, Homo sapien
gcataccaaaggacttattctatga

SEQ ID NO: 50007 - DNA, 25 bp, Homo sapien
ataccaaaggacttattctatgaaa

SEQ ID NO: 50008 - DNA, 25 bp, Homo sapien
tttaaaaattcctcatcagcaaagg

SEQ ID NO: 50009 - DNA, 25 bp, Homo sapien
attcctcatcagcaaaggacaattc

SEQ ID NO: 50010 - DNA, 25 bp, Homo sapien
gacaattcaataaatacatccaaac

SEQ ID NO: 50011 - DNA, 25 bp, Homo sapien
atacatccaaacatgatcatcgttg

SEQ ID NO: 50012 - DNA, 25 bp, Homo sapien
aaacatgatcatcgttggagccgga

SEQ ID NO: 50013 - DNA, 25 bp, Homo sapien
aacatgatcatcgttggagccggag

SEQ ID NO: 50014 - DNA, 25 bp, Homo sapien
catgatcatcgttggagccggaggt

SEQ ID NO: 50015 - DNA, 25 bp, Homo sapien
ccaacactatagcaaaagggctgat

SEQ ID NO: 50016 - DNA, 25 bp, Homo sapien
tgatagtaaaccaaacctcaaaagg

SEQ ID NO: 50017 - DNA, 25 bp, Homo sapien
aaaggaccaagacaacagagagcat

SEQ ID NO: 50018 - DNA, 25 bp, Homo sapien
ggaaatttaagaacacaagctacgg

SEQ ID NO: 50019 - DNA, 25 bp, Homo sapien
caagctacggtattatgttaacacc

SEQ ID NO: 50020 - DNA, 25 bp, Homo sapien
gaaaacaagcggtagctctgtgaaa

SEQ ID NO: 50021 - DNA, 25 bp, Homo sapien
acaagcggtagctctgtgaaatcag

SEQ ID NO: 50022 - DNA, 25 bp, Homo sapien
gaaaaactccctgaatcaagcctct

SEQ ID NO: 50023 - DNA, 25 bp, Homo sapien
tccctgaatcaagcctctttctaaa

SEQ ID NO: 50024 - DNA, 25 bp, Homo sapien
gaatcaagcctctttctaaaagtta

SEQ ID NO: 50025 - DNA, 25 bp, Homo sapien
agttaaggctaactaatgccacata

SEQ ID NO: 50026 - DNA, 25 bp, Homo sapien
gatttcggtttcacaaatggcagac

SEQ ID NO: 50027 - DNA, 25 bp, Homo sapien
tttcacaaatggcagacttgaagat

SEQ ID NO: 50028 - DNA, 25 bp, Homo sapien
tttacaggtgcagtcaccgaaagag

SEQ ID NO: 50029 - DNA, 25 bp, Homo sapien
caccgaaagagagcgcctatctcat

SEQ ID NO: 50030 - DNA, 25 bp, Homo sapien
aagagagcgcctatctcattcagaa

SEQ ID NO: 50031 - DNA, 25 bp, Homo sapien
gagcgcctatctcattcagaatatt

SEQ ID NO: 50032 - DNA, 25 bp, Homo sapien
gcagcagttccgctttatctattac

SEQ ID NO: 50033 - DNA, 25 bp, Homo sapien
gcttttaatgcgggagctgcgattt

SEQ ID NO: 50034 - DNA, 25 bp, Homo sapien
ttagagacgattacaagcggaggcg

SEQ ID NO: 50035 - DNA, 25 bp, Homo sapien
agacgattacaagcggaggcgctgc

SEQ ID NO: 50036 - DNA, 25 bp, Homo sapien
gattacaagcggaggcgctgccgcg

SEQ ID NO: 50037 - DNA, 25 bp, Homo sapien
ccgcgcagcttgaacgactaaagca

SEQ ID NO: 50038 - DNA, 25 bp, Homo sapien
gcagcttgaacgactaaagcagaaa

SEQ ID NO: 50039 - DNA, 25 bp, Homo sapien
gagcagcctttcgagaaacgttcat

SEQ ID NO: 50040 - DNA, 25 bp, Homo sapien
gaggcgctggcaagcccgaatcggt

SEQ ID NO: 50041 - DNA, 25 bp, Homo sapien
ttaaagaggattttgtgcctgtgca

SEQ ID NO: 50042 - DNA, 25 bp, Homo sapien
ttttgtgcctgtgcagattgcaata

SEQ ID NO: 50043 - DNA, 25 bp, Homo sapien
gcagattgcaatagactatgaggct

SEQ ID NO: 50044 - DNA, 25 bp, Homo sapien
atagactatgaggctgcgaaggcag

SEQ ID NO: 50045 - DNA, 25 bp, Homo sapien
actatgaggctgcgaaggcagatgc

SEQ ID NO: 50046 - DNA, 25 bp, Homo sapien
ttctgacactttcacttttgcagat

SEQ ID NO: 50047 - DNA, 25 bp, Homo sapien
tgacactttcacttttgcagattgg

SEQ ID NO: 50048 - DNA, 25 bp, Homo sapien
acttttgcagattgggtaacacagg

SEQ ID NO: 50049 - DNA, 25 bp, Homo sapien
aacaactgccggtgatactggtagt

SEQ ID NO: 50050 - DNA, 25 bp, Homo sapien
gccggtgatactggtagttggtgtg

SEQ ID NO: 50051 - DNA, 25 bp, Homo sapien
aactcggctgtattaatcacgcgat

SEQ ID NO: 50052 - DNA, 25 bp, Homo sapien
cacaggtaatacaacacgccggact

SEQ ID NO: 50053 - DNA, 25 bp, Homo sapien
acaacacgccggactgactctggcg

SEQ ID NO: 50054 - DNA, 25 bp, Homo sapien
gtcacgctgaatatatgaccacgct

SEQ ID NO: 50055 - DNA, 25 bp, Homo sapien
tcacgctgaatatatgaccacgctc

SEQ ID NO: 50056 - DNA, 25 bp, Homo sapien
tgctgggagagatcccctggcttgc

SEQ ID NO: 50057 - DNA, 25 bp, Homo sapien
aatggtcaccgcaggccatactacc

SEQ ID NO: 50058 - DNA, 25 bp, Homo sapien
tcaccgcaggccatactaccaatga

SEQ ID NO: 50059 - DNA, 25 bp, Homo sapien
ccatactaccaatgaaatggtaggt

SEQ ID NO: 50060 - DNA, 25 bp, Homo sapien
gaaatagcactctgcatgctttgct

SEQ ID NO: 50061 - DNA, 25 bp, Homo sapien
agcactctgcatgctttgctctaca

SEQ ID NO: 50062 - DNA, 25 bp, Homo sapien
gcactctgcatgctttgctctacaa

SEQ ID NO: 50063 - DNA, 25 bp, Homo sapien
cactctgcatgctttgctctacaag

SEQ ID NO: 50064 - DNA, 25 bp, Homo sapien
actctgcatgctttgctctacaaga

SEQ ID NO: 50065 - DNA, 25 bp, Homo sapien
ctctgcatgctttgctctacaagat

SEQ ID NO: 50066 - DNA, 25 bp, Homo sapien
tctgcatgctttgctctacaagatg

SEQ ID NO: 50067 - DNA, 25 bp, Homo sapien
tgaagtgcaactgaaagctgctagt

SEQ ID NO: 50068 - DNA, 25 bp, Homo sapien
actgaaagctgctagtgatgatctg

SEQ ID NO: 50069 - DNA, 25 bp, Homo sapien
ctgaaagctgctagtgatgatctgg

SEQ ID NO: 50070 - DNA, 25 bp, Homo sapien
gtaatatacaatttgtccagtagcc

SEQ ID NO: 50071 - DNA, 25 bp, Homo sapien
aatatacaatttgtccagtagccag

SEQ ID NO: 50072 - DNA, 25 bp, Homo sapien
aatttgtccagtagccagtttgttt

SEQ ID NO: 50073 - DNA, 25 bp, Homo sapien
tgaaatccttcacgcatatcagctg

SEQ ID NO: 50074 - DNA, 25 bp, Homo sapien
tatcagctgatcgcccgtgtagaag

SEQ ID NO: 50075 - DNA, 25 bp, Homo sapien
gttcttgcgcgtctatcgcaggagt

SEQ ID NO: 50076 - DNA, 25 bp, Homo sapien
agatccgaacacagcggtcgacatt

SEQ ID NO: 50077 - DNA, 25 bp, Homo sapien
aaatcaagcctgtcacattgccgac

SEQ ID NO: 50078 - DNA, 25 bp, Homo sapien
gaacgaagccgacatgctgttctct

SEQ ID NO: 50079 - DNA, 25 bp, Homo sapien
tctgtcactgttcccggaagcacag

SEQ ID NO: 50080 - DNA, 25 bp, Homo sapien
gccccggctttgattcagtcggaat

SEQ ID NO: 50081 - DNA, 25 bp, Homo sapien
tcagtcggaatggcgctcagcagat

SEQ ID NO: 50082 - DNA, 25 bp, Homo sapien
gataacctgatctaccaagtggcta

SEQ ID NO: 50083 - DNA, 25 bp, Homo sapien
aaatgcctcctgtccatgtgaaggt

SEQ ID NO: 50084 - DNA, 25 bp, Homo sapien
ggagtgataacagtaccaagtttct

SEQ ID NO: 50085 - DNA, 25 bp, Homo sapien
gagtgataacagtaccaagtttctt

SEQ ID NO: 50086 - DNA, 25 bp, Homo sapien
agtgataacagtaccaagtttcttt

SEQ ID NO: 50087 - DNA, 25 bp, Homo sapien
gtgataacagtaccaagtttctttt

SEQ ID NO: 50088 - DNA, 25 bp, Homo sapien
gataacagtaccaagtttcttttca

SEQ ID NO: 50089 - DNA, 25 bp, Homo sapien
taacagtaccaagtttcttttcaca

SEQ ID NO: 50090 - DNA, 25 bp, Homo sapien
aacagtaccaagtttcttttcacat

SEQ ID NO: 50091 - DNA, 25 bp, Homo sapien
cttttcacatttttcgcacaccatc

SEQ ID NO: 50092 - DNA, 25 bp, Homo sapien
ttttcacatttttcgcacaccatcc

SEQ ID NO: 50093 - DNA, 25 bp, Homo sapien
tttcacatttttcgcacaccatcct

SEQ ID NO: 50094 - DNA, 25 bp, Homo sapien
tcacatttttcgcacaccatccttc

SEQ ID NO: 50095 - DNA, 25 bp, Homo sapien
ggtgccttctcggctcttgacactt

SEQ ID NO: 50096 - DNA, 25 bp, Homo sapien
tgccttctcggctcttgacacttag

SEQ ID NO: 50097 - DNA, 25 bp, Homo sapien
gccttctcggctcttgacacttagc

SEQ ID NO: 50098 - DNA, 25 bp, Homo sapien
ttctcggctcttgacacttagccgc

SEQ ID NO: 50099 - DNA, 25 bp, Homo sapien
tctcggctcttgacacttagccgct

SEQ ID NO: 50100 - DNA, 25 bp, Homo sapien
ctcggctcttgacacttagccgctg

SEQ ID NO: 50101 - DNA, 25 bp, Homo sapien
tcggctcttgacacttagccgctgt

SEQ ID NO: 50102 - DNA, 25 bp, Homo sapien
cggctcttgacacttagccgctgtc

SEQ ID NO: 50103 - DNA, 25 bp, Homo sapien
ggctcttgacacttagccgctgtct

SEQ ID NO: 50104 - DNA, 25 bp, Homo sapien
gctcttgacacttagccgctgtctc

SEQ ID NO: 50105 - DNA, 25 bp, Homo sapien
ctcttgacacttagccgctgtctcg

SEQ ID NO: 50106 - DNA, 25 bp, Homo sapien
tcttgacacttagccgctgtctcgc

SEQ ID NO: 50107 - DNA, 25 bp, Homo sapien
cttgacacttagccgctgtctcgcc

SEQ ID NO: 50108 - DNA, 25 bp, Homo sapien
ttgacacttagccgctgtctcgccg

SEQ ID NO: 50109 - DNA, 25 bp, Homo sapien
tgacacttagccgctgtctcgccgt

SEQ ID NO: 50110 - DNA, 25 bp, Homo sapien
gacacttagccgctgtctcgccgtg

SEQ ID NO: 50111 - DNA, 25 bp, Homo sapien
acacttagccgctgtctcgccgtgt

SEQ ID NO: 50112 - DNA, 25 bp, Homo sapien
cacttagccgctgtctcgccgtgtc

SEQ ID NO: 50113 - DNA, 25 bp, Homo sapien
tctccaccgagcggcgtgtaagagt

SEQ ID NO: 50114 - DNA, 25 bp, Homo sapien
tccaccgagcggcgtgtaagagtgc

SEQ ID NO: 50115 - DNA, 25 bp, Homo sapien
ggtgctggcggctggtttacgccgc

SEQ ID NO: 50116 - DNA, 25 bp, Homo sapien
ctttctgacactttcacttttgcag

SEQ ID NO: 50117 - DNA, 25 bp, Homo sapien
tgacactttcacttttgcagattgg

SEQ ID NO: 50118 - DNA, 25 bp, Homo sapien
tttgcagattgggtaacacaggaac

SEQ ID NO: 50119 - DNA, 25 bp, Homo sapien
gaaaacgtcacgctgaatatatgac

SEQ ID NO: 50120 - DNA, 25 bp, Homo sapien
aaacgtcacgctgaatatatgacca

SEQ ID NO: 50121 - DNA, 25 bp, Homo sapien
cgtcacgctgaatatatgaccacgc

SEQ ID NO: 50122 - DNA, 25 bp, Homo sapien
acgctgaatatatgaccacgctcac

SEQ ID NO: 50123 - DNA, 25 bp, Homo sapien
ctgaatatatgaccacgctcacccg

SEQ ID NO: 50124 - DNA, 25 bp, Homo sapien
gaatatatgaccacgctcacccgca

SEQ ID NO: 50125 - DNA, 25 bp, Homo sapien
cccgcatgattcccgcgccgctgct

SEQ ID NO: 50126 - DNA, 25 bp, Homo sapien
catgattcccgcgccgctgctggga

SEQ ID NO: 50127 - DNA, 25 bp, Homo sapien
gattcccgcgccgctgctgggagag

SEQ ID NO: 50128 - DNA, 25 bp, Homo sapien
cgcgccgctgctgggagagatcccc

SEQ ID NO: 50129 - DNA, 25 bp, Homo sapien
ccgctgctgggagagatcccctggc

SEQ ID NO: 50130 - DNA, 25 bp, Homo sapien
ctgctgggagagatcccctggcttg

SEQ ID NO: 50131 - DNA, 25 bp, Homo sapien
gctgggagagatcccctggcttgca

SEQ ID NO: 50132 - DNA, 25 bp, Homo sapien
ggagagatcccctggcttgcagaaa

SEQ ID NO: 50133 - DNA, 25 bp, Homo sapien
gagatcccctggcttgcagaaaatc

SEQ ID NO: 50134 - DNA, 25 bp, Homo sapien
atcccctggcttgcagaaaatccag

SEQ ID NO: 50135 - DNA, 25 bp, Homo sapien
tactggcaatgcttccacagcgtaa

SEQ ID NO: 50136 - DNA, 25 bp, Homo sapien
gggttgtggacctggctggatgagc

SEQ ID NO: 50137 - DNA, 25 bp, Homo sapien
tgagccgccactggcgggaacgtca

SEQ ID NO: 50138 - DNA, 25 bp, Homo sapien
gcgcaggtgacggccttagatctct

SEQ ID NO: 50139 - DNA, 25 bp, Homo sapien
gccttagatctctcgccgccaatgc

SEQ ID NO: 50140 - DNA, 25 bp, Homo sapien
gccgccaatgcttgttcaggcacgc

SEQ ID NO: 50141 - DNA, 25 bp, Homo sapien
tgttcaggcacgccagaaggatgcc

SEQ ID NO: 50142 - DNA, 25 bp, Homo sapien
agaaggatgccgcagaccattatct

SEQ ID NO: 50143 - DNA, 25 bp, Homo sapien
gccgcagaccattatctggcgggag

SEQ ID NO: 50144 - DNA, 25 bp, Homo sapien
cgttagcgactgcgacgttcgatct

SEQ ID NO: 50145 - DNA, 25 bp, Homo sapien
cgacgttcgatcttgcatggagcaa

SEQ ID NO: 50146 - DNA, 25 bp, Homo sapien
gatcttgcatggagcaatctcgcag

SEQ ID NO: 50147 - DNA, 25 bp, Homo sapien
caatctcgcagtgcagtggtgcggt

SEQ ID NO: 50148 - DNA, 25 bp, Homo sapien
atttatccacggcactccgcgagct

SEQ ID NO: 50149 - DNA, 25 bp, Homo sapien
cagcggcatttggtcgggcagccgc

SEQ ID NO: 50150 - DNA, 25 bp, Homo sapien
gtcgggcagccgcacactatgagca

SEQ ID NO: 50151 - DNA, 25 bp, Homo sapien
cgcacactatgagcaacatgcagat

SEQ ID NO: 50152 - DNA, 25 bp, Homo sapien
aacatgcagatctacagcgccagag

SEQ ID NO: 50153 - DNA, 25 bp, Homo sapien
tacagcgccagagtgctgacgcctt

SEQ ID NO: 50154 - DNA, 25 bp, Homo sapien
gagtgctgacgccttactggcaatg

SEQ ID NO: 50155 - DNA, 25 bp, Homo sapien
gatgcagacccagaagcacggctga

SEQ ID NO: 50156 - DNA, 25 bp, Homo sapien
cacggctgacagctgagtgtgtaca

SEQ ID NO: 50157 - DNA, 25 bp, Homo sapien
tgagtgtgtacagcagcgcctggct

SEQ ID NO: 50158 - DNA, 25 bp, Homo sapien
tttccagagagctgtccacgtggct

SEQ ID NO: 50159 - DNA, 25 bp, Homo sapien
acctctctgcccagaagactgtact

SEQ ID NO: 50160 - DNA, 25 bp, Homo sapien
gaagactgtacttcaattcctgccc

SEQ ID NO: 50161 - DNA, 25 bp, Homo sapien
ctgtaggcctcagcggagtgcctgc

SEQ ID NO: 50162 - DNA, 25 bp, Homo sapien
acttcagcgttcagcaaggcccttg

SEQ ID NO: 50163 - DNA, 25 bp, Homo sapien
aaggcccttgttccaggaatcctca

SEQ ID NO: 50164 - DNA, 25 bp, Homo sapien
tgcctgtaccctttctcctgtgtaa

SEQ ID NO: 50165 - DNA, 25 bp, Homo sapien
atatgcagtttatgtgtcatcaatg

SEQ ID NO: 50166 - DNA, 25 bp, Homo sapien
gtgtgtctgtctattttgatccggc

SEQ ID NO: 50167 - DNA, 25 bp, Homo sapien
tgtctattttgatccggcccaagtt

SEQ ID NO: 50168 - DNA, 25 bp, Homo sapien
ccggcccaagttcctaagtagagca

SEQ ID NO: 50169 - DNA, 25 bp, Homo sapien
caagaattcatcaaccagctgcctt

SEQ ID NO: 50170 - DNA, 25 bp, Homo sapien
tgcctttgtttcatttcacctcagc

SEQ ID NO: 50171 - DNA, 25 bp, Homo sapien
ttgtttcatttcacctcagcacgta

SEQ ID NO: 50172 - DNA, 25 bp, Homo sapien
tcagcacgtaccatcgtcctttggg

SEQ ID NO: 50173 - DNA, 25 bp, Homo sapien
gtttgtaaatcttaacctcctgcct

SEQ ID NO: 50174 - DNA, 25 bp, Homo sapien
aacctcctgcctaggatttgtacag

SEQ ID NO: 50175 - DNA, 25 bp, Homo sapien
gcctaggatttgtacagcatttggt

SEQ ID NO: 50176 - DNA, 25 bp, Homo sapien
gtacagcatttggtgtgtgcttata

SEQ ID NO: 50177 - DNA, 25 bp, Homo sapien
cccgtgattgtcatacatctctggt

SEQ ID NO: 50178 - DNA, 25 bp, Homo sapien
acatctctggtataagcaacatttg

SEQ ID NO: 50179 - DNA, 25 bp, Homo sapien
aagtgtgtagaccatctcttcatat

SEQ ID NO: 50180 - DNA, 25 bp, Homo sapien
agaccatctcttcatattttcaaga

SEQ ID NO: 50181 - DNA, 25 bp, Homo sapien
ttaaaacagtttggccataatccta

SEQ ID NO: 50182 - DNA, 25 bp, Homo sapien
tggccataatcctagatgcacgctt

SEQ ID NO: 50183 - DNA, 25 bp, Homo sapien
tgcacgcttctaattcatgtacctg

SEQ ID NO: 50184 - DNA, 25 bp, Homo sapien
gtacctgcacatgtgacctttgtga

SEQ ID NO: 50185 - DNA, 25 bp, Homo sapien
gacctttgtgaacagaaatttgcat

SEQ ID NO: 50186 - DNA, 25 bp, Homo sapien
aactttctggttatatactgcttat

SEQ ID NO: 50187 - DNA, 25 bp, Homo sapien
atactgcttatatctgtggattcaa

SEQ ID NO: 50188 - DNA, 25 bp, Homo sapien
catcccaggtcaccacttggatgac

SEQ ID NO: 50189 - DNA, 25 bp, Homo sapien
atcccaggtcaccacttggatgacc

SEQ ID NO: 50190 - DNA, 25 bp, Homo sapien
taactccctcacttggacttgagac

SEQ ID NO: 50191 - DNA, 25 bp, Homo sapien
aactccctcacttggacttgagacc

SEQ ID NO: 50192 - DNA, 25 bp, Homo sapien
tccctcacttggacttgagaccctt

SEQ ID NO: 50193 - DNA, 25 bp, Homo sapien
ctcacttggacttgagacccttcac

SEQ ID NO: 50194 - DNA, 25 bp, Homo sapien
tcacttggacttgagacccttcaca

SEQ ID NO: 50195 - DNA, 25 bp, Homo sapien
acttggacttgagacccttcacaac

SEQ ID NO: 50196 - DNA, 25 bp, Homo sapien
cctcacttggacttgagacccttca

SEQ ID NO: 50197 - DNA, 25 bp, Homo sapien
cacttggacttgagacccttcacaa

SEQ ID NO: 50198 - DNA, 25 bp, Homo sapien
cttggacttgagacccttcacaacc

SEQ ID NO: 50199 - DNA, 25 bp, Homo sapien
tgacatcatgctttctggaaacttc

SEQ ID NO: 50200 - DNA, 25 bp, Homo sapien
gacatcatgctttctggaaacttcc

SEQ ID NO: 50201 - DNA, 25 bp, Homo sapien
atcatgctttctggaaacttccccg

SEQ ID NO: 50202 - DNA, 25 bp, Homo sapien
tcatgctttctggaaacttccccgt

SEQ ID NO: 50203 - DNA, 25 bp, Homo sapien
tgctttctggaaacttccccgtatg

SEQ ID NO: 50204 - DNA, 25 bp, Homo sapien
ggagcaggttcaccagctttatgat

SEQ ID NO: 50205 - DNA, 25 bp, Homo sapien
cagttttcccatggaaatcagacag

SEQ ID NO: 50206 - DNA, 25 bp, Homo sapien
ggaaatcagacagtacctggcacag

SEQ ID NO: 50207 - DNA, 25 bp, Homo sapien
gtacctggcacagtggttagaaaag

SEQ ID NO: 50208 - DNA, 25 bp, Homo sapien
ggagcacgctgccaatgatgtttca

SEQ ID NO: 50209 - DNA, 25 bp, Homo sapien
cgctgccaatgatgtttcatttgcc

SEQ ID NO: 50210 - DNA, 25 bp, Homo sapien
tgtttcatttgccaccatccgtttt

SEQ ID NO: 50211 - DNA, 25 bp, Homo sapien
caccatccgttttcatgacctcctg

SEQ ID NO: 50212 - DNA, 25 bp, Homo sapien
cctcctgtcacagctggatgatcaa

SEQ ID NO: 50213 - DNA, 25 bp, Homo sapien
ggagaataacttcttgctacagcat

SEQ ID NO: 50214 - DNA, 25 bp, Homo sapien
aagcaagcgtaatcttcaggataat

SEQ ID NO: 50215 - DNA, 25 bp, Homo sapien
taattttcaggaagacccaatccag

SEQ ID NO: 50216 - DNA, 25 bp, Homo sapien
cccaatccagatgtctatgatcatt

SEQ ID NO: 50217 - DNA, 25 bp, Homo sapien
catttacagctgtctgaaggaagaa

SEQ ID NO: 50218 - DNA, 25 bp, Homo sapien
tctggaaaacgcccagagatttaat

SEQ ID NO: 50219 - DNA, 25 bp, Homo sapien
gagatttaatcaggctcagtcgggg

SEQ ID NO: 50220 - DNA, 25 bp, Homo sapien
tattcagagcacagtgatgttagac

SEQ ID NO: 50221 - DNA, 25 bp, Homo sapien
caaatgcaaaaccttgcagaacaga

SEQ ID NO: 50222 - DNA, 25 bp, Homo sapien
cagagaacacgagaccaatggtgtg

SEQ ID NO: 50223 - DNA, 25 bp, Homo sapien
gaaacaagaacagctgttactcaag

SEQ ID NO: 50224 - DNA, 25 bp, Homo sapien
gattcagtagcagatgccgttcaaa

SEQ ID NO: 50225 - DNA, 25 bp, Homo sapien
gcagatgccgttcaaaaggtcgatt

SEQ ID NO: 50226 - DNA, 25 bp, Homo sapien
aggtcgatttaagtagaagtgcgtt

SEQ ID NO: 50227 - DNA, 25 bp, Homo sapien
ttttccattctacaccatggtaaaa

SEQ ID NO: 50228 - DNA, 25 bp, Homo sapien
tttggaggataggtcaggtgcgtta

SEQ ID NO: 50229 - DNA, 25 bp, Homo sapien
ggaggataggtcaggtgcgttatct

SEQ ID NO: 50230 - DNA, 25 bp, Homo sapien
gtagctgattctggaagcaacgttc

SEQ ID NO: 50231 - DNA, 25 bp, Homo sapien
ctggaagcaacgttctttccattca

SEQ ID NO: 50232 - DNA, 25 bp, Homo sapien
gtgacactgtctatcagtacgtcgg

SEQ ID NO: 50233 - DNA, 25 bp, Homo sapien
tgacactgtctatcagtacgtcggc

SEQ ID NO: 50234 - DNA, 25 bp, Homo sapien
tatcagtacgtcggcaatggaagaa

SEQ ID NO: 50235 - DNA, 25 bp, Homo sapien
ttgtctcccaaccaaagtcatctgt

SEQ ID NO: 50236 - DNA, 25 bp, Homo sapien
atctgttcgatagcctgaccctaga

SEQ ID NO: 50237 - DNA, 25 bp, Homo sapien
accctagagctccaagatgtcatca

SEQ ID NO: 50238 - DNA, 25 bp, Homo sapien
aagatgtcatcactcacgccaggct

SEQ ID NO: 50239 - DNA, 25 bp, Homo sapien
gaagcccatgttgaagttctcggtg

SEQ ID NO: 50240 - DNA, 25 bp, Homo sapien
aagttctcggtgagcttcaaagcaa

SEQ ID NO: 50241 - DNA, 25 bp, Homo sapien
ttaacacacacaaagccccggtgtc

SEQ ID NO: 50242 - DNA, 25 bp, Homo sapien
ccggtgtcggacacacagcagtaat

SEQ ID NO: 50243 - DNA, 25 bp, Homo sapien
acagcagtaatttcccagtcatagt

SEQ ID NO: 50244 - DNA, 25 bp, Homo sapien
tttcccagtcatagtcttcttttca

SEQ ID NO: 50245 - DNA, 25 bp, Homo sapien
caaatgttttgaacacctggtgatt

SEQ ID NO: 50246 - DNA, 25 bp, Homo sapien
aagatcatcagcaatgcctcctgca

SEQ ID NO: 50247 - DNA, 25 bp, Homo sapien
accaactgcttagcacccctggcca

SEQ ID NO: 50248 - DNA, 25 bp, Homo sapien
ttagcacccctggccaaggtcatcc

SEQ ID NO: 50249 - DNA, 25 bp, Homo sapien
gacaactttggtatcgtggaaggac

SEQ ID NO: 50250 - DNA, 25 bp, Homo sapien
gtggaaggactcatgaccacagtcc

SEQ ID NO: 50251 - DNA, 25 bp, Homo sapien
atcactgccacccagaagactgtgg

SEQ ID NO: 50252 - DNA, 25 bp, Homo sapien
gccacccagaagactgtggatggcc

SEQ ID NO: 50253 - DNA, 25 bp, Homo sapien
ccctccgggaaactgtggcgtgatg

SEQ ID NO: 50254 - DNA, 25 bp, Homo sapien
ggccgcggggctctccagaacatca

SEQ ID NO: 50255 - DNA, 25 bp, Homo sapien
gcctctactggcgctgccaaggctg

SEQ ID NO: 50256 - DNA, 25 bp, Homo sapien
gtgggcaaggtcatccctgagctga

SEQ ID NO: 50257 - DNA, 25 bp, Homo sapien
gtcatccctgagctgaacgggaagc

SEQ ID NO: 50258 - DNA, 25 bp, Homo sapien
gagctgaacgggaagctcactggca

SEQ ID NO: 50259 - DNA, 25 bp, Homo sapien
aagctcactggcatggccttccgtg

SEQ ID NO: 50260 - DNA, 25 bp, Homo sapien
actggcatggccttccgtgtcccca

SEQ ID NO: 50261 - DNA, 25 bp, Homo sapien
actgccaacgtgtcagtggtggacc

SEQ ID NO: 50262 - DNA, 25 bp, Homo sapien
aacgtgtcagtggtggacctgacct

SEQ ID NO: 50263 - DNA, 25 bp, Homo sapien
gtggacctgacctgccgtctagaaa

SEQ ID NO: 50264 - DNA, 25 bp, Homo sapien
ctgacctgccgtctagaaaaacctg

SEQ ID NO: 50265 - DNA, 25 bp, Homo sapien
gaaaaacctgccaaatatgatgaca

SEQ ID NO: 50266 - DNA, 25 bp, Homo sapien
gaaatattaggttcaggtgcataag

SEQ ID NO: 50267 - DNA, 25 bp, Homo sapien
ttatttaggtccagcagctacattt

SEQ ID NO: 50268 - DNA, 25 bp, Homo sapien
aggtccagcagctacatttacacat

SEQ ID NO: 50269 - DNA, 25 bp, Homo sapien
gctacatttacacatctagcagtca

SEQ ID NO: 50270 - DNA, 25 bp, Homo sapien
tacacatctagcagtcagttcttgt

SEQ ID NO: 50271 - DNA, 25 bp, Homo sapien
tcaaaacggcgccgaacatgttgct

SEQ ID NO: 50272 - DNA, 25 bp, Homo sapien
cgaacatgttgcttaccgcaccatt

SEQ ID NO: 50273 - DNA, 25 bp, Homo sapien
ccgcaccattccggagtgtatagat

SEQ ID NO: 50274 - DNA, 25 bp, Homo sapien
gtgtatagatgcagccgttgcaggc

SEQ ID NO: 50275 - DNA, 25 bp, Homo sapien
gatgcagccgttgcaggcgaagttg

SEQ ID NO: 50276 - DNA, 25 bp, Homo sapien
ctatttaatacatgaacagcctttg

SEQ ID NO: 50277 - DNA, 25 bp, Homo sapien
catgaacagcctttgccaatcgtgg

SEQ ID NO: 50278 - DNA, 25 bp, Homo sapien
gggtgaaatgacgttgccgattcac

SEQ ID NO: 50279 - DNA, 25 bp, Homo sapien
gacgttgccgattcaccagcacttg

SEQ ID NO: 50280 - DNA, 25 bp, Homo sapien
cacttgctcgtccatccctcaagag

SEQ ID NO: 50281 - DNA, 25 bp, Homo sapien
gagctcgacaaaatttactcacatt

SEQ ID NO: 50282 - DNA, 25 bp, Homo sapien
aatttactcacattcacacgcgatt

SEQ ID NO: 50283 - DNA, 25 bp, Homo sapien
tcacattcacacgcgattgcgcaat

SEQ ID NO: 50284 - DNA, 25 bp, Homo sapien
acacgcgattgcgcaatgccataaa

SEQ ID NO: 50285 - DNA, 25 bp, Homo sapien
attgcgcaatgccataaatttcttc

SEQ ID NO: 50286 - DNA, 25 bp, Homo sapien
tagaaatcggaggtgtggatgctct

SEQ ID NO: 50287 - DNA, 25 bp, Homo sapien
ggatgctctctatttagcggagaaa

SEQ ID NO: 50288 - DNA, 25 bp, Homo sapien
agcggagaaatatggtacacctctt

SEQ ID NO: 50289 - DNA, 25 bp, Homo sapien
ggagaaatatggtacacctctttac

SEQ ID NO: 50290 - DNA, 25 bp, Homo sapien
tacacctctttacgtatatgatgtg

SEQ ID NO: 50291 - DNA, 25 bp, Homo sapien
cacctctttacgtatatgatgtggc

SEQ ID NO: 50292 - DNA, 25 bp, Homo sapien
ggctttaatacgtgagcgtgctaaa

SEQ ID NO: 50293 - DNA, 25 bp, Homo sapien
gcaggcgtttatttctgcagggctg

SEQ ID NO: 50294 - DNA, 25 bp, Homo sapien
atcagtcgcaatgattcagctcgct

SEQ ID NO: 50295 - DNA, 25 bp, Homo sapien
ggactttctttagatgtcgtatccg

SEQ ID NO: 50296 - DNA, 25 bp, Homo sapien
gagagctatatacggctgttgcagc

SEQ ID NO: 50297 - DNA, 25 bp, Homo sapien
gatcgtgccattgtgatatgaatat

SEQ ID NO: 50298 - DNA, 25 bp, Homo sapien
cgtgccattgtgatatgaatatgcc

SEQ ID NO: 50299 - DNA, 25 bp, Homo sapien
gccattgtgatatgaatatgcctta

SEQ ID NO: 50300 - DNA, 25 bp, Homo sapien
gtgatatgaatatgccttatatgct

SEQ ID NO: 50301 - DNA, 25 bp, Homo sapien
atatgaatatgccttatatgctgat

SEQ ID NO: 50302 - DNA, 25 bp, Homo sapien
gaatatgccttatatgctgatatga

SEQ ID NO: 50303 - DNA, 25 bp, Homo sapien
atatgccttatatgctgatatgaat

SEQ ID NO: 50304 - DNA, 25 bp, Homo sapien
atgccttatatgctgatatgaatat

SEQ ID NO: 50305 - DNA, 25 bp, Homo sapien
atatgctgatatgaatatgccttaa

SEQ ID NO: 50306 - DNA, 25 bp, Homo sapien
atgctgatatgaatatgccttaaaa

SEQ ID NO: 50307 - DNA, 25 bp, Homo sapien
gctgatatgaatatgccttaaaata

SEQ ID NO: 50308 - DNA, 25 bp, Homo sapien
gtaaaggcagccgaggaatccaatg

SEQ ID NO: 50309 - DNA, 25 bp, Homo sapien
actgatgatgaaatccttcacgcat

SEQ ID NO: 50310 - DNA, 25 bp, Homo sapien
atccttcacgcatatcagctgatcg

SEQ ID NO: 50311 - DNA, 25 bp, Homo sapien
tatcagctgatcgcccgtgtagaag

SEQ ID NO: 50312 - DNA, 25 bp, Homo sapien
cagaaccaggttcttgcgcgtctat

SEQ ID NO: 50313 - DNA, 25 bp, Homo sapien
tgcgcgtctatcgcaggagtgctga

SEQ ID NO: 50314 - DNA, 25 bp, Homo sapien
aaggcagcaaggtcgtagctgtgtt

SEQ ID NO: 50315 - DNA, 25 bp, Homo sapien
aagatccgaacacagcggtcgacat

SEQ ID NO: 50316 - DNA, 25 bp, Homo sapien
gcggtcgacatttcagaaatcaagc

SEQ ID NO: 50317 - DNA, 25 bp, Homo sapien
tcagaaatcaagcctgtcacattgc

SEQ ID NO: 50318 - DNA, 25 bp, Homo sapien
cctgtcacattgccgactgatgaag

SEQ ID NO: 50319 - DNA, 25 bp, Homo sapien
gacagcatccttgaatatgtaaaag

SEQ ID NO: 50320 - DNA, 25 bp, Homo sapien
acgaagccgacatgctgttctctgt

SEQ ID NO: 50321 - DNA, 25 bp, Homo sapien
tgctgttctctgtcactgttcccgg

SEQ ID NO: 50322 - DNA, 25 bp, Homo sapien
gctttgattcagtcggaatggcgct

SEQ ID NO: 50323 - DNA, 25 bp, Homo sapien
tcggaatggcgctcagcagatattt

SEQ ID NO: 50324 - DNA, 25 bp, Homo sapien
cagatatttgaagctgaccgtcttt

SEQ ID NO: 50325 - DNA, 25 bp, Homo sapien
tgaccgtctttgaaagcgacaaatg

SEQ ID NO: 50326 - DNA, 25 bp, Homo sapien
cagataacctgatctaccaagtggc

SEQ ID NO: 50327 - DNA, 25 bp, Homo sapien
ctcctgtccatgtgaaggtgtggag

SEQ ID NO: 50328 - DNA, 25 bp, Homo sapien
gctttggaaattattgcctctgata

SEQ ID NO: 50329 - DNA, 25 bp, Homo sapien
ttattgcctctgatacatacctaag

SEQ ID NO: 50330 - DNA, 25 bp, Homo sapien
acattacttggagggttgcagtttc

SEQ ID NO: 50331 - DNA, 25 bp, Homo sapien
ggagggttgcagtttctaagtgaaa

SEQ ID NO: 50332 - DNA, 25 bp, Homo sapien
ggaaacaagcatgaacggcagtcta

SEQ ID NO: 50333 - DNA, 25 bp, Homo sapien
tgaacggcagtctagaataccagaa

SEQ ID NO: 50334 - DNA, 25 bp, Homo sapien
gaataccagaaacatctacttgggt

SEQ ID NO: 50335 - DNA, 25 bp, Homo sapien
tctacttgggtagcttggtgccatt

SEQ ID NO: 50336 - DNA, 25 bp, Homo sapien
agcttggtgccattatcctgtggaa

SEQ ID NO: 50337 - DNA, 25 bp, Homo sapien
gccattatcctgtggaatctgatat

SEQ ID NO: 50338 - DNA, 25 bp, Homo sapien
gatatgtctggtagcatgtcattga

SEQ ID NO: 50339 - DNA, 25 bp, Homo sapien
cttgacttcttaaccttaatttgat

SEQ ID NO: 50340 - DNA, 25 bp, Homo sapien
ccctgtgaagggtattcaaaaacat

SEQ ID NO: 50341 - DNA, 25 bp, Homo sapien
aaaaacataactcatcaactctcta

SEQ ID NO: 50342 - DNA, 25 bp, Homo sapien
taactcatcaactctctatttcaag

SEQ ID NO: 50343 - DNA, 25 bp, Homo sapien
aactctctatttcaagtacacttat

SEQ ID NO: 50344 - DNA, 25 bp, Homo sapien
acacttatcctttggtatactcggg

SEQ ID NO: 50345 - DNA, 25 bp, Homo sapien
attggttccaggaccacccatgtat

SEQ ID NO: 50346 - DNA, 25 bp, Homo sapien
ggaccacccatgtatacgaaaatct

SEQ ID NO: 50347 - DNA, 25 bp, Homo sapien
aatctacccatactcaagttgcacg

SEQ ID NO: 50348 - DNA, 25 bp, Homo sapien
atactcaagttgcacggtcagcctg

SEQ ID NO: 50349 - DNA, 25 bp, Homo sapien
gtcagcctggtggaacctgtgtata

SEQ ID NO: 50350 - DNA, 25 bp, Homo sapien
gaaactctggcttaggaaaacatga

SEQ ID NO: 50351 - DNA, 25 bp, Homo sapien
tctggcttaggaaaacatgaacaca

SEQ ID NO: 50352 - DNA, 25 bp, Homo sapien
cagaggcaaactgttgttcgagtta

SEQ ID NO: 50353 - DNA, 25 bp, Homo sapien
agttaaatataaatctcaggctctt

SEQ ID NO: 50354 - DNA, 25 bp, Homo sapien
taaatctcaggctctttaaaggtaa

SEQ ID NO: 50355 - DNA, 25 bp, Homo sapien
gatgatacaaatatgaaagaggcct

SEQ ID NO: 50356 - DNA, 25 bp, Homo sapien
gccttcagtgtttgtttattaagaa

SEQ ID NO: 50357 - DNA, 25 bp, Homo sapien
ttaagaatcttaatgcagtttactg

SEQ ID NO: 50358 - DNA, 25 bp, Homo sapien
aaaacagctaacattgtctgaaaat

SEQ ID NO: 50359 - DNA, 25 bp, Homo sapien
attgtctgaaaattatgttacctat

SEQ ID NO: 50360 - DNA, 25 bp, Homo sapien
tatgttacctataagaagttggaaa

SEQ ID NO: 50361 - DNA, 25 bp, Homo sapien
ctaacttagctgtattctcatgtaa

SEQ ID NO: 50362 - DNA, 25 bp, Homo sapien
taattaagcaaatccctcaataagt

SEQ ID NO: 50363 - DNA, 25 bp, Homo sapien
tcaataagttgagcccaggtgtcct

SEQ ID NO: 50364 - DNA, 25 bp, Homo sapien
aggtgtcctctttcctgaacttgga

SEQ ID NO: 50365 - DNA, 25 bp, Homo sapien
gaacttggagcatgtttggataaca

SEQ ID NO: 50366 - DNA, 25 bp, Homo sapien
cactgggatgttcaagtctactttt

SEQ ID NO: 50367 - DNA, 25 bp, Homo sapien
actcagtaggtgttgggcaggaatt

SEQ ID NO: 50368 - DNA, 25 bp, Homo sapien
aattggtgagattcctgacttgata

SEQ ID NO: 50369 - DNA, 25 bp, Homo sapien
gattcctgacttgataccttgctaa

SEQ ID NO: 50370 - DNA, 25 bp, Homo sapien
ctaaatggacatgtaactgtgtgct

SEQ ID NO: 50371 - DNA, 25 bp, Homo sapien
gtgctccttcctatcagtttgtaaa

SEQ ID NO: 50372 - DNA, 25 bp, Homo sapien
acctgtaatccgactgtaagctcat

SEQ ID NO: 50373 - DNA, 25 bp, Homo sapien
gtaatccgactgtaagctcatcacc

SEQ ID NO: 50374 - DNA, 25 bp, Homo sapien
aatccgactgtaagctcatcacctt

SEQ ID NO: 50375 - DNA, 25 bp, Homo sapien
cgactgtaagctcatcaccttggga

SEQ ID NO: 50376 - DNA, 25 bp, Homo sapien
actgtaagctcatcaccttgggagg

SEQ ID NO: 50377 - DNA, 25 bp, Homo sapien
agtaataaaatgaaccgggcatggt

SEQ ID NO: 50378 - DNA, 25 bp, Homo sapien
agctgctctgataagaggaggctca

SEQ ID NO: 50379 - DNA, 25 bp, Homo sapien
ataagaggaggctcactcgagccca

SEQ ID NO: 50380 - DNA, 25 bp, Homo sapien
agtgagcagagcgtgccgctacact

SEQ ID NO: 50381 - DNA, 25 bp, Homo sapien
cagcctgatgacagaccgagacact

SEQ ID NO: 50382 - DNA, 25 bp, Homo sapien
tgatgacagaccgagacactgtctc

SEQ ID NO: 50383 - DNA, 25 bp, Homo sapien
ctgccagtagcatatgcttgtctca

SEQ ID NO: 50384 - DNA, 25 bp, Homo sapien
aaagattaagccatgcatgtctaag

SEQ ID NO: 50385 - DNA, 25 bp, Homo sapien
taagccatgcatgtctaagtacgca

SEQ ID NO: 50386 - DNA, 25 bp, Homo sapien
gtctaagtacgcacggccggtacag

SEQ ID NO: 50387 - DNA, 25 bp, Homo sapien
ggtacagtgaaactgcgaatggctc

SEQ ID NO: 50388 - DNA, 25 bp, Homo sapien
cattaaatcagttatggttcctttg

SEQ ID NO: 50389 - DNA, 25 bp, Homo sapien
atcagttatggttcctttggtcgct

SEQ ID NO: 50390 - DNA, 25 bp, Homo sapien
tcgctcctctcctacttggataact

SEQ ID NO: 50391 - DNA, 25 bp, Homo sapien
aattctagagctaatacatgccgac

SEQ ID NO: 50392 - DNA, 25 bp, Homo sapien
aatacatgccgacgggcgctgaccc

SEQ ID NO: 50393 - DNA, 25 bp, Homo sapien
tttatcagatcaaaaccaacccggt

SEQ ID NO: 50394 - DNA, 25 bp, Homo sapien
cggctttggtgactctagataacct

SEQ ID NO: 50395 - DNA, 25 bp, Homo sapien
tgactctagataacctcgggccgat

SEQ ID NO: 50396 - DNA, 25 bp, Homo sapien
cgtggcggcgacgacccattcgaac

SEQ ID NO: 50397 - DNA, 25 bp, Homo sapien
gacccattcgaacgtctgccctatc

SEQ ID NO: 50398 - DNA, 25 bp, Homo sapien
ccctatcaactttcgatggtagtcg

SEQ ID NO: 50399 - DNA, 25 bp, Homo sapien
tcgatggtagtcgccgtgcctacca

SEQ ID NO: 50400 - DNA, 25 bp, Homo sapien
cctaccatggtgaccacgggtgacg

SEQ ID NO: 50401 - DNA, 25 bp, Homo sapien
acggctaccacatccaaggaaggca

SEQ ID NO: 50402 - DNA, 25 bp, Homo sapien
ggcagcaggcgcgcaaattacccac

SEQ ID NO: 50403 - DNA, 25 bp, Homo sapien
gaaatcacatgtagcagattgcata

SEQ ID NO: 50404 - DNA, 25 bp, Homo sapien
gattgcatagtctgtaatcctctca

SEQ ID NO: 50405 - DNA, 25 bp, Homo sapien
atagtctgtaatcctctcagaggga

SEQ ID NO: 50406 - DNA, 25 bp, Homo sapien
cctctcagagggaaacttcttgttt

SEQ ID NO: 50407 - DNA, 25 bp, Homo sapien
aacttcttgtttaaacagctctata

SEQ ID NO: 50408 - DNA, 25 bp, Homo sapien
aacagctctatatggatttatactt

SEQ ID NO: 50409 - DNA, 25 bp, Homo sapien
atttcagtcatttgaagcctccgtc

SEQ ID NO: 50410 - DNA, 25 bp, Homo sapien
tcatttgaagcctccgtcccttctt

SEQ ID NO: 50411 - DNA, 25 bp, Homo sapien
cttcttccattctcagccagaagca

SEQ ID NO: 50412 - DNA, 25 bp, Homo sapien
aggattcacactcaacaggttttag

SEQ ID NO: 50413 - DNA, 25 bp, Homo sapien
gattgttatacttacacattaggta

SEQ ID NO: 50414 - DNA, 25 bp, Homo sapien
atgttgtctgaatttaccacctttg

SEQ ID NO: 50415 - DNA, 25 bp, Homo sapien
gaatttaccacctttgtcagaagtc

SEQ ID NO: 50416 - DNA, 25 bp, Homo sapien
accacctttgtcagaagtcaactca

SEQ ID NO: 50417 - DNA, 25 bp, Homo sapien
agtcaactcaaagcttccaatgtag

SEQ ID NO: 50418 - DNA, 25 bp, Homo sapien
tcaaagcttccaatgtagtcagtct

SEQ ID NO: 50419 - DNA, 25 bp, Homo sapien
aatgtagtcagtctataattcctta

SEQ ID NO: 50420 - DNA, 25 bp, Homo sapien
ttccttaatcaaagtcagcaattta

SEQ ID NO: 50421 - DNA, 25 bp, Homo sapien
tatggacagcttcagcatttacagt

SEQ ID NO: 50422 - DNA, 25 bp, Homo sapien
gcatttacagttgacctttcactag

SEQ ID NO: 50423 - DNA, 25 bp, Homo sapien
agttgacctttcactagccaggcaa

SEQ ID NO: 50424 - DNA, 25 bp, Homo sapien
tagccaggcaaacttcccttaaaat

SEQ ID NO: 50425 - DNA, 25 bp, Homo sapien
tgtatgacgctgggcacgttgagtg

SEQ ID NO: 50426 - DNA, 25 bp, Homo sapien
gctgggcacgttgagtgaatctcag

SEQ ID NO: 50427 - DNA, 25 bp, Homo sapien
cacgcacttatcaggaacgcctcga

SEQ ID NO: 50428 - DNA, 25 bp, Homo sapien
tgccgggatcaaagtctgttctggc

SEQ ID NO: 50429 - DNA, 25 bp, Homo sapien
ccgggatcaaagtctgttctggcgg

SEQ ID NO: 50430 - DNA, 25 bp, Homo sapien
cgggatcaaagtctgttctggcggc

SEQ ID NO: 50431 - DNA, 25 bp, Homo sapien
gcattgtgggcttaggcgaaacggt

SEQ ID NO: 50432 - DNA, 25 bp, Homo sapien
aaaagatcgcgccggattattgctg

SEQ ID NO: 50433 - DNA, 25 bp, Homo sapien
agatcgcgccggattattgctgcaa

SEQ ID NO: 50434 - DNA, 25 bp, Homo sapien
ccggattattgctgcaactggcaaa

SEQ ID NO: 50435 - DNA, 25 bp, Homo sapien
cggaaagcgtgccaatcaacatgct

SEQ ID NO: 50436 - DNA, 25 bp, Homo sapien
gaaatagatgtgtttgcaatttgaa

SEQ ID NO: 50437 - DNA, 25 bp, Homo sapien
gcaatttgaagatatctttctgtcc

SEQ ID NO: 50438 - DNA, 25 bp, Homo sapien
tttgaagatatctttctgtccagaa

SEQ ID NO: 50439 - DNA, 25 bp, Homo sapien
gtccagaaggcaaaattaccgaatg

SEQ ID NO: 50440 - DNA, 25 bp, Homo sapien
ggcaaaattaccgaatgccattttt

SEQ ID NO: 50441 - DNA, 25 bp, Homo sapien
taccgaatgccatttttaaaagtat

SEQ ID NO: 50442 - DNA, 25 bp, Homo sapien
aactatgctactctcatacagggga

SEQ ID NO: 50443 - DNA, 25 bp, Homo sapien
gtgaatgacaaaccctttgaatgaa

SEQ ID NO: 50444 - DNA, 25 bp, Homo sapien
acaaaatctgttcaggttggtgtac

SEQ ID NO: 50445 - DNA, 25 bp, Homo sapien
gtggttaacgtactgttggatcaac

SEQ ID NO: 50446 - DNA, 25 bp, Homo sapien
ggttaacgtactgttggatcaacaa

SEQ ID NO: 50447 - DNA, 25 bp, Homo sapien
gattcatttttctgttagactaggc

SEQ ID NO: 50448 - DNA, 25 bp, Homo sapien
ttctgttagactaggcaaattgttc

SEQ ID NO: 50449 - DNA, 25 bp, Homo sapien
ctttttgtcttttaagtagcagtca

SEQ ID NO: 50450 - DNA, 25 bp, Homo sapien
gtagcagtcactttgcttaagatgc

SEQ ID NO: 50451 - DNA, 25 bp, Homo sapien
gtcactttgcttaagatgctaatag

SEQ ID NO: 50452 - DNA, 25 bp, Homo sapien
gatgctaatagaaaactgtggttaa

SEQ ID NO: 50453 - DNA, 25 bp, Homo sapien
ctgtgttacatgttgtattagtaaa

SEQ ID NO: 50454 - DNA, 25 bp, Homo sapien
atatcttatccaattcattatgtca

SEQ ID NO: 50455 - DNA, 25 bp, Homo sapien
ccaattcattatgtcaattcatcaa

SEQ ID NO: 50456 - DNA, 25 bp, Homo sapien
taaaataccttttatgtagaggctt

SEQ ID NO: 50457 - DNA, 25 bp, Homo sapien
tatgtagaggctttatgttgcaatt

SEQ ID NO: 50458 - DNA, 25 bp, Homo sapien
gccttagccaagacaaagcagtgtt

SEQ ID NO: 50459 - DNA, 25 bp, Homo sapien
tagccaagacaaagcagtgtttttc

SEQ ID NO: 50460 - DNA, 25 bp, Homo sapien
gagaattgactcgtatgaacaggac

SEQ ID NO: 50461 - DNA, 25 bp, Homo sapien
actcgtatgaacaggacagggtgaa

SEQ ID NO: 50462 - DNA, 25 bp, Homo sapien
aatgctgggaattataatgggaaac

SEQ ID NO: 50463 - DNA, 25 bp, Homo sapien
acaagtataatcatatcgtcggagg

SEQ ID NO: 50464 - DNA, 25 bp, Homo sapien
ataatcatatcgtcggaggttaaga

SEQ ID NO: 50465 - DNA, 25 bp, Homo sapien
tcgtcggaggttaagattatgaaat

SEQ ID NO: 50466 - DNA, 25 bp, Homo sapien
tctctattcaagatgatgttcactc

SEQ ID NO: 50467 - DNA, 25 bp, Homo sapien
atgttcactccaaatacactacaga

SEQ ID NO: 50468 - DNA, 25 bp, Homo sapien
tacactacagaatttagtcaacatt

SEQ ID NO: 50469 - DNA, 25 bp, Homo sapien
cctctcttgtttatgtcagagcttt

SEQ ID NO: 50470 - DNA, 25 bp, Homo sapien
agagctttgttgtaagcctctcact

SEQ ID NO: 50471 - DNA, 25 bp, Homo sapien
gttgtaagcctctcactttgtaagg

SEQ ID NO: 50472 - DNA, 25 bp, Homo sapien
aattcttattgggtaggttaggctg

SEQ ID NO: 50473 - DNA, 25 bp, Homo sapien
taggttaggctgagggcttacatcc

SEQ ID NO: 50474 - DNA, 25 bp, Homo sapien
gagggcttacatccttatcatcagg

SEQ ID NO: 50475 - DNA, 25 bp, Homo sapien
gttgttatttattactccttgagat

SEQ ID NO: 50476 - DNA, 25 bp, Homo sapien
tactccttgagatctagatacacat

SEQ ID NO: 50477 - DNA, 25 bp, Homo sapien
aaaatgctgggttcaaagtccttag

SEQ ID NO: 50478 - DNA, 25 bp, Homo sapien
tcaaagtccttagaattcccttcct

SEQ ID NO: 50479 - DNA, 25 bp, Homo sapien
gtctatgttgatgaccataactggg

SEQ ID NO: 50480 - DNA, 25 bp, Homo sapien
agctgcgggccatgctggccatcga

SEQ ID NO: 50481 - DNA, 25 bp, Homo sapien
ctgcgggccatgctggccatcgaag

SEQ ID NO: 50482 - DNA, 25 bp, Homo sapien
tgcgggccatgctggccatcgaaga

SEQ ID NO: 50483 - DNA, 25 bp, Homo sapien
gccatgctggccatcgaagactggc

SEQ ID NO: 50484 - DNA, 25 bp, Homo sapien
catgctggccatcgaagactggcag

SEQ ID NO: 50485 - DNA, 25 bp, Homo sapien
gctggccatcgaagactggcagaaa

SEQ ID NO: 50486 - DNA, 25 bp, Homo sapien
tggccatcgaagactggcagaaaac

SEQ ID NO: 50487 - DNA, 25 bp, Homo sapien
gcctcatggagtcaggtgccaacaa

SEQ ID NO: 50488 - DNA, 25 bp, Homo sapien
catggagtcaggtgccaacaagctg

SEQ ID NO: 50489 - DNA, 25 bp, Homo sapien
gagtcaggtgccaacaagctgcagg

SEQ ID NO: 50490 - DNA, 25 bp, Homo sapien
caggtgccaacaagctgcaggagga

SEQ ID NO: 50491 - DNA, 25 bp, Homo sapien
aggtgctgatccaggagtggttcac

SEQ ID NO: 50492 - DNA, 25 bp, Homo sapien
ggtgctgatccaggagtggttcacc

SEQ ID NO: 50493 - DNA, 25 bp, Homo sapien
ctgatccaggagtggttcaccctgg

SEQ ID NO: 50494 - DNA, 25 bp, Homo sapien
ccaggagtggttcaccctggtcaac

SEQ ID NO: 50495 - DNA, 25 bp, Homo sapien
caggagtggttcaccctggtcaaca

SEQ ID NO: 50496 - DNA, 25 bp, Homo sapien
agaagaagcagctgaagcagcccgc

SEQ ID NO: 50497 - DNA, 25 bp, Homo sapien
gaagcagctgaagcagcccgcatat

SEQ ID NO: 50498 - DNA, 25 bp, Homo sapien
gctgaagcagcccgcatattaggcg

SEQ ID NO: 50499 - DNA, 25 bp, Homo sapien
gcagcccgcatattaggcgcagata

SEQ ID NO: 50500 - DNA, 25 bp, Homo sapien
aagaattcagctaacgcttccagac

SEQ ID NO: 50501 - DNA, 25 bp, Homo sapien
aatgagtgatcaggcaattcggtca

SEQ ID NO: 50502 - DNA, 25 bp, Homo sapien
tgatcaggcaattcggtcaattgtc

SEQ ID NO: 50503 - DNA, 25 bp, Homo sapien
attcggtcaattgtcactgtcatca

SEQ ID NO: 50504 - DNA, 25 bp, Homo sapien
tcaattgtcactgtcatcagaatct

SEQ ID NO: 50505 - DNA, 25 bp, Homo sapien
gtcactgtcatcagaatctgtcggc

SEQ ID NO: 50506 - DNA, 25 bp, Homo sapien
catcagaatctgtcggccaaaagcg

SEQ ID NO: 50507 - DNA, 25 bp, Homo sapien
aggatcgccatccggatcacggcaa

SEQ ID NO: 50508 - DNA, 25 bp, Homo sapien
tccggatcacggcaatgcggctgca

SEQ ID NO: 50509 - DNA, 25 bp, Homo sapien
ggcaatgcggctgcactggtggaag

SEQ ID NO: 50510 - DNA, 25 bp, Homo sapien
gccttccggcgcataaagtcagcaa

SEQ ID NO: 50511 - DNA, 25 bp, Homo sapien
gataaatggttttcatcagccggat

SEQ ID NO: 50512 - DNA, 25 bp, Homo sapien
ttttgttattgatatctcggataca

SEQ ID NO: 50513 - DNA, 25 bp, Homo sapien
ttgatatctcggatacaatagaggc

SEQ ID NO: 50514 - DNA, 25 bp, Homo sapien
ctactcctctgacgaatgggtatat

SEQ ID NO: 50515 - DNA, 25 bp, Homo sapien
ggtatattgaaatcgttgaagcgag

SEQ ID NO: 50516 - DNA, 25 bp, Homo sapien
gcggctgaatttcggcacctgcaat

SEQ ID NO: 50517 - DNA, 25 bp, Homo sapien
agaacgaatgagggtcctctcatcg

SEQ ID NO: 50518 - DNA, 25 bp, Homo sapien
gagggtcctctcatcgttactgaag

SEQ ID NO: 50519 - DNA, 25 bp, Homo sapien
gttactgaagagcttcactccctta

SEQ ID NO: 50520 - DNA, 25 bp, Homo sapien
gaaacccaattgtgccagcctggtt

SEQ ID NO: 50521 - DNA, 25 bp, Homo sapien
caattgtgccagcctggtttggtaa

SEQ ID NO: 50522 - DNA, 25 bp, Homo sapien
attgacctcgagacgacctctctgc

SEQ ID NO: 50523 - DNA, 25 bp, Homo sapien
acgacctctctgcccgttgtggtga

SEQ ID NO: 50524 - DNA, 25 bp, Homo sapien
agccagctcccgagcggttgggcct

SEQ ID NO: 50525 - DNA, 25 bp, Homo sapien
gtggcggaacccaggaatctgtcct

SEQ ID NO: 50526 - DNA, 25 bp, Homo sapien
cccaggaatctgtccttcttcctga

SEQ ID NO: 50527 - DNA, 25 bp, Homo sapien
tccttcttcctgactccaccatgtg

SEQ ID NO: 50528 - DNA, 25 bp, Homo sapien
ccaccatgtgcacgatgggctcagc

SEQ ID NO: 50529 - DNA, 25 bp, Homo sapien
gcacgatgggctcagctttcagaag

SEQ ID NO: 50530 - DNA, 25 bp, Homo sapien
cagctttcagaagtgctgagttggc

SEQ ID NO: 50531 - DNA, 25 bp, Homo sapien
ttttcttctgtcaccaaaagaggtc

SEQ ID NO: 50532 - DNA, 25 bp, Homo sapien
agaggtctcaatgtggaccagctga

SEQ ID NO: 50533 - DNA, 25 bp, Homo sapien
gaccagctgaacatgttgggagaga

SEQ ID NO: 50534 - DNA, 25 bp, Homo sapien
cccgatggtctcattccgtggacga

SEQ ID NO: 50535 - DNA, 25 bp, Homo sapien
gatggtctcattccgtggacgaggt

SEQ ID NO: 50536 - DNA, 25 bp, Homo sapien
gtaaatacacccacgtactggacgc

SEQ ID NO: 50537 - DNA, 25 bp, Homo sapien
acgcgggttgtggacctggctggat

SEQ ID NO: 50538 - DNA, 25 bp, Homo sapien
cgccgccaatgcttgttcaggcacg

SEQ ID NO: 50539 - DNA, 25 bp, Homo sapien
ccagaaggatgccgcagaccattat

SEQ ID NO: 50540 - DNA, 25 bp, Homo sapien
aggatgccgcagaccattatctggc

SEQ ID NO: 50541 - DNA, 25 bp, Homo sapien
ctgccgttagcgactgcgacgttcg

SEQ ID NO: 50542 - DNA, 25 bp, Homo sapien
acgttcgatcttgcatggagcaatc

SEQ ID NO: 50543 - DNA, 25 bp, Homo sapien
gcatggagcaatctcgcagtgcagt

SEQ ID NO: 50544 - DNA, 25 bp, Homo sapien
atggagcaatctcgcagtgcagtgg

SEQ ID NO: 50545 - DNA, 25 bp, Homo sapien
cacggcactccgcgagctgtatcgg

SEQ ID NO: 50546 - DNA, 25 bp, Homo sapien
atgcagatctacagcgccagagtgc

SEQ ID NO: 50547 - DNA, 25 bp, Homo sapien
agccaggcatcgcaggactcatgaa

SEQ ID NO: 50548 - DNA, 25 bp, Homo sapien
gaagatcgtgaaagaggcttaccca

SEQ ID NO: 50549 - DNA, 25 bp, Homo sapien
gaaagaggcttacccagaccacaca

SEQ ID NO: 50550 - DNA, 25 bp, Homo sapien
aaaacaatccccattatgacccatc

SEQ ID NO: 50551 - DNA, 25 bp, Homo sapien
ttatgacccatctagcaaagaggac

SEQ ID NO: 50552 - DNA, 25 bp, Homo sapien
tctagcaaagaggacaaccctaagt

SEQ ID NO: 50553 - DNA, 25 bp, Homo sapien
accaagttaactgagatactgctgc

SEQ ID NO: 50554 - DNA, 25 bp, Homo sapien
ggaatgggcgagacattgctgcaaa

SEQ ID NO: 50555 - DNA, 25 bp, Homo sapien
gacattgctgcaaagaagtcaagct

SEQ ID NO: 50556 - DNA, 25 bp, Homo sapien
gaagtcaagcttttttcagacaaaa

SEQ ID NO: 50557 - DNA, 25 bp, Homo sapien
ttgcttggtatgcttacctgggctt

SEQ ID NO: 50558 - DNA, 25 bp, Homo sapien
gggtcagaaggattcctatgtgggc

SEQ ID NO: 50559 - DNA, 25 bp, Homo sapien
gaaggattcctatgtgggcgacgag

SEQ ID NO: 50560 - DNA, 25 bp, Homo sapien
ccccatcgagcacggcatcgtcacc

SEQ ID NO: 50561 - DNA, 25 bp, Homo sapien
cgtcaccaactgggacgacatggag

SEQ ID NO: 50562 - DNA, 25 bp, Homo sapien
caccttctacaatgagctgcgtgtg

SEQ ID NO: 50563 - DNA, 25 bp, Homo sapien
tcccgaggagcaccccgtgctgctg

SEQ ID NO: 50564 - DNA, 25 bp, Homo sapien
ggccaaccgcgagaagatgacccag

SEQ ID NO: 50565 - DNA, 25 bp, Homo sapien
ccagatcatgtttgagaccttcaac

SEQ ID NO: 50566 - DNA, 25 bp, Homo sapien
cccagccatgtacgttgctatccag

SEQ ID NO: 50567 - DNA, 25 bp, Homo sapien
cgttgctatccaggctgtgctatcc

SEQ ID NO: 50568 - DNA, 25 bp, Homo sapien
ggctgtgctatccctgtacgcctct

SEQ ID NO: 50569 - DNA, 25 bp, Homo sapien
cgcctctggccgtaccactggcatc

SEQ ID NO: 50570 - DNA, 25 bp, Homo sapien
taccactggcatcgtgatggactcc

SEQ ID NO: 50571 - DNA, 25 bp, Homo sapien
cggtgacggggtcacccacactgtg

SEQ ID NO: 50572 - DNA, 25 bp, Homo sapien
ccacactgtgcccatctacgagggg

SEQ ID NO: 50573 - DNA, 25 bp, Homo sapien
gcccatctacgaggggtatgccctc

SEQ ID NO: 50574 - DNA, 25 bp, Homo sapien
tgccatcctgcgtctggacctggct

SEQ ID NO: 50575 - DNA, 25 bp, Homo sapien
tgatatcgccgcgctcgtcgtcgac

SEQ ID NO: 50576 - DNA, 25 bp, Homo sapien
cgtcgtcgacaacggctccggcatg

SEQ ID NO: 50577 - DNA, 25 bp, Homo sapien
cggctccggcatgtgcaaggccggc

SEQ ID NO: 50578 - DNA, 25 bp, Homo sapien
aagatatctcacgtactgacggtgg

SEQ ID NO: 50579 - DNA, 25 bp, Homo sapien
gttaatccatattggcagaacgaaa

SEQ ID NO: 50580 - DNA, 25 bp, Homo sapien
aacgaaaacgctggttagcaccgca

SEQ ID NO: 50581 - DNA, 25 bp, Homo sapien
cgctggttagcaccgcaggtgtaga

SEQ ID NO: 50582 - DNA, 25 bp, Homo sapien
ggtcgagcgatggatttccgtctct

SEQ ID NO: 50583 - DNA, 25 bp, Homo sapien
tagctgatgatccgaataactacct

SEQ ID NO: 50584 - DNA, 25 bp, Homo sapien
atgatccgaataactacctgttttg

SEQ ID NO: 50585 - DNA, 25 bp, Homo sapien
ataactacctgttttgccgggtcag

SEQ ID NO: 50586 - DNA, 25 bp, Homo sapien
ctgttttgccgggtcagaaaaaatg

SEQ ID NO: 50587 - DNA, 25 bp, Homo sapien
aaaaaatggtgttgccgcgccatct

SEQ ID NO: 50588 - DNA, 25 bp, Homo sapien
ccagctatcaactcgcgccctggaa

SEQ ID NO: 50589 - DNA, 25 bp, Homo sapien
gctcccagctggctaaactttgcct

SEQ ID NO: 50590 - DNA, 25 bp, Homo sapien
aactttgcctccagtggtcaaagat

SEQ ID NO: 50591 - DNA, 25 bp, Homo sapien
gtgggtttgggctccattctggatt

SEQ ID NO: 50592 - DNA, 25 bp, Homo sapien
tgggctccattctggattcggcggt

SEQ ID NO: 50593 - DNA, 25 bp, Homo sapien
tccattctggattcggcggttccgg

SEQ ID NO: 50594 - DNA, 25 bp, Homo sapien
tgggtctgtgccgattactctgtct

SEQ ID NO: 50595 - DNA, 25 bp, Homo sapien
tgtgccgattactctgtcttgtacg

SEQ ID NO: 50596 - DNA, 25 bp, Homo sapien
ccgattactctgtcttgtacgtttg

SEQ ID NO: 50597 - DNA, 25 bp, Homo sapien
ttactctgtcttgtacgtttgttct

SEQ ID NO: 50598 - DNA, 25 bp, Homo sapien
tcttcaatattgtatcaacgccagg

SEQ ID NO: 50599 - DNA, 25 bp, Homo sapien
aatattgtatcaacgccaggaaagg

SEQ ID NO: 50600 - DNA, 25 bp, Homo sapien
acagctcactggctttcaccagcct

SEQ ID NO: 50601 - DNA, 25 bp, Homo sapien
caccagcctcaactgtgtggcggac

SEQ ID NO: 50602 - DNA, 25 bp, Homo sapien
gcctcaactgtgtggcggaccccat

SEQ ID NO: 50603 - DNA, 25 bp, Homo sapien
actgtgtggcggaccccatcctcta

SEQ ID NO: 50604 - DNA, 25 bp, Homo sapien
atcctctactgcctggtcaacgagg

SEQ ID NO: 50605 - DNA, 25 bp, Homo sapien
tactgcctggtcaacgagggcgccc

SEQ ID NO: 50606 - DNA, 25 bp, Homo sapien
agggcgcccgcagcgatgtggccaa

SEQ ID NO: 50607 - DNA, 25 bp, Homo sapien
tggccagcgacaagccccaggagat

SEQ ID NO: 50608 - DNA, 25 bp, Homo sapien
aggagatggccaatgcctcgctcac

SEQ ID NO: 50609 - DNA, 25 bp, Homo sapien
agatgctgccgccagcacaatgaac

SEQ ID NO: 50610 - DNA, 25 bp, Homo sapien
cagcacaatgaaccccgagtggcac

SEQ ID NO: 50611 - DNA, 25 bp, Homo sapien
cgctggttagcaccgcaggtgtaga

SEQ ID NO: 50612 - DNA, 25 bp, Homo sapien
caccgcaggtgtagagaaggcactt

SEQ ID NO: 50613 - DNA, 25 bp, Homo sapien
tggtcgagcgatggatttccgtctc

SEQ ID NO: 50614 - DNA, 25 bp, Homo sapien
atggatttccgtctctggtgtagct

SEQ ID NO: 50615 - DNA, 25 bp, Homo sapien
gtctctggtgtagctgatgatccga

SEQ ID NO: 50616 - DNA, 25 bp, Homo sapien
tgtagctgatgatccgaataactac

SEQ ID NO: 50617 - DNA, 25 bp, Homo sapien
accagccagctatcaactcgcgccc

SEQ ID NO: 50618 - DNA, 25 bp, Homo sapien
gcaactcatcgattgatttacggcg

SEQ ID NO: 50619 - DNA, 25 bp, Homo sapien
gattgatttacggcgctaaggatga

SEQ ID NO: 50620 - DNA, 25 bp, Homo sapien
taaggatgactctggtcagagatac

SEQ ID NO: 50621 - DNA, 25 bp, Homo sapien
tggtcagagatacctggcctggtct

SEQ ID NO: 50622 - DNA, 25 bp, Homo sapien
ctggtctggacacagtgcccgtgtc

SEQ ID NO: 50623 - DNA, 25 bp, Homo sapien
gtgcccgtgtcggagccgcgcgaga

SEQ ID NO: 50624 - DNA, 25 bp, Homo sapien
cgagatatggcccgcgctggagttt

SEQ ID NO: 50625 - DNA, 25 bp, Homo sapien
ggagtttcaataccggagatcatgc

SEQ ID NO: 50626 - DNA, 25 bp, Homo sapien
ggagatcatgcaagctggtggctgg

SEQ ID NO: 50627 - DNA, 25 bp, Homo sapien
ctggtggctggaccaatgtaaatat

SEQ ID NO: 50628 - DNA, 25 bp, Homo sapien
ccaatgtaaatattgtcatgaacta

SEQ ID NO: 50629 - DNA, 25 bp, Homo sapien
ttgtcatgaactatatccgtaacct

SEQ ID NO: 50630 - DNA, 25 bp, Homo sapien
tagtgaaacaggggcaatggtgcgc

SEQ ID NO: 50631 - DNA, 25 bp, Homo sapien
attagcaaacacaagacattttatg

SEQ ID NO: 50632 - DNA, 25 bp, Homo sapien
tgtattatttcgatttacttcctaa

SEQ ID NO: 50633 - DNA, 25 bp, Homo sapien
tatttcgatttacttcctaattata

SEQ ID NO: 50634 - DNA, 25 bp, Homo sapien
aaagctgcttttttgcagaacattc

SEQ ID NO: 50635 - DNA, 25 bp, Homo sapien
gcttttttgcagaacattccttgaa

SEQ ID NO: 50636 - DNA, 25 bp, Homo sapien
gaaaagagatttctaggcctcatgt

SEQ ID NO: 50637 - DNA, 25 bp, Homo sapien
gatttctaggcctcatgtataacca

SEQ ID NO: 50638 - DNA, 25 bp, Homo sapien
aggcctcatgtataaccagggtttt

SEQ ID NO: 50639 - DNA, 25 bp, Homo sapien
tataaccagggttttgaggataaag

SEQ ID NO: 50640 - DNA, 25 bp, Homo sapien
gaactatctcatcatagcatatctg

SEQ ID NO: 50641 - DNA, 25 bp, Homo sapien
agcatatctgctttggaataactat

SEQ ID NO: 50642 - DNA, 25 bp, Homo sapien
tttttcttcccgatctgaacccctg

SEQ ID NO: 50643 - DNA, 25 bp, Homo sapien
gatctgaacccctgttgactaatct

SEQ ID NO: 50644 - DNA, 25 bp, Homo sapien
tctgaacccctgttgactaatcttg

SEQ ID NO: 50645 - DNA, 25 bp, Homo sapien
tgaacccctgttgactaatcttgcc

SEQ ID NO: 50646 - DNA, 25 bp, Homo sapien
aacccctgttgactaatcttgcctg

SEQ ID NO: 50647 - DNA, 25 bp, Homo sapien
cctgttgactaatcttgcctgggtt

SEQ ID NO: 50648 - DNA, 25 bp, Homo sapien
ctgttgactaatcttgcctgggttt

SEQ ID NO: 50649 - DNA, 25 bp, Homo sapien
gttgactaatcttgcctgggtttgt

SEQ ID NO: 50650 - DNA, 25 bp, Homo sapien
gactaatcttgcctgggtttgtgta

SEQ ID NO: 50651 - DNA, 25 bp, Homo sapien
actaatcttgcctgggtttgtgtag

SEQ ID NO: 50652 - DNA, 25 bp, Homo sapien
ctgggtttgtgtaggtctgcaggaa

SEQ ID NO: 50653 - DNA, 25 bp, Homo sapien
catcaaaggcttcccaagaggcaag

SEQ ID NO: 50654 - DNA, 25 bp, Homo sapien
caaaggcttcccaagaggcaagagg

SEQ ID NO: 50655 - DNA, 25 bp, Homo sapien
agaggcaaggagaagtgtcctactt

SEQ ID NO: 50656 - DNA, 25 bp, Homo sapien
gaagtgtcctactttaaacggccag

SEQ ID NO: 50657 - DNA, 25 bp, Homo sapien
gtgtcctactttaaacggccagcct

SEQ ID NO: 50658 - DNA, 25 bp, Homo sapien
actttaaacggccagcctcagtggt

SEQ ID NO: 50659 - DNA, 25 bp, Homo sapien
cagcctcagtggtcggccctgttca

SEQ ID NO: 50660 - DNA, 25 bp, Homo sapien
agtggtcggccctgttcactctgcc

SEQ ID NO: 50661 - DNA, 25 bp, Homo sapien
cccagcagaggtgtgacgggaggct

SEQ ID NO: 50662 - DNA, 25 bp, Homo sapien
agcaccttgagcacacaggagccag

SEQ ID NO: 50663 - DNA, 25 bp, Homo sapien
accttgagcacacaggagccaggag

SEQ ID NO: 50664 - DNA, 25 bp, Homo sapien
gaaccatcagctgattgtcaccagg

SEQ ID NO: 50665 - DNA, 25 bp, Homo sapien
gactacagaaaggatgccagcatcg

SEQ ID NO: 50666 - DNA, 25 bp, Homo sapien
gccagcatcggcacgaaggttgtct

SEQ ID NO: 50667 - DNA, 25 bp, Homo sapien
aggttgtctgctggttcgtccacaa

SEQ ID NO: 50668 - DNA, 25 bp, Homo sapien
gctggttcgtccacaacaacggaga

SEQ ID NO: 50669 - DNA, 25 bp, Homo sapien
ccacaacaacggagaagggctgatt

SEQ ID NO: 50670 - DNA, 25 bp, Homo sapien
aagggctgattgatggtgtccacac

SEQ ID NO: 50671 - DNA, 25 bp, Homo sapien
tggtgtccacactgactacattgtc

SEQ ID NO: 50672 - DNA, 25 bp, Homo sapien
attgtccccaacctgttttgagtag

SEQ ID NO: 50673 - DNA, 25 bp, Homo sapien
gttttgagtagacacaccagctcct

SEQ ID NO: 50674 - DNA, 25 bp, Homo sapien
ggatggcccggattttatggcatct

SEQ ID NO: 50675 - DNA, 25 bp, Homo sapien
acacagcggtgtgagaagtgcagca

SEQ ID NO: 50676 - DNA, 25 bp, Homo sapien
gaagtgcagcaagccctgtgcccga

SEQ ID NO: 50677 - DNA, 25 bp, Homo sapien
agttcctgtccctctgcgcatgcag

SEQ ID NO: 50678 - DNA, 25 bp, Homo sapien
cctcttgggacctagtctctgcctt

SEQ ID NO: 50679 - DNA, 25 bp, Homo sapien
ggacctagtctctgccttctactct

SEQ ID NO: 50680 - DNA, 25 bp, Homo sapien
ctacaagtgtccctatatcccctgt

SEQ ID NO: 50681 - DNA, 25 bp, Homo sapien
tccctatatcccctgtcagtgtggg

SEQ ID NO: 50682 - DNA, 25 bp, Homo sapien
ggcccggaccctgatgctcatgtgg

SEQ ID NO: 50683 - DNA, 25 bp, Homo sapien
tgtggctgttgacctgtcccggtat

SEQ ID NO: 50684 - DNA, 25 bp, Homo sapien
tgacctgtcccggtatgaaggctga

SEQ ID NO: 50685 - DNA, 25 bp, Homo sapien
ggtatgaaggctgagacggcccctt

SEQ ID NO: 50686 - DNA, 25 bp, Homo sapien
tcggttatttaggtccagcagctac

SEQ ID NO: 50687 - DNA, 25 bp, Homo sapien
ctacatttacacatctagcagtcag

SEQ ID NO: 50688 - DNA, 25 bp, Homo sapien
tacatttacacatctagcagtcagt

SEQ ID NO: 50689 - DNA, 25 bp, Homo sapien
ccgaacatgttgcttaccgcaccat

SEQ ID NO: 50690 - DNA, 25 bp, Homo sapien
gaacatgttgcttaccgcaccattc

SEQ ID NO: 50691 - DNA, 25 bp, Homo sapien
ggagtgtatagatgcagccgttgca

SEQ ID NO: 50692 - DNA, 25 bp, Homo sapien
gttgcaggcgaagttgattttgctt

SEQ ID NO: 50693 - DNA, 25 bp, Homo sapien
aatcgtgggtgaaatgacgttgccg

SEQ ID NO: 50694 - DNA, 25 bp, Homo sapien
gctcgacaaaatttactcacattca

SEQ ID NO: 50695 - DNA, 25 bp, Homo sapien
atttcttcatcgacattttccttcc

SEQ ID NO: 50696 - DNA, 25 bp, Homo sapien
atatgaatacgccaattctaccggg

SEQ ID NO: 50697 - DNA, 25 bp, Homo sapien
ggtgggtgtgtccaggaggagagca

SEQ ID NO: 50698 - DNA, 25 bp, Homo sapien
tgagcgtgagcttggcatagtgatt

SEQ ID NO: 50699 - DNA, 25 bp, Homo sapien
gcgtgagcttggcatagtgattttt

SEQ ID NO: 50700 - DNA, 25 bp, Homo sapien
cgtgagcttggcatagtgattttta

SEQ ID NO: 50701 - DNA, 25 bp, Homo sapien
tgagcttggcatagtgatttttatt

SEQ ID NO: 50702 - DNA, 25 bp, Homo sapien
ctgggtgggatgtggccttttggct

SEQ ID NO: 50703 - DNA, 25 bp, Homo sapien
cttttggctggtcccgtccctgatg

SEQ ID NO: 50704 - DNA, 25 bp, Homo sapien
ttggctggtcccgtccctgatgtca

SEQ ID NO: 50705 - DNA, 25 bp, Homo sapien
cctcagtttttgttggaaagattat

SEQ ID NO: 50706 - DNA, 25 bp, Homo sapien
gtttttgttggaaagattatctcta

SEQ ID NO: 50707 - DNA, 25 bp, Homo sapien
gattatctctagagttatattttct

SEQ ID NO: 50708 - DNA, 25 bp, Homo sapien
taattcagtattcttccccattctg

SEQ ID NO: 50709 - DNA, 25 bp, Homo sapien
ccattctgggttggagtttactgca

SEQ ID NO: 50710 - DNA, 25 bp, Homo sapien
gtaattcttacagtgctgatgtcaa

SEQ ID NO: 50711 - DNA, 25 bp, Homo sapien
ctgttactgttcttcgactttgatt

SEQ ID NO: 50712 - DNA, 25 bp, Homo sapien
gactttgattccttgctcatgacat

SEQ ID NO: 50713 - DNA, 25 bp, Homo sapien
tgtgctcttctgtcacttcacacag

SEQ ID NO: 50714 - DNA, 25 bp, Homo sapien
tcacacagaccttttgcctttttta

SEQ ID NO: 50715 - DNA, 25 bp, Homo sapien
caaggactaggttgatgatgcccat

SEQ ID NO: 50716 - DNA, 25 bp, Homo sapien
gatgatgcccatgacctgtaattgt

SEQ ID NO: 50717 - DNA, 25 bp, Homo sapien
atttaaaccatcttggcttgtgctt

SEQ ID NO: 50718 - DNA, 25 bp, Homo sapien
cttggcttgtgctttattcaaacta

SEQ ID NO: 50719 - DNA, 25 bp, Homo sapien
gccataccgggcaggaaccatcaga

SEQ ID NO: 50720 - DNA, 25 bp, Homo sapien
taccgggcaggaaccatcagagaga

SEQ ID NO: 50721 - DNA, 25 bp, Homo sapien
gcaggaaccatcagagagacacact

SEQ ID NO: 50722 - DNA, 25 bp, Homo sapien
gaaccatcagagagacacactgagg

SEQ ID NO: 50723 - DNA, 25 bp, Homo sapien
gaattgaatttacatatagctgata

SEQ ID NO: 50724 - DNA, 25 bp, Homo sapien
tttacatatagctgataaagcctaa

SEQ ID NO: 50725 - DNA, 25 bp, Homo sapien
gatgtatttagcttgaatccttcac

SEQ ID NO: 50726 - DNA, 25 bp, Homo sapien
gcttgaatccttcactttagtggtc

SEQ ID NO: 50727 - DNA, 25 bp, Homo sapien
gaatccttcactttagtggtctaat

SEQ ID NO: 50728 - DNA, 25 bp, Homo sapien
ttcactttagtggtctaatcaacag

SEQ ID NO: 50729 - DNA, 25 bp, Homo sapien
gtggtctaatcaacagataaatgac

SEQ ID NO: 50730 - DNA, 25 bp, Homo sapien
gaacgcatccactttcatggaaaca

SEQ ID NO: 50731 - DNA, 25 bp, Homo sapien
gcttcttgaagacctatgtaaagaa

SEQ ID NO: 50732 - DNA, 25 bp, Homo sapien
cttcggatcacgcccggagtagaag

SEQ ID NO: 50733 - DNA, 25 bp, Homo sapien
tacgcatgactacattacaacgggc

SEQ ID NO: 50734 - DNA, 25 bp, Homo sapien
tgactacattacaacgggccaggaa

SEQ ID NO: 50735 - DNA, 25 bp, Homo sapien
gactacattacaacgggccaggaag

SEQ ID NO: 50736 - DNA, 25 bp, Homo sapien
agtttggtttcgatcttcataacgg

SEQ ID NO: 50737 - DNA, 25 bp, Homo sapien
tttcgatcttcataacggacaaact

SEQ ID NO: 50738 - DNA, 25 bp, Homo sapien
actgaacgggccattgaacaagtat

SEQ ID NO: 50739 - DNA, 25 bp, Homo sapien
ctgaacgggccattgaacaagtatt

SEQ ID NO: 50740 - DNA, 25 bp, Homo sapien
tccattgccatatcggctcgcaaat

SEQ ID NO: 50741 - DNA, 25 bp, Homo sapien
tggaacacagcggtgtgagaagtgc

SEQ ID NO: 50742 - DNA, 25 bp, Homo sapien
ggaacacagcggtgtgagaagtgca

SEQ ID NO: 50743 - DNA, 25 bp, Homo sapien
gaacacagcggtgtgagaagtgcag

SEQ ID NO: 50744 - DNA, 25 bp, Homo sapien
gtgagaagtgcagcaagccctgtgc

SEQ ID NO: 50745 - DNA, 25 bp, Homo sapien
tgagaagtgcagcaagccctgtgcc

SEQ ID NO: 50746 - DNA, 25 bp, Homo sapien
gagaagtgcagcaagccctgtgccc

SEQ ID NO: 50747 - DNA, 25 bp, Homo sapien
agaagtgcagcaagccctgtgcccg

SEQ ID NO: 50748 - DNA, 25 bp, Homo sapien
gaagtgcagcaagccctgtgcccga

SEQ ID NO: 50749 - DNA, 25 bp, Homo sapien
aagtgcagcaagccctgtgcccgag

SEQ ID NO: 50750 - DNA, 25 bp, Homo sapien
ggatggaacacagcggtgtgagaag

SEQ ID NO: 50751 - DNA, 25 bp, Homo sapien
cttgcagtagttttataataagtca

SEQ ID NO: 50752 - DNA, 25 bp, Homo sapien
gtaggacacattattagaattgttg

SEQ ID NO: 50753 - DNA, 25 bp, Homo sapien
agaattgttgggatctcatagatgg

SEQ ID NO: 50754 - DNA, 25 bp, Homo sapien
ggatctcatagatggaatgggaatg

SEQ ID NO: 50755 - DNA, 25 bp, Homo sapien
gggtgatatagataaacttactaga

SEQ ID NO: 50756 - DNA, 25 bp, Homo sapien
atatgattggattatgcaacagcat

SEQ ID NO: 50757 - DNA, 25 bp, Homo sapien
gcaacagcatatgtaatatgggaat

SEQ ID NO: 50758 - DNA, 25 bp, Homo sapien
aacttacatgatctgtacttccacg

SEQ ID NO: 50759 - DNA, 25 bp, Homo sapien
acatgatctgtacttccacgtgact

SEQ ID NO: 50760 - DNA, 25 bp, Homo sapien
atgatctgtacttccacgtgactgg

SEQ ID NO: 50761 - DNA, 25 bp, Homo sapien
gatctgtacttccacgtgactgggt

SEQ ID NO: 50762 - DNA, 25 bp, Homo sapien
aaacatcacactttaatttggagca

SEQ ID NO: 50763 - DNA, 25 bp, Homo sapien
catcacactttaatttggagcatag

SEQ ID NO: 50764 - DNA, 25 bp, Homo sapien
acactttaatttggagcatagtacc

SEQ ID NO: 50765 - DNA, 25 bp, Homo sapien
atttggagcatagtaccatagaaat

SEQ ID NO: 50766 - DNA, 25 bp, Homo sapien
gagcatagtaccatagaaatttggg

SEQ ID NO: 50767 - DNA, 25 bp, Homo sapien
taagaagaatggtttacactaacat

SEQ ID NO: 50768 - DNA, 25 bp, Homo sapien
tggtttacactaacattatgacaaa

SEQ ID NO: 50769 - DNA, 25 bp, Homo sapien
ataacacagaattccatattgctat

SEQ ID NO: 50770 - DNA, 25 bp, Homo sapien
ttccatattgctatagtacttctgt

SEQ ID NO: 50771 - DNA, 25 bp, Homo sapien
ccatattgctatagtacttctgtaa

SEQ ID NO: 50772 - DNA, 25 bp, Homo sapien
attgctatagtacttctgtaaagag

SEQ ID NO: 50773 - DNA, 25 bp, Homo sapien
ttcctggtactgacggcgtcctccg

SEQ ID NO: 50774 - DNA, 25 bp, Homo sapien
gtcccctgtggttcttgcctgcctt

SEQ ID NO: 50775 - DNA, 25 bp, Homo sapien
ccctgtggttcttgcctgccttgtc

SEQ ID NO: 50776 - DNA, 25 bp, Homo sapien
gtggttcttgcctgccttgtctcct

SEQ ID NO: 50777 - DNA, 25 bp, Homo sapien
ccgaggctccccagagatagcagag

SEQ ID NO: 50778 - DNA, 25 bp, Homo sapien
gctccccagagatagcagagaattc

SEQ ID NO: 50779 - DNA, 25 bp, Homo sapien
cgggggcatccctctctgtcgctgg

SEQ ID NO: 50780 - DNA, 25 bp, Homo sapien
cctctctgtcgctggcttccagagg

SEQ ID NO: 50781 - DNA, 25 bp, Homo sapien
tctgtcgctggcttccagaggcagg

SEQ ID NO: 50782 - DNA, 25 bp, Homo sapien
ctgtcgctggcttccagaggcagga

SEQ ID NO: 50783 - DNA, 25 bp, Homo sapien
tcgctggcttccagaggcaggacag

SEQ ID NO: 50784 - DNA, 25 bp, Homo sapien
gcttccagaggcaggacaggcctcc

SEQ ID NO: 50785 - DNA, 25 bp, Homo sapien
ttccagaggcaggacaggcctcctg

SEQ ID NO: 50786 - DNA, 25 bp, Homo sapien
gcaggacaggcctcctggtaagccc

SEQ ID NO: 50787 - DNA, 25 bp, Homo sapien
ggcctcctggtaagcccgcaaagtt

SEQ ID NO: 50788 - DNA, 25 bp, Homo sapien
tggtaagcccgcaaagttgctgacc

SEQ ID NO: 50789 - DNA, 25 bp, Homo sapien
ctgcaggcttcctagaggtgtgcta

SEQ ID NO: 50790 - DNA, 25 bp, Homo sapien
aggtgtgctataccatgcgtctgtc

SEQ ID NO: 50791 - DNA, 25 bp, Homo sapien
ataccatgcgtctgtcgttgtgctt

SEQ ID NO: 50792 - DNA, 25 bp, Homo sapien
tagaccaattttttacagttctttg

SEQ ID NO: 50793 - DNA, 25 bp, Homo sapien
cagttctttggtaagcattgtcgta

SEQ ID NO: 50794 - DNA, 25 bp, Homo sapien
gcattgtcgtatctggtgatggatt

SEQ ID NO: 50795 - DNA, 25 bp, Homo sapien
acatatagcctttgttttctaataa

SEQ ID NO: 50796 - DNA, 25 bp, Homo sapien
ttatctttctcttacaatctgtttt

SEQ ID NO: 50797 - DNA, 25 bp, Homo sapien
caatctgttttagacatctttgctt

SEQ ID NO: 50798 - DNA, 25 bp, Homo sapien
gacatctttgcttatgaaacctgta

SEQ ID NO: 50799 - DNA, 25 bp, Homo sapien
atgaaacctgtacatatgtgtgtgt

SEQ ID NO: 50800 - DNA, 25 bp, Homo sapien
gatgccaacaacctgcatggattcg

SEQ ID NO: 50801 - DNA, 25 bp, Homo sapien
gcatggattcgaggtggactccaga

SEQ ID NO: 50802 - DNA, 25 bp, Homo sapien
ggactccagagtttatctcctgatg

SEQ ID NO: 50803 - DNA, 25 bp, Homo sapien
tagccttctgaacctcgcctgaagc

SEQ ID NO: 50804 - DNA, 25 bp, Homo sapien
aagtcactcaggtcatgggcattgt

SEQ ID NO: 50805 - DNA, 25 bp, Homo sapien
gggcattgttcaagcctgagtggca

SEQ ID NO: 50806 - DNA, 25 bp, Homo sapien
aagcctgagtggcagccgctcttgc

SEQ ID NO: 50807 - DNA, 25 bp, Homo sapien
cgctcttgctcacctgttgaggaag

SEQ ID NO: 50808 - DNA, 25 bp, Homo sapien
caccgtggcggcatctttaactggc

SEQ ID NO: 50809 - DNA, 25 bp, Homo sapien
taactggcctccactcaatgggaaa

SEQ ID NO: 50810 - DNA, 25 bp, Homo sapien
atgggaaactgactcgcctgtgaaa

SEQ ID NO: 50811 - DNA, 25 bp, Homo sapien
tatatggattgtatcgcttccccaa

SEQ ID NO: 50812 - DNA, 25 bp, Homo sapien
gtatcgcttccccaatgtttgtaaa

SEQ ID NO: 50813 - DNA, 25 bp, Homo sapien
tcgcttccccaatgtttgtaaattc

SEQ ID NO: 50814 - DNA, 25 bp, Homo sapien
cttgctacctgtattacttgatctc

SEQ ID NO: 50815 - DNA, 25 bp, Homo sapien
attacttgatctcagacccatacct

SEQ ID NO: 50816 - DNA, 25 bp, Homo sapien
gacccatacctgatggttcagtctg

SEQ ID NO: 50817 - DNA, 25 bp, Homo sapien
tttacctgtcagtgtattactgcaa

SEQ ID NO: 50818 - DNA, 25 bp, Homo sapien
cagtgtattactgcaacttgaatca

SEQ ID NO: 50819 - DNA, 25 bp, Homo sapien
gcaacttgaatcactcttttactgt

SEQ ID NO: 50820 - DNA, 25 bp, Homo sapien
ataaacttatcctgtaccaatgtat

SEQ ID NO: 50821 - DNA, 25 bp, Homo sapien
atcctgtaccaatgtatttattaac

SEQ ID NO: 50822 - DNA, 25 bp, Homo sapien
ccacctttccatgtatctggagtga

SEQ ID NO: 50823 - DNA, 25 bp, Homo sapien
cctttccatgtatctggagtgataa

SEQ ID NO: 50824 - DNA, 25 bp, Homo sapien
ggagtgataacagtaccaagtttct

SEQ ID NO: 50825 - DNA, 25 bp, Homo sapien
gtgataacagtaccaagtttctttt

SEQ ID NO: 50826 - DNA, 25 bp, Homo sapien
gataacagtaccaagtttcttttca

SEQ ID NO: 50827 - DNA, 25 bp, Homo sapien
aacagtaccaagtttcttttcacat

SEQ ID NO: 50828 - DNA, 25 bp, Homo sapien
cttttcacatttttcgcacaccatc

SEQ ID NO: 50829 - DNA, 25 bp, Homo sapien
tttcacatttttcgcacaccatcct

SEQ ID NO: 50830 - DNA, 25 bp, Homo sapien
gacacctttttcttcccgatctgaa

SEQ ID NO: 50831 - DNA, 25 bp, Homo sapien
atctgaacccctgttgactaatctt

SEQ ID NO: 50832 - DNA, 25 bp, Homo sapien
gactaatcttgcctgggtttgtgta

SEQ ID NO: 50833 - DNA, 25 bp, Homo sapien
tgttggttttcggaactgaggccat

SEQ ID NO: 50834 - DNA, 25 bp, Homo sapien
tcggaactgaggccatgattaagag

SEQ ID NO: 50835 - DNA, 25 bp, Homo sapien
attcgtattgcgccgctagaggtga

SEQ ID NO: 50836 - DNA, 25 bp, Homo sapien
gtgaaattcttggaccggcgcaaga

SEQ ID NO: 50837 - DNA, 25 bp, Homo sapien
gaccggcgcaagacggaccagagcg

SEQ ID NO: 50838 - DNA, 25 bp, Homo sapien
cagagcgaaagcatttgccaagaat

SEQ ID NO: 50839 - DNA, 25 bp, Homo sapien
tgttttcattaatcaagaacgaaag

SEQ ID NO: 50840 - DNA, 25 bp, Homo sapien
ccggcgatgcggcggcgttattccc

SEQ ID NO: 50841 - DNA, 25 bp, Homo sapien
aggatccattggagggcaagtctgg

SEQ ID NO: 50842 - DNA, 25 bp, Homo sapien
agtctggtgccagcagccgcggtaa

SEQ ID NO: 50843 - DNA, 25 bp, Homo sapien
ccagcagccgcggtaattccagctc

SEQ ID NO: 50844 - DNA, 25 bp, Homo sapien
gcggtaattccagctccaatagcgt

SEQ ID NO: 50845 - DNA, 25 bp, Homo sapien
tatattaaagttgctgcagttaaaa

SEQ ID NO: 50846 - DNA, 25 bp, Homo sapien
gcagttaaaaagctcgtagttggat

SEQ ID NO: 50847 - DNA, 25 bp, Homo sapien
cctcgatgctcttagctgagtgtcc

SEQ ID NO: 50848 - DNA, 25 bp, Homo sapien
tagagtgttcaaagcaggcccgagc

SEQ ID NO: 50849 - DNA, 25 bp, Homo sapien
agtgttcaaagcaggcccgagccgc

SEQ ID NO: 50850 - DNA, 25 bp, Homo sapien
cccgagccgcctggataccgcagct

SEQ ID NO: 50851 - DNA, 25 bp, Homo sapien
cctggataccgcagctaggaataat

SEQ ID NO: 50852 - DNA, 25 bp, Homo sapien
accgcagctaggaataatggaatag

SEQ ID NO: 50853 - DNA, 25 bp, Homo sapien
catcctgaggatcccctcagctgag

SEQ ID NO: 50854 - DNA, 25 bp, Homo sapien
gtgatcgtcttctacgggaccttat

SEQ ID NO: 50855 - DNA, 25 bp, Homo sapien
ctacgggaccttattcttcatgtat

SEQ ID NO: 50856 - DNA, 25 bp, Homo sapien
ttcatgtatgggaagcctaagtcta

SEQ ID NO: 50857 - DNA, 25 bp, Homo sapien
gaagcctaagtctaaggactccatg

SEQ ID NO: 50858 - DNA, 25 bp, Homo sapien
taaggactccatgggagcagacaaa

SEQ ID NO: 50859 - DNA, 25 bp, Homo sapien
atgggagcagacaaagaggatcttt

SEQ ID NO: 50860 - DNA, 25 bp, Homo sapien
ggatctttcagacaaactcatcccc

SEQ ID NO: 50861 - DNA, 25 bp, Homo sapien
tgctgtgaggagactgctgagacca

SEQ ID NO: 50862 - DNA, 25 bp, Homo sapien
gactgctgagaccaaaaggcttcac

SEQ ID NO: 50863 - DNA, 25 bp, Homo sapien
gagaccaaaaggcttcactcagtga

SEQ ID NO: 50864 - DNA, 25 bp, Homo sapien
cattgtttattgtattttgaaccaa

SEQ ID NO: 50865 - DNA, 25 bp, Homo sapien
tttgaaccaatctacaagtctctgt

SEQ ID NO: 50866 - DNA, 25 bp, Homo sapien
gaaccaatctacaagtctctgtctt

SEQ ID NO: 50867 - DNA, 25 bp, Homo sapien
ccaatctacaagtctctgtctttta

SEQ ID NO: 50868 - DNA, 25 bp, Homo sapien
ctacaagtctctgtcttttaataaa

SEQ ID NO: 50869 - DNA, 25 bp, Homo sapien
aaaggctaagtaatatgtgaatatc

SEQ ID NO: 50870 - DNA, 25 bp, Homo sapien
tatatggacataacttgtgaaggat

SEQ ID NO: 50871 - DNA, 25 bp, Homo sapien
agcctctcggtggtgggattatgaa

SEQ ID NO: 50872 - DNA, 25 bp, Homo sapien
ctcggtggtgggattatgaatgatt

SEQ ID NO: 50873 - DNA, 25 bp, Homo sapien
ttctccttttgcttgttagtatttt

SEQ ID NO: 50874 - DNA, 25 bp, Homo sapien
tccttttgcttgttagtattttcta

SEQ ID NO: 50875 - DNA, 25 bp, Homo sapien
ctgggtctgcagacgcgatggataa

SEQ ID NO: 50876 - DNA, 25 bp, Homo sapien
gcgatggataacgtgcagccgaaaa

SEQ ID NO: 50877 - DNA, 25 bp, Homo sapien
gaaaataaaacatcgccccttctgc

SEQ ID NO: 50878 - DNA, 25 bp, Homo sapien
atcgccccttctgcttcagtgtgaa

SEQ ID NO: 50879 - DNA, 25 bp, Homo sapien
gcttcagtgtgaaaggccacgtgaa

SEQ ID NO: 50880 - DNA, 25 bp, Homo sapien
gtttgcacttgtgacagcagtatgc

SEQ ID NO: 50881 - DNA, 25 bp, Homo sapien
agcagtatgctgtcttgccgacggg

SEQ ID NO: 50882 - DNA, 25 bp, Homo sapien
ggcccttatttaccggaagcttctg

SEQ ID NO: 50883 - DNA, 25 bp, Homo sapien
gaagcttctgttcaatcccagcggt

SEQ ID NO: 50884 - DNA, 25 bp, Homo sapien
tcccagcggtccttaccagaaaaag

SEQ ID NO: 50885 - DNA, 25 bp, Homo sapien
ttaccagaaaaagcctgtgcatgaa

SEQ ID NO: 50886 - DNA, 25 bp, Homo sapien
tacttggaactgctaaattatttta

SEQ ID NO: 50887 - DNA, 25 bp, Homo sapien
aaagcgattaaaagacatctttcct

SEQ ID NO: 50888 - DNA, 25 bp, Homo sapien
ctttcctgcattgccatctacataa

SEQ ID NO: 50889 - DNA, 25 bp, Homo sapien
cagatattacggatgttagattgca

SEQ ID NO: 50890 - DNA, 25 bp, Homo sapien
ggatgttagattgcatctcagtgtt

SEQ ID NO: 50891 - DNA, 25 bp, Homo sapien
gtggacgtaaaatggttgtgctatt

SEQ ID NO: 50892 - DNA, 25 bp, Homo sapien
atggttgtgctatttggataatggc

SEQ ID NO: 50893 - DNA, 25 bp, Homo sapien
tttggataatggcactaggcagcat

SEQ ID NO: 50894 - DNA, 25 bp, Homo sapien
atggcactaggcagcatttgtatag

SEQ ID NO: 50895 - DNA, 25 bp, Homo sapien
aggcagcatttgtatagtaactaat

SEQ ID NO: 50896 - DNA, 25 bp, Homo sapien
aaaattcatggctagtgatgtataa

SEQ ID NO: 50897 - DNA, 25 bp, Homo sapien
atgaggtgcggaagctcttcatcag

SEQ ID NO: 50898 - DNA, 25 bp, Homo sapien
tcaggctctaccctggaagctggtg

SEQ ID NO: 50899 - DNA, 25 bp, Homo sapien
tgtattattaagaccacctcccttc

SEQ ID NO: 50900 - DNA, 25 bp, Homo sapien
ctatgtctctcagcagcacgttggg

SEQ ID NO: 50901 - DNA, 25 bp, Homo sapien
gggcacacttgttcatcttctgacc

SEQ ID NO: 50902 - DNA, 25 bp, Homo sapien
atcttctgaccgtttgctgggctat

SEQ ID NO: 50903 - DNA, 25 bp, Homo sapien
tttgctgggctattcccctgcagtg

SEQ ID NO: 50904 - DNA, 25 bp, Homo sapien
ccctgcagtgcagacatcgtcaaaa

SEQ ID NO: 50905 - DNA, 25 bp, Homo sapien
aagctgtatgcaggatgctcactga

SEQ ID NO: 50906 - DNA, 25 bp, Homo sapien
ggatgctcactgatgttttgcactt

SEQ ID NO: 50907 - DNA, 25 bp, Homo sapien
actgaaattcaactctttatatagg

SEQ ID NO: 50908 - DNA, 25 bp, Homo sapien
ctctcgccgagggagtgggcgtgga

SEQ ID NO: 50909 - DNA, 25 bp, Homo sapien
gggcatggcctctgcgagtcactct

SEQ ID NO: 50910 - DNA, 25 bp, Homo sapien
atggcctctgcgagtcactctgcta

SEQ ID NO: 50911 - DNA, 25 bp, Homo sapien
tctgcgagtcactctgctacaatcc

SEQ ID NO: 50912 - DNA, 25 bp, Homo sapien
atccagcttgtaatccgcccaaaag

SEQ ID NO: 50913 - DNA, 25 bp, Homo sapien
ttgtaatccgcccaaaagcggcagc

SEQ ID NO: 50914 - DNA, 25 bp, Homo sapien
tggtctggaggtaccgccgaagatc

SEQ ID NO: 50915 - DNA, 25 bp, Homo sapien
aagatctgggaccactcagggcatc

SEQ ID NO: 50916 - DNA, 25 bp, Homo sapien
atctgggaccactcagggcatcagg

SEQ ID NO: 50917 - DNA, 25 bp, Homo sapien
gaatggtttctatggccaaagtttg

SEQ ID NO: 50918 - DNA, 25 bp, Homo sapien
gccaaagtttggttttctcaacact

SEQ ID NO: 50919 - DNA, 25 bp, Homo sapien
atattacaacgcggcagcattatga

SEQ ID NO: 50920 - DNA, 25 bp, Homo sapien
ggtcgcgcggatcatgatgccaacc

SEQ ID NO: 50921 - DNA, 25 bp, Homo sapien
ggatcatgatgccaacctcttacgt

SEQ ID NO: 50922 - DNA, 25 bp, Homo sapien
tgccaacctcttacgtgcgcctttc

SEQ ID NO: 50923 - DNA, 25 bp, Homo sapien
gcgcctttctgccggacgcgagcag

SEQ ID NO: 50924 - DNA, 25 bp, Homo sapien
gccggacgcgagcagatgaacgaac

SEQ ID NO: 50925 - DNA, 25 bp, Homo sapien
cgagcagatgaacgaacagactcag

SEQ ID NO: 50926 - DNA, 25 bp, Homo sapien
gatgaacgaacagactcaggcgatg

SEQ ID NO: 50927 - DNA, 25 bp, Homo sapien
aacagactcaggcgatgtgctttat

SEQ ID NO: 50928 - DNA, 25 bp, Homo sapien
tcaggcgatgtgctttatggcaggc

SEQ ID NO: 50929 - DNA, 25 bp, Homo sapien
gtgctttatggcaggcgcaaactcg

SEQ ID NO: 50930 - DNA, 25 bp, Homo sapien
atggcaggcgcaaactcgattttct

SEQ ID NO: 50931 - DNA, 25 bp, Homo sapien
tacggttgcaaactgctgaccacgc

SEQ ID NO: 50932 - DNA, 25 bp, Homo sapien
caaactgctgaccacgccgaatccg

SEQ ID NO: 50933 - DNA, 25 bp, Homo sapien
gacctgcaactgttccgcaaactgg

SEQ ID NO: 50934 - DNA, 25 bp, Homo sapien
gggctaaatccgcagcaaactgccg

SEQ ID NO: 50935 - DNA, 25 bp, Homo sapien
cgcagcaaactgccgtgctggcagg

SEQ ID NO: 50936 - DNA, 25 bp, Homo sapien
acagcaacgtcttgaacaggcgctg

SEQ ID NO: 50937 - DNA, 25 bp, Homo sapien
cgtcttgaacaggcgctgatgaccc

SEQ ID NO: 50938 - DNA, 25 bp, Homo sapien
acaggcgctgatgaccccggacacc

SEQ ID NO: 50939 - DNA, 25 bp, Homo sapien
caaacaattcggcaagttccaaatg

SEQ ID NO: 50940 - DNA, 25 bp, Homo sapien
aattcggcaagttccaaatgattct

SEQ ID NO: 50941 - DNA, 25 bp, Homo sapien
aaatgattctgatcgcaaatacctg

SEQ ID NO: 50942 - DNA, 25 bp, Homo sapien
agaagaaacaaaagtgccaccgaag

SEQ ID NO: 50943 - DNA, 25 bp, Homo sapien
ccccagcgacgctaacgttaaagca

SEQ ID NO: 50944 - DNA, 25 bp, Homo sapien
gacgctaacgttaaagcagttcgta

SEQ ID NO: 50945 - DNA, 25 bp, Homo sapien
aaagcagttcgtaagaaggcaacaa

SEQ ID NO: 50946 - DNA, 25 bp, Homo sapien
gaaggcaacaagttcttctcctcta

SEQ ID NO: 50947 - DNA, 25 bp, Homo sapien
aggcaacaagttcttctcctctaca

SEQ ID NO: 50948 - DNA, 25 bp, Homo sapien
tcttctcctctacagaaggattttg

SEQ ID NO: 50949 - DNA, 25 bp, Homo sapien
tctacagaaggattttgcaaacaat

SEQ ID NO: 50950 - DNA, 25 bp, Homo sapien
tctgaaggggtatactctagttgaa

SEQ ID NO: 50951 - DNA, 25 bp, Homo sapien
aaacatacaaggaagcccaggctgc

SEQ ID NO: 50952 - DNA, 25 bp, Homo sapien
acatacaaggaagcccaggctgcta

SEQ ID NO: 50953 - DNA, 25 bp, Homo sapien
caggctgctatggagggactcaatg

SEQ ID NO: 50954 - DNA, 25 bp, Homo sapien
atgggacagcccatcagcgttgact

SEQ ID NO: 50955 - DNA, 25 bp, Homo sapien
ggacagcccatcagcgttgactggt

SEQ ID NO: 50956 - DNA, 25 bp, Homo sapien
agcccatcagcgttgactggtgttt

SEQ ID NO: 50957 - DNA, 25 bp, Homo sapien
atcagcgttgactggtgttttgttc

SEQ ID NO: 50958 - DNA, 25 bp, Homo sapien
tggccgaagacgcagcagaagtcca

SEQ ID NO: 50959 - DNA, 25 bp, Homo sapien
gaagacgcagcagaagtccagaccg

SEQ ID NO: 50960 - DNA, 25 bp, Homo sapien
gacgcagcagaagtccagaccggag

SEQ ID NO: 50961 - DNA, 25 bp, Homo sapien
gcagacaaaatcaacatggtcattt

SEQ ID NO: 50962 - DNA, 25 bp, Homo sapien
tagaaatcggaggtgtggatgctct

SEQ ID NO: 50963 - DNA, 25 bp, Homo sapien
aggtgtggatgctctctatttagcg

SEQ ID NO: 50964 - DNA, 25 bp, Homo sapien
tggatgctctctatttagcggagaa

SEQ ID NO: 50965 - DNA, 25 bp, Homo sapien
tggtacacctctttacgtatatgat

SEQ ID NO: 50966 - DNA, 25 bp, Homo sapien
cacctctttacgtatatgatgtggc

SEQ ID NO: 50967 - DNA, 25 bp, Homo sapien
gtatatgatgtggctttaatacgtg

SEQ ID NO: 50968 - DNA, 25 bp, Homo sapien
tttaagcaggcgtttatttctgcag

SEQ ID NO: 50969 - DNA, 25 bp, Homo sapien
gcaggcgtttatttctgcagggctg

SEQ ID NO: 50970 - DNA, 25 bp, Homo sapien
tttatttctgcagggctgaaagcac

SEQ ID NO: 50971 - DNA, 25 bp, Homo sapien
gggctgaaagcacaggtggcatatg

SEQ ID NO: 50972 - DNA, 25 bp, Homo sapien
ggcatatgcgagcaaagcattctca

SEQ ID NO: 50973 - DNA, 25 bp, Homo sapien
atgcgagcaaagcattctcatcagt

SEQ ID NO: 50974 - DNA, 25 bp, Homo sapien
gcaaagcattctcatcagtcgcaat

SEQ ID NO: 50975 - DNA, 25 bp, Homo sapien
cattctcatcagtcgcaatgattca

SEQ ID NO: 50976 - DNA, 25 bp, Homo sapien
catcagtcgcaatgattcagctcgc

SEQ ID NO: 50977 - DNA, 25 bp, Homo sapien
tcgcaatgattcagctcgctgagga

SEQ ID NO: 50978 - DNA, 25 bp, Homo sapien
tctttagatgtcgtatccggaggag

SEQ ID NO: 50979 - DNA, 25 bp, Homo sapien
atgtcgtatccggaggagagctata

SEQ ID NO: 50980 - DNA, 25 bp, Homo sapien
ggagagctatatacggctgttgcag

SEQ ID NO: 50981 - DNA, 25 bp, Homo sapien
ctatggctcccctggaacaggaggg

SEQ ID NO: 50982 - DNA, 25 bp, Homo sapien
tatggctcccctggaacaggaggga

SEQ ID NO: 50983 - DNA, 25 bp, Homo sapien
acacggcgggcctgagctccagcat

SEQ ID NO: 50984 - DNA, 25 bp, Homo sapien
gcctgagctccagcatctgagtttg

SEQ ID NO: 50985 - DNA, 25 bp, Homo sapien
ctgagctccagcatctgagtttggg

SEQ ID NO: 50986 - DNA, 25 bp, Homo sapien
tccagcatctgagtttgggggtatg

SEQ ID NO: 50987 - DNA, 25 bp, Homo sapien
aggacaccaggctggtggccacagt

SEQ ID NO: 50988 - DNA, 25 bp, Homo sapien
tggccacagtgctgctgtccgtggt

SEQ ID NO: 50989 - DNA, 25 bp, Homo sapien
tgtccgtggtcgtgctgctccacgc

SEQ ID NO: 50990 - DNA, 25 bp, Homo sapien
tgtaagttgtacttcttccagtcgc

SEQ ID NO: 50991 - DNA, 25 bp, Homo sapien
ccagtcgctgcctccggagaacgtg

SEQ ID NO: 50992 - DNA, 25 bp, Homo sapien
gctgcctccggagaacgtggctcct

SEQ ID NO: 50993 - DNA, 25 bp, Homo sapien
ggtcccacaggcaacacctaagtgg

SEQ ID NO: 50994 - DNA, 25 bp, Homo sapien
caggcaacacctaagtggaccaacc

SEQ ID NO: 50995 - DNA, 25 bp, Homo sapien
ccccagacgatgactgaaggctcct

SEQ ID NO: 50996 - DNA, 25 bp, Homo sapien
gatgattctgctactttccagactt

SEQ ID NO: 50997 - DNA, 25 bp, Homo sapien
ttgtatgagtgtaaccgctacccct

SEQ ID NO: 50998 - DNA, 25 bp, Homo sapien
cgctacccctgcatcaaggaggtgg

SEQ ID NO: 50999 - DNA, 25 bp, Homo sapien
tggaatgttatgtgtcccggccaac

SEQ ID NO: 51000 - DNA, 25 bp, Homo sapien
aagactgtctttctagtgttcatgt

SEQ ID NO: 51001 - DNA, 25 bp, Homo sapien
agtggcatctgtgttgtgctcaacc

SEQ ID NO: 51002 - DNA, 25 bp, Homo sapien
ttgtgctcaacctggctgaactcaa

SEQ ID NO: 51003 - DNA, 25 bp, Homo sapien
tcaaccacctgggatggcgcaagat

SEQ ID NO: 51004 - DNA, 25 bp, Homo sapien
gagattcgtaacaaggacctgccaa

SEQ ID NO: 51005 - DNA, 25 bp, Homo sapien
gccaagggtcagtgttcccaatttt

SEQ ID NO: 51006 - DNA, 25 bp, Homo sapien
tcccaattttggcaggactcagtcc

SEQ ID NO: 51007 - DNA, 25 bp, Homo sapien
gtccagtgactctgcctatgtgtga

SEQ ID NO: 51008 - DNA, 25 bp, Homo sapien
ttaacatttgtcaatgaacatgggg

SEQ ID NO: 51009 - DNA, 25 bp, Homo sapien
gcgagctgtacttatcggtgaatca

SEQ ID NO: 51010 - DNA, 25 bp, Homo sapien
atgagacaaacttctcagcgtaaag

SEQ ID NO: 51011 - DNA, 25 bp, Homo sapien
tctcagcgtaaagcaatccatgctt

SEQ ID NO: 51012 - DNA, 25 bp, Homo sapien
gtcactaaaggatttgcagcttgcg

SEQ ID NO: 51013 - DNA, 25 bp, Homo sapien
tttgcagcttgcggcggaatcacag

SEQ ID NO: 51014 - DNA, 25 bp, Homo sapien
gcggcggaatcacaggctgattacc

SEQ ID NO: 51015 - DNA, 25 bp, Homo sapien
atcaatagagacgatgtcacgtatt

SEQ ID NO: 51016 - DNA, 25 bp, Homo sapien
acgatgtcacgtattgccaagagct

SEQ ID NO: 51017 - DNA, 25 bp, Homo sapien
gtattgccaagagcttgaagctcga

SEQ ID NO: 51018 - DNA, 25 bp, Homo sapien
gagcttgaagctcgacgtcattcag

SEQ ID NO: 51019 - DNA, 25 bp, Homo sapien
ctcgacgtcattcagcttcacggtg

SEQ ID NO: 51020 - DNA, 25 bp, Homo sapien
ttcagcttcacggtgatgaaaaacc

SEQ ID NO: 51021 - DNA, 25 bp, Homo sapien
ggatgctgctgctcttcgcaagctg

SEQ ID NO: 51022 - DNA, 25 bp, Homo sapien
agctgacaggctgtgaaatatggaa

SEQ ID NO: 51023 - DNA, 25 bp, Homo sapien
gcgcttcaccatcaagataacacaa

SEQ ID NO: 51024 - DNA, 25 bp, Homo sapien
atgttgacggctttgtgattgattc

SEQ ID NO: 51025 - DNA, 25 bp, Homo sapien
ttgattcatctgtaaaagggtctag

SEQ ID NO: 51026 - DNA, 25 bp, Homo sapien
tgggaatgtgtgccggaatatcagc

SEQ ID NO: 51027 - DNA, 25 bp, Homo sapien
tgccggaatatcagcaggcggctat

SEQ ID NO: 51028 - DNA, 25 bp, Homo sapien
gtgatcggcctgcatgaggatgacg

SEQ ID NO: 51029 - DNA, 25 bp, Homo sapien
gacgagacccaaatgatccgcgtcc

SEQ ID NO: 51030 - DNA, 25 bp, Homo sapien
gacgtagtcgttgtcattccttttt

SEQ ID NO: 51031 - DNA, 25 bp, Homo sapien
acgcgagagacgtgcttccgaagga

SEQ ID NO: 51032 - DNA, 25 bp, Homo sapien
gaaggagtttccatatgccgatgcc

SEQ ID NO: 51033 - DNA, 25 bp, Homo sapien
tcctcattgctgcgatcatgtccaa

SEQ ID NO: 51034 - DNA, 25 bp, Homo sapien
ggattggccgcttgtcgggaaaatc

SEQ ID NO: 51035 - DNA, 25 bp, Homo sapien
gaaggatatgttccatcagccgtac

SEQ ID NO: 51036 - DNA, 25 bp, Homo sapien
atgcttgtgcctgagctgtcaaaag

SEQ ID NO: 51037 - DNA, 25 bp, Homo sapien
gaagggcgcatatggaacggctctc

SEQ ID NO: 51038 - DNA, 25 bp, Homo sapien
aaagaacagctcgcgcttcatttcc

SEQ ID NO: 51039 - DNA, 25 bp, Homo sapien
aacccacaactgattattgatactg

SEQ ID NO: 51040 - DNA, 25 bp, Homo sapien
aacatcatccctgggcagaaaggcc

SEQ ID NO: 51041 - DNA, 25 bp, Homo sapien
atccctgggcagaaaggccttcttc

SEQ ID NO: 51042 - DNA, 25 bp, Homo sapien
gggcagaaaggccttcttctcatga

SEQ ID NO: 51043 - DNA, 25 bp, Homo sapien
aaaggccttcttctcatgacttcat

SEQ ID NO: 51044 - DNA, 25 bp, Homo sapien
ggccttcttctcatgacttcatgat

SEQ ID NO: 51045 - DNA, 25 bp, Homo sapien
ctcatgacttcatgatctgaatccc

SEQ ID NO: 51046 - DNA, 25 bp, Homo sapien
ggcccctacccctcagggataatga

SEQ ID NO: 51047 - DNA, 25 bp, Homo sapien
gttttatacctgcacacatccttat

SEQ ID NO: 51048 - DNA, 25 bp, Homo sapien
atacctgcacacatccttatctttg

SEQ ID NO: 51049 - DNA, 25 bp, Homo sapien
catatgaaatatctgtatcacgggt

SEQ ID NO: 51050 - DNA, 25 bp, Homo sapien
ggccagggaggcctacccgctgggt

SEQ ID NO: 51051 - DNA, 25 bp, Homo sapien
aggagcccgagctgttgaccaagct

SEQ ID NO: 51052 - DNA, 25 bp, Homo sapien
agcccgagctgttgaccaagctcca

SEQ ID NO: 51053 - DNA, 25 bp, Homo sapien
ttccagacccctaactcgccagggt

SEQ ID NO: 51054 - DNA, 25 bp, Homo sapien
ttccccacgggcaggttggcctagc

SEQ ID NO: 51055 - DNA, 25 bp, Homo sapien
gcaggttggcctagcctgggtcctc

SEQ ID NO: 51056 - DNA, 25 bp, Homo sapien
gttggcctagcctgggtcctccgcg

SEQ ID NO: 51057 - DNA, 25 bp, Homo sapien
gtggctccacgtgaggcctgagctt

SEQ ID NO: 51058 - DNA, 25 bp, Homo sapien
tccacgtgaggcctgagcttcagcc

SEQ ID NO: 51059 - DNA, 25 bp, Homo sapien
tgctctactgcttcgtcagcgagac

SEQ ID NO: 51060 - DNA, 25 bp, Homo sapien
tctactgcttcgtcagcgagaccac

SEQ ID NO: 51061 - DNA, 25 bp, Homo sapien
tgcttcagacacctagatcccagaa

SEQ ID NO: 51062 - DNA, 25 bp, Homo sapien
tcccagaactcaggcgcatatgcat

SEQ ID NO: 51063 - DNA, 25 bp, Homo sapien
aggcgcatatgcatattttccctgc

SEQ ID NO: 51064 - DNA, 25 bp, Homo sapien
agaatggtgctcttcacgttttgac

SEQ ID NO: 51065 - DNA, 25 bp, Homo sapien
gctcttcacgttttgacggtggttt

SEQ ID NO: 51066 - DNA, 25 bp, Homo sapien
aatgttgttcttcaaccagcaacag

SEQ ID NO: 51067 - DNA, 25 bp, Homo sapien
gcaacagcaacagctagggactgat

SEQ ID NO: 51068 - DNA, 25 bp, Homo sapien
atgcaaattcttgggtcactctcta

SEQ ID NO: 51069 - DNA, 25 bp, Homo sapien
gtcactctctagaccaactgatgca

SEQ ID NO: 51070 - DNA, 25 bp, Homo sapien
aaacaggaggtgtgagccagcaatc

SEQ ID NO: 51071 - DNA, 25 bp, Homo sapien
gtatcttggtgtattttgctactgt

SEQ ID NO: 51072 - DNA, 25 bp, Homo sapien
tgatagcagcagatgcctagctcat

SEQ ID NO: 51073 - DNA, 25 bp, Homo sapien
agatgcctagctcatcctgggtttg

SEQ ID NO: 51074 - DNA, 25 bp, Homo sapien
atcctgggtttgcttctgaccttgt

SEQ ID NO: 51075 - DNA, 25 bp, Homo sapien
ttctgaccttgtcatgtgtgtgcca

SEQ ID NO: 51076 - DNA, 25 bp, Homo sapien
gtgtgtgccaccaaacacgttattg

SEQ ID NO: 51077 - DNA, 25 bp, Homo sapien
attggcacctttttaaataagctct

SEQ ID NO: 51078 - DNA, 25 bp, Homo sapien
taagctctcatgatcaagatggtga

SEQ ID NO: 51079 - DNA, 25 bp, Homo sapien
tgatggtagagaagctgcccggaat

SEQ ID NO: 51080 - DNA, 25 bp, Homo sapien
gaagctgcccggaataaactgaatt

SEQ ID NO: 51081 - DNA, 25 bp, Homo sapien
gttctaaaatgactagcaatggttt

SEQ ID NO: 51082 - DNA, 25 bp, Homo sapien
gaaggtggtataaatgctgtcaatt

SEQ ID NO: 51083 - DNA, 25 bp, Homo sapien
ttttttgtaaatcacggacacctca

SEQ ID NO: 51084 - DNA, 25 bp, Homo sapien
gtaaatcacggacacctcaattagc

SEQ ID NO: 51085 - DNA, 25 bp, Homo sapien
atcacggacacctcaattagcaaga

SEQ ID NO: 51086 - DNA, 25 bp, Homo sapien
ggacacctcaattagcaagaactga

SEQ ID NO: 51087 - DNA, 25 bp, Homo sapien
gagggctttttccattgtttaatgt

SEQ ID NO: 51088 - DNA, 25 bp, Homo sapien
gagggaacctcatctaagtaacatt

SEQ ID NO: 51089 - DNA, 25 bp, Homo sapien
gaacctcatctaagtaacatttgca

SEQ ID NO: 51090 - DNA, 25 bp, Homo sapien
aagtaacatttgcacatgatacagc

SEQ ID NO: 51091 - DNA, 25 bp, Homo sapien
gcacatgatacagcaaaaggagttc

SEQ ID NO: 51092 - DNA, 25 bp, Homo sapien
aaggagttcattgcaatactgtctt

SEQ ID NO: 51093 - DNA, 25 bp, Homo sapien
agttcattgcaatactgtctttgga

SEQ ID NO: 51094 - DNA, 25 bp, Homo sapien
aagatcattgctcctcctgagcgca

SEQ ID NO: 51095 - DNA, 25 bp, Homo sapien
cctcctgagcgcaagtactccgtgt

SEQ ID NO: 51096 - DNA, 25 bp, Homo sapien
tccgtgtggatcggcggctccatcc

SEQ ID NO: 51097 - DNA, 25 bp, Homo sapien
cagatgtggatcagcaagcaggagt

SEQ ID NO: 51098 - DNA, 25 bp, Homo sapien
gtccaccgcaaatgcttctaggcgg

SEQ ID NO: 51099 - DNA, 25 bp, Homo sapien
accacggccgagcgggaaatcgtgc

SEQ ID NO: 51100 - DNA, 25 bp, Homo sapien
ctgtgctacgtcgccctggacttcg

SEQ ID NO: 51101 - DNA, 25 bp, Homo sapien
gagcaagagatggccacggctgctt

SEQ ID NO: 51102 - DNA, 25 bp, Homo sapien
tcctccctggagaagagctacgagc

SEQ ID NO: 51103 - DNA, 25 bp, Homo sapien
ctgcctgacggccaggtcatcacca

SEQ ID NO: 51104 - DNA, 25 bp, Homo sapien
caggtcatcaccattggcaatgagc

SEQ ID NO: 51105 - DNA, 25 bp, Homo sapien
cggttccgctgccctgaggcactct

SEQ ID NO: 51106 - DNA, 25 bp, Homo sapien
cctgaggcactcttccagccttcct

SEQ ID NO: 51107 - DNA, 25 bp, Homo sapien
gagtcctgtggcatccacgaaacta

SEQ ID NO: 51108 - DNA, 25 bp, Homo sapien
atccacgaaactaccttcaactcca

SEQ ID NO: 51109 - DNA, 25 bp, Homo sapien
aactccatcatgaagtgtgacgtgg

SEQ ID NO: 51110 - DNA, 25 bp, Homo sapien
gacatccgcaaagacctgtacgcca

SEQ ID NO: 51111 - DNA, 25 bp, Homo sapien
aacacagtgctgtctggcggcacca

SEQ ID NO: 51112 - DNA, 25 bp, Homo sapien
accatgtaccctggcattgccgaca

SEQ ID NO: 51113 - DNA, 25 bp, Homo sapien
cagaaggagatcactgccctggcac

SEQ ID NO: 51114 - DNA, 25 bp, Homo sapien
acaccacattttgaccttgtagggg

SEQ ID NO: 51115 - DNA, 25 bp, Homo sapien
ggccatagaccatacatacgatcag

SEQ ID NO: 51116 - DNA, 25 bp, Homo sapien
attatctgatgtgatgcctgttgag

SEQ ID NO: 51117 - DNA, 25 bp, Homo sapien
acaaccggatgtcttgattgattta

SEQ ID NO: 51118 - DNA, 25 bp, Homo sapien
tcttgattgatttaacaacgcccga

SEQ ID NO: 51119 - DNA, 25 bp, Homo sapien
ttagagcacggagtccgtccagttg

SEQ ID NO: 51120 - DNA, 25 bp, Homo sapien
acaaccggtttctcagaagctgatt

SEQ ID NO: 51121 - DNA, 25 bp, Homo sapien
gaaaaagggatcggagccatcatcg

SEQ ID NO: 51122 - DNA, 25 bp, Homo sapien
ccaaattttgcgctcggtgcgatac

SEQ ID NO: 51123 - DNA, 25 bp, Homo sapien
ctcggtgcgatactgatgatgaaat

SEQ ID NO: 51124 - DNA, 25 bp, Homo sapien
tcatcatgaccagaagcttgacgca

SEQ ID NO: 51125 - DNA, 25 bp, Homo sapien
attttgcgtctaatgattttttatt

SEQ ID NO: 51126 - DNA, 25 bp, Homo sapien
tgaaatggagtctcaaagcttcata

SEQ ID NO: 51127 - DNA, 25 bp, Homo sapien
ggagtctcaaagcttcataaattta

SEQ ID NO: 51128 - DNA, 25 bp, Homo sapien
gaaatgattctaataacaacgtatg

SEQ ID NO: 51129 - DNA, 25 bp, Homo sapien
caacgtatgtaattgtaacattgca

SEQ ID NO: 51130 - DNA, 25 bp, Homo sapien
aacattgcagtaatggtgctacgaa

SEQ ID NO: 51131 - DNA, 25 bp, Homo sapien
agcaaatttgcttctggctcacttt

SEQ ID NO: 51132 - DNA, 25 bp, Homo sapien
aaatttgcttctggctcactttcaa

SEQ ID NO: 51133 - DNA, 25 bp, Homo sapien
gcttctggctcactttcaatcagtt

SEQ ID NO: 51134 - DNA, 25 bp, Homo sapien
tggctcactttcaatcagttaaata

SEQ ID NO: 51135 - DNA, 25 bp, Homo sapien
aaataattttggaagctgtgaagat

SEQ ID NO: 51136 - DNA, 25 bp, Homo sapien
ctggatatatcaagactgagttgat

SEQ ID NO: 51137 - DNA, 25 bp, Homo sapien
acccttctagacttcagaccacaga

SEQ ID NO: 51138 - DNA, 25 bp, Homo sapien
ttcagaccacagacaacctgctccc

SEQ ID NO: 51139 - DNA, 25 bp, Homo sapien
aggagtttgacgaggtgtctcggat

SEQ ID NO: 51140 - DNA, 25 bp, Homo sapien
aggtgtctcggatagtgggctctgt

SEQ ID NO: 51141 - DNA, 25 bp, Homo sapien
tttttcatcttctctggcgacagtt

SEQ ID NO: 51142 - DNA, 25 bp, Homo sapien
tctggcgacagttttccttctcatc

SEQ ID NO: 51143 - DNA, 25 bp, Homo sapien
cctgctactctgttccttcacatcc

SEQ ID NO: 51144 - DNA, 25 bp, Homo sapien
ttccttcacatcctgtgtttctagg

SEQ ID NO: 51145 - DNA, 25 bp, Homo sapien
agcaaattcgctgcaacctgttgat

SEQ ID NO: 51146 - DNA, 25 bp, Homo sapien
ttttctctaactcagaaacatcagt

SEQ ID NO: 51147 - DNA, 25 bp, Homo sapien
ttactctgaagggcatcatgcatct

SEQ ID NO: 51148 - DNA, 25 bp, Homo sapien
gcatcatgcatcttactgaaggtaa

SEQ ID NO: 51149 - DNA, 25 bp, Homo sapien
tgaagagtgggtttcacaagtgaaa

SEQ ID NO: 51150 - DNA, 25 bp, Homo sapien
ccagatacacccaaagtatcaggac

SEQ ID NO: 51151 - DNA, 25 bp, Homo sapien
cgagaatgagggtcctttgggaaag

SEQ ID NO: 51152 - DNA, 25 bp, Homo sapien
caacatctagcaaatgttatgcata

SEQ ID NO: 51153 - DNA, 25 bp, Homo sapien
agtgcccaactgttataggttgttg

SEQ ID NO: 51154 - DNA, 25 bp, Homo sapien
ggataaatcagtggttatttaggga

SEQ ID NO: 51155 - DNA, 25 bp, Homo sapien
taggaacggtaaatttctgtgggag

SEQ ID NO: 51156 - DNA, 25 bp, Homo sapien
ttctgactgattttgccttgaagga

SEQ ID NO: 51157 - DNA, 25 bp, Homo sapien
catcatttaccaatcatgccacaca

SEQ ID NO: 51158 - DNA, 25 bp, Homo sapien
atcatgccacacaagcatttatttt

SEQ ID NO: 51159 - DNA, 25 bp, Homo sapien
agctcactccgagaacaggagaaat

SEQ ID NO: 51160 - DNA, 25 bp, Homo sapien
ggagaaatcaacattgcagtaacaa

SEQ ID NO: 51161 - DNA, 25 bp, Homo sapien
gaatggtttattattgccagttttg

SEQ ID NO: 51162 - DNA, 25 bp, Homo sapien
attgccagttttggcctcctcagtg

SEQ ID NO: 51163 - DNA, 25 bp, Homo sapien
tgctacatgatcatcagagccacag

SEQ ID NO: 51164 - DNA, 25 bp, Homo sapien
gatcatcagagccacagctagcttg

SEQ ID NO: 51165 - DNA, 25 bp, Homo sapien
gagccacagctagcttgaatgctaa

SEQ ID NO: 51166 - DNA, 25 bp, Homo sapien
aaacctgctttctgactgattttgc

SEQ ID NO: 51167 - DNA, 25 bp, Homo sapien
agttcctgtccctctgcgcatgcag

SEQ ID NO: 51168 - DNA, 25 bp, Homo sapien
cctcttgggacctagtctctgcctt

SEQ ID NO: 51169 - DNA, 25 bp, Homo sapien
ggacctagtctctgccttctactct

SEQ ID NO: 51170 - DNA, 25 bp, Homo sapien
ctacaagtgtccctatatcccctgt

SEQ ID NO: 51171 - DNA, 25 bp, Homo sapien
tccctatatcccctgtcagtgtggg

SEQ ID NO: 51172 - DNA, 25 bp, Homo sapien
ggcccggaccctgatgctcatgtgg

SEQ ID NO: 51173 - DNA, 25 bp, Homo sapien
tgtggctgttgacctgtcccggtat

SEQ ID NO: 51174 - DNA, 25 bp, Homo sapien
gctgttgacctgtcccggtatgaag

SEQ ID NO: 51175 - DNA, 25 bp, Homo sapien
tgacctgtcccggtatgaaggctga

SEQ ID NO: 51176 - DNA, 25 bp, Homo sapien
ggtatgaaggctgagacggcccctt

SEQ ID NO: 51177 - DNA, 25 bp, Homo sapien
atgaaggctgagacggccccttccc

SEQ ID NO: 51178 - DNA, 25 bp, Homo sapien
tcctttcttaatcatggagttcaag

SEQ ID NO: 51179 - DNA, 25 bp, Homo sapien
aagttcctttgcattcgattgtcca

SEQ ID NO: 51180 - DNA, 25 bp, Homo sapien
attcgattgtccatcgggaccacac

SEQ ID NO: 51181 - DNA, 25 bp, Homo sapien
ggaccacactaggaagctgcagaga

SEQ ID NO: 51182 - DNA, 25 bp, Homo sapien
gggcaacatagtacttctccttcac

SEQ ID NO: 51183 - DNA, 25 bp, Homo sapien
cttcacccatagtaatcctcctggg

SEQ ID NO: 51184 - DNA, 25 bp, Homo sapien
ggcagaaacataacaccccaaaggc

SEQ ID NO: 51185 - DNA, 25 bp, Homo sapien
accccaaaggcacgttgatttgtat

SEQ ID NO: 51186 - DNA, 25 bp, Homo sapien
atccagtttcttttagcattcagtg

SEQ ID NO: 51187 - DNA, 25 bp, Homo sapien
gctgcaggctccaaagacagcctaa

SEQ ID NO: 51188 - DNA, 25 bp, Homo sapien
gcctaacctctcaactacatttgaa

SEQ ID NO: 51189 - DNA, 25 bp, Homo sapien
taaggactcccaaacccattaatag

SEQ ID NO: 51190 - DNA, 25 bp, Homo sapien
cttcttggagcctatgggcttcaga

SEQ ID NO: 51191 - DNA, 25 bp, Homo sapien
ttcagatgtctttgccccatttgtc

SEQ ID NO: 51192 - DNA, 25 bp, Homo sapien
catttgtcacctcgcacacttatag

SEQ ID NO: 51193 - DNA, 25 bp, Homo sapien
acacttatagcgtttcctcctcgaa

SEQ ID NO: 51194 - DNA, 25 bp, Homo sapien
tttcctcctcgaaattctaccaaga

SEQ ID NO: 51195 - DNA, 25 bp, Homo sapien
ccaagactggtcaaatgttgctgag

SEQ ID NO: 51196 - DNA, 25 bp, Homo sapien
ccaccttctcaacactgctgaaaag

SEQ ID NO: 51197 - DNA, 25 bp, Homo sapien
gaaccccaagagaattgtcacacat

SEQ ID NO: 51198 - DNA, 25 bp, Homo sapien
acataatatcatgctcacgcctgga

SEQ ID NO: 51199 - DNA, 25 bp, Homo sapien
atgctcacgcctggagtgttattta

SEQ ID NO: 51200 - DNA, 25 bp, Homo sapien
tcatttcctggtatgacaacgaatt

SEQ ID NO: 51201 - DNA, 25 bp, Homo sapien
acaacgaatttggctacagcaacag

SEQ ID NO: 51202 - DNA, 25 bp, Homo sapien
gggtggtggacctcatggcccacat

SEQ ID NO: 51203 - DNA, 25 bp, Homo sapien
tcatggcccacatggcctccaagga

SEQ ID NO: 51204 - DNA, 25 bp, Homo sapien
acatggcctccaaggagtaagaccc

SEQ ID NO: 51205 - DNA, 25 bp, Homo sapien
aggagtaagacccctggaccaccag

SEQ ID NO: 51206 - DNA, 25 bp, Homo sapien
gccccagcaagagcacaagaggaag

SEQ ID NO: 51207 - DNA, 25 bp, Homo sapien
gagagagaccctcactgctggggag

SEQ ID NO: 51208 - DNA, 25 bp, Homo sapien
cctcactgctggggagtccctgcca

SEQ ID NO: 51209 - DNA, 25 bp, Homo sapien
cctcctcacagttgccatgtagacc

SEQ ID NO: 51210 - DNA, 25 bp, Homo sapien
agttgccatgtagaccccttgaaga

SEQ ID NO: 51211 - DNA, 25 bp, Homo sapien
catgtagaccccttgaagaggggag

SEQ ID NO: 51212 - DNA, 25 bp, Homo sapien
tagggagccgcaccttgtcatgtac

SEQ ID NO: 51213 - DNA, 25 bp, Homo sapien
gccgcaccttgtcatgtaccatcaa

SEQ ID NO: 51214 - DNA, 25 bp, Homo sapien
tgtcatgtaccatcaataaagtacc

SEQ ID NO: 51215 - DNA, 25 bp, Homo sapien
cctctgacttcaacagcgacaccca

SEQ ID NO: 51216 - DNA, 25 bp, Homo sapien
gggctggcattgccctcaacgacca

SEQ ID NO: 51217 - DNA, 25 bp, Homo sapien
ccctcaacgaccactttgtcaagct

SEQ ID NO: 51218 - DNA, 25 bp, Homo sapien
accactttgtcaagctcatttcctg

SEQ ID NO: 51219 - DNA, 25 bp, Homo sapien
ttgtcaagctcatttcctggtatga

SEQ ID NO: 51220 - DNA, 25 bp, Homo sapien
ttcacccttgaagaagtgctgttcc

SEQ ID NO: 51221 - DNA, 25 bp, Homo sapien
aagtgctgttccctcaatctgatag

SEQ ID NO: 51222 - DNA, 25 bp, Homo sapien
gttccctcaatctgataggttccag

SEQ ID NO: 51223 - DNA, 25 bp, Homo sapien
ataggttccagccttatatgcagga

SEQ ID NO: 51224 - DNA, 25 bp, Homo sapien
gccttatatgcaggaggtggtgccc

SEQ ID NO: 51225 - DNA, 25 bp, Homo sapien
gccaggctcagcaacaggctaagca

SEQ ID NO: 51226 - DNA, 25 bp, Homo sapien
acaggctaagcacatgtcatattga

SEQ ID NO: 51227 - DNA, 25 bp, Homo sapien
ggtgatgacctgcatatccagagga

SEQ ID NO: 51228 - DNA, 25 bp, Homo sapien
caattggagaactggatttgctgtt

SEQ ID NO: 51229 - DNA, 25 bp, Homo sapien
tatgtctctgagaaatgcctgcatt

SEQ ID NO: 51230 - DNA, 25 bp, Homo sapien
aatgcctgcatttgaccagagcaaa

SEQ ID NO: 51231 - DNA, 25 bp, Homo sapien
ttctgactgattttgccttgaagga

SEQ ID NO: 51232 - DNA, 25 bp, Homo sapien
catcatttaccaatcatgccacaca

SEQ ID NO: 51233 - DNA, 25 bp, Homo sapien
atcatttaccaatcatgccacacaa

SEQ ID NO: 51234 - DNA, 25 bp, Homo sapien
catttaccaatcatgccacacaagc

SEQ ID NO: 51235 - DNA, 25 bp, Homo sapien
atttaccaatcatgccacacaagca

SEQ ID NO: 51236 - DNA, 25 bp, Homo sapien
tttaccaatcatgccacacaagcat

SEQ ID NO: 51237 - DNA, 25 bp, Homo sapien
taccaatcatgccacacaagcattt

SEQ ID NO: 51238 - DNA, 25 bp, Homo sapien
caatcatgccacacaagcatttatt

SEQ ID NO: 51239 - DNA, 25 bp, Homo sapien
atcatgccacacaagcatttatttt

SEQ ID NO: 51240 - DNA, 25 bp, Homo sapien
catgccacacaagcatttattttta

SEQ ID NO: 51241 - DNA, 25 bp, Homo sapien
aaacctgctttctgactgattttgc

SEQ ID NO: 51242 - DNA, 25 bp, Homo sapien
ccttatcttgttttccacaattcac

SEQ ID NO: 51243 - DNA, 25 bp, Homo sapien
gcaacagcaagcattttctataatt

SEQ ID NO: 51244 - DNA, 25 bp, Homo sapien
aaccatatggtgtgtactttttagg

SEQ ID NO: 51245 - DNA, 25 bp, Homo sapien
gtggggctctggctttttcagtaaa

SEQ ID NO: 51246 - DNA, 25 bp, Homo sapien
aaggttaatccattatcttgttgca

SEQ ID NO: 51247 - DNA, 25 bp, Homo sapien
atccattatcttgttgcatgaatca

SEQ ID NO: 51248 - DNA, 25 bp, Homo sapien
gcatgaatcaattgtttgctcattt

SEQ ID NO: 51249 - DNA, 25 bp, Homo sapien
gaatcaattgtttgctcatttgtat

SEQ ID NO: 51250 - DNA, 25 bp, Homo sapien
ttttcttctttgtcaacttaattgt

SEQ ID NO: 51251 - DNA, 25 bp, Homo sapien
acttaattgttatggatgtttgggt

SEQ ID NO: 51252 - DNA, 25 bp, Homo sapien
tggatgtttgggtaactttcagttt

SEQ ID NO: 51253 - DNA, 25 bp, Homo sapien
gacaactcatggattggaggtctga

SEQ ID NO: 51254 - DNA, 25 bp, Homo sapien
gaggtctgaaggaaatgtgtgcact

SEQ ID NO: 51255 - DNA, 25 bp, Homo sapien
gtgcactgtgatgccatttgctgag

SEQ ID NO: 51256 - DNA, 25 bp, Homo sapien
ggaatactagggaaggcgcagcttt

SEQ ID NO: 51257 - DNA, 25 bp, Homo sapien
gggaggatacagacatcaaaagttc

SEQ ID NO: 51258 - DNA, 25 bp, Homo sapien
atcttgctaagtttgagaagctctt

SEQ ID NO: 51259 - DNA, 25 bp, Homo sapien
gctctttagacaaggtgacaagtca

SEQ ID NO: 51260 - DNA, 25 bp, Homo sapien
caagtcaaatgagcgggcacaccta

SEQ ID NO: 51261 - DNA, 25 bp, Homo sapien
gcacacctaggagtgtggagctcct

SEQ ID NO: 51262 - DNA, 25 bp, Homo sapien
gagctcctgcgaggagtctggacta

SEQ ID NO: 51263 - DNA, 25 bp, Homo sapien
agtgttatcagcatacagatggtaa

SEQ ID NO: 51264 - DNA, 25 bp, Homo sapien
aagtttgtcagtgaccatcccgagc

SEQ ID NO: 51265 - DNA, 25 bp, Homo sapien
gtcagtgaccatcccgagctgaata

SEQ ID NO: 51266 - DNA, 25 bp, Homo sapien
ccatcccgagctgaatatcggggtc

SEQ ID NO: 51267 - DNA, 25 bp, Homo sapien
gagctgaatatcggggtcattgcca

SEQ ID NO: 51268 - DNA, 25 bp, Homo sapien
tatcggggtcattgccaatgatatg

SEQ ID NO: 51269 - DNA, 25 bp, Homo sapien
gccaatgatatggcagcttctacat

SEQ ID NO: 51270 - DNA, 25 bp, Homo sapien
atggcagcttctacatacgaattaa

SEQ ID NO: 51271 - DNA, 25 bp, Homo sapien
ctgtctcccgatgaaaacatatctt

SEQ ID NO: 51272 - DNA, 25 bp, Homo sapien
gaattcaaaattgagctctaggccc

SEQ ID NO: 51273 - DNA, 25 bp, Homo sapien
ttaatggtcatgctgccgcaggatg

SEQ ID NO: 51274 - DNA, 25 bp, Homo sapien
catgctgccgcaggatgatcagtcc

SEQ ID NO: 51275 - DNA, 25 bp, Homo sapien
ggatgatcagtccggggcgctgcat

SEQ ID NO: 51276 - DNA, 25 bp, Homo sapien
cggggcgctgcatagagtgctgtct

SEQ ID NO: 51277 - DNA, 25 bp, Homo sapien
ctgcatagagtgctgtctgcatttt

SEQ ID NO: 51278 - DNA, 25 bp, Homo sapien
gtgctgtctgcattttcttggagaa

SEQ ID NO: 51279 - DNA, 25 bp, Homo sapien
tgatgatgtattgattccaggggcc

SEQ ID NO: 51280 - DNA, 25 bp, Homo sapien
gtattgattccaggggccatgcagg

SEQ ID NO: 51281 - DNA, 25 bp, Homo sapien
aggggccatgcaggagcttgaagca

SEQ ID NO: 51282 - DNA, 25 bp, Homo sapien
agtgaggcttctgggtgcataccag

SEQ ID NO: 51283 - DNA, 25 bp, Homo sapien
cttctgggtgcataccagtcttacc

SEQ ID NO: 51284 - DNA, 25 bp, Homo sapien
tcgcacacttatagcgtttcctcct

SEQ ID NO: 51285 - DNA, 25 bp, Homo sapien
acacttatagcgtttcctcctcgaa

SEQ ID NO: 51286 - DNA, 25 bp, Homo sapien
ttatagcgtttcctcctcgaaattc

SEQ ID NO: 51287 - DNA, 25 bp, Homo sapien
atagcgtttcctcctcgaaattcta

SEQ ID NO: 51288 - DNA, 25 bp, Homo sapien
gtttcctcctcgaaattctaccaag

SEQ ID NO: 51289 - DNA, 25 bp, Homo sapien
tcctcctcgaaattctaccaagact

SEQ ID NO: 51290 - DNA, 25 bp, Homo sapien
tcctcgaaattctaccaagactggt

SEQ ID NO: 51291 - DNA, 25 bp, Homo sapien
taccaagactggtcaaatgttgctg

SEQ ID NO: 51292 - DNA, 25 bp, Homo sapien
aagactggtcaaatgttgctgaggg

SEQ ID NO: 51293 - DNA, 25 bp, Homo sapien
accaccttctcaacactgctgaaaa

SEQ ID NO: 51294 - DNA, 25 bp, Homo sapien
caccttctcaacactgctgaaaaga

SEQ ID NO: 51295 - DNA, 25 bp, Homo sapien
cctctggcagcgaaaagaccccgga

SEQ ID NO: 51296 - DNA, 25 bp, Homo sapien
ctggcagcgaaaagaccccggaagg

SEQ ID NO: 51297 - DNA, 25 bp, Homo sapien
agcctgcagctggattacgcaacag

SEQ ID NO: 51298 - DNA, 25 bp, Homo sapien
cctgcagctggattacgcaacagta

SEQ ID NO: 51299 - DNA, 25 bp, Homo sapien
acgcaacagtaaatccttacacctt

SEQ ID NO: 51300 - DNA, 25 bp, Homo sapien
cgcaacagtaaatccttacaccttc

SEQ ID NO: 51301 - DNA, 25 bp, Homo sapien
gtaaatccttacaccttcgcagaac

SEQ ID NO: 51302 - DNA, 25 bp, Homo sapien
cttacaccttcgcagaacccacttc

SEQ ID NO: 51303 - DNA, 25 bp, Homo sapien
gggcagaccgatagaatcattggta

SEQ ID NO: 51304 - DNA, 25 bp, Homo sapien
gaatcattggtaatgagcgccggat

SEQ ID NO: 51305 - DNA, 25 bp, Homo sapien
gcagcaggctaccggacggcaggtt

SEQ ID NO: 51306 - DNA, 25 bp, Homo sapien
gatggttgttttgtatcatttgatt

SEQ ID NO: 51307 - DNA, 25 bp, Homo sapien
agctgggaatatggctggatatctg

SEQ ID NO: 51308 - DNA, 25 bp, Homo sapien
aatatggctggatatctggtactaa

SEQ ID NO: 51309 - DNA, 25 bp, Homo sapien
tggctggatatctggtactaaaaaa

SEQ ID NO: 51310 - DNA, 25 bp, Homo sapien
taagaacctacttcctaatctcttc

SEQ ID NO: 51311 - DNA, 25 bp, Homo sapien
aatccaaaccatagctgtctgtcca

SEQ ID NO: 51312 - DNA, 25 bp, Homo sapien
tccaaaccatagctgtctgtccagt

SEQ ID NO: 51313 - DNA, 25 bp, Homo sapien
ctgtctgtccagtgctctcttcctg

SEQ ID NO: 51314 - DNA, 25 bp, Homo sapien
aggaccagctgggtgcttgggcatt

SEQ ID NO: 51315 - DNA, 25 bp, Homo sapien
gcttgggcattgacagaatgatggt

SEQ ID NO: 51316 - DNA, 25 bp, Homo sapien
gacagaatgatggttgttttgtatc

SEQ ID NO: 51317 - DNA, 25 bp, Homo sapien
ggcaaggtagtgtccctgtactcgg

SEQ ID NO: 51318 - DNA, 25 bp, Homo sapien
gtagtgtccctgtactcggcggctg

SEQ ID NO: 51319 - DNA, 25 bp, Homo sapien
cggtggactgcgtccggcaagctca

SEQ ID NO: 51320 - DNA, 25 bp, Homo sapien
gcaagctcagccagccatggttcat

SEQ ID NO: 51321 - DNA, 25 bp, Homo sapien
agccatggttcatgccctggttgac

SEQ ID NO: 51322 - DNA, 25 bp, Homo sapien
ttcatgccctggttgactgcctggg

SEQ ID NO: 51323 - DNA, 25 bp, Homo sapien
ggaatttgtacgcaagaccttggct

SEQ ID NO: 51324 - DNA, 25 bp, Homo sapien
tgtacgcaagaccttggctacctgg

SEQ ID NO: 51325 - DNA, 25 bp, Homo sapien
agaccttggctacctggcttcggag

SEQ ID NO: 51326 - DNA, 25 bp, Homo sapien
ggcgtggtggatggacggacgtcct

SEQ ID NO: 51327 - DNA, 25 bp, Homo sapien
cgtggccacactctgcagctttggc

SEQ ID NO: 51328 - DNA, 25 bp, Homo sapien
tgatgtgttgttgccatggtaatcc

SEQ ID NO: 51329 - DNA, 25 bp, Homo sapien
atgtgttgttgccatggtaatcctg

SEQ ID NO: 51330 - DNA, 25 bp, Homo sapien
tgtgttgttgccatggtaatcctgc

SEQ ID NO: 51331 - DNA, 25 bp, Homo sapien
ttgttgccatggtaatcctgctcag

SEQ ID NO: 51332 - DNA, 25 bp, Homo sapien
tgttgccatggtaatcctgctcagt

SEQ ID NO: 51333 - DNA, 25 bp, Homo sapien
ttgccatggtaatcctgctcagtac

SEQ ID NO: 51334 - DNA, 25 bp, Homo sapien
tgccatggtaatcctgctcagtacg

SEQ ID NO: 51335 - DNA, 25 bp, Homo sapien
gccatggtaatcctgctcagtacga

SEQ ID NO: 51336 - DNA, 25 bp, Homo sapien
ccatggtaatcctgctcagtacgag

SEQ ID NO: 51337 - DNA, 25 bp, Homo sapien
atggtaatcctgctcagtacgagag

SEQ ID NO: 51338 - DNA, 25 bp, Homo sapien
tggtaatcctgctcagtacgagagg

SEQ ID NO: 51339 - DNA, 25 bp, Homo sapien
ggtaatcctgctcagtacgagagga

SEQ ID NO: 51340 - DNA, 25 bp, Homo sapien
tcctgctcagtacgagaggaaccgc

SEQ ID NO: 51341 - DNA, 25 bp, Homo sapien
acatttggtgtatgtgcttggctga

SEQ ID NO: 51342 - DNA, 25 bp, Homo sapien
tagttttaccctactgatgatgtgt

SEQ ID NO: 51343 - DNA, 25 bp, Homo sapien
ttttaccctactgatgatgtgttgt

SEQ ID NO: 51344 - DNA, 25 bp, Homo sapien
tttaccctactgatgatgtgttgtt

SEQ ID NO: 51345 - DNA, 25 bp, Homo sapien
ttaccctactgatgatgtgttgttg

SEQ ID NO: 51346 - DNA, 25 bp, Homo sapien
accctactgatgatgtgttgttgcc

SEQ ID NO: 51347 - DNA, 25 bp, Homo sapien
ccctactgatgatgtgttgttgcca

SEQ ID NO: 51348 - DNA, 25 bp, Homo sapien
agaaggacacccggacaatgctggc

SEQ ID NO: 51349 - DNA, 25 bp, Homo sapien
cgcttctctcgtcggcggacttgtg

SEQ ID NO: 51350 - DNA, 25 bp, Homo sapien
cggcggacttgtgatcggcctgcat

SEQ ID NO: 51351 - DNA, 25 bp, Homo sapien
cggcctgcatgaggatgacgagacc

SEQ ID NO: 51352 - DNA, 25 bp, Homo sapien
ccaaatgatccgcgtcccgaatgct

SEQ ID NO: 51353 - DNA, 25 bp, Homo sapien
cccgaatgctgacattgacgtagtc

SEQ ID NO: 51354 - DNA, 25 bp, Homo sapien
tgtcattcctttttatgaagtgctg

SEQ ID NO: 51355 - DNA, 25 bp, Homo sapien
tgaagtgctgacaagagacgcgaga

SEQ ID NO: 51356 - DNA, 25 bp, Homo sapien
agacgcgagagacgtgcttccgaag

SEQ ID NO: 51357 - DNA, 25 bp, Homo sapien
gaaggagtttccatatgccgatgcc

SEQ ID NO: 51358 - DNA, 25 bp, Homo sapien
tgccgatgccgtaaaagcaagtgct

SEQ ID NO: 51359 - DNA, 25 bp, Homo sapien
tgctgtcagcaatatcctcattgct

SEQ ID NO: 51360 - DNA, 25 bp, Homo sapien
cctcattgctgcgatcatgtccaag

SEQ ID NO: 51361 - DNA, 25 bp, Homo sapien
catgtccaaggattggccgcttgtc

SEQ ID NO: 51362 - DNA, 25 bp, Homo sapien
gttccatcagccgtaccgggcgatg

SEQ ID NO: 51363 - DNA, 25 bp, Homo sapien
gtaccgggcgatgcttgtgcctgag

SEQ ID NO: 51364 - DNA, 25 bp, Homo sapien
agtagagcacgtcgccgagatgaag

SEQ ID NO: 51365 - DNA, 25 bp, Homo sapien
atatggaacggctctcagcggagca

SEQ ID NO: 51366 - DNA, 25 bp, Homo sapien
cggagcaggcccaacgattctcgtc

SEQ ID NO: 51367 - DNA, 25 bp, Homo sapien
gctcgcgcttcatttccctcattgt

SEQ ID NO: 51368 - DNA, 25 bp, Homo sapien
acaagagatcccaggaatactgact

SEQ ID NO: 51369 - DNA, 25 bp, Homo sapien
agagatcccaggaatactgacttga

SEQ ID NO: 51370 - DNA, 25 bp, Homo sapien
agatcccaggaatactgacttgatg

SEQ ID NO: 51371 - DNA, 25 bp, Homo sapien
atactgacttgatgaaaaagtcaca

SEQ ID NO: 51372 - DNA, 25 bp, Homo sapien
atgaaaaagtcacatcagagcactc

SEQ ID NO: 51373 - DNA, 25 bp, Homo sapien
aaagtcacatcagagcactcagttt

SEQ ID NO: 51374 - DNA, 25 bp, Homo sapien
gtcacatcagagcactcagtttggc

SEQ ID NO: 51375 - DNA, 25 bp, Homo sapien
cacatcagagcactcagtttggcag

SEQ ID NO: 51376 - DNA, 25 bp, Homo sapien
catcagagcactcagtttggcagag

SEQ ID NO: 51377 - DNA, 25 bp, Homo sapien
ccctaaggcaattttgagtccaaga

SEQ ID NO: 51378 - DNA, 25 bp, Homo sapien
aaggcaattttgagtccaagagaca

SEQ ID NO: 51379 - DNA, 25 bp, Homo sapien
aggcaattttgagtccaagagacat

SEQ ID NO: 51380 - DNA, 25 bp, Homo sapien
ggcaattttgagtccaagagacatt

SEQ ID NO: 51381 - DNA, 25 bp, Homo sapien
gcaattttgagtccaagagacattt

SEQ ID NO: 51382 - DNA, 25 bp, Homo sapien
caattttgagtccaagagacatttt

SEQ ID NO: 51383 - DNA, 25 bp, Homo sapien
tttccaatggtgtccccaatttcag

SEQ ID NO: 51384 - DNA, 25 bp, Homo sapien
tcttagaagctcacgccttagtttg

SEQ ID NO: 51385 - DNA, 25 bp, Homo sapien
gaagctcacgccttagtttgaaaca

SEQ ID NO: 51386 - DNA, 25 bp, Homo sapien
gctcacgccttagtttgaaacagat

SEQ ID NO: 51387 - DNA, 25 bp, Homo sapien
tttgaaacagattctccacggtggt

SEQ ID NO: 51388 - DNA, 25 bp, Homo sapien
ggtccccaaaacactgtctgcatat

SEQ ID NO: 51389 - DNA, 25 bp, Homo sapien
aaaacactgtctgcatatccataag

SEQ ID NO: 51390 - DNA, 25 bp, Homo sapien
actgtctgcatatccataagaattg

SEQ ID NO: 51391 - DNA, 25 bp, Homo sapien
gaggatcagtttgcagcagcaagta

SEQ ID NO: 51392 - DNA, 25 bp, Homo sapien
atcagtttgcagcagcaagtacaaa

SEQ ID NO: 51393 - DNA, 25 bp, Homo sapien
aacttcagatacttgtgaacatgcc

SEQ ID NO: 51394 - DNA, 25 bp, Homo sapien
cagatacttgtgaacatgccttata

SEQ ID NO: 51395 - DNA, 25 bp, Homo sapien
tatctttaaatgatgtacaggcaga

SEQ ID NO: 51396 - DNA, 25 bp, Homo sapien
tacaggcagatgaaaccaggtcact

SEQ ID NO: 51397 - DNA, 25 bp, Homo sapien
ctgagctgttatcttgtgtatggat

SEQ ID NO: 51398 - DNA, 25 bp, Homo sapien
gtgtaaatgttatgactccttgata

SEQ ID NO: 51399 - DNA, 25 bp, Homo sapien
tattatgtccattattcaagaaaga

SEQ ID NO: 51400 - DNA, 25 bp, Homo sapien
atagtatatctaatggctgtggcat

SEQ ID NO: 51401 - DNA, 25 bp, Homo sapien
gctgtggcattgttgatgctcacat

SEQ ID NO: 51402 - DNA, 25 bp, Homo sapien
gcattgttgatgctcacatatgata

SEQ ID NO: 51403 - DNA, 25 bp, Homo sapien
aagtgtcctataattctattgaaag

SEQ ID NO: 51404 - DNA, 25 bp, Homo sapien
attttgttactgtctgtagcgtttt

SEQ ID NO: 51405 - DNA, 25 bp, Homo sapien
ctgtctgtagcgttttgtggagtac

SEQ ID NO: 51406 - DNA, 25 bp, Homo sapien
tcgagggccagctcagcgcgcggag

SEQ ID NO: 51407 - DNA, 25 bp, Homo sapien
gcggagccgcagcaacagcgccgag

SEQ ID NO: 51408 - DNA, 25 bp, Homo sapien
cgcgcgccgtggagaaccagtactc

SEQ ID NO: 51409 - DNA, 25 bp, Homo sapien
gcgccgtggagaaccagtactcctt

SEQ ID NO: 51410 - DNA, 25 bp, Homo sapien
gtggagaaccagtactccttctact

SEQ ID NO: 51411 - DNA, 25 bp, Homo sapien
ggagaaccagtactccttctactag

SEQ ID NO: 51412 - DNA, 25 bp, Homo sapien
agaaccagtactccttctactagcc

SEQ ID NO: 51413 - DNA, 25 bp, Homo sapien
ggtgggacacgccaagctcttcagt

SEQ ID NO: 51414 - DNA, 25 bp, Homo sapien
ggacacgccaagctcttcagtgaag

SEQ ID NO: 51415 - DNA, 25 bp, Homo sapien
acacgccaagctcttcagtgaagac

SEQ ID NO: 51416 - DNA, 25 bp, Homo sapien
aagctcttcagtgaagacacgatgt

SEQ ID NO: 51417 - DNA, 25 bp, Homo sapien
tgacaaacttcatcaagccctccag

SEQ ID NO: 51418 - DNA, 25 bp, Homo sapien
ggaaactgagcccaattaccaagtc

SEQ ID NO: 51419 - DNA, 25 bp, Homo sapien
aattaccaagtcctgattcgcatcc

SEQ ID NO: 51420 - DNA, 25 bp, Homo sapien
attcgcatccttatctctcgatgtg

SEQ ID NO: 51421 - DNA, 25 bp, Homo sapien
tctcgatgtgagactgaccttctga

SEQ ID NO: 51422 - DNA, 25 bp, Homo sapien
gaccttctgagtatcagagctgagt

SEQ ID NO: 51423 - DNA, 25 bp, Homo sapien
gaaatttgggaagtccctctactct

SEQ ID NO: 51424 - DNA, 25 bp, Homo sapien
gaagacatgtgagacttccctgccc

SEQ ID NO: 51425 - DNA, 25 bp, Homo sapien
gacatccgaggatctgagatttccg

SEQ ID NO: 51426 - DNA, 25 bp, Homo sapien
gagatttccgtgtttggctgaacct

SEQ ID NO: 51427 - DNA, 25 bp, Homo sapien
gggagaccagctgggcctccaagta

SEQ ID NO: 51428 - DNA, 25 bp, Homo sapien
gatacccactgattttcagtcgggt

SEQ ID NO: 51429 - DNA, 25 bp, Homo sapien
acccactgattttcagtcgggtgaa

SEQ ID NO: 51430 - DNA, 25 bp, Homo sapien
cagtcgggtgaaaaaatcagttgaa

SEQ ID NO: 51431 - DNA, 25 bp, Homo sapien
ttttcctgtgaacagccatgcaacc

SEQ ID NO: 51432 - DNA, 25 bp, Homo sapien
tgaacagccatgcaaccaaaccacg

SEQ ID NO: 51433 - DNA, 25 bp, Homo sapien
atgcaaccaaaccacggcaggcaac

SEQ ID NO: 51434 - DNA, 25 bp, Homo sapien
cacggcaggcaacgcgctgacattt

SEQ ID NO: 51435 - DNA, 25 bp, Homo sapien
aggcaacgcgctgacatttctgaag

SEQ ID NO: 51436 - DNA, 25 bp, Homo sapien
ctttctctttaagttgctacaattt

SEQ ID NO: 51437 - DNA, 25 bp, Homo sapien
atcaagtaagctactctaaatcagt

SEQ ID NO: 51438 - DNA, 25 bp, Homo sapien
gctactctaaatcagtatcagttgt

SEQ ID NO: 51439 - DNA, 25 bp, Homo sapien
tgggttatacatagggcagctcttt

SEQ ID NO: 51440 - DNA, 25 bp, Homo sapien
acatagggcagctctttgtgaaagt

SEQ ID NO: 51441 - DNA, 25 bp, Homo sapien
gaaaatcagttagaaccaatgtatt

SEQ ID NO: 51442 - DNA, 25 bp, Homo sapien
accaatgtatttcttgccccacgga

SEQ ID NO: 51443 - DNA, 25 bp, Homo sapien
tatttcttgccccacggaacactat

SEQ ID NO: 51444 - DNA, 25 bp, Homo sapien
gccccacggaacactattcctataa

SEQ ID NO: 51445 - DNA, 25 bp, Homo sapien
ccacggaacactattcctataagat

SEQ ID NO: 51446 - DNA, 25 bp, Homo sapien
aggatcagcaccttgtataggaatt

SEQ ID NO: 51447 - DNA, 25 bp, Homo sapien
agcaccttgtataggaattcccatg

SEQ ID NO: 51448 - DNA, 25 bp, Homo sapien
ccttgtataggaattcccatgaatt

SEQ ID NO: 51449 - DNA, 25 bp, Homo sapien
aacagtcatttacgaaagaaagtca

SEQ ID NO: 51450 - DNA, 25 bp, Homo sapien
ggttctagatctttcaggaattggc

SEQ ID NO: 51451 - DNA, 25 bp, Homo sapien
tctagatctttcaggaattggcaca

SEQ ID NO: 51452 - DNA, 25 bp, Homo sapien
ctagatctttcaggaattggcacac

SEQ ID NO: 51453 - DNA, 25 bp, Homo sapien
gatctttcaggaattggcacactct

SEQ ID NO: 51454 - DNA, 25 bp, Homo sapien
ctttcaggaattggcacactctctt

SEQ ID NO: 51455 - DNA, 25 bp, Homo sapien
tcaggaattggcacactctcttcca

SEQ ID NO: 51456 - DNA, 25 bp, Homo sapien
tggcacactctcttccacaatggtt

SEQ ID NO: 51457 - DNA, 25 bp, Homo sapien
agcattcatgtttctccacagcttt

SEQ ID NO: 51458 - DNA, 25 bp, Homo sapien
gcattcatgtttctccacagcttta

SEQ ID NO: 51459 - DNA, 25 bp, Homo sapien
cattcatgtttctccacagctttac

SEQ ID NO: 51460 - DNA, 25 bp, Homo sapien
atgtttctccacagctttaccagca

SEQ ID NO: 51461 - DNA, 25 bp, Homo sapien
agtcttgtcattgccagctgtgttg

SEQ ID NO: 51462 - DNA, 25 bp, Homo sapien
aacagccaaaactccacagtcaata

SEQ ID NO: 51463 - DNA, 25 bp, Homo sapien
agccaaaactccacagtcaatatta

SEQ ID NO: 51464 - DNA, 25 bp, Homo sapien
caaaactccacagtcaatattagta

SEQ ID NO: 51465 - DNA, 25 bp, Homo sapien
gactgcatttttaaatacaaggctt

SEQ ID NO: 51466 - DNA, 25 bp, Homo sapien
aagatgtttttatgtgctctccaaa

SEQ ID NO: 51467 - DNA, 25 bp, Homo sapien
agatgtttttatgtgctctccaaat

SEQ ID NO: 51468 - DNA, 25 bp, Homo sapien
gatgtttttatgtgctctccaaatt

SEQ ID NO: 51469 - DNA, 25 bp, Homo sapien
tgtttttatgtgctctccaaatttt

SEQ ID NO: 51470 - DNA, 25 bp, Homo sapien
tttatgtgctctccaaatttttttt

SEQ ID NO: 51471 - DNA, 25 bp, Homo sapien
ttactgtttctgattgtatggaaat

SEQ ID NO: 51472 - DNA, 25 bp, Homo sapien
caattgggcaaactttgtattaatg

SEQ ID NO: 51473 - DNA, 25 bp, Homo sapien
ttaagtgcaggagacattggtattc

SEQ ID NO: 51474 - DNA, 25 bp, Homo sapien
agacattggtattctgggcagcttc

SEQ ID NO: 51475 - DNA, 25 bp, Homo sapien
tctgggcagcttcctaatatgcttt

SEQ ID NO: 51476 - DNA, 25 bp, Homo sapien
gcttcctaatatgctttacaatctg

SEQ ID NO: 51477 - DNA, 25 bp, Homo sapien
tacaatctgcactttaactgactta

SEQ ID NO: 51478 - DNA, 25 bp, Homo sapien
ctttaactgacttaagtggcattaa

SEQ ID NO: 51479 - DNA, 25 bp, Homo sapien
taagtggcattaaacatttgagagc

SEQ ID NO: 51480 - DNA, 25 bp, Homo sapien
catttgagagctaactatattttta

SEQ ID NO: 51481 - DNA, 25 bp, Homo sapien
taagactactatacaaactacagag

SEQ ID NO: 51482 - DNA, 25 bp, Homo sapien
aaagcttctatggttgacattgtat

SEQ ID NO: 51483 - DNA, 25 bp, Homo sapien
cagctgtggctggaacctttataaa

SEQ ID NO: 51484 - DNA, 25 bp, Homo sapien
aaagtgaccaagcacaccttttcat

SEQ ID NO: 51485 - DNA, 25 bp, Homo sapien
accttttcatccagtctcagcgtgg

SEQ ID NO: 51486 - DNA, 25 bp, Homo sapien
agcctagcagctatgaggatccatt

SEQ ID NO: 51487 - DNA, 25 bp, Homo sapien
gctatgaggatccattatcttctgt

SEQ ID NO: 51488 - DNA, 25 bp, Homo sapien
tgtttttggtgcctgttccaggtca

SEQ ID NO: 51489 - DNA, 25 bp, Homo sapien
tgcctgttccaggtcatggaggaat

SEQ ID NO: 51490 - DNA, 25 bp, Homo sapien
ggaggaatcataaacacattacaga

SEQ ID NO: 51491 - DNA, 25 bp, Homo sapien
attgcagagtcagaggcggccggtg

SEQ ID NO: 51492 - DNA, 25 bp, Homo sapien
gaacagatcggcaagtgctcgacgc

SEQ ID NO: 51493 - DNA, 25 bp, Homo sapien
agtgctcgacgcgtggccgaaaatg

SEQ ID NO: 51494 - DNA, 25 bp, Homo sapien
aacagctgtctcaccagagtttgcc

SEQ ID NO: 51495 - DNA, 25 bp, Homo sapien
agagtttgcctacgtcccagctgac

SEQ ID NO: 51496 - DNA, 25 bp, Homo sapien
gatctggtgacaaatgtgctccctt

SEQ ID NO: 51497 - DNA, 25 bp, Homo sapien
gacaaatgtgctccctttggaagtt

SEQ ID NO: 51498 - DNA, 25 bp, Homo sapien
tgctccctttggaagttacggtatt

SEQ ID NO: 51499 - DNA, 25 bp, Homo sapien
gggaggtaaccgtgactactgctca

SEQ ID NO: 51500 - DNA, 25 bp, Homo sapien
tgactactgctcacaaacgtcgcaa

SEQ ID NO: 51501 - DNA, 25 bp, Homo sapien
aaacgtcgcaaagcagaaactgaaa

SEQ ID NO: 51502 - DNA, 25 bp, Homo sapien
actgatccagaaatgacgctgtctg

SEQ ID NO: 51503 - DNA, 25 bp, Homo sapien
gaaatgacgctgtctgggtcaacat

SEQ ID NO: 51504 - DNA, 25 bp, Homo sapien
caacatttcagggaggagtctgcca

SEQ ID NO: 51505 - DNA, 25 bp, Homo sapien
aacagccaaaactccacagtcaata

SEQ ID NO: 51506 - DNA, 25 bp, Homo sapien
cagccaaaactccacagtcaatatt

SEQ ID NO: 51507 - DNA, 25 bp, Homo sapien
gccaaaactccacagtcaatattag

SEQ ID NO: 51508 - DNA, 25 bp, Homo sapien
caaaactccacagtcaatattagta

SEQ ID NO: 51509 - DNA, 25 bp, Homo sapien
aagatgtttttatgtgctctccaaa

SEQ ID NO: 51510 - DNA, 25 bp, Homo sapien
agatgtttttatgtgctctccaaat

SEQ ID NO: 51511 - DNA, 25 bp, Homo sapien
gatgtttttatgtgctctccaaatt

SEQ ID NO: 51512 - DNA, 25 bp, Homo sapien
atgtttttatgtgctctccaaattt

SEQ ID NO: 51513 - DNA, 25 bp, Homo sapien
tgtttttatgtgctctccaaatttt

SEQ ID NO: 51514 - DNA, 25 bp, Homo sapien
tttatgtgctctccaaatttttttt

SEQ ID NO: 51515 - DNA, 25 bp, Homo sapien
ttactgtttctgattgtatggaaat

SEQ ID NO: 51516 - DNA, 25 bp, Homo sapien
catctcaaggtggacttctgatcat

SEQ ID NO: 51517 - DNA, 25 bp, Homo sapien
aaggtggacttctgatcattgagga

SEQ ID NO: 51518 - DNA, 25 bp, Homo sapien
atcatctgtgagtttaggagtctta

SEQ ID NO: 51519 - DNA, 25 bp, Homo sapien
agtcttaagatcctcacagcacggg

SEQ ID NO: 51520 - DNA, 25 bp, Homo sapien
gaggctctagaacaaggtttcacaa

SEQ ID NO: 51521 - DNA, 25 bp, Homo sapien
ggtttcacaaccgagatgcctttga

SEQ ID NO: 51522 - DNA, 25 bp, Homo sapien
gaaaacctgtttcctattttgtgca

SEQ ID NO: 51523 - DNA, 25 bp, Homo sapien
acctgtttcctattttgtgcattac

SEQ ID NO: 51524 - DNA, 25 bp, Homo sapien
ggcccactctagttatgacaaccaa

SEQ ID NO: 51525 - DNA, 25 bp, Homo sapien
atgtctctatacattgccagatttc

SEQ ID NO: 51526 - DNA, 25 bp, Homo sapien
atacattgccagatttctcctaggg

SEQ ID NO: 51527 - DNA, 25 bp, Homo sapien
ttgtgccttggaaagaggttcccat

SEQ ID NO: 51528 - DNA, 25 bp, Homo sapien
aggttcccatccctcattggaatca

SEQ ID NO: 51529 - DNA, 25 bp, Homo sapien
atccaggacttctcttacacttggg

SEQ ID NO: 51530 - DNA, 25 bp, Homo sapien
acagtgtggcccttgctgtgcagaa

SEQ ID NO: 51531 - DNA, 25 bp, Homo sapien
tgtgcagaaccaactcagcatccca

SEQ ID NO: 51532 - DNA, 25 bp, Homo sapien
aaagccccaggcattcttcagcatt

SEQ ID NO: 51533 - DNA, 25 bp, Homo sapien
attcttcagcattgcggcagctcct

SEQ ID NO: 51534 - DNA, 25 bp, Homo sapien
ggcagctcctgaactcgatgatgac

SEQ ID NO: 51535 - DNA, 25 bp, Homo sapien
gatgatgaccgtggacccgcatcag

SEQ ID NO: 51536 - DNA, 25 bp, Homo sapien
ggccaacatactacccaaatctgaa

SEQ ID NO: 51537 - DNA, 25 bp, Homo sapien
atgttgagaagatggccccttgtgc

SEQ ID NO: 51538 - DNA, 25 bp, Homo sapien
agattccccaacagcagactacagg

SEQ ID NO: 51539 - DNA, 25 bp, Homo sapien
gcagactacaggtaaatggtatccc

SEQ ID NO: 51540 - DNA, 25 bp, Homo sapien
ggtaaatggtatccctgaagaaaga

SEQ ID NO: 51541 - DNA, 25 bp, Homo sapien
gaaaactgactgaagcaatgaattt

SEQ ID NO: 51542 - DNA, 25 bp, Homo sapien
cagacaatatagcagttacatcaca

SEQ ID NO: 51543 - DNA, 25 bp, Homo sapien
cttccaataatgcatgagcttttct

SEQ ID NO: 51544 - DNA, 25 bp, Homo sapien
gcatgagcttttctggcatatgtta

SEQ ID NO: 51545 - DNA, 25 bp, Homo sapien
gcatatgttatgcatgttggcagta

SEQ ID NO: 51546 - DNA, 25 bp, Homo sapien
ggcagtattaagtgtataccaaata

SEQ ID NO: 51547 - DNA, 25 bp, Homo sapien
acaacataactttcattttactaat

SEQ ID NO: 51548 - DNA, 25 bp, Homo sapien
gtacttaaagcatttttgacaattt

SEQ ID NO: 51549 - DNA, 25 bp, Homo sapien
gagtttgaggcttaagaagctggat

SEQ ID NO: 51550 - DNA, 25 bp, Homo sapien
ttgaggcttaagaagctggatctcc

SEQ ID NO: 51551 - DNA, 25 bp, Homo sapien
tgaggcttaagaagctggatctcct

SEQ ID NO: 51552 - DNA, 25 bp, Homo sapien
gaggcttaagaagctggatctcctg

SEQ ID NO: 51553 - DNA, 25 bp, Homo sapien
aggcttaagaagctggatctcctgc

SEQ ID NO: 51554 - DNA, 25 bp, Homo sapien
ggcttaagaagctggatctcctgcc

SEQ ID NO: 51555 - DNA, 25 bp, Homo sapien
gcttaagaagctggatctcctgccg

SEQ ID NO: 51556 - DNA, 25 bp, Homo sapien
ttaagaagctggatctcctgccggg

SEQ ID NO: 51557 - DNA, 25 bp, Homo sapien
taagaagctggatctcctgccgggc

SEQ ID NO: 51558 - DNA, 25 bp, Homo sapien
agaagctggatctcctgccgggcgt

SEQ ID NO: 51559 - DNA, 25 bp, Homo sapien
agctggatctcctgccgggcgtggt

SEQ ID NO: 51560 - DNA, 25 bp, Homo sapien
ccagctgccatgtttcaaagacgac

SEQ ID NO: 51561 - DNA, 25 bp, Homo sapien
tttcaaagacgacctttacctcctg

SEQ ID NO: 51562 - DNA, 25 bp, Homo sapien
ttgactctgcatttgaccacggact

SEQ ID NO: 51563 - DNA, 25 bp, Homo sapien
accacggactccagtctgtgtgtag

SEQ ID NO: 51564 - DNA, 25 bp, Homo sapien
gagagctgagtaggaggcctccact

SEQ ID NO: 51565 - DNA, 25 bp, Homo sapien
tccactccggatcgaggcctgtata

SEQ ID NO: 51566 - DNA, 25 bp, Homo sapien
gaggcctgtatagggctcgtttccc

SEQ ID NO: 51567 - DNA, 25 bp, Homo sapien
cccacacatgcctatttctgaagag

SEQ ID NO: 51568 - DNA, 25 bp, Homo sapien
ctgtcttatttgaaggccagcccac

SEQ ID NO: 51569 - DNA, 25 bp, Homo sapien
acacccagctactttaacaccaggt

SEQ ID NO: 51570 - DNA, 25 bp, Homo sapien
atggaaaatgtcaggccttccccac

SEQ ID NO: 51571 - DNA, 25 bp, Homo sapien
gctaacaaactcagatatcctccca

SEQ ID NO: 51572 - DNA, 25 bp, Homo sapien
tatcctcccaacagccagtcaaagg

SEQ ID NO: 51573 - DNA, 25 bp, Homo sapien
tttctcttgaaacggttcaacaaag

SEQ ID NO: 51574 - DNA, 25 bp, Homo sapien
aagaaaaactcggtctcctgttgct

SEQ ID NO: 51575 - DNA, 25 bp, Homo sapien
ctgttgctcactttcctgggtattg

SEQ ID NO: 51576 - DNA, 25 bp, Homo sapien
gaagaatgatcctgttcaacctcct

SEQ ID NO: 51577 - DNA, 25 bp, Homo sapien
tcaacctcctagtgcctctactgaa

SEQ ID NO: 51578 - DNA, 25 bp, Homo sapien
agtgcctctactgaattattcctct

SEQ ID NO: 51579 - DNA, 25 bp, Homo sapien
ttattcctcttttaaatggttaatg

SEQ ID NO: 51580 - DNA, 25 bp, Homo sapien
gaaaatatgcaaacactctgtgatc

SEQ ID NO: 51581 - DNA, 25 bp, Homo sapien
tgcaaacactctgtgatcaaactta

SEQ ID NO: 51582 - DNA, 25 bp, Homo sapien
tccctgggctctgtcagctagcaga

SEQ ID NO: 51583 - DNA, 25 bp, Homo sapien
ggagccgcagcccatctctagatga

SEQ ID NO: 51584 - DNA, 25 bp, Homo sapien
gccgcagcccatctctagatgaaag

SEQ ID NO: 51585 - DNA, 25 bp, Homo sapien
aaagagcccagttgtctccttgtga

SEQ ID NO: 51586 - DNA, 25 bp, Homo sapien
agcccagttgtctccttgtgacatt

SEQ ID NO: 51587 - DNA, 25 bp, Homo sapien
agttgtctccttgtgacattctctg

SEQ ID NO: 51588 - DNA, 25 bp, Homo sapien
ccttgtgacattctctgttctcaga

SEQ ID NO: 51589 - DNA, 25 bp, Homo sapien
tgccgtcgagtctctgctttttgtc

SEQ ID NO: 51590 - DNA, 25 bp, Homo sapien
agtctctgctttttgtccacatttt

SEQ ID NO: 51591 - DNA, 25 bp, Homo sapien
ttgtccacattttgggatcagctta

SEQ ID NO: 51592 - DNA, 25 bp, Homo sapien
cacattttgggatcagcttactgca

SEQ ID NO: 51593 - DNA, 25 bp, Homo sapien
tatgggagtgtctagatgcctgaaa

SEQ ID NO: 51594 - DNA, 25 bp, Homo sapien
gagtgtctagatgcctgaaagggcc

SEQ ID NO: 51595 - DNA, 25 bp, Homo sapien
gcagggtgccggacaaaggcctcct

SEQ ID NO: 51596 - DNA, 25 bp, Homo sapien
gacaaaggcctcctggtcactctgt

SEQ ID NO: 51597 - DNA, 25 bp, Homo sapien
tgcactccatgtatagtcctcttgg

SEQ ID NO: 51598 - DNA, 25 bp, Homo sapien
ccatgtatagtcctcttgggttggg

SEQ ID NO: 51599 - DNA, 25 bp, Homo sapien
gagcaaggctgggtaccgtgcaccc

SEQ ID NO: 51600 - DNA, 25 bp, Homo sapien
ttaccctaagtccaactcttccaag

SEQ ID NO: 51601 - DNA, 25 bp, Homo sapien
tcttccaaggagtatgtgtgacctg

SEQ ID NO: 51602 - DNA, 25 bp, Homo sapien
gtgacctgggatctccttgccccag

SEQ ID NO: 51603 - DNA, 25 bp, Homo sapien
ccccagcctgacaggctatgggagt

SEQ ID NO: 51604 - DNA, 25 bp, Homo sapien
cattatgcttgagatgtcttaacct

SEQ ID NO: 51605 - DNA, 25 bp, Homo sapien
ccaaatgccttctgttttccaaagg

SEQ ID NO: 51606 - DNA, 25 bp, Homo sapien
aaatgccttctgttttccaaaggag

SEQ ID NO: 51607 - DNA, 25 bp, Homo sapien
atgccttctgttttccaaaggagtg

SEQ ID NO: 51608 - DNA, 25 bp, Homo sapien
gccttctgttttccaaaggagtggt

SEQ ID NO: 51609 - DNA, 25 bp, Homo sapien
cttctgttttccaaaggagtggtca

SEQ ID NO: 51610 - DNA, 25 bp, Homo sapien
tctgttttccaaaggagtggtcaag

SEQ ID NO: 51611 - DNA, 25 bp, Homo sapien
ggagtggtcaagcccttgcccagag

SEQ ID NO: 51612 - DNA, 25 bp, Homo sapien
actgaattatgccagggcgcacttt

SEQ ID NO: 51613 - DNA, 25 bp, Homo sapien
tgaattatgccagggcgcactttcc

SEQ ID NO: 51614 - DNA, 25 bp, Homo sapien
aattatgccagggcgcactttccac

SEQ ID NO: 51615 - DNA, 25 bp, Homo sapien
cagaacgtggtgacctttcacgaac

SEQ ID NO: 51616 - DNA, 25 bp, Homo sapien
gaacgtggtgacctttcacgaacat

SEQ ID NO: 51617 - DNA, 25 bp, Homo sapien
aacgtggtgacctttcacgaacatg

SEQ ID NO: 51618 - DNA, 25 bp, Homo sapien
acgtggtgacctttcacgaacatgg

SEQ ID NO: 51619 - DNA, 25 bp, Homo sapien
gtggtgacctttcacgaacatgggc

SEQ ID NO: 51620 - DNA, 25 bp, Homo sapien
ggtgacctttcacgaacatgggcat

SEQ ID NO: 51621 - DNA, 25 bp, Homo sapien
gtgacctttcacgaacatgggcatg

SEQ ID NO: 51622 - DNA, 25 bp, Homo sapien
tgacctttcacgaacatgggcatgg

SEQ ID NO: 51623 - DNA, 25 bp, Homo sapien
gacctttcacgaacatgggcatggc

SEQ ID NO: 51624 - DNA, 25 bp, Homo sapien
acctttcacgaacatgggcatggct

SEQ ID NO: 51625 - DNA, 25 bp, Homo sapien
cctttcacgaacatgggcatggctg

SEQ ID NO: 51626 - DNA, 25 bp, Homo sapien
tacctattgaaattctctcactctg

SEQ ID NO: 51627 - DNA, 25 bp, Homo sapien
gaaattctctcactctgtgtatgta

SEQ ID NO: 51628 - DNA, 25 bp, Homo sapien
gaaaggagtacgtgattccctccct

SEQ ID NO: 51629 - DNA, 25 bp, Homo sapien
cctccctttcacttttcaaagtgag

SEQ ID NO: 51630 - DNA, 25 bp, Homo sapien
aagtgagccactaaacagaaagtct

SEQ ID NO: 51631 - DNA, 25 bp, Homo sapien
agttcagaaatgtcccattctccta

SEQ ID NO: 51632 - DNA, 25 bp, Homo sapien
gaaatgtcccattctcctaaggact

SEQ ID NO: 51633 - DNA, 25 bp, Homo sapien
tcctaaggactttcccttcaccatt

SEQ ID NO: 51634 - DNA, 25 bp, Homo sapien
cttcaccatttttctagggtatagt

SEQ ID NO: 51635 - DNA, 25 bp, Homo sapien
ttttctagggtatagtgccactgac

SEQ ID NO: 51636 - DNA, 25 bp, Homo sapien
gctagatgtttttccacaagaggat

SEQ ID NO: 51637 - DNA, 25 bp, Homo sapien
gattgcataacgcattatgaaggca

SEQ ID NO: 51638 - DNA, 25 bp, Homo sapien
tatgaaggcagcacatgccccaaat

SEQ ID NO: 51639 - DNA, 25 bp, Homo sapien
gaaggcagcacatgccccaaatgga

SEQ ID NO: 51640 - DNA, 25 bp, Homo sapien
cagcacatgccccaaatggaaggca

SEQ ID NO: 51641 - DNA, 25 bp, Homo sapien
aaatggaaggcaccgaagagccctg

SEQ ID NO: 51642 - DNA, 25 bp, Homo sapien
gggtgcagcccatactgaacgaaca

SEQ ID NO: 51643 - DNA, 25 bp, Homo sapien
ttctgtgtcggcatgtctaagtacc

SEQ ID NO: 51644 - DNA, 25 bp, Homo sapien
ctggtacgcggctgggatcctaagc

SEQ ID NO: 51645 - DNA, 25 bp, Homo sapien
gtacgcggctgggatcctaagcttt

SEQ ID NO: 51646 - DNA, 25 bp, Homo sapien
acgcggctgggatcctaagctttga

SEQ ID NO: 51647 - DNA, 25 bp, Homo sapien
cgcggctgggatcctaagctttgat

SEQ ID NO: 51648 - DNA, 25 bp, Homo sapien
ggccaggctcactggaccattgtca

SEQ ID NO: 51649 - DNA, 25 bp, Homo sapien
attgtcacaaccctctgtttctctt

SEQ ID NO: 51650 - DNA, 25 bp, Homo sapien
gtttctctttgactaagtgccctgg

SEQ ID NO: 51651 - DNA, 25 bp, Homo sapien
agtgccctggctacaggaattacac

SEQ ID NO: 51652 - DNA, 25 bp, Homo sapien
ggaattacacagttctctttctcca

SEQ ID NO: 51653 - DNA, 25 bp, Homo sapien
gttctctttctccaaagggcaagat

SEQ ID NO: 51654 - DNA, 25 bp, Homo sapien
aaagggcaagatctcatttcaattt

SEQ ID NO: 51655 - DNA, 25 bp, Homo sapien
atttctttattagagggccttattg

SEQ ID NO: 51656 - DNA, 25 bp, Homo sapien
gggccttattgatgtgttctaagtc

SEQ ID NO: 51657 - DNA, 25 bp, Homo sapien
gtgatttatatcctgatttcaacca

SEQ ID NO: 51658 - DNA, 25 bp, Homo sapien
gatttcaaccagtcacttagctgat

SEQ ID NO: 51659 - DNA, 25 bp, Homo sapien
gtatgtctcctttgaacactgattt

SEQ ID NO: 51660 - DNA, 25 bp, Homo sapien
aaagcaccagcatggccaagtttct

SEQ ID NO: 51661 - DNA, 25 bp, Homo sapien
gcatggccaagtttctctagggact

SEQ ID NO: 51662 - DNA, 25 bp, Homo sapien
ttctctagggacttcatttcatttt

SEQ ID NO: 51663 - DNA, 25 bp, Homo sapien
ttcaggttttcaatccagctataag

SEQ ID NO: 51664 - DNA, 25 bp, Homo sapien
gactgacatgtcatagttttcatag

SEQ ID NO: 51665 - DNA, 25 bp, Homo sapien
gtcacaaatactatgatgggtttca

SEQ ID NO: 51666 - DNA, 25 bp, Homo sapien
tgatgggtttcatggtcttggttgt

SEQ ID NO: 51667 - DNA, 25 bp, Homo sapien
tagatatctgaaacaccgtgagctt

SEQ ID NO: 51668 - DNA, 25 bp, Homo sapien
gaaacaccgtgagcttagaataaaa

SEQ ID NO: 51669 - DNA, 25 bp, Homo sapien
gtagtagtgagattttccactttct

SEQ ID NO: 51670 - DNA, 25 bp, Homo sapien
ttgcctgctttacccacaactgctg

SEQ ID NO: 51671 - DNA, 25 bp, Homo sapien
tgcctgctttacccacaactgctgg

SEQ ID NO: 51672 - DNA, 25 bp, Homo sapien
gcctgctttacccacaactgctggg

SEQ ID NO: 51673 - DNA, 25 bp, Homo sapien
cctgctttacccacaactgctgggt

SEQ ID NO: 51674 - DNA, 25 bp, Homo sapien
ctgctttacccacaactgctgggtc

SEQ ID NO: 51675 - DNA, 25 bp, Homo sapien
tgctttacccacaactgctgggtcc

SEQ ID NO: 51676 - DNA, 25 bp, Homo sapien
gctttacccacaactgctgggtcct

SEQ ID NO: 51677 - DNA, 25 bp, Homo sapien
ctttacccacaactgctgggtcctg

SEQ ID NO: 51678 - DNA, 25 bp, Homo sapien
tgtctctgtgtttgtggactggatt

SEQ ID NO: 51679 - DNA, 25 bp, Homo sapien
gtctctgtgtttgtggactggattc

SEQ ID NO: 51680 - DNA, 25 bp, Homo sapien
acgctctactcggtaaaagcgttat

SEQ ID NO: 51681 - DNA, 25 bp, Homo sapien
cgctctactcggtaaaagcgttata

SEQ ID NO: 51682 - DNA, 25 bp, Homo sapien
gctctactcggtaaaagcgttatac

SEQ ID NO: 51683 - DNA, 25 bp, Homo sapien
ctctactcggtaaaagcgttataca

SEQ ID NO: 51684 - DNA, 25 bp, Homo sapien
tctactcggtaaaagcgttatacaa

SEQ ID NO: 51685 - DNA, 25 bp, Homo sapien
tactcggtaaaagcgttatacaaag

SEQ ID NO: 51686 - DNA, 25 bp, Homo sapien
taaaagcgttatacaaagtcatagg

SEQ ID NO: 51687 - DNA, 25 bp, Homo sapien
aaagcgttatacaaagtcataggag

SEQ ID NO: 51688 - DNA, 25 bp, Homo sapien
aagcgttatacaaagtcataggaga

SEQ ID NO: 51689 - DNA, 25 bp, Homo sapien
gcgttatacaaagtcataggagaaa

SEQ ID NO: 51690 - DNA, 25 bp, Homo sapien
gtttataaattgagtcctaagtatt

SEQ ID NO: 51691 - DNA, 25 bp, Homo sapien
gtacctgcccaattgtgaccgcaaa

SEQ ID NO: 51692 - DNA, 25 bp, Homo sapien
tgaccgcaaaggattctacaagaga

SEQ ID NO: 51693 - DNA, 25 bp, Homo sapien
agaaagcagtgcaaaccttcccgtg

SEQ ID NO: 51694 - DNA, 25 bp, Homo sapien
agtgcaaaccttcccgtggccgcaa

SEQ ID NO: 51695 - DNA, 25 bp, Homo sapien
aagcgtggcatctgctggtgcgtgg

SEQ ID NO: 51696 - DNA, 25 bp, Homo sapien
ggacaagtacgggatgaagctgcca

SEQ ID NO: 51697 - DNA, 25 bp, Homo sapien
gctgccaggcatggagtacgttgac

SEQ ID NO: 51698 - DNA, 25 bp, Homo sapien
gggactttcagtgccacaccttcga

SEQ ID NO: 51699 - DNA, 25 bp, Homo sapien
agtgccacaccttcgacagcagcaa

SEQ ID NO: 51700 - DNA, 25 bp, Homo sapien
cagcaacgttgagtgatgcgtcccc

SEQ ID NO: 51701 - DNA, 25 bp, Homo sapien
gccactcatttcatctcatttaagg

SEQ ID NO: 51702 - DNA, 25 bp, Homo sapien
taaaagcatcccagataatgtcatc

SEQ ID NO: 51703 - DNA, 25 bp, Homo sapien
aagaagccgatgttgatcctggtgc

SEQ ID NO: 51704 - DNA, 25 bp, Homo sapien
ttgatcctggtgctcctccttatga

SEQ ID NO: 51705 - DNA, 25 bp, Homo sapien
ttatgactccctgcagacatatgct

SEQ ID NO: 51706 - DNA, 25 bp, Homo sapien
atggctcagttgctgaatcactcag

SEQ ID NO: 51707 - DNA, 25 bp, Homo sapien
gctctttagattccatcagctcaaa

SEQ ID NO: 51708 - DNA, 25 bp, Homo sapien
gaactatgactacctaagtgactgg

SEQ ID NO: 51709 - DNA, 25 bp, Homo sapien
ggacctcgctttaaacgactcgcgg

SEQ ID NO: 51710 - DNA, 25 bp, Homo sapien
aacgactcgcggacatgtatgggac

SEQ ID NO: 51711 - DNA, 25 bp, Homo sapien
gggactggccaagagagtttgtact

SEQ ID NO: 51712 - DNA, 25 bp, Homo sapien
gtttgtactcatagccttggaacct

SEQ ID NO: 51713 - DNA, 25 bp, Homo sapien
gcggagccgcagcaacagcgccgag

SEQ ID NO: 51714 - DNA, 25 bp, Homo sapien
cgcgcgccgtggagaaccagtactc

SEQ ID NO: 51715 - DNA, 25 bp, Homo sapien
gcgccgtggagaaccagtactcctt

SEQ ID NO: 51716 - DNA, 25 bp, Homo sapien
gccgtggagaaccagtactccttct

SEQ ID NO: 51717 - DNA, 25 bp, Homo sapien
cgtggagaaccagtactccttctac

SEQ ID NO: 51718 - DNA, 25 bp, Homo sapien
gtggagaaccagtactccttctact

SEQ ID NO: 51719 - DNA, 25 bp, Homo sapien
tggagaaccagtactccttctacta

SEQ ID NO: 51720 - DNA, 25 bp, Homo sapien
ggagaaccagtactccttctactag

SEQ ID NO: 51721 - DNA, 25 bp, Homo sapien
gagaaccagtactccttctactagc

SEQ ID NO: 51722 - DNA, 25 bp, Homo sapien
agaaccagtactccttctactagcc

SEQ ID NO: 51723 - DNA, 25 bp, Homo sapien
ggtgggacacgccaagctcttcagt

SEQ ID NO: 51724 - DNA, 25 bp, Homo sapien
atagctgtttggtaaccatagtttc

SEQ ID NO: 51725 - DNA, 25 bp, Homo sapien
ctgtttggtaaccatagtttcactt

SEQ ID NO: 51726 - DNA, 25 bp, Homo sapien
ttcacttgttcaaagccgtgtaatc

SEQ ID NO: 51727 - DNA, 25 bp, Homo sapien
ttgttcaaagccgtgtaatcgtggg

SEQ ID NO: 51728 - DNA, 25 bp, Homo sapien
gccgtgtaatcgtgggggtactatc

SEQ ID NO: 51729 - DNA, 25 bp, Homo sapien
gggtactatctcaactgcttttgta

SEQ ID NO: 51730 - DNA, 25 bp, Homo sapien
gtactatctcaactgcttttgtatt

SEQ ID NO: 51731 - DNA, 25 bp, Homo sapien
actatctcaactgcttttgtattca

SEQ ID NO: 51732 - DNA, 25 bp, Homo sapien
atctcaactgcttttgtattcattg

SEQ ID NO: 51733 - DNA, 25 bp, Homo sapien
ctcaactgcttttgtattcattgta

SEQ ID NO: 51734 - DNA, 25 bp, Homo sapien
actgcttttgtattcattgtattaa

SEQ ID NO: 51735 - DNA, 25 bp, Homo sapien
ggtactgtcgccctccgtgaaatcc

SEQ ID NO: 51736 - DNA, 25 bp, Homo sapien
cgtgaaatccgccgctatcagaaat

SEQ ID NO: 51737 - DNA, 25 bp, Homo sapien
tcagaaatcgactgagctactgatt

SEQ ID NO: 51738 - DNA, 25 bp, Homo sapien
gagctactgattcgcaagctaccat

SEQ ID NO: 51739 - DNA, 25 bp, Homo sapien
tactgattcgcaagctaccattcca

SEQ ID NO: 51740 - DNA, 25 bp, Homo sapien
gcaagctaccattccagcgtctggt

SEQ ID NO: 51741 - DNA, 25 bp, Homo sapien
aagctaccattccagcgtctggtac

SEQ ID NO: 51742 - DNA, 25 bp, Homo sapien
accattccagcgtctggtacgtgag

SEQ ID NO: 51743 - DNA, 25 bp, Homo sapien
ctgtgtgctatccacgccaagcgag

SEQ ID NO: 51744 - DNA, 25 bp, Homo sapien
gtgtgctatccacgccaagcgagtg

SEQ ID NO: 51745 - DNA, 25 bp, Homo sapien
ccgcattcgcggagagagggcataa

SEQ ID NO: 51746 - DNA, 25 bp, Homo sapien
gagagctattctatctatgtgtaca

SEQ ID NO: 51747 - DNA, 25 bp, Homo sapien
ttctcgcctggctcactacaataag

SEQ ID NO: 51748 - DNA, 25 bp, Homo sapien
tcgcctggctcactacaataagcgc

SEQ ID NO: 51749 - DNA, 25 bp, Homo sapien
ggagctggctaagcatgctgtgtcc

SEQ ID NO: 51750 - DNA, 25 bp, Homo sapien
gctaagcatgctgtgtccgagggca

SEQ ID NO: 51751 - DNA, 25 bp, Homo sapien
taagcatgctgtgtccgagggcact

SEQ ID NO: 51752 - DNA, 25 bp, Homo sapien
gtccgagggcactaaggcagttacc

SEQ ID NO: 51753 - DNA, 25 bp, Homo sapien
ggcagttaccaagtacactagctct

SEQ ID NO: 51754 - DNA, 25 bp, Homo sapien
gcagttaccaagtacactagctcta

SEQ ID NO: 51755 - DNA, 25 bp, Homo sapien
gttaccaagtacactagctctaaat

SEQ ID NO: 51756 - DNA, 25 bp, Homo sapien
taccaagtacactagctctaaataa

SEQ ID NO: 51757 - DNA, 25 bp, Homo sapien
ggactggtctggcaggttgggcctg

SEQ ID NO: 51758 - DNA, 25 bp, Homo sapien
gggaggctctagcatctctcatagg

SEQ ID NO: 51759 - DNA, 25 bp, Homo sapien
ggctctagcatctctcataggtgca

SEQ ID NO: 51760 - DNA, 25 bp, Homo sapien
agcatctctcataggtgcaacctga

SEQ ID NO: 51761 - DNA, 25 bp, Homo sapien
ctcataggtgcaacctgagagtggg

SEQ ID NO: 51762 - DNA, 25 bp, Homo sapien
aggcaagagagaggattcagacgct

SEQ ID NO: 51763 - DNA, 25 bp, Homo sapien
ggattcagacgctctgggagccagt

SEQ ID NO: 51764 - DNA, 25 bp, Homo sapien
tgggagccagttcctagtcctcaac

SEQ ID NO: 51765 - DNA, 25 bp, Homo sapien
cagctcgacggcactgggccagttc

SEQ ID NO: 51766 - DNA, 25 bp, Homo sapien
ccccgagaccatgtgaagaaaacca

SEQ ID NO: 51767 - DNA, 25 bp, Homo sapien
tgtgaagaaaaccatcttgtgaggg

SEQ ID NO: 51768 - DNA, 25 bp, Homo sapien
gtctccatctcagtacacaatcatt

SEQ ID NO: 51769 - DNA, 25 bp, Homo sapien
ccatctcagtacacaatcatttaat

SEQ ID NO: 51770 - DNA, 25 bp, Homo sapien
taatatttccctgtcttacccctat

SEQ ID NO: 51771 - DNA, 25 bp, Homo sapien
tttccctgtcttacccctattcaag

SEQ ID NO: 51772 - DNA, 25 bp, Homo sapien
tccagtagttcattctaatgcctag

SEQ ID NO: 51773 - DNA, 25 bp, Homo sapien
tctaatgcctagattcttttgtggt

SEQ ID NO: 51774 - DNA, 25 bp, Homo sapien
cctagattcttttgtggttgttgct

SEQ ID NO: 51775 - DNA, 25 bp, Homo sapien
cctgccagagggagttcttcttttg

SEQ ID NO: 51776 - DNA, 25 bp, Homo sapien
ccagagggagttcttcttttgtgag

SEQ ID NO: 51777 - DNA, 25 bp, Homo sapien
catcagggccagatcttccacgtct

SEQ ID NO: 51778 - DNA, 25 bp, Homo sapien
agatcttccacgtctccatctcagt

SEQ ID NO: 51779 - DNA, 25 bp, Homo sapien
taccccttattagagccatgacagc

SEQ ID NO: 51780 - DNA, 25 bp, Homo sapien
agatggttcctttctgccccttcct

SEQ ID NO: 51781 - DNA, 25 bp, Homo sapien
tcctttctgccccttcctggaagga

SEQ ID NO: 51782 - DNA, 25 bp, Homo sapien
aggtgaggctgccaatagcctcctg

SEQ ID NO: 51783 - DNA, 25 bp, Homo sapien
gaggctgccaatagcctcctggcac

SEQ ID NO: 51784 - DNA, 25 bp, Homo sapien
ccaagaaagagcaaagggaacccag

SEQ ID NO: 51785 - DNA, 25 bp, Homo sapien
acccagcagttctgagtgagttctg

SEQ ID NO: 51786 - DNA, 25 bp, Homo sapien
agttctgagtgagttctgagccagc

SEQ ID NO: 51787 - DNA, 25 bp, Homo sapien
ggctggctgttgagacatgctacaa

SEQ ID NO: 51788 - DNA, 25 bp, Homo sapien
ggctgttgagacatgctacaatttt

SEQ ID NO: 51789 - DNA, 25 bp, Homo sapien
tgagacatgctacaattttcatttt

SEQ ID NO: 51790 - DNA, 25 bp, Homo sapien
atcagagtattccagaggagcttgt

SEQ ID NO: 51791 - DNA, 25 bp, Homo sapien
tattccagaggagcttgtatcaatg

SEQ ID NO: 51792 - DNA, 25 bp, Homo sapien
gaggagcttgtatcaatggctgaga

SEQ ID NO: 51793 - DNA, 25 bp, Homo sapien
atggctgagaggtttgaggcacatc

SEQ ID NO: 51794 - DNA, 25 bp, Homo sapien
gaggtttgaggcacatcaacggaaa

SEQ ID NO: 51795 - DNA, 25 bp, Homo sapien
gaggcacatcaacggaaaagggaaa

SEQ ID NO: 51796 - DNA, 25 bp, Homo sapien
cattaatgtcttctgtactagtggg

SEQ ID NO: 51797 - DNA, 25 bp, Homo sapien
gaagtattggacatgttggcagtat

SEQ ID NO: 51798 - DNA, 25 bp, Homo sapien
gttggcagtatgaagagaccggact

SEQ ID NO: 51799 - DNA, 25 bp, Homo sapien
gagaccggactgatttgactgattc

SEQ ID NO: 51800 - DNA, 25 bp, Homo sapien
cggactgatttgactgattcttaaa

SEQ ID NO: 51801 - DNA, 25 bp, Homo sapien
ctcaatggcttcaggctaagaagag

SEQ ID NO: 51802 - DNA, 25 bp, Homo sapien
ttcaggctaagaagagatttctccc

SEQ ID NO: 51803 - DNA, 25 bp, Homo sapien
gatttctccctgttataagcagcaa

SEQ ID NO: 51804 - DNA, 25 bp, Homo sapien
taagcagcaagacaaattagccatt

SEQ ID NO: 51805 - DNA, 25 bp, Homo sapien
attagccatttcactctcaaacttc

SEQ ID NO: 51806 - DNA, 25 bp, Homo sapien
ctcaaacttcactaatgatcacatt

SEQ ID NO: 51807 - DNA, 25 bp, Homo sapien
aactctagaagaccaaatgccccga

SEQ ID NO: 51808 - DNA, 25 bp, Homo sapien
tagaagaccaaatgccccgagttaa

SEQ ID NO: 51809 - DNA, 25 bp, Homo sapien
aatgccccgagttaagaacatcaaa

SEQ ID NO: 51810 - DNA, 25 bp, Homo sapien
taaccatctgaagaaacttcccaag

SEQ ID NO: 51811 - DNA, 25 bp, Homo sapien
ctgaagaaacttcccaagtgtaaga

SEQ ID NO: 51812 - DNA, 25 bp, Homo sapien
tcctgtaactgcttttgcttttaaa

SEQ ID NO: 51813 - DNA, 25 bp, Homo sapien
tcatttggtcatccttgcaatccat

SEQ ID NO: 51814 - DNA, 25 bp, Homo sapien
atttggtcatccttgcaatccattg

SEQ ID NO: 51815 - DNA, 25 bp, Homo sapien
ttggtcatccttgcaatccattggg

SEQ ID NO: 51816 - DNA, 25 bp, Homo sapien
atccttgcaatccattggggtctag

SEQ ID NO: 51817 - DNA, 25 bp, Homo sapien
cccaagatcctcagcagggattaag

SEQ ID NO: 51818 - DNA, 25 bp, Homo sapien
agatcctcagcagggattaagaagg

SEQ ID NO: 51819 - DNA, 25 bp, Homo sapien
aggaacccggtgtgcacagcagatc

SEQ ID NO: 51820 - DNA, 25 bp, Homo sapien
gtgtgcacagcagatccccgaaatt

SEQ ID NO: 51821 - DNA, 25 bp, Homo sapien
ccacttgctgttcaggaccactaaa

SEQ ID NO: 51822 - DNA, 25 bp, Homo sapien
acttgctgttcaggaccactaaatg

SEQ ID NO: 51823 - DNA, 25 bp, Homo sapien
ccatctccattgcattcatgtacta

SEQ ID NO: 51824 - DNA, 25 bp, Homo sapien
attgcattcatgtactaccctcagt

SEQ ID NO: 51825 - DNA, 25 bp, Homo sapien
tcagtctacactcacaatcatcttc

SEQ ID NO: 51826 - DNA, 25 bp, Homo sapien
caagactgctcccttttgttttgtg

SEQ ID NO: 51827 - DNA, 25 bp, Homo sapien
gagctgcttccagtggatagttgat

SEQ ID NO: 51828 - DNA, 25 bp, Homo sapien
gatagttgatgagaatcctgaccaa

SEQ ID NO: 51829 - DNA, 25 bp, Homo sapien
tcctgaccaaaggaaggcacccttg

SEQ ID NO: 51830 - DNA, 25 bp, Homo sapien
aggaaggcacccttgactgttggga

SEQ ID NO: 51831 - DNA, 25 bp, Homo sapien
gtgggaggtggtgtccctttcacac

SEQ ID NO: 51832 - DNA, 25 bp, Homo sapien
gtgtccctttcacactgtggtgtct

SEQ ID NO: 51833 - DNA, 25 bp, Homo sapien
aggatctccccgaatctcaataaac

SEQ ID NO: 51834 - DNA, 25 bp, Homo sapien
cctgctacaaattggttgaatgttt

SEQ ID NO: 51835 - DNA, 25 bp, Homo sapien
tgaatgtttctgtctgtggtgcgaa

SEQ ID NO: 51836 - DNA, 25 bp, Homo sapien
gaatgtttctgtctgtggtgcgaac

SEQ ID NO: 51837 - DNA, 25 bp, Homo sapien
aatgtttctgtctgtggtgcgaacc

SEQ ID NO: 51838 - DNA, 25 bp, Homo sapien
atgtttctgtctgtggtgcgaacca

SEQ ID NO: 51839 - DNA, 25 bp, Homo sapien
tgtttctgtctgtggtgcgaaccag

SEQ ID NO: 51840 - DNA, 25 bp, Homo sapien
tttctgtctgtggtgcgaaccagca

SEQ ID NO: 51841 - DNA, 25 bp, Homo sapien
tctgtctgtggtgcgaaccagcatt

SEQ ID NO: 51842 - DNA, 25 bp, Homo sapien
gtctgtggtgcgaaccagcattaac

SEQ ID NO: 51843 - DNA, 25 bp, Homo sapien
gtggtgcgaaccagcattaacggat

SEQ ID NO: 51844 - DNA, 25 bp, Homo sapien
gtgcgaaccagcattaacggatggg

SEQ ID NO: 51845 - DNA, 25 bp, Homo sapien
tcaaaccttgcctccgaggctgggc

SEQ ID NO: 51846 - DNA, 25 bp, Homo sapien
gactcttccagcacccatggatgtg

SEQ ID NO: 51847 - DNA, 25 bp, Homo sapien
gggttggtttgcatgtcatttgcat

SEQ ID NO: 51848 - DNA, 25 bp, Homo sapien
atttgcatatcgtttgcatgccctc

SEQ ID NO: 51849 - DNA, 25 bp, Homo sapien
atatcgtttgcatgccctcatccca

SEQ ID NO: 51850 - DNA, 25 bp, Homo sapien
atcccacccattctcagggcagtat

SEQ ID NO: 51851 - DNA, 25 bp, Homo sapien
ctcagggcagtatgggaagccccaa

SEQ ID NO: 51852 - DNA, 25 bp, Homo sapien
tagcaataatttgggtccagggtca

SEQ ID NO: 51853 - DNA, 25 bp, Homo sapien
tgggtccagggtcacctattgcccc

SEQ ID NO: 51854 - DNA, 25 bp, Homo sapien
tgggaccccagcacagaggcaataa

SEQ ID NO: 51855 - DNA, 25 bp, Homo sapien
ggcaataaaggcagtggtcccttcc

SEQ ID NO: 51856 - DNA, 25 bp, Homo sapien
ttgccaccctttcaggaaccctgta

SEQ ID NO: 51857 - DNA, 25 bp, Homo sapien
tcaggaaccctgtatggtttttagt

SEQ ID NO: 51858 - DNA, 25 bp, Homo sapien
acatgctcttcatggtgcatcccga

SEQ ID NO: 51859 - DNA, 25 bp, Homo sapien
tgctcttcatggtgcatcccgagta

SEQ ID NO: 51860 - DNA, 25 bp, Homo sapien
ttcatggtgcatcccgagtaccggc

SEQ ID NO: 51861 - DNA, 25 bp, Homo sapien
gcatcccgagtaccggcccaagaga

SEQ ID NO: 51862 - DNA, 25 bp, Homo sapien
tgccaaccagtttgtgcccaggctc

SEQ ID NO: 51863 - DNA, 25 bp, Homo sapien
tccaagccgccagcaacttcaagag

SEQ ID NO: 51864 - DNA, 25 bp, Homo sapien
acttcaagagcccagtcaagacgat

SEQ ID NO: 51865 - DNA, 25 bp, Homo sapien
gagcccagtcaagacgattcgctga

SEQ ID NO: 51866 - DNA, 25 bp, Homo sapien
gtcaagacgattcgctgattccctc

SEQ ID NO: 51867 - DNA, 25 bp, Homo sapien
gagcatccggcatgagggctgagat

SEQ ID NO: 51868 - DNA, 25 bp, Homo sapien
gctgagatgcgcaaagagtgtgctc

SEQ ID NO: 51869 - DNA, 25 bp, Homo sapien
gttccctacgaggagtgttcccaat

SEQ ID NO: 51870 - DNA, 25 bp, Homo sapien
agtgttcccaatgctttgtccatga

SEQ ID NO: 51871 - DNA, 25 bp, Homo sapien
aatgctttgtccatgatgtccttgt

SEQ ID NO: 51872 - DNA, 25 bp, Homo sapien
tgatgtccttgttattttattgcct

SEQ ID NO: 51873 - DNA, 25 bp, Homo sapien
gtccttgttattttattgcctttag

SEQ ID NO: 51874 - DNA, 25 bp, Homo sapien
ttagaaactgagtcctgttcttgtt

SEQ ID NO: 51875 - DNA, 25 bp, Homo sapien
tcctgttcttgttacggcagtcaca

SEQ ID NO: 51876 - DNA, 25 bp, Homo sapien
gttacggcagtcacactgctgggaa

SEQ ID NO: 51877 - DNA, 25 bp, Homo sapien
tcacactgctgggaagtggcttaat

SEQ ID NO: 51878 - DNA, 25 bp, Homo sapien
tccaaccaggagtgtaacatcaagc

SEQ ID NO: 51879 - DNA, 25 bp, Homo sapien
gagtgtaacatcaagcaccgaggac

SEQ ID NO: 51880 - DNA, 25 bp, Homo sapien
tgtgcactgagggactgttggcccc

SEQ ID NO: 51881 - DNA, 25 bp, Homo sapien
cactgagggactgttggcccctgtg

SEQ ID NO: 51882 - DNA, 25 bp, Homo sapien
gaaggaattataatccccaaccgag

SEQ ID NO: 51883 - DNA, 25 bp, Homo sapien
taatccccaaccgagtatgcgcaag

SEQ ID NO: 51884 - DNA, 25 bp, Homo sapien
gtatgcgcaaggtcccgctggccag

SEQ ID NO: 51885 - DNA, 25 bp, Homo sapien
tctctgtgtttgtggactggattca

SEQ ID NO: 51886 - DNA, 25 bp, Homo sapien
gattcacaaggtcatgagactgggt

SEQ ID NO: 51887 - DNA, 25 bp, Homo sapien
gagactgggttaggcccagccttga

SEQ ID NO: 51888 - DNA, 25 bp, Homo sapien
cagccttgatgccatatgccttggg

SEQ ID NO: 51889 - DNA, 25 bp, Homo sapien
tgtatgatgatgaaagcctgtgtct

SEQ ID NO: 51890 - DNA, 25 bp, Homo sapien
cctgtgtctttgagggattctaccc

SEQ ID NO: 51891 - DNA, 25 bp, Homo sapien
gggattctaccctgaacatacctca

SEQ ID NO: 51892 - DNA, 25 bp, Homo sapien
tctaccctgaacatacctcacagat

SEQ ID NO: 51893 - DNA, 25 bp, Homo sapien
agatcctccctgtcatgccacattt

SEQ ID NO: 51894 - DNA, 25 bp, Homo sapien
gtcatgccacatttcactgattgga

SEQ ID NO: 51895 - DNA, 25 bp, Homo sapien
gatgtgcattttcacctgaggtttc

SEQ ID NO: 51896 - DNA, 25 bp, Homo sapien
attttcacctgaggtttccctgcat

SEQ ID NO: 51897 - DNA, 25 bp, Homo sapien
gggctgacagcacagtaacgtgcat

SEQ ID NO: 51898 - DNA, 25 bp, Homo sapien
taacgtgcatacatatctgcagggc

SEQ ID NO: 51899 - DNA, 25 bp, Homo sapien
gaagctttaaaggtggtagtgattt

SEQ ID NO: 51900 - DNA, 25 bp, Homo sapien
ctccaaccaggagtgtaacatcaag

SEQ ID NO: 51901 - DNA, 25 bp, Homo sapien
tccaaccaggagtgtaacatcaagc

SEQ ID NO: 51902 - DNA, 25 bp, Homo sapien
ccaaccaggagtgtaacatcaagca

SEQ ID NO: 51903 - DNA, 25 bp, Homo sapien
aaccaggagtgtaacatcaagcacc

SEQ ID NO: 51904 - DNA, 25 bp, Homo sapien
ccaggagtgtaacatcaagcaccga

SEQ ID NO: 51905 - DNA, 25 bp, Homo sapien
aggagtgtaacatcaagcaccgagg

SEQ ID NO: 51906 - DNA, 25 bp, Homo sapien
ggagtgtaacatcaagcaccgagga

SEQ ID NO: 51907 - DNA, 25 bp, Homo sapien
gagtgtaacatcaagcaccgaggac

SEQ ID NO: 51908 - DNA, 25 bp, Homo sapien
tgtgcactgagggactgttggcccc

SEQ ID NO: 51909 - DNA, 25 bp, Homo sapien
gtgcactgagggactgttggcccct

SEQ ID NO: 51910 - DNA, 25 bp, Homo sapien
gcactgagggactgttggcccctgt

SEQ ID NO: 51911 - DNA, 25 bp, Homo sapien
gattgcataacgcattatgaaggca

SEQ ID NO: 51912 - DNA, 25 bp, Homo sapien
tatgaaggcagcacatgccccaaat

SEQ ID NO: 51913 - DNA, 25 bp, Homo sapien
gaaggcagcacatgccccaaatgga

SEQ ID NO: 51914 - DNA, 25 bp, Homo sapien
ggcagcacatgccccaaatggaagg

SEQ ID NO: 51915 - DNA, 25 bp, Homo sapien
aaatggaaggcaccgaagagccctg

SEQ ID NO: 51916 - DNA, 25 bp, Homo sapien
ctggtacgcggctgggatcctaagc

SEQ ID NO: 51917 - DNA, 25 bp, Homo sapien
tggtacgcggctgggatcctaagct

SEQ ID NO: 51918 - DNA, 25 bp, Homo sapien
gtacgcggctgggatcctaagcttt

SEQ ID NO: 51919 - DNA, 25 bp, Homo sapien
tacgcggctgggatcctaagctttg

SEQ ID NO: 51920 - DNA, 25 bp, Homo sapien
acgcggctgggatcctaagctttga

SEQ ID NO: 51921 - DNA, 25 bp, Homo sapien
cgcggctgggatcctaagctttgat

SEQ ID NO: 51922 - DNA, 25 bp, Homo sapien
cttcgaaggcttaatgatgtcacca

SEQ ID NO: 51923 - DNA, 25 bp, Homo sapien
ttcgaaggcttaatgatgtcaccat

SEQ ID NO: 51924 - DNA, 25 bp, Homo sapien
tcgaaggcttaatgatgtcaccatt

SEQ ID NO: 51925 - DNA, 25 bp, Homo sapien
cgaaggcttaatgatgtcaccattt

SEQ ID NO: 51926 - DNA, 25 bp, Homo sapien
gaaggcttaatgatgtcaccatttc

SEQ ID NO: 51927 - DNA, 25 bp, Homo sapien
tttctacctgccacgtctcggcgaa

SEQ ID NO: 51928 - DNA, 25 bp, Homo sapien
tacctgccacgtctcggcgaaggtt

SEQ ID NO: 51929 - DNA, 25 bp, Homo sapien
ccacgtctcggcgaaggttgggact

SEQ ID NO: 51930 - DNA, 25 bp, Homo sapien
atattaagaagaaacatgctgcttc

SEQ ID NO: 51931 - DNA, 25 bp, Homo sapien
taagaagaaacatgctgcttcccct

SEQ ID NO: 51932 - DNA, 25 bp, Homo sapien
aagaaacatgctgcttccccttcgc

SEQ ID NO: 51933 - DNA, 25 bp, Homo sapien
ttccctgccgtcaaggtggcgtctt

SEQ ID NO: 51934 - DNA, 25 bp, Homo sapien
caaggtggcgtcttactcgggattc

SEQ ID NO: 51935 - DNA, 25 bp, Homo sapien
cgtcttactcgggattcctgctgtt

SEQ ID NO: 51936 - DNA, 25 bp, Homo sapien
tgttgtggccttgggtaaaggcctc

SEQ ID NO: 51937 - DNA, 25 bp, Homo sapien
aggcctcccctgagaacacaggaca

SEQ ID NO: 51938 - DNA, 25 bp, Homo sapien
cctgagaacacaggacaggcctgct

SEQ ID NO: 51939 - DNA, 25 bp, Homo sapien
accttactgttcacctcatcaaatc

SEQ ID NO: 51940 - DNA, 25 bp, Homo sapien
gttcacctcatcaaatcagttctgc

SEQ ID NO: 51941 - DNA, 25 bp, Homo sapien
acctcatcaaatcagttctgccctg

SEQ ID NO: 51942 - DNA, 25 bp, Homo sapien
ttctgccctgtgaaaagatccagcc

SEQ ID NO: 51943 - DNA, 25 bp, Homo sapien
tgtgaaaagatccagccttccctgc

SEQ ID NO: 51944 - DNA, 25 bp, Homo sapien
aagtccatattgttccttatcacct

SEQ ID NO: 51945 - DNA, 25 bp, Homo sapien
agtgagcccatggtgacctcgggaa

SEQ ID NO: 51946 - DNA, 25 bp, Homo sapien
atggcaattttttgggcggcccctg

SEQ ID NO: 51947 - DNA, 25 bp, Homo sapien
cggcccctggacgaaggtctgaatc

SEQ ID NO: 51948 - DNA, 25 bp, Homo sapien
gaaggtctgaatcccgactctgata

SEQ ID NO: 51949 - DNA, 25 bp, Homo sapien
actctgataccttctggctgtgcta

SEQ ID NO: 51950 - DNA, 25 bp, Homo sapien
ggctgtgctacctgagccaagtcgc

SEQ ID NO: 51951 - DNA, 25 bp, Homo sapien
gggctagagtttccttatccagaca

SEQ ID NO: 51952 - DNA, 25 bp, Homo sapien
gaaattggcgatgtcacccgtgtac

SEQ ID NO: 51953 - DNA, 25 bp, Homo sapien
tgtacggtacgcagcccagagcaga

SEQ ID NO: 51954 - DNA, 25 bp, Homo sapien
gcagaccctcaataaacgtcagctt

SEQ ID NO: 51955 - DNA, 25 bp, Homo sapien
ataattcataccaaacagaagccct

SEQ ID NO: 51956 - DNA, 25 bp, Homo sapien
aattcataccaaacagaagccctac

SEQ ID NO: 51957 - DNA, 25 bp, Homo sapien
tcataccaaacagaagccctacaag

SEQ ID NO: 51958 - DNA, 25 bp, Homo sapien
cataccaaacagaagccctacaagt

SEQ ID NO: 51959 - DNA, 25 bp, Homo sapien
cctataaacctataacaagttctca

SEQ ID NO: 51960 - DNA, 25 bp, Homo sapien
aacctataacaagttctcaattcct

SEQ ID NO: 51961 - DNA, 25 bp, Homo sapien
acctataacaagttctcaattcctt

SEQ ID NO: 51962 - DNA, 25 bp, Homo sapien
ctataacaagttctcaattcctttt

SEQ ID NO: 51963 - DNA, 25 bp, Homo sapien
agccctcgactcttagtaaatttga

SEQ ID NO: 51964 - DNA, 25 bp, Homo sapien
tatggaacacaaaccctacaaatat

SEQ ID NO: 51965 - DNA, 25 bp, Homo sapien
attacacataattcataccaaacag

SEQ ID NO: 51966 - DNA, 25 bp, Homo sapien
aattgttttactgagccttctgact

SEQ ID NO: 51967 - DNA, 25 bp, Homo sapien
tactgagccttctgactatgccttg

SEQ ID NO: 51968 - DNA, 25 bp, Homo sapien
gactatgccttgttctcttttgaga

SEQ ID NO: 51969 - DNA, 25 bp, Homo sapien
acttaacaaatcttagcaatctctc

SEQ ID NO: 51970 - DNA, 25 bp, Homo sapien
tagcaatctctcaatgccttttcac

SEQ ID NO: 51971 - DNA, 25 bp, Homo sapien
atctctcaatgccttttcacttatt

SEQ ID NO: 51972 - DNA, 25 bp, Homo sapien
agttatgattctttttcctcacagt

SEQ ID NO: 51973 - DNA, 25 bp, Homo sapien
tatgattctttttcctcacagtctt

SEQ ID NO: 51974 - DNA, 25 bp, Homo sapien
tcttttttgttccatagcaatgagg

SEQ ID NO: 51975 - DNA, 25 bp, Homo sapien
gttccatagcaatgaggttgtccat

SEQ ID NO: 51976 - DNA, 25 bp, Homo sapien
gcaatgaggttgtccatttgataat

SEQ ID NO: 51977 - DNA, 25 bp, Homo sapien
agcatgaagtcaccacacggaggaa

SEQ ID NO: 51978 - DNA, 25 bp, Homo sapien
agtcaccacacggaggaaaatgtaa

SEQ ID NO: 51979 - DNA, 25 bp, Homo sapien
aatgtgtaaacctcaagtttgccat

SEQ ID NO: 51980 - DNA, 25 bp, Homo sapien
gaatgggtgtgctaagttacttggc

SEQ ID NO: 51981 - DNA, 25 bp, Homo sapien
tgtgctaagttacttggcagctgaa

SEQ ID NO: 51982 - DNA, 25 bp, Homo sapien
ggcagctgaattaaaccttactcta

SEQ ID NO: 51983 - DNA, 25 bp, Homo sapien
ttactctagagtagtgctgtccact

SEQ ID NO: 51984 - DNA, 25 bp, Homo sapien
agtgctgtccactagtaatataatg

SEQ ID NO: 51985 - DNA, 25 bp, Homo sapien
gtaatataatgagaaccccatatgt

SEQ ID NO: 51986 - DNA, 25 bp, Homo sapien
tgagaaccccatatgttaaaaactt

SEQ ID NO: 51987 - DNA, 25 bp, Homo sapien
gtttaacccggtgtatattatctat

SEQ ID NO: 51988 - DNA, 25 bp, Homo sapien
aagattccccccagtgagatgttct

SEQ ID NO: 51989 - DNA, 25 bp, Homo sapien
tcagaaaccgacaaatactccaagt

SEQ ID NO: 51990 - DNA, 25 bp, Homo sapien
cacatgacatggagggcaaagagct

SEQ ID NO: 51991 - DNA, 25 bp, Homo sapien
aagagctcagcaaagggcaagccaa

SEQ ID NO: 51992 - DNA, 25 bp, Homo sapien
aagaagctcttcgaggctcaggaga

SEQ ID NO: 51993 - DNA, 25 bp, Homo sapien
tcttcgaggctcaggagaagctcta

SEQ ID NO: 51994 - DNA, 25 bp, Homo sapien
gaagctctacaaggaatatctgcag

SEQ ID NO: 51995 - DNA, 25 bp, Homo sapien
ggaatatctgcagatggcccagaat

SEQ ID NO: 51996 - DNA, 25 bp, Homo sapien
gatggcccagaatggaagcttccag

SEQ ID NO: 51997 - DNA, 25 bp, Homo sapien
ggcacaggactgactttttaaacca

SEQ ID NO: 51998 - DNA, 25 bp, Homo sapien
ctgactttttaaaccattgtggact

SEQ ID NO: 51999 - DNA, 25 bp, Homo sapien
gaaatgattcaaagggagtgccaga

SEQ ID NO: 52000 - DNA, 25 bp, Homo sapien
cagaacaatgggaaacagctgcgcc

SEQ ID NO: 52001 - DNA, 25 bp, Homo sapien
gaaacagctgcgcccctcaggaaaa

SEQ ID NO: 52002 - DNA, 25 bp, Homo sapien
gctgcgcccctcaggaaaactaaat

SEQ ID NO: 52003 - DNA, 25 bp, Homo sapien
ggaaaactaaatacctctgagaagg

SEQ ID NO: 52004 - DNA, 25 bp, Homo sapien
gaaaactaaatacctctgagaaggt

SEQ ID NO: 52005 - DNA, 25 bp, Homo sapien
ctaaatacctctgagaaggttaaca

SEQ ID NO: 52006 - DNA, 25 bp, Homo sapien
aaatacctctgagaaggttaacaag

SEQ ID NO: 52007 - DNA, 25 bp, Homo sapien
atacctctgagaaggttaacaagac

SEQ ID NO: 52008 - DNA, 25 bp, Homo sapien
acctctgagaaggttaacaagacat

SEQ ID NO: 52009 - DNA, 25 bp, Homo sapien
tctgagaaggttaacaagacatctg

SEQ ID NO: 52010 - DNA, 25 bp, Homo sapien
tctttggagtgagaagtgccctctt

SEQ ID NO: 52011 - DNA, 25 bp, Homo sapien
gccctcttcgttgccatgaacagta

SEQ ID NO: 52012 - DNA, 25 bp, Homo sapien
aggaagattgtacgcaacgcccagc

SEQ ID NO: 52013 - DNA, 25 bp, Homo sapien
gcaacgcccagcttccaagaagaat

SEQ ID NO: 52014 - DNA, 25 bp, Homo sapien
tcctgcccaacaattacaatgccta

SEQ ID NO: 52015 - DNA, 25 bp, Homo sapien
attacaatgcctacgagtcagactt

SEQ ID NO: 52016 - DNA, 25 bp, Homo sapien
gagtcagacttgtaccaagggacct

SEQ ID NO: 52017 - DNA, 25 bp, Homo sapien
aagggacctacattgccctgagcaa

SEQ ID NO: 52018 - DNA, 25 bp, Homo sapien
ttgccctgagcaaatacggacgggt

SEQ ID NO: 52019 - DNA, 25 bp, Homo sapien
aaggtgtccccgatcatgactgtca

SEQ ID NO: 52020 - DNA, 25 bp, Homo sapien
ttcccaggatctaaggacccacaaa

SEQ ID NO: 52021 - DNA, 25 bp, Homo sapien
gcctacatgcacatccgggcatagt

SEQ ID NO: 52022 - DNA, 25 bp, Homo sapien
ctacatgcacatccgggcatagtac

SEQ ID NO: 52023 - DNA, 25 bp, Homo sapien
catgcacatccgggcatagtacctt

SEQ ID NO: 52024 - DNA, 25 bp, Homo sapien
actcaaaggccggtgccagtgcagg

SEQ ID NO: 52025 - DNA, 25 bp, Homo sapien
tcaaaggccggtgccagtgcaggtc

SEQ ID NO: 52026 - DNA, 25 bp, Homo sapien
aggtccttggtgtgtcgaatactgg

SEQ ID NO: 52027 - DNA, 25 bp, Homo sapien
gtccttggtgtgtcgaatactggtc

SEQ ID NO: 52028 - DNA, 25 bp, Homo sapien
cttggtgtgtcgaatactggtcccc

SEQ ID NO: 52029 - DNA, 25 bp, Homo sapien
tggtgtgtcgaatactggtcccctg

SEQ ID NO: 52030 - DNA, 25 bp, Homo sapien
gtgtgtcgaatactggtcccctgga

SEQ ID NO: 52031 - DNA, 25 bp, Homo sapien
gtgtcgaatactggtcccctggacc

SEQ ID NO: 52032 - DNA, 25 bp, Homo sapien
agccaccctctgcttgggcttctga

SEQ ID NO: 52033 - DNA, 25 bp, Homo sapien
cttgggcttctgagctggtggccct

SEQ ID NO: 52034 - DNA, 25 bp, Homo sapien
agaggtctggcggaggcccaggcag

SEQ ID NO: 52035 - DNA, 25 bp, Homo sapien
gggagaggcgggagcctgccaccct

SEQ ID NO: 52036 - DNA, 25 bp, Homo sapien
actaacacttcctgccccatttgga

SEQ ID NO: 52037 - DNA, 25 bp, Homo sapien
tgccccatttggacccgtaccatgg

SEQ ID NO: 52038 - DNA, 25 bp, Homo sapien
gagggagctagcagctggcctccat

SEQ ID NO: 52039 - DNA, 25 bp, Homo sapien
ctccttcgaggctgtgctgggtgca

SEQ ID NO: 52040 - DNA, 25 bp, Homo sapien
gctgggtgcagaaccgccagagcca

SEQ ID NO: 52041 - DNA, 25 bp, Homo sapien
aaccgccagagccacccaaaaggtg

SEQ ID NO: 52042 - DNA, 25 bp, Homo sapien
gagccacccaaaaggtgtttctctt

SEQ ID NO: 52043 - DNA, 25 bp, Homo sapien
tgaagcgaaccattaataaagcctg

SEQ ID NO: 52044 - DNA, 25 bp, Homo sapien
accattaataaagcctgggtggaat

SEQ ID NO: 52045 - DNA, 25 bp, Homo sapien
aagcctgggtggaatcaagagagaa

SEQ ID NO: 52046 - DNA, 25 bp, Homo sapien
aagagagaagcaagccaaaggagac

SEQ ID NO: 52047 - DNA, 25 bp, Homo sapien
agtcgttttgggaactgtgatgtga

SEQ ID NO: 52048 - DNA, 25 bp, Homo sapien
aactgtgatgtgatgtggaaatact

SEQ ID NO: 52049 - DNA, 25 bp, Homo sapien
aatactgatgtttccagtaagggaa

SEQ ID NO: 52050 - DNA, 25 bp, Homo sapien
gtaagggaatattggtgagctgcat

SEQ ID NO: 52051 - DNA, 25 bp, Homo sapien
attggtgagctgcatatataaattt

SEQ ID NO: 52052 - DNA, 25 bp, Homo sapien
gacagatagctatttacatagcctt

SEQ ID NO: 52053 - DNA, 25 bp, Homo sapien
tccatttcctactggaggatttatt

SEQ ID NO: 52054 - DNA, 25 bp, Homo sapien
ccccaagcggaatgaggccaagact

SEQ ID NO: 52055 - DNA, 25 bp, Homo sapien
atgaggccaagactggcgctgacac

SEQ ID NO: 52056 - DNA, 25 bp, Homo sapien
atggaccctagctcatactcagacg

SEQ ID NO: 52057 - DNA, 25 bp, Homo sapien
cggtaagtgacaacccctcttgact

SEQ ID NO: 52058 - DNA, 25 bp, Homo sapien
agtgacaacccctcttgactcagta

SEQ ID NO: 52059 - DNA, 25 bp, Homo sapien
aacccctcttgactcagtacgtgga

SEQ ID NO: 52060 - DNA, 25 bp, Homo sapien
tcttgactcagtacgtggacaccat

SEQ ID NO: 52061 - DNA, 25 bp, Homo sapien
ctccattcctcattgggaccaggtg

SEQ ID NO: 52062 - DNA, 25 bp, Homo sapien
attcctcattgggaccaggtgggct

SEQ ID NO: 52063 - DNA, 25 bp, Homo sapien
gaccaggtgggctgtgtccgccaca

SEQ ID NO: 52064 - DNA, 25 bp, Homo sapien
aggtgggctgtgtccgccacatcac

SEQ ID NO: 52065 - DNA, 25 bp, Homo sapien
tcgcctgctccgcaaaggcaactat

SEQ ID NO: 52066 - DNA, 25 bp, Homo sapien
caactatgcggagcgggtcggtgct

SEQ ID NO: 52067 - DNA, 25 bp, Homo sapien
atgcggagcgggtcggtgctggagc

SEQ ID NO: 52068 - DNA, 25 bp, Homo sapien
gtcggtgctggagcgccggtgtacc

SEQ ID NO: 52069 - DNA, 25 bp, Homo sapien
aagtcaccatcgcacagggtggcgt

SEQ ID NO: 52070 - DNA, 25 bp, Homo sapien
ggccgtgctgctgccaaagaaaact

SEQ ID NO: 52071 - DNA, 25 bp, Homo sapien
ccgtgctgctgccaaagaaaactga

SEQ ID NO: 52072 - DNA, 25 bp, Homo sapien
gtgctgctgccaaagaaaactgaga

SEQ ID NO: 52073 - DNA, 25 bp, Homo sapien
tgctgctgccaaagaaaactgagag

SEQ ID NO: 52074 - DNA, 25 bp, Homo sapien
gccaaagaaaactgagagccaccac

SEQ ID NO: 52075 - DNA, 25 bp, Homo sapien
tgagagccaccacaagactaagtaa

SEQ ID NO: 52076 - DNA, 25 bp, Homo sapien
gagggcctcgagactgacagtcgac

SEQ ID NO: 52077 - DNA, 25 bp, Homo sapien
agggcctcgagactgacagtcgaca

SEQ ID NO: 52078 - DNA, 25 bp, Homo sapien
agctggcccggaagaagcgcgagga

SEQ ID NO: 52079 - DNA, 25 bp, Homo sapien
ggccaagggccccatgaagctggga

SEQ ID NO: 52080 - DNA, 25 bp, Homo sapien
gagcccggaagctggactgaaccgt

SEQ ID NO: 52081 - DNA, 25 bp, Homo sapien
cccggaagctggactgaaccgtggc

SEQ ID NO: 52082 - DNA, 25 bp, Homo sapien
gaagctggactgaaccgtggcggtg

SEQ ID NO: 52083 - DNA, 25 bp, Homo sapien
gactgaaccgtggcggtggcccttc

SEQ ID NO: 52084 - DNA, 25 bp, Homo sapien
tattgtacaaaccatgtgagcccgg

SEQ ID NO: 52085 - DNA, 25 bp, Homo sapien
ttgtacaaaccatgtgagcccggcc

SEQ ID NO: 52086 - DNA, 25 bp, Homo sapien
gtacaaaccatgtgagcccggccgg

SEQ ID NO: 52087 - DNA, 25 bp, Homo sapien
ggacttgacttgtgtgtgtttctga

SEQ ID NO: 52088 - DNA, 25 bp, Homo sapien
gtttctgaagtgttcgagggtacca

SEQ ID NO: 52089 - DNA, 25 bp, Homo sapien
gctggcgatgactgaactgctgatg

SEQ ID NO: 52090 - DNA, 25 bp, Homo sapien
acaaatgctctgtgctctctagtga

SEQ ID NO: 52091 - DNA, 25 bp, Homo sapien
tagtgagccctgaatttgcttcctc

SEQ ID NO: 52092 - DNA, 25 bp, Homo sapien
atttgcttcctctgacaagttacct

SEQ ID NO: 52093 - DNA, 25 bp, Homo sapien
cacctaatttttgcttctcaggaat

SEQ ID NO: 52094 - DNA, 25 bp, Homo sapien
gaatgagaatctttggccactggag

SEQ ID NO: 52095 - DNA, 25 bp, Homo sapien
actggagagcccttgctcagttttc

SEQ ID NO: 52096 - DNA, 25 bp, Homo sapien
gtggagatactgtaacctgagggca

SEQ ID NO: 52097 - DNA, 25 bp, Homo sapien
ggcagaaagcccaatgtgtcattgt

SEQ ID NO: 52098 - DNA, 25 bp, Homo sapien
ctttcataggtgtccatcttggaac

SEQ ID NO: 52099 - DNA, 25 bp, Homo sapien
taggtgtccatcttggaacatactt

SEQ ID NO: 52100 - DNA, 25 bp, Homo sapien
gtccatcttggaacatactttttgc

SEQ ID NO: 52101 - DNA, 25 bp, Homo sapien
ggaacatactttttgcagaggtctg

SEQ ID NO: 52102 - DNA, 25 bp, Homo sapien
aacatactttttgcagaggtctgca

SEQ ID NO: 52103 - DNA, 25 bp, Homo sapien
gcagaggtctgcaaagcagtctgta

SEQ ID NO: 52104 - DNA, 25 bp, Homo sapien
gtctgcaaagcagtctgtaaaattt

SEQ ID NO: 52105 - DNA, 25 bp, Homo sapien
gtaaaatttcagtctcaaagcaaac

SEQ ID NO: 52106 - DNA, 25 bp, Homo sapien
cattctatgctgattagcttcataa

SEQ ID NO: 52107 - DNA, 25 bp, Homo sapien
gattagcttcataaacattgaactt

SEQ ID NO: 52108 - DNA, 25 bp, Homo sapien
tttgattttatagccacaatgctgc

SEQ ID NO: 52109 - DNA, 25 bp, Homo sapien
agcagaccactgataaaaccatgta

SEQ ID NO: 52110 - DNA, 25 bp, Homo sapien
gaccactgataaaaccatgtagaaa

SEQ ID NO: 52111 - DNA, 25 bp, Homo sapien
aacctcgctggactctcagtctctg

SEQ ID NO: 52112 - DNA, 25 bp, Homo sapien
ggactctcagtctctgagcagtgaa

SEQ ID NO: 52113 - DNA, 25 bp, Homo sapien
ctcagtctctgagcagtgaatgatt

SEQ ID NO: 52114 - DNA, 25 bp, Homo sapien
gtctctgagcagtgaatgattcagt

SEQ ID NO: 52115 - DNA, 25 bp, Homo sapien
gtgttaaatgtgatgaatactgtat

SEQ ID NO: 52116 - DNA, 25 bp, Homo sapien
ttgtttcaattgcatctcccagata

SEQ ID NO: 52117 - DNA, 25 bp, Homo sapien
ataagaaacaactctttgagaaaca

SEQ ID NO: 52118 - DNA, 25 bp, Homo sapien
aacaacaatttctactttgaagtca

SEQ ID NO: 52119 - DNA, 25 bp, Homo sapien
ctactttgaagtcataccaatgaaa

SEQ ID NO: 52120 - DNA, 25 bp, Homo sapien
tccacttcaatgtccacctgtgaga

SEQ ID NO: 52121 - DNA, 25 bp, Homo sapien
ccacttcaatgtccacctgtgagaa

SEQ ID NO: 52122 - DNA, 25 bp, Homo sapien
cacttcaatgtccacctgtgagaaa

SEQ ID NO: 52123 - DNA, 25 bp, Homo sapien
ttcaatgtccacctgtgagaaagga

SEQ ID NO: 52124 - DNA, 25 bp, Homo sapien
tcaatgtccacctgtgagaaaggaa

SEQ ID NO: 52125 - DNA, 25 bp, Homo sapien
ttcagatgattcaaatatcaaaagg

SEQ ID NO: 52126 - DNA, 25 bp, Homo sapien
tcaaatatcaaaaggaagattcttc

SEQ ID NO: 52127 - DNA, 25 bp, Homo sapien
aaatatcaaaaggaagattcttcca

SEQ ID NO: 52128 - DNA, 25 bp, Homo sapien
aatatcaaaaggaagattcttccat

SEQ ID NO: 52129 - DNA, 25 bp, Homo sapien
atcaaaaggaagattcttccattaa

SEQ ID NO: 52130 - DNA, 25 bp, Homo sapien
caaaaggaagattcttccattaaat

SEQ ID NO: 52131 - DNA, 25 bp, Homo sapien
ccccaagcggaatgaggccaagact

SEQ ID NO: 52132 - DNA, 25 bp, Homo sapien
cccaagcggaatgaggccaagactg

SEQ ID NO: 52133 - DNA, 25 bp, Homo sapien
caagcggaatgaggccaagactggc

SEQ ID NO: 52134 - DNA, 25 bp, Homo sapien
gaatgaggccaagactggcgctgac

SEQ ID NO: 52135 - DNA, 25 bp, Homo sapien
aatgaggccaagactggcgctgaca

SEQ ID NO: 52136 - DNA, 25 bp, Homo sapien
atgaggccaagactggcgctgacac

SEQ ID NO: 52137 - DNA, 25 bp, Homo sapien
tgaggccaagactggcgctgacacc

SEQ ID NO: 52138 - DNA, 25 bp, Homo sapien
cctcttccagcagcggccgtatcca

SEQ ID NO: 52139 - DNA, 25 bp, Homo sapien
gcagcggccgtatccatccccaggg

SEQ ID NO: 52140 - DNA, 25 bp, Homo sapien
aggggctgtgctccgggccaatgca

SEQ ID NO: 52141 - DNA, 25 bp, Homo sapien
ggaccctagctcatactcagacgcc

SEQ ID NO: 52142 - DNA, 25 bp, Homo sapien
cacgtgtttggtattacattactgc

SEQ ID NO: 52143 - DNA, 25 bp, Homo sapien
attactgctatgcaccacttgaagg

SEQ ID NO: 52144 - DNA, 25 bp, Homo sapien
gaaggagctctatcaccagcctgaa

SEQ ID NO: 52145 - DNA, 25 bp, Homo sapien
tgaaacccgaagactgaggcatttt

SEQ ID NO: 52146 - DNA, 25 bp, Homo sapien
gcattttccaggtctacttgcctaa

SEQ ID NO: 52147 - DNA, 25 bp, Homo sapien
gtatggatgtcactcaactaagatc

SEQ ID NO: 52148 - DNA, 25 bp, Homo sapien
gggatggcattctttatacctaaac

SEQ ID NO: 52149 - DNA, 25 bp, Homo sapien
atacctaaacacctaagagctgaag

SEQ ID NO: 52150 - DNA, 25 bp, Homo sapien
aagtcaggtcttttaatcaggttag

SEQ ID NO: 52151 - DNA, 25 bp, Homo sapien
gaaattgtacttcagggtgatagcc

SEQ ID NO: 52152 - DNA, 25 bp, Homo sapien
ggtgatagcctgtgtcttcttaatt

SEQ ID NO: 52153 - DNA, 25 bp, Homo sapien
aggattctctgtacgcccagggaaa

SEQ ID NO: 52154 - DNA, 25 bp, Homo sapien
ggattctctgtacgcccagggaaag

SEQ ID NO: 52155 - DNA, 25 bp, Homo sapien
tctctgtacgcccagggaaagcggc

SEQ ID NO: 52156 - DNA, 25 bp, Homo sapien
gtacgcccagggaaagcggcgttat

SEQ ID NO: 52157 - DNA, 25 bp, Homo sapien
acgcccagggaaagcggcgttatga

SEQ ID NO: 52158 - DNA, 25 bp, Homo sapien
gtgggcaaactaagccgattttccg

SEQ ID NO: 52159 - DNA, 25 bp, Homo sapien
ttgtgctaaggcttgagtgcgttga

SEQ ID NO: 52160 - DNA, 25 bp, Homo sapien
tgagtgcgttgagcccaactgcaga

SEQ ID NO: 52161 - DNA, 25 bp, Homo sapien
ctaagagaatgctggctattaaaag

SEQ ID NO: 52162 - DNA, 25 bp, Homo sapien
gatccagttctaagtgtcatctttt

SEQ ID NO: 52163 - DNA, 25 bp, Homo sapien
tggcaagcaccaaccccataaagtg

SEQ ID NO: 52164 - DNA, 25 bp, Homo sapien
ggacggcccaggtacctgctctctt

SEQ ID NO: 52165 - DNA, 25 bp, Homo sapien
acggcccaggtacctgctctcttgg

SEQ ID NO: 52166 - DNA, 25 bp, Homo sapien
ggcccaggtacctgctctcttggga

SEQ ID NO: 52167 - DNA, 25 bp, Homo sapien
gcccaggtacctgctctcttgggaa

SEQ ID NO: 52168 - DNA, 25 bp, Homo sapien
ccaggtacctgctctcttgggaaga

SEQ ID NO: 52169 - DNA, 25 bp, Homo sapien
caggtacctgctctcttgggaagag

SEQ ID NO: 52170 - DNA, 25 bp, Homo sapien
aggtacctgctctcttgggaagaga

SEQ ID NO: 52171 - DNA, 25 bp, Homo sapien
gtacctgctctcttgggaagagaga

SEQ ID NO: 52172 - DNA, 25 bp, Homo sapien
tacctgctctcttgggaagagagag

SEQ ID NO: 52173 - DNA, 25 bp, Homo sapien
gggatggggcctcacacttgccacc

SEQ ID NO: 52174 - DNA, 25 bp, Homo sapien
tgcagccttgatgacacctgccgct

SEQ ID NO: 52175 - DNA, 25 bp, Homo sapien
gtgttctttttgtcagagatatggt

SEQ ID NO: 52176 - DNA, 25 bp, Homo sapien
tgatgagaatcttaaatgcttgttt

SEQ ID NO: 52177 - DNA, 25 bp, Homo sapien
atgcttgttttgcactatcacttag

SEQ ID NO: 52178 - DNA, 25 bp, Homo sapien
gttttgcactatcacttagtacctg

SEQ ID NO: 52179 - DNA, 25 bp, Homo sapien
atcacttagtacctgtttgaccaag

SEQ ID NO: 52180 - DNA, 25 bp, Homo sapien
gtacctgtttgaccaaggtgttaag

SEQ ID NO: 52181 - DNA, 25 bp, Homo sapien
ggtgttaagggatagtacctcccat

SEQ ID NO: 52182 - DNA, 25 bp, Homo sapien
gatagtacctcccatcagcagagaa

SEQ ID NO: 52183 - DNA, 25 bp, Homo sapien
gtacctcccatcagcagagaaactg

SEQ ID NO: 52184 - DNA, 25 bp, Homo sapien
actgacctgactaaagttaatcgca

SEQ ID NO: 52185 - DNA, 25 bp, Homo sapien
gatgaactagaagtcacagttaatt

SEQ ID NO: 52186 - DNA, 25 bp, Homo sapien
ttcttggaaagtgtaggcttacctc

SEQ ID NO: 52187 - DNA, 25 bp, Homo sapien
gaaagtgtaggcttacctcaaataa

SEQ ID NO: 52188 - DNA, 25 bp, Homo sapien
aatggctaacttatacatattttta

SEQ ID NO: 52189 - DNA, 25 bp, Homo sapien
aaaagtatgagcgttaggacactat

SEQ ID NO: 52190 - DNA, 25 bp, Homo sapien
gagcgttaggacactattttaatta

SEQ ID NO: 52191 - DNA, 25 bp, Homo sapien
gaagctgagttaatttatgtaagtc

SEQ ID NO: 52192 - DNA, 25 bp, Homo sapien
agaagtaccacttgaaacattttat

SEQ ID NO: 52193 - DNA, 25 bp, Homo sapien
aaagtggctatgcagtttgaatatc

SEQ ID NO: 52194 - DNA, 25 bp, Homo sapien
gaatatcctttgtttcagagccaga

SEQ ID NO: 52195 - DNA, 25 bp, Homo sapien
tcctttgtttcagagccagatcatt

SEQ ID NO: 52196 - DNA, 25 bp, Homo sapien
tgtttcagagccagatcatttcttg

SEQ ID NO: 52197 - DNA, 25 bp, Homo sapien
gaggctacaacccagaagcagtctg

SEQ ID NO: 52198 - DNA, 25 bp, Homo sapien
gaagacaaccaggaccttgctatct

SEQ ID NO: 52199 - DNA, 25 bp, Homo sapien
ggaaatggactctctgctcttagaa

SEQ ID NO: 52200 - DNA, 25 bp, Homo sapien
gaacctcaggttctcaggcaagagc

SEQ ID NO: 52201 - DNA, 25 bp, Homo sapien
gcaagagccacctgctattgccgaa

SEQ ID NO: 52202 - DNA, 25 bp, Homo sapien
aaccggccgttgtgctacccgtgag

SEQ ID NO: 52203 - DNA, 25 bp, Homo sapien
gtgtgtgaaatcagtggccgcctct

SEQ ID NO: 52204 - DNA, 25 bp, Homo sapien
tacagactctgctgtcgctgagctt

SEQ ID NO: 52205 - DNA, 25 bp, Homo sapien
ctgtcgctgagcttcctagatagaa

SEQ ID NO: 52206 - DNA, 25 bp, Homo sapien
agcagtgcaagattcagttcaaggt

SEQ ID NO: 52207 - DNA, 25 bp, Homo sapien
ttttactctgtgtaccttgtgtctt

SEQ ID NO: 52208 - DNA, 25 bp, Homo sapien
tgtctggacagggacactggcttca

SEQ ID NO: 52209 - DNA, 25 bp, Homo sapien
tcactgctgggccaccacgggtttg

SEQ ID NO: 52210 - DNA, 25 bp, Homo sapien
tggaagtttgcttctctgagcctca

SEQ ID NO: 52211 - DNA, 25 bp, Homo sapien
tctccatctgtgagatgaggctagc

SEQ ID NO: 52212 - DNA, 25 bp, Homo sapien
atgaggctagcgattgccctgtgtc

SEQ ID NO: 52213 - DNA, 25 bp, Homo sapien
tcccaggcccgctgggagggtacat

SEQ ID NO: 52214 - DNA, 25 bp, Homo sapien
gcgcatgttcagtgtgctccagctc

SEQ ID NO: 52215 - DNA, 25 bp, Homo sapien
agtgtgctccagctcttggcgttct

SEQ ID NO: 52216 - DNA, 25 bp, Homo sapien
tcgatagaccagtccagtggcccct

SEQ ID NO: 52217 - DNA, 25 bp, Homo sapien
tcaccacactgacttatttccctaa

SEQ ID NO: 52218 - DNA, 25 bp, Homo sapien
cacactgacttatttccctaaacta

SEQ ID NO: 52219 - DNA, 25 bp, Homo sapien
gtggcctgaagagccagagctagct

SEQ ID NO: 52220 - DNA, 25 bp, Homo sapien
tctggccaccagctgggcgacgtca

SEQ ID NO: 52221 - DNA, 25 bp, Homo sapien
cccaagttctaaggtcttttcagag

SEQ ID NO: 52222 - DNA, 25 bp, Homo sapien
taaggtcttttcagagcgtggaggt

SEQ ID NO: 52223 - DNA, 25 bp, Homo sapien
gaaggagtggctgctctccaaacta

SEQ ID NO: 52224 - DNA, 25 bp, Homo sapien
tgctctccaaactatgccaaggcgg

SEQ ID NO: 52225 - DNA, 25 bp, Homo sapien
caaactatgccaaggcggcggcaga

SEQ ID NO: 52226 - DNA, 25 bp, Homo sapien
agagctggtcttctggtctccttgg

SEQ ID NO: 52227 - DNA, 25 bp, Homo sapien
ggtctccttggagaaaggttctgtt

SEQ ID NO: 52228 - DNA, 25 bp, Homo sapien
gaaaggttctgttgccctgatttat

SEQ ID NO: 52229 - DNA, 25 bp, Homo sapien
tttctgtaacaatgcgatgtatatt

SEQ ID NO: 52230 - DNA, 25 bp, Homo sapien
gtaccattcacaaatgcgtcagaaa

SEQ ID NO: 52231 - DNA, 25 bp, Homo sapien
gtcagaaacactactaccgaagcta

SEQ ID NO: 52232 - DNA, 25 bp, Homo sapien
accgaagctatgagtacgacgtacc

SEQ ID NO: 52233 - DNA, 25 bp, Homo sapien
tcttacctccataggcaatcagcat

SEQ ID NO: 52234 - DNA, 25 bp, Homo sapien
atacctactgtaacatccctatgac

SEQ ID NO: 52235 - DNA, 25 bp, Homo sapien
tatgacactcatcaacgggcagcgg

SEQ ID NO: 52236 - DNA, 25 bp, Homo sapien
gggcagcggccacagacaaaatcga

SEQ ID NO: 52237 - DNA, 25 bp, Homo sapien
gatgaggcccacacaaacagtgcca

SEQ ID NO: 52238 - DNA, 25 bp, Homo sapien
atcctgccgctgttgccaagggaga

SEQ ID NO: 52239 - DNA, 25 bp, Homo sapien
gggagaccagtatatccagtgtgat

SEQ ID NO: 52240 - DNA, 25 bp, Homo sapien
aaaagcaagggacatcccgtccctg

SEQ ID NO: 52241 - DNA, 25 bp, Homo sapien
ggcccctgctaggaccttaagaagg

SEQ ID NO: 52242 - DNA, 25 bp, Homo sapien
ccttaagaaggagctcatgtgagtc

SEQ ID NO: 52243 - DNA, 25 bp, Homo sapien
agctcatgtgagtcaggaccctgaa

SEQ ID NO: 52244 - DNA, 25 bp, Homo sapien
ggaccctgaatgttagggctcgtta

SEQ ID NO: 52245 - DNA, 25 bp, Homo sapien
gggctcgttagctctatggttcata

SEQ ID NO: 52246 - DNA, 25 bp, Homo sapien
agctctatggttcatatgcttcttg

SEQ ID NO: 52247 - DNA, 25 bp, Homo sapien
atgcttcttgaaccaagtcacaggg

SEQ ID NO: 52248 - DNA, 25 bp, Homo sapien
attgccaggcaacaggactaaacta

SEQ ID NO: 52249 - DNA, 25 bp, Homo sapien
gactaaactacctccaaagcaagca

SEQ ID NO: 52250 - DNA, 25 bp, Homo sapien
aagcaagcagtcttttcagttttga

SEQ ID NO: 52251 - DNA, 25 bp, Homo sapien
agtgatgtgagaaacttcttttctt

SEQ ID NO: 52252 - DNA, 25 bp, Homo sapien
tgcacattttggctgttagacctgt

SEQ ID NO: 52253 - DNA, 25 bp, Homo sapien
attttggctgttagacctgtgtgtg

SEQ ID NO: 52254 - DNA, 25 bp, Homo sapien
gagaagtcagtgctcactttttgta

SEQ ID NO: 52255 - DNA, 25 bp, Homo sapien
tgggagggatgtgcccctgaccatt

SEQ ID NO: 52256 - DNA, 25 bp, Homo sapien
gcccctgaccattaacgactgtttt

SEQ ID NO: 52257 - DNA, 25 bp, Homo sapien
tgttggggcaggacatgcacacaat

SEQ ID NO: 52258 - DNA, 25 bp, Homo sapien
gacaaaatgcattacacctgtagtg

SEQ ID NO: 52259 - DNA, 25 bp, Homo sapien
acacctgtagtgtaaagtggccact

SEQ ID NO: 52260 - DNA, 25 bp, Homo sapien
agcaggagctcatttcctctgcaca

SEQ ID NO: 52261 - DNA, 25 bp, Homo sapien
agctcatttcctctgcacattttgg

SEQ ID NO: 52262 - DNA, 25 bp, Homo sapien
atttcctctgcacattttggctgtt

SEQ ID NO: 52263 - DNA, 25 bp, Homo sapien
ggcatgacctggagccacggtctct

SEQ ID NO: 52264 - DNA, 25 bp, Homo sapien
tggagccacggtctctcagtatcta

SEQ ID NO: 52265 - DNA, 25 bp, Homo sapien
gccacggtctctcagtatctaaagt

SEQ ID NO: 52266 - DNA, 25 bp, Homo sapien
acggtctctcagtatctaaagtcct

SEQ ID NO: 52267 - DNA, 25 bp, Homo sapien
ggtctctcagtatctaaagtcctac

SEQ ID NO: 52268 - DNA, 25 bp, Homo sapien
cagtatctaaagtcctacacaaggc

SEQ ID NO: 52269 - DNA, 25 bp, Homo sapien
caccgctgtagtagtagtcgaatta

SEQ ID NO: 52270 - DNA, 25 bp, Homo sapien
gtagtagtcgaattatcatctcctt

SEQ ID NO: 52271 - DNA, 25 bp, Homo sapien
gtagtcgaattatcatctccttcaa

SEQ ID NO: 52272 - DNA, 25 bp, Homo sapien
gtcgaattatcatctccttcaacta

SEQ ID NO: 52273 - DNA, 25 bp, Homo sapien
gaattatcatctccttcaactaatg

SEQ ID NO: 52274 - DNA, 25 bp, Homo sapien
tgtctccagcagctttccctgttga

SEQ ID NO: 52275 - DNA, 25 bp, Homo sapien
cagctttccctgttgatgtggatca

SEQ ID NO: 52276 - DNA, 25 bp, Homo sapien
tgatgtggatcacgcagtgctttct

SEQ ID NO: 52277 - DNA, 25 bp, Homo sapien
atcacgcagtgctttctgcccgtgt

SEQ ID NO: 52278 - DNA, 25 bp, Homo sapien
ctttctgcccgtgtttttggctcag

SEQ ID NO: 52279 - DNA, 25 bp, Homo sapien
gcagaggcgctaagcccagcctggc

SEQ ID NO: 52280 - DNA, 25 bp, Homo sapien
cctagggaatggtcccagcacgagt

SEQ ID NO: 52281 - DNA, 25 bp, Homo sapien
ggaatggtcccagcacgagtggcca

SEQ ID NO: 52282 - DNA, 25 bp, Homo sapien
ggcctgattgtttgtcgctggagga

SEQ ID NO: 52283 - DNA, 25 bp, Homo sapien
gaggaggacggcttacatgtttgtt

SEQ ID NO: 52284 - DNA, 25 bp, Homo sapien
aggacggcttacatgtttgtttctg

SEQ ID NO: 52285 - DNA, 25 bp, Homo sapien
cagaagttgggagtcttgtgttgct

SEQ ID NO: 52286 - DNA, 25 bp, Homo sapien
gggagtcttgtgttgctccctcttc

SEQ ID NO: 52287 - DNA, 25 bp, Homo sapien
ctctgggtttctgtggatcgtgaag

SEQ ID NO: 52288 - DNA, 25 bp, Homo sapien
aggcgatctcaagagtgtttccctc

SEQ ID NO: 52289 - DNA, 25 bp, Homo sapien
agagtgtttccctccaaacctgata

SEQ ID NO: 52290 - DNA, 25 bp, Homo sapien
aaacctgatagctgcctattcctgt

SEQ ID NO: 52291 - DNA, 25 bp, Homo sapien
agctgcctattcctgtctggttggg

SEQ ID NO: 52292 - DNA, 25 bp, Homo sapien
ggaggatgtagttgtatttattgca

SEQ ID NO: 52293 - DNA, 25 bp, Homo sapien
taacatcctgtgacttcatgctaga

SEQ ID NO: 52294 - DNA, 25 bp, Homo sapien
gtgacttcatgctagaaattttcta

SEQ ID NO: 52295 - DNA, 25 bp, Homo sapien
actctaaagcacatctgcatgtcag

SEQ ID NO: 52296 - DNA, 25 bp, Homo sapien
tctctctggctgaggttggctctta

SEQ ID NO: 52297 - DNA, 25 bp, Homo sapien
aggttggctcttagctcattgctgg

SEQ ID NO: 52298 - DNA, 25 bp, Homo sapien
aagcagtggcttttgtgggcattgc

SEQ ID NO: 52299 - DNA, 25 bp, Homo sapien
tttgtgggcattgctctaacctact

SEQ ID NO: 52300 - DNA, 25 bp, Homo sapien
ttgctctaacctacttctcaagctt

SEQ ID NO: 52301 - DNA, 25 bp, Homo sapien
tcaagcttccctccaaagaaactga

SEQ ID NO: 52302 - DNA, 25 bp, Homo sapien
aagaaactgattggccctggaacct

SEQ ID NO: 52303 - DNA, 25 bp, Homo sapien
atcccactcttgttatgactccaca

SEQ ID NO: 52304 - DNA, 25 bp, Homo sapien
gttatgactccacagtgtccagact

SEQ ID NO: 52305 - DNA, 25 bp, Homo sapien
gtgtccagactaatttgtgcatgaa

SEQ ID NO: 52306 - DNA, 25 bp, Homo sapien
taaaaccatcctacggtatccaggg

SEQ ID NO: 52307 - DNA, 25 bp, Homo sapien
gatcttacagaaaataccacctcga

SEQ ID NO: 52308 - DNA, 25 bp, Homo sapien
tcttacagaaaataccacctcgaga

SEQ ID NO: 52309 - DNA, 25 bp, Homo sapien
taccacctcgagatgggtgctggtc

SEQ ID NO: 52310 - DNA, 25 bp, Homo sapien
agtctctgccagaccaaggcgagtt

SEQ ID NO: 52311 - DNA, 25 bp, Homo sapien
accattgacatcgagcctgacatcg

SEQ ID NO: 52312 - DNA, 25 bp, Homo sapien
cattgacatcgagcctgacatcgaa

SEQ ID NO: 52313 - DNA, 25 bp, Homo sapien
tgacatcgagcctgacatcgaagcc

SEQ ID NO: 52314 - DNA, 25 bp, Homo sapien
acatcgagcctgacatcgaagccct

SEQ ID NO: 52315 - DNA, 25 bp, Homo sapien
atcgagcctgacatcgaagccctgc

SEQ ID NO: 52316 - DNA, 25 bp, Homo sapien
gagcctgacatcgaagccctgctgt

SEQ ID NO: 52317 - DNA, 25 bp, Homo sapien
gcctgacatcgaagccctgctgtct

SEQ ID NO: 52318 - DNA, 25 bp, Homo sapien
ggtgtctccagcctggctctatctt

SEQ ID NO: 52319 - DNA, 25 bp, Homo sapien
tggctctatcttcctccttgtgatc

SEQ ID NO: 52320 - DNA, 25 bp, Homo sapien
tatcttcctccttgtgatcgtccca

SEQ ID NO: 52321 - DNA, 25 bp, Homo sapien
acatctcccagccaagtccaagagg

SEQ ID NO: 52322 - DNA, 25 bp, Homo sapien
tcccagccaagtccaagagggcagg

SEQ ID NO: 52323 - DNA, 25 bp, Homo sapien
agagggcagggccagttcctcccat

SEQ ID NO: 52324 - DNA, 25 bp, Homo sapien
agtcggctcctcaactgggtgacaa

SEQ ID NO: 52325 - DNA, 25 bp, Homo sapien
ctcctcaactgggtgacaagggtga

SEQ ID NO: 52326 - DNA, 25 bp, Homo sapien
gtggtcacgggatttattcagcctt

SEQ ID NO: 52327 - DNA, 25 bp, Homo sapien
acgggatttattcagccttggtcag

SEQ ID NO: 52328 - DNA, 25 bp, Homo sapien
tttattcagccttggtcagagcaga

SEQ ID NO: 52329 - DNA, 25 bp, Homo sapien
aagctggaaccagtagcaaggagcc

SEQ ID NO: 52330 - DNA, 25 bp, Homo sapien
tcactgtgtattctcttggagcctt

SEQ ID NO: 52331 - DNA, 25 bp, Homo sapien
ggacggcccaggtacctgctctctt

SEQ ID NO: 52332 - DNA, 25 bp, Homo sapien
ccaggtacctgctctcttgggaaga

SEQ ID NO: 52333 - DNA, 25 bp, Homo sapien
aggtacctgctctcttgggaagaga

SEQ ID NO: 52334 - DNA, 25 bp, Homo sapien
gtacctgctctcttgggaagagaga

SEQ ID NO: 52335 - DNA, 25 bp, Homo sapien
gagcaaggccaatgtcagagacccc

SEQ ID NO: 52336 - DNA, 25 bp, Homo sapien
gggatggggcctcacacttgccacc

SEQ ID NO: 52337 - DNA, 25 bp, Homo sapien
acctggccagagtgggttcctgctg

SEQ ID NO: 52338 - DNA, 25 bp, Homo sapien
ctgctggccagggtgcagccttgat

SEQ ID NO: 52339 - DNA, 25 bp, Homo sapien
tgcagccttgatgacacctgccgct

SEQ ID NO: 52340 - DNA, 25 bp, Homo sapien
ggaaaccatacaggctgaaatcctc

SEQ ID NO: 52341 - DNA, 25 bp, Homo sapien
tgaaatcctccatggtggacaagat

SEQ ID NO: 52342 - DNA, 25 bp, Homo sapien
gacatgtgaagaactttttcaaccc

SEQ ID NO: 52343 - DNA, 25 bp, Homo sapien
aatcatttccaggtttatccgtgtc

SEQ ID NO: 52344 - DNA, 25 bp, Homo sapien
caggtttatccgtgtcattcctaaa

SEQ ID NO: 52345 - DNA, 25 bp, Homo sapien
caaagtattgcacttcgcctggaac

SEQ ID NO: 52346 - DNA, 25 bp, Homo sapien
acttcgcctggaactctttggctgt

SEQ ID NO: 52347 - DNA, 25 bp, Homo sapien
ctttggctgtgatatttactagaat

SEQ ID NO: 52348 - DNA, 25 bp, Homo sapien
gaacattcaaaaacccctggaagag

SEQ ID NO: 52349 - DNA, 25 bp, Homo sapien
agactctttaagacctcaaaccatt

SEQ ID NO: 52350 - DNA, 25 bp, Homo sapien
gggcaatgtattttacgctgtgtta

SEQ ID NO: 52351 - DNA, 25 bp, Homo sapien
aaagaaggtacagtgctccacctct

SEQ ID NO: 52352 - DNA, 25 bp, Homo sapien
tgtatctttcccttgtcactttatc

SEQ ID NO: 52353 - DNA, 25 bp, Homo sapien
tttatctcctcatcctatctcaaaa

SEQ ID NO: 52354 - DNA, 25 bp, Homo sapien
atcctatctcaaaacccatggaggg

SEQ ID NO: 52355 - DNA, 25 bp, Homo sapien
aacctaggcttggaattcacactga

SEQ ID NO: 52356 - DNA, 25 bp, Homo sapien
ggaattcacactgatctgggttaaa

SEQ ID NO: 52357 - DNA, 25 bp, Homo sapien
gggttaaaacctggcactatatcct

SEQ ID NO: 52358 - DNA, 25 bp, Homo sapien
cctaactgtaggactctttgagcat

SEQ ID NO: 52359 - DNA, 25 bp, Homo sapien
tttgagcatgctacttaatctatat

SEQ ID NO: 52360 - DNA, 25 bp, Homo sapien
taatctatatgtttccttgggtgta

SEQ ID NO: 52361 - DNA, 25 bp, Homo sapien
aaaagttacttaggcagtgctgtcc

SEQ ID NO: 52362 - DNA, 25 bp, Homo sapien
gattcttagaagtatgtcctcatag

SEQ ID NO: 52363 - DNA, 25 bp, Homo sapien
aaggctttgtaaaaactatccatga

SEQ ID NO: 52364 - DNA, 25 bp, Homo sapien
gggaaagctcctcagcataactgct

SEQ ID NO: 52365 - DNA, 25 bp, Homo sapien
ctgctcagggaaatagggctaaata

SEQ ID NO: 52366 - DNA, 25 bp, Homo sapien
aaaggtgctgttagtcgagcctcaa

SEQ ID NO: 52367 - DNA, 25 bp, Homo sapien
tcgagcctcaatgcttgctacaagg

SEQ ID NO: 52368 - DNA, 25 bp, Homo sapien
ggatgtatgtacaaggactgacttt

SEQ ID NO: 52369 - DNA, 25 bp, Homo sapien
gcattatattgtcccaaccagtagt

SEQ ID NO: 52370 - DNA, 25 bp, Homo sapien
ttattttttgccacggagatgtaga

SEQ ID NO: 52371 - DNA, 25 bp, Homo sapien
attacaagctactggatgcactgtc

SEQ ID NO: 52372 - DNA, 25 bp, Homo sapien
atgcactgtcagattaacttatttc

SEQ ID NO: 52373 - DNA, 25 bp, Homo sapien
gcgccgcagggctagcctcagtttc

SEQ ID NO: 52374 - DNA, 25 bp, Homo sapien
tttcccagtctgtagattgggccgg

SEQ ID NO: 52375 - DNA, 25 bp, Homo sapien
ggcaagccagctggcgcctgagtct

SEQ ID NO: 52376 - DNA, 25 bp, Homo sapien
ggcgcctgagtctctgtactgagaa

SEQ ID NO: 52377 - DNA, 25 bp, Homo sapien
actctctcactgtggcaagtcagag

SEQ ID NO: 52378 - DNA, 25 bp, Homo sapien
ctcactgtggcaagtcagagcactt

SEQ ID NO: 52379 - DNA, 25 bp, Homo sapien
taatgccttatagggtgagggaaga

SEQ ID NO: 52380 - DNA, 25 bp, Homo sapien
gagggaagattagactcctgttcac

SEQ ID NO: 52381 - DNA, 25 bp, Homo sapien
aagattagactcctgttcacctgtg

SEQ ID NO: 52382 - DNA, 25 bp, Homo sapien
gttcacctgtgcctatgagggctca

SEQ ID NO: 52383 - DNA, 25 bp, Homo sapien
tgagggctcagctcaaagccgagca

SEQ ID NO: 52384 - DNA, 25 bp, Homo sapien
aacgggtagttaatcctgcaagtgc

SEQ ID NO: 52385 - DNA, 25 bp, Homo sapien
agttaatcctgcaagtgctttccag

SEQ ID NO: 52386 - DNA, 25 bp, Homo sapien
gtgctttccagggattgggttctaa

SEQ ID NO: 52387 - DNA, 25 bp, Homo sapien
gctgcctccagttgttggaatagcc

SEQ ID NO: 52388 - DNA, 25 bp, Homo sapien
gctaacttaatgtcagaaaccaatg

SEQ ID NO: 52389 - DNA, 25 bp, Homo sapien
gaaaccaatggtagtatacccctat

SEQ ID NO: 52390 - DNA, 25 bp, Homo sapien
atacccctatgcagtgtattgccaa

SEQ ID NO: 52391 - DNA, 25 bp, Homo sapien
gtattgccaaaactgattagctagt

SEQ ID NO: 52392 - DNA, 25 bp, Homo sapien
ggacagagatatgcccagagatgca

SEQ ID NO: 52393 - DNA, 25 bp, Homo sapien
tatgatcttacaaacctgcaaatgg

SEQ ID NO: 52394 - DNA, 25 bp, Homo sapien
aatgcaagcccattggtggatgttt

SEQ ID NO: 52395 - DNA, 25 bp, Homo sapien
gacacacttttcatgacctcaaatg

SEQ ID NO: 52396 - DNA, 25 bp, Homo sapien
atgacctcaaatgtgggcccagcct

SEQ ID NO: 52397 - DNA, 25 bp, Homo sapien
caacccttagactcacgaacaaatc

SEQ ID NO: 52398 - DNA, 25 bp, Homo sapien
cgaacaaatccacctgagatcagca

SEQ ID NO: 52399 - DNA, 25 bp, Homo sapien
agagccaccctagatcagctgaaac

SEQ ID NO: 52400 - DNA, 25 bp, Homo sapien
aacttatcactgtataccactggag

SEQ ID NO: 52401 - DNA, 25 bp, Homo sapien
gttttctggttatctctcgtatagc

SEQ ID NO: 52402 - DNA, 25 bp, Homo sapien
taactgatgcaatctccatctggcc

SEQ ID NO: 52403 - DNA, 25 bp, Homo sapien
tctccctttattgtcctttcgtgta

SEQ ID NO: 52404 - DNA, 25 bp, Homo sapien
gtcctttcgtgtattgttcatccag

SEQ ID NO: 52405 - DNA, 25 bp, Homo sapien
gtgtattgttcatccagcaaccagg

SEQ ID NO: 52406 - DNA, 25 bp, Homo sapien
gacggaagtcattagaatggcttgt

SEQ ID NO: 52407 - DNA, 25 bp, Homo sapien
gtgatatctgatggcttgaacttgc

SEQ ID NO: 52408 - DNA, 25 bp, Homo sapien
tgatggcttgaacttgcccacagtt

SEQ ID NO: 52409 - DNA, 25 bp, Homo sapien
tggcttgaacttgcccacagttgaa

SEQ ID NO: 52410 - DNA, 25 bp, Homo sapien
tgaacttgcccacagttgaacacaa

SEQ ID NO: 52411 - DNA, 25 bp, Homo sapien
ttgcccacagttgaacacaagtgct

SEQ ID NO: 52412 - DNA, 25 bp, Homo sapien
gttgaacacaagtgctgtcattgca

SEQ ID NO: 52413 - DNA, 25 bp, Homo sapien
agtgctgtcattgcatttcttccat

SEQ ID NO: 52414 - DNA, 25 bp, Homo sapien
ttcttccattgtgaatacgaatttt

SEQ ID NO: 52415 - DNA, 25 bp, Homo sapien
gtgaatacgaattttcttcctcaga

SEQ ID NO: 52416 - DNA, 25 bp, Homo sapien
tttcttcctcagaaatgctccacct

SEQ ID NO: 52417 - DNA, 25 bp, Homo sapien
agtgcagtaagagcttgcctggcct

SEQ ID NO: 52418 - DNA, 25 bp, Homo sapien
tgtgtgcagagctgcctcatcctga

SEQ ID NO: 52419 - DNA, 25 bp, Homo sapien
gctgcctcatcctgaaattctggga

SEQ ID NO: 52420 - DNA, 25 bp, Homo sapien
ctgggagttgaaagccccagggcaa

SEQ ID NO: 52421 - DNA, 25 bp, Homo sapien
gcagctgagccatattctacatgac

SEQ ID NO: 52422 - DNA, 25 bp, Homo sapien
gccatattctacatgacacttccga

SEQ ID NO: 52423 - DNA, 25 bp, Homo sapien
ttctacatgacacttccgaggatcc

SEQ ID NO: 52424 - DNA, 25 bp, Homo sapien
gacacttccgaggatccccagtggg

SEQ ID NO: 52425 - DNA, 25 bp, Homo sapien
tgggcatgacctcaatcgcccacat

SEQ ID NO: 52426 - DNA, 25 bp, Homo sapien
aatcgcccacattggatgccacaac

SEQ ID NO: 52427 - DNA, 25 bp, Homo sapien
gatgccacaacctgcactggctttt

SEQ ID NO: 52428 - DNA, 25 bp, Homo sapien
cggtaagtgacaacccctcttgact

SEQ ID NO: 52429 - DNA, 25 bp, Homo sapien
aagtgacaacccctcttgactcagt

SEQ ID NO: 52430 - DNA, 25 bp, Homo sapien
tgacaacccctcttgactcagtacg

SEQ ID NO: 52431 - DNA, 25 bp, Homo sapien
aacccctcttgactcagtacgtgga

SEQ ID NO: 52432 - DNA, 25 bp, Homo sapien
tcttgactcagtacgtggacaccat

SEQ ID NO: 52433 - DNA, 25 bp, Homo sapien
ctccattcctcattgggaccaggtg

SEQ ID NO: 52434 - DNA, 25 bp, Homo sapien
attcctcattgggaccaggtgggct

SEQ ID NO: 52435 - DNA, 25 bp, Homo sapien
ttcctcattgggaccaggtgggctg

SEQ ID NO: 52436 - DNA, 25 bp, Homo sapien
gaccaggtgggctgtgtccgccaca

SEQ ID NO: 52437 - DNA, 25 bp, Homo sapien
aggtgggctgtgtccgccacatcac

SEQ ID NO: 52438 - DNA, 25 bp, Homo sapien
ctgactctttcaccggcaggggcac

SEQ ID NO: 52439 - DNA, 25 bp, Homo sapien
tcctgacctacttccccgggaggag

SEQ ID NO: 52440 - DNA, 25 bp, Homo sapien
aggatcagcgctgaggacggcctca

SEQ ID NO: 52441 - DNA, 25 bp, Homo sapien
gatcagcgctgaggacggcctcaag

SEQ ID NO: 52442 - DNA, 25 bp, Homo sapien
gaggacggcctcaagcatgagtatt

SEQ ID NO: 52443 - DNA, 25 bp, Homo sapien
gacggcctcaagcatgagtatttcc

SEQ ID NO: 52444 - DNA, 25 bp, Homo sapien
ggcctcaagcatgagtatttccgcg

SEQ ID NO: 52445 - DNA, 25 bp, Homo sapien
tcaagcatgagtatttccgcgagac

SEQ ID NO: 52446 - DNA, 25 bp, Homo sapien
aagcatgagtatttccgcgagaccc

SEQ ID NO: 52447 - DNA, 25 bp, Homo sapien
agcatgagtatttccgcgagacccc

SEQ ID NO: 52448 - DNA, 25 bp, Homo sapien
ccaagagcgagcagcagcgtgtgaa

SEQ ID NO: 52449 - DNA, 25 bp, Homo sapien
tccaccttaccaccacgaaccaggg

SEQ ID NO: 52450 - DNA, 25 bp, Homo sapien
ggccctgttcaggaaattttgagat

SEQ ID NO: 52451 - DNA, 25 bp, Homo sapien
gaaagagccaataactcagactttg

SEQ ID NO: 52452 - DNA, 25 bp, Homo sapien
ctcagactttggactcgtagcagct

SEQ ID NO: 52453 - DNA, 25 bp, Homo sapien
gactcgtagcagctgtctttactaa

SEQ ID NO: 52454 - DNA, 25 bp, Homo sapien
gccctcacagtgtcttctgcaatgc

SEQ ID NO: 52455 - DNA, 25 bp, Homo sapien
gtcttctgcaatgcaagctgggact

SEQ ID NO: 52456 - DNA, 25 bp, Homo sapien
aagctgggactgtttggatcaattg

SEQ ID NO: 52457 - DNA, 25 bp, Homo sapien
gttacaatgccttaaatgcccagag

SEQ ID NO: 52458 - DNA, 25 bp, Homo sapien
agaatttggcttgcgggagtactca

SEQ ID NO: 52459 - DNA, 25 bp, Homo sapien
gcttgcgggagtactcagaagttaa

SEQ ID NO: 52460 - DNA, 25 bp, Homo sapien
taagacggtgacagtaaagatcccc

SEQ ID NO: 52461 - DNA, 25 bp, Homo sapien
tcatctttctccctaattcatccca

SEQ ID NO: 52462 - DNA, 25 bp, Homo sapien
taattcatcccaggacaagcctagg

SEQ ID NO: 52463 - DNA, 25 bp, Homo sapien
ttcatcccaggacaagcctaggaaa

SEQ ID NO: 52464 - DNA, 25 bp, Homo sapien
cctggtgttacctccaagaggaaag

SEQ ID NO: 52465 - DNA, 25 bp, Homo sapien
ctccaagaggaaagacatacacatc

SEQ ID NO: 52466 - DNA, 25 bp, Homo sapien
gacatacacatcaaatgcagcggta

SEQ ID NO: 52467 - DNA, 25 bp, Homo sapien
acacatcaaatgcagcggtatgctg

SEQ ID NO: 52468 - DNA, 25 bp, Homo sapien
tcaaatgcagcggtatgctgataaa

SEQ ID NO: 52469 - DNA, 25 bp, Homo sapien
tatgctgataaatgttacccctgga

SEQ ID NO: 52470 - DNA, 25 bp, Homo sapien
tgctgataaatgttacccctggatc

SEQ ID NO: 52471 - DNA, 25 bp, Homo sapien
tgataaatgttacccctggatcccc

SEQ ID NO: 52472 - DNA, 25 bp, Homo sapien
ccgtactgtctgtgtccttgtataa

SEQ ID NO: 52473 - DNA, 25 bp, Homo sapien
ggagctttgctcttggaattactga

SEQ ID NO: 52474 - DNA, 25 bp, Homo sapien
gacacaagtggccttaagtcttttt

SEQ ID NO: 52475 - DNA, 25 bp, Homo sapien
tgaagtgttatttcatccagggaaa

SEQ ID NO: 52476 - DNA, 25 bp, Homo sapien
atccagggaaatgcctcgagccata

SEQ ID NO: 52477 - DNA, 25 bp, Homo sapien
atgcctcgagccatagagcctgaaa

SEQ ID NO: 52478 - DNA, 25 bp, Homo sapien
agagcctgaaatcatctttgttggc

SEQ ID NO: 52479 - DNA, 25 bp, Homo sapien
aaataccttagcttcactcagctgg

SEQ ID NO: 52480 - DNA, 25 bp, Homo sapien
ttcactcagctggactgcattgaag

SEQ ID NO: 52481 - DNA, 25 bp, Homo sapien
tgcattgaaggcgaggctgcccctt

SEQ ID NO: 52482 - DNA, 25 bp, Homo sapien
ggctgccccttggatcaagcagaaa

SEQ ID NO: 52483 - DNA, 25 bp, Homo sapien
tgacattggaaatcctcaacgagaa

SEQ ID NO: 52484 - DNA, 25 bp, Homo sapien
ggacgaacccaacatgaaccccaag

SEQ ID NO: 52485 - DNA, 25 bp, Homo sapien
gaaccccaagctggacttaccaaat

SEQ ID NO: 52486 - DNA, 25 bp, Homo sapien
ttaccaaatcgaccagaaacctcct

SEQ ID NO: 52487 - DNA, 25 bp, Homo sapien
ggttcaccaacccatgcaagaccat

SEQ ID NO: 52488 - DNA, 25 bp, Homo sapien
atgaagttcatcgtgtggcgccgct

SEQ ID NO: 52489 - DNA, 25 bp, Homo sapien
tggcgccgctttaagtgggtcatca

SEQ ID NO: 52490 - DNA, 25 bp, Homo sapien
taagtgggtcatcatcggcttgctg

SEQ ID NO: 52491 - DNA, 25 bp, Homo sapien
tcatcggcttgctgttcctgcttat

SEQ ID NO: 52492 - DNA, 25 bp, Homo sapien
tgcttatcctgctgctcttcgtggc

SEQ ID NO: 52493 - DNA, 25 bp, Homo sapien
ctactctttgccgaactatttgtca

SEQ ID NO: 52494 - DNA, 25 bp, Homo sapien
ttcaactcagaagcactcaaaaatg

SEQ ID NO: 52495 - DNA, 25 bp, Homo sapien
aaatgtgataatgggcacttgttta

SEQ ID NO: 52496 - DNA, 25 bp, Homo sapien
ctgaaaggacaaatgtgcttggttt

SEQ ID NO: 52497 - DNA, 25 bp, Homo sapien
gtaatcacaacttactttctgcttg

SEQ ID NO: 52498 - DNA, 25 bp, Homo sapien
acttactttctgcttgtagttgctt

SEQ ID NO: 52499 - DNA, 25 bp, Homo sapien
actttctgcttgtagttgcttaaaa

SEQ ID NO: 52500 - DNA, 25 bp, Homo sapien
aattatgtattttgtcttgggctgc

SEQ ID NO: 52501 - DNA, 25 bp, Homo sapien
gtattttgtcttgggctgcaatttg

SEQ ID NO: 52502 - DNA, 25 bp, Homo sapien
ttgtcttgggctgcaatttgtttta

SEQ ID NO: 52503 - DNA, 25 bp, Homo sapien
ttgggctgcaatttgttttatgctt

SEQ ID NO: 52504 - DNA, 25 bp, Homo sapien
ttttattattactgcagtagttgac

SEQ ID NO: 52505 - DNA, 25 bp, Homo sapien
ttctcgcctggctcactacaataag

SEQ ID NO: 52506 - DNA, 25 bp, Homo sapien
tctcgcctggctcactacaataagc

SEQ ID NO: 52507 - DNA, 25 bp, Homo sapien
tcgcctggctcactacaataagcgc

SEQ ID NO: 52508 - DNA, 25 bp, Homo sapien
gctaagcatgctgtgtccgagggca

SEQ ID NO: 52509 - DNA, 25 bp, Homo sapien
ctaagcatgctgtgtccgagggcac

SEQ ID NO: 52510 - DNA, 25 bp, Homo sapien
taagcatgctgtgtccgagggcact

SEQ ID NO: 52511 - DNA, 25 bp, Homo sapien
ggcagttaccaagtacactagctct

SEQ ID NO: 52512 - DNA, 25 bp, Homo sapien
gcagttaccaagtacactagctcta

SEQ ID NO: 52513 - DNA, 25 bp, Homo sapien
cagttaccaagtacactagctctaa

SEQ ID NO: 52514 - DNA, 25 bp, Homo sapien
gttaccaagtacactagctctaaat

SEQ ID NO: 52515 - DNA, 25 bp, Homo sapien
taccaagtacactagctctaaataa

SEQ ID NO: 52516 - DNA, 25 bp, Homo sapien
tgggcagacttaggaacgctctact

SEQ ID NO: 52517 - DNA, 25 bp, Homo sapien
acgctctactcggtaaaagcgttat

SEQ ID NO: 52518 - DNA, 25 bp, Homo sapien
gctctactcggtaaaagcgttatac

SEQ ID NO: 52519 - DNA, 25 bp, Homo sapien
ctctactcggtaaaagcgttataca

SEQ ID NO: 52520 - DNA, 25 bp, Homo sapien
tctactcggtaaaagcgttatacaa

SEQ ID NO: 52521 - DNA, 25 bp, Homo sapien
tactcggtaaaagcgttatacaaag

SEQ ID NO: 52522 - DNA, 25 bp, Homo sapien
aaaagcgttatacaaagtcatagga

SEQ ID NO: 52523 - DNA, 25 bp, Homo sapien
aagcgttatacaaagtcataggaga

SEQ ID NO: 52524 - DNA, 25 bp, Homo sapien
gcgttatacaaagtcataggagaaa

SEQ ID NO: 52525 - DNA, 25 bp, Homo sapien
atgggacaattcatgattatactta

SEQ ID NO: 52526 - DNA, 25 bp, Homo sapien
gtttataaattgagtcctaagtatt

SEQ ID NO: 52527 - DNA, 25 bp, Homo sapien
ctccaagggtcctcatcacctattg

SEQ ID NO: 52528 - DNA, 25 bp, Homo sapien
aagggtcctcatcacctattgcagc

SEQ ID NO: 52529 - DNA, 25 bp, Homo sapien
tcatcacctattgcagccttcaggg

SEQ ID NO: 52530 - DNA, 25 bp, Homo sapien
atcacctattgcagccttcagggct

SEQ ID NO: 52531 - DNA, 25 bp, Homo sapien
acctattgcagccttcagggctcgg

SEQ ID NO: 52532 - DNA, 25 bp, Homo sapien
tcagggctcggcctattttccacta

SEQ ID NO: 52533 - DNA, 25 bp, Homo sapien
agggctcggcctattttccactact

SEQ ID NO: 52534 - DNA, 25 bp, Homo sapien
tcaacctccggagtccaggagaacc

SEQ ID NO: 52535 - DNA, 25 bp, Homo sapien
agagccttaagcaactacttctgtg

SEQ ID NO: 52536 - DNA, 25 bp, Homo sapien
gccttaagcaactacttctgtgaag

SEQ ID NO: 52537 - DNA, 25 bp, Homo sapien
aagcaactacttctgtgaagtattt

SEQ ID NO: 52538 - DNA, 25 bp, Homo sapien
agatggttcctttctgccccttcct

SEQ ID NO: 52539 - DNA, 25 bp, Homo sapien
atggttcctttctgccccttcctgg

SEQ ID NO: 52540 - DNA, 25 bp, Homo sapien
aggtgaggctgccaatagcctcctg

SEQ ID NO: 52541 - DNA, 25 bp, Homo sapien
tgaggctgccaatagcctcctggca

SEQ ID NO: 52542 - DNA, 25 bp, Homo sapien
gaggctgccaatagcctcctggcac

SEQ ID NO: 52543 - DNA, 25 bp, Homo sapien
ggctggctgttgagacatgctacaa

SEQ ID NO: 52544 - DNA, 25 bp, Homo sapien
gctggctgttgagacatgctacaat

SEQ ID NO: 52545 - DNA, 25 bp, Homo sapien
ctggctgttgagacatgctacaatt

SEQ ID NO: 52546 - DNA, 25 bp, Homo sapien
ggctgttgagacatgctacaatttt

SEQ ID NO: 52547 - DNA, 25 bp, Homo sapien
gttgagacatgctacaattttcatt

SEQ ID NO: 52548 - DNA, 25 bp, Homo sapien
tgagacatgctacaattttcatttt

SEQ ID NO: 52549 - DNA, 25 bp, Homo sapien
agacaactagagaattctgggcctg

SEQ ID NO: 52550 - DNA, 25 bp, Homo sapien
attctgggcctgaaatttcaatcta

SEQ ID NO: 52551 - DNA, 25 bp, Homo sapien
aggtggttttgataacacacttata

SEQ ID NO: 52552 - DNA, 25 bp, Homo sapien
gataacacacttataaggctttctg

SEQ ID NO: 52553 - DNA, 25 bp, Homo sapien
aagggcgaagaatcgttcaactgtc

SEQ ID NO: 52554 - DNA, 25 bp, Homo sapien
gttcaactgtcaatcagcctcttga

SEQ ID NO: 52555 - DNA, 25 bp, Homo sapien
gcctcttgattctttgtaaattgcc

SEQ ID NO: 52556 - DNA, 25 bp, Homo sapien
tctttgtaaattgccagggtgggtg

SEQ ID NO: 52557 - DNA, 25 bp, Homo sapien
agggtgggtgggtacatatctcttc

SEQ ID NO: 52558 - DNA, 25 bp, Homo sapien
gtacatatctcttcttgattctgca

SEQ ID NO: 52559 - DNA, 25 bp, Homo sapien
gattctgcatttcatacttaactat

SEQ ID NO: 52560 - DNA, 25 bp, Homo sapien
gattgtgtctgatgggaactgagtt

SEQ ID NO: 52561 - DNA, 25 bp, Homo sapien
tgtgtctgatgggaactgagttgtt

SEQ ID NO: 52562 - DNA, 25 bp, Homo sapien
gatgggaactgagttgttggccttt

SEQ ID NO: 52563 - DNA, 25 bp, Homo sapien
gaaatgaaatttttggctcttgaga

SEQ ID NO: 52564 - DNA, 25 bp, Homo sapien
ttcttatgaattgttatgcgaattt

SEQ ID NO: 52565 - DNA, 25 bp, Homo sapien
gaattgttatgcgaattttatatat

SEQ ID NO: 52566 - DNA, 25 bp, Homo sapien
gagatctggggctgttatttttaaa

SEQ ID NO: 52567 - DNA, 25 bp, Homo sapien
cataatacatattccgagtagatat

SEQ ID NO: 52568 - DNA, 25 bp, Homo sapien
acatattccgagtagatatttataa

SEQ ID NO: 52569 - DNA, 25 bp, Homo sapien
atgcatagttttgaactaatgtaac

SEQ ID NO: 52570 - DNA, 25 bp, Homo sapien
agttttgaactaatgtaacatgatt

SEQ ID NO: 52571 - DNA, 25 bp, Homo sapien
ggtggccagggatgaaccttgccca

SEQ ID NO: 52572 - DNA, 25 bp, Homo sapien
atgaaccttgcccagccgtggtggc

SEQ ID NO: 52573 - DNA, 25 bp, Homo sapien
ggcctggtccccaagagctttggag

SEQ ID NO: 52574 - DNA, 25 bp, Homo sapien
tggtccccaagagctttggaggctt

SEQ ID NO: 52575 - DNA, 25 bp, Homo sapien
gcccaggtggctgtttccctgagga

SEQ ID NO: 52576 - DNA, 25 bp, Homo sapien
gaggaccagaactgctcattttagc

SEQ ID NO: 52577 - DNA, 25 bp, Homo sapien
gaactgctcattttagcttgagtga

SEQ ID NO: 52578 - DNA, 25 bp, Homo sapien
gggccatgccttgtccagcactgtt

SEQ ID NO: 52579 - DNA, 25 bp, Homo sapien
ttgtccagcactgttctgtcagtct

SEQ ID NO: 52580 - DNA, 25 bp, Homo sapien
ggaccattcattccctggcattaat

SEQ ID NO: 52581 - DNA, 25 bp, Homo sapien
ttcattccctggcattaatccctta

SEQ ID NO: 52582 - DNA, 25 bp, Homo sapien
tcgcctgctgtttgctggatacaat

SEQ ID NO: 52583 - DNA, 25 bp, Homo sapien
actatcaacgtctgggatgttctca

SEQ ID NO: 52584 - DNA, 25 bp, Homo sapien
gtttggacatgaaaaccgcgttagc

SEQ ID NO: 52585 - DNA, 25 bp, Homo sapien
aaccgcgttagcactctacgagttt

SEQ ID NO: 52586 - DNA, 25 bp, Homo sapien
tgctttctgctctggatcatgggat

SEQ ID NO: 52587 - DNA, 25 bp, Homo sapien
gatcatgggatcataccctcagagt

SEQ ID NO: 52588 - DNA, 25 bp, Homo sapien
gcttcagggtcagatgacgctacgt

SEQ ID NO: 52589 - DNA, 25 bp, Homo sapien
atgacgctacgtgtcgcctctatga

SEQ ID NO: 52590 - DNA, 25 bp, Homo sapien
gcctctatgacctgcgggcagatag

SEQ ID NO: 52591 - DNA, 25 bp, Homo sapien
gatagggaggttgccatctattcca

SEQ ID NO: 52592 - DNA, 25 bp, Homo sapien
aaagcatcatatttggagcatccag

SEQ ID NO: 52593 - DNA, 25 bp, Homo sapien
gtgctgtcccttgtatttactttaa

SEQ ID NO: 52594 - DNA, 25 bp, Homo sapien
gtatttactttaagcactgatcact

SEQ ID NO: 52595 - DNA, 25 bp, Homo sapien
gatcacttatcattcattcggtatg

SEQ ID NO: 52596 - DNA, 25 bp, Homo sapien
attcattcggtatggttttccctgt

SEQ ID NO: 52597 - DNA, 25 bp, Homo sapien
tgtcccttgtacacattctggtatg

SEQ ID NO: 52598 - DNA, 25 bp, Homo sapien
cgtgcccaactgaggaacaggagaa

SEQ ID NO: 52599 - DNA, 25 bp, Homo sapien
gaaatcaccaatttgggctctcaga

SEQ ID NO: 52600 - DNA, 25 bp, Homo sapien
gggctctcagagctaagacacactt

SEQ ID NO: 52601 - DNA, 25 bp, Homo sapien
gacacacttattgattctgttgcac

SEQ ID NO: 52602 - DNA, 25 bp, Homo sapien
attttgcactggtttatggcgattg

SEQ ID NO: 52603 - DNA, 25 bp, Homo sapien
tatggcgattgttttcttggacgga

SEQ ID NO: 52604 - DNA, 25 bp, Homo sapien
ggagaaggacgtagcgaccgcaaca

SEQ ID NO: 52605 - DNA, 25 bp, Homo sapien
tagcgaccgcaacataggatggaga

SEQ ID NO: 52606 - DNA, 25 bp, Homo sapien
aagcagctcgaatttcttccagata

SEQ ID NO: 52607 - DNA, 25 bp, Homo sapien
ttccagatatcctcactgggcgcgg

SEQ ID NO: 52608 - DNA, 25 bp, Homo sapien
ggctgcagctcgctctgctgttgct

SEQ ID NO: 52609 - DNA, 25 bp, Homo sapien
tgatagaaattctcttcctcgtcgc

SEQ ID NO: 52610 - DNA, 25 bp, Homo sapien
tctcttcctcgtcgcagatgaaata

SEQ ID NO: 52611 - DNA, 25 bp, Homo sapien
tgaaatagggctgtacggagtcgta

SEQ ID NO: 52612 - DNA, 25 bp, Homo sapien
gtacggagtcgtagtcgaggtcata

SEQ ID NO: 52613 - DNA, 25 bp, Homo sapien
tcgaggtcatagttcctgttggtga

SEQ ID NO: 52614 - DNA, 25 bp, Homo sapien
gttcctgttggtgaagttcacgttg

SEQ ID NO: 52615 - DNA, 25 bp, Homo sapien
gctgacacctcccttcgtgtgtgcg

SEQ ID NO: 52616 - DNA, 25 bp, Homo sapien
ccctgtgtccgctctctcatgtggg

SEQ ID NO: 52617 - DNA, 25 bp, Homo sapien
gggatgtttgtgctgcagacaaaaa

SEQ ID NO: 52618 - DNA, 25 bp, Homo sapien
gtttgtgctgcagacaaaaagaaca

SEQ ID NO: 52619 - DNA, 25 bp, Homo sapien
gtagtgtttacattaaagccgccgt

SEQ ID NO: 52620 - DNA, 25 bp, Homo sapien
attaaagccgccgttttcatgacca

SEQ ID NO: 52621 - DNA, 25 bp, Homo sapien
taaagccgccgttttcatgaccaat

SEQ ID NO: 52622 - DNA, 25 bp, Homo sapien
gccgttttcatgaccaatcctatgt

SEQ ID NO: 52623 - DNA, 25 bp, Homo sapien
gaccaatcctatgtcatttctactt

SEQ ID NO: 52624 - DNA, 25 bp, Homo sapien
tcatttctactttgactaataccca

SEQ ID NO: 52625 - DNA, 25 bp, Homo sapien
tcttcacggtttcacttttaagact

SEQ ID NO: 52626 - DNA, 25 bp, Homo sapien
tgttgccaacgtgcttctggggccc

SEQ ID NO: 52627 - DNA, 25 bp, Homo sapien
gtttgtgcaccccttggcgagccag

SEQ ID NO: 52628 - DNA, 25 bp, Homo sapien
tttgtgcaccccttggcgagccaga

SEQ ID NO: 52629 - DNA, 25 bp, Homo sapien
ttgtgcaccccttggcgagccagaa

SEQ ID NO: 52630 - DNA, 25 bp, Homo sapien
accccttggcgagccagaactggga

SEQ ID NO: 52631 - DNA, 25 bp, Homo sapien
cccttggcgagccagaactgggaac

SEQ ID NO: 52632 - DNA, 25 bp, Homo sapien
ccttggcgagccagaactgggaacc

SEQ ID NO: 52633 - DNA, 25 bp, Homo sapien
cttggcgagccagaactgggaaccc

SEQ ID NO: 52634 - DNA, 25 bp, Homo sapien
ttggcgagccagaactgggaacccc

SEQ ID NO: 52635 - DNA, 25 bp, Homo sapien
tggcgagccagaactgggaaccccg

SEQ ID NO: 52636 - DNA, 25 bp, Homo sapien
gcgagccagaactgggaaccccgcg

SEQ ID NO: 52637 - DNA, 25 bp, Homo sapien
tgaaattttcaagggcactctcaaa

SEQ ID NO: 52638 - DNA, 25 bp, Homo sapien
gcactctcaaaccagatagtactca

SEQ ID NO: 52639 - DNA, 25 bp, Homo sapien
aaccagatagtactcattccaatga

SEQ ID NO: 52640 - DNA, 25 bp, Homo sapien
actcattccaatgaatttgactcag

SEQ ID NO: 52641 - DNA, 25 bp, Homo sapien
atgtgatcaacccaactttacctag

SEQ ID NO: 52642 - DNA, 25 bp, Homo sapien
actttacctagagtgggagcatcca

SEQ ID NO: 52643 - DNA, 25 bp, Homo sapien
gagtgggagcatccaagattatagt

SEQ ID NO: 52644 - DNA, 25 bp, Homo sapien
tctgtagtccagaaaccgtcaggga

SEQ ID NO: 52645 - DNA, 25 bp, Homo sapien
gtcagggaggaagttctgctcaccc

SEQ ID NO: 52646 - DNA, 25 bp, Homo sapien
tcacaccgtgttaggagactactgt

SEQ ID NO: 52647 - DNA, 25 bp, Homo sapien
gagactactgttatttgaccaatga

SEQ ID NO: 52648 - DNA, 25 bp, Homo sapien
ccccggactggaggcttgagagctc

SEQ ID NO: 52649 - DNA, 25 bp, Homo sapien
aggcttgagagctccaacgggaaga

SEQ ID NO: 52650 - DNA, 25 bp, Homo sapien
aaggaggccggcgagatctgaaccc

SEQ ID NO: 52651 - DNA, 25 bp, Homo sapien
tctcccgggtgctgtaaatagtctg

SEQ ID NO: 52652 - DNA, 25 bp, Homo sapien
gtctgataaacgttcacacagtcta

SEQ ID NO: 52653 - DNA, 25 bp, Homo sapien
aattaccctttatatttgctgaata

SEQ ID NO: 52654 - DNA, 25 bp, Homo sapien
tttgctgaatacaactcatcttttg

SEQ ID NO: 52655 - DNA, 25 bp, Homo sapien
tctattgttttggagctagctgtga

SEQ ID NO: 52656 - DNA, 25 bp, Homo sapien
agctgtgagtttctagaagtgtaca

SEQ ID NO: 52657 - DNA, 25 bp, Homo sapien
agtgtacagagttgctcctgtgttc

SEQ ID NO: 52658 - DNA, 25 bp, Homo sapien
ctgtgttcccgggtcatgttgagta

SEQ ID NO: 52659 - DNA, 25 bp, Homo sapien
agagggcggcgctcgccaagtccct

SEQ ID NO: 52660 - DNA, 25 bp, Homo sapien
tcgccaagtccctcaaaatgacgga

SEQ ID NO: 52661 - DNA, 25 bp, Homo sapien
atgacggacgcgcaggtcaagacct

SEQ ID NO: 52662 - DNA, 25 bp, Homo sapien
ggaggaccaagtggcggcggcagac

SEQ ID NO: 52663 - DNA, 25 bp, Homo sapien
ggctcatgctgcagctgcaacacga

SEQ ID NO: 52664 - DNA, 25 bp, Homo sapien
gcaacacgacgccttccaaaagagc

SEQ ID NO: 52665 - DNA, 25 bp, Homo sapien
gccttccaaaagagcctcaacgact

SEQ ID NO: 52666 - DNA, 25 bp, Homo sapien
tgtctgcacaactcgtcactctttg

SEQ ID NO: 52667 - DNA, 25 bp, Homo sapien
gtcactctttgctctgcagaatctg

SEQ ID NO: 52668 - DNA, 25 bp, Homo sapien
ggaggatagttccaaggttcccgct

SEQ ID NO: 52669 - DNA, 25 bp, Homo sapien
gatagttccaaggttcccgctgtca

SEQ ID NO: 52670 - DNA, 25 bp, Homo sapien
tgggaggttgtcagagcagaaatca

SEQ ID NO: 52671 - DNA, 25 bp, Homo sapien
gggaggttgtcagagcagaaatcat

SEQ ID NO: 52672 - DNA, 25 bp, Homo sapien
ggaggttgtcagagcagaaatcatg

SEQ ID NO: 52673 - DNA, 25 bp, Homo sapien
gaggttgtcagagcagaaatcatga

SEQ ID NO: 52674 - DNA, 25 bp, Homo sapien
aggttgtcagagcagaaatcatgag

SEQ ID NO: 52675 - DNA, 25 bp, Homo sapien
ggttgtcagagcagaaatcatgaga

SEQ ID NO: 52676 - DNA, 25 bp, Homo sapien
gttgtcagagcagaaatcatgagat

SEQ ID NO: 52677 - DNA, 25 bp, Homo sapien
ttgtcagagcagaaatcatgagatc

SEQ ID NO: 52678 - DNA, 25 bp, Homo sapien
gaggcagggagaaagctttccaaat

SEQ ID NO: 52679 - DNA, 25 bp, Homo sapien
catgttggaaacttttgtcacggct

SEQ ID NO: 52680 - DNA, 25 bp, Homo sapien
gaaacttttgtcacggctttattga

SEQ ID NO: 52681 - DNA, 25 bp, Homo sapien
tgagattaagttcacatacaatttg

SEQ ID NO: 52682 - DNA, 25 bp, Homo sapien
gatgacttttggtatattcagagtt

SEQ ID NO: 52683 - DNA, 25 bp, Homo sapien
accattatcactagatcaattttag

SEQ ID NO: 52684 - DNA, 25 bp, Homo sapien
tagaaagtttatcaccccaaagaga

SEQ ID NO: 52685 - DNA, 25 bp, Homo sapien
aaagagaaatcctgcacccatcagc

SEQ ID NO: 52686 - DNA, 25 bp, Homo sapien
tctgcaaccacgaatcgactgtctc

SEQ ID NO: 52687 - DNA, 25 bp, Homo sapien
atcgactgtctctgtagattggcct

SEQ ID NO: 52688 - DNA, 25 bp, Homo sapien
actgtctctgtagattggccttctg

SEQ ID NO: 52689 - DNA, 25 bp, Homo sapien
tttggtgatatgagaactgaaacta

SEQ ID NO: 52690 - DNA, 25 bp, Homo sapien
gtgatatgagaactgaaactaaagc

SEQ ID NO: 52691 - DNA, 25 bp, Homo sapien
gtcagaaattacattgtatttccat

SEQ ID NO: 52692 - DNA, 25 bp, Homo sapien
ttctccacctctgctaaccctgaga

SEQ ID NO: 52693 - DNA, 25 bp, Homo sapien
cacctctgctaaccctgagacagca

SEQ ID NO: 52694 - DNA, 25 bp, Homo sapien
aacccctcttctacctattcaatgt

SEQ ID NO: 52695 - DNA, 25 bp, Homo sapien
acccctcttctacctattcaatgta

SEQ ID NO: 52696 - DNA, 25 bp, Homo sapien
cccctcttctacctattcaatgtaa

SEQ ID NO: 52697 - DNA, 25 bp, Homo sapien
cctcttctacctattcaatgtaaag

SEQ ID NO: 52698 - DNA, 25 bp, Homo sapien
tctacctattcaatgtaaagacaag

SEQ ID NO: 52699 - DNA, 25 bp, Homo sapien
agacttttatgatgatcgactttca

SEQ ID NO: 52700 - DNA, 25 bp, Homo sapien
gctcaaagatcttgtctcgctggcc

SEQ ID NO: 52701 - DNA, 25 bp, Homo sapien
tcaaagatcttgtctcgctggcctg

SEQ ID NO: 52702 - DNA, 25 bp, Homo sapien
aagatcttgtctcgctggcctgcga

SEQ ID NO: 52703 - DNA, 25 bp, Homo sapien
gtcctggtatctgggatagcaaagg

SEQ ID NO: 52704 - DNA, 25 bp, Homo sapien
gtatctgggatagcaaaggtcttct

SEQ ID NO: 52705 - DNA, 25 bp, Homo sapien
atctgggatagcaaaggtcttcttc

SEQ ID NO: 52706 - DNA, 25 bp, Homo sapien
ctgggatagcaaaggtcttcttccc

SEQ ID NO: 52707 - DNA, 25 bp, Homo sapien
agagtgaacaagaacacccctgccg

SEQ ID NO: 52708 - DNA, 25 bp, Homo sapien
gtgaacaagaacacccctgccgact

SEQ ID NO: 52709 - DNA, 25 bp, Homo sapien
aagacaaaacacatagacgcacaca

SEQ ID NO: 52710 - DNA, 25 bp, Homo sapien
acacatagacgcacacactcaggag

SEQ ID NO: 52711 - DNA, 25 bp, Homo sapien
tgaggaggtagtgctgtaggcccag

SEQ ID NO: 52712 - DNA, 25 bp, Homo sapien
catgtgagggatggaaatgacctcc

SEQ ID NO: 52713 - DNA, 25 bp, Homo sapien
agcagcctggttcaccacacaaact

SEQ ID NO: 52714 - DNA, 25 bp, Homo sapien
agcctggttcaccacacaaactctg

SEQ ID NO: 52715 - DNA, 25 bp, Homo sapien
gttcaccacacaaactctgcctgga

SEQ ID NO: 52716 - DNA, 25 bp, Homo sapien
aactctgcctggaccccattgtctg

SEQ ID NO: 52717 - DNA, 25 bp, Homo sapien
tgcctggaccccattgtctgtctgc

SEQ ID NO: 52718 - DNA, 25 bp, Homo sapien
tcgggcaccagcctgcatatgtgtt

SEQ ID NO: 52719 - DNA, 25 bp, Homo sapien
gggcaccagcctgcatatgtgttca

SEQ ID NO: 52720 - DNA, 25 bp, Homo sapien
accagcctgcatatgtgttcacttt

SEQ ID NO: 52721 - DNA, 25 bp, Homo sapien
cagcctgcatatgtgttcactttta

SEQ ID NO: 52722 - DNA, 25 bp, Homo sapien
aaaccctgctgttcccagtccagct

SEQ ID NO: 52723 - DNA, 25 bp, Homo sapien
tgctgtgtcccaatttgctgccagt

SEQ ID NO: 52724 - DNA, 25 bp, Homo sapien
gctgtgtcccaatttgctgccagtg

SEQ ID NO: 52725 - DNA, 25 bp, Homo sapien
ctgtgtcccaatttgctgccagtgc

SEQ ID NO: 52726 - DNA, 25 bp, Homo sapien
tgtgtcccaatttgctgccagtgca

SEQ ID NO: 52727 - DNA, 25 bp, Homo sapien
gtgtcccaatttgctgccagtgcaa

SEQ ID NO: 52728 - DNA, 25 bp, Homo sapien
tgtcccaatttgctgccagtgcaag

SEQ ID NO: 52729 - DNA, 25 bp, Homo sapien
gtcccaatttgctgccagtgcaaga

SEQ ID NO: 52730 - DNA, 25 bp, Homo sapien
tcccaatttgctgccagtgcaagat

SEQ ID NO: 52731 - DNA, 25 bp, Homo sapien
ccaatttgctgccagtgcaagatct

SEQ ID NO: 52732 - DNA, 25 bp, Homo sapien
caatttgctgccagtgcaagatctg

SEQ ID NO: 52733 - DNA, 25 bp, Homo sapien
actcagatggccgacgagctgaggc

SEQ ID NO: 52734 - DNA, 25 bp, Homo sapien
gctgaggcggcacctggagctgaaa

SEQ ID NO: 52735 - DNA, 25 bp, Homo sapien
gtggtgctgggtgccatcgagaaca

SEQ ID NO: 52736 - DNA, 25 bp, Homo sapien
catcgagaacaaggtggagagcaaa

SEQ ID NO: 52737 - DNA, 25 bp, Homo sapien
gagagcaaaggcaattcacctccga

SEQ ID NO: 52738 - DNA, 25 bp, Homo sapien
attcacctccgagctcaggagaggc

SEQ ID NO: 52739 - DNA, 25 bp, Homo sapien
caggagaggcctgtcgcgaggagaa

SEQ ID NO: 52740 - DNA, 25 bp, Homo sapien
gaagggcctggctgccgaggatagt

SEQ ID NO: 52741 - DNA, 25 bp, Homo sapien
tcagcgaggtcagcgagaccacaga

SEQ ID NO: 52742 - DNA, 25 bp, Homo sapien
cagcgagaccacagagagcacagat

SEQ ID NO: 52743 - DNA, 25 bp, Homo sapien
cagatgtcaaggacagctcagaggc

SEQ ID NO: 52744 - DNA, 25 bp, Homo sapien
gggccctccttgtcattgaccttag

SEQ ID NO: 52745 - DNA, 25 bp, Homo sapien
ttgtcattgaccttagctaaaccat

SEQ ID NO: 52746 - DNA, 25 bp, Homo sapien
tgaccttagctaaaccatggcaatt

SEQ ID NO: 52747 - DNA, 25 bp, Homo sapien
tagctaaaccatggcaattcataaa

SEQ ID NO: 52748 - DNA, 25 bp, Homo sapien
ttcctttgacagatggtatcccttc

SEQ ID NO: 52749 - DNA, 25 bp, Homo sapien
ttgacagatggtatcccttcctgga

SEQ ID NO: 52750 - DNA, 25 bp, Homo sapien
gatggtatcccttcctggatcattc

SEQ ID NO: 52751 - DNA, 25 bp, Homo sapien
ggatcattcatttcaccttggtttc

SEQ ID NO: 52752 - DNA, 25 bp, Homo sapien
taggtttactttcacttgttatttg

SEQ ID NO: 52753 - DNA, 25 bp, Homo sapien
gttatttgacttagcaggtgcaaca

SEQ ID NO: 52754 - DNA, 25 bp, Homo sapien
acaagaaacaaatgtgcccacccca

SEQ ID NO: 52755 - DNA, 25 bp, Homo sapien
cagggattatgtcaaggcttctttc

SEQ ID NO: 52756 - DNA, 25 bp, Homo sapien
ggcttctttcaaggaggctcataaa

SEQ ID NO: 52757 - DNA, 25 bp, Homo sapien
cataaaagcagtgacctcatccggg

SEQ ID NO: 52758 - DNA, 25 bp, Homo sapien
ggatagagtgagaattccccaacta

SEQ ID NO: 52759 - DNA, 25 bp, Homo sapien
tccccaactaaattggacttctctg

SEQ ID NO: 52760 - DNA, 25 bp, Homo sapien
ttggacttctctgctttatcccctt

SEQ ID NO: 52761 - DNA, 25 bp, Homo sapien
atctgcactacatttctggctgatc

SEQ ID NO: 52762 - DNA, 25 bp, Homo sapien
tacatttctggctgatcccaatcag

SEQ ID NO: 52763 - DNA, 25 bp, Homo sapien
tcccaatcagattcccgctaatgga

SEQ ID NO: 52764 - DNA, 25 bp, Homo sapien
gattcccgctaatggaagaagttta

SEQ ID NO: 52765 - DNA, 25 bp, Homo sapien
gaagtttagaatctttcaggtggaa

SEQ ID NO: 52766 - DNA, 25 bp, Homo sapien
aaccgcaatctctccaagacggagt

SEQ ID NO: 52767 - DNA, 25 bp, Homo sapien
cgcaatctctccaagacggagttcc

SEQ ID NO: 52768 - DNA, 25 bp, Homo sapien
agagctggctgcctttacaaagaac

SEQ ID NO: 52769 - DNA, 25 bp, Homo sapien
agctggctgcctttacaaagaacca

SEQ ID NO: 52770 - DNA, 25 bp, Homo sapien
cccggtgtccttgaccacatgaaga

SEQ ID NO: 52771 - DNA, 25 bp, Homo sapien
aactggatgtcagcagtgatgggca

SEQ ID NO: 52772 - DNA, 25 bp, Homo sapien
gtcagcagtgatgggcagttagatt

SEQ ID NO: 52773 - DNA, 25 bp, Homo sapien
gtgatgggcagttagatttcccaaa

SEQ ID NO: 52774 - DNA, 25 bp, Homo sapien
tgggcagttagatttcccaaaattt

SEQ ID NO: 52775 - DNA, 25 bp, Homo sapien
gaaaggatggttacaaccgcaatct

SEQ ID NO: 52776 - DNA, 25 bp, Homo sapien
tggttacaaccgcaatctctccaag

SEQ ID NO: 52777 - DNA, 25 bp, Homo sapien
tatactctggaaggcagtccctgga

SEQ ID NO: 52778 - DNA, 25 bp, Homo sapien
ggcggatgacagatgggaccctcct

SEQ ID NO: 52779 - DNA, 25 bp, Homo sapien
tgggaccctcctctggccaaatgta

SEQ ID NO: 52780 - DNA, 25 bp, Homo sapien
aaatgtacctctcgtgcacatgatg

SEQ ID NO: 52781 - DNA, 25 bp, Homo sapien
gtgcacatgatgctctcatagttgg

SEQ ID NO: 52782 - DNA, 25 bp, Homo sapien
atagttggcactttatctggtacga

SEQ ID NO: 52783 - DNA, 25 bp, Homo sapien
atctggtacgatcttctttatttta

SEQ ID NO: 52784 - DNA, 25 bp, Homo sapien
atcattttcctctcttggataattc

SEQ ID NO: 52785 - DNA, 25 bp, Homo sapien
gaagtggctatccatttacattctc

SEQ ID NO: 52786 - DNA, 25 bp, Homo sapien
ttctcaaggaggcagcagcgttcat

SEQ ID NO: 52787 - DNA, 25 bp, Homo sapien
aagaaaatagcagggtccttccttg

SEQ ID NO: 52788 - DNA, 25 bp, Homo sapien
tattttatctagttacctttcatta

SEQ ID NO: 52789 - DNA, 25 bp, Homo sapien
tagttacctttcattaacaaccaat

SEQ ID NO: 52790 - DNA, 25 bp, Homo sapien
caaccaattttaaccgtgtgtcaag

SEQ ID NO: 52791 - DNA, 25 bp, Homo sapien
ttttaaccgtgtgtcaagatttggt

SEQ ID NO: 52792 - DNA, 25 bp, Homo sapien
aagatttggttaagtcttgcctgac

SEQ ID NO: 52793 - DNA, 25 bp, Homo sapien
tggttaagtcttgcctgacagaact

SEQ ID NO: 52794 - DNA, 25 bp, Homo sapien
aagtcttgcctgacagaactcaaag

SEQ ID NO: 52795 - DNA, 25 bp, Homo sapien
tcttgcctgacagaactcaaagaca

SEQ ID NO: 52796 - DNA, 25 bp, Homo sapien
tctatcagcttattccttctctact

SEQ ID NO: 52797 - DNA, 25 bp, Homo sapien
tccttctctactggaatattggtat

SEQ ID NO: 52798 - DNA, 25 bp, Homo sapien
taaagcccagaaatttgaaaagaat

SEQ ID NO: 52799 - DNA, 25 bp, Homo sapien
agccaagggtgccaggcctaactgg

SEQ ID NO: 52800 - DNA, 25 bp, Homo sapien
actcagggcagtgtgttggaaattc

SEQ ID NO: 52801 - DNA, 25 bp, Homo sapien
aaatcaggtgctgcggccgcctggg

SEQ ID NO: 52802 - DNA, 25 bp, Homo sapien
tcaagcccatctccacaacctcgag

SEQ ID NO: 52803 - DNA, 25 bp, Homo sapien
acaacctcgagcctgggctctggtc

SEQ ID NO: 52804 - DNA, 25 bp, Homo sapien
gagcctgggctctggtccactactg

SEQ ID NO: 52805 - DNA, 25 bp, Homo sapien
gaccaccctcaaagctggtcttcag

SEQ ID NO: 52806 - DNA, 25 bp, Homo sapien
ggtcttcagaaatcaataatatgag

SEQ ID NO: 52807 - DNA, 25 bp, Homo sapien
gtttattttggagtctagtatttca

SEQ ID NO: 52808 - DNA, 25 bp, Homo sapien
tggagtctagtatttcaataattta

SEQ ID NO: 52809 - DNA, 25 bp, Homo sapien
taagaatcagaagcactgacctttc

SEQ ID NO: 52810 - DNA, 25 bp, Homo sapien
gaaacagctgcgcccctcaggaaaa

SEQ ID NO: 52811 - DNA, 25 bp, Homo sapien
aaacagctgcgcccctcaggaaaac

SEQ ID NO: 52812 - DNA, 25 bp, Homo sapien
ggaaaactaaatacctctgagaagg

SEQ ID NO: 52813 - DNA, 25 bp, Homo sapien
gaaaactaaatacctctgagaaggt

SEQ ID NO: 52814 - DNA, 25 bp, Homo sapien
ctaaatacctctgagaaggttaaca

SEQ ID NO: 52815 - DNA, 25 bp, Homo sapien
taaatacctctgagaaggttaacaa

SEQ ID NO: 52816 - DNA, 25 bp, Homo sapien
aaatacctctgagaaggttaacaag

SEQ ID NO: 52817 - DNA, 25 bp, Homo sapien
aatacctctgagaaggttaacaaga

SEQ ID NO: 52818 - DNA, 25 bp, Homo sapien
atacctctgagaaggttaacaagac

SEQ ID NO: 52819 - DNA, 25 bp, Homo sapien
tacctctgagaaggttaacaagaca

SEQ ID NO: 52820 - DNA, 25 bp, Homo sapien
acctctgagaaggttaacaagacat

SEQ ID NO: 52821 - DNA, 25 bp, Homo sapien
accgcaatctctccaagacggagtt

SEQ ID NO: 52822 - DNA, 25 bp, Homo sapien
agagctggctgcctttacaaagaac

SEQ ID NO: 52823 - DNA, 25 bp, Homo sapien
agctggctgcctttacaaagaacca

SEQ ID NO: 52824 - DNA, 25 bp, Homo sapien
cccggtgtccttgaccacatgaaga

SEQ ID NO: 52825 - DNA, 25 bp, Homo sapien
aactggatgtcagcagtgatgggca

SEQ ID NO: 52826 - DNA, 25 bp, Homo sapien
gtcagcagtgatgggcagttagatt

SEQ ID NO: 52827 - DNA, 25 bp, Homo sapien
gatgggcagttagatttcccaaaat

SEQ ID NO: 52828 - DNA, 25 bp, Homo sapien
actgagcggtgcattgagtccctga

SEQ ID NO: 52829 - DNA, 25 bp, Homo sapien
agtccctgattgctgttttccagaa

SEQ ID NO: 52830 - DNA, 25 bp, Homo sapien
gaaaggatggttacaaccgcaatct

SEQ ID NO: 52831 - DNA, 25 bp, Homo sapien
tggttacaaccgcaatctctccaag

SEQ ID NO: 52832 - DNA, 25 bp, Homo sapien
tgatggacgcgcagctgaggctcca

SEQ ID NO: 52833 - DNA, 25 bp, Homo sapien
ccccaacttcctggcctgcaagcag

SEQ ID NO: 52834 - DNA, 25 bp, Homo sapien
acgactgggactactgcgagcaccg

SEQ ID NO: 52835 - DNA, 25 bp, Homo sapien
gactgggactactgcgagcaccgcg

SEQ ID NO: 52836 - DNA, 25 bp, Homo sapien
actgggactactgcgagcaccgcga

SEQ ID NO: 52837 - DNA, 25 bp, Homo sapien
tgggactactgcgagcaccgcgact

SEQ ID NO: 52838 - DNA, 25 bp, Homo sapien
ggactactgcgagcaccgcgactat

SEQ ID NO: 52839 - DNA, 25 bp, Homo sapien
actactgcgagcaccgcgactatgt

SEQ ID NO: 52840 - DNA, 25 bp, Homo sapien
ctactgcgagcaccgcgactatgtg

SEQ ID NO: 52841 - DNA, 25 bp, Homo sapien
actgcgagcaccgcgactatgtgat

SEQ ID NO: 52842 - DNA, 25 bp, Homo sapien
gaagaaggcggcagagttggccaaa

SEQ ID NO: 52843 - DNA, 25 bp, Homo sapien
tgtaatgactagaaagctgctttgc

SEQ ID NO: 52844 - DNA, 25 bp, Homo sapien
ctgctttgctccctatattgagaaa

SEQ ID NO: 52845 - DNA, 25 bp, Homo sapien
ggacatggtatgtgttatccaaaga

SEQ ID NO: 52846 - DNA, 25 bp, Homo sapien
agatttctatccttagctttggcat

SEQ ID NO: 52847 - DNA, 25 bp, Homo sapien
cttagctttggcattattgactgga

SEQ ID NO: 52848 - DNA, 25 bp, Homo sapien
gaacaagtcgcttaacttctacaag

SEQ ID NO: 52849 - DNA, 25 bp, Homo sapien
caagcttgtttccttatttgtcaaa

SEQ ID NO: 52850 - DNA, 25 bp, Homo sapien
gattacactaggaaacgattctcga

SEQ ID NO: 52851 - DNA, 25 bp, Homo sapien
gattctcgaacatgttttaacctta

SEQ ID NO: 52852 - DNA, 25 bp, Homo sapien
catgttttaaccttacaactctttg

SEQ ID NO: 52853 - DNA, 25 bp, Homo sapien
taaatctttcaatgaatccccaaca

SEQ ID NO: 52854 - DNA, 25 bp, Homo sapien
aagtggagaaccacacggcgtgcca

SEQ ID NO: 52855 - DNA, 25 bp, Homo sapien
cgtgccactgcagtacttgttatta

SEQ ID NO: 52856 - DNA, 25 bp, Homo sapien
aatgttttaccaagtgctgtcttga

SEQ ID NO: 52857 - DNA, 25 bp, Homo sapien
aagtgctgtcttgatgactgctgat

SEQ ID NO: 52858 - DNA, 25 bp, Homo sapien
atgactgctgattttctggaatgga

SEQ ID NO: 52859 - DNA, 25 bp, Homo sapien
gtgagataaaactctccttttcctt

SEQ ID NO: 52860 - DNA, 25 bp, Homo sapien
ttaccataccactttgacacgcttc

SEQ ID NO: 52861 - DNA, 25 bp, Homo sapien
gacacgcttcaaggatatactgcag

SEQ ID NO: 52862 - DNA, 25 bp, Homo sapien
atatactgcagctttactgccttcc

SEQ ID NO: 52863 - DNA, 25 bp, Homo sapien
ttcctccttatcctacagtacaatc

SEQ ID NO: 52864 - DNA, 25 bp, Homo sapien
cagcagtctagttcttttcatttgg

SEQ ID NO: 52865 - DNA, 25 bp, Homo sapien
gccaaagagaactacatactgccca

SEQ ID NO: 52866 - DNA, 25 bp, Homo sapien
gaactacatactgcccagttcaaga

SEQ ID NO: 52867 - DNA, 25 bp, Homo sapien
ccagttcaagagacgggaataccca

SEQ ID NO: 52868 - DNA, 25 bp, Homo sapien
gggaatacccagatggcactgttaa

SEQ ID NO: 52869 - DNA, 25 bp, Homo sapien
gatggcactgttaaaaccgtatatg

SEQ ID NO: 52870 - DNA, 25 bp, Homo sapien
gcaaacggtcatcaagaaacgaagt

SEQ ID NO: 52871 - DNA, 25 bp, Homo sapien
aacgaagtacagatccggtcggata

SEQ ID NO: 52872 - DNA, 25 bp, Homo sapien
gatccggtcggataagagttaagga

SEQ ID NO: 52873 - DNA, 25 bp, Homo sapien
caaggagggtaatgtgtcaatggac

SEQ ID NO: 52874 - DNA, 25 bp, Homo sapien
tcaatggacacggagctgtgacgat

SEQ ID NO: 52875 - DNA, 25 bp, Homo sapien
gtgacgatcctcatgtgatcatgaa

SEQ ID NO: 52876 - DNA, 25 bp, Homo sapien
ataattcataccaaacagaagccct

SEQ ID NO: 52877 - DNA, 25 bp, Homo sapien
taattcataccaaacagaagcccta

SEQ ID NO: 52878 - DNA, 25 bp, Homo sapien
aattcataccaaacagaagccctac

SEQ ID NO: 52879 - DNA, 25 bp, Homo sapien
cctataaacctataacaagttctca

SEQ ID NO: 52880 - DNA, 25 bp, Homo sapien
taaacctataacaagttctcaattc

SEQ ID NO: 52881 - DNA, 25 bp, Homo sapien
aacctataacaagttctcaattcct

SEQ ID NO: 52882 - DNA, 25 bp, Homo sapien
acctataacaagttctcaattcctt

SEQ ID NO: 52883 - DNA, 25 bp, Homo sapien
cctataacaagttctcaattccttt

SEQ ID NO: 52884 - DNA, 25 bp, Homo sapien
ctataacaagttctcaattcctttt

SEQ ID NO: 52885 - DNA, 25 bp, Homo sapien
attacacataattcataccaaacag

SEQ ID NO: 52886 - DNA, 25 bp, Homo sapien
ttacacataattcataccaaacaga

SEQ ID NO: 52887 - DNA, 25 bp, Homo sapien
tttttgtgctgaacactgggcagcc

SEQ ID NO: 52888 - DNA, 25 bp, Homo sapien
gccttgttgccaacgtgcttctggg

SEQ ID NO: 52889 - DNA, 25 bp, Homo sapien
cctgtgactgctgccggatgctgtg

SEQ ID NO: 52890 - DNA, 25 bp, Homo sapien
tgactgctgccggatgctgtgcaca

SEQ ID NO: 52891 - DNA, 25 bp, Homo sapien
actgctgccggatgctgtgcacaca

SEQ ID NO: 52892 - DNA, 25 bp, Homo sapien
ctgctgccggatgctgtgcacacag

SEQ ID NO: 52893 - DNA, 25 bp, Homo sapien
cggatgctgtgcacacaggcagagt

SEQ ID NO: 52894 - DNA, 25 bp, Homo sapien
agccagaactgggaaccccgcggag

SEQ ID NO: 52895 - DNA, 25 bp, Homo sapien
tttaatcttgtttgttgcgcaatgg

SEQ ID NO: 52896 - DNA, 25 bp, Homo sapien
ttaatcttgtttgttgcgcaatgga

SEQ ID NO: 52897 - DNA, 25 bp, Homo sapien
atcttgtttgttgcgcaatggaaat

SEQ ID NO: 52898 - DNA, 25 bp, Homo sapien
tccttctctttttcaacaaacttga

SEQ ID NO: 52899 - DNA, 25 bp, Homo sapien
tggttcatcatggaaatgattctca

SEQ ID NO: 52900 - DNA, 25 bp, Homo sapien
ggttcatcatggaaatgattctcat

SEQ ID NO: 52901 - DNA, 25 bp, Homo sapien
ttctcattgactaatgcatcatctc

SEQ ID NO: 52902 - DNA, 25 bp, Homo sapien
tctcattgactaatgcatcatctca

SEQ ID NO: 52903 - DNA, 25 bp, Homo sapien
ctcattgactaatgcatcatctcac

SEQ ID NO: 52904 - DNA, 25 bp, Homo sapien
tcattgactaatgcatcatctcaca

SEQ ID NO: 52905 - DNA, 25 bp, Homo sapien
cattgactaatgcatcatctcacac

SEQ ID NO: 52906 - DNA, 25 bp, Homo sapien
aatgcatcatctcacactttcatga

SEQ ID NO: 52907 - DNA, 25 bp, Homo sapien
tcatgagttcttccatttcaaagac

SEQ ID NO: 52908 - DNA, 25 bp, Homo sapien
caaagactcacttctataaccacca

SEQ ID NO: 52909 - DNA, 25 bp, Homo sapien
accaaggtcacacgttccgtgctgt

SEQ ID NO: 52910 - DNA, 25 bp, Homo sapien
tctggtggacgtttcaagtggcatt

SEQ ID NO: 52911 - DNA, 25 bp, Homo sapien
tttgtacaatgcaggttagaattca

SEQ ID NO: 52912 - DNA, 25 bp, Homo sapien
gaatttcaagtatgtgcccgggtct

SEQ ID NO: 52913 - DNA, 25 bp, Homo sapien
gtatgtgcccgggtctgtcaggtcc

SEQ ID NO: 52914 - DNA, 25 bp, Homo sapien
gggtctgtcaggtcccagttgcctt

SEQ ID NO: 52915 - DNA, 25 bp, Homo sapien
caggtcccagttgcctttctgacgg

SEQ ID NO: 52916 - DNA, 25 bp, Homo sapien
gggacggcgacgagcactaaatgct

SEQ ID NO: 52917 - DNA, 25 bp, Homo sapien
ggcgacgagcactaaatgctttttt

SEQ ID NO: 52918 - DNA, 25 bp, Homo sapien
aatgcttttttgactattttcctat

SEQ ID NO: 52919 - DNA, 25 bp, Homo sapien
ttcctcctgttccaattgatagctt

SEQ ID NO: 52920 - DNA, 25 bp, Homo sapien
gggaagctgcggctacacattccac

SEQ ID NO: 52921 - DNA, 25 bp, Homo sapien
ggctacacattccacaaagtgctgg

SEQ ID NO: 52922 - DNA, 25 bp, Homo sapien
aaagtgctggcacttacacccacaa

SEQ ID NO: 52923 - DNA, 25 bp, Homo sapien
ttacacccacaacccggaaggctgt

SEQ ID NO: 52924 - DNA, 25 bp, Homo sapien
gaaggctgtggaccgattcctctag

SEQ ID NO: 52925 - DNA, 25 bp, Homo sapien
gaccgattcctctagggtggtgacc

SEQ ID NO: 52926 - DNA, 25 bp, Homo sapien
tagggtggtgacctcccattagcaa

SEQ ID NO: 52927 - DNA, 25 bp, Homo sapien
gacctcccattagcaaacggtgtca

SEQ ID NO: 52928 - DNA, 25 bp, Homo sapien
aacggtgtcatggtttggaatgttc

SEQ ID NO: 52929 - DNA, 25 bp, Homo sapien
gttcattatcgccaagaacctggtt

SEQ ID NO: 52930 - DNA, 25 bp, Homo sapien
ttttttggtgtgttgtacagcagta

SEQ ID NO: 52931 - DNA, 25 bp, Homo sapien
ccctcctacctgtgagagatatttg

SEQ ID NO: 52932 - DNA, 25 bp, Homo sapien
tatgtgaatgagcttatccctccac

SEQ ID NO: 52933 - DNA, 25 bp, Homo sapien
tatccctccacaaccaggtgcatat

SEQ ID NO: 52934 - DNA, 25 bp, Homo sapien
aaccaggtgcatatgaaagtgtaca

SEQ ID NO: 52935 - DNA, 25 bp, Homo sapien
tgtacatattatgactgccaagtat

SEQ ID NO: 52936 - DNA, 25 bp, Homo sapien
gacctggagtctatgctaggaagct

SEQ ID NO: 52937 - DNA, 25 bp, Homo sapien
gaagctgagatattttggtattgca

SEQ ID NO: 52938 - DNA, 25 bp, Homo sapien
gtattgcattggtttttatggtaac

SEQ ID NO: 52939 - DNA, 25 bp, Homo sapien
ggtaactaggttttgcatgcaatta

SEQ ID NO: 52940 - DNA, 25 bp, Homo sapien
ttatttcttgttctagggcttccct

SEQ ID NO: 52941 - DNA, 25 bp, Homo sapien
tctagggcttcccttagttaatggt

SEQ ID NO: 52942 - DNA, 25 bp, Homo sapien
attgttgataaagccagtcccttca

SEQ ID NO: 52943 - DNA, 25 bp, Homo sapien
agtcccttcatttaactgtctttca

SEQ ID NO: 52944 - DNA, 25 bp, Homo sapien
ttaactgtctttcaggatgttcctt

SEQ ID NO: 52945 - DNA, 25 bp, Homo sapien
gatgttccttcgttgtttccatgag

SEQ ID NO: 52946 - DNA, 25 bp, Homo sapien
tgtttccatgagtattgcaggtaat

SEQ ID NO: 52947 - DNA, 25 bp, Homo sapien
gtgtgttccataagaatctcaatct

SEQ ID NO: 52948 - DNA, 25 bp, Homo sapien
atgccttgtttctttgcacctcttt

SEQ ID NO: 52949 - DNA, 25 bp, Homo sapien
gcacctcttttcaagtccttacatt

SEQ ID NO: 52950 - DNA, 25 bp, Homo sapien
gcagcagcttcctacatatagtagg

SEQ ID NO: 52951 - DNA, 25 bp, Homo sapien
ggaaactgccacatttttgctatca

SEQ ID NO: 52952 - DNA, 25 bp, Homo sapien
ttgctatcatgattggctgggcctg

SEQ ID NO: 52953 - DNA, 25 bp, Homo sapien
ggatacgctgcattttattgtgatg

SEQ ID NO: 52954 - DNA, 25 bp, Homo sapien
gagaatgttcttttccacttaacgc

SEQ ID NO: 52955 - DNA, 25 bp, Homo sapien
accaaccacgctatagttcagactc

SEQ ID NO: 52956 - DNA, 25 bp, Homo sapien
gttcagactctggttcatctgatgt

SEQ ID NO: 52957 - DNA, 25 bp, Homo sapien
tcatctgatgtttcctgaccacgta

SEQ ID NO: 52958 - DNA, 25 bp, Homo sapien
tgaccacgtaccaaagccttgttgt

SEQ ID NO: 52959 - DNA, 25 bp, Homo sapien
aaagccttgttgtgctccaaccaaa

SEQ ID NO: 52960 - DNA, 25 bp, Homo sapien
ttaaatgccatctctgttctgtact

SEQ ID NO: 52961 - DNA, 25 bp, Homo sapien
tgttctgtactttgatgacagctcc

SEQ ID NO: 52962 - DNA, 25 bp, Homo sapien
atggtagtacgctcatgtggctgcc

SEQ ID NO: 52963 - DNA, 25 bp, Homo sapien
tgtggctgccactaatattaaataa

SEQ ID NO: 52964 - DNA, 25 bp, Homo sapien
tgcctccaaattatgaagcccgtga

SEQ ID NO: 52965 - DNA, 25 bp, Homo sapien
ctccaaattatgaagcccgtgaacc

SEQ ID NO: 52966 - DNA, 25 bp, Homo sapien
atgaagcccgtgaaccaagacagac

SEQ ID NO: 52967 - DNA, 25 bp, Homo sapien
gcccgtgaaccaagacagaccaatt

SEQ ID NO: 52968 - DNA, 25 bp, Homo sapien
gacagaccaattagcttgtgaccaa

SEQ ID NO: 52969 - DNA, 25 bp, Homo sapien
gcttgtgaccaattgtctaacttcg

SEQ ID NO: 52970 - DNA, 25 bp, Homo sapien
gaccaattgtctaacttcggaccta

SEQ ID NO: 52971 - DNA, 25 bp, Homo sapien
gtctaacttcggacctatacttatg

SEQ ID NO: 52972 - DNA, 25 bp, Homo sapien
aacttcggacctatacttatgagga

SEQ ID NO: 52973 - DNA, 25 bp, Homo sapien
ggacctatacttatgaggaagctca

SEQ ID NO: 52974 - DNA, 25 bp, Homo sapien
ttatgaggaagctcatctttctccc

SEQ ID NO: 52975 - DNA, 25 bp, Homo sapien
tgcccgcgcgaagtgggcattgcaa

SEQ ID NO: 52976 - DNA, 25 bp, Homo sapien
gtgggcattgcaaagtgcgctcatt

SEQ ID NO: 52977 - DNA, 25 bp, Homo sapien
tgcaaagtgcgctcattttaggcct

SEQ ID NO: 52978 - DNA, 25 bp, Homo sapien
aaagtgcgctcattttaggcctcct

SEQ ID NO: 52979 - DNA, 25 bp, Homo sapien
agtgcgctcattttaggcctcctct

SEQ ID NO: 52980 - DNA, 25 bp, Homo sapien
cataatcccattcaaagaatactag

SEQ ID NO: 52981 - DNA, 25 bp, Homo sapien
gaatactagaatggtagcactaccc

SEQ ID NO: 52982 - DNA, 25 bp, Homo sapien
gaatggtagcactacccggccggag

SEQ ID NO: 52983 - DNA, 25 bp, Homo sapien
ggcggcggccctcaaaagcacttgt

SEQ ID NO: 52984 - DNA, 25 bp, Homo sapien
tcaaaagcacttgttccttctgctt

SEQ ID NO: 52985 - DNA, 25 bp, Homo sapien
taggctgggttcattccccggccct

SEQ ID NO: 52986 - DNA, 25 bp, Homo sapien
actacagaaaggctttcctctcggc

SEQ ID NO: 52987 - DNA, 25 bp, Homo sapien
gtgagcagcggttggatgccattca

SEQ ID NO: 52988 - DNA, 25 bp, Homo sapien
atgccattcactctgaggtgtccgt

SEQ ID NO: 52989 - DNA, 25 bp, Homo sapien
ggtgtccgtgacattcaaggctaaa

SEQ ID NO: 52990 - DNA, 25 bp, Homo sapien
agaaagaacagtggccccaatgact

SEQ ID NO: 52991 - DNA, 25 bp, Homo sapien
ggccccaatgactctttcacagagg

SEQ ID NO: 52992 - DNA, 25 bp, Homo sapien
acagaggctaccaatgtctaaggaa

SEQ ID NO: 52993 - DNA, 25 bp, Homo sapien
ttccagcttgccgttgacattgaca

SEQ ID NO: 52994 - DNA, 25 bp, Homo sapien
gacattgacagccaggtcctggacc

SEQ ID NO: 52995 - DNA, 25 bp, Homo sapien
gagtacaaactcatcttcacagtgt

SEQ ID NO: 52996 - DNA, 25 bp, Homo sapien
gccatgtgctccacttttgccaatc

SEQ ID NO: 52997 - DNA, 25 bp, Homo sapien
gaacaaagctcttattcaactgcga

SEQ ID NO: 52998 - DNA, 25 bp, Homo sapien
tcaactgcgaattccatagtgggct

SEQ ID NO: 52999 - DNA, 25 bp, Homo sapien
gcgaattccatagtgggctctggct

SEQ ID NO: 53000 - DNA, 25 bp, Homo sapien
ctggcttttcttgaatagatatcac

SEQ ID NO: 53001 - DNA, 25 bp, Homo sapien
tatcacaaggttgcttattatcaaa

SEQ ID NO: 53002 - DNA, 25 bp, Homo sapien
actgttaacacttttcactctttct

SEQ ID NO: 53003 - DNA, 25 bp, Homo sapien
cactctttctgttgattcacctaac

SEQ ID NO: 53004 - DNA, 25 bp, Homo sapien
gattcacctaactcattattttgct

SEQ ID NO: 53005 - DNA, 25 bp, Homo sapien
tgctttattaaaagtcttccttcac

SEQ ID NO: 53006 - DNA, 25 bp, Homo sapien
tccttcaccaccgagatatgctaat

SEQ ID NO: 53007 - DNA, 25 bp, Homo sapien
cttgagtttgtatcacatgttactt

SEQ ID NO: 53008 - DNA, 25 bp, Homo sapien
gtgtcttcagcagtgttcagagcca

SEQ ID NO: 53009 - DNA, 25 bp, Homo sapien
agttgaagttgcctagaccagagga

SEQ ID NO: 53010 - DNA, 25 bp, Homo sapien
aagtatcatgtctcctttaactagc

SEQ ID NO: 53011 - DNA, 25 bp, Homo sapien
ttaactagcataccccgaagtggag

SEQ ID NO: 53012 - DNA, 25 bp, Homo sapien
aagggtgcagcaggctcaaaggcat

SEQ ID NO: 53013 - DNA, 25 bp, Homo sapien
gcataagtcattccaatcagccaac

SEQ ID NO: 53014 - DNA, 25 bp, Homo sapien
gccaactaagttgtccttttctggt

SEQ ID NO: 53015 - DNA, 25 bp, Homo sapien
tctggtttcgtgttcaccatggaac

SEQ ID NO: 53016 - DNA, 25 bp, Homo sapien
aatccttctatcttgaatcttctag

SEQ ID NO: 53017 - DNA, 25 bp, Homo sapien
gaatcttctagagagttgctgacca

SEQ ID NO: 53018 - DNA, 25 bp, Homo sapien
tgaccaactgacgtatgtttccctt

SEQ ID NO: 53019 - DNA, 25 bp, Homo sapien
ttaaagtcttcaacactatgcgctt

SEQ ID NO: 53020 - DNA, 25 bp, Homo sapien
gtcttcaacactatgcgctttatca

SEQ ID NO: 53021 - DNA, 25 bp, Homo sapien
cactatgcgctttatcatattattc

SEQ ID NO: 53022 - DNA, 25 bp, Homo sapien
atattattcacagatgcatttttga

SEQ ID NO: 53023 - DNA, 25 bp, Homo sapien
gtatgtaacgtgctgtttattaaca

SEQ ID NO: 53024 - DNA, 25 bp, Homo sapien
ttgttcacaacatctcatgtagttt

SEQ ID NO: 53025 - DNA, 25 bp, Homo sapien
ttgtaaatactgcttctgttttgtt

SEQ ID NO: 53026 - DNA, 25 bp, Homo sapien
gtttctcctttatacacttgactgt

SEQ ID NO: 53027 - DNA, 25 bp, Homo sapien
cctttatacacttgactgtctttgt

SEQ ID NO: 53028 - DNA, 25 bp, Homo sapien
taggattaagtatgttttcctgaaa

SEQ ID NO: 53029 - DNA, 25 bp, Homo sapien
gaatgaaatccttcaagtgttataa

SEQ ID NO: 53030 - DNA, 25 bp, Homo sapien
gtctccaccctcgtatgatagtgtg

SEQ ID NO: 53031 - DNA, 25 bp, Homo sapien
accctcgtatgatagtgtgaccaaa

SEQ ID NO: 53032 - DNA, 25 bp, Homo sapien
gatagtgtgaccaaaccagaaaaag

SEQ ID NO: 53033 - DNA, 25 bp, Homo sapien
aagaattttccattttgtgatcaat

SEQ ID NO: 53034 - DNA, 25 bp, Homo sapien
caattgtttacagcccgtgatggtg

SEQ ID NO: 53035 - DNA, 25 bp, Homo sapien
tttgtgtcaacaggactcccacagg

SEQ ID NO: 53036 - DNA, 25 bp, Homo sapien
aacaggactcccacaggaggtctat

SEQ ID NO: 53037 - DNA, 25 bp, Homo sapien
tcccacaggaggtctatgccaaact

SEQ ID NO: 53038 - DNA, 25 bp, Homo sapien
caaatgtatacttaaggtcagtgcc

SEQ ID NO: 53039 - DNA, 25 bp, Homo sapien
gtgcctataacaagacagagacctc

SEQ ID NO: 53040 - DNA, 25 bp, Homo sapien
gagacctctggtcagcaaactggaa

SEQ ID NO: 53041 - DNA, 25 bp, Homo sapien
tatctcttgcaacacaaatggttag

SEQ ID NO: 53042 - DNA, 25 bp, Homo sapien
gattgatgacattcgtaagcctgga

SEQ ID NO: 53043 - DNA, 25 bp, Homo sapien
cattcgtaagcctggagaatctgaa

SEQ ID NO: 53044 - DNA, 25 bp, Homo sapien
gtaaatggatgtctcgtgatgcgtc

SEQ ID NO: 53045 - DNA, 25 bp, Homo sapien
atggatgtctcgtgatgcgtctaca

SEQ ID NO: 53046 - DNA, 25 bp, Homo sapien
atgtctcgtgatgcgtctacagtta

SEQ ID NO: 53047 - DNA, 25 bp, Homo sapien
ctcgtgatgcgtctacagttattta

SEQ ID NO: 53048 - DNA, 25 bp, Homo sapien
gatgcgtctacagttatttattgtt

SEQ ID NO: 53049 - DNA, 25 bp, Homo sapien
ttgttacatccttttccagacactg

SEQ ID NO: 53050 - DNA, 25 bp, Homo sapien
atccttttccagacactgtagatgc

SEQ ID NO: 53051 - DNA, 25 bp, Homo sapien
ttccagacactgtagatgctataat

SEQ ID NO: 53052 - DNA, 25 bp, Homo sapien
caagggtcctcatcacctattgcag

SEQ ID NO: 53053 - DNA, 25 bp, Homo sapien
tcatcacctattgcagccttcaggg

SEQ ID NO: 53054 - DNA, 25 bp, Homo sapien
acctattgcagccttcagggctcgg

SEQ ID NO: 53055 - DNA, 25 bp, Homo sapien
tcagggctcggcctattttccacta

SEQ ID NO: 53056 - DNA, 25 bp, Homo sapien
agggctcggcctattttccactact

SEQ ID NO: 53057 - DNA, 25 bp, Homo sapien
gtcccctttagctgcctcctattga

SEQ ID NO: 53058 - DNA, 25 bp, Homo sapien
gctgcctcctattgatctcagggaa

SEQ ID NO: 53059 - DNA, 25 bp, Homo sapien
agggaagcctgggagtcccttctca

SEQ ID NO: 53060 - DNA, 25 bp, Homo sapien
ctcaacctccggagtccaggagaac

SEQ ID NO: 53061 - DNA, 25 bp, Homo sapien
agagccttaagcaactacttctgtg

SEQ ID NO: 53062 - DNA, 25 bp, Homo sapien
gccttaagcaactacttctgtgaag

SEQ ID NO: 53063 - DNA, 25 bp, Homo sapien
gggagactacacctgacaaactttt

SEQ ID NO: 53064 - DNA, 25 bp, Homo sapien
actacacctgacaaacttttcactc

SEQ ID NO: 53065 - DNA, 25 bp, Homo sapien
gacaaacttttcactcttatagaag

SEQ ID NO: 53066 - DNA, 25 bp, Homo sapien
gggcctgtgtgaacgcaccaatggt

SEQ ID NO: 53067 - DNA, 25 bp, Homo sapien
gtgtgaacgcaccaatggttcaaat

SEQ ID NO: 53068 - DNA, 25 bp, Homo sapien
aattactatgaggatttgacagcta

SEQ ID NO: 53069 - DNA, 25 bp, Homo sapien
ggatttgacagctaaggatattgaa

SEQ ID NO: 53070 - DNA, 25 bp, Homo sapien
gctcaaggctggcaaaatcccaaaa

SEQ ID NO: 53071 - DNA, 25 bp, Homo sapien
aaccagggccaaggagtggacgctt

SEQ ID NO: 53072 - DNA, 25 bp, Homo sapien
agggccaaggagtggacgcttctct

SEQ ID NO: 53073 - DNA, 25 bp, Homo sapien
ccaaggagtggacgcttctcttgtg

SEQ ID NO: 53074 - DNA, 25 bp, Homo sapien
cctaaatctggctggatgacttttc

SEQ ID NO: 53075 - DNA, 25 bp, Homo sapien
atctggctggatgacttttctagaa

SEQ ID NO: 53076 - DNA, 25 bp, Homo sapien
gctggatgacttttctagaagttac

SEQ ID NO: 53077 - DNA, 25 bp, Homo sapien
atgacttttctagaagttacaggaa

SEQ ID NO: 53078 - DNA, 25 bp, Homo sapien
tcctgaagcaatactgttgaccaga

SEQ ID NO: 53079 - DNA, 25 bp, Homo sapien
atactgttgaccagaaaggacactc

SEQ ID NO: 53080 - DNA, 25 bp, Homo sapien
tgtgaaaccggcctaatttttctga

SEQ ID NO: 53081 - DNA, 25 bp, Homo sapien
tgaaaccggcctaatttttctgact

SEQ ID NO: 53082 - DNA, 25 bp, Homo sapien
acgattgccaacacatacttctact

SEQ ID NO: 53083 - DNA, 25 bp, Homo sapien
gattgccaacacatacttctacttt

SEQ ID NO: 53084 - DNA, 25 bp, Homo sapien
ttgccaacacatacttctactttta

SEQ ID NO: 53085 - DNA, 25 bp, Homo sapien
ggtgaagacctatcgaagaaaactt

SEQ ID NO: 53086 - DNA, 25 bp, Homo sapien
gaaaactttgctacgtttctggcta

SEQ ID NO: 53087 - DNA, 25 bp, Homo sapien
gtttctggctaccatttggtttcat

SEQ ID NO: 53088 - DNA, 25 bp, Homo sapien
tatttgtaaccggtctgcttttgcg

SEQ ID NO: 53089 - DNA, 25 bp, Homo sapien
gcttttgcgtaagccaaacacctac

SEQ ID NO: 53090 - DNA, 25 bp, Homo sapien
aacacctacccaaaaatgattccag

SEQ ID NO: 53091 - DNA, 25 bp, Homo sapien
tctgtgatacatgaagactttccat

SEQ ID NO: 53092 - DNA, 25 bp, Homo sapien
gaagactttccatatcaagagacat

SEQ ID NO: 53093 - DNA, 25 bp, Homo sapien
agagacatggtattgactcaacagt

SEQ ID NO: 53094 - DNA, 25 bp, Homo sapien
actcaacagtttccagtcatggcca

SEQ ID NO: 53095 - DNA, 25 bp, Homo sapien
tccagtcatggccaaatgttcaata

SEQ ID NO: 53096 - DNA, 25 bp, Homo sapien
gagacaattcctcaagtggacttgg

SEQ ID NO: 53097 - DNA, 25 bp, Homo sapien
tcaagtggacttggccatgattggt

SEQ ID NO: 53098 - DNA, 25 bp, Homo sapien
gcatactgatgaaactactgatgtc

SEQ ID NO: 53099 - DNA, 25 bp, Homo sapien
gtctgaaggaccctaccagaagcta

SEQ ID NO: 53100 - DNA, 25 bp, Homo sapien
aggaccctaccagaagctaaatcat

SEQ ID NO: 53101 - DNA, 25 bp, Homo sapien
gaatgcaatttccatatcctaatga

SEQ ID NO: 53102 - DNA, 25 bp, Homo sapien
aatgattcaatctcccttaccctga

SEQ ID NO: 53103 - DNA, 25 bp, Homo sapien
taccctgaccaatcagtggcccaaa

SEQ ID NO: 53104 - DNA, 25 bp, Homo sapien
caatcagtggcccaaattttccagc

SEQ ID NO: 53105 - DNA, 25 bp, Homo sapien
agagatttaagaatctcctcctacc

SEQ ID NO: 53106 - DNA, 25 bp, Homo sapien
tcctgactcagcaccatgtaatcat

SEQ ID NO: 53107 - DNA, 25 bp, Homo sapien
ctaccaatcccaactacgtaatagg

SEQ ID NO: 53108 - DNA, 25 bp, Homo sapien
atgtaggatcaaaaggcccatgtat

SEQ ID NO: 53109 - DNA, 25 bp, Homo sapien
agtactgaccactgggccataatgt

SEQ ID NO: 53110 - DNA, 25 bp, Homo sapien
gccataatgttgcttctcaggctat

SEQ ID NO: 53111 - DNA, 25 bp, Homo sapien
ggctatatgcagtcctttagtcaga

SEQ ID NO: 53112 - DNA, 25 bp, Homo sapien
tagtcagaagtcaataggcctattt

SEQ ID NO: 53113 - DNA, 25 bp, Homo sapien
acagaccatattacctggattacca

SEQ ID NO: 53114 - DNA, 25 bp, Homo sapien
tggattaccagggactatctttgct

SEQ ID NO: 53115 - DNA, 25 bp, Homo sapien
ggactatctttgctgcagagatcaa

SEQ ID NO: 53116 - DNA, 25 bp, Homo sapien
gatacttatttttctgaggtcctta

SEQ ID NO: 53117 - DNA, 25 bp, Homo sapien
gaggtccttatgtcctgtcatataa

SEQ ID NO: 53118 - DNA, 25 bp, Homo sapien
gcctatcttctttcacatatgtgtt

SEQ ID NO: 53119 - DNA, 25 bp, Homo sapien
cttttattttatagagcagaaccct

SEQ ID NO: 53120 - DNA, 25 bp, Homo sapien
ttatagagcagaaccctagtctttt

SEQ ID NO: 53121 - DNA, 25 bp, Homo sapien
tagagcagaaccctagtcttttaaa

SEQ ID NO: 53122 - DNA, 25 bp, Homo sapien
gagcagaaccctagtcttttaaaca

SEQ ID NO: 53123 - DNA, 25 bp, Homo sapien
gcagaaccctagtcttttaaacagt

SEQ ID NO: 53124 - DNA, 25 bp, Homo sapien
atgctatatcagtttttactttctc

SEQ ID NO: 53125 - DNA, 25 bp, Homo sapien
atatcagtttttactttctctaggg

SEQ ID NO: 53126 - DNA, 25 bp, Homo sapien
aaatgatcatgggaagagtggttaa

SEQ ID NO: 53127 - DNA, 25 bp, Homo sapien
catgggaagagtggttaagactact

SEQ ID NO: 53128 - DNA, 25 bp, Homo sapien
ataagatttcgatatcttctttttt

SEQ ID NO: 53129 - DNA, 25 bp, Homo sapien
gtagacacttttggctgtctggtaa

SEQ ID NO: 53130 - DNA, 25 bp, Homo sapien
acttttggctgtctggtaacatgga

SEQ ID NO: 53131 - DNA, 25 bp, Homo sapien
gctgtctggtaacatggaaaatctc

SEQ ID NO: 53132 - DNA, 25 bp, Homo sapien
acattacatgatttggtgagcctaa

SEQ ID NO: 53133 - DNA, 25 bp, Homo sapien
atttggtgagcctaattgctgttac

SEQ ID NO: 53134 - DNA, 25 bp, Homo sapien
gtgagcctaattgctgttactaatt

SEQ ID NO: 53135 - DNA, 25 bp, Homo sapien
aattgctgttactaattagaggagt

SEQ ID NO: 53136 - DNA, 25 bp, Homo sapien
aaatgtttcacgataactcagcaat

SEQ ID NO: 53137 - DNA, 25 bp, Homo sapien
tcacgataactcagcaattgtaatg

SEQ ID NO: 53138 - DNA, 25 bp, Homo sapien
acatctaatgtcttttgggttacaa

SEQ ID NO: 53139 - DNA, 25 bp, Homo sapien
aacaggtactgagatttgtggccta

SEQ ID NO: 53140 - DNA, 25 bp, Homo sapien
tactttctacagaagccagtcccag

SEQ ID NO: 53141 - DNA, 25 bp, Homo sapien
gccagtcccaggttttgaggagctt

SEQ ID NO: 53142 - DNA, 25 bp, Homo sapien
gcagagcctgcaaccgactagagga

SEQ ID NO: 53143 - DNA, 25 bp, Homo sapien
agaggacctgggtcccggcagctct

SEQ ID NO: 53144 - DNA, 25 bp, Homo sapien
catctccccagtcagacaaggttta

SEQ ID NO: 53145 - DNA, 25 bp, Homo sapien
gacaaggtttatacgtttcaataca

SEQ ID NO: 53146 - DNA, 25 bp, Homo sapien
gcattctgtgctacacaagccttag

SEQ ID NO: 53147 - DNA, 25 bp, Homo sapien
acaagccttagcctcagtggagctg

SEQ ID NO: 53148 - DNA, 25 bp, Homo sapien
cagtggagctgtggttctcttggta

SEQ ID NO: 53149 - DNA, 25 bp, Homo sapien
gttctcttggtactttcttgtcaaa

SEQ ID NO: 53150 - DNA, 25 bp, Homo sapien
taaaattctttccacacctgtcaaa

SEQ ID NO: 53151 - DNA, 25 bp, Homo sapien
agaccggcctgcgagacatggcaaa

SEQ ID NO: 53152 - DNA, 25 bp, Homo sapien
aaagaaagaatgatgtcctgacatg

SEQ ID NO: 53153 - DNA, 25 bp, Homo sapien
ctgacatgaaacagcaggctacaaa

SEQ ID NO: 53154 - DNA, 25 bp, Homo sapien
aggctacaaaaccactgcatgctgt

SEQ ID NO: 53155 - DNA, 25 bp, Homo sapien
cactgcatgctgtgatcccaatttt

SEQ ID NO: 53156 - DNA, 25 bp, Homo sapien
gggaaatacgccaaaatgttgacaa

SEQ ID NO: 53157 - DNA, 25 bp, Homo sapien
gttgacaatgactgtctccaggtca

SEQ ID NO: 53158 - DNA, 25 bp, Homo sapien
caatgactgtctccaggtcaaagga

SEQ ID NO: 53159 - DNA, 25 bp, Homo sapien
gattgtgggtgacttttaatgtgta

SEQ ID NO: 53160 - DNA, 25 bp, Homo sapien
gtattttacagaatttctgccatga

SEQ ID NO: 53161 - DNA, 25 bp, Homo sapien
tctgccatgactgtgtattttgcat

SEQ ID NO: 53162 - DNA, 25 bp, Homo sapien
atcaggcaactgtggaaaatctaaa

SEQ ID NO: 53163 - DNA, 25 bp, Homo sapien
gaaaatctaaacgaactgcgccaag

SEQ ID NO: 53164 - DNA, 25 bp, Homo sapien
aacgaactgcgccaagatctgtcaa

SEQ ID NO: 53165 - DNA, 25 bp, Homo sapien
gaactgcgccaagatctgtcaaaat

SEQ ID NO: 53166 - DNA, 25 bp, Homo sapien
gccaagatctgtcaaaattccgaaa

SEQ ID NO: 53167 - DNA, 25 bp, Homo sapien
gatttacttggctttcggacttcta

SEQ ID NO: 53168 - DNA, 25 bp, Homo sapien
acttggctttcggacttctaaatat

SEQ ID NO: 53169 - DNA, 25 bp, Homo sapien
ttcggacttctaaatatgctatgtt

SEQ ID NO: 53170 - DNA, 25 bp, Homo sapien
taaatatgctatgttttatccaaga

SEQ ID NO: 53171 - DNA, 25 bp, Homo sapien
catggagcgaataattttcaataac

SEQ ID NO: 53172 - DNA, 25 bp, Homo sapien
acagatccaaaagactatattgcat

SEQ ID NO: 53173 - DNA, 25 bp, Homo sapien
attccactaaatttgttctttgata

SEQ ID NO: 53174 - DNA, 25 bp, Homo sapien
tattcaagtttatcgcttccatgtg

SEQ ID NO: 53175 - DNA, 25 bp, Homo sapien
aagtttatcgcttccatgtgagaga

SEQ ID NO: 53176 - DNA, 25 bp, Homo sapien
tccatgtgagagaagcctacatctt

SEQ ID NO: 53177 - DNA, 25 bp, Homo sapien
agcctacatcttcttattctattta

SEQ ID NO: 53178 - DNA, 25 bp, Homo sapien
ggaatcgttctttaactcttcttat

SEQ ID NO: 53179 - DNA, 25 bp, Homo sapien
taactcttcttattcattctaggca

SEQ ID NO: 53180 - DNA, 25 bp, Homo sapien
ttcattctaggcatgactcctatat

SEQ ID NO: 53181 - DNA, 25 bp, Homo sapien
actcataaatataccctcctacttt

SEQ ID NO: 53182 - DNA, 25 bp, Homo sapien
taaatataccctcctactttcaatt

SEQ ID NO: 53183 - DNA, 25 bp, Homo sapien
attactcatacatttgctcaatttg

SEQ ID NO: 53184 - DNA, 25 bp, Homo sapien
cgtccgaggaggatcgttttctaag

SEQ ID NO: 53185 - DNA, 25 bp, Homo sapien
aggaggatcgttttctaagtgcaat

SEQ ID NO: 53186 - DNA, 25 bp, Homo sapien
gaggatcgttttctaagtgcaatac

SEQ ID NO: 53187 - DNA, 25 bp, Homo sapien
ttctaagtgcaatacttggcccgcc

SEQ ID NO: 53188 - DNA, 25 bp, Homo sapien
agtgcaatacttggcccgccggctt

SEQ ID NO: 53189 - DNA, 25 bp, Homo sapien
cccatcgcgctcacgcaataaccgg

SEQ ID NO: 53190 - DNA, 25 bp, Homo sapien
agcactggcaccgagaggcaggcct

SEQ ID NO: 53191 - DNA, 25 bp, Homo sapien
ggtcccgccgccgtgatgaatgtac

SEQ ID NO: 53192 - DNA, 25 bp, Homo sapien
ccgccgccgtgatgaatgtactgac

SEQ ID NO: 53193 - DNA, 25 bp, Homo sapien
gatgaatgtactgacgagccgaggc

SEQ ID NO: 53194 - DNA, 25 bp, Homo sapien
tactgacgagccgaggcagcagtgc

SEQ ID NO: 53195 - DNA, 25 bp, Homo sapien
ttgtacccagacagtaactacccac

SEQ ID NO: 53196 - DNA, 25 bp, Homo sapien
gactggctacatcttttcagccgat

SEQ ID NO: 53197 - DNA, 25 bp, Homo sapien
gaactcatttacaagacctcactcc

SEQ ID NO: 53198 - DNA, 25 bp, Homo sapien
accttgaagacgtatatgtgggact

SEQ ID NO: 53199 - DNA, 25 bp, Homo sapien
atgtgggactgtgtcttcgaaagct

SEQ ID NO: 53200 - DNA, 25 bp, Homo sapien
tcttcgaaagctgggcatacatcct

SEQ ID NO: 53201 - DNA, 25 bp, Homo sapien
tacatcctttccagaacagtggctt

SEQ ID NO: 53202 - DNA, 25 bp, Homo sapien
gtggcttcaatcactggaaaatggc

SEQ ID NO: 53203 - DNA, 25 bp, Homo sapien
agtttgtgtaggtatcgccgagtta

SEQ ID NO: 53204 - DNA, 25 bp, Homo sapien
atcgccgagttatcactgtgcatca

SEQ ID NO: 53205 - DNA, 25 bp, Homo sapien
tgtgcatcagatctctccagaagaa

SEQ ID NO: 53206 - DNA, 25 bp, Homo sapien
ggccttggttctggttcatcctatg

SEQ ID NO: 53207 - DNA, 25 bp, Homo sapien
ggttctggttcatcctatgtacaga

SEQ ID NO: 53208 - DNA, 25 bp, Homo sapien
gccaacaagcagtcatgacatgaaa

SEQ ID NO: 53209 - DNA, 25 bp, Homo sapien
atttttatttcgagctacacacatg

SEQ ID NO: 53210 - DNA, 25 bp, Homo sapien
ttcgagctacacacatgcttgtata

SEQ ID NO: 53211 - DNA, 25 bp, Homo sapien
gcttgtatataggttttatctctgg

SEQ ID NO: 53212 - DNA, 25 bp, Homo sapien
ttatctctggttgaatccctcgaac

SEQ ID NO: 53213 - DNA, 25 bp, Homo sapien
gaatccctcgaacaatagacagtac

SEQ ID NO: 53214 - DNA, 25 bp, Homo sapien
tcgaacaatagacagtacctttccc

SEQ ID NO: 53215 - DNA, 25 bp, Homo sapien
catggcccattttattgtctgcctt

SEQ ID NO: 53216 - DNA, 25 bp, Homo sapien
ttattgtctgcctttcagtactaag

SEQ ID NO: 53217 - DNA, 25 bp, Homo sapien
tgatggacgcgcagctgaggctcca

SEQ ID NO: 53218 - DNA, 25 bp, Homo sapien
tgaggctccagctgcgggactactg

SEQ ID NO: 53219 - DNA, 25 bp, Homo sapien
aagtgcaagcgtgacagcttcccca

SEQ ID NO: 53220 - DNA, 25 bp, Homo sapien
ccccaacttcctggcctgcaagcag

SEQ ID NO: 53221 - DNA, 25 bp, Homo sapien
aagcaggagcggcacgactgggact

SEQ ID NO: 53222 - DNA, 25 bp, Homo sapien
acgactgggactactgcgagcaccg

SEQ ID NO: 53223 - DNA, 25 bp, Homo sapien
actgggactactgcgagcaccgcga

SEQ ID NO: 53224 - DNA, 25 bp, Homo sapien
ggactactgcgagcaccgcgactat

SEQ ID NO: 53225 - DNA, 25 bp, Homo sapien
ctactgcgagcaccgcgactatgtg

SEQ ID NO: 53226 - DNA, 25 bp, Homo sapien
agcaccgcgactatgtgatgcgcat

SEQ ID NO: 53227 - DNA, 25 bp, Homo sapien
gaagaaggcggcagagttggccaaa

SEQ ID NO: 53228 - DNA, 25 bp, Homo sapien
tctacagtgactaacccaaaccagc

SEQ ID NO: 53229 - DNA, 25 bp, Homo sapien
gtgactaacccaaaccagcaccagg

SEQ ID NO: 53230 - DNA, 25 bp, Homo sapien
caggcagggacccaataaacctttg

SEQ ID NO: 53231 - DNA, 25 bp, Homo sapien
agctcccgggagatggctgaacccc

SEQ ID NO: 53232 - DNA, 25 bp, Homo sapien
gctcccgggagatggctgaacccca

SEQ ID NO: 53233 - DNA, 25 bp, Homo sapien
gctagtcatcctcttcagcggtcct

SEQ ID NO: 53234 - DNA, 25 bp, Homo sapien
ggcccagatggatcctctacagtga

SEQ ID NO: 53235 - DNA, 25 bp, Homo sapien
ccagatggatcctctacagtgacta

SEQ ID NO: 53236 - DNA, 25 bp, Homo sapien
gatggatcctctacagtgactaacc

SEQ ID NO: 53237 - DNA, 25 bp, Homo sapien
tggatcctctacagtgactaaccca

SEQ ID NO: 53238 - DNA, 25 bp, Homo sapien
gatcctctacagtgactaacccaaa

SEQ ID NO: 53239 - DNA, 25 bp, Homo sapien
gcttccggtagggaggcagcctcca

SEQ ID NO: 53240 - DNA, 25 bp, Homo sapien
tacctgccctggaacatcctttgca

SEQ ID NO: 53241 - DNA, 25 bp, Homo sapien
cctggaacatcctttgcagggcagc

SEQ ID NO: 53242 - DNA, 25 bp, Homo sapien
ggcagccccacaactttaaacattg

SEQ ID NO: 53243 - DNA, 25 bp, Homo sapien
aacattgacgattccttctctgaac

SEQ ID NO: 53244 - DNA, 25 bp, Homo sapien
attccttctctgaacacaggcagct

SEQ ID NO: 53245 - DNA, 25 bp, Homo sapien
tatccactgggcacaactgcaataa

SEQ ID NO: 53246 - DNA, 25 bp, Homo sapien
gggcacaactgcaataacttctgac

SEQ ID NO: 53247 - DNA, 25 bp, Homo sapien
acttctgaccttttggtgaaagctg

SEQ ID NO: 53248 - DNA, 25 bp, Homo sapien
gtgaaagctgagaactcctgactgt

SEQ ID NO: 53249 - DNA, 25 bp, Homo sapien
aactcctgactgtaacatattctgt

SEQ ID NO: 53250 - DNA, 25 bp, Homo sapien
aagtgcgcacacacaccgatgtaca

SEQ ID NO: 53251 - DNA, 25 bp, Homo sapien
agatgcacacacaccgatgctgact

SEQ ID NO: 53252 - DNA, 25 bp, Homo sapien
accgatgctgactccatgtgtgctg

SEQ ID NO: 53253 - DNA, 25 bp, Homo sapien
actccatgtgtgctgtcctctgaag

SEQ ID NO: 53254 - DNA, 25 bp, Homo sapien
tgaaggcggttgtttagctctcact

SEQ ID NO: 53255 - DNA, 25 bp, Homo sapien
tagctctcacttttctggttcttat

SEQ ID NO: 53256 - DNA, 25 bp, Homo sapien
atcatcttcacttcagacaattcag

SEQ ID NO: 53257 - DNA, 25 bp, Homo sapien
gacaattcagaagcatcaccatgca

SEQ ID NO: 53258 - DNA, 25 bp, Homo sapien
atgtatttctcccttcgctgggtgc

SEQ ID NO: 53259 - DNA, 25 bp, Homo sapien
tgggtgccgggctgcacagactatt

SEQ ID NO: 53260 - DNA, 25 bp, Homo sapien
gcttcccagcttcacaataaacggc

SEQ ID NO: 53261 - DNA, 25 bp, Homo sapien
gacatgcataattgatggtttctag

SEQ ID NO: 53262 - DNA, 25 bp, Homo sapien
ctagattatctagtccaaacaatag

SEQ ID NO: 53263 - DNA, 25 bp, Homo sapien
ttcttcatctgaaccaacatgctac

SEQ ID NO: 53264 - DNA, 25 bp, Homo sapien
ctgaaccaacatgctacagtagcta

SEQ ID NO: 53265 - DNA, 25 bp, Homo sapien
gaagtcatagttgaccacagacatg

SEQ ID NO: 53266 - DNA, 25 bp, Homo sapien
tgaccacagacatgttattcttctg

SEQ ID NO: 53267 - DNA, 25 bp, Homo sapien
tcttctgaaagagccacattttggt

SEQ ID NO: 53268 - DNA, 25 bp, Homo sapien
ttttggttttatttcttgtcacatg

SEQ ID NO: 53269 - DNA, 25 bp, Homo sapien
cttgtcacatgatttcttttcttga

SEQ ID NO: 53270 - DNA, 25 bp, Homo sapien
aatcttttatatctgttgcctagtt

SEQ ID NO: 53271 - DNA, 25 bp, Homo sapien
atctgttgcctagttttgtacatgg

SEQ ID NO: 53272 - DNA, 25 bp, Homo sapien
gactcagtagcgttttagtcgtttt

SEQ ID NO: 53273 - DNA, 25 bp, Homo sapien
tagtcgttttatgtttctttgcaac

SEQ ID NO: 53274 - DNA, 25 bp, Homo sapien
tatgtttctttgcaacggcctcaga

SEQ ID NO: 53275 - DNA, 25 bp, Homo sapien
ctttgcaacggcctcagaagtttgg

SEQ ID NO: 53276 - DNA, 25 bp, Homo sapien
agaggctatcacaggctcagggcaa

SEQ ID NO: 53277 - DNA, 25 bp, Homo sapien
aggctcagggcaaagaagtggcctc

SEQ ID NO: 53278 - DNA, 25 bp, Homo sapien
aagcagctcagctcgatggtgggcc

SEQ ID NO: 53279 - DNA, 25 bp, Homo sapien
agctcagctcgatggtgggcccagc

SEQ ID NO: 53280 - DNA, 25 bp, Homo sapien
ctgtccaaggctggctagctgcggt

SEQ ID NO: 53281 - DNA, 25 bp, Homo sapien
tagctgcggtgctccttgctggttt

SEQ ID NO: 53282 - DNA, 25 bp, Homo sapien
gctccttgctggtttttaacttggg

SEQ ID NO: 53283 - DNA, 25 bp, Homo sapien
gttacctctgcatggaacagcatta

SEQ ID NO: 53284 - DNA, 25 bp, Homo sapien
ttacctctgcatggaacagcattac

SEQ ID NO: 53285 - DNA, 25 bp, Homo sapien
tacctctgcatggaacagcattacc

SEQ ID NO: 53286 - DNA, 25 bp, Homo sapien
acctctgcatggaacagcattaccc

SEQ ID NO: 53287 - DNA, 25 bp, Homo sapien
cctctgcatggaacagcattaccct

SEQ ID NO: 53288 - DNA, 25 bp, Homo sapien
ctctgcatggaacagcattaccctc

SEQ ID NO: 53289 - DNA, 25 bp, Homo sapien
tctgcatggaacagcattaccctcc

SEQ ID NO: 53290 - DNA, 25 bp, Homo sapien
ctgcatggaacagcattaccctcct

SEQ ID NO: 53291 - DNA, 25 bp, Homo sapien
tgcatggaacagcattaccctcctc

SEQ ID NO: 53292 - DNA, 25 bp, Homo sapien
gcatggaacagcattaccctcctct

SEQ ID NO: 53293 - DNA, 25 bp, Homo sapien
gaaactataacatagctgtcacagt

SEQ ID NO: 53294 - DNA, 25 bp, Homo sapien
gctgtcacagtatagtcacaatcca

SEQ ID NO: 53295 - DNA, 25 bp, Homo sapien
aatccacaaatgatgcaggtgcaaa

SEQ ID NO: 53296 - DNA, 25 bp, Homo sapien
ggtttatagccctgtgaagttctta

SEQ ID NO: 53297 - DNA, 25 bp, Homo sapien
gtttagaggctaacttacagaaatg

SEQ ID NO: 53298 - DNA, 25 bp, Homo sapien
gagttaaccccaaaggtgatatggt

SEQ ID NO: 53299 - DNA, 25 bp, Homo sapien
ttggcattcttttcccattgactat

SEQ ID NO: 53300 - DNA, 25 bp, Homo sapien
gactatatacatctctatttctcaa

SEQ ID NO: 53301 - DNA, 25 bp, Homo sapien
ctctatttctcaaatgttcatggaa

SEQ ID NO: 53302 - DNA, 25 bp, Homo sapien
gttcatggaactagctcttttattt

SEQ ID NO: 53303 - DNA, 25 bp, Homo sapien
ttattttcctgctggtttcttcagt

SEQ ID NO: 53304 - DNA, 25 bp, Homo sapien
gatgcagactcttatgagaacatgg

SEQ ID NO: 53305 - DNA, 25 bp, Homo sapien
gaacatggataatcccgatgggcca

SEQ ID NO: 53306 - DNA, 25 bp, Homo sapien
ggataatcccgatgggccagaccca

SEQ ID NO: 53307 - DNA, 25 bp, Homo sapien
ctggagcaccaggtgatcctcaggt

SEQ ID NO: 53308 - DNA, 25 bp, Homo sapien
aggtgatcctcaggtggccagcctg

SEQ ID NO: 53309 - DNA, 25 bp, Homo sapien
aagtccccaagattcacacctgact

SEQ ID NO: 53310 - DNA, 25 bp, Homo sapien
gattcacacctgactctgaaatctg

SEQ ID NO: 53311 - DNA, 25 bp, Homo sapien
tgactctgaaatctgaagacctcga

SEQ ID NO: 53312 - DNA, 25 bp, Homo sapien
gaagacctcgagcagatgatgccaa

SEQ ID NO: 53313 - DNA, 25 bp, Homo sapien
cgagcagatgatgccaacctctgga

SEQ ID NO: 53314 - DNA, 25 bp, Homo sapien
gcaatgttgcttaggatgtgtgcat

SEQ ID NO: 53315 - DNA, 25 bp, Homo sapien
gaagatggatgtaattctcatgaaa

SEQ ID NO: 53316 - DNA, 25 bp, Homo sapien
gtaattctcatgaaagcagtgaagc

SEQ ID NO: 53317 - DNA, 25 bp, Homo sapien
ttaaaaatgaagatcggctttcatg

SEQ ID NO: 53318 - DNA, 25 bp, Homo sapien
gctttcatgtaattatctagtagtt

SEQ ID NO: 53319 - DNA, 25 bp, Homo sapien
tttgtttgcctcatgcctttatact

SEQ ID NO: 53320 - DNA, 25 bp, Homo sapien
tgcctcatgcctttatactttgctg

SEQ ID NO: 53321 - DNA, 25 bp, Homo sapien
tcatgcctttatactttgctgttga

SEQ ID NO: 53322 - DNA, 25 bp, Homo sapien
gaagaaactactaatctcaatttaa

SEQ ID NO: 53323 - DNA, 25 bp, Homo sapien
ataaggacacaaactttcaagtatt

SEQ ID NO: 53324 - DNA, 25 bp, Homo sapien
tatctttgtagcctaaagaccattt

SEQ ID NO: 53325 - DNA, 25 bp, Homo sapien
agaccatttaattttgaaggacaca

SEQ ID NO: 53326 - DNA, 25 bp, Homo sapien
tctgatgctgtggaacttgcaaatc

SEQ ID NO: 53327 - DNA, 25 bp, Homo sapien
cttgcaaatcgaagtgataactctt

SEQ ID NO: 53328 - DNA, 25 bp, Homo sapien
gataactcttctgatagcagcttat

SEQ ID NO: 53329 - DNA, 25 bp, Homo sapien
tatttaaaactcagtgtatccctta

SEQ ID NO: 53330 - DNA, 25 bp, Homo sapien
gaaaatttgttcgtacacctgaaag

SEQ ID NO: 53331 - DNA, 25 bp, Homo sapien
tgttcgtacacctgaaagtgttcac

SEQ ID NO: 53332 - DNA, 25 bp, Homo sapien
aagtgttcacgcaagtgattcatca

SEQ ID NO: 53333 - DNA, 25 bp, Homo sapien
caagtgactcatcttttgaaccaat

SEQ ID NO: 53334 - DNA, 25 bp, Homo sapien
cttttgaaccaataccattgactat

SEQ ID NO: 53335 - DNA, 25 bp, Homo sapien
atcaggaatagattctcttgaccat

SEQ ID NO: 53336 - DNA, 25 bp, Homo sapien
tcttgaccatgtgacatctgatgct

SEQ ID NO: 53337 - DNA, 25 bp, Homo sapien
aattatttcccttcaatcctctagg

SEQ ID NO: 53338 - DNA, 25 bp, Homo sapien
aatcctctaggcttcgagagttttg

SEQ ID NO: 53339 - DNA, 25 bp, Homo sapien
agattgcacatctccccttgagtga

SEQ ID NO: 53340 - DNA, 25 bp, Homo sapien
gattgcacatctccccttgagtgaa

SEQ ID NO: 53341 - DNA, 25 bp, Homo sapien
tgcacatctccccttgagtgaagtg

SEQ ID NO: 53342 - DNA, 25 bp, Homo sapien
acatctccccttgagtgaagtgcct

SEQ ID NO: 53343 - DNA, 25 bp, Homo sapien
tgaagtgcctctcatgatacttgat

SEQ ID NO: 53344 - DNA, 25 bp, Homo sapien
gaagtgcctctcatgatacttgatg

SEQ ID NO: 53345 - DNA, 25 bp, Homo sapien
aagtgcctctcatgatacttgatga

SEQ ID NO: 53346 - DNA, 25 bp, Homo sapien
atggaaatccaatctgttgcagtct

SEQ ID NO: 53347 - DNA, 25 bp, Homo sapien
tctgttgcagtctcctttaagcatt

SEQ ID NO: 53348 - DNA, 25 bp, Homo sapien
gatgtcgggacagccctgctgtcag

SEQ ID NO: 53349 - DNA, 25 bp, Homo sapien
agccctgctgtcagatgaaaacaga

SEQ ID NO: 53350 - DNA, 25 bp, Homo sapien
agaatgacacgtaaaatccgaggtt

SEQ ID NO: 53351 - DNA, 25 bp, Homo sapien
gaatgacacgtaaaatccgaggttt

SEQ ID NO: 53352 - DNA, 25 bp, Homo sapien
ttttttctacaactccgactcattt

SEQ ID NO: 53353 - DNA, 25 bp, Homo sapien
tctacaactccgactcatttgctac

SEQ ID NO: 53354 - DNA, 25 bp, Homo sapien
tacaactccgactcatttgctacat

SEQ ID NO: 53355 - DNA, 25 bp, Homo sapien
acaactccgactcatttgctacatt

SEQ ID NO: 53356 - DNA, 25 bp, Homo sapien
caactccgactcatttgctacattc

SEQ ID NO: 53357 - DNA, 25 bp, Homo sapien
tcctgcgaggctggtggctcctgcg

SEQ ID NO: 53358 - DNA, 25 bp, Homo sapien
ggctggtggctcctgcgcctgcgcc

SEQ ID NO: 53359 - DNA, 25 bp, Homo sapien
tgcctaatggagaagacccacgtgc

SEQ ID NO: 53360 - DNA, 25 bp, Homo sapien
taatggagaagacccacgtgctagg

SEQ ID NO: 53361 - DNA, 25 bp, Homo sapien
ctaccccatttgtggtcacagccat

SEQ ID NO: 53362 - DNA, 25 bp, Homo sapien
ccccatttgtggtcacagccatgaa

SEQ ID NO: 53363 - DNA, 25 bp, Homo sapien
gtcacagccatgaagtcaccgggat

SEQ ID NO: 53364 - DNA, 25 bp, Homo sapien
cacagccatgaagtcaccgggatga

SEQ ID NO: 53365 - DNA, 25 bp, Homo sapien
aagtcaccgggatgaacctatcctt

SEQ ID NO: 53366 - DNA, 25 bp, Homo sapien
ccgggatgaacctatccttccagtg

SEQ ID NO: 53367 - DNA, 25 bp, Homo sapien
gcatcttctggcttgactggatgga

SEQ ID NO: 53368 - DNA, 25 bp, Homo sapien
atcttctggcttgactggatggaag

SEQ ID NO: 53369 - DNA, 25 bp, Homo sapien
gcttgactggatggaaggagactta

SEQ ID NO: 53370 - DNA, 25 bp, Homo sapien
atttccagatttgggctatttctgt

SEQ ID NO: 53371 - DNA, 25 bp, Homo sapien
gggctatttctgtatgatccaataa

SEQ ID NO: 53372 - DNA, 25 bp, Homo sapien
caataacttattttgtcacagggct

SEQ ID NO: 53373 - DNA, 25 bp, Homo sapien
ttgtcacagggcttaatttgccatt

SEQ ID NO: 53374 - DNA, 25 bp, Homo sapien
cagggcttaatttgccatttttggg

SEQ ID NO: 53375 - DNA, 25 bp, Homo sapien
gggatttgtcgactcattttgtctg

SEQ ID NO: 53376 - DNA, 25 bp, Homo sapien
tttgtcgactcattttgtctgaatt

SEQ ID NO: 53377 - DNA, 25 bp, Homo sapien
gtattatgtcactagctacctgata

SEQ ID NO: 53378 - DNA, 25 bp, Homo sapien
ttcccttataactcaatagtacctt

SEQ ID NO: 53379 - DNA, 25 bp, Homo sapien
gtaccttaacacaaagtataactct

SEQ ID NO: 53380 - DNA, 25 bp, Homo sapien
actctgtagagttggtgaatatttt

SEQ ID NO: 53381 - DNA, 25 bp, Homo sapien
aactgttgggagaattgacatctta

SEQ ID NO: 53382 - DNA, 25 bp, Homo sapien
aataatattgagtcttctggcctat

SEQ ID NO: 53383 - DNA, 25 bp, Homo sapien
gagtcttctggcctataaacaaggt

SEQ ID NO: 53384 - DNA, 25 bp, Homo sapien
aaacaaggtctgtcttcctaggtat

SEQ ID NO: 53385 - DNA, 25 bp, Homo sapien
gtcttcctaggtattaatgttttgt

SEQ ID NO: 53386 - DNA, 25 bp, Homo sapien
agttttcagtgtacaggtctaccat

SEQ ID NO: 53387 - DNA, 25 bp, Homo sapien
ggtctaccatgtcagcatttcatag

SEQ ID NO: 53388 - DNA, 25 bp, Homo sapien
aaattctaaccacttgttgctagta

SEQ ID NO: 53389 - DNA, 25 bp, Homo sapien
aacttgtatccttcagccttgctaa

SEQ ID NO: 53390 - DNA, 25 bp, Homo sapien
gccttgctaaactgtgagttctcat

SEQ ID NO: 53391 - DNA, 25 bp, Homo sapien
gtgagttctcatggtgtttttgtaa

SEQ ID NO: 53392 - DNA, 25 bp, Homo sapien
gttacttacctgcatgtgttgtaca

SEQ ID NO: 53393 - DNA, 25 bp, Homo sapien
tgttgtacaataccagatcactcaa

SEQ ID NO: 53394 - DNA, 25 bp, Homo sapien
attttacctgggatatgacaagcaa

SEQ ID NO: 53395 - DNA, 25 bp, Homo sapien
atgacaagcaaggtttctggtgcct

SEQ ID NO: 53396 - DNA, 25 bp, Homo sapien
ggtttctggtgcctatttattcatt

SEQ ID NO: 53397 - DNA, 25 bp, Homo sapien
gagacacagagtggagccctcagtt

SEQ ID NO: 53398 - DNA, 25 bp, Homo sapien
gagccctcagttttatggatcccaa

SEQ ID NO: 53399 - DNA, 25 bp, Homo sapien
tatggatcccaattcatttcatcta

SEQ ID NO: 53400 - DNA, 25 bp, Homo sapien
tcatctactacagggtgaggtgctt

SEQ ID NO: 53401 - DNA, 25 bp, Homo sapien
ccccatgtgggtgtggcagttacag

SEQ ID NO: 53402 - DNA, 25 bp, Homo sapien
agggcccaggtgagctgaagacaaa

SEQ ID NO: 53403 - DNA, 25 bp, Homo sapien
ctcaggctgtgggtcatcctgctgc

SEQ ID NO: 53404 - DNA, 25 bp, Homo sapien
tcaggctgtgggtcatcctgctgcc

SEQ ID NO: 53405 - DNA, 25 bp, Homo sapien
caggctgtgggtcatcctgctgcca

SEQ ID NO: 53406 - DNA, 25 bp, Homo sapien
aggctgtgggtcatcctgctgccag

SEQ ID NO: 53407 - DNA, 25 bp, Homo sapien
ggctgtgggtcatcctgctgccagt

SEQ ID NO: 53408 - DNA, 25 bp, Homo sapien
gctgtgggtcatcctgctgccagtc

SEQ ID NO: 53409 - DNA, 25 bp, Homo sapien
ctgtgggtcatcctgctgccagtcc

SEQ ID NO: 53410 - DNA, 25 bp, Homo sapien
tgtgggtcatcctgctgccagtcca

SEQ ID NO: 53411 - DNA, 25 bp, Homo sapien
gtgggtcatcctgctgccagtccag

SEQ ID NO: 53412 - DNA, 25 bp, Homo sapien
tgggtcatcctgctgccagtccagc

SEQ ID NO: 53413 - DNA, 25 bp, Homo sapien
gggtcatcctgctgccagtccagct

SEQ ID NO: 53414 - DNA, 25 bp, Homo sapien
ctaaactcatcagccgttccagggt

SEQ ID NO: 53415 - DNA, 25 bp, Homo sapien
gttccagggtctatcttcagggatt

SEQ ID NO: 53416 - DNA, 25 bp, Homo sapien
tatttatttggaaacagcagcactg

SEQ ID NO: 53417 - DNA, 25 bp, Homo sapien
agcagcactgtattggaggactcga

SEQ ID NO: 53418 - DNA, 25 bp, Homo sapien
ggactcgaagtccaacgagaaagct

SEQ ID NO: 53419 - DNA, 25 bp, Homo sapien
agacctgacggcctgcctaagaaat

SEQ ID NO: 53420 - DNA, 25 bp, Homo sapien
tgacggcctgcctaagaaatactga

SEQ ID NO: 53421 - DNA, 25 bp, Homo sapien
tcctctgctctcagggaaactgggc

SEQ ID NO: 53422 - DNA, 25 bp, Homo sapien
gaaactgggctgtgagccacacact

SEQ ID NO: 53423 - DNA, 25 bp, Homo sapien
agggacacagggtcactgagctttg

SEQ ID NO: 53424 - DNA, 25 bp, Homo sapien
gtgtccccaggaactggtatagggc

SEQ ID NO: 53425 - DNA, 25 bp, Homo sapien
tatgcaccagtaaggcccgtccaga

SEQ ID NO: 53426 - DNA, 25 bp, Homo sapien
ggagtgggccctgagtccacactgt

SEQ ID NO: 53427 - DNA, 25 bp, Homo sapien
acactgtccctgagtgatccaggag

SEQ ID NO: 53428 - DNA, 25 bp, Homo sapien
gagtgatccaggaggctgcccacat

SEQ ID NO: 53429 - DNA, 25 bp, Homo sapien
ccacatgtgcactgtggttccagtg

SEQ ID NO: 53430 - DNA, 25 bp, Homo sapien
cactgtggttccagtgtagctgctg

SEQ ID NO: 53431 - DNA, 25 bp, Homo sapien
tgcctcagaagggagccactgtgaa

SEQ ID NO: 53432 - DNA, 25 bp, Homo sapien
cagaagggagccactgtgaacctct

SEQ ID NO: 53433 - DNA, 25 bp, Homo sapien
tggctccaaagagcagtggcttttt

SEQ ID NO: 53434 - DNA, 25 bp, Homo sapien
agaatggcccatacttctggcccgg

SEQ ID NO: 53435 - DNA, 25 bp, Homo sapien
gaagggaatgccgaccctttggcct

SEQ ID NO: 53436 - DNA, 25 bp, Homo sapien
caaacatctggtgccaagatctaca

SEQ ID NO: 53437 - DNA, 25 bp, Homo sapien
aagatctacatttcaaccctgcctt

SEQ ID NO: 53438 - DNA, 25 bp, Homo sapien
gagcgtccagatctgccacatagaa

SEQ ID NO: 53439 - DNA, 25 bp, Homo sapien
atagaaggctctcaacatcatgtag

SEQ ID NO: 53440 - DNA, 25 bp, Homo sapien
gacaaagcgctgaacttgattggga

SEQ ID NO: 53441 - DNA, 25 bp, Homo sapien
agctgaacctcaccaatatctacgc

SEQ ID NO: 53442 - DNA, 25 bp, Homo sapien
tctgccgatgacatcctggctcatg

SEQ ID NO: 53443 - DNA, 25 bp, Homo sapien
ggctcatgctgcctgatggcatcac

SEQ ID NO: 53444 - DNA, 25 bp, Homo sapien
atggcatcaccgtggaggtcattgt

SEQ ID NO: 53445 - DNA, 25 bp, Homo sapien
gaggtcattgtggtcaaccaggtca

SEQ ID NO: 53446 - DNA, 25 bp, Homo sapien
ggtcaaccaggtcaatgccgggcac

SEQ ID NO: 53447 - DNA, 25 bp, Homo sapien
gatgtggcatcttttgtaaaactga

SEQ ID NO: 53448 - DNA, 25 bp, Homo sapien
gtaaaactgattcttggagactaaa

SEQ ID NO: 53449 - DNA, 25 bp, Homo sapien
gcagtggacttaatcggttgaccct

SEQ ID NO: 53450 - DNA, 25 bp, Homo sapien
ggacttaatcggttgaccctactgt

SEQ ID NO: 53451 - DNA, 25 bp, Homo sapien
atcggttgaccctactgtggattgg

SEQ ID NO: 53452 - DNA, 25 bp, Homo sapien
ccctactgtggattggtgggtttcg

SEQ ID NO: 53453 - DNA, 25 bp, Homo sapien
aagttcactacagcatcaatagaaa

SEQ ID NO: 53454 - DNA, 25 bp, Homo sapien
gagataatttaaccctgcctctcag

SEQ ID NO: 53455 - DNA, 25 bp, Homo sapien
gggccttggaatctatagtatagaa

SEQ ID NO: 53456 - DNA, 25 bp, Homo sapien
aactgtctagatggatgaattatga

SEQ ID NO: 53457 - DNA, 25 bp, Homo sapien
aaggcttaggacttcaaaaggtgat

SEQ ID NO: 53458 - DNA, 25 bp, Homo sapien
gctgcgacgcttgctctgtttgtgg

SEQ ID NO: 53459 - DNA, 25 bp, Homo sapien
ctcaggcgggacagtgctgcagctc

SEQ ID NO: 53460 - DNA, 25 bp, Homo sapien
gtgggtcccggctctgtgggtgatg

SEQ ID NO: 53461 - DNA, 25 bp, Homo sapien
gcattgctgactgtgtatataggat

SEQ ID NO: 53462 - DNA, 25 bp, Homo sapien
cagttctggatggtgtgccttccag

SEQ ID NO: 53463 - DNA, 25 bp, Homo sapien
tggatggtgtgccttccagatcctc

SEQ ID NO: 53464 - DNA, 25 bp, Homo sapien
atggtgtgccttccagatcctctct

SEQ ID NO: 53465 - DNA, 25 bp, Homo sapien
gttttgagcagcaggtagcctggct

SEQ ID NO: 53466 - DNA, 25 bp, Homo sapien
cagcaggtagcctggctggttttat

SEQ ID NO: 53467 - DNA, 25 bp, Homo sapien
tagcctggctggttttatctgagtg

SEQ ID NO: 53468 - DNA, 25 bp, Homo sapien
cctggctggttttatctgagtgaaa

SEQ ID NO: 53469 - DNA, 25 bp, Homo sapien
ataacaaagcactcccttaggcatt

SEQ ID NO: 53470 - DNA, 25 bp, Homo sapien
aagcactcccttaggcattatttaa

SEQ ID NO: 53471 - DNA, 25 bp, Homo sapien
gtaatagtccaatatttggcgatga

SEQ ID NO: 53472 - DNA, 25 bp, Homo sapien
ttggcgatgaggtaattctccctaa

SEQ ID NO: 53473 - DNA, 25 bp, Homo sapien
tgaggtaattctccctaaggaatct

SEQ ID NO: 53474 - DNA, 25 bp, Homo sapien
tctgaaagtatattttcctcccagt

SEQ ID NO: 53475 - DNA, 25 bp, Homo sapien
ccttcctttcccaagtattgcgaat

SEQ ID NO: 53476 - DNA, 25 bp, Homo sapien
gtgcagaaagcaacagttacggagg

SEQ ID NO: 53477 - DNA, 25 bp, Homo sapien
ttacggagggaggacatcataagga

SEQ ID NO: 53478 - DNA, 25 bp, Homo sapien
ttattaacgggcatgtattatcaca

SEQ ID NO: 53479 - DNA, 25 bp, Homo sapien
tgtattatcacatcaagcatgcaat

SEQ ID NO: 53480 - DNA, 25 bp, Homo sapien
ttccgaccactcagctgtcagggca

SEQ ID NO: 53481 - DNA, 25 bp, Homo sapien
accactcagctgtcagggcactgcg

SEQ ID NO: 53482 - DNA, 25 bp, Homo sapien
ctggcctgaagtcacagcagagttc

SEQ ID NO: 53483 - DNA, 25 bp, Homo sapien
tgaagtcacagcagagttcacccca

SEQ ID NO: 53484 - DNA, 25 bp, Homo sapien
aagtcacagcagagttcaccccaga

SEQ ID NO: 53485 - DNA, 25 bp, Homo sapien
tcacagcagagttcaccccagagcg

SEQ ID NO: 53486 - DNA, 25 bp, Homo sapien
tttaatgttctcaatcgtggctctc

SEQ ID NO: 53487 - DNA, 25 bp, Homo sapien
taatgttctcaatcgtggctctcag

SEQ ID NO: 53488 - DNA, 25 bp, Homo sapien
aatgttctcaatcgtggctctcaga

SEQ ID NO: 53489 - DNA, 25 bp, Homo sapien
tgttctcaatcgtggctctcagaca

SEQ ID NO: 53490 - DNA, 25 bp, Homo sapien
acgctacactagaagaaacgctagt

SEQ ID NO: 53491 - DNA, 25 bp, Homo sapien
acctcttgtgcaaggtggcctttgt

SEQ ID NO: 53492 - DNA, 25 bp, Homo sapien
ctgggacggaccagcatctggaaga

SEQ ID NO: 53493 - DNA, 25 bp, Homo sapien
gacggaccagcatctggaagatgta

SEQ ID NO: 53494 - DNA, 25 bp, Homo sapien
gaccagcatctggaagatgtacata

SEQ ID NO: 53495 - DNA, 25 bp, Homo sapien
ggaagatgtacatagttatttttct

SEQ ID NO: 53496 - DNA, 25 bp, Homo sapien
tatttttgacgtcactttttggcca

SEQ ID NO: 53497 - DNA, 25 bp, Homo sapien
tttttgacgtcactttttggccatg

SEQ ID NO: 53498 - DNA, 25 bp, Homo sapien
tttgacgtcactttttggccatgta

SEQ ID NO: 53499 - DNA, 25 bp, Homo sapien
tgacgtcactttttggccatgtaaa

SEQ ID NO: 53500 - DNA, 25 bp, Homo sapien
actatttgtggcaattttatgtttt

SEQ ID NO: 53501 - DNA, 25 bp, Homo sapien
tgaataaagaatgccatttctcacg

SEQ ID NO: 53502 - DNA, 25 bp, Homo sapien
gtcagtctctggtctcgtttgtcta

SEQ ID NO: 53503 - DNA, 25 bp, Homo sapien
tctcgtttgtctagttcctgggagt

SEQ ID NO: 53504 - DNA, 25 bp, Homo sapien
agcagagcaggctacgtcctcactg

SEQ ID NO: 53505 - DNA, 25 bp, Homo sapien
gtcctcactgaggtgttcttcatga

SEQ ID NO: 53506 - DNA, 25 bp, Homo sapien
gtgttcttcatgagagtactagcct

SEQ ID NO: 53507 - DNA, 25 bp, Homo sapien
ttcatgagagtactagcctcctcca

SEQ ID NO: 53508 - DNA, 25 bp, Homo sapien
ctccccacagcgcagaggaaacagg

SEQ ID NO: 53509 - DNA, 25 bp, Homo sapien
cgcagaggaaacaggccagcccagt

SEQ ID NO: 53510 - DNA, 25 bp, Homo sapien
gccagcccagtgacatgacgttatt

SEQ ID NO: 53511 - DNA, 25 bp, Homo sapien
gcccagtgacatgacgttattagtt

SEQ ID NO: 53512 - DNA, 25 bp, Homo sapien
tattagttttgttttacctgaatgt

SEQ ID NO: 53513 - DNA, 25 bp, Homo sapien
aggattctctgtacgcccagggaaa

SEQ ID NO: 53514 - DNA, 25 bp, Homo sapien
ggattctctgtacgcccagggaaag

SEQ ID NO: 53515 - DNA, 25 bp, Homo sapien
attctctgtacgcccagggaaagcg

SEQ ID NO: 53516 - DNA, 25 bp, Homo sapien
ttctctgtacgcccagggaaagcgg

SEQ ID NO: 53517 - DNA, 25 bp, Homo sapien
tctctgtacgcccagggaaagcggc

SEQ ID NO: 53518 - DNA, 25 bp, Homo sapien
ctctgtacgcccagggaaagcggcg

SEQ ID NO: 53519 - DNA, 25 bp, Homo sapien
tctgtacgcccagggaaagcggcgt

SEQ ID NO: 53520 - DNA, 25 bp, Homo sapien
tgtacgcccagggaaagcggcgtta

SEQ ID NO: 53521 - DNA, 25 bp, Homo sapien
gtacgcccagggaaagcggcgttat

SEQ ID NO: 53522 - DNA, 25 bp, Homo sapien
tacgcccagggaaagcggcgttatg

SEQ ID NO: 53523 - DNA, 25 bp, Homo sapien
acgcccagggaaagcggcgttatga

SEQ ID NO: 53524 - DNA, 25 bp, Homo sapien
cccctgtgactgctgccggatgctg

SEQ ID NO: 53525 - DNA, 25 bp, Homo sapien
ccctgtgactgctgccggatgctgt

SEQ ID NO: 53526 - DNA, 25 bp, Homo sapien
cctgtgactgctgccggatgctgtg

SEQ ID NO: 53527 - DNA, 25 bp, Homo sapien
tgactgctgccggatgctgtgcaca

SEQ ID NO: 53528 - DNA, 25 bp, Homo sapien
gactgctgccggatgctgtgcacac

SEQ ID NO: 53529 - DNA, 25 bp, Homo sapien
actgctgccggatgctgtgcacaca

SEQ ID NO: 53530 - DNA, 25 bp, Homo sapien
ctgctgccggatgctgtgcacacag

SEQ ID NO: 53531 - DNA, 25 bp, Homo sapien
tgctgccggatgctgtgcacacagg

SEQ ID NO: 53532 - DNA, 25 bp, Homo sapien
cgcggagtgaccccaccttctcatg

SEQ ID NO: 53533 - DNA, 25 bp, Homo sapien
tttaatcttgtttgttgcgcaatgg

SEQ ID NO: 53534 - DNA, 25 bp, Homo sapien
ttaatcttgtttgttgcgcaatgga

SEQ ID NO: 53535 - DNA, 25 bp, Homo sapien
ttagctttccctgtgccactttgac

SEQ ID NO: 53536 - DNA, 25 bp, Homo sapien
tagctttccctgtgccactttgact

SEQ ID NO: 53537 - DNA, 25 bp, Homo sapien
tttccctgtgccactttgactcaga

SEQ ID NO: 53538 - DNA, 25 bp, Homo sapien
ttccctgtgccactttgactcagag

SEQ ID NO: 53539 - DNA, 25 bp, Homo sapien
cctgtgccactttgactcagaggct

SEQ ID NO: 53540 - DNA, 25 bp, Homo sapien
tgtgccactttgactcagaggctgg

SEQ ID NO: 53541 - DNA, 25 bp, Homo sapien
tgccactttgactcagaggctggga

SEQ ID NO: 53542 - DNA, 25 bp, Homo sapien
cactttgactcagaggctgggagca

SEQ ID NO: 53543 - DNA, 25 bp, Homo sapien
ctttgactcagaggctgggagcata

SEQ ID NO: 53544 - DNA, 25 bp, Homo sapien
tgactcagaggctgggagcatagca

SEQ ID NO: 53545 - DNA, 25 bp, Homo sapien
atgtccaccacttcaggggatgggt

SEQ ID NO: 53546 - DNA, 25 bp, Homo sapien
gagcaggcgaacagagctctctctg

SEQ ID NO: 53547 - DNA, 25 bp, Homo sapien
tctctggatcagctttacttgggta

SEQ ID NO: 53548 - DNA, 25 bp, Homo sapien
gagggcagaatctttaattaccttt

SEQ ID NO: 53549 - DNA, 25 bp, Homo sapien
gatttttctgacactgtgtgcgaag

SEQ ID NO: 53550 - DNA, 25 bp, Homo sapien
actgtgtgcgaaggcttggagtcca

SEQ ID NO: 53551 - DNA, 25 bp, Homo sapien
caaggtgttctgacaagggtggctt

SEQ ID NO: 53552 - DNA, 25 bp, Homo sapien
tggcttttctctgccattcgctaag

SEQ ID NO: 53553 - DNA, 25 bp, Homo sapien
attcgctaaggcctttgtcactttt

SEQ ID NO: 53554 - DNA, 25 bp, Homo sapien
tttgtcacttttccaccacagaaag

SEQ ID NO: 53555 - DNA, 25 bp, Homo sapien
tggccttggatacagagatgccaat

SEQ ID NO: 53556 - DNA, 25 bp, Homo sapien
gaaagttctactctcgtatctgttt

SEQ ID NO: 53557 - DNA, 25 bp, Homo sapien
tgctgttcccagtccagctgttgta

SEQ ID NO: 53558 - DNA, 25 bp, Homo sapien
tgttcccagtccagctgttgtaagc

SEQ ID NO: 53559 - DNA, 25 bp, Homo sapien
agtccagctgttgtaagccctgcag

SEQ ID NO: 53560 - DNA, 25 bp, Homo sapien
gctgttcccagtccagctgctgtaa

SEQ ID NO: 53561 - DNA, 25 bp, Homo sapien
tgctgtgtcccaatttgctgccagt

SEQ ID NO: 53562 - DNA, 25 bp, Homo sapien
gctgtgtcccaatttgctgccagtg

SEQ ID NO: 53563 - DNA, 25 bp, Homo sapien
tgtgtcccaatttgctgccagtgca

SEQ ID NO: 53564 - DNA, 25 bp, Homo sapien
gtgtcccaatttgctgccagtgcaa

SEQ ID NO: 53565 - DNA, 25 bp, Homo sapien
gtcccaatttgctgccagtgcaaga

SEQ ID NO: 53566 - DNA, 25 bp, Homo sapien
tcccaatttgctgccagtgcaagat

SEQ ID NO: 53567 - DNA, 25 bp, Homo sapien
caatttgctgccagtgcaagatctg

SEQ ID NO: 53568 - DNA, 25 bp, Homo sapien
atccattgctcatcctaggaagacg

SEQ ID NO: 53569 - DNA, 25 bp, Homo sapien
gacgggttgagaatccctaatttga

SEQ ID NO: 53570 - DNA, 25 bp, Homo sapien
cctaatttgagggtcagttcctgca

SEQ ID NO: 53571 - DNA, 25 bp, Homo sapien
agttcctgcagaagtgccctttgcc

SEQ ID NO: 53572 - DNA, 25 bp, Homo sapien
actcaatgcctcaatttgttttctg

SEQ ID NO: 53573 - DNA, 25 bp, Homo sapien
gttttctgcatgactgagagtctca

SEQ ID NO: 53574 - DNA, 25 bp, Homo sapien
agagtctcagtgttggaacgggaca

SEQ ID NO: 53575 - DNA, 25 bp, Homo sapien
tgagtctgtgaggtcttcttgtcat

SEQ ID NO: 53576 - DNA, 25 bp, Homo sapien
gtagatgttacaattttgtcgccaa

SEQ ID NO: 53577 - DNA, 25 bp, Homo sapien
ttgtcgccaaactaaacttgctgct

SEQ ID NO: 53578 - DNA, 25 bp, Homo sapien
acttgctgcttaatgatttgctcac

SEQ ID NO: 53579 - DNA, 25 bp, Homo sapien
agagctcacctccagtgaagtcgcc

SEQ ID NO: 53580 - DNA, 25 bp, Homo sapien
gtgaagtcgccactgaggtcccatt

SEQ ID NO: 53581 - DNA, 25 bp, Homo sapien
tcagcctgaggacccagctaaggaa

SEQ ID NO: 53582 - DNA, 25 bp, Homo sapien
gtttttgaggagtttgctcgccata

SEQ ID NO: 53583 - DNA, 25 bp, Homo sapien
gagtttgctcgccataatctgaaag

SEQ ID NO: 53584 - DNA, 25 bp, Homo sapien
acgctgatgagtgaagatgtcggct

SEQ ID NO: 53585 - DNA, 25 bp, Homo sapien
agatgtcggctcaggatgccggaaa

SEQ ID NO: 53586 - DNA, 25 bp, Homo sapien
aggatgccggaaaatgacctgtagt

SEQ ID NO: 53587 - DNA, 25 bp, Homo sapien
gacctgtagttaccagtgcaacgag

SEQ ID NO: 53588 - DNA, 25 bp, Homo sapien
agccccacagtttagtcctttggag

SEQ ID NO: 53589 - DNA, 25 bp, Homo sapien
gtcctttggagttatgctgcgtatg

SEQ ID NO: 53590 - DNA, 25 bp, Homo sapien
gtgactatgaacttctctcagactt

SEQ ID NO: 53591 - DNA, 25 bp, Homo sapien
acttctctcagacttactttactca

SEQ ID NO: 53592 - DNA, 25 bp, Homo sapien
ctcagacttactttactcatttttt

SEQ ID NO: 53593 - DNA, 25 bp, Homo sapien
taagttgcactgatattttacctct

SEQ ID NO: 53594 - DNA, 25 bp, Homo sapien
gttgcactgatattttacctcttat

SEQ ID NO: 53595 - DNA, 25 bp, Homo sapien
ctgatattttacctcttattgcaaa

SEQ ID NO: 53596 - DNA, 25 bp, Homo sapien
agcatttgtttaagggtgatagtca

SEQ ID NO: 53597 - DNA, 25 bp, Homo sapien
ggcatttaaaatgtgctgtcaaaac

SEQ ID NO: 53598 - DNA, 25 bp, Homo sapien
tctgtcaagaagatgatcagacctt

SEQ ID NO: 53599 - DNA, 25 bp, Homo sapien
atcagaccttggatcagatgaactc

SEQ ID NO: 53600 - DNA, 25 bp, Homo sapien
accttggatcagatgaactcttaga

SEQ ID NO: 53601 - DNA, 25 bp, Homo sapien
gaaacaaatctaagaatcattcctg

SEQ ID NO: 53602 - DNA, 25 bp, Homo sapien
ctaagaatcattcctgtactacaga

SEQ ID NO: 53603 - DNA, 25 bp, Homo sapien
cattcctgtactacagaagggttaa

SEQ ID NO: 53604 - DNA, 25 bp, Homo sapien
taaggcaaaggtagccttttgggct

SEQ ID NO: 53605 - DNA, 25 bp, Homo sapien
tttttaatgaatatgacccctatag

SEQ ID NO: 53606 - DNA, 25 bp, Homo sapien
atatgacccctatagaaaagtcaag

SEQ ID NO: 53607 - DNA, 25 bp, Homo sapien
gtaattagatcttcacaaagttgtc

SEQ ID NO: 53608 - DNA, 25 bp, Homo sapien
tcttcacaaagttgtcttttcactg

SEQ ID NO: 53609 - DNA, 25 bp, Homo sapien
gttataagcaaaagttggttgccta

SEQ ID NO: 53610 - DNA, 25 bp, Homo sapien
ggttgcctagggaacaattgtatat

SEQ ID NO: 53611 - DNA, 25 bp, Homo sapien
ggaacaattgtatattcagtttaac

SEQ ID NO: 53612 - DNA, 25 bp, Homo sapien
actactttgatacgacaccgcatgg

SEQ ID NO: 53613 - DNA, 25 bp, Homo sapien
gatacgacaccgcatggcttcgaga

SEQ ID NO: 53614 - DNA, 25 bp, Homo sapien
atggcttcgagactcacacgctgga

SEQ ID NO: 53615 - DNA, 25 bp, Homo sapien
acacgctggaggagcacaacctggc

SEQ ID NO: 53616 - DNA, 25 bp, Homo sapien
acctggccaattacatgtttttcct

SEQ ID NO: 53617 - DNA, 25 bp, Homo sapien
gagacagaacacacgggtcaggagt

SEQ ID NO: 53618 - DNA, 25 bp, Homo sapien
tcccagctggtgattgtttccgtaa

SEQ ID NO: 53619 - DNA, 25 bp, Homo sapien
gtgattgtttccgtaagcagtatga

SEQ ID NO: 53620 - DNA, 25 bp, Homo sapien
agcagtatgaggaccagcttagctg

SEQ ID NO: 53621 - DNA, 25 bp, Homo sapien
tgaggaccagcttagctgacacacc

SEQ ID NO: 53622 - DNA, 25 bp, Homo sapien
ttattctcacagcaagccccttagt

SEQ ID NO: 53623 - DNA, 25 bp, Homo sapien
gttggtgagtgttcctaggctaatg

SEQ ID NO: 53624 - DNA, 25 bp, Homo sapien
gtgagtgttcctaggctaatgataa

SEQ ID NO: 53625 - DNA, 25 bp, Homo sapien
gttcctaggctaatgataatctgta

SEQ ID NO: 53626 - DNA, 25 bp, Homo sapien
tgataatctgtataattcacatcct

SEQ ID NO: 53627 - DNA, 25 bp, Homo sapien
gtataattcacatcctgaaactaag

SEQ ID NO: 53628 - DNA, 25 bp, Homo sapien
cccgccccatggaatatttaatcta

SEQ ID NO: 53629 - DNA, 25 bp, Homo sapien
aatctatttaatcttcttgcattta

SEQ ID NO: 53630 - DNA, 25 bp, Homo sapien
gaagccaaagcactactagcttttt

SEQ ID NO: 53631 - DNA, 25 bp, Homo sapien
gtatttttgatgctgcttccaattt

SEQ ID NO: 53632 - DNA, 25 bp, Homo sapien
tttgatgctgcttccaattttaaaa

SEQ ID NO: 53633 - DNA, 25 bp, Homo sapien
gaacaaagctgccataaatcgaaat

SEQ ID NO: 53634 - DNA, 25 bp, Homo sapien
ttcaagctgactatgcctcccaggc

SEQ ID NO: 53635 - DNA, 25 bp, Homo sapien
ttcattgtggcgctgagcggcacct

SEQ ID NO: 53636 - DNA, 25 bp, Homo sapien
ctgagcggcacctccgagatgctgg

SEQ ID NO: 53637 - DNA, 25 bp, Homo sapien
acctccgagatgctggccttggtca

SEQ ID NO: 53638 - DNA, 25 bp, Homo sapien
ttggtcattggccacttcatctaca

SEQ ID NO: 53639 - DNA, 25 bp, Homo sapien
tcattggccacttcatctacagcag

SEQ ID NO: 53640 - DNA, 25 bp, Homo sapien
tgaggcctctgggtcaagctttcat

SEQ ID NO: 53641 - DNA, 25 bp, Homo sapien
tccaccaaagttctcatgcactatg

SEQ ID NO: 53642 - DNA, 25 bp, Homo sapien
aagttctcatgcactatgcactcag

SEQ ID NO: 53643 - DNA, 25 bp, Homo sapien
tgcactatgcactcagaaaaatcca

SEQ ID NO: 53644 - DNA, 25 bp, Homo sapien
tttttattctccagctttcagtgcc

SEQ ID NO: 53645 - DNA, 25 bp, Homo sapien
tcctggaccctttagcctctctgcc

SEQ ID NO: 53646 - DNA, 25 bp, Homo sapien
gggaggaaagaaactcctgatcatt

SEQ ID NO: 53647 - DNA, 25 bp, Homo sapien
gaaagaaactcctgatcattggcca

SEQ ID NO: 53648 - DNA, 25 bp, Homo sapien
aaagaaactcctgatcattggccaa

SEQ ID NO: 53649 - DNA, 25 bp, Homo sapien
aagaaactcctgatcattggccaaa

SEQ ID NO: 53650 - DNA, 25 bp, Homo sapien
gagagggtgggtcacccccccagat

SEQ ID NO: 53651 - DNA, 25 bp, Homo sapien
ggccatgcaggatgcttgatgctgc

SEQ ID NO: 53652 - DNA, 25 bp, Homo sapien
catgcaggatgcttgatgctgcgtc

SEQ ID NO: 53653 - DNA, 25 bp, Homo sapien
atgcaggatgcttgatgctgcgtcc

SEQ ID NO: 53654 - DNA, 25 bp, Homo sapien
gcaggatgcttgatgctgcgtcccc

SEQ ID NO: 53655 - DNA, 25 bp, Homo sapien
ttgatgctgcgtcccccgctgcttg

SEQ ID NO: 53656 - DNA, 25 bp, Homo sapien
gtttgagtacctgatgaaaatgaat

SEQ ID NO: 53657 - DNA, 25 bp, Homo sapien
gagagtatgtaatctttgaaagctg

SEQ ID NO: 53658 - DNA, 25 bp, Homo sapien
gagtatgtaatctttgaaagctgaa

SEQ ID NO: 53659 - DNA, 25 bp, Homo sapien
agctaaataatgtatacacatggac

SEQ ID NO: 53660 - DNA, 25 bp, Homo sapien
ggacacaccagagtgtagaataata

SEQ ID NO: 53661 - DNA, 25 bp, Homo sapien
acaccagagtgtagaataatagaca

SEQ ID NO: 53662 - DNA, 25 bp, Homo sapien
acttggaagagttggagggttggca

SEQ ID NO: 53663 - DNA, 25 bp, Homo sapien
ggcagggggcgatgataatttactt

SEQ ID NO: 53664 - DNA, 25 bp, Homo sapien
gggtgatggttacagcccagacttt

SEQ ID NO: 53665 - DNA, 25 bp, Homo sapien
ggtgatggttacagcccagacttta

SEQ ID NO: 53666 - DNA, 25 bp, Homo sapien
tgatggttacagcccagactttacc

SEQ ID NO: 53667 - DNA, 25 bp, Homo sapien
tgaaagtttccagccctattcagaa

SEQ ID NO: 53668 - DNA, 25 bp, Homo sapien
agccctattcagaaagcaactcttg

SEQ ID NO: 53669 - DNA, 25 bp, Homo sapien
gaaagcaactcttggctgtgtgcat

SEQ ID NO: 53670 - DNA, 25 bp, Homo sapien
tcttggctgtgtgcatttttcaact

SEQ ID NO: 53671 - DNA, 25 bp, Homo sapien
gaaggtcagattttcttgtcagttt

SEQ ID NO: 53672 - DNA, 25 bp, Homo sapien
cagtttctgagaaacctggcagcct

SEQ ID NO: 53673 - DNA, 25 bp, Homo sapien
tggcagcctgctgttaacaacacag

SEQ ID NO: 53674 - DNA, 25 bp, Homo sapien
aacaacacaggccagtattgggttt

SEQ ID NO: 53675 - DNA, 25 bp, Homo sapien
ggtatgtgaccaaggtcggcctaaa

SEQ ID NO: 53676 - DNA, 25 bp, Homo sapien
tcggcctaaaggatggcgcaggtcc

SEQ ID NO: 53677 - DNA, 25 bp, Homo sapien
ctgtaatatttggttgctcagcata

SEQ ID NO: 53678 - DNA, 25 bp, Homo sapien
ctgcggatgccaccctgggtgaaca

SEQ ID NO: 53679 - DNA, 25 bp, Homo sapien
ccctgggtgaacatctggctgctgg

SEQ ID NO: 53680 - DNA, 25 bp, Homo sapien
ctgccgatgatcttcaagctccggg

SEQ ID NO: 53681 - DNA, 25 bp, Homo sapien
atgatcttcaagctccgggccctgg

SEQ ID NO: 53682 - DNA, 25 bp, Homo sapien
tggacctcacccagtggctcatggt

SEQ ID NO: 53683 - DNA, 25 bp, Homo sapien
agtggctcatggtcctcaagatctc

SEQ ID NO: 53684 - DNA, 25 bp, Homo sapien
tcaagatctcactgccagtcattgg

SEQ ID NO: 53685 - DNA, 25 bp, Homo sapien
actgccagtcattgggctcgacgaa

SEQ ID NO: 53686 - DNA, 25 bp, Homo sapien
tgggctcgacgaaatcctcaagttc

SEQ ID NO: 53687 - DNA, 25 bp, Homo sapien
gaaatcctcaagttcgttgctcgga

SEQ ID NO: 53688 - DNA, 25 bp, Homo sapien
gttgctcggaactacctagagggat

SEQ ID NO: 53689 - DNA, 25 bp, Homo sapien
tttatgtggcctattgtctcaggac

SEQ ID NO: 53690 - DNA, 25 bp, Homo sapien
tggcctattgtctcaggactctcat

SEQ ID NO: 53691 - DNA, 25 bp, Homo sapien
tgtctcaggactctcatcactcaga

SEQ ID NO: 53692 - DNA, 25 bp, Homo sapien
cactcagaagcctgcctctgattta

SEQ ID NO: 53693 - DNA, 25 bp, Homo sapien
ctctgatttaccctacagcttcagg

SEQ ID NO: 53694 - DNA, 25 bp, Homo sapien
gatttaccctacagcttcaggccca

SEQ ID NO: 53695 - DNA, 25 bp, Homo sapien
ttgggtggtgctgttcttttctggt

SEQ ID NO: 53696 - DNA, 25 bp, Homo sapien
gcccaagatttggtgcctgcagcct

SEQ ID NO: 53697 - DNA, 25 bp, Homo sapien
aagatttggtgcctgcagcctcttg

SEQ ID NO: 53698 - DNA, 25 bp, Homo sapien
tgcagcctcttgtctggttgaggac

SEQ ID NO: 53699 - DNA, 25 bp, Homo sapien
gcctcttgtctggttgaggacttgg

SEQ ID NO: 53700 - DNA, 25 bp, Homo sapien
gggcttgtgaactcaaccccaattt

SEQ ID NO: 53701 - DNA, 25 bp, Homo sapien
ggcttgtgaactcaaccccaatttc

SEQ ID NO: 53702 - DNA, 25 bp, Homo sapien
gcttgtgaactcaaccccaatttcc

SEQ ID NO: 53703 - DNA, 25 bp, Homo sapien
caatttccccgagacatttatccaa

SEQ ID NO: 53704 - DNA, 25 bp, Homo sapien
atttccccgagacatttatccaaag

SEQ ID NO: 53705 - DNA, 25 bp, Homo sapien
tttccccgagacatttatccaaagg

SEQ ID NO: 53706 - DNA, 25 bp, Homo sapien
ttccccgagacatttatccaaaggc

SEQ ID NO: 53707 - DNA, 25 bp, Homo sapien
tccccgagacatttatccaaaggcc

SEQ ID NO: 53708 - DNA, 25 bp, Homo sapien
cccgagacatttatccaaaggccct

SEQ ID NO: 53709 - DNA, 25 bp, Homo sapien
ccgagacatttatccaaaggccctg

SEQ ID NO: 53710 - DNA, 25 bp, Homo sapien
gagacatttatccaaaggccctggg

SEQ ID NO: 53711 - DNA, 25 bp, Homo sapien
tgggcgaggccgtgcagaacactct

SEQ ID NO: 53712 - DNA, 25 bp, Homo sapien
agaacactctgggagccgtggtgac

SEQ ID NO: 53713 - DNA, 25 bp, Homo sapien
gagccgtggtgacagccattgacat

SEQ ID NO: 53714 - DNA, 25 bp, Homo sapien
gacagccattgacataccactaggt

SEQ ID NO: 53715 - DNA, 25 bp, Homo sapien
ctaggtctggtaaaggacgcggcca

SEQ ID NO: 53716 - DNA, 25 bp, Homo sapien
gtactgggtgcctgaccacgaaatc

SEQ ID NO: 53717 - DNA, 25 bp, Homo sapien
actgccacaactgccggaaggagtt

SEQ ID NO: 53718 - DNA, 25 bp, Homo sapien
aggagttcagcatcaagctctccaa

SEQ ID NO: 53719 - DNA, 25 bp, Homo sapien
acagggcttctgtgatgagtgctcc

SEQ ID NO: 53720 - DNA, 25 bp, Homo sapien
tgttccttctcgtggctgggaccat

SEQ ID NO: 53721 - DNA, 25 bp, Homo sapien
gtccgagtctgcttcaactgcaata

SEQ ID NO: 53722 - DNA, 25 bp, Homo sapien
ccagtactctgggtgcaataaataa

SEQ ID NO: 53723 - DNA, 25 bp, Homo sapien
agaaatttaagtcctccaattccag

SEQ ID NO: 53724 - DNA, 25 bp, Homo sapien
tccaattccagcatatccagtgagt

SEQ ID NO: 53725 - DNA, 25 bp, Homo sapien
atccagtgagttttgacagtgtgtt

SEQ ID NO: 53726 - DNA, 25 bp, Homo sapien
ttggttcttgttcttcttaaatgtg

SEQ ID NO: 53727 - DNA, 25 bp, Homo sapien
gacatgaaataattgtgctgctaca

SEQ ID NO: 53728 - DNA, 25 bp, Homo sapien
gtgctgctacattatactggaaatt

SEQ ID NO: 53729 - DNA, 25 bp, Homo sapien
ggaagagctcttggctcccttgagg

SEQ ID NO: 53730 - DNA, 25 bp, Homo sapien
cccttgaggttctgctagtggtgtt

SEQ ID NO: 53731 - DNA, 25 bp, Homo sapien
aggagtggttacaactgagctttta

SEQ ID NO: 53732 - DNA, 25 bp, Homo sapien
caactgagcttttagtaaccattta

SEQ ID NO: 53733 - DNA, 25 bp, Homo sapien
tccggctacaccaacatcatgaggg

SEQ ID NO: 53734 - DNA, 25 bp, Homo sapien
ccaacatcatgagggtgctaagcat

SEQ ID NO: 53735 - DNA, 25 bp, Homo sapien
gtgctaagcatatcctgagacgccc

SEQ ID NO: 53736 - DNA, 25 bp, Homo sapien
acctttaagtcctctcttctctatt

SEQ ID NO: 53737 - DNA, 25 bp, Homo sapien
taagtcctctcttctctattcctga

SEQ ID NO: 53738 - DNA, 25 bp, Homo sapien
cctgaggcctatctgagactataac

SEQ ID NO: 53739 - DNA, 25 bp, Homo sapien
agactataactgtcatctagcccct

SEQ ID NO: 53740 - DNA, 25 bp, Homo sapien
gtcatctagccccttcgaggttgcc

SEQ ID NO: 53741 - DNA, 25 bp, Homo sapien
tttcacacaggtcctgaaagtctgt

SEQ ID NO: 53742 - DNA, 25 bp, Homo sapien
gaaagtctgtgtccaattatgcact

SEQ ID NO: 53743 - DNA, 25 bp, Homo sapien
tgtgtccaattatgcactggccacc

SEQ ID NO: 53744 - DNA, 25 bp, Homo sapien
aagggcagctattccttagaccagc

SEQ ID NO: 53745 - DNA, 25 bp, Homo sapien
ttagaccagcctcctgaaagaaaca

SEQ ID NO: 53746 - DNA, 25 bp, Homo sapien
gagctggttatgtgtaactagcgtt

SEQ ID NO: 53747 - DNA, 25 bp, Homo sapien
agcgttggagttgacattttggcat

SEQ ID NO: 53748 - DNA, 25 bp, Homo sapien
tttggcatgtgctctgagcttgaat

SEQ ID NO: 53749 - DNA, 25 bp, Homo sapien
agcttgaattttgataccaaccatt

SEQ ID NO: 53750 - DNA, 25 bp, Homo sapien
caaccattcagtgcatcatacctag

SEQ ID NO: 53751 - DNA, 25 bp, Homo sapien
atacctagtctttctatgctccaaa

SEQ ID NO: 53752 - DNA, 25 bp, Homo sapien
ggacctgagagcacctggaatttgt

SEQ ID NO: 53753 - DNA, 25 bp, Homo sapien
gagcacctggaatttgttggaagca

SEQ ID NO: 53754 - DNA, 25 bp, Homo sapien
aagcagatcagagcacacgtacgaa

SEQ ID NO: 53755 - DNA, 25 bp, Homo sapien
ggtgggagacgtgacttatccagcc

SEQ ID NO: 53756 - DNA, 25 bp, Homo sapien
acttatccagcccacagggactgct

SEQ ID NO: 53757 - DNA, 25 bp, Homo sapien
acagggactgctacctgggagacct

SEQ ID NO: 53758 - DNA, 25 bp, Homo sapien
tgggagacctgtgcaacagcgccgt

SEQ ID NO: 53759 - DNA, 25 bp, Homo sapien
gcaacagcgccgtggcaagccatgt

SEQ ID NO: 53760 - DNA, 25 bp, Homo sapien
tgacctgtctcttgccaggactgtg

SEQ ID NO: 53761 - DNA, 25 bp, Homo sapien
tcttgccaggactgtggagcggata

SEQ ID NO: 53762 - DNA, 25 bp, Homo sapien
gggaacaagggacatctgaacatct

SEQ ID NO: 53763 - DNA, 25 bp, Homo sapien
ggacatctgaacatctaatgtgaga

SEQ ID NO: 53764 - DNA, 25 bp, Homo sapien
cgtcgcagcccatcattgcaatcaa

SEQ ID NO: 53765 - DNA, 25 bp, Homo sapien
gcaatcaagtggagacagagtcggt

SEQ ID NO: 53766 - DNA, 25 bp, Homo sapien
tccgtttcaaccaagagaacatcaa

SEQ ID NO: 53767 - DNA, 25 bp, Homo sapien
cgtttcaaccaagagaacatcaagg

SEQ ID NO: 53768 - DNA, 25 bp, Homo sapien
accccgcaggaaacccgagctgata

SEQ ID NO: 53769 - DNA, 25 bp, Homo sapien
gaaacccgagctgatattgcgcgca

SEQ ID NO: 53770 - DNA, 25 bp, Homo sapien
aacccgagctgatattgcgcgcaga

SEQ ID NO: 53771 - DNA, 25 bp, Homo sapien
cccgagctgatattgcgcgcagagg

SEQ ID NO: 53772 - DNA, 25 bp, Homo sapien
atattgcgcgcagagggtggacttt

SEQ ID NO: 53773 - DNA, 25 bp, Homo sapien
tggagcccctgggtgcgaactcaca

SEQ ID NO: 53774 - DNA, 25 bp, Homo sapien
gcccctgggtgcgaactcacagtga

SEQ ID NO: 53775 - DNA, 25 bp, Homo sapien
cctgggtgcgaactcacagtgactg

SEQ ID NO: 53776 - DNA, 25 bp, Homo sapien
agagtcccagaaacaaaactatgct

SEQ ID NO: 53777 - DNA, 25 bp, Homo sapien
taactaaattcatcgccatcaagaa

SEQ ID NO: 53778 - DNA, 25 bp, Homo sapien
aattcatcgccatcaagaataagta

SEQ ID NO: 53779 - DNA, 25 bp, Homo sapien
ctgataggaaggtcctaggctgccg

SEQ ID NO: 53780 - DNA, 25 bp, Homo sapien
aaggtcctaggctgccgtgggccct

SEQ ID NO: 53781 - DNA, 25 bp, Homo sapien
tcttattggtttagaactcttgatt

SEQ ID NO: 53782 - DNA, 25 bp, Homo sapien
gaactcttgattttgtacatagtcc

SEQ ID NO: 53783 - DNA, 25 bp, Homo sapien
gattttgtacatagtcctctggtct

SEQ ID NO: 53784 - DNA, 25 bp, Homo sapien
tgtacatagtcctctggtctatctc

SEQ ID NO: 53785 - DNA, 25 bp, Homo sapien
atagtcctctggtctatctcatgaa

SEQ ID NO: 53786 - DNA, 25 bp, Homo sapien
agtcctctggtctatctcatgaaac

SEQ ID NO: 53787 - DNA, 25 bp, Homo sapien
gtctatctcatgaaacctcttctca

SEQ ID NO: 53788 - DNA, 25 bp, Homo sapien
tagaagcgtctgtatctctggagca

SEQ ID NO: 53789 - DNA, 25 bp, Homo sapien
agagagatcctgatacctctgtggg

SEQ ID NO: 53790 - DNA, 25 bp, Homo sapien
aggtgggatcagatgctgctccaac

SEQ ID NO: 53791 - DNA, 25 bp, Homo sapien
agatgctgctccaaccatgcagttc

SEQ ID NO: 53792 - DNA, 25 bp, Homo sapien
gggacggtaccaagagcagcgctta

SEQ ID NO: 53793 - DNA, 25 bp, Homo sapien
gtaccaagagcagcgcttagccctt

SEQ ID NO: 53794 - DNA, 25 bp, Homo sapien
gcttagcccttacccaggaaatatc

SEQ ID NO: 53795 - DNA, 25 bp, Homo sapien
ccaggaaatatccttcatggccaca

SEQ ID NO: 53796 - DNA, 25 bp, Homo sapien
cacagaaatggagggcgcccaggat

SEQ ID NO: 53797 - DNA, 25 bp, Homo sapien
aggatccaggcagccaccgggaaca

SEQ ID NO: 53798 - DNA, 25 bp, Homo sapien
accgggaacagtcagctttctttat

SEQ ID NO: 53799 - DNA, 25 bp, Homo sapien
tgtggcccctggacgggtacaataa

SEQ ID NO: 53800 - DNA, 25 bp, Homo sapien
aataacacactgtactgatgtcaca

SEQ ID NO: 53801 - DNA, 25 bp, Homo sapien
actgtactgatgtcacaactttgca

SEQ ID NO: 53802 - DNA, 25 bp, Homo sapien
gatgtcacaactttgcaagctctgc

SEQ ID NO: 53803 - DNA, 25 bp, Homo sapien
acaactttgcaagctctgccttggg

SEQ ID NO: 53804 - DNA, 25 bp, Homo sapien
tctgccttgggttcagcccatctgg

SEQ ID NO: 53805 - DNA, 25 bp, Homo sapien
gggttcagcccatctgggctcaaat

SEQ ID NO: 53806 - DNA, 25 bp, Homo sapien
agtgcccagaacctcggtttcctca

SEQ ID NO: 53807 - DNA, 25 bp, Homo sapien
gggatcataacacctacctcatgga

SEQ ID NO: 53808 - DNA, 25 bp, Homo sapien
gatcataacacctacctcatggagt

SEQ ID NO: 53809 - DNA, 25 bp, Homo sapien
aagtgcttaatagtgcctggtacat

SEQ ID NO: 53810 - DNA, 25 bp, Homo sapien
caccagatgagttaggaataaacct

SEQ ID NO: 53811 - DNA, 25 bp, Homo sapien
aatatttcacacatgttcttataga

SEQ ID NO: 53812 - DNA, 25 bp, Homo sapien
gttcttatagatcatgtatcacttg

SEQ ID NO: 53813 - DNA, 25 bp, Homo sapien
agatcatgtatcacttgcaagtttt

SEQ ID NO: 53814 - DNA, 25 bp, Homo sapien
cttgcaagttttaggagttcatatc

SEQ ID NO: 53815 - DNA, 25 bp, Homo sapien
ggagttcatatcctatatcatttca

SEQ ID NO: 53816 - DNA, 25 bp, Homo sapien
tatttttgccaagatttagatgttt

SEQ ID NO: 53817 - DNA, 25 bp, Homo sapien
tttcactaaggcatgtttattcccc

SEQ ID NO: 53818 - DNA, 25 bp, Homo sapien
aaggcatgtttattcccctaatcca

SEQ ID NO: 53819 - DNA, 25 bp, Homo sapien
tgtttattcccctaatccattaaag

SEQ ID NO: 53820 - DNA, 25 bp, Homo sapien
attcccctaatccattaaagagcat

SEQ ID NO: 53821 - DNA, 25 bp, Homo sapien
tgaatgggtccattttgcccttcca

SEQ ID NO: 53822 - DNA, 25 bp, Homo sapien
cattttgcccttccatagcctaatc

SEQ ID NO: 53823 - DNA, 25 bp, Homo sapien
tccatagcctaatccctgggcattg

SEQ ID NO: 53824 - DNA, 25 bp, Homo sapien
tagttacacatcttcaacagacccc

SEQ ID NO: 53825 - DNA, 25 bp, Homo sapien
cagaccccctctagaaatttttcag

SEQ ID NO: 53826 - DNA, 25 bp, Homo sapien
aatttttcagatgcttctgggagac

SEQ ID NO: 53827 - DNA, 25 bp, Homo sapien
caaagggtgaagctatttatctgta

SEQ ID NO: 53828 - DNA, 25 bp, Homo sapien
ttaaaccctggatcagtcctttgat

SEQ ID NO: 53829 - DNA, 25 bp, Homo sapien
ggatcagtcctttgatcagtataat

SEQ ID NO: 53830 - DNA, 25 bp, Homo sapien
taaagttactttgtcagaggcacaa

SEQ ID NO: 53831 - DNA, 25 bp, Homo sapien
tcagaggcacaaaagggtttaaact

SEQ ID NO: 53832 - DNA, 25 bp, Homo sapien
tcccaagtacaaatagagtgacccg

SEQ ID NO: 53833 - DNA, 25 bp, Homo sapien
caagtacaaatagagtgacccgtaa

SEQ ID NO: 53834 - DNA, 25 bp, Homo sapien
tacaaatagagtgacccgtaaaatc

SEQ ID NO: 53835 - DNA, 25 bp, Homo sapien
gttttttgctacaatcttgacccct

SEQ ID NO: 53836 - DNA, 25 bp, Homo sapien
ttttttgctacaatcttgacccctt

SEQ ID NO: 53837 - DNA, 25 bp, Homo sapien
tttttgctacaatcttgaccccttt

SEQ ID NO: 53838 - DNA, 25 bp, Homo sapien
ttttgctacaatcttgacccctttg

SEQ ID NO: 53839 - DNA, 25 bp, Homo sapien
tttgctacaatcttgacccctttgc

SEQ ID NO: 53840 - DNA, 25 bp, Homo sapien
tgctacaatcttgacccctttgcta

SEQ ID NO: 53841 - DNA, 25 bp, Homo sapien
ctacaatcttgacccctttgctaca

SEQ ID NO: 53842 - DNA, 25 bp, Homo sapien
acaatcttgacccctttgctacatt

SEQ ID NO: 53843 - DNA, 25 bp, Homo sapien
gagtagcctaattcaggaataccca

SEQ ID NO: 53844 - DNA, 25 bp, Homo sapien
ggaatacccaagcattgcaaggcgt

SEQ ID NO: 53845 - DNA, 25 bp, Homo sapien
tgcaaggcgtgcagtgcgtgtactt

SEQ ID NO: 53846 - DNA, 25 bp, Homo sapien
gcagtgcgtgtacttcttccttttg

SEQ ID NO: 53847 - DNA, 25 bp, Homo sapien
ttccttttgctacaatgcacctgtg

SEQ ID NO: 53848 - DNA, 25 bp, Homo sapien
gggttttcatattacgctgcaacaa

SEQ ID NO: 53849 - DNA, 25 bp, Homo sapien
ggaaaagacttgatgctgcacctca

SEQ ID NO: 53850 - DNA, 25 bp, Homo sapien
tgctgcacctcatatgcgaatccga

SEQ ID NO: 53851 - DNA, 25 bp, Homo sapien
gcgaatccgacttagcaatattaca

SEQ ID NO: 53852 - DNA, 25 bp, Homo sapien
aattggaggagtttgcatgtctcat

SEQ ID NO: 53853 - DNA, 25 bp, Homo sapien
gcatgtctcatgataaccaaatgta

SEQ ID NO: 53854 - DNA, 25 bp, Homo sapien
gcttgacagtttctaaacaaacaaa

SEQ ID NO: 53855 - DNA, 25 bp, Homo sapien
tgtttctttttagctgagatgacag

SEQ ID NO: 53856 - DNA, 25 bp, Homo sapien
agctgagatgacagattgcttctct

SEQ ID NO: 53857 - DNA, 25 bp, Homo sapien
gagatgacagattgcttctctgtat

SEQ ID NO: 53858 - DNA, 25 bp, Homo sapien
gggatggtcacatttaccatgtatt

SEQ ID NO: 53859 - DNA, 25 bp, Homo sapien
ggtcacatttaccatgtattgtgtt

SEQ ID NO: 53860 - DNA, 25 bp, Homo sapien
atttaccatgtattgtgttattagc

SEQ ID NO: 53861 - DNA, 25 bp, Homo sapien
ccatgtattgtgttattagcagtta

SEQ ID NO: 53862 - DNA, 25 bp, Homo sapien
tcttcactattgtacctgtggaaat

SEQ ID NO: 53863 - DNA, 25 bp, Homo sapien
ttcactattgtacctgtggaaatac

SEQ ID NO: 53864 - DNA, 25 bp, Homo sapien
ggaaatacaagccattttacaggaa

SEQ ID NO: 53865 - DNA, 25 bp, Homo sapien
accagatctggaacattacttattt

SEQ ID NO: 53866 - DNA, 25 bp, Homo sapien
ggaacattacttatttgaggtcaga

SEQ ID NO: 53867 - DNA, 25 bp, Homo sapien
gaacaaaacaagaacctggccaggt

SEQ ID NO: 53868 - DNA, 25 bp, Homo sapien
gaacctggccaggtgttgattacct

SEQ ID NO: 53869 - DNA, 25 bp, Homo sapien
ggccaggtgttgattaccttttagt

SEQ ID NO: 53870 - DNA, 25 bp, Homo sapien
ataagctgagtccatatacttgtct

SEQ ID NO: 53871 - DNA, 25 bp, Homo sapien
gagtccatatacttgtctaactaag

SEQ ID NO: 53872 - DNA, 25 bp, Homo sapien
acttgtctaactaagaaagcagtac

SEQ ID NO: 53873 - DNA, 25 bp, Homo sapien
aattctgcaatttcatactacctaa

SEQ ID NO: 53874 - DNA, 25 bp, Homo sapien
gaaaatgtcaagctgatttacttta

SEQ ID NO: 53875 - DNA, 25 bp, Homo sapien
taaactgagtccttcactggcatgc

SEQ ID NO: 53876 - DNA, 25 bp, Homo sapien
gagaactagacagctccgactagaa

SEQ ID NO: 53877 - DNA, 25 bp, Homo sapien
gctccgactagaagctaagcgttct

SEQ ID NO: 53878 - DNA, 25 bp, Homo sapien
agcgttctaaacagttacagcacca

SEQ ID NO: 53879 - DNA, 25 bp, Homo sapien
tacagcaccacctatatatgtcaga

SEQ ID NO: 53880 - DNA, 25 bp, Homo sapien
tatatgtcagaagccaaaccttttc

SEQ ID NO: 53881 - DNA, 25 bp, Homo sapien
caaaccttttcgttttactgatcat

SEQ ID NO: 53882 - DNA, 25 bp, Homo sapien
atttcagtgggcagctgctatcaaa

SEQ ID NO: 53883 - DNA, 25 bp, Homo sapien
gggcagctgctatcaaaattttgga

SEQ ID NO: 53884 - DNA, 25 bp, Homo sapien
gatttcttagggtctgtgtactttg

SEQ ID NO: 53885 - DNA, 25 bp, Homo sapien
gtctgtgtactttggttgtattcta

SEQ ID NO: 53886 - DNA, 25 bp, Homo sapien
ggtatttatcttttattgacagtga

SEQ ID NO: 53887 - DNA, 25 bp, Homo sapien
gagacgggccggaaactcacaccca

SEQ ID NO: 53888 - DNA, 25 bp, Homo sapien
gaaactcacacccaaggaggctttc

SEQ ID NO: 53889 - DNA, 25 bp, Homo sapien
tcacacccaaggaggctttccggca

SEQ ID NO: 53890 - DNA, 25 bp, Homo sapien
tgtcgcaccgcttccatggcaaggg

SEQ ID NO: 53891 - DNA, 25 bp, Homo sapien
gcttccatggcaagggctcaggcaa

SEQ ID NO: 53892 - DNA, 25 bp, Homo sapien
tcaggcaagatgaagacagagcggc

SEQ ID NO: 53893 - DNA, 25 bp, Homo sapien
acgaggaggcgctcctgaagaagat

SEQ ID NO: 53894 - DNA, 25 bp, Homo sapien
agaagatgagctccagcgacacgcc

SEQ ID NO: 53895 - DNA, 25 bp, Homo sapien
cctacatcgtgctcagcggcagcgg

SEQ ID NO: 53896 - DNA, 25 bp, Homo sapien
gcaagagcatgaacgcgaacaccat

SEQ ID NO: 53897 - DNA, 25 bp, Homo sapien
gaacaccatcaccaagtgacagcgc

SEQ ID NO: 53898 - DNA, 25 bp, Homo sapien
tctttcaacctggatgacactgaag

SEQ ID NO: 53899 - DNA, 25 bp, Homo sapien
tgaagtagccctccttcaggccgtc

SEQ ID NO: 53900 - DNA, 25 bp, Homo sapien
ggcttgcctgtgttgagagaataga

SEQ ID NO: 53901 - DNA, 25 bp, Homo sapien
accaagatagtttcctgctggcctt

SEQ ID NO: 53902 - DNA, 25 bp, Homo sapien
tcctgctggcctttgaacactatat

SEQ ID NO: 53903 - DNA, 25 bp, Homo sapien
gaaaacaccacgtgacacacttttg

SEQ ID NO: 53904 - DNA, 25 bp, Homo sapien
acttttggccaaaactcctgatgaa

SEQ ID NO: 53905 - DNA, 25 bp, Homo sapien
ctcctgatgaaggtgacagatctgc

SEQ ID NO: 53906 - DNA, 25 bp, Homo sapien
acagatctgcggatgataggagcct

SEQ ID NO: 53907 - DNA, 25 bp, Homo sapien
gatgataggagcctgccatgccagc

SEQ ID NO: 53908 - DNA, 25 bp, Homo sapien
catgaaggtggaatgccccacagaa

SEQ ID NO: 53909 - DNA, 25 bp, Homo sapien
tcggcccagacctcggtgatcactg

SEQ ID NO: 53910 - DNA, 25 bp, Homo sapien
atcactgagggatttccgcgagctc

SEQ ID NO: 53911 - DNA, 25 bp, Homo sapien
cactgagggatttccgcgagctcgg

SEQ ID NO: 53912 - DNA, 25 bp, Homo sapien
agggatttccgcgagctcggcctca

SEQ ID NO: 53913 - DNA, 25 bp, Homo sapien
gatttccgcgagctcggcctcactt

SEQ ID NO: 53914 - DNA, 25 bp, Homo sapien
acttctgccccgacttgtggctcgg

SEQ ID NO: 53915 - DNA, 25 bp, Homo sapien
ttctgccccgacttgtggctcggac

SEQ ID NO: 53916 - DNA, 25 bp, Homo sapien
ccgacttgtggctcggacccaggga

SEQ ID NO: 53917 - DNA, 25 bp, Homo sapien
acttgtggctcggacccagggacct

SEQ ID NO: 53918 - DNA, 25 bp, Homo sapien
cttgtggctcggacccagggacctt

SEQ ID NO: 53919 - DNA, 25 bp, Homo sapien
tcccggcgccttgagacccgaggcg

SEQ ID NO: 53920 - DNA, 25 bp, Homo sapien
gaagctcaatgggacagaccccgag

SEQ ID NO: 53921 - DNA, 25 bp, Homo sapien
caatgggacagaccccgaggaagcc

SEQ ID NO: 53922 - DNA, 25 bp, Homo sapien
aggaagccatcctgagtgccttccg

SEQ ID NO: 53923 - DNA, 25 bp, Homo sapien
tcctgagtgccttccgcatgtttga

SEQ ID NO: 53924 - DNA, 25 bp, Homo sapien
aaggatgagttcaagcagcttctcc

SEQ ID NO: 53925 - DNA, 25 bp, Homo sapien
ttctcctgacccaggcagacaagtt

SEQ ID NO: 53926 - DNA, 25 bp, Homo sapien
tgacccaggcagacaagttctctcc

SEQ ID NO: 53927 - DNA, 25 bp, Homo sapien
acaagttctctccagctgaggtgga

SEQ ID NO: 53928 - DNA, 25 bp, Homo sapien
tccagctgaggtggagcagatgttc

SEQ ID NO: 53929 - DNA, 25 bp, Homo sapien
agatgttcgccctgacacccatgga

SEQ ID NO: 53930 - DNA, 25 bp, Homo sapien
tacatcatcacccatggagacgaga

SEQ ID NO: 53931 - DNA, 25 bp, Homo sapien
aggtgatgctcgtgattgatgctgc

SEQ ID NO: 53932 - DNA, 25 bp, Homo sapien
tgctcgtgattgatgctgcagtgac

SEQ ID NO: 53933 - DNA, 25 bp, Homo sapien
gatgctgcagtgaccaatgtggaag

SEQ ID NO: 53934 - DNA, 25 bp, Homo sapien
aatgtggaagacctgtcctcactgg

SEQ ID NO: 53935 - DNA, 25 bp, Homo sapien
tggaagacctgtcctcactggagga

SEQ ID NO: 53936 - DNA, 25 bp, Homo sapien
gaggagtaccttgccagcctgggca

SEQ ID NO: 53937 - DNA, 25 bp, Homo sapien
aagctcagctccttctcgacagtgg

SEQ ID NO: 53938 - DNA, 25 bp, Homo sapien
agctccttctcgacagtgggtgagt

SEQ ID NO: 53939 - DNA, 25 bp, Homo sapien
tacatgctggagaagtgtctgggcc

SEQ ID NO: 53940 - DNA, 25 bp, Homo sapien
gcaggccatgagtcgaggctgggat

SEQ ID NO: 53941 - DNA, 25 bp, Homo sapien
atggcgagtaagaggcgaccccgcc

SEQ ID NO: 53942 - DNA, 25 bp, Homo sapien
cactcactggtactggccctttagt

SEQ ID NO: 53943 - DNA, 25 bp, Homo sapien
tggccctttagtgctttgcctgaaa

SEQ ID NO: 53944 - DNA, 25 bp, Homo sapien
tttgcctgaaagagacacagtcaca

SEQ ID NO: 53945 - DNA, 25 bp, Homo sapien
cagtcacatggccagatgagaactt

SEQ ID NO: 53946 - DNA, 25 bp, Homo sapien
gagaacttgcgatactagcctgcac

SEQ ID NO: 53947 - DNA, 25 bp, Homo sapien
ctagcctgcacccactggctgggaa

SEQ ID NO: 53948 - DNA, 25 bp, Homo sapien
tggctgggaagatctcttcctgctc

SEQ ID NO: 53949 - DNA, 25 bp, Homo sapien
tgtctggatcccctcccttgtgagc

SEQ ID NO: 53950 - DNA, 25 bp, Homo sapien
tgagccccagggttatcagttgctg

SEQ ID NO: 53951 - DNA, 25 bp, Homo sapien
gttatcagttgctggctgtgcctga

SEQ ID NO: 53952 - DNA, 25 bp, Homo sapien
tgcctgagcagctctgggtgctctc

SEQ ID NO: 53953 - DNA, 25 bp, Homo sapien
tttgtgaccaaagatggcatccttc

SEQ ID NO: 53954 - DNA, 25 bp, Homo sapien
atccttcatactggatgctgtatcc

SEQ ID NO: 53955 - DNA, 25 bp, Homo sapien
gtatccaatactttgttgtgtctgt

SEQ ID NO: 53956 - DNA, 25 bp, Homo sapien
ttgtgtctgtgctaacctgggaact

SEQ ID NO: 53957 - DNA, 25 bp, Homo sapien
tgggaactggccacctccattgttc

SEQ ID NO: 53958 - DNA, 25 bp, Homo sapien
cattgttctttgcttctgcacaaga

SEQ ID NO: 53959 - DNA, 25 bp, Homo sapien
agaagaacttcacctgcagacctct

SEQ ID NO: 53960 - DNA, 25 bp, Homo sapien
tgcagacctcttcaagtgacactat

SEQ ID NO: 53961 - DNA, 25 bp, Homo sapien
gtgacactatgtaggaatccttcca

SEQ ID NO: 53962 - DNA, 25 bp, Homo sapien
ccttccaaggaatatctatgtacaa

SEQ ID NO: 53963 - DNA, 25 bp, Homo sapien
taaaaccactgcctattgtaactac

SEQ ID NO: 53964 - DNA, 25 bp, Homo sapien
aatgattctctcccaaagaaagaca

SEQ ID NO: 53965 - DNA, 25 bp, Homo sapien
tccttcactctaaaactctggtatt

SEQ ID NO: 53966 - DNA, 25 bp, Homo sapien
cttcactctaaaactctggtattat

SEQ ID NO: 53967 - DNA, 25 bp, Homo sapien
taaaactctggtattataacttttg

SEQ ID NO: 53968 - DNA, 25 bp, Homo sapien
tttctacatgaaatgtttagctctt

SEQ ID NO: 53969 - DNA, 25 bp, Homo sapien
atgtttagctcttacactctatcct

SEQ ID NO: 53970 - DNA, 25 bp, Homo sapien
gtttagctcttacactctatccttc

SEQ ID NO: 53971 - DNA, 25 bp, Homo sapien
tagctcttacactctatccttccta

SEQ ID NO: 53972 - DNA, 25 bp, Homo sapien
ctatccttcctagaaaatggtaatt

SEQ ID NO: 53973 - DNA, 25 bp, Homo sapien
tggtaattgagattactcagatatt

SEQ ID NO: 53974 - DNA, 25 bp, Homo sapien
atattcacagagtataaacctaaat

SEQ ID NO: 53975 - DNA, 25 bp, Homo sapien
tctacaaattccctcttggtgtaaa

SEQ ID NO: 53976 - DNA, 25 bp, Homo sapien
attccctcttggtgtaaaattcaag

SEQ ID NO: 53977 - DNA, 25 bp, Homo sapien
agcttatattttctaacttggcaaa

SEQ ID NO: 53978 - DNA, 25 bp, Homo sapien
acttggcaaaagacttatccttaga

SEQ ID NO: 53979 - DNA, 25 bp, Homo sapien
gagaagtgtacattgatttccaatt

SEQ ID NO: 53980 - DNA, 25 bp, Homo sapien
aaataagcacacttacataagcccc

SEQ ID NO: 53981 - DNA, 25 bp, Homo sapien
ccccatacatagagtgggactcttg

SEQ ID NO: 53982 - DNA, 25 bp, Homo sapien
gggactcttggaatcaggagacaaa

SEQ ID NO: 53983 - DNA, 25 bp, Homo sapien
ggagacaaagctaccacatgtggaa

SEQ ID NO: 53984 - DNA, 25 bp, Homo sapien
gaaaggtactatgtgtccatgtcat

SEQ ID NO: 53985 - DNA, 25 bp, Homo sapien
gtactatgtgtccatgtcattcaaa

SEQ ID NO: 53986 - DNA, 25 bp, Homo sapien
ggcatggcttgggtatctcaattcc

SEQ ID NO: 53987 - DNA, 25 bp, Homo sapien
gggtatctcaattcccttataaatc

SEQ ID NO: 53988 - DNA, 25 bp, Homo sapien
aaaagcttgtgcgatgtcgatgtta

SEQ ID NO: 53989 - DNA, 25 bp, Homo sapien
caggtctgaattcaagcatgagaaa

SEQ ID NO: 53990 - DNA, 25 bp, Homo sapien
gaaggcaaaagatctcaggtacaag

SEQ ID NO: 53991 - DNA, 25 bp, Homo sapien
agagaacggaaagcagccactaccc

SEQ ID NO: 53992 - DNA, 25 bp, Homo sapien
aagcagccactaccctgggattaat

SEQ ID NO: 53993 - DNA, 25 bp, Homo sapien
gggattaatcttgggtgcatttgta

SEQ ID NO: 53994 - DNA, 25 bp, Homo sapien
atttgtaatatgttggcttcctttt

SEQ ID NO: 53995 - DNA, 25 bp, Homo sapien
gaattagttgttaatgtctgtgaca

SEQ ID NO: 53996 - DNA, 25 bp, Homo sapien
gtccaattttttggcatggcttggg

SEQ ID NO: 53997 - DNA, 25 bp, Homo sapien
attttttgcgggttctcccacagca

SEQ ID NO: 53998 - DNA, 25 bp, Homo sapien
cagcaacagcttttttagttttgtc

SEQ ID NO: 53999 - DNA, 25 bp, Homo sapien
tagttttgtctctccaagtcgtgaa

SEQ ID NO: 54000 - DNA, 25 bp, Homo sapien
ttgtctctccaagtcgtgaattaga

SEQ ID NO: 54001 - DNA, 25 bp, Homo sapien
ccaagtcgtgaattagagcagcagc

SEQ ID NO: 54002 - DNA, 25 bp, Homo sapien
agcagcagcaagtttctagcagggc

SEQ ID NO: 54003 - DNA, 25 bp, Homo sapien
ctagcagggccttcaaagtaaaaag

SEQ ID NO: 54004 - DNA, 25 bp, Homo sapien
gaatttgagccacgcatagtgtcac

SEQ ID NO: 54005 - DNA, 25 bp, Homo sapien
ttgagccacgcatagtgtcacgcac

SEQ ID NO: 54006 - DNA, 25 bp, Homo sapien
acgcatagtgtcacgcacctgtgat

SEQ ID NO: 54007 - DNA, 25 bp, Homo sapien
ggagtctgaggctttagtgatctaa

SEQ ID NO: 54008 - DNA, 25 bp, Homo sapien
tggcactgaacaggccactgtgacc

SEQ ID NO: 54009 - DNA, 25 bp, Homo sapien
aggccactgtgaccatggtgtcatc

SEQ ID NO: 54010 - DNA, 25 bp, Homo sapien
gaccatggtgtcatcagaggacatc

SEQ ID NO: 54011 - DNA, 25 bp, Homo sapien
tcatcagaggacatcgagatcctgg

SEQ ID NO: 54012 - DNA, 25 bp, Homo sapien
agcatgcaggcgagctggtcatcgc

SEQ ID NO: 54013 - DNA, 25 bp, Homo sapien
gaggtgcagacggtcatcgtctagc

SEQ ID NO: 54014 - DNA, 25 bp, Homo sapien
gtcatcgtctagcatgaggtctgcg

SEQ ID NO: 54015 - DNA, 25 bp, Homo sapien
ggcagaggactctgaagcgccccac

SEQ ID NO: 54016 - DNA, 25 bp, Homo sapien
cctgcctggcctggtagagaagatg

SEQ ID NO: 54017 - DNA, 25 bp, Homo sapien
gaggcgccccaagacggacagtgta

SEQ ID NO: 54018 - DNA, 25 bp, Homo sapien
gccccaagacggacagtgtacataa

SEQ ID NO: 54019 - DNA, 25 bp, Homo sapien
gattgttgcctatttcctgctgaaa

SEQ ID NO: 54020 - DNA, 25 bp, Homo sapien
gatcctttcctacccaaagtcataa

SEQ ID NO: 54021 - DNA, 25 bp, Homo sapien
aatatattctttactgccttgtgga

SEQ ID NO: 54022 - DNA, 25 bp, Homo sapien
ctttactgccttgtggaaattttat

SEQ ID NO: 54023 - DNA, 25 bp, Homo sapien
agttttgcctttcacatttgtcttt

SEQ ID NO: 54024 - DNA, 25 bp, Homo sapien
tgtctttagtctgtcctgaactgat

SEQ ID NO: 54025 - DNA, 25 bp, Homo sapien
tagtctgtcctgaactgatttttgt

SEQ ID NO: 54026 - DNA, 25 bp, Homo sapien
catattcgaagtggttgtctctgca

SEQ ID NO: 54027 - DNA, 25 bp, Homo sapien
ggttgtctctgcactatttactgaa

SEQ ID NO: 54028 - DNA, 25 bp, Homo sapien
cctttccccagtgatttgtaacact

SEQ ID NO: 54029 - DNA, 25 bp, Homo sapien
cagtgatttgtaacactgcctcttt

SEQ ID NO: 54030 - DNA, 25 bp, Homo sapien
tgccccttcaccttgtgtggacagt

SEQ ID NO: 54031 - DNA, 25 bp, Homo sapien
ccttcaccttgtgtggacagtgtct

SEQ ID NO: 54032 - DNA, 25 bp, Homo sapien
ggtgggctttgcctaaggacacaca

SEQ ID NO: 54033 - DNA, 25 bp, Homo sapien
gggctttgcctaaggacacacaaat

SEQ ID NO: 54034 - DNA, 25 bp, Homo sapien
ggacacacaaatttggttgggagtt

SEQ ID NO: 54035 - DNA, 25 bp, Homo sapien
tttcacccttcagcaacatgcagag

SEQ ID NO: 54036 - DNA, 25 bp, Homo sapien
agcaacatgcagagtccctgagccc

SEQ ID NO: 54037 - DNA, 25 bp, Homo sapien
tcattctctgaacccactgtggtga

SEQ ID NO: 54038 - DNA, 25 bp, Homo sapien
gaagaatttgctccggccaaattgg

SEQ ID NO: 54039 - DNA, 25 bp, Homo sapien
caaattggccgttagccacctgggt

SEQ ID NO: 54040 - DNA, 25 bp, Homo sapien
ggtccacatcctgctaagacgttta

SEQ ID NO: 54041 - DNA, 25 bp, Homo sapien
aatgcagtgtctgcctgttacagca

SEQ ID NO: 54042 - DNA, 25 bp, Homo sapien
ttttctaatgttatcacctgagtca

SEQ ID NO: 54043 - DNA, 25 bp, Homo sapien
aggaaacatgttacgccttcttgtt

SEQ ID NO: 54044 - DNA, 25 bp, Homo sapien
tgttacgccttcttgttgtaggaaa

SEQ ID NO: 54045 - DNA, 25 bp, Homo sapien
ttgtaggaaaaacggcttgcagatt

SEQ ID NO: 54046 - DNA, 25 bp, Homo sapien
ggttgatattcattaatggccccat

SEQ ID NO: 54047 - DNA, 25 bp, Homo sapien
taatggccccatggacttaaagtga

SEQ ID NO: 54048 - DNA, 25 bp, Homo sapien
ggacttaaagtgatcaggccctaaa

SEQ ID NO: 54049 - DNA, 25 bp, Homo sapien
gatcaggccctaaaacgttgttgtg

SEQ ID NO: 54050 - DNA, 25 bp, Homo sapien
gaggtttctttagcaagttcttgtt

SEQ ID NO: 54051 - DNA, 25 bp, Homo sapien
gtttttaacatgctttgctgtgtga

SEQ ID NO: 54052 - DNA, 25 bp, Homo sapien
agtacctatctcttcaacaccagag

SEQ ID NO: 54053 - DNA, 25 bp, Homo sapien
aatactactcaaattctcgccaacc

SEQ ID NO: 54054 - DNA, 25 bp, Homo sapien
gtcctcacacagtattgctcaatgc

SEQ ID NO: 54055 - DNA, 25 bp, Homo sapien
ctcaatgccactgtccaagttacga

SEQ ID NO: 54056 - DNA, 25 bp, Homo sapien
tgtccaagttacgacttccaaccaa

SEQ ID NO: 54057 - DNA, 25 bp, Homo sapien
ttacgacttccaaccaaactatatt

SEQ ID NO: 54058 - DNA, 25 bp, Homo sapien
aactatattaagcagcccagccttt

SEQ ID NO: 54059 - DNA, 25 bp, Homo sapien
tgccatttttggttgaacatgcaat

SEQ ID NO: 54060 - DNA, 25 bp, Homo sapien
atgatattttccaaactgctctgat

SEQ ID NO: 54061 - DNA, 25 bp, Homo sapien
caaactgctctgatatcttagaaga

SEQ ID NO: 54062 - DNA, 25 bp, Homo sapien
aatgattttgatggaaccaaccctg

SEQ ID NO: 54063 - DNA, 25 bp, Homo sapien
tgtctttagtctgtcctgaactgat

SEQ ID NO: 54064 - DNA, 25 bp, Homo sapien
ctttagtctgtcctgaactgatttt

SEQ ID NO: 54065 - DNA, 25 bp, Homo sapien
tagtctgtcctgaactgatttttgt

SEQ ID NO: 54066 - DNA, 25 bp, Homo sapien
ttaacatttttcatattcgaagtgg

SEQ ID NO: 54067 - DNA, 25 bp, Homo sapien
catattcgaagtggttgtctctgca

SEQ ID NO: 54068 - DNA, 25 bp, Homo sapien
attcgaagtggttgtctctgcacta

SEQ ID NO: 54069 - DNA, 25 bp, Homo sapien
cgaagtggttgtctctgcactattt

SEQ ID NO: 54070 - DNA, 25 bp, Homo sapien
ggttgtctctgcactatttactgaa

SEQ ID NO: 54071 - DNA, 25 bp, Homo sapien
gtctctgcactatttactgaaaagt

SEQ ID NO: 54072 - DNA, 25 bp, Homo sapien
cctttccccagtgatttgtaacact

SEQ ID NO: 54073 - DNA, 25 bp, Homo sapien
ccagtgatttgtaacactgcctctt

SEQ ID NO: 54074 - DNA, 25 bp, Homo sapien
ttttctaatacggaagcattgccta

SEQ ID NO: 54075 - DNA, 25 bp, Homo sapien
ggaagcattgcctaataattaagaa

SEQ ID NO: 54076 - DNA, 25 bp, Homo sapien
agctactttcttttatattgcctat

SEQ ID NO: 54077 - DNA, 25 bp, Homo sapien
taagcaaaaaaccaaccactgtatt

SEQ ID NO: 54078 - DNA, 25 bp, Homo sapien
agcaaactaagcctgcatttatatc

SEQ ID NO: 54079 - DNA, 25 bp, Homo sapien
ctaagcctgcatttatatctgaatt

SEQ ID NO: 54080 - DNA, 25 bp, Homo sapien
ttatatctgaattattacctccata

SEQ ID NO: 54081 - DNA, 25 bp, Homo sapien
gaattattacctccatattttacca

SEQ ID NO: 54082 - DNA, 25 bp, Homo sapien
acctccatattttaccaaacatttg

SEQ ID NO: 54083 - DNA, 25 bp, Homo sapien
taccaaacatttgaatgtccccctt

SEQ ID NO: 54084 - DNA, 25 bp, Homo sapien
gactgtatttattcctttactgtaa

SEQ ID NO: 54085 - DNA, 25 bp, Homo sapien
taactgtggttgctttcattcccta

SEQ ID NO: 54086 - DNA, 25 bp, Homo sapien
ttccctactctgttcatatgttaat

SEQ ID NO: 54087 - DNA, 25 bp, Homo sapien
ttggcttgggctttgcaatcaactc

SEQ ID NO: 54088 - DNA, 25 bp, Homo sapien
agagatgttcctcctgagctgccga

SEQ ID NO: 54089 - DNA, 25 bp, Homo sapien
aataactacacactgagcttccggt

SEQ ID NO: 54090 - DNA, 25 bp, Homo sapien
agcttccggttgctctgtgccttga

SEQ ID NO: 54091 - DNA, 25 bp, Homo sapien
ctgtgccttgacctcattgacaata

SEQ ID NO: 54092 - DNA, 25 bp, Homo sapien
attgacaatactgcagctctaccat

SEQ ID NO: 54093 - DNA, 25 bp, Homo sapien
agatcccgactcacgaagagcattt

SEQ ID NO: 54094 - DNA, 25 bp, Homo sapien
tttttgtaaaagtgcatccattccc

SEQ ID NO: 54095 - DNA, 25 bp, Homo sapien
atccattcccctaactgtggttgct

SEQ ID NO: 54096 - DNA, 25 bp, Homo sapien
tacccacgggcacacagaggtctga

SEQ ID NO: 54097 - DNA, 25 bp, Homo sapien
gggccggctcccacagtgagtgcag

SEQ ID NO: 54098 - DNA, 25 bp, Homo sapien
gagtgcagttgattcactgggtgac

SEQ ID NO: 54099 - DNA, 25 bp, Homo sapien
tgattcactgggtgactgtctgacc

SEQ ID NO: 54100 - DNA, 25 bp, Homo sapien
tgggtgactgtctgacccgtcacac

SEQ ID NO: 54101 - DNA, 25 bp, Homo sapien
tcacaccaggctgtgtgctctggcg

SEQ ID NO: 54102 - DNA, 25 bp, Homo sapien
gctctggcgggcaggacacaaactc

SEQ ID NO: 54103 - DNA, 25 bp, Homo sapien
tggcgggcaggacacaaactccctg

SEQ ID NO: 54104 - DNA, 25 bp, Homo sapien
tgcctgccgggctcactgtttagtg

SEQ ID NO: 54105 - DNA, 25 bp, Homo sapien
ccgggctcactgtttagtgctgaga

SEQ ID NO: 54106 - DNA, 25 bp, Homo sapien
ctgtttagtgctgagagtgagctgc

SEQ ID NO: 54107 - DNA, 25 bp, Homo sapien
gtgcctgtctcattcgcctctggat

SEQ ID NO: 54108 - DNA, 25 bp, Homo sapien
tgtctcattcgcctctggatctgct

SEQ ID NO: 54109 - DNA, 25 bp, Homo sapien
gtctcattcgcctctggatctgctg

SEQ ID NO: 54110 - DNA, 25 bp, Homo sapien
tgctgcatccaggactgtgccagca

SEQ ID NO: 54111 - DNA, 25 bp, Homo sapien
tgcatccaggactgtgccagcacaa

SEQ ID NO: 54112 - DNA, 25 bp, Homo sapien
catccaggactgtgccagcacaaag

SEQ ID NO: 54113 - DNA, 25 bp, Homo sapien
tgccagcacaaagtgggagcccgat

SEQ ID NO: 54114 - DNA, 25 bp, Homo sapien
ccagcacaaagtgggagcccgataa

SEQ ID NO: 54115 - DNA, 25 bp, Homo sapien
agtgggagcccgataaatatttatt

SEQ ID NO: 54116 - DNA, 25 bp, Homo sapien
tgggagcccgataaatatttattga

SEQ ID NO: 54117 - DNA, 25 bp, Homo sapien
aaatgaaaggtgacaaaaggcagaa

SEQ ID NO: 54118 - DNA, 25 bp, Homo sapien
aggatatcctgccttccaactgttt

SEQ ID NO: 54119 - DNA, 25 bp, Homo sapien
ctgccttccaactgtttctgaagcc

SEQ ID NO: 54120 - DNA, 25 bp, Homo sapien
ctcctcctaacatggcgattccgga

SEQ ID NO: 54121 - DNA, 25 bp, Homo sapien
ctaacatggcgattccggaggtcaa

SEQ ID NO: 54122 - DNA, 25 bp, Homo sapien
tggcgattccggaggtcaaggcctt

SEQ ID NO: 54123 - DNA, 25 bp, Homo sapien
attccggaggtcaaggccttgggct

SEQ ID NO: 54124 - DNA, 25 bp, Homo sapien
gggacccacataccagtgccaaggg

SEQ ID NO: 54125 - DNA, 25 bp, Homo sapien
aggtggccttcccatttaagtgcct

SEQ ID NO: 54126 - DNA, 25 bp, Homo sapien
catttaagtgccttctctgtgactg

SEQ ID NO: 54127 - DNA, 25 bp, Homo sapien
tctgtgactgagagccctagtgtga

SEQ ID NO: 54128 - DNA, 25 bp, Homo sapien
ctgagagccctagtgtgatgagaac

SEQ ID NO: 54129 - DNA, 25 bp, Homo sapien
aaacctggactgatctttctttaat

SEQ ID NO: 54130 - DNA, 25 bp, Homo sapien
cctggactgatctttctttaatagt

SEQ ID NO: 54131 - DNA, 25 bp, Homo sapien
gaacccctgggccactgaagagtaa

SEQ ID NO: 54132 - DNA, 25 bp, Homo sapien
cccctgggccactgaagagtaacat

SEQ ID NO: 54133 - DNA, 25 bp, Homo sapien
gaagagtaacatggctccactggac

SEQ ID NO: 54134 - DNA, 25 bp, Homo sapien
gtaacatggctccactggacacaaa

SEQ ID NO: 54135 - DNA, 25 bp, Homo sapien
tggctccactggacacaaaagaggg

SEQ ID NO: 54136 - DNA, 25 bp, Homo sapien
gcagggggccttttataagccttag

SEQ ID NO: 54137 - DNA, 25 bp, Homo sapien
ttcaatactattggagtgatttttt

SEQ ID NO: 54138 - DNA, 25 bp, Homo sapien
tttgttatttgtttgcatccctccc

SEQ ID NO: 54139 - DNA, 25 bp, Homo sapien
cacaccctggtgttttaaaatgaag

SEQ ID NO: 54140 - DNA, 25 bp, Homo sapien
gcagaggattggtgcagtcccagct

SEQ ID NO: 54141 - DNA, 25 bp, Homo sapien
ttggtgcagtcccagctgaagccca

SEQ ID NO: 54142 - DNA, 25 bp, Homo sapien
ttcacctgcagaaagccccaagtga

SEQ ID NO: 54143 - DNA, 25 bp, Homo sapien
ccaagtgagccaccagcactcatgg

SEQ ID NO: 54144 - DNA, 25 bp, Homo sapien
agggcttctcatagacgtcctgaga

SEQ ID NO: 54145 - DNA, 25 bp, Homo sapien
tcctgagaaggacggtgtaatgcaa

SEQ ID NO: 54146 - DNA, 25 bp, Homo sapien
aatgcaaggaaatggctgtggtaac

SEQ ID NO: 54147 - DNA, 25 bp, Homo sapien
ggctgtggtaacactgatccttcag

SEQ ID NO: 54148 - DNA, 25 bp, Homo sapien
ttcagaagaagcttcattccctctt

SEQ ID NO: 54149 - DNA, 25 bp, Homo sapien
gcttcattccctcttaatctagtta

SEQ ID NO: 54150 - DNA, 25 bp, Homo sapien
atctagttaagccaggacatccaga

SEQ ID NO: 54151 - DNA, 25 bp, Homo sapien
tcgccttggtcatgtacagcactga

SEQ ID NO: 54152 - DNA, 25 bp, Homo sapien
tacagcactgaaaggaatgaggcac

SEQ ID NO: 54153 - DNA, 25 bp, Homo sapien
tgaaaggaatgaggcaccagcagga

SEQ ID NO: 54154 - DNA, 25 bp, Homo sapien
gaggtggacagagtctctcatggat

SEQ ID NO: 54155 - DNA, 25 bp, Homo sapien
acagagtctctcatggatgccggca

SEQ ID NO: 54156 - DNA, 25 bp, Homo sapien
agtctctcatggatgccggcacaaa

SEQ ID NO: 54157 - DNA, 25 bp, Homo sapien
ggatgccggcacaaaactgccttaa

SEQ ID NO: 54158 - DNA, 25 bp, Homo sapien
agctcaaggagcttccttttaaatt

SEQ ID NO: 54159 - DNA, 25 bp, Homo sapien
ttttgtctgtaggaaatggttgaaa

SEQ ID NO: 54160 - DNA, 25 bp, Homo sapien
ctgaaggtagatggtgttatagtta

SEQ ID NO: 54161 - DNA, 25 bp, Homo sapien
aataagcatctcactttgtaaaaat

SEQ ID NO: 54162 - DNA, 25 bp, Homo sapien
ttggttcctaactgggattcagctc

SEQ ID NO: 54163 - DNA, 25 bp, Homo sapien
ttcctaactgggattcagctcaggg

SEQ ID NO: 54164 - DNA, 25 bp, Homo sapien
ctaactgggattcagctcagggact

SEQ ID NO: 54165 - DNA, 25 bp, Homo sapien
aactgggattcagctcagggactgc

SEQ ID NO: 54166 - DNA, 25 bp, Homo sapien
tgggattcagctcagggactgccat

SEQ ID NO: 54167 - DNA, 25 bp, Homo sapien
ggattcagctcagggactgccattt

SEQ ID NO: 54168 - DNA, 25 bp, Homo sapien
ttcagctcagggactgccatttgga

SEQ ID NO: 54169 - DNA, 25 bp, Homo sapien
agctcagggactgccatttggacta

SEQ ID NO: 54170 - DNA, 25 bp, Homo sapien
ctcagggactgccatttggactatt

SEQ ID NO: 54171 - DNA, 25 bp, Homo sapien
gggactgccatttggactattggga

SEQ ID NO: 54172 - DNA, 25 bp, Homo sapien
gactgccatttggactattgggagt

SEQ ID NO: 54173 - DNA, 25 bp, Homo sapien
cccctgagcgtaaatactctgtctg

SEQ ID NO: 54174 - DNA, 25 bp, Homo sapien
caagagtacgatgaggcaggcccat

SEQ ID NO: 54175 - DNA, 25 bp, Homo sapien
tacgatgaggcaggcccatccattg

SEQ ID NO: 54176 - DNA, 25 bp, Homo sapien
gcaaatgcttctaagatgccttctc

SEQ ID NO: 54177 - DNA, 25 bp, Homo sapien
tccatctaccttccagtcaggatga

SEQ ID NO: 54178 - DNA, 25 bp, Homo sapien
atctaccttccagtcaggatgacgg

SEQ ID NO: 54179 - DNA, 25 bp, Homo sapien
gtcaggatgacggtattatgcttct

SEQ ID NO: 54180 - DNA, 25 bp, Homo sapien
gtattatgcttcttggagtctccca

SEQ ID NO: 54181 - DNA, 25 bp, Homo sapien
ttcttggagtctcccaaaccacctt

SEQ ID NO: 54182 - DNA, 25 bp, Homo sapien
gtacagtttgtttacacacgtgcaa

SEQ ID NO: 54183 - DNA, 25 bp, Homo sapien
gtttacacacgtgcaatttgtttgt

SEQ ID NO: 54184 - DNA, 25 bp, Homo sapien
tccaaacaccggcagaaaacggaga

SEQ ID NO: 54185 - DNA, 25 bp, Homo sapien
acaccggcagaaaacggagagtgct

SEQ ID NO: 54186 - DNA, 25 bp, Homo sapien
caccggcagaaaacggagagtgctt

SEQ ID NO: 54187 - DNA, 25 bp, Homo sapien
cagaaaacggagagtgcttgggtgg

SEQ ID NO: 54188 - DNA, 25 bp, Homo sapien
gggtgctggaggattttccagttct

SEQ ID NO: 54189 - DNA, 25 bp, Homo sapien
gaggattttccagttctgacacacg

SEQ ID NO: 54190 - DNA, 25 bp, Homo sapien
tttccagttctgacacacgtattta

SEQ ID NO: 54191 - DNA, 25 bp, Homo sapien
cagttctgacacacgtatttatatt

SEQ ID NO: 54192 - DNA, 25 bp, Homo sapien
tggaaagagaccagcaccgagctcg

SEQ ID NO: 54193 - DNA, 25 bp, Homo sapien
aaagagaccagcaccgagctcggca

SEQ ID NO: 54194 - DNA, 25 bp, Homo sapien
ttcccagctgcagatgccacacctg

SEQ ID NO: 54195 - DNA, 25 bp, Homo sapien
aaacccatgtgttaaaatactcagt

SEQ ID NO: 54196 - DNA, 25 bp, Homo sapien
aatactcagtgctaaacatggctta

SEQ ID NO: 54197 - DNA, 25 bp, Homo sapien
gctaaacatggcttaatcttatttt

SEQ ID NO: 54198 - DNA, 25 bp, Homo sapien
tatcttctttcctcaatataggagg

SEQ ID NO: 54199 - DNA, 25 bp, Homo sapien
tttgtattactgcttcccattgagt

SEQ ID NO: 54200 - DNA, 25 bp, Homo sapien
ctgcttcccattgagtaatcatact

SEQ ID NO: 54201 - DNA, 25 bp, Homo sapien
aggggtgctccttaaatatatatag

SEQ ID NO: 54202 - DNA, 25 bp, Homo sapien
gaaacaaaccgaaaatggacattga

SEQ ID NO: 54203 - DNA, 25 bp, Homo sapien
atggacattgagatactatcattaa

SEQ ID NO: 54204 - DNA, 25 bp, Homo sapien
tatcattaacattaggaccttagaa

SEQ ID NO: 54205 - DNA, 25 bp, Homo sapien
taggaccttagaattttgggtattg

SEQ ID NO: 54206 - DNA, 25 bp, Homo sapien
aggacggaggttaatggctgctcct

SEQ ID NO: 54207 - DNA, 25 bp, Homo sapien
gctgctcctggctagatcacaggac

SEQ ID NO: 54208 - DNA, 25 bp, Homo sapien
tcacaggaccctgcatgatactgga

SEQ ID NO: 54209 - DNA, 25 bp, Homo sapien
ctgcatgatactggaatgctccctg

SEQ ID NO: 54210 - DNA, 25 bp, Homo sapien
atgctccctggtgaggtactgcaga

SEQ ID NO: 54211 - DNA, 25 bp, Homo sapien
gtactgcagagttacaggatcgtga

SEQ ID NO: 54212 - DNA, 25 bp, Homo sapien
gatcgtgaactctatttattcccac

SEQ ID NO: 54213 - DNA, 25 bp, Homo sapien
tgctgtgatcagatttggaatacct

SEQ ID NO: 54214 - DNA, 25 bp, Homo sapien
gaaaacagtctacctgtcagattct

SEQ ID NO: 54215 - DNA, 25 bp, Homo sapien
gtcagattcttgtctaacttcaatt

SEQ ID NO: 54216 - DNA, 25 bp, Homo sapien
taacttcaatttcaagagaccctga

SEQ ID NO: 54217 - DNA, 25 bp, Homo sapien
cgcgccatgtggctgtccttgttct

SEQ ID NO: 54218 - DNA, 25 bp, Homo sapien
gcgccatgtggctgtccttgttctc

SEQ ID NO: 54219 - DNA, 25 bp, Homo sapien
cgccatgtggctgtccttgttctcc

SEQ ID NO: 54220 - DNA, 25 bp, Homo sapien
gccatgtggctgtccttgttctcca

SEQ ID NO: 54221 - DNA, 25 bp, Homo sapien
gtccttgttctccagtgaggagagc

SEQ ID NO: 54222 - DNA, 25 bp, Homo sapien
tccttgttctccagtgaggagagca

SEQ ID NO: 54223 - DNA, 25 bp, Homo sapien
ccttgttctccagtgaggagagcaa

SEQ ID NO: 54224 - DNA, 25 bp, Homo sapien
cttgttctccagtgaggagagcaac

SEQ ID NO: 54225 - DNA, 25 bp, Homo sapien
gccagcctgaccagtggctctgttt

SEQ ID NO: 54226 - DNA, 25 bp, Homo sapien
agtggctctgttttcccacaacaga

SEQ ID NO: 54227 - DNA, 25 bp, Homo sapien
tgttttcccacaacagacgggacaa

SEQ ID NO: 54228 - DNA, 25 bp, Homo sapien
cgggacaacttgcagagctgcaacc

SEQ ID NO: 54229 - DNA, 25 bp, Homo sapien
ggcgaaggaggcgagacacccactt

SEQ ID NO: 54230 - DNA, 25 bp, Homo sapien
tgcggctgctgtcatcgatcaaagt

SEQ ID NO: 54231 - DNA, 25 bp, Homo sapien
gctgctgtcatcgatcaaagtgtgg

SEQ ID NO: 54232 - DNA, 25 bp, Homo sapien
tcgatcaaagtgtgggatgtgctgc

SEQ ID NO: 54233 - DNA, 25 bp, Homo sapien
gatgtgctgcaagacgtagaaccta

SEQ ID NO: 54234 - DNA, 25 bp, Homo sapien
aagacgtagaacctacctgccctgc

SEQ ID NO: 54235 - DNA, 25 bp, Homo sapien
tcccttccttatttattcctgctgc

SEQ ID NO: 54236 - DNA, 25 bp, Homo sapien
gatagcaaccctaatgaggaatcaa

SEQ ID NO: 54237 - DNA, 25 bp, Homo sapien
gataaaaacccagaagagtccaaga

SEQ ID NO: 54238 - DNA, 25 bp, Homo sapien
aacccagaagagtccaagagtccaa

SEQ ID NO: 54239 - DNA, 25 bp, Homo sapien
gaagagtccaagagtccaagcaaaa

SEQ ID NO: 54240 - DNA, 25 bp, Homo sapien
gagtccaagcaaaactaccgtgcga

SEQ ID NO: 54241 - DNA, 25 bp, Homo sapien
caaaactaccgtgcgatgcctggaa

SEQ ID NO: 54242 - DNA, 25 bp, Homo sapien
aaactaccgtgcgatgcctggaagc

SEQ ID NO: 54243 - DNA, 25 bp, Homo sapien
actaccgtgcgatgcctggaagctg

SEQ ID NO: 54244 - DNA, 25 bp, Homo sapien
gcctggaagctgaagtttagatgag

SEQ ID NO: 54245 - DNA, 25 bp, Homo sapien
ggagaaggccaatgatagcaaccct

SEQ ID NO: 54246 - DNA, 25 bp, Homo sapien
ggccaatgatagcaaccctaatgag

SEQ ID NO: 54247 - DNA, 25 bp, Homo sapien
gaagccgccacccatgaaagcattt

SEQ ID NO: 54248 - DNA, 25 bp, Homo sapien
gaaagcatttctgaagcccctttct

SEQ ID NO: 54249 - DNA, 25 bp, Homo sapien
ctttctaagacaaggctcagcatct

SEQ ID NO: 54250 - DNA, 25 bp, Homo sapien
tttttgacagattcctcccaagtct

SEQ ID NO: 54251 - DNA, 25 bp, Homo sapien
ctggctctgggaggtatgtacccat

SEQ ID NO: 54252 - DNA, 25 bp, Homo sapien
tatgtacccatctcaaatgttccca

SEQ ID NO: 54253 - DNA, 25 bp, Homo sapien
ggaaatggaaatgaacttgcttact

SEQ ID NO: 54254 - DNA, 25 bp, Homo sapien
cttgcttactaatgtgtgattccta

SEQ ID NO: 54255 - DNA, 25 bp, Homo sapien
gtgattcctagttgtagccaccgga

SEQ ID NO: 54256 - DNA, 25 bp, Homo sapien
ccaccggatgtgctgaggcctaaat

SEQ ID NO: 54257 - DNA, 25 bp, Homo sapien
gggaggaggccacagaacaataaaa

SEQ ID NO: 54258 - DNA, 25 bp, Homo sapien
gacgtggccgtggaactgcccttca

SEQ ID NO: 54259 - DNA, 25 bp, Homo sapien
taatgcaccccaagcccaaagagga

SEQ ID NO: 54260 - DNA, 25 bp, Homo sapien
ccccgcatcgggaagttccagagaa

SEQ ID NO: 54261 - DNA, 25 bp, Homo sapien
agttccagagaacgagacgccagta

SEQ ID NO: 54262 - DNA, 25 bp, Homo sapien
gacgccagtagataccaatctcata

SEQ ID NO: 54263 - DNA, 25 bp, Homo sapien
gaacttgacacaaatgatgacgaca

SEQ ID NO: 54264 - DNA, 25 bp, Homo sapien
gtatttgaggactttgctcgccaga

SEQ ID NO: 54265 - DNA, 25 bp, Homo sapien
gactttgctcgccagagactgaaag

SEQ ID NO: 54266 - DNA, 25 bp, Homo sapien
agaggaggatggtaccggctctcca

SEQ ID NO: 54267 - DNA, 25 bp, Homo sapien
ggctctccacagctcaacaacagat

SEQ ID NO: 54268 - DNA, 25 bp, Homo sapien
aacaacagatagacgggccggccct

SEQ ID NO: 54269 - DNA, 25 bp, Homo sapien
aggcttgggaggaaaccgccgcaat

SEQ ID NO: 54270 - DNA, 25 bp, Homo sapien
tttaaagccttgctctgttgtgtcc

SEQ ID NO: 54271 - DNA, 25 bp, Homo sapien
aaagccttgctctgttgtgtcctgt

SEQ ID NO: 54272 - DNA, 25 bp, Homo sapien
ttgctctgttgtgtcctgttgccgg

SEQ ID NO: 54273 - DNA, 25 bp, Homo sapien
tgttgtgtcctgttgccggctctgg

SEQ ID NO: 54274 - DNA, 25 bp, Homo sapien
actgtgaagtggcttctccgtacga

SEQ ID NO: 54275 - DNA, 25 bp, Homo sapien
gaagtggcttctccgtacgattgtc

SEQ ID NO: 54276 - DNA, 25 bp, Homo sapien
cttctccgtacgattgtctctgaaa

SEQ ID NO: 54277 - DNA, 25 bp, Homo sapien
tccgtacgattgtctctgaaacatc

SEQ ID NO: 54278 - DNA, 25 bp, Homo sapien
cagggtttgatggacagtagcatta

SEQ ID NO: 54279 - DNA, 25 bp, Homo sapien
ggacagtagcattagaattgtggaa

SEQ ID NO: 54280 - DNA, 25 bp, Homo sapien
atcgcttaagcacaggagttggaat

SEQ ID NO: 54281 - DNA, 25 bp, Homo sapien
taagcacaggagttggaatccagcc

SEQ ID NO: 54282 - DNA, 25 bp, Homo sapien
tttgattaaaattgactacagcggt

SEQ ID NO: 54283 - DNA, 25 bp, Homo sapien
gactacagcggtcagtataaaatac

SEQ ID NO: 54284 - DNA, 25 bp, Homo sapien
atacatgtcgcttttaaggaagtgc

SEQ ID NO: 54285 - DNA, 25 bp, Homo sapien
ggaagtgctctttatgtatctaaca

SEQ ID NO: 54286 - DNA, 25 bp, Homo sapien
gaagtttttgcattggtaagagcat

SEQ ID NO: 54287 - DNA, 25 bp, Homo sapien
catttatatatgctttgtttcaggg

SEQ ID NO: 54288 - DNA, 25 bp, Homo sapien
ttcagggtttatggatttgtattca

SEQ ID NO: 54289 - DNA, 25 bp, Homo sapien
tattgtcaaataggtttcatactct

SEQ ID NO: 54290 - DNA, 25 bp, Homo sapien
taggtttcatactctaattttactt

SEQ ID NO: 54291 - DNA, 25 bp, Homo sapien
gattcatctgaagtgtatgtttccc

SEQ ID NO: 54292 - DNA, 25 bp, Homo sapien
gtgtatgtttcccaagtgacgcaaa

SEQ ID NO: 54293 - DNA, 25 bp, Homo sapien
tcccaagtgacgcaaaaagttttct

SEQ ID NO: 54294 - DNA, 25 bp, Homo sapien
aacatcaactggcatacacatccct

SEQ ID NO: 54295 - DNA, 25 bp, Homo sapien
tggcatacacatccctgtgatcatg

SEQ ID NO: 54296 - DNA, 25 bp, Homo sapien
atccctgtgatcatgagtctggctc

SEQ ID NO: 54297 - DNA, 25 bp, Homo sapien
gagtctggctcaaagccaatttata

SEQ ID NO: 54298 - DNA, 25 bp, Homo sapien
gccaatttatagcaaatcatccatt

SEQ ID NO: 54299 - DNA, 25 bp, Homo sapien
aaatcatccatttctgtttattatg

SEQ ID NO: 54300 - DNA, 25 bp, Homo sapien
gaagcataatccaacagaatcaatt

SEQ ID NO: 54301 - DNA, 25 bp, Homo sapien
gaagagtgacaaatcctgacaccca

SEQ ID NO: 54302 - DNA, 25 bp, Homo sapien
ccagctccgcttcttgttacttggg

SEQ ID NO: 54303 - DNA, 25 bp, Homo sapien
gggaggaaagaaactcctgatcatt

SEQ ID NO: 54304 - DNA, 25 bp, Homo sapien
gaaagaaactcctgatcattggcca

SEQ ID NO: 54305 - DNA, 25 bp, Homo sapien
aagaaactcctgatcattggccaaa

SEQ ID NO: 54306 - DNA, 25 bp, Homo sapien
gggacttacccctggagaggccaag

SEQ ID NO: 54307 - DNA, 25 bp, Homo sapien
gaggccaagtgccttctaggaagtt

SEQ ID NO: 54308 - DNA, 25 bp, Homo sapien
ggttgaggcacagcctgtgcagaga

SEQ ID NO: 54309 - DNA, 25 bp, Homo sapien
gtcaagggctgataacggccatgca

SEQ ID NO: 54310 - DNA, 25 bp, Homo sapien
ggccatgcaggatgcttgatgctgc

SEQ ID NO: 54311 - DNA, 25 bp, Homo sapien
atgcaggatgcttgatgctgcgtcc

SEQ ID NO: 54312 - DNA, 25 bp, Homo sapien
gcaggatgcttgatgctgcgtcccc

SEQ ID NO: 54313 - DNA, 25 bp, Homo sapien
agacctccaccataactgttgtgag

SEQ ID NO: 54314 - DNA, 25 bp, Homo sapien
tgttgtgagattgtgggcagcctta

SEQ ID NO: 54315 - DNA, 25 bp, Homo sapien
cagccttagggccataaatatctct

SEQ ID NO: 54316 - DNA, 25 bp, Homo sapien
ggagacatgtgcacctttgaggcta

SEQ ID NO: 54317 - DNA, 25 bp, Homo sapien
atgtgcacctttgaggctacgggct

SEQ ID NO: 54318 - DNA, 25 bp, Homo sapien
gctacgggcttctccaaagacttag

SEQ ID NO: 54319 - DNA, 25 bp, Homo sapien
tctccaaagacttaggaatctgtgg

SEQ ID NO: 54320 - DNA, 25 bp, Homo sapien
gaaacttgggtatttctgaggccag

SEQ ID NO: 54321 - DNA, 25 bp, Homo sapien
gggacacaggcatctccaaggccag

SEQ ID NO: 54322 - DNA, 25 bp, Homo sapien
gcaccaaggaggcagactactccaa

SEQ ID NO: 54323 - DNA, 25 bp, Homo sapien
ggcagactactccaagcatcagtga

SEQ ID NO: 54324 - DNA, 25 bp, Homo sapien
tggacatttgagtcttcgtcttctg

SEQ ID NO: 54325 - DNA, 25 bp, Homo sapien
tgagtcttcgtcttctgctgctgct

SEQ ID NO: 54326 - DNA, 25 bp, Homo sapien
ggctggaccagcttctttaacagca

SEQ ID NO: 54327 - DNA, 25 bp, Homo sapien
agcaagcataatccacttcaatgta

SEQ ID NO: 54328 - DNA, 25 bp, Homo sapien
gtaatattttctgtagctccaaagg

SEQ ID NO: 54329 - DNA, 25 bp, Homo sapien
gctccaaaggctatctcttcatatt

SEQ ID NO: 54330 - DNA, 25 bp, Homo sapien
ggctatctcttcatattgactgcag

SEQ ID NO: 54331 - DNA, 25 bp, Homo sapien
gaatggacagtttcttagagggctt

SEQ ID NO: 54332 - DNA, 25 bp, Homo sapien
ttagagggcttgtctcctttctacc

SEQ ID NO: 54333 - DNA, 25 bp, Homo sapien
cctttgacctaatggagctagaaat

SEQ ID NO: 54334 - DNA, 25 bp, Homo sapien
ctgtgactccaccagttattctaat

SEQ ID NO: 54335 - DNA, 25 bp, Homo sapien
cttaactgaattgggagcctctgcc

SEQ ID NO: 54336 - DNA, 25 bp, Homo sapien
ttgcacgctcgctagcagctggtaa

SEQ ID NO: 54337 - DNA, 25 bp, Homo sapien
gctagcagctggtaaggtcttcaca

SEQ ID NO: 54338 - DNA, 25 bp, Homo sapien
gtaaggtcttcacaccctgattcct

SEQ ID NO: 54339 - DNA, 25 bp, Homo sapien
cctgattcctcaagttttctgctta

SEQ ID NO: 54340 - DNA, 25 bp, Homo sapien
agttttctgcttagtggcactgaca

SEQ ID NO: 54341 - DNA, 25 bp, Homo sapien
gcttagtggcactgacattaagtag

SEQ ID NO: 54342 - DNA, 25 bp, Homo sapien
ttggccgtgggcaggccctaactca

SEQ ID NO: 54343 - DNA, 25 bp, Homo sapien
gccctaactcactgtcgctttggag

SEQ ID NO: 54344 - DNA, 25 bp, Homo sapien
gtcgctttggagttgaggtgtcttt

SEQ ID NO: 54345 - DNA, 25 bp, Homo sapien
ttctttagttcctgtattctaaaca

SEQ ID NO: 54346 - DNA, 25 bp, Homo sapien
ggcgagaacagaagagcagctccag

SEQ ID NO: 54347 - DNA, 25 bp, Homo sapien
ccgagcgtctgacccctgagctgaa

SEQ ID NO: 54348 - DNA, 25 bp, Homo sapien
cctgagctgaattcagcggttgtga

SEQ ID NO: 54349 - DNA, 25 bp, Homo sapien
ttcagcggttgtgaaaggctacact

SEQ ID NO: 54350 - DNA, 25 bp, Homo sapien
aaaggctacactggttgagagagac

SEQ ID NO: 54351 - DNA, 25 bp, Homo sapien
gagagaccgaactacaatacggctg

SEQ ID NO: 54352 - DNA, 25 bp, Homo sapien
aatacggctgacgaatgcattgtag

SEQ ID NO: 54353 - DNA, 25 bp, Homo sapien
atgcattgtagcaacgtggccgcaa

SEQ ID NO: 54354 - DNA, 25 bp, Homo sapien
aacgtggccgcaattactcgtacaa

SEQ ID NO: 54355 - DNA, 25 bp, Homo sapien
aattactcgtacaaacacagggact

SEQ ID NO: 54356 - DNA, 25 bp, Homo sapien
cagggactgacagaggtgtaccgta

SEQ ID NO: 54357 - DNA, 25 bp, Homo sapien
ttcactgcccgacggtaaacggtgc

SEQ ID NO: 54358 - DNA, 25 bp, Homo sapien
gacggtaaacggtgcccatgctccc

SEQ ID NO: 54359 - DNA, 25 bp, Homo sapien
gaagcggaaaccctacacgaagcag

SEQ ID NO: 54360 - DNA, 25 bp, Homo sapien
acacgaagcagcagattgcggagtt

SEQ ID NO: 54361 - DNA, 25 bp, Homo sapien
tgcggagttggagaacgaattcctc

SEQ ID NO: 54362 - DNA, 25 bp, Homo sapien
gagaacgaattcctcgtcaacgaat

SEQ ID NO: 54363 - DNA, 25 bp, Homo sapien
gtcaacgaattcatcaacaggcaga

SEQ ID NO: 54364 - DNA, 25 bp, Homo sapien
ggcagaaacgcaaggaattgtccaa

SEQ ID NO: 54365 - DNA, 25 bp, Homo sapien
ggaattgtccaataggctgaacctc

SEQ ID NO: 54366 - DNA, 25 bp, Homo sapien
tgaacctcagcgaccagcaagtcaa

SEQ ID NO: 54367 - DNA, 25 bp, Homo sapien
tccagaacaggcgtatgaagaagaa

SEQ ID NO: 54368 - DNA, 25 bp, Homo sapien
tagtaggtgtatatgcatttttctt

SEQ ID NO: 54369 - DNA, 25 bp, Homo sapien
tttcttttaatagtacatctagtgg

SEQ ID NO: 54370 - DNA, 25 bp, Homo sapien
atagtacatctagtggttctttcca

SEQ ID NO: 54371 - DNA, 25 bp, Homo sapien
tagtacatctagtggttctttccaa

SEQ ID NO: 54372 - DNA, 25 bp, Homo sapien
agtacatctagtggttctttccaaa

SEQ ID NO: 54373 - DNA, 25 bp, Homo sapien
gtacatctagtggttctttccaaaa

SEQ ID NO: 54374 - DNA, 25 bp, Homo sapien
tacatctagtggttctttccaaaat

SEQ ID NO: 54375 - DNA, 25 bp, Homo sapien
acatctagtggttctttccaaaata

SEQ ID NO: 54376 - DNA, 25 bp, Homo sapien
atctagtggttctttccaaaatagt

SEQ ID NO: 54377 - DNA, 25 bp, Homo sapien
tagtggttctttccaaaatagtaca

SEQ ID NO: 54378 - DNA, 25 bp, Homo sapien
gtacaaaaaagtgttctcatacaaa

SEQ ID NO: 54379 - DNA, 25 bp, Homo sapien
aaaagagcagcacaggaaacttccc

SEQ ID NO: 54380 - DNA, 25 bp, Homo sapien
aaagagcagcacaggaaacttcccc

SEQ ID NO: 54381 - DNA, 25 bp, Homo sapien
gcacaggaaacttccccctcaaaca

SEQ ID NO: 54382 - DNA, 25 bp, Homo sapien
cactaaaggctcctggagctattca

SEQ ID NO: 54383 - DNA, 25 bp, Homo sapien
taaaggctcctggagctattcacag

SEQ ID NO: 54384 - DNA, 25 bp, Homo sapien
caaacaaaaccaaattctatacatg

SEQ ID NO: 54385 - DNA, 25 bp, Homo sapien
tctatacatgtatatctcgagtgag

SEQ ID NO: 54386 - DNA, 25 bp, Homo sapien
ctatacatgtatatctcgagtgagt

SEQ ID NO: 54387 - DNA, 25 bp, Homo sapien
tatacatgtatatctcgagtgagta

SEQ ID NO: 54388 - DNA, 25 bp, Homo sapien
tacatgtatatctcgagtgagtaaa

SEQ ID NO: 54389 - DNA, 25 bp, Homo sapien
atctcgagtgagtaaatgtgtaaca

SEQ ID NO: 54390 - DNA, 25 bp, Homo sapien
aaccaccgcatatgcatgccaggct

SEQ ID NO: 54391 - DNA, 25 bp, Homo sapien
atatgcatgccaggctgggcacggc

SEQ ID NO: 54392 - DNA, 25 bp, Homo sapien
agggacagacgcttgcgccgagacc

SEQ ID NO: 54393 - DNA, 25 bp, Homo sapien
tgctgggagcagaacagtccctcac

SEQ ID NO: 54394 - DNA, 25 bp, Homo sapien
ttcgtgctggaggaacttgctgctg

SEQ ID NO: 54395 - DNA, 25 bp, Homo sapien
aggaacttgctgctgtgcctgcgtc

SEQ ID NO: 54396 - DNA, 25 bp, Homo sapien
ggctgtcatgcggtttccaaggtgc

SEQ ID NO: 54397 - DNA, 25 bp, Homo sapien
gtttccaaggtgcacattttccacg

SEQ ID NO: 54398 - DNA, 25 bp, Homo sapien
ttttccacggaaacagaactcgatg

SEQ ID NO: 54399 - DNA, 25 bp, Homo sapien
acagaactcgatgcactgacctgct

SEQ ID NO: 54400 - DNA, 25 bp, Homo sapien
gacctgctccgccaggaaagtgagc

SEQ ID NO: 54401 - DNA, 25 bp, Homo sapien
ttggctgcagtattggtggtagaat

SEQ ID NO: 54402 - DNA, 25 bp, Homo sapien
aatatggatcatctctacttctgta

SEQ ID NO: 54403 - DNA, 25 bp, Homo sapien
atttattactagacctcaaccacag

SEQ ID NO: 54404 - DNA, 25 bp, Homo sapien
agacctcaaccacagtcttcttttt

SEQ ID NO: 54405 - DNA, 25 bp, Homo sapien
ctctttgcctgtaggatgtactgta

SEQ ID NO: 54406 - DNA, 25 bp, Homo sapien
gatgtactgtatgtagtcatgcact

SEQ ID NO: 54407 - DNA, 25 bp, Homo sapien
ctgtatgtagtcatgcactttgtat

SEQ ID NO: 54408 - DNA, 25 bp, Homo sapien
gtagtcatgcactttgtattaatat

SEQ ID NO: 54409 - DNA, 25 bp, Homo sapien
gaaatctacagatctgttttgtact

SEQ ID NO: 54410 - DNA, 25 bp, Homo sapien
gtactttttatactgttggatactt

SEQ ID NO: 54411 - DNA, 25 bp, Homo sapien
gggtattgaataaatctagtcttac

SEQ ID NO: 54412 - DNA, 25 bp, Homo sapien
cttctcatcaaagccatccagggat

SEQ ID NO: 54413 - DNA, 25 bp, Homo sapien
ctcatcaaagccatccagggataca

SEQ ID NO: 54414 - DNA, 25 bp, Homo sapien
agccatccagggatacacagggagc

SEQ ID NO: 54415 - DNA, 25 bp, Homo sapien
gatccccgacagcaaaatgtttcct

SEQ ID NO: 54416 - DNA, 25 bp, Homo sapien
cgacagcaaaatgtttcctttctga

SEQ ID NO: 54417 - DNA, 25 bp, Homo sapien
agtcctcagctgtaccggcctttca

SEQ ID NO: 54418 - DNA, 25 bp, Homo sapien
gctgtaccggcctttcagagcttct

SEQ ID NO: 54419 - DNA, 25 bp, Homo sapien
agagcttctctttgggtgccatcaa

SEQ ID NO: 54420 - DNA, 25 bp, Homo sapien
ttgggtgccatcaaagaattatttt

SEQ ID NO: 54421 - DNA, 25 bp, Homo sapien
ctggcatgagcttctactatctgtg

SEQ ID NO: 54422 - DNA, 25 bp, Homo sapien
tggcatgagcttctactatctgtgc

SEQ ID NO: 54423 - DNA, 25 bp, Homo sapien
acagccagacccttcatctgtggca

SEQ ID NO: 54424 - DNA, 25 bp, Homo sapien
agacccttcatctgtggcacttcct

SEQ ID NO: 54425 - DNA, 25 bp, Homo sapien
atctgtggcacttcctgcagctgca

SEQ ID NO: 54426 - DNA, 25 bp, Homo sapien
aggacatttctgtggctaggctatg

SEQ ID NO: 54427 - DNA, 25 bp, Homo sapien
acatttctgtggctaggctatgcaa

SEQ ID NO: 54428 - DNA, 25 bp, Homo sapien
tctgtggctaggctatgcaaactct

SEQ ID NO: 54429 - DNA, 25 bp, Homo sapien
tatatatgccttcttcaaccgggac

SEQ ID NO: 54430 - DNA, 25 bp, Homo sapien
gccagtaccggaatatcaaccggaa

SEQ ID NO: 54431 - DNA, 25 bp, Homo sapien
aatatcaaccggaagctctcagctg

SEQ ID NO: 54432 - DNA, 25 bp, Homo sapien
cctgagtttgtgctacaaaatgctg

SEQ ID NO: 54433 - DNA, 25 bp, Homo sapien
ttgtgctacaaaatgctgactactg

SEQ ID NO: 54434 - DNA, 25 bp, Homo sapien
acagccagacccttcatctgtggca

SEQ ID NO: 54435 - DNA, 25 bp, Homo sapien
agccagacccttcatctgtggcact

SEQ ID NO: 54436 - DNA, 25 bp, Homo sapien
gccagacccttcatctgtggcactt

SEQ ID NO: 54437 - DNA, 25 bp, Homo sapien
agacccttcatctgtggcacttcct

SEQ ID NO: 54438 - DNA, 25 bp, Homo sapien
tgtgggtggagaggacatttctgtg

SEQ ID NO: 54439 - DNA, 25 bp, Homo sapien
tttctgtggctaggctatgcaaact

SEQ ID NO: 54440 - DNA, 25 bp, Homo sapien
tctgtggctaggctatgcaaactct

SEQ ID NO: 54441 - DNA, 25 bp, Homo sapien
gccagtaccggaatatcaaccggaa

SEQ ID NO: 54442 - DNA, 25 bp, Homo sapien
gtaccggaatatcaaccggaagctc

SEQ ID NO: 54443 - DNA, 25 bp, Homo sapien
ccggaatatcaaccggaagctctca

SEQ ID NO: 54444 - DNA, 25 bp, Homo sapien
ggaatatcaaccggaagctctcagc

SEQ ID NO: 54445 - DNA, 25 bp, Homo sapien
ttttatggctcttctgggaaactcc

SEQ ID NO: 54446 - DNA, 25 bp, Homo sapien
ttatggctcttctgggaaactcctc

SEQ ID NO: 54447 - DNA, 25 bp, Homo sapien
tatggctcttctgggaaactcctcc

SEQ ID NO: 54448 - DNA, 25 bp, Homo sapien
gggctgtgaattctttcttcatccc

SEQ ID NO: 54449 - DNA, 25 bp, Homo sapien
ggctgtgaattctttcttcatcccc

SEQ ID NO: 54450 - DNA, 25 bp, Homo sapien
gctgtgaattctttcttcatccccg

SEQ ID NO: 54451 - DNA, 25 bp, Homo sapien
tgtgaattctttcttcatccccgca

SEQ ID NO: 54452 - DNA, 25 bp, Homo sapien
gtgaattctttcttcatccccgcat

SEQ ID NO: 54453 - DNA, 25 bp, Homo sapien
tgaattctttcttcatccccgcatt

SEQ ID NO: 54454 - DNA, 25 bp, Homo sapien
gaattctttcttcatccccgcattc

SEQ ID NO: 54455 - DNA, 25 bp, Homo sapien
cccgcattcccaatatacccaggcc

SEQ ID NO: 54456 - DNA, 25 bp, Homo sapien
gaggtagtattaatcagttttatct

SEQ ID NO: 54457 - DNA, 25 bp, Homo sapien
tcttttgaaaggcacagtctaaatc

SEQ ID NO: 54458 - DNA, 25 bp, Homo sapien
ggcacagtctaaatcgaaaccctaa

SEQ ID NO: 54459 - DNA, 25 bp, Homo sapien
gaaaccctaaactcaatgctgcaag

SEQ ID NO: 54460 - DNA, 25 bp, Homo sapien
ctcaatgctgcaagtatgaatttaa

SEQ ID NO: 54461 - DNA, 25 bp, Homo sapien
taagagtagcaatactgcacctggt

SEQ ID NO: 54462 - DNA, 25 bp, Homo sapien
gtagcaatactgcacctggtgatca

SEQ ID NO: 54463 - DNA, 25 bp, Homo sapien
actgcacctggtgatcacaaagata

SEQ ID NO: 54464 - DNA, 25 bp, Homo sapien
aaagataatgttctacttctgatag

SEQ ID NO: 54465 - DNA, 25 bp, Homo sapien
aacaaatgttgttactatgcatgta

SEQ ID NO: 54466 - DNA, 25 bp, Homo sapien
gttactatgcatgtatatggatgga

SEQ ID NO: 54467 - DNA, 25 bp, Homo sapien
tctgtgggacgaagaccgggcaccc

SEQ ID NO: 54468 - DNA, 25 bp, Homo sapien
cgaagaccgggcacccgccagagag

SEQ ID NO: 54469 - DNA, 25 bp, Homo sapien
gaaggtaccaggttgcgtcctttca

SEQ ID NO: 54470 - DNA, 25 bp, Homo sapien
aggtaccaggttgcgtcctttcagg

SEQ ID NO: 54471 - DNA, 25 bp, Homo sapien
gtaccaggttgcgtcctttcaggcc

SEQ ID NO: 54472 - DNA, 25 bp, Homo sapien
aggttgcgtcctttcaggccccgcg

SEQ ID NO: 54473 - DNA, 25 bp, Homo sapien
ttcaggccccgcgttgttacaggac

SEQ ID NO: 54474 - DNA, 25 bp, Homo sapien
aggccccgcgttgttacaggacact

SEQ ID NO: 54475 - DNA, 25 bp, Homo sapien
gccccgcgttgttacaggacactcg

SEQ ID NO: 54476 - DNA, 25 bp, Homo sapien
ccgcgttgttacaggacactcgctg

SEQ ID NO: 54477 - DNA, 25 bp, Homo sapien
gcgttgttacaggacactcgctggg

SEQ ID NO: 54478 - DNA, 25 bp, Homo sapien
ttctgtgttggaaacctgcgtcatg

SEQ ID NO: 54479 - DNA, 25 bp, Homo sapien
gaaacctgcgtcatgtaaatatctg

SEQ ID NO: 54480 - DNA, 25 bp, Homo sapien
gcgtcatgtaaatatctgcaaatca

SEQ ID NO: 54481 - DNA, 25 bp, Homo sapien
atatctgcaaatcatgacagtctaa

SEQ ID NO: 54482 - DNA, 25 bp, Homo sapien
gacagtctaaagtgcaaaccatttt

SEQ ID NO: 54483 - DNA, 25 bp, Homo sapien
aaagtgcaaaccattttcagagact

SEQ ID NO: 54484 - DNA, 25 bp, Homo sapien
gaatgcagtgatcagaagtggctaa

SEQ ID NO: 54485 - DNA, 25 bp, Homo sapien
aatcttccacttaaccactgaaaat

SEQ ID NO: 54486 - DNA, 25 bp, Homo sapien
tgcctccccaaaaagctcctattaa

SEQ ID NO: 54487 - DNA, 25 bp, Homo sapien
agctcctattaatttgcttatcccc

SEQ ID NO: 54488 - DNA, 25 bp, Homo sapien
cccctcatgtagctagttgaatgtg

SEQ ID NO: 54489 - DNA, 25 bp, Homo sapien
gccccctggatggtctgagcacagt

SEQ ID NO: 54490 - DNA, 25 bp, Homo sapien
ggcactgaagcctccggatttgatg

SEQ ID NO: 54491 - DNA, 25 bp, Homo sapien
tgaagcctccggatttgatgcacca

SEQ ID NO: 54492 - DNA, 25 bp, Homo sapien
gcctccggatttgatgcaccatgaa

SEQ ID NO: 54493 - DNA, 25 bp, Homo sapien
atttgatgcaccatgaatgaggaga

SEQ ID NO: 54494 - DNA, 25 bp, Homo sapien
atgaggagaaatggcctcccgtctt

SEQ ID NO: 54495 - DNA, 25 bp, Homo sapien
gagaaatggcctcccgtcttgtgaa

SEQ ID NO: 54496 - DNA, 25 bp, Homo sapien
aaatggcctcccgtcttgtgaactt

SEQ ID NO: 54497 - DNA, 25 bp, Homo sapien
ctcccgtcttgtgaacttcaatggg

SEQ ID NO: 54498 - DNA, 25 bp, Homo sapien
gcaatagaaatgcacagatgcctat

SEQ ID NO: 54499 - DNA, 25 bp, Homo sapien
atgcacagatgcctatacatacata

SEQ ID NO: 54500 - DNA, 25 bp, Homo sapien
ctcttgtttctgagctgttagactt

SEQ ID NO: 54501 - DNA, 25 bp, Homo sapien
gagctgttagacttcttcttcatta

SEQ ID NO: 54502 - DNA, 25 bp, Homo sapien
ttcttcattagtgaacctctgttca

SEQ ID NO: 54503 - DNA, 25 bp, Homo sapien
aagtcttgccaaatttgatgcccct

SEQ ID NO: 54504 - DNA, 25 bp, Homo sapien
gatgcccctccggaagctgttgcag

SEQ ID NO: 54505 - DNA, 25 bp, Homo sapien
gctgttgcagccaagttaggagtga

SEQ ID NO: 54506 - DNA, 25 bp, Homo sapien
gatgcacggatcagatgtcccttca

SEQ ID NO: 54507 - DNA, 25 bp, Homo sapien
tgtcccttcagaaacgaagcctcat

SEQ ID NO: 54508 - DNA, 25 bp, Homo sapien
cgaagcctcattgcggaagtcctgg

SEQ ID NO: 54509 - DNA, 25 bp, Homo sapien
atcctggtttccactgtctttcaat

SEQ ID NO: 54510 - DNA, 25 bp, Homo sapien
actgtctttcaatgacaccctgatc

SEQ ID NO: 54511 - DNA, 25 bp, Homo sapien
gagatgtggttcttaatgtttaaca

SEQ ID NO: 54512 - DNA, 25 bp, Homo sapien
agaacagttctaatcctgccacgtg

SEQ ID NO: 54513 - DNA, 25 bp, Homo sapien
aatcctgccacgtgttatcattata

SEQ ID NO: 54514 - DNA, 25 bp, Homo sapien
ttatagattttatagttgcctttct

SEQ ID NO: 54515 - DNA, 25 bp, Homo sapien
acttagcacagtttgagaatacgtt

SEQ ID NO: 54516 - DNA, 25 bp, Homo sapien
gaatacgttaattgctatttactat

SEQ ID NO: 54517 - DNA, 25 bp, Homo sapien
tactgaaatcagtccataacattaa

SEQ ID NO: 54518 - DNA, 25 bp, Homo sapien
gtccataacattaagatgagcccta

SEQ ID NO: 54519 - DNA, 25 bp, Homo sapien
gagccctaatatgtaagattttcct

SEQ ID NO: 54520 - DNA, 25 bp, Homo sapien
gcagtatttatcctggtttaattct

SEQ ID NO: 54521 - DNA, 25 bp, Homo sapien
ggtttaattctaatacgatgtcatg

SEQ ID NO: 54522 - DNA, 25 bp, Homo sapien
tagtcgtgcaggtagggaaaaagtt

SEQ ID NO: 54523 - DNA, 25 bp, Homo sapien
tgaagattgtgcatttcctagtgac

SEQ ID NO: 54524 - DNA, 25 bp, Homo sapien
gccaagaggttatgatacgggtttc

SEQ ID NO: 54525 - DNA, 25 bp, Homo sapien
tacgggtttcttgggtctgatgtac

SEQ ID NO: 54526 - DNA, 25 bp, Homo sapien
cttgggtctgatgtacagtgtgaat

SEQ ID NO: 54527 - DNA, 25 bp, Homo sapien
cagtgtgaataaatgcttgcagctc

SEQ ID NO: 54528 - DNA, 25 bp, Homo sapien
aaatgcttgcagctcttagctcttt

SEQ ID NO: 54529 - DNA, 25 bp, Homo sapien
gaggaaccgtaactctccatagctg

SEQ ID NO: 54530 - DNA, 25 bp, Homo sapien
ccgtaactctccatagctgtacata

SEQ ID NO: 54531 - DNA, 25 bp, Homo sapien
agctgtacatataacccttttctcc

SEQ ID NO: 54532 - DNA, 25 bp, Homo sapien
catataacccttttctcctaaagag

SEQ ID NO: 54533 - DNA, 25 bp, Homo sapien
aggtccaagtaaaccgctagcttgt

SEQ ID NO: 54534 - DNA, 25 bp, Homo sapien
aagtaaaccgctagcttgttgcacc

SEQ ID NO: 54535 - DNA, 25 bp, Homo sapien
taaaccgctagcttgttgcaccgtg

SEQ ID NO: 54536 - DNA, 25 bp, Homo sapien
aaccgctagcttgttgcaccgtgga

SEQ ID NO: 54537 - DNA, 25 bp, Homo sapien
ccgctagcttgttgcaccgtggagg

SEQ ID NO: 54538 - DNA, 25 bp, Homo sapien
tagcttgttgcaccgtggaggccac

SEQ ID NO: 54539 - DNA, 25 bp, Homo sapien
ttgttgcaccgtggaggccacagga

SEQ ID NO: 54540 - DNA, 25 bp, Homo sapien
ttgcaccgtggaggccacaggagca

SEQ ID NO: 54541 - DNA, 25 bp, Homo sapien
gaaacatggaatgccagacgctggg

SEQ ID NO: 54542 - DNA, 25 bp, Homo sapien
atgctggtacaagttgtgggactgc

SEQ ID NO: 54543 - DNA, 25 bp, Homo sapien
ctggtacaagttgtgggactgcatg

SEQ ID NO: 54544 - DNA, 25 bp, Homo sapien
tagtacctgtttaaccattagaaat

SEQ ID NO: 54545 - DNA, 25 bp, Homo sapien
tagaaatatttcatgtcaaggagga

SEQ ID NO: 54546 - DNA, 25 bp, Homo sapien
tattgttccaattcacaggttacat

SEQ ID NO: 54547 - DNA, 25 bp, Homo sapien
actaagcttaactacatgtcacaca

SEQ ID NO: 54548 - DNA, 25 bp, Homo sapien
atgtcacacattgtacatggaaaca

SEQ ID NO: 54549 - DNA, 25 bp, Homo sapien
aagaacattaagaagtccgactgac

SEQ ID NO: 54550 - DNA, 25 bp, Homo sapien
aagtccgactgacagtatcagtact

SEQ ID NO: 54551 - DNA, 25 bp, Homo sapien
gtatcagtactgttttgcaaatact

SEQ ID NO: 54552 - DNA, 25 bp, Homo sapien
aatactcagcatactttggatccat

SEQ ID NO: 54553 - DNA, 25 bp, Homo sapien
tactttggatccatttcatgcagga

SEQ ID NO: 54554 - DNA, 25 bp, Homo sapien
tcatgcaggattgtgttgttttaac

SEQ ID NO: 54555 - DNA, 25 bp, Homo sapien
ttggagatgcatcagctatgaacac

SEQ ID NO: 54556 - DNA, 25 bp, Homo sapien
agctatgaacacatcctaaccagga

SEQ ID NO: 54557 - DNA, 25 bp, Homo sapien
ggaaacagctccttgtacaacacgc

SEQ ID NO: 54558 - DNA, 25 bp, Homo sapien
tgtacaacacgcctccatgtttcag

SEQ ID NO: 54559 - DNA, 25 bp, Homo sapien
atgtttcagcatctacgtcatgggc

SEQ ID NO: 54560 - DNA, 25 bp, Homo sapien
agcatctacgtcatgggcttggttc

SEQ ID NO: 54561 - DNA, 25 bp, Homo sapien
aaaacaatggaggtgccgcggccat

SEQ ID NO: 54562 - DNA, 25 bp, Homo sapien
tgccgcggccatggagaagcttagc

SEQ ID NO: 54563 - DNA, 25 bp, Homo sapien
gagaagcttagctccatcaaatctc

SEQ ID NO: 54564 - DNA, 25 bp, Homo sapien
ggcctctctgtataatgctgtcaca

SEQ ID NO: 54565 - DNA, 25 bp, Homo sapien
aagacgttcagaagctggccgcctt

SEQ ID NO: 54566 - DNA, 25 bp, Homo sapien
ggagatcgtggcagcccagcagaat

SEQ ID NO: 54567 - DNA, 25 bp, Homo sapien
atcgtggcagcccagcagaatggct

SEQ ID NO: 54568 - DNA, 25 bp, Homo sapien
tgtgaagagtgtagccgaggcctcc

SEQ ID NO: 54569 - DNA, 25 bp, Homo sapien
agagtgtagccgaggcctccgagct

SEQ ID NO: 54570 - DNA, 25 bp, Homo sapien
cgtccccgttcaagtggagcgggat

SEQ ID NO: 54571 - DNA, 25 bp, Homo sapien
ggagctgcccgctgcgagtctgaac

SEQ ID NO: 54572 - DNA, 25 bp, Homo sapien
gctgcgagtctgaaccactgcacca

SEQ ID NO: 54573 - DNA, 25 bp, Homo sapien
tgcaccatccagatcagcgagctgg

SEQ ID NO: 54574 - DNA, 25 bp, Homo sapien
ccagatcagcgagctggagaccaat

SEQ ID NO: 54575 - DNA, 25 bp, Homo sapien
gagaccaatgtctgagcctgcggag

SEQ ID NO: 54576 - DNA, 25 bp, Homo sapien
tgaggcaggaactcgactctccaac

SEQ ID NO: 54577 - DNA, 25 bp, Homo sapien
cgcttccaggcagcattccagaatg

SEQ ID NO: 54578 - DNA, 25 bp, Homo sapien
gaatgtgatctcttctttccacaaa

SEQ ID NO: 54579 - DNA, 25 bp, Homo sapien
ccagcggaacatcttcctgacagaa

SEQ ID NO: 54580 - DNA, 25 bp, Homo sapien
tcttcctgacagaatgccactttgt

SEQ ID NO: 54581 - DNA, 25 bp, Homo sapien
tgccactttgtggagctgaccgaag

SEQ ID NO: 54582 - DNA, 25 bp, Homo sapien
gaagatataggtccccaattcccat

SEQ ID NO: 54583 - DNA, 25 bp, Homo sapien
atgtcagtcatccatgcacaactct

SEQ ID NO: 54584 - DNA, 25 bp, Homo sapien
aacagccctctctagtgaacagatg

SEQ ID NO: 54585 - DNA, 25 bp, Homo sapien
gaacaaactatcaaagcttccactt

SEQ ID NO: 54586 - DNA, 25 bp, Homo sapien
tcttctacctgagctcagctgtcaa

SEQ ID NO: 54587 - DNA, 25 bp, Homo sapien
agctgtcaaccccattatctataac

SEQ ID NO: 54588 - DNA, 25 bp, Homo sapien
gcggcgatgttaccatggcaaccaa

SEQ ID NO: 54589 - DNA, 25 bp, Homo sapien
tggcaaccaacgtcctgcagaccgt

SEQ ID NO: 54590 - DNA, 25 bp, Homo sapien
tgcagaccgtgcagcgcatcctggc

SEQ ID NO: 54591 - DNA, 25 bp, Homo sapien
acgtcatcggcgtgctgcgggatca

SEQ ID NO: 54592 - DNA, 25 bp, Homo sapien
gcgtgctgcgggatcagcaacgcta

SEQ ID NO: 54593 - DNA, 25 bp, Homo sapien
agcaacgctaccacgaagacatttt

SEQ ID NO: 54594 - DNA, 25 bp, Homo sapien
acgaagacattttcgggctcacgct

SEQ ID NO: 54595 - DNA, 25 bp, Homo sapien
ctcacgctgcgcacccaggaggtga

SEQ ID NO: 54596 - DNA, 25 bp, Homo sapien
aggaggtgacaagccgcatacgcac

SEQ ID NO: 54597 - DNA, 25 bp, Homo sapien
cacccagagcttttccttgcaggag

SEQ ID NO: 54598 - DNA, 25 bp, Homo sapien
ttttccttgcaggagcgtcagttgc

SEQ ID NO: 54599 - DNA, 25 bp, Homo sapien
tggagcagacccttttcatctcctg

SEQ ID NO: 54600 - DNA, 25 bp, Homo sapien
ttttcatctcctgtgcctgtaacac

SEQ ID NO: 54601 - DNA, 25 bp, Homo sapien
tccgcaattcaatgagggctttctt

SEQ ID NO: 54602 - DNA, 25 bp, Homo sapien
ggctttcttgggtcagaggacttca

SEQ ID NO: 54603 - DNA, 25 bp, Homo sapien
gaggacttcaaggttgtctagagaa

SEQ ID NO: 54604 - DNA, 25 bp, Homo sapien
ttgccatgtgtgtaaggtgctgtga

SEQ ID NO: 54605 - DNA, 25 bp, Homo sapien
gattcgcagcattcaataccaggca

SEQ ID NO: 54606 - DNA, 25 bp, Homo sapien
ggcagccaaagagctgctcttgcaa

SEQ ID NO: 54607 - DNA, 25 bp, Homo sapien
ctcttgcaattattttggctctcaa

SEQ ID NO: 54608 - DNA, 25 bp, Homo sapien
ttggctctcaagctctgttcttcat

SEQ ID NO: 54609 - DNA, 25 bp, Homo sapien
tgttcttcatcgcattctcatttct

SEQ ID NO: 54610 - DNA, 25 bp, Homo sapien
accaacagcccctgagagccgcctg

SEQ ID NO: 54611 - DNA, 25 bp, Homo sapien
ccaacagcccctgagagccgcctgg

SEQ ID NO: 54612 - DNA, 25 bp, Homo sapien
tgagagccgcctggctttcccttcc

SEQ ID NO: 54613 - DNA, 25 bp, Homo sapien
gagagccgcctggctttcccttcca

SEQ ID NO: 54614 - DNA, 25 bp, Homo sapien
agagccgcctggctttcccttccag

SEQ ID NO: 54615 - DNA, 25 bp, Homo sapien
gagccgcctggctttcccttccagt

SEQ ID NO: 54616 - DNA, 25 bp, Homo sapien
agccgcctggctttcccttccagtt

SEQ ID NO: 54617 - DNA, 25 bp, Homo sapien
gccgcctggctttcccttccagttc

SEQ ID NO: 54618 - DNA, 25 bp, Homo sapien
tcgtccaggcccagcgatagatcag

SEQ ID NO: 54619 - DNA, 25 bp, Homo sapien
cgtccaggcccagcgatagatcagg

SEQ ID NO: 54620 - DNA, 25 bp, Homo sapien
ccaggcccagcgatagatcaggagg

SEQ ID NO: 54621 - DNA, 25 bp, Homo sapien
tctgcccttgacctgtattccactt

SEQ ID NO: 54622 - DNA, 25 bp, Homo sapien
ctgcccttgacctgtattccactta

SEQ ID NO: 54623 - DNA, 25 bp, Homo sapien
gcccttgacctgtattccacttact

SEQ ID NO: 54624 - DNA, 25 bp, Homo sapien
cttgacctgtattccacttactcca

SEQ ID NO: 54625 - DNA, 25 bp, Homo sapien
ttgacctgtattccacttactccac

SEQ ID NO: 54626 - DNA, 25 bp, Homo sapien
tgacctgtattccacttactccacc

SEQ ID NO: 54627 - DNA, 25 bp, Homo sapien
gtccccacagccgagtcctgcatca

SEQ ID NO: 54628 - DNA, 25 bp, Homo sapien
cccacagccgagtcctgcatcagcc

SEQ ID NO: 54629 - DNA, 25 bp, Homo sapien
aataggaaacccttgcctcatcagt

SEQ ID NO: 54630 - DNA, 25 bp, Homo sapien
cagttttcctgatttacaagtgcaa

SEQ ID NO: 54631 - DNA, 25 bp, Homo sapien
atattttagccaatgccttgggaga

SEQ ID NO: 54632 - DNA, 25 bp, Homo sapien
gaagctgccatgcaaaggtggacac

SEQ ID NO: 54633 - DNA, 25 bp, Homo sapien
aaaggtggacaccattctccagctt

SEQ ID NO: 54634 - DNA, 25 bp, Homo sapien
gcagctggccttctggactaaggca

SEQ ID NO: 54635 - DNA, 25 bp, Homo sapien
gggacactgcagtctggctacacac

SEQ ID NO: 54636 - DNA, 25 bp, Homo sapien
ggctacacacagagatctggcaccc

SEQ ID NO: 54637 - DNA, 25 bp, Homo sapien
ggctttgggaaagcatggcaccctc

SEQ ID NO: 54638 - DNA, 25 bp, Homo sapien
gggaaagcatggcaccctcagacca

SEQ ID NO: 54639 - DNA, 25 bp, Homo sapien
gaccacacagtagccaagttctgga

SEQ ID NO: 54640 - DNA, 25 bp, Homo sapien
gttggtgagtgttcctaggctaatg

SEQ ID NO: 54641 - DNA, 25 bp, Homo sapien
gtgagtgttcctaggctaatgataa

SEQ ID NO: 54642 - DNA, 25 bp, Homo sapien
gttcctaggctaatgataatctgta

SEQ ID NO: 54643 - DNA, 25 bp, Homo sapien
tgataatctgtataattcacatcct

SEQ ID NO: 54644 - DNA, 25 bp, Homo sapien
gtataattcacatcctgaaactaag

SEQ ID NO: 54645 - DNA, 25 bp, Homo sapien
ttcacatcctgaaactaaggaatac

SEQ ID NO: 54646 - DNA, 25 bp, Homo sapien
aatctatttaatcttcttgcattta

SEQ ID NO: 54647 - DNA, 25 bp, Homo sapien
ctatttaatcttcttgcatttattt

SEQ ID NO: 54648 - DNA, 25 bp, Homo sapien
gtatttttgatgctgcttccaattt

SEQ ID NO: 54649 - DNA, 25 bp, Homo sapien
atttttgatgctgcttccaatttta

SEQ ID NO: 54650 - DNA, 25 bp, Homo sapien
tttgatgctgcttccaattttaaaa

SEQ ID NO: 54651 - DNA, 25 bp, Homo sapien
actagtggtcaactttggctcagcc

SEQ ID NO: 54652 - DNA, 25 bp, Homo sapien
ttgacctcctttcacgagccagctg

SEQ ID NO: 54653 - DNA, 25 bp, Homo sapien
gccagccttccgcaaactggtggaa

SEQ ID NO: 54654 - DNA, 25 bp, Homo sapien
ggaagagttctcctcagtggctgac

SEQ ID NO: 54655 - DNA, 25 bp, Homo sapien
gacttcctgctggtctacattgatg

SEQ ID NO: 54656 - DNA, 25 bp, Homo sapien
gatgaggctcatccatcagatggct

SEQ ID NO: 54657 - DNA, 25 bp, Homo sapien
gcaccagaaccaggaagatcgatgt

SEQ ID NO: 54658 - DNA, 25 bp, Homo sapien
aagatcgatgtgcagcagcccagca

SEQ ID NO: 54659 - DNA, 25 bp, Homo sapien
ttgccgccccagtgccgagttgtgg

SEQ ID NO: 54660 - DNA, 25 bp, Homo sapien
cgagttgtggctgaccgcatggaca

SEQ ID NO: 54661 - DNA, 25 bp, Homo sapien
gaccgcatggacaataacgccaaca

SEQ ID NO: 54662 - DNA, 25 bp, Homo sapien
gactgaacagaaatccttagctagt

SEQ ID NO: 54663 - DNA, 25 bp, Homo sapien
ctagtagaatggcagcacgctgtaa

SEQ ID NO: 54664 - DNA, 25 bp, Homo sapien
attactgtattgtgtactggctata

SEQ ID NO: 54665 - DNA, 25 bp, Homo sapien
actggctataagatgtagacacctt

SEQ ID NO: 54666 - DNA, 25 bp, Homo sapien
gtagacacctttcagtaagccaatc

SEQ ID NO: 54667 - DNA, 25 bp, Homo sapien
taagccaatcatttgtaaccattct

SEQ ID NO: 54668 - DNA, 25 bp, Homo sapien
gtaaccattctagcagtgtcatatt

SEQ ID NO: 54669 - DNA, 25 bp, Homo sapien
attaggttaataaggctgctgtgtt

SEQ ID NO: 54670 - DNA, 25 bp, Homo sapien
gcattcattgacacatagctctaat

SEQ ID NO: 54671 - DNA, 25 bp, Homo sapien
aaccatacactggatgacctagtcg

SEQ ID NO: 54672 - DNA, 25 bp, Homo sapien
ggatgacctagtcgattatttaagc

SEQ ID NO: 54673 - DNA, 25 bp, Homo sapien
gtttgagtacctgatgaaaatgaat

SEQ ID NO: 54674 - DNA, 25 bp, Homo sapien
gagagtatgtaatctttgaaagctg

SEQ ID NO: 54675 - DNA, 25 bp, Homo sapien
ttgaaagctgaatactgcgtgttct

SEQ ID NO: 54676 - DNA, 25 bp, Homo sapien
tgtatacacatggacacaccagagt

SEQ ID NO: 54677 - DNA, 25 bp, Homo sapien
cacaccagagtgtagaataatagac

SEQ ID NO: 54678 - DNA, 25 bp, Homo sapien
acttggaagagttggagggttggca

SEQ ID NO: 54679 - DNA, 25 bp, Homo sapien
ggcagggggcgatgataatttactt

SEQ ID NO: 54680 - DNA, 25 bp, Homo sapien
gggtgatggttacagcccagacttt

SEQ ID NO: 54681 - DNA, 25 bp, Homo sapien
ggtgatggttacagcccagacttta

SEQ ID NO: 54682 - DNA, 25 bp, Homo sapien
tgatggttacagcccagactttacc

SEQ ID NO: 54683 - DNA, 25 bp, Homo sapien
gtaacaaaactatacttgtactcct

SEQ ID NO: 54684 - DNA, 25 bp, Homo sapien
cgcaccccaaatccagtacaggagg

SEQ ID NO: 54685 - DNA, 25 bp, Homo sapien
aggaggctgctggtacaaatactgc

SEQ ID NO: 54686 - DNA, 25 bp, Homo sapien
aacagcgtggcttagattgtgccca

SEQ ID NO: 54687 - DNA, 25 bp, Homo sapien
tgcccacccagggaaggtgctgaat

SEQ ID NO: 54688 - DNA, 25 bp, Homo sapien
gaatgggaccctgttgatggcccca

SEQ ID NO: 54689 - DNA, 25 bp, Homo sapien
ggatgtaaatcctgagctcaaatct

SEQ ID NO: 54690 - DNA, 25 bp, Homo sapien
agctcaaatctctgttactccatta

SEQ ID NO: 54691 - DNA, 25 bp, Homo sapien
actccattactgtgatttctggctg

SEQ ID NO: 54692 - DNA, 25 bp, Homo sapien
gctgggtcaccagaaatatcgctga

SEQ ID NO: 54693 - DNA, 25 bp, Homo sapien
aatatcgctgatgcagacacagatt

SEQ ID NO: 54694 - DNA, 25 bp, Homo sapien
gacacagattatgttcctgctgtat

SEQ ID NO: 54695 - DNA, 25 bp, Homo sapien
aagagtcttataactacttgaattt

SEQ ID NO: 54696 - DNA, 25 bp, Homo sapien
atgtcttaatgtaggttgtagtcac

SEQ ID NO: 54697 - DNA, 25 bp, Homo sapien
taatgtaggttgtagtcactttaga

SEQ ID NO: 54698 - DNA, 25 bp, Homo sapien
gttgtagtcactttagatggaaaat

SEQ ID NO: 54699 - DNA, 25 bp, Homo sapien
catctgttttcttcagtattactta

SEQ ID NO: 54700 - DNA, 25 bp, Homo sapien
aagattgtttatttagtggtagaga

SEQ ID NO: 54701 - DNA, 25 bp, Homo sapien
ttttttcagcctagaggcagctatt

SEQ ID NO: 54702 - DNA, 25 bp, Homo sapien
agcctagaggcagctattttaccat

SEQ ID NO: 54703 - DNA, 25 bp, Homo sapien
aggcagctattttaccatctggtat

SEQ ID NO: 54704 - DNA, 25 bp, Homo sapien
ctggtatttatggtctaatttgtat

SEQ ID NO: 54705 - DNA, 25 bp, Homo sapien
tttgtatttaaacatatgcacacat

SEQ ID NO: 54706 - DNA, 25 bp, Homo sapien
tgtggtcacctgcaatctctttgtt

SEQ ID NO: 54707 - DNA, 25 bp, Homo sapien
aatctctttgttgtgcctgcactga

SEQ ID NO: 54708 - DNA, 25 bp, Homo sapien
cagggcatcttggatcctcggccaa

SEQ ID NO: 54709 - DNA, 25 bp, Homo sapien
atcctcgtccagaataccatcggtg

SEQ ID NO: 54710 - DNA, 25 bp, Homo sapien
atcggtgtatactaacttggcatca

SEQ ID NO: 54711 - DNA, 25 bp, Homo sapien
ttggcatcaccaagaaccactacct

SEQ ID NO: 54712 - DNA, 25 bp, Homo sapien
cttgggcacagagtacaggtaatca

SEQ ID NO: 54713 - DNA, 25 bp, Homo sapien
ggtaatcaaatgagcagccgtctga

SEQ ID NO: 54714 - DNA, 25 bp, Homo sapien
agcatgcgcagtgccaatggattgt

SEQ ID NO: 54715 - DNA, 25 bp, Homo sapien
ggattgttgatgctacctccaaaga

SEQ ID NO: 54716 - DNA, 25 bp, Homo sapien
gacagaacagtacgtggagctccac

SEQ ID NO: 54717 - DNA, 25 bp, Homo sapien
ggtacaaaatggtctgatgctcctt

SEQ ID NO: 54718 - DNA, 25 bp, Homo sapien
aatggtctgatgctccttcaaaaac

SEQ ID NO: 54719 - DNA, 25 bp, Homo sapien
gatgctccttcaaaaacattcactt

SEQ ID NO: 54720 - DNA, 25 bp, Homo sapien
acattcactttttacaacgtcaagg

SEQ ID NO: 54721 - DNA, 25 bp, Homo sapien
caacgtcaaggaattaagcataaaa

SEQ ID NO: 54722 - DNA, 25 bp, Homo sapien
cagatttcaggctgcaaacttgttt

SEQ ID NO: 54723 - DNA, 25 bp, Homo sapien
gttttataatcgtttgcttctccaa

SEQ ID NO: 54724 - DNA, 25 bp, Homo sapien
ataatcgtttgcttctccaagtgaa

SEQ ID NO: 54725 - DNA, 25 bp, Homo sapien
tccaagtgaagctcagaaataccta

SEQ ID NO: 54726 - DNA, 25 bp, Homo sapien
taaaaatagctgtaacgttcgcgtt

SEQ ID NO: 54727 - DNA, 25 bp, Homo sapien
cgttcgcgttaggaaagatggtgtt

SEQ ID NO: 54728 - DNA, 25 bp, Homo sapien
actggtggcttaatgactctgcacc

SEQ ID NO: 54729 - DNA, 25 bp, Homo sapien
ggcttaatgactctgcacctttttc

SEQ ID NO: 54730 - DNA, 25 bp, Homo sapien
tttttctcaggaattctgcctaagt

SEQ ID NO: 54731 - DNA, 25 bp, Homo sapien
aattctgcctaagttgtctgccttt

SEQ ID NO: 54732 - DNA, 25 bp, Homo sapien
tgccttttctaccaccaaaaagact

SEQ ID NO: 54733 - DNA, 25 bp, Homo sapien
atgctttctcctgaattttggtagg

SEQ ID NO: 54734 - DNA, 25 bp, Homo sapien
gtcaaaggcacagccttgatgatct

SEQ ID NO: 54735 - DNA, 25 bp, Homo sapien
gccttgatgatctcagggaaaaatt

SEQ ID NO: 54736 - DNA, 25 bp, Homo sapien
atgatactgaaccttgattaataac

SEQ ID NO: 54737 - DNA, 25 bp, Homo sapien
gaaattcaggatgtaaagccacaga

SEQ ID NO: 54738 - DNA, 25 bp, Homo sapien
gatttattaatgtgggatacctcag

SEQ ID NO: 54739 - DNA, 25 bp, Homo sapien
tcgcctgttggctcctgtgcctgtg

SEQ ID NO: 54740 - DNA, 25 bp, Homo sapien
cgctgcgtgttttcctcttgatcgg

SEQ ID NO: 54741 - DNA, 25 bp, Homo sapien
ctgcgtgttttcctcttgatcggga

SEQ ID NO: 54742 - DNA, 25 bp, Homo sapien
gcgtgttttcctcttgatcgggaac

SEQ ID NO: 54743 - DNA, 25 bp, Homo sapien
gtgttttcctcttgatcgggaactc

SEQ ID NO: 54744 - DNA, 25 bp, Homo sapien
ttttcctcttgatcgggaactcctg

SEQ ID NO: 54745 - DNA, 25 bp, Homo sapien
ctcttgatcgggaactcctgcttct

SEQ ID NO: 54746 - DNA, 25 bp, Homo sapien
ttgatcgggaactcctgcttctcct

SEQ ID NO: 54747 - DNA, 25 bp, Homo sapien
ctgcttctccttgcctcgaaatgga

SEQ ID NO: 54748 - DNA, 25 bp, Homo sapien
gcttctccttgcctcgaaatggacc

SEQ ID NO: 54749 - DNA, 25 bp, Homo sapien
aactgctcctgctcgcctgttggct

SEQ ID NO: 54750 - DNA, 25 bp, Homo sapien
tggatgcttcatccaaatcgcctca

SEQ ID NO: 54751 - DNA, 25 bp, Homo sapien
acctacagcagggaagttgactcat

SEQ ID NO: 54752 - DNA, 25 bp, Homo sapien
gttgactcatccaagcattttgcca

SEQ ID NO: 54753 - DNA, 25 bp, Homo sapien
cctgccaatctttgcaatttgcttg

SEQ ID NO: 54754 - DNA, 25 bp, Homo sapien
aatttgcttgactcacctcagactt

SEQ ID NO: 54755 - DNA, 25 bp, Homo sapien
cctcagactttcattcacaacagac

SEQ ID NO: 54756 - DNA, 25 bp, Homo sapien
aaggctaacgtccagctgtatttac

SEQ ID NO: 54757 - DNA, 25 bp, Homo sapien
ctgtatttacttctggctgtgccgt

SEQ ID NO: 54758 - DNA, 25 bp, Homo sapien
gctgtgccgtttggctgtttaagct

SEQ ID NO: 54759 - DNA, 25 bp, Homo sapien
ttaagctgccaattgtagcactcag

SEQ ID NO: 54760 - DNA, 25 bp, Homo sapien
gcatcagcctggagtgaaccatgaa

SEQ ID NO: 54761 - DNA, 25 bp, Homo sapien
gggaagcccagcaataccacgcagt

SEQ ID NO: 54762 - DNA, 25 bp, Homo sapien
ctccactttctcaaagcacactgga

SEQ ID NO: 54763 - DNA, 25 bp, Homo sapien
gaaaggccattagaattgccccagc

SEQ ID NO: 54764 - DNA, 25 bp, Homo sapien
gtttgcttgcagtgctttcttaatt

SEQ ID NO: 54765 - DNA, 25 bp, Homo sapien
ttttatggctcttctgggaaactcc

SEQ ID NO: 54766 - DNA, 25 bp, Homo sapien
ttatggctcttctgggaaactcctc

SEQ ID NO: 54767 - DNA, 25 bp, Homo sapien
tatggctcttctgggaaactcctcc

SEQ ID NO: 54768 - DNA, 25 bp, Homo sapien
gggctgtgaattctttcttcatccc

SEQ ID NO: 54769 - DNA, 25 bp, Homo sapien
gctgtgaattctttcttcatccccg

SEQ ID NO: 54770 - DNA, 25 bp, Homo sapien
tgtgaattctttcttcatccccgca

SEQ ID NO: 54771 - DNA, 25 bp, Homo sapien
tgaattctttcttcatccccgcatt

SEQ ID NO: 54772 - DNA, 25 bp, Homo sapien
ggagacctaaatcggagtccacacc

SEQ ID NO: 54773 - DNA, 25 bp, Homo sapien
agtccacaccaagccttcagaagtg

SEQ ID NO: 54774 - DNA, 25 bp, Homo sapien
agtggaggattcatttgtacccaga

SEQ ID NO: 54775 - DNA, 25 bp, Homo sapien
ttgtacccagaattggcaaatttac

SEQ ID NO: 54776 - DNA, 25 bp, Homo sapien
tttaccaagcatttcaaggattagt

SEQ ID NO: 54777 - DNA, 25 bp, Homo sapien
gacacacttgttaacagaaacctgg

SEQ ID NO: 54778 - DNA, 25 bp, Homo sapien
aagacaagagcttccttcaaactgc

SEQ ID NO: 54779 - DNA, 25 bp, Homo sapien
cccttccttaccatgtctacaatat

SEQ ID NO: 54780 - DNA, 25 bp, Homo sapien
aattatcacgacactcttatttcag

SEQ ID NO: 54781 - DNA, 25 bp, Homo sapien
gttcttatcaagatcacgccaagtg

SEQ ID NO: 54782 - DNA, 25 bp, Homo sapien
aaatcgctggacatgtattggagac

SEQ ID NO: 54783 - DNA, 25 bp, Homo sapien
ctctgtcattcgctcccacattctg

SEQ ID NO: 54784 - DNA, 25 bp, Homo sapien
tagcagtgtctgtaaaagagcctag

SEQ ID NO: 54785 - DNA, 25 bp, Homo sapien
gtgtctgtaaaagagcctagttttt

SEQ ID NO: 54786 - DNA, 25 bp, Homo sapien
gagcctagtttttaatagctatgga

SEQ ID NO: 54787 - DNA, 25 bp, Homo sapien
tttaatagctatggaatcaattcaa

SEQ ID NO: 54788 - DNA, 25 bp, Homo sapien
aatttggactggtgtgctctcttta

SEQ ID NO: 54789 - DNA, 25 bp, Homo sapien
tggactggtgtgctctctttaaatc

SEQ ID NO: 54790 - DNA, 25 bp, Homo sapien
gactggtgtgctctctttaaatcaa

SEQ ID NO: 54791 - DNA, 25 bp, Homo sapien
ggtgtgctctctttaaatcaagtcc

SEQ ID NO: 54792 - DNA, 25 bp, Homo sapien
gtgctctctttaaatcaagtccttt

SEQ ID NO: 54793 - DNA, 25 bp, Homo sapien
aatcaagtcctttaattaagactga

SEQ ID NO: 54794 - DNA, 25 bp, Homo sapien
gaacagagtgttcgattctgcccta

SEQ ID NO: 54795 - DNA, 25 bp, Homo sapien
agagtgttcgattctgccctattta

SEQ ID NO: 54796 - DNA, 25 bp, Homo sapien
agtgttcgattctgccctatttatg

SEQ ID NO: 54797 - DNA, 25 bp, Homo sapien
ttcgattctgccctatttatgtttc

SEQ ID NO: 54798 - DNA, 25 bp, Homo sapien
gattctgccctatttatgtttctac

SEQ ID NO: 54799 - DNA, 25 bp, Homo sapien
gttttgttttgctacgagtccacat

SEQ ID NO: 54800 - DNA, 25 bp, Homo sapien
ttgttttgctacgagtccacattcc

SEQ ID NO: 54801 - DNA, 25 bp, Homo sapien
ttttgctacgagtccacattcctgt

SEQ ID NO: 54802 - DNA, 25 bp, Homo sapien
tacgagtccacattcctgtttgtaa

SEQ ID NO: 54803 - DNA, 25 bp, Homo sapien
attcctgtttgtaatccttggttcg

SEQ ID NO: 54804 - DNA, 25 bp, Homo sapien
tgtttgtaatccttggttcgcccgg

SEQ ID NO: 54805 - DNA, 25 bp, Homo sapien
ggatctgagccatcgagggaagagt

SEQ ID NO: 54806 - DNA, 25 bp, Homo sapien
tggatagggccccacaggtgacagg

SEQ ID NO: 54807 - DNA, 25 bp, Homo sapien
cctgcagggcggatctggtgatcat

SEQ ID NO: 54808 - DNA, 25 bp, Homo sapien
cagtattggcaggagggccagtgca

SEQ ID NO: 54809 - DNA, 25 bp, Homo sapien
gccagtgcagaaaggctggtagctc

SEQ ID NO: 54810 - DNA, 25 bp, Homo sapien
cagaaaggctggtagctcaggcagt

SEQ ID NO: 54811 - DNA, 25 bp, Homo sapien
ggaagcactgaagcctgtagtcccc

SEQ ID NO: 54812 - DNA, 25 bp, Homo sapien
agcactgaagcctgtagtccccact

SEQ ID NO: 54813 - DNA, 25 bp, Homo sapien
gggtttgctcactcagcaataaata

SEQ ID NO: 54814 - DNA, 25 bp, Homo sapien
aactgtgtcacatcaaatcctaaat

SEQ ID NO: 54815 - DNA, 25 bp, Homo sapien
aaatcctaaatataccactacaaag

SEQ ID NO: 54816 - DNA, 25 bp, Homo sapien
gagattgttacagcaacctgatttt

SEQ ID NO: 54817 - DNA, 25 bp, Homo sapien
aggaacttcctcgaactaaagcagt

SEQ ID NO: 54818 - DNA, 25 bp, Homo sapien
agttaagacctcgacatttgctcac

SEQ ID NO: 54819 - DNA, 25 bp, Homo sapien
gacctcgacatttgctcacagaaaa

SEQ ID NO: 54820 - DNA, 25 bp, Homo sapien
aagtcgctgagtcgtttctagttgt

SEQ ID NO: 54821 - DNA, 25 bp, Homo sapien
aaagatgcagttatcccttatggaa

SEQ ID NO: 54822 - DNA, 25 bp, Homo sapien
gaacttgtgcctaatttgagtcatg

SEQ ID NO: 54823 - DNA, 25 bp, Homo sapien
aaacctgagttctgcatgactgagc

SEQ ID NO: 54824 - DNA, 25 bp, Homo sapien
gcatgactgagctctgtcactcaat

SEQ ID NO: 54825 - DNA, 25 bp, Homo sapien
agctctgtcactcaatggttgggaa

SEQ ID NO: 54826 - DNA, 25 bp, Homo sapien
aatttgtgatcatctctacgccttg

SEQ ID NO: 54827 - DNA, 25 bp, Homo sapien
cagtgatccatttggtgagcccagt

SEQ ID NO: 54828 - DNA, 25 bp, Homo sapien
gtccacaggccggtagctagatagc

SEQ ID NO: 54829 - DNA, 25 bp, Homo sapien
ctagatagcgcaggtctgggagcca

SEQ ID NO: 54830 - DNA, 25 bp, Homo sapien
gtacgcgcagatcaacagacctaag

SEQ ID NO: 54831 - DNA, 25 bp, Homo sapien
aatagcatcgatgcgagctcgtggt

SEQ ID NO: 54832 - DNA, 25 bp, Homo sapien
ggtgctcaagactggcatggacatc

SEQ ID NO: 54833 - DNA, 25 bp, Homo sapien
gcatggacatcagcatcacgacagg

SEQ ID NO: 54834 - DNA, 25 bp, Homo sapien
acgacaggctctcttgtattctttc

SEQ ID NO: 54835 - DNA, 25 bp, Homo sapien
tcacctcttcccacaagaaattcat

SEQ ID NO: 54836 - DNA, 25 bp, Homo sapien
attgcccaatggaactcgctcagaa

SEQ ID NO: 54837 - DNA, 25 bp, Homo sapien
gaactaagcatttttggcaaccaat

SEQ ID NO: 54838 - DNA, 25 bp, Homo sapien
gctttggcacctctgctccggctgg

SEQ ID NO: 54839 - DNA, 25 bp, Homo sapien
gctccggctggcatggctgcacgct

SEQ ID NO: 54840 - DNA, 25 bp, Homo sapien
ctccggctgctagtaggagccgtta

SEQ ID NO: 54841 - DNA, 25 bp, Homo sapien
gggtctccacacgatgcctagagaa

SEQ ID NO: 54842 - DNA, 25 bp, Homo sapien
atgcctagagaatgctgcagtctgc

SEQ ID NO: 54843 - DNA, 25 bp, Homo sapien
gctgcagtctgcacattagacgctt

SEQ ID NO: 54844 - DNA, 25 bp, Homo sapien
ctgcacattagacgctttttagaag

SEQ ID NO: 54845 - DNA, 25 bp, Homo sapien
gatcttttcttgactctcccacatg

SEQ ID NO: 54846 - DNA, 25 bp, Homo sapien
gttatgggagagaatcccctaccct

SEQ ID NO: 54847 - DNA, 25 bp, Homo sapien
cccctaccctactctgatgtataga

SEQ ID NO: 54848 - DNA, 25 bp, Homo sapien
tgatgtatagaccattctcccttca

SEQ ID NO: 54849 - DNA, 25 bp, Homo sapien
tgttttcagcagtgtgaagaagctt

SEQ ID NO: 54850 - DNA, 25 bp, Homo sapien
ttcagcagtgtgaagaagcttggtg

SEQ ID NO: 54851 - DNA, 25 bp, Homo sapien
tcagcagtgtgaagaagcttggtgt

SEQ ID NO: 54852 - DNA, 25 bp, Homo sapien
aagaagcttggtgtataccttgcag

SEQ ID NO: 54853 - DNA, 25 bp, Homo sapien
agaagcttggtgtataccttgcagg

SEQ ID NO: 54854 - DNA, 25 bp, Homo sapien
gaagcttggtgtataccttgcaggc

SEQ ID NO: 54855 - DNA, 25 bp, Homo sapien
aagcttggtgtataccttgcaggca

SEQ ID NO: 54856 - DNA, 25 bp, Homo sapien
agcttggtgtataccttgcaggcac

SEQ ID NO: 54857 - DNA, 25 bp, Homo sapien
gcttggtgtataccttgcaggcact

SEQ ID NO: 54858 - DNA, 25 bp, Homo sapien
cttggtgtataccttgcaggcacta

SEQ ID NO: 54859 - DNA, 25 bp, Homo sapien
gtgtataccttgcaggcactagtcc

SEQ ID NO: 54860 - DNA, 25 bp, Homo sapien
aatcagggaaggtggtcataatatt

SEQ ID NO: 54861 - DNA, 25 bp, Homo sapien
attcgaaatggaccctgctgatgga

SEQ ID NO: 54862 - DNA, 25 bp, Homo sapien
aagaagatggagagaccaccttcac

SEQ ID NO: 54863 - DNA, 25 bp, Homo sapien
accaccttcactggcagactagata

SEQ ID NO: 54864 - DNA, 25 bp, Homo sapien
gactagataaattgcatttcccctt

SEQ ID NO: 54865 - DNA, 25 bp, Homo sapien
ttcctgtgtttctttacatgagatt

SEQ ID NO: 54866 - DNA, 25 bp, Homo sapien
gagcaggtatggaagacagccatgt

SEQ ID NO: 54867 - DNA, 25 bp, Homo sapien
gacagccatgtgtagtgatggataa

SEQ ID NO: 54868 - DNA, 25 bp, Homo sapien
agaatccttgtttcttggcttttgc

SEQ ID NO: 54869 - DNA, 25 bp, Homo sapien
tcttggcttttgctcctggagttaa

SEQ ID NO: 54870 - DNA, 25 bp, Homo sapien
ggagttaagcttactgcccaggtga

SEQ ID NO: 54871 - DNA, 25 bp, Homo sapien
aaccagaactggaggagcagccaga

SEQ ID NO: 54872 - DNA, 25 bp, Homo sapien
aaagaggttctctgcatgtttggaa

SEQ ID NO: 54873 - DNA, 25 bp, Homo sapien
tctctgcatgtttggaagtcggaat

SEQ ID NO: 54874 - DNA, 25 bp, Homo sapien
gtgtatctgaggcacagctcttccc

SEQ ID NO: 54875 - DNA, 25 bp, Homo sapien
tcttccctgacttataggctttgac

SEQ ID NO: 54876 - DNA, 25 bp, Homo sapien
ggctttgacactgctgttgaggttt

SEQ ID NO: 54877 - DNA, 25 bp, Homo sapien
gttgaggtttgactcgaagcccaga

SEQ ID NO: 54878 - DNA, 25 bp, Homo sapien
cgaagcccagagttttggtgtggat

SEQ ID NO: 54879 - DNA, 25 bp, Homo sapien
tgagcagggacaaattgctgagcat

SEQ ID NO: 54880 - DNA, 25 bp, Homo sapien
aagtggaacatatgccctttgcctc

SEQ ID NO: 54881 - DNA, 25 bp, Homo sapien
atcctctgccacaccacagtggaga

SEQ ID NO: 54882 - DNA, 25 bp, Homo sapien
ttcagcagtgtgaagaagcttggtg

SEQ ID NO: 54883 - DNA, 25 bp, Homo sapien
tcagcagtgtgaagaagcttggtgt

SEQ ID NO: 54884 - DNA, 25 bp, Homo sapien
aagaagcttggtgtataccttgcag

SEQ ID NO: 54885 - DNA, 25 bp, Homo sapien
agaagcttggtgtataccttgcagg

SEQ ID NO: 54886 - DNA, 25 bp, Homo sapien
gaagcttggtgtataccttgcaggc

SEQ ID NO: 54887 - DNA, 25 bp, Homo sapien
aagcttggtgtataccttgcaggca

SEQ ID NO: 54888 - DNA, 25 bp, Homo sapien
agcttggtgtataccttgcaggcac

SEQ ID NO: 54889 - DNA, 25 bp, Homo sapien
gcttggtgtataccttgcaggcact

SEQ ID NO: 54890 - DNA, 25 bp, Homo sapien
cttggtgtataccttgcaggcacta

SEQ ID NO: 54891 - DNA, 25 bp, Homo sapien
agaccacacttgtgcgggagctaat

SEQ ID NO: 54892 - DNA, 25 bp, Homo sapien
acacttgtgcgggagctaattgatg

SEQ ID NO: 54893 - DNA, 25 bp, Homo sapien
gtgcgggagctaattgatggaaaac

SEQ ID NO: 54894 - DNA, 25 bp, Homo sapien
tcacccacggcactgcagtttgcac

SEQ ID NO: 54895 - DNA, 25 bp, Homo sapien
gactgcactgttgctgactactact

SEQ ID NO: 54896 - DNA, 25 bp, Homo sapien
tgcactgttgctgactactactctg

SEQ ID NO: 54897 - DNA, 25 bp, Homo sapien
gtacaaatccacgaattcttctggg

SEQ ID NO: 54898 - DNA, 25 bp, Homo sapien
aattcttctggggtcaggtgccact

SEQ ID NO: 54899 - DNA, 25 bp, Homo sapien
actgaccgggatccagttccagttc

SEQ ID NO: 54900 - DNA, 25 bp, Homo sapien
agttccagttcccatggtgtatgtg

SEQ ID NO: 54901 - DNA, 25 bp, Homo sapien
gttcccatggtgtatgtggtttttt

SEQ ID NO: 54902 - DNA, 25 bp, Homo sapien
catcttttgataattgtgctttaca

SEQ ID NO: 54903 - DNA, 25 bp, Homo sapien
gtgctttacaacttgaatgctgatt

SEQ ID NO: 54904 - DNA, 25 bp, Homo sapien
acagcatttctttggaaaccacctt

SEQ ID NO: 54905 - DNA, 25 bp, Homo sapien
gaaaccaccttaaaacattagtgct

SEQ ID NO: 54906 - DNA, 25 bp, Homo sapien
gtgctatggttatgagtgtatgtgc

SEQ ID NO: 54907 - DNA, 25 bp, Homo sapien
gtgtatgtgccagtacttaccagtc

SEQ ID NO: 54908 - DNA, 25 bp, Homo sapien
gccagtacttaccagtcaatgcatt

SEQ ID NO: 54909 - DNA, 25 bp, Homo sapien
caatgcattgtggatatgagctttc

SEQ ID NO: 54910 - DNA, 25 bp, Homo sapien
atgagctttcgttgactgcttctct

SEQ ID NO: 54911 - DNA, 25 bp, Homo sapien
gcttctctgcagtcgttgatgctaa

SEQ ID NO: 54912 - DNA, 25 bp, Homo sapien
aatattgtcctgtttcttcatataa

SEQ ID NO: 54913 - DNA, 25 bp, Homo sapien
aaagccagagtggacccttccagac

SEQ ID NO: 54914 - DNA, 25 bp, Homo sapien
atatctctactatggcacttcgtca

SEQ ID NO: 54915 - DNA, 25 bp, Homo sapien
atggcacttcgtcaggatcctatca

SEQ ID NO: 54916 - DNA, 25 bp, Homo sapien
aggatcctatcagtttcccatggtg

SEQ ID NO: 54917 - DNA, 25 bp, Homo sapien
agaccggtctccttccagaatgctt

SEQ ID NO: 54918 - DNA, 25 bp, Homo sapien
cacctcgaatggcagcacgctatta

SEQ ID NO: 54919 - DNA, 25 bp, Homo sapien
ggcagcacgctattaaatccaaatt

SEQ ID NO: 54920 - DNA, 25 bp, Homo sapien
aatgatggtgttgacgctgatggaa

SEQ ID NO: 54921 - DNA, 25 bp, Homo sapien
gatggaagccacagcagttccccaa

SEQ ID NO: 54922 - DNA, 25 bp, Homo sapien
gttccccaactgttttgaattctag

SEQ ID NO: 54923 - DNA, 25 bp, Homo sapien
ggatgaatctgtttggcgaccatat

SEQ ID NO: 54924 - DNA, 25 bp, Homo sapien
caaaatccttgccttcaaacgaaat

SEQ ID NO: 54925 - DNA, 25 bp, Homo sapien
aaatccttgccttcaaacgaaatgg

SEQ ID NO: 54926 - DNA, 25 bp, Homo sapien
ttgccttcaaacgaaatggctcggc

SEQ ID NO: 54927 - DNA, 25 bp, Homo sapien
cttcaaacgaaatggctcggccagg

SEQ ID NO: 54928 - DNA, 25 bp, Homo sapien
aaacgaaatggctcggccaggcacg

SEQ ID NO: 54929 - DNA, 25 bp, Homo sapien
aaaaattatctgatccttgtggcac

SEQ ID NO: 54930 - DNA, 25 bp, Homo sapien
aattatctgatccttgtggcacaca

SEQ ID NO: 54931 - DNA, 25 bp, Homo sapien
ttatctgatccttgtggcacacaac

SEQ ID NO: 54932 - DNA, 25 bp, Homo sapien
gatccttgtggcacacaactgtggt

SEQ ID NO: 54933 - DNA, 25 bp, Homo sapien
cttgtggcacacaactgtggtccca

SEQ ID NO: 54934 - DNA, 25 bp, Homo sapien
agccaagttcacaccactgccattt

SEQ ID NO: 54935 - DNA, 25 bp, Homo sapien
atttgtagtaaaccaggcctcccag

SEQ ID NO: 54936 - DNA, 25 bp, Homo sapien
tggcgagctccagtaagatgataat

SEQ ID NO: 54937 - DNA, 25 bp, Homo sapien
cagcttgttggttgtcactctacaa

SEQ ID NO: 54938 - DNA, 25 bp, Homo sapien
gtcagaagtttggataaccttcctt

SEQ ID NO: 54939 - DNA, 25 bp, Homo sapien
gttagacctgggaccacggctggat

SEQ ID NO: 54940 - DNA, 25 bp, Homo sapien
tgggaccacggctggatactctgag

SEQ ID NO: 54941 - DNA, 25 bp, Homo sapien
actctgaggctgtatgtttgatcac

SEQ ID NO: 54942 - DNA, 25 bp, Homo sapien
gtttgatcacacagccacttagcag

SEQ ID NO: 54943 - DNA, 25 bp, Homo sapien
gcaggaagtactcataaggttcttt

SEQ ID NO: 54944 - DNA, 25 bp, Homo sapien
aggttctttagctgtcacttaggga

SEQ ID NO: 54945 - DNA, 25 bp, Homo sapien
gggataacactgtctacctcacaga

SEQ ID NO: 54946 - DNA, 25 bp, Homo sapien
cacaatgcgcgttgactacgagcag

SEQ ID NO: 54947 - DNA, 25 bp, Homo sapien
atgcgcgttgactacgagcagatca

SEQ ID NO: 54948 - DNA, 25 bp, Homo sapien
gcgttgactacgagcagatcaagat

SEQ ID NO: 54949 - DNA, 25 bp, Homo sapien
tctgctgctgaagaggcggaagaaa

SEQ ID NO: 54950 - DNA, 25 bp, Homo sapien
aggctgcggctctggcccactgagc

SEQ ID NO: 54951 - DNA, 25 bp, Homo sapien
tcctgcccacgggaggacaagcaat

SEQ ID NO: 54952 - DNA, 25 bp, Homo sapien
ggacaagcaataactctctacagga

SEQ ID NO: 54953 - DNA, 25 bp, Homo sapien
aagcaataactctctacaggaatat

SEQ ID NO: 54954 - DNA, 25 bp, Homo sapien
taactctctacaggaatatattttt

SEQ ID NO: 54955 - DNA, 25 bp, Homo sapien
ttttaaacgaagagacagaactgtc

SEQ ID NO: 54956 - DNA, 25 bp, Homo sapien
agacagaactgtccacatctgcctc

SEQ ID NO: 54957 - DNA, 25 bp, Homo sapien
ggtttacattagttacttcatgctg

SEQ ID NO: 54958 - DNA, 25 bp, Homo sapien
acattagttacttcatgctggctgg

SEQ ID NO: 54959 - DNA, 25 bp, Homo sapien
gggttagtgaccatttgcatactct

SEQ ID NO: 54960 - DNA, 25 bp, Homo sapien
ggttagtgaccatttgcatactctt

SEQ ID NO: 54961 - DNA, 25 bp, Homo sapien
actcttttaaatcaaggaggctgta

SEQ ID NO: 54962 - DNA, 25 bp, Homo sapien
tttaaatcaaggaggctgtagtaga

SEQ ID NO: 54963 - DNA, 25 bp, Homo sapien
gaaaaacagtgaatacttctaattg

SEQ ID NO: 54964 - DNA, 25 bp, Homo sapien
gtttccttttagtgccagaactaag

SEQ ID NO: 54965 - DNA, 25 bp, Homo sapien
gacattgtgaagcacttgttagtaa

SEQ ID NO: 54966 - DNA, 25 bp, Homo sapien
gtgaagcacttgttagtaaacttaa

SEQ ID NO: 54967 - DNA, 25 bp, Homo sapien
atgtcagactggaaggagtttttat

SEQ ID NO: 54968 - DNA, 25 bp, Homo sapien
taaattttaagtgttgtgggtacat

SEQ ID NO: 54969 - DNA, 25 bp, Homo sapien
tagtaggtgtatatgcatttttctt

SEQ ID NO: 54970 - DNA, 25 bp, Homo sapien
tttcttttaatagtacatctagtgg

SEQ ID NO: 54971 - DNA, 25 bp, Homo sapien
atagtacatctagtggttctttcca

SEQ ID NO: 54972 - DNA, 25 bp, Homo sapien
agtacatctagtggttctttccaaa

SEQ ID NO: 54973 - DNA, 25 bp, Homo sapien
gtacatctagtggttctttccaaaa

SEQ ID NO: 54974 - DNA, 25 bp, Homo sapien
acatctagtggttctttccaaaata

SEQ ID NO: 54975 - DNA, 25 bp, Homo sapien
tagtggttctttccaaaatagtaca

SEQ ID NO: 54976 - DNA, 25 bp, Homo sapien
gtacaaaaaagtgttctcatacaaa

SEQ ID NO: 54977 - DNA, 25 bp, Homo sapien
ttggagtgagccaggactgtgacac

SEQ ID NO: 54978 - DNA, 25 bp, Homo sapien
caacagagtggactccatcgcaaaa

SEQ ID NO: 54979 - DNA, 25 bp, Homo sapien
aggccccagagactctatgtctgcc

SEQ ID NO: 54980 - DNA, 25 bp, Homo sapien
agagactctatgtctgcccgtccat

SEQ ID NO: 54981 - DNA, 25 bp, Homo sapien
tggcctggtgtctccaaatgaccat

SEQ ID NO: 54982 - DNA, 25 bp, Homo sapien
atgaccatgaaaatacacacgtata

SEQ ID NO: 54983 - DNA, 25 bp, Homo sapien
atacacacgtataatggagatcatt

SEQ ID NO: 54984 - DNA, 25 bp, Homo sapien
ggagatcattctctgtgggtatgca

SEQ ID NO: 54985 - DNA, 25 bp, Homo sapien
ttctctgtgggtatgcaaagttatg

SEQ ID NO: 54986 - DNA, 25 bp, Homo sapien
ggaattcctttataggtaactgcca

SEQ ID NO: 54987 - DNA, 25 bp, Homo sapien
ttataggtaactgccatttaggact

SEQ ID NO: 54988 - DNA, 25 bp, Homo sapien
gccatttaggactgatggccctaat

SEQ ID NO: 54989 - DNA, 25 bp, Homo sapien
ggccctaatttttgaggtgctgatt

SEQ ID NO: 54990 - DNA, 25 bp, Homo sapien
gtccgagttcatggtgcgccgctgt

SEQ ID NO: 54991 - DNA, 25 bp, Homo sapien
cgagttcatggtgcgccgctgtgct

SEQ ID NO: 54992 - DNA, 25 bp, Homo sapien
atggtgcgccgctgtgctgggagct

SEQ ID NO: 54993 - DNA, 25 bp, Homo sapien
aatgtgtgggacaccttgaccaaag

SEQ ID NO: 54994 - DNA, 25 bp, Homo sapien
atgtgtgggacaccttgaccaaagg

SEQ ID NO: 54995 - DNA, 25 bp, Homo sapien
agctttgtctcgtgtgttttgaaaa

SEQ ID NO: 54996 - DNA, 25 bp, Homo sapien
gctttgtctcgtgtgttttgaaaaa

SEQ ID NO: 54997 - DNA, 25 bp, Homo sapien
gtctcgtgtgttttgaaaaaggctt

SEQ ID NO: 54998 - DNA, 25 bp, Homo sapien
aatgttgttcattcttagtagtata

SEQ ID NO: 54999 - DNA, 25 bp, Homo sapien
ttcttagtagtatagtttgcaattc

SEQ ID NO: 55000 - DNA, 25 bp, Homo sapien
atagtttgcaattcttaatggcaaa

SEQ ID NO: 55001 - DNA, 25 bp, Homo sapien
gcatcatctcaacactaacttgata

SEQ ID NO: 55002 - DNA, 25 bp, Homo sapien
acttgataattaagtgcttcccact

SEQ ID NO: 55003 - DNA, 25 bp, Homo sapien
gataattaagtgcttcccacttaaa

SEQ ID NO: 55004 - DNA, 25 bp, Homo sapien
tcccacttaaaacatatcaggcctt

SEQ ID NO: 55005 - DNA, 25 bp, Homo sapien
cacttaaaacatatcaggccttcta

SEQ ID NO: 55006 - DNA, 25 bp, Homo sapien
aacatatcaggccttctatttattt

SEQ ID NO: 55007 - DNA, 25 bp, Homo sapien
gttgaatgtatggttgctacctatt

SEQ ID NO: 55008 - DNA, 25 bp, Homo sapien
gtatggttgctacctattgtaacta

SEQ ID NO: 55009 - DNA, 25 bp, Homo sapien
aatatggatcttttatgattctttt

SEQ ID NO: 55010 - DNA, 25 bp, Homo sapien
atgattctttttgtaagccctaggg

SEQ ID NO: 55011 - DNA, 25 bp, Homo sapien
atctatgtagattggttagtaaaac

SEQ ID NO: 55012 - DNA, 25 bp, Homo sapien
tgtggacaactcgaataagtttgac

SEQ ID NO: 55013 - DNA, 25 bp, Homo sapien
tggacaactcgaataagtttgactt

SEQ ID NO: 55014 - DNA, 25 bp, Homo sapien
gacaactcgaataagtttgacttgt

SEQ ID NO: 55015 - DNA, 25 bp, Homo sapien
caactcgaataagtttgacttgtgt

SEQ ID NO: 55016 - DNA, 25 bp, Homo sapien
actcgaataagtttgacttgtgttt

SEQ ID NO: 55017 - DNA, 25 bp, Homo sapien
taaccaccagatcattccttctgta

SEQ ID NO: 55018 - DNA, 25 bp, Homo sapien
aaccaccagatcattccttctgtag

SEQ ID NO: 55019 - DNA, 25 bp, Homo sapien
accaccagatcattccttctgtagc

SEQ ID NO: 55020 - DNA, 25 bp, Homo sapien
ccaccagatcattccttctgtagct

SEQ ID NO: 55021 - DNA, 25 bp, Homo sapien
caccagatcattccttctgtagctc

SEQ ID NO: 55022 - DNA, 25 bp, Homo sapien
accagatcattccttctgtagctca

SEQ ID NO: 55023 - DNA, 25 bp, Homo sapien
aaagactttatgtacagtgcccagt

SEQ ID NO: 55024 - DNA, 25 bp, Homo sapien
gactttatgtacagtgcccagtttt

SEQ ID NO: 55025 - DNA, 25 bp, Homo sapien
tctatggtagatttttgaggtgtct

SEQ ID NO: 55026 - DNA, 25 bp, Homo sapien
aggtgtctactgtaaagtattgctt

SEQ ID NO: 55027 - DNA, 25 bp, Homo sapien
aatatatatggtatgtatcctcaag

SEQ ID NO: 55028 - DNA, 25 bp, Homo sapien
tatggtatgtatcctcaagacctaa

SEQ ID NO: 55029 - DNA, 25 bp, Homo sapien
gtatgtatcctcaagacctaaaatg

SEQ ID NO: 55030 - DNA, 25 bp, Homo sapien
gacctaaaatgtcagactggtttat

SEQ ID NO: 55031 - DNA, 25 bp, Homo sapien
aatgtcagactggtttattgttaag

SEQ ID NO: 55032 - DNA, 25 bp, Homo sapien
agactggtttattgttaagttgcaa

SEQ ID NO: 55033 - DNA, 25 bp, Homo sapien
taagttgcaattactgcaatgacag

SEQ ID NO: 55034 - DNA, 25 bp, Homo sapien
attgcatgttgcttattaggataat

SEQ ID NO: 55035 - DNA, 25 bp, Homo sapien
aatgcaatatatgtcttgtctttat

SEQ ID NO: 55036 - DNA, 25 bp, Homo sapien
tatatgtcttgtctttattatggca

SEQ ID NO: 55037 - DNA, 25 bp, Homo sapien
ctttattatggcatctatttaggag

SEQ ID NO: 55038 - DNA, 25 bp, Homo sapien
ggagttgttcaaatcactgcagtag

SEQ ID NO: 55039 - DNA, 25 bp, Homo sapien
atcactgcagtagggctctgcaaat

SEQ ID NO: 55040 - DNA, 25 bp, Homo sapien
catggatctaatgtactgtaacttt

SEQ ID NO: 55041 - DNA, 25 bp, Homo sapien
ttccaatagatttcattcttgtcat

SEQ ID NO: 55042 - DNA, 25 bp, Homo sapien
tcattttgtaagacgaccctgcagt

SEQ ID NO: 55043 - DNA, 25 bp, Homo sapien
tttgtaagacgaccctgcagtccac

SEQ ID NO: 55044 - DNA, 25 bp, Homo sapien
cctgcagtccacctgtttgtaactt

SEQ ID NO: 55045 - DNA, 25 bp, Homo sapien
ggtgtcctgttcctgccacatggag

SEQ ID NO: 55046 - DNA, 25 bp, Homo sapien
atggagcttgacttcatgccagcta

SEQ ID NO: 55047 - DNA, 25 bp, Homo sapien
ttcatgccagctataatctcccctg

SEQ ID NO: 55048 - DNA, 25 bp, Homo sapien
tgctcactcttccacagatataaag

SEQ ID NO: 55049 - DNA, 25 bp, Homo sapien
agaacaaacacttagcatcccacac

SEQ ID NO: 55050 - DNA, 25 bp, Homo sapien
actcaccccttctaatcctgaaggg

SEQ ID NO: 55051 - DNA, 25 bp, Homo sapien
gaagggaagcccattctaaactcct

SEQ ID NO: 55052 - DNA, 25 bp, Homo sapien
caaacccatttccagctcctagtag

SEQ ID NO: 55053 - DNA, 25 bp, Homo sapien
tagtagctttcctcccaaaggcttt

SEQ ID NO: 55054 - DNA, 25 bp, Homo sapien
ggctttctttccaatcctttatagc

SEQ ID NO: 55055 - DNA, 25 bp, Homo sapien
ggaaggaaactgttgtgtccaatcc

SEQ ID NO: 55056 - DNA, 25 bp, Homo sapien
gcagacttcacctctgtaagttgag

SEQ ID NO: 55057 - DNA, 25 bp, Homo sapien
ttcacctctgtaagttgagtcctcc

SEQ ID NO: 55058 - DNA, 25 bp, Homo sapien
acctctgtaagttgagtcctccgcc

SEQ ID NO: 55059 - DNA, 25 bp, Homo sapien
tgtaagttgagtcctccgcctccgg

SEQ ID NO: 55060 - DNA, 25 bp, Homo sapien
ttccgcttgcagcttccctgggatt

SEQ ID NO: 55061 - DNA, 25 bp, Homo sapien
ccgcttgcagcttccctgggatttt

SEQ ID NO: 55062 - DNA, 25 bp, Homo sapien
tcccagcttctttagcctcttggta

SEQ ID NO: 55063 - DNA, 25 bp, Homo sapien
gcttctttagcctcttggtacctca

SEQ ID NO: 55064 - DNA, 25 bp, Homo sapien
actctctgtccctcgcgttatttat

SEQ ID NO: 55065 - DNA, 25 bp, Homo sapien
tgtccctcgcgttatttattctaca

SEQ ID NO: 55066 - DNA, 25 bp, Homo sapien
ccctcgcgttatttattctacactg

SEQ ID NO: 55067 - DNA, 25 bp, Homo sapien
ccccagaggtgtggcaggtgctgaa

SEQ ID NO: 55068 - DNA, 25 bp, Homo sapien
gcttccagtgcagtctctggcatct

SEQ ID NO: 55069 - DNA, 25 bp, Homo sapien
tctggcatctctatcccctatgagg

SEQ ID NO: 55070 - DNA, 25 bp, Homo sapien
tggcatctctatcccctatgaggca

SEQ ID NO: 55071 - DNA, 25 bp, Homo sapien
tatcccctatgaggcaccacgtaag

SEQ ID NO: 55072 - DNA, 25 bp, Homo sapien
atgaggcaccacgtaagacctcctg

SEQ ID NO: 55073 - DNA, 25 bp, Homo sapien
agctctcttgctcaccacccaagaa

SEQ ID NO: 55074 - DNA, 25 bp, Homo sapien
caagaacctcaggacagaagcgaga

SEQ ID NO: 55075 - DNA, 25 bp, Homo sapien
ctcaggacagaagcgagagcccatt

SEQ ID NO: 55076 - DNA, 25 bp, Homo sapien
ggacagaagcgagagcccattgctc

SEQ ID NO: 55077 - DNA, 25 bp, Homo sapien
acagaagcgagagcccattgctcct

SEQ ID NO: 55078 - DNA, 25 bp, Homo sapien
gcaggagagcctgcgaacgcaaaag

SEQ ID NO: 55079 - DNA, 25 bp, Homo sapien
tgttttgacttcgtacagggtactt

SEQ ID NO: 55080 - DNA, 25 bp, Homo sapien
tgggctgacggcatgacctctgtaa

SEQ ID NO: 55081 - DNA, 25 bp, Homo sapien
tgacctctgtaagggactcctgcta

SEQ ID NO: 55082 - DNA, 25 bp, Homo sapien
gtcccctcttggcatgaatgactga

SEQ ID NO: 55083 - DNA, 25 bp, Homo sapien
tgactgactgtagacgcatgacctc

SEQ ID NO: 55084 - DNA, 25 bp, Homo sapien
gactgtagacgcatgacctccaggc

SEQ ID NO: 55085 - DNA, 25 bp, Homo sapien
aggcttcaatcctgcctcttgcaat

SEQ ID NO: 55086 - DNA, 25 bp, Homo sapien
tgcctcttgcaatgacagctgatct

SEQ ID NO: 55087 - DNA, 25 bp, Homo sapien
acagctgatctgtcggaaccaggac

SEQ ID NO: 55088 - DNA, 25 bp, Homo sapien
gaaccaggacacaaaagcagcaaga

SEQ ID NO: 55089 - DNA, 25 bp, Homo sapien
ggaggaccagcgtttctgcgcaagt

SEQ ID NO: 55090 - DNA, 25 bp, Homo sapien
ctgcgcaagttgtttcatctaggta

SEQ ID NO: 55091 - DNA, 25 bp, Homo sapien
taaggatggctcagcacttgctcat

SEQ ID NO: 55092 - DNA, 25 bp, Homo sapien
tcagcacttgctcatcttggatggc

SEQ ID NO: 55093 - DNA, 25 bp, Homo sapien
catcttggatggcttctgggccaaa

SEQ ID NO: 55094 - DNA, 25 bp, Homo sapien
tgggccaaaactgcagtcactgaat

SEQ ID NO: 55095 - DNA, 25 bp, Homo sapien
ggacttggaacctatccttgtaaag

SEQ ID NO: 55096 - DNA, 25 bp, Homo sapien
taatggtgaccaaatgcctcccttt

SEQ ID NO: 55097 - DNA, 25 bp, Homo sapien
ctcccttttcagtacctttgaacag

SEQ ID NO: 55098 - DNA, 25 bp, Homo sapien
gaacagcaaccatgtgggctactca

SEQ ID NO: 55099 - DNA, 25 bp, Homo sapien
gggctactcatgatgggcttgattc

SEQ ID NO: 55100 - DNA, 25 bp, Homo sapien
tgaggagccccagctcaccaagagg

SEQ ID NO: 55101 - DNA, 25 bp, Homo sapien
tcaccaagaggacccacaacgtgtg

SEQ ID NO: 55102 - DNA, 25 bp, Homo sapien
acaacgtgtgcaccctgacattggc

SEQ ID NO: 55103 - DNA, 25 bp, Homo sapien
gtgcaccctgacattggcatctctg

SEQ ID NO: 55104 - DNA, 25 bp, Homo sapien
catgagcatcatgaactcgtttgta

SEQ ID NO: 55105 - DNA, 25 bp, Homo sapien
tgaactcgtttgtaaacgacgtgtt

SEQ ID NO: 55106 - DNA, 25 bp, Homo sapien
aaacgacgtgtttgagcagctggcg

SEQ ID NO: 55107 - DNA, 25 bp, Homo sapien
ggaccaccctgacatcccgagaagt

SEQ ID NO: 55108 - DNA, 25 bp, Homo sapien
atcccgagaagtccagacggctgtg

SEQ ID NO: 55109 - DNA, 25 bp, Homo sapien
cagctccaagtgacccagggcctga

SEQ ID NO: 55110 - DNA, 25 bp, Homo sapien
tccaagtgacccagggcctgacaaa

SEQ ID NO: 55111 - DNA, 25 bp, Homo sapien
gtgtcttcagctggcagcatttatt

SEQ ID NO: 55112 - DNA, 25 bp, Homo sapien
tttattttaaatccttagcactgag

SEQ ID NO: 55113 - DNA, 25 bp, Homo sapien
aatccttagcactgagtttgaatgg

SEQ ID NO: 55114 - DNA, 25 bp, Homo sapien
gtataacttccatagatgagctgtt

SEQ ID NO: 55115 - DNA, 25 bp, Homo sapien
atgagctgttgttaggaaggcacca

SEQ ID NO: 55116 - DNA, 25 bp, Homo sapien
ggaaggcaccaaagaacctcctctg

SEQ ID NO: 55117 - DNA, 25 bp, Homo sapien
agaacctcctctgcactaaacagga

SEQ ID NO: 55118 - DNA, 25 bp, Homo sapien
gaaaagtctccattgagtacatatc

SEQ ID NO: 55119 - DNA, 25 bp, Homo sapien
gtctccattgagtacatatcatgtc

SEQ ID NO: 55120 - DNA, 25 bp, Homo sapien
acatatcatgtcagtttagtaatca

SEQ ID NO: 55121 - DNA, 25 bp, Homo sapien
atgttgatattgttaaactggttca

SEQ ID NO: 55122 - DNA, 25 bp, Homo sapien
aacaaatgctactgttcttgtcccc

SEQ ID NO: 55123 - DNA, 25 bp, Homo sapien
gttcttgtccccttttttagatatg

SEQ ID NO: 55124 - DNA, 25 bp, Homo sapien
ttgtccccttttttagatatgtcaa

SEQ ID NO: 55125 - DNA, 25 bp, Homo sapien
attttttgggatgatgccatctcat

SEQ ID NO: 55126 - DNA, 25 bp, Homo sapien
atgccatctcattcatcatgtgact

SEQ ID NO: 55127 - DNA, 25 bp, Homo sapien
attcatcatgtgactgtgcccattc

SEQ ID NO: 55128 - DNA, 25 bp, Homo sapien
tgactgtgcccattcctgcatggac

SEQ ID NO: 55129 - DNA, 25 bp, Homo sapien
tgcatggacctttcccaagcgctag

SEQ ID NO: 55130 - DNA, 25 bp, Homo sapien
agacagactctggacagctgcacgg

SEQ ID NO: 55131 - DNA, 25 bp, Homo sapien
tctggacagctgcacggcttgtgaa

SEQ ID NO: 55132 - DNA, 25 bp, Homo sapien
cagctgcacggcttgtgaagtgagc

SEQ ID NO: 55133 - DNA, 25 bp, Homo sapien
gagactgtgaacatcaccatcactc

SEQ ID NO: 55134 - DNA, 25 bp, Homo sapien
tcaccatcactcaaggtttggcagt

SEQ ID NO: 55135 - DNA, 25 bp, Homo sapien
ggtttggcagtgtcaaccatctcat

SEQ ID NO: 55136 - DNA, 25 bp, Homo sapien
gcagtgtcaaccatctcatcattct

SEQ ID NO: 55137 - DNA, 25 bp, Homo sapien
tgggtaccaagtctctttctgcttg

SEQ ID NO: 55138 - DNA, 25 bp, Homo sapien
tgcttggtgatggtactcctttttg

SEQ ID NO: 55139 - DNA, 25 bp, Homo sapien
ggtactcctttttgcagtggacaca

SEQ ID NO: 55140 - DNA, 25 bp, Homo sapien
tttgcagtggacacaggactatatt

SEQ ID NO: 55141 - DNA, 25 bp, Homo sapien
ggactatatttctctgtgaagacaa

SEQ ID NO: 55142 - DNA, 25 bp, Homo sapien
ctcaacaagagactggaaggaccat

SEQ ID NO: 55143 - DNA, 25 bp, Homo sapien
gaaaggaccctcaagacaaatgacc

SEQ ID NO: 55144 - DNA, 25 bp, Homo sapien
aaaagaggcaatttctaccagaaca

SEQ ID NO: 55145 - DNA, 25 bp, Homo sapien
ttctaccagaacactgtgggtgatc

SEQ ID NO: 55146 - DNA, 25 bp, Homo sapien
aacactgtgggtgatctgctaaagt

SEQ ID NO: 55147 - DNA, 25 bp, Homo sapien
ggtgatctgctaaagttcatccgga

SEQ ID NO: 55148 - DNA, 25 bp, Homo sapien
gatctgctaaagttcatccggaatt

SEQ ID NO: 55149 - DNA, 25 bp, Homo sapien
gctaaagttcatccggaatttggga

SEQ ID NO: 55150 - DNA, 25 bp, Homo sapien
gaagacatttccagatctggtgatc

SEQ ID NO: 55151 - DNA, 25 bp, Homo sapien
tccagatctggtgatctatgtctac

SEQ ID NO: 55152 - DNA, 25 bp, Homo sapien
ctatgtctacacaaaactacagaac

SEQ ID NO: 55153 - DNA, 25 bp, Homo sapien
ccacagtccaaacaaacctcagtgt

SEQ ID NO: 55154 - DNA, 25 bp, Homo sapien
gtccaaacaaacctcagtgtgatgg

SEQ ID NO: 55155 - DNA, 25 bp, Homo sapien
ctatgatgactacaggatggactgg

SEQ ID NO: 55156 - DNA, 25 bp, Homo sapien
atggactggcttgtgcctgccacct

SEQ ID NO: 55157 - DNA, 25 bp, Homo sapien
tgccacctgtgaacccatccagagt

SEQ ID NO: 55158 - DNA, 25 bp, Homo sapien
aacccatccagagtgtcttcttctt

SEQ ID NO: 55159 - DNA, 25 bp, Homo sapien
agagtgtcttcttcttctctggaga

SEQ ID NO: 55160 - DNA, 25 bp, Homo sapien
gtcttcttcttctctggagacaagt

SEQ ID NO: 55161 - DNA, 25 bp, Homo sapien
agacaagtactaccgagtcaatctt

SEQ ID NO: 55162 - DNA, 25 bp, Homo sapien
acacggcgagtggacactgtggacc

SEQ ID NO: 55163 - DNA, 25 bp, Homo sapien
gagtggacactgtggaccctcccta

SEQ ID NO: 55164 - DNA, 25 bp, Homo sapien
agctcctggccatctgtaggagtca

SEQ ID NO: 55165 - DNA, 25 bp, Homo sapien
tgtaggagtcagagcccacatggcc

SEQ ID NO: 55166 - DNA, 25 bp, Homo sapien
gaatgtatttatttgggagaccggg

SEQ ID NO: 55167 - DNA, 25 bp, Homo sapien
gggacccaatgtaggagctgccttg

SEQ ID NO: 55168 - DNA, 25 bp, Homo sapien
aatgtaggagctgccttggctcaga

SEQ ID NO: 55169 - DNA, 25 bp, Homo sapien
agctgccttggctcagacatgtttt

SEQ ID NO: 55170 - DNA, 25 bp, Homo sapien
ccttggctcagacatgttttccgtg

SEQ ID NO: 55171 - DNA, 25 bp, Homo sapien
tggcctctgtgccttcttttgatta

SEQ ID NO: 55172 - DNA, 25 bp, Homo sapien
ctctgtgccttcttttgattatgtt

SEQ ID NO: 55173 - DNA, 25 bp, Homo sapien
gattaagttgtctaaacaatgctga

SEQ ID NO: 55174 - DNA, 25 bp, Homo sapien
aacaatgctgatttggtgaccaact

SEQ ID NO: 55175 - DNA, 25 bp, Homo sapien
gatttggtgaccaactgtcactcat

SEQ ID NO: 55176 - DNA, 25 bp, Homo sapien
gtgaccaactgtcactcattgctga

SEQ ID NO: 55177 - DNA, 25 bp, Homo sapien
aaatggccaggatcctctcctttga

SEQ ID NO: 55178 - DNA, 25 bp, Homo sapien
tctcctttgaaacctgctctgtagg

SEQ ID NO: 55179 - DNA, 25 bp, Homo sapien
aaacctgctctgtaggagctaccct

SEQ ID NO: 55180 - DNA, 25 bp, Homo sapien
taggagctacccttttcctttgtgg

SEQ ID NO: 55181 - DNA, 25 bp, Homo sapien
ttgtggttttatggagacctctcct

SEQ ID NO: 55182 - DNA, 25 bp, Homo sapien
gcactgtttaagtactgtttaccat

SEQ ID NO: 55183 - DNA, 25 bp, Homo sapien
ttaccatttttcattcacttctctt

SEQ ID NO: 55184 - DNA, 25 bp, Homo sapien
aacttgtgaatgcttctcacttttt

SEQ ID NO: 55185 - DNA, 25 bp, Homo sapien
gatgcaggcacttattgtaaatttt

SEQ ID NO: 55186 - DNA, 25 bp, Homo sapien
ttttagaaacccctctgtagccact

SEQ ID NO: 55187 - DNA, 25 bp, Homo sapien
cccctctgtagccactagtaagtaa

SEQ ID NO: 55188 - DNA, 25 bp, Homo sapien
tacattgtctgaatacaggatgcac

SEQ ID NO: 55189 - DNA, 25 bp, Homo sapien
gatgcacaatgttgtcaatcctgga

SEQ ID NO: 55190 - DNA, 25 bp, Homo sapien
tgttgtcaatcctggaaatggtctt

SEQ ID NO: 55191 - DNA, 25 bp, Homo sapien
gaatgaagtgttggtgtcctcacca

SEQ ID NO: 55192 - DNA, 25 bp, Homo sapien
gtcctcaccaagaggtggcacctaa

SEQ ID NO: 55193 - DNA, 25 bp, Homo sapien
tggcacctaagggttctgaggaaat

SEQ ID NO: 55194 - DNA, 25 bp, Homo sapien
tagacccttatgtacagacctgtgt

SEQ ID NO: 55195 - DNA, 25 bp, Homo sapien
acatataggatagcttttttgaact

SEQ ID NO: 55196 - DNA, 25 bp, Homo sapien
cttttttgaactatacagctgtaca

SEQ ID NO: 55197 - DNA, 25 bp, Homo sapien
agctgatattagttaggcctgtgtc

SEQ ID NO: 55198 - DNA, 25 bp, Homo sapien
aggcctgtgtcaacagtttggattt

SEQ ID NO: 55199 - DNA, 25 bp, Homo sapien
taatgccaagggtctagtgtgttct

SEQ ID NO: 55200 - DNA, 25 bp, Homo sapien
aagggtctagtgtgttcttagtggt

SEQ ID NO: 55201 - DNA, 25 bp, Homo sapien
ggtctagtgtgttcttagtggttat

SEQ ID NO: 55202 - DNA, 25 bp, Homo sapien
tagtgtgttcttagtggttatactg

SEQ ID NO: 55203 - DNA, 25 bp, Homo sapien
tgtgtggagatttaggtgctgctct

SEQ ID NO: 55204 - DNA, 25 bp, Homo sapien
tgggccatcttcatgtgctgcttga

SEQ ID NO: 55205 - DNA, 25 bp, Homo sapien
catgtgctgcttgaagagctcctat

SEQ ID NO: 55206 - DNA, 25 bp, Homo sapien
aaaagttctctgtagatttctgaag

SEQ ID NO: 55207 - DNA, 25 bp, Homo sapien
gttctctgtagatttctgaagtgca

SEQ ID NO: 55208 - DNA, 25 bp, Homo sapien
tctctgtagatttctgaagtgcata

SEQ ID NO: 55209 - DNA, 25 bp, Homo sapien
ctgtagatttctgaagtgcatattc

SEQ ID NO: 55210 - DNA, 25 bp, Homo sapien
ctggtagcagaggacacccccagcc

SEQ ID NO: 55211 - DNA, 25 bp, Homo sapien
cagccccccaagcattgaagacata

SEQ ID NO: 55212 - DNA, 25 bp, Homo sapien
agccccccaagcattgaagacatag

SEQ ID NO: 55213 - DNA, 25 bp, Homo sapien
gccccccaagcattgaagacatagt

SEQ ID NO: 55214 - DNA, 25 bp, Homo sapien
ccccccaagcattgaagacatagtg

SEQ ID NO: 55215 - DNA, 25 bp, Homo sapien
ccccaagcattgaagacatagtgta

SEQ ID NO: 55216 - DNA, 25 bp, Homo sapien
cccaagcattgaagacatagtgtat

SEQ ID NO: 55217 - DNA, 25 bp, Homo sapien
ccaagcattgaagacatagtgtatt

SEQ ID NO: 55218 - DNA, 25 bp, Homo sapien
caagcattgaagacatagtgtattt

SEQ ID NO: 55219 - DNA, 25 bp, Homo sapien
aagcattgaagacatagtgtatttc

SEQ ID NO: 55220 - DNA, 25 bp, Homo sapien
agcattgaagacatagtgtatttcc

SEQ ID NO: 55221 - DNA, 25 bp, Homo sapien
aataactcttttgaacaaacagaca

SEQ ID NO: 55222 - DNA, 25 bp, Homo sapien
gaacaaacagacaaattagctagta

SEQ ID NO: 55223 - DNA, 25 bp, Homo sapien
gtagtatggagatgtataccctcta

SEQ ID NO: 55224 - DNA, 25 bp, Homo sapien
tggagatgtataccctctattacac

SEQ ID NO: 55225 - DNA, 25 bp, Homo sapien
gtataccctctattacacacataaa

SEQ ID NO: 55226 - DNA, 25 bp, Homo sapien
accgtaacaaaattcattgtggtgt

SEQ ID NO: 55227 - DNA, 25 bp, Homo sapien
taatgttgaatcacattgtcagaat

SEQ ID NO: 55228 - DNA, 25 bp, Homo sapien
attttttcctcctcgctgttcaatt

SEQ ID NO: 55229 - DNA, 25 bp, Homo sapien
tcctcctcgctgttcaattttgtag

SEQ ID NO: 55230 - DNA, 25 bp, Homo sapien
tcctcgctgttcaattttgtagttt

SEQ ID NO: 55231 - DNA, 25 bp, Homo sapien
tcaattttgtagtttttactctcaa

SEQ ID NO: 55232 - DNA, 25 bp, Homo sapien
tatccaggaccagtattgcgagaag

SEQ ID NO: 55233 - DNA, 25 bp, Homo sapien
agagtgcagcactgacgtggctcat

SEQ ID NO: 55234 - DNA, 25 bp, Homo sapien
tctagccccagagaccaatttgatc

SEQ ID NO: 55235 - DNA, 25 bp, Homo sapien
tgatcccgcctcctatatcataggg

SEQ ID NO: 55236 - DNA, 25 bp, Homo sapien
ggaatttgtttgtcatgcaccttct

SEQ ID NO: 55237 - DNA, 25 bp, Homo sapien
gtcatgcaccttctgagtatttcaa

SEQ ID NO: 55238 - DNA, 25 bp, Homo sapien
gtatttcaagtcacggtcatcacca

SEQ ID NO: 55239 - DNA, 25 bp, Homo sapien
acagttcccaccagaccagagaagg

SEQ ID NO: 55240 - DNA, 25 bp, Homo sapien
atatggactcatgttgggcctactc

SEQ ID NO: 55241 - DNA, 25 bp, Homo sapien
tgttgggcctactcctgcaataaca

SEQ ID NO: 55242 - DNA, 25 bp, Homo sapien
ggaatcagttgccaaccatttgtag

SEQ ID NO: 55243 - DNA, 25 bp, Homo sapien
agcacccttcgttggaggagctgca

SEQ ID NO: 55244 - DNA, 25 bp, Homo sapien
agatgaggcccaccattaaagatca

SEQ ID NO: 55245 - DNA, 25 bp, Homo sapien
gatcactggttgaaacacccgggcc

SEQ ID NO: 55246 - DNA, 25 bp, Homo sapien
ggcccagctttgtgtgaccatcgag

SEQ ID NO: 55247 - DNA, 25 bp, Homo sapien
gaccatcgaggagtgctgggaccat

SEQ ID NO: 55248 - DNA, 25 bp, Homo sapien
ggaccatgatgcagaggctcgcttg

SEQ ID NO: 55249 - DNA, 25 bp, Homo sapien
gtccctgattcggaggtcggtcaac

SEQ ID NO: 55250 - DNA, 25 bp, Homo sapien
ttcggaggtcggtcaacggcactac

SEQ ID NO: 55251 - DNA, 25 bp, Homo sapien
ggcactacctcggactgtctcgttt

SEQ ID NO: 55252 - DNA, 25 bp, Homo sapien
tgacctctgtcaccaatgtggacct

SEQ ID NO: 55253 - DNA, 25 bp, Homo sapien
aagagtcaagcatctaagcccagga

SEQ ID NO: 55254 - DNA, 25 bp, Homo sapien
gctcccacattctgatgagcaaccg

SEQ ID NO: 55255 - DNA, 25 bp, Homo sapien
tcccacattctgatgagcaaccgct

SEQ ID NO: 55256 - DNA, 25 bp, Homo sapien
cccacattctgatgagcaaccgctt

SEQ ID NO: 55257 - DNA, 25 bp, Homo sapien
cacattctgatgagcaaccgcttcc

SEQ ID NO: 55258 - DNA, 25 bp, Homo sapien
attctgatgagcaaccgcttcccta

SEQ ID NO: 55259 - DNA, 25 bp, Homo sapien
tctgatgagcaaccgcttccctatt

SEQ ID NO: 55260 - DNA, 25 bp, Homo sapien
gatgagcaaccgcttccctatttat

SEQ ID NO: 55261 - DNA, 25 bp, Homo sapien
tgagcaaccgcttccctatttattt

SEQ ID NO: 55262 - DNA, 25 bp, Homo sapien
gagcaaccgcttccctatttattta

SEQ ID NO: 55263 - DNA, 25 bp, Homo sapien
tttattcattggtctaatttattca

SEQ ID NO: 55264 - DNA, 25 bp, Homo sapien
ttcattggtctaatttattcaaagg

SEQ ID NO: 55265 - DNA, 25 bp, Homo sapien
aattaacatgataaaagacactccc

SEQ ID NO: 55266 - DNA, 25 bp, Homo sapien
tttacaaatgacatggacacatcag

SEQ ID NO: 55267 - DNA, 25 bp, Homo sapien
aaatgacatggacacatcaggaagt

SEQ ID NO: 55268 - DNA, 25 bp, Homo sapien
tgacatggacacatcaggaagttac

SEQ ID NO: 55269 - DNA, 25 bp, Homo sapien
ggaggagccctcctttccaattgtc

SEQ ID NO: 55270 - DNA, 25 bp, Homo sapien
aggagccctcctttccaattgtcca

SEQ ID NO: 55271 - DNA, 25 bp, Homo sapien
ttccaattgtccacccctttcctgg

SEQ ID NO: 55272 - DNA, 25 bp, Homo sapien
ataaccatgaaaatagccaaaccca

SEQ ID NO: 55273 - DNA, 25 bp, Homo sapien
tgaaaatagccaaacccaagccctc

SEQ ID NO: 55274 - DNA, 25 bp, Homo sapien
aaaatagccaaacccaagccctcag

SEQ ID NO: 55275 - DNA, 25 bp, Homo sapien
aatagccaaacccaagccctcaggg

SEQ ID NO: 55276 - DNA, 25 bp, Homo sapien
tgtgtctgggtccacacacccttca

SEQ ID NO: 55277 - DNA, 25 bp, Homo sapien
gtgtctgggtccacacacccttcag

SEQ ID NO: 55278 - DNA, 25 bp, Homo sapien
ctcagcctgggatccggtgatggtc

SEQ ID NO: 55279 - DNA, 25 bp, Homo sapien
ctgggatccggtgatggtctgggca

SEQ ID NO: 55280 - DNA, 25 bp, Homo sapien
atccggtgatggtctgggcagaggc

SEQ ID NO: 55281 - DNA, 25 bp, Homo sapien
gctgggtcaggagtcccaaaggtca

SEQ ID NO: 55282 - DNA, 25 bp, Homo sapien
tcaggagtcccaaaggtcagtgaca

SEQ ID NO: 55283 - DNA, 25 bp, Homo sapien
aggagtcccaaaggtcagtgacagt

SEQ ID NO: 55284 - DNA, 25 bp, Homo sapien
gagtcccaaaggtcagtgacagttt

SEQ ID NO: 55285 - DNA, 25 bp, Homo sapien
gtcccaaaggtcagtgacagtttct

SEQ ID NO: 55286 - DNA, 25 bp, Homo sapien
cccaaaggtcagtgacagtttctca

SEQ ID NO: 55287 - DNA, 25 bp, Homo sapien
ccacctctgagatggacacttaaga

SEQ ID NO: 55288 - DNA, 25 bp, Homo sapien
ccatgaccaggtccactgtggagca

SEQ ID NO: 55289 - DNA, 25 bp, Homo sapien
ggtccactgtggagcagccatctat

SEQ ID NO: 55290 - DNA, 25 bp, Homo sapien
gtggagcagccatctatctacctga

SEQ ID NO: 55291 - DNA, 25 bp, Homo sapien
gagcagccatctatctacctgactc

SEQ ID NO: 55292 - DNA, 25 bp, Homo sapien
ctgccgtggtgtcatttctgtcatc

SEQ ID NO: 55293 - DNA, 25 bp, Homo sapien
gtggtgtcatttctgtcatccgtgc

SEQ ID NO: 55294 - DNA, 25 bp, Homo sapien
tcatttctgtcatccgtgctctgtt

SEQ ID NO: 55295 - DNA, 25 bp, Homo sapien
atccgtgctctgtttccttttggag

SEQ ID NO: 55296 - DNA, 25 bp, Homo sapien
gagtttcttctccacattatctttg

SEQ ID NO: 55297 - DNA, 25 bp, Homo sapien
ttctccacattatctttgttcctgg

SEQ ID NO: 55298 - DNA, 25 bp, Homo sapien
aacctgttggatgcctgttgccaga

SEQ ID NO: 55299 - DNA, 25 bp, Homo sapien
gttgccagagcctgaatcatcgttt

SEQ ID NO: 55300 - DNA, 25 bp, Homo sapien
gaatcatcgtttaaggttgccatca

SEQ ID NO: 55301 - DNA, 25 bp, Homo sapien
gtagctgtgcttagggtgcgtttat

SEQ ID NO: 55302 - DNA, 25 bp, Homo sapien
gtgcgtttattcttcagggatcagt

SEQ ID NO: 55303 - DNA, 25 bp, Homo sapien
atagcgttgtgtgttatggtaacca

SEQ ID NO: 55304 - DNA, 25 bp, Homo sapien
atggtaaccattctgaaggctcgtt

SEQ ID NO: 55305 - DNA, 25 bp, Homo sapien
gaaggctcgtttggctttataaaca

SEQ ID NO: 55306 - DNA, 25 bp, Homo sapien
acattgttttattagtccgtggcgg

SEQ ID NO: 55307 - DNA, 25 bp, Homo sapien
gcacgggattcatgcagtggtctcc

SEQ ID NO: 55308 - DNA, 25 bp, Homo sapien
cagtatattctaacgcggtggctcc

SEQ ID NO: 55309 - DNA, 25 bp, Homo sapien
ggagaatcgtcctttgggagccatc

SEQ ID NO: 55310 - DNA, 25 bp, Homo sapien
gagccatctgcctgactgcagtaca

SEQ ID NO: 55311 - DNA, 25 bp, Homo sapien
actccacccctgagcatcagtggga

SEQ ID NO: 55312 - DNA, 25 bp, Homo sapien
gcaagatgggtctcctgacctagaa

SEQ ID NO: 55313 - DNA, 25 bp, Homo sapien
ttcatgccacattacccttcttcaa

SEQ ID NO: 55314 - DNA, 25 bp, Homo sapien
cttcttcaagtctaagctcagggca

SEQ ID NO: 55315 - DNA, 25 bp, Homo sapien
agctcagggcatgtgcattcaactc

SEQ ID NO: 55316 - DNA, 25 bp, Homo sapien
tgcattcaactccttttcaggctgg

SEQ ID NO: 55317 - DNA, 25 bp, Homo sapien
gatgttcctatagacatgtcctatg

SEQ ID NO: 55318 - DNA, 25 bp, Homo sapien
ccatcatggtattgggacccaactc

SEQ ID NO: 55319 - DNA, 25 bp, Homo sapien
gggacccaactcaatacagtcttca

SEQ ID NO: 55320 - DNA, 25 bp, Homo sapien
tccccggaaactacgtcaagaggct

SEQ ID NO: 55321 - DNA, 25 bp, Homo sapien
ccggaaactacgtcaagaggctgtg

SEQ ID NO: 55322 - DNA, 25 bp, Homo sapien
caagaggctgtgaattgcgctccct

SEQ ID NO: 55323 - DNA, 25 bp, Homo sapien
aggctgtgaattgcgctccctcctt

SEQ ID NO: 55324 - DNA, 25 bp, Homo sapien
gcgggcctcccgttgtcatgcctta

SEQ ID NO: 55325 - DNA, 25 bp, Homo sapien
gttgtcatgccttacggtttccaat

SEQ ID NO: 55326 - DNA, 25 bp, Homo sapien
tgtcatgccttacggtttccaatgc

SEQ ID NO: 55327 - DNA, 25 bp, Homo sapien
ggacgacatggcaggctggtccccc

SEQ ID NO: 55328 - DNA, 25 bp, Homo sapien
gaaagtgtggattcctacttcctgc

SEQ ID NO: 55329 - DNA, 25 bp, Homo sapien
gtggattcctacttcctgctctaag

SEQ ID NO: 55330 - DNA, 25 bp, Homo sapien
ttgacacgtcaaaatgtgggatcag

SEQ ID NO: 55331 - DNA, 25 bp, Homo sapien
aaacggagacgcaggagaagaacac

SEQ ID NO: 55332 - DNA, 25 bp, Homo sapien
gagaagaacaccctgccgaccaaag

SEQ ID NO: 55333 - DNA, 25 bp, Homo sapien
ctgccgaccaaagagaccattgagc

SEQ ID NO: 55334 - DNA, 25 bp, Homo sapien
agaagcggagtgaaatttcctaaga

SEQ ID NO: 55335 - DNA, 25 bp, Homo sapien
gatcctggaggatttcctacccccg

SEQ ID NO: 55336 - DNA, 25 bp, Homo sapien
tcttcgagaccccagtcgtgatgtg

SEQ ID NO: 55337 - DNA, 25 bp, Homo sapien
agaccccagtcgtgatgtggaggaa

SEQ ID NO: 55338 - DNA, 25 bp, Homo sapien
aagagccacctgcaagatggacacg

SEQ ID NO: 55339 - DNA, 25 bp, Homo sapien
agatggacacgagccacaagctgca

SEQ ID NO: 55340 - DNA, 25 bp, Homo sapien
gcactgtgaacctgggcactccgcg

SEQ ID NO: 55341 - DNA, 25 bp, Homo sapien
tgaacctgggcactccgcgccgatg

SEQ ID NO: 55342 - DNA, 25 bp, Homo sapien
tatttgcacagggagaattgaaact

SEQ ID NO: 55343 - DNA, 25 bp, Homo sapien
agctagatacgaaatcagtttctca

SEQ ID NO: 55344 - DNA, 25 bp, Homo sapien
cattttgtactcttgtttttgcata

SEQ ID NO: 55345 - DNA, 25 bp, Homo sapien
cttgtttttgcataactggttttgt

SEQ ID NO: 55346 - DNA, 25 bp, Homo sapien
gaattaactataacaatcactggct

SEQ ID NO: 55347 - DNA, 25 bp, Homo sapien
tataacaatcactggctaccgaagt

SEQ ID NO: 55348 - DNA, 25 bp, Homo sapien
tcactggctaccgaagtaaactgat

SEQ ID NO: 55349 - DNA, 25 bp, Homo sapien
aagtaaactgatgtactgaattcca

SEQ ID NO: 55350 - DNA, 25 bp, Homo sapien
ttaccacttctgtttagcgaacttg

SEQ ID NO: 55351 - DNA, 25 bp, Homo sapien
agcgaacttgtatacttattttctg

SEQ ID NO: 55352 - DNA, 25 bp, Homo sapien
tgtatacttattttctgttcagatt

SEQ ID NO: 55353 - DNA, 25 bp, Homo sapien
gttctaatagaactcagttttaact

SEQ ID NO: 55354 - DNA, 25 bp, Homo sapien
atagaactcagttttaactagaatt

SEQ ID NO: 55355 - DNA, 25 bp, Homo sapien
ctcagttttaactagaatttattca

SEQ ID NO: 55356 - DNA, 25 bp, Homo sapien
attcctctgggaatgttacattgtt

SEQ ID NO: 55357 - DNA, 25 bp, Homo sapien
tcctctgggaatgttacattgtttg

SEQ ID NO: 55358 - DNA, 25 bp, Homo sapien
gggaatgttacattgtttgtctgtc

SEQ ID NO: 55359 - DNA, 25 bp, Homo sapien
ttgtttgtctgtcttcatagcagat

SEQ ID NO: 55360 - DNA, 25 bp, Homo sapien
tgtttgtctgtcttcatagcagatt

SEQ ID NO: 55361 - DNA, 25 bp, Homo sapien
gtttgtctgtcttcatagcagattt

SEQ ID NO: 55362 - DNA, 25 bp, Homo sapien
ttgtctgtcttcatagcagatttta

SEQ ID NO: 55363 - DNA, 25 bp, Homo sapien
gtctgtcttcatagcagattttaat

SEQ ID NO: 55364 - DNA, 25 bp, Homo sapien
agttcttcattctgactgttgaggg

SEQ ID NO: 55365 - DNA, 25 bp, Homo sapien
gactcagctgtcttttcacatggat

SEQ ID NO: 55366 - DNA, 25 bp, Homo sapien
tcagctgtcttttcacatggatgaa

SEQ ID NO: 55367 - DNA, 25 bp, Homo sapien
taccaacaacagagcttcaccagga

SEQ ID NO: 55368 - DNA, 25 bp, Homo sapien
cttcaccaggaagttgagttttcaa

SEQ ID NO: 55369 - DNA, 25 bp, Homo sapien
tgccttgttgctttgaagaagggag

SEQ ID NO: 55370 - DNA, 25 bp, Homo sapien
gagtgatgtcaattctcttgttaca

SEQ ID NO: 55371 - DNA, 25 bp, Homo sapien
tcttgttacattctccctttagcaa

SEQ ID NO: 55372 - DNA, 25 bp, Homo sapien
ttctccctttagcaacctgagtaag

SEQ ID NO: 55373 - DNA, 25 bp, Homo sapien
gcaacctgagtaagagactctctgc

SEQ ID NO: 55374 - DNA, 25 bp, Homo sapien
taagagactctctgccactgggctg

SEQ ID NO: 55375 - DNA, 25 bp, Homo sapien
ggtatgttttaccatctgcatccag

SEQ ID NO: 55376 - DNA, 25 bp, Homo sapien
tgctaactcctagctgactcagcat

SEQ ID NO: 55377 - DNA, 25 bp, Homo sapien
agctgactcagcatagattgtataa

SEQ ID NO: 55378 - DNA, 25 bp, Homo sapien
atacctttgtaacggctcttagcac

SEQ ID NO: 55379 - DNA, 25 bp, Homo sapien
ggctcttagcacactcacagatgtt

SEQ ID NO: 55380 - DNA, 25 bp, Homo sapien
gtttgaggctttcagaagctcttct

SEQ ID NO: 55381 - DNA, 25 bp, Homo sapien
aaaaatgatacacacctttcacaag

SEQ ID NO: 55382 - DNA, 25 bp, Homo sapien
gattcagtagacctaatgacatttg

SEQ ID NO: 55383 - DNA, 25 bp, Homo sapien
atttgtattttatgatcttggctgt

SEQ ID NO: 55384 - DNA, 25 bp, Homo sapien
gatcttggctgtatttaatggcata

SEQ ID NO: 55385 - DNA, 25 bp, Homo sapien
aatggcataggctgacttttgcaga

SEQ ID NO: 55386 - DNA, 25 bp, Homo sapien
aaagctgctttgttaggttccttat

SEQ ID NO: 55387 - DNA, 25 bp, Homo sapien
gctgctttgttaggttccttatgtt

SEQ ID NO: 55388 - DNA, 25 bp, Homo sapien
ttttctagttttggtgacttagtga

SEQ ID NO: 55389 - DNA, 25 bp, Homo sapien
ggtgacttagtgattttgtcatttt

SEQ ID NO: 55390 - DNA, 25 bp, Homo sapien
cattttttacatcaacttcatggtc

SEQ ID NO: 55391 - DNA, 25 bp, Homo sapien
ggtcttgtttttacatggtaattgc

SEQ ID NO: 55392 - DNA, 25 bp, Homo sapien
ggtaattgcatgtacttaggatcta

SEQ ID NO: 55393 - DNA, 25 bp, Homo sapien
gcatgtacttaggatctatctaata

SEQ ID NO: 55394 - DNA, 25 bp, Homo sapien
tttggtcatatttatgtgtaagcac

SEQ ID NO: 55395 - DNA, 25 bp, Homo sapien
atgtgtaagcacattttactgtaaa

SEQ ID NO: 55396 - DNA, 25 bp, Homo sapien
tatcttaaagtgtccgattcactac

SEQ ID NO: 55397 - DNA, 25 bp, Homo sapien
gtggccttggtgtatgctatgctca

SEQ ID NO: 55398 - DNA, 25 bp, Homo sapien
tgctatgctcagaggaaaggctact

SEQ ID NO: 55399 - DNA, 25 bp, Homo sapien
gagtaattcttcatctaaagccacg

SEQ ID NO: 55400 - DNA, 25 bp, Homo sapien
aagactccactttagagatacacca

SEQ ID NO: 55401 - DNA, 25 bp, Homo sapien
gagatacaccaaagccaccgttgtt

SEQ ID NO: 55402 - DNA, 25 bp, Homo sapien
aagccaccgttgttacacaagttat

SEQ ID NO: 55403 - DNA, 25 bp, Homo sapien
ataaaactctgctttgtccgacatt

SEQ ID NO: 55404 - DNA, 25 bp, Homo sapien
taagtggcatcatagcagccgtagt

SEQ ID NO: 55405 - DNA, 25 bp, Homo sapien
agcagccgtagtagttgtggcctta

SEQ ID NO: 55406 - DNA, 25 bp, Homo sapien
gttgtggccttagtgatttccgttt

SEQ ID NO: 55407 - DNA, 25 bp, Homo sapien
tagtgatttccgtttgtggccttgg

SEQ ID NO: 55408 - DNA, 25 bp, Homo sapien
gtgatggatgatgaacctggcaagt

SEQ ID NO: 55409 - DNA, 25 bp, Homo sapien
gaacctggcaagtcacaggactatg

SEQ ID NO: 55410 - DNA, 25 bp, Homo sapien
aggactatggacttggctgtatgtt

SEQ ID NO: 55411 - DNA, 25 bp, Homo sapien
ggacttggctgtatgttgcatgtat

SEQ ID NO: 55412 - DNA, 25 bp, Homo sapien
aagatctgagttgagacctttgatt

SEQ ID NO: 55413 - DNA, 25 bp, Homo sapien
atttttgcccagaaagatccagcta

SEQ ID NO: 55414 - DNA, 25 bp, Homo sapien
catactatataagccagtgagacca

SEQ ID NO: 55415 - DNA, 25 bp, Homo sapien
agtgagaccagccagtgtctgttca

SEQ ID NO: 55416 - DNA, 25 bp, Homo sapien
cagccagtgtctgttcattgcctct

SEQ ID NO: 55417 - DNA, 25 bp, Homo sapien
agcagggccctatagcataatgaaa

SEQ ID NO: 55418 - DNA, 25 bp, Homo sapien
aaaatgcgaacaaccttttctctgg

SEQ ID NO: 55419 - DNA, 25 bp, Homo sapien
tgctttcccatcagcctgatttctc

SEQ ID NO: 55420 - DNA, 25 bp, Homo sapien
aggagccccctgagagtgtcagtta

SEQ ID NO: 55421 - DNA, 25 bp, Homo sapien
gtgtcagttattatttactattacg

SEQ ID NO: 55422 - DNA, 25 bp, Homo sapien
tttactattacgtgctattttacat

SEQ ID NO: 55423 - DNA, 25 bp, Homo sapien
tattttacatatcccaagcccttta

SEQ ID NO: 55424 - DNA, 25 bp, Homo sapien
ttacatatcccaagccctttagggc

SEQ ID NO: 55425 - DNA, 25 bp, Homo sapien
gccctttagggctacagtctcttgt

SEQ ID NO: 55426 - DNA, 25 bp, Homo sapien
ctttagggctacagtctcttgtcct

SEQ ID NO: 55427 - DNA, 25 bp, Homo sapien
ttgtcctggaccctgtagggtgcca

SEQ ID NO: 55428 - DNA, 25 bp, Homo sapien
ctggaccctgtagggtgccatttgg

SEQ ID NO: 55429 - DNA, 25 bp, Homo sapien
ggtgccatttggagttcacagccta

SEQ ID NO: 55430 - DNA, 25 bp, Homo sapien
tatttaggaatagatctgactttaa

SEQ ID NO: 55431 - DNA, 25 bp, Homo sapien
aacatggctcagaatctacaggtca

SEQ ID NO: 55432 - DNA, 25 bp, Homo sapien
ggctcagaatctacaggtcaaatta

SEQ ID NO: 55433 - DNA, 25 bp, Homo sapien
agttcttgtcaatccgaattgttga

SEQ ID NO: 55434 - DNA, 25 bp, Homo sapien
caatccgaattgttgattctgttta

SEQ ID NO: 55435 - DNA, 25 bp, Homo sapien
gatgtacttagtttcaagattcata

SEQ ID NO: 55436 - DNA, 25 bp, Homo sapien
ttcaagattcatagattctgttatc

SEQ ID NO: 55437 - DNA, 25 bp, Homo sapien
gttatctatgtagacagaatggtca

SEQ ID NO: 55438 - DNA, 25 bp, Homo sapien
gaatggtcatgtatattttctatta

SEQ ID NO: 55439 - DNA, 25 bp, Homo sapien
ctattagttgagtttttacatcttt

SEQ ID NO: 55440 - DNA, 25 bp, Homo sapien
cagtatagtttgaaagcggcacaat

SEQ ID NO: 55441 - DNA, 25 bp, Homo sapien
gcgacgaggaggaagcggagctgga

SEQ ID NO: 55442 - DNA, 25 bp, Homo sapien
tggagctgctgaggcagtttgacct

SEQ ID NO: 55443 - DNA, 25 bp, Homo sapien
gctgctgaggcagtttgacctggcc

SEQ ID NO: 55444 - DNA, 25 bp, Homo sapien
tttgacctggcctggcagtacgggc

SEQ ID NO: 55445 - DNA, 25 bp, Homo sapien
tggcctggcagtacgggccctgcac

SEQ ID NO: 55446 - DNA, 25 bp, Homo sapien
cagtacgggccctgcaccgggatca

SEQ ID NO: 55447 - DNA, 25 bp, Homo sapien
gtacgggccctgcaccgggatcaca

SEQ ID NO: 55448 - DNA, 25 bp, Homo sapien
tgcaccgggatcacacggctgcagc

SEQ ID NO: 55449 - DNA, 25 bp, Homo sapien
accgggatcacacggctgcagcgct

SEQ ID NO: 55450 - DNA, 25 bp, Homo sapien
ctggtgtcgggccaagcagatgggc

SEQ ID NO: 55451 - DNA, 25 bp, Homo sapien
caagcagatgggcttggagcctccc

SEQ ID NO: 55452 - DNA, 25 bp, Homo sapien
cttgccggcggcaggttgcagccac

SEQ ID NO: 55453 - DNA, 25 bp, Homo sapien
atgtcaccttcactcacagtctgag

SEQ ID NO: 55454 - DNA, 25 bp, Homo sapien
gtcaccttcactcacagtctgagtt

SEQ ID NO: 55455 - DNA, 25 bp, Homo sapien
cttcactcacagtctgagttcttgt

SEQ ID NO: 55456 - DNA, 25 bp, Homo sapien
actcacagtctgagttcttgtccgc

SEQ ID NO: 55457 - DNA, 25 bp, Homo sapien
acagtctgagttcttgtccgcctgt

SEQ ID NO: 55458 - DNA, 25 bp, Homo sapien
agtctgagttcttgtccgcctgtca

SEQ ID NO: 55459 - DNA, 25 bp, Homo sapien
tctgagttcttgtccgcctgtcacg

SEQ ID NO: 55460 - DNA, 25 bp, Homo sapien
gggccttcccagaagcgtcctgtga

SEQ ID NO: 55461 - DNA, 25 bp, Homo sapien
agaagcgtcctgtgactctgggaga

SEQ ID NO: 55462 - DNA, 25 bp, Homo sapien
gtgactctgggagaggtgacacctc

SEQ ID NO: 55463 - DNA, 25 bp, Homo sapien
gtggaaaacaaagtgactgacctgt

SEQ ID NO: 55464 - DNA, 25 bp, Homo sapien
aagtgactgacctgtgagctctggc

SEQ ID NO: 55465 - DNA, 25 bp, Homo sapien
tgactgacctgtgagctctggctca

SEQ ID NO: 55466 - DNA, 25 bp, Homo sapien
tgtgagctctggctcagacagcagc

SEQ ID NO: 55467 - DNA, 25 bp, Homo sapien
tcagacagcagcaagccggatccac

SEQ ID NO: 55468 - DNA, 25 bp, Homo sapien
agcgccttatgaccccggaaccgag

SEQ ID NO: 55469 - DNA, 25 bp, Homo sapien
ccggaaccgagccagccactgaggg

SEQ ID NO: 55470 - DNA, 25 bp, Homo sapien
ccccacctgagattgtttctaattt

SEQ ID NO: 55471 - DNA, 25 bp, Homo sapien
tctaatttataaggatccccctcct

SEQ ID NO: 55472 - DNA, 25 bp, Homo sapien
ccctctccccattgtatttatttgc

SEQ ID NO: 55473 - DNA, 25 bp, Homo sapien
ttatttgcctgctggaaaatcacat

SEQ ID NO: 55474 - DNA, 25 bp, Homo sapien
cgtggatattggcatccccttggat

SEQ ID NO: 55475 - DNA, 25 bp, Homo sapien
attggcatccccttggatggagaaa

SEQ ID NO: 55476 - DNA, 25 bp, Homo sapien
ggagctgtgaggtgtttcctcctct

SEQ ID NO: 55477 - DNA, 25 bp, Homo sapien
ccctctctggctccaatttggagag

SEQ ID NO: 55478 - DNA, 25 bp, Homo sapien
gagggaatgctgagcagatagcccc

SEQ ID NO: 55479 - DNA, 25 bp, Homo sapien
ccccattgttaatccagtatcctta

SEQ ID NO: 55480 - DNA, 25 bp, Homo sapien
aggagagatctacctttccatcctt

SEQ ID NO: 55481 - DNA, 25 bp, Homo sapien
tacctttccatcctttactccaagt

SEQ ID NO: 55482 - DNA, 25 bp, Homo sapien
cccttctacttgctccatatggaac

SEQ ID NO: 55483 - DNA, 25 bp, Homo sapien
atatggaacctgctcgtttatggaa

SEQ ID NO: 55484 - DNA, 25 bp, Homo sapien
ctgctcgtttatggaatttgctctg

SEQ ID NO: 55485 - DNA, 25 bp, Homo sapien
tgtgaagacctattcaacgagcttt

SEQ ID NO: 55486 - DNA, 25 bp, Homo sapien
ttcaacgagctttaccccgatgtat

SEQ ID NO: 55487 - DNA, 25 bp, Homo sapien
cccgatgtatcacgcagttaccaaa

SEQ ID NO: 55488 - DNA, 25 bp, Homo sapien
gatgaaaatggtctgtgctaacaag

SEQ ID NO: 55489 - DNA, 25 bp, Homo sapien
gacttgggtgtgatgaaatgctgca

SEQ ID NO: 55490 - DNA, 25 bp, Homo sapien
aaatgctgcagggttttgctgttgc

SEQ ID NO: 55491 - DNA, 25 bp, Homo sapien
gatgggagcaacgaaggcagacttt

SEQ ID NO: 55492 - DNA, 25 bp, Homo sapien
gactttgacaacacagtcgccattc

SEQ ID NO: 55493 - DNA, 25 bp, Homo sapien
attcaccctacctcttcagaagagc

SEQ ID NO: 55494 - DNA, 25 bp, Homo sapien
agagctggtcacacttcgttgagaa

SEQ ID NO: 55495 - DNA, 25 bp, Homo sapien
ttgagaaccaggagacacgtgtggc

SEQ ID NO: 55496 - DNA, 25 bp, Homo sapien
gggactgagactataccaattcagg

SEQ ID NO: 55497 - DNA, 25 bp, Homo sapien
accaattcagggttacagagtggat

SEQ ID NO: 55498 - DNA, 25 bp, Homo sapien
tgttctattccatttgttaaaccga

SEQ ID NO: 55499 - DNA, 25 bp, Homo sapien
acagacattccccatcaggcattta

SEQ ID NO: 55500 - DNA, 25 bp, Homo sapien
ttccccatcaggcatttataacatt

SEQ ID NO: 55501 - DNA, 25 bp, Homo sapien
gaccacattagtatcaggacctccc

SEQ ID NO: 55502 - DNA, 25 bp, Homo sapien
ggacctcccctgtcagatgattcag

SEQ ID NO: 55503 - DNA, 25 bp, Homo sapien
gggctgatttgcctcaaatggaaca

SEQ ID NO: 55504 - DNA, 25 bp, Homo sapien
gatttgcctcaaatggaacaccagc

SEQ ID NO: 55505 - DNA, 25 bp, Homo sapien
gaacaccagcactgagaaccatttt

SEQ ID NO: 55506 - DNA, 25 bp, Homo sapien
gagaaccattttggttctgaactgg

SEQ ID NO: 55507 - DNA, 25 bp, Homo sapien
gaggttttggtgtccctggtcctct

SEQ ID NO: 55508 - DNA, 25 bp, Homo sapien
aggttttggtgtccctggtcctctg

SEQ ID NO: 55509 - DNA, 25 bp, Homo sapien
ggttttggtgtccctggtcctctgg

SEQ ID NO: 55510 - DNA, 25 bp, Homo sapien
gttttggtgtccctggtcctctggg

SEQ ID NO: 55511 - DNA, 25 bp, Homo sapien
gcaagcacgttttccacctcactgt

SEQ ID NO: 55512 - DNA, 25 bp, Homo sapien
aagcacgttttccacctcactgtct

SEQ ID NO: 55513 - DNA, 25 bp, Homo sapien
agcacgttttccacctcactgtctc

SEQ ID NO: 55514 - DNA, 25 bp, Homo sapien
gcacgttttccacctcactgtctcc

SEQ ID NO: 55515 - DNA, 25 bp, Homo sapien
acgttttccacctcactgtctccat

SEQ ID NO: 55516 - DNA, 25 bp, Homo sapien
cgttttccacctcactgtctccatc

SEQ ID NO: 55517 - DNA, 25 bp, Homo sapien
gttttccacctcactgtctccatcc

SEQ ID NO: 55518 - DNA, 25 bp, Homo sapien
gcacttgtgctttagctttttcata

SEQ ID NO: 55519 - DNA, 25 bp, Homo sapien
gcatagatgatgatttacagacaat

SEQ ID NO: 55520 - DNA, 25 bp, Homo sapien
aaaagttcaagtctgtactgttaca

SEQ ID NO: 55521 - DNA, 25 bp, Homo sapien
aagtctgtactgttacagtttgaga

SEQ ID NO: 55522 - DNA, 25 bp, Homo sapien
gtagataacatcatacataagtcat

SEQ ID NO: 55523 - DNA, 25 bp, Homo sapien
agtcatttagtaacagcctttgtga

SEQ ID NO: 55524 - DNA, 25 bp, Homo sapien
gtttactattggagataaccacact

SEQ ID NO: 55525 - DNA, 25 bp, Homo sapien
ggagataaccacacttaataaagaa

SEQ ID NO: 55526 - DNA, 25 bp, Homo sapien
gaagagacagtgaaagtaccatcat

SEQ ID NO: 55527 - DNA, 25 bp, Homo sapien
gaaagtaccatcataattaacctaa

SEQ ID NO: 55528 - DNA, 25 bp, Homo sapien
tgttatagcagagtttcttgtttaa

SEQ ID NO: 55529 - DNA, 25 bp, Homo sapien
aattccttaaatgaactactgctat

SEQ ID NO: 55530 - DNA, 25 bp, Homo sapien
ctgttgtttctataaatgactattg

SEQ ID NO: 55531 - DNA, 25 bp, Homo sapien
tgtaatgccaatatgacacagcttg

SEQ ID NO: 55532 - DNA, 25 bp, Homo sapien
gaatgtttagtgtgctgctgttctg

SEQ ID NO: 55533 - DNA, 25 bp, Homo sapien
tgtgctgctgttctgtgtacataaa

SEQ ID NO: 55534 - DNA, 25 bp, Homo sapien
gttctgtgtacataaagtcatcaaa

SEQ ID NO: 55535 - DNA, 25 bp, Homo sapien
gaggcttccaagcattactttaacc

SEQ ID NO: 55536 - DNA, 25 bp, Homo sapien
caagcattactttaacctccctcaa

SEQ ID NO: 55537 - DNA, 25 bp, Homo sapien
taacctccctcaacaaggtatacct

SEQ ID NO: 55538 - DNA, 25 bp, Homo sapien
aaggtatacctcagttccacggttg

SEQ ID NO: 55539 - DNA, 25 bp, Homo sapien
tcagttccacggttgctaaattata

SEQ ID NO: 55540 - DNA, 25 bp, Homo sapien
acctgagtttgtgctgagggcctgc

SEQ ID NO: 55541 - DNA, 25 bp, Homo sapien
agtttgtgctgagggcctgcacaag

SEQ ID NO: 55542 - DNA, 25 bp, Homo sapien
cacaaggagggtgctgttgagacca

SEQ ID NO: 55543 - DNA, 25 bp, Homo sapien
gaccagaaaagaggccaccggtatc

SEQ ID NO: 55544 - DNA, 25 bp, Homo sapien
gaaaagaggccaccggtatctgtgt

SEQ ID NO: 55545 - DNA, 25 bp, Homo sapien
accggtatctgtgtgggtgctacaa

SEQ ID NO: 55546 - DNA, 25 bp, Homo sapien
atctgtgtgggtgctacaatctcca

SEQ ID NO: 55547 - DNA, 25 bp, Homo sapien
gtgggtgctacaatctccagaccat

SEQ ID NO: 55548 - DNA, 25 bp, Homo sapien
gtgctacaatctccagaccatcaca

SEQ ID NO: 55549 - DNA, 25 bp, Homo sapien
gaccatcacaattggttagcagaca

SEQ ID NO: 55550 - DNA, 25 bp, Homo sapien
tggttagcagacaaaatgctgacta

SEQ ID NO: 55551 - DNA, 25 bp, Homo sapien
gccaggagggtaatacactctgatc

SEQ ID NO: 55552 - DNA, 25 bp, Homo sapien
actctgatcccctcagtctgaatct

SEQ ID NO: 55553 - DNA, 25 bp, Homo sapien
gtctgaatcttctcattgtcttata

SEQ ID NO: 55554 - DNA, 25 bp, Homo sapien
gcaagttcaaatactggaggcaatt

SEQ ID NO: 55555 - DNA, 25 bp, Homo sapien
ggacgtctagaattggtctaccagt

SEQ ID NO: 55556 - DNA, 25 bp, Homo sapien
ttggtctaccagttactatggagta

SEQ ID NO: 55557 - DNA, 25 bp, Homo sapien
aattaaactggaccatctctctcca

SEQ ID NO: 55558 - DNA, 25 bp, Homo sapien
tctctctccatatcaatctggacca

SEQ ID NO: 55559 - DNA, 25 bp, Homo sapien
gaccatctctcctctgctaaatttg

SEQ ID NO: 55560 - DNA, 25 bp, Homo sapien
atttgcatgactgatctttagtatc

SEQ ID NO: 55561 - DNA, 25 bp, Homo sapien
gtatctttacctacctcaatttctg

SEQ ID NO: 55562 - DNA, 25 bp, Homo sapien
gtatgtgtgtagactgtaacttttt

SEQ ID NO: 55563 - DNA, 25 bp, Homo sapien
ttttttcagttcatatgcagaacgt

SEQ ID NO: 55564 - DNA, 25 bp, Homo sapien
ttcatatgcagaacgtatttagcca

SEQ ID NO: 55565 - DNA, 25 bp, Homo sapien
agaacgtatttagccattacccacg

SEQ ID NO: 55566 - DNA, 25 bp, Homo sapien
gtatttagccattacccacgtgaca

SEQ ID NO: 55567 - DNA, 25 bp, Homo sapien
ttacccacgtgacaccaccgaatat

SEQ ID NO: 55568 - DNA, 25 bp, Homo sapien
gtgacaccaccgaatatattatcga

SEQ ID NO: 55569 - DNA, 25 bp, Homo sapien
ccaccgaatatattatcgatttaga

SEQ ID NO: 55570 - DNA, 25 bp, Homo sapien
atcgatttagaagcaaagatttcag

SEQ ID NO: 55571 - DNA, 25 bp, Homo sapien
agtagaattttagtcctgaacgcta

SEQ ID NO: 55572 - DNA, 25 bp, Homo sapien
gaattttagtcctgaacgctacggg

SEQ ID NO: 55573 - DNA, 25 bp, Homo sapien
ctgttacactgtatagtagtcctat

SEQ ID NO: 55574 - DNA, 25 bp, Homo sapien
ctgtatagtagtcctatggcacccc

SEQ ID NO: 55575 - DNA, 25 bp, Homo sapien
ccaccccagtgtgtataagctggca

SEQ ID NO: 55576 - DNA, 25 bp, Homo sapien
gtgtgtataagctggcatttcgcca

SEQ ID NO: 55577 - DNA, 25 bp, Homo sapien
tggcatttcgccagcttgtacgtag

SEQ ID NO: 55578 - DNA, 25 bp, Homo sapien
agcttgtacgtagcttgccactcag

SEQ ID NO: 55579 - DNA, 25 bp, Homo sapien
agcttgccactcagtgaaaataata

SEQ ID NO: 55580 - DNA, 25 bp, Homo sapien
gacttaaccgaaatggaaccaactg

SEQ ID NO: 55581 - DNA, 25 bp, Homo sapien
gaaccaactgacattctatcgtgtt

SEQ ID NO: 55582 - DNA, 25 bp, Homo sapien
gaatgatgaagggttccactgttgt

SEQ ID NO: 55583 - DNA, 25 bp, Homo sapien
ggttccactgttgttgtatgtctta

SEQ ID NO: 55584 - DNA, 25 bp, Homo sapien
gtgggacagagacagctattttgcc

SEQ ID NO: 55585 - DNA, 25 bp, Homo sapien
agctattttgccttgccagggcctt

SEQ ID NO: 55586 - DNA, 25 bp, Homo sapien
ttgccagggcctttgtccgcaaaag

SEQ ID NO: 55587 - DNA, 25 bp, Homo sapien
ggcctttgtccgcaaaagcagcatt

SEQ ID NO: 55588 - DNA, 25 bp, Homo sapien
tgtccgcaaaagcagcattcttatt

SEQ ID NO: 55589 - DNA, 25 bp, Homo sapien
aaagcagcattcttattatggatga

SEQ ID NO: 55590 - DNA, 25 bp, Homo sapien
tcttattatggatgaggcaacagct

SEQ ID NO: 55591 - DNA, 25 bp, Homo sapien
acatggccacagagaatattttgca

SEQ ID NO: 55592 - DNA, 25 bp, Homo sapien
aagtagtaatgacagcctttgcaga

SEQ ID NO: 55593 - DNA, 25 bp, Homo sapien
taatgacagcctttgcagaccggac

SEQ ID NO: 55594 - DNA, 25 bp, Homo sapien
ttgcagaccggaccgtggtgacaat

SEQ ID NO: 55595 - DNA, 25 bp, Homo sapien
gagctgtccccgtgttgcatgaagg

SEQ ID NO: 55596 - DNA, 25 bp, Homo sapien
tccccgtgttgcatgaaggagcagc

SEQ ID NO: 55597 - DNA, 25 bp, Homo sapien
aaggagcagcattgactggtttaca

SEQ ID NO: 55598 - DNA, 25 bp, Homo sapien
ttgactggtttacaggccctgctcc

SEQ ID NO: 55599 - DNA, 25 bp, Homo sapien
tctttactcccaagacttcattgtc

SEQ ID NO: 55600 - DNA, 25 bp, Homo sapien
tttactcccaagacttcattgtccc

SEQ ID NO: 55601 - DNA, 25 bp, Homo sapien
cctgtcccatgcaggccctttgaag

SEQ ID NO: 55602 - DNA, 25 bp, Homo sapien
ccatgcaggccctttgaagcctcag

SEQ ID NO: 55603 - DNA, 25 bp, Homo sapien
ctttgaagcctcagctacccactat

SEQ ID NO: 55604 - DNA, 25 bp, Homo sapien
gctacccactatccttcgtgaacat

SEQ ID NO: 55605 - DNA, 25 bp, Homo sapien
atcattacccttccctgcactaaag

SEQ ID NO: 55606 - DNA, 25 bp, Homo sapien
gactgaatcttcctttgttgcacaa

SEQ ID NO: 55607 - DNA, 25 bp, Homo sapien
gaatcttcctttgttgcacaaatag

SEQ ID NO: 55608 - DNA, 25 bp, Homo sapien
aatagagtttggaaaaagcctgtga

SEQ ID NO: 55609 - DNA, 25 bp, Homo sapien
aagcctgtgaaaggtgtcttctttg

SEQ ID NO: 55610 - DNA, 25 bp, Homo sapien
gtgtcttctttgacttaatgtcttt

SEQ ID NO: 55611 - DNA, 25 bp, Homo sapien
taatgtctttaaaagtatccagaga

SEQ ID NO: 55612 - DNA, 25 bp, Homo sapien
tatccagagatactacaatattaac

SEQ ID NO: 55613 - DNA, 25 bp, Homo sapien
attatttctgaatcgagatgtccat

SEQ ID NO: 55614 - DNA, 25 bp, Homo sapien
ttctgaatcgagatgtccatagtca

SEQ ID NO: 55615 - DNA, 25 bp, Homo sapien
gagatgtccatagtcaaatttgtaa

SEQ ID NO: 55616 - DNA, 25 bp, Homo sapien
gacagtgaacattctgattttacat

SEQ ID NO: 55617 - DNA, 25 bp, Homo sapien
atgctcatcagcttatggcttctgt

SEQ ID NO: 55618 - DNA, 25 bp, Homo sapien
tatggcttctgtctaagcacctgaa

SEQ ID NO: 55619 - DNA, 25 bp, Homo sapien
gtctaagcacctgaacagaggactg

SEQ ID NO: 55620 - DNA, 25 bp, Homo sapien
agaggactgaaacctccactgcagg

SEQ ID NO: 55621 - DNA, 25 bp, Homo sapien
cactgcaggctggttttaggtcttg

SEQ ID NO: 55622 - DNA, 25 bp, Homo sapien
caggctggttttaggtcttgaatta

SEQ ID NO: 55623 - DNA, 25 bp, Homo sapien
agaatcttgcacagcactgctaatg

SEQ ID NO: 55624 - DNA, 25 bp, Homo sapien
ttccctctaggacaaacacttacca

SEQ ID NO: 55625 - DNA, 25 bp, Homo sapien
gggaagagagattgtcctgtgattt

SEQ ID NO: 55626 - DNA, 25 bp, Homo sapien
ctgtgatttctacccatttcctgag

SEQ ID NO: 55627 - DNA, 25 bp, Homo sapien
tacccatttcctgaggcctgtggaa

SEQ ID NO: 55628 - DNA, 25 bp, Homo sapien
atgctgctggctactgcatgtgcca

SEQ ID NO: 55629 - DNA, 25 bp, Homo sapien
gttcgccattcctaacattctgttt

SEQ ID NO: 55630 - DNA, 25 bp, Homo sapien
ttctgtttcattcttcctcgggaga

SEQ ID NO: 55631 - DNA, 25 bp, Homo sapien
cttcctcgggagatatttcaaacat

SEQ ID NO: 55632 - DNA, 25 bp, Homo sapien
catttggtcttttcttttaacactg

SEQ ID NO: 55633 - DNA, 25 bp, Homo sapien
tcttttaacactgagggtaggccct

SEQ ID NO: 55634 - DNA, 25 bp, Homo sapien
tttaggaaagtctgaacacgttatc

SEQ ID NO: 55635 - DNA, 25 bp, Homo sapien
acacgttatcacttggttttctgga

SEQ ID NO: 55636 - DNA, 25 bp, Homo sapien
tctggaaagtagcttaccctagaaa

SEQ ID NO: 55637 - DNA, 25 bp, Homo sapien
gagaacattggcttccacatcacag

SEQ ID NO: 55638 - DNA, 25 bp, Homo sapien
acatcacagtatctacccttacatg

SEQ ID NO: 55639 - DNA, 25 bp, Homo sapien
taccttcaatgggaacttaaactgt

SEQ ID NO: 55640 - DNA, 25 bp, Homo sapien
gaacttaaactgttacatgtatcac

SEQ ID NO: 55641 - DNA, 25 bp, Homo sapien
acattccagctacaatacttccatt

SEQ ID NO: 55642 - DNA, 25 bp, Homo sapien
gctacaatacttccatttattagaa

SEQ ID NO: 55643 - DNA, 25 bp, Homo sapien
gaagcacattaaccatttctatagc

SEQ ID NO: 55644 - DNA, 25 bp, Homo sapien
atttctatagcatgatttcttcaag

SEQ ID NO: 55645 - DNA, 25 bp, Homo sapien
ataattgacttgagtactttaagcc

SEQ ID NO: 55646 - DNA, 25 bp, Homo sapien
catttcttacttaacttttgcaaat

SEQ ID NO: 55647 - DNA, 25 bp, Homo sapien
tttgcaaattaaacccattgtagct

SEQ ID NO: 55648 - DNA, 25 bp, Homo sapien
taaacccattgtagcttacctgtaa

SEQ ID NO: 55649 - DNA, 25 bp, Homo sapien
tattgctttaaccaacactgtaaat

SEQ ID NO: 55650 - DNA, 25 bp, Homo sapien
aagtcctgggacactggatccccga

SEQ ID NO: 55651 - DNA, 25 bp, Homo sapien
actggatccccgagcagtgctaatg

SEQ ID NO: 55652 - DNA, 25 bp, Homo sapien
gagcagtgctaatgctggctactgt

SEQ ID NO: 55653 - DNA, 25 bp, Homo sapien
tgacttcatgctcaggattcaagaa

SEQ ID NO: 55654 - DNA, 25 bp, Homo sapien
ggatgtctagaactggtcctgcaat

SEQ ID NO: 55655 - DNA, 25 bp, Homo sapien
gaactggtcctgcaattactatgaa

SEQ ID NO: 55656 - DNA, 25 bp, Homo sapien
ttaaactagactatgtctccaactc

SEQ ID NO: 55657 - DNA, 25 bp, Homo sapien
tgtctccaactcagttcagaccatc

SEQ ID NO: 55658 - DNA, 25 bp, Homo sapien
atctcctccctaatgagtttgcatc

SEQ ID NO: 55659 - DNA, 25 bp, Homo sapien
gagtttgcatcgctgatcttcagta

SEQ ID NO: 55660 - DNA, 25 bp, Homo sapien
tgatcttcagtaccttcacctgtct

SEQ ID NO: 55661 - DNA, 25 bp, Homo sapien
taaaggttgaggaaacaagcccaga

SEQ ID NO: 55662 - DNA, 25 bp, Homo sapien
ttaagggaggagttcctgcccacca

SEQ ID NO: 55663 - DNA, 25 bp, Homo sapien
taagggaggagttcctgcccaccag

SEQ ID NO: 55664 - DNA, 25 bp, Homo sapien
cccaccaggaacctgctttagtggg

SEQ ID NO: 55665 - DNA, 25 bp, Homo sapien
acctgctttagtgggggatagtgaa

SEQ ID NO: 55666 - DNA, 25 bp, Homo sapien
taaaagatagtagttcaggccaggc

SEQ ID NO: 55667 - DNA, 25 bp, Homo sapien
aaaagatagtagttcaggccaggcg

SEQ ID NO: 55668 - DNA, 25 bp, Homo sapien
aaagatagtagttcaggccaggcgg

SEQ ID NO: 55669 - DNA, 25 bp, Homo sapien
aagatagtagttcaggccaggcggg

SEQ ID NO: 55670 - DNA, 25 bp, Homo sapien
gatacttgaatccaggcatttgaga

SEQ ID NO: 55671 - DNA, 25 bp, Homo sapien
atacttgaatccaggcatttgagac

SEQ ID NO: 55672 - DNA, 25 bp, Homo sapien
tagtatgtatgtgtacctaagggag

SEQ ID NO: 55673 - DNA, 25 bp, Homo sapien
acctaagggagtagtgtcactgctt

SEQ ID NO: 55674 - DNA, 25 bp, Homo sapien
agggagtagtgtcactgcttgttat

SEQ ID NO: 55675 - DNA, 25 bp, Homo sapien
cactgcttgttatgcatcatttcag

SEQ ID NO: 55676 - DNA, 25 bp, Homo sapien
ttgttatgcatcatttcaggagtta

SEQ ID NO: 55677 - DNA, 25 bp, Homo sapien
tggaaaccaggaactctggagttca

SEQ ID NO: 55678 - DNA, 25 bp, Homo sapien
gagttcatcagagttatggtgccga

SEQ ID NO: 55679 - DNA, 25 bp, Homo sapien
tatggtgccgaattgtctttggtgc

SEQ ID NO: 55680 - DNA, 25 bp, Homo sapien
gccgaattgtctttggtgcttttca

SEQ ID NO: 55681 - DNA, 25 bp, Homo sapien
gtctttggtgcttttcacttgtgtt

SEQ ID NO: 55682 - DNA, 25 bp, Homo sapien
tggtgcttttcacttgtgttttaaa

SEQ ID NO: 55683 - DNA, 25 bp, Homo sapien
agagacaggcagctcggattcaact

SEQ ID NO: 55684 - DNA, 25 bp, Homo sapien
agacaggcagctcggattcaactac

SEQ ID NO: 55685 - DNA, 25 bp, Homo sapien
aggcagctcggattcaactacctta

SEQ ID NO: 55686 - DNA, 25 bp, Homo sapien
gcagctcggattcaactaccttaga

SEQ ID NO: 55687 - DNA, 25 bp, Homo sapien
agctcggattcaactaccttagata

SEQ ID NO: 55688 - DNA, 25 bp, Homo sapien
ctcggattcaactaccttagataat

SEQ ID NO: 55689 - DNA, 25 bp, Homo sapien
caactaccttagataatatttctga

SEQ ID NO: 55690 - DNA, 25 bp, Homo sapien
accagccagagggtagggcacaaag

SEQ ID NO: 55691 - DNA, 25 bp, Homo sapien
gcacaaagatggatgtaatgcactt

SEQ ID NO: 55692 - DNA, 25 bp, Homo sapien
tttaaagaccaatttatgggagaat

SEQ ID NO: 55693 - DNA, 25 bp, Homo sapien
ccaatttatgggagaattgcacaca

SEQ ID NO: 55694 - DNA, 25 bp, Homo sapien
cgcagccagccggtgcctggcgccc

SEQ ID NO: 55695 - DNA, 25 bp, Homo sapien
cctctccaaacaccggcagaaaacg

SEQ ID NO: 55696 - DNA, 25 bp, Homo sapien
tccaaacaccggcagaaaacggaga

SEQ ID NO: 55697 - DNA, 25 bp, Homo sapien
ccaaacaccggcagaaaacggagag

SEQ ID NO: 55698 - DNA, 25 bp, Homo sapien
caaacaccggcagaaaacggagagt

SEQ ID NO: 55699 - DNA, 25 bp, Homo sapien
aaacaccggcagaaaacggagagtg

SEQ ID NO: 55700 - DNA, 25 bp, Homo sapien
aacaccggcagaaaacggagagtgc

SEQ ID NO: 55701 - DNA, 25 bp, Homo sapien
acaccggcagaaaacggagagtgct

SEQ ID NO: 55702 - DNA, 25 bp, Homo sapien
caccggcagaaaacggagagtgctt

SEQ ID NO: 55703 - DNA, 25 bp, Homo sapien
accggcagaaaacggagagtgcttg

SEQ ID NO: 55704 - DNA, 25 bp, Homo sapien
cagaaaacggagagtgcttgggtgg

SEQ ID NO: 55705 - DNA, 25 bp, Homo sapien
tcattgatccagcagacaccagact

SEQ ID NO: 55706 - DNA, 25 bp, Homo sapien
acaccagactggtcttgggtctcag

SEQ ID NO: 55707 - DNA, 25 bp, Homo sapien
cttgggtctcagttttagtgcagcc

SEQ ID NO: 55708 - DNA, 25 bp, Homo sapien
gtctcagttttagtgcagccctcaa

SEQ ID NO: 55709 - DNA, 25 bp, Homo sapien
agccctcaacgcaccaatagagaag

SEQ ID NO: 55710 - DNA, 25 bp, Homo sapien
tagagaagactgacttcggtatctt

SEQ ID NO: 55711 - DNA, 25 bp, Homo sapien
gacttcggtatcttcaggatgtaac

SEQ ID NO: 55712 - DNA, 25 bp, Homo sapien
ggatgttttctgttggacatgtact

SEQ ID NO: 55713 - DNA, 25 bp, Homo sapien
taacacatgtagtagccttaaaatt

SEQ ID NO: 55714 - DNA, 25 bp, Homo sapien
tagacttctcgaacatgaggctgtt

SEQ ID NO: 55715 - DNA, 25 bp, Homo sapien
aacactgtgcattgtacttttctac

SEQ ID NO: 55716 - DNA, 25 bp, Homo sapien
gctcgacaaagatgacatgggcgat

SEQ ID NO: 55717 - DNA, 25 bp, Homo sapien
catgggcgatgagcagcgtggcagc

SEQ ID NO: 55718 - DNA, 25 bp, Homo sapien
aaagcgggagcgcagtgaccccaac

SEQ ID NO: 55719 - DNA, 25 bp, Homo sapien
ggcgcctcctcgaggttccaaaaga

SEQ ID NO: 55720 - DNA, 25 bp, Homo sapien
gaggttccaaaagatgccgcctggt

SEQ ID NO: 55721 - DNA, 25 bp, Homo sapien
agatgccgcctggtcactctgggaa

SEQ ID NO: 55722 - DNA, 25 bp, Homo sapien
actctgggaacctggatttcaccgg

SEQ ID NO: 55723 - DNA, 25 bp, Homo sapien
atttcaccggctccaccaaattagt

SEQ ID NO: 55724 - DNA, 25 bp, Homo sapien
gctccaccaaattagtgcctcttag

SEQ ID NO: 55725 - DNA, 25 bp, Homo sapien
gtgatgtttactttgactcaagcgg

SEQ ID NO: 55726 - DNA, 25 bp, Homo sapien
gctcccggggtcagtgttcaagaag

SEQ ID NO: 55727 - DNA, 25 bp, Homo sapien
aaagcatatcactagccaaagaggg

SEQ ID NO: 55728 - DNA, 25 bp, Homo sapien
gttcttcttactgtgcctatattaa

SEQ ID NO: 55729 - DNA, 25 bp, Homo sapien
gtgcctatattaagactagtacaaa

SEQ ID NO: 55730 - DNA, 25 bp, Homo sapien
acaaatgtggtgtgtcttccaactt

SEQ ID NO: 55731 - DNA, 25 bp, Homo sapien
atgtggtgtgtcttccaactttcat

SEQ ID NO: 55732 - DNA, 25 bp, Homo sapien
gaaaatgccatatctataccatatt

SEQ ID NO: 55733 - DNA, 25 bp, Homo sapien
taccatattttattcgagtcactga

SEQ ID NO: 55734 - DNA, 25 bp, Homo sapien
ttcgagtcactgatgatgtaatgat

SEQ ID NO: 55735 - DNA, 25 bp, Homo sapien
atttgtggtcttgatcatacctatt

SEQ ID NO: 55736 - DNA, 25 bp, Homo sapien
aaaataatgccaaacaccaaatatg

SEQ ID NO: 55737 - DNA, 25 bp, Homo sapien
gaattttatgatgtacactttgtgc

SEQ ID NO: 55738 - DNA, 25 bp, Homo sapien
agtggatggccttgtgtccctcggg

SEQ ID NO: 55739 - DNA, 25 bp, Homo sapien
tgtgtccctcgggcatgacaggcag

SEQ ID NO: 55740 - DNA, 25 bp, Homo sapien
acaggcagaaacgagggctgctcca

SEQ ID NO: 55741 - DNA, 25 bp, Homo sapien
aagggagcattcctagacccctggg

SEQ ID NO: 55742 - DNA, 25 bp, Homo sapien
gagcattcctagacccctgggtgct

SEQ ID NO: 55743 - DNA, 25 bp, Homo sapien
agacccctgggtgcttgtctgcaca

SEQ ID NO: 55744 - DNA, 25 bp, Homo sapien
gtgcttgtctgcacagagctctggt

SEQ ID NO: 55745 - DNA, 25 bp, Homo sapien
acactgtgtgggagggcacagcaca

SEQ ID NO: 55746 - DNA, 25 bp, Homo sapien
agggcacagcacagctgcgggtaaa

SEQ ID NO: 55747 - DNA, 25 bp, Homo sapien
cacagcacagctgcgggtaaagtgt

SEQ ID NO: 55748 - DNA, 25 bp, Homo sapien
gggtaaagtgtgagagcttgccatc

SEQ ID NO: 55749 - DNA, 25 bp, Homo sapien
cacaacgtgtgcaccctgacattgg

SEQ ID NO: 55750 - DNA, 25 bp, Homo sapien
aacgtgtgcaccctgacattggcat

SEQ ID NO: 55751 - DNA, 25 bp, Homo sapien
gtgcaccctgacattggcatctctg

SEQ ID NO: 55752 - DNA, 25 bp, Homo sapien
tcatgaactcgtttgtaaacgacgt

SEQ ID NO: 55753 - DNA, 25 bp, Homo sapien
aaacgacgtgtttgagcagctggcg

SEQ ID NO: 55754 - DNA, 25 bp, Homo sapien
gagcagctggcgtgtgaggctgccc

SEQ ID NO: 55755 - DNA, 25 bp, Homo sapien
ggaccaccctgacatcccgagaagt

SEQ ID NO: 55756 - DNA, 25 bp, Homo sapien
gacatcccgagaagtccagacggct

SEQ ID NO: 55757 - DNA, 25 bp, Homo sapien
atcccgagaagtccagacggctgtg

SEQ ID NO: 55758 - DNA, 25 bp, Homo sapien
cagctccaagtgacccagggcctga

SEQ ID NO: 55759 - DNA, 25 bp, Homo sapien
tccaagtgacccagggcctgacaaa

SEQ ID NO: 55760 - DNA, 25 bp, Homo sapien
cagcttcaagcagtattggaacaga

SEQ ID NO: 55761 - DNA, 25 bp, Homo sapien
gaacagaggagagcccaacaacgtt

SEQ ID NO: 55762 - DNA, 25 bp, Homo sapien
gggaggaagactgcgcggaatttag

SEQ ID NO: 55763 - DNA, 25 bp, Homo sapien
agtggcaatggctggaacgacgaca

SEQ ID NO: 55764 - DNA, 25 bp, Homo sapien
ggcaatggctggaacgacgacaaat

SEQ ID NO: 55765 - DNA, 25 bp, Homo sapien
ggctggaacgacgacaaatgtaatc

SEQ ID NO: 55766 - DNA, 25 bp, Homo sapien
gacgacaaatgtaatcttgccaaat

SEQ ID NO: 55767 - DNA, 25 bp, Homo sapien
gtaatcttgccaaattctggatctg

SEQ ID NO: 55768 - DNA, 25 bp, Homo sapien
tctgcaaaaagtccgcagcctcctg

SEQ ID NO: 55769 - DNA, 25 bp, Homo sapien
agcctcctgctccagggatgaagaa

SEQ ID NO: 55770 - DNA, 25 bp, Homo sapien
cctgctccagggatgaagaacagtt

SEQ ID NO: 55771 - DNA, 25 bp, Homo sapien
tccccttgggtgaaaatagtctctt

SEQ ID NO: 55772 - DNA, 25 bp, Homo sapien
aaaatagtctcttctcctgttgggt

SEQ ID NO: 55773 - DNA, 25 bp, Homo sapien
gtctcttctcctgttgggtatcaaa

SEQ ID NO: 55774 - DNA, 25 bp, Homo sapien
aaggttcagaacgtagtctctactc

SEQ ID NO: 55775 - DNA, 25 bp, Homo sapien
cctgcctgcatcaactgttgcaaat

SEQ ID NO: 55776 - DNA, 25 bp, Homo sapien
aactgttgcaaatcccgtttctctc

SEQ ID NO: 55777 - DNA, 25 bp, Homo sapien
aattatactttattcaggtgatggt

SEQ ID NO: 55778 - DNA, 25 bp, Homo sapien
tgatggttacatgaacagcccagac

SEQ ID NO: 55779 - DNA, 25 bp, Homo sapien
ccaatgattcttgacatcttttcac

SEQ ID NO: 55780 - DNA, 25 bp, Homo sapien
atcttttcacttcacgtagtcctaa

SEQ ID NO: 55781 - DNA, 25 bp, Homo sapien
gtagtcctaagtccctgtgacctgc

SEQ ID NO: 55782 - DNA, 25 bp, Homo sapien
acacaccgtcctacactttaagctg

SEQ ID NO: 55783 - DNA, 25 bp, Homo sapien
tacactttaagctgctcctttggta

SEQ ID NO: 55784 - DNA, 25 bp, Homo sapien
taagctgctcctttggtatgactct

SEQ ID NO: 55785 - DNA, 25 bp, Homo sapien
gctgctcctttggtatgactctata

SEQ ID NO: 55786 - DNA, 25 bp, Homo sapien
tatgactctatacttatggaaatgt

SEQ ID NO: 55787 - DNA, 25 bp, Homo sapien
cacattttgatttattaggtactag

SEQ ID NO: 55788 - DNA, 25 bp, Homo sapien
tattaggtactagcactgaggaaaa

SEQ ID NO: 55789 - DNA, 25 bp, Homo sapien
aaaaaattcagcacttggactatca

SEQ ID NO: 55790 - DNA, 25 bp, Homo sapien
ttcagcacttggactatcataggat

SEQ ID NO: 55791 - DNA, 25 bp, Homo sapien
ataggatgagtaaaacttttcttgt

SEQ ID NO: 55792 - DNA, 25 bp, Homo sapien
aaaggttgtactcattgtatttaca

SEQ ID NO: 55793 - DNA, 25 bp, Homo sapien
actggccatccacgccatggatatc

SEQ ID NO: 55794 - DNA, 25 bp, Homo sapien
ggccaccttcatccgaaagttctac

SEQ ID NO: 55795 - DNA, 25 bp, Homo sapien
ttcatccgaaagttctacacagagt

SEQ ID NO: 55796 - DNA, 25 bp, Homo sapien
gttctacacagagtttgatcggcgt

SEQ ID NO: 55797 - DNA, 25 bp, Homo sapien
gtttgatcggcgtaacaaccgcatt

SEQ ID NO: 55798 - DNA, 25 bp, Homo sapien
atcggcgtaacaaccgcattggctt

SEQ ID NO: 55799 - DNA, 25 bp, Homo sapien
taacaaccgcattggcttcgccttg

SEQ ID NO: 55800 - DNA, 25 bp, Homo sapien
attggcttcgccttggcccgctgag

SEQ ID NO: 55801 - DNA, 25 bp, Homo sapien
gaacactctctgagatgcccctctg

SEQ ID NO: 55802 - DNA, 25 bp, Homo sapien
gcctgggcttatgccctcagatgga

SEQ ID NO: 55803 - DNA, 25 bp, Homo sapien
agacattggatgtggagctcctgct

SEQ ID NO: 55804 - DNA, 25 bp, Homo sapien
gagtgcctatacatcctgtccagcc

SEQ ID NO: 55805 - DNA, 25 bp, Homo sapien
tatacatcctgtccagccacgacat

SEQ ID NO: 55806 - DNA, 25 bp, Homo sapien
tccagccacgacattgagcagcacg

SEQ ID NO: 55807 - DNA, 25 bp, Homo sapien
aggcctgcgaggagtacctcagcca

SEQ ID NO: 55808 - DNA, 25 bp, Homo sapien
gaggagtacctcagccagatccaca

SEQ ID NO: 55809 - DNA, 25 bp, Homo sapien
agccagatccacagttgccaaacgt

SEQ ID NO: 55810 - DNA, 25 bp, Homo sapien
agttgccaaacgttgcaggaccgca

SEQ ID NO: 55811 - DNA, 25 bp, Homo sapien
aaacgttgcaggaccgcacggagaa

SEQ ID NO: 55812 - DNA, 25 bp, Homo sapien
agatcgtagggtggatgcccctgat

SEQ ID NO: 55813 - DNA, 25 bp, Homo sapien
tgatggccgcacagaaggacttctt

SEQ ID NO: 55814 - DNA, 25 bp, Homo sapien
cctggacatgctgcagagggctgaa

SEQ ID NO: 55815 - DNA, 25 bp, Homo sapien
ttaaattgtacttcagagtctatat

SEQ ID NO: 55816 - DNA, 25 bp, Homo sapien
gagtctatatttcaagggcacattt

SEQ ID NO: 55817 - DNA, 25 bp, Homo sapien
ttcaagggcacattttctcactact

SEQ ID NO: 55818 - DNA, 25 bp, Homo sapien
aatcacttgctttatatgtttcatt

SEQ ID NO: 55819 - DNA, 25 bp, Homo sapien
gaataccaatgaaacatacaacttg

SEQ ID NO: 55820 - DNA, 25 bp, Homo sapien
attttggaagatcccatttctaatt

SEQ ID NO: 55821 - DNA, 25 bp, Homo sapien
atcccatttctaattggagatctct

SEQ ID NO: 55822 - DNA, 25 bp, Homo sapien
ggagatctctttaatttcgatcaac

SEQ ID NO: 55823 - DNA, 25 bp, Homo sapien
atttcgatcaacttataatgtgtag

SEQ ID NO: 55824 - DNA, 25 bp, Homo sapien
gtgtagtactatattaagtgcactt

SEQ ID NO: 55825 - DNA, 25 bp, Homo sapien
gtgcacttgagtgggattcaacatt

SEQ ID NO: 55826 - DNA, 25 bp, Homo sapien
ggagcacaccggaggagccaacagc

SEQ ID NO: 55827 - DNA, 25 bp, Homo sapien
cggtctttggcctccaggtttatga

SEQ ID NO: 55828 - DNA, 25 bp, Homo sapien
ctttggcctccaggtttatgatgaa

SEQ ID NO: 55829 - DNA, 25 bp, Homo sapien
gggaaattcaccttcgatgttgaga

SEQ ID NO: 55830 - DNA, 25 bp, Homo sapien
atcggagattcagactttccacctg

SEQ ID NO: 55831 - DNA, 25 bp, Homo sapien
tcagactttccacctgcagaatgac

SEQ ID NO: 55832 - DNA, 25 bp, Homo sapien
agctgcctttcccaaggtgaagatc

SEQ ID NO: 55833 - DNA, 25 bp, Homo sapien
gtgaagatccagattctaagcaact

SEQ ID NO: 55834 - DNA, 25 bp, Homo sapien
gtttcacgtgcttgtatcgagtccg

SEQ ID NO: 55835 - DNA, 25 bp, Homo sapien
gcttgtatcgagtccgtgcccacgg

SEQ ID NO: 55836 - DNA, 25 bp, Homo sapien
gtgcccacggtgtgcgaacctcaga

SEQ ID NO: 55837 - DNA, 25 bp, Homo sapien
tacctctgtgccgtgagagactaca

SEQ ID NO: 55838 - DNA, 25 bp, Homo sapien
acctctgtgccgtgagagactacaa

SEQ ID NO: 55839 - DNA, 25 bp, Homo sapien
cctctgtgccgtgagagactacaag

SEQ ID NO: 55840 - DNA, 25 bp, Homo sapien
ctctgtgccgtgagagactacaagc

SEQ ID NO: 55841 - DNA, 25 bp, Homo sapien
tctgtgccgtgagagactacaagct

SEQ ID NO: 55842 - DNA, 25 bp, Homo sapien
ctgtgccgtgagagactacaagctc

SEQ ID NO: 55843 - DNA, 25 bp, Homo sapien
tgtgccgtgagagactacaagctca

SEQ ID NO: 55844 - DNA, 25 bp, Homo sapien
gtgccgtgagagactacaagctcag

SEQ ID NO: 55845 - DNA, 25 bp, Homo sapien
tgccgtgagagactacaagctcagc

SEQ ID NO: 55846 - DNA, 25 bp, Homo sapien
gtgaattttcatctagttccccaat

SEQ ID NO: 55847 - DNA, 25 bp, Homo sapien
tagttccccaatcgatgctctcagg

SEQ ID NO: 55848 - DNA, 25 bp, Homo sapien
aatcgatgctctcagggtcatctcg

SEQ ID NO: 55849 - DNA, 25 bp, Homo sapien
gatcacagggatccttaaatctcca

SEQ ID NO: 55850 - DNA, 25 bp, Homo sapien
gatccttaaatctccattctgtttg

SEQ ID NO: 55851 - DNA, 25 bp, Homo sapien
ttcttcttgcagttctgggagtaaa

SEQ ID NO: 55852 - DNA, 25 bp, Homo sapien
gctcccagcatatttagataatagg

SEQ ID NO: 55853 - DNA, 25 bp, Homo sapien
tctagactggattatgctcacatgc

SEQ ID NO: 55854 - DNA, 25 bp, Homo sapien
tgctcccttgccctgacatttttgt

SEQ ID NO: 55855 - DNA, 25 bp, Homo sapien
tgtgccctttgctgtagctacactt

SEQ ID NO: 55856 - DNA, 25 bp, Homo sapien
ttgctgtagctacacttcagattaa

SEQ ID NO: 55857 - DNA, 25 bp, Homo sapien
tttgtcttgcgggtctgtcagggtt

SEQ ID NO: 55858 - DNA, 25 bp, Homo sapien
cggtttgcatttacgcctgtaaatg

SEQ ID NO: 55859 - DNA, 25 bp, Homo sapien
ggtttgcatttacgcctgtaaatgt

SEQ ID NO: 55860 - DNA, 25 bp, Homo sapien
gtttgcatttacgcctgtaaatgta

SEQ ID NO: 55861 - DNA, 25 bp, Homo sapien
tttgcatttacgcctgtaaatgtat

SEQ ID NO: 55862 - DNA, 25 bp, Homo sapien
ttgcatttacgcctgtaaatgtatt

SEQ ID NO: 55863 - DNA, 25 bp, Homo sapien
tgcatttacgcctgtaaatgtattc

SEQ ID NO: 55864 - DNA, 25 bp, Homo sapien
gcatttacgcctgtaaatgtattca

SEQ ID NO: 55865 - DNA, 25 bp, Homo sapien
tcagatgatggctacatcaagatct

SEQ ID NO: 55866 - DNA, 25 bp, Homo sapien
tgatggctacatcaagatctatgat

SEQ ID NO: 55867 - DNA, 25 bp, Homo sapien
gatggctacatcaagatctatgatg

SEQ ID NO: 55868 - DNA, 25 bp, Homo sapien
tcaagatctatgatgtacaacatgc

SEQ ID NO: 55869 - DNA, 25 bp, Homo sapien
agatctatgatgtacaacatgccaa

SEQ ID NO: 55870 - DNA, 25 bp, Homo sapien
gatctatgatgtacaacatgccaat

SEQ ID NO: 55871 - DNA, 25 bp, Homo sapien
tctatgatgtacaacatgccaattt

SEQ ID NO: 55872 - DNA, 25 bp, Homo sapien
tcactttgtttccagttcgtctgac

SEQ ID NO: 55873 - DNA, 25 bp, Homo sapien
cactttgtttccagttcgtctgaca

SEQ ID NO: 55874 - DNA, 25 bp, Homo sapien
actttgtttccagttcgtctgacaa

SEQ ID NO: 55875 - DNA, 25 bp, Homo sapien
ctttgtttccagttcgtctgacaaa

SEQ ID NO: 55876 - DNA, 25 bp, Homo sapien
ggtgctatgaggtgatccgtcccca

SEQ ID NO: 55877 - DNA, 25 bp, Homo sapien
gaggtgatccgtccccacacatggg

SEQ ID NO: 55878 - DNA, 25 bp, Homo sapien
tccagagcccgcaaatggactcgga

SEQ ID NO: 55879 - DNA, 25 bp, Homo sapien
agcccgcaaatggactcggagccga

SEQ ID NO: 55880 - DNA, 25 bp, Homo sapien
aaatggactcggagccgagggcctc

SEQ ID NO: 55881 - DNA, 25 bp, Homo sapien
cctcccagcagagcttgggaagggc

SEQ ID NO: 55882 - DNA, 25 bp, Homo sapien
catggacccaactgggccccagaag

SEQ ID NO: 55883 - DNA, 25 bp, Homo sapien
ccagaagagccacaggaacatcatt

SEQ ID NO: 55884 - DNA, 25 bp, Homo sapien
gagccacaggaacatcattcctctc

SEQ ID NO: 55885 - DNA, 25 bp, Homo sapien
caaagggcctggagtagaaggacaa

SEQ ID NO: 55886 - DNA, 25 bp, Homo sapien
aaggacaacagggcagcaacttgga

SEQ ID NO: 55887 - DNA, 25 bp, Homo sapien
aaatcttccaactgtcctctagagt

SEQ ID NO: 55888 - DNA, 25 bp, Homo sapien
tcttccaactgtcctctagagtgtg

SEQ ID NO: 55889 - DNA, 25 bp, Homo sapien
ccaactgtcctctagagtgtgaata

SEQ ID NO: 55890 - DNA, 25 bp, Homo sapien
tgtcctctagagtgtgaatatatga

SEQ ID NO: 55891 - DNA, 25 bp, Homo sapien
gggaaagccttcacacagccttttg

SEQ ID NO: 55892 - DNA, 25 bp, Homo sapien
aagccttcacacagccttttgagca

SEQ ID NO: 55893 - DNA, 25 bp, Homo sapien
ttcacacagccttttgagcacacat

SEQ ID NO: 55894 - DNA, 25 bp, Homo sapien
acacagccttttgagcacacatgag

SEQ ID NO: 55895 - DNA, 25 bp, Homo sapien
acagccttttgagcacacatgagaa

SEQ ID NO: 55896 - DNA, 25 bp, Homo sapien
aattcttcatcctagttcttttgtt

SEQ ID NO: 55897 - DNA, 25 bp, Homo sapien
cttcatcctagttcttttgttgttg

SEQ ID NO: 55898 - DNA, 25 bp, Homo sapien
tttcttccaagcctagagccaccag

SEQ ID NO: 55899 - DNA, 25 bp, Homo sapien
cttctctggaaaagcctggaaactg

SEQ ID NO: 55900 - DNA, 25 bp, Homo sapien
tctggaaaagcctggaaactgggca

SEQ ID NO: 55901 - DNA, 25 bp, Homo sapien
gaaggactgtgtgcctgggtctaac

SEQ ID NO: 55902 - DNA, 25 bp, Homo sapien
aggactgtgtgcctgggtctaacat

SEQ ID NO: 55903 - DNA, 25 bp, Homo sapien
gactgtgtgcctgggtctaacatgt

SEQ ID NO: 55904 - DNA, 25 bp, Homo sapien
tgtgcctgggtctaacatgtggtcc

SEQ ID NO: 55905 - DNA, 25 bp, Homo sapien
gcctgggtctaacatgtggtcccct

SEQ ID NO: 55906 - DNA, 25 bp, Homo sapien
gtctaacatgtggtcccctttgtcc

SEQ ID NO: 55907 - DNA, 25 bp, Homo sapien
ctaacatgtggtcccctttgtccct

SEQ ID NO: 55908 - DNA, 25 bp, Homo sapien
aattggagggcagcttgcctggacc

SEQ ID NO: 55909 - DNA, 25 bp, Homo sapien
cccttccagggcatcttgtggacat

SEQ ID NO: 55910 - DNA, 25 bp, Homo sapien
ccttccagggcatcttgtggacatg

SEQ ID NO: 55911 - DNA, 25 bp, Homo sapien
cttccagggcatcttgtggacatga

SEQ ID NO: 55912 - DNA, 25 bp, Homo sapien
catcttgtggacatgagcggcacca

SEQ ID NO: 55913 - DNA, 25 bp, Homo sapien
atcttgtggacatgagcggcaccag

SEQ ID NO: 55914 - DNA, 25 bp, Homo sapien
tcttgtggacatgagcggcaccagg

SEQ ID NO: 55915 - DNA, 25 bp, Homo sapien
cttgtggacatgagcggcaccagga

SEQ ID NO: 55916 - DNA, 25 bp, Homo sapien
ttgtggacatgagcggcaccaggac

SEQ ID NO: 55917 - DNA, 25 bp, Homo sapien
tgtggacatgagcggcaccaggacc

SEQ ID NO: 55918 - DNA, 25 bp, Homo sapien
tgggctccatattctctgttcacaa

SEQ ID NO: 55919 - DNA, 25 bp, Homo sapien
tctctgttcacaattgtcctttcat

SEQ ID NO: 55920 - DNA, 25 bp, Homo sapien
ttattcctcagcaacaggtcctaaa

SEQ ID NO: 55921 - DNA, 25 bp, Homo sapien
attgcattttggcttcagtggttca

SEQ ID NO: 55922 - DNA, 25 bp, Homo sapien
ggcttcagtggttcaattcctttgt

SEQ ID NO: 55923 - DNA, 25 bp, Homo sapien
ttgtcaatcctcttttgtatccatt

SEQ ID NO: 55924 - DNA, 25 bp, Homo sapien
gtatccattgtgtcacaagcgcttt

SEQ ID NO: 55925 - DNA, 25 bp, Homo sapien
aagcgctttcaaaaggctttcttga

SEQ ID NO: 55926 - DNA, 25 bp, Homo sapien
tctaccatcacaacacagtcggtca

SEQ ID NO: 55927 - DNA, 25 bp, Homo sapien
acagtcggtcagtatcttcttaaag

SEQ ID NO: 55928 - DNA, 25 bp, Homo sapien
caagtcactggccattctcttaggg

SEQ ID NO: 55929 - DNA, 25 bp, Homo sapien
ttcccttggctggaactactggaca

SEQ ID NO: 55930 - DNA, 25 bp, Homo sapien
tggaactactggacagacccttttg

SEQ ID NO: 55931 - DNA, 25 bp, Homo sapien
gaactactggacagacccttttgag

SEQ ID NO: 55932 - DNA, 25 bp, Homo sapien
actactggacagacccttttgagat

SEQ ID NO: 55933 - DNA, 25 bp, Homo sapien
actggacagacccttttgagatgtg

SEQ ID NO: 55934 - DNA, 25 bp, Homo sapien
ggacagacccttttgagatgtgcct

SEQ ID NO: 55935 - DNA, 25 bp, Homo sapien
gacagacccttttgagatgtgcctg

SEQ ID NO: 55936 - DNA, 25 bp, Homo sapien
agacccttttgagatgtgcctgtgg

SEQ ID NO: 55937 - DNA, 25 bp, Homo sapien
ccttttgagatgtgcctgtggtgct

SEQ ID NO: 55938 - DNA, 25 bp, Homo sapien
tgcctgtggtgctgtggagatgtgt

SEQ ID NO: 55939 - DNA, 25 bp, Homo sapien
agatgtgtgtagtggtcttagctct

SEQ ID NO: 55940 - DNA, 25 bp, Homo sapien
caggagagagatcatcactccctgc

SEQ ID NO: 55941 - DNA, 25 bp, Homo sapien
tgccttttaccctggcacttcaggc

SEQ ID NO: 55942 - DNA, 25 bp, Homo sapien
acttcaggctcctgttccggatgtg

SEQ ID NO: 55943 - DNA, 25 bp, Homo sapien
tcctgttccggatgtgggtccctct

SEQ ID NO: 55944 - DNA, 25 bp, Homo sapien
tcctggcaggcctcgtggctgctga

SEQ ID NO: 55945 - DNA, 25 bp, Homo sapien
gatgcggtggcatcgctgctcatcg

SEQ ID NO: 55946 - DNA, 25 bp, Homo sapien
agccccgcccaagaagatggcaaag

SEQ ID NO: 55947 - DNA, 25 bp, Homo sapien
aagtctacatcaacatgccaggcag

SEQ ID NO: 55948 - DNA, 25 bp, Homo sapien
tgatccatctgggtcacatcctctt

SEQ ID NO: 55949 - DNA, 25 bp, Homo sapien
tcccagtggctgcagctcagacgac

SEQ ID NO: 55950 - DNA, 25 bp, Homo sapien
gcagctcagacgaccccaggagaga

SEQ ID NO: 55951 - DNA, 25 bp, Homo sapien
gttgggtcacttacctaagaaattg

SEQ ID NO: 55952 - DNA, 25 bp, Homo sapien
gaaattgagctattgttctttacat

SEQ ID NO: 55953 - DNA, 25 bp, Homo sapien
tctttacatttgcatgtgtcttttg

SEQ ID NO: 55954 - DNA, 25 bp, Homo sapien
gggcaaaatgttgcctagactttgc

SEQ ID NO: 55955 - DNA, 25 bp, Homo sapien
gactttgctcttaaatgttgttcta

SEQ ID NO: 55956 - DNA, 25 bp, Homo sapien
ttctaataatctcagctgcattgta

SEQ ID NO: 55957 - DNA, 25 bp, Homo sapien
gctgcattgtaaaccgttcctacac

SEQ ID NO: 55958 - DNA, 25 bp, Homo sapien
acacatagtgccttaaatatttgag

SEQ ID NO: 55959 - DNA, 25 bp, Homo sapien
gcagcacttaaaattcagacctact

SEQ ID NO: 55960 - DNA, 25 bp, Homo sapien
tcagacctactatttagtttccttt

SEQ ID NO: 55961 - DNA, 25 bp, Homo sapien
agtttccttttgatagcgtaatgtt

SEQ ID NO: 55962 - DNA, 25 bp, Homo sapien
agctttaaatttgtagaactcatct

SEQ ID NO: 55963 - DNA, 25 bp, Homo sapien
gtaaattctgctgtgactaatccaa

SEQ ID NO: 55964 - DNA, 25 bp, Homo sapien
ctgctgtgactaatccaatatactc

SEQ ID NO: 55965 - DNA, 25 bp, Homo sapien
tatactcagaatgttatccatctaa

SEQ ID NO: 55966 - DNA, 25 bp, Homo sapien
atgttatccatctaaagcatttttc

SEQ ID NO: 55967 - DNA, 25 bp, Homo sapien
aagataacttttagcacatgcttaa

SEQ ID NO: 55968 - DNA, 25 bp, Homo sapien
atatcaaagcagttgtcatttggaa

SEQ ID NO: 55969 - DNA, 25 bp, Homo sapien
gtcatttggaagtcacttgtgaata

SEQ ID NO: 55970 - DNA, 25 bp, Homo sapien
caagctgatattgctacatcgtgtt

SEQ ID NO: 55971 - DNA, 25 bp, Homo sapien
attgctacatcgtgttcatctggat

SEQ ID NO: 55972 - DNA, 25 bp, Homo sapien
catcgtgttcatctggatgtattag

SEQ ID NO: 55973 - DNA, 25 bp, Homo sapien
caggagggcggcttcacccttcgta

SEQ ID NO: 55974 - DNA, 25 bp, Homo sapien
tcacccttcgtaaccaggagacaag

SEQ ID NO: 55975 - DNA, 25 bp, Homo sapien
cgtaaccaggagacaaggcggccat

SEQ ID NO: 55976 - DNA, 25 bp, Homo sapien
aaggcggccatggatttgcccttga

SEQ ID NO: 55977 - DNA, 25 bp, Homo sapien
catggatttgcccttgattctattt

SEQ ID NO: 55978 - DNA, 25 bp, Homo sapien
gcccttgattctattttgctaatgg

SEQ ID NO: 55979 - DNA, 25 bp, Homo sapien
ttttttaacattctgaagatggtgc

SEQ ID NO: 55980 - DNA, 25 bp, Homo sapien
ggatctatggcctctggtgctttgt

SEQ ID NO: 55981 - DNA, 25 bp, Homo sapien
atggcctctggtgctttgtcctgta

SEQ ID NO: 55982 - DNA, 25 bp, Homo sapien
tctggtgctttgtcctgtatttggt

SEQ ID NO: 55983 - DNA, 25 bp, Homo sapien
aatgtttttgtcctaatctcttcaa

SEQ ID NO: 55984 - DNA, 25 bp, Homo sapien
aaggccgggacttgggcatcgcctt

SEQ ID NO: 55985 - DNA, 25 bp, Homo sapien
ggacttgggcatcgcctttaatttt

SEQ ID NO: 55986 - DNA, 25 bp, Homo sapien
ttgggcatcgcctttaattttctat

SEQ ID NO: 55987 - DNA, 25 bp, Homo sapien
gggcatcgcctttaattttctatgt

SEQ ID NO: 55988 - DNA, 25 bp, Homo sapien
atcgcctttaattttctatgttgta

SEQ ID NO: 55989 - DNA, 25 bp, Homo sapien
taatagatgtgtttagtttaccgta

SEQ ID NO: 55990 - DNA, 25 bp, Homo sapien
gatgtgtttagtttaccgtaagctg

SEQ ID NO: 55991 - DNA, 25 bp, Homo sapien
tagtttaccgtaagctgaagcactg

SEQ ID NO: 55992 - DNA, 25 bp, Homo sapien
tttaccgtaagctgaagcactgggt

SEQ ID NO: 55993 - DNA, 25 bp, Homo sapien
ccgtaagctgaagcactgggtgaat

SEQ ID NO: 55994 - DNA, 25 bp, Homo sapien
agctgaagcactgggtgaatatttt

SEQ ID NO: 55995 - DNA, 25 bp, Homo sapien
gcaatggttctgttcaatcattcag

SEQ ID NO: 55996 - DNA, 25 bp, Homo sapien
agactgcatgttgaaacctttcttt

SEQ ID NO: 55997 - DNA, 25 bp, Homo sapien
gttactgaactgcttggttaaacta

SEQ ID NO: 55998 - DNA, 25 bp, Homo sapien
ggaaccatgtgctaatttttcacaa

SEQ ID NO: 55999 - DNA, 25 bp, Homo sapien
tgacctgtattgattgccactgtag

SEQ ID NO: 56000 - DNA, 25 bp, Homo sapien
gccactgtagtttggtatttccctt

SEQ ID NO: 56001 - DNA, 25 bp, Homo sapien
ttccctcatgccctggaatacaact

SEQ ID NO: 56002 - DNA, 25 bp, Homo sapien
gaatacaactcagagctccaggcag

SEQ ID NO: 56003 - DNA, 25 bp, Homo sapien
caggcagcggaaccatctattgttt

SEQ ID NO: 56004 - DNA, 25 bp, Homo sapien
gtttgccagaaagtgcaccctgtat

SEQ ID NO: 56005 - DNA, 25 bp, Homo sapien
ctgtatggtctcctgtctaagttgg

SEQ ID NO: 56006 - DNA, 25 bp, Homo sapien
tggctcagtcttttccccttgaagt

SEQ ID NO: 56007 - DNA, 25 bp, Homo sapien
tttccccttgaagttctctaataga

SEQ ID NO: 56008 - DNA, 25 bp, Homo sapien
ttttgacaaaagatcgcctatgagt

SEQ ID NO: 56009 - DNA, 25 bp, Homo sapien
atcgcctatgagttacaagcaccag

SEQ ID NO: 56010 - DNA, 25 bp, Homo sapien
ggatgctctacatcaagggatgcac

SEQ ID NO: 56011 - DNA, 25 bp, Homo sapien
agggatgcaccttcagtcaaactgt

SEQ ID NO: 56012 - DNA, 25 bp, Homo sapien
gcccagaattcccaaaggcattagg

SEQ ID NO: 56013 - DNA, 25 bp, Homo sapien
gtttcccaactgctttgtgctgata

SEQ ID NO: 56014 - DNA, 25 bp, Homo sapien
gtttctgatgacttatgttctacaa

SEQ ID NO: 56015 - DNA, 25 bp, Homo sapien
tgttctacaatctatggacatacgg

SEQ ID NO: 56016 - DNA, 25 bp, Homo sapien
cttgctttgaagctacctggatatt

SEQ ID NO: 56017 - DNA, 25 bp, Homo sapien
ttttaaattgtacttcagagtctat

SEQ ID NO: 56018 - DNA, 25 bp, Homo sapien
ttcagagtctatatttcaagggcac

SEQ ID NO: 56019 - DNA, 25 bp, Homo sapien
gtctatatttcaagggcacattttc

SEQ ID NO: 56020 - DNA, 25 bp, Homo sapien
gaataccaatgaaacatacaacttg

SEQ ID NO: 56021 - DNA, 25 bp, Homo sapien
attttggaagatcccatttctaatt

SEQ ID NO: 56022 - DNA, 25 bp, Homo sapien
ggaagatcccatttctaattggaga

SEQ ID NO: 56023 - DNA, 25 bp, Homo sapien
cccatttctaattggagatctcttt

SEQ ID NO: 56024 - DNA, 25 bp, Homo sapien
ggagatctctttaatttcgatcaac

SEQ ID NO: 56025 - DNA, 25 bp, Homo sapien
atttcgatcaacttataatgtgtag

SEQ ID NO: 56026 - DNA, 25 bp, Homo sapien
gtgtagtactatattaagtgcactt

SEQ ID NO: 56027 - DNA, 25 bp, Homo sapien
gtgcacttgagtgggattcaacatt

SEQ ID NO: 56028 - DNA, 25 bp, Homo sapien
ccaattttattggactaaatagtca

SEQ ID NO: 56029 - DNA, 25 bp, Homo sapien
ggactaaatagtcaaaacaatgttt

SEQ ID NO: 56030 - DNA, 25 bp, Homo sapien
gactaaatagtcaaaacaatgtttt

SEQ ID NO: 56031 - DNA, 25 bp, Homo sapien
tgcttttgctccctaagtgccccag

SEQ ID NO: 56032 - DNA, 25 bp, Homo sapien
gcttttgctccctaagtgccccaga

SEQ ID NO: 56033 - DNA, 25 bp, Homo sapien
tttgctccctaagtgccccagaatt

SEQ ID NO: 56034 - DNA, 25 bp, Homo sapien
ttgctccctaagtgccccagaattg

SEQ ID NO: 56035 - DNA, 25 bp, Homo sapien
ctaagtgccccagaattgggaaact

SEQ ID NO: 56036 - DNA, 25 bp, Homo sapien
attgggaaactattcaggagtattc

SEQ ID NO: 56037 - DNA, 25 bp, Homo sapien
gaaactattcaggagtattcatatg

SEQ ID NO: 56038 - DNA, 25 bp, Homo sapien
aaactattcaggagtattcatatgt

SEQ ID NO: 56039 - DNA, 25 bp, Homo sapien
ccccagagcggaagtactcagtctg

SEQ ID NO: 56040 - DNA, 25 bp, Homo sapien
gagcggaagtactcagtctggatcg

SEQ ID NO: 56041 - DNA, 25 bp, Homo sapien
tgagtatgatgaggcagggccctcc

SEQ ID NO: 56042 - DNA, 25 bp, Homo sapien
agggccctccattgtccacaggaag

SEQ ID NO: 56043 - DNA, 25 bp, Homo sapien
cattgtccacaggaagtgcttctaa

SEQ ID NO: 56044 - DNA, 25 bp, Homo sapien
gtgcttctaaagtcagaacaggttc

SEQ ID NO: 56045 - DNA, 25 bp, Homo sapien
agaacaggttctccaaggatcccct

SEQ ID NO: 56046 - DNA, 25 bp, Homo sapien
aggttctccaaggatcccctcgaga

SEQ ID NO: 56047 - DNA, 25 bp, Homo sapien
aaggatcccctcgagactactctgt

SEQ ID NO: 56048 - DNA, 25 bp, Homo sapien
gatcccctcgagactactctgttac

SEQ ID NO: 56049 - DNA, 25 bp, Homo sapien
atatgccaacaatgtcctctctggg

SEQ ID NO: 56050 - DNA, 25 bp, Homo sapien
tcgcctcagatgatgtgaatctggg

SEQ ID NO: 56051 - DNA, 25 bp, Homo sapien
aagggcgggtcaggcccacagcctt

SEQ ID NO: 56052 - DNA, 25 bp, Homo sapien
aaaccagctccagatgggttttctc

SEQ ID NO: 56053 - DNA, 25 bp, Homo sapien
ggaatggagcagagcctgtacccct

SEQ ID NO: 56054 - DNA, 25 bp, Homo sapien
atggagcagagcctgtacccctaac

SEQ ID NO: 56055 - DNA, 25 bp, Homo sapien
tggagcagagcctgtacccctaacc

SEQ ID NO: 56056 - DNA, 25 bp, Homo sapien
aggacctcagccttatataatcatt

SEQ ID NO: 56057 - DNA, 25 bp, Homo sapien
gcccaccagtggctatggcaacagc

SEQ ID NO: 56058 - DNA, 25 bp, Homo sapien
caccagtggctatggcaacagcttt

SEQ ID NO: 56059 - DNA, 25 bp, Homo sapien
ggtatcagcatcactcctcagatgt

SEQ ID NO: 56060 - DNA, 25 bp, Homo sapien
gtatcagcatcactcctcagatgtc

SEQ ID NO: 56061 - DNA, 25 bp, Homo sapien
tcaggatacagaaatctgctgtgtt

SEQ ID NO: 56062 - DNA, 25 bp, Homo sapien
ctgctgtgttttgactagttatccc

SEQ ID NO: 56063 - DNA, 25 bp, Homo sapien
gatgtgcttaatttatggtgtaact

SEQ ID NO: 56064 - DNA, 25 bp, Homo sapien
aaagattttgtttgtgtaatgcatg

SEQ ID NO: 56065 - DNA, 25 bp, Homo sapien
cttccgagaaacttttctgatcagt

SEQ ID NO: 56066 - DNA, 25 bp, Homo sapien
ttctgatcagtttgcgagttttgat

SEQ ID NO: 56067 - DNA, 25 bp, Homo sapien
atcagtttgcgagttttgatgagtt

SEQ ID NO: 56068 - DNA, 25 bp, Homo sapien
tgttttacaaactatgaatcagcaa

SEQ ID NO: 56069 - DNA, 25 bp, Homo sapien
gcaaatttttaagattgtaccacat

SEQ ID NO: 56070 - DNA, 25 bp, Homo sapien
agattgtaccacatagcaaacatac

SEQ ID NO: 56071 - DNA, 25 bp, Homo sapien
catagcaaacatacagctgttgaaa

SEQ ID NO: 56072 - DNA, 25 bp, Homo sapien
agggaggtgccagcactcgcatcat

SEQ ID NO: 56073 - DNA, 25 bp, Homo sapien
tcgcatcatgcttcccgagaacggc

SEQ ID NO: 56074 - DNA, 25 bp, Homo sapien
accctttagctaccttgaacttcag

SEQ ID NO: 56075 - DNA, 25 bp, Homo sapien
agctaccttgaacttcagcggtacg

SEQ ID NO: 56076 - DNA, 25 bp, Homo sapien
aagcaacaaatccacagcccctgat

SEQ ID NO: 56077 - DNA, 25 bp, Homo sapien
aaagtacttcctactgttggccgag

SEQ ID NO: 56078 - DNA, 25 bp, Homo sapien
gaggccaactcactggtcaatgctg

SEQ ID NO: 56079 - DNA, 25 bp, Homo sapien
ggtcaatgctgctgtgtactcttgc

SEQ ID NO: 56080 - DNA, 25 bp, Homo sapien
tgtactcttgccgagatgctgagat

SEQ ID NO: 56081 - DNA, 25 bp, Homo sapien
gagatgctgagatgcgccgcacctt

SEQ ID NO: 56082 - DNA, 25 bp, Homo sapien
gagtctgtccactatacatcctctg

SEQ ID NO: 56083 - DNA, 25 bp, Homo sapien
gcgcttgctgcgttcacactctctg

SEQ ID NO: 56084 - DNA, 25 bp, Homo sapien
tctctgcactacctcttcatgggtg

SEQ ID NO: 56085 - DNA, 25 bp, Homo sapien
ctcagagcaggaccttggtctttcc

SEQ ID NO: 56086 - DNA, 25 bp, Homo sapien
gaagctttgggctacgtggatgacc

SEQ ID NO: 56087 - DNA, 25 bp, Homo sapien
tgcccagccgtcaaaagagtcttaa

SEQ ID NO: 56088 - DNA, 25 bp, Homo sapien
atatccagatggcatgtgtttactt

SEQ ID NO: 56089 - DNA, 25 bp, Homo sapien
gtgtttactttatgttactacatgc

SEQ ID NO: 56090 - DNA, 25 bp, Homo sapien
tatgttactacatgcacttggctgc

SEQ ID NO: 56091 - DNA, 25 bp, Homo sapien
actacatgcacttggctgcataaat

SEQ ID NO: 56092 - DNA, 25 bp, Homo sapien
aaatgtggtacaagcattctgtctt

SEQ ID NO: 56093 - DNA, 25 bp, Homo sapien
attctgtcttgaagggcaggtgctt

SEQ ID NO: 56094 - DNA, 25 bp, Homo sapien
caccgtctggcaccctagtcattgg

SEQ ID NO: 56095 - DNA, 25 bp, Homo sapien
gtggaattgctgtttttgtcgtcat

SEQ ID NO: 56096 - DNA, 25 bp, Homo sapien
ggaattgctgtttttgtcgtcatct

SEQ ID NO: 56097 - DNA, 25 bp, Homo sapien
aattgctgtttttgtcgtcatcttg

SEQ ID NO: 56098 - DNA, 25 bp, Homo sapien
ttgctgtttttgtcgtcatcttgtt

SEQ ID NO: 56099 - DNA, 25 bp, Homo sapien
ctgtttttgtcgtcatcttgttcat

SEQ ID NO: 56100 - DNA, 25 bp, Homo sapien
gtttttgtcgtcatcttgttcattg

SEQ ID NO: 56101 - DNA, 25 bp, Homo sapien
ttttgtcgtcatcttgttcattgga

SEQ ID NO: 56102 - DNA, 25 bp, Homo sapien
gggcactacgtcttagctgaacgtg

SEQ ID NO: 56103 - DNA, 25 bp, Homo sapien
gcactacgtcttagctgaacgtgag

SEQ ID NO: 56104 - DNA, 25 bp, Homo sapien
tacgtcttagctgaacgtgagtgac

SEQ ID NO: 56105 - DNA, 25 bp, Homo sapien
gtgctaaattattaagagtctcttt

SEQ ID NO: 56106 - DNA, 25 bp, Homo sapien
aagagtctctttttgaaacatgcgg

SEQ ID NO: 56107 - DNA, 25 bp, Homo sapien
agtctctttttgaaacatgcgggtt

SEQ ID NO: 56108 - DNA, 25 bp, Homo sapien
aacatgcgggtttgaaatatgacac

SEQ ID NO: 56109 - DNA, 25 bp, Homo sapien
aaatatgacaccttgtgggtttcca

SEQ ID NO: 56110 - DNA, 25 bp, Homo sapien
tatgacaccttgtgggtttccatat

SEQ ID NO: 56111 - DNA, 25 bp, Homo sapien
gacaccttgtgggtttccatattaa

SEQ ID NO: 56112 - DNA, 25 bp, Homo sapien
aaatcctcactctttaattgtcatt

SEQ ID NO: 56113 - DNA, 25 bp, Homo sapien
atgagttccatgatatgtggtctaa

SEQ ID NO: 56114 - DNA, 25 bp, Homo sapien
gttccatgatatgtggtctaagaaa

SEQ ID NO: 56115 - DNA, 25 bp, Homo sapien
ttttcttataagttcgttgtgtcta

SEQ ID NO: 56116 - DNA, 25 bp, Homo sapien
aagacgaagggatgctgcagttcca

SEQ ID NO: 56117 - DNA, 25 bp, Homo sapien
ttctgtgcctcagccgttcttgaca

SEQ ID NO: 56118 - DNA, 25 bp, Homo sapien
tgtgcctcagccgttcttgacatca

SEQ ID NO: 56119 - DNA, 25 bp, Homo sapien
gcctcagccgttcttgacatcaaga

SEQ ID NO: 56120 - DNA, 25 bp, Homo sapien
ctcagccgttcttgacatcaagaat

SEQ ID NO: 56121 - DNA, 25 bp, Homo sapien
cagatgtagcaacatgaaagacgct

SEQ ID NO: 56122 - DNA, 25 bp, Homo sapien
gaaagacgctatgttacaggttaca

SEQ ID NO: 56123 - DNA, 25 bp, Homo sapien
gacgctatgttacaggttacatgag

SEQ ID NO: 56124 - DNA, 25 bp, Homo sapien
ctatgttacaggttacatgagagca

SEQ ID NO: 56125 - DNA, 25 bp, Homo sapien
atgagagcaatcatgtaagtctata

SEQ ID NO: 56126 - DNA, 25 bp, Homo sapien
gagcaatcatgtaagtctatatgac

SEQ ID NO: 56127 - DNA, 25 bp, Homo sapien
gaagtcaagaaactaaggaaggccg

SEQ ID NO: 56128 - DNA, 25 bp, Homo sapien
tcaagaaactaaggaaggccgggtg

SEQ ID NO: 56129 - DNA, 25 bp, Homo sapien
gtggctcccgcctgtaatccagcac

SEQ ID NO: 56130 - DNA, 25 bp, Homo sapien
aggtgggcggatcatctgtggtcag

SEQ ID NO: 56131 - DNA, 25 bp, Homo sapien
ggtgggcggatcatctgtggtcagg

SEQ ID NO: 56132 - DNA, 25 bp, Homo sapien
cgtgcacctgtagtcccggctactt

SEQ ID NO: 56133 - DNA, 25 bp, Homo sapien
gtgcacctgtagtcccggctacttg

SEQ ID NO: 56134 - DNA, 25 bp, Homo sapien
tgcacctgtagtcccggctacttgg

SEQ ID NO: 56135 - DNA, 25 bp, Homo sapien
tgcgcacctccccttgagtggagtg

SEQ ID NO: 56136 - DNA, 25 bp, Homo sapien
tggagtgcctctcatgatccttgac

SEQ ID NO: 56137 - DNA, 25 bp, Homo sapien
gagtgcctctcatgatccttgacga

SEQ ID NO: 56138 - DNA, 25 bp, Homo sapien
accatgggaatccaatctgttgcag

SEQ ID NO: 56139 - DNA, 25 bp, Homo sapien
ggaatccaatctgttgcagtctcct

SEQ ID NO: 56140 - DNA, 25 bp, Homo sapien
agatatttaaatttcttagtgcttc

SEQ ID NO: 56141 - DNA, 25 bp, Homo sapien
ttagtgcttcagagtttgtgtgtat

SEQ ID NO: 56142 - DNA, 25 bp, Homo sapien
tagtgcttcagagtttgtgtgtatt

SEQ ID NO: 56143 - DNA, 25 bp, Homo sapien
agtgcttcagagtttgtgtgtattt

SEQ ID NO: 56144 - DNA, 25 bp, Homo sapien
gtgcttcagagtttgtgtgtatttg

SEQ ID NO: 56145 - DNA, 25 bp, Homo sapien
tgcttcagagtttgtgtgtatttgt

SEQ ID NO: 56146 - DNA, 25 bp, Homo sapien
ttagtgcttttgcaagttcaatttg

SEQ ID NO: 56147 - DNA, 25 bp, Homo sapien
gttcaatttgttagttcctgtatga

SEQ ID NO: 56148 - DNA, 25 bp, Homo sapien
tagttcctgtatgaaagattgtggg

SEQ ID NO: 56149 - DNA, 25 bp, Homo sapien
tcgtgccgttagctttttccgtaat

SEQ ID NO: 56150 - DNA, 25 bp, Homo sapien
taataacacccttccttctgtaaat

SEQ ID NO: 56151 - DNA, 25 bp, Homo sapien
tccttctgtaaatacccgttaccat

SEQ ID NO: 56152 - DNA, 25 bp, Homo sapien
atacccgttaccatatttatccatt

SEQ ID NO: 56153 - DNA, 25 bp, Homo sapien
atggtattaacttgctacagaggaa

SEQ ID NO: 56154 - DNA, 25 bp, Homo sapien
caattgtgggcataaactgttttag

SEQ ID NO: 56155 - DNA, 25 bp, Homo sapien
gaaggttttaagtggtttgatcatt

SEQ ID NO: 56156 - DNA, 25 bp, Homo sapien
tcatttcttgtgatgttttgagagt

SEQ ID NO: 56157 - DNA, 25 bp, Homo sapien
ttttttcttatgacagaagcaaatg

SEQ ID NO: 56158 - DNA, 25 bp, Homo sapien
atacaggtacccaaagagtaaatca

SEQ ID NO: 56159 - DNA, 25 bp, Homo sapien
gagtaaatcaacatctgtatacccc

SEQ ID NO: 56160 - DNA, 25 bp, Homo sapien
gtaagcactgttaccaatttagcat

SEQ ID NO: 56161 - DNA, 25 bp, Homo sapien
agcactgttaccaatttagcatatg

SEQ ID NO: 56162 - DNA, 25 bp, Homo sapien
gttaccaatttagcatatgtccttg

SEQ ID NO: 56163 - DNA, 25 bp, Homo sapien
ccaatttagcatatgtccttgcaga

SEQ ID NO: 56164 - DNA, 25 bp, Homo sapien
tagcatatgtccttgcagaattttt

SEQ ID NO: 56165 - DNA, 25 bp, Homo sapien
gaatcattactctatgttgttttac

SEQ ID NO: 56166 - DNA, 25 bp, Homo sapien
ttactctatgttgttttactatttg

SEQ ID NO: 56167 - DNA, 25 bp, Homo sapien
tttgtttgacatatcagtatatctg

SEQ ID NO: 56168 - DNA, 25 bp, Homo sapien
acttttggtggagacttggatgtca

SEQ ID NO: 56169 - DNA, 25 bp, Homo sapien
ggatgtcatatcttctttgttttgg

SEQ ID NO: 56170 - DNA, 25 bp, Homo sapien
tttcttccctagcttattttgtggc

SEQ ID NO: 56171 - DNA, 25 bp, Homo sapien
attgtgagatcctgtgattcctggt

SEQ ID NO: 56172 - DNA, 25 bp, Homo sapien
gtgattcctggtggccagtatcctg

SEQ ID NO: 56173 - DNA, 25 bp, Homo sapien
gccagtatcctggattcctctaaga

SEQ ID NO: 56174 - DNA, 25 bp, Homo sapien
gattcctctaagatcttgcctcttt

SEQ ID NO: 56175 - DNA, 25 bp, Homo sapien
cctcctcatgaaagcagcacacatt

SEQ ID NO: 56176 - DNA, 25 bp, Homo sapien
cattgtgttaacttatgtctcttgt

SEQ ID NO: 56177 - DNA, 25 bp, Homo sapien
atgtctcttgttaaatgagcttaat

SEQ ID NO: 56178 - DNA, 25 bp, Homo sapien
atgtctttgtgttttgtccaaaact

SEQ ID NO: 56179 - DNA, 25 bp, Homo sapien
gggactgtgtcctcgccaccccccg

SEQ ID NO: 56180 - DNA, 25 bp, Homo sapien
agtgcagcttggatctcgggggtgt

SEQ ID NO: 56181 - DNA, 25 bp, Homo sapien
gtgcagcttggatctcgggggtgtg

SEQ ID NO: 56182 - DNA, 25 bp, Homo sapien
tgcagcttggatctcgggggtgtgg

SEQ ID NO: 56183 - DNA, 25 bp, Homo sapien
ggggccctgtgccttcctgaagtgc

SEQ ID NO: 56184 - DNA, 25 bp, Homo sapien
tattcccctagtgtgcccaagtcag

SEQ ID NO: 56185 - DNA, 25 bp, Homo sapien
attcccctagtgtgcccaagtcagc

SEQ ID NO: 56186 - DNA, 25 bp, Homo sapien
ttcccctagtgtgcccaagtcagcc

SEQ ID NO: 56187 - DNA, 25 bp, Homo sapien
ctgggcggacagcttgtctggactt

SEQ ID NO: 56188 - DNA, 25 bp, Homo sapien
ggggtggtcagacaccacaggagct

SEQ ID NO: 56189 - DNA, 25 bp, Homo sapien
aacaagtattgtcaggtattctctc

SEQ ID NO: 56190 - DNA, 25 bp, Homo sapien
aagtattgtcaggtattctctccat

SEQ ID NO: 56191 - DNA, 25 bp, Homo sapien
agtattgtcaggtattctctccata

SEQ ID NO: 56192 - DNA, 25 bp, Homo sapien
gtattgtcaggtattctctccatag

SEQ ID NO: 56193 - DNA, 25 bp, Homo sapien
tattgtcaggtattctctccataga

SEQ ID NO: 56194 - DNA, 25 bp, Homo sapien
attgtcaggtattctctccatagaa

SEQ ID NO: 56195 - DNA, 25 bp, Homo sapien
ttgtcaggtattctctccatagaac

SEQ ID NO: 56196 - DNA, 25 bp, Homo sapien
gtcaggtattctctccatagaacag

SEQ ID NO: 56197 - DNA, 25 bp, Homo sapien
caggtattctctccatagaacagca

SEQ ID NO: 56198 - DNA, 25 bp, Homo sapien
ggtattctctccatagaacagcact

SEQ ID NO: 56199 - DNA, 25 bp, Homo sapien
gtattctctccatagaacagcacta

SEQ ID NO: 56200 - DNA, 25 bp, Homo sapien
accaagctggagtgggaaaggcaca

SEQ ID NO: 56201 - DNA, 25 bp, Homo sapien
aaaggcacaagattcgggccaggca

SEQ ID NO: 56202 - DNA, 25 bp, Homo sapien
tggagagggactgccctgcacagct

SEQ ID NO: 56203 - DNA, 25 bp, Homo sapien
ggagaggtgttttggaccaacaagt

SEQ ID NO: 56204 - DNA, 25 bp, Homo sapien
gtgcctcctttggtgaaggtgacac

SEQ ID NO: 56205 - DNA, 25 bp, Homo sapien
tgacacatcatgtgagccaccctgc

SEQ ID NO: 56206 - DNA, 25 bp, Homo sapien
tgcccagccgtcaaaagagtcttaa

SEQ ID NO: 56207 - DNA, 25 bp, Homo sapien
atatccagatggcatgtgtttactt

SEQ ID NO: 56208 - DNA, 25 bp, Homo sapien
tatgttactacatgcacttggctgc

SEQ ID NO: 56209 - DNA, 25 bp, Homo sapien
aaatgtggtacaagcattctgtctt

SEQ ID NO: 56210 - DNA, 25 bp, Homo sapien
attctgtcttgaagggcaggtgctt

SEQ ID NO: 56211 - DNA, 25 bp, Homo sapien
catctgttgcttgggatgagaggct

SEQ ID NO: 56212 - DNA, 25 bp, Homo sapien
tctgttgcttgggatgagaggcttc

SEQ ID NO: 56213 - DNA, 25 bp, Homo sapien
gatgagaggcttctagacaaactct

SEQ ID NO: 56214 - DNA, 25 bp, Homo sapien
gagaggcttctagacaaactctata

SEQ ID NO: 56215 - DNA, 25 bp, Homo sapien
gaggcttctagacaaactctatact

SEQ ID NO: 56216 - DNA, 25 bp, Homo sapien
ggcttctagacaaactctatactga

SEQ ID NO: 56217 - DNA, 25 bp, Homo sapien
gcttctagacaaactctatactgaa

SEQ ID NO: 56218 - DNA, 25 bp, Homo sapien
cactctctacctgacagagaaaaag

SEQ ID NO: 56219 - DNA, 25 bp, Homo sapien
cctgacagagaaaaagtacagccct

SEQ ID NO: 56220 - DNA, 25 bp, Homo sapien
tccttctcttcatcaagaaacttgc

SEQ ID NO: 56221 - DNA, 25 bp, Homo sapien
ttctcttcatcaagaaacttgcaag

SEQ ID NO: 56222 - DNA, 25 bp, Homo sapien
attagtccggcgtggtggcacactc

SEQ ID NO: 56223 - DNA, 25 bp, Homo sapien
ttagtccggcgtggtggcacactcc

SEQ ID NO: 56224 - DNA, 25 bp, Homo sapien
tagtccggcgtggtggcacactcct

SEQ ID NO: 56225 - DNA, 25 bp, Homo sapien
agtccggcgtggtggcacactcctg

SEQ ID NO: 56226 - DNA, 25 bp, Homo sapien
gtccggcgtggtggcacactcctgt

SEQ ID NO: 56227 - DNA, 25 bp, Homo sapien
tccggcgtggtggcacactcctgta

SEQ ID NO: 56228 - DNA, 25 bp, Homo sapien
agaatcacttggactccagaggtgg

SEQ ID NO: 56229 - DNA, 25 bp, Homo sapien
atcacttggactccagaggtggagg

SEQ ID NO: 56230 - DNA, 25 bp, Homo sapien
tcacttggactccagaggtggaggt

SEQ ID NO: 56231 - DNA, 25 bp, Homo sapien
ccactgcaccctagcttgggtggca

SEQ ID NO: 56232 - DNA, 25 bp, Homo sapien
gcaccctagcttgggtggcagagca

SEQ ID NO: 56233 - DNA, 25 bp, Homo sapien
agtgaatgtccccattccagtgcct

SEQ ID NO: 56234 - DNA, 25 bp, Homo sapien
aatgtccccattccagtgcctttgc

SEQ ID NO: 56235 - DNA, 25 bp, Homo sapien
tttgccaatgttctcattcaccggc

SEQ ID NO: 56236 - DNA, 25 bp, Homo sapien
atgttctcattcaccggctctcgat

SEQ ID NO: 56237 - DNA, 25 bp, Homo sapien
gggagacaccaatttctatggcaaa

SEQ ID NO: 56238 - DNA, 25 bp, Homo sapien
aatttctatggcaaacagggcatcc

SEQ ID NO: 56239 - DNA, 25 bp, Homo sapien
ggcaaacagggcatccaattctaca

SEQ ID NO: 56240 - DNA, 25 bp, Homo sapien
ggcatccaattctacactcagttaa

SEQ ID NO: 56241 - DNA, 25 bp, Homo sapien
ttctacactcagttaaagaccatta

SEQ ID NO: 56242 - DNA, 25 bp, Homo sapien
aagaccattacttctcagtggaaag

SEQ ID NO: 56243 - DNA, 25 bp, Homo sapien
aaagaagaagatgctactctttcct

SEQ ID NO: 56244 - DNA, 25 bp, Homo sapien
gatggtaattccctgctaagtagca

SEQ ID NO: 56245 - DNA, 25 bp, Homo sapien
gtagcattgaatgttatgaccctat

SEQ ID NO: 56246 - DNA, 25 bp, Homo sapien
tatgaccctatcatcgacagctggg

SEQ ID NO: 56247 - DNA, 25 bp, Homo sapien
gacagctgggaagtcgtgacatcca

SEQ ID NO: 56248 - DNA, 25 bp, Homo sapien
tgggaagtcgtgacatccatgggaa

SEQ ID NO: 56249 - DNA, 25 bp, Homo sapien
catgggaacccagcgctgtgatgct

SEQ ID NO: 56250 - DNA, 25 bp, Homo sapien
tctccgcgagaagtgaccattgttg

SEQ ID NO: 56251 - DNA, 25 bp, Homo sapien
gaccattgttggagcaccatccaga

SEQ ID NO: 56252 - DNA, 25 bp, Homo sapien
atccagagctagtgaccagtccagt

SEQ ID NO: 56253 - DNA, 25 bp, Homo sapien
agctagtgaccagtccagtggacag

SEQ ID NO: 56254 - DNA, 25 bp, Homo sapien
cagtggacagttagtgggagaatca

SEQ ID NO: 56255 - DNA, 25 bp, Homo sapien
tgccagaagctggtgggtgaccgtt

SEQ ID NO: 56256 - DNA, 25 bp, Homo sapien
ggtgaccgttgggaatcggccacac

SEQ ID NO: 56257 - DNA, 25 bp, Homo sapien
ttgggaatcggccacacctggtgtc

SEQ ID NO: 56258 - DNA, 25 bp, Homo sapien
acacctggtgtccatgggcagcctg

SEQ ID NO: 56259 - DNA, 25 bp, Homo sapien
gggcagcctggtgcaattccattca

SEQ ID NO: 56260 - DNA, 25 bp, Homo sapien
ggtgcaattccattcatttgtacag

SEQ ID NO: 56261 - DNA, 25 bp, Homo sapien
gattttgttctagatttcctgtagc

SEQ ID NO: 56262 - DNA, 25 bp, Homo sapien
agatttcctgtagctgtgaattgtt

SEQ ID NO: 56263 - DNA, 25 bp, Homo sapien
gattcaggataaaacgtaaacacgt

SEQ ID NO: 56264 - DNA, 25 bp, Homo sapien
aaacacgtgctgttagtaatttctt

SEQ ID NO: 56265 - DNA, 25 bp, Homo sapien
tagtaatttcttgtggatttcattg

SEQ ID NO: 56266 - DNA, 25 bp, Homo sapien
gtatgagtttcaggtatgtacatgt

SEQ ID NO: 56267 - DNA, 25 bp, Homo sapien
atgagtttcaggtatgtacatgtta

SEQ ID NO: 56268 - DNA, 25 bp, Homo sapien
gagtttcaggtatgtacatgttatg

SEQ ID NO: 56269 - DNA, 25 bp, Homo sapien
tttatgtttaagctcaatattcaaa

SEQ ID NO: 56270 - DNA, 25 bp, Homo sapien
atgtttaagctcaatattcaaacac

SEQ ID NO: 56271 - DNA, 25 bp, Homo sapien
tgttttatgtaagtacagcagcagc

SEQ ID NO: 56272 - DNA, 25 bp, Homo sapien
aaatactgtatttctatggtgattg

SEQ ID NO: 56273 - DNA, 25 bp, Homo sapien
atactgtatttctatggtgattgaa

SEQ ID NO: 56274 - DNA, 25 bp, Homo sapien
actgtatttctatggtgattgaaaa

SEQ ID NO: 56275 - DNA, 25 bp, Homo sapien
tatggtgattgaaaattagtaggca

SEQ ID NO: 56276 - DNA, 25 bp, Homo sapien
aattagtaggcagagaatttttgta

SEQ ID NO: 56277 - DNA, 25 bp, Homo sapien
agagcatctgtgctgaccaggcctg

SEQ ID NO: 56278 - DNA, 25 bp, Homo sapien
caagagggtgcctacaggcggatat

SEQ ID NO: 56279 - DNA, 25 bp, Homo sapien
gcctacaggcggatatgaaaccggt

SEQ ID NO: 56280 - DNA, 25 bp, Homo sapien
atatgaaaccggtgggctggcacct

SEQ ID NO: 56281 - DNA, 25 bp, Homo sapien
tgggcacagtgcttccaggtatgga

SEQ ID NO: 56282 - DNA, 25 bp, Homo sapien
cacagtgcttccaggtatggagaaa

SEQ ID NO: 56283 - DNA, 25 bp, Homo sapien
aaagaggacacgctggccttctcag

SEQ ID NO: 56284 - DNA, 25 bp, Homo sapien
cagcccgctggacttgtaacactac

SEQ ID NO: 56285 - DNA, 25 bp, Homo sapien
gctggacttgtaacactacctcccg

SEQ ID NO: 56286 - DNA, 25 bp, Homo sapien
cacactgttggctctggccgaagct

SEQ ID NO: 56287 - DNA, 25 bp, Homo sapien
actgttggctctggccgaagctcac

SEQ ID NO: 56288 - DNA, 25 bp, Homo sapien
tcgaacctaaagacgtattgcccaa

SEQ ID NO: 56289 - DNA, 25 bp, Homo sapien
acctaaagacgtattgcccaatggg

SEQ ID NO: 56290 - DNA, 25 bp, Homo sapien
atgggacctaccagggctggataac

SEQ ID NO: 56291 - DNA, 25 bp, Homo sapien
taccagggctggataaccttggctg

SEQ ID NO: 56292 - DNA, 25 bp, Homo sapien
gggctggataaccttggctgtaccc

SEQ ID NO: 56293 - DNA, 25 bp, Homo sapien
cagagatatacgtgccaggtggagc

SEQ ID NO: 56294 - DNA, 25 bp, Homo sapien
atatacgtgccaggtggagcaccca

SEQ ID NO: 56295 - DNA, 25 bp, Homo sapien
gtggagcacccaggcctggatcagc

SEQ ID NO: 56296 - DNA, 25 bp, Homo sapien
ggatcagcccctcattgtgatctgg

SEQ ID NO: 56297 - DNA, 25 bp, Homo sapien
attgtgatctgggagccctcaccgt

SEQ ID NO: 56298 - DNA, 25 bp, Homo sapien
ggaattgctgtttttgtcgtcatct

SEQ ID NO: 56299 - DNA, 25 bp, Homo sapien
gcacctgcactaccactttttagag

SEQ ID NO: 56300 - DNA, 25 bp, Homo sapien
gcactaccactttttagaggaaatt

SEQ ID NO: 56301 - DNA, 25 bp, Homo sapien
gaggaaattcactccctcgtaagca

SEQ ID NO: 56302 - DNA, 25 bp, Homo sapien
attcactccctcgtaagcattggaa

SEQ ID NO: 56303 - DNA, 25 bp, Homo sapien
tccctcgtaagcattggaaggtcaa

SEQ ID NO: 56304 - DNA, 25 bp, Homo sapien
caaaaggtaaattagcagcacatat

SEQ ID NO: 56305 - DNA, 25 bp, Homo sapien
tatgatccattttgtatggtctcaa

SEQ ID NO: 56306 - DNA, 25 bp, Homo sapien
atggtctcaaagttggatgacctca

SEQ ID NO: 56307 - DNA, 25 bp, Homo sapien
ggatgacctcattactaatatttgt

SEQ ID NO: 56308 - DNA, 25 bp, Homo sapien
gtgaaacttgtttgccaaccaataa

SEQ ID NO: 56309 - DNA, 25 bp, Homo sapien
gtttgccaaccaataaacaactgat

SEQ ID NO: 56310 - DNA, 25 bp, Homo sapien
tctccaccttcagtttagcgtcatt

SEQ ID NO: 56311 - DNA, 25 bp, Homo sapien
accttcagtttagcgtcattccaaa

SEQ ID NO: 56312 - DNA, 25 bp, Homo sapien
tttagcgtcattccaaaaccacacc

SEQ ID NO: 56313 - DNA, 25 bp, Homo sapien
tttgtactccgcaccccagatgatc

SEQ ID NO: 56314 - DNA, 25 bp, Homo sapien
ttgtagcactcagctccccagccaa

SEQ ID NO: 56315 - DNA, 25 bp, Homo sapien
agccaatctgtacatccctcagagg

SEQ ID NO: 56316 - DNA, 25 bp, Homo sapien
caatctgtacatccctcagaggcag

SEQ ID NO: 56317 - DNA, 25 bp, Homo sapien
atctgtacatccctcagaggcagcg

SEQ ID NO: 56318 - DNA, 25 bp, Homo sapien
ctcagaggcagcgatctgatgaatt

SEQ ID NO: 56319 - DNA, 25 bp, Homo sapien
tggagttggcagtcatcacggtaga

SEQ ID NO: 56320 - DNA, 25 bp, Homo sapien
gcagtcatcacggtagatggcgtat

SEQ ID NO: 56321 - DNA, 25 bp, Homo sapien
gaaacctgagatgcagtgggccaag

SEQ ID NO: 56322 - DNA, 25 bp, Homo sapien
aacactgtgacgagttcagtgctaa

SEQ ID NO: 56323 - DNA, 25 bp, Homo sapien
caggaaatcttacagcacgtgccat

SEQ ID NO: 56324 - DNA, 25 bp, Homo sapien
gtgccatcctaagcctgtgtgtgtg

SEQ ID NO: 56325 - DNA, 25 bp, Homo sapien
cttcttgctggtgatggtcttgctg

SEQ ID NO: 56326 - DNA, 25 bp, Homo sapien
ggacacggtcacatcctccttggga

SEQ ID NO: 56327 - DNA, 25 bp, Homo sapien
tcctccttgggagggtccagtatga

SEQ ID NO: 56328 - DNA, 25 bp, Homo sapien
tgagaggatgacacgtctgccggct

SEQ ID NO: 56329 - DNA, 25 bp, Homo sapien
gcactgtgatgtccacctcataagt

SEQ ID NO: 56330 - DNA, 25 bp, Homo sapien
gatgtccacctcataagtcatgtct

SEQ ID NO: 56331 - DNA, 25 bp, Homo sapien
ataagtcatgtctcttgggcctctt

SEQ ID NO: 56332 - DNA, 25 bp, Homo sapien
aaatctgttggatcctctcagctat

SEQ ID NO: 56333 - DNA, 25 bp, Homo sapien
atctgttggatcctctcagctatct

SEQ ID NO: 56334 - DNA, 25 bp, Homo sapien
tgttggatcctctcagctatctagt

SEQ ID NO: 56335 - DNA, 25 bp, Homo sapien
ttggatcctctcagctatctagttt

SEQ ID NO: 56336 - DNA, 25 bp, Homo sapien
ggatcctctcagctatctagtttca

SEQ ID NO: 56337 - DNA, 25 bp, Homo sapien
atcctctcagctatctagtttcatg

SEQ ID NO: 56338 - DNA, 25 bp, Homo sapien
ctctcagctatctagtttcatggga

SEQ ID NO: 56339 - DNA, 25 bp, Homo sapien
tcagctatctagtttcatgggaagt

SEQ ID NO: 56340 - DNA, 25 bp, Homo sapien
cagctatctagtttcatgggaagtt

SEQ ID NO: 56341 - DNA, 25 bp, Homo sapien
atcacactgaaactttctgtataac

SEQ ID NO: 56342 - DNA, 25 bp, Homo sapien
gaaactttctgtataacttgtatta

SEQ ID NO: 56343 - DNA, 25 bp, Homo sapien
gaaacagctgctgatgctacagtcc

SEQ ID NO: 56344 - DNA, 25 bp, Homo sapien
agctgctgatgctacagtccctgga

SEQ ID NO: 56345 - DNA, 25 bp, Homo sapien
ctgatgctacagtccctggagtgag

SEQ ID NO: 56346 - DNA, 25 bp, Homo sapien
tgctacagtccctggagtgagggca

SEQ ID NO: 56347 - DNA, 25 bp, Homo sapien
tgcctaggaggaagggacccagctg

SEQ ID NO: 56348 - DNA, 25 bp, Homo sapien
ctgggtctgggccacaagggaggag

SEQ ID NO: 56349 - DNA, 25 bp, Homo sapien
aggccaccgtgtgtgtcccgagtaa

SEQ ID NO: 56350 - DNA, 25 bp, Homo sapien
caccgtgtgtgtcccgagtaaccgt

SEQ ID NO: 56351 - DNA, 25 bp, Homo sapien
gtgtgtgtcccgagtaaccgtgccg

SEQ ID NO: 56352 - DNA, 25 bp, Homo sapien
gtgtcccgagtaaccgtgccgttgt

SEQ ID NO: 56353 - DNA, 25 bp, Homo sapien
agtaaccgtgccgttgtcgtgtgat

SEQ ID NO: 56354 - DNA, 25 bp, Homo sapien
gggtacccaggtcgccggtgtggcg

SEQ ID NO: 56355 - DNA, 25 bp, Homo sapien
ccggtgtggcgtggaacctcaagca

SEQ ID NO: 56356 - DNA, 25 bp, Homo sapien
gtgtggcgtggaacctcaagcaggg

SEQ ID NO: 56357 - DNA, 25 bp, Homo sapien
aagcaggggcaattccacctcacca

SEQ ID NO: 56358 - DNA, 25 bp, Homo sapien
agatgcaaggcatctcagcaccctc

SEQ ID NO: 56359 - DNA, 25 bp, Homo sapien
cctggagccagggtgctcgtctgca

SEQ ID NO: 56360 - DNA, 25 bp, Homo sapien
tggagccagggtgctcgtctgcact

SEQ ID NO: 56361 - DNA, 25 bp, Homo sapien
agccagggtgctcgtctgcactcca

SEQ ID NO: 56362 - DNA, 25 bp, Homo sapien
aaggactgggacgcgcagcgcgacg

SEQ ID NO: 56363 - DNA, 25 bp, Homo sapien
ttccgggcacttgcgcggtgggaca

SEQ ID NO: 56364 - DNA, 25 bp, Homo sapien
cacagggccaaggtgtgcttgcgcc

SEQ ID NO: 56365 - DNA, 25 bp, Homo sapien
agtattgtcaggtattctctccata

SEQ ID NO: 56366 - DNA, 25 bp, Homo sapien
tattctctccatagaacagcactac

SEQ ID NO: 56367 - DNA, 25 bp, Homo sapien
taatttccgatttttcctctgcatt

SEQ ID NO: 56368 - DNA, 25 bp, Homo sapien
gcttttctccattgccatgcgacct

SEQ ID NO: 56369 - DNA, 25 bp, Homo sapien
tttctccattgccatgcgacctggt

SEQ ID NO: 56370 - DNA, 25 bp, Homo sapien
ttctccattgccatgcgacctggtc

SEQ ID NO: 56371 - DNA, 25 bp, Homo sapien
tgtactcccctatccgattccgttg

SEQ ID NO: 56372 - DNA, 25 bp, Homo sapien
tcccctatccgattccgttgtatca

SEQ ID NO: 56373 - DNA, 25 bp, Homo sapien
ccctatccgattccgttgtatcagt

SEQ ID NO: 56374 - DNA, 25 bp, Homo sapien
ctatccgattccgttgtatcagtca

SEQ ID NO: 56375 - DNA, 25 bp, Homo sapien
gattccgttgtatcagtcactgaca

SEQ ID NO: 56376 - DNA, 25 bp, Homo sapien
attttaaactcaaccaagctgtgat

SEQ ID NO: 56377 - DNA, 25 bp, Homo sapien
gaatggttactgtttatactgtggt

SEQ ID NO: 56378 - DNA, 25 bp, Homo sapien
gtggtatgtttttgattacagcaga

SEQ ID NO: 56379 - DNA, 25 bp, Homo sapien
gataatgctttcttttccagtcgtc

SEQ ID NO: 56380 - DNA, 25 bp, Homo sapien
tcttttccagtcgtctttgagaata

SEQ ID NO: 56381 - DNA, 25 bp, Homo sapien
aaaatcttcagatgcaatggttttg

SEQ ID NO: 56382 - DNA, 25 bp, Homo sapien
ggttttgtgtagcatcttgtctatc

SEQ ID NO: 56383 - DNA, 25 bp, Homo sapien
gcatcttgtctatcatgttttgtaa

SEQ ID NO: 56384 - DNA, 25 bp, Homo sapien
ggagaagctttgaccaatttgactt

SEQ ID NO: 56385 - DNA, 25 bp, Homo sapien
agagatggaatgtaactttgcttac

SEQ ID NO: 56386 - DNA, 25 bp, Homo sapien
ttaaactcctgcttaaggtgttcta

SEQ ID NO: 56387 - DNA, 25 bp, Homo sapien
gaacattgaaacagttttcctcctt

SEQ ID NO: 56388 - DNA, 25 bp, Homo sapien
cattgaaacagttttcctccttgtc

SEQ ID NO: 56389 - DNA, 25 bp, Homo sapien
gtaatagtcattatatttacctgtt

SEQ ID NO: 56390 - DNA, 25 bp, Homo sapien
tctgtacccacgcataaccactata

SEQ ID NO: 56391 - DNA, 25 bp, Homo sapien
cccacgcataaccactatacatagt

SEQ ID NO: 56392 - DNA, 25 bp, Homo sapien
aaccactatacatagtttcttttgt

SEQ ID NO: 56393 - DNA, 25 bp, Homo sapien
acatagtttcttttgtacttgaata

SEQ ID NO: 56394 - DNA, 25 bp, Homo sapien
acatgaacacagtgccatatgaata

SEQ ID NO: 56395 - DNA, 25 bp, Homo sapien
gaataatttcacatacagaaccttt

SEQ ID NO: 56396 - DNA, 25 bp, Homo sapien
ttttttctctgaagtcctgtggact

SEQ ID NO: 56397 - DNA, 25 bp, Homo sapien
ttctctgaagtcctgtggacttgca

SEQ ID NO: 56398 - DNA, 25 bp, Homo sapien
gacatttctccaagggaaaacgagc

SEQ ID NO: 56399 - DNA, 25 bp, Homo sapien
gaaaacgagctagaggagaccagta

SEQ ID NO: 56400 - DNA, 25 bp, Homo sapien
ggagaccagtacctcaagacaaact

SEQ ID NO: 56401 - DNA, 25 bp, Homo sapien
gacacacatttaatgcagagcggta

SEQ ID NO: 56402 - DNA, 25 bp, Homo sapien
cagagcggtagcaatgacttcagtg

SEQ ID NO: 56403 - DNA, 25 bp, Homo sapien
gacttcagtgctatgccttcactag

SEQ ID NO: 56404 - DNA, 25 bp, Homo sapien
tgctatgccttcactagatattcag

SEQ ID NO: 56405 - DNA, 25 bp, Homo sapien
gccttcactagatattcaggtatgt

SEQ ID NO: 56406 - DNA, 25 bp, Homo sapien
tcaggtatgtatttttctgtccttt

SEQ ID NO: 56407 - DNA, 25 bp, Homo sapien
attccatgattattttgtccttaag

SEQ ID NO: 56408 - DNA, 25 bp, Homo sapien
gattattttgtccttaagtccaaca

SEQ ID NO: 56409 - DNA, 25 bp, Homo sapien
aagtgaagataagttggcaggactc

SEQ ID NO: 56410 - DNA, 25 bp, Homo sapien
gggctctgaccacttcaaagaaggt

SEQ ID NO: 56411 - DNA, 25 bp, Homo sapien
aagaaggttctagccagagtgagtc

SEQ ID NO: 56412 - DNA, 25 bp, Homo sapien
aggatcacagagaggctcagataaa

SEQ ID NO: 56413 - DNA, 25 bp, Homo sapien
aagtgagccctgagaatggcttgga

SEQ ID NO: 56414 - DNA, 25 bp, Homo sapien
agatgtggctattgacctctccagc

SEQ ID NO: 56415 - DNA, 25 bp, Homo sapien
tctgcccggcaggagaccaagaaag

SEQ ID NO: 56416 - DNA, 25 bp, Homo sapien
tggtgctcaaggaggctccaactcc

SEQ ID NO: 56417 - DNA, 25 bp, Homo sapien
aggctccaactccacggcactggag

SEQ ID NO: 56418 - DNA, 25 bp, Homo sapien
gggagccacatgagacccacaggtc

SEQ ID NO: 56419 - DNA, 25 bp, Homo sapien
aggtcccactgtcaaaggctgaaaa

SEQ ID NO: 56420 - DNA, 25 bp, Homo sapien
tcacgcacagctctcagaagctgca

SEQ ID NO: 56421 - DNA, 25 bp, Homo sapien
aagctgcaggcggacgaacatctga

SEQ ID NO: 56422 - DNA, 25 bp, Homo sapien
tgcaggcggacgaacatctgaccaa

SEQ ID NO: 56423 - DNA, 25 bp, Homo sapien
aggcggacgaacatctgaccaaaga

SEQ ID NO: 56424 - DNA, 25 bp, Homo sapien
ggacgaacatctgaccaaagaggtg

SEQ ID NO: 56425 - DNA, 25 bp, Homo sapien
ccaaagaggtgtggtcgaggctcct

SEQ ID NO: 56426 - DNA, 25 bp, Homo sapien
tgtggtcgaggctcctgaaagagaa

SEQ ID NO: 56427 - DNA, 25 bp, Homo sapien
gacagagactgagtcactggcccat

SEQ ID NO: 56428 - DNA, 25 bp, Homo sapien
gagactgagtcactggcccatctct

SEQ ID NO: 56429 - DNA, 25 bp, Homo sapien
actggcccatctctttgctcttgtg

SEQ ID NO: 56430 - DNA, 25 bp, Homo sapien
atctctttgctcttgtgccccaggc

SEQ ID NO: 56431 - DNA, 25 bp, Homo sapien
ggcctggtgagcacagtcagcgtca

SEQ ID NO: 56432 - DNA, 25 bp, Homo sapien
tggtgagcacagtcagcgtcactca

SEQ ID NO: 56433 - DNA, 25 bp, Homo sapien
gtgagcacagtcagcgtcactcagc

SEQ ID NO: 56434 - DNA, 25 bp, Homo sapien
gcacagtcagcgtcactcagcactt

SEQ ID NO: 56435 - DNA, 25 bp, Homo sapien
gactgccacctgctttatgcccaga

SEQ ID NO: 56436 - DNA, 25 bp, Homo sapien
gccacctgctttatgcccagatgga

SEQ ID NO: 56437 - DNA, 25 bp, Homo sapien
cacctgctttatgcccagatggact

SEQ ID NO: 56438 - DNA, 25 bp, Homo sapien
cccagatggactgggctgtgttcca

SEQ ID NO: 56439 - DNA, 25 bp, Homo sapien
gggacattacaggaggccaaataga

SEQ ID NO: 56440 - DNA, 25 bp, Homo sapien
caggaggccaaatagagggatgcta

SEQ ID NO: 56441 - DNA, 25 bp, Homo sapien
gggatgctaggtgtctgggatcggg

SEQ ID NO: 56442 - DNA, 25 bp, Homo sapien
cagacatttctccaagggaaaacga

SEQ ID NO: 56443 - DNA, 25 bp, Homo sapien
atttctccaagggaaaacgagctag

SEQ ID NO: 56444 - DNA, 25 bp, Homo sapien
gaaaacgagctagaggagaccagta

SEQ ID NO: 56445 - DNA, 25 bp, Homo sapien
aacgagctagaggagaccagtacct

SEQ ID NO: 56446 - DNA, 25 bp, Homo sapien
gagctagaggagaccagtacctcaa

SEQ ID NO: 56447 - DNA, 25 bp, Homo sapien
agaggagaccagtacctcaagacaa

SEQ ID NO: 56448 - DNA, 25 bp, Homo sapien
aactgacacacatttaatgcagagc

SEQ ID NO: 56449 - DNA, 25 bp, Homo sapien
cacacatttaatgcagagcggtagc

SEQ ID NO: 56450 - DNA, 25 bp, Homo sapien
aatgcagagcggtagcaatgacttc

SEQ ID NO: 56451 - DNA, 25 bp, Homo sapien
gcagagcggtagcaatgacttcagt

SEQ ID NO: 56452 - DNA, 25 bp, Homo sapien
gagcggtagcaatgacttcagtgct

SEQ ID NO: 56453 - DNA, 25 bp, Homo sapien
gctgctctgagtttgggctgcaagt

SEQ ID NO: 56454 - DNA, 25 bp, Homo sapien
ctgagtttgggctgcaagtgctcac

SEQ ID NO: 56455 - DNA, 25 bp, Homo sapien
cagggtgctatgactgctctggcac

SEQ ID NO: 56456 - DNA, 25 bp, Homo sapien
tatgactgctctggcacccttggat

SEQ ID NO: 56457 - DNA, 25 bp, Homo sapien
actgctctggcacccttggatcagg

SEQ ID NO: 56458 - DNA, 25 bp, Homo sapien
ggcacccttggatcaggccaagcta

SEQ ID NO: 56459 - DNA, 25 bp, Homo sapien
ggatcaggccaagctagactttttc

SEQ ID NO: 56460 - DNA, 25 bp, Homo sapien
caggccaagctagactttttctgag

SEQ ID NO: 56461 - DNA, 25 bp, Homo sapien
gccaagctagactttttctgagcct

SEQ ID NO: 56462 - DNA, 25 bp, Homo sapien
agctagactttttctgagccttcat

SEQ ID NO: 56463 - DNA, 25 bp, Homo sapien
ctagactttttctgagccttcatcc

SEQ ID NO: 56464 - DNA, 25 bp, Homo sapien
ggctagatgtatagcctctactccc

SEQ ID NO: 56465 - DNA, 25 bp, Homo sapien
ttgctcttgaccctgcactgtaagt

SEQ ID NO: 56466 - DNA, 25 bp, Homo sapien
gcactgtaagttgcccttctattag

SEQ ID NO: 56467 - DNA, 25 bp, Homo sapien
agttgcccttctattagcagccaag

SEQ ID NO: 56468 - DNA, 25 bp, Homo sapien
gaaacatgagcttatccagaacggt

SEQ ID NO: 56469 - DNA, 25 bp, Homo sapien
cagaacggtggcagagtctccttgg

SEQ ID NO: 56470 - DNA, 25 bp, Homo sapien
gtctccttggcaatcaaccaacgtt

SEQ ID NO: 56471 - DNA, 25 bp, Homo sapien
aacgttgctatgaaatatgcctcac

SEQ ID NO: 56472 - DNA, 25 bp, Homo sapien
tatgcctcacactgtatagctcatt

SEQ ID NO: 56473 - DNA, 25 bp, Homo sapien
tagctcattataggccgtcaggttt

SEQ ID NO: 56474 - DNA, 25 bp, Homo sapien
atcagaatcctgtttcattggtgac

SEQ ID NO: 56475 - DNA, 25 bp, Homo sapien
agccttgagatgcttcactttcctt

SEQ ID NO: 56476 - DNA, 25 bp, Homo sapien
agatgcttcactttccttctctgta

SEQ ID NO: 56477 - DNA, 25 bp, Homo sapien
tccttctctgtaaccagactttgaa

SEQ ID NO: 56478 - DNA, 25 bp, Homo sapien
ctgtaaccagactttgaaaaattgt

SEQ ID NO: 56479 - DNA, 25 bp, Homo sapien
aaattgttcgtttcatcaggctctg

SEQ ID NO: 56480 - DNA, 25 bp, Homo sapien
ttgttcgtttcatcaggctctgttc

SEQ ID NO: 56481 - DNA, 25 bp, Homo sapien
gtttcatcaggctctgttcctcaat

SEQ ID NO: 56482 - DNA, 25 bp, Homo sapien
ttcatcaggctctgttcctcaatgg

SEQ ID NO: 56483 - DNA, 25 bp, Homo sapien
ttcctcaatggccttttgctacgtg

SEQ ID NO: 56484 - DNA, 25 bp, Homo sapien
tcaatggccttttgctacgtgcctc

SEQ ID NO: 56485 - DNA, 25 bp, Homo sapien
ccttttgctacgtgcctcccgagaa

SEQ ID NO: 56486 - DNA, 25 bp, Homo sapien
ctatggtctgttctgcaagcacacg

SEQ ID NO: 56487 - DNA, 25 bp, Homo sapien
gcaagcacacgcagaaggcacacag

SEQ ID NO: 56488 - DNA, 25 bp, Homo sapien
acacagggacaggacgccccatgga

SEQ ID NO: 56489 - DNA, 25 bp, Homo sapien
atggagccccgaattgaccctcact

SEQ ID NO: 56490 - DNA, 25 bp, Homo sapien
acagtcccgctgtttcctgtgcatt

SEQ ID NO: 56491 - DNA, 25 bp, Homo sapien
tttcctgtgcattcgtgacccgctt

SEQ ID NO: 56492 - DNA, 25 bp, Homo sapien
gtctcctgtctccatcgttggatta

SEQ ID NO: 56493 - DNA, 25 bp, Homo sapien
catcgttggattatctttgaacccc

SEQ ID NO: 56494 - DNA, 25 bp, Homo sapien
ccccttgtgtggatcattttgagcc

SEQ ID NO: 56495 - DNA, 25 bp, Homo sapien
tgtggatcattttgagccgcctggc

SEQ ID NO: 56496 - DNA, 25 bp, Homo sapien
attttgagccgcctggccttgctca

SEQ ID NO: 56497 - DNA, 25 bp, Homo sapien
ccatactgcagtgggttgggttata

SEQ ID NO: 56498 - DNA, 25 bp, Homo sapien
tataatgtccagagatttggtgcca

SEQ ID NO: 56499 - DNA, 25 bp, Homo sapien
tttggtgccaaggatctatgaaatg

SEQ ID NO: 56500 - DNA, 25 bp, Homo sapien
ggtcacgtaaaacccatcaagtttg

SEQ ID NO: 56501 - DNA, 25 bp, Homo sapien
gtttatgtcgggatctgtttgaatt

SEQ ID NO: 56502 - DNA, 25 bp, Homo sapien
atccatttggatgtctgtcaactga

SEQ ID NO: 56503 - DNA, 25 bp, Homo sapien
aactgagacgtgtgattgcagccca

SEQ ID NO: 56504 - DNA, 25 bp, Homo sapien
attgcagcccatggcttttcttcca

SEQ ID NO: 56505 - DNA, 25 bp, Homo sapien
ggagatcatcactttttggcaggtc

SEQ ID NO: 56506 - DNA, 25 bp, Homo sapien
ttggcaggtcatgctaaggaacacc

SEQ ID NO: 56507 - DNA, 25 bp, Homo sapien
taaggaacaccacatgccattatta

SEQ ID NO: 56508 - DNA, 25 bp, Homo sapien
aaacaaaccatgactgaggcaggca

SEQ ID NO: 56509 - DNA, 25 bp, Homo sapien
aaaccatgactgaggcaggcatgga

SEQ ID NO: 56510 - DNA, 25 bp, Homo sapien
aggcaggcatggagttgggcgttag

SEQ ID NO: 56511 - DNA, 25 bp, Homo sapien
gggcctttgctacactgctgacagc

SEQ ID NO: 56512 - DNA, 25 bp, Homo sapien
ctttgctacactgctgacagctata

SEQ ID NO: 56513 - DNA, 25 bp, Homo sapien
tgctgacagctatagggagccccag

SEQ ID NO: 56514 - DNA, 25 bp, Homo sapien
atagctggtgttagggctatctcag

SEQ ID NO: 56515 - DNA, 25 bp, Homo sapien
tggtgttagggctatctcaggcaat

SEQ ID NO: 56516 - DNA, 25 bp, Homo sapien
gtgttagggctatctcaggcaatat

SEQ ID NO: 56517 - DNA, 25 bp, Homo sapien
aaatgatctagatattttcctcttt

SEQ ID NO: 56518 - DNA, 25 bp, Homo sapien
tgatctagatattttcctctttttc

SEQ ID NO: 56519 - DNA, 25 bp, Homo sapien
aaataatttcattgtttctgttact

SEQ ID NO: 56520 - DNA, 25 bp, Homo sapien
taatttcattgtttctgttactaac

SEQ ID NO: 56521 - DNA, 25 bp, Homo sapien
tttcattgtttctgttactaacatt

SEQ ID NO: 56522 - DNA, 25 bp, Homo sapien
ctaacattaaaagtgtgcaaattgt

SEQ ID NO: 56523 - DNA, 25 bp, Homo sapien
gtataaaattaggtacttcgattag

SEQ ID NO: 56524 - DNA, 25 bp, Homo sapien
ttaagcatgcccagttatgccaagc

SEQ ID NO: 56525 - DNA, 25 bp, Homo sapien
aagcatgcccagttatgccaagcat

SEQ ID NO: 56526 - DNA, 25 bp, Homo sapien
gcatgcccagttatgccaagcatag

SEQ ID NO: 56527 - DNA, 25 bp, Homo sapien
atgcccagttatgccaagcatagta

SEQ ID NO: 56528 - DNA, 25 bp, Homo sapien
gcccagttatgccaagcatagtaaa

SEQ ID NO: 56529 - DNA, 25 bp, Homo sapien
tatgaaaaactttgtcttgtcatta

SEQ ID NO: 56530 - DNA, 25 bp, Homo sapien
gggccacagtgcttcgggggagact

SEQ ID NO: 56531 - DNA, 25 bp, Homo sapien
agtgcttcgggggagactctatgca

SEQ ID NO: 56532 - DNA, 25 bp, Homo sapien
gcttcgggggagactctatgcaatt

SEQ ID NO: 56533 - DNA, 25 bp, Homo sapien
ttcgggggagactctatgcaattgc

SEQ ID NO: 56534 - DNA, 25 bp, Homo sapien
tcgggggagactctatgcaattgca

SEQ ID NO: 56535 - DNA, 25 bp, Homo sapien
cgggggagactctatgcaattgcag

SEQ ID NO: 56536 - DNA, 25 bp, Homo sapien
gggagactctatgcaattgcaggat

SEQ ID NO: 56537 - DNA, 25 bp, Homo sapien
ggagactctatgcaattgcaggata

SEQ ID NO: 56538 - DNA, 25 bp, Homo sapien
gagactctatgcaattgcaggatat

SEQ ID NO: 56539 - DNA, 25 bp, Homo sapien
agactctatgcaattgcaggatatg

SEQ ID NO: 56540 - DNA, 25 bp, Homo sapien
gactctatgcaattgcaggatatga

SEQ ID NO: 56541 - DNA, 25 bp, Homo sapien
atacaaccgattcctgaaccctgac

SEQ ID NO: 56542 - DNA, 25 bp, Homo sapien
gattcctgaaccctgacggatcaga

SEQ ID NO: 56543 - DNA, 25 bp, Homo sapien
ggaaacggctgaagaattacaacat

SEQ ID NO: 56544 - DNA, 25 bp, Homo sapien
ggagttatgcggtcaacagcatcaa

SEQ ID NO: 56545 - DNA, 25 bp, Homo sapien
aatttgtgttccttgtgctggtgca

SEQ ID NO: 56546 - DNA, 25 bp, Homo sapien
tgctggtgcacttggacttggagct

SEQ ID NO: 56547 - DNA, 25 bp, Homo sapien
ggacttggagctgatcaacgcagat

SEQ ID NO: 56548 - DNA, 25 bp, Homo sapien
atgtggagatccctgagtttgacct

SEQ ID NO: 56549 - DNA, 25 bp, Homo sapien
agtttgacctcagcaggtacggctt

SEQ ID NO: 56550 - DNA, 25 bp, Homo sapien
gcaggtacggcttcggtctgatgca

SEQ ID NO: 56551 - DNA, 25 bp, Homo sapien
tgatgcagccggaacacgacgtgcc

SEQ ID NO: 56552 - DNA, 25 bp, Homo sapien
ggaaaaccactcacagcctgacact

SEQ ID NO: 56553 - DNA, 25 bp, Homo sapien
ctgacactgggctgactttcttgaa

SEQ ID NO: 56554 - DNA, 25 bp, Homo sapien
gggctgactttcttgaagatcctca

SEQ ID NO: 56555 - DNA, 25 bp, Homo sapien
gaagatcctcatccaattggtgttt

SEQ ID NO: 56556 - DNA, 25 bp, Homo sapien
ggtgtttttcagaagtgttccaata

SEQ ID NO: 56557 - DNA, 25 bp, Homo sapien
gttccaatattatgaattctgtgtt

SEQ ID NO: 56558 - DNA, 25 bp, Homo sapien
aaagcaaccatgcatttactggtca

SEQ ID NO: 56559 - DNA, 25 bp, Homo sapien
gcatttactggtcaatgccttcttg

SEQ ID NO: 56560 - DNA, 25 bp, Homo sapien
tttacttttaatatcctcaccttat

SEQ ID NO: 56561 - DNA, 25 bp, Homo sapien
atatcctcaccttatctaatctttg

SEQ ID NO: 56562 - DNA, 25 bp, Homo sapien
attgcttcattaaggttactttttg

SEQ ID NO: 56563 - DNA, 25 bp, Homo sapien
cccgagggctgcaaggacagcctcg

SEQ ID NO: 56564 - DNA, 25 bp, Homo sapien
gctgcaaggacagcctcgcggtgct

SEQ ID NO: 56565 - DNA, 25 bp, Homo sapien
gcaaggacagcctcgcggtgctgct

SEQ ID NO: 56566 - DNA, 25 bp, Homo sapien
acagcctcgcggtgctgctggagtt

SEQ ID NO: 56567 - DNA, 25 bp, Homo sapien
cagcctcgcggtgctgctggagttc

SEQ ID NO: 56568 - DNA, 25 bp, Homo sapien
gccgagcacgtcttcatctgcttcc

SEQ ID NO: 56569 - DNA, 25 bp, Homo sapien
tgctccgcaccttcggcttcctggg

SEQ ID NO: 56570 - DNA, 25 bp, Homo sapien
ggcttcctgggcttcgagctggtga

SEQ ID NO: 56571 - DNA, 25 bp, Homo sapien
ttcctgggcttcgagctggtgaggc

SEQ ID NO: 56572 - DNA, 25 bp, Homo sapien
tggcctactcgctgcagggctagcg

SEQ ID NO: 56573 - DNA, 25 bp, Homo sapien
cgcggccccgtgtcgtgtttgtgat

SEQ ID NO: 56574 - DNA, 25 bp, Homo sapien
caggcctaagcctgggatttgggcc

SEQ ID NO: 56575 - DNA, 25 bp, Homo sapien
ataagaatccaaactatgaggctag

SEQ ID NO: 56576 - DNA, 25 bp, Homo sapien
gaggctagttcttgtctaactcaag

SEQ ID NO: 56577 - DNA, 25 bp, Homo sapien
ctaactcaagactgttctggaatga

SEQ ID NO: 56578 - DNA, 25 bp, Homo sapien
gaatgagggtccaggcctgtcaacc

SEQ ID NO: 56579 - DNA, 25 bp, Homo sapien
gcaccaaggttgagggacaggatta

SEQ ID NO: 56580 - DNA, 25 bp, Homo sapien
caggattaggcagggtctgtcctgt

SEQ ID NO: 56581 - DNA, 25 bp, Homo sapien
tgtcctgtggccacctggaaagtcc

SEQ ID NO: 56582 - DNA, 25 bp, Homo sapien
aatcccaggtccatactctaggttt

SEQ ID NO: 56583 - DNA, 25 bp, Homo sapien
atactctaggttttggataccatga

SEQ ID NO: 56584 - DNA, 25 bp, Homo sapien
gagtatgtatgtttacctgtgccta

SEQ ID NO: 56585 - DNA, 25 bp, Homo sapien
aaaagacatcccttggtcctggagg

SEQ ID NO: 56586 - DNA, 25 bp, Homo sapien
gtcctggaggcagctatcaaatatc

SEQ ID NO: 56587 - DNA, 25 bp, Homo sapien
atatcagagcatgctccagaggcat

SEQ ID NO: 56588 - DNA, 25 bp, Homo sapien
gagaacatctctaaggacctctaca

SEQ ID NO: 56589 - DNA, 25 bp, Homo sapien
gtatatccagggacctattctgtca

SEQ ID NO: 56590 - DNA, 25 bp, Homo sapien
acctattctgtcactgtgggctcaa

SEQ ID NO: 56591 - DNA, 25 bp, Homo sapien
gtgggctcaaatgacttaaccaaga

SEQ ID NO: 56592 - DNA, 25 bp, Homo sapien
gactcatgtggtagcagttgattct

SEQ ID NO: 56593 - DNA, 25 bp, Homo sapien
attctggacaaagcgtggacctggt

SEQ ID NO: 56594 - DNA, 25 bp, Homo sapien
gtcttccctgtgtgatgttgaccat

SEQ ID NO: 56595 - DNA, 25 bp, Homo sapien
atcactgccatcacatcaccttttt

SEQ ID NO: 56596 - DNA, 25 bp, Homo sapien
agctctctcgaggacacttcaaaag

SEQ ID NO: 56597 - DNA, 25 bp, Homo sapien
gtgccacttgtattcatcagctgac

SEQ ID NO: 56598 - DNA, 25 bp, Homo sapien
ttgtattcatcagctgaccccagag

SEQ ID NO: 56599 - DNA, 25 bp, Homo sapien
gaccccagaggtgttcatttctatt

SEQ ID NO: 56600 - DNA, 25 bp, Homo sapien
acaaggagagcttctagactttgga

SEQ ID NO: 56601 - DNA, 25 bp, Homo sapien
gtcaagtccaggcattgtgttttca

SEQ ID NO: 56602 - DNA, 25 bp, Homo sapien
attgattccaaagaactccaccagg

SEQ ID NO: 56603 - DNA, 25 bp, Homo sapien
aaagaactccaccaggaattcctgt

SEQ ID NO: 56604 - DNA, 25 bp, Homo sapien
gaattcctgtgacggcctgttgata

SEQ ID NO: 56605 - DNA, 25 bp, Homo sapien
tgttgatatgagctcccagttggga

SEQ ID NO: 56606 - DNA, 25 bp, Homo sapien
gtacactataccatacttccttagc

SEQ ID NO: 56607 - DNA, 25 bp, Homo sapien
gtggtatgtcactcaaagaataata

SEQ ID NO: 56608 - DNA, 25 bp, Homo sapien
tggtatgtcactcaaagaataataa

SEQ ID NO: 56609 - DNA, 25 bp, Homo sapien
ggtatgtcactcaaagaataataat

SEQ ID NO: 56610 - DNA, 25 bp, Homo sapien
gtatgtcactcaaagaataataatg

SEQ ID NO: 56611 - DNA, 25 bp, Homo sapien
tatgtcactcaaagaataataatgg

SEQ ID NO: 56612 - DNA, 25 bp, Homo sapien
atgtcactcaaagaataataatggg

SEQ ID NO: 56613 - DNA, 25 bp, Homo sapien
tgtcactcaaagaataataatgggt

SEQ ID NO: 56614 - DNA, 25 bp, Homo sapien
gtcactcaaagaataataatgggta

SEQ ID NO: 56615 - DNA, 25 bp, Homo sapien
tcactcaaagaataataatgggtat

SEQ ID NO: 56616 - DNA, 25 bp, Homo sapien
cactcaaagaataataatgggtata

SEQ ID NO: 56617 - DNA, 25 bp, Homo sapien
actcaaagaataataatgggtatat

SEQ ID NO: 56618 - DNA, 25 bp, Homo sapien
aggtgacctggccagagccaagaaa

SEQ ID NO: 56619 - DNA, 25 bp, Homo sapien
ggccagagccaagaaacactttcag

SEQ ID NO: 56620 - DNA, 25 bp, Homo sapien
tcactcaacaaccaagcgcctggag

SEQ ID NO: 56621 - DNA, 25 bp, Homo sapien
tggacagacagccaccctgagaacc

SEQ ID NO: 56622 - DNA, 25 bp, Homo sapien
cctgagaacccctctgggaaaatct

SEQ ID NO: 56623 - DNA, 25 bp, Homo sapien
gaaaatctattcctgccaccactgg

SEQ ID NO: 56624 - DNA, 25 bp, Homo sapien
ccaccactgggcaaacagaagaatt

SEQ ID NO: 56625 - DNA, 25 bp, Homo sapien
tgtctttggagagtattttagaaac

SEQ ID NO: 56626 - DNA, 25 bp, Homo sapien
tagaaactccaatgaaagacactgt

SEQ ID NO: 56627 - DNA, 25 bp, Homo sapien
actgtttctcctgttggctcacagg

SEQ ID NO: 56628 - DNA, 25 bp, Homo sapien
tcctgttggctcacagggctgaaag

SEQ ID NO: 56629 - DNA, 25 bp, Homo sapien
acctgccggccatggtgctgtgagc

SEQ ID NO: 56630 - DNA, 25 bp, Homo sapien
atggtgctgtgagcgcgcccgcgcc

SEQ ID NO: 56631 - DNA, 25 bp, Homo sapien
gttgcgccccggaggcggatctcag

SEQ ID NO: 56632 - DNA, 25 bp, Homo sapien
cgccttggcccgtgtcgcagatgag

SEQ ID NO: 56633 - DNA, 25 bp, Homo sapien
ccttggcccgtgtcgcagatgagga

SEQ ID NO: 56634 - DNA, 25 bp, Homo sapien
ggcccgtgtcgcagatgaggacact

SEQ ID NO: 56635 - DNA, 25 bp, Homo sapien
aggacactgagggcggcgtccctca

SEQ ID NO: 56636 - DNA, 25 bp, Homo sapien
actgagggcggcgtccctcacccag

SEQ ID NO: 56637 - DNA, 25 bp, Homo sapien
aggccacgcagctggtgcggctgtt

SEQ ID NO: 56638 - DNA, 25 bp, Homo sapien
cacgcagctggtgcggctgttcggc

SEQ ID NO: 56639 - DNA, 25 bp, Homo sapien
agctggtgcggctgttcggccgcct

SEQ ID NO: 56640 - DNA, 25 bp, Homo sapien
tacttcaactgtcgaaacttccttg

SEQ ID NO: 56641 - DNA, 25 bp, Homo sapien
tcaactgtcgaaacttccttgtttt

SEQ ID NO: 56642 - DNA, 25 bp, Homo sapien
aaatgatcatttgggttcactcagg

SEQ ID NO: 56643 - DNA, 25 bp, Homo sapien
gggttcactcaggaaatgcatgtca

SEQ ID NO: 56644 - DNA, 25 bp, Homo sapien
atgcatgtcaggaaacttgtattat

SEQ ID NO: 56645 - DNA, 25 bp, Homo sapien
gttgtgatgtatcagtaactgctgt

SEQ ID NO: 56646 - DNA, 25 bp, Homo sapien
atcagtaactgctgttacccctttt

SEQ ID NO: 56647 - DNA, 25 bp, Homo sapien
gaagttttctagattgtcacatgct

SEQ ID NO: 56648 - DNA, 25 bp, Homo sapien
cacatgctttgtgactaatgcaaga

SEQ ID NO: 56649 - DNA, 25 bp, Homo sapien
gcaagaaagcaagtcctgtgttgta

SEQ ID NO: 56650 - DNA, 25 bp, Homo sapien
gcaagtcctgtgttgtatttgttct

SEQ ID NO: 56651 - DNA, 25 bp, Homo sapien
acatccagcctaaggtatgattttc

SEQ ID NO: 56652 - DNA, 25 bp, Homo sapien
tccagcctaaggtatgattttcgct

SEQ ID NO: 56653 - DNA, 25 bp, Homo sapien
gcctaaggtatgattttcgctacag

SEQ ID NO: 56654 - DNA, 25 bp, Homo sapien
aaggtatgattttcgctacagtgag

SEQ ID NO: 56655 - DNA, 25 bp, Homo sapien
gtatgattttcgctacagtgaggat

SEQ ID NO: 56656 - DNA, 25 bp, Homo sapien
atgattttcgctacagtgaggatcg

SEQ ID NO: 56657 - DNA, 25 bp, Homo sapien
ttttcgctacagtgaggatcgagag

SEQ ID NO: 56658 - DNA, 25 bp, Homo sapien
ttgatgctggcagcggatatcatgc

SEQ ID NO: 56659 - DNA, 25 bp, Homo sapien
atgctggcagcggatatcatgcggg

SEQ ID NO: 56660 - DNA, 25 bp, Homo sapien
gcaacgcggatgaacgtggtgacat

SEQ ID NO: 56661 - DNA, 25 bp, Homo sapien
aacgcggatgaacgtggtgacatca

SEQ ID NO: 56662 - DNA, 25 bp, Homo sapien
ctaatttgatcttttgttaactgag

SEQ ID NO: 56663 - DNA, 25 bp, Homo sapien
gttctgtatattcatggccatatgt

SEQ ID NO: 56664 - DNA, 25 bp, Homo sapien
atggccatatgtttttagctgaaga

SEQ ID NO: 56665 - DNA, 25 bp, Homo sapien
tttagctgaagactggtattaccaa

SEQ ID NO: 56666 - DNA, 25 bp, Homo sapien
aagctttttgttgcagctgattctc

SEQ ID NO: 56667 - DNA, 25 bp, Homo sapien
gttgcagctgattctctgaaagagc

SEQ ID NO: 56668 - DNA, 25 bp, Homo sapien
gaaagagcagcttattttattctta

SEQ ID NO: 56669 - DNA, 25 bp, Homo sapien
gagattagaattgccagctatgctt

SEQ ID NO: 56670 - DNA, 25 bp, Homo sapien
tgccagctatgcttttagtttaaaa

SEQ ID NO: 56671 - DNA, 25 bp, Homo sapien
gaaaaagtctgactgaattatccta

SEQ ID NO: 56672 - DNA, 25 bp, Homo sapien
tcctatttagggtgggatttcccat

SEQ ID NO: 56673 - DNA, 25 bp, Homo sapien
aacatgtcgaccagtttaattgaaa

SEQ ID NO: 56674 - DNA, 25 bp, Homo sapien
gaaaagtattctgagactgcaaaat

SEQ ID NO: 56675 - DNA, 25 bp, Homo sapien
aatactgcagttacggagctgtgta

SEQ ID NO: 56676 - DNA, 25 bp, Homo sapien
ggagctgtgtaaaccagtttctcat

SEQ ID NO: 56677 - DNA, 25 bp, Homo sapien
gtgtaaaccagtttctcattgcata

SEQ ID NO: 56678 - DNA, 25 bp, Homo sapien
ttctcattgcataagatacagatgt

SEQ ID NO: 56679 - DNA, 25 bp, Homo sapien
ggagaggttgatatgcacctgtaca

SEQ ID NO: 56680 - DNA, 25 bp, Homo sapien
atgcacctgtacagtaattcactcc

SEQ ID NO: 56681 - DNA, 25 bp, Homo sapien
ctttgtcagagaatagttcttgttc

SEQ ID NO: 56682 - DNA, 25 bp, Homo sapien
gttcttgttcatactgagtgttcta

SEQ ID NO: 56683 - DNA, 25 bp, Homo sapien
gttcatactgagtgttctaaatttg

SEQ ID NO: 56684 - DNA, 25 bp, Homo sapien
cacaccagaagtgccatgctcagaa

SEQ ID NO: 56685 - DNA, 25 bp, Homo sapien
gacaagaactcactactgggcatgg

SEQ ID NO: 56686 - DNA, 25 bp, Homo sapien
ctactgggcatggagggtgccaaca

SEQ ID NO: 56687 - DNA, 25 bp, Homo sapien
aacagcatcttttccgggttcctgc

SEQ ID NO: 56688 - DNA, 25 bp, Homo sapien
ttccagatatggaggcctgacctgt

SEQ ID NO: 56689 - DNA, 25 bp, Homo sapien
ttgcccagccaatggacacagtagg

SEQ ID NO: 56690 - DNA, 25 bp, Homo sapien
acagtagggcttggtgaatgctgct

SEQ ID NO: 56691 - DNA, 25 bp, Homo sapien
gaatgctgctgagtgaatgagtaaa

SEQ ID NO: 56692 - DNA, 25 bp, Homo sapien
ataaactcttcaaggccaaggaaca

SEQ ID NO: 56693 - DNA, 25 bp, Homo sapien
ggaacagtggtctaattcaactctg

SEQ ID NO: 56694 - DNA, 25 bp, Homo sapien
aattcaactctgtgtcccagcactg

SEQ ID NO: 56695 - DNA, 25 bp, Homo sapien
ggagcgccaggccttagccaaacac

SEQ ID NO: 56696 - DNA, 25 bp, Homo sapien
caggccttagccaaacacgtcaggg

SEQ ID NO: 56697 - DNA, 25 bp, Homo sapien
ttagccaaacacgtcagggcagagg

SEQ ID NO: 56698 - DNA, 25 bp, Homo sapien
ttcggctggcccaagacgaggccct

SEQ ID NO: 56699 - DNA, 25 bp, Homo sapien
tgctgacagacaagatgaagccaga

SEQ ID NO: 56700 - DNA, 25 bp, Homo sapien
cactctggaccatctacacttgaag

SEQ ID NO: 56701 - DNA, 25 bp, Homo sapien
ctctggaccatctacacttgaagat

SEQ ID NO: 56702 - DNA, 25 bp, Homo sapien
gaccatctacacttgaagatgtgct

SEQ ID NO: 56703 - DNA, 25 bp, Homo sapien
ttgaagatgtgctccctccacgatc

SEQ ID NO: 56704 - DNA, 25 bp, Homo sapien
agatgtgctccctccacgatcatct

SEQ ID NO: 56705 - DNA, 25 bp, Homo sapien
atctcagcaacctgccacttgaggg

SEQ ID NO: 56706 - DNA, 25 bp, Homo sapien
tggtccatcatcacttacgacgtct

SEQ ID NO: 56707 - DNA, 25 bp, Homo sapien
atcatcacttacgacgtctcccagg

SEQ ID NO: 56708 - DNA, 25 bp, Homo sapien
ttgcctccccggatcggattccttt

SEQ ID NO: 56709 - DNA, 25 bp, Homo sapien
ggatcggattcctttcccttcgatc

SEQ ID NO: 56710 - DNA, 25 bp, Homo sapien
cttcgatcccgcaggccggagggcg

SEQ ID NO: 56711 - DNA, 25 bp, Homo sapien
tcctgggagacctgcagaccacgcc

SEQ ID NO: 56712 - DNA, 25 bp, Homo sapien
cacgcccacctcatttacatgttca

SEQ ID NO: 56713 - DNA, 25 bp, Homo sapien
tacatgttcactcccgaccctggaa

SEQ ID NO: 56714 - DNA, 25 bp, Homo sapien
tttcgcctccggacagcggcgtctg

SEQ ID NO: 56715 - DNA, 25 bp, Homo sapien
cagggttcgggtactgcagtcccgc

SEQ ID NO: 56716 - DNA, 25 bp, Homo sapien
cgggtactgcagtcccgcgtctgga

SEQ ID NO: 56717 - DNA, 25 bp, Homo sapien
gtcacttactcccttgtgattgaat

SEQ ID NO: 56718 - DNA, 25 bp, Homo sapien
ggatccccagccagtatagagactt

SEQ ID NO: 56719 - DNA, 25 bp, Homo sapien
agagacttggttggcatcttctgct

SEQ ID NO: 56720 - DNA, 25 bp, Homo sapien
ttctgctgcagggactaaaagtatt

SEQ ID NO: 56721 - DNA, 25 bp, Homo sapien
gggcacatgtggctgttgtcattct

SEQ ID NO: 56722 - DNA, 25 bp, Homo sapien
gtggctgttgtcattctttctgcat

SEQ ID NO: 56723 - DNA, 25 bp, Homo sapien
actgttcccctccaatttatgttat

SEQ ID NO: 56724 - DNA, 25 bp, Homo sapien
tctaccctgtttttcagttccatct

SEQ ID NO: 56725 - DNA, 25 bp, Homo sapien
agttccatctctgctctgtcctata

SEQ ID NO: 56726 - DNA, 25 bp, Homo sapien
gctctgtcctatagctttataaaac

SEQ ID NO: 56727 - DNA, 25 bp, Homo sapien
tagctttataaaaccagagtgtgtg

SEQ ID NO: 56728 - DNA, 25 bp, Homo sapien
tgggaggccccctactagaaggacg

SEQ ID NO: 56729 - DNA, 25 bp, Homo sapien
ctagaaggacgtgaaagcagctttt

SEQ ID NO: 56730 - DNA, 25 bp, Homo sapien
tccagcacaggctgtatctgcagag

SEQ ID NO: 56731 - DNA, 25 bp, Homo sapien
gcacaggctgtatctgcagagggtc

SEQ ID NO: 56732 - DNA, 25 bp, Homo sapien
gagccaagagaagccctgggaagga

SEQ ID NO: 56733 - DNA, 25 bp, Homo sapien
aacgacatgcatgtgagggatggca

SEQ ID NO: 56734 - DNA, 25 bp, Homo sapien
atgcatgtgagggatggcacactga

SEQ ID NO: 56735 - DNA, 25 bp, Homo sapien
ggcacactgatgtgtttatgcacct

SEQ ID NO: 56736 - DNA, 25 bp, Homo sapien
actgatgtgtttatgcacctgtaca

SEQ ID NO: 56737 - DNA, 25 bp, Homo sapien
acctgtacacaggagcgcatggcca

SEQ ID NO: 56738 - DNA, 25 bp, Homo sapien
tacacaggagcgcatggccatggct

SEQ ID NO: 56739 - DNA, 25 bp, Homo sapien
gctgctcgggtaactttagccctta

SEQ ID NO: 56740 - DNA, 25 bp, Homo sapien
gtaactttagcccttaaccaagcat

SEQ ID NO: 56741 - DNA, 25 bp, Homo sapien
agcccttaaccaagcatatgtgggt

SEQ ID NO: 56742 - DNA, 25 bp, Homo sapien
tcctttttgggtacagctgtaaaat

SEQ ID NO: 56743 - DNA, 25 bp, Homo sapien
aaatgttgtgttattcttgcagcct

SEQ ID NO: 56744 - DNA, 25 bp, Homo sapien
gtgttattcttgcagccttgatatt

SEQ ID NO: 56745 - DNA, 25 bp, Homo sapien
tattcttgcagccttgatattcagg

SEQ ID NO: 56746 - DNA, 25 bp, Homo sapien
tgatattcagggtggattgtaaaat

SEQ ID NO: 56747 - DNA, 25 bp, Homo sapien
gatgtggttatcacaagtctcgagg

SEQ ID NO: 56748 - DNA, 25 bp, Homo sapien
gtctcgagggggaaactactgcata

SEQ ID NO: 56749 - DNA, 25 bp, Homo sapien
ctactgcataaaataactaacttgg

SEQ ID NO: 56750 - DNA, 25 bp, Homo sapien
ttgcaagttacgtacagtttttatg

SEQ ID NO: 56751 - DNA, 25 bp, Homo sapien
ttggaacttctacagcttgatgcct

SEQ ID NO: 56752 - DNA, 25 bp, Homo sapien
agcttgatgcctcctgcttttatag

SEQ ID NO: 56753 - DNA, 25 bp, Homo sapien
gatgcctcctgcttttatagcagtt

SEQ ID NO: 56754 - DNA, 25 bp, Homo sapien
gagcacttgaaagagcgtgtgtaca

SEQ ID NO: 56755 - DNA, 25 bp, Homo sapien
acattgaatgcaaacgtgtattttt

SEQ ID NO: 56756 - DNA, 25 bp, Homo sapien
atataactgtccttttcatcccatg

SEQ ID NO: 56757 - DNA, 25 bp, Homo sapien
tcatcccatgttgccgctaagtgat

SEQ ID NO: 56758 - DNA, 25 bp, Homo sapien
gttgccgctaagtgatatttcatat

SEQ ID NO: 56759 - DNA, 25 bp, Homo sapien
tatttcatatgtgtggttatactca

SEQ ID NO: 56760 - DNA, 25 bp, Homo sapien
atactcataataatgggccttgtaa

SEQ ID NO: 56761 - DNA, 25 bp, Homo sapien
cagggacagcaggaccttcgacgct

SEQ ID NO: 56762 - DNA, 25 bp, Homo sapien
acagcaggaccttcgacgctggaag

SEQ ID NO: 56763 - DNA, 25 bp, Homo sapien
tcgacgctggaaggatagcctcgct

SEQ ID NO: 56764 - DNA, 25 bp, Homo sapien
gaaggatagcctcgcttcccaggtg

SEQ ID NO: 56765 - DNA, 25 bp, Homo sapien
atagcctcgcttcccaggtgcagct

SEQ ID NO: 56766 - DNA, 25 bp, Homo sapien
gcagctcccggcaggtctggacagt

SEQ ID NO: 56767 - DNA, 25 bp, Homo sapien
cggcaggtctggacagttccacaga

SEQ ID NO: 56768 - DNA, 25 bp, Homo sapien
ggacagttccacagagcacggtact

SEQ ID NO: 56769 - DNA, 25 bp, Homo sapien
agttccacagagcacggtactggcc

SEQ ID NO: 56770 - DNA, 25 bp, Homo sapien
acggtactggccctgtcctcagttc

SEQ ID NO: 56771 - DNA, 25 bp, Homo sapien
gtggctcctgggagacttttcctcc

SEQ ID NO: 56772 - DNA, 25 bp, Homo sapien
gtagtggtagtaactcgtgaatctt

SEQ ID NO: 56773 - DNA, 25 bp, Homo sapien
gtagtaactcgtgaatctttttaat

SEQ ID NO: 56774 - DNA, 25 bp, Homo sapien
actcgtgaatctttttaataacata

SEQ ID NO: 56775 - DNA, 25 bp, Homo sapien
ttcccttgttataagttttatgtca

SEQ ID NO: 56776 - DNA, 25 bp, Homo sapien
agttagttacccatgtccccaatca

SEQ ID NO: 56777 - DNA, 25 bp, Homo sapien
agttacccatgtccccaatcaaggg

SEQ ID NO: 56778 - DNA, 25 bp, Homo sapien
catgtccccaatcaagggaacctaa

SEQ ID NO: 56779 - DNA, 25 bp, Homo sapien
aagggaacctaaatgaagatatatc

SEQ ID NO: 56780 - DNA, 25 bp, Homo sapien
gtcaagcaatactaatttgtgtcat

SEQ ID NO: 56781 - DNA, 25 bp, Homo sapien
tgtgtcataaaatttgttttgcatc

SEQ ID NO: 56782 - DNA, 25 bp, Homo sapien
gttttgcatcattcaacaatttatg

SEQ ID NO: 56783 - DNA, 25 bp, Homo sapien
gggatatcaatatcaggctgcccca

SEQ ID NO: 56784 - DNA, 25 bp, Homo sapien
gatatcaatatcaggctgccccact

SEQ ID NO: 56785 - DNA, 25 bp, Homo sapien
ccaggtggtgggagcagagggtacc

SEQ ID NO: 56786 - DNA, 25 bp, Homo sapien
tgccccaccagggtccttagggatg

SEQ ID NO: 56787 - DNA, 25 bp, Homo sapien
ccccaccagggtccttagggatgct

SEQ ID NO: 56788 - DNA, 25 bp, Homo sapien
cagtttgtaccaaaaaccttgtgag

SEQ ID NO: 56789 - DNA, 25 bp, Homo sapien
tttgtaccaaaaaccttgtgaggag

SEQ ID NO: 56790 - DNA, 25 bp, Homo sapien
gtaccaaaaaccttgtgaggaggtg

SEQ ID NO: 56791 - DNA, 25 bp, Homo sapien
ggagccatgtctgtgctcaggaaga

SEQ ID NO: 56792 - DNA, 25 bp, Homo sapien
gtggctagtaggctcctggcctctt

SEQ ID NO: 56793 - DNA, 25 bp, Homo sapien
taggctcctggcctctttggtttat

SEQ ID NO: 56794 - DNA, 25 bp, Homo sapien
atggattcactagctttcggtggtg

SEQ ID NO: 56795 - DNA, 25 bp, Homo sapien
attcactagctttcggtggtggagg

SEQ ID NO: 56796 - DNA, 25 bp, Homo sapien
aggaggagaatttgcgctttggctt

SEQ ID NO: 56797 - DNA, 25 bp, Homo sapien
tgcgctttggcttgatggagatctc

SEQ ID NO: 56798 - DNA, 25 bp, Homo sapien
gagatctctaccatggaagaagcca

SEQ ID NO: 56799 - DNA, 25 bp, Homo sapien
agaagccattcttgtaaaacgtttg

SEQ ID NO: 56800 - DNA, 25 bp, Homo sapien
gaaggaagatttctttatccaagat

SEQ ID NO: 56801 - DNA, 25 bp, Homo sapien
tccaagatattgaaatctgggcttt

SEQ ID NO: 56802 - DNA, 25 bp, Homo sapien
aaaatgctctctgtcttagcaggag

SEQ ID NO: 56803 - DNA, 25 bp, Homo sapien
cttagcaggagaatggcccaaacct

SEQ ID NO: 56804 - DNA, 25 bp, Homo sapien
ggacaagcattgtttggaaagttca

SEQ ID NO: 56805 - DNA, 25 bp, Homo sapien
aacatgccaatttggctggcacgct

SEQ ID NO: 56806 - DNA, 25 bp, Homo sapien
aatttggctggcacgctgagcggcc

SEQ ID NO: 56807 - DNA, 25 bp, Homo sapien
atgcctcctgggtgctgaacgttgc

SEQ ID NO: 56808 - DNA, 25 bp, Homo sapien
tgctgaacgttgcattctgtcctga

SEQ ID NO: 56809 - DNA, 25 bp, Homo sapien
aacgttgcattctgtcctgatgaca

SEQ ID NO: 56810 - DNA, 25 bp, Homo sapien
ctgatgacactcactttgtttccag

SEQ ID NO: 56811 - DNA, 25 bp, Homo sapien
agttcgtctgacaaaagtgtaaaag

SEQ ID NO: 56812 - DNA, 25 bp, Homo sapien
gaacgaggacttgtgttcacacctt

SEQ ID NO: 56813 - DNA, 25 bp, Homo sapien
ttcacaccttctttgatcaccagga

SEQ ID NO: 56814 - DNA, 25 bp, Homo sapien
ccttctttgatcaccaggatcaggt

SEQ ID NO: 56815 - DNA, 25 bp, Homo sapien
ggaaattcacatctatgattgtcca

SEQ ID NO: 56816 - DNA, 25 bp, Homo sapien
tgcaaatggaacaagtcgccaccta

SEQ ID NO: 56817 - DNA, 25 bp, Homo sapien
ggaacaagtcgccacctaaggaagt

SEQ ID NO: 56818 - DNA, 25 bp, Homo sapien
gccacctaaggaagtcctcggcaat

SEQ ID NO: 56819 - DNA, 25 bp, Homo sapien
agtcctcggcaattacgagattctg

SEQ ID NO: 56820 - DNA, 25 bp, Homo sapien
ctgaccgggagctgagaagccgtca

SEQ ID NO: 56821 - DNA, 25 bp, Homo sapien
ctgagaagccgtcagggtcagtctc

SEQ ID NO: 56822 - DNA, 25 bp, Homo sapien
cagagcaggccgatcgagagactcg

SEQ ID NO: 56823 - DNA, 25 bp, Homo sapien
agagcggtcctcaccacctggaagt

SEQ ID NO: 56824 - DNA, 25 bp, Homo sapien
acctggaagtgagtcccacctggac

SEQ ID NO: 56825 - DNA, 25 bp, Homo sapien
ccacctggaccttatcaaaactact

SEQ ID NO: 56826 - DNA, 25 bp, Homo sapien
ttatcaaaactactcactccacctg

SEQ ID NO: 56827 - DNA, 25 bp, Homo sapien
gtatctcagattgaccatttctgtt

SEQ ID NO: 56828 - DNA, 25 bp, Homo sapien
ttctgttacttgtcatttctacttt

SEQ ID NO: 56829 - DNA, 25 bp, Homo sapien
aagaactgaagtgctcactactcag

SEQ ID NO: 56830 - DNA, 25 bp, Homo sapien
agtgctcactactcagtgatttgga

SEQ ID NO: 56831 - DNA, 25 bp, Homo sapien
tttggaaattttgatgcttgtataa

SEQ ID NO: 56832 - DNA, 25 bp, Homo sapien
gataattaatttccaaaggcgtatg

SEQ ID NO: 56833 - DNA, 25 bp, Homo sapien
tttccaaaggcgtatgtattaagta

SEQ ID NO: 56834 - DNA, 25 bp, Homo sapien
tgttaatgaggccaatttttccagc

SEQ ID NO: 56835 - DNA, 25 bp, Homo sapien
tttttcacttgttaggaagcttttg

SEQ ID NO: 56836 - DNA, 25 bp, Homo sapien
gttaggaagcttttgttatgtattt

SEQ ID NO: 56837 - DNA, 25 bp, Homo sapien
tgtattttctgttaatagtacctaa

SEQ ID NO: 56838 - DNA, 25 bp, Homo sapien
caagagggtgcctacaggcggatat

SEQ ID NO: 56839 - DNA, 25 bp, Homo sapien
gcctacaggcggatatgaaaccggt

SEQ ID NO: 56840 - DNA, 25 bp, Homo sapien
atatgaaaccggtgggctggcacct

SEQ ID NO: 56841 - DNA, 25 bp, Homo sapien
acctgggcacagtgcttccaggtat

SEQ ID NO: 56842 - DNA, 25 bp, Homo sapien
tgggcacagtgcttccaggtatgga

SEQ ID NO: 56843 - DNA, 25 bp, Homo sapien
gcacagtgcttccaggtatggagaa

SEQ ID NO: 56844 - DNA, 25 bp, Homo sapien
cagtgcttccaggtatggagaaaga

SEQ ID NO: 56845 - DNA, 25 bp, Homo sapien
cagcccgctggacttgtaacactac

SEQ ID NO: 56846 - DNA, 25 bp, Homo sapien
gctggacttgtaacactacctcccg

SEQ ID NO: 56847 - DNA, 25 bp, Homo sapien
cacactgttggctctggccgaagct

SEQ ID NO: 56848 - DNA, 25 bp, Homo sapien
actgttggctctggccgaagctcac

SEQ ID NO: 56849 - DNA, 25 bp, Homo sapien
ggtctttccttgtttgaagctttgg

SEQ ID NO: 56850 - DNA, 25 bp, Homo sapien
gaagctttgggctacgtggatgacc

SEQ ID NO: 56851 - DNA, 25 bp, Homo sapien
tggatgaccagctgttcgtgttcta

SEQ ID NO: 56852 - DNA, 25 bp, Homo sapien
agctgttcgtgttctatgatcatga

SEQ ID NO: 56853 - DNA, 25 bp, Homo sapien
tgtggagccccgaactccatgggtt

SEQ ID NO: 56854 - DNA, 25 bp, Homo sapien
gaactccatgggtttccagtagaat

SEQ ID NO: 56855 - DNA, 25 bp, Homo sapien
gccagatgtggctgcagctgagtca

SEQ ID NO: 56856 - DNA, 25 bp, Homo sapien
gagtcagagtctgcccagccgtcaa

SEQ ID NO: 56857 - DNA, 25 bp, Homo sapien
atatccagatggcatgtgtttactt

SEQ ID NO: 56858 - DNA, 25 bp, Homo sapien
tatgttactacatgcacttggctgc

SEQ ID NO: 56859 - DNA, 25 bp, Homo sapien
attctgtcttgaagggcaggtgctt

SEQ ID NO: 56860 - DNA, 25 bp, Homo sapien
gaacattgaaacagttttcctcctt

SEQ ID NO: 56861 - DNA, 25 bp, Homo sapien
cattgaaacagttttcctccttgtc

SEQ ID NO: 56862 - DNA, 25 bp, Homo sapien
gtaatagtcattatatttacctgtt

SEQ ID NO: 56863 - DNA, 25 bp, Homo sapien
ttattattcatcttctgtacccacg

SEQ ID NO: 56864 - DNA, 25 bp, Homo sapien
tctgtacccacgcataaccactata

SEQ ID NO: 56865 - DNA, 25 bp, Homo sapien
cccacgcataaccactatacatagt

SEQ ID NO: 56866 - DNA, 25 bp, Homo sapien
acatagtttcttttgtacttgaata

SEQ ID NO: 56867 - DNA, 25 bp, Homo sapien
acatgaacacagtgccatatgaata

SEQ ID NO: 56868 - DNA, 25 bp, Homo sapien
gaataatttcacatacagaaccttt

SEQ ID NO: 56869 - DNA, 25 bp, Homo sapien
ttttttctctgaagtcctgtggact

SEQ ID NO: 56870 - DNA, 25 bp, Homo sapien
gtcctgtggacttgcaaatatatat

SEQ ID NO: 56871 - DNA, 25 bp, Homo sapien
tcatatgggctgactggtgtaggtt

SEQ ID NO: 56872 - DNA, 25 bp, Homo sapien
gtaggtttggtaggcctcactgctc

SEQ ID NO: 56873 - DNA, 25 bp, Homo sapien
tcactgctctccagaggctagtgtt

SEQ ID NO: 56874 - DNA, 25 bp, Homo sapien
aggctagtgttcctatcccaggatg

SEQ ID NO: 56875 - DNA, 25 bp, Homo sapien
ggaccacaagagatttggcctcctt

SEQ ID NO: 56876 - DNA, 25 bp, Homo sapien
aagagatttggcctccttggaacat

SEQ ID NO: 56877 - DNA, 25 bp, Homo sapien
aaggatgtaattctagcccagggaa

SEQ ID NO: 56878 - DNA, 25 bp, Homo sapien
ggaagaaaatccttttcagcagacg

SEQ ID NO: 56879 - DNA, 25 bp, Homo sapien
tcccctagggaatgtgtccctacta

SEQ ID NO: 56880 - DNA, 25 bp, Homo sapien
gtgtccctactatagtaaactcttc

SEQ ID NO: 56881 - DNA, 25 bp, Homo sapien
ttctctgtcagatcaatttgttttt

SEQ ID NO: 56882 - DNA, 25 bp, Homo sapien
acaaggccttcttcaacggaaggag

SEQ ID NO: 56883 - DNA, 25 bp, Homo sapien
acaggccacaggtaacagtcaaata

SEQ ID NO: 56884 - DNA, 25 bp, Homo sapien
gtcaaataaccaccagtatctccac

SEQ ID NO: 56885 - DNA, 25 bp, Homo sapien
acgaagacctccctgcagataagca

SEQ ID NO: 56886 - DNA, 25 bp, Homo sapien
gaaggcacctgttgtgagggctata

SEQ ID NO: 56887 - DNA, 25 bp, Homo sapien
ataggaatgtgggatcctgccctgg

SEQ ID NO: 56888 - DNA, 25 bp, Homo sapien
agggccctggtgaaactgctttaag

SEQ ID NO: 56889 - DNA, 25 bp, Homo sapien
gctttaagatgcctcttccgtggaa

SEQ ID NO: 56890 - DNA, 25 bp, Homo sapien
gggtcagcctgctttgggcaaatgt

SEQ ID NO: 56891 - DNA, 25 bp, Homo sapien
ttgggcaaatgtgtccacagccact

SEQ ID NO: 56892 - DNA, 25 bp, Homo sapien
caccttcccataaagcctagttgta

SEQ ID NO: 56893 - DNA, 25 bp, Homo sapien
ttgcgcccttactgtgattcctggc

SEQ ID NO: 56894 - DNA, 25 bp, Homo sapien
ttactgtgattcctggcttcatttt

SEQ ID NO: 56895 - DNA, 25 bp, Homo sapien
tgtgattcctggcttcattttttgc

SEQ ID NO: 56896 - DNA, 25 bp, Homo sapien
gattcctggcttcattttttgctga

SEQ ID NO: 56897 - DNA, 25 bp, Homo sapien
ctggcttcattttttgctgatggtt

SEQ ID NO: 56898 - DNA, 25 bp, Homo sapien
cttcattttttgctgatggttcccc

SEQ ID NO: 56899 - DNA, 25 bp, Homo sapien
gtacccgcaacgaaggcctgggctt

SEQ ID NO: 56900 - DNA, 25 bp, Homo sapien
ctccttagcaggtgccgtgctggga

SEQ ID NO: 56901 - DNA, 25 bp, Homo sapien
aggtgccgtgctgggacaccatacg

SEQ ID NO: 56902 - DNA, 25 bp, Homo sapien
tgctgggacaccatacgggttggtt

SEQ ID NO: 56903 - DNA, 25 bp, Homo sapien
ttgcctaccccagtgagagtctgat

SEQ ID NO: 56904 - DNA, 25 bp, Homo sapien
aagtgtttgctgaggacattgctcc

SEQ ID NO: 56905 - DNA, 25 bp, Homo sapien
gctgaggacattgctcctctgactc

SEQ ID NO: 56906 - DNA, 25 bp, Homo sapien
atctcactttgtccatcgcagcctt

SEQ ID NO: 56907 - DNA, 25 bp, Homo sapien
ccatcgcagccttttgttgggagat

SEQ ID NO: 56908 - DNA, 25 bp, Homo sapien
gcagccttttgttgggagatgacac

SEQ ID NO: 56909 - DNA, 25 bp, Homo sapien
gagatgacactgtcagtcagcccat

SEQ ID NO: 56910 - DNA, 25 bp, Homo sapien
agtcagcccatgatgtctgttcaca

SEQ ID NO: 56911 - DNA, 25 bp, Homo sapien
gtctgttcacacgagatgctttttt

SEQ ID NO: 56912 - DNA, 25 bp, Homo sapien
attgaccaatgttttgctgccactg

SEQ ID NO: 56913 - DNA, 25 bp, Homo sapien
gttttgctgccactgattaaagtat

SEQ ID NO: 56914 - DNA, 25 bp, Homo sapien
gttgcttgtagttttgatgtaattc

SEQ ID NO: 56915 - DNA, 25 bp, Homo sapien
gctacgtggatgaccagctgttcgt

SEQ ID NO: 56916 - DNA, 25 bp, Homo sapien
acgtggatgaccagctgttcgtgtt

SEQ ID NO: 56917 - DNA, 25 bp, Homo sapien
tggatgaccagctgttcgtgttcta

SEQ ID NO: 56918 - DNA, 25 bp, Homo sapien
atgaccagctgttcgtgttctatga

SEQ ID NO: 56919 - DNA, 25 bp, Homo sapien
accagctgttcgtgttctatgatca

SEQ ID NO: 56920 - DNA, 25 bp, Homo sapien
agctgttcgtgttctatgatcatga

SEQ ID NO: 56921 - DNA, 25 bp, Homo sapien
ttcgtgttctatgatcatgagagtc

SEQ ID NO: 56922 - DNA, 25 bp, Homo sapien
gtggagccccgaactccatgggttt

SEQ ID NO: 56923 - DNA, 25 bp, Homo sapien
gccccgaactccatgggtttccagt

SEQ ID NO: 56924 - DNA, 25 bp, Homo sapien
atttcaagccagatgtggctgcagc

SEQ ID NO: 56925 - DNA, 25 bp, Homo sapien
tcaagccagatgtggctgcagctga

SEQ ID NO: 56926 - DNA, 25 bp, Homo sapien
aagacgaagggatgctgcagttcca

SEQ ID NO: 56927 - DNA, 25 bp, Homo sapien
caaatgactgactgcaccttctgtg

SEQ ID NO: 56928 - DNA, 25 bp, Homo sapien
ttctgtgcctcagccgttcttgaca

SEQ ID NO: 56929 - DNA, 25 bp, Homo sapien
gcctcagccgttcttgacatcaaga

SEQ ID NO: 56930 - DNA, 25 bp, Homo sapien
ctcagccgttcttgacatcaagaat

SEQ ID NO: 56931 - DNA, 25 bp, Homo sapien
tcaagaatcttctgttccacatcca

SEQ ID NO: 56932 - DNA, 25 bp, Homo sapien
cagatgtagcaacatgaaagacgct

SEQ ID NO: 56933 - DNA, 25 bp, Homo sapien
gaaagacgctatgttacaggttaca

SEQ ID NO: 56934 - DNA, 25 bp, Homo sapien
gacgctatgttacaggttacatgag

SEQ ID NO: 56935 - DNA, 25 bp, Homo sapien
ctatgttacaggttacatgagagca

SEQ ID NO: 56936 - DNA, 25 bp, Homo sapien
gagcaatcatgtaagtctatatgac

SEQ ID NO: 56937 - DNA, 25 bp, Homo sapien
gggatctgattttagaggcctaatt

SEQ ID NO: 56938 - DNA, 25 bp, Homo sapien
gaggcctaattttctgttcatggac

SEQ ID NO: 56939 - DNA, 25 bp, Homo sapien
aacatcaaatgctggcactatatac

SEQ ID NO: 56940 - DNA, 25 bp, Homo sapien
aaatgctggcactatatacatacga

SEQ ID NO: 56941 - DNA, 25 bp, Homo sapien
aatgctggcactatatacatacgat

SEQ ID NO: 56942 - DNA, 25 bp, Homo sapien
tgctggcactatatacatacgatca

SEQ ID NO: 56943 - DNA, 25 bp, Homo sapien
gcactatatacatacgatcagcctg

SEQ ID NO: 56944 - DNA, 25 bp, Homo sapien
ctatatacatacgatcagcctgatt

SEQ ID NO: 56945 - DNA, 25 bp, Homo sapien
atatacatacgatcagcctgattat

SEQ ID NO: 56946 - DNA, 25 bp, Homo sapien
acgatcagcctgattatgatatcac

SEQ ID NO: 56947 - DNA, 25 bp, Homo sapien
aagacttatataccactttctcgta

SEQ ID NO: 56948 - DNA, 25 bp, Homo sapien
gccctttgacatccacacctatggg

SEQ ID NO: 56949 - DNA, 25 bp, Homo sapien
ttgacatccacacctatggggacca

SEQ ID NO: 56950 - DNA, 25 bp, Homo sapien
acatccacacctatggggaccagct

SEQ ID NO: 56951 - DNA, 25 bp, Homo sapien
gggaccagctggtctcacggttccc

SEQ ID NO: 56952 - DNA, 25 bp, Homo sapien
ccagctcaatgagtggtgtcccttt

SEQ ID NO: 56953 - DNA, 25 bp, Homo sapien
cagctcaatgagtggtgtccctttg

SEQ ID NO: 56954 - DNA, 25 bp, Homo sapien
agctcaatgagtggtgtccctttgc

SEQ ID NO: 56955 - DNA, 25 bp, Homo sapien
actacacagtggagataacccagca

SEQ ID NO: 56956 - DNA, 25 bp, Homo sapien
tacacagtggagataacccagcagc

SEQ ID NO: 56957 - DNA, 25 bp, Homo sapien
gataacccagcagcccgggctggag

SEQ ID NO: 56958 - DNA, 25 bp, Homo sapien
taacccagcagcccgggctggagat

SEQ ID NO: 56959 - DNA, 25 bp, Homo sapien
caataaaatagcctccaaatgtata

SEQ ID NO: 56960 - DNA, 25 bp, Homo sapien
tatctcagacaccatagagctgcta

SEQ ID NO: 56961 - DNA, 25 bp, Homo sapien
agagctgctaacaatgagaatcaag

SEQ ID NO: 56962 - DNA, 25 bp, Homo sapien
gaatcaaggaagatgcttgcactta

SEQ ID NO: 56963 - DNA, 25 bp, Homo sapien
gatgcttgcacttagatttcgtttg

SEQ ID NO: 56964 - DNA, 25 bp, Homo sapien
gatttcgtttgttgtatttcagtag

SEQ ID NO: 56965 - DNA, 25 bp, Homo sapien
cagtagttctggatgtcctttgtta

SEQ ID NO: 56966 - DNA, 25 bp, Homo sapien
gtctcgacagaaatgtcaatctggt

SEQ ID NO: 56967 - DNA, 25 bp, Homo sapien
caatctggtgattctgtgaactgta

SEQ ID NO: 56968 - DNA, 25 bp, Homo sapien
gaaaaccatgtgatccatcctgtat

SEQ ID NO: 56969 - DNA, 25 bp, Homo sapien
tgtgatccatcctgtattttgattg

SEQ ID NO: 56970 - DNA, 25 bp, Homo sapien
cccagaacatcaccatgaagtggct

SEQ ID NO: 56971 - DNA, 25 bp, Homo sapien
gaacctaaagacgtattgcccaatg

SEQ ID NO: 56972 - DNA, 25 bp, Homo sapien
atgggacctaccagggctggataac

SEQ ID NO: 56973 - DNA, 25 bp, Homo sapien
agggctggataaccttggctgtacc

SEQ ID NO: 56974 - DNA, 25 bp, Homo sapien
tggctgtacccccaaagtactgaga

SEQ ID NO: 56975 - DNA, 25 bp, Homo sapien
tgcccagccgtcaaaagagtcttaa

SEQ ID NO: 56976 - DNA, 25 bp, Homo sapien
atatccagatggcatgtgtttactt

SEQ ID NO: 56977 - DNA, 25 bp, Homo sapien
tatgttactacatgcacttggctgc

SEQ ID NO: 56978 - DNA, 25 bp, Homo sapien
actacatgcacttggctgcataaat

SEQ ID NO: 56979 - DNA, 25 bp, Homo sapien
aaatgtggtacaagcattctgtctt

SEQ ID NO: 56980 - DNA, 25 bp, Homo sapien
attctgtcttgaagggcaggtgctt

SEQ ID NO: 56981 - DNA, 25 bp, Homo sapien
ttctttaatgtatgggactgaaatc

SEQ ID NO: 56982 - DNA, 25 bp, Homo sapien
gggactgaaatcaaaccatgaaagc

SEQ ID NO: 56983 - DNA, 25 bp, Homo sapien
gactgaaatcaaaccatgaaagcca

SEQ ID NO: 56984 - DNA, 25 bp, Homo sapien
gaaatcaaaccatgaaagccaatta

SEQ ID NO: 56985 - DNA, 25 bp, Homo sapien
aagccaattattgaccttccttcct

SEQ ID NO: 56986 - DNA, 25 bp, Homo sapien
agccaattattgaccttccttcctt

SEQ ID NO: 56987 - DNA, 25 bp, Homo sapien
gccaattattgaccttccttccttc

SEQ ID NO: 56988 - DNA, 25 bp, Homo sapien
caattattgaccttccttccttcct

SEQ ID NO: 56989 - DNA, 25 bp, Homo sapien
tatttcttgggtctcactctcatca

SEQ ID NO: 56990 - DNA, 25 bp, Homo sapien
atttcttgggtctcactctcatcac

SEQ ID NO: 56991 - DNA, 25 bp, Homo sapien
tttcttgggtctcactctcatcacc

SEQ ID NO: 56992 - DNA, 25 bp, Homo sapien
atatatatccagatggcatgtgttt

SEQ ID NO: 56993 - DNA, 25 bp, Homo sapien
atatccagatggcatgtgtttactt

SEQ ID NO: 56994 - DNA, 25 bp, Homo sapien
gtgtttactttatgttactacatgc

SEQ ID NO: 56995 - DNA, 25 bp, Homo sapien
gtttactttatgttactacatgcac

SEQ ID NO: 56996 - DNA, 25 bp, Homo sapien
tactttatgttactacatgcacttg

SEQ ID NO: 56997 - DNA, 25 bp, Homo sapien
tatgttactacatgcacttggctgc

SEQ ID NO: 56998 - DNA, 25 bp, Homo sapien
atgttactacatgcacttggctgca

SEQ ID NO: 56999 - DNA, 25 bp, Homo sapien
tgttactacatgcacttggctgcat

SEQ ID NO: 57000 - DNA, 25 bp, Homo sapien
gttactacatgcacttggctgcata

SEQ ID NO: 57001 - DNA, 25 bp, Homo sapien
tactacatgcacttggctgcataaa

SEQ ID NO: 57002 - DNA, 25 bp, Homo sapien
ctacatgcacttggctgcataaatg

SEQ ID NO: 57003 - DNA, 25 bp, Homo sapien
ccagtatgtttctctgctcatcaga

SEQ ID NO: 57004 - DNA, 25 bp, Homo sapien
tacctctgtgccgtgagagactaca

SEQ ID NO: 57005 - DNA, 25 bp, Homo sapien
acctctgtgccgtgagagactacaa

SEQ ID NO: 57006 - DNA, 25 bp, Homo sapien
cctctgtgccgtgagagactacaag

SEQ ID NO: 57007 - DNA, 25 bp, Homo sapien
ctctgtgccgtgagagactacaagc

SEQ ID NO: 57008 - DNA, 25 bp, Homo sapien
tctgtgccgtgagagactacaagct

SEQ ID NO: 57009 - DNA, 25 bp, Homo sapien
ctgtgccgtgagagactacaagctc

SEQ ID NO: 57010 - DNA, 25 bp, Homo sapien
tgtgccgtgagagactacaagctca

SEQ ID NO: 57011 - DNA, 25 bp, Homo sapien
gtgccgtgagagactacaagctcag

SEQ ID NO: 57012 - DNA, 25 bp, Homo sapien
tgccgtgagagactacaagctcagc

SEQ ID NO: 57013 - DNA, 25 bp, Homo sapien
agactacaagctcagctttggagcc

SEQ ID NO: 57014 - DNA, 25 bp, Homo sapien
gtgctgagtcccaagtgagtgagaa

SEQ ID NO: 57015 - DNA, 25 bp, Homo sapien
ttaaccctatcctcgaggacgactg

SEQ ID NO: 57016 - DNA, 25 bp, Homo sapien
acgactgcagctcgactagtggctt

SEQ ID NO: 57017 - DNA, 25 bp, Homo sapien
gtggcttccccacacaggagtcctt

SEQ ID NO: 57018 - DNA, 25 bp, Homo sapien
aggagtcctttaccatggcctcctg

SEQ ID NO: 57019 - DNA, 25 bp, Homo sapien
agccccatcgaatgcacagagctgg

SEQ ID NO: 57020 - DNA, 25 bp, Homo sapien
agagctggacctgcaaaagttttcc

SEQ ID NO: 57021 - DNA, 25 bp, Homo sapien
acctgcaaaagttttccagctctgc

SEQ ID NO: 57022 - DNA, 25 bp, Homo sapien
gctctgcctcctatactggagctga

SEQ ID NO: 57023 - DNA, 25 bp, Homo sapien
agtcgaaagcactggagacaggctg

SEQ ID NO: 57024 - DNA, 25 bp, Homo sapien
tcaatgtgccctttgaagttcccag

SEQ ID NO: 57025 - DNA, 25 bp, Homo sapien
aatgttctgggtgggagccgccctt

SEQ ID NO: 57026 - DNA, 25 bp, Homo sapien
ttagagaaccaagtgcctcctgtct

SEQ ID NO: 57027 - DNA, 25 bp, Homo sapien
aagtgcctcctgtctgaaaggtgag

SEQ ID NO: 57028 - DNA, 25 bp, Homo sapien
tgcccctccataggtgggtttgtag

SEQ ID NO: 57029 - DNA, 25 bp, Homo sapien
agggtcttgtgttgcttctggtctc

SEQ ID NO: 57030 - DNA, 25 bp, Homo sapien
ctggtctctccaggcttggctgaga

SEQ ID NO: 57031 - DNA, 25 bp, Homo sapien
gagacggacggtagacttccaccat

SEQ ID NO: 57032 - DNA, 25 bp, Homo sapien
agacttccaccatgtaccgatcaca

SEQ ID NO: 57033 - DNA, 25 bp, Homo sapien
atggcccctgctaaggctcaggtat

SEQ ID NO: 57034 - DNA, 25 bp, Homo sapien
aaggctcaggtataacctcaccttc

SEQ ID NO: 57035 - DNA, 25 bp, Homo sapien
gttgcctttaggcttgagtcctcaa

SEQ ID NO: 57036 - DNA, 25 bp, Homo sapien
agctggtcgagaaaagctttgaaac

SEQ ID NO: 57037 - DNA, 25 bp, Homo sapien
aagctttgaaacagatacgaaccta

SEQ ID NO: 57038 - DNA, 25 bp, Homo sapien
tgaaacagatacgaacctaaacttt

SEQ ID NO: 57039 - DNA, 25 bp, Homo sapien
ctaaactttcaaaacctgtcagtga

SEQ ID NO: 57040 - DNA, 25 bp, Homo sapien
aaacctgtcagtgattgggttccga

SEQ ID NO: 57041 - DNA, 25 bp, Homo sapien
tcagtgattgggttccgaatcctcc

SEQ ID NO: 57042 - DNA, 25 bp, Homo sapien
tgattgggttccgaatcctcctcct

SEQ ID NO: 57043 - DNA, 25 bp, Homo sapien
gaaagtggccgggtttaatctgctc

SEQ ID NO: 57044 - DNA, 25 bp, Homo sapien
tggccgggtttaatctgctcatgac

SEQ ID NO: 57045 - DNA, 25 bp, Homo sapien
gggtttaatctgctcatgacgctgc

SEQ ID NO: 57046 - DNA, 25 bp, Homo sapien
gtttaatctgctcatgacgctgcgg

SEQ ID NO: 57047 - DNA, 25 bp, Homo sapien
gccatcatatggtcaatattttagc

SEQ ID NO: 57048 - DNA, 25 bp, Homo sapien
attgtaaagcccctatggttctaat

SEQ ID NO: 57049 - DNA, 25 bp, Homo sapien
tggttctaatcagcgttatccgggt

SEQ ID NO: 57050 - DNA, 25 bp, Homo sapien
gcgttatccgggttctgatgtcaga

SEQ ID NO: 57051 - DNA, 25 bp, Homo sapien
ttctgatgtcagaatcctgggaacc

SEQ ID NO: 57052 - DNA, 25 bp, Homo sapien
gaacactaagttttaggccaaaatg

SEQ ID NO: 57053 - DNA, 25 bp, Homo sapien
tttttctttcagatgcacagggaat

SEQ ID NO: 57054 - DNA, 25 bp, Homo sapien
cagggaatgcacctattattgctat

SEQ ID NO: 57055 - DNA, 25 bp, Homo sapien
gattgttcctcctgtaatttcacta

SEQ ID NO: 57056 - DNA, 25 bp, Homo sapien
ctaactttttattcatgcacttcaa

SEQ ID NO: 57057 - DNA, 25 bp, Homo sapien
gcacttcaaacaaactttactacta

SEQ ID NO: 57058 - DNA, 25 bp, Homo sapien
ggcatctcctctaaggccatgggaa

SEQ ID NO: 57059 - DNA, 25 bp, Homo sapien
gcatctcctctaaggccatgggaat

SEQ ID NO: 57060 - DNA, 25 bp, Homo sapien
catctcctctaaggccatgggaatc

SEQ ID NO: 57061 - DNA, 25 bp, Homo sapien
ctctaaggccatgggaatcatgaac

SEQ ID NO: 57062 - DNA, 25 bp, Homo sapien
cttcgaacgcatcgcaggtgaggct

SEQ ID NO: 57063 - DNA, 25 bp, Homo sapien
tcgaacgcatcgcaggtgaggcttc

SEQ ID NO: 57064 - DNA, 25 bp, Homo sapien
gaacgcatcgcaggtgaggcttccc

SEQ ID NO: 57065 - DNA, 25 bp, Homo sapien
aacgcatcgcaggtgaggcttcccg

SEQ ID NO: 57066 - DNA, 25 bp, Homo sapien
tcgcaggtgaggcttcccgcctgcc

SEQ ID NO: 57067 - DNA, 25 bp, Homo sapien
cgcaggtgaggcttcccgcctgccg

SEQ ID NO: 57068 - DNA, 25 bp, Homo sapien
aggtgaggcttcccgcctgccgcat

SEQ ID NO: 57069 - DNA, 25 bp, Homo sapien
aattcctctagctaccatttcaata

SEQ ID NO: 57070 - DNA, 25 bp, Homo sapien
tagctaccatttcaatagccccatc

SEQ ID NO: 57071 - DNA, 25 bp, Homo sapien
tgacttgccactgccataacttgtt

SEQ ID NO: 57072 - DNA, 25 bp, Homo sapien
ttgccactgccataacttgtttgta

SEQ ID NO: 57073 - DNA, 25 bp, Homo sapien
agagctgttctttttgactgattgt

SEQ ID NO: 57074 - DNA, 25 bp, Homo sapien
tgcagatcccgcaggcttcgtttgc

SEQ ID NO: 57075 - DNA, 25 bp, Homo sapien
gcaggcttcgtttgcctccagaacc

SEQ ID NO: 57076 - DNA, 25 bp, Homo sapien
agaaccttcccgtctgattgttcct

SEQ ID NO: 57077 - DNA, 25 bp, Homo sapien
cacaaccctgttgctacatcagagt

SEQ ID NO: 57078 - DNA, 25 bp, Homo sapien
cctgttgctacatcagagtgtattt

SEQ ID NO: 57079 - DNA, 25 bp, Homo sapien
gtatttttgtaattcctctagctac

SEQ ID NO: 57080 - DNA, 25 bp, Homo sapien
gcttggaccctggaacatcattttt

SEQ ID NO: 57081 - DNA, 25 bp, Homo sapien
tgggcgatacaattttaactcactt

SEQ ID NO: 57082 - DNA, 25 bp, Homo sapien
ttaactcacttcgtttccagcttta

SEQ ID NO: 57083 - DNA, 25 bp, Homo sapien
tcgtttccagctttacatgtggttt

SEQ ID NO: 57084 - DNA, 25 bp, Homo sapien
ctccaacccggttgatgtggttcga

SEQ ID NO: 57085 - DNA, 25 bp, Homo sapien
gatgtggttcgaactcgcatgatga

SEQ ID NO: 57086 - DNA, 25 bp, Homo sapien
tcgcatgatgaaccagagggcaatc

SEQ ID NO: 57087 - DNA, 25 bp, Homo sapien
caatcgtgggacatgtggatctcta

SEQ ID NO: 57088 - DNA, 25 bp, Homo sapien
tggatctctataagggcactgttga

SEQ ID NO: 57089 - DNA, 25 bp, Homo sapien
aacatgagggcttttttgcactcta

SEQ ID NO: 57090 - DNA, 25 bp, Homo sapien
tggccaaactggcttcggcttggac

SEQ ID NO: 57091 - DNA, 25 bp, Homo sapien
gaagctccattgaccgaagccacag

SEQ ID NO: 57092 - DNA, 25 bp, Homo sapien
ttgaccgaagccacagggcagcatg

SEQ ID NO: 57093 - DNA, 25 bp, Homo sapien
atgccaaggataaagctggctgctt

SEQ ID NO: 57094 - DNA, 25 bp, Homo sapien
tgggcggtgaaacttttccagatga

SEQ ID NO: 57095 - DNA, 25 bp, Homo sapien
taaatgtgttactggctttgtgcct

SEQ ID NO: 57096 - DNA, 25 bp, Homo sapien
gctttgtgcctgtagctcattttat

SEQ ID NO: 57097 - DNA, 25 bp, Homo sapien
tatgacctatatgctcctgatttaa

SEQ ID NO: 57098 - DNA, 25 bp, Homo sapien
agagatctgtgtactgtttacttcc

SEQ ID NO: 57099 - DNA, 25 bp, Homo sapien
ctgtttacttcccacttcccagaat

SEQ ID NO: 57100 - DNA, 25 bp, Homo sapien
ttcccagaatcccttgtatctcctt

SEQ ID NO: 57101 - DNA, 25 bp, Homo sapien
gtatctcctttctcgggaattgtat

SEQ ID NO: 57102 - DNA, 25 bp, Homo sapien
gttaacctaagcacatacacagcaa

SEQ ID NO: 57103 - DNA, 25 bp, Homo sapien
acagcaattgctcgactgtgtcaat

SEQ ID NO: 57104 - DNA, 25 bp, Homo sapien
gctcgactgtgtcaattaaatgagt

SEQ ID NO: 57105 - DNA, 25 bp, Homo sapien
tgagtaaaggaagcccaagtacttt

SEQ ID NO: 57106 - DNA, 25 bp, Homo sapien
cagtgactgaaaagcttcataaggg

SEQ ID NO: 57107 - DNA, 25 bp, Homo sapien
gggaaagggctaatactgtaatggt

SEQ ID NO: 57108 - DNA, 25 bp, Homo sapien
acatatgtgtcaattcagtttcctt

SEQ ID NO: 57109 - DNA, 25 bp, Homo sapien
aattcagtttccttagaccagtgcc

SEQ ID NO: 57110 - DNA, 25 bp, Homo sapien
gtttccttagaccagtgccagtgtg

SEQ ID NO: 57111 - DNA, 25 bp, Homo sapien
gtgccagtgtggaggattaattgaa

SEQ ID NO: 57112 - DNA, 25 bp, Homo sapien
gaggattaattgaaaaccaggacca

SEQ ID NO: 57113 - DNA, 25 bp, Homo sapien
ctgaaagaggacgtgtgtatacaca

SEQ ID NO: 57114 - DNA, 25 bp, Homo sapien
cacacacagagattggtataatgga

SEQ ID NO: 57115 - DNA, 25 bp, Homo sapien
gatggtttaggtgtacagcaaattt

SEQ ID NO: 57116 - DNA, 25 bp, Homo sapien
aaatagtcagtggattgtgtcttac

SEQ ID NO: 57117 - DNA, 25 bp, Homo sapien
attgtgtcttactacttcatgtccc

SEQ ID NO: 57118 - DNA, 25 bp, Homo sapien
tacttcatgtcccagtgtaagcctt

SEQ ID NO: 57119 - DNA, 25 bp, Homo sapien
gtcccagtgtaagcctttatgtcct

SEQ ID NO: 57120 - DNA, 25 bp, Homo sapien
gtaagcctttatgtcctaagcagga

SEQ ID NO: 57121 - DNA, 25 bp, Homo sapien
gtcctaagcaggactttattgttag

SEQ ID NO: 57122 - DNA, 25 bp, Homo sapien
ttataggctaataacctgcagcaga

SEQ ID NO: 57123 - DNA, 25 bp, Homo sapien
ctgcagcagaaattcatactctatt

SEQ ID NO: 57124 - DNA, 25 bp, Homo sapien
gctgacatgttaaacttactcttgg

SEQ ID NO: 57125 - DNA, 25 bp, Homo sapien
aacttactcttggtttagagcatgt

SEQ ID NO: 57126 - DNA, 25 bp, Homo sapien
aaacacctaaggtagctctatgcta

SEQ ID NO: 57127 - DNA, 25 bp, Homo sapien
gtatttgctgatacgttgctcacat

SEQ ID NO: 57128 - DNA, 25 bp, Homo sapien
gatacgttgctcacattctcaagca

SEQ ID NO: 57129 - DNA, 25 bp, Homo sapien
tcaactgcattaaccgatctgagag

SEQ ID NO: 57130 - DNA, 25 bp, Homo sapien
gatctgagagttttcctttaacctg

SEQ ID NO: 57131 - DNA, 25 bp, Homo sapien
gagttttcctttaacctggactgtg

SEQ ID NO: 57132 - DNA, 25 bp, Homo sapien
taacctggactgtgtttctcaagca

SEQ ID NO: 57133 - DNA, 25 bp, Homo sapien
gtgtttctcaagcacattttttctt

SEQ ID NO: 57134 - DNA, 25 bp, Homo sapien
caaggactagaactgtatttttaag

SEQ ID NO: 57135 - DNA, 25 bp, Homo sapien
ctttacctcctttcagctgtttcaa

SEQ ID NO: 57136 - DNA, 25 bp, Homo sapien
gctgtttcaaacaggtgccaggata

SEQ ID NO: 57137 - DNA, 25 bp, Homo sapien
ggtgccaggatacctatgtcttaga

SEQ ID NO: 57138 - DNA, 25 bp, Homo sapien
ggattatgtgaaagagcccagggac

SEQ ID NO: 57139 - DNA, 25 bp, Homo sapien
gagcccagggacattatccattaca

SEQ ID NO: 57140 - DNA, 25 bp, Homo sapien
taactctttcatttaaaggtccaga

SEQ ID NO: 57141 - DNA, 25 bp, Homo sapien
agggaccaagaacgcagacctgatt

SEQ ID NO: 57142 - DNA, 25 bp, Homo sapien
agacctgatttccaagccaagactc

SEQ ID NO: 57143 - DNA, 25 bp, Homo sapien
aagactcccatgctgcctcatttgt

SEQ ID NO: 57144 - DNA, 25 bp, Homo sapien
gctgcctcatttgtattcaagcctt

SEQ ID NO: 57145 - DNA, 25 bp, Homo sapien
ttcaagcctttaacaggagggcaaa

SEQ ID NO: 57146 - DNA, 25 bp, Homo sapien
aaatgagagcgaatgtcgttgctga

SEQ ID NO: 57147 - DNA, 25 bp, Homo sapien
gaatgtcgttgctgagtgtactcta

SEQ ID NO: 57148 - DNA, 25 bp, Homo sapien
gaaagtgcagctatcaaccagattc

SEQ ID NO: 57149 - DNA, 25 bp, Homo sapien
gctatcaaccagattcttggcagaa

SEQ ID NO: 57150 - DNA, 25 bp, Homo sapien
ttggcagaaggtggcatgccctctc

SEQ ID NO: 57151 - DNA, 25 bp, Homo sapien
cccgtgaagagcaggctaaatatta

SEQ ID NO: 57152 - DNA, 25 bp, Homo sapien
gaaagacagctacatatgcagcttt

SEQ ID NO: 57153 - DNA, 25 bp, Homo sapien
ccaggctggtctgcaagagacaatt

SEQ ID NO: 57154 - DNA, 25 bp, Homo sapien
actacaggaatctgcatcaggtaca

SEQ ID NO: 57155 - DNA, 25 bp, Homo sapien
aaaagacctcacattaagaagcctc

SEQ ID NO: 57156 - DNA, 25 bp, Homo sapien
gcctctgaatgcttttatgttatac

SEQ ID NO: 57157 - DNA, 25 bp, Homo sapien
tgcttcctgtggtagtgtctttcag

SEQ ID NO: 57158 - DNA, 25 bp, Homo sapien
tagtgtctttcaggtatccgttcca

SEQ ID NO: 57159 - DNA, 25 bp, Homo sapien
tatccgttccactagctacaggtga

SEQ ID NO: 57160 - DNA, 25 bp, Homo sapien
gttccactagctacaggtgagcatt

SEQ ID NO: 57161 - DNA, 25 bp, Homo sapien
gttggataatggtaatctctttttc

SEQ ID NO: 57162 - DNA, 25 bp, Homo sapien
gaactcattcattcttgtcccagaa

SEQ ID NO: 57163 - DNA, 25 bp, Homo sapien
gaattctgttgagaacatccattca

SEQ ID NO: 57164 - DNA, 25 bp, Homo sapien
acatccattcattctggctaattga

SEQ ID NO: 57165 - DNA, 25 bp, Homo sapien
gaataactgtggatacgatcccttt

SEQ ID NO: 57166 - DNA, 25 bp, Homo sapien
gatacgatccctttagaacctgctt

SEQ ID NO: 57167 - DNA, 25 bp, Homo sapien
tagaacctgcttctctgatctgtgt

SEQ ID NO: 57168 - DNA, 25 bp, Homo sapien
tgactgtttgaatgagagtctcatc

SEQ ID NO: 57169 - DNA, 25 bp, Homo sapien
ttgaatgagagtctcatcttggcta

SEQ ID NO: 57170 - DNA, 25 bp, Homo sapien
tctcatcttggctaggcaccatggc

SEQ ID NO: 57171 - DNA, 25 bp, Homo sapien
tcatcttggctaggcaccatggcgc

SEQ ID NO: 57172 - DNA, 25 bp, Homo sapien
atcttggctaggcaccatggcgcaa

SEQ ID NO: 57173 - DNA, 25 bp, Homo sapien
ttggctaggcaccatggcgcaacaa

SEQ ID NO: 57174 - DNA, 25 bp, Homo sapien
tggctaggcaccatggcgcaacaac

SEQ ID NO: 57175 - DNA, 25 bp, Homo sapien
gctaggcaccatggcgcaacaactg

SEQ ID NO: 57176 - DNA, 25 bp, Homo sapien
gcctgggcaacctatcaagacgctg

SEQ ID NO: 57177 - DNA, 25 bp, Homo sapien
cctgggcaacctatcaagacgctgt

SEQ ID NO: 57178 - DNA, 25 bp, Homo sapien
gacgctgtctttacgaaaagaaaag

SEQ ID NO: 57179 - DNA, 25 bp, Homo sapien
ctcgtcttaacactagtggacaatt

SEQ ID NO: 57180 - DNA, 25 bp, Homo sapien
ctagcattttgtttggaggatttca

SEQ ID NO: 57181 - DNA, 25 bp, Homo sapien
aggatttcagagttaacctcatgga

SEQ ID NO: 57182 - DNA, 25 bp, Homo sapien
gaattcaggattttttagcaagttt

SEQ ID NO: 57183 - DNA, 25 bp, Homo sapien
tttgcttttggttttatcttggctt

SEQ ID NO: 57184 - DNA, 25 bp, Homo sapien
cttggcttttagtaatcatgttggc

SEQ ID NO: 57185 - DNA, 25 bp, Homo sapien
aaacagatgcccctggtcttgcttt

SEQ ID NO: 57186 - DNA, 25 bp, Homo sapien
tgctttcatcactctaggatcatga

SEQ ID NO: 57187 - DNA, 25 bp, Homo sapien
tcatgaagtgctatgctatttcctg

SEQ ID NO: 57188 - DNA, 25 bp, Homo sapien
gattgtttggatcagagctcagttc

SEQ ID NO: 57189 - DNA, 25 bp, Homo sapien
gatcagagctcagttcctgtagaaa

SEQ ID NO: 57190 - DNA, 25 bp, Homo sapien
tcctcgtccggcctgcagcccagaa

SEQ ID NO: 57191 - DNA, 25 bp, Homo sapien
ccggacgctggctcgggactgtctt

SEQ ID NO: 57192 - DNA, 25 bp, Homo sapien
acgctggctcgggactgtcttcaac

SEQ ID NO: 57193 - DNA, 25 bp, Homo sapien
gctggctcgggactgtcttcaaccc

SEQ ID NO: 57194 - DNA, 25 bp, Homo sapien
tggctcgggactgtcttcaaccctg

SEQ ID NO: 57195 - DNA, 25 bp, Homo sapien
ggctcgggactgtcttcaaccctgc

SEQ ID NO: 57196 - DNA, 25 bp, Homo sapien
ccctgccctgcaccttgggcacggg

SEQ ID NO: 57197 - DNA, 25 bp, Homo sapien
ttgggcacgggagagcgccacccgc

SEQ ID NO: 57198 - DNA, 25 bp, Homo sapien
ctcgctccgggtgcgtgaccggccc

SEQ ID NO: 57199 - DNA, 25 bp, Homo sapien
tgaccggcccgccaccttgtacaga

SEQ ID NO: 57200 - DNA, 25 bp, Homo sapien
cttgtacagaaccagcactcccagg

SEQ ID NO: 57201 - DNA, 25 bp, Homo sapien
gaaaatcgctgcagcgacacaagtg

SEQ ID NO: 57202 - DNA, 25 bp, Homo sapien
tgcagcgacacaagtgaccctgggc

SEQ ID NO: 57203 - DNA, 25 bp, Homo sapien
acacaagtgaccctgggcgcgtgca

SEQ ID NO: 57204 - DNA, 25 bp, Homo sapien
agggccagaccctggctggaagcca

SEQ ID NO: 57205 - DNA, 25 bp, Homo sapien
gctggaagccagaacgcagactgca

SEQ ID NO: 57206 - DNA, 25 bp, Homo sapien
gggtcacttccttcatgtaagactt

SEQ ID NO: 57207 - DNA, 25 bp, Homo sapien
ttccttcatgtaagactttggccga

SEQ ID NO: 57208 - DNA, 25 bp, Homo sapien
gactttggccgaaatttctacacct

SEQ ID NO: 57209 - DNA, 25 bp, Homo sapien
tttggccgaaatttctacacctgtg

SEQ ID NO: 57210 - DNA, 25 bp, Homo sapien
ggccgaaatttctacacctgtgtct

SEQ ID NO: 57211 - DNA, 25 bp, Homo sapien
atttctacacctgtgtctagtcctc

SEQ ID NO: 57212 - DNA, 25 bp, Homo sapien
tcactgaatttcctgctttcctggt

SEQ ID NO: 57213 - DNA, 25 bp, Homo sapien
tgaatttcctgctttcctggttgaa

SEQ ID NO: 57214 - DNA, 25 bp, Homo sapien
atttcctgctttcctggttgaattt

SEQ ID NO: 57215 - DNA, 25 bp, Homo sapien
ttcctgctttcctggttgaattttc

SEQ ID NO: 57216 - DNA, 25 bp, Homo sapien
cctgctttcctggttgaattttcta

SEQ ID NO: 57217 - DNA, 25 bp, Homo sapien
gctttcctggttgaattttctactg

SEQ ID NO: 57218 - DNA, 25 bp, Homo sapien
ggttgaattttctactgtttcacgt

SEQ ID NO: 57219 - DNA, 25 bp, Homo sapien
gaattttctactgtttcacgtggtg

SEQ ID NO: 57220 - DNA, 25 bp, Homo sapien
attttctactgtttcacgtggtgta

SEQ ID NO: 57221 - DNA, 25 bp, Homo sapien
ttctactgtttcacgtggtgtaacc

SEQ ID NO: 57222 - DNA, 25 bp, Homo sapien
gcgcccttggcgtgcccctttgtgt

SEQ ID NO: 57223 - DNA, 25 bp, Homo sapien
ggacccaagatagaggtttatattc

SEQ ID NO: 57224 - DNA, 25 bp, Homo sapien
aatgacagcatatcaaacttcctat

SEQ ID NO: 57225 - DNA, 25 bp, Homo sapien
tcctatgggaaaaagtctggtgggt

SEQ ID NO: 57226 - DNA, 25 bp, Homo sapien
gtcagctgacagatttcccatttag

SEQ ID NO: 57227 - DNA, 25 bp, Homo sapien
cagatttcccatttagtagtcatag

SEQ ID NO: 57228 - DNA, 25 bp, Homo sapien
agggacatgtattcattttgttatt

SEQ ID NO: 57229 - DNA, 25 bp, Homo sapien
gttattttgagcattgataggtcag

SEQ ID NO: 57230 - DNA, 25 bp, Homo sapien
ggtcagtatatctacctaatctgtt

SEQ ID NO: 57231 - DNA, 25 bp, Homo sapien
aaaccattaccattgatctgtctta

SEQ ID NO: 57232 - DNA, 25 bp, Homo sapien
ccattgatctgtcttatgccataat

SEQ ID NO: 57233 - DNA, 25 bp, Homo sapien
attgaatgctcttgaatttgtatat

SEQ ID NO: 57234 - DNA, 25 bp, Homo sapien
gaggacgaaatctaccgcttcaaca

SEQ ID NO: 57235 - DNA, 25 bp, Homo sapien
aagaccaacagccttatctggacca

SEQ ID NO: 57236 - DNA, 25 bp, Homo sapien
tatctggaccacgaggaccacaagg

SEQ ID NO: 57237 - DNA, 25 bp, Homo sapien
aaagactcagcctttcacatcatgt

SEQ ID NO: 57238 - DNA, 25 bp, Homo sapien
acatcatgtcccacgagagcccagg

SEQ ID NO: 57239 - DNA, 25 bp, Homo sapien
gcatcgagtggctctgtctggagaa

SEQ ID NO: 57240 - DNA, 25 bp, Homo sapien
ggagaatgccccatgctatgacaat

SEQ ID NO: 57241 - DNA, 25 bp, Homo sapien
tatgacaatgttccccaaggcatct

SEQ ID NO: 57242 - DNA, 25 bp, Homo sapien
atctttgcccctgaattcttcttca

SEQ ID NO: 57243 - DNA, 25 bp, Homo sapien
attcttcttcaaggtgttggtgagc

SEQ ID NO: 57244 - DNA, 25 bp, Homo sapien
tcttccgggacagtgtctatgttct

SEQ ID NO: 57245 - DNA, 25 bp, Homo sapien
gagcactgtgagcacctgagcatga

SEQ ID NO: 57246 - DNA, 25 bp, Homo sapien
gagcatgaaactcgacgcgttcttc

SEQ ID NO: 57247 - DNA, 25 bp, Homo sapien
aaactcgacgcgttcttcggcatct

SEQ ID NO: 57248 - DNA, 25 bp, Homo sapien
ggacgttcgtggtcctgcgcttctg

SEQ ID NO: 57249 - DNA, 25 bp, Homo sapien
aggttctcctatttcctgaactcag

SEQ ID NO: 57250 - DNA, 25 bp, Homo sapien
tgaactcagctgaggccttgccttg

SEQ ID NO: 57251 - DNA, 25 bp, Homo sapien
agctgtggcctaggctacctcaaga

SEQ ID NO: 57252 - DNA, 25 bp, Homo sapien
taggctacctcaagactcacctcat

SEQ ID NO: 57253 - DNA, 25 bp, Homo sapien
acctcatccttaccgcacatttaag

SEQ ID NO: 57254 - DNA, 25 bp, Homo sapien
taccgcacatttaaggcgccattgc

SEQ ID NO: 57255 - DNA, 25 bp, Homo sapien
tttaaggcgccattgcttttgggag

SEQ ID NO: 57256 - DNA, 25 bp, Homo sapien
tgaaactttttataacagggaatga

SEQ ID NO: 57257 - DNA, 25 bp, Homo sapien
gtgaaaacctaaatccacctggcat

SEQ ID NO: 57258 - DNA, 25 bp, Homo sapien
aaaacctaaatccacctggcatggt

SEQ ID NO: 57259 - DNA, 25 bp, Homo sapien
aaatccacctggcatggttgctctg

SEQ ID NO: 57260 - DNA, 25 bp, Homo sapien
cacctggcatggttgctctgctgaa

SEQ ID NO: 57261 - DNA, 25 bp, Homo sapien
tggcatggttgctctgctgaactac

SEQ ID NO: 57262 - DNA, 25 bp, Homo sapien
atggttgctctgctgaactaccgta

SEQ ID NO: 57263 - DNA, 25 bp, Homo sapien
gttgctctgctgaactaccgtaagg

SEQ ID NO: 57264 - DNA, 25 bp, Homo sapien
tgctctgctgaactaccgtaaggat

SEQ ID NO: 57265 - DNA, 25 bp, Homo sapien
gaactaccgtaaggatggtcagtat

SEQ ID NO: 57266 - DNA, 25 bp, Homo sapien
ggatggtcagtatgaccccatatat

SEQ ID NO: 57267 - DNA, 25 bp, Homo sapien
aacatcaaatgctggcactatatac

SEQ ID NO: 57268 - DNA, 25 bp, Homo sapien
aaatgctggcactatatacatacga

SEQ ID NO: 57269 - DNA, 25 bp, Homo sapien
aatgctggcactatatacatacgat

SEQ ID NO: 57270 - DNA, 25 bp, Homo sapien
tgctggcactatatacatacgatca

SEQ ID NO: 57271 - DNA, 25 bp, Homo sapien
gctggcactatatacatacgatcag

SEQ ID NO: 57272 - DNA, 25 bp, Homo sapien
gcactatatacatacgatcagcctg

SEQ ID NO: 57273 - DNA, 25 bp, Homo sapien
actatatacatacgatcagcctgat

SEQ ID NO: 57274 - DNA, 25 bp, Homo sapien
ctatatacatacgatcagcctgatt

SEQ ID NO: 57275 - DNA, 25 bp, Homo sapien
atatacatacgatcagcctgattat

SEQ ID NO: 57276 - DNA, 25 bp, Homo sapien
tacatacgatcagcctgattatgat

SEQ ID NO: 57277 - DNA, 25 bp, Homo sapien
acgatcagcctgattatgatatcac

SEQ ID NO: 57278 - DNA, 25 bp, Homo sapien
atattttttaacaatgcccaatctg

SEQ ID NO: 57279 - DNA, 25 bp, Homo sapien
aacaatgcccaatctgtatgaataa

SEQ ID NO: 57280 - DNA, 25 bp, Homo sapien
gtatgaataatgtaaacttcgattt

SEQ ID NO: 57281 - DNA, 25 bp, Homo sapien
gtaaatgccaaactaccgacttgat

SEQ ID NO: 57282 - DNA, 25 bp, Homo sapien
gccaaactaccgacttgatagggat

SEQ ID NO: 57283 - DNA, 25 bp, Homo sapien
accgacttgatagggatgtttttgt

SEQ ID NO: 57284 - DNA, 25 bp, Homo sapien
tttctaagactttttcacatccaaa

SEQ ID NO: 57285 - DNA, 25 bp, Homo sapien
gggttggtacagaaacttgaagctg

SEQ ID NO: 57286 - DNA, 25 bp, Homo sapien
acttgaagctgtttgtgatatgtac

SEQ ID NO: 57287 - DNA, 25 bp, Homo sapien
agctgtttgtgatatgtacaactca

SEQ ID NO: 57288 - DNA, 25 bp, Homo sapien
gtacaactcagatgtttctcattaa

SEQ ID NO: 57289 - DNA, 25 bp, Homo sapien
caataagtatacatgtggcttcaca

SEQ ID NO: 57290 - DNA, 25 bp, Homo sapien
gtggcttcacatttattaaacaata

SEQ ID NO: 57291 - DNA, 25 bp, Homo sapien
ataaattccgcacagaaagtttcat

SEQ ID NO: 57292 - DNA, 25 bp, Homo sapien
gtttcatttcaccaatgtgtcacag

SEQ ID NO: 57293 - DNA, 25 bp, Homo sapien
gaaacaaactcatgtcttcgtctgt

SEQ ID NO: 57294 - DNA, 25 bp, Homo sapien
atgtcttcgtctgttgtctgtacat

SEQ ID NO: 57295 - DNA, 25 bp, Homo sapien
tgttgtctgtacattctccgttaat

SEQ ID NO: 57296 - DNA, 25 bp, Homo sapien
tctccgttaatgtttctcgcattta

SEQ ID NO: 57297 - DNA, 25 bp, Homo sapien
gaaacaccttttactccaaatgtat

SEQ ID NO: 57298 - DNA, 25 bp, Homo sapien
gtattaaagttgatcccttctctgt

SEQ ID NO: 57299 - DNA, 25 bp, Homo sapien
gatcccttctctgtaaatttgtgta

SEQ ID NO: 57300 - DNA, 25 bp, Homo sapien
cagcctcctggtggataatgaataa

SEQ ID NO: 57301 - DNA, 25 bp, Homo sapien
cctcctggtggataatgaataacaa

SEQ ID NO: 57302 - DNA, 25 bp, Homo sapien
taatgaataacaactgagccagacc

SEQ ID NO: 57303 - DNA, 25 bp, Homo sapien
tgaataacaactgagccagacctgc

SEQ ID NO: 57304 - DNA, 25 bp, Homo sapien
acttgggcctggtggaagggctctc

SEQ ID NO: 57305 - DNA, 25 bp, Homo sapien
cagggactgggctgcttgctttcta

SEQ ID NO: 57306 - DNA, 25 bp, Homo sapien
agggactgggctgcttgctttctat

SEQ ID NO: 57307 - DNA, 25 bp, Homo sapien
gggactgggctgcttgctttctatt

SEQ ID NO: 57308 - DNA, 25 bp, Homo sapien
gactgggctgcttgctttctattta

SEQ ID NO: 57309 - DNA, 25 bp, Homo sapien
actgggctgcttgctttctatttat

SEQ ID NO: 57310 - DNA, 25 bp, Homo sapien
tgggctgcttgctttctatttatta

SEQ ID NO: 57311 - DNA, 25 bp, Homo sapien
gtgctagactattatatttagtagt

SEQ ID NO: 57312 - DNA, 25 bp, Homo sapien
agtagtatgtcattgtaactagcca

SEQ ID NO: 57313 - DNA, 25 bp, Homo sapien
gtaactagccaatatcacagctttt

SEQ ID NO: 57314 - DNA, 25 bp, Homo sapien
aactagccaatatcacagcttttga

SEQ ID NO: 57315 - DNA, 25 bp, Homo sapien
ctagccaatatcacagcttttgaaa

SEQ ID NO: 57316 - DNA, 25 bp, Homo sapien
cagaaacatggcagataggtatcaa

SEQ ID NO: 57317 - DNA, 25 bp, Homo sapien
gcagataggtatcaatatgttttca

SEQ ID NO: 57318 - DNA, 25 bp, Homo sapien
ataggtatcaatatgttttcaatgc

SEQ ID NO: 57319 - DNA, 25 bp, Homo sapien
ttttcaatgcctgatgacctataag

SEQ ID NO: 57320 - DNA, 25 bp, Homo sapien
caatgcctgatgacctataagaaga

SEQ ID NO: 57321 - DNA, 25 bp, Homo sapien
gcctgatgacctataagaagaaagt

SEQ ID NO: 57322 - DNA, 25 bp, Homo sapien
ggtgtgtgtggtcttactcatcttc

SEQ ID NO: 57323 - DNA, 25 bp, Homo sapien
actcatcttctagtacctttaagga

SEQ ID NO: 57324 - DNA, 25 bp, Homo sapien
atcctaaggacttggacacttgcaa

SEQ ID NO: 57325 - DNA, 25 bp, Homo sapien
ttaaacccaagcctccctggattga

SEQ ID NO: 57326 - DNA, 25 bp, Homo sapien
agcctccctggattgataatatata

SEQ ID NO: 57327 - DNA, 25 bp, Homo sapien
acacatttgtcagcatttccggtcg

SEQ ID NO: 57328 - DNA, 25 bp, Homo sapien
tcagcatttccggtcgtggtgagag

SEQ ID NO: 57329 - DNA, 25 bp, Homo sapien
gaggcagctgtttgagctccaatgt

SEQ ID NO: 57330 - DNA, 25 bp, Homo sapien
gctccaatgtgtgcagctttgaact

SEQ ID NO: 57331 - DNA, 25 bp, Homo sapien
gtgcctcttctgaaaggtctaacca

SEQ ID NO: 57332 - DNA, 25 bp, Homo sapien
aaccattattggataactggctttt

SEQ ID NO: 57333 - DNA, 25 bp, Homo sapien
ttctctgaacctcaattgtatatct

SEQ ID NO: 57334 - DNA, 25 bp, Homo sapien
gaacctcaattgtatatctagacat

SEQ ID NO: 57335 - DNA, 25 bp, Homo sapien
aattgttttctgtataggatgttgt

SEQ ID NO: 57336 - DNA, 25 bp, Homo sapien
ctgtataggatgttgtttggtttgt

SEQ ID NO: 57337 - DNA, 25 bp, Homo sapien
tgtttctgagtgtttaaattttgca

SEQ ID NO: 57338 - DNA, 25 bp, Homo sapien
atttgtgcttcagtacctagataaa

SEQ ID NO: 57339 - DNA, 25 bp, Homo sapien
gtgcttcagtacctagataaattgg

SEQ ID NO: 57340 - DNA, 25 bp, Homo sapien
gcctgggagacacataagcaattca

SEQ ID NO: 57341 - DNA, 25 bp, Homo sapien
gggagacacataagcaattcactgc

SEQ ID NO: 57342 - DNA, 25 bp, Homo sapien
gtaaaatgacggaaactgactcaat

SEQ ID NO: 57343 - DNA, 25 bp, Homo sapien
ggaaactgactcaatatgtcaggtt

SEQ ID NO: 57344 - DNA, 25 bp, Homo sapien
gtggagggtgccgtgtcactgttgg

SEQ ID NO: 57345 - DNA, 25 bp, Homo sapien
tgtcactgttggttggaggacaagt

SEQ ID NO: 57346 - DNA, 25 bp, Homo sapien
tgttggttggaggacaagtgggcac

SEQ ID NO: 57347 - DNA, 25 bp, Homo sapien
gcctccctagcccaggcagagagtg

SEQ ID NO: 57348 - DNA, 25 bp, Homo sapien
acaggcaggcccttgggtgctaagg

SEQ ID NO: 57349 - DNA, 25 bp, Homo sapien
gctgcatgtgggtagcccgagctcc

SEQ ID NO: 57350 - DNA, 25 bp, Homo sapien
gagctcctactctgtctaaagaggg

SEQ ID NO: 57351 - DNA, 25 bp, Homo sapien
gctcctactctgtctaaagagggcc

SEQ ID NO: 57352 - DNA, 25 bp, Homo sapien
tcctactctgtctaaagagggccac

SEQ ID NO: 57353 - DNA, 25 bp, Homo sapien
ctactctgtctaaagagggccacag

SEQ ID NO: 57354 - DNA, 25 bp, Homo sapien
actctgtctaaagagggccacagtg

SEQ ID NO: 57355 - DNA, 25 bp, Homo sapien
ttcttcagtcatggcattcgcagtg

SEQ ID NO: 57356 - DNA, 25 bp, Homo sapien
agtcatggcattcgcagtgcccagt

SEQ ID NO: 57357 - DNA, 25 bp, Homo sapien
atggcattcgcagtgcccagtgatg

SEQ ID NO: 57358 - DNA, 25 bp, Homo sapien
attcgcagtgcccagtgatggcatt

SEQ ID NO: 57359 - DNA, 25 bp, Homo sapien
ccagtgatggcattactctgcacta

SEQ ID NO: 57360 - DNA, 25 bp, Homo sapien
gtgatggcattactctgcactatag

SEQ ID NO: 57361 - DNA, 25 bp, Homo sapien
gatggcattactctgcactatagcc

SEQ ID NO: 57362 - DNA, 25 bp, Homo sapien
gcattactctgcactatagccattt

SEQ ID NO: 57363 - DNA, 25 bp, Homo sapien
ttactctgcactatagccatttgcc

SEQ ID NO: 57364 - DNA, 25 bp, Homo sapien
actatagccatttgccccaacttaa

SEQ ID NO: 57365 - DNA, 25 bp, Homo sapien
gccatttgccccaacttaagtttag

SEQ ID NO: 57366 - DNA, 25 bp, Homo sapien
caggcctggatcagcccctcattgt

SEQ ID NO: 57367 - DNA, 25 bp, Homo sapien
aggcctggatcagcccctcattgtg

SEQ ID NO: 57368 - DNA, 25 bp, Homo sapien
ggcctggatcagcccctcattgtga

SEQ ID NO: 57369 - DNA, 25 bp, Homo sapien
gcctggatcagcccctcattgtgat

SEQ ID NO: 57370 - DNA, 25 bp, Homo sapien
cctggatcagcccctcattgtgatc

SEQ ID NO: 57371 - DNA, 25 bp, Homo sapien
ctggatcagcccctcattgtgatct

SEQ ID NO: 57372 - DNA, 25 bp, Homo sapien
tggatcagcccctcattgtgatctg

SEQ ID NO: 57373 - DNA, 25 bp, Homo sapien
ggatcagcccctcattgtgatctgg

SEQ ID NO: 57374 - DNA, 25 bp, Homo sapien
gatcagcccctcattgtgatctggg

SEQ ID NO: 57375 - DNA, 25 bp, Homo sapien
ggttgtagtgcatgtcttggagtta

SEQ ID NO: 57376 - DNA, 25 bp, Homo sapien
aataatttcattgtttctgttacta

SEQ ID NO: 57377 - DNA, 25 bp, Homo sapien
tttcattgtttctgttactaacatt

SEQ ID NO: 57378 - DNA, 25 bp, Homo sapien
ctaacattaaaagtgtgcaaattgt

SEQ ID NO: 57379 - DNA, 25 bp, Homo sapien
gtataaaattaggtacttcgattag

SEQ ID NO: 57380 - DNA, 25 bp, Homo sapien
ttaagcatgcccagttatgccaagc

SEQ ID NO: 57381 - DNA, 25 bp, Homo sapien
aagcatgcccagttatgccaagcat

SEQ ID NO: 57382 - DNA, 25 bp, Homo sapien
gcatgcccagttatgccaagcatag

SEQ ID NO: 57383 - DNA, 25 bp, Homo sapien
gcccagttatgccaagcatagtaaa

SEQ ID NO: 57384 - DNA, 25 bp, Homo sapien
gaagtattgttatccctagcatgag

SEQ ID NO: 57385 - DNA, 25 bp, Homo sapien
tatgaaaaactttgtcttgtcatta

SEQ ID NO: 57386 - DNA, 25 bp, Homo sapien
attcctctcagatgtcatttttgag

SEQ ID NO: 57387 - DNA, 25 bp, Homo sapien
tgtcatttttgagtggtccaagcct

SEQ ID NO: 57388 - DNA, 25 bp, Homo sapien
agtggtccaagcctgctgttttgaa

SEQ ID NO: 57389 - DNA, 25 bp, Homo sapien
aagcctgctgttttgaacccacagc

SEQ ID NO: 57390 - DNA, 25 bp, Homo sapien
agcagtggagatttgtattcttatt

SEQ ID NO: 57391 - DNA, 25 bp, Homo sapien
gtattcttatttacagttgtgtact

SEQ ID NO: 57392 - DNA, 25 bp, Homo sapien
gatacaaagtctgtgtctaaatatt

SEQ ID NO: 57393 - DNA, 25 bp, Homo sapien
gtgatttttcattctcttggattct

SEQ ID NO: 57394 - DNA, 25 bp, Homo sapien
agtgtggtgccttttatatgcctca

SEQ ID NO: 57395 - DNA, 25 bp, Homo sapien
tatatgcctcacatagtctccttgt

SEQ ID NO: 57396 - DNA, 25 bp, Homo sapien
gtctccttgttctcctactaatatt

SEQ ID NO: 57397 - DNA, 25 bp, Homo sapien
agaggccctgagctccacccttcgg

SEQ ID NO: 57398 - DNA, 25 bp, Homo sapien
ctgcgggccaagaacctactgctga

SEQ ID NO: 57399 - DNA, 25 bp, Homo sapien
tgcgggccaagaacctactgctgac

SEQ ID NO: 57400 - DNA, 25 bp, Homo sapien
gcgggccaagaacctactgctgaca

SEQ ID NO: 57401 - DNA, 25 bp, Homo sapien
cgggccaagaacctactgctgacag

SEQ ID NO: 57402 - DNA, 25 bp, Homo sapien
gggccaagaacctactgctgacaga

SEQ ID NO: 57403 - DNA, 25 bp, Homo sapien
ggccaagaacctactgctgacagac

SEQ ID NO: 57404 - DNA, 25 bp, Homo sapien
gccaagaacctactgctgacagaca

SEQ ID NO: 57405 - DNA, 25 bp, Homo sapien
ccaagaacctactgctgacagacaa

SEQ ID NO: 57406 - DNA, 25 bp, Homo sapien
caagaacctactgctgacagacaag

SEQ ID NO: 57407 - DNA, 25 bp, Homo sapien
aagaacctactgctgacagacaaga

SEQ ID NO: 57408 - DNA, 25 bp, Homo sapien
cccatccaggcgcaaagaggaatag

SEQ ID NO: 57409 - DNA, 25 bp, Homo sapien
gaataggagggacatggaaccattt

SEQ ID NO: 57410 - DNA, 25 bp, Homo sapien
ggacatggaaccatttgcctctggc

SEQ ID NO: 57411 - DNA, 25 bp, Homo sapien
catggaaccatttgcctctggctgt

SEQ ID NO: 57412 - DNA, 25 bp, Homo sapien
ggctgtgtcacagggtgagccccaa

SEQ ID NO: 57413 - DNA, 25 bp, Homo sapien
gtgtcacagggtgagccccaaaatt

SEQ ID NO: 57414 - DNA, 25 bp, Homo sapien
ggaggccacgtggattcttggcttt

SEQ ID NO: 57415 - DNA, 25 bp, Homo sapien
cacgtggattcttggctttgtacag

SEQ ID NO: 57416 - DNA, 25 bp, Homo sapien
cttggctttgtacaggaagatctac

SEQ ID NO: 57417 - DNA, 25 bp, Homo sapien
gaagatctacaagagcaagccaaca

SEQ ID NO: 57418 - DNA, 25 bp, Homo sapien
aagagcaagccaacagagtaaagtg

SEQ ID NO: 57419 - DNA, 25 bp, Homo sapien
gtatctagtggaaaacctaagcctc

SEQ ID NO: 57420 - DNA, 25 bp, Homo sapien
tctccctggaggcaactgttttgat

SEQ ID NO: 57421 - DNA, 25 bp, Homo sapien
tggaggcaactgttttgatccattt

SEQ ID NO: 57422 - DNA, 25 bp, Homo sapien
acacacactgccagagatactctag

SEQ ID NO: 57423 - DNA, 25 bp, Homo sapien
gatactctaggcatgtaaagcacaa

SEQ ID NO: 57424 - DNA, 25 bp, Homo sapien
tacatataaaatctgcgggcttcaa

SEQ ID NO: 57425 - DNA, 25 bp, Homo sapien
gtaggatgtcatctatactgtcata

SEQ ID NO: 57426 - DNA, 25 bp, Homo sapien
ctatactgtcatacactttgttttt

SEQ ID NO: 57427 - DNA, 25 bp, Homo sapien
tacactttgttttttatcacttact

SEQ ID NO: 57428 - DNA, 25 bp, Homo sapien
cacttacttaatgttatatcttgga

SEQ ID NO: 57429 - DNA, 25 bp, Homo sapien
cttggatattgtattaccctgggta

SEQ ID NO: 57430 - DNA, 25 bp, Homo sapien
aagaattcccattcgctctatctgg

SEQ ID NO: 57431 - DNA, 25 bp, Homo sapien
attcgctctatctggcaggtatatt

SEQ ID NO: 57432 - DNA, 25 bp, Homo sapien
ggctatgatttattggtgaggtcca

SEQ ID NO: 57433 - DNA, 25 bp, Homo sapien
tggccttagccgatggagtgaccat

SEQ ID NO: 57434 - DNA, 25 bp, Homo sapien
gtgaccatgcaggtgactgtcagaa

SEQ ID NO: 57435 - DNA, 25 bp, Homo sapien
gtagatgttatcttagcttctgttg

SEQ ID NO: 57436 - DNA, 25 bp, Homo sapien
gcttctgttggataaatgcttactg

SEQ ID NO: 57437 - DNA, 25 bp, Homo sapien
gaaactgatgcacactacatggtca

SEQ ID NO: 57438 - DNA, 25 bp, Homo sapien
tacatggtcagtgggcttttaggct

SEQ ID NO: 57439 - DNA, 25 bp, Homo sapien
ttttaggctagtggcatcagtttcc

SEQ ID NO: 57440 - DNA, 25 bp, Homo sapien
aaattaaacatttggccctgagcca

SEQ ID NO: 57441 - DNA, 25 bp, Homo sapien
tccccacctggtacatgatacatga

SEQ ID NO: 57442 - DNA, 25 bp, Homo sapien
tacatgatacatgaccccaggttcc

SEQ ID NO: 57443 - DNA, 25 bp, Homo sapien
gttccagtgtagaacctgagtcccc

SEQ ID NO: 57444 - DNA, 25 bp, Homo sapien
aaagccatccctgcattgatatgtc

SEQ ID NO: 57445 - DNA, 25 bp, Homo sapien
attgatatgtcttgactctcctgtc

SEQ ID NO: 57446 - DNA, 25 bp, Homo sapien
atgtcttgactctcctgtctacttt

SEQ ID NO: 57447 - DNA, 25 bp, Homo sapien
tgtctacttttgcacacacccttaa

SEQ ID NO: 57448 - DNA, 25 bp, Homo sapien
tttgcacacacccttaatttttaat

SEQ ID NO: 57449 - DNA, 25 bp, Homo sapien
gttttgtacaatgttatctctgtgg

SEQ ID NO: 57450 - DNA, 25 bp, Homo sapien
tacaatgttatctctgtgggaggaa

SEQ ID NO: 57451 - DNA, 25 bp, Homo sapien
ctgagttccactgctctagaatcta

SEQ ID NO: 57452 - DNA, 25 bp, Homo sapien
ataagttccctgatagaagagcatg

SEQ ID NO: 57453 - DNA, 25 bp, Homo sapien
gagggtcatccattccacattaaaa

SEQ ID NO: 57454 - DNA, 25 bp, Homo sapien
gacattcttttcagggttgaatttt

SEQ ID NO: 57455 - DNA, 25 bp, Homo sapien
gttgaattttcagtggtatccatta

SEQ ID NO: 57456 - DNA, 25 bp, Homo sapien
ggtatccattatgaaaactcacttc

SEQ ID NO: 57457 - DNA, 25 bp, Homo sapien
tcacttcatggattcagtgggcaaa

SEQ ID NO: 57458 - DNA, 25 bp, Homo sapien
tagcggcaagcaagagacatggatt

SEQ ID NO: 57459 - DNA, 25 bp, Homo sapien
gacatggattcacttattcggcaaa

SEQ ID NO: 57460 - DNA, 25 bp, Homo sapien
gcaaacatttactgggcatgccaca

SEQ ID NO: 57461 - DNA, 25 bp, Homo sapien
atgccacatgccagataccgggcta

SEQ ID NO: 57462 - DNA, 25 bp, Homo sapien
agataccgggctaagtatctggcat

SEQ ID NO: 57463 - DNA, 25 bp, Homo sapien
gtagtgtgcgtgcaaaatccgcttc

SEQ ID NO: 57464 - DNA, 25 bp, Homo sapien
aaatccgcttcctgagcgtagggtg

SEQ ID NO: 57465 - DNA, 25 bp, Homo sapien
cgctagggctcggttgtgaaataca

SEQ ID NO: 57466 - DNA, 25 bp, Homo sapien
gaaatacagcgtagtcagcccttgc

SEQ ID NO: 57467 - DNA, 25 bp, Homo sapien
tagtcagcccttgcgctcagtgtag

SEQ ID NO: 57468 - DNA, 25 bp, Homo sapien
gctcagtgtagaaacccacgtctgt

SEQ ID NO: 57469 - DNA, 25 bp, Homo sapien
tctgtaaggtcggtcttcgtccatc

SEQ ID NO: 57470 - DNA, 25 bp, Homo sapien
ttcgtccatctgcttttttctgaaa

SEQ ID NO: 57471 - DNA, 25 bp, Homo sapien
gaaatacactaagagcagccacaaa

SEQ ID NO: 57472 - DNA, 25 bp, Homo sapien
gcagccacaaaactgtaacctcaag

SEQ ID NO: 57473 - DNA, 25 bp, Homo sapien
aaaccataaagcttggagtgcctta

SEQ ID NO: 57474 - DNA, 25 bp, Homo sapien
gaccaggtcagtgggatccctggct

SEQ ID NO: 57475 - DNA, 25 bp, Homo sapien
ctggctgcatcttcgtccatgcaag

SEQ ID NO: 57476 - DNA, 25 bp, Homo sapien
atcttcgtccatgcaagcggcttca

SEQ ID NO: 57477 - DNA, 25 bp, Homo sapien
tcgtccatgcaagcggcttcattgg

SEQ ID NO: 57478 - DNA, 25 bp, Homo sapien
tcattggcggtcacccgacccgaga

SEQ ID NO: 57479 - DNA, 25 bp, Homo sapien
cgacccgagagggtgccttgagcat

SEQ ID NO: 57480 - DNA, 25 bp, Homo sapien
ccatcttctttgttatctacactga

SEQ ID NO: 57481 - DNA, 25 bp, Homo sapien
tttgttatctacactgaccaggctg

SEQ ID NO: 57482 - DNA, 25 bp, Homo sapien
tgttatctacactgaccaggctgga

SEQ ID NO: 57483 - DNA, 25 bp, Homo sapien
ctggacagtggcgaatacagtgtgt

SEQ ID NO: 57484 - DNA, 25 bp, Homo sapien
acagtggcgaatacagtgtgtgccc

SEQ ID NO: 57485 - DNA, 25 bp, Homo sapien
gggaaccagcaactcaacgtcagga

SEQ ID NO: 57486 - DNA, 25 bp, Homo sapien
ggaaccagcaactcaacgtcaggat

SEQ ID NO: 57487 - DNA, 25 bp, Homo sapien
gaaccagcaactcaacgtcaggatc

SEQ ID NO: 57488 - DNA, 25 bp, Homo sapien
aaccagcaactcaacgtcaggatcc

SEQ ID NO: 57489 - DNA, 25 bp, Homo sapien
accagcaactcaacgtcaggatcct

SEQ ID NO: 57490 - DNA, 25 bp, Homo sapien
ccagcaactcaacgtcaggatcctg

SEQ ID NO: 57491 - DNA, 25 bp, Homo sapien
agcaactcaacgtcaggatcctgca

SEQ ID NO: 57492 - DNA, 25 bp, Homo sapien
gcaactcaacgtcaggatcctgcag

SEQ ID NO: 57493 - DNA, 25 bp, Homo sapien
aactcaacgtcaggatcctgcagct

SEQ ID NO: 57494 - DNA, 25 bp, Homo sapien
cccacagactgggtgtgagtgtgaa

SEQ ID NO: 57495 - DNA, 25 bp, Homo sapien
agtgtgaagatggtcctgatgggca

SEQ ID NO: 57496 - DNA, 25 bp, Homo sapien
gtggagggtgccgtgtcactgttgg

SEQ ID NO: 57497 - DNA, 25 bp, Homo sapien
tgtcactgttggttggaggacaagt

SEQ ID NO: 57498 - DNA, 25 bp, Homo sapien
tgagaccctggtgacccatggaaag

SEQ ID NO: 57499 - DNA, 25 bp, Homo sapien
gcctccctagcccaggcagagagtg

SEQ ID NO: 57500 - DNA, 25 bp, Homo sapien
acaggcaggcccttgggtgctaagg

SEQ ID NO: 57501 - DNA, 25 bp, Homo sapien
gctgcatgtgggtagcccgagctcc

SEQ ID NO: 57502 - DNA, 25 bp, Homo sapien
gagctcctactctgtctaaagaggg

SEQ ID NO: 57503 - DNA, 25 bp, Homo sapien
gctcctactctgtctaaagagggcc

SEQ ID NO: 57504 - DNA, 25 bp, Homo sapien
ctactctgtctaaagagggccacag

SEQ ID NO: 57505 - DNA, 25 bp, Homo sapien
actctgtctaaagagggccacagtg

SEQ ID NO: 57506 - DNA, 25 bp, Homo sapien
catgctgccctagtacgtgtttaga

SEQ ID NO: 57507 - DNA, 25 bp, Homo sapien
gagatgattgtacttcagaatgact

SEQ ID NO: 57508 - DNA, 25 bp, Homo sapien
agaatgactgaaacccatataccac

SEQ ID NO: 57509 - DNA, 25 bp, Homo sapien
catataccacccaaaatccattttc

SEQ ID NO: 57510 - DNA, 25 bp, Homo sapien
gaccataatggtgggtcgccccgga

SEQ ID NO: 57511 - DNA, 25 bp, Homo sapien
ccttccagtttctctacacgtatat

SEQ ID NO: 57512 - DNA, 25 bp, Homo sapien
gggagatctctgcatcacatgtcag

SEQ ID NO: 57513 - DNA, 25 bp, Homo sapien
atcacatgtcagcaggatgctaaac

SEQ ID NO: 57514 - DNA, 25 bp, Homo sapien
ggatgctaaactacatggaacagga

SEQ ID NO: 57515 - DNA, 25 bp, Homo sapien
aattggccctgatggtataatcaca

SEQ ID NO: 57516 - DNA, 25 bp, Homo sapien
tgaatgactttacccaaaaccccag

SEQ ID NO: 57517 - DNA, 25 bp, Homo sapien
ggttcagctggagtaaaagcacaat

SEQ ID NO: 57518 - DNA, 25 bp, Homo sapien
caggacttggtggacaaattgcaaa

SEQ ID NO: 57519 - DNA, 25 bp, Homo sapien
aaaccaaagtcaaagcttacaagag

SEQ ID NO: 57520 - DNA, 25 bp, Homo sapien
gaacaatccaatgtcaaccttgcca

SEQ ID NO: 57521 - DNA, 25 bp, Homo sapien
aacaatccaatgtcaaccttgccaa

SEQ ID NO: 57522 - DNA, 25 bp, Homo sapien
caatccaatgtcaaccttgccaagt

SEQ ID NO: 57523 - DNA, 25 bp, Homo sapien
atccaatgtcaaccttgccaagttc

SEQ ID NO: 57524 - DNA, 25 bp, Homo sapien
tccaatgtcaaccttgccaagttcc

SEQ ID NO: 57525 - DNA, 25 bp, Homo sapien
aatgtcaaccttgccaagttccgca

SEQ ID NO: 57526 - DNA, 25 bp, Homo sapien
tgtcaaccttgccaagttccgcaag

SEQ ID NO: 57527 - DNA, 25 bp, Homo sapien
tcaaccttgccaagttccgcaagct

SEQ ID NO: 57528 - DNA, 25 bp, Homo sapien
gaaatgcacgaaatgtgaagttctt

SEQ ID NO: 57529 - DNA, 25 bp, Homo sapien
gaggattttacgagtctcttgccaa

SEQ ID NO: 57530 - DNA, 25 bp, Homo sapien
tgccaaggtcaagccagggaacttc

SEQ ID NO: 57531 - DNA, 25 bp, Homo sapien
gggaacttcaaggtccagactgtct

SEQ ID NO: 57532 - DNA, 25 bp, Homo sapien
ggtccagactgtctctccaagagaa

SEQ ID NO: 57533 - DNA, 25 bp, Homo sapien
gagaaccagcttccaaagtgactga

SEQ ID NO: 57534 - DNA, 25 bp, Homo sapien
gaacaagctctgttaagacctcaaa

SEQ ID NO: 57535 - DNA, 25 bp, Homo sapien
ctcaaagtaaaaatggccctcagga

SEQ ID NO: 57536 - DNA, 25 bp, Homo sapien
agtagacttggacgatgcgagcctt

SEQ ID NO: 57537 - DNA, 25 bp, Homo sapien
agccttccggtcagtgacgtgtgag

SEQ ID NO: 57538 - DNA, 25 bp, Homo sapien
tgccgtcctcagttacctttcatga

SEQ ID NO: 57539 - DNA, 25 bp, Homo sapien
gttacctttcatgaggcttctagcc

SEQ ID NO: 57540 - DNA, 25 bp, Homo sapien
tgaaggaccttttctgctgggacaa

SEQ ID NO: 57541 - DNA, 25 bp, Homo sapien
gaccttttctgctgggacaagacac

SEQ ID NO: 57542 - DNA, 25 bp, Homo sapien
acagggtcctccgatgctggccttt

SEQ ID NO: 57543 - DNA, 25 bp, Homo sapien
ctagaggcagccactcatggattca

SEQ ID NO: 57544 - DNA, 25 bp, Homo sapien
ggcagccactcatggattcaagtcc

SEQ ID NO: 57545 - DNA, 25 bp, Homo sapien
actcatggattcaagtcctggctcc

SEQ ID NO: 57546 - DNA, 25 bp, Homo sapien
atggattcaagtcctggctccgcct

SEQ ID NO: 57547 - DNA, 25 bp, Homo sapien
gcctcttccatcaggaccactatta

SEQ ID NO: 57548 - DNA, 25 bp, Homo sapien
atcaggaccactattaagccatagg

SEQ ID NO: 57549 - DNA, 25 bp, Homo sapien
actattaagccataggagtcctggg

SEQ ID NO: 57550 - DNA, 25 bp, Homo sapien
gggtgcaaagggtgcccctctgtca

SEQ ID NO: 57551 - DNA, 25 bp, Homo sapien
aggtgcccacaaccacggagatgtt

SEQ ID NO: 57552 - DNA, 25 bp, Homo sapien
ttctgctgctatggtcctgtggtcc

SEQ ID NO: 57553 - DNA, 25 bp, Homo sapien
aaatgggtatggtgcctgctacaac

SEQ ID NO: 57554 - DNA, 25 bp, Homo sapien
agccagagaccatccttttctgcat

SEQ ID NO: 57555 - DNA, 25 bp, Homo sapien
ttttctgcatctctagctttcacag

SEQ ID NO: 57556 - DNA, 25 bp, Homo sapien
tttcacagctgcaaagagacttctt

SEQ ID NO: 57557 - DNA, 25 bp, Homo sapien
gacttcttctagcaagtttgcaaaa

SEQ ID NO: 57558 - DNA, 25 bp, Homo sapien
gtggaagaaagcctcattgacatga

SEQ ID NO: 57559 - DNA, 25 bp, Homo sapien
acatgagagacctctgcagtctgct

SEQ ID NO: 57560 - DNA, 25 bp, Homo sapien
gccgcctactgagagcaagccattg

SEQ ID NO: 57561 - DNA, 25 bp, Homo sapien
aaccttgactcctgccactaggttt

SEQ ID NO: 57562 - DNA, 25 bp, Homo sapien
gcagtcgcctggcagcaaggccttc

SEQ ID NO: 57563 - DNA, 25 bp, Homo sapien
cagtcgcctggcagcaaggccttcc

SEQ ID NO: 57564 - DNA, 25 bp, Homo sapien
gcatcctcatcgaccacctgcgggc

SEQ ID NO: 57565 - DNA, 25 bp, Homo sapien
tcatcgaccacctgcgggccccgga

SEQ ID NO: 57566 - DNA, 25 bp, Homo sapien
catcgaccacctgcgggccccggac

SEQ ID NO: 57567 - DNA, 25 bp, Homo sapien
gagaaggcaccagcagtcgcctggc

SEQ ID NO: 57568 - DNA, 25 bp, Homo sapien
agaaggcaccagcagtcgcctggca

SEQ ID NO: 57569 - DNA, 25 bp, Homo sapien
gaaggcaccagcagtcgcctggcag

SEQ ID NO: 57570 - DNA, 25 bp, Homo sapien
aggcaccagcagtcgcctggcagca

SEQ ID NO: 57571 - DNA, 25 bp, Homo sapien
ggcaccagcagtcgcctggcagcaa

SEQ ID NO: 57572 - DNA, 25 bp, Homo sapien
accagcagtcgcctggcagcaaggc

SEQ ID NO: 57573 - DNA, 25 bp, Homo sapien
gcacatccctaaactggttgctgat

SEQ ID NO: 57574 - DNA, 25 bp, Homo sapien
gagaagttgaatctagatccactaa

SEQ ID NO: 57575 - DNA, 25 bp, Homo sapien
gatccactaattactcatactctga

SEQ ID NO: 57576 - DNA, 25 bp, Homo sapien
tactcatactctgaatcttgataaa

SEQ ID NO: 57577 - DNA, 25 bp, Homo sapien
ctggaaaatggtaaactgcccacat

SEQ ID NO: 57578 - DNA, 25 bp, Homo sapien
ggtaaactgcccacataaattttat

SEQ ID NO: 57579 - DNA, 25 bp, Homo sapien
tgtctgtgtgtttgagaccaagaga

SEQ ID NO: 57580 - DNA, 25 bp, Homo sapien
tagaagaagggtcgtccctgctgca

SEQ ID NO: 57581 - DNA, 25 bp, Homo sapien
aagaagggtcgtccctgctgcagaa

SEQ ID NO: 57582 - DNA, 25 bp, Homo sapien
gctgcagaagctgtatactgataat

SEQ ID NO: 57583 - DNA, 25 bp, Homo sapien
tttcaggaatttgtaaagcatctcc

SEQ ID NO: 57584 - DNA, 25 bp, Homo sapien
atgcttctgttgagctctccattat

SEQ ID NO: 57585 - DNA, 25 bp, Homo sapien
gagctctccattatgtgggacccat

SEQ ID NO: 57586 - DNA, 25 bp, Homo sapien
gggacccattcctcaccaaaatgag

SEQ ID NO: 57587 - DNA, 25 bp, Homo sapien
agagacagtgactgttcctgccaca

SEQ ID NO: 57588 - DNA, 25 bp, Homo sapien
agtccttcccagtctaacactattc

SEQ ID NO: 57589 - DNA, 25 bp, Homo sapien
taacactattcctgggctgcatgat

SEQ ID NO: 57590 - DNA, 25 bp, Homo sapien
gtgacaggcacttagatgcagcatt

SEQ ID NO: 57591 - DNA, 25 bp, Homo sapien
atttcaccactcatgctactaatca

SEQ ID NO: 57592 - DNA, 25 bp, Homo sapien
aatcatctacctgctactactgtaa

SEQ ID NO: 57593 - DNA, 25 bp, Homo sapien
taaaccatggttccagcagcctgtt

SEQ ID NO: 57594 - DNA, 25 bp, Homo sapien
cacaccatcaggatagcacagggaa

SEQ ID NO: 57595 - DNA, 25 bp, Homo sapien
attgtgatctggggtatgtgactga

SEQ ID NO: 57596 - DNA, 25 bp, Homo sapien
ttgtgatctggggtatgtgactgat

SEQ ID NO: 57597 - DNA, 25 bp, Homo sapien
tgtgatctggggtatgtgactgatg

SEQ ID NO: 57598 - DNA, 25 bp, Homo sapien
gtgatctggggtatgtgactgatga

SEQ ID NO: 57599 - DNA, 25 bp, Homo sapien
tgatctggggtatgtgactgatgag

SEQ ID NO: 57600 - DNA, 25 bp, Homo sapien
gatctggggtatgtgactgatgaga

SEQ ID NO: 57601 - DNA, 25 bp, Homo sapien
atctggggtatgtgactgatgagag

SEQ ID NO: 57602 - DNA, 25 bp, Homo sapien
tatgtgactgatgagagccaggagc

SEQ ID NO: 57603 - DNA, 25 bp, Homo sapien
atgtgactgatgagagccaggagct

SEQ ID NO: 57604 - DNA, 25 bp, Homo sapien
tgtgactgatgagagccaggagctg

SEQ ID NO: 57605 - DNA, 25 bp, Homo sapien
gtgactgatgagagccaggagctga

SEQ ID NO: 57606 - DNA, 25 bp, Homo sapien
gaggtgttttttctaattggcatga

SEQ ID NO: 57607 - DNA, 25 bp, Homo sapien
gaaggtgtcatacagatttgcaaag

SEQ ID NO: 57608 - DNA, 25 bp, Homo sapien
tcatttgggatgctactctagtatt

SEQ ID NO: 57609 - DNA, 25 bp, Homo sapien
gctactctagtattccagacctgaa

SEQ ID NO: 57610 - DNA, 25 bp, Homo sapien
tcacaataattttctacctggtctc

SEQ ID NO: 57611 - DNA, 25 bp, Homo sapien
gtctctccttgttctgataatgaaa

SEQ ID NO: 57612 - DNA, 25 bp, Homo sapien
aaaagcacttacttcgtgtccgact

SEQ ID NO: 57613 - DNA, 25 bp, Homo sapien
acttcgtgtccgactcttctgagca

SEQ ID NO: 57614 - DNA, 25 bp, Homo sapien
gactcttctgagcacctacttacat

SEQ ID NO: 57615 - DNA, 25 bp, Homo sapien
gagcacctacttacatgcattactg

SEQ ID NO: 57616 - DNA, 25 bp, Homo sapien
gcattactgcatgcacttcttacaa

SEQ ID NO: 57617 - DNA, 25 bp, Homo sapien
gcacatccctaaactggttgctgat

SEQ ID NO: 57618 - DNA, 25 bp, Homo sapien
acatccctaaactggttgctgatta

SEQ ID NO: 57619 - DNA, 25 bp, Homo sapien
gttgctgattatatggcagagaagt

SEQ ID NO: 57620 - DNA, 25 bp, Homo sapien
gcagagaagttgaatctagatccac

SEQ ID NO: 57621 - DNA, 25 bp, Homo sapien
gaagttgaatctagatccactaatt

SEQ ID NO: 57622 - DNA, 25 bp, Homo sapien
gaatctagatccactaattactcat

SEQ ID NO: 57623 - DNA, 25 bp, Homo sapien
gatccactaattactcatactctga

SEQ ID NO: 57624 - DNA, 25 bp, Homo sapien
cactaattactcatactctgaatct

SEQ ID NO: 57625 - DNA, 25 bp, Homo sapien
ttactcatactctgaatcttgataa

SEQ ID NO: 57626 - DNA, 25 bp, Homo sapien
catactctgaatcttgataaaatca

SEQ ID NO: 57627 - DNA, 25 bp, Homo sapien
caatgaagcagttgaattaatgaaa

SEQ ID NO: 57628 - DNA, 25 bp, Homo sapien
tcggccctggattatcccagcgaga

SEQ ID NO: 57629 - DNA, 25 bp, Homo sapien
ggccctggattatcccagcgagaac

SEQ ID NO: 57630 - DNA, 25 bp, Homo sapien
tggattatcccagcgagaacctggc

SEQ ID NO: 57631 - DNA, 25 bp, Homo sapien
attatcccagcgagaacctggcctt

SEQ ID NO: 57632 - DNA, 25 bp, Homo sapien
tggccttcatcgacgagtcctcgga

SEQ ID NO: 57633 - DNA, 25 bp, Homo sapien
atcgacgagtcctcggatacgcaga

SEQ ID NO: 57634 - DNA, 25 bp, Homo sapien
acgagtcctcggatacgcagagcga

SEQ ID NO: 57635 - DNA, 25 bp, Homo sapien
gagtcctcggatacgcagagcgagc

SEQ ID NO: 57636 - DNA, 25 bp, Homo sapien
atacgcagagcgagcgcggctgccc

SEQ ID NO: 57637 - DNA, 25 bp, Homo sapien
ggcgtccccgagacaaaggcgtgcc

SEQ ID NO: 57638 - DNA, 25 bp, Homo sapien
ccccgagacaaaggcgtgccggtgt

SEQ ID NO: 57639 - DNA, 25 bp, Homo sapien
tccaaatctcttgcttgtcattgac

SEQ ID NO: 57640 - DNA, 25 bp, Homo sapien
aaatctcttgcttgtcattgactct

SEQ ID NO: 57641 - DNA, 25 bp, Homo sapien
gcttgtcattgactcttgcgtgtca

SEQ ID NO: 57642 - DNA, 25 bp, Homo sapien
tcttgcgtgtcaatttccctcaggt

SEQ ID NO: 57643 - DNA, 25 bp, Homo sapien
gtgtcaatttccctcaggttctatt

SEQ ID NO: 57644 - DNA, 25 bp, Homo sapien
caatttccctcaggttctattttct

SEQ ID NO: 57645 - DNA, 25 bp, Homo sapien
caacctttaaaattgtcacctctgt

SEQ ID NO: 57646 - DNA, 25 bp, Homo sapien
tgtcacctctgttaaggttgaactt

SEQ ID NO: 57647 - DNA, 25 bp, Homo sapien
tctgttaaggttgaactttgccaaa

SEQ ID NO: 57648 - DNA, 25 bp, Homo sapien
aactaggtaatgttttgtatataca

SEQ ID NO: 57649 - DNA, 25 bp, Homo sapien
agcacttttgttattccatcaataa

SEQ ID NO: 57650 - DNA, 25 bp, Homo sapien
cccaggtgccgattgcaccagggag

SEQ ID NO: 57651 - DNA, 25 bp, Homo sapien
gggcctgcggctagactcttggaac

SEQ ID NO: 57652 - DNA, 25 bp, Homo sapien
ctgcggctagactcttggaacattc

SEQ ID NO: 57653 - DNA, 25 bp, Homo sapien
ggctagactcttggaacattctgga

SEQ ID NO: 57654 - DNA, 25 bp, Homo sapien
ggaacattctggaactctctccttt

SEQ ID NO: 57655 - DNA, 25 bp, Homo sapien
attctggaactctctcctttcctgg

SEQ ID NO: 57656 - DNA, 25 bp, Homo sapien
gctgcccctgggacatggtggtgat

SEQ ID NO: 57657 - DNA, 25 bp, Homo sapien
gggtgcaggagccagtgtctgttgt

SEQ ID NO: 57658 - DNA, 25 bp, Homo sapien
cagtgtctgttgtcgggactcgcaa

SEQ ID NO: 57659 - DNA, 25 bp, Homo sapien
tgttgtcgggactcgcaagtgccct

SEQ ID NO: 57660 - DNA, 25 bp, Homo sapien
cagtgcagactcaagttatgcttga

SEQ ID NO: 57661 - DNA, 25 bp, Homo sapien
tcattgacaagagttcgtgcgggaa

SEQ ID NO: 57662 - DNA, 25 bp, Homo sapien
gagttcgtgcgggaaaaccacctga

SEQ ID NO: 57663 - DNA, 25 bp, Homo sapien
gacccctagggatttgtcatcttaa

SEQ ID NO: 57664 - DNA, 25 bp, Homo sapien
gactcaaaaggcttaataccaggaa

SEQ ID NO: 57665 - DNA, 25 bp, Homo sapien
ccaggaaccaccttggcaagatatt

SEQ ID NO: 57666 - DNA, 25 bp, Homo sapien
ggcaagatatttacccaccggccat

SEQ ID NO: 57667 - DNA, 25 bp, Homo sapien
ccggccatctctgtttactcatgaa

SEQ ID NO: 57668 - DNA, 25 bp, Homo sapien
tgttaaaacgcagcgctctaaccct

SEQ ID NO: 57669 - DNA, 25 bp, Homo sapien
gcgctctaaccctgcatattattta

SEQ ID NO: 57670 - DNA, 25 bp, Homo sapien
taatctgtaattgtgatgcctctga

SEQ ID NO: 57671 - DNA, 25 bp, Homo sapien
aattgtgatgcctctgatggaataa

SEQ ID NO: 57672 - DNA, 25 bp, Homo sapien
tgaatgatcccatgcggcagcggca

SEQ ID NO: 57673 - DNA, 25 bp, Homo sapien
tgcggcagcggcagctttttgaaga

SEQ ID NO: 57674 - DNA, 25 bp, Homo sapien
tttttgaagaacaggccaaggccaa

SEQ ID NO: 57675 - DNA, 25 bp, Homo sapien
caggtgatgatgaggccatgttcat

SEQ ID NO: 57676 - DNA, 25 bp, Homo sapien
gatgaaaacttctgtactgccctgg

SEQ ID NO: 57677 - DNA, 25 bp, Homo sapien
aacttctgtactgccctggaatatg

SEQ ID NO: 57678 - DNA, 25 bp, Homo sapien
gcatgggcattgatcgagtcgccat

SEQ ID NO: 57679 - DNA, 25 bp, Homo sapien
atcgagtcgccatgtttctcacgga

SEQ ID NO: 57680 - DNA, 25 bp, Homo sapien
tgtttctcacggactccaacaacat

SEQ ID NO: 57681 - DNA, 25 bp, Homo sapien
tctgtttcctgccatgaaacccgaa

SEQ ID NO: 57682 - DNA, 25 bp, Homo sapien
tgtagcaaccactgatacactggaa

SEQ ID NO: 57683 - DNA, 25 bp, Homo sapien
tcagcttagaagcatcctaaataat

SEQ ID NO: 57684 - DNA, 25 bp, Homo sapien
gagagagctgcaaagattggaagaa

SEQ ID NO: 57685 - DNA, 25 bp, Homo sapien
aaagaagacgctggataagtttgca

SEQ ID NO: 57686 - DNA, 25 bp, Homo sapien
cgctggataagtttgcagaggctga

SEQ ID NO: 57687 - DNA, 25 bp, Homo sapien
cagaggctgaggatgagctagttca

SEQ ID NO: 57688 - DNA, 25 bp, Homo sapien
tgaggatgagctagttcagcagaag

SEQ ID NO: 57689 - DNA, 25 bp, Homo sapien
aagcagttggtgagagagctcatct

SEQ ID NO: 57690 - DNA, 25 bp, Homo sapien
atctcagatgtggagtgtcggagtc

SEQ ID NO: 57691 - DNA, 25 bp, Homo sapien
agtgtcggagtcagtggtcaacaat

SEQ ID NO: 57692 - DNA, 25 bp, Homo sapien
cggagtcagtggtcaacaatggagc

SEQ ID NO: 57693 - DNA, 25 bp, Homo sapien
tgcaggacatgagtggaatcatgaa

SEQ ID NO: 57694 - DNA, 25 bp, Homo sapien
attgtctttgtcatctcaggggtcc

SEQ ID NO: 57695 - DNA, 25 bp, Homo sapien
gggtcctgacgctaatccccgtgtg

SEQ ID NO: 57696 - DNA, 25 bp, Homo sapien
cctgacgctaatccccgtgtgctgg

SEQ ID NO: 57697 - DNA, 25 bp, Homo sapien
cgctaatccccgtgtgctggacggc

SEQ ID NO: 57698 - DNA, 25 bp, Homo sapien
gctggacggcgcatgccgtcatccg

SEQ ID NO: 57699 - DNA, 25 bp, Homo sapien
gcatgccgtcatccgggacttctat

SEQ ID NO: 57700 - DNA, 25 bp, Homo sapien
tgggcggcctcaggccttttgttgc

SEQ ID NO: 57701 - DNA, 25 bp, Homo sapien
ttacatggcccgctactcaacatct

SEQ ID NO: 57702 - DNA, 25 bp, Homo sapien
ctgagtaccctaccaagaattacgt

SEQ ID NO: 57703 - DNA, 25 bp, Homo sapien
gagtaccctaccaagaattacgtct

SEQ ID NO: 57704 - DNA, 25 bp, Homo sapien
gtaccctaccaagaattacgtctga

SEQ ID NO: 57705 - DNA, 25 bp, Homo sapien
gacaccagacacagaagggtacgct

SEQ ID NO: 57706 - DNA, 25 bp, Homo sapien
agaagggtacgctgtgatcccactt

SEQ ID NO: 57707 - DNA, 25 bp, Homo sapien
acgctgtgatcccacttctatgaaa

SEQ ID NO: 57708 - DNA, 25 bp, Homo sapien
atgtccaggacagaccaatccacag

SEQ ID NO: 57709 - DNA, 25 bp, Homo sapien
ggacagaccaatccacagaatcagg

SEQ ID NO: 57710 - DNA, 25 bp, Homo sapien
gagaggattcgtgggtgccgggact

SEQ ID NO: 57711 - DNA, 25 bp, Homo sapien
gctgccttctgggtgatgagaatgt

SEQ ID NO: 57712 - DNA, 25 bp, Homo sapien
ctggaatcagatgggatggctgcac

SEQ ID NO: 57713 - DNA, 25 bp, Homo sapien
ggtgaaggtactgaacgccacctca

SEQ ID NO: 57714 - DNA, 25 bp, Homo sapien
aacgccacctcactgtaagacggta

SEQ ID NO: 57715 - DNA, 25 bp, Homo sapien
cctcactgtaagacggtagattttg

SEQ ID NO: 57716 - DNA, 25 bp, Homo sapien
agagattcttttccctatgaatgtg

SEQ ID NO: 57717 - DNA, 25 bp, Homo sapien
gggaaatgcaggatttattctgtga

SEQ ID NO: 57718 - DNA, 25 bp, Homo sapien
ctgtgaattgttgtttctgtgtgtt

SEQ ID NO: 57719 - DNA, 25 bp, Homo sapien
ttctgtgtgttgtccagcgtattca

SEQ ID NO: 57720 - DNA, 25 bp, Homo sapien
gtgtgttgtccagcgtattcattca

SEQ ID NO: 57721 - DNA, 25 bp, Homo sapien
ttcattcactcactcgttttgcaaa

SEQ ID NO: 57722 - DNA, 25 bp, Homo sapien
actcgttttgcaaacataatgggca

SEQ ID NO: 57723 - DNA, 25 bp, Homo sapien
gtgggcatttactgctgctctttaa

SEQ ID NO: 57724 - DNA, 25 bp, Homo sapien
gctgctctttaacagttagctctaa

SEQ ID NO: 57725 - DNA, 25 bp, Homo sapien
tgaaaggacatgttactcaagctgc

SEQ ID NO: 57726 - DNA, 25 bp, Homo sapien
actcaagctgcatccctgtgagaag

SEQ ID NO: 57727 - DNA, 25 bp, Homo sapien
aattaaatatgttagtagtgcccac

SEQ ID NO: 57728 - DNA, 25 bp, Homo sapien
aaatatgttagtagtgcccacttca

SEQ ID NO: 57729 - DNA, 25 bp, Homo sapien
atatgttagtagtgcccacttcaaa

SEQ ID NO: 57730 - DNA, 25 bp, Homo sapien
gttagtagtgcccacttcaaatgac

SEQ ID NO: 57731 - DNA, 25 bp, Homo sapien
agtagtgcccacttcaaatgactgt

SEQ ID NO: 57732 - DNA, 25 bp, Homo sapien
gtagtgcccacttcaaatgactgta

SEQ ID NO: 57733 - DNA, 25 bp, Homo sapien
agtgcccacttcaaatgactgtaaa

SEQ ID NO: 57734 - DNA, 25 bp, Homo sapien
tgcaaggaaaatcctagttttcggt

SEQ ID NO: 57735 - DNA, 25 bp, Homo sapien
ggtccactcgccccactttgtagta

SEQ ID NO: 57736 - DNA, 25 bp, Homo sapien
cgtggtgtaaccctagactggcgcc

SEQ ID NO: 57737 - DNA, 25 bp, Homo sapien
gtgtaaccctagactggcgcccttg

SEQ ID NO: 57738 - DNA, 25 bp, Homo sapien
caagaacaaacgctaactaatattt

SEQ ID NO: 57739 - DNA, 25 bp, Homo sapien
tttttaagagattcttttccctatg

SEQ ID NO: 57740 - DNA, 25 bp, Homo sapien
aagagattcttttccctatgaatgt

SEQ ID NO: 57741 - DNA, 25 bp, Homo sapien
agattcttttccctatgaatgtggg

SEQ ID NO: 57742 - DNA, 25 bp, Homo sapien
gggaaatgcaggatttattctgtga

SEQ ID NO: 57743 - DNA, 25 bp, Homo sapien
atgcaggatttattctgtgaattgt

SEQ ID NO: 57744 - DNA, 25 bp, Homo sapien
ttcattcactcactcgttttgcaaa

SEQ ID NO: 57745 - DNA, 25 bp, Homo sapien
attcactcactcgttttgcaaacat

SEQ ID NO: 57746 - DNA, 25 bp, Homo sapien
actcgttttgcaaacataatgggca

SEQ ID NO: 57747 - DNA, 25 bp, Homo sapien
tttatttctgaaaggacatgttact

SEQ ID NO: 57748 - DNA, 25 bp, Homo sapien
tgaaaggacatgttactcaagctgc

SEQ ID NO: 57749 - DNA, 25 bp, Homo sapien
cattttatctgttctcatgtcaaag

SEQ ID NO: 57750 - DNA, 25 bp, Homo sapien
tcatgtcaaagactactccttgccc

SEQ ID NO: 57751 - DNA, 25 bp, Homo sapien
actccttgccccattgaatatatag

SEQ ID NO: 57752 - DNA, 25 bp, Homo sapien
gaatatatagtggtagcaggtgtac

SEQ ID NO: 57753 - DNA, 25 bp, Homo sapien
ggtgtacaaattggtcaagttgcaa

SEQ ID NO: 57754 - DNA, 25 bp, Homo sapien
aagcatgaatctaagagcacgcaat

SEQ ID NO: 57755 - DNA, 25 bp, Homo sapien
ctaagagcacgcaatatataatttt

SEQ ID NO: 57756 - DNA, 25 bp, Homo sapien
tgttgttttataatgactgctgtac

SEQ ID NO: 57757 - DNA, 25 bp, Homo sapien
actgctgtacagtgggtatagtatt

SEQ ID NO: 57758 - DNA, 25 bp, Homo sapien
tttggttttggttccagattgtgca

SEQ ID NO: 57759 - DNA, 25 bp, Homo sapien
gttttggttccagattgtgcaatct

SEQ ID NO: 57760 - DNA, 25 bp, Homo sapien
gcgaaggccgtggagaccgtgaaga

SEQ ID NO: 57761 - DNA, 25 bp, Homo sapien
agaccgtgaagaagcagcaaggcga

SEQ ID NO: 57762 - DNA, 25 bp, Homo sapien
gtggcagcagctccgtcatgagtct

SEQ ID NO: 57763 - DNA, 25 bp, Homo sapien
ctccgtcatgagtctagctaccaag

SEQ ID NO: 57764 - DNA, 25 bp, Homo sapien
gagtctagctaccaagatgaatgaa

SEQ ID NO: 57765 - DNA, 25 bp, Homo sapien
aaagtcttcagtgatggcctacgcc

SEQ ID NO: 57766 - DNA, 25 bp, Homo sapien
atggcctacgccaaagcacaggatg

SEQ ID NO: 57767 - DNA, 25 bp, Homo sapien
agccctctcccaagatcgagttggc

SEQ ID NO: 57768 - DNA, 25 bp, Homo sapien
tcccaagatcgagttggccgaggat

SEQ ID NO: 57769 - DNA, 25 bp, Homo sapien
tgtggcagcagaagccgttgcagcc

SEQ ID NO: 57770 - DNA, 25 bp, Homo sapien
gttgcagccccacgttgtgctctag

SEQ ID NO: 57771 - DNA, 25 bp, Homo sapien
cccgagggctgcaaggacagcctcg

SEQ ID NO: 57772 - DNA, 25 bp, Homo sapien
gctgcaaggacagcctcgcggtgct

SEQ ID NO: 57773 - DNA, 25 bp, Homo sapien
gcaaggacagcctcgcggtgctgct

SEQ ID NO: 57774 - DNA, 25 bp, Homo sapien
acagcctcgcggtgctgctggagtt

SEQ ID NO: 57775 - DNA, 25 bp, Homo sapien
agctgcgcgccgagcacgtcttcat

SEQ ID NO: 57776 - DNA, 25 bp, Homo sapien
acgtcttcatctgcttccccaagaa

SEQ ID NO: 57777 - DNA, 25 bp, Homo sapien
caccttcggcttcctgggcttcgag

SEQ ID NO: 57778 - DNA, 25 bp, Homo sapien
ttcctgggcttcgagctggtgaggc

SEQ ID NO: 57779 - DNA, 25 bp, Homo sapien
tggcctactcgctgcagggctagcg

SEQ ID NO: 57780 - DNA, 25 bp, Homo sapien
cgcggccccgtgtcgtgtttgtgat

SEQ ID NO: 57781 - DNA, 25 bp, Homo sapien
gccccgtgtcgtgtttgtgatactg

SEQ ID NO: 57782 - DNA, 25 bp, Homo sapien
cagagatatacgtgccaggtggagc

SEQ ID NO: 57783 - DNA, 25 bp, Homo sapien
atatacgtgccaggtggagcaccca

SEQ ID NO: 57784 - DNA, 25 bp, Homo sapien
gtggagcacccaggcctggatcagc

SEQ ID NO: 57785 - DNA, 25 bp, Homo sapien
tggatcagcccctcattgtgatctg

SEQ ID NO: 57786 - DNA, 25 bp, Homo sapien
gatcagcccctcattgtgatctggg

SEQ ID NO: 57787 - DNA, 25 bp, Homo sapien
atgtgactgatgagagccaggagct

SEQ ID NO: 57788 - DNA, 25 bp, Homo sapien
gccaggagctgagaaaatctattgg

SEQ ID NO: 57789 - DNA, 25 bp, Homo sapien
aggagtgcctgaggagagccctcac

SEQ ID NO: 57790 - DNA, 25 bp, Homo sapien
ggaattgctgtttttgtcgtcatct

SEQ ID NO: 57791 - DNA, 25 bp, Homo sapien
ttttgtcgtcatcttgttcattgga

SEQ ID NO: 57792 - DNA, 25 bp, Homo sapien
gggcactacgtcttagctgaacgtg

SEQ ID NO: 57793 - DNA, 25 bp, Homo sapien
ttgcgcccttactgtgattcctggc

SEQ ID NO: 57794 - DNA, 25 bp, Homo sapien
ccttactgtgattcctggcttcatt

SEQ ID NO: 57795 - DNA, 25 bp, Homo sapien
tactgtgattcctggcttcattttt

SEQ ID NO: 57796 - DNA, 25 bp, Homo sapien
tgtgattcctggcttcattttttgc

SEQ ID NO: 57797 - DNA, 25 bp, Homo sapien
gattcctggcttcattttttgctga

SEQ ID NO: 57798 - DNA, 25 bp, Homo sapien
ctggcttcattttttgctgatggtt

SEQ ID NO: 57799 - DNA, 25 bp, Homo sapien
cttcattttttgctgatggttcccc

SEQ ID NO: 57800 - DNA, 25 bp, Homo sapien
tccctccttagcaggtgccgtgctg

SEQ ID NO: 57801 - DNA, 25 bp, Homo sapien
ttagcaggtgccgtgctgggacacc

SEQ ID NO: 57802 - DNA, 25 bp, Homo sapien
aggtgccgtgctgggacaccatacg

SEQ ID NO: 57803 - DNA, 25 bp, Homo sapien
tgctgggacaccatacgggttggtt

SEQ ID NO: 57804 - DNA, 25 bp, Homo sapien
cagagatatacgtgccaggtggagc

SEQ ID NO: 57805 - DNA, 25 bp, Homo sapien
agagatatacgtgccaggtggagca

SEQ ID NO: 57806 - DNA, 25 bp, Homo sapien
gagatatacgtgccaggtggagcac

SEQ ID NO: 57807 - DNA, 25 bp, Homo sapien
caggcctggatcagcccctcattgt

SEQ ID NO: 57808 - DNA, 25 bp, Homo sapien
aggcctggatcagcccctcattgtg

SEQ ID NO: 57809 - DNA, 25 bp, Homo sapien
ggcctggatcagcccctcattgtga

SEQ ID NO: 57810 - DNA, 25 bp, Homo sapien
gcctggatcagcccctcattgtgat

SEQ ID NO: 57811 - DNA, 25 bp, Homo sapien
ctggatcagcccctcattgtgatct

SEQ ID NO: 57812 - DNA, 25 bp, Homo sapien
tggatcagcccctcattgtgatctg

SEQ ID NO: 57813 - DNA, 25 bp, Homo sapien
ggatcagcccctcattgtgatctgg

SEQ ID NO: 57814 - DNA, 25 bp, Homo sapien
gatcagcccctcattgtgatctggg

SEQ ID NO: 57815 - DNA, 25 bp, Homo sapien
gttttttttgtacgcaattctcgat

SEQ ID NO: 57816 - DNA, 25 bp, Homo sapien
tttgtacgcaattctcgattctttg

SEQ ID NO: 57817 - DNA, 25 bp, Homo sapien
ttgtacgcaattctcgattctttga

SEQ ID NO: 57818 - DNA, 25 bp, Homo sapien
tgtacgcaattctcgattctttgaa

SEQ ID NO: 57819 - DNA, 25 bp, Homo sapien
gtacgcaattctcgattctttgaag

SEQ ID NO: 57820 - DNA, 25 bp, Homo sapien
tacgcaattctcgattctttgaaga

SEQ ID NO: 57821 - DNA, 25 bp, Homo sapien
acgcaattctcgattctttgaagag

SEQ ID NO: 57822 - DNA, 25 bp, Homo sapien
cgcaattctcgattctttgaagaga

SEQ ID NO: 57823 - DNA, 25 bp, Homo sapien
ggagccatgaacttctgggccatca

SEQ ID NO: 57824 - DNA, 25 bp, Homo sapien
tgggccatcatcatgtacaaccttg

SEQ ID NO: 57825 - DNA, 25 bp, Homo sapien
gtacaaccttgtgagcctgaacagc

SEQ ID NO: 57826 - DNA, 25 bp, Homo sapien
gtgagcctgaacagcctcaaattca

SEQ ID NO: 57827 - DNA, 25 bp, Homo sapien
aaattcacagagctggttgcccggc

SEQ ID NO: 57828 - DNA, 25 bp, Homo sapien
agaccacgctgtccatcctgtttgt

SEQ ID NO: 57829 - DNA, 25 bp, Homo sapien
ctgtccatcctgtttgtcacctact

SEQ ID NO: 57830 - DNA, 25 bp, Homo sapien
ttgtcacctactgtggcgtccagct

SEQ ID NO: 57831 - DNA, 25 bp, Homo sapien
actgtggcgtccagctggtaaagga

SEQ ID NO: 57832 - DNA, 25 bp, Homo sapien
aggagcgtgagcgaaccttggcact

SEQ ID NO: 57833 - DNA, 25 bp, Homo sapien
tgctcagctattcttgggccagatg

SEQ ID NO: 57834 - DNA, 25 bp, Homo sapien
gatttgactcctgttcttaaacaca

SEQ ID NO: 57835 - DNA, 25 bp, Homo sapien
ccagaggaactggacgtcaccaaac

SEQ ID NO: 57836 - DNA, 25 bp, Homo sapien
ggacgtcaccaaacaaggttgcatt

SEQ ID NO: 57837 - DNA, 25 bp, Homo sapien
cttttgcatccagtttttatagttt

SEQ ID NO: 57838 - DNA, 25 bp, Homo sapien
tatagttttccacaaccaagccacc

SEQ ID NO: 57839 - DNA, 25 bp, Homo sapien
caagccacccttcacagataaaata

SEQ ID NO: 57840 - DNA, 25 bp, Homo sapien
agaccaaagcactgtccccaattgt

SEQ ID NO: 57841 - DNA, 25 bp, Homo sapien
actgtccccaattgttgtcttaact

SEQ ID NO: 57842 - DNA, 25 bp, Homo sapien
gactagacatgttatacagccattt

SEQ ID NO: 57843 - DNA, 25 bp, Homo sapien
agccatttatcttgtacaactgaga

SEQ ID NO: 57844 - DNA, 25 bp, Homo sapien
tttgacctaccttgtagagatgtga

SEQ ID NO: 57845 - DNA, 25 bp, Homo sapien
aagttgcagtacctaccccagctaa

SEQ ID NO: 57846 - DNA, 25 bp, Homo sapien
ttgcagtacctaccccagctaactg

SEQ ID NO: 57847 - DNA, 25 bp, Homo sapien
agtacctaccccagctaactggcag

SEQ ID NO: 57848 - DNA, 25 bp, Homo sapien
aagaagtactactgtgataccaaga

SEQ ID NO: 57849 - DNA, 25 bp, Homo sapien
gaagtactactgtgataccaagaaa

SEQ ID NO: 57850 - DNA, 25 bp, Homo sapien
gtactactgtgataccaagaaactt

SEQ ID NO: 57851 - DNA, 25 bp, Homo sapien
tgataccaagaaacttaactaccgt

SEQ ID NO: 57852 - DNA, 25 bp, Homo sapien
aaacatttaaaggagctaaggagag

SEQ ID NO: 57853 - DNA, 25 bp, Homo sapien
acagaaacatccaagttgcagtacc

SEQ ID NO: 57854 - DNA, 25 bp, Homo sapien
gaaacatccaagttgcagtacctac

SEQ ID NO: 57855 - DNA, 25 bp, Homo sapien
aaacatccaagttgcagtacctacc

SEQ ID NO: 57856 - DNA, 25 bp, Homo sapien
gagagacgctgcattccagaaacgt

SEQ ID NO: 57857 - DNA, 25 bp, Homo sapien
agaaacgtcttaacacttgagtgaa

SEQ ID NO: 57858 - DNA, 25 bp, Homo sapien
ccctgacattaaatgctgaggcttt

SEQ ID NO: 57859 - DNA, 25 bp, Homo sapien
tgctgaggctttaatacacacatat

SEQ ID NO: 57860 - DNA, 25 bp, Homo sapien
tacacacatattttatcccaagttt

SEQ ID NO: 57861 - DNA, 25 bp, Homo sapien
gtggtctgaacaaggcacctgtaaa

SEQ ID NO: 57862 - DNA, 25 bp, Homo sapien
aataatctggtcttggactttttat

SEQ ID NO: 57863 - DNA, 25 bp, Homo sapien
gacttgggccaactaagtctaccca

SEQ ID NO: 57864 - DNA, 25 bp, Homo sapien
tttgccttgtccctttgtgtacaac

SEQ ID NO: 57865 - DNA, 25 bp, Homo sapien
gtccctttgtgtacaaccatgcaaa

SEQ ID NO: 57866 - DNA, 25 bp, Homo sapien
ccatgcaaaactgtttgttggctca

SEQ ID NO: 57867 - DNA, 25 bp, Homo sapien
gagttccaagtctcccctagggttg

SEQ ID NO: 57868 - DNA, 25 bp, Homo sapien
cctagggttgtctctacatttcttt

SEQ ID NO: 57869 - DNA, 25 bp, Homo sapien
tacatttctttatcattccagtggg

SEQ ID NO: 57870 - DNA, 25 bp, Homo sapien
tcattccagtgggtagggtttagct

SEQ ID NO: 57871 - DNA, 25 bp, Homo sapien
tggactgagcagtatggacatttgc

SEQ ID NO: 57872 - DNA, 25 bp, Homo sapien
catttgcttttttcattacgtactg

SEQ ID NO: 57873 - DNA, 25 bp, Homo sapien
cattacgtactgttgtttttccttg

SEQ ID NO: 57874 - DNA, 25 bp, Homo sapien
gtttttccttgttaggtgtgctttg

SEQ ID NO: 57875 - DNA, 25 bp, Homo sapien
aggtgtgctttggtggttttaatat

SEQ ID NO: 57876 - DNA, 25 bp, Homo sapien
tcttcagtgtaattgttcttggtaa

SEQ ID NO: 57877 - DNA, 25 bp, Homo sapien
ggtaattgatacctctctgttttat

SEQ ID NO: 57878 - DNA, 25 bp, Homo sapien
acaatggtgggcagttgctcttaca

SEQ ID NO: 57879 - DNA, 25 bp, Homo sapien
gggcagttgctcttacatgagctaa

SEQ ID NO: 57880 - DNA, 25 bp, Homo sapien
ttacatgagctaagtttggagacct

SEQ ID NO: 57881 - DNA, 25 bp, Homo sapien
gagctaagtttggagacctgaggcc

SEQ ID NO: 57882 - DNA, 25 bp, Homo sapien
caggactggcattgcactagtctga

SEQ ID NO: 57883 - DNA, 25 bp, Homo sapien
gcattgcactagtctgaggtggcca

SEQ ID NO: 57884 - DNA, 25 bp, Homo sapien
tgcactagtctgaggtggccactgc

SEQ ID NO: 57885 - DNA, 25 bp, Homo sapien
tgaggtggccactgcctttgatcaa

SEQ ID NO: 57886 - DNA, 25 bp, Homo sapien
gtggccactgcctttgatcaacctt

SEQ ID NO: 57887 - DNA, 25 bp, Homo sapien
gagggtctaagtagggtcgaacaca

SEQ ID NO: 57888 - DNA, 25 bp, Homo sapien
taagtagggtcgaacacagaagtgg

SEQ ID NO: 57889 - DNA, 25 bp, Homo sapien
gcatgtcatctatgctccaagcagc

SEQ ID NO: 57890 - DNA, 25 bp, Homo sapien
tatgctccaagcagccacaacaagt

SEQ ID NO: 57891 - DNA, 25 bp, Homo sapien
aagcagccacaacaagtatgcaggg

SEQ ID NO: 57892 - DNA, 25 bp, Homo sapien
tcattcccaggaatttatgatgctc

SEQ ID NO: 57893 - DNA, 25 bp, Homo sapien
gatgctctgtttgatattgaaagca

SEQ ID NO: 57894 - DNA, 25 bp, Homo sapien
gcaaagtggacccttccaaggcctg

SEQ ID NO: 57895 - DNA, 25 bp, Homo sapien
tgttgcagccttcacagtgcaggca

SEQ ID NO: 57896 - DNA, 25 bp, Homo sapien
agccttcacagtgcaggcagctgca

SEQ ID NO: 57897 - DNA, 25 bp, Homo sapien
gcagagactttgagtgaagtagcct

SEQ ID NO: 57898 - DNA, 25 bp, Homo sapien
gaagtagcctaagaggattctttag

SEQ ID NO: 57899 - DNA, 25 bp, Homo sapien
ttgaatttgtgtggtatgtcactca

SEQ ID NO: 57900 - DNA, 25 bp, Homo sapien
ctcatcctcctcagcagaagattcc

SEQ ID NO: 57901 - DNA, 25 bp, Homo sapien
agaagattccgctgtgggggcaata

SEQ ID NO: 57902 - DNA, 25 bp, Homo sapien
gggcaataagaagcgcaggcaaatc

SEQ ID NO: 57903 - DNA, 25 bp, Homo sapien
gaagcgcaggcaaatcaatgaagat

SEQ ID NO: 57904 - DNA, 25 bp, Homo sapien
ggcaaatcaatgaagatgagccgta

SEQ ID NO: 57905 - DNA, 25 bp, Homo sapien
tgaagatgagccgtaacagcagcct

SEQ ID NO: 57906 - DNA, 25 bp, Homo sapien
aagatgagccgtaacagcagcctcg

SEQ ID NO: 57907 - DNA, 25 bp, Homo sapien
agatgagccgtaacagcagcctcgg

SEQ ID NO: 57908 - DNA, 25 bp, Homo sapien
atgagccgtaacagcagcctcggcg

SEQ ID NO: 57909 - DNA, 25 bp, Homo sapien
agcctcggcggtgccacccactgca

SEQ ID NO: 57910 - DNA, 25 bp, Homo sapien
gccagctgggaagccaagcatggcc

SEQ ID NO: 57911 - DNA, 25 bp, Homo sapien
gaaaggccagcttcttatcagtctg

SEQ ID NO: 57912 - DNA, 25 bp, Homo sapien
gcttcttatcagtctgtttctgttt

SEQ ID NO: 57913 - DNA, 25 bp, Homo sapien
gtgggaattcagtgtctttagatac

SEQ ID NO: 57914 - DNA, 25 bp, Homo sapien
ttgtttcctagtattgtcaactctt

SEQ ID NO: 57915 - DNA, 25 bp, Homo sapien
gtcaactcttagttatcagattctt

SEQ ID NO: 57916 - DNA, 25 bp, Homo sapien
gaaactactcattgaacctacagct

SEQ ID NO: 57917 - DNA, 25 bp, Homo sapien
aacctacagctggtgttggagtggc

SEQ ID NO: 57918 - DNA, 25 bp, Homo sapien
caacattttcaaactgtttccccag

SEQ ID NO: 57919 - DNA, 25 bp, Homo sapien
catttgtattgtgctcagtggtgga

SEQ ID NO: 57920 - DNA, 25 bp, Homo sapien
gaaatgtagacttaacctcctccat

SEQ ID NO: 57921 - DNA, 25 bp, Homo sapien
acctcctccataacttgggtgaagc

SEQ ID NO: 57922 - DNA, 25 bp, Homo sapien
tctcttgccaccctgcatgttgaag

SEQ ID NO: 57923 - DNA, 25 bp, Homo sapien
gcatgttgaagtccccgaagcggat

SEQ ID NO: 57924 - DNA, 25 bp, Homo sapien
tgtctccactgtcactggagatgag

SEQ ID NO: 57925 - DNA, 25 bp, Homo sapien
tagaacagtatttgcgtacccctca

SEQ ID NO: 57926 - DNA, 25 bp, Homo sapien
tttgcgtacccctcaggaagttagg

SEQ ID NO: 57927 - DNA, 25 bp, Homo sapien
aggctgctagacaggctgccacgag

SEQ ID NO: 57928 - DNA, 25 bp, Homo sapien
gacaggctgccacgagtgtccctaa

SEQ ID NO: 57929 - DNA, 25 bp, Homo sapien
taaccctccctgatggatatccact

SEQ ID NO: 57930 - DNA, 25 bp, Homo sapien
tggatatccactgggagcacttcat

SEQ ID NO: 57931 - DNA, 25 bp, Homo sapien
cactgggagcacttcatcctgttct

SEQ ID NO: 57932 - DNA, 25 bp, Homo sapien
taacattcctgttataaccaaggat

SEQ ID NO: 57933 - DNA, 25 bp, Homo sapien
atcacagagtacagtcttggaggga

SEQ ID NO: 57934 - DNA, 25 bp, Homo sapien
acagaattgtttgtgctgggtattg

SEQ ID NO: 57935 - DNA, 25 bp, Homo sapien
tgtgctgggtattggagctctcagt

SEQ ID NO: 57936 - DNA, 25 bp, Homo sapien
gagaaactgaactgtactgctgcat

SEQ ID NO: 57937 - DNA, 25 bp, Homo sapien
ctgaactgtactgctgcatttcctg

SEQ ID NO: 57938 - DNA, 25 bp, Homo sapien
ttccttcctaggtggctgctttgca

SEQ ID NO: 57939 - DNA, 25 bp, Homo sapien
gctttgcagggctttggctgttacc

SEQ ID NO: 57940 - DNA, 25 bp, Homo sapien
gggctttggctgttacctttccctg

SEQ ID NO: 57941 - DNA, 25 bp, Homo sapien
ggattctcagtcgagtttccagagc

SEQ ID NO: 57942 - DNA, 25 bp, Homo sapien
gagcaggaggccctacagacatttc

SEQ ID NO: 57943 - DNA, 25 bp, Homo sapien
gccccaaatccctgactcaataaag

SEQ ID NO: 57944 - DNA, 25 bp, Homo sapien
atgtcagtgtgttgctcaggatacc

SEQ ID NO: 57945 - DNA, 25 bp, Homo sapien
tgtgttgctcaggataccccaggta

SEQ ID NO: 57946 - DNA, 25 bp, Homo sapien
accccaggtacatcaaggaatcaag

SEQ ID NO: 57947 - DNA, 25 bp, Homo sapien
gattttatgtccagagtatttgagc

SEQ ID NO: 57948 - DNA, 25 bp, Homo sapien
atttgagctcaaaccttgcctgttg

SEQ ID NO: 57949 - DNA, 25 bp, Homo sapien
accttgcctgttgttttctaatcat

SEQ ID NO: 57950 - DNA, 25 bp, Homo sapien
atgatgaatactttctcagtttctt

SEQ ID NO: 57951 - DNA, 25 bp, Homo sapien
taaattgggatttaagactgtacct

SEQ ID NO: 57952 - DNA, 25 bp, Homo sapien
gtacctaactattaagatcactgtg

SEQ ID NO: 57953 - DNA, 25 bp, Homo sapien
actaagtgtctctaaatgtaatgca

SEQ ID NO: 57954 - DNA, 25 bp, Homo sapien
aatgcatcgatttagtgtctggaac

SEQ ID NO: 57955 - DNA, 25 bp, Homo sapien
gcaccgggagcctgtctcagaacta

SEQ ID NO: 57956 - DNA, 25 bp, Homo sapien
gggagcctgtctcagaactatcagt

SEQ ID NO: 57957 - DNA, 25 bp, Homo sapien
agaactatcagtacgaggtgtgcct

SEQ ID NO: 57958 - DNA, 25 bp, Homo sapien
tatcagtacgaggtgtgcctggcag

SEQ ID NO: 57959 - DNA, 25 bp, Homo sapien
tccagttcctgaaaccagtattacc

SEQ ID NO: 57960 - DNA, 25 bp, Homo sapien
agtattacctaatattcagggccat

SEQ ID NO: 57961 - DNA, 25 bp, Homo sapien
acctaatattcagggccattctttt

SEQ ID NO: 57962 - DNA, 25 bp, Homo sapien
ctctaactttaggaatggctttggt

SEQ ID NO: 57963 - DNA, 25 bp, Homo sapien
gaatggctttggtttcagccttcag

SEQ ID NO: 57964 - DNA, 25 bp, Homo sapien
gctttggtttcagccttcagttaaa

SEQ ID NO: 57965 - DNA, 25 bp, Homo sapien
tggtttcagccttcagttaaagtaa

SEQ ID NO: 57966 - DNA, 25 bp, Homo sapien
ggctgatagagatcaaagtcccttc

SEQ ID NO: 57967 - DNA, 25 bp, Homo sapien
gatagagatcaaagtcccttctcaa

SEQ ID NO: 57968 - DNA, 25 bp, Homo sapien
agatcaaagtcccttctcaaaaata

SEQ ID NO: 57969 - DNA, 25 bp, Homo sapien
tgaattaaagtcctccatgttgaaa

SEQ ID NO: 57970 - DNA, 25 bp, Homo sapien
taaagtcctccatgttgaaaaataa

SEQ ID NO: 57971 - DNA, 25 bp, Homo sapien
aatcaagccctggaacagatgaaga

SEQ ID NO: 57972 - DNA, 25 bp, Homo sapien
gttatataaacttacttccattctg

SEQ ID NO: 57973 - DNA, 25 bp, Homo sapien
aacttacttccattctgtttcggat

SEQ ID NO: 57974 - DNA, 25 bp, Homo sapien
tacttccattctgtttcggatttta

SEQ ID NO: 57975 - DNA, 25 bp, Homo sapien
ttctgtttcggattttaagtttgag

SEQ ID NO: 57976 - DNA, 25 bp, Homo sapien
gtttgagagacttgctaatgaatct

SEQ ID NO: 57977 - DNA, 25 bp, Homo sapien
acagcattcctccatcttagataga

SEQ ID NO: 57978 - DNA, 25 bp, Homo sapien
tagatggtactctccaaaggcccta

SEQ ID NO: 57979 - DNA, 25 bp, Homo sapien
ctaccagagggaacacggcctactg

SEQ ID NO: 57980 - DNA, 25 bp, Homo sapien
gaacacggcctactgagcggacaga

SEQ ID NO: 57981 - DNA, 25 bp, Homo sapien
tactgagcggacagaatgatgccaa

SEQ ID NO: 57982 - DNA, 25 bp, Homo sapien
gccaaaatattgcttatgtctctac

SEQ ID NO: 57983 - DNA, 25 bp, Homo sapien
gcttatgtctctacatggtattgta

SEQ ID NO: 57984 - DNA, 25 bp, Homo sapien
gaatatctgctttaatatagctatc

SEQ ID NO: 57985 - DNA, 25 bp, Homo sapien
ggaagcatatgcctacttgtaattt

SEQ ID NO: 57986 - DNA, 25 bp, Homo sapien
gaagagaaacctccggtgtgagata

SEQ ID NO: 57987 - DNA, 25 bp, Homo sapien
aacctccggtgtgagatatacaaat

SEQ ID NO: 57988 - DNA, 25 bp, Homo sapien
tttcagcttcagagacagatccaat

SEQ ID NO: 57989 - DNA, 25 bp, Homo sapien
agatccaatatagtcccagggacct

SEQ ID NO: 57990 - DNA, 25 bp, Homo sapien
gggtatgtcccctgtagtacactct

SEQ ID NO: 57991 - DNA, 25 bp, Homo sapien
tgtagtacactcttacctcttactt

SEQ ID NO: 57992 - DNA, 25 bp, Homo sapien
ttacctcttacttcctagactttga

SEQ ID NO: 57993 - DNA, 25 bp, Homo sapien
atttctccggcagcccagatgttca

SEQ ID NO: 57994 - DNA, 25 bp, Homo sapien
agcccagatgttcagttctcttggc

SEQ ID NO: 57995 - DNA, 25 bp, Homo sapien
tctctaccccttactgggatctggt

SEQ ID NO: 57996 - DNA, 25 bp, Homo sapien
tccttttgccatacacagttacaga

SEQ ID NO: 57997 - DNA, 25 bp, Homo sapien
gagatcagtcaaatccataccacca

SEQ ID NO: 57998 - DNA, 25 bp, Homo sapien
ccataccaccactgagatctcattt

SEQ ID NO: 57999 - DNA, 25 bp, Homo sapien
agagatcagtccaccagaaggttag

SEQ ID NO: 58000 - DNA, 25 bp, Homo sapien
gatcagtccaccagaaggttagacc

SEQ ID NO: 58001 - DNA, 25 bp, Homo sapien
cagtccaccagaaggttagacctgt

SEQ ID NO: 58002 - DNA, 25 bp, Homo sapien
gtccaccagaaggttagacctgttt

SEQ ID NO: 58003 - DNA, 25 bp, Homo sapien
caccagaaggttagacctgttttgt

SEQ ID NO: 58004 - DNA, 25 bp, Homo sapien
cagaaggttagacctgttttgttga

SEQ ID NO: 58005 - DNA, 25 bp, Homo sapien
aacaggccttattatgtctagggcg

SEQ ID NO: 58006 - DNA, 25 bp, Homo sapien
acaggccttattatgtctagggcgt

SEQ ID NO: 58007 - DNA, 25 bp, Homo sapien
aggccttattatgtctagggcgtgg

SEQ ID NO: 58008 - DNA, 25 bp, Homo sapien
gccctactccctttgaaagccaaag

SEQ ID NO: 58009 - DNA, 25 bp, Homo sapien
ttgaaagccaaagggtataaaagcg

SEQ ID NO: 58010 - DNA, 25 bp, Homo sapien
agacccaggtgctctgtatgtttgt

SEQ ID NO: 58011 - DNA, 25 bp, Homo sapien
ccaggtgctctgtatgtttgttttt

SEQ ID NO: 58012 - DNA, 25 bp, Homo sapien
catcatatccaagttcactctgtct

SEQ ID NO: 58013 - DNA, 25 bp, Homo sapien
gttcactctgtcttcctgagcagtg

SEQ ID NO: 58014 - DNA, 25 bp, Homo sapien
tcctgagcagtggaagatcatattg

SEQ ID NO: 58015 - DNA, 25 bp, Homo sapien
gtgttttatccaacttttgtgcata

SEQ ID NO: 58016 - DNA, 25 bp, Homo sapien
atgtcatggcatggtttgcttagga

SEQ ID NO: 58017 - DNA, 25 bp, Homo sapien
ttgcttaggagttcagagttccttc

SEQ ID NO: 58018 - DNA, 25 bp, Homo sapien
gagttccttcatcatcgaaatagtg

SEQ ID NO: 58019 - DNA, 25 bp, Homo sapien
aatagtgattaagtgatcccagaac

SEQ ID NO: 58020 - DNA, 25 bp, Homo sapien
gtgatcccagaacaaggaatactag

SEQ ID NO: 58021 - DNA, 25 bp, Homo sapien
ggccgaggcgcgtttgtgtatatct

SEQ ID NO: 58022 - DNA, 25 bp, Homo sapien
ccgaggcgcgtttgtgtatatctgc

SEQ ID NO: 58023 - DNA, 25 bp, Homo sapien
ggcgcgtttgtgtatatctgcctcc

SEQ ID NO: 58024 - DNA, 25 bp, Homo sapien
gcgtttgtgtatatctgcctcccct

SEQ ID NO: 58025 - DNA, 25 bp, Homo sapien
tgtatatctgcctcccctgtctgta

SEQ ID NO: 58026 - DNA, 25 bp, Homo sapien
gggaacggagcttcggagcctcctc

SEQ ID NO: 58027 - DNA, 25 bp, Homo sapien
acgctcttgaggaagcccaggctcg

SEQ ID NO: 58028 - DNA, 25 bp, Homo sapien
accctggaaaacagacgggtctgag

SEQ ID NO: 58029 - DNA, 25 bp, Homo sapien
gggtctgagactgaaaatggtttac

SEQ ID NO: 58030 - DNA, 25 bp, Homo sapien
atggtttaccagctcccaggtgact

SEQ ID NO: 58031 - DNA, 25 bp, Homo sapien
ctcccaggtgacttcagtgtgtgta

SEQ ID NO: 58032 - DNA, 25 bp, Homo sapien
ggaaggaatacttgacagtttggat

SEQ ID NO: 58033 - DNA, 25 bp, Homo sapien
cagtttggatgtttgggtcattgct

SEQ ID NO: 58034 - DNA, 25 bp, Homo sapien
gtttgggtcattgctgtgattgtta

SEQ ID NO: 58035 - DNA, 25 bp, Homo sapien
ggagctgaatatgccacttaccaga

SEQ ID NO: 58036 - DNA, 25 bp, Homo sapien
ttaccagactaaatcaaccactcca

SEQ ID NO: 58037 - DNA, 25 bp, Homo sapien
gactaaatcaaccactccagcagag

SEQ ID NO: 58038 - DNA, 25 bp, Homo sapien
atcaaccactccagcagagcagaga

SEQ ID NO: 58039 - DNA, 25 bp, Homo sapien
ggctgaatagattccacaacctggt

SEQ ID NO: 58040 - DNA, 25 bp, Homo sapien
aggtcctaggcctacttacaagcct

SEQ ID NO: 58041 - DNA, 25 bp, Homo sapien
tacaagcctccagtctcaaattatc

SEQ ID NO: 58042 - DNA, 25 bp, Homo sapien
ggatatcctaaacctgaggaaggaa

SEQ ID NO: 58043 - DNA, 25 bp, Homo sapien
ataaaggataactctgtattacagc

SEQ ID NO: 58044 - DNA, 25 bp, Homo sapien
gtattacagctttcacagtagctat

SEQ ID NO: 58045 - DNA, 25 bp, Homo sapien
agctatgtggacaatgtgttatttc

SEQ ID NO: 58046 - DNA, 25 bp, Homo sapien
atagctacatcctaaaatcagggct

SEQ ID NO: 58047 - DNA, 25 bp, Homo sapien
aaatcagggctatctttaacaatag

SEQ ID NO: 58048 - DNA, 25 bp, Homo sapien
ctcagttatgagaccctttagttat

SEQ ID NO: 58049 - DNA, 25 bp, Homo sapien
tttagttattctccattaatgcttc

SEQ ID NO: 58050 - DNA, 25 bp, Homo sapien
taatgcttcttagtttgtaatacca

SEQ ID NO: 58051 - DNA, 25 bp, Homo sapien
gtttgtaataccatacctcacagta

SEQ ID NO: 58052 - DNA, 25 bp, Homo sapien
aaacttctgcaggtgtgtaattttg

SEQ ID NO: 58053 - DNA, 25 bp, Homo sapien
gtgtaattttgaaactagtcctcta

SEQ ID NO: 58054 - DNA, 25 bp, Homo sapien
agggcctaaggatcattttctcgga

SEQ ID NO: 58055 - DNA, 25 bp, Homo sapien
agttcctccagtggtgtgcgggcca

SEQ ID NO: 58056 - DNA, 25 bp, Homo sapien
gtgtgcgggccaccctcagactgta

SEQ ID NO: 58057 - DNA, 25 bp, Homo sapien
accctcagactgtacgcagagagct

SEQ ID NO: 58058 - DNA, 25 bp, Homo sapien
gcagagagctacgagagggatccca

SEQ ID NO: 58059 - DNA, 25 bp, Homo sapien
gagagggatcccagcggccatgacc

SEQ ID NO: 58060 - DNA, 25 bp, Homo sapien
cagcggccatgaccaggagccacag

SEQ ID NO: 58061 - DNA, 25 bp, Homo sapien
caggcagtgctgagccctctcatag

SEQ ID NO: 58062 - DNA, 25 bp, Homo sapien
ctctcatagccatcgcactgaaaat

SEQ ID NO: 58063 - DNA, 25 bp, Homo sapien
tagccatcgcactgaaaatatccca

SEQ ID NO: 58064 - DNA, 25 bp, Homo sapien
aaatatcccagattcatgagagaac

SEQ ID NO: 58065 - DNA, 25 bp, Homo sapien
ttcacccggcctcaccaatgcagat

SEQ ID NO: 58066 - DNA, 25 bp, Homo sapien
tcacccggcctcaccaatgcagatg

SEQ ID NO: 58067 - DNA, 25 bp, Homo sapien
cacccggcctcaccaatgcagatgc

SEQ ID NO: 58068 - DNA, 25 bp, Homo sapien
accaatgcagatgctgcccccgacc

SEQ ID NO: 58069 - DNA, 25 bp, Homo sapien
aatgcagatgctgcccccgaccccg

SEQ ID NO: 58070 - DNA, 25 bp, Homo sapien
gaccccgacctggtcagtgccccag

SEQ ID NO: 58071 - DNA, 25 bp, Homo sapien
accccgacctggtcagtgccccagg

SEQ ID NO: 58072 - DNA, 25 bp, Homo sapien
ccccgacctggtcagtgccccaggt

SEQ ID NO: 58073 - DNA, 25 bp, Homo sapien
tggtcagtgccccaggtccctcggc

SEQ ID NO: 58074 - DNA, 25 bp, Homo sapien
ggtcagtgccccaggtccctcggcc

SEQ ID NO: 58075 - DNA, 25 bp, Homo sapien
gtcagtgccccaggtccctcggccc

SEQ ID NO: 58076 - DNA, 25 bp, Homo sapien
tgctggctgccttagaacctttctt

SEQ ID NO: 58077 - DNA, 25 bp, Homo sapien
gctggctgccttagaacctttctta

SEQ ID NO: 58078 - DNA, 25 bp, Homo sapien
tggctgccttagaacctttcttaca

SEQ ID NO: 58079 - DNA, 25 bp, Homo sapien
gctgccttagaacctttcttacatt

SEQ ID NO: 58080 - DNA, 25 bp, Homo sapien
tgccttagaacctttcttacattag

SEQ ID NO: 58081 - DNA, 25 bp, Homo sapien
ttagaacctttcttacattagcagt

SEQ ID NO: 58082 - DNA, 25 bp, Homo sapien
gaacctttcttacattagcagtttg

SEQ ID NO: 58083 - DNA, 25 bp, Homo sapien
cctttcttacattagcagtttgctt

SEQ ID NO: 58084 - DNA, 25 bp, Homo sapien
tacattagcagtttgctttgtatgc

SEQ ID NO: 58085 - DNA, 25 bp, Homo sapien
ttgctttgtatgcactttgtttttt

SEQ ID NO: 58086 - DNA, 25 bp, Homo sapien
tttttccacttagaaattgcatttc

SEQ ID NO: 58087 - DNA, 25 bp, Homo sapien
gggtcctatgcaagaattgtctcct

SEQ ID NO: 58088 - DNA, 25 bp, Homo sapien
ggtcctatgcaagaattgtctcctc

SEQ ID NO: 58089 - DNA, 25 bp, Homo sapien
catcctcaaggtcccttcttctaag

SEQ ID NO: 58090 - DNA, 25 bp, Homo sapien
ttcttctaagggtatctgcaaggcc

SEQ ID NO: 58091 - DNA, 25 bp, Homo sapien
aagggtatctgcaaggccttctcta

SEQ ID NO: 58092 - DNA, 25 bp, Homo sapien
tatctgcaaggccttctctacttgt

SEQ ID NO: 58093 - DNA, 25 bp, Homo sapien
tgcaaggccttctctacttgtggct

SEQ ID NO: 58094 - DNA, 25 bp, Homo sapien
caaggccttctctacttgtggctcc

SEQ ID NO: 58095 - DNA, 25 bp, Homo sapien
catcagctaatagttctactctaaa

SEQ ID NO: 58096 - DNA, 25 bp, Homo sapien
gttctactctaaaggacactgtcat

SEQ ID NO: 58097 - DNA, 25 bp, Homo sapien
ggaacagagacatgaagggagccct

SEQ ID NO: 58098 - DNA, 25 bp, Homo sapien
actctcacccgaccggtgcatgatg

SEQ ID NO: 58099 - DNA, 25 bp, Homo sapien
tcacccgaccggtgcatgatgctgc

SEQ ID NO: 58100 - DNA, 25 bp, Homo sapien
ccgaccggtgcatgatgctgcccgg

SEQ ID NO: 58101 - DNA, 25 bp, Homo sapien
ggtgcatgatgctgcccgggagggc

SEQ ID NO: 58102 - DNA, 25 bp, Homo sapien
gtcgtctgcccgtggacttggccga

SEQ ID NO: 58103 - DNA, 25 bp, Homo sapien
tcgtctgcccgtggacttggccgag

SEQ ID NO: 58104 - DNA, 25 bp, Homo sapien
tgcccgtggacttggccgaggagcg

SEQ ID NO: 58105 - DNA, 25 bp, Homo sapien
gccaccgcgacgttgcagggtacct

SEQ ID NO: 58106 - DNA, 25 bp, Homo sapien
ccaccgcgacgttgcagggtacctg

SEQ ID NO: 58107 - DNA, 25 bp, Homo sapien
gacgttgcagggtacctgcgcacag

SEQ ID NO: 58108 - DNA, 25 bp, Homo sapien
cgttgcagggtacctgcgcacagcc

SEQ ID NO: 58109 - DNA, 25 bp, Homo sapien
tgttctcaaatatctgttccaacca

SEQ ID NO: 58110 - DNA, 25 bp, Homo sapien
ctgttccaaccactcactagtaagg

SEQ ID NO: 58111 - DNA, 25 bp, Homo sapien
actcactagtaaggtgaccgtggcc

SEQ ID NO: 58112 - DNA, 25 bp, Homo sapien
gtgaccgtggccagattaacctttg

SEQ ID NO: 58113 - DNA, 25 bp, Homo sapien
gtggccagattaacctttgtttcct

SEQ ID NO: 58114 - DNA, 25 bp, Homo sapien
gattaacctttgtttcctcttcagt

SEQ ID NO: 58115 - DNA, 25 bp, Homo sapien
atacgttaaatattcagaggtgcaa

SEQ ID NO: 58116 - DNA, 25 bp, Homo sapien
tattcagaggtgcaagacacatagt

SEQ ID NO: 58117 - DNA, 25 bp, Homo sapien
gtaagcactcaattgtaactacagt

SEQ ID NO: 58118 - DNA, 25 bp, Homo sapien
gttaagtccttaaatgccatcgaaa

SEQ ID NO: 58119 - DNA, 25 bp, Homo sapien
aagcaaaatgacacgtagcacaatg

SEQ ID NO: 58120 - DNA, 25 bp, Homo sapien
agcagcgaagtggacgtctcggatc

SEQ ID NO: 58121 - DNA, 25 bp, Homo sapien
gaagtggacgtctcggatctcggct

SEQ ID NO: 58122 - DNA, 25 bp, Homo sapien
acgtctcggatctcggctcgcgaaa

SEQ ID NO: 58123 - DNA, 25 bp, Homo sapien
tcggatctcggctcgcgaaactaca

SEQ ID NO: 58124 - DNA, 25 bp, Homo sapien
atctcggctcgcgaaactacagtgc

SEQ ID NO: 58125 - DNA, 25 bp, Homo sapien
ggctcgcgaaactacagtgcccgca

SEQ ID NO: 58126 - DNA, 25 bp, Homo sapien
gcgaaactacagtgcccgcacagac

SEQ ID NO: 58127 - DNA, 25 bp, Homo sapien
cccgcacagacttctactgcctggt

SEQ ID NO: 58128 - DNA, 25 bp, Homo sapien
ggatgatatgtagctcccaccccag

SEQ ID NO: 58129 - DNA, 25 bp, Homo sapien
tgatatgtagctcccaccccagagt

SEQ ID NO: 58130 - DNA, 25 bp, Homo sapien
ccagagtgcaggatcatagggacag

SEQ ID NO: 58131 - DNA, 25 bp, Homo sapien
aatacatggagtttgaccttaatgg

SEQ ID NO: 58132 - DNA, 25 bp, Homo sapien
ttgaccttaatggaaatggcgatat

SEQ ID NO: 58133 - DNA, 25 bp, Homo sapien
tggcgatattgatatcatgtccctg

SEQ ID NO: 58134 - DNA, 25 bp, Homo sapien
atcatgtccctgaaacgaatgctgg

SEQ ID NO: 58135 - DNA, 25 bp, Homo sapien
gtccctgaaacgaatgctggagaaa

SEQ ID NO: 58136 - DNA, 25 bp, Homo sapien
tgctggagaaacttggagtccccaa

SEQ ID NO: 58137 - DNA, 25 bp, Homo sapien
agtccccaagactcacctagagcta

SEQ ID NO: 58138 - DNA, 25 bp, Homo sapien
ttggagaggtgtccagtggctccgg

SEQ ID NO: 58139 - DNA, 25 bp, Homo sapien
gggagacgttcagctaccctgactt

SEQ ID NO: 58140 - DNA, 25 bp, Homo sapien
accctgactttctcaggatgatgct

SEQ ID NO: 58141 - DNA, 25 bp, Homo sapien
tttctcaggatgatgctgggcaaga

SEQ ID NO: 58142 - DNA, 25 bp, Homo sapien
catggagtttgaccttaatggaaat

SEQ ID NO: 58143 - DNA, 25 bp, Homo sapien
ggagtttgaccttaatggaaatggc

SEQ ID NO: 58144 - DNA, 25 bp, Homo sapien
gtttgaccttaatggaaatggcgat

SEQ ID NO: 58145 - DNA, 25 bp, Homo sapien
ttgaccttaatggaaatggcgatat

SEQ ID NO: 58146 - DNA, 25 bp, Homo sapien
gaccttaatggaaatggcgatattg

SEQ ID NO: 58147 - DNA, 25 bp, Homo sapien
gtccctgaaacgaatgctggagaaa

SEQ ID NO: 58148 - DNA, 25 bp, Homo sapien
ggctccggggagacgttcagctacc

SEQ ID NO: 58149 - DNA, 25 bp, Homo sapien
ggggagacgttcagctaccctgact

SEQ ID NO: 58150 - DNA, 25 bp, Homo sapien
tttctcaggatgatgctgggcaaga

SEQ ID NO: 58151 - DNA, 25 bp, Homo sapien
tctcaggatgatgctgggcaagaga

SEQ ID NO: 58152 - DNA, 25 bp, Homo sapien
atcctgatgtatgaggaaaaagcga

SEQ ID NO: 58153 - DNA, 25 bp, Homo sapien
aaagaacagtggtggctcaagctac

SEQ ID NO: 58154 - DNA, 25 bp, Homo sapien
aagctacggcccctcatgaaaatcc

SEQ ID NO: 58155 - DNA, 25 bp, Homo sapien
tcatgaaaatcctggccaagtacaa

SEQ ID NO: 58156 - DNA, 25 bp, Homo sapien
caaggccagctatgacgtgtcggac

SEQ ID NO: 58157 - DNA, 25 bp, Homo sapien
gtgtcggactcaggccagctggaac

SEQ ID NO: 58158 - DNA, 25 bp, Homo sapien
gctggaacatgtgcagccctggagt

SEQ ID NO: 58159 - DNA, 25 bp, Homo sapien
gcagccaccgtggactgtctgtttt

SEQ ID NO: 58160 - DNA, 25 bp, Homo sapien
agcactttatgcacgtattattgac

SEQ ID NO: 58161 - DNA, 25 bp, Homo sapien
ttaatacctaatcggcgagtgccca

SEQ ID NO: 58162 - DNA, 25 bp, Homo sapien
agctccagtgcgtgctgtctgtgga

SEQ ID NO: 58163 - DNA, 25 bp, Homo sapien
ctgtctgtggagtgtgtctcatgct

SEQ ID NO: 58164 - DNA, 25 bp, Homo sapien
ataaagaaacaaaactatctgccct

SEQ ID NO: 58165 - DNA, 25 bp, Homo sapien
tttcccttccagtgggttcctctgg

SEQ ID NO: 58166 - DNA, 25 bp, Homo sapien
ttcccttccagtgggttcctctggt

SEQ ID NO: 58167 - DNA, 25 bp, Homo sapien
ttccagtgggttcctctggtgctgc

SEQ ID NO: 58168 - DNA, 25 bp, Homo sapien
tccagtgggttcctctggtgctgca

SEQ ID NO: 58169 - DNA, 25 bp, Homo sapien
agagctccctgttgccctccttttc

SEQ ID NO: 58170 - DNA, 25 bp, Homo sapien
ttagtcccaggaacaaaaagggcat

SEQ ID NO: 58171 - DNA, 25 bp, Homo sapien
tagtcccaggaacaaaaagggcatt

SEQ ID NO: 58172 - DNA, 25 bp, Homo sapien
gtcccaggaacaaaaagggcatttg

SEQ ID NO: 58173 - DNA, 25 bp, Homo sapien
agggcatttgggtacaggggcatat

SEQ ID NO: 58174 - DNA, 25 bp, Homo sapien
tacaggggcatatacctgtaatcct

SEQ ID NO: 58175 - DNA, 25 bp, Homo sapien
aaggaagaagactgctcagcgccac

SEQ ID NO: 58176 - DNA, 25 bp, Homo sapien
ggaagaagactgctcagcgccacaa

SEQ ID NO: 58177 - DNA, 25 bp, Homo sapien
aagaagactgctcagcgccacaagt

SEQ ID NO: 58178 - DNA, 25 bp, Homo sapien
gaagactgctcagcgccacaagtga

SEQ ID NO: 58179 - DNA, 25 bp, Homo sapien
tgctcagcgccacaagtgaccagtg

SEQ ID NO: 58180 - DNA, 25 bp, Homo sapien
acaagtgaccagtgcctcccaggag

SEQ ID NO: 58181 - DNA, 25 bp, Homo sapien
caagtgaccagtgcctcccaggagt

SEQ ID NO: 58182 - DNA, 25 bp, Homo sapien
gtgaccagtgcctcccaggagtcct

SEQ ID NO: 58183 - DNA, 25 bp, Homo sapien
gggactctgactcaattgtacctgc

SEQ ID NO: 58184 - DNA, 25 bp, Homo sapien
ggactctgactcaattgtacctgca

SEQ ID NO: 58185 - DNA, 25 bp, Homo sapien
actctgactcaattgtacctgcagc

SEQ ID NO: 58186 - DNA, 25 bp, Homo sapien
aaattcaatcaaatcctgtcctagt

SEQ ID NO: 58187 - DNA, 25 bp, Homo sapien
ttcaatcaaatcctgtcctagtgtg

SEQ ID NO: 58188 - DNA, 25 bp, Homo sapien
aatcaaatcctgtcctagtgtgtgc

SEQ ID NO: 58189 - DNA, 25 bp, Homo sapien
atcaaatcctgtcctagtgtgtgca

SEQ ID NO: 58190 - DNA, 25 bp, Homo sapien
aaatcctgtcctagtgtgtgcagtg

SEQ ID NO: 58191 - DNA, 25 bp, Homo sapien
atcctgtcctagtgtgtgcagtgtc

SEQ ID NO: 58192 - DNA, 25 bp, Homo sapien
gtgtgtgcagtgtcttcggccctgt

SEQ ID NO: 58193 - DNA, 25 bp, Homo sapien
tgtgcagtgtcttcggccctgtgga

SEQ ID NO: 58194 - DNA, 25 bp, Homo sapien
cacaggtgaatgagggaccagccct

SEQ ID NO: 58195 - DNA, 25 bp, Homo sapien
aggtgaatgagggaccagccctgcc

SEQ ID NO: 58196 - DNA, 25 bp, Homo sapien
gctgttgagaagagatcagtccacc

SEQ ID NO: 58197 - DNA, 25 bp, Homo sapien
gaaaagtattccaacgtgatattcc

SEQ ID NO: 58198 - DNA, 25 bp, Homo sapien
aaagtattccaacgtgatattcctt

SEQ ID NO: 58199 - DNA, 25 bp, Homo sapien
agtattccaacgtgatattccttga

SEQ ID NO: 58200 - DNA, 25 bp, Homo sapien
gtattccaacgtgatattccttgaa

SEQ ID NO: 58201 - DNA, 25 bp, Homo sapien
attccaacgtgatattccttgaagt

SEQ ID NO: 58202 - DNA, 25 bp, Homo sapien
tccaacgtgatattccttgaagtag

SEQ ID NO: 58203 - DNA, 25 bp, Homo sapien
caacgtgatattccttgaagtagat

SEQ ID NO: 58204 - DNA, 25 bp, Homo sapien
acgtgatattccttgaagtagatgt

SEQ ID NO: 58205 - DNA, 25 bp, Homo sapien
ttccttgaagtagatgtggatgact

SEQ ID NO: 58206 - DNA, 25 bp, Homo sapien
tggatgactgtcaggatgttgcttc

SEQ ID NO: 58207 - DNA, 25 bp, Homo sapien
gatgactgtcaggatgttgcttcag

SEQ ID NO: 58208 - DNA, 25 bp, Homo sapien
gaaaaagtctctcctgtttctctct

SEQ ID NO: 58209 - DNA, 25 bp, Homo sapien
atcacctcacgcctttctgttcctt

SEQ ID NO: 58210 - DNA, 25 bp, Homo sapien
ttctgttccttgtcctcaccttact

SEQ ID NO: 58211 - DNA, 25 bp, Homo sapien
aaagacaaagctctgcctacataga

SEQ ID NO: 58212 - DNA, 25 bp, Homo sapien
tctgcctacatagaagacttttttt

SEQ ID NO: 58213 - DNA, 25 bp, Homo sapien
taaccaaagttactgttgtttacag

SEQ ID NO: 58214 - DNA, 25 bp, Homo sapien
aagttactgttgtttacagtgagtt

SEQ ID NO: 58215 - DNA, 25 bp, Homo sapien
gttactgttgtttacagtgagtttg

SEQ ID NO: 58216 - DNA, 25 bp, Homo sapien
ttactgttgtttacagtgagtttgg

SEQ ID NO: 58217 - DNA, 25 bp, Homo sapien
agtccctgccaccaagggaagccca

SEQ ID NO: 58218 - DNA, 25 bp, Homo sapien
gtccctgccaccaagggaagcccac

SEQ ID NO: 58219 - DNA, 25 bp, Homo sapien
accaccttccacaaatgcagggaga

SEQ ID NO: 58220 - DNA, 25 bp, Homo sapien
aaacacagactaacatgcccttcat

SEQ ID NO: 58221 - DNA, 25 bp, Homo sapien
atgcccttcatgtgattcttatgag

SEQ ID NO: 58222 - DNA, 25 bp, Homo sapien
ccacccaaagaattcctagaaagat

SEQ ID NO: 58223 - DNA, 25 bp, Homo sapien
tagaaagattcaaatcacttctcca

SEQ ID NO: 58224 - DNA, 25 bp, Homo sapien
aagatgattcatcagcatctgtcct

SEQ ID NO: 58225 - DNA, 25 bp, Homo sapien
gcatctgtcctctagaacacacgga

SEQ ID NO: 58226 - DNA, 25 bp, Homo sapien
gaacacacggaagtgaagattcctg

SEQ ID NO: 58227 - DNA, 25 bp, Homo sapien
agattcctgaggatctaacttgcag

SEQ ID NO: 58228 - DNA, 25 bp, Homo sapien
ctaacttgcagttggacactatgtt

SEQ ID NO: 58229 - DNA, 25 bp, Homo sapien
aagtcatttctttgtattccaagtg

SEQ ID NO: 58230 - DNA, 25 bp, Homo sapien
gagagttctgtattggatttcgatt

SEQ ID NO: 58231 - DNA, 25 bp, Homo sapien
ggatttcgattatgactatctcatt

SEQ ID NO: 58232 - DNA, 25 bp, Homo sapien
tagaaaccttcattagaggcagcat

SEQ ID NO: 58233 - DNA, 25 bp, Homo sapien
cttcattagaggcagcatgtaaact

SEQ ID NO: 58234 - DNA, 25 bp, Homo sapien
ctttctttttacagcctgttcagtc

SEQ ID NO: 58235 - DNA, 25 bp, Homo sapien
tacagcctgttcagtctgtagaaca

SEQ ID NO: 58236 - DNA, 25 bp, Homo sapien
agtctgtagaacattctaggatcta

SEQ ID NO: 58237 - DNA, 25 bp, Homo sapien
agattaaatctctggctgagcctca

SEQ ID NO: 58238 - DNA, 25 bp, Homo sapien
tctggctgagcctcatgccatcaaa

SEQ ID NO: 58239 - DNA, 25 bp, Homo sapien
gccatcaaactgtttaggtatttat

SEQ ID NO: 58240 - DNA, 25 bp, Homo sapien
caacttttatctcactttaagcatt

SEQ ID NO: 58241 - DNA, 25 bp, Homo sapien
acagcacctgcagcattgtaactgc

SEQ ID NO: 58242 - DNA, 25 bp, Homo sapien
agtgatggagatacctgaggctatt

SEQ ID NO: 58243 - DNA, 25 bp, Homo sapien
cccaggccttggacatttagtgact

SEQ ID NO: 58244 - DNA, 25 bp, Homo sapien
atttagtgactgttagccggtccct

SEQ ID NO: 58245 - DNA, 25 bp, Homo sapien
agccggtccctttcagatccagtgg

SEQ ID NO: 58246 - DNA, 25 bp, Homo sapien
tgcttcccatggttcactgtcattg

SEQ ID NO: 58247 - DNA, 25 bp, Homo sapien
gttcactgtcattgtgtttcccagc

SEQ ID NO: 58248 - DNA, 25 bp, Homo sapien
agaaaggagcctgagtgattctctt

SEQ ID NO: 58249 - DNA, 25 bp, Homo sapien
ttttcttcttgtttccctgattatg

SEQ ID NO: 58250 - DNA, 25 bp, Homo sapien
gtttccctgattatgatgagcttcc

SEQ ID NO: 58251 - DNA, 25 bp, Homo sapien
gatgagcttccattgttctgttaag

SEQ ID NO: 58252 - DNA, 25 bp, Homo sapien
agcctcaacgggtaccgcctgggag

SEQ ID NO: 58253 - DNA, 25 bp, Homo sapien
ggagacagagtgttgcaagtttcct

SEQ ID NO: 58254 - DNA, 25 bp, Homo sapien
aacaaagcccacaagtcctgaattt

SEQ ID NO: 58255 - DNA, 25 bp, Homo sapien
cacaagtcctgaatttcccattctt

SEQ ID NO: 58256 - DNA, 25 bp, Homo sapien
tcctgaatttcccattcttacttac

SEQ ID NO: 58257 - DNA, 25 bp, Homo sapien
tatacgaacaaaacacacgcgcgca

SEQ ID NO: 58258 - DNA, 25 bp, Homo sapien
caaggcttatattcaaccatggact

SEQ ID NO: 58259 - DNA, 25 bp, Homo sapien
tattcaaccatggactttataagcc

SEQ ID NO: 58260 - DNA, 25 bp, Homo sapien
ctttataagccagtgttgcctaagt

SEQ ID NO: 58261 - DNA, 25 bp, Homo sapien
agccagtgttgcctaagtattaaaa

SEQ ID NO: 58262 - DNA, 25 bp, Homo sapien
gtattaaaacattggattatcctga

SEQ ID NO: 58263 - DNA, 25 bp, Homo sapien
cacaatggccagtccaattgctatc

SEQ ID NO: 58264 - DNA, 25 bp, Homo sapien
acaatggccagtccaattgctatct

SEQ ID NO: 58265 - DNA, 25 bp, Homo sapien
ggccagtccaattgctatctatttt

SEQ ID NO: 58266 - DNA, 25 bp, Homo sapien
gccagtccaattgctatctattttt

SEQ ID NO: 58267 - DNA, 25 bp, Homo sapien
ccagtccaattgctatctatttttt

SEQ ID NO: 58268 - DNA, 25 bp, Homo sapien
gtccaattgctatctatttttttat

SEQ ID NO: 58269 - DNA, 25 bp, Homo sapien
tttttatccagaggcttaattaaat

SEQ ID NO: 58270 - DNA, 25 bp, Homo sapien
aaaatgatgtttgagcattaagaca

SEQ ID NO: 58271 - DNA, 25 bp, Homo sapien
gatgtttgagcattaagacaatgta

SEQ ID NO: 58272 - DNA, 25 bp, Homo sapien
tgagcattaagacaatgtaattctt

SEQ ID NO: 58273 - DNA, 25 bp, Homo sapien
gcattaagacaatgtaattctttat

SEQ ID NO: 58274 - DNA, 25 bp, Homo sapien
catgtctacagcgtggcgaagacgg

SEQ ID NO: 58275 - DNA, 25 bp, Homo sapien
tacagcgtggcgaagacggatagtt

SEQ ID NO: 58276 - DNA, 25 bp, Homo sapien
ggcgaagacggatagttttgaatac

SEQ ID NO: 58277 - DNA, 25 bp, Homo sapien
atagttttgaatacgtggaccctgt

SEQ ID NO: 58278 - DNA, 25 bp, Homo sapien
gttttgaatacgtggaccctgtgga

SEQ ID NO: 58279 - DNA, 25 bp, Homo sapien
ggaccctgtggatggcactgtgacc

SEQ ID NO: 58280 - DNA, 25 bp, Homo sapien
gcactgtgaccaagaaacagggcct

SEQ ID NO: 58281 - DNA, 25 bp, Homo sapien
gtgaccaagaaacagggcctaagga

SEQ ID NO: 58282 - DNA, 25 bp, Homo sapien
attttctcggatgcatcacggctca

SEQ ID NO: 58283 - DNA, 25 bp, Homo sapien
tctcggatgcatcacggctcatctt

SEQ ID NO: 58284 - DNA, 25 bp, Homo sapien
gatgcatcacggctcatcttccggc

SEQ ID NO: 58285 - DNA, 25 bp, Homo sapien
gtcacctacgatgccctggtacaga

SEQ ID NO: 58286 - DNA, 25 bp, Homo sapien
gattattcccagttgttagtagagt

SEQ ID NO: 58287 - DNA, 25 bp, Homo sapien
attcccagttgttagtagagttacg

SEQ ID NO: 58288 - DNA, 25 bp, Homo sapien
gtagagttacgagagtctgcaagaa

SEQ ID NO: 58289 - DNA, 25 bp, Homo sapien
attgaaatcaatggagtgttcattc

SEQ ID NO: 58290 - DNA, 25 bp, Homo sapien
aaagggttagcagtgatggttccaa

SEQ ID NO: 58291 - DNA, 25 bp, Homo sapien
agtgatggttccaatctatgctctt

SEQ ID NO: 58292 - DNA, 25 bp, Homo sapien
ggttccaatctatgctcttcaccat

SEQ ID NO: 58293 - DNA, 25 bp, Homo sapien
gttctgccctgaaagatcccactga

SEQ ID NO: 58294 - DNA, 25 bp, Homo sapien
ctgccctgaaagatcccactgaaat

SEQ ID NO: 58295 - DNA, 25 bp, Homo sapien
gacaatctaccaattcttcaaccag

SEQ ID NO: 58296 - DNA, 25 bp, Homo sapien
aggcacctgtcacctacgatgccct

SEQ ID NO: 58297 - DNA, 25 bp, Homo sapien
gattattcccagttgttagtagagt

SEQ ID NO: 58298 - DNA, 25 bp, Homo sapien
attcccagttgttagtagagttacg

SEQ ID NO: 58299 - DNA, 25 bp, Homo sapien
gtagagttacgagagtctgcaagaa

SEQ ID NO: 58300 - DNA, 25 bp, Homo sapien
ttacgagagtctgcaagaaagatat

SEQ ID NO: 58301 - DNA, 25 bp, Homo sapien
attgaaatcaatggagtgttcattc

SEQ ID NO: 58302 - DNA, 25 bp, Homo sapien
cattcccaaagggttagcagtgatg

SEQ ID NO: 58303 - DNA, 25 bp, Homo sapien
aaagggttagcagtgatggttccaa

SEQ ID NO: 58304 - DNA, 25 bp, Homo sapien
gggttagcagtgatggttccaatct

SEQ ID NO: 58305 - DNA, 25 bp, Homo sapien
agtgatggttccaatctatgctctt

SEQ ID NO: 58306 - DNA, 25 bp, Homo sapien
ggttccaatctatgctcttcaccat

SEQ ID NO: 58307 - DNA, 25 bp, Homo sapien
tcaagaatcctcttgagccagtaat

SEQ ID NO: 58308 - DNA, 25 bp, Homo sapien
gagccagtaatcaatcctgtctcaa

SEQ ID NO: 58309 - DNA, 25 bp, Homo sapien
gttctttgccatttcctagatactg

SEQ ID NO: 58310 - DNA, 25 bp, Homo sapien
tgccatttcctagatactgcacaaa

SEQ ID NO: 58311 - DNA, 25 bp, Homo sapien
tactgcacaaaagtggccatgtcga

SEQ ID NO: 58312 - DNA, 25 bp, Homo sapien
aagtggccatgtcgacatttgtcca

SEQ ID NO: 58313 - DNA, 25 bp, Homo sapien
gagcgacaaagggacattccatccc

SEQ ID NO: 58314 - DNA, 25 bp, Homo sapien
atccctgtacccttagtggtagcca

SEQ ID NO: 58315 - DNA, 25 bp, Homo sapien
cacgatggccagatcatggactccg

SEQ ID NO: 58316 - DNA, 25 bp, Homo sapien
ttactggaaacatagcaaaccttga

SEQ ID NO: 58317 - DNA, 25 bp, Homo sapien
gcaaaccttgatttagctccaagaa

SEQ ID NO: 58318 - DNA, 25 bp, Homo sapien
aagcggcggaaatacgtcttccagt

SEQ ID NO: 58319 - DNA, 25 bp, Homo sapien
gaaatacgtcttccagtgcacggac

SEQ ID NO: 58320 - DNA, 25 bp, Homo sapien
tacgtcttccagtgcacggacggct

SEQ ID NO: 58321 - DNA, 25 bp, Homo sapien
acggacggctcctcgtttgtagaag

SEQ ID NO: 58322 - DNA, 25 bp, Homo sapien
acggctcctcgtttgtagaagaggt

SEQ ID NO: 58323 - DNA, 25 bp, Homo sapien
agagacacttagagtgcggctgcct

SEQ ID NO: 58324 - DNA, 25 bp, Homo sapien
gacacttagagtgcggctgcctcgc

SEQ ID NO: 58325 - DNA, 25 bp, Homo sapien
tgcggctgcctcgcgtgttcctaag

SEQ ID NO: 58326 - DNA, 25 bp, Homo sapien
acctctcggactccagcttgatgga

SEQ ID NO: 58327 - DNA, 25 bp, Homo sapien
cagcttgatggagttgggacagcca

SEQ ID NO: 58328 - DNA, 25 bp, Homo sapien
cccctggtgattcagcatgaaggaa

SEQ ID NO: 58329 - DNA, 25 bp, Homo sapien
gggctgagtggtatccctacctggc

SEQ ID NO: 58330 - DNA, 25 bp, Homo sapien
tgagtggtatccctacctggcctcc

SEQ ID NO: 58331 - DNA, 25 bp, Homo sapien
ctccagcgctgggtttgtcgagtga

SEQ ID NO: 58332 - DNA, 25 bp, Homo sapien
agagaggagcttgggttgcttccct

SEQ ID NO: 58333 - DNA, 25 bp, Homo sapien
aggagcttgggttgcttccctgtcc

SEQ ID NO: 58334 - DNA, 25 bp, Homo sapien
ccaattgctatttttccgaacaatc

SEQ ID NO: 58335 - DNA, 25 bp, Homo sapien
gctatttttccgaacaatccttgta

SEQ ID NO: 58336 - DNA, 25 bp, Homo sapien
aatccttgtagagtatgtaccatcc

SEQ ID NO: 58337 - DNA, 25 bp, Homo sapien
gtagagtatgtaccatccaaaggca

SEQ ID NO: 58338 - DNA, 25 bp, Homo sapien
gccgtggccggctctggttggagat

SEQ ID NO: 58339 - DNA, 25 bp, Homo sapien
gctctggttggagatggtacagttt

SEQ ID NO: 58340 - DNA, 25 bp, Homo sapien
gtcaaagacaaagcaaacgccctag

SEQ ID NO: 58341 - DNA, 25 bp, Homo sapien
gcaaacgccctaggttaagtgtgga

SEQ ID NO: 58342 - DNA, 25 bp, Homo sapien
cgccctaggttaagtgtggatgata

SEQ ID NO: 58343 - DNA, 25 bp, Homo sapien
atgactgggaggatttggactatgc

SEQ ID NO: 58344 - DNA, 25 bp, Homo sapien
tagaaggactgtgagataccatgat

SEQ ID NO: 58345 - DNA, 25 bp, Homo sapien
aatgtgttagatttcaatggttgca

SEQ ID NO: 58346 - DNA, 25 bp, Homo sapien
atggttgcaccttatgaccttgagg

SEQ ID NO: 58347 - DNA, 25 bp, Homo sapien
ccttgagggaaagccagttcattta

SEQ ID NO: 58348 - DNA, 25 bp, Homo sapien
gggaaagccagttcatttaagagga

SEQ ID NO: 58349 - DNA, 25 bp, Homo sapien
atggactggcatttatggtgaaagc

SEQ ID NO: 58350 - DNA, 25 bp, Homo sapien
gaaagctggctgttaaaattatttt

SEQ ID NO: 58351 - DNA, 25 bp, Homo sapien
agatgccaccgccagaagagccctt

SEQ ID NO: 58352 - DNA, 25 bp, Homo sapien
gccaccgccagaagagcccttatga

SEQ ID NO: 58353 - DNA, 25 bp, Homo sapien
agaagagcccttatgacccctgggc

SEQ ID NO: 58354 - DNA, 25 bp, Homo sapien
tgtgccttagtgtctacttgcagga

SEQ ID NO: 58355 - DNA, 25 bp, Homo sapien
tgccttagtgtctacttgcaggacc

SEQ ID NO: 58356 - DNA, 25 bp, Homo sapien
ttagtgtctacttgcaggacccttc

SEQ ID NO: 58357 - DNA, 25 bp, Homo sapien
agtgtctacttgcaggacccttcct

SEQ ID NO: 58358 - DNA, 25 bp, Homo sapien
caggccagaatgaagtcctgggtca

SEQ ID NO: 58359 - DNA, 25 bp, Homo sapien
gggcccagctgcctatgtaaggcct

SEQ ID NO: 58360 - DNA, 25 bp, Homo sapien
agctgcctatgtaaggccttctagt

SEQ ID NO: 58361 - DNA, 25 bp, Homo sapien
cctatgtaaggccttctagtttgtt

SEQ ID NO: 58362 - DNA, 25 bp, Homo sapien
tgattgtaacatatttcttgagtaa

SEQ ID NO: 58363 - DNA, 25 bp, Homo sapien
tattcaaatcagcaagcttgtagct

SEQ ID NO: 58364 - DNA, 25 bp, Homo sapien
caagcttgtagctggactgcaatat

SEQ ID NO: 58365 - DNA, 25 bp, Homo sapien
gtagctggactgcaatatcaacaac

SEQ ID NO: 58366 - DNA, 25 bp, Homo sapien
gttgtttcaaacagcatcaaaatac

SEQ ID NO: 58367 - DNA, 25 bp, Homo sapien
aaacagcatcaaaatacaacttcat

SEQ ID NO: 58368 - DNA, 25 bp, Homo sapien
acaacttcattgctacacttacaag

SEQ ID NO: 58369 - DNA, 25 bp, Homo sapien
cattgctacacttacaagtaatgaa

SEQ ID NO: 58370 - DNA, 25 bp, Homo sapien
gtgactatgaaacgaatataagctt

SEQ ID NO: 58371 - DNA, 25 bp, Homo sapien
aaatggctattcctctttttacttg

SEQ ID NO: 58372 - DNA, 25 bp, Homo sapien
gctattcctctttttacttggaaat

SEQ ID NO: 58373 - DNA, 25 bp, Homo sapien
ggatcacgtagacatgtaacccagc

SEQ ID NO: 58374 - DNA, 25 bp, Homo sapien
agacatgtaacccagcagcagtttg

SEQ ID NO: 58375 - DNA, 25 bp, Homo sapien
agcagcagtttgcttctgttgtcca

SEQ ID NO: 58376 - DNA, 25 bp, Homo sapien
gcttctgttgtccactgattaatca

SEQ ID NO: 58377 - DNA, 25 bp, Homo sapien
taatcagcctatgtgcctgacactg

SEQ ID NO: 58378 - DNA, 25 bp, Homo sapien
gcctgacactggtcttgcagtacaa

SEQ ID NO: 58379 - DNA, 25 bp, Homo sapien
gctaaagagaagatctctgcccttc

SEQ ID NO: 58380 - DNA, 25 bp, Homo sapien
tgcccttcagagtgcaggagttgtg

SEQ ID NO: 58381 - DNA, 25 bp, Homo sapien
agttgtggtcagtatgtctcctgca

SEQ ID NO: 58382 - DNA, 25 bp, Homo sapien
atgtctcctgcacagctgggaacca

SEQ ID NO: 58383 - DNA, 25 bp, Homo sapien
gctgggaaccacgatctacaaggaa

SEQ ID NO: 58384 - DNA, 25 bp, Homo sapien
ctttctaaccatcaagaacatacaa

SEQ ID NO: 58385 - DNA, 25 bp, Homo sapien
tttctaaccatcaagaacatacaat

SEQ ID NO: 58386 - DNA, 25 bp, Homo sapien
tctaaccatcaagaacatacaatag

SEQ ID NO: 58387 - DNA, 25 bp, Homo sapien
taaccatcaagaacatacaatagat

SEQ ID NO: 58388 - DNA, 25 bp, Homo sapien
tacaatagatagtagatctcacatt

SEQ ID NO: 58389 - DNA, 25 bp, Homo sapien
caatagatagtagatctcacattaa

SEQ ID NO: 58390 - DNA, 25 bp, Homo sapien
agatagtagatctcacattaatatc

SEQ ID NO: 58391 - DNA, 25 bp, Homo sapien
gatagtagatctcacattaatatca

SEQ ID NO: 58392 - DNA, 25 bp, Homo sapien
atagtagatctcacattaatatcaa

SEQ ID NO: 58393 - DNA, 25 bp, Homo sapien
tagtagatctcacattaatatcaag

SEQ ID NO: 58394 - DNA, 25 bp, Homo sapien
agtagatctcacattaatatcaagt

SEQ ID NO: 58395 - DNA, 25 bp, Homo sapien
attggtattcaggtaactcatttac

SEQ ID NO: 58396 - DNA, 25 bp, Homo sapien
aatttttaaactatgtgggtctgtg

SEQ ID NO: 58397 - DNA, 25 bp, Homo sapien
ctatgtgggtctgtgaatttcttta

SEQ ID NO: 58398 - DNA, 25 bp, Homo sapien
ggtctgtgaatttctttaatgtcta

SEQ ID NO: 58399 - DNA, 25 bp, Homo sapien
aatgtctaagaaatccagcttcata

SEQ ID NO: 58400 - DNA, 25 bp, Homo sapien
aatccagcttcataatttccatgat

SEQ ID NO: 58401 - DNA, 25 bp, Homo sapien
acaaagatcttttttcaggtggatt

SEQ ID NO: 58402 - DNA, 25 bp, Homo sapien
tttacctttgttccttttgctctga

SEQ ID NO: 58403 - DNA, 25 bp, Homo sapien
ctttgttccttttgctctgatagac

SEQ ID NO: 58404 - DNA, 25 bp, Homo sapien
tgttccttttgctctgatagacaaa

SEQ ID NO: 58405 - DNA, 25 bp, Homo sapien
gacaaaatcagtttaggactattaa

SEQ ID NO: 58406 - DNA, 25 bp, Homo sapien
atccccatttgctgtccagagtgtg

SEQ ID NO: 58407 - DNA, 25 bp, Homo sapien
cccatttgctgtccagagtgtgacc

SEQ ID NO: 58408 - DNA, 25 bp, Homo sapien
gagtgtgaccacagttaacggttaa

SEQ ID NO: 58409 - DNA, 25 bp, Homo sapien
cagttaacggttaatgtgcatcttt

SEQ ID NO: 58410 - DNA, 25 bp, Homo sapien
gtgcatcttttatgtacttaacatg

SEQ ID NO: 58411 - DNA, 25 bp, Homo sapien
agaacttccatgttagtatgtgcag

SEQ ID NO: 58412 - DNA, 25 bp, Homo sapien
tccatgttagtatgtgcagctgtaa

SEQ ID NO: 58413 - DNA, 25 bp, Homo sapien
tagtagccacatagtgtttcaatgt

SEQ ID NO: 58414 - DNA, 25 bp, Homo sapien
ggatgttccaaaatacattacccat

SEQ ID NO: 58415 - DNA, 25 bp, Homo sapien
aaatacattacccatttcctgctgt

SEQ ID NO: 58416 - DNA, 25 bp, Homo sapien
acattacccatttcctgctgtaaca

SEQ ID NO: 58417 - DNA, 25 bp, Homo sapien
agtcagctccctctaaaatactcag

SEQ ID NO: 58418 - DNA, 25 bp, Homo sapien
ctaaaatactcagcggccagggcgg

SEQ ID NO: 58419 - DNA, 25 bp, Homo sapien
ctcctcccgtgttacattctcaggg

SEQ ID NO: 58420 - DNA, 25 bp, Homo sapien
gcatctgcagcagttgctgaggctc

SEQ ID NO: 58421 - DNA, 25 bp, Homo sapien
gcagcagttgctgaggctccgtcag

SEQ ID NO: 58422 - DNA, 25 bp, Homo sapien
tcttcacctgttgttacagtgcctt

SEQ ID NO: 58423 - DNA, 25 bp, Homo sapien
ggcacattcaggactagaagcccct

SEQ ID NO: 58424 - DNA, 25 bp, Homo sapien
attcaggactagaagcccctctggg

SEQ ID NO: 58425 - DNA, 25 bp, Homo sapien
acatggcaggtcagcctgtggaact

SEQ ID NO: 58426 - DNA, 25 bp, Homo sapien
aggtcagcctgtggaacttgcgcag

SEQ ID NO: 58427 - DNA, 25 bp, Homo sapien
gaacttgcgcaggtgcgactggcca

SEQ ID NO: 58428 - DNA, 25 bp, Homo sapien
gtgatatcagttgtttgacgtgcaa

SEQ ID NO: 58429 - DNA, 25 bp, Homo sapien
gttgtttgacgtgcaatggcccagg

SEQ ID NO: 58430 - DNA, 25 bp, Homo sapien
caatggcccaggattcaagaactgt

SEQ ID NO: 58431 - DNA, 25 bp, Homo sapien
tcaagaactgtacaagctgccctag

SEQ ID NO: 58432 - DNA, 25 bp, Homo sapien
aactgtacaagctgccctagtgggt

SEQ ID NO: 58433 - DNA, 25 bp, Homo sapien
aagctgccctagtgggtatctctta

SEQ ID NO: 58434 - DNA, 25 bp, Homo sapien
gccctagtgggtatctcttagactt

SEQ ID NO: 58435 - DNA, 25 bp, Homo sapien
gtgggtatctcttagacttaggaat

SEQ ID NO: 58436 - DNA, 25 bp, Homo sapien
aggaatgtgtcaaatgggagccatt

SEQ ID NO: 58437 - DNA, 25 bp, Homo sapien
aatgggagccatttgcaaggatgca

SEQ ID NO: 58438 - DNA, 25 bp, Homo sapien
ttgcaaggatgcaacggaagagtcc

SEQ ID NO: 58439 - DNA, 25 bp, Homo sapien
gctttttcctattaatactacttat

SEQ ID NO: 58440 - DNA, 25 bp, Homo sapien
atccattaaaaagcaatctctgtac

SEQ ID NO: 58441 - DNA, 25 bp, Homo sapien
aatctctgtacagtgtatttaaata

SEQ ID NO: 58442 - DNA, 25 bp, Homo sapien
attgacatactgtgatctctattag

SEQ ID NO: 58443 - DNA, 25 bp, Homo sapien
gatctctattagtgatggatgtaca

SEQ ID NO: 58444 - DNA, 25 bp, Homo sapien
tgttttcttacccttgacttacaat

SEQ ID NO: 58445 - DNA, 25 bp, Homo sapien
tgaaattacttgtctgaaccccgtg

SEQ ID NO: 58446 - DNA, 25 bp, Homo sapien
tccatccttgaatcagttctcataa

SEQ ID NO: 58447 - DNA, 25 bp, Homo sapien
gaatcagttctcataatgcttttta

SEQ ID NO: 58448 - DNA, 25 bp, Homo sapien
agatgaatttcttccaatatttgaa

SEQ ID NO: 58449 - DNA, 25 bp, Homo sapien
taaagctcttagatacagagtagat

SEQ ID NO: 58450 - DNA, 25 bp, Homo sapien
tgtctgtggcccacttgggcaccca

SEQ ID NO: 58451 - DNA, 25 bp, Homo sapien
tgtccacttctggttgccaggagac

SEQ ID NO: 58452 - DNA, 25 bp, Homo sapien
acttctggttgccaggagacagcaa

SEQ ID NO: 58453 - DNA, 25 bp, Homo sapien
ctggttgccaggagacagcaagcaa

SEQ ID NO: 58454 - DNA, 25 bp, Homo sapien
gccaggagacagcaagcaaagccag

SEQ ID NO: 58455 - DNA, 25 bp, Homo sapien
acagcaagcaaagccagcaggacat

SEQ ID NO: 58456 - DNA, 25 bp, Homo sapien
agcaaagccagcaggacatgaagtt

SEQ ID NO: 58457 - DNA, 25 bp, Homo sapien
agccagcaggacatgaagttgctat

SEQ ID NO: 58458 - DNA, 25 bp, Homo sapien
tgctattaaatggacttcgtgattt

SEQ ID NO: 58459 - DNA, 25 bp, Homo sapien
tggacttcgtgatttttgttttgca

SEQ ID NO: 58460 - DNA, 25 bp, Homo sapien
ttgttttgcactaaagtttctgtga

SEQ ID NO: 58461 - DNA, 25 bp, Homo sapien
gatacagtgggtaccaagctcctct

SEQ ID NO: 58462 - DNA, 25 bp, Homo sapien
cccactttgtagagcctagcatgag

SEQ ID NO: 58463 - DNA, 25 bp, Homo sapien
gaattggatcctaggtgcttagccc

SEQ ID NO: 58464 - DNA, 25 bp, Homo sapien
aggtgcttagccctgcaatatcagg

SEQ ID NO: 58465 - DNA, 25 bp, Homo sapien
caatatcagggcctcactggtggga

SEQ ID NO: 58466 - DNA, 25 bp, Homo sapien
cctcgggctgggttgcttggtcata

SEQ ID NO: 58467 - DNA, 25 bp, Homo sapien
aaggaagctgtcagcccggagtgcc

SEQ ID NO: 58468 - DNA, 25 bp, Homo sapien
tgccacctagacactgatgccattg

SEQ ID NO: 58469 - DNA, 25 bp, Homo sapien
tgtgtgctgcctcaagactgctgga

SEQ ID NO: 58470 - DNA, 25 bp, Homo sapien
gactgctggagtcaggacattttat

SEQ ID NO: 58471 - DNA, 25 bp, Homo sapien
gacattttatagagccttttccagt

SEQ ID NO: 58472 - DNA, 25 bp, Homo sapien
tttaaccggagcttcatctagtgat

SEQ ID NO: 58473 - DNA, 25 bp, Homo sapien
agcccgctccctccgtggaatggag

SEQ ID NO: 58474 - DNA, 25 bp, Homo sapien
ggagctcagctcttcggaggcatca

SEQ ID NO: 58475 - DNA, 25 bp, Homo sapien
tcggaggcatcaaagcacctgtcgc

SEQ ID NO: 58476 - DNA, 25 bp, Homo sapien
ttcgtttgcctggagtggccggccc

SEQ ID NO: 58477 - DNA, 25 bp, Homo sapien
ggccctgcttgtgccatgtggatgt

SEQ ID NO: 58478 - DNA, 25 bp, Homo sapien
atgtggatgtttgtgagcctcggtc

SEQ ID NO: 58479 - DNA, 25 bp, Homo sapien
agcctcggtcctacagcactgtgta

SEQ ID NO: 58480 - DNA, 25 bp, Homo sapien
gcactgtgtaggctgcatctgtttc

SEQ ID NO: 58481 - DNA, 25 bp, Homo sapien
aggctgcatctgtttcgtgctggtc

SEQ ID NO: 58482 - DNA, 25 bp, Homo sapien
ggtcctgttgacttgtatgatatcc

SEQ ID NO: 58483 - DNA, 25 bp, Homo sapien
agaccgaaagcctggactcagctca

SEQ ID NO: 58484 - DNA, 25 bp, Homo sapien
tcagctcactgcctacatccagtgg

SEQ ID NO: 58485 - DNA, 25 bp, Homo sapien
atccagtggccacatagcctgggac

SEQ ID NO: 58486 - DNA, 25 bp, Homo sapien
tgggaccctcctttgaaacatcctt

SEQ ID NO: 58487 - DNA, 25 bp, Homo sapien
tgaaacatcctttacaggctccctt

SEQ ID NO: 58488 - DNA, 25 bp, Homo sapien
tgctcttgcctcttgtgatgtcttg

SEQ ID NO: 58489 - DNA, 25 bp, Homo sapien
tcttgtgatgtcttgggtttgggct

SEQ ID NO: 58490 - DNA, 25 bp, Homo sapien
gggcttgtttttacagcttgtgaac

SEQ ID NO: 58491 - DNA, 25 bp, Homo sapien
tacagcttgtgaacggactgcacgt

SEQ ID NO: 58492 - DNA, 25 bp, Homo sapien
cggactgcacgtttgttacaaggga

SEQ ID NO: 58493 - DNA, 25 bp, Homo sapien
atggaggctgcatattcatgaatag

SEQ ID NO: 58494 - DNA, 25 bp, Homo sapien
atatgactagtgtatgttccacacc

SEQ ID NO: 58495 - DNA, 25 bp, Homo sapien
ttccacaccctctgctactgtgtta

SEQ ID NO: 58496 - DNA, 25 bp, Homo sapien
actgtgttacattctgattgtcttg

SEQ ID NO: 58497 - DNA, 25 bp, Homo sapien
ttgtatggaccagaagagagctttg

SEQ ID NO: 58498 - DNA, 25 bp, Homo sapien
gaagagagctttgggacattttttc

SEQ ID NO: 58499 - DNA, 25 bp, Homo sapien
gggacattttttctgaacattctaa

SEQ ID NO: 58500 - DNA, 25 bp, Homo sapien
gaacattctaagcattctagtgaaa

SEQ ID NO: 58501 - DNA, 25 bp, Homo sapien
gtgaaagttcccatgttccaacaga

SEQ ID NO: 58502 - DNA, 25 bp, Homo sapien
tacacaataattgaggtccaccttc

SEQ ID NO: 58503 - DNA, 25 bp, Homo sapien
ggtccaccttctaggaaatcctagg

SEQ ID NO: 58504 - DNA, 25 bp, Homo sapien
cctaggactcgtttatttgggacat

SEQ ID NO: 58505 - DNA, 25 bp, Homo sapien
tccagccctgtccagcaagtgcagg

SEQ ID NO: 58506 - DNA, 25 bp, Homo sapien
tgtccagcaagtgcagggtgcctgc

SEQ ID NO: 58507 - DNA, 25 bp, Homo sapien
tgcacttcaccctgtgcagagaggt

SEQ ID NO: 58508 - DNA, 25 bp, Homo sapien
ttcaccctgtgcagagaggtgggat

SEQ ID NO: 58509 - DNA, 25 bp, Homo sapien
ggcccaggccccttttggaggcagc

SEQ ID NO: 58510 - DNA, 25 bp, Homo sapien
ctcttctgcagctttgtggaaggct

SEQ ID NO: 58511 - DNA, 25 bp, Homo sapien
gcagctttgtggaaggctgatcagt

SEQ ID NO: 58512 - DNA, 25 bp, Homo sapien
gaaggctgatcagtggctgctgggt

SEQ ID NO: 58513 - DNA, 25 bp, Homo sapien
tggcgggtacccttgctcagatgcc

SEQ ID NO: 58514 - DNA, 25 bp, Homo sapien
gtacccttgctcagatgcctggcag

SEQ ID NO: 58515 - DNA, 25 bp, Homo sapien
ccttgctcagatgcctggcagggct

SEQ ID NO: 58516 - DNA, 25 bp, Homo sapien
gctgggagcctggtatattcctata

SEQ ID NO: 58517 - DNA, 25 bp, Homo sapien
tattcctatatcactttcactgaag

SEQ ID NO: 58518 - DNA, 25 bp, Homo sapien
gaggctaataacaagctggacatta

SEQ ID NO: 58519 - DNA, 25 bp, Homo sapien
gtgtgaccagaggattgcttcatct

SEQ ID NO: 58520 - DNA, 25 bp, Homo sapien
gcttcatctgatacgtaggcctaag

SEQ ID NO: 58521 - DNA, 25 bp, Homo sapien
aactcagaacactggcagttcctac

SEQ ID NO: 58522 - DNA, 25 bp, Homo sapien
agttcctacagagacactgaggtgt

SEQ ID NO: 58523 - DNA, 25 bp, Homo sapien
aataaccattcctttgcacttgtac

SEQ ID NO: 58524 - DNA, 25 bp, Homo sapien
tttgcacttgtacaatctgaggatt

SEQ ID NO: 58525 - DNA, 25 bp, Homo sapien
ggagattatattttcacgtggacaa

SEQ ID NO: 58526 - DNA, 25 bp, Homo sapien
ttcacgtggacaaacttcattggtt

SEQ ID NO: 58527 - DNA, 25 bp, Homo sapien
tggaagaaccgcaccctctgatgtt

SEQ ID NO: 58528 - DNA, 25 bp, Homo sapien
gaaactccaggaccagatctttaat

SEQ ID NO: 58529 - DNA, 25 bp, Homo sapien
aggaccagatctttaatctcatgaa

SEQ ID NO: 58530 - DNA, 25 bp, Homo sapien
catgaagtacgacagctacagccgc

SEQ ID NO: 58531 - DNA, 25 bp, Homo sapien
aaaacacaagcgaaccgaggaagag

SEQ ID NO: 58532 - DNA, 25 bp, Homo sapien
ggaagaagatttgcctgatgctcaa

SEQ ID NO: 58533 - DNA, 25 bp, Homo sapien
agatttgcctgatgctcaaactgca

SEQ ID NO: 58534 - DNA, 25 bp, Homo sapien
aaactgcagctaaaagagcttccag

SEQ ID NO: 58535 - DNA, 25 bp, Homo sapien
aaaagccgggactggcagctttaag

SEQ ID NO: 58536 - DNA, 25 bp, Homo sapien
aagcaaaggaatttcctctcaggac

SEQ ID NO: 58537 - DNA, 25 bp, Homo sapien
cgtgccgggtttatcattgctttgt

SEQ ID NO: 58538 - DNA, 25 bp, Homo sapien
ttccaaaatggcctggacgagaagt

SEQ ID NO: 58539 - DNA, 25 bp, Homo sapien
aaaatggcctggacgagaagttcct

SEQ ID NO: 58540 - DNA, 25 bp, Homo sapien
aagttcctcggaagacacagctggg

SEQ ID NO: 58541 - DNA, 25 bp, Homo sapien
gagctccctgctgttcgggacctaa

SEQ ID NO: 58542 - DNA, 25 bp, Homo sapien
atctaccatggtgaggtgccccagg

SEQ ID NO: 58543 - DNA, 25 bp, Homo sapien
accatggtgaggtgccccaggccag

SEQ ID NO: 58544 - DNA, 25 bp, Homo sapien
ctcccagtggattcactgtccacgg

SEQ ID NO: 58545 - DNA, 25 bp, Homo sapien
cagtggattcactgtccacggcctc

SEQ ID NO: 58546 - DNA, 25 bp, Homo sapien
tgacctcccgagcaaacatgacaga

SEQ ID NO: 58547 - DNA, 25 bp, Homo sapien
ggagaggtctccaacaagcttccaa

SEQ ID NO: 58548 - DNA, 25 bp, Homo sapien
aggtctccaacaagcttccaaaatg

SEQ ID NO: 58549 - DNA, 25 bp, Homo sapien
ttgtttcccaatttctttagttgca

SEQ ID NO: 58550 - DNA, 25 bp, Homo sapien
tttagttgcaaatcccttaaccatt

SEQ ID NO: 58551 - DNA, 25 bp, Homo sapien
gttgcaaatcccttaaccatttatt

SEQ ID NO: 58552 - DNA, 25 bp, Homo sapien
gcatggatgtaatgatctctcttca

SEQ ID NO: 58553 - DNA, 25 bp, Homo sapien
agccctctggatcacaatgcacttt

SEQ ID NO: 58554 - DNA, 25 bp, Homo sapien
atgcactttgtatagctgaagtcat

SEQ ID NO: 58555 - DNA, 25 bp, Homo sapien
gaagtcatgatttctacacgtcact

SEQ ID NO: 58556 - DNA, 25 bp, Homo sapien
gatttctacacgtcactaatgtttg

SEQ ID NO: 58557 - DNA, 25 bp, Homo sapien
aaagcactaatttcttataacatac

SEQ ID NO: 58558 - DNA, 25 bp, Homo sapien
tacagtgaatgttttccacatatga

SEQ ID NO: 58559 - DNA, 25 bp, Homo sapien
tgttttccacatatgatctagaggg

SEQ ID NO: 58560 - DNA, 25 bp, Homo sapien
gaggcctagaaatcggatgttagaa

SEQ ID NO: 58561 - DNA, 25 bp, Homo sapien
taggaatcatggctctgagcgcctt

SEQ ID NO: 58562 - DNA, 25 bp, Homo sapien
gagcgccttgcatacaggagatact

SEQ ID NO: 58563 - DNA, 25 bp, Homo sapien
ggagatactcactgatactaaatca

SEQ ID NO: 58564 - DNA, 25 bp, Homo sapien
tcaaggcatgtaaacaatactgggt

SEQ ID NO: 58565 - DNA, 25 bp, Homo sapien
tactgggtaaatcatacctaccaga

SEQ ID NO: 58566 - DNA, 25 bp, Homo sapien
aagagtaacattcagagcttttctt

SEQ ID NO: 58567 - DNA, 25 bp, Homo sapien
ctccatatttcaaaagtctgcacgt

SEQ ID NO: 58568 - DNA, 25 bp, Homo sapien
gtctgcacgtatgaaattgtgtctt

SEQ ID NO: 58569 - DNA, 25 bp, Homo sapien
tatttctggtttttagagcctaaga

SEQ ID NO: 58570 - DNA, 25 bp, Homo sapien
gatactcattcttaattcctattta

SEQ ID NO: 58571 - DNA, 25 bp, Homo sapien
aagaataactctggcttccgccatg

SEQ ID NO: 58572 - DNA, 25 bp, Homo sapien
atgtctcagaaataggtggccatgg

SEQ ID NO: 58573 - DNA, 25 bp, Homo sapien
atgctctgtgcagtctgagaaagca

SEQ ID NO: 58574 - DNA, 25 bp, Homo sapien
gcaaatttgcctcttttcttaacac

SEQ ID NO: 58575 - DNA, 25 bp, Homo sapien
ttgcctcttttcttaacacagtctc

SEQ ID NO: 58576 - DNA, 25 bp, Homo sapien
ttttcttaacacagtctctactggg

SEQ ID NO: 58577 - DNA, 25 bp, Homo sapien
gaagcagaacactggtgggataaaa

SEQ ID NO: 58578 - DNA, 25 bp, Homo sapien
cctccactgtgaacagtaagccaga

SEQ ID NO: 58579 - DNA, 25 bp, Homo sapien
aagccagaatatgcttattcctcag

SEQ ID NO: 58580 - DNA, 25 bp, Homo sapien
attcctcagcataaacagtatctcg

SEQ ID NO: 58581 - DNA, 25 bp, Homo sapien
acagtatctcggagaagcctgggat

SEQ ID NO: 58582 - DNA, 25 bp, Homo sapien
aacatatagagctatttctactgat

SEQ ID NO: 58583 - DNA, 25 bp, Homo sapien
tttctactgatttttgcccttgttc

SEQ ID NO: 58584 - DNA, 25 bp, Homo sapien
gatttttgcccttgttctgtccttt

SEQ ID NO: 58585 - DNA, 25 bp, Homo sapien
gttttttgtttggtaccatagtgtg

SEQ ID NO: 58586 - DNA, 25 bp, Homo sapien
ggtaccatagtgtgaaatgctggga

SEQ ID NO: 58587 - DNA, 25 bp, Homo sapien
tgctgggaacaatgactataagaca

SEQ ID NO: 58588 - DNA, 25 bp, Homo sapien
gactataagacatgctatggcacat

SEQ ID NO: 58589 - DNA, 25 bp, Homo sapien
aagacatgctatggcacatatattt

SEQ ID NO: 58590 - DNA, 25 bp, Homo sapien
gaactttgtactattcacattttgt

SEQ ID NO: 58591 - DNA, 25 bp, Homo sapien
tgtactattcacattttgtatcagt

SEQ ID NO: 58592 - DNA, 25 bp, Homo sapien
caaaggtcataatgctttcagcaat

SEQ ID NO: 58593 - DNA, 25 bp, Homo sapien
aaagaggaacccagtggatgtaaca

SEQ ID NO: 58594 - DNA, 25 bp, Homo sapien
ggatgtaacagaaccgactccagtt

SEQ ID NO: 58595 - DNA, 25 bp, Homo sapien
accgactccagttgaatgtttagat

SEQ ID NO: 58596 - DNA, 25 bp, Homo sapien
tagatttttgctaaactgttttctt

SEQ ID NO: 58597 - DNA, 25 bp, Homo sapien
ttcccttttttgctgtggtttgcat

SEQ ID NO: 58598 - DNA, 25 bp, Homo sapien
gctgtggtttgcattcacggcagta

SEQ ID NO: 58599 - DNA, 25 bp, Homo sapien
tcacggcagtagttagcccaggtgt

SEQ ID NO: 58600 - DNA, 25 bp, Homo sapien
gtgcactgcatgatagcgttctggt

SEQ ID NO: 58601 - DNA, 25 bp, Homo sapien
gtgagctgggaaggacccaccactg

SEQ ID NO: 58602 - DNA, 25 bp, Homo sapien
gggaccagctaagtctctgcagtag

SEQ ID NO: 58603 - DNA, 25 bp, Homo sapien
agtctctgcagtagtgtgaaattcc

SEQ ID NO: 58604 - DNA, 25 bp, Homo sapien
attgtatttcccagaattctcaagt

SEQ ID NO: 58605 - DNA, 25 bp, Homo sapien
tgtatttcccagaattctcaagtgt

SEQ ID NO: 58606 - DNA, 25 bp, Homo sapien
gtatttcccagaattctcaagtgtt

SEQ ID NO: 58607 - DNA, 25 bp, Homo sapien
atttcccagaattctcaagtgttgt

SEQ ID NO: 58608 - DNA, 25 bp, Homo sapien
ttcccagaattctcaagtgttgtgg

SEQ ID NO: 58609 - DNA, 25 bp, Homo sapien
aataagtctcacaacatctcatgag

SEQ ID NO: 58610 - DNA, 25 bp, Homo sapien
aagtctcacaacatctcatgagttt

SEQ ID NO: 58611 - DNA, 25 bp, Homo sapien
gtctcacaacatctcatgagtttat

SEQ ID NO: 58612 - DNA, 25 bp, Homo sapien
acaacatctcatgagtttatcaggg

SEQ ID NO: 58613 - DNA, 25 bp, Homo sapien
acttttgcttctgtcctctttttct

SEQ ID NO: 58614 - DNA, 25 bp, Homo sapien
cttttgcttctgtcctctttttctc

SEQ ID NO: 58615 - DNA, 25 bp, Homo sapien
atctaccatggtgaggtgccccagg

SEQ ID NO: 58616 - DNA, 25 bp, Homo sapien
accatggtgaggtgccccaggccag

SEQ ID NO: 58617 - DNA, 25 bp, Homo sapien
ctcccagtggattcactgtccacgg

SEQ ID NO: 58618 - DNA, 25 bp, Homo sapien
cagtggattcactgtccacggcctc

SEQ ID NO: 58619 - DNA, 25 bp, Homo sapien
caacatctccagaccggccaggctc

SEQ ID NO: 58620 - DNA, 25 bp, Homo sapien
gacctgcccagcatgcctgaacctg

SEQ ID NO: 58621 - DNA, 25 bp, Homo sapien
agcatgcctgaacctgccctgacct

SEQ ID NO: 58622 - DNA, 25 bp, Homo sapien
tgacctcccgagcaaacatgacaga

SEQ ID NO: 58623 - DNA, 25 bp, Homo sapien
acctcccgagcaaacatgacagagc

SEQ ID NO: 58624 - DNA, 25 bp, Homo sapien
ggtctccaacaagcttccaaaatgg

SEQ ID NO: 58625 - DNA, 25 bp, Homo sapien
tctccaacaagcttccaaaatggcc

SEQ ID NO: 58626 - DNA, 25 bp, Homo sapien
tttttcctcaatgaatgggatgtct

SEQ ID NO: 58627 - DNA, 25 bp, Homo sapien
ttttcctcaatgaatgggatgtcta

SEQ ID NO: 58628 - DNA, 25 bp, Homo sapien
ttcctcaatgaatgggatgtctaat

SEQ ID NO: 58629 - DNA, 25 bp, Homo sapien
ctcaatgaatgggatgtctaatgta

SEQ ID NO: 58630 - DNA, 25 bp, Homo sapien
atgaatgggatgtctaatgtatttc

SEQ ID NO: 58631 - DNA, 25 bp, Homo sapien
gaatgggatgtctaatgtatttcaa

SEQ ID NO: 58632 - DNA, 25 bp, Homo sapien
atgggatgtctaatgtatttcaaaa

SEQ ID NO: 58633 - DNA, 25 bp, Homo sapien
gggatgtctaatgtatttcaaaatc

SEQ ID NO: 58634 - DNA, 25 bp, Homo sapien
gtctaatgtatttcaaaatcaccca

SEQ ID NO: 58635 - DNA, 25 bp, Homo sapien
tgtatttcaaaatcacccaaaactt

SEQ ID NO: 58636 - DNA, 25 bp, Homo sapien
tcaaaatcacccaaaacttttggca

SEQ ID NO: 58637 - DNA, 25 bp, Homo sapien
ttgttggcaaacttgatgtaacctt

SEQ ID NO: 58638 - DNA, 25 bp, Homo sapien
gcaaacttgatgtaaccttatatgg

SEQ ID NO: 58639 - DNA, 25 bp, Homo sapien
tatggtggttttagtcccttcttat

SEQ ID NO: 58640 - DNA, 25 bp, Homo sapien
agtcccttcttatggttggcagaag

SEQ ID NO: 58641 - DNA, 25 bp, Homo sapien
atggttggcagaagggcactgaact

SEQ ID NO: 58642 - DNA, 25 bp, Homo sapien
actgttgggtgaaagttagttagca

SEQ ID NO: 58643 - DNA, 25 bp, Homo sapien
agtttttatgtgaggactttgtaag

SEQ ID NO: 58644 - DNA, 25 bp, Homo sapien
ccaacgtttaaagggagtgatctgc

SEQ ID NO: 58645 - DNA, 25 bp, Homo sapien
aagggagtgatctgctttacatgat

SEQ ID NO: 58646 - DNA, 25 bp, Homo sapien
gatctgctttacatgatactatgca

SEQ ID NO: 58647 - DNA, 25 bp, Homo sapien
tactatgcaatgcttgttttccaac

SEQ ID NO: 58648 - DNA, 25 bp, Homo sapien
gatatgcatttttatacaggcacat

SEQ ID NO: 58649 - DNA, 25 bp, Homo sapien
gcttgggagcagaatgcattgcatt

SEQ ID NO: 58650 - DNA, 25 bp, Homo sapien
attgtataaatgactctggcctgtg

SEQ ID NO: 58651 - DNA, 25 bp, Homo sapien
ataaatgactctggcctgtgtgtac

SEQ ID NO: 58652 - DNA, 25 bp, Homo sapien
gactctggcctgtgtgtactttgat

SEQ ID NO: 58653 - DNA, 25 bp, Homo sapien
ggcctgtgtgtactttgattttata

SEQ ID NO: 58654 - DNA, 25 bp, Homo sapien
tttagaacactttggtagcaataga

SEQ ID NO: 58655 - DNA, 25 bp, Homo sapien
gaacactttggtagcaatagaaact

SEQ ID NO: 58656 - DNA, 25 bp, Homo sapien
acactttggtagcaatagaaacttt

SEQ ID NO: 58657 - DNA, 25 bp, Homo sapien
catttttgtatggtacctgtgatgt

SEQ ID NO: 58658 - DNA, 25 bp, Homo sapien
gtagggtgggtttccaaatttgcat

SEQ ID NO: 58659 - DNA, 25 bp, Homo sapien
atgaccacatcctatgtacgtattg

SEQ ID NO: 58660 - DNA, 25 bp, Homo sapien
gtacgtattgtcagaaccatccttc

SEQ ID NO: 58661 - DNA, 25 bp, Homo sapien
gtattgtcagaaccatccttcaaat

SEQ ID NO: 58662 - DNA, 25 bp, Homo sapien
tgccctcggcctctaagaaatacaa

SEQ ID NO: 58663 - DNA, 25 bp, Homo sapien
tttgggtgtggtctccctcttttat

SEQ ID NO: 58664 - DNA, 25 bp, Homo sapien
cctcttttatgggacgcttgctatg

SEQ ID NO: 58665 - DNA, 25 bp, Homo sapien
gacgcttgctatggtgtacctgcag

SEQ ID NO: 58666 - DNA, 25 bp, Homo sapien
ctgtgctgacacctatgatgaaccc

SEQ ID NO: 58667 - DNA, 25 bp, Homo sapien
ctgacacctatgatgaaccctttca

SEQ ID NO: 58668 - DNA, 25 bp, Homo sapien
ggaagagtcctatggagaccctttc

SEQ ID NO: 58669 - DNA, 25 bp, Homo sapien
atggagaccctttcagaggcctaaa

SEQ ID NO: 58670 - DNA, 25 bp, Homo sapien
ggaaagaatgctagtttccaaatgt

SEQ ID NO: 58671 - DNA, 25 bp, Homo sapien
attacgttgaagaacgatctggcga

SEQ ID NO: 58672 - DNA, 25 bp, Homo sapien
cgatctggcgaggatccactggtaa

SEQ ID NO: 58673 - DNA, 25 bp, Homo sapien
ggatccactggtaaagggcatccca

SEQ ID NO: 58674 - DNA, 25 bp, Homo sapien
aagggcatcccagaggacaaaaatc

SEQ ID NO: 58675 - DNA, 25 bp, Homo sapien
aaaaatcccttcaaggagctcaaag

SEQ ID NO: 58676 - DNA, 25 bp, Homo sapien
gagctcaaaggaggctgtgtgattt

SEQ ID NO: 58677 - DNA, 25 bp, Homo sapien
gaggctgtgtgatttcataatacaa

SEQ ID NO: 58678 - DNA, 25 bp, Homo sapien
ttttctcatgcatactattactact

SEQ ID NO: 58679 - DNA, 25 bp, Homo sapien
tattactactaagcatgtacgtgaa

SEQ ID NO: 58680 - DNA, 25 bp, Homo sapien
aagaagtgacactggaaagaatgct

SEQ ID NO: 58681 - DNA, 25 bp, Homo sapien
aaagtggtctccagcccttgctcca

SEQ ID NO: 58682 - DNA, 25 bp, Homo sapien
gggctgagtggtatccctacctggc

SEQ ID NO: 58683 - DNA, 25 bp, Homo sapien
ctccagcgctgggtttgtcgagtga

SEQ ID NO: 58684 - DNA, 25 bp, Homo sapien
agagaggagcttgggttgcttccct

SEQ ID NO: 58685 - DNA, 25 bp, Homo sapien
aggagcttgggttgcttccctgtcc

SEQ ID NO: 58686 - DNA, 25 bp, Homo sapien
tttctaccaattgctatttttccga

SEQ ID NO: 58687 - DNA, 25 bp, Homo sapien
gctatttttccgaacaatccttgta

SEQ ID NO: 58688 - DNA, 25 bp, Homo sapien
aatccttgtagagtatgtaccatcc

SEQ ID NO: 58689 - DNA, 25 bp, Homo sapien
gtagagtatgtaccatccaaaggca

SEQ ID NO: 58690 - DNA, 25 bp, Homo sapien
tgtaccatccaaaggcaggagggcc

SEQ ID NO: 58691 - DNA, 25 bp, Homo sapien
gctctggttggagatggtacagttt

SEQ ID NO: 58692 - DNA, 25 bp, Homo sapien
gcctgacctggctgttgatgttcta

SEQ ID NO: 58693 - DNA, 25 bp, Homo sapien
gacctggctgttgatgttctagaga

SEQ ID NO: 58694 - DNA, 25 bp, Homo sapien
atgttctagagaggacagcagacaa

SEQ ID NO: 58695 - DNA, 25 bp, Homo sapien
gacagcagacaaggccacagtcaat

SEQ ID NO: 58696 - DNA, 25 bp, Homo sapien
aggccacagtcaatggacttcctga

SEQ ID NO: 58697 - DNA, 25 bp, Homo sapien
aaggacagagagacggacacctcgg

SEQ ID NO: 58698 - DNA, 25 bp, Homo sapien
agagagacggacacctcggccctgg

SEQ ID NO: 58699 - DNA, 25 bp, Homo sapien
gagttcccaggaggtgacgtatgct

SEQ ID NO: 58700 - DNA, 25 bp, Homo sapien
gaggtgacgtatgctcagctggacc

SEQ ID NO: 58701 - DNA, 25 bp, Homo sapien
actgggccctcacacagaggacagc

SEQ ID NO: 58702 - DNA, 25 bp, Homo sapien
agtccacaaagcccatggccgagtc

SEQ ID NO: 58703 - DNA, 25 bp, Homo sapien
aatgagtagaacagttttgtattct

SEQ ID NO: 58704 - DNA, 25 bp, Homo sapien
tattctactccctacaagccatttt

SEQ ID NO: 58705 - DNA, 25 bp, Homo sapien
tctactccctacaagccattttgaa

SEQ ID NO: 58706 - DNA, 25 bp, Homo sapien
tgccctcaccggactctgggctgtg

SEQ ID NO: 58707 - DNA, 25 bp, Homo sapien
gtgactggggcaccaaactcagcac

SEQ ID NO: 58708 - DNA, 25 bp, Homo sapien
aaactcagcacatgagtctccccta

SEQ ID NO: 58709 - DNA, 25 bp, Homo sapien
atgagtctcccctagctctcgtggg

SEQ ID NO: 58710 - DNA, 25 bp, Homo sapien
accctgatgccaacagccgggtggc

SEQ ID NO: 58711 - DNA, 25 bp, Homo sapien
caacagccgggtggctgtccaagca

SEQ ID NO: 58712 - DNA, 25 bp, Homo sapien
gggtggctgtccaagcaggattgca

SEQ ID NO: 58713 - DNA, 25 bp, Homo sapien
ggacacagggaagcactgcccagcc

SEQ ID NO: 58714 - DNA, 25 bp, Homo sapien
ggagcggcctctccagacctgcctt

SEQ ID NO: 58715 - DNA, 25 bp, Homo sapien
ctccggcggcgagatgcagaggtga

SEQ ID NO: 58716 - DNA, 25 bp, Homo sapien
gagatgcagaggtgaccctcggacc

SEQ ID NO: 58717 - DNA, 25 bp, Homo sapien
atgcagaggtgaccctcggacccgc

SEQ ID NO: 58718 - DNA, 25 bp, Homo sapien
gccgttcgcgaaccctagcagagga

SEQ ID NO: 58719 - DNA, 25 bp, Homo sapien
gttcgcgaaccctagcagaggactc

SEQ ID NO: 58720 - DNA, 25 bp, Homo sapien
tcgcgaaccctagcagaggactcag

SEQ ID NO: 58721 - DNA, 25 bp, Homo sapien
gaaccctagcagaggactcagccac

SEQ ID NO: 58722 - DNA, 25 bp, Homo sapien
agcagaggactcagccaccgccgag

SEQ ID NO: 58723 - DNA, 25 bp, Homo sapien
gggcattaactgacctctgagtaca

SEQ ID NO: 58724 - DNA, 25 bp, Homo sapien
cattaactgacctctgagtacagca

SEQ ID NO: 58725 - DNA, 25 bp, Homo sapien
attgaaccctgccagagacgggaag

SEQ ID NO: 58726 - DNA, 25 bp, Homo sapien
ggagccccaggacctatgcacttta

SEQ ID NO: 58727 - DNA, 25 bp, Homo sapien
atgcactttatttctgaccccgtgg

SEQ ID NO: 58728 - DNA, 25 bp, Homo sapien
ctttatttctgaccccgtggcttcg

SEQ ID NO: 58729 - DNA, 25 bp, Homo sapien
gaccccgtggcttcggctgagacct

SEQ ID NO: 58730 - DNA, 25 bp, Homo sapien
agtcctacctgtcacaccggacgga

SEQ ID NO: 58731 - DNA, 25 bp, Homo sapien
tgtcacaccggacggacccgctgtg

SEQ ID NO: 58732 - DNA, 25 bp, Homo sapien
ttctaccatcgttccaccattgatg

SEQ ID NO: 58733 - DNA, 25 bp, Homo sapien
tccaccattgatgtacatactcatg

SEQ ID NO: 58734 - DNA, 25 bp, Homo sapien
atcttttctttctgcgctcggctcc

SEQ ID NO: 58735 - DNA, 25 bp, Homo sapien
tcggctccggccattttgttttata

SEQ ID NO: 58736 - DNA, 25 bp, Homo sapien
acaagaaccagatgcccatgctcat

SEQ ID NO: 58737 - DNA, 25 bp, Homo sapien
gaaccagatgcccatgctcatgggc

SEQ ID NO: 58738 - DNA, 25 bp, Homo sapien
ctggactctactcccgaggctctgt

SEQ ID NO: 58739 - DNA, 25 bp, Homo sapien
tactcccgaggctctgtacattgct

SEQ ID NO: 58740 - DNA, 25 bp, Homo sapien
ggctctgtacattgctgccacatac

SEQ ID NO: 58741 - DNA, 25 bp, Homo sapien
gtacattgctgccacatactcctgc

SEQ ID NO: 58742 - DNA, 25 bp, Homo sapien
tgccacatactcctgccagcttggg

SEQ ID NO: 58743 - DNA, 25 bp, Homo sapien
cagtatttattatcctgcaccacct

SEQ ID NO: 58744 - DNA, 25 bp, Homo sapien
tattatcctgcaccacctcactgtt

SEQ ID NO: 58745 - DNA, 25 bp, Homo sapien
acaccccaaaacacatacattgaaa

SEQ ID NO: 58746 - DNA, 25 bp, Homo sapien
tacattgaaagtgcctcatctgaat

SEQ ID NO: 58747 - DNA, 25 bp, Homo sapien
atggctcccactactgaaacgaact

SEQ ID NO: 58748 - DNA, 25 bp, Homo sapien
gaactcgcttagaaaagttggcgtt

SEQ ID NO: 58749 - DNA, 25 bp, Homo sapien
aaaagttggcgtttcttcatgagaa

SEQ ID NO: 58750 - DNA, 25 bp, Homo sapien
agaaagtattcacctctgctctctg

SEQ ID NO: 58751 - DNA, 25 bp, Homo sapien
aagctataggtgtatactgtaccag

SEQ ID NO: 58752 - DNA, 25 bp, Homo sapien
actgtaccaggtgttgcaaaatgat

SEQ ID NO: 58753 - DNA, 25 bp, Homo sapien
ggagacttaattgtatccaaggcag

SEQ ID NO: 58754 - DNA, 25 bp, Homo sapien
gtatccaaggcaggttagagctagt

SEQ ID NO: 58755 - DNA, 25 bp, Homo sapien
agagctagtgtatgttactgtgaat

SEQ ID NO: 58756 - DNA, 25 bp, Homo sapien
gttggattgtacaaattactgcaaa

SEQ ID NO: 58757 - DNA, 25 bp, Homo sapien
aatgtatacatgttactcttagtaa

SEQ ID NO: 58758 - DNA, 25 bp, Homo sapien
cgttctagatctcgctcaaagtcaa

SEQ ID NO: 58759 - DNA, 25 bp, Homo sapien
tcaaagtcaagatcaaggtccaggt

SEQ ID NO: 58760 - DNA, 25 bp, Homo sapien
gtccaggtcgagttccagagattaa

SEQ ID NO: 58761 - DNA, 25 bp, Homo sapien
gagattaactcagaactccttgttt

SEQ ID NO: 58762 - DNA, 25 bp, Homo sapien
gaactccttgtttgcacattattat

SEQ ID NO: 58763 - DNA, 25 bp, Homo sapien
cctacttaggcagttactcttccat

SEQ ID NO: 58764 - DNA, 25 bp, Homo sapien
ggcagttactcttccatgtttatac

SEQ ID NO: 58765 - DNA, 25 bp, Homo sapien
atgtttatacttggcctcttctgca

SEQ ID NO: 58766 - DNA, 25 bp, Homo sapien
ggcctcttctgcaagaggaatctct

SEQ ID NO: 58767 - DNA, 25 bp, Homo sapien
aggaaatggtggcatgaagaccctc

SEQ ID NO: 58768 - DNA, 25 bp, Homo sapien
ctctcccttctttgtagaattaaga

SEQ ID NO: 58769 - DNA, 25 bp, Homo sapien
tcttcttcattctatcaagcccagg

SEQ ID NO: 58770 - DNA, 25 bp, Homo sapien
ttcattctatcaagcccaggtgcca

SEQ ID NO: 58771 - DNA, 25 bp, Homo sapien
tgaggcagccacttcggccaggtca

SEQ ID NO: 58772 - DNA, 25 bp, Homo sapien
gggcagcaccacttcgctttaaaga

SEQ ID NO: 58773 - DNA, 25 bp, Homo sapien
acttcgctttaaagactctgaactt

SEQ ID NO: 58774 - DNA, 25 bp, Homo sapien
ctttggagagtgacagagccgagca

SEQ ID NO: 58775 - DNA, 25 bp, Homo sapien
gagccgagcaatatttaggatgcaa

SEQ ID NO: 58776 - DNA, 25 bp, Homo sapien
taggatgcaacacgcatggtcaccc

SEQ ID NO: 58777 - DNA, 25 bp, Homo sapien
ataagccttttatactgattattct

SEQ ID NO: 58778 - DNA, 25 bp, Homo sapien
gttataattcactcaagcactgatt

SEQ ID NO: 58779 - DNA, 25 bp, Homo sapien
actcaagcactgattctggcctaaa

SEQ ID NO: 58780 - DNA, 25 bp, Homo sapien
tttaggtttggtgctttcattagat

SEQ ID NO: 58781 - DNA, 25 bp, Homo sapien
ggtgctttcattagattgcttgtta

SEQ ID NO: 58782 - DNA, 25 bp, Homo sapien
cattagattgcttgttaagccctta

SEQ ID NO: 58783 - DNA, 25 bp, Homo sapien
gttaagcccttattgaattcactcc

SEQ ID NO: 58784 - DNA, 25 bp, Homo sapien
aagcccttattgaattcactcctgc

SEQ ID NO: 58785 - DNA, 25 bp, Homo sapien
cttattgaattcactcctgctttcc

SEQ ID NO: 58786 - DNA, 25 bp, Homo sapien
cacccccaattatttcctatactag

SEQ ID NO: 58787 - DNA, 25 bp, Homo sapien
ttcctatactagtttctgatggcag

SEQ ID NO: 58788 - DNA, 25 bp, Homo sapien
actagtttctgatggcagtgaaggt

SEQ ID NO: 58789 - DNA, 25 bp, Homo sapien
aatgggatccagcttcattatggct

SEQ ID NO: 58790 - DNA, 25 bp, Homo sapien
catctgtaatgaatagtggcaataa

SEQ ID NO: 58791 - DNA, 25 bp, Homo sapien
tgctttttcacttccaaggtgcttg

SEQ ID NO: 58792 - DNA, 25 bp, Homo sapien
aaggtgcttgatcaacatctccctg

SEQ ID NO: 58793 - DNA, 25 bp, Homo sapien
tgatcaacatctccctgacaacaca

SEQ ID NO: 58794 - DNA, 25 bp, Homo sapien
tgacaacacaaaactagagccaggg

SEQ ID NO: 58795 - DNA, 25 bp, Homo sapien
actcatttctactgttctctaactg

SEQ ID NO: 58796 - DNA, 25 bp, Homo sapien
tactgttctctaactgtggagtgaa

SEQ ID NO: 58797 - DNA, 25 bp, Homo sapien
aaattccaactgtatgttcaccctc

SEQ ID NO: 58798 - DNA, 25 bp, Homo sapien
gttcaccctctgaagtgggtaccca

SEQ ID NO: 58799 - DNA, 25 bp, Homo sapien
tgggtacccagtctcttaaatcttt

SEQ ID NO: 58800 - DNA, 25 bp, Homo sapien
aaatcttttgtatttgctcacagtg

SEQ ID NO: 58801 - DNA, 25 bp, Homo sapien
tcacagtgtttgagcagtgctgagc

SEQ ID NO: 58802 - DNA, 25 bp, Homo sapien
tcgatggaagcgtccaaacctgctt

SEQ ID NO: 58803 - DNA, 25 bp, Homo sapien
aagtctgttccgtcagagcttctgg

SEQ ID NO: 58804 - DNA, 25 bp, Homo sapien
gtcagagcttctggctgctcctgaa

SEQ ID NO: 58805 - DNA, 25 bp, Homo sapien
ttctggctgctcctgaatggtggaa

SEQ ID NO: 58806 - DNA, 25 bp, Homo sapien
cctgaatggtggaatgcctgtgtcc

SEQ ID NO: 58807 - DNA, 25 bp, Homo sapien
gggcccagacgcaaggcaccgattg

SEQ ID NO: 58808 - DNA, 25 bp, Homo sapien
aaggcaccgattgggccaacatcag

SEQ ID NO: 58809 - DNA, 25 bp, Homo sapien
ttgggccaacatcagagccctgctg

SEQ ID NO: 58810 - DNA, 25 bp, Homo sapien
tgcccagaactcataacctcattgt

SEQ ID NO: 58811 - DNA, 25 bp, Homo sapien
ttgttcaaaccaacacttgcacctt

SEQ ID NO: 58812 - DNA, 25 bp, Homo sapien
caacacttgcacctttctctttttc

SEQ ID NO: 58813 - DNA, 25 bp, Homo sapien
gtgaccgcagcccagttcctgacgc

SEQ ID NO: 58814 - DNA, 25 bp, Homo sapien
cagccaccagctacaggtgcctgag

SEQ ID NO: 58815 - DNA, 25 bp, Homo sapien
gccaccagctacaggtgcctgagca

SEQ ID NO: 58816 - DNA, 25 bp, Homo sapien
cggagtcgcccgaccaatggtcgtc

SEQ ID NO: 58817 - DNA, 25 bp, Homo sapien
tcgtcgccgcactctaatgtgtctg

SEQ ID NO: 58818 - DNA, 25 bp, Homo sapien
gccgcactctaatgtgtctgactgg

SEQ ID NO: 58819 - DNA, 25 bp, Homo sapien
actctaatgtgtctgactggtctga

SEQ ID NO: 58820 - DNA, 25 bp, Homo sapien
ctaatgtgtctgactggtctgaggg

SEQ ID NO: 58821 - DNA, 25 bp, Homo sapien
tgactggtctgagggcgtgtcgtcg

SEQ ID NO: 58822 - DNA, 25 bp, Homo sapien
gacctccatgcagtcccagatcgcg

SEQ ID NO: 58823 - DNA, 25 bp, Homo sapien
cagatcgcgcgcatcccggaggcgt

SEQ ID NO: 58824 - DNA, 25 bp, Homo sapien
ggctacgtgcacttcaggcaggagc

SEQ ID NO: 58825 - DNA, 25 bp, Homo sapien
gtgcacttcaggcaggagctgaaca

SEQ ID NO: 58826 - DNA, 25 bp, Homo sapien
tgaacaagagccttcaggagtgtct

SEQ ID NO: 58827 - DNA, 25 bp, Homo sapien
aggagtgtctgtccacaggcagcct

SEQ ID NO: 58828 - DNA, 25 bp, Homo sapien
gggattctgaggaggcagcctctcc

SEQ ID NO: 58829 - DNA, 25 bp, Homo sapien
gctttgcatcactgggaagcaggca

SEQ ID NO: 58830 - DNA, 25 bp, Homo sapien
atcactgggaagcaggcagtgtctt

SEQ ID NO: 58831 - DNA, 25 bp, Homo sapien
ggtcagtatcctctccgtctgggtg

SEQ ID NO: 58832 - DNA, 25 bp, Homo sapien
cacgcacacctgagctttcggcatg

SEQ ID NO: 58833 - DNA, 25 bp, Homo sapien
atgctcccacctcgttaaaggtgat

SEQ ID NO: 58834 - DNA, 25 bp, Homo sapien
tcgttaaaggtgatttccctctcaa

SEQ ID NO: 58835 - DNA, 25 bp, Homo sapien
ttgacctactccacatggagaggca

SEQ ID NO: 58836 - DNA, 25 bp, Homo sapien
gaggcaaccatgtctggaagtgact

SEQ ID NO: 58837 - DNA, 25 bp, Homo sapien
ggaagtgactatgcctgagtcccag

SEQ ID NO: 58838 - DNA, 25 bp, Homo sapien
gatgaagacagcagattccccacat

SEQ ID NO: 58839 - DNA, 25 bp, Homo sapien
attctcatctttggcctgttcaatg

SEQ ID NO: 58840 - DNA, 25 bp, Homo sapien
atgaaaccattgtttgcccatctct

SEQ ID NO: 58841 - DNA, 25 bp, Homo sapien
tgcccatctcttcttagtggaactt

SEQ ID NO: 58842 - DNA, 25 bp, Homo sapien
tagtggaactttaggtctcttttca

SEQ ID NO: 58843 - DNA, 25 bp, Homo sapien
tctcttttcaagtctcctcagtcat

SEQ ID NO: 58844 - DNA, 25 bp, Homo sapien
gtctcctcagtcatcaatagttcct

SEQ ID NO: 58845 - DNA, 25 bp, Homo sapien
ttgatgttgggtggcttttgttctt

SEQ ID NO: 58846 - DNA, 25 bp, Homo sapien
gggatgtaatactaataaccactac

SEQ ID NO: 58847 - DNA, 25 bp, Homo sapien
gtaatactaataaccactacctata

SEQ ID NO: 58848 - DNA, 25 bp, Homo sapien
aaataaagcacacaattgttccggt

SEQ ID NO: 58849 - DNA, 25 bp, Homo sapien
gcacacaattgttccggtgatttta

SEQ ID NO: 58850 - DNA, 25 bp, Homo sapien
attgttccggtgattttacaaatct

SEQ ID NO: 58851 - DNA, 25 bp, Homo sapien
ttccaggtgtaaagtctacaaaaat

SEQ ID NO: 58852 - DNA, 25 bp, Homo sapien
gtttgacatccaactttatagtatt

SEQ ID NO: 58853 - DNA, 25 bp, Homo sapien
gtatgttagtaaaactccacgtgtt

SEQ ID NO: 58854 - DNA, 25 bp, Homo sapien
gtaaaactccacgtgttgtaaccat

SEQ ID NO: 58855 - DNA, 25 bp, Homo sapien
aaactccacgtgttgtaaccattat

SEQ ID NO: 58856 - DNA, 25 bp, Homo sapien
ccacgtgttgtaaccattattatgt

SEQ ID NO: 58857 - DNA, 25 bp, Homo sapien
gggagcgaagcccatgttcgcttcc

SEQ ID NO: 58858 - DNA, 25 bp, Homo sapien
gaagcccatgttcgcttcctgactt

SEQ ID NO: 58859 - DNA, 25 bp, Homo sapien
atgttcgcttcctgacttagagctg

SEQ ID NO: 58860 - DNA, 25 bp, Homo sapien
gttcgcttcctgacttagagctggg

SEQ ID NO: 58861 - DNA, 25 bp, Homo sapien
ttgttcccctgcagtatctgttctg

SEQ ID NO: 58862 - DNA, 25 bp, Homo sapien
gttcccctgcagtatctgttctgtg

SEQ ID NO: 58863 - DNA, 25 bp, Homo sapien
tatttaacccttttgtgttctagat

SEQ ID NO: 58864 - DNA, 25 bp, Homo sapien
tgttctagatttacttacacacata

SEQ ID NO: 58865 - DNA, 25 bp, Homo sapien
tacacacatagcctagagctcagtt

SEQ ID NO: 58866 - DNA, 25 bp, Homo sapien
catagcctagagctcagttttagtt

SEQ ID NO: 58867 - DNA, 25 bp, Homo sapien
gcctagagctcagttttagttttaa

SEQ ID NO: 58868 - DNA, 25 bp, Homo sapien
aatacgaaaggccacgaattacatg

SEQ ID NO: 58869 - DNA, 25 bp, Homo sapien
ggccacgaattacatgattccattt

SEQ ID NO: 58870 - DNA, 25 bp, Homo sapien
catgattccatttttaggaagtgtc

SEQ ID NO: 58871 - DNA, 25 bp, Homo sapien
aggaagtgtccagaatatgcaaatc

SEQ ID NO: 58872 - DNA, 25 bp, Homo sapien
gaaagtacagactggtgactgctaa

SEQ ID NO: 58873 - DNA, 25 bp, Homo sapien
actggtgactgctaaggatgggaca

SEQ ID NO: 58874 - DNA, 25 bp, Homo sapien
gggaatgagcactagtcagtatacg

SEQ ID NO: 58875 - DNA, 25 bp, Homo sapien
gcactagtcagtatacggtttcttt

SEQ ID NO: 58876 - DNA, 25 bp, Homo sapien
ctagtcagtatacggtttctttttg

SEQ ID NO: 58877 - DNA, 25 bp, Homo sapien
aaaatgttctgtagtggtgatggtt

SEQ ID NO: 58878 - DNA, 25 bp, Homo sapien
ggttgcacaactgagtataataaaa

SEQ ID NO: 58879 - DNA, 25 bp, Homo sapien
atcatcactgcctacagccacgtgg

SEQ ID NO: 58880 - DNA, 25 bp, Homo sapien
gcagctgcagttctacgaatccgtt

SEQ ID NO: 58881 - DNA, 25 bp, Homo sapien
gaatccgttcagtggagggccgaaa

SEQ ID NO: 58882 - DNA, 25 bp, Homo sapien
cacctcaccgtggtttgtcttttct

SEQ ID NO: 58883 - DNA, 25 bp, Homo sapien
agaggtatcttcaactacatgagac

SEQ ID NO: 58884 - DNA, 25 bp, Homo sapien
tcaactacatgagactgggttcaga

SEQ ID NO: 58885 - DNA, 25 bp, Homo sapien
tgggttcagaggaggcttcagacaa

SEQ ID NO: 58886 - DNA, 25 bp, Homo sapien
gggttggagttttcaacactgttat

SEQ ID NO: 58887 - DNA, 25 bp, Homo sapien
caacactgttatcaaccctatgctg

SEQ ID NO: 58888 - DNA, 25 bp, Homo sapien
tgttatcaaccctatgctgaaccct

SEQ ID NO: 58889 - DNA, 25 bp, Homo sapien
gatgttcagggtgctctgtggcaaa

SEQ ID NO: 58890 - DNA, 25 bp, Homo sapien
tactgtcctcagaggcgtgctggtc

SEQ ID NO: 58891 - DNA, 25 bp, Homo sapien
agtgacatcaaagcctggcctaatt

SEQ ID NO: 58892 - DNA, 25 bp, Homo sapien
aaagcctggcctaattgttcctatt

SEQ ID NO: 58893 - DNA, 25 bp, Homo sapien
gcctggcctaattgttcctattggg

SEQ ID NO: 58894 - DNA, 25 bp, Homo sapien
ggcatgaggaggtcccacttgcaac

SEQ ID NO: 58895 - DNA, 25 bp, Homo sapien
aggaggtcccacttgcaacttcttt

SEQ ID NO: 58896 - DNA, 25 bp, Homo sapien
ttctgttgagagaacctcaggtacg

SEQ ID NO: 58897 - DNA, 25 bp, Homo sapien
gagaacctcaggtacggagaagaat

SEQ ID NO: 58898 - DNA, 25 bp, Homo sapien
aatagaggtcctcatgggtcccttg

SEQ ID NO: 58899 - DNA, 25 bp, Homo sapien
gaaaggagagacgtgcagcgcccct

SEQ ID NO: 58900 - DNA, 25 bp, Homo sapien
ctctgcacccttatcatgggatgtc

SEQ ID NO: 58901 - DNA, 25 bp, Homo sapien
cagaaggctggctgacatgcccagg

SEQ ID NO: 58902 - DNA, 25 bp, Homo sapien
agggctccactctcatctaatgtca

SEQ ID NO: 58903 - DNA, 25 bp, Homo sapien
tcatctaatgtcacagccctcagaa

SEQ ID NO: 58904 - DNA, 25 bp, Homo sapien
agccctcagaactaaagcggacttt

SEQ ID NO: 58905 - DNA, 25 bp, Homo sapien
ttcttatttagtcagcttgccatcc

SEQ ID NO: 58906 - DNA, 25 bp, Homo sapien
tcactagcagtgtagatcattccag

SEQ ID NO: 58907 - DNA, 25 bp, Homo sapien
tcagcaacctctgagtgtggacaat

SEQ ID NO: 58908 - DNA, 25 bp, Homo sapien
gagtgtggacaatagctgctttctt

SEQ ID NO: 58909 - DNA, 25 bp, Homo sapien
ttctctatccaagagcaccaggctg

SEQ ID NO: 58910 - DNA, 25 bp, Homo sapien
accaggctgtgcttgggtccttgct

SEQ ID NO: 58911 - DNA, 25 bp, Homo sapien
gggtccttgctctcagagtctataa

SEQ ID NO: 58912 - DNA, 25 bp, Homo sapien
gagaatgatgctttcgaagacggag

SEQ ID NO: 58913 - DNA, 25 bp, Homo sapien
aagacggaggcaggcagtccttgat

SEQ ID NO: 58914 - DNA, 25 bp, Homo sapien
acaagtgactctgaccagcaggctt

SEQ ID NO: 58915 - DNA, 25 bp, Homo sapien
accagcaggcttaccttgttcaaag

SEQ ID NO: 58916 - DNA, 25 bp, Homo sapien
ggactggcggcaacagcggaatatt

SEQ ID NO: 58917 - DNA, 25 bp, Homo sapien
ggaatattccgattcattcctgccc

SEQ ID NO: 58918 - DNA, 25 bp, Homo sapien
attcctgccccaagtgtggagaggt

SEQ ID NO: 58919 - DNA, 25 bp, Homo sapien
gaggttctgcctgacatagacacgt

SEQ ID NO: 58920 - DNA, 25 bp, Homo sapien
acagattcacgtgatggattgcatc

SEQ ID NO: 58921 - DNA, 25 bp, Homo sapien
taagtgttgatgtatcacctcccca

SEQ ID NO: 58922 - DNA, 25 bp, Homo sapien
tatcacctccccaaaactgttggta

SEQ ID NO: 58923 - DNA, 25 bp, Homo sapien
accacaccaggccagagctatattt

SEQ ID NO: 58924 - DNA, 25 bp, Homo sapien
agagctatatttccaaaggctgctg

SEQ ID NO: 58925 - DNA, 25 bp, Homo sapien
ggcacactcctcatcaattctcagg

SEQ ID NO: 58926 - DNA, 25 bp, Homo sapien
gctgcagggacaaactttccgatag

SEQ ID NO: 58927 - DNA, 25 bp, Homo sapien
aaactttccgatagggctcagtagg

SEQ ID NO: 58928 - DNA, 25 bp, Homo sapien
gctcagtaggatcaagccgacccag

SEQ ID NO: 58929 - DNA, 25 bp, Homo sapien
taggatcaagccgacccagagtggg

SEQ ID NO: 58930 - DNA, 25 bp, Homo sapien
cccagagtgggcatgggatgctcca

SEQ ID NO: 58931 - DNA, 25 bp, Homo sapien
atgaagctcttgtgctcatgtatat

SEQ ID NO: 58932 - DNA, 25 bp, Homo sapien
gtgctcatgtatattatgaccttct

SEQ ID NO: 58933 - DNA, 25 bp, Homo sapien
atattatgaccttctgtgtttttgt

SEQ ID NO: 58934 - DNA, 25 bp, Homo sapien
atcgtattaaaaatggcaggagacc

SEQ ID NO: 58935 - DNA, 25 bp, Homo sapien
gcaggagaccaagtagcaaatgttc

SEQ ID NO: 58936 - DNA, 25 bp, Homo sapien
agcaaatgttcgcttcaatgtggcc

SEQ ID NO: 58937 - DNA, 25 bp, Homo sapien
tctctacaaaagattggaccaattc

SEQ ID NO: 58938 - DNA, 25 bp, Homo sapien
ggaccaattctagataccaatgctt

SEQ ID NO: 58939 - DNA, 25 bp, Homo sapien
agataccaatgctttacagggagaa

SEQ ID NO: 58940 - DNA, 25 bp, Homo sapien
cagggagaagtgaagccagtactac

SEQ ID NO: 58941 - DNA, 25 bp, Homo sapien
aagtgaagccagtactacagaagtt

SEQ ID NO: 58942 - DNA, 25 bp, Homo sapien
agccagtactacagaagttaggtca

SEQ ID NO: 58943 - DNA, 25 bp, Homo sapien
gacatggatgtcaaatactttgcac

SEQ ID NO: 58944 - DNA, 25 bp, Homo sapien
tactttgcacaggaagctataagtg

SEQ ID NO: 58945 - DNA, 25 bp, Homo sapien
gctaatgagaaaagggcactccgga

SEQ ID NO: 58946 - DNA, 25 bp, Homo sapien
gaggaaggccctggagtttgtaact

SEQ ID NO: 58947 - DNA, 25 bp, Homo sapien
ggccctggagtttgtaactaatcct

SEQ ID NO: 58948 - DNA, 25 bp, Homo sapien
actaatcctgatattgctgccaaga

SEQ ID NO: 58949 - DNA, 25 bp, Homo sapien
gaaagatagagttcctgcgtccagg

SEQ ID NO: 58950 - DNA, 25 bp, Homo sapien
ctgcgtccaggatataaggccaaga

SEQ ID NO: 58951 - DNA, 25 bp, Homo sapien
agccatagcctgaaagatttagcaa

SEQ ID NO: 58952 - DNA, 25 bp, Homo sapien
tggtggagtaatgtctccctgtgct

SEQ ID NO: 58953 - DNA, 25 bp, Homo sapien
gtctccctgtgctgatacaagcatg

SEQ ID NO: 58954 - DNA, 25 bp, Homo sapien
tggaatattctgctagtctgaaatt

SEQ ID NO: 58955 - DNA, 25 bp, Homo sapien
gtctgaaattacagcaggttgtctg

SEQ ID NO: 58956 - DNA, 25 bp, Homo sapien
tgaccatcgaggcttctaccggaag

SEQ ID NO: 58957 - DNA, 25 bp, Homo sapien
aggcttctaccggaagcggcagtgc

SEQ ID NO: 58958 - DNA, 25 bp, Homo sapien
gtgtggatcggatgggcaagtccct

SEQ ID NO: 58959 - DNA, 25 bp, Homo sapien
gatggcaatggaagctcctcctgcc

SEQ ID NO: 58960 - DNA, 25 bp, Homo sapien
tgccccactgggagtagcggctaaa

SEQ ID NO: 58961 - DNA, 25 bp, Homo sapien
ctgcagggccactggaaggaacatg

SEQ ID NO: 58962 - DNA, 25 bp, Homo sapien
catggagctgtcatcactcaacaaa

SEQ ID NO: 58963 - DNA, 25 bp, Homo sapien
ggagctgtcatcactcaacaaaaaa

SEQ ID NO: 58964 - DNA, 25 bp, Homo sapien
tcactcaacaaaaaaccgaggccct

SEQ ID NO: 58965 - DNA, 25 bp, Homo sapien
ggcccctcaccgctggttggaaaga

SEQ ID NO: 58966 - DNA, 25 bp, Homo sapien
ctcaccgctggttggaaagagtgtt

SEQ ID NO: 58967 - DNA, 25 bp, Homo sapien
actgctatcaccttctatcagatgc

SEQ ID NO: 58968 - DNA, 25 bp, Homo sapien
atcagatgcaaatgcctatgccaag

SEQ ID NO: 58969 - DNA, 25 bp, Homo sapien
gcctatgccaaggacagtacctgaa

SEQ ID NO: 58970 - DNA, 25 bp, Homo sapien
agacctaccatcactcctgattaat

SEQ ID NO: 58971 - DNA, 25 bp, Homo sapien
ggccagttttggttaaagctctaag

SEQ ID NO: 58972 - DNA, 25 bp, Homo sapien
gttctcattactattgtccaggtat

SEQ ID NO: 58973 - DNA, 25 bp, Homo sapien
gtccaggtattagacttaggattac

SEQ ID NO: 58974 - DNA, 25 bp, Homo sapien
aattaagcacatactacaccctaaa

SEQ ID NO: 58975 - DNA, 25 bp, Homo sapien
aaagcatatataagtctgacaccaa

SEQ ID NO: 58976 - DNA, 25 bp, Homo sapien
aattctgcaagtatctgtgggccta

SEQ ID NO: 58977 - DNA, 25 bp, Homo sapien
gtatctgtgggcctactatgcataa

SEQ ID NO: 58978 - DNA, 25 bp, Homo sapien
gttaagtgatcagtacgtgggttta

SEQ ID NO: 58979 - DNA, 25 bp, Homo sapien
atcagtacgtgggtttattacacta

SEQ ID NO: 58980 - DNA, 25 bp, Homo sapien
gtttattacactattcttttcacat

SEQ ID NO: 58981 - DNA, 25 bp, Homo sapien
tcacatttgctttgaaactgttcat

SEQ ID NO: 58982 - DNA, 25 bp, Homo sapien
aactgttcataaaaatttccataat

SEQ ID NO: 58983 - DNA, 25 bp, Homo sapien
gcttcactagacatggtatgtagca

SEQ ID NO: 58984 - DNA, 25 bp, Homo sapien
gtatgtagcatgtagtgcacaagct

SEQ ID NO: 58985 - DNA, 25 bp, Homo sapien
gcatgtagtgcacaagctgatttta

SEQ ID NO: 58986 - DNA, 25 bp, Homo sapien
tgtagtgcacaagctgattttaagt

SEQ ID NO: 58987 - DNA, 25 bp, Homo sapien
tattcagatggccttttaaatttaa

SEQ ID NO: 58988 - DNA, 25 bp, Homo sapien
aagtgatatgaactgtgataatgca

SEQ ID NO: 58989 - DNA, 25 bp, Homo sapien
ttttttacctccttgtttgcacaat

SEQ ID NO: 58990 - DNA, 25 bp, Homo sapien
ttacctccttgtttgcacaatttgg

SEQ ID NO: 58991 - DNA, 25 bp, Homo sapien
tgtttgcacaatttgggccactcac

SEQ ID NO: 58992 - DNA, 25 bp, Homo sapien
cacaatttgggccactcacaagagt

SEQ ID NO: 58993 - DNA, 25 bp, Homo sapien
cactcacaagagtgtataccctgtg

SEQ ID NO: 58994 - DNA, 25 bp, Homo sapien
gtataccctgtgataaacagttacc

SEQ ID NO: 58995 - DNA, 25 bp, Homo sapien
gataaacagttacctacattctcct

SEQ ID NO: 58996 - DNA, 25 bp, Homo sapien
agttacctacattctcctctgcatg

SEQ ID NO: 58997 - DNA, 25 bp, Homo sapien
tctgcatgcttgtctttagaggaag

SEQ ID NO: 58998 - DNA, 25 bp, Homo sapien
ggaaatgtattaattgcccaaagta

SEQ ID NO: 58999 - DNA, 25 bp, Homo sapien
aaagtgtatattgacatttctggaa

SEQ ID NO: 59000 - DNA, 25 bp, Homo sapien
ggctgatgaacaagccaatgctcat

SEQ ID NO: 59001 - DNA, 25 bp, Homo sapien
aatgctcatctcaccaaattccgga

SEQ ID NO: 59002 - DNA, 25 bp, Homo sapien
caaattccggaaagctcagcatgag

SEQ ID NO: 59003 - DNA, 25 bp, Homo sapien
tgcggatatcgcagaatctcaagtc

SEQ ID NO: 59004 - DNA, 25 bp, Homo sapien
gaatctcaagtcaacaagctccgcg

SEQ ID NO: 59005 - DNA, 25 bp, Homo sapien
aagctccgcgctaagactcgagact

SEQ ID NO: 59006 - DNA, 25 bp, Homo sapien
gagacttcacctccagcaggatggt

SEQ ID NO: 59007 - DNA, 25 bp, Homo sapien
tgagccagcccttctggagcaggag

SEQ ID NO: 59008 - DNA, 25 bp, Homo sapien
gtatattttcttgattcctgaccat

SEQ ID NO: 59009 - DNA, 25 bp, Homo sapien
tgattcctgaccattgatacttaat

SEQ ID NO: 59010 - DNA, 25 bp, Homo sapien
gatacttaatgtccatgtgactctt

SEQ ID NO: 59011 - DNA, 25 bp, Homo sapien
atgaattactttgttacatgcccat

SEQ ID NO: 59012 - DNA, 25 bp, Homo sapien
tacatgcccattagtggcctcctta

SEQ ID NO: 59013 - DNA, 25 bp, Homo sapien
tagtggcctccttaagagttcatcc

SEQ ID NO: 59014 - DNA, 25 bp, Homo sapien
aagagttcatccttcctagattaaa

SEQ ID NO: 59015 - DNA, 25 bp, Homo sapien
ggtctaagttgtgactattcttctt

SEQ ID NO: 59016 - DNA, 25 bp, Homo sapien
agtagtatccagacattcagctcat

SEQ ID NO: 59017 - DNA, 25 bp, Homo sapien
gacattcagctcatagctttctgag

SEQ ID NO: 59018 - DNA, 25 bp, Homo sapien
agcttctgtagccaaatatccttca

SEQ ID NO: 59019 - DNA, 25 bp, Homo sapien
aaactgccatctccatatgaaagta

SEQ ID NO: 59020 - DNA, 25 bp, Homo sapien
gaaacaggacttttttgcatatcat

SEQ ID NO: 59021 - DNA, 25 bp, Homo sapien
aaaatagggtttgcctgggtgcgat

SEQ ID NO: 59022 - DNA, 25 bp, Homo sapien
aatgaactaactgacagcttcatga

SEQ ID NO: 59023 - DNA, 25 bp, Homo sapien
aactgtccaccaagatcaagcagag

SEQ ID NO: 59024 - DNA, 25 bp, Homo sapien
gaactaatgaggattgctgattctt

SEQ ID NO: 59025 - DNA, 25 bp, Homo sapien
ttctttaaatgtcttgtttcccaga

SEQ ID NO: 59026 - DNA, 25 bp, Homo sapien
tgtcttgtttcccagatttcaggaa

SEQ ID NO: 59027 - DNA, 25 bp, Homo sapien
ttaagctatccactcttacagcaat

SEQ ID NO: 59028 - DNA, 25 bp, Homo sapien
tccactcttacagcaatttgataaa

SEQ ID NO: 59029 - DNA, 25 bp, Homo sapien
tacattttctccctatgtggtcgct

SEQ ID NO: 59030 - DNA, 25 bp, Homo sapien
atgtggtcgctccagacttgggaaa

SEQ ID NO: 59031 - DNA, 25 bp, Homo sapien
gtcgctccagacttgggaaactatt

SEQ ID NO: 59032 - DNA, 25 bp, Homo sapien
ggtaatatagttattgcacaagttc

SEQ ID NO: 59033 - DNA, 25 bp, Homo sapien
tcttccagcaggcactggttttgtt

SEQ ID NO: 59034 - DNA, 25 bp, Homo sapien
tccagcaggcactggttttgttgcc

SEQ ID NO: 59035 - DNA, 25 bp, Homo sapien
gttttgttgccccagggctgctttg

SEQ ID NO: 59036 - DNA, 25 bp, Homo sapien
gctgtgatgatgattgcatttcaac

SEQ ID NO: 59037 - DNA, 25 bp, Homo sapien
gcatttcaacacatgccagatgcag

SEQ ID NO: 59038 - DNA, 25 bp, Homo sapien
aacacatgccagatgcagatttttt

SEQ ID NO: 59039 - DNA, 25 bp, Homo sapien
cccttactgtttcaatgacctttat

SEQ ID NO: 59040 - DNA, 25 bp, Homo sapien
tactgtttcaatgacctttatttta

SEQ ID NO: 59041 - DNA, 25 bp, Homo sapien
actgatattagtttggatgtgccac

SEQ ID NO: 59042 - DNA, 25 bp, Homo sapien
ttagtttggatgtgccacttttggc

SEQ ID NO: 59043 - DNA, 25 bp, Homo sapien
gatgtgccacttttggcaccaaacg

SEQ ID NO: 59044 - DNA, 25 bp, Homo sapien
ctttattctctccatgtggcaacat

SEQ ID NO: 59045 - DNA, 25 bp, Homo sapien
attctgtcagcctctttcatagtgt

SEQ ID NO: 59046 - DNA, 25 bp, Homo sapien
gtcagcctctttcatagtgtgcaaa

SEQ ID NO: 59047 - DNA, 25 bp, Homo sapien
gcctctttcatagtgtgcaaacatt

SEQ ID NO: 59048 - DNA, 25 bp, Homo sapien
tttcatagtgtgcaaacattttatc

SEQ ID NO: 59049 - DNA, 25 bp, Homo sapien
atcattctaaatggtgactctctgc

SEQ ID NO: 59050 - DNA, 25 bp, Homo sapien
attctaaatggtgactctctgccct

SEQ ID NO: 59051 - DNA, 25 bp, Homo sapien
taaatggtgactctctgcccttgga

SEQ ID NO: 59052 - DNA, 25 bp, Homo sapien
tctgcccttggacccatttattatt

SEQ ID NO: 59053 - DNA, 25 bp, Homo sapien
ccttggacccatttattattcacag

SEQ ID NO: 59054 - DNA, 25 bp, Homo sapien
tggacccatttattattcacagatg

SEQ ID NO: 59055 - DNA, 25 bp, Homo sapien
aactgccagttggagaacggttcct

SEQ ID NO: 59056 - DNA, 25 bp, Homo sapien
tcctgggaggtgtttggcatcgtca

SEQ ID NO: 59057 - DNA, 25 bp, Homo sapien
gaggtgtttggcatcgtcagctttg

SEQ ID NO: 59058 - DNA, 25 bp, Homo sapien
tgtttggcatcgtcagctttggctc

SEQ ID NO: 59059 - DNA, 25 bp, Homo sapien
atcgtcagctttggctcccggcggg

SEQ ID NO: 59060 - DNA, 25 bp, Homo sapien
ctgcaacacccgcaagaagccggta

SEQ ID NO: 59061 - DNA, 25 bp, Homo sapien
gcaagaagccggtagtctacacccg

SEQ ID NO: 59062 - DNA, 25 bp, Homo sapien
gggtgtccgcctacatcgactggat

SEQ ID NO: 59063 - DNA, 25 bp, Homo sapien
catcgactggatcaacgagaaaatg

SEQ ID NO: 59064 - DNA, 25 bp, Homo sapien
atgcagctgtgatttgttgctggga

SEQ ID NO: 59065 - DNA, 25 bp, Homo sapien
tgatttgttgctgggagcggcggca

SEQ ID NO: 59066 - DNA, 25 bp, Homo sapien
gtgaccttagtgatgcagagttcct

SEQ ID NO: 59067 - DNA, 25 bp, Homo sapien
agagttcctgagtggtgtttgtaga

SEQ ID NO: 59068 - DNA, 25 bp, Homo sapien
atcatacattctttctactactgga

SEQ ID NO: 59069 - DNA, 25 bp, Homo sapien
gtctggactgttgtaaccttaggtt

SEQ ID NO: 59070 - DNA, 25 bp, Homo sapien
aaccttaggttgtaatctgatttgg

SEQ ID NO: 59071 - DNA, 25 bp, Homo sapien
agtacatctttaaaagttgctacag

SEQ ID NO: 59072 - DNA, 25 bp, Homo sapien
gttgctacagatttgagttcatgat

SEQ ID NO: 59073 - DNA, 25 bp, Homo sapien
gttatataacagaagccatcctgaa

SEQ ID NO: 59074 - DNA, 25 bp, Homo sapien
gccatcctgaaatgaaactagtcta

SEQ ID NO: 59075 - DNA, 25 bp, Homo sapien
aattcattgttctacttagttgcag

SEQ ID NO: 59076 - DNA, 25 bp, Homo sapien
acttagttgcagctgtacctgaaat

SEQ ID NO: 59077 - DNA, 25 bp, Homo sapien
gtgtgggccttgcaaaatgatcaag

SEQ ID NO: 59078 - DNA, 25 bp, Homo sapien
tgggccttgcaaaatgatcaagcct

SEQ ID NO: 59079 - DNA, 25 bp, Homo sapien
ccttggacgctgcaggtgataaact

SEQ ID NO: 59080 - DNA, 25 bp, Homo sapien
ttggacgctgcaggtgataaacttg

SEQ ID NO: 59081 - DNA, 25 bp, Homo sapien
ggacgctgcaggtgataaacttgta

SEQ ID NO: 59082 - DNA, 25 bp, Homo sapien
cgctgcaggtgataaacttgtagta

SEQ ID NO: 59083 - DNA, 25 bp, Homo sapien
acttgtagtagttgacttctcagcc

SEQ ID NO: 59084 - DNA, 25 bp, Homo sapien
ttgtagtagttgacttctcagccac

SEQ ID NO: 59085 - DNA, 25 bp, Homo sapien
gtagtagttgacttctcagccacgt

SEQ ID NO: 59086 - DNA, 25 bp, Homo sapien
agtagttgacttctcagccacgtgg

SEQ ID NO: 59087 - DNA, 25 bp, Homo sapien
tagttgacttctcagccacgtggtg

SEQ ID NO: 59088 - DNA, 25 bp, Homo sapien
ctgtggtcaggaaataactactaag

SEQ ID NO: 59089 - DNA, 25 bp, Homo sapien
ggtcaggaaataactactaagcaaa

SEQ ID NO: 59090 - DNA, 25 bp, Homo sapien
taagcaaatgctgcccatcgtatta

SEQ ID NO: 59091 - DNA, 25 bp, Homo sapien
gcaaatgctgcccatcgtattaaaa

SEQ ID NO: 59092 - DNA, 25 bp, Homo sapien
aaatgctgcccatcgtattaaaaat

SEQ ID NO: 59093 - DNA, 25 bp, Homo sapien
aagtgttcttgcattggcataatga

SEQ ID NO: 59094 - DNA, 25 bp, Homo sapien
tcttgcattggcataatgaggagca

SEQ ID NO: 59095 - DNA, 25 bp, Homo sapien
ggaaaaggcctttactagattcttg

SEQ ID NO: 59096 - DNA, 25 bp, Homo sapien
aaggcctttactagattcttgtcac

SEQ ID NO: 59097 - DNA, 25 bp, Homo sapien
ggcctttactagattcttgtcacaa

SEQ ID NO: 59098 - DNA, 25 bp, Homo sapien
actagattcttgtcacaaatttcta

SEQ ID NO: 59099 - DNA, 25 bp, Homo sapien
gccctgggctcctagcgctcgaaag

SEQ ID NO: 59100 - DNA, 25 bp, Homo sapien
gggctcctagcgctcgaaagcccaa

SEQ ID NO: 59101 - DNA, 25 bp, Homo sapien
gcctcttccctctcgaagcaataaa

SEQ ID NO: 59102 - DNA, 25 bp, Homo sapien
tctcgaagcaataaacccaggctgg

SEQ ID NO: 59103 - DNA, 25 bp, Homo sapien
aagcaataaacccaggctggccggc

SEQ ID NO: 59104 - DNA, 25 bp, Homo sapien
gaagccctcgccgagcaattctgta

SEQ ID NO: 59105 - DNA, 25 bp, Homo sapien
gccctcgccgagcaattctgtatgg

SEQ ID NO: 59106 - DNA, 25 bp, Homo sapien
gccgagcaattctgtatggcttcta

SEQ ID NO: 59107 - DNA, 25 bp, Homo sapien
gagcaattctgtatggcttctatat

SEQ ID NO: 59108 - DNA, 25 bp, Homo sapien
tctgtatggcttctatataaatatt

SEQ ID NO: 59109 - DNA, 25 bp, Homo sapien
tatttaaacctatatagcgggttct

SEQ ID NO: 59110 - DNA, 25 bp, Homo sapien
atagcagcagtagtggcttctccat

SEQ ID NO: 59111 - DNA, 25 bp, Homo sapien
ctatacaaaactgtgctgtgacctt

SEQ ID NO: 59112 - DNA, 25 bp, Homo sapien
tgtgctgtgaccttgcggtaggcct

SEQ ID NO: 59113 - DNA, 25 bp, Homo sapien
gtgaccttgcggtaggcctggatct

SEQ ID NO: 59114 - DNA, 25 bp, Homo sapien
ttgcggtaggcctggatctggcaaa

SEQ ID NO: 59115 - DNA, 25 bp, Homo sapien
cctggatctggcaaagagaatacaa

SEQ ID NO: 59116 - DNA, 25 bp, Homo sapien
ttctttctctttccgtccaacaact

SEQ ID NO: 59117 - DNA, 25 bp, Homo sapien
tttccgtccaacaactctgtagagc

SEQ ID NO: 59118 - DNA, 25 bp, Homo sapien
aacaactctgtagagctctctgcac

SEQ ID NO: 59119 - DNA, 25 bp, Homo sapien
gaagctggatgcaagatagatacta

SEQ ID NO: 59120 - DNA, 25 bp, Homo sapien
gatactatattaaactgtactgtta

SEQ ID NO: 59121 - DNA, 25 bp, Homo sapien
gtcaccatgggcttttttgtggtca

SEQ ID NO: 59122 - DNA, 25 bp, Homo sapien
agaatgtcaatgctttggcctgccg

SEQ ID NO: 59123 - DNA, 25 bp, Homo sapien
tggcctgccgctaccgataagctat

SEQ ID NO: 59124 - DNA, 25 bp, Homo sapien
accgataagctatcctcacactcat

SEQ ID NO: 59125 - DNA, 25 bp, Homo sapien
acactcatggctaccagtgggcctg

SEQ ID NO: 59126 - DNA, 25 bp, Homo sapien
tccactccagtagtatcctctgttt

SEQ ID NO: 59127 - DNA, 25 bp, Homo sapien
gtatcctctgttttcagacatccta

SEQ ID NO: 59128 - DNA, 25 bp, Homo sapien
atcctgctggaatcaacacagactt

SEQ ID NO: 59129 - DNA, 25 bp, Homo sapien
caacacagacttgctctccaaagag

SEQ ID NO: 59130 - DNA, 25 bp, Homo sapien
atgtcatagcgtgatcttagcctag

SEQ ID NO: 59131 - DNA, 25 bp, Homo sapien
cttagcctaggtaggccacatccat

SEQ ID NO: 59132 - DNA, 25 bp, Homo sapien
taattttcattgcttccggaaggcc

SEQ ID NO: 59133 - DNA, 25 bp, Homo sapien
ttgcttccggaaggccattcatgaa

SEQ ID NO: 59134 - DNA, 25 bp, Homo sapien
ggaaggccattcatgaagtttttga

SEQ ID NO: 59135 - DNA, 25 bp, Homo sapien
gaaaggttcagaatcggctgcagaa

SEQ ID NO: 59136 - DNA, 25 bp, Homo sapien
taatgggacccctagagtgctgctg

SEQ ID NO: 59137 - DNA, 25 bp, Homo sapien
acccctagagtgctgctgtaggtga

SEQ ID NO: 59138 - DNA, 25 bp, Homo sapien
gtgaggtttcaggaatgtcttttga

SEQ ID NO: 59139 - DNA, 25 bp, Homo sapien
aatcagaccttatccatgaggctgc

SEQ ID NO: 59140 - DNA, 25 bp, Homo sapien
ttatccatgaggctgctgcgccatg

SEQ ID NO: 59141 - DNA, 25 bp, Homo sapien
tgctgcgccatgttgcactaaagga

SEQ ID NO: 59142 - DNA, 25 bp, Homo sapien
attgggacacataccattgatttgt

SEQ ID NO: 59143 - DNA, 25 bp, Homo sapien
ttttttctggaagtgatatatgtca

SEQ ID NO: 59144 - DNA, 25 bp, Homo sapien
tttctggaagtgatatatgtcaaat

SEQ ID NO: 59145 - DNA, 25 bp, Homo sapien
caaattacatttcctactgcagtat

SEQ ID NO: 59146 - DNA, 25 bp, Homo sapien
aattacatttcctactgcagtattt

SEQ ID NO: 59147 - DNA, 25 bp, Homo sapien
ttacatttcctactgcagtatttga

SEQ ID NO: 59148 - DNA, 25 bp, Homo sapien
acatttcctactgcagtatttgagc

SEQ ID NO: 59149 - DNA, 25 bp, Homo sapien
catttcctactgcagtatttgagca

SEQ ID NO: 59150 - DNA, 25 bp, Homo sapien
tttcctactgcagtatttgagcagg

SEQ ID NO: 59151 - DNA, 25 bp, Homo sapien
cctactgcagtatttgagcagggac

SEQ ID NO: 59152 - DNA, 25 bp, Homo sapien
gcagtatttgagcagggacagtcat

SEQ ID NO: 59153 - DNA, 25 bp, Homo sapien
agtatttgagcagggacagtcattt

SEQ ID NO: 59154 - DNA, 25 bp, Homo sapien
gatgcattactctcccaaatcttag

SEQ ID NO: 59155 - DNA, 25 bp, Homo sapien
agggatgattatgttccatttttgt

SEQ ID NO: 59156 - DNA, 25 bp, Homo sapien
gtttggtgagttcccatctttgtat

SEQ ID NO: 59157 - DNA, 25 bp, Homo sapien
atctttgtatgtacctccttgctcc

SEQ ID NO: 59158 - DNA, 25 bp, Homo sapien
ctcctcttccctagtgagtggttaa

SEQ ID NO: 59159 - DNA, 25 bp, Homo sapien
gtgttaatgcctaaaccatacttgt

SEQ ID NO: 59160 - DNA, 25 bp, Homo sapien
tggacacttctataatggattcgtt

SEQ ID NO: 59161 - DNA, 25 bp, Homo sapien
aatggattcgttgcataattttcat

SEQ ID NO: 59162 - DNA, 25 bp, Homo sapien
gttggaaattcttggaggactctta

SEQ ID NO: 59163 - DNA, 25 bp, Homo sapien
ggaggactcttagctgtctgatgaa

SEQ ID NO: 59164 - DNA, 25 bp, Homo sapien
agctgtctgatgaaattcctagtag

SEQ ID NO: 59165 - DNA, 25 bp, Homo sapien
aaagtcttttgtattgggtcaggag

SEQ ID NO: 59166 - DNA, 25 bp, Homo sapien
ggtgcccagatgtgcgctattagat

SEQ ID NO: 59167 - DNA, 25 bp, Homo sapien
gtgcgctattagatgtttctctgat

SEQ ID NO: 59168 - DNA, 25 bp, Homo sapien
tttctctgataatgtccccaatcat

SEQ ID NO: 59169 - DNA, 25 bp, Homo sapien
taatgtccccaatcataccagggag

SEQ ID NO: 59170 - DNA, 25 bp, Homo sapien
agggagactggcattgacgagaact

SEQ ID NO: 59171 - DNA, 25 bp, Homo sapien
attgacgagaactcaggtggaggct

SEQ ID NO: 59172 - DNA, 25 bp, Homo sapien
tcagctttgcaaagagccaccctag

SEQ ID NO: 59173 - DNA, 25 bp, Homo sapien
taggccccagctgaccgcatgggtg

SEQ ID NO: 59174 - DNA, 25 bp, Homo sapien
accgcatgggtgtgagccagcttga

SEQ ID NO: 59175 - DNA, 25 bp, Homo sapien
gagccagcttgagaacactaactac

SEQ ID NO: 59176 - DNA, 25 bp, Homo sapien
gtggaactcgtgtctggcacagcct

SEQ ID NO: 59177 - DNA, 25 bp, Homo sapien
acagcctggctgtggcctaacctgc

SEQ ID NO: 59178 - DNA, 25 bp, Homo sapien
ggctgtggcctaacctgccgagagt

SEQ ID NO: 59179 - DNA, 25 bp, Homo sapien
gtggcctaacctgccgagagtccat

SEQ ID NO: 59180 - DNA, 25 bp, Homo sapien
tcgagatcccaacactgccagcatt

SEQ ID NO: 59181 - DNA, 25 bp, Homo sapien
gagatcccaacactgccagcatttc

SEQ ID NO: 59182 - DNA, 25 bp, Homo sapien
tctgcccgggagctcaggaaccgag

SEQ ID NO: 59183 - DNA, 25 bp, Homo sapien
aggatcccatgagctccttaaggct

SEQ ID NO: 59184 - DNA, 25 bp, Homo sapien
atgagctccttaaggctcttttgta

SEQ ID NO: 59185 - DNA, 25 bp, Homo sapien
gctccttaaggctcttttgtaaggt

SEQ ID NO: 59186 - DNA, 25 bp, Homo sapien
ttgtagtgatttttatgccacctga

SEQ ID NO: 59187 - DNA, 25 bp, Homo sapien
gtggatgttactccaaaacttcgtt

SEQ ID NO: 59188 - DNA, 25 bp, Homo sapien
caaattttatctgcctctcttgtaa

SEQ ID NO: 59189 - DNA, 25 bp, Homo sapien
ctgcctctcttgtaatttggatctc

SEQ ID NO: 59190 - DNA, 25 bp, Homo sapien
ggatctcttcttaatgtacatagtg

SEQ ID NO: 59191 - DNA, 25 bp, Homo sapien
atagtgctaacatgaagaccttttt

SEQ ID NO: 59192 - DNA, 25 bp, Homo sapien
gaagacctttttctgcactatatgc

SEQ ID NO: 59193 - DNA, 25 bp, Homo sapien
gcactatatgcaaacagggtaacta

SEQ ID NO: 59194 - DNA, 25 bp, Homo sapien
aaagccactttcaatcttcaatcct

SEQ ID NO: 59195 - DNA, 25 bp, Homo sapien
caatccttgaaggtatatctaggtt

SEQ ID NO: 59196 - DNA, 25 bp, Homo sapien
acattttatggtgcctagtattgac

SEQ ID NO: 59197 - DNA, 25 bp, Homo sapien
atggtgcctagtattgacaaaatgt

SEQ ID NO: 59198 - DNA, 25 bp, Homo sapien
taaccaacatttgcatctcctatct

SEQ ID NO: 59199 - DNA, 25 bp, Homo sapien
catctcctatctagccaagtatcta

SEQ ID NO: 59200 - DNA, 25 bp, Homo sapien
ggaaccttgccacctaaattagatg

SEQ ID NO: 59201 - DNA, 25 bp, Homo sapien
atttgatgctgttgttgcaagacac

SEQ ID NO: 59202 - DNA, 25 bp, Homo sapien
gaacttgcacttgtgaagccacgac

SEQ ID NO: 59203 - DNA, 25 bp, Homo sapien
gtgaagccacgacagagcatgaccc

SEQ ID NO: 59204 - DNA, 25 bp, Homo sapien
cctcagctcaactttcaccaataaa

SEQ ID NO: 59205 - DNA, 25 bp, Homo sapien
tttcaccaataaagaggccttcctt

SEQ ID NO: 59206 - DNA, 25 bp, Homo sapien
aggccttccttgatgttgattccag

SEQ ID NO: 59207 - DNA, 25 bp, Homo sapien
ttgattccagtccagaagggtctgg

SEQ ID NO: 59208 - DNA, 25 bp, Homo sapien
gataatttacagtgaccccatctaa

SEQ ID NO: 59209 - DNA, 25 bp, Homo sapien
gacctggtttgagatagaagagcat

SEQ ID NO: 59210 - DNA, 25 bp, Homo sapien
gagcattttgtccttttgatagtta

SEQ ID NO: 59211 - DNA, 25 bp, Homo sapien
aaattgaaccagagttttcttatgt

SEQ ID NO: 59212 - DNA, 25 bp, Homo sapien
acaggattttgtgggtattggttga

SEQ ID NO: 59213 - DNA, 25 bp, Homo sapien
tatttgtaaaccattccctagccta

SEQ ID NO: 59214 - DNA, 25 bp, Homo sapien
aaccattccctagcctacatattta

SEQ ID NO: 59215 - DNA, 25 bp, Homo sapien
taactttcctgataaccattgcata

SEQ ID NO: 59216 - DNA, 25 bp, Homo sapien
accattgcataattacatttttcta

SEQ ID NO: 59217 - DNA, 25 bp, Homo sapien
agagatactgtgtctttattgtgtg

SEQ ID NO: 59218 - DNA, 25 bp, Homo sapien
agtgcaggtgtgtgtctttattata

SEQ ID NO: 59219 - DNA, 25 bp, Homo sapien
aaaagctgtcactcagacctggttt

SEQ ID NO: 59220 - DNA, 25 bp, Homo sapien
tcccttcgcaaactatatttcttgg

SEQ ID NO: 59221 - DNA, 25 bp, Homo sapien
gcaaactatatttcttggaacgcga

SEQ ID NO: 59222 - DNA, 25 bp, Homo sapien
ttcttggaacgcgaaaggaagcttt

SEQ ID NO: 59223 - DNA, 25 bp, Homo sapien
aaggaagctttacctatttcataga

SEQ ID NO: 59224 - DNA, 25 bp, Homo sapien
ataacctcagaaggcaatattattg

SEQ ID NO: 59225 - DNA, 25 bp, Homo sapien
ggaagttcttagattcttggatgac

SEQ ID NO: 59226 - DNA, 25 bp, Homo sapien
gattcttggatgacagatgcatgtt

SEQ ID NO: 59227 - DNA, 25 bp, Homo sapien
gacagatgcatgttgatgccctatg

SEQ ID NO: 59228 - DNA, 25 bp, Homo sapien
gttgatgccctatggagatgtcctt

SEQ ID NO: 59229 - DNA, 25 bp, Homo sapien
gatgtccttgtgttttgaggtcact

SEQ ID NO: 59230 - DNA, 25 bp, Homo sapien
ggtaggaagacctgtctactcttgg

SEQ ID NO: 59231 - DNA, 25 bp, Homo sapien
aaccatgaggaagagcatttttcta

SEQ ID NO: 59232 - DNA, 25 bp, Homo sapien
aatatacacatgtcgcgtaatcgta

SEQ ID NO: 59233 - DNA, 25 bp, Homo sapien
cgcgtaatcgtaaaatgagcatctt

SEQ ID NO: 59234 - DNA, 25 bp, Homo sapien
gagcatcttagtctttaaaacacat

SEQ ID NO: 59235 - DNA, 25 bp, Homo sapien
gtcgatgaaataaacacaactcttt

SEQ ID NO: 59236 - DNA, 25 bp, Homo sapien
aacacaactctttgaggatttgaga

SEQ ID NO: 59237 - DNA, 25 bp, Homo sapien
ggatttgagactacattcacccttt

SEQ ID NO: 59238 - DNA, 25 bp, Homo sapien
tacattcaccctttattcacagtca

SEQ ID NO: 59239 - DNA, 25 bp, Homo sapien
ttcacagtcacttgcagttttgctt

SEQ ID NO: 59240 - DNA, 25 bp, Homo sapien
tctctccatttctctgctgtaagat

SEQ ID NO: 59241 - DNA, 25 bp, Homo sapien
gctgtaagatgactgttgcattgtt

SEQ ID NO: 59242 - DNA, 25 bp, Homo sapien
aaaacagtatgtttgtcagccaact

SEQ ID NO: 59243 - DNA, 25 bp, Homo sapien
atgtttgtcagccaactgatttaaa

SEQ ID NO: 59244 - DNA, 25 bp, Homo sapien
actctccccttcctatgaggaagaa

SEQ ID NO: 59245 - DNA, 25 bp, Homo sapien
gagaggggcacctatttctgtaaaa

SEQ ID NO: 59246 - DNA, 25 bp, Homo sapien
gtaaaatccccaaattggtgttgat

SEQ ID NO: 59247 - DNA, 25 bp, Homo sapien
tggtgttgatgattttgagcttgaa

SEQ ID NO: 59248 - DNA, 25 bp, Homo sapien
ttttcatacctgattaaaacttggt

SEQ ID NO: 59249 - DNA, 25 bp, Homo sapien
ctgtatcatatcatctgaggtttac

SEQ ID NO: 59250 - DNA, 25 bp, Homo sapien
atcatctgaggtttacgtggtaact

SEQ ID NO: 59251 - DNA, 25 bp, Homo sapien
cgtggtaactagtcttataacatgt

SEQ ID NO: 59252 - DNA, 25 bp, Homo sapien
tttttgttgttcatctaaagctttt

SEQ ID NO: 59253 - DNA, 25 bp, Homo sapien
gaacgaaaaagaggtagcactacaa

SEQ ID NO: 59254 - DNA, 25 bp, Homo sapien
ggtagcactacaaacacaatattca

SEQ ID NO: 59255 - DNA, 25 bp, Homo sapien
aatattttggcattgtactaatacc

SEQ ID NO: 59256 - DNA, 25 bp, Homo sapien
gcagcatactgagaccctgccttta

SEQ ID NO: 59257 - DNA, 25 bp, Homo sapien
aaacaccagggacacatttctctgt

SEQ ID NO: 59258 - DNA, 25 bp, Homo sapien
cagggacacatttctctgtcttttt

SEQ ID NO: 59259 - DNA, 25 bp, Homo sapien
tttgatcagtgtcctatacatcgaa

SEQ ID NO: 59260 - DNA, 25 bp, Homo sapien
gatcagtgtcctatacatcgaaggt

SEQ ID NO: 59261 - DNA, 25 bp, Homo sapien
gtcctatacatcgaaggtgtgcata

SEQ ID NO: 59262 - DNA, 25 bp, Homo sapien
catcgaaggtgtgcatatatgttga

SEQ ID NO: 59263 - DNA, 25 bp, Homo sapien
aaggtgtgcatatatgttgaatgac

SEQ ID NO: 59264 - DNA, 25 bp, Homo sapien
ttaaaggcccataagacaagtgatt

SEQ ID NO: 59265 - DNA, 25 bp, Homo sapien
agacaagtgattattatgattccca

SEQ ID NO: 59266 - DNA, 25 bp, Homo sapien
atgattcccatactccagatacaaa

SEQ ID NO: 59267 - DNA, 25 bp, Homo sapien
atcccagccattgcctaaacagatt

SEQ ID NO: 59268 - DNA, 25 bp, Homo sapien
ataaaatccctttcatcttcatatc

SEQ ID NO: 59269 - DNA, 25 bp, Homo sapien
catcttcatatcacagtttctgctc

SEQ ID NO: 59270 - DNA, 25 bp, Homo sapien
tgctcttcagaagtttcaccctttt

SEQ ID NO: 59271 - DNA, 25 bp, Homo sapien
agtttcaccctttttaatctctcag

SEQ ID NO: 59272 - DNA, 25 bp, Homo sapien
tttttaatctctcagccacaaacct

SEQ ID NO: 59273 - DNA, 25 bp, Homo sapien
gccacaaacctcagttccaatattg

SEQ ID NO: 59274 - DNA, 25 bp, Homo sapien
aagacgtatatgattccgtcaagaa

SEQ ID NO: 59275 - DNA, 25 bp, Homo sapien
gaaactgacagtaaatggcaatatt

SEQ ID NO: 59276 - DNA, 25 bp, Homo sapien
ggtagtatgaacttcagctttcaga

SEQ ID NO: 59277 - DNA, 25 bp, Homo sapien
cagctttcagaaatttgcagggact

SEQ ID NO: 59278 - DNA, 25 bp, Homo sapien
tttgcagggacttttgtgttctatc

SEQ ID NO: 59279 - DNA, 25 bp, Homo sapien
gtttctttttcttgcactcataggt

SEQ ID NO: 59280 - DNA, 25 bp, Homo sapien
ttctttttcttgcactcataggtag

SEQ ID NO: 59281 - DNA, 25 bp, Homo sapien
agttgtgaggaaatctgagagccaa

SEQ ID NO: 59282 - DNA, 25 bp, Homo sapien
gagagccaaagccaagattcaacat

SEQ ID NO: 59283 - DNA, 25 bp, Homo sapien
gaagaactgagtactccactttctg

SEQ ID NO: 59284 - DNA, 25 bp, Homo sapien
tgagtactccactttctggctacaa

SEQ ID NO: 59285 - DNA, 25 bp, Homo sapien
actttctggctacaactacctacaa

SEQ ID NO: 59286 - DNA, 25 bp, Homo sapien
gcaggctaaagtgctgtatccttta

SEQ ID NO: 59287 - DNA, 25 bp, Homo sapien
ttggaggtagcaaacactaaggtga

SEQ ID NO: 59288 - DNA, 25 bp, Homo sapien
tgtttattaacctgtattctgttta

SEQ ID NO: 59289 - DNA, 25 bp, Homo sapien
acagtggttcttaaattgtaagctc

SEQ ID NO: 59290 - DNA, 25 bp, Homo sapien
caaagtgttggtaatgcctgattca

SEQ ID NO: 59291 - DNA, 25 bp, Homo sapien
gtaatgcctgattcacaactttgag

SEQ ID NO: 59292 - DNA, 25 bp, Homo sapien
aactttgagaaggtagcactggaga

SEQ ID NO: 59293 - DNA, 25 bp, Homo sapien
attggtgatacttctttgaatgtag

SEQ ID NO: 59294 - DNA, 25 bp, Homo sapien
gaatgtagatttccaatcacatctt

SEQ ID NO: 59295 - DNA, 25 bp, Homo sapien
gatttccaatcacatctttagtgtc

SEQ ID NO: 59296 - DNA, 25 bp, Homo sapien
aatgttttaggatgtatgttacttc

SEQ ID NO: 59297 - DNA, 25 bp, Homo sapien
gaggaagccaattggatttcaagtt

SEQ ID NO: 59298 - DNA, 25 bp, Homo sapien
agaattacttattatcttggattta

SEQ ID NO: 59299 - DNA, 25 bp, Homo sapien
ggtgttattaaaatgctgaccatat

SEQ ID NO: 59300 - DNA, 25 bp, Homo sapien
aatgctgaccatatttccttcatcc

SEQ ID NO: 59301 - DNA, 25 bp, Homo sapien
ccttcatcctcttgttcctaaggaa

SEQ ID NO: 59302 - DNA, 25 bp, Homo sapien
tcatcctcttgttcctaaggaaaca

SEQ ID NO: 59303 - DNA, 25 bp, Homo sapien
tgttgaagacgagcagagatattaa

SEQ ID NO: 59304 - DNA, 25 bp, Homo sapien
tataaccaactttcaatttcctgtg

SEQ ID NO: 59305 - DNA, 25 bp, Homo sapien
ccaactttcaatttcctgtgctaat

SEQ ID NO: 59306 - DNA, 25 bp, Homo sapien
tcaatttcctgtgctaattaaggga

SEQ ID NO: 59307 - DNA, 25 bp, Homo sapien
agggaaattctgttgtggataatca

SEQ ID NO: 59308 - DNA, 25 bp, Homo sapien
aggtggacactgtgcttcgctaccg

SEQ ID NO: 59309 - DNA, 25 bp, Homo sapien
ctgtgcttcgctaccggtgccggga

SEQ ID NO: 59310 - DNA, 25 bp, Homo sapien
gaaggactggcccagcgcaatctgc

SEQ ID NO: 59311 - DNA, 25 bp, Homo sapien
tggcccagcgcaatctgccgctgat

SEQ ID NO: 59312 - DNA, 25 bp, Homo sapien
tgccgctgatccgatgccaagagaa

SEQ ID NO: 59313 - DNA, 25 bp, Homo sapien
atccgatgccaagagaacggtcgtt

SEQ ID NO: 59314 - DNA, 25 bp, Homo sapien
ggaggctactgggacgctggaaggc

SEQ ID NO: 59315 - DNA, 25 bp, Homo sapien
acgctggaaggcgctgttgatcccc

SEQ ID NO: 59316 - DNA, 25 bp, Homo sapien
gggcaaggccttgaacactgccggc

SEQ ID NO: 59317 - DNA, 25 bp, Homo sapien
aggccttgaacactgccggccacag

SEQ ID NO: 59318 - DNA, 25 bp, Homo sapien
agcactgccctgtcacccaaatttt

SEQ ID NO: 59319 - DNA, 25 bp, Homo sapien
aaagaagttgtgatcctgttgccta

SEQ ID NO: 59320 - DNA, 25 bp, Homo sapien
aagaagttgtgatcctgttgcctaa

SEQ ID NO: 59321 - DNA, 25 bp, Homo sapien
agaagttgtgatcctgttgcctaaa

SEQ ID NO: 59322 - DNA, 25 bp, Homo sapien
gaagttgtgatcctgttgcctaaac

SEQ ID NO: 59323 - DNA, 25 bp, Homo sapien
aagttgtgatcctgttgcctaaact

SEQ ID NO: 59324 - DNA, 25 bp, Homo sapien
gttgtgatcctgttgcctaaactaa

SEQ ID NO: 59325 - DNA, 25 bp, Homo sapien
tgatcctgttgcctaaactaaagct

SEQ ID NO: 59326 - DNA, 25 bp, Homo sapien
gatcctgttgcctaaactaaagctt

SEQ ID NO: 59327 - DNA, 25 bp, Homo sapien
atcctgttgcctaaactaaagctta

SEQ ID NO: 59328 - DNA, 25 bp, Homo sapien
gtttagtaaaaatcgtctgggcaca

SEQ ID NO: 59329 - DNA, 25 bp, Homo sapien
ttagtaaaaatcgtctgggcacagt

SEQ ID NO: 59330 - DNA, 25 bp, Homo sapien
tccgtgtacctcaagacctatgtta

SEQ ID NO: 59331 - DNA, 25 bp, Homo sapien
gcatccaacttataatatctcccat

SEQ ID NO: 59332 - DNA, 25 bp, Homo sapien
tatctcccatcccagtggcatagtt

SEQ ID NO: 59333 - DNA, 25 bp, Homo sapien
tggcatagttcaccaagtcccagtg

SEQ ID NO: 59334 - DNA, 25 bp, Homo sapien
cagtgggcttaaatccccgtctgtt

SEQ ID NO: 59335 - DNA, 25 bp, Homo sapien
ccaaccattcatcagactcagtaca

SEQ ID NO: 59336 - DNA, 25 bp, Homo sapien
gactcagtacaaaccaatcttccca

SEQ ID NO: 59337 - DNA, 25 bp, Homo sapien
cagcatcacctgcatatactggatt

SEQ ID NO: 59338 - DNA, 25 bp, Homo sapien
cacctgcatatactggatttccact

SEQ ID NO: 59339 - DNA, 25 bp, Homo sapien
gtccaacaaaactcagccagtatcc

SEQ ID NO: 59340 - DNA, 25 bp, Homo sapien
aactcagccagtatccatatatgtg

SEQ ID NO: 59341 - DNA, 25 bp, Homo sapien
gaagagggacgctagggccttcctt

SEQ ID NO: 59342 - DNA, 25 bp, Homo sapien
tgatctatccctgtctcactgaaag

SEQ ID NO: 59343 - DNA, 25 bp, Homo sapien
aaagcccctgtgtagtgtctgtgtt

SEQ ID NO: 59344 - DNA, 25 bp, Homo sapien
tgttgttttcccttgaccctgggct

SEQ ID NO: 59345 - DNA, 25 bp, Homo sapien
tgggctttcctatcctcccaaagac

SEQ ID NO: 59346 - DNA, 25 bp, Homo sapien
tgttagatggctctgcctgtccttc

SEQ ID NO: 59347 - DNA, 25 bp, Homo sapien
gggcagctgagtgcattcattttgt

SEQ ID NO: 59348 - DNA, 25 bp, Homo sapien
tgtgggctttctgcttagtctgaaa

SEQ ID NO: 59349 - DNA, 25 bp, Homo sapien
ttagtctgaaaggtgtgtggcattc

SEQ ID NO: 59350 - DNA, 25 bp, Homo sapien
tgtggcattcatggcaatcctgtaa

SEQ ID NO: 59351 - DNA, 25 bp, Homo sapien
ggcaatcctgtaacttcaacataga

SEQ ID NO: 59352 - DNA, 25 bp, Homo sapien
ggagcggcacccacaacatgtaccg

SEQ ID NO: 59353 - DNA, 25 bp, Homo sapien
gcggcacccacaacatgtaccggga

SEQ ID NO: 59354 - DNA, 25 bp, Homo sapien
catgtaccgggaataccgggacctg

SEQ ID NO: 59355 - DNA, 25 bp, Homo sapien
cagtgctaccgagacatgggtgccc

SEQ ID NO: 59356 - DNA, 25 bp, Homo sapien
gagcccactccattcagatcatgaa

SEQ ID NO: 59357 - DNA, 25 bp, Homo sapien
ggccggctgtcaagcagttccacga

SEQ ID NO: 59358 - DNA, 25 bp, Homo sapien
acgactccaagatcaagttcccgct

SEQ ID NO: 59359 - DNA, 25 bp, Homo sapien
tgcgccgtcagcacaagccacgctt

SEQ ID NO: 59360 - DNA, 25 bp, Homo sapien
ccaacaccttcttctaggtgcaggg

SEQ ID NO: 59361 - DNA, 25 bp, Homo sapien
caacaccttcttctaggtgcagggc

SEQ ID NO: 59362 - DNA, 25 bp, Homo sapien
tcttctaggtgcagggccctcgtcc

SEQ ID NO: 59363 - DNA, 25 bp, Homo sapien
gctcacacagctgctgagacttcag

SEQ ID NO: 59364 - DNA, 25 bp, Homo sapien
gagacttcagggacccatcagaact

SEQ ID NO: 59365 - DNA, 25 bp, Homo sapien
ggcccacacctaagcttccatgtag

SEQ ID NO: 59366 - DNA, 25 bp, Homo sapien
catgtagccctcatccagggaagtt

SEQ ID NO: 59367 - DNA, 25 bp, Homo sapien
ccagggaagttttgcgatcctttag

SEQ ID NO: 59368 - DNA, 25 bp, Homo sapien
gatcctttaggaagacactgtcctc

SEQ ID NO: 59369 - DNA, 25 bp, Homo sapien
gacactgtcctcttattacagattg

SEQ ID NO: 59370 - DNA, 25 bp, Homo sapien
agtagcagctttgtacactgaggac

SEQ ID NO: 59371 - DNA, 25 bp, Homo sapien
gaggacactgtagccaggaacctgt

SEQ ID NO: 59372 - DNA, 25 bp, Homo sapien
gtagccaggaacctgtgcatgccac

SEQ ID NO: 59373 - DNA, 25 bp, Homo sapien
agtcatcctgcctctgatgtgaatc

SEQ ID NO: 59374 - DNA, 25 bp, Homo sapien
ttttgccagggccaagctaccagaa

SEQ ID NO: 59375 - DNA, 25 bp, Homo sapien
gattacctggtatgtatctctctgg

SEQ ID NO: 59376 - DNA, 25 bp, Homo sapien
cctggtatgtatctctctgggtgcc

SEQ ID NO: 59377 - DNA, 25 bp, Homo sapien
tgggtgccccagttagagctgccac

SEQ ID NO: 59378 - DNA, 25 bp, Homo sapien
gttagagctgccacagctcaggaaa

SEQ ID NO: 59379 - DNA, 25 bp, Homo sapien
gaggcataacgaccttgaatgtaat

SEQ ID NO: 59380 - DNA, 25 bp, Homo sapien
aaccctgcattcaatgtagctgtca

SEQ ID NO: 59381 - DNA, 25 bp, Homo sapien
tgtagctgtcaattcagtattttta

SEQ ID NO: 59382 - DNA, 25 bp, Homo sapien
tttaagtacacctgtcagctgtttc

SEQ ID NO: 59383 - DNA, 25 bp, Homo sapien
agctgtttcttaccacttcgatggt

SEQ ID NO: 59384 - DNA, 25 bp, Homo sapien
cttaccacttcgatggttgtgatta

SEQ ID NO: 59385 - DNA, 25 bp, Homo sapien
ctgacagaaggactcaggttgtctg

SEQ ID NO: 59386 - DNA, 25 bp, Homo sapien
tcaggttgtctgaagtcactgcaca

SEQ ID NO: 59387 - DNA, 25 bp, Homo sapien
tctgaagtcactgcacagtgcatct

SEQ ID NO: 59388 - DNA, 25 bp, Homo sapien
atctcagcccacatagtgatggttc

SEQ ID NO: 59389 - DNA, 25 bp, Homo sapien
cagcccacatagtgatggttcccct

SEQ ID NO: 59390 - DNA, 25 bp, Homo sapien
tgttcactctacttagcatgtccct

SEQ ID NO: 59391 - DNA, 25 bp, Homo sapien
tacttagcatgtccctaccgagtct

SEQ ID NO: 59392 - DNA, 25 bp, Homo sapien
taccgagtctcttctccactggatg

SEQ ID NO: 59393 - DNA, 25 bp, Homo sapien
tggaggaaaaccaagccgtggcttc

SEQ ID NO: 59394 - DNA, 25 bp, Homo sapien
ccttcaaccattccccatgggaaat

SEQ ID NO: 59395 - DNA, 25 bp, Homo sapien
aaccattccccatgggaaatgtcaa

SEQ ID NO: 59396 - DNA, 25 bp, Homo sapien
gaccgcaagaatatccttaggctcc

SEQ ID NO: 59397 - DNA, 25 bp, Homo sapien
agaatatccttaggctccaggacct

SEQ ID NO: 59398 - DNA, 25 bp, Homo sapien
caggccaaagtgaagtcttacaaga

SEQ ID NO: 59399 - DNA, 25 bp, Homo sapien
agtgaagtcttacaagaggcaggct

SEQ ID NO: 59400 - DNA, 25 bp, Homo sapien
aggccaacacgcagctgtccagatg

SEQ ID NO: 59401 - DNA, 25 bp, Homo sapien
agctgtccagatgccggagagtcca

SEQ ID NO: 59402 - DNA, 25 bp, Homo sapien
gccggagagtccagcatgagctaga

SEQ ID NO: 59403 - DNA, 25 bp, Homo sapien
ccaagagccgagacgtgggcagcca

SEQ ID NO: 59404 - DNA, 25 bp, Homo sapien
agaatgaggctcacctgatgctcgt

SEQ ID NO: 59405 - DNA, 25 bp, Homo sapien
acctgatgctcgttgccatgggaca

SEQ ID NO: 59406 - DNA, 25 bp, Homo sapien
ccatgggacacctccgagagagtgg

SEQ ID NO: 59407 - DNA, 25 bp, Homo sapien
ctgggcgagcctgtagacctatcgg

SEQ ID NO: 59408 - DNA, 25 bp, Homo sapien
gggcgagcctgtagacctatcggct

SEQ ID NO: 59409 - DNA, 25 bp, Homo sapien
gcgagcctgtagacctatcggctct

SEQ ID NO: 59410 - DNA, 25 bp, Homo sapien
tatcggctctcatcccttgggataa

SEQ ID NO: 59411 - DNA, 25 bp, Homo sapien
tcatcccttgggataagccccagtc

SEQ ID NO: 59412 - DNA, 25 bp, Homo sapien
taagccccagtccaggtccaggagg

SEQ ID NO: 59413 - DNA, 25 bp, Homo sapien
ctgcccagcgagtcttccagaaggg

SEQ ID NO: 59414 - DNA, 25 bp, Homo sapien
gggttgcaggtcccgaccactgacc

SEQ ID NO: 59415 - DNA, 25 bp, Homo sapien
aagcccagcacgcagcgtaccttga

SEQ ID NO: 59416 - DNA, 25 bp, Homo sapien
agcacgcagcgtaccttgaacagag

SEQ ID NO: 59417 - DNA, 25 bp, Homo sapien
cacgcagcgtaccttgaacagaggg

SEQ ID NO: 59418 - DNA, 25 bp, Homo sapien
ctgacactttaacatgtgccttaac

SEQ ID NO: 59419 - DNA, 25 bp, Homo sapien
aacatgtgccttaacaatcttgcat

SEQ ID NO: 59420 - DNA, 25 bp, Homo sapien
gtgccttaacaatcttgcatactaa

SEQ ID NO: 59421 - DNA, 25 bp, Homo sapien
aacaatcttgcatactaaggtacag

SEQ ID NO: 59422 - DNA, 25 bp, Homo sapien
gtaacaattagcatagtcttataag

SEQ ID NO: 59423 - DNA, 25 bp, Homo sapien
ggagaataaaagtgccctgcaaaca

SEQ ID NO: 59424 - DNA, 25 bp, Homo sapien
aagtgccctgcaaacatggcttcta

SEQ ID NO: 59425 - DNA, 25 bp, Homo sapien
tgccctgcaaacatggcttctatgt

SEQ ID NO: 59426 - DNA, 25 bp, Homo sapien
gcaaacatggcttctatgtacttaa

SEQ ID NO: 59427 - DNA, 25 bp, Homo sapien
atggcttctatgtacttaatatggt

SEQ ID NO: 59428 - DNA, 25 bp, Homo sapien
gtaaaacatgtgacagggaagcctg

SEQ ID NO: 59429 - DNA, 25 bp, Homo sapien
gggcacgaagttttagcaccggcac

SEQ ID NO: 59430 - DNA, 25 bp, Homo sapien
ggtagcagcagcagccaacaaaatt

SEQ ID NO: 59431 - DNA, 25 bp, Homo sapien
cagctttccttttcatggcggtcgg

SEQ ID NO: 59432 - DNA, 25 bp, Homo sapien
cttttcatggcggtcggcctgcagg

SEQ ID NO: 59433 - DNA, 25 bp, Homo sapien
tgggctctagtacccaaaaggtcac

SEQ ID NO: 59434 - DNA, 25 bp, Homo sapien
caaaaggtcacccaccgggtgctgg

SEQ ID NO: 59435 - DNA, 25 bp, Homo sapien
tgggccccgtcagaggtaagccagt

SEQ ID NO: 59436 - DNA, 25 bp, Homo sapien
tgggagcccctgcaacatgtgttcg

SEQ ID NO: 59437 - DNA, 25 bp, Homo sapien
ccctgcaacatgtgttcggttgtct

SEQ ID NO: 59438 - DNA, 25 bp, Homo sapien
gagcttgaagatatactgttggccc

SEQ ID NO: 59439 - DNA, 25 bp, Homo sapien
agatatactgttggcccaggaccaa

SEQ ID NO: 59440 - DNA, 25 bp, Homo sapien
ggcaggagcttggaccttggtacta

SEQ ID NO: 59441 - DNA, 25 bp, Homo sapien
aggagcttggaccttggtactacct

SEQ ID NO: 59442 - DNA, 25 bp, Homo sapien
agcttggaccttggtactacctcag

SEQ ID NO: 59443 - DNA, 25 bp, Homo sapien
tggaccttggtactacctcagctga

SEQ ID NO: 59444 - DNA, 25 bp, Homo sapien
gaccttggtactacctcagctgagg

SEQ ID NO: 59445 - DNA, 25 bp, Homo sapien
ccttggtactacctcagctgagggt

SEQ ID NO: 59446 - DNA, 25 bp, Homo sapien
tggtactacctcagctgagggtggt

SEQ ID NO: 59447 - DNA, 25 bp, Homo sapien
actacctcagctgagggtggtgaca

SEQ ID NO: 59448 - DNA, 25 bp, Homo sapien
ctcagctgagggtggtgacacaacc

SEQ ID NO: 59449 - DNA, 25 bp, Homo sapien
ctgagggtggtgacacaaccccttc

SEQ ID NO: 59450 - DNA, 25 bp, Homo sapien
caaccccttccatttgtcagcactt

SEQ ID NO: 59451 - DNA, 25 bp, Homo sapien
aagccagggtcggaagactctcttg

SEQ ID NO: 59452 - DNA, 25 bp, Homo sapien
gaagactctcttgagccccgaagtt

SEQ ID NO: 59453 - DNA, 25 bp, Homo sapien
aaagccccatggatggaggactcag

SEQ ID NO: 59454 - DNA, 25 bp, Homo sapien
gaggactcagtattgagcatctctt

SEQ ID NO: 59455 - DNA, 25 bp, Homo sapien
tctctttgagaggacgcgtgcacag

SEQ ID NO: 59456 - DNA, 25 bp, Homo sapien
gtcagcacctcgacaggatacagtt

SEQ ID NO: 59457 - DNA, 25 bp, Homo sapien
gacaggatacagtttttcccagaag

SEQ ID NO: 59458 - DNA, 25 bp, Homo sapien
ttttcccagaagaggttctccctag

SEQ ID NO: 59459 - DNA, 25 bp, Homo sapien
agaagaggttctccctaggcctggc

SEQ ID NO: 59460 - DNA, 25 bp, Homo sapien
acactctctccttccaaggcttggg

SEQ ID NO: 59461 - DNA, 25 bp, Homo sapien
gggacaccaatgagcagcaacaaat

SEQ ID NO: 59462 - DNA, 25 bp, Homo sapien
tatcggctctcatcccttgggataa

SEQ ID NO: 59463 - DNA, 25 bp, Homo sapien
atcggctctcatcccttgggataag

SEQ ID NO: 59464 - DNA, 25 bp, Homo sapien
ggctctcatcccttgggataagccc

SEQ ID NO: 59465 - DNA, 25 bp, Homo sapien
tcatcccttgggataagccccagtc

SEQ ID NO: 59466 - DNA, 25 bp, Homo sapien
atcccttgggataagccccagtcca

SEQ ID NO: 59467 - DNA, 25 bp, Homo sapien
tcccttgggataagccccagtccag

SEQ ID NO: 59468 - DNA, 25 bp, Homo sapien
ataagccccagtccaggtccaggag

SEQ ID NO: 59469 - DNA, 25 bp, Homo sapien
taagccccagtccaggtccaggagg

SEQ ID NO: 59470 - DNA, 25 bp, Homo sapien
aagccccagtccaggtccaggaggc

SEQ ID NO: 59471 - DNA, 25 bp, Homo sapien
ctgcccagcgagtcttccagaaggg

SEQ ID NO: 59472 - DNA, 25 bp, Homo sapien
gggttgcaggtcccgaccactgacc

SEQ ID NO: 59473 - DNA, 25 bp, Homo sapien
actccatctcttacaagatcgagga

SEQ ID NO: 59474 - DNA, 25 bp, Homo sapien
gatcgaggagatctcaccaagcaca

SEQ ID NO: 59475 - DNA, 25 bp, Homo sapien
ggagatctcaccaagcacattaaaa

SEQ ID NO: 59476 - DNA, 25 bp, Homo sapien
atctctcctgggttacacagcttta

SEQ ID NO: 59477 - DNA, 25 bp, Homo sapien
tgggttacacagctttaccgaccac

SEQ ID NO: 59478 - DNA, 25 bp, Homo sapien
tttaccgaccaccagaggctgatga

SEQ ID NO: 59479 - DNA, 25 bp, Homo sapien
accagaggctgatgaaacgccggaa

SEQ ID NO: 59480 - DNA, 25 bp, Homo sapien
gatgaaacgccggaagtccgtttag

SEQ ID NO: 59481 - DNA, 25 bp, Homo sapien
gtggcaccgcagaactccttcagcg

SEQ ID NO: 59482 - DNA, 25 bp, Homo sapien
cagaactccttcagcgccaagcttg

SEQ ID NO: 59483 - DNA, 25 bp, Homo sapien
ttccactccatctcttacaagatcg

SEQ ID NO: 59484 - DNA, 25 bp, Homo sapien
ccttgggagtttcagctctttggcg

SEQ ID NO: 59485 - DNA, 25 bp, Homo sapien
caggtgccatgcgatcagcgaagcc

SEQ ID NO: 59486 - DNA, 25 bp, Homo sapien
atgcgatcagcgaagcctgcgagtt

SEQ ID NO: 59487 - DNA, 25 bp, Homo sapien
gaagcctgcgagttggcaggactct

SEQ ID NO: 59488 - DNA, 25 bp, Homo sapien
aggactctgaggtttcctgcagacc

SEQ ID NO: 59489 - DNA, 25 bp, Homo sapien
tttcctgcagaccatgccatgagat

SEQ ID NO: 59490 - DNA, 25 bp, Homo sapien
accttttcctggatgggtgaggcaa

SEQ ID NO: 59491 - DNA, 25 bp, Homo sapien
caagcagtgttgtcctcacgggagg

SEQ ID NO: 59492 - DNA, 25 bp, Homo sapien
gaggactgagcgactgggaaaactc

SEQ ID NO: 59493 - DNA, 25 bp, Homo sapien
gactgggaaaactcggctctacatc

SEQ ID NO: 59494 - DNA, 25 bp, Homo sapien
gaaacaccacagctggagagtcctg

SEQ ID NO: 59495 - DNA, 25 bp, Homo sapien
ggatgaactagattccctaattaca

SEQ ID NO: 59496 - DNA, 25 bp, Homo sapien
ctagattccctaattacagtgaaat

SEQ ID NO: 59497 - DNA, 25 bp, Homo sapien
cagtgaaattctatcttgcaaatgc

SEQ ID NO: 59498 - DNA, 25 bp, Homo sapien
ttgcctttgggttttctgtacagat

SEQ ID NO: 59499 - DNA, 25 bp, Homo sapien
tctgtacagattgtttttgttatta

SEQ ID NO: 59500 - DNA, 25 bp, Homo sapien
ggaaaaggcctgaattatgctctta

SEQ ID NO: 59501 - DNA, 25 bp, Homo sapien
ggcctgaattatgctcttatgtgaa

SEQ ID NO: 59502 - DNA, 25 bp, Homo sapien
ataacctattgactgtattctgtgt

SEQ ID NO: 59503 - DNA, 25 bp, Homo sapien
gactgtattctgtgtattattcttt

SEQ ID NO: 59504 - DNA, 25 bp, Homo sapien
tctttattttgggaccttctgtgta

SEQ ID NO: 59505 - DNA, 25 bp, Homo sapien
tattttgggaccttctgtgtaaaag

SEQ ID NO: 59506 - DNA, 25 bp, Homo sapien
gagttatttggactgaaagcttaag

SEQ ID NO: 59507 - DNA, 25 bp, Homo sapien
tctattttgtgatctagtcaagcca

SEQ ID NO: 59508 - DNA, 25 bp, Homo sapien
gtgatctagtcaagccacagttatc

SEQ ID NO: 59509 - DNA, 25 bp, Homo sapien
gccacagttatcaaaggctacattt

SEQ ID NO: 59510 - DNA, 25 bp, Homo sapien
aactcaaatatgtatcacgtgtgct

SEQ ID NO: 59511 - DNA, 25 bp, Homo sapien
gtatcacgtgtgctttgtatcttaa

SEQ ID NO: 59512 - DNA, 25 bp, Homo sapien
acgtgtgctttgtatcttaagatgt

SEQ ID NO: 59513 - DNA, 25 bp, Homo sapien
gatgtgtttccaagagcatctgaaa

SEQ ID NO: 59514 - DNA, 25 bp, Homo sapien
gagcatctgaaattttgtttgtaca

SEQ ID NO: 59515 - DNA, 25 bp, Homo sapien
aaagccactgtgatctataaatcaa

SEQ ID NO: 59516 - DNA, 25 bp, Homo sapien
agaaaatccattgtcataaccattt

SEQ ID NO: 59517 - DNA, 25 bp, Homo sapien
tgggagtagttgtctttcctggcac

SEQ ID NO: 59518 - DNA, 25 bp, Homo sapien
tgtctttcctggcactaacgttgag

SEQ ID NO: 59519 - DNA, 25 bp, Homo sapien
tggcactaacgttgagcccctggag

SEQ ID NO: 59520 - DNA, 25 bp, Homo sapien
agcccctggaggcactgaagtgctt

SEQ ID NO: 59521 - DNA, 25 bp, Homo sapien
gaagtgcttagtgtacttggagtat

SEQ ID NO: 59522 - DNA, 25 bp, Homo sapien
agctcctgtaacatactggcctgga

SEQ ID NO: 59523 - DNA, 25 bp, Homo sapien
atactggcctggactgttttctctc

SEQ ID NO: 59524 - DNA, 25 bp, Homo sapien
atgtgtcctggttcccgtttctcca

SEQ ID NO: 59525 - DNA, 25 bp, Homo sapien
cacctagactgtaaacctctcgagg

SEQ ID NO: 59526 - DNA, 25 bp, Homo sapien
actgtaaacctctcgagggcaggga

SEQ ID NO: 59527 - DNA, 25 bp, Homo sapien
acaccctgtactgttctgtgtcttt

SEQ ID NO: 59528 - DNA, 25 bp, Homo sapien
ctgaggctaagattggtaaactgta

SEQ ID NO: 59529 - DNA, 25 bp, Homo sapien
aactgtaagcccacacttaaccttg

SEQ ID NO: 59530 - DNA, 25 bp, Homo sapien
agcccacacttaaccttgtcaatag

SEQ ID NO: 59531 - DNA, 25 bp, Homo sapien
taggttcttgaaaacttgtacttca

SEQ ID NO: 59532 - DNA, 25 bp, Homo sapien
aaggcagttatttgaggactggcta

SEQ ID NO: 59533 - DNA, 25 bp, Homo sapien
gaggactggctatacactgtttcac

SEQ ID NO: 59534 - DNA, 25 bp, Homo sapien
ggctatacactgtttcacgtaaaag

SEQ ID NO: 59535 - DNA, 25 bp, Homo sapien
ttcacgtaaaagttggagttttcat

SEQ ID NO: 59536 - DNA, 25 bp, Homo sapien
tgaaaaccatcattaccttctccat

SEQ ID NO: 59537 - DNA, 25 bp, Homo sapien
atcattaccttctccataccatttg

SEQ ID NO: 59538 - DNA, 25 bp, Homo sapien
tctccataccatttggctcccaaat

SEQ ID NO: 59539 - DNA, 25 bp, Homo sapien
gagaaggttgatgcagcgcttcaca

SEQ ID NO: 59540 - DNA, 25 bp, Homo sapien
aaggttgatgcagcgcttcacacca

SEQ ID NO: 59541 - DNA, 25 bp, Homo sapien
agcgcttcacaccatgctgttgaaa

SEQ ID NO: 59542 - DNA, 25 bp, Homo sapien
caaaggcaacatttggcctggttag

SEQ ID NO: 59543 - DNA, 25 bp, Homo sapien
aacatttggcctggttaggtacctg

SEQ ID NO: 59544 - DNA, 25 bp, Homo sapien
tggcctggttaggtacctgggtcct

SEQ ID NO: 59545 - DNA, 25 bp, Homo sapien
tcctttaccataaccttcgcattat

SEQ ID NO: 59546 - DNA, 25 bp, Homo sapien
cttcgcattatgatacagtaccttc

SEQ ID NO: 59547 - DNA, 25 bp, Homo sapien
gatacagtaccttctaagtggcttt

SEQ ID NO: 59548 - DNA, 25 bp, Homo sapien
gtaccttctaagtggctttgaattg

SEQ ID NO: 59549 - DNA, 25 bp, Homo sapien
ggctttgaattggaactctacagta

SEQ ID NO: 59550 - DNA, 25 bp, Homo sapien
tctcttacacgaacgttttctcgac

SEQ ID NO: 59551 - DNA, 25 bp, Homo sapien
acgttttctcgaccatcctgaagat

SEQ ID NO: 59552 - DNA, 25 bp, Homo sapien
tcctgaagatcccatcagctcaggg

SEQ ID NO: 59553 - DNA, 25 bp, Homo sapien
gggacttctttttgtgttgatttca

SEQ ID NO: 59554 - DNA, 25 bp, Homo sapien
ttgtgttgatttcagttctccctca

SEQ ID NO: 59555 - DNA, 25 bp, Homo sapien
cactcggcccagaaggacacagttg

SEQ ID NO: 59556 - DNA, 25 bp, Homo sapien
aggacacagttgcatcagtgatgta

SEQ ID NO: 59557 - DNA, 25 bp, Homo sapien
tgatgtacacagtggtaactccaat

SEQ ID NO: 59558 - DNA, 25 bp, Homo sapien
ggtaactccaatgttgaatcccttt

SEQ ID NO: 59559 - DNA, 25 bp, Homo sapien
ctttatctacagtttgaggaaccaa

SEQ ID NO: 59560 - DNA, 25 bp, Homo sapien
gaaataaagtcttccctgagaaagt

SEQ ID NO: 59561 - DNA, 25 bp, Homo sapien
ggtgttaataaaatcctcatcggaa

SEQ ID NO: 59562 - DNA, 25 bp, Homo sapien
aatcctcatcggaaaagatccaaag

SEQ ID NO: 59563 - DNA, 25 bp, Homo sapien
aaacataatttcctagactgaaagt

SEQ ID NO: 59564 - DNA, 25 bp, Homo sapien
aaagatgcagggtctgagtcaggcc

SEQ ID NO: 59565 - DNA, 25 bp, Homo sapien
gatgcagggtctgagtcaggccttc

SEQ ID NO: 59566 - DNA, 25 bp, Homo sapien
tctgagtcaggccttctggttatat

SEQ ID NO: 59567 - DNA, 25 bp, Homo sapien
gagtcaggccttctggttatattgt

SEQ ID NO: 59568 - DNA, 25 bp, Homo sapien
tctggttatattgtgcagtttcaaa

SEQ ID NO: 59569 - DNA, 25 bp, Homo sapien
atttaaaatgacctgatttcctgga

SEQ ID NO: 59570 - DNA, 25 bp, Homo sapien
aaatgacctgatttcctggaaaatt

SEQ ID NO: 59571 - DNA, 25 bp, Homo sapien
ttattattcaaaaggtggaggcatt

SEQ ID NO: 59572 - DNA, 25 bp, Homo sapien
ggcctcgccaggagtcttggctgtt

SEQ ID NO: 59573 - DNA, 25 bp, Homo sapien
gagtcttggctgttggcagctcaga

SEQ ID NO: 59574 - DNA, 25 bp, Homo sapien
cctgtggtgtgaggtgccctgcacc

SEQ ID NO: 59575 - DNA, 25 bp, Homo sapien
atgcccaaggaacacccatggtgca

SEQ ID NO: 59576 - DNA, 25 bp, Homo sapien
aggaacacccatggtgcagtcctca

SEQ ID NO: 59577 - DNA, 25 bp, Homo sapien
atggtgcagtcctcaggcaaggcca

SEQ ID NO: 59578 - DNA, 25 bp, Homo sapien
cagtcctcaggcaaggccaggacgg

SEQ ID NO: 59579 - DNA, 25 bp, Homo sapien
ggaaggctgagacccgcttacctta

SEQ ID NO: 59580 - DNA, 25 bp, Homo sapien
gcttaccttagttcatctgttcact

SEQ ID NO: 59581 - DNA, 25 bp, Homo sapien
ccttagttcatctgttcactcgtaa

SEQ ID NO: 59582 - DNA, 25 bp, Homo sapien
gttcatctgttcactcgtaataaaa

SEQ ID NO: 59583 - DNA, 25 bp, Homo sapien
catgagttcataccagtagtgttga

SEQ ID NO: 59584 - DNA, 25 bp, Homo sapien
tagtgttgaacccaatcttcatggt

SEQ ID NO: 59585 - DNA, 25 bp, Homo sapien
atcttcatggttcatctactcttct

SEQ ID NO: 59586 - DNA, 25 bp, Homo sapien
tactcttctcctttgctatatttac

SEQ ID NO: 59587 - DNA, 25 bp, Homo sapien
tcctttgctatatttacaacccttt

SEQ ID NO: 59588 - DNA, 25 bp, Homo sapien
aaactaactcccattgtctttcata

SEQ ID NO: 59589 - DNA, 25 bp, Homo sapien
actcccattgtctttcatatattta

SEQ ID NO: 59590 - DNA, 25 bp, Homo sapien
taaccaattcctctgtatgtagcca

SEQ ID NO: 59591 - DNA, 25 bp, Homo sapien
cctctgtatgtagccagatttccat

SEQ ID NO: 59592 - DNA, 25 bp, Homo sapien
tattccccatccaaggactcaaaag

SEQ ID NO: 59593 - DNA, 25 bp, Homo sapien
ctcaaaagccagtttgcatgtcccc

SEQ ID NO: 59594 - DNA, 25 bp, Homo sapien
gtgaaaacccggaccttgcagaatt

SEQ ID NO: 59595 - DNA, 25 bp, Homo sapien
aacccggaccttgcagaattggaag

SEQ ID NO: 59596 - DNA, 25 bp, Homo sapien
ggaagttctggattttcagcatcat

SEQ ID NO: 59597 - DNA, 25 bp, Homo sapien
ttttcagcatcatcatcaagccgct

SEQ ID NO: 59598 - DNA, 25 bp, Homo sapien
atcaagccgctgtttgagtcgttca

SEQ ID NO: 59599 - DNA, 25 bp, Homo sapien
ttgagtcgttcaagggcatggtgtc

SEQ ID NO: 59600 - DNA, 25 bp, Homo sapien
catcctcaggccgatggtattgagc

SEQ ID NO: 59601 - DNA, 25 bp, Homo sapien
atggtattgagcacgctgcggcagc

SEQ ID NO: 59602 - DNA, 25 bp, Homo sapien
acagctgccagagcaggcgtccaag

SEQ ID NO: 59603 - DNA, 25 bp, Homo sapien
gcaggcgtccaaggctgtcaccagg

SEQ ID NO: 59604 - DNA, 25 bp, Homo sapien
ttggcaagagattgggagagtccta

SEQ ID NO: 59605 - DNA, 25 bp, Homo sapien
gaagaactgcttcattcggggctca

SEQ ID NO: 59606 - DNA, 25 bp, Homo sapien
gctcagtggtccgatacgtgcagct

SEQ ID NO: 59607 - DNA, 25 bp, Homo sapien
agtggtccgatacgtgcagctgcca

SEQ ID NO: 59608 - DNA, 25 bp, Homo sapien
gatacgtgcagctgccagcagatga

SEQ ID NO: 59609 - DNA, 25 bp, Homo sapien
agctgccagcagatgaggtcgacac

SEQ ID NO: 59610 - DNA, 25 bp, Homo sapien
gatgaggtcgacacacagttgctac

SEQ ID NO: 59611 - DNA, 25 bp, Homo sapien
ggtcgacacacagttgctacaggat

SEQ ID NO: 59612 - DNA, 25 bp, Homo sapien
acacagttgctacaggatgcggcaa

SEQ ID NO: 59613 - DNA, 25 bp, Homo sapien
tccctctttcattggtgacccataa

SEQ ID NO: 59614 - DNA, 25 bp, Homo sapien
tcattggtgacccataaccccaagt

SEQ ID NO: 59615 - DNA, 25 bp, Homo sapien
agtaatagggaacagctatcctctc

SEQ ID NO: 59616 - DNA, 25 bp, Homo sapien
acactctcatcctctcgaagaagaa

SEQ ID NO: 59617 - DNA, 25 bp, Homo sapien
aaggagaggctctgtttccagccag

SEQ ID NO: 59618 - DNA, 25 bp, Homo sapien
tctgtttccagccagttagttttct

SEQ ID NO: 59619 - DNA, 25 bp, Homo sapien
tgggagacttctctgtacatttctg

SEQ ID NO: 59620 - DNA, 25 bp, Homo sapien
gtacatttctgccatgtactccaga

SEQ ID NO: 59621 - DNA, 25 bp, Homo sapien
ttctgccatgtactccagaactcat

SEQ ID NO: 59622 - DNA, 25 bp, Homo sapien
aactcatcctgtcaatcactctgtc

SEQ ID NO: 59623 - DNA, 25 bp, Homo sapien
tgtcccattgtctactgggaaggtc

SEQ ID NO: 59624 - DNA, 25 bp, Homo sapien
tcccaggtcttcaccagttttacaa

SEQ ID NO: 59625 - DNA, 25 bp, Homo sapien
gttttacaatgagttatcccaggcc

SEQ ID NO: 59626 - DNA, 25 bp, Homo sapien
tgagttatcccaggccagacgtggt

SEQ ID NO: 59627 - DNA, 25 bp, Homo sapien
gtatgatgctgagataagacaacta

SEQ ID NO: 59628 - DNA, 25 bp, Homo sapien
agacaactattagatcatcttgaaa

SEQ ID NO: 59629 - DNA, 25 bp, Homo sapien
gcaagatacaattttgacacatgat

SEQ ID NO: 59630 - DNA, 25 bp, Homo sapien
gacacatgatgaactctagcactgg

SEQ ID NO: 59631 - DNA, 25 bp, Homo sapien
ctagcactggtgtatatgagaagga

SEQ ID NO: 59632 - DNA, 25 bp, Homo sapien
gaaggcgaaagcatgacaggaaacc

SEQ ID NO: 59633 - DNA, 25 bp, Homo sapien
gacaggaaacctgccgcctgctggg

SEQ ID NO: 59634 - DNA, 25 bp, Homo sapien
ggagcccctgctgagacgatttgga

SEQ ID NO: 59635 - DNA, 25 bp, Homo sapien
gcccctgctgagacgatttggaagt

SEQ ID NO: 59636 - DNA, 25 bp, Homo sapien
cgatttggaagtctcgttaagatca

SEQ ID NO: 59637 - DNA, 25 bp, Homo sapien
gtctcgttaagatcagtgacatatt

SEQ ID NO: 59638 - DNA, 25 bp, Homo sapien
tggttccaatctatgctcttcacca

SEQ ID NO: 59639 - DNA, 25 bp, Homo sapien
gatctttacagatacataccttttg

SEQ ID NO: 59640 - DNA, 25 bp, Homo sapien
tacataccttttggagctggacccc

SEQ ID NO: 59641 - DNA, 25 bp, Homo sapien
ttttggagctggaccccgaaactgc

SEQ ID NO: 59642 - DNA, 25 bp, Homo sapien
tgaggtttgctctcacaaacataaa

SEQ ID NO: 59643 - DNA, 25 bp, Homo sapien
gctctcacaaacataaaacttgctg

SEQ ID NO: 59644 - DNA, 25 bp, Homo sapien
aaacttgctgtcattagagcactgc

SEQ ID NO: 59645 - DNA, 25 bp, Homo sapien
ttagagcactgcagaacttctcctt

SEQ ID NO: 59646 - DNA, 25 bp, Homo sapien
ttgtaaagagactcagatcccactg

SEQ ID NO: 59647 - DNA, 25 bp, Homo sapien
aaagagactcagatcccactgaaat

SEQ ID NO: 59648 - DNA, 25 bp, Homo sapien
gacaatctaccaattcttcaaccag

SEQ ID NO: 59649 - DNA, 25 bp, Homo sapien
ctgcagtgacatgtacgagaaagtg

SEQ ID NO: 59650 - DNA, 25 bp, Homo sapien
gtgacatgtacgagaaagtgctgtg

SEQ ID NO: 59651 - DNA, 25 bp, Homo sapien
tacgagaaagtgctgtgcaccagct

SEQ ID NO: 59652 - DNA, 25 bp, Homo sapien
tgtgcaccagctgtgccatgttcga

SEQ ID NO: 59653 - DNA, 25 bp, Homo sapien
tgcaccagctgtgccatgttcgaga

SEQ ID NO: 59654 - DNA, 25 bp, Homo sapien
gctcaagccggctgccttcaccggg

SEQ ID NO: 59655 - DNA, 25 bp, Homo sapien
ttcaccgggagccacgccgtgcatg

SEQ ID NO: 59656 - DNA, 25 bp, Homo sapien
ggagccacgccgtgcatggcagcct

SEQ ID NO: 59657 - DNA, 25 bp, Homo sapien
gtgcatggcagccttccctggacga

SEQ ID NO: 59658 - DNA, 25 bp, Homo sapien
tgcatggcagccttccctggacgag

SEQ ID NO: 59659 - DNA, 25 bp, Homo sapien
catggcagccttccctggacgagcg

SEQ ID NO: 59660 - DNA, 25 bp, Homo sapien
tgcatggcagcttctcaaactcagc

SEQ ID NO: 59661 - DNA, 25 bp, Homo sapien
caaactcagccagaggagaaagctc

SEQ ID NO: 59662 - DNA, 25 bp, Homo sapien
gggatgcagcaagggtgtttcccct

SEQ ID NO: 59663 - DNA, 25 bp, Homo sapien
agcaagggtgtttcccctgcaatct

SEQ ID NO: 59664 - DNA, 25 bp, Homo sapien
tcctcagcctctattaacctttgaa

SEQ ID NO: 59665 - DNA, 25 bp, Homo sapien
gcctctattaacctttgaatcacca

SEQ ID NO: 59666 - DNA, 25 bp, Homo sapien
aatcaccaagaaggagagggcagtc

SEQ ID NO: 59667 - DNA, 25 bp, Homo sapien
cagggcctcagtcactgtcagagcc

SEQ ID NO: 59668 - DNA, 25 bp, Homo sapien
gcagaggacccttttcgtttccgct

SEQ ID NO: 59669 - DNA, 25 bp, Homo sapien
tttcgtttccgcttggtaggcttcg

SEQ ID NO: 59670 - DNA, 25 bp, Homo sapien
gtaggcttcggtttcgtgtcttcct

SEQ ID NO: 59671 - DNA, 25 bp, Homo sapien
tttcccttccagtgggttcctctgg

SEQ ID NO: 59672 - DNA, 25 bp, Homo sapien
ttcccttccagtgggttcctctggt

SEQ ID NO: 59673 - DNA, 25 bp, Homo sapien
tcccttccagtgggttcctctggtg

SEQ ID NO: 59674 - DNA, 25 bp, Homo sapien
ttagtcccaggaacaaaaagggcat

SEQ ID NO: 59675 - DNA, 25 bp, Homo sapien
tagtcccaggaacaaaaagggcatt

SEQ ID NO: 59676 - DNA, 25 bp, Homo sapien
aagggcatttgggtacaggggcata

SEQ ID NO: 59677 - DNA, 25 bp, Homo sapien
agggcatttgggtacaggggcatat

SEQ ID NO: 59678 - DNA, 25 bp, Homo sapien
gggcatttgggtacaggggcatata

SEQ ID NO: 59679 - DNA, 25 bp, Homo sapien
ggcatttgggtacaggggcatatac

SEQ ID NO: 59680 - DNA, 25 bp, Homo sapien
gcatttgggtacaggggcatatacc

SEQ ID NO: 59681 - DNA, 25 bp, Homo sapien
tacaggggcatatacctgtaatcct

SEQ ID NO: 59682 - DNA, 25 bp, Homo sapien
cagtgtggtttttaacagataatac

SEQ ID NO: 59683 - DNA, 25 bp, Homo sapien
catttcttccacattcagattagat

SEQ ID NO: 59684 - DNA, 25 bp, Homo sapien
ccacattcagattagattcggacat

SEQ ID NO: 59685 - DNA, 25 bp, Homo sapien
attcggacatgaatccattctataa

SEQ ID NO: 59686 - DNA, 25 bp, Homo sapien
cacatcgtgttcatgatagtgtata

SEQ ID NO: 59687 - DNA, 25 bp, Homo sapien
gaagatgtcccacttgccattaaat

SEQ ID NO: 59688 - DNA, 25 bp, Homo sapien
gccattaaatatagaagccaacttt

SEQ ID NO: 59689 - DNA, 25 bp, Homo sapien
ttaccttttgaaatatggctacatt

SEQ ID NO: 59690 - DNA, 25 bp, Homo sapien
cacagctcggtttttcttatttgtt

SEQ ID NO: 59691 - DNA, 25 bp, Homo sapien
tatttgttgagtgctattaccagga

SEQ ID NO: 59692 - DNA, 25 bp, Homo sapien
gttgagtgctattaccaggagaaat

SEQ ID NO: 59693 - DNA, 25 bp, Homo sapien
cagcatagatctttacagatacata

SEQ ID NO: 59694 - DNA, 25 bp, Homo sapien
gatctttacagatacataccttttg

SEQ ID NO: 59695 - DNA, 25 bp, Homo sapien
tttacagatacataccttttggagc

SEQ ID NO: 59696 - DNA, 25 bp, Homo sapien
gatacataccttttggagctggacc

SEQ ID NO: 59697 - DNA, 25 bp, Homo sapien
tacataccttttggagctggacccc

SEQ ID NO: 59698 - DNA, 25 bp, Homo sapien
acataccttttggagctggaccccg

SEQ ID NO: 59699 - DNA, 25 bp, Homo sapien
tgaggtttgctctcacaaacataaa

SEQ ID NO: 59700 - DNA, 25 bp, Homo sapien
taaaacttgctgtcattagagcact

SEQ ID NO: 59701 - DNA, 25 bp, Homo sapien
aacttgctgtcattagagcactgca

SEQ ID NO: 59702 - DNA, 25 bp, Homo sapien
taaagagactcagatcccactgaaa

SEQ ID NO: 59703 - DNA, 25 bp, Homo sapien
aaagagactcagatcccactgaaat

SEQ ID NO: 59704 - DNA, 25 bp, Homo sapien
acacatgtactaagggatgcagtgg

SEQ ID NO: 59705 - DNA, 25 bp, Homo sapien
tgggagagtcagtgtcacccgccag

SEQ ID NO: 59706 - DNA, 25 bp, Homo sapien
gagagtcagtgtcacccgccagcaa

SEQ ID NO: 59707 - DNA, 25 bp, Homo sapien
cagtgacacttaggcccctgggaca

SEQ ID NO: 59708 - DNA, 25 bp, Homo sapien
taggcccctgggacaatgacccaga

SEQ ID NO: 59709 - DNA, 25 bp, Homo sapien
agaagacagccatgcctccgaaaga

SEQ ID NO: 59710 - DNA, 25 bp, Homo sapien
agccatgcctccgaaagagggccag

SEQ ID NO: 59711 - DNA, 25 bp, Homo sapien
aaagagggccaggtcctaagctgct

SEQ ID NO: 59712 - DNA, 25 bp, Homo sapien
aggtcctaagctgctgcttgtgcgc

SEQ ID NO: 59713 - DNA, 25 bp, Homo sapien
aagctgctgcttgtgcgcgactgca

SEQ ID NO: 59714 - DNA, 25 bp, Homo sapien
attctcttcacctgaggctttccgt

SEQ ID NO: 59715 - DNA, 25 bp, Homo sapien
acttgtttttcttacatgtgactag

SEQ ID NO: 59716 - DNA, 25 bp, Homo sapien
atgtgactagcaactttctccactt

SEQ ID NO: 59717 - DNA, 25 bp, Homo sapien
gcaactttctccacttaaagactaa

SEQ ID NO: 59718 - DNA, 25 bp, Homo sapien
cttttaggtcagcaaaatgtgtgtc

SEQ ID NO: 59719 - DNA, 25 bp, Homo sapien
aaatgtgtgtcttcagtgctttctc

SEQ ID NO: 59720 - DNA, 25 bp, Homo sapien
cagtgctttctctaaaaacgttcct

SEQ ID NO: 59721 - DNA, 25 bp, Homo sapien
ttttttagcgttgccattgaaagtt

SEQ ID NO: 59722 - DNA, 25 bp, Homo sapien
aatgtttgcatggtttaccctctga

SEQ ID NO: 59723 - DNA, 25 bp, Homo sapien
ggtttaccctctgagttatgtttct

SEQ ID NO: 59724 - DNA, 25 bp, Homo sapien
tgtttcttctagtgagcatgcctgc

SEQ ID NO: 59725 - DNA, 25 bp, Homo sapien
gcatgcctgctgtcactaagtgaat

SEQ ID NO: 59726 - DNA, 25 bp, Homo sapien
gagctgggatgacatcttcacctga

SEQ ID NO: 59727 - DNA, 25 bp, Homo sapien
ggatgacatcttcacctgatgccac

SEQ ID NO: 59728 - DNA, 25 bp, Homo sapien
tgatgccacaactggccagactttt

SEQ ID NO: 59729 - DNA, 25 bp, Homo sapien
acaactggccagacttttggctaaa

SEQ ID NO: 59730 - DNA, 25 bp, Homo sapien
taatactggcactttagaacagatt

SEQ ID NO: 59731 - DNA, 25 bp, Homo sapien
ctgtacagatttaagagcaatgcgt

SEQ ID NO: 59732 - DNA, 25 bp, Homo sapien
gcatttcgtttggttagtcagcatt

SEQ ID NO: 59733 - DNA, 25 bp, Homo sapien
agtcagcattctttgaactgcctta

SEQ ID NO: 59734 - DNA, 25 bp, Homo sapien
aactgccttacatgttgtcaccttt

SEQ ID NO: 59735 - DNA, 25 bp, Homo sapien
gtcacctttatagaagcaatgcatt

SEQ ID NO: 59736 - DNA, 25 bp, Homo sapien
gcaatgcattacttgttttagatca

SEQ ID NO: 59737 - DNA, 25 bp, Homo sapien
tgaaatcagcactgcttgcacctac

SEQ ID NO: 59738 - DNA, 25 bp, Homo sapien
gcttgcacctacaaaaaccaggagt

SEQ ID NO: 59739 - DNA, 25 bp, Homo sapien
aaaaccaggagtgccgtttgaccat

SEQ ID NO: 59740 - DNA, 25 bp, Homo sapien
gagtgccgtttgaccatacattatg

SEQ ID NO: 59741 - DNA, 25 bp, Homo sapien
tattaccactgaaccacaggagggt

SEQ ID NO: 59742 - DNA, 25 bp, Homo sapien
accacaggagggtgcctttcccaag

SEQ ID NO: 59743 - DNA, 25 bp, Homo sapien
gcctttcccaagaccatcatacagt

SEQ ID NO: 59744 - DNA, 25 bp, Homo sapien
gaccatcatacagtctccttatgaa

SEQ ID NO: 59745 - DNA, 25 bp, Homo sapien
ggagagattcaactggaccttcatt

SEQ ID NO: 59746 - DNA, 25 bp, Homo sapien
gccccaagccaattgttttcatcat

SEQ ID NO: 59747 - DNA, 25 bp, Homo sapien
tccttcctgtcagctaagattacaa

SEQ ID NO: 59748 - DNA, 25 bp, Homo sapien
agggaaggcccctcatgcctttcct

SEQ ID NO: 59749 - DNA, 25 bp, Homo sapien
ggcttccccgaaagtctgggaccag

SEQ ID NO: 59750 - DNA, 25 bp, Homo sapien
ccgaaagtctgggaccaggtccagg

SEQ ID NO: 59751 - DNA, 25 bp, Homo sapien
gcatggaatgctgatgacttggagc

SEQ ID NO: 59752 - DNA, 25 bp, Homo sapien
tgatgacttggagcaggccccacag

SEQ ID NO: 59753 - DNA, 25 bp, Homo sapien
ccacagaccccacagaggatgaagc

SEQ ID NO: 59754 - DNA, 25 bp, Homo sapien
tgaagccaccccacagaggatgcag

SEQ ID NO: 59755 - DNA, 25 bp, Homo sapien
tggaggacagaagccctgtggatcc

SEQ ID NO: 59756 - DNA, 25 bp, Homo sapien
gtggatccccggatttcacactcct

SEQ ID NO: 59757 - DNA, 25 bp, Homo sapien
gatttcacactccttctgttttgtt

SEQ ID NO: 59758 - DNA, 25 bp, Homo sapien
tttgttgccgtttattttgtactca

SEQ ID NO: 59759 - DNA, 25 bp, Homo sapien
ggctacgtgcacttcaggcaggagc

SEQ ID NO: 59760 - DNA, 25 bp, Homo sapien
gtgcacttcaggcaggagctgaaca

SEQ ID NO: 59761 - DNA, 25 bp, Homo sapien
tgtccacaggcagccttcctctggg

SEQ ID NO: 59762 - DNA, 25 bp, Homo sapien
gctttgcatcactgggaagcaggca

SEQ ID NO: 59763 - DNA, 25 bp, Homo sapien
atcactgggaagcaggcagtgtctt

SEQ ID NO: 59764 - DNA, 25 bp, Homo sapien
ggtcagtatcctctccgtctgggtg

SEQ ID NO: 59765 - DNA, 25 bp, Homo sapien
gtatcctctccgtctgggtgcccag

SEQ ID NO: 59766 - DNA, 25 bp, Homo sapien
cacgcacacctgagctttcggcatg

SEQ ID NO: 59767 - DNA, 25 bp, Homo sapien
gcacacctgagctttcggcatgctc

SEQ ID NO: 59768 - DNA, 25 bp, Homo sapien
atgctcccacctcgttaaaggtgat

SEQ ID NO: 59769 - DNA, 25 bp, Homo sapien
tcgttaaaggtgatttccctctcaa

SEQ ID NO: 59770 - DNA, 25 bp, Homo sapien
actgcctgtaacagccacctggaga

SEQ ID NO: 59771 - DNA, 25 bp, Homo sapien
acagccacctggagaacttcataaa

SEQ ID NO: 59772 - DNA, 25 bp, Homo sapien
cttcataaagatgtctcacagccct

SEQ ID NO: 59773 - DNA, 25 bp, Homo sapien
cagcctacagggactgggcaaagat

SEQ ID NO: 59774 - DNA, 25 bp, Homo sapien
agatgatgtttccagattacactcc

SEQ ID NO: 59775 - DNA, 25 bp, Homo sapien
tagcaacctgccttgggacttagaa

SEQ ID NO: 59776 - DNA, 25 bp, Homo sapien
tgccttgggacttagaacaccgccg

SEQ ID NO: 59777 - DNA, 25 bp, Homo sapien
tgtgggccctctttcaaagtccagc

SEQ ID NO: 59778 - DNA, 25 bp, Homo sapien
aagtccagcctagtctggactgctt

SEQ ID NO: 59779 - DNA, 25 bp, Homo sapien
agccttcccaaggttctatcctgtt

SEQ ID NO: 59780 - DNA, 25 bp, Homo sapien
ttctatcctgttccgagcaactttt

SEQ ID NO: 59781 - DNA, 25 bp, Homo sapien
gaaaaccatgatgggcctccagcag

SEQ ID NO: 59782 - DNA, 25 bp, Homo sapien
cctccagcaggcacatagaaaatag

SEQ ID NO: 59783 - DNA, 25 bp, Homo sapien
aaatagaacctcatcgccagtacct

SEQ ID NO: 59784 - DNA, 25 bp, Homo sapien
ctcatcgccagtaccttaaaggaca

SEQ ID NO: 59785 - DNA, 25 bp, Homo sapien
gcaactcccacctactgtagtggag

SEQ ID NO: 59786 - DNA, 25 bp, Homo sapien
cctgtactccaatgctgggacccag

SEQ ID NO: 59787 - DNA, 25 bp, Homo sapien
ggacccagcacagcgaacacatttg

SEQ ID NO: 59788 - DNA, 25 bp, Homo sapien
aggagcatcctccaaggacaacctt

SEQ ID NO: 59789 - DNA, 25 bp, Homo sapien
ggacaaccttgctcatctccacaga

SEQ ID NO: 59790 - DNA, 25 bp, Homo sapien
ttgggttttaattcactgtcttata

SEQ ID NO: 59791 - DNA, 25 bp, Homo sapien
aattcactgtcttatatgcagggac

SEQ ID NO: 59792 - DNA, 25 bp, Homo sapien
ggagacgtccctctaacaagaactt

SEQ ID NO: 59793 - DNA, 25 bp, Homo sapien
aagaacttgcctcagcacatgcgca

SEQ ID NO: 59794 - DNA, 25 bp, Homo sapien
acgcacactcggactcacacgaagt

SEQ ID NO: 59795 - DNA, 25 bp, Homo sapien
tcacacgaagtcacacgcacacatg

SEQ ID NO: 59796 - DNA, 25 bp, Homo sapien
cctgcgcacctgcaaaacgagggaa

SEQ ID NO: 59797 - DNA, 25 bp, Homo sapien
cgagggaacaactaaggtggctgaa

SEQ ID NO: 59798 - DNA, 25 bp, Homo sapien
gctgaagacctttctggcagggcat

SEQ ID NO: 59799 - DNA, 25 bp, Homo sapien
ggcagggcatttgcaaggacccaaa

SEQ ID NO: 59800 - DNA, 25 bp, Homo sapien
ttgcaaggacccaaatccattcaac

SEQ ID NO: 59801 - DNA, 25 bp, Homo sapien
cattcaacaagggtgcagcctgcca

SEQ ID NO: 59802 - DNA, 25 bp, Homo sapien
acaggctcctcatccggactgagga

SEQ ID NO: 59803 - DNA, 25 bp, Homo sapien
cataattagtgctgtacatttgatt

SEQ ID NO: 59804 - DNA, 25 bp, Homo sapien
gattgcaaacaaattggtgatactt

SEQ ID NO: 59805 - DNA, 25 bp, Homo sapien
ggtgatacttctaaactataactat

SEQ ID NO: 59806 - DNA, 25 bp, Homo sapien
actataaatctctagaattctgtga

SEQ ID NO: 59807 - DNA, 25 bp, Homo sapien
gaattctgtgaatttcaacattatt

SEQ ID NO: 59808 - DNA, 25 bp, Homo sapien
acttttagcttaggaagtcttccag

SEQ ID NO: 59809 - DNA, 25 bp, Homo sapien
taggaagtcttccagaatacaaact

SEQ ID NO: 59810 - DNA, 25 bp, Homo sapien
ttccagaatacaaactactcccagt

SEQ ID NO: 59811 - DNA, 25 bp, Homo sapien
gaatacaaactactcccagttagat

SEQ ID NO: 59812 - DNA, 25 bp, Homo sapien
actactcccagttagatatcagtga

SEQ ID NO: 59813 - DNA, 25 bp, Homo sapien
tcccagttagatatcagtgagtttg

SEQ ID NO: 59814 - DNA, 25 bp, Homo sapien
gccaaccgtggacctctttgaggat

SEQ ID NO: 59815 - DNA, 25 bp, Homo sapien
acctctttgaggatatgatgacagc

SEQ ID NO: 59816 - DNA, 25 bp, Homo sapien
atgatgacagctacataccttcccc

SEQ ID NO: 59817 - DNA, 25 bp, Homo sapien
ttcccctcaaaaaagatagtactca

SEQ ID NO: 59818 - DNA, 25 bp, Homo sapien
gatagtactcacaattctacctgta

SEQ ID NO: 59819 - DNA, 25 bp, Homo sapien
caattctacctgtaatttcagagag

SEQ ID NO: 59820 - DNA, 25 bp, Homo sapien
gagttaatggaacccttgatgccta

SEQ ID NO: 59821 - DNA, 25 bp, Homo sapien
aacccttgatgcctaaagacctcag

SEQ ID NO: 59822 - DNA, 25 bp, Homo sapien
gagacattcatagatgagcacaatt

SEQ ID NO: 59823 - DNA, 25 bp, Homo sapien
gagcacaatttgataaccgataata

SEQ ID NO: 59824 - DNA, 25 bp, Homo sapien
taaaaggagcccttaccagattctt

SEQ ID NO: 59825 - DNA, 25 bp, Homo sapien
ccacagttgctctatgctttccaaa

SEQ ID NO: 59826 - DNA, 25 bp, Homo sapien
ttgctctatgctttccaaaccttat

SEQ ID NO: 59827 - DNA, 25 bp, Homo sapien
tgctttccaaaccttatctccacaa

SEQ ID NO: 59828 - DNA, 25 bp, Homo sapien
agcctgctagctagctcaactagtg

SEQ ID NO: 59829 - DNA, 25 bp, Homo sapien
gtttcctggcactggaccccagcaa

SEQ ID NO: 59830 - DNA, 25 bp, Homo sapien
ccagcaagtggtcctagaggccctt

SEQ ID NO: 59831 - DNA, 25 bp, Homo sapien
tagaggccctttgctgtcccatagt

SEQ ID NO: 59832 - DNA, 25 bp, Homo sapien
atagtccctgccacgaatttctgtg

SEQ ID NO: 59833 - DNA, 25 bp, Homo sapien
gccacgaatttctgtgccctcctga

SEQ ID NO: 59834 - DNA, 25 bp, Homo sapien
ctcctgacccattgctgttgtccaa

SEQ ID NO: 59835 - DNA, 25 bp, Homo sapien
gggtccttcctgaaactatattttg

SEQ ID NO: 59836 - DNA, 25 bp, Homo sapien
tttggttgtgttctatcaaccccac

SEQ ID NO: 59837 - DNA, 25 bp, Homo sapien
gttgtgttctatcaaccccaccaga

SEQ ID NO: 59838 - DNA, 25 bp, Homo sapien
gtgttctatcaaccccaccagagtt

SEQ ID NO: 59839 - DNA, 25 bp, Homo sapien
accagagttccctaaacttgcttca

SEQ ID NO: 59840 - DNA, 25 bp, Homo sapien
gagttccctaaacttgcttcagtta

SEQ ID NO: 59841 - DNA, 25 bp, Homo sapien
gttccctaaacttgcttcagttata

SEQ ID NO: 59842 - DNA, 25 bp, Homo sapien
gcttcagttatagtaactgactggt

SEQ ID NO: 59843 - DNA, 25 bp, Homo sapien
attcagaagcgccataagtcagttg

SEQ ID NO: 59844 - DNA, 25 bp, Homo sapien
gaagcgccataagtcagttgagtat

SEQ ID NO: 59845 - DNA, 25 bp, Homo sapien
ggtcatacagggtaagcaccaggga

SEQ ID NO: 59846 - DNA, 25 bp, Homo sapien
tacagggtaagcaccagggacaata

SEQ ID NO: 59847 - DNA, 25 bp, Homo sapien
aaacttggatgcttaagaggcctgc

SEQ ID NO: 59848 - DNA, 25 bp, Homo sapien
aagaggcctgcatatagataagaat

SEQ ID NO: 59849 - DNA, 25 bp, Homo sapien
gaatttcaggcaaaactacatttat

SEQ ID NO: 59850 - DNA, 25 bp, Homo sapien
taacagcttgttcataggctcttgt

SEQ ID NO: 59851 - DNA, 25 bp, Homo sapien
tatattgaggttattgtttgtcggt

SEQ ID NO: 59852 - DNA, 25 bp, Homo sapien
attgtttgtcggtgaagtgttagtc

SEQ ID NO: 59853 - DNA, 25 bp, Homo sapien
gtcggtgaagtgttagtcacagtat

SEQ ID NO: 59854 - DNA, 25 bp, Homo sapien
caaaagtttgcacatattgttctgt

SEQ ID NO: 59855 - DNA, 25 bp, Homo sapien
tctgtgtaattgtgtaagccataat

SEQ ID NO: 59856 - DNA, 25 bp, Homo sapien
ttctcttttcctattacatcattca

SEQ ID NO: 59857 - DNA, 25 bp, Homo sapien
aagtgatcactttaccattttgaaa

SEQ ID NO: 59858 - DNA, 25 bp, Homo sapien
actgggctgtagttagcttttcatc

SEQ ID NO: 59859 - DNA, 25 bp, Homo sapien
ggctgtagttagcttttcatcccta

SEQ ID NO: 59860 - DNA, 25 bp, Homo sapien
gtagttagcttttcatccctaaaga

SEQ ID NO: 59861 - DNA, 25 bp, Homo sapien
gttagcttttcatccctaaagaagg

SEQ ID NO: 59862 - DNA, 25 bp, Homo sapien
tcatccctaaagaaggctttcccta

SEQ ID NO: 59863 - DNA, 25 bp, Homo sapien
gaaggctttccctaaggaaccatag

SEQ ID NO: 59864 - DNA, 25 bp, Homo sapien
tttccctaaggaaccatagaagaga

SEQ ID NO: 59865 - DNA, 25 bp, Homo sapien
catgtgtgagggaagctgcttgggt

SEQ ID NO: 59866 - DNA, 25 bp, Homo sapien
aagctgcttgggtgggtgttagggc

SEQ ID NO: 59867 - DNA, 25 bp, Homo sapien
gtgttagggctatgaaatcttggat

SEQ ID NO: 59868 - DNA, 25 bp, Homo sapien
acactcaaaggctaaactggtgtca

SEQ ID NO: 59869 - DNA, 25 bp, Homo sapien
atgaattcatctcagtccaggcaac

SEQ ID NO: 59870 - DNA, 25 bp, Homo sapien
aggtgaacctggattcttgcaccag

SEQ ID NO: 59871 - DNA, 25 bp, Homo sapien
gcaccagggaagagacaagccggaa

SEQ ID NO: 59872 - DNA, 25 bp, Homo sapien
aagccggaacatgctagagcctaca

SEQ ID NO: 59873 - DNA, 25 bp, Homo sapien
gagcctacaataacctgctttgatg

SEQ ID NO: 59874 - DNA, 25 bp, Homo sapien
gaagattttcaacctgatggagaag

SEQ ID NO: 59875 - DNA, 25 bp, Homo sapien
atggagaaggattcctaccgccgct

SEQ ID NO: 59876 - DNA, 25 bp, Homo sapien
gcttcctcaagtctcgattctatct

SEQ ID NO: 59877 - DNA, 25 bp, Homo sapien
tatcttgatttggtcaacccgtcca

SEQ ID NO: 59878 - DNA, 25 bp, Homo sapien
aaaggagccaagagttcagcagact

SEQ ID NO: 59879 - DNA, 25 bp, Homo sapien
ggtccctcagtgtgcctaattctca

SEQ ID NO: 59880 - DNA, 25 bp, Homo sapien
taagaactttggcttagagagcttt

SEQ ID NO: 59881 - DNA, 25 bp, Homo sapien
gagagctttccaggtgtagtgccaa

SEQ ID NO: 59882 - DNA, 25 bp, Homo sapien
tgtagtgccaataaaaactgacctg

SEQ ID NO: 59883 - DNA, 25 bp, Homo sapien
gaaagaaaacctgcccagcacggaa

SEQ ID NO: 59884 - DNA, 25 bp, Homo sapien
gcccagcacggaacatgctttctga

SEQ ID NO: 59885 - DNA, 25 bp, Homo sapien
tgctttctgaactcacttgagagtg

SEQ ID NO: 59886 - DNA, 25 bp, Homo sapien
gtatgtcacttctcatatattcttg

SEQ ID NO: 59887 - DNA, 25 bp, Homo sapien
gtcttttatacaatttttagctctt

SEQ ID NO: 59888 - DNA, 25 bp, Homo sapien
tttagctcttttccagttcacttgt

SEQ ID NO: 59889 - DNA, 25 bp, Homo sapien
agttcacttgtgctcgtctgtatat

SEQ ID NO: 59890 - DNA, 25 bp, Homo sapien
tgtgctcgtctgtatattggtattt

SEQ ID NO: 59891 - DNA, 25 bp, Homo sapien
caggccacatccaggccgtgtatgt

SEQ ID NO: 59892 - DNA, 25 bp, Homo sapien
tgcagaacgtggtcaagctctacgc

SEQ ID NO: 59893 - DNA, 25 bp, Homo sapien
acgtggtcaagctctacgcctccat

SEQ ID NO: 59894 - DNA, 25 bp, Homo sapien
aggcagagggcgctcaggccgtcac

SEQ ID NO: 59895 - DNA, 25 bp, Homo sapien
agctcatggtggaccggctgcccca

SEQ ID NO: 59896 - DNA, 25 bp, Homo sapien
gaccggctgccccagtttgtgcaga

SEQ ID NO: 59897 - DNA, 25 bp, Homo sapien
agtttgtgcagagcgcagacctgga

SEQ ID NO: 59898 - DNA, 25 bp, Homo sapien
aggagcgggcgtcctgcatcctgca

SEQ ID NO: 59899 - DNA, 25 bp, Homo sapien
cagctggtcaagcacatccagaagc

SEQ ID NO: 59900 - DNA, 25 bp, Homo sapien
ggtcaagcacatccagaagcttcag

SEQ ID NO: 59901 - DNA, 25 bp, Homo sapien
gaagcttcaggccaaggacgtgcct

SEQ ID NO: 59902 - DNA, 25 bp, Homo sapien
gaagtagccaactctattttacaga

SEQ ID NO: 59903 - DNA, 25 bp, Homo sapien
gattctataaacaagcattctccaa

SEQ ID NO: 59904 - DNA, 25 bp, Homo sapien
agaagacctctctcctgtgggtgca

SEQ ID NO: 59905 - DNA, 25 bp, Homo sapien
tcctgtgggtgcaattgaactgttc

SEQ ID NO: 59906 - DNA, 25 bp, Homo sapien
tgaactgttcatccgttcatcttgc

SEQ ID NO: 59907 - DNA, 25 bp, Homo sapien
atccgttcatcttgctgagagactt

SEQ ID NO: 59908 - DNA, 25 bp, Homo sapien
taatatatccttactctcgaagtgt

SEQ ID NO: 59909 - DNA, 25 bp, Homo sapien
actctcgaagtgttccctttgtata

SEQ ID NO: 59910 - DNA, 25 bp, Homo sapien
tgcattgactggaagctccttttct

SEQ ID NO: 59911 - DNA, 25 bp, Homo sapien
gtacatggactcttatgatattgtt

SEQ ID NO: 59912 - DNA, 25 bp, Homo sapien
gatgaatcattagaagtagccaact

SEQ ID NO: 59913 - DNA, 25 bp, Homo sapien
cttctctagcttttcactagctgtg

SEQ ID NO: 59914 - DNA, 25 bp, Homo sapien
actagctgtgaaccagccttcctgt

SEQ ID NO: 59915 - DNA, 25 bp, Homo sapien
agccttcctgtccatggacgtgaaa

SEQ ID NO: 59916 - DNA, 25 bp, Homo sapien
aaactgcatagtaatgagactgtgc

SEQ ID NO: 59917 - DNA, 25 bp, Homo sapien
gagactgtgcacactgatgtttaca

SEQ ID NO: 59918 - DNA, 25 bp, Homo sapien
gtgcacactgatgtttacaagattg

SEQ ID NO: 59919 - DNA, 25 bp, Homo sapien
gagtctttctccgaaaatcatggta

SEQ ID NO: 59920 - DNA, 25 bp, Homo sapien
tatgctttctggagaactgtacctt

SEQ ID NO: 59921 - DNA, 25 bp, Homo sapien
ggtttgcttgcacatcagtagtttc

SEQ ID NO: 59922 - DNA, 25 bp, Homo sapien
ctgctgaacgtgctgtcataatgaa

SEQ ID NO: 59923 - DNA, 25 bp, Homo sapien
gctgtcataatgaagagatttccaa

SEQ ID NO: 59924 - DNA, 25 bp, Homo sapien
gtttgtgaccactaagcttctgtct

SEQ ID NO: 59925 - DNA, 25 bp, Homo sapien
gaccactaagcttctgtcttaatac

SEQ ID NO: 59926 - DNA, 25 bp, Homo sapien
gtcttaatacaaagctgttaccttc

SEQ ID NO: 59927 - DNA, 25 bp, Homo sapien
gagagaacaggccttgtgtaacaga

SEQ ID NO: 59928 - DNA, 25 bp, Homo sapien
ggccttgtgtaacagaagatactct

SEQ ID NO: 59929 - DNA, 25 bp, Homo sapien
tttatgctccttactgtgatcacag

SEQ ID NO: 59930 - DNA, 25 bp, Homo sapien
gataaacattttatgcttgcattta

SEQ ID NO: 59931 - DNA, 25 bp, Homo sapien
ttatgcttgcatttaaacttgaaat

SEQ ID NO: 59932 - DNA, 25 bp, Homo sapien
gagcagaatgagacaatcagttaaa

SEQ ID NO: 59933 - DNA, 25 bp, Homo sapien
gtattataatgtaaaggccttgttt

SEQ ID NO: 59934 - DNA, 25 bp, Homo sapien
tgctgtagcaataaaatgaccaagt

SEQ ID NO: 59935 - DNA, 25 bp, Homo sapien
gggccccttgagaatggtgatccac

SEQ ID NO: 59936 - DNA, 25 bp, Homo sapien
aatggtgatccacccagttacaggg

SEQ ID NO: 59937 - DNA, 25 bp, Homo sapien
tcggaagcccgggagcccagtatgg

SEQ ID NO: 59938 - DNA, 25 bp, Homo sapien
ggaagggtcttacctcagcagttac

SEQ ID NO: 59939 - DNA, 25 bp, Homo sapien
acttgcccagcacaggcctggtgct

SEQ ID NO: 59940 - DNA, 25 bp, Homo sapien
tggtgctcaagatctcgcctcaggg

SEQ ID NO: 59941 - DNA, 25 bp, Homo sapien
tcaagatctcgcctcagggctcctt

SEQ ID NO: 59942 - DNA, 25 bp, Homo sapien
cttcctccagtcttggagcattttt

SEQ ID NO: 59943 - DNA, 25 bp, Homo sapien
agcattttttcgaggtgacctgcct

SEQ ID NO: 59944 - DNA, 25 bp, Homo sapien
cctgcgtcacactgtgtgaggctgt

SEQ ID NO: 59945 - DNA, 25 bp, Homo sapien
tgtgtctctgccatccaaaaggggg

SEQ ID NO: 59946 - DNA, 25 bp, Homo sapien
atggtcggtaaagtgttctttcata

SEQ ID NO: 59947 - DNA, 25 bp, Homo sapien
tcaagacatggtcccatttgcagga

SEQ ID NO: 59948 - DNA, 25 bp, Homo sapien
gcagactctgagtgttccagggaaa

SEQ ID NO: 59949 - DNA, 25 bp, Homo sapien
ggaaacacatgctggacatcccttg

SEQ ID NO: 59950 - DNA, 25 bp, Homo sapien
ggacatcccttgtaacccggtatgg

SEQ ID NO: 59951 - DNA, 25 bp, Homo sapien
tatgggcgcccctgcattgctggga

SEQ ID NO: 59952 - DNA, 25 bp, Homo sapien
ctgcattgctgggatgtttctgccc

SEQ ID NO: 59953 - DNA, 25 bp, Homo sapien
ctgcccacggttttgtttgtgcaat

SEQ ID NO: 59954 - DNA, 25 bp, Homo sapien
gtgcaataacgttatcacatttcta

SEQ ID NO: 59955 - DNA, 25 bp, Homo sapien
aggtcagttactggtctctttctgc

SEQ ID NO: 59956 - DNA, 25 bp, Homo sapien
tggtctctttctgccgaatgttatg

SEQ ID NO: 59957 - DNA, 25 bp, Homo sapien
gggccccttgagaatggtgatccac

SEQ ID NO: 59958 - DNA, 25 bp, Homo sapien
ttacaggggcatttagggagcagat

SEQ ID NO: 59959 - DNA, 25 bp, Homo sapien
gcctgagggcagggctctacctccc

SEQ ID NO: 59960 - DNA, 25 bp, Homo sapien
ctcccctgcgtcacactgtgtgagg

SEQ ID NO: 59961 - DNA, 25 bp, Homo sapien
tcccctgcgtcacactgtgtgaggc

SEQ ID NO: 59962 - DNA, 25 bp, Homo sapien
cccctgcgtcacactgtgtgaggct

SEQ ID NO: 59963 - DNA, 25 bp, Homo sapien
cctgcgtcacactgtgtgaggctgt

SEQ ID NO: 59964 - DNA, 25 bp, Homo sapien
tgtgtctctgccatccaaaaggggg

SEQ ID NO: 59965 - DNA, 25 bp, Homo sapien
gtgtctctgccatccaaaagggggc

SEQ ID NO: 59966 - DNA, 25 bp, Homo sapien
gtctctgccatccaaaagggggccc

SEQ ID NO: 59967 - DNA, 25 bp, Homo sapien
ctgccatccaaaagggggccccttg

SEQ ID NO: 59968 - DNA, 25 bp, Homo sapien
agccagaggcatccatgaacttcac

SEQ ID NO: 59969 - DNA, 25 bp, Homo sapien
tgaacttcacacttgcgggctgcat

SEQ ID NO: 59970 - DNA, 25 bp, Homo sapien
atggacaataggtgctgcatcccct

SEQ ID NO: 59971 - DNA, 25 bp, Homo sapien
tgcatcccctacaagtctaagacta

SEQ ID NO: 59972 - DNA, 25 bp, Homo sapien
tctaagactatcgacgtgtccttcc

SEQ ID NO: 59973 - DNA, 25 bp, Homo sapien
cagtgtcctgatgggcttggcttct

SEQ ID NO: 59974 - DNA, 25 bp, Homo sapien
tcccgccaggtcctatggattaatg

SEQ ID NO: 59975 - DNA, 25 bp, Homo sapien
attaatgcctgcttctgtaacctga

SEQ ID NO: 59976 - DNA, 25 bp, Homo sapien
gtaacctgagctgtaggaatcccaa

SEQ ID NO: 59977 - DNA, 25 bp, Homo sapien
tgacttggaatcctaccctgacttc

SEQ ID NO: 59978 - DNA, 25 bp, Homo sapien
gacttctcagaaattgccaactagg

SEQ ID NO: 59979 - DNA, 25 bp, Homo sapien
ataatgctacacagtcacagtcgac

SEQ ID NO: 59980 - DNA, 25 bp, Homo sapien
gtcacagtcgactttttgcaaaagt

SEQ ID NO: 59981 - DNA, 25 bp, Homo sapien
gaaacagtgcttataaagccccata

SEQ ID NO: 59982 - DNA, 25 bp, Homo sapien
aaagccccatatactccttagatat

SEQ ID NO: 59983 - DNA, 25 bp, Homo sapien
atatactccttagatatttcccaag

SEQ ID NO: 59984 - DNA, 25 bp, Homo sapien
aaggatttcttctcttggctagcag

SEQ ID NO: 59985 - DNA, 25 bp, Homo sapien
tggctagcaggaaaacaatcttaat

SEQ ID NO: 59986 - DNA, 25 bp, Homo sapien
acactttgtgcacatgtttccaaca

SEQ ID NO: 59987 - DNA, 25 bp, Homo sapien
gtgcacatgtttccaacaatttcat

SEQ ID NO: 59988 - DNA, 25 bp, Homo sapien
gcatctttacataaggtagtagcta

SEQ ID NO: 59989 - DNA, 25 bp, Homo sapien
gtagctaataactctttctgtggac

SEQ ID NO: 59990 - DNA, 25 bp, Homo sapien
aaattctttcacttcattatatgca

SEQ ID NO: 59991 - DNA, 25 bp, Homo sapien
gcaagttttcaataattaggtctaa

SEQ ID NO: 59992 - DNA, 25 bp, Homo sapien
ggagttttaaggttactgatgactt

SEQ ID NO: 59993 - DNA, 25 bp, Homo sapien
gatgacttacaaataatgggctctg

SEQ ID NO: 59994 - DNA, 25 bp, Homo sapien
taatgggctctgattgggcaatact

SEQ ID NO: 59995 - DNA, 25 bp, Homo sapien
attcatgggctcatctttaaagctt

SEQ ID NO: 59996 - DNA, 25 bp, Homo sapien
gggctcatctttaaagcttttacta

SEQ ID NO: 59997 - DNA, 25 bp, Homo sapien
agattttcagctgaatggaactcat

SEQ ID NO: 59998 - DNA, 25 bp, Homo sapien
ctcattagctgtgtgcatataaaaa

SEQ ID NO: 59999 - DNA, 25 bp, Homo sapien
gagacatttgatcccttgtttgctt

SEQ ID NO: 60000 - DNA, 25 bp, Homo sapien
ttgatcccttgtttgcttaataaat

SEQ ID NO: 60001 - DNA, 25 bp, Homo sapien
gccatccttcagcagcgatgccagg

SEQ ID NO: 60002 - DNA, 25 bp, Homo sapien
atgccaggctagcaccaccgtcaat

SEQ ID NO: 60003 - DNA, 25 bp, Homo sapien
acctcggctggctattgcttgaaga

SEQ ID NO: 60004 - DNA, 25 bp, Homo sapien
gcttgaagagtatcagctccctcga

SEQ ID NO: 60005 - DNA, 25 bp, Homo sapien
agtatcagctccctcgaaaacacat

SEQ ID NO: 60006 - DNA, 25 bp, Homo sapien
gctccctcgaaaacacatccaaggt

SEQ ID NO: 60007 - DNA, 25 bp, Homo sapien
atccaaggtctagaaaaggccctca

SEQ ID NO: 60008 - DNA, 25 bp, Homo sapien
aaaggccctcaaacctggcaagaag

SEQ ID NO: 60009 - DNA, 25 bp, Homo sapien
gaagaagtgacagactcttttgtct

SEQ ID NO: 60010 - DNA, 25 bp, Homo sapien
gactcttttgtctcacgtggtggat

SEQ ID NO: 60011 - DNA, 25 bp, Homo sapien
cattttcagcttttgcaaatacaaa

SEQ ID NO: 60012 - DNA, 25 bp, Homo sapien
acttgacaaaggtaatgactcttct

SEQ ID NO: 60013 - DNA, 25 bp, Homo sapien
tgactcttctaagtgtattcagaac

SEQ ID NO: 60014 - DNA, 25 bp, Homo sapien
gtgtattcagaactagtttccttgc

SEQ ID NO: 60015 - DNA, 25 bp, Homo sapien
tcagaactagtttccttgcatgtaa

SEQ ID NO: 60016 - DNA, 25 bp, Homo sapien
aattctacatgcacattaatttttt

SEQ ID NO: 60017 - DNA, 25 bp, Homo sapien
gaagtaagtcatttagtcgatcata

SEQ ID NO: 60018 - DNA, 25 bp, Homo sapien
ttagtcgatcataaaatattcctgt

SEQ ID NO: 60019 - DNA, 25 bp, Homo sapien
ttttaatagctgacaaatgacactg

SEQ ID NO: 60020 - DNA, 25 bp, Homo sapien
agctgacaaatgacactgattggaa

SEQ ID NO: 60021 - DNA, 25 bp, Homo sapien
gaactcaaatgtagctgtttaccct

SEQ ID NO: 60022 - DNA, 25 bp, Homo sapien
tgtagctgtttaccctcagtgtatt

SEQ ID NO: 60023 - DNA, 25 bp, Homo sapien
ggcgtgaagcgcatctccggcctca

SEQ ID NO: 60024 - DNA, 25 bp, Homo sapien
gtgaagcgcatctccggcctcatct

SEQ ID NO: 60025 - DNA, 25 bp, Homo sapien
catctccggcctcatctacgaggag

SEQ ID NO: 60026 - DNA, 25 bp, Homo sapien
gcaccctctacggtttcggtggttg

SEQ ID NO: 60027 - DNA, 25 bp, Homo sapien
cgctaagcgccaccgtaaagtactg

SEQ ID NO: 60028 - DNA, 25 bp, Homo sapien
ctaagcgccaccgtaaagtactgcg

SEQ ID NO: 60029 - DNA, 25 bp, Homo sapien
agcgccaccgtaaagtactgcgcga

SEQ ID NO: 60030 - DNA, 25 bp, Homo sapien
ccaccgtaaagtactgcgcgacaat

SEQ ID NO: 60031 - DNA, 25 bp, Homo sapien
ccgtaaagtactgcgcgacaatatc

SEQ ID NO: 60032 - DNA, 25 bp, Homo sapien
gtactgcgcgacaatatccagggca

SEQ ID NO: 60033 - DNA, 25 bp, Homo sapien
actgcgcgacaatatccagggcatc

SEQ ID NO: 60034 - DNA, 25 bp, Homo sapien
aaatattatcctatcagagactgac

SEQ ID NO: 60035 - DNA, 25 bp, Homo sapien
cagggaccctcttcaggtggtataa

SEQ ID NO: 60036 - DNA, 25 bp, Homo sapien
cattctacaaatcagctggatgcca

SEQ ID NO: 60037 - DNA, 25 bp, Homo sapien
agctggatgccaacttaaatttgta

SEQ ID NO: 60038 - DNA, 25 bp, Homo sapien
agtcagtgggactggtgtgcttcca

SEQ ID NO: 60039 - DNA, 25 bp, Homo sapien
actggtgtgcttccagagagtgtct

SEQ ID NO: 60040 - DNA, 25 bp, Homo sapien
gagagtgtcttcgagggtatcatca

SEQ ID NO: 60041 - DNA, 25 bp, Homo sapien
gggtatcatcatttccggtttgtta

SEQ ID NO: 60042 - DNA, 25 bp, Homo sapien
tccggtttgttaatcttattcacca

SEQ ID NO: 60043 - DNA, 25 bp, Homo sapien
attcaccaaatgttctatcgctcgt

SEQ ID NO: 60044 - DNA, 25 bp, Homo sapien
tctatcgctcgtaaggtaaaactgt

SEQ ID NO: 60045 - DNA, 25 bp, Homo sapien
aaagtgtttatcttcagcaccaaat

SEQ ID NO: 60046 - DNA, 25 bp, Homo sapien
gtttatcttcagcaccaaatacatg

SEQ ID NO: 60047 - DNA, 25 bp, Homo sapien
tcaatcactatttataaacagagct

SEQ ID NO: 60048 - DNA, 25 bp, Homo sapien
cagagctttcaaacactcctcagaa

SEQ ID NO: 60049 - DNA, 25 bp, Homo sapien
acactcctcagaatattcttctaag

SEQ ID NO: 60050 - DNA, 25 bp, Homo sapien
ggaaacactgattaactgcaagtct

SEQ ID NO: 60051 - DNA, 25 bp, Homo sapien
actgcaagtcttcatgattctgtca

SEQ ID NO: 60052 - DNA, 25 bp, Homo sapien
agtcttcatgattctgtcatattaa

SEQ ID NO: 60053 - DNA, 25 bp, Homo sapien
gtcatattaagaaacacctgtaggt

SEQ ID NO: 60054 - DNA, 25 bp, Homo sapien
gaaacacctgtaggtttgcttcaaa

SEQ ID NO: 60055 - DNA, 25 bp, Homo sapien
aggcatatataccaaggacttacag

SEQ ID NO: 60056 - DNA, 25 bp, Homo sapien
ggttcatgacttacttgctagcgtc

SEQ ID NO: 60057 - DNA, 25 bp, Homo sapien
ttacttgctagcgtcccttcatttt

SEQ ID NO: 60058 - DNA, 25 bp, Homo sapien
gtcccttcattttcccacaagtttg

SEQ ID NO: 60059 - DNA, 25 bp, Homo sapien
cctttcacgtagacacacctggctg

SEQ ID NO: 60060 - DNA, 25 bp, Homo sapien
acgtagacacacctggctgccttct

SEQ ID NO: 60061 - DNA, 25 bp, Homo sapien
ggctgccttcttcacgccctgagga

SEQ ID NO: 60062 - DNA, 25 bp, Homo sapien
gccctgaggacacttcttggagatt

SEQ ID NO: 60063 - DNA, 25 bp, Homo sapien
ggacacttcttggagatttcagaca

SEQ ID NO: 60064 - DNA, 25 bp, Homo sapien
ggagatttcagacaggcagcaccag

SEQ ID NO: 60065 - DNA, 25 bp, Homo sapien
agcaccagggctcctgactgaaagg

SEQ ID NO: 60066 - DNA, 25 bp, Homo sapien
tggtgggcctttaggtctgccccat

SEQ ID NO: 60067 - DNA, 25 bp, Homo sapien
gcatccagccctgagacatgtagga

SEQ ID NO: 60068 - DNA, 25 bp, Homo sapien
atgtaggaaacacctttcagaccca

SEQ ID NO: 60069 - DNA, 25 bp, Homo sapien
acccaggctctgaagattcccagaa

SEQ ID NO: 60070 - DNA, 25 bp, Homo sapien
gaagattcccagaagccacaaggat

SEQ ID NO: 60071 - DNA, 25 bp, Homo sapien
aaggtgatcctggtaactgttccag

SEQ ID NO: 60072 - DNA, 25 bp, Homo sapien
ggtaactgttccaggattgctccag

SEQ ID NO: 60073 - DNA, 25 bp, Homo sapien
gttccaggattgctccaggtttgag

SEQ ID NO: 60074 - DNA, 25 bp, Homo sapien
ccaggtttgagatggtattgctaaa

SEQ ID NO: 60075 - DNA, 25 bp, Homo sapien
cagcttttaaagtgtcttctatctc

SEQ ID NO: 60076 - DNA, 25 bp, Homo sapien
gtgtcttctatctcattgtattttt

SEQ ID NO: 60077 - DNA, 25 bp, Homo sapien
ttaacttgccccaatgatagaaaag

SEQ ID NO: 60078 - DNA, 25 bp, Homo sapien
tccttaggcaaccaccatacttatt

SEQ ID NO: 60079 - DNA, 25 bp, Homo sapien
atacttattgtaacctgcctctgac

SEQ ID NO: 60080 - DNA, 25 bp, Homo sapien
tctgacgctactcaacggacagcta

SEQ ID NO: 60081 - DNA, 25 bp, Homo sapien
tcaacggacagctaccccttaataa

SEQ ID NO: 60082 - DNA, 25 bp, Homo sapien
ttaataacaccctgaaagataccca

SEQ ID NO: 60083 - DNA, 25 bp, Homo sapien
gatacccaggaatttcacaggaaca

SEQ ID NO: 60084 - DNA, 25 bp, Homo sapien
caggaacagttctttgctgccttta

SEQ ID NO: 60085 - DNA, 25 bp, Homo sapien
ctgcctttatcctccaaagagctta

SEQ ID NO: 60086 - DNA, 25 bp, Homo sapien
agagcttagctttaccagtgatatt

SEQ ID NO: 60087 - DNA, 25 bp, Homo sapien
aatctgaattcctctgaacagctag

SEQ ID NO: 60088 - DNA, 25 bp, Homo sapien
gcataaagtacacctaataacgttg

SEQ ID NO: 60089 - DNA, 25 bp, Homo sapien
gtcctggccaggccatgctacacta

SEQ ID NO: 60090 - DNA, 25 bp, Homo sapien
tgttccacccaggaggaggaaactt

SEQ ID NO: 60091 - DNA, 25 bp, Homo sapien
cacccaggaggaggaaacttcacat

SEQ ID NO: 60092 - DNA, 25 bp, Homo sapien
aggaaacttcacatagccgtgctca

SEQ ID NO: 60093 - DNA, 25 bp, Homo sapien
ttcacatagccgtgctcacagtttt

SEQ ID NO: 60094 - DNA, 25 bp, Homo sapien
atagccgtgctcacagttttttatt

SEQ ID NO: 60095 - DNA, 25 bp, Homo sapien
ggctccctgtgatctgaagaaagct

SEQ ID NO: 60096 - DNA, 25 bp, Homo sapien
ctgtgatctgaagaaagcttttggt

SEQ ID NO: 60097 - DNA, 25 bp, Homo sapien
tttggtgcttgtcctcacaaccacc

SEQ ID NO: 60098 - DNA, 25 bp, Homo sapien
ctcctcctgggttcatgttgtaata

SEQ ID NO: 60099 - DNA, 25 bp, Homo sapien
cctcctgggttcatgttgtaataaa

SEQ ID NO: 60100 - DNA, 25 bp, Homo sapien
gcccattgagccaataactgctgct

SEQ ID NO: 60101 - DNA, 25 bp, Homo sapien
ctaccccgtggcaaataacagaaat

SEQ ID NO: 60102 - DNA, 25 bp, Homo sapien
gccttctggcactgcgtgaatggag

SEQ ID NO: 60103 - DNA, 25 bp, Homo sapien
tgaatggagtcacgtaccagcagaa

SEQ ID NO: 60104 - DNA, 25 bp, Homo sapien
agcagaactgccaggccgggcttgt

SEQ ID NO: 60105 - DNA, 25 bp, Homo sapien
ttgtcttcgacaccagctgtgattg

SEQ ID NO: 60106 - DNA, 25 bp, Homo sapien
agctgtgattgctgcaactgggcat

SEQ ID NO: 60107 - DNA, 25 bp, Homo sapien
caactgggcataaacctgacctggt

SEQ ID NO: 60108 - DNA, 25 bp, Homo sapien
ctgacctggtctatattccctagag

SEQ ID NO: 60109 - DNA, 25 bp, Homo sapien
ggtctatattccctagagttccagt

SEQ ID NO: 60110 - DNA, 25 bp, Homo sapien
gagttccagtctcttttgcttagga

SEQ ID NO: 60111 - DNA, 25 bp, Homo sapien
ttgagcaatgcttttaaagttatct

SEQ ID NO: 60112 - DNA, 25 bp, Homo sapien
gtatgtattacagtctttataatct

SEQ ID NO: 60113 - DNA, 25 bp, Homo sapien
tactttcaagtactgatggagatag

SEQ ID NO: 60114 - DNA, 25 bp, Homo sapien
tcaagtactgatggagatagactca

SEQ ID NO: 60115 - DNA, 25 bp, Homo sapien
ggagatagactcaaaacagttattt

SEQ ID NO: 60116 - DNA, 25 bp, Homo sapien
tttacaattaatctacaaagggaat

SEQ ID NO: 60117 - DNA, 25 bp, Homo sapien
tggtttttggttgtcatcgatttac

SEQ ID NO: 60118 - DNA, 25 bp, Homo sapien
ggttgtcatcgatttacattgccac

SEQ ID NO: 60119 - DNA, 25 bp, Homo sapien
gtcatcgatttacattgccactaat

SEQ ID NO: 60120 - DNA, 25 bp, Homo sapien
ttacattgccactaataaaccatat

SEQ ID NO: 60121 - DNA, 25 bp, Homo sapien
attgccactaataaaccatattgag

SEQ ID NO: 60122 - DNA, 25 bp, Homo sapien
atcaaagacacccttgccctctgag

SEQ ID NO: 60123 - DNA, 25 bp, Homo sapien
ccttgccctctgagcgtcgctggat

SEQ ID NO: 60124 - DNA, 25 bp, Homo sapien
cgctggatctctgggagctccttga

SEQ ID NO: 60125 - DNA, 25 bp, Homo sapien
ttgatggctcccagaccttggcttt

SEQ ID NO: 60126 - DNA, 25 bp, Homo sapien
agaccttggcttttgggaattgcac

SEQ ID NO: 60127 - DNA, 25 bp, Homo sapien
acctgctctgggtcattggtgagac

SEQ ID NO: 60128 - DNA, 25 bp, Homo sapien
tcaggtcatccttttaatctttgct

SEQ ID NO: 60129 - DNA, 25 bp, Homo sapien
aatctttgctgacggttcagtcctg

SEQ ID NO: 60130 - DNA, 25 bp, Homo sapien
gacggttcagtcctgcctctactgt

SEQ ID NO: 60131 - DNA, 25 bp, Homo sapien
tactgtctctccatagccctggtgg

SEQ ID NO: 60132 - DNA, 25 bp, Homo sapien
ttctccactgtacagaagagccacc

SEQ ID NO: 60133 - DNA, 25 bp, Homo sapien
tctctgcacccttgttcacctgttg

SEQ ID NO: 60134 - DNA, 25 bp, Homo sapien
tctgccgttgtttacctggagactc

SEQ ID NO: 60135 - DNA, 25 bp, Homo sapien
ttacctggagactcaggagagatta

SEQ ID NO: 60136 - DNA, 25 bp, Homo sapien
ggagagattagtgcacctgttcaag

SEQ ID NO: 60137 - DNA, 25 bp, Homo sapien
gagattagtgcacctgttcaagtta

SEQ ID NO: 60138 - DNA, 25 bp, Homo sapien
attagtgcacctgttcaagttatca

SEQ ID NO: 60139 - DNA, 25 bp, Homo sapien
gtgcacctgttcaagttatcacctt

SEQ ID NO: 60140 - DNA, 25 bp, Homo sapien
gcacctgttcaagttatcaccttta

SEQ ID NO: 60141 - DNA, 25 bp, Homo sapien
gttcaagttatcacctttaagtgga

SEQ ID NO: 60142 - DNA, 25 bp, Homo sapien
gttatcacctttaagtggaaattag

SEQ ID NO: 60143 - DNA, 25 bp, Homo sapien
gtggaaattagctttcatttagaaa

SEQ ID NO: 60144 - DNA, 25 bp, Homo sapien
atctccatggcgagtggcgactaca

SEQ ID NO: 60145 - DNA, 25 bp, Homo sapien
tccatggcgagtggcgactacagcg

SEQ ID NO: 60146 - DNA, 25 bp, Homo sapien
tggcgagtggcgactacagcgccta

SEQ ID NO: 60147 - DNA, 25 bp, Homo sapien
agtggcgactacagcgcctacggcg

SEQ ID NO: 60148 - DNA, 25 bp, Homo sapien
gactacagcgcctacggcgtgccgt

SEQ ID NO: 60149 - DNA, 25 bp, Homo sapien
agcgcctacggcgtgccgttgaagc

SEQ ID NO: 60150 - DNA, 25 bp, Homo sapien
tacggcgtgccgttgaagccgctgt

SEQ ID NO: 60151 - DNA, 25 bp, Homo sapien
cgttgaagccgctgtgccacgcggc

SEQ ID NO: 60152 - DNA, 25 bp, Homo sapien
tcgcaaacagccaccagccaaagca

SEQ ID NO: 60153 - DNA, 25 bp, Homo sapien
agcgaaacgctcaccagcccggcct

SEQ ID NO: 60154 - DNA, 25 bp, Homo sapien
ccttgcactcggtggccgtgcactg

SEQ ID NO: 60155 - DNA, 25 bp, Homo sapien
ttagtgcttgacacaaggtgaccca

SEQ ID NO: 60156 - DNA, 25 bp, Homo sapien
tgacacaaggtgacccaatccgcat

SEQ ID NO: 60157 - DNA, 25 bp, Homo sapien
atcaggcattctcattcgccacgaa

SEQ ID NO: 60158 - DNA, 25 bp, Homo sapien
attcgccacgaagttaccgccagta

SEQ ID NO: 60159 - DNA, 25 bp, Homo sapien
gaagttaccgccagtatcgcaggtc

SEQ ID NO: 60160 - DNA, 25 bp, Homo sapien
tatcgcaggtcccagtgttcagatg

SEQ ID NO: 60161 - DNA, 25 bp, Homo sapien
gggagcgatcagttctctcggaagt

SEQ ID NO: 60162 - DNA, 25 bp, Homo sapien
tcagttctctcggaagtgaattcaa

SEQ ID NO: 60163 - DNA, 25 bp, Homo sapien
gatcttgtaccaccacttccggtga

SEQ ID NO: 60164 - DNA, 25 bp, Homo sapien
ggtgacccattcttcggatgctcag

SEQ ID NO: 60165 - DNA, 25 bp, Homo sapien
cattcttcggatgctcagggttctg

SEQ ID NO: 60166 - DNA, 25 bp, Homo sapien
aaactggacaggaagaatctaaagc

SEQ ID NO: 60167 - DNA, 25 bp, Homo sapien
aactggacaggaagaatctaaagca

SEQ ID NO: 60168 - DNA, 25 bp, Homo sapien
actggacaggaagaatctaaagcaa

SEQ ID NO: 60169 - DNA, 25 bp, Homo sapien
ctggacaggaagaatctaaagcaaa

SEQ ID NO: 60170 - DNA, 25 bp, Homo sapien
tggacaggaagaatctaaagcaaac

SEQ ID NO: 60171 - DNA, 25 bp, Homo sapien
ggacaggaagaatctaaagcaaaca

SEQ ID NO: 60172 - DNA, 25 bp, Homo sapien
gacaggaagaatctaaagcaaacat

SEQ ID NO: 60173 - DNA, 25 bp, Homo sapien
ggaagaatctaaagcaaacattgaa

SEQ ID NO: 60174 - DNA, 25 bp, Homo sapien
gaagaatctaaagcaaacattgaaa

SEQ ID NO: 60175 - DNA, 25 bp, Homo sapien
gcaaacattgaaagtaaacgaccca

SEQ ID NO: 60176 - DNA, 25 bp, Homo sapien
aaacgacccaaagcaaagagtgtca

SEQ ID NO: 60177 - DNA, 25 bp, Homo sapien
ttaatttatcagagaccctgccacc

SEQ ID NO: 60178 - DNA, 25 bp, Homo sapien
tccatctccatccaagcaaactgaa

SEQ ID NO: 60179 - DNA, 25 bp, Homo sapien
actgaatggcattgaaacaaactgg

SEQ ID NO: 60180 - DNA, 25 bp, Homo sapien
gaaagggcggtgaactctggctctt

SEQ ID NO: 60181 - DNA, 25 bp, Homo sapien
aactctggctctttgctgtggacat

SEQ ID NO: 60182 - DNA, 25 bp, Homo sapien
ctgtggacatgcgtgaccagcagta

SEQ ID NO: 60183 - DNA, 25 bp, Homo sapien
gtgaccagcagtactcaggtttgag

SEQ ID NO: 60184 - DNA, 25 bp, Homo sapien
aggtttgagggtttgcagaaagcca

SEQ ID NO: 60185 - DNA, 25 bp, Homo sapien
gccagggaacccacagagtcaccaa

SEQ ID NO: 60186 - DNA, 25 bp, Homo sapien
gtcaccaacccttcatttaacaagt

SEQ ID NO: 60187 - DNA, 25 bp, Homo sapien
ccccgtggccattactgcataaaaa

SEQ ID NO: 60188 - DNA, 25 bp, Homo sapien
tatttatgcctctttttaatcccct

SEQ ID NO: 60189 - DNA, 25 bp, Homo sapien
atgatgcagtggtttttatctgatc

SEQ ID NO: 60190 - DNA, 25 bp, Homo sapien
cagtggtttttatctgatcaggaac

SEQ ID NO: 60191 - DNA, 25 bp, Homo sapien
ttatctgatcaggaacttgtcatga

SEQ ID NO: 60192 - DNA, 25 bp, Homo sapien
gatcaggaacttgtcatgatttcct

SEQ ID NO: 60193 - DNA, 25 bp, Homo sapien
tgatttcctttcttagacttcatag

SEQ ID NO: 60194 - DNA, 25 bp, Homo sapien
cctttcttagacttcataggagata

SEQ ID NO: 60195 - DNA, 25 bp, Homo sapien
gacttcataggagatagtgctttaa

SEQ ID NO: 60196 - DNA, 25 bp, Homo sapien
atattatgtttaacttcagaaggca

SEQ ID NO: 60197 - DNA, 25 bp, Homo sapien
gtttaacttcagaaggcatcattta

SEQ ID NO: 60198 - DNA, 25 bp, Homo sapien
agacagtatggcagttaattataaa

SEQ ID NO: 60199 - DNA, 25 bp, Homo sapien
agtactctaactaaagtctccaagt

SEQ ID NO: 60200 - DNA, 25 bp, Homo sapien
aaagtctccaagttatgtattataa

SEQ ID NO: 60201 - DNA, 25 bp, Homo sapien
acatagtagtatgcttaggctttac

SEQ ID NO: 60202 - DNA, 25 bp, Homo sapien
gtatgcttaggctttactatgtatt

SEQ ID NO: 60203 - DNA, 25 bp, Homo sapien
ctatgtattagccttttgttggact

SEQ ID NO: 60204 - DNA, 25 bp, Homo sapien
gccttttgttggactgtgtatgtat

SEQ ID NO: 60205 - DNA, 25 bp, Homo sapien
tgttggactgtgtatgtattttacc

SEQ ID NO: 60206 - DNA, 25 bp, Homo sapien
atgataatggtgtatgactgcttta

SEQ ID NO: 60207 - DNA, 25 bp, Homo sapien
gtatgactgctttacatgagtcctt

SEQ ID NO: 60208 - DNA, 25 bp, Homo sapien
gctttacatgagtccttatgcatcc

SEQ ID NO: 60209 - DNA, 25 bp, Homo sapien
tccttatgcatccagatgttataat

SEQ ID NO: 60210 - DNA, 25 bp, Homo sapien
tggcgcacctgacctctgcatctgc

SEQ ID NO: 60211 - DNA, 25 bp, Homo sapien
tccctgcccaccagtgaggaggacc

SEQ ID NO: 60212 - DNA, 25 bp, Homo sapien
agtgaggaggacctctgccccatct

SEQ ID NO: 60213 - DNA, 25 bp, Homo sapien
gtgaggaggacctctgccccatctg

SEQ ID NO: 60214 - DNA, 25 bp, Homo sapien
gaggaggacctctgccccatctgct

SEQ ID NO: 60215 - DNA, 25 bp, Homo sapien
atctgctatgcccaccccatctctg

SEQ ID NO: 60216 - DNA, 25 bp, Homo sapien
tgtggccacaagtcctgcaaagcct

SEQ ID NO: 60217 - DNA, 25 bp, Homo sapien
gtggccacaagtcctgcaaagcctg

SEQ ID NO: 60218 - DNA, 25 bp, Homo sapien
ctgcaaagcctgtatcaaccagcac

SEQ ID NO: 60219 - DNA, 25 bp, Homo sapien
tgcaaagcctgtatcaaccagcacc

SEQ ID NO: 60220 - DNA, 25 bp, Homo sapien
gcaaagcctgtatcaaccagcacct

SEQ ID NO: 60221 - DNA, 25 bp, Homo sapien
gatgatctccatgaaggacttgctg

SEQ ID NO: 60222 - DNA, 25 bp, Homo sapien
catgaaggacttgctggcagccaac

SEQ ID NO: 60223 - DNA, 25 bp, Homo sapien
tggcagccaacaaggcctcgttggc

SEQ ID NO: 60224 - DNA, 25 bp, Homo sapien
ctcgttggccatcctgcagaagcaa

SEQ ID NO: 60225 - DNA, 25 bp, Homo sapien
gccatcctgcagaagcaactgtctg

SEQ ID NO: 60226 - DNA, 25 bp, Homo sapien
aactgtctgagatggccaacggctg

SEQ ID NO: 60227 - DNA, 25 bp, Homo sapien
actggcccgggacaatgaattctca

SEQ ID NO: 60228 - DNA, 25 bp, Homo sapien
ttgcaatcatgaacaacaggttggc

SEQ ID NO: 60229 - DNA, 25 bp, Homo sapien
gaacaacaggttggcagagaccagt

SEQ ID NO: 60230 - DNA, 25 bp, Homo sapien
tgatgccaggcagcgtccggaaccg

SEQ ID NO: 60231 - DNA, 25 bp, Homo sapien
aaccgctgcaacatctccatagaga

SEQ ID NO: 60232 - DNA, 25 bp, Homo sapien
tgttctctgatcatatactctgctg

SEQ ID NO: 60233 - DNA, 25 bp, Homo sapien
tctgatcatatactctgctgtggtc

SEQ ID NO: 60234 - DNA, 25 bp, Homo sapien
atatactctgctgtggtcatgccca

SEQ ID NO: 60235 - DNA, 25 bp, Homo sapien
gtcatgcccactctttgggagtata

SEQ ID NO: 60236 - DNA, 25 bp, Homo sapien
cactctttgggagtatattcccttt

SEQ ID NO: 60237 - DNA, 25 bp, Homo sapien
atattgagtattgtaccacttgaga

SEQ ID NO: 60238 - DNA, 25 bp, Homo sapien
agtattgtaccacttgagaaattcc

SEQ ID NO: 60239 - DNA, 25 bp, Homo sapien
gagaaattcctttgttctgttatac

SEQ ID NO: 60240 - DNA, 25 bp, Homo sapien
aaattaatctttctgctcataatga

SEQ ID NO: 60241 - DNA, 25 bp, Homo sapien
ataatgattgatgataccaccagta

SEQ ID NO: 60242 - DNA, 25 bp, Homo sapien
gaatttgaacacaaccacatttttt

SEQ ID NO: 60243 - DNA, 25 bp, Homo sapien
gcagtgcctcggttgtctctgcggc

SEQ ID NO: 60244 - DNA, 25 bp, Homo sapien
gtctctgcggctccttagggcagaa

SEQ ID NO: 60245 - DNA, 25 bp, Homo sapien
gctccttagggcagaacagctgcat

SEQ ID NO: 60246 - DNA, 25 bp, Homo sapien
aacagctgcatgtggcacttgtgac

SEQ ID NO: 60247 - DNA, 25 bp, Homo sapien
atgtggcacttgtgacactcactca

SEQ ID NO: 60248 - DNA, 25 bp, Homo sapien
ttcagtgccatcctgactctagaag

SEQ ID NO: 60249 - DNA, 25 bp, Homo sapien
agtgccatcctgactctagaaggcc

SEQ ID NO: 60250 - DNA, 25 bp, Homo sapien
aggatccgcttctcagactccaatg

SEQ ID NO: 60251 - DNA, 25 bp, Homo sapien
agactccaatggcagtgtcctgttt

SEQ ID NO: 60252 - DNA, 25 bp, Homo sapien
aatggcagtgtcctgtttgagcacc

SEQ ID NO: 60253 - DNA, 25 bp, Homo sapien
agtgtcctgtttgagcaccctgcag

SEQ ID NO: 60254 - DNA, 25 bp, Homo sapien
atcatttgggttaatatggctcttc

SEQ ID NO: 60255 - DNA, 25 bp, Homo sapien
atggctcttcataattctaagacta

SEQ ID NO: 60256 - DNA, 25 bp, Homo sapien
gactaatgctcagaacctaaccact

SEQ ID NO: 60257 - DNA, 25 bp, Homo sapien
gaacctaaccactaccttacagtga

SEQ ID NO: 60258 - DNA, 25 bp, Homo sapien
ctaccttacagtgagggctatacat

SEQ ID NO: 60259 - DNA, 25 bp, Homo sapien
gctatacatggtagccagttgaatt

SEQ ID NO: 60260 - DNA, 25 bp, Homo sapien
aatctaccaactgtttagggccctg

SEQ ID NO: 60261 - DNA, 25 bp, Homo sapien
ccctgatttgctgggcagtttttct

SEQ ID NO: 60262 - DNA, 25 bp, Homo sapien
gtatcttcatgtatccctgttactg

SEQ ID NO: 60263 - DNA, 25 bp, Homo sapien
gttactgatagggatacatgtctta

SEQ ID NO: 60264 - DNA, 25 bp, Homo sapien
aaattcactattggctgggagtggt

SEQ ID NO: 60265 - DNA, 25 bp, Homo sapien
tacagtttgagcctggccacatcaa

SEQ ID NO: 60266 - DNA, 25 bp, Homo sapien
ttgagcctggccacatcaagaggag

SEQ ID NO: 60267 - DNA, 25 bp, Homo sapien
agctaagaccatggctctagttgac

SEQ ID NO: 60268 - DNA, 25 bp, Homo sapien
ggctctagttgacatccagttggat

SEQ ID NO: 60269 - DNA, 25 bp, Homo sapien
tccagttggatcaccatgaacgatg

SEQ ID NO: 60270 - DNA, 25 bp, Homo sapien
gaacgatgtgattgtatctgcagct

SEQ ID NO: 60271 - DNA, 25 bp, Homo sapien
gcagctcaagaccacctcgataaga

SEQ ID NO: 60272 - DNA, 25 bp, Homo sapien
ctcgataagagaatgtgcacatcct

SEQ ID NO: 60273 - DNA, 25 bp, Homo sapien
gtgcacatccttacattaagcctga

SEQ ID NO: 60274 - DNA, 25 bp, Homo sapien
acattaagcctgaaagaacctttag

SEQ ID NO: 60275 - DNA, 25 bp, Homo sapien
agataagagacccttttcctaccag

SEQ ID NO: 60276 - DNA, 25 bp, Homo sapien
atagtttgatcctttgtacagttaa

SEQ ID NO: 60277 - DNA, 25 bp, Homo sapien
tgatcctttgtacagttaaactctt

SEQ ID NO: 60278 - DNA, 25 bp, Homo sapien
gtacagttaaactcttaagaacgtg

SEQ ID NO: 60279 - DNA, 25 bp, Homo sapien
gaaaaggaatgcacacagaaaggtt

SEQ ID NO: 60280 - DNA, 25 bp, Homo sapien
gaaaggttgcatgtaactctctagt

SEQ ID NO: 60281 - DNA, 25 bp, Homo sapien
gcatgtaactctctagtgttatttt

SEQ ID NO: 60282 - DNA, 25 bp, Homo sapien
attcatccatgtaaatgcattcttg

SEQ ID NO: 60283 - DNA, 25 bp, Homo sapien
ttctcttcctttctctacttagatt

SEQ ID NO: 60284 - DNA, 25 bp, Homo sapien
ttcctttctctacttagattagatg

SEQ ID NO: 60285 - DNA, 25 bp, Homo sapien
gaatttgggtgtcttaagaatgttt

SEQ ID NO: 60286 - DNA, 25 bp, Homo sapien
gaagtatcaagcagtagttggtttt

SEQ ID NO: 60287 - DNA, 25 bp, Homo sapien
tatttgctctcgactcaagaaggtt

SEQ ID NO: 60288 - DNA, 25 bp, Homo sapien
ctcgactcaagaaggttaacatttt

SEQ ID NO: 60289 - DNA, 25 bp, Homo sapien
cattttctgattcatgttagacttt

SEQ ID NO: 60290 - DNA, 25 bp, Homo sapien
attttcaagaggaacatatgcctga

SEQ ID NO: 60291 - DNA, 25 bp, Homo sapien
gaacatatgcctgagaacctttgca

SEQ ID NO: 60292 - DNA, 25 bp, Homo sapien
atatgcctgagaacctttgcatgaa

SEQ ID NO: 60293 - DNA, 25 bp, Homo sapien
aaaatttcaattatccattcttata

SEQ ID NO: 60294 - DNA, 25 bp, Homo sapien
atatctccgaagttaaaatctgtaa

SEQ ID NO: 60295 - DNA, 25 bp, Homo sapien
tgtaataggaattgattcattctct

SEQ ID NO: 60296 - DNA, 25 bp, Homo sapien
taaaaacatcacactaatcttagga

SEQ ID NO: 60297 - DNA, 25 bp, Homo sapien
gtacaattgattgcaacatcttgat

SEQ ID NO: 60298 - DNA, 25 bp, Homo sapien
actgttttcagacctaaccttggca

SEQ ID NO: 60299 - DNA, 25 bp, Homo sapien
aaccttggcaaggtcagtcctactt

SEQ ID NO: 60300 - DNA, 25 bp, Homo sapien
agtcctactttgatgttcttgtttc

SEQ ID NO: 60301 - DNA, 25 bp, Homo sapien
tgttcttgtttcatcacacttcttg

SEQ ID NO: 60302 - DNA, 25 bp, Homo sapien
aagaattgggcctttggtacctctg

SEQ ID NO: 60303 - DNA, 25 bp, Homo sapien
tacctctgatctcttcgtttagcaa

SEQ ID NO: 60304 - DNA, 25 bp, Homo sapien
gtttagcaacttactgtgcacccat

SEQ ID NO: 60305 - DNA, 25 bp, Homo sapien
actgtgcacccatatgcttagcttt

SEQ ID NO: 60306 - DNA, 25 bp, Homo sapien
ttaacctgccacctagtggccgaaa

SEQ ID NO: 60307 - DNA, 25 bp, Homo sapien
gtggccgaaatgttgctatactatt

SEQ ID NO: 60308 - DNA, 25 bp, Homo sapien
gataaggtactcctaattttggcaa

SEQ ID NO: 60309 - DNA, 25 bp, Homo sapien
tcaggagagggtcacttttgtagct

SEQ ID NO: 60310 - DNA, 25 bp, Homo sapien
tcacttttgtagctgagacctctct

SEQ ID NO: 60311 - DNA, 25 bp, Homo sapien
tggagacccagatcccctagagcag

SEQ ID NO: 60312 - DNA, 25 bp, Homo sapien
agagaccatccagaatcccagaatt

SEQ ID NO: 60313 - DNA, 25 bp, Homo sapien
aggaaattgtatcagcctcccaagc

SEQ ID NO: 60314 - DNA, 25 bp, Homo sapien
aggaatccatcggacaagaccccgt

SEQ ID NO: 60315 - DNA, 25 bp, Homo sapien
gacaagaccccgtctaacactgcat

SEQ ID NO: 60316 - DNA, 25 bp, Homo sapien
aactgggcattacccaccattgtag

SEQ ID NO: 60317 - DNA, 25 bp, Homo sapien
attgtagccacctgtgcaccatgac

SEQ ID NO: 60318 - DNA, 25 bp, Homo sapien
tgtgcaccatgaccatgctggcaga

SEQ ID NO: 60319 - DNA, 25 bp, Homo sapien
atgctggcagagtctttcctgttcc

SEQ ID NO: 60320 - DNA, 25 bp, Homo sapien
caatttcctgcgggcgggtacaaag

SEQ ID NO: 60321 - DNA, 25 bp, Homo sapien
gcgggtacaaaggaccctttcaatg

SEQ ID NO: 60322 - DNA, 25 bp, Homo sapien
accctttcaatgtccctggagttgg

SEQ ID NO: 60323 - DNA, 25 bp, Homo sapien
ctgtcctgtctctattctaggcaag

SEQ ID NO: 60324 - DNA, 25 bp, Homo sapien
attctaggcaagagagagtgggttc

SEQ ID NO: 60325 - DNA, 25 bp, Homo sapien
gtgggttcaaaagactcctgggctc

SEQ ID NO: 60326 - DNA, 25 bp, Homo sapien
tgggctcacctgttagcgctggccc

SEQ ID NO: 60327 - DNA, 25 bp, Homo sapien
gggctcacctgttagcgctggccca

SEQ ID NO: 60328 - DNA, 25 bp, Homo sapien
ggctcacctgttagcgctggcccag

SEQ ID NO: 60329 - DNA, 25 bp, Homo sapien
gggacagtgctacactcgtctccac

SEQ ID NO: 60330 - DNA, 25 bp, Homo sapien
tcgtctccactgtttgttttacttc

SEQ ID NO: 60331 - DNA, 25 bp, Homo sapien
tagtgctggccctcatattaggaat

SEQ ID NO: 60332 - DNA, 25 bp, Homo sapien
ggccctcatattaggaataactgcg

SEQ ID NO: 60333 - DNA, 25 bp, Homo sapien
ggtcaaatgggctctctcattcttg

SEQ ID NO: 60334 - DNA, 25 bp, Homo sapien
gggctctctcattcttggagtgaaa

SEQ ID NO: 60335 - DNA, 25 bp, Homo sapien
ggattccagacacaaaacatatttc

SEQ ID NO: 60336 - DNA, 25 bp, Homo sapien
acatctgtgaaaatgggcgacctcg

SEQ ID NO: 60337 - DNA, 25 bp, Homo sapien
ggcgacctcgaagtaactcttggca

SEQ ID NO: 60338 - DNA, 25 bp, Homo sapien
gtaactcttggcaaggtaacctggg

SEQ ID NO: 60339 - DNA, 25 bp, Homo sapien
gcaaggtaacctgggaggcaacaaa

SEQ ID NO: 60340 - DNA, 25 bp, Homo sapien
aggcaaaagatttagacctcggtct

SEQ ID NO: 60341 - DNA, 25 bp, Homo sapien
tagacctcggtctaattcaactgag

SEQ ID NO: 60342 - DNA, 25 bp, Homo sapien
aatccaatgactggcatccttagga

SEQ ID NO: 60343 - DNA, 25 bp, Homo sapien
caatgactggcatccttaggagaag

SEQ ID NO: 60344 - DNA, 25 bp, Homo sapien
gagagagttttggtaatagacacaa

SEQ ID NO: 60345 - DNA, 25 bp, Homo sapien
acaagaggcaagttggagtgatgca

SEQ ID NO: 60346 - DNA, 25 bp, Homo sapien
aggatctccggccaccagcagaagc

SEQ ID NO: 60347 - DNA, 25 bp, Homo sapien
cagcagagaggcatgggacaggttc

SEQ ID NO: 60348 - DNA, 25 bp, Homo sapien
gacaggttccccacaagccttagaa

SEQ ID NO: 60349 - DNA, 25 bp, Homo sapien
ttccccacaagccttagaaggaagc

SEQ ID NO: 60350 - DNA, 25 bp, Homo sapien
ggaagcatggccctgacttcagaat

SEQ ID NO: 60351 - DNA, 25 bp, Homo sapien
atggccctgacttcagaattccaga

SEQ ID NO: 60352 - DNA, 25 bp, Homo sapien
tgacttcagaattccagactccaga

SEQ ID NO: 60353 - DNA, 25 bp, Homo sapien
accgagaaggccgtgtttgacgtgc

SEQ ID NO: 60354 - DNA, 25 bp, Homo sapien
ccgagaaggccgtgtttgacgtgca

SEQ ID NO: 60355 - DNA, 25 bp, Homo sapien
cgagaaggccgtgtttgacgtgcac

SEQ ID NO: 60356 - DNA, 25 bp, Homo sapien
gagaaggccgtgtttgacgtgcaca

SEQ ID NO: 60357 - DNA, 25 bp, Homo sapien
agaaggccgtgtttgacgtgcacag

SEQ ID NO: 60358 - DNA, 25 bp, Homo sapien
aaggccgtgtttgacgtgcacagga

SEQ ID NO: 60359 - DNA, 25 bp, Homo sapien
tgagggagctctgggagggcctgac

SEQ ID NO: 60360 - DNA, 25 bp, Homo sapien
ctgggagggcctgacggtggacgac

SEQ ID NO: 60361 - DNA, 25 bp, Homo sapien
gggagggcctgacggtggacgacat

SEQ ID NO: 60362 - DNA, 25 bp, Homo sapien
gggtttgctactggcctcctacttt

SEQ ID NO: 60363 - DNA, 25 bp, Homo sapien
tttgctactggcctcctactttcct

SEQ ID NO: 60364 - DNA, 25 bp, Homo sapien
gctttaatctgagtgatgatatccg

SEQ ID NO: 60365 - DNA, 25 bp, Homo sapien
atgatatccgtgtggctatttcaaa

SEQ ID NO: 60366 - DNA, 25 bp, Homo sapien
atatccgtgtggctatttcaaaaaa

SEQ ID NO: 60367 - DNA, 25 bp, Homo sapien
aaagttcctcgtttctcggacatca

SEQ ID NO: 60368 - DNA, 25 bp, Homo sapien
agttcctcgtttctcggacatcatt

SEQ ID NO: 60369 - DNA, 25 bp, Homo sapien
ttcctcgtttctcggacatcattga

SEQ ID NO: 60370 - DNA, 25 bp, Homo sapien
cagaagtcactgtaagctgatatac

SEQ ID NO: 60371 - DNA, 25 bp, Homo sapien
cactgtaagctgatatactttttta

SEQ ID NO: 60372 - DNA, 25 bp, Homo sapien
aattctgtctctttcatatttatga

SEQ ID NO: 60373 - DNA, 25 bp, Homo sapien
actgaattctatgtctaaaaaactt

SEQ ID NO: 60374 - DNA, 25 bp, Homo sapien
ttaattttgaatgaggcatgtgaaa

SEQ ID NO: 60375 - DNA, 25 bp, Homo sapien
agatcccaaaagtccctaaagcagt

SEQ ID NO: 60376 - DNA, 25 bp, Homo sapien
taaagcagtcgtagagtctcaccat

SEQ ID NO: 60377 - DNA, 25 bp, Homo sapien
agtctcaccatctccaaggattggt

SEQ ID NO: 60378 - DNA, 25 bp, Homo sapien
ggattggtcttgagaacactgttca

SEQ ID NO: 60379 - DNA, 25 bp, Homo sapien
actgttcagtgacggccatgcaggt

SEQ ID NO: 60380 - DNA, 25 bp, Homo sapien
gcaggtggccgtccaaagacagcca

SEQ ID NO: 60381 - DNA, 25 bp, Homo sapien
aaagacagccaacggagctgcctcg

SEQ ID NO: 60382 - DNA, 25 bp, Homo sapien
ggagctgcctcgcagaatcagccag

SEQ ID NO: 60383 - DNA, 25 bp, Homo sapien
cctcgcagaatcagccagtgggcag

SEQ ID NO: 60384 - DNA, 25 bp, Homo sapien
gaatggatagactggtgtgctcaaa

SEQ ID NO: 60385 - DNA, 25 bp, Homo sapien
gaaatgacaagaataacccttttgg

SEQ ID NO: 60386 - DNA, 25 bp, Homo sapien
actgctgttttatttgtggcacaac

SEQ ID NO: 60387 - DNA, 25 bp, Homo sapien
tgctgttttatttgtggcacaactg

SEQ ID NO: 60388 - DNA, 25 bp, Homo sapien
atttgtggcacaactgatcaatctt

SEQ ID NO: 60389 - DNA, 25 bp, Homo sapien
ttgtggcacaactgatcaatcttgg

SEQ ID NO: 60390 - DNA, 25 bp, Homo sapien
gtggcacaactgatcaatcttggaa

SEQ ID NO: 60391 - DNA, 25 bp, Homo sapien
ggcacaactgatcaatcttggaaat

SEQ ID NO: 60392 - DNA, 25 bp, Homo sapien
cacaactgatcaatcttggaaattc

SEQ ID NO: 60393 - DNA, 25 bp, Homo sapien
atttgctaccttaaggtgattggga

SEQ ID NO: 60394 - DNA, 25 bp, Homo sapien
ccttaaggtgattgggaaaattctg

SEQ ID NO: 60395 - DNA, 25 bp, Homo sapien
gtttataccagtcttaaagatccag

SEQ ID NO: 60396 - DNA, 25 bp, Homo sapien
tataccagtcttaaagatccaggtt

SEQ ID NO: 60397 - DNA, 25 bp, Homo sapien
ggcgcctgaccacgcctaggcggga

SEQ ID NO: 60398 - DNA, 25 bp, Homo sapien
gcctgaccacgcctaggcgggagga

SEQ ID NO: 60399 - DNA, 25 bp, Homo sapien
aacatactgagaagccgtctctacc

SEQ ID NO: 60400 - DNA, 25 bp, Homo sapien
atactgagaagccgtctctaccaaa

SEQ ID NO: 60401 - DNA, 25 bp, Homo sapien
gctactcagaggggtgactgagact

SEQ ID NO: 60402 - DNA, 25 bp, Homo sapien
ctactcagaggggtgactgagactc

SEQ ID NO: 60403 - DNA, 25 bp, Homo sapien
tactcagaggggtgactgagactcg

SEQ ID NO: 60404 - DNA, 25 bp, Homo sapien
actcagaggggtgactgagactcga

SEQ ID NO: 60405 - DNA, 25 bp, Homo sapien
ctcagaggggtgactgagactcgag

SEQ ID NO: 60406 - DNA, 25 bp, Homo sapien
tcagaggggtgactgagactcgagg

SEQ ID NO: 60407 - DNA, 25 bp, Homo sapien
ggtgactgagactcgaggatcactt

SEQ ID NO: 60408 - DNA, 25 bp, Homo sapien
gggcgtcccgtgttctaactcgctc

SEQ ID NO: 60409 - DNA, 25 bp, Homo sapien
ctccggcttggtgagcagcgtctga

SEQ ID NO: 60410 - DNA, 25 bp, Homo sapien
gccagcctgctgcactagatgccag

SEQ ID NO: 60411 - DNA, 25 bp, Homo sapien
agatgccagctgtgtcacttagcag

SEQ ID NO: 60412 - DNA, 25 bp, Homo sapien
cacttagcagcaaggtgacctcagc

SEQ ID NO: 60413 - DNA, 25 bp, Homo sapien
aaggtgacctcagcaaagttgtttt

SEQ ID NO: 60414 - DNA, 25 bp, Homo sapien
aaagttgttttacctctgtgcctca

SEQ ID NO: 60415 - DNA, 25 bp, Homo sapien
gtaaataacagctacccatgggatt

SEQ ID NO: 60416 - DNA, 25 bp, Homo sapien
gctacccatgggattgatgtgaaag

SEQ ID NO: 60417 - DNA, 25 bp, Homo sapien
aatttcctagaatggtgtctggcat

SEQ ID NO: 60418 - DNA, 25 bp, Homo sapien
gtgtctggcatgaagtactgataat

SEQ ID NO: 60419 - DNA, 25 bp, Homo sapien
gaaaatgctgccttcgtaacaacca

SEQ ID NO: 60420 - DNA, 25 bp, Homo sapien
gctgccttcgtaacaaccagtgtga

SEQ ID NO: 60421 - DNA, 25 bp, Homo sapien
gtaacaaccagtgtgactacgtcag

SEQ ID NO: 60422 - DNA, 25 bp, Homo sapien
tgactacgtcagagctcctcatgtt

SEQ ID NO: 60423 - DNA, 25 bp, Homo sapien
tcctcatgttcttgcatggcccaag

SEQ ID NO: 60424 - DNA, 25 bp, Homo sapien
atggcccaagatgtatttccctgtg

SEQ ID NO: 60425 - DNA, 25 bp, Homo sapien
gtatttccctgtgactgaaccagga

SEQ ID NO: 60426 - DNA, 25 bp, Homo sapien
taagaagccgaagcccaactcacag

SEQ ID NO: 60427 - DNA, 25 bp, Homo sapien
aagcccaactcacagggctgactct

SEQ ID NO: 60428 - DNA, 25 bp, Homo sapien
gggccagttgttctgtgcacttgtc

SEQ ID NO: 60429 - DNA, 25 bp, Homo sapien
agttgttctgtgcacttgtccaccc

SEQ ID NO: 60430 - DNA, 25 bp, Homo sapien
tgtttcgccttattttattaatcct

SEQ ID NO: 60431 - DNA, 25 bp, Homo sapien
ttattaatcctttcagtggtttttg

SEQ ID NO: 60432 - DNA, 25 bp, Homo sapien
tttttgtgtttttccggcaagtgat

SEQ ID NO: 60433 - DNA, 25 bp, Homo sapien
ttttgtgtttttccggcaagtgata

SEQ ID NO: 60434 - DNA, 25 bp, Homo sapien
gtgtttttccggcaagtgataggaa

SEQ ID NO: 60435 - DNA, 25 bp, Homo sapien
ttccggcaagtgataggaaaccact

SEQ ID NO: 60436 - DNA, 25 bp, Homo sapien
ccggcaagtgataggaaaccactta

SEQ ID NO: 60437 - DNA, 25 bp, Homo sapien
ggcaagtgataggaaaccacttaaa

SEQ ID NO: 60438 - DNA, 25 bp, Homo sapien
aaaaatgccactatccaaagcaaaa

SEQ ID NO: 60439 - DNA, 25 bp, Homo sapien
gacaggaagaatctgaagcaaaaac

SEQ ID NO: 60440 - DNA, 25 bp, Homo sapien
aacgacccaaagcaaagagtgtcaa

SEQ ID NO: 60441 - DNA, 25 bp, Homo sapien
gactcagacgacgagaagaaggccg

SEQ ID NO: 60442 - DNA, 25 bp, Homo sapien
accccaaatatgacgaggacgccaa

SEQ ID NO: 60443 - DNA, 25 bp, Homo sapien
aatatgacgaggacgccaagcggcc

SEQ ID NO: 60444 - DNA, 25 bp, Homo sapien
aagcggccctacttcaccgtggatg

SEQ ID NO: 60445 - DNA, 25 bp, Homo sapien
ctacttcaccgtggatgaggccgag

SEQ ID NO: 60446 - DNA, 25 bp, Homo sapien
gggaccggactctgggctaccagta

SEQ ID NO: 60447 - DNA, 25 bp, Homo sapien
tgggctaccagtacgaccctgagca

SEQ ID NO: 60448 - DNA, 25 bp, Homo sapien
tacgaccctgagcagctggacttgg

SEQ ID NO: 60449 - DNA, 25 bp, Homo sapien
tggtttctcagaacgacgggtcttt

SEQ ID NO: 60450 - DNA, 25 bp, Homo sapien
gaacgacgggtctttcatttccaag

SEQ ID NO: 60451 - DNA, 25 bp, Homo sapien
tcatttccaagaaggagtggtacgt

SEQ ID NO: 60452 - DNA, 25 bp, Homo sapien
tacaaacttctatgtttggaaactt

SEQ ID NO: 60453 - DNA, 25 bp, Homo sapien
aaacttctaaacaactcacaggtgc

SEQ ID NO: 60454 - DNA, 25 bp, Homo sapien
cacaggtgcaaggagaaattacaac

SEQ ID NO: 60455 - DNA, 25 bp, Homo sapien
tatcaaaatctgtatgttgcaataa

SEQ ID NO: 60456 - DNA, 25 bp, Homo sapien
ttttcaattgaactcgtgtatcttt

SEQ ID NO: 60457 - DNA, 25 bp, Homo sapien
gaactcgtgtatcttttgatagtca

SEQ ID NO: 60458 - DNA, 25 bp, Homo sapien
gtatcttttgatagtcatattggaa

SEQ ID NO: 60459 - DNA, 25 bp, Homo sapien
ggtagaacattaatttgctcggcat

SEQ ID NO: 60460 - DNA, 25 bp, Homo sapien
taatttgctcggcatgcaccttaag

SEQ ID NO: 60461 - DNA, 25 bp, Homo sapien
gctcggcatgcaccttaagaacttg

SEQ ID NO: 60462 - DNA, 25 bp, Homo sapien
ggcatgcaccttaagaacttggaag

SEQ ID NO: 60463 - DNA, 25 bp, Homo sapien
gcaagtaaaaataaggatggccccg

SEQ ID NO: 60464 - DNA, 25 bp, Homo sapien
ttgtctcagcatcagtatatcccat

SEQ ID NO: 60465 - DNA, 25 bp, Homo sapien
gtctcagcatcagtatatcccatgc

SEQ ID NO: 60466 - DNA, 25 bp, Homo sapien
tcagcatcagtatatcccatgcaat

SEQ ID NO: 60467 - DNA, 25 bp, Homo sapien
gcatcagtatatcccatgcaatatt

SEQ ID NO: 60468 - DNA, 25 bp, Homo sapien
gaggtgtgctcatactaaaattatt

SEQ ID NO: 60469 - DNA, 25 bp, Homo sapien
gcaaccctactaagatcataaaccc

SEQ ID NO: 60470 - DNA, 25 bp, Homo sapien
cctactaagatcataaacccttgga

SEQ ID NO: 60471 - DNA, 25 bp, Homo sapien
taaacccttggaaatctgtgtgtgt

SEQ ID NO: 60472 - DNA, 25 bp, Homo sapien
acccttggaaatctgtgtgtgtgcg

SEQ ID NO: 60473 - DNA, 25 bp, Homo sapien
ggaaatctgtgtgtgtgcgggtgtg

SEQ ID NO: 60474 - DNA, 25 bp, Homo sapien
atactcagtcttgtggtcaagagag

SEQ ID NO: 60475 - DNA, 25 bp, Homo sapien
gtcttgtggtcaagagagttctcaa

SEQ ID NO: 60476 - DNA, 25 bp, Homo sapien
gagagttctcaagtgacaaccattg

SEQ ID NO: 60477 - DNA, 25 bp, Homo sapien
gagttctcaagtgacaaccattggg

SEQ ID NO: 60478 - DNA, 25 bp, Homo sapien
gggtttcttcataaagatcttgata

SEQ ID NO: 60479 - DNA, 25 bp, Homo sapien
gacaagcataaacaatgtgccctgt

SEQ ID NO: 60480 - DNA, 25 bp, Homo sapien
aacaatgtgccctgtttgactaagt

SEQ ID NO: 60481 - DNA, 25 bp, Homo sapien
caatgtgccctgtttgactaagtca

SEQ ID NO: 60482 - DNA, 25 bp, Homo sapien
atgtgccctgtttgactaagtcaaa

SEQ ID NO: 60483 - DNA, 25 bp, Homo sapien
gtgccctgtttgactaagtcaaatg

SEQ ID NO: 60484 - DNA, 25 bp, Homo sapien
aacttaatttctggcctgtgactag

SEQ ID NO: 60485 - DNA, 25 bp, Homo sapien
ccgggttgctagctcccatgtacca

SEQ ID NO: 60486 - DNA, 25 bp, Homo sapien
aaggcatcagtcttcatcttagggg

SEQ ID NO: 60487 - DNA, 25 bp, Homo sapien
aggcatcagtcttcatcttagggga

SEQ ID NO: 60488 - DNA, 25 bp, Homo sapien
ggcatcagtcttcatcttaggggat

SEQ ID NO: 60489 - DNA, 25 bp, Homo sapien
gcatcagtcttcatcttaggggatc

SEQ ID NO: 60490 - DNA, 25 bp, Homo sapien
catcagtcttcatcttaggggatcg

SEQ ID NO: 60491 - DNA, 25 bp, Homo sapien
atcagtcttcatcttaggggatcgc

SEQ ID NO: 60492 - DNA, 25 bp, Homo sapien
tcagtcttcatcttaggggatcgct

SEQ ID NO: 60493 - DNA, 25 bp, Homo sapien
cagtcttcatcttaggggatcgctc

SEQ ID NO: 60494 - DNA, 25 bp, Homo sapien
aaatctgaacatgcctctctcttgc

SEQ ID NO: 60495 - DNA, 25 bp, Homo sapien
aatctgaacatgcctctctcttgct

SEQ ID NO: 60496 - DNA, 25 bp, Homo sapien
gtcaagatgaggtcacattggatta

SEQ ID NO: 60497 - DNA, 25 bp, Homo sapien
gggccccaaatccaatgactggcat

SEQ ID NO: 60498 - DNA, 25 bp, Homo sapien
ccaatgactggcatccttaggagaa

SEQ ID NO: 60499 - DNA, 25 bp, Homo sapien
gagagagttttggtaatagacacaa

SEQ ID NO: 60500 - DNA, 25 bp, Homo sapien
acaagaggcaagttggagtgatgca

SEQ ID NO: 60501 - DNA, 25 bp, Homo sapien
aggatctccggccaccagcagaagc

SEQ ID NO: 60502 - DNA, 25 bp, Homo sapien
agaggcatgggacaggttccccaca

SEQ ID NO: 60503 - DNA, 25 bp, Homo sapien
caggttccccacaagccttagaagg

SEQ ID NO: 60504 - DNA, 25 bp, Homo sapien
ggaagcatggccctgacttcagaat

SEQ ID NO: 60505 - DNA, 25 bp, Homo sapien
atggccctgacttcagaattccaga

SEQ ID NO: 60506 - DNA, 25 bp, Homo sapien
tgacttcagaattccagactccaga

SEQ ID NO: 60507 - DNA, 25 bp, Homo sapien
ggaatggacaagtagtagtctctgt

SEQ ID NO: 60508 - DNA, 25 bp, Homo sapien
gacaagtagtagtctctgtcagagc

SEQ ID NO: 60509 - DNA, 25 bp, Homo sapien
caagtagtagtctctgtcagagcta

SEQ ID NO: 60510 - DNA, 25 bp, Homo sapien
gtagtagtctctgtcagagctacat

SEQ ID NO: 60511 - DNA, 25 bp, Homo sapien
agtctctgtcagagctacattttaa

SEQ ID NO: 60512 - DNA, 25 bp, Homo sapien
aagaaacgtgaagtcatgaactgtt

SEQ ID NO: 60513 - DNA, 25 bp, Homo sapien
aaacgtgaagtcatgaactgtttat

SEQ ID NO: 60514 - DNA, 25 bp, Homo sapien
gtgtttactcacctcatttatattg

SEQ ID NO: 60515 - DNA, 25 bp, Homo sapien
gtttactcacctcatttatattgac

SEQ ID NO: 60516 - DNA, 25 bp, Homo sapien
tactcacctcatttatattgacttg

SEQ ID NO: 60517 - DNA, 25 bp, Homo sapien
tcacctcatttatattgacttgtaa

SEQ ID NO: 60518 - DNA, 25 bp, Homo sapien
gagattttaggcgtcttcggatatc

SEQ ID NO: 60519 - DNA, 25 bp, Homo sapien
tcttcggatatcttctcacctatgt

SEQ ID NO: 60520 - DNA, 25 bp, Homo sapien
cacctatgttccctggctaagaagt

SEQ ID NO: 60521 - DNA, 25 bp, Homo sapien
catttttaaacttaccattggtgca

SEQ ID NO: 60522 - DNA, 25 bp, Homo sapien
taccattggtgcatatgttccagat

SEQ ID NO: 60523 - DNA, 25 bp, Homo sapien
taatctcaccattgatgacctttgt

SEQ ID NO: 60524 - DNA, 25 bp, Homo sapien
ttgatgacctttgtgtatgtagttc

SEQ ID NO: 60525 - DNA, 25 bp, Homo sapien
tgtagttcttgcatcctatactgga

SEQ ID NO: 60526 - DNA, 25 bp, Homo sapien
actggataagcctgttttaacctgc

SEQ ID NO: 60527 - DNA, 25 bp, Homo sapien
atgatgggtgcttccattgcttcat

SEQ ID NO: 60528 - DNA, 25 bp, Homo sapien
gcttccattgcttcataatcttcat

SEQ ID NO: 60529 - DNA, 25 bp, Homo sapien
tagaaaacgttcagacccatcctgt

SEQ ID NO: 60530 - DNA, 25 bp, Homo sapien
agacccatcctgttagtatgtcaaa

SEQ ID NO: 60531 - DNA, 25 bp, Homo sapien
gactggcagggtattaactccattc

SEQ ID NO: 60532 - DNA, 25 bp, Homo sapien
gataaagagccccattattttcaca

SEQ ID NO: 60533 - DNA, 25 bp, Homo sapien
agtgccagcctctacctaaggaaac

SEQ ID NO: 60534 - DNA, 25 bp, Homo sapien
tagaccttggaaccagtttcctggt

SEQ ID NO: 60535 - DNA, 25 bp, Homo sapien
agtttcctggtagggaactgctgac

SEQ ID NO: 60536 - DNA, 25 bp, Homo sapien
aactgctgacagtttcaatgctgac

SEQ ID NO: 60537 - DNA, 25 bp, Homo sapien
gtttcaatgctgacagttggagcca

SEQ ID NO: 60538 - DNA, 25 bp, Homo sapien
gttggagccaatgcctcatagtgta

SEQ ID NO: 60539 - DNA, 25 bp, Homo sapien
gaaggcctgcctcatcttaacaaag

SEQ ID NO: 60540 - DNA, 25 bp, Homo sapien
agcataagatctgtgggatttcatc

SEQ ID NO: 60541 - DNA, 25 bp, Homo sapien
agatctgtgggatttcatcttaggg

SEQ ID NO: 60542 - DNA, 25 bp, Homo sapien
ttatttagaatgacttagcagccat

SEQ ID NO: 60543 - DNA, 25 bp, Homo sapien
gaatgacttagcagccatttaaatt

SEQ ID NO: 60544 - DNA, 25 bp, Homo sapien
ttaaattttcacagagggctcaacc

SEQ ID NO: 60545 - DNA, 25 bp, Homo sapien
gccatggtcagggttgttggaacat

SEQ ID NO: 60546 - DNA, 25 bp, Homo sapien
gttgttggaacatctgacctgtgca

SEQ ID NO: 60547 - DNA, 25 bp, Homo sapien
gaacatctgacctgtgcatccagga

SEQ ID NO: 60548 - DNA, 25 bp, Homo sapien
acctgtgcatccaggagccgaggag

SEQ ID NO: 60549 - DNA, 25 bp, Homo sapien
agccgaggagtcaggttgtaataca

SEQ ID NO: 60550 - DNA, 25 bp, Homo sapien
ggttgtaatacaggccaagcagacg

SEQ ID NO: 60551 - DNA, 25 bp, Homo sapien
tgagggcaattgcttcctgacgcca

SEQ ID NO: 60552 - DNA, 25 bp, Homo sapien
ggcaattgcttcctgacgccaagct

SEQ ID NO: 60553 - DNA, 25 bp, Homo sapien
cctgacgccaagctccttgaggtta

SEQ ID NO: 60554 - DNA, 25 bp, Homo sapien
tctattgggacatccagagaatgca

SEQ ID NO: 60555 - DNA, 25 bp, Homo sapien
tgggacatccagagaatgcagtctt

SEQ ID NO: 60556 - DNA, 25 bp, Homo sapien
gacatccagagaatgcagtcttgca

SEQ ID NO: 60557 - DNA, 25 bp, Homo sapien
gaatgcagtcttgcaagcctactct

SEQ ID NO: 60558 - DNA, 25 bp, Homo sapien
agcctactctggaccgagcagctga

SEQ ID NO: 60559 - DNA, 25 bp, Homo sapien
acttcccttcacactatctcttttg

SEQ ID NO: 60560 - DNA, 25 bp, Homo sapien
ggctgtgtacaaggtcaggtccctt

SEQ ID NO: 60561 - DNA, 25 bp, Homo sapien
agaggcaaggtgcttcctgaccctt

SEQ ID NO: 60562 - DNA, 25 bp, Homo sapien
atactcagtcttgtggtcaagagag

SEQ ID NO: 60563 - DNA, 25 bp, Homo sapien
gtcttgtggtcaagagagttctcaa

SEQ ID NO: 60564 - DNA, 25 bp, Homo sapien
gagagttctcaagtgacaaccattg

SEQ ID NO: 60565 - DNA, 25 bp, Homo sapien
gagttctcaagtgacaaccattggg

SEQ ID NO: 60566 - DNA, 25 bp, Homo sapien
gggtttcttcataaagatcttgata

SEQ ID NO: 60567 - DNA, 25 bp, Homo sapien
gacaagcataaacaatgtgccctgt

SEQ ID NO: 60568 - DNA, 25 bp, Homo sapien
gcataaacaatgtgccctgtttgac

SEQ ID NO: 60569 - DNA, 25 bp, Homo sapien
aacaatgtgccctgtttgactaagt

SEQ ID NO: 60570 - DNA, 25 bp, Homo sapien
caatgtgccctgtttgactaagtca

SEQ ID NO: 60571 - DNA, 25 bp, Homo sapien
atgtgccctgtttgactaagtcaaa

SEQ ID NO: 60572 - DNA, 25 bp, Homo sapien
gtgccctgtttgactaagtcaaatg

SEQ ID NO: 60573 - DNA, 25 bp, Homo sapien
gccagagctgatgtttccaatacca

SEQ ID NO: 60574 - DNA, 25 bp, Homo sapien
agagctgatgtttccaataccaaga

SEQ ID NO: 60575 - DNA, 25 bp, Homo sapien
aataccaagatgtcttcacagggca

SEQ ID NO: 60576 - DNA, 25 bp, Homo sapien
aagatgtcttcacagggcacagccc

SEQ ID NO: 60577 - DNA, 25 bp, Homo sapien
gcacagcccctgcagagcatcttgg

SEQ ID NO: 60578 - DNA, 25 bp, Homo sapien
gcagagcatcttggtcatttggaag

SEQ ID NO: 60579 - DNA, 25 bp, Homo sapien
aagaggacacggtatcccctctggc

SEQ ID NO: 60580 - DNA, 25 bp, Homo sapien
cccctctggccagagtatgtcagag

SEQ ID NO: 60581 - DNA, 25 bp, Homo sapien
aagccttaatatcttttctgtaaca

SEQ ID NO: 60582 - DNA, 25 bp, Homo sapien
atatcttttctgtaacacggagtaa

SEQ ID NO: 60583 - DNA, 25 bp, Homo sapien
tttaatgtcatgttttggatgtaca

SEQ ID NO: 60584 - DNA, 25 bp, Homo sapien
gggaacaagtagtgtttggttgcat

SEQ ID NO: 60585 - DNA, 25 bp, Homo sapien
acaagtagtgtttggttgcatggaa

SEQ ID NO: 60586 - DNA, 25 bp, Homo sapien
gtttggttgcatggaaaagttcttc

SEQ ID NO: 60587 - DNA, 25 bp, Homo sapien
cacccatcacccaagggtagtcttt

SEQ ID NO: 60588 - DNA, 25 bp, Homo sapien
caagggtagtcttttttatccatca

SEQ ID NO: 60589 - DNA, 25 bp, Homo sapien
agggtagtcttttttatccatcaag

SEQ ID NO: 60590 - DNA, 25 bp, Homo sapien
tttttatccatcaagtctgtaccca

SEQ ID NO: 60591 - DNA, 25 bp, Homo sapien
tttatccatcaagtctgtacccaat

SEQ ID NO: 60592 - DNA, 25 bp, Homo sapien
tatccatcaagtctgtacccaatgt

SEQ ID NO: 60593 - DNA, 25 bp, Homo sapien
tccatcaagtctgtacccaatgtgt

SEQ ID NO: 60594 - DNA, 25 bp, Homo sapien
gtcgctgggattactgagattgtgc

SEQ ID NO: 60595 - DNA, 25 bp, Homo sapien
tgcaaattaacttctttcacctttc

SEQ ID NO: 60596 - DNA, 25 bp, Homo sapien
acctttcctggcgatttcttgatgt

SEQ ID NO: 60597 - DNA, 25 bp, Homo sapien
ggcgatttcttgatgttagtctgtg

SEQ ID NO: 60598 - DNA, 25 bp, Homo sapien
tgttagtctgtgaagctgtggttaa

SEQ ID NO: 60599 - DNA, 25 bp, Homo sapien
gtgaagctgtggttaacttctccaa

SEQ ID NO: 60600 - DNA, 25 bp, Homo sapien
aacttctccaaaatagtgtctggaa

SEQ ID NO: 60601 - DNA, 25 bp, Homo sapien
tttcttttcttctgttcgatgaaca

SEQ ID NO: 60602 - DNA, 25 bp, Homo sapien
tgttcgatgaacagctcctcgcgtc

SEQ ID NO: 60603 - DNA, 25 bp, Homo sapien
tctccttcaggagcgttttatccct

SEQ ID NO: 60604 - DNA, 25 bp, Homo sapien
aggagcgttttatccctgcgcacgg

SEQ ID NO: 60605 - DNA, 25 bp, Homo sapien
tgggcgctggcgaaagtcagctcct

SEQ ID NO: 60606 - DNA, 25 bp, Homo sapien
tgaaggacagtacccatctatctgc

SEQ ID NO: 60607 - DNA, 25 bp, Homo sapien
atctatctgcccacggcttgaactg

SEQ ID NO: 60608 - DNA, 25 bp, Homo sapien
gaacgactgggactctgccaccaag

SEQ ID NO: 60609 - DNA, 25 bp, Homo sapien
gactgggactctgccaccaagcagt

SEQ ID NO: 60610 - DNA, 25 bp, Homo sapien
accaagcagttgctgggactccagc

SEQ ID NO: 60611 - DNA, 25 bp, Homo sapien
ggactccagcccataagcactgtgt

SEQ ID NO: 60612 - DNA, 25 bp, Homo sapien
actgtgtcccctcttcatagagtcc

SEQ ID NO: 60613 - DNA, 25 bp, Homo sapien
catagagtcctccattacagtcaag

SEQ ID NO: 60614 - DNA, 25 bp, Homo sapien
gagtcctccattacagtcaaggcta

SEQ ID NO: 60615 - DNA, 25 bp, Homo sapien
tccattacagtcaaggctaagtcaa

SEQ ID NO: 60616 - DNA, 25 bp, Homo sapien
actttttgcatgcttctatgtagaa

SEQ ID NO: 60617 - DNA, 25 bp, Homo sapien
tggtgccttgtcttttgcttgtaca

SEQ ID NO: 60618 - DNA, 25 bp, Homo sapien
tgtcttttgcttgtacagaatctgt

SEQ ID NO: 60619 - DNA, 25 bp, Homo sapien
gaatctgtagtgattttggtggcca

SEQ ID NO: 60620 - DNA, 25 bp, Homo sapien
ggtggccagtaaatgccagccattt

SEQ ID NO: 60621 - DNA, 25 bp, Homo sapien
taaatgccagccatttctcaaaccc

SEQ ID NO: 60622 - DNA, 25 bp, Homo sapien
ggaccacccagagtttcctcttggt

SEQ ID NO: 60623 - DNA, 25 bp, Homo sapien
agagtttcctcttggtccctgtcta

SEQ ID NO: 60624 - DNA, 25 bp, Homo sapien
ttggtccctgtctactaagagtcat

SEQ ID NO: 60625 - DNA, 25 bp, Homo sapien
ctaagagtcatgaaggcagggtgct

SEQ ID NO: 60626 - DNA, 25 bp, Homo sapien
gccttccagtccaagaaactgcttc

SEQ ID NO: 60627 - DNA, 25 bp, Homo sapien
gaaactgcttcttgaaatggattta

SEQ ID NO: 60628 - DNA, 25 bp, Homo sapien
ttctgagtactgcttccggtgctaa

SEQ ID NO: 60629 - DNA, 25 bp, Homo sapien
gtactgcttccggtgctaaaatgaa

SEQ ID NO: 60630 - DNA, 25 bp, Homo sapien
acttaatggcatggactctggagaa

SEQ ID NO: 60631 - DNA, 25 bp, Homo sapien
tggactctggagaatctatgcgaat

SEQ ID NO: 60632 - DNA, 25 bp, Homo sapien
ctatgcgaatcaacctttctacctt

SEQ ID NO: 60633 - DNA, 25 bp, Homo sapien
tctaccttaatatctccccaaaaat

SEQ ID NO: 60634 - DNA, 25 bp, Homo sapien
tctccccaaaaatgtatagtgcctt

SEQ ID NO: 60635 - DNA, 25 bp, Homo sapien
gaaaagtttgctctgcatttttgat

SEQ ID NO: 60636 - DNA, 25 bp, Homo sapien
gatggtttggaacattatctacaat

SEQ ID NO: 60637 - DNA, 25 bp, Homo sapien
gtaaacaaacagtacacatgtcatt

SEQ ID NO: 60638 - DNA, 25 bp, Homo sapien
tcattttgtgatataggactcccaa

SEQ ID NO: 60639 - DNA, 25 bp, Homo sapien
agtggcccatcagggctcactgtaa

SEQ ID NO: 60640 - DNA, 25 bp, Homo sapien
gtggcccatcagggctcactgtaac

SEQ ID NO: 60641 - DNA, 25 bp, Homo sapien
acccagccctgtattcttattcttc

SEQ ID NO: 60642 - DNA, 25 bp, Homo sapien
cccagccctgtattcttattcttca

SEQ ID NO: 60643 - DNA, 25 bp, Homo sapien
ccagccctgtattcttattcttcag

SEQ ID NO: 60644 - DNA, 25 bp, Homo sapien
cagccctgtattcttattcttcaga

SEQ ID NO: 60645 - DNA, 25 bp, Homo sapien
agccctgtattcttattcttcagat

SEQ ID NO: 60646 - DNA, 25 bp, Homo sapien
gccctgtattcttattcttcagata

SEQ ID NO: 60647 - DNA, 25 bp, Homo sapien
ccctgtattcttattcttcagatat

SEQ ID NO: 60648 - DNA, 25 bp, Homo sapien
cctgtattcttattcttcagatatt

SEQ ID NO: 60649 - DNA, 25 bp, Homo sapien
gtattcttattcttcagatatttat

SEQ ID NO: 60650 - DNA, 25 bp, Homo sapien
gcaagtaaaaataaggatggccccg

SEQ ID NO: 60651 - DNA, 25 bp, Homo sapien
ttgtctcagcatcagtatatcccat

SEQ ID NO: 60652 - DNA, 25 bp, Homo sapien
tcagcatcagtatatcccatgcaat

SEQ ID NO: 60653 - DNA, 25 bp, Homo sapien
gcatcagtatatcccatgcaatatt

SEQ ID NO: 60654 - DNA, 25 bp, Homo sapien
gaggtgtgctcatactaaaattatt

SEQ ID NO: 60655 - DNA, 25 bp, Homo sapien
ttttcttttcatctggcaaccctac

SEQ ID NO: 60656 - DNA, 25 bp, Homo sapien
tctggcaaccctactaagatcataa

SEQ ID NO: 60657 - DNA, 25 bp, Homo sapien
accctactaagatcataaacccttg

SEQ ID NO: 60658 - DNA, 25 bp, Homo sapien
taaacccttggaaatctgtgtgtgt

SEQ ID NO: 60659 - DNA, 25 bp, Homo sapien
acccttggaaatctgtgtgtgtgcg

SEQ ID NO: 60660 - DNA, 25 bp, Homo sapien
ggaaatctgtgtgtgtgcgggtgtg

SEQ ID NO: 60661 - DNA, 25 bp, Homo sapien
atgcccctatagaaacaccagtacc

SEQ ID NO: 60662 - DNA, 25 bp, Homo sapien
gtacctgaaagcactgtagccctgg

SEQ ID NO: 60663 - DNA, 25 bp, Homo sapien
atacttctgtttccatctgctgggc

SEQ ID NO: 60664 - DNA, 25 bp, Homo sapien
tgggccaccagccactttagtgacc

SEQ ID NO: 60665 - DNA, 25 bp, Homo sapien
ctacttccttcctgttggatatcat

SEQ ID NO: 60666 - DNA, 25 bp, Homo sapien
ggatatcatacttccatctggctgc

SEQ ID NO: 60667 - DNA, 25 bp, Homo sapien
tgcctttgcttaagccatctttgtg

SEQ ID NO: 60668 - DNA, 25 bp, Homo sapien
ggccctggaattgcagctgtactga

SEQ ID NO: 60669 - DNA, 25 bp, Homo sapien
ggatgatgttattcacagcccctgg

SEQ ID NO: 60670 - DNA, 25 bp, Homo sapien
cacccactaatactactgcacagag

SEQ ID NO: 60671 - DNA, 25 bp, Homo sapien
agagtcaggatctcacatttcaccc

SEQ ID NO: 60672 - DNA, 25 bp, Homo sapien
tcctgaaggaaaccactggcttgat

SEQ ID NO: 60673 - DNA, 25 bp, Homo sapien
accactggcttgatatttctgtgac

SEQ ID NO: 60674 - DNA, 25 bp, Homo sapien
tctgtgactcgtgttgcctttgaaa

SEQ ID NO: 60675 - DNA, 25 bp, Homo sapien
tgcctttgaaactagtcccctacca

SEQ ID NO: 60676 - DNA, 25 bp, Homo sapien
taccacctcggtaatgagctccatt

SEQ ID NO: 60677 - DNA, 25 bp, Homo sapien
taatgagctccattacagaaagtgg

SEQ ID NO: 60678 - DNA, 25 bp, Homo sapien
gaatgaactgttttttctgtagact

SEQ ID NO: 60679 - DNA, 25 bp, Homo sapien
tgttttttctgtagactagctgaga

SEQ ID NO: 60680 - DNA, 25 bp, Homo sapien
cattttgtgaattgttctgaactta

SEQ ID NO: 60681 - DNA, 25 bp, Homo sapien
tgttctgaacttaaatgtccactaa

SEQ ID NO: 60682 - DNA, 25 bp, Homo sapien
tgtccactaaaacaacttagacttc

SEQ ID NO: 60683 - DNA, 25 bp, Homo sapien
cagtacaatcactaactttcctttg

SEQ ID NO: 60684 - DNA, 25 bp, Homo sapien
aatcactaactttcctttgtacata

SEQ ID NO: 60685 - DNA, 25 bp, Homo sapien
ctaactttcctttgtacatattatt

SEQ ID NO: 60686 - DNA, 25 bp, Homo sapien
aatcagtttgattattctcagaggg

SEQ ID NO: 60687 - DNA, 25 bp, Homo sapien
gattattctcagagggtgctgctct

SEQ ID NO: 60688 - DNA, 25 bp, Homo sapien
attctcagagggtgctgctctttaa

SEQ ID NO: 60689 - DNA, 25 bp, Homo sapien
ctcagagggtgctgctctttaatga

SEQ ID NO: 60690 - DNA, 25 bp, Homo sapien
agggtgctgctctttaatgaaaatg

SEQ ID NO: 60691 - DNA, 25 bp, Homo sapien
aatacaattcgttattctgtttcca

SEQ ID NO: 60692 - DNA, 25 bp, Homo sapien
caattcgttattctgtttccaatgt

SEQ ID NO: 60693 - DNA, 25 bp, Homo sapien
cgttattctgtttccaatgttagta

SEQ ID NO: 60694 - DNA, 25 bp, Homo sapien
gatgtccgcagcagccattgccaac

SEQ ID NO: 60695 - DNA, 25 bp, Homo sapien
gtccgcagcagccattgccaacggg

SEQ ID NO: 60696 - DNA, 25 bp, Homo sapien
cgcagcagccattgccaacgggggt

SEQ ID NO: 60697 - DNA, 25 bp, Homo sapien
gggtggtgtttctgcggggagcctg

SEQ ID NO: 60698 - DNA, 25 bp, Homo sapien
cggggagcctggtggctactctgca

SEQ ID NO: 60699 - DNA, 25 bp, Homo sapien
ggcagctggactctccacatcatcc

SEQ ID NO: 60700 - DNA, 25 bp, Homo sapien
tggactctccacatcatccaacatc

SEQ ID NO: 60701 - DNA, 25 bp, Homo sapien
tccacatcatccaacatcctcctgg

SEQ ID NO: 60702 - DNA, 25 bp, Homo sapien
ggcctgcttggggaattcaccttct

SEQ ID NO: 60703 - DNA, 25 bp, Homo sapien
gggaattcaccttcttcttctctcc

SEQ ID NO: 60704 - DNA, 25 bp, Homo sapien
tgaacctccaaaacccccactcaag

SEQ ID NO: 60705 - DNA, 25 bp, Homo sapien
agcaatttgaatacgacattaagac

SEQ ID NO: 60706 - DNA, 25 bp, Homo sapien
gacaaagaatattacccgaatcatg

SEQ ID NO: 60707 - DNA, 25 bp, Homo sapien
ttacccgaatcatgagaactaatac

SEQ ID NO: 60708 - DNA, 25 bp, Homo sapien
gaactaatacttggtttcaatgcaa

SEQ ID NO: 60709 - DNA, 25 bp, Homo sapien
caatgcaaagaaccaaagaactcct

SEQ ID NO: 60710 - DNA, 25 bp, Homo sapien
gaactcctcatttggttttgatatc

SEQ ID NO: 60711 - DNA, 25 bp, Homo sapien
tcaggaggcataaagatattgtatc

SEQ ID NO: 60712 - DNA, 25 bp, Homo sapien
gtatcataagagtttaagcttgttt

SEQ ID NO: 60713 - DNA, 25 bp, Homo sapien
tatttttggtattgttcatttgctg

SEQ ID NO: 60714 - DNA, 25 bp, Homo sapien
tcaagacctaaaataaacctcaaca

SEQ ID NO: 60715 - DNA, 25 bp, Homo sapien
cctcaacaggtcttttaatataaat

SEQ ID NO: 60716 - DNA, 25 bp, Homo sapien
gactacttaccacatcaaatctggg

SEQ ID NO: 60717 - DNA, 25 bp, Homo sapien
aaatctgggcccaaacagcctcagt

SEQ ID NO: 60718 - DNA, 25 bp, Homo sapien
aaacagcctcagttaactgcataat

SEQ ID NO: 60719 - DNA, 25 bp, Homo sapien
aaccagcttgctttgttgcacgcct

SEQ ID NO: 60720 - DNA, 25 bp, Homo sapien
ttgttgcacgcctgggcaatttcag

SEQ ID NO: 60721 - DNA, 25 bp, Homo sapien
tgggcaatttcagccaggacattag

SEQ ID NO: 60722 - DNA, 25 bp, Homo sapien
agccaggacattaggaccacttgtt

SEQ ID NO: 60723 - DNA, 25 bp, Homo sapien
ggaccacttgttgtacatctgaata

SEQ ID NO: 60724 - DNA, 25 bp, Homo sapien
aatatgttcatcaccaacaatcagc

SEQ ID NO: 60725 - DNA, 25 bp, Homo sapien
attaatctatcccttttgtgcatgc

SEQ ID NO: 60726 - DNA, 25 bp, Homo sapien
ttgtgcatgcaccatttctctctta

SEQ ID NO: 60727 - DNA, 25 bp, Homo sapien
gggacagtgatgagacttacttttt

SEQ ID NO: 60728 - DNA, 25 bp, Homo sapien
tgagacttactttttaccacatact

SEQ ID NO: 60729 - DNA, 25 bp, Homo sapien
tttgtatttgtacctcatacatgta

SEQ ID NO: 60730 - DNA, 25 bp, Homo sapien
gtacctcatacatgtattacctagt

SEQ ID NO: 60731 - DNA, 25 bp, Homo sapien
aataagcttacttttgaaatactat

SEQ ID NO: 60732 - DNA, 25 bp, Homo sapien
aggtgtattacttcttgattcacaa

SEQ ID NO: 60733 - DNA, 25 bp, Homo sapien
tgattcacaaagatgtacaacacat

SEQ ID NO: 60734 - DNA, 25 bp, Homo sapien
gatgtacaacacattgttaggtgaa

SEQ ID NO: 60735 - DNA, 25 bp, Homo sapien
gaaaccacaaaacagtattacagta

SEQ ID NO: 60736 - DNA, 25 bp, Homo sapien
gtattgtaatattaacgtgggcaac

SEQ ID NO: 60737 - DNA, 25 bp, Homo sapien
ttaacgtgggcaacgggtgtataca

SEQ ID NO: 60738 - DNA, 25 bp, Homo sapien
ggaactatacagattacatggcagt

SEQ ID NO: 60739 - DNA, 25 bp, Homo sapien
acatggcagtagtattcccgtggtc

SEQ ID NO: 60740 - DNA, 25 bp, Homo sapien
gtattcccgtggtcaatctgtacaa

SEQ ID NO: 60741 - DNA, 25 bp, Homo sapien
ggtcaatctgtacaaatcagggcat

SEQ ID NO: 60742 - DNA, 25 bp, Homo sapien
cagggcatcttcatacaagtctcat

SEQ ID NO: 60743 - DNA, 25 bp, Homo sapien
gaaccacagcatagatttggcctga

SEQ ID NO: 60744 - DNA, 25 bp, Homo sapien
gatttggcctgagacaagtacaaga

SEQ ID NO: 60745 - DNA, 25 bp, Homo sapien
agcaggtaaggaattcagaatctca

SEQ ID NO: 60746 - DNA, 25 bp, Homo sapien
aattaacaaaaactggctgctccat

SEQ ID NO: 60747 - DNA, 25 bp, Homo sapien
gtaaaaggtcaaccatatcccctca

SEQ ID NO: 60748 - DNA, 25 bp, Homo sapien
atatcccctcatccatgaaatctag

SEQ ID NO: 60749 - DNA, 25 bp, Homo sapien
aaataaaatcctgacatcctgccat

SEQ ID NO: 60750 - DNA, 25 bp, Homo sapien
aataaaatcctgacatcctgccatc

SEQ ID NO: 60751 - DNA, 25 bp, Homo sapien
ataaaatcctgacatcctgccatct

SEQ ID NO: 60752 - DNA, 25 bp, Homo sapien
taaaatcctgacatcctgccatctt

SEQ ID NO: 60753 - DNA, 25 bp, Homo sapien
aaaatcctgacatcctgccatcttt

SEQ ID NO: 60754 - DNA, 25 bp, Homo sapien
aaatcctgacatcctgccatctttt

SEQ ID NO: 60755 - DNA, 25 bp, Homo sapien
atcctgacatcctgccatcttttct

SEQ ID NO: 60756 - DNA, 25 bp, Homo sapien
gccatcttttctcttcaatttaaag

SEQ ID NO: 60757 - DNA, 25 bp, Homo sapien
ttctcttcaatttaaagttgatttc

SEQ ID NO: 60758 - DNA, 25 bp, Homo sapien
agttgatttcttaatgatgacttca

SEQ ID NO: 60759 - DNA, 25 bp, Homo sapien
gatttcttaatgatgacttcaaaaa

SEQ ID NO: 60760 - DNA, 25 bp, Homo sapien
ggtatgagaaattagggcccagtcg

SEQ ID NO: 60761 - DNA, 25 bp, Homo sapien
ttagggcccagtcgagacccagatc

SEQ ID NO: 60762 - DNA, 25 bp, Homo sapien
gagacccagatccactgaacatctg

SEQ ID NO: 60763 - DNA, 25 bp, Homo sapien
gtagtcaaatgctttacatcagaat

SEQ ID NO: 60764 - DNA, 25 bp, Homo sapien
gaaaataggcttgccactttctctt

SEQ ID NO: 60765 - DNA, 25 bp, Homo sapien
ggcttgccactttctcttattttaa

SEQ ID NO: 60766 - DNA, 25 bp, Homo sapien
ggtagtcaatgaactggctgccact

SEQ ID NO: 60767 - DNA, 25 bp, Homo sapien
actggctgccactttaatataactg

SEQ ID NO: 60768 - DNA, 25 bp, Homo sapien
attcattttgagaccaagcaggatc

SEQ ID NO: 60769 - DNA, 25 bp, Homo sapien
tgtagaataaacactggtttcctag

SEQ ID NO: 60770 - DNA, 25 bp, Homo sapien
ggtttcctagctatcctctgaaaac

SEQ ID NO: 60771 - DNA, 25 bp, Homo sapien
tggataccaacattagcttttcttc

SEQ ID NO: 60772 - DNA, 25 bp, Homo sapien
tttcttcttggttatatcatctgcc

SEQ ID NO: 60773 - DNA, 25 bp, Homo sapien
tgatctattcatgtgtgtttcaggc

SEQ ID NO: 60774 - DNA, 25 bp, Homo sapien
gtgtttcaggcttatttgggagaac

SEQ ID NO: 60775 - DNA, 25 bp, Homo sapien
gaacttaatcaccacttcatctaat

SEQ ID NO: 60776 - DNA, 25 bp, Homo sapien
caaggtaacagttgcccagggcagt

SEQ ID NO: 60777 - DNA, 25 bp, Homo sapien
agtacctgaattaactgtccatttc

SEQ ID NO: 60778 - DNA, 25 bp, Homo sapien
tgtccatttcagtacatgtcaagtg

SEQ ID NO: 60779 - DNA, 25 bp, Homo sapien
atgtcaagtgcctttgttaggtgga

SEQ ID NO: 60780 - DNA, 25 bp, Homo sapien
aaatacctgatttcttgtcatcgag

SEQ ID NO: 60781 - DNA, 25 bp, Homo sapien
cttgtcatcgagattcttgtactgt

SEQ ID NO: 60782 - DNA, 25 bp, Homo sapien
atctctggtcgggaaacgtggctga

SEQ ID NO: 60783 - DNA, 25 bp, Homo sapien
tttacgacccggcttccttctatgg

SEQ ID NO: 60784 - DNA, 25 bp, Homo sapien
cttctatggccattccgagtttgaa

SEQ ID NO: 60785 - DNA, 25 bp, Homo sapien
ccgagtttgaactggcaatcgcctt

SEQ ID NO: 60786 - DNA, 25 bp, Homo sapien
actggcaatcgccttgatgtttggg

SEQ ID NO: 60787 - DNA, 25 bp, Homo sapien
aaggctccgggcttcgaccagcggc

SEQ ID NO: 60788 - DNA, 25 bp, Homo sapien
gctgtttaactacctgaaccactgg

SEQ ID NO: 60789 - DNA, 25 bp, Homo sapien
cactggaaccacttcgggcgggagt

SEQ ID NO: 60790 - DNA, 25 bp, Homo sapien
ggcgggagtacaggagcccttcctt

SEQ ID NO: 60791 - DNA, 25 bp, Homo sapien
tgggcaccatgcgaaggctgctcaa

SEQ ID NO: 60792 - DNA, 25 bp, Homo sapien
cgaaggctgctcaagtagcggcccc

SEQ ID NO: 60793 - DNA, 25 bp, Homo sapien
tccaagaaggacaggcctctctgca

SEQ ID NO: 60794 - DNA, 25 bp, Homo sapien
agaaggacaggcctctctgcaagag

SEQ ID NO: 60795 - DNA, 25 bp, Homo sapien
gaaggacaggcctctctgcaagagc

SEQ ID NO: 60796 - DNA, 25 bp, Homo sapien
tctctgcaagagccatgccttctct

SEQ ID NO: 60797 - DNA, 25 bp, Homo sapien
ccatgccttctctcatgtgtgagcc

SEQ ID NO: 60798 - DNA, 25 bp, Homo sapien
tgccttctctcatgtgtgagcccct

SEQ ID NO: 60799 - DNA, 25 bp, Homo sapien
agctgccgcggtggcccctagcctg

SEQ ID NO: 60800 - DNA, 25 bp, Homo sapien
ggcctggagtcgtggccctgcattt

SEQ ID NO: 60801 - DNA, 25 bp, Homo sapien
ctggagtcgtggccctgcatttctg

SEQ ID NO: 60802 - DNA, 25 bp, Homo sapien
tgcatttctgggtagggctggcaat

SEQ ID NO: 60803 - DNA, 25 bp, Homo sapien
ggtagggctggcaatggttgcctta

SEQ ID NO: 60804 - DNA, 25 bp, Homo sapien
tatgaagacccatactggaaggaag

SEQ ID NO: 60805 - DNA, 25 bp, Homo sapien
gtgagtattgtgaatacagcactac

SEQ ID NO: 60806 - DNA, 25 bp, Homo sapien
gaatacagcactacagatgcatctg

SEQ ID NO: 60807 - DNA, 25 bp, Homo sapien
cagcactacagatgcatctggcttt

SEQ ID NO: 60808 - DNA, 25 bp, Homo sapien
gatgcatctggctttaaacgacatg

SEQ ID NO: 60809 - DNA, 25 bp, Homo sapien
ctggctttaaacgacatgtgatatc

SEQ ID NO: 60810 - DNA, 25 bp, Homo sapien
acgacatgtgatatcaatacataca

SEQ ID NO: 60811 - DNA, 25 bp, Homo sapien
acaaaagactatccacacaggtgtg

SEQ ID NO: 60812 - DNA, 25 bp, Homo sapien
atccacacaggtgtgaattctgcaa

SEQ ID NO: 60813 - DNA, 25 bp, Homo sapien
gaggctcttatgtaataagatcaat

SEQ ID NO: 60814 - DNA, 25 bp, Homo sapien
gatatgatatgctacttgggagaaa

SEQ ID NO: 60815 - DNA, 25 bp, Homo sapien
aactctgtccggttccttggacttg

SEQ ID NO: 60816 - DNA, 25 bp, Homo sapien
gtgtgtctcctatcttatcaagaat

SEQ ID NO: 60817 - DNA, 25 bp, Homo sapien
gtgtctcctatcttatcaagaataa

SEQ ID NO: 60818 - DNA, 25 bp, Homo sapien
acatcttagaagaatgttttttgct

SEQ ID NO: 60819 - DNA, 25 bp, Homo sapien
caaaactgtccagttccttggactt

SEQ ID NO: 60820 - DNA, 25 bp, Homo sapien
gtgtgtctcctatctaccattaaac

SEQ ID NO: 60821 - DNA, 25 bp, Homo sapien
ctcctatctaccattaaacccttat

SEQ ID NO: 60822 - DNA, 25 bp, Homo sapien
taccattaaacccttatgacttaag

SEQ ID NO: 60823 - DNA, 25 bp, Homo sapien
tacatatatacatcttggtggcatt

SEQ ID NO: 60824 - DNA, 25 bp, Homo sapien
atatacatcttggtggcattgattt

SEQ ID NO: 60825 - DNA, 25 bp, Homo sapien
ttgatttttctatgttgtgtattaa

SEQ ID NO: 60826 - DNA, 25 bp, Homo sapien
gagaaaggcactactaaaacagacc

SEQ ID NO: 60827 - DNA, 25 bp, Homo sapien
gaaaggcactactaaaacagaccca

SEQ ID NO: 60828 - DNA, 25 bp, Homo sapien
aaagtactaatattatctgctgcaa

SEQ ID NO: 60829 - DNA, 25 bp, Homo sapien
taatattatctgctgcaagtatatg

SEQ ID NO: 60830 - DNA, 25 bp, Homo sapien
ttatctgctgcaagtatatgaagtt

SEQ ID NO: 60831 - DNA, 25 bp, Homo sapien
tctgctgcaagtatatgaagttatt

SEQ ID NO: 60832 - DNA, 25 bp, Homo sapien
gttattgtgaaagaacactgctaca

SEQ ID NO: 60833 - DNA, 25 bp, Homo sapien
gaacactgctacaagcacaaatatg

SEQ ID NO: 60834 - DNA, 25 bp, Homo sapien
gctacaagcacaaatatgtggactt

SEQ ID NO: 60835 - DNA, 25 bp, Homo sapien
ggactttaagcatttcataactttt

SEQ ID NO: 60836 - DNA, 25 bp, Homo sapien
gaaaaatcgccaccaaaaagtatag

SEQ ID NO: 60837 - DNA, 25 bp, Homo sapien
aactcagaagtttggtcagtcattg

SEQ ID NO: 60838 - DNA, 25 bp, Homo sapien
actcagaagtttggtcagtcattgt

SEQ ID NO: 60839 - DNA, 25 bp, Homo sapien
ctcagaagtttggtcagtcattgtg

SEQ ID NO: 60840 - DNA, 25 bp, Homo sapien
cagaagtttggtcagtcattgtgaa

SEQ ID NO: 60841 - DNA, 25 bp, Homo sapien
agaagtttggtcagtcattgtgaat

SEQ ID NO: 60842 - DNA, 25 bp, Homo sapien
aagtttggtcagtcattgtgaatga

SEQ ID NO: 60843 - DNA, 25 bp, Homo sapien
tggtcagtcattgtgaatgaagatc

SEQ ID NO: 60844 - DNA, 25 bp, Homo sapien
cagtcattgtgaatgaagatcattt

SEQ ID NO: 60845 - DNA, 25 bp, Homo sapien
atttgataagaattactggctgggc

SEQ ID NO: 60846 - DNA, 25 bp, Homo sapien
ttgataagaattactggctgggcgc

SEQ ID NO: 60847 - DNA, 25 bp, Homo sapien
gggttgcaccgagcagagattgcac

SEQ ID NO: 60848 - DNA, 25 bp, Homo sapien
gttgttctgccctcagatggaatta

SEQ ID NO: 60849 - DNA, 25 bp, Homo sapien
ctgccctcagatggaattaggtgaa

SEQ ID NO: 60850 - DNA, 25 bp, Homo sapien
aggtgaatgtgtgtagctgcttttt

SEQ ID NO: 60851 - DNA, 25 bp, Homo sapien
agctgctttttcactcgtggtcctc

SEQ ID NO: 60852 - DNA, 25 bp, Homo sapien
gaggccatggaaacattctttgcat

SEQ ID NO: 60853 - DNA, 25 bp, Homo sapien
ggaaacattctttgcatttaagaga

SEQ ID NO: 60854 - DNA, 25 bp, Homo sapien
gagtgggtggattcattgccacact

SEQ ID NO: 60855 - DNA, 25 bp, Homo sapien
gacccaggaaactaggactttgtgt

SEQ ID NO: 60856 - DNA, 25 bp, Homo sapien
ttgctgcccacctcccttttatttt

SEQ ID NO: 60857 - DNA, 25 bp, Homo sapien
taaaaactgtgctagtctcctttgc

SEQ ID NO: 60858 - DNA, 25 bp, Homo sapien
ctgtgctagtctcctttgcatggac

SEQ ID NO: 60859 - DNA, 25 bp, Homo sapien
atgtagaaagcagaccaggtttagg

SEQ ID NO: 60860 - DNA, 25 bp, Homo sapien
aatgataggacaatgcactctctgc

SEQ ID NO: 60861 - DNA, 25 bp, Homo sapien
atgcactctctgcaatagccaacta

SEQ ID NO: 60862 - DNA, 25 bp, Homo sapien
atagccaactacaacaaaacacttt

SEQ ID NO: 60863 - DNA, 25 bp, Homo sapien
aggtatcaaaacaccctgttgcact

SEQ ID NO: 60864 - DNA, 25 bp, Homo sapien
acaccctgttgcactacgttgatag

SEQ ID NO: 60865 - DNA, 25 bp, Homo sapien
agactgatagagtgccctccatttt

SEQ ID NO: 60866 - DNA, 25 bp, Homo sapien
ccattttcaatgaggatgtctccat

SEQ ID NO: 60867 - DNA, 25 bp, Homo sapien
tgtctccatattttagttcagtgat

SEQ ID NO: 60868 - DNA, 25 bp, Homo sapien
gattactgatttttaacccaactct

SEQ ID NO: 60869 - DNA, 25 bp, Homo sapien
taacccaactcttaataggctgcat

SEQ ID NO: 60870 - DNA, 25 bp, Homo sapien
tctgggaaccacagctccacaaggg

SEQ ID NO: 60871 - DNA, 25 bp, Homo sapien
gcagctgggccagaccgaggtcaca

SEQ ID NO: 60872 - DNA, 25 bp, Homo sapien
agaccgaggtcacagccactccaag

SEQ ID NO: 60873 - DNA, 25 bp, Homo sapien
gaggtcacagccactccaagtcctg

SEQ ID NO: 60874 - DNA, 25 bp, Homo sapien
cctttcctcctgtacataatgtcac

SEQ ID NO: 60875 - DNA, 25 bp, Homo sapien
ctgtacataatgtcactggcttgtt

SEQ ID NO: 60876 - DNA, 25 bp, Homo sapien
cataatgtcactggcttgttgggat

SEQ ID NO: 60877 - DNA, 25 bp, Homo sapien
gtcactggcttgttgggatttttaa

SEQ ID NO: 60878 - DNA, 25 bp, Homo sapien
aatttatcttcactcagcaccaagg

SEQ ID NO: 60879 - DNA, 25 bp, Homo sapien
tgagctgagcagagtcattattgga

SEQ ID NO: 60880 - DNA, 25 bp, Homo sapien
agcagagtcattattggagagtttt

SEQ ID NO: 60881 - DNA, 25 bp, Homo sapien
ggaacaccaggtggcttctccgaag

SEQ ID NO: 60882 - DNA, 25 bp, Homo sapien
ggcttctccgaagtcatgggcagtg

SEQ ID NO: 60883 - DNA, 25 bp, Homo sapien
tctccgaagtcatgggcagtgccct

SEQ ID NO: 60884 - DNA, 25 bp, Homo sapien
agtgccctggcctgaaggcccacaa

SEQ ID NO: 60885 - DNA, 25 bp, Homo sapien
tgctgctggagcctggacacgtcct

SEQ ID NO: 60886 - DNA, 25 bp, Homo sapien
agcctggacacgtcctacttaagaa

SEQ ID NO: 60887 - DNA, 25 bp, Homo sapien
agaaaatgccttttactcagggaat

SEQ ID NO: 60888 - DNA, 25 bp, Homo sapien
tactcagggaatctcctgctactta

SEQ ID NO: 60889 - DNA, 25 bp, Homo sapien
tacttaatgtggaaagacacgccca

SEQ ID NO: 60890 - DNA, 25 bp, Homo sapien
ctgtcctcagcacgcgtgtgcaaaa

SEQ ID NO: 60891 - DNA, 25 bp, Homo sapien
gcacgcgtgtgcaaaagtgaacaat

SEQ ID NO: 60892 - DNA, 25 bp, Homo sapien
ttccccaacactacctggaagttgt

SEQ ID NO: 60893 - DNA, 25 bp, Homo sapien
aacactacctggaagttgtgccttc

SEQ ID NO: 60894 - DNA, 25 bp, Homo sapien
tcatgaaactggcagaaaccccttc

SEQ ID NO: 60895 - DNA, 25 bp, Homo sapien
cagaaaccccttcccaagcttctgt

SEQ ID NO: 60896 - DNA, 25 bp, Homo sapien
aacaattaggaatcattgcagattt

SEQ ID NO: 60897 - DNA, 25 bp, Homo sapien
acccgggactacttgctggtgactt

SEQ ID NO: 60898 - DNA, 25 bp, Homo sapien
ccgggactacttgctggtgactttt

SEQ ID NO: 60899 - DNA, 25 bp, Homo sapien
ccaggaaagggacattgtaaatgaa

SEQ ID NO: 60900 - DNA, 25 bp, Homo sapien
acattctcaactcctcttgaatcta

SEQ ID NO: 60901 - DNA, 25 bp, Homo sapien
attctcaactcctcttgaatctatc

SEQ ID NO: 60902 - DNA, 25 bp, Homo sapien
tcctcttgaatctatcccccaagaa

SEQ ID NO: 60903 - DNA, 25 bp, Homo sapien
aagggagggagctaccctctagtcg

SEQ ID NO: 60904 - DNA, 25 bp, Homo sapien
ctaccctctagtcggacagctgata

SEQ ID NO: 60905 - DNA, 25 bp, Homo sapien
tagtcggacagctgatactgcttcc

SEQ ID NO: 60906 - DNA, 25 bp, Homo sapien
cagctgatactgcttccttgcatgg

SEQ ID NO: 60907 - DNA, 25 bp, Homo sapien
acatgggagggagacgttatagatt

SEQ ID NO: 60908 - DNA, 25 bp, Homo sapien
tgttatttgcagaggagtgttgtat

SEQ ID NO: 60909 - DNA, 25 bp, Homo sapien
gatgttattttatgtcacactgctt

SEQ ID NO: 60910 - DNA, 25 bp, Homo sapien
gtcacactgcttcaatgatacctat

SEQ ID NO: 60911 - DNA, 25 bp, Homo sapien
gcttcaatgatacctatatccatgt

SEQ ID NO: 60912 - DNA, 25 bp, Homo sapien
atatccatgtgtttgtatccatgtt

SEQ ID NO: 60913 - DNA, 25 bp, Homo sapien
ttgtatccatgtttttatccattca

SEQ ID NO: 60914 - DNA, 25 bp, Homo sapien
aaggccgaggaggagttcttcgaca

SEQ ID NO: 60915 - DNA, 25 bp, Homo sapien
gaggagttcttcgacatcatcttca

SEQ ID NO: 60916 - DNA, 25 bp, Homo sapien
cttcgacatcatcttcacagagctg

SEQ ID NO: 60917 - DNA, 25 bp, Homo sapien
gaggcagacgccataaagctgacgc

SEQ ID NO: 60918 - DNA, 25 bp, Homo sapien
agacgccataaagctgacgccagtg

SEQ ID NO: 60919 - DNA, 25 bp, Homo sapien
aaagctgacgccagtgcctcagcaa

SEQ ID NO: 60920 - DNA, 25 bp, Homo sapien
tgcctcagcaaccaagtccagaaga

SEQ ID NO: 60921 - DNA, 25 bp, Homo sapien
gaagtggaagaagacttagcctaga

SEQ ID NO: 60922 - DNA, 25 bp, Homo sapien
ttagcctagaagtcagccttcgact

SEQ ID NO: 60923 - DNA, 25 bp, Homo sapien
tagaagtcagccttcgactgcggcg

SEQ ID NO: 60924 - DNA, 25 bp, Homo sapien
tcgactgcggcgctatccctgtgtg

SEQ ID NO: 60925 - DNA, 25 bp, Homo sapien
acttaaattttctgatgctctgctt

SEQ ID NO: 60926 - DNA, 25 bp, Homo sapien
gggttcataataatatttgtcccac

SEQ ID NO: 60927 - DNA, 25 bp, Homo sapien
atatttgtcccacccaacttcttgg

SEQ ID NO: 60928 - DNA, 25 bp, Homo sapien
atctgatgaaatctcctgatcttgc

SEQ ID NO: 60929 - DNA, 25 bp, Homo sapien
tgatgaaatctcctgatcttgctcc

SEQ ID NO: 60930 - DNA, 25 bp, Homo sapien
atgaaatctcctgatcttgctccct

SEQ ID NO: 60931 - DNA, 25 bp, Homo sapien
aatctcctgatcttgctccctgtgt

SEQ ID NO: 60932 - DNA, 25 bp, Homo sapien
cagtttggatatccttttggagcat

SEQ ID NO: 60933 - DNA, 25 bp, Homo sapien
atatccttttggagcatttgcttgc

SEQ ID NO: 60934 - DNA, 25 bp, Homo sapien
tccttttggagcatttgcttgcttc

SEQ ID NO: 60935 - DNA, 25 bp, Homo sapien
atttgcttgcttcacataccaaaat

SEQ ID NO: 60936 - DNA, 25 bp, Homo sapien
gagcaggatttcatcttccagaatc

SEQ ID NO: 60937 - DNA, 25 bp, Homo sapien
aagaagaatctgcttattttgtggg

SEQ ID NO: 60938 - DNA, 25 bp, Homo sapien
tcagatccagaaggtcagcgacatt

SEQ ID NO: 60939 - DNA, 25 bp, Homo sapien
gaaagttccacattctggcatccac

SEQ ID NO: 60940 - DNA, 25 bp, Homo sapien
tggcatccacgtgagcccagtgatc

SEQ ID NO: 60941 - DNA, 25 bp, Homo sapien
tgagcccagtgatcccaatgagcgc

SEQ ID NO: 60942 - DNA, 25 bp, Homo sapien
tgatcccaatgagcgctgcgttgtg

SEQ ID NO: 60943 - DNA, 25 bp, Homo sapien
gctgcgttgtgctaaattttcgtaa

SEQ ID NO: 60944 - DNA, 25 bp, Homo sapien
ttttcgtaaatcacccaaaagatgg

SEQ ID NO: 60945 - DNA, 25 bp, Homo sapien
gatgttaattgtcttggtcctcaaa

SEQ ID NO: 60946 - DNA, 25 bp, Homo sapien
gtgagatgatgaagatccacttatg

SEQ ID NO: 60947 - DNA, 25 bp, Homo sapien
gtttacataattttgggccccagat

SEQ ID NO: 60948 - DNA, 25 bp, Homo sapien
tttgggccccagatggttaagtgct

SEQ ID NO: 60949 - DNA, 25 bp, Homo sapien
ggccccagatggttaagtgctaaat

SEQ ID NO: 60950 - DNA, 25 bp, Homo sapien
gctaaatttgtagggtaggctatca

SEQ ID NO: 60951 - DNA, 25 bp, Homo sapien
ggtaggctatcaggaagtgcaggct

SEQ ID NO: 60952 - DNA, 25 bp, Homo sapien
tgcaggctggaaacatgcaggagct

SEQ ID NO: 60953 - DNA, 25 bp, Homo sapien
ggctggaaacatgcaggagctgtcc

SEQ ID NO: 60954 - DNA, 25 bp, Homo sapien
gtccacaagtggaatttcttcttca

SEQ ID NO: 60955 - DNA, 25 bp, Homo sapien
tcatcatggaaacctcagttttgtt

SEQ ID NO: 60956 - DNA, 25 bp, Homo sapien
gaaacctcagttttgttcatacacc

SEQ ID NO: 60957 - DNA, 25 bp, Homo sapien
cctcagttttgttcatacacctaaa

SEQ ID NO: 60958 - DNA, 25 bp, Homo sapien
atggtggcacatttaatggcttttt

SEQ ID NO: 60959 - DNA, 25 bp, Homo sapien
tttttctgtgttctggaataagaga

SEQ ID NO: 60960 - DNA, 25 bp, Homo sapien
gagaatacctagctactatttaagc

SEQ ID NO: 60961 - DNA, 25 bp, Homo sapien
agctactatttaagcatccaaaaat

SEQ ID NO: 60962 - DNA, 25 bp, Homo sapien
gcatccaaaaatcatatcttgcttt

SEQ ID NO: 60963 - DNA, 25 bp, Homo sapien
catttagttgagaaaagccagcata

SEQ ID NO: 60964 - DNA, 25 bp, Homo sapien
gtgtcatactaattcagtatccaga

SEQ ID NO: 60965 - DNA, 25 bp, Homo sapien
aattcagtatccagaccaaatgttg

SEQ ID NO: 60966 - DNA, 25 bp, Homo sapien
gaccaaatgttggaaagtcttattt

SEQ ID NO: 60967 - DNA, 25 bp, Homo sapien
taatatcccttgttccattttacag

SEQ ID NO: 60968 - DNA, 25 bp, Homo sapien
aacttacctacaatattcatttcaa

SEQ ID NO: 60969 - DNA, 25 bp, Homo sapien
gatgacctgaggttcactgaggata

SEQ ID NO: 60970 - DNA, 25 bp, Homo sapien
aaaccatacggcttagagtctatca

SEQ ID NO: 60971 - DNA, 25 bp, Homo sapien
tatcacagcctctgctaaggtaagt

SEQ ID NO: 60972 - DNA, 25 bp, Homo sapien
gtaagtgtgagtgacgcagctctat

SEQ ID NO: 60973 - DNA, 25 bp, Homo sapien
agtgacgcagctctattcccaaaga

SEQ ID NO: 60974 - DNA, 25 bp, Homo sapien
gacctggcccatgggaagtagtgta

SEQ ID NO: 60975 - DNA, 25 bp, Homo sapien
aagtagtgtacaggcaccagacccc

SEQ ID NO: 60976 - DNA, 25 bp, Homo sapien
gctctgccactaaacgctggttgag

SEQ ID NO: 60977 - DNA, 25 bp, Homo sapien
gttgagcctagaaaggcctctttac

SEQ ID NO: 60978 - DNA, 25 bp, Homo sapien
gatatgtctgccttatgtttttcac

SEQ ID NO: 60979 - DNA, 25 bp, Homo sapien
tatgtttttcacaggccttttacaa

SEQ ID NO: 60980 - DNA, 25 bp, Homo sapien
gagacgccctttcatggtctgctga

SEQ ID NO: 60981 - DNA, 25 bp, Homo sapien
agacgccctttcatggtctgctgag

SEQ ID NO: 60982 - DNA, 25 bp, Homo sapien
acgccctttcatggtctgctgagta

SEQ ID NO: 60983 - DNA, 25 bp, Homo sapien
gccctttcatggtctgctgagtaac

SEQ ID NO: 60984 - DNA, 25 bp, Homo sapien
ccctttcatggtctgctgagtaaca

SEQ ID NO: 60985 - DNA, 25 bp, Homo sapien
tttcatggtctgctgagtaacaggt

SEQ ID NO: 60986 - DNA, 25 bp, Homo sapien
catggtctgctgagtaacaggtgcc

SEQ ID NO: 60987 - DNA, 25 bp, Homo sapien
tggtctgctgagtaacaggtgcctt

SEQ ID NO: 60988 - DNA, 25 bp, Homo sapien
cttatgccagcgtgacagagggctc

SEQ ID NO: 60989 - DNA, 25 bp, Homo sapien
tatgccagcgtgacagagggctcac

SEQ ID NO: 60990 - DNA, 25 bp, Homo sapien
acctgaccctgtgcccgccagttat

SEQ ID NO: 60991 - DNA, 25 bp, Homo sapien
tgagggcaattgcttcctgacgcca

SEQ ID NO: 60992 - DNA, 25 bp, Homo sapien
gagggcaattgcttcctgacgccaa

SEQ ID NO: 60993 - DNA, 25 bp, Homo sapien
ggcaattgcttcctgacgccaagct

SEQ ID NO: 60994 - DNA, 25 bp, Homo sapien
aattgcttcctgacgccaagctcct

SEQ ID NO: 60995 - DNA, 25 bp, Homo sapien
ttcctgacgccaagctccttgaggt

SEQ ID NO: 60996 - DNA, 25 bp, Homo sapien
cctgacgccaagctccttgaggtta

SEQ ID NO: 60997 - DNA, 25 bp, Homo sapien
tctattgggacatccagagaatgca

SEQ ID NO: 60998 - DNA, 25 bp, Homo sapien
ttgggacatccagagaatgcagtct

SEQ ID NO: 60999 - DNA, 25 bp, Homo sapien
gggacatccagagaatgcagtcttg

SEQ ID NO: 61000 - DNA, 25 bp, Homo sapien
gacatccagagaatgcagtcttgca

SEQ ID NO: 61001 - DNA, 25 bp, Homo sapien
agaggcaaggtgcttcctgaccctt

SEQ ID NO: 61002 - DNA, 25 bp, Homo sapien
ttcaacgagaacttccgccgcggct

SEQ ID NO: 61003 - DNA, 25 bp, Homo sapien
tcaacgagaacttccgccgcggctt

SEQ ID NO: 61004 - DNA, 25 bp, Homo sapien
gagaacttccgccgcggcttccagg

SEQ ID NO: 61005 - DNA, 25 bp, Homo sapien
cacaaggaggcctactccgagcggc

SEQ ID NO: 61006 - DNA, 25 bp, Homo sapien
aaggaggcctactccgagcggcccg

SEQ ID NO: 61007 - DNA, 25 bp, Homo sapien
ggcttctgcacaggcgggtcttcgt

SEQ ID NO: 61008 - DNA, 25 bp, Homo sapien
ggctgccctctgagtcgggccctag

SEQ ID NO: 61009 - DNA, 25 bp, Homo sapien
cctctgagtcgggccctagcagtgg

SEQ ID NO: 61010 - DNA, 25 bp, Homo sapien
ggaatgggcgggtggctcaccacgg

SEQ ID NO: 61011 - DNA, 25 bp, Homo sapien
gggtggctcaccacggcttgcccag

SEQ ID NO: 61012 - DNA, 25 bp, Homo sapien
tcaccacggcttgcccagggaaggg

SEQ ID NO: 61013 - DNA, 25 bp, Homo sapien
tatttttactatttctttatcactt

SEQ ID NO: 61014 - DNA, 25 bp, Homo sapien
tatcactttattgtatcatcaccat

SEQ ID NO: 61015 - DNA, 25 bp, Homo sapien
ttattgtatcatcaccattggtttc

SEQ ID NO: 61016 - DNA, 25 bp, Homo sapien
catcaccattggtttcataatgtaa

SEQ ID NO: 61017 - DNA, 25 bp, Homo sapien
ttttattaccatagtccatgttaat

SEQ ID NO: 61018 - DNA, 25 bp, Homo sapien
taccatagtccatgttaatagtggg

SEQ ID NO: 61019 - DNA, 25 bp, Homo sapien
gggctttcaggtgtttagagatttt

SEQ ID NO: 61020 - DNA, 25 bp, Homo sapien
tcattgcaaaagtactagatggtgt

SEQ ID NO: 61021 - DNA, 25 bp, Homo sapien
agatggtgtataactctagagttga

SEQ ID NO: 61022 - DNA, 25 bp, Homo sapien
taagggattccctaatatgtatact

SEQ ID NO: 61023 - DNA, 25 bp, Homo sapien
ggattccctaatatgtatactatct

SEQ ID NO: 61024 - DNA, 25 bp, Homo sapien
tgaagccatgattgccttcctcatg

SEQ ID NO: 61025 - DNA, 25 bp, Homo sapien
ttgccttcctcatgggttacagtga

SEQ ID NO: 61026 - DNA, 25 bp, Homo sapien
gcctcttctaccaagtggctgagta

SEQ ID NO: 61027 - DNA, 25 bp, Homo sapien
aagtggctgagtacaccttccgcca

SEQ ID NO: 61028 - DNA, 25 bp, Homo sapien
gccagtttcgcgatcccgagtacgg

SEQ ID NO: 61029 - DNA, 25 bp, Homo sapien
tttggctacctgagccgagagggca

SEQ ID NO: 61030 - DNA, 25 bp, Homo sapien
ctccatcaagggaggtcctttcaaa

SEQ ID NO: 61031 - DNA, 25 bp, Homo sapien
gaggtcctttcaaaggctgcttcca

SEQ ID NO: 61032 - DNA, 25 bp, Homo sapien
aaaggctgcttccacgtgccgcggt

SEQ ID NO: 61033 - DNA, 25 bp, Homo sapien
acgtgccgcggtgcctagccatgtg

SEQ ID NO: 61034 - DNA, 25 bp, Homo sapien
gcctagccatgtgcgaggagatgct

SEQ ID NO: 61035 - DNA, 25 bp, Homo sapien
atttgacctgcttcgctctggaaag

SEQ ID NO: 61036 - DNA, 25 bp, Homo sapien
tttgacctgcttcgctctggaaaga

SEQ ID NO: 61037 - DNA, 25 bp, Homo sapien
tgacctgcttcgctctggaaagagt

SEQ ID NO: 61038 - DNA, 25 bp, Homo sapien
gacctgcttcgctctggaaagagta

SEQ ID NO: 61039 - DNA, 25 bp, Homo sapien
cctgcttcgctctggaaagagtatc

SEQ ID NO: 61040 - DNA, 25 bp, Homo sapien
gcttcgctctggaaagagtatccgt

SEQ ID NO: 61041 - DNA, 25 bp, Homo sapien
ttcgctctggaaagagtatccgtac

SEQ ID NO: 61042 - DNA, 25 bp, Homo sapien
gctctggaaagagtatccgtaccgt

SEQ ID NO: 61043 - DNA, 25 bp, Homo sapien
gtcctgacgttttgaaacaatacag

SEQ ID NO: 61044 - DNA, 25 bp, Homo sapien
tgaaacaatacagatgccttccctt

SEQ ID NO: 61045 - DNA, 25 bp, Homo sapien
taaaaataaattacacgtgggagct

SEQ ID NO: 61046 - DNA, 25 bp, Homo sapien
acaagttccctgtccttatcagcca

SEQ ID NO: 61047 - DNA, 25 bp, Homo sapien
ttatcagccactgggtggttcccac

SEQ ID NO: 61048 - DNA, 25 bp, Homo sapien
tggttcccactgcatgaccctctat

SEQ ID NO: 61049 - DNA, 25 bp, Homo sapien
tgtccccatggtttccagctcaatc

SEQ ID NO: 61050 - DNA, 25 bp, Homo sapien
tgtcagctttttcccagggagccgt

SEQ ID NO: 61051 - DNA, 25 bp, Homo sapien
tggcctcagaacctggtggctcctg

SEQ ID NO: 61052 - DNA, 25 bp, Homo sapien
tttgtaaaaccatccccttcaccag

SEQ ID NO: 61053 - DNA, 25 bp, Homo sapien
catccccttcaccagaatggtatta

SEQ ID NO: 61054 - DNA, 25 bp, Homo sapien
gaatggtattaactcctggtgcttt

SEQ ID NO: 61055 - DNA, 25 bp, Homo sapien
taactcctggtgctttgtactactg

SEQ ID NO: 61056 - DNA, 25 bp, Homo sapien
tgctttgtactactggtccagctgc

SEQ ID NO: 61057 - DNA, 25 bp, Homo sapien
atggccatggcgcaggctctcgaac

SEQ ID NO: 61058 - DNA, 25 bp, Homo sapien
caggctctcgaacccgcatggcttt

SEQ ID NO: 61059 - DNA, 25 bp, Homo sapien
tgctctccagggacggttggcacct

SEQ ID NO: 61060 - DNA, 25 bp, Homo sapien
agaacacacagacccacctttctgg

SEQ ID NO: 61061 - DNA, 25 bp, Homo sapien
gacccacctttctggcgttctttct

SEQ ID NO: 61062 - DNA, 25 bp, Homo sapien
tacctcccttttcgttgcctgagga

SEQ ID NO: 61063 - DNA, 25 bp, Homo sapien
tcccttttcgttgcctgaggagctg

SEQ ID NO: 61064 - DNA, 25 bp, Homo sapien
ggagctggtggtttcatgagttaat

SEQ ID NO: 61065 - DNA, 25 bp, Homo sapien
gagttaatgatacatcttgcaaggt

SEQ ID NO: 61066 - DNA, 25 bp, Homo sapien
acatcttgcaaggtgtacacataga

SEQ ID NO: 61067 - DNA, 25 bp, Homo sapien
aatgtggaaaagcacgccaaagcct

SEQ ID NO: 61068 - DNA, 25 bp, Homo sapien
aacactttgagtggccaggcctgtg

SEQ ID NO: 61069 - DNA, 25 bp, Homo sapien
gcctgtgtcatgtgctaattcctag

SEQ ID NO: 61070 - DNA, 25 bp, Homo sapien
atgtgctaattcctagagccaggga

SEQ ID NO: 61071 - DNA, 25 bp, Homo sapien
cagggaaataaggtctgaggattca

SEQ ID NO: 61072 - DNA, 25 bp, Homo sapien
gggaaacgagtggtctgctctgctc

SEQ ID NO: 61073 - DNA, 25 bp, Homo sapien
ggtctgctctgctcgggcaaaacaa

SEQ ID NO: 61074 - DNA, 25 bp, Homo sapien
caaaacaagagatgcccattactgt

SEQ ID NO: 61075 - DNA, 25 bp, Homo sapien
gcccattactgtgagggacccttga

SEQ ID NO: 61076 - DNA, 25 bp, Homo sapien
ggacccttgaagtctggactcttaa

SEQ ID NO: 61077 - DNA, 25 bp, Homo sapien
ttttgctgatttcctgggtgcatgc

SEQ ID NO: 61078 - DNA, 25 bp, Homo sapien
tttcctgggtgcatgctaggatgat

SEQ ID NO: 61079 - DNA, 25 bp, Homo sapien
atcttcactgtgctggagctcttat

SEQ ID NO: 61080 - DNA, 25 bp, Homo sapien
gctcttattagctgcatacagttct

SEQ ID NO: 61081 - DNA, 25 bp, Homo sapien
tacagttctgtcttttggtggaaac

SEQ ID NO: 61082 - DNA, 25 bp, Homo sapien
tttggtggaaacagctctactccaa

SEQ ID NO: 61083 - DNA, 25 bp, Homo sapien
tccaacaaccctgggagttcatttt

SEQ ID NO: 61084 - DNA, 25 bp, Homo sapien
gggagttcattttcctcgacccagt

SEQ ID NO: 61085 - DNA, 25 bp, Homo sapien
tcgacccagtcacaagatcatatcc

SEQ ID NO: 61086 - DNA, 25 bp, Homo sapien
gagttcttcacggtcttggatataa

SEQ ID NO: 61087 - DNA, 25 bp, Homo sapien
tataagtaactcttggcctcagagg

SEQ ID NO: 61088 - DNA, 25 bp, Homo sapien
gaaggaaaagcaactcaacactcat

SEQ ID NO: 61089 - DNA, 25 bp, Homo sapien
caagtgtgattagactttcctgaaa

SEQ ID NO: 61090 - DNA, 25 bp, Homo sapien
attagtcatgcctcaaaactgccct

SEQ ID NO: 61091 - DNA, 25 bp, Homo sapien
aaaactgccctttgaggtaggtcag

SEQ ID NO: 61092 - DNA, 25 bp, Homo sapien
gccctttgaggtaggtcagtattat

SEQ ID NO: 61093 - DNA, 25 bp, Homo sapien
aactgaggcaccttatagttaagtg

SEQ ID NO: 61094 - DNA, 25 bp, Homo sapien
tcacacagcaagtcagtggcacagt

SEQ ID NO: 61095 - DNA, 25 bp, Homo sapien
cagcaagtcagtggcacagtggttg

SEQ ID NO: 61096 - DNA, 25 bp, Homo sapien
taacatggccacctcgcttttttaa

SEQ ID NO: 61097 - DNA, 25 bp, Homo sapien
gatgacctatttgagctacacttac

SEQ ID NO: 61098 - DNA, 25 bp, Homo sapien
gctacacttacagagaatacaccca

SEQ ID NO: 61099 - DNA, 25 bp, Homo sapien
gagaatacacccaagatactagcaa

SEQ ID NO: 61100 - DNA, 25 bp, Homo sapien
caagatactagcaaaccaaggagaa

SEQ ID NO: 61101 - DNA, 25 bp, Homo sapien
aatgttcaggatgtgcctgtacaca

SEQ ID NO: 61102 - DNA, 25 bp, Homo sapien
gtacacaactcatttctgtttggca

SEQ ID NO: 61103 - DNA, 25 bp, Homo sapien
atttctgtttggcacattcagctgt

SEQ ID NO: 61104 - DNA, 25 bp, Homo sapien
tttctttcctgtgtgcttaccatga

SEQ ID NO: 61105 - DNA, 25 bp, Homo sapien
gtgcttaccatgagtgtcaccatta

SEQ ID NO: 61106 - DNA, 25 bp, Homo sapien
gggccattcactctggcaattatat

SEQ ID NO: 61107 - DNA, 25 bp, Homo sapien
atatttggtttcagattccagttct

SEQ ID NO: 61108 - DNA, 25 bp, Homo sapien
gattccagttctgttgtcactttta

SEQ ID NO: 61109 - DNA, 25 bp, Homo sapien
tgttgtcacttttagaaccaccctc

SEQ ID NO: 61110 - DNA, 25 bp, Homo sapien
tagaaccaccctcatttttccttag

SEQ ID NO: 61111 - DNA, 25 bp, Homo sapien
cagcagttggacactgacctcctta

SEQ ID NO: 61112 - DNA, 25 bp, Homo sapien
agccctccagaggtgaggccactga

SEQ ID NO: 61113 - DNA, 25 bp, Homo sapien
gtgaggccactgagagacaggcttt

SEQ ID NO: 61114 - DNA, 25 bp, Homo sapien
gagagacaggctttgggcaccactt

SEQ ID NO: 61115 - DNA, 25 bp, Homo sapien
tcacaggccttcagaggcgatggct

SEQ ID NO: 61116 - DNA, 25 bp, Homo sapien
gctgggcgacagtgacgaaagcaaa

SEQ ID NO: 61117 - DNA, 25 bp, Homo sapien
agggctgtggagacactcctcgcat

SEQ ID NO: 61118 - DNA, 25 bp, Homo sapien
tttgtctcttccctccaaggattat

SEQ ID NO: 61119 - DNA, 25 bp, Homo sapien
ggattatctgagcaagtcgacttgt

SEQ ID NO: 61120 - DNA, 25 bp, Homo sapien
gtcgacttgttcattcaaaggcggg

SEQ ID NO: 61121 - DNA, 25 bp, Homo sapien
gccaagccctgctctatccaatggg

SEQ ID NO: 61122 - DNA, 25 bp, Homo sapien
gggatagcttctacgtaacggattc

SEQ ID NO: 61123 - DNA, 25 bp, Homo sapien
ttgccgccgcgtctgtgaaccttta

SEQ ID NO: 61124 - DNA, 25 bp, Homo sapien
tgaacctttactaggctactaccca

SEQ ID NO: 61125 - DNA, 25 bp, Homo sapien
taggctactacccatatccatactg

SEQ ID NO: 61126 - DNA, 25 bp, Homo sapien
actgctaccaaggaggacgagtcat

SEQ ID NO: 61127 - DNA, 25 bp, Homo sapien
gacgagtcatctgtcgtgtcatcat

SEQ ID NO: 61128 - DNA, 25 bp, Homo sapien
gtgtcatcatgccttgtaactggtg

SEQ ID NO: 61129 - DNA, 25 bp, Homo sapien
gagctcaaatgcttaaactgctggc

SEQ ID NO: 61130 - DNA, 25 bp, Homo sapien
ttcaatgaatttctgcctatgaggc

SEQ ID NO: 61131 - DNA, 25 bp, Homo sapien
ctatgaggcatctggcccctggtag

SEQ ID NO: 61132 - DNA, 25 bp, Homo sapien
gccagctctccagaattacttgtag

SEQ ID NO: 61133 - DNA, 25 bp, Homo sapien
gttgtatttactgccgtcgaggcaa

SEQ ID NO: 61134 - DNA, 25 bp, Homo sapien
ggcttttgggaacagctcatcaatt

SEQ ID NO: 61135 - DNA, 25 bp, Homo sapien
gggaacagctcatcaattacgaatt

SEQ ID NO: 61136 - DNA, 25 bp, Homo sapien
tcaattacgaattcaagctgtttaa

SEQ ID NO: 61137 - DNA, 25 bp, Homo sapien
gctgtttaataacaacaccgtgcgc

SEQ ID NO: 61138 - DNA, 25 bp, Homo sapien
taacaacaccgtgcgcatgatcaac

SEQ ID NO: 61139 - DNA, 25 bp, Homo sapien
gcatgatcaactcgccggtaggtaa

SEQ ID NO: 61140 - DNA, 25 bp, Homo sapien
cggtaggtaacatccctgacatcta

SEQ ID NO: 61141 - DNA, 25 bp, Homo sapien
gaaggacctacgtacgatgatatca

SEQ ID NO: 61142 - DNA, 25 bp, Homo sapien
atctgccatcgatcttgcaccaaga

SEQ ID NO: 61143 - DNA, 25 bp, Homo sapien
gatcttgcaccaagactgaacttga

SEQ ID NO: 61144 - DNA, 25 bp, Homo sapien
taaagaaaaccggatggtgccttgt

SEQ ID NO: 61145 - DNA, 25 bp, Homo sapien
gtttcctaaggtacaatagtggatt

SEQ ID NO: 61146 - DNA, 25 bp, Homo sapien
atagtggattcagaacttgacgttc

SEQ ID NO: 61147 - DNA, 25 bp, Homo sapien
aacttgacgttctgaggcacatcct

SEQ ID NO: 61148 - DNA, 25 bp, Homo sapien
gaggcacatcctcactgtaaacagt

SEQ ID NO: 61149 - DNA, 25 bp, Homo sapien
gctatatgcatgaagcttctgttta

SEQ ID NO: 61150 - DNA, 25 bp, Homo sapien
aaatgagcatgcagggctaaggcat

SEQ ID NO: 61151 - DNA, 25 bp, Homo sapien
gcagggctaaggcatataggatttt

SEQ ID NO: 61152 - DNA, 25 bp, Homo sapien
ataggatttttctgcaggactttaa

SEQ ID NO: 61153 - DNA, 25 bp, Homo sapien
ttctgcaggactttaaagctttgaa

SEQ ID NO: 61154 - DNA, 25 bp, Homo sapien
gctttgaaaggccaatatcccatag

SEQ ID NO: 61155 - DNA, 25 bp, Homo sapien
ggccaatatcccataggctaacttt

SEQ ID NO: 61156 - DNA, 25 bp, Homo sapien
ctgcacaaggccaccagcgaggtgg

SEQ ID NO: 61157 - DNA, 25 bp, Homo sapien
caccagcgaggtggctagtgactac

SEQ ID NO: 61158 - DNA, 25 bp, Homo sapien
cgaggtggctagtgactacaagaaa

SEQ ID NO: 61159 - DNA, 25 bp, Homo sapien
aagaagcatgtcttcaagctccaga

SEQ ID NO: 61160 - DNA, 25 bp, Homo sapien
agcatgtcttcaagctccagaccca

SEQ ID NO: 61161 - DNA, 25 bp, Homo sapien
cagacccaggatggcagtgagtttt

SEQ ID NO: 61162 - DNA, 25 bp, Homo sapien
ggcagtgagtttttgctccaggcaa

SEQ ID NO: 61163 - DNA, 25 bp, Homo sapien
gtgagtttttgctccaggcaaaaga

SEQ ID NO: 61164 - DNA, 25 bp, Homo sapien
ctggctggaggctgtagcttcctcg

SEQ ID NO: 61165 - DNA, 25 bp, Homo sapien
tcctcggtggcggaacacgcagaga

SEQ ID NO: 61166 - DNA, 25 bp, Homo sapien
tcatccacagatgagggcaacccta

SEQ ID NO: 61167 - DNA, 25 bp, Homo sapien
ttattaatcctttcagtggtttttg

SEQ ID NO: 61168 - DNA, 25 bp, Homo sapien
tttttgtgtttttccggcaagtgat

SEQ ID NO: 61169 - DNA, 25 bp, Homo sapien
ttttgtgtttttccggcaagtgata

SEQ ID NO: 61170 - DNA, 25 bp, Homo sapien
gtgtttttccggcaagtgataggaa

SEQ ID NO: 61171 - DNA, 25 bp, Homo sapien
tgtttttccggcaagtgataggaaa

SEQ ID NO: 61172 - DNA, 25 bp, Homo sapien
ttttccggcaagtgataggaaacca

SEQ ID NO: 61173 - DNA, 25 bp, Homo sapien
ttccggcaagtgataggaaaccact

SEQ ID NO: 61174 - DNA, 25 bp, Homo sapien
tccggcaagtgataggaaaccactt

SEQ ID NO: 61175 - DNA, 25 bp, Homo sapien
ccggcaagtgataggaaaccactta

SEQ ID NO: 61176 - DNA, 25 bp, Homo sapien
cggcaagtgataggaaaccacttaa

SEQ ID NO: 61177 - DNA, 25 bp, Homo sapien
gcaagtgataggaaaccacttaaaa

SEQ ID NO: 61178 - DNA, 25 bp, Homo sapien
gagaatgtttcagaactccctgatg

SEQ ID NO: 61179 - DNA, 25 bp, Homo sapien
gaactccctgatgaatttctaagtg

SEQ ID NO: 61180 - DNA, 25 bp, Homo sapien
gaatttctaagtgagcaacttgata

SEQ ID NO: 61181 - DNA, 25 bp, Homo sapien
catttttgtcagtgtatccagttac

SEQ ID NO: 61182 - DNA, 25 bp, Homo sapien
gtatccagttacagaatgctacaca

SEQ ID NO: 61183 - DNA, 25 bp, Homo sapien
agaatgctacacacttaccttttta

SEQ ID NO: 61184 - DNA, 25 bp, Homo sapien
tttttattggctgagaaatctggtt

SEQ ID NO: 61185 - DNA, 25 bp, Homo sapien
gaaatctggttatttcatcttaatc

SEQ ID NO: 61186 - DNA, 25 bp, Homo sapien
tcaatcttcctaaaaggtctgcttt

SEQ ID NO: 61187 - DNA, 25 bp, Homo sapien
ttttatttaacaataggcactgggt

SEQ ID NO: 61188 - DNA, 25 bp, Homo sapien
ggcactgggtttgtgttacatattt

SEQ ID NO: 61189 - DNA, 25 bp, Homo sapien
gtgatctcattgatggtagttctca

SEQ ID NO: 61190 - DNA, 25 bp, Homo sapien
cattgatggtagttctcagccgtct

SEQ ID NO: 61191 - DNA, 25 bp, Homo sapien
tggtagttctcagccgtctcaaaaa

SEQ ID NO: 61192 - DNA, 25 bp, Homo sapien
gttctcagccgtctcaaaaactgca

SEQ ID NO: 61193 - DNA, 25 bp, Homo sapien
ctcagccgtctcaaaaactgcaagc

SEQ ID NO: 61194 - DNA, 25 bp, Homo sapien
tgcaagctaatcagtcagacattct

SEQ ID NO: 61195 - DNA, 25 bp, Homo sapien
gtcagacattctttaatgaccccaa

SEQ ID NO: 61196 - DNA, 25 bp, Homo sapien
agacattctttaatgaccccaattt

SEQ ID NO: 61197 - DNA, 25 bp, Homo sapien
tttttcactttaattgttaccatgt

SEQ ID NO: 61198 - DNA, 25 bp, Homo sapien
taattgttaccatgttttctatttt

SEQ ID NO: 61199 - DNA, 25 bp, Homo sapien
aatcttgtgtttctcctgatgtgca

SEQ ID NO: 61200 - DNA, 25 bp, Homo sapien
ccattctgatgttttgagacaatac

SEQ ID NO: 61201 - DNA, 25 bp, Homo sapien
tgagacaatacagatgttttccctt

SEQ ID NO: 61202 - DNA, 25 bp, Homo sapien
caatacagatgttttcccttgtggc

SEQ ID NO: 61203 - DNA, 25 bp, Homo sapien
atacagatgttttcccttgtggcag

SEQ ID NO: 61204 - DNA, 25 bp, Homo sapien
tacagatgttttcccttgtggcagt

SEQ ID NO: 61205 - DNA, 25 bp, Homo sapien
cagatgttttcccttgtggcagtct

SEQ ID NO: 61206 - DNA, 25 bp, Homo sapien
agatgttttcccttgtggcagtctt

SEQ ID NO: 61207 - DNA, 25 bp, Homo sapien
atgttttcccttgtggcagtcttca

SEQ ID NO: 61208 - DNA, 25 bp, Homo sapien
gttttcccttgtggcagtcttcagc

SEQ ID NO: 61209 - DNA, 25 bp, Homo sapien
tttcccttgtggcagtcttcagcct

SEQ ID NO: 61210 - DNA, 25 bp, Homo sapien
tcattaattctgctcatcacagatt

SEQ ID NO: 61211 - DNA, 25 bp, Homo sapien
tattagaaaatgtcctcgtcccctt

SEQ ID NO: 61212 - DNA, 25 bp, Homo sapien
ccctttctttgcaaatattagttct

SEQ ID NO: 61213 - DNA, 25 bp, Homo sapien
tatttataacgatgattcttttgct

SEQ ID NO: 61214 - DNA, 25 bp, Homo sapien
ccttggaagacatgctcaacagatc

SEQ ID NO: 61215 - DNA, 25 bp, Homo sapien
gacatgctcaacagatccaatttca

SEQ ID NO: 61216 - DNA, 25 bp, Homo sapien
gatccaatttcattgcagcagtcag

SEQ ID NO: 61217 - DNA, 25 bp, Homo sapien
caatttcattgcagcagtcagtgtc

SEQ ID NO: 61218 - DNA, 25 bp, Homo sapien
tccaggctgcaggaacacagtcatc

SEQ ID NO: 61219 - DNA, 25 bp, Homo sapien
cacagtcatcttacccttacaaaaa

SEQ ID NO: 61220 - DNA, 25 bp, Homo sapien
caaaaaagaccttccgcttactctg

SEQ ID NO: 61221 - DNA, 25 bp, Homo sapien
aagaccttccgcttactctgttttg

SEQ ID NO: 61222 - DNA, 25 bp, Homo sapien
ggtaacgaccgcttgtctttggtct

SEQ ID NO: 61223 - DNA, 25 bp, Homo sapien
ttgtctttggtctctaaccctaatc

SEQ ID NO: 61224 - DNA, 25 bp, Homo sapien
tttggtctctaaccctaatctctgg

SEQ ID NO: 61225 - DNA, 25 bp, Homo sapien
taaccctaatctctgggcttgccct

SEQ ID NO: 61226 - DNA, 25 bp, Homo sapien
ccctttgcctcctgcagaactttga

SEQ ID NO: 61227 - DNA, 25 bp, Homo sapien
aaagctgggttgagtgaggctatca

SEQ ID NO: 61228 - DNA, 25 bp, Homo sapien
gaggctatcagcacagccttccttg

SEQ ID NO: 61229 - DNA, 25 bp, Homo sapien
gactctgaaggtgtccccacgaagg

SEQ ID NO: 61230 - DNA, 25 bp, Homo sapien
ggtgtccccacgaaggccagaaagg

SEQ ID NO: 61231 - DNA, 25 bp, Homo sapien
gtgcttggaagagccggccttgggt

SEQ ID NO: 61232 - DNA, 25 bp, Homo sapien
taccctcactgggtgggactgccag

SEQ ID NO: 61233 - DNA, 25 bp, Homo sapien
atagtaatagaggattcgctgttga

SEQ ID NO: 61234 - DNA, 25 bp, Homo sapien
tagaggattcgctgttgaaacaagt

SEQ ID NO: 61235 - DNA, 25 bp, Homo sapien
ttcgctgttgaaacaagttgtccaa

SEQ ID NO: 61236 - DNA, 25 bp, Homo sapien
gttgtccaagcaatgttatattcat

SEQ ID NO: 61237 - DNA, 25 bp, Homo sapien
aagtgtgagttaatattggacacat

SEQ ID NO: 61238 - DNA, 25 bp, Homo sapien
tggacacattttatcctgatccaca

SEQ ID NO: 61239 - DNA, 25 bp, Homo sapien
tatcctgatccacagtggagtttta

SEQ ID NO: 61240 - DNA, 25 bp, Homo sapien
atccacagtggagttttagtaatta

SEQ ID NO: 61241 - DNA, 25 bp, Homo sapien
gtagagataatgtgtagtcacttct

SEQ ID NO: 61242 - DNA, 25 bp, Homo sapien
gtcacttctgatttagtgaaaccaa

SEQ ID NO: 61243 - DNA, 25 bp, Homo sapien
ctgatttagtgaaaccaattgtaat

SEQ ID NO: 61244 - DNA, 25 bp, Homo sapien
catggccagcgagaacagcgagtgc

SEQ ID NO: 61245 - DNA, 25 bp, Homo sapien
gcgagtgctctgtcaagacgctcta

SEQ ID NO: 61246 - DNA, 25 bp, Homo sapien
ctgtcaagacgctctatgggattta

SEQ ID NO: 61247 - DNA, 25 bp, Homo sapien
ggatttactacaagtgtccctgtga

SEQ ID NO: 61248 - DNA, 25 bp, Homo sapien
aagtgtccctgtgagcgtggcctga

SEQ ID NO: 61249 - DNA, 25 bp, Homo sapien
cctgtgagggagacaagaccatcgt

SEQ ID NO: 61250 - DNA, 25 bp, Homo sapien
tcaccaacaccaactttggcatctg

SEQ ID NO: 61251 - DNA, 25 bp, Homo sapien
ttggcatctgccatgacgctggacg

SEQ ID NO: 61252 - DNA, 25 bp, Homo sapien
tgacgctggacgctccaagcagtga

SEQ ID NO: 61253 - DNA, 25 bp, Homo sapien
cagaatgctgtaggccactaggcgc

SEQ ID NO: 61254 - DNA, 25 bp, Homo sapien
ttgaccagcatatctgttttctgat

SEQ ID NO: 61255 - DNA, 25 bp, Homo sapien
tatctgtgatggatggacacaaaaa

SEQ ID NO: 61256 - DNA, 25 bp, Homo sapien
aatgtacattacctggtttcctggg

SEQ ID NO: 61257 - DNA, 25 bp, Homo sapien
acattacctggtttcctgggattca

SEQ ID NO: 61258 - DNA, 25 bp, Homo sapien
tttcctgggattcaaacctgcatat

SEQ ID NO: 61259 - DNA, 25 bp, Homo sapien
gggattcaaacctgcatattgtgat

SEQ ID NO: 61260 - DNA, 25 bp, Homo sapien
tcaaacctgcatattgtgattttaa

SEQ ID NO: 61261 - DNA, 25 bp, Homo sapien
taaagttatcttacgctatttctgt

SEQ ID NO: 61262 - DNA, 25 bp, Homo sapien
tatcttacgctatttctgttggtta

SEQ ID NO: 61263 - DNA, 25 bp, Homo sapien
gctatttctgttggttagtagacac

SEQ ID NO: 61264 - DNA, 25 bp, Homo sapien
gtagacactaattctgtcagtaggg

SEQ ID NO: 61265 - DNA, 25 bp, Homo sapien
tgaggtggtactatgattaaaagcc

SEQ ID NO: 61266 - DNA, 25 bp, Homo sapien
aatttccagataagacatgtcacca

SEQ ID NO: 61267 - DNA, 25 bp, Homo sapien
gacatgtcaccattaattctcaacg

SEQ ID NO: 61268 - DNA, 25 bp, Homo sapien
ccattaattctcaacgactgctcta

SEQ ID NO: 61269 - DNA, 25 bp, Homo sapien
gactgctctattttgttgtacggta

SEQ ID NO: 61270 - DNA, 25 bp, Homo sapien
gtacggtaatagttatcaccttcta

SEQ ID NO: 61271 - DNA, 25 bp, Homo sapien
agttatcaccttctaaattactatg

SEQ ID NO: 61272 - DNA, 25 bp, Homo sapien
gtttattgtcttgtatcctttctct

SEQ ID NO: 61273 - DNA, 25 bp, Homo sapien
atcctttctctggagtgtaagcaca

SEQ ID NO: 61274 - DNA, 25 bp, Homo sapien
aatgcaacatactctcagcacctaa

SEQ ID NO: 61275 - DNA, 25 bp, Homo sapien
gcacctaaaatagtgccgggaacat

SEQ ID NO: 61276 - DNA, 25 bp, Homo sapien
ccgggaacatagtaagggctcagta

SEQ ID NO: 61277 - DNA, 25 bp, Homo sapien
tagttcttttacgaagtcatcctca

SEQ ID NO: 61278 - DNA, 25 bp, Homo sapien
agttcttttacgaagtcatcctcaa

SEQ ID NO: 61279 - DNA, 25 bp, Homo sapien
gttcttttacgaagtcatcctcaag

SEQ ID NO: 61280 - DNA, 25 bp, Homo sapien
tcttttacgaagtcatcctcaagct

SEQ ID NO: 61281 - DNA, 25 bp, Homo sapien
cttttacgaagtcatcctcaagctt

SEQ ID NO: 61282 - DNA, 25 bp, Homo sapien
tttacgaagtcatcctcaagcttca

SEQ ID NO: 61283 - DNA, 25 bp, Homo sapien
tacgaagtcatcctcaagcttcaat

SEQ ID NO: 61284 - DNA, 25 bp, Homo sapien
gaagtcatcctcaagcttcaattta

SEQ ID NO: 61285 - DNA, 25 bp, Homo sapien
agtcatcctcaagcttcaatttatt

SEQ ID NO: 61286 - DNA, 25 bp, Homo sapien
gtcatcctcaagcttcaatttattt

SEQ ID NO: 61287 - DNA, 25 bp, Homo sapien
catcctcaagcttcaatttatttat

SEQ ID NO: 61288 - DNA, 25 bp, Homo sapien
gaattagatagttcatcctcattgt

SEQ ID NO: 61289 - DNA, 25 bp, Homo sapien
tcatcctcattgtgtgtgctagtaa

SEQ ID NO: 61290 - DNA, 25 bp, Homo sapien
tcctcattgtgtgtgctagtaagca

SEQ ID NO: 61291 - DNA, 25 bp, Homo sapien
gctagtaagcactgttggaaaactc

SEQ ID NO: 61292 - DNA, 25 bp, Homo sapien
gcactgttggaaaactctgtaggct

SEQ ID NO: 61293 - DNA, 25 bp, Homo sapien
ctgttggaaaactctgtaggctgat

SEQ ID NO: 61294 - DNA, 25 bp, Homo sapien
tggaaaactctgtaggctgattaat

SEQ ID NO: 61295 - DNA, 25 bp, Homo sapien
aaactctgtaggctgattaatgaag

SEQ ID NO: 61296 - DNA, 25 bp, Homo sapien
gaagatgtgaatgagcaggttatgc

SEQ ID NO: 61297 - DNA, 25 bp, Homo sapien
gaatgagcaggttatgcaggtatta

SEQ ID NO: 61298 - DNA, 25 bp, Homo sapien
tgcaggtattaggacctgaagacct

SEQ ID NO: 61299 - DNA, 25 bp, Homo sapien
gctactgtaagttttgctccatgga

SEQ ID NO: 61300 - DNA, 25 bp, Homo sapien
ctgtaagttttgctccatggaataa

SEQ ID NO: 61301 - DNA, 25 bp, Homo sapien
ttgctccatggaataatgatgtgat

SEQ ID NO: 61302 - DNA, 25 bp, Homo sapien
gactatgaataagttcctacatgaa

SEQ ID NO: 61303 - DNA, 25 bp, Homo sapien
agttcctacatgaaggttaatgtca

SEQ ID NO: 61304 - DNA, 25 bp, Homo sapien
ggtgaaaaatcttattatgctccaa

SEQ ID NO: 61305 - DNA, 25 bp, Homo sapien
tattatgctccaatatactgccagc

SEQ ID NO: 61306 - DNA, 25 bp, Homo sapien
gctccaatatactgccagcatgctg

SEQ ID NO: 61307 - DNA, 25 bp, Homo sapien
atactgccagcatgctgagtatact

SEQ ID NO: 61308 - DNA, 25 bp, Homo sapien
gcatgctgagtatacttggatcata

SEQ ID NO: 61309 - DNA, 25 bp, Homo sapien
cttggatcataaaaaactgtttcat

SEQ ID NO: 61310 - DNA, 25 bp, Homo sapien
ggatcaactgttgtcggtgaacggt

SEQ ID NO: 61311 - DNA, 25 bp, Homo sapien
caactgttgtcggtgaacggtgtga

SEQ ID NO: 61312 - DNA, 25 bp, Homo sapien
gctcggtgaagctggttgtccgtta

SEQ ID NO: 61313 - DNA, 25 bp, Homo sapien
tgaagctggttgtccgttacacacc

SEQ ID NO: 61314 - DNA, 25 bp, Homo sapien
tggttgtccgttacacaccgcgagt

SEQ ID NO: 61315 - DNA, 25 bp, Homo sapien
acacaccgcgagtgctggaggagat

SEQ ID NO: 61316 - DNA, 25 bp, Homo sapien
aggcccggttcgagaagatgcgctc

SEQ ID NO: 61317 - DNA, 25 bp, Homo sapien
ggttcgagaagatgcgctctgcccg

SEQ ID NO: 61318 - DNA, 25 bp, Homo sapien
gccggcgccaacagcatcagagcta

SEQ ID NO: 61319 - DNA, 25 bp, Homo sapien
atcagagctactcgtccttggagtc

SEQ ID NO: 61320 - DNA, 25 bp, Homo sapien
agagctactcgtccttggagtctcg

SEQ ID NO: 61321 - DNA, 25 bp, Homo sapien
taacctcggagccaaggtgttcttc

SEQ ID NO: 61322 - DNA, 25 bp, Homo sapien
ggtgttcttcttcaaagcactgcta

SEQ ID NO: 61323 - DNA, 25 bp, Homo sapien
agcactgctattaactggagacttt

SEQ ID NO: 61324 - DNA, 25 bp, Homo sapien
actggagacttttcccaggctggga

SEQ ID NO: 61325 - DNA, 25 bp, Homo sapien
aagggccatcatgtgtgggtcacta

SEQ ID NO: 61326 - DNA, 25 bp, Homo sapien
tacctggcccaagttaggaggtttg

SEQ ID NO: 61327 - DNA, 25 bp, Homo sapien
ttgtttcagacctctgatgggccga

SEQ ID NO: 61328 - DNA, 25 bp, Homo sapien
tgcctgtggacggtgctcagacaag

SEQ ID NO: 61329 - DNA, 25 bp, Homo sapien
gacaagtctgggattagagcctcaa

SEQ ID NO: 61330 - DNA, 25 bp, Homo sapien
agagcctcaaggacattgtgtgatt

SEQ ID NO: 61331 - DNA, 25 bp, Homo sapien
gtgattgcctcacatttgcaggtaa

SEQ ID NO: 61332 - DNA, 25 bp, Homo sapien
gggttacagctcattcgttttgcat

SEQ ID NO: 61333 - DNA, 25 bp, Homo sapien
gctcattcgttttgcatctacagtg

SEQ ID NO: 61334 - DNA, 25 bp, Homo sapien
gaataggcactcaatacatactttt

SEQ ID NO: 61335 - DNA, 25 bp, Homo sapien
gattttacattaccaccactattta

SEQ ID NO: 61336 - DNA, 25 bp, Homo sapien
cattaacattcctaccattagccgt

SEQ ID NO: 61337 - DNA, 25 bp, Homo sapien
ctaccattagccgtctccaaaataa

SEQ ID NO: 61338 - DNA, 25 bp, Homo sapien
gccacatgttcagcagttttcacaa

SEQ ID NO: 61339 - DNA, 25 bp, Homo sapien
atacagtgtgtctggactttttaat

SEQ ID NO: 61340 - DNA, 25 bp, Homo sapien
acatgcttgatttaccaattttcag

SEQ ID NO: 61341 - DNA, 25 bp, Homo sapien
accaattttcagagcaaggacacaa

SEQ ID NO: 61342 - DNA, 25 bp, Homo sapien
ggacacaaacttagcattcttctag

SEQ ID NO: 61343 - DNA, 25 bp, Homo sapien
ttccccaacactacctggaagttgt

SEQ ID NO: 61344 - DNA, 25 bp, Homo sapien
aacactacctggaagttgtgccttc

SEQ ID NO: 61345 - DNA, 25 bp, Homo sapien
gccttcctcatgaaactggcagaaa

SEQ ID NO: 61346 - DNA, 25 bp, Homo sapien
tcatgaaactggcagaaaccccttc

SEQ ID NO: 61347 - DNA, 25 bp, Homo sapien
cccttcccaagcttctgtattgaaa

SEQ ID NO: 61348 - DNA, 25 bp, Homo sapien
aacaattaggaatcattgcagattt

SEQ ID NO: 61349 - DNA, 25 bp, Homo sapien
acccgggactacttgctggtgactt

SEQ ID NO: 61350 - DNA, 25 bp, Homo sapien
ccgggactacttgctggtgactttt

SEQ ID NO: 61351 - DNA, 25 bp, Homo sapien
acattctcaactcctcttgaatcta

SEQ ID NO: 61352 - DNA, 25 bp, Homo sapien
attctcaactcctcttgaatctatc

SEQ ID NO: 61353 - DNA, 25 bp, Homo sapien
tcctcttgaatctatcccccaagaa

SEQ ID NO: 61354 - DNA, 25 bp, Homo sapien
aaataagtgctcttgtgaccctcat

SEQ ID NO: 61355 - DNA, 25 bp, Homo sapien
gtgaccctcatgtgagcacttttga

SEQ ID NO: 61356 - DNA, 25 bp, Homo sapien
gagaaacctatagcaacttcatgaa

SEQ ID NO: 61357 - DNA, 25 bp, Homo sapien
gcaacttcatgaattaagccttttt

SEQ ID NO: 61358 - DNA, 25 bp, Homo sapien
gggctcaggaggctcaacctctgca

SEQ ID NO: 61359 - DNA, 25 bp, Homo sapien
cagccatctcactttcttgatattt

SEQ ID NO: 61360 - DNA, 25 bp, Homo sapien
ttctgaggattggtctcttcacaca

SEQ ID NO: 61361 - DNA, 25 bp, Homo sapien
atatgattgggtccatgtgatcctc

SEQ ID NO: 61362 - DNA, 25 bp, Homo sapien
gggtccatgtgatcctcaggtttgg

SEQ ID NO: 61363 - DNA, 25 bp, Homo sapien
gggtctcctgaagatgctatttcta

SEQ ID NO: 61364 - DNA, 25 bp, Homo sapien
aaatgtctgacaaataagtgctctt

SEQ ID NO: 61365 - DNA, 25 bp, Homo sapien
tgcctgatgctattgccaagataat

SEQ ID NO: 61366 - DNA, 25 bp, Homo sapien
ataattctgtagttagagctgcact

SEQ ID NO: 61367 - DNA, 25 bp, Homo sapien
gagctgcactacaatctatcataat

SEQ ID NO: 61368 - DNA, 25 bp, Homo sapien
ttcatcgtctcactgtctagggtag

SEQ ID NO: 61369 - DNA, 25 bp, Homo sapien
cactgtctagggtagcctttgttaa

SEQ ID NO: 61370 - DNA, 25 bp, Homo sapien
atattccaataccttggtgccagcc

SEQ ID NO: 61371 - DNA, 25 bp, Homo sapien
ggtgccagccttgcattcaggatgg

SEQ ID NO: 61372 - DNA, 25 bp, Homo sapien
atatattttgccacaggtaggctga

SEQ ID NO: 61373 - DNA, 25 bp, Homo sapien
gtaggctgaaactctacccacaaaa

SEQ ID NO: 61374 - DNA, 25 bp, Homo sapien
aaaacctcattccttagcacttggt

SEQ ID NO: 61375 - DNA, 25 bp, Homo sapien
ctgcataccaggcaccttaggttat

SEQ ID NO: 61376 - DNA, 25 bp, Homo sapien
ggcgcctgaccacgcctaggcggga

SEQ ID NO: 61377 - DNA, 25 bp, Homo sapien
gcctgaccacgcctaggcgggagga

SEQ ID NO: 61378 - DNA, 25 bp, Homo sapien
aacatactgagaagccgtctctacc

SEQ ID NO: 61379 - DNA, 25 bp, Homo sapien
acatactgagaagccgtctctacca

SEQ ID NO: 61380 - DNA, 25 bp, Homo sapien
atactgagaagccgtctctaccaaa

SEQ ID NO: 61381 - DNA, 25 bp, Homo sapien
tactgagaagccgtctctaccaaaa

SEQ ID NO: 61382 - DNA, 25 bp, Homo sapien
tctctaccaaaaccaaaagcaaaca

SEQ ID NO: 61383 - DNA, 25 bp, Homo sapien
ggtgactgagactcgaggatcactt

SEQ ID NO: 61384 - DNA, 25 bp, Homo sapien
gagctatgatcttgctgcttgcact

SEQ ID NO: 61385 - DNA, 25 bp, Homo sapien
agctatgatcttgctgcttgcactc

SEQ ID NO: 61386 - DNA, 25 bp, Homo sapien
tatgatcttgctgcttgcactccag

SEQ ID NO: 61387 - DNA, 25 bp, Homo sapien
aaccagcctttcaacagtgtgcatc

SEQ ID NO: 61388 - DNA, 25 bp, Homo sapien
ttccttcatggttctagctctgaat

SEQ ID NO: 61389 - DNA, 25 bp, Homo sapien
ctctgaatgtggtgactgtagcgac

SEQ ID NO: 61390 - DNA, 25 bp, Homo sapien
gtagcgacaatcacagtgaggcatt

SEQ ID NO: 61391 - DNA, 25 bp, Homo sapien
ggcattttgtaaatcaacgggcaga

SEQ ID NO: 61392 - DNA, 25 bp, Homo sapien
gggcagactacaaataccagaagct

SEQ ID NO: 61393 - DNA, 25 bp, Homo sapien
gaagctgcagaactattaactaaca

SEQ ID NO: 61394 - DNA, 25 bp, Homo sapien
taacaggtccaaccctaagtgagac

SEQ ID NO: 61395 - DNA, 25 bp, Homo sapien
gtgagacatgtttctccaggatgcc

SEQ ID NO: 61396 - DNA, 25 bp, Homo sapien
aaggaaatgctacctcgtggctaca

SEQ ID NO: 61397 - DNA, 25 bp, Homo sapien
gctacctcgtggctacacatattat

SEQ ID NO: 61398 - DNA, 25 bp, Homo sapien
gaaacaatgccagcccgctgctttt

SEQ ID NO: 61399 - DNA, 25 bp, Homo sapien
gtcacctttgcagacaaagaccagg

SEQ ID NO: 61400 - DNA, 25 bp, Homo sapien
ccatgccacacagtgagaactgtag

SEQ ID NO: 61401 - DNA, 25 bp, Homo sapien
cagtgagaactgtagcctctgcgtc

SEQ ID NO: 61402 - DNA, 25 bp, Homo sapien
aaggcacacagggtactttctggac

SEQ ID NO: 61403 - DNA, 25 bp, Homo sapien
gcacacagggtactttctggaccca

SEQ ID NO: 61404 - DNA, 25 bp, Homo sapien
agggtactttctggacccactgctg

SEQ ID NO: 61405 - DNA, 25 bp, Homo sapien
tggacccactgctggacagacttga

SEQ ID NO: 61406 - DNA, 25 bp, Homo sapien
acccactgctggacagacttgaagg

SEQ ID NO: 61407 - DNA, 25 bp, Homo sapien
gtgtgcaggaggaaactaacagttc

SEQ ID NO: 61408 - DNA, 25 bp, Homo sapien
aaactaacagttcagtaaactctgc

SEQ ID NO: 61409 - DNA, 25 bp, Homo sapien
caatttcctgcgggcgggtacaaag

SEQ ID NO: 61410 - DNA, 25 bp, Homo sapien
tctctattctaggcaagagagagtg

SEQ ID NO: 61411 - DNA, 25 bp, Homo sapien
ctctattctaggcaagagagagtgg

SEQ ID NO: 61412 - DNA, 25 bp, Homo sapien
tattctaggcaagagagagtgggtt

SEQ ID NO: 61413 - DNA, 25 bp, Homo sapien
attctaggcaagagagagtgggttc

SEQ ID NO: 61414 - DNA, 25 bp, Homo sapien
ctgggctcacctgttagcgctggcc

SEQ ID NO: 61415 - DNA, 25 bp, Homo sapien
tgggctcacctgttagcgctggccc

SEQ ID NO: 61416 - DNA, 25 bp, Homo sapien
gggctcacctgttagcgctggccca

SEQ ID NO: 61417 - DNA, 25 bp, Homo sapien
ggctcacctgttagcgctggcccag

SEQ ID NO: 61418 - DNA, 25 bp, Homo sapien
gctcacctgttagcgctggcccagc

SEQ ID NO: 61419 - DNA, 25 bp, Homo sapien
ctcacctgttagcgctggcccagcc

SEQ ID NO: 61420 - DNA, 25 bp, Homo sapien
gctatttattaacttgctcatctca

SEQ ID NO: 61421 - DNA, 25 bp, Homo sapien
aacttgctcatctcatagaacattt

SEQ ID NO: 61422 - DNA, 25 bp, Homo sapien
ttaatagatttttcacacacctcat

SEQ ID NO: 61423 - DNA, 25 bp, Homo sapien
aacatgctggtgtcttggttaccca

SEQ ID NO: 61424 - DNA, 25 bp, Homo sapien
tgctggtgtcttggttacccattat

SEQ ID NO: 61425 - DNA, 25 bp, Homo sapien
ttggttacccattattcctctgtac

SEQ ID NO: 61426 - DNA, 25 bp, Homo sapien
ttattcctctgtacctgaattcagg

SEQ ID NO: 61427 - DNA, 25 bp, Homo sapien
gaattcaggttggtttttctatttg

SEQ ID NO: 61428 - DNA, 25 bp, Homo sapien
aagaggttgagcaccagaatctcag

SEQ ID NO: 61429 - DNA, 25 bp, Homo sapien
agaatctcagaatttaccaccaaag

SEQ ID NO: 61430 - DNA, 25 bp, Homo sapien
tcagaatttaccaccaaagaactca

SEQ ID NO: 61431 - DNA, 25 bp, Homo sapien
tttccctggaaacacaaccaaggtg

SEQ ID NO: 61432 - DNA, 25 bp, Homo sapien
atagcttgttgccaaagtctgttga

SEQ ID NO: 61433 - DNA, 25 bp, Homo sapien
agtctgttgagcagcactgttgcca

SEQ ID NO: 61434 - DNA, 25 bp, Homo sapien
cactgttgccaagggtcctggtgaa

SEQ ID NO: 61435 - DNA, 25 bp, Homo sapien
aagggtcctggtgaagtcatcccag

SEQ ID NO: 61436 - DNA, 25 bp, Homo sapien
agtcatcccaggaggaaaccacagt

SEQ ID NO: 61437 - DNA, 25 bp, Homo sapien
gaggaaaccacagtctgtattcttt

SEQ ID NO: 61438 - DNA, 25 bp, Homo sapien
gtattctttgaagggctgctgcaca

SEQ ID NO: 61439 - DNA, 25 bp, Homo sapien
gaagggctgctgcacattgttgaat

SEQ ID NO: 61440 - DNA, 25 bp, Homo sapien
gaatccatcgacctttaactgcaat

SEQ ID NO: 61441 - DNA, 25 bp, Homo sapien
taactgcaatgggatctctaataca

SEQ ID NO: 61442 - DNA, 25 bp, Homo sapien
aagtgaggatttgggtcaccccagg

SEQ ID NO: 61443 - DNA, 25 bp, Homo sapien
tgaggatttgggtcaccccaggctg

SEQ ID NO: 61444 - DNA, 25 bp, Homo sapien
gaagggaaaacttaggccacagtct

SEQ ID NO: 61445 - DNA, 25 bp, Homo sapien
gaaaacttaggccacagtctgatta

SEQ ID NO: 61446 - DNA, 25 bp, Homo sapien
aacttaggccacagtctgattagaa

SEQ ID NO: 61447 - DNA, 25 bp, Homo sapien
cttaggccacagtctgattagaaat

SEQ ID NO: 61448 - DNA, 25 bp, Homo sapien
ggctgaattccaccctgtttttcct

SEQ ID NO: 61449 - DNA, 25 bp, Homo sapien
tcctttactggagattcaatttgaa

SEQ ID NO: 61450 - DNA, 25 bp, Homo sapien
ttcaatttgaattactctgcctccc

SEQ ID NO: 61451 - DNA, 25 bp, Homo sapien
caatttgaattactctgcctccctt

SEQ ID NO: 61452 - DNA, 25 bp, Homo sapien
atttgaattactctgcctcccttct

SEQ ID NO: 61453 - DNA, 25 bp, Homo sapien
ttaggcattcattaaattggcaaga

SEQ ID NO: 61454 - DNA, 25 bp, Homo sapien
attggcaagattttagatttcatgt

SEQ ID NO: 61455 - DNA, 25 bp, Homo sapien
gatttcatgtattcaagattttgct

SEQ ID NO: 61456 - DNA, 25 bp, Homo sapien
gaagcaaattctataaactccctat

SEQ ID NO: 61457 - DNA, 25 bp, Homo sapien
taaactccctattggaatcacgtat

SEQ ID NO: 61458 - DNA, 25 bp, Homo sapien
ggaatcacgtattttgggaattaga

SEQ ID NO: 61459 - DNA, 25 bp, Homo sapien
gatatttttcaatgtgagctgctgt

SEQ ID NO: 61460 - DNA, 25 bp, Homo sapien
tgctgttttcttctaactgcaggga

SEQ ID NO: 61461 - DNA, 25 bp, Homo sapien
atttgtatctgctgagttctcttag

SEQ ID NO: 61462 - DNA, 25 bp, Homo sapien
gagttctcttagcataaggcaccaa

SEQ ID NO: 61463 - DNA, 25 bp, Homo sapien
ggcaccaacaaaacaaccttcagga

SEQ ID NO: 61464 - DNA, 25 bp, Homo sapien
gtatcgaatttaccccagacaaagg

SEQ ID NO: 61465 - DNA, 25 bp, Homo sapien
actggttgcgactgaaacttggcta

SEQ ID NO: 61466 - DNA, 25 bp, Homo sapien
gctatagatagcttgatgtcccaat

SEQ ID NO: 61467 - DNA, 25 bp, Homo sapien
aataagccaactctccattttcaag

SEQ ID NO: 61468 - DNA, 25 bp, Homo sapien
caagtaaatccagcttcatccacag

SEQ ID NO: 61469 - DNA, 25 bp, Homo sapien
taacctcaagagcaaccagcttgtt

SEQ ID NO: 61470 - DNA, 25 bp, Homo sapien
caaccagcttgttacattttcccta

SEQ ID NO: 61471 - DNA, 25 bp, Homo sapien
acattttccctatcctatggcagga

SEQ ID NO: 61472 - DNA, 25 bp, Homo sapien
aatgcgtattacttctgttctgttt

SEQ ID NO: 61473 - DNA, 25 bp, Homo sapien
tgttctgtttaagcatctcagtcta

SEQ ID NO: 61474 - DNA, 25 bp, Homo sapien
catctcagtctaaatgccatgaaga

SEQ ID NO: 61475 - DNA, 25 bp, Homo sapien
tctgagataagaaccatttgtgtaa

SEQ ID NO: 61476 - DNA, 25 bp, Homo sapien
atttgtgtaacaccaacacttaact

SEQ ID NO: 61477 - DNA, 25 bp, Homo sapien
gtaacaccaacacttaacttcagaa

SEQ ID NO: 61478 - DNA, 25 bp, Homo sapien
acaccaacacttaacttcagaaaga

SEQ ID NO: 61479 - DNA, 25 bp, Homo sapien
acttaacttcagaaagacatgcatt

SEQ ID NO: 61480 - DNA, 25 bp, Homo sapien
ccgatgctttcagatgacctactta

SEQ ID NO: 61481 - DNA, 25 bp, Homo sapien
gacctacttacatcttcaatgtgga

SEQ ID NO: 61482 - DNA, 25 bp, Homo sapien
aacacatgcatctaaactgctgggc

SEQ ID NO: 61483 - DNA, 25 bp, Homo sapien
actgctgggcaatccagttgacttt

SEQ ID NO: 61484 - DNA, 25 bp, Homo sapien
tggaattccaaacacttaacacatt

SEQ ID NO: 61485 - DNA, 25 bp, Homo sapien
aaacacttaacacattcagctatat

SEQ ID NO: 61486 - DNA, 25 bp, Homo sapien
acaaggtgtcgctggcgctgctgca

SEQ ID NO: 61487 - DNA, 25 bp, Homo sapien
ggctacccgcgcagcgtgtgcgtca

SEQ ID NO: 61488 - DNA, 25 bp, Homo sapien
gtgtgcgtcaacacgcgccagaacg

SEQ ID NO: 61489 - DNA, 25 bp, Homo sapien
ggcgcgctgggcatcatgaacaacc

SEQ ID NO: 61490 - DNA, 25 bp, Homo sapien
tgggcatcatgaacaaccggctggc

SEQ ID NO: 61491 - DNA, 25 bp, Homo sapien
tgaacaaccggctggccgagaccag

SEQ ID NO: 61492 - DNA, 25 bp, Homo sapien
gagaccagcgcctccaggtagaccg

SEQ ID NO: 61493 - DNA, 25 bp, Homo sapien
gccgccgggcgtggtttgcttctct

SEQ ID NO: 61494 - DNA, 25 bp, Homo sapien
ggtttgcttctctcagtcactgctg

SEQ ID NO: 61495 - DNA, 25 bp, Homo sapien
tcagtcactgctggcgctttcttaa

SEQ ID NO: 61496 - DNA, 25 bp, Homo sapien
cgctttcttaatctttatccaataa

SEQ ID NO: 61497 - DNA, 25 bp, Homo sapien
tgtatccataagaaggagtgctctt

SEQ ID NO: 61498 - DNA, 25 bp, Homo sapien
ataagaaggagtgctcttcatcaac

SEQ ID NO: 61499 - DNA, 25 bp, Homo sapien
tcttcatcaactaatagagcaccta

SEQ ID NO: 61500 - DNA, 25 bp, Homo sapien
aatagagcacctaccacagtgtcat

SEQ ID NO: 61501 - DNA, 25 bp, Homo sapien
tagagcacctaccacagtgtcatac

SEQ ID NO: 61502 - DNA, 25 bp, Homo sapien
acctaccacagtgtcatacctggta

SEQ ID NO: 61503 - DNA, 25 bp, Homo sapien
accacagtgtcatacctggtagagg

SEQ ID NO: 61504 - DNA, 25 bp, Homo sapien
cacagtgtcatacctggtagaggtg

SEQ ID NO: 61505 - DNA, 25 bp, Homo sapien
aaaggttgcaaagtgtttgtaatat

SEQ ID NO: 61506 - DNA, 25 bp, Homo sapien
atatattcatgaggctggaagtaag

SEQ ID NO: 61507 - DNA, 25 bp, Homo sapien
ggatggggcttagatagtatcgaat

SEQ ID NO: 61508 - DNA, 25 bp, Homo sapien
atttgtgtaacaccaacacttaact

SEQ ID NO: 61509 - DNA, 25 bp, Homo sapien
tttgtgtaacaccaacacttaactt

SEQ ID NO: 61510 - DNA, 25 bp, Homo sapien
gtgtaacaccaacacttaacttcag

SEQ ID NO: 61511 - DNA, 25 bp, Homo sapien
tgtaacaccaacacttaacttcaga

SEQ ID NO: 61512 - DNA, 25 bp, Homo sapien
gtaacaccaacacttaacttcagaa

SEQ ID NO: 61513 - DNA, 25 bp, Homo sapien
taacaccaacacttaacttcagaaa

SEQ ID NO: 61514 - DNA, 25 bp, Homo sapien
aacaccaacacttaacttcagaaag

SEQ ID NO: 61515 - DNA, 25 bp, Homo sapien
acaccaacacttaacttcagaaaga

SEQ ID NO: 61516 - DNA, 25 bp, Homo sapien
accaacacttaacttcagaaagaca

SEQ ID NO: 61517 - DNA, 25 bp, Homo sapien
aacacttaacttcagaaagacatgc

SEQ ID NO: 61518 - DNA, 25 bp, Homo sapien
acttaacttcagaaagacatgcatt

SEQ ID NO: 61519 - DNA, 25 bp, Homo sapien
gcattccaaattaggcttagactgt

SEQ ID NO: 61520 - DNA, 25 bp, Homo sapien
ttaggcttagactgtgcaaagggct

SEQ ID NO: 61521 - DNA, 25 bp, Homo sapien
aaagggcttagctaagttatcgagc

SEQ ID NO: 61522 - DNA, 25 bp, Homo sapien
gttatcgagcttaaaacccgtcaat

SEQ ID NO: 61523 - DNA, 25 bp, Homo sapien
tgaacagttactgcatgccacgcac

SEQ ID NO: 61524 - DNA, 25 bp, Homo sapien
ccacgcactgtgttgggcttagtaa

SEQ ID NO: 61525 - DNA, 25 bp, Homo sapien
agataagtgcttgttctagcataaa

SEQ ID NO: 61526 - DNA, 25 bp, Homo sapien
ggaagagaacatatgccaattttta

SEQ ID NO: 61527 - DNA, 25 bp, Homo sapien
ctctttccattcaaatagtcctggt

SEQ ID NO: 61528 - DNA, 25 bp, Homo sapien
aatagtcctggttcattcccagaag

SEQ ID NO: 61529 - DNA, 25 bp, Homo sapien
tggttcattcccagaagggcacaaa

SEQ ID NO: 61530 - DNA, 25 bp, Homo sapien
tgctcaatctcagctaacattccat

SEQ ID NO: 61531 - DNA, 25 bp, Homo sapien
tctcccagatgttgcatccctgaaa

SEQ ID NO: 61532 - DNA, 25 bp, Homo sapien
atccctgaaacatctcaacaacctg

SEQ ID NO: 61533 - DNA, 25 bp, Homo sapien
ctgaatgtcccaacccagacaatgg

SEQ ID NO: 61534 - DNA, 25 bp, Homo sapien
aggtctctcaacttcatcagtgtgg

SEQ ID NO: 61535 - DNA, 25 bp, Homo sapien
atcagtgtggcttctatgagcccag

SEQ ID NO: 61536 - DNA, 25 bp, Homo sapien
tgaacgttctgtctgtggcacattc

SEQ ID NO: 61537 - DNA, 25 bp, Homo sapien
ttaaatatttccatcagcccatctc

SEQ ID NO: 61538 - DNA, 25 bp, Homo sapien
tccttattcccagtgttccatttga

SEQ ID NO: 61539 - DNA, 25 bp, Homo sapien
gttccatttgaaccagtgatccatg

SEQ ID NO: 61540 - DNA, 25 bp, Homo sapien
gtgatccatgtcctgaaaaatgctc

SEQ ID NO: 61541 - DNA, 25 bp, Homo sapien
ggatttctgacttgaggcccatctc

SEQ ID NO: 61542 - DNA, 25 bp, Homo sapien
gatttctgacttgaggcccatctct

SEQ ID NO: 61543 - DNA, 25 bp, Homo sapien
atttctgacttgaggcccatctctc

SEQ ID NO: 61544 - DNA, 25 bp, Homo sapien
cactgccttctttgtaatattaagt

SEQ ID NO: 61545 - DNA, 25 bp, Homo sapien
actgccttctttgtaatattaagtg

SEQ ID NO: 61546 - DNA, 25 bp, Homo sapien
gacaagggtcagtctgtcgggtggg

SEQ ID NO: 61547 - DNA, 25 bp, Homo sapien
atcaaatcagcccaaggatatagtt

SEQ ID NO: 61548 - DNA, 25 bp, Homo sapien
tcagcccaaggatatagttaggatt

SEQ ID NO: 61549 - DNA, 25 bp, Homo sapien
gcccaaggatatagttaggattaat

SEQ ID NO: 61550 - DNA, 25 bp, Homo sapien
aactatatcacacaaagggatacaa

SEQ ID NO: 61551 - DNA, 25 bp, Homo sapien
tcacacaaagggatacaactataaa

SEQ ID NO: 61552 - DNA, 25 bp, Homo sapien
gctctaaggcccgaagaacaggtga

SEQ ID NO: 61553 - DNA, 25 bp, Homo sapien
agagctgggctctagcaggacagtt

SEQ ID NO: 61554 - DNA, 25 bp, Homo sapien
ggctctagcaggacagttcttttgt

SEQ ID NO: 61555 - DNA, 25 bp, Homo sapien
actgagacccatgcagagtttccag

SEQ ID NO: 61556 - DNA, 25 bp, Homo sapien
atgcagagtttccaggtgtgcactg

SEQ ID NO: 61557 - DNA, 25 bp, Homo sapien
acatgagcagcgtgggaagaagact

SEQ ID NO: 61558 - DNA, 25 bp, Homo sapien
gaagaagactctgtcaagactctca

SEQ ID NO: 61559 - DNA, 25 bp, Homo sapien
gactctgtcaagactctcagaagaa

SEQ ID NO: 61560 - DNA, 25 bp, Homo sapien
aacctggagtaattgtgcctgaagc

SEQ ID NO: 61561 - DNA, 25 bp, Homo sapien
gtgcctgaagctcagcgtgaagtct

SEQ ID NO: 61562 - DNA, 25 bp, Homo sapien
gaagctcagcgtgaagtctgaaata

SEQ ID NO: 61563 - DNA, 25 bp, Homo sapien
tatgttgggctagcttttggcattt

SEQ ID NO: 61564 - DNA, 25 bp, Homo sapien
agcttttggcattttggtgggcaac

SEQ ID NO: 61565 - DNA, 25 bp, Homo sapien
ggtgggcaacaatttcgctccaaat

SEQ ID NO: 61566 - DNA, 25 bp, Homo sapien
ggcatgttcctctatatttctctgg

SEQ ID NO: 61567 - DNA, 25 bp, Homo sapien
atttctctggcagatatgtttccag

SEQ ID NO: 61568 - DNA, 25 bp, Homo sapien
aaaaaccgatttcaccttcttcatg

SEQ ID NO: 61569 - DNA, 25 bp, Homo sapien
gatttcaccttcttcatgattcaga

SEQ ID NO: 61570 - DNA, 25 bp, Homo sapien
gaatgttaactggattcacagccat

SEQ ID NO: 61571 - DNA, 25 bp, Homo sapien
ggattcacagccattctactcatta

SEQ ID NO: 61572 - DNA, 25 bp, Homo sapien
agccattctactcattaccttgtat

SEQ ID NO: 61573 - DNA, 25 bp, Homo sapien
actcattaccttgtatgcaggagaa

SEQ ID NO: 61574 - DNA, 25 bp, Homo sapien
gtatcatcccaacaaagtatccttt

SEQ ID NO: 61575 - DNA, 25 bp, Homo sapien
aacaaagtatcctttcatgaacggg

SEQ ID NO: 61576 - DNA, 25 bp, Homo sapien
ggaaagtaaagctactcagagcaac

SEQ ID NO: 61577 - DNA, 25 bp, Homo sapien
gctactcagagcaacaggttccaca

SEQ ID NO: 61578 - DNA, 25 bp, Homo sapien
gagcaacaggttccacaagcacaaa

SEQ ID NO: 61579 - DNA, 25 bp, Homo sapien
gtacaattttgaaatgcactacaat

SEQ ID NO: 61580 - DNA, 25 bp, Homo sapien
gcttctttacataaactgagaggtt

SEQ ID NO: 61581 - DNA, 25 bp, Homo sapien
gagaggttatacaaaactcagtttc

SEQ ID NO: 61582 - DNA, 25 bp, Homo sapien
actcagtttcacaagggaacaatct

SEQ ID NO: 61583 - DNA, 25 bp, Homo sapien
ggaacaatctatacctttctaaaag

SEQ ID NO: 61584 - DNA, 25 bp, Homo sapien
atatttcaagtctctaataggcaga

SEQ ID NO: 61585 - DNA, 25 bp, Homo sapien
agcctcagttggcagcccagagctg

SEQ ID NO: 61586 - DNA, 25 bp, Homo sapien
cccagagctgtgaccgggtgttgga

SEQ ID NO: 61587 - DNA, 25 bp, Homo sapien
gggagcctggccatttaaaggcctt

SEQ ID NO: 61588 - DNA, 25 bp, Homo sapien
gctgcccttgggaacctggaaaaag

SEQ ID NO: 61589 - DNA, 25 bp, Homo sapien
actgctgacctcaagaaggtgctgg

SEQ ID NO: 61590 - DNA, 25 bp, Homo sapien
gaaggtgctggcgatagatcccaaa

SEQ ID NO: 61591 - DNA, 25 bp, Homo sapien
gcgatagatcccaaaaacccgggca

SEQ ID NO: 61592 - DNA, 25 bp, Homo sapien
tggctcagggtctgcgcaagatgtt

SEQ ID NO: 61593 - DNA, 25 bp, Homo sapien
cagggtctgcgcaagatgtttggct

SEQ ID NO: 61594 - DNA, 25 bp, Homo sapien
gtctgcgcaagatgtttggctgatt

SEQ ID NO: 61595 - DNA, 25 bp, Homo sapien
gcgcaagatgtttggctgattaaaa

SEQ ID NO: 61596 - DNA, 25 bp, Homo sapien
aaagctgctaagtgccaaactgtta

SEQ ID NO: 61597 - DNA, 25 bp, Homo sapien
gtgccaaactgttattttactatat

SEQ ID NO: 61598 - DNA, 25 bp, Homo sapien
tatgctccaacattaatcatgactc

SEQ ID NO: 61599 - DNA, 25 bp, Homo sapien
atcatgactcttttgtaaattacag

SEQ ID NO: 61600 - DNA, 25 bp, Homo sapien
atgttgactcatttcatgcaggttt

SEQ ID NO: 61601 - DNA, 25 bp, Homo sapien
catgcaggtttgtgttttaacattc

SEQ ID NO: 61602 - DNA, 25 bp, Homo sapien
aacattccacttatgccttgaaaca

SEQ ID NO: 61603 - DNA, 25 bp, Homo sapien
tcttgataactttttgatacttctt

SEQ ID NO: 61604 - DNA, 25 bp, Homo sapien
gatacttctttcttgataaggcact

SEQ ID NO: 61605 - DNA, 25 bp, Homo sapien
gataaggcacttttaccaggtgtgt

SEQ ID NO: 61606 - DNA, 25 bp, Homo sapien
cacttttaccaggtgtgtgttggaa

SEQ ID NO: 61607 - DNA, 25 bp, Homo sapien
ctctccctggagagtggttttcctg

SEQ ID NO: 61608 - DNA, 25 bp, Homo sapien
ttttcctgcttttctgctgctagaa

SEQ ID NO: 61609 - DNA, 25 bp, Homo sapien
ctgctagaaatgttgctgtatggga

SEQ ID NO: 61610 - DNA, 25 bp, Homo sapien
gaaagtgcccagtgactgcaggcga

SEQ ID NO: 61611 - DNA, 25 bp, Homo sapien
tgcaggcgacccttaccgaggattt

SEQ ID NO: 61612 - DNA, 25 bp, Homo sapien
ggcttctgctgaacagcacattgta

SEQ ID NO: 61613 - DNA, 25 bp, Homo sapien
cagcacattgtataagcagcgtttt

SEQ ID NO: 61614 - DNA, 25 bp, Homo sapien
ataagcagcgttttccttctttaat

SEQ ID NO: 61615 - DNA, 25 bp, Homo sapien
aatcctgtaatcaatacctctctgc

SEQ ID NO: 61616 - DNA, 25 bp, Homo sapien
aatcaatacctctctgcctttacaa

SEQ ID NO: 61617 - DNA, 25 bp, Homo sapien
ctttacaatggctctgcttccaact

SEQ ID NO: 61618 - DNA, 25 bp, Homo sapien
agctttaaagagtctgttcagaatc

SEQ ID NO: 61619 - DNA, 25 bp, Homo sapien
agtgttaaacactgttaagaggaca

SEQ ID NO: 61620 - DNA, 25 bp, Homo sapien
gaatttctgctatgaatttttcttc

SEQ ID NO: 61621 - DNA, 25 bp, Homo sapien
tttctgctatgaatttttcttcagc

SEQ ID NO: 61622 - DNA, 25 bp, Homo sapien
ttcttcagcatttgtcctcagtaca

SEQ ID NO: 61623 - DNA, 25 bp, Homo sapien
cttcagcatttgtcctcagtacagg

SEQ ID NO: 61624 - DNA, 25 bp, Homo sapien
tcagcatttgtcctcagtacaggtg

SEQ ID NO: 61625 - DNA, 25 bp, Homo sapien
gcatttgtcctcagtacaggtggtt

SEQ ID NO: 61626 - DNA, 25 bp, Homo sapien
ttgtcctcagtacaggtggttcctt

SEQ ID NO: 61627 - DNA, 25 bp, Homo sapien
tcctcagtacaggtggttccttgaa

SEQ ID NO: 61628 - DNA, 25 bp, Homo sapien
actagaacatcctgatattttatcc

SEQ ID NO: 61629 - DNA, 25 bp, Homo sapien
tagacccacaagaggcagttccatt

SEQ ID NO: 61630 - DNA, 25 bp, Homo sapien
tttcatttgtgccagaatgctttag

SEQ ID NO: 61631 - DNA, 25 bp, Homo sapien
gtgccagaatgctttaggatgtaca

SEQ ID NO: 61632 - DNA, 25 bp, Homo sapien
gctttaggatgtacagttatggatt

SEQ ID NO: 61633 - DNA, 25 bp, Homo sapien
taggccgttccttcaaagcaaatgt

SEQ ID NO: 61634 - DNA, 25 bp, Homo sapien
tgtcttcctggattattcaaaatga

SEQ ID NO: 61635 - DNA, 25 bp, Homo sapien
gaagcctttgtaaattgtcagatgc

SEQ ID NO: 61636 - DNA, 25 bp, Homo sapien
tgtcagatgctgtgcaaatgttatt

SEQ ID NO: 61637 - DNA, 25 bp, Homo sapien
tttactgtcttaagtttatactctt

SEQ ID NO: 61638 - DNA, 25 bp, Homo sapien
actcttatagacaacatggccgtga

SEQ ID NO: 61639 - DNA, 25 bp, Homo sapien
atggccgtgaactttatgctgtaaa

SEQ ID NO: 61640 - DNA, 25 bp, Homo sapien
acagaaggtgccaacactgtcgcta

SEQ ID NO: 61641 - DNA, 25 bp, Homo sapien
gaaggtgccaacactgtcgctacag

SEQ ID NO: 61642 - DNA, 25 bp, Homo sapien
gtgccaacactgtcgctacagtaag

SEQ ID NO: 61643 - DNA, 25 bp, Homo sapien
tgtcgctacagtaaggacctgaagt

SEQ ID NO: 61644 - DNA, 25 bp, Homo sapien
gagaaattcaccctcacaaaccttc

SEQ ID NO: 61645 - DNA, 25 bp, Homo sapien
tcaggagcaggcattggtagtgcag

SEQ ID NO: 61646 - DNA, 25 bp, Homo sapien
agtgcagaggcacagattccgtcct

SEQ ID NO: 61647 - DNA, 25 bp, Homo sapien
gcagaggcacagattccgtccttta

SEQ ID NO: 61648 - DNA, 25 bp, Homo sapien
gaggcacagattccgtcctttacca

SEQ ID NO: 61649 - DNA, 25 bp, Homo sapien
gattccgtcctttaccagctgcaga

SEQ ID NO: 61650 - DNA, 25 bp, Homo sapien
gcctctgtgagcctcatcggtaaac

SEQ ID NO: 61651 - DNA, 25 bp, Homo sapien
tgttcctgtcagtcacgggtgagca

SEQ ID NO: 61652 - DNA, 25 bp, Homo sapien
tgagcagtatggaagccccatccgt

SEQ ID NO: 61653 - DNA, 25 bp, Homo sapien
gaagccccatccgtgggcagcatga

SEQ ID NO: 61654 - DNA, 25 bp, Homo sapien
agcatgaggtccacggcatgcccag

SEQ ID NO: 61655 - DNA, 25 bp, Homo sapien
agtgccaacacgcacaatacgtgga

SEQ ID NO: 61656 - DNA, 25 bp, Homo sapien
gcacaatacgtggaaggccatggaa

SEQ ID NO: 61657 - DNA, 25 bp, Homo sapien
gcatcttcatcaagcctagtgtgga

SEQ ID NO: 61658 - DNA, 25 bp, Homo sapien
tagtgtggagccctctgcaggtcac

SEQ ID NO: 61659 - DNA, 25 bp, Homo sapien
gcaggtcacgatgaactctgagtgt

SEQ ID NO: 61660 - DNA, 25 bp, Homo sapien
tgcagggccactcttggcagagact

SEQ ID NO: 61661 - DNA, 25 bp, Homo sapien
tcttggcagagactttgggtttgta

SEQ ID NO: 61662 - DNA, 25 bp, Homo sapien
tgggacaggcgtgcagctcactgaa

SEQ ID NO: 61663 - DNA, 25 bp, Homo sapien
tgcagctcactgaactccaagcgag

SEQ ID NO: 61664 - DNA, 25 bp, Homo sapien
gccctctcttggactagaaggccta

SEQ ID NO: 61665 - DNA, 25 bp, Homo sapien
ctactgtcagcccttcgcttacaaa

SEQ ID NO: 61666 - DNA, 25 bp, Homo sapien
cttcgcttacaaactgcaggctcaa

SEQ ID NO: 61667 - DNA, 25 bp, Homo sapien
caaactgcaggctcaatccgaaggg

SEQ ID NO: 61668 - DNA, 25 bp, Homo sapien
gggctctcctagtgcccagagacag

SEQ ID NO: 61669 - DNA, 25 bp, Homo sapien
gacaggcccagaggtttacaagttt

SEQ ID NO: 61670 - DNA, 25 bp, Homo sapien
tttgataatgtgaagctccaggccg

SEQ ID NO: 61671 - DNA, 25 bp, Homo sapien
agctccaggccgagaggatgctgtt

SEQ ID NO: 61672 - DNA, 25 bp, Homo sapien
ctgttgagcacattgcagctatgta

SEQ ID NO: 61673 - DNA, 25 bp, Homo sapien
tacacagtttcattgttctgaatcc

SEQ ID NO: 61674 - DNA, 25 bp, Homo sapien
tgcaagttttgatagcccgtgaagt

SEQ ID NO: 61675 - DNA, 25 bp, Homo sapien
ttttgatagcccgtgaagtgcataa

SEQ ID NO: 61676 - DNA, 25 bp, Homo sapien
gatagcccgtgaagtgcataagtat

SEQ ID NO: 61677 - DNA, 25 bp, Homo sapien
gcccgtgaagtgcataagtatctaa

SEQ ID NO: 61678 - DNA, 25 bp, Homo sapien
gtgcataagtatctaattttacctg

SEQ ID NO: 61679 - DNA, 25 bp, Homo sapien
gtatctaattttacctgaattgatt

SEQ ID NO: 61680 - DNA, 25 bp, Homo sapien
gggaaattaccagtagaatgccttg

SEQ ID NO: 61681 - DNA, 25 bp, Homo sapien
ttaccagtagaatgccttggtctga

SEQ ID NO: 61682 - DNA, 25 bp, Homo sapien
agtagaatgccttggtctgaatatt

SEQ ID NO: 61683 - DNA, 25 bp, Homo sapien
gtctgaatatttgatagaaccaatt

SEQ ID NO: 61684 - DNA, 25 bp, Homo sapien
gatttgctgctcttggatgtcactc

SEQ ID NO: 61685 - DNA, 25 bp, Homo sapien
tcctctttcccttggtattgaaact

SEQ ID NO: 61686 - DNA, 25 bp, Homo sapien
aactgctggtggagtcatgactgtc

SEQ ID NO: 61687 - DNA, 25 bp, Homo sapien
tcatgactgtcctcatcaagcgtaa

SEQ ID NO: 61688 - DNA, 25 bp, Homo sapien
atcaagcgtaataccaccattccta

SEQ ID NO: 61689 - DNA, 25 bp, Homo sapien
agaccttcactacctattctgacaa

SEQ ID NO: 61690 - DNA, 25 bp, Homo sapien
tacctattctgacaaccagcctggt

SEQ ID NO: 61691 - DNA, 25 bp, Homo sapien
caaccagcctggtgtgcttattcag

SEQ ID NO: 61692 - DNA, 25 bp, Homo sapien
tcaggtttatgaaggcgagcgtgcc

SEQ ID NO: 61693 - DNA, 25 bp, Homo sapien
ggcgagcgtgccatgacaaaggata

SEQ ID NO: 61694 - DNA, 25 bp, Homo sapien
aacctgcttggcaagtttgaactca

SEQ ID NO: 61695 - DNA, 25 bp, Homo sapien
aaacaagatgtaagagaggccctct

SEQ ID NO: 61696 - DNA, 25 bp, Homo sapien
agagaggccctctttgactgaaaat

SEQ ID NO: 61697 - DNA, 25 bp, Homo sapien
ggccctctttgactgaaaatgacac

SEQ ID NO: 61698 - DNA, 25 bp, Homo sapien
aaaaaggtgatcaagtcttccaggg

SEQ ID NO: 61699 - DNA, 25 bp, Homo sapien
agggcctgctgttactgatggagac

SEQ ID NO: 61700 - DNA, 25 bp, Homo sapien
tgatggagactacagctacaatgaa

SEQ ID NO: 61701 - DNA, 25 bp, Homo sapien
aattactctcactaccatatcttgg

SEQ ID NO: 61702 - DNA, 25 bp, Homo sapien
gaaggagcgctctagttgcaaggaa

SEQ ID NO: 61703 - DNA, 25 bp, Homo sapien
agcgctctagttgcaaggaatttgt

SEQ ID NO: 61704 - DNA, 25 bp, Homo sapien
aaaggccgagagactctaacaaaca

SEQ ID NO: 61705 - DNA, 25 bp, Homo sapien
gaccatctcagtggacaaaagagcc

SEQ ID NO: 61706 - DNA, 25 bp, Homo sapien
taaagccctatgaaccagtcaaacc

SEQ ID NO: 61707 - DNA, 25 bp, Homo sapien
gaaccagtcaaaccaatcattccac

SEQ ID NO: 61708 - DNA, 25 bp, Homo sapien
gtcaaaccaatcattccacttttag

SEQ ID NO: 61709 - DNA, 25 bp, Homo sapien
caatcattccacttttagaaacttt

SEQ ID NO: 61710 - DNA, 25 bp, Homo sapien
ttagaaactttctcaaggacataat

SEQ ID NO: 61711 - DNA, 25 bp, Homo sapien
acaaggacattcactctgccactgc

SEQ ID NO: 61712 - DNA, 25 bp, Homo sapien
cactctgccactgcttgtagtaata

SEQ ID NO: 61713 - DNA, 25 bp, Homo sapien
gagtaaattcttgacttcctccttc

SEQ ID NO: 61714 - DNA, 25 bp, Homo sapien
aatcctcttttagcttcagtgatac

SEQ ID NO: 61715 - DNA, 25 bp, Homo sapien
gcttcagtgatacaattttctcttg

SEQ ID NO: 61716 - DNA, 25 bp, Homo sapien
tacaattttctcttggtattccttg

SEQ ID NO: 61717 - DNA, 25 bp, Homo sapien
tcctcttcgtgaacaccagcagata

SEQ ID NO: 61718 - DNA, 25 bp, Homo sapien
cttcgtgaacaccagcagatacctc

SEQ ID NO: 61719 - DNA, 25 bp, Homo sapien
gtgcctccactgatgcaggagctgc

SEQ ID NO: 61720 - DNA, 25 bp, Homo sapien
gccaggaagtggacaagaacgaacc

SEQ ID NO: 61721 - DNA, 25 bp, Homo sapien
gaacgaacccttccttccgaatgat

SEQ ID NO: 61722 - DNA, 25 bp, Homo sapien
gaacccttccttccgaatgatcagc

SEQ ID NO: 61723 - DNA, 25 bp, Homo sapien
ccttccttccgaatgatcagcagtt

SEQ ID NO: 61724 - DNA, 25 bp, Homo sapien
ttccttccgaatgatcagcagttcc

SEQ ID NO: 61725 - DNA, 25 bp, Homo sapien
gcgcaaccaccccttccttaggttg

SEQ ID NO: 61726 - DNA, 25 bp, Homo sapien
ccttaggttgatgtgcttgggaaag

SEQ ID NO: 61727 - DNA, 25 bp, Homo sapien
gttgatgtgcttgggaaagctccct

SEQ ID NO: 61728 - DNA, 25 bp, Homo sapien
ttgaacacagacgaccttgcttggg

SEQ ID NO: 61729 - DNA, 25 bp, Homo sapien
gggtgatgagacatcccctttatct

SEQ ID NO: 61730 - DNA, 25 bp, Homo sapien
ggccaagacccgtcactttataaga

SEQ ID NO: 61731 - DNA, 25 bp, Homo sapien
agaagctcagatgcagcagtgctgg

SEQ ID NO: 61732 - DNA, 25 bp, Homo sapien
tggagagctctctctttatgcaaaa

SEQ ID NO: 61733 - DNA, 25 bp, Homo sapien
atctcatttcaccaggagctttcag

SEQ ID NO: 61734 - DNA, 25 bp, Homo sapien
gagctttcagaagtttcacctgggc

SEQ ID NO: 61735 - DNA, 25 bp, Homo sapien
acctgggctaaattcagcagcattt

SEQ ID NO: 61736 - DNA, 25 bp, Homo sapien
tattttcacacttggattcttgctc

SEQ ID NO: 61737 - DNA, 25 bp, Homo sapien
gtaccaatatttgcctccttttctg

SEQ ID NO: 61738 - DNA, 25 bp, Homo sapien
aactgggtttttctgacatgcctag

SEQ ID NO: 61739 - DNA, 25 bp, Homo sapien
acctatttcagactgttgatgacat

SEQ ID NO: 61740 - DNA, 25 bp, Homo sapien
gacattgacatttcatggattcgga

SEQ ID NO: 61741 - DNA, 25 bp, Homo sapien
tgatgcaaggagacacatgccaccc

SEQ ID NO: 61742 - DNA, 25 bp, Homo sapien
gcagtacacaaagcacttaccttga

SEQ ID NO: 61743 - DNA, 25 bp, Homo sapien
agcacttaccttgactggtgaagtc

SEQ ID NO: 61744 - DNA, 25 bp, Homo sapien
gactggtgaagtcagccagccatct

SEQ ID NO: 61745 - DNA, 25 bp, Homo sapien
agccagccatctcagcagggaagaa

SEQ ID NO: 61746 - DNA, 25 bp, Homo sapien
aaccttctcaaccaaaactgcaatc

SEQ ID NO: 61747 - DNA, 25 bp, Homo sapien
gggaatctcacactgactaactgaa

SEQ ID NO: 61748 - DNA, 25 bp, Homo sapien
actaactgaatggacgctttgtatt

SEQ ID NO: 61749 - DNA, 25 bp, Homo sapien
gacgctttgtattcagagatggctt

SEQ ID NO: 61750 - DNA, 25 bp, Homo sapien
aaaagcaggatctaggcagcctcat

SEQ ID NO: 61751 - DNA, 25 bp, Homo sapien
tctaggcagcctcatgaaactcgga

SEQ ID NO: 61752 - DNA, 25 bp, Homo sapien
ggcagcctcatgaaactcggaaaaa

SEQ ID NO: 61753 - DNA, 25 bp, Homo sapien
ttgatttcatgtcaatagctttttt

SEQ ID NO: 61754 - DNA, 25 bp, Homo sapien
gtagcttatctgttgctgggtcatc

SEQ ID NO: 61755 - DNA, 25 bp, Homo sapien
atcaccacaaactcttttcacaggg

SEQ ID NO: 61756 - DNA, 25 bp, Homo sapien
caaactcttttcacagggaaattca

SEQ ID NO: 61757 - DNA, 25 bp, Homo sapien
gggaaattcaatgagcagcactgga

SEQ ID NO: 61758 - DNA, 25 bp, Homo sapien
gcagcactggatctcaaaatgtcat

SEQ ID NO: 61759 - DNA, 25 bp, Homo sapien
catatagaatctcaaccacagctcc

SEQ ID NO: 61760 - DNA, 25 bp, Homo sapien
agctccatcattctattccattatt

SEQ ID NO: 61761 - DNA, 25 bp, Homo sapien
agcgtcgagctgctttgtagttgca

SEQ ID NO: 61762 - DNA, 25 bp, Homo sapien
tgctttgtagttgcagagtgctgca

SEQ ID NO: 61763 - DNA, 25 bp, Homo sapien
agagtgctgcatggaatctggcccc

SEQ ID NO: 61764 - DNA, 25 bp, Homo sapien
aatctggccccaggttctgtgctga

SEQ ID NO: 61765 - DNA, 25 bp, Homo sapien
ttcatcaggcacaacagagccaaca

SEQ ID NO: 61766 - DNA, 25 bp, Homo sapien
gagccaacagcattctgttctgtgg

SEQ ID NO: 61767 - DNA, 25 bp, Homo sapien
gcaggttctcatcgccataaagggt

SEQ ID NO: 61768 - DNA, 25 bp, Homo sapien
aaagggtgcacttaccgtgcactcg

SEQ ID NO: 61769 - DNA, 25 bp, Homo sapien
agatccccactacagctccaagagg

SEQ ID NO: 61770 - DNA, 25 bp, Homo sapien
cagctccaagaggatgggcctagaa

SEQ ID NO: 61771 - DNA, 25 bp, Homo sapien
ggatgggcctagaaagccaagtgca

SEQ ID NO: 61772 - DNA, 25 bp, Homo sapien
gaagtgctggagcaacagccaacct

SEQ ID NO: 61773 - DNA, 25 bp, Homo sapien
acctgcctctgagatctggaagaaa

SEQ ID NO: 61774 - DNA, 25 bp, Homo sapien
aggtgagcctcgtgagacgtgttcc

SEQ ID NO: 61775 - DNA, 25 bp, Homo sapien
tcgtgagacgtgttcctaacctgcc

SEQ ID NO: 61776 - DNA, 25 bp, Homo sapien
cagccaaaagtgtctgcaggatgct

SEQ ID NO: 61777 - DNA, 25 bp, Homo sapien
gatttgtgtcaaggatccatgcatt

SEQ ID NO: 61778 - DNA, 25 bp, Homo sapien
ttcaccatgtgccaatgacttattt

SEQ ID NO: 61779 - DNA, 25 bp, Homo sapien
cttattttactccatgacctgccag

SEQ ID NO: 61780 - DNA, 25 bp, Homo sapien
tgccagcaccaagaaatccagaatc

SEQ ID NO: 61781 - DNA, 25 bp, Homo sapien
gaatcccgatcaaaaacagtcaagg

SEQ ID NO: 61782 - DNA, 25 bp, Homo sapien
gtcaaggagactgctattcaagaaa

SEQ ID NO: 61783 - DNA, 25 bp, Homo sapien
gcttagggatgagatacttatgcaa

SEQ ID NO: 61784 - DNA, 25 bp, Homo sapien
atgaaaaacctctccaagtcctggt

SEQ ID NO: 61785 - DNA, 25 bp, Homo sapien
aacctctccaagtcctggtggaaga

SEQ ID NO: 61786 - DNA, 25 bp, Homo sapien
gaagaagtactgctgtttcgtatga

SEQ ID NO: 61787 - DNA, 25 bp, Homo sapien
ctgtttcgtatgatgctggcaagac

SEQ ID NO: 61788 - DNA, 25 bp, Homo sapien
ggcaagacacccagaaaggctattt

SEQ ID NO: 61789 - DNA, 25 bp, Homo sapien
gctgaaacaactccttttactgcgt

SEQ ID NO: 61790 - DNA, 25 bp, Homo sapien
caactccttttactgcgtagaacct

SEQ ID NO: 61791 - DNA, 25 bp, Homo sapien
cgtagaacctatatcgagagtgtgt

SEQ ID NO: 61792 - DNA, 25 bp, Homo sapien
atatgtattataggaggagctctca

SEQ ID NO: 61793 - DNA, 25 bp, Homo sapien
gaggagctctcaattttatgtattc

SEQ ID NO: 61794 - DNA, 25 bp, Homo sapien
gcgccaggccagcaccaacgtgaaa

SEQ ID NO: 61795 - DNA, 25 bp, Homo sapien
aggccagcaccaacgtgaaacactg

SEQ ID NO: 61796 - DNA, 25 bp, Homo sapien
aacactggaatgtccagatgaaccg

SEQ ID NO: 61797 - DNA, 25 bp, Homo sapien
tgatgcatccaattgagcctggaga

SEQ ID NO: 61798 - DNA, 25 bp, Homo sapien
gagcctggagataagcgtccggtca

SEQ ID NO: 61799 - DNA, 25 bp, Homo sapien
ggagataagcgtccggtcaccagca

SEQ ID NO: 61800 - DNA, 25 bp, Homo sapien
tcgcccaacagcaatgagcagcaga

SEQ ID NO: 61801 - DNA, 25 bp, Homo sapien
aacagcaatgagcagcagaagtccc

SEQ ID NO: 61802 - DNA, 25 bp, Homo sapien
cacccctcaggaagataaactggat

SEQ ID NO: 61803 - DNA, 25 bp, Homo sapien
gataaactggatccagcaccagaaa

SEQ ID NO: 61804 - DNA, 25 bp, Homo sapien
actggatccagcaccagaaaattag

SEQ ID NO: 61805 - DNA, 25 bp, Homo sapien
gcctggagggctgctctgtgttaat

SEQ ID NO: 61806 - DNA, 25 bp, Homo sapien
agattgtaaggtttgccctcctcac

SEQ ID NO: 61807 - DNA, 25 bp, Homo sapien
taaggtttgccctcctcacctgttg

SEQ ID NO: 61808 - DNA, 25 bp, Homo sapien
tgcgggtagtattagccacccccct

SEQ ID NO: 61809 - DNA, 25 bp, Homo sapien
atctgttcccagcaccggagaaggg

SEQ ID NO: 61810 - DNA, 25 bp, Homo sapien
tatgcacctgagctcctgcttcgcg

SEQ ID NO: 61811 - DNA, 25 bp, Homo sapien
tgcccagagggctggatgcctgccg

SEQ ID NO: 61812 - DNA, 25 bp, Homo sapien
tcaggaaaattcacaggacttggga

SEQ ID NO: 61813 - DNA, 25 bp, Homo sapien
aattcacaggacttgggagattcta

SEQ ID NO: 61814 - DNA, 25 bp, Homo sapien
cacaggacttgggagattctaaatc

SEQ ID NO: 61815 - DNA, 25 bp, Homo sapien
aggacttgggagattctaaatctta

SEQ ID NO: 61816 - DNA, 25 bp, Homo sapien
ctactgatttgtaatggctctctat

SEQ ID NO: 61817 - DNA, 25 bp, Homo sapien
gtaatggctctctatataaaaagga

SEQ ID NO: 61818 - DNA, 25 bp, Homo sapien
acaaatattctctcatgttttctat

SEQ ID NO: 61819 - DNA, 25 bp, Homo sapien
ttatgtcatcatatctttcagtcct

SEQ ID NO: 61820 - DNA, 25 bp, Homo sapien
gtcatcatatctttcagtccttttc

SEQ ID NO: 61821 - DNA, 25 bp, Homo sapien
atctttcagtccttttctgtattat

SEQ ID NO: 61822 - DNA, 25 bp, Homo sapien
tatttctggctttgatggcatgcat

SEQ ID NO: 61823 - DNA, 25 bp, Homo sapien
gatggcatgcattgaaagccctttt

SEQ ID NO: 61824 - DNA, 25 bp, Homo sapien
gtactaatgtgtatgaattccatct

SEQ ID NO: 61825 - DNA, 25 bp, Homo sapien
atgaattccatcttaatagttttgc

SEQ ID NO: 61826 - DNA, 25 bp, Homo sapien
gttttgctaacttgtccattgaggg

SEQ ID NO: 61827 - DNA, 25 bp, Homo sapien
agaattaacccatagatgtgaccat

SEQ ID NO: 61828 - DNA, 25 bp, Homo sapien
acccatagatgtgaccattgaccat

SEQ ID NO: 61829 - DNA, 25 bp, Homo sapien
gaccattgaaaatcaccctcatctg

SEQ ID NO: 61830 - DNA, 25 bp, Homo sapien
ctcccatgtgttcagttcacccatg

SEQ ID NO: 61831 - DNA, 25 bp, Homo sapien
ttcacccatgcaggcatgctgaggt

SEQ ID NO: 61832 - DNA, 25 bp, Homo sapien
gaaaatcattgagactgttgcagaa

SEQ ID NO: 61833 - DNA, 25 bp, Homo sapien
ggagaacttggagttcatatgtatc

SEQ ID NO: 61834 - DNA, 25 bp, Homo sapien
gtacaagctgtcattccaacaatag

SEQ ID NO: 61835 - DNA, 25 bp, Homo sapien
gactacacaagacacttcacaatgt

SEQ ID NO: 61836 - DNA, 25 bp, Homo sapien
gagagcataaaatctatcctaatta

SEQ ID NO: 61837 - DNA, 25 bp, Homo sapien
aatctatcctaattattggttctga

SEQ ID NO: 61838 - DNA, 25 bp, Homo sapien
ataacttgtgttactaatttgtata

SEQ ID NO: 61839 - DNA, 25 bp, Homo sapien
taatttgtataacccatatctgtgc

SEQ ID NO: 61840 - DNA, 25 bp, Homo sapien
gtataacccatatctgtgcaatgga

SEQ ID NO: 61841 - DNA, 25 bp, Homo sapien
acccatatctgtgcaatggaatata

SEQ ID NO: 61842 - DNA, 25 bp, Homo sapien
aagttgtttaactagactgcgtgtt

SEQ ID NO: 61843 - DNA, 25 bp, Homo sapien
actagactgcgtgttgtttttcccg

SEQ ID NO: 61844 - DNA, 25 bp, Homo sapien
agactgcgtgttgtttttcccgtat

SEQ ID NO: 61845 - DNA, 25 bp, Homo sapien
tgcgtgttgtttttcccgtataata

SEQ ID NO: 61846 - DNA, 25 bp, Homo sapien
aaaattcacttctatatatacaatg

SEQ ID NO: 61847 - DNA, 25 bp, Homo sapien
taataactaaaccagattctttgtg

SEQ ID NO: 61848 - DNA, 25 bp, Homo sapien
actaaaccagattctttgtggatac

SEQ ID NO: 61849 - DNA, 25 bp, Homo sapien
gattggtctactttttcctgtagga

SEQ ID NO: 61850 - DNA, 25 bp, Homo sapien
gattttattgtagagttttgctggt

SEQ ID NO: 61851 - DNA, 25 bp, Homo sapien
gtgattttgaacagattatgcaaca

SEQ ID NO: 61852 - DNA, 25 bp, Homo sapien
gcaacattggaaggaaggctgtact

SEQ ID NO: 61853 - DNA, 25 bp, Homo sapien
ggaaggctgtactttgatggtttga

SEQ ID NO: 61854 - DNA, 25 bp, Homo sapien
gatggtttgaaggaactcagcagta

SEQ ID NO: 61855 - DNA, 25 bp, Homo sapien
gaactcagcagtatgatgatctggt

SEQ ID NO: 61856 - DNA, 25 bp, Homo sapien
aaatagctggttggtgtctagcccc

SEQ ID NO: 61857 - DNA, 25 bp, Homo sapien
ccccaacacttttgtctgttgtgta

SEQ ID NO: 61858 - DNA, 25 bp, Homo sapien
agaaagactggcatgtaccttcatt

SEQ ID NO: 61859 - DNA, 25 bp, Homo sapien
tttgcttagctatttgagtatctag

SEQ ID NO: 61860 - DNA, 25 bp, Homo sapien
ctttgtcagatttccggtattaatc

SEQ ID NO: 61861 - DNA, 25 bp, Homo sapien
aacctttcaaattctgcatgatctg

SEQ ID NO: 61862 - DNA, 25 bp, Homo sapien
ttctgcatgatctgtgattcttcac

SEQ ID NO: 61863 - DNA, 25 bp, Homo sapien
atctgtgattcttcaccagcatctg

SEQ ID NO: 61864 - DNA, 25 bp, Homo sapien
gcatctggagatctagtcttggagt

SEQ ID NO: 61865 - DNA, 25 bp, Homo sapien
cttggagtagttaatagccctgctt

SEQ ID NO: 61866 - DNA, 25 bp, Homo sapien
agccctgcttggtcattactttgaa

SEQ ID NO: 61867 - DNA, 25 bp, Homo sapien
aatttggatctgctgaaacttcagg

SEQ ID NO: 61868 - DNA, 25 bp, Homo sapien
tgtgtgatgcatattattacctaac

SEQ ID NO: 61869 - DNA, 25 bp, Homo sapien
tattacctaacattctcattatcag

SEQ ID NO: 61870 - DNA, 25 bp, Homo sapien
cattatcagaatttgacctttgtca

SEQ ID NO: 61871 - DNA, 25 bp, Homo sapien
cagctgacaggctgttgctgtgcct

SEQ ID NO: 61872 - DNA, 25 bp, Homo sapien
cagccacaagtggtagaactgcctt

SEQ ID NO: 61873 - DNA, 25 bp, Homo sapien
tggtagaactgccttggtggacacc

SEQ ID NO: 61874 - DNA, 25 bp, Homo sapien
tctttatttcctgaatggtttgtga

SEQ ID NO: 61875 - DNA, 25 bp, Homo sapien
ggtttgtgaacttgctcacctggac

SEQ ID NO: 61876 - DNA, 25 bp, Homo sapien
tggaccactgtatcctgccactgtc

SEQ ID NO: 61877 - DNA, 25 bp, Homo sapien
ctggtctcgcactgccactgcatgg

SEQ ID NO: 61878 - DNA, 25 bp, Homo sapien
actgcatggcctcctgtcactgtga

SEQ ID NO: 61879 - DNA, 25 bp, Homo sapien
gtcactgtgaatcgtggcccagtct

SEQ ID NO: 61880 - DNA, 25 bp, Homo sapien
ggcccagtctcagtttgtagtttct

SEQ ID NO: 61881 - DNA, 25 bp, Homo sapien
gtttctcattaaattggccctttca

SEQ ID NO: 61882 - DNA, 25 bp, Homo sapien
atgcaaggttttgagagatctaaga

SEQ ID NO: 61883 - DNA, 25 bp, Homo sapien
gagagatctaagaattggagcattt

SEQ ID NO: 61884 - DNA, 25 bp, Homo sapien
tataaacaccaaatcaaggcatttt

SEQ ID NO: 61885 - DNA, 25 bp, Homo sapien
aaggcattttgcattgtactactca

SEQ ID NO: 61886 - DNA, 25 bp, Homo sapien
gcattgtactactcatcttttgaat

SEQ ID NO: 61887 - DNA, 25 bp, Homo sapien
gtactactcatcttttgaattaaaa

SEQ ID NO: 61888 - DNA, 25 bp, Homo sapien
taattttgcctgctactgttttcct

SEQ ID NO: 61889 - DNA, 25 bp, Homo sapien
gcctgctactgttttcctacataaa

SEQ ID NO: 61890 - DNA, 25 bp, Homo sapien
tactgttttcctacataaattcaat

SEQ ID NO: 61891 - DNA, 25 bp, Homo sapien
tgaaacattttcaactcattaatct

SEQ ID NO: 61892 - DNA, 25 bp, Homo sapien
caactcattaatctttctagcaata

SEQ ID NO: 61893 - DNA, 25 bp, Homo sapien
atgtttacatgtttacatctctaaa

SEQ ID NO: 61894 - DNA, 25 bp, Homo sapien
gcttatttgaaatgttaatgctctt

SEQ ID NO: 61895 - DNA, 25 bp, Homo sapien
gaaatgttaatgctctttagaaaaa

SEQ ID NO: 61896 - DNA, 25 bp, Homo sapien
aaaactacttgaaagagctgtaatc

SEQ ID NO: 61897 - DNA, 25 bp, Homo sapien
gctgtaatcatatagctaaagtgat

SEQ ID NO: 61898 - DNA, 25 bp, Homo sapien
aagtgataagatagccttgatttta

SEQ ID NO: 61899 - DNA, 25 bp, Homo sapien
aatactttaataagtgtcacagtta

SEQ ID NO: 61900 - DNA, 25 bp, Homo sapien
tttagtttccacgtaatctttatct

SEQ ID NO: 61901 - DNA, 25 bp, Homo sapien
agtttccacgtaatctttatctcta

SEQ ID NO: 61902 - DNA, 25 bp, Homo sapien
cacgtaatctttatctctacctaga

SEQ ID NO: 61903 - DNA, 25 bp, Homo sapien
atctctacctagatttagtgagttt

SEQ ID NO: 61904 - DNA, 25 bp, Homo sapien
gccaggtgggctgcagagtgggctc

SEQ ID NO: 61905 - DNA, 25 bp, Homo sapien
ctgcctgttctggactgtgttctgg

SEQ ID NO: 61906 - DNA, 25 bp, Homo sapien
ctgttctggactgtgttctgggcct

SEQ ID NO: 61907 - DNA, 25 bp, Homo sapien
atccagcactgaccagccctgattc

SEQ ID NO: 61908 - DNA, 25 bp, Homo sapien
gaccaccgcccagggtggagaagga

SEQ ID NO: 61909 - DNA, 25 bp, Homo sapien
gggatggcttaactgtacctgtttg

SEQ ID NO: 61910 - DNA, 25 bp, Homo sapien
gatggcttaactgtacctgtttgga

SEQ ID NO: 61911 - DNA, 25 bp, Homo sapien
ggcttaactgtacctgtttggatgc

SEQ ID NO: 61912 - DNA, 25 bp, Homo sapien
taactgtacctgtttggatgcttct

SEQ ID NO: 61913 - DNA, 25 bp, Homo sapien
actgtacctgtttggatgcttctga

SEQ ID NO: 61914 - DNA, 25 bp, Homo sapien
ctgtgctgagtgtgcccccggcctg

SEQ ID NO: 61915 - DNA, 25 bp, Homo sapien
gtaaatgtcagtaatcacttcatga

SEQ ID NO: 61916 - DNA, 25 bp, Homo sapien
gatttctatgcaggatttaccttca

SEQ ID NO: 61917 - DNA, 25 bp, Homo sapien
gatttaccttcatcctgtgcatgtt

SEQ ID NO: 61918 - DNA, 25 bp, Homo sapien
tcatcctgtgcatgtttcccaaact

SEQ ID NO: 61919 - DNA, 25 bp, Homo sapien
gggaaggctcagagatcgagcttct

SEQ ID NO: 61920 - DNA, 25 bp, Homo sapien
agatcgagcttctcctctgagttct

SEQ ID NO: 61921 - DNA, 25 bp, Homo sapien
ctgagttctaacaaaatggtgcttt

SEQ ID NO: 61922 - DNA, 25 bp, Homo sapien
atggtgctttgagggtcagccttta

SEQ ID NO: 61923 - DNA, 25 bp, Homo sapien
gtcagcctttaggaaggtgcagctt

SEQ ID NO: 61924 - DNA, 25 bp, Homo sapien
ggaaggtgcagctttgttgtccttt

SEQ ID NO: 61925 - DNA, 25 bp, Homo sapien
gcagctttgttgtcctttgagcttt

SEQ ID NO: 61926 - DNA, 25 bp, Homo sapien
tcagtggcaggatgtgagtggctac

SEQ ID NO: 61927 - DNA, 25 bp, Homo sapien
gagcaaaaggatggtcactcttccg

SEQ ID NO: 61928 - DNA, 25 bp, Homo sapien
aaaggatggtcactcttccgaggtc

SEQ ID NO: 61929 - DNA, 25 bp, Homo sapien
tcttccgaggtctccctgaaatgaa

SEQ ID NO: 61930 - DNA, 25 bp, Homo sapien
gaggtctccctgaaatgaatgtatt

SEQ ID NO: 61931 - DNA, 25 bp, Homo sapien
aaccttatttataatctgggtgatc

SEQ ID NO: 61932 - DNA, 25 bp, Homo sapien
ctgggtgatccaatcattttttact

SEQ ID NO: 61933 - DNA, 25 bp, Homo sapien
cccttttgatgccatacatagagga

SEQ ID NO: 61934 - DNA, 25 bp, Homo sapien
gccatacatagaggaaagtctagct

SEQ ID NO: 61935 - DNA, 25 bp, Homo sapien
aaagtctagcttttttggcgtgaga

SEQ ID NO: 61936 - DNA, 25 bp, Homo sapien
gcttttttggcgtgagacttttgca

SEQ ID NO: 61937 - DNA, 25 bp, Homo sapien
gctgcgtgaaagggagcgacactca

SEQ ID NO: 61938 - DNA, 25 bp, Homo sapien
ggagcgacactcagctgtgtgttcc

SEQ ID NO: 61939 - DNA, 25 bp, Homo sapien
agcgacactcagctgtgtgttcctg

SEQ ID NO: 61940 - DNA, 25 bp, Homo sapien
gcgacactcagctgtgtgttcctgg

SEQ ID NO: 61941 - DNA, 25 bp, Homo sapien
gtacttgagattccatttgagagtt

SEQ ID NO: 61942 - DNA, 25 bp, Homo sapien
cttgagattccatttgagagttgta

SEQ ID NO: 61943 - DNA, 25 bp, Homo sapien
gattccatttgagagttgtattgtt

SEQ ID NO: 61944 - DNA, 25 bp, Homo sapien
ccatttgagagttgtattgttaata

SEQ ID NO: 61945 - DNA, 25 bp, Homo sapien
ggtgtctttttcttgaaacaagctt

SEQ ID NO: 61946 - DNA, 25 bp, Homo sapien
ttgaaacaagcttccaagggctaga

SEQ ID NO: 61947 - DNA, 25 bp, Homo sapien
acaagcttccaagggctagaaataa

SEQ ID NO: 61948 - DNA, 25 bp, Homo sapien
tgatctcctcccactatgcatatgt

SEQ ID NO: 61949 - DNA, 25 bp, Homo sapien
tatgcatatgtaccctttactgtta

SEQ ID NO: 61950 - DNA, 25 bp, Homo sapien
aagatatgtcattctcccaaaggag

SEQ ID NO: 61951 - DNA, 25 bp, Homo sapien
gagacacaggtggttttcaatgatt

SEQ ID NO: 61952 - DNA, 25 bp, Homo sapien
tccttgcctcatgttgatgagtctg

SEQ ID NO: 61953 - DNA, 25 bp, Homo sapien
gatgagtctgtagaattcagaaccc

SEQ ID NO: 61954 - DNA, 25 bp, Homo sapien
ttcagaacccatttggacacagcta

SEQ ID NO: 61955 - DNA, 25 bp, Homo sapien
ttggacacagctaatatccctgctc

SEQ ID NO: 61956 - DNA, 25 bp, Homo sapien
cacagctaatatccctgctcttggg

SEQ ID NO: 61957 - DNA, 25 bp, Homo sapien
aaggacaccaagtcattggtaggga

SEQ ID NO: 61958 - DNA, 25 bp, Homo sapien
tggtagggaggtacaggcccttcct

SEQ ID NO: 61959 - DNA, 25 bp, Homo sapien
aggcggccagatccacatctggatc

SEQ ID NO: 61960 - DNA, 25 bp, Homo sapien
tggatctggatctgcggcggcctcg

SEQ ID NO: 61961 - DNA, 25 bp, Homo sapien
gccgtaaataggctcatctacctct

SEQ ID NO: 61962 - DNA, 25 bp, Homo sapien
gggcccggacggctgctgcggaaag

SEQ ID NO: 61963 - DNA, 25 bp, Homo sapien
gggccccagcgcttttgtgtatata

SEQ ID NO: 61964 - DNA, 25 bp, Homo sapien
gccccagcgcttttgtgtatataaa

SEQ ID NO: 61965 - DNA, 25 bp, Homo sapien
ccccagcgcttttgtgtatataaat

SEQ ID NO: 61966 - DNA, 25 bp, Homo sapien
tataggtatttgtaaccctgcccac

SEQ ID NO: 61967 - DNA, 25 bp, Homo sapien
aggtatttgtaaccctgcccacata

SEQ ID NO: 61968 - DNA, 25 bp, Homo sapien
tatttgtaaccctgcccacatatct

SEQ ID NO: 61969 - DNA, 25 bp, Homo sapien
aaccctgcccacatatcttatttat

SEQ ID NO: 61970 - DNA, 25 bp, Homo sapien
gggcccaatgtatgtagccaaattg

SEQ ID NO: 61971 - DNA, 25 bp, Homo sapien
ggtgacatgaatttgtaaactgtgt

SEQ ID NO: 61972 - DNA, 25 bp, Homo sapien
atgcagtaactttctctgggtctgt

SEQ ID NO: 61973 - DNA, 25 bp, Homo sapien
ctctgggtctgtttggaatcctatt

SEQ ID NO: 61974 - DNA, 25 bp, Homo sapien
ggtctgtttggaatcctatttagtt

SEQ ID NO: 61975 - DNA, 25 bp, Homo sapien
gttaatactttagcatcttagaatc

SEQ ID NO: 61976 - DNA, 25 bp, Homo sapien
gcatcttagaatctaggcttgagaa

SEQ ID NO: 61977 - DNA, 25 bp, Homo sapien
ggcttgagaattgttcaggtgtatt

SEQ ID NO: 61978 - DNA, 25 bp, Homo sapien
gtaacaatgatttaaggtggtgcag

SEQ ID NO: 61979 - DNA, 25 bp, Homo sapien
gtggtgcagatggtgtttgttctat

SEQ ID NO: 61980 - DNA, 25 bp, Homo sapien
gcagatggtgtttgttctatattat

SEQ ID NO: 61981 - DNA, 25 bp, Homo sapien
gaaacgatgcgggacaaatgatggt

SEQ ID NO: 61982 - DNA, 25 bp, Homo sapien
caaatgatggtcttcacggtgggat

SEQ ID NO: 61983 - DNA, 25 bp, Homo sapien
ttcacggtgggatggacctcgtcag

SEQ ID NO: 61984 - DNA, 25 bp, Homo sapien
ggatggacctcgtcagctgcccagg

SEQ ID NO: 61985 - DNA, 25 bp, Homo sapien
ctctctctactcaggacccaggagt

SEQ ID NO: 61986 - DNA, 25 bp, Homo sapien
gaaccatcacgcctggcatggtctg

SEQ ID NO: 61987 - DNA, 25 bp, Homo sapien
tggtctgtgcaggagttccccaggg

SEQ ID NO: 61988 - DNA, 25 bp, Homo sapien
gacccctggtgtgcagaggacagct

SEQ ID NO: 61989 - DNA, 25 bp, Homo sapien
aggacagctccagggcctcgtgtct

SEQ ID NO: 61990 - DNA, 25 bp, Homo sapien
gtctacaccaacctgtgcaagtaca

SEQ ID NO: 61991 - DNA, 25 bp, Homo sapien
acagaagctggattgaggaaacgat

SEQ ID NO: 61992 - DNA, 25 bp, Homo sapien
gaaggacgcgctccaggagatatat

SEQ ID NO: 61993 - DNA, 25 bp, Homo sapien
atataatcagaagggcatgtttcca

SEQ ID NO: 61994 - DNA, 25 bp, Homo sapien
agcagtttaagcctgcccggaggcc

SEQ ID NO: 61995 - DNA, 25 bp, Homo sapien
cttcagttttgtcttgggcgtcttt

SEQ ID NO: 61996 - DNA, 25 bp, Homo sapien
ttgggcgtctttgccagcggatcac

SEQ ID NO: 61997 - DNA, 25 bp, Homo sapien
ttgccagcggatcacctctcctgat

SEQ ID NO: 61998 - DNA, 25 bp, Homo sapien
ctctcctgatcctgactttcttggg

SEQ ID NO: 61999 - DNA, 25 bp, Homo sapien
gtgggagcagcttcctttggagttc

SEQ ID NO: 62000 - DNA, 25 bp, Homo sapien
gcttcctttggagttcgcagactga

SEQ ID NO: 62001 - DNA, 25 bp, Homo sapien
gagttcgcagactgataggagtaac

SEQ ID NO: 62002 - DNA, 25 bp, Homo sapien
aaaggctccagctacggaaaccaag

SEQ ID NO: 62003 - DNA, 25 bp, Homo sapien
gagccggaccgcaagacctcgagca

SEQ ID NO: 62004 - DNA, 25 bp, Homo sapien
ggaccgcaagacctcgagcatcgcg

SEQ ID NO: 62005 - DNA, 25 bp, Homo sapien
agcatcgcggccctccgcatgaagg

SEQ ID NO: 62006 - DNA, 25 bp, Homo sapien
ggccctccgcatgaaggccaaggag

SEQ ID NO: 62007 - DNA, 25 bp, Homo sapien
gccaaggagcacagtgcggccattt

SEQ ID NO: 62008 - DNA, 25 bp, Homo sapien
cacagtgcggccatttcctgggcca

SEQ ID NO: 62009 - DNA, 25 bp, Homo sapien
tgggccacatgacagggcacccctg

SEQ ID NO: 62010 - DNA, 25 bp, Homo sapien
atgggccacgcccatgttttccagg

SEQ ID NO: 62011 - DNA, 25 bp, Homo sapien
tcccactcgactttcctcttaggaa

SEQ ID NO: 62012 - DNA, 25 bp, Homo sapien
actttcagccgccccaagtctgagg

SEQ ID NO: 62013 - DNA, 25 bp, Homo sapien
caagtctgaggccccgtggactgct

SEQ ID NO: 62014 - DNA, 25 bp, Homo sapien
ctctccatgttcctgtaacttcata

SEQ ID NO: 62015 - DNA, 25 bp, Homo sapien
gttcctgtaacttcatacatgctca

SEQ ID NO: 62016 - DNA, 25 bp, Homo sapien
tacatgctcatatccattatggcaa

SEQ ID NO: 62017 - DNA, 25 bp, Homo sapien
atgatgtattattggcatccagcca

SEQ ID NO: 62018 - DNA, 25 bp, Homo sapien
tggcatccagccaacatgacaggat

SEQ ID NO: 62019 - DNA, 25 bp, Homo sapien
acaggatgtcacaggtcgctgagca

SEQ ID NO: 62020 - DNA, 25 bp, Homo sapien
gtcacaggtcgctgagcagagattt

SEQ ID NO: 62021 - DNA, 25 bp, Homo sapien
agattttcagactcagtttccaccc

SEQ ID NO: 62022 - DNA, 25 bp, Homo sapien
tttccacccgaattaactattattg

SEQ ID NO: 62023 - DNA, 25 bp, Homo sapien
atcattttctgctaaccttggctta

SEQ ID NO: 62024 - DNA, 25 bp, Homo sapien
tctgctaaccttggcttaagggaag

SEQ ID NO: 62025 - DNA, 25 bp, Homo sapien
gccctcagatgatggaagattttgt

SEQ ID NO: 62026 - DNA, 25 bp, Homo sapien
tggaagattttgtggagaagctgct

SEQ ID NO: 62027 - DNA, 25 bp, Homo sapien
tgcccctccaggatgtgtctgtggc

SEQ ID NO: 62028 - DNA, 25 bp, Homo sapien
ctgcaatttctgtcgccgtcctgta

SEQ ID NO: 62029 - DNA, 25 bp, Homo sapien
ccgtcctgtacactttgagctcatg

SEQ ID NO: 62030 - DNA, 25 bp, Homo sapien
gtgagtgggaacgttcctacttcgg

SEQ ID NO: 62031 - DNA, 25 bp, Homo sapien
tatgtcaccacctatgcctgagaag

SEQ ID NO: 62032 - DNA, 25 bp, Homo sapien
acctgcgcttcacttgggtccaggc

SEQ ID NO: 62033 - DNA, 25 bp, Homo sapien
tactcctgtcttctgctttgttgtg

SEQ ID NO: 62034 - DNA, 25 bp, Homo sapien
cttctgctttgttgtgtgcctctag

SEQ ID NO: 62035 - DNA, 25 bp, Homo sapien
gtgcctctagctgaattgagcctaa

SEQ ID NO: 62036 - DNA, 25 bp, Homo sapien
gctgtgtggagtggacaccctgacc

SEQ ID NO: 62037 - DNA, 25 bp, Homo sapien
tgtgtggagtggacaccctgacccc

SEQ ID NO: 62038 - DNA, 25 bp, Homo sapien
tgtggccttcgtcacagccgcgcag

SEQ ID NO: 62039 - DNA, 25 bp, Homo sapien
tcacagccgcgcagtgcccatggag

SEQ ID NO: 62040 - DNA, 25 bp, Homo sapien
tagcccgcctcggtgtctatgcaag

SEQ ID NO: 62041 - DNA, 25 bp, Homo sapien
tcggtgtctatgcaaggccgcttcg

SEQ ID NO: 62042 - DNA, 25 bp, Homo sapien
tatgcaaggccgcttcgccattgcg

SEQ ID NO: 62043 - DNA, 25 bp, Homo sapien
gccattgcggtattctttgcggtat

SEQ ID NO: 62044 - DNA, 25 bp, Homo sapien
attgcggtattctttgcggtattct

SEQ ID NO: 62045 - DNA, 25 bp, Homo sapien
gtattctttgcggtattcttgtccc

SEQ ID NO: 62046 - DNA, 25 bp, Homo sapien
tctttgcggtattcttgtccccgtc

SEQ ID NO: 62047 - DNA, 25 bp, Homo sapien
attttattatgttgtctttatcgac

SEQ ID NO: 62048 - DNA, 25 bp, Homo sapien
atgttgtctttatcgactttgtaaa

SEQ ID NO: 62049 - DNA, 25 bp, Homo sapien
aaagcagcaagatgttcaaactcca

SEQ ID NO: 62050 - DNA, 25 bp, Homo sapien
gttcaaactccatctgcaaaagaag

SEQ ID NO: 62051 - DNA, 25 bp, Homo sapien
ggaaaaaattcagcgtcgacctcat

SEQ ID NO: 62052 - DNA, 25 bp, Homo sapien
attcagcgtcgacctcatgagttac

SEQ ID NO: 62053 - DNA, 25 bp, Homo sapien
catgagttacctccccagagtcaac

SEQ ID NO: 62054 - DNA, 25 bp, Homo sapien
agagtcaaccttgggtgatgccttc

SEQ ID NO: 62055 - DNA, 25 bp, Homo sapien
ttgggtgatgccttcccagagtcaa

SEQ ID NO: 62056 - DNA, 25 bp, Homo sapien
ttcccagagtcaacctcctgtgacg

SEQ ID NO: 62057 - DNA, 25 bp, Homo sapien
gtgatgccttcccagagtcaacctc

SEQ ID NO: 62058 - DNA, 25 bp, Homo sapien
ttttcctgcctcacagttacattgg

SEQ ID NO: 62059 - DNA, 25 bp, Homo sapien
cctgcctcacagttacattggtaat

SEQ ID NO: 62060 - DNA, 25 bp, Homo sapien
gcctcacagttacattggtaattct

SEQ ID NO: 62061 - DNA, 25 bp, Homo sapien
tggtaattctggcatgtcctcaaaa

SEQ ID NO: 62062 - DNA, 25 bp, Homo sapien
gtaattctggcatgtcctcaaaaat

SEQ ID NO: 62063 - DNA, 25 bp, Homo sapien
aattctggcatgtcctcaaaaatga

SEQ ID NO: 62064 - DNA, 25 bp, Homo sapien
tggcatgtcctcaaaaatgactcat

SEQ ID NO: 62065 - DNA, 25 bp, Homo sapien
atgtcctcaaaaatgactcatgact

SEQ ID NO: 62066 - DNA, 25 bp, Homo sapien
aaatgactcatgactgtggatatga

SEQ ID NO: 62067 - DNA, 25 bp, Homo sapien
atcagaaagttgattcttatgataa

SEQ ID NO: 62068 - DNA, 25 bp, Homo sapien
atagaaaagcaaagcttgagtttcc

SEQ ID NO: 62069 - DNA, 25 bp, Homo sapien
gggacaccaccagttgtcaagctac

SEQ ID NO: 62070 - DNA, 25 bp, Homo sapien
ccagttgtcaagctactaggcagta

SEQ ID NO: 62071 - DNA, 25 bp, Homo sapien
gtctgagggctcaggcctccacctg

SEQ ID NO: 62072 - DNA, 25 bp, Homo sapien
caggcctccacctgagaggttataa

SEQ ID NO: 62073 - DNA, 25 bp, Homo sapien
taacctgagagacagctctaccctt

SEQ ID NO: 62074 - DNA, 25 bp, Homo sapien
tctacccttcctcccagtaagaagg

SEQ ID NO: 62075 - DNA, 25 bp, Homo sapien
ggtgggcacctgagagattaagact

SEQ ID NO: 62076 - DNA, 25 bp, Homo sapien
agattaagactattctcccagtccc

SEQ ID NO: 62077 - DNA, 25 bp, Homo sapien
gtttacgggctgtgaatggaccttc

SEQ ID NO: 62078 - DNA, 25 bp, Homo sapien
gctgtgaatggaccttcagccctgc

SEQ ID NO: 62079 - DNA, 25 bp, Homo sapien
ctgatgttttggttgtgtgaataaa

SEQ ID NO: 62080 - DNA, 25 bp, Homo sapien
atctgatcaagttcttgttatttcc

SEQ ID NO: 62081 - DNA, 25 bp, Homo sapien
cttgttatttccaaatagaatggac

SEQ ID NO: 62082 - DNA, 25 bp, Homo sapien
gtgtcttttcactaattacctatac

SEQ ID NO: 62083 - DNA, 25 bp, Homo sapien
tcactaattacctatactatgccaa

SEQ ID NO: 62084 - DNA, 25 bp, Homo sapien
ctatactatgccaatatttccttat

SEQ ID NO: 62085 - DNA, 25 bp, Homo sapien
atatttccttatatctatccataac

SEQ ID NO: 62086 - DNA, 25 bp, Homo sapien
atccataacatttatactacatttg

SEQ ID NO: 62087 - DNA, 25 bp, Homo sapien
tgtaagagaatatgcacgtgaaact

SEQ ID NO: 62088 - DNA, 25 bp, Homo sapien
gagaatatgcacgtgaaacttaaca

SEQ ID NO: 62089 - DNA, 25 bp, Homo sapien
gcacgtgaaacttaacactttataa

SEQ ID NO: 62090 - DNA, 25 bp, Homo sapien
atgaggtttccaagatttaataatc

SEQ ID NO: 62091 - DNA, 25 bp, Homo sapien
cacacccagccagatgcaaataatt

SEQ ID NO: 62092 - DNA, 25 bp, Homo sapien
acacccagccagatgcaaataattt

SEQ ID NO: 62093 - DNA, 25 bp, Homo sapien
cacccagccagatgcaaataatttt

SEQ ID NO: 62094 - DNA, 25 bp, Homo sapien
acccagccagatgcaaataattttc

SEQ ID NO: 62095 - DNA, 25 bp, Homo sapien
cccagccagatgcaaataattttct

SEQ ID NO: 62096 - DNA, 25 bp, Homo sapien
cagccagatgcaaataattttctta

SEQ ID NO: 62097 - DNA, 25 bp, Homo sapien
gccagatgcaaataattttcttaga

SEQ ID NO: 62098 - DNA, 25 bp, Homo sapien
ttattttaggcccagaaatcaagga

SEQ ID NO: 62099 - DNA, 25 bp, Homo sapien
attttaggcccagaaatcaaggatt

SEQ ID NO: 62100 - DNA, 25 bp, Homo sapien
ttttaggcccagaaatcaaggattg

SEQ ID NO: 62101 - DNA, 25 bp, Homo sapien
tttaggcccagaaatcaaggattgt

SEQ ID NO: 62102 - DNA, 25 bp, Homo sapien
gcagtattttgaaccagttgctact

SEQ ID NO: 62103 - DNA, 25 bp, Homo sapien
gaaccagttgctactataagagtac

SEQ ID NO: 62104 - DNA, 25 bp, Homo sapien
ataagagtacttgaaaacctagaag

SEQ ID NO: 62105 - DNA, 25 bp, Homo sapien
gaagaaactaccacagaagcaattt

SEQ ID NO: 62106 - DNA, 25 bp, Homo sapien
accacagaagcaatttttcatgttt

SEQ ID NO: 62107 - DNA, 25 bp, Homo sapien
ttctcctatgagacagatatgaaag

SEQ ID NO: 62108 - DNA, 25 bp, Homo sapien
gaacatcaacaaaagattggtcctt

SEQ ID NO: 62109 - DNA, 25 bp, Homo sapien
gattggtccttggtgaaataaactt

SEQ ID NO: 62110 - DNA, 25 bp, Homo sapien
gaaaaatgcacttactaagaacatg

SEQ ID NO: 62111 - DNA, 25 bp, Homo sapien
tgaagactttgtattttggctgtaa

SEQ ID NO: 62112 - DNA, 25 bp, Homo sapien
aagttttattgtgtgatcatcttaa

SEQ ID NO: 62113 - DNA, 25 bp, Homo sapien
aatcataagggacatcctctcagcc

SEQ ID NO: 62114 - DNA, 25 bp, Homo sapien
aagttctattcaccctgatactcaa

SEQ ID NO: 62115 - DNA, 25 bp, Homo sapien
aacctcactttcgaagtaacgctga

SEQ ID NO: 62116 - DNA, 25 bp, Homo sapien
gaatgactcacccatttcatagctt

SEQ ID NO: 62117 - DNA, 25 bp, Homo sapien
atagcttttccgtggcaaagcctca

SEQ ID NO: 62118 - DNA, 25 bp, Homo sapien
ggcaaagcctcactaaaacctatct

SEQ ID NO: 62119 - DNA, 25 bp, Homo sapien
taatccctagctccaattctttaat

SEQ ID NO: 62120 - DNA, 25 bp, Homo sapien
caattctttaatctccatggtgctt

SEQ ID NO: 62121 - DNA, 25 bp, Homo sapien
tctccatggtgcttctgattaatag

SEQ ID NO: 62122 - DNA, 25 bp, Homo sapien
tactaacattttcaccccgaagtat

SEQ ID NO: 62123 - DNA, 25 bp, Homo sapien
gaagtattatccttcgccatcctct

SEQ ID NO: 62124 - DNA, 25 bp, Homo sapien
cattttaaacgtacagttctgcagc

SEQ ID NO: 62125 - DNA, 25 bp, Homo sapien
gttctgcagcattaagtccactcac

SEQ ID NO: 62126 - DNA, 25 bp, Homo sapien
ttaagtccactcacactgctgggca

SEQ ID NO: 62127 - DNA, 25 bp, Homo sapien
tgctgggcaaccaatctcctgtagt

SEQ ID NO: 62128 - DNA, 25 bp, Homo sapien
ggcaaccaatctcctgtagtactga

SEQ ID NO: 62129 - DNA, 25 bp, Homo sapien
atctcctgtagtactgaatcacatt

SEQ ID NO: 62130 - DNA, 25 bp, Homo sapien
tctatgaatctgacttactctaaga

SEQ ID NO: 62131 - DNA, 25 bp, Homo sapien
gacttactctaagaacctcatataa

SEQ ID NO: 62132 - DNA, 25 bp, Homo sapien
tgaaatcatctggtgttttgtcttt

SEQ ID NO: 62133 - DNA, 25 bp, Homo sapien
ttgtgatgggcttatttcattttgc

SEQ ID NO: 62134 - DNA, 25 bp, Homo sapien
atgtcctcaaggtgcttttatagct

SEQ ID NO: 62135 - DNA, 25 bp, Homo sapien
aaatcttacatctttgcctttaaag

SEQ ID NO: 62136 - DNA, 25 bp, Homo sapien
tacaaccatcactagatcacagtag

SEQ ID NO: 62137 - DNA, 25 bp, Homo sapien
ggagaggctctcatgctgtaaataa

SEQ ID NO: 62138 - DNA, 25 bp, Homo sapien
taataacctttcatcacttcctttg

SEQ ID NO: 62139 - DNA, 25 bp, Homo sapien
tgcgcttcctgccttaagtgacaag

SEQ ID NO: 62140 - DNA, 25 bp, Homo sapien
aagtagcaacatggcttgggtcccc

SEQ ID NO: 62141 - DNA, 25 bp, Homo sapien
gtcccctgtgcagcatcagcttatg

SEQ ID NO: 62142 - DNA, 25 bp, Homo sapien
acaagtcagtttgcaccctaggtgc

SEQ ID NO: 62143 - DNA, 25 bp, Homo sapien
aggtgcccaggagctagtatcctta

SEQ ID NO: 62144 - DNA, 25 bp, Homo sapien
gtatccttagatctttctatcgcta

SEQ ID NO: 62145 - DNA, 25 bp, Homo sapien
ctatcgctaacttaattctcttcgt

SEQ ID NO: 62146 - DNA, 25 bp, Homo sapien
aaatgcttcctcttaaatttctcat

SEQ ID NO: 62147 - DNA, 25 bp, Homo sapien
ctcagttctctagggatactttata

SEQ ID NO: 62148 - DNA, 25 bp, Homo sapien
gggaacttatactctaaacctcatt

SEQ ID NO: 62149 - DNA, 25 bp, Homo sapien
ttggacaagaccaccaataagttgt

SEQ ID NO: 62150 - DNA, 25 bp, Homo sapien
gtaggttacaattataaactgccag

SEQ ID NO: 62151 - DNA, 25 bp, Homo sapien
taaactgccagaccaaagattgacc

SEQ ID NO: 62152 - DNA, 25 bp, Homo sapien
aagattgaccaagtcaggcatagta

SEQ ID NO: 62153 - DNA, 25 bp, Homo sapien
ggcatagtaatgaccagcagtcctt

SEQ ID NO: 62154 - DNA, 25 bp, Homo sapien
gatccgtaaattccaagtagttttg

SEQ ID NO: 62155 - DNA, 25 bp, Homo sapien
tagttttgcttgtgtatacggatac

SEQ ID NO: 62156 - DNA, 25 bp, Homo sapien
atcctagcttgtcagttctctaaaa

SEQ ID NO: 62157 - DNA, 25 bp, Homo sapien
agccactgctgctcattcaaacttc

SEQ ID NO: 62158 - DNA, 25 bp, Homo sapien
gctcattcaaacttctgtccatgtc

SEQ ID NO: 62159 - DNA, 25 bp, Homo sapien
cactgttcctatcagcaggtggccc

SEQ ID NO: 62160 - DNA, 25 bp, Homo sapien
caggtggcccctgggcatcagaaca

SEQ ID NO: 62161 - DNA, 25 bp, Homo sapien
ggtggcagacacactcagagcatgt

SEQ ID NO: 62162 - DNA, 25 bp, Homo sapien
gacacactcagagcatgtctggctt

SEQ ID NO: 62163 - DNA, 25 bp, Homo sapien
atgtctggctttcctggtgggtcca

SEQ ID NO: 62164 - DNA, 25 bp, Homo sapien
ggtgggtccaggctcattctgcttc

SEQ ID NO: 62165 - DNA, 25 bp, Homo sapien
tttttcctgtacacatccctgtcta

SEQ ID NO: 62166 - DNA, 25 bp, Homo sapien
cacagattcttcctatcacacaggg

SEQ ID NO: 62167 - DNA, 25 bp, Homo sapien
tcacacagggatgccagttgtattt

SEQ ID NO: 62168 - DNA, 25 bp, Homo sapien
ggaaatcttttccatctccatccta

SEQ ID NO: 62169 - DNA, 25 bp, Homo sapien
tccatcctaacatgcacaacctgtg

SEQ ID NO: 62170 - DNA, 25 bp, Homo sapien
aactggtctgtgatcttttgtggcc

SEQ ID NO: 62171 - DNA, 25 bp, Homo sapien
attagggccttgacagaatttccac

SEQ ID NO: 62172 - DNA, 25 bp, Homo sapien
gacagaatttccacgaagctctgag

SEQ ID NO: 62173 - DNA, 25 bp, Homo sapien
agctctgagaacatgtttgtttcga

SEQ ID NO: 62174 - DNA, 25 bp, Homo sapien
gtttcgaatgtctgattcctctttg

SEQ ID NO: 62175 - DNA, 25 bp, Homo sapien
gattcctctttgtcatcaatgtgta

SEQ ID NO: 62176 - DNA, 25 bp, Homo sapien
atcaatgtgtatgctctgtccccat

SEQ ID NO: 62177 - DNA, 25 bp, Homo sapien
tcctcaagctcacaccaattggttt

SEQ ID NO: 62178 - DNA, 25 bp, Homo sapien
caccaattggtttggcacaggcaca

SEQ ID NO: 62179 - DNA, 25 bp, Homo sapien
gaggaaggtgacttctctctgtttg

SEQ ID NO: 62180 - DNA, 25 bp, Homo sapien
ctctgtttgtcttaagttgcactgg

SEQ ID NO: 62181 - DNA, 25 bp, Homo sapien
ggatttctgacttgaggcccatctc

SEQ ID NO: 62182 - DNA, 25 bp, Homo sapien
atttctgacttgaggcccatctctc

SEQ ID NO: 62183 - DNA, 25 bp, Homo sapien
cactgccttctttgtaatattaagt

SEQ ID NO: 62184 - DNA, 25 bp, Homo sapien
gacaagggtcagtctgtcgggtggg

SEQ ID NO: 62185 - DNA, 25 bp, Homo sapien
atcaaatcagcccaaggatatagtt

SEQ ID NO: 62186 - DNA, 25 bp, Homo sapien
tcagcccaaggatatagttaggatt

SEQ ID NO: 62187 - DNA, 25 bp, Homo sapien
gcccaaggatatagttaggattaat

SEQ ID NO: 62188 - DNA, 25 bp, Homo sapien
gagaaatcctaactatatcacacaa

SEQ ID NO: 62189 - DNA, 25 bp, Homo sapien
tcacacaaagggatacaactataaa

SEQ ID NO: 62190 - DNA, 25 bp, Homo sapien
ctgtgaccgatgagacctcagctca

SEQ ID NO: 62191 - DNA, 25 bp, Homo sapien
agctcagccctcaggtgcagtggcc

SEQ ID NO: 62192 - DNA, 25 bp, Homo sapien
aggtgcagtggccctacccagcctg

SEQ ID NO: 62193 - DNA, 25 bp, Homo sapien
gacacacacagggatgctcacgggt

SEQ ID NO: 62194 - DNA, 25 bp, Homo sapien
acacacagggatgctcacgggtgca

SEQ ID NO: 62195 - DNA, 25 bp, Homo sapien
acagggatgctcacgggtgcaccag

SEQ ID NO: 62196 - DNA, 25 bp, Homo sapien
atgctcacgggtgcaccaggagcca

SEQ ID NO: 62197 - DNA, 25 bp, Homo sapien
caggtgcggcgcagccaaccctgag

SEQ ID NO: 62198 - DNA, 25 bp, Homo sapien
aaggacacgctctccccaacagggt

SEQ ID NO: 62199 - DNA, 25 bp, Homo sapien
tccccaacagggtgcttcggcggga

SEQ ID NO: 62200 - DNA, 25 bp, Homo sapien
gaacaaggggtcttccgagcagccc

SEQ ID NO: 62201 - DNA, 25 bp, Homo sapien
agcaccgcagtcctatcaaggtttg

SEQ ID NO: 62202 - DNA, 25 bp, Homo sapien
tttgctgtagctcagaaggctctgc

SEQ ID NO: 62203 - DNA, 25 bp, Homo sapien
gaaggctctgcctacatgactactg

SEQ ID NO: 62204 - DNA, 25 bp, Homo sapien
ctactgcataccctactgggagaat

SEQ ID NO: 62205 - DNA, 25 bp, Homo sapien
ggagtcacccagcatagaagcatga

SEQ ID NO: 62206 - DNA, 25 bp, Homo sapien
gcatgagtgaatgacatcccagaga

SEQ ID NO: 62207 - DNA, 25 bp, Homo sapien
aaaggatcctggtagccacttcaaa

SEQ ID NO: 62208 - DNA, 25 bp, Homo sapien
gccacttcaaagactttttctccct

SEQ ID NO: 62209 - DNA, 25 bp, Homo sapien
ttcctcagacaatcatggcacatgg

SEQ ID NO: 62210 - DNA, 25 bp, Homo sapien
ggcgaagtttgtatgactcctccag

SEQ ID NO: 62211 - DNA, 25 bp, Homo sapien
actcctccagcagagtccttggaaa

SEQ ID NO: 62212 - DNA, 25 bp, Homo sapien
tacagaggtctctgccggctctttc

SEQ ID NO: 62213 - DNA, 25 bp, Homo sapien
tttccttgctcaaccatggctgaag

SEQ ID NO: 62214 - DNA, 25 bp, Homo sapien
ttgctcaaccatggctgaaggaaac

SEQ ID NO: 62215 - DNA, 25 bp, Homo sapien
aacagtgcaacagcactggctctct

SEQ ID NO: 62216 - DNA, 25 bp, Homo sapien
gcactggctctctccaggatccaga

SEQ ID NO: 62217 - DNA, 25 bp, Homo sapien
gggtttggtctggacttccttgctc

SEQ ID NO: 62218 - DNA, 25 bp, Homo sapien
ccctcttctcaagtgccttaatagt

SEQ ID NO: 62219 - DNA, 25 bp, Homo sapien
ccagtcaggaggcatagtttttagt

SEQ ID NO: 62220 - DNA, 25 bp, Homo sapien
gaacaatcaaagcacttggactctt

SEQ ID NO: 62221 - DNA, 25 bp, Homo sapien
agcacttggactcttgctctttcta

SEQ ID NO: 62222 - DNA, 25 bp, Homo sapien
gctctttctactctgaactaataaa

SEQ ID NO: 62223 - DNA, 25 bp, Homo sapien
catgtgatattagggagtttgcaat

SEQ ID NO: 62224 - DNA, 25 bp, Homo sapien
ggcagcttagcccatccagactggt

SEQ ID NO: 62225 - DNA, 25 bp, Homo sapien
ctggtcctgaagtctgtccctccat

SEQ ID NO: 62226 - DNA, 25 bp, Homo sapien
tgtccctccattggcatgaagtctg

SEQ ID NO: 62227 - DNA, 25 bp, Homo sapien
tgaagtctgccccttagcaatccgg

SEQ ID NO: 62228 - DNA, 25 bp, Homo sapien
tagcaatccggcctcgcaggctgta

SEQ ID NO: 62229 - DNA, 25 bp, Homo sapien
caggctgtactttcatggtgctctc

SEQ ID NO: 62230 - DNA, 25 bp, Homo sapien
tttcatggtgctctctaccttctgg

SEQ ID NO: 62231 - DNA, 25 bp, Homo sapien
ccatcccggaacattcctgagtgaa

SEQ ID NO: 62232 - DNA, 25 bp, Homo sapien
attcctgagtgaattcgcaagcgca

SEQ ID NO: 62233 - DNA, 25 bp, Homo sapien
tcgcaagcgcactagcatgtgatat

SEQ ID NO: 62234 - DNA, 25 bp, Homo sapien
aaggcttatggaattgatggaacaa

SEQ ID NO: 62235 - DNA, 25 bp, Homo sapien
aatattccagttgttggagttaaag

SEQ ID NO: 62236 - DNA, 25 bp, Homo sapien
gacaaagcagtgtgaaggttattca

SEQ ID NO: 62237 - DNA, 25 bp, Homo sapien
ataataggactttccaaacctggag

SEQ ID NO: 62238 - DNA, 25 bp, Homo sapien
taggactttccaaacctggagaaag

SEQ ID NO: 62239 - DNA, 25 bp, Homo sapien
atacaggaactggaagatcacagct

SEQ ID NO: 62240 - DNA, 25 bp, Homo sapien
ggaactggaagatcacagctaatca

SEQ ID NO: 62241 - DNA, 25 bp, Homo sapien
ggaagatcacagctaatcaatcaga

SEQ ID NO: 62242 - DNA, 25 bp, Homo sapien
gatcacagctaatcaatcagattca

SEQ ID NO: 62243 - DNA, 25 bp, Homo sapien
tcaacccaaataagaataccccaag

SEQ ID NO: 62244 - DNA, 25 bp, Homo sapien
gaataccccaagatatattataatc

SEQ ID NO: 62245 - DNA, 25 bp, Homo sapien
ttgcctgcctgtatcctcattggtg

SEQ ID NO: 62246 - DNA, 25 bp, Homo sapien
tgcctgtatcctcattggtgggagc

SEQ ID NO: 62247 - DNA, 25 bp, Homo sapien
tgtatcctcattggtgggagcccag

SEQ ID NO: 62248 - DNA, 25 bp, Homo sapien
atcctcattggtgggagcccagcca

SEQ ID NO: 62249 - DNA, 25 bp, Homo sapien
tgggagcccagccatggccctaatt

SEQ ID NO: 62250 - DNA, 25 bp, Homo sapien
agccatggccctaattgtgcctgag

SEQ ID NO: 62251 - DNA, 25 bp, Homo sapien
atggccctaattgtgcctgagcttg

SEQ ID NO: 62252 - DNA, 25 bp, Homo sapien
ccctaattgtgcctgagcttgactt

SEQ ID NO: 62253 - DNA, 25 bp, Homo sapien
ctaattgtgcctgagcttgactttc

SEQ ID NO: 62254 - DNA, 25 bp, Homo sapien
gagcttgactttcagtcagggccac

SEQ ID NO: 62255 - DNA, 25 bp, Homo sapien
tgactttcagtcagggccacagtga

SEQ ID NO: 62256 - DNA, 25 bp, Homo sapien
gaattacctatcacatttcccaatc

SEQ ID NO: 62257 - DNA, 25 bp, Homo sapien
attacctatcacatttcccaatctt

SEQ ID NO: 62258 - DNA, 25 bp, Homo sapien
tacctatcacatttcccaatcttga

SEQ ID NO: 62259 - DNA, 25 bp, Homo sapien
atcacatttcccaatcttgactatt

SEQ ID NO: 62260 - DNA, 25 bp, Homo sapien
catttcccaatcttgactattcaga

SEQ ID NO: 62261 - DNA, 25 bp, Homo sapien
tcccaatcttgactattcagaatgc

SEQ ID NO: 62262 - DNA, 25 bp, Homo sapien
gaatgctgtttatttagtgatgagg

SEQ ID NO: 62263 - DNA, 25 bp, Homo sapien
tgatgaggattagcacttgattgaa

SEQ ID NO: 62264 - DNA, 25 bp, Homo sapien
ggattagcacttgattgaagattct

SEQ ID NO: 62265 - DNA, 25 bp, Homo sapien
tagcacttgattgaagattctttta

SEQ ID NO: 62266 - DNA, 25 bp, Homo sapien
tgtattcattatgctacagaactga

SEQ ID NO: 62267 - DNA, 25 bp, Homo sapien
ttccttcctggagccacagtgctta

SEQ ID NO: 62268 - DNA, 25 bp, Homo sapien
gccacagtgcttagagacaggccac

SEQ ID NO: 62269 - DNA, 25 bp, Homo sapien
gggtcagcatttgagctcagctatg

SEQ ID NO: 62270 - DNA, 25 bp, Homo sapien
gcatttgagctcagctatgatcaga

SEQ ID NO: 62271 - DNA, 25 bp, Homo sapien
aaaaagcaccgttgaggttgcagtg

SEQ ID NO: 62272 - DNA, 25 bp, Homo sapien
aacaaacagaaagcaccgtcgagaa

SEQ ID NO: 62273 - DNA, 25 bp, Homo sapien
aagcaccgtcgagaaatggctccag

SEQ ID NO: 62274 - DNA, 25 bp, Homo sapien
gaaatggctccagcgctgactagcg

SEQ ID NO: 62275 - DNA, 25 bp, Homo sapien
cagttgggtggctaggttgcctcat

SEQ ID NO: 62276 - DNA, 25 bp, Homo sapien
taggttgcctcattttgcatccttc

SEQ ID NO: 62277 - DNA, 25 bp, Homo sapien
gcctcattttgcatccttctgtatc

SEQ ID NO: 62278 - DNA, 25 bp, Homo sapien
tattctctttgctatgtctacttta

SEQ ID NO: 62279 - DNA, 25 bp, Homo sapien
gtctactttaggctttgacagttat

SEQ ID NO: 62280 - DNA, 25 bp, Homo sapien
tgacagttatgtggaacctctgaaa

SEQ ID NO: 62281 - DNA, 25 bp, Homo sapien
gaattggtggagcagtcacagctac

SEQ ID NO: 62282 - DNA, 25 bp, Homo sapien
aagagcttacagaggaggcatttac

SEQ ID NO: 62283 - DNA, 25 bp, Homo sapien
ggaggcatttactaaccagttacca

SEQ ID NO: 62284 - DNA, 25 bp, Homo sapien
accagttaccagctggcttaataac

SEQ ID NO: 62285 - DNA, 25 bp, Homo sapien
gctggcttaataaccacagacggtc

SEQ ID NO: 62286 - DNA, 25 bp, Homo sapien
ccacagacggtcaacaacaaaatgt

SEQ ID NO: 62287 - DNA, 25 bp, Homo sapien
gttatggtttacacaacatcatatc

SEQ ID NO: 62288 - DNA, 25 bp, Homo sapien
aacatcatatcaacagatttctggt

SEQ ID NO: 62289 - DNA, 25 bp, Homo sapien
ttggtccccgacttcatgcttggaa

SEQ ID NO: 62290 - DNA, 25 bp, Homo sapien
atgcttggaaggctagcgctcatct

SEQ ID NO: 62291 - DNA, 25 bp, Homo sapien
gctcatctctacactagcctagatg

SEQ ID NO: 62292 - DNA, 25 bp, Homo sapien
agatggctgtgttttgcccctatga

SEQ ID NO: 62293 - DNA, 25 bp, Homo sapien
gcccctatgattccttgcagcatat

SEQ ID NO: 62294 - DNA, 25 bp, Homo sapien
aattgttgagtttttctcagcagca

SEQ ID NO: 62295 - DNA, 25 bp, Homo sapien
gtcagtgtctgcaggtatcggagct

SEQ ID NO: 62296 - DNA, 25 bp, Homo sapien
gatgaccatggaggcttctttcaga

SEQ ID NO: 62297 - DNA, 25 bp, Homo sapien
ttcatttctccttcggctgcaataa

SEQ ID NO: 62298 - DNA, 25 bp, Homo sapien
gctgcaataaccttggcgcgggcct

SEQ ID NO: 62299 - DNA, 25 bp, Homo sapien
tcgcgggacgcttctgcttctgcag

SEQ ID NO: 62300 - DNA, 25 bp, Homo sapien
ccatcagaaagattcattggcatgc

SEQ ID NO: 62301 - DNA, 25 bp, Homo sapien
cagaaagattcattggcatgccaca

SEQ ID NO: 62302 - DNA, 25 bp, Homo sapien
gaaagattcattggcatgccacagg

SEQ ID NO: 62303 - DNA, 25 bp, Homo sapien
tccttcatcctgtaaaggtcaacaa

SEQ ID NO: 62304 - DNA, 25 bp, Homo sapien
tcatcctgtaaaggtcaacaataaa

SEQ ID NO: 62305 - DNA, 25 bp, Homo sapien
gtcacactagcatagagaatgtgtt

SEQ ID NO: 62306 - DNA, 25 bp, Homo sapien
agcttgtatgtggttgttgatcttt

SEQ ID NO: 62307 - DNA, 25 bp, Homo sapien
gcttgtatgtggttgttgatctttt

SEQ ID NO: 62308 - DNA, 25 bp, Homo sapien
ttgtatgtggttgttgatctttttt

SEQ ID NO: 62309 - DNA, 25 bp, Homo sapien
ttttttccttacagacacccataat

SEQ ID NO: 62310 - DNA, 25 bp, Homo sapien
tttccttacagacacccataataaa

SEQ ID NO: 62311 - DNA, 25 bp, Homo sapien
agaaggtgccaacactgtcgctaca

SEQ ID NO: 62312 - DNA, 25 bp, Homo sapien
gtgccaacactgtcgctacagtaag

SEQ ID NO: 62313 - DNA, 25 bp, Homo sapien
tgtcgctacagtaaggacctgaagt

SEQ ID NO: 62314 - DNA, 25 bp, Homo sapien
ggacctgaagtgactttgagaaatt

SEQ ID NO: 62315 - DNA, 25 bp, Homo sapien
gagaaattcaccctcacaaaccttc

SEQ ID NO: 62316 - DNA, 25 bp, Homo sapien
acaaaccttccttcaggagcaggca

SEQ ID NO: 62317 - DNA, 25 bp, Homo sapien
agtgcagaggcacagattccgtcct

SEQ ID NO: 62318 - DNA, 25 bp, Homo sapien
agaggcacagattccgtcctttacc

SEQ ID NO: 62319 - DNA, 25 bp, Homo sapien
gattccgtcctttaccagctgcaga

SEQ ID NO: 62320 - DNA, 25 bp, Homo sapien
taccagctgcagaatcttgggcaag

SEQ ID NO: 62321 - DNA, 25 bp, Homo sapien
gcctctgtgagcctcatcggtaaac

SEQ ID NO: 62322 - DNA, 25 bp, Homo sapien
tgcattgtaagagtgatgtcacctt

SEQ ID NO: 62323 - DNA, 25 bp, Homo sapien
caccttgaagagcagctggcatgat

SEQ ID NO: 62324 - DNA, 25 bp, Homo sapien
catgatgactgctgtttgactcctg

SEQ ID NO: 62325 - DNA, 25 bp, Homo sapien
gtttgactcctgcataccaagatat

SEQ ID NO: 62326 - DNA, 25 bp, Homo sapien
taccaagatattctgcagcaatgtc

SEQ ID NO: 62327 - DNA, 25 bp, Homo sapien
tgtctttaaacagtgccggtagtac

SEQ ID NO: 62328 - DNA, 25 bp, Homo sapien
gccggtagtacagataacccctcat

SEQ ID NO: 62329 - DNA, 25 bp, Homo sapien
ccccagtgttcaggtgtttcacaag

SEQ ID NO: 62330 - DNA, 25 bp, Homo sapien
atgactagctacacgttttgccaaa

SEQ ID NO: 62331 - DNA, 25 bp, Homo sapien
gagtgccgccatttagtggctgcta

SEQ ID NO: 62332 - DNA, 25 bp, Homo sapien
gtggctgctagaaacattgcttctg

SEQ ID NO: 62333 - DNA, 25 bp, Homo sapien
aatgggggacataaagcctgtcctg

SEQ ID NO: 62334 - DNA, 25 bp, Homo sapien
atgggggacataaagcctgtcctgt

SEQ ID NO: 62335 - DNA, 25 bp, Homo sapien
tgggggacataaagcctgtcctgtc

SEQ ID NO: 62336 - DNA, 25 bp, Homo sapien
gggggacataaagcctgtcctgtct

SEQ ID NO: 62337 - DNA, 25 bp, Homo sapien
agcctgtcctgtctctattctaggc

SEQ ID NO: 62338 - DNA, 25 bp, Homo sapien
gcctgtcctgtctctattctaggca

SEQ ID NO: 62339 - DNA, 25 bp, Homo sapien
tttttctaaagagtcccagagaatg

SEQ ID NO: 62340 - DNA, 25 bp, Homo sapien
ttttctaaagagtcccagagaatgg

SEQ ID NO: 62341 - DNA, 25 bp, Homo sapien
tttctaaagagtcccagagaatggg

SEQ ID NO: 62342 - DNA, 25 bp, Homo sapien
tagcaatgattcacactcacagcaa

SEQ ID NO: 62343 - DNA, 25 bp, Homo sapien
gcaatgatgagtgactcctgcctca

SEQ ID NO: 62344 - DNA, 25 bp, Homo sapien
tgcctcatccattgtcctggattat

SEQ ID NO: 62345 - DNA, 25 bp, Homo sapien
gtcctggattattgcttctttaaag

SEQ ID NO: 62346 - DNA, 25 bp, Homo sapien
gaaagttatcacaagagagcacatc

SEQ ID NO: 62347 - DNA, 25 bp, Homo sapien
gagcacatcaatagattttaccgta

SEQ ID NO: 62348 - DNA, 25 bp, Homo sapien
gattttaccgtacagagttctttga

SEQ ID NO: 62349 - DNA, 25 bp, Homo sapien
gagttctttgaaccaacagctatga

SEQ ID NO: 62350 - DNA, 25 bp, Homo sapien
tctgtgtgccaagcatagtgtcttt

SEQ ID NO: 62351 - DNA, 25 bp, Homo sapien
atagtgtctttctggcatgcattca

SEQ ID NO: 62352 - DNA, 25 bp, Homo sapien
tctggcatgcattcaaccagtattt

SEQ ID NO: 62353 - DNA, 25 bp, Homo sapien
ggtatccctgtgtcctggtctatca

SEQ ID NO: 62354 - DNA, 25 bp, Homo sapien
gtgtcctggtctatcaccccagctt

SEQ ID NO: 62355 - DNA, 25 bp, Homo sapien
ccagccagccaataagaggacacaa

SEQ ID NO: 62356 - DNA, 25 bp, Homo sapien
gacacaaatgaggacacgtggcttt

SEQ ID NO: 62357 - DNA, 25 bp, Homo sapien
atgaggacacgtggcttttatacaa

SEQ ID NO: 62358 - DNA, 25 bp, Homo sapien
aagtatctatatgagattcttctat

SEQ ID NO: 62359 - DNA, 25 bp, Homo sapien
gattcttctatattgtacagagtgg

SEQ ID NO: 62360 - DNA, 25 bp, Homo sapien
tattgccctgcaacgtcccatctat

SEQ ID NO: 62361 - DNA, 25 bp, Homo sapien
gcaacgtcccatctatacgaggtgt

SEQ ID NO: 62362 - DNA, 25 bp, Homo sapien
tcccatctatacgaggtgttggaga

SEQ ID NO: 62363 - DNA, 25 bp, Homo sapien
gagaaggtgaagaaccctcccattc

SEQ ID NO: 62364 - DNA, 25 bp, Homo sapien
gggcctggaaacactaggattcagg

SEQ ID NO: 62365 - DNA, 25 bp, Homo sapien
gattcaggaaggtaggcaggacgtg

SEQ ID NO: 62366 - DNA, 25 bp, Homo sapien
gatgtgttaggaggcgtttaaaaca

SEQ ID NO: 62367 - DNA, 25 bp, Homo sapien
agatccagttcatttactccacagt

SEQ ID NO: 62368 - DNA, 25 bp, Homo sapien
gttcatttactccacagttattccc

SEQ ID NO: 62369 - DNA, 25 bp, Homo sapien
atttactccacagttattcccaggg

SEQ ID NO: 62370 - DNA, 25 bp, Homo sapien
actccacagttattcccagggctgg

SEQ ID NO: 62371 - DNA, 25 bp, Homo sapien
acagttattcccagggctggcccta

SEQ ID NO: 62372 - DNA, 25 bp, Homo sapien
agggctggccctagccacaaaggaa

SEQ ID NO: 62373 - DNA, 25 bp, Homo sapien
ggccctagccacaaaggaactttag

SEQ ID NO: 62374 - DNA, 25 bp, Homo sapien
agccacaaaggaactttagggcagg

SEQ ID NO: 62375 - DNA, 25 bp, Homo sapien
aggtcagtgtgaaaagcttgctatg

SEQ ID NO: 62376 - DNA, 25 bp, Homo sapien
atatagcgaaatctctccactgcct

SEQ ID NO: 62377 - DNA, 25 bp, Homo sapien
accagcatttagtgccagcctaggc

SEQ ID NO: 62378 - DNA, 25 bp, Homo sapien
ctaggcacaacttgtcctggtccaa

SEQ ID NO: 62379 - DNA, 25 bp, Homo sapien
caagtccttattctgcttgccccaa

SEQ ID NO: 62380 - DNA, 25 bp, Homo sapien
actccttttgctaccactcaaggaa

SEQ ID NO: 62381 - DNA, 25 bp, Homo sapien
tcaccagtggccttagtgcaggaaa

SEQ ID NO: 62382 - DNA, 25 bp, Homo sapien
gccttagtgcaggaaactcagccct

SEQ ID NO: 62383 - DNA, 25 bp, Homo sapien
ggtggccctgcagaacaatgcatct

SEQ ID NO: 62384 - DNA, 25 bp, Homo sapien
acaatgcatctgacatgtgcgatgc

SEQ ID NO: 62385 - DNA, 25 bp, Homo sapien
atgtgcgatgcatccccatggagag

SEQ ID NO: 62386 - DNA, 25 bp, Homo sapien
gaagtagtaccaatcaatgtcacat

SEQ ID NO: 62387 - DNA, 25 bp, Homo sapien
gtagtaccaatcaatgtcacatgaa

SEQ ID NO: 62388 - DNA, 25 bp, Homo sapien
gtcacatgaacaaacaagctgcccc

SEQ ID NO: 62389 - DNA, 25 bp, Homo sapien
aagctgcccccagggtaccatttgg

SEQ ID NO: 62390 - DNA, 25 bp, Homo sapien
atatcccaacactcagaactcttgt

SEQ ID NO: 62391 - DNA, 25 bp, Homo sapien
caacactcagaactcttgtgacatt

SEQ ID NO: 62392 - DNA, 25 bp, Homo sapien
ctcagaactcttgtgacattagcca

SEQ ID NO: 62393 - DNA, 25 bp, Homo sapien
gacagacagacttgggtctctttcc

SEQ ID NO: 62394 - DNA, 25 bp, Homo sapien
ccaacttttccacatggtcatcgtg

SEQ ID NO: 62395 - DNA, 25 bp, Homo sapien
acttttccacatggtcatcgtgaaa

SEQ ID NO: 62396 - DNA, 25 bp, Homo sapien
ttccacatggtcatcgtgaaataaa

SEQ ID NO: 62397 - DNA, 25 bp, Homo sapien
gtccaggaacaagctaattgggagt

SEQ ID NO: 62398 - DNA, 25 bp, Homo sapien
gaacaagctaattgggagtccaggc

SEQ ID NO: 62399 - DNA, 25 bp, Homo sapien
aggcacaggatgctgtgttgtcaac

SEQ ID NO: 62400 - DNA, 25 bp, Homo sapien
acaggatgctgtgttgtcaacaaac

SEQ ID NO: 62401 - DNA, 25 bp, Homo sapien
gtgttgtcaacaaaccaagcatcag

SEQ ID NO: 62402 - DNA, 25 bp, Homo sapien
gttgtcaacaaaccaagcatcaggg

SEQ ID NO: 62403 - DNA, 25 bp, Homo sapien
aagcagagagatgcggccaagatag

SEQ ID NO: 62404 - DNA, 25 bp, Homo sapien
agagatgcggccaagataggacctt

SEQ ID NO: 62405 - DNA, 25 bp, Homo sapien
agataggaccttgggccaaatccgc

SEQ ID NO: 62406 - DNA, 25 bp, Homo sapien
ttctcatgtgtttgcataaacattc

SEQ ID NO: 62407 - DNA, 25 bp, Homo sapien
ttttaacttctttctatttgacttg

SEQ ID NO: 62408 - DNA, 25 bp, Homo sapien
agggtccttagtctgtttctgacaa

SEQ ID NO: 62409 - DNA, 25 bp, Homo sapien
gttaatttcttaggacagctgtctt

SEQ ID NO: 62410 - DNA, 25 bp, Homo sapien
aggacagctgtctttggtttgcttt

SEQ ID NO: 62411 - DNA, 25 bp, Homo sapien
ttccagcaggcgtagtatatttagt

SEQ ID NO: 62412 - DNA, 25 bp, Homo sapien
tatatttagtcggagagcacatctg

SEQ ID NO: 62413 - DNA, 25 bp, Homo sapien
gagcacatctgtatgcgacaacttg

SEQ ID NO: 62414 - DNA, 25 bp, Homo sapien
tgcgacaacttgattacatcttttt

SEQ ID NO: 62415 - DNA, 25 bp, Homo sapien
tttcttttaccatgtttcagtttct

SEQ ID NO: 62416 - DNA, 25 bp, Homo sapien
cacatggaaatgctgcccaatcttc

SEQ ID NO: 62417 - DNA, 25 bp, Homo sapien
ccaatcttcaccagcttcagaaatc

SEQ ID NO: 62418 - DNA, 25 bp, Homo sapien
agaaatctgacctttgccgatgctg

SEQ ID NO: 62419 - DNA, 25 bp, Homo sapien
gagtattcagtgctctctaagtagc

SEQ ID NO: 62420 - DNA, 25 bp, Homo sapien
agtgctctctaagtagcagcccctg

SEQ ID NO: 62421 - DNA, 25 bp, Homo sapien
taccactcccctcttgcatttattt

SEQ ID NO: 62422 - DNA, 25 bp, Homo sapien
atgttttccaaatacttagagttat

SEQ ID NO: 62423 - DNA, 25 bp, Homo sapien
tagcataatttcttgataccataac

SEQ ID NO: 62424 - DNA, 25 bp, Homo sapien
tacacttttgtcttcatttacctaa

SEQ ID NO: 62425 - DNA, 25 bp, Homo sapien
atttactcttatacttttgtcgaca

SEQ ID NO: 62426 - DNA, 25 bp, Homo sapien
ttttgtcgacattcagctcatatgg

SEQ ID NO: 62427 - DNA, 25 bp, Homo sapien
atggcatctgttcttgattaaccca

SEQ ID NO: 62428 - DNA, 25 bp, Homo sapien
tgattaacccaagactttcctgata

SEQ ID NO: 62429 - DNA, 25 bp, Homo sapien
gatacatacccaagctgaacaatct

SEQ ID NO: 62430 - DNA, 25 bp, Homo sapien
atgcacgacatatacctaggacttt

SEQ ID NO: 62431 - DNA, 25 bp, Homo sapien
acctaggactttaagtgctgttcca

SEQ ID NO: 62432 - DNA, 25 bp, Homo sapien
tgttccatcatctgccttaaagctg

SEQ ID NO: 62433 - DNA, 25 bp, Homo sapien
tggccgctgcagcaaactgtcaagt

SEQ ID NO: 62434 - DNA, 25 bp, Homo sapien
tgtcaagtttccaaggtcccatctt

SEQ ID NO: 62435 - DNA, 25 bp, Homo sapien
tcatcctctgtagattcagttccaa

SEQ ID NO: 62436 - DNA, 25 bp, Homo sapien
atagcagacaacacagtagcgatgg

SEQ ID NO: 62437 - DNA, 25 bp, Homo sapien
agcgatggaggtgacgtagcttcct

SEQ ID NO: 62438 - DNA, 25 bp, Homo sapien
tagcttcctccgagtggaactgcag

SEQ ID NO: 62439 - DNA, 25 bp, Homo sapien
gggacttgattaggtgctatgcatc

SEQ ID NO: 62440 - DNA, 25 bp, Homo sapien
tggaaagcagcacatgcgtttctgt

SEQ ID NO: 62441 - DNA, 25 bp, Homo sapien
gcagaagcgttatcatactccattt

SEQ ID NO: 62442 - DNA, 25 bp, Homo sapien
gtgttacacgtgatctgcttaccaa

SEQ ID NO: 62443 - DNA, 25 bp, Homo sapien
gcggtctcaggccaattactgtgga

SEQ ID NO: 62444 - DNA, 25 bp, Homo sapien
actgtggagcagctttcattcctac

SEQ ID NO: 62445 - DNA, 25 bp, Homo sapien
aaaccttggcgctgttgtctgagat

SEQ ID NO: 62446 - DNA, 25 bp, Homo sapien
gtctgagattgctgcagccattctt

SEQ ID NO: 62447 - DNA, 25 bp, Homo sapien
accatggtacttctcaaactttgtg

SEQ ID NO: 62448 - DNA, 25 bp, Homo sapien
gtgaaaacctgcacttttccttgca

SEQ ID NO: 62449 - DNA, 25 bp, Homo sapien
ttttccttgcatgacaggttcctgt

SEQ ID NO: 62450 - DNA, 25 bp, Homo sapien
aggttcctgtcttgtctgtcatggg

SEQ ID NO: 62451 - DNA, 25 bp, Homo sapien
tcatgggagccattctgccaattta

SEQ ID NO: 62452 - DNA, 25 bp, Homo sapien
gcagaggcgcccagccttggatggg

SEQ ID NO: 62453 - DNA, 25 bp, Homo sapien
ctggcctgtacctgtttcctcattc

SEQ ID NO: 62454 - DNA, 25 bp, Homo sapien
tgtttcctcattccttggctgaggg

SEQ ID NO: 62455 - DNA, 25 bp, Homo sapien
tggagctcagccgacagttttgatg

SEQ ID NO: 62456 - DNA, 25 bp, Homo sapien
cagccgacagttttgatgagcaggg

SEQ ID NO: 62457 - DNA, 25 bp, Homo sapien
acagttttgatgagcagggaagtct

SEQ ID NO: 62458 - DNA, 25 bp, Homo sapien
gcccagcggtaagggatgtcccgca

SEQ ID NO: 62459 - DNA, 25 bp, Homo sapien
ggtaagggatgtcccgcactccctt

SEQ ID NO: 62460 - DNA, 25 bp, Homo sapien
ttagccattgccttggaccaaacca

SEQ ID NO: 62461 - DNA, 25 bp, Homo sapien
ttgccttggaccaaaccacgtggtt

SEQ ID NO: 62462 - DNA, 25 bp, Homo sapien
cagcttttctacgagccagggggga

SEQ ID NO: 62463 - DNA, 25 bp, Homo sapien
gttacaaattcccttgtcatttact

SEQ ID NO: 62464 - DNA, 25 bp, Homo sapien
attcccttgtcatttacttatttgg

SEQ ID NO: 62465 - DNA, 25 bp, Homo sapien
ggaaacatgggatttactctgacaa

SEQ ID NO: 62466 - DNA, 25 bp, Homo sapien
gatttactctgacaagctttagcct

SEQ ID NO: 62467 - DNA, 25 bp, Homo sapien
gctttagcctatgttatgggattca

SEQ ID NO: 62468 - DNA, 25 bp, Homo sapien
ataataattctcactgaccaaagct

SEQ ID NO: 62469 - DNA, 25 bp, Homo sapien
aagctgggactccatcctgccattt

SEQ ID NO: 62470 - DNA, 25 bp, Homo sapien
cctgccatttttgtgtggagatatt

SEQ ID NO: 62471 - DNA, 25 bp, Homo sapien
ggagatattcataattctgcaatac

SEQ ID NO: 62472 - DNA, 25 bp, Homo sapien
gaaaacaccccagggtaggtctgtg

SEQ ID NO: 62473 - DNA, 25 bp, Homo sapien
aggtctgtggcccttagacagtgaa

SEQ ID NO: 62474 - DNA, 25 bp, Homo sapien
gggcacagtccaggaacaagctaat

SEQ ID NO: 62475 - DNA, 25 bp, Homo sapien
gaacaagctaattgggagtccaggc

SEQ ID NO: 62476 - DNA, 25 bp, Homo sapien
aggcacaggatgctgtgttgtcaac

SEQ ID NO: 62477 - DNA, 25 bp, Homo sapien
acaggatgctgtgttgtcaacaaac

SEQ ID NO: 62478 - DNA, 25 bp, Homo sapien
gttgtcaacaaaccaagcatcaggg

SEQ ID NO: 62479 - DNA, 25 bp, Homo sapien
agagatgcggccaagataggacctt

SEQ ID NO: 62480 - DNA, 25 bp, Homo sapien
agataggaccttgggccaaatccgc

SEQ ID NO: 62481 - DNA, 25 bp, Homo sapien
gaccttgggccaaatccgctctctt

SEQ ID NO: 62482 - DNA, 25 bp, Homo sapien
ctgcacccttcttttctcatgtgtt

SEQ ID NO: 62483 - DNA, 25 bp, Homo sapien
tctcatgtgtttgcataaacattct

SEQ ID NO: 62484 - DNA, 25 bp, Homo sapien
ttttaacttctttctatttgacttg

SEQ ID NO: 62485 - DNA, 25 bp, Homo sapien
ggaggacaagaagcgcggcggcggg

SEQ ID NO: 62486 - DNA, 25 bp, Homo sapien
cctgagcaggactgcgccgtgacct

SEQ ID NO: 62487 - DNA, 25 bp, Homo sapien
aggactgcgccgtgacctccggcga

SEQ ID NO: 62488 - DNA, 25 bp, Homo sapien
tgacctccggcgaggagcttctggc

SEQ ID NO: 62489 - DNA, 25 bp, Homo sapien
cctccggcgaggagcttctggcgct

SEQ ID NO: 62490 - DNA, 25 bp, Homo sapien
ttgccgcccgagagggccgcctgcc

SEQ ID NO: 62491 - DNA, 25 bp, Homo sapien
tggccttagcgcgtcgccacagccc

SEQ ID NO: 62492 - DNA, 25 bp, Homo sapien
tcggcggccgcaggaaccacgatga

SEQ ID NO: 62493 - DNA, 25 bp, Homo sapien
gccgcaggaaccacgatgagaggca

SEQ ID NO: 62494 - DNA, 25 bp, Homo sapien
ggaaccacgatgagaggcaggagct

SEQ ID NO: 62495 - DNA, 25 bp, Homo sapien
tgaggggcttcaaccactcgccgag

SEQ ID NO: 62496 - DNA, 25 bp, Homo sapien
ggtaatttattttgtctgccacttg

SEQ ID NO: 62497 - DNA, 25 bp, Homo sapien
ttgtctgccacttgaacagtttggg

SEQ ID NO: 62498 - DNA, 25 bp, Homo sapien
atttgttcagagatttgtttcccac

SEQ ID NO: 62499 - DNA, 25 bp, Homo sapien
atttgtttcccacagttggattgtc

SEQ ID NO: 62500 - DNA, 25 bp, Homo sapien
cagttggattgtcaaaaccctattt

SEQ ID NO: 62501 - DNA, 25 bp, Homo sapien
atttccaagttcaagttaactagct

SEQ ID NO: 62502 - DNA, 25 bp, Homo sapien
aagttaactagctttgaatgtgtcc

SEQ ID NO: 62503 - DNA, 25 bp, Homo sapien
aatgtgtcccaaaacagcttcctcc

SEQ ID NO: 62504 - DNA, 25 bp, Homo sapien
cagcttcctccatttcctgaaagtt

SEQ ID NO: 62505 - DNA, 25 bp, Homo sapien
agaaatgttgtcctgggtgtgtttt

SEQ ID NO: 62506 - DNA, 25 bp, Homo sapien
cctgggtgtgttttttcaatcttct

SEQ ID NO: 62507 - DNA, 25 bp, Homo sapien
taaatgttacatgttcctaaagaac

SEQ ID NO: 62508 - DNA, 25 bp, Homo sapien
gttcctaaagaactgtggtagtgga

SEQ ID NO: 62509 - DNA, 25 bp, Homo sapien
agaactgtggtagtggagatacttt

SEQ ID NO: 62510 - DNA, 25 bp, Homo sapien
gccaaaaatgtgatagctgtccttg

SEQ ID NO: 62511 - DNA, 25 bp, Homo sapien
aatgtgatagctgtccttgaagaat

SEQ ID NO: 62512 - DNA, 25 bp, Homo sapien
accaaagtttttgatcatatgtttt

SEQ ID NO: 62513 - DNA, 25 bp, Homo sapien
gatcaagttgtatatttaagtctta

SEQ ID NO: 62514 - DNA, 25 bp, Homo sapien
attgcagttataattgttcatagga

SEQ ID NO: 62515 - DNA, 25 bp, Homo sapien
attgttcataggattgctatttaag

SEQ ID NO: 62516 - DNA, 25 bp, Homo sapien
gatgatttgaaactcaatccagatt

SEQ ID NO: 62517 - DNA, 25 bp, Homo sapien
ctcaatccagattttctttttgtat

SEQ ID NO: 62518 - DNA, 25 bp, Homo sapien
gggtaattgcattcgtctgcagtag

SEQ ID NO: 62519 - DNA, 25 bp, Homo sapien
tctgcagtagacacgagttcctcgg

SEQ ID NO: 62520 - DNA, 25 bp, Homo sapien
gagttcctcggacctgtataatctc

SEQ ID NO: 62521 - DNA, 25 bp, Homo sapien
ggacctgtataatctcccaaagcca

SEQ ID NO: 62522 - DNA, 25 bp, Homo sapien
taataatgtagtccccaaatacctg

SEQ ID NO: 62523 - DNA, 25 bp, Homo sapien
cccaaatacctgaaagctgtcttta

SEQ ID NO: 62524 - DNA, 25 bp, Homo sapien
acaggaaactggattgccaaggcat

SEQ ID NO: 62525 - DNA, 25 bp, Homo sapien
ttgccaaggcatggcagactgagct

SEQ ID NO: 62526 - DNA, 25 bp, Homo sapien
gtttgccctgaaatcagttacggac

SEQ ID NO: 62527 - DNA, 25 bp, Homo sapien
agttacggacaaaatgttggctaca

SEQ ID NO: 62528 - DNA, 25 bp, Homo sapien
aaaggagtggacatttcctaacaat

SEQ ID NO: 62529 - DNA, 25 bp, Homo sapien
ttcagacttctgaagagcagcctgt

SEQ ID NO: 62530 - DNA, 25 bp, Homo sapien
gcagcctgtggctacaaatctatgc

SEQ ID NO: 62531 - DNA, 25 bp, Homo sapien
gtattttgccataaatgcttctaag

SEQ ID NO: 62532 - DNA, 25 bp, Homo sapien
agatatatccagctgggacttctat

SEQ ID NO: 62533 - DNA, 25 bp, Homo sapien
tgggacttctattactccctttgga

SEQ ID NO: 62534 - DNA, 25 bp, Homo sapien
cttcttctgtatcccaataatccac

SEQ ID NO: 62535 - DNA, 25 bp, Homo sapien
aaactagaaatatgcaactcccttg

SEQ ID NO: 62536 - DNA, 25 bp, Homo sapien
atgcaactcccttgatttcagtgtt

SEQ ID NO: 62537 - DNA, 25 bp, Homo sapien
cttgatttcagtgtttggcaggtaa

SEQ ID NO: 62538 - DNA, 25 bp, Homo sapien
attgagacccagacactggtcaaca

SEQ ID NO: 62539 - DNA, 25 bp, Homo sapien
caggaaaacaatacagactcccaga

SEQ ID NO: 62540 - DNA, 25 bp, Homo sapien
cctggactgggctagcctgcactgc

SEQ ID NO: 62541 - DNA, 25 bp, Homo sapien
gggctagcctgcactgcctgggaaa

SEQ ID NO: 62542 - DNA, 25 bp, Homo sapien
gctagcctgcactgcctgggaaagt

SEQ ID NO: 62543 - DNA, 25 bp, Homo sapien
ctagcctgcactgcctgggaaagtc

SEQ ID NO: 62544 - DNA, 25 bp, Homo sapien
gcctgcactgcctgggaaagtcggc

SEQ ID NO: 62545 - DNA, 25 bp, Homo sapien
tgcactgcctgggaaagtcggccga

SEQ ID NO: 62546 - DNA, 25 bp, Homo sapien
tgcctgggaaagtcggccgagggcc

SEQ ID NO: 62547 - DNA, 25 bp, Homo sapien
gggcctcggtccatagagaacacca

SEQ ID NO: 62548 - DNA, 25 bp, Homo sapien
ggcctcggtccatagagaacaccac

SEQ ID NO: 62549 - DNA, 25 bp, Homo sapien
ggtccatagagaacaccaccaccat

SEQ ID NO: 62550 - DNA, 25 bp, Homo sapien
ggctcagtctgggaggtaataaaag

SEQ ID NO: 62551 - DNA, 25 bp, Homo sapien
gactttttaccctctgaattgagtg

SEQ ID NO: 62552 - DNA, 25 bp, Homo sapien
taccctctgaattgagtgcctttga

SEQ ID NO: 62553 - DNA, 25 bp, Homo sapien
gtgcctttgagtgacacatgctaat

SEQ ID NO: 62554 - DNA, 25 bp, Homo sapien
cagaggatgtaatatggagcctgat

SEQ ID NO: 62555 - DNA, 25 bp, Homo sapien
gcctgatgatgaagcattaatgtaa

SEQ ID NO: 62556 - DNA, 25 bp, Homo sapien
tgagatgtacacttgtcatgattta

SEQ ID NO: 62557 - DNA, 25 bp, Homo sapien
gatttatgtatgttgaccttttgtg

SEQ ID NO: 62558 - DNA, 25 bp, Homo sapien
gttgaccttttgtgtttattactgt

SEQ ID NO: 62559 - DNA, 25 bp, Homo sapien
aatagccatgttcattttctttcca

SEQ ID NO: 62560 - DNA, 25 bp, Homo sapien
ctttccagttagagtaagtacttct

SEQ ID NO: 62561 - DNA, 25 bp, Homo sapien
aagtacttctgtggttaatgtatat

SEQ ID NO: 62562 - DNA, 25 bp, Homo sapien
aggtatacaaaatatgctgatcttt

SEQ ID NO: 62563 - DNA, 25 bp, Homo sapien
gaatttttcttaagtcgtctcaact

SEQ ID NO: 62564 - DNA, 25 bp, Homo sapien
cgtctcaactgatttactcacttag

SEQ ID NO: 62565 - DNA, 25 bp, Homo sapien
tgatttactcacttagcttcccttc

SEQ ID NO: 62566 - DNA, 25 bp, Homo sapien
cccttccctcatcagcatagtataa

SEQ ID NO: 62567 - DNA, 25 bp, Homo sapien
ggtgttcattataatctgtattgac

SEQ ID NO: 62568 - DNA, 25 bp, Homo sapien
tcttcctcatgatgctaatagtttt

SEQ ID NO: 62569 - DNA, 25 bp, Homo sapien
gctaatagttttttgtatacatggg

SEQ ID NO: 62570 - DNA, 25 bp, Homo sapien
acatgggaggatagcacatttgaca

SEQ ID NO: 62571 - DNA, 25 bp, Homo sapien
tttatgtatgagcacagtatcctat

SEQ ID NO: 62572 - DNA, 25 bp, Homo sapien
gtatcctatgactgtgctacgtata

SEQ ID NO: 62573 - DNA, 25 bp, Homo sapien
ttttcccctgggttctgccgtcttg

SEQ ID NO: 62574 - DNA, 25 bp, Homo sapien
tgggttctgccgtcttgcctcactt

SEQ ID NO: 62575 - DNA, 25 bp, Homo sapien
tcctgtcacatgctgacgttggact

SEQ ID NO: 62576 - DNA, 25 bp, Homo sapien
gtcacatgctgacgttggacttagc

SEQ ID NO: 62577 - DNA, 25 bp, Homo sapien
gctgacgttggacttagcaggttct

SEQ ID NO: 62578 - DNA, 25 bp, Homo sapien
agcaggttctaaggccacatgtgtg

SEQ ID NO: 62579 - DNA, 25 bp, Homo sapien
ggttctaaggccacatgtgtgacct

SEQ ID NO: 62580 - DNA, 25 bp, Homo sapien
taaggccacatgtgtgacctctctg

SEQ ID NO: 62581 - DNA, 25 bp, Homo sapien
aaggcagctttccttaccctgacac

SEQ ID NO: 62582 - DNA, 25 bp, Homo sapien
gccttctggacctggaaagcctggg

SEQ ID NO: 62583 - DNA, 25 bp, Homo sapien
gaaggactgacagaccccaggacca

SEQ ID NO: 62584 - DNA, 25 bp, Homo sapien
cactatgaagataatcccattcaac

SEQ ID NO: 62585 - DNA, 25 bp, Homo sapien
gagccaaacaggctggagacgttta

SEQ ID NO: 62586 - DNA, 25 bp, Homo sapien
caggctggagacgtttaaaagaccg

SEQ ID NO: 62587 - DNA, 25 bp, Homo sapien
taatatttttcctattggacaatgg

SEQ ID NO: 62588 - DNA, 25 bp, Homo sapien
ttttcctattggacaatggacttgc

SEQ ID NO: 62589 - DNA, 25 bp, Homo sapien
ctattggacaatggacttgcaaagc

SEQ ID NO: 62590 - DNA, 25 bp, Homo sapien
ggacttgcaaagcttcacttcattt

SEQ ID NO: 62591 - DNA, 25 bp, Homo sapien
aaagaccccatgttgaaaactccat

SEQ ID NO: 62592 - DNA, 25 bp, Homo sapien
gaccccatgttgaaaactccataac

SEQ ID NO: 62593 - DNA, 25 bp, Homo sapien
aaactccataacagttttatgctga

SEQ ID NO: 62594 - DNA, 25 bp, Homo sapien
acagttttatgctgatgataattta

SEQ ID NO: 62595 - DNA, 25 bp, Homo sapien
gctttctgatttttgatagtcggtt

SEQ ID NO: 62596 - DNA, 25 bp, Homo sapien
ctgatttttgatagtcggttgaaga

SEQ ID NO: 62597 - DNA, 25 bp, Homo sapien
ccatgtcctgctgaaataccgtgat

SEQ ID NO: 62598 - DNA, 25 bp, Homo sapien
gtcctgctgaaataccgtgattggt

SEQ ID NO: 62599 - DNA, 25 bp, Homo sapien
ctttctgggttgtggatctttagac

SEQ ID NO: 62600 - DNA, 25 bp, Homo sapien
ggatctttagacaaattctcccatt

SEQ ID NO: 62601 - DNA, 25 bp, Homo sapien
tagacaaattctcccattttcattt

SEQ ID NO: 62602 - DNA, 25 bp, Homo sapien
acttcctgaaagtcatgcttgggtc

SEQ ID NO: 62603 - DNA, 25 bp, Homo sapien
atgcttgggtcatgaaaagttgttc

SEQ ID NO: 62604 - DNA, 25 bp, Homo sapien
gaaaagttgttcaaccctcactcta

SEQ ID NO: 62605 - DNA, 25 bp, Homo sapien
gaaaacttcatagggtttgataggg

SEQ ID NO: 62606 - DNA, 25 bp, Homo sapien
gtagcttttctcaaatggttctttt

SEQ ID NO: 62607 - DNA, 25 bp, Homo sapien
caggactctgttacctaagatgtga

SEQ ID NO: 62608 - DNA, 25 bp, Homo sapien
ctaagatgtgataagctgggctgca

SEQ ID NO: 62609 - DNA, 25 bp, Homo sapien
aggcggttcagcatccagcaactag

SEQ ID NO: 62610 - DNA, 25 bp, Homo sapien
taggagctgcttttctacgtacaaa

SEQ ID NO: 62611 - DNA, 25 bp, Homo sapien
aaagctgccttcaggaaggctcctt

SEQ ID NO: 62612 - DNA, 25 bp, Homo sapien
aggctccttaccctgtagcagatga

SEQ ID NO: 62613 - DNA, 25 bp, Homo sapien
gatgattttcatctggctgcctacc

SEQ ID NO: 62614 - DNA, 25 bp, Homo sapien
tgcctaccgcatgctgtactataat

SEQ ID NO: 62615 - DNA, 25 bp, Homo sapien
gatatggatttctctctgcatcgaa

SEQ ID NO: 62616 - DNA, 25 bp, Homo sapien
ctctctgcatcgaaaactgtctttt

SEQ ID NO: 62617 - DNA, 25 bp, Homo sapien
agtggtgactgccaggaacgtccta

SEQ ID NO: 62618 - DNA, 25 bp, Homo sapien
gaacgtcctatgatccactttgttg

SEQ ID NO: 62619 - DNA, 25 bp, Homo sapien
ccactttgttggttgttgttgcaga

SEQ ID NO: 62620 - DNA, 25 bp, Homo sapien
aacagtcaagtgttttccaatgtgg

SEQ ID NO: 62621 - DNA, 25 bp, Homo sapien
ttccaatgtggttgtccggtttcta

SEQ ID NO: 62622 - DNA, 25 bp, Homo sapien
ggttgtccggtttctatggccttgc

SEQ ID NO: 62623 - DNA, 25 bp, Homo sapien
tctatggccttgctgtgtactttcc

SEQ ID NO: 62624 - DNA, 25 bp, Homo sapien
tgtactttccctctttttgacagta

SEQ ID NO: 62625 - DNA, 25 bp, Homo sapien
tttgacagtaaacttctgcctatgg

SEQ ID NO: 62626 - DNA, 25 bp, Homo sapien
aatttattagcgctgctctgcaccc

SEQ ID NO: 62627 - DNA, 25 bp, Homo sapien
ggagacttcatgtggtttattgcga

SEQ ID NO: 62628 - DNA, 25 bp, Homo sapien
gggtctggcttcagctatcagggca

SEQ ID NO: 62629 - DNA, 25 bp, Homo sapien
ctggcttcagctatcagggcaccct

SEQ ID NO: 62630 - DNA, 25 bp, Homo sapien
cctccccagggattggaaacggatg

SEQ ID NO: 62631 - DNA, 25 bp, Homo sapien
gattggaaacggatgacgggcctct

SEQ ID NO: 62632 - DNA, 25 bp, Homo sapien
atgacgggcctctaggcggtcttct

SEQ ID NO: 62633 - DNA, 25 bp, Homo sapien
tctaggcggtcttctgcacgagcaa

SEQ ID NO: 62634 - DNA, 25 bp, Homo sapien
gtcttctgcacgagcaagtttctca

SEQ ID NO: 62635 - DNA, 25 bp, Homo sapien
gagcaagtttctcattactgtctgt

SEQ ID NO: 62636 - DNA, 25 bp, Homo sapien
gtttctcattactgtctgtggctaa

SEQ ID NO: 62637 - DNA, 25 bp, Homo sapien
attactgtctgtggctaagtcccct

SEQ ID NO: 62638 - DNA, 25 bp, Homo sapien
aatatattacagtcaccccataaaa

SEQ ID NO: 62639 - DNA, 25 bp, Homo sapien
aaagcccaactcccagggctctgga

SEQ ID NO: 62640 - DNA, 25 bp, Homo sapien
cagggctctggaaatggtgaggcga

SEQ ID NO: 62641 - DNA, 25 bp, Homo sapien
gggcttgagaggaacgcccacccac

SEQ ID NO: 62642 - DNA, 25 bp, Homo sapien
cagacggccccgaaaaggcgctcgg

SEQ ID NO: 62643 - DNA, 25 bp, Homo sapien
cccttggcctctaggaggaaacagt

SEQ ID NO: 62644 - DNA, 25 bp, Homo sapien
tggcctctaggaggaaacagttttt

SEQ ID NO: 62645 - DNA, 25 bp, Homo sapien
aagccagtctaaaggcctctggata

SEQ ID NO: 62646 - DNA, 25 bp, Homo sapien
agtctaaaggcctctggatactggg

SEQ ID NO: 62647 - DNA, 25 bp, Homo sapien
taaaggcctctggatactgggctcc

SEQ ID NO: 62648 - DNA, 25 bp, Homo sapien
tggatactgggctccccagaactgc

SEQ ID NO: 62649 - DNA, 25 bp, Homo sapien
tactgggctccccagaactgctggc

SEQ ID NO: 62650 - DNA, 25 bp, Homo sapien
ttgatatttctaatttggaccgact

SEQ ID NO: 62651 - DNA, 25 bp, Homo sapien
tttggaccgactaggcaaatcagag

SEQ ID NO: 62652 - DNA, 25 bp, Homo sapien
ctggtgcaactggtcatcgatggag

SEQ ID NO: 62653 - DNA, 25 bp, Homo sapien
ctggtcatcgatggagtaaactatt

SEQ ID NO: 62654 - DNA, 25 bp, Homo sapien
aactatttgattgattgtgaacggc

SEQ ID NO: 62655 - DNA, 25 bp, Homo sapien
tgattgattgtgaacggcgtctgga

SEQ ID NO: 62656 - DNA, 25 bp, Homo sapien
gagagaggccaggatatccgcatcc

SEQ ID NO: 62657 - DNA, 25 bp, Homo sapien
tgtcatccacaccaagcattaactc

SEQ ID NO: 62658 - DNA, 25 bp, Homo sapien
atcgccagctgatgactcaagattc

SEQ ID NO: 62659 - DNA, 25 bp, Homo sapien
taatgatggcccattctacttgctc

SEQ ID NO: 62660 - DNA, 25 bp, Homo sapien
atggcccattctacttgctctggac

SEQ ID NO: 62661 - DNA, 25 bp, Homo sapien
ataacagacttgtccgaagcctgct

SEQ ID NO: 62662 - DNA, 25 bp, Homo sapien
tgtccgaagcctgctggaatgtgat

SEQ ID NO: 62663 - DNA, 25 bp, Homo sapien
gaagacacagtcagcacaatcagag

SEQ ID NO: 62664 - DNA, 25 bp, Homo sapien
aaaattgggcctaacatggccagcc

SEQ ID NO: 62665 - DNA, 25 bp, Homo sapien
tgcagacagaccactgtgcccaaac

SEQ ID NO: 62666 - DNA, 25 bp, Homo sapien
acccacgagctgacttcaacaggag

SEQ ID NO: 62667 - DNA, 25 bp, Homo sapien
ggagacgcaccaatgagccgcagaa

SEQ ID NO: 62668 - DNA, 25 bp, Homo sapien
ctcctcaggaacctccgaggtgagg

SEQ ID NO: 62669 - DNA, 25 bp, Homo sapien
acatcaaacgcacatcccatgagag

SEQ ID NO: 62670 - DNA, 25 bp, Homo sapien
catcccatgagagtgcataaccagg

SEQ ID NO: 62671 - DNA, 25 bp, Homo sapien
gagaggttattcacaacctcaccaa

SEQ ID NO: 62672 - DNA, 25 bp, Homo sapien
atgtggcaggcatgtcatcgacagc

SEQ ID NO: 62673 - DNA, 25 bp, Homo sapien
atgtcatcgacagcacagaagggct

SEQ ID NO: 62674 - DNA, 25 bp, Homo sapien
cacctctgccaaggctgggtaagac

SEQ ID NO: 62675 - DNA, 25 bp, Homo sapien
gccaaggctgggtaagactcctcta

SEQ ID NO: 62676 - DNA, 25 bp, Homo sapien
tgggtaagactcctctatgttgcct

SEQ ID NO: 62677 - DNA, 25 bp, Homo sapien
aagactcctctatgttgcctgctgt

SEQ ID NO: 62678 - DNA, 25 bp, Homo sapien
ctctatgttgcctgctgtccaggag

SEQ ID NO: 62679 - DNA, 25 bp, Homo sapien
gtgggacgagtggaggccgcggcct

SEQ ID NO: 62680 - DNA, 25 bp, Homo sapien
tctgtatctccctcaataaagcctc

SEQ ID NO: 62681 - DNA, 25 bp, Homo sapien
gtatctccctcaataaagcctcctg

SEQ ID NO: 62682 - DNA, 25 bp, Homo sapien
tcctgctctgtgcaccctcaaaaaa

SEQ ID NO: 62683 - DNA, 25 bp, Homo sapien
ccccttctcaatggaatgacaacag

SEQ ID NO: 62684 - DNA, 25 bp, Homo sapien
aacagccaatatctgtgtggcgcct

SEQ ID NO: 62685 - DNA, 25 bp, Homo sapien
caatatctgtgtggcgcctctgtgt

SEQ ID NO: 62686 - DNA, 25 bp, Homo sapien
actgttctaggtgcttcgtgtgtat

SEQ ID NO: 62687 - DNA, 25 bp, Homo sapien
ctaggtgcttcgtgtgtattcagac

SEQ ID NO: 62688 - DNA, 25 bp, Homo sapien
tcgtgtgtattcagacccctttttt

SEQ ID NO: 62689 - DNA, 25 bp, Homo sapien
cagaccccttttttaggcctgtcat

SEQ ID NO: 62690 - DNA, 25 bp, Homo sapien
tgtccttcccagttgcctattatta

SEQ ID NO: 62691 - DNA, 25 bp, Homo sapien
cctattattaccctctccatgggat

SEQ ID NO: 62692 - DNA, 25 bp, Homo sapien
ctccatgggatgtcacagcatgaaa

SEQ ID NO: 62693 - DNA, 25 bp, Homo sapien
gcatgaaacaggctaaagacaggat

SEQ ID NO: 62694 - DNA, 25 bp, Homo sapien
gtgatctggcctcagacaactactg

SEQ ID NO: 62695 - DNA, 25 bp, Homo sapien
acaactactggtgagcaagctggac

SEQ ID NO: 62696 - DNA, 25 bp, Homo sapien
gtgagcaagctggacccaccatgta

SEQ ID NO: 62697 - DNA, 25 bp, Homo sapien
ggacccaccatgtacagtgtgttat

SEQ ID NO: 62698 - DNA, 25 bp, Homo sapien
gtgttatagtgttaatccttgtgca

SEQ ID NO: 62699 - DNA, 25 bp, Homo sapien
aatccttgtgcatatgtgtcataat

SEQ ID NO: 62700 - DNA, 25 bp, Homo sapien
tgtgtcataatacaactatttctgt

SEQ ID NO: 62701 - DNA, 25 bp, Homo sapien
agaaaggacactattacatatgaaa

SEQ ID NO: 62702 - DNA, 25 bp, Homo sapien
agagaaattactccagtcagaagga

SEQ ID NO: 62703 - DNA, 25 bp, Homo sapien
gtttctttacttttcaatgcacaca

SEQ ID NO: 62704 - DNA, 25 bp, Homo sapien
cacacatgctttgggatacgtttgt

SEQ ID NO: 62705 - DNA, 25 bp, Homo sapien
atgaatcttctgatgggctgggcac

SEQ ID NO: 62706 - DNA, 25 bp, Homo sapien
tgaatcttctgatgggctgggcacg

SEQ ID NO: 62707 - DNA, 25 bp, Homo sapien
gaatcttctgatgggctgggcacgg

SEQ ID NO: 62708 - DNA, 25 bp, Homo sapien
aatcttctgatgggctgggcacggt

SEQ ID NO: 62709 - DNA, 25 bp, Homo sapien
atcttctgatgggctgggcacggtg

SEQ ID NO: 62710 - DNA, 25 bp, Homo sapien
tgtggtggtgatgcgcacctgtcat

SEQ ID NO: 62711 - DNA, 25 bp, Homo sapien
gtggtggtgatgcgcacctgtcatc

SEQ ID NO: 62712 - DNA, 25 bp, Homo sapien
tggtggtgatgcgcacctgtcatcc

SEQ ID NO: 62713 - DNA, 25 bp, Homo sapien
ggtggtgatgcgcacctgtcatccc

SEQ ID NO: 62714 - DNA, 25 bp, Homo sapien
gtggtgatgcgcacctgtcatccca

SEQ ID NO: 62715 - DNA, 25 bp, Homo sapien
tggtgatgcgcacctgtcatcccag

SEQ ID NO: 62716 - DNA, 25 bp, Homo sapien
ctcagcttggccatcgtgatagctc

SEQ ID NO: 62717 - DNA, 25 bp, Homo sapien
agcttggccatcgtgatagctctca

SEQ ID NO: 62718 - DNA, 25 bp, Homo sapien
ttggccatcgtgatagctctcacgt

SEQ ID NO: 62719 - DNA, 25 bp, Homo sapien
atcgtgatagctctcacgtctggtc

SEQ ID NO: 62720 - DNA, 25 bp, Homo sapien
gtgatagctctcacgtctggtctcc

SEQ ID NO: 62721 - DNA, 25 bp, Homo sapien
atagctctcacgtctggtctcctga

SEQ ID NO: 62722 - DNA, 25 bp, Homo sapien
tcacgtctggtctcctgacaggttt

SEQ ID NO: 62723 - DNA, 25 bp, Homo sapien
acgtctggtctcctgacaggtttgc

SEQ ID NO: 62724 - DNA, 25 bp, Homo sapien
gtctggtctcctgacaggtttgctc

SEQ ID NO: 62725 - DNA, 25 bp, Homo sapien
gtctcctgacaggtttgctcctaaa

SEQ ID NO: 62726 - DNA, 25 bp, Homo sapien
ctcctgacaggtttgctcctaaatc

SEQ ID NO: 62727 - DNA, 25 bp, Homo sapien
ccatctccgtgctcttctttgacaa

SEQ ID NO: 62728 - DNA, 25 bp, Homo sapien
catctccgtgctcttctttgacaac

SEQ ID NO: 62729 - DNA, 25 bp, Homo sapien
ttctttgacaacagcgacaacgtgg

SEQ ID NO: 62730 - DNA, 25 bp, Homo sapien
tttgacaacagcgacaacgtggtgc

SEQ ID NO: 62731 - DNA, 25 bp, Homo sapien
gacaacagcgacaacgtggtgctgc

SEQ ID NO: 62732 - DNA, 25 bp, Homo sapien
acagcgacaacgtggtgctgcggca

SEQ ID NO: 62733 - DNA, 25 bp, Homo sapien
cgacaacgtggtgctgcggcagtat

SEQ ID NO: 62734 - DNA, 25 bp, Homo sapien
acaacgtggtgctgcggcagtatga

SEQ ID NO: 62735 - DNA, 25 bp, Homo sapien
tggtgctgcggcagtatgaggacat

SEQ ID NO: 62736 - DNA, 25 bp, Homo sapien
atggtggtggacgagtgcggctgcc

SEQ ID NO: 62737 - DNA, 25 bp, Homo sapien
gacgagtgcggctgccgctaacccg

SEQ ID NO: 62738 - DNA, 25 bp, Homo sapien
gaggctgagtttccatatgggcaac

SEQ ID NO: 62739 - DNA, 25 bp, Homo sapien
atatgggcaactgagcacatcctgc

SEQ ID NO: 62740 - DNA, 25 bp, Homo sapien
acctcgtgcctcagaatggacacca

SEQ ID NO: 62741 - DNA, 25 bp, Homo sapien
gaatggacaccaggctactcatctg

SEQ ID NO: 62742 - DNA, 25 bp, Homo sapien
aggctactcatctggaggtgaccaa

SEQ ID NO: 62743 - DNA, 25 bp, Homo sapien
tgaccaagcagccaaccaatcgggt

SEQ ID NO: 62744 - DNA, 25 bp, Homo sapien
ataccttgttccaggccttgtggct

SEQ ID NO: 62745 - DNA, 25 bp, Homo sapien
agtggctctgctgacacagtcggtc

SEQ ID NO: 62746 - DNA, 25 bp, Homo sapien
agtcggtccccgcagaggtcactgt

SEQ ID NO: 62747 - DNA, 25 bp, Homo sapien
aggtcactgtggcaaagcctcacaa

SEQ ID NO: 62748 - DNA, 25 bp, Homo sapien
cctctcctagttcattcacaagcat

SEQ ID NO: 62749 - DNA, 25 bp, Homo sapien
gttctaagtttctaagattctaaag

SEQ ID NO: 62750 - DNA, 25 bp, Homo sapien
agattctaaaggtccacaggtctag

SEQ ID NO: 62751 - DNA, 25 bp, Homo sapien
aaggtccacaggtctagactattag

SEQ ID NO: 62752 - DNA, 25 bp, Homo sapien
acaggtctagactattaggtgcaat

SEQ ID NO: 62753 - DNA, 25 bp, Homo sapien
gttctaaccctatactgtagtattc

SEQ ID NO: 62754 - DNA, 25 bp, Homo sapien
tactgtagtattctttggggtgccc

SEQ ID NO: 62755 - DNA, 25 bp, Homo sapien
gggatggacgatctcccacctttcg

SEQ ID NO: 62756 - DNA, 25 bp, Homo sapien
atctcccacctttcgggccatgttg

SEQ ID NO: 62757 - DNA, 25 bp, Homo sapien
tgagccaatccctcaccttctgagt

SEQ ID NO: 62758 - DNA, 25 bp, Homo sapien
caccttctgagtacagagtgtggac

SEQ ID NO: 62759 - DNA, 25 bp, Homo sapien
gagtgtggactctggtgcctccaga

SEQ ID NO: 62760 - DNA, 25 bp, Homo sapien
gctctgaggtctgtgatcgccggac

SEQ ID NO: 62761 - DNA, 25 bp, Homo sapien
tgaggtctgtgatcgccggacagtc

SEQ ID NO: 62762 - DNA, 25 bp, Homo sapien
tgatcgccggacagtccaggcctgt

SEQ ID NO: 62763 - DNA, 25 bp, Homo sapien
actcacttctgtgggctctaggact

SEQ ID NO: 62764 - DNA, 25 bp, Homo sapien
acttctgtgggctctaggactgact

SEQ ID NO: 62765 - DNA, 25 bp, Homo sapien
ggctctaggactgactgggttcttc

SEQ ID NO: 62766 - DNA, 25 bp, Homo sapien
ccgaagcccagacagttcagttggg

SEQ ID NO: 62767 - DNA, 25 bp, Homo sapien
tcagccaggcaacccgtcagtctgt

SEQ ID NO: 62768 - DNA, 25 bp, Homo sapien
aggcaacccgtcagtctgtctccat

SEQ ID NO: 62769 - DNA, 25 bp, Homo sapien
agaaatagacataactgagctgaag

SEQ ID NO: 62770 - DNA, 25 bp, Homo sapien
aactgagctgaagtaattccataaa

SEQ ID NO: 62771 - DNA, 25 bp, Homo sapien
gaacaagcaatggatctggtgaaaa

SEQ ID NO: 62772 - DNA, 25 bp, Homo sapien
gaaagaaactctttacttgaacgag

SEQ ID NO: 62773 - DNA, 25 bp, Homo sapien
ttacttgaacgagaaaatgcactgt

SEQ ID NO: 62774 - DNA, 25 bp, Homo sapien
gcactgttaaaatctctttcaagca

SEQ ID NO: 62775 - DNA, 25 bp, Homo sapien
aatgatcaattatcccaactcccaa

SEQ ID NO: 62776 - DNA, 25 bp, Homo sapien
aacaggccaatcctggtagcacttc

SEQ ID NO: 62777 - DNA, 25 bp, Homo sapien
aatcctggtagcacttctcaacagc

SEQ ID NO: 62778 - DNA, 25 bp, Homo sapien
gtagcacttctcaacagcaagcagt

SEQ ID NO: 62779 - DNA, 25 bp, Homo sapien
aagcagtgatagcacagcctccgca

SEQ ID NO: 62780 - DNA, 25 bp, Homo sapien
agcagccgaatgtctcctcagcata

SEQ ID NO: 62781 - DNA, 25 bp, Homo sapien
gaatgtctcctcagcataaagcttt

SEQ ID NO: 62782 - DNA, 25 bp, Homo sapien
tgtcagaggtatccacacttctcct

SEQ ID NO: 62783 - DNA, 25 bp, Homo sapien
gaggtatccacacttctcctttggg

SEQ ID NO: 62784 - DNA, 25 bp, Homo sapien
ttgcatttccttcttaactctctgt

SEQ ID NO: 62785 - DNA, 25 bp, Homo sapien
gcatttccttcttaactctctgtta

SEQ ID NO: 62786 - DNA, 25 bp, Homo sapien
tttccttcttaactctctgttacac

SEQ ID NO: 62787 - DNA, 25 bp, Homo sapien
cttcttaactctctgttacacgtca

SEQ ID NO: 62788 - DNA, 25 bp, Homo sapien
aactctctgttacacgtcattgaaa

SEQ ID NO: 62789 - DNA, 25 bp, Homo sapien
gttacacgtcattgaaactacactt

SEQ ID NO: 62790 - DNA, 25 bp, Homo sapien
cgtcattgaaactacacttttttgg

SEQ ID NO: 62791 - DNA, 25 bp, Homo sapien
ttggtctgtttttgtgctagactgt

SEQ ID NO: 62792 - DNA, 25 bp, Homo sapien
ctgtttttgtgctagactgtaagtt

SEQ ID NO: 62793 - DNA, 25 bp, Homo sapien
ttctctgctccttttggtgactgga

SEQ ID NO: 62794 - DNA, 25 bp, Homo sapien
ccttttggtgactggagcctttggc

SEQ ID NO: 62795 - DNA, 25 bp, Homo sapien
agcctttggctttcacctttggaga

SEQ ID NO: 62796 - DNA, 25 bp, Homo sapien
ggctttcacctttggagaagacagt

SEQ ID NO: 62797 - DNA, 25 bp, Homo sapien
gaagacagtggcgaccaagacgatt

SEQ ID NO: 62798 - DNA, 25 bp, Homo sapien
gcgaccaagacgattttctgcctta

SEQ ID NO: 62799 - DNA, 25 bp, Homo sapien
agacgattttctgccttagagcaag

SEQ ID NO: 62800 - DNA, 25 bp, Homo sapien
tagagcaagggattcaccctcgcca

SEQ ID NO: 62801 - DNA, 25 bp, Homo sapien
tcgccaggctcagacgcaagataga

SEQ ID NO: 62802 - DNA, 25 bp, Homo sapien
agccggagcagctctgacctggagc

SEQ ID NO: 62803 - DNA, 25 bp, Homo sapien
ctgaggcagccagcagatctcagca

SEQ ID NO: 62804 - DNA, 25 bp, Homo sapien
gaaataattgctctgttgaaaataa

SEQ ID NO: 62805 - DNA, 25 bp, Homo sapien
tttgtcagaaaagaaggtagctacc

SEQ ID NO: 62806 - DNA, 25 bp, Homo sapien
aaggtagctaccacatcattttgaa

SEQ ID NO: 62807 - DNA, 25 bp, Homo sapien
ggtagctaccacatcattttgaaag

SEQ ID NO: 62808 - DNA, 25 bp, Homo sapien
taccacatcattttgaaaggaccat

SEQ ID NO: 62809 - DNA, 25 bp, Homo sapien
tgaaaggaccatgagcaactataag

SEQ ID NO: 62810 - DNA, 25 bp, Homo sapien
atgagcaactataagcaaagccata

SEQ ID NO: 62811 - DNA, 25 bp, Homo sapien
gcaaagccataagaagtggtttgat

SEQ ID NO: 62812 - DNA, 25 bp, Homo sapien
gaagtggtttgatcgatatattagg

SEQ ID NO: 62813 - DNA, 25 bp, Homo sapien
gggtagctcttgattttgttaacat

SEQ ID NO: 62814 - DNA, 25 bp, Homo sapien
gatacttctatatttttatcactat

SEQ ID NO: 62815 - DNA, 25 bp, Homo sapien
gatcaattatcccaactcccaaccc

SEQ ID NO: 62816 - DNA, 25 bp, Homo sapien
caacaggccaatcctggtagcactt

SEQ ID NO: 62817 - DNA, 25 bp, Homo sapien
aggccaatcctggtagcacttctca

SEQ ID NO: 62818 - DNA, 25 bp, Homo sapien
caatcctggtagcacttctcaacag

SEQ ID NO: 62819 - DNA, 25 bp, Homo sapien
tcctggtagcacttctcaacagcaa

SEQ ID NO: 62820 - DNA, 25 bp, Homo sapien
tggtagcacttctcaacagcaagca

SEQ ID NO: 62821 - DNA, 25 bp, Homo sapien
gtagcacttctcaacagcaagcagt

SEQ ID NO: 62822 - DNA, 25 bp, Homo sapien
acttctcaacagcaagcagtgatag

SEQ ID NO: 62823 - DNA, 25 bp, Homo sapien
acagcaagcagtgatagcacagcct

SEQ ID NO: 62824 - DNA, 25 bp, Homo sapien
aagcagtgatagcacagcctccgca

SEQ ID NO: 62825 - DNA, 25 bp, Homo sapien
gcagtgatagcacagcctccgcagc

SEQ ID NO: 62826 - DNA, 25 bp, Homo sapien
gtgtcatcatccagggagcccgcgg

SEQ ID NO: 62827 - DNA, 25 bp, Homo sapien
gagacagtatcactgctgtggaagc

SEQ ID NO: 62828 - DNA, 25 bp, Homo sapien
agtatcactgctgtggaagccagag

SEQ ID NO: 62829 - DNA, 25 bp, Homo sapien
aagccagagcatttgtgcgcaagtt

SEQ ID NO: 62830 - DNA, 25 bp, Homo sapien
cagagcatttgtgcgcaagttcaaa

SEQ ID NO: 62831 - DNA, 25 bp, Homo sapien
tgtgcgcaagttcaaagtctcctac

SEQ ID NO: 62832 - DNA, 25 bp, Homo sapien
tcaaagtctcctacagcctaaacgg

SEQ ID NO: 62833 - DNA, 25 bp, Homo sapien
gtctcctacagcctaaacggcaagg

SEQ ID NO: 62834 - DNA, 25 bp, Homo sapien
ctaaacggcaaggactgggaataca

SEQ ID NO: 62835 - DNA, 25 bp, Homo sapien
ggactgggaatacattcaggacccc

SEQ ID NO: 62836 - DNA, 25 bp, Homo sapien
tgggaatacattcaggaccccagga

SEQ ID NO: 62837 - DNA, 25 bp, Homo sapien
gggcaaggaataggcccaagatcac

SEQ ID NO: 62838 - DNA, 25 bp, Homo sapien
atcacttggcaagctgggcacccag

SEQ ID NO: 62839 - DNA, 25 bp, Homo sapien
aggtgcttgacagagtcaccccatg

SEQ ID NO: 62840 - DNA, 25 bp, Homo sapien
gtcaccccatggtggtatggctgaa

SEQ ID NO: 62841 - DNA, 25 bp, Homo sapien
tatggctgaacaaggagcggcagac

SEQ ID NO: 62842 - DNA, 25 bp, Homo sapien
gaaactcaggagtgcagtaccaggg

SEQ ID NO: 62843 - DNA, 25 bp, Homo sapien
gagtgcagtaccagggacacctcag

SEQ ID NO: 62844 - DNA, 25 bp, Homo sapien
cagggacacctcaggacagattctc

SEQ ID NO: 62845 - DNA, 25 bp, Homo sapien
tgtctgcttccctggaatccaagat

SEQ ID NO: 62846 - DNA, 25 bp, Homo sapien
tgcttccctggaatccaagatgctg

SEQ ID NO: 62847 - DNA, 25 bp, Homo sapien
ggaaaattacatcctcccatggagg

SEQ ID NO: 62848 - DNA, 25 bp, Homo sapien
aagagtggtattatatggctatcct

SEQ ID NO: 62849 - DNA, 25 bp, Homo sapien
atggctatcctggtattctttcata

SEQ ID NO: 62850 - DNA, 25 bp, Homo sapien
cctggtattctttcatattgttagt

SEQ ID NO: 62851 - DNA, 25 bp, Homo sapien
gaaatttttgctgatgttcaattag

SEQ ID NO: 62852 - DNA, 25 bp, Homo sapien
gcagttgtactgtttgtatgttaaa

SEQ ID NO: 62853 - DNA, 25 bp, Homo sapien
gaagttaatgttaaagcctaatcct

SEQ ID NO: 62854 - DNA, 25 bp, Homo sapien
tttactggcaattgggtggccttgg

SEQ ID NO: 62855 - DNA, 25 bp, Homo sapien
gccttgggacctgtgtgaagagcat

SEQ ID NO: 62856 - DNA, 25 bp, Homo sapien
gagcatagactgtagtttggtggaa

SEQ ID NO: 62857 - DNA, 25 bp, Homo sapien
aagactttgaagttctcggattctg

SEQ ID NO: 62858 - DNA, 25 bp, Homo sapien
aagttctcggattctgtgtgtattc

SEQ ID NO: 62859 - DNA, 25 bp, Homo sapien
tctgttctttctggcagctatctta

SEQ ID NO: 62860 - DNA, 25 bp, Homo sapien
agctatcttaccagactgtgcctaa

SEQ ID NO: 62861 - DNA, 25 bp, Homo sapien
cttaccagactgtgcctaaagaatt

SEQ ID NO: 62862 - DNA, 25 bp, Homo sapien
gtggaatacactttgtttgcttcat

SEQ ID NO: 62863 - DNA, 25 bp, Homo sapien
gtttgcttcatgtgcagataaccaa

SEQ ID NO: 62864 - DNA, 25 bp, Homo sapien
gatatcaaacttattgatgggcaat

SEQ ID NO: 62865 - DNA, 25 bp, Homo sapien
ttaataaaccacctgaatctgtcat

SEQ ID NO: 62866 - DNA, 25 bp, Homo sapien
gaatctgtcattctagtcctataaa

SEQ ID NO: 62867 - DNA, 25 bp, Homo sapien
gatggttatatgtggtattgtttac

SEQ ID NO: 62868 - DNA, 25 bp, Homo sapien
ggtattgtttacactgttaatatcc

SEQ ID NO: 62869 - DNA, 25 bp, Homo sapien
gttaatatccacatgtaaggccatt

SEQ ID NO: 62870 - DNA, 25 bp, Homo sapien
atagtgaactttgttagagccctca

SEQ ID NO: 62871 - DNA, 25 bp, Homo sapien
ttgttagagccctcacttctatcaa

SEQ ID NO: 62872 - DNA, 25 bp, Homo sapien
cacttctatcaatcagctgtcctgt

SEQ ID NO: 62873 - DNA, 25 bp, Homo sapien
tggaaagaacccttccctgcagttt

SEQ ID NO: 62874 - DNA, 25 bp, Homo sapien
ttaaggacaaaactgcccactcctc

SEQ ID NO: 62875 - DNA, 25 bp, Homo sapien
cattaagtttgctgcctggatacac

SEQ ID NO: 62876 - DNA, 25 bp, Homo sapien
gcctggatacacttttccacaaagg

SEQ ID NO: 62877 - DNA, 25 bp, Homo sapien
ggaaaactggcatatcctgccttcc

SEQ ID NO: 62878 - DNA, 25 bp, Homo sapien
atatcctgccttccgagtagtatgg

SEQ ID NO: 62879 - DNA, 25 bp, Homo sapien
atgggtctctgtgtgagaaaccagg

SEQ ID NO: 62880 - DNA, 25 bp, Homo sapien
gaaaccaggagatattttcatcttg

SEQ ID NO: 62881 - DNA, 25 bp, Homo sapien
tgtcagtttacaccaatagtttctt

SEQ ID NO: 62882 - DNA, 25 bp, Homo sapien
ttcttgttaatccttctttcctgga

SEQ ID NO: 62883 - DNA, 25 bp, Homo sapien
tctttcctggatatataaggctggt

SEQ ID NO: 62884 - DNA, 25 bp, Homo sapien
aggctggtggtaacttttgaattat

SEQ ID NO: 62885 - DNA, 25 bp, Homo sapien
aaattggcagtgtaacatttctaga

SEQ ID NO: 62886 - DNA, 25 bp, Homo sapien
tctagatacttttcattaccttttt

SEQ ID NO: 62887 - DNA, 25 bp, Homo sapien
attctggtatataggctaaccactt

SEQ ID NO: 62888 - DNA, 25 bp, Homo sapien
ggctaaccactttaaagctattctt

SEQ ID NO: 62889 - DNA, 25 bp, Homo sapien
aaagctattcttatgctgtaacagt

SEQ ID NO: 62890 - DNA, 25 bp, Homo sapien
gcatggcttcacactgtttgtgtag

SEQ ID NO: 62891 - DNA, 25 bp, Homo sapien
gctgtatattgctcagagcttttat

SEQ ID NO: 62892 - DNA, 25 bp, Homo sapien
ttatcccatacctcctctcagtggg

SEQ ID NO: 62893 - DNA, 25 bp, Homo sapien
atacctcctctcagtgggcagtctg

SEQ ID NO: 62894 - DNA, 25 bp, Homo sapien
tctcagtgggcagtctgccaggaga

SEQ ID NO: 62895 - DNA, 25 bp, Homo sapien
gtacatagtagacatgtgtgtgtgt

SEQ ID NO: 62896 - DNA, 25 bp, Homo sapien
tgtgaatagctctctgtgtgtgggt

SEQ ID NO: 62897 - DNA, 25 bp, Homo sapien
agagagcggctggttcattgtgtgt

SEQ ID NO: 62898 - DNA, 25 bp, Homo sapien
gtgagtgttcagagagggccccttt

SEQ ID NO: 62899 - DNA, 25 bp, Homo sapien
gagtgttcagagagggcccctttaa

SEQ ID NO: 62900 - DNA, 25 bp, Homo sapien
gagagggcccctttaactcttatgt

SEQ ID NO: 62901 - DNA, 25 bp, Homo sapien
actcttatgttacttctcctggggt

SEQ ID NO: 62902 - DNA, 25 bp, Homo sapien
tctcctggggtacattttacaagaa

SEQ ID NO: 62903 - DNA, 25 bp, Homo sapien
gagcgattcaaacaaggaacctcaa

SEQ ID NO: 62904 - DNA, 25 bp, Homo sapien
ggaacctcaaagaagtgtatacaga

SEQ ID NO: 62905 - DNA, 25 bp, Homo sapien
gataaaaagtggttcactcccaggg

SEQ ID NO: 62906 - DNA, 25 bp, Homo sapien
cactcccagggaatttgaaattgaa

SEQ ID NO: 62907 - DNA, 25 bp, Homo sapien
aaattgaaggagaccgcggagcatc

SEQ ID NO: 62908 - DNA, 25 bp, Homo sapien
gaccgcggagcatccaagaactgga

SEQ ID NO: 62909 - DNA, 25 bp, Homo sapien
gaactggaagctaagtatacgctgc

SEQ ID NO: 62910 - DNA, 25 bp, Homo sapien
tatacgctgcggtggatataccctg

SEQ ID NO: 62911 - DNA, 25 bp, Homo sapien
tgcggtggatataccctgaaagtcc

SEQ ID NO: 62912 - DNA, 25 bp, Homo sapien
ggagaacaaatttctgccagaacca

SEQ ID NO: 62913 - DNA, 25 bp, Homo sapien
gccagaaccaccaagcacaagaaaa

SEQ ID NO: 62914 - DNA, 25 bp, Homo sapien
gctggtgaacgcgtgcctagcagaa

SEQ ID NO: 62915 - DNA, 25 bp, Homo sapien
tggtgaacgcgtgcctagcagaaga

SEQ ID NO: 62916 - DNA, 25 bp, Homo sapien
aacgcgtgcctagcagaagagctcc

SEQ ID NO: 62917 - DNA, 25 bp, Homo sapien
cgtgcctagcagaagagctcccgca

SEQ ID NO: 62918 - DNA, 25 bp, Homo sapien
gcctagcagaagagctcccgcacat

SEQ ID NO: 62919 - DNA, 25 bp, Homo sapien
agcagaagagctcccgcacatccat

SEQ ID NO: 62920 - DNA, 25 bp, Homo sapien
tttgaacagaaaaccctgaccccag

SEQ ID NO: 62921 - DNA, 25 bp, Homo sapien
ttgaacagaaaaccctgaccccaga

SEQ ID NO: 62922 - DNA, 25 bp, Homo sapien
gaccccagaccagtgggcacgtgag

SEQ ID NO: 62923 - DNA, 25 bp, Homo sapien
accagtgggcacgtgagcgacagaa

SEQ ID NO: 62924 - DNA, 25 bp, Homo sapien
cagtgggcacgtgagcgacagaaat

SEQ ID NO: 62925 - DNA, 25 bp, Homo sapien
gaaccagcccagcccgtctcctctt

SEQ ID NO: 62926 - DNA, 25 bp, Homo sapien
gaaaacgtcgattcgcaccgtccaa

SEQ ID NO: 62927 - DNA, 25 bp, Homo sapien
aacgtcgattcgcaccgtccaacct

SEQ ID NO: 62928 - DNA, 25 bp, Homo sapien
acgtcgattcgcaccgtccaacctg

SEQ ID NO: 62929 - DNA, 25 bp, Homo sapien
cgtcgattcgcaccgtccaacctgc

SEQ ID NO: 62930 - DNA, 25 bp, Homo sapien
gattcgcaccgtccaacctgccccg

SEQ ID NO: 62931 - DNA, 25 bp, Homo sapien
tcctacagctgtaactcccctcctg

SEQ ID NO: 62932 - DNA, 25 bp, Homo sapien
cctacagctgtaactcccctcctgt

SEQ ID NO: 62933 - DNA, 25 bp, Homo sapien
ctacagctgtaactcccctcctgtc

SEQ ID NO: 62934 - DNA, 25 bp, Homo sapien
tacagctgtaactcccctcctgtcc

SEQ ID NO: 62935 - DNA, 25 bp, Homo sapien
acagctgtaactcccctcctgtcct

SEQ ID NO: 62936 - DNA, 25 bp, Homo sapien
gtgacacatcattataatatccagt

SEQ ID NO: 62937 - DNA, 25 bp, Homo sapien
aatatccagtagctaacattagatc

SEQ ID NO: 62938 - DNA, 25 bp, Homo sapien
acattagatctagcttattatttca

SEQ ID NO: 62939 - DNA, 25 bp, Homo sapien
aaaacatgttggctacagtagcact

SEQ ID NO: 62940 - DNA, 25 bp, Homo sapien
ttttttggtatctctagcctagaat

SEQ ID NO: 62941 - DNA, 25 bp, Homo sapien
tctctagcctagaatctcgtgtgtt

SEQ ID NO: 62942 - DNA, 25 bp, Homo sapien
tagcctagaatctcgtgtgttagtt

SEQ ID NO: 62943 - DNA, 25 bp, Homo sapien
tagaatctcgtgtgttagttttaac

SEQ ID NO: 62944 - DNA, 25 bp, Homo sapien
tctcgtgtgttagttttaactgttt

SEQ ID NO: 62945 - DNA, 25 bp, Homo sapien
gatatttggatcataaccgtaacat

SEQ ID NO: 62946 - DNA, 25 bp, Homo sapien
gtaaattcctgaatgtaccattaaa

SEQ ID NO: 62947 - DNA, 25 bp, Homo sapien
gtatgatgggacattatggacacac

SEQ ID NO: 62948 - DNA, 25 bp, Homo sapien
atggacacactaacagcactcttta

SEQ ID NO: 62949 - DNA, 25 bp, Homo sapien
gcactctttatgttggctgaaaatg

SEQ ID NO: 62950 - DNA, 25 bp, Homo sapien
ggctgaaaatggcactgaaactgat

SEQ ID NO: 62951 - DNA, 25 bp, Homo sapien
gaatgcaagacccaaagtttatact

SEQ ID NO: 62952 - DNA, 25 bp, Homo sapien
cattgcagctatttgtaaggacagt

SEQ ID NO: 62953 - DNA, 25 bp, Homo sapien
gagaaagcctatattcccaggctga

SEQ ID NO: 62954 - DNA, 25 bp, Homo sapien
ttcccaggctgaatgttctacacat

SEQ ID NO: 62955 - DNA, 25 bp, Homo sapien
atgttctacacatttaccactgtat

SEQ ID NO: 62956 - DNA, 25 bp, Homo sapien
atgcacatagggacagtgtaacctg

SEQ ID NO: 62957 - DNA, 25 bp, Homo sapien
gtgtaacctgtctataccaccgtag

SEQ ID NO: 62958 - DNA, 25 bp, Homo sapien
gatagtaacaagactggctggctga

SEQ ID NO: 62959 - DNA, 25 bp, Homo sapien
tggctggctgatgagcaaagccttt

SEQ ID NO: 62960 - DNA, 25 bp, Homo sapien
aagcctttgctctcacgcagaggaa

SEQ ID NO: 62961 - DNA, 25 bp, Homo sapien
tctcacgcagaggaaggcttggatg

SEQ ID NO: 62962 - DNA, 25 bp, Homo sapien
aatgaaactgcctggaactaaaagc

SEQ ID NO: 62963 - DNA, 25 bp, Homo sapien
aagcaagggaggcaatcacactgaa

SEQ ID NO: 62964 - DNA, 25 bp, Homo sapien
aatcacactgaagcgggtcttcctc

SEQ ID NO: 62965 - DNA, 25 bp, Homo sapien
gtcccacaggcgtgttgttttaaat

SEQ ID NO: 62966 - DNA, 25 bp, Homo sapien
cctgatgctgtgtgcatgatgctgg

SEQ ID NO: 62967 - DNA, 25 bp, Homo sapien
catgatgctggtgcttgaccatgaa

SEQ ID NO: 62968 - DNA, 25 bp, Homo sapien
gtgttgtacttcacaatcctggact

SEQ ID NO: 62969 - DNA, 25 bp, Homo sapien
gacctcactttattacaagatcttt

SEQ ID NO: 62970 - DNA, 25 bp, Homo sapien
tttccaaatacccaaatatccctgc

SEQ ID NO: 62971 - DNA, 25 bp, Homo sapien
atatccctgcaagcccgttaaataa

SEQ ID NO: 62972 - DNA, 25 bp, Homo sapien
taattccctatgctacccttaataa

SEQ ID NO: 62973 - DNA, 25 bp, Homo sapien
tagtgtgagaacttccaacaagcct

SEQ ID NO: 62974 - DNA, 25 bp, Homo sapien
aagcctcaaagtcccttgagactcc

SEQ ID NO: 62975 - DNA, 25 bp, Homo sapien
tgagactccccaatacctaataagg

SEQ ID NO: 62976 - DNA, 25 bp, Homo sapien
aaatgttctcatgaactaccccaca

SEQ ID NO: 62977 - DNA, 25 bp, Homo sapien
aaaatatctcctccaatgtcctgag

SEQ ID NO: 62978 - DNA, 25 bp, Homo sapien
tgtcctgagacatgaacccaaaaag

SEQ ID NO: 62979 - DNA, 25 bp, Homo sapien
tttataatagtaagcccctgtgacc

SEQ ID NO: 62980 - DNA, 25 bp, Homo sapien
tgagtaccaggtgctggccagcctg

SEQ ID NO: 62981 - DNA, 25 bp, Homo sapien
aggacgagggctacttccaggagct

SEQ ID NO: 62982 - DNA, 25 bp, Homo sapien
gacgagggctacttccaggagctgc

SEQ ID NO: 62983 - DNA, 25 bp, Homo sapien
tgggctctgtcaacagcttgctgaa

SEQ ID NO: 62984 - DNA, 25 bp, Homo sapien
aaggagctgagatgaggccccacac

SEQ ID NO: 62985 - DNA, 25 bp, Homo sapien
gactggactgggatgccgctagtga

SEQ ID NO: 62986 - DNA, 25 bp, Homo sapien
gcgtgggtgggcttctcaggcagga

SEQ ID NO: 62987 - DNA, 25 bp, Homo sapien
tcaggcaggaggacatcttggcagt

SEQ ID NO: 62988 - DNA, 25 bp, Homo sapien
gacatcttggcagtgctggcttggc

SEQ ID NO: 62989 - DNA, 25 bp, Homo sapien
ggcagtgctggcttggccattaaat

SEQ ID NO: 62990 - DNA, 25 bp, Homo sapien
ggcttggccattaaatggaaacctg

SEQ ID NO: 62991 - DNA, 25 bp, Homo sapien
aggacgagggctacttccaggagct

SEQ ID NO: 62992 - DNA, 25 bp, Homo sapien
gacgagggctacttccaggagctgc

SEQ ID NO: 62993 - DNA, 25 bp, Homo sapien
tgggctctgtcaacagcttgctgaa

SEQ ID NO: 62994 - DNA, 25 bp, Homo sapien
gactggactgggatgccgctagtga

SEQ ID NO: 62995 - DNA, 25 bp, Homo sapien
actgggatgccgctagtgaggctga

SEQ ID NO: 62996 - DNA, 25 bp, Homo sapien
gcgtgggtgggcttctcaggcagga

SEQ ID NO: 62997 - DNA, 25 bp, Homo sapien
tcaggcaggaggacatcttggcagt

SEQ ID NO: 62998 - DNA, 25 bp, Homo sapien
gacatcttggcagtgctggcttggc

SEQ ID NO: 62999 - DNA, 25 bp, Homo sapien
ggcagtgctggcttggccattaaat

SEQ ID NO: 63000 - DNA, 25 bp, Homo sapien
tgctggcttggccattaaatggaaa

SEQ ID NO: 63001 - DNA, 25 bp, Homo sapien
gccattaaatggaaacctgaaggcc

SEQ ID NO: 63002 - DNA, 25 bp, Homo sapien
tggaagaaccactgactgtgtggat

SEQ ID NO: 63003 - DNA, 25 bp, Homo sapien
ggaagaaccactgactgtgtggatg

SEQ ID NO: 63004 - DNA, 25 bp, Homo sapien
gaagaaccactgactgtgtggatgg

SEQ ID NO: 63005 - DNA, 25 bp, Homo sapien
tgtgtggatggccagcttttcccct

SEQ ID NO: 63006 - DNA, 25 bp, Homo sapien
gtgtggatggccagcttttcccctg

SEQ ID NO: 63007 - DNA, 25 bp, Homo sapien
tgtggatggccagcttttcccctgt

SEQ ID NO: 63008 - DNA, 25 bp, Homo sapien
gtggatggccagcttttcccctgtc

SEQ ID NO: 63009 - DNA, 25 bp, Homo sapien
tggatggccagcttttcccctgtct

SEQ ID NO: 63010 - DNA, 25 bp, Homo sapien
ggatggccagcttttcccctgtctc

SEQ ID NO: 63011 - DNA, 25 bp, Homo sapien
caattaattgtggatttgatcagat

SEQ ID NO: 63012 - DNA, 25 bp, Homo sapien
gatcagattgaattcgttttgtttc

SEQ ID NO: 63013 - DNA, 25 bp, Homo sapien
attcgttttgtttcagattcctatt

SEQ ID NO: 63014 - DNA, 25 bp, Homo sapien
ttttgtttcagattcctatttaaat

SEQ ID NO: 63015 - DNA, 25 bp, Homo sapien
aatatttcacttgtactgttgctga

SEQ ID NO: 63016 - DNA, 25 bp, Homo sapien
acttgtactgttgctgatttttgca

SEQ ID NO: 63017 - DNA, 25 bp, Homo sapien
cttgaagagcaagagtctgtacatt

SEQ ID NO: 63018 - DNA, 25 bp, Homo sapien
gcaagagtctgtacattattaagct

SEQ ID NO: 63019 - DNA, 25 bp, Homo sapien
gagtctgtacattattaagcttaga

SEQ ID NO: 63020 - DNA, 25 bp, Homo sapien
caaaactgatttactggtttgcctt

SEQ ID NO: 63021 - DNA, 25 bp, Homo sapien
gtattgtcaagtactgtacaatgaa

SEQ ID NO: 63022 - DNA, 25 bp, Homo sapien
aggacaaggtaaactctgacatgca

SEQ ID NO: 63023 - DNA, 25 bp, Homo sapien
aactctgacatgcactaggtatgtg

SEQ ID NO: 63024 - DNA, 25 bp, Homo sapien
tcatgcaagtcatccccgacatgac

SEQ ID NO: 63025 - DNA, 25 bp, Homo sapien
gaaagtcacagcactgatgaggaca

SEQ ID NO: 63026 - DNA, 25 bp, Homo sapien
agcactgatgaggacagctgcagag

SEQ ID NO: 63027 - DNA, 25 bp, Homo sapien
tgtgtggacacaggaagtttgggcc

SEQ ID NO: 63028 - DNA, 25 bp, Homo sapien
tgccccagctttcctaggccagaat

SEQ ID NO: 63029 - DNA, 25 bp, Homo sapien
ccagctttcctaggccagaattgtg

SEQ ID NO: 63030 - DNA, 25 bp, Homo sapien
gctttcctaggccagaattgtgttt

SEQ ID NO: 63031 - DNA, 25 bp, Homo sapien
gccagaattgtgtttggcagtaatt

SEQ ID NO: 63032 - DNA, 25 bp, Homo sapien
gtgtttggcagtaattgtctgttta

SEQ ID NO: 63033 - DNA, 25 bp, Homo sapien
gcccttccctggtgggctattgaag

SEQ ID NO: 63034 - DNA, 25 bp, Homo sapien
tccctggtgggctattgaagataca

SEQ ID NO: 63035 - DNA, 25 bp, Homo sapien
gagggactgtattttctgtggaaaa

SEQ ID NO: 63036 - DNA, 25 bp, Homo sapien
gcataatactaatttattgccgtcc

SEQ ID NO: 63037 - DNA, 25 bp, Homo sapien
ccgtccggactctgtgtgtatatgt

SEQ ID NO: 63038 - DNA, 25 bp, Homo sapien
gtattgacagcttctgtcagcagct

SEQ ID NO: 63039 - DNA, 25 bp, Homo sapien
aatcatgattgttcaaagctgctgg

SEQ ID NO: 63040 - DNA, 25 bp, Homo sapien
caaagctgctgggacgttagaatta

SEQ ID NO: 63041 - DNA, 25 bp, Homo sapien
gggacgttagaattaggccatgata

SEQ ID NO: 63042 - DNA, 25 bp, Homo sapien
ttaggccatgatactggtctcattt

SEQ ID NO: 63043 - DNA, 25 bp, Homo sapien
ggtctcatttaactacagtggtatt

SEQ ID NO: 63044 - DNA, 25 bp, Homo sapien
tatatgtgcaatttttcaacaaatg

SEQ ID NO: 63045 - DNA, 25 bp, Homo sapien
tgttcaaagctgctgggacgttaga

SEQ ID NO: 63046 - DNA, 25 bp, Homo sapien
ttcaaagctgctgggacgttagaat

SEQ ID NO: 63047 - DNA, 25 bp, Homo sapien
caaagctgctgggacgttagaatta

SEQ ID NO: 63048 - DNA, 25 bp, Homo sapien
agctgctgggacgttagaattaggc

SEQ ID NO: 63049 - DNA, 25 bp, Homo sapien
tgctgggacgttagaattaggccat

SEQ ID NO: 63050 - DNA, 25 bp, Homo sapien
gggacgttagaattaggccatgata

SEQ ID NO: 63051 - DNA, 25 bp, Homo sapien
gacgttagaattaggccatgatact

SEQ ID NO: 63052 - DNA, 25 bp, Homo sapien
gaattaggccatgatactggtctca

SEQ ID NO: 63053 - DNA, 25 bp, Homo sapien
attaggccatgatactggtctcatt

SEQ ID NO: 63054 - DNA, 25 bp, Homo sapien
ttaggccatgatactggtctcattt

SEQ ID NO: 63055 - DNA, 25 bp, Homo sapien
cagaggcctgggtgatgttaaagtc

SEQ ID NO: 63056 - DNA, 25 bp, Homo sapien
gatgttaaagtctatcctgtcccac

SEQ ID NO: 63057 - DNA, 25 bp, Homo sapien
acttcctacattctgggactaccgt

SEQ ID NO: 63058 - DNA, 25 bp, Homo sapien
tgggactaccgtgaagcctggagta

SEQ ID NO: 63059 - DNA, 25 bp, Homo sapien
caaactgtgtttcttagagccataa

SEQ ID NO: 63060 - DNA, 25 bp, Homo sapien
gtttcttagagccataagccccaca

SEQ ID NO: 63061 - DNA, 25 bp, Homo sapien
ataagccccacatattatccctgaa

SEQ ID NO: 63062 - DNA, 25 bp, Homo sapien
ttatccctgaacaagggcagctcct

SEQ ID NO: 63063 - DNA, 25 bp, Homo sapien
gggcagctcctgctttatatatttg

SEQ ID NO: 63064 - DNA, 25 bp, Homo sapien
gggttccatgagagattttgggttt

SEQ ID NO: 63065 - DNA, 25 bp, Homo sapien
aaatgctttggaaaccagaggcctg

SEQ ID NO: 63066 - DNA, 25 bp, Homo sapien
aaatgtatgcatgttgtctaagaaa

SEQ ID NO: 63067 - DNA, 25 bp, Homo sapien
ttgaatacttgaatgtgtctcacag

SEQ ID NO: 63068 - DNA, 25 bp, Homo sapien
gtgtctcacagtttgaaataagcta

SEQ ID NO: 63069 - DNA, 25 bp, Homo sapien
tgtaatacttcttgtgtgtatgcac

SEQ ID NO: 63070 - DNA, 25 bp, Homo sapien
gtgtatgcacatgaaacttagattt

SEQ ID NO: 63071 - DNA, 25 bp, Homo sapien
ttttcagtattatatgtaccctctg

SEQ ID NO: 63072 - DNA, 25 bp, Homo sapien
atgtaccctctgaaatacataggga

SEQ ID NO: 63073 - DNA, 25 bp, Homo sapien
acatagggatatgcgtattatacca

SEQ ID NO: 63074 - DNA, 25 bp, Homo sapien
aatgggcacttaaagctttcagaat

SEQ ID NO: 63075 - DNA, 25 bp, Homo sapien
gtcagtgctgatgtagcatgcttgt

SEQ ID NO: 63076 - DNA, 25 bp, Homo sapien
gcatgcttgttgcaattgccttttt

SEQ ID NO: 63077 - DNA, 25 bp, Homo sapien
ggcgattactaccaacgtcactatg

SEQ ID NO: 63078 - DNA, 25 bp, Homo sapien
atgaagactctgcaattggtccccg

SEQ ID NO: 63079 - DNA, 25 bp, Homo sapien
agcccctacggctttaggcatggag

SEQ ID NO: 63080 - DNA, 25 bp, Homo sapien
atggagccagcgtcaactacgatga

SEQ ID NO: 63081 - DNA, 25 bp, Homo sapien
atgactactaaccatgacttgccac

SEQ ID NO: 63082 - DNA, 25 bp, Homo sapien
atgacttgccacacgctgtacaaga

SEQ ID NO: 63083 - DNA, 25 bp, Homo sapien
gcaaatagcgattctcttcatgtat

SEQ ID NO: 63084 - DNA, 25 bp, Homo sapien
cttcatgtatctcctaatgccttac

SEQ ID NO: 63085 - DNA, 25 bp, Homo sapien
aatgccttacactacttggtttctg

SEQ ID NO: 63086 - DNA, 25 bp, Homo sapien
cttggtttctgatttgctctatttc

SEQ ID NO: 63087 - DNA, 25 bp, Homo sapien
tttcagcagatctttctacctactt

SEQ ID NO: 63088 - DNA, 25 bp, Homo sapien
aaacatgtttcttcaaattgcataa

SEQ ID NO: 63089 - DNA, 25 bp, Homo sapien
caaatggcaatgtgagtaggttaca

SEQ ID NO: 63090 - DNA, 25 bp, Homo sapien
tttctgttgttataatgcgtaaaga

SEQ ID NO: 63091 - DNA, 25 bp, Homo sapien
taaaagcatcttaggttataccatc

SEQ ID NO: 63092 - DNA, 25 bp, Homo sapien
ggttataccatctttatatgctatt

SEQ ID NO: 63093 - DNA, 25 bp, Homo sapien
atgctattgcgtttcaatatttaag

SEQ ID NO: 63094 - DNA, 25 bp, Homo sapien
aagtgattttttggtcacagtgttt

SEQ ID NO: 63095 - DNA, 25 bp, Homo sapien
tggtcacagtgttttgttgataaaa

SEQ ID NO: 63096 - DNA, 25 bp, Homo sapien
gaagtttgaattctaagacttgaaa

SEQ ID NO: 63097 - DNA, 25 bp, Homo sapien
tgaagccaactttgtcccagcacat

SEQ ID NO: 63098 - DNA, 25 bp, Homo sapien
ctttgtcccagcacattccttaagt

SEQ ID NO: 63099 - DNA, 25 bp, Homo sapien
aagggcttcttttccgcaaatgcca

SEQ ID NO: 63100 - DNA, 25 bp, Homo sapien
gtcagcaatgctattatctctaatt

SEQ ID NO: 63101 - DNA, 25 bp, Homo sapien
tattatctctaattagtgccaccag

SEQ ID NO: 63102 - DNA, 25 bp, Homo sapien
tagtgccaccagactagacctgtat

SEQ ID NO: 63103 - DNA, 25 bp, Homo sapien
gactagacctgtatcattcatggta

SEQ ID NO: 63104 - DNA, 25 bp, Homo sapien
actcttgcaacataactaccatctc

SEQ ID NO: 63105 - DNA, 25 bp, Homo sapien
aactaccatctctctcttaaaacga

SEQ ID NO: 63106 - DNA, 25 bp, Homo sapien
gaagctttattgtctagttgttttt

SEQ ID NO: 63107 - DNA, 25 bp, Homo sapien
tataccctttttggcctgaagacat

SEQ ID NO: 63108 - DNA, 25 bp, Homo sapien
tagaatttcctaacagagtttactg

SEQ ID NO: 63109 - DNA, 25 bp, Homo sapien
gtttagaaatttgcaagggcttctt

SEQ ID NO: 63110 - DNA, 25 bp, Homo sapien
cagccaacaggtaataccttttcat

SEQ ID NO: 63111 - DNA, 25 bp, Homo sapien
taataccttttcatcctctttaaga

SEQ ID NO: 63112 - DNA, 25 bp, Homo sapien
ccttttcatcctctttaagaaacag

SEQ ID NO: 63113 - DNA, 25 bp, Homo sapien
cttttcatcctctttaagaaacaga

SEQ ID NO: 63114 - DNA, 25 bp, Homo sapien
ttttcatcctctttaagaaacagat

SEQ ID NO: 63115 - DNA, 25 bp, Homo sapien
tttcatcctctttaagaaacagatt

SEQ ID NO: 63116 - DNA, 25 bp, Homo sapien
ttaagaaacagatttggaggccagg

SEQ ID NO: 63117 - DNA, 25 bp, Homo sapien
taagaaacagatttggaggccaggc

SEQ ID NO: 63118 - DNA, 25 bp, Homo sapien
aagaaacagatttggaggccaggcg

SEQ ID NO: 63119 - DNA, 25 bp, Homo sapien
tcggaggcctcgtcatcgccgggat

SEQ ID NO: 63120 - DNA, 25 bp, Homo sapien
gggatcctcttcatcctgggcatcc

SEQ ID NO: 63121 - DNA, 25 bp, Homo sapien
ggcatcctcatcgtgctgagcagaa

SEQ ID NO: 63122 - DNA, 25 bp, Homo sapien
gaagatgccggtgcaagttcaacca

SEQ ID NO: 63123 - DNA, 25 bp, Homo sapien
tgccggtgcaagttcaaccagcagc

SEQ ID NO: 63124 - DNA, 25 bp, Homo sapien
aagaggagggaactttccgcagctc

SEQ ID NO: 63125 - DNA, 25 bp, Homo sapien
ggagggaactttccgcagctccatc

SEQ ID NO: 63126 - DNA, 25 bp, Homo sapien
tgtccacccgcaggcggtagaaaca

SEQ ID NO: 63127 - DNA, 25 bp, Homo sapien
gtagaaacacctggagcgatggaat

SEQ ID NO: 63128 - DNA, 25 bp, Homo sapien
cacctggagcgatggaatccggcca

SEQ ID NO: 63129 - DNA, 25 bp, Homo sapien
atggaatccggccaggactcccctg

SEQ ID NO: 63130 - DNA, 25 bp, Homo sapien
gggcagcgacaacaccgacactgag

SEQ ID NO: 63131 - DNA, 25 bp, Homo sapien
gcgacaacaccgacactgagggctc

SEQ ID NO: 63132 - DNA, 25 bp, Homo sapien
gagccgtcgctgacttggcctggaa

SEQ ID NO: 63133 - DNA, 25 bp, Homo sapien
tgacttggcctggaacgaggaatct

SEQ ID NO: 63134 - DNA, 25 bp, Homo sapien
gggccgtttgttaagcggcactcat

SEQ ID NO: 63135 - DNA, 25 bp, Homo sapien
taagcggcactcattttgcggaggc

SEQ ID NO: 63136 - DNA, 25 bp, Homo sapien
actcattttgcggaggccatgcggg

SEQ ID NO: 63137 - DNA, 25 bp, Homo sapien
acgccatctgtgtaacttcaggatc

SEQ ID NO: 63138 - DNA, 25 bp, Homo sapien
gtgtaacttcaggatctgttctgtt

SEQ ID NO: 63139 - DNA, 25 bp, Homo sapien
ggatctgttctgtttcaccatgtaa

SEQ ID NO: 63140 - DNA, 25 bp, Homo sapien
gttctgtttcaccatgtaacacaca

SEQ ID NO: 63141 - DNA, 25 bp, Homo sapien
atatatgcaatgtggccagtaagag

SEQ ID NO: 63142 - DNA, 25 bp, Homo sapien
cactgaggcgtgtctggatgcttta

SEQ ID NO: 63143 - DNA, 25 bp, Homo sapien
aagggaactccactcaattgctgat

SEQ ID NO: 63144 - DNA, 25 bp, Homo sapien
ctcaattgctgataaccgatgtttt

SEQ ID NO: 63145 - DNA, 25 bp, Homo sapien
aaagactgcatgacgtttacctatc

SEQ ID NO: 63146 - DNA, 25 bp, Homo sapien
gacgtttacctatcaattgctttga

SEQ ID NO: 63147 - DNA, 25 bp, Homo sapien
gctttgatttctctgcctgtaagat

SEQ ID NO: 63148 - DNA, 25 bp, Homo sapien
caaatatacctagaagtgctgctta

SEQ ID NO: 63149 - DNA, 25 bp, Homo sapien
gtgctgcttagaatgccttacttga

SEQ ID NO: 63150 - DNA, 25 bp, Homo sapien
gaatgccttacttgatacctggtag

SEQ ID NO: 63151 - DNA, 25 bp, Homo sapien
agagatgtgtagcagccgcatgtct

SEQ ID NO: 63152 - DNA, 25 bp, Homo sapien
aagaccccaccgagcatgcgactga

SEQ ID NO: 63153 - DNA, 25 bp, Homo sapien
atgcgactgaaactcattgccagca

SEQ ID NO: 63154 - DNA, 25 bp, Homo sapien
attgccagcaacagcaccatggagc

SEQ ID NO: 63155 - DNA, 25 bp, Homo sapien
atggagcgcaagttcagcccctgga

SEQ ID NO: 63156 - DNA, 25 bp, Homo sapien
tcactgggcactttccagcagatgt

SEQ ID NO: 63157 - DNA, 25 bp, Homo sapien
gtggatctccaagcaggaatatgag

SEQ ID NO: 63158 - DNA, 25 bp, Homo sapien
tgcgtggagcgaaagtgcccctgat

SEQ ID NO: 63159 - DNA, 25 bp, Homo sapien
cgaaagtgcccctgatggcactcct

SEQ ID NO: 63160 - DNA, 25 bp, Homo sapien
tcccaagctcagatggaagtccctt

SEQ ID NO: 63161 - DNA, 25 bp, Homo sapien
agctcagatggaagtcccttaaccc

SEQ ID NO: 63162 - DNA, 25 bp, Homo sapien
tttccctcttgtcctcataaatggt

SEQ ID NO: 63163 - DNA, 25 bp, Homo sapien
aaacattttgtgacttcttaaagag

SEQ ID NO: 63164 - DNA, 25 bp, Homo sapien
tgcactgttaaaaatgctgtttaag

SEQ ID NO: 63165 - DNA, 25 bp, Homo sapien
ttgaattcaggtattgccagcccac

SEQ ID NO: 63166 - DNA, 25 bp, Homo sapien
ctcactttttcagacctatagttgt

SEQ ID NO: 63167 - DNA, 25 bp, Homo sapien
atagttgtcctttttgattctccag

SEQ ID NO: 63168 - DNA, 25 bp, Homo sapien
tgtcctttttgattctccagttaaa

SEQ ID NO: 63169 - DNA, 25 bp, Homo sapien
ttttctttgcttgggagaagaatct

SEQ ID NO: 63170 - DNA, 25 bp, Homo sapien
aagaatctagaatccttgaagcagg

SEQ ID NO: 63171 - DNA, 25 bp, Homo sapien
agcagggattgggaaacttgattct

SEQ ID NO: 63172 - DNA, 25 bp, Homo sapien
aacttgattctgatgccacacataa

SEQ ID NO: 63173 - DNA, 25 bp, Homo sapien
gattctgatgccacacataataaat

SEQ ID NO: 63174 - DNA, 25 bp, Homo sapien
ttttagacacgctttcttgtagtgc

SEQ ID NO: 63175 - DNA, 25 bp, Homo sapien
cgctttcttgtagtgcttctgcaaa

SEQ ID NO: 63176 - DNA, 25 bp, Homo sapien
aaagggacttattttgcattctcaa

SEQ ID NO: 63177 - DNA, 25 bp, Homo sapien
cagatttctaggttgggtaggccac

SEQ ID NO: 63178 - DNA, 25 bp, Homo sapien
ggtaggccactgcattctcttttgt

SEQ ID NO: 63179 - DNA, 25 bp, Homo sapien
gaaaatcataattgccgtctggacc

SEQ ID NO: 63180 - DNA, 25 bp, Homo sapien
aattgccgtctggaccattgattga

SEQ ID NO: 63181 - DNA, 25 bp, Homo sapien
gaccattgattgattgtgaccagta

SEQ ID NO: 63182 - DNA, 25 bp, Homo sapien
tgaccagtagcagaagggtgcctgt

SEQ ID NO: 63183 - DNA, 25 bp, Homo sapien
gtgcctgttacatagagaggctcct

SEQ ID NO: 63184 - DNA, 25 bp, Homo sapien
agaggctccttctgtccaaatgaat

SEQ ID NO: 63185 - DNA, 25 bp, Homo sapien
aagaccccaccgagcatgcgactga

SEQ ID NO: 63186 - DNA, 25 bp, Homo sapien
accgagcatgcgactgaaactcatt

SEQ ID NO: 63187 - DNA, 25 bp, Homo sapien
agcatgcgactgaaactcattgcca

SEQ ID NO: 63188 - DNA, 25 bp, Homo sapien
tgcgactgaaactcattgccagcaa

SEQ ID NO: 63189 - DNA, 25 bp, Homo sapien
gactgaaactcattgccagcaacag

SEQ ID NO: 63190 - DNA, 25 bp, Homo sapien
gaaactcattgccagcaacagcacc

SEQ ID NO: 63191 - DNA, 25 bp, Homo sapien
tcattgccagcaacagcaccatgga

SEQ ID NO: 63192 - DNA, 25 bp, Homo sapien
attgccagcaacagcaccatggagc

SEQ ID NO: 63193 - DNA, 25 bp, Homo sapien
tgccagcaacagcaccatggagcgc

SEQ ID NO: 63194 - DNA, 25 bp, Homo sapien
atggagcgcaagttcagcccctgga

SEQ ID NO: 63195 - DNA, 25 bp, Homo sapien
gagcgcaagttcagcccctggatcg

SEQ ID NO: 63196 - DNA, 25 bp, Homo sapien
atcccctgatggctgggacctttgt

SEQ ID NO: 63197 - DNA, 25 bp, Homo sapien
gctgctcttctactggaatgcaaag

SEQ ID NO: 63198 - DNA, 25 bp, Homo sapien
cttctactggaatgcaaagcctccc

SEQ ID NO: 63199 - DNA, 25 bp, Homo sapien
tccccacaagcagaaaaaggcgcag

SEQ ID NO: 63200 - DNA, 25 bp, Homo sapien
aaaaggcgcagtagagccagctact

SEQ ID NO: 63201 - DNA, 25 bp, Homo sapien
agccagctactggagtcattccgtt

SEQ ID NO: 63202 - DNA, 25 bp, Homo sapien
cagctactggagtcattccgtttcc

SEQ ID NO: 63203 - DNA, 25 bp, Homo sapien
tggtgtgacttactcatcctccatt

SEQ ID NO: 63204 - DNA, 25 bp, Homo sapien
tccattcctctgcacttgcagactt

SEQ ID NO: 63205 - DNA, 25 bp, Homo sapien
ttgcagactttctgagccagggttt

SEQ ID NO: 63206 - DNA, 25 bp, Homo sapien
gttgatggatccagaaccttagaaa

SEQ ID NO: 63207 - DNA, 25 bp, Homo sapien
tgaatctgatctccatcgcagggac

SEQ ID NO: 63208 - DNA, 25 bp, Homo sapien
aatctgatctccatcgcagggacgc

SEQ ID NO: 63209 - DNA, 25 bp, Homo sapien
gatctccatcgcagggacgccaggg

SEQ ID NO: 63210 - DNA, 25 bp, Homo sapien
gggctcaggacctcgtggacatcct

SEQ ID NO: 63211 - DNA, 25 bp, Homo sapien
aggacctcgtggacatcctgccagg

SEQ ID NO: 63212 - DNA, 25 bp, Homo sapien
tggacatcctgccaggccacatggt

SEQ ID NO: 63213 - DNA, 25 bp, Homo sapien
aggccacatggtggccccgctgtga

SEQ ID NO: 63214 - DNA, 25 bp, Homo sapien
ccccgtggttatgtatcagaagaga

SEQ ID NO: 63215 - DNA, 25 bp, Homo sapien
acactttctcttcttgtttctcctg

SEQ ID NO: 63216 - DNA, 25 bp, Homo sapien
ggaggagcacagtttgtggcttata

SEQ ID NO: 63217 - DNA, 25 bp, Homo sapien
agcacagtttgtggcttataggtgt

SEQ ID NO: 63218 - DNA, 25 bp, Homo sapien
ccagcatgtccagcccctgaagttg

SEQ ID NO: 63219 - DNA, 25 bp, Homo sapien
cctctgccctgcagctgaaacttgg

SEQ ID NO: 63220 - DNA, 25 bp, Homo sapien
tgccctgcagctgaaacttggccat

SEQ ID NO: 63221 - DNA, 25 bp, Homo sapien
ctgcagctgaaacttggccatcaca

SEQ ID NO: 63222 - DNA, 25 bp, Homo sapien
tgcagctgaaacttggccatcacat

SEQ ID NO: 63223 - DNA, 25 bp, Homo sapien
cagctgaaacttggccatcacatca

SEQ ID NO: 63224 - DNA, 25 bp, Homo sapien
ctgaaacttggccatcacatcaaca

SEQ ID NO: 63225 - DNA, 25 bp, Homo sapien
tggccatcacatcaacagaaaaccc

SEQ ID NO: 63226 - DNA, 25 bp, Homo sapien
ccagtgccagctgcccagcgtgggc

SEQ ID NO: 63227 - DNA, 25 bp, Homo sapien
gggacaatacaggtccacctgaggg

SEQ ID NO: 63228 - DNA, 25 bp, Homo sapien
tgaggctggcggctggatgcgtggc

SEQ ID NO: 63229 - DNA, 25 bp, Homo sapien
attagtctatatggttctccaagaa

SEQ ID NO: 63230 - DNA, 25 bp, Homo sapien
gtctatatggttctccaagaaactg

SEQ ID NO: 63231 - DNA, 25 bp, Homo sapien
atggttctccaagaaactgaatgaa

SEQ ID NO: 63232 - DNA, 25 bp, Homo sapien
tctccaagaaactgaatgaatccat

SEQ ID NO: 63233 - DNA, 25 bp, Homo sapien
atgaatccattggagaagcggtgga

SEQ ID NO: 63234 - DNA, 25 bp, Homo sapien
ttggagaagcggtggataactagcc

SEQ ID NO: 63235 - DNA, 25 bp, Homo sapien
tttgagaatacataaacaacgcatt

SEQ ID NO: 63236 - DNA, 25 bp, Homo sapien
gaaacatacagaggatgccttttct

SEQ ID NO: 63237 - DNA, 25 bp, Homo sapien
tgccttttctgtgattgggtgggat

SEQ ID NO: 63238 - DNA, 25 bp, Homo sapien
ggatatagtagttacttgtgacaag

SEQ ID NO: 63239 - DNA, 25 bp, Homo sapien
atatcaactctgaagctaattgtac

SEQ ID NO: 63240 - DNA, 25 bp, Homo sapien
cacactcaggtgatcgagttggaga

SEQ ID NO: 63241 - DNA, 25 bp, Homo sapien
gagttggagaggaagttcagccatc

SEQ ID NO: 63242 - DNA, 25 bp, Homo sapien
gaacctcaagctcacggagacccaa

SEQ ID NO: 63243 - DNA, 25 bp, Homo sapien
caagctcacggagacccaagtgaag

SEQ ID NO: 63244 - DNA, 25 bp, Homo sapien
atggttccagaacagacgctataag

SEQ ID NO: 63245 - DNA, 25 bp, Homo sapien
gttccagaacagacgctataagact

SEQ ID NO: 63246 - DNA, 25 bp, Homo sapien
gactaagcgaaagcagctctcctcg

SEQ ID NO: 63247 - DNA, 25 bp, Homo sapien
cctgaaagaggaggccttctcccgg

SEQ ID NO: 63248 - DNA, 25 bp, Homo sapien
gggcctccctggtctccgtgtataa

SEQ ID NO: 63249 - DNA, 25 bp, Homo sapien
ggtctccgtgtataacagctatcct

SEQ ID NO: 63250 - DNA, 25 bp, Homo sapien
tataacagctatccttactacccat

SEQ ID NO: 63251 - DNA, 25 bp, Homo sapien
gaaattagcctttctgtgaaccaga

SEQ ID NO: 63252 - DNA, 25 bp, Homo sapien
gcctttctgtgaaccagatgtggtt

SEQ ID NO: 63253 - DNA, 25 bp, Homo sapien
ttatttttactctctggaaaaggag

SEQ ID NO: 63254 - DNA, 25 bp, Homo sapien
aagtgaactcatatttctaaggtaa

SEQ ID NO: 63255 - DNA, 25 bp, Homo sapien
gtaagatcccttttatgcacctaga

SEQ ID NO: 63256 - DNA, 25 bp, Homo sapien
taagatcccttttatgcacctagaa

SEQ ID NO: 63257 - DNA, 25 bp, Homo sapien
agaatatgctatgcacagagcgggt

SEQ ID NO: 63258 - DNA, 25 bp, Homo sapien
cgggtgcttgagttgttgtcgtttt

SEQ ID NO: 63259 - DNA, 25 bp, Homo sapien
ggtaaattttgtgcttatcttcaag

SEQ ID NO: 63260 - DNA, 25 bp, Homo sapien
gtgcttatcttcaaggctggcttaa

SEQ ID NO: 63261 - DNA, 25 bp, Homo sapien
cttcaaggctggcttaagtataaaa

SEQ ID NO: 63262 - DNA, 25 bp, Homo sapien
cccagctttctttctacagatggtg

SEQ ID NO: 63263 - DNA, 25 bp, Homo sapien
cagctttctttctacagatggtgct

SEQ ID NO: 63264 - DNA, 25 bp, Homo sapien
ttggtctcccacaggaaaaggcctc

SEQ ID NO: 63265 - DNA, 25 bp, Homo sapien
ctgctcgctctgttttgtcagagag

SEQ ID NO: 63266 - DNA, 25 bp, Homo sapien
gttttgtcagagagtggcctatcca

SEQ ID NO: 63267 - DNA, 25 bp, Homo sapien
gagtggcctatccagattggtgcta

SEQ ID NO: 63268 - DNA, 25 bp, Homo sapien
gtggcctatccagattggtgctatg

SEQ ID NO: 63269 - DNA, 25 bp, Homo sapien
tccctcctccctctggaggtgatgt

SEQ ID NO: 63270 - DNA, 25 bp, Homo sapien
atgtgggccctcaatggagggaatt

SEQ ID NO: 63271 - DNA, 25 bp, Homo sapien
gggagggactagactggccacactg

SEQ ID NO: 63272 - DNA, 25 bp, Homo sapien
ggccacactggctctgaaactcacc

SEQ ID NO: 63273 - DNA, 25 bp, Homo sapien
gggcgcccggcgaagccacgggact

SEQ ID NO: 63274 - DNA, 25 bp, Homo sapien
aagccacgggactggcgggaggagc

SEQ ID NO: 63275 - DNA, 25 bp, Homo sapien
cggaggaaatcctggagctgaccct

SEQ ID NO: 63276 - DNA, 25 bp, Homo sapien
gaaatcctggagctgaccctcacct

SEQ ID NO: 63277 - DNA, 25 bp, Homo sapien
ccccttctgggctcgtgatggtgga

SEQ ID NO: 63278 - DNA, 25 bp, Homo sapien
ctcgtgatggtggagctaaggtcca

SEQ ID NO: 63279 - DNA, 25 bp, Homo sapien
ggtggagctaaggtccaggcctctc

SEQ ID NO: 63280 - DNA, 25 bp, Homo sapien
tctccctcccgagtgcatttttggg

SEQ ID NO: 63281 - DNA, 25 bp, Homo sapien
gtaaatgttttattcgggtgtatca

SEQ ID NO: 63282 - DNA, 25 bp, Homo sapien
gttttattcgggtgtatcattcata

SEQ ID NO: 63283 - DNA, 25 bp, Homo sapien
attcgggtgtatcattcatacagta

SEQ ID NO: 63284 - DNA, 25 bp, Homo sapien
gaagtacgaactggacgctcagctc

SEQ ID NO: 63285 - DNA, 25 bp, Homo sapien
ttacaggagtcacctgctccatgtg

SEQ ID NO: 63286 - DNA, 25 bp, Homo sapien
gtttcctgaacacagacctctttct

SEQ ID NO: 63287 - DNA, 25 bp, Homo sapien
acagacctctttcttgtgccttgtt

SEQ ID NO: 63288 - DNA, 25 bp, Homo sapien
ttgtgccttgttcacttctgttgaa

SEQ ID NO: 63289 - DNA, 25 bp, Homo sapien
gttcacttctgttgaacccctcgta

SEQ ID NO: 63290 - DNA, 25 bp, Homo sapien
actgccgggcatttattatactact

SEQ ID NO: 63291 - DNA, 25 bp, Homo sapien
tatactacttcctgtcataaccttc

SEQ ID NO: 63292 - DNA, 25 bp, Homo sapien
ttcctgtcataaccttctaacttgt

SEQ ID NO: 63293 - DNA, 25 bp, Homo sapien
tctaacttgtttcttgacgaccacc

SEQ ID NO: 63294 - DNA, 25 bp, Homo sapien
ttgacgaccacctcatgtggccaat

SEQ ID NO: 63295 - DNA, 25 bp, Homo sapien
ggatcaagtcctagttgttcagcat

SEQ ID NO: 63296 - DNA, 25 bp, Homo sapien
gttcagcatggcatccaagactctt

SEQ ID NO: 63297 - DNA, 25 bp, Homo sapien
aagactctttatgatctggcccttg

SEQ ID NO: 63298 - DNA, 25 bp, Homo sapien
caactcttgcacagtcactgctctt

SEQ ID NO: 63299 - DNA, 25 bp, Homo sapien
ctgctcttcagccatagtggatcac

SEQ ID NO: 63300 - DNA, 25 bp, Homo sapien
agtggatcactcaccattcccagat

SEQ ID NO: 63301 - DNA, 25 bp, Homo sapien
attcccagatgtaccaggctctcgc

SEQ ID NO: 63302 - DNA, 25 bp, Homo sapien
cacgtgctgtttgctgtgcgtggaa

SEQ ID NO: 63303 - DNA, 25 bp, Homo sapien
tgtgcgtggaatgcccttcactgtc

SEQ ID NO: 63304 - DNA, 25 bp, Homo sapien
atccactctactaatgcctcttcat

SEQ ID NO: 63305 - DNA, 25 bp, Homo sapien
cattcttttatactcagctttcttt

SEQ ID NO: 63306 - DNA, 25 bp, Homo sapien
ttgagctgctgcctgatcccaccag

SEQ ID NO: 63307 - DNA, 25 bp, Homo sapien
atccccattgcacgacttgtgttga

SEQ ID NO: 63308 - DNA, 25 bp, Homo sapien
gcacgacttgtgttgaaatccaaaa

SEQ ID NO: 63309 - DNA, 25 bp, Homo sapien
aaaatggaatccacctgcgtctcag

SEQ ID NO: 63310 - DNA, 25 bp, Homo sapien
gaatccacctgcgtctcaggaggct

SEQ ID NO: 63311 - DNA, 25 bp, Homo sapien
tcaggaggctccctaacccttgtga

SEQ ID NO: 63312 - DNA, 25 bp, Homo sapien
gaggctccctaacccttgtgaagac

SEQ ID NO: 63313 - DNA, 25 bp, Homo sapien
ttgtgaagacaaggaccagctttga

SEQ ID NO: 63314 - DNA, 25 bp, Homo sapien
tgtctgcccatatcctgttttctgt

SEQ ID NO: 63315 - DNA, 25 bp, Homo sapien
atatcctgttttctgtctgcccata

SEQ ID NO: 63316 - DNA, 25 bp, Homo sapien
gcttgtctgttcctatattagtttc

SEQ ID NO: 63317 - DNA, 25 bp, Homo sapien
ctttaatttggcagaaattagcctt

SEQ ID NO: 63318 - DNA, 25 bp, Homo sapien
gaaattagcctttctgtgaaccaga

SEQ ID NO: 63319 - DNA, 25 bp, Homo sapien
attagcctttctgtgaaccagatgt

SEQ ID NO: 63320 - DNA, 25 bp, Homo sapien
gcctttctgtgaaccagatgtggtt

SEQ ID NO: 63321 - DNA, 25 bp, Homo sapien
tatttatttttactctctggaaaag

SEQ ID NO: 63322 - DNA, 25 bp, Homo sapien
ttatttttactctctggaaaaggag

SEQ ID NO: 63323 - DNA, 25 bp, Homo sapien
cgggtgcttgagttgttgtcgtttt

SEQ ID NO: 63324 - DNA, 25 bp, Homo sapien
ggtaaattttgtgcttatcttcaag

SEQ ID NO: 63325 - DNA, 25 bp, Homo sapien
aattttgtgcttatcttcaaggctg

SEQ ID NO: 63326 - DNA, 25 bp, Homo sapien
tttgtgcttatcttcaaggctggct

SEQ ID NO: 63327 - DNA, 25 bp, Homo sapien
cttcaaggctggcttaagtataaaa

SEQ ID NO: 63328 - DNA, 25 bp, Homo sapien
tgcctgatcccaccaggatccccat

SEQ ID NO: 63329 - DNA, 25 bp, Homo sapien
gcacgacttgtgttgaaatccaaaa

SEQ ID NO: 63330 - DNA, 25 bp, Homo sapien
gacttgtgttgaaatccaaaaatgg

SEQ ID NO: 63331 - DNA, 25 bp, Homo sapien
aaaaatggaatccacctgcgtctca

SEQ ID NO: 63332 - DNA, 25 bp, Homo sapien
aaatggaatccacctgcgtctcagg

SEQ ID NO: 63333 - DNA, 25 bp, Homo sapien
atggaatccacctgcgtctcaggag

SEQ ID NO: 63334 - DNA, 25 bp, Homo sapien
gaatccacctgcgtctcaggaggct

SEQ ID NO: 63335 - DNA, 25 bp, Homo sapien
tcaggaggctccctaacccttgtga

SEQ ID NO: 63336 - DNA, 25 bp, Homo sapien
aggaggctccctaacccttgtgaag

SEQ ID NO: 63337 - DNA, 25 bp, Homo sapien
gaggctccctaacccttgtgaagac

SEQ ID NO: 63338 - DNA, 25 bp, Homo sapien
ttgtgaagacaaggaccagctttga

SEQ ID NO: 63339 - DNA, 25 bp, Homo sapien
attgcagctctcagcaaactgggtc

SEQ ID NO: 63340 - DNA, 25 bp, Homo sapien
tcagcaaactgggtcatagctttcc

SEQ ID NO: 63341 - DNA, 25 bp, Homo sapien
aactgggtcatagctttccccacag

SEQ ID NO: 63342 - DNA, 25 bp, Homo sapien
gggcatgattctctcaggcttctgc

SEQ ID NO: 63343 - DNA, 25 bp, Homo sapien
attctctcaggcttctgccccgagg

SEQ ID NO: 63344 - DNA, 25 bp, Homo sapien
ttcgtcgtcctcagggtctggactt

SEQ ID NO: 63345 - DNA, 25 bp, Homo sapien
agggcccgtgccttagacttctcct

SEQ ID NO: 63346 - DNA, 25 bp, Homo sapien
agcgctggtacacaggtctaggcac

SEQ ID NO: 63347 - DNA, 25 bp, Homo sapien
ggtacacaggtctaggcaccacgca

SEQ ID NO: 63348 - DNA, 25 bp, Homo sapien
taggcaccacgcagtgctttggaaa

SEQ ID NO: 63349 - DNA, 25 bp, Homo sapien
ccacgcagtgctttggaaattctca

SEQ ID NO: 63350 - DNA, 25 bp, Homo sapien
ctctattatccacaacaagccatcg

SEQ ID NO: 63351 - DNA, 25 bp, Homo sapien
aagccatcgtgtttgcccaggtcag

SEQ ID NO: 63352 - DNA, 25 bp, Homo sapien
gggtttacgaggatatatagtcata

SEQ ID NO: 63353 - DNA, 25 bp, Homo sapien
gaaggagaactttcaaaagccagga

SEQ ID NO: 63354 - DNA, 25 bp, Homo sapien
gaagaattcacctggaactaagtag

SEQ ID NO: 63355 - DNA, 25 bp, Homo sapien
ggaaaaactagaccagacctctgtt

SEQ ID NO: 63356 - DNA, 25 bp, Homo sapien
gacctctgttatcttctgtgaaatc

SEQ ID NO: 63357 - DNA, 25 bp, Homo sapien
gtgaaatcatcctacaagcaaacta

SEQ ID NO: 63358 - DNA, 25 bp, Homo sapien
agcaaactaacctggaatcccttca

SEQ ID NO: 63359 - DNA, 25 bp, Homo sapien
ggaatcccttcacctagagataatg

SEQ ID NO: 63360 - DNA, 25 bp, Homo sapien
taatgtacaagccttagaactcctc

SEQ ID NO: 63361 - DNA, 25 bp, Homo sapien
aatgactggcctggcattatgctat

SEQ ID NO: 63362 - DNA, 25 bp, Homo sapien
gagtttgtgcctttgctgaggacac

SEQ ID NO: 63363 - DNA, 25 bp, Homo sapien
gaggacactagaacctggcttgcct

SEQ ID NO: 63364 - DNA, 25 bp, Homo sapien
ggcttgcctcccttataagcagaaa

SEQ ID NO: 63365 - DNA, 25 bp, Homo sapien
gccacaaccactagtctctttaata

SEQ ID NO: 63366 - DNA, 25 bp, Homo sapien
gggcatttacacacgtaactggatc

SEQ ID NO: 63367 - DNA, 25 bp, Homo sapien
actggatccagtgaatgtcttatgc

SEQ ID NO: 63368 - DNA, 25 bp, Homo sapien
aatgtcttatgctctgcatttgccc

SEQ ID NO: 63369 - DNA, 25 bp, Homo sapien
gcatttgcccctggtgatcttaaaa

SEQ ID NO: 63370 - DNA, 25 bp, Homo sapien
ggtgatcttaaaattcgtttgcctt

SEQ ID NO: 63371 - DNA, 25 bp, Homo sapien
tcaatcttcctattttgtcagcgaa

SEQ ID NO: 63372 - DNA, 25 bp, Homo sapien
aacacggcactttcttaagctggtt

SEQ ID NO: 63373 - DNA, 25 bp, Homo sapien
gctggttttgcaaaagcacaacaca

SEQ ID NO: 63374 - DNA, 25 bp, Homo sapien
agagatgaccactgcggctggcgaa

SEQ ID NO: 63375 - DNA, 25 bp, Homo sapien
ggcgaagctttctacacgttggtgt

SEQ ID NO: 63376 - DNA, 25 bp, Homo sapien
gtgtgtttgcaccaggctgaatatt

SEQ ID NO: 63377 - DNA, 25 bp, Homo sapien
gaactggtcgaaacattactatcaa

SEQ ID NO: 63378 - DNA, 25 bp, Homo sapien
attactatcaagtcagcaagaccca

SEQ ID NO: 63379 - DNA, 25 bp, Homo sapien
gcaagacccagttatttaccagaga

SEQ ID NO: 63380 - DNA, 25 bp, Homo sapien
agagattagcagatgccttcaacaa

SEQ ID NO: 63381 - DNA, 25 bp, Homo sapien
atgccttcaacaagctcactgcaag

SEQ ID NO: 63382 - DNA, 25 bp, Homo sapien
tcctcctacgctggatcggaagcag

SEQ ID NO: 63383 - DNA, 25 bp, Homo sapien
tgttttaatcatcatctagacttgt

SEQ ID NO: 63384 - DNA, 25 bp, Homo sapien
aatcatcatctagacttgttaagta

SEQ ID NO: 63385 - DNA, 25 bp, Homo sapien
tatgaaaatataacccccagaaagt

SEQ ID NO: 63386 - DNA, 25 bp, Homo sapien
aaatgataatgttggcatctgtgat

SEQ ID NO: 63387 - DNA, 25 bp, Homo sapien
tgttggcatctgtgataaactatca

SEQ ID NO: 63388 - DNA, 25 bp, Homo sapien
aaactatcaatgaggctcccatcat

SEQ ID NO: 63389 - DNA, 25 bp, Homo sapien
tatcaatgaggctcccatcatgcca

SEQ ID NO: 63390 - DNA, 25 bp, Homo sapien
aatgaggctcccatcatgccatttt

SEQ ID NO: 63391 - DNA, 25 bp, Homo sapien
gaggctcccatcatgccattttttg

SEQ ID NO: 63392 - DNA, 25 bp, Homo sapien
ctcccatcatgccattttttgttca

SEQ ID NO: 63393 - DNA, 25 bp, Homo sapien
cccatcatgccattttttgttcatt

SEQ ID NO: 63394 - DNA, 25 bp, Homo sapien
gtattttaacatttctatttcacag

SEQ ID NO: 63395 - DNA, 25 bp, Homo sapien
ttcacagtcaaactcggcattcttc

SEQ ID NO: 63396 - DNA, 25 bp, Homo sapien
ggcattcttcagtcagcttgaggat

SEQ ID NO: 63397 - DNA, 25 bp, Homo sapien
gcattgttaatcttggactccataa

SEQ ID NO: 63398 - DNA, 25 bp, Homo sapien
tatgagtcctagcactgattttgag

SEQ ID NO: 63399 - DNA, 25 bp, Homo sapien
gaggatcagaagttcaagggaccgt

SEQ ID NO: 63400 - DNA, 25 bp, Homo sapien
gggaccgtgaaagccctcagagtca

SEQ ID NO: 63401 - DNA, 25 bp, Homo sapien
gagtcagcacctagtttgagaccaa

SEQ ID NO: 63402 - DNA, 25 bp, Homo sapien
tttgagaccaagcaccctttcgaat

SEQ ID NO: 63403 - DNA, 25 bp, Homo sapien
cctttcgaatccctggatggctgag

SEQ ID NO: 63404 - DNA, 25 bp, Homo sapien
aggccggctctgactgggcagccca

SEQ ID NO: 63405 - DNA, 25 bp, Homo sapien
gggcgcccggcgaagccacgggact

SEQ ID NO: 63406 - DNA, 25 bp, Homo sapien
gaaatcctggagctgaccctcacct

SEQ ID NO: 63407 - DNA, 25 bp, Homo sapien
ccccttctgggctcgtgatggtgga

SEQ ID NO: 63408 - DNA, 25 bp, Homo sapien
tctgggctcgtgatggtggagctaa

SEQ ID NO: 63409 - DNA, 25 bp, Homo sapien
tctccctcccgagtgcatttttggg

SEQ ID NO: 63410 - DNA, 25 bp, Homo sapien
gtaaatgttttattcgggtgtatca

SEQ ID NO: 63411 - DNA, 25 bp, Homo sapien
tgttttattcgggtgtatcattcat

SEQ ID NO: 63412 - DNA, 25 bp, Homo sapien
gttttattcgggtgtatcattcata

SEQ ID NO: 63413 - DNA, 25 bp, Homo sapien
ttttattcgggtgtatcattcatac

SEQ ID NO: 63414 - DNA, 25 bp, Homo sapien
ttattcgggtgtatcattcatacag

SEQ ID NO: 63415 - DNA, 25 bp, Homo sapien
attcgggtgtatcattcatacagta

SEQ ID NO: 63416 - DNA, 25 bp, Homo sapien
aaacagtgtctgctattttattcac

SEQ ID NO: 63417 - DNA, 25 bp, Homo sapien
caattaattgtggatttgatcagat

SEQ ID NO: 63418 - DNA, 25 bp, Homo sapien
gatcagattgaattcgttttgtttc

SEQ ID NO: 63419 - DNA, 25 bp, Homo sapien
attcgttttgtttcagattcctatt

SEQ ID NO: 63420 - DNA, 25 bp, Homo sapien
aatatttcacttgtactgttgctga

SEQ ID NO: 63421 - DNA, 25 bp, Homo sapien
acttgtactgttgctgatttttgca

SEQ ID NO: 63422 - DNA, 25 bp, Homo sapien
cttgaagagcaagagtctgtacatt

SEQ ID NO: 63423 - DNA, 25 bp, Homo sapien
gagtctgtacattattaagcttaga

SEQ ID NO: 63424 - DNA, 25 bp, Homo sapien
caaaactgatttactggtttgcctt

SEQ ID NO: 63425 - DNA, 25 bp, Homo sapien
ctggtttgcctttcagtttgttgaa

SEQ ID NO: 63426 - DNA, 25 bp, Homo sapien
gtattgtcaagtactgtacaatgaa

SEQ ID NO: 63427 - DNA, 25 bp, Homo sapien
ataatgaattttgtaatgctttctt

SEQ ID NO: 63428 - DNA, 25 bp, Homo sapien
atgtgttataggtgaattgccatac

SEQ ID NO: 63429 - DNA, 25 bp, Homo sapien
tataggtgaattgccatacaaagtt

SEQ ID NO: 63430 - DNA, 25 bp, Homo sapien
gccatacaaagttaacagctatgta

SEQ ID NO: 63431 - DNA, 25 bp, Homo sapien
gagataaacatatcagtgttctaag

SEQ ID NO: 63432 - DNA, 25 bp, Homo sapien
ctaagtagtgataatggatcctgtt

SEQ ID NO: 63433 - DNA, 25 bp, Homo sapien
taatggatcctgttgaaggttaaca

SEQ ID NO: 63434 - DNA, 25 bp, Homo sapien
ggatcctgttgaaggttaacataat

SEQ ID NO: 63435 - DNA, 25 bp, Homo sapien
gacatctaatatctgaatgtttttg

SEQ ID NO: 63436 - DNA, 25 bp, Homo sapien
ttttgtatcaagtagtttgttttca

SEQ ID NO: 63437 - DNA, 25 bp, Homo sapien
gtttgttttcatagacttcaattca

SEQ ID NO: 63438 - DNA, 25 bp, Homo sapien
gagctcaacgaagccgccgtgtggt

SEQ ID NO: 63439 - DNA, 25 bp, Homo sapien
aagccgccgtgtggtaaggccgccg

SEQ ID NO: 63440 - DNA, 25 bp, Homo sapien
ctgaaaccaaaacgcccgacgcaga

SEQ ID NO: 63441 - DNA, 25 bp, Homo sapien
caaaacgcccgacgcagacgcggtg

SEQ ID NO: 63442 - DNA, 25 bp, Homo sapien
gacgcggtgggagacgtgggtgtcc

SEQ ID NO: 63443 - DNA, 25 bp, Homo sapien
tctcgggtccgcactcaactggcag

SEQ ID NO: 63444 - DNA, 25 bp, Homo sapien
ggtccgcactcaactggcagctgct

SEQ ID NO: 63445 - DNA, 25 bp, Homo sapien
cagcaaccgcgagcaatttcttggg

SEQ ID NO: 63446 - DNA, 25 bp, Homo sapien
aaccgcgagcaatttcttgggacca

SEQ ID NO: 63447 - DNA, 25 bp, Homo sapien
gcgagcaatttcttgggaccaaagt

SEQ ID NO: 63448 - DNA, 25 bp, Homo sapien
gcaatttcttgggaccaaagtcaat

SEQ ID NO: 63449 - DNA, 25 bp, Homo sapien
ttgggctttcccctaaattgcaaga

SEQ ID NO: 63450 - DNA, 25 bp, Homo sapien
ggctttcccctaaattgcaagataa

SEQ ID NO: 63451 - DNA, 25 bp, Homo sapien
ggccatgtgtaagattttccctaaa

SEQ ID NO: 63452 - DNA, 25 bp, Homo sapien
tgtgtaagattttccctaaaactag

SEQ ID NO: 63453 - DNA, 25 bp, Homo sapien
tttgcatatttggactcagccatcc

SEQ ID NO: 63454 - DNA, 25 bp, Homo sapien
gactcagccatccattaagaaccca

SEQ ID NO: 63455 - DNA, 25 bp, Homo sapien
taagaacccatgttgtcctctggac

SEQ ID NO: 63456 - DNA, 25 bp, Homo sapien
aacccatgttgtcctctggacatat

SEQ ID NO: 63457 - DNA, 25 bp, Homo sapien
tgtcctctggacatatttatcaata

SEQ ID NO: 63458 - DNA, 25 bp, Homo sapien
aatttatgtatcaccttcattgtaa

SEQ ID NO: 63459 - DNA, 25 bp, Homo sapien
ttagcaggaaatgcatcacaattat

SEQ ID NO: 63460 - DNA, 25 bp, Homo sapien
taattttcaacctttctggatacct

SEQ ID NO: 63461 - DNA, 25 bp, Homo sapien
tttcaacctttctggataccttaat

SEQ ID NO: 63462 - DNA, 25 bp, Homo sapien
caacctttctggataccttaattgt

SEQ ID NO: 63463 - DNA, 25 bp, Homo sapien
ttctggataccttaattgtaactgt

SEQ ID NO: 63464 - DNA, 25 bp, Homo sapien
tgtaactgtcagtttgcactggtcg

SEQ ID NO: 63465 - DNA, 25 bp, Homo sapien
aactgtcagtttgcactggtcggta

SEQ ID NO: 63466 - DNA, 25 bp, Homo sapien
ctgtcagtttgcactggtcggtata

SEQ ID NO: 63467 - DNA, 25 bp, Homo sapien
cagtttgcactggtcggtatatgga

SEQ ID NO: 63468 - DNA, 25 bp, Homo sapien
gcactggtcggtatatggaaacaca

SEQ ID NO: 63469 - DNA, 25 bp, Homo sapien
tggtcggtatatggaaacacattgc

SEQ ID NO: 63470 - DNA, 25 bp, Homo sapien
taaagtgaatttacagtgatgagaa

SEQ ID NO: 63471 - DNA, 25 bp, Homo sapien
gttttctgaaattacacatggcttt

SEQ ID NO: 63472 - DNA, 25 bp, Homo sapien
atttctaatgtatccaagatgtgca

SEQ ID NO: 63473 - DNA, 25 bp, Homo sapien
gatgtgcaatgttgttaggatctca

SEQ ID NO: 63474 - DNA, 25 bp, Homo sapien
gttaggatctcattcttcagtgcat

SEQ ID NO: 63475 - DNA, 25 bp, Homo sapien
ctactaccctcagaacattttgtgt

SEQ ID NO: 63476 - DNA, 25 bp, Homo sapien
cattttgtgttaattgtacctgcaa

SEQ ID NO: 63477 - DNA, 25 bp, Homo sapien
aattgtacctgcaagaacacctcag

SEQ ID NO: 63478 - DNA, 25 bp, Homo sapien
gcaagaacacctcaggcaagccaag

SEQ ID NO: 63479 - DNA, 25 bp, Homo sapien
gaacacctcaggcaagccaagaaga

SEQ ID NO: 63480 - DNA, 25 bp, Homo sapien
tgctttattttgatggaatggccat

SEQ ID NO: 63481 - DNA, 25 bp, Homo sapien
atggccattaaatacacattttgag

SEQ ID NO: 63482 - DNA, 25 bp, Homo sapien
actctaaattcaaggtagtgaccca

SEQ ID NO: 63483 - DNA, 25 bp, Homo sapien
gaaaagctgttgaaaatctttctcc

SEQ ID NO: 63484 - DNA, 25 bp, Homo sapien
aaatatatgccctagagctgctcca

SEQ ID NO: 63485 - DNA, 25 bp, Homo sapien
tatatgccctagagctgctccagca

SEQ ID NO: 63486 - DNA, 25 bp, Homo sapien
gctgctccagcacccttggtttctg

SEQ ID NO: 63487 - DNA, 25 bp, Homo sapien
gaaatcagatgacacctgactgcaa

SEQ ID NO: 63488 - DNA, 25 bp, Homo sapien
gacacctgactgcaaaaatgtttat

SEQ ID NO: 63489 - DNA, 25 bp, Homo sapien
aagcaaatagccttcttacattttg

SEQ ID NO: 63490 - DNA, 25 bp, Homo sapien
tttggtataaagctgtgaacttcgt

SEQ ID NO: 63491 - DNA, 25 bp, Homo sapien
gctgtgaacttcgtaactttgtaaa

SEQ ID NO: 63492 - DNA, 25 bp, Homo sapien
gaacttcgtaactttgtaaagcaag

SEQ ID NO: 63493 - DNA, 25 bp, Homo sapien
aaggagcccatggacctaaagccag

SEQ ID NO: 63494 - DNA, 25 bp, Homo sapien
ctaaagccagaaccccatagccaag

SEQ ID NO: 63495 - DNA, 25 bp, Homo sapien
gccaaggagttgaaggtcctccaca

SEQ ID NO: 63496 - DNA, 25 bp, Homo sapien
ttgaaggtcctccacaagagaaggg

SEQ ID NO: 63497 - DNA, 25 bp, Homo sapien
cgcaggactcgggactgtgttcgct

SEQ ID NO: 63498 - DNA, 25 bp, Homo sapien
actgtgttcgctgggagcgctctaa

SEQ ID NO: 63499 - DNA, 25 bp, Homo sapien
gggagcgctctaaaggccggacacc

SEQ ID NO: 63500 - DNA, 25 bp, Homo sapien
gggccagtagcataccggcctggta

SEQ ID NO: 63501 - DNA, 25 bp, Homo sapien
cataccggcctggtactcggaggga

SEQ ID NO: 63502 - DNA, 25 bp, Homo sapien
gagtccctgggcctggaatctaagg

SEQ ID NO: 63503 - DNA, 25 bp, Homo sapien
aggatggttcctagcaggacttggt

SEQ ID NO: 63504 - DNA, 25 bp, Homo sapien
gagatgattctgaaggcccgagtta

SEQ ID NO: 63505 - DNA, 25 bp, Homo sapien
ttctgaaggcccgagttaggagatt

SEQ ID NO: 63506 - DNA, 25 bp, Homo sapien
tcttccttcaagactagactcactg

SEQ ID NO: 63507 - DNA, 25 bp, Homo sapien
tagactcactgaggcattttcccta

SEQ ID NO: 63508 - DNA, 25 bp, Homo sapien
ttttccctaaatcaaccggtagcag

SEQ ID NO: 63509 - DNA, 25 bp, Homo sapien
aaccggtagcagatacttccaagga

SEQ ID NO: 63510 - DNA, 25 bp, Homo sapien
gatacttccaaggagtggctccctg

SEQ ID NO: 63511 - DNA, 25 bp, Homo sapien
cctatgcctctaagctgtatttttt

SEQ ID NO: 63512 - DNA, 25 bp, Homo sapien
aagcaattatttttcctggtgtctc

SEQ ID NO: 63513 - DNA, 25 bp, Homo sapien
ctggtgtctcttcttggtactttta

SEQ ID NO: 63514 - DNA, 25 bp, Homo sapien
ggtacttttagttctattccagtgt

SEQ ID NO: 63515 - DNA, 25 bp, Homo sapien
gcccagtgttctcctggtttagcag

SEQ ID NO: 63516 - DNA, 25 bp, Homo sapien
gatgtgatgtaactgtttccctttg

SEQ ID NO: 63517 - DNA, 25 bp, Homo sapien
tgtttccctttgattctccagtatt

SEQ ID NO: 63518 - DNA, 25 bp, Homo sapien
gattctccagtattcctgtttccat

SEQ ID NO: 63519 - DNA, 25 bp, Homo sapien
ctgtttccatccagttccttactct

SEQ ID NO: 63520 - DNA, 25 bp, Homo sapien
ggaaattacataacgttcagttggg

SEQ ID NO: 63521 - DNA, 25 bp, Homo sapien
ttcagttgggatggaaatcttccgg

SEQ ID NO: 63522 - DNA, 25 bp, Homo sapien
tcttccggaggacgaatagagttta

SEQ ID NO: 63523 - DNA, 25 bp, Homo sapien
agtttaattactcattgcgtcggaa

SEQ ID NO: 63524 - DNA, 25 bp, Homo sapien
tcattgcgtcggaaagccaagccat

SEQ ID NO: 63525 - DNA, 25 bp, Homo sapien
gtcggaaagccaagccatttctgtc

SEQ ID NO: 63526 - DNA, 25 bp, Homo sapien
tgggctgccgagtccggatccctgc

SEQ ID NO: 63527 - DNA, 25 bp, Homo sapien
ggatccctgccgaggtgctcatcct

SEQ ID NO: 63528 - DNA, 25 bp, Homo sapien
ctcatcctgaactcgattgttctgc

SEQ ID NO: 63529 - DNA, 25 bp, Homo sapien
tgaactcgattgttctgccacacaa

SEQ ID NO: 63530 - DNA, 25 bp, Homo sapien
ctcgattgttctgccacacaaggag

SEQ ID NO: 63531 - DNA, 25 bp, Homo sapien
acaaggagctgagccgaagcttcac

SEQ ID NO: 63532 - DNA, 25 bp, Homo sapien
ctgagccgaagcttcaccaaccaga

SEQ ID NO: 63533 - DNA, 25 bp, Homo sapien
accaaccagatcatcctctgagtag

SEQ ID NO: 63534 - DNA, 25 bp, Homo sapien
atcatcctctgagtagggctgccag

SEQ ID NO: 63535 - DNA, 25 bp, Homo sapien
aaagccaggctggatcgtcacatgc

SEQ ID NO: 63536 - DNA, 25 bp, Homo sapien
ccaggctggatcgtcacatgccggg

SEQ ID NO: 63537 - DNA, 25 bp, Homo sapien
aagcatcaaagtctactcagctaaa

SEQ ID NO: 63538 - DNA, 25 bp, Homo sapien
tcagctaaagactaacagaggacag

SEQ ID NO: 63539 - DNA, 25 bp, Homo sapien
gtgacagtttcagctaggacgaaca

SEQ ID NO: 63540 - DNA, 25 bp, Homo sapien
gacgaacaggaggtgtcagactgct

SEQ ID NO: 63541 - DNA, 25 bp, Homo sapien
gtgtcagactgctgaagccgactct

SEQ ID NO: 63542 - DNA, 25 bp, Homo sapien
agtgatcatgaagttccagaaccag

SEQ ID NO: 63543 - DNA, 25 bp, Homo sapien
gttccagaaccagaatcagaaatga

SEQ ID NO: 63544 - DNA, 25 bp, Homo sapien
agatgagactaccaagacgagccaa

SEQ ID NO: 63545 - DNA, 25 bp, Homo sapien
gacgagccaaaaccgcagcactaga

SEQ ID NO: 63546 - DNA, 25 bp, Homo sapien
agacgatggaggtggaatcctttaa

SEQ ID NO: 63547 - DNA, 25 bp, Homo sapien
agattatgtccagttatttgcttta

SEQ ID NO: 63548 - DNA, 25 bp, Homo sapien
aaaaagactctctcttcatcattcc

SEQ ID NO: 63549 - DNA, 25 bp, Homo sapien
ctcttcatcattccccagtgaaata

SEQ ID NO: 63550 - DNA, 25 bp, Homo sapien
gaagcgagatgccattgccaactgt

SEQ ID NO: 63551 - DNA, 25 bp, Homo sapien
gccattgccaactgttttattcctt

SEQ ID NO: 63552 - DNA, 25 bp, Homo sapien
ttattcctttcaacaactgcattgg

SEQ ID NO: 63553 - DNA, 25 bp, Homo sapien
tcactatgatattcggctacccaac

SEQ ID NO: 63554 - DNA, 25 bp, Homo sapien
tcggctacccaacttctatcaaatg

SEQ ID NO: 63555 - DNA, 25 bp, Homo sapien
aaatgtcaactccagaaatacgcag

SEQ ID NO: 63556 - DNA, 25 bp, Homo sapien
agaaatacgcagatcacccctgaca

SEQ ID NO: 63557 - DNA, 25 bp, Homo sapien
atcacccctgacacaacattttcag

SEQ ID NO: 63558 - DNA, 25 bp, Homo sapien
acattttcagaattccagacgatac

SEQ ID NO: 63559 - DNA, 25 bp, Homo sapien
aaattctgactctccagacttgtct

SEQ ID NO: 63560 - DNA, 25 bp, Homo sapien
agacttgtctggctataacccctgt

SEQ ID NO: 63561 - DNA, 25 bp, Homo sapien
taattctcccagtctaaaatctaaa

SEQ ID NO: 63562 - DNA, 25 bp, Homo sapien
ttttttctagtactttctcctgaag

SEQ ID NO: 63563 - DNA, 25 bp, Homo sapien
tctcctgaagtattgaaacctattg

SEQ ID NO: 63564 - DNA, 25 bp, Homo sapien
gattcaatgggtagagatttgctaa

SEQ ID NO: 63565 - DNA, 25 bp, Homo sapien
taagtatgatgtgcttccacctctt

SEQ ID NO: 63566 - DNA, 25 bp, Homo sapien
atactctctaccttccttaccatga

SEQ ID NO: 63567 - DNA, 25 bp, Homo sapien
taccttccttaccatgattcagcca

SEQ ID NO: 63568 - DNA, 25 bp, Homo sapien
atgattcagccacactggcctttct

SEQ ID NO: 63569 - DNA, 25 bp, Homo sapien
ttctgttccttggacatgcctggag

SEQ ID NO: 63570 - DNA, 25 bp, Homo sapien
ttttctgcttagacttacttattct

SEQ ID NO: 63571 - DNA, 25 bp, Homo sapien
gtcatgtaggagctcattgttctct

SEQ ID NO: 63572 - DNA, 25 bp, Homo sapien
agagctgagctcttctgctaaagtt

SEQ ID NO: 63573 - DNA, 25 bp, Homo sapien
gagctcttctgctaaagttcaaagt

SEQ ID NO: 63574 - DNA, 25 bp, Homo sapien
aaagttcacatcagtgtagccagag

SEQ ID NO: 63575 - DNA, 25 bp, Homo sapien
gtagccagagtgaagcatctttgtt

SEQ ID NO: 63576 - DNA, 25 bp, Homo sapien
atctttgttagcagttatgtggtca

SEQ ID NO: 63577 - DNA, 25 bp, Homo sapien
tagaatgggagcacacctggtgccc

SEQ ID NO: 63578 - DNA, 25 bp, Homo sapien
agcaaccagggctccttagaaaatg

SEQ ID NO: 63579 - DNA, 25 bp, Homo sapien
atgaactgattctagagctgggata

SEQ ID NO: 63580 - DNA, 25 bp, Homo sapien
gagctgggatatgaactatacaaga

SEQ ID NO: 63581 - DNA, 25 bp, Homo sapien
caagttcgacgtggctgattggctg

SEQ ID NO: 63582 - DNA, 25 bp, Homo sapien
gttcctggaccacgagatcgatggc

SEQ ID NO: 63583 - DNA, 25 bp, Homo sapien
tggaccacgagatcgatggctccca

SEQ ID NO: 63584 - DNA, 25 bp, Homo sapien
acctgcccgccttgaccaaggagga

SEQ ID NO: 63585 - DNA, 25 bp, Homo sapien
gaccaaggaggactacgtcgatcta

SEQ ID NO: 63586 - DNA, 25 bp, Homo sapien
gactacgtcgatctaggtgtgacca

SEQ ID NO: 63587 - DNA, 25 bp, Homo sapien
acgtcgatctaggtgtgaccagggt

SEQ ID NO: 63588 - DNA, 25 bp, Homo sapien
catcgaccgggctctcaaattcttc

SEQ ID NO: 63589 - DNA, 25 bp, Homo sapien
cgggctctcaaattcttcctggaga

SEQ ID NO: 63590 - DNA, 25 bp, Homo sapien
ctcaaattcttcctggagaggtgat

SEQ ID NO: 63591 - DNA, 25 bp, Homo sapien
gtccacagaactcttgagcctgctg

SEQ ID NO: 63592 - DNA, 25 bp, Homo sapien
gactaggtagagtagttaccaggag

SEQ ID NO: 63593 - DNA, 25 bp, Homo sapien
ttaccaggagatgtgaatgtgcgtc

SEQ ID NO: 63594 - DNA, 25 bp, Homo sapien
gatgggtttgtcaagggaatcgtta

SEQ ID NO: 63595 - DNA, 25 bp, Homo sapien
tgggcagcctttgacacatgtattc

SEQ ID NO: 63596 - DNA, 25 bp, Homo sapien
catgtattccaaaaacgagtttata

SEQ ID NO: 63597 - DNA, 25 bp, Homo sapien
tcaaacggtttttacagcttagact

SEQ ID NO: 63598 - DNA, 25 bp, Homo sapien
gcttagactttgtacttactgccct

SEQ ID NO: 63599 - DNA, 25 bp, Homo sapien
ttagactttgtacttactgccctgc

SEQ ID NO: 63600 - DNA, 25 bp, Homo sapien
tttgtacttactgccctgcctgtga

SEQ ID NO: 63601 - DNA, 25 bp, Homo sapien
gcctgtgacagttgtatgccttcat

SEQ ID NO: 63602 - DNA, 25 bp, Homo sapien
gtatccaacagcaaagtctacaata

SEQ ID NO: 63603 - DNA, 25 bp, Homo sapien
aaaaaagagtcaggcctggtggtgt

SEQ ID NO: 63604 - DNA, 25 bp, Homo sapien
agagtcaggcctggtggtgtgcgcc

SEQ ID NO: 63605 - DNA, 25 bp, Homo sapien
ttgtgtggccacactccatcctggg

SEQ ID NO: 63606 - DNA, 25 bp, Homo sapien
tgtggccacactccatcctgggtca

SEQ ID NO: 63607 - DNA, 25 bp, Homo sapien
aaaaagaagccttgctttagcacag

SEQ ID NO: 63608 - DNA, 25 bp, Homo sapien
ctttagcacaggtatgaagccagaa

SEQ ID NO: 63609 - DNA, 25 bp, Homo sapien
gaagccagaagccagcatctcaact

SEQ ID NO: 63610 - DNA, 25 bp, Homo sapien
agaagccagcatctcaactgtgctt

SEQ ID NO: 63611 - DNA, 25 bp, Homo sapien
aagccagcatctcaactgtgcttgt

SEQ ID NO: 63612 - DNA, 25 bp, Homo sapien
gcatctcaactgtgcttgtcttatg

SEQ ID NO: 63613 - DNA, 25 bp, Homo sapien
atctcaactgtgcttgtcttatgca

SEQ ID NO: 63614 - DNA, 25 bp, Homo sapien
aatattcaatgagtttaagatggat

SEQ ID NO: 63615 - DNA, 25 bp, Homo sapien
atattcaatgagtttaagatggata

SEQ ID NO: 63616 - DNA, 25 bp, Homo sapien
tattcaatgagtttaagatggatat

SEQ ID NO: 63617 - DNA, 25 bp, Homo sapien
attcaatgagtttaagatggatatg

SEQ ID NO: 63618 - DNA, 25 bp, Homo sapien
caatgagtttaagatggatatgatt

SEQ ID NO: 63619 - DNA, 25 bp, Homo sapien
atgagtttaagatggatatgatttc

SEQ ID NO: 63620 - DNA, 25 bp, Homo sapien
gagtttaagatggatatgatttcaa

SEQ ID NO: 63621 - DNA, 25 bp, Homo sapien
agtttaagatggatatgatttcaaa

SEQ ID NO: 63622 - DNA, 25 bp, Homo sapien
gtttaagatggatatgatttcaaaa

SEQ ID NO: 63623 - DNA, 25 bp, Homo sapien
tttaagatggatatgatttcaaaaa

SEQ ID NO: 63624 - DNA, 25 bp, Homo sapien
taagatggatatgatttcaaaaaat

SEQ ID NO: 63625 - DNA, 25 bp, Homo sapien
cagtggacagtgatattcttagctc

SEQ ID NO: 63626 - DNA, 25 bp, Homo sapien
gtgatattcttagctccagtcatag

SEQ ID NO: 63627 - DNA, 25 bp, Homo sapien
gctccagtcatagcagtgatacttt

SEQ ID NO: 63628 - DNA, 25 bp, Homo sapien
agcagtgatactttgtgcaatgcag

SEQ ID NO: 63629 - DNA, 25 bp, Homo sapien
tgcagacaatgctcagatccctttg

SEQ ID NO: 63630 - DNA, 25 bp, Homo sapien
atgctcagatccctttggctaatgg

SEQ ID NO: 63631 - DNA, 25 bp, Homo sapien
tggctaatggacttgactctcacag

SEQ ID NO: 63632 - DNA, 25 bp, Homo sapien
tgactctcacagtatcacaagtagt

SEQ ID NO: 63633 - DNA, 25 bp, Homo sapien
gaagactctggaactgatagtgaat

SEQ ID NO: 63634 - DNA, 25 bp, Homo sapien
aatgcagtacatgtatttcaaagct

SEQ ID NO: 63635 - DNA, 25 bp, Homo sapien
aaagctgaaccttatgctgcagatg

SEQ ID NO: 63636 - DNA, 25 bp, Homo sapien
accgggtcagtggtctcttgcgcgc

SEQ ID NO: 63637 - DNA, 25 bp, Homo sapien
tcagtggtctcttgcgcgccagctt

SEQ ID NO: 63638 - DNA, 25 bp, Homo sapien
tgctggtgatcctgagccctgacgg

SEQ ID NO: 63639 - DNA, 25 bp, Homo sapien
tggtgatcctgagccctgacggccg

SEQ ID NO: 63640 - DNA, 25 bp, Homo sapien
agcccagtggtcagcgcagcttctg

SEQ ID NO: 63641 - DNA, 25 bp, Homo sapien
tgggcatggccctgaccagggacaa

SEQ ID NO: 63642 - DNA, 25 bp, Homo sapien
tgaccagggacaaccaccacttcta

SEQ ID NO: 63643 - DNA, 25 bp, Homo sapien
gacaaccaccacttctataaccgga

SEQ ID NO: 63644 - DNA, 25 bp, Homo sapien
accacttctataaccggaacttctg

SEQ ID NO: 63645 - DNA, 25 bp, Homo sapien
ggacccacggccgaatagccgtgag

SEQ ID NO: 63646 - DNA, 25 bp, Homo sapien
gaatagccgtgagccggaatcctgc

SEQ ID NO: 63647 - DNA, 25 bp, Homo sapien
tgcacagctgtctctgtcggagagc

SEQ ID NO: 63648 - DNA, 25 bp, Homo sapien
tctgtcggagagcaagtctgttttg

SEQ ID NO: 63649 - DNA, 25 bp, Homo sapien
gtctgttttgggaactagaacgcaa

SEQ ID NO: 63650 - DNA, 25 bp, Homo sapien
ggaactagaacgcaattgtgaaatt

SEQ ID NO: 63651 - DNA, 25 bp, Homo sapien
ttgtgaaattataagaccagtggat

SEQ ID NO: 63652 - DNA, 25 bp, Homo sapien
ttttttacctggcacatgggttggt

SEQ ID NO: 63653 - DNA, 25 bp, Homo sapien
gatcaatctcatattcattccctgg

SEQ ID NO: 63654 - DNA, 25 bp, Homo sapien
cattccctgggatgtttagttacca

SEQ ID NO: 63655 - DNA, 25 bp, Homo sapien
cagttttcccaaagtgttctggtag

SEQ ID NO: 63656 - DNA, 25 bp, Homo sapien
gtgttctggtagcatctaccatatt

SEQ ID NO: 63657 - DNA, 25 bp, Homo sapien
atctgtgattcctttgattattata

SEQ ID NO: 63658 - DNA, 25 bp, Homo sapien
taatttatttaatcagtccctcact

SEQ ID NO: 63659 - DNA, 25 bp, Homo sapien
tatttaatcagtccctcactgacag

SEQ ID NO: 63660 - DNA, 25 bp, Homo sapien
ctcactgacagacgtttccattgtt

SEQ ID NO: 63661 - DNA, 25 bp, Homo sapien
tgacagacgtttccattgtttcctg

SEQ ID NO: 63662 - DNA, 25 bp, Homo sapien
gacgtttccattgtttcctgtcttt

SEQ ID NO: 63663 - DNA, 25 bp, Homo sapien
gtttcctgtcttttgctataaataa

SEQ ID NO: 63664 - DNA, 25 bp, Homo sapien
attaatttatgggattacatctgca

SEQ ID NO: 63665 - DNA, 25 bp, Homo sapien
ggattacatctgcaggataaattct

SEQ ID NO: 63666 - DNA, 25 bp, Homo sapien
ataaattcttagaaccaatggtggt

SEQ ID NO: 63667 - DNA, 25 bp, Homo sapien
ataggtacaggattgggagactttt

SEQ ID NO: 63668 - DNA, 25 bp, Homo sapien
gctgtatactattccattgaatgga

SEQ ID NO: 63669 - DNA, 25 bp, Homo sapien
ggagaacgaagttctgtgacccagg

SEQ ID NO: 63670 - DNA, 25 bp, Homo sapien
ggtggagaatacactctaggtttgc

SEQ ID NO: 63671 - DNA, 25 bp, Homo sapien
atacactctaggtttgcgggctggt

SEQ ID NO: 63672 - DNA, 25 bp, Homo sapien
ggctggtgggctttcaaattggtac

SEQ ID NO: 63673 - DNA, 25 bp, Homo sapien
gggctttcaaattggtacttccaga

SEQ ID NO: 63674 - DNA, 25 bp, Homo sapien
agctgcttctgttgtgagcgaatca

SEQ ID NO: 63675 - DNA, 25 bp, Homo sapien
ttgtgagcgaatcagccaagagcct

SEQ ID NO: 63676 - DNA, 25 bp, Homo sapien
gcgaatcagccaagagcctgaggct

SEQ ID NO: 63677 - DNA, 25 bp, Homo sapien
aaaccaggtcagtgtaggccaagac

SEQ ID NO: 63678 - DNA, 25 bp, Homo sapien
gtgtaggccaagacttatggtctac

SEQ ID NO: 63679 - DNA, 25 bp, Homo sapien
acttatggtctacagattttggcgg

SEQ ID NO: 63680 - DNA, 25 bp, Homo sapien
ttgtcctctggcttattgcctcaga

SEQ ID NO: 63681 - DNA, 25 bp, Homo sapien
gcctcagagttgcaagatggttcct

SEQ ID NO: 63682 - DNA, 25 bp, Homo sapien
gatggttcctgaactgtcaggtatc

SEQ ID NO: 63683 - DNA, 25 bp, Homo sapien
ggtatcatgtctgctttctaagtgg

SEQ ID NO: 63684 - DNA, 25 bp, Homo sapien
gaggcaagcaactaggtacaatgtc

SEQ ID NO: 63685 - DNA, 25 bp, Homo sapien
atcaggaaagcaaagcttccccaga

SEQ ID NO: 63686 - DNA, 25 bp, Homo sapien
gagacgctcagcttgtatccattga

SEQ ID NO: 63687 - DNA, 25 bp, Homo sapien
gactggaagtctgtcacgtggctcc

SEQ ID NO: 63688 - DNA, 25 bp, Homo sapien
ccctagccgcacactagtgtgggaa

SEQ ID NO: 63689 - DNA, 25 bp, Homo sapien
attgagctaggcacattactctctg

SEQ ID NO: 63690 - DNA, 25 bp, Homo sapien
ggcacattactctctgaacgaaatt

SEQ ID NO: 63691 - DNA, 25 bp, Homo sapien
tcatatttttatgatattggcacac

SEQ ID NO: 63692 - DNA, 25 bp, Homo sapien
gatattggcacactgagaaattcat

SEQ ID NO: 63693 - DNA, 25 bp, Homo sapien
attggcacactgagaaattcatttt

SEQ ID NO: 63694 - DNA, 25 bp, Homo sapien
gaaattcattttgtagagctatgga

SEQ ID NO: 63695 - DNA, 25 bp, Homo sapien
gagctatggataaggcttgctatga

SEQ ID NO: 63696 - DNA, 25 bp, Homo sapien
atggataaggcttgctatgatttgc

SEQ ID NO: 63697 - DNA, 25 bp, Homo sapien
aaactattaacatattttcgtatat

SEQ ID NO: 63698 - DNA, 25 bp, Homo sapien
tcgtatatgagtaacaactttgctt

SEQ ID NO: 63699 - DNA, 25 bp, Homo sapien
atgagtaacaactttgcttaagtgt

SEQ ID NO: 63700 - DNA, 25 bp, Homo sapien
agtgtttatcttagttcagaaatac

SEQ ID NO: 63701 - DNA, 25 bp, Homo sapien
ttagttcagaaatacataatgtcat

SEQ ID NO: 63702 - DNA, 25 bp, Homo sapien
cctcaagtcctgacttttctggagc

SEQ ID NO: 63703 - DNA, 25 bp, Homo sapien
ttctggagctcagctgacatcaaga

SEQ ID NO: 63704 - DNA, 25 bp, Homo sapien
agctgacatcaagaaacctcatctt

SEQ ID NO: 63705 - DNA, 25 bp, Homo sapien
atcttgcctctatgttatttctaga

SEQ ID NO: 63706 - DNA, 25 bp, Homo sapien
aaaagctttcctgacccaagcaaag

SEQ ID NO: 63707 - DNA, 25 bp, Homo sapien
tcctgacccaagcaaagacacacat

SEQ ID NO: 63708 - DNA, 25 bp, Homo sapien
acttccaatgtctggacaactcctt

SEQ ID NO: 63709 - DNA, 25 bp, Homo sapien
acaactccttcctgttgagggtcga

SEQ ID NO: 63710 - DNA, 25 bp, Homo sapien
tccttcctgttgagggtcgagcctg

SEQ ID NO: 63711 - DNA, 25 bp, Homo sapien
tgtttctaaagatgttcagctccct

SEQ ID NO: 63712 - DNA, 25 bp, Homo sapien
agatgttcagctccctgtaatctga

SEQ ID NO: 63713 - DNA, 25 bp, Homo sapien
ggtacccatagccagtctcttccag

SEQ ID NO: 63714 - DNA, 25 bp, Homo sapien
gtctcttccagactcatagcatcag

SEQ ID NO: 63715 - DNA, 25 bp, Homo sapien
gactcatagcatcagtggataccat

SEQ ID NO: 63716 - DNA, 25 bp, Homo sapien
cagtggataccatgtggctgagaaa

SEQ ID NO: 63717 - DNA, 25 bp, Homo sapien
aaagaactgtttgagtgccattaag

SEQ ID NO: 63718 - DNA, 25 bp, Homo sapien
gccattaagaattctgcatcagact

SEQ ID NO: 63719 - DNA, 25 bp, Homo sapien
gcatcagacttagatacaagcctta

SEQ ID NO: 63720 - DNA, 25 bp, Homo sapien
acaagccttaccaacaattacagaa

SEQ ID NO: 63721 - DNA, 25 bp, Homo sapien
atgacacattacctttttagctatt

SEQ ID NO: 63722 - DNA, 25 bp, Homo sapien
cagctttaaagcatcataccatcat

SEQ ID NO: 63723 - DNA, 25 bp, Homo sapien
aaagcatcataccatcattttttaa

SEQ ID NO: 63724 - DNA, 25 bp, Homo sapien
gaagtgcaagaacgtggtgcccctc

SEQ ID NO: 63725 - DNA, 25 bp, Homo sapien
gcaagaacgtggtgcccctctatga

SEQ ID NO: 63726 - DNA, 25 bp, Homo sapien
tggtgcccctctatgacctgctgct

SEQ ID NO: 63727 - DNA, 25 bp, Homo sapien
tacatgcgcccactagccgtggagg

SEQ ID NO: 63728 - DNA, 25 bp, Homo sapien
gcatccgtggaggagacggaccaaa

SEQ ID NO: 63729 - DNA, 25 bp, Homo sapien
tggaggagacggaccaaagccactt

SEQ ID NO: 63730 - DNA, 25 bp, Homo sapien
gagacggaccaaagccacttggcca

SEQ ID NO: 63731 - DNA, 25 bp, Homo sapien
accaaagccacttggccactgcggg

SEQ ID NO: 63732 - DNA, 25 bp, Homo sapien
actgcgggctctacttcatcgcatt

SEQ ID NO: 63733 - DNA, 25 bp, Homo sapien
tacttcatcgcattccttgcaaaag

SEQ ID NO: 63734 - DNA, 25 bp, Homo sapien
ccttgcaaaagtattacatcacggg

SEQ ID NO: 63735 - DNA, 25 bp, Homo sapien
aatgccttgtcgtggtgccattccc

SEQ ID NO: 63736 - DNA, 25 bp, Homo sapien
agcgcctgacgatacgctcttctat

SEQ ID NO: 63737 - DNA, 25 bp, Homo sapien
acgatacgctcttctattgtcttat

SEQ ID NO: 63738 - DNA, 25 bp, Homo sapien
acgctcttctattgtcttattctgg

SEQ ID NO: 63739 - DNA, 25 bp, Homo sapien
ttctattgtcttattctggcaggtt

SEQ ID NO: 63740 - DNA, 25 bp, Homo sapien
tcacattttgagtgtccagaggaaa

SEQ ID NO: 63741 - DNA, 25 bp, Homo sapien
tgagtgtgtgacgttgctgcacgcc

SEQ ID NO: 63742 - DNA, 25 bp, Homo sapien
tgctgcacgcctgactctgtgcgag

SEQ ID NO: 63743 - DNA, 25 bp, Homo sapien
ctgtgcgagcttctttctgtgtata

SEQ ID NO: 63744 - DNA, 25 bp, Homo sapien
tccgtgtatatttttaatcccgaca

SEQ ID NO: 63745 - DNA, 25 bp, Homo sapien
gtatatttttaatcccgacagaaca

SEQ ID NO: 63746 - DNA, 25 bp, Homo sapien
aagtggaactaccatcttttattct

SEQ ID NO: 63747 - DNA, 25 bp, Homo sapien
tgaatttttatacatggcatacatt

SEQ ID NO: 63748 - DNA, 25 bp, Homo sapien
atggcatacatttttctagttcctt

SEQ ID NO: 63749 - DNA, 25 bp, Homo sapien
ttctagttccttctgcttgctttat

SEQ ID NO: 63750 - DNA, 25 bp, Homo sapien
ccttctgcttgctttattaactcaa

SEQ ID NO: 63751 - DNA, 25 bp, Homo sapien
tctagttctagtctgttgatctgcc

SEQ ID NO: 63752 - DNA, 25 bp, Homo sapien
tagtctgttgatctgccttttgttc

SEQ ID NO: 63753 - DNA, 25 bp, Homo sapien
tgccttttgttctcccaaaatgtac

SEQ ID NO: 63754 - DNA, 25 bp, Homo sapien
gttctcccaaaatgtacagtaattc

SEQ ID NO: 63755 - DNA, 25 bp, Homo sapien
atgtacagtaattccatttgtttgt

SEQ ID NO: 63756 - DNA, 25 bp, Homo sapien
gtagagactcatatcatggcctttt

SEQ ID NO: 63757 - DNA, 25 bp, Homo sapien
gcgccgggagcgctccccggaatga

SEQ ID NO: 63758 - DNA, 25 bp, Homo sapien
caccccaaggctggagccgctgcac

SEQ ID NO: 63759 - DNA, 25 bp, Homo sapien
aggccttggcaatgacgatccccca

SEQ ID NO: 63760 - DNA, 25 bp, Homo sapien
tggcaatgacgatcccccaaagagc

SEQ ID NO: 63761 - DNA, 25 bp, Homo sapien
caaagagcccgtctgcaccccagac

SEQ ID NO: 63762 - DNA, 25 bp, Homo sapien
cagctcctgggatccgggagtccat

SEQ ID NO: 63763 - DNA, 25 bp, Homo sapien
agctcctgggatccgggagtccatc

SEQ ID NO: 63764 - DNA, 25 bp, Homo sapien
ctgggatccgggagtccatcccggc

SEQ ID NO: 63765 - DNA, 25 bp, Homo sapien
tccttgtctcatccccgaagatccg

SEQ ID NO: 63766 - DNA, 25 bp, Homo sapien
tggcccctcagtgtccatgtcttga

SEQ ID NO: 63767 - DNA, 25 bp, Homo sapien
gcccctcagtgtccatgtcttgagc

SEQ ID NO: 63768 - DNA, 25 bp, Homo sapien
gaatgctgggtatgctctgtgacaa

SEQ ID NO: 63769 - DNA, 25 bp, Homo sapien
tgctctgtgacaaggctacgctgac

SEQ ID NO: 63770 - DNA, 25 bp, Homo sapien
gacaaggctacgctgacaatcagtt

SEQ ID NO: 63771 - DNA, 25 bp, Homo sapien
aatcagttaaacacaccggagaaga

SEQ ID NO: 63772 - DNA, 25 bp, Homo sapien
gaaccatttacatgcaccttatatt

SEQ ID NO: 63773 - DNA, 25 bp, Homo sapien
acatgcaccttatatttctgtgtac

SEQ ID NO: 63774 - DNA, 25 bp, Homo sapien
gtgtacacatctattctcaaagcta

SEQ ID NO: 63775 - DNA, 25 bp, Homo sapien
gggtatgaaagtgcctgccttgttt

SEQ ID NO: 63776 - DNA, 25 bp, Homo sapien
ctgccttgtttatagccacttgtga

SEQ ID NO: 63777 - DNA, 25 bp, Homo sapien
aaggcattccacacctaagaactag

SEQ ID NO: 63778 - DNA, 25 bp, Homo sapien
gtagccctgggtttaatgtcaaatc

SEQ ID NO: 63779 - DNA, 25 bp, Homo sapien
aaatgcctggtcagcaattcactgt

SEQ ID NO: 63780 - DNA, 25 bp, Homo sapien
agcaattcactgtcatgcacctatt

SEQ ID NO: 63781 - DNA, 25 bp, Homo sapien
cacctatttttagattgggcaggga

SEQ ID NO: 63782 - DNA, 25 bp, Homo sapien
ggaggagtcgtgatttttactttga

SEQ ID NO: 63783 - DNA, 25 bp, Homo sapien
atactatttcactgacgttactaag

SEQ ID NO: 63784 - DNA, 25 bp, Homo sapien
gacgttactaagcattgcagcacaa

SEQ ID NO: 63785 - DNA, 25 bp, Homo sapien
attcgttgggaaattgatgaccgga

SEQ ID NO: 63786 - DNA, 25 bp, Homo sapien
tgaccggaaactagaaagcccctat

SEQ ID NO: 63787 - DNA, 25 bp, Homo sapien
aagcccctataatgtggaatatgca

SEQ ID NO: 63788 - DNA, 25 bp, Homo sapien
gaaaccgtatactactttcactgcc

SEQ ID NO: 63789 - DNA, 25 bp, Homo sapien
actactttcactgccatgacactag

SEQ ID NO: 63790 - DNA, 25 bp, Homo sapien
tgggcccaggatttccacatcttgg

SEQ ID NO: 63791 - DNA, 25 bp, Homo sapien
gcccaggatttccacatcttggtga

SEQ ID NO: 63792 - DNA, 25 bp, Homo sapien
caggatttccacatcttggtgaagt

SEQ ID NO: 63793 - DNA, 25 bp, Homo sapien
atttccacatcttggtgaagttgcc

SEQ ID NO: 63794 - DNA, 25 bp, Homo sapien
tgtggtgaagctgagtttctgtcca

SEQ ID NO: 63795 - DNA, 25 bp, Homo sapien
tgaagctgagtttctgtccaatgag

SEQ ID NO: 63796 - DNA, 25 bp, Homo sapien
tccaatgagcaggaagattctgaga

SEQ ID NO: 63797 - DNA, 25 bp, Homo sapien
aagattctgagacatttcgcctgag

SEQ ID NO: 63798 - DNA, 25 bp, Homo sapien
gattctgagacatttcgcctgagat

SEQ ID NO: 63799 - DNA, 25 bp, Homo sapien
ttctgagacatttcgcctgagatat

SEQ ID NO: 63800 - DNA, 25 bp, Homo sapien
gatataagttgtactgcgtatgcag

SEQ ID NO: 63801 - DNA, 25 bp, Homo sapien
gccagagccaaaggccaggacagaa

SEQ ID NO: 63802 - DNA, 25 bp, Homo sapien
gccaggacagaaacgccgagaggaa

SEQ ID NO: 63803 - DNA, 25 bp, Homo sapien
gagaggaaccaagatgacccttgtt

SEQ ID NO: 63804 - DNA, 25 bp, Homo sapien
ttgagaatatcatgagtgccacggg

SEQ ID NO: 63805 - DNA, 25 bp, Homo sapien
tttcccccccagcagtgatgagtgg

SEQ ID NO: 63806 - DNA, 25 bp, Homo sapien
tagctgaagcccattggtttccacg

SEQ ID NO: 63807 - DNA, 25 bp, Homo sapien
agcccattggtttccacgatttcaa

SEQ ID NO: 63808 - DNA, 25 bp, Homo sapien
ggtttccacgatttcaattggctga

SEQ ID NO: 63809 - DNA, 25 bp, Homo sapien
acgatttcaattggctgagaaggca

SEQ ID NO: 63810 - DNA, 25 bp, Homo sapien
agagagctagctcctccctttcttt

SEQ ID NO: 63811 - DNA, 25 bp, Homo sapien
tttttccacctgagacttgtttata

SEQ ID NO: 63812 - DNA, 25 bp, Homo sapien
ggtgatacagagacgatactcaaat

SEQ ID NO: 63813 - DNA, 25 bp, Homo sapien
aactcttcattttgtgaattataga

SEQ ID NO: 63814 - DNA, 25 bp, Homo sapien
aactaaggagtgacatagaactgat

SEQ ID NO: 63815 - DNA, 25 bp, Homo sapien
gtaagttttgctggatttttgtaga

SEQ ID NO: 63816 - DNA, 25 bp, Homo sapien
gctggatttttgtagaactctggac

SEQ ID NO: 63817 - DNA, 25 bp, Homo sapien
gaactctggacgttgaggattcatt

SEQ ID NO: 63818 - DNA, 25 bp, Homo sapien
atatctgaattaatgagccttgtgt

SEQ ID NO: 63819 - DNA, 25 bp, Homo sapien
gaattaatgagccttgtgtttacaa

SEQ ID NO: 63820 - DNA, 25 bp, Homo sapien
aatatgtgccattgtgcaacatcgg

SEQ ID NO: 63821 - DNA, 25 bp, Homo sapien
gtgccattgtgcaacatcggtggat

SEQ ID NO: 63822 - DNA, 25 bp, Homo sapien
gtgcaacatcggtggattttctaaa

SEQ ID NO: 63823 - DNA, 25 bp, Homo sapien
gattctagtctctaaagttcttcac

SEQ ID NO: 63824 - DNA, 25 bp, Homo sapien
tctaaagttcttcacgttttctgac

SEQ ID NO: 63825 - DNA, 25 bp, Homo sapien
cgttttctgacattccctggagggt

SEQ ID NO: 63826 - DNA, 25 bp, Homo sapien
ctgacattccctggagggtgactgg

SEQ ID NO: 63827 - DNA, 25 bp, Homo sapien
aagaattgctccagggtagaagaac

SEQ ID NO: 63828 - DNA, 25 bp, Homo sapien
aggcccaagactttaccattctgat

SEQ ID NO: 63829 - DNA, 25 bp, Homo sapien
gactttaccattctgatctagagac

SEQ ID NO: 63830 - DNA, 25 bp, Homo sapien
gtaacagctattcccatattctagg

SEQ ID NO: 63831 - DNA, 25 bp, Homo sapien
attcccatattctaggagtggccta

SEQ ID NO: 63832 - DNA, 25 bp, Homo sapien
gagtggcctaagaaatgcgtgtttc

SEQ ID NO: 63833 - DNA, 25 bp, Homo sapien
atgcgtgtttcagtgactagattat

SEQ ID NO: 63834 - DNA, 25 bp, Homo sapien
agaggcctttgcttctctgcctacg

SEQ ID NO: 63835 - DNA, 25 bp, Homo sapien
tacgtccccttagatgggcagcaga

SEQ ID NO: 63836 - DNA, 25 bp, Homo sapien
gggcagcagaggcaactcccgcatc

SEQ ID NO: 63837 - DNA, 25 bp, Homo sapien
tttgctctgcctgtcggtggtcaga

SEQ ID NO: 63838 - DNA, 25 bp, Homo sapien
tggagactcagcaggctccgtgcag

SEQ ID NO: 63839 - DNA, 25 bp, Homo sapien
gaaggtcataacgagagtgggaact

SEQ ID NO: 63840 - DNA, 25 bp, Homo sapien
ggaaaccaaccaaaccgtgcgctgt

SEQ ID NO: 63841 - DNA, 25 bp, Homo sapien
aaaccgtgcgctgtgacccattgct

SEQ ID NO: 63842 - DNA, 25 bp, Homo sapien
tgtgacccattgctgttctctgtat

SEQ ID NO: 63843 - DNA, 25 bp, Homo sapien
tgctgttctctgtatcgtgatctat

SEQ ID NO: 63844 - DNA, 25 bp, Homo sapien
gtatcgtgatctatcctcaacaaca

SEQ ID NO: 63845 - DNA, 25 bp, Homo sapien
cctgaaagaggaggccttctcccgg

SEQ ID NO: 63846 - DNA, 25 bp, Homo sapien
ggtctccgtgtataacagctatcct

SEQ ID NO: 63847 - DNA, 25 bp, Homo sapien
tataacagctatccttactacccat

SEQ ID NO: 63848 - DNA, 25 bp, Homo sapien
ttactacccatacctgtactgcgtg

SEQ ID NO: 63849 - DNA, 25 bp, Homo sapien
tacctgtactgcgtgggcagctgga

SEQ ID NO: 63850 - DNA, 25 bp, Homo sapien
gctggagcccagctttttggtaatg

SEQ ID NO: 63851 - DNA, 25 bp, Homo sapien
ccagctttttggtaatgccagctca

SEQ ID NO: 63852 - DNA, 25 bp, Homo sapien
gccagctcaggtgacaaccattatg

SEQ ID NO: 63853 - DNA, 25 bp, Homo sapien
atgatcaaaaactgccttccccagg

SEQ ID NO: 63854 - DNA, 25 bp, Homo sapien
cttccccagggtgtctctatgaaaa

SEQ ID NO: 63855 - DNA, 25 bp, Homo sapien
aggtgtgcacaccaaagctattgga

SEQ ID NO: 63856 - DNA, 25 bp, Homo sapien
gtgggtcttgctcaatactgttcat

SEQ ID NO: 63857 - DNA, 25 bp, Homo sapien
caatactgttcatacctggagagag

SEQ ID NO: 63858 - DNA, 25 bp, Homo sapien
ggtattgaaacatctcctttatgtg

SEQ ID NO: 63859 - DNA, 25 bp, Homo sapien
tcctttatgtgtgactttcccaaat

SEQ ID NO: 63860 - DNA, 25 bp, Homo sapien
ttaggccccttaaatactgtgtagc

SEQ ID NO: 63861 - DNA, 25 bp, Homo sapien
agcaggatgaagtctaccattacca

SEQ ID NO: 63862 - DNA, 25 bp, Homo sapien
aagtctaccattaccagctgggtca

SEQ ID NO: 63863 - DNA, 25 bp, Homo sapien
gtcaccttggatgggtctgtcaaca

SEQ ID NO: 63864 - DNA, 25 bp, Homo sapien
gagggtagtccctacctcataaggg

SEQ ID NO: 63865 - DNA, 25 bp, Homo sapien
gagaaaatacctcccaagtgcctgg

SEQ ID NO: 63866 - DNA, 25 bp, Homo sapien
atacctcccaagtgcctggtacata

SEQ ID NO: 63867 - DNA, 25 bp, Homo sapien
acagaactaccatcggtgggccagt

SEQ ID NO: 63868 - DNA, 25 bp, Homo sapien
gttctgcctctctgacaaccatcag

SEQ ID NO: 63869 - DNA, 25 bp, Homo sapien
aaatgcccagcgtttgggtctgact

SEQ ID NO: 63870 - DNA, 25 bp, Homo sapien
gggtctgactctgagcctagggcta

SEQ ID NO: 63871 - DNA, 25 bp, Homo sapien
tgagcctagggctactgatcctcct

SEQ ID NO: 63872 - DNA, 25 bp, Homo sapien
gtccctctcctgtagtcagtctgag

SEQ ID NO: 63873 - DNA, 25 bp, Homo sapien
agtcagtctgagttctgatggtcag

SEQ ID NO: 63874 - DNA, 25 bp, Homo sapien
atacgaggtgttttgttctctctgc

SEQ ID NO: 63875 - DNA, 25 bp, Homo sapien
ttctctctgctgcttctacctttat

SEQ ID NO: 63876 - DNA, 25 bp, Homo sapien
ctacctttattgcagttccccaaat

SEQ ID NO: 63877 - DNA, 25 bp, Homo sapien
aatcgcctaataaactttcctcttg

SEQ ID NO: 63878 - DNA, 25 bp, Homo sapien
gtgatttcaaattaggtggccttat

SEQ ID NO: 63879 - DNA, 25 bp, Homo sapien
gatttcaaattaggtggccttataa

SEQ ID NO: 63880 - DNA, 25 bp, Homo sapien
attaggtggccttataaatataagc

SEQ ID NO: 63881 - DNA, 25 bp, Homo sapien
atataagcagatggtttctgggcaa

SEQ ID NO: 63882 - DNA, 25 bp, Homo sapien
taagcagatggtttctgggcaaaat

SEQ ID NO: 63883 - DNA, 25 bp, Homo sapien
agcagatggtttctgggcaaaatca

SEQ ID NO: 63884 - DNA, 25 bp, Homo sapien
gggcaaaatcaaatgatttctgtct

SEQ ID NO: 63885 - DNA, 25 bp, Homo sapien
gatttctgtctctattttcttgagt

SEQ ID NO: 63886 - DNA, 25 bp, Homo sapien
atttctgtctctattttcttgagta

SEQ ID NO: 63887 - DNA, 25 bp, Homo sapien
tttctgtctctattttcttgagtac

SEQ ID NO: 63888 - DNA, 25 bp, Homo sapien
attaggttgaggaaagtgctttaga

SEQ ID NO: 63889 - DNA, 25 bp, Homo sapien
ccctgtgtgcctcagggcagatata

SEQ ID NO: 63890 - DNA, 25 bp, Homo sapien
tcagggcagatatagcaagctcttt

SEQ ID NO: 63891 - DNA, 25 bp, Homo sapien
gcaagctctttcgaccatagttgat

SEQ ID NO: 63892 - DNA, 25 bp, Homo sapien
tgatggtaggacattttagactttg

SEQ ID NO: 63893 - DNA, 25 bp, Homo sapien
agctctgtacaaacacaaatacaca

SEQ ID NO: 63894 - DNA, 25 bp, Homo sapien
gtttcactacataacactgggcctt

SEQ ID NO: 63895 - DNA, 25 bp, Homo sapien
ataacactgggccttactgcatgtg

SEQ ID NO: 63896 - DNA, 25 bp, Homo sapien
gccttactgcatgtggttcattcta

SEQ ID NO: 63897 - DNA, 25 bp, Homo sapien
gtggttcattctagcatttctgttc

SEQ ID NO: 63898 - DNA, 25 bp, Homo sapien
atttctgttctgtgctgtgctaagc

SEQ ID NO: 63899 - DNA, 25 bp, Homo sapien
gctgtgctaagctatactactgtat

SEQ ID NO: 63900 - DNA, 25 bp, Homo sapien
ttttcccctgggttctgccgtcttg

SEQ ID NO: 63901 - DNA, 25 bp, Homo sapien
tgggttctgccgtcttgcctcactt

SEQ ID NO: 63902 - DNA, 25 bp, Homo sapien
tcctgtcacatgctgacgttggact

SEQ ID NO: 63903 - DNA, 25 bp, Homo sapien
gtcacatgctgacgttggacttagc

SEQ ID NO: 63904 - DNA, 25 bp, Homo sapien
gctgacgttggacttagcaggttct

SEQ ID NO: 63905 - DNA, 25 bp, Homo sapien
tgacgttggacttagcaggttctaa

SEQ ID NO: 63906 - DNA, 25 bp, Homo sapien
agcaggttctaaggccacatgtgtg

SEQ ID NO: 63907 - DNA, 25 bp, Homo sapien
ggttctaaggccacatgtgtgacct

SEQ ID NO: 63908 - DNA, 25 bp, Homo sapien
taaggccacatgtgtgacctctctg

SEQ ID NO: 63909 - DNA, 25 bp, Homo sapien
aaggcagctttccttaccctgacac

SEQ ID NO: 63910 - DNA, 25 bp, Homo sapien
ggcagctttccttaccctgacacag

SEQ ID NO: 63911 - DNA, 25 bp, Homo sapien
aaagatgagctttgccgtcagatgg

SEQ ID NO: 63912 - DNA, 25 bp, Homo sapien
ttgccgtcagatggctggtctgccc

SEQ ID NO: 63913 - DNA, 25 bp, Homo sapien
taggagactccgtcgctccaattac

SEQ ID NO: 63914 - DNA, 25 bp, Homo sapien
cgacttcctccctgtgaaaatgtgg

SEQ ID NO: 63915 - DNA, 25 bp, Homo sapien
tgaaaatgtggatttgcagagaccc

SEQ ID NO: 63916 - DNA, 25 bp, Homo sapien
agacccaatggtctgtgatcattga

SEQ ID NO: 63917 - DNA, 25 bp, Homo sapien
caaccattgacagctaacccttaga

SEQ ID NO: 63918 - DNA, 25 bp, Homo sapien
gctaacccttagacagtatttctta

SEQ ID NO: 63919 - DNA, 25 bp, Homo sapien
gacagtatttcttaaaccaatcctt

SEQ ID NO: 63920 - DNA, 25 bp, Homo sapien
ccaatccttttgcaatgtccagctt

SEQ ID NO: 63921 - DNA, 25 bp, Homo sapien
ttgcaatgtccagcttttaccccta

SEQ ID NO: 63922 - DNA, 25 bp, Homo sapien
aagcccaactcccagggctctggaa

SEQ ID NO: 63923 - DNA, 25 bp, Homo sapien
gggcttgagaggaacgcccacccac

SEQ ID NO: 63924 - DNA, 25 bp, Homo sapien
cagacggccccgaaaaggcgctcgg

SEQ ID NO: 63925 - DNA, 25 bp, Homo sapien
gggagcgtttaaaggacactgtaca

SEQ ID NO: 63926 - DNA, 25 bp, Homo sapien
ttaaaggacactgtacaggccctcc

SEQ ID NO: 63927 - DNA, 25 bp, Homo sapien
cccttggcctctaggaggaaacagt

SEQ ID NO: 63928 - DNA, 25 bp, Homo sapien
tggcctctaggaggaaacagttttt

SEQ ID NO: 63929 - DNA, 25 bp, Homo sapien
aagccagtctaaaggcctctggata

SEQ ID NO: 63930 - DNA, 25 bp, Homo sapien
taaaggcctctggatactgggctcc

SEQ ID NO: 63931 - DNA, 25 bp, Homo sapien
ggatactgggctccccagaactgct

SEQ ID NO: 63932 - DNA, 25 bp, Homo sapien
cccagaactgctggccacaggatgg

SEQ ID NO: 63933 - DNA, 25 bp, Homo sapien
gctgccccacaagtctattggcgag

SEQ ID NO: 63934 - DNA, 25 bp, Homo sapien
tctattggcgagtcagtgccagagc

SEQ ID NO: 63935 - DNA, 25 bp, Homo sapien
gccagagcctcgtatcatcatgtga

SEQ ID NO: 63936 - DNA, 25 bp, Homo sapien
agccccggttttcccatcagcaagg

SEQ ID NO: 63937 - DNA, 25 bp, Homo sapien
ggagtgctggcctgacacatcagaa

SEQ ID NO: 63938 - DNA, 25 bp, Homo sapien
gacacatcagaagaccctggacttg

SEQ ID NO: 63939 - DNA, 25 bp, Homo sapien
gaccctggacttgtcattatttgtc

SEQ ID NO: 63940 - DNA, 25 bp, Homo sapien
aagctgaagctgttggacacctgcc

SEQ ID NO: 63941 - DNA, 25 bp, Homo sapien
tgttggacacctgccttctcatgtg

SEQ ID NO: 63942 - DNA, 25 bp, Homo sapien
gtggacatcatctggcaggatccct

SEQ ID NO: 63943 - DNA, 25 bp, Homo sapien
agggccagggctgtatggaataata

SEQ ID NO: 63944 - DNA, 25 bp, Homo sapien
gagactagactaggtagagtagtta

SEQ ID NO: 63945 - DNA, 25 bp, Homo sapien
agagtagttaccaggagatgtgaat

SEQ ID NO: 63946 - DNA, 25 bp, Homo sapien
gagatgtgaatgtgcgtcaggtgat

SEQ ID NO: 63947 - DNA, 25 bp, Homo sapien
gcgtcaggtgatggatgggtttgtc

SEQ ID NO: 63948 - DNA, 25 bp, Homo sapien
gatgggtttgtcaagggaatcgtta

SEQ ID NO: 63949 - DNA, 25 bp, Homo sapien
catgtattccaaaaacgagtttata

SEQ ID NO: 63950 - DNA, 25 bp, Homo sapien
tcaaacggtttttacagcttagact

SEQ ID NO: 63951 - DNA, 25 bp, Homo sapien
gcttagactttgtacttactgccct

SEQ ID NO: 63952 - DNA, 25 bp, Homo sapien
ttagactttgtacttactgccctgc

SEQ ID NO: 63953 - DNA, 25 bp, Homo sapien
tttgtacttactgccctgcctgtga

SEQ ID NO: 63954 - DNA, 25 bp, Homo sapien
gcctgtgacagttgtatgccttcat

SEQ ID NO: 63955 - DNA, 25 bp, Homo sapien
atagactacaacttccactgtttcc

SEQ ID NO: 63956 - DNA, 25 bp, Homo sapien
actgtttccgaaaagctattcatga

SEQ ID NO: 63957 - DNA, 25 bp, Homo sapien
gggtgtgacttctcacaggagctgt

SEQ ID NO: 63958 - DNA, 25 bp, Homo sapien
caggagctgtggtcaccagactagt

SEQ ID NO: 63959 - DNA, 25 bp, Homo sapien
tagtgcctccagtctgaaagcgctg

SEQ ID NO: 63960 - DNA, 25 bp, Homo sapien
gaaagcgctgacacacaatggcacg

SEQ ID NO: 63961 - DNA, 25 bp, Homo sapien
gccacgaaacgccatctagtctgaa

SEQ ID NO: 63962 - DNA, 25 bp, Homo sapien
atctagtctgaatcccagcgtcggg

SEQ ID NO: 63963 - DNA, 25 bp, Homo sapien
ttactcttcactccagggtcggatg

SEQ ID NO: 63964 - DNA, 25 bp, Homo sapien
gatgccacgtgctacaggacatggg

SEQ ID NO: 63965 - DNA, 25 bp, Homo sapien
aatctggtgcctgttccactagaga

SEQ ID NO: 63966 - DNA, 25 bp, Homo sapien
gactcctgggccctgcttccctgaa

SEQ ID NO: 63967 - DNA, 25 bp, Homo sapien
gccagagaaggtcaccatgtaccac

SEQ ID NO: 63968 - DNA, 25 bp, Homo sapien
gagaaggtcaccatgtaccacacac

SEQ ID NO: 63969 - DNA, 25 bp, Homo sapien
aaggtcaccatgtaccacacaccaa

SEQ ID NO: 63970 - DNA, 25 bp, Homo sapien
ggtcaccatgtaccacacaccaaag

SEQ ID NO: 63971 - DNA, 25 bp, Homo sapien
tcaccatgtaccacacaccaaagaa

SEQ ID NO: 63972 - DNA, 25 bp, Homo sapien
ccatgtaccacacaccaaagaaggg

SEQ ID NO: 63973 - DNA, 25 bp, Homo sapien
acaggcagcttcttcggcagcctca

SEQ ID NO: 63974 - DNA, 25 bp, Homo sapien
agcttcttcggcagcctcacggcag

SEQ ID NO: 63975 - DNA, 25 bp, Homo sapien
ttcttcggcagcctcacggcagcaa

SEQ ID NO: 63976 - DNA, 25 bp, Homo sapien
aggctggggcccaacctagaaggca

SEQ ID NO: 63977 - DNA, 25 bp, Homo sapien
atcatcatctttgaagactgtagga

SEQ ID NO: 63978 - DNA, 25 bp, Homo sapien
aggaaccagtggtctatgtcccgac

SEQ ID NO: 63979 - DNA, 25 bp, Homo sapien
gtcccgaccactacttggcttgata

SEQ ID NO: 63980 - DNA, 25 bp, Homo sapien
acttggcttgatattgcttaatgaa

SEQ ID NO: 63981 - DNA, 25 bp, Homo sapien
aacagtattgtgaacagccagccac

SEQ ID NO: 63982 - DNA, 25 bp, Homo sapien
agccagccaccggagaagcagcagg

SEQ ID NO: 63983 - DNA, 25 bp, Homo sapien
cacctgtgttttgagaacctgatgg

SEQ ID NO: 63984 - DNA, 25 bp, Homo sapien
gaacctgatggaaggcatcgagcga

SEQ ID NO: 63985 - DNA, 25 bp, Homo sapien
ggcatcgagcgaaatcttcttacga

SEQ ID NO: 63986 - DNA, 25 bp, Homo sapien
acctgtcagcattccgtcgagaagt

SEQ ID NO: 63987 - DNA, 25 bp, Homo sapien
gaagaattccacttatggcgtgaat

SEQ ID NO: 63988 - DNA, 25 bp, Homo sapien
gtacaagctgtcattccaacaatag

SEQ ID NO: 63989 - DNA, 25 bp, Homo sapien
gactacacaagacacttcacaatgt

SEQ ID NO: 63990 - DNA, 25 bp, Homo sapien
gagagcataaaatctatcctaatta

SEQ ID NO: 63991 - DNA, 25 bp, Homo sapien
aatctatcctaattattggttctga

SEQ ID NO: 63992 - DNA, 25 bp, Homo sapien
gaattaacccatagatgtgaccatt

SEQ ID NO: 63993 - DNA, 25 bp, Homo sapien
agatgtgaccattgaccatattcat

SEQ ID NO: 63994 - DNA, 25 bp, Homo sapien
atatacagtttctctaataagggac

SEQ ID NO: 63995 - DNA, 25 bp, Homo sapien
aagggacttatatgtttatgcatta

SEQ ID NO: 63996 - DNA, 25 bp, Homo sapien
aaaatatgttccactaccagcctta

SEQ ID NO: 63997 - DNA, 25 bp, Homo sapien
tccactaccagccttacttgtttaa

SEQ ID NO: 63998 - DNA, 25 bp, Homo sapien
cactaccagccttacttgtttaata

SEQ ID NO: 63999 - DNA, 25 bp, Homo sapien
gtcttcgcaaaagctttcctcagca

SEQ ID NO: 64000 - DNA, 25 bp, Homo sapien
tcgcaaaagctttcctcagcacttt

SEQ ID NO: 64001 - DNA, 25 bp, Homo sapien
ggagagcatcctcccatccagtctg

SEQ ID NO: 64002 - DNA, 25 bp, Homo sapien
ccatccagtctgtggcaccagctaa

SEQ ID NO: 64003 - DNA, 25 bp, Homo sapien
agtctgtggcaccagctaacacgga

SEQ ID NO: 64004 - DNA, 25 bp, Homo sapien
gtggcaccagctaacacggatctga

SEQ ID NO: 64005 - DNA, 25 bp, Homo sapien
cagctaacacggatctgagagaagc

SEQ ID NO: 64006 - DNA, 25 bp, Homo sapien
tcctctgtgccaactccttgtggac

SEQ ID NO: 64007 - DNA, 25 bp, Homo sapien
gccaactccttgtggaccgcaagaa

SEQ ID NO: 64008 - DNA, 25 bp, Homo sapien
gtggaccgcaagaaagcatgacttt

SEQ ID NO: 64009 - DNA, 25 bp, Homo sapien
aaatgttcatggactattccatatt

SEQ ID NO: 64010 - DNA, 25 bp, Homo sapien
agggtggactccatccaggtgcaca

SEQ ID NO: 64011 - DNA, 25 bp, Homo sapien
aggccgtgactgtctcgaggcagcc

SEQ ID NO: 64012 - DNA, 25 bp, Homo sapien
aacgcctacaactcactgacaaggt

SEQ ID NO: 64013 - DNA, 25 bp, Homo sapien
ggctgaagcgtacgccctcgctaaa

SEQ ID NO: 64014 - DNA, 25 bp, Homo sapien
tacgccctcgctaaagccggacgta

SEQ ID NO: 64015 - DNA, 25 bp, Homo sapien
tttccacatccatgaagcccaatga

SEQ ID NO: 64016 - DNA, 25 bp, Homo sapien
tgaagcccaatgatgcgtgtacata

SEQ ID NO: 64017 - DNA, 25 bp, Homo sapien
atgatgcgtgtacataatcccaggg

SEQ ID NO: 64018 - DNA, 25 bp, Homo sapien
ggtcaggtgtcgaaccagcaggcaa

SEQ ID NO: 64019 - DNA, 25 bp, Homo sapien
aggtgcccgctcagctcagcaaggt

SEQ ID NO: 64020 - DNA, 25 bp, Homo sapien
agctcagcaaggttctcaactgcct

SEQ ID NO: 64021 - DNA, 25 bp, Homo sapien
gacacagactgtactctcagaactg

SEQ ID NO: 64022 - DNA, 25 bp, Homo sapien
gcaggaaaagcagtcaatcacagat

SEQ ID NO: 64023 - DNA, 25 bp, Homo sapien
atcacagatgagctcaaacagtgta

SEQ ID NO: 64024 - DNA, 25 bp, Homo sapien
aaaaacaacctgaagctgctccgag

SEQ ID NO: 64025 - DNA, 25 bp, Homo sapien
ataatccttccatattacaacccgt

SEQ ID NO: 64026 - DNA, 25 bp, Homo sapien
gtattcatcggcctattcctggctt

SEQ ID NO: 64027 - DNA, 25 bp, Homo sapien
ctggctttcctgttttggtgtttcg

SEQ ID NO: 64028 - DNA, 25 bp, Homo sapien
tttggtgtttcggtccattgtggta

SEQ ID NO: 64029 - DNA, 25 bp, Homo sapien
ctggccctggatgcccatgttggct

SEQ ID NO: 64030 - DNA, 25 bp, Homo sapien
gttggctgccctggttgcagtaaca

SEQ ID NO: 64031 - DNA, 25 bp, Homo sapien
ccctggttgcagtaacagccatcgt

SEQ ID NO: 64032 - DNA, 25 bp, Homo sapien
gttttacagagattgaagatacctg

SEQ ID NO: 64033 - DNA, 25 bp, Homo sapien
gaaagggctctgtttcaagaatttt

SEQ ID NO: 64034 - DNA, 25 bp, Homo sapien
gatctatgaaatctgtgtaggtttt

SEQ ID NO: 64035 - DNA, 25 bp, Homo sapien
taatacaaatcatcagtgcttttag

SEQ ID NO: 64036 - DNA, 25 bp, Homo sapien
tcatcagtgcttttagtacttcagt

SEQ ID NO: 64037 - DNA, 25 bp, Homo sapien
gtgcttttagtacttcagtgtttaa

SEQ ID NO: 64038 - DNA, 25 bp, Homo sapien
gtagataaccagattgttgcttttt

SEQ ID NO: 64039 - DNA, 25 bp, Homo sapien
taaaccaagcagttgaaatggctat

SEQ ID NO: 64040 - DNA, 25 bp, Homo sapien
gaaatggctataaagactgactcta

SEQ ID NO: 64041 - DNA, 25 bp, Homo sapien
gactgactctaaaccaagattctgc

SEQ ID NO: 64042 - DNA, 25 bp, Homo sapien
gactctaaaccaagattctgcaaat

SEQ ID NO: 64043 - DNA, 25 bp, Homo sapien
ttccctaaccgtctgcagaaggagc

SEQ ID NO: 64044 - DNA, 25 bp, Homo sapien
gagctaagcagcatgtgtcccaatg

SEQ ID NO: 64045 - DNA, 25 bp, Homo sapien
aatgacaccccgcaggtaaacgtgc

SEQ ID NO: 64046 - DNA, 25 bp, Homo sapien
ggtaaacgtgctgcctgaaagagac

SEQ ID NO: 64047 - DNA, 25 bp, Homo sapien
tcagggtttccaaccattgtgggtc

SEQ ID NO: 64048 - DNA, 25 bp, Homo sapien
tgggtccaccgctttgagtacgagg

SEQ ID NO: 64049 - DNA, 25 bp, Homo sapien
gagtacgaggaacacgggcctttct

SEQ ID NO: 64050 - DNA, 25 bp, Homo sapien
cttctgaacggcgacgaggatggac

SEQ ID NO: 64051 - DNA, 25 bp, Homo sapien
acgaggatggacactgcactggcag

SEQ ID NO: 64052 - DNA, 25 bp, Homo sapien
gcagtgcctaccctcgacagggtga

SEQ ID NO: 64053 - DNA, 25 bp, Homo sapien
ggtgagcgcactcctacacacaggg

SEQ ID NO: 64054 - DNA, 25 bp, Homo sapien
gtacaagctgtcattccaacaatag

SEQ ID NO: 64055 - DNA, 25 bp, Homo sapien
gctgtcattccaacaatagaatatg

SEQ ID NO: 64056 - DNA, 25 bp, Homo sapien
gaatatgactacacaagacacttca

SEQ ID NO: 64057 - DNA, 25 bp, Homo sapien
gactacacaagacacttcacaatgt

SEQ ID NO: 64058 - DNA, 25 bp, Homo sapien
gagagcataaaatctatcctaatta

SEQ ID NO: 64059 - DNA, 25 bp, Homo sapien
aatctatcctaattattggttctga

SEQ ID NO: 64060 - DNA, 25 bp, Homo sapien
ctatcctaattattggttctgattt

SEQ ID NO: 64061 - DNA, 25 bp, Homo sapien
agaattaacccatagatgtgaccat

SEQ ID NO: 64062 - DNA, 25 bp, Homo sapien
aacccatagatgtgaccattgacca

SEQ ID NO: 64063 - DNA, 25 bp, Homo sapien
agatgtgaccattgaccatattcat

SEQ ID NO: 64064 - DNA, 25 bp, Homo sapien
gtgaccattgaccatattcatcaat

SEQ ID NO: 64065 - DNA, 25 bp, Homo sapien
aataatgctgggaagtcctaaccac

SEQ ID NO: 64066 - DNA, 25 bp, Homo sapien
aatgctgggaagtcctaaccacatc

SEQ ID NO: 64067 - DNA, 25 bp, Homo sapien
gggaagtcctaaccacatcaagaat

SEQ ID NO: 64068 - DNA, 25 bp, Homo sapien
gaagtcctaaccacatcaagaatgc

SEQ ID NO: 64069 - DNA, 25 bp, Homo sapien
gtcctaaccacatcaagaatgcctc

SEQ ID NO: 64070 - DNA, 25 bp, Homo sapien
taaccacatcaagaatgcctcagat

SEQ ID NO: 64071 - DNA, 25 bp, Homo sapien
cacatcaagaatgcctcagatcagt

SEQ ID NO: 64072 - DNA, 25 bp, Homo sapien
atcaagaatgcctcagatcagtgac

SEQ ID NO: 64073 - DNA, 25 bp, Homo sapien
aagaatgcctcagatcagtgaccca

SEQ ID NO: 64074 - DNA, 25 bp, Homo sapien
gaatgcctcagatcagtgacccaag

SEQ ID NO: 64075 - DNA, 25 bp, Homo sapien
atgcctcagatcagtgacccaagga

SEQ ID NO: 64076 - DNA, 25 bp, Homo sapien
aagtttgaaatgactgagcaggaaa

SEQ ID NO: 64077 - DNA, 25 bp, Homo sapien
gagcaggaaaagcagtcaatcacag

SEQ ID NO: 64078 - DNA, 25 bp, Homo sapien
aaagcagtcaatcacagatgagctc

SEQ ID NO: 64079 - DNA, 25 bp, Homo sapien
tcaatcacagatgagctcaaacagt

SEQ ID NO: 64080 - DNA, 25 bp, Homo sapien
atcacagatgagctcaaacagtgta

SEQ ID NO: 64081 - DNA, 25 bp, Homo sapien
cagatgagctcaaacagtgtaaaaa

SEQ ID NO: 64082 - DNA, 25 bp, Homo sapien
gtgtaaaaacaacctgaagctgctc

SEQ ID NO: 64083 - DNA, 25 bp, Homo sapien
aaaaacaacctgaagctgctccgag

SEQ ID NO: 64084 - DNA, 25 bp, Homo sapien
aacaacctgaagctgctccgagaga

SEQ ID NO: 64085 - DNA, 25 bp, Homo sapien
aacctgaagctgctccgagagaaag

SEQ ID NO: 64086 - DNA, 25 bp, Homo sapien
ctggccctggatgcccatgttggct

SEQ ID NO: 64087 - DNA, 25 bp, Homo sapien
aacgtgctactgtgtggcggctgca

SEQ ID NO: 64088 - DNA, 25 bp, Homo sapien
gcggctgcactatgctggatggctt

SEQ ID NO: 64089 - DNA, 25 bp, Homo sapien
cttccccgagcgcttccagagggag

SEQ ID NO: 64090 - DNA, 25 bp, Homo sapien
gctgccgctcctgagaggaagacct

SEQ ID NO: 64091 - DNA, 25 bp, Homo sapien
aggccttccaacagctctgggtcag

SEQ ID NO: 64092 - DNA, 25 bp, Homo sapien
agctctgggtcagcaaggaagagtt

SEQ ID NO: 64093 - DNA, 25 bp, Homo sapien
tacagcaagtgctgagcctcggcat

SEQ ID NO: 64094 - DNA, 25 bp, Homo sapien
tgagcctcggcatttccacagacaa

SEQ ID NO: 64095 - DNA, 25 bp, Homo sapien
gcatttccacagacaaggcctccag

SEQ ID NO: 64096 - DNA, 25 bp, Homo sapien
aggcctccagcacagatggcacagg

SEQ ID NO: 64097 - DNA, 25 bp, Homo sapien
atggcacaggcctctctatacacat

SEQ ID NO: 64098 - DNA, 25 bp, Homo sapien
aaagcctcagatttactcctcatat

SEQ ID NO: 64099 - DNA, 25 bp, Homo sapien
tcctcatatcagaacaaccagcctt

SEQ ID NO: 64100 - DNA, 25 bp, Homo sapien
atcagaacaaccagccttctcattt

SEQ ID NO: 64101 - DNA, 25 bp, Homo sapien
cttctcatttttgcattagttcatg

SEQ ID NO: 64102 - DNA, 25 bp, Homo sapien
gcgagtatgttagcctggagcaaat

SEQ ID NO: 64103 - DNA, 25 bp, Homo sapien
gagcaaattgtgtatggcagcgagt

SEQ ID NO: 64104 - DNA, 25 bp, Homo sapien
ggcagcgagttacaaaccacagaaa

SEQ ID NO: 64105 - DNA, 25 bp, Homo sapien
caaaccacagaaaatgggtcattta

SEQ ID NO: 64106 - DNA, 25 bp, Homo sapien
gtggaaacactgacaacctttcaaa

SEQ ID NO: 64107 - DNA, 25 bp, Homo sapien
gttttgctttacctacagtgtttca

SEQ ID NO: 64108 - DNA, 25 bp, Homo sapien
cagtgtttcaattatttctttggta

SEQ ID NO: 64109 - DNA, 25 bp, Homo sapien
agttcccggatgagcagctgagcag

SEQ ID NO: 64110 - DNA, 25 bp, Homo sapien
agtctgacttcaggccaggaactca

SEQ ID NO: 64111 - DNA, 25 bp, Homo sapien
gaactcactgagattcccatacact

SEQ ID NO: 64112 - DNA, 25 bp, Homo sapien
agattcccatacactggacagccaa

SEQ ID NO: 64113 - DNA, 25 bp, Homo sapien
ggacagccaagttaccagccaagtg

SEQ ID NO: 64114 - DNA, 25 bp, Homo sapien
cagccaagtggtcagtctcagagtc

SEQ ID NO: 64115 - DNA, 25 bp, Homo sapien
atggccccagtccttgcagttgtgg

SEQ ID NO: 64116 - DNA, 25 bp, Homo sapien
agtccttattctgtggctctgatga

SEQ ID NO: 64117 - DNA, 25 bp, Homo sapien
tgtggctctgatgacccagttagtc

SEQ ID NO: 64118 - DNA, 25 bp, Homo sapien
gttagtcctgccagatgtcactgta

SEQ ID NO: 64119 - DNA, 25 bp, Homo sapien
gttcccctgttgtgcaggcacaaat

SEQ ID NO: 64120 - DNA, 25 bp, Homo sapien
atctcactcttctgacatcctgcag

SEQ ID NO: 64121 - DNA, 25 bp, Homo sapien
tctgggagtgtgacgttgtaatctt

SEQ ID NO: 64122 - DNA, 25 bp, Homo sapien
gttgtaatcttcatccgtctctatc

SEQ ID NO: 64123 - DNA, 25 bp, Homo sapien
aacttcctcctgtgagacagggaga

SEQ ID NO: 64124 - DNA, 25 bp, Homo sapien
tgtcaccaggataagaccacaggga

SEQ ID NO: 64125 - DNA, 25 bp, Homo sapien
gaaggaagagagctccacttacaaa

SEQ ID NO: 64126 - DNA, 25 bp, Homo sapien
gctccacttacaaagaactgcttct

SEQ ID NO: 64127 - DNA, 25 bp, Homo sapien
gggtatccttcaagtattgcatcag

SEQ ID NO: 64128 - DNA, 25 bp, Homo sapien
ttcaagtattgcatcagacagctct

SEQ ID NO: 64129 - DNA, 25 bp, Homo sapien
gacagctctgtagcctgacaagaaa

SEQ ID NO: 64130 - DNA, 25 bp, Homo sapien
gcctgacaagaaataaaaccacccg

SEQ ID NO: 64131 - DNA, 25 bp, Homo sapien
cactgtgatatgtactttgcagaca

SEQ ID NO: 64132 - DNA, 25 bp, Homo sapien
gacaacatcctttacactattcata

SEQ ID NO: 64133 - DNA, 25 bp, Homo sapien
acactattcatatgggatgtcatgg

SEQ ID NO: 64134 - DNA, 25 bp, Homo sapien
aatccttttcagtgtaatatatgtg

SEQ ID NO: 64135 - DNA, 25 bp, Homo sapien
aacaagtatgattttgcctgtcatt

SEQ ID NO: 64136 - DNA, 25 bp, Homo sapien
gcctgtcattttgcaagagggcaac

SEQ ID NO: 64137 - DNA, 25 bp, Homo sapien
gagggcaacataaccaacattgatt

SEQ ID NO: 64138 - DNA, 25 bp, Homo sapien
gtcatattttacttagttttgctgt

SEQ ID NO: 64139 - DNA, 25 bp, Homo sapien
tagttttgctgtttttgtggtttgg

SEQ ID NO: 64140 - DNA, 25 bp, Homo sapien
tgttttggtcatccctaataaagtg

SEQ ID NO: 64141 - DNA, 25 bp, Homo sapien
gtcatccctaataaagtgtctgcta

SEQ ID NO: 64142 - DNA, 25 bp, Homo sapien
ctactcggcaggctgcagcaggaaa

SEQ ID NO: 64143 - DNA, 25 bp, Homo sapien
tactcggcaggctgcagcaggaaaa

SEQ ID NO: 64144 - DNA, 25 bp, Homo sapien
actcggcaggctgcagcaggaaaat

SEQ ID NO: 64145 - DNA, 25 bp, Homo sapien
ctcggcaggctgcagcaggaaaatg

SEQ ID NO: 64146 - DNA, 25 bp, Homo sapien
caggctgcagcaggaaaatggcata

SEQ ID NO: 64147 - DNA, 25 bp, Homo sapien
aggctgcagcaggaaaatggcataa

SEQ ID NO: 64148 - DNA, 25 bp, Homo sapien
gctgcagcaggaaaatggcataaac

SEQ ID NO: 64149 - DNA, 25 bp, Homo sapien
ctgcagcaggaaaatggcataaacc

SEQ ID NO: 64150 - DNA, 25 bp, Homo sapien
tgcagcaggaaaatggcataaaccc

SEQ ID NO: 64151 - DNA, 25 bp, Homo sapien
gcagcaggaaaatggcataaacccg

SEQ ID NO: 64152 - DNA, 25 bp, Homo sapien
cagcaggaaaatggcataaacccgg

SEQ ID NO: 64153 - DNA, 25 bp, Homo sapien
ttgggctcccacataagcactagtc

SEQ ID NO: 64154 - DNA, 25 bp, Homo sapien
gcactagtctatagatgcctcttag

SEQ ID NO: 64155 - DNA, 25 bp, Homo sapien
tctatagatgcctcttaggactggt

SEQ ID NO: 64156 - DNA, 25 bp, Homo sapien
ggctgccacacggaagcaagcagat

SEQ ID NO: 64157 - DNA, 25 bp, Homo sapien
ctaatttcatttcaaggcagttttt

SEQ ID NO: 64158 - DNA, 25 bp, Homo sapien
cttggaaacagacggcggcaccttt

SEQ ID NO: 64159 - DNA, 25 bp, Homo sapien
acctttcctctaatccagcaaagtg

SEQ ID NO: 64160 - DNA, 25 bp, Homo sapien
aaagtgattccctgcacaccagaga

SEQ ID NO: 64161 - DNA, 25 bp, Homo sapien
agacaagcagagtaacaggatcagt

SEQ ID NO: 64162 - DNA, 25 bp, Homo sapien
gatcagtgggtctaagtgtccgaga

SEQ ID NO: 64163 - DNA, 25 bp, Homo sapien
gtgtccgagacttaacgaaaatagt

SEQ ID NO: 64164 - DNA, 25 bp, Homo sapien
tagcaggctggctccgcccggaaga

SEQ ID NO: 64165 - DNA, 25 bp, Homo sapien
tgaactggaagtccggttcaacgcc

SEQ ID NO: 64166 - DNA, 25 bp, Homo sapien
aacgccccctttgatgttggaatca

SEQ ID NO: 64167 - DNA, 25 bp, Homo sapien
gtttcttcaggacatcctctgggaa

SEQ ID NO: 64168 - DNA, 25 bp, Homo sapien
aaagaggccccagccgacaagtgat

SEQ ID NO: 64169 - DNA, 25 bp, Homo sapien
agccgacaagtgatcgcccacaagc

SEQ ID NO: 64170 - DNA, 25 bp, Homo sapien
aagtgatcgcccacaagccttactc

SEQ ID NO: 64171 - DNA, 25 bp, Homo sapien
ttactcacctctctctaagtttaga

SEQ ID NO: 64172 - DNA, 25 bp, Homo sapien
gtttagaagcgctcatctggctttt

SEQ ID NO: 64173 - DNA, 25 bp, Homo sapien
tcatctggcttttcgcttgcttctg

SEQ ID NO: 64174 - DNA, 25 bp, Homo sapien
ggcttttcgcttgcttctgcagcaa

SEQ ID NO: 64175 - DNA, 25 bp, Homo sapien
actggttgcatctggtggtgtcgca

SEQ ID NO: 64176 - DNA, 25 bp, Homo sapien
atctggtggtgtcgcaagtaacttc

SEQ ID NO: 64177 - DNA, 25 bp, Homo sapien
gtaacttctatatccgcagagctct

SEQ ID NO: 64178 - DNA, 25 bp, Homo sapien
gagctctggaaattttaacaaacgc

SEQ ID NO: 64179 - DNA, 25 bp, Homo sapien
acagtgcactttgttgtgtcctcct

SEQ ID NO: 64180 - DNA, 25 bp, Homo sapien
tcctcccagactatgcactgataat

SEQ ID NO: 64181 - DNA, 25 bp, Homo sapien
aagactacgtggtggcttgggcatt

SEQ ID NO: 64182 - DNA, 25 bp, Homo sapien
gtggcttgggcattttacatgacat

SEQ ID NO: 64183 - DNA, 25 bp, Homo sapien
gaaggcatccgctatgaaccaaaat

SEQ ID NO: 64184 - DNA, 25 bp, Homo sapien
gtcctcttggagtagacatatcaaa

SEQ ID NO: 64185 - DNA, 25 bp, Homo sapien
tggagatatgatttctgctgttcaa

SEQ ID NO: 64186 - DNA, 25 bp, Homo sapien
acctattgattcctcgtgattattt

SEQ ID NO: 64187 - DNA, 25 bp, Homo sapien
gattcctcgtgattatttccaatgt

SEQ ID NO: 64188 - DNA, 25 bp, Homo sapien
aaacagttgtgtatgattgcattaa

SEQ ID NO: 64189 - DNA, 25 bp, Homo sapien
aatcatatcatcttttagaggttag

SEQ ID NO: 64190 - DNA, 25 bp, Homo sapien
aaatgctacttgagattgcagtaag

SEQ ID NO: 64191 - DNA, 25 bp, Homo sapien
gaagatacgttttctaacctgaaag

SEQ ID NO: 64192 - DNA, 25 bp, Homo sapien
agttaaatcgcatttgttttcttca

SEQ ID NO: 64193 - DNA, 25 bp, Homo sapien
tagaatgggaatgtgttgctgttac

SEQ ID NO: 64194 - DNA, 25 bp, Homo sapien
tcatttttgttgcatgttatgggtc

SEQ ID NO: 64195 - DNA, 25 bp, Homo sapien
atgttatgggtcgatgttcctgtaa

SEQ ID NO: 64196 - DNA, 25 bp, Homo sapien
atgttcctgtaattgcagtgccgta

SEQ ID NO: 64197 - DNA, 25 bp, Homo sapien
caggctggagacgtttaaaagaccg

SEQ ID NO: 64198 - DNA, 25 bp, Homo sapien
taatatttttcctattggacaatgg

SEQ ID NO: 64199 - DNA, 25 bp, Homo sapien
ttttcctattggacaatggacttgc

SEQ ID NO: 64200 - DNA, 25 bp, Homo sapien
ttcctattggacaatggacttgcaa

SEQ ID NO: 64201 - DNA, 25 bp, Homo sapien
ctattggacaatggacttgcaaagc

SEQ ID NO: 64202 - DNA, 25 bp, Homo sapien
aaagaccccatgttgaaaactccat

SEQ ID NO: 64203 - DNA, 25 bp, Homo sapien
aagaccccatgttgaaaactccata

SEQ ID NO: 64204 - DNA, 25 bp, Homo sapien
gaccccatgttgaaaactccataac

SEQ ID NO: 64205 - DNA, 25 bp, Homo sapien
ccatgttgaaaactccataacagtt

SEQ ID NO: 64206 - DNA, 25 bp, Homo sapien
aactccataacagttttatgctgat

SEQ ID NO: 64207 - DNA, 25 bp, Homo sapien
acagttttatgctgatgataattta

SEQ ID NO: 64208 - DNA, 25 bp, Homo sapien
ctattcctaatcaacatggagtgga

SEQ ID NO: 64209 - DNA, 25 bp, Homo sapien
gtggagagtttattcactgtcttat

SEQ ID NO: 64210 - DNA, 25 bp, Homo sapien
gtttattcactgtcttatctgcaga

SEQ ID NO: 64211 - DNA, 25 bp, Homo sapien
atctgcagaaatttgctgtcaatat

SEQ ID NO: 64212 - DNA, 25 bp, Homo sapien
tgtcaatatataacccgcctgcagt

SEQ ID NO: 64213 - DNA, 25 bp, Homo sapien
cgcctgcagtggaaagtgtatagtg

SEQ ID NO: 64214 - DNA, 25 bp, Homo sapien
ttttgtaataaatggcctgatgcta

SEQ ID NO: 64215 - DNA, 25 bp, Homo sapien
gaaacttttttcttgatgagactca

SEQ ID NO: 64216 - DNA, 25 bp, Homo sapien
gagactcacagatctacacaaacta

SEQ ID NO: 64217 - DNA, 25 bp, Homo sapien
gttaattttcttgttacacccactg

SEQ ID NO: 64218 - DNA, 25 bp, Homo sapien
tgcactctgcaaccagtgttgcctg

SEQ ID NO: 64219 - DNA, 25 bp, Homo sapien
ctgtaggattttcttatgcactgca

SEQ ID NO: 64220 - DNA, 25 bp, Homo sapien
taggattttcttatgcactgcacac

SEQ ID NO: 64221 - DNA, 25 bp, Homo sapien
attttcttatgcactgcacactctg

SEQ ID NO: 64222 - DNA, 25 bp, Homo sapien
tttcttatgcactgcacactctgga

SEQ ID NO: 64223 - DNA, 25 bp, Homo sapien
tatgcactgcacactctggacctca

SEQ ID NO: 64224 - DNA, 25 bp, Homo sapien
ctggacctcacctgcagatacagtt

SEQ ID NO: 64225 - DNA, 25 bp, Homo sapien
ggacctcacctgcagatacagttcc

SEQ ID NO: 64226 - DNA, 25 bp, Homo sapien
atctgcatgtggtacttctcttttc

SEQ ID NO: 64227 - DNA, 25 bp, Homo sapien
tgcatgtggtacttctcttttccct

SEQ ID NO: 64228 - DNA, 25 bp, Homo sapien
tacttctcttttccctcagttgata

SEQ ID NO: 64229 - DNA, 25 bp, Homo sapien
aacctcagattttgttacctgtctt

SEQ ID NO: 64230 - DNA, 25 bp, Homo sapien
aagaaagtcacagcatcaatggagg

SEQ ID NO: 64231 - DNA, 25 bp, Homo sapien
acttcgagaagatttggaactctac

SEQ ID NO: 64232 - DNA, 25 bp, Homo sapien
tggaactctactataaaaaactgct

SEQ ID NO: 64233 - DNA, 25 bp, Homo sapien
aactgctcatgcaacttgaagccag

SEQ ID NO: 64234 - DNA, 25 bp, Homo sapien
gccagggagatcaagatgagaccaa

SEQ ID NO: 64235 - DNA, 25 bp, Homo sapien
ggcaaacatcacagactccaagaat

SEQ ID NO: 64236 - DNA, 25 bp, Homo sapien
tcacagactccaagaattacctaat

SEQ ID NO: 64237 - DNA, 25 bp, Homo sapien
aatccagatcactgaggtacagcat

SEQ ID NO: 64238 - DNA, 25 bp, Homo sapien
ggtacagcatgcaattgaccagctt

SEQ ID NO: 64239 - DNA, 25 bp, Homo sapien
gcatgcaattgaccagcttaagaga

SEQ ID NO: 64240 - DNA, 25 bp, Homo sapien
aacaagcagtttcagatttacgaac

SEQ ID NO: 64241 - DNA, 25 bp, Homo sapien
gcccagagggacaagatctaaaaaa

SEQ ID NO: 64242 - DNA, 25 bp, Homo sapien
aaaaatcttcagatactgggagaac

SEQ ID NO: 64243 - DNA, 25 bp, Homo sapien
aaaatcttcagatactgggagaaca

SEQ ID NO: 64244 - DNA, 25 bp, Homo sapien
aaatcttcagatactgggagaacaa

SEQ ID NO: 64245 - DNA, 25 bp, Homo sapien
gagaacaaatctcaattgctcaatt

SEQ ID NO: 64246 - DNA, 25 bp, Homo sapien
agaacaaatctcaattgctcaattg

SEQ ID NO: 64247 - DNA, 25 bp, Homo sapien
gaacaaatctcaattgctcaattgt

SEQ ID NO: 64248 - DNA, 25 bp, Homo sapien
acaaatctcaattgctcaattgtat

SEQ ID NO: 64249 - DNA, 25 bp, Homo sapien
aaatctcaattgctcaattgtatct

SEQ ID NO: 64250 - DNA, 25 bp, Homo sapien
atctcaattgctcaattgtatctta

SEQ ID NO: 64251 - DNA, 25 bp, Homo sapien
ctcaattgctcaattgtatcttatg

SEQ ID NO: 64252 - DNA, 25 bp, Homo sapien
ctttcccctaactgcatcagggaag

SEQ ID NO: 64253 - DNA, 25 bp, Homo sapien
actgcatcagggaagaattcttatc

SEQ ID NO: 64254 - DNA, 25 bp, Homo sapien
tcttatctctagcttggtttccaca

SEQ ID NO: 64255 - DNA, 25 bp, Homo sapien
ggtttccacatgaggtttttctgag

SEQ ID NO: 64256 - DNA, 25 bp, Homo sapien
gtttttctgagaagggcttgggaca

SEQ ID NO: 64257 - DNA, 25 bp, Homo sapien
agaagtctgtcatgttagttaagca

SEQ ID NO: 64258 - DNA, 25 bp, Homo sapien
ggcaagaaatcctactaatccagtt

SEQ ID NO: 64259 - DNA, 25 bp, Homo sapien
atcctactaatccagttttgtttga

SEQ ID NO: 64260 - DNA, 25 bp, Homo sapien
gaaagttgtttgtccgtatgatttt

SEQ ID NO: 64261 - DNA, 25 bp, Homo sapien
gagagacattttgtaaccctgtaaa

SEQ ID NO: 64262 - DNA, 25 bp, Homo sapien
tataacattccagtgtatacaaaga

SEQ ID NO: 64263 - DNA, 25 bp, Homo sapien
acagtcctgcctacgccaaagagga

SEQ ID NO: 64264 - DNA, 25 bp, Homo sapien
aggcccctccaaggaagtgcttcgg

SEQ ID NO: 64265 - DNA, 25 bp, Homo sapien
agtagtgagcctgtgaaggccttca

SEQ ID NO: 64266 - DNA, 25 bp, Homo sapien
tgagcctgtgaaggccttcaagtgt

SEQ ID NO: 64267 - DNA, 25 bp, Homo sapien
tgagcactgccgtatcctcttcctg

SEQ ID NO: 64268 - DNA, 25 bp, Homo sapien
ttcctggaccacgtcatgttcacta

SEQ ID NO: 64269 - DNA, 25 bp, Homo sapien
accacgtcatgttcactatccacat

SEQ ID NO: 64270 - DNA, 25 bp, Homo sapien
cttcagagacccttttgagtgcaac

SEQ ID NO: 64271 - DNA, 25 bp, Homo sapien
tttgagtgcaacatctgtggttatc

SEQ ID NO: 64272 - DNA, 25 bp, Homo sapien
ctgtggttatcacagccaggaccgg

SEQ ID NO: 64273 - DNA, 25 bp, Homo sapien
gaccggtacgaattctcttcccaca

SEQ ID NO: 64274 - DNA, 25 bp, Homo sapien
ctgaagctgccgctttggacaccaa

SEQ ID NO: 64275 - DNA, 25 bp, Homo sapien
ttctcccagggtcatgcagggatct

SEQ ID NO: 64276 - DNA, 25 bp, Homo sapien
ccagggtcatgcagggatctgctcc

SEQ ID NO: 64277 - DNA, 25 bp, Homo sapien
agtcgtgcaccgctgactcccagga

SEQ ID NO: 64278 - DNA, 25 bp, Homo sapien
gcaccgctgactcccaggaagtctt

SEQ ID NO: 64279 - DNA, 25 bp, Homo sapien
ggaagtcttccctgaagtctgacca

SEQ ID NO: 64280 - DNA, 25 bp, Homo sapien
ttccctgaagtctgaccacctttct

SEQ ID NO: 64281 - DNA, 25 bp, Homo sapien
tctgatcccttctgccctggcagaa

SEQ ID NO: 64282 - DNA, 25 bp, Homo sapien
ggtaatctgagccttcttcactcct

SEQ ID NO: 64283 - DNA, 25 bp, Homo sapien
ttcttcactcctttaccctagctga

SEQ ID NO: 64284 - DNA, 25 bp, Homo sapien
ggattcagaaaactgcttgtcagag

SEQ ID NO: 64285 - DNA, 25 bp, Homo sapien
gtggaacgtgtgatcaccattatgc

SEQ ID NO: 64286 - DNA, 25 bp, Homo sapien
accattatgcagaatccacgccagt

SEQ ID NO: 64287 - DNA, 25 bp, Homo sapien
aatccacgccagtacaagatcccag

SEQ ID NO: 64288 - DNA, 25 bp, Homo sapien
gatcccagactggttcttgaacaga

SEQ ID NO: 64289 - DNA, 25 bp, Homo sapien
acagccaggtcctagccaatggtct

SEQ ID NO: 64290 - DNA, 25 bp, Homo sapien
atggtctggacaacaagctccgtga

SEQ ID NO: 64291 - DNA, 25 bp, Homo sapien
tccgtgaagacctggagcgactgaa

SEQ ID NO: 64292 - DNA, 25 bp, Homo sapien
gacctggagcgactgaagaagattc

SEQ ID NO: 64293 - DNA, 25 bp, Homo sapien
attcgggcccatagagggctgcgtc

SEQ ID NO: 64294 - DNA, 25 bp, Homo sapien
ccatagagggctgcgtcacttctgg

SEQ ID NO: 64295 - DNA, 25 bp, Homo sapien
gtgtccgaggccagcacaccaagac

SEQ ID NO: 64296 - DNA, 25 bp, Homo sapien
tgtttgcttatacttcgggtaacct

SEQ ID NO: 64297 - DNA, 25 bp, Homo sapien
ttatacttcgggtaaccttgatatt

SEQ ID NO: 64298 - DNA, 25 bp, Homo sapien
gattagggcctacattgtttatcgc

SEQ ID NO: 64299 - DNA, 25 bp, Homo sapien
gggcctacattgtttatcgcaatta

SEQ ID NO: 64300 - DNA, 25 bp, Homo sapien
gtttatcgcaattacttgtatcatt

SEQ ID NO: 64301 - DNA, 25 bp, Homo sapien
tcattgatacgggatttctttgtaa

SEQ ID NO: 64302 - DNA, 25 bp, Homo sapien
gatttctttgtaaagcatcctctac

SEQ ID NO: 64303 - DNA, 25 bp, Homo sapien
tgctgaaagctagacctttggtatt

SEQ ID NO: 64304 - DNA, 25 bp, Homo sapien
agacctttggtattttccatgctat

SEQ ID NO: 64305 - DNA, 25 bp, Homo sapien
ggtattttccatgctataattctta

SEQ ID NO: 64306 - DNA, 25 bp, Homo sapien
tgctataattcttatggctgctgaa

SEQ ID NO: 64307 - DNA, 25 bp, Homo sapien
accagtggcaagtgcaggcagctgt

SEQ ID NO: 64308 - DNA, 25 bp, Homo sapien
agtggcaagtgcaggcagctgtccc

SEQ ID NO: 64309 - DNA, 25 bp, Homo sapien
aagtgcaggcagctgtcccggttat

SEQ ID NO: 64310 - DNA, 25 bp, Homo sapien
agctgtcccggttatgccggaatca

SEQ ID NO: 64311 - DNA, 25 bp, Homo sapien
cggttatgccggaatcattgcaggt

SEQ ID NO: 64312 - DNA, 25 bp, Homo sapien
gaatcattgcaggtgagtccatcag

SEQ ID NO: 64313 - DNA, 25 bp, Homo sapien
attgcaggtgagtccatcagaaaca

SEQ ID NO: 64314 - DNA, 25 bp, Homo sapien
caggtgagtccatcagaaacaggag

SEQ ID NO: 64315 - DNA, 25 bp, Homo sapien
atcccctcgaagagcctggccagag

SEQ ID NO: 64316 - DNA, 25 bp, Homo sapien
ccctgaaggctacctggcgccttgg

SEQ ID NO: 64317 - DNA, 25 bp, Homo sapien
gggctgtccctcaagttatctcctc

SEQ ID NO: 64318 - DNA, 25 bp, Homo sapien
ttttcttccaagatgacctccattc

SEQ ID NO: 64319 - DNA, 25 bp, Homo sapien
tccattctcggcagacctaagagtt

SEQ ID NO: 64320 - DNA, 25 bp, Homo sapien
agagttgcctctgagttagctcttt

SEQ ID NO: 64321 - DNA, 25 bp, Homo sapien
ttagctctttggaatcgtgaacaca

SEQ ID NO: 64322 - DNA, 25 bp, Homo sapien
cacaggtgtgctatattgtccttgt

SEQ ID NO: 64323 - DNA, 25 bp, Homo sapien
ttgtcctaactgtcacttgccatgg

SEQ ID NO: 64324 - DNA, 25 bp, Homo sapien
tgccatggcctgaatgttggcttaa

SEQ ID NO: 64325 - DNA, 25 bp, Homo sapien
aagacatgcctccatatgtgccttt

SEQ ID NO: 64326 - DNA, 25 bp, Homo sapien
atatgtgcctttctgttagctctct

SEQ ID NO: 64327 - DNA, 25 bp, Homo sapien
gttagctctctttgactcaagctgt

SEQ ID NO: 64328 - DNA, 25 bp, Homo sapien
ggctcctctatacatgctatacatg

SEQ ID NO: 64329 - DNA, 25 bp, Homo sapien
gtccacattttcatttaggagctag

SEQ ID NO: 64330 - DNA, 25 bp, Homo sapien
tttcatttaggagctagactaccat

SEQ ID NO: 64331 - DNA, 25 bp, Homo sapien
gctagactaccataacaatgcttat

SEQ ID NO: 64332 - DNA, 25 bp, Homo sapien
gcttatgctgtttccaagggtaggt

SEQ ID NO: 64333 - DNA, 25 bp, Homo sapien
tgctgtttccaagggtaggttattt

SEQ ID NO: 64334 - DNA, 25 bp, Homo sapien
ttaattcttcatagctgaaagcaca

SEQ ID NO: 64335 - DNA, 25 bp, Homo sapien
gcacaaatttaacggcttcactgga

SEQ ID NO: 64336 - DNA, 25 bp, Homo sapien
acggcttcactggacagttttcctt

SEQ ID NO: 64337 - DNA, 25 bp, Homo sapien
aaggtagttttgtgtgactgtgact

SEQ ID NO: 64338 - DNA, 25 bp, Homo sapien
gtgtgactgtgactaaactatttta

SEQ ID NO: 64339 - DNA, 25 bp, Homo sapien
ggaaagactgatcttatatgtgtat

SEQ ID NO: 64340 - DNA, 25 bp, Homo sapien
agaagctgtgctgccacggcaggcc

SEQ ID NO: 64341 - DNA, 25 bp, Homo sapien
gtggaggtcctgtccacagctggac

SEQ ID NO: 64342 - DNA, 25 bp, Homo sapien
gagacaccgcctgcggtggttcatt

SEQ ID NO: 64343 - DNA, 25 bp, Homo sapien
gtggttcattcctttcagccatcgt

SEQ ID NO: 64344 - DNA, 25 bp, Homo sapien
ggcggacagctgcttacatgttcat

SEQ ID NO: 64345 - DNA, 25 bp, Homo sapien
agctgcttacatgttcatctcttgc

SEQ ID NO: 64346 - DNA, 25 bp, Homo sapien
atctcttgccaaataagggtcccct

SEQ ID NO: 64347 - DNA, 25 bp, Homo sapien
aataagggtcccctcctcactggag

SEQ ID NO: 64348 - DNA, 25 bp, Homo sapien
ctcctcactggagactacaagtggt

SEQ ID NO: 64349 - DNA, 25 bp, Homo sapien
actggagactacaagtggtgggtca

SEQ ID NO: 64350 - DNA, 25 bp, Homo sapien
gagatctaagatgtcccaggtcctg

SEQ ID NO: 64351 - DNA, 25 bp, Homo sapien
tcagacggatgggtgactagaccca

SEQ ID NO: 64352 - DNA, 25 bp, Homo sapien
gactagacccatgaagaggaactct

SEQ ID NO: 64353 - DNA, 25 bp, Homo sapien
agaggaactcttcttgcactctgag

SEQ ID NO: 64354 - DNA, 25 bp, Homo sapien
tcttcttgcactctgagctggccag

SEQ ID NO: 64355 - DNA, 25 bp, Homo sapien
gctgcagagcagtgagcctacatct

SEQ ID NO: 64356 - DNA, 25 bp, Homo sapien
agagcagtgagcctacatctgccac

SEQ ID NO: 64357 - DNA, 25 bp, Homo sapien
gctcacagccttctacatggtgcta

SEQ ID NO: 64358 - DNA, 25 bp, Homo sapien
ccttctacatggtgctactgctctt

SEQ ID NO: 64359 - DNA, 25 bp, Homo sapien
tgagggctcaggacacaggcccagc

SEQ ID NO: 64360 - DNA, 25 bp, Homo sapien
cacaggccgctgcataacagcgata

SEQ ID NO: 64361 - DNA, 25 bp, Homo sapien
acagcgatacagtacttaagtgtct

SEQ ID NO: 64362 - DNA, 25 bp, Homo sapien
caatctcccaagtattgatttaact

SEQ ID NO: 64363 - DNA, 25 bp, Homo sapien
ataaactatattctgtgacatgcta

SEQ ID NO: 64364 - DNA, 25 bp, Homo sapien
ttctgtgacatgctaattattatta

SEQ ID NO: 64365 - DNA, 25 bp, Homo sapien
gtaagtcgttagttcgaaagcctct

SEQ ID NO: 64366 - DNA, 25 bp, Homo sapien
gttcgaaagcctctcactaagtatg

SEQ ID NO: 64367 - DNA, 25 bp, Homo sapien
gcctctcactaagtatgatctatgc

SEQ ID NO: 64368 - DNA, 25 bp, Homo sapien
tgctatattcaaaattcaacccatt

SEQ ID NO: 64369 - DNA, 25 bp, Homo sapien
acccatttactttggtcaatatttg

SEQ ID NO: 64370 - DNA, 25 bp, Homo sapien
gtcaatatttgatctaagttgcatc

SEQ ID NO: 64371 - DNA, 25 bp, Homo sapien
agttgcatctttaatcctggtggtc

SEQ ID NO: 64372 - DNA, 25 bp, Homo sapien
taatcctggtggtcttgccttctga

SEQ ID NO: 64373 - DNA, 25 bp, Homo sapien
gttttcttcatttctcttgctcacc

SEQ ID NO: 64374 - DNA, 25 bp, Homo sapien
atagttttgacagagttggtgttca

SEQ ID NO: 64375 - DNA, 25 bp, Homo sapien
gttggtgttcataatttcagttcta

SEQ ID NO: 64376 - DNA, 25 bp, Homo sapien
atttcagttctagttgattgcgaga

SEQ ID NO: 64377 - DNA, 25 bp, Homo sapien
gattgcgagaattttcaaataagga

SEQ ID NO: 64378 - DNA, 25 bp, Homo sapien
gaagaggggtcttttatccttgtcg

SEQ ID NO: 64379 - DNA, 25 bp, Homo sapien
ttatccttgtcgtaggaaaaccatg

SEQ ID NO: 64380 - DNA, 25 bp, Homo sapien
cttgtcgtaggaaaaccatgacgga

SEQ ID NO: 64381 - DNA, 25 bp, Homo sapien
accatgacggaaaggaaaaactgat

SEQ ID NO: 64382 - DNA, 25 bp, Homo sapien
ttatttatgtaggatctgtcaaaga

SEQ ID NO: 64383 - DNA, 25 bp, Homo sapien
tgtaggatctgtcaaagaaaacttc

SEQ ID NO: 64384 - DNA, 25 bp, Homo sapien
tccactgcagagcttttatccatat

SEQ ID NO: 64385 - DNA, 25 bp, Homo sapien
tgcagagcttttatccatatggtat

SEQ ID NO: 64386 - DNA, 25 bp, Homo sapien
agcttttatccatatggtatgcaca

SEQ ID NO: 64387 - DNA, 25 bp, Homo sapien
cacatgtagccaatattggtttctt

SEQ ID NO: 64388 - DNA, 25 bp, Homo sapien
gggagggcgttgacaccattcccca

SEQ ID NO: 64389 - DNA, 25 bp, Homo sapien
accattccccacagagatagtcatg

SEQ ID NO: 64390 - DNA, 25 bp, Homo sapien
ccacagagatagtcatgctgagtgt

SEQ ID NO: 64391 - DNA, 25 bp, Homo sapien
tgctgagtgtgggttgtttaaacat

SEQ ID NO: 64392 - DNA, 25 bp, Homo sapien
aacacatatagtaacgtgggaatac

SEQ ID NO: 64393 - DNA, 25 bp, Homo sapien
tatactttctatactgtagattgtg

SEQ ID NO: 64394 - DNA, 25 bp, Homo sapien
ctgtagattgtgtatgttatgtgtt

SEQ ID NO: 64395 - DNA, 25 bp, Homo sapien
gggtataatctaatcttcattgttt

SEQ ID NO: 64396 - DNA, 25 bp, Homo sapien
ttgtttaaatggtttgccttctcac

SEQ ID NO: 64397 - DNA, 25 bp, Homo sapien
atggtttgccttctcaccattgaag

SEQ ID NO: 64398 - DNA, 25 bp, Homo sapien
gccttctcaccattgaagccatttt

SEQ ID NO: 64399 - DNA, 25 bp, Homo sapien
agaggaaataatgcctccaccattt

SEQ ID NO: 64400 - DNA, 25 bp, Homo sapien
aaataatgcctccaccattttctac

SEQ ID NO: 64401 - DNA, 25 bp, Homo sapien
caccattttctacctggtgacttga

SEQ ID NO: 64402 - DNA, 25 bp, Homo sapien
gagtcagggaacttgtataccacta

SEQ ID NO: 64403 - DNA, 25 bp, Homo sapien
gtataccactatctatgcagcattg

SEQ ID NO: 64404 - DNA, 25 bp, Homo sapien
ctatgcagcattgttatagtctgat

SEQ ID NO: 64405 - DNA, 25 bp, Homo sapien
atagtctgattatttctgtgttttg

SEQ ID NO: 64406 - DNA, 25 bp, Homo sapien
tctcttgctgttaaatcagttctgt

SEQ ID NO: 64407 - DNA, 25 bp, Homo sapien
aaatcagttctgtccttggcaactt

SEQ ID NO: 64408 - DNA, 25 bp, Homo sapien
gtccttggcaactttcttctgatat

SEQ ID NO: 64409 - DNA, 25 bp, Homo sapien
ggcaactttcttctgatatctgaat

SEQ ID NO: 64410 - DNA, 25 bp, Homo sapien
atctgaatgttcatgaaggtcctag

SEQ ID NO: 64411 - DNA, 25 bp, Homo sapien
gaaggtcctagctttatattgtccc

SEQ ID NO: 64412 - DNA, 25 bp, Homo sapien
tagctttatattgtccctcttttag

SEQ ID NO: 64413 - DNA, 25 bp, Homo sapien
gaaacctcaacaaagtccagccatt

SEQ ID NO: 64414 - DNA, 25 bp, Homo sapien
aaagtccagccattgaacatggaag

SEQ ID NO: 64415 - DNA, 25 bp, Homo sapien
aaactccacatcaaaggctcatctg

SEQ ID NO: 64416 - DNA, 25 bp, Homo sapien
atagccatgcatttgatttgtttag

SEQ ID NO: 64417 - DNA, 25 bp, Homo sapien
gattgagtccaataccagaagaagt

SEQ ID NO: 64418 - DNA, 25 bp, Homo sapien
gaagaagttccaaagagtactctag

SEQ ID NO: 64419 - DNA, 25 bp, Homo sapien
agaaaagcctggctctcctgaggca

SEQ ID NO: 64420 - DNA, 25 bp, Homo sapien
tcctgaggcagctgaaacttctcca

SEQ ID NO: 64421 - DNA, 25 bp, Homo sapien
aacttctccaccatctaatatcatt

SEQ ID NO: 64422 - DNA, 25 bp, Homo sapien
actgtgagaaactagcctcagaaaa

SEQ ID NO: 64423 - DNA, 25 bp, Homo sapien
gaagtggtagaatgccagagtacaa

SEQ ID NO: 64424 - DNA, 25 bp, Homo sapien
ctgttggtggccagtctgtgaaaaa

SEQ ID NO: 64425 - DNA, 25 bp, Homo sapien
agaggattctgagttcacaaaggta

SEQ ID NO: 64426 - DNA, 25 bp, Homo sapien
gataatctggacaatgcccagacct

SEQ ID NO: 64427 - DNA, 25 bp, Homo sapien
gcccagacctctggcatagaggagc

SEQ ID NO: 64428 - DNA, 25 bp, Homo sapien
gtggatggccgtggatgcgcagtgc

SEQ ID NO: 64429 - DNA, 25 bp, Homo sapien
agtgccttgcatacccaaaccaggt

SEQ ID NO: 64430 - DNA, 25 bp, Homo sapien
caaaccaggtgggagcgttttgttg

SEQ ID NO: 64431 - DNA, 25 bp, Homo sapien
tgggagcgttttgttgagcatgaca

SEQ ID NO: 64432 - DNA, 25 bp, Homo sapien
atatgtgtgcctatttgtgtggaca

SEQ ID NO: 64433 - DNA, 25 bp, Homo sapien
acacttagggtttggagctattcaa

SEQ ID NO: 64434 - DNA, 25 bp, Homo sapien
tgagcaccctctggattctgaatct

SEQ ID NO: 64435 - DNA, 25 bp, Homo sapien
gcaccctctggattctgaatctcaa

SEQ ID NO: 64436 - DNA, 25 bp, Homo sapien
ctgctgagtcatctgttagggcctt

SEQ ID NO: 64437 - DNA, 25 bp, Homo sapien
agtcatctgttagggccttggttca

SEQ ID NO: 64438 - DNA, 25 bp, Homo sapien
agggccttggttcaataaagcactg

SEQ ID NO: 64439 - DNA, 25 bp, Homo sapien
gtctgcagaggagccgtggactcaa

SEQ ID NO: 64440 - DNA, 25 bp, Homo sapien
agccgtggactcaaaatcaacagaa

SEQ ID NO: 64441 - DNA, 25 bp, Homo sapien
agaaacttctggaactggcgttgca

SEQ ID NO: 64442 - DNA, 25 bp, Homo sapien
gaactggcgttgcagcagtacccaa

SEQ ID NO: 64443 - DNA, 25 bp, Homo sapien
atcctctgaccgctgggacaaaata

SEQ ID NO: 64444 - DNA, 25 bp, Homo sapien
aaatagccagatgtgtcccgtccaa

SEQ ID NO: 64445 - DNA, 25 bp, Homo sapien
gatgtgtcccgtccaagagcaagga

SEQ ID NO: 64446 - DNA, 25 bp, Homo sapien
aggaagactgtatcgctaggtacaa

SEQ ID NO: 64447 - DNA, 25 bp, Homo sapien
tacaagttgctggttgaactggtcc

SEQ ID NO: 64448 - DNA, 25 bp, Homo sapien
ttctgggagatgatgttcaccttca

SEQ ID NO: 64449 - DNA, 25 bp, Homo sapien
gcattttgtacctcaatatttctac

SEQ ID NO: 64450 - DNA, 25 bp, Homo sapien
gtgtgagttatcagccactcaggct

SEQ ID NO: 64451 - DNA, 25 bp, Homo sapien
aggctccgagccagctggattctct

SEQ ID NO: 64452 - DNA, 25 bp, Homo sapien
cactgtcagggttaagcggcaggca

SEQ ID NO: 64453 - DNA, 25 bp, Homo sapien
aggattgggcttttctggcttctac

SEQ ID NO: 64454 - DNA, 25 bp, Homo sapien
tggcttctaccatgaaatcctggcc

SEQ ID NO: 64455 - DNA, 25 bp, Homo sapien
gaaatcctggccatgggaccccagt

SEQ ID NO: 64456 - DNA, 25 bp, Homo sapien
gtgacagatgatgtcttccatggtc

SEQ ID NO: 64457 - DNA, 25 bp, Homo sapien
atcagtgacctcagtagcctcaaat

SEQ ID NO: 64458 - DNA, 25 bp, Homo sapien
tcaaatcatggtgagggctgggctt

SEQ ID NO: 64459 - DNA, 25 bp, Homo sapien
tgtcctcttctcacgcaaagttctg

SEQ ID NO: 64460 - DNA, 25 bp, Homo sapien
aagttctgccaggaaggtgtgctgt

SEQ ID NO: 64461 - DNA, 25 bp, Homo sapien
gagagagcaggttccatagctcagc

SEQ ID NO: 64462 - DNA, 25 bp, Homo sapien
ggttccatagctcagcacttttaag

SEQ ID NO: 64463 - DNA, 25 bp, Homo sapien
ttgaatctcagtcttcagcctgcac

SEQ ID NO: 64464 - DNA, 25 bp, Homo sapien
ttcagcctgcactgatttgtagcct

SEQ ID NO: 64465 - DNA, 25 bp, Homo sapien
tgatttgtagcctgcactgtcttac

SEQ ID NO: 64466 - DNA, 25 bp, Homo sapien
gcactgtcttactgatttacaaact

SEQ ID NO: 64467 - DNA, 25 bp, Homo sapien
gagaaatgtctttagttcagtgaga

SEQ ID NO: 64468 - DNA, 25 bp, Homo sapien
gaagaaaccagaacacttgttccta

SEQ ID NO: 64469 - DNA, 25 bp, Homo sapien
cttgttcctagtgttgtgttgtttt

SEQ ID NO: 64470 - DNA, 25 bp, Homo sapien
aaagtgttacaacggcttctaatga

SEQ ID NO: 64471 - DNA, 25 bp, Homo sapien
gcttctaatgaagtccggtatttaa

SEQ ID NO: 64472 - DNA, 25 bp, Homo sapien
atgtatgcggactcagaaatgtgag

SEQ ID NO: 64473 - DNA, 25 bp, Homo sapien
tgcctttgagaccaaaccaagtgct

SEQ ID NO: 64474 - DNA, 25 bp, Homo sapien
ttgagaccaaaccaagtgcttccaa

SEQ ID NO: 64475 - DNA, 25 bp, Homo sapien
caaattcttttggtgcaattgagga

SEQ ID NO: 64476 - DNA, 25 bp, Homo sapien
tttggtgcaattgaggagatatgcc

SEQ ID NO: 64477 - DNA, 25 bp, Homo sapien
gagatatgccagatgcttaaacaca

SEQ ID NO: 64478 - DNA, 25 bp, Homo sapien
atgccagatgcttaaacacatttaa

SEQ ID NO: 64479 - DNA, 25 bp, Homo sapien
aacacatttaattgctgtcagatta

SEQ ID NO: 64480 - DNA, 25 bp, Homo sapien
gctgtcagattaattccatgatcac

SEQ ID NO: 64481 - DNA, 25 bp, Homo sapien
gtcagattaattccatgatcactaa

SEQ ID NO: 64482 - DNA, 25 bp, Homo sapien
catgatcactaaagagttgctgctt

SEQ ID NO: 64483 - DNA, 25 bp, Homo sapien
agagcaagacgggttctcacccctg

SEQ ID NO: 64484 - DNA, 25 bp, Homo sapien
agacgggttctcacccctgacttct

SEQ ID NO: 64485 - DNA, 25 bp, Homo sapien
ctgacttctggaggcttcccttgaa

SEQ ID NO: 64486 - DNA, 25 bp, Homo sapien
aggcttcccttgaagctctgtgcaa

SEQ ID NO: 64487 - DNA, 25 bp, Homo sapien
cttcccttgaagctctgtgcaaaag

SEQ ID NO: 64488 - DNA, 25 bp, Homo sapien
gaagctctgtgcaaaaggtgggaaa

SEQ ID NO: 64489 - DNA, 25 bp, Homo sapien
caaaaggtgggaaacagagctggac

SEQ ID NO: 64490 - DNA, 25 bp, Homo sapien
gttaccgttacgaggctgtggtccg

SEQ ID NO: 64491 - DNA, 25 bp, Homo sapien
gggcaagccaagtacgaagcagcag

SEQ ID NO: 64492 - DNA, 25 bp, Homo sapien
agccaagtacgaagcagcagccatc

SEQ ID NO: 64493 - DNA, 25 bp, Homo sapien
aagcagcagccatcgcgggctgcat

SEQ ID NO: 64494 - DNA, 25 bp, Homo sapien
gcagtcggcgggagtgttggaggtc

SEQ ID NO: 64495 - DNA, 25 bp, Homo sapien
gggcggaaagaagccctcagtcgcc

SEQ ID NO: 64496 - DNA, 25 bp, Homo sapien
agaagccctcagtcgccggccggga

SEQ ID NO: 64497 - DNA, 25 bp, Homo sapien
gagccgatgccgagctgctccacgt

SEQ ID NO: 64498 - DNA, 25 bp, Homo sapien
accatgccgggcatgatctgcaaga

SEQ ID NO: 64499 - DNA, 25 bp, Homo sapien
atgccgggcatgatctgcaagaacc

SEQ ID NO: 64500 - DNA, 25 bp, Homo sapien
tgttggagccgagcaagcgctagcc

SEQ ID NO: 64501 - DNA, 25 bp, Homo sapien
gagcaagcgctagccaggcgcaagc

SEQ ID NO: 64502 - DNA, 25 bp, Homo sapien
tagccaggcgcaagcgcgcacagac

SEQ ID NO: 64503 - DNA, 25 bp, Homo sapien
gcaagcgcgcacagactgtagccat

SEQ ID NO: 64504 - DNA, 25 bp, Homo sapien
gcacagactgtagccatccgaggac

SEQ ID NO: 64505 - DNA, 25 bp, Homo sapien
taagggatcatctcattagcaggta

SEQ ID NO: 64506 - DNA, 25 bp, Homo sapien
agtgaagctgccgactgtgcatgac

SEQ ID NO: 64507 - DNA, 25 bp, Homo sapien
aatgagagtgccatgtatttctttc

SEQ ID NO: 64508 - DNA, 25 bp, Homo sapien
ttctttcttgacaggacatctcaag

SEQ ID NO: 64509 - DNA, 25 bp, Homo sapien
aaccattaagactccatttgtgcct

SEQ ID NO: 64510 - DNA, 25 bp, Homo sapien
catttgtgcctcttggatccaagca

SEQ ID NO: 64511 - DNA, 25 bp, Homo sapien
tcttggatccaagcaggccttgaat

SEQ ID NO: 64512 - DNA, 25 bp, Homo sapien
gaagtggtttatagtcccttgctct

SEQ ID NO: 64513 - DNA, 25 bp, Homo sapien
tatagtcccttgctcttacaacttg

SEQ ID NO: 64514 - DNA, 25 bp, Homo sapien
acaacttgcagggacatgtggttat

SEQ ID NO: 64515 - DNA, 25 bp, Homo sapien
ggaaattgtgactgagcggacccaa

SEQ ID NO: 64516 - DNA, 25 bp, Homo sapien
gggcggaaagaagccctcagtcgcc

SEQ ID NO: 64517 - DNA, 25 bp, Homo sapien
cggaaagaagccctcagtcgccggc

SEQ ID NO: 64518 - DNA, 25 bp, Homo sapien
ggaaagaagccctcagtcgccggcc

SEQ ID NO: 64519 - DNA, 25 bp, Homo sapien
aaagaagccctcagtcgccggccgg

SEQ ID NO: 64520 - DNA, 25 bp, Homo sapien
agaagccctcagtcgccggccggga

SEQ ID NO: 64521 - DNA, 25 bp, Homo sapien
gggaggcgagccgatgccgagctgc

SEQ ID NO: 64522 - DNA, 25 bp, Homo sapien
gagccgatgccgagctgctccacgt

SEQ ID NO: 64523 - DNA, 25 bp, Homo sapien
accatgccgggcatgatctgcaaga

SEQ ID NO: 64524 - DNA, 25 bp, Homo sapien
ccatgccgggcatgatctgcaagaa

SEQ ID NO: 64525 - DNA, 25 bp, Homo sapien
catgccgggcatgatctgcaagaac

SEQ ID NO: 64526 - DNA, 25 bp, Homo sapien
atgccgggcatgatctgcaagaacc

SEQ ID NO: 64527 - DNA, 25 bp, Homo sapien
ctgtaggattttcttatgcactgca

SEQ ID NO: 64528 - DNA, 25 bp, Homo sapien
gtaggattttcttatgcactgcaca

SEQ ID NO: 64529 - DNA, 25 bp, Homo sapien
taggattttcttatgcactgcacac

SEQ ID NO: 64530 - DNA, 25 bp, Homo sapien
ggattttcttatgcactgcacactc

SEQ ID NO: 64531 - DNA, 25 bp, Homo sapien
attttcttatgcactgcacactctg

SEQ ID NO: 64532 - DNA, 25 bp, Homo sapien
tttcttatgcactgcacactctgga

SEQ ID NO: 64533 - DNA, 25 bp, Homo sapien
tatgcactgcacactctggacctca

SEQ ID NO: 64534 - DNA, 25 bp, Homo sapien
ctggacctcacctgcagatacagtt

SEQ ID NO: 64535 - DNA, 25 bp, Homo sapien
ggacctcacctgcagatacagttcc

SEQ ID NO: 64536 - DNA, 25 bp, Homo sapien
atctgcatgtggtacttctcttttc

SEQ ID NO: 64537 - DNA, 25 bp, Homo sapien
tgcatgtggtacttctcttttccct

SEQ ID NO: 64538 - DNA, 25 bp, Homo sapien
aggtatacaaaatatgctgatcttt

SEQ ID NO: 64539 - DNA, 25 bp, Homo sapien
tcctgaatttttcttaagtcgtctc

SEQ ID NO: 64540 - DNA, 25 bp, Homo sapien
atttttcttaagtcgtctcaactga

SEQ ID NO: 64541 - DNA, 25 bp, Homo sapien
cgtctcaactgatttactcacttag

SEQ ID NO: 64542 - DNA, 25 bp, Homo sapien
aactgatttactcacttagcttccc

SEQ ID NO: 64543 - DNA, 25 bp, Homo sapien
tgatttactcacttagcttcccttc

SEQ ID NO: 64544 - DNA, 25 bp, Homo sapien
ttcccttccctcatcagcatagtat

SEQ ID NO: 64545 - DNA, 25 bp, Homo sapien
ttccctcatcagcatagtataatag

SEQ ID NO: 64546 - DNA, 25 bp, Homo sapien
ggtgttcattataatctgtattgac

SEQ ID NO: 64547 - DNA, 25 bp, Homo sapien
gctaatagttttttgtatacatggg

SEQ ID NO: 64548 - DNA, 25 bp, Homo sapien
acatgggaggatagcacatttgaca

SEQ ID NO: 64549 - DNA, 25 bp, Homo sapien
gtgtaaatgtactcaccttagggat

SEQ ID NO: 64550 - DNA, 25 bp, Homo sapien
actcaccttagggattcatttgaat

SEQ ID NO: 64551 - DNA, 25 bp, Homo sapien
ccatgattgtatacagtttgtgaaa

SEQ ID NO: 64552 - DNA, 25 bp, Homo sapien
cagtttgtgaaattgttgcaagggc

SEQ ID NO: 64553 - DNA, 25 bp, Homo sapien
gttgcaagggcaaagataactctta

SEQ ID NO: 64554 - DNA, 25 bp, Homo sapien
aaaccgtcgagattacaatgctcta

SEQ ID NO: 64555 - DNA, 25 bp, Homo sapien
gagattacaatgctctagaatcagc

SEQ ID NO: 64556 - DNA, 25 bp, Homo sapien
aataaatgatatctgcatgttgaat

SEQ ID NO: 64557 - DNA, 25 bp, Homo sapien
tttttaagtgtgaagctttgcatca

SEQ ID NO: 64558 - DNA, 25 bp, Homo sapien
gtgtgaagctttgcatcaagaaatt

SEQ ID NO: 64559 - DNA, 25 bp, Homo sapien
ttttctccagtattttctgtattat

SEQ ID NO: 64560 - DNA, 25 bp, Homo sapien
gggtaattatggtggccatcccgcg

SEQ ID NO: 64561 - DNA, 25 bp, Homo sapien
attatggtggccatcccgcgtacct

SEQ ID NO: 64562 - DNA, 25 bp, Homo sapien
acgctaagggcgactcgcccttcga

SEQ ID NO: 64563 - DNA, 25 bp, Homo sapien
ggcaggtacagattactcccatcat

SEQ ID NO: 64564 - DNA, 25 bp, Homo sapien
agattactcccatcatctggcatag

SEQ ID NO: 64565 - DNA, 25 bp, Homo sapien
ctcccatcatctggcatagtgagac

SEQ ID NO: 64566 - DNA, 25 bp, Homo sapien
tagtgagacagtgccttcagccaga

SEQ ID NO: 64567 - DNA, 25 bp, Homo sapien
ttcagccagatcatgagagtcttga

SEQ ID NO: 64568 - DNA, 25 bp, Homo sapien
gagagtcttgatatacacacttcca

SEQ ID NO: 64569 - DNA, 25 bp, Homo sapien
gtcttgatatacacacttccatgaa

SEQ ID NO: 64570 - DNA, 25 bp, Homo sapien
tacacacttccatgaatttttattc

SEQ ID NO: 64571 - DNA, 25 bp, Homo sapien
gttggatatccaaaatggccgtgca

SEQ ID NO: 64572 - DNA, 25 bp, Homo sapien
aaatggccgtgcaagcttaggctgg

SEQ ID NO: 64573 - DNA, 25 bp, Homo sapien
gggattctggatgcaacgtctttac

SEQ ID NO: 64574 - DNA, 25 bp, Homo sapien
ttacaaccttacctagatatctgct

SEQ ID NO: 64575 - DNA, 25 bp, Homo sapien
gatatctgctactcacatttttggt

SEQ ID NO: 64576 - DNA, 25 bp, Homo sapien
tactcacatttttggtagtgtttca

SEQ ID NO: 64577 - DNA, 25 bp, Homo sapien
gtgtttcaaacgttctttatccaga

SEQ ID NO: 64578 - DNA, 25 bp, Homo sapien
gttctttatccagacagacaatgtt

SEQ ID NO: 64579 - DNA, 25 bp, Homo sapien
tatttctgttaatatttaccggtag

SEQ ID NO: 64580 - DNA, 25 bp, Homo sapien
ttaccggtagaattcacaccctcta

SEQ ID NO: 64581 - DNA, 25 bp, Homo sapien
gaattcacaccctctatcataaaca

SEQ ID NO: 64582 - DNA, 25 bp, Homo sapien
gaagagatctcaggtccagcagaac

SEQ ID NO: 64583 - DNA, 25 bp, Homo sapien
agagacaaccacaacagcccaggag

SEQ ID NO: 64584 - DNA, 25 bp, Homo sapien
aacagcccaggagacttcggcggca

SEQ ID NO: 64585 - DNA, 25 bp, Homo sapien
agacttcggcggcagcagttcaggg

SEQ ID NO: 64586 - DNA, 25 bp, Homo sapien
gacagccaaggtcacctcaagcagg

SEQ ID NO: 64587 - DNA, 25 bp, Homo sapien
ggtcacctcaagcaggcaggaacta

SEQ ID NO: 64588 - DNA, 25 bp, Homo sapien
ctaaaccccctgaaatccatagtgg

SEQ ID NO: 64589 - DNA, 25 bp, Homo sapien
gtatcttactaacagaacaagccct

SEQ ID NO: 64590 - DNA, 25 bp, Homo sapien
aacaagcccttgcaaaagcaggaaa

SEQ ID NO: 64591 - DNA, 25 bp, Homo sapien
ggtggaaaacaattcatcgaaaatg

SEQ ID NO: 64592 - DNA, 25 bp, Homo sapien
agtctattaaaaccatgggcatgag

SEQ ID NO: 64593 - DNA, 25 bp, Homo sapien
aggatttggccttagcttcgtgggc

SEQ ID NO: 64594 - DNA, 25 bp, Homo sapien
tttggccttagcttcgtgggcctat

SEQ ID NO: 64595 - DNA, 25 bp, Homo sapien
gccttagcttcgtgggcctatcggc

SEQ ID NO: 64596 - DNA, 25 bp, Homo sapien
agcttcgtgggcctatcggctgcct

SEQ ID NO: 64597 - DNA, 25 bp, Homo sapien
ttcgtgggcctatcggctgccttcc

SEQ ID NO: 64598 - DNA, 25 bp, Homo sapien
ctctcccaacataacaatcgtggta

SEQ ID NO: 64599 - DNA, 25 bp, Homo sapien
caacataacaatcgtggtaacagaa

SEQ ID NO: 64600 - DNA, 25 bp, Homo sapien
atcgtggtaacagaatgcgactgct

SEQ ID NO: 64601 - DNA, 25 bp, Homo sapien
gtggtaacagaatgcgactgctgat

SEQ ID NO: 64602 - DNA, 25 bp, Homo sapien
aacagaatgcgactgctgatttacc

SEQ ID NO: 64603 - DNA, 25 bp, Homo sapien
acagaatgcgactgctgatttaccg

SEQ ID NO: 64604 - DNA, 25 bp, Homo sapien
aggacacctggatgctgagttggat

SEQ ID NO: 64605 - DNA, 25 bp, Homo sapien
acatggcgcagacagatcccgaaac

SEQ ID NO: 64606 - DNA, 25 bp, Homo sapien
gacagatcccgaaaccaatgattga

SEQ ID NO: 64607 - DNA, 25 bp, Homo sapien
gagagactcttgttagtcaacacat

SEQ ID NO: 64608 - DNA, 25 bp, Homo sapien
atctgattgatgctggatggaccta

SEQ ID NO: 64609 - DNA, 25 bp, Homo sapien
gatgctggatggacctatcacaata

SEQ ID NO: 64610 - DNA, 25 bp, Homo sapien
caataggctgtggacttacttgcca

SEQ ID NO: 64611 - DNA, 25 bp, Homo sapien
tacttgccaccagcttgtgcattta

SEQ ID NO: 64612 - DNA, 25 bp, Homo sapien
agcttgtgcatttagtgtgttcctt

SEQ ID NO: 64613 - DNA, 25 bp, Homo sapien
ttgtatgaaacccttttgtcctttg

SEQ ID NO: 64614 - DNA, 25 bp, Homo sapien
aaccaattggatgcatatatgtcga

SEQ ID NO: 64615 - DNA, 25 bp, Homo sapien
tttttatgttattggcctagagcta

SEQ ID NO: 64616 - DNA, 25 bp, Homo sapien
gttattggcctagagctacacgtat

SEQ ID NO: 64617 - DNA, 25 bp, Homo sapien
ggcctagagctacacgtatatgggt

SEQ ID NO: 64618 - DNA, 25 bp, Homo sapien
gctacacgtatatgggtttgtcctg

SEQ ID NO: 64619 - DNA, 25 bp, Homo sapien
tatatgggtttgtcctgagtccgtt

SEQ ID NO: 64620 - DNA, 25 bp, Homo sapien
ctgagtccgttttcaaatgaccttg

SEQ ID NO: 64621 - DNA, 25 bp, Homo sapien
ccttgtgatagggaaatggttttgt

SEQ ID NO: 64622 - DNA, 25 bp, Homo sapien
aatggttttgtccatgttcttggaa

SEQ ID NO: 64623 - DNA, 25 bp, Homo sapien
gtccatgttcttggaaatacttgtg

SEQ ID NO: 64624 - DNA, 25 bp, Homo sapien
tctaattttctaatgtgccttggat

SEQ ID NO: 64625 - DNA, 25 bp, Homo sapien
gaaacagtaaactttatgattctta

SEQ ID NO: 64626 - DNA, 25 bp, Homo sapien
ttgcagtgccacttatttaggtaac

SEQ ID NO: 64627 - DNA, 25 bp, Homo sapien
gtgccacttatttaggtaactgaag

SEQ ID NO: 64628 - DNA, 25 bp, Homo sapien
taggtaactgaagtgtatttccagt

SEQ ID NO: 64629 - DNA, 25 bp, Homo sapien
gtatttccagtacaatttgattttg

SEQ ID NO: 64630 - DNA, 25 bp, Homo sapien
gaaaatgtatcatccctgggttctc

SEQ ID NO: 64631 - DNA, 25 bp, Homo sapien
acaataaataccctctgttctcaca

SEQ ID NO: 64632 - DNA, 25 bp, Homo sapien
aaataccctctgttctcacacaaat

SEQ ID NO: 64633 - DNA, 25 bp, Homo sapien
cctctgttctcacacaaatgctgtt

SEQ ID NO: 64634 - DNA, 25 bp, Homo sapien
aatgctgtttcttagctaacttgct

SEQ ID NO: 64635 - DNA, 25 bp, Homo sapien
gctaacttgctttgacaacctactg

SEQ ID NO: 64636 - DNA, 25 bp, Homo sapien
ctgatgtaacttctttattaatgtg

SEQ ID NO: 64637 - DNA, 25 bp, Homo sapien
atttatttaaaaccttgcacgcatt

SEQ ID NO: 64638 - DNA, 25 bp, Homo sapien
accttgcacgcatttggataccttg

SEQ ID NO: 64639 - DNA, 25 bp, Homo sapien
tggataccttgtgatttccaagaac

SEQ ID NO: 64640 - DNA, 25 bp, Homo sapien
gaactacgtgaagattaagctttgc

SEQ ID NO: 64641 - DNA, 25 bp, Homo sapien
taagctttgcttactgatacatggc

SEQ ID NO: 64642 - DNA, 25 bp, Homo sapien
catggcatgtattcttttcagtctt

SEQ ID NO: 64643 - DNA, 25 bp, Homo sapien
tgtttgattttgtttgatttccctc

SEQ ID NO: 64644 - DNA, 25 bp, Homo sapien
ttttgtttgatttccctctgcagca

SEQ ID NO: 64645 - DNA, 25 bp, Homo sapien
aaggtttttatgctttcaccagcca

SEQ ID NO: 64646 - DNA, 25 bp, Homo sapien
gctttcaccagccatgtcttaaata

SEQ ID NO: 64647 - DNA, 25 bp, Homo sapien
acatttggtgttcacacttcttcag

SEQ ID NO: 64648 - DNA, 25 bp, Homo sapien
tatgaatttctccaattggtctagc

SEQ ID NO: 64649 - DNA, 25 bp, Homo sapien
gaatttctccaattggtctagcatg

SEQ ID NO: 64650 - DNA, 25 bp, Homo sapien
atttctccaattggtctagcatgct

SEQ ID NO: 64651 - DNA, 25 bp, Homo sapien
ttctccaattggtctagcatgctta

SEQ ID NO: 64652 - DNA, 25 bp, Homo sapien
ctccaattggtctagcatgcttata

SEQ ID NO: 64653 - DNA, 25 bp, Homo sapien
caattggtctagcatgcttatagga

SEQ ID NO: 64654 - DNA, 25 bp, Homo sapien
gtctagcatgcttataggaatgtca

SEQ ID NO: 64655 - DNA, 25 bp, Homo sapien
gaatgtcagtggttcttacaggctc

SEQ ID NO: 64656 - DNA, 25 bp, Homo sapien
atgtcagtggttcttacaggctcaa

SEQ ID NO: 64657 - DNA, 25 bp, Homo sapien
gtcagtggttcttacaggctcaaat

SEQ ID NO: 64658 - DNA, 25 bp, Homo sapien
tcagtggttcttacaggctcaaatt

SEQ ID NO: 64659 - DNA, 25 bp, Homo sapien
ttttaaccctcttctgcaagtttgt

SEQ ID NO: 64660 - DNA, 25 bp, Homo sapien
gcaagtttgttgacctacatgggct

SEQ ID NO: 64661 - DNA, 25 bp, Homo sapien
gttgacctacatgggctaatatgga

SEQ ID NO: 64662 - DNA, 25 bp, Homo sapien
gaagaaactagccttgtggagtata

SEQ ID NO: 64663 - DNA, 25 bp, Homo sapien
gtggagtatatagatgcttttcatt

SEQ ID NO: 64664 - DNA, 25 bp, Homo sapien
agggacattttgaggcatgaatata

SEQ ID NO: 64665 - DNA, 25 bp, Homo sapien
cccctgtgtaagttactatggtttg

SEQ ID NO: 64666 - DNA, 25 bp, Homo sapien
atggtttgtggtacaacttcattct

SEQ ID NO: 64667 - DNA, 25 bp, Homo sapien
gtgggtgaattctactttttatgtt

SEQ ID NO: 64668 - DNA, 25 bp, Homo sapien
ctactttttatgttggagtggacca

SEQ ID NO: 64669 - DNA, 25 bp, Homo sapien
gtggaccaatgtctatcaagagtga

SEQ ID NO: 64670 - DNA, 25 bp, Homo sapien
ccccgttgttcagtccgatgaggag

SEQ ID NO: 64671 - DNA, 25 bp, Homo sapien
aggaagttcaggtggacactgccct

SEQ ID NO: 64672 - DNA, 25 bp, Homo sapien
atggtggtgaggacagcgactctta

SEQ ID NO: 64673 - DNA, 25 bp, Homo sapien
gacagcgactcttaaattgggacat

SEQ ID NO: 64674 - DNA, 25 bp, Homo sapien
ggacatgggcgttgtctggccacac

SEQ ID NO: 64675 - DNA, 25 bp, Homo sapien
tgtctggccacactggaatccagtt

SEQ ID NO: 64676 - DNA, 25 bp, Homo sapien
gaatccagttttggctgtatgcgga

SEQ ID NO: 64677 - DNA, 25 bp, Homo sapien
ggctgtatgcggaattccacctgga

SEQ ID NO: 64678 - DNA, 25 bp, Homo sapien
tgcggaattccacctggaaagccag

SEQ ID NO: 64679 - DNA, 25 bp, Homo sapien
gccaggttgttttatagaggttctt

SEQ ID NO: 64680 - DNA, 25 bp, Homo sapien
ggttcttgatttttacataattgcc

SEQ ID NO: 64681 - DNA, 25 bp, Homo sapien
gatatttcaagatgaccatctgcat

SEQ ID NO: 64682 - DNA, 25 bp, Homo sapien
ccatctgcattgagaggaaaggtag

SEQ ID NO: 64683 - DNA, 25 bp, Homo sapien
agatgaagagcataccaggccccac

SEQ ID NO: 64684 - DNA, 25 bp, Homo sapien
gggaactttgctcggccaatggaaa

SEQ ID NO: 64685 - DNA, 25 bp, Homo sapien
gctcggccaatggaaatgcagccaa

SEQ ID NO: 64686 - DNA, 25 bp, Homo sapien
agccaagatggccatatactcccta

SEQ ID NO: 64687 - DNA, 25 bp, Homo sapien
aagatggccatatactccctaggaa

SEQ ID NO: 64688 - DNA, 25 bp, Homo sapien
tggccatatactccctaggaaccca

SEQ ID NO: 64689 - DNA, 25 bp, Homo sapien
caccatcttgattttactttcctta

SEQ ID NO: 64690 - DNA, 25 bp, Homo sapien
gacacagaaagacttggacccaagg

SEQ ID NO: 64691 - DNA, 25 bp, Homo sapien
ggatacagtgagaattaccactgtt

SEQ ID NO: 64692 - DNA, 25 bp, Homo sapien
gcgttaagtcggtaagctagaggat

SEQ ID NO: 64693 - DNA, 25 bp, Homo sapien
aaatatcttttatgtcctctagata

SEQ ID NO: 64694 - DNA, 25 bp, Homo sapien
gtcctctagataaaacacccgatta

SEQ ID NO: 64695 - DNA, 25 bp, Homo sapien
gataaaacacccgattaacagatgt

SEQ ID NO: 64696 - DNA, 25 bp, Homo sapien
tggccttcctacacattagctccag

SEQ ID NO: 64697 - DNA, 25 bp, Homo sapien
cttcctacacattagctccagctaa

SEQ ID NO: 64698 - DNA, 25 bp, Homo sapien
gacacattggagagcttagaggata

SEQ ID NO: 64699 - DNA, 25 bp, Homo sapien
agaggataagtctctggagcagaat

SEQ ID NO: 64700 - DNA, 25 bp, Homo sapien
tcacacacaaaagttacaccaacag

SEQ ID NO: 64701 - DNA, 25 bp, Homo sapien
caagcagaatgatgaggacctgtaa

SEQ ID NO: 64702 - DNA, 25 bp, Homo sapien
acctgtaaaataccttgtgccctat

SEQ ID NO: 64703 - DNA, 25 bp, Homo sapien
ttctctttcaaatagatttcaggcc

SEQ ID NO: 64704 - DNA, 25 bp, Homo sapien
aaatagatttcaggcctctagagtc

SEQ ID NO: 64705 - DNA, 25 bp, Homo sapien
tctagagtctttcaaccctcacatt

SEQ ID NO: 64706 - DNA, 25 bp, Homo sapien
tctttcaaccctcacattcaggaat

SEQ ID NO: 64707 - DNA, 25 bp, Homo sapien
taatgttcttacttttttctattca

SEQ ID NO: 64708 - DNA, 25 bp, Homo sapien
atttttatccatagctttttccata

SEQ ID NO: 64709 - DNA, 25 bp, Homo sapien
gctttttccatataagtatgtatct

SEQ ID NO: 64710 - DNA, 25 bp, Homo sapien
atcttagggtcagaactgctgaaag

SEQ ID NO: 64711 - DNA, 25 bp, Homo sapien
aactcagccaaaaacacttggaaag

SEQ ID NO: 64712 - DNA, 25 bp, Homo sapien
ttttggtatctgcattgctttgcat

SEQ ID NO: 64713 - DNA, 25 bp, Homo sapien
ttgctttgcatatctaaattttccc

SEQ ID NO: 64714 - DNA, 25 bp, Homo sapien
agactactgttgtccagggtcaatt

SEQ ID NO: 64715 - DNA, 25 bp, Homo sapien
tgttgtccagggtcaatttgagtgt

SEQ ID NO: 64716 - DNA, 25 bp, Homo sapien
taaattctgactttgctgacttaat

SEQ ID NO: 64717 - DNA, 25 bp, Homo sapien
ctgactttgctgacttaatttaaat

SEQ ID NO: 64718 - DNA, 25 bp, Homo sapien
aatttaaatgctcgttctgaaccaa

SEQ ID NO: 64719 - DNA, 25 bp, Homo sapien
cgttctgaaccaattttctcctatc

SEQ ID NO: 64720 - DNA, 25 bp, Homo sapien
agactcagttaattgatttccagga

SEQ ID NO: 64721 - DNA, 25 bp, Homo sapien
gatttccaggaagtactcatagcaa

SEQ ID NO: 64722 - DNA, 25 bp, Homo sapien
aggaagtactcatagcaagttcata

SEQ ID NO: 64723 - DNA, 25 bp, Homo sapien
gttcataaaagttcttgagacctaa

SEQ ID NO: 64724 - DNA, 25 bp, Homo sapien
aattgtgtagaggttgttcaactga

SEQ ID NO: 64725 - DNA, 25 bp, Homo sapien
cctcgctgccagatgattgttcaaa

SEQ ID NO: 64726 - DNA, 25 bp, Homo sapien
gtcagaaacctgcagggactccatg

SEQ ID NO: 64727 - DNA, 25 bp, Homo sapien
tgccagccttctccgtaattagcat

SEQ ID NO: 64728 - DNA, 25 bp, Homo sapien
cgtaattagcatggccccagtccat

SEQ ID NO: 64729 - DNA, 25 bp, Homo sapien
atgcttctagccttggttccttctg

SEQ ID NO: 64730 - DNA, 25 bp, Homo sapien
gtttgaaattctagagccagctgtg

SEQ ID NO: 64731 - DNA, 25 bp, Homo sapien
ccagctgtgggacaattatctgtgt

SEQ ID NO: 64732 - DNA, 25 bp, Homo sapien
atctcaataacaaactggctgcttt

SEQ ID NO: 64733 - DNA, 25 bp, Homo sapien
aacaaactggctgctttgttcaatg

SEQ ID NO: 64734 - DNA, 25 bp, Homo sapien
aatgctagaacaacgcctgtcacag

SEQ ID NO: 64735 - DNA, 25 bp, Homo sapien
acgcctgtcacagagtagaaactca

SEQ ID NO: 64736 - DNA, 25 bp, Homo sapien
cctggccaatatggttgaattcccg

SEQ ID NO: 64737 - DNA, 25 bp, Homo sapien
ctggccaatatggttgaattcccgt

SEQ ID NO: 64738 - DNA, 25 bp, Homo sapien
tggccaatatggttgaattcccgtc

SEQ ID NO: 64739 - DNA, 25 bp, Homo sapien
ggccaatatggttgaattcccgtct

SEQ ID NO: 64740 - DNA, 25 bp, Homo sapien
gccaatatggttgaattcccgtctc

SEQ ID NO: 64741 - DNA, 25 bp, Homo sapien
ccaatatggttgaattcccgtctct

SEQ ID NO: 64742 - DNA, 25 bp, Homo sapien
caatatggttgaattcccgtctcta

SEQ ID NO: 64743 - DNA, 25 bp, Homo sapien
aatatggttgaattcccgtctctac

SEQ ID NO: 64744 - DNA, 25 bp, Homo sapien
aaatgggagcacagtactgggaaat

SEQ ID NO: 64745 - DNA, 25 bp, Homo sapien
agcacagtactgggaaatgggagca

SEQ ID NO: 64746 - DNA, 25 bp, Homo sapien
ctagcccagacttcttatcttagta

SEQ ID NO: 64747 - DNA, 25 bp, Homo sapien
agcccagacttcttatcttagtaga

SEQ ID NO: 64748 - DNA, 25 bp, Homo sapien
ccagacttcttatcttagtagacaa

SEQ ID NO: 64749 - DNA, 25 bp, Homo sapien
gacttcttatcttagtagacaaaaa

SEQ ID NO: 64750 - DNA, 25 bp, Homo sapien
gagtcaataccagagaaccagaggc

SEQ ID NO: 64751 - DNA, 25 bp, Homo sapien
aataccagagaaccagaggcatcct

SEQ ID NO: 64752 - DNA, 25 bp, Homo sapien
taccagagaaccagaggcatcctct

SEQ ID NO: 64753 - DNA, 25 bp, Homo sapien
gaaccagaggcatcctctgtatttt

SEQ ID NO: 64754 - DNA, 25 bp, Homo sapien
cagaggcatcctctgtattttaatg

SEQ ID NO: 64755 - DNA, 25 bp, Homo sapien
acagacgaccggattgtggtgcccc

SEQ ID NO: 64756 - DNA, 25 bp, Homo sapien
agacgaccggattgtggtgccccag

SEQ ID NO: 64757 - DNA, 25 bp, Homo sapien
acgaccggattgtggtgccccagcg

SEQ ID NO: 64758 - DNA, 25 bp, Homo sapien
gtgcccgtggccagtgtgctcatct

SEQ ID NO: 64759 - DNA, 25 bp, Homo sapien
cgtggccagtgtgctcatctgagag

SEQ ID NO: 64760 - DNA, 25 bp, Homo sapien
atctgagaggctgccgctcacctac

SEQ ID NO: 64761 - DNA, 25 bp, Homo sapien
cagctcccagacactacatgggtag

SEQ ID NO: 64762 - DNA, 25 bp, Homo sapien
cagacactacatgggtagctcaggg

SEQ ID NO: 64763 - DNA, 25 bp, Homo sapien
agccccaagggctcggtgctatttg

SEQ ID NO: 64764 - DNA, 25 bp, Homo sapien
cccaagggctcggtgctatttgtaa

SEQ ID NO: 64765 - DNA, 25 bp, Homo sapien
caagggctcggtgctatttgtaacg

SEQ ID NO: 64766 - DNA, 25 bp, Homo sapien
gtacagtcatcatctgatagttcag

SEQ ID NO: 64767 - DNA, 25 bp, Homo sapien
agttcagatgaaccagcagaaaaac

SEQ ID NO: 64768 - DNA, 25 bp, Homo sapien
aaagaagcgacgtgatttctatgag

SEQ ID NO: 64769 - DNA, 25 bp, Homo sapien
gagaagtatcgtaacccccaaagag

SEQ ID NO: 64770 - DNA, 25 bp, Homo sapien
gatgcaattgtatatcagagtgagt

SEQ ID NO: 64771 - DNA, 25 bp, Homo sapien
gagtgagatcactactttcctttac

SEQ ID NO: 64772 - DNA, 25 bp, Homo sapien
gatcactactttcctttactatttt

SEQ ID NO: 64773 - DNA, 25 bp, Homo sapien
atttgtcatcatttatttcccatgg

SEQ ID NO: 64774 - DNA, 25 bp, Homo sapien
tcatttatttcccatggtcgtctac

SEQ ID NO: 64775 - DNA, 25 bp, Homo sapien
ttcccatggtcgtctacttggatta

SEQ ID NO: 64776 - DNA, 25 bp, Homo sapien
tggtcgtctacttggattaaatggg

SEQ ID NO: 64777 - DNA, 25 bp, Homo sapien
aaggtggcccttagagacagagctt

SEQ ID NO: 64778 - DNA, 25 bp, Homo sapien
gagacagagcttggacagatccaga

SEQ ID NO: 64779 - DNA, 25 bp, Homo sapien
agatccagaggctctgttccagagt

SEQ ID NO: 64780 - DNA, 25 bp, Homo sapien
gctctgttccagagtgcaggaagaa

SEQ ID NO: 64781 - DNA, 25 bp, Homo sapien
cagccccaggacaggaaacagaact

SEQ ID NO: 64782 - DNA, 25 bp, Homo sapien
aacagaactgcctgaaaaaggtgaa

SEQ ID NO: 64783 - DNA, 25 bp, Homo sapien
gaaacttggatctctatttctccca

SEQ ID NO: 64784 - DNA, 25 bp, Homo sapien
tatttctcccataagggacttctga

SEQ ID NO: 64785 - DNA, 25 bp, Homo sapien
ccataagggacttctgaaacaggga

SEQ ID NO: 64786 - DNA, 25 bp, Homo sapien
ccctcccatgtgaaccaaggaaagg

SEQ ID NO: 64787 - DNA, 25 bp, Homo sapien
aggaaaggagcacagcccagagaac

SEQ ID NO: 64788 - DNA, 25 bp, Homo sapien
tccagagcacttatggtatgaagac

SEQ ID NO: 64789 - DNA, 25 bp, Homo sapien
gtatgaagacagatggcggaagcct

SEQ ID NO: 64790 - DNA, 25 bp, Homo sapien
atggcggaagcctagctggaaatga

SEQ ID NO: 64791 - DNA, 25 bp, Homo sapien
gactatgaagatgaccccaaatcag

SEQ ID NO: 64792 - DNA, 25 bp, Homo sapien
gaccccaaatcagactatagcagtg

SEQ ID NO: 64793 - DNA, 25 bp, Homo sapien
aatgaagccccggaggctgtcagtg

SEQ ID NO: 64794 - DNA, 25 bp, Homo sapien
gctgtcagtgccaactgaggagttt

SEQ ID NO: 64795 - DNA, 25 bp, Homo sapien
aactgaggagtttttgtttgctgaa

SEQ ID NO: 64796 - DNA, 25 bp, Homo sapien
gctgaattaaagtactctgacattt

SEQ ID NO: 64797 - DNA, 25 bp, Homo sapien
agagttattaaagagcccgcatgca

SEQ ID NO: 64798 - DNA, 25 bp, Homo sapien
cccgcatgcatttgtggctccacaa

SEQ ID NO: 64799 - DNA, 25 bp, Homo sapien
gatatactgtgggatgagtatctca

SEQ ID NO: 64800 - DNA, 25 bp, Homo sapien
gagtatctcagggtaagtaacaaaa

SEQ ID NO: 64801 - DNA, 25 bp, Homo sapien
aatcactgaaatttttccctcacag

SEQ ID NO: 64802 - DNA, 25 bp, Homo sapien
cagtcagtagctttgtttgatattt

SEQ ID NO: 64803 - DNA, 25 bp, Homo sapien
ttatgtccagaatgtcactggaata

SEQ ID NO: 64804 - DNA, 25 bp, Homo sapien
agaatgtcactggaatattacaatg

SEQ ID NO: 64805 - DNA, 25 bp, Homo sapien
tgagcataaataatcaagcttagga

SEQ ID NO: 64806 - DNA, 25 bp, Homo sapien
aaataatcaagcttaggactaaatg

SEQ ID NO: 64807 - DNA, 25 bp, Homo sapien
gaaagatactatctcatgtatgctt

SEQ ID NO: 64808 - DNA, 25 bp, Homo sapien
gatactatctcatgtatgctttaaa

SEQ ID NO: 64809 - DNA, 25 bp, Homo sapien
ctcatgtatgctttaaatagagaat

SEQ ID NO: 64810 - DNA, 25 bp, Homo sapien
gttcattacctacttaatatttcct

SEQ ID NO: 64811 - DNA, 25 bp, Homo sapien
atactaactgttaaggccctctaat

SEQ ID NO: 64812 - DNA, 25 bp, Homo sapien
gttaaggccctctaatgccattttt

SEQ ID NO: 64813 - DNA, 25 bp, Homo sapien
aaggccctctaatgccatttttcta

SEQ ID NO: 64814 - DNA, 25 bp, Homo sapien
attaaaatttggtatggattcactt

SEQ ID NO: 64815 - DNA, 25 bp, Homo sapien
gtatggattcactttttacttatgt

SEQ ID NO: 64816 - DNA, 25 bp, Homo sapien
aaattataccatttaactggctctt

SEQ ID NO: 64817 - DNA, 25 bp, Homo sapien
ccatttaactggctcttttgtcatt

SEQ ID NO: 64818 - DNA, 25 bp, Homo sapien
aactggctcttttgtcattgtgctg

SEQ ID NO: 64819 - DNA, 25 bp, Homo sapien
tgtcattgtgctgttattaaaacaa

SEQ ID NO: 64820 - DNA, 25 bp, Homo sapien
aacaatgttcttcaatattttgaca

SEQ ID NO: 64821 - DNA, 25 bp, Homo sapien
cagtttaagaaatcattggcccctt

SEQ ID NO: 64822 - DNA, 25 bp, Homo sapien
cccttcccagcacattgaatgggta

SEQ ID NO: 64823 - DNA, 25 bp, Homo sapien
cattgaatgggtaagcagacaggcc

SEQ ID NO: 64824 - DNA, 25 bp, Homo sapien
agcagacaggccatgatttagttgg

SEQ ID NO: 64825 - DNA, 25 bp, Homo sapien
tttagttggccagcactaactccac

SEQ ID NO: 64826 - DNA, 25 bp, Homo sapien
taactccacctctgttctccttgaa

SEQ ID NO: 64827 - DNA, 25 bp, Homo sapien
acctctgttctccttgaacagcttc

SEQ ID NO: 64828 - DNA, 25 bp, Homo sapien
tccagcccactgctttaggatgaca

SEQ ID NO: 64829 - DNA, 25 bp, Homo sapien
gcccactgctttaggatgacacaat

SEQ ID NO: 64830 - DNA, 25 bp, Homo sapien
gatgacacaatgaataacacctagt

SEQ ID NO: 64831 - DNA, 25 bp, Homo sapien
gtcatagaaatcagtctctctggtt

SEQ ID NO: 64832 - DNA, 25 bp, Homo sapien
taatctatccggtatatgcatatat

SEQ ID NO: 64833 - DNA, 25 bp, Homo sapien
atctatatgctgtgttaagtggtaa

SEQ ID NO: 64834 - DNA, 25 bp, Homo sapien
aatgggtacattacagtctgtgaga

SEQ ID NO: 64835 - DNA, 25 bp, Homo sapien
gtctgtgagagatggatcgctccct

SEQ ID NO: 64836 - DNA, 25 bp, Homo sapien
gatcgctccctctgtaaggaacaag

SEQ ID NO: 64837 - DNA, 25 bp, Homo sapien
gctccctctgtaaggaacaagacgt

SEQ ID NO: 64838 - DNA, 25 bp, Homo sapien
gaacaagacgttctcagctgatgtc

SEQ ID NO: 64839 - DNA, 25 bp, Homo sapien
gacgttctcagctgatgtcacggta

SEQ ID NO: 64840 - DNA, 25 bp, Homo sapien
tctcagctgatgtcacggtaggttt

SEQ ID NO: 64841 - DNA, 25 bp, Homo sapien
tgtcacggtaggtttagattctgta

SEQ ID NO: 64842 - DNA, 25 bp, Homo sapien
agattctgtagagtgttccccaacc

SEQ ID NO: 64843 - DNA, 25 bp, Homo sapien
attgctgtgtcttgtaataccttgc

SEQ ID NO: 64844 - DNA, 25 bp, Homo sapien
gctgtgtcttgtaataccttgcttt

SEQ ID NO: 64845 - DNA, 25 bp, Homo sapien
gtgtcttgtaataccttgctttaac

SEQ ID NO: 64846 - DNA, 25 bp, Homo sapien
gtcttgtaataccttgctttaacta

SEQ ID NO: 64847 - DNA, 25 bp, Homo sapien
gtaataccttgctttaactagcttt

SEQ ID NO: 64848 - DNA, 25 bp, Homo sapien
gctttaactagctttttatgtattt

SEQ ID NO: 64849 - DNA, 25 bp, Homo sapien
attttagttggtatagctttgttat

SEQ ID NO: 64850 - DNA, 25 bp, Homo sapien
atagctttgttattattcatattaa

SEQ ID NO: 64851 - DNA, 25 bp, Homo sapien
gtttttatgaccatgtaatgtttta

SEQ ID NO: 64852 - DNA, 25 bp, Homo sapien
ttagttttcccattggtatttatag

SEQ ID NO: 64853 - DNA, 25 bp, Homo sapien
ttcccattggtatttatagtttact

SEQ ID NO: 64854 - DNA, 25 bp, Homo sapien
tcagttagaaaaggactccctggcc

SEQ ID NO: 64855 - DNA, 25 bp, Homo sapien
cagttagaaaaggactccctggcca

SEQ ID NO: 64856 - DNA, 25 bp, Homo sapien
agttagaaaaggactccctggccag

SEQ ID NO: 64857 - DNA, 25 bp, Homo sapien
gttagaaaaggactccctggccagg

SEQ ID NO: 64858 - DNA, 25 bp, Homo sapien
ttagaaaaggactccctggccaggc

SEQ ID NO: 64859 - DNA, 25 bp, Homo sapien
tagaaaaggactccctggccaggcg

SEQ ID NO: 64860 - DNA, 25 bp, Homo sapien
agaaaaggactccctggccaggcgc

SEQ ID NO: 64861 - DNA, 25 bp, Homo sapien
gaaaaggactccctggccaggcgca

SEQ ID NO: 64862 - DNA, 25 bp, Homo sapien
aaaaggactccctggccaggcgcag

SEQ ID NO: 64863 - DNA, 25 bp, Homo sapien
aaaggactccctggccaggcgcagt

SEQ ID NO: 64864 - DNA, 25 bp, Homo sapien
aaggactccctggccaggcgcagtg

SEQ ID NO: 64865 - DNA, 25 bp, Homo sapien
tcccctctgaggcaattattacatg

SEQ ID NO: 64866 - DNA, 25 bp, Homo sapien
gaactttaaaccttcagcgtgactg

SEQ ID NO: 64867 - DNA, 25 bp, Homo sapien
agcgtgactgaagcagcagcctgca

SEQ ID NO: 64868 - DNA, 25 bp, Homo sapien
gcagcagcctgcacatgtggatggt

SEQ ID NO: 64869 - DNA, 25 bp, Homo sapien
gtcatcagtgcctcgcccagagata

SEQ ID NO: 64870 - DNA, 25 bp, Homo sapien
gctccttcgcactgagtatgttgga

SEQ ID NO: 64871 - DNA, 25 bp, Homo sapien
atgttggactctgccatagactgac

SEQ ID NO: 64872 - DNA, 25 bp, Homo sapien
atagactgaccctcttgtctggctg

SEQ ID NO: 64873 - DNA, 25 bp, Homo sapien
tgctgcagtttgtctgtaatgccct

SEQ ID NO: 64874 - DNA, 25 bp, Homo sapien
gtctgtaatgccctgacatgttgca

SEQ ID NO: 64875 - DNA, 25 bp, Homo sapien
atgttgcattctccccatttggata

SEQ ID NO: 64876 - DNA, 25 bp, Homo sapien
gagtgaaacccttaatcaatcagtc

SEQ ID NO: 64877 - DNA, 25 bp, Homo sapien
gaaacccttaatcaatcagtcaata

SEQ ID NO: 64878 - DNA, 25 bp, Homo sapien
ttagacccaccactaggtcatctta

SEQ ID NO: 64879 - DNA, 25 bp, Homo sapien
acccaccactaggtcatcttatttg

SEQ ID NO: 64880 - DNA, 25 bp, Homo sapien
ccaccactaggtcatcttatttgat

SEQ ID NO: 64881 - DNA, 25 bp, Homo sapien
ggtcatcttatttgatgcatcagta

SEQ ID NO: 64882 - DNA, 25 bp, Homo sapien
gcatcagtaaagcagcatattcaaa

SEQ ID NO: 64883 - DNA, 25 bp, Homo sapien
gcagcatattcaaatgtggattttt

SEQ ID NO: 64884 - DNA, 25 bp, Homo sapien
ctttactttgtaatcctatgcattt

SEQ ID NO: 64885 - DNA, 25 bp, Homo sapien
gtaatcctatgcattttacgcatta

SEQ ID NO: 64886 - DNA, 25 bp, Homo sapien
tcctatgcattttacgcattaaaac

SEQ ID NO: 64887 - DNA, 25 bp, Homo sapien
aagttggaatcttcagctactgtca

SEQ ID NO: 64888 - DNA, 25 bp, Homo sapien
agctactgtcaagaacagccacaaa

SEQ ID NO: 64889 - DNA, 25 bp, Homo sapien
aaaatgtgtcacgatcaagatcttt

SEQ ID NO: 64890 - DNA, 25 bp, Homo sapien
tcaagatctttgagagtccaccaat

SEQ ID NO: 64891 - DNA, 25 bp, Homo sapien
agtccaccaatcaggaggcgtctgt

SEQ ID NO: 64892 - DNA, 25 bp, Homo sapien
gaggcgtctgtgacagtcgctgtct

SEQ ID NO: 64893 - DNA, 25 bp, Homo sapien
acagtcgctgtcttctcagaacaga

SEQ ID NO: 64894 - DNA, 25 bp, Homo sapien
aacagaatccacacccaggattcaa

SEQ ID NO: 64895 - DNA, 25 bp, Homo sapien
gatttctcatcaggtgattcttggt

SEQ ID NO: 64896 - DNA, 25 bp, Homo sapien
gattcttggttgtagcaaagttcat

SEQ ID NO: 64897 - DNA, 25 bp, Homo sapien
gagtttctgttatgaatgtggtcaa

SEQ ID NO: 64898 - DNA, 25 bp, Homo sapien
aatagtcataacagttttcaacttg

SEQ ID NO: 64899 - DNA, 25 bp, Homo sapien
ataacagttttcaacttgttcttgt

SEQ ID NO: 64900 - DNA, 25 bp, Homo sapien
gttaaactatattcctagaaacata

SEQ ID NO: 64901 - DNA, 25 bp, Homo sapien
acatagtttgaacaacttggtcttt

SEQ ID NO: 64902 - DNA, 25 bp, Homo sapien
aacttggtctttgttaggcttgtca

SEQ ID NO: 64903 - DNA, 25 bp, Homo sapien
gttaggcttgtcaaattgccttcat

SEQ ID NO: 64904 - DNA, 25 bp, Homo sapien
gcttgtcaaattgccttcatggaaa

SEQ ID NO: 64905 - DNA, 25 bp, Homo sapien
tggtttaattgattgtcttacatga

SEQ ID NO: 64906 - DNA, 25 bp, Homo sapien
tcttacatgataattttccctggca

SEQ ID NO: 64907 - DNA, 25 bp, Homo sapien
acatgataattttccctggcaacaa

SEQ ID NO: 64908 - DNA, 25 bp, Homo sapien
ccctggcaacaacttagtaagtgat

SEQ ID NO: 64909 - DNA, 25 bp, Homo sapien
agatgtggccatcgaacaccggaat

SEQ ID NO: 64910 - DNA, 25 bp, Homo sapien
ggccatcgaacaccggaatgaggct

SEQ ID NO: 64911 - DNA, 25 bp, Homo sapien
tgagcctcgtattgtcccactgcac

SEQ ID NO: 64912 - DNA, 25 bp, Homo sapien
ccactgcacgggagccacagatggg

SEQ ID NO: 64913 - DNA, 25 bp, Homo sapien
gggccacagctgacaagattcaacg

SEQ ID NO: 64914 - DNA, 25 bp, Homo sapien
tgacaagattcaacgggccagggca

SEQ ID NO: 64915 - DNA, 25 bp, Homo sapien
gattcaacgggccagggcacaagcc

SEQ ID NO: 64916 - DNA, 25 bp, Homo sapien
aagtgaggagtccatcctgtacatc

SEQ ID NO: 64917 - DNA, 25 bp, Homo sapien
gtccatcctgtacatctcaagcaag

SEQ ID NO: 64918 - DNA, 25 bp, Homo sapien
ctcctcccctagagcaatgctgagg

SEQ ID NO: 64919 - DNA, 25 bp, Homo sapien
gtagcagggctgtctggttttaaat

SEQ ID NO: 64920 - DNA, 25 bp, Homo sapien
tcttctggtgctacagctccaaggg

SEQ ID NO: 64921 - DNA, 25 bp, Homo sapien
tggtgctacagctccaagggccctt

SEQ ID NO: 64922 - DNA, 25 bp, Homo sapien
aagggcccttcaccttcatgtctga

SEQ ID NO: 64923 - DNA, 25 bp, Homo sapien
gcccttcaccttcatgtctgaaatg

SEQ ID NO: 64924 - DNA, 25 bp, Homo sapien
cttcaccttcatgtctgaaatggaa

SEQ ID NO: 64925 - DNA, 25 bp, Homo sapien
ttggctttttcagtggaagaatatg

SEQ ID NO: 64926 - DNA, 25 bp, Homo sapien
gaatactaagactgtttgggaattt

SEQ ID NO: 64927 - DNA, 25 bp, Homo sapien
ccaaatgataggttgtagagcctga

SEQ ID NO: 64928 - DNA, 25 bp, Homo sapien
tgataggttgtagagcctgatgact

SEQ ID NO: 64929 - DNA, 25 bp, Homo sapien
agcctgatgactccaaacaaagcca

SEQ ID NO: 64930 - DNA, 25 bp, Homo sapien
aaacaaagccatcacccgcattctt

SEQ ID NO: 64931 - DNA, 25 bp, Homo sapien
gggaaatcccactctgggcaactta

SEQ ID NO: 64932 - DNA, 25 bp, Homo sapien
gcaacttagccagcgcaatacggga

SEQ ID NO: 64933 - DNA, 25 bp, Homo sapien
gggcaatggagcataccaacagcaa

SEQ ID NO: 64934 - DNA, 25 bp, Homo sapien
aacagcaacgagagtgacagcagtc

SEQ ID NO: 64935 - DNA, 25 bp, Homo sapien
aggcagatctcctatgcaagccgtg

SEQ ID NO: 64936 - DNA, 25 bp, Homo sapien
aagccgtgcatcctgtacacgtcaa

SEQ ID NO: 64937 - DNA, 25 bp, Homo sapien
gtacacgtcaaagaagagcccctcg

SEQ ID NO: 64938 - DNA, 25 bp, Homo sapien
agaagagcccctcgatccagaggaa

SEQ ID NO: 64939 - DNA, 25 bp, Homo sapien
agaggaagctgaagggcccctgtcc

SEQ ID NO: 64940 - DNA, 25 bp, Homo sapien
tgaccatgacagagattacgaagat

SEQ ID NO: 64941 - DNA, 25 bp, Homo sapien
taaacgaggacatggagtgactatc

SEQ ID NO: 64942 - DNA, 25 bp, Homo sapien
tcattcttaagaactggtaacaaac

SEQ ID NO: 64943 - DNA, 25 bp, Homo sapien
gaactggtaacaaacgtgaacattt

SEQ ID NO: 64944 - DNA, 25 bp, Homo sapien
ttttttcagcattaacaaatgtgga

SEQ ID NO: 64945 - DNA, 25 bp, Homo sapien
caagaactggttttagtgagtagct

SEQ ID NO: 64946 - DNA, 25 bp, Homo sapien
agcatttcttcttgttaggtattat

SEQ ID NO: 64947 - DNA, 25 bp, Homo sapien
atttcttcttgttaggtattatgga

SEQ ID NO: 64948 - DNA, 25 bp, Homo sapien
acacattatatttcctgttgagaga

SEQ ID NO: 64949 - DNA, 25 bp, Homo sapien
gtaaatgactttttcttctattctc

SEQ ID NO: 64950 - DNA, 25 bp, Homo sapien
aatgactttttcttctattctctat

SEQ ID NO: 64951 - DNA, 25 bp, Homo sapien
tgactttttcttctattctctatta

SEQ ID NO: 64952 - DNA, 25 bp, Homo sapien
tattaaacaatttagttctagtctt

SEQ ID NO: 64953 - DNA, 25 bp, Homo sapien
taggataaatcatgtgtcttagaat

SEQ ID NO: 64954 - DNA, 25 bp, Homo sapien
taaggtctttgaggtcacttgatct

SEQ ID NO: 64955 - DNA, 25 bp, Homo sapien
tcacttgatcttctctaagtagact

SEQ ID NO: 64956 - DNA, 25 bp, Homo sapien
aatattgtgttttatctcatttctc

SEQ ID NO: 64957 - DNA, 25 bp, Homo sapien
catttctcaatattagaatacgggt

SEQ ID NO: 64958 - DNA, 25 bp, Homo sapien
ggaaatggttcatctttgtaccaaa

SEQ ID NO: 64959 - DNA, 25 bp, Homo sapien
gtaccaaaatattgcattcttctga

SEQ ID NO: 64960 - DNA, 25 bp, Homo sapien
tagacagttggaaactttctaaaat

SEQ ID NO: 64961 - DNA, 25 bp, Homo sapien
aaattgaggattttgtagtgtatac

SEQ ID NO: 64962 - DNA, 25 bp, Homo sapien
gtagtgtatactaaataattgcata

SEQ ID NO: 64963 - DNA, 25 bp, Homo sapien
atgtattctgagtatggtgatatta

SEQ ID NO: 64964 - DNA, 25 bp, Homo sapien
atgtgtcctgtggttatagctagaa

SEQ ID NO: 64965 - DNA, 25 bp, Homo sapien
atagctagaaggacaggagtctcct

SEQ ID NO: 64966 - DNA, 25 bp, Homo sapien
ggagtctcctgctgatgcgtgatag

SEQ ID NO: 64967 - DNA, 25 bp, Homo sapien
gctgatgcgtgatagcttaagcttg

SEQ ID NO: 64968 - DNA, 25 bp, Homo sapien
gggagaaggtcttttccactgccta

SEQ ID NO: 64969 - DNA, 25 bp, Homo sapien
agaaggtcttttccactgcctagct

SEQ ID NO: 64970 - DNA, 25 bp, Homo sapien
ttctatgtgtgtgggtaatctggtc

SEQ ID NO: 64971 - DNA, 25 bp, Homo sapien
aactagtgttgtaagtccgatgcca

SEQ ID NO: 64972 - DNA, 25 bp, Homo sapien
tgttgtaagtccgatgccagaattt

SEQ ID NO: 64973 - DNA, 25 bp, Homo sapien
tcatggcttttattcactgtgacta

SEQ ID NO: 64974 - DNA, 25 bp, Homo sapien
ttcactgtgactaataagcttccta

SEQ ID NO: 64975 - DNA, 25 bp, Homo sapien
cacctgtccacttgttcttgtgtga

SEQ ID NO: 64976 - DNA, 25 bp, Homo sapien
gtccacttgttcttgtgtgacagaa

SEQ ID NO: 64977 - DNA, 25 bp, Homo sapien
aaccataaagaaacacagtcagtac

SEQ ID NO: 64978 - DNA, 25 bp, Homo sapien
gaaacacagtcagtactatacaaga

SEQ ID NO: 64979 - DNA, 25 bp, Homo sapien
gaataatggctacttctagagggaa

SEQ ID NO: 64980 - DNA, 25 bp, Homo sapien
ggagttgtcattgtgatgaggcact

SEQ ID NO: 64981 - DNA, 25 bp, Homo sapien
tgtcattgtgatgaggcacttggag

SEQ ID NO: 64982 - DNA, 25 bp, Homo sapien
ttctggggtgcctgacaaagttctg

SEQ ID NO: 64983 - DNA, 25 bp, Homo sapien
tgtccccgtatttcaaattgtacct

SEQ ID NO: 64984 - DNA, 25 bp, Homo sapien
aattgtacctttgtgagattgtatg

SEQ ID NO: 64985 - DNA, 25 bp, Homo sapien
tgtacctttgtgagattgtatgttt

SEQ ID NO: 64986 - DNA, 25 bp, Homo sapien
gtcattaactgaagatacatgtttt

SEQ ID NO: 64987 - DNA, 25 bp, Homo sapien
taatcttgttgggaataagcttacc

SEQ ID NO: 64988 - DNA, 25 bp, Homo sapien
ggaataagcttacccactttctcct

SEQ ID NO: 64989 - DNA, 25 bp, Homo sapien
aatacccgagaatgtaaggtctcta

SEQ ID NO: 64990 - DNA, 25 bp, Homo sapien
aaggtctctaagtcattactaacaa

SEQ ID NO: 64991 - DNA, 25 bp, Homo sapien
aagtcattactaacaaagagcaaaa

SEQ ID NO: 64992 - DNA, 25 bp, Homo sapien
cagtattgtttttcccattgatttt

SEQ ID NO: 64993 - DNA, 25 bp, Homo sapien
aactgtatattagaatttgcctgta

SEQ ID NO: 64994 - DNA, 25 bp, Homo sapien
aatttgcctgtaaaatgaattctaa

SEQ ID NO: 64995 - DNA, 25 bp, Homo sapien
aaagcagatgtaaagtctctcctga

SEQ ID NO: 64996 - DNA, 25 bp, Homo sapien
agatgtaaagtctctcctgaaaatg

SEQ ID NO: 64997 - DNA, 25 bp, Homo sapien
gggctttaacagaactcggatataa

SEQ ID NO: 64998 - DNA, 25 bp, Homo sapien
gagagactgacttctaagtacatca

SEQ ID NO: 64999 - DNA, 25 bp, Homo sapien
tcatctcctttctattgctgttcaa

SEQ ID NO: 65000 - DNA, 25 bp, Homo sapien
ttgctgttcaacaagttaccattaa

SEQ ID NO: 65001 - DNA, 25 bp, Homo sapien
aagtgttctgaatctgtcaagcttc

SEQ ID NO: 65002 - DNA, 25 bp, Homo sapien
gtcaagcttcaagaataccagagaa

SEQ ID NO: 65003 - DNA, 25 bp, Homo sapien
tactacttccataaaacaggattgg

SEQ ID NO: 65004 - DNA, 25 bp, Homo sapien
tggtgaatcacggacttctagtcaa

SEQ ID NO: 65005 - DNA, 25 bp, Homo sapien
ggacttctagtcaacctacagctta

SEQ ID NO: 65006 - DNA, 25 bp, Homo sapien
cagcttaattattcagcatttgagt

SEQ ID NO: 65007 - DNA, 25 bp, Homo sapien
gcatttgagttattgagatccttat

SEQ ID NO: 65008 - DNA, 25 bp, Homo sapien
ttcatcccatgtgtgatcataaact

SEQ ID NO: 65009 - DNA, 25 bp, Homo sapien
tcatcccatgtgtgatcataaactc

SEQ ID NO: 65010 - DNA, 25 bp, Homo sapien
atcccatgtgtgatcataaactcat

SEQ ID NO: 65011 - DNA, 25 bp, Homo sapien
tcccatgtgtgatcataaactcata

SEQ ID NO: 65012 - DNA, 25 bp, Homo sapien
ccatgtgtgatcataaactcataaa

SEQ ID NO: 65013 - DNA, 25 bp, Homo sapien
taagatgtcggaaaaggatactttg

SEQ ID NO: 65014 - DNA, 25 bp, Homo sapien
gattaaataaaaacactcatggata

SEQ ID NO: 65015 - DNA, 25 bp, Homo sapien
acactcatggatatgtaaaaactgt

SEQ ID NO: 65016 - DNA, 25 bp, Homo sapien
atagtgatgaacaaagatccttttt

SEQ ID NO: 65017 - DNA, 25 bp, Homo sapien
gtgatgaacaaagatcctttttcat

SEQ ID NO: 65018 - DNA, 25 bp, Homo sapien
tgatgcaacagttttctgaaatgat

SEQ ID NO: 65019 - DNA, 25 bp, Homo sapien
cagctgatgtctgcactgagtgggt

SEQ ID NO: 65020 - DNA, 25 bp, Homo sapien
actgagtgggtttcatgagccccaa

SEQ ID NO: 65021 - DNA, 25 bp, Homo sapien
ttcatgagccccaagccaaaaccag

SEQ ID NO: 65022 - DNA, 25 bp, Homo sapien
caaaaccagctccagtcacagctgg

SEQ ID NO: 65023 - DNA, 25 bp, Homo sapien
tgcccacctcttgggctgtgagctg

SEQ ID NO: 65024 - DNA, 25 bp, Homo sapien
tccttcctcccatcggagggagaag

SEQ ID NO: 65025 - DNA, 25 bp, Homo sapien
agagaatttatccagaggcctgctg

SEQ ID NO: 65026 - DNA, 25 bp, Homo sapien
gaagtttgtcaacagaggaccccta

SEQ ID NO: 65027 - DNA, 25 bp, Homo sapien
gaggacccctactccatgcaggaca

SEQ ID NO: 65028 - DNA, 25 bp, Homo sapien
aggacagggtctcctgctgcaagtc

SEQ ID NO: 65029 - DNA, 25 bp, Homo sapien
gctgcaagtcccaactttgaataaa

SEQ ID NO: 65030 - DNA, 25 bp, Homo sapien
tgatatccagtcttttctaggagga

SEQ ID NO: 65031 - DNA, 25 bp, Homo sapien
gaagaccaagattctccagcggcag

SEQ ID NO: 65032 - DNA, 25 bp, Homo sapien
agaccaagattctccagcggcaggg

SEQ ID NO: 65033 - DNA, 25 bp, Homo sapien
ggcagggcagcctatcacccaactt

SEQ ID NO: 65034 - DNA, 25 bp, Homo sapien
tatcacccaacttctaagtcaggaa

SEQ ID NO: 65035 - DNA, 25 bp, Homo sapien
gaatgccagctggtaagcgcaggct

SEQ ID NO: 65036 - DNA, 25 bp, Homo sapien
actccttcaaggaaaagaggccctg

SEQ ID NO: 65037 - DNA, 25 bp, Homo sapien
ctccttttagcagttagggagaact

SEQ ID NO: 65038 - DNA, 25 bp, Homo sapien
taccagtggagtgtggaataaatcc

SEQ ID NO: 65039 - DNA, 25 bp, Homo sapien
atccaaagcagtgatttttaaatgt

SEQ ID NO: 65040 - DNA, 25 bp, Homo sapien
aatcttacatagaaccccaatataa

SEQ ID NO: 65041 - DNA, 25 bp, Homo sapien
gatggatgggtgaccacaggcccca

SEQ ID NO: 65042 - DNA, 25 bp, Homo sapien
acaggccccagtgcttactgtggag

SEQ ID NO: 65043 - DNA, 25 bp, Homo sapien
ggacatccaggataagttttcttct

SEQ ID NO: 65044 - DNA, 25 bp, Homo sapien
ataagttttcttctatcctcagccg

SEQ ID NO: 65045 - DNA, 25 bp, Homo sapien
gagactgctgtggaatggccgctat

SEQ ID NO: 65046 - DNA, 25 bp, Homo sapien
ggaatggccgctattacaactatga

SEQ ID NO: 65047 - DNA, 25 bp, Homo sapien
ttacaactatgacagcagctctcgg

SEQ ID NO: 65048 - DNA, 25 bp, Homo sapien
tcggcctcagtctcgtagtgttatg

SEQ ID NO: 65049 - DNA, 25 bp, Homo sapien
tctcgtagtgttatgtctgaccagt

SEQ ID NO: 65050 - DNA, 25 bp, Homo sapien
accagtgtgctggacagtggttcct

SEQ ID NO: 65051 - DNA, 25 bp, Homo sapien
ctggacagtggttcctgaaggcctg

SEQ ID NO: 65052 - DNA, 25 bp, Homo sapien
atttcagtactaggagcttctttgc

SEQ ID NO: 65053 - DNA, 25 bp, Homo sapien
gtactaggagcttctttgcagtcat

SEQ ID NO: 65054 - DNA, 25 bp, Homo sapien
aggagcttctttgcagtcattaaca

SEQ ID NO: 65055 - DNA, 25 bp, Homo sapien
agcttctttgcagtcattaacatga

SEQ ID NO: 65056 - DNA, 25 bp, Homo sapien
gtgattgtccataaattatcattga

SEQ ID NO: 65057 - DNA, 25 bp, Homo sapien
ttgtagtgttctgtatttatctgca

SEQ ID NO: 65058 - DNA, 25 bp, Homo sapien
gtgttctgtatttatctgcactttg

SEQ ID NO: 65059 - DNA, 25 bp, Homo sapien
atatgccaacatgtaaataacctca

SEQ ID NO: 65060 - DNA, 25 bp, Homo sapien
gtttattcctaatctaaattgccac

SEQ ID NO: 65061 - DNA, 25 bp, Homo sapien
attgccacaatatttttaatgtatg

SEQ ID NO: 65062 - DNA, 25 bp, Homo sapien
taatgtatggttacactgtgtttta

SEQ ID NO: 65063 - DNA, 25 bp, Homo sapien
actccctggctttggcattcagtga

SEQ ID NO: 65064 - DNA, 25 bp, Homo sapien
tttggcattcagtgagacgccctgc

SEQ ID NO: 65065 - DNA, 25 bp, Homo sapien
tgcacacacagaaagccaaagcgat

SEQ ID NO: 65066 - DNA, 25 bp, Homo sapien
aaagccaaagcgatcggtgctccca

SEQ ID NO: 65067 - DNA, 25 bp, Homo sapien
aagcgatcggtgctcccagatcccg

SEQ ID NO: 65068 - DNA, 25 bp, Homo sapien
agatcccgcagcctctggagagagc

SEQ ID NO: 65069 - DNA, 25 bp, Homo sapien
cagcctctggagagagctgacggca

SEQ ID NO: 65070 - DNA, 25 bp, Homo sapien
gagctgacggcagatgaaatcacca

SEQ ID NO: 65071 - DNA, 25 bp, Homo sapien
acggcagatgaaatcaccagggcgg

SEQ ID NO: 65072 - DNA, 25 bp, Homo sapien
aagtgaccccgcacggcgagacgcg

SEQ ID NO: 65073 - DNA, 25 bp, Homo sapien
cagtccttggaaataattaggcaaa

SEQ ID NO: 65074 - DNA, 25 bp, Homo sapien
caatggttttactttgcatctccct

SEQ ID NO: 65075 - DNA, 25 bp, Homo sapien
atctccctgattggtgttgctgtag

SEQ ID NO: 65076 - DNA, 25 bp, Homo sapien
tgtctttggtgtttattccatgaat

SEQ ID NO: 65077 - DNA, 25 bp, Homo sapien
attccatgaatagattgtgtgccca

SEQ ID NO: 65078 - DNA, 25 bp, Homo sapien
aatagattgtgtgcccattttctct

SEQ ID NO: 65079 - DNA, 25 bp, Homo sapien
ttattactgatgtgagcatgtgtat

SEQ ID NO: 65080 - DNA, 25 bp, Homo sapien
gcatgtgtatgggtgattatttgat

SEQ ID NO: 65081 - DNA, 25 bp, Homo sapien
gatgattatcagttttgcttagtag

SEQ ID NO: 65082 - DNA, 25 bp, Homo sapien
gcttagtagactggcaatatttagt

SEQ ID NO: 65083 - DNA, 25 bp, Homo sapien
atttagtcttgctgtcactgtgttc

SEQ ID NO: 65084 - DNA, 25 bp, Homo sapien
gttcccagtgccaactagattgctt

SEQ ID NO: 65085 - DNA, 25 bp, Homo sapien
gagagaaaatgaacttcccgatttc

SEQ ID NO: 65086 - DNA, 25 bp, Homo sapien
cacattgatgagttttttaccctta

SEQ ID NO: 65087 - DNA, 25 bp, Homo sapien
tttacccttaactcaacaccatcta

SEQ ID NO: 65088 - DNA, 25 bp, Homo sapien
actcaacaccatctagatctgcata

SEQ ID NO: 65089 - DNA, 25 bp, Homo sapien
gatctgcatatgatgagcctcattt

SEQ ID NO: 65090 - DNA, 25 bp, Homo sapien
agcctcatttgctcgtaaatattga

SEQ ID NO: 65091 - DNA, 25 bp, Homo sapien
acgacgactggatatcgaggccgaa

SEQ ID NO: 65092 - DNA, 25 bp, Homo sapien
ggccgaaacggctgcaggtagaaaa

SEQ ID NO: 65093 - DNA, 25 bp, Homo sapien
aaggaacgcctacaaatcgagaaag

SEQ ID NO: 65094 - DNA, 25 bp, Homo sapien
gaggctgcggcatttagacatggaa

SEQ ID NO: 65095 - DNA, 25 bp, Homo sapien
gaacatgagcggcttcagctagaga

SEQ ID NO: 65096 - DNA, 25 bp, Homo sapien
gactttcagtaaacataaagccaca

SEQ ID NO: 65097 - DNA, 25 bp, Homo sapien
ataaagccacaactcctacatgatg

SEQ ID NO: 65098 - DNA, 25 bp, Homo sapien
agccacaactcctacatgatgttat

SEQ ID NO: 65099 - DNA, 25 bp, Homo sapien
aactcctacatgatgttatgtacca

SEQ ID NO: 65100 - DNA, 25 bp, Homo sapien
gttatgtaccatatgatctgttttg

SEQ ID NO: 65101 - DNA, 25 bp, Homo sapien
attatttatttctggtaactcactc

SEQ ID NO: 65102 - DNA, 25 bp, Homo sapien
ttatttctggtaactcactcagttt

SEQ ID NO: 65103 - DNA, 25 bp, Homo sapien
ggtaactcactcagtttatgctgtg

SEQ ID NO: 65104 - DNA, 25 bp, Homo sapien
cagtttatgctgtgctaaatatcaa

SEQ ID NO: 65105 - DNA, 25 bp, Homo sapien
tatgctgtgctaaatatcaatcaag

SEQ ID NO: 65106 - DNA, 25 bp, Homo sapien
gctaaatatcaatcaagccatgtat

SEQ ID NO: 65107 - DNA, 25 bp, Homo sapien
agcccctaatgcaaagctctttacc

SEQ ID NO: 65108 - DNA, 25 bp, Homo sapien
atgcaaagctctttacctcttgcta

SEQ ID NO: 65109 - DNA, 25 bp, Homo sapien
aagctctttacctcttgctattttg

SEQ ID NO: 65110 - DNA, 25 bp, Homo sapien
ttacctcttgctattttgttatata

SEQ ID NO: 65111 - DNA, 25 bp, Homo sapien
aatgctcagagatcttttttcactg

SEQ ID NO: 65112 - DNA, 25 bp, Homo sapien
tatgggtattacctttgtctcttca

SEQ ID NO: 65113 - DNA, 25 bp, Homo sapien
ctttgtctcttcataccggttttat

SEQ ID NO: 65114 - DNA, 25 bp, Homo sapien
ctcttcataccggttttatgacaaa

SEQ ID NO: 65115 - DNA, 25 bp, Homo sapien
atgacaaaggtctattgaatttatt

SEQ ID NO: 65116 - DNA, 25 bp, Homo sapien
tgtaagtttctactcccatcaaagc

SEQ ID NO: 65117 - DNA, 25 bp, Homo sapien
tttctactcccatcaaagcagcttt

SEQ ID NO: 65118 - DNA, 25 bp, Homo sapien
tagggtctcttcttgcttgactcaa

SEQ ID NO: 65119 - DNA, 25 bp, Homo sapien
gcttgactcaatctacccagagatg

SEQ ID NO: 65120 - DNA, 25 bp, Homo sapien
agatgccccatagcacacctagagg

SEQ ID NO: 65121 - DNA, 25 bp, Homo sapien
ggcagggaccataggacccaggttc

SEQ ID NO: 65122 - DNA, 25 bp, Homo sapien
taggacccaggttccaaccccattg

SEQ ID NO: 65123 - DNA, 25 bp, Homo sapien
acacctgctcgtcccatttagctta

SEQ ID NO: 65124 - DNA, 25 bp, Homo sapien
ttagcttaccctcccagttggccag

SEQ ID NO: 65125 - DNA, 25 bp, Homo sapien
cccttccccatcagaagactgttga

SEQ ID NO: 65126 - DNA, 25 bp, Homo sapien
gaagactgttgactgctttgcattt

SEQ ID NO: 65127 - DNA, 25 bp, Homo sapien
gactgctttgcattttgggctcttc

SEQ ID NO: 65128 - DNA, 25 bp, Homo sapien
gcattttgggctcttctatatattt

SEQ ID NO: 65129 - DNA, 25 bp, Homo sapien
gaagcagccagaccacattctataa

SEQ ID NO: 65130 - DNA, 25 bp, Homo sapien
ctataatctttgaacatgctggcag

SEQ ID NO: 65131 - DNA, 25 bp, Homo sapien
aaacattctgacaaggtccagccag

SEQ ID NO: 65132 - DNA, 25 bp, Homo sapien
aggtccagccaggaatttctaagga

SEQ ID NO: 65133 - DNA, 25 bp, Homo sapien
atcccagtgtcatggagttgcttgg

SEQ ID NO: 65134 - DNA, 25 bp, Homo sapien
gggtcaacacaagtcacctcttagc

SEQ ID NO: 65135 - DNA, 25 bp, Homo sapien
cctcttagcttcatgccttagaatt

SEQ ID NO: 65136 - DNA, 25 bp, Homo sapien
tcatgccttagaattctcaactggg

SEQ ID NO: 65137 - DNA, 25 bp, Homo sapien
cagttgagtatatggcccaggtgca

SEQ ID NO: 65138 - DNA, 25 bp, Homo sapien
tggagggccagccttctcaaatgtc

SEQ ID NO: 65139 - DNA, 25 bp, Homo sapien
agccttctcaaatgtcctggtgtac

SEQ ID NO: 65140 - DNA, 25 bp, Homo sapien
atggccaccgcctgacgaatcgagt

SEQ ID NO: 65141 - DNA, 25 bp, Homo sapien
gaatcgagtgcctgtgtgtctacct

SEQ ID NO: 65142 - DNA, 25 bp, Homo sapien
tgtgtctacctctctgaagcctgag

SEQ ID NO: 65143 - DNA, 25 bp, Homo sapien
tctgaagcctgagcaccatgattcc

SEQ ID NO: 65144 - DNA, 25 bp, Homo sapien
acagccagctcttggctccaagatg

SEQ ID NO: 65145 - DNA, 25 bp, Homo sapien
agatgagcacccacaggaagccgac

SEQ ID NO: 65146 - DNA, 25 bp, Homo sapien
caggaacttgctgggtcagatctgt

SEQ ID NO: 65147 - DNA, 25 bp, Homo sapien
tgggtcagatctgtgtggccagccc

SEQ ID NO: 65148 - DNA, 25 bp, Homo sapien
atgcctctcctgcactggagagcag

SEQ ID NO: 65149 - DNA, 25 bp, Homo sapien
ttaggcttcatctgcttgacattgc

SEQ ID NO: 65150 - DNA, 25 bp, Homo sapien
cctgtcctcttcctcatatgagaac

SEQ ID NO: 65151 - DNA, 25 bp, Homo sapien
tgtttgctttatgcatttcccctgc

SEQ ID NO: 65152 - DNA, 25 bp, Homo sapien
gctttatgcatttcccctgcagctg

SEQ ID NO: 65153 - DNA, 25 bp, Homo sapien
gtgactaattgtggaacagcataca

SEQ ID NO: 65154 - DNA, 25 bp, Homo sapien
attgtggaacagcatacattttgtt

SEQ ID NO: 65155 - DNA, 25 bp, Homo sapien
ttgttttgagactctcttgagattt

SEQ ID NO: 65156 - DNA, 25 bp, Homo sapien
tttttctggcagtgtaaggtctaca

SEQ ID NO: 65157 - DNA, 25 bp, Homo sapien
tgtaaggtctacaccattttcctct

SEQ ID NO: 65158 - DNA, 25 bp, Homo sapien
caatgtgagcaaggccaggcacact

SEQ ID NO: 65159 - DNA, 25 bp, Homo sapien
agcaaggccaggcacacttgtgcta

SEQ ID NO: 65160 - DNA, 25 bp, Homo sapien
acacttgtgctactgcagttggcaa

SEQ ID NO: 65161 - DNA, 25 bp, Homo sapien
gtgctactgcagttggcaagaatgg

SEQ ID NO: 65162 - DNA, 25 bp, Homo sapien
gaagtaaagctttatgctaatttta

SEQ ID NO: 65163 - DNA, 25 bp, Homo sapien
gaaaatttatcttggtatgtccttt

SEQ ID NO: 65164 - DNA, 25 bp, Homo sapien
tcttggtatgtccttttttagataa

SEQ ID NO: 65165 - DNA, 25 bp, Homo sapien
ttagataactccagcaggaaactgt

SEQ ID NO: 65166 - DNA, 25 bp, Homo sapien
ggaaactgtaactgctatgtcttta

SEQ ID NO: 65167 - DNA, 25 bp, Homo sapien
gtaactgctatgtctttaggaaaac

SEQ ID NO: 65168 - DNA, 25 bp, Homo sapien
ttctttaattcctacaaggtacttg

SEQ ID NO: 65169 - DNA, 25 bp, Homo sapien
tttctatctttttatcttggcgcat

SEQ ID NO: 65170 - DNA, 25 bp, Homo sapien
tttatcttggcgcatttatggaaaa

SEQ ID NO: 65171 - DNA, 25 bp, Homo sapien
attaactgtcctgaatattttataa

SEQ ID NO: 65172 - DNA, 25 bp, Homo sapien
ttttcttgacttcttttatatagta

SEQ ID NO: 65173 - DNA, 25 bp, Homo sapien
tgctatgggatgtgtggactgttta

SEQ ID NO: 65174 - DNA, 25 bp, Homo sapien
tgtggactgtttagtgtgttcccct

SEQ ID NO: 65175 - DNA, 25 bp, Homo sapien
actgtttagtgtgttcccctttgtg

SEQ ID NO: 65176 - DNA, 25 bp, Homo sapien
ccctttgtgggtgggttcctatgat

SEQ ID NO: 65177 - DNA, 25 bp, Homo sapien
ggtgggttcctatgatacttattat

SEQ ID NO: 65178 - DNA, 25 bp, Homo sapien
agaacacagtggatcctttttgaat

SEQ ID NO: 65179 - DNA, 25 bp, Homo sapien
cagtggatcctttttgaatgttcgt

SEQ ID NO: 65180 - DNA, 25 bp, Homo sapien
ttttgaatgttcgtggaagggccag

SEQ ID NO: 65181 - DNA, 25 bp, Homo sapien
gaagggccaggagttcctgtgaaac

SEQ ID NO: 65182 - DNA, 25 bp, Homo sapien
gtgaaaccaggatactgcagcttta

SEQ ID NO: 65183 - DNA, 25 bp, Homo sapien
gaaactgtaacatatctcttatata

SEQ ID NO: 65184 - DNA, 25 bp, Homo sapien
ccctgtgtgtgagcaagaccacagc

SEQ ID NO: 65185 - DNA, 25 bp, Homo sapien
aagaccacagctctccttctatcta

SEQ ID NO: 65186 - DNA, 25 bp, Homo sapien
agctctccttctatctacagatgca

SEQ ID NO: 65187 - DNA, 25 bp, Homo sapien
tctccttctatctacagatgcatga

SEQ ID NO: 65188 - DNA, 25 bp, Homo sapien
ctatctacagatgcatgagggttgg

SEQ ID NO: 65189 - DNA, 25 bp, Homo sapien
ttagaccttctggtcagctgtattt

SEQ ID NO: 65190 - DNA, 25 bp, Homo sapien
cagctgtatttgtgtaacaactttt

SEQ ID NO: 65191 - DNA, 25 bp, Homo sapien
tgtgtggtgggaacatgtgaactat

SEQ ID NO: 65192 - DNA, 25 bp, Homo sapien
gtgggaacatgtgaactatgaaact

SEQ ID NO: 65193 - DNA, 25 bp, Homo sapien
ggttgtccacgcaggttgggctcct

SEQ ID NO: 65194 - DNA, 25 bp, Homo sapien
tgtccacgcaggttgggctcctctc

SEQ ID NO: 65195 - DNA, 25 bp, Homo sapien
tgggaacatacagagacctacaggg

SEQ ID NO: 65196 - DNA, 25 bp, Homo sapien
acctacagggaagacggccatggga

SEQ ID NO: 65197 - DNA, 25 bp, Homo sapien
tacgctgcctacagtcacggaatgc

SEQ ID NO: 65198 - DNA, 25 bp, Homo sapien
ctgcctacagtcacggaatgccaag

SEQ ID NO: 65199 - DNA, 25 bp, Homo sapien
cagtcacggaatgccaaggacagct

SEQ ID NO: 65200 - DNA, 25 bp, Homo sapien
acggaatgccaaggacagctggaaa

SEQ ID NO: 65201 - DNA, 25 bp, Homo sapien
cagaagctaagaaggagattttacc

SEQ ID NO: 65202 - DNA, 25 bp, Homo sapien
agaaatcaatcatactcacacctcc

SEQ ID NO: 65203 - DNA, 25 bp, Homo sapien
aatcaatcatactcacacctccttt

SEQ ID NO: 65204 - DNA, 25 bp, Homo sapien
gaatttctggcctcgtgaatggtga

SEQ ID NO: 65205 - DNA, 25 bp, Homo sapien
tctggcctcgtgaatggtgaaaaaa

SEQ ID NO: 65206 - DNA, 25 bp, Homo sapien
gatgagttcatttgcttctgtagat

SEQ ID NO: 65207 - DNA, 25 bp, Homo sapien
tgtgttttcagagctaggtacagag

SEQ ID NO: 65208 - DNA, 25 bp, Homo sapien
agaggaatgtttgctacctttagcg

SEQ ID NO: 65209 - DNA, 25 bp, Homo sapien
gaatgtttgctacctttagcggtga

SEQ ID NO: 65210 - DNA, 25 bp, Homo sapien
tgtttgctacctttagcggtgaaaa

SEQ ID NO: 65211 - DNA, 25 bp, Homo sapien
gaattttgttggattgtgtttgtgt

SEQ ID NO: 65212 - DNA, 25 bp, Homo sapien
gtgtgtgcatatatttgatatcatc

SEQ ID NO: 65213 - DNA, 25 bp, Homo sapien
atatttgtaatctttggacttgtaa

SEQ ID NO: 65214 - DNA, 25 bp, Homo sapien
ggacttgtaatcatagcctgtttat

SEQ ID NO: 65215 - DNA, 25 bp, Homo sapien
ttctactgtgccattaaatatactt

SEQ ID NO: 65216 - DNA, 25 bp, Homo sapien
gtgccattaaatatactttacctta

SEQ ID NO: 65217 - DNA, 25 bp, Homo sapien
ggctgcttctaccatctaataaata

SEQ ID NO: 65218 - DNA, 25 bp, Homo sapien
cctcaggcctttacaaaggtggaga

SEQ ID NO: 65219 - DNA, 25 bp, Homo sapien
agtgaccacccaaccttctgtgggc

SEQ ID NO: 65220 - DNA, 25 bp, Homo sapien
gagggaaggtgaagcttaactgcca

SEQ ID NO: 65221 - DNA, 25 bp, Homo sapien
ggtgaagcttaactgccagcttgaa

SEQ ID NO: 65222 - DNA, 25 bp, Homo sapien
actgccagcttgaaatgagagtaaa

SEQ ID NO: 65223 - DNA, 25 bp, Homo sapien
gagcaaacagtgtttcagaaactgt

SEQ ID NO: 65224 - DNA, 25 bp, Homo sapien
gaaactgtcctgccctgggtgtgat

SEQ ID NO: 65225 - DNA, 25 bp, Homo sapien
ctgggtgtgattctttggcttcaat

SEQ ID NO: 65226 - DNA, 25 bp, Homo sapien
agttcctccttgtttcatctctttg

SEQ ID NO: 65227 - DNA, 25 bp, Homo sapien
taagctggctgcttctaccatctaa

SEQ ID NO: 65228 - DNA, 25 bp, Homo sapien
ggaaatgacaccactagccatctca

SEQ ID NO: 65229 - DNA, 25 bp, Homo sapien
gacaccactagccatctcaatagtt

SEQ ID NO: 65230 - DNA, 25 bp, Homo sapien
acagtacctgaagtgcttagcgcat

SEQ ID NO: 65231 - DNA, 25 bp, Homo sapien
gcttagcgcatggtagcatttcata

SEQ ID NO: 65232 - DNA, 25 bp, Homo sapien
agcgcatggtagcatttcataaatg

SEQ ID NO: 65233 - DNA, 25 bp, Homo sapien
gtgtcaatactaatgctctaataat

SEQ ID NO: 65234 - DNA, 25 bp, Homo sapien
ttccctaatatcaggaaatcccagt

SEQ ID NO: 65235 - DNA, 25 bp, Homo sapien
aaatcccagttgtctatgtggccca

SEQ ID NO: 65236 - DNA, 25 bp, Homo sapien
agttgtctatgtggcccagtgctta

SEQ ID NO: 65237 - DNA, 25 bp, Homo sapien
tatgtggcccagtgcttaaaaacgc

SEQ ID NO: 65238 - DNA, 25 bp, Homo sapien
ggcccagtgcttaaaaacgccttct

SEQ ID NO: 65239 - DNA, 25 bp, Homo sapien
aaattatgtctatggcactaatata

SEQ ID NO: 65240 - DNA, 25 bp, Homo sapien
aattatgtctatggcactaatataa

SEQ ID NO: 65241 - DNA, 25 bp, Homo sapien
attatgtctatggcactaatataaa

SEQ ID NO: 65242 - DNA, 25 bp, Homo sapien
ttatgtctatggcactaatataaaa

SEQ ID NO: 65243 - DNA, 25 bp, Homo sapien
tatgtctatggcactaatataaaat

SEQ ID NO: 65244 - DNA, 25 bp, Homo sapien
atgtctatggcactaatataaaatg

SEQ ID NO: 65245 - DNA, 25 bp, Homo sapien
tgtctatggcactaatataaaatga

SEQ ID NO: 65246 - DNA, 25 bp, Homo sapien
ctggagtacagcagagcgatctcgg

SEQ ID NO: 65247 - DNA, 25 bp, Homo sapien
tggagtacagcagagcgatctcggc

SEQ ID NO: 65248 - DNA, 25 bp, Homo sapien
actgcaagctcctgcaagctccgcc

SEQ ID NO: 65249 - DNA, 25 bp, Homo sapien
tcctttcaggaaggtcgtgggaaca

SEQ ID NO: 65250 - DNA, 25 bp, Homo sapien
cctttcaggaaggtcgtgggaacat

SEQ ID NO: 65251 - DNA, 25 bp, Homo sapien
ctttcaggaaggtcgtgggaacata

SEQ ID NO: 65252 - DNA, 25 bp, Homo sapien
tttcaggaaggtcgtgggaacatac

SEQ ID NO: 65253 - DNA, 25 bp, Homo sapien
ttcaggaaggtcgtgggaacataca

SEQ ID NO: 65254 - DNA, 25 bp, Homo sapien
tcaggaaggtcgtgggaacatacag

SEQ ID NO: 65255 - DNA, 25 bp, Homo sapien
caggaaggtcgtgggaacatacaga

SEQ ID NO: 65256 - DNA, 25 bp, Homo sapien
aggaaggtcgtgggaacatacagag

SEQ ID NO: 65257 - DNA, 25 bp, Homo sapien
ggaagcaaaacgctgcccagatcct

SEQ ID NO: 65258 - DNA, 25 bp, Homo sapien
cctggagaaaatcaaccttagtagt

SEQ ID NO: 65259 - DNA, 25 bp, Homo sapien
gtagtttcaactcatacattgtctt

SEQ ID NO: 65260 - DNA, 25 bp, Homo sapien
tgttttttatcctctttaagcacag

SEQ ID NO: 65261 - DNA, 25 bp, Homo sapien
aagcacagatgcgtgttgaagtcta

SEQ ID NO: 65262 - DNA, 25 bp, Homo sapien
gaagtctaaggtgttctgtcatcac

SEQ ID NO: 65263 - DNA, 25 bp, Homo sapien
gtcatcacactctctttactagaat

SEQ ID NO: 65264 - DNA, 25 bp, Homo sapien
actagaataagtgtgcccaggcaga

SEQ ID NO: 65265 - DNA, 25 bp, Homo sapien
gtgtattcaatgttgctggcatgtg

SEQ ID NO: 65266 - DNA, 25 bp, Homo sapien
atgtgtggattcacagctcgtggct

SEQ ID NO: 65267 - DNA, 25 bp, Homo sapien
agctcgtggctgtaaggaaatctgg

SEQ ID NO: 65268 - DNA, 25 bp, Homo sapien
tggctcccctgggtggcctgccagc

SEQ ID NO: 65269 - DNA, 25 bp, Homo sapien
ctgggtggcctgccagcacagccag

SEQ ID NO: 65270 - DNA, 25 bp, Homo sapien
tgggtggcctgccagcacagccagt

SEQ ID NO: 65271 - DNA, 25 bp, Homo sapien
gggtggcctgccagcacagccagtg

SEQ ID NO: 65272 - DNA, 25 bp, Homo sapien
tgccagcacagccagtgccatcagg

SEQ ID NO: 65273 - DNA, 25 bp, Homo sapien
gccagcacagccagtgccatcaggg

SEQ ID NO: 65274 - DNA, 25 bp, Homo sapien
ccagcacagccagtgccatcaggga

SEQ ID NO: 65275 - DNA, 25 bp, Homo sapien
cagcacagccagtgccatcagggag

SEQ ID NO: 65276 - DNA, 25 bp, Homo sapien
agcacagccagtgccatcagggagc

SEQ ID NO: 65277 - DNA, 25 bp, Homo sapien
gcacagccagtgccatcagggagct

SEQ ID NO: 65278 - DNA, 25 bp, Homo sapien
gagatgctctgcctctgaacttcaa

SEQ ID NO: 65279 - DNA, 25 bp, Homo sapien
atgctctgcctctgaacttcaaagt

SEQ ID NO: 65280 - DNA, 25 bp, Homo sapien
gctctgcctctgaacttcaaagtgg

SEQ ID NO: 65281 - DNA, 25 bp, Homo sapien
tctgcctctgaacttcaaagtggag

SEQ ID NO: 65282 - DNA, 25 bp, Homo sapien
aacttcaaagtggaggtggagtgct

SEQ ID NO: 65283 - DNA, 25 bp, Homo sapien
tggagtgctggccacgtctccacct

SEQ ID NO: 65284 - DNA, 25 bp, Homo sapien
gagtgctggccacgtctccacctaa

SEQ ID NO: 65285 - DNA, 25 bp, Homo sapien
ctaacaaccctctttattctcttgt

SEQ ID NO: 65286 - DNA, 25 bp, Homo sapien
taacaaccctctttattctcttgtt

SEQ ID NO: 65287 - DNA, 25 bp, Homo sapien
attctcttgttaaagttttgttcat

SEQ ID NO: 65288 - DNA, 25 bp, Homo sapien
caccacacacaccatctgattaaaa

SEQ ID NO: 65289 - DNA, 25 bp, Homo sapien
atggagagtccatgttgtacttaga

SEQ ID NO: 65290 - DNA, 25 bp, Homo sapien
ttgtacttagatgggcagcggcatt

SEQ ID NO: 65291 - DNA, 25 bp, Homo sapien
agcggcatttcaactccatgagtgg

SEQ ID NO: 65292 - DNA, 25 bp, Homo sapien
gagtggcccagcgaccttgagaaag

SEQ ID NO: 65293 - DNA, 25 bp, Homo sapien
aaggactaccttgtggagccctaag

SEQ ID NO: 65294 - DNA, 25 bp, Homo sapien
ggagccctaagaacaccacatttgt

SEQ ID NO: 65295 - DNA, 25 bp, Homo sapien
gttgaaaactagcactctacccaca

SEQ ID NO: 65296 - DNA, 25 bp, Homo sapien
ctctacccacagtgacgtggtatct

SEQ ID NO: 65297 - DNA, 25 bp, Homo sapien
cgtggtatctgatgaagacctgatc

SEQ ID NO: 65298 - DNA, 25 bp, Homo sapien
gacctgatcgagtgtattgatttta

SEQ ID NO: 65299 - DNA, 25 bp, Homo sapien
attttagtattgcttcgtgtcctcc

SEQ ID NO: 65300 - DNA, 25 bp, Homo sapien
ggcaggcatttgtcaggccatatgt

SEQ ID NO: 65301 - DNA, 25 bp, Homo sapien
gtcaggccatatgttttaaccttat

SEQ ID NO: 65302 - DNA, 25 bp, Homo sapien
ttaaccttatggtaatactttgctt

SEQ ID NO: 65303 - DNA, 25 bp, Homo sapien
atactttgctttagtcgttcctcct

SEQ ID NO: 65304 - DNA, 25 bp, Homo sapien
tagtcgttcctcctgctaccagtag

SEQ ID NO: 65305 - DNA, 25 bp, Homo sapien
taccagtagcgttttgacccacctg

SEQ ID NO: 65306 - DNA, 25 bp, Homo sapien
acctgccagtgtttgcttgctctat

SEQ ID NO: 65307 - DNA, 25 bp, Homo sapien
agtgtttgcttgctctatgtttcag

SEQ ID NO: 65308 - DNA, 25 bp, Homo sapien
gcttgctctatgtttcagtagcaga

SEQ ID NO: 65309 - DNA, 25 bp, Homo sapien
tcagtagcagattttcacacatgtg

SEQ ID NO: 65310 - DNA, 25 bp, Homo sapien
acacatgtgcattgcagagacgtca

SEQ ID NO: 65311 - DNA, 25 bp, Homo sapien
gcctctgaacttcaaagtggaggtg

SEQ ID NO: 65312 - DNA, 25 bp, Homo sapien
ctctgaacttcaaagtggaggtgga

SEQ ID NO: 65313 - DNA, 25 bp, Homo sapien
aacttcaaagtggaggtggagtgct

SEQ ID NO: 65314 - DNA, 25 bp, Homo sapien
tcaaagtggaggtggagtgctggcc

SEQ ID NO: 65315 - DNA, 25 bp, Homo sapien
tggagtgctggccacgtctccacct

SEQ ID NO: 65316 - DNA, 25 bp, Homo sapien
gagtgctggccacgtctccacctaa

SEQ ID NO: 65317 - DNA, 25 bp, Homo sapien
tgctggccacgtctccacctaacaa

SEQ ID NO: 65318 - DNA, 25 bp, Homo sapien
ctaacaaccctctttattctcttgt

SEQ ID NO: 65319 - DNA, 25 bp, Homo sapien
taacaaccctctttattctcttgtt

SEQ ID NO: 65320 - DNA, 25 bp, Homo sapien
tattctcttgttaaagttttgttca

SEQ ID NO: 65321 - DNA, 25 bp, Homo sapien
attctcttgttaaagttttgttcat

SEQ ID NO: 65322 - DNA, 25 bp, Homo sapien
ttagatgatctatgtgcagggcaat

SEQ ID NO: 65323 - DNA, 25 bp, Homo sapien
gcaatgaagttgaaaccccttggta

SEQ ID NO: 65324 - DNA, 25 bp, Homo sapien
ggttgcaaaccaaatcaagagtatt

SEQ ID NO: 65325 - DNA, 25 bp, Homo sapien
attaggcctgcctttaattttcagt

SEQ ID NO: 65326 - DNA, 25 bp, Homo sapien
gtaagtgttcagtatgccgcatcct

SEQ ID NO: 65327 - DNA, 25 bp, Homo sapien
gcatcctgcctcagtattgatcttg

SEQ ID NO: 65328 - DNA, 25 bp, Homo sapien
gcctcagtattgatcttgtgttctt

SEQ ID NO: 65329 - DNA, 25 bp, Homo sapien
tcctttattgttgaatgctcccatt

SEQ ID NO: 65330 - DNA, 25 bp, Homo sapien
gaatgctcccatttaatgctttatg

SEQ ID NO: 65331 - DNA, 25 bp, Homo sapien
ttacttttttagactcccgtctgca

SEQ ID NO: 65332 - DNA, 25 bp, Homo sapien
tagactcccgtctgcacaaaatgca

SEQ ID NO: 65333 - DNA, 25 bp, Homo sapien
tctcctggcaatctgtcagaacggt

SEQ ID NO: 65334 - DNA, 25 bp, Homo sapien
aaggagcttgggtgcatttgccctc

SEQ ID NO: 65335 - DNA, 25 bp, Homo sapien
atttgccctcatcctgagaaggcca

SEQ ID NO: 65336 - DNA, 25 bp, Homo sapien
tactggagaccagcgtgaaccctca

SEQ ID NO: 65337 - DNA, 25 bp, Homo sapien
tttagaaacagtgacacctgcatat

SEQ ID NO: 65338 - DNA, 25 bp, Homo sapien
gaattttgattccttgaagagccta

SEQ ID NO: 65339 - DNA, 25 bp, Homo sapien
gaagagcctatttagttccataaaa

SEQ ID NO: 65340 - DNA, 25 bp, Homo sapien
aaaattggagaactgctgaaggtca

SEQ ID NO: 65341 - DNA, 25 bp, Homo sapien
aaggtcagtaattccgactttctca

SEQ ID NO: 65342 - DNA, 25 bp, Homo sapien
aattccgactttctcagcagtggtg

SEQ ID NO: 65343 - DNA, 25 bp, Homo sapien
agtggtgtctctgaattactgcaaa

SEQ ID NO: 65344 - DNA, 25 bp, Homo sapien
tcttttcctcgcagatgataaaagg

SEQ ID NO: 65345 - DNA, 25 bp, Homo sapien
aggaatctggcattctacacctgga

SEQ ID NO: 65346 - DNA, 25 bp, Homo sapien
ggcattctacacctggaccatttga

SEQ ID NO: 65347 - DNA, 25 bp, Homo sapien
cacctggaccatttgattgttttat

SEQ ID NO: 65348 - DNA, 25 bp, Homo sapien
attggtgtatatcatgaagccttgc

SEQ ID NO: 65349 - DNA, 25 bp, Homo sapien
ctgaactaagttttgtgtgtatata

SEQ ID NO: 65350 - DNA, 25 bp, Homo sapien
ataaagacctatgtacttaatcctt

SEQ ID NO: 65351 - DNA, 25 bp, Homo sapien
tacttaatcctttaactctgcggat

SEQ ID NO: 65352 - DNA, 25 bp, Homo sapien
aactctgcggatagcatttggtagg

SEQ ID NO: 65353 - DNA, 25 bp, Homo sapien
agcatttggtaggtagtgattaact

SEQ ID NO: 65354 - DNA, 25 bp, Homo sapien
gagcgtttgctgtgccaggaggcgg

SEQ ID NO: 65355 - DNA, 25 bp, Homo sapien
aggtcctggccgtccacagggtcgg

SEQ ID NO: 65356 - DNA, 25 bp, Homo sapien
gtcagggaggagactcgctgggagt

SEQ ID NO: 65357 - DNA, 25 bp, Homo sapien
agtgggagggcagcacgggcgtgaa

SEQ ID NO: 65358 - DNA, 25 bp, Homo sapien
cacgggcgtgaaggtcggaggacag

SEQ ID NO: 65359 - DNA, 25 bp, Homo sapien
agaaaggtcagcagggtcagagtat

SEQ ID NO: 65360 - DNA, 25 bp, Homo sapien
cagagtatgtgaggtcagagggcat

SEQ ID NO: 65361 - DNA, 25 bp, Homo sapien
agcaaggtgtgaggagcacaagcca

SEQ ID NO: 65362 - DNA, 25 bp, Homo sapien
agcacaagccagggtgccccgagga

SEQ ID NO: 65363 - DNA, 25 bp, Homo sapien
ggtgggtccttgtgtggcctggcgc

SEQ ID NO: 65364 - DNA, 25 bp, Homo sapien
ggcagcacgggagacgttgacacca

SEQ ID NO: 65365 - DNA, 25 bp, Homo sapien
agcacgggagacgttgacaccaccg

SEQ ID NO: 65366 - DNA, 25 bp, Homo sapien
gtgctctgaacttgaaactcactgg

SEQ ID NO: 65367 - DNA, 25 bp, Homo sapien
actcactggagagctgaagggagct

SEQ ID NO: 65368 - DNA, 25 bp, Homo sapien
gctgaagggagctgccatgtccgat

SEQ ID NO: 65369 - DNA, 25 bp, Homo sapien
aagggagctgccatgtccgatgaat

SEQ ID NO: 65370 - DNA, 25 bp, Homo sapien
gagctgccatgtccgatgaatgcca

SEQ ID NO: 65371 - DNA, 25 bp, Homo sapien
tgccatgtccgatgaatgccaacag

SEQ ID NO: 65372 - DNA, 25 bp, Homo sapien
gaatgccaacagacaggccactctt

SEQ ID NO: 65373 - DNA, 25 bp, Homo sapien
caacagacaggccactctttggtca

SEQ ID NO: 65374 - DNA, 25 bp, Homo sapien
actctttggtcagcctgctgacaaa

SEQ ID NO: 65375 - DNA, 25 bp, Homo sapien
tcagcctgctgacaaatttaagtgc

SEQ ID NO: 65376 - DNA, 25 bp, Homo sapien
aatttaagtgctggtacctgtggtg

SEQ ID NO: 65377 - DNA, 25 bp, Homo sapien
tagtgtttctagcattatcccatcc

SEQ ID NO: 65378 - DNA, 25 bp, Homo sapien
ttctagcattatcccatccctttga

SEQ ID NO: 65379 - DNA, 25 bp, Homo sapien
atcccatccctttgagccattcagg

SEQ ID NO: 65380 - DNA, 25 bp, Homo sapien
cattcaggggtacttgtgcatttaa

SEQ ID NO: 65381 - DNA, 25 bp, Homo sapien
taacattttaggtttctcttgcaga

SEQ ID NO: 65382 - DNA, 25 bp, Homo sapien
atgagagatagcacagatggaccaa

SEQ ID NO: 65383 - DNA, 25 bp, Homo sapien
gatggaccaaaggttatgcacaggt

SEQ ID NO: 65384 - DNA, 25 bp, Homo sapien
atgcacaggtgggagtcttttgtat

SEQ ID NO: 65385 - DNA, 25 bp, Homo sapien
gggagtcttttgtatatagttgtaa

SEQ ID NO: 65386 - DNA, 25 bp, Homo sapien
atagttgtaaatattgtcttggtta

SEQ ID NO: 65387 - DNA, 25 bp, Homo sapien
attgaactgtattcctgttttgtat

SEQ ID NO: 65388 - DNA, 25 bp, Homo sapien
gctctcccccaggattttggtgttt

SEQ ID NO: 65389 - DNA, 25 bp, Homo sapien
tggtgttttgactaacaccagttcc

SEQ ID NO: 65390 - DNA, 25 bp, Homo sapien
caggccctaagcacgtgcagcaaag

SEQ ID NO: 65391 - DNA, 25 bp, Homo sapien
agcacgtgcagcaaagcacaccaca

SEQ ID NO: 65392 - DNA, 25 bp, Homo sapien
aagcacaccacagcacctttgataa

SEQ ID NO: 65393 - DNA, 25 bp, Homo sapien
agcacctttgataacctctctccat

SEQ ID NO: 65394 - DNA, 25 bp, Homo sapien
ctgatgacctgctctagactgttat

SEQ ID NO: 65395 - DNA, 25 bp, Homo sapien
gagggataagcagctcattcccctg

SEQ ID NO: 65396 - DNA, 25 bp, Homo sapien
ggttcagatgacactgctgcatcct

SEQ ID NO: 65397 - DNA, 25 bp, Homo sapien
tgcatcctggtcacattctctgtct

SEQ ID NO: 65398 - DNA, 25 bp, Homo sapien
atgctcccacctcaagtggagttag

SEQ ID NO: 65399 - DNA, 25 bp, Homo sapien
gtttttaatttcatcgtggcacagc

SEQ ID NO: 65400 - DNA, 25 bp, Homo sapien
ttttaatttcatcgtggcacagctt

SEQ ID NO: 65401 - DNA, 25 bp, Homo sapien
taatttcatcgtggcacagcttcaa

SEQ ID NO: 65402 - DNA, 25 bp, Homo sapien
tttcatcgtggcacagcttcaaaat

SEQ ID NO: 65403 - DNA, 25 bp, Homo sapien
tcgtggcacagcttcaaaatgacat

SEQ ID NO: 65404 - DNA, 25 bp, Homo sapien
ggcacagcttcaaaatgacatctaa

SEQ ID NO: 65405 - DNA, 25 bp, Homo sapien
atgacatctaagtagctgacataaa

SEQ ID NO: 65406 - DNA, 25 bp, Homo sapien
aatgaaaattctgtgtactttgata

SEQ ID NO: 65407 - DNA, 25 bp, Homo sapien
gtgtactttgatattagcaggcttc

SEQ ID NO: 65408 - DNA, 25 bp, Homo sapien
attagcaggcttcaaatacaaacca

SEQ ID NO: 65409 - DNA, 25 bp, Homo sapien
gcaggcttcaaatacaaaccagaat

SEQ ID NO: 65410 - DNA, 25 bp, Homo sapien
gcagcaggaagtagctttgtcaata

SEQ ID NO: 65411 - DNA, 25 bp, Homo sapien
ggaagtagctttgtcaataaggcaa

SEQ ID NO: 65412 - DNA, 25 bp, Homo sapien
caagacttggaatacaggttggaaa

SEQ ID NO: 65413 - DNA, 25 bp, Homo sapien
gtagcagcataaaattacttgtgtt

SEQ ID NO: 65414 - DNA, 25 bp, Homo sapien
attacttgtgttaatttcattcaaa

SEQ ID NO: 65415 - DNA, 25 bp, Homo sapien
attgcttaaaatatccttcctacag

SEQ ID NO: 65416 - DNA, 25 bp, Homo sapien
tatccttcctacagtaaacttgttg

SEQ ID NO: 65417 - DNA, 25 bp, Homo sapien
acagtaaacttgttgacacgagtaa

SEQ ID NO: 65418 - DNA, 25 bp, Homo sapien
gagtaaagtttaatctgcagccatc

SEQ ID NO: 65419 - DNA, 25 bp, Homo sapien
gtttaatctgcagccatcttttctt

SEQ ID NO: 65420 - DNA, 25 bp, Homo sapien
ttgccttccctttataagtaaatat

SEQ ID NO: 65421 - DNA, 25 bp, Homo sapien
gtgtgcctgtcagtatgaaaaagat

SEQ ID NO: 65422 - DNA, 25 bp, Homo sapien
aagatgagtaggacttctccagcag

SEQ ID NO: 65423 - DNA, 25 bp, Homo sapien
atggcaagccaaggcttagcctcca

SEQ ID NO: 65424 - DNA, 25 bp, Homo sapien
caaggcttagcctccatgaagaaga

SEQ ID NO: 65425 - DNA, 25 bp, Homo sapien
agagccactcgtaacagcgaacggt

SEQ ID NO: 65426 - DNA, 25 bp, Homo sapien
gcgaacggtcagtcaaggatcataa

SEQ ID NO: 65427 - DNA, 25 bp, Homo sapien
ggatcataagtttttactgccagta

SEQ ID NO: 65428 - DNA, 25 bp, Homo sapien
aaattcgtggaagaaatgtcagcag

SEQ ID NO: 65429 - DNA, 25 bp, Homo sapien
aaaattcaccgagaagtgtgtgtgt

SEQ ID NO: 65430 - DNA, 25 bp, Homo sapien
aagtgtgtgtgtgttcgctgcttcc

SEQ ID NO: 65431 - DNA, 25 bp, Homo sapien
gtgttcgctgcttccacacattaat

SEQ ID NO: 65432 - DNA, 25 bp, Homo sapien
ttcagtggctcacgttggtgctaca

SEQ ID NO: 65433 - DNA, 25 bp, Homo sapien
cacgttggtgctacacagctagaat

SEQ ID NO: 65434 - DNA, 25 bp, Homo sapien
gagatatttttaagacaaagcccac

SEQ ID NO: 65435 - DNA, 25 bp, Homo sapien
caaagcccacaattagctgtccttt

SEQ ID NO: 65436 - DNA, 25 bp, Homo sapien
ttagctgtcctttaacaccgcagaa

SEQ ID NO: 65437 - DNA, 25 bp, Homo sapien
gaagaagagcgatccctcggacggt

SEQ ID NO: 65438 - DNA, 25 bp, Homo sapien
tcagccgggctctttgcagaagcag

SEQ ID NO: 65439 - DNA, 25 bp, Homo sapien
tgcagaagcagcaccgctgactgtg

SEQ ID NO: 65440 - DNA, 25 bp, Homo sapien
gatgtgtacatatacggctatttcc

SEQ ID NO: 65441 - DNA, 25 bp, Homo sapien
ggctatttcctattttactgttctt

SEQ ID NO: 65442 - DNA, 25 bp, Homo sapien
ctgttcttcagatttagtacttgta

SEQ ID NO: 65443 - DNA, 25 bp, Homo sapien
cttacggatttagacgaggttcgag

SEQ ID NO: 65444 - DNA, 25 bp, Homo sapien
agggcagctctcaggattgtcattt

SEQ ID NO: 65445 - DNA, 25 bp, Homo sapien
atgtttttatcgtactctttggaga

SEQ ID NO: 65446 - DNA, 25 bp, Homo sapien
ttatcgtactctttggagatgccca

SEQ ID NO: 65447 - DNA, 25 bp, Homo sapien
ctctttggagatgcccattctactt

SEQ ID NO: 65448 - DNA, 25 bp, Homo sapien
tagcttttactaattcgcatctgga

SEQ ID NO: 65449 - DNA, 25 bp, Homo sapien
tttactaattcgcatctggaagctc

SEQ ID NO: 65450 - DNA, 25 bp, Homo sapien
gctcagcaagtgcacaagccttact

SEQ ID NO: 65451 - DNA, 25 bp, Homo sapien
gcaagtgcacaagccttactttggt

SEQ ID NO: 65452 - DNA, 25 bp, Homo sapien
tgcacaagccttactttggttaccg

SEQ ID NO: 65453 - DNA, 25 bp, Homo sapien
tgccttcttacggatttagacgagg

SEQ ID NO: 65454 - DNA, 25 bp, Homo sapien
gttaaaattgaggtcacatattttc

SEQ ID NO: 65455 - DNA, 25 bp, Homo sapien
tgtatcctggcaaatactcctgcag

SEQ ID NO: 65456 - DNA, 25 bp, Homo sapien
tcctggcaaatactcctgcaggcca

SEQ ID NO: 65457 - DNA, 25 bp, Homo sapien
gcaggccaggaagtataatagcaaa

SEQ ID NO: 65458 - DNA, 25 bp, Homo sapien
gtattacattaccattgccactgat

SEQ ID NO: 65459 - DNA, 25 bp, Homo sapien
tacattaccattgccactgattttt

SEQ ID NO: 65460 - DNA, 25 bp, Homo sapien
ggtaaatgaccttgtatataaatat

SEQ ID NO: 65461 - DNA, 25 bp, Homo sapien
aatattgccatatcatggtacctat

SEQ ID NO: 65462 - DNA, 25 bp, Homo sapien
tcatggtacctataatggtgatata

SEQ ID NO: 65463 - DNA, 25 bp, Homo sapien
aaatgtattgtgctttgatactaaa

SEQ ID NO: 65464 - DNA, 25 bp, Homo sapien
tttctgctggtggatttacatatta

SEQ ID NO: 65465 - DNA, 25 bp, Homo sapien
gaaactttcagaagtgggcagaaga

SEQ ID NO: 65466 - DNA, 25 bp, Homo sapien
gaatatgaatgaagccatcggtaga

SEQ ID NO: 65467 - DNA, 25 bp, Homo sapien
aagccatcggtagagatgaggatca

SEQ ID NO: 65468 - DNA, 25 bp, Homo sapien
gtgttcagagggatcatgggatttt

SEQ ID NO: 65469 - DNA, 25 bp, Homo sapien
ggatcatgggattttattaaactgg

SEQ ID NO: 65470 - DNA, 25 bp, Homo sapien
aactggattttcaagcgatttgtct

SEQ ID NO: 65471 - DNA, 25 bp, Homo sapien
caagcgatttgtctgttataggaaa

SEQ ID NO: 65472 - DNA, 25 bp, Homo sapien
aaatgagggttttacttctgctgct

SEQ ID NO: 65473 - DNA, 25 bp, Homo sapien
gttttacttctgctgctttccatca

SEQ ID NO: 65474 - DNA, 25 bp, Homo sapien
gctttccatcactattttgccatta

SEQ ID NO: 65475 - DNA, 25 bp, Homo sapien
tgccattaaataggtgtctttcact

SEQ ID NO: 65476 - DNA, 25 bp, Homo sapien
gctctggcagaatcaagctgttgca

SEQ ID NO: 65477 - DNA, 25 bp, Homo sapien
atcaagctgttgcagcagtgccttc

SEQ ID NO: 65478 - DNA, 25 bp, Homo sapien
tcttcatccttccttacgatcaatc

SEQ ID NO: 65479 - DNA, 25 bp, Homo sapien
ttacgatcaatcacagtctccagaa

SEQ ID NO: 65480 - DNA, 25 bp, Homo sapien
agctcaattgctgtgcaggttaaaa

SEQ ID NO: 65481 - DNA, 25 bp, Homo sapien
aaactacagaaccacatcccaaagg

SEQ ID NO: 65482 - DNA, 25 bp, Homo sapien
cacatcccaaaggtacctggtaaga

SEQ ID NO: 65483 - DNA, 25 bp, Homo sapien
gtttgaaagatcttccatttctagg

SEQ ID NO: 65484 - DNA, 25 bp, Homo sapien
catttctaggaaccccagtcctgct

SEQ ID NO: 65485 - DNA, 25 bp, Homo sapien
tgcttctccgcaatggcacatgctt

SEQ ID NO: 65486 - DNA, 25 bp, Homo sapien
catccatactggcatcctcaaataa

SEQ ID NO: 65487 - DNA, 25 bp, Homo sapien
aataaaattttatggccgggcacag

SEQ ID NO: 65488 - DNA, 25 bp, Homo sapien
ataaaattttatggccgggcacagt

SEQ ID NO: 65489 - DNA, 25 bp, Homo sapien
taaaattttatggccgggcacagtg

SEQ ID NO: 65490 - DNA, 25 bp, Homo sapien
aaaattttatggccgggcacagtgg

SEQ ID NO: 65491 - DNA, 25 bp, Homo sapien
aaattttatggccgggcacagtggc

SEQ ID NO: 65492 - DNA, 25 bp, Homo sapien
attgtttgaaccctggaggcggaag

SEQ ID NO: 65493 - DNA, 25 bp, Homo sapien
ttgtttgaaccctggaggcggaagt

SEQ ID NO: 65494 - DNA, 25 bp, Homo sapien
tgtttgaaccctggaggcggaagtt

SEQ ID NO: 65495 - DNA, 25 bp, Homo sapien
gtttgaaccctggaggcggaagttg

SEQ ID NO: 65496 - DNA, 25 bp, Homo sapien
tttgaaccctggaggcggaagttgc

SEQ ID NO: 65497 - DNA, 25 bp, Homo sapien
cttgcagtgctggaaatagatctca

SEQ ID NO: 65498 - DNA, 25 bp, Homo sapien
gtgctggaaatagatctcattttta

SEQ ID NO: 65499 - DNA, 25 bp, Homo sapien
ttaggttttctcttcgttccagata

SEQ ID NO: 65500 - DNA, 25 bp, Homo sapien
gttttctcttcgttccagataccaa

SEQ ID NO: 65501 - DNA, 25 bp, Homo sapien
cttcgttccagataccaaataaatg

SEQ ID NO: 65502 - DNA, 25 bp, Homo sapien
aaatatgtgctcatctcctaagtag

SEQ ID NO: 65503 - DNA, 25 bp, Homo sapien
ctcatctcctaagtagctcttcaga

SEQ ID NO: 65504 - DNA, 25 bp, Homo sapien
tcctaagtagctcttcagagtctga

SEQ ID NO: 65505 - DNA, 25 bp, Homo sapien
gagtctgaccgtaagtaaaaacaca

SEQ ID NO: 65506 - DNA, 25 bp, Homo sapien
aaatattatttgatcgtggctgtca

SEQ ID NO: 65507 - DNA, 25 bp, Homo sapien
atcgtggctgtcaaatttagtgaac

SEQ ID NO: 65508 - DNA, 25 bp, Homo sapien
taatgctctgaaccaagttgtccta

SEQ ID NO: 65509 - DNA, 25 bp, Homo sapien
tctgaaccaagttgtcctatgggac

SEQ ID NO: 65510 - DNA, 25 bp, Homo sapien
gtcctatgggacaagattgttttga

SEQ ID NO: 65511 - DNA, 25 bp, Homo sapien
ggtgataatccgaagctgctgctga

SEQ ID NO: 65512 - DNA, 25 bp, Homo sapien
ttctttgacgatggaaatggtctca

SEQ ID NO: 65513 - DNA, 25 bp, Homo sapien
gaccctgtcttggaacgtcgtacca

SEQ ID NO: 65514 - DNA, 25 bp, Homo sapien
tggaacgtcgtaccaaatgctggaa

SEQ ID NO: 65515 - DNA, 25 bp, Homo sapien
aatgctggaattctacctcttgtga

SEQ ID NO: 65516 - DNA, 25 bp, Homo sapien
ggaattctacctcttgtgacaggat

SEQ ID NO: 65517 - DNA, 25 bp, Homo sapien
cttgtgacaggatcaggacacgtat

SEQ ID NO: 65518 - DNA, 25 bp, Homo sapien
gatcaggacacgtatctgtcccatt

SEQ ID NO: 65519 - DNA, 25 bp, Homo sapien
tgaaatctcgtcttgtagcatggat

SEQ ID NO: 65520 - DNA, 25 bp, Homo sapien
cttgtagcatggattattcttctca

SEQ ID NO: 65521 - DNA, 25 bp, Homo sapien
attcttctcatgttaaacccaccaa

SEQ ID NO: 65522 - DNA, 25 bp, Homo sapien
atgattttcctagtgcatttgcata

SEQ ID NO: 65523 - DNA, 25 bp, Homo sapien
gtgcatttgcatactgtgataatcc

SEQ ID NO: 65524 - DNA, 25 bp, Homo sapien
tcctgggccttgcaatagttctaca

SEQ ID NO: 65525 - DNA, 25 bp, Homo sapien
aatagttctacagggctcttgggca

SEQ ID NO: 65526 - DNA, 25 bp, Homo sapien
ctacagggctcttgggcattgaatt

SEQ ID NO: 65527 - DNA, 25 bp, Homo sapien
gttcaccttattgaagctcactctg

SEQ ID NO: 65528 - DNA, 25 bp, Homo sapien
ttgaagctcactctgatgttaatga

SEQ ID NO: 65529 - DNA, 25 bp, Homo sapien
tagagatcagcagtcttggatggga

SEQ ID NO: 65530 - DNA, 25 bp, Homo sapien
tatgttttaagacccccagttaatg

SEQ ID NO: 65531 - DNA, 25 bp, Homo sapien
atgtacgtacatatgataaagttca

SEQ ID NO: 65532 - DNA, 25 bp, Homo sapien
cgtacatatgataaagttcagttta

SEQ ID NO: 65533 - DNA, 25 bp, Homo sapien
gtaagagactaacaacagctcacag

SEQ ID NO: 65534 - DNA, 25 bp, Homo sapien
agagactaacaacagctcacagcca

SEQ ID NO: 65535 - DNA, 25 bp, Homo sapien
gagactaacaacagctcacagccaa

SEQ ID NO: 65536 - DNA, 25 bp, Homo sapien
gactaacaacagctcacagccaaat

SEQ ID NO: 65537 - DNA, 25 bp, Homo sapien
ctaacaacagctcacagccaaatag

SEQ ID NO: 65538 - DNA, 25 bp, Homo sapien
aacaacagctcacagccaaatagag

SEQ ID NO: 65539 - DNA, 25 bp, Homo sapien
tcacagccaaatagagcaattataa

SEQ ID NO: 65540 - DNA, 25 bp, Homo sapien
cagccaaatagagcaattataacaa

SEQ ID NO: 65541 - DNA, 25 bp, Homo sapien
tatcgactgggcttactacaaggcc

SEQ ID NO: 65542 - DNA, 25 bp, Homo sapien
atcgactgggcttactacaaggcca

SEQ ID NO: 65543 - DNA, 25 bp, Homo sapien
ttactacaaggccaatgtggccaag

SEQ ID NO: 65544 - DNA, 25 bp, Homo sapien
ctacaaggccaatgtggccaaggct

SEQ ID NO: 65545 - DNA, 25 bp, Homo sapien
caaggccaatgtggccaaggctggc

SEQ ID NO: 65546 - DNA, 25 bp, Homo sapien
tgatcagatgaccattgaggacttg

SEQ ID NO: 65547 - DNA, 25 bp, Homo sapien
gatcagatgaccattgaggacttga

SEQ ID NO: 65548 - DNA, 25 bp, Homo sapien
atcagatgaccattgaggacttgaa

SEQ ID NO: 65549 - DNA, 25 bp, Homo sapien
tcagatgaccattgaggacttgaat

SEQ ID NO: 65550 - DNA, 25 bp, Homo sapien
gatgaccattgaggacttgaatgaa

SEQ ID NO: 65551 - DNA, 25 bp, Homo sapien
tgaccattgaggacttgaatgaagc

SEQ ID NO: 65552 - DNA, 25 bp, Homo sapien
tgggagaaccttagtcccctctctt

SEQ ID NO: 65553 - DNA, 25 bp, Homo sapien
gtaatattcagagagcacttggatt

SEQ ID NO: 65554 - DNA, 25 bp, Homo sapien
gcacttggattatggatctgaatag

SEQ ID NO: 65555 - DNA, 25 bp, Homo sapien
atagagaaatgcttacagataatca

SEQ ID NO: 65556 - DNA, 25 bp, Homo sapien
agataatcattagcccacataccag

SEQ ID NO: 65557 - DNA, 25 bp, Homo sapien
tcattagcccacataccagtaactt

SEQ ID NO: 65558 - DNA, 25 bp, Homo sapien
agcccacataccagtaacttatact

SEQ ID NO: 65559 - DNA, 25 bp, Homo sapien
gtaacttatacttaaagatgggatg

SEQ ID NO: 65560 - DNA, 25 bp, Homo sapien
ggcaagggttgactctttgttttat

SEQ ID NO: 65561 - DNA, 25 bp, Homo sapien
tgttttattttgacatggcatgtcc

SEQ ID NO: 65562 - DNA, 25 bp, Homo sapien
acatggcatgtcctgaaataaatat

SEQ ID NO: 65563 - DNA, 25 bp, Homo sapien
tgatggaataaaacccctaaaatct

SEQ ID NO: 65564 - DNA, 25 bp, Homo sapien
cttacccacctctaaagatatttgt

SEQ ID NO: 65565 - DNA, 25 bp, Homo sapien
gtgaccttttgctagtagcatttca

SEQ ID NO: 65566 - DNA, 25 bp, Homo sapien
gcatttcaagttaaaatctggtttg

SEQ ID NO: 65567 - DNA, 25 bp, Homo sapien
gattttgctacccatgaaatacagt

SEQ ID NO: 65568 - DNA, 25 bp, Homo sapien
atgaaatacagttcggcccttactt

SEQ ID NO: 65569 - DNA, 25 bp, Homo sapien
gttcggcccttacttattgatgact

SEQ ID NO: 65570 - DNA, 25 bp, Homo sapien
attgatgacttaacctaaacagtga

SEQ ID NO: 65571 - DNA, 25 bp, Homo sapien
gtggcttaacaatcagacttcttct

SEQ ID NO: 65572 - DNA, 25 bp, Homo sapien
ttttgctgctatggtggttgtatta

SEQ ID NO: 65573 - DNA, 25 bp, Homo sapien
gagaactgatgtattatcttgaata

SEQ ID NO: 65574 - DNA, 25 bp, Homo sapien
aaagcgtcgccaactgtggttatcc

SEQ ID NO: 65575 - DNA, 25 bp, Homo sapien
tggttatcctgcaagctgctacctg

SEQ ID NO: 65576 - DNA, 25 bp, Homo sapien
aagctgctacctgcaacttggacgt

SEQ ID NO: 65577 - DNA, 25 bp, Homo sapien
aacttggacgttgtttccacgtgct

SEQ ID NO: 65578 - DNA, 25 bp, Homo sapien
gctggctacgattcttgcattctgg

SEQ ID NO: 65579 - DNA, 25 bp, Homo sapien
tgcattctgggtttggcttttttct

SEQ ID NO: 65580 - DNA, 25 bp, Homo sapien
ggcttttttctgtgtcatcaactat

SEQ ID NO: 65581 - DNA, 25 bp, Homo sapien
actcatttgatgacacctgggaata

SEQ ID NO: 65582 - DNA, 25 bp, Homo sapien
ttctgtgtgctgtgacgactgtcaa

SEQ ID NO: 65583 - DNA, 25 bp, Homo sapien
caaagagtatctggccatggcggac

SEQ ID NO: 65584 - DNA, 25 bp, Homo sapien
ggccatggcggacactcagcatttg

SEQ ID NO: 65585 - DNA, 25 bp, Homo sapien
taggataaatcatgtgtcttagaat

SEQ ID NO: 65586 - DNA, 25 bp, Homo sapien
taaggtctttgaggtcacttgatct

SEQ ID NO: 65587 - DNA, 25 bp, Homo sapien
tcacttgatcttctctaagtagact

SEQ ID NO: 65588 - DNA, 25 bp, Homo sapien
gtagactttataatattgtgtttta

SEQ ID NO: 65589 - DNA, 25 bp, Homo sapien
catttctcaatattagaatacgggt

SEQ ID NO: 65590 - DNA, 25 bp, Homo sapien
gctataatataggaaatggttcatc

SEQ ID NO: 65591 - DNA, 25 bp, Homo sapien
tctgatatttagacagttggaaact

SEQ ID NO: 65592 - DNA, 25 bp, Homo sapien
gacagttggaaactttctaaaattg

SEQ ID NO: 65593 - DNA, 25 bp, Homo sapien
aaattgaggattttgtagtgtatac

SEQ ID NO: 65594 - DNA, 25 bp, Homo sapien
gtagtgtatactaaataattgcata

SEQ ID NO: 65595 - DNA, 25 bp, Homo sapien
atgtattctgagtatggtgatatta

SEQ ID NO: 65596 - DNA, 25 bp, Homo sapien
ggagttcaaggccttaacatttttg

SEQ ID NO: 65597 - DNA, 25 bp, Homo sapien
ttaacatttttgagcactgctacta

SEQ ID NO: 65598 - DNA, 25 bp, Homo sapien
gagcactgctactactgtcattaat

SEQ ID NO: 65599 - DNA, 25 bp, Homo sapien
actgctactactgtcattaatatgt

SEQ ID NO: 65600 - DNA, 25 bp, Homo sapien
gtatctgaaaaatcttgtccaattt

SEQ ID NO: 65601 - DNA, 25 bp, Homo sapien
tgatgaatgttttatctctgagaca

SEQ ID NO: 65602 - DNA, 25 bp, Homo sapien
tatctctgagacatagatttctaat

SEQ ID NO: 65603 - DNA, 25 bp, Homo sapien
catgtattttcttgtgatatgctca

SEQ ID NO: 65604 - DNA, 25 bp, Homo sapien
gatatgctcatttgtctttagttat

SEQ ID NO: 65605 - DNA, 25 bp, Homo sapien
ttgtctttagttatttatgttctta

SEQ ID NO: 65606 - DNA, 25 bp, Homo sapien
tagtgcacaataccttgtacacagt

SEQ ID NO: 65607 - DNA, 25 bp, Homo sapien
tggagacttgtctttaacgagaaac

SEQ ID NO: 65608 - DNA, 25 bp, Homo sapien
ctcttctagaccaagcatgggacag

SEQ ID NO: 65609 - DNA, 25 bp, Homo sapien
gcatgggacagtacccattttggat

SEQ ID NO: 65610 - DNA, 25 bp, Homo sapien
gtacccattttggatgaacccaagg

SEQ ID NO: 65611 - DNA, 25 bp, Homo sapien
ccaagcaaagcagtgaagcggccaa

SEQ ID NO: 65612 - DNA, 25 bp, Homo sapien
tgaagcggccaagggtttgcctgta

SEQ ID NO: 65613 - DNA, 25 bp, Homo sapien
ggccaagggtttgcctgtagacttt

SEQ ID NO: 65614 - DNA, 25 bp, Homo sapien
taaaaccttggaaatgccccatggg

SEQ ID NO: 65615 - DNA, 25 bp, Homo sapien
atgccccatgggattgattgcggtt

SEQ ID NO: 65616 - DNA, 25 bp, Homo sapien
ccatgggattgattgcggttttcaa

SEQ ID NO: 65617 - DNA, 25 bp, Homo sapien
caaaccccaacattgcccaagagaa

SEQ ID NO: 65618 - DNA, 25 bp, Homo sapien
aaacatctcccagcaaaagtgccgg

SEQ ID NO: 65619 - DNA, 25 bp, Homo sapien
agtgccggttagtcaggtttgttga

SEQ ID NO: 65620 - DNA, 25 bp, Homo sapien
gaaaagctgattctggttatctctt

SEQ ID NO: 65621 - DNA, 25 bp, Homo sapien
ggttatctctttaaggacaattaat

SEQ ID NO: 65622 - DNA, 25 bp, Homo sapien
ttgtctcaacattcattcacagatt

SEQ ID NO: 65623 - DNA, 25 bp, Homo sapien
tctttgtgcagactgaaggaacact

SEQ ID NO: 65624 - DNA, 25 bp, Homo sapien
gaaggaacactgtagtataccccaa

SEQ ID NO: 65625 - DNA, 25 bp, Homo sapien
gtataccccaaagtgcatttgccta

SEQ ID NO: 65626 - DNA, 25 bp, Homo sapien
gcatttgcctaggacttctcagctt

SEQ ID NO: 65627 - DNA, 25 bp, Homo sapien
tcagcttctcccataggtagtttaa

SEQ ID NO: 65628 - DNA, 25 bp, Homo sapien
tctcccataggtagtttaacaggca

SEQ ID NO: 65629 - DNA, 25 bp, Homo sapien
gatgtataaactagttcatgagtct

SEQ ID NO: 65630 - DNA, 25 bp, Homo sapien
gtaaaatatcaattacctctgttta

SEQ ID NO: 65631 - DNA, 25 bp, Homo sapien
cctctgtttaaaatgctctgttaat

SEQ ID NO: 65632 - DNA, 25 bp, Homo sapien
agtgttaattctacacagtgctaca

SEQ ID NO: 65633 - DNA, 25 bp, Homo sapien
ttctacacagtgctacacagctttt

SEQ ID NO: 65634 - DNA, 25 bp, Homo sapien
gtgctacacagcttttagtgtcaca

SEQ ID NO: 65635 - DNA, 25 bp, Homo sapien
agcttttagtgtcacatagccttac

SEQ ID NO: 65636 - DNA, 25 bp, Homo sapien
atgcatagcttatatcctattttta

SEQ ID NO: 65637 - DNA, 25 bp, Homo sapien
cctatttttatagagccagtaatgg

SEQ ID NO: 65638 - DNA, 25 bp, Homo sapien
aatggtttttgtgatgctgtattac

SEQ ID NO: 65639 - DNA, 25 bp, Homo sapien
gctgtattacttctgggttttagac

SEQ ID NO: 65640 - DNA, 25 bp, Homo sapien
atggcctgggactctctgcgatgta

SEQ ID NO: 65641 - DNA, 25 bp, Homo sapien
gggactctctgcgatgtacataact

SEQ ID NO: 65642 - DNA, 25 bp, Homo sapien
taactatttaatgcagcggcagcgg

SEQ ID NO: 65643 - DNA, 25 bp, Homo sapien
gacagccttccctgagaggacttaa

SEQ ID NO: 65644 - DNA, 25 bp, Homo sapien
aaggaaaccgagatgcttcccgcag

SEQ ID NO: 65645 - DNA, 25 bp, Homo sapien
agatgcttcccgcagccgtggacga

SEQ ID NO: 65646 - DNA, 25 bp, Homo sapien
agccgtggacgattctccaggactc

SEQ ID NO: 65647 - DNA, 25 bp, Homo sapien
ttttttaccttgagcacttgcctcg

SEQ ID NO: 65648 - DNA, 25 bp, Homo sapien
agcacttgcctcgtgagacttcata

SEQ ID NO: 65649 - DNA, 25 bp, Homo sapien
gcctcgtgagacttcatagaacagt

SEQ ID NO: 65650 - DNA, 25 bp, Homo sapien
catagaacagtggtttactgtcccc

SEQ ID NO: 65651 - DNA, 25 bp, Homo sapien
ctccttccctcctggatggaagtaa

SEQ ID NO: 65652 - DNA, 25 bp, Homo sapien
tccttccctcctggatggaagtaaa

SEQ ID NO: 65653 - DNA, 25 bp, Homo sapien
tctgtgggccacacgtgcacttgca

SEQ ID NO: 65654 - DNA, 25 bp, Homo sapien
ctgtgggccacacgtgcacttgcac

SEQ ID NO: 65655 - DNA, 25 bp, Homo sapien
acacacacacactgcatatctgagc

SEQ ID NO: 65656 - DNA, 25 bp, Homo sapien
actgggtctcaccttgcaccttctt

SEQ ID NO: 65657 - DNA, 25 bp, Homo sapien
tgggtctcaccttgcaccttcttca

SEQ ID NO: 65658 - DNA, 25 bp, Homo sapien
tcaccttgcaccttcttcaggattt

SEQ ID NO: 65659 - DNA, 25 bp, Homo sapien
accttgcaccttcttcaggatttta

SEQ ID NO: 65660 - DNA, 25 bp, Homo sapien
ccttgcaccttcttcaggattttat

SEQ ID NO: 65661 - DNA, 25 bp, Homo sapien
caggattttatatgtgaagagattt

SEQ ID NO: 65662 - DNA, 25 bp, Homo sapien
acgtgtctggatgtgattctctact

SEQ ID NO: 65663 - DNA, 25 bp, Homo sapien
gtgattctctactacatcgtttcaa

SEQ ID NO: 65664 - DNA, 25 bp, Homo sapien
ttcaggctcgagtcattagtgtcat

SEQ ID NO: 65665 - DNA, 25 bp, Homo sapien
gtgtcatgctataccgtaattacct

SEQ ID NO: 65666 - DNA, 25 bp, Homo sapien
gtaattaccttcgaagcatgcgcag

SEQ ID NO: 65667 - DNA, 25 bp, Homo sapien
aaagtttccgatctggtagtctacg

SEQ ID NO: 65668 - DNA, 25 bp, Homo sapien
ggtagtctacggtcactaagcaata

SEQ ID NO: 65669 - DNA, 25 bp, Homo sapien
aaggttctttcatttcaatcccatc

SEQ ID NO: 65670 - DNA, 25 bp, Homo sapien
aattcacttcactaactactctggc

SEQ ID NO: 65671 - DNA, 25 bp, Homo sapien
tactctggcgtcaatggatattctg

SEQ ID NO: 65672 - DNA, 25 bp, Homo sapien
atactatcaagtcccttttctcttg

SEQ ID NO: 65673 - DNA, 25 bp, Homo sapien
gatgcactttaactgaagatagaga

SEQ ID NO: 65674 - DNA, 25 bp, Homo sapien
ctaaagcataagttagtcttttcct

SEQ ID NO: 65675 - DNA, 25 bp, Homo sapien
ttcctgattcttaaaggtcatactt

SEQ ID NO: 65676 - DNA, 25 bp, Homo sapien
aaaggtcatacttgaaatcctgcca

SEQ ID NO: 65677 - DNA, 25 bp, Homo sapien
aattgtcttgccattacttagtata

SEQ ID NO: 65678 - DNA, 25 bp, Homo sapien
gtatatgtagacttcatcccaattg

SEQ ID NO: 65679 - DNA, 25 bp, Homo sapien
tgtagacttcatcccaattgtcaaa

SEQ ID NO: 65680 - DNA, 25 bp, Homo sapien
attgtcaaacatcctaggtaagtgg

SEQ ID NO: 65681 - DNA, 25 bp, Homo sapien
acatcctaggtaagtggttgacatt

SEQ ID NO: 65682 - DNA, 25 bp, Homo sapien
aagtggttgacatttcttacagcaa

SEQ ID NO: 65683 - DNA, 25 bp, Homo sapien
gacatttcttacagcaattacagat

SEQ ID NO: 65684 - DNA, 25 bp, Homo sapien
acaaggccgcggacctggcccacat

SEQ ID NO: 65685 - DNA, 25 bp, Homo sapien
tggcccacatcactgcacgcctggc

SEQ ID NO: 65686 - DNA, 25 bp, Homo sapien
tggcccaccagacacgtgctgagga

SEQ ID NO: 65687 - DNA, 25 bp, Homo sapien
cccaccagacacgtgctgaggaggg

SEQ ID NO: 65688 - DNA, 25 bp, Homo sapien
acagacgtgggcttcagaagctcgc

SEQ ID NO: 65689 - DNA, 25 bp, Homo sapien
tgggcccaccagcattttcttttat

SEQ ID NO: 65690 - DNA, 25 bp, Homo sapien
ggcccaccagcattttcttttatga

SEQ ID NO: 65691 - DNA, 25 bp, Homo sapien
gcccaccagcattttcttttatgaa

SEQ ID NO: 65692 - DNA, 25 bp, Homo sapien
accagcattttcttttatgaacatg

SEQ ID NO: 65693 - DNA, 25 bp, Homo sapien
cttttatgaacatgatacactttgg

SEQ ID NO: 65694 - DNA, 25 bp, Homo sapien
gagggtctctggctgcgggcggtgg

SEQ ID NO: 65695 - DNA, 25 bp, Homo sapien
tctcagaggagcaagagaccctcaa

SEQ ID NO: 65696 - DNA, 25 bp, Homo sapien
ctcagaggagcaagagaccctcaac

SEQ ID NO: 65697 - DNA, 25 bp, Homo sapien
gagcaagagaccctcaacagatacc

SEQ ID NO: 65698 - DNA, 25 bp, Homo sapien
agcaagagaccctcaacagatacca

SEQ ID NO: 65699 - DNA, 25 bp, Homo sapien
gcaagagaccctcaacagataccag

SEQ ID NO: 65700 - DNA, 25 bp, Homo sapien
cagataccagcgtgtgtatagaact

SEQ ID NO: 65701 - DNA, 25 bp, Homo sapien
agataccagcgtgtgtatagaactt

SEQ ID NO: 65702 - DNA, 25 bp, Homo sapien
gataccagcgtgtgtatagaacttc

SEQ ID NO: 65703 - DNA, 25 bp, Homo sapien
taccagcgtgtgtatagaacttcca

SEQ ID NO: 65704 - DNA, 25 bp, Homo sapien
ggaacactggacattgcttagtgac

SEQ ID NO: 65705 - DNA, 25 bp, Homo sapien
ctggacattgcttagtgaccttttg

SEQ ID NO: 65706 - DNA, 25 bp, Homo sapien
tgcttagtgaccttttgttcctttt

SEQ ID NO: 65707 - DNA, 25 bp, Homo sapien
tgtggttcaccaccagcccatcagt

SEQ ID NO: 65708 - DNA, 25 bp, Homo sapien
caccagcccatcagtgtttctttga

SEQ ID NO: 65709 - DNA, 25 bp, Homo sapien
gattgcattagggaagttggctctg

SEQ ID NO: 65710 - DNA, 25 bp, Homo sapien
gaagttggctctgggattgcaaaaa

SEQ ID NO: 65711 - DNA, 25 bp, Homo sapien
gaaaatatactaggccatctggtta

SEQ ID NO: 65712 - DNA, 25 bp, Homo sapien
atactaggccatctggttagaaaaa

SEQ ID NO: 65713 - DNA, 25 bp, Homo sapien
cagaccagactagaaaaagctgtga

SEQ ID NO: 65714 - DNA, 25 bp, Homo sapien
gtagattaaacaaagccagatgatt

SEQ ID NO: 65715 - DNA, 25 bp, Homo sapien
acctcctgctcgctgatggaaacct

SEQ ID NO: 65716 - DNA, 25 bp, Homo sapien
tgctcgctgatggaaacctccaggg

SEQ ID NO: 65717 - DNA, 25 bp, Homo sapien
gatggaaacctccagggcaaagctg

SEQ ID NO: 65718 - DNA, 25 bp, Homo sapien
ggaagccaggaaagccagtatttcc

SEQ ID NO: 65719 - DNA, 25 bp, Homo sapien
aaagccagtatttcctatgtgtcag

SEQ ID NO: 65720 - DNA, 25 bp, Homo sapien
gccagtatttcctatgtgtcagatc

SEQ ID NO: 65721 - DNA, 25 bp, Homo sapien
gtatttcctatgtgtcagatctgct

SEQ ID NO: 65722 - DNA, 25 bp, Homo sapien
atttcctatgtgtcagatctgcttg

SEQ ID NO: 65723 - DNA, 25 bp, Homo sapien
gatctgcttggcttccaagaaggga

SEQ ID NO: 65724 - DNA, 25 bp, Homo sapien
ccacaaacaagttggctgttactgt

SEQ ID NO: 65725 - DNA, 25 bp, Homo sapien
aaacaagttggctgttactgtattt

SEQ ID NO: 65726 - DNA, 25 bp, Homo sapien
ggctcccgccggtaatcccaaagct

SEQ ID NO: 65727 - DNA, 25 bp, Homo sapien
gctcccgccggtaatcccaaagctt

SEQ ID NO: 65728 - DNA, 25 bp, Homo sapien
ggaatcacctgagccgggggaatca

SEQ ID NO: 65729 - DNA, 25 bp, Homo sapien
gaatcacctgagccgggggaatcac

SEQ ID NO: 65730 - DNA, 25 bp, Homo sapien
aatcacctgagccgggggaatcacc

SEQ ID NO: 65731 - DNA, 25 bp, Homo sapien
atcacctgagccgggggaatcacct

SEQ ID NO: 65732 - DNA, 25 bp, Homo sapien
tcacctgagccgggggaatcacctg

SEQ ID NO: 65733 - DNA, 25 bp, Homo sapien
cacctgagccgggggaatcacctga

SEQ ID NO: 65734 - DNA, 25 bp, Homo sapien
atgtttttatcgtactctttggaga

SEQ ID NO: 65735 - DNA, 25 bp, Homo sapien
ttatcgtactctttggagatgccca

SEQ ID NO: 65736 - DNA, 25 bp, Homo sapien
tagcttttactaattcgcatctgga

SEQ ID NO: 65737 - DNA, 25 bp, Homo sapien
gcttttactaattcgcatctggaag

SEQ ID NO: 65738 - DNA, 25 bp, Homo sapien
tttactaattcgcatctggaagctc

SEQ ID NO: 65739 - DNA, 25 bp, Homo sapien
gctcagcaagtgcacaagccttact

SEQ ID NO: 65740 - DNA, 25 bp, Homo sapien
tcagcaagtgcacaagccttacttt

SEQ ID NO: 65741 - DNA, 25 bp, Homo sapien
gcaagtgcacaagccttactttggt

SEQ ID NO: 65742 - DNA, 25 bp, Homo sapien
agtgcacaagccttactttggttac

SEQ ID NO: 65743 - DNA, 25 bp, Homo sapien
tgcacaagccttactttggttaccg

SEQ ID NO: 65744 - DNA, 25 bp, Homo sapien
acccctccccgatgtggtgcgctca

SEQ ID NO: 65745 - DNA, 25 bp, Homo sapien
aaagtcatccctcactgttagtaag

SEQ ID NO: 65746 - DNA, 25 bp, Homo sapien
gaagcagtatacatcaatgggaaca

SEQ ID NO: 65747 - DNA, 25 bp, Homo sapien
ggaacagggcccatggaaatgtaca

SEQ ID NO: 65748 - DNA, 25 bp, Homo sapien
gaaatgtacaggagtttccctattt

SEQ ID NO: 65749 - DNA, 25 bp, Homo sapien
ttccctattttggtgttcagcttga

SEQ ID NO: 65750 - DNA, 25 bp, Homo sapien
gacttgtcagaatcaactgtgtcat

SEQ ID NO: 65751 - DNA, 25 bp, Homo sapien
gtgttttacagctttcaccacagct

SEQ ID NO: 65752 - DNA, 25 bp, Homo sapien
tttcaccacagctgcatcagcttat

SEQ ID NO: 65753 - DNA, 25 bp, Homo sapien
gctgcatcagcttatagttactatc

SEQ ID NO: 65754 - DNA, 25 bp, Homo sapien
ttactatcattatggccggaagact

SEQ ID NO: 65755 - DNA, 25 bp, Homo sapien
tatggccggaagactgttcaggtga

SEQ ID NO: 65756 - DNA, 25 bp, Homo sapien
ctggagtttatatcccctcaggata

SEQ ID NO: 65757 - DNA, 25 bp, Homo sapien
tcccctcaggataatctattctcta

SEQ ID NO: 65758 - DNA, 25 bp, Homo sapien
ggataatctattctctagcttaggt

SEQ ID NO: 65759 - DNA, 25 bp, Homo sapien
ctctagcttaggtatctgtgactct

SEQ ID NO: 65760 - DNA, 25 bp, Homo sapien
ttaggtatctgtgactcttgggcct

SEQ ID NO: 65761 - DNA, 25 bp, Homo sapien
gtatctgtgactcttgggcctctgc

SEQ ID NO: 65762 - DNA, 25 bp, Homo sapien
gcctctgctctggtgggaacttact

SEQ ID NO: 65763 - DNA, 25 bp, Homo sapien
ggtgggaacttacttctctatagcc

SEQ ID NO: 65764 - DNA, 25 bp, Homo sapien
acttacttctctatagcccactgag

SEQ ID NO: 65765 - DNA, 25 bp, Homo sapien
cccacctaagtctctgggaagaagt

SEQ ID NO: 65766 - DNA, 25 bp, Homo sapien
agtggagaggactgatgctcttctt

SEQ ID NO: 65767 - DNA, 25 bp, Homo sapien
ttttgacccatacttaatgttgcag

SEQ ID NO: 65768 - DNA, 25 bp, Homo sapien
ttgacccatacttaatgttgcagaa

SEQ ID NO: 65769 - DNA, 25 bp, Homo sapien
gacccatacttaatgttgcagaaac

SEQ ID NO: 65770 - DNA, 25 bp, Homo sapien
aatgttgcagaaactattcttgtca

SEQ ID NO: 65771 - DNA, 25 bp, Homo sapien
gttgcagaaactattcttgtcataa

SEQ ID NO: 65772 - DNA, 25 bp, Homo sapien
gcagaaactattcttgtcataacat

SEQ ID NO: 65773 - DNA, 25 bp, Homo sapien
attcttgtcataacattatctctca

SEQ ID NO: 65774 - DNA, 25 bp, Homo sapien
tcttgtcataacattatctctcatg

SEQ ID NO: 65775 - DNA, 25 bp, Homo sapien
cattatctctcatgtacagtaatta

SEQ ID NO: 65776 - DNA, 25 bp, Homo sapien
atctctcatgtacagtaattatatg

SEQ ID NO: 65777 - DNA, 25 bp, Homo sapien
gcaaatatggaaactttacaataga

SEQ ID NO: 65778 - DNA, 25 bp, Homo sapien
tacctgctccactgttcgagtggaa

SEQ ID NO: 65779 - DNA, 25 bp, Homo sapien
gtggaatgttctgtctatatctctt

SEQ ID NO: 65780 - DNA, 25 bp, Homo sapien
gatctggttgctttagagtgtcatc

SEQ ID NO: 65781 - DNA, 25 bp, Homo sapien
gagtgtcatctatatcttctgtttc

SEQ ID NO: 65782 - DNA, 25 bp, Homo sapien
ctatatcttctgtttccatgtttat

SEQ ID NO: 65783 - DNA, 25 bp, Homo sapien
tatattgtgcccagttgtcctaacc

SEQ ID NO: 65784 - DNA, 25 bp, Homo sapien
gcccagttgtcctaaccattattga

SEQ ID NO: 65785 - DNA, 25 bp, Homo sapien
ttgctacacatactttgaggctctg

SEQ ID NO: 65786 - DNA, 25 bp, Homo sapien
ggctctgttagtagtacatacgctt

SEQ ID NO: 65787 - DNA, 25 bp, Homo sapien
acgcttagaattgttatgtctcctt

SEQ ID NO: 65788 - DNA, 25 bp, Homo sapien
atgtctcctttattgattgaccctt

SEQ ID NO: 65789 - DNA, 25 bp, Homo sapien
ttcttggagccttcatggtccaggg

SEQ ID NO: 65790 - DNA, 25 bp, Homo sapien
ctggcctgagcatgccattttgagg

SEQ ID NO: 65791 - DNA, 25 bp, Homo sapien
ggagggtagttgtgcctacttatcc

SEQ ID NO: 65792 - DNA, 25 bp, Homo sapien
gaccatggacatgaggcttgcccat

SEQ ID NO: 65793 - DNA, 25 bp, Homo sapien
tggacatgaggcttgcccatccctg

SEQ ID NO: 65794 - DNA, 25 bp, Homo sapien
aacttacacagcctgtaccactgtc

SEQ ID NO: 65795 - DNA, 25 bp, Homo sapien
tggctactttgacatgtgcctgctc

SEQ ID NO: 65796 - DNA, 25 bp, Homo sapien
tactttgacatgtgcctgctcctgg

SEQ ID NO: 65797 - DNA, 25 bp, Homo sapien
ttgacatgtgcctgctcctggcatt

SEQ ID NO: 65798 - DNA, 25 bp, Homo sapien
tgtgcctgctcctggcatttcaata

SEQ ID NO: 65799 - DNA, 25 bp, Homo sapien
tcaataaaacccggcttgggtctga

SEQ ID NO: 65800 - DNA, 25 bp, Homo sapien
tcattacatttctatttcttggtgg

SEQ ID NO: 65801 - DNA, 25 bp, Homo sapien
atttctatttcttggtggagcagca

SEQ ID NO: 65802 - DNA, 25 bp, Homo sapien
gcagcacattgtggagtgtgattct

SEQ ID NO: 65803 - DNA, 25 bp, Homo sapien
gtgtgattcttaattcttcattgag

SEQ ID NO: 65804 - DNA, 25 bp, Homo sapien
cattgatgctggataggttgtcttt

SEQ ID NO: 65805 - DNA, 25 bp, Homo sapien
gctggataggttgtcttttgtattt

SEQ ID NO: 65806 - DNA, 25 bp, Homo sapien
gtatttatgtctcagaccatcttgt

SEQ ID NO: 65807 - DNA, 25 bp, Homo sapien
gtctcagaccatcttgtgagattgt

SEQ ID NO: 65808 - DNA, 25 bp, Homo sapien
gtgagattgtttgcctatctcataa

SEQ ID NO: 65809 - DNA, 25 bp, Homo sapien
gtttgcctatctcataatacagttt

SEQ ID NO: 65810 - DNA, 25 bp, Homo sapien
agaatggcatctttgtttataggag

SEQ ID NO: 65811 - DNA, 25 bp, Homo sapien
acatgaggtgtccagggccaggccc

SEQ ID NO: 65812 - DNA, 25 bp, Homo sapien
gtgtcctccacagggacaagcagtg

SEQ ID NO: 65813 - DNA, 25 bp, Homo sapien
gtgggaggagtctgaatggtcacca

SEQ ID NO: 65814 - DNA, 25 bp, Homo sapien
ggaagcccgggctccatcttgacct

SEQ ID NO: 65815 - DNA, 25 bp, Homo sapien
atcttgacctcctttttcagggaca

SEQ ID NO: 65816 - DNA, 25 bp, Homo sapien
tttttcagggacaggagcaacaggc

SEQ ID NO: 65817 - DNA, 25 bp, Homo sapien
ttcagggacaggagcaacaggcccc

SEQ ID NO: 65818 - DNA, 25 bp, Homo sapien
tgactctaagcccttccctgtaagg

SEQ ID NO: 65819 - DNA, 25 bp, Homo sapien
aagcccttccctgtaaggtgaggca

SEQ ID NO: 65820 - DNA, 25 bp, Homo sapien
ggagagctctttattggaacagatc

SEQ ID NO: 65821 - DNA, 25 bp, Homo sapien
aacagatctggtggttcaaataaac

SEQ ID NO: 65822 - DNA, 25 bp, Homo sapien
cacatagaagggtaatcccggaaat

SEQ ID NO: 65823 - DNA, 25 bp, Homo sapien
agggtaatcccggaaatgcttcatc

SEQ ID NO: 65824 - DNA, 25 bp, Homo sapien
ggtaatcccggaaatgcttcatctg

SEQ ID NO: 65825 - DNA, 25 bp, Homo sapien
gtaatcccggaaatgcttcatctgg

SEQ ID NO: 65826 - DNA, 25 bp, Homo sapien
aatcccggaaatgcttcatctggtg

SEQ ID NO: 65827 - DNA, 25 bp, Homo sapien
atcccggaaatgcttcatctggtgg

SEQ ID NO: 65828 - DNA, 25 bp, Homo sapien
ccggaaatgcttcatctggtggact

SEQ ID NO: 65829 - DNA, 25 bp, Homo sapien
ggaaatgcttcatctggtggactgt

SEQ ID NO: 65830 - DNA, 25 bp, Homo sapien
ggacttgggaaacagtcactgtgaa

SEQ ID NO: 65831 - DNA, 25 bp, Homo sapien
agtcactgtgaaatgcgctgcgtat

SEQ ID NO: 65832 - DNA, 25 bp, Homo sapien
tcactgtgaaatgcgctgcgtatct

SEQ ID NO: 65833 - DNA, 25 bp, Homo sapien
cacctttaacagagcacccctttga

SEQ ID NO: 65834 - DNA, 25 bp, Homo sapien
tttaacagagcacccctttgaaagt

SEQ ID NO: 65835 - DNA, 25 bp, Homo sapien
gggtgctgtgtaaatcttgtattta

SEQ ID NO: 65836 - DNA, 25 bp, Homo sapien
ataaaggattgtgtactgactgaat

SEQ ID NO: 65837 - DNA, 25 bp, Homo sapien
gattgtgtactgactgaatacattt

SEQ ID NO: 65838 - DNA, 25 bp, Homo sapien
gtactgactgaatacatttaaaaga

SEQ ID NO: 65839 - DNA, 25 bp, Homo sapien
ttttgaaacctgttctgctatgaac

SEQ ID NO: 65840 - DNA, 25 bp, Homo sapien
gaaacctgttctgctatgaacagag

SEQ ID NO: 65841 - DNA, 25 bp, Homo sapien
gttctgctatgaacagagataacat

SEQ ID NO: 65842 - DNA, 25 bp, Homo sapien
aggttaagcttcctaatgcataata

SEQ ID NO: 65843 - DNA, 25 bp, Homo sapien
aagcttcctaatgcataataaattt

SEQ ID NO: 65844 - DNA, 25 bp, Homo sapien
aggactgtgtctgtgtacgtgtgat

SEQ ID NO: 65845 - DNA, 25 bp, Homo sapien
gtctgtgtacgtgtgataacatgca

SEQ ID NO: 65846 - DNA, 25 bp, Homo sapien
cgtgtgataacatgcatatggatgc

SEQ ID NO: 65847 - DNA, 25 bp, Homo sapien
atatggatgcaggtgctcagatacc

SEQ ID NO: 65848 - DNA, 25 bp, Homo sapien
gtgctcagatacctgacaccttagg

SEQ ID NO: 65849 - DNA, 25 bp, Homo sapien
gacaccttaggattcagacaggaaa

SEQ ID NO: 65850 - DNA, 25 bp, Homo sapien
ggaaactatatctgcacatgtgtac

SEQ ID NO: 65851 - DNA, 25 bp, Homo sapien
atgtgtacttggtgcatgtatgtgt

SEQ ID NO: 65852 - DNA, 25 bp, Homo sapien
cacaggtgagtgtttcagggtgcat

SEQ ID NO: 65853 - DNA, 25 bp, Homo sapien
aactgcaagcataaatgtgtacatg

SEQ ID NO: 65854 - DNA, 25 bp, Homo sapien
caaatacataaggttgttcaggaaa

SEQ ID NO: 65855 - DNA, 25 bp, Homo sapien
gcctaaagctctggaactggtattc

SEQ ID NO: 65856 - DNA, 25 bp, Homo sapien
agctgaccgaactcactgaccagta

SEQ ID NO: 65857 - DNA, 25 bp, Homo sapien
cagtacaggcatggttatttcaaca

SEQ ID NO: 65858 - DNA, 25 bp, Homo sapien
gcatgtcaactggactcctatttgt

SEQ ID NO: 65859 - DNA, 25 bp, Homo sapien
aatccagctcatcagtctactagtt

SEQ ID NO: 65860 - DNA, 25 bp, Homo sapien
ctactagtttgcttctttccgagag

SEQ ID NO: 65861 - DNA, 25 bp, Homo sapien
tttccgagagatgtcaagtcctcaa

SEQ ID NO: 65862 - DNA, 25 bp, Homo sapien
agaatttgatggcttcttctgcagc

SEQ ID NO: 65863 - DNA, 25 bp, Homo sapien
tcttctgcagctataaccacaagga

SEQ ID NO: 65864 - DNA, 25 bp, Homo sapien
attgtaactcaagtccactgctggc

SEQ ID NO: 65865 - DNA, 25 bp, Homo sapien
gaaatgtgtaaagtagaaccctcct

SEQ ID NO: 65866 - DNA, 25 bp, Homo sapien
aatgttttgccacagccagcatgtt

SEQ ID NO: 65867 - DNA, 25 bp, Homo sapien
tgttcacacacaaaagggcggcttt

SEQ ID NO: 65868 - DNA, 25 bp, Homo sapien
aaagggcggctttcctcatggaagg

SEQ ID NO: 65869 - DNA, 25 bp, Homo sapien
aacacagttgtataggttcttccac

SEQ ID NO: 65870 - DNA, 25 bp, Homo sapien
agccttctcttggacagcgacataa

SEQ ID NO: 65871 - DNA, 25 bp, Homo sapien
ggacagcgacataatcccttctggg

SEQ ID NO: 65872 - DNA, 25 bp, Homo sapien
gtgttgcttaaggaacttgcgttaa

SEQ ID NO: 65873 - DNA, 25 bp, Homo sapien
aaagttttccggcaacttcacatgg

SEQ ID NO: 65874 - DNA, 25 bp, Homo sapien
ggcaacttcacatggattcctttga

SEQ ID NO: 65875 - DNA, 25 bp, Homo sapien
tgttcccatgctaagctgagtctgt

SEQ ID NO: 65876 - DNA, 25 bp, Homo sapien
gagtctgtgccatagcaaaccatga

SEQ ID NO: 65877 - DNA, 25 bp, Homo sapien
gtggtcattgttacattcatctgct

SEQ ID NO: 65878 - DNA, 25 bp, Homo sapien
gttacattcatctgctgaacttaac

SEQ ID NO: 65879 - DNA, 25 bp, Homo sapien
gaacttaacaaaactgttcatcctg

SEQ ID NO: 65880 - DNA, 25 bp, Homo sapien
acaggcacaggtgatgcattctcct

SEQ ID NO: 65881 - DNA, 25 bp, Homo sapien
aggtgatgcattctcctgctgtcgc

SEQ ID NO: 65882 - DNA, 25 bp, Homo sapien
attctcctgctgtcgcttctcagtg

SEQ ID NO: 65883 - DNA, 25 bp, Homo sapien
ttctcagtgctctctttccaatata

SEQ ID NO: 65884 - DNA, 25 bp, Homo sapien
gctctctttccaatatagatgtggt

SEQ ID NO: 65885 - DNA, 25 bp, Homo sapien
atgtggtcatgtttgacttgtacag

SEQ ID NO: 65886 - DNA, 25 bp, Homo sapien
gacttgtacagaatgttaatcatac

SEQ ID NO: 65887 - DNA, 25 bp, Homo sapien
gttaatcatacagagaatccttgat

SEQ ID NO: 65888 - DNA, 25 bp, Homo sapien
tggtagttaaagatcgagccctgac

SEQ ID NO: 65889 - DNA, 25 bp, Homo sapien
aaagatcgagccctgacctaatcgg

SEQ ID NO: 65890 - DNA, 25 bp, Homo sapien
atcggttatgttatctacagattac

SEQ ID NO: 65891 - DNA, 25 bp, Homo sapien
aatccctgtcctgttctgttccatt

SEQ ID NO: 65892 - DNA, 25 bp, Homo sapien
gttccattctaattactggtgcatg

SEQ ID NO: 65893 - DNA, 25 bp, Homo sapien
tccattctaattactggtgcatgca

SEQ ID NO: 65894 - DNA, 25 bp, Homo sapien
ggtgcatgcagccttcagtcactta

SEQ ID NO: 65895 - DNA, 25 bp, Homo sapien
tgcatgcagccttcagtcacttact

SEQ ID NO: 65896 - DNA, 25 bp, Homo sapien
ttcagtcacttactccctgcttgct

SEQ ID NO: 65897 - DNA, 25 bp, Homo sapien
gagggataggaattgctcactcagg

SEQ ID NO: 65898 - DNA, 25 bp, Homo sapien
tgagacgtgagtcttgccaatgctc

SEQ ID NO: 65899 - DNA, 25 bp, Homo sapien
gctggtttttacaccatcctaaaga

SEQ ID NO: 65900 - DNA, 25 bp, Homo sapien
gtaaaattaaccattgagtgtcaaa

SEQ ID NO: 65901 - DNA, 25 bp, Homo sapien
tgagtgtcaaagttctaaaagcaga

SEQ ID NO: 65902 - DNA, 25 bp, Homo sapien
gcaatgaacataaggaaagactact

SEQ ID NO: 65903 - DNA, 25 bp, Homo sapien
taaggaaagactactgtataggttt

SEQ ID NO: 65904 - DNA, 25 bp, Homo sapien
agtaaatctgaatgatcctactcct

SEQ ID NO: 65905 - DNA, 25 bp, Homo sapien
atctgaatgatcctactcctttgga

SEQ ID NO: 65906 - DNA, 25 bp, Homo sapien
gaatgatcctactcctttggagtaa

SEQ ID NO: 65907 - DNA, 25 bp, Homo sapien
actagtgcttaccagtttccaattg

SEQ ID NO: 65908 - DNA, 25 bp, Homo sapien
gtgcttaccagtttccaattgtatt

SEQ ID NO: 65909 - DNA, 25 bp, Homo sapien
cagtttccaattgtatttagcttct

SEQ ID NO: 65910 - DNA, 25 bp, Homo sapien
gcaagaacttgccttaccccagatt

SEQ ID NO: 65911 - DNA, 25 bp, Homo sapien
accccagattctctatatctcatgg

SEQ ID NO: 65912 - DNA, 25 bp, Homo sapien
ctatatctcatggtttccttttcct

SEQ ID NO: 65913 - DNA, 25 bp, Homo sapien
ttccttttcctcttgactgtcttta

SEQ ID NO: 65914 - DNA, 25 bp, Homo sapien
gactgtctttacgagtgttttttat

SEQ ID NO: 65915 - DNA, 25 bp, Homo sapien
tatttgggaccctcgagcccagaga

SEQ ID NO: 65916 - DNA, 25 bp, Homo sapien
ggaaaccatccatttactcatgata

SEQ ID NO: 65917 - DNA, 25 bp, Homo sapien
taaggcttcatcactggatttctgt

SEQ ID NO: 65918 - DNA, 25 bp, Homo sapien
ggatttctgtgtcttcactagaaca

SEQ ID NO: 65919 - DNA, 25 bp, Homo sapien
gaacaccattgtcatctcatattga

SEQ ID NO: 65920 - DNA, 25 bp, Homo sapien
gatcaggtattttaatctagcactt

SEQ ID NO: 65921 - DNA, 25 bp, Homo sapien
tgggtttgttatggttaacaagttg

SEQ ID NO: 65922 - DNA, 25 bp, Homo sapien
ttaacaagttggtgagcattattga

SEQ ID NO: 65923 - DNA, 25 bp, Homo sapien
taacaagttggtgagcattattgag

SEQ ID NO: 65924 - DNA, 25 bp, Homo sapien
aacaagttggtgagcattattgaga

SEQ ID NO: 65925 - DNA, 25 bp, Homo sapien
acaagttggtgagcattattgagag

SEQ ID NO: 65926 - DNA, 25 bp, Homo sapien
aagttggtgagcattattgagaggt

SEQ ID NO: 65927 - DNA, 25 bp, Homo sapien
agttggtgagcattattgagaggtg

SEQ ID NO: 65928 - DNA, 25 bp, Homo sapien
gttggtgagcattattgagaggtga

SEQ ID NO: 65929 - DNA, 25 bp, Homo sapien
aggtgaagccagctgagcttctggg

SEQ ID NO: 65930 - DNA, 25 bp, Homo sapien
gaagccagctgagcttctgggttgg

SEQ ID NO: 65931 - DNA, 25 bp, Homo sapien
ccagctgagcttctgggttgggtgg

SEQ ID NO: 65932 - DNA, 25 bp, Homo sapien
gtctccttggttccttggtattcac

SEQ ID NO: 65933 - DNA, 25 bp, Homo sapien
tggtattcaccgtgcctgatctgca

SEQ ID NO: 65934 - DNA, 25 bp, Homo sapien
tgcctgatctgcacatttcatcgtg

SEQ ID NO: 65935 - DNA, 25 bp, Homo sapien
gcacatttcatcgtggctgtttctg

SEQ ID NO: 65936 - DNA, 25 bp, Homo sapien
ggctgtttctgtatagcctatactg

SEQ ID NO: 65937 - DNA, 25 bp, Homo sapien
atagcctatactgcattagcccaag

SEQ ID NO: 65938 - DNA, 25 bp, Homo sapien
gcattagcccaagagattgttgctt

SEQ ID NO: 65939 - DNA, 25 bp, Homo sapien
agattgttgctttgtaactttttgc

SEQ ID NO: 65940 - DNA, 25 bp, Homo sapien
aactttttgcactattgttttggct

SEQ ID NO: 65941 - DNA, 25 bp, Homo sapien
gcactattgttttggctggatttgt

SEQ ID NO: 65942 - DNA, 25 bp, Homo sapien
ggctggatttgtattacacacagtt

SEQ ID NO: 65943 - DNA, 25 bp, Homo sapien
ttcttctctttttccttggacaaat

SEQ ID NO: 65944 - DNA, 25 bp, Homo sapien
tatgaatttctccaattggtctagc

SEQ ID NO: 65945 - DNA, 25 bp, Homo sapien
gaatttctccaattggtctagcatg

SEQ ID NO: 65946 - DNA, 25 bp, Homo sapien
ttctccaattggtctagcatgctta

SEQ ID NO: 65947 - DNA, 25 bp, Homo sapien
ctccaattggtctagcatgcttata

SEQ ID NO: 65948 - DNA, 25 bp, Homo sapien
caattggtctagcatgcttatagga

SEQ ID NO: 65949 - DNA, 25 bp, Homo sapien
gtctagcatgcttataggaatgtca

SEQ ID NO: 65950 - DNA, 25 bp, Homo sapien
gaatgtcagtggttcttacaggctc

SEQ ID NO: 65951 - DNA, 25 bp, Homo sapien
atgtcagtggttcttacaggctcaa

SEQ ID NO: 65952 - DNA, 25 bp, Homo sapien
tcagtggttcttacaggctcaaatt

SEQ ID NO: 65953 - DNA, 25 bp, Homo sapien
gtggttcttacaggctcaaatttgg

SEQ ID NO: 65954 - DNA, 25 bp, Homo sapien
gaattaacctaatcacagtgctacc

SEQ ID NO: 65955 - DNA, 25 bp, Homo sapien
cacagtgctaccagagtcttgtttg

SEQ ID NO: 65956 - DNA, 25 bp, Homo sapien
ggacaacttagtgagccccagatgt

SEQ ID NO: 65957 - DNA, 25 bp, Homo sapien
agccccagatgtctatgagcccaaa

SEQ ID NO: 65958 - DNA, 25 bp, Homo sapien
atgagcccaaagtcccaggtctgaa

SEQ ID NO: 65959 - DNA, 25 bp, Homo sapien
agtcccaggtctgaaccatagacag

SEQ ID NO: 65960 - DNA, 25 bp, Homo sapien
acagaggcttagtccagagtgggtt

SEQ ID NO: 65961 - DNA, 25 bp, Homo sapien
aaccagcttcattaggtataattga

SEQ ID NO: 65962 - DNA, 25 bp, Homo sapien
gtttggatgtgttgcatatgccctt

SEQ ID NO: 65963 - DNA, 25 bp, Homo sapien
ttgcatatgcccttgattgccatct

SEQ ID NO: 65964 - DNA, 25 bp, Homo sapien
tgccatctccaccatcaaagtaatt

SEQ ID NO: 65965 - DNA, 25 bp, Homo sapien
tgaaatggcagttgtattgctgtct

SEQ ID NO: 65966 - DNA, 25 bp, Homo sapien
gtattgctgtcttatcatgaggtga

SEQ ID NO: 65967 - DNA, 25 bp, Homo sapien
tgaagctatggtagccaccctgtga

SEQ ID NO: 65968 - DNA, 25 bp, Homo sapien
agccaccctgtgaaccttggaagga

SEQ ID NO: 65969 - DNA, 25 bp, Homo sapien
aaggagggttctacaggaactggca

SEQ ID NO: 65970 - DNA, 25 bp, Homo sapien
cagagctgagactgggacgcaaccc

SEQ ID NO: 65971 - DNA, 25 bp, Homo sapien
gcaacccatgtcctggtgacgtatt

SEQ ID NO: 65972 - DNA, 25 bp, Homo sapien
acgtatttgagtcctgaggctggcc

SEQ ID NO: 65973 - DNA, 25 bp, Homo sapien
gaggctggccctcctgttagtcttt

SEQ ID NO: 65974 - DNA, 25 bp, Homo sapien
tagtcttttctcttactggcttcag

SEQ ID NO: 65975 - DNA, 25 bp, Homo sapien
atctatgcatgctattaccgcctta

SEQ ID NO: 65976 - DNA, 25 bp, Homo sapien
gtttctgggagttacacctcgttat

SEQ ID NO: 65977 - DNA, 25 bp, Homo sapien
gttacacctcgttataattactctg

SEQ ID NO: 65978 - DNA, 25 bp, Homo sapien
aattactctgaagcactaacgtttg

SEQ ID NO: 65979 - DNA, 25 bp, Homo sapien
gaagcactaacgtttgatccccaaa

SEQ ID NO: 65980 - DNA, 25 bp, Homo sapien
gcaaaggccgaaaatatccacctat

SEQ ID NO: 65981 - DNA, 25 bp, Homo sapien
atccacctatggatccagagtctag

SEQ ID NO: 65982 - DNA, 25 bp, Homo sapien
gagtctagaacgttcctctctaatt

SEQ ID NO: 65983 - DNA, 25 bp, Homo sapien
ttactaccgagatcataatgtggaa

SEQ ID NO: 65984 - DNA, 25 bp, Homo sapien
tgtggaactatccaaactgctacac

SEQ ID NO: 65985 - DNA, 25 bp, Homo sapien
tgctacacagactgggacagcctct

SEQ ID NO: 65986 - DNA, 25 bp, Homo sapien
cactggagacaagaactaagcctct

SEQ ID NO: 65987 - DNA, 25 bp, Homo sapien
tgcccagaaagtaaccagacaagaa

SEQ ID NO: 65988 - DNA, 25 bp, Homo sapien
aggcgttggtcagaggagtcttcat

SEQ ID NO: 65989 - DNA, 25 bp, Homo sapien
ttctagtgaggacgttgccagctcc

SEQ ID NO: 65990 - DNA, 25 bp, Homo sapien
tgcttccagggaactcaccagtcac

SEQ ID NO: 65991 - DNA, 25 bp, Homo sapien
tcaccagtcaccaaggtgtcctggg

SEQ ID NO: 65992 - DNA, 25 bp, Homo sapien
gggaagtgtcgctacgtttactatg

SEQ ID NO: 65993 - DNA, 25 bp, Homo sapien
gtgtcgctacgtttactatgggaaa

SEQ ID NO: 65994 - DNA, 25 bp, Homo sapien
aactcagagggcaacaggtttatcc

SEQ ID NO: 65995 - DNA, 25 bp, Homo sapien
ggtttatccgagatgaccagctctg

SEQ ID NO: 65996 - DNA, 25 bp, Homo sapien
accagctctgaagccaacttctgta

SEQ ID NO: 65997 - DNA, 25 bp, Homo sapien
aacttctgtataccttcacccattt

SEQ ID NO: 65998 - DNA, 25 bp, Homo sapien
ctgcaccaatccagctgtgcatgaa

SEQ ID NO: 65999 - DNA, 25 bp, Homo sapien
tgcaccaatccagctgtgcatgaaa

SEQ ID NO: 66000 - DNA, 25 bp, Homo sapien
gcaccaatccagctgtgcatgaaaa

SEQ ID NO: 66001 - DNA, 25 bp, Homo sapien
caccaatccagctgtgcatgaaaag

SEQ ID NO: 66002 - DNA, 25 bp, Homo sapien
accaatccagctgtgcatgaaaagc

SEQ ID NO: 66003 - DNA, 25 bp, Homo sapien
ccaatccagctgtgcatgaaaagct

SEQ ID NO: 66004 - DNA, 25 bp, Homo sapien
caatccagctgtgcatgaaaagctg

SEQ ID NO: 66005 - DNA, 25 bp, Homo sapien
aatccagctgtgcatgaaaagctga

SEQ ID NO: 66006 - DNA, 25 bp, Homo sapien
atccagctgtgcatgaaaagctgaa

SEQ ID NO: 66007 - DNA, 25 bp, Homo sapien
tccagctgtgcatgaaaagctgaag

SEQ ID NO: 66008 - DNA, 25 bp, Homo sapien
cagctgtgcatgaaaagctgaagaa

SEQ ID NO: 66009 - DNA, 25 bp, Homo sapien
aactggtctctaaggcccataggat

SEQ ID NO: 66010 - DNA, 25 bp, Homo sapien
tgtgcaggctccacgggaggtaaac

SEQ ID NO: 66011 - DNA, 25 bp, Homo sapien
gtaaacattgacttccagacccgag

SEQ ID NO: 66012 - DNA, 25 bp, Homo sapien
tccagacccgagaagccacgaggaa

SEQ ID NO: 66013 - DNA, 25 bp, Homo sapien
ggagccatccctgacttgctttgac

SEQ ID NO: 66014 - DNA, 25 bp, Homo sapien
cttgctttgaccaagcccaaggaaa

SEQ ID NO: 66015 - DNA, 25 bp, Homo sapien
ggaaaagtacacagcctcatggaga

SEQ ID NO: 66016 - DNA, 25 bp, Homo sapien
tggagaaagactcttaccccaggtt

SEQ ID NO: 66017 - DNA, 25 bp, Homo sapien
ggttcctgaggtccaaaatgtactt

SEQ ID NO: 66018 - DNA, 25 bp, Homo sapien
ttagatctgctgtcccaaagccaga

SEQ ID NO: 66019 - DNA, 25 bp, Homo sapien
gaactcctggaaatcaccggctttc

SEQ ID NO: 66020 - DNA, 25 bp, Homo sapien
agatgctgcggcaccgtcatgaggc

SEQ ID NO: 66021 - DNA, 25 bp, Homo sapien
tgcggcaccgtcatgaggcactggc

SEQ ID NO: 66022 - DNA, 25 bp, Homo sapien
gacttggtcctgaccccaaggacac

SEQ ID NO: 66023 - DNA, 25 bp, Homo sapien
gaccccaaggacaccatcattgatg

SEQ ID NO: 66024 - DNA, 25 bp, Homo sapien
atcattgatgtggtgggcgcacccc

SEQ ID NO: 66025 - DNA, 25 bp, Homo sapien
cctcacgcccaattcgagaaagcga

SEQ ID NO: 66026 - DNA, 25 bp, Homo sapien
agaaagcgacgggagtcggcctcca

SEQ ID NO: 66027 - DNA, 25 bp, Homo sapien
ctccagctcatcttccgtgaagaaa

SEQ ID NO: 66028 - DNA, 25 bp, Homo sapien
gctcatcttccgtgaagaaagccaa

SEQ ID NO: 66029 - DNA, 25 bp, Homo sapien
agccaagaagccgtgagaggcccca

SEQ ID NO: 66030 - DNA, 25 bp, Homo sapien
gtgggcgacgctgttatgtaaatag

SEQ ID NO: 66031 - DNA, 25 bp, Homo sapien
gttttgcttgcttgtctatttttac

SEQ ID NO: 66032 - DNA, 25 bp, Homo sapien
agaagtaaaatcttgtcttctctgc

SEQ ID NO: 66033 - DNA, 25 bp, Homo sapien
tgtcttctctgctgattctttaatt

SEQ ID NO: 66034 - DNA, 25 bp, Homo sapien
atatgagccggatactttccactgt

SEQ ID NO: 66035 - DNA, 25 bp, Homo sapien
gatactttccactgtcttcttggca

SEQ ID NO: 66036 - DNA, 25 bp, Homo sapien
gtcttcttggcactttcaggatttc

SEQ ID NO: 66037 - DNA, 25 bp, Homo sapien
ggcactttcaggatttcttaatgct

SEQ ID NO: 66038 - DNA, 25 bp, Homo sapien
aatgctgatatatggactcttagaa

SEQ ID NO: 66039 - DNA, 25 bp, Homo sapien
gaaaaatctcaaagcctgtatcgtt

SEQ ID NO: 66040 - DNA, 25 bp, Homo sapien
gcctgtatcgttcttgaaggtcaca

SEQ ID NO: 66041 - DNA, 25 bp, Homo sapien
gaaggtcacatgtacctattgtgaa

SEQ ID NO: 66042 - DNA, 25 bp, Homo sapien
cttatcacatctcgccacaattagt

SEQ ID NO: 66043 - DNA, 25 bp, Homo sapien
acatctcgccacaattagttgtaat

SEQ ID NO: 66044 - DNA, 25 bp, Homo sapien
gtacaaacgtacaaacactggagtg

SEQ ID NO: 66045 - DNA, 25 bp, Homo sapien
tctctttccaaaagtttgtcaaact

SEQ ID NO: 66046 - DNA, 25 bp, Homo sapien
gaaaattcccctccatttgaatatg

SEQ ID NO: 66047 - DNA, 25 bp, Homo sapien
tcccctccatttgaatatggtggtt

SEQ ID NO: 66048 - DNA, 25 bp, Homo sapien
tataagcacacacaagatacatggt

SEQ ID NO: 66049 - DNA, 25 bp, Homo sapien
gatctaaggagtcttcatgtacttc

SEQ ID NO: 66050 - DNA, 25 bp, Homo sapien
ctaaggagtcttcatgtacttcatt

SEQ ID NO: 66051 - DNA, 25 bp, Homo sapien
catggattccatactgagagcctat

SEQ ID NO: 66052 - DNA, 25 bp, Homo sapien
ttccatactgagagcctatctacac

SEQ ID NO: 66053 - DNA, 25 bp, Homo sapien
gggagacatagctaggctgatgtga

SEQ ID NO: 66054 - DNA, 25 bp, Homo sapien
gggtggctgacctgtgctgaccttc

SEQ ID NO: 66055 - DNA, 25 bp, Homo sapien
tgaccttcctgttgttggcaggatg

SEQ ID NO: 66056 - DNA, 25 bp, Homo sapien
cttcctgttgttggcaggatggctg

SEQ ID NO: 66057 - DNA, 25 bp, Homo sapien
tcctggagcgcctgtgagatggtca

SEQ ID NO: 66058 - DNA, 25 bp, Homo sapien
atggtcagcgtggagcgcaagtgct

SEQ ID NO: 66059 - DNA, 25 bp, Homo sapien
acaggtggcccgtgtgccccacagg

SEQ ID NO: 66060 - DNA, 25 bp, Homo sapien
ccaggctcctggtgccagatgatga

SEQ ID NO: 66061 - DNA, 25 bp, Homo sapien
atgatgacgacctgggtggaaacct

SEQ ID NO: 66062 - DNA, 25 bp, Homo sapien
gacctgggtggaaacctaccctgtg

SEQ ID NO: 66063 - DNA, 25 bp, Homo sapien
tggaaacctaccctgtgggcaccca

SEQ ID NO: 66064 - DNA, 25 bp, Homo sapien
aacaactgcagaggagtctccctaa

SEQ ID NO: 66065 - DNA, 25 bp, Homo sapien
agaggagtctccctaaagcaactga

SEQ ID NO: 66066 - DNA, 25 bp, Homo sapien
aaatgctcacacaacaccgaggtcg

SEQ ID NO: 66067 - DNA, 25 bp, Homo sapien
agtactccagaaatgcctgccgtgt

SEQ ID NO: 66068 - DNA, 25 bp, Homo sapien
atgcctgccgtgtctgcgttcttta

SEQ ID NO: 66069 - DNA, 25 bp, Homo sapien
tttagcctcgctgcgctggctgaag

SEQ ID NO: 66070 - DNA, 25 bp, Homo sapien
agaggtcagaggtcaactccgctca

SEQ ID NO: 66071 - DNA, 25 bp, Homo sapien
aaagaaatgccgcaggctcctgtac

SEQ ID NO: 66072 - DNA, 25 bp, Homo sapien
aggctcctgtacttatttcctgcgc

SEQ ID NO: 66073 - DNA, 25 bp, Homo sapien
ttatttcctgcgctgaccagtgaag

SEQ ID NO: 66074 - DNA, 25 bp, Homo sapien
gtgaagcgccctttcattgtaaaac

SEQ ID NO: 66075 - DNA, 25 bp, Homo sapien
agttttggttagtgccacaaggaat

SEQ ID NO: 66076 - DNA, 25 bp, Homo sapien
tttggttagtgccacaaggaattta

SEQ ID NO: 66077 - DNA, 25 bp, Homo sapien
gttagtgccacaaggaatttaactt

SEQ ID NO: 66078 - DNA, 25 bp, Homo sapien
aactgaactaggaattgttagcggg

SEQ ID NO: 66079 - DNA, 25 bp, Homo sapien
gaaggatgtgtactttccttcaaaa

SEQ ID NO: 66080 - DNA, 25 bp, Homo sapien
attttacactagtcagttctttata

SEQ ID NO: 66081 - DNA, 25 bp, Homo sapien
tacactagtcagttctttatattct

SEQ ID NO: 66082 - DNA, 25 bp, Homo sapien
aggttactgcataatgatttcattt

SEQ ID NO: 66083 - DNA, 25 bp, Homo sapien
gttactgcataatgatttcattttg

SEQ ID NO: 66084 - DNA, 25 bp, Homo sapien
ttgataatgtgcagaatggcctcat

SEQ ID NO: 66085 - DNA, 25 bp, Homo sapien
gataatgtgcagaatggcctcataa

SEQ ID NO: 66086 - DNA, 25 bp, Homo sapien
gaatttatccaacgtggaggtcctg

SEQ ID NO: 66087 - DNA, 25 bp, Homo sapien
caacgtggaggtcctgaataaccat

SEQ ID NO: 66088 - DNA, 25 bp, Homo sapien
ggtcctgaataaccatggtggctgc

SEQ ID NO: 66089 - DNA, 25 bp, Homo sapien
gtggctgctgtttgtcatcagacaa

SEQ ID NO: 66090 - DNA, 25 bp, Homo sapien
gctgctgtttgtcatcagacaatag

SEQ ID NO: 66091 - DNA, 25 bp, Homo sapien
aaggacttccaaaatgacagatgag

SEQ ID NO: 66092 - DNA, 25 bp, Homo sapien
tgagaaactgtatattaaacacctt

SEQ ID NO: 66093 - DNA, 25 bp, Homo sapien
gatggacacttgtatttcctaattt

SEQ ID NO: 66094 - DNA, 25 bp, Homo sapien
aatttatgtatcttggtcagcttct

SEQ ID NO: 66095 - DNA, 25 bp, Homo sapien
gcttctccacaagcttacctaattg

SEQ ID NO: 66096 - DNA, 25 bp, Homo sapien
aagcttacctaattgtttatatact

SEQ ID NO: 66097 - DNA, 25 bp, Homo sapien
caggctcttatgtgctagttttgtt

SEQ ID NO: 66098 - DNA, 25 bp, Homo sapien
ctagttttgttggtagcacgttatt

SEQ ID NO: 66099 - DNA, 25 bp, Homo sapien
ggtagcacgttatttaatgcataaa

SEQ ID NO: 66100 - DNA, 25 bp, Homo sapien
gcataaaggcagaattcttacaagt

SEQ ID NO: 66101 - DNA, 25 bp, Homo sapien
gtgaacatagatgcagcaccgactt

SEQ ID NO: 66102 - DNA, 25 bp, Homo sapien
gcagcaccgactttttaaacttgaa

SEQ ID NO: 66103 - DNA, 25 bp, Homo sapien
taacatttggacacactagtaattg

SEQ ID NO: 66104 - DNA, 25 bp, Homo sapien
gagatacttttagtgtgacttttta

SEQ ID NO: 66105 - DNA, 25 bp, Homo sapien
gcctcagtgatgacctcgtctgcca

SEQ ID NO: 66106 - DNA, 25 bp, Homo sapien
tgccagggacacaggttttcatcat

SEQ ID NO: 66107 - DNA, 25 bp, Homo sapien
ggttttcatcatttacaggctctta

SEQ ID NO: 66108 - DNA, 25 bp, Homo sapien
agactgacagttttgcataattata

SEQ ID NO: 66109 - DNA, 25 bp, Homo sapien
ataatcggcattgtacatagaaagg

SEQ ID NO: 66110 - DNA, 25 bp, Homo sapien
ggctaccttttgttaaatctgcact

SEQ ID NO: 66111 - DNA, 25 bp, Homo sapien
aaatctgcactttctaaatatcaaa

SEQ ID NO: 66112 - DNA, 25 bp, Homo sapien
ggctttgccccttttctgtaagtct

SEQ ID NO: 66113 - DNA, 25 bp, Homo sapien
ctgtaagtctcttgggatcctgtgt

SEQ ID NO: 66114 - DNA, 25 bp, Homo sapien
gaagctgttctcattaaacaccaaa

SEQ ID NO: 66115 - DNA, 25 bp, Homo sapien
acagttaagtccattctctggtact

SEQ ID NO: 66116 - DNA, 25 bp, Homo sapien
agtccattctctggtactagctaca

SEQ ID NO: 66117 - DNA, 25 bp, Homo sapien
ggtactagctacaaattcggtttca

SEQ ID NO: 66118 - DNA, 25 bp, Homo sapien
attcggtttcatattctacttaaca

SEQ ID NO: 66119 - DNA, 25 bp, Homo sapien
ccagagaggtgagtggacctgacaa

SEQ ID NO: 66120 - DNA, 25 bp, Homo sapien
gtgagtggacctgacaagtgccaga

SEQ ID NO: 66121 - DNA, 25 bp, Homo sapien
gtggacctgacaagtgccagagtaa

SEQ ID NO: 66122 - DNA, 25 bp, Homo sapien
ctgacaagtgccagagtaaccgtgt

SEQ ID NO: 66123 - DNA, 25 bp, Homo sapien
aagtgccagagtaaccgtgtagaca

SEQ ID NO: 66124 - DNA, 25 bp, Homo sapien
gtaaccgtgtagacagagcagtgta

SEQ ID NO: 66125 - DNA, 25 bp, Homo sapien
ccgtgtagacagagcagtgtagaca

SEQ ID NO: 66126 - DNA, 25 bp, Homo sapien
agccccaggtgtggacctcatgctg

SEQ ID NO: 66127 - DNA, 25 bp, Homo sapien
caggtgtggacctcatgctggtgat

SEQ ID NO: 66128 - DNA, 25 bp, Homo sapien
tggacctcatgctggtgatggctcc

SEQ ID NO: 66129 - DNA, 25 bp, Homo sapien
ttcacgttgtcaccaaggccctgtg

SEQ ID NO: 66130 - DNA, 25 bp, Homo sapien
gataatctccttgtctattagccac

SEQ ID NO: 66131 - DNA, 25 bp, Homo sapien
actagcatggctaattgatcattga

SEQ ID NO: 66132 - DNA, 25 bp, Homo sapien
gatcattgattggacctcattacat

SEQ ID NO: 66133 - DNA, 25 bp, Homo sapien
gctgtggacgtctttggaatttgtt

SEQ ID NO: 66134 - DNA, 25 bp, Homo sapien
gaaggctatgtggtaagctctacta

SEQ ID NO: 66135 - DNA, 25 bp, Homo sapien
aagagtacatagtttgatccattcc

SEQ ID NO: 66136 - DNA, 25 bp, Homo sapien
gatccattcctacggtcgagtctaa

SEQ ID NO: 66137 - DNA, 25 bp, Homo sapien
ggtcgagtctaatcaattccatttc

SEQ ID NO: 66138 - DNA, 25 bp, Homo sapien
attccatttcttagtgtatgcatct

SEQ ID NO: 66139 - DNA, 25 bp, Homo sapien
atgcatctaatgaggcttacaactt

SEQ ID NO: 66140 - DNA, 25 bp, Homo sapien
gcttacaacttgctaaccccaaaag

SEQ ID NO: 66141 - DNA, 25 bp, Homo sapien
aggatttggccttagcttcgtgggc

SEQ ID NO: 66142 - DNA, 25 bp, Homo sapien
tttggccttagcttcgtgggcctat

SEQ ID NO: 66143 - DNA, 25 bp, Homo sapien
gccttagcttcgtgggcctatcggc

SEQ ID NO: 66144 - DNA, 25 bp, Homo sapien
agcttcgtgggcctatcggctgcct

SEQ ID NO: 66145 - DNA, 25 bp, Homo sapien
ttcgtgggcctatcggctgccttcc

SEQ ID NO: 66146 - DNA, 25 bp, Homo sapien
tctgccttcctttgagctctgttgg

SEQ ID NO: 66147 - DNA, 25 bp, Homo sapien
gaaagcatttgcctttcttcctctc

SEQ ID NO: 66148 - DNA, 25 bp, Homo sapien
ctctcccaacataacaatcgtggta

SEQ ID NO: 66149 - DNA, 25 bp, Homo sapien
atcgtggtaacagaatgcgactgct

SEQ ID NO: 66150 - DNA, 25 bp, Homo sapien
aacagaatgcgactgctgatttacc

SEQ ID NO: 66151 - DNA, 25 bp, Homo sapien
acagaatgcgactgctgatttaccg

SEQ ID NO: 66152 - DNA, 25 bp, Homo sapien
actcatggaatatcctgcagaagaa

SEQ ID NO: 66153 - DNA, 25 bp, Homo sapien
atggatttcgttatatcccctttag

SEQ ID NO: 66154 - DNA, 25 bp, Homo sapien
tatcccctttagaatatatcagaca

SEQ ID NO: 66155 - DNA, 25 bp, Homo sapien
aagacctttcattcagaagctgttt

SEQ ID NO: 66156 - DNA, 25 bp, Homo sapien
gcagatggacagttgcacacactag

SEQ ID NO: 66157 - DNA, 25 bp, Homo sapien
gttgcacacactaggagatctcctc

SEQ ID NO: 66158 - DNA, 25 bp, Homo sapien
ttctgctattgatcctgaagatggg

SEQ ID NO: 66159 - DNA, 25 bp, Homo sapien
gagccaatgttggaaacacctctgc

SEQ ID NO: 66160 - DNA, 25 bp, Homo sapien
aacacctctgcagtggctgagtgaa

SEQ ID NO: 66161 - DNA, 25 bp, Homo sapien
gagtgaacatctgagctacccggat

SEQ ID NO: 66162 - DNA, 25 bp, Homo sapien
tgagctacccggataattttcttca

SEQ ID NO: 66163 - DNA, 25 bp, Homo sapien
accagccttaactatgcagctcatg

SEQ ID NO: 66164 - DNA, 25 bp, Homo sapien
gctcatgctgtgaaatccagggtcc

SEQ ID NO: 66165 - DNA, 25 bp, Homo sapien
ctctgctgagtttgttttaaaggga

SEQ ID NO: 66166 - DNA, 25 bp, Homo sapien
gaagagctccaagctaatgcctgca

SEQ ID NO: 66167 - DNA, 25 bp, Homo sapien
caagctaatgcctgcaccaatccag

SEQ ID NO: 66168 - DNA, 25 bp, Homo sapien
tatggcttggatatctgatgttttc

SEQ ID NO: 66169 - DNA, 25 bp, Homo sapien
tgtacaatttatcctttgagagaga

SEQ ID NO: 66170 - DNA, 25 bp, Homo sapien
tataaccccttctcaggttactggc

SEQ ID NO: 66171 - DNA, 25 bp, Homo sapien
cccttctcaggttactggcattgga

SEQ ID NO: 66172 - DNA, 25 bp, Homo sapien
tcaggttactggcattggagtgaaa

SEQ ID NO: 66173 - DNA, 25 bp, Homo sapien
tggagtgaaaataccagccttaact

SEQ ID NO: 66174 - DNA, 25 bp, Homo sapien
acaagagagcctgaagtggagctac

SEQ ID NO: 66175 - DNA, 25 bp, Homo sapien
gagcctgaagtggagctacatcctc

SEQ ID NO: 66176 - DNA, 25 bp, Homo sapien
tgaagtggagctacatcctctcagc

SEQ ID NO: 66177 - DNA, 25 bp, Homo sapien
tggagctacatcctctcagcaggga

SEQ ID NO: 66178 - DNA, 25 bp, Homo sapien
atcctctcagcagggacagcaagat

SEQ ID NO: 66179 - DNA, 25 bp, Homo sapien
agcagggacagcaagataactagtt

SEQ ID NO: 66180 - DNA, 25 bp, Homo sapien
gcaggcctccaagaagtagcgccat

SEQ ID NO: 66181 - DNA, 25 bp, Homo sapien
aagaagtagcgccatcctggcagca

SEQ ID NO: 66182 - DNA, 25 bp, Homo sapien
atcctggcagcagccaagtgagcca

SEQ ID NO: 66183 - DNA, 25 bp, Homo sapien
ctataataaaccagcgggcctccag

SEQ ID NO: 66184 - DNA, 25 bp, Homo sapien
aaaccagcgggcctccagcattggg

SEQ ID NO: 66185 - DNA, 25 bp, Homo sapien
ttggaagaccctacccctgacatca

SEQ ID NO: 66186 - DNA, 25 bp, Homo sapien
tgacatcatcctctcttctcaagaa

SEQ ID NO: 66187 - DNA, 25 bp, Homo sapien
tcctctcttctcaagaacccataga

SEQ ID NO: 66188 - DNA, 25 bp, Homo sapien
aatacacccagaggctgcacagtga

SEQ ID NO: 66189 - DNA, 25 bp, Homo sapien
gacaccctggtgaccgacctgatgg

SEQ ID NO: 66190 - DNA, 25 bp, Homo sapien
gctgatgagctcagccccataaaga

SEQ ID NO: 66191 - DNA, 25 bp, Homo sapien
aagaatgtcgaggaggctttgcgcc

SEQ ID NO: 66192 - DNA, 25 bp, Homo sapien
aggctttgcgcctctgcaggtgact

SEQ ID NO: 66193 - DNA, 25 bp, Homo sapien
tgcgcctctgcaggtgactctcggg

SEQ ID NO: 66194 - DNA, 25 bp, Homo sapien
tcgggcccaagcaaccttctggaaa

SEQ ID NO: 66195 - DNA, 25 bp, Homo sapien
gcccaagcaaccttctggaaaacgg

SEQ ID NO: 66196 - DNA, 25 bp, Homo sapien
gcaatagctggctcctctataggag

SEQ ID NO: 66197 - DNA, 25 bp, Homo sapien
tcctctataggagatgagcttcatt

SEQ ID NO: 66198 - DNA, 25 bp, Homo sapien
gagcttcattgggagttcctagcaa

SEQ ID NO: 66199 - DNA, 25 bp, Homo sapien
gggagttcctagcaagttgactaaa

SEQ ID NO: 66200 - DNA, 25 bp, Homo sapien
cagcaaaagttctttctcgtgggta

SEQ ID NO: 66201 - DNA, 25 bp, Homo sapien
ggtaaatatacccacaggttctatg

SEQ ID NO: 66202 - DNA, 25 bp, Homo sapien
ccacaggttctatgatttgtagctc

SEQ ID NO: 66203 - DNA, 25 bp, Homo sapien
gtagctctaggtttcttgatgatca

SEQ ID NO: 66204 - DNA, 25 bp, Homo sapien
ataaataaccaggaagcattgcttt

SEQ ID NO: 66205 - DNA, 25 bp, Homo sapien
gcattgcttttggacaaggaagaac

SEQ ID NO: 66206 - DNA, 25 bp, Homo sapien
cttggcctcaagttcaatatggaga

SEQ ID NO: 66207 - DNA, 25 bp, Homo sapien
taaccgccattatgtctctagtggg

SEQ ID NO: 66208 - DNA, 25 bp, Homo sapien
ggactgttcgttctagtactttgga

SEQ ID NO: 66209 - DNA, 25 bp, Homo sapien
ttgatagccaaggtttgcagcagtt

SEQ ID NO: 66210 - DNA, 25 bp, Homo sapien
gcagcagttggccttggagtttcac

SEQ ID NO: 66211 - DNA, 25 bp, Homo sapien
ggccttggagtttcactggtttatt

SEQ ID NO: 66212 - DNA, 25 bp, Homo sapien
atttctgcatacttgggtcatctgt

SEQ ID NO: 66213 - DNA, 25 bp, Homo sapien
ggtcatctgtaacaggctaacccaa

SEQ ID NO: 66214 - DNA, 25 bp, Homo sapien
taacccaaaacgtggaagcctgatt

SEQ ID NO: 66215 - DNA, 25 bp, Homo sapien
aagcctgattattcttctcgctgtt

SEQ ID NO: 66216 - DNA, 25 bp, Homo sapien
tgagtgcttgtcttagggcgttttc

SEQ ID NO: 66217 - DNA, 25 bp, Homo sapien
aacttattttccatcaggagggcag

SEQ ID NO: 66218 - DNA, 25 bp, Homo sapien
aggactgagccaatcctgccagaaa

SEQ ID NO: 66219 - DNA, 25 bp, Homo sapien
gactgagccaatcctgccagaaatt

SEQ ID NO: 66220 - DNA, 25 bp, Homo sapien
tgagccaatcctgccagaaattcat

SEQ ID NO: 66221 - DNA, 25 bp, Homo sapien
gccaatcctgccagaaattcatttc

SEQ ID NO: 66222 - DNA, 25 bp, Homo sapien
atcctgccagaaattcatttcctaa

SEQ ID NO: 66223 - DNA, 25 bp, Homo sapien
attcaagaggaatcgcagatcccaa

SEQ ID NO: 66224 - DNA, 25 bp, Homo sapien
aagaggaatcgcagatcccaatcaa

SEQ ID NO: 66225 - DNA, 25 bp, Homo sapien
ggaatcgcagatcccaatcaaagtg

SEQ ID NO: 66226 - DNA, 25 bp, Homo sapien
cagatcccaatcaaagtgccaagtg

SEQ ID NO: 66227 - DNA, 25 bp, Homo sapien
gatcccaatcaaagtgccaagtgag

SEQ ID NO: 66228 - DNA, 25 bp, Homo sapien
cccaatcaaagtgccaagtgagctt

SEQ ID NO: 66229 - DNA, 25 bp, Homo sapien
tggtagttaaagatcgagccctgac

SEQ ID NO: 66230 - DNA, 25 bp, Homo sapien
aaagatcgagccctgacctaatcgg

SEQ ID NO: 66231 - DNA, 25 bp, Homo sapien
atcggttatgttatctacagattac

SEQ ID NO: 66232 - DNA, 25 bp, Homo sapien
gttccattctaattactggtgcatg

SEQ ID NO: 66233 - DNA, 25 bp, Homo sapien
tccattctaattactggtgcatgca

SEQ ID NO: 66234 - DNA, 25 bp, Homo sapien
ggtgcatgcagccttcagtcactta

SEQ ID NO: 66235 - DNA, 25 bp, Homo sapien
tgcatgcagccttcagtcacttact

SEQ ID NO: 66236 - DNA, 25 bp, Homo sapien
ttcagtcacttactccctgcttgct

SEQ ID NO: 66237 - DNA, 25 bp, Homo sapien
tctcatggaaacccccttagagttg

SEQ ID NO: 66238 - DNA, 25 bp, Homo sapien
aagagggataggaattgctcactca

SEQ ID NO: 66239 - DNA, 25 bp, Homo sapien
gagggataggaattgctcactcagg

SEQ ID NO: 66240 - DNA, 25 bp, Homo sapien
cagctgggctgcaggatgcccactt

SEQ ID NO: 66241 - DNA, 25 bp, Homo sapien
atgcccactttgaggagggaggcac

SEQ ID NO: 66242 - DNA, 25 bp, Homo sapien
agaggccatcagaactgcccggctt

SEQ ID NO: 66243 - DNA, 25 bp, Homo sapien
ctgcccggcttttttggaaactgag

SEQ ID NO: 66244 - DNA, 25 bp, Homo sapien
tgaggacccaacaactaaccacgtt

SEQ ID NO: 66245 - DNA, 25 bp, Homo sapien
actaaccacgtttacacgacttgag

SEQ ID NO: 66246 - DNA, 25 bp, Homo sapien
cacgacttgagttttgaaccccgat

SEQ ID NO: 66247 - DNA, 25 bp, Homo sapien
gaaccccgattaatgtctgtacgtc

SEQ ID NO: 66248 - DNA, 25 bp, Homo sapien
attaatgtctgtacgtcacctttcc

SEQ ID NO: 66249 - DNA, 25 bp, Homo sapien
tgtacgtcacctttcctagttctga

SEQ ID NO: 66250 - DNA, 25 bp, Homo sapien
ctggcctcttgcactgctttgtctc

SEQ ID NO: 66251 - DNA, 25 bp, Homo sapien
aatgtttgactgcagttgccttgga

SEQ ID NO: 66252 - DNA, 25 bp, Homo sapien
aattcctccaaagtttgccttcatc

SEQ ID NO: 66253 - DNA, 25 bp, Homo sapien
tcatctctcctctacagtttggagg

SEQ ID NO: 66254 - DNA, 25 bp, Homo sapien
gcagcagtggaacatctcttgatgc

SEQ ID NO: 66255 - DNA, 25 bp, Homo sapien
tggaacatctcttgatgcaccacac

SEQ ID NO: 66256 - DNA, 25 bp, Homo sapien
gatgcaccacactacttgtgttctg

SEQ ID NO: 66257 - DNA, 25 bp, Homo sapien
cacactacttgtgttctgtgaagtg

SEQ ID NO: 66258 - DNA, 25 bp, Homo sapien
aactggttctagtttgcacactaca

SEQ ID NO: 66259 - DNA, 25 bp, Homo sapien
gtttgcacactacacacatagtttt

SEQ ID NO: 66260 - DNA, 25 bp, Homo sapien
acacacatagttttgtgaagcttca

SEQ ID NO: 66261 - DNA, 25 bp, Homo sapien
atctgattatattcatctgctaatg

SEQ ID NO: 66262 - DNA, 25 bp, Homo sapien
tttgttggtagatccatgtgcatgc

SEQ ID NO: 66263 - DNA, 25 bp, Homo sapien
gtgcatgctagaatttgggacaggc

SEQ ID NO: 66264 - DNA, 25 bp, Homo sapien
agcaaaggtacacgttgtaacggtg

SEQ ID NO: 66265 - DNA, 25 bp, Homo sapien
tctgtgaaaaagatgtccctttcat

SEQ ID NO: 66266 - DNA, 25 bp, Homo sapien
agatgtccctttcataatatatgca

SEQ ID NO: 66267 - DNA, 25 bp, Homo sapien
atatgcaatatattccagatgtttt

SEQ ID NO: 66268 - DNA, 25 bp, Homo sapien
agaggaggcctgcttcacttgcaga

SEQ ID NO: 66269 - DNA, 25 bp, Homo sapien
ggcctgcttcacttgcagataagtt

SEQ ID NO: 66270 - DNA, 25 bp, Homo sapien
ataattctccagaaatgtgcaggat

SEQ ID NO: 66271 - DNA, 25 bp, Homo sapien
tgcaggatgtgcattagcaaattgc

SEQ ID NO: 66272 - DNA, 25 bp, Homo sapien
aaattgcactgtacttttcactcca

SEQ ID NO: 66273 - DNA, 25 bp, Homo sapien
tgttgctggccagagactgcctggt

SEQ ID NO: 66274 - DNA, 25 bp, Homo sapien
gagactgcctggtcgccagcgctca

SEQ ID NO: 66275 - DNA, 25 bp, Homo sapien
cagcgctcaccatgggtgccaggat

SEQ ID NO: 66276 - DNA, 25 bp, Homo sapien
catgggtgccaggatgcttcgcaga

SEQ ID NO: 66277 - DNA, 25 bp, Homo sapien
aggatgcttcgcagaggcactgtgc

SEQ ID NO: 66278 - DNA, 25 bp, Homo sapien
cagaggcactgtgctcacggttgga

SEQ ID NO: 66279 - DNA, 25 bp, Homo sapien
gctcacggttggacttggtgtcagt

SEQ ID NO: 66280 - DNA, 25 bp, Homo sapien
taacacacagtgaaaatccaggaag

SEQ ID NO: 66281 - DNA, 25 bp, Homo sapien
attaagcttcttctgggagttgttt

SEQ ID NO: 66282 - DNA, 25 bp, Homo sapien
gggagttgtttattcctgctcgtgc

SEQ ID NO: 66283 - DNA, 25 bp, Homo sapien
attcctgctcgtgcttaagattgat

SEQ ID NO: 66284 - DNA, 25 bp, Homo sapien
gctttagaacacatgcaaacagctg

SEQ ID NO: 66285 - DNA, 25 bp, Homo sapien
tgcaaacagctgcagctctgtgatt

SEQ ID NO: 66286 - DNA, 25 bp, Homo sapien
agctgcagctctgtgattaaaatgt

SEQ ID NO: 66287 - DNA, 25 bp, Homo sapien
agataattctgctgcctctattagc

SEQ ID NO: 66288 - DNA, 25 bp, Homo sapien
attctgctgcctctattagcttatg

SEQ ID NO: 66289 - DNA, 25 bp, Homo sapien
gcctctattagcttatgtatgatcc

SEQ ID NO: 66290 - DNA, 25 bp, Homo sapien
gatccttaatagcattgcttcccct

SEQ ID NO: 66291 - DNA, 25 bp, Homo sapien
tgcttccccttcagtttctatttag

SEQ ID NO: 66292 - DNA, 25 bp, Homo sapien
ccttcagtttctatttaggaggtga

SEQ ID NO: 66293 - DNA, 25 bp, Homo sapien
ttgtactgtagaatgtttgtgatac

SEQ ID NO: 66294 - DNA, 25 bp, Homo sapien
caaagtctattgtttgatctagtta

SEQ ID NO: 66295 - DNA, 25 bp, Homo sapien
tctccaaccccatttatgcaggaag

SEQ ID NO: 66296 - DNA, 25 bp, Homo sapien
gaagggactgctaacaagaacgctt

SEQ ID NO: 66297 - DNA, 25 bp, Homo sapien
tgctaacaagaacgcttccatctca

SEQ ID NO: 66298 - DNA, 25 bp, Homo sapien
agaacgcttccatctcaaacctttt

SEQ ID NO: 66299 - DNA, 25 bp, Homo sapien
caaaccttttctctgcctgggaaat

SEQ ID NO: 66300 - DNA, 25 bp, Homo sapien
ttagagaaacaaacgtaggccttgt

SEQ ID NO: 66301 - DNA, 25 bp, Homo sapien
ggccttgtttactaatagccagaca

SEQ ID NO: 66302 - DNA, 25 bp, Homo sapien
tgtttactaatagccagacatcaga

SEQ ID NO: 66303 - DNA, 25 bp, Homo sapien
gacatcagaactgcaggtagggtat

SEQ ID NO: 66304 - DNA, 25 bp, Homo sapien
gatgactttatttctgggcagctcc

SEQ ID NO: 66305 - DNA, 25 bp, Homo sapien
cctgggggatcctcaattattgtta

SEQ ID NO: 66306 - DNA, 25 bp, Homo sapien
atgtacatattttgcagtgtttcac

SEQ ID NO: 66307 - DNA, 25 bp, Homo sapien
gtttcacaggagaaagtggccttaa

SEQ ID NO: 66308 - DNA, 25 bp, Homo sapien
cttattctctctccacgttgtaaat

SEQ ID NO: 66309 - DNA, 25 bp, Homo sapien
aactcagaacttgaatcccgtcagc

SEQ ID NO: 66310 - DNA, 25 bp, Homo sapien
gaatcccgtcagcttaaaacttgtg

SEQ ID NO: 66311 - DNA, 25 bp, Homo sapien
acttgtgtagggaatcctgactttt

SEQ ID NO: 66312 - DNA, 25 bp, Homo sapien
tgagggtatttggatctgtgttgaa

SEQ ID NO: 66313 - DNA, 25 bp, Homo sapien
ggatctgtgttgaaagtcgtatatt

SEQ ID NO: 66314 - DNA, 25 bp, Homo sapien
tttatctgtgcggtgctgagtgcag

SEQ ID NO: 66315 - DNA, 25 bp, Homo sapien
agaggttccctatatgcgcgtatga

SEQ ID NO: 66316 - DNA, 25 bp, Homo sapien
atatgcgcgtatgacatggtgaata

SEQ ID NO: 66317 - DNA, 25 bp, Homo sapien
gatgaggtgactattctgagatgac

SEQ ID NO: 66318 - DNA, 25 bp, Homo sapien
atgactattcagtggctaacttggg

SEQ ID NO: 66319 - DNA, 25 bp, Homo sapien
attttctccaaatgttcactggtac

SEQ ID NO: 66320 - DNA, 25 bp, Homo sapien
gttcactggtactctgccactttat

SEQ ID NO: 66321 - DNA, 25 bp, Homo sapien
gccactttatttctctcatctgtta

SEQ ID NO: 66322 - DNA, 25 bp, Homo sapien
gcaaatcagtttggttggtaactct

SEQ ID NO: 66323 - DNA, 25 bp, Homo sapien
ggtaactctgtaattcctaactatc

SEQ ID NO: 66324 - DNA, 25 bp, Homo sapien
actatcactggtttggttctggact

SEQ ID NO: 66325 - DNA, 25 bp, Homo sapien
ggttctggactaaaactacattgac

SEQ ID NO: 66326 - DNA, 25 bp, Homo sapien
gaatttgcctaatatgatgactgtt

SEQ ID NO: 66327 - DNA, 25 bp, Homo sapien
gtatgtgttctattcagcccaagga

SEQ ID NO: 66328 - DNA, 25 bp, Homo sapien
ccggcaccttccacgaaagatggta

SEQ ID NO: 66329 - DNA, 25 bp, Homo sapien
aagatggtacttcccaagcaagccc

SEQ ID NO: 66330 - DNA, 25 bp, Homo sapien
aagcaagcccctatgatttgtcact

SEQ ID NO: 66331 - DNA, 25 bp, Homo sapien
gcccctatgatttgtcactatagat

SEQ ID NO: 66332 - DNA, 25 bp, Homo sapien
ggcatgcacatgagttgaaattctt

SEQ ID NO: 66333 - DNA, 25 bp, Homo sapien
gggatgtcagtttcctatggaagag

SEQ ID NO: 66334 - DNA, 25 bp, Homo sapien
gaagagacacctctgacccgttatt

SEQ ID NO: 66335 - DNA, 25 bp, Homo sapien
acctctgacccgttattcttataat

SEQ ID NO: 66336 - DNA, 25 bp, Homo sapien
gacccgttattcttataatcaaaat

SEQ ID NO: 66337 - DNA, 25 bp, Homo sapien
ttccccactcgttgggttcaactag

SEQ ID NO: 66338 - DNA, 25 bp, Homo sapien
ggttcaactagattaaaaggctgat

SEQ ID NO: 66339 - DNA, 25 bp, Homo sapien
tttaaccaaacaccaaggttgcgtg

SEQ ID NO: 66340 - DNA, 25 bp, Homo sapien
aacaccaaggttgcgtgaggcccca

SEQ ID NO: 66341 - DNA, 25 bp, Homo sapien
aaggttgcgtgaggccccatttcat

SEQ ID NO: 66342 - DNA, 25 bp, Homo sapien
gtgaggccccatttcatgagccggg

SEQ ID NO: 66343 - DNA, 25 bp, Homo sapien
agccgggctccaaggacgtgtcctt

SEQ ID NO: 66344 - DNA, 25 bp, Homo sapien
gacgtgtccttaggcggctctggaa

SEQ ID NO: 66345 - DNA, 25 bp, Homo sapien
tccttaggcggctctggaaggccca

SEQ ID NO: 66346 - DNA, 25 bp, Homo sapien
cccgtcctctgttaaagggagccag

SEQ ID NO: 66347 - DNA, 25 bp, Homo sapien
tctgttaaagggagccagccccggc

SEQ ID NO: 66348 - DNA, 25 bp, Homo sapien
gtccgcccaggcatggtagcctgag

SEQ ID NO: 66349 - DNA, 25 bp, Homo sapien
tgccctggcatgagcagagcccagg

SEQ ID NO: 66350 - DNA, 25 bp, Homo sapien
cagagctgtctggtgatcactttat

SEQ ID NO: 66351 - DNA, 25 bp, Homo sapien
tcactttatgtctcacagggaccca

SEQ ID NO: 66352 - DNA, 25 bp, Homo sapien
gaaattgtgaaagctccatgtttag

SEQ ID NO: 66353 - DNA, 25 bp, Homo sapien
tgagctggtggctgcgtactttgac

SEQ ID NO: 66354 - DNA, 25 bp, Homo sapien
gtggctgcgtactttgactggtaca

SEQ ID NO: 66355 - DNA, 25 bp, Homo sapien
tgactggtacatggaggctatttta

SEQ ID NO: 66356 - DNA, 25 bp, Homo sapien
tggaggctattttaatccttctaac

SEQ ID NO: 66357 - DNA, 25 bp, Homo sapien
tacaagtaaagctagacaaaggccc

SEQ ID NO: 66358 - DNA, 25 bp, Homo sapien
gttattggaagctgattcccagagc

SEQ ID NO: 66359 - DNA, 25 bp, Homo sapien
ttcccagagcagaccacatatacag

SEQ ID NO: 66360 - DNA, 25 bp, Homo sapien
gcagaccacatatacagcaggatgt

SEQ ID NO: 66361 - DNA, 25 bp, Homo sapien
tatgttttaagacccccagttaatg

SEQ ID NO: 66362 - DNA, 25 bp, Homo sapien
ttaatgcctgaaaccgctgctagta

SEQ ID NO: 66363 - DNA, 25 bp, Homo sapien
gctgctagtaccaaaccctaatgtt

SEQ ID NO: 66364 - DNA, 25 bp, Homo sapien
atgtacgtacatatgataaagttca

SEQ ID NO: 66365 - DNA, 25 bp, Homo sapien
cgtacatatgataaagttcagttta

SEQ ID NO: 66366 - DNA, 25 bp, Homo sapien
gttcagtttataagttaggcacagt

SEQ ID NO: 66367 - DNA, 25 bp, Homo sapien
gtaagagactaacaacagctcacag

SEQ ID NO: 66368 - DNA, 25 bp, Homo sapien
gagactaacaacagctcacagccaa

SEQ ID NO: 66369 - DNA, 25 bp, Homo sapien
gactaacaacagctcacagccaaat

SEQ ID NO: 66370 - DNA, 25 bp, Homo sapien
aacaacagctcacagccaaatagag

SEQ ID NO: 66371 - DNA, 25 bp, Homo sapien
cacagccaaatagagcaattataac

SEQ ID NO: 66372 - DNA, 25 bp, Homo sapien
aagtggttggagatagcacccaatt

SEQ ID NO: 66373 - DNA, 25 bp, Homo sapien
gcacccaattaacatcgacagccaa

SEQ ID NO: 66374 - DNA, 25 bp, Homo sapien
tcgacagccaagtcttctatttcag

SEQ ID NO: 66375 - DNA, 25 bp, Homo sapien
aatattgatttatttcgctttggct

SEQ ID NO: 66376 - DNA, 25 bp, Homo sapien
tcgctttggcttttgatgccatcat

SEQ ID NO: 66377 - DNA, 25 bp, Homo sapien
aagtctgcagtttcaaaagctcatg

SEQ ID NO: 66378 - DNA, 25 bp, Homo sapien
aagctcatgctacttagaagagatg

SEQ ID NO: 66379 - DNA, 25 bp, Homo sapien
attgcttgtgactgcagtatgtaca

SEQ ID NO: 66380 - DNA, 25 bp, Homo sapien
cagttaaaaagctgttcactgcccc

SEQ ID NO: 66381 - DNA, 25 bp, Homo sapien
tttcattttgagctttactaagaga

SEQ ID NO: 66382 - DNA, 25 bp, Homo sapien
agaatgcttttaggaacagaattcc

SEQ ID NO: 66383 - DNA, 25 bp, Homo sapien
ccaactgtggaatggcagtgtaggt

SEQ ID NO: 66384 - DNA, 25 bp, Homo sapien
caactgtggaatggcagtgtaggta

SEQ ID NO: 66385 - DNA, 25 bp, Homo sapien
tggaatggcagtgtaggtagcttca

SEQ ID NO: 66386 - DNA, 25 bp, Homo sapien
aatggcagtgtaggtagcttcagga

SEQ ID NO: 66387 - DNA, 25 bp, Homo sapien
atggcagtgtaggtagcttcaggaa

SEQ ID NO: 66388 - DNA, 25 bp, Homo sapien
tggcagtgtaggtagcttcaggaaa

SEQ ID NO: 66389 - DNA, 25 bp, Homo sapien
ggcagtgtaggtagcttcaggaaat

SEQ ID NO: 66390 - DNA, 25 bp, Homo sapien
gcagtgtaggtagcttcaggaaatg

SEQ ID NO: 66391 - DNA, 25 bp, Homo sapien
cagtgtaggtagcttcaggaaatgg

SEQ ID NO: 66392 - DNA, 25 bp, Homo sapien
attctcaaaacacaaattgttgctg

SEQ ID NO: 66393 - DNA, 25 bp, Homo sapien
tctcaaaacacaaattgttgctggc

SEQ ID NO: 66394 - DNA, 25 bp, Homo sapien
gaaaacaattgccttcacttttaag

SEQ ID NO: 66395 - DNA, 25 bp, Homo sapien
caattgccttcacttttaaggagta

SEQ ID NO: 66396 - DNA, 25 bp, Homo sapien
gaatattaataactctggtctagat

SEQ ID NO: 66397 - DNA, 25 bp, Homo sapien
gtagtgaacatcaatgaacatctga

SEQ ID NO: 66398 - DNA, 25 bp, Homo sapien
actgtaatcaggcataagcttgttt

SEQ ID NO: 66399 - DNA, 25 bp, Homo sapien
aagcttgtttgtatgttctggcagt

SEQ ID NO: 66400 - DNA, 25 bp, Homo sapien
tgttctggcagtgactaatcagtaa

SEQ ID NO: 66401 - DNA, 25 bp, Homo sapien
atcagtaaatgatgtcggtttgccc

SEQ ID NO: 66402 - DNA, 25 bp, Homo sapien
aaatgatgtcggtttgcccagtatc

SEQ ID NO: 66403 - DNA, 25 bp, Homo sapien
tgtcggtttgcccagtatcacttat

SEQ ID NO: 66404 - DNA, 25 bp, Homo sapien
gtttgcccagtatcacttatcttct

SEQ ID NO: 66405 - DNA, 25 bp, Homo sapien
ccctatgagtgtattctagttccgt

SEQ ID NO: 66406 - DNA, 25 bp, Homo sapien
ctatgagtgtattctagttccgttt

SEQ ID NO: 66407 - DNA, 25 bp, Homo sapien
tctagttccgtttgatatcatgaaa

SEQ ID NO: 66408 - DNA, 25 bp, Homo sapien
tagttccgtttgatatcatgaaagg

SEQ ID NO: 66409 - DNA, 25 bp, Homo sapien
ttcagatgtgcctcgcaccttcaac

SEQ ID NO: 66410 - DNA, 25 bp, Homo sapien
gcctcgcaccttcaacggcatggaa

SEQ ID NO: 66411 - DNA, 25 bp, Homo sapien
caccttcaacggcatggaagggttc

SEQ ID NO: 66412 - DNA, 25 bp, Homo sapien
atggaagggttcacacttgggagaa

SEQ ID NO: 66413 - DNA, 25 bp, Homo sapien
gaagggttcacacttgggagaaact

SEQ ID NO: 66414 - DNA, 25 bp, Homo sapien
gggttcacacttgggagaaactcta

SEQ ID NO: 66415 - DNA, 25 bp, Homo sapien
gaaggtataataaaatatcccattg

SEQ ID NO: 66416 - DNA, 25 bp, Homo sapien
gaagttcatggatcaacatccggag

SEQ ID NO: 66417 - DNA, 25 bp, Homo sapien
gttcatggatcaacatccggagatg

SEQ ID NO: 66418 - DNA, 25 bp, Homo sapien
aacatccggagatggatttttccaa

SEQ ID NO: 66419 - DNA, 25 bp, Homo sapien
tccggagatggatttttccaaggct

SEQ ID NO: 66420 - DNA, 25 bp, Homo sapien
gatggatttttccaaggctaaattc

SEQ ID NO: 66421 - DNA, 25 bp, Homo sapien
tggatttttccaaggctaaattcaa

SEQ ID NO: 66422 - DNA, 25 bp, Homo sapien
gggctgagctgcaaccacccaactt

SEQ ID NO: 66423 - DNA, 25 bp, Homo sapien
gagctgcaaccacccaactttcttt

SEQ ID NO: 66424 - DNA, 25 bp, Homo sapien
ttctctgggacttgtgggcctcagg

SEQ ID NO: 66425 - DNA, 25 bp, Homo sapien
gacagaagtccatggggctgccaac

SEQ ID NO: 66426 - DNA, 25 bp, Homo sapien
gctgccaacttcagacgaacagaag

SEQ ID NO: 66427 - DNA, 25 bp, Homo sapien
gggtggagcaagatcatcctagaat

SEQ ID NO: 66428 - DNA, 25 bp, Homo sapien
cctagaatgaggctgctcttggcaa

SEQ ID NO: 66429 - DNA, 25 bp, Homo sapien
ggatcttataggcacagcagctgat

SEQ ID NO: 66430 - DNA, 25 bp, Homo sapien
agcagctgatgcctttcttcatctg

SEQ ID NO: 66431 - DNA, 25 bp, Homo sapien
gcaactctggtgaaggttgtcctgc

SEQ ID NO: 66432 - DNA, 25 bp, Homo sapien
tcctgcctgtcacaggtgctgagta

SEQ ID NO: 66433 - DNA, 25 bp, Homo sapien
aagtggtggcagtgggatttcctca

SEQ ID NO: 66434 - DNA, 25 bp, Homo sapien
gtgggatttcctcagtaatagtcct

SEQ ID NO: 66435 - DNA, 25 bp, Homo sapien
aaggtacgtgtttgtcctggctact

SEQ ID NO: 66436 - DNA, 25 bp, Homo sapien
aaggcatccaaacccttatctgtgg

SEQ ID NO: 66437 - DNA, 25 bp, Homo sapien
gtgtatgccatataataccctctaa

SEQ ID NO: 66438 - DNA, 25 bp, Homo sapien
tggcaaacatttttccagtaacttt

SEQ ID NO: 66439 - DNA, 25 bp, Homo sapien
caaatgaattttcttcatacttaaa

SEQ ID NO: 66440 - DNA, 25 bp, Homo sapien
ttcatacttaaaaaagccctttgct

SEQ ID NO: 66441 - DNA, 25 bp, Homo sapien
ggtaaaattatgtctatggcactaa

SEQ ID NO: 66442 - DNA, 25 bp, Homo sapien
aaattatgtctatggcactaatata

SEQ ID NO: 66443 - DNA, 25 bp, Homo sapien
tatgtctatggcactaatataaaat

SEQ ID NO: 66444 - DNA, 25 bp, Homo sapien
tgtctatggcactaatataaaatga

SEQ ID NO: 66445 - DNA, 25 bp, Homo sapien
gttaatgattttacttaactcattt

SEQ ID NO: 66446 - DNA, 25 bp, Homo sapien
ctggagtacagcagagcgatctcgg

SEQ ID NO: 66447 - DNA, 25 bp, Homo sapien
tggagtacagcagagcgatctcggc

SEQ ID NO: 66448 - DNA, 25 bp, Homo sapien
actgcaagctcctgcaagctccgcc

SEQ ID NO: 66449 - DNA, 25 bp, Homo sapien
accatggtttggctccttccggtct

SEQ ID NO: 66450 - DNA, 25 bp, Homo sapien
ttccggtctgtgctcctacgtgaaa

SEQ ID NO: 66451 - DNA, 25 bp, Homo sapien
gtctgtgctcctacgtgaaacccga

SEQ ID NO: 66452 - DNA, 25 bp, Homo sapien
gtgctcctacgtgaaacccgagcaa

SEQ ID NO: 66453 - DNA, 25 bp, Homo sapien
tcctacgtgaaacccgagcaacatt

SEQ ID NO: 66454 - DNA, 25 bp, Homo sapien
tacgtgaaacccgagcaacattaag

SEQ ID NO: 66455 - DNA, 25 bp, Homo sapien
gaaacccgagcaacattaaggcttt

SEQ ID NO: 66456 - DNA, 25 bp, Homo sapien
acattaaggctttcagggcttttct

SEQ ID NO: 66457 - DNA, 25 bp, Homo sapien
ttaaggctttcagggcttttcttgg

SEQ ID NO: 66458 - DNA, 25 bp, Homo sapien
ggctttcagggcttttcttggtctt

SEQ ID NO: 66459 - DNA, 25 bp, Homo sapien
gctttcagggcttttcttggtcttt

SEQ ID NO: 66460 - DNA, 25 bp, Homo sapien
cattgttatatgtaccccagttgtt

SEQ ID NO: 66461 - DNA, 25 bp, Homo sapien
atatgtaccccagttgttgttagtg

SEQ ID NO: 66462 - DNA, 25 bp, Homo sapien
gagaggcagtcattcacgatggttt

SEQ ID NO: 66463 - DNA, 25 bp, Homo sapien
acgatggttttgtgccagctctttt

SEQ ID NO: 66464 - DNA, 25 bp, Homo sapien
gctctttttagggttttggatcaca

SEQ ID NO: 66465 - DNA, 25 bp, Homo sapien
gaacatattaccctgtgacttacgt

SEQ ID NO: 66466 - DNA, 25 bp, Homo sapien
ctgtgacttacgtaggaaacctaat

SEQ ID NO: 66467 - DNA, 25 bp, Homo sapien
gaaacctaatatgctgagtatctgg

SEQ ID NO: 66468 - DNA, 25 bp, Homo sapien
gagtatctggcacttgaattcctgc

SEQ ID NO: 66469 - DNA, 25 bp, Homo sapien
tcctgcttttattgctggaggtcca

SEQ ID NO: 66470 - DNA, 25 bp, Homo sapien
cacatgtgtggttgacctctgttat

SEQ ID NO: 66471 - DNA, 25 bp, Homo sapien
cagatgagcatcacagatccgaaga

SEQ ID NO: 66472 - DNA, 25 bp, Homo sapien
gatccgaagaggaactcctggtcat

SEQ ID NO: 66473 - DNA, 25 bp, Homo sapien
gaggaactcctggtcatctttaaca

SEQ ID NO: 66474 - DNA, 25 bp, Homo sapien
gaactcctggtcatctttaacaaga

SEQ ID NO: 66475 - DNA, 25 bp, Homo sapien
gaaaatcagcaagaaccctaccttt

SEQ ID NO: 66476 - DNA, 25 bp, Homo sapien
tcagcaagaaccctacctttaagtt

SEQ ID NO: 66477 - DNA, 25 bp, Homo sapien
aaggacaaagtcaagcttgtgaaat

SEQ ID NO: 66478 - DNA, 25 bp, Homo sapien
aaattgaatccattctgctgacttc

SEQ ID NO: 66479 - DNA, 25 bp, Homo sapien
acttcttcctttcactgctgtttat

SEQ ID NO: 66480 - DNA, 25 bp, Homo sapien
tcctttcactgctgtttataaaatg

SEQ ID NO: 66481 - DNA, 25 bp, Homo sapien
gaattctaacaactcaaattttgct

SEQ ID NO: 66482 - DNA, 25 bp, Homo sapien
gaaatgtctgtggttccttggaaat

SEQ ID NO: 66483 - DNA, 25 bp, Homo sapien
ggttccttggaaatgctgcgctctt

SEQ ID NO: 66484 - DNA, 25 bp, Homo sapien
aaatgctgcgctctttgtgtttttc

SEQ ID NO: 66485 - DNA, 25 bp, Homo sapien
gcgctctttgtgtttttccatcatt

SEQ ID NO: 66486 - DNA, 25 bp, Homo sapien
gtttttccatcattagtgcagttgg

SEQ ID NO: 66487 - DNA, 25 bp, Homo sapien
gtgtataggtcagaggtcttcgtgt

SEQ ID NO: 66488 - DNA, 25 bp, Homo sapien
ggtcttcgtgttcacattttaaaat

SEQ ID NO: 66489 - DNA, 25 bp, Homo sapien
taggtaaatgacctcatctttcaag

SEQ ID NO: 66490 - DNA, 25 bp, Homo sapien
tacaatgtgtagacagttccctgtt

SEQ ID NO: 66491 - DNA, 25 bp, Homo sapien
gtgtagacagttccctgttctctgc

SEQ ID NO: 66492 - DNA, 25 bp, Homo sapien
gatgtaactctatcttatccttaaa

SEQ ID NO: 66493 - DNA, 25 bp, Homo sapien
ttgcgcattcctagtaagcaaaaaa

SEQ ID NO: 66494 - DNA, 25 bp, Homo sapien
aaaaaatttgttatgccatcttcat

SEQ ID NO: 66495 - DNA, 25 bp, Homo sapien
gttatgccatcttcattattcgaat

SEQ ID NO: 66496 - DNA, 25 bp, Homo sapien
gccatcttcattattcgaattacag

SEQ ID NO: 66497 - DNA, 25 bp, Homo sapien
tcattattcgaattacagactgaaa

SEQ ID NO: 66498 - DNA, 25 bp, Homo sapien
cagactgaaaaaatatggccagttt

SEQ ID NO: 66499 - DNA, 25 bp, Homo sapien
gattatgttttccatggaaggacaa

SEQ ID NO: 66500 - DNA, 25 bp, Homo sapien
tttccatggaaggacaagtctgact

SEQ ID NO: 66501 - DNA, 25 bp, Homo sapien
gacaagtctgactgttcataggctg

SEQ ID NO: 66502 - DNA, 25 bp, Homo sapien
aagtctgactgttcataggctgatt

SEQ ID NO: 66503 - DNA, 25 bp, Homo sapien
ctgactgttcataggctgattttct

SEQ ID NO: 66504 - DNA, 25 bp, Homo sapien
gcctcctccagttacgcaatagaaa

SEQ ID NO: 66505 - DNA, 25 bp, Homo sapien
tagaaaaaaagacccctgccagcct

SEQ ID NO: 66506 - DNA, 25 bp, Homo sapien
gggacacccagatattccccggctg

SEQ ID NO: 66507 - DNA, 25 bp, Homo sapien
atattccccggctgttgacactgga

SEQ ID NO: 66508 - DNA, 25 bp, Homo sapien
ccggctgttgacactggacgtgtag

SEQ ID NO: 66509 - DNA, 25 bp, Homo sapien
tgacactggacgtgtagtcctcctg

SEQ ID NO: 66510 - DNA, 25 bp, Homo sapien
acgtgtagtcctcctgccacaaaag

SEQ ID NO: 66511 - DNA, 25 bp, Homo sapien
gccacaaaagcctgaacttcctgaa

SEQ ID NO: 66512 - DNA, 25 bp, Homo sapien
ttcctgaaggcccagtaaggtgcga

SEQ ID NO: 66513 - DNA, 25 bp, Homo sapien
ctgatggtcaatgtggattctcccc

SEQ ID NO: 66514 - DNA, 25 bp, Homo sapien
ggtcaatgtggattctccccaataa

SEQ ID NO: 66515 - DNA, 25 bp, Homo sapien
gtgaagatggacgactgagcccctt

SEQ ID NO: 66516 - DNA, 25 bp, Homo sapien
gaagatggacgactgagcccctttg

SEQ ID NO: 66517 - DNA, 25 bp, Homo sapien
acagtggcaaggagctccatgctga

SEQ ID NO: 66518 - DNA, 25 bp, Homo sapien
tccatgctgaggatcgccacatggc

SEQ ID NO: 66519 - DNA, 25 bp, Homo sapien
catgctgaggatcgccacatggctg

SEQ ID NO: 66520 - DNA, 25 bp, Homo sapien
gctgaggatcgccacatggctgcaa

SEQ ID NO: 66521 - DNA, 25 bp, Homo sapien
tgaggatcgccacatggctgcaaag

SEQ ID NO: 66522 - DNA, 25 bp, Homo sapien
gctgcaaaggacagggttggaccca

SEQ ID NO: 66523 - DNA, 25 bp, Homo sapien
ggacccaatcccagagcagaggtct

SEQ ID NO: 66524 - DNA, 25 bp, Homo sapien
acccaatcccagagcagaggtctga

SEQ ID NO: 66525 - DNA, 25 bp, Homo sapien
ttaactgctttgtcaaaattaaaca

SEQ ID NO: 66526 - DNA, 25 bp, Homo sapien
aataatttgttctgtgccttttgcc

SEQ ID NO: 66527 - DNA, 25 bp, Homo sapien
aatttgttctgtgccttttgcctgg

SEQ ID NO: 66528 - DNA, 25 bp, Homo sapien
tgttctgtgccttttgcctggtata

SEQ ID NO: 66529 - DNA, 25 bp, Homo sapien
tctgtgccttttgcctggtatatag

SEQ ID NO: 66530 - DNA, 25 bp, Homo sapien
gtgccttttgcctggtatatagcaa

SEQ ID NO: 66531 - DNA, 25 bp, Homo sapien
ttgcctggtatatagcaaatactca

SEQ ID NO: 66532 - DNA, 25 bp, Homo sapien
gcgattcctctagtctttcagatta

SEQ ID NO: 66533 - DNA, 25 bp, Homo sapien
gagacacttgagaaaactatacatg

SEQ ID NO: 66534 - DNA, 25 bp, Homo sapien
aaaaatgaatggttgctaacttagc

SEQ ID NO: 66535 - DNA, 25 bp, Homo sapien
aaagaggactcaggcattgctgaaa

SEQ ID NO: 66536 - DNA, 25 bp, Homo sapien
gactcaggcattgctgaaagagtta

SEQ ID NO: 66537 - DNA, 25 bp, Homo sapien
agctcagtccccacaaagttcaggg

SEQ ID NO: 66538 - DNA, 25 bp, Homo sapien
ccacaaagttcagggccggtcggag

SEQ ID NO: 66539 - DNA, 25 bp, Homo sapien
gtccgggtccaaagcaaggacacca

SEQ ID NO: 66540 - DNA, 25 bp, Homo sapien
ccgggtccaaagcaaggacaccaca

SEQ ID NO: 66541 - DNA, 25 bp, Homo sapien
caaagcaaggacaccacagctcttc

SEQ ID NO: 66542 - DNA, 25 bp, Homo sapien
attcggacacggatgtgaagtccca

SEQ ID NO: 66543 - DNA, 25 bp, Homo sapien
gacacggatgtgaagtcccacgctg

SEQ ID NO: 66544 - DNA, 25 bp, Homo sapien
acacggatgtgaagtcccacgctgc

SEQ ID NO: 66545 - DNA, 25 bp, Homo sapien
cacggatgtgaagtcccacgctgct

SEQ ID NO: 66546 - DNA, 25 bp, Homo sapien
tggctccaagcagcacgagagcatc

SEQ ID NO: 66547 - DNA, 25 bp, Homo sapien
agcagcacgagagcatcccgggcaa

SEQ ID NO: 66548 - DNA, 25 bp, Homo sapien
gaggatgaccgtgcttgaggaggaa

SEQ ID NO: 66549 - DNA, 25 bp, Homo sapien
ggaagaatgggttcaagatcatcat

SEQ ID NO: 66550 - DNA, 25 bp, Homo sapien
gggttcaagatcatcatattcatca

SEQ ID NO: 66551 - DNA, 25 bp, Homo sapien
aagatcatcatattcatcagaaggg

SEQ ID NO: 66552 - DNA, 25 bp, Homo sapien
gacactaaatagaacccttaacctg

SEQ ID NO: 66553 - DNA, 25 bp, Homo sapien
tagaacccttaacctgttgtacttg

SEQ ID NO: 66554 - DNA, 25 bp, Homo sapien
cctgttgtacttgccaaaattgaga

SEQ ID NO: 66555 - DNA, 25 bp, Homo sapien
gtacttgccaaaattgagaatcaga

SEQ ID NO: 66556 - DNA, 25 bp, Homo sapien
tgccaagttgcaaagttgtatccac

SEQ ID NO: 66557 - DNA, 25 bp, Homo sapien
gcaaagttgtatccacatcaggtca

SEQ ID NO: 66558 - DNA, 25 bp, Homo sapien
agttgtatccacatcaggtcactgt

SEQ ID NO: 66559 - DNA, 25 bp, Homo sapien
gcaggctccaggaggcctccagagt

SEQ ID NO: 66560 - DNA, 25 bp, Homo sapien
gtcagctggaccttgctgtgtcgcc

SEQ ID NO: 66561 - DNA, 25 bp, Homo sapien
acaccggtgaggtgggatgatttca

SEQ ID NO: 66562 - DNA, 25 bp, Homo sapien
ggatgatttcaggaggtcccagccc

SEQ ID NO: 66563 - DNA, 25 bp, Homo sapien
gatgatttcaggaggtcccagcccg

SEQ ID NO: 66564 - DNA, 25 bp, Homo sapien
gaaccagtccaaggggctgtcagtt

SEQ ID NO: 66565 - DNA, 25 bp, Homo sapien
ctccttttaaggaattatgaagcta

SEQ ID NO: 66566 - DNA, 25 bp, Homo sapien
gttggtggacaaagttctagctgat

SEQ ID NO: 66567 - DNA, 25 bp, Homo sapien
ggtggacaaagttctagctgattaa

SEQ ID NO: 66568 - DNA, 25 bp, Homo sapien
agttctagctgattaaatatggtct

SEQ ID NO: 66569 - DNA, 25 bp, Homo sapien
agctgattaaatatggtctaactta

SEQ ID NO: 66570 - DNA, 25 bp, Homo sapien
attcggacacggatgtgaagtccca

SEQ ID NO: 66571 - DNA, 25 bp, Homo sapien
ttcggacacggatgtgaagtcccac

SEQ ID NO: 66572 - DNA, 25 bp, Homo sapien
tcggacacggatgtgaagtcccacg

SEQ ID NO: 66573 - DNA, 25 bp, Homo sapien
cggacacggatgtgaagtcccacgc

SEQ ID NO: 66574 - DNA, 25 bp, Homo sapien
ggacacggatgtgaagtcccacgct

SEQ ID NO: 66575 - DNA, 25 bp, Homo sapien
gacacggatgtgaagtcccacgctg

SEQ ID NO: 66576 - DNA, 25 bp, Homo sapien
acacggatgtgaagtcccacgctgc

SEQ ID NO: 66577 - DNA, 25 bp, Homo sapien
cacggatgtgaagtcccacgctgct

SEQ ID NO: 66578 - DNA, 25 bp, Homo sapien
ttttgttttggaagtcttggccagg

SEQ ID NO: 66579 - DNA, 25 bp, Homo sapien
cctggccaatatggttgaattcccg

SEQ ID NO: 66580 - DNA, 25 bp, Homo sapien
ctggccaatatggttgaattcccgt

SEQ ID NO: 66581 - DNA, 25 bp, Homo sapien
tggccaatatggttgaattcccgtc

SEQ ID NO: 66582 - DNA, 25 bp, Homo sapien
ggccaatatggttgaattcccgtct

SEQ ID NO: 66583 - DNA, 25 bp, Homo sapien
gccaatatggttgaattcccgtctc

SEQ ID NO: 66584 - DNA, 25 bp, Homo sapien
ccaatatggttgaattcccgtctct

SEQ ID NO: 66585 - DNA, 25 bp, Homo sapien
caatatggttgaattcccgtctcta

SEQ ID NO: 66586 - DNA, 25 bp, Homo sapien
aatatggttgaattcccgtctctac

SEQ ID NO: 66587 - DNA, 25 bp, Homo sapien
atatggttgaattcccgtctctact

SEQ ID NO: 66588 - DNA, 25 bp, Homo sapien
tatggttgaattcccgtctctactg

SEQ ID NO: 66589 - DNA, 25 bp, Homo sapien
gatttactactagaaatttggagaa

SEQ ID NO: 66590 - DNA, 25 bp, Homo sapien
gtacttgtgatttgttcatgttata

SEQ ID NO: 66591 - DNA, 25 bp, Homo sapien
aaacttgagatttgtgtatttatgt

SEQ ID NO: 66592 - DNA, 25 bp, Homo sapien
gtatttatgtagagtctgtattgac

SEQ ID NO: 66593 - DNA, 25 bp, Homo sapien
gtctgtattgacaagactgttgttt

SEQ ID NO: 66594 - DNA, 25 bp, Homo sapien
aagactgttgttttttgctccttga

SEQ ID NO: 66595 - DNA, 25 bp, Homo sapien
ctgttgttttttgctccttgagcta

SEQ ID NO: 66596 - DNA, 25 bp, Homo sapien
gctccttgagctatataataatctg

SEQ ID NO: 66597 - DNA, 25 bp, Homo sapien
ctgtgtattggattgttgtcttgat

SEQ ID NO: 66598 - DNA, 25 bp, Homo sapien
gatagatttatattgtaaccttttt

SEQ ID NO: 66599 - DNA, 25 bp, Homo sapien
tgtaacctttttctagttcttgaat

SEQ ID NO: 66600 - DNA, 25 bp, Homo sapien
tgggtttgttatggttaacaagttg

SEQ ID NO: 66601 - DNA, 25 bp, Homo sapien
aacaagttggtgagcattattgaga

SEQ ID NO: 66602 - DNA, 25 bp, Homo sapien
aagttggtgagcattattgagaggt

SEQ ID NO: 66603 - DNA, 25 bp, Homo sapien
gtgagcattattgagaggtgaagcc

SEQ ID NO: 66604 - DNA, 25 bp, Homo sapien
aggtgaagccagctgagcttctggg

SEQ ID NO: 66605 - DNA, 25 bp, Homo sapien
gaagccagctgagcttctgggttgg

SEQ ID NO: 66606 - DNA, 25 bp, Homo sapien
ccagctgagcttctgggttgggtgg

SEQ ID NO: 66607 - DNA, 25 bp, Homo sapien
aaatgcaccaatcaatgctcagtgt

SEQ ID NO: 66608 - DNA, 25 bp, Homo sapien
atcaatgctcagtgtctagctaaag

SEQ ID NO: 66609 - DNA, 25 bp, Homo sapien
gtaaaattgaccaatcagcgttctg

SEQ ID NO: 66610 - DNA, 25 bp, Homo sapien
aaattgaccaatcagcgttctgtaa

SEQ ID NO: 66611 - DNA, 25 bp, Homo sapien
aaagtgtaaaccagcccatgacagg

SEQ ID NO: 66612 - DNA, 25 bp, Homo sapien
aaagaacttcattgttcagttttca

SEQ ID NO: 66613 - DNA, 25 bp, Homo sapien
agactgatgtagatgttctgtgctg

SEQ ID NO: 66614 - DNA, 25 bp, Homo sapien
tgtgctgtcctggaccatgttaatt

SEQ ID NO: 66615 - DNA, 25 bp, Homo sapien
gaccatgttaattacacttacgacg

SEQ ID NO: 66616 - DNA, 25 bp, Homo sapien
tacgacgtattttagttccacatca

SEQ ID NO: 66617 - DNA, 25 bp, Homo sapien
acatcacaatgatttgtccccagtg

SEQ ID NO: 66618 - DNA, 25 bp, Homo sapien
gatttgtccccagtgacccttttat

SEQ ID NO: 66619 - DNA, 25 bp, Homo sapien
atcctttctaggcacatttcttgtt

SEQ ID NO: 66620 - DNA, 25 bp, Homo sapien
tgcagttcccctttgcattgtattg

SEQ ID NO: 66621 - DNA, 25 bp, Homo sapien
gcattgtattgctttgacaactgta

SEQ ID NO: 66622 - DNA, 25 bp, Homo sapien
agtgagcatgcacggacctcttccc

SEQ ID NO: 66623 - DNA, 25 bp, Homo sapien
gagatcggtgctaccaaggaagaga

SEQ ID NO: 66624 - DNA, 25 bp, Homo sapien
gaagagagcacacagataagacaga

SEQ ID NO: 66625 - DNA, 25 bp, Homo sapien
gaggaggtgggcatttcctacattc

SEQ ID NO: 66626 - DNA, 25 bp, Homo sapien
gaggtgggcatttcctacattcctc

SEQ ID NO: 66627 - DNA, 25 bp, Homo sapien
gggcatttcctacattcctccttgt

SEQ ID NO: 66628 - DNA, 25 bp, Homo sapien
tcctccttgtttgccgctgctgaga

SEQ ID NO: 66629 - DNA, 25 bp, Homo sapien
cttgtttgccgctgctgagattgca

SEQ ID NO: 66630 - DNA, 25 bp, Homo sapien
gtttgccgctgctgagattgcagta

SEQ ID NO: 66631 - DNA, 25 bp, Homo sapien
gccgctgctgagattgcagtattta

SEQ ID NO: 66632 - DNA, 25 bp, Homo sapien
gcaatgtaaatgtatcctgaaggtg

SEQ ID NO: 66633 - DNA, 25 bp, Homo sapien
tctactgtgcagtcattttccctga

SEQ ID NO: 66634 - DNA, 25 bp, Homo sapien
gtgcagtcattttccctgaatttct

SEQ ID NO: 66635 - DNA, 25 bp, Homo sapien
atttctcaaggagttggctgccatc

SEQ ID NO: 66636 - DNA, 25 bp, Homo sapien
acctcgcctttcttgttggagactt

SEQ ID NO: 66637 - DNA, 25 bp, Homo sapien
agaggaaggatctggccctctcatc

SEQ ID NO: 66638 - DNA, 25 bp, Homo sapien
tgtgggcccctcaatccttaacttt

SEQ ID NO: 66639 - DNA, 25 bp, Homo sapien
tccttaactttcttccatggacaat

SEQ ID NO: 66640 - DNA, 25 bp, Homo sapien
tttcttccatggacaatcagggcca

SEQ ID NO: 66641 - DNA, 25 bp, Homo sapien
gggctagggcacaggctccttttta

SEQ ID NO: 66642 - DNA, 25 bp, Homo sapien
gcacaggctcctttttatgtttgga

SEQ ID NO: 66643 - DNA, 25 bp, Homo sapien
atgttttatggagaacttgttgcaa

SEQ ID NO: 66644 - DNA, 25 bp, Homo sapien
tttaatgactttcaacactcccatg

SEQ ID NO: 66645 - DNA, 25 bp, Homo sapien
tcaacactcccatgaaaacaccgta

SEQ ID NO: 66646 - DNA, 25 bp, Homo sapien
aaaacaccgtagtctgcttttcctg

SEQ ID NO: 66647 - DNA, 25 bp, Homo sapien
accgtagtctgcttttcctgaaagg

SEQ ID NO: 66648 - DNA, 25 bp, Homo sapien
gcttttcctgaaaggtgactgtcta

SEQ ID NO: 66649 - DNA, 25 bp, Homo sapien
aaggtgactgtctaggatgctgaat

SEQ ID NO: 66650 - DNA, 25 bp, Homo sapien
aggatgctgaatgagccaccactcc

SEQ ID NO: 66651 - DNA, 25 bp, Homo sapien
ccaccactccgtagctttatatatt

SEQ ID NO: 66652 - DNA, 25 bp, Homo sapien
atttccatcatagaatttcagcgtt

SEQ ID NO: 66653 - DNA, 25 bp, Homo sapien
agaatttcagcgttagaagggatct

SEQ ID NO: 66654 - DNA, 25 bp, Homo sapien
ggtagattatccaggccatccccta

SEQ ID NO: 66655 - DNA, 25 bp, Homo sapien
ctacctgagagctgtggacctgatc

SEQ ID NO: 66656 - DNA, 25 bp, Homo sapien
tggacctgatccgtcatggcgggaa

SEQ ID NO: 66657 - DNA, 25 bp, Homo sapien
agaagatgcggttcctggtcgcgaa

SEQ ID NO: 66658 - DNA, 25 bp, Homo sapien
cctggtcgcgaagtccgacgtggaa

SEQ ID NO: 66659 - DNA, 25 bp, Homo sapien
aagtccgacgtggaaacagccaaga

SEQ ID NO: 66660 - DNA, 25 bp, Homo sapien
ggtcccacctggtgacactgggctt

SEQ ID NO: 66661 - DNA, 25 bp, Homo sapien
gtccctgttttgtaactgaccaagt

SEQ ID NO: 66662 - DNA, 25 bp, Homo sapien
tgtaactgaccaagttgggtcccgg

SEQ ID NO: 66663 - DNA, 25 bp, Homo sapien
gggacatgcctgttgataacatgca

SEQ ID NO: 66664 - DNA, 25 bp, Homo sapien
aacatgcatctcagtgtaggttcta

SEQ ID NO: 66665 - DNA, 25 bp, Homo sapien
gtaggttctatttatatggcagatg

SEQ ID NO: 66666 - DNA, 25 bp, Homo sapien
cctaaagcaaggtgtgtattttgtt

SEQ ID NO: 66667 - DNA, 25 bp, Homo sapien
ttgcatctggacaaatactaaatat

SEQ ID NO: 66668 - DNA, 25 bp, Homo sapien
tgcatctggacaaatactaaatatc

SEQ ID NO: 66669 - DNA, 25 bp, Homo sapien
gcatctggacaaatactaaatatcc

SEQ ID NO: 66670 - DNA, 25 bp, Homo sapien
ggacaaatactaaatatcccagtgg

SEQ ID NO: 66671 - DNA, 25 bp, Homo sapien
gacaaatactaaatatcccagtggc

SEQ ID NO: 66672 - DNA, 25 bp, Homo sapien
acaaatactaaatatcccagtggcc

SEQ ID NO: 66673 - DNA, 25 bp, Homo sapien
caaatactaaatatcccagtggcct

SEQ ID NO: 66674 - DNA, 25 bp, Homo sapien
aaatactaaatatcccagtggcctt

SEQ ID NO: 66675 - DNA, 25 bp, Homo sapien
aatactaaatatcccagtggccttt

SEQ ID NO: 66676 - DNA, 25 bp, Homo sapien
tactaaatatcccagtggccttttt

SEQ ID NO: 66677 - DNA, 25 bp, Homo sapien
ttccatgcgttaacttttcccaata

SEQ ID NO: 66678 - DNA, 25 bp, Homo sapien
gcgttaacttttcccaatagcagag

SEQ ID NO: 66679 - DNA, 25 bp, Homo sapien
agaggaggcaaatatgagcatacaa

SEQ ID NO: 66680 - DNA, 25 bp, Homo sapien
atgagcatacaatccctttgttcta

SEQ ID NO: 66681 - DNA, 25 bp, Homo sapien
gcatacaatccctttgttctaaaga

SEQ ID NO: 66682 - DNA, 25 bp, Homo sapien
ctaaagatattgttccagctagtgg

SEQ ID NO: 66683 - DNA, 25 bp, Homo sapien
ccagctagtggaatgatgttgaatc

SEQ ID NO: 66684 - DNA, 25 bp, Homo sapien
accataattagttgctttttcagta

SEQ ID NO: 66685 - DNA, 25 bp, Homo sapien
gttgctttttcagtatcttctgctt

SEQ ID NO: 66686 - DNA, 25 bp, Homo sapien
tttcagtatcttctgctttgtctgt

SEQ ID NO: 66687 - DNA, 25 bp, Homo sapien
ctatccagtggcctaggaattaaag

SEQ ID NO: 66688 - DNA, 25 bp, Homo sapien
aagagtcattccatcacagggactg

SEQ ID NO: 66689 - DNA, 25 bp, Homo sapien
ttccatcacagggactgcatgagac

SEQ ID NO: 66690 - DNA, 25 bp, Homo sapien
gcatgagaccatgtaacctccgaca

SEQ ID NO: 66691 - DNA, 25 bp, Homo sapien
gtaacctccgacatgtatttaaacg

SEQ ID NO: 66692 - DNA, 25 bp, Homo sapien
aaacgtgtatagcttaacctggatt

SEQ ID NO: 66693 - DNA, 25 bp, Homo sapien
gattaaacacgagcaagcgcgcggg

SEQ ID NO: 66694 - DNA, 25 bp, Homo sapien
tgccgttggcttctagtgctagtaa

SEQ ID NO: 66695 - DNA, 25 bp, Homo sapien
tctagtgctagtaatcattggatgc

SEQ ID NO: 66696 - DNA, 25 bp, Homo sapien
ggaaggcagccgctttcaccgctca

SEQ ID NO: 66697 - DNA, 25 bp, Homo sapien
tcaccgctcattatgtagtctggct

SEQ ID NO: 66698 - DNA, 25 bp, Homo sapien
tggctacagccctcaaaaacagctt

SEQ ID NO: 66699 - DNA, 25 bp, Homo sapien
ccactaatagctttttgatgacttc

SEQ ID NO: 66700 - DNA, 25 bp, Homo sapien
tagctttttgatgacttctagcaag

SEQ ID NO: 66701 - DNA, 25 bp, Homo sapien
tttgatgacttctagcaagcctcgc

SEQ ID NO: 66702 - DNA, 25 bp, Homo sapien
ttgatgacttctagcaagcctcgct

SEQ ID NO: 66703 - DNA, 25 bp, Homo sapien
gatgacttctagcaagcctcgctaa

SEQ ID NO: 66704 - DNA, 25 bp, Homo sapien
tgacttctagcaagcctcgctaacc

SEQ ID NO: 66705 - DNA, 25 bp, Homo sapien
ttaacctactgggagaactctctgt

SEQ ID NO: 66706 - DNA, 25 bp, Homo sapien
acctactgggagaactctctgtgct

SEQ ID NO: 66707 - DNA, 25 bp, Homo sapien
tactgggagaactctctgtgctagt

SEQ ID NO: 66708 - DNA, 25 bp, Homo sapien
gggagaactctctgtgctagtaacc

SEQ ID NO: 66709 - DNA, 25 bp, Homo sapien
ggagaactctctgtgctagtaacca

SEQ ID NO: 66710 - DNA, 25 bp, Homo sapien
gtgaagatggacgactgagcccctt

SEQ ID NO: 66711 - DNA, 25 bp, Homo sapien
tgaagatggacgactgagccccttt

SEQ ID NO: 66712 - DNA, 25 bp, Homo sapien
gaagatggacgactgagcccctttg

SEQ ID NO: 66713 - DNA, 25 bp, Homo sapien
tccatgctgaggatcgccacatggc

SEQ ID NO: 66714 - DNA, 25 bp, Homo sapien
catgctgaggatcgccacatggctg

SEQ ID NO: 66715 - DNA, 25 bp, Homo sapien
gctgaggatcgccacatggctgcaa

SEQ ID NO: 66716 - DNA, 25 bp, Homo sapien
ctgaggatcgccacatggctgcaaa

SEQ ID NO: 66717 - DNA, 25 bp, Homo sapien
tgaggatcgccacatggctgcaaag

SEQ ID NO: 66718 - DNA, 25 bp, Homo sapien
ggacccaatcccagagcagaggtct

SEQ ID NO: 66719 - DNA, 25 bp, Homo sapien
acccaatcccagagcagaggtctga

SEQ ID NO: 66720 - DNA, 25 bp, Homo sapien
ttaactgctttgtcaaaattaaaca

SEQ ID NO: 66721 - DNA, 25 bp, Homo sapien
tgaagtcacttttgagccctcatca

SEQ ID NO: 66722 - DNA, 25 bp, Homo sapien
agtcacttttgagccctcatcaagc

SEQ ID NO: 66723 - DNA, 25 bp, Homo sapien
caagctctcattgtgatgggaggga

SEQ ID NO: 66724 - DNA, 25 bp, Homo sapien
gatgggagggatacctttttgttgt

SEQ ID NO: 66725 - DNA, 25 bp, Homo sapien
tggaaaacaaccttaaatgtggatg

SEQ ID NO: 66726 - DNA, 25 bp, Homo sapien
taaatgtggatgtatcagatttggt

SEQ ID NO: 66727 - DNA, 25 bp, Homo sapien
ttggtttatccagccatgggagaga

SEQ ID NO: 66728 - DNA, 25 bp, Homo sapien
ggatagtatatttgctgtaaactac

SEQ ID NO: 66729 - DNA, 25 bp, Homo sapien
gtaaactacaatgtaaaacctcaat

SEQ ID NO: 66730 - DNA, 25 bp, Homo sapien
ctcaataaaagtgcgctgtacttct

SEQ ID NO: 66731 - DNA, 25 bp, Homo sapien
gtgcgctgtacttcttaatgtttat

SEQ ID NO: 66732 - DNA, 25 bp, Homo sapien
gtaatgcctttgtacagctcatact

SEQ ID NO: 66733 - DNA, 25 bp, Homo sapien
tgcctttgtacagctcatactttcc

SEQ ID NO: 66734 - DNA, 25 bp, Homo sapien
ctttcctgctgacatatctgatcat

SEQ ID NO: 66735 - DNA, 25 bp, Homo sapien
tatctgatcatctctttcatgcagt

SEQ ID NO: 66736 - DNA, 25 bp, Homo sapien
catgcagttgccaatattcataact

SEQ ID NO: 66737 - DNA, 25 bp, Homo sapien
ggaaacttgcctctgttttttgcaa

SEQ ID NO: 66738 - DNA, 25 bp, Homo sapien
aacttgcctctgttttttgcaaggg

SEQ ID NO: 66739 - DNA, 25 bp, Homo sapien
gagtgtttagtaattacctatctta

SEQ ID NO: 66740 - DNA, 25 bp, Homo sapien
acctatcttaaatctttctgagttg

SEQ ID NO: 66741 - DNA, 25 bp, Homo sapien
ctttctgagttggtagtagattcat

SEQ ID NO: 66742 - DNA, 25 bp, Homo sapien
ggtagtagattcatgttcaaggaac

SEQ ID NO: 66743 - DNA, 25 bp, Homo sapien
gctccacagagagaaattcctggaa

SEQ ID NO: 66744 - DNA, 25 bp, Homo sapien
ttcctggaatctggaccccatggcc

SEQ ID NO: 66745 - DNA, 25 bp, Homo sapien
ccatggcccagtcaggttacacaaa

SEQ ID NO: 66746 - DNA, 25 bp, Homo sapien
tggcccagtcaggttacacaaaact

SEQ ID NO: 66747 - DNA, 25 bp, Homo sapien
aaactgatcatcacagatctgtaga

SEQ ID NO: 66748 - DNA, 25 bp, Homo sapien
tacaaaagtgctaacattcatgatt

SEQ ID NO: 66749 - DNA, 25 bp, Homo sapien
taacattcatgattagggtctcaga

SEQ ID NO: 66750 - DNA, 25 bp, Homo sapien
tcatgattagggtctcagaaggtaa

SEQ ID NO: 66751 - DNA, 25 bp, Homo sapien
tgggacaattgctttagaccttgca

SEQ ID NO: 66752 - DNA, 25 bp, Homo sapien
gctttagaccttgcaactggcctga

SEQ ID NO: 66753 - DNA, 25 bp, Homo sapien
acacagggagactcagtttctccaa

SEQ ID NO: 66754 - DNA, 25 bp, Homo sapien
gagtatatcagaacacacccttcca

SEQ ID NO: 66755 - DNA, 25 bp, Homo sapien
cccttccaaggtatgtatgctctgt

SEQ ID NO: 66756 - DNA, 25 bp, Homo sapien
tgtcttcactgagcgcagggctgga

SEQ ID NO: 66757 - DNA, 25 bp, Homo sapien
agggctggaggcctcttagacattc

SEQ ID NO: 66758 - DNA, 25 bp, Homo sapien
ttagacattctccttggtcctcgtt

SEQ ID NO: 66759 - DNA, 25 bp, Homo sapien
tgtagtatccacagtgcccgagttc

SEQ ID NO: 66760 - DNA, 25 bp, Homo sapien
gagttctcgctggttttggcaatta

SEQ ID NO: 66761 - DNA, 25 bp, Homo sapien
ctccttcctactggtttagactaca

SEQ ID NO: 66762 - DNA, 25 bp, Homo sapien
aaatgcccctcgtgtgaccatagat

SEQ ID NO: 66763 - DNA, 25 bp, Homo sapien
gattgagatttataccacataccac

SEQ ID NO: 66764 - DNA, 25 bp, Homo sapien
acataccacacatagccacagaaac

SEQ ID NO: 66765 - DNA, 25 bp, Homo sapien
acagcaggtgctgccatactcttgt

SEQ ID NO: 66766 - DNA, 25 bp, Homo sapien
agcaggtgctgccatactcttgtgg

SEQ ID NO: 66767 - DNA, 25 bp, Homo sapien
acccgtctgccaagcatgggtatga

SEQ ID NO: 66768 - DNA, 25 bp, Homo sapien
ccgtctgccaagcatgggtatgaat

SEQ ID NO: 66769 - DNA, 25 bp, Homo sapien
tctgccaagcatgggtatgaatcgt

SEQ ID NO: 66770 - DNA, 25 bp, Homo sapien
aagcatgggtatgaatcgtgcacac

SEQ ID NO: 66771 - DNA, 25 bp, Homo sapien
atgggtatgaatcgtgcacacagcc

SEQ ID NO: 66772 - DNA, 25 bp, Homo sapien
gggtatgaatcgtgcacacagccat

SEQ ID NO: 66773 - DNA, 25 bp, Homo sapien
gtatgaatcgtgcacacagccatgc

SEQ ID NO: 66774 - DNA, 25 bp, Homo sapien
atgaatcgtgcacacagccatgctt

SEQ ID NO: 66775 - DNA, 25 bp, Homo sapien
tgaatcgtgcacacagccatgcttc

SEQ ID NO: 66776 - DNA, 25 bp, Homo sapien
agggtgctgtgtctccccttgcctg

SEQ ID NO: 66777 - DNA, 25 bp, Homo sapien
ggtgctgtgtctccccttgcctgtg

SEQ ID NO: 66778 - DNA, 25 bp, Homo sapien
tgcctgtgcccaggtcatcccaaac

SEQ ID NO: 66779 - DNA, 25 bp, Homo sapien
aggtcatcccaaacccttctgttat

SEQ ID NO: 66780 - DNA, 25 bp, Homo sapien
ggtcatcccaaacccttctgttatt

SEQ ID NO: 66781 - DNA, 25 bp, Homo sapien
cttctgttatttattagggctgtgg

SEQ ID NO: 66782 - DNA, 25 bp, Homo sapien
ctgttatttattagggctgtgggaa

SEQ ID NO: 66783 - DNA, 25 bp, Homo sapien
tctttttcttggaacctgcccctgt

SEQ ID NO: 66784 - DNA, 25 bp, Homo sapien
ctcaccccgggcaggcaaaggcagt

SEQ ID NO: 66785 - DNA, 25 bp, Homo sapien
tcaccccgggcaggcaaaggcagtg

SEQ ID NO: 66786 - DNA, 25 bp, Homo sapien
cgggcaggcaaaggcagtgggtaga

SEQ ID NO: 66787 - DNA, 25 bp, Homo sapien
tactcagccttgttttcggtgtgta

SEQ ID NO: 66788 - DNA, 25 bp, Homo sapien
gttttcggtgtgtaggccccagctg

SEQ ID NO: 66789 - DNA, 25 bp, Homo sapien
tgcccactggaactgccggctaatg

SEQ ID NO: 66790 - DNA, 25 bp, Homo sapien
ggaactgccggctaatgcttgctct

SEQ ID NO: 66791 - DNA, 25 bp, Homo sapien
aatgcttgctctcccaagatcttta

SEQ ID NO: 66792 - DNA, 25 bp, Homo sapien
aagatctttaactcctcctggctgc

SEQ ID NO: 66793 - DNA, 25 bp, Homo sapien
agggatggtggcatcgatgcccctc

SEQ ID NO: 66794 - DNA, 25 bp, Homo sapien
tctgctgaaggacctgttgctgctt

SEQ ID NO: 66795 - DNA, 25 bp, Homo sapien
cttggctgatgacccagagccctct

SEQ ID NO: 66796 - DNA, 25 bp, Homo sapien
gatgatggcattctcctggcaagag

SEQ ID NO: 66797 - DNA, 25 bp, Homo sapien
gacttaactagacttctgaacttga

SEQ ID NO: 66798 - DNA, 25 bp, Homo sapien
gtcttctaaaaagccacgacatgaa

SEQ ID NO: 66799 - DNA, 25 bp, Homo sapien
gaaaatgacaatccctttcgtctcc

SEQ ID NO: 66800 - DNA, 25 bp, Homo sapien
tgcctccgcctttgtttcatagtga

SEQ ID NO: 66801 - DNA, 25 bp, Homo sapien
tccctctaaatacctaccctagatg

SEQ ID NO: 66802 - DNA, 25 bp, Homo sapien
taccctagatgatttcatcctgccc

SEQ ID NO: 66803 - DNA, 25 bp, Homo sapien
ttcttaacatattcctgtgtctttg

SEQ ID NO: 66804 - DNA, 25 bp, Homo sapien
tcctgtgtctttgtaatggccaaat

SEQ ID NO: 66805 - DNA, 25 bp, Homo sapien
gtaatggccaaatttctccttccac

SEQ ID NO: 66806 - DNA, 25 bp, Homo sapien
gcacggtacgtcttcatgggagtca

SEQ ID NO: 66807 - DNA, 25 bp, Homo sapien
attttattccttacagcttccttgt

SEQ ID NO: 66808 - DNA, 25 bp, Homo sapien
agcttccttgtaaccacagccctaa

SEQ ID NO: 66809 - DNA, 25 bp, Homo sapien
gagaatgaccaaatctcctttcttg

SEQ ID NO: 66810 - DNA, 25 bp, Homo sapien
aaatctcctttcttgccataattaa

SEQ ID NO: 66811 - DNA, 25 bp, Homo sapien
gtaattatgtagaaacgcactgctt

SEQ ID NO: 66812 - DNA, 25 bp, Homo sapien
atgtagaaacgcactgcttggtcag

SEQ ID NO: 66813 - DNA, 25 bp, Homo sapien
aggcttcctgcctagctatatatta

SEQ ID NO: 66814 - DNA, 25 bp, Homo sapien
gcctagctatatattacgttgtctt

SEQ ID NO: 66815 - DNA, 25 bp, Homo sapien
aaatgtacttctttaatcttgtgat

SEQ ID NO: 66816 - DNA, 25 bp, Homo sapien
ttaatcttgtgattacagtaactgc

SEQ ID NO: 66817 - DNA, 25 bp, Homo sapien
gcaagtgtgtttttacatctgcatt

SEQ ID NO: 66818 - DNA, 25 bp, Homo sapien
gtgtgtttttacatctgcattttta

SEQ ID NO: 66819 - DNA, 25 bp, Homo sapien
cattttactgtaattctgttgtgtg

SEQ ID NO: 66820 - DNA, 25 bp, Homo sapien
catccattacgatgccagcttccag

SEQ ID NO: 66821 - DNA, 25 bp, Homo sapien
attacgatgccagcttccagccttg

SEQ ID NO: 66822 - DNA, 25 bp, Homo sapien
gcccaggtcagagctgtggcagagg

SEQ ID NO: 66823 - DNA, 25 bp, Homo sapien
gaaggccaggcctgacagatgtttg

SEQ ID NO: 66824 - DNA, 25 bp, Homo sapien
ccaggcctgacagatgtttgggaga

SEQ ID NO: 66825 - DNA, 25 bp, Homo sapien
cctgacagatgtttgggagaggaat

SEQ ID NO: 66826 - DNA, 25 bp, Homo sapien
cctccccgagttctaagtcaggatg

SEQ ID NO: 66827 - DNA, 25 bp, Homo sapien
ccccgagttctaagtcaggatgagg

SEQ ID NO: 66828 - DNA, 25 bp, Homo sapien
ccgagttctaagtcaggatgaggcc

SEQ ID NO: 66829 - DNA, 25 bp, Homo sapien
cacctgtccaaggtatcggaaccta

SEQ ID NO: 66830 - DNA, 25 bp, Homo sapien
tccaaggtatcggaacctacccagg

SEQ ID NO: 66831 - DNA, 25 bp, Homo sapien
gatgcctgaggagtgcgagctccac

SEQ ID NO: 66832 - DNA, 25 bp, Homo sapien
tgcgagctccacagcaacatggcag

SEQ ID NO: 66833 - DNA, 25 bp, Homo sapien
gaaggtgtcaggaggttccacactc

SEQ ID NO: 66834 - DNA, 25 bp, Homo sapien
aggaggttccacactcgccagttca

SEQ ID NO: 66835 - DNA, 25 bp, Homo sapien
agttcactggagcagagtcccttcg

SEQ ID NO: 66836 - DNA, 25 bp, Homo sapien
ttcgccacacttagggtcccagtaa

SEQ ID NO: 66837 - DNA, 25 bp, Homo sapien
cacttagggtcccagtaagccatgc

SEQ ID NO: 66838 - DNA, 25 bp, Homo sapien
taagccatgccagcattaccttttg

SEQ ID NO: 66839 - DNA, 25 bp, Homo sapien
atgccagcattaccttttgcgtaaa

SEQ ID NO: 66840 - DNA, 25 bp, Homo sapien
accttttgcgtaaacagacgtgtat

SEQ ID NO: 66841 - DNA, 25 bp, Homo sapien
gtaaagaattgagccacattgaaca

SEQ ID NO: 66842 - DNA, 25 bp, Homo sapien
ggacagaacagtgaataggcaggac

SEQ ID NO: 66843 - DNA, 25 bp, Homo sapien
gacagaacagtgaataggcaggact

SEQ ID NO: 66844 - DNA, 25 bp, Homo sapien
gtgaataggcaggactctgatgaac

SEQ ID NO: 66845 - DNA, 25 bp, Homo sapien
aggtgacgtacgcacagttggatca

SEQ ID NO: 66846 - DNA, 25 bp, Homo sapien
gtgacgtacgcacagttggatcact

SEQ ID NO: 66847 - DNA, 25 bp, Homo sapien
gacgtacgcacagttggatcactgc

SEQ ID NO: 66848 - DNA, 25 bp, Homo sapien
gtacgcacagttggatcactgcgtt

SEQ ID NO: 66849 - DNA, 25 bp, Homo sapien
ccctaacagataccagcgtgtacac

SEQ ID NO: 66850 - DNA, 25 bp, Homo sapien
cctaacagataccagcgtgtacacg

SEQ ID NO: 66851 - DNA, 25 bp, Homo sapien
ctaacagataccagcgtgtacacgg

SEQ ID NO: 66852 - DNA, 25 bp, Homo sapien
accagcgtgtacacggaacttccaa

SEQ ID NO: 66853 - DNA, 25 bp, Homo sapien
caacgaagtcggctccatgaagata

SEQ ID NO: 66854 - DNA, 25 bp, Homo sapien
gggcctgggtttgctaccaatatcc

SEQ ID NO: 66855 - DNA, 25 bp, Homo sapien
aatatcctggatatcgtgggtatca

SEQ ID NO: 66856 - DNA, 25 bp, Homo sapien
cgtgggtatcagtatatcttggaat

SEQ ID NO: 66857 - DNA, 25 bp, Homo sapien
tcatgcccagacttcgcagatccaa

SEQ ID NO: 66858 - DNA, 25 bp, Homo sapien
ttcgcagatccaatcgattcgccga

SEQ ID NO: 66859 - DNA, 25 bp, Homo sapien
gattcgccgaatccaacagtagctg

SEQ ID NO: 66860 - DNA, 25 bp, Homo sapien
agctccaagtacgataattcctcaa

SEQ ID NO: 66861 - DNA, 25 bp, Homo sapien
aattcctcaagcatgagaccttgct

SEQ ID NO: 66862 - DNA, 25 bp, Homo sapien
gagaccttgctaagcactctagaaa

SEQ ID NO: 66863 - DNA, 25 bp, Homo sapien
cattgctttcaaatgttagctggtg

SEQ ID NO: 66864 - DNA, 25 bp, Homo sapien
tttatttcttaaacggctgagtgat

SEQ ID NO: 66865 - DNA, 25 bp, Homo sapien
tcttaaacggctgagtgataatcca

SEQ ID NO: 66866 - DNA, 25 bp, Homo sapien
tgagtgataatccagctagtgtgca

SEQ ID NO: 66867 - DNA, 25 bp, Homo sapien
agtgtgcagtcatttcatacctttc

SEQ ID NO: 66868 - DNA, 25 bp, Homo sapien
atgctgagggccgacacaattcacg

SEQ ID NO: 66869 - DNA, 25 bp, Homo sapien
gagggccgacacaattcacggaaca

SEQ ID NO: 66870 - DNA, 25 bp, Homo sapien
aattcacggaacagattcatcatat

SEQ ID NO: 66871 - DNA, 25 bp, Homo sapien
cagattcatcatatttggtctttat

SEQ ID NO: 66872 - DNA, 25 bp, Homo sapien
tgcggtcacacacacggtctcagtc

SEQ ID NO: 66873 - DNA, 25 bp, Homo sapien
acggtctcagtcacgtgatggtttt

SEQ ID NO: 66874 - DNA, 25 bp, Homo sapien
agtcacgtgatggttttgcttttat

SEQ ID NO: 66875 - DNA, 25 bp, Homo sapien
tccaagtgattctgttcttctccat

SEQ ID NO: 66876 - DNA, 25 bp, Homo sapien
gtaactgacagctgacaccatatga

SEQ ID NO: 66877 - DNA, 25 bp, Homo sapien
acaccatatgagaacctttgtataa

SEQ ID NO: 66878 - DNA, 25 bp, Homo sapien
ggcatgtaaacagcacagacaccgt

SEQ ID NO: 66879 - DNA, 25 bp, Homo sapien
aacagcacagacaccgtaacacact

SEQ ID NO: 66880 - DNA, 25 bp, Homo sapien
gtaacacactctgtgccctgtttgg

SEQ ID NO: 66881 - DNA, 25 bp, Homo sapien
gtgccctgtttggttgttgacaatg

SEQ ID NO: 66882 - DNA, 25 bp, Homo sapien
gaagcaccattatgtgactcttcat

SEQ ID NO: 66883 - DNA, 25 bp, Homo sapien
tgtgactcttcatataacccttttt

SEQ ID NO: 66884 - DNA, 25 bp, Homo sapien
ataacccttttttctacggcagcat

SEQ ID NO: 66885 - DNA, 25 bp, Homo sapien
ttctacggcagcattaaaattgtct

SEQ ID NO: 66886 - DNA, 25 bp, Homo sapien
acttctttctttatactaattctca

SEQ ID NO: 66887 - DNA, 25 bp, Homo sapien
atgtattcatacagttattctcaat

SEQ ID NO: 66888 - DNA, 25 bp, Homo sapien
tcatacagttattctcaatttttaa

SEQ ID NO: 66889 - DNA, 25 bp, Homo sapien
gtaatcattgaatgtttcctacata

SEQ ID NO: 66890 - DNA, 25 bp, Homo sapien
cattgaatgtttcctacatacgtag

SEQ ID NO: 66891 - DNA, 25 bp, Homo sapien
gaatgtttcctacatacgtagtggg

SEQ ID NO: 66892 - DNA, 25 bp, Homo sapien
tgtttcctacatacgtagtgggttt

SEQ ID NO: 66893 - DNA, 25 bp, Homo sapien
atacgtagtgggttttatttgctca

SEQ ID NO: 66894 - DNA, 25 bp, Homo sapien
cgtagtgggttttatttgctcacag

SEQ ID NO: 66895 - DNA, 25 bp, Homo sapien
ttgctcacagcatacagttattttt

SEQ ID NO: 66896 - DNA, 25 bp, Homo sapien
tgctcacagcatacagttatttttc

SEQ ID NO: 66897 - DNA, 25 bp, Homo sapien
agacaattcctcctgtcagttgcgt

SEQ ID NO: 66898 - DNA, 25 bp, Homo sapien
aattcctcctgtcagttgcgtgaat

SEQ ID NO: 66899 - DNA, 25 bp, Homo sapien
cctcctgtcagttgcgtgaattttt

SEQ ID NO: 66900 - DNA, 25 bp, Homo sapien
gaaacaacccagtgaagagttctac

SEQ ID NO: 66901 - DNA, 25 bp, Homo sapien
aacccagtgaagagttctaccatag

SEQ ID NO: 66902 - DNA, 25 bp, Homo sapien
tctaccatagcaaggcctaatgtta

SEQ ID NO: 66903 - DNA, 25 bp, Homo sapien
aggcctaatgttagctttagcttta

SEQ ID NO: 66904 - DNA, 25 bp, Homo sapien
taacagtttgtgaacttacttccct

SEQ ID NO: 66905 - DNA, 25 bp, Homo sapien
gaacttacttccctatatttgcagc

SEQ ID NO: 66906 - DNA, 25 bp, Homo sapien
acttacttccctatatttgcagctg

SEQ ID NO: 66907 - DNA, 25 bp, Homo sapien
acttccctatatttgcagctgtatc

SEQ ID NO: 66908 - DNA, 25 bp, Homo sapien
catctgcagatattggtatcggagg

SEQ ID NO: 66909 - DNA, 25 bp, Homo sapien
atctgcagatattggtatcggaggg

SEQ ID NO: 66910 - DNA, 25 bp, Homo sapien
tctgcagatattggtatcggagggc

SEQ ID NO: 66911 - DNA, 25 bp, Homo sapien
ctgcagatattggtatcggagggcg

SEQ ID NO: 66912 - DNA, 25 bp, Homo sapien
tgcagatattggtatcggagggcgg

SEQ ID NO: 66913 - DNA, 25 bp, Homo sapien
gcagatattggtatcggagggcggt

SEQ ID NO: 66914 - DNA, 25 bp, Homo sapien
cagatattggtatcggagggcggtc

SEQ ID NO: 66915 - DNA, 25 bp, Homo sapien
agatattggtatcggagggcggtcc

SEQ ID NO: 66916 - DNA, 25 bp, Homo sapien
gatattggtatcggagggcggtcct

SEQ ID NO: 66917 - DNA, 25 bp, Homo sapien
tctttgctggtatatttgaagagct

SEQ ID NO: 66918 - DNA, 25 bp, Homo sapien
aagagcttgggatggatttgactaa

SEQ ID NO: 66919 - DNA, 25 bp, Homo sapien
gatggatttgactaaatctgccccg

SEQ ID NO: 66920 - DNA, 25 bp, Homo sapien
ggtgaacaaggtgatctcagagatc

SEQ ID NO: 66921 - DNA, 25 bp, Homo sapien
tgctcttggagttccttctcctaaa

SEQ ID NO: 66922 - DNA, 25 bp, Homo sapien
gagttccttctcctaaagctaaggc

SEQ ID NO: 66923 - DNA, 25 bp, Homo sapien
taaagctaaggccagcctccatcac

SEQ ID NO: 66924 - DNA, 25 bp, Homo sapien
agcctccatcacaaatgcccataaa

SEQ ID NO: 66925 - DNA, 25 bp, Homo sapien
gcccataaaatctggctcgtctttg

SEQ ID NO: 66926 - DNA, 25 bp, Homo sapien
aaatctggctcgtctttgatgaaca

SEQ ID NO: 66927 - DNA, 25 bp, Homo sapien
ctggctcgtctttgatgaacaataa

SEQ ID NO: 66928 - DNA, 25 bp, Homo sapien
agccgttgtgcgaagacagagtcct

SEQ ID NO: 66929 - DNA, 25 bp, Homo sapien
agcctaggcctgcagcgccatttta

SEQ ID NO: 66930 - DNA, 25 bp, Homo sapien
aacagacccacattggaacagtgaa

SEQ ID NO: 66931 - DNA, 25 bp, Homo sapien
aatcagtcccatagagagggcccgt

SEQ ID NO: 66932 - DNA, 25 bp, Homo sapien
tagagagggcccgtggaccatcgct

SEQ ID NO: 66933 - DNA, 25 bp, Homo sapien
gtggaccatcgctgtcatgagtgat

SEQ ID NO: 66934 - DNA, 25 bp, Homo sapien
tgtcatgagtgatgccctggccctt

SEQ ID NO: 66935 - DNA, 25 bp, Homo sapien
gaaaccagccaacctaattacctgt

SEQ ID NO: 66936 - DNA, 25 bp, Homo sapien
attacctgtattgtggaaatgcgca

SEQ ID NO: 66937 - DNA, 25 bp, Homo sapien
gtggaaatgcgcatgagtccccaac

SEQ ID NO: 66938 - DNA, 25 bp, Homo sapien
caaccccttgtttctatacattcta

SEQ ID NO: 66939 - DNA, 25 bp, Homo sapien
atgtcaaagctgcatgtgtaggatg

SEQ ID NO: 66940 - DNA, 25 bp, Homo sapien
tgtgtaggatgtatgctgtttgtac

SEQ ID NO: 66941 - DNA, 25 bp, Homo sapien
ccccaaaggcatgcagtcatgagaa

SEQ ID NO: 66942 - DNA, 25 bp, Homo sapien
catgcagtcatgagaattacagaaa

SEQ ID NO: 66943 - DNA, 25 bp, Homo sapien
ctaagaggattcaacacctttgttt

SEQ ID NO: 66944 - DNA, 25 bp, Homo sapien
gatttgtaaatctttgtgaacattc

SEQ ID NO: 66945 - DNA, 25 bp, Homo sapien
gaacattctgtactggttcccaaga

SEQ ID NO: 66946 - DNA, 25 bp, Homo sapien
actggttcccaagagctattcattc

SEQ ID NO: 66947 - DNA, 25 bp, Homo sapien
aagagctattcattccctgctacct

SEQ ID NO: 66948 - DNA, 25 bp, Homo sapien
attcattccctgctacctgatttca

SEQ ID NO: 66949 - DNA, 25 bp, Homo sapien
cctgctacctgatttcagcacaata

SEQ ID NO: 66950 - DNA, 25 bp, Homo sapien
tggatcttagagatgcagtgacatc

SEQ ID NO: 66951 - DNA, 25 bp, Homo sapien
tgtaaaagtgtctcagttgctgtgt

SEQ ID NO: 66952 - DNA, 25 bp, Homo sapien
ctcagttgctgtgtttagagaacat

SEQ ID NO: 66953 - DNA, 25 bp, Homo sapien
gaacatcaaagataaaccctggcat

SEQ ID NO: 66954 - DNA, 25 bp, Homo sapien
aaaccctggcatatttgtgctagtg

SEQ ID NO: 66955 - DNA, 25 bp, Homo sapien
catatttgtgctagtgatgccataa

SEQ ID NO: 66956 - DNA, 25 bp, Homo sapien
gcttgcaagaaggtgtagactggct

SEQ ID NO: 66957 - DNA, 25 bp, Homo sapien
aaggtgtagactggcttcaagatca

SEQ ID NO: 66958 - DNA, 25 bp, Homo sapien
ggcttcaagatcagatccagactgt

SEQ ID NO: 66959 - DNA, 25 bp, Homo sapien
gataatagttggaaacctcagcaat

SEQ ID NO: 66960 - DNA, 25 bp, Homo sapien
aacctcagcaattttcaattcaagg

SEQ ID NO: 66961 - DNA, 25 bp, Homo sapien
ctgctggttttagttggtccctatg

SEQ ID NO: 66962 - DNA, 25 bp, Homo sapien
ctggttttagttggtccctatgttg

SEQ ID NO: 66963 - DNA, 25 bp, Homo sapien
tagttggtccctatgttggaagtaa

SEQ ID NO: 66964 - DNA, 25 bp, Homo sapien
ttggttgtgtttgctcacgttctgc

SEQ ID NO: 66965 - DNA, 25 bp, Homo sapien
gtgtttgctcacgttctgcttggaa

SEQ ID NO: 66966 - DNA, 25 bp, Homo sapien
tgctcacgttctgcttggaagtggg

SEQ ID NO: 66967 - DNA, 25 bp, Homo sapien
tgcgtccacgtgtctgcgacctgtg

SEQ ID NO: 66968 - DNA, 25 bp, Homo sapien
tgtctgcgacctgtgtggagtgtca

SEQ ID NO: 66969 - DNA, 25 bp, Homo sapien
tgcgacctgtgtggagtgtcaccgc

SEQ ID NO: 66970 - DNA, 25 bp, Homo sapien
tgtggagtgtcaccgcgtgtacata

SEQ ID NO: 66971 - DNA, 25 bp, Homo sapien
gtgtcaccgcgtgtacatactgtaa

SEQ ID NO: 66972 - DNA, 25 bp, Homo sapien
gggcatgagaataaatacctcccca

SEQ ID NO: 66973 - DNA, 25 bp, Homo sapien
taaatacctccccaaattcaatctg

SEQ ID NO: 66974 - DNA, 25 bp, Homo sapien
aattcaatctgagcccagcaggaga

SEQ ID NO: 66975 - DNA, 25 bp, Homo sapien
aggatggtagggttgccagggctca

SEQ ID NO: 66976 - DNA, 25 bp, Homo sapien
gttgccagggctcagaagtgcaagc

SEQ ID NO: 66977 - DNA, 25 bp, Homo sapien
agtgcaagctgattactcaccccac

SEQ ID NO: 66978 - DNA, 25 bp, Homo sapien
tcctttgtttccttgggtgaatgca

SEQ ID NO: 66979 - DNA, 25 bp, Homo sapien
cttcccacctggacagtggtgtgtg

SEQ ID NO: 66980 - DNA, 25 bp, Homo sapien
tgtgtgtagaaagccagctggatgt

SEQ ID NO: 66981 - DNA, 25 bp, Homo sapien
agaaagccagctggatgtttgtggt

SEQ ID NO: 66982 - DNA, 25 bp, Homo sapien
gggcctcatggtgcctaggaggaga

SEQ ID NO: 66983 - DNA, 25 bp, Homo sapien
agcaggaggccgtgggtgccattcg

SEQ ID NO: 66984 - DNA, 25 bp, Homo sapien
gggacaccgtgccggcttcagacac

SEQ ID NO: 66985 - DNA, 25 bp, Homo sapien
caggactggagctttctctggccaa

SEQ ID NO: 66986 - DNA, 25 bp, Homo sapien
ggagctttctctggccaagtttcag

SEQ ID NO: 66987 - DNA, 25 bp, Homo sapien
aagtttcaggccaatgatccccgca

SEQ ID NO: 66988 - DNA, 25 bp, Homo sapien
tcttggtgcctggacttgagtctca

SEQ ID NO: 66989 - DNA, 25 bp, Homo sapien
tggacttgagtctcaccctacagat

SEQ ID NO: 66990 - DNA, 25 bp, Homo sapien
tcaccctacagatgagaggtggctg

SEQ ID NO: 66991 - DNA, 25 bp, Homo sapien
ggctgaggcaccagggctaagcaat

SEQ ID NO: 66992 - DNA, 25 bp, Homo sapien
ccagggctaagcaattaaaccagtt

SEQ ID NO: 66993 - DNA, 25 bp, Homo sapien
gcaattaaaccagttaagtctccca

SEQ ID NO: 66994 - DNA, 25 bp, Homo sapien
ctggcaccccgggatgtgatgtaag

SEQ ID NO: 66995 - DNA, 25 bp, Homo sapien
atgtgatgtaagaacgccctgcgcg

SEQ ID NO: 66996 - DNA, 25 bp, Homo sapien
gtaagaacgccctgcgcgtcagcct

SEQ ID NO: 66997 - DNA, 25 bp, Homo sapien
gcgtcagcctggaacgggcttgatt

SEQ ID NO: 66998 - DNA, 25 bp, Homo sapien
gaacgggcttgattgctgcccttaa

SEQ ID NO: 66999 - DNA, 25 bp, Homo sapien
ttgattgctgcccttaactgtgttc

SEQ ID NO: 67000 - DNA, 25 bp, Homo sapien
gctgcccttaactgtgttctgaagt

SEQ ID NO: 67001 - DNA, 25 bp, Homo sapien
gaagtttcacagcttggcttcagcc

SEQ ID NO: 67002 - DNA, 25 bp, Homo sapien
tcacagcttggcttcagcctatcag

SEQ ID NO: 67003 - DNA, 25 bp, Homo sapien
ttcagcctatcagcgcatacattgg

SEQ ID NO: 67004 - DNA, 25 bp, Homo sapien
tcagcgcatacattggcatgaattt

SEQ ID NO: 67005 - DNA, 25 bp, Homo sapien
aatgtcaataaatgccccaactgct

SEQ ID NO: 67006 - DNA, 25 bp, Homo sapien
ggaggtgcgtccttgttttccagga

SEQ ID NO: 67007 - DNA, 25 bp, Homo sapien
atgttcttagaacttggactactga

SEQ ID NO: 67008 - DNA, 25 bp, Homo sapien
attaattgactgtgccttgggaaac

SEQ ID NO: 67009 - DNA, 25 bp, Homo sapien
tgggaagtaacttggtgcagcactg

SEQ ID NO: 67010 - DNA, 25 bp, Homo sapien
ggactggttcaattcgtttaactcg

SEQ ID NO: 67011 - DNA, 25 bp, Homo sapien
gtttaactcgaattcttgctcctgg

SEQ ID NO: 67012 - DNA, 25 bp, Homo sapien
cctggccgtggttaagctgtgtaca

SEQ ID NO: 67013 - DNA, 25 bp, Homo sapien
gagagtttggcctcaagtttttata

SEQ ID NO: 67014 - DNA, 25 bp, Homo sapien
gagactagtgttcaggatctcctcc

SEQ ID NO: 67015 - DNA, 25 bp, Homo sapien
gatctcctcccttgtttaaatgtca

SEQ ID NO: 67016 - DNA, 25 bp, Homo sapien
cacgagtgtcccccatgccttggtg

SEQ ID NO: 67017 - DNA, 25 bp, Homo sapien
gggctccttggaccctgtagaccca

SEQ ID NO: 67018 - DNA, 25 bp, Homo sapien
tccttggaccctgtagacccagcag

SEQ ID NO: 67019 - DNA, 25 bp, Homo sapien
acccgtggggttgcttcattgagat

SEQ ID NO: 67020 - DNA, 25 bp, Homo sapien
cttcattgagataaagcacacttat

SEQ ID NO: 67021 - DNA, 25 bp, Homo sapien
cattgagataaagcacacttatcac

SEQ ID NO: 67022 - DNA, 25 bp, Homo sapien
cacaaaggacgtgccatggtgcttt

SEQ ID NO: 67023 - DNA, 25 bp, Homo sapien
caaaggacgtgccatggtgctttcc

SEQ ID NO: 67024 - DNA, 25 bp, Homo sapien
aaaggacgtgccatggtgctttccc

SEQ ID NO: 67025 - DNA, 25 bp, Homo sapien
aaggacgtgccatggtgctttcccc

SEQ ID NO: 67026 - DNA, 25 bp, Homo sapien
tggtgctttccccaaaagttgtgtt

SEQ ID NO: 67027 - DNA, 25 bp, Homo sapien
aacttgagcatctgcagatattggt

SEQ ID NO: 67028 - DNA, 25 bp, Homo sapien
catctgcagatattggtatcggagg

SEQ ID NO: 67029 - DNA, 25 bp, Homo sapien
atctgcagatattggtatcggaggg

SEQ ID NO: 67030 - DNA, 25 bp, Homo sapien
tctgcagatattggtatcggagggc

SEQ ID NO: 67031 - DNA, 25 bp, Homo sapien
agatattggtatcggagggcggtcc

SEQ ID NO: 67032 - DNA, 25 bp, Homo sapien
cggtcctggaaccaagcatccacgg

SEQ ID NO: 67033 - DNA, 25 bp, Homo sapien
gaaccaagcatccacggatactgag

SEQ ID NO: 67034 - DNA, 25 bp, Homo sapien
gggtgacatttcatgaagtgtagat

SEQ ID NO: 67035 - DNA, 25 bp, Homo sapien
aagtgtagatcattgtattcagaga

SEQ ID NO: 67036 - DNA, 25 bp, Homo sapien
ttttttctgacaatgtgaccagact

SEQ ID NO: 67037 - DNA, 25 bp, Homo sapien
ctgacaatgtgaccagactgaattt

SEQ ID NO: 67038 - DNA, 25 bp, Homo sapien
gaagccagctatcacaggtttgtta

SEQ ID NO: 67039 - DNA, 25 bp, Homo sapien
tgagttaggtttttccccatctcct

SEQ ID NO: 67040 - DNA, 25 bp, Homo sapien
ccccatctcctgtagagcgaattta

SEQ ID NO: 67041 - DNA, 25 bp, Homo sapien
gggtaagtgttcactacttttcctg

SEQ ID NO: 67042 - DNA, 25 bp, Homo sapien
tttcctgattaagggatctgtgctg

SEQ ID NO: 67043 - DNA, 25 bp, Homo sapien
ggaacaaagcttttgcagtacctta

SEQ ID NO: 67044 - DNA, 25 bp, Homo sapien
taacatatccttcagtgagctcatt

SEQ ID NO: 67045 - DNA, 25 bp, Homo sapien
gagctcatttcacactgtagcctct

SEQ ID NO: 67046 - DNA, 25 bp, Homo sapien
tcacactgtagcctcttccttaaaa

SEQ ID NO: 67047 - DNA, 25 bp, Homo sapien
ttccttaaaatttgtggtgctcctg

SEQ ID NO: 67048 - DNA, 25 bp, Homo sapien
atttgtggtgctcctgtaacagtaa

SEQ ID NO: 67049 - DNA, 25 bp, Homo sapien
attttcttctatcgtgcctgccagg

SEQ ID NO: 67050 - DNA, 25 bp, Homo sapien
ttttcttctatcgtgcctgccaggg

SEQ ID NO: 67051 - DNA, 25 bp, Homo sapien
ttcttctatcgtgcctgccagggct

SEQ ID NO: 67052 - DNA, 25 bp, Homo sapien
agggctgaagctgcctggtatccag

SEQ ID NO: 67053 - DNA, 25 bp, Homo sapien
gctgaagctgcctggtatccaggag

SEQ ID NO: 67054 - DNA, 25 bp, Homo sapien
ctgaagctgcctggtatccaggagg

SEQ ID NO: 67055 - DNA, 25 bp, Homo sapien
gggaatgctggtatccccatatgtc

SEQ ID NO: 67056 - DNA, 25 bp, Homo sapien
atccccatatgtctgtgtttgtttg

SEQ ID NO: 67057 - DNA, 25 bp, Homo sapien
ccccatatgtctgtgtttgtttgag

SEQ ID NO: 67058 - DNA, 25 bp, Homo sapien
ccatatgtctgtgtttgtttgagat

SEQ ID NO: 67059 - DNA, 25 bp, Homo sapien
tatgtctgtgtttgtttgagatttt

SEQ ID NO: 67060 - DNA, 25 bp, Homo sapien
gtccaacgaggtggtcaagctgagc

SEQ ID NO: 67061 - DNA, 25 bp, Homo sapien
cgaggtggtcaagctgagcaccagc

SEQ ID NO: 67062 - DNA, 25 bp, Homo sapien
gcacgtcaactgcagccactgcaag

SEQ ID NO: 67063 - DNA, 25 bp, Homo sapien
gcagccactgcaagcggcccatgag

SEQ ID NO: 67064 - DNA, 25 bp, Homo sapien
tgggtctgcgacaggtgccaccgct

SEQ ID NO: 67065 - DNA, 25 bp, Homo sapien
gctgcgccagcatgtgtgccgtctg

SEQ ID NO: 67066 - DNA, 25 bp, Homo sapien
atgtgtgccgtctgccaccacgtag

SEQ ID NO: 67067 - DNA, 25 bp, Homo sapien
accacgtagtcaagggtctcttcgt

SEQ ID NO: 67068 - DNA, 25 bp, Homo sapien
tcaagggtctcttcgtgtggtgcca

SEQ ID NO: 67069 - DNA, 25 bp, Homo sapien
ctcttcgtgtggtgccagggctgca

SEQ ID NO: 67070 - DNA, 25 bp, Homo sapien
cacctgcagcacatcatgaagtggc

SEQ ID NO: 67071 - DNA, 25 bp, Homo sapien
cctttggcgggagtgttggtgacgg

SEQ ID NO: 67072 - DNA, 25 bp, Homo sapien
tggagtatgcagtgctcgatgagtt

SEQ ID NO: 67073 - DNA, 25 bp, Homo sapien
gtatgcagtgctcgatgagttagaa

SEQ ID NO: 67074 - DNA, 25 bp, Homo sapien
gtgctcgatgagttagaagatttta

SEQ ID NO: 67075 - DNA, 25 bp, Homo sapien
atttcccctacgaggtatgttggca

SEQ ID NO: 67076 - DNA, 25 bp, Homo sapien
ttcccctacgaggtatgttggcagc

SEQ ID NO: 67077 - DNA, 25 bp, Homo sapien
cctacgaggtatgttggcagcccct

SEQ ID NO: 67078 - DNA, 25 bp, Homo sapien
gaggtatgttggcagcccctcctct

SEQ ID NO: 67079 - DNA, 25 bp, Homo sapien
agcccctcctctagagggctcttag

SEQ ID NO: 67080 - DNA, 25 bp, Homo sapien
agagggctcttagcaaaacccaaag

SEQ ID NO: 67081 - DNA, 25 bp, Homo sapien
caaagagagatttgggaattgcagc

SEQ ID NO: 67082 - DNA, 25 bp, Homo sapien
ttgggactcgggacggcaggcgagc

SEQ ID NO: 67083 - DNA, 25 bp, Homo sapien
gggacaacccttctctgtccattga

SEQ ID NO: 67084 - DNA, 25 bp, Homo sapien
tggcgcggacgcagagccagcggga

SEQ ID NO: 67085 - DNA, 25 bp, Homo sapien
gagcagaaccgcatcatattcgact

SEQ ID NO: 67086 - DNA, 25 bp, Homo sapien
gcagaaccgcatcatattcgactcg

SEQ ID NO: 67087 - DNA, 25 bp, Homo sapien
gaaccgcatcatattcgactcggtg

SEQ ID NO: 67088 - DNA, 25 bp, Homo sapien
gcatcatattcgactcggtgggcaa

SEQ ID NO: 67089 - DNA, 25 bp, Homo sapien
atcatattcgactcggtgggcaagt

SEQ ID NO: 67090 - DNA, 25 bp, Homo sapien
tattcgactcggtgggcaagtgatg

SEQ ID NO: 67091 - DNA, 25 bp, Homo sapien
tttcccccaccccagagttgggatg

SEQ ID NO: 67092 - DNA, 25 bp, Homo sapien
gccaccagggcactgtctgcgtgac

SEQ ID NO: 67093 - DNA, 25 bp, Homo sapien
gcaagcccctcttcgcctggtgagc

SEQ ID NO: 67094 - DNA, 25 bp, Homo sapien
caagcccctcttcgcctggtgagcc

SEQ ID NO: 67095 - DNA, 25 bp, Homo sapien
aagcccctcttcgcctggtgagccg

SEQ ID NO: 67096 - DNA, 25 bp, Homo sapien
gcccctcttcgcctggtgagccgcc

SEQ ID NO: 67097 - DNA, 25 bp, Homo sapien
ccgccttgcctgcagtaaacgcgtt

SEQ ID NO: 67098 - DNA, 25 bp, Homo sapien
cgccttgcctgcagtaaacgcgttt

SEQ ID NO: 67099 - DNA, 25 bp, Homo sapien
gggccgcggtgcctcctgcgcgtcc

SEQ ID NO: 67100 - DNA, 25 bp, Homo sapien
tcccccgcgcgcgaggccagagaag

SEQ ID NO: 67101 - DNA, 25 bp, Homo sapien
ccccgcgcgcgaggccagagaaggc

SEQ ID NO: 67102 - DNA, 25 bp, Homo sapien
gagaaggccccgctcccaccggtgc

SEQ ID NO: 67103 - DNA, 25 bp, Homo sapien
gaaggccccgctcccaccggtgctg

SEQ ID NO: 67104 - DNA, 25 bp, Homo sapien
tctctctccagggtgcttagttggc

SEQ ID NO: 67105 - DNA, 25 bp, Homo sapien
tctccagggtgcttagttggctttg

SEQ ID NO: 67106 - DNA, 25 bp, Homo sapien
ccagggtgcttagttggctttgccc

SEQ ID NO: 67107 - DNA, 25 bp, Homo sapien
agctgccctagctgaccccgagaag

SEQ ID NO: 67108 - DNA, 25 bp, Homo sapien
gaccccgagaagtgctcttggctga

SEQ ID NO: 67109 - DNA, 25 bp, Homo sapien
cgagaagtgctcttggctgacccct

SEQ ID NO: 67110 - DNA, 25 bp, Homo sapien
ttggctgacccctctggtgtgtggt

SEQ ID NO: 67111 - DNA, 25 bp, Homo sapien
ccccatttcccgcacatggtgtggg

SEQ ID NO: 67112 - DNA, 25 bp, Homo sapien
ggaggtccaagcagagtgttttatt

SEQ ID NO: 67113 - DNA, 25 bp, Homo sapien
ggtccaagcagagtgttttattatt

SEQ ID NO: 67114 - DNA, 25 bp, Homo sapien
gtgttttattattatcgctttatgt

SEQ ID NO: 67115 - DNA, 25 bp, Homo sapien
tcaagggatgagacctttgtagata

SEQ ID NO: 67116 - DNA, 25 bp, Homo sapien
gggatgagacctttgtagatatgga

SEQ ID NO: 67117 - DNA, 25 bp, Homo sapien
tgtagatatggagcccattcacatg

SEQ ID NO: 67118 - DNA, 25 bp, Homo sapien
ttgggaactactttgtcctaccatc

SEQ ID NO: 67119 - DNA, 25 bp, Homo sapien
tgggaactactttgtcctaccatca

SEQ ID NO: 67120 - DNA, 25 bp, Homo sapien
gggaactactttgtcctaccatcag

SEQ ID NO: 67121 - DNA, 25 bp, Homo sapien
ggaactactttgtcctaccatcaga

SEQ ID NO: 67122 - DNA, 25 bp, Homo sapien
gaactactttgtcctaccatcagat

SEQ ID NO: 67123 - DNA, 25 bp, Homo sapien
aactactttgtcctaccatcagatc

SEQ ID NO: 67124 - DNA, 25 bp, Homo sapien
tactttgtcctaccatcagatcccg

SEQ ID NO: 67125 - DNA, 25 bp, Homo sapien
ttgtcctaccatcagatcccgctga

SEQ ID NO: 67126 - DNA, 25 bp, Homo sapien
tgctgcccatgctgtggccggactt

SEQ ID NO: 67127 - DNA, 25 bp, Homo sapien
atgctgtggccggacttgtcagcag

SEQ ID NO: 67128 - DNA, 25 bp, Homo sapien
tgcccaaatgaactgccacagcagg

SEQ ID NO: 67129 - DNA, 25 bp, Homo sapien
cagggacagctggaccgcagagttt

SEQ ID NO: 67130 - DNA, 25 bp, Homo sapien
gctggaccgcagagtttatttttgt

SEQ ID NO: 67131 - DNA, 25 bp, Homo sapien
tttttgtatttctactgggcctgca

SEQ ID NO: 67132 - DNA, 25 bp, Homo sapien
tgtatttctactgggcctgcacact

SEQ ID NO: 67133 - DNA, 25 bp, Homo sapien
acactccagcccaaagggtctgtgg

SEQ ID NO: 67134 - DNA, 25 bp, Homo sapien
gcagtcaccggctctggtcttgggc

SEQ ID NO: 67135 - DNA, 25 bp, Homo sapien
atttggccgcgtgcactgagtgtca

SEQ ID NO: 67136 - DNA, 25 bp, Homo sapien
tgagtgtcactttgctgcagctcgt

SEQ ID NO: 67137 - DNA, 25 bp, Homo sapien
tgtcctttctcaacagaagcgcttt

SEQ ID NO: 67138 - DNA, 25 bp, Homo sapien
aagcgcttttgcaattgatcccggg

SEQ ID NO: 67139 - DNA, 25 bp, Homo sapien
gatcccgggcaacaagtcaaaataa

SEQ ID NO: 67140 - DNA, 25 bp, Homo sapien
gtgttctttgaagcacattacgatg

SEQ ID NO: 67141 - DNA, 25 bp, Homo sapien
gaagcacattacgatgcctcgagag

SEQ ID NO: 67142 - DNA, 25 bp, Homo sapien
ttacgatgcctcgagagggcggccc

SEQ ID NO: 67143 - DNA, 25 bp, Homo sapien
ccgtgcacgcgctttcaagaaaatg

SEQ ID NO: 67144 - DNA, 25 bp, Homo sapien
aaatgttctcgggacactcggtctt

SEQ ID NO: 67145 - DNA, 25 bp, Homo sapien
acactcggtcttctctttgaaagga

SEQ ID NO: 67146 - DNA, 25 bp, Homo sapien
aaatcctgtggagacttcgcaaaga

SEQ ID NO: 67147 - DNA, 25 bp, Homo sapien
gacttcgcaaagaaaacgcagcctt

SEQ ID NO: 67148 - DNA, 25 bp, Homo sapien
actgtggcactttctcagttattcg

SEQ ID NO: 67149 - DNA, 25 bp, Homo sapien
tgtggcactttctcagttattcgca

SEQ ID NO: 67150 - DNA, 25 bp, Homo sapien
gtggcactttctcagttattcgcag

SEQ ID NO: 67151 - DNA, 25 bp, Homo sapien
ggcactttctcagttattcgcagac

SEQ ID NO: 67152 - DNA, 25 bp, Homo sapien
gcactttctcagttattcgcagaca

SEQ ID NO: 67153 - DNA, 25 bp, Homo sapien
actttctcagttattcgcagacaca

SEQ ID NO: 67154 - DNA, 25 bp, Homo sapien
ttctcagttattcgcagacacacag

SEQ ID NO: 67155 - DNA, 25 bp, Homo sapien
tcagttattcgcagacacacagaga

SEQ ID NO: 67156 - DNA, 25 bp, Homo sapien
cagttattcgcagacacacagagac

SEQ ID NO: 67157 - DNA, 25 bp, Homo sapien
aaaaatttgaagtgcctggctgggc

SEQ ID NO: 67158 - DNA, 25 bp, Homo sapien
aaaatttgaagtgcctggctgggcg

SEQ ID NO: 67159 - DNA, 25 bp, Homo sapien
actcaaggttcattgggctctgctc

SEQ ID NO: 67160 - DNA, 25 bp, Homo sapien
ctgccattacgggagctgtggacag

SEQ ID NO: 67161 - DNA, 25 bp, Homo sapien
gacagagctccctcacttcaagatt

SEQ ID NO: 67162 - DNA, 25 bp, Homo sapien
agtgtttttgcacaacaggttgtcc

SEQ ID NO: 67163 - DNA, 25 bp, Homo sapien
ctgagttgcgtgtctgtaaatgtct

SEQ ID NO: 67164 - DNA, 25 bp, Homo sapien
aaatgtctgcgcagggtgcacatgc

SEQ ID NO: 67165 - DNA, 25 bp, Homo sapien
ggtgcacatgctgcgaggtctccat

SEQ ID NO: 67166 - DNA, 25 bp, Homo sapien
tgggccctcctcagagtatgcctgg

SEQ ID NO: 67167 - DNA, 25 bp, Homo sapien
gtatgcctgggtacaaacctcactg

SEQ ID NO: 67168 - DNA, 25 bp, Homo sapien
aaacctcactgttcagatgggctgt

SEQ ID NO: 67169 - DNA, 25 bp, Homo sapien
tcagatgggctgtaagttctcactt

SEQ ID NO: 67170 - DNA, 25 bp, Homo sapien
caaagaaatatgaaggtggccgtga

SEQ ID NO: 67171 - DNA, 25 bp, Homo sapien
gaaggtggccgtgaattaagtgatt

SEQ ID NO: 67172 - DNA, 25 bp, Homo sapien
gtgattttattagctatctacaaag

SEQ ID NO: 67173 - DNA, 25 bp, Homo sapien
tctacaaagagaagctacaaacccc

SEQ ID NO: 67174 - DNA, 25 bp, Homo sapien
gaaggcacaggaggatctctaaagc

SEQ ID NO: 67175 - DNA, 25 bp, Homo sapien
ggaggatctctaaagcagtagccaa

SEQ ID NO: 67176 - DNA, 25 bp, Homo sapien
cagtagccaaacaccactttgtaaa

SEQ ID NO: 67177 - DNA, 25 bp, Homo sapien
actttgtaaaaggactcttccatca

SEQ ID NO: 67178 - DNA, 25 bp, Homo sapien
aaaggactcttccatcagagatggg

SEQ ID NO: 67179 - DNA, 25 bp, Homo sapien
tatgggaattattacctctcagggc

SEQ ID NO: 67180 - DNA, 25 bp, Homo sapien
tgggaattattacctctcagggccg

SEQ ID NO: 67181 - DNA, 25 bp, Homo sapien
tgggagagtggtttttcaaagtaga

SEQ ID NO: 67182 - DNA, 25 bp, Homo sapien
aaatgtcctgtattccagtgatcat

SEQ ID NO: 67183 - DNA, 25 bp, Homo sapien
gtcctgtattccagtgatcatcctc

SEQ ID NO: 67184 - DNA, 25 bp, Homo sapien
atatctctacgctggaaatttgctg

SEQ ID NO: 67185 - DNA, 25 bp, Homo sapien
tacgctggaaatttgctgcctcaat

SEQ ID NO: 67186 - DNA, 25 bp, Homo sapien
gctggaaatttgctgcctcaatgtt

SEQ ID NO: 67187 - DNA, 25 bp, Homo sapien
atttgctgcctcaatgtttactgtg

SEQ ID NO: 67188 - DNA, 25 bp, Homo sapien
gctgcctcaatgtttactgtgcctt

SEQ ID NO: 67189 - DNA, 25 bp, Homo sapien
tgcctcaatgtttactgtgcctttg

SEQ ID NO: 67190 - DNA, 25 bp, Homo sapien
tgcctttgtttttgctagtgtgtgt

SEQ ID NO: 67191 - DNA, 25 bp, Homo sapien
gtttttgctagtgtgtgttgttgaa

SEQ ID NO: 67192 - DNA, 25 bp, Homo sapien
gggctgaacctctgctcccatggaa

SEQ ID NO: 67193 - DNA, 25 bp, Homo sapien
gctcccatggaaccggatgctgcaa

SEQ ID NO: 67194 - DNA, 25 bp, Homo sapien
catggaaccggatgctgcaaaccca

SEQ ID NO: 67195 - DNA, 25 bp, Homo sapien
agaatgcagccttccagccaaacca

SEQ ID NO: 67196 - DNA, 25 bp, Homo sapien
cttccagccaaaccagtaccagatg

SEQ ID NO: 67197 - DNA, 25 bp, Homo sapien
agctgggcctggtgggtatccaccc

SEQ ID NO: 67198 - DNA, 25 bp, Homo sapien
tggtgggtatccacccagacgagat

SEQ ID NO: 67199 - DNA, 25 bp, Homo sapien
gggtatccacccagacgagatgatc

SEQ ID NO: 67200 - DNA, 25 bp, Homo sapien
gtatccacccagacgagatgatcgt

SEQ ID NO: 67201 - DNA, 25 bp, Homo sapien
cacccagacgagatgatcgtggagg

SEQ ID NO: 67202 - DNA, 25 bp, Homo sapien
tggagggagacagggatatcccaga

SEQ ID NO: 67203 - DNA, 25 bp, Homo sapien
gttaatgttcatgttctgctatgca

SEQ ID NO: 67204 - DNA, 25 bp, Homo sapien
gttcatgttctgctatgcaatcgtt

SEQ ID NO: 67205 - DNA, 25 bp, Homo sapien
gctatgcaatcgtttatatgcacgt

SEQ ID NO: 67206 - DNA, 25 bp, Homo sapien
tagattttcctggatgtatagttta

SEQ ID NO: 67207 - DNA, 25 bp, Homo sapien
gtagcagtagtttacagttctagca

SEQ ID NO: 67208 - DNA, 25 bp, Homo sapien
gtttacagttctagcaaagaggaaa

SEQ ID NO: 67209 - DNA, 25 bp, Homo sapien
attttctttcttatagaggcttcta

SEQ ID NO: 67210 - DNA, 25 bp, Homo sapien
gtgtacaacctttaaaacatcaatg

SEQ ID NO: 67211 - DNA, 25 bp, Homo sapien
gtttggatcaaaacaagacccagct

SEQ ID NO: 67212 - DNA, 25 bp, Homo sapien
agacccagcttattttctgcttgct

SEQ ID NO: 67213 - DNA, 25 bp, Homo sapien
gcttattttctgcttgctgtaaatt

SEQ ID NO: 67214 - DNA, 25 bp, Homo sapien
tgcctcagatgctataggtcagtga

SEQ ID NO: 67215 - DNA, 25 bp, Homo sapien
gggcaagtagtaagctgcctgcctc

SEQ ID NO: 67216 - DNA, 25 bp, Homo sapien
cctcataattccagagaagggcatt

SEQ ID NO: 67217 - DNA, 25 bp, Homo sapien
ttatccctcttctggcttgggccct

SEQ ID NO: 67218 - DNA, 25 bp, Homo sapien
ttgggccctgacacctaagtctttc

SEQ ID NO: 67219 - DNA, 25 bp, Homo sapien
taagtctttcccacggtttatgtgt

SEQ ID NO: 67220 - DNA, 25 bp, Homo sapien
acggtttatgtgtgtgcctcattcc

SEQ ID NO: 67221 - DNA, 25 bp, Homo sapien
tttcccaccaagaatccatcttagc

SEQ ID NO: 67222 - DNA, 25 bp, Homo sapien
gtgctttctccaagggccatcagtg

SEQ ID NO: 67223 - DNA, 25 bp, Homo sapien
gccatcagtgtcttgcctagcttga

SEQ ID NO: 67224 - DNA, 25 bp, Homo sapien
gtcttgcctagcttgagggcttaag

SEQ ID NO: 67225 - DNA, 25 bp, Homo sapien
aattgagaaacatggagactccaaa

SEQ ID NO: 67226 - DNA, 25 bp, Homo sapien
acatggagactccaaatggattatt

SEQ ID NO: 67227 - DNA, 25 bp, Homo sapien
aatggattatttacaggttcacaaa

SEQ ID NO: 67228 - DNA, 25 bp, Homo sapien
tttacaggttcacaaaacagctttg

SEQ ID NO: 67229 - DNA, 25 bp, Homo sapien
caaaacagctttgtggcactgaaag

SEQ ID NO: 67230 - DNA, 25 bp, Homo sapien
cagctttgtggcactgaaagggcga

SEQ ID NO: 67231 - DNA, 25 bp, Homo sapien
gaaagggcgagagccaagatctcct

SEQ ID NO: 67232 - DNA, 25 bp, Homo sapien
agccaagatctcctgatttctgttc

SEQ ID NO: 67233 - DNA, 25 bp, Homo sapien
ttctgttcctgtgttcatagattct

SEQ ID NO: 67234 - DNA, 25 bp, Homo sapien
gttcctgtgttcatagattcttttt

SEQ ID NO: 67235 - DNA, 25 bp, Homo sapien
tgtgttcatagattctttttcctta

SEQ ID NO: 67236 - DNA, 25 bp, Homo sapien
aaaagccatcgtaggtatcaagtca

SEQ ID NO: 67237 - DNA, 25 bp, Homo sapien
gccatcgtaggtatcaagtcaacat

SEQ ID NO: 67238 - DNA, 25 bp, Homo sapien
caagtcaacatgaaattggaatgca

SEQ ID NO: 67239 - DNA, 25 bp, Homo sapien
aaattaatactgctgaggatttcct

SEQ ID NO: 67240 - DNA, 25 bp, Homo sapien
atatcccatgctgtttaactatctc

SEQ ID NO: 67241 - DNA, 25 bp, Homo sapien
tgtttaactatctcttccacagtcc

SEQ ID NO: 67242 - DNA, 25 bp, Homo sapien
taactatctcttccacagtcctaga

SEQ ID NO: 67243 - DNA, 25 bp, Homo sapien
ctatctcttccacagtcctagaatc

SEQ ID NO: 67244 - DNA, 25 bp, Homo sapien
tacagtggtgtcatcaaagctcagt

SEQ ID NO: 67245 - DNA, 25 bp, Homo sapien
agacacatgccccaatactcagcta

SEQ ID NO: 67246 - DNA, 25 bp, Homo sapien
acatgccccaatactcagctaattt

SEQ ID NO: 67247 - DNA, 25 bp, Homo sapien
taagaaccagaaagcacttgaaact

SEQ ID NO: 67248 - DNA, 25 bp, Homo sapien
cagaaagcacttgaaactgatgttt

SEQ ID NO: 67249 - DNA, 25 bp, Homo sapien
atctcattaacttaaaacagctatg

SEQ ID NO: 67250 - DNA, 25 bp, Homo sapien
tctgagcaatccctttcttatggga

SEQ ID NO: 67251 - DNA, 25 bp, Homo sapien
gagcaatccctttcttatgggaaaa

SEQ ID NO: 67252 - DNA, 25 bp, Homo sapien
gggtgagctgtatctggatgccttt

SEQ ID NO: 67253 - DNA, 25 bp, Homo sapien
gagctgtatctggatgcctttttac

SEQ ID NO: 67254 - DNA, 25 bp, Homo sapien
gctgtatctggatgcctttttacaa

SEQ ID NO: 67255 - DNA, 25 bp, Homo sapien
gtatctggatgcctttttacaattt

SEQ ID NO: 67256 - DNA, 25 bp, Homo sapien
atctggatgcctttttacaatttga

SEQ ID NO: 67257 - DNA, 25 bp, Homo sapien
ctggatgcctttttacaatttgatt

SEQ ID NO: 67258 - DNA, 25 bp, Homo sapien
tcacttgtgctgtccagatgggcac

SEQ ID NO: 67259 - DNA, 25 bp, Homo sapien
tgtgctgtccagatgggcacatgca

SEQ ID NO: 67260 - DNA, 25 bp, Homo sapien
tccagatgggcacatgcagcatgct

SEQ ID NO: 67261 - DNA, 25 bp, Homo sapien
tgcagcatgctgtgctcacagcccg

SEQ ID NO: 67262 - DNA, 25 bp, Homo sapien
cgccggcacggcagggatttgtatc

SEQ ID NO: 67263 - DNA, 25 bp, Homo sapien
cagggatttgtatcgttgtgcccgt

SEQ ID NO: 67264 - DNA, 25 bp, Homo sapien
gatttgtatcgttgtgcccgtgtca

SEQ ID NO: 67265 - DNA, 25 bp, Homo sapien
ttgtatcgttgtgcccgtgtcagct

SEQ ID NO: 67266 - DNA, 25 bp, Homo sapien
cgttgtgcccgtgtcagctcctggg

SEQ ID NO: 67267 - DNA, 25 bp, Homo sapien
gggagatcttttacctgtgcttact

SEQ ID NO: 67268 - DNA, 25 bp, Homo sapien
agggctgaagctgcctggtatccag

SEQ ID NO: 67269 - DNA, 25 bp, Homo sapien
tgggcagctgctcactaactgccct

SEQ ID NO: 67270 - DNA, 25 bp, Homo sapien
gctgctcactaactgcccttcaaaa

SEQ ID NO: 67271 - DNA, 25 bp, Homo sapien
agtttttgctactttacaattctag

SEQ ID NO: 67272 - DNA, 25 bp, Homo sapien
gccacggtgatgaaaatatgtttca

SEQ ID NO: 67273 - DNA, 25 bp, Homo sapien
atatgtttcatattttgtggaaatc

SEQ ID NO: 67274 - DNA, 25 bp, Homo sapien
cattttcctgattacttaagaagtt

SEQ ID NO: 67275 - DNA, 25 bp, Homo sapien
agtggctttgtatattcagatgtta

SEQ ID NO: 67276 - DNA, 25 bp, Homo sapien
tggctttgtatattcagatgttaaa

SEQ ID NO: 67277 - DNA, 25 bp, Homo sapien
gatgttaaatctttatctgttacac

SEQ ID NO: 67278 - DNA, 25 bp, Homo sapien
aatctttatctgttacacaaattac

SEQ ID NO: 67279 - DNA, 25 bp, Homo sapien
atctgttacacaaattacatatatg

SEQ ID NO: 67280 - DNA, 25 bp, Homo sapien
tggttcttccaggtggctcccgctg

SEQ ID NO: 67281 - DNA, 25 bp, Homo sapien
aggagttggcaagagaaccccctgc

SEQ ID NO: 67282 - DNA, 25 bp, Homo sapien
ctgccctgtccaggtgggaagctga

SEQ ID NO: 67283 - DNA, 25 bp, Homo sapien
ctgtccaggtgggaagctgagtccc

SEQ ID NO: 67284 - DNA, 25 bp, Homo sapien
ggcctgggctgatcttgagccttaa

SEQ ID NO: 67285 - DNA, 25 bp, Homo sapien
cctgggctgatcttgagccttaact

SEQ ID NO: 67286 - DNA, 25 bp, Homo sapien
gggctgatcttgagccttaactgga

SEQ ID NO: 67287 - DNA, 25 bp, Homo sapien
gatcttgagccttaactggacatga

SEQ ID NO: 67288 - DNA, 25 bp, Homo sapien
cttgagccttaactggacatgaggg

SEQ ID NO: 67289 - DNA, 25 bp, Homo sapien
taaagctgaactgcagcctcctgaa

SEQ ID NO: 67290 - DNA, 25 bp, Homo sapien
aagctgaactgcagcctcctgaaaa

SEQ ID NO: 67291 - DNA, 25 bp, Homo sapien
aaaactcggcatgaacctgatgaat

SEQ ID NO: 67292 - DNA, 25 bp, Homo sapien
tggcatgacatgcagactaccactg

SEQ ID NO: 67293 - DNA, 25 bp, Homo sapien
tgcagactaccactgcctacaagaa

SEQ ID NO: 67294 - DNA, 25 bp, Homo sapien
gaaaccctgagtcacgcagggcaaa

SEQ ID NO: 67295 - DNA, 25 bp, Homo sapien
aggcaactgcagctttcagcaacgt

SEQ ID NO: 67296 - DNA, 25 bp, Homo sapien
gcaacgttggaacggccatcagcaa

SEQ ID NO: 67297 - DNA, 25 bp, Homo sapien
ccatcagcaagaagttcggagacat

SEQ ID NO: 67298 - DNA, 25 bp, Homo sapien
gtaggcggtacgaaccctaatggag

SEQ ID NO: 67299 - DNA, 25 bp, Homo sapien
gaaccctaatggaggcagttttgag

SEQ ID NO: 67300 - DNA, 25 bp, Homo sapien
agttttgaggaggtcctcagctcca

SEQ ID NO: 67301 - DNA, 25 bp, Homo sapien
tgccagtgcccagagcttggcagga

SEQ ID NO: 67302 - DNA, 25 bp, Homo sapien
gaagaccctataatatatgggcatt

SEQ ID NO: 67303 - DNA, 25 bp, Homo sapien
cattactgagagatactgcccatat

SEQ ID NO: 67304 - DNA, 25 bp, Homo sapien
agagatactgcccatatgttgtcct

SEQ ID NO: 67305 - DNA, 25 bp, Homo sapien
gcccatatgttgtcctcgtaagcaa

SEQ ID NO: 67306 - DNA, 25 bp, Homo sapien
gttgtcctcgtaagcaaggagatat

SEQ ID NO: 67307 - DNA, 25 bp, Homo sapien
gatattttttatctcccatatatta

SEQ ID NO: 67308 - DNA, 25 bp, Homo sapien
ctcccatatattacctttcaaacct

SEQ ID NO: 67309 - DNA, 25 bp, Homo sapien
tagtttcgagatatagatccagttt

SEQ ID NO: 67310 - DNA, 25 bp, Homo sapien
gatccagtttatgttgttactcagt

SEQ ID NO: 67311 - DNA, 25 bp, Homo sapien
actcagtagtgaggaagtttctttt

SEQ ID NO: 67312 - DNA, 25 bp, Homo sapien
ttttcactcctattcaatgccattt

SEQ ID NO: 67313 - DNA, 25 bp, Homo sapien
gttgactttgactttgtcgatgtca

SEQ ID NO: 67314 - DNA, 25 bp, Homo sapien
aaagttattcaggtgctgcttcaac

SEQ ID NO: 67315 - DNA, 25 bp, Homo sapien
gtgctgcttcaactggccaagttaa

SEQ ID NO: 67316 - DNA, 25 bp, Homo sapien
ttaaagtggtccatgacgtgagcat

SEQ ID NO: 67317 - DNA, 25 bp, Homo sapien
acgtgatgtcgtgatcgtcgatgaa

SEQ ID NO: 67318 - DNA, 25 bp, Homo sapien
attattgattctggtcggacgatgc

SEQ ID NO: 67319 - DNA, 25 bp, Homo sapien
gtgtgacgacggtagccttagctga

SEQ ID NO: 67320 - DNA, 25 bp, Homo sapien
tagctgataaaaaggccgctcgggt

SEQ ID NO: 67321 - DNA, 25 bp, Homo sapien
ctcgggtggttgactttgacgttga

SEQ ID NO: 67322 - DNA, 25 bp, Homo sapien
gattactttggtcttgatgtgcccg

SEQ ID NO: 67323 - DNA, 25 bp, Homo sapien
tggtcttgatgtgcccgatgaattc

SEQ ID NO: 67324 - DNA, 25 bp, Homo sapien
gctgcccgcacctgcggagtgcttc

SEQ ID NO: 67325 - DNA, 25 bp, Homo sapien
tggtgccccccaagttcctgggcga

SEQ ID NO: 67326 - DNA, 25 bp, Homo sapien
aagttcctgggcgactcgctgctgc

SEQ ID NO: 67327 - DNA, 25 bp, Homo sapien
agttcctgggcgactcgctgctgct

SEQ ID NO: 67328 - DNA, 25 bp, Homo sapien
ctgctcaactgcctgtgcgagctct

SEQ ID NO: 67329 - DNA, 25 bp, Homo sapien
tgctcaactgcctgtgcgagctctc

SEQ ID NO: 67330 - DNA, 25 bp, Homo sapien
aactgcctgtgcgagctctccaagg

SEQ ID NO: 67331 - DNA, 25 bp, Homo sapien
actgcctgtgcgagctctccaagga

SEQ ID NO: 67332 - DNA, 25 bp, Homo sapien
tctccaaggaggacggcaagcccct

SEQ ID NO: 67333 - DNA, 25 bp, Homo sapien
ggcaagcccctcttcgcctggtgag

SEQ ID NO: 67334 - DNA, 25 bp, Homo sapien
cgccttgcctgcagtaaacgcgttt

SEQ ID NO: 67335 - DNA, 25 bp, Homo sapien
actcaggagagtggatcagcaaaac

SEQ ID NO: 67336 - DNA, 25 bp, Homo sapien
cagtgtcagcaaggagtatacaaga

SEQ ID NO: 67337 - DNA, 25 bp, Homo sapien
atacaagaatacaacctctgtcccc

SEQ ID NO: 67338 - DNA, 25 bp, Homo sapien
ctgtccccaaagagcatgttatcct

SEQ ID NO: 67339 - DNA, 25 bp, Homo sapien
atgttatccttcaacacaccggagg

SEQ ID NO: 67340 - DNA, 25 bp, Homo sapien
cacaccggaggtagaagttctagac

SEQ ID NO: 67341 - DNA, 25 bp, Homo sapien
gttctagactgggtgaattctttca

SEQ ID NO: 67342 - DNA, 25 bp, Homo sapien
gactgggtgaattctttcatgaata

SEQ ID NO: 67343 - DNA, 25 bp, Homo sapien
gaatatgagcttcacatttacatca

SEQ ID NO: 67344 - DNA, 25 bp, Homo sapien
ttgaggaatcaagtggtcctcttta

SEQ ID NO: 67345 - DNA, 25 bp, Homo sapien
ctttatggtggcacatgtaaatcta

SEQ ID NO: 67346 - DNA, 25 bp, Homo sapien
ctggtttattgtgcagtgactgtaa

SEQ ID NO: 67347 - DNA, 25 bp, Homo sapien
gcagtgactgtaatatactagagtt

SEQ ID NO: 67348 - DNA, 25 bp, Homo sapien
ataaattgtttactctgcctcacca

SEQ ID NO: 67349 - DNA, 25 bp, Homo sapien
tgcctcaccaaacacatgctaggat

SEQ ID NO: 67350 - DNA, 25 bp, Homo sapien
atgctaggatataacccccaaaata

SEQ ID NO: 67351 - DNA, 25 bp, Homo sapien
aggagactgggtgctataattagat

SEQ ID NO: 67352 - DNA, 25 bp, Homo sapien
aattagattattttgaggcagacag

SEQ ID NO: 67353 - DNA, 25 bp, Homo sapien
ggcagacagagagctgttatcctaa

SEQ ID NO: 67354 - DNA, 25 bp, Homo sapien
gagagctgttatcctaactgattta

SEQ ID NO: 67355 - DNA, 25 bp, Homo sapien
aactgatttagtatgttctgtaatt

SEQ ID NO: 67356 - DNA, 25 bp, Homo sapien
tactttttagtgatttacatgtaca

SEQ ID NO: 67357 - DNA, 25 bp, Homo sapien
gagagttcacgaactgtgcccaacg

SEQ ID NO: 67358 - DNA, 25 bp, Homo sapien
gtgcccaacgcatgttatagccagg

SEQ ID NO: 67359 - DNA, 25 bp, Homo sapien
gcatgttatagccagggtcctacta

SEQ ID NO: 67360 - DNA, 25 bp, Homo sapien
cagggtcctactaactactcagtaa

SEQ ID NO: 67361 - DNA, 25 bp, Homo sapien
aacgtattgttgtattcctccagtg

SEQ ID NO: 67362 - DNA, 25 bp, Homo sapien
tcctccagtgttaagctatagccat

SEQ ID NO: 67363 - DNA, 25 bp, Homo sapien
actgtgcatttattctcagcatcaa

SEQ ID NO: 67364 - DNA, 25 bp, Homo sapien
aaataccttgtaacgtcttctctgc

SEQ ID NO: 67365 - DNA, 25 bp, Homo sapien
tcttctctgccttgttagtgcatat

SEQ ID NO: 67366 - DNA, 25 bp, Homo sapien
atagtcattttctctgctccttaaa

SEQ ID NO: 67367 - DNA, 25 bp, Homo sapien
tctgctccttaaatatcatctctat

SEQ ID NO: 67368 - DNA, 25 bp, Homo sapien
acatgctcaccgtgaaggtgggtga

SEQ ID NO: 67369 - DNA, 25 bp, Homo sapien
agcccaaaggctatcctcctgaaga

SEQ ID NO: 67370 - DNA, 25 bp, Homo sapien
ggctatcctcctgaagacatcttta

SEQ ID NO: 67371 - DNA, 25 bp, Homo sapien
aagacatctttaatctagtgggcaa

SEQ ID NO: 67372 - DNA, 25 bp, Homo sapien
tctagtgggcaagaaggtcctggtc

SEQ ID NO: 67373 - DNA, 25 bp, Homo sapien
aaggtcctggtcactgttgaagagg

SEQ ID NO: 67374 - DNA, 25 bp, Homo sapien
gtcactgttgaagaggatgacacca

SEQ ID NO: 67375 - DNA, 25 bp, Homo sapien
gcaatgagaagctgggcaagtctgt

SEQ ID NO: 67376 - DNA, 25 bp, Homo sapien
gtgaaaattccggaaggcaccattc

SEQ ID NO: 67377 - DNA, 25 bp, Homo sapien
ttccggaaggcaccattctaacaat

SEQ ID NO: 67378 - DNA, 25 bp, Homo sapien
ttctaacaatggacatgctcaccgt

SEQ ID NO: 67379 - DNA, 25 bp, Homo sapien
cactctggccggaggaaggaccgca

SEQ ID NO: 67380 - DNA, 25 bp, Homo sapien
aggaaggaccgcaggcagacagcct

SEQ ID NO: 67381 - DNA, 25 bp, Homo sapien
agcctgggcctctaacagcttttgt

SEQ ID NO: 67382 - DNA, 25 bp, Homo sapien
ggcctctaacagcttttgtccggag

SEQ ID NO: 67383 - DNA, 25 bp, Homo sapien
aacagcttttgtccggagctagact

SEQ ID NO: 67384 - DNA, 25 bp, Homo sapien
ttttgtccggagctagacttcgtgt

SEQ ID NO: 67385 - DNA, 25 bp, Homo sapien
ggagctagacttcgtgtcctttcag

SEQ ID NO: 67386 - DNA, 25 bp, Homo sapien
agacttcgtgtcctttcagttggta

SEQ ID NO: 67387 - DNA, 25 bp, Homo sapien
cttcgtgtcctttcagttggtaaat

SEQ ID NO: 67388 - DNA, 25 bp, Homo sapien
gtgtcctttcagttggtaaatggtt

SEQ ID NO: 67389 - DNA, 25 bp, Homo sapien
cagttggtaaatggttttctataga

SEQ ID NO: 67390 - DNA, 25 bp, Homo sapien
aaacctgttttctaacctggagctg

SEQ ID NO: 67391 - DNA, 25 bp, Homo sapien
taacctggagctgctatcctgactt

SEQ ID NO: 67392 - DNA, 25 bp, Homo sapien
gctgctatcctgactttttctagag

SEQ ID NO: 67393 - DNA, 25 bp, Homo sapien
tagagtttgaatctctcccggaact

SEQ ID NO: 67394 - DNA, 25 bp, Homo sapien
tctcccggaactctgacctagagag

SEQ ID NO: 67395 - DNA, 25 bp, Homo sapien
agaggatcctggtacttctttgcca

SEQ ID NO: 67396 - DNA, 25 bp, Homo sapien
ataataccttaactcacaaccaacg

SEQ ID NO: 67397 - DNA, 25 bp, Homo sapien
acaaccaacgagtcaaagatgcatg

SEQ ID NO: 67398 - DNA, 25 bp, Homo sapien
ataaatgttgcccacatctttgttc

SEQ ID NO: 67399 - DNA, 25 bp, Homo sapien
atctttgttccatcggcttgattta

SEQ ID NO: 67400 - DNA, 25 bp, Homo sapien
gatcttttctaagccttttactcta

SEQ ID NO: 67401 - DNA, 25 bp, Homo sapien
gccaaggcgccaacattaatgagat

SEQ ID NO: 67402 - DNA, 25 bp, Homo sapien
cattaatgagatccgccagatgtcc

SEQ ID NO: 67403 - DNA, 25 bp, Homo sapien
ccagtggaaggctcctctggtaggc

SEQ ID NO: 67404 - DNA, 25 bp, Homo sapien
ctctggtaggcaggttactatcact

SEQ ID NO: 67405 - DNA, 25 bp, Homo sapien
tggctctgctgccagtattagtctg

SEQ ID NO: 67406 - DNA, 25 bp, Homo sapien
gctgccagtattagtctggcccagt

SEQ ID NO: 67407 - DNA, 25 bp, Homo sapien
ccagtattagtctggcccagtatct

SEQ ID NO: 67408 - DNA, 25 bp, Homo sapien
tcaatgccaggctttcctctgagaa

SEQ ID NO: 67409 - DNA, 25 bp, Homo sapien
atgccaggctttcctctgagaaggg

SEQ ID NO: 67410 - DNA, 25 bp, Homo sapien
aggctttcctctgagaagggcatgg

SEQ ID NO: 67411 - DNA, 25 bp, Homo sapien
agctagaacagtgtaggttccctca

SEQ ID NO: 67412 - DNA, 25 bp, Homo sapien
tgtctcatggtggtctctcttacac

SEQ ID NO: 67413 - DNA, 25 bp, Homo sapien
aggcccatcttttgcctcatggtag

SEQ ID NO: 67414 - DNA, 25 bp, Homo sapien
tagcctcttctggttttgctcttgc

SEQ ID NO: 67415 - DNA, 25 bp, Homo sapien
ttttgctcttgcctcacagttgcct

SEQ ID NO: 67416 - DNA, 25 bp, Homo sapien
cagctttaagcctttgatggtcaac

SEQ ID NO: 67417 - DNA, 25 bp, Homo sapien
atggtcaacagcatcaaggagccta

SEQ ID NO: 67418 - DNA, 25 bp, Homo sapien
taaagcttccctggactctcatttg

SEQ ID NO: 67419 - DNA, 25 bp, Homo sapien
ggactctcatttgttcactttacag

SEQ ID NO: 67420 - DNA, 25 bp, Homo sapien
gttcactttacagcagagtgcctta

SEQ ID NO: 67421 - DNA, 25 bp, Homo sapien
gcaaaaactgtctcttaaccttgag

SEQ ID NO: 67422 - DNA, 25 bp, Homo sapien
taaccttgagagtggatttctgaca

SEQ ID NO: 67423 - DNA, 25 bp, Homo sapien
catttgatttattgtgcacctgatt

SEQ ID NO: 67424 - DNA, 25 bp, Homo sapien
gtgcacctgatttttggtctaaaag

SEQ ID NO: 67425 - DNA, 25 bp, Homo sapien
ggtctaaaaggaattattgccacaa

SEQ ID NO: 67426 - DNA, 25 bp, Homo sapien
attctttagattttagccttgtaag

SEQ ID NO: 67427 - DNA, 25 bp, Homo sapien
gtgaaaagctgtttgtccctttact

SEQ ID NO: 67428 - DNA, 25 bp, Homo sapien
tttatcgttcaaactgtccactctg

SEQ ID NO: 67429 - DNA, 25 bp, Homo sapien
gttcaaactgtccactctgatccaa

SEQ ID NO: 67430 - DNA, 25 bp, Homo sapien
tctgatccaaccctgtactgatagt

SEQ ID NO: 67431 - DNA, 25 bp, Homo sapien
gtacttcccagtatgatattgtgat

SEQ ID NO: 67432 - DNA, 25 bp, Homo sapien
ttgtgatgtttcatacaatgcagtg

SEQ ID NO: 67433 - DNA, 25 bp, Homo sapien
tgaacataaccaacttgttacctaa

SEQ ID NO: 67434 - DNA, 25 bp, Homo sapien
actgtccccaaacttgctgtcaatt

SEQ ID NO: 67435 - DNA, 25 bp, Homo sapien
cttgctgtcaattccgagatctaat

SEQ ID NO: 67436 - DNA, 25 bp, Homo sapien
ctacgctctgccaggaattctttca

SEQ ID NO: 67437 - DNA, 25 bp, Homo sapien
aattctttcagacctcactagcaca

SEQ ID NO: 67438 - DNA, 25 bp, Homo sapien
acaagcccggttgctccttgtcagg

SEQ ID NO: 67439 - DNA, 25 bp, Homo sapien
atcattctcacttcaaattcctggg

SEQ ID NO: 67440 - DNA, 25 bp, Homo sapien
gggctgatacttctctcatcttgca

SEQ ID NO: 67441 - DNA, 25 bp, Homo sapien
gatttaccgcatttacggctgcatt

SEQ ID NO: 67442 - DNA, 25 bp, Homo sapien
ctgtaagtgggcatggtctcctaat

SEQ ID NO: 67443 - DNA, 25 bp, Homo sapien
aagttattcacctgagtatgcaata

SEQ ID NO: 67444 - DNA, 25 bp, Homo sapien
atgcaataaagatgtggtggccact

SEQ ID NO: 67445 - DNA, 25 bp, Homo sapien
cttggtctccctagtaatggttcaa

SEQ ID NO: 67446 - DNA, 25 bp, Homo sapien
aatggttcaagttcttcccaggaag

SEQ ID NO: 67447 - DNA, 25 bp, Homo sapien
tcttcccaggaagtcttacatatta

SEQ ID NO: 67448 - DNA, 25 bp, Homo sapien
actttgttcattatctttcccttat

SEQ ID NO: 67449 - DNA, 25 bp, Homo sapien
ctttcccttatagcatcattttcct

SEQ ID NO: 67450 - DNA, 25 bp, Homo sapien
gtggaaatcagactagctgctaaac

SEQ ID NO: 67451 - DNA, 25 bp, Homo sapien
aaggttaatcctccagaaatgtact

SEQ ID NO: 67452 - DNA, 25 bp, Homo sapien
gggaggcattttagtcacaacaact

SEQ ID NO: 67453 - DNA, 25 bp, Homo sapien
gtcacaacaacttacatttggcttt

SEQ ID NO: 67454 - DNA, 25 bp, Homo sapien
catttggctttggaagttgttaaca

SEQ ID NO: 67455 - DNA, 25 bp, Homo sapien
gtatcttggaacttacattttgaca

SEQ ID NO: 67456 - DNA, 25 bp, Homo sapien
cgctgcccgcacctgcggagtgctt

SEQ ID NO: 67457 - DNA, 25 bp, Homo sapien
ctgcccgcacctgcggagtgcttct

SEQ ID NO: 67458 - DNA, 25 bp, Homo sapien
gtggtgccccccaagttcctgggcg

SEQ ID NO: 67459 - DNA, 25 bp, Homo sapien
tggtgccccccaagttcctgggcga

SEQ ID NO: 67460 - DNA, 25 bp, Homo sapien
aagttcctgggcgactcgctgctgc

SEQ ID NO: 67461 - DNA, 25 bp, Homo sapien
agttcctgggcgactcgctgctgct

SEQ ID NO: 67462 - DNA, 25 bp, Homo sapien
gttcctgggcgactcgctgctgctg

SEQ ID NO: 67463 - DNA, 25 bp, Homo sapien
ctgctcaactgcctgtgcgagctct

SEQ ID NO: 67464 - DNA, 25 bp, Homo sapien
tgctcaactgcctgtgcgagctctc

SEQ ID NO: 67465 - DNA, 25 bp, Homo sapien
aactgcctgtgcgagctctccaagg

SEQ ID NO: 67466 - DNA, 25 bp, Homo sapien
actgcctgtgcgagctctccaagga

SEQ ID NO: 67467 - DNA, 25 bp, Homo sapien
gaaagaacggcctcgcatctataca

SEQ ID NO: 67468 - DNA, 25 bp, Homo sapien
acagcccttgatccttttagagtga

SEQ ID NO: 67469 - DNA, 25 bp, Homo sapien
gagtgaacactgagttcgtgctgtt

SEQ ID NO: 67470 - DNA, 25 bp, Homo sapien
agttcgtgctgttgaccgtgaagga

SEQ ID NO: 67471 - DNA, 25 bp, Homo sapien
gaatatcaggccagggagtccactg

SEQ ID NO: 67472 - DNA, 25 bp, Homo sapien
gagtccactggagtggttgatccag

SEQ ID NO: 67473 - DNA, 25 bp, Homo sapien
gtcagcaaagctgcatggatcagga

SEQ ID NO: 67474 - DNA, 25 bp, Homo sapien
aaggcctgcctattgataatttcac

SEQ ID NO: 67475 - DNA, 25 bp, Homo sapien
agcaagggaaaacagcggcccctga

SEQ ID NO: 67476 - DNA, 25 bp, Homo sapien
agcggcccctgaacttggacaaaat

SEQ ID NO: 67477 - DNA, 25 bp, Homo sapien
gtatttatctaaaccagccttggga

SEQ ID NO: 67478 - DNA, 25 bp, Homo sapien
caaccaggagggattgactgagatc

SEQ ID NO: 67479 - DNA, 25 bp, Homo sapien
gagggattgactgagatcttaacaa

SEQ ID NO: 67480 - DNA, 25 bp, Homo sapien
gagatcttaacaacagcagcaacga

SEQ ID NO: 67481 - DNA, 25 bp, Homo sapien
cagcagcaacgatacatcagcaaat

SEQ ID NO: 67482 - DNA, 25 bp, Homo sapien
cagcaaatccttattatccagcctt

SEQ ID NO: 67483 - DNA, 25 bp, Homo sapien
ttatccagccttcaactatctttac

SEQ ID NO: 67484 - DNA, 25 bp, Homo sapien
gccttcaactatctttaccctggaa

SEQ ID NO: 67485 - DNA, 25 bp, Homo sapien
tttaccctggaaaacaatctcgatt

SEQ ID NO: 67486 - DNA, 25 bp, Homo sapien
acaatctcgatttttgacttttcaa

SEQ ID NO: 67487 - DNA, 25 bp, Homo sapien
ttcaaagttgtgtatgctccaggtt

SEQ ID NO: 67488 - DNA, 25 bp, Homo sapien
tgtatgctccaggttaatgcaagga

SEQ ID NO: 67489 - DNA, 25 bp, Homo sapien
agagttcctgttcctactggtgcat

SEQ ID NO: 67490 - DNA, 25 bp, Homo sapien
ctactggtgcatttgatgggcctct

SEQ ID NO: 67491 - DNA, 25 bp, Homo sapien
atttgatgggcctctgcatagtcca

SEQ ID NO: 67492 - DNA, 25 bp, Homo sapien
aagagatcctcttcctgatacccct

SEQ ID NO: 67493 - DNA, 25 bp, Homo sapien
ggcatcttcacagagattcagactg

SEQ ID NO: 67494 - DNA, 25 bp, Homo sapien
gagattcagactggctcagagacat

SEQ ID NO: 67495 - DNA, 25 bp, Homo sapien
ctggctcagagacattagtacgtgt

SEQ ID NO: 67496 - DNA, 25 bp, Homo sapien
tagtacgtgtccaaattcgccaagc

SEQ ID NO: 67497 - DNA, 25 bp, Homo sapien
aagggtaccgcgtcgatgctatgtg

SEQ ID NO: 67498 - DNA, 25 bp, Homo sapien
gatgctatgtgctcagttctagtca

SEQ ID NO: 67499 - DNA, 25 bp, Homo sapien
agttctagtcagaataatcttgctc

SEQ ID NO: 67500 - DNA, 25 bp, Homo sapien
taagtaatgtcagactcatatgcat

SEQ ID NO: 67501 - DNA, 25 bp, Homo sapien
agtaatgtcagactcatatgcattt

SEQ ID NO: 67502 - DNA, 25 bp, Homo sapien
aatgtcagactcatatgcattttca

SEQ ID NO: 67503 - DNA, 25 bp, Homo sapien
tttcattctcattagctaaagtaaa

SEQ ID NO: 67504 - DNA, 25 bp, Homo sapien
aattatctcaaatagttacaagttt

SEQ ID NO: 67505 - DNA, 25 bp, Homo sapien
atctcaaatagttacaagttttgga

SEQ ID NO: 67506 - DNA, 25 bp, Homo sapien
gtaaagtctattatgtaatatgctt

SEQ ID NO: 67507 - DNA, 25 bp, Homo sapien
tatgcttatttgtaatcctaatata

SEQ ID NO: 67508 - DNA, 25 bp, Homo sapien
gcttatttgtaatcctaatatatga

SEQ ID NO: 67509 - DNA, 25 bp, Homo sapien
aatcctaatatatgagggtgacatt

SEQ ID NO: 67510 - DNA, 25 bp, Homo sapien
cctaatatatgagggtgacattttt

SEQ ID NO: 67511 - DNA, 25 bp, Homo sapien
agtactggaccctccaatcatgggt

SEQ ID NO: 67512 - DNA, 25 bp, Homo sapien
gaccctccaatcatgggtaccggag

SEQ ID NO: 67513 - DNA, 25 bp, Homo sapien
ggtaccggagatgcaggaccctcag

SEQ ID NO: 67514 - DNA, 25 bp, Homo sapien
ggaacctgagggtcattgaacattt

SEQ ID NO: 67515 - DNA, 25 bp, Homo sapien
tgaacatttgttccgtgtctggcca

SEQ ID NO: 67516 - DNA, 25 bp, Homo sapien
agggttgacccctggtctcagtgct

SEQ ID NO: 67517 - DNA, 25 bp, Homo sapien
tggtctcagtgctttccaattcgaa

SEQ ID NO: 67518 - DNA, 25 bp, Homo sapien
cagtgctttccaattcgaacttttt

SEQ ID NO: 67519 - DNA, 25 bp, Homo sapien
gaactttttccaatcttaggtatct

SEQ ID NO: 67520 - DNA, 25 bp, Homo sapien
ggtatctactttagagtcttctcca

SEQ ID NO: 67521 - DNA, 25 bp, Homo sapien
ttagagtcttctccaatgtccaaaa

SEQ ID NO: 67522 - DNA, 25 bp, Homo sapien
attcccctcagctaatgacggagtg

SEQ ID NO: 67523 - DNA, 25 bp, Homo sapien
ctcagctaatgacggagtgctcctt

SEQ ID NO: 67524 - DNA, 25 bp, Homo sapien
taatgacggagtgctccttctccag

SEQ ID NO: 67525 - DNA, 25 bp, Homo sapien
gctccttctccagttccgggtgaaa

SEQ ID NO: 67526 - DNA, 25 bp, Homo sapien
tccgggtgaaaaagttctgaattct

SEQ ID NO: 67527 - DNA, 25 bp, Homo sapien
aaaagtgattcagtgatttcagata

SEQ ID NO: 67528 - DNA, 25 bp, Homo sapien
aaaggaaagcatatgtcagttgttt

SEQ ID NO: 67529 - DNA, 25 bp, Homo sapien
gcatatgtcagttgtttaaaaccca

SEQ ID NO: 67530 - DNA, 25 bp, Homo sapien
actgattgtataactctaagatctg

SEQ ID NO: 67531 - DNA, 25 bp, Homo sapien
ttgccattttgtcctttgattatat

SEQ ID NO: 67532 - DNA, 25 bp, Homo sapien
gattatattgggaagttgactaaac

SEQ ID NO: 67533 - DNA, 25 bp, Homo sapien
gaatgtgaaccagtgactctcgggc

SEQ ID NO: 67534 - DNA, 25 bp, Homo sapien
atgtgaaccagtgactctcgggcgc

SEQ ID NO: 67535 - DNA, 25 bp, Homo sapien
tctcgggcgcccctgtggtaacttt

SEQ ID NO: 67536 - DNA, 25 bp, Homo sapien
tgtggtaactttgcaggcggccctc

SEQ ID NO: 67537 - DNA, 25 bp, Homo sapien
ggtaactttgcaggcggccctcagt

SEQ ID NO: 67538 - DNA, 25 bp, Homo sapien
cgagggccgcctgccttagcaatgg

SEQ ID NO: 67539 - DNA, 25 bp, Homo sapien
ggcctccgcttatcctgctagcagg

SEQ ID NO: 67540 - DNA, 25 bp, Homo sapien
ggccacagcgtgctggcgacactca

SEQ ID NO: 67541 - DNA, 25 bp, Homo sapien
cagcgtgctggcgacactcagggca

SEQ ID NO: 67542 - DNA, 25 bp, Homo sapien
tggcgacactcagggcagctgcctg

SEQ ID NO: 67543 - DNA, 25 bp, Homo sapien
gaggtgggtggtgggcttctgcgtc

SEQ ID NO: 67544 - DNA, 25 bp, Homo sapien
cctgtttacacagacacctggcctc

SEQ ID NO: 67545 - DNA, 25 bp, Homo sapien
tggagcagcgcctcaatcgacacaa

SEQ ID NO: 67546 - DNA, 25 bp, Homo sapien
gcagcgcctcaatcgacacaaggaa

SEQ ID NO: 67547 - DNA, 25 bp, Homo sapien
tcaatcgacacaaggaactggcccc

SEQ ID NO: 67548 - DNA, 25 bp, Homo sapien
gacacaaggaactggccccactgaa

SEQ ID NO: 67549 - DNA, 25 bp, Homo sapien
cccactgaagtacctggctctggag

SEQ ID NO: 67550 - DNA, 25 bp, Homo sapien
tgaagtacctggctctggaggaaaa

SEQ ID NO: 67551 - DNA, 25 bp, Homo sapien
gctctggaggaaaagctctacaagg

SEQ ID NO: 67552 - DNA, 25 bp, Homo sapien
gaaaatattcgcttgatgtccctcc

SEQ ID NO: 67553 - DNA, 25 bp, Homo sapien
atattcgcttgatgtccctcctggg

SEQ ID NO: 67554 - DNA, 25 bp, Homo sapien
tctatccagccaatgcctgtttaca

SEQ ID NO: 67555 - DNA, 25 bp, Homo sapien
cctttggcgggagtgttggtgacgg

SEQ ID NO: 67556 - DNA, 25 bp, Homo sapien
tggagtatgcagtgctcgatgagtt

SEQ ID NO: 67557 - DNA, 25 bp, Homo sapien
gtgctcgatgagttagaagatttta

SEQ ID NO: 67558 - DNA, 25 bp, Homo sapien
caggcgggttcacggctaaagcaat

SEQ ID NO: 67559 - DNA, 25 bp, Homo sapien
tgaagaggccttgaatttcccctac

SEQ ID NO: 67560 - DNA, 25 bp, Homo sapien
atttcccctacgaggtatgttggca

SEQ ID NO: 67561 - DNA, 25 bp, Homo sapien
tcccctacgaggtatgttggcagcc

SEQ ID NO: 67562 - DNA, 25 bp, Homo sapien
acgaggtatgttggcagcccctcct

SEQ ID NO: 67563 - DNA, 25 bp, Homo sapien
agcccctcctctagagggctcttag

SEQ ID NO: 67564 - DNA, 25 bp, Homo sapien
agagggctcttagcaaaacccaaag

SEQ ID NO: 67565 - DNA, 25 bp, Homo sapien
caaagagagatttgggaattgcagc

SEQ ID NO: 67566 - DNA, 25 bp, Homo sapien
aaaggagtctcctgctacacattca

SEQ ID NO: 67567 - DNA, 25 bp, Homo sapien
cctgctacacattcatcaaactttc

SEQ ID NO: 67568 - DNA, 25 bp, Homo sapien
tcaaactttctgtatggtaccatgg

SEQ ID NO: 67569 - DNA, 25 bp, Homo sapien
ggtaccatggtttcatacacctgta

SEQ ID NO: 67570 - DNA, 25 bp, Homo sapien
acttggaatggcagtgcaccatcct

SEQ ID NO: 67571 - DNA, 25 bp, Homo sapien
gcaccatcctgcatttcaattgaat

SEQ ID NO: 67572 - DNA, 25 bp, Homo sapien
gcctactgctcctgaaaatggcttt

SEQ ID NO: 67573 - DNA, 25 bp, Homo sapien
atggctttttgcgttttacagagac

SEQ ID NO: 67574 - DNA, 25 bp, Homo sapien
gaagtgctgtgcagtatagctgtaa

SEQ ID NO: 67575 - DNA, 25 bp, Homo sapien
atagctgtaaacctggacacattct

SEQ ID NO: 67576 - DNA, 25 bp, Homo sapien
gacacattctagcaggctctgactt

SEQ ID NO: 67577 - DNA, 25 bp, Homo sapien
ttttagtcaaaccattccatatcag

SEQ ID NO: 67578 - DNA, 25 bp, Homo sapien
ccattccatatcagaattttccttg

SEQ ID NO: 67579 - DNA, 25 bp, Homo sapien
tacaatgttctgataaatttgactg

SEQ ID NO: 67580 - DNA, 25 bp, Homo sapien
gtaaaaaattgcattccctttgtat

SEQ ID NO: 67581 - DNA, 25 bp, Homo sapien
attccctttgtatttcatgtgtaat

SEQ ID NO: 67582 - DNA, 25 bp, Homo sapien
gtgtaattcaccaattaagtgcagt

SEQ ID NO: 67583 - DNA, 25 bp, Homo sapien
agtgcagtttatattcaggttggat

SEQ ID NO: 67584 - DNA, 25 bp, Homo sapien
caggttggattatgcatgtttaggt

SEQ ID NO: 67585 - DNA, 25 bp, Homo sapien
gtttaggtaaacgaaagctgtgtct

SEQ ID NO: 67586 - DNA, 25 bp, Homo sapien
acgaaagctgtgtcttacttgattt

SEQ ID NO: 67587 - DNA, 25 bp, Homo sapien
gctgtgtcttacttgatttattctt

SEQ ID NO: 67588 - DNA, 25 bp, Homo sapien
agatgcggactgagctccctctgta

SEQ ID NO: 67589 - DNA, 25 bp, Homo sapien
atggagggttcaatcaatttcagga

SEQ ID NO: 67590 - DNA, 25 bp, Homo sapien
tcaggaattccaatttgctccagca

SEQ ID NO: 67591 - DNA, 25 bp, Homo sapien
ccaagttctgtctggatcctgttat

SEQ ID NO: 67592 - DNA, 25 bp, Homo sapien
gatcctgttatgtgtgctgaagagc

SEQ ID NO: 67593 - DNA, 25 bp, Homo sapien
tgtgctgaagagctttccagagtca

SEQ ID NO: 67594 - DNA, 25 bp, Homo sapien
tcatcctggtgtggacagggcatgt

SEQ ID NO: 67595 - DNA, 25 bp, Homo sapien
gacagggtccagtgccctctagtgg

SEQ ID NO: 67596 - DNA, 25 bp, Homo sapien
acacctcctgattgtcctcaaaaga

SEQ ID NO: 67597 - DNA, 25 bp, Homo sapien
aaagagctgctgcacaagtcttgct

SEQ ID NO: 67598 - DNA, 25 bp, Homo sapien
aagtcttgctcttactttgtttgca

SEQ ID NO: 67599 - DNA, 25 bp, Homo sapien
aatcactttgaaatcctccctcctg

SEQ ID NO: 67600 - DNA, 25 bp, Homo sapien
tcctgaactgggtgactgtcgggct

SEQ ID NO: 67601 - DNA, 25 bp, Homo sapien
tgactgtcgggctctgaagcgagct

SEQ ID NO: 67602 - DNA, 25 bp, Homo sapien
gaagcgagctggtttagttgtagaa

SEQ ID NO: 67603 - DNA, 25 bp, Homo sapien
aagatgctctgtttgaaactctgcc

SEQ ID NO: 67604 - DNA, 25 bp, Homo sapien
aaactctgccttctgacgtccggga

SEQ ID NO: 67605 - DNA, 25 bp, Homo sapien
tgacgtccgggagcaaatgaaaaca

SEQ ID NO: 67606 - DNA, 25 bp, Homo sapien
gtttgactgaaacacgcttctacca

SEQ ID NO: 67607 - DNA, 25 bp, Homo sapien
gaaacacgcttctaccaaatacagt

SEQ ID NO: 67608 - DNA, 25 bp, Homo sapien
ataattaggtagtcttaatgccttt

SEQ ID NO: 67609 - DNA, 25 bp, Homo sapien
gatcgcgtaaggagtatgtattttt

SEQ ID NO: 67610 - DNA, 25 bp, Homo sapien
ggtgattctcatcagggtgacctga

SEQ ID NO: 67611 - DNA, 25 bp, Homo sapien
gttggtggtaacgactgttctgtgt

SEQ ID NO: 67612 - DNA, 25 bp, Homo sapien
tctgtgtcagcacccaggacagtgg

SEQ ID NO: 67613 - DNA, 25 bp, Homo sapien
acagtggtgtctgttaaggctgcca

SEQ ID NO: 67614 - DNA, 25 bp, Homo sapien
tctgttaaggctgccagggattagc

SEQ ID NO: 67615 - DNA, 25 bp, Homo sapien
agcagggaggaaagccatcaggact

SEQ ID NO: 67616 - DNA, 25 bp, Homo sapien
gtagcctggtagcaccaaatcccaa

SEQ ID NO: 67617 - DNA, 25 bp, Homo sapien
ggtagcaccaaatcccaattaatgt

SEQ ID NO: 67618 - DNA, 25 bp, Homo sapien
aatcccaattaatgttacctgaaca

SEQ ID NO: 67619 - DNA, 25 bp, Homo sapien
gaacatgtggtgaggtcagccgtat

SEQ ID NO: 67620 - DNA, 25 bp, Homo sapien
cagccgtatgatgaaagatgtttaa

SEQ ID NO: 67621 - DNA, 25 bp, Homo sapien
gggctccactaacagaagcagcaca

SEQ ID NO: 67622 - DNA, 25 bp, Homo sapien
ggctccactaacagaagcagcacat

SEQ ID NO: 67623 - DNA, 25 bp, Homo sapien
gctccactaacagaagcagcacatc

SEQ ID NO: 67624 - DNA, 25 bp, Homo sapien
ctccactaacagaagcagcacatcg

SEQ ID NO: 67625 - DNA, 25 bp, Homo sapien
tccactaacagaagcagcacatcgt

SEQ ID NO: 67626 - DNA, 25 bp, Homo sapien
ccactaacagaagcagcacatcgtc

SEQ ID NO: 67627 - DNA, 25 bp, Homo sapien
cactaacagaagcagcacatcgtca

SEQ ID NO: 67628 - DNA, 25 bp, Homo sapien
actaacagaagcagcacatcgtcat

SEQ ID NO: 67629 - DNA, 25 bp, Homo sapien
ctaacagaagcagcacatcgtcatt

SEQ ID NO: 67630 - DNA, 25 bp, Homo sapien
taacagaagcagcacatcgtcattt

SEQ ID NO: 67631 - DNA, 25 bp, Homo sapien
aacagaagcagcacatcgtcatttt

SEQ ID NO: 67632 - DNA, 25 bp, Homo sapien
ggattggcataagaccattactaaa

SEQ ID NO: 67633 - DNA, 25 bp, Homo sapien
cattactaaaatttggcacctgtga

SEQ ID NO: 67634 - DNA, 25 bp, Homo sapien
aaaatttggcacctgtgagatgttt

SEQ ID NO: 67635 - DNA, 25 bp, Homo sapien
cctgtgagatgtttgatattatgaa

SEQ ID NO: 67636 - DNA, 25 bp, Homo sapien
atgtttgtaacacacttcatggtgt

SEQ ID NO: 67637 - DNA, 25 bp, Homo sapien
acacacttcatggtgttcccatagg

SEQ ID NO: 67638 - DNA, 25 bp, Homo sapien
acttcatggtgttcccataggcttt

SEQ ID NO: 67639 - DNA, 25 bp, Homo sapien
catggtgttcccataggctttgctg

SEQ ID NO: 67640 - DNA, 25 bp, Homo sapien
cataggctttgctgtctagtcttat

SEQ ID NO: 67641 - DNA, 25 bp, Homo sapien
ggctttgctgtctagtcttatagtt

SEQ ID NO: 67642 - DNA, 25 bp, Homo sapien
gctgtctagtcttatagtttgaggt

SEQ ID NO: 67643 - DNA, 25 bp, Homo sapien
ggcatttacacaaagtcccagacaa

SEQ ID NO: 67644 - DNA, 25 bp, Homo sapien
aagtcccagacaaccaaggaactga

SEQ ID NO: 67645 - DNA, 25 bp, Homo sapien
catcatatgagagcagcacatccca

SEQ ID NO: 67646 - DNA, 25 bp, Homo sapien
acaatattcgtatatctttctgcaa

SEQ ID NO: 67647 - DNA, 25 bp, Homo sapien
atctttctgcaaatatggctctgga

SEQ ID NO: 67648 - DNA, 25 bp, Homo sapien
aaacatatgccaaccctgagcaagg

SEQ ID NO: 67649 - DNA, 25 bp, Homo sapien
gggaactcctcaaaaaatcatgcag

SEQ ID NO: 67650 - DNA, 25 bp, Homo sapien
atcatgcagcggaaccttgtcaggt

SEQ ID NO: 67651 - DNA, 25 bp, Homo sapien
cttgtcaggtagagaagccgtgcat

SEQ ID NO: 67652 - DNA, 25 bp, Homo sapien
gaagccgtgcatgaaagaatttgtt

SEQ ID NO: 67653 - DNA, 25 bp, Homo sapien
aatgtcttgttttgcgtatgtgttt

SEQ ID NO: 67654 - DNA, 25 bp, Homo sapien
tctgtttgctcacccaggacctctg

SEQ ID NO: 67655 - DNA, 25 bp, Homo sapien
tgtttgctcacccaggacctctggg

SEQ ID NO: 67656 - DNA, 25 bp, Homo sapien
gtttgctcacccaggacctctgggg

SEQ ID NO: 67657 - DNA, 25 bp, Homo sapien
tttgctcacccaggacctctggggg

SEQ ID NO: 67658 - DNA, 25 bp, Homo sapien
ttgctcacccaggacctctgggggt

SEQ ID NO: 67659 - DNA, 25 bp, Homo sapien
tgctcacccaggacctctgggggtt

SEQ ID NO: 67660 - DNA, 25 bp, Homo sapien
tcacccaggacctctgggggttgtt

SEQ ID NO: 67661 - DNA, 25 bp, Homo sapien
ccaaggcgtgcaggggcggtccaga

SEQ ID NO: 67662 - DNA, 25 bp, Homo sapien
cgtgcaggggcggtccagaggaggt

SEQ ID NO: 67663 - DNA, 25 bp, Homo sapien
tgcgctgccctgcaaaccgtgaggt

SEQ ID NO: 67664 - DNA, 25 bp, Homo sapien
gcgctgccctgcaaaccgtgaggtc

SEQ ID NO: 67665 - DNA, 25 bp, Homo sapien
gattttttcaagtttagttcaacat

SEQ ID NO: 67666 - DNA, 25 bp, Homo sapien
tagttcaacattatactacctttaa

SEQ ID NO: 67667 - DNA, 25 bp, Homo sapien
aaggcagactgttaagattgtagta

SEQ ID NO: 67668 - DNA, 25 bp, Homo sapien
gtagtagtgctgactctaactttca

SEQ ID NO: 67669 - DNA, 25 bp, Homo sapien
ctaactttcagcattcacttcataa

SEQ ID NO: 67670 - DNA, 25 bp, Homo sapien
agcattcacttcataattgtccaaa

SEQ ID NO: 67671 - DNA, 25 bp, Homo sapien
ccacatcagtgagctttactgaagg

SEQ ID NO: 67672 - DNA, 25 bp, Homo sapien
gtgagctttactgaagggtgaaata

SEQ ID NO: 67673 - DNA, 25 bp, Homo sapien
aagcaaattacaacaccaaaaccat

SEQ ID NO: 67674 - DNA, 25 bp, Homo sapien
aagaatgacctttatgtctataaaa

SEQ ID NO: 67675 - DNA, 25 bp, Homo sapien
tttttacctgtggaatttcaataat

SEQ ID NO: 67676 - DNA, 25 bp, Homo sapien
tacatgtttggtgatacagatgcaa

SEQ ID NO: 67677 - DNA, 25 bp, Homo sapien
gttgagtcttttgactttactaaag

SEQ ID NO: 67678 - DNA, 25 bp, Homo sapien
gactttactaaaggtgctgaatagc

SEQ ID NO: 67679 - DNA, 25 bp, Homo sapien
ggtgctgaatagcattaaattcact

SEQ ID NO: 67680 - DNA, 25 bp, Homo sapien
atgcactaaggttgggtagaagttc

SEQ ID NO: 67681 - DNA, 25 bp, Homo sapien
gtagaagttctgtttgcactcacta

SEQ ID NO: 67682 - DNA, 25 bp, Homo sapien
agttctgtttgcactcactaattgt

SEQ ID NO: 67683 - DNA, 25 bp, Homo sapien
tcactaattgtgacagacagaggtt

SEQ ID NO: 67684 - DNA, 25 bp, Homo sapien
gcatgtttatttttagcgttgttat

SEQ ID NO: 67685 - DNA, 25 bp, Homo sapien
tttagcgttgttattgcctctggtg

SEQ ID NO: 67686 - DNA, 25 bp, Homo sapien
cgttgttattgcctctggtgttaat

SEQ ID NO: 67687 - DNA, 25 bp, Homo sapien
aggaatttgatgttacagtgaggta

SEQ ID NO: 67688 - DNA, 25 bp, Homo sapien
ttaactcttctaataatgttttgtt

SEQ ID NO: 67689 - DNA, 25 bp, Homo sapien
aataatgttttgttgcaggaaatgt

SEQ ID NO: 67690 - DNA, 25 bp, Homo sapien
gttttgttgcaggaaatgtatttca

SEQ ID NO: 67691 - DNA, 25 bp, Homo sapien
atgtgaatcatcttgtctaaatagc

SEQ ID NO: 67692 - DNA, 25 bp, Homo sapien
gtgaatcatcttgtctaaatagctt

SEQ ID NO: 67693 - DNA, 25 bp, Homo sapien
tcatcttgtctaaatagcttacagc

SEQ ID NO: 67694 - DNA, 25 bp, Homo sapien
aatagcttacagcatagttggctta

SEQ ID NO: 67695 - DNA, 25 bp, Homo sapien
tagcttacagcatagttggcttaaa

SEQ ID NO: 67696 - DNA, 25 bp, Homo sapien
tacagcatagttggcttaaatgaaa

SEQ ID NO: 67697 - DNA, 25 bp, Homo sapien
atgatatgcttatacatttggaaaa

SEQ ID NO: 67698 - DNA, 25 bp, Homo sapien
atgcattactgtgcagtgccaccca

SEQ ID NO: 67699 - DNA, 25 bp, Homo sapien
agggtgccatgttccaggttgccca

SEQ ID NO: 67700 - DNA, 25 bp, Homo sapien
ttacgacttacatctgcgcagccaa

SEQ ID NO: 67701 - DNA, 25 bp, Homo sapien
gcagccaatctctcacaatgcaaga

SEQ ID NO: 67702 - DNA, 25 bp, Homo sapien
aataaacagtggtcattcacctccc

SEQ ID NO: 67703 - DNA, 25 bp, Homo sapien
attcacctcccctgtctaattaaga

SEQ ID NO: 67704 - DNA, 25 bp, Homo sapien
aagcagatgcttgtgggctgagtaa

SEQ ID NO: 67705 - DNA, 25 bp, Homo sapien
tgggctgagtaattggcacaactct

SEQ ID NO: 67706 - DNA, 25 bp, Homo sapien
ggcacaactctatctaaggtgttta

SEQ ID NO: 67707 - DNA, 25 bp, Homo sapien
aaggtgtttactagtttctgcagtg

SEQ ID NO: 67708 - DNA, 25 bp, Homo sapien
gtttctgcagtgtgtttcaactatt

SEQ ID NO: 67709 - DNA, 25 bp, Homo sapien
tctgcaaaaagcccgcagcctgctt

SEQ ID NO: 67710 - DNA, 25 bp, Homo sapien
agcctgcttcagagacgaatagttg

SEQ ID NO: 67711 - DNA, 25 bp, Homo sapien
gacgaatagttgtttccctgctagc

SEQ ID NO: 67712 - DNA, 25 bp, Homo sapien
atagttgtttccctgctagcctcag

SEQ ID NO: 67713 - DNA, 25 bp, Homo sapien
tagcctcagcctccattgtggtata

SEQ ID NO: 67714 - DNA, 25 bp, Homo sapien
ctcagcctccattgtggtatagcag

SEQ ID NO: 67715 - DNA, 25 bp, Homo sapien
cctccattgtggtatagcagaactt

SEQ ID NO: 67716 - DNA, 25 bp, Homo sapien
cattgtggtatagcagaacttcacc

SEQ ID NO: 67717 - DNA, 25 bp, Homo sapien
gcatggaggctccatacaacctctt

SEQ ID NO: 67718 - DNA, 25 bp, Homo sapien
acatctttctttgtcctatacatgt

SEQ ID NO: 67719 - DNA, 25 bp, Homo sapien
tctttgtcctatacatgtcttccat

SEQ ID NO: 67720 - DNA, 25 bp, Homo sapien
aacaatggcattgtcataggccttc

SEQ ID NO: 67721 - DNA, 25 bp, Homo sapien
gtcataggccttccttttactagta

SEQ ID NO: 67722 - DNA, 25 bp, Homo sapien
ggccttccttttactagtagggcat

SEQ ID NO: 67723 - DNA, 25 bp, Homo sapien
atgaagtctctttctgatcacgaac

SEQ ID NO: 67724 - DNA, 25 bp, Homo sapien
gatcacgaacaatagcttgcgctct

SEQ ID NO: 67725 - DNA, 25 bp, Homo sapien
aatagcttgcgctctactctgtagt

SEQ ID NO: 67726 - DNA, 25 bp, Homo sapien
tactctgtagttatgtggattgccg

SEQ ID NO: 67727 - DNA, 25 bp, Homo sapien
gtggattgccgagcaatgacccttt

SEQ ID NO: 67728 - DNA, 25 bp, Homo sapien
gagcaatgacccttttcaatttctt

SEQ ID NO: 67729 - DNA, 25 bp, Homo sapien
gtgttactgaggaccctaatcactt

SEQ ID NO: 67730 - DNA, 25 bp, Homo sapien
tgtacagtttttcttatagtctaat

SEQ ID NO: 67731 - DNA, 25 bp, Homo sapien
caatattttaggtgggctgcgagct

SEQ ID NO: 67732 - DNA, 25 bp, Homo sapien
tgcagtcagccttcacgtctggcct

SEQ ID NO: 67733 - DNA, 25 bp, Homo sapien
tgtcagtgccgctctgcgtgtgcgt

SEQ ID NO: 67734 - DNA, 25 bp, Homo sapien
gcgtgtgtgagcctctacacatata

SEQ ID NO: 67735 - DNA, 25 bp, Homo sapien
gtacagagccttaaaccacatcgtg

SEQ ID NO: 67736 - DNA, 25 bp, Homo sapien
ttaaaccacatcgtggcggtgccgt

SEQ ID NO: 67737 - DNA, 25 bp, Homo sapien
acatcgtggcggtgccgtctgagct

SEQ ID NO: 67738 - DNA, 25 bp, Homo sapien
agctgtagcgggtggctttgtttcc

SEQ ID NO: 67739 - DNA, 25 bp, Homo sapien
tagcgggtggctttgtttccagttt

SEQ ID NO: 67740 - DNA, 25 bp, Homo sapien
tccagtttttgtacccgtgtccttg

SEQ ID NO: 67741 - DNA, 25 bp, Homo sapien
gggatgtgtctgtgttccacacctt

SEQ ID NO: 67742 - DNA, 25 bp, Homo sapien
cttttactaaacagtggcagcagat

SEQ ID NO: 67743 - DNA, 25 bp, Homo sapien
acagtggcagcagattttaagttaa

SEQ ID NO: 67744 - DNA, 25 bp, Homo sapien
tagccactataattctgtaggccaa

SEQ ID NO: 67745 - DNA, 25 bp, Homo sapien
ctgtaggccaaattttatattgagt

SEQ ID NO: 67746 - DNA, 25 bp, Homo sapien
ttatattgagtttagctgttttctc

SEQ ID NO: 67747 - DNA, 25 bp, Homo sapien
tttctcaaaatttagcagagtggtt

SEQ ID NO: 67748 - DNA, 25 bp, Homo sapien
aaaattctgtgctgataagtaactg

SEQ ID NO: 67749 - DNA, 25 bp, Homo sapien
ttctgtgctgataagtaactgatac

SEQ ID NO: 67750 - DNA, 25 bp, Homo sapien
aacataacaaagttgcctagttgat

SEQ ID NO: 67751 - DNA, 25 bp, Homo sapien
aaagttgcctagttgatgtaacagt

SEQ ID NO: 67752 - DNA, 25 bp, Homo sapien
tgcctagttgatgtaacagtggaaa

SEQ ID NO: 67753 - DNA, 25 bp, Homo sapien
gaggcgcagtggacggcaaacttac

SEQ ID NO: 67754 - DNA, 25 bp, Homo sapien
tggacggcaaacttacagccggtat

SEQ ID NO: 67755 - DNA, 25 bp, Homo sapien
acttacagccggtatcagaccttgg

SEQ ID NO: 67756 - DNA, 25 bp, Homo sapien
gccggtatcagaccttggaactaga

SEQ ID NO: 67757 - DNA, 25 bp, Homo sapien
taatccttatttgacacgaaaacgt

SEQ ID NO: 67758 - DNA, 25 bp, Homo sapien
gaaaacgtcggattgaagtctctca

SEQ ID NO: 67759 - DNA, 25 bp, Homo sapien
attgaagtctctcatgccctgggac

SEQ ID NO: 67760 - DNA, 25 bp, Homo sapien
tcatgccctgggactgaccgagaga

SEQ ID NO: 67761 - DNA, 25 bp, Homo sapien
ctgggactgaccgagagacaagtga

SEQ ID NO: 67762 - DNA, 25 bp, Homo sapien
caaggataaactgccgggagcccga

SEQ ID NO: 67763 - DNA, 25 bp, Homo sapien
taaactgccgggagcccgagatgag

SEQ ID NO: 67764 - DNA, 25 bp, Homo sapien
ctcatttcttatccccgccaagggt

SEQ ID NO: 67765 - DNA, 25 bp, Homo sapien
ccgccaagggtttcctctcagtcat

SEQ ID NO: 67766 - DNA, 25 bp, Homo sapien
gtcatttgtttaccagaaacatgaa

SEQ ID NO: 67767 - DNA, 25 bp, Homo sapien
catgaaaactgcctgtctggccggg

SEQ ID NO: 67768 - DNA, 25 bp, Homo sapien
atgaaaactgcctgtctggccgggc

SEQ ID NO: 67769 - DNA, 25 bp, Homo sapien
gaaaactgcctgtctggccgggccg

SEQ ID NO: 67770 - DNA, 25 bp, Homo sapien
aaactgcctgtctggccgggccgca

SEQ ID NO: 67771 - DNA, 25 bp, Homo sapien
ggaccctttcactgccccggtggag

SEQ ID NO: 67772 - DNA, 25 bp, Homo sapien
ttcactgccccggtggagtgaatag

SEQ ID NO: 67773 - DNA, 25 bp, Homo sapien
cactgccccggtggagtgaatagag

SEQ ID NO: 67774 - DNA, 25 bp, Homo sapien
tcgcagccccattaaagcgctctca

SEQ ID NO: 67775 - DNA, 25 bp, Homo sapien
aattacgctttggaggacttcttct

SEQ ID NO: 67776 - DNA, 25 bp, Homo sapien
acgctttggaggacttcttctaaca

SEQ ID NO: 67777 - DNA, 25 bp, Homo sapien
ttggaggacttcttctaacagaaaa

SEQ ID NO: 67778 - DNA, 25 bp, Homo sapien
tcaagggatgagacctttgtagata

SEQ ID NO: 67779 - DNA, 25 bp, Homo sapien
gggatgagacctttgtagatatgga

SEQ ID NO: 67780 - DNA, 25 bp, Homo sapien
tgtagatatggagcccattcacatg

SEQ ID NO: 67781 - DNA, 25 bp, Homo sapien
agatatggagcccattcacatggac

SEQ ID NO: 67782 - DNA, 25 bp, Homo sapien
ttgggaactactttgtcctaccatc

SEQ ID NO: 67783 - DNA, 25 bp, Homo sapien
gaactactttgtcctaccatcagat

SEQ ID NO: 67784 - DNA, 25 bp, Homo sapien
tactttgtcctaccatcagatcccg

SEQ ID NO: 67785 - DNA, 25 bp, Homo sapien
ttgtcctaccatcagatcccgctga

SEQ ID NO: 67786 - DNA, 25 bp, Homo sapien
aaggccttgaaaatccgcctgcaag

SEQ ID NO: 67787 - DNA, 25 bp, Homo sapien
aaaccaccccactcatagagtacta

SEQ ID NO: 67788 - DNA, 25 bp, Homo sapien
atgtcgtgttcgcaagcatcctagc

SEQ ID NO: 67789 - DNA, 25 bp, Homo sapien
tctccaaagccacatgtaaagactt

SEQ ID NO: 67790 - DNA, 25 bp, Homo sapien
gtaaagacttggttatgtttatcta

SEQ ID NO: 67791 - DNA, 25 bp, Homo sapien
atgtttatctaatgttgggtccaag

SEQ ID NO: 67792 - DNA, 25 bp, Homo sapien
tgttgggtccaagaaggaatttctt

SEQ ID NO: 67793 - DNA, 25 bp, Homo sapien
tttccatccctgtgaggcaatgggt

SEQ ID NO: 67794 - DNA, 25 bp, Homo sapien
ggacaggcaaagagaagcttcctca

SEQ ID NO: 67795 - DNA, 25 bp, Homo sapien
gagaagcttcctcaggctagcaaaa

SEQ ID NO: 67796 - DNA, 25 bp, Homo sapien
ttcctcaggctagcaaaaatatcat

SEQ ID NO: 67797 - DNA, 25 bp, Homo sapien
tgaacagtttgcagccatcattgtg

SEQ ID NO: 67798 - DNA, 25 bp, Homo sapien
ccatcattgtgcttggctttgcaac

SEQ ID NO: 67799 - DNA, 25 bp, Homo sapien
tgtgcttggctttgcaactttgtcc

SEQ ID NO: 67800 - DNA, 25 bp, Homo sapien
tgcctttatattacagtacttctta

SEQ ID NO: 67801 - DNA, 25 bp, Homo sapien
gaggtatgaattaatgctacacatt

SEQ ID NO: 67802 - DNA, 25 bp, Homo sapien
cacacatttattcagatactcccct

SEQ ID NO: 67803 - DNA, 25 bp, Homo sapien
catttattcagatactccccttttt

SEQ ID NO: 67804 - DNA, 25 bp, Homo sapien
ttgatttatatactctgttttacag

SEQ ID NO: 67805 - DNA, 25 bp, Homo sapien
tctgttttacagatttagctagaaa

SEQ ID NO: 67806 - DNA, 25 bp, Homo sapien
aaatgtcagtgttttggtgcacctt

SEQ ID NO: 67807 - DNA, 25 bp, Homo sapien
gttttggtgcacctttttgaaatgc

SEQ ID NO: 67808 - DNA, 25 bp, Homo sapien
cgtgtgtgtgcgtgccagcgaaggc

SEQ ID NO: 67809 - DNA, 25 bp, Homo sapien
gaaggctgctgtgggcgtgtgtgtc

SEQ ID NO: 67810 - DNA, 25 bp, Homo sapien
cgtgtgtgtcaagtgggccacgcgt

SEQ ID NO: 67811 - DNA, 25 bp, Homo sapien
gccacgcgtgcagggtgtgtgtcca

SEQ ID NO: 67812 - DNA, 25 bp, Homo sapien
gtgtgtgtccacgagcgacgatcgt

SEQ ID NO: 67813 - DNA, 25 bp, Homo sapien
cacgagcgacgatcgtggtggcccc

SEQ ID NO: 67814 - DNA, 25 bp, Homo sapien
ggcctgggcgttggctgagccgacg

SEQ ID NO: 67815 - DNA, 25 bp, Homo sapien
tccgaggtgccggttaggagtttga

SEQ ID NO: 67816 - DNA, 25 bp, Homo sapien
gggtttcaggcaggagacacgagga

SEQ ID NO: 67817 - DNA, 25 bp, Homo sapien
agggcctgcccggaagtcacatcgg

SEQ ID NO: 67818 - DNA, 25 bp, Homo sapien
aagtcacatcggcagcagctgtcta

SEQ ID NO: 67819 - DNA, 25 bp, Homo sapien
aatgacttcttaattcctgccttta

SEQ ID NO: 67820 - DNA, 25 bp, Homo sapien
aattcctgcctttagtgtcaacttt

SEQ ID NO: 67821 - DNA, 25 bp, Homo sapien
gttaatacaggtttcaattgtggca

SEQ ID NO: 67822 - DNA, 25 bp, Homo sapien
acaggtttcaattgtggcattagga

SEQ ID NO: 67823 - DNA, 25 bp, Homo sapien
aaaaaaccttgtgatgctatggttg

SEQ ID NO: 67824 - DNA, 25 bp, Homo sapien
gactacatgaaattgtgtgccccta

SEQ ID NO: 67825 - DNA, 25 bp, Homo sapien
tacatgaaattgtgtgcccctattt

SEQ ID NO: 67826 - DNA, 25 bp, Homo sapien
ttctttctgatcctaaatcattttg

SEQ ID NO: 67827 - DNA, 25 bp, Homo sapien
aatcagctatagcatctttctagaa

SEQ ID NO: 67828 - DNA, 25 bp, Homo sapien
gcatctttctagaattaatcctgaa

SEQ ID NO: 67829 - DNA, 25 bp, Homo sapien
gaattaatcctgaatatgttgaatg

SEQ ID NO: 67830 - DNA, 25 bp, Homo sapien
tgatatggtcttccaatcagtgtgt

SEQ ID NO: 67831 - DNA, 25 bp, Homo sapien
tatggtcttccaatcagtgtgtgta

SEQ ID NO: 67832 - DNA, 25 bp, Homo sapien
ggtcttccaatcagtgtgtgtaaca

SEQ ID NO: 67833 - DNA, 25 bp, Homo sapien
tccaatcagtgtgtgtaacatacct

SEQ ID NO: 67834 - DNA, 25 bp, Homo sapien
gtaacatacctgttgtttatcagcc

SEQ ID NO: 67835 - DNA, 25 bp, Homo sapien
ttgtttatcagccattgtaggtggc

SEQ ID NO: 67836 - DNA, 25 bp, Homo sapien
ttatcagccattgtaggtggctgtg

SEQ ID NO: 67837 - DNA, 25 bp, Homo sapien
gctgtgtctgttgcatcatcataag

SEQ ID NO: 67838 - DNA, 25 bp, Homo sapien
gtctgttgcatcatcataagaagtt

SEQ ID NO: 67839 - DNA, 25 bp, Homo sapien
aagaagtttaagctttgtgctctga

SEQ ID NO: 67840 - DNA, 25 bp, Homo sapien
gttctgttaaagaggttagtaggat

SEQ ID NO: 67841 - DNA, 25 bp, Homo sapien
aattacgctttggaggacttcttct

SEQ ID NO: 67842 - DNA, 25 bp, Homo sapien
attacgctttggaggacttcttcta

SEQ ID NO: 67843 - DNA, 25 bp, Homo sapien
ttacgctttggaggacttcttctaa

SEQ ID NO: 67844 - DNA, 25 bp, Homo sapien
tacgctttggaggacttcttctaac

SEQ ID NO: 67845 - DNA, 25 bp, Homo sapien
acgctttggaggacttcttctaaca

SEQ ID NO: 67846 - DNA, 25 bp, Homo sapien
cgctttggaggacttcttctaacag

SEQ ID NO: 67847 - DNA, 25 bp, Homo sapien
gctttggaggacttcttctaacaga

SEQ ID NO: 67848 - DNA, 25 bp, Homo sapien
ctttggaggacttcttctaacagaa

SEQ ID NO: 67849 - DNA, 25 bp, Homo sapien
tttggaggacttcttctaacagaaa

SEQ ID NO: 67850 - DNA, 25 bp, Homo sapien
ttggaggacttcttctaacagaaaa

SEQ ID NO: 67851 - DNA, 25 bp, Homo sapien
cagatgataatgaaaaggccttgaa

SEQ ID NO: 67852 - DNA, 25 bp, Homo sapien
aaggccttgaaaatccgcctgcaag

SEQ ID NO: 67853 - DNA, 25 bp, Homo sapien
tgaaaatccgcctgcaagcctacca

SEQ ID NO: 67854 - DNA, 25 bp, Homo sapien
aaaccaccccactcatagagtacta

SEQ ID NO: 67855 - DNA, 25 bp, Homo sapien
accccactcatagagtactacagga

SEQ ID NO: 67856 - DNA, 25 bp, Homo sapien
ctcatagagtactacaggaaacggg

SEQ ID NO: 67857 - DNA, 25 bp, Homo sapien
cgatgtcgtgttcgcaagcatccta

SEQ ID NO: 67858 - DNA, 25 bp, Homo sapien
atgtcgtgttcgcaagcatcctagc

SEQ ID NO: 67859 - DNA, 25 bp, Homo sapien
gtcgtgttcgcaagcatcctagcag

SEQ ID NO: 67860 - DNA, 25 bp, Homo sapien
gtgttcgcaagcatcctagcagcct

SEQ ID NO: 67861 - DNA, 25 bp, Homo sapien
ttcgcaagcatcctagcagccttct

SEQ ID NO: 67862 - DNA, 25 bp, Homo sapien
caagaaactgggaccttcccctcat

SEQ ID NO: 67863 - DNA, 25 bp, Homo sapien
tcatcctaggcccaggacccattat

SEQ ID NO: 67864 - DNA, 25 bp, Homo sapien
tcctaggcccaggacccattatggg

SEQ ID NO: 67865 - DNA, 25 bp, Homo sapien
acaggagctgaagggctcccagggc

SEQ ID NO: 67866 - DNA, 25 bp, Homo sapien
caggatattcagaggtaggcagcca

SEQ ID NO: 67867 - DNA, 25 bp, Homo sapien
gatattcagaggtaggcagccaaag

SEQ ID NO: 67868 - DNA, 25 bp, Homo sapien
taggcagccaaagggcacagaaccc

SEQ ID NO: 67869 - DNA, 25 bp, Homo sapien
cagccaaagggcacagaaccctgtg

SEQ ID NO: 67870 - DNA, 25 bp, Homo sapien
aaagggcacagaaccctgtgcccca

SEQ ID NO: 67871 - DNA, 25 bp, Homo sapien
ccaccaggattggcctgctgctagg

SEQ ID NO: 67872 - DNA, 25 bp, Homo sapien
ctgaccaggaagacaggtgggttcc

SEQ ID NO: 67873 - DNA, 25 bp, Homo sapien
gactgactggtcttgttattggtgg

SEQ ID NO: 67874 - DNA, 25 bp, Homo sapien
attggtggtctataccctgttttct

SEQ ID NO: 67875 - DNA, 25 bp, Homo sapien
gttttcttggctatacctgtaaatg

SEQ ID NO: 67876 - DNA, 25 bp, Homo sapien
aatggtggtctagcagccaggtatc

SEQ ID NO: 67877 - DNA, 25 bp, Homo sapien
gccaggtatcaatcagctctgttac

SEQ ID NO: 67878 - DNA, 25 bp, Homo sapien
atcagctctgttaccacacaaaggg

SEQ ID NO: 67879 - DNA, 25 bp, Homo sapien
agggaacatcttaagttactggatt

SEQ ID NO: 67880 - DNA, 25 bp, Homo sapien
gatgttatttcctattttgctccag

SEQ ID NO: 67881 - DNA, 25 bp, Homo sapien
ttgctccagactatgttttcagcat

SEQ ID NO: 67882 - DNA, 25 bp, Homo sapien
atgttttcagcataccttgggtctg

SEQ ID NO: 67883 - DNA, 25 bp, Homo sapien
aaggcccttcagttatctgaacctg

SEQ ID NO: 67884 - DNA, 25 bp, Homo sapien
tctgcttcgagtcctggtcttaaag

SEQ ID NO: 67885 - DNA, 25 bp, Homo sapien
ctggtcttaaaggtagtcagaggca

SEQ ID NO: 67886 - DNA, 25 bp, Homo sapien
aggcagaggctggattaaacacaca

SEQ ID NO: 67887 - DNA, 25 bp, Homo sapien
acacacactgtttaccaagtgccac

SEQ ID NO: 67888 - DNA, 25 bp, Homo sapien
aagtgccactctcagaccacctgag

SEQ ID NO: 67889 - DNA, 25 bp, Homo sapien
tttcccttgttcgtgtatgttctgc

SEQ ID NO: 67890 - DNA, 25 bp, Homo sapien
atgttctgctgatccgtggcctgaa

SEQ ID NO: 67891 - DNA, 25 bp, Homo sapien
tggcctgaaggttcctagagacgtc

SEQ ID NO: 67892 - DNA, 25 bp, Homo sapien
tatcttacactgtgattctgtgagg

SEQ ID NO: 67893 - DNA, 25 bp, Homo sapien
gactggtaacccaaaactctcttct

SEQ ID NO: 67894 - DNA, 25 bp, Homo sapien
aactctcttctctaatgtatttttt

SEQ ID NO: 67895 - DNA, 25 bp, Homo sapien
tccgaggtgccggttaggagtttga

SEQ ID NO: 67896 - DNA, 25 bp, Homo sapien
gggtttcaggcaggagacacgagga

SEQ ID NO: 67897 - DNA, 25 bp, Homo sapien
ttcaggcaggagacacgaggagggc

SEQ ID NO: 67898 - DNA, 25 bp, Homo sapien
agggcctgcccggaagtcacatcgg

SEQ ID NO: 67899 - DNA, 25 bp, Homo sapien
gggcctgcccggaagtcacatcggc

SEQ ID NO: 67900 - DNA, 25 bp, Homo sapien
ggcctgcccggaagtcacatcggca

SEQ ID NO: 67901 - DNA, 25 bp, Homo sapien
tgcccggaagtcacatcggcagcag

SEQ ID NO: 67902 - DNA, 25 bp, Homo sapien
gcccggaagtcacatcggcagcagc

SEQ ID NO: 67903 - DNA, 25 bp, Homo sapien
ccggaagtcacatcggcagcagctg

SEQ ID NO: 67904 - DNA, 25 bp, Homo sapien
cggaagtcacatcggcagcagctgt

SEQ ID NO: 67905 - DNA, 25 bp, Homo sapien
aagtcacatcggcagcagctgtcta

SEQ ID NO: 67906 - DNA, 25 bp, Homo sapien
gcccgccggcggaaatgaatgctga

SEQ ID NO: 67907 - DNA, 25 bp, Homo sapien
gaaatgaatgctgataccctagtag

SEQ ID NO: 67908 - DNA, 25 bp, Homo sapien
atgaatgctgataccctagtagtcc

SEQ ID NO: 67909 - DNA, 25 bp, Homo sapien
tgaatgctgataccctagtagtccc

SEQ ID NO: 67910 - DNA, 25 bp, Homo sapien
aatgctgataccctagtagtcccca

SEQ ID NO: 67911 - DNA, 25 bp, Homo sapien
atgctgataccctagtagtccccag

SEQ ID NO: 67912 - DNA, 25 bp, Homo sapien
tgctgataccctagtagtccccagc

SEQ ID NO: 67913 - DNA, 25 bp, Homo sapien
agtagtccccagctcccaaacactg

SEQ ID NO: 67914 - DNA, 25 bp, Homo sapien
aaacgtgaaaacactcaaggcctag

SEQ ID NO: 67915 - DNA, 25 bp, Homo sapien
acgtgaaaacactcaaggcctaggg

SEQ ID NO: 67916 - DNA, 25 bp, Homo sapien
ggaggacaggttggtaaaacatgaa

SEQ ID NO: 67917 - DNA, 25 bp, Homo sapien
agctccgtggcagcggtcactaagg

SEQ ID NO: 67918 - DNA, 25 bp, Homo sapien
gcagcggtcactaaggacagcctga

SEQ ID NO: 67919 - DNA, 25 bp, Homo sapien
aggacagcctgactgtgccatcttg

SEQ ID NO: 67920 - DNA, 25 bp, Homo sapien
gcctgactgtgccatcttggagcct

SEQ ID NO: 67921 - DNA, 25 bp, Homo sapien
gctccggagatagaagacaggtcgc

SEQ ID NO: 67922 - DNA, 25 bp, Homo sapien
atagaagacaggtcgccggaggctc

SEQ ID NO: 67923 - DNA, 25 bp, Homo sapien
tctgcagatgctccctgggcgctac

SEQ ID NO: 67924 - DNA, 25 bp, Homo sapien
aggagtggtctcagaacgtgcgctt

SEQ ID NO: 67925 - DNA, 25 bp, Homo sapien
gaacgtgcgcttctgattattttac

SEQ ID NO: 67926 - DNA, 25 bp, Homo sapien
gggtccattgtccagatttttcttt

SEQ ID NO: 67927 - DNA, 25 bp, Homo sapien
gtccagatttttctttgattgtaaa

SEQ ID NO: 67928 - DNA, 25 bp, Homo sapien
tgcggactgacctgcgggcttgctt

SEQ ID NO: 67929 - DNA, 25 bp, Homo sapien
gacctgcgggcttgcttgctgactc

SEQ ID NO: 67930 - DNA, 25 bp, Homo sapien
gggcttgcttgctgactcctctcaa

SEQ ID NO: 67931 - DNA, 25 bp, Homo sapien
gggaggaggctcaccggaccctggg

SEQ ID NO: 67932 - DNA, 25 bp, Homo sapien
tgagcttgggacaccagcgggaaca

SEQ ID NO: 67933 - DNA, 25 bp, Homo sapien
tgacttccagatcatggttctccct

SEQ ID NO: 67934 - DNA, 25 bp, Homo sapien
ttcctccctgaggacaccaaattgg

SEQ ID NO: 67935 - DNA, 25 bp, Homo sapien
caccaaattggatgagagcaagttt

SEQ ID NO: 67936 - DNA, 25 bp, Homo sapien
gaatgaatcaactgctatccttccc

SEQ ID NO: 67937 - DNA, 25 bp, Homo sapien
gcccaggagggaaagggcattttct

SEQ ID NO: 67938 - DNA, 25 bp, Homo sapien
tttcatctttgaaaggcattgtggg

SEQ ID NO: 67939 - DNA, 25 bp, Homo sapien
tccgctaaggcttccggctgagctg

SEQ ID NO: 67940 - DNA, 25 bp, Homo sapien
ccgctaaggcttccggctgagctgt

SEQ ID NO: 67941 - DNA, 25 bp, Homo sapien
aaggcttccggctgagctgtgccag

SEQ ID NO: 67942 - DNA, 25 bp, Homo sapien
gcttccggctgagctgtgccagctg

SEQ ID NO: 67943 - DNA, 25 bp, Homo sapien
tctgggctcacaccagccctggtgg

SEQ ID NO: 67944 - DNA, 25 bp, Homo sapien
ggccactctgtttgctcacccagga

SEQ ID NO: 67945 - DNA, 25 bp, Homo sapien
tgtttgctcacccaggacctctggg

SEQ ID NO: 67946 - DNA, 25 bp, Homo sapien
gggcccgagggtcccaaggcgtgca

SEQ ID NO: 67947 - DNA, 25 bp, Homo sapien
ttcgccatgtgctgtgcacccgtgc

SEQ ID NO: 67948 - DNA, 25 bp, Homo sapien
atgtgctgtgcacccgtgccacgcg

SEQ ID NO: 67949 - DNA, 25 bp, Homo sapien
gctgcgctgccctgcaaaccgtgag

SEQ ID NO: 67950 - DNA, 25 bp, Homo sapien
tcctccgcctgctgtatattacctg

SEQ ID NO: 67951 - DNA, 25 bp, Homo sapien
acctgagctggtgttgtatcttcaa

SEQ ID NO: 67952 - DNA, 25 bp, Homo sapien
gtatcttcaagtccatatgcgtatt

SEQ ID NO: 67953 - DNA, 25 bp, Homo sapien
tatgcgtatttgcagacctttcctg

SEQ ID NO: 67954 - DNA, 25 bp, Homo sapien
actcttgttggctcttctgatttat

SEQ ID NO: 67955 - DNA, 25 bp, Homo sapien
tgatttatgcacagatggttcccag

SEQ ID NO: 67956 - DNA, 25 bp, Homo sapien
gcacagatggttcccagcatgtgtc

SEQ ID NO: 67957 - DNA, 25 bp, Homo sapien
agcatgtgtccagtgcttcatggat

SEQ ID NO: 67958 - DNA, 25 bp, Homo sapien
ggatgggaccatcccagcaactaat

SEQ ID NO: 67959 - DNA, 25 bp, Homo sapien
aactaatcagacttcctgccagtgt

SEQ ID NO: 67960 - DNA, 25 bp, Homo sapien
ggcaccctgttcaaccatatttaaa

SEQ ID NO: 67961 - DNA, 25 bp, Homo sapien
ttatttttcctagagtcaaccaaag

SEQ ID NO: 67962 - DNA, 25 bp, Homo sapien
tttcctagagtcaaccaaagatcag

SEQ ID NO: 67963 - DNA, 25 bp, Homo sapien
ctagagtcaaccaaagatcagcatg

SEQ ID NO: 67964 - DNA, 25 bp, Homo sapien
caaagatcagcatggtccctgttgt

SEQ ID NO: 67965 - DNA, 25 bp, Homo sapien
atggtccctgttgttctaaagctaa

SEQ ID NO: 67966 - DNA, 25 bp, Homo sapien
tggtccctgttgttctaaagctaaa

SEQ ID NO: 67967 - DNA, 25 bp, Homo sapien
ctcaaggaaaaggactcagtgcata

SEQ ID NO: 67968 - DNA, 25 bp, Homo sapien
aaaggactcagtgcataagatgact

SEQ ID NO: 67969 - DNA, 25 bp, Homo sapien
ggactcagtgcataagatgactttg

SEQ ID NO: 67970 - DNA, 25 bp, Homo sapien
ataagatgactttggtgaaaccccg

SEQ ID NO: 67971 - DNA, 25 bp, Homo sapien
taagatgactttggtgaaaccccgt

SEQ ID NO: 67972 - DNA, 25 bp, Homo sapien
ctccgctaaggcttccggctgagct

SEQ ID NO: 67973 - DNA, 25 bp, Homo sapien
tccgctaaggcttccggctgagctg

SEQ ID NO: 67974 - DNA, 25 bp, Homo sapien
tgcccaccccgcctctgggctcaca

SEQ ID NO: 67975 - DNA, 25 bp, Homo sapien
gcctctgggctcacaccagccctgg

SEQ ID NO: 67976 - DNA, 25 bp, Homo sapien
cctctgggctcacaccagccctggt

SEQ ID NO: 67977 - DNA, 25 bp, Homo sapien
gcctgccccggccactctgtttgct

SEQ ID NO: 67978 - DNA, 25 bp, Homo sapien
ctgccccggccactctgtttgctca

SEQ ID NO: 67979 - DNA, 25 bp, Homo sapien
tgccccggccactctgtttgctcac

SEQ ID NO: 67980 - DNA, 25 bp, Homo sapien
gccccggccactctgtttgctcacc

SEQ ID NO: 67981 - DNA, 25 bp, Homo sapien
cttcgccatgtgctgtgcacccgtg

SEQ ID NO: 67982 - DNA, 25 bp, Homo sapien
ttcgccatgtgctgtgcacccgtgc

SEQ ID NO: 67983 - DNA, 25 bp, Homo sapien
caaaaactggtatttcagatctgtt

SEQ ID NO: 67984 - DNA, 25 bp, Homo sapien
ttcagatctgttttctgaaatcttt

SEQ ID NO: 67985 - DNA, 25 bp, Homo sapien
ttttaagctaaaatcacatgcaaga

SEQ ID NO: 67986 - DNA, 25 bp, Homo sapien
aagaattgactttgcagctactaat

SEQ ID NO: 67987 - DNA, 25 bp, Homo sapien
gactttgcagctactaattttgaca

SEQ ID NO: 67988 - DNA, 25 bp, Homo sapien
gcagctactaattttgacacctttt

SEQ ID NO: 67989 - DNA, 25 bp, Homo sapien
tgtgttgtgttgaagcagcaaacca

SEQ ID NO: 67990 - DNA, 25 bp, Homo sapien
gttgaagcagcaaaccaatgagtgc

SEQ ID NO: 67991 - DNA, 25 bp, Homo sapien
ggattcatttataccatctaatata

SEQ ID NO: 67992 - DNA, 25 bp, Homo sapien
taccatctaatatatgacacactgt

SEQ ID NO: 67993 - DNA, 25 bp, Homo sapien
atatgacacactgttgtagtatgta

SEQ ID NO: 67994 - DNA, 25 bp, Homo sapien
cagtatgatccagaatgtcaggtgt

SEQ ID NO: 67995 - DNA, 25 bp, Homo sapien
gagtctgctgatgaggacaacctaa

SEQ ID NO: 67996 - DNA, 25 bp, Homo sapien
ggacaacctaaaagagcactggatt

SEQ ID NO: 67997 - DNA, 25 bp, Homo sapien
cagaagacctacctttgattcctgg

SEQ ID NO: 67998 - DNA, 25 bp, Homo sapien
agacctacctttgattcctggcttt

SEQ ID NO: 67999 - DNA, 25 bp, Homo sapien
tttgattcctggctttcccttaatg

SEQ ID NO: 68000 - DNA, 25 bp, Homo sapien
ggctttcccttaatggccatgtgat

SEQ ID NO: 68001 - DNA, 25 bp, Homo sapien
gatgttattaagtcacctctaaagc

SEQ ID NO: 68002 - DNA, 25 bp, Homo sapien
attaagtcacctctaaagctttagt

SEQ ID NO: 68003 - DNA, 25 bp, Homo sapien
aagctttagtttcctgtcagtcaaa

SEQ ID NO: 68004 - DNA, 25 bp, Homo sapien
aaatgttgacatgatacctacctca

SEQ ID NO: 68005 - DNA, 25 bp, Homo sapien
gggatgcctgggactttcctccggc

SEQ ID NO: 68006 - DNA, 25 bp, Homo sapien
ggatgcctgggactttcctccggcc

SEQ ID NO: 68007 - DNA, 25 bp, Homo sapien
gatgcctgggactttcctccggcct

SEQ ID NO: 68008 - DNA, 25 bp, Homo sapien
atgcctgggactttcctccggcctt

SEQ ID NO: 68009 - DNA, 25 bp, Homo sapien
tgcctgggactttcctccggccttt

SEQ ID NO: 68010 - DNA, 25 bp, Homo sapien
gggaagtggatgtctcctcccctcc

SEQ ID NO: 68011 - DNA, 25 bp, Homo sapien
ctgtgtattattgtgagcgaataaa

SEQ ID NO: 68012 - DNA, 25 bp, Homo sapien
attgtgagcgaataaacagagagac

SEQ ID NO: 68013 - DNA, 25 bp, Homo sapien
ttgtgagcgaataaacagagagacg

SEQ ID NO: 68014 - DNA, 25 bp, Homo sapien
gtgagcgaataaacagagagacgct

SEQ ID NO: 68015 - DNA, 25 bp, Homo sapien
gagcgaataaacagagagacgctaa

SEQ ID NO: 68016 - DNA, 25 bp, Homo sapien
gtcaaggcagctacttagagtctta

SEQ ID NO: 68017 - DNA, 25 bp, Homo sapien
tagagtcttaccctgtaaccacgag

SEQ ID NO: 68018 - DNA, 25 bp, Homo sapien
taaccacgagttccatgccaagtgt

SEQ ID NO: 68019 - DNA, 25 bp, Homo sapien
aggcaaatcgtacttgcccaatttg

SEQ ID NO: 68020 - DNA, 25 bp, Homo sapien
caatttgccgagctgatgcttcaga

SEQ ID NO: 68021 - DNA, 25 bp, Homo sapien
aagtgcatcgggattcagaatgacc

SEQ ID NO: 68022 - DNA, 25 bp, Homo sapien
ttgggtgttcctcatcacatgtata

SEQ ID NO: 68023 - DNA, 25 bp, Homo sapien
tacggactatccattgaacttaatc

SEQ ID NO: 68024 - DNA, 25 bp, Homo sapien
ttgaacttaatctgtgtggcttcca

SEQ ID NO: 68025 - DNA, 25 bp, Homo sapien
tcaatggacctttctttgcactgtg

SEQ ID NO: 68026 - DNA, 25 bp, Homo sapien
ttgcactgtgtgacttaatcaacta

SEQ ID NO: 68027 - DNA, 25 bp, Homo sapien
gcttaaagttgtgtatctgctattg

SEQ ID NO: 68028 - DNA, 25 bp, Homo sapien
tgtgtatctgctattgtgatgccaa

SEQ ID NO: 68029 - DNA, 25 bp, Homo sapien
ttgtgatgccaatgccggtgtttta

SEQ ID NO: 68030 - DNA, 25 bp, Homo sapien
gccaatgccggtgttttaagtggaa

SEQ ID NO: 68031 - DNA, 25 bp, Homo sapien
atgacctctttgatttgtgctgtgt

SEQ ID NO: 68032 - DNA, 25 bp, Homo sapien
tgctgtgtacacaagatttctggaa

SEQ ID NO: 68033 - DNA, 25 bp, Homo sapien
aaaccctttttatggctcacacagc

SEQ ID NO: 68034 - DNA, 25 bp, Homo sapien
atggctcacacagcttaagagtagc

SEQ ID NO: 68035 - DNA, 25 bp, Homo sapien
gagtagctgtctctcaaacgtgcgc

SEQ ID NO: 68036 - DNA, 25 bp, Homo sapien
aaacgtgcgctcacagttgagctgc

SEQ ID NO: 68037 - DNA, 25 bp, Homo sapien
gcgctcacagttgagctgcttttgt

SEQ ID NO: 68038 - DNA, 25 bp, Homo sapien
gataagtgcaagaaggctgcttcca

SEQ ID NO: 68039 - DNA, 25 bp, Homo sapien
tgcttccagctccaaagcacctaag

SEQ ID NO: 68040 - DNA, 25 bp, Homo sapien
gaaggattcagcaaagacaacagag

SEQ ID NO: 68041 - DNA, 25 bp, Homo sapien
aaacttccaagccaaaagatgacta

SEQ ID NO: 68042 - DNA, 25 bp, Homo sapien
caagttaaggtatctggtatctgca

SEQ ID NO: 68043 - DNA, 25 bp, Homo sapien
aggtatctggtatctgcatgtaaaa

SEQ ID NO: 68044 - DNA, 25 bp, Homo sapien
gcatgtaaaatcttcagctggtgga

SEQ ID NO: 68045 - DNA, 25 bp, Homo sapien
aagaacaaaaggctttggcaacaga

SEQ ID NO: 68046 - DNA, 25 bp, Homo sapien
gttctgggtgatttctagaatggtt

SEQ ID NO: 68047 - DNA, 25 bp, Homo sapien
gaatggtttttgttgagtctctgaa

SEQ ID NO: 68048 - DNA, 25 bp, Homo sapien
gagtctctgaacatcctaaatattg

SEQ ID NO: 68049 - DNA, 25 bp, Homo sapien
gacacacagtgacaaaaggctcgga

SEQ ID NO: 68050 - DNA, 25 bp, Homo sapien
agtgatctcaaatccactgacagat

SEQ ID NO: 68051 - DNA, 25 bp, Homo sapien
gaaaagctgcctctggtcaagtaga

SEQ ID NO: 68052 - DNA, 25 bp, Homo sapien
catggcagcatgaattccaactcac

SEQ ID NO: 68053 - DNA, 25 bp, Homo sapien
actccaacttctatgtttatctttg

SEQ ID NO: 68054 - DNA, 25 bp, Homo sapien
tcacttttttacaacctggccagag

SEQ ID NO: 68055 - DNA, 25 bp, Homo sapien
acaacctggccagaggcatttttta

SEQ ID NO: 68056 - DNA, 25 bp, Homo sapien
aatcaggcccaatatcagtattctt

SEQ ID NO: 68057 - DNA, 25 bp, Homo sapien
cagtattctttttgtgtgtgccaat

SEQ ID NO: 68058 - DNA, 25 bp, Homo sapien
gtgccaattttgttatcacatccct

SEQ ID NO: 68059 - DNA, 25 bp, Homo sapien
gttatcacatccctatgaagttgaa

SEQ ID NO: 68060 - DNA, 25 bp, Homo sapien
tgagatctaccctctggccgaggct

SEQ ID NO: 68061 - DNA, 25 bp, Homo sapien
gatctaccctctggccgaggctgag

SEQ ID NO: 68062 - DNA, 25 bp, Homo sapien
agatcagtggctgactctgcccgac

SEQ ID NO: 68063 - DNA, 25 bp, Homo sapien
tgactctgcccgacttcctctttgg

SEQ ID NO: 68064 - DNA, 25 bp, Homo sapien
acctccattccctgttgctgaaggc

SEQ ID NO: 68065 - DNA, 25 bp, Homo sapien
attccctgttgctgaaggccctcca

SEQ ID NO: 68066 - DNA, 25 bp, Homo sapien
agcatccccttaagcatctgtacat

SEQ ID NO: 68067 - DNA, 25 bp, Homo sapien
tccccttaagcatctgtacatactg

SEQ ID NO: 68068 - DNA, 25 bp, Homo sapien
atctgtacatactgtgtcccttcct

SEQ ID NO: 68069 - DNA, 25 bp, Homo sapien
ccaccaccttgtaagttctaaattg

SEQ ID NO: 68070 - DNA, 25 bp, Homo sapien
ctcttagcactggtgaccccaaaaa

SEQ ID NO: 68071 - DNA, 25 bp, Homo sapien
ttggttacctcattttgccgtttca

SEQ ID NO: 68072 - DNA, 25 bp, Homo sapien
gttacctcattttgccgtttcagat

SEQ ID NO: 68073 - DNA, 25 bp, Homo sapien
cctcattttgccgtttcagattgtg

SEQ ID NO: 68074 - DNA, 25 bp, Homo sapien
gccgtttcagattgtgaaagctcac

SEQ ID NO: 68075 - DNA, 25 bp, Homo sapien
ttgctgagtcattttctcaaatcat

SEQ ID NO: 68076 - DNA, 25 bp, Homo sapien
ttccattgtatcagttaacatatag

SEQ ID NO: 68077 - DNA, 25 bp, Homo sapien
aaccaaatcatttgaaggcttgata

SEQ ID NO: 68078 - DNA, 25 bp, Homo sapien
gtaatgctttactaagtagtgcaat

SEQ ID NO: 68079 - DNA, 25 bp, Homo sapien
tttatttttaatccctgtgcccaat

SEQ ID NO: 68080 - DNA, 25 bp, Homo sapien
tttttaatccctgtgcccaattttg

SEQ ID NO: 68081 - DNA, 25 bp, Homo sapien
cccaattttggagttgagagggttg

SEQ ID NO: 68082 - DNA, 25 bp, Homo sapien
gcagactcaagtaccaacattttta

SEQ ID NO: 68083 - DNA, 25 bp, Homo sapien
gaaagtttcaggatttctctggaca

SEQ ID NO: 68084 - DNA, 25 bp, Homo sapien
gatttctctggacaagatcctaaca

SEQ ID NO: 68085 - DNA, 25 bp, Homo sapien
agatcctaacattttactgagtcat

SEQ ID NO: 68086 - DNA, 25 bp, Homo sapien
gagtcatcttttggccagaatctgg

SEQ ID NO: 68087 - DNA, 25 bp, Homo sapien
atacaagaaacgtgagactcctgat

SEQ ID NO: 68088 - DNA, 25 bp, Homo sapien
ctcctgattgcttctggaaatactg

SEQ ID NO: 68089 - DNA, 25 bp, Homo sapien
ttgcttctggaaatactgtgtctga

SEQ ID NO: 68090 - DNA, 25 bp, Homo sapien
aataagcatctgttagtcagctcag

SEQ ID NO: 68091 - DNA, 25 bp, Homo sapien
gttagtcagctcagaaacacccatc

SEQ ID NO: 68092 - DNA, 25 bp, Homo sapien
gaaacacccatcttagaatatgaaa

SEQ ID NO: 68093 - DNA, 25 bp, Homo sapien
tgggcagctgctcactaactgccct

SEQ ID NO: 68094 - DNA, 25 bp, Homo sapien
tgctcactaactgcccttcaaaaag

SEQ ID NO: 68095 - DNA, 25 bp, Homo sapien
agtttttgctactttacaattctag

SEQ ID NO: 68096 - DNA, 25 bp, Homo sapien
tacaattctagccacggtgatgaaa

SEQ ID NO: 68097 - DNA, 25 bp, Homo sapien
gccacggtgatgaaaatatgtttca

SEQ ID NO: 68098 - DNA, 25 bp, Homo sapien
atatgtttcatattttgtggaaatc

SEQ ID NO: 68099 - DNA, 25 bp, Homo sapien
aatgtgcattttcctgattacttaa

SEQ ID NO: 68100 - DNA, 25 bp, Homo sapien
cattttcctgattacttaagaagtt

SEQ ID NO: 68101 - DNA, 25 bp, Homo sapien
agtggctttgtatattcagatgtta

SEQ ID NO: 68102 - DNA, 25 bp, Homo sapien
gatgttaaatctttatctgttacac

SEQ ID NO: 68103 - DNA, 25 bp, Homo sapien
aatctttatctgttacacaaattac

SEQ ID NO: 68104 - DNA, 25 bp, Homo sapien
gggctccctaaagccagtggacact

SEQ ID NO: 68105 - DNA, 25 bp, Homo sapien
agtggacactgccagagtctacctt

SEQ ID NO: 68106 - DNA, 25 bp, Homo sapien
agagtctaccttcctggcaagaggc

SEQ ID NO: 68107 - DNA, 25 bp, Homo sapien
taccttcctggcaagaggcagaccc

SEQ ID NO: 68108 - DNA, 25 bp, Homo sapien
aggcgtcttgccaggaacctcagga

SEQ ID NO: 68109 - DNA, 25 bp, Homo sapien
gtcttgccaggaacctcaggaggag

SEQ ID NO: 68110 - DNA, 25 bp, Homo sapien
ccgggacctgtgtgggacctgtgtc

SEQ ID NO: 68111 - DNA, 25 bp, Homo sapien
tggccgtttgcagtttctctctgtg

SEQ ID NO: 68112 - DNA, 25 bp, Homo sapien
gcagtttctctctgtgttgtgattc

SEQ ID NO: 68113 - DNA, 25 bp, Homo sapien
ttctcttcaatggtttcagtacgtg

SEQ ID NO: 68114 - DNA, 25 bp, Homo sapien
atggtttcagtacgtgtttctcttc

SEQ ID NO: 68115 - DNA, 25 bp, Homo sapien
aaggaatcctgcaagtagccttaat

SEQ ID NO: 68116 - DNA, 25 bp, Homo sapien
aatactgccatccatactaacacaa

SEQ ID NO: 68117 - DNA, 25 bp, Homo sapien
tgccatccatactaacacaaatttg

SEQ ID NO: 68118 - DNA, 25 bp, Homo sapien
aaagacatgaatggctcccatcctt

SEQ ID NO: 68119 - DNA, 25 bp, Homo sapien
catccttcagccttagttctttgta

SEQ ID NO: 68120 - DNA, 25 bp, Homo sapien
ttcagccttagttctttgtacagtg

SEQ ID NO: 68121 - DNA, 25 bp, Homo sapien
gccttagttctttgtacagtgtatc

SEQ ID NO: 68122 - DNA, 25 bp, Homo sapien
ttgtacagtgtatcatcagttgtgt

SEQ ID NO: 68123 - DNA, 25 bp, Homo sapien
gtgtatcatcagttgtgtacagtat

SEQ ID NO: 68124 - DNA, 25 bp, Homo sapien
gtgtacagtatgatttttagtgtca

SEQ ID NO: 68125 - DNA, 25 bp, Homo sapien
tttagtgtcagtttatagactgaac

SEQ ID NO: 68126 - DNA, 25 bp, Homo sapien
tttctttggcttattggagatcgag

SEQ ID NO: 68127 - DNA, 25 bp, Homo sapien
gactaataaattctacaaactgctc

SEQ ID NO: 68128 - DNA, 25 bp, Homo sapien
caaactgctctcaagttaccaagga

SEQ ID NO: 68129 - DNA, 25 bp, Homo sapien
gaaaatacacgacaaccacttatgg

SEQ ID NO: 68130 - DNA, 25 bp, Homo sapien
gacaaccacttatggctctttttca

SEQ ID NO: 68131 - DNA, 25 bp, Homo sapien
ttttcaaaactcttaaatcagtagt

SEQ ID NO: 68132 - DNA, 25 bp, Homo sapien
cagtagtttgacttttgccagggta

SEQ ID NO: 68133 - DNA, 25 bp, Homo sapien
cttttgccagggtaatcttcagttg

SEQ ID NO: 68134 - DNA, 25 bp, Homo sapien
gtaatcttcagttggccctgattca

SEQ ID NO: 68135 - DNA, 25 bp, Homo sapien
cagttggccctgattcaattaaatg

SEQ ID NO: 68136 - DNA, 25 bp, Homo sapien
ccctgattcaattaaatggccttaa

SEQ ID NO: 68137 - DNA, 25 bp, Homo sapien
aatagatatgccctaggagttcaga

SEQ ID NO: 68138 - DNA, 25 bp, Homo sapien
tatgccctaggagttcagaaaaagt

SEQ ID NO: 68139 - DNA, 25 bp, Homo sapien
tgttttctaattaaatgcagtgcac

SEQ ID NO: 68140 - DNA, 25 bp, Homo sapien
aatgcagtgcacattcctggatcaa

SEQ ID NO: 68141 - DNA, 25 bp, Homo sapien
gcagtgcacattcctggatcaatat

SEQ ID NO: 68142 - DNA, 25 bp, Homo sapien
gtgcacattcctggatcaatattca

SEQ ID NO: 68143 - DNA, 25 bp, Homo sapien
ttcctggatcaatattcaaagactg

SEQ ID NO: 68144 - DNA, 25 bp, Homo sapien
tcaaagactggtcataacctgctgt

SEQ ID NO: 68145 - DNA, 25 bp, Homo sapien
agactggtcataacctgctgtgtta

SEQ ID NO: 68146 - DNA, 25 bp, Homo sapien
aaataatcacatatgctctttttca

SEQ ID NO: 68147 - DNA, 25 bp, Homo sapien
caagtgaaaacagatgtgtgcagct

SEQ ID NO: 68148 - DNA, 25 bp, Homo sapien
tcagaagtgctggttagatagtaaa

SEQ ID NO: 68149 - DNA, 25 bp, Homo sapien
gctagttttagcttcctttgtggct

SEQ ID NO: 68150 - DNA, 25 bp, Homo sapien
gtggctccctggtgcaaaacaatta

SEQ ID NO: 68151 - DNA, 25 bp, Homo sapien
ttagcagttatgcaatggacctgat

SEQ ID NO: 68152 - DNA, 25 bp, Homo sapien
atggacctgattctagtttattcta

SEQ ID NO: 68153 - DNA, 25 bp, Homo sapien
agtgaggccgagtttgacttcgttc

SEQ ID NO: 68154 - DNA, 25 bp, Homo sapien
gagtttgacttcgttcctgaataca

SEQ ID NO: 68155 - DNA, 25 bp, Homo sapien
ttcgttcctgaatacaatcttgagt

SEQ ID NO: 68156 - DNA, 25 bp, Homo sapien
gaaagtctgagtgaaaggatggcct

SEQ ID NO: 68157 - DNA, 25 bp, Homo sapien
aaaggatggcctcattctctttcta

SEQ ID NO: 68158 - DNA, 25 bp, Homo sapien
tctctttctaatcttgctggtttca

SEQ ID NO: 68159 - DNA, 25 bp, Homo sapien
gcgtattcagcccaaaattgtgcac

SEQ ID NO: 68160 - DNA, 25 bp, Homo sapien
aattgtgcactgctggaggccaatg

SEQ ID NO: 68161 - DNA, 25 bp, Homo sapien
aatgcggcgcacgttcaaaagctat

SEQ ID NO: 68162 - DNA, 25 bp, Homo sapien
tggaacagggctgctaagcgtcgca

SEQ ID NO: 68163 - DNA, 25 bp, Homo sapien
taagcgtcgcagatttcaggacggt

SEQ ID NO: 68164 - DNA, 25 bp, Homo sapien
agacagtacagcatcaacctctctg

SEQ ID NO: 68165 - DNA, 25 bp, Homo sapien
agagttcttccatattctggagtat

SEQ ID NO: 68166 - DNA, 25 bp, Homo sapien
ggagtattacgataagacgctgtct

SEQ ID NO: 68167 - DNA, 25 bp, Homo sapien
tcaaaaatctcctacaacgacttcc

SEQ ID NO: 68168 - DNA, 25 bp, Homo sapien
gggacgacagccacagggcctgttt

SEQ ID NO: 68169 - DNA, 25 bp, Homo sapien
cacagggcctgtttcaaggctaata

SEQ ID NO: 68170 - DNA, 25 bp, Homo sapien
tttcatcacttgttatctcaaagag

SEQ ID NO: 68171 - DNA, 25 bp, Homo sapien
tatctcaaagagactcggagccagt

SEQ ID NO: 68172 - DNA, 25 bp, Homo sapien
aagagactcggagccagtgatcctt

SEQ ID NO: 68173 - DNA, 25 bp, Homo sapien
gactcggagccagtgatccttttat

SEQ ID NO: 68174 - DNA, 25 bp, Homo sapien
ggagccagtgatccttttatcctgc

SEQ ID NO: 68175 - DNA, 25 bp, Homo sapien
agtgatccttttatcctgctacagt

SEQ ID NO: 68176 - DNA, 25 bp, Homo sapien
atccttttatcctgctacagtcttt

SEQ ID NO: 68177 - DNA, 25 bp, Homo sapien
atcctgctacagtctttagggagct

SEQ ID NO: 68178 - DNA, 25 bp, Homo sapien
ccaaaactcttgatttcatatttcc

SEQ ID NO: 68179 - DNA, 25 bp, Homo sapien
taatcaacaagatcagtctacaggt

SEQ ID NO: 68180 - DNA, 25 bp, Homo sapien
aagatcagtctacaggtcacagtgg

SEQ ID NO: 68181 - DNA, 25 bp, Homo sapien
tttaccatgctttaattttgcacat

SEQ ID NO: 68182 - DNA, 25 bp, Homo sapien
gcacattcgtactatagggagccta

SEQ ID NO: 68183 - DNA, 25 bp, Homo sapien
gggagcctattggttctctattagt

SEQ ID NO: 68184 - DNA, 25 bp, Homo sapien
tctctattagtcttgtgggttttct

SEQ ID NO: 68185 - DNA, 25 bp, Homo sapien
aaggagtcatggcatctgtttacat

SEQ ID NO: 68186 - DNA, 25 bp, Homo sapien
catggcatctgtttacatttacctt

SEQ ID NO: 68187 - DNA, 25 bp, Homo sapien
ttaccttatcaaacctagaatgtgt

SEQ ID NO: 68188 - DNA, 25 bp, Homo sapien
gtatgtcttcattgctaggtactaa

SEQ ID NO: 68189 - DNA, 25 bp, Homo sapien
ggtactaatttgcagatgtctttac

SEQ ID NO: 68190 - DNA, 25 bp, Homo sapien
gatgtctttacatatttcaatacag

SEQ ID NO: 68191 - DNA, 25 bp, Homo sapien
gctcacctggatatacctacattgt

SEQ ID NO: 68192 - DNA, 25 bp, Homo sapien
cactcacgttcaatggtacatctgg

SEQ ID NO: 68193 - DNA, 25 bp, Homo sapien
gttcaatggtacatctgggtctcta

SEQ ID NO: 68194 - DNA, 25 bp, Homo sapien
ggtacatctgggtctctatgtggtt

SEQ ID NO: 68195 - DNA, 25 bp, Homo sapien
atctgggtctctatgtggttctgca

SEQ ID NO: 68196 - DNA, 25 bp, Homo sapien
tgggtctctatgtggttctgcagct

SEQ ID NO: 68197 - DNA, 25 bp, Homo sapien
tggttctgcagctcttcctttgttt

SEQ ID NO: 68198 - DNA, 25 bp, Homo sapien
gaggatttgcaattgctcattgaag

SEQ ID NO: 68199 - DNA, 25 bp, Homo sapien
tcattgaagcattcttatgatggct

SEQ ID NO: 68200 - DNA, 25 bp, Homo sapien
gctttataatccttgtcagatatta

SEQ ID NO: 68201 - DNA, 25 bp, Homo sapien
gattcatgttggtgttggcatcagt

SEQ ID NO: 68202 - DNA, 25 bp, Homo sapien
ggtgttggcatcagttgattatctt

SEQ ID NO: 68203 - DNA, 25 bp, Homo sapien
gggctgggacacaatttcatgtttt

SEQ ID NO: 68204 - DNA, 25 bp, Homo sapien
tttgcactaaaaaccttctctgtaa

SEQ ID NO: 68205 - DNA, 25 bp, Homo sapien
gaaactcttactatgcagattacgt

SEQ ID NO: 68206 - DNA, 25 bp, Homo sapien
gcagattacgtttttgaatggtgaa

SEQ ID NO: 68207 - DNA, 25 bp, Homo sapien
ggtgaacaggctattttgtacatca

SEQ ID NO: 68208 - DNA, 25 bp, Homo sapien
tgctgtacagaacacttggaggtgt

SEQ ID NO: 68209 - DNA, 25 bp, Homo sapien
acttggaggtgtgccttgtacgtca

SEQ ID NO: 68210 - DNA, 25 bp, Homo sapien
tgtgccttgtacgtcactcaacaaa

SEQ ID NO: 68211 - DNA, 25 bp, Homo sapien
acgtcactcaacaaacactcagcag

SEQ ID NO: 68212 - DNA, 25 bp, Homo sapien
gagaaatcattcttacccaagtagg

SEQ ID NO: 68213 - DNA, 25 bp, Homo sapien
acccaagtaggtttatgtgagaagg

SEQ ID NO: 68214 - DNA, 25 bp, Homo sapien
aaagacacatcactataaatagcaa

SEQ ID NO: 68215 - DNA, 25 bp, Homo sapien
caaatctaacttattaatactagga

SEQ ID NO: 68216 - DNA, 25 bp, Homo sapien
ggaataccaacattattagggcact

SEQ ID NO: 68217 - DNA, 25 bp, Homo sapien
accaacattattagggcacttgcag

SEQ ID NO: 68218 - DNA, 25 bp, Homo sapien
ttattagggcacttgcaggttattc

SEQ ID NO: 68219 - DNA, 25 bp, Homo sapien
gttattcttttctaggccaagtact

SEQ ID NO: 68220 - DNA, 25 bp, Homo sapien
tcttttctaggccaagtacttcact

SEQ ID NO: 68221 - DNA, 25 bp, Homo sapien
taggccaagtacttcacttccattt

SEQ ID NO: 68222 - DNA, 25 bp, Homo sapien
aagtacttcacttccatttgtctga

SEQ ID NO: 68223 - DNA, 25 bp, Homo sapien
acttcacttccatttgtctgacatg

SEQ ID NO: 68224 - DNA, 25 bp, Homo sapien
catttgtctgacatggagattgagg

SEQ ID NO: 68225 - DNA, 25 bp, Homo sapien
ttttgccctaccgtattccaaagcg

SEQ ID NO: 68226 - DNA, 25 bp, Homo sapien
tgccctaccgtattccaaagcgtgt

SEQ ID NO: 68227 - DNA, 25 bp, Homo sapien
ctaccgtattccaaagcgtgtgctg

SEQ ID NO: 68228 - DNA, 25 bp, Homo sapien
ccgtattccaaagcgtgtgctggtt

SEQ ID NO: 68229 - DNA, 25 bp, Homo sapien
attccaaagcgtgtgctggtttctc

SEQ ID NO: 68230 - DNA, 25 bp, Homo sapien
aaagcgtgtgctggtttctcatatt

SEQ ID NO: 68231 - DNA, 25 bp, Homo sapien
gcgtgtgctggtttctcatattgtc

SEQ ID NO: 68232 - DNA, 25 bp, Homo sapien
tgtgctggtttctcatattgtctgt

SEQ ID NO: 68233 - DNA, 25 bp, Homo sapien
tgctggtttctcatattgtctgtag

SEQ ID NO: 68234 - DNA, 25 bp, Homo sapien
ggtttctcatattgtctgtaggctc

SEQ ID NO: 68235 - DNA, 25 bp, Homo sapien
tttctcatattgtctgtaggctcac

SEQ ID NO: 68236 - DNA, 25 bp, Homo sapien
taccgaactggtaatgtagacttca

SEQ ID NO: 68237 - DNA, 25 bp, Homo sapien
gtagacttcatgtcacttgtacaag

SEQ ID NO: 68238 - DNA, 25 bp, Homo sapien
gacttcatgtcacttgtacaaggag

SEQ ID NO: 68239 - DNA, 25 bp, Homo sapien
gagaattgtattttactccgtgtat

SEQ ID NO: 68240 - DNA, 25 bp, Homo sapien
gtattttactccgtgtatttacaca

SEQ ID NO: 68241 - DNA, 25 bp, Homo sapien
gtgtatttacacattttgctattag

SEQ ID NO: 68242 - DNA, 25 bp, Homo sapien
cacattttgctattagttgatattc

SEQ ID NO: 68243 - DNA, 25 bp, Homo sapien
gaattattttcattccaaacttagg

SEQ ID NO: 68244 - DNA, 25 bp, Homo sapien
aaaagccaactttttgtacatgagt

SEQ ID NO: 68245 - DNA, 25 bp, Homo sapien
gtacatgagttggaatgcccactgt

SEQ ID NO: 68246 - DNA, 25 bp, Homo sapien
gttggaatgcccactgtttgaccaa

SEQ ID NO: 68247 - DNA, 25 bp, Homo sapien
cagataacaccctacaagaaactgg

SEQ ID NO: 68248 - DNA, 25 bp, Homo sapien
caagaaactgggaccttcccctcat

SEQ ID NO: 68249 - DNA, 25 bp, Homo sapien
atcctaggcccaggacccattatgg

SEQ ID NO: 68250 - DNA, 25 bp, Homo sapien
acaggagctgaagggctcccagggc

SEQ ID NO: 68251 - DNA, 25 bp, Homo sapien
tggcttgctggccaggatattcaga

SEQ ID NO: 68252 - DNA, 25 bp, Homo sapien
ggatattcagaggtaggcagccaaa

SEQ ID NO: 68253 - DNA, 25 bp, Homo sapien
taggcagccaaagggcacagaaccc

SEQ ID NO: 68254 - DNA, 25 bp, Homo sapien
aaagggcacagaaccctgtgcccca

SEQ ID NO: 68255 - DNA, 25 bp, Homo sapien
ccaccaggattggcctgctgctagg

SEQ ID NO: 68256 - DNA, 25 bp, Homo sapien
ctgaccaggaagacaggtgggttcc

SEQ ID NO: 68257 - DNA, 25 bp, Homo sapien
ccagggcctttgtggactagccaag

SEQ ID NO: 68258 - DNA, 25 bp, Homo sapien
ttgctgcccttctttcatgaagtct

SEQ ID NO: 68259 - DNA, 25 bp, Homo sapien
tgcccttctttcatgaagtctgttt

SEQ ID NO: 68260 - DNA, 25 bp, Homo sapien
gaagtctgttttttaagtgctggtt

SEQ ID NO: 68261 - DNA, 25 bp, Homo sapien
tttaagtgctggttcccccgaatat

SEQ ID NO: 68262 - DNA, 25 bp, Homo sapien
tggttcccccgaatattttatgcag

SEQ ID NO: 68263 - DNA, 25 bp, Homo sapien
tatagtggcaattattttctcacag

SEQ ID NO: 68264 - DNA, 25 bp, Homo sapien
cacagtctggtgagcaggcaattaa

SEQ ID NO: 68265 - DNA, 25 bp, Homo sapien
gtgagcaggcaattaattaggagta

SEQ ID NO: 68266 - DNA, 25 bp, Homo sapien
gtagagcgtggcgtgtggcagaatc

SEQ ID NO: 68267 - DNA, 25 bp, Homo sapien
gtgtggcagaatcgcaccgccccgg

SEQ ID NO: 68268 - DNA, 25 bp, Homo sapien
tgtgcccctctgctgggtgtaactg

SEQ ID NO: 68269 - DNA, 25 bp, Homo sapien
gcctctaagtctaatattgcagttg

SEQ ID NO: 68270 - DNA, 25 bp, Homo sapien
aggtgcatttaactgctttcttcat

SEQ ID NO: 68271 - DNA, 25 bp, Homo sapien
gctttcttcatccatgacgacattc

SEQ ID NO: 68272 - DNA, 25 bp, Homo sapien
tccatgacgacattcccaccatggg

SEQ ID NO: 68273 - DNA, 25 bp, Homo sapien
gggtcttgacaaagcagagtaaaaa

SEQ ID NO: 68274 - DNA, 25 bp, Homo sapien
ggagcctgaaataacctgtagtttc

SEQ ID NO: 68275 - DNA, 25 bp, Homo sapien
tgtagtttcgaatgcaggccctgat

SEQ ID NO: 68276 - DNA, 25 bp, Homo sapien
aggccctgatttactggcgttgtca

SEQ ID NO: 68277 - DNA, 25 bp, Homo sapien
ctggcgttgtcagtttcaattatga

SEQ ID NO: 68278 - DNA, 25 bp, Homo sapien
gaaactgaagtttggtgcctcctct

SEQ ID NO: 68279 - DNA, 25 bp, Homo sapien
tttggtgcctcctctttatcatgtt

SEQ ID NO: 68280 - DNA, 25 bp, Homo sapien
tactgaacaaccaaatctaccctcc

SEQ ID NO: 68281 - DNA, 25 bp, Homo sapien
aaatctaccctccacggccctgagg

SEQ ID NO: 68282 - DNA, 25 bp, Homo sapien
ggcccttgactgctcctttgggctg

SEQ ID NO: 68283 - DNA, 25 bp, Homo sapien
ttgactgctcctttgggctgggcca

SEQ ID NO: 68284 - DNA, 25 bp, Homo sapien
tgactgctcctttgggctgggccaa

SEQ ID NO: 68285 - DNA, 25 bp, Homo sapien
atgcatgactcagatgccctcaggt

SEQ ID NO: 68286 - DNA, 25 bp, Homo sapien
gcatgactcagatgccctcaggtcc

SEQ ID NO: 68287 - DNA, 25 bp, Homo sapien
ttgggttgaagcactacctgacatt

SEQ ID NO: 68288 - DNA, 25 bp, Homo sapien
gttgaagcactacctgacattaaag

SEQ ID NO: 68289 - DNA, 25 bp, Homo sapien
gaagcactacctgacattaaaggaa

SEQ ID NO: 68290 - DNA, 25 bp, Homo sapien
agcactacctgacattaaaggaagg

SEQ ID NO: 68291 - DNA, 25 bp, Homo sapien
ataaaaccagtttgcaggtgcacaa

SEQ ID NO: 68292 - DNA, 25 bp, Homo sapien
caggtgcacaaactatgagggtctt

SEQ ID NO: 68293 - DNA, 25 bp, Homo sapien
gagggtcttgtatccacgtaacaca

SEQ ID NO: 68294 - DNA, 25 bp, Homo sapien
ttgtatccacgtaacacaggtagtt

SEQ ID NO: 68295 - DNA, 25 bp, Homo sapien
gtactgtgtaaagatgcatagtcat

SEQ ID NO: 68296 - DNA, 25 bp, Homo sapien
gcatagtcatctcatttggttggct

SEQ ID NO: 68297 - DNA, 25 bp, Homo sapien
ttggttggctttgtaccttgtacct

SEQ ID NO: 68298 - DNA, 25 bp, Homo sapien
ttagccttggcttttgttgaactag

SEQ ID NO: 68299 - DNA, 25 bp, Homo sapien
gttgaactagaaccctcagcacata

SEQ ID NO: 68300 - DNA, 25 bp, Homo sapien
gaaccctcagcacatactgtgttgt

SEQ ID NO: 68301 - DNA, 25 bp, Homo sapien
ctcagcacatactgtgttgtacttt

SEQ ID NO: 68302 - DNA, 25 bp, Homo sapien
aattgcaatttatcggacacacctt

SEQ ID NO: 68303 - DNA, 25 bp, Homo sapien
gacacaccttcttagtgctgcacag

SEQ ID NO: 68304 - DNA, 25 bp, Homo sapien
tgctgcacagggtcacatggatgaa

SEQ ID NO: 68305 - DNA, 25 bp, Homo sapien
gaggctctgctccagatcatacaaa

SEQ ID NO: 68306 - DNA, 25 bp, Homo sapien
gcttgtgtgctagccgttagcactg

SEQ ID NO: 68307 - DNA, 25 bp, Homo sapien
gttagcactgactgccagtatctgt

SEQ ID NO: 68308 - DNA, 25 bp, Homo sapien
ctgttttatcttgctggtgctgaac

SEQ ID NO: 68309 - DNA, 25 bp, Homo sapien
ggtgctgaacattctttgtgcaact

SEQ ID NO: 68310 - DNA, 25 bp, Homo sapien
acattctttgtgcaactccatggtc

SEQ ID NO: 68311 - DNA, 25 bp, Homo sapien
aactccatggtctttctgggcctta

SEQ ID NO: 68312 - DNA, 25 bp, Homo sapien
tctgggccttactgtgctggtataa

SEQ ID NO: 68313 - DNA, 25 bp, Homo sapien
ctgcacaaacttcgcgacgtgatca

SEQ ID NO: 68314 - DNA, 25 bp, Homo sapien
acaaacttcgcgacgtgatcatgga

SEQ ID NO: 68315 - DNA, 25 bp, Homo sapien
ttcgcgacgtgatcatggagacccc

SEQ ID NO: 68316 - DNA, 25 bp, Homo sapien
ccagggcagggtagcctgcgcttcc

SEQ ID NO: 68317 - DNA, 25 bp, Homo sapien
acaagccaccagtggagctcaaggg

SEQ ID NO: 68318 - DNA, 25 bp, Homo sapien
tcaaggggcccgatgggatccatgt

SEQ ID NO: 68319 - DNA, 25 bp, Homo sapien
ggatccatgtggtgcacggcagcac

SEQ ID NO: 68320 - DNA, 25 bp, Homo sapien
aacagcctgcccgaggaagaccaga

SEQ ID NO: 68321 - DNA, 25 bp, Homo sapien
agcctgcccgaggaagaccagaagg

SEQ ID NO: 68322 - DNA, 25 bp, Homo sapien
cgctcgctggagacgctgaccgctg

SEQ ID NO: 68323 - DNA, 25 bp, Homo sapien
gaggccactgccttcgagcgcaacg

SEQ ID NO: 68324 - DNA, 25 bp, Homo sapien
gctgctgtgtggtgccatcgagtcc

SEQ ID NO: 68325 - DNA, 25 bp, Homo sapien
cttgtcctgggagggtcacccattg

SEQ ID NO: 68326 - DNA, 25 bp, Homo sapien
aaggaagtgcatccacctggcaggt

SEQ ID NO: 68327 - DNA, 25 bp, Homo sapien
tgacctggaggagtagcttccccga

SEQ ID NO: 68328 - DNA, 25 bp, Homo sapien
aggcttggcctgtgattgcgcaaac

SEQ ID NO: 68329 - DNA, 25 bp, Homo sapien
gtgattgcgcaaacccacatttcct

SEQ ID NO: 68330 - DNA, 25 bp, Homo sapien
acatttcctaagcacactggacacc

SEQ ID NO: 68331 - DNA, 25 bp, Homo sapien
tggacacccttcgagtgtgggtttt

SEQ ID NO: 68332 - DNA, 25 bp, Homo sapien
gtgggttttaacatccctgtgagat

SEQ ID NO: 68333 - DNA, 25 bp, Homo sapien
gagattgaatacttgtgccacacat

SEQ ID NO: 68334 - DNA, 25 bp, Homo sapien
gtgccacacatgtcacaaaagagta

SEQ ID NO: 68335 - DNA, 25 bp, Homo sapien
ggctcatggctggataatttcccta

SEQ ID NO: 68336 - DNA, 25 bp, Homo sapien
ttccctaggcttaacaacccaagca

SEQ ID NO: 68337 - DNA, 25 bp, Homo sapien
aagcaagcttcgcatcctcgtttta

SEQ ID NO: 68338 - DNA, 25 bp, Homo sapien
tcgcatcctcgttttatttttggtt

SEQ ID NO: 68339 - DNA, 25 bp, Homo sapien
aagagtgcagctcgagagagattca

SEQ ID NO: 68340 - DNA, 25 bp, Homo sapien
agatggaacacaccagaccccagat

SEQ ID NO: 68341 - DNA, 25 bp, Homo sapien
agatcacaaagccaaccatgcccag

SEQ ID NO: 68342 - DNA, 25 bp, Homo sapien
cacgaccatcgttctgaattctgac

SEQ ID NO: 68343 - DNA, 25 bp, Homo sapien
gttctgaattctgacgacaccgtga

SEQ ID NO: 68344 - DNA, 25 bp, Homo sapien
tgacgacaccgtgagcctgcctttg

SEQ ID NO: 68345 - DNA, 25 bp, Homo sapien
cctgcctttgtacttcaaactcatg

SEQ ID NO: 68346 - DNA, 25 bp, Homo sapien
gtcattttctctcaggaaaggtttt

SEQ ID NO: 68347 - DNA, 25 bp, Homo sapien
ggttttcaaagttctgcccatttct

SEQ ID NO: 68348 - DNA, 25 bp, Homo sapien
agttctgcccatttctggaggccac

SEQ ID NO: 68349 - DNA, 25 bp, Homo sapien
cccagcacaggcactttctagatat

SEQ ID NO: 68350 - DNA, 25 bp, Homo sapien
acaggcactttctagatatttcccc

SEQ ID NO: 68351 - DNA, 25 bp, Homo sapien
tggagaagaaagagcccctggtttt

SEQ ID NO: 68352 - DNA, 25 bp, Homo sapien
atttgtttgtttactcatcactcag

SEQ ID NO: 68353 - DNA, 25 bp, Homo sapien
actcatcactcagtgagcatctact

SEQ ID NO: 68354 - DNA, 25 bp, Homo sapien
gagcatctactttgggtgcattcta

SEQ ID NO: 68355 - DNA, 25 bp, Homo sapien
ttgggtgcattctagtgtagttact

SEQ ID NO: 68356 - DNA, 25 bp, Homo sapien
gttactagtcttttgacatggatga

SEQ ID NO: 68357 - DNA, 25 bp, Homo sapien
gaggaattcgtggttgctgtaagcc

SEQ ID NO: 68358 - DNA, 25 bp, Homo sapien
aggtggaggcccaacgagagcacca

SEQ ID NO: 68359 - DNA, 25 bp, Homo sapien
tggaggcccaacgagagcaccaggc

SEQ ID NO: 68360 - DNA, 25 bp, Homo sapien
gaggcccaacgagagcaccaggctg

SEQ ID NO: 68361 - DNA, 25 bp, Homo sapien
aacgagagcaccaggctgccaagag

SEQ ID NO: 68362 - DNA, 25 bp, Homo sapien
tgccaagagggcttgcagtgcctgc

SEQ ID NO: 68363 - DNA, 25 bp, Homo sapien
ccaagagggcttgcagtgcctgcgc

SEQ ID NO: 68364 - DNA, 25 bp, Homo sapien
gcttgcagtgcctgcgcagggacat

SEQ ID NO: 68365 - DNA, 25 bp, Homo sapien
cttgcagtgcctgcgcagggacatt

SEQ ID NO: 68366 - DNA, 25 bp, Homo sapien
cagtgcctgcgcagggacatttggg

SEQ ID NO: 68367 - DNA, 25 bp, Homo sapien
atttggggaggacacatccgcactc

SEQ ID NO: 68368 - DNA, 25 bp, Homo sapien
tatcaactgaaggtaactacttttt

SEQ ID NO: 68369 - DNA, 25 bp, Homo sapien
taactacttttttcatatttggagt

SEQ ID NO: 68370 - DNA, 25 bp, Homo sapien
aacttttggtgtttacctcagactg

SEQ ID NO: 68371 - DNA, 25 bp, Homo sapien
tacctcagactgatgttacctcttt

SEQ ID NO: 68372 - DNA, 25 bp, Homo sapien
agactgatgttacctcttttatatt

SEQ ID NO: 68373 - DNA, 25 bp, Homo sapien
ttttatgtcttaattggctcggatg

SEQ ID NO: 68374 - DNA, 25 bp, Homo sapien
ggctcggatgatgaacttgtgcaat

SEQ ID NO: 68375 - DNA, 25 bp, Homo sapien
gaacttgtgcaatcttctaccaaca

SEQ ID NO: 68376 - DNA, 25 bp, Homo sapien
gtgcaatcttctaccaacaaagttc

SEQ ID NO: 68377 - DNA, 25 bp, Homo sapien
ccaacaaagttcaagtggcatcatt

SEQ ID NO: 68378 - DNA, 25 bp, Homo sapien
acatgtatctttttcaggtattttc

SEQ ID NO: 68379 - DNA, 25 bp, Homo sapien
caggcagccgcatcgccaggacaaa

SEQ ID NO: 68380 - DNA, 25 bp, Homo sapien
atcgccaggacaaagcggccacagc

SEQ ID NO: 68381 - DNA, 25 bp, Homo sapien
acagccatccagtccgcctggaggg

SEQ ID NO: 68382 - DNA, 25 bp, Homo sapien
gggctttaagatccgccagcagatg

SEQ ID NO: 68383 - DNA, 25 bp, Homo sapien
tttaagatccgccagcagatgaggc

SEQ ID NO: 68384 - DNA, 25 bp, Homo sapien
gcagcaaatggcagcgaagatagtt

SEQ ID NO: 68385 - DNA, 25 bp, Homo sapien
gcgaagatagttcaagccacctggc

SEQ ID NO: 68386 - DNA, 25 bp, Homo sapien
gacttcgtgggaggcactcatggct

SEQ ID NO: 68387 - DNA, 25 bp, Homo sapien
tcgtgggaggcactcatggctctct

SEQ ID NO: 68388 - DNA, 25 bp, Homo sapien
aggcactcatggctctctgggtcta

SEQ ID NO: 68389 - DNA, 25 bp, Homo sapien
cactcatggctctctgggtctaatg

SEQ ID NO: 68390 - DNA, 25 bp, Homo sapien
agttgcatagtatagttttgccatt

SEQ ID NO: 68391 - DNA, 25 bp, Homo sapien
gccattttaacatttctgtatttga

SEQ ID NO: 68392 - DNA, 25 bp, Homo sapien
gtatttgaagtgcttatcgaatcta

SEQ ID NO: 68393 - DNA, 25 bp, Homo sapien
tatcgaatctaaaagtgactactgt

SEQ ID NO: 68394 - DNA, 25 bp, Homo sapien
gtggatccttttcataccttatttg

SEQ ID NO: 68395 - DNA, 25 bp, Homo sapien
tgctggattgtcacttttgggagaa

SEQ ID NO: 68396 - DNA, 25 bp, Homo sapien
aaacctgttaatcctgtcttttgca

SEQ ID NO: 68397 - DNA, 25 bp, Homo sapien
taatcctgtcttttgcatgcctgaa

SEQ ID NO: 68398 - DNA, 25 bp, Homo sapien
tcctgtcttttgcatgcctgaagaa

SEQ ID NO: 68399 - DNA, 25 bp, Homo sapien
gagagtgaatgttcagcctgagcta

SEQ ID NO: 68400 - DNA, 25 bp, Homo sapien
gctagtgagctagattcattgaatt

SEQ ID NO: 68401 - DNA, 25 bp, Homo sapien
tagacaactttgtaatagccctgaa

SEQ ID NO: 68402 - DNA, 25 bp, Homo sapien
gacaactttgtaatagccctgaaga

SEQ ID NO: 68403 - DNA, 25 bp, Homo sapien
aactttgtaatagccctgaagagac

SEQ ID NO: 68404 - DNA, 25 bp, Homo sapien
gccctgaagagactccacaaagatt

SEQ ID NO: 68405 - DNA, 25 bp, Homo sapien
aagagactccacaaagatttcctgt

SEQ ID NO: 68406 - DNA, 25 bp, Homo sapien
acaaagatttcctgtggccacttcc

SEQ ID NO: 68407 - DNA, 25 bp, Homo sapien
ctgtggccacttccaatcatcccag

SEQ ID NO: 68408 - DNA, 25 bp, Homo sapien
aatcatcccagcctcttctatcagt

SEQ ID NO: 68409 - DNA, 25 bp, Homo sapien
cagcctcttctatcagttctccttt

SEQ ID NO: 68410 - DNA, 25 bp, Homo sapien
tcttctatcagttctcctttcaaaa

SEQ ID NO: 68411 - DNA, 25 bp, Homo sapien
ttctatcagttctcctttcaaaaat

SEQ ID NO: 68412 - DNA, 25 bp, Homo sapien
attgcacccatatggctgggcaggc

SEQ ID NO: 68413 - DNA, 25 bp, Homo sapien
ccgaggccaatagcgagtgatgagc

SEQ ID NO: 68414 - DNA, 25 bp, Homo sapien
atagcgagtgatgagcgggatccta

SEQ ID NO: 68415 - DNA, 25 bp, Homo sapien
atcctaggactgatctgtagcccat

SEQ ID NO: 68416 - DNA, 25 bp, Homo sapien
tgtagcccatgctgatgtcacccac

SEQ ID NO: 68417 - DNA, 25 bp, Homo sapien
accagggcaatccatctggaggcct

SEQ ID NO: 68418 - DNA, 25 bp, Homo sapien
aggactggcttcatcctggcactga

SEQ ID NO: 68419 - DNA, 25 bp, Homo sapien
aaagactgcctctgaccctcttagc

SEQ ID NO: 68420 - DNA, 25 bp, Homo sapien
tgaccctcttagcagacagagccca

SEQ ID NO: 68421 - DNA, 25 bp, Homo sapien
attgattttcgtctgtttaccctat

SEQ ID NO: 68422 - DNA, 25 bp, Homo sapien
gtctgtttaccctatccattaatca

SEQ ID NO: 68423 - DNA, 25 bp, Homo sapien
tatttggctcttatccctgcacatg

SEQ ID NO: 68424 - DNA, 25 bp, Homo sapien
ttatccctgcacatgtagaggcata

SEQ ID NO: 68425 - DNA, 25 bp, Homo sapien
aattggtaaacatgtcccgctgtgt

SEQ ID NO: 68426 - DNA, 25 bp, Homo sapien
atgtcccgctgtgtagaactttaaa

SEQ ID NO: 68427 - DNA, 25 bp, Homo sapien
ataactggtgaagcctacagccatc

SEQ ID NO: 68428 - DNA, 25 bp, Homo sapien
agccatccgcccaaaagtctgttct

SEQ ID NO: 68429 - DNA, 25 bp, Homo sapien
agtctgttctgatggcactgagttt

SEQ ID NO: 68430 - DNA, 25 bp, Homo sapien
tacagctgggcccagccagcttgag

SEQ ID NO: 68431 - DNA, 25 bp, Homo sapien
agccagcttgagtcactcttgtaca

SEQ ID NO: 68432 - DNA, 25 bp, Homo sapien
tgagtcactcttgtacaagcttgtt

SEQ ID NO: 68433 - DNA, 25 bp, Homo sapien
ttttctgtcttgtgaatgcacttga

SEQ ID NO: 68434 - DNA, 25 bp, Homo sapien
caggagctacgaggctacatgaacc

SEQ ID NO: 68435 - DNA, 25 bp, Homo sapien
gagctacgaggctacatgaaccggg

SEQ ID NO: 68436 - DNA, 25 bp, Homo sapien
gatcggcaggctgaggaccaggtcc

SEQ ID NO: 68437 - DNA, 25 bp, Homo sapien
agctggtggatttggtcaaccagag

SEQ ID NO: 68438 - DNA, 25 bp, Homo sapien
tggtcaaccagagagatgccctcat

SEQ ID NO: 68439 - DNA, 25 bp, Homo sapien
tcaaccagagagatgccctcatccg

SEQ ID NO: 68440 - DNA, 25 bp, Homo sapien
aggaggagcgcaggctcagcgagct

SEQ ID NO: 68441 - DNA, 25 bp, Homo sapien
gtctgctttcgttcccacaaagaaa

SEQ ID NO: 68442 - DNA, 25 bp, Homo sapien
tcgttcccacaaagaaagcacctca

SEQ ID NO: 68443 - DNA, 25 bp, Homo sapien
cctgttcatctgggctgcctggcag

SEQ ID NO: 68444 - DNA, 25 bp, Homo sapien
tggcagagagccttgctgtttacaa

SEQ ID NO: 68445 - DNA, 25 bp, Homo sapien
ctgcccctgttcttcacactgcccc

SEQ ID NO: 68446 - DNA, 25 bp, Homo sapien
tgcctcagcctcatacagatgtgcc

SEQ ID NO: 68447 - DNA, 25 bp, Homo sapien
gcctcagcctcatacagatgtgcca

SEQ ID NO: 68448 - DNA, 25 bp, Homo sapien
cctcagcctcatacagatgtgccat

SEQ ID NO: 68449 - DNA, 25 bp, Homo sapien
ctcagcctcatacagatgtgccatc

SEQ ID NO: 68450 - DNA, 25 bp, Homo sapien
tcagcctcatacagatgtgccatca

SEQ ID NO: 68451 - DNA, 25 bp, Homo sapien
cagcctcatacagatgtgccatcat

SEQ ID NO: 68452 - DNA, 25 bp, Homo sapien
agcctcatacagatgtgccatcatg

SEQ ID NO: 68453 - DNA, 25 bp, Homo sapien
gcctcatacagatgtgccatcatgg

SEQ ID NO: 68454 - DNA, 25 bp, Homo sapien
cctcatacagatgtgccatcatggg

SEQ ID NO: 68455 - DNA, 25 bp, Homo sapien
acagatgtgccatcatggggggcat

SEQ ID NO: 68456 - DNA, 25 bp, Homo sapien
gattgcccattgtataagaacaaat

SEQ ID NO: 68457 - DNA, 25 bp, Homo sapien
gatttcctatccacctgattatgtt

SEQ ID NO: 68458 - DNA, 25 bp, Homo sapien
gattatgttctctggttagtttagc

SEQ ID NO: 68459 - DNA, 25 bp, Homo sapien
gtttagccattttgaacttaagatc

SEQ ID NO: 68460 - DNA, 25 bp, Homo sapien
agatcatatgaccttagtgcttttg

SEQ ID NO: 68461 - DNA, 25 bp, Homo sapien
atgaccttagtgcttttggctaaac

SEQ ID NO: 68462 - DNA, 25 bp, Homo sapien
gtgcttttggctaaacatacagaat

SEQ ID NO: 68463 - DNA, 25 bp, Homo sapien
acagaatactacttgtatgcagaag

SEQ ID NO: 68464 - DNA, 25 bp, Homo sapien
gattacatgtttcaaccttttaggg

SEQ ID NO: 68465 - DNA, 25 bp, Homo sapien
atttcttgtcatatagtggctctac

SEQ ID NO: 68466 - DNA, 25 bp, Homo sapien
gtggctctacgtaatgtagcctgta

SEQ ID NO: 68467 - DNA, 25 bp, Homo sapien
cagggctcgcgtgcgggaaaactaa

SEQ ID NO: 68468 - DNA, 25 bp, Homo sapien
gctcgcgtgcgggaaaactaatatg

SEQ ID NO: 68469 - DNA, 25 bp, Homo sapien
ctcgcgtgcgggaaaactaatatgc

SEQ ID NO: 68470 - DNA, 25 bp, Homo sapien
tcgcgtgcgggaaaactaatatgcc

SEQ ID NO: 68471 - DNA, 25 bp, Homo sapien
gcgtgcgggaaaactaatatgccgg

SEQ ID NO: 68472 - DNA, 25 bp, Homo sapien
gtgcgggaaaactaatatgccggcg

SEQ ID NO: 68473 - DNA, 25 bp, Homo sapien
tgcgggaaaactaatatgccggcgt

SEQ ID NO: 68474 - DNA, 25 bp, Homo sapien
gcgggaaaactaatatgccggcgtt

SEQ ID NO: 68475 - DNA, 25 bp, Homo sapien
gaaaactaatatgccggcgtttaag

SEQ ID NO: 68476 - DNA, 25 bp, Homo sapien
taatatgccggcgtttaagcctgtg

SEQ ID NO: 68477 - DNA, 25 bp, Homo sapien
aatatgccggcgtttaagcctgtgc

SEQ ID NO: 68478 - DNA, 25 bp, Homo sapien
tgcacacatgtgttcttggcccggt

SEQ ID NO: 68479 - DNA, 25 bp, Homo sapien
acatgtgttcttggcccggtttcat

SEQ ID NO: 68480 - DNA, 25 bp, Homo sapien
tgcagatggacacagcgcacaccca

SEQ ID NO: 68481 - DNA, 25 bp, Homo sapien
ttgacaaggcccctcaatcggagga

SEQ ID NO: 68482 - DNA, 25 bp, Homo sapien
aatcggaggacagccggccgtgcac

SEQ ID NO: 68483 - DNA, 25 bp, Homo sapien
cgtgcacactttcatcatcgtcgga

SEQ ID NO: 68484 - DNA, 25 bp, Homo sapien
acactttcatcatcgtcggacaaac

SEQ ID NO: 68485 - DNA, 25 bp, Homo sapien
atcgtcggacaaacagcgtctactg

SEQ ID NO: 68486 - DNA, 25 bp, Homo sapien
agcgtctactgcacatttttcttat

SEQ ID NO: 68487 - DNA, 25 bp, Homo sapien
attcctattcttgagccatagctat

SEQ ID NO: 68488 - DNA, 25 bp, Homo sapien
atagctatggcatattcttctacta

SEQ ID NO: 68489 - DNA, 25 bp, Homo sapien
acaggaggaaactcagtgacctctg

SEQ ID NO: 68490 - DNA, 25 bp, Homo sapien
aggacctcgccgctctgaagagcac

SEQ ID NO: 68491 - DNA, 25 bp, Homo sapien
tgaagagcaccgtgcacatgtgggt

SEQ ID NO: 68492 - DNA, 25 bp, Homo sapien
agatctccgtggatgaactgcgtct

SEQ ID NO: 68493 - DNA, 25 bp, Homo sapien
gatgaactgcgtctggactcttaga

SEQ ID NO: 68494 - DNA, 25 bp, Homo sapien
gcgtctggactcttagattcataaa

SEQ ID NO: 68495 - DNA, 25 bp, Homo sapien
aatattcgagggtttgggagtcaca

SEQ ID NO: 68496 - DNA, 25 bp, Homo sapien
tcctcagtgcactttggcatttgca

SEQ ID NO: 68497 - DNA, 25 bp, Homo sapien
gcactttggcatttgcacggtgtct

SEQ ID NO: 68498 - DNA, 25 bp, Homo sapien
atttgcacggtgtcttccccggaca

SEQ ID NO: 68499 - DNA, 25 bp, Homo sapien
ttccccggacagcacagcaataaat

SEQ ID NO: 68500 - DNA, 25 bp, Homo sapien
tctaatttacatcttcccacttttt

SEQ ID NO: 68501 - DNA, 25 bp, Homo sapien
gacatgtttcactacattcttcctc

SEQ ID NO: 68502 - DNA, 25 bp, Homo sapien
cactgccaggtaccagacacagggt

SEQ ID NO: 68503 - DNA, 25 bp, Homo sapien
gtcacacccaccactaatttgagaa

SEQ ID NO: 68504 - DNA, 25 bp, Homo sapien
gagaattgcttatttgcgcttgaaa

SEQ ID NO: 68505 - DNA, 25 bp, Homo sapien
gaaacatcaagaaagctctaccgac

SEQ ID NO: 68506 - DNA, 25 bp, Homo sapien
agctctaccgacagacatgtttcat

SEQ ID NO: 68507 - DNA, 25 bp, Homo sapien
agacatgtttcattcacttatgatg

SEQ ID NO: 68508 - DNA, 25 bp, Homo sapien
cacttatgatgaaccaactgcccat

SEQ ID NO: 68509 - DNA, 25 bp, Homo sapien
gaaccaactgcccatctttactgaa

SEQ ID NO: 68510 - DNA, 25 bp, Homo sapien
tactgaatcttcttgactgtattta

SEQ ID NO: 68511 - DNA, 25 bp, Homo sapien
aaaagcaggcactaatatatatttc

SEQ ID NO: 68512 - DNA, 25 bp, Homo sapien
ttccagcctttgattacaaatttgt

SEQ ID NO: 68513 - DNA, 25 bp, Homo sapien
acaaatttgtccttgcacatgttaa

SEQ ID NO: 68514 - DNA, 25 bp, Homo sapien
gtccttgcacatgttaagatgaatt

SEQ ID NO: 68515 - DNA, 25 bp, Homo sapien
aaatatcattgttcttgggagcagt

SEQ ID NO: 68516 - DNA, 25 bp, Homo sapien
ttgggagcagtgtatgttactttac

SEQ ID NO: 68517 - DNA, 25 bp, Homo sapien
gttactttacatagcagcggttcct

SEQ ID NO: 68518 - DNA, 25 bp, Homo sapien
tacatagcagcggttcctgtcatgt

SEQ ID NO: 68519 - DNA, 25 bp, Homo sapien
cagcggttcctgtcatgtgttcatg

SEQ ID NO: 68520 - DNA, 25 bp, Homo sapien
tcctgtcatgtgttcatgttcagaa

SEQ ID NO: 68521 - DNA, 25 bp, Homo sapien
attgcctttggctgttgattagtac

SEQ ID NO: 68522 - DNA, 25 bp, Homo sapien
attctacatgacacaggacatgtca

SEQ ID NO: 68523 - DNA, 25 bp, Homo sapien
ttctacatgacacaggacatgtcac

SEQ ID NO: 68524 - DNA, 25 bp, Homo sapien
tctacatgacacaggacatgtcact

SEQ ID NO: 68525 - DNA, 25 bp, Homo sapien
ctacatgacacaggacatgtcactc

SEQ ID NO: 68526 - DNA, 25 bp, Homo sapien
tcatctgaaaattgcatggagactt

SEQ ID NO: 68527 - DNA, 25 bp, Homo sapien
agccaataaacctgtgataagtttc

SEQ ID NO: 68528 - DNA, 25 bp, Homo sapien
gccaataaacctgtgataagtttct

SEQ ID NO: 68529 - DNA, 25 bp, Homo sapien
ccaataaacctgtgataagtttcta

SEQ ID NO: 68530 - DNA, 25 bp, Homo sapien
caataaacctgtgataagtttctaa

SEQ ID NO: 68531 - DNA, 25 bp, Homo sapien
aataaacctgtgataagtttctaag

SEQ ID NO: 68532 - DNA, 25 bp, Homo sapien
attctacatgacacaggacatgtca

SEQ ID NO: 68533 - DNA, 25 bp, Homo sapien
ctacatgacacaggacatgtcactc

SEQ ID NO: 68534 - DNA, 25 bp, Homo sapien
acatgtcactcccatggccagaaag

SEQ ID NO: 68535 - DNA, 25 bp, Homo sapien
tgttagcaaaccctttcaaccatct

SEQ ID NO: 68536 - DNA, 25 bp, Homo sapien
tcaaccatctaaatgaaaacacaca

SEQ ID NO: 68537 - DNA, 25 bp, Homo sapien
tcatctgaaaattgcatggagactt

SEQ ID NO: 68538 - DNA, 25 bp, Homo sapien
ctgaaaattgcatggagacttttgt

SEQ ID NO: 68539 - DNA, 25 bp, Homo sapien
gcatggagacttttgtttctattta

SEQ ID NO: 68540 - DNA, 25 bp, Homo sapien
gccaataaacctgtgataagtttct

SEQ ID NO: 68541 - DNA, 25 bp, Homo sapien
aataaacctgtgataagtttctaag

SEQ ID NO: 68542 - DNA, 25 bp, Homo sapien
tagttcagtgatgcttttgtatttg

SEQ ID NO: 68543 - DNA, 25 bp, Homo sapien
ggagtgagactgactgcaagcccca

SEQ ID NO: 68544 - DNA, 25 bp, Homo sapien
gcgtctgcatacgagagacttggtt

SEQ ID NO: 68545 - DNA, 25 bp, Homo sapien
aacttggttggtccttgtctgcacc

SEQ ID NO: 68546 - DNA, 25 bp, Homo sapien
accctcgacaagaccacactttggg

SEQ ID NO: 68547 - DNA, 25 bp, Homo sapien
accacactttgggacttgggagctg

SEQ ID NO: 68548 - DNA, 25 bp, Homo sapien
tctgtacccatgaactcccagtttg

SEQ ID NO: 68549 - DNA, 25 bp, Homo sapien
ccatgaactcccagtttgcgaatta

SEQ ID NO: 68550 - DNA, 25 bp, Homo sapien
aatctattttgttacttgcacttgt

SEQ ID NO: 68551 - DNA, 25 bp, Homo sapien
cttgcacttgttattcgaaccactg

SEQ ID NO: 68552 - DNA, 25 bp, Homo sapien
gttattcgaaccactgagagcgaga

SEQ ID NO: 68553 - DNA, 25 bp, Homo sapien
tttatttctactatgagggccttgt

SEQ ID NO: 68554 - DNA, 25 bp, Homo sapien
aatggaaaggtgaattggctctaga

SEQ ID NO: 68555 - DNA, 25 bp, Homo sapien
gtgaattggctctagaggccctgta

SEQ ID NO: 68556 - DNA, 25 bp, Homo sapien
aattggctctagaggccctgtatgc

SEQ ID NO: 68557 - DNA, 25 bp, Homo sapien
tagaggccctgtatgctagtatcat

SEQ ID NO: 68558 - DNA, 25 bp, Homo sapien
ggccctgtatgctagtatcattttc

SEQ ID NO: 68559 - DNA, 25 bp, Homo sapien
aagagcaacctatttttcaagcaga

SEQ ID NO: 68560 - DNA, 25 bp, Homo sapien
aacctatttttcaagcagattgcac

SEQ ID NO: 68561 - DNA, 25 bp, Homo sapien
ttgcagctttaatggaatattgggt

SEQ ID NO: 68562 - DNA, 25 bp, Homo sapien
aaaaagctattttcattgccacaaa

SEQ ID NO: 68563 - DNA, 25 bp, Homo sapien
tttcattgccacaaagtgctttgat

SEQ ID NO: 68564 - DNA, 25 bp, Homo sapien
gtgctttgatgatgtaatacctaat

SEQ ID NO: 68565 - DNA, 25 bp, Homo sapien
taatttattgttcacttcatttcat

SEQ ID NO: 68566 - DNA, 25 bp, Homo sapien
tcattaggttcagtatgaaacaggt

SEQ ID NO: 68567 - DNA, 25 bp, Homo sapien
tgaaacaggtattgtcatctctttg

SEQ ID NO: 68568 - DNA, 25 bp, Homo sapien
catctctttgtgtctactttgccac

SEQ ID NO: 68569 - DNA, 25 bp, Homo sapien
tttgtgtctactttgccacctttcc

SEQ ID NO: 68570 - DNA, 25 bp, Homo sapien
tgaaaacgttacttcagttccttgt

SEQ ID NO: 68571 - DNA, 25 bp, Homo sapien
ttcagttccttgtgtctgacattgc

SEQ ID NO: 68572 - DNA, 25 bp, Homo sapien
tccttgtgtctgacattgcttgttt

SEQ ID NO: 68573 - DNA, 25 bp, Homo sapien
gatacttccaaagttatagcactgt

SEQ ID NO: 68574 - DNA, 25 bp, Homo sapien
agcactgttcctaaatcatttttgg

SEQ ID NO: 68575 - DNA, 25 bp, Homo sapien
gttcctaaatcatttttggctttat

SEQ ID NO: 68576 - DNA, 25 bp, Homo sapien
tacattgaaggactcagtgcggagt

SEQ ID NO: 68577 - DNA, 25 bp, Homo sapien
ctcagtgcggagtccaacagcatta

SEQ ID NO: 68578 - DNA, 25 bp, Homo sapien
gtgggatcagacactggcagctcga

SEQ ID NO: 68579 - DNA, 25 bp, Homo sapien
agacactggcagctcgaagacgcga

SEQ ID NO: 68580 - DNA, 25 bp, Homo sapien
gaagacgcgacgtccatttgtcgaa

SEQ ID NO: 68581 - DNA, 25 bp, Homo sapien
gtcgaaagaacaggagagccgccta

SEQ ID NO: 68582 - DNA, 25 bp, Homo sapien
atggcagatgccctctggcgccttc

SEQ ID NO: 68583 - DNA, 25 bp, Homo sapien
tctggcgccttcgagatttgatgct

SEQ ID NO: 68584 - DNA, 25 bp, Homo sapien
gagatttgatgctccgggacaccct

SEQ ID NO: 68585 - DNA, 25 bp, Homo sapien
tcaacattcgccaagcatacaacct

SEQ ID NO: 68586 - DNA, 25 bp, Homo sapien
tcgccaagcatacaacctagaaaat

SEQ ID NO: 68587 - DNA, 25 bp, Homo sapien
gaggcagagccagctgattgacact

SEQ ID NO: 68588 - DNA, 25 bp, Homo sapien
ggcagagccagctgattgacactct

SEQ ID NO: 68589 - DNA, 25 bp, Homo sapien
gagccagctgattgacactctgcag

SEQ ID NO: 68590 - DNA, 25 bp, Homo sapien
gccagctgattgacactctgcagca

SEQ ID NO: 68591 - DNA, 25 bp, Homo sapien
agctgattgacactctgcagcacca

SEQ ID NO: 68592 - DNA, 25 bp, Homo sapien
tgattgacactctgcagcaccaagt

SEQ ID NO: 68593 - DNA, 25 bp, Homo sapien
attgacactctgcagcaccaagtga

SEQ ID NO: 68594 - DNA, 25 bp, Homo sapien
gacactctgcagcaccaagtgaaat

SEQ ID NO: 68595 - DNA, 25 bp, Homo sapien
ctctgcagcaccaagtgaaatctct

SEQ ID NO: 68596 - DNA, 25 bp, Homo sapien
tggagcaacagctggccgatgctga

SEQ ID NO: 68597 - DNA, 25 bp, Homo sapien
ggccgatgctgacagacagcaccaa

SEQ ID NO: 68598 - DNA, 25 bp, Homo sapien
ttcctgtttctgtttgcgtttgact

SEQ ID NO: 68599 - DNA, 25 bp, Homo sapien
gcgtttgacttagtagcaaccgaca

SEQ ID NO: 68600 - DNA, 25 bp, Homo sapien
gcaaccgacagagtggcaagggatt

SEQ ID NO: 68601 - DNA, 25 bp, Homo sapien
gcaagggatttggtcttcagcagta

SEQ ID NO: 68602 - DNA, 25 bp, Homo sapien
gtcttcagcagtagacatccttcca

SEQ ID NO: 68603 - DNA, 25 bp, Homo sapien
tcagccaagtctcttgctgccatgc

SEQ ID NO: 68604 - DNA, 25 bp, Homo sapien
tcttgctgccatgccaatgctatgt

SEQ ID NO: 68605 - DNA, 25 bp, Homo sapien
atgccaatgctatgtccacccttgc

SEQ ID NO: 68606 - DNA, 25 bp, Homo sapien
ctcggcccaagagtgtccagcggtg

SEQ ID NO: 68607 - DNA, 25 bp, Homo sapien
tgtaccatctcccactgtaaatagt

SEQ ID NO: 68608 - DNA, 25 bp, Homo sapien
agtcccagttagaacggaatgccgt

SEQ ID NO: 68609 - DNA, 25 bp, Homo sapien
ttctgctccagcttgctggatgtta

SEQ ID NO: 68610 - DNA, 25 bp, Homo sapien
ttgctggatgttacctgtcctcttc

SEQ ID NO: 68611 - DNA, 25 bp, Homo sapien
gtcccctgtggcacctagcatgtgg

SEQ ID NO: 68612 - DNA, 25 bp, Homo sapien
tggcacctagcatgtggcacagcac

SEQ ID NO: 68613 - DNA, 25 bp, Homo sapien
ggcacagcacattagaagtgctcaa

SEQ ID NO: 68614 - DNA, 25 bp, Homo sapien
aagtgctcaaaaacatctgatgact

SEQ ID NO: 68615 - DNA, 25 bp, Homo sapien
tctgatgactgactaaagatgctag

SEQ ID NO: 68616 - DNA, 25 bp, Homo sapien
aagatgctaggcgtgacaccgttcc

SEQ ID NO: 68617 - DNA, 25 bp, Homo sapien
gttccctccaaaagcagacctcgga

SEQ ID NO: 68618 - DNA, 25 bp, Homo sapien
agacctcggaatcactgccaaataa

SEQ ID NO: 68619 - DNA, 25 bp, Homo sapien
gaatcactgccaaataagtaactag

SEQ ID NO: 68620 - DNA, 25 bp, Homo sapien
ctgttaggctgccacaggccctgct

SEQ ID NO: 68621 - DNA, 25 bp, Homo sapien
tgcttctggaaggtgaacagctcct

SEQ ID NO: 68622 - DNA, 25 bp, Homo sapien
tctggaaggtgaacagctcctggct

SEQ ID NO: 68623 - DNA, 25 bp, Homo sapien
gggtcaccaaagtgtgcccggctgc

SEQ ID NO: 68624 - DNA, 25 bp, Homo sapien
agtgtgcccggctgctatgaaaaac

SEQ ID NO: 68625 - DNA, 25 bp, Homo sapien
ggctgctatgaaaaacgttgggaat

SEQ ID NO: 68626 - DNA, 25 bp, Homo sapien
ctatgctaggttgtacagacttatt

SEQ ID NO: 68627 - DNA, 25 bp, Homo sapien
gtacagacttatttatatcatcgtt

SEQ ID NO: 68628 - DNA, 25 bp, Homo sapien
atatcatcgttttgagggactaatg

SEQ ID NO: 68629 - DNA, 25 bp, Homo sapien
gggactaatggaggcttattgtaac

SEQ ID NO: 68630 - DNA, 25 bp, Homo sapien
aaggaaactattttgctgattgtaa

SEQ ID NO: 68631 - DNA, 25 bp, Homo sapien
aaatccctgagcaatttcgacatgc

SEQ ID NO: 68632 - DNA, 25 bp, Homo sapien
gacatgcgatctggaagggcatcct

SEQ ID NO: 68633 - DNA, 25 bp, Homo sapien
tggaccaccggcagctccacgaatt

SEQ ID NO: 68634 - DNA, 25 bp, Homo sapien
aagcagtgcctctacagtcagtgtg

SEQ ID NO: 68635 - DNA, 25 bp, Homo sapien
gtcagtgtgggctccagtgagaccc

SEQ ID NO: 68636 - DNA, 25 bp, Homo sapien
tattgatgctgtgcgattcaccctc

SEQ ID NO: 68637 - DNA, 25 bp, Homo sapien
tttcccaccccgagatgagtggaat

SEQ ID NO: 68638 - DNA, 25 bp, Homo sapien
gagtggaatgacttcaactttgaca

SEQ ID NO: 68639 - DNA, 25 bp, Homo sapien
aactttgacatggatgctcgccgca

SEQ ID NO: 68640 - DNA, 25 bp, Homo sapien
ggatgctcgccgcaataagcaacag

SEQ ID NO: 68641 - DNA, 25 bp, Homo sapien
taagcaacagcgcatcaaagaggag

SEQ ID NO: 68642 - DNA, 25 bp, Homo sapien
gctccatttttccacagcgtggttt

SEQ ID NO: 68643 - DNA, 25 bp, Homo sapien
tccacagcgtggttttcttaaaata

SEQ ID NO: 68644 - DNA, 25 bp, Homo sapien
gtttaatgttttatagtctcatagt

SEQ ID NO: 68645 - DNA, 25 bp, Homo sapien
gtctcatagtagtagtgttgctttc

SEQ ID NO: 68646 - DNA, 25 bp, Homo sapien
atagtagtagtgttgctttctaagc

SEQ ID NO: 68647 - DNA, 25 bp, Homo sapien
gtagtgttgctttctaagctataac

SEQ ID NO: 68648 - DNA, 25 bp, Homo sapien
cagtcgactttattcttctactctg

SEQ ID NO: 68649 - DNA, 25 bp, Homo sapien
tcgactttattcttctactctgaaa

SEQ ID NO: 68650 - DNA, 25 bp, Homo sapien
ttgtatttgctcttgtataattgtt

SEQ ID NO: 68651 - DNA, 25 bp, Homo sapien
gaattgagggtggaattcttagaac

SEQ ID NO: 68652 - DNA, 25 bp, Homo sapien
aaaaatcaccacatgcttggaccat

SEQ ID NO: 68653 - DNA, 25 bp, Homo sapien
tgttgaaatgtaagccccctggtgg

SEQ ID NO: 68654 - DNA, 25 bp, Homo sapien
gggcagagtcctcacaaacggttta

SEQ ID NO: 68655 - DNA, 25 bp, Homo sapien
cagagtcctcacaaacggtttagca

SEQ ID NO: 68656 - DNA, 25 bp, Homo sapien
aaacggtttagcaccacccgctcag

SEQ ID NO: 68657 - DNA, 25 bp, Homo sapien
ttctcctgatattgagtcctcatca

SEQ ID NO: 68658 - DNA, 25 bp, Homo sapien
atattgagtcctcatcacatctggt

SEQ ID NO: 68659 - DNA, 25 bp, Homo sapien
tcatcacatctggttgcttcaaagt

SEQ ID NO: 68660 - DNA, 25 bp, Homo sapien
tggttgcttcaaagtgtgtggtgcc

SEQ ID NO: 68661 - DNA, 25 bp, Homo sapien
ttctccttcgccttctaacatgatt

SEQ ID NO: 68662 - DNA, 25 bp, Homo sapien
tgctgtgcttcctgtaccatctact

SEQ ID NO: 68663 - DNA, 25 bp, Homo sapien
accatctactggaccgtgagccaat

SEQ ID NO: 68664 - DNA, 25 bp, Homo sapien
tggcgaggccaccatacccggagct

SEQ ID NO: 68665 - DNA, 25 bp, Homo sapien
gtctgaagaacacagaggcgctctt

SEQ ID NO: 68666 - DNA, 25 bp, Homo sapien
gaagaacacagaggcgctcttggga

SEQ ID NO: 68667 - DNA, 25 bp, Homo sapien
aacacagaggcgctcttgggaccag

SEQ ID NO: 68668 - DNA, 25 bp, Homo sapien
acagaggcgctcttgggaccagcag

SEQ ID NO: 68669 - DNA, 25 bp, Homo sapien
tgggaccagcagacccctcggccag

SEQ ID NO: 68670 - DNA, 25 bp, Homo sapien
tcggccagctcacggcacatgcatt

SEQ ID NO: 68671 - DNA, 25 bp, Homo sapien
agctcacggcacatgcattggcctg

SEQ ID NO: 68672 - DNA, 25 bp, Homo sapien
tcacggcacatgcattggcctggca

SEQ ID NO: 68673 - DNA, 25 bp, Homo sapien
ggcacatgcattggcctggcatcta

SEQ ID NO: 68674 - DNA, 25 bp, Homo sapien
catgcattggcctggcatctaggac

SEQ ID NO: 68675 - DNA, 25 bp, Homo sapien
aaggcatgagtctgcatcttagggc

SEQ ID NO: 68676 - DNA, 25 bp, Homo sapien
acaaatctgaatgtgcctctcactt

SEQ ID NO: 68677 - DNA, 25 bp, Homo sapien
caaatctgaatgtgcctctcacttg

SEQ ID NO: 68678 - DNA, 25 bp, Homo sapien
aaatctgaatgtgcctctcacttgc

SEQ ID NO: 68679 - DNA, 25 bp, Homo sapien
aatctgaatgtgcctctcacttgct

SEQ ID NO: 68680 - DNA, 25 bp, Homo sapien
atctgaatgtgcctctcacttgctt

SEQ ID NO: 68681 - DNA, 25 bp, Homo sapien
tctgaatgtgcctctcacttgctta

SEQ ID NO: 68682 - DNA, 25 bp, Homo sapien
ctgaatgtgcctctcacttgcttac

SEQ ID NO: 68683 - DNA, 25 bp, Homo sapien
tgaatgtgcctctcacttgcttaca

SEQ ID NO: 68684 - DNA, 25 bp, Homo sapien
gaatgtgcctctcacttgcttacaa

SEQ ID NO: 68685 - DNA, 25 bp, Homo sapien
ggctccctcttaacgcagcacttag

SEQ ID NO: 68686 - DNA, 25 bp, Homo sapien
tccgtgccatcaacgggacgtgggt

SEQ ID NO: 68687 - DNA, 25 bp, Homo sapien
catcaacgggacgtgggttggctat

SEQ ID NO: 68688 - DNA, 25 bp, Homo sapien
ggttggctatgagttccccggctac

SEQ ID NO: 68689 - DNA, 25 bp, Homo sapien
accgtgggcgccagtacgtgtttga

SEQ ID NO: 68690 - DNA, 25 bp, Homo sapien
gcgagtaccgccactggaatgagtg

SEQ ID NO: 68691 - DNA, 25 bp, Homo sapien
actggaatgagtgggacgccagcca

SEQ ID NO: 68692 - DNA, 25 bp, Homo sapien
gcagctgcagtctgtgcgccgcatc

SEQ ID NO: 68693 - DNA, 25 bp, Homo sapien
tgcgccgcatccgtgaccagaagtg

SEQ ID NO: 68694 - DNA, 25 bp, Homo sapien
atccgtgaccagaagtggcacaagc

SEQ ID NO: 68695 - DNA, 25 bp, Homo sapien
cagcagctgaaaggcacccagactt

SEQ ID NO: 68696 - DNA, 25 bp, Homo sapien
ggcacccagacttcaaggacccaga

SEQ ID NO: 68697 - DNA, 25 bp, Homo sapien
tgtagactgctgaagtttccaccct

SEQ ID NO: 68698 - DNA, 25 bp, Homo sapien
tcttcccctgggattgcacacatag

SEQ ID NO: 68699 - DNA, 25 bp, Homo sapien
gggattgcacacatagctgttattt

SEQ ID NO: 68700 - DNA, 25 bp, Homo sapien
taaagctttaggcatagaaatcact

SEQ ID NO: 68701 - DNA, 25 bp, Homo sapien
aaaaactgtgtttgtcatgaccttt

SEQ ID NO: 68702 - DNA, 25 bp, Homo sapien
gtcatgacctttgtacttgatttat

SEQ ID NO: 68703 - DNA, 25 bp, Homo sapien
atcatgactttgtatgactgagtaa

SEQ ID NO: 68704 - DNA, 25 bp, Homo sapien
aatagtttgtcatttcccagaagtc

SEQ ID NO: 68705 - DNA, 25 bp, Homo sapien
tttgtcatttcccagaagtcttcca

SEQ ID NO: 68706 - DNA, 25 bp, Homo sapien
aagtcttccaacgatgcatgtttca

SEQ ID NO: 68707 - DNA, 25 bp, Homo sapien
gcatgtttcatacacttttgctaaa

SEQ ID NO: 68708 - DNA, 25 bp, Homo sapien
gggtaattccagaattgattggcca

SEQ ID NO: 68709 - DNA, 25 bp, Homo sapien
gattggccataccattgtcactgta

SEQ ID NO: 68710 - DNA, 25 bp, Homo sapien
gtcactgtattactgctcatgtcat

SEQ ID NO: 68711 - DNA, 25 bp, Homo sapien
atgtcattgcactggttcatcttcc

SEQ ID NO: 68712 - DNA, 25 bp, Homo sapien
gttcatcttccttctcaacttacct

SEQ ID NO: 68713 - DNA, 25 bp, Homo sapien
aacttacctgttgccacttggaata

SEQ ID NO: 68714 - DNA, 25 bp, Homo sapien
gatcttagctttgataaatgactga

SEQ ID NO: 68715 - DNA, 25 bp, Homo sapien
cacagttgaggagccagagacttct

SEQ ID NO: 68716 - DNA, 25 bp, Homo sapien
gagacttcttaaatcatccttagaa

SEQ ID NO: 68717 - DNA, 25 bp, Homo sapien
atccttagaaccgtgaccatagcag

SEQ ID NO: 68718 - DNA, 25 bp, Homo sapien
agcagtatatattttcctcttggaa

SEQ ID NO: 68719 - DNA, 25 bp, Homo sapien
ctcatcacatctggttgcttcaaag

SEQ ID NO: 68720 - DNA, 25 bp, Homo sapien
tcatcacatctggttgcttcaaagt

SEQ ID NO: 68721 - DNA, 25 bp, Homo sapien
atcacatctggttgcttcaaagtgt

SEQ ID NO: 68722 - DNA, 25 bp, Homo sapien
tggttgcttcaaagtgtgtggtgcc

SEQ ID NO: 68723 - DNA, 25 bp, Homo sapien
gtgtgtggtgcctcccctctgtctc

SEQ ID NO: 68724 - DNA, 25 bp, Homo sapien
tgctgtgcttcctgtaccatctact

SEQ ID NO: 68725 - DNA, 25 bp, Homo sapien
gtgcttcctgtaccatctactggac

SEQ ID NO: 68726 - DNA, 25 bp, Homo sapien
tcctgtaccatctactggaccgtga

SEQ ID NO: 68727 - DNA, 25 bp, Homo sapien
tgtaccatctactggaccgtgagcc

SEQ ID NO: 68728 - DNA, 25 bp, Homo sapien
taccatctactggaccgtgagccaa

SEQ ID NO: 68729 - DNA, 25 bp, Homo sapien
ccatctactggaccgtgagccaatt

SEQ ID NO: 68730 - DNA, 25 bp, Homo sapien
ggaattctccattaactgtggattt

SEQ ID NO: 68731 - DNA, 25 bp, Homo sapien
ggtgaagcagatttatccatcgaga

SEQ ID NO: 68732 - DNA, 25 bp, Homo sapien
atccatcgagactatctggtatgcg

SEQ ID NO: 68733 - DNA, 25 bp, Homo sapien
gactatctggtatgcgttatgtatg

SEQ ID NO: 68734 - DNA, 25 bp, Homo sapien
tatgtatgtagtctgttgctgctga

SEQ ID NO: 68735 - DNA, 25 bp, Homo sapien
gaaagatgtctgtgtgcccgtatca

SEQ ID NO: 68736 - DNA, 25 bp, Homo sapien
gtgcccgtatcaacatgtgacttca

SEQ ID NO: 68737 - DNA, 25 bp, Homo sapien
gtgacttcatgtaaagtttctttgt

SEQ ID NO: 68738 - DNA, 25 bp, Homo sapien
gtgttcacagttcttagcaaatgca

SEQ ID NO: 68739 - DNA, 25 bp, Homo sapien
gcaaatgcagttacaatccatagat

SEQ ID NO: 68740 - DNA, 25 bp, Homo sapien
tagccagcagtggatgttactccag

SEQ ID NO: 68741 - DNA, 25 bp, Homo sapien
cctggttaagcaagcactaatctct

SEQ ID NO: 68742 - DNA, 25 bp, Homo sapien
gcaagcactaatctcttttcctgga

SEQ ID NO: 68743 - DNA, 25 bp, Homo sapien
gagatcaaggatgcaacctcaggtt

SEQ ID NO: 68744 - DNA, 25 bp, Homo sapien
gttgagaaagaaacagggttccctg

SEQ ID NO: 68745 - DNA, 25 bp, Homo sapien
ttccctgggcccattagactgtttg

SEQ ID NO: 68746 - DNA, 25 bp, Homo sapien
agactgtttgcagggcatcactgct

SEQ ID NO: 68747 - DNA, 25 bp, Homo sapien
cctgacacctcacaactagcaaaaa

SEQ ID NO: 68748 - DNA, 25 bp, Homo sapien
gtgcagatgcaaacttaggctgtct

SEQ ID NO: 68749 - DNA, 25 bp, Homo sapien
taggctgtcttgatgcaaacttaga

SEQ ID NO: 68750 - DNA, 25 bp, Homo sapien
aacttagaaccacagaaatgctttt

SEQ ID NO: 68751 - DNA, 25 bp, Homo sapien
atgcctgttttaagatggaattgtt

SEQ ID NO: 68752 - DNA, 25 bp, Homo sapien
tgagagtgacacatggcagagaaca

SEQ ID NO: 68753 - DNA, 25 bp, Homo sapien
gaacacagcctgattgaagatttga

SEQ ID NO: 68754 - DNA, 25 bp, Homo sapien
tacttttagaagaatgcgacgccaa

SEQ ID NO: 68755 - DNA, 25 bp, Homo sapien
gacgccaacatcagagcatcctaag

SEQ ID NO: 68756 - DNA, 25 bp, Homo sapien
gcatcctaagggaacgcagtcagag

SEQ ID NO: 68757 - DNA, 25 bp, Homo sapien
gaatgccttattgaggtcacacact

SEQ ID NO: 68758 - DNA, 25 bp, Homo sapien
ggtcacacactctatgctttgttag

SEQ ID NO: 68759 - DNA, 25 bp, Homo sapien
tgctttgttagctgtgtgaacctct

SEQ ID NO: 68760 - DNA, 25 bp, Homo sapien
aaattctgttccgtgtttgtgtagg

SEQ ID NO: 68761 - DNA, 25 bp, Homo sapien
taaaggcagacatggtttgcaaacc

SEQ ID NO: 68762 - DNA, 25 bp, Homo sapien
ttagttgtagagaagcacgattata

SEQ ID NO: 68763 - DNA, 25 bp, Homo sapien
gagcagaaatgcaattctttgttat

SEQ ID NO: 68764 - DNA, 25 bp, Homo sapien
attatgaaaaccaccttcctatgtt

SEQ ID NO: 68765 - DNA, 25 bp, Homo sapien
caccttcctatgtttgtaaaatatt

SEQ ID NO: 68766 - DNA, 25 bp, Homo sapien
tattttggatactatttgtttttct

SEQ ID NO: 68767 - DNA, 25 bp, Homo sapien
attttctatgaagcctttcagatac

SEQ ID NO: 68768 - DNA, 25 bp, Homo sapien
gaagcctttcagataccaatttagt

SEQ ID NO: 68769 - DNA, 25 bp, Homo sapien
gataccaatttagtttatgcagaaa

SEQ ID NO: 68770 - DNA, 25 bp, Homo sapien
gaacaaaacagggtaccagcacgga

SEQ ID NO: 68771 - DNA, 25 bp, Homo sapien
ggtaccagcacggaagactttctta

SEQ ID NO: 68772 - DNA, 25 bp, Homo sapien
gaagactttcttaaaacgcaacctg

SEQ ID NO: 68773 - DNA, 25 bp, Homo sapien
aaaacgcaacctgaattgaatgatg

SEQ ID NO: 68774 - DNA, 25 bp, Homo sapien
gcaaactcttctctgtggttctagc

SEQ ID NO: 68775 - DNA, 25 bp, Homo sapien
gtggttctagccttgggcagaatta

SEQ ID NO: 68776 - DNA, 25 bp, Homo sapien
ttatatcccagagaccacagagcaa

SEQ ID NO: 68777 - DNA, 25 bp, Homo sapien
agagcaactgtcaagctgcttaccc

SEQ ID NO: 68778 - DNA, 25 bp, Homo sapien
tctaatttgtgcctctcttgtgttg

SEQ ID NO: 68779 - DNA, 25 bp, Homo sapien
gctctggcctccttgaaagttcaga

SEQ ID NO: 68780 - DNA, 25 bp, Homo sapien
ttgaaagttcagagtacccagtaca

SEQ ID NO: 68781 - DNA, 25 bp, Homo sapien
agccaccatgctgacgggtattttt

SEQ ID NO: 68782 - DNA, 25 bp, Homo sapien
tgctgacgggtatttttcctcataa

SEQ ID NO: 68783 - DNA, 25 bp, Homo sapien
tatgaatctttgttatgtccatttg

SEQ ID NO: 68784 - DNA, 25 bp, Homo sapien
tatgtccatttgtttgtattgcgta

SEQ ID NO: 68785 - DNA, 25 bp, Homo sapien
aagaatcaaacaactctcctcggga

SEQ ID NO: 68786 - DNA, 25 bp, Homo sapien
tctcctcgggaccacacataaaaat

SEQ ID NO: 68787 - DNA, 25 bp, Homo sapien
aaatcccaaagcagggcaagtgtgg

SEQ ID NO: 68788 - DNA, 25 bp, Homo sapien
gtgtggaggcctgaagctactcgat

SEQ ID NO: 68789 - DNA, 25 bp, Homo sapien
aagctactcgatgaggcgaggtccg

SEQ ID NO: 68790 - DNA, 25 bp, Homo sapien
gatgaggcgaggtccgcccctatta

SEQ ID NO: 68791 - DNA, 25 bp, Homo sapien
cgcccctattattcattgtcctaag

SEQ ID NO: 68792 - DNA, 25 bp, Homo sapien
attgtcctaagtcttcatcgtgctg

SEQ ID NO: 68793 - DNA, 25 bp, Homo sapien
tttccaggcttctttcctgctcagc

SEQ ID NO: 68794 - DNA, 25 bp, Homo sapien
cccagcgtggaaaggcttccatttc

SEQ ID NO: 68795 - DNA, 25 bp, Homo sapien
gaatgggtctgtaatttctctaaga

SEQ ID NO: 68796 - DNA, 25 bp, Homo sapien
gcttgtctccaatgtctggactttt

SEQ ID NO: 68797 - DNA, 25 bp, Homo sapien
tggactttttggttccatctgggcc

SEQ ID NO: 68798 - DNA, 25 bp, Homo sapien
tgggccccgcaaagcgatgtgtatg

SEQ ID NO: 68799 - DNA, 25 bp, Homo sapien
gtgtatgaaaattgctgccccatca

SEQ ID NO: 68800 - DNA, 25 bp, Homo sapien
ttcgacccacatggaaaaccaagcg

SEQ ID NO: 68801 - DNA, 25 bp, Homo sapien
aaaccaagcggtcgtgtgcaaggaa

SEQ ID NO: 68802 - DNA, 25 bp, Homo sapien
ggtcgtgtgcaaggaatactacccg

SEQ ID NO: 68803 - DNA, 25 bp, Homo sapien
ttcaacccgtttcgcgcctatatga

SEQ ID NO: 68804 - DNA, 25 bp, Homo sapien
ttcgcgcctatatgaacctggacat

SEQ ID NO: 68805 - DNA, 25 bp, Homo sapien
ggacatatggactaccacagcgaat

SEQ ID NO: 68806 - DNA, 25 bp, Homo sapien
tagagactcgagttactgtgggaat

SEQ ID NO: 68807 - DNA, 25 bp, Homo sapien
gaattatgtcagtgtgggcagcagt

SEQ ID NO: 68808 - DNA, 25 bp, Homo sapien
cagtgtgggcagcagtagaatacta

SEQ ID NO: 68809 - DNA, 25 bp, Homo sapien
aatgtcatgttaagcaatttcagaa

SEQ ID NO: 68810 - DNA, 25 bp, Homo sapien
gaaaaattgacattgctgcctttaa

SEQ ID NO: 68811 - DNA, 25 bp, Homo sapien
gacattgctgcctttaagaatacca

SEQ ID NO: 68812 - DNA, 25 bp, Homo sapien
gctgcctttaagaataccatgaatg

SEQ ID NO: 68813 - DNA, 25 bp, Homo sapien
attgtggcagatgttgtgtgtgaac

SEQ ID NO: 68814 - DNA, 25 bp, Homo sapien
gtgtgtgaactgttgtttctttgcc

SEQ ID NO: 68815 - DNA, 25 bp, Homo sapien
gtgaactgttgtttctttgccacat

SEQ ID NO: 68816 - DNA, 25 bp, Homo sapien
tgttgtttctttgccacatgtgttg

SEQ ID NO: 68817 - DNA, 25 bp, Homo sapien
tctttgccacatgtgttgtatttga

SEQ ID NO: 68818 - DNA, 25 bp, Homo sapien
gaagccccacgttccacaaacttgg

SEQ ID NO: 68819 - DNA, 25 bp, Homo sapien
gggctaactgaatcttttaccactt

SEQ ID NO: 68820 - DNA, 25 bp, Homo sapien
actgaatcttttaccacttctggcc

SEQ ID NO: 68821 - DNA, 25 bp, Homo sapien
ggcctggctccagaactttgttcta

SEQ ID NO: 68822 - DNA, 25 bp, Homo sapien
cagaactttgttctagattccttaa

SEQ ID NO: 68823 - DNA, 25 bp, Homo sapien
gattccttaaaagtcggtagctgat

SEQ ID NO: 68824 - DNA, 25 bp, Homo sapien
gtcggtagctgatgtcaaactcaat

SEQ ID NO: 68825 - DNA, 25 bp, Homo sapien
tgagcagtagctttgatcccttggt

SEQ ID NO: 68826 - DNA, 25 bp, Homo sapien
agtagctttgatcccttggtctggg

SEQ ID NO: 68827 - DNA, 25 bp, Homo sapien
gtcgaaggaagatggcgctgttatc

SEQ ID NO: 68828 - DNA, 25 bp, Homo sapien
gtactatttaagatcagctttgttg

SEQ ID NO: 68829 - DNA, 25 bp, Homo sapien
taagccacagactgcgaaggcctgg

SEQ ID NO: 68830 - DNA, 25 bp, Homo sapien
cacagactgcgaaggcctggagccc

SEQ ID NO: 68831 - DNA, 25 bp, Homo sapien
caccttccacccataacaaagaaag

SEQ ID NO: 68832 - DNA, 25 bp, Homo sapien
gggatagtttcagaactgcttttat

SEQ ID NO: 68833 - DNA, 25 bp, Homo sapien
tttatttggataactgactgaagga

SEQ ID NO: 68834 - DNA, 25 bp, Homo sapien
gactgaaggagtctcatttgtaacc

SEQ ID NO: 68835 - DNA, 25 bp, Homo sapien
gagtctcatttgtaaccaagatgga

SEQ ID NO: 68836 - DNA, 25 bp, Homo sapien
cagtatgttgttacattcacactta

SEQ ID NO: 68837 - DNA, 25 bp, Homo sapien
atatctctatgtacaggaatttgca

SEQ ID NO: 68838 - DNA, 25 bp, Homo sapien
taatttccaagtacatttctcccct

SEQ ID NO: 68839 - DNA, 25 bp, Homo sapien
aaagccatccaatgaggcaacccct

SEQ ID NO: 68840 - DNA, 25 bp, Homo sapien
gaaagtgtactgatgttcttacatt

SEQ ID NO: 68841 - DNA, 25 bp, Homo sapien
gatgttcttacattaaagctttaca

SEQ ID NO: 68842 - DNA, 25 bp, Homo sapien
tacttctaccaaatagcctttcctt

SEQ ID NO: 68843 - DNA, 25 bp, Homo sapien
taccaaatagcctttccttttcgat

SEQ ID NO: 68844 - DNA, 25 bp, Homo sapien
gcctttccttttcgataacattcct

SEQ ID NO: 68845 - DNA, 25 bp, Homo sapien
tttcgataacattcctcagtatttt

SEQ ID NO: 68846 - DNA, 25 bp, Homo sapien
cagtatttttatagccaagtacatt

SEQ ID NO: 68847 - DNA, 25 bp, Homo sapien
tcttgctgatgaactggaattggat

SEQ ID NO: 68848 - DNA, 25 bp, Homo sapien
gagttggaaattatgcactttgaaa

SEQ ID NO: 68849 - DNA, 25 bp, Homo sapien
gtttaagcttattgggtttcagatt

SEQ ID NO: 68850 - DNA, 25 bp, Homo sapien
gtggaggctttctatagcattctaa

SEQ ID NO: 68851 - DNA, 25 bp, Homo sapien
gaaacagcagcccagaagacctctt

SEQ ID NO: 68852 - DNA, 25 bp, Homo sapien
agcccagaagacctctttgatgaga

SEQ ID NO: 68853 - DNA, 25 bp, Homo sapien
gacctctttgatgagatttaacagt

SEQ ID NO: 68854 - DNA, 25 bp, Homo sapien
actgatattgcaccaagtagaaaaa

SEQ ID NO: 68855 - DNA, 25 bp, Homo sapien
gagacagcgaatgcaaagaaatctt

SEQ ID NO: 68856 - DNA, 25 bp, Homo sapien
gaaatcttgggacagaacctaaaat

SEQ ID NO: 68857 - DNA, 25 bp, Homo sapien
gacagaacctaaaatggctcctcag

SEQ ID NO: 68858 - DNA, 25 bp, Homo sapien
ggctcctcaggagaatcagcttcaa

SEQ ID NO: 68859 - DNA, 25 bp, Homo sapien
aaaattctaggcctgattcttcact

SEQ ID NO: 68860 - DNA, 25 bp, Homo sapien
ctgattcttcactacctgagacgtc

SEQ ID NO: 68861 - DNA, 25 bp, Homo sapien
atctcagctgaaaacatgtctttag

SEQ ID NO: 68862 - DNA, 25 bp, Homo sapien
ggccagcctgctggacaagcagaga

SEQ ID NO: 68863 - DNA, 25 bp, Homo sapien
gctggacaagcagagaccatgagaa

SEQ ID NO: 68864 - DNA, 25 bp, Homo sapien
gggtcccaatccaggccatcctaga

SEQ ID NO: 68865 - DNA, 25 bp, Homo sapien
ttcggctaccttctactggccaaag

SEQ ID NO: 68866 - DNA, 25 bp, Homo sapien
cttctactggccaaagggagtccca

SEQ ID NO: 68867 - DNA, 25 bp, Homo sapien
aagggagtcccagggctcacccaga

SEQ ID NO: 68868 - DNA, 25 bp, Homo sapien
gggaaactgagtccaccacttgaga

SEQ ID NO: 68869 - DNA, 25 bp, Homo sapien
gtccaccacttgagaagagtagcta

SEQ ID NO: 68870 - DNA, 25 bp, Homo sapien
gacatatgagcgaggccagctgagc

SEQ ID NO: 68871 - DNA, 25 bp, Homo sapien
atgagcgaggccagctgagcccagc

SEQ ID NO: 68872 - DNA, 25 bp, Homo sapien
tgcggccaagtcgaagactttagga

SEQ ID NO: 68873 - DNA, 25 bp, Homo sapien
tgtcttggtcacagagctgggtgct

SEQ ID NO: 68874 - DNA, 25 bp, Homo sapien
tgggtgctgccggtcaccttgagct

SEQ ID NO: 68875 - DNA, 25 bp, Homo sapien
ttgagctgtggtggctcccggcaca

SEQ ID NO: 68876 - DNA, 25 bp, Homo sapien
gtggctcccggcacacgagtgtccg

SEQ ID NO: 68877 - DNA, 25 bp, Homo sapien
ttcggccatgtcctcacgcgggcag

SEQ ID NO: 68878 - DNA, 25 bp, Homo sapien
gggctgttggatttccatttcaggt

SEQ ID NO: 68879 - DNA, 25 bp, Homo sapien
ggatttccatttcaggtggttttct

SEQ ID NO: 68880 - DNA, 25 bp, Homo sapien
caggtggttttctaagtgctcctta

SEQ ID NO: 68881 - DNA, 25 bp, Homo sapien
agtgctccttatgtgaatttcaaac

SEQ ID NO: 68882 - DNA, 25 bp, Homo sapien
gtgaatttcaaacacgtatggaatt

SEQ ID NO: 68883 - DNA, 25 bp, Homo sapien
tatggaattcattccgcatggactc

SEQ ID NO: 68884 - DNA, 25 bp, Homo sapien
aaagtatccctttcaaatgcctttg

SEQ ID NO: 68885 - DNA, 25 bp, Homo sapien
atccctttcaaatgcctttgagaag

SEQ ID NO: 68886 - DNA, 25 bp, Homo sapien
aagtcagtttgcaacatgtctgtac

SEQ ID NO: 68887 - DNA, 25 bp, Homo sapien
gcaacatgtctgtaccaagatggta

SEQ ID NO: 68888 - DNA, 25 bp, Homo sapien
caagatggtactttgccttaaccgt

SEQ ID NO: 68889 - DNA, 25 bp, Homo sapien
gtactttgccttaaccgtttatatg

SEQ ID NO: 68890 - DNA, 25 bp, Homo sapien
tgccttaaccgtttatatgcacttt

SEQ ID NO: 68891 - DNA, 25 bp, Homo sapien
cactttcatggagactgcaatacgt

SEQ ID NO: 68892 - DNA, 25 bp, Homo sapien
gactgcaatacgttgctatgagcac

SEQ ID NO: 68893 - DNA, 25 bp, Homo sapien
tgctatgagcactttctttatcctt

SEQ ID NO: 68894 - DNA, 25 bp, Homo sapien
atccttggagtttaatcctttgctt

SEQ ID NO: 68895 - DNA, 25 bp, Homo sapien
gcacctgccacctataggactagaa

SEQ ID NO: 68896 - DNA, 25 bp, Homo sapien
gcacaagctttgctgaactgctctt

SEQ ID NO: 68897 - DNA, 25 bp, Homo sapien
gctaaaaatgccagtgcgagctttg

SEQ ID NO: 68898 - DNA, 25 bp, Homo sapien
gcgagctttgctgagattggctcct

SEQ ID NO: 68899 - DNA, 25 bp, Homo sapien
tttgcttcttggaaatccacagcca

SEQ ID NO: 68900 - DNA, 25 bp, Homo sapien
cagccaatggtgatgtgaccgtgtc

SEQ ID NO: 68901 - DNA, 25 bp, Homo sapien
gtgaccgtgtctggcggtgaaccta

SEQ ID NO: 68902 - DNA, 25 bp, Homo sapien
ggtgaacctaccctgaaacgtgact

SEQ ID NO: 68903 - DNA, 25 bp, Homo sapien
gaaacgtgacttctgcacaacaaac

SEQ ID NO: 68904 - DNA, 25 bp, Homo sapien
aaacgtgaccaaacatcaaagctaa

SEQ ID NO: 68905 - DNA, 25 bp, Homo sapien
gagctgcacaaacctcaatgtattt

SEQ ID NO: 68906 - DNA, 25 bp, Homo sapien
aaacagcagcccagaagacctcttt

SEQ ID NO: 68907 - DNA, 25 bp, Homo sapien
cagcccagaagacctctttgatgag

SEQ ID NO: 68908 - DNA, 25 bp, Homo sapien
agcccagaagacctctttgatgaga

SEQ ID NO: 68909 - DNA, 25 bp, Homo sapien
gcccagaagacctctttgatgagat

SEQ ID NO: 68910 - DNA, 25 bp, Homo sapien
ccagaagacctctttgatgagattt

SEQ ID NO: 68911 - DNA, 25 bp, Homo sapien
gaagacctctttgatgagatttaac

SEQ ID NO: 68912 - DNA, 25 bp, Homo sapien
gacctctttgatgagatttaacagt

SEQ ID NO: 68913 - DNA, 25 bp, Homo sapien
gcctgattcttcactacctgagacg

SEQ ID NO: 68914 - DNA, 25 bp, Homo sapien
ctgattcttcactacctgagacgtc

SEQ ID NO: 68915 - DNA, 25 bp, Homo sapien
gcacatctcagctgaaaacatgtct

SEQ ID NO: 68916 - DNA, 25 bp, Homo sapien
atctcagctgaaaacatgtctttag

SEQ ID NO: 68917 - DNA, 25 bp, Homo sapien
gcgctggccatcaggcgctgctgac

SEQ ID NO: 68918 - DNA, 25 bp, Homo sapien
ctgtcgctgctctggacggtgctgt

SEQ ID NO: 68919 - DNA, 25 bp, Homo sapien
tgctctggacggtgctgttggaccc

SEQ ID NO: 68920 - DNA, 25 bp, Homo sapien
gtctccgcgtggctctggagcctca

SEQ ID NO: 68921 - DNA, 25 bp, Homo sapien
tggagcctcacctcggagacgacgc

SEQ ID NO: 68922 - DNA, 25 bp, Homo sapien
aggtggactccagggcaccggcttt

SEQ ID NO: 68923 - DNA, 25 bp, Homo sapien
cagggcaccggctttatttctggtg

SEQ ID NO: 68924 - DNA, 25 bp, Homo sapien
accggctttatttctggtgcactcc

SEQ ID NO: 68925 - DNA, 25 bp, Homo sapien
gctttatttctggtgcactcctctc

SEQ ID NO: 68926 - DNA, 25 bp, Homo sapien
ctctcctgagagtgtagaccaaggt

SEQ ID NO: 68927 - DNA, 25 bp, Homo sapien
gtagaccaaggtcgcctaataaact

SEQ ID NO: 68928 - DNA, 25 bp, Homo sapien
agtgcaggtgcagtttcattcaaca

SEQ ID NO: 68929 - DNA, 25 bp, Homo sapien
acatttttaagatgcatgtctgcca

SEQ ID NO: 68930 - DNA, 25 bp, Homo sapien
gtctgccaaaatgcaacatacggga

SEQ ID NO: 68931 - DNA, 25 bp, Homo sapien
acgggaagtttatttcctgacagca

SEQ ID NO: 68932 - DNA, 25 bp, Homo sapien
gacagcaggtgtacacatgccaaca

SEQ ID NO: 68933 - DNA, 25 bp, Homo sapien
gtacacatgccaacacttaatcatt

SEQ ID NO: 68934 - DNA, 25 bp, Homo sapien
atggcacctatttctttcttggagt

SEQ ID NO: 68935 - DNA, 25 bp, Homo sapien
acctatttctttcttggagtgccaa

SEQ ID NO: 68936 - DNA, 25 bp, Homo sapien
cttggagtgccaagtttgcaaacct

SEQ ID NO: 68937 - DNA, 25 bp, Homo sapien
agtttgcaaacctgcagtttttaat

SEQ ID NO: 68938 - DNA, 25 bp, Homo sapien
acgtttgacaaacacaattctagga

SEQ ID NO: 68939 - DNA, 25 bp, Homo sapien
atactcagtggacgtgactctggac

SEQ ID NO: 68940 - DNA, 25 bp, Homo sapien
tgatcctctctgataatctgcggca

SEQ ID NO: 68941 - DNA, 25 bp, Homo sapien
atctgcggcaagtgcggtacagtta

SEQ ID NO: 68942 - DNA, 25 bp, Homo sapien
gtacagttacctccaacaggacctg

SEQ ID NO: 68943 - DNA, 25 bp, Homo sapien
gtctccttctacaacgtgacagaga

SEQ ID NO: 68944 - DNA, 25 bp, Homo sapien
gacagagaggtgtcacaccttcact

SEQ ID NO: 68945 - DNA, 25 bp, Homo sapien
tccggccctacttcagtctgagtta

SEQ ID NO: 68946 - DNA, 25 bp, Homo sapien
tacttcagtctgagttactcgggag

SEQ ID NO: 68947 - DNA, 25 bp, Homo sapien
ggaaaagtgcagctcctctgatcat

SEQ ID NO: 68948 - DNA, 25 bp, Homo sapien
ggatagatgggttttctggccatgt

SEQ ID NO: 68949 - DNA, 25 bp, Homo sapien
gttttctggccatgttgggaatcat

SEQ ID NO: 68950 - DNA, 25 bp, Homo sapien
gatgggacagcaacaaaatcatggc

SEQ ID NO: 68951 - DNA, 25 bp, Homo sapien
aaaatcatggcttaggatcgacaag

SEQ ID NO: 68952 - DNA, 25 bp, Homo sapien
tggcttaggatcgacaagaagttaa

SEQ ID NO: 68953 - DNA, 25 bp, Homo sapien
agaagttaaaaaacagctgcatctg

SEQ ID NO: 68954 - DNA, 25 bp, Homo sapien
aacagctgcatctgttacttaagtt

SEQ ID NO: 68955 - DNA, 25 bp, Homo sapien
ttaagtttgtaagacagtgccctga

SEQ ID NO: 68956 - DNA, 25 bp, Homo sapien
ttgtaagacagtgccctgagacctc

SEQ ID NO: 68957 - DNA, 25 bp, Homo sapien
taagacagtgccctgagacctctag

SEQ ID NO: 68958 - DNA, 25 bp, Homo sapien
gacagtgccctgagacctctagaga

SEQ ID NO: 68959 - DNA, 25 bp, Homo sapien
agtgccctgagacctctagagaaaa

SEQ ID NO: 68960 - DNA, 25 bp, Homo sapien
gccctgagacctctagagaaaagat

SEQ ID NO: 68961 - DNA, 25 bp, Homo sapien
cagtctaaacttgtgcagtgtagta

SEQ ID NO: 68962 - DNA, 25 bp, Homo sapien
gtctaaacttgtgcagtgtagtaaa

SEQ ID NO: 68963 - DNA, 25 bp, Homo sapien
gcagtgtagtaaacatgcaagttgt

SEQ ID NO: 68964 - DNA, 25 bp, Homo sapien
acatgcaagttgttacgattgagct

SEQ ID NO: 68965 - DNA, 25 bp, Homo sapien
gcaagttgttacgattgagctgtat

SEQ ID NO: 68966 - DNA, 25 bp, Homo sapien
gttgttacgattgagctgtattacc

SEQ ID NO: 68967 - DNA, 25 bp, Homo sapien
gttacgattgagctgtattaccata

SEQ ID NO: 68968 - DNA, 25 bp, Homo sapien
gattgagctgtattaccataagtag

SEQ ID NO: 68969 - DNA, 25 bp, Homo sapien
gagctgtattaccataagtagaatt

SEQ ID NO: 68970 - DNA, 25 bp, Homo sapien
acaagctaactgttagaggtataca

SEQ ID NO: 68971 - DNA, 25 bp, Homo sapien
ctgttgtacagatttgattatgatt

SEQ ID NO: 68972 - DNA, 25 bp, Homo sapien
gtccatggtggaagacgataaccct

SEQ ID NO: 68973 - DNA, 25 bp, Homo sapien
tgtctaacctccaactgctgtgctg

SEQ ID NO: 68974 - DNA, 25 bp, Homo sapien
ctgtgctgtctgctagggtcacctc

SEQ ID NO: 68975 - DNA, 25 bp, Homo sapien
tgctagggtcacctcctgtttgtga

SEQ ID NO: 68976 - DNA, 25 bp, Homo sapien
gaaagaaagatcctctgctgacccc

SEQ ID NO: 68977 - DNA, 25 bp, Homo sapien
tgacccctggagcagctctcgagaa

SEQ ID NO: 68978 - DNA, 25 bp, Homo sapien
gctctcgagaactacctgttggtat

SEQ ID NO: 68979 - DNA, 25 bp, Homo sapien
tgttggtattgtccacaagctctcc

SEQ ID NO: 68980 - DNA, 25 bp, Homo sapien
gccccatcttgtgccatgttttaag

SEQ ID NO: 68981 - DNA, 25 bp, Homo sapien
ctaaaactcacccaacagatctttc

SEQ ID NO: 68982 - DNA, 25 bp, Homo sapien
cagatctttccagaggtccatggtg

SEQ ID NO: 68983 - DNA, 25 bp, Homo sapien
tctggaggctaaaccctgtctggat

SEQ ID NO: 68984 - DNA, 25 bp, Homo sapien
taaaccctgtctggatttctcttgg

SEQ ID NO: 68985 - DNA, 25 bp, Homo sapien
atttctcttgggatctaacgtggga

SEQ ID NO: 68986 - DNA, 25 bp, Homo sapien
tcttctggacagacaaccgtgacat

SEQ ID NO: 68987 - DNA, 25 bp, Homo sapien
acaaccgtgacatcagcagtgctgg

SEQ ID NO: 68988 - DNA, 25 bp, Homo sapien
gtgtgtggactgaacacctgcactt

SEQ ID NO: 68989 - DNA, 25 bp, Homo sapien
gcactttgcagaggacacgctgcat

SEQ ID NO: 68990 - DNA, 25 bp, Homo sapien
gcttgcggttcattcaggcctgctg

SEQ ID NO: 68991 - DNA, 25 bp, Homo sapien
gaaagagtggacacccgttcccctg

SEQ ID NO: 68992 - DNA, 25 bp, Homo sapien
atcatctgtcttgcgtgctatttca

SEQ ID NO: 68993 - DNA, 25 bp, Homo sapien
agtgataaactatttgccttctgga

SEQ ID NO: 68994 - DNA, 25 bp, Homo sapien
acggcagccacctgactgggcagac

SEQ ID NO: 68995 - DNA, 25 bp, Homo sapien
cggcagccacctgactgggcagacc

SEQ ID NO: 68996 - DNA, 25 bp, Homo sapien
ggcagccacctgactgggcagaccc

SEQ ID NO: 68997 - DNA, 25 bp, Homo sapien
gcagccacctgactgggcagaccct

SEQ ID NO: 68998 - DNA, 25 bp, Homo sapien
cagccacctgactgggcagaccctc

SEQ ID NO: 68999 - DNA, 25 bp, Homo sapien
agccacctgactgggcagaccctca

SEQ ID NO: 69000 - DNA, 25 bp, Homo sapien
acctgactgggcagaccctcaagca

SEQ ID NO: 69001 - DNA, 25 bp, Homo sapien
gctgtggcttctaggggcccgcgtg

SEQ ID NO: 69002 - DNA, 25 bp, Homo sapien
taggggcccgcgtggcatcctgtga

SEQ ID NO: 69003 - DNA, 25 bp, Homo sapien
aggggcccgcgtggcatcctgtgac

SEQ ID NO: 69004 - DNA, 25 bp, Homo sapien
ggcccgcgtggcatcctgtgacccc

SEQ ID NO: 69005 - DNA, 25 bp, Homo sapien
acttcggttgtgttccaccaactgg

SEQ ID NO: 69006 - DNA, 25 bp, Homo sapien
acagccatgcctatgtcggtggagg

SEQ ID NO: 69007 - DNA, 25 bp, Homo sapien
cgctgccctcgatgtggtcatgaag

SEQ ID NO: 69008 - DNA, 25 bp, Homo sapien
gaaggaatggcataccacaccagac

SEQ ID NO: 69009 - DNA, 25 bp, Homo sapien
taccacaccagacagatgcgttcag

SEQ ID NO: 69010 - DNA, 25 bp, Homo sapien
atgcgttcagccgatgaagggcaaa

SEQ ID NO: 69011 - DNA, 25 bp, Homo sapien
aaactgtcttctacacctgtaccaa

SEQ ID NO: 69012 - DNA, 25 bp, Homo sapien
tgtaccaactgcaagttccaggaga

SEQ ID NO: 69013 - DNA, 25 bp, Homo sapien
gagaaggaagactcttgaccttttt

SEQ ID NO: 69014 - DNA, 25 bp, Homo sapien
tccctcctttcggaaggtgaaggat

SEQ ID NO: 69015 - DNA, 25 bp, Homo sapien
gaaggatactgggtttttagatgcc

SEQ ID NO: 69016 - DNA, 25 bp, Homo sapien
cttgttgttgatacagcataagtga

SEQ ID NO: 69017 - DNA, 25 bp, Homo sapien
ataagtgaatcatgggcatttccct

SEQ ID NO: 69018 - DNA, 25 bp, Homo sapien
gagttggaagttgagctccacctcc

SEQ ID NO: 69019 - DNA, 25 bp, Homo sapien
aagttgagctccacctcctttccaa

SEQ ID NO: 69020 - DNA, 25 bp, Homo sapien
gagcactcagtgttgaatcacagtt

SEQ ID NO: 69021 - DNA, 25 bp, Homo sapien
tgaatcacagttacaacccactggg

SEQ ID NO: 69022 - DNA, 25 bp, Homo sapien
agatgcgttgtatgggactggaagc

SEQ ID NO: 69023 - DNA, 25 bp, Homo sapien
gactggaagcaagaggttcattcaa

SEQ ID NO: 69024 - DNA, 25 bp, Homo sapien
aaactcatgggatttgtaaccagat

SEQ ID NO: 69025 - DNA, 25 bp, Homo sapien
atgaatcatgatttctaagacttct

SEQ ID NO: 69026 - DNA, 25 bp, Homo sapien
aagacttctgatcaaaaatactgtg

SEQ ID NO: 69027 - DNA, 25 bp, Homo sapien
ttgagggctttaactgggaaggctt

SEQ ID NO: 69028 - DNA, 25 bp, Homo sapien
gaaaaggtaccttgacacctcctat

SEQ ID NO: 69029 - DNA, 25 bp, Homo sapien
aataccaagtgttgcatcacccaca

SEQ ID NO: 69030 - DNA, 25 bp, Homo sapien
acagtttccctgaggacaacgatga

SEQ ID NO: 69031 - DNA, 25 bp, Homo sapien
gatgaaccaccacctgatgacaact

SEQ ID NO: 69032 - DNA, 25 bp, Homo sapien
actcaggatgggatatagacttcta

SEQ ID NO: 69033 - DNA, 25 bp, Homo sapien
tctaatgtatttctcttacctgctt

SEQ ID NO: 69034 - DNA, 25 bp, Homo sapien
gctgaagacagctttttctgagaca

SEQ ID NO: 69035 - DNA, 25 bp, Homo sapien
ttttctgagacacagctgccagcaa

SEQ ID NO: 69036 - DNA, 25 bp, Homo sapien
acagctgccagcaaacctgagggaa

SEQ ID NO: 69037 - DNA, 25 bp, Homo sapien
atgatgcctttgatcgatgctgctc

SEQ ID NO: 69038 - DNA, 25 bp, Homo sapien
ttattagttttgcaagatcacacac

SEQ ID NO: 69039 - DNA, 25 bp, Homo sapien
gttttgcaagatcacacactaatgt

SEQ ID NO: 69040 - DNA, 25 bp, Homo sapien
gatcacacactaatgtaaccatttt

SEQ ID NO: 69041 - DNA, 25 bp, Homo sapien
agtggatttatgcaggcagttctat

SEQ ID NO: 69042 - DNA, 25 bp, Homo sapien
tttatgcaggcagttctatatatag

SEQ ID NO: 69043 - DNA, 25 bp, Homo sapien
tttaggaccaatacaaaataacaca

SEQ ID NO: 69044 - DNA, 25 bp, Homo sapien
caaatgtaatggaatcagactgaat

SEQ ID NO: 69045 - DNA, 25 bp, Homo sapien
gactgaattaaagtaaggctgtata

SEQ ID NO: 69046 - DNA, 25 bp, Homo sapien
aggctgtatattgaaagtcatatta

SEQ ID NO: 69047 - DNA, 25 bp, Homo sapien
aatttttgaatcataacgtcagcat

SEQ ID NO: 69048 - DNA, 25 bp, Homo sapien
cataacgtcagcataacttcatttg

SEQ ID NO: 69049 - DNA, 25 bp, Homo sapien
gtgcctggcccctaatttgctgaag

SEQ ID NO: 69050 - DNA, 25 bp, Homo sapien
gcctggcccctaatttgctgaagaa

SEQ ID NO: 69051 - DNA, 25 bp, Homo sapien
atcaacctgagtaaaagcagcactg

SEQ ID NO: 69052 - DNA, 25 bp, Homo sapien
cctgagtaaaagcagcactggtttt

SEQ ID NO: 69053 - DNA, 25 bp, Homo sapien
taaaagcagcactggttttgagttt

SEQ ID NO: 69054 - DNA, 25 bp, Homo sapien
agacctttggaaatacattaaggat

SEQ ID NO: 69055 - DNA, 25 bp, Homo sapien
gggtagataatccattcagccagac

SEQ ID NO: 69056 - DNA, 25 bp, Homo sapien
gtagataatccattcagccagacaa

SEQ ID NO: 69057 - DNA, 25 bp, Homo sapien
gataatccattcagccagacaaacg

SEQ ID NO: 69058 - DNA, 25 bp, Homo sapien
ataatccattcagccagacaaacgg

SEQ ID NO: 69059 - DNA, 25 bp, Homo sapien
gagactgaggaggtgaaactgaaaa

SEQ ID NO: 69060 - DNA, 25 bp, Homo sapien
gcaaaccaaggagggagctggaggt

SEQ ID NO: 69061 - DNA, 25 bp, Homo sapien
gtggctggcgactgaggctcaggtc

SEQ ID NO: 69062 - DNA, 25 bp, Homo sapien
tggctggcgactgaggctcaggtca

SEQ ID NO: 69063 - DNA, 25 bp, Homo sapien
gaagagaggccagaaactgagcccc

SEQ ID NO: 69064 - DNA, 25 bp, Homo sapien
aaactgagcccctgctgagctttgt

SEQ ID NO: 69065 - DNA, 25 bp, Homo sapien
tgtctccccggctgaccgaatgctc

SEQ ID NO: 69066 - DNA, 25 bp, Homo sapien
tgaccgaatgctcactgtgaccccg

SEQ ID NO: 69067 - DNA, 25 bp, Homo sapien
accgaatgctcactgtgaccccgct

SEQ ID NO: 69068 - DNA, 25 bp, Homo sapien
tgaccccgctccaggatccccaagg

SEQ ID NO: 69069 - DNA, 25 bp, Homo sapien
aagacatggcccctgaagggcaata

SEQ ID NO: 69070 - DNA, 25 bp, Homo sapien
agacatggcccctgaagggcaataa

SEQ ID NO: 69071 - DNA, 25 bp, Homo sapien
gacacctcgtgtattataggactca

SEQ ID NO: 69072 - DNA, 25 bp, Homo sapien
taggactcacgggatgccatctagc

SEQ ID NO: 69073 - DNA, 25 bp, Homo sapien
ggatgccatctagcaagtggagaaa

SEQ ID NO: 69074 - DNA, 25 bp, Homo sapien
atagcagtccattttctcttgcaag

SEQ ID NO: 69075 - DNA, 25 bp, Homo sapien
tcttgcaagccctttaccattgagt

SEQ ID NO: 69076 - DNA, 25 bp, Homo sapien
gcaagccctttaccattgagttgaa

SEQ ID NO: 69077 - DNA, 25 bp, Homo sapien
aattcttgaattgccagagagccgt

SEQ ID NO: 69078 - DNA, 25 bp, Homo sapien
aattgccagagagccgtatcctcca

SEQ ID NO: 69079 - DNA, 25 bp, Homo sapien
cactcctgttcattgccccttaggt

SEQ ID NO: 69080 - DNA, 25 bp, Homo sapien
tgccccttaggtctccaaaatgtaa

SEQ ID NO: 69081 - DNA, 25 bp, Homo sapien
ctaatgtttaccttgtaccatggaa

SEQ ID NO: 69082 - DNA, 25 bp, Homo sapien
gagaggtgctccctagaagaacctg

SEQ ID NO: 69083 - DNA, 25 bp, Homo sapien
tccctagaagaacctgccatacgtt

SEQ ID NO: 69084 - DNA, 25 bp, Homo sapien
gaacctgccatacgtttcaaagcaa

SEQ ID NO: 69085 - DNA, 25 bp, Homo sapien
aaaatcactgtatatctttctaagg

SEQ ID NO: 69086 - DNA, 25 bp, Homo sapien
gtatatctttctaaggaccttcaag

SEQ ID NO: 69087 - DNA, 25 bp, Homo sapien
aaggaccttcaagtcatgactccag

SEQ ID NO: 69088 - DNA, 25 bp, Homo sapien
atgactccagggaagcctattggga

SEQ ID NO: 69089 - DNA, 25 bp, Homo sapien
gaaaaagcctcacagatttgaagaa

SEQ ID NO: 69090 - DNA, 25 bp, Homo sapien
tcacctgcctggaagcaactgggaa

SEQ ID NO: 69091 - DNA, 25 bp, Homo sapien
tgcctggaagcaactgggaaaccct

SEQ ID NO: 69092 - DNA, 25 bp, Homo sapien
gaaacccttccaataagtcctgata

SEQ ID NO: 69093 - DNA, 25 bp, Homo sapien
ggacactcccgtgtgcaggccgaat

SEQ ID NO: 69094 - DNA, 25 bp, Homo sapien
actcccgtgtgcaggccgaatcaga

SEQ ID NO: 69095 - DNA, 25 bp, Homo sapien
gtgcaggccgaatcagacccggcgt

SEQ ID NO: 69096 - DNA, 25 bp, Homo sapien
atcagacccggcgtgggcgaattca

SEQ ID NO: 69097 - DNA, 25 bp, Homo sapien
gcgaattcagaagtgcccaggtaga

SEQ ID NO: 69098 - DNA, 25 bp, Homo sapien
gaagtgcccaggtagagacaagcta

SEQ ID NO: 69099 - DNA, 25 bp, Homo sapien
agacaagctagaggctctgcggact

SEQ ID NO: 69100 - DNA, 25 bp, Homo sapien
agctagaggctctgcggacttctgc

SEQ ID NO: 69101 - DNA, 25 bp, Homo sapien
cttctgcgggcggtgacaaccgcga

SEQ ID NO: 69102 - DNA, 25 bp, Homo sapien
gggagaaagtcatcaggtcctagac

SEQ ID NO: 69103 - DNA, 25 bp, Homo sapien
aagtcatcaggtcctagacgtggga

SEQ ID NO: 69104 - DNA, 25 bp, Homo sapien
taccagttcaatgatgagttttctt

SEQ ID NO: 69105 - DNA, 25 bp, Homo sapien
tggtttgtacttgcagtggctgaac

SEQ ID NO: 69106 - DNA, 25 bp, Homo sapien
gtggctgaacaaagagcatggcttg

SEQ ID NO: 69107 - DNA, 25 bp, Homo sapien
gcttgagaatcaaagggatctgcat

SEQ ID NO: 69108 - DNA, 25 bp, Homo sapien
agggatctgcatttagcaatgtgat

SEQ ID NO: 69109 - DNA, 25 bp, Homo sapien
caggattgttgtaaaggttgggcat

SEQ ID NO: 69110 - DNA, 25 bp, Homo sapien
gcatgatgtatgcaaagtactggcc

SEQ ID NO: 69111 - DNA, 25 bp, Homo sapien
gggtagactaataactgatggcatt

SEQ ID NO: 69112 - DNA, 25 bp, Homo sapien
gatggcatttatatgctgtgctgga

SEQ ID NO: 69113 - DNA, 25 bp, Homo sapien
tatgctgtgctggaatattgttacc

SEQ ID NO: 69114 - DNA, 25 bp, Homo sapien
taccaagctgatgtgccgttctcac

SEQ ID NO: 69115 - DNA, 25 bp, Homo sapien
gaatgtcctcggcttagaaccagtc

SEQ ID NO: 69116 - DNA, 25 bp, Homo sapien
ttagaaccagtcttccgccttcaga

SEQ ID NO: 69117 - DNA, 25 bp, Homo sapien
tcttccaagaggagagctccctgga

SEQ ID NO: 69118 - DNA, 25 bp, Homo sapien
ggagagccacagtactgtctcttta

SEQ ID NO: 69119 - DNA, 25 bp, Homo sapien
ccatcgttacagcagggtcatttat

SEQ ID NO: 69120 - DNA, 25 bp, Homo sapien
gcagggtcatttatggcagccacta

SEQ ID NO: 69121 - DNA, 25 bp, Homo sapien
agccactagaacctcgtttttagag

SEQ ID NO: 69122 - DNA, 25 bp, Homo sapien
gtttttagagccttccattgtcccg

SEQ ID NO: 69123 - DNA, 25 bp, Homo sapien
atgtcctttgtcctaaacttactcg

SEQ ID NO: 69124 - DNA, 25 bp, Homo sapien
tttgtcctaaacttactcgagctgc

SEQ ID NO: 69125 - DNA, 25 bp, Homo sapien
tactcgagctgccttctctaagaaa

SEQ ID NO: 69126 - DNA, 25 bp, Homo sapien
ctgcctagggaagaggacaggtggg

SEQ ID NO: 69127 - DNA, 25 bp, Homo sapien
gggcccagcacctgtgccacctccc

SEQ ID NO: 69128 - DNA, 25 bp, Homo sapien
atccttccccctcactttgcagagt

SEQ ID NO: 69129 - DNA, 25 bp, Homo sapien
tccttccccctcactttgcagagta

SEQ ID NO: 69130 - DNA, 25 bp, Homo sapien
cttccccctcactttgcagagtatt

SEQ ID NO: 69131 - DNA, 25 bp, Homo sapien
ttccccctcactttgcagagtattt

SEQ ID NO: 69132 - DNA, 25 bp, Homo sapien
tccccctcactttgcagagtatttt

SEQ ID NO: 69133 - DNA, 25 bp, Homo sapien
ccccctcactttgcagagtattttt

SEQ ID NO: 69134 - DNA, 25 bp, Homo sapien
actgcaaagccccgccttctgggtt

SEQ ID NO: 69135 - DNA, 25 bp, Homo sapien
ctgcaaagccccgccttctgggttc

SEQ ID NO: 69136 - DNA, 25 bp, Homo sapien
tgcaaagccccgccttctgggttcc

SEQ ID NO: 69137 - DNA, 25 bp, Homo sapien
aaggacatggacaaggtcgagacat

SEQ ID NO: 69138 - DNA, 25 bp, Homo sapien
aggacatggacaaggtcgagacatt

SEQ ID NO: 69139 - DNA, 25 bp, Homo sapien
ggacatggacaaggtcgagacattc

SEQ ID NO: 69140 - DNA, 25 bp, Homo sapien
gacatggacaaggtcgagacattcc

SEQ ID NO: 69141 - DNA, 25 bp, Homo sapien
acatggacaaggtcgagacattcct

SEQ ID NO: 69142 - DNA, 25 bp, Homo sapien
catggacaaggtcgagacattcctg

SEQ ID NO: 69143 - DNA, 25 bp, Homo sapien
atggacaaggtcgagacattcctgc

SEQ ID NO: 69144 - DNA, 25 bp, Homo sapien
tggacaaggtcgagacattcctgcg

SEQ ID NO: 69145 - DNA, 25 bp, Homo sapien
ggacaaggtcgagacattcctgcgc

SEQ ID NO: 69146 - DNA, 25 bp, Homo sapien
gacaaggtcgagacattcctgcgca

SEQ ID NO: 69147 - DNA, 25 bp, Homo sapien
acaaggtcgagacattcctgcgcat

SEQ ID NO: 69148 - DNA, 25 bp, Homo sapien
aaggacatggacaaggtcgagacat

SEQ ID NO: 69149 - DNA, 25 bp, Homo sapien
aggacatggacaaggtcgagacatt

SEQ ID NO: 69150 - DNA, 25 bp, Homo sapien
ggacatggacaaggtcgagacattc

SEQ ID NO: 69151 - DNA, 25 bp, Homo sapien
gacatggacaaggtcgagacattcc

SEQ ID NO: 69152 - DNA, 25 bp, Homo sapien
acatggacaaggtcgagacattcct

SEQ ID NO: 69153 - DNA, 25 bp, Homo sapien
catggacaaggtcgagacattcctg

SEQ ID NO: 69154 - DNA, 25 bp, Homo sapien
atggacaaggtcgagacattcctgc

SEQ ID NO: 69155 - DNA, 25 bp, Homo sapien
tggacaaggtcgagacattcctgcg

SEQ ID NO: 69156 - DNA, 25 bp, Homo sapien
ggacaaggtcgagacattcctgcgc

SEQ ID NO: 69157 - DNA, 25 bp, Homo sapien
gacaaggtcgagacattcctgcgca

SEQ ID NO: 69158 - DNA, 25 bp, Homo sapien
acaaggtcgagacattcctgcgcat

SEQ ID NO: 69159 - DNA, 25 bp, Homo sapien
atgagctgacccgacttttctgacc

SEQ ID NO: 69160 - DNA, 25 bp, Homo sapien
cccgacttttctgaccatgtgcgga

SEQ ID NO: 69161 - DNA, 25 bp, Homo sapien
tcaagagactcctgaaggtctgggt

SEQ ID NO: 69162 - DNA, 25 bp, Homo sapien
aaggtctgggtctcaggacagtgat

SEQ ID NO: 69163 - DNA, 25 bp, Homo sapien
aggacagtgatgttggctagcccag

SEQ ID NO: 69164 - DNA, 25 bp, Homo sapien
gcaacagcaaaaaccctaacttctt

SEQ ID NO: 69165 - DNA, 25 bp, Homo sapien
taacttcttatacgtctagcctaat

SEQ ID NO: 69166 - DNA, 25 bp, Homo sapien
gtaccagtgtaaattcagtcttttc

SEQ ID NO: 69167 - DNA, 25 bp, Homo sapien
ttcagtctttctatcaaatattatc

SEQ ID NO: 69168 - DNA, 25 bp, Homo sapien
ttatctttgttctcctaatgctctg

SEQ ID NO: 69169 - DNA, 25 bp, Homo sapien
tgttctcctaatgctctgaaaggat

SEQ ID NO: 69170 - DNA, 25 bp, Homo sapien
gtggagctttatacaaacagggcag

SEQ ID NO: 69171 - DNA, 25 bp, Homo sapien
gctttatacaaacagggcagaacca

SEQ ID NO: 69172 - DNA, 25 bp, Homo sapien
gggcagaaccacagaagaacgtttt

SEQ ID NO: 69173 - DNA, 25 bp, Homo sapien
cgttttagaaaccaagagatgtgca

SEQ ID NO: 69174 - DNA, 25 bp, Homo sapien
aaccaagagatgtgcagaaagaaat

SEQ ID NO: 69175 - DNA, 25 bp, Homo sapien
gtggaagttaaacagctatgtatgt

SEQ ID NO: 69176 - DNA, 25 bp, Homo sapien
gctatgtatgtaaaagtaaggctta

SEQ ID NO: 69177 - DNA, 25 bp, Homo sapien
ttttacatatctatcaatatcagag

SEQ ID NO: 69178 - DNA, 25 bp, Homo sapien
ctatcaatatcagagatttgggtaa

SEQ ID NO: 69179 - DNA, 25 bp, Homo sapien
tgtggaggcatgtggagctttatac

SEQ ID NO: 69180 - DNA, 25 bp, Homo sapien
gaggcatgtggagctttatacaaac

SEQ ID NO: 69181 - DNA, 25 bp, Homo sapien
cagtctaaacttgtgcagtgtagta

SEQ ID NO: 69182 - DNA, 25 bp, Homo sapien
gcagtgtagtaaacatgcaagttgt

SEQ ID NO: 69183 - DNA, 25 bp, Homo sapien
acatgcaagttgttacgattgagct

SEQ ID NO: 69184 - DNA, 25 bp, Homo sapien
gcaagttgttacgattgagctgtat

SEQ ID NO: 69185 - DNA, 25 bp, Homo sapien
gttacgattgagctgtattaccata

SEQ ID NO: 69186 - DNA, 25 bp, Homo sapien
gattgagctgtattaccataagtag

SEQ ID NO: 69187 - DNA, 25 bp, Homo sapien
gagctgtattaccataagtagaatt

SEQ ID NO: 69188 - DNA, 25 bp, Homo sapien
taaactggtgaatttgggcaataaa

SEQ ID NO: 69189 - DNA, 25 bp, Homo sapien
acaagctaactgttagaggtataca

SEQ ID NO: 69190 - DNA, 25 bp, Homo sapien
ctgttgtacagatttgattatgatt

SEQ ID NO: 69191 - DNA, 25 bp, Homo sapien
gaaagattgcacttgtttgctttta

SEQ ID NO: 69192 - DNA, 25 bp, Homo sapien
gtgtgacaggtcccctttaggttat

SEQ ID NO: 69193 - DNA, 25 bp, Homo sapien
ttaggttatttaagggtgcatgtcc

SEQ ID NO: 69194 - DNA, 25 bp, Homo sapien
gaaggccgggtaatgagccatttcc

SEQ ID NO: 69195 - DNA, 25 bp, Homo sapien
aggccgggtaatgagccatttccat

SEQ ID NO: 69196 - DNA, 25 bp, Homo sapien
ggccgggtaatgagccatttccatg

SEQ ID NO: 69197 - DNA, 25 bp, Homo sapien
gccgggtaatgagccatttccatgg

SEQ ID NO: 69198 - DNA, 25 bp, Homo sapien
gggtaatgagccatttccatggtgc

SEQ ID NO: 69199 - DNA, 25 bp, Homo sapien
gtaatgagccatttccatggtgccc

SEQ ID NO: 69200 - DNA, 25 bp, Homo sapien
taatgagccatttccatggtgccca

SEQ ID NO: 69201 - DNA, 25 bp, Homo sapien
aatgagccatttccatggtgcccag

SEQ ID NO: 69202 - DNA, 25 bp, Homo sapien
tgagccatttccatggtgcccagct

SEQ ID NO: 69203 - DNA, 25 bp, Homo sapien
tccaggagatttgaccagcaagtgg

SEQ ID NO: 69204 - DNA, 25 bp, Homo sapien
aaataccataaaccctgctgaagac

SEQ ID NO: 69205 - DNA, 25 bp, Homo sapien
gaatgacaacattgagcccacactg

SEQ ID NO: 69206 - DNA, 25 bp, Homo sapien
gagcccacactgcagttttgaagat

SEQ ID NO: 69207 - DNA, 25 bp, Homo sapien
atagtaactgatggctggtgggaaa

SEQ ID NO: 69208 - DNA, 25 bp, Homo sapien
tttacaagactcttatgggcccacc

SEQ ID NO: 69209 - DNA, 25 bp, Homo sapien
gtggagcagcacttcccaaaacttg

SEQ ID NO: 69210 - DNA, 25 bp, Homo sapien
gcacttcccaaaacttgttcactgg

SEQ ID NO: 69211 - DNA, 25 bp, Homo sapien
gggtcctcgtgcctatggaatcctt

SEQ ID NO: 69212 - DNA, 25 bp, Homo sapien
gtgcctatggaatccttctttttat

SEQ ID NO: 69213 - DNA, 25 bp, Homo sapien
aaaatctttggagtatgcgtgagca

SEQ ID NO: 69214 - DNA, 25 bp, Homo sapien
aaatagtgcccctccttaagcccat

SEQ ID NO: 69215 - DNA, 25 bp, Homo sapien
tttccctcctctgaactattagagc

SEQ ID NO: 69216 - DNA, 25 bp, Homo sapien
gaactattagagcagttactgtctg

SEQ ID NO: 69217 - DNA, 25 bp, Homo sapien
gagcagttactgtctgttcagttcg

SEQ ID NO: 69218 - DNA, 25 bp, Homo sapien
tactgtctgttcagttcgtttggca

SEQ ID NO: 69219 - DNA, 25 bp, Homo sapien
gttcagttcgtttggcaggcacaca

SEQ ID NO: 69220 - DNA, 25 bp, Homo sapien
gttcgtttggcaggcacacacagtg

SEQ ID NO: 69221 - DNA, 25 bp, Homo sapien
gcaggcacacacagtggcataaatt

SEQ ID NO: 69222 - DNA, 25 bp, Homo sapien
acacacagtggcataaattctattg

SEQ ID NO: 69223 - DNA, 25 bp, Homo sapien
aaattctattgttttgaactctgat

SEQ ID NO: 69224 - DNA, 25 bp, Homo sapien
ttaaaattaaattgcagctgggcgt

SEQ ID NO: 69225 - DNA, 25 bp, Homo sapien
ctgtgtcggacagccagatggtcat

SEQ ID NO: 69226 - DNA, 25 bp, Homo sapien
gtcggacagccagatggtcatcata

SEQ ID NO: 69227 - DNA, 25 bp, Homo sapien
gatggtcatcatagtcacggtggtg

SEQ ID NO: 69228 - DNA, 25 bp, Homo sapien
tggtcatcatagtcacggtggtgtc

SEQ ID NO: 69229 - DNA, 25 bp, Homo sapien
tcatagtcacggtggtgtcggtgtt

SEQ ID NO: 69230 - DNA, 25 bp, Homo sapien
tggtgtcggtgttgctgtccctgtt

SEQ ID NO: 69231 - DNA, 25 bp, Homo sapien
gtgttgctgtccctgttcgtgacat

SEQ ID NO: 69232 - DNA, 25 bp, Homo sapien
tgctgtccctgttcgtgacatctgt

SEQ ID NO: 69233 - DNA, 25 bp, Homo sapien
tcatcttcggccagcacttgcgcca

SEQ ID NO: 69234 - DNA, 25 bp, Homo sapien
cgccagcagcggatgggcacctacg

SEQ ID NO: 69235 - DNA, 25 bp, Homo sapien
gaggtccagccctggctgaaggact

SEQ ID NO: 69236 - DNA, 25 bp, Homo sapien
accctgggcgtggtgactatcgtac

SEQ ID NO: 69237 - DNA, 25 bp, Homo sapien
gtgactatcgtactggccttaatgt

SEQ ID NO: 69238 - DNA, 25 bp, Homo sapien
aatgtacgtcttcagggagcaccaa

SEQ ID NO: 69239 - DNA, 25 bp, Homo sapien
ggagcaccaacggagcggcagttac

SEQ ID NO: 69240 - DNA, 25 bp, Homo sapien
acggagcggcagttaccatgttagg

SEQ ID NO: 69241 - DNA, 25 bp, Homo sapien
agggaggagagcacctatctgcccc

SEQ ID NO: 69242 - DNA, 25 bp, Homo sapien
tcacgtctatgcagccgacagaagc

SEQ ID NO: 69243 - DNA, 25 bp, Homo sapien
gaagaaccgtccagagctgagtgac

SEQ ID NO: 69244 - DNA, 25 bp, Homo sapien
agtgacgctgggatccgggatcaaa

SEQ ID NO: 69245 - DNA, 25 bp, Homo sapien
gggcttggctgtgccctcagattcc

SEQ ID NO: 69246 - DNA, 25 bp, Homo sapien
gattccgcaccaataaagccttcaa

SEQ ID NO: 69247 - DNA, 25 bp, Homo sapien
gtttgacacaaactcgcacaaccat

SEQ ID NO: 69248 - DNA, 25 bp, Homo sapien
gcacaaccatgacgcactgctcaag

SEQ ID NO: 69249 - DNA, 25 bp, Homo sapien
gtgcccgagtagcatcctgtgaccc

SEQ ID NO: 69250 - DNA, 25 bp, Homo sapien
tgcccgagtagcatcctgtgacccc

SEQ ID NO: 69251 - DNA, 25 bp, Homo sapien
gcccgagtagcatcctgtgacccct

SEQ ID NO: 69252 - DNA, 25 bp, Homo sapien
cccgagtagcatcctgtgacccctc

SEQ ID NO: 69253 - DNA, 25 bp, Homo sapien
ccgagtagcatcctgtgacccctcc

SEQ ID NO: 69254 - DNA, 25 bp, Homo sapien
cgagtagcatcctgtgacccctccc

SEQ ID NO: 69255 - DNA, 25 bp, Homo sapien
ggcccctgaaggtgccactccagtg

SEQ ID NO: 69256 - DNA, 25 bp, Homo sapien
gcccctgaaggtgccactccagtgc

SEQ ID NO: 69257 - DNA, 25 bp, Homo sapien
cccctgaaggtgccactccagtgcc

SEQ ID NO: 69258 - DNA, 25 bp, Homo sapien
ggactaggtttcatgggacaaaggc

SEQ ID NO: 69259 - DNA, 25 bp, Homo sapien
gactaggtttcatgggacaaaggca

SEQ ID NO: 69260 - DNA, 25 bp, Homo sapien
actaggtttcatgggacaaaggcat

SEQ ID NO: 69261 - DNA, 25 bp, Homo sapien
taggtttcatgggacaaaggcattc

SEQ ID NO: 69262 - DNA, 25 bp, Homo sapien
aggtttcatgggacaaaggcattct

SEQ ID NO: 69263 - DNA, 25 bp, Homo sapien
ggtttcatgggacaaaggcattctg

SEQ ID NO: 69264 - DNA, 25 bp, Homo sapien
gtttcatgggacaaaggcattctgc

SEQ ID NO: 69265 - DNA, 25 bp, Homo sapien
aaggcattctgcaagaagtagaagc

SEQ ID NO: 69266 - DNA, 25 bp, Homo sapien
ggcattctgcaagaagtagaagctt

SEQ ID NO: 69267 - DNA, 25 bp, Homo sapien
tgcaagaagtagaagcttgtggccg

SEQ ID NO: 69268 - DNA, 25 bp, Homo sapien
aagaagtagaagcttgtggccgggt

SEQ ID NO: 69269 - DNA, 25 bp, Homo sapien
atcagtgtttctgctataaatctct

SEQ ID NO: 69270 - DNA, 25 bp, Homo sapien
ataaatctctttgttgctctgtagt

SEQ ID NO: 69271 - DNA, 25 bp, Homo sapien
gctctgtagttttgatgcattgttt

SEQ ID NO: 69272 - DNA, 25 bp, Homo sapien
atgcattgttttatctctcttattc

SEQ ID NO: 69273 - DNA, 25 bp, Homo sapien
tatctctcttattcctttacttgaa

SEQ ID NO: 69274 - DNA, 25 bp, Homo sapien
taacttatagggatccacaggagat

SEQ ID NO: 69275 - DNA, 25 bp, Homo sapien
tacgtgttggccaaagtcactggat

SEQ ID NO: 69276 - DNA, 25 bp, Homo sapien
gcaaattcagaaagttggtccagat

SEQ ID NO: 69277 - DNA, 25 bp, Homo sapien
gaacttttcacttgtatactactct

SEQ ID NO: 69278 - DNA, 25 bp, Homo sapien
gtatactactcttacaatggaaaaa

SEQ ID NO: 69279 - DNA, 25 bp, Homo sapien
aaatcccgaaaactgtatacttctg

SEQ ID NO: 69280 - DNA, 25 bp, Homo sapien
cctaccaggagtttaggctggaaga

SEQ ID NO: 69281 - DNA, 25 bp, Homo sapien
ctaccaggagtttaggctggaagac

SEQ ID NO: 69282 - DNA, 25 bp, Homo sapien
taccaggagtttaggctggaagacg

SEQ ID NO: 69283 - DNA, 25 bp, Homo sapien
accaggagtttaggctggaagacgg

SEQ ID NO: 69284 - DNA, 25 bp, Homo sapien
ccaggagtttaggctggaagacggc

SEQ ID NO: 69285 - DNA, 25 bp, Homo sapien
gtgcccgagtagcatcctgtgaccc

SEQ ID NO: 69286 - DNA, 25 bp, Homo sapien
tgcccgagtagcatcctgtgacccc

SEQ ID NO: 69287 - DNA, 25 bp, Homo sapien
gcccgagtagcatcctgtgacccct

SEQ ID NO: 69288 - DNA, 25 bp, Homo sapien
ccgagtagcatcctgtgacccctcc

SEQ ID NO: 69289 - DNA, 25 bp, Homo sapien
cgagtagcatcctgtgacccctccc

SEQ ID NO: 69290 - DNA, 25 bp, Homo sapien
ggcccctgaaggtgccactccagtg

SEQ ID NO: 69291 - DNA, 25 bp, Homo sapien
gagcaggaacttcaagctgtgattc

SEQ ID NO: 69292 - DNA, 25 bp, Homo sapien
aagctgtgattctatctcggctcag

SEQ ID NO: 69293 - DNA, 25 bp, Homo sapien
tatctcggctcagacttttggttgg

SEQ ID NO: 69294 - DNA, 25 bp, Homo sapien
aaaagatcttcatggccccaaatcc

SEQ ID NO: 69295 - DNA, 25 bp, Homo sapien
aaatcccctgagacatgccttgtag

SEQ ID NO: 69296 - DNA, 25 bp, Homo sapien
gattttgtgatgttgtgatgcttgt

SEQ ID NO: 69297 - DNA, 25 bp, Homo sapien
gcttgtggagcatcgcgtaaggctt

SEQ ID NO: 69298 - DNA, 25 bp, Homo sapien
catcgcgtaaggcttcttgcttatt

SEQ ID NO: 69299 - DNA, 25 bp, Homo sapien
ggcttcttgcttatttaaactgtgc

SEQ ID NO: 69300 - DNA, 25 bp, Homo sapien
aaaaatcaagcctttggagccacag

SEQ ID NO: 69301 - DNA, 25 bp, Homo sapien
gctcaagtacatgccaatgttgttt

SEQ ID NO: 69302 - DNA, 25 bp, Homo sapien
ggaatgacctttagattgtgcgact

SEQ ID NO: 69303 - DNA, 25 bp, Homo sapien
agattgtgcgacttttgtttttgtt

SEQ ID NO: 69304 - DNA, 25 bp, Homo sapien
aaccaagaatgatttctcctgcttc

SEQ ID NO: 69305 - DNA, 25 bp, Homo sapien
ttcccagacggagttcaaaggccac

SEQ ID NO: 69306 - DNA, 25 bp, Homo sapien
agttcaaaggccacttctcaagcag

SEQ ID NO: 69307 - DNA, 25 bp, Homo sapien
tctcaagcagcttttggcaccttca

SEQ ID NO: 69308 - DNA, 25 bp, Homo sapien
tttggcaccttcagcctcagagtgg

SEQ ID NO: 69309 - DNA, 25 bp, Homo sapien
cagcctcagagtggaatcttttaaa

SEQ ID NO: 69310 - DNA, 25 bp, Homo sapien
atcttttaaagacaggacccctatg

SEQ ID NO: 69311 - DNA, 25 bp, Homo sapien
gacaggacccctatgtccaggaaag

SEQ ID NO: 69312 - DNA, 25 bp, Homo sapien
gaactttgccaatgatagtgaccac

SEQ ID NO: 69313 - DNA, 25 bp, Homo sapien
gctcgcatccccttcaagacgtttt

SEQ ID NO: 69314 - DNA, 25 bp, Homo sapien
gcatccccttcaagacgttttccta

SEQ ID NO: 69315 - DNA, 25 bp, Homo sapien
tcctacgtttaccgctacttggcca

SEQ ID NO: 69316 - DNA, 25 bp, Homo sapien
ttagactcagatgtgtctcccttgg

SEQ ID NO: 69317 - DNA, 25 bp, Homo sapien
gactcagatgtgtctcccttggaga

SEQ ID NO: 69318 - DNA, 25 bp, Homo sapien
agatgtgtctcccttggagacggaa

SEQ ID NO: 69319 - DNA, 25 bp, Homo sapien
tctcccttggagacggaatcctacc

SEQ ID NO: 69320 - DNA, 25 bp, Homo sapien
ttggagacggaatcctaccttgcct

SEQ ID NO: 69321 - DNA, 25 bp, Homo sapien
ggagacggaatcctaccttgcctct

SEQ ID NO: 69322 - DNA, 25 bp, Homo sapien
ctaccttgcctctctaaaggaaaat

SEQ ID NO: 69323 - DNA, 25 bp, Homo sapien
aaggaaaatatagacgccaggaaga

SEQ ID NO: 69324 - DNA, 25 bp, Homo sapien
ccagtgttgctgaattaaaattctg

SEQ ID NO: 69325 - DNA, 25 bp, Homo sapien
aattctgctggactttttaacatag

SEQ ID NO: 69326 - DNA, 25 bp, Homo sapien
ggactttttaacatagcaaatccga

SEQ ID NO: 69327 - DNA, 25 bp, Homo sapien
agcaaatccgatgtttataaactgg

SEQ ID NO: 69328 - DNA, 25 bp, Homo sapien
tgagtgggaaagtattacccttgtt

SEQ ID NO: 69329 - DNA, 25 bp, Homo sapien
tacccttgttttaaatatctaagca

SEQ ID NO: 69330 - DNA, 25 bp, Homo sapien
tctaagcaatgcctatcaacccttt

SEQ ID NO: 69331 - DNA, 25 bp, Homo sapien
aatgcctatcaacccttttttgtgt

SEQ ID NO: 69332 - DNA, 25 bp, Homo sapien
gcctatcaacccttttttgtgttat

SEQ ID NO: 69333 - DNA, 25 bp, Homo sapien
acccttttttgtgttatgattactg

SEQ ID NO: 69334 - DNA, 25 bp, Homo sapien
tgattactgtagtcatatttatgaa

SEQ ID NO: 69335 - DNA, 25 bp, Homo sapien
taggcttgaagcatagagctactgt

SEQ ID NO: 69336 - DNA, 25 bp, Homo sapien
gctactgtagggtgaaaaatctctg

SEQ ID NO: 69337 - DNA, 25 bp, Homo sapien
gggcttcagtaccatttacacccac

SEQ ID NO: 69338 - DNA, 25 bp, Homo sapien
agtaccatttacacccacgatgaag

SEQ ID NO: 69339 - DNA, 25 bp, Homo sapien
tacacccacgatgaagggcttaaat

SEQ ID NO: 69340 - DNA, 25 bp, Homo sapien
gtagccatttatatttgtgaccttg

SEQ ID NO: 69341 - DNA, 25 bp, Homo sapien
atttgtgaccttgcattaatattta

SEQ ID NO: 69342 - DNA, 25 bp, Homo sapien
gattttaatatggagctagcacaca

SEQ ID NO: 69343 - DNA, 25 bp, Homo sapien
gagctagcacacatagatgcgcagg

SEQ ID NO: 69344 - DNA, 25 bp, Homo sapien
gatgcgcaggcacgcacacacaaaa

SEQ ID NO: 69345 - DNA, 25 bp, Homo sapien
acaagcaaatgtaactccaggcatt

SEQ ID NO: 69346 - DNA, 25 bp, Homo sapien
gacctggcctagcagtttggccctg

SEQ ID NO: 69347 - DNA, 25 bp, Homo sapien
cctgctggccttagcagggagacag

SEQ ID NO: 69348 - DNA, 25 bp, Homo sapien
gcaaagaacgccaagccggaggccc

SEQ ID NO: 69349 - DNA, 25 bp, Homo sapien
cggcctctcgagagccagagcagca

SEQ ID NO: 69350 - DNA, 25 bp, Homo sapien
ccagagcagcagttgaatgtaatgc

SEQ ID NO: 69351 - DNA, 25 bp, Homo sapien
gggacccggacagccaggtgactac

SEQ ID NO: 69352 - DNA, 25 bp, Homo sapien
gacagccaggtgactaccagtcctg

SEQ ID NO: 69353 - DNA, 25 bp, Homo sapien
gggacacactcaccataaacacatc

SEQ ID NO: 69354 - DNA, 25 bp, Homo sapien
acatccccaggcaggacagatcggg

SEQ ID NO: 69355 - DNA, 25 bp, Homo sapien
gggtgtgtaccaggctatgatttct

SEQ ID NO: 69356 - DNA, 25 bp, Homo sapien
taccaggctatgatttctcttgcat

SEQ ID NO: 69357 - DNA, 25 bp, Homo sapien
tgccccttatacctttactgatgtt

SEQ ID NO: 69358 - DNA, 25 bp, Homo sapien
ttactgatgtttctagcctatgtgg

SEQ ID NO: 69359 - DNA, 25 bp, Homo sapien
gtttctagcctatgtggcctacaaa

SEQ ID NO: 69360 - DNA, 25 bp, Homo sapien
gggaaaagctatgttgttcacatta

SEQ ID NO: 69361 - DNA, 25 bp, Homo sapien
ctgctttttgtaagccattgctgaa

SEQ ID NO: 69362 - DNA, 25 bp, Homo sapien
actaaactcttgaaccaattctagg

SEQ ID NO: 69363 - DNA, 25 bp, Homo sapien
accaattctaggacaggtttgcaga

SEQ ID NO: 69364 - DNA, 25 bp, Homo sapien
gcagaatgattttcttaaaggacct

SEQ ID NO: 69365 - DNA, 25 bp, Homo sapien
ggacctttataatctattaccctga

SEQ ID NO: 69366 - DNA, 25 bp, Homo sapien
atttctgagacttaacattcgtaac

SEQ ID NO: 69367 - DNA, 25 bp, Homo sapien
cattcgtaacactagggcatgatta

SEQ ID NO: 69368 - DNA, 25 bp, Homo sapien
tgcttaatcatacgtcaaaatctgt

SEQ ID NO: 69369 - DNA, 25 bp, Homo sapien
aatctgtaaaatctgctcttgcatg

SEQ ID NO: 69370 - DNA, 25 bp, Homo sapien
aaaatctgctcttgcatgctaaggt

SEQ ID NO: 69371 - DNA, 25 bp, Homo sapien
taaacagaccactatctacacattt

SEQ ID NO: 69372 - DNA, 25 bp, Homo sapien
tctacacatttattccccaaatact

SEQ ID NO: 69373 - DNA, 25 bp, Homo sapien
aatacttattagctgacaccatata

SEQ ID NO: 69374 - DNA, 25 bp, Homo sapien
tagacttcactgagcctttctccca

SEQ ID NO: 69375 - DNA, 25 bp, Homo sapien
ttctcccattggtagcttgctctaa

SEQ ID NO: 69376 - DNA, 25 bp, Homo sapien
tggtagcttgctctaaacttacaaa

SEQ ID NO: 69377 - DNA, 25 bp, Homo sapien
gaattctttggcatgatctgacttt

SEQ ID NO: 69378 - DNA, 25 bp, Homo sapien
ggcatgatctgactttccaactaaa

SEQ ID NO: 69379 - DNA, 25 bp, Homo sapien
aaggacatggacaaggtcgagacat

SEQ ID NO: 69380 - DNA, 25 bp, Homo sapien
aggacatggacaaggtcgagacatt

SEQ ID NO: 69381 - DNA, 25 bp, Homo sapien
ggacatggacaaggtcgagacattc

SEQ ID NO: 69382 - DNA, 25 bp, Homo sapien
gacatggacaaggtcgagacattcc

SEQ ID NO: 69383 - DNA, 25 bp, Homo sapien
acatggacaaggtcgagacattcct

SEQ ID NO: 69384 - DNA, 25 bp, Homo sapien
catggacaaggtcgagacattcctg

SEQ ID NO: 69385 - DNA, 25 bp, Homo sapien
atggacaaggtcgagacattcctgc

SEQ ID NO: 69386 - DNA, 25 bp, Homo sapien
tggacaaggtcgagacattcctgcg

SEQ ID NO: 69387 - DNA, 25 bp, Homo sapien
ggacaaggtcgagacattcctgcgc

SEQ ID NO: 69388 - DNA, 25 bp, Homo sapien
gacaaggtcgagacattcctgcgca

SEQ ID NO: 69389 - DNA, 25 bp, Homo sapien
acaaggtcgagacattcctgcgcat

SEQ ID NO: 69390 - DNA, 25 bp, Homo sapien
tgggccagcggctgagctgtacata

SEQ ID NO: 69391 - DNA, 25 bp, Homo sapien
ggctgagctgtacataccgtgtgca

SEQ ID NO: 69392 - DNA, 25 bp, Homo sapien
gctgtacataccgtgtgcaaagtgt

SEQ ID NO: 69393 - DNA, 25 bp, Homo sapien
accgtgtgcaaagtgtatatgaagt

SEQ ID NO: 69394 - DNA, 25 bp, Homo sapien
aagttatttattcgtgacccatgag

SEQ ID NO: 69395 - DNA, 25 bp, Homo sapien
ttatttattcgtgacccatgagccc

SEQ ID NO: 69396 - DNA, 25 bp, Homo sapien
ttattcgtgacccatgagcccgtga

SEQ ID NO: 69397 - DNA, 25 bp, Homo sapien
cccgtgaccgtgtccgtggattagt

SEQ ID NO: 69398 - DNA, 25 bp, Homo sapien
cgtgtccgtggattagtgagtctgt

SEQ ID NO: 69399 - DNA, 25 bp, Homo sapien
gattagtgagtctgtggcctgtgcc

SEQ ID NO: 69400 - DNA, 25 bp, Homo sapien
tagtgagtctgtggcctgtgccctc

SEQ ID NO: 69401 - DNA, 25 bp, Homo sapien
aagatttatgattctccttccaaga

SEQ ID NO: 69402 - DNA, 25 bp, Homo sapien
ttatgattctccttccaagacacac

SEQ ID NO: 69403 - DNA, 25 bp, Homo sapien
tgattctccttccaagacacacata

SEQ ID NO: 69404 - DNA, 25 bp, Homo sapien
tctccttccaagacacacataactt

SEQ ID NO: 69405 - DNA, 25 bp, Homo sapien
cagttttctctcaagtctttatcaa

SEQ ID NO: 69406 - DNA, 25 bp, Homo sapien
gtctttatcaagatttctctcatat

SEQ ID NO: 69407 - DNA, 25 bp, Homo sapien
tcaagatttctctcatatcacaaat

SEQ ID NO: 69408 - DNA, 25 bp, Homo sapien
agttacattatatcccttagctgac

SEQ ID NO: 69409 - DNA, 25 bp, Homo sapien
acattatatcccttagctgacctgt

SEQ ID NO: 69410 - DNA, 25 bp, Homo sapien
atatcccttagctgacctgttaatt

SEQ ID NO: 69411 - DNA, 25 bp, Homo sapien
tcccttagctgacctgttaattttt

SEQ ID NO: 69412 - DNA, 25 bp, Homo sapien
aggccctgcacagagtagcactcat

SEQ ID NO: 69413 - DNA, 25 bp, Homo sapien
gagtagcactcattaattcttggtt

SEQ ID NO: 69414 - DNA, 25 bp, Homo sapien
atgaatcaacgaatgaatggctatg

SEQ ID NO: 69415 - DNA, 25 bp, Homo sapien
aatggctatgcatggacctctgggc

SEQ ID NO: 69416 - DNA, 25 bp, Homo sapien
agacctgggtcttctctggctgaga

SEQ ID NO: 69417 - DNA, 25 bp, Homo sapien
aggctaaggcatggctgagattcaa

SEQ ID NO: 69418 - DNA, 25 bp, Homo sapien
tgagattcaagccaccattccaggc

SEQ ID NO: 69419 - DNA, 25 bp, Homo sapien
ggcctctttgcccaagaaagaaact

SEQ ID NO: 69420 - DNA, 25 bp, Homo sapien
gaaacttctgtcacccttgcactct

SEQ ID NO: 69421 - DNA, 25 bp, Homo sapien
ttctgagtccctggccaatagcaca

SEQ ID NO: 69422 - DNA, 25 bp, Homo sapien
ctggccaatagcacagccttccatg

SEQ ID NO: 69423 - DNA, 25 bp, Homo sapien
ttctcgaggtaagagattcagccat

SEQ ID NO: 69424 - DNA, 25 bp, Homo sapien
ttcagccatccaattggttttaggt

SEQ ID NO: 69425 - DNA, 25 bp, Homo sapien
ggttttaggtcttgcatatcagttt

SEQ ID NO: 69426 - DNA, 25 bp, Homo sapien
ggtcttgcatatcagttttattact

SEQ ID NO: 69427 - DNA, 25 bp, Homo sapien
tattactgcaccatgtttacttcaa

SEQ ID NO: 69428 - DNA, 25 bp, Homo sapien
atttttccagtctaccgtggtccag

SEQ ID NO: 69429 - DNA, 25 bp, Homo sapien
gtggtccaggttatcagctctttaa

SEQ ID NO: 69430 - DNA, 25 bp, Homo sapien
gagctctattaattgccatgtttac

SEQ ID NO: 69431 - DNA, 25 bp, Homo sapien
caggtagatctttagcagtcttttc

SEQ ID NO: 69432 - DNA, 25 bp, Homo sapien
agcagtcttttctagtttccctgga

SEQ ID NO: 69433 - DNA, 25 bp, Homo sapien
tcttttctagtttccctggatttca

SEQ ID NO: 69434 - DNA, 25 bp, Homo sapien
aaggacatggacaaggtcgagacat

SEQ ID NO: 69435 - DNA, 25 bp, Homo sapien
aggacatggacaaggtcgagacatt

SEQ ID NO: 69436 - DNA, 25 bp, Homo sapien
ggacatggacaaggtcgagacattc

SEQ ID NO: 69437 - DNA, 25 bp, Homo sapien
gacatggacaaggtcgagacattcc

SEQ ID NO: 69438 - DNA, 25 bp, Homo sapien
acatggacaaggtcgagacattcct

SEQ ID NO: 69439 - DNA, 25 bp, Homo sapien
catggacaaggtcgagacattcctg

SEQ ID NO: 69440 - DNA, 25 bp, Homo sapien
atggacaaggtcgagacattcctgc

SEQ ID NO: 69441 - DNA, 25 bp, Homo sapien
tggacaaggtcgagacattcctgcg

SEQ ID NO: 69442 - DNA, 25 bp, Homo sapien
ggacaaggtcgagacattcctgcgc

SEQ ID NO: 69443 - DNA, 25 bp, Homo sapien
gacaaggtcgagacattcctgcgca

SEQ ID NO: 69444 - DNA, 25 bp, Homo sapien
acaaggtcgagacattcctgcgcat

SEQ ID NO: 69445 - DNA, 25 bp, Homo sapien
atttcttcctgcaggttaagcaccg

SEQ ID NO: 69446 - DNA, 25 bp, Homo sapien
ttcctgcaggttaagcaccgcaatg

SEQ ID NO: 69447 - DNA, 25 bp, Homo sapien
taagcaccgcaatgggcagtcaatt

SEQ ID NO: 69448 - DNA, 25 bp, Homo sapien
caatgggcagtcaattgcagtgtat

SEQ ID NO: 69449 - DNA, 25 bp, Homo sapien
tcaattgcagtgtatataagactca

SEQ ID NO: 69450 - DNA, 25 bp, Homo sapien
agactcagaatccgtctttgccctt

SEQ ID NO: 69451 - DNA, 25 bp, Homo sapien
gtctttgcccttcaaggatttttca

SEQ ID NO: 69452 - DNA, 25 bp, Homo sapien
tgcccttcaaggatttttcacgtat

SEQ ID NO: 69453 - DNA, 25 bp, Homo sapien
ggatttttcacgtatcataaacaac

SEQ ID NO: 69454 - DNA, 25 bp, Homo sapien
tgtttttgcaaagtgctttcataat

SEQ ID NO: 69455 - DNA, 25 bp, Homo sapien
tgggcctctaataagttggaacaat

SEQ ID NO: 69456 - DNA, 25 bp, Homo sapien
aaggacatggacaaggtcgagacat

SEQ ID NO: 69457 - DNA, 25 bp, Homo sapien
aggacatggacaaggtcgagacatt

SEQ ID NO: 69458 - DNA, 25 bp, Homo sapien
ggacatggacaaggtcgagacattc

SEQ ID NO: 69459 - DNA, 25 bp, Homo sapien
gacatggacaaggtcgagacattcc

SEQ ID NO: 69460 - DNA, 25 bp, Homo sapien
acatggacaaggtcgagacattcct

SEQ ID NO: 69461 - DNA, 25 bp, Homo sapien
catggacaaggtcgagacattcctg

SEQ ID NO: 69462 - DNA, 25 bp, Homo sapien
atggacaaggtcgagacattcctgc

SEQ ID NO: 69463 - DNA, 25 bp, Homo sapien
tggacaaggtcgagacattcctgcg

SEQ ID NO: 69464 - DNA, 25 bp, Homo sapien
ggacaaggtcgagacattcctgcgc

SEQ ID NO: 69465 - DNA, 25 bp, Homo sapien
gacaaggtcgagacattcctgcgca

SEQ ID NO: 69466 - DNA, 25 bp, Homo sapien
acaaggtcgagacattcctgcgcat

SEQ ID NO: 69467 - DNA, 25 bp, Homo sapien
tcttaacattggtatcccttccctg

SEQ ID NO: 69468 - DNA, 25 bp, Homo sapien
tcccttccctgacaaagtgttgcaa

SEQ ID NO: 69469 - DNA, 25 bp, Homo sapien
gttgcaaccaacacgacaggtgcta

SEQ ID NO: 69470 - DNA, 25 bp, Homo sapien
aggtgctatgagacctgtggcaaaa

SEQ ID NO: 69471 - DNA, 25 bp, Homo sapien
gaagaattccagtattgcctctcca

SEQ ID NO: 69472 - DNA, 25 bp, Homo sapien
tgcctctccaagatctgccgagatg

SEQ ID NO: 69473 - DNA, 25 bp, Homo sapien
aactcagcatgttcaggcatgtgaa

SEQ ID NO: 69474 - DNA, 25 bp, Homo sapien
tgtgaaacaacagtggagctcttgt

SEQ ID NO: 69475 - DNA, 25 bp, Homo sapien
gttgtaaaccatatctggacagcca

SEQ ID NO: 69476 - DNA, 25 bp, Homo sapien
tggacagccaacgagccgcatgcag

SEQ ID NO: 69477 - DNA, 25 bp, Homo sapien
gagccgcatgcaggtgtcattatga

SEQ ID NO: 69478 - DNA, 25 bp, Homo sapien
cagtatgtcacagtcatgcacattc

SEQ ID NO: 69479 - DNA, 25 bp, Homo sapien
gtcacagtcatgcacattcaagaga

SEQ ID NO: 69480 - DNA, 25 bp, Homo sapien
cttttatgagcaatcccttatgcat

SEQ ID NO: 69481 - DNA, 25 bp, Homo sapien
aatcccttatgcatagactaccttg

SEQ ID NO: 69482 - DNA, 25 bp, Homo sapien
agactaccttggcaaaagagcatta

SEQ ID NO: 69483 - DNA, 25 bp, Homo sapien
aaaagagcattagcaagtgtcactg

SEQ ID NO: 69484 - DNA, 25 bp, Homo sapien
agtgtcactgctcatcagttacttc

SEQ ID NO: 69485 - DNA, 25 bp, Homo sapien
tatatcacaaatacccaagtttcaa

SEQ ID NO: 69486 - DNA, 25 bp, Homo sapien
gtttcaattctaacttcatttcatg

SEQ ID NO: 69487 - DNA, 25 bp, Homo sapien
tcttcctcctcaatgcccaaggtaa

SEQ ID NO: 69488 - DNA, 25 bp, Homo sapien
ataagggcacctattgagattcaag

SEQ ID NO: 69489 - DNA, 25 bp, Homo sapien
tcaccatccctgacttgactgatgt

SEQ ID NO: 69490 - DNA, 25 bp, Homo sapien
gaatgccatagatcggtggtcccgc

SEQ ID NO: 69491 - DNA, 25 bp, Homo sapien
gtcccgcatattcttcccagtggtt

SEQ ID NO: 69492 - DNA, 25 bp, Homo sapien
aacatggcctcccactggaagcaag

SEQ ID NO: 69493 - DNA, 25 bp, Homo sapien
gaagcaaggactagattcctcctca

SEQ ID NO: 69494 - DNA, 25 bp, Homo sapien
ttcctcctcaaaccagttgtacagc

SEQ ID NO: 69495 - DNA, 25 bp, Homo sapien
gttgtacagcctgatgtaggacttg

SEQ ID NO: 69496 - DNA, 25 bp, Homo sapien
aaataccttagttgctggcctatcc

SEQ ID NO: 69497 - DNA, 25 bp, Homo sapien
tggcctatcctgtggtccatttcat

SEQ ID NO: 69498 - DNA, 25 bp, Homo sapien
ggtccatttcataccatttgggttg

SEQ ID NO: 69499 - DNA, 25 bp, Homo sapien
ccatttgggttgcttctgctaagta

SEQ ID NO: 69500 - DNA, 25 bp, Homo sapien
aatggtaggtaacaattaaatggca

SEQ ID NO: 69501 - DNA, 25 bp, Homo sapien
tttaaaaatttgctgaatgcttgct

SEQ ID NO: 69502 - DNA, 25 bp, Homo sapien
ttaaaaatttgctgaatgcttgcta

SEQ ID NO: 69503 - DNA, 25 bp, Homo sapien
tttgctgaatgcttgctacgagcgg

SEQ ID NO: 69504 - DNA, 25 bp, Homo sapien
ttgctgaatgcttgctacgagcggt

SEQ ID NO: 69505 - DNA, 25 bp, Homo sapien
tgctgaatgcttgctacgagcggtg

SEQ ID NO: 69506 - DNA, 25 bp, Homo sapien
ctgaatgcttgctacgagcggtggc

SEQ ID NO: 69507 - DNA, 25 bp, Homo sapien
tgaatgcttgctacgagcggtggct

SEQ ID NO: 69508 - DNA, 25 bp, Homo sapien
aatgcttgctacgagcggtggctca

SEQ ID NO: 69509 - DNA, 25 bp, Homo sapien
atgcttgctacgagcggtggctcat

SEQ ID NO: 69510 - DNA, 25 bp, Homo sapien
tgcttgctacgagcggtggctcatg

SEQ ID NO: 69511 - DNA, 25 bp, Homo sapien
agtgagggcccgcacaccacccacg

SEQ ID NO: 69512 - DNA, 25 bp, Homo sapien
tgagggcccgcacaccacccacgtg

SEQ ID NO: 69513 - DNA, 25 bp, Homo sapien
ccacgtgcctccagacagcgagtga

SEQ ID NO: 69514 - DNA, 25 bp, Homo sapien
acgtgcctccagacagcgagtgaca

SEQ ID NO: 69515 - DNA, 25 bp, Homo sapien
cgtgcctccagacagcgagtgacat

SEQ ID NO: 69516 - DNA, 25 bp, Homo sapien
gtgcctccagacagcgagtgacatc

SEQ ID NO: 69517 - DNA, 25 bp, Homo sapien
ctccagacagcgagtgacatcccat

SEQ ID NO: 69518 - DNA, 25 bp, Homo sapien
ccagacagcgagtgacatcccatct

SEQ ID NO: 69519 - DNA, 25 bp, Homo sapien
agacagcgagtgacatcccatctcc

SEQ ID NO: 69520 - DNA, 25 bp, Homo sapien
gacagcgagtgacatcccatctcct

SEQ ID NO: 69521 - DNA, 25 bp, Homo sapien
acagcgagtgacatcccatctcctc

SEQ ID NO: 69522 - DNA, 25 bp, Homo sapien
caaaactggtggcaaagctctctag

SEQ ID NO: 69523 - DNA, 25 bp, Homo sapien
aagctctctagagaaccacaaactg

SEQ ID NO: 69524 - DNA, 25 bp, Homo sapien
aactgttgcatccttactacatggg

SEQ ID NO: 69525 - DNA, 25 bp, Homo sapien
gaagatgtgcatgttcttggagaaa

SEQ ID NO: 69526 - DNA, 25 bp, Homo sapien
taacataccgacacttacatctggg

SEQ ID NO: 69527 - DNA, 25 bp, Homo sapien
cgacacttacatctgggtgaataat

SEQ ID NO: 69528 - DNA, 25 bp, Homo sapien
tcatcaaatctcttaactcacgctt

SEQ ID NO: 69529 - DNA, 25 bp, Homo sapien
atctcttaactcacgcttgcacaaa

SEQ ID NO: 69530 - DNA, 25 bp, Homo sapien
cgcttgcacaaacttcacctggaga

SEQ ID NO: 69531 - DNA, 25 bp, Homo sapien
ttacatgtcactatggctaagacac

SEQ ID NO: 69532 - DNA, 25 bp, Homo sapien
ggctaagacactaaaagccctctcc

SEQ ID NO: 69533 - DNA, 25 bp, Homo sapien
taccaggtgtcccaaggcaccgggc

SEQ ID NO: 69534 - DNA, 25 bp, Homo sapien
gggtcctcgtccacacatcggtatc

SEQ ID NO: 69535 - DNA, 25 bp, Homo sapien
aagcccagacaacctgcgtcgcttt

SEQ ID NO: 69536 - DNA, 25 bp, Homo sapien
cgtcgctttgccctggaacacgagg

SEQ ID NO: 69537 - DNA, 25 bp, Homo sapien
ttgccctggaacacgaggcctcgga

SEQ ID NO: 69538 - DNA, 25 bp, Homo sapien
aggcctcggacttggtggagatcta

SEQ ID NO: 69539 - DNA, 25 bp, Homo sapien
tggtggagatctacctctggaagct

SEQ ID NO: 69540 - DNA, 25 bp, Homo sapien
gatctacctctggaagctggtaaaa

SEQ ID NO: 69541 - DNA, 25 bp, Homo sapien
gagctgaaggtcacggccagtccag

SEQ ID NO: 69542 - DNA, 25 bp, Homo sapien
ggtcacggccagtccagacaaagtg

SEQ ID NO: 69543 - DNA, 25 bp, Homo sapien
gacataacaaagacctaacagttgc

SEQ ID NO: 69544 - DNA, 25 bp, Homo sapien
ggcagtctgcctaaagattcctttc

SEQ ID NO: 69545 - DNA, 25 bp, Homo sapien
gcctaaagattcctttccctgcctt

SEQ ID NO: 69546 - DNA, 25 bp, Homo sapien
tgccttctcccatacattccaaaag

SEQ ID NO: 69547 - DNA, 25 bp, Homo sapien
ggaagttcaacagtaagcagcacct

SEQ ID NO: 69548 - DNA, 25 bp, Homo sapien
gttcaacagtaagcagcacctccaa

SEQ ID NO: 69549 - DNA, 25 bp, Homo sapien
gtaagcagcacctccaagactgtct

SEQ ID NO: 69550 - DNA, 25 bp, Homo sapien
aagactgtctcctttcggccagtat

SEQ ID NO: 69551 - DNA, 25 bp, Homo sapien
tctcctttcggccagtatcataaga

SEQ ID NO: 69552 - DNA, 25 bp, Homo sapien
gatggacgccataatcctgaggctc

SEQ ID NO: 69553 - DNA, 25 bp, Homo sapien
cgccataatcctgaggctcctagag

SEQ ID NO: 69554 - DNA, 25 bp, Homo sapien
gcaagccagttgtcaaacacagcca

SEQ ID NO: 69555 - DNA, 25 bp, Homo sapien
atccctttgccttggcatccctgta

SEQ ID NO: 69556 - DNA, 25 bp, Homo sapien
cagcatcccagctgggccagagaga

SEQ ID NO: 69557 - DNA, 25 bp, Homo sapien
ccagagagagccgagtgtgccaaca

SEQ ID NO: 69558 - DNA, 25 bp, Homo sapien
agagccgagtgtgccaacaaggact

SEQ ID NO: 69559 - DNA, 25 bp, Homo sapien
tcagggatgggcacctcatgcctgt

SEQ ID NO: 69560 - DNA, 25 bp, Homo sapien
gggtgcagcttccacttactgatta

SEQ ID NO: 69561 - DNA, 25 bp, Homo sapien
tgcagcttccacttactgattagaa

SEQ ID NO: 69562 - DNA, 25 bp, Homo sapien
actgattagaagacaccactgccct

SEQ ID NO: 69563 - DNA, 25 bp, Homo sapien
tgattagaagacaccactgccctcc

SEQ ID NO: 69564 - DNA, 25 bp, Homo sapien
cccatctgtctgtctatatttgtct

SEQ ID NO: 69565 - DNA, 25 bp, Homo sapien
tgtctgtctatatttgtctgtactc

SEQ ID NO: 69566 - DNA, 25 bp, Homo sapien
ctgtgccatcatgatcagcacctat

SEQ ID NO: 69567 - DNA, 25 bp, Homo sapien
gatcagcacctatgagttcggcaaa

SEQ ID NO: 69568 - DNA, 25 bp, Homo sapien
tgagttcggcaaaagcttcttccag

SEQ ID NO: 69569 - DNA, 25 bp, Homo sapien
aagcttcttccagaggctgaaccag

SEQ ID NO: 69570 - DNA, 25 bp, Homo sapien
agaggctgaaccaggaccggcttct

SEQ ID NO: 69571 - DNA, 25 bp, Homo sapien
agctttgtggctggtggcatctcag

SEQ ID NO: 69572 - DNA, 25 bp, Homo sapien
ctgactctaccctttgacgtggtaa

SEQ ID NO: 69573 - DNA, 25 bp, Homo sapien
gacgtggtaaagacccaacgccagg

SEQ ID NO: 69574 - DNA, 25 bp, Homo sapien
tgtggactccacctggctgctgctg

SEQ ID NO: 69575 - DNA, 25 bp, Homo sapien
gtcgggcaccaagggactctttgca

SEQ ID NO: 69576 - DNA, 25 bp, Homo sapien
aggcttccttcctcggatcatcaag

SEQ ID NO: 69577 - DNA, 25 bp, Homo sapien
aactttcatagtacacatgaggtgg

SEQ ID NO: 69578 - DNA, 25 bp, Homo sapien
atttgatacacagaacatttgcggt

SEQ ID NO: 69579 - DNA, 25 bp, Homo sapien
aacatttgcggtgggctttctgtgg

SEQ ID NO: 69580 - DNA, 25 bp, Homo sapien
gggttagatgtaaagcccacatatt

SEQ ID NO: 69581 - DNA, 25 bp, Homo sapien
gaatgcagtgtcagtacctggccta

SEQ ID NO: 69582 - DNA, 25 bp, Homo sapien
agtgtcagtacctggcctattttta

SEQ ID NO: 69583 - DNA, 25 bp, Homo sapien
gtgtaatcaccctagtcataccatt

SEQ ID NO: 69584 - DNA, 25 bp, Homo sapien
atcaccctagtcataccattcagta

SEQ ID NO: 69585 - DNA, 25 bp, Homo sapien
taccattcagtatgtttgcttttta

SEQ ID NO: 69586 - DNA, 25 bp, Homo sapien
attaagttgttgtagcccttgcact

SEQ ID NO: 69587 - DNA, 25 bp, Homo sapien
gtagcccttgcacttcaagagatct

SEQ ID NO: 69588 - DNA, 25 bp, Homo sapien
gggtcaatcttgcaacaacctgccc

SEQ ID NO: 69589 - DNA, 25 bp, Homo sapien
ctgagccacaaggtctacatgagga

SEQ ID NO: 69590 - DNA, 25 bp, Homo sapien
gaggaactctaagtatccccaggat

SEQ ID NO: 69591 - DNA, 25 bp, Homo sapien
aagtatccccaggatctggtgatga

SEQ ID NO: 69592 - DNA, 25 bp, Homo sapien
tgatgagctactgcactactgggca

SEQ ID NO: 69593 - DNA, 25 bp, Homo sapien
gtgttcaatcttaccagtgctgatc

SEQ ID NO: 69594 - DNA, 25 bp, Homo sapien
gtgctgatcatttatatgtcaacgt

SEQ ID NO: 69595 - DNA, 25 bp, Homo sapien
tatgtcaacgtatctgagctctctc

SEQ ID NO: 69596 - DNA, 25 bp, Homo sapien
gtatctgagctctctctggtcaatt

SEQ ID NO: 69597 - DNA, 25 bp, Homo sapien
ggaatctcagacgtttttcggctta

SEQ ID NO: 69598 - DNA, 25 bp, Homo sapien
taagctctaagagaagcactttggg

SEQ ID NO: 69599 - DNA, 25 bp, Homo sapien
gtagagggtagctgtggcttctagg

SEQ ID NO: 69600 - DNA, 25 bp, Homo sapien
tagagggtagctgtggcttctaggt

SEQ ID NO: 69601 - DNA, 25 bp, Homo sapien
gtagctgtggcttctaggtgcccgc

SEQ ID NO: 69602 - DNA, 25 bp, Homo sapien
tagctgtggcttctaggtgcccgcg

SEQ ID NO: 69603 - DNA, 25 bp, Homo sapien
tgcccgcgtggcatcctgtgaccga

SEQ ID NO: 69604 - DNA, 25 bp, Homo sapien
gcccgcgtggcatcctgtgaccgac

SEQ ID NO: 69605 - DNA, 25 bp, Homo sapien
cccgcgtggcatcctgtgaccgacc

SEQ ID NO: 69606 - DNA, 25 bp, Homo sapien
ccgcgtggcatcctgtgaccgaccc

SEQ ID NO: 69607 - DNA, 25 bp, Homo sapien
cgcgtggcatcctgtgaccgacccc

SEQ ID NO: 69608 - DNA, 25 bp, Homo sapien
gcgtggcatcctgtgaccgacccct

SEQ ID NO: 69609 - DNA, 25 bp, Homo sapien
gtggcatcctgtgaccgacccctcc

SEQ ID NO: 69610 - DNA, 25 bp, Homo sapien
gtagggttgccctgcaagaatcggc

SEQ ID NO: 69611 - DNA, 25 bp, Homo sapien
gccctgcaagaatcggccgcctttt

SEQ ID NO: 69612 - DNA, 25 bp, Homo sapien
gggaacccccaaagaggcatcgtga

SEQ ID NO: 69613 - DNA, 25 bp, Homo sapien
agaggcatcgtgatggttctgcctt

SEQ ID NO: 69614 - DNA, 25 bp, Homo sapien
atcgtgatggttctgccttccagta

SEQ ID NO: 69615 - DNA, 25 bp, Homo sapien
atggttctgccttccagtatgagta

SEQ ID NO: 69616 - DNA, 25 bp, Homo sapien
tctgccttccagtatgagtatgagc

SEQ ID NO: 69617 - DNA, 25 bp, Homo sapien
ttccagtatgagtatgagccaccct

SEQ ID NO: 69618 - DNA, 25 bp, Homo sapien
gtccctctgtgctcgggtccaagct

SEQ ID NO: 69619 - DNA, 25 bp, Homo sapien
agctcatggcctgggccttgcactt

SEQ ID NO: 69620 - DNA, 25 bp, Homo sapien
gtcacgcaggacagataccgctcca

SEQ ID NO: 69621 - DNA, 25 bp, Homo sapien
tgaattccgggaaaagcacaacatt

SEQ ID NO: 69622 - DNA, 25 bp, Homo sapien
ttccgggaaaagcacaacattcgtc

SEQ ID NO: 69623 - DNA, 25 bp, Homo sapien
gggaaaagcacaacattcgtctcat

SEQ ID NO: 69624 - DNA, 25 bp, Homo sapien
aaagcacaacattcgtctcatggga

SEQ ID NO: 69625 - DNA, 25 bp, Homo sapien
agcacaacattcgtctcatgggaga

SEQ ID NO: 69626 - DNA, 25 bp, Homo sapien
agctcagctggagtgttggtctcct

SEQ ID NO: 69627 - DNA, 25 bp, Homo sapien
tcagctggagtgttggtctcctagg

SEQ ID NO: 69628 - DNA, 25 bp, Homo sapien
ctggagtgttggtctcctagggacc

SEQ ID NO: 69629 - DNA, 25 bp, Homo sapien
ggagtgttggtctcctagggaccaa

SEQ ID NO: 69630 - DNA, 25 bp, Homo sapien
gtctcctagggaccaaggcctttgc

SEQ ID NO: 69631 - DNA, 25 bp, Homo sapien
cctagggaccaaggcctttgcattt

SEQ ID NO: 69632 - DNA, 25 bp, Homo sapien
atgagttaacggctctttccctcaa

SEQ ID NO: 69633 - DNA, 25 bp, Homo sapien
tcaaccttagtctagtcccagggct

SEQ ID NO: 69634 - DNA, 25 bp, Homo sapien
accttagtctagtcccagggctgag

SEQ ID NO: 69635 - DNA, 25 bp, Homo sapien
gattcagctggatccacatggtctt

SEQ ID NO: 69636 - DNA, 25 bp, Homo sapien
tccacatggtcttgagggttggcat

SEQ ID NO: 69637 - DNA, 25 bp, Homo sapien
gcttttttgaatcgctttttgatca

SEQ ID NO: 69638 - DNA, 25 bp, Homo sapien
gctttttgatcacataatctgccat

SEQ ID NO: 69639 - DNA, 25 bp, Homo sapien
gatcacataatctgccattttaaga

SEQ ID NO: 69640 - DNA, 25 bp, Homo sapien
aagttgcaataccatttcacagtga

SEQ ID NO: 69641 - DNA, 25 bp, Homo sapien
ttttgttgctagaatagtcatgggc

SEQ ID NO: 69642 - DNA, 25 bp, Homo sapien
agtcatgggcaagagttttatgcaa

SEQ ID NO: 69643 - DNA, 25 bp, Homo sapien
gggaatgacctgagagccacactca

SEQ ID NO: 69644 - DNA, 25 bp, Homo sapien
ggaatgacctgagagccacactcag

SEQ ID NO: 69645 - DNA, 25 bp, Homo sapien
gaatgacctgagagccacactcagc

SEQ ID NO: 69646 - DNA, 25 bp, Homo sapien
aatgacctgagagccacactcagct

SEQ ID NO: 69647 - DNA, 25 bp, Homo sapien
atgacctgagagccacactcagctc

SEQ ID NO: 69648 - DNA, 25 bp, Homo sapien
tgagagccacactcagctcctcaag

SEQ ID NO: 69649 - DNA, 25 bp, Homo sapien
gagagccacactcagctcctcaagg

SEQ ID NO: 69650 - DNA, 25 bp, Homo sapien
agagccacactcagctcctcaaggg

SEQ ID NO: 69651 - DNA, 25 bp, Homo sapien
gagccacactcagctcctcaagggc

SEQ ID NO: 69652 - DNA, 25 bp, Homo sapien
agccacactcagctcctcaagggca

SEQ ID NO: 69653 - DNA, 25 bp, Homo sapien
aagggcagcccagcttggggctcac

SEQ ID NO: 69654 - DNA, 25 bp, Homo sapien
aaggacatggacaaggtcgagacat

SEQ ID NO: 69655 - DNA, 25 bp, Homo sapien
aggacatggacaaggtcgagacatt

SEQ ID NO: 69656 - DNA, 25 bp, Homo sapien
ggacatggacaaggtcgagacattc

SEQ ID NO: 69657 - DNA, 25 bp, Homo sapien
gacatggacaaggtcgagacattcc

SEQ ID NO: 69658 - DNA, 25 bp, Homo sapien
acatggacaaggtcgagacattcct

SEQ ID NO: 69659 - DNA, 25 bp, Homo sapien
catggacaaggtcgagacattcctg

SEQ ID NO: 69660 - DNA, 25 bp, Homo sapien
atggacaaggtcgagacattcctgc

SEQ ID NO: 69661 - DNA, 25 bp, Homo sapien
tggacaaggtcgagacattcctgcg

SEQ ID NO: 69662 - DNA, 25 bp, Homo sapien
ggacaaggtcgagacattcctgcgc

SEQ ID NO: 69663 - DNA, 25 bp, Homo sapien
gacaaggtcgagacattcctgcgca

SEQ ID NO: 69664 - DNA, 25 bp, Homo sapien
acaaggtcgagacattcctgcgcat

SEQ ID NO: 69665 - DNA, 25 bp, Homo sapien
cctaccaggagtttaggctggaaga

SEQ ID NO: 69666 - DNA, 25 bp, Homo sapien
ctaccaggagtttaggctggaagac

SEQ ID NO: 69667 - DNA, 25 bp, Homo sapien
taccaggagtttaggctggaagacg

SEQ ID NO: 69668 - DNA, 25 bp, Homo sapien
accaggagtttaggctggaagacgg

SEQ ID NO: 69669 - DNA, 25 bp, Homo sapien
ccaggagtttaggctggaagacggc

SEQ ID NO: 69670 - DNA, 25 bp, Homo sapien
tgcccgcgtggcatcctgtgaccga

SEQ ID NO: 69671 - DNA, 25 bp, Homo sapien
gcccgcgtggcatcctgtgaccgac

SEQ ID NO: 69672 - DNA, 25 bp, Homo sapien
cccgcgtggcatcctgtgaccgacc

SEQ ID NO: 69673 - DNA, 25 bp, Homo sapien
ccgcgtggcatcctgtgaccgaccc

SEQ ID NO: 69674 - DNA, 25 bp, Homo sapien
cgcgtggcatcctgtgaccgacccc

SEQ ID NO: 69675 - DNA, 25 bp, Homo sapien
gcgtggcatcctgtgaccgacccct

SEQ ID NO: 69676 - DNA, 25 bp, Homo sapien
agccacctgactgggcagaccctca

SEQ ID NO: 69677 - DNA, 25 bp, Homo sapien
acctgactgggcagaccctcaagca

SEQ ID NO: 69678 - DNA, 25 bp, Homo sapien
gctgtggcttctaggggcccgcgtg

SEQ ID NO: 69679 - DNA, 25 bp, Homo sapien
ggcccgcgtggcatcctgtgacccc

SEQ ID NO: 69680 - DNA, 25 bp, Homo sapien
cacctagcggcaatggctgcagagg

SEQ ID NO: 69681 - DNA, 25 bp, Homo sapien
cggcaatggctgcagaggctggaag

SEQ ID NO: 69682 - DNA, 25 bp, Homo sapien
acggcagccacctgactgggcagac

SEQ ID NO: 69683 - DNA, 25 bp, Homo sapien
cggcagccacctgactgggcagacc

SEQ ID NO: 69684 - DNA, 25 bp, Homo sapien
ggcagccacctgactgggcagaccc

SEQ ID NO: 69685 - DNA, 25 bp, Homo sapien
gcagccacctgactgggcagaccct

SEQ ID NO: 69686 - DNA, 25 bp, Homo sapien
cagccacctgactgggcagaccctc

SEQ ID NO: 69687 - DNA, 25 bp, Homo sapien
ggaacgttcattccccgctgaagct

SEQ ID NO: 69688 - DNA, 25 bp, Homo sapien
tgaagcttctcaccagcatggccat

SEQ ID NO: 69689 - DNA, 25 bp, Homo sapien
accagcatggccatctcggtggtgt

SEQ ID NO: 69690 - DNA, 25 bp, Homo sapien
ggccatctcggtggtgtgcttcttc

SEQ ID NO: 69691 - DNA, 25 bp, Homo sapien
cttcttcttcctggtgcactgactg

SEQ ID NO: 69692 - DNA, 25 bp, Homo sapien
tggtgcactgactgcctggtgccca

SEQ ID NO: 69693 - DNA, 25 bp, Homo sapien
tgcctggtgcccagcacatgtgctg

SEQ ID NO: 69694 - DNA, 25 bp, Homo sapien
accctgtggtcttcctcgataaagg

SEQ ID NO: 69695 - DNA, 25 bp, Homo sapien
tcgataaagggaaccactttcttat

SEQ ID NO: 69696 - DNA, 25 bp, Homo sapien
tttgttatcctgtatacctcctcca

SEQ ID NO: 69697 - DNA, 25 bp, Homo sapien
gactaaccatgtgttatgttttcga

SEQ ID NO: 69698 - DNA, 25 bp, Homo sapien
ttagtgctttataaggagagacacc

SEQ ID NO: 69699 - DNA, 25 bp, Homo sapien
aaggagagacaccagagagatgatc

SEQ ID NO: 69700 - DNA, 25 bp, Homo sapien
gagacaccagagagatgatctctct

SEQ ID NO: 69701 - DNA, 25 bp, Homo sapien
acagtgagaagacagccgtctgcag

SEQ ID NO: 69702 - DNA, 25 bp, Homo sapien
actgttggcaccttgagacttccca

SEQ ID NO: 69703 - DNA, 25 bp, Homo sapien
gtttaagcctttcaggctacggctt

SEQ ID NO: 69704 - DNA, 25 bp, Homo sapien
ttcaggctacggctttctgttacag

SEQ ID NO: 69705 - DNA, 25 bp, Homo sapien
aggctacggctttctgttacagcag

SEQ ID NO: 69706 - DNA, 25 bp, Homo sapien
ctacggctttctgttacagcagcct

SEQ ID NO: 69707 - DNA, 25 bp, Homo sapien
acagcagcctgaactgagagtccat

SEQ ID NO: 69708 - DNA, 25 bp, Homo sapien
agcctgaactgagagtccatgccga

SEQ ID NO: 69709 - DNA, 25 bp, Homo sapien
tgaccaaggctgtcacccctatgtg

SEQ ID NO: 69710 - DNA, 25 bp, Homo sapien
tgtcacccctatgtggaccactatg

SEQ ID NO: 69711 - DNA, 25 bp, Homo sapien
ggaccactatgatcacaccatcgag

SEQ ID NO: 69712 - DNA, 25 bp, Homo sapien
gatcacaccatcgagaacaacactg

SEQ ID NO: 69713 - DNA, 25 bp, Homo sapien
gatagtctgcagtgacctcaacaag

SEQ ID NO: 69714 - DNA, 25 bp, Homo sapien
gacagagtgtgacaagcagacatgc

SEQ ID NO: 69715 - DNA, 25 bp, Homo sapien
gttctgtgcctcatgaaccagacgt

SEQ ID NO: 69716 - DNA, 25 bp, Homo sapien
tgaaccagacgtaccgagaggagta

SEQ ID NO: 69717 - DNA, 25 bp, Homo sapien
gagaggagtaccgtggcttcctcaa

SEQ ID NO: 69718 - DNA, 25 bp, Homo sapien
gcttcctcaatgtctactgccaggg

SEQ ID NO: 69719 - DNA, 25 bp, Homo sapien
acgcccaactgcagcatctatgaac

SEQ ID NO: 69720 - DNA, 25 bp, Homo sapien
cctctgttctcataaagcctcaaac

SEQ ID NO: 69721 - DNA, 25 bp, Homo sapien
taaagcctcaaacagttttttggag

SEQ ID NO: 69722 - DNA, 25 bp, Homo sapien
ttttccatgttgattgagggaggca

SEQ ID NO: 69723 - DNA, 25 bp, Homo sapien
atggataccaattaatcttgagatc

SEQ ID NO: 69724 - DNA, 25 bp, Homo sapien
tcttgagatcctgaacatgtgctga

SEQ ID NO: 69725 - DNA, 25 bp, Homo sapien
gaacatgtgctgatttttattgtgc

SEQ ID NO: 69726 - DNA, 25 bp, Homo sapien
tagtatttctgcaacgtgacctgat

SEQ ID NO: 69727 - DNA, 25 bp, Homo sapien
gcaacgtgacctgataatgaatcta

SEQ ID NO: 69728 - DNA, 25 bp, Homo sapien
gaatctattcatcctgagtaagcta

SEQ ID NO: 69729 - DNA, 25 bp, Homo sapien
cctgagtaagctatacttctgtgct

SEQ ID NO: 69730 - DNA, 25 bp, Homo sapien
tacttctgtgctttatattgatatg

SEQ ID NO: 69731 - DNA, 25 bp, Homo sapien
tttgtgcccacctcaagatgggcag

SEQ ID NO: 69732 - DNA, 25 bp, Homo sapien
agatgggcagtgtccctgttctgaa

SEQ ID NO: 69733 - DNA, 25 bp, Homo sapien
tccctgttctgaagtgccagtggca

SEQ ID NO: 69734 - DNA, 25 bp, Homo sapien
gctccagtggtagaggaccacgctt

SEQ ID NO: 69735 - DNA, 25 bp, Homo sapien
ggaccacgcttgaggtttgggacct

SEQ ID NO: 69736 - DNA, 25 bp, Homo sapien
ttgggacctgaagctccagtgtggt

SEQ ID NO: 69737 - DNA, 25 bp, Homo sapien
tggcctcttccctggactgggttga

SEQ ID NO: 69738 - DNA, 25 bp, Homo sapien
tggactgggttgaccgtctcgtctt

SEQ ID NO: 69739 - DNA, 25 bp, Homo sapien
tgggtgaaccagtttccaacattcc

SEQ ID NO: 69740 - DNA, 25 bp, Homo sapien
attcctccggatggtgctcaattac

SEQ ID NO: 69741 - DNA, 25 bp, Homo sapien
gctcaattaccccaataaccaggtg

SEQ ID NO: 69742 - DNA, 25 bp, Homo sapien
aaggtgaagcccagtgtgaatgaat

SEQ ID NO: 69743 - DNA, 25 bp, Homo sapien
gaatgaatcctgcttgttggtacaa

SEQ ID NO: 69744 - DNA, 25 bp, Homo sapien
agcaaagcccaggagtccttggtgc

SEQ ID NO: 69745 - DNA, 25 bp, Homo sapien
gagtccttggtgctcttcttttaac

SEQ ID NO: 69746 - DNA, 25 bp, Homo sapien
ttgggctgcccggtgttaactggtt

SEQ ID NO: 69747 - DNA, 25 bp, Homo sapien
gattatcacctctgtgttttgcctg

SEQ ID NO: 69748 - DNA, 25 bp, Homo sapien
gaagctactgacacccagagtggct

SEQ ID NO: 69749 - DNA, 25 bp, Homo sapien
agtggctcagcgatactcacacgtg

SEQ ID NO: 69750 - DNA, 25 bp, Homo sapien
tcacacgtgctttcagttactttcg

SEQ ID NO: 69751 - DNA, 25 bp, Homo sapien
gttactttcgcagcatttggttaaa

SEQ ID NO: 69752 - DNA, 25 bp, Homo sapien
tgagtttagctgcacatcctcactt

SEQ ID NO: 69753 - DNA, 25 bp, Homo sapien
tgttcaatgcgcagttcggcagcat

SEQ ID NO: 69754 - DNA, 25 bp, Homo sapien
agttcggcagcatcttccgcacctt

SEQ ID NO: 69755 - DNA, 25 bp, Homo sapien
ttctcaaggcgcctcgtgcgcttct

SEQ ID NO: 69756 - DNA, 25 bp, Homo sapien
gtgcgcttctctgacctctacatgg

SEQ ID NO: 69757 - DNA, 25 bp, Homo sapien
tcaactaccgcgtggacttcacctt

SEQ ID NO: 69758 - DNA, 25 bp, Homo sapien
cgaggcacccctctggatggaccag

SEQ ID NO: 69759 - DNA, 25 bp, Homo sapien
tggatggaccagctctgcaccggct

SEQ ID NO: 69760 - DNA, 25 bp, Homo sapien
ggtgacatggcccacatccgctgag

SEQ ID NO: 69761 - DNA, 25 bp, Homo sapien
cacatccgctgagggcacctttatt

SEQ ID NO: 69762 - DNA, 25 bp, Homo sapien
gagggcacctttattgtctgggaca

SEQ ID NO: 69763 - DNA, 25 bp, Homo sapien
acctttattgtctgggacaggccct

SEQ ID NO: 69764 - DNA, 25 bp, Homo sapien
ctggatgtgcccacagggaccaaga

SEQ ID NO: 69765 - DNA, 25 bp, Homo sapien
gaccaagaagtgaggtttccactgt

SEQ ID NO: 69766 - DNA, 25 bp, Homo sapien
gaagtgaggtttccactgtcttgcc

SEQ ID NO: 69767 - DNA, 25 bp, Homo sapien
gtttccactgtcttgcctgccaggg

SEQ ID NO: 69768 - DNA, 25 bp, Homo sapien
agtcgagccctgcagccaaacagag

SEQ ID NO: 69769 - DNA, 25 bp, Homo sapien
ctgcagccaaacagagccttcacaa

SEQ ID NO: 69770 - DNA, 25 bp, Homo sapien
ttcacaaccagccacacagagcctg

SEQ ID NO: 69771 - DNA, 25 bp, Homo sapien
ctgcctcagctgctcgcacagatta

SEQ ID NO: 69772 - DNA, 25 bp, Homo sapien
agctgctcgcacagattacttcagg

SEQ ID NO: 69773 - DNA, 25 bp, Homo sapien
tgctcgcacagattacttcagggct

SEQ ID NO: 69774 - DNA, 25 bp, Homo sapien
gcacagattacttcagggctggaaa

SEQ ID NO: 69775 - DNA, 25 bp, Homo sapien
attagctgagcatgttgacacacgc

SEQ ID NO: 69776 - DNA, 25 bp, Homo sapien
ttagctgagcatgttgacacacgcc

SEQ ID NO: 69777 - DNA, 25 bp, Homo sapien
tagctgagcatgttgacacacgccc

SEQ ID NO: 69778 - DNA, 25 bp, Homo sapien
agctgagcatgttgacacacgcccg

SEQ ID NO: 69779 - DNA, 25 bp, Homo sapien
gctgagcatgttgacacacgcccgt

SEQ ID NO: 69780 - DNA, 25 bp, Homo sapien
ctgagcatgttgacacacgcccgta

SEQ ID NO: 69781 - DNA, 25 bp, Homo sapien
tgagcatgttgacacacgcccgtaa

SEQ ID NO: 69782 - DNA, 25 bp, Homo sapien
gagcatgttgacacacgcccgtaat

SEQ ID NO: 69783 - DNA, 25 bp, Homo sapien
agcatgttgacacacgcccgtaatc

SEQ ID NO: 69784 - DNA, 25 bp, Homo sapien
tttcttcttggtgctatgacagtgt

SEQ ID NO: 69785 - DNA, 25 bp, Homo sapien
cagtgtgagactcaggttgtctgta

SEQ ID NO: 69786 - DNA, 25 bp, Homo sapien
tggcccgcgtgattgtggcatttaa

SEQ ID NO: 69787 - DNA, 25 bp, Homo sapien
ggcatttaaggagcagtggcccatg

SEQ ID NO: 69788 - DNA, 25 bp, Homo sapien
ccatgtgactgtggcattttcggca

SEQ ID NO: 69789 - DNA, 25 bp, Homo sapien
gcattttcggcacttttcattactt

SEQ ID NO: 69790 - DNA, 25 bp, Homo sapien
ttcattactttctgcttgaccggaa

SEQ ID NO: 69791 - DNA, 25 bp, Homo sapien
gaggcttagctatgtttccatcttc

SEQ ID NO: 69792 - DNA, 25 bp, Homo sapien
gaagactagttatatattccttact

SEQ ID NO: 69793 - DNA, 25 bp, Homo sapien
agaatgcatgttctgtgtgccctga

SEQ ID NO: 69794 - DNA, 25 bp, Homo sapien
tgcatgttctgtgtgccctgaaaat

SEQ ID NO: 69795 - DNA, 25 bp, Homo sapien
acggcagccacctgactgggcagac

SEQ ID NO: 69796 - DNA, 25 bp, Homo sapien
cggcagccacctgactgggcagacc

SEQ ID NO: 69797 - DNA, 25 bp, Homo sapien
ggcagccacctgactgggcagaccc

SEQ ID NO: 69798 - DNA, 25 bp, Homo sapien
gcagccacctgactgggcagaccct

SEQ ID NO: 69799 - DNA, 25 bp, Homo sapien
cagccacctgactgggcagaccctc

SEQ ID NO: 69800 - DNA, 25 bp, Homo sapien
agccacctgactgggcagaccctca

SEQ ID NO: 69801 - DNA, 25 bp, Homo sapien
acctgactgggcagaccctcaagca

SEQ ID NO: 69802 - DNA, 25 bp, Homo sapien
gctgtggcttctaggggcccgcgtg

SEQ ID NO: 69803 - DNA, 25 bp, Homo sapien
taggggcccgcgtggcatcctgtga

SEQ ID NO: 69804 - DNA, 25 bp, Homo sapien
aggggcccgcgtggcatcctgtgac

SEQ ID NO: 69805 - DNA, 25 bp, Homo sapien
ggcccgcgtggcatcctgtgacccc

SEQ ID NO: 69806 - DNA, 25 bp, Homo sapien
aaggacatggacaaggtcgagacat

SEQ ID NO: 69807 - DNA, 25 bp, Homo sapien
aggacatggacaaggtcgagacatt

SEQ ID NO: 69808 - DNA, 25 bp, Homo sapien
ggacatggacaaggtcgagacattc

SEQ ID NO: 69809 - DNA, 25 bp, Homo sapien
gacatggacaaggtcgagacattcc

SEQ ID NO: 69810 - DNA, 25 bp, Homo sapien
acatggacaaggtcgagacattcct

SEQ ID NO: 69811 - DNA, 25 bp, Homo sapien
catggacaaggtcgagacattcctg

SEQ ID NO: 69812 - DNA, 25 bp, Homo sapien
atggacaaggtcgagacattcctgc

SEQ ID NO: 69813 - DNA, 25 bp, Homo sapien
tggacaaggtcgagacattcctgcg

SEQ ID NO: 69814 - DNA, 25 bp, Homo sapien
ggacaaggtcgagacattcctgcgc

SEQ ID NO: 69815 - DNA, 25 bp, Homo sapien
gacaaggtcgagacattcctgcgca

SEQ ID NO: 69816 - DNA, 25 bp, Homo sapien
acaaggtcgagacattcctgcgcat

SEQ ID NO: 69817 - DNA, 25 bp, Homo sapien
acaggcgcaaagtcatggaggaaaa

SEQ ID NO: 69818 - DNA, 25 bp, Homo sapien
ggaggaaaacaacatcgtacaccag

SEQ ID NO: 69819 - DNA, 25 bp, Homo sapien
acaacatcgtacaccaggctcgctt

SEQ ID NO: 69820 - DNA, 25 bp, Homo sapien
aggctcgcttcttcaggcggcagac

SEQ ID NO: 69821 - DNA, 25 bp, Homo sapien
ttcttcaggcggcagacggatagca

SEQ ID NO: 69822 - DNA, 25 bp, Homo sapien
tggtgggtgaccaacaatacctact

SEQ ID NO: 69823 - DNA, 25 bp, Homo sapien
acaatacctactggaggctgcgggc

SEQ ID NO: 69824 - DNA, 25 bp, Homo sapien
ccgagccaggctacgggaacatgga

SEQ ID NO: 69825 - DNA, 25 bp, Homo sapien
cccctaccatggacacatgggtgag

SEQ ID NO: 69826 - DNA, 25 bp, Homo sapien
tggacacatgggtgaggccgggctc

SEQ ID NO: 69827 - DNA, 25 bp, Homo sapien
gcctcactgcccttgagaccaaagg

SEQ ID NO: 69828 - DNA, 25 bp, Homo sapien
ctacttccttatacagcctttcctt

SEQ ID NO: 69829 - DNA, 25 bp, Homo sapien
tatacagcctttccttctgtgggct

SEQ ID NO: 69830 - DNA, 25 bp, Homo sapien
tctgtgggcttgtcacttttcagta

SEQ ID NO: 69831 - DNA, 25 bp, Homo sapien
tgtcacttttcagtacatttctagt

SEQ ID NO: 69832 - DNA, 25 bp, Homo sapien
ctctgctgggtttctccttaaatgt

SEQ ID NO: 69833 - DNA, 25 bp, Homo sapien
gggtttctccttaaatgtgaagcaa

SEQ ID NO: 69834 - DNA, 25 bp, Homo sapien
aatggaatttggtggcagtgactga

SEQ ID NO: 69835 - DNA, 25 bp, Homo sapien
tggcagtgactgatgtttgtctcta

SEQ ID NO: 69836 - DNA, 25 bp, Homo sapien
tgtctctagctaaaaccaactgttt

SEQ ID NO: 69837 - DNA, 25 bp, Homo sapien
gttggaagtccttgtttactggaat

SEQ ID NO: 69838 - DNA, 25 bp, Homo sapien
gaatatattatgcttttgttaacac

SEQ ID NO: 69839 - DNA, 25 bp, Homo sapien
gtgcaaggatcagtagccaggacca

SEQ ID NO: 69840 - DNA, 25 bp, Homo sapien
agagtggccgcctggaggtccccat

SEQ ID NO: 69841 - DNA, 25 bp, Homo sapien
ggaggtccccatctcacgtgtgatg

SEQ ID NO: 69842 - DNA, 25 bp, Homo sapien
ctcctgagcagggatccaagaatgt

SEQ ID NO: 69843 - DNA, 25 bp, Homo sapien
aagaatgtgccaagagtcccgccag

SEQ ID NO: 69844 - DNA, 25 bp, Homo sapien
caggtgggcctgtatatagggtcca

SEQ ID NO: 69845 - DNA, 25 bp, Homo sapien
ctgtatatagggtccatgtgcaata

SEQ ID NO: 69846 - DNA, 25 bp, Homo sapien
tgtgcaatagggagggacgtcttct

SEQ ID NO: 69847 - DNA, 25 bp, Homo sapien
ggagggacgtcttctattttttgct

SEQ ID NO: 69848 - DNA, 25 bp, Homo sapien
attttcgagataaagcacaggcacc

SEQ ID NO: 69849 - DNA, 25 bp, Homo sapien
gcacaggcaccacaaataaaagtcg

SEQ ID NO: 69850 - DNA, 25 bp, Homo sapien
aggagcaggggctggctaacagtct

SEQ ID NO: 69851 - DNA, 25 bp, Homo sapien
ggagcaggggctggctaacagtctc

SEQ ID NO: 69852 - DNA, 25 bp, Homo sapien
gagcaggggctggctaacagtctca

SEQ ID NO: 69853 - DNA, 25 bp, Homo sapien
agcaggggctggctaacagtctcat

SEQ ID NO: 69854 - DNA, 25 bp, Homo sapien
gcaggggctggctaacagtctcatg

SEQ ID NO: 69855 - DNA, 25 bp, Homo sapien
caggggctggctaacagtctcatgg

SEQ ID NO: 69856 - DNA, 25 bp, Homo sapien
aggggctggctaacagtctcatggg

SEQ ID NO: 69857 - DNA, 25 bp, Homo sapien
ggggctggctaacagtctcatgggt

SEQ ID NO: 69858 - DNA, 25 bp, Homo sapien
tgtcatttgggccccgagctctgac

SEQ ID NO: 69859 - DNA, 25 bp, Homo sapien
tctgacgcggccacctctttctgga

SEQ ID NO: 69860 - DNA, 25 bp, Homo sapien
gctgaggacagatgtgcctgcttgt

SEQ ID NO: 69861 - DNA, 25 bp, Homo sapien
cagatgtgcctgcttgtggagacca

SEQ ID NO: 69862 - DNA, 25 bp, Homo sapien
tgggcctaagcgaagggtcatcgca

SEQ ID NO: 69863 - DNA, 25 bp, Homo sapien
tggtcgggtgggatgtgcgttctcc

SEQ ID NO: 69864 - DNA, 25 bp, Homo sapien
gcgttctccgctcgtggtgatgtca

SEQ ID NO: 69865 - DNA, 25 bp, Homo sapien
ctcgtggtgatgtcaggagctcctc

SEQ ID NO: 69866 - DNA, 25 bp, Homo sapien
agagcggctgtgtatgcagcctgca

SEQ ID NO: 69867 - DNA, 25 bp, Homo sapien
agcctgcaggtttccatacactgaa

SEQ ID NO: 69868 - DNA, 25 bp, Homo sapien
tacactgaagcttttacctcaactt

SEQ ID NO: 69869 - DNA, 25 bp, Homo sapien
tcaggatttgaaaaccggaacggcg

SEQ ID NO: 69870 - DNA, 25 bp, Homo sapien
ccggaacggcgaaggtgatagtagt

SEQ ID NO: 69871 - DNA, 25 bp, Homo sapien
acggcgaaggtgatagtagtcggtt

SEQ ID NO: 69872 - DNA, 25 bp, Homo sapien
gagcttcccccaaagttctacaatg

SEQ ID NO: 69873 - DNA, 25 bp, Homo sapien
ccccaaagttctacaatgtggccaa

SEQ ID NO: 69874 - DNA, 25 bp, Homo sapien
caaagttctacaatgtggccaagga

SEQ ID NO: 69875 - DNA, 25 bp, Homo sapien
aaagttctacaatgtggccaaggac

SEQ ID NO: 69876 - DNA, 25 bp, Homo sapien
aagttctacaatgtggccaaggact

SEQ ID NO: 69877 - DNA, 25 bp, Homo sapien
agttctacaatgtggccaaggactt

SEQ ID NO: 69878 - DNA, 25 bp, Homo sapien
gttctacaatgtggccaaggacttt

SEQ ID NO: 69879 - DNA, 25 bp, Homo sapien
tctacaatgtggccaaggactttga

SEQ ID NO: 69880 - DNA, 25 bp, Homo sapien
cctaatttatggaatgggtgctatc

SEQ ID NO: 69881 - DNA, 25 bp, Homo sapien
gggtgctatcctgtttatgtgtgtc

SEQ ID NO: 69882 - DNA, 25 bp, Homo sapien
tatgtgtgtcttggtttttcttggc

SEQ ID NO: 69883 - DNA, 25 bp, Homo sapien
gtcttggtttttcttggctacagaa

SEQ ID NO: 69884 - DNA, 25 bp, Homo sapien
gttgcagggcaacactagtttgata

SEQ ID NO: 69885 - DNA, 25 bp, Homo sapien
gatatttgatttactctccaatgag

SEQ ID NO: 69886 - DNA, 25 bp, Homo sapien
aatggctgggccgtggtagactcat

SEQ ID NO: 69887 - DNA, 25 bp, Homo sapien
ggtagactcatagttcctcttgttc

SEQ ID NO: 69888 - DNA, 25 bp, Homo sapien
tagttcctcttgttctttattaaat

SEQ ID NO: 69889 - DNA, 25 bp, Homo sapien
ttcatcctgctaattagatttctag

SEQ ID NO: 69890 - DNA, 25 bp, Homo sapien
cagatgcatacaactactatactag

SEQ ID NO: 69891 - DNA, 25 bp, Homo sapien
agaagctgtcagctatcttccggga

SEQ ID NO: 69892 - DNA, 25 bp, Homo sapien
tgtcagctatcttccgggactttct

SEQ ID NO: 69893 - DNA, 25 bp, Homo sapien
ttccgggactttctgaaccgctgtc

SEQ ID NO: 69894 - DNA, 25 bp, Homo sapien
ggactttctgaaccgctgtctcgag

SEQ ID NO: 69895 - DNA, 25 bp, Homo sapien
ttctgaaccgctgtctcgagatgga

SEQ ID NO: 69896 - DNA, 25 bp, Homo sapien
tgaaccgctgtctcgagatggatgt

SEQ ID NO: 69897 - DNA, 25 bp, Homo sapien
gaggttcagctaaagagctgctaca

SEQ ID NO: 69898 - DNA, 25 bp, Homo sapien
tgaagattgccaagcccctctccag

SEQ ID NO: 69899 - DNA, 25 bp, Homo sapien
agcctcactccactgattgctgcag

SEQ ID NO: 69900 - DNA, 25 bp, Homo sapien
actccactgattgctgcagctaagg

SEQ ID NO: 69901 - DNA, 25 bp, Homo sapien
attgctgcagctaaggaggcaacaa

SEQ ID NO: 69902 - DNA, 25 bp, Homo sapien
aatatttctggtattttcttcatta

SEQ ID NO: 69903 - DNA, 25 bp, Homo sapien
gtattttcttcattataacacgtgg

SEQ ID NO: 69904 - DNA, 25 bp, Homo sapien
aacacgtggaatgggacagtggcta

SEQ ID NO: 69905 - DNA, 25 bp, Homo sapien
aggtatggatggagcaaggtcaaat

SEQ ID NO: 69906 - DNA, 25 bp, Homo sapien
aaggtcaaatatgagctgatggagc

SEQ ID NO: 69907 - DNA, 25 bp, Homo sapien
agctgatggagctgggcgctaaata

SEQ ID NO: 69908 - DNA, 25 bp, Homo sapien
gctgggcgctaaataagggtataat

SEQ ID NO: 69909 - DNA, 25 bp, Homo sapien
tgttgtgtatggtatagtatgctat

SEQ ID NO: 69910 - DNA, 25 bp, Homo sapien
tggtatagtatgctatttctgtgta

SEQ ID NO: 69911 - DNA, 25 bp, Homo sapien
ctgtgtatgttcaaattgtttatgt

SEQ ID NO: 69912 - DNA, 25 bp, Homo sapien
tatgtacttgacaattccttagaaa

SEQ ID NO: 69913 - DNA, 25 bp, Homo sapien
aagcaagatctgttgcgactcccaa

SEQ ID NO: 69914 - DNA, 25 bp, Homo sapien
gttgcgactcccaaatgcgttttaa

SEQ ID NO: 69915 - DNA, 25 bp, Homo sapien
aaatgcgttttaatgagctcatcct

SEQ ID NO: 69916 - DNA, 25 bp, Homo sapien
taatgagctcatccttatttgcctt

SEQ ID NO: 69917 - DNA, 25 bp, Homo sapien
ttgcctttcttcttacgtattttgt

SEQ ID NO: 69918 - DNA, 25 bp, Homo sapien
gcaggagatattctagaaggcatta

SEQ ID NO: 69919 - DNA, 25 bp, Homo sapien
gaaggcattaatggtttgcattcaa

SEQ ID NO: 69920 - DNA, 25 bp, Homo sapien
gtttgcattcaaaacgatgtggttt

SEQ ID NO: 69921 - DNA, 25 bp, Homo sapien
tttctgtctttattactgagacgga

SEQ ID NO: 69922 - DNA, 25 bp, Homo sapien
ctgagacggattaatctccttattt

SEQ ID NO: 69923 - DNA, 25 bp, Homo sapien
tgaagttgtaagagttgtccagcta

SEQ ID NO: 69924 - DNA, 25 bp, Homo sapien
gcttgtggaagaatcacgtggcctt

SEQ ID NO: 69925 - DNA, 25 bp, Homo sapien
ggaagaatcacgtggccttggcttg

SEQ ID NO: 69926 - DNA, 25 bp, Homo sapien
aatcacgtggccttggcttgtatga

SEQ ID NO: 69927 - DNA, 25 bp, Homo sapien
tggccttggcttgtatgattgttat

SEQ ID NO: 69928 - DNA, 25 bp, Homo sapien
tgttattttcctcacaattgcctac

SEQ ID NO: 69929 - DNA, 25 bp, Homo sapien
ttcctcacaattgcctacctgaaat

SEQ ID NO: 69930 - DNA, 25 bp, Homo sapien
gcctacctgaaattgttatttctta

SEQ ID NO: 69931 - DNA, 25 bp, Homo sapien
taaatttccccttaattcagtatga

SEQ ID NO: 69932 - DNA, 25 bp, Homo sapien
aattcagtatgatttatcctcacat

SEQ ID NO: 69933 - DNA, 25 bp, Homo sapien
tgttgttttctgttcccttgccatc

SEQ ID NO: 69934 - DNA, 25 bp, Homo sapien
ttgccatcacactgttgcacagcag

SEQ ID NO: 69935 - DNA, 25 bp, Homo sapien
atttatgtttctgaggtgtttcaac

SEQ ID NO: 69936 - DNA, 25 bp, Homo sapien
ggtgtttcaacacaattttggatca

SEQ ID NO: 69937 - DNA, 25 bp, Homo sapien
ttttggatcagctgcctgtttgcaa

SEQ ID NO: 69938 - DNA, 25 bp, Homo sapien
ttaaacagttcttcacctaacagca

SEQ ID NO: 69939 - DNA, 25 bp, Homo sapien
agcatattgctcttataactggtag

SEQ ID NO: 69940 - DNA, 25 bp, Homo sapien
aactggtagagctgtttcaaaggaa

SEQ ID NO: 69941 - DNA, 25 bp, Homo sapien
tggtttctggtccaagttttgacct

SEQ ID NO: 69942 - DNA, 25 bp, Homo sapien
gttttgacctaaaccatgtccatct

SEQ ID NO: 69943 - DNA, 25 bp, Homo sapien
atgtccatcttctattaccagcact

SEQ ID NO: 69944 - DNA, 25 bp, Homo sapien
ttaccagcacttacaagcactgtga

SEQ ID NO: 69945 - DNA, 25 bp, Homo sapien
agcactgtgaaaactgatcatgaca

SEQ ID NO: 69946 - DNA, 25 bp, Homo sapien
agaaagactgtactccataactgac

SEQ ID NO: 69947 - DNA, 25 bp, Homo sapien
tccataactgactattcacgtccca

SEQ ID NO: 69948 - DNA, 25 bp, Homo sapien
ataactgactattcacgtcccatct

SEQ ID NO: 69949 - DNA, 25 bp, Homo sapien
aactgactattcacgtcccatcttt

SEQ ID NO: 69950 - DNA, 25 bp, Homo sapien
gactattcacgtcccatctttttgg

SEQ ID NO: 69951 - DNA, 25 bp, Homo sapien
atctttttggctcttccccaaagca

SEQ ID NO: 69952 - DNA, 25 bp, Homo sapien
tagcaccagagcctttcggctccgg

SEQ ID NO: 69953 - DNA, 25 bp, Homo sapien
accagagcctttcggctccgggaga

SEQ ID NO: 69954 - DNA, 25 bp, Homo sapien
tcggctccgggagacgagagggtca

SEQ ID NO: 69955 - DNA, 25 bp, Homo sapien
ggcattgtgactttatagcctaaac

SEQ ID NO: 69956 - DNA, 25 bp, Homo sapien
tgactttatagcctaaactggagct

SEQ ID NO: 69957 - DNA, 25 bp, Homo sapien
caatcctcgggcaagatcctgctct

SEQ ID NO: 69958 - DNA, 25 bp, Homo sapien
tctgcccgctctgccaagaggagga

SEQ ID NO: 69959 - DNA, 25 bp, Homo sapien
gagcaggcagagactcccatggccc

SEQ ID NO: 69960 - DNA, 25 bp, Homo sapien
tgggcccgctgggagaaacttactg

SEQ ID NO: 69961 - DNA, 25 bp, Homo sapien
gaggagcacggcgagaagatctact

SEQ ID NO: 69962 - DNA, 25 bp, Homo sapien
gatctacttcttctgcgagaacgat

SEQ ID NO: 69963 - DNA, 25 bp, Homo sapien
tacttcttctgcgagaacgatgccg

SEQ ID NO: 69964 - DNA, 25 bp, Homo sapien
tcttctgcgagaacgatgccgagtt

SEQ ID NO: 69965 - DNA, 25 bp, Homo sapien
tgcgagaacgatgccgagttcctct

SEQ ID NO: 69966 - DNA, 25 bp, Homo sapien
gtgcagaaccacagacggcttcggc

SEQ ID NO: 69967 - DNA, 25 bp, Homo sapien
acggcttcggctgtgcctagggcaa

SEQ ID NO: 69968 - DNA, 25 bp, Homo sapien
gagatctcggagacgatatatggaa

SEQ ID NO: 69969 - DNA, 25 bp, Homo sapien
gatgccaatcaaagagaagcctggg

SEQ ID NO: 69970 - DNA, 25 bp, Homo sapien
gaagcctgggtttctaacgacacct

SEQ ID NO: 69971 - DNA, 25 bp, Homo sapien
aacgacacctactgggagcttcgaa

SEQ ID NO: 69972 - DNA, 25 bp, Homo sapien
ctactgggagcttcgaaaggaccct

SEQ ID NO: 69973 - DNA, 25 bp, Homo sapien
gaccctgggtttagcaaagtagaca

SEQ ID NO: 69974 - DNA, 25 bp, Homo sapien
agtagacagccctgttctttggtag

SEQ ID NO: 69975 - DNA, 25 bp, Homo sapien
gtagagctagccaacatatcacatt

SEQ ID NO: 69976 - DNA, 25 bp, Homo sapien
agctatgtgtggtttctgggtcaac

SEQ ID NO: 69977 - DNA, 25 bp, Homo sapien
gggtcaactgaaaacctaccatttg

SEQ ID NO: 69978 - DNA, 25 bp, Homo sapien
cctaccatttgcttttctattcatc

SEQ ID NO: 69979 - DNA, 25 bp, Homo sapien
tctgatgtgccattggctgaacctt

SEQ ID NO: 69980 - DNA, 25 bp, Homo sapien
tgatgtgccattggctgaaccttgg

SEQ ID NO: 69981 - DNA, 25 bp, Homo sapien
atgtgccattggctgaaccttgggt

SEQ ID NO: 69982 - DNA, 25 bp, Homo sapien
tgtgccattggctgaaccttgggtt

SEQ ID NO: 69983 - DNA, 25 bp, Homo sapien
gtgccattggctgaaccttgggtta

SEQ ID NO: 69984 - DNA, 25 bp, Homo sapien
tgccattggctgaaccttgggttaa

SEQ ID NO: 69985 - DNA, 25 bp, Homo sapien
gccattggctgaaccttgggttaat

SEQ ID NO: 69986 - DNA, 25 bp, Homo sapien
ccattggctgaaccttgggttaatt

SEQ ID NO: 69987 - DNA, 25 bp, Homo sapien
acttccaaaggtcaatatgtcgtcc

SEQ ID NO: 69988 - DNA, 25 bp, Homo sapien
ttccaaaggtcaatatgtcgtcctt

SEQ ID NO: 69989 - DNA, 25 bp, Homo sapien
ccaaaggtcaatatgtcgtcctttg

SEQ ID NO: 69990 - DNA, 25 bp, Homo sapien
aaaaattctcaactggtagcttgct

SEQ ID NO: 69991 - DNA, 25 bp, Homo sapien
aattctcaactggtagcttgcttgc

SEQ ID NO: 69992 - DNA, 25 bp, Homo sapien
gtcttccaaactaaagcctgcaagc

SEQ ID NO: 69993 - DNA, 25 bp, Homo sapien
aactaaagcctgcaagcgccacaat

SEQ ID NO: 69994 - DNA, 25 bp, Homo sapien
gcctgcaagcgccacaattctaagt

SEQ ID NO: 69995 - DNA, 25 bp, Homo sapien
aagcgccacaattctaagtgccgcc

SEQ ID NO: 69996 - DNA, 25 bp, Homo sapien
acaattctaagtgccgccttccatt

SEQ ID NO: 69997 - DNA, 25 bp, Homo sapien
tttcagtatgttttcactggcttat

SEQ ID NO: 69998 - DNA, 25 bp, Homo sapien
gtatgttttcactggcttatgtttt

SEQ ID NO: 69999 - DNA, 25 bp, Homo sapien
gttttcactggcttatgttttcaga

SEQ ID NO: 70000 - DNA, 25 bp, Homo sapien
ttcactggcttatgttttcagatat

SEQ ID NO: 70001 - DNA, 25 bp, Homo sapien
ccaggggagctacaccgtggtgcag

SEQ ID NO: 70002 - DNA, 25 bp, Homo sapien
caggggagctacaccgtggtgcagc

SEQ ID NO: 70003 - DNA, 25 bp, Homo sapien
aggggagctacaccgtggtgcagcc

SEQ ID NO: 70004 - DNA, 25 bp, Homo sapien
tttctcagaccacggagaagtgact

SEQ ID NO: 70005 - DNA, 25 bp, Homo sapien
ttctcagaccacggagaagtgactt

SEQ ID NO: 70006 - DNA, 25 bp, Homo sapien
tctcagaccacggagaagtgacttt

SEQ ID NO: 70007 - DNA, 25 bp, Homo sapien
ctcagaccacggagaagtgactttt

SEQ ID NO: 70008 - DNA, 25 bp, Homo sapien
tcagaccacggagaagtgacttttg

SEQ ID NO: 70009 - DNA, 25 bp, Homo sapien
ggggccatgcccgggctgtgcaaag

SEQ ID NO: 70010 - DNA, 25 bp, Homo sapien
gctgtgcaaagctggccagggcctc

SEQ ID NO: 70011 - DNA, 25 bp, Homo sapien
ctgtgcaaagctggccagggcctcc

SEQ ID NO: 70012 - DNA, 25 bp, Homo sapien
tagatacttcgagagtagccctgtc

SEQ ID NO: 70013 - DNA, 25 bp, Homo sapien
acttcgagagtagccctgtcttgtc

SEQ ID NO: 70014 - DNA, 25 bp, Homo sapien
cctctcactcttgggttggatgcta

SEQ ID NO: 70015 - DNA, 25 bp, Homo sapien
ctcttgggttggatgctatgggaat

SEQ ID NO: 70016 - DNA, 25 bp, Homo sapien
atgggaattacaacccatcactccc

SEQ ID NO: 70017 - DNA, 25 bp, Homo sapien
tggaggagcctgctgcattctcctg

SEQ ID NO: 70018 - DNA, 25 bp, Homo sapien
attctcctgctgagggatcccagag

SEQ ID NO: 70019 - DNA, 25 bp, Homo sapien
tctggccccttacccattgggttct

SEQ ID NO: 70020 - DNA, 25 bp, Homo sapien
tacccattgggttcttactccttca

SEQ ID NO: 70021 - DNA, 25 bp, Homo sapien
attgggttcttactccttcacaacg

SEQ ID NO: 70022 - DNA, 25 bp, Homo sapien
ttactccttcacaacggtcagcact

SEQ ID NO: 70023 - DNA, 25 bp, Homo sapien
ggactaggtttcatgggacaaaggc

SEQ ID NO: 70024 - DNA, 25 bp, Homo sapien
gactaggtttcatgggacaaaggca

SEQ ID NO: 70025 - DNA, 25 bp, Homo sapien
taggtttcatgggacaaaggcattc

SEQ ID NO: 70026 - DNA, 25 bp, Homo sapien
aggtttcatgggacaaaggcattct

SEQ ID NO: 70027 - DNA, 25 bp, Homo sapien
gtttcatgggacaaaggcattctgc

SEQ ID NO: 70028 - DNA, 25 bp, Homo sapien
tcatgggacaaaggcattctgcaag

SEQ ID NO: 70029 - DNA, 25 bp, Homo sapien
ggcattctgcaagaagtagaagctt

SEQ ID NO: 70030 - DNA, 25 bp, Homo sapien
tgcaagaagtagaagcttgtggccg

SEQ ID NO: 70031 - DNA, 25 bp, Homo sapien
aagaagtagaagcttgtggccgggt

SEQ ID NO: 70032 - DNA, 25 bp, Homo sapien
ttagctgagcatgttgacacacgcc

SEQ ID NO: 70033 - DNA, 25 bp, Homo sapien
gagcatgttgacacacgcccgtaat

SEQ ID NO: 70034 - DNA, 25 bp, Homo sapien
gtgcccgagtagcatcctgtgaccc

SEQ ID NO: 70035 - DNA, 25 bp, Homo sapien
tgcccgagtagcatcctgtgacccc

SEQ ID NO: 70036 - DNA, 25 bp, Homo sapien
cttctcttccttcactttgcagagg

SEQ ID NO: 70037 - DNA, 25 bp, Homo sapien
ttctcttccttcactttgcagaggc

SEQ ID NO: 70038 - DNA, 25 bp, Homo sapien
tctcttccttcactttgcagaggct

SEQ ID NO: 70039 - DNA, 25 bp, Homo sapien
ctcttccttcactttgcagaggctg

SEQ ID NO: 70040 - DNA, 25 bp, Homo sapien
tcttccttcactttgcagaggctgg

SEQ ID NO: 70041 - DNA, 25 bp, Homo sapien
ttccttcactttgcagaggctggaa

SEQ ID NO: 70042 - DNA, 25 bp, Homo sapien
tccttcactttgcagaggctggaag

SEQ ID NO: 70043 - DNA, 25 bp, Homo sapien
cttcactttgcagaggctggaagac

SEQ ID NO: 70044 - DNA, 25 bp, Homo sapien
tcactttgcagaggctggaagacgg

SEQ ID NO: 70045 - DNA, 25 bp, Homo sapien
ggttcttgaaccagcctgtcaacca

SEQ ID NO: 70046 - DNA, 25 bp, Homo sapien
ttgaaccagcctgtcaaccagttgt

SEQ ID NO: 70047 - DNA, 25 bp, Homo sapien
gaaccagcctgtcaaccagttgtat

SEQ ID NO: 70048 - DNA, 25 bp, Homo sapien
catcttgttttcttccaataatgtt

SEQ ID NO: 70049 - DNA, 25 bp, Homo sapien
gttttcttccaataatgttagagtt

SEQ ID NO: 70050 - DNA, 25 bp, Homo sapien
taatgttagagttcatgtaatcaca

SEQ ID NO: 70051 - DNA, 25 bp, Homo sapien
gagttcatgtaatcacattctctag

SEQ ID NO: 70052 - DNA, 25 bp, Homo sapien
gtaatcacattctctagaaccattt

SEQ ID NO: 70053 - DNA, 25 bp, Homo sapien
acattctctagaaccatttagtttg

SEQ ID NO: 70054 - DNA, 25 bp, Homo sapien
ctctagaaccatttagtttgtgtta

SEQ ID NO: 70055 - DNA, 25 bp, Homo sapien
ttagtttgtgttaactatgaaccaa

SEQ ID NO: 70056 - DNA, 25 bp, Homo sapien
gccggcagggtcaaactgagaaatt

SEQ ID NO: 70057 - DNA, 25 bp, Homo sapien
attccagtttgaactaactttagag

SEQ ID NO: 70058 - DNA, 25 bp, Homo sapien
gaagatggtgagtcagacacggaaa

SEQ ID NO: 70059 - DNA, 25 bp, Homo sapien
acacggaaaaggacagtggcagtca

SEQ ID NO: 70060 - DNA, 25 bp, Homo sapien
gaagacactagctgcagtgactcca

SEQ ID NO: 70061 - DNA, 25 bp, Homo sapien
tagctgcagtgactccaagactctt

SEQ ID NO: 70062 - DNA, 25 bp, Homo sapien
gagtctactgaaattccccttgatg

SEQ ID NO: 70063 - DNA, 25 bp, Homo sapien
attccccttgatgaacaggttgaag

SEQ ID NO: 70064 - DNA, 25 bp, Homo sapien
cctgaagcctgtgtcatagatgatc

SEQ ID NO: 70065 - DNA, 25 bp, Homo sapien
atagatgatcgttctcctgacacgt

SEQ ID NO: 70066 - DNA, 25 bp, Homo sapien
gttctcctgacacgtaacagtgcaa

SEQ ID NO: 70067 - DNA, 25 bp, Homo sapien
aaggacatggacaaggtcgagacat

SEQ ID NO: 70068 - DNA, 25 bp, Homo sapien
aggacatggacaaggtcgagacatt

SEQ ID NO: 70069 - DNA, 25 bp, Homo sapien
ggacatggacaaggtcgagacattc

SEQ ID NO: 70070 - DNA, 25 bp, Homo sapien
gacatggacaaggtcgagacattcc

SEQ ID NO: 70071 - DNA, 25 bp, Homo sapien
acatggacaaggtcgagacattcct

SEQ ID NO: 70072 - DNA, 25 bp, Homo sapien
catggacaaggtcgagacattcctg

SEQ ID NO: 70073 - DNA, 25 bp, Homo sapien
atggacaaggtcgagacattcctgc

SEQ ID NO: 70074 - DNA, 25 bp, Homo sapien
tggacaaggtcgagacattcctgcg

SEQ ID NO: 70075 - DNA, 25 bp, Homo sapien
ggacaaggtcgagacattcctgcgc

SEQ ID NO: 70076 - DNA, 25 bp, Homo sapien
gacaaggtcgagacattcctgcgca

SEQ ID NO: 70077 - DNA, 25 bp, Homo sapien
acaaggtcgagacattcctgcgcat

SEQ ID NO: 70078 - DNA, 25 bp, Homo sapien
acactgcagcagatcagccacatcg

SEQ ID NO: 70079 - DNA, 25 bp, Homo sapien
atgtggtccgagtgtggttctgtaa

SEQ ID NO: 70080 - DNA, 25 bp, Homo sapien
tggtccgagtgtggttctgtaaccg

SEQ ID NO: 70081 - DNA, 25 bp, Homo sapien
accggcgccagaagggcaagcgatc

SEQ ID NO: 70082 - DNA, 25 bp, Homo sapien
gggcaagcgatcaagcagtggctat

SEQ ID NO: 70083 - DNA, 25 bp, Homo sapien
gtggctatgcacaacgagaggattt

SEQ ID NO: 70084 - DNA, 25 bp, Homo sapien
gcacaacgagaggattttgaggctg

SEQ ID NO: 70085 - DNA, 25 bp, Homo sapien
gaggctgttgggtctcctttctcag

SEQ ID NO: 70086 - DNA, 25 bp, Homo sapien
attttggtaccccaggctatgggag

SEQ ID NO: 70087 - DNA, 25 bp, Homo sapien
gctatgggagccctcacttcactgc

SEQ ID NO: 70088 - DNA, 25 bp, Homo sapien
acttcactgcactgtactcctcggt

SEQ ID NO: 70089 - DNA, 25 bp, Homo sapien
acttgggagccggtggtctcaaaca

SEQ ID NO: 70090 - DNA, 25 bp, Homo sapien
ggtcctagtccccttctgaaatcta

SEQ ID NO: 70091 - DNA, 25 bp, Homo sapien
tccccttctgaaatctacatgcttg

SEQ ID NO: 70092 - DNA, 25 bp, Homo sapien
atctacatgcttgggttggagcgca

SEQ ID NO: 70093 - DNA, 25 bp, Homo sapien
gttggagcgcagcagtaaacaccct

SEQ ID NO: 70094 - DNA, 25 bp, Homo sapien
ccagtgacctggactgaggcgcgct

SEQ ID NO: 70095 - DNA, 25 bp, Homo sapien
gtgggtgcgccgtgtggcctgagca

SEQ ID NO: 70096 - DNA, 25 bp, Homo sapien
gggtgagagacacattcccctcgct

SEQ ID NO: 70097 - DNA, 25 bp, Homo sapien
gcccatgcccagaaccatcaaggga

SEQ ID NO: 70098 - DNA, 25 bp, Homo sapien
cccagaaccatcaagggatcccttg

SEQ ID NO: 70099 - DNA, 25 bp, Homo sapien
atcccttgcggcttgtcagcacttt

SEQ ID NO: 70100 - DNA, 25 bp, Homo sapien
ttagtgctttataaggagagacacc

SEQ ID NO: 70101 - DNA, 25 bp, Homo sapien
aggagagacaccagagagatgatct

SEQ ID NO: 70102 - DNA, 25 bp, Homo sapien
agatgatctctctctccaccatgtg

SEQ ID NO: 70103 - DNA, 25 bp, Homo sapien
acagtgagaagacagccgtctgcag

SEQ ID NO: 70104 - DNA, 25 bp, Homo sapien
agccctcaccaggaaatgaaactgt

SEQ ID NO: 70105 - DNA, 25 bp, Homo sapien
actgttggcaccttgagacttccca

SEQ ID NO: 70106 - DNA, 25 bp, Homo sapien
gtttaagcctttcaggctacggctt

SEQ ID NO: 70107 - DNA, 25 bp, Homo sapien
ttcaggctacggctttctgttacag

SEQ ID NO: 70108 - DNA, 25 bp, Homo sapien
ggctacggctttctgttacagcagc

SEQ ID NO: 70109 - DNA, 25 bp, Homo sapien
tacagcagcctgaactgagagtcca

SEQ ID NO: 70110 - DNA, 25 bp, Homo sapien
agcctgaactgagagtccatgccga

SEQ ID NO: 70111 - DNA, 25 bp, Homo sapien
gcagatcagccacatcgcccagcag

SEQ ID NO: 70112 - DNA, 25 bp, Homo sapien
tcagccacatcgcccagcagcttgg

SEQ ID NO: 70113 - DNA, 25 bp, Homo sapien
cagccacatcgcccagcagcttggg

SEQ ID NO: 70114 - DNA, 25 bp, Homo sapien
agccacatcgcccagcagcttgggc

SEQ ID NO: 70115 - DNA, 25 bp, Homo sapien
atgtggtccgagtgtggttctgtaa

SEQ ID NO: 70116 - DNA, 25 bp, Homo sapien
ccaggctatgggagccctcacttca

SEQ ID NO: 70117 - DNA, 25 bp, Homo sapien
caggctatgggagccctcacttcac

SEQ ID NO: 70118 - DNA, 25 bp, Homo sapien
aggctatgggagccctcacttcact

SEQ ID NO: 70119 - DNA, 25 bp, Homo sapien
ggctatgggagccctcacttcactg

SEQ ID NO: 70120 - DNA, 25 bp, Homo sapien
gctatgggagccctcacttcactgc

SEQ ID NO: 70121 - DNA, 25 bp, Homo sapien
gtgtcaaaagccaaggcagaccgtc

SEQ ID NO: 70122 - DNA, 25 bp, Homo sapien
gtcaaaagccaaggcagaccgtcct

SEQ ID NO: 70123 - DNA, 25 bp, Homo sapien
aaaagccaaggcagaccgtcctcct

SEQ ID NO: 70124 - DNA, 25 bp, Homo sapien
cactgccagtgcagtgtggtggact

SEQ ID NO: 70125 - DNA, 25 bp, Homo sapien
tgccacctgacctgacagggaggag

SEQ ID NO: 70126 - DNA, 25 bp, Homo sapien
aacgtcccacttcatttgttccatt

SEQ ID NO: 70127 - DNA, 25 bp, Homo sapien
tcatttgttccattcctgattcttg

SEQ ID NO: 70128 - DNA, 25 bp, Homo sapien
tttgttccattcctgattcttgggt

SEQ ID NO: 70129 - DNA, 25 bp, Homo sapien
gttccattcctgattcttgggtaat

SEQ ID NO: 70130 - DNA, 25 bp, Homo sapien
ttccattcctgattcttgggtaata

SEQ ID NO: 70131 - DNA, 25 bp, Homo sapien
ccattcctgattcttgggtaataaa

SEQ ID NO: 70132 - DNA, 25 bp, Homo sapien
ggattcccctgggtagatggaaact

SEQ ID NO: 70133 - DNA, 25 bp, Homo sapien
tggaaactgcaaaaacccaaagcct

SEQ ID NO: 70134 - DNA, 25 bp, Homo sapien
ctccctcccctaagaagatggatgt

SEQ ID NO: 70135 - DNA, 25 bp, Homo sapien
agaagatggatgtcctcaaaagaga

SEQ ID NO: 70136 - DNA, 25 bp, Homo sapien
aatggaaaagctctgtctccctaac

SEQ ID NO: 70137 - DNA, 25 bp, Homo sapien
tccctaactcaactgctttgcaagg

SEQ ID NO: 70138 - DNA, 25 bp, Homo sapien
aatcaagctgggagaatctttttct

SEQ ID NO: 70139 - DNA, 25 bp, Homo sapien
agaatctttttctggccacctgtag

SEQ ID NO: 70140 - DNA, 25 bp, Homo sapien
gccacctgtagggtaggttgtcaaa

SEQ ID NO: 70141 - DNA, 25 bp, Homo sapien
caaaccaaacagagccaccgtggga

SEQ ID NO: 70142 - DNA, 25 bp, Homo sapien
accgtgggacatcaagtggaagaac

SEQ ID NO: 70143 - DNA, 25 bp, Homo sapien
ggagctacaccgtggtgcagcccag

SEQ ID NO: 70144 - DNA, 25 bp, Homo sapien
tgcaccccgcaggaggagggcaact

SEQ ID NO: 70145 - DNA, 25 bp, Homo sapien
ggcccggcattgtcctcctgaggag

SEQ ID NO: 70146 - DNA, 25 bp, Homo sapien
agcaggggctggctaacagtctcat

SEQ ID NO: 70147 - DNA, 25 bp, Homo sapien
gctggctaacagtctcatgggtcac

SEQ ID NO: 70148 - DNA, 25 bp, Homo sapien
acagtctcatgggtcaccacatggg

SEQ ID NO: 70149 - DNA, 25 bp, Homo sapien
gggagggctgcctcagcagatttct

SEQ ID NO: 70150 - DNA, 25 bp, Homo sapien
agcagatttctcagaccacggagaa

SEQ ID NO: 70151 - DNA, 25 bp, Homo sapien
cacggagaagtgacttttgcgcccg

SEQ ID NO: 70152 - DNA, 25 bp, Homo sapien
ccatgcccgggctgtgcaaagctgg

SEQ ID NO: 70153 - DNA, 25 bp, Homo sapien
gctgtgcaaagctggccagggcctc

SEQ ID NO: 70154 - DNA, 25 bp, Homo sapien
aagtgctacgcctcggaccaggagg

SEQ ID NO: 70155 - DNA, 25 bp, Homo sapien
gctacgcctcggaccaggaggtgct

SEQ ID NO: 70156 - DNA, 25 bp, Homo sapien
aggtgctggacatgcacggtttcct

SEQ ID NO: 70157 - DNA, 25 bp, Homo sapien
tggacatgcacggtttcctgcgcca

SEQ ID NO: 70158 - DNA, 25 bp, Homo sapien
atgcacggtttcctgcgccaggcgc

SEQ ID NO: 70159 - DNA, 25 bp, Homo sapien
agagcctgcaagctgccgtgcgcac

SEQ ID NO: 70160 - DNA, 25 bp, Homo sapien
tgcaagctgccgtgcgcaccgatgg

SEQ ID NO: 70161 - DNA, 25 bp, Homo sapien
gcaccgatggcttcgacgagttcaa

SEQ ID NO: 70162 - DNA, 25 bp, Homo sapien
ttcgacgagttcaaggtgcgcctgc

SEQ ID NO: 70163 - DNA, 25 bp, Homo sapien
cgagttcaaggtgcgcctgcaggac

SEQ ID NO: 70164 - DNA, 25 bp, Homo sapien
agctcttgcatcacccaggggaaag

SEQ ID NO: 70165 - DNA, 25 bp, Homo sapien
aaggacatggacaaggtcgagacat

SEQ ID NO: 70166 - DNA, 25 bp, Homo sapien
aggacatggacaaggtcgagacatt

SEQ ID NO: 70167 - DNA, 25 bp, Homo sapien
ggacatggacaaggtcgagacattc

SEQ ID NO: 70168 - DNA, 25 bp, Homo sapien
gacatggacaaggtcgagacattcc

SEQ ID NO: 70169 - DNA, 25 bp, Homo sapien
acatggacaaggtcgagacattcct

SEQ ID NO: 70170 - DNA, 25 bp, Homo sapien
catggacaaggtcgagacattcctg

SEQ ID NO: 70171 - DNA, 25 bp, Homo sapien
atggacaaggtcgagacattcctgc

SEQ ID NO: 70172 - DNA, 25 bp, Homo sapien
tggacaaggtcgagacattcctgcg

SEQ ID NO: 70173 - DNA, 25 bp, Homo sapien
ggacaaggtcgagacattcctgcgc

SEQ ID NO: 70174 - DNA, 25 bp, Homo sapien
gacaaggtcgagacattcctgcgca

SEQ ID NO: 70175 - DNA, 25 bp, Homo sapien
acaaggtcgagacattcctgcgcat

SEQ ID NO: 70176 - DNA, 25 bp, Homo sapien
gacaaaagtgattttcgttcattat

SEQ ID NO: 70177 - DNA, 25 bp, Homo sapien
taataatagtatcagtcggtgcaac

SEQ ID NO: 70178 - DNA, 25 bp, Homo sapien
gtatcagtcggtgcaacagttggca

SEQ ID NO: 70179 - DNA, 25 bp, Homo sapien
acagttggcaacatgtgccttcaca

SEQ ID NO: 70180 - DNA, 25 bp, Homo sapien
tgtgccttcacactttaccataaag

SEQ ID NO: 70181 - DNA, 25 bp, Homo sapien
taccataaagagacgggtttgaggg

SEQ ID NO: 70182 - DNA, 25 bp, Homo sapien
tgccttctaaagtctgcaacttcaa

SEQ ID NO: 70183 - DNA, 25 bp, Homo sapien
atcgacactgtggattgactttccc

SEQ ID NO: 70184 - DNA, 25 bp, Homo sapien
actgtggattgactttcccggtcac

SEQ ID NO: 70185 - DNA, 25 bp, Homo sapien
tttcccggtcactatataaagcaaa

SEQ ID NO: 70186 - DNA, 25 bp, Homo sapien
aacactttgtaaccatgtatttact

SEQ ID NO: 70187 - DNA, 25 bp, Homo sapien
aaggacatggacaaggtcgagacat

SEQ ID NO: 70188 - DNA, 25 bp, Homo sapien
aggacatggacaaggtcgagacatt

SEQ ID NO: 70189 - DNA, 25 bp, Homo sapien
ggacatggacaaggtcgagacattc

SEQ ID NO: 70190 - DNA, 25 bp, Homo sapien
gacatggacaaggtcgagacattcc

SEQ ID NO: 70191 - DNA, 25 bp, Homo sapien
acatggacaaggtcgagacattcct

SEQ ID NO: 70192 - DNA, 25 bp, Homo sapien
catggacaaggtcgagacattcctg

SEQ ID NO: 70193 - DNA, 25 bp, Homo sapien
atggacaaggtcgagacattcctgc

SEQ ID NO: 70194 - DNA, 25 bp, Homo sapien
tggacaaggtcgagacattcctgcg

SEQ ID NO: 70195 - DNA, 25 bp, Homo sapien
ggacaaggtcgagacattcctgcgc

SEQ ID NO: 70196 - DNA, 25 bp, Homo sapien
gacaaggtcgagacattcctgcgca

SEQ ID NO: 70197 - DNA, 25 bp, Homo sapien
acaaggtcgagacattcctgcgcat

SEQ ID NO: 70198 - DNA, 25 bp, Homo sapien
actagctcgacacagtctgcagtcc

SEQ ID NO: 70199 - DNA, 25 bp, Homo sapien
agctcgacacagtctgcagtccagg

SEQ ID NO: 70200 - DNA, 25 bp, Homo sapien
tcgacacagtctgcagtccaggcgt

SEQ ID NO: 70201 - DNA, 25 bp, Homo sapien
gacacagtctgcagtccaggcgtgt

SEQ ID NO: 70202 - DNA, 25 bp, Homo sapien
cacagtctgcagtccaggcgtgtgg

SEQ ID NO: 70203 - DNA, 25 bp, Homo sapien
agtccaggcgtgtggagccgcctcc

SEQ ID NO: 70204 - DNA, 25 bp, Homo sapien
ggccctgctgccgaccaggagctgc

SEQ ID NO: 70205 - DNA, 25 bp, Homo sapien
gggaggtcccgtgttccatatagag

SEQ ID NO: 70206 - DNA, 25 bp, Homo sapien
gaggtcccgtgttccatatagagga

SEQ ID NO: 70207 - DNA, 25 bp, Homo sapien
aggtcccgtgttccatatagaggaa

SEQ ID NO: 70208 - DNA, 25 bp, Homo sapien
tcccgtgttccatatagaggaaccc

SEQ ID NO: 70209 - DNA, 25 bp, Homo sapien
atccctgggacgtgagacttagctt

SEQ ID NO: 70210 - DNA, 25 bp, Homo sapien
gacttagcttccagccagtgtgaat

SEQ ID NO: 70211 - DNA, 25 bp, Homo sapien
agtgtgaatcattgtatctgtctca

SEQ ID NO: 70212 - DNA, 25 bp, Homo sapien
gtatctgtctcataatcacagcaca

SEQ ID NO: 70213 - DNA, 25 bp, Homo sapien
ataatcacagcacagctgcagacac

SEQ ID NO: 70214 - DNA, 25 bp, Homo sapien
gcagacacaacaacgtgcagcattt

SEQ ID NO: 70215 - DNA, 25 bp, Homo sapien
ggaaatgccttacgtggtatcacac

SEQ ID NO: 70216 - DNA, 25 bp, Homo sapien
gtggtatcacacttagtcttgaaaa

SEQ ID NO: 70217 - DNA, 25 bp, Homo sapien
gtacatatcctcaaattggagctaa

SEQ ID NO: 70218 - DNA, 25 bp, Homo sapien
ttggagctaagttatacttctttta

SEQ ID NO: 70219 - DNA, 25 bp, Homo sapien
cttttgggcatctggtcgagagaag

SEQ ID NO: 70220 - DNA, 25 bp, Homo sapien
cctgagaaagttccggtcctataag

SEQ ID NO: 70221 - DNA, 25 bp, Homo sapien
ggacatcagtgcgagacctgctccg

SEQ ID NO: 70222 - DNA, 25 bp, Homo sapien
acctgctccgtgctgtgaggaacaa

SEQ ID NO: 70223 - DNA, 25 bp, Homo sapien
gaagcaccactacagggagctccca

SEQ ID NO: 70224 - DNA, 25 bp, Homo sapien
agctcccagttgaggtgcgacaggc

SEQ ID NO: 70225 - DNA, 25 bp, Homo sapien
ggtgcgacaggcacttggccaagtc

SEQ ID NO: 70226 - DNA, 25 bp, Homo sapien
tggccaagtccctgacggcttcgtc

SEQ ID NO: 70227 - DNA, 25 bp, Homo sapien
acggcttcgtccagtacttcacaaa

SEQ ID NO: 70228 - DNA, 25 bp, Homo sapien
ccacacgcaccgagtcatgaggagt

SEQ ID NO: 70229 - DNA, 25 bp, Homo sapien
gtcatgaggagttgcgcctctgaga

SEQ ID NO: 70230 - DNA, 25 bp, Homo sapien
tacccaccagactcagaggccaggg

SEQ ID NO: 70231 - DNA, 25 bp, Homo sapien
taactaaatttaccaccagatacaa

SEQ ID NO: 70232 - DNA, 25 bp, Homo sapien
acttcttacacagagttatccttta

SEQ ID NO: 70233 - DNA, 25 bp, Homo sapien
aagacgtgaatgaaacatcatccta

SEQ ID NO: 70234 - DNA, 25 bp, Homo sapien
gaaacatcatcctaacttacttccc

SEQ ID NO: 70235 - DNA, 25 bp, Homo sapien
atcctaacttacttccccaagatat

SEQ ID NO: 70236 - DNA, 25 bp, Homo sapien
aacttacttccccaagatattgaga

SEQ ID NO: 70237 - DNA, 25 bp, Homo sapien
gaggtcatatctgtttttctttatc

SEQ ID NO: 70238 - DNA, 25 bp, Homo sapien
gttgttactgatatgcttttgattt

SEQ ID NO: 70239 - DNA, 25 bp, Homo sapien
gcttttgatttcctatgactctatt

SEQ ID NO: 70240 - DNA, 25 bp, Homo sapien
tttcctatgactctattatgttgta

SEQ ID NO: 70241 - DNA, 25 bp, Homo sapien
gttgtacagaacatcttttcaattt

SEQ ID NO: 70242 - DNA, 25 bp, Homo sapien
ggaagcgcagcgagcaggacgcaga

SEQ ID NO: 70243 - DNA, 25 bp, Homo sapien
gcaggacgcagagaacagcatggcc

SEQ ID NO: 70244 - DNA, 25 bp, Homo sapien
gacgcagagaacagcatggcctgga

SEQ ID NO: 70245 - DNA, 25 bp, Homo sapien
cagagaacagcatggcctggaccag

SEQ ID NO: 70246 - DNA, 25 bp, Homo sapien
tgctctgcccgtcagggtccaacat

SEQ ID NO: 70247 - DNA, 25 bp, Homo sapien
gtcagggtccaacatgcccatcctg

SEQ ID NO: 70248 - DNA, 25 bp, Homo sapien
tggacgggacctggtctccctggct

SEQ ID NO: 70249 - DNA, 25 bp, Homo sapien
tgccccctgggcctatggtttcaga

SEQ ID NO: 70250 - DNA, 25 bp, Homo sapien
atggtttcagaaccagctggcgctg

SEQ ID NO: 70251 - DNA, 25 bp, Homo sapien
gctgcagaaggaaccttgcggccca

SEQ ID NO: 70252 - DNA, 25 bp, Homo sapien
agatgaggaaggaaccccctcacca

SEQ ID NO: 70253 - DNA, 25 bp, Homo sapien
acaagaagacccatctacggaggag

SEQ ID NO: 70254 - DNA, 25 bp, Homo sapien
atctacggaggaggtcttcacagct

SEQ ID NO: 70255 - DNA, 25 bp, Homo sapien
ggaggtcttcacagctcaaaattaa

SEQ ID NO: 70256 - DNA, 25 bp, Homo sapien
taaaatacctgatctaaccgatgtg

SEQ ID NO: 70257 - DNA, 25 bp, Homo sapien
tgatctaaccgatgtgaatgccata

SEQ ID NO: 70258 - DNA, 25 bp, Homo sapien
agacagatggtccaggatcgtgttt

SEQ ID NO: 70259 - DNA, 25 bp, Homo sapien
tactggctgtactatgttaactgag

SEQ ID NO: 70260 - DNA, 25 bp, Homo sapien
actgagtgactgtacttgatttttc

SEQ ID NO: 70261 - DNA, 25 bp, Homo sapien
aaagacttcatttaacactgagtga

SEQ ID NO: 70262 - DNA, 25 bp, Homo sapien
gtgaaatattactctgcctgtcaag

SEQ ID NO: 70263 - DNA, 25 bp, Homo sapien
gcctgtcaagtttttatacctgtac

SEQ ID NO: 70264 - DNA, 25 bp, Homo sapien
tcctttgctggctgcatgacataga

SEQ ID NO: 70265 - DNA, 25 bp, Homo sapien
ttgctggctgcatgacatagacctt

SEQ ID NO: 70266 - DNA, 25 bp, Homo sapien
gcatgacatagacctttctcttttt

SEQ ID NO: 70267 - DNA, 25 bp, Homo sapien
tctctttttgagttttgcacatact

SEQ ID NO: 70268 - DNA, 25 bp, Homo sapien
gcacatactgaatgcctcctgttgg

SEQ ID NO: 70269 - DNA, 25 bp, Homo sapien
ctgaatgcctcctgttggtgctgat

SEQ ID NO: 70270 - DNA, 25 bp, Homo sapien
tcatcatcatgacctggaaagtctg

SEQ ID NO: 70271 - DNA, 25 bp, Homo sapien
ggaaagtctgcatcactcttgccat

SEQ ID NO: 70272 - DNA, 25 bp, Homo sapien
tccctcctggctatggtccatgtga

SEQ ID NO: 70273 - DNA, 25 bp, Homo sapien
atggtccatgtgagcctcatcctaa

SEQ ID NO: 70274 - DNA, 25 bp, Homo sapien
ctcatcctaagactgcccttttgtg

SEQ ID NO: 70275 - DNA, 25 bp, Homo sapien
ttattgagctaatgaatggcagaat

SEQ ID NO: 70276 - DNA, 25 bp, Homo sapien
caaacattttatgtatcggaagcat

SEQ ID NO: 70277 - DNA, 25 bp, Homo sapien
atgtatcggaagcatataccttgga

SEQ ID NO: 70278 - DNA, 25 bp, Homo sapien
gaagcatataccttggagggaccat

SEQ ID NO: 70279 - DNA, 25 bp, Homo sapien
taccttggagggaccatgctatgag

SEQ ID NO: 70280 - DNA, 25 bp, Homo sapien
gtaaatctagaaatgagaaacccct

SEQ ID NO: 70281 - DNA, 25 bp, Homo sapien
atataggagtgaacatcttatgaat

SEQ ID NO: 70282 - DNA, 25 bp, Homo sapien
taaaccacagctggactgttaacct

SEQ ID NO: 70283 - DNA, 25 bp, Homo sapien
tggactgttaacctcaccttagaag

SEQ ID NO: 70284 - DNA, 25 bp, Homo sapien
gttaacctcaccttagaagcttctt

SEQ ID NO: 70285 - DNA, 25 bp, Homo sapien
acctcaccttagaagcttctttcta

SEQ ID NO: 70286 - DNA, 25 bp, Homo sapien
ataagtgctaatgttttattgcata

SEQ ID NO: 70287 - DNA, 25 bp, Homo sapien
tttattgcatagtagggtgactaga

SEQ ID NO: 70288 - DNA, 25 bp, Homo sapien
gtgactagagttaacaataacctat

SEQ ID NO: 70289 - DNA, 25 bp, Homo sapien
caaagaaatgacacatatttgaggt

SEQ ID NO: 70290 - DNA, 25 bp, Homo sapien
atgctaattaccctggttcggttat

SEQ ID NO: 70291 - DNA, 25 bp, Homo sapien
taccctggttcggttattacgcaat

SEQ ID NO: 70292 - DNA, 25 bp, Homo sapien
cctggttcggttattacgcaatgta

SEQ ID NO: 70293 - DNA, 25 bp, Homo sapien
ggttcggttattacgcaatgtatac

SEQ ID NO: 70294 - DNA, 25 bp, Homo sapien
ggttattacgcaatgtatacatgta

SEQ ID NO: 70295 - DNA, 25 bp, Homo sapien
aaaccttcatctaatactttggatc

SEQ ID NO: 70296 - DNA, 25 bp, Homo sapien
ctaatactttggatcattgtgaaaa

SEQ ID NO: 70297 - DNA, 25 bp, Homo sapien
ccaccatccgtgcttggcacagaag

SEQ ID NO: 70298 - DNA, 25 bp, Homo sapien
caccatccgtgcttggcacagaagt

SEQ ID NO: 70299 - DNA, 25 bp, Homo sapien
accatccgtgcttggcacagaagta

SEQ ID NO: 70300 - DNA, 25 bp, Homo sapien
ccatccgtgcttggcacagaagtag

SEQ ID NO: 70301 - DNA, 25 bp, Homo sapien
atccgtgcttggcacagaagtagct

SEQ ID NO: 70302 - DNA, 25 bp, Homo sapien
tccgtgcttggcacagaagtagctg

SEQ ID NO: 70303 - DNA, 25 bp, Homo sapien
ccgtgcttggcacagaagtagctgc

SEQ ID NO: 70304 - DNA, 25 bp, Homo sapien
cgtgcttggcacagaagtagctgca

SEQ ID NO: 70305 - DNA, 25 bp, Homo sapien
gtgcttggcacagaagtagctgcat

SEQ ID NO: 70306 - DNA, 25 bp, Homo sapien
tgcttggcacagaagtagctgcata

SEQ ID NO: 70307 - DNA, 25 bp, Homo sapien
gcttggcacagaagtagctgcatag

SEQ ID NO: 70308 - DNA, 25 bp, Homo sapien
acggcagccacctgactgggcagac

SEQ ID NO: 70309 - DNA, 25 bp, Homo sapien
cggcagccacctgactgggcagacc

SEQ ID NO: 70310 - DNA, 25 bp, Homo sapien
ggcagccacctgactgggcagaccc

SEQ ID NO: 70311 - DNA, 25 bp, Homo sapien
gcagccacctgactgggcagaccct

SEQ ID NO: 70312 - DNA, 25 bp, Homo sapien
cagccacctgactgggcagaccctc

SEQ ID NO: 70313 - DNA, 25 bp, Homo sapien
agccacctgactgggcagaccctca

SEQ ID NO: 70314 - DNA, 25 bp, Homo sapien
acctgactgggcagaccctcaagca

SEQ ID NO: 70315 - DNA, 25 bp, Homo sapien
gctgtggcttctaggggcccgcgtg

SEQ ID NO: 70316 - DNA, 25 bp, Homo sapien
taggggcccgcgtggcatcctgtga

SEQ ID NO: 70317 - DNA, 25 bp, Homo sapien
aggggcccgcgtggcatcctgtgac

SEQ ID NO: 70318 - DNA, 25 bp, Homo sapien
ggcccgcgtggcatcctgtgacccc

SEQ ID NO: 70319 - DNA, 25 bp, Homo sapien
acaagatcacagagacaggaaggca

SEQ ID NO: 70320 - DNA, 25 bp, Homo sapien
aaggcaggtgaccttgatgtgtcac

SEQ ID NO: 70321 - DNA, 25 bp, Homo sapien
gatgtgtcaccagacttggagccac

SEQ ID NO: 70322 - DNA, 25 bp, Homo sapien
ggagccacagctatatgttctggta

SEQ ID NO: 70323 - DNA, 25 bp, Homo sapien
tgatctattactcagcagctgctga

SEQ ID NO: 70324 - DNA, 25 bp, Homo sapien
cagcagctgctgatattacagataa

SEQ ID NO: 70325 - DNA, 25 bp, Homo sapien
agaagtccccgatggctatgttgtc

SEQ ID NO: 70326 - DNA, 25 bp, Homo sapien
ggctatgttgtctccagatccaaga

SEQ ID NO: 70327 - DNA, 25 bp, Homo sapien
cagatccaagacagagaatttcccc

SEQ ID NO: 70328 - DNA, 25 bp, Homo sapien
gtatttctgcgccagcagtggtagt

SEQ ID NO: 70329 - DNA, 25 bp, Homo sapien
gtagtagggcaagcgagcagtactt

SEQ ID NO: 70330 - DNA, 25 bp, Homo sapien
gtaaccggtgccagaaaggcaagca

SEQ ID NO: 70331 - DNA, 25 bp, Homo sapien
taaccggtgccagaaaggcaagcaa

SEQ ID NO: 70332 - DNA, 25 bp, Homo sapien
aaccggtgccagaaaggcaagcaat

SEQ ID NO: 70333 - DNA, 25 bp, Homo sapien
accggtgccagaaaggcaagcaatc

SEQ ID NO: 70334 - DNA, 25 bp, Homo sapien
ccggtgccagaaaggcaagcaatca

SEQ ID NO: 70335 - DNA, 25 bp, Homo sapien
cggtgccagaaaggcaagcaatcaa

SEQ ID NO: 70336 - DNA, 25 bp, Homo sapien
ggtgccagaaaggcaagcaatcaag

SEQ ID NO: 70337 - DNA, 25 bp, Homo sapien
gtgccagaaaggcaagcaatcaagc

SEQ ID NO: 70338 - DNA, 25 bp, Homo sapien
tgccagaaaggcaagcaatcaagca

SEQ ID NO: 70339 - DNA, 25 bp, Homo sapien
ccttgtcactttccgttcaactata

SEQ ID NO: 70340 - DNA, 25 bp, Homo sapien
ttttaactgcactaacaaaggatca

SEQ ID NO: 70341 - DNA, 25 bp, Homo sapien
aaccttgtgtggtgtgcaacttctt

SEQ ID NO: 70342 - DNA, 25 bp, Homo sapien
actacgaccaagaccacacctgggt

SEQ ID NO: 70343 - DNA, 25 bp, Homo sapien
acacctgggtgtattgctgatgctg

SEQ ID NO: 70344 - DNA, 25 bp, Homo sapien
tcttcagaggaagactgccgccata

SEQ ID NO: 70345 - DNA, 25 bp, Homo sapien
aagactgccgccatactgaggctga

SEQ ID NO: 70346 - DNA, 25 bp, Homo sapien
gatttgtctttttcattgcatctgt

SEQ ID NO: 70347 - DNA, 25 bp, Homo sapien
ttttcattgcatctgtcaagcttaa

SEQ ID NO: 70348 - DNA, 25 bp, Homo sapien
tttagaaataccctctgcaccacct

SEQ ID NO: 70349 - DNA, 25 bp, Homo sapien
atcagctggtcctttgtgaagaacg

SEQ ID NO: 70350 - DNA, 25 bp, Homo sapien
tgagtaccctccgacggttggaaga

SEQ ID NO: 70351 - DNA, 25 bp, Homo sapien
ggttggaagaccaggccactgcata

SEQ ID NO: 70352 - DNA, 25 bp, Homo sapien
gaagaccaggccactgcatatgtgt

SEQ ID NO: 70353 - DNA, 25 bp, Homo sapien
accaggccactgcatatgtgtgtga

SEQ ID NO: 70354 - DNA, 25 bp, Homo sapien
atgtgtgtgagaatcaagcctgctc

SEQ ID NO: 70355 - DNA, 25 bp, Homo sapien
atcactgatccctgcgaattacgaa

SEQ ID NO: 70356 - DNA, 25 bp, Homo sapien
ctgatccctgcgaattacgaaaact

SEQ ID NO: 70357 - DNA, 25 bp, Homo sapien
aaaactactacatccatgactgccc

SEQ ID NO: 70358 - DNA, 25 bp, Homo sapien
gtgaagcatcccaactgactagaga

SEQ ID NO: 70359 - DNA, 25 bp, Homo sapien
atcccaactgactagagactcaggc

SEQ ID NO: 70360 - DNA, 25 bp, Homo sapien
gggcacccactcaccctagaataaa

SEQ ID NO: 70361 - DNA, 25 bp, Homo sapien
gcgacgacctcgaccggctcggcgt

SEQ ID NO: 70362 - DNA, 25 bp, Homo sapien
ctggactacgaggccggcgtcctcg

SEQ ID NO: 70363 - DNA, 25 bp, Homo sapien
ggcgtcctcgccttctacgacgtga

SEQ ID NO: 70364 - DNA, 25 bp, Homo sapien
gtcctcgccttctacgacgtgacgg

SEQ ID NO: 70365 - DNA, 25 bp, Homo sapien
tcctcgccttctacgacgtgacggg

SEQ ID NO: 70366 - DNA, 25 bp, Homo sapien
gccttctacgacgtgacgggcggca

SEQ ID NO: 70367 - DNA, 25 bp, Homo sapien
ccttctacgacgtgacgggcggcat

SEQ ID NO: 70368 - DNA, 25 bp, Homo sapien
ttctacgacgtgacgggcggcatga

SEQ ID NO: 70369 - DNA, 25 bp, Homo sapien
acgtgacgggcggcatgagccacct

SEQ ID NO: 70370 - DNA, 25 bp, Homo sapien
gcgccacgttccaggagccgctcta

SEQ ID NO: 70371 - DNA, 25 bp, Homo sapien
ccaggaccggcgtgacagcctccag

SEQ ID NO: 70372 - DNA, 25 bp, Homo sapien
tcttgacattgagcagcgactacaa

SEQ ID NO: 70373 - DNA, 25 bp, Homo sapien
agcagcgactacaaggtgtaatcaa

SEQ ID NO: 70374 - DNA, 25 bp, Homo sapien
gagtgacaggactgccgttatctat

SEQ ID NO: 70375 - DNA, 25 bp, Homo sapien
gactgccgttatctattgaaggaca

SEQ ID NO: 70376 - DNA, 25 bp, Homo sapien
gatgaaaacttactatgccagatgt

SEQ ID NO: 70377 - DNA, 25 bp, Homo sapien
tgccagatgtatcttggttggactc

SEQ ID NO: 70378 - DNA, 25 bp, Homo sapien
ggttggactccatatatgtgaaatg

SEQ ID NO: 70379 - DNA, 25 bp, Homo sapien
aatgcatttggtatgaatctgtggt

SEQ ID NO: 70380 - DNA, 25 bp, Homo sapien
gaatctgtggttgtatctgttcaat

SEQ ID NO: 70381 - DNA, 25 bp, Homo sapien
cataaatttacgttctcagcaactg

SEQ ID NO: 70382 - DNA, 25 bp, Homo sapien
tctcagcaactgttatttctctctg

SEQ ID NO: 70383 - DNA, 25 bp, Homo sapien
gagtgcttgtcaaccatgaccatct

SEQ ID NO: 70384 - DNA, 25 bp, Homo sapien
atgaccatctttgagccttcctagt

SEQ ID NO: 70385 - DNA, 25 bp, Homo sapien
tcctccacctggcacagtatttgaa

SEQ ID NO: 70386 - DNA, 25 bp, Homo sapien
gtgcttcatcctctaacaaacagtg

SEQ ID NO: 70387 - DNA, 25 bp, Homo sapien
aacagtgtacactcccagagctgat

SEQ ID NO: 70388 - DNA, 25 bp, Homo sapien
tgactgtgcacatttcctctagttc

SEQ ID NO: 70389 - DNA, 25 bp, Homo sapien
catttcctctagttcatgtctgtag

SEQ ID NO: 70390 - DNA, 25 bp, Homo sapien
ctgtagtccctatagaatgatctgt

SEQ ID NO: 70391 - DNA, 25 bp, Homo sapien
tatactggactgtgcatcaaaggga

SEQ ID NO: 70392 - DNA, 25 bp, Homo sapien
ccaaaggttgaagttctgctgtttt

SEQ ID NO: 70393 - DNA, 25 bp, Homo sapien
ctgctgttttgttataatgcctgat

SEQ ID NO: 70394 - DNA, 25 bp, Homo sapien
tgcccgcgtggcatcctgtgaccga

SEQ ID NO: 70395 - DNA, 25 bp, Homo sapien
gcccgcgtggcatcctgtgaccgac

SEQ ID NO: 70396 - DNA, 25 bp, Homo sapien
cccgcgtggcatcctgtgaccgacc

SEQ ID NO: 70397 - DNA, 25 bp, Homo sapien
ccgcgtggcatcctgtgaccgaccc

SEQ ID NO: 70398 - DNA, 25 bp, Homo sapien
gcgtggcatcctgtgaccgacccct

SEQ ID NO: 70399 - DNA, 25 bp, Homo sapien
ttccttcactttgcagaggctggaa

SEQ ID NO: 70400 - DNA, 25 bp, Homo sapien
tccttcactttgcagaggctggaag

SEQ ID NO: 70401 - DNA, 25 bp, Homo sapien
ccttcactttgcagaggctggaaga

SEQ ID NO: 70402 - DNA, 25 bp, Homo sapien
cttcactttgcagaggctggaagac

SEQ ID NO: 70403 - DNA, 25 bp, Homo sapien
ttcactttgcagaggctggaagacg

SEQ ID NO: 70404 - DNA, 25 bp, Homo sapien
tcactttgcagaggctggaagacgg

SEQ ID NO: 70405 - DNA, 25 bp, Homo sapien
acggcagccacctgactgggcagac

SEQ ID NO: 70406 - DNA, 25 bp, Homo sapien
cggcagccacctgactgggcagacc

SEQ ID NO: 70407 - DNA, 25 bp, Homo sapien
ggcagccacctgactgggcagaccc

SEQ ID NO: 70408 - DNA, 25 bp, Homo sapien
gcagccacctgactgggcagaccct

SEQ ID NO: 70409 - DNA, 25 bp, Homo sapien
cagccacctgactgggcagaccctc

SEQ ID NO: 70410 - DNA, 25 bp, Homo sapien
agccacctgactgggcagaccctca

SEQ ID NO: 70411 - DNA, 25 bp, Homo sapien
acctgactgggcagaccctcaagca

SEQ ID NO: 70412 - DNA, 25 bp, Homo sapien
gctgtggcttctaggggcccgcgtg

SEQ ID NO: 70413 - DNA, 25 bp, Homo sapien
taggggcccgcgtggcatcctgtga

SEQ ID NO: 70414 - DNA, 25 bp, Homo sapien
aggggcccgcgtggcatcctgtgac

SEQ ID NO: 70415 - DNA, 25 bp, Homo sapien
ggcccgcgtggcatcctgtgacccc

SEQ ID NO: 70416 - DNA, 25 bp, Homo sapien
gccccgggaccgcactgacaggaaa

SEQ ID NO: 70417 - DNA, 25 bp, Homo sapien
actgacaggaaaccttccgtcgtga

SEQ ID NO: 70418 - DNA, 25 bp, Homo sapien
gaaaccttccgtcgtgagggagcac

SEQ ID NO: 70419 - DNA, 25 bp, Homo sapien
tccgtcgtgagggagcacttcccag

SEQ ID NO: 70420 - DNA, 25 bp, Homo sapien
cagggacgacactctccagggaggc

SEQ ID NO: 70421 - DNA, 25 bp, Homo sapien
aaccacaccatcttcttgctgtgag

SEQ ID NO: 70422 - DNA, 25 bp, Homo sapien
ttgctgtgagaggtctcaccccggg

SEQ ID NO: 70423 - DNA, 25 bp, Homo sapien
tgtgagaggtctcaccccgggctac

SEQ ID NO: 70424 - DNA, 25 bp, Homo sapien
gggtgcctagccaggtgcagtcccc

SEQ ID NO: 70425 - DNA, 25 bp, Homo sapien
tagtcctcggcgtcacgcaatgctc

SEQ ID NO: 70426 - DNA, 25 bp, Homo sapien
ccactaacatcccagactttaaaat

SEQ ID NO: 70427 - DNA, 25 bp, Homo sapien
tactccctcttcaacttgtacatga

SEQ ID NO: 70428 - DNA, 25 bp, Homo sapien
aggcctgtgggagcaaatctgtgta

SEQ ID NO: 70429 - DNA, 25 bp, Homo sapien
aaatctgtgtatgacggcccggagc

SEQ ID NO: 70430 - DNA, 25 bp, Homo sapien
gcaggaggagtattcgacgttcgtc

SEQ ID NO: 70431 - DNA, 25 bp, Homo sapien
gtattcgacgttcgtcattgacgac

SEQ ID NO: 70432 - DNA, 25 bp, Homo sapien
ggagacctacaagacgctaaagcaa

SEQ ID NO: 70433 - DNA, 25 bp, Homo sapien
ttggagcaggagcacgcccagtata

SEQ ID NO: 70434 - DNA, 25 bp, Homo sapien
gagcacgcccagtataagagggaca

SEQ ID NO: 70435 - DNA, 25 bp, Homo sapien
aggagcaccccatcggagacaagag

SEQ ID NO: 70436 - DNA, 25 bp, Homo sapien
ggagacaagagcttccagaactaca

SEQ ID NO: 70437 - DNA, 25 bp, Homo sapien
aactacatccggcagcagtccgaga

SEQ ID NO: 70438 - DNA, 25 bp, Homo sapien
tccccggcgggactgtcaatggagg

SEQ ID NO: 70439 - DNA, 25 bp, Homo sapien
gggttccagcacaaagtttacttct

SEQ ID NO: 70440 - DNA, 25 bp, Homo sapien
tgggcaatttttgtatccaaggaaa

SEQ ID NO: 70441 - DNA, 25 bp, Homo sapien
ggcaatttttgtatccaaggaaata

SEQ ID NO: 70442 - DNA, 25 bp, Homo sapien
aatgtgaatgcgaggaaatgtcttt

SEQ ID NO: 70443 - DNA, 25 bp, Homo sapien
gtgaatgcgaggaaatgtctttaga

SEQ ID NO: 70444 - DNA, 25 bp, Homo sapien
gaaatgtctttagagcacagggaca

SEQ ID NO: 70445 - DNA, 25 bp, Homo sapien
atgtctttagagcacagggacagag

SEQ ID NO: 70446 - DNA, 25 bp, Homo sapien
aagctctctataccaaagactgaaa

SEQ ID NO: 70447 - DNA, 25 bp, Homo sapien
aaatcctgtctgtttttgtatttat

SEQ ID NO: 70448 - DNA, 25 bp, Homo sapien
atgtgggtgatttgataacaagttt

SEQ ID NO: 70449 - DNA, 25 bp, Homo sapien
cagaattctgagttctctactgatg

SEQ ID NO: 70450 - DNA, 25 bp, Homo sapien
agtctcctccggctttctggaagaa

SEQ ID NO: 70451 - DNA, 25 bp, Homo sapien
tctggaagaattcactgagaacaca

SEQ ID NO: 70452 - DNA, 25 bp, Homo sapien
cacagtgaaaattccattagctggg

SEQ ID NO: 70453 - DNA, 25 bp, Homo sapien
cattagctgggaatccagtctcccc

SEQ ID NO: 70454 - DNA, 25 bp, Homo sapien
acttcctgagaagactccaactttg

SEQ ID NO: 70455 - DNA, 25 bp, Homo sapien
ttgaaataaacctgcgactgccatt

SEQ ID NO: 70456 - DNA, 25 bp, Homo sapien
tgcgactgccattcaggatattgtc

SEQ ID NO: 70457 - DNA, 25 bp, Homo sapien
ataaatctaagatgctcccagcaaa

SEQ ID NO: 70458 - DNA, 25 bp, Homo sapien
gtgccaggcatctctaagctctgcc

SEQ ID NO: 70459 - DNA, 25 bp, Homo sapien
ctaagctctgcccttactctgtgtg

SEQ ID NO: 70460 - DNA, 25 bp, Homo sapien
gaattattaattggccatgttcatt

SEQ ID NO: 70461 - DNA, 25 bp, Homo sapien
tattaattggccatgttcattattt

SEQ ID NO: 70462 - DNA, 25 bp, Homo sapien
attaatgggccaatgcaaaaaatca

SEQ ID NO: 70463 - DNA, 25 bp, Homo sapien
tgctgctttgtataactcttctatg

SEQ ID NO: 70464 - DNA, 25 bp, Homo sapien
gctttgtataactcttctatgttta

SEQ ID NO: 70465 - DNA, 25 bp, Homo sapien
gtataactcttctatgtttattcta

SEQ ID NO: 70466 - DNA, 25 bp, Homo sapien
attctattcatttgttcctttccct

SEQ ID NO: 70467 - DNA, 25 bp, Homo sapien
ttctattcatttgttcctttcccta

SEQ ID NO: 70468 - DNA, 25 bp, Homo sapien
atttattacatttctgcttttttct

SEQ ID NO: 70469 - DNA, 25 bp, Homo sapien
aatttatcactgctgaattgcatca

SEQ ID NO: 70470 - DNA, 25 bp, Homo sapien
cagatcatggatgcatttttattat

SEQ ID NO: 70471 - DNA, 25 bp, Homo sapien
ggaagtaagtcagggcgggctttga

SEQ ID NO: 70472 - DNA, 25 bp, Homo sapien
gggacccatatcctacaggcaaaaa

SEQ ID NO: 70473 - DNA, 25 bp, Homo sapien
gcaaaaagcaggctaggtgaccttg

SEQ ID NO: 70474 - DNA, 25 bp, Homo sapien
gcaggctaggtgaccttgggacact

SEQ ID NO: 70475 - DNA, 25 bp, Homo sapien
aggtgaccttgggacactacgctaa

SEQ ID NO: 70476 - DNA, 25 bp, Homo sapien
gaccttgggacactacgctaaggga

SEQ ID NO: 70477 - DNA, 25 bp, Homo sapien
acactacgctaagggagggaggcta

SEQ ID NO: 70478 - DNA, 25 bp, Homo sapien
gccaggtttgcagtgcgggaagatg

SEQ ID NO: 70479 - DNA, 25 bp, Homo sapien
ctgtagttggtgactgggtgttcat

SEQ ID NO: 70480 - DNA, 25 bp, Homo sapien
tagttggtgactgggtgttcatttt

SEQ ID NO: 70481 - DNA, 25 bp, Homo sapien
aaaaatcagtgtttcgtgaaggtgt

SEQ ID NO: 70482 - DNA, 25 bp, Homo sapien
gcagatactttttaggtggcatttt

SEQ ID NO: 70483 - DNA, 25 bp, Homo sapien
tttattcatttcctgtgctttaaat

SEQ ID NO: 70484 - DNA, 25 bp, Homo sapien
agctgtttaagtgcttcggctactt

SEQ ID NO: 70485 - DNA, 25 bp, Homo sapien
tacttgtcccctggttcagtagagg

SEQ ID NO: 70486 - DNA, 25 bp, Homo sapien
ccggtttcccagttgttgactgtga

SEQ ID NO: 70487 - DNA, 25 bp, Homo sapien
actgtgacaggctcagcatgggctc

SEQ ID NO: 70488 - DNA, 25 bp, Homo sapien
gcatgggctcagcagatgctgtctt

SEQ ID NO: 70489 - DNA, 25 bp, Homo sapien
gatgctgtcttaatttgtggatgat

SEQ ID NO: 70490 - DNA, 25 bp, Homo sapien
gccaggctttgggatacaagttctt

SEQ ID NO: 70491 - DNA, 25 bp, Homo sapien
tttcctcttcatttgatgccgtgca

SEQ ID NO: 70492 - DNA, 25 bp, Homo sapien
gatgccgtgcactgtgtgaagcaga

SEQ ID NO: 70493 - DNA, 25 bp, Homo sapien
ttcacctaatatcctcttttagctg

SEQ ID NO: 70494 - DNA, 25 bp, Homo sapien
atcctcttttagctgcatgtatatt

SEQ ID NO: 70495 - DNA, 25 bp, Homo sapien
taattataaccctggtggactgcag

SEQ ID NO: 70496 - DNA, 25 bp, Homo sapien
gactgcagccttcatctttattggg

SEQ ID NO: 70497 - DNA, 25 bp, Homo sapien
ctgcagccttcatctttattgggaa

SEQ ID NO: 70498 - DNA, 25 bp, Homo sapien
gttataaatcagaaatgggtccatg

SEQ ID NO: 70499 - DNA, 25 bp, Homo sapien
gtccatgatgaccactgttttccaa

SEQ ID NO: 70500 - DNA, 25 bp, Homo sapien
ccatgatgaccactgttttccaaac

SEQ ID NO: 70501 - DNA, 25 bp, Homo sapien
ttttccaaacccagtctgttccctg

SEQ ID NO: 70502 - DNA, 25 bp, Homo sapien
gcaagccccaccacacaggagtgag

SEQ ID NO: 70503 - DNA, 25 bp, Homo sapien
taactgtatttaatttgctttcaaa

SEQ ID NO: 70504 - DNA, 25 bp, Homo sapien
gcaaaccaaggagggagctggaggt

SEQ ID NO: 70505 - DNA, 25 bp, Homo sapien
ggtggcgctggcacaagagcagggt

SEQ ID NO: 70506 - DNA, 25 bp, Homo sapien
gtggctggcgactgaggctcaggtc

SEQ ID NO: 70507 - DNA, 25 bp, Homo sapien
gactgaggctcaggtcacccaggag

SEQ ID NO: 70508 - DNA, 25 bp, Homo sapien
gtcacccaggagctgaaaggactga

SEQ ID NO: 70509 - DNA, 25 bp, Homo sapien
gaagagaggccagaaactgagcccc

SEQ ID NO: 70510 - DNA, 25 bp, Homo sapien
aaactgagcccctgctgagctttgt

SEQ ID NO: 70511 - DNA, 25 bp, Homo sapien
tgaccgaatgctcactgtgaccccg

SEQ ID NO: 70512 - DNA, 25 bp, Homo sapien
ctccatcatttcttacaggttttcc

SEQ ID NO: 70513 - DNA, 25 bp, Homo sapien
ctcaagcaattcgacatctcaagtg

SEQ ID NO: 70514 - DNA, 25 bp, Homo sapien
aagacatggcccctgaagggcaata

SEQ ID NO: 70515 - DNA, 25 bp, Homo sapien
gtaaagtcctttaagcactcagaag

SEQ ID NO: 70516 - DNA, 25 bp, Homo sapien
taagcactcagaagccatacctcat

SEQ ID NO: 70517 - DNA, 25 bp, Homo sapien
agaagccatacctcatctctctggc

SEQ ID NO: 70518 - DNA, 25 bp, Homo sapien
gagatgtgttgctgtgcccacccag

SEQ ID NO: 70519 - DNA, 25 bp, Homo sapien
ttcttcctttgtactcttcagctgg

SEQ ID NO: 70520 - DNA, 25 bp, Homo sapien
tttgtactcttcagctggcacctgc

SEQ ID NO: 70521 - DNA, 25 bp, Homo sapien
tccattctgccctacatgatgggta

SEQ ID NO: 70522 - DNA, 25 bp, Homo sapien
acatgatgggtaactgtgatctttc

SEQ ID NO: 70523 - DNA, 25 bp, Homo sapien
actgtgatctttcttccctgttaga

SEQ ID NO: 70524 - DNA, 25 bp, Homo sapien
cttccctgttagattgtaagcctcc

SEQ ID NO: 70525 - DNA, 25 bp, Homo sapien
cccagtgcctgacacaggaactgtg

SEQ ID NO: 70526 - DNA, 25 bp, Homo sapien
ggcagcagcctcaccgaagagagga

SEQ ID NO: 70527 - DNA, 25 bp, Homo sapien
agatgtgtcctgatgactatagtgc

SEQ ID NO: 70528 - DNA, 25 bp, Homo sapien
gatgactatagtgcagctaactttt

SEQ ID NO: 70529 - DNA, 25 bp, Homo sapien
gcagctaactttttggttctcagat

SEQ ID NO: 70530 - DNA, 25 bp, Homo sapien
tctcagatttgtaggtgcataggtg

SEQ ID NO: 70531 - DNA, 25 bp, Homo sapien
gtaggtgcataggtgtgtgtttcaa

SEQ ID NO: 70532 - DNA, 25 bp, Homo sapien
cataggtgtgtgtttcaaggaagga

SEQ ID NO: 70533 - DNA, 25 bp, Homo sapien
gttaacttatcagctacatcctctg

SEQ ID NO: 70534 - DNA, 25 bp, Homo sapien
atcagctacatcctctgtaacgtgg

SEQ ID NO: 70535 - DNA, 25 bp, Homo sapien
atcctctgtaacgtggttcatccct

SEQ ID NO: 70536 - DNA, 25 bp, Homo sapien
tgtaacgtggttcatccctggttaa

SEQ ID NO: 70537 - DNA, 25 bp, Homo sapien
gtggttgtcatgtgatgggtccctc

SEQ ID NO: 70538 - DNA, 25 bp, Homo sapien
tggttgtcatgtgatgggtccctcc

SEQ ID NO: 70539 - DNA, 25 bp, Homo sapien
ggttgtcatgtgatgggtccctcca

SEQ ID NO: 70540 - DNA, 25 bp, Homo sapien
ttgtcatgtgatgggtccctccagg

SEQ ID NO: 70541 - DNA, 25 bp, Homo sapien
gtcatgtgatgggtccctccaggtt

SEQ ID NO: 70542 - DNA, 25 bp, Homo sapien
tgtgatgggtccctccaggttacta

SEQ ID NO: 70543 - DNA, 25 bp, Homo sapien
ctgcttgaacactgaagggcaggtg

SEQ ID NO: 70544 - DNA, 25 bp, Homo sapien
gcttgaacactgaagggcaggtggt

SEQ ID NO: 70545 - DNA, 25 bp, Homo sapien
cttgaacactgaagggcaggtggtg

SEQ ID NO: 70546 - DNA, 25 bp, Homo sapien
tcccatcgctcttacccggtaagta

SEQ ID NO: 70547 - DNA, 25 bp, Homo sapien
atctctagagctgtcttgtcgccgc

SEQ ID NO: 70548 - DNA, 25 bp, Homo sapien
gtcactgttgccaaactataccatg

SEQ ID NO: 70549 - DNA, 25 bp, Homo sapien
tgttgccaaactataccatggaggg

SEQ ID NO: 70550 - DNA, 25 bp, Homo sapien
ggtctgaaccgcaaccagggcctga

SEQ ID NO: 70551 - DNA, 25 bp, Homo sapien
ctgaaccgcaaccagggcctgaaca

SEQ ID NO: 70552 - DNA, 25 bp, Homo sapien
aggcgccgcacgaggacgacgctga

SEQ ID NO: 70553 - DNA, 25 bp, Homo sapien
tgagcgtccgcagaggtgaccgaaa

SEQ ID NO: 70554 - DNA, 25 bp, Homo sapien
agaggtgaccgaaaagccgtatgat

SEQ ID NO: 70555 - DNA, 25 bp, Homo sapien
aagccgtatgatgatgttcccgatt

SEQ ID NO: 70556 - DNA, 25 bp, Homo sapien
tatgatgatgttcccgatttctctg

SEQ ID NO: 70557 - DNA, 25 bp, Homo sapien
gatgttcccgatttctctgttggtc

SEQ ID NO: 70558 - DNA, 25 bp, Homo sapien
ccgatttctctgttggtcggagtcg

SEQ ID NO: 70559 - DNA, 25 bp, Homo sapien
aaaactgtcctggttatgcaataga

SEQ ID NO: 70560 - DNA, 25 bp, Homo sapien
gtggctacccaacttttcacacatc

SEQ ID NO: 70561 - DNA, 25 bp, Homo sapien
cccaacttttcacacatcttactga

SEQ ID NO: 70562 - DNA, 25 bp, Homo sapien
atcttactgattataggccttgctg

SEQ ID NO: 70563 - DNA, 25 bp, Homo sapien
attataggccttgctgtgaatgctt

SEQ ID NO: 70564 - DNA, 25 bp, Homo sapien
tgctgtgaatgctttcttgctctat

SEQ ID NO: 70565 - DNA, 25 bp, Homo sapien
gaatgctttcttgctctatctgaag

SEQ ID NO: 70566 - DNA, 25 bp, Homo sapien
gctctatctgaagtattcccaccag

SEQ ID NO: 70567 - DNA, 25 bp, Homo sapien
agtattcccaccagagttgtttcca

SEQ ID NO: 70568 - DNA, 25 bp, Homo sapien
ttcccaccagagttgtttccaactt

SEQ ID NO: 70569 - DNA, 25 bp, Homo sapien
ttccaactttatttcctatattatg

SEQ ID NO: 70570 - DNA, 25 bp, Homo sapien
agtgagggcccgcacaccacccacg

SEQ ID NO: 70571 - DNA, 25 bp, Homo sapien
tgagggcccgcacaccacccacgtg

SEQ ID NO: 70572 - DNA, 25 bp, Homo sapien
ccacgtgcctccagacagcgagtga

SEQ ID NO: 70573 - DNA, 25 bp, Homo sapien
acgtgcctccagacagcgagtgaca

SEQ ID NO: 70574 - DNA, 25 bp, Homo sapien
cgtgcctccagacagcgagtgacat

SEQ ID NO: 70575 - DNA, 25 bp, Homo sapien
gtgcctccagacagcgagtgacatc

SEQ ID NO: 70576 - DNA, 25 bp, Homo sapien
ctccagacagcgagtgacatcccat

SEQ ID NO: 70577 - DNA, 25 bp, Homo sapien
ccagacagcgagtgacatcccatct

SEQ ID NO: 70578 - DNA, 25 bp, Homo sapien
agacagcgagtgacatcccatctcc

SEQ ID NO: 70579 - DNA, 25 bp, Homo sapien
gacagcgagtgacatcccatctcct

SEQ ID NO: 70580 - DNA, 25 bp, Homo sapien
acagcgagtgacatcccatctcctc

SEQ ID NO: 70581 - DNA, 25 bp, Homo sapien
tatttgccaccgtccgtgaactggt

SEQ ID NO: 70582 - DNA, 25 bp, Homo sapien
caccgtccgtgaactggtctcaggg

SEQ ID NO: 70583 - DNA, 25 bp, Homo sapien
tctctgaggcagagcagcgctgtgt

SEQ ID NO: 70584 - DNA, 25 bp, Homo sapien
agagcagcgctgtgtatctcgtggc

SEQ ID NO: 70585 - DNA, 25 bp, Homo sapien
tgtgtatctcgtggcttcacacccg

SEQ ID NO: 70586 - DNA, 25 bp, Homo sapien
gttccaggcggctctggatgaatat

SEQ ID NO: 70587 - DNA, 25 bp, Homo sapien
gaggagctcaatgtctggcaggtca

SEQ ID NO: 70588 - DNA, 25 bp, Homo sapien
gtctggcaggtcaatgcttcccgga

SEQ ID NO: 70589 - DNA, 25 bp, Homo sapien
aggtcaatgcttcccggacacggat

SEQ ID NO: 70590 - DNA, 25 bp, Homo sapien
ggacacggatcacttttgtctgatt

SEQ ID NO: 70591 - DNA, 25 bp, Homo sapien
ttgtctgattccagcctgcttgcaa

SEQ ID NO: 70592 - DNA, 25 bp, Homo sapien
acttgaatctgtagacatttcttta

SEQ ID NO: 70593 - DNA, 25 bp, Homo sapien
cttgaatctgtagacatttctttat

SEQ ID NO: 70594 - DNA, 25 bp, Homo sapien
catttctttattgatatggcaaatt

SEQ ID NO: 70595 - DNA, 25 bp, Homo sapien
tctttattgatatggcaaattgctt

SEQ ID NO: 70596 - DNA, 25 bp, Homo sapien
tattgatatggcaaattgcttgcag

SEQ ID NO: 70597 - DNA, 25 bp, Homo sapien
ttgatatggcaaattgcttgcagat

SEQ ID NO: 70598 - DNA, 25 bp, Homo sapien
gatatggcaaattgcttgcagatat

SEQ ID NO: 70599 - DNA, 25 bp, Homo sapien
atggcaaattgcttgcagatatttt

SEQ ID NO: 70600 - DNA, 25 bp, Homo sapien
tggcaaattgcttgcagatattttt

SEQ ID NO: 70601 - DNA, 25 bp, Homo sapien
ttaaatgacagcaattttctaatat

SEQ ID NO: 70602 - DNA, 25 bp, Homo sapien
aaatgacagcaattttctaatattt

SEQ ID NO: 70603 - DNA, 25 bp, Homo sapien
acacaccttgtgtcactttatcttg

SEQ ID NO: 70604 - DNA, 25 bp, Homo sapien
gtcactttatcttggtaacgagcca

SEQ ID NO: 70605 - DNA, 25 bp, Homo sapien
atgcaaccagttcatccatgtctga

SEQ ID NO: 70606 - DNA, 25 bp, Homo sapien
gtctgacccaagagctcttaactgc

SEQ ID NO: 70607 - DNA, 25 bp, Homo sapien
tcttaactgctatgctgcactgcct

SEQ ID NO: 70608 - DNA, 25 bp, Homo sapien
gctgcactgcctcattcagagatag

SEQ ID NO: 70609 - DNA, 25 bp, Homo sapien
cattcagagatagatgcctgcatgg

SEQ ID NO: 70610 - DNA, 25 bp, Homo sapien
atgcctgcatgggtcctggcgatta

SEQ ID NO: 70611 - DNA, 25 bp, Homo sapien
tgggtcctggcgattattttaatgc

SEQ ID NO: 70612 - DNA, 25 bp, Homo sapien
attattttaatgctggctacacccc

SEQ ID NO: 70613 - DNA, 25 bp, Homo sapien
ccccacaggtgacttggattcagaa

SEQ ID NO: 70614 - DNA, 25 bp, Homo sapien
cccacggcggtgaggtccatcctga

SEQ ID NO: 70615 - DNA, 25 bp, Homo sapien
gtgaggtccatcctgaccaaggagc

SEQ ID NO: 70616 - DNA, 25 bp, Homo sapien
agcggcggccagagggcgggtacaa

SEQ ID NO: 70617 - DNA, 25 bp, Homo sapien
gggcgggtacaaggctgtctggttt

SEQ ID NO: 70618 - DNA, 25 bp, Homo sapien
tctggtttggcgaggacatcgggac

SEQ ID NO: 70619 - DNA, 25 bp, Homo sapien
acggaggcagacgtggtcgttctca

SEQ ID NO: 70620 - DNA, 25 bp, Homo sapien
gtggatggcgccagtgactccggca

SEQ ID NO: 70621 - DNA, 25 bp, Homo sapien
acgatgcgcccggtggtgatgactc

SEQ ID NO: 70622 - DNA, 25 bp, Homo sapien
cggtggtgatgactcctacatctaa

SEQ ID NO: 70623 - DNA, 25 bp, Homo sapien
gatgactcctacatctaagtggccc

SEQ ID NO: 70624 - DNA, 25 bp, Homo sapien
ccgcacgggcactggaggtctcgct

SEQ ID NO: 70625 - DNA, 25 bp, Homo sapien
gggtgtcaagaatttggcctgggtg

SEQ ID NO: 70626 - DNA, 25 bp, Homo sapien
agaccagctcctctatcagcatttt

SEQ ID NO: 70627 - DNA, 25 bp, Homo sapien
accagctcctctatcagcatttttg

SEQ ID NO: 70628 - DNA, 25 bp, Homo sapien
cagctcctctatcagcatttttggt

SEQ ID NO: 70629 - DNA, 25 bp, Homo sapien
agctcctctatcagcatttttggtg

SEQ ID NO: 70630 - DNA, 25 bp, Homo sapien
gctcctctatcagcatttttggtgt

SEQ ID NO: 70631 - DNA, 25 bp, Homo sapien
ctcctctatcagcatttttggtgtc

SEQ ID NO: 70632 - DNA, 25 bp, Homo sapien
tcctctatcagcatttttggtgtct

SEQ ID NO: 70633 - DNA, 25 bp, Homo sapien
cctctatcagcatttttggtgtctc

SEQ ID NO: 70634 - DNA, 25 bp, Homo sapien
ctctatcagcatttttggtgtctcc

SEQ ID NO: 70635 - DNA, 25 bp, Homo sapien
tctatcagcatttttggtgtctccc

SEQ ID NO: 70636 - DNA, 25 bp, Homo sapien
acttggcccttgtatgacctgaatt

SEQ ID NO: 70637 - DNA, 25 bp, Homo sapien
ggcccttgtatgacctgaatttgca

SEQ ID NO: 70638 - DNA, 25 bp, Homo sapien
atttgcaacctctggtatactgtta

SEQ ID NO: 70639 - DNA, 25 bp, Homo sapien
ggtatactgttatgttctggagaaa

SEQ ID NO: 70640 - DNA, 25 bp, Homo sapien
agatctgccaaatactgcattagta

SEQ ID NO: 70641 - DNA, 25 bp, Homo sapien
gtttatacagcatttttgtagggtt

SEQ ID NO: 70642 - DNA, 25 bp, Homo sapien
ttcaaggtcactttccaagcacttt

SEQ ID NO: 70643 - DNA, 25 bp, Homo sapien
actttccaagcactttctggttttg

SEQ ID NO: 70644 - DNA, 25 bp, Homo sapien
agcactttctggttttgcttgtttt

SEQ ID NO: 70645 - DNA, 25 bp, Homo sapien
ttccttataataaacatggcagcaa

SEQ ID NO: 70646 - DNA, 25 bp, Homo sapien
acatggcagcaagtaaacagtgtga

SEQ ID NO: 70647 - DNA, 25 bp, Homo sapien
tttattgagcatccacgtgctggac

SEQ ID NO: 70648 - DNA, 25 bp, Homo sapien
gagcatccacgtgctggacgatact

SEQ ID NO: 70649 - DNA, 25 bp, Homo sapien
aagtatttttggtacctctgatgta

SEQ ID NO: 70650 - DNA, 25 bp, Homo sapien
ggtacctctgatgtagcagcacttg

SEQ ID NO: 70651 - DNA, 25 bp, Homo sapien
gatgtagcagcacttgccatgttat

SEQ ID NO: 70652 - DNA, 25 bp, Homo sapien
gcagcacttgccatgttatatatat

SEQ ID NO: 70653 - DNA, 25 bp, Homo sapien
gtgttctagaaattccgactctttt

SEQ ID NO: 70654 - DNA, 25 bp, Homo sapien
gaaattccgactcttttcattagat

SEQ ID NO: 70655 - DNA, 25 bp, Homo sapien
attccgactcttttcattagatata

SEQ ID NO: 70656 - DNA, 25 bp, Homo sapien
ctttcattcttgctggtttatacct

SEQ ID NO: 70657 - DNA, 25 bp, Homo sapien
agtagtagcttcttctacaatgtaa

SEQ ID NO: 70658 - DNA, 25 bp, Homo sapien
tgtgtggcgtcctctctccgggcga

SEQ ID NO: 70659 - DNA, 25 bp, Homo sapien
tctccgggcgatgttgactccgaca

SEQ ID NO: 70660 - DNA, 25 bp, Homo sapien
gatgttgactccgacaggcggcatt

SEQ ID NO: 70661 - DNA, 25 bp, Homo sapien
ttgactccgacaggcggcattcttg

SEQ ID NO: 70662 - DNA, 25 bp, Homo sapien
gtgcgtcactagtattgggtgagcc

SEQ ID NO: 70663 - DNA, 25 bp, Homo sapien
cactagtattgggtgagccacgcgg

SEQ ID NO: 70664 - DNA, 25 bp, Homo sapien
tttcgctcgaggcttgggcgcccac

SEQ ID NO: 70665 - DNA, 25 bp, Homo sapien
tgggcgcccactcccgaggtgtctt

SEQ ID NO: 70666 - DNA, 25 bp, Homo sapien
actaccttgggcaccccgatgtcat

SEQ ID NO: 70667 - DNA, 25 bp, Homo sapien
ggcaccccgatgtcatcttctgttg

SEQ ID NO: 70668 - DNA, 25 bp, Homo sapien
gtcaggcgaggtgtccgttttctgc

SEQ ID NO: 70669 - DNA, 25 bp, Homo sapien
gggtgtttctgtgggtactcctctt

SEQ ID NO: 70670 - DNA, 25 bp, Homo sapien
gtgtttctgtgggtactcctcttac

SEQ ID NO: 70671 - DNA, 25 bp, Homo sapien
ttctgtgggtactcctcttacccca

SEQ ID NO: 70672 - DNA, 25 bp, Homo sapien
tagaggcagatgctgcactgcacta

SEQ ID NO: 70673 - DNA, 25 bp, Homo sapien
aggcagatgctgcactgcactactc

SEQ ID NO: 70674 - DNA, 25 bp, Homo sapien
atgctgcactgcactactccaatgt

SEQ ID NO: 70675 - DNA, 25 bp, Homo sapien
actgcactactccaatgtcttccat

SEQ ID NO: 70676 - DNA, 25 bp, Homo sapien
gccccttcagctgctagtgatatca

SEQ ID NO: 70677 - DNA, 25 bp, Homo sapien
ccttcagctgctagtgatatcactt

SEQ ID NO: 70678 - DNA, 25 bp, Homo sapien
cagctgctagtgatatcacttgttg

SEQ ID NO: 70679 - DNA, 25 bp, Homo sapien
ctagtgatatcacttgttggacatt

SEQ ID NO: 70680 - DNA, 25 bp, Homo sapien
caactggcttaaactggagctgtcc

SEQ ID NO: 70681 - DNA, 25 bp, Homo sapien
tggagctgtcccagcgaatcaggac

SEQ ID NO: 70682 - DNA, 25 bp, Homo sapien
gaatcaggacgctcagtcactctga

SEQ ID NO: 70683 - DNA, 25 bp, Homo sapien
gtcactctgatattacgtaacatac

SEQ ID NO: 70684 - DNA, 25 bp, Homo sapien
gtaacataccagttagggcctgcgg

SEQ ID NO: 70685 - DNA, 25 bp, Homo sapien
gggcctgcggaagcatcttgtaatg

SEQ ID NO: 70686 - DNA, 25 bp, Homo sapien
atggaacacattactatttctgcag

SEQ ID NO: 70687 - DNA, 25 bp, Homo sapien
accgcagaatcgatttcagaaagat

SEQ ID NO: 70688 - DNA, 25 bp, Homo sapien
gtccatattatatagggtgtccaca

SEQ ID NO: 70689 - DNA, 25 bp, Homo sapien
gggtgtccacataattgttgtacaa

SEQ ID NO: 70690 - DNA, 25 bp, Homo sapien
tgttgtacaaaccagagctttttaa

SEQ ID NO: 70691 - DNA, 25 bp, Homo sapien
tcaccaagttggctagactagtctt

SEQ ID NO: 70692 - DNA, 25 bp, Homo sapien
accaagttggctagactagtcttga

SEQ ID NO: 70693 - DNA, 25 bp, Homo sapien
actatacccgaccagatcaaatctt

SEQ ID NO: 70694 - DNA, 25 bp, Homo sapien
ctatacccgaccagatcaaatcttt

SEQ ID NO: 70695 - DNA, 25 bp, Homo sapien
ctaatgttcttgatttaattgtata

SEQ ID NO: 70696 - DNA, 25 bp, Homo sapien
aattaggtgtattttatttgcctct

SEQ ID NO: 70697 - DNA, 25 bp, Homo sapien
tttatttgcctctagctttgaggta

SEQ ID NO: 70698 - DNA, 25 bp, Homo sapien
tttgcctctagctttgaggtatctt

SEQ ID NO: 70699 - DNA, 25 bp, Homo sapien
gcctctagctttgaggtatcttaat

SEQ ID NO: 70700 - DNA, 25 bp, Homo sapien
ctagctttgaggtatcttaatttat

SEQ ID NO: 70701 - DNA, 25 bp, Homo sapien
gaggtatcttaatttatgtatctta

SEQ ID NO: 70702 - DNA, 25 bp, Homo sapien
aaggacatggacaaggtcgagacat

SEQ ID NO: 70703 - DNA, 25 bp, Homo sapien
aggacatggacaaggtcgagacatt

SEQ ID NO: 70704 - DNA, 25 bp, Homo sapien
ggacatggacaaggtcgagacattc

SEQ ID NO: 70705 - DNA, 25 bp, Homo sapien
gacatggacaaggtcgagacattcc

SEQ ID NO: 70706 - DNA, 25 bp, Homo sapien
acatggacaaggtcgagacattcct

SEQ ID NO: 70707 - DNA, 25 bp, Homo sapien
catggacaaggtcgagacattcctg

SEQ ID NO: 70708 - DNA, 25 bp, Homo sapien
atggacaaggtcgagacattcctgc

SEQ ID NO: 70709 - DNA, 25 bp, Homo sapien
tggacaaggtcgagacattcctgcg

SEQ ID NO: 70710 - DNA, 25 bp, Homo sapien
ggacaaggtcgagacattcctgcgc

SEQ ID NO: 70711 - DNA, 25 bp, Homo sapien
gacaaggtcgagacattcctgcgca

SEQ ID NO: 70712 - DNA, 25 bp, Homo sapien
acaaggtcgagacattcctgcgcat

SEQ ID NO: 70713 - DNA, 25 bp, Homo sapien
gaccccgtctatgcaaaaaatacac

SEQ ID NO: 70714 - DNA, 25 bp, Homo sapien
accccgtctatgcaaaaaatacaca

SEQ ID NO: 70715 - DNA, 25 bp, Homo sapien
cccgtctatgcaaaaaatacacaaa

SEQ ID NO: 70716 - DNA, 25 bp, Homo sapien
ccgtctatgcaaaaaatacacaaat

SEQ ID NO: 70717 - DNA, 25 bp, Homo sapien
cgtctatgcaaaaaatacacaaatt

SEQ ID NO: 70718 - DNA, 25 bp, Homo sapien
cctttgagccctgaaagtcgaggtt

SEQ ID NO: 70719 - DNA, 25 bp, Homo sapien
ctttgagccctgaaagtcgaggttg

SEQ ID NO: 70720 - DNA, 25 bp, Homo sapien
tttgagccctgaaagtcgaggttgc

SEQ ID NO: 70721 - DNA, 25 bp, Homo sapien
tgagccctgaaagtcgaggttgcag

SEQ ID NO: 70722 - DNA, 25 bp, Homo sapien
gagccctgaaagtcgaggttgcagt

SEQ ID NO: 70723 - DNA, 25 bp, Homo sapien
agccctgaaagtcgaggttgcagtg

SEQ ID NO: 70724 - DNA, 25 bp, Homo sapien
aagtgaggactcttgtgaagatatg

SEQ ID NO: 70725 - DNA, 25 bp, Homo sapien
agctctcctcccagtgatcaagagt

SEQ ID NO: 70726 - DNA, 25 bp, Homo sapien
tctcctcccagtgatcaagagtgca

SEQ ID NO: 70727 - DNA, 25 bp, Homo sapien
gtgatcaagagtgcaccttcttttt

SEQ ID NO: 70728 - DNA, 25 bp, Homo sapien
agagtgcaccttctttttcaacttc

SEQ ID NO: 70729 - DNA, 25 bp, Homo sapien
acaaacactgtgctttccatcttag

SEQ ID NO: 70730 - DNA, 25 bp, Homo sapien
aaacactgtgctttccatcttagaa

SEQ ID NO: 70731 - DNA, 25 bp, Homo sapien
ttccatcttagaaatctgattgttc

SEQ ID NO: 70732 - DNA, 25 bp, Homo sapien
cttagaaatctgattgttctgtcag

SEQ ID NO: 70733 - DNA, 25 bp, Homo sapien
tggtttagcccccatctagtcagga

SEQ ID NO: 70734 - DNA, 25 bp, Homo sapien
ccatctagtcaggaattaatatact

SEQ ID NO: 70735 - DNA, 25 bp, Homo sapien
ggtctttatgctttgccatgaggcc

SEQ ID NO: 70736 - DNA, 25 bp, Homo sapien
tgaggccacattcagctgctattta

SEQ ID NO: 70737 - DNA, 25 bp, Homo sapien
tcttgaacctaaagaatgctgactt

SEQ ID NO: 70738 - DNA, 25 bp, Homo sapien
atgctgacttttcctacatttccag

SEQ ID NO: 70739 - DNA, 25 bp, Homo sapien
ctacatttccagagttaggcagtat

SEQ ID NO: 70740 - DNA, 25 bp, Homo sapien
gagttaggcagtattctacacttaa

SEQ ID NO: 70741 - DNA, 25 bp, Homo sapien
ggtaatctattcaaatttcttcaca

SEQ ID NO: 70742 - DNA, 25 bp, Homo sapien
tcttcacagatttcaagtctctcaa

SEQ ID NO: 70743 - DNA, 25 bp, Homo sapien
gatttcaagtctctcaaacatcaag

SEQ ID NO: 70744 - DNA, 25 bp, Homo sapien
agacaacttcagcagtcggtacaag

SEQ ID NO: 70745 - DNA, 25 bp, Homo sapien
gtcggtacaagtcacatttcatttt

SEQ ID NO: 70746 - DNA, 25 bp, Homo sapien
gctctgtttaagaaacaggcacttt

SEQ ID NO: 70747 - DNA, 25 bp, Homo sapien
aaaatgttgagatgacaggaggtca

SEQ ID NO: 70748 - DNA, 25 bp, Homo sapien
gacaggaggtcatttcaatatggct

SEQ ID NO: 70749 - DNA, 25 bp, Homo sapien
ggaggtcatttcaatatggcttagt

SEQ ID NO: 70750 - DNA, 25 bp, Homo sapien
ggtcatttcaatatggcttagtaaa

SEQ ID NO: 70751 - DNA, 25 bp, Homo sapien
tctctgtacaagattttgggcctct

SEQ ID NO: 70752 - DNA, 25 bp, Homo sapien
tgtacaagattttgggcctcttttt

SEQ ID NO: 70753 - DNA, 25 bp, Homo sapien
acaatgttgagttcagcatgtgtct

SEQ ID NO: 70754 - DNA, 25 bp, Homo sapien
ccatttcatttgtacgcttgttcaa

SEQ ID NO: 70755 - DNA, 25 bp, Homo sapien
tcatttgtacgcttgttcaaaacca

SEQ ID NO: 70756 - DNA, 25 bp, Homo sapien
tgtacgcttgttcaaaaccaagttt

SEQ ID NO: 70757 - DNA, 25 bp, Homo sapien
gagccactatacccgaccagatcaa

SEQ ID NO: 70758 - DNA, 25 bp, Homo sapien
agccactatacccgaccagatcaaa

SEQ ID NO: 70759 - DNA, 25 bp, Homo sapien
gccactatacccgaccagatcaaat

SEQ ID NO: 70760 - DNA, 25 bp, Homo sapien
cactatacccgaccagatcaaatct

SEQ ID NO: 70761 - DNA, 25 bp, Homo sapien
actatacccgaccagatcaaatctt

SEQ ID NO: 70762 - DNA, 25 bp, Homo sapien
ctatacccgaccagatcaaatcttt

SEQ ID NO: 70763 - DNA, 25 bp, Homo sapien
ctaatgttcttgatttaattgtata

SEQ ID NO: 70764 - DNA, 25 bp, Homo sapien
taatgttcttgatttaattgtatag

SEQ ID NO: 70765 - DNA, 25 bp, Homo sapien
aatgttcttgatttaattgtataga

SEQ ID NO: 70766 - DNA, 25 bp, Homo sapien
atgttcttgatttaattgtatagaa

SEQ ID NO: 70767 - DNA, 25 bp, Homo sapien
gtataattaggtgtattttatttgc

SEQ ID NO: 70768 - DNA, 25 bp, Homo sapien
acactgcagcagatcagccacatcg

SEQ ID NO: 70769 - DNA, 25 bp, Homo sapien
ccagcagcttgggctcgagaaggat

SEQ ID NO: 70770 - DNA, 25 bp, Homo sapien
atgtggtccgagtgtggttctgtaa

SEQ ID NO: 70771 - DNA, 25 bp, Homo sapien
gtaaccggtgccagaaaggcaagca

SEQ ID NO: 70772 - DNA, 25 bp, Homo sapien
tgccagaaaggcaagcaatcaagca

SEQ ID NO: 70773 - DNA, 25 bp, Homo sapien
aggcaagcaatcaagcagcgactat

SEQ ID NO: 70774 - DNA, 25 bp, Homo sapien
cagcgactatgcataacgagaggat

SEQ ID NO: 70775 - DNA, 25 bp, Homo sapien
gggtaccagtatcctttcctctggc

SEQ ID NO: 70776 - DNA, 25 bp, Homo sapien
attttggtaccccaggctatgggag

SEQ ID NO: 70777 - DNA, 25 bp, Homo sapien
gctatgggagccctcacttcactgc

SEQ ID NO: 70778 - DNA, 25 bp, Homo sapien
acttcactgcactgtactcctcggt

SEQ ID NO: 70779 - DNA, 25 bp, Homo sapien
tagcctgccgtgtggcactgcccac

SEQ ID NO: 70780 - DNA, 25 bp, Homo sapien
ggacaagcagcccttgtgttgagtc

SEQ ID NO: 70781 - DNA, 25 bp, Homo sapien
caagcagcccttgtgttgagtcagg

SEQ ID NO: 70782 - DNA, 25 bp, Homo sapien
agcagcccttgtgttgagtcaggtt

SEQ ID NO: 70783 - DNA, 25 bp, Homo sapien
agcccttgtgttgagtcaggttggc

SEQ ID NO: 70784 - DNA, 25 bp, Homo sapien
ccttgtgttgagtcaggttggccct

SEQ ID NO: 70785 - DNA, 25 bp, Homo sapien
tgtgttgagtcaggttggccctgtc

SEQ ID NO: 70786 - DNA, 25 bp, Homo sapien
ttgagtcaggttggccctgtctagg

SEQ ID NO: 70787 - DNA, 25 bp, Homo sapien
tggccctgtctagggtggaacagaa

SEQ ID NO: 70788 - DNA, 25 bp, Homo sapien
acagaaggacagatggacccaggag

SEQ ID NO: 70789 - DNA, 25 bp, Homo sapien
taactgggtaacttattggggctgg

SEQ ID NO: 70790 - DNA, 25 bp, Homo sapien
ggatcataattgtctctacagtctg

SEQ ID NO: 70791 - DNA, 25 bp, Homo sapien
ctctacagtctgatattaaaggcat

SEQ ID NO: 70792 - DNA, 25 bp, Homo sapien
aaaggcattggatctatcttggata

SEQ ID NO: 70793 - DNA, 25 bp, Homo sapien
gcattggatctatcttggatatcat

SEQ ID NO: 70794 - DNA, 25 bp, Homo sapien
tggatatcatacatggtcagagaag

SEQ ID NO: 70795 - DNA, 25 bp, Homo sapien
gatgttatatggactttaatgacac

SEQ ID NO: 70796 - DNA, 25 bp, Homo sapien
atggactttaatgacacaatgttta

SEQ ID NO: 70797 - DNA, 25 bp, Homo sapien
ggaattcttttaagcaatgcaggta

SEQ ID NO: 70798 - DNA, 25 bp, Homo sapien
caatgcaggtattgcgataactgta

SEQ ID NO: 70799 - DNA, 25 bp, Homo sapien
ggtattgcgataactgtagatttta

SEQ ID NO: 70800 - DNA, 25 bp, Homo sapien
tacaataatgttactctacaaatgg

SEQ ID NO: 70801 - DNA, 25 bp, Homo sapien
aaagaactccgagatgctctgctcc

SEQ ID NO: 70802 - DNA, 25 bp, Homo sapien
gctctgctcctgatttttgctaaca

SEQ ID NO: 70803 - DNA, 25 bp, Homo sapien
acaaacaggatgttgctggagcact

SEQ ID NO: 70804 - DNA, 25 bp, Homo sapien
tgttgctggagcactgtcagtagaa

SEQ ID NO: 70805 - DNA, 25 bp, Homo sapien
gaaatcactgaactactcagtctcc

SEQ ID NO: 70806 - DNA, 25 bp, Homo sapien
actactcagtctccataaattatgc

SEQ ID NO: 70807 - DNA, 25 bp, Homo sapien
ataaattatgctgtggccgtagctg

SEQ ID NO: 70808 - DNA, 25 bp, Homo sapien
atatgtgaccaatatactgggaaag

SEQ ID NO: 70809 - DNA, 25 bp, Homo sapien
ggtcatgctgttacaggtgtagttt

SEQ ID NO: 70810 - DNA, 25 bp, Homo sapien
ttacaggtgtagtttgtgtgcataa

SEQ ID NO: 70811 - DNA, 25 bp, Homo sapien
gtgtgcataaataatacttccgaat

SEQ ID NO: 70812 - DNA, 25 bp, Homo sapien
ttttcctttgttcatatgcatattc

SEQ ID NO: 70813 - DNA, 25 bp, Homo sapien
gcatattcatgattataatttggct

SEQ ID NO: 70814 - DNA, 25 bp, Homo sapien
attataatttggctttgtttgtgat

SEQ ID NO: 70815 - DNA, 25 bp, Homo sapien
ttggctttgtttgtgattaatgttt

SEQ ID NO: 70816 - DNA, 25 bp, Homo sapien
ttttcttaagattttcacattatag

SEQ ID NO: 70817 - DNA, 25 bp, Homo sapien
ttcacattatagaatacctcaaaag

SEQ ID NO: 70818 - DNA, 25 bp, Homo sapien
aagaagttgtctaaggactgggata

SEQ ID NO: 70819 - DNA, 25 bp, Homo sapien
actgggatagagagtatgtttcata

SEQ ID NO: 70820 - DNA, 25 bp, Homo sapien
agataggagcaacactttaaattat

SEQ ID NO: 70821 - DNA, 25 bp, Homo sapien
aattatttgtgggagaatacagcat

SEQ ID NO: 70822 - DNA, 25 bp, Homo sapien
gggagaatacagcattaaaggtgat

SEQ ID NO: 70823 - DNA, 25 bp, Homo sapien
gcagatcagccacatcgcccagcag

SEQ ID NO: 70824 - DNA, 25 bp, Homo sapien
tcagccacatcgcccagcagcttgg

SEQ ID NO: 70825 - DNA, 25 bp, Homo sapien
cagccacatcgcccagcagcttggg

SEQ ID NO: 70826 - DNA, 25 bp, Homo sapien
agccacatcgcccagcagcttgggc

SEQ ID NO: 70827 - DNA, 25 bp, Homo sapien
atgtggtccgagtgtggttctgtaa

SEQ ID NO: 70828 - DNA, 25 bp, Homo sapien
ccaggctatgggagccctcacttca

SEQ ID NO: 70829 - DNA, 25 bp, Homo sapien
caggctatgggagccctcacttcac

SEQ ID NO: 70830 - DNA, 25 bp, Homo sapien
aggctatgggagccctcacttcact

SEQ ID NO: 70831 - DNA, 25 bp, Homo sapien
ggctatgggagccctcacttcactg

SEQ ID NO: 70832 - DNA, 25 bp, Homo sapien
gctatgggagccctcacttcactgc

SEQ ID NO: 70833 - DNA, 25 bp, Homo sapien
ggcgacggtcccctggtggcaggag

SEQ ID NO: 70834 - DNA, 25 bp, Homo sapien
gggctccccctgttgcgggtgaggc

SEQ ID NO: 70835 - DNA, 25 bp, Homo sapien
gggtgaggcggctgctctctatttt

SEQ ID NO: 70836 - DNA, 25 bp, Homo sapien
gtgaggcggctgctctctattttca

SEQ ID NO: 70837 - DNA, 25 bp, Homo sapien
gaggcggctgctctctattttcaga

SEQ ID NO: 70838 - DNA, 25 bp, Homo sapien
aggcggctgctctctattttcagat

SEQ ID NO: 70839 - DNA, 25 bp, Homo sapien
gcggctgctctctattttcagatgt

SEQ ID NO: 70840 - DNA, 25 bp, Homo sapien
ctgctctctattttcagatgttgct

SEQ ID NO: 70841 - DNA, 25 bp, Homo sapien
gctctctattttcagatgttgctgt

SEQ ID NO: 70842 - DNA, 25 bp, Homo sapien
ctctattttcagatgttgctgtaga

SEQ ID NO: 70843 - DNA, 25 bp, Homo sapien
gttgctgtagaaataaagacggttt

SEQ ID NO: 70844 - DNA, 25 bp, Homo sapien
ttttaccctcagtttacttaagctg

SEQ ID NO: 70845 - DNA, 25 bp, Homo sapien
ccctcagtttacttaagctgcagaa

SEQ ID NO: 70846 - DNA, 25 bp, Homo sapien
agaggcttgtggaactattgcagtc

SEQ ID NO: 70847 - DNA, 25 bp, Homo sapien
gtggaactattgcagtctatcaagg

SEQ ID NO: 70848 - DNA, 25 bp, Homo sapien
ttgcagtctatcaaggaccacagaa

SEQ ID NO: 70849 - DNA, 25 bp, Homo sapien
gagcctgatgattattctaactttg

SEQ ID NO: 70850 - DNA, 25 bp, Homo sapien
ttctaactttgtaatcgaggattct

SEQ ID NO: 70851 - DNA, 25 bp, Homo sapien
ggattctgtaacaacctttaagaca

SEQ ID NO: 70852 - DNA, 25 bp, Homo sapien
acaacctttaagacaattcagcaaa

SEQ ID NO: 70853 - DNA, 25 bp, Homo sapien
ccagtagtgcaaaatatgggagcaa

SEQ ID NO: 70854 - DNA, 25 bp, Homo sapien
ccaattgttgggaaagcatcttaga

SEQ ID NO: 70855 - DNA, 25 bp, Homo sapien
gagttctaaactattcattcagcat

SEQ ID NO: 70856 - DNA, 25 bp, Homo sapien
attcagcatgcctataattacataa

SEQ ID NO: 70857 - DNA, 25 bp, Homo sapien
gtatgagactttttgttgcaaagga

SEQ ID NO: 70858 - DNA, 25 bp, Homo sapien
gttgcaaaggacacatttatcatat

SEQ ID NO: 70859 - DNA, 25 bp, Homo sapien
tttatcatattcattcacacatatt

SEQ ID NO: 70860 - DNA, 25 bp, Homo sapien
atattatatgtgatagctgtccaac

SEQ ID NO: 70861 - DNA, 25 bp, Homo sapien
atgtgatagctgtccaacatcctgt

SEQ ID NO: 70862 - DNA, 25 bp, Homo sapien
tgatagctgtccaacatcctgtctg

SEQ ID NO: 70863 - DNA, 25 bp, Homo sapien
gctgtccaacatcctgtctgggaag

SEQ ID NO: 70864 - DNA, 25 bp, Homo sapien
agacgtattcaaacatattctgaac

SEQ ID NO: 70865 - DNA, 25 bp, Homo sapien
atattctgaacattgatgtttgaac

SEQ ID NO: 70866 - DNA, 25 bp, Homo sapien
ttgatgccggcactgtgaattacga

SEQ ID NO: 70867 - DNA, 25 bp, Homo sapien
tgaattacgagcaacccaccaaaga

SEQ ID NO: 70868 - DNA, 25 bp, Homo sapien
gatggcattgaccacagtaacattg

SEQ ID NO: 70869 - DNA, 25 bp, Homo sapien
aagtgtcaaggcattacggctccca

SEQ ID NO: 70870 - DNA, 25 bp, Homo sapien
attacggctcccattgaggctcaag

SEQ ID NO: 70871 - DNA, 25 bp, Homo sapien
tgaggctcaagttcggctaaaggga

SEQ ID NO: 70872 - DNA, 25 bp, Homo sapien
gagccaaaggcagcgcatatggttt

SEQ ID NO: 70873 - DNA, 25 bp, Homo sapien
gcatatggtttgtcgggcgccgatt

SEQ ID NO: 70874 - DNA, 25 bp, Homo sapien
ggcgccgattcctacaaagatgctg

SEQ ID NO: 70875 - DNA, 25 bp, Homo sapien
agatgctgtccggaaagccatgttt

SEQ ID NO: 70876 - DNA, 25 bp, Homo sapien
cggaaagccatgtttgcccggttca

SEQ ID NO: 70877 - DNA, 25 bp, Homo sapien
tgacttagttgcgttacaccctttc

SEQ ID NO: 70878 - DNA, 25 bp, Homo sapien
gacttagttgcgttacaccctttct

SEQ ID NO: 70879 - DNA, 25 bp, Homo sapien
cttagttgcgttacaccctttcttg

SEQ ID NO: 70880 - DNA, 25 bp, Homo sapien
ttagttgcgttacaccctttcttga

SEQ ID NO: 70881 - DNA, 25 bp, Homo sapien
tagttgcgttacaccctttcttgac

SEQ ID NO: 70882 - DNA, 25 bp, Homo sapien
agttgcgttacaccctttcttgaca

SEQ ID NO: 70883 - DNA, 25 bp, Homo sapien
gttgcgttacaccctttcttgacaa

SEQ ID NO: 70884 - DNA, 25 bp, Homo sapien
ttgcgttacaccctttcttgacaaa

SEQ ID NO: 70885 - DNA, 25 bp, Homo sapien
tgcgttacaccctttcttgacaaaa

SEQ ID NO: 70886 - DNA, 25 bp, Homo sapien
aaggacatggacaaggtcgagacat

SEQ ID NO: 70887 - DNA, 25 bp, Homo sapien
aggacatggacaaggtcgagacatt

SEQ ID NO: 70888 - DNA, 25 bp, Homo sapien
ggacatggacaaggtcgagacattc

SEQ ID NO: 70889 - DNA, 25 bp, Homo sapien
gacatggacaaggtcgagacattcc

SEQ ID NO: 70890 - DNA, 25 bp, Homo sapien
acatggacaaggtcgagacattcct

SEQ ID NO: 70891 - DNA, 25 bp, Homo sapien
catggacaaggtcgagacattcctg

SEQ ID NO: 70892 - DNA, 25 bp, Homo sapien
atggacaaggtcgagacattcctgc

SEQ ID NO: 70893 - DNA, 25 bp, Homo sapien
tggacaaggtcgagacattcctgcg

SEQ ID NO: 70894 - DNA, 25 bp, Homo sapien
ggacaaggtcgagacattcctgcgc

SEQ ID NO: 70895 - DNA, 25 bp, Homo sapien
gacaaggtcgagacattcctgcgca

SEQ ID NO: 70896 - DNA, 25 bp, Homo sapien
acaaggtcgagacattcctgcgcat

SEQ ID NO: 70897 - DNA, 25 bp, Homo sapien
tctgcagccagcctatggcaattat

SEQ ID NO: 70898 - DNA, 25 bp, Homo sapien
ttaagaggtgttcccaggacttttg

SEQ ID NO: 70899 - DNA, 25 bp, Homo sapien
ttttgggacctactaaaacaatgat

SEQ ID NO: 70900 - DNA, 25 bp, Homo sapien
gagatatttctggaccactcaagct

SEQ ID NO: 70901 - DNA, 25 bp, Homo sapien
tctggaccactcaagctcttcgata

SEQ ID NO: 70902 - DNA, 25 bp, Homo sapien
aagctcttcgataccaaaatcagga

SEQ ID NO: 70903 - DNA, 25 bp, Homo sapien
aatcaggagcatcttgggatttatt

SEQ ID NO: 70904 - DNA, 25 bp, Homo sapien
gaagatagcacagatatcgggatat

SEQ ID NO: 70905 - DNA, 25 bp, Homo sapien
aaatgctgcttttactttgatgtga

SEQ ID NO: 70906 - DNA, 25 bp, Homo sapien
ttgatgtgatctcattgatgtacac

SEQ ID NO: 70907 - DNA, 25 bp, Homo sapien
gatgtacacaaccaagttccaataa

SEQ ID NO: 70908 - DNA, 25 bp, Homo sapien
gatgtctctgcaaaccaacaggcta

SEQ ID NO: 70909 - DNA, 25 bp, Homo sapien
tgcaaaccaacaggctaccaacttg

SEQ ID NO: 70910 - DNA, 25 bp, Homo sapien
cctgggaatggattaggtttcagca

SEQ ID NO: 70911 - DNA, 25 bp, Homo sapien
agagtcctggagctggctctataag

SEQ ID NO: 70912 - DNA, 25 bp, Homo sapien
gagctggctctataaggcagccttg

SEQ ID NO: 70913 - DNA, 25 bp, Homo sapien
ggcagccttgagttgcatagagatt

SEQ ID NO: 70914 - DNA, 25 bp, Homo sapien
tgtattggttcagggaactctggca

SEQ ID NO: 70915 - DNA, 25 bp, Homo sapien
atgtcttctcacaagccagccaact

SEQ ID NO: 70916 - DNA, 25 bp, Homo sapien
tctctctgggcttcgggctatgcaa

SEQ ID NO: 70917 - DNA, 25 bp, Homo sapien
gcttcgggctatgcaagagcgttgt

SEQ ID NO: 70918 - DNA, 25 bp, Homo sapien
atgcaagagcgttgtctaccttctt

SEQ ID NO: 70919 - DNA, 25 bp, Homo sapien
ctagtggcaatggctccagaggctg

SEQ ID NO: 70920 - DNA, 25 bp, Homo sapien
tagtggcaatggctccagaggctgg

SEQ ID NO: 70921 - DNA, 25 bp, Homo sapien
agtggcaatggctccagaggctgga

SEQ ID NO: 70922 - DNA, 25 bp, Homo sapien
tggcaatggctccagaggctggaag

SEQ ID NO: 70923 - DNA, 25 bp, Homo sapien
ggcaatggctccagaggctggaaga

SEQ ID NO: 70924 - DNA, 25 bp, Homo sapien
gcaatggctccagaggctggaagac

SEQ ID NO: 70925 - DNA, 25 bp, Homo sapien
caatggctccagaggctggaagacg

SEQ ID NO: 70926 - DNA, 25 bp, Homo sapien
aatggctccagaggctggaagacgg

SEQ ID NO: 70927 - DNA, 25 bp, Homo sapien
gtgcccgagtagcatcctgtgaccc

SEQ ID NO: 70928 - DNA, 25 bp, Homo sapien
tgcccgagtagcatcctgtgacccc

SEQ ID NO: 70929 - DNA, 25 bp, Homo sapien
gcccgagtagcatcctgtgacccct

SEQ ID NO: 70930 - DNA, 25 bp, Homo sapien
gggaatgacctgagagccacactca

SEQ ID NO: 70931 - DNA, 25 bp, Homo sapien
ggaatgacctgagagccacactcag

SEQ ID NO: 70932 - DNA, 25 bp, Homo sapien
gaatgacctgagagccacactcagc

SEQ ID NO: 70933 - DNA, 25 bp, Homo sapien
aatgacctgagagccacactcagct

SEQ ID NO: 70934 - DNA, 25 bp, Homo sapien
atgacctgagagccacactcagctc

SEQ ID NO: 70935 - DNA, 25 bp, Homo sapien
tgagagccacactcagctcctcaag

SEQ ID NO: 70936 - DNA, 25 bp, Homo sapien
gagagccacactcagctcctcaagg

SEQ ID NO: 70937 - DNA, 25 bp, Homo sapien
agagccacactcagctcctcaaggg

SEQ ID NO: 70938 - DNA, 25 bp, Homo sapien
agccacactcagctcctcaagggca

SEQ ID NO: 70939 - DNA, 25 bp, Homo sapien
ctcctcaagggcagcccagcttggg

SEQ ID NO: 70940 - DNA, 25 bp, Homo sapien
aagggcagcccagcttggggctcac

SEQ ID NO: 70941 - DNA, 25 bp, Homo sapien
tggaccacacaaaggcaaggagctg

SEQ ID NO: 70942 - DNA, 25 bp, Homo sapien
tgaccaggaggtgtcagttccctga

SEQ ID NO: 70943 - DNA, 25 bp, Homo sapien
gtcagttccctgagagacagggcca

SEQ ID NO: 70944 - DNA, 25 bp, Homo sapien
gacagggccaaaggcagtgtaccct

SEQ ID NO: 70945 - DNA, 25 bp, Homo sapien
aaaggcagtgtacccttgagtctca

SEQ ID NO: 70946 - DNA, 25 bp, Homo sapien
gtgtacccttgagtctcactaccgg

SEQ ID NO: 70947 - DNA, 25 bp, Homo sapien
taccggccattctacgtcaacaaag

SEQ ID NO: 70948 - DNA, 25 bp, Homo sapien
tcaacaaaggcaacgggattgggtc

SEQ ID NO: 70949 - DNA, 25 bp, Homo sapien
ggattgggtccaacgaagccccatg

SEQ ID NO: 70950 - DNA, 25 bp, Homo sapien
aagccccatgagctcctggcggaag

SEQ ID NO: 70951 - DNA, 25 bp, Homo sapien
gagacaaaaccaggagcagcacagt

SEQ ID NO: 70952 - DNA, 25 bp, Homo sapien
gagagaattcttcttaagatccaag

SEQ ID NO: 70953 - DNA, 25 bp, Homo sapien
aagttgtttgcaggcttgcaacctc

SEQ ID NO: 70954 - DNA, 25 bp, Homo sapien
gcttgcaacctctcacaaattttaa

SEQ ID NO: 70955 - DNA, 25 bp, Homo sapien
ggctagctcttcaactatgtctttg

SEQ ID NO: 70956 - DNA, 25 bp, Homo sapien
aaaagaatatgtctgcccacagcag

SEQ ID NO: 70957 - DNA, 25 bp, Homo sapien
agcagccagaagtgacagcattctt

SEQ ID NO: 70958 - DNA, 25 bp, Homo sapien
gaatgtttacatcctgctgctgata

SEQ ID NO: 70959 - DNA, 25 bp, Homo sapien
acatcctgctgctgataggttcaag

SEQ ID NO: 70960 - DNA, 25 bp, Homo sapien
aaccagattctgctgacatgagaag

SEQ ID NO: 70961 - DNA, 25 bp, Homo sapien
gacatgagaagctccagtgatttgt

SEQ ID NO: 70962 - DNA, 25 bp, Homo sapien
ggtctgtatcagagcaagcctaaca

SEQ ID NO: 70963 - DNA, 25 bp, Homo sapien
caacactaccaaatcccggatgact

SEQ ID NO: 70964 - DNA, 25 bp, Homo sapien
aatcccggatgactttgtggccgat

SEQ ID NO: 70965 - DNA, 25 bp, Homo sapien
gccgatgtccgtttgatcttcaaga

SEQ ID NO: 70966 - DNA, 25 bp, Homo sapien
gattcagaagtagctcaggcaggga

SEQ ID NO: 70967 - DNA, 25 bp, Homo sapien
gctcaggcagggaaagcagttgcat

SEQ ID NO: 70968 - DNA, 25 bp, Homo sapien
gcagttgcattgtactttgaagata

SEQ ID NO: 70969 - DNA, 25 bp, Homo sapien
gataaactcacagagatctactcag

SEQ ID NO: 70970 - DNA, 25 bp, Homo sapien
gatctactcagacaggaccttcgca

SEQ ID NO: 70971 - DNA, 25 bp, Homo sapien
cttcgcacctttgccagagtttgag

SEQ ID NO: 70972 - DNA, 25 bp, Homo sapien
gtgaggtaactgaggactctgatga

SEQ ID NO: 70973 - DNA, 25 bp, Homo sapien
gcagaaaacgcctaaagtcagatga

SEQ ID NO: 70974 - DNA, 25 bp, Homo sapien
taccggccattctacgtcaacaaag

SEQ ID NO: 70975 - DNA, 25 bp, Homo sapien
attctacgtcaacaaaggcaacggg

SEQ ID NO: 70976 - DNA, 25 bp, Homo sapien
tcaacaaaggcaacgggattgggtc

SEQ ID NO: 70977 - DNA, 25 bp, Homo sapien
gggattgggtccaacgaagccccat

SEQ ID NO: 70978 - DNA, 25 bp, Homo sapien
attgggtccaacgaagccccatgag

SEQ ID NO: 70979 - DNA, 25 bp, Homo sapien
aagccccatgagctcctggcggaag

SEQ ID NO: 70980 - DNA, 25 bp, Homo sapien
tgctcaaggattggagaggagacaa

SEQ ID NO: 70981 - DNA, 25 bp, Homo sapien
gagacaaaaccaggagcagcacagt

SEQ ID NO: 70982 - DNA, 25 bp, Homo sapien
acaaaaccaggagcagcacagtggg

SEQ ID NO: 70983 - DNA, 25 bp, Homo sapien
agtggggacatctcccgtctcaaca

SEQ ID NO: 70984 - DNA, 25 bp, Homo sapien
gggagggagacatccagcttgggct

SEQ ID NO: 70985 - DNA, 25 bp, Homo sapien
gctaccgtgagatccaagttgaaat

SEQ ID NO: 70986 - DNA, 25 bp, Homo sapien
aattcagaagcctactttgatggta

SEQ ID NO: 70987 - DNA, 25 bp, Homo sapien
gatggtaggtttgaatgacgtgtcc

SEQ ID NO: 70988 - DNA, 25 bp, Homo sapien
ttgaatgacgtgtcctacagcctca

SEQ ID NO: 70989 - DNA, 25 bp, Homo sapien
acgtgtcctacagcctcagaggcag

SEQ ID NO: 70990 - DNA, 25 bp, Homo sapien
gcagcaggaggctagcaaagcttta

SEQ ID NO: 70991 - DNA, 25 bp, Homo sapien
ggaggctagcaaagctttaaatgcc

SEQ ID NO: 70992 - DNA, 25 bp, Homo sapien
agggctgtaggaagattccctcttc

SEQ ID NO: 70993 - DNA, 25 bp, Homo sapien
caccttccagtgagctctggatgaa

SEQ ID NO: 70994 - DNA, 25 bp, Homo sapien
tctggatgaagctctggccaaccaa

SEQ ID NO: 70995 - DNA, 25 bp, Homo sapien
agctctggccaaccaaagacactgt

SEQ ID NO: 70996 - DNA, 25 bp, Homo sapien
aactccgctccccaagaatcagtta

SEQ ID NO: 70997 - DNA, 25 bp, Homo sapien
tttttaatcgtaacacctccatttg

SEQ ID NO: 70998 - DNA, 25 bp, Homo sapien
aacacctccatttgtattacatatg

SEQ ID NO: 70999 - DNA, 25 bp, Homo sapien
ggtattgatgaggtcatggtatcat

SEQ ID NO: 71000 - DNA, 25 bp, Homo sapien
gaggtcatggtatcatatatgggat

SEQ ID NO: 71001 - DNA, 25 bp, Homo sapien
aagaaactatgggactctgagcctt

SEQ ID NO: 71002 - DNA, 25 bp, Homo sapien
aactatgggactctgagccttgctt

SEQ ID NO: 71003 - DNA, 25 bp, Homo sapien
gtggacaaataggtgtcatcaaacc

SEQ ID NO: 71004 - DNA, 25 bp, Homo sapien
aaccagtttttaatcattctgactc

SEQ ID NO: 71005 - DNA, 25 bp, Homo sapien
attctgactcaagtgaaaacgctca

SEQ ID NO: 71006 - DNA, 25 bp, Homo sapien
aaacgctcagaatttcacactgtga

SEQ ID NO: 71007 - DNA, 25 bp, Homo sapien
atgttttttgaaccagctataaaag

SEQ ID NO: 71008 - DNA, 25 bp, Homo sapien
cactggctgtcccatatggtatcca

SEQ ID NO: 71009 - DNA, 25 bp, Homo sapien
ggctgtcccatatggtatccaggag

SEQ ID NO: 71010 - DNA, 25 bp, Homo sapien
gtatccaggagccaccaatgtctgt

SEQ ID NO: 71011 - DNA, 25 bp, Homo sapien
gagccaccaatgtctgttgagtact

SEQ ID NO: 71012 - DNA, 25 bp, Homo sapien
gttgagtacttcatacatgcctagt

SEQ ID NO: 71013 - DNA, 25 bp, Homo sapien
agtacttcatacatgcctagtctga

SEQ ID NO: 71014 - DNA, 25 bp, Homo sapien
tcatacatgcctagtctgaattgag

SEQ ID NO: 71015 - DNA, 25 bp, Homo sapien
accagatttcaaatacctacttcaa

SEQ ID NO: 71016 - DNA, 25 bp, Homo sapien
ataacttttcctttgtgtattgcaa

SEQ ID NO: 71017 - DNA, 25 bp, Homo sapien
gcaatgataatatgttggctctatt

SEQ ID NO: 71018 - DNA, 25 bp, Homo sapien
tggaccaaaatctgcaaaccagtgc

SEQ ID NO: 71019 - DNA, 25 bp, Homo sapien
gggaagtctgtaccaaacaacgcaa

SEQ ID NO: 71020 - DNA, 25 bp, Homo sapien
aacgcaagaagggttctcatgggct

SEQ ID NO: 71021 - DNA, 25 bp, Homo sapien
ttgcgactgtgcgaagggcctgtct

SEQ ID NO: 71022 - DNA, 25 bp, Homo sapien
gcgaagggcctgtcttgcaaagtat

SEQ ID NO: 71023 - DNA, 25 bp, Homo sapien
agggcctgtcttgcaaagtatggaa

SEQ ID NO: 71024 - DNA, 25 bp, Homo sapien
gtatggaaagatgccacctactcct

SEQ ID NO: 71025 - DNA, 25 bp, Homo sapien
aagccagactccatgtgtgtcagaa

SEQ ID NO: 71026 - DNA, 25 bp, Homo sapien
gaaaatttgatcaccattgaggaac

SEQ ID NO: 71027 - DNA, 25 bp, Homo sapien
gaggaacatcatcaattgcagactg

SEQ ID NO: 71028 - DNA, 25 bp, Homo sapien
aattgcagactgtgaagttgtgtat

SEQ ID NO: 71029 - DNA, 25 bp, Homo sapien
aagaccactgggacgaagtcaagga

SEQ ID NO: 71030 - DNA, 25 bp, Homo sapien
agtgccttggccactatgcgggtag

SEQ ID NO: 71031 - DNA, 25 bp, Homo sapien
cttggccactatgcgggtagactac

SEQ ID NO: 71032 - DNA, 25 bp, Homo sapien
atgcgggtagactacgaccaggtga

SEQ ID NO: 71033 - DNA, 25 bp, Homo sapien
ctacgaccaggtgaagatcaaggac

SEQ ID NO: 71034 - DNA, 25 bp, Homo sapien
ggacctgaagacctctaacaaccgg

SEQ ID NO: 71035 - DNA, 25 bp, Homo sapien
taacaaccggctcctcaacaagagg

SEQ ID NO: 71036 - DNA, 25 bp, Homo sapien
gcctcacagggctgcaacaaccagt

SEQ ID NO: 71037 - DNA, 25 bp, Homo sapien
gggctgcaacaaccagtagctcatg

SEQ ID NO: 71038 - DNA, 25 bp, Homo sapien
acagactgaaatgtgctcaggccct

SEQ ID NO: 71039 - DNA, 25 bp, Homo sapien
aggaggacaaagaccactgggacga

SEQ ID NO: 71040 - DNA, 25 bp, Homo sapien
atgacattgcagtaaagagcttaaa

SEQ ID NO: 71041 - DNA, 25 bp, Homo sapien
gagcttaaatagtttcatctttggt

SEQ ID NO: 71042 - DNA, 25 bp, Homo sapien
tttcttttatcccagtcatctctga

SEQ ID NO: 71043 - DNA, 25 bp, Homo sapien
attgagctatccatacaacctgtat

SEQ ID NO: 71044 - DNA, 25 bp, Homo sapien
ttaatttcactatgctttcagctta

SEQ ID NO: 71045 - DNA, 25 bp, Homo sapien
gaaaacgttaatgggtcttgaagat

SEQ ID NO: 71046 - DNA, 25 bp, Homo sapien
aagatttttggcatccactgataga

SEQ ID NO: 71047 - DNA, 25 bp, Homo sapien
ccactgatagattttaggactgaga

SEQ ID NO: 71048 - DNA, 25 bp, Homo sapien
gacttgagattgtacatttcttact

SEQ ID NO: 71049 - DNA, 25 bp, Homo sapien
atttcttactactcttctactgtct

SEQ ID NO: 71050 - DNA, 25 bp, Homo sapien
actactcttctactgtctgagatca

SEQ ID NO: 71051 - DNA, 25 bp, Homo sapien
gaattattaattggccatgttcatt

SEQ ID NO: 71052 - DNA, 25 bp, Homo sapien
ggccatgttcattatttatctatgt

SEQ ID NO: 71053 - DNA, 25 bp, Homo sapien
attaatgggccaatgcaaaaaatca

SEQ ID NO: 71054 - DNA, 25 bp, Homo sapien
gaaaaatttgtccatgtaaagctta

SEQ ID NO: 71055 - DNA, 25 bp, Homo sapien
tgctgctttgtataactcttctatg

SEQ ID NO: 71056 - DNA, 25 bp, Homo sapien
gtataactcttctatgtttattcta

SEQ ID NO: 71057 - DNA, 25 bp, Homo sapien
attctattcatttgttcctttccct

SEQ ID NO: 71058 - DNA, 25 bp, Homo sapien
ttccctaccatattttacacatgta

SEQ ID NO: 71059 - DNA, 25 bp, Homo sapien
atttattacatttctgcttttttct

SEQ ID NO: 71060 - DNA, 25 bp, Homo sapien
aatttatcactgctgaattgcatca

SEQ ID NO: 71061 - DNA, 25 bp, Homo sapien
cagatcatggatgcatttttattat

SEQ ID NO: 71062 - DNA, 25 bp, Homo sapien
aggagtatgatgagtcaggcccctc

SEQ ID NO: 71063 - DNA, 25 bp, Homo sapien
atgcttctaggtggactctgactta

SEQ ID NO: 71064 - DNA, 25 bp, Homo sapien
tctgacttagttgcgttacaccctt

SEQ ID NO: 71065 - DNA, 25 bp, Homo sapien
ttcttgacaaaaccaaacttctcag

SEQ ID NO: 71066 - DNA, 25 bp, Homo sapien
tcaggatttgaaaaccggaacggcg

SEQ ID NO: 71067 - DNA, 25 bp, Homo sapien
cggaacggcgaaggtgatagtagtc

SEQ ID NO: 71068 - DNA, 25 bp, Homo sapien
gagcttcccccaaagttctacaatg

SEQ ID NO: 71069 - DNA, 25 bp, Homo sapien
ccccaaagttctacaatgtggccaa

SEQ ID NO: 71070 - DNA, 25 bp, Homo sapien
caaagttctacaatgtggccaagga

SEQ ID NO: 71071 - DNA, 25 bp, Homo sapien
aagttctacaatgtggccaaggact

SEQ ID NO: 71072 - DNA, 25 bp, Homo sapien
gttctacaatgtggccaaggacttt

SEQ ID NO: 71073 - DNA, 25 bp, Homo sapien
tagtggcaatggctgcagaggctgg

SEQ ID NO: 71074 - DNA, 25 bp, Homo sapien
agtggcaatggctgcagaggctgga

SEQ ID NO: 71075 - DNA, 25 bp, Homo sapien
gtggcaatggctgcagaggctggaa

SEQ ID NO: 71076 - DNA, 25 bp, Homo sapien
tggcaatggctgcagaggctggaag

SEQ ID NO: 71077 - DNA, 25 bp, Homo sapien
caatggctgcagaggctggaagacg

SEQ ID NO: 71078 - DNA, 25 bp, Homo sapien
tgcccgcgtggcatcctgtgaccga

SEQ ID NO: 71079 - DNA, 25 bp, Homo sapien
gcccgcgtggcatcctgtgaccgac

SEQ ID NO: 71080 - DNA, 25 bp, Homo sapien
cccgcgtggcatcctgtgaccgacc

SEQ ID NO: 71081 - DNA, 25 bp, Homo sapien
ccgcgtggcatcctgtgaccgaccc

SEQ ID NO: 71082 - DNA, 25 bp, Homo sapien
cgcgtggcatcctgtgaccgacccc

SEQ ID NO: 71083 - DNA, 25 bp, Homo sapien
gcgtggcatcctgtgaccgacccct

SEQ ID NO: 71084 - DNA, 25 bp, Homo sapien
gggctctgctttgcgtctaaccttt

SEQ ID NO: 71085 - DNA, 25 bp, Homo sapien
ctctgctttgcgtctaacctttgtg

SEQ ID NO: 71086 - DNA, 25 bp, Homo sapien
ctgctttgcgtctaacctttgtggg

SEQ ID NO: 71087 - DNA, 25 bp, Homo sapien
acctgtccccacagtcaaagcctgg

SEQ ID NO: 71088 - DNA, 25 bp, Homo sapien
cagacatcctgtccccacagtcagc

SEQ ID NO: 71089 - DNA, 25 bp, Homo sapien
acctaccctgtgctttttgccgtcg

SEQ ID NO: 71090 - DNA, 25 bp, Homo sapien
taccctgtgctttttgccgtcgggc

SEQ ID NO: 71091 - DNA, 25 bp, Homo sapien
tgctttttgccgtcgggcctctgca

SEQ ID NO: 71092 - DNA, 25 bp, Homo sapien
tctgcacctgggtccatggggtctg

SEQ ID NO: 71093 - DNA, 25 bp, Homo sapien
gtctgcctggcctgtgggttctgcc

SEQ ID NO: 71094 - DNA, 25 bp, Homo sapien
ctggcctgtgggttctgccggtggg

SEQ ID NO: 71095 - DNA, 25 bp, Homo sapien
aaggacatggacaaggtcgagacat

SEQ ID NO: 71096 - DNA, 25 bp, Homo sapien
aggacatggacaaggtcgagacatt

SEQ ID NO: 71097 - DNA, 25 bp, Homo sapien
ggacatggacaaggtcgagacattc

SEQ ID NO: 71098 - DNA, 25 bp, Homo sapien
gacatggacaaggtcgagacattcc

SEQ ID NO: 71099 - DNA, 25 bp, Homo sapien
acatggacaaggtcgagacattcct

SEQ ID NO: 71100 - DNA, 25 bp, Homo sapien
catggacaaggtcgagacattcctg

SEQ ID NO: 71101 - DNA, 25 bp, Homo sapien
atggacaaggtcgagacattcctgc

SEQ ID NO: 71102 - DNA, 25 bp, Homo sapien
tggacaaggtcgagacattcctgcg

SEQ ID NO: 71103 - DNA, 25 bp, Homo sapien
ggacaaggtcgagacattcctgcgc

SEQ ID NO: 71104 - DNA, 25 bp, Homo sapien
gacaaggtcgagacattcctgcgca

SEQ ID NO: 71105 - DNA, 25 bp, Homo sapien
acaaggtcgagacattcctgcgcat

SEQ ID NO: 71106 - DNA, 25 bp, Homo sapien
tcaggcgaggccgtgtgtctcaacg

SEQ ID NO: 71107 - DNA, 25 bp, Homo sapien
tgtgtctcaacggagcgggcggcgg

SEQ ID NO: 71108 - DNA, 25 bp, Homo sapien
gagggcgaggtcttcgccatacagc

SEQ ID NO: 71109 - DNA, 25 bp, Homo sapien
gaggtcttcgccatacagctgacat

SEQ ID NO: 71110 - DNA, 25 bp, Homo sapien
gtcttcgccatacagctgacatcgg

SEQ ID NO: 71111 - DNA, 25 bp, Homo sapien
gccatacagctgacatcggcgtgag

SEQ ID NO: 71112 - DNA, 25 bp, Homo sapien
atacagctgacatcggcgtgagccg

SEQ ID NO: 71113 - DNA, 25 bp, Homo sapien
cacacgggggcttatttattgcttt

SEQ ID NO: 71114 - DNA, 25 bp, Homo sapien
atttatgtattcaactccaagggcg

SEQ ID NO: 71115 - DNA, 25 bp, Homo sapien
atgtattcaactccaagggcgtcac

SEQ ID NO: 71116 - DNA, 25 bp, Homo sapien
gtattcaactccaagggcgtcaccc

SEQ ID NO: 71117 - DNA, 25 bp, Homo sapien
ttgagcaatggtaaacctcgagaca

SEQ ID NO: 71118 - DNA, 25 bp, Homo sapien
caatggtaaacctcgagacaacaaa

SEQ ID NO: 71119 - DNA, 25 bp, Homo sapien
ggtaaacctcgagacaacaaacaag

SEQ ID NO: 71120 - DNA, 25 bp, Homo sapien
aaacctcgagacaacaaacaagcag

SEQ ID NO: 71121 - DNA, 25 bp, Homo sapien
agcaggggtgtttgaaccaaccata

SEQ ID NO: 71122 - DNA, 25 bp, Homo sapien
agctgcaatcaccattcttcgaatt

SEQ ID NO: 71123 - DNA, 25 bp, Homo sapien
gctgcaatcaccattcttcgaattg

SEQ ID NO: 71124 - DNA, 25 bp, Homo sapien
gcaatcaccattcttcgaattgatg

SEQ ID NO: 71125 - DNA, 25 bp, Homo sapien
atcaccattcttcgaattgatgatc

SEQ ID NO: 71126 - DNA, 25 bp, Homo sapien
ccattcttcgaattgatgatcttat

SEQ ID NO: 71127 - DNA, 25 bp, Homo sapien
atgatcttattaaattacatccaga

SEQ ID NO: 71128 - DNA, 25 bp, Homo sapien
tccaccagtgtatcagcattaacat

SEQ ID NO: 71129 - DNA, 25 bp, Homo sapien
ggcagataaattgaacatgactcca

SEQ ID NO: 71130 - DNA, 25 bp, Homo sapien
gactggatgccaagattgattctaa

SEQ ID NO: 71131 - DNA, 25 bp, Homo sapien
gattctaaattaggtcatgtggtta

SEQ ID NO: 71132 - DNA, 25 bp, Homo sapien
gttatgggtaacaatgcagtctcac

SEQ ID NO: 71133 - DNA, 25 bp, Homo sapien
gcagtctcaccctatcagcaagtga

SEQ ID NO: 71134 - DNA, 25 bp, Homo sapien
aagcctttcctttagaagccagatg

SEQ ID NO: 71135 - DNA, 25 bp, Homo sapien
cagatgttggccatgaatattgaga

SEQ ID NO: 71136 - DNA, 25 bp, Homo sapien
gaatagcaggtcagaggctcctaac

SEQ ID NO: 71137 - DNA, 25 bp, Homo sapien
aggctcctaactgggcaactcaaga

SEQ ID NO: 71138 - DNA, 25 bp, Homo sapien
gcaactcaagattctggcttctact

SEQ ID NO: 71139 - DNA, 25 bp, Homo sapien
agattcattgatgcagtttggaaat

SEQ ID NO: 71140 - DNA, 25 bp, Homo sapien
aatggtgaaggtgctgaaccctcag

SEQ ID NO: 71141 - DNA, 25 bp, Homo sapien
tgaaccctcagcaggagggcagttt

SEQ ID NO: 71142 - DNA, 25 bp, Homo sapien
aggagggcagtttgagtccctcacc

SEQ ID NO: 71143 - DNA, 25 bp, Homo sapien
agtccctcacctttgacatggagtt

SEQ ID NO: 71144 - DNA, 25 bp, Homo sapien
tgacatggagttgacctcggagtgc

SEQ ID NO: 71145 - DNA, 25 bp, Homo sapien
aaagatacgactgaggcgcctacct

SEQ ID NO: 71146 - DNA, 25 bp, Homo sapien
gactgaggcgcctacctgcattctg

SEQ ID NO: 71147 - DNA, 25 bp, Homo sapien
gaaactactaactttgtggttccag

SEQ ID NO: 71148 - DNA, 25 bp, Homo sapien
tttttaatctcctacttctgctatc

SEQ ID NO: 71149 - DNA, 25 bp, Homo sapien
tcctacttctgctatctttgagcaa

SEQ ID NO: 71150 - DNA, 25 bp, Homo sapien
tgggccaagccgtccaccaactaag

SEQ ID NO: 71151 - DNA, 25 bp, Homo sapien
accaactaagccagctgccactgtg

SEQ ID NO: 71152 - DNA, 25 bp, Homo sapien
tgccactgtgtactcggtccgggac

SEQ ID NO: 71153 - DNA, 25 bp, Homo sapien
gtccgggacccttggcgacagaaga

SEQ ID NO: 71154 - DNA, 25 bp, Homo sapien
agcgcgggctccaagggcaataaag

SEQ ID NO: 71155 - DNA, 25 bp, Homo sapien
tcccgcatctacctggctaaggaca

SEQ ID NO: 71156 - DNA, 25 bp, Homo sapien
gctaaggacaagaccactggccaat

SEQ ID NO: 71157 - DNA, 25 bp, Homo sapien
actggccaatccaagggctttgcct

SEQ ID NO: 71158 - DNA, 25 bp, Homo sapien
agggctttgccttcatcagcttcca

SEQ ID NO: 71159 - DNA, 25 bp, Homo sapien
gggtgtccggctttggctacgacca

SEQ ID NO: 71160 - DNA, 25 bp, Homo sapien
tcatcctcaacgtcgagtgggccaa

SEQ ID NO: 71161 - DNA, 25 bp, Homo sapien
cctggaggactgtgccaccatgaga

SEQ ID NO: 71162 - DNA, 25 bp, Homo sapien
gactgtgccaccatgagagactctt

SEQ ID NO: 71163 - DNA, 25 bp, Homo sapien
gagagactcttcaaacccaaggcaa

SEQ ID NO: 71164 - DNA, 25 bp, Homo sapien
agactcttcaaacccaaggcaaaat

SEQ ID NO: 71165 - DNA, 25 bp, Homo sapien
gaatgatgtaacctgtttcctcaat

SEQ ID NO: 71166 - DNA, 25 bp, Homo sapien
taacctgtttcctcaattattttcg

SEQ ID NO: 71167 - DNA, 25 bp, Homo sapien
tcctcaattattttcggatttgtga

SEQ ID NO: 71168 - DNA, 25 bp, Homo sapien
tttaagaacagaaggcacaactcaa

SEQ ID NO: 71169 - DNA, 25 bp, Homo sapien
caccgccccacacgagaaatttgtg

SEQ ID NO: 71170 - DNA, 25 bp, Homo sapien
cgagaaatttgtgcgctgaacttca

SEQ ID NO: 71171 - DNA, 25 bp, Homo sapien
gtgcgctgaacttcaaaggacttca

SEQ ID NO: 71172 - DNA, 25 bp, Homo sapien
agcccaaatatgacactggccattt

SEQ ID NO: 71173 - DNA, 25 bp, Homo sapien
cactggccatttttgtaaacgagac

SEQ ID NO: 71174 - DNA, 25 bp, Homo sapien
gtaaacgagaccaccaggccttctt

SEQ ID NO: 71175 - DNA, 25 bp, Homo sapien
gatttgccattagctttttcgtaaa

SEQ ID NO: 71176 - DNA, 25 bp, Homo sapien
ggaagtcatttctttacccaagaat

SEQ ID NO: 71177 - DNA, 25 bp, Homo sapien
tttacccaagaatgacctgctgcag

SEQ ID NO: 71178 - DNA, 25 bp, Homo sapien
gacctgctgcagagacttgatgctc

SEQ ID NO: 71179 - DNA, 25 bp, Homo sapien
gagacttgatgctctggtagctgaa

SEQ ID NO: 71180 - DNA, 25 bp, Homo sapien
aacatctcacagtggacgccagggt

SEQ ID NO: 71181 - DNA, 25 bp, Homo sapien
gccagggtctattcctacgctctag

SEQ ID NO: 71182 - DNA, 25 bp, Homo sapien
gcaaagccatttgaagtgcccttct

SEQ ID NO: 71183 - DNA, 25 bp, Homo sapien
accggtccctggtggagcgaggcct

SEQ ID NO: 71184 - DNA, 25 bp, Homo sapien
cagtgggtagacagctactacacaa

SEQ ID NO: 71185 - DNA, 25 bp, Homo sapien
gacagctactacacaagcctttgac

SEQ ID NO: 71186 - DNA, 25 bp, Homo sapien
ctgcttcctgagagtctttttttgc

SEQ ID NO: 71187 - DNA, 25 bp, Homo sapien
acaaacattgtcctctccagaaagt

SEQ ID NO: 71188 - DNA, 25 bp, Homo sapien
tgtcctctccagaaagtcctttctt

SEQ ID NO: 71189 - DNA, 25 bp, Homo sapien
tccatactgtagtcctattgagaag

SEQ ID NO: 71190 - DNA, 25 bp, Homo sapien
ttgagaagacatttcgtctctgaga

SEQ ID NO: 71191 - DNA, 25 bp, Homo sapien
gaactatgggttctcttcgcaaagc

SEQ ID NO: 71192 - DNA, 25 bp, Homo sapien
ggttctcttcgcaaagccaaaggat

SEQ ID NO: 71193 - DNA, 25 bp, Homo sapien
atagtgtttaacaagccagctggct

SEQ ID NO: 71194 - DNA, 25 bp, Homo sapien
tctttagtgctaacatcccctttag

SEQ ID NO: 71195 - DNA, 25 bp, Homo sapien
gctaacatcccctttagagttcaca

SEQ ID NO: 71196 - DNA, 25 bp, Homo sapien
ttccatgaatgacccctcagtctgg

SEQ ID NO: 71197 - DNA, 25 bp, Homo sapien
tcaaggtccactcaggcacaagagc

SEQ ID NO: 71198 - DNA, 25 bp, Homo sapien
caagagccacagtaccctagatagt

SEQ ID NO: 71199 - DNA, 25 bp, Homo sapien
gacaccgttgtcatccaaggataat

SEQ ID NO: 71200 - DNA, 25 bp, Homo sapien
gaccaactaggctacatctgtgatg

SEQ ID NO: 71201 - DNA, 25 bp, Homo sapien
tagcaaagccgctggtcttctccta

SEQ ID NO: 71202 - DNA, 25 bp, Homo sapien
ggtcttctcctaggactaagtccag

SEQ ID NO: 71203 - DNA, 25 bp, Homo sapien
taggactaagtccaggtgccttcca

SEQ ID NO: 71204 - DNA, 25 bp, Homo sapien
aatctcatggtctttcaggtccctg

SEQ ID NO: 71205 - DNA, 25 bp, Homo sapien
aagttctgggccggttggtccactg

SEQ ID NO: 71206 - DNA, 25 bp, Homo sapien
cggttggtccactgccccatagaga

SEQ ID NO: 71207 - DNA, 25 bp, Homo sapien
tgccccatagagacccaagttctgc

SEQ ID NO: 71208 - DNA, 25 bp, Homo sapien
tagagacccaagttctgcgggaggc

SEQ ID NO: 71209 - DNA, 25 bp, Homo sapien
gtgcctcagggtgcagcgggctggt

SEQ ID NO: 71210 - DNA, 25 bp, Homo sapien
ctggacagttcgccttctccaaggc

SEQ ID NO: 71211 - DNA, 25 bp, Homo sapien
agctaagccagcactgagctgcgtg

SEQ ID NO: 71212 - DNA, 25 bp, Homo sapien
actgagctgcgtggtgcctccagga

SEQ ID NO: 71213 - DNA, 25 bp, Homo sapien
ctgcgtggtgcctccaggaccgctg

SEQ ID NO: 71214 - DNA, 25 bp, Homo sapien
cgttctatccccagccatgataata

SEQ ID NO: 71215 - DNA, 25 bp, Homo sapien
tatccccagccatgataataaagct

SEQ ID NO: 71216 - DNA, 25 bp, Homo sapien
atgtgtaacacattcattgaattat

SEQ ID NO: 71217 - DNA, 25 bp, Homo sapien
attatcactgttttcttgggacaac

SEQ ID NO: 71218 - DNA, 25 bp, Homo sapien
gttttcttgggacaacatcaagcct

SEQ ID NO: 71219 - DNA, 25 bp, Homo sapien
gggacaacatcaagcctaaatactg

SEQ ID NO: 71220 - DNA, 25 bp, Homo sapien
tcagatcagttctatcactggcact

SEQ ID NO: 71221 - DNA, 25 bp, Homo sapien
tcagttctatcactggcactacaga

SEQ ID NO: 71222 - DNA, 25 bp, Homo sapien
tttcttaaggcactttgcattgtag

SEQ ID NO: 71223 - DNA, 25 bp, Homo sapien
ctggatgttcatatctagtgtttga

SEQ ID NO: 71224 - DNA, 25 bp, Homo sapien
gagggatttaaactggtcctgtaca

SEQ ID NO: 71225 - DNA, 25 bp, Homo sapien
aactggtcctgtacatagaaggttt

SEQ ID NO: 71226 - DNA, 25 bp, Homo sapien
acatagaaggtttgtttgacagagg

SEQ ID NO: 71227 - DNA, 25 bp, Homo sapien
tgttcatctgtccttgacagtggct

SEQ ID NO: 71228 - DNA, 25 bp, Homo sapien
gacagtggctgtcatcttgactact

SEQ ID NO: 71229 - DNA, 25 bp, Homo sapien
cttgactactttgttgatttgttgg

SEQ ID NO: 71230 - DNA, 25 bp, Homo sapien
acgtagttttcgcatccttgaatta

SEQ ID NO: 71231 - DNA, 25 bp, Homo sapien
gcatccttgaattaaactgccttaa

SEQ ID NO: 71232 - DNA, 25 bp, Homo sapien
actgccttaactccttttgtggtat

SEQ ID NO: 71233 - DNA, 25 bp, Homo sapien
aagcaaaactccatggactctgtcc

SEQ ID NO: 71234 - DNA, 25 bp, Homo sapien
atggactctgtcctggtatcctttt

SEQ ID NO: 71235 - DNA, 25 bp, Homo sapien
gtatccttttcctgtgtggttgccc

SEQ ID NO: 71236 - DNA, 25 bp, Homo sapien
gtgtgcaagataactactcgtgagt

SEQ ID NO: 71237 - DNA, 25 bp, Homo sapien
gttgttcctaataaatgcacttgtt

SEQ ID NO: 71238 - DNA, 25 bp, Homo sapien
ctgctattgcagaataccagcgtgc

SEQ ID NO: 71239 - DNA, 25 bp, Homo sapien
cagaataccagcgtgcattgcagga

SEQ ID NO: 71240 - DNA, 25 bp, Homo sapien
gtgcattgcaggagaacgtcgctat

SEQ ID NO: 71241 - DNA, 25 bp, Homo sapien
gagaacgtcgctatggaacctgcat

SEQ ID NO: 71242 - DNA, 25 bp, Homo sapien
aacgtcgctatggaacctgcatcta

SEQ ID NO: 71243 - DNA, 25 bp, Homo sapien
tcgctatggaacctgcatctaccag

SEQ ID NO: 71244 - DNA, 25 bp, Homo sapien
ggaacctgcatctaccagggaagac

SEQ ID NO: 71245 - DNA, 25 bp, Homo sapien
taccagggaagactctgggcattct

SEQ ID NO: 71246 - DNA, 25 bp, Homo sapien
gctacagggaattgctattactcct

SEQ ID NO: 71247 - DNA, 25 bp, Homo sapien
gaattgctattactcctgtaccttc

SEQ ID NO: 71248 - DNA, 25 bp, Homo sapien
tgctattactcctgtaccttctgct

SEQ ID NO: 71249 - DNA, 25 bp, Homo sapien
tgagacgggcagacggcacctgcag

SEQ ID NO: 71250 - DNA, 25 bp, Homo sapien
agcctgaaacgcaccgctcctgcgt

SEQ ID NO: 71251 - DNA, 25 bp, Homo sapien
tgcggtcacccctttagttctctgg

SEQ ID NO: 71252 - DNA, 25 bp, Homo sapien
ggtcacccctttagttctctgggtg

SEQ ID NO: 71253 - DNA, 25 bp, Homo sapien
tcacccctttagttctctgggtgta

SEQ ID NO: 71254 - DNA, 25 bp, Homo sapien
cacccctttagttctctgggtgtag

SEQ ID NO: 71255 - DNA, 25 bp, Homo sapien
ttagttctctgggtgtagaccacac

SEQ ID NO: 71256 - DNA, 25 bp, Homo sapien
agttctctgggtgtagaccacacca

SEQ ID NO: 71257 - DNA, 25 bp, Homo sapien
gttctctgggtgtagaccacaccac

SEQ ID NO: 71258 - DNA, 25 bp, Homo sapien
ttctctgggtgtagaccacaccacc

SEQ ID NO: 71259 - DNA, 25 bp, Homo sapien
cacccagcgcctggctccaggaaaa

SEQ ID NO: 71260 - DNA, 25 bp, Homo sapien
tgagacgggcagacggcacctgcag

SEQ ID NO: 71261 - DNA, 25 bp, Homo sapien
agcctgaaacgcaccgctcctgcgt

SEQ ID NO: 71262 - DNA, 25 bp, Homo sapien
tggacagaggccacactgactgccc

SEQ ID NO: 71263 - DNA, 25 bp, Homo sapien
gactgcccacccagctgtggcggga

SEQ ID NO: 71264 - DNA, 25 bp, Homo sapien
tgcggtcacccctttagttctctgg

SEQ ID NO: 71265 - DNA, 25 bp, Homo sapien
tcacccctttagttctctgggtgta

SEQ ID NO: 71266 - DNA, 25 bp, Homo sapien
ttagttctctgggtgtagaccacac

SEQ ID NO: 71267 - DNA, 25 bp, Homo sapien
agttctctgggtgtagaccacacca

SEQ ID NO: 71268 - DNA, 25 bp, Homo sapien
ttctctgggtgtagaccacaccacc

SEQ ID NO: 71269 - DNA, 25 bp, Homo sapien
cacccagcgcctggctccaggaaaa

SEQ ID NO: 71270 - DNA, 25 bp, Homo sapien
ggctccaggaaaacacgcttgcctt

SEQ ID NO: 71271 - DNA, 25 bp, Homo sapien
ttttcagggtttacaaaagagtatg

SEQ ID NO: 71272 - DNA, 25 bp, Homo sapien
tgattggtagtaagagacacacaga

SEQ ID NO: 71273 - DNA, 25 bp, Homo sapien
gtagtaagagacacacagaatgttt

SEQ ID NO: 71274 - DNA, 25 bp, Homo sapien
taacgtcttgagatggcacattcct

SEQ ID NO: 71275 - DNA, 25 bp, Homo sapien
gtcttgagatggcacattcctacga

SEQ ID NO: 71276 - DNA, 25 bp, Homo sapien
gagatggcacattcctacgattgaa

SEQ ID NO: 71277 - DNA, 25 bp, Homo sapien
tggcacattcctacgattgaagaag

SEQ ID NO: 71278 - DNA, 25 bp, Homo sapien
gggtcttgagatcccctaaacttgc

SEQ ID NO: 71279 - DNA, 25 bp, Homo sapien
ttgagatcccctaaacttgcatacc

SEQ ID NO: 71280 - DNA, 25 bp, Homo sapien
atcccctaaacttgcatacccagtt

SEQ ID NO: 71281 - DNA, 25 bp, Homo sapien
ctaaacttgcatacccagttttttg

SEQ ID NO: 71282 - DNA, 25 bp, Homo sapien
acccgtgtggtaccttcagccctgg

SEQ ID NO: 71283 - DNA, 25 bp, Homo sapien
tgtggtaccttcagccctggccaag

SEQ ID NO: 71284 - DNA, 25 bp, Homo sapien
agccctggccaagctttgaggctct

SEQ ID NO: 71285 - DNA, 25 bp, Homo sapien
tggccaagctttgaggctctgtcac

SEQ ID NO: 71286 - DNA, 25 bp, Homo sapien
gccaagctttgaggctctgtcactg

SEQ ID NO: 71287 - DNA, 25 bp, Homo sapien
tgaggctctgtcactgagcaatggt

SEQ ID NO: 71288 - DNA, 25 bp, Homo sapien
ctctgtcactgagcaatggtaactg

SEQ ID NO: 71289 - DNA, 25 bp, Homo sapien
gtcactgagcaatggtaactgcacc

SEQ ID NO: 71290 - DNA, 25 bp, Homo sapien
gagcaatggtaactgcacctgggca

SEQ ID NO: 71291 - DNA, 25 bp, Homo sapien
gcaatggtaactgcacctgggcagc

SEQ ID NO: 71292 - DNA, 25 bp, Homo sapien
agcccaacttcttacccgaaagcat

SEQ ID NO: 71293 - DNA, 25 bp, Homo sapien
ctctgtttcatgatgcatgggtcat

SEQ ID NO: 71294 - DNA, 25 bp, Homo sapien
gtttcatgatgcatgggtcatttgt

SEQ ID NO: 71295 - DNA, 25 bp, Homo sapien
ttcatgatgcatgggtcatttgtct

SEQ ID NO: 71296 - DNA, 25 bp, Homo sapien
catgatgcatgggtcatttgtcttg

SEQ ID NO: 71297 - DNA, 25 bp, Homo sapien
atgatgcatgggtcatttgtcttgg

SEQ ID NO: 71298 - DNA, 25 bp, Homo sapien
gatgcatgggtcatttgtcttgggt

SEQ ID NO: 71299 - DNA, 25 bp, Homo sapien
tgcatgggtcatttgtcttgggtgt

SEQ ID NO: 71300 - DNA, 25 bp, Homo sapien
ggtgtcctatcccatatggagaaga

SEQ ID NO: 71301 - DNA, 25 bp, Homo sapien
gtgtcctatcccatatggagaagaa

SEQ ID NO: 71302 - DNA, 25 bp, Homo sapien
gtcctatcccatatggagaagaaag

SEQ ID NO: 71303 - DNA, 25 bp, Homo sapien
atttcctaggaggtagaaaactgtg

SEQ ID NO: 71304 - DNA, 25 bp, Homo sapien
gaaacgtatttacagctccaggaag

SEQ ID NO: 71305 - DNA, 25 bp, Homo sapien
gaagcctttggttgggagccattca

SEQ ID NO: 71306 - DNA, 25 bp, Homo sapien
tgggagccattcatccgtctcttca

SEQ ID NO: 71307 - DNA, 25 bp, Homo sapien
gtctcttcaccgagtacaggaacca

SEQ ID NO: 71308 - DNA, 25 bp, Homo sapien
tacaggaaccagaccaacttgccca

SEQ ID NO: 71309 - DNA, 25 bp, Homo sapien
gaccaacttgcccacagaaaatgtt

SEQ ID NO: 71310 - DNA, 25 bp, Homo sapien
aatctgtgggtcaagatgttctccc

SEQ ID NO: 71311 - DNA, 25 bp, Homo sapien
tgttctcccaccaagtgcagaagaa

SEQ ID NO: 71312 - DNA, 25 bp, Homo sapien
gaagaacctggctccgttctttgag

SEQ ID NO: 71313 - DNA, 25 bp, Homo sapien
ggcctatctgcctgaatggaaggaa

SEQ ID NO: 71314 - DNA, 25 bp, Homo sapien
tatgaaattgtacctcctcacacag

SEQ ID NO: 71315 - DNA, 25 bp, Homo sapien
gaagttaagagctgatcacaagcac

SEQ ID NO: 71316 - DNA, 25 bp, Homo sapien
tgatcacaagcacaaatctttccca

SEQ ID NO: 71317 - DNA, 25 bp, Homo sapien
tttcccactagccatttaataagtt

SEQ ID NO: 71318 - DNA, 25 bp, Homo sapien
aaacctactagtcttgaacaaactg

SEQ ID NO: 71319 - DNA, 25 bp, Homo sapien
gaacaaactgtcatacgtatgggac

SEQ ID NO: 71320 - DNA, 25 bp, Homo sapien
tgtcatacgtatgggacctacactt

SEQ ID NO: 71321 - DNA, 25 bp, Homo sapien
gtatgggacctacacttaatctata

SEQ ID NO: 71322 - DNA, 25 bp, Homo sapien
ggacctacacttaatctatatgctt

SEQ ID NO: 71323 - DNA, 25 bp, Homo sapien
atatgctttacactagctttctgca

SEQ ID NO: 71324 - DNA, 25 bp, Homo sapien
ctttacactagctttctgcatttaa

SEQ ID NO: 71325 - DNA, 25 bp, Homo sapien
tagctttctgcatttaataggttag

SEQ ID NO: 71326 - DNA, 25 bp, Homo sapien
gctttgcctccaaggtgaaccagtg

SEQ ID NO: 71327 - DNA, 25 bp, Homo sapien
gcctccaaggtgaaccagtgtgtta

SEQ ID NO: 71328 - DNA, 25 bp, Homo sapien
agtgtgttattggtactgctcaggc

SEQ ID NO: 71329 - DNA, 25 bp, Homo sapien
aggaagtgaagacggatccagatct

SEQ ID NO: 71330 - DNA, 25 bp, Homo sapien
gtgtgtgtgtccctatgtctatgta

SEQ ID NO: 71331 - DNA, 25 bp, Homo sapien
gtgtgtccctatgtctatgtatcgg

SEQ ID NO: 71332 - DNA, 25 bp, Homo sapien
ccctatgtctatgtatcgggtgagg

SEQ ID NO: 71333 - DNA, 25 bp, Homo sapien
gagggttgctggagggtgctttatt

SEQ ID NO: 71334 - DNA, 25 bp, Homo sapien
tgctttattgggtggagggcaccat

SEQ ID NO: 71335 - DNA, 25 bp, Homo sapien
tggagggcaccatgtcccagggcta

SEQ ID NO: 71336 - DNA, 25 bp, Homo sapien
atgtcccagggctatcaaataaaga

SEQ ID NO: 71337 - DNA, 25 bp, Homo sapien
atcttatgttcctttataccatctt

SEQ ID NO: 71338 - DNA, 25 bp, Homo sapien
ataccatctttattgtggccacaaa

SEQ ID NO: 71339 - DNA, 25 bp, Homo sapien
taaccatgatgactacacagacttc

SEQ ID NO: 71340 - DNA, 25 bp, Homo sapien
gacttctactatgacatttgctcct

SEQ ID NO: 71341 - DNA, 25 bp, Homo sapien
gacatttgctccttttgaggataca

SEQ ID NO: 71342 - DNA, 25 bp, Homo sapien
agttggatgctatttggctggcagc

SEQ ID NO: 71343 - DNA, 25 bp, Homo sapien
gcagcagccgttttcatcatgtgag

SEQ ID NO: 71344 - DNA, 25 bp, Homo sapien
agcaaagtcaccttccaatggcgtt

SEQ ID NO: 71345 - DNA, 25 bp, Homo sapien
aatggcgttgggtcattggcctcaa

SEQ ID NO: 71346 - DNA, 25 bp, Homo sapien
gggtcattggcctcaaagccggtag

SEQ ID NO: 71347 - DNA, 25 bp, Homo sapien
aagccggtagatgttgcctcagata

SEQ ID NO: 71348 - DNA, 25 bp, Homo sapien
atccctttccacagtatccttcttc

SEQ ID NO: 71349 - DNA, 25 bp, Homo sapien
gtctctggctgtctcgagcagtcta

SEQ ID NO: 71350 - DNA, 25 bp, Homo sapien
tggctgtctcgagcagtctagaaga

SEQ ID NO: 71351 - DNA, 25 bp, Homo sapien
gagcagtctagaagagtgcatctcc

SEQ ID NO: 71352 - DNA, 25 bp, Homo sapien
gagtgcatctccagcctatgaaaca

SEQ ID NO: 71353 - DNA, 25 bp, Homo sapien
tgcatctccagcctatgaaacagct

SEQ ID NO: 71354 - DNA, 25 bp, Homo sapien
ctatgaaacagctgggtctttggcc

SEQ ID NO: 71355 - DNA, 25 bp, Homo sapien
aaacagctgggtctttggccataag

SEQ ID NO: 71356 - DNA, 25 bp, Homo sapien
aactcaggagtaagcttctagaccc

SEQ ID NO: 71357 - DNA, 25 bp, Homo sapien
aggagtaagcttctagaccccttca

SEQ ID NO: 71358 - DNA, 25 bp, Homo sapien
gtaagcttctagaccccttcagctt

SEQ ID NO: 71359 - DNA, 25 bp, Homo sapien
aattgtgacataataatagcagtgg

SEQ ID NO: 71360 - DNA, 25 bp, Homo sapien
atttgcttaaaattgtgagcgaatt

SEQ ID NO: 71361 - DNA, 25 bp, Homo sapien
gtgagcgaattagcaataacataca

SEQ ID NO: 71362 - DNA, 25 bp, Homo sapien
gcgaattagcaataacatacatgag

SEQ ID NO: 71363 - DNA, 25 bp, Homo sapien
gcaataacatacatgagataactca

SEQ ID NO: 71364 - DNA, 25 bp, Homo sapien
gttgattcttgccttgtacctcaat

SEQ ID NO: 71365 - DNA, 25 bp, Homo sapien
ttgattcttgccttgtacctcaatc

SEQ ID NO: 71366 - DNA, 25 bp, Homo sapien
gattcttgccttgtacctcaatcta

SEQ ID NO: 71367 - DNA, 25 bp, Homo sapien
aaatatgcaaaccaggatttccttg

SEQ ID NO: 71368 - DNA, 25 bp, Homo sapien
gcaaaccaggatttccttgacttct

SEQ ID NO: 71369 - DNA, 25 bp, Homo sapien
aaccaggatttccttgacttctttg

SEQ ID NO: 71370 - DNA, 25 bp, Homo sapien
gaagaacacctgagagcgctttcca

SEQ ID NO: 71371 - DNA, 25 bp, Homo sapien
ccgagtgcctgtgggaatgctcttt

SEQ ID NO: 71372 - DNA, 25 bp, Homo sapien
aatgctctttggtcagacattccct

SEQ ID NO: 71373 - DNA, 25 bp, Homo sapien
tcagacattccctcacacagtacag

SEQ ID NO: 71374 - DNA, 25 bp, Homo sapien
ggcccatttgagcttctagattatg

SEQ ID NO: 71375 - DNA, 25 bp, Homo sapien
gcttctagattatgtcggactggat

SEQ ID NO: 71376 - DNA, 25 bp, Homo sapien
ggactggatactacgaagttcatcg

SEQ ID NO: 71377 - DNA, 25 bp, Homo sapien
tgcagagaacccattacatcagccc

SEQ ID NO: 71378 - DNA, 25 bp, Homo sapien
gcccagcccatccttaaataagctg

SEQ ID NO: 71379 - DNA, 25 bp, Homo sapien
gctggtagcagagaacaagttcggc

SEQ ID NO: 71380 - DNA, 25 bp, Homo sapien
tacaagtgatgtgcagcttctccgg

SEQ ID NO: 71381 - DNA, 25 bp, Homo sapien
aaagcttgttgactctagcggctca

SEQ ID NO: 71382 - DNA, 25 bp, Homo sapien
tagcggctcagagaggactttgctg

SEQ ID NO: 71383 - DNA, 25 bp, Homo sapien
ctttctgtgaatatctccgtgctga

SEQ ID NO: 71384 - DNA, 25 bp, Homo sapien
tccgtgctgaccatgctggaattgg

SEQ ID NO: 71385 - DNA, 25 bp, Homo sapien
atgattctgcaattcgggacctact

SEQ ID NO: 71386 - DNA, 25 bp, Homo sapien
gtcttgtctgtgatctttgttcttg

SEQ ID NO: 71387 - DNA, 25 bp, Homo sapien
ctagaccccaagatgtgaacagtgc

SEQ ID NO: 71388 - DNA, 25 bp, Homo sapien
acagtgcacgtgttaatgtcatctt

SEQ ID NO: 71389 - DNA, 25 bp, Homo sapien
aatgtcatctttgctcatgtgttat

SEQ ID NO: 71390 - DNA, 25 bp, Homo sapien
gttataagccccaagttgctgtata

SEQ ID NO: 71391 - DNA, 25 bp, Homo sapien
gtatgtctacacactggtcatgatt

SEQ ID NO: 71392 - DNA, 25 bp, Homo sapien
gtacaaatatgacctcatcgcggtt

SEQ ID NO: 71393 - DNA, 25 bp, Homo sapien
catcgcggtttccaaccattatggg

SEQ ID NO: 71394 - DNA, 25 bp, Homo sapien
gggcatgcgtgatggacactacaca

SEQ ID NO: 71395 - DNA, 25 bp, Homo sapien
gacactacacaacatttgcctgcaa

SEQ ID NO: 71396 - DNA, 25 bp, Homo sapien
ttgcctgcaacaaggacagcggcca

SEQ ID NO: 71397 - DNA, 25 bp, Homo sapien
ggccagtggcactactttgatgaca

SEQ ID NO: 71398 - DNA, 25 bp, Homo sapien
tttgatgacaacagcgtctcccctg

SEQ ID NO: 71399 - DNA, 25 bp, Homo sapien
gcgtctcccctgtcaatgagaatca

SEQ ID NO: 71400 - DNA, 25 bp, Homo sapien
gaatcagatcgagtccaaggcagcc

SEQ ID NO: 71401 - DNA, 25 bp, Homo sapien
caaggcagcctatgtcctcttctac

SEQ ID NO: 71402 - DNA, 25 bp, Homo sapien
cacccagctctgagttcatggatgt

SEQ ID NO: 71403 - DNA, 25 bp, Homo sapien
tgagccttggcagtggggcgtgctt

SEQ ID NO: 71404 - DNA, 25 bp, Homo sapien
gagccttggcagtggggcgtgcttg

SEQ ID NO: 71405 - DNA, 25 bp, Homo sapien
tggggcgtgcttggaagccaccagc

SEQ ID NO: 71406 - DNA, 25 bp, Homo sapien
ggggcgtgcttggaagccaccagcc

SEQ ID NO: 71407 - DNA, 25 bp, Homo sapien
caccagccagcaagcattaatgggg

SEQ ID NO: 71408 - DNA, 25 bp, Homo sapien
accagccagcaagcattaatggggc

SEQ ID NO: 71409 - DNA, 25 bp, Homo sapien
ccagccagcaagcattaatggggct

SEQ ID NO: 71410 - DNA, 25 bp, Homo sapien
agcaagcattaatggggctggtgcc

SEQ ID NO: 71411 - DNA, 25 bp, Homo sapien
gggctggtgcccactttccactcag

SEQ ID NO: 71412 - DNA, 25 bp, Homo sapien
ggctggtgcccactttccactcagc

SEQ ID NO: 71413 - DNA, 25 bp, Homo sapien
ctagttagcctagtactgctgtact

SEQ ID NO: 71414 - DNA, 25 bp, Homo sapien
gtactgctgtactggcctgtatgta

SEQ ID NO: 71415 - DNA, 25 bp, Homo sapien
gctgtactggcctgtatgtacatgg

SEQ ID NO: 71416 - DNA, 25 bp, Homo sapien
gggtccttcaactgaggccttgcaa

SEQ ID NO: 71417 - DNA, 25 bp, Homo sapien
ttcaactgaggccttgcaagtcaag

SEQ ID NO: 71418 - DNA, 25 bp, Homo sapien
cttgcaagtcaagctggctgtgcca

SEQ ID NO: 71419 - DNA, 25 bp, Homo sapien
gcagaggaatctagaacaatgggaa

SEQ ID NO: 71420 - DNA, 25 bp, Homo sapien
acaatgggaaacttagctatttata

SEQ ID NO: 71421 - DNA, 25 bp, Homo sapien
tgaggctagacctttaacttcccta

SEQ ID NO: 71422 - DNA, 25 bp, Homo sapien
cttccctaaggcatacttttctagc

SEQ ID NO: 71423 - DNA, 25 bp, Homo sapien
ttttctagctaccttctgccctgtg

SEQ ID NO: 71424 - DNA, 25 bp, Homo sapien
gaaaaactaattgagcctgtgcctg

SEQ ID NO: 71425 - DNA, 25 bp, Homo sapien
ttacagaattcctaccaaacagctt

SEQ ID NO: 71426 - DNA, 25 bp, Homo sapien
tcaagaaagaattcctgcagcagtt

SEQ ID NO: 71427 - DNA, 25 bp, Homo sapien
tgcagcagttattcccttacctgaa

SEQ ID NO: 71428 - DNA, 25 bp, Homo sapien
gttattcccttacctgaaggcttca

SEQ ID NO: 71429 - DNA, 25 bp, Homo sapien
gaaggcttcaatcatttggatcaac

SEQ ID NO: 71430 - DNA, 25 bp, Homo sapien
ttggatcaacaactgctactctcgg

SEQ ID NO: 71431 - DNA, 25 bp, Homo sapien
tgctactctcgggaagactcctcta

SEQ ID NO: 71432 - DNA, 25 bp, Homo sapien
agactcctctactcacagctgaaga

SEQ ID NO: 71433 - DNA, 25 bp, Homo sapien
aagaaaatgagcacacccttcacac

SEQ ID NO: 71434 - DNA, 25 bp, Homo sapien
atgagcacacccttcacactgttat

SEQ ID NO: 71435 - DNA, 25 bp, Homo sapien
ttgtcccttttgatcattaactcag

SEQ ID NO: 71436 - DNA, 25 bp, Homo sapien
attaactcagggtttcagctccaac

SEQ ID NO: 71437 - DNA, 25 bp, Homo sapien
gctccaacctcgctgagttggtgca

SEQ ID NO: 71438 - DNA, 25 bp, Homo sapien
agttggtgcagctccgggtcattcc

SEQ ID NO: 71439 - DNA, 25 bp, Homo sapien
gtgggaatcggatcatccctgactc

SEQ ID NO: 71440 - DNA, 25 bp, Homo sapien
tccctgactcagcttataccttaat

SEQ ID NO: 71441 - DNA, 25 bp, Homo sapien
gattcttttctcaaaatgctctggc

SEQ ID NO: 71442 - DNA, 25 bp, Homo sapien
tgctctggcatttggacacacatca

SEQ ID NO: 71443 - DNA, 25 bp, Homo sapien
acacatcacatgtcgatatttgcat

SEQ ID NO: 71444 - DNA, 25 bp, Homo sapien
gcataggagtcattttcagtggaat

SEQ ID NO: 71445 - DNA, 25 bp, Homo sapien
taatgtgtggttttacggttcaagg

SEQ ID NO: 71446 - DNA, 25 bp, Homo sapien
tatcagttatgagcaaagttgttac

SEQ ID NO: 71447 - DNA, 25 bp, Homo sapien
gttactgatttcttgtatctcccag

SEQ ID NO: 71448 - DNA, 25 bp, Homo sapien
ctgatttcttgtatctcccaggatt

SEQ ID NO: 71449 - DNA, 25 bp, Homo sapien
atctcccaggattcctgttgcttta

SEQ ID NO: 71450 - DNA, 25 bp, Homo sapien
aggattcctgttgctttacccacaa

SEQ ID NO: 71451 - DNA, 25 bp, Homo sapien
gttgctttacccacaacagacaagt

SEQ ID NO: 71452 - DNA, 25 bp, Homo sapien
tgtctaagtgtttttcttcgtggtc

SEQ ID NO: 71453 - DNA, 25 bp, Homo sapien
cattcttaactctgcattctggctt

SEQ ID NO: 71454 - DNA, 25 bp, Homo sapien
tctgcattctggcttctgtatgtag

SEQ ID NO: 71455 - DNA, 25 bp, Homo sapien
ctggcttctgtatgtagtattttaa

SEQ ID NO: 71456 - DNA, 25 bp, Homo sapien
taagtgtgtagatgcttttttcttt

SEQ ID NO: 71457 - DNA, 25 bp, Homo sapien
gatcctgaaaggttgtcccaaactg

SEQ ID NO: 71458 - DNA, 25 bp, Homo sapien
gaaataagcacatagataaccttat

SEQ ID NO: 71459 - DNA, 25 bp, Homo sapien
taaccttattgtgtgctgcatggaa

SEQ ID NO: 71460 - DNA, 25 bp, Homo sapien
taagcatctgctggtacaagtcaat

SEQ ID NO: 71461 - DNA, 25 bp, Homo sapien
agtcaatgtggcaccatgagcttca

SEQ ID NO: 71462 - DNA, 25 bp, Homo sapien
gagacaatagtccttagctctcctc

SEQ ID NO: 71463 - DNA, 25 bp, Homo sapien
tgtaggccaacaagaaggttccttt

SEQ ID NO: 71464 - DNA, 25 bp, Homo sapien
cccatgcaagacacttatgagaaca

SEQ ID NO: 71465 - DNA, 25 bp, Homo sapien
tgcaagacacttatgagaacacatt

SEQ ID NO: 71466 - DNA, 25 bp, Homo sapien
agacacttatgagaacacattacaa

SEQ ID NO: 71467 - DNA, 25 bp, Homo sapien
acattacaagatggctgaccgtgga

SEQ ID NO: 71468 - DNA, 25 bp, Homo sapien
gagaggtttgcatccacttcaggag

SEQ ID NO: 71469 - DNA, 25 bp, Homo sapien
gtttgcatccacttcaggagcccta

SEQ ID NO: 71470 - DNA, 25 bp, Homo sapien
ttcaggagccctactgaagggaaca

SEQ ID NO: 71471 - DNA, 25 bp, Homo sapien
gaagggaacagcctgagccgaacat

SEQ ID NO: 71472 - DNA, 25 bp, Homo sapien
cagcctgagccgaacatgttattta

SEQ ID NO: 71473 - DNA, 25 bp, Homo sapien
agtatagtatttaacgaagcctaga

SEQ ID NO: 71474 - DNA, 25 bp, Homo sapien
aacgaagcctagaagcacggctgtg

SEQ ID NO: 71475 - DNA, 25 bp, Homo sapien
ggtggtgatttggtcagcatatctt

SEQ ID NO: 71476 - DNA, 25 bp, Homo sapien
taataactttgaagccataactttt

SEQ ID NO: 71477 - DNA, 25 bp, Homo sapien
tctctgtgattacctctcaatctat

SEQ ID NO: 71478 - DNA, 25 bp, Homo sapien
gattacctctcaatctatttgtttt

SEQ ID NO: 71479 - DNA, 25 bp, Homo sapien
gaaatcttagtgtgatacatctctc

SEQ ID NO: 71480 - DNA, 25 bp, Homo sapien
gtgatacatctctcatacagtttgg

SEQ ID NO: 71481 - DNA, 25 bp, Homo sapien
gtgaaataccccattagaagaggat

SEQ ID NO: 71482 - DNA, 25 bp, Homo sapien
gaatgttttgttgggctgtgttgaa

SEQ ID NO: 71483 - DNA, 25 bp, Homo sapien
gctgtgttgaacattatttctttgt

SEQ ID NO: 71484 - DNA, 25 bp, Homo sapien
gaatgaggacttgggttggtccaac

SEQ ID NO: 71485 - DNA, 25 bp, Homo sapien
gggttggtccaacattgactttctt

SEQ ID NO: 71486 - DNA, 25 bp, Homo sapien
caacattgactttcttcatcactgc

SEQ ID NO: 71487 - DNA, 25 bp, Homo sapien
gactttcttcatcactgcaacattt

SEQ ID NO: 71488 - DNA, 25 bp, Homo sapien
ttcatcactgcaacatttctctgac

SEQ ID NO: 71489 - DNA, 25 bp, Homo sapien
atttctctgactagcaatgtgacga

SEQ ID NO: 71490 - DNA, 25 bp, Homo sapien
gatcaccggacacaatcctgcagaa

SEQ ID NO: 71491 - DNA, 25 bp, Homo sapien
tcctgcagaaggacacacgactcta

SEQ ID NO: 71492 - DNA, 25 bp, Homo sapien
acgactctatttcctacagtgcgaa

SEQ ID NO: 71493 - DNA, 25 bp, Homo sapien
tacagtgcgaaacttgtcattctag

SEQ ID NO: 71494 - DNA, 25 bp, Homo sapien
ttgtcattctagatgttctgttgcc

SEQ ID NO: 71495 - DNA, 25 bp, Homo sapien
gccagtatcaaaaccggcttccagg

SEQ ID NO: 71496 - DNA, 25 bp, Homo sapien
ttccaggctgtcacgggcaagcgag

SEQ ID NO: 71497 - DNA, 25 bp, Homo sapien
acagctccgtgccaaagctaactaa

SEQ ID NO: 71498 - DNA, 25 bp, Homo sapien
ggctggacaggtttgccatcagagt

SEQ ID NO: 71499 - DNA, 25 bp, Homo sapien
gccatcagagtggatataccgttgt

SEQ ID NO: 71500 - DNA, 25 bp, Homo sapien
tgtcacttgtcacacatgccgatca

SEQ ID NO: 71501 - DNA, 25 bp, Homo sapien
tctgacttcggtttatgttttcatt

SEQ ID NO: 71502 - DNA, 25 bp, Homo sapien
tttctttggagtaatgctgctctag

SEQ ID NO: 71503 - DNA, 25 bp, Homo sapien
gtaatgctgctctagattgttctaa

SEQ ID NO: 71504 - DNA, 25 bp, Homo sapien
gttctaaatagaatgtgggcttcat

SEQ ID NO: 71505 - DNA, 25 bp, Homo sapien
cagagtagtcaacttatatagtcaa

SEQ ID NO: 71506 - DNA, 25 bp, Homo sapien
tatagtcaattacatcaggacattt

SEQ ID NO: 71507 - DNA, 25 bp, Homo sapien
cattttgtgtttcttacagaagcaa

SEQ ID NO: 71508 - DNA, 25 bp, Homo sapien
gaagcaaaccataggctcctctttt

SEQ ID NO: 71509 - DNA, 25 bp, Homo sapien
gataaactgtattcgtgaactgcat

SEQ ID NO: 71510 - DNA, 25 bp, Homo sapien
gtattcgtgaactgcatgctggaaa

SEQ ID NO: 71511 - DNA, 25 bp, Homo sapien
atgctggaaaatgctactattatgc

SEQ ID NO: 71512 - DNA, 25 bp, Homo sapien
tgtctaagtgtttttcttcgtggtc

SEQ ID NO: 71513 - DNA, 25 bp, Homo sapien
tccccaccttattccattcttaact

SEQ ID NO: 71514 - DNA, 25 bp, Homo sapien
tccattcttaactctgcattctggc

SEQ ID NO: 71515 - DNA, 25 bp, Homo sapien
attcttaactctgcattctggcttc

SEQ ID NO: 71516 - DNA, 25 bp, Homo sapien
ttaactctgcattctggcttctgta

SEQ ID NO: 71517 - DNA, 25 bp, Homo sapien
aactctgcattctggcttctgtatg

SEQ ID NO: 71518 - DNA, 25 bp, Homo sapien
tctgcattctggcttctgtatgtag

SEQ ID NO: 71519 - DNA, 25 bp, Homo sapien
gcattctggcttctgtatgtagtat

SEQ ID NO: 71520 - DNA, 25 bp, Homo sapien
attctggcttctgtatgtagtattt

SEQ ID NO: 71521 - DNA, 25 bp, Homo sapien
ctggcttctgtatgtagtattttaa

SEQ ID NO: 71522 - DNA, 25 bp, Homo sapien
taagtgtgtagatgcttttttcttt

SEQ ID NO: 71523 - DNA, 25 bp, Homo sapien
gaaataagcacatagataaccttat

SEQ ID NO: 71524 - DNA, 25 bp, Homo sapien
cccatgcaagacacttatgagaaca

SEQ ID NO: 71525 - DNA, 25 bp, Homo sapien
ccatgcaagacacttatgagaacac

SEQ ID NO: 71526 - DNA, 25 bp, Homo sapien
catgcaagacacttatgagaacaca

SEQ ID NO: 71527 - DNA, 25 bp, Homo sapien
atgcaagacacttatgagaacacat

SEQ ID NO: 71528 - DNA, 25 bp, Homo sapien
tgcaagacacttatgagaacacatt

SEQ ID NO: 71529 - DNA, 25 bp, Homo sapien
gcaagacacttatgagaacacatta

SEQ ID NO: 71530 - DNA, 25 bp, Homo sapien
caagacacttatgagaacacattac

SEQ ID NO: 71531 - DNA, 25 bp, Homo sapien
aagacacttatgagaacacattaca

SEQ ID NO: 71532 - DNA, 25 bp, Homo sapien
agacacttatgagaacacattacaa

SEQ ID NO: 71533 - DNA, 25 bp, Homo sapien
accacacctggctatgtttgatgtt

SEQ ID NO: 71534 - DNA, 25 bp, Homo sapien
ccacacctggctatgtttgatgttg

SEQ ID NO: 71535 - DNA, 25 bp, Homo sapien
cacacctggctatgtttgatgttgt

SEQ ID NO: 71536 - DNA, 25 bp, Homo sapien
acacctggctatgtttgatgttgtt

SEQ ID NO: 71537 - DNA, 25 bp, Homo sapien
cacctggctatgtttgatgttgttg

SEQ ID NO: 71538 - DNA, 25 bp, Homo sapien
acctggctatgtttgatgttgttgt

SEQ ID NO: 71539 - DNA, 25 bp, Homo sapien
cctggctatgtttgatgttgttgtt

SEQ ID NO: 71540 - DNA, 25 bp, Homo sapien
gtagagatgagatgtttcccaggct

SEQ ID NO: 71541 - DNA, 25 bp, Homo sapien
tagagatgagatgtttcccaggctg

SEQ ID NO: 71542 - DNA, 25 bp, Homo sapien
gggcagaagcccacctgtcttgcag

SEQ ID NO: 71543 - DNA, 25 bp, Homo sapien
tgcaaccagcccttttgaagagcag

SEQ ID NO: 71544 - DNA, 25 bp, Homo sapien
ttgaagagcagcttctgtgttcctc

SEQ ID NO: 71545 - DNA, 25 bp, Homo sapien
agcagaactgatgctcctcagagta

SEQ ID NO: 71546 - DNA, 25 bp, Homo sapien
cctcagagtagtgggctggcgtcca

SEQ ID NO: 71547 - DNA, 25 bp, Homo sapien
tggcgtccaaggatttgagccctgt

SEQ ID NO: 71548 - DNA, 25 bp, Homo sapien
aggatttgagccctgtcgagctcac

SEQ ID NO: 71549 - DNA, 25 bp, Homo sapien
cgagctcacggcaacctgggatggc

SEQ ID NO: 71550 - DNA, 25 bp, Homo sapien
aaggcgcctctctgcagtcgggctg

SEQ ID NO: 71551 - DNA, 25 bp, Homo sapien
gggtcaactgtacccagcctagagc

SEQ ID NO: 71552 - DNA, 25 bp, Homo sapien
gcctagagccaagaaatccttcctt

SEQ ID NO: 71553 - DNA, 25 bp, Homo sapien
ggttgtgcactgttgctggacagat

SEQ ID NO: 71554 - DNA, 25 bp, Homo sapien
gttgctggacagatgcattcattca

SEQ ID NO: 71555 - DNA, 25 bp, Homo sapien
agaagagccaaccaggtcctgatta

SEQ ID NO: 71556 - DNA, 25 bp, Homo sapien
ggtcctgattagtggcaagctgccc

SEQ ID NO: 71557 - DNA, 25 bp, Homo sapien
ggcaagctgccccacaaagggctat

SEQ ID NO: 71558 - DNA, 25 bp, Homo sapien
gggctatgcctgtgtcttattgaga

SEQ ID NO: 71559 - DNA, 25 bp, Homo sapien
gtcttattgagacaccttggcaaag

SEQ ID NO: 71560 - DNA, 25 bp, Homo sapien
ttggcaaagagatggctgattctgg

SEQ ID NO: 71561 - DNA, 25 bp, Homo sapien
tggtcctggacatggccgcacccaa

SEQ ID NO: 71562 - DNA, 25 bp, Homo sapien
tccaagccttaatggcaccctgaag

SEQ ID NO: 71563 - DNA, 25 bp, Homo sapien
ttaatggcaccctgaagcctccatg

SEQ ID NO: 71564 - DNA, 25 bp, Homo sapien
gatggcttgccgacatgctttagaa

SEQ ID NO: 71565 - DNA, 25 bp, Homo sapien
tgctttagaaactcccctcttggga

SEQ ID NO: 71566 - DNA, 25 bp, Homo sapien
ctcttgggaatgctcctctgactga

SEQ ID NO: 71567 - DNA, 25 bp, Homo sapien
gactgagggctccaacagctttaat

SEQ ID NO: 71568 - DNA, 25 bp, Homo sapien
ttaatgaaatcagccgagagggtaa

SEQ ID NO: 71569 - DNA, 25 bp, Homo sapien
gagggtaaaaaccaacctgttgcat

SEQ ID NO: 71570 - DNA, 25 bp, Homo sapien
aaccaacctgttgcatagaatggag

SEQ ID NO: 71571 - DNA, 25 bp, Homo sapien
gggaaaaagcacatactcaatagat

SEQ ID NO: 71572 - DNA, 25 bp, Homo sapien
gtgtggtactctgtatttttgcagc

SEQ ID NO: 71573 - DNA, 25 bp, Homo sapien
ttattttccaaatgagcagtttaga

SEQ ID NO: 71574 - DNA, 25 bp, Homo sapien
gtacatactgtacgtttgctgaaaa

SEQ ID NO: 71575 - DNA, 25 bp, Homo sapien
ttttgaaaaggtgtgggtccctgtg

SEQ ID NO: 71576 - DNA, 25 bp, Homo sapien
gaaaaggtgtgggtccctgtgtcct

SEQ ID NO: 71577 - DNA, 25 bp, Homo sapien
aaaggtgtgggtccctgtgtcctct

SEQ ID NO: 71578 - DNA, 25 bp, Homo sapien
aaatctttctaagcaaagtgtgaat

SEQ ID NO: 71579 - DNA, 25 bp, Homo sapien
gatttttactccctttgtacagtat

SEQ ID NO: 71580 - DNA, 25 bp, Homo sapien
tttactccctttgtacagtattctg

SEQ ID NO: 71581 - DNA, 25 bp, Homo sapien
tactccctttgtacagtattctgag

SEQ ID NO: 71582 - DNA, 25 bp, Homo sapien
ctccctttgtacagtattctgagaa

SEQ ID NO: 71583 - DNA, 25 bp, Homo sapien
ccctttgtacagtattctgagaaac

SEQ ID NO: 71584 - DNA, 25 bp, Homo sapien
gtacagtattctgagaaacgcaaat

SEQ ID NO: 71585 - DNA, 25 bp, Homo sapien
gtattctgagaaacgcaaataaaag

SEQ ID NO: 71586 - DNA, 25 bp, Homo sapien
atacttccaagaacgtcaactctgt

SEQ ID NO: 71587 - DNA, 25 bp, Homo sapien
aagaacgtcaactctgtcattgcca

SEQ ID NO: 71588 - DNA, 25 bp, Homo sapien
aactctgtcattgccatctgcgtag

SEQ ID NO: 71589 - DNA, 25 bp, Homo sapien
atctgcgtagatgggaccttccaca

SEQ ID NO: 71590 - DNA, 25 bp, Homo sapien
gggaccttccacaaatatgtcttca

SEQ ID NO: 71591 - DNA, 25 bp, Homo sapien
caaatatgtcttcactcctgatgga

SEQ ID NO: 71592 - DNA, 25 bp, Homo sapien
tcactcctgatggaaactgcaacag

SEQ ID NO: 71593 - DNA, 25 bp, Homo sapien
actgcaacagagaggctttcgacgt

SEQ ID NO: 71594 - DNA, 25 bp, Homo sapien
agaggctttcgacgtgtaccttgac

SEQ ID NO: 71595 - DNA, 25 bp, Homo sapien
cgacgtgtaccttgacatctgtgat

SEQ ID NO: 71596 - DNA, 25 bp, Homo sapien
agtggcagaactgcagagctgagcc

SEQ ID NO: 71597 - DNA, 25 bp, Homo sapien
agcaggcatgcaacggaagcctctt

SEQ ID NO: 71598 - DNA, 25 bp, Homo sapien
tgcaacggaagcctcttaccagatg

SEQ ID NO: 71599 - DNA, 25 bp, Homo sapien
ttaccagatgctcacctcagagttg

SEQ ID NO: 71600 - DNA, 25 bp, Homo sapien
cagatgctcacctcagagttggcat

SEQ ID NO: 71601 - DNA, 25 bp, Homo sapien
atttctcacaagacacactcctaga

SEQ ID NO: 71602 - DNA, 25 bp, Homo sapien
ctcacaagacacactcctagaaggg

SEQ ID NO: 71603 - DNA, 25 bp, Homo sapien
aaaggttgctgccaggaccatgtga

SEQ ID NO: 71604 - DNA, 25 bp, Homo sapien
aaacctcccacattgtgcactgtca

SEQ ID NO: 71605 - DNA, 25 bp, Homo sapien
ccacattgtgcactgtcatttgaaa

SEQ ID NO: 71606 - DNA, 25 bp, Homo sapien
aaatactttgtcagtttgacaggtg

SEQ ID NO: 71607 - DNA, 25 bp, Homo sapien
gtttgacaggtggaaatatcttgaa

SEQ ID NO: 71608 - DNA, 25 bp, Homo sapien
cgccctaccggcttttggattctgg

SEQ ID NO: 71609 - DNA, 25 bp, Homo sapien
ctaccggcttttggattctgggagg

SEQ ID NO: 71610 - DNA, 25 bp, Homo sapien
ggaactctgcctccctgcaaatctt

SEQ ID NO: 71611 - DNA, 25 bp, Homo sapien
gatagctctactgttcccttggcca

SEQ ID NO: 71612 - DNA, 25 bp, Homo sapien
tgttcccttggccacgaaggtgccc

SEQ ID NO: 71613 - DNA, 25 bp, Homo sapien
agatgccctggccctaggcctgact

SEQ ID NO: 71614 - DNA, 25 bp, Homo sapien
cctaggcctgactccggccaggagg

SEQ ID NO: 71615 - DNA, 25 bp, Homo sapien
gagagctgggacaaggccttgcccc

SEQ ID NO: 71616 - DNA, 25 bp, Homo sapien
tccacctttgcttctgaattcttgt

SEQ ID NO: 71617 - DNA, 25 bp, Homo sapien
ccacctttgcttctgaattcttgtt

SEQ ID NO: 71618 - DNA, 25 bp, Homo sapien
tctgaattcttgtttttgagcaata

SEQ ID NO: 71619 - DNA, 25 bp, Homo sapien
atggaaataacaggcgggcttcacg

SEQ ID NO: 71620 - DNA, 25 bp, Homo sapien
tcccatggcctgtgagcaccggagc

SEQ ID NO: 71621 - DNA, 25 bp, Homo sapien
gccaaggaagtgcaattgcataaaa

SEQ ID NO: 71622 - DNA, 25 bp, Homo sapien
aagaacaacgccctggagccaatct

SEQ ID NO: 71623 - DNA, 25 bp, Homo sapien
cgccctggagccaatcttcaagaaa

SEQ ID NO: 71624 - DNA, 25 bp, Homo sapien
tttttctaataaatgcggctgcaac

SEQ ID NO: 71625 - DNA, 25 bp, Homo sapien
taataaatgcggctgcaacctcctg

SEQ ID NO: 71626 - DNA, 25 bp, Homo sapien
aatgcggctgcaacctcctgtgcat

SEQ ID NO: 71627 - DNA, 25 bp, Homo sapien
cgccgtggagttccggtgacccatt

SEQ ID NO: 71628 - DNA, 25 bp, Homo sapien
gagttccggtgacccatttccccag

SEQ ID NO: 71629 - DNA, 25 bp, Homo sapien
ccaggaccacccgatggaaataaca

SEQ ID NO: 71630 - DNA, 25 bp, Homo sapien
gttgaaaattctgcaaaacgagatt

SEQ ID NO: 71631 - DNA, 25 bp, Homo sapien
ttctgcaaaacgagatttatttaat

SEQ ID NO: 71632 - DNA, 25 bp, Homo sapien
ttgttgtaaacattcttaagggata

SEQ ID NO: 71633 - DNA, 25 bp, Homo sapien
gtaaacattcttaagggataggtag

SEQ ID NO: 71634 - DNA, 25 bp, Homo sapien
ggtagaagaggcgtgtgtgtgttgt

SEQ ID NO: 71635 - DNA, 25 bp, Homo sapien
gtgtgggcataatttgagttgtcta

SEQ ID NO: 71636 - DNA, 25 bp, Homo sapien
agttgtctaagagatgtgatgtaac

SEQ ID NO: 71637 - DNA, 25 bp, Homo sapien
gtgatgtaacatagtttctgtgaac

SEQ ID NO: 71638 - DNA, 25 bp, Homo sapien
gtttctgtgaactgatgttactttc

SEQ ID NO: 71639 - DNA, 25 bp, Homo sapien
ctgtgaactgatgttactttcttgt

SEQ ID NO: 71640 - DNA, 25 bp, Homo sapien
tgaactgatgttactttcttgtttt

SEQ ID NO: 71641 - DNA, 25 bp, Homo sapien
tgacccaccttgagagagagccacc

SEQ ID NO: 71642 - DNA, 25 bp, Homo sapien
agagccaccaggaaggcgcatctta

SEQ ID NO: 71643 - DNA, 25 bp, Homo sapien
accaggaaggcgcatcttagcagat

SEQ ID NO: 71644 - DNA, 25 bp, Homo sapien
actgattactggctgtgtcttgggt

SEQ ID NO: 71645 - DNA, 25 bp, Homo sapien
cttgggtgggcagaaactcgaactt

SEQ ID NO: 71646 - DNA, 25 bp, Homo sapien
gaacttgctatgtaatttgtgtcta

SEQ ID NO: 71647 - DNA, 25 bp, Homo sapien
atttgtgtctagttattcagaggag

SEQ ID NO: 71648 - DNA, 25 bp, Homo sapien
gatggtgatgttcacctggcaatca

SEQ ID NO: 71649 - DNA, 25 bp, Homo sapien
ctggcaatcagctgagttgagactt

SEQ ID NO: 71650 - DNA, 25 bp, Homo sapien
agacactggttttcatgcgctgttt

SEQ ID NO: 71651 - DNA, 25 bp, Homo sapien
ttttcatgcgctgtttttgttttaa

SEQ ID NO: 71652 - DNA, 25 bp, Homo sapien
gtttctgattgcttcctgttgagca

SEQ ID NO: 71653 - DNA, 25 bp, Homo sapien
gattgcttcctgttgagcacaaagt

SEQ ID NO: 71654 - DNA, 25 bp, Homo sapien
ttgagcacaaagtgagagctgccac

SEQ ID NO: 71655 - DNA, 25 bp, Homo sapien
tgagagctgccactgagcagccctg

SEQ ID NO: 71656 - DNA, 25 bp, Homo sapien
ttcaggctgggcatcgccaggcggc

SEQ ID NO: 71657 - DNA, 25 bp, Homo sapien
aggcggcctccctgcaaaccaaggg

SEQ ID NO: 71658 - DNA, 25 bp, Homo sapien
gcctccctgcaaaccaagggctggg

SEQ ID NO: 71659 - DNA, 25 bp, Homo sapien
gcatgatccagggtcccccagggtg

SEQ ID NO: 71660 - DNA, 25 bp, Homo sapien
acgtggcagccccacctcttgagag

SEQ ID NO: 71661 - DNA, 25 bp, Homo sapien
agagcccccagtgccggagcagaaa

SEQ ID NO: 71662 - DNA, 25 bp, Homo sapien
aaaaggtagagtaggctgtggcaat

SEQ ID NO: 71663 - DNA, 25 bp, Homo sapien
atgctctggggcttctgtggccaag

SEQ ID NO: 71664 - DNA, 25 bp, Homo sapien
tttcgtgtccccctgtgcggtcagt

SEQ ID NO: 71665 - DNA, 25 bp, Homo sapien
cgtgtccccctgtgcggtcagtgtt

SEQ ID NO: 71666 - DNA, 25 bp, Homo sapien
tctcccgtgcccacttggctattta

SEQ ID NO: 71667 - DNA, 25 bp, Homo sapien
atttattgtgtgccagtgatggtgg

SEQ ID NO: 71668 - DNA, 25 bp, Homo sapien
ccgtacttaataaagtgcgcgtggg

SEQ ID NO: 71669 - DNA, 25 bp, Homo sapien
gtacttaataaagtgcgcgtgggag

SEQ ID NO: 71670 - DNA, 25 bp, Homo sapien
acttaataaagtgcgcgtgggagtg

SEQ ID NO: 71671 - DNA, 25 bp, Homo sapien
aataaagtgcgcgtgggagtgttaa

SEQ ID NO: 71672 - DNA, 25 bp, Homo sapien
ataaagtgcgcgtgggagtgttaaa

SEQ ID NO: 71673 - DNA, 25 bp, Homo sapien
taaagtgcgcgtgggagtgttaaaa

SEQ ID NO: 71674 - DNA, 25 bp, Homo sapien
ctggtgctgtgcttcccgtgaggac

SEQ ID NO: 71675 - DNA, 25 bp, Homo sapien
ctgtgcttcccgtgaggacccagga

SEQ ID NO: 71676 - DNA, 25 bp, Homo sapien
gtgcttcccgtgaggacccaggacc

SEQ ID NO: 71677 - DNA, 25 bp, Homo sapien
aaggtcctgccccagctcaagagct

SEQ ID NO: 71678 - DNA, 25 bp, Homo sapien
acctgaggcagaagctccaggccct

SEQ ID NO: 71679 - DNA, 25 bp, Homo sapien
gatgatttgcactttggttccctgt

SEQ ID NO: 71680 - DNA, 25 bp, Homo sapien
tttccttccccgttgtgaatctcag

SEQ ID NO: 71681 - DNA, 25 bp, Homo sapien
ttccttccccgttgtgaatctcagt

SEQ ID NO: 71682 - DNA, 25 bp, Homo sapien
tccttccccgttgtgaatctcagtt

SEQ ID NO: 71683 - DNA, 25 bp, Homo sapien
ccttccccgttgtgaatctcagttt

SEQ ID NO: 71684 - DNA, 25 bp, Homo sapien
ttgtgaatctcagttttgggacggg

SEQ ID NO: 71685 - DNA, 25 bp, Homo sapien
tgctggtctcctggacctaccagga

SEQ ID NO: 71686 - DNA, 25 bp, Homo sapien
ctggacctaccaggacgaggagctg

SEQ ID NO: 71687 - DNA, 25 bp, Homo sapien
ggagcttcctcacatctctgctgaa

SEQ ID NO: 71688 - DNA, 25 bp, Homo sapien
catctctgctgaagaagggcctccc

SEQ ID NO: 71689 - DNA, 25 bp, Homo sapien
agaccctgggcctgcacttcaggac

SEQ ID NO: 71690 - DNA, 25 bp, Homo sapien
gcacttcaggactgtgggtgccctg

SEQ ID NO: 71691 - DNA, 25 bp, Homo sapien
gtgccctgggtgaacagaccctgca

SEQ ID NO: 71692 - DNA, 25 bp, Homo sapien
ggtgaacagaccctgcaggtcccat

SEQ ID NO: 71693 - DNA, 25 bp, Homo sapien
gggacagaggccttgtgtcacctgc

SEQ ID NO: 71694 - DNA, 25 bp, Homo sapien
tgcccaggcagctgtttgcagctga

SEQ ID NO: 71695 - DNA, 25 bp, Homo sapien
aacaaactggtctcctagacagcag

SEQ ID NO: 71696 - DNA, 25 bp, Homo sapien
aagtggtctgaattctggaatcaca

SEQ ID NO: 71697 - DNA, 25 bp, Homo sapien
ttctggaatcacaaaccaagccatg

SEQ ID NO: 71698 - DNA, 25 bp, Homo sapien
ctggtgggccattaatggttggaaa

SEQ ID NO: 71699 - DNA, 25 bp, Homo sapien
gggctttgccagagcgtgctttcaa

SEQ ID NO: 71700 - DNA, 25 bp, Homo sapien
gagcgtgctttcaagtgtcctggaa

SEQ ID NO: 71701 - DNA, 25 bp, Homo sapien
tttcaagtgtcctggaaagtctgct

SEQ ID NO: 71702 - DNA, 25 bp, Homo sapien
tgctgcttctccaagctttcagaca

SEQ ID NO: 71703 - DNA, 25 bp, Homo sapien
aagaatgtgcactctctgcttaggt

SEQ ID NO: 71704 - DNA, 25 bp, Homo sapien
ctctgatttccttctgctatgacaa

SEQ ID NO: 71705 - DNA, 25 bp, Homo sapien
gatttccttctgctatgacaaaacc

SEQ ID NO: 71706 - DNA, 25 bp, Homo sapien
tgacaaaacctttaatctgcacctt

SEQ ID NO: 71707 - DNA, 25 bp, Homo sapien
accacacctggctatgtttgatgtt

SEQ ID NO: 71708 - DNA, 25 bp, Homo sapien
ccacacctggctatgtttgatgttg

SEQ ID NO: 71709 - DNA, 25 bp, Homo sapien
cacacctggctatgtttgatgttgt

SEQ ID NO: 71710 - DNA, 25 bp, Homo sapien
acacctggctatgtttgatgttgtt

SEQ ID NO: 71711 - DNA, 25 bp, Homo sapien
cacctggctatgtttgatgttgttg

SEQ ID NO: 71712 - DNA, 25 bp, Homo sapien
acctggctatgtttgatgttgttgt

SEQ ID NO: 71713 - DNA, 25 bp, Homo sapien
cctggctatgtttgatgttgttgtt

SEQ ID NO: 71714 - DNA, 25 bp, Homo sapien
gtagagatgagatgtttcccaggct

SEQ ID NO: 71715 - DNA, 25 bp, Homo sapien
tagagatgagatgtttcccaggctg

SEQ ID NO: 71716 - DNA, 25 bp, Homo sapien
agagatgagatgtttcccaggctgg

SEQ ID NO: 71717 - DNA, 25 bp, Homo sapien
ggtgtgagtcatggcacccagcatt

SEQ ID NO: 71718 - DNA, 25 bp, Homo sapien
ctggtgctgtgcttcccgtgaggac

SEQ ID NO: 71719 - DNA, 25 bp, Homo sapien
tggtgctgtgcttcccgtgaggacc

SEQ ID NO: 71720 - DNA, 25 bp, Homo sapien
ggtgctgtgcttcccgtgaggaccc

SEQ ID NO: 71721 - DNA, 25 bp, Homo sapien
gtgctgtgcttcccgtgaggaccca

SEQ ID NO: 71722 - DNA, 25 bp, Homo sapien
tgctgtgcttcccgtgaggacccag

SEQ ID NO: 71723 - DNA, 25 bp, Homo sapien
gctgtgcttcccgtgaggacccagg

SEQ ID NO: 71724 - DNA, 25 bp, Homo sapien
ctgtgcttcccgtgaggacccagga

SEQ ID NO: 71725 - DNA, 25 bp, Homo sapien
tgcttcccgtgaggacccaggaccc

SEQ ID NO: 71726 - DNA, 25 bp, Homo sapien
cgtgaggacccaggaccccttcctg

SEQ ID NO: 71727 - DNA, 25 bp, Homo sapien
atacatgatcctcaactgctaacag

SEQ ID NO: 71728 - DNA, 25 bp, Homo sapien
gctaacagagagagctttacatcat

SEQ ID NO: 71729 - DNA, 25 bp, Homo sapien
ttacattgattccttccgctttgga

SEQ ID NO: 71730 - DNA, 25 bp, Homo sapien
cctcatgctggtggaggcattggat

SEQ ID NO: 71731 - DNA, 25 bp, Homo sapien
ggcattggattggaacgagttacta

SEQ ID NO: 71732 - DNA, 25 bp, Homo sapien
acgagttactatgctgtttctggga

SEQ ID NO: 71733 - DNA, 25 bp, Homo sapien
gtttctgggattgcataatgttcgt

SEQ ID NO: 71734 - DNA, 25 bp, Homo sapien
taatgttcgtcagacctccatgttc

SEQ ID NO: 71735 - DNA, 25 bp, Homo sapien
catgttccctcgtgatcccaaacga

SEQ ID NO: 71736 - DNA, 25 bp, Homo sapien
aaacgactcactccttaaattcaca

SEQ ID NO: 71737 - DNA, 25 bp, Homo sapien
tttgccacttaactccagtgtggat

SEQ ID NO: 71738 - DNA, 25 bp, Homo sapien
tgggaactctgacaagggctgacct

SEQ ID NO: 71739 - DNA, 25 bp, Homo sapien
tgcctctcacacacatagattaatg

SEQ ID NO: 71740 - DNA, 25 bp, Homo sapien
ttttagagactatggagcctggcac

SEQ ID NO: 71741 - DNA, 25 bp, Homo sapien
atggagcctggcacaggactgactc

SEQ ID NO: 71742 - DNA, 25 bp, Homo sapien
aggactgactctgggatgctcctag

SEQ ID NO: 71743 - DNA, 25 bp, Homo sapien
atgctcctagtttgacctcacagtg

SEQ ID NO: 71744 - DNA, 25 bp, Homo sapien
ataccatcaggcctaatctcatacc

SEQ ID NO: 71745 - DNA, 25 bp, Homo sapien
tcatacctctgaccaacaggctgtt

SEQ ID NO: 71746 - DNA, 25 bp, Homo sapien
accaacaggctgttctgcactgaaa

SEQ ID NO: 71747 - DNA, 25 bp, Homo sapien
gttctgcactgaaaaggttcttcat

SEQ ID NO: 71748 - DNA, 25 bp, Homo sapien
tccttccttacccaaactgttcaag

SEQ ID NO: 71749 - DNA, 25 bp, Homo sapien
tttataaactgaagccaactgtgaa

SEQ ID NO: 71750 - DNA, 25 bp, Homo sapien
ttataaactgaagccaactgtgaat

SEQ ID NO: 71751 - DNA, 25 bp, Homo sapien
ataaactgaagccaactgtgaataa

SEQ ID NO: 71752 - DNA, 25 bp, Homo sapien
taaactgaagccaactgtgaataaa

SEQ ID NO: 71753 - DNA, 25 bp, Homo sapien
aaactgaagccaactgtgaataaac

SEQ ID NO: 71754 - DNA, 25 bp, Homo sapien
aactgaagccaactgtgaataaact

SEQ ID NO: 71755 - DNA, 25 bp, Homo sapien
actgaagccaactgtgaataaactg

SEQ ID NO: 71756 - DNA, 25 bp, Homo sapien
ctgaagccaactgtgaataaactgt

SEQ ID NO: 71757 - DNA, 25 bp, Homo sapien
tgaagccaactgtgaataaactgta

SEQ ID NO: 71758 - DNA, 25 bp, Homo sapien
gaagccaactgtgaataaactgtag

SEQ ID NO: 71759 - DNA, 25 bp, Homo sapien
aagccaactgtgaataaactgtagc

SEQ ID NO: 71760 - DNA, 25 bp, Homo sapien
attgagggctattctggtgctgaca

SEQ ID NO: 71761 - DNA, 25 bp, Homo sapien
ggtgctgacatcactaatgtttgca

SEQ ID NO: 71762 - DNA, 25 bp, Homo sapien
agggatgcctctttaatggcaatga

SEQ ID NO: 71763 - DNA, 25 bp, Homo sapien
atgagacggcgtatcaatggcttaa

SEQ ID NO: 71764 - DNA, 25 bp, Homo sapien
agtccagaagaaatccgtgcacttt

SEQ ID NO: 71765 - DNA, 25 bp, Homo sapien
gaaatccgtgcactttctaaagagg

SEQ ID NO: 71766 - DNA, 25 bp, Homo sapien
gatgcctgttaccaaaggagacttt

SEQ ID NO: 71767 - DNA, 25 bp, Homo sapien
ggagactttgaattggccctaaaga

SEQ ID NO: 71768 - DNA, 25 bp, Homo sapien
aaattgctaagtctgtctctgctgc

SEQ ID NO: 71769 - DNA, 25 bp, Homo sapien
tgcttgaatttctgtcagctcttta

SEQ ID NO: 71770 - DNA, 25 bp, Homo sapien
ctgtcagctctttaatttctggtat

SEQ ID NO: 71771 - DNA, 25 bp, Homo sapien
ggtgagagcccaagttatctttccc

SEQ ID NO: 71772 - DNA, 25 bp, Homo sapien
ttatctttccctcttcggtgttctt

SEQ ID NO: 71773 - DNA, 25 bp, Homo sapien
tgcttctgtagcttctaatgttccc

SEQ ID NO: 71774 - DNA, 25 bp, Homo sapien
tttcctgccgagtgctctgatgcaa

SEQ ID NO: 71775 - DNA, 25 bp, Homo sapien
tgctctgatgcaatagtggaaatcg

SEQ ID NO: 71776 - DNA, 25 bp, Homo sapien
aatcgcttatatgtccttgggttgc

SEQ ID NO: 71777 - DNA, 25 bp, Homo sapien
ccttgggttgctggttggattaatc

SEQ ID NO: 71778 - DNA, 25 bp, Homo sapien
gaattgtagactgatgttttagcat

SEQ ID NO: 71779 - DNA, 25 bp, Homo sapien
gttttagcatttttccaacacacac

SEQ ID NO: 71780 - DNA, 25 bp, Homo sapien
gcatttttccaacacacacaacgta

SEQ ID NO: 71781 - DNA, 25 bp, Homo sapien
aaaaagtgcatgatggtgagagccc

SEQ ID NO: 71782 - DNA, 25 bp, Homo sapien
tgaggtcacacctcgggcacctgga

SEQ ID NO: 71783 - DNA, 25 bp, Homo sapien
tgggaggccccacacgaaagactct

SEQ ID NO: 71784 - DNA, 25 bp, Homo sapien
cccacacgaaagactcttaccattt

SEQ ID NO: 71785 - DNA, 25 bp, Homo sapien
ttattaaaaacgcaaggacctcaga

SEQ ID NO: 71786 - DNA, 25 bp, Homo sapien
gcaaggacctcagagacgttctttt

SEQ ID NO: 71787 - DNA, 25 bp, Homo sapien
ggacctcagagacgttcttttctgt

SEQ ID NO: 71788 - DNA, 25 bp, Homo sapien
gagacgttcttttctgtatggaccc

SEQ ID NO: 71789 - DNA, 25 bp, Homo sapien
gacgttcttttctgtatggaccctt

SEQ ID NO: 71790 - DNA, 25 bp, Homo sapien
ttcttttctgtatggacccttcctg

SEQ ID NO: 71791 - DNA, 25 bp, Homo sapien
acccttcctgccatttgtattttgt

SEQ ID NO: 71792 - DNA, 25 bp, Homo sapien
atttgtattttgtcccagagagaaa

SEQ ID NO: 71793 - DNA, 25 bp, Homo sapien
acagtgcctttttcatcagttgcat

SEQ ID NO: 71794 - DNA, 25 bp, Homo sapien
tttcatcagttgcattttccaggct

SEQ ID NO: 71795 - DNA, 25 bp, Homo sapien
gcattttccaggctgagagctgtat

SEQ ID NO: 71796 - DNA, 25 bp, Homo sapien
aaaacattttggactgtgaccatgt

SEQ ID NO: 71797 - DNA, 25 bp, Homo sapien
gtgaccatgtaccttcctttttaag

SEQ ID NO: 71798 - DNA, 25 bp, Homo sapien
gttaggagggacagacagctcttcc

SEQ ID NO: 71799 - DNA, 25 bp, Homo sapien
tcggagcctggctagtctaggacat

SEQ ID NO: 71800 - DNA, 25 bp, Homo sapien
agtctaggacatcaccttgctgtgt

SEQ ID NO: 71801 - DNA, 25 bp, Homo sapien
cctgaacgtgtgacagggtcctatg

SEQ ID NO: 71802 - DNA, 25 bp, Homo sapien
tcctatggtgttactcaaagctgtg

SEQ ID NO: 71803 - DNA, 25 bp, Homo sapien
agctgtgcagggtaaatgatgacat

SEQ ID NO: 71804 - DNA, 25 bp, Homo sapien
ggagaatgaggttctgtgttttgaa

SEQ ID NO: 71805 - DNA, 25 bp, Homo sapien
agaatgaggttctgtgttttgaagg

SEQ ID NO: 71806 - DNA, 25 bp, Homo sapien
gaagaatatcagaattggtagacat

SEQ ID NO: 71807 - DNA, 25 bp, Homo sapien
cagaattggtagacatttcaaactg

SEQ ID NO: 71808 - DNA, 25 bp, Homo sapien
caaactgtcacattagggatacaaa

SEQ ID NO: 71809 - DNA, 25 bp, Homo sapien
aactgtcacattagggatacaaaaa

SEQ ID NO: 71810 - DNA, 25 bp, Homo sapien
tacaaaaatgaacaggctgggagtg

SEQ ID NO: 71811 - DNA, 25 bp, Homo sapien
accaggagttcagtactaacctggg

SEQ ID NO: 71812 - DNA, 25 bp, Homo sapien
acaaagaggcccctgtctctgataa

SEQ ID NO: 71813 - DNA, 25 bp, Homo sapien
caaagaggcccctgtctctgataaa

SEQ ID NO: 71814 - DNA, 25 bp, Homo sapien
aaagaggcccctgtctctgataaaa

SEQ ID NO: 71815 - DNA, 25 bp, Homo sapien
agctgacactaagtttttcctgttc

SEQ ID NO: 71816 - DNA, 25 bp, Homo sapien
gtttttcctgttctgggttaatcat

SEQ ID NO: 71817 - DNA, 25 bp, Homo sapien
gcaaaggcagtgagtgtcaactatc

SEQ ID NO: 71818 - DNA, 25 bp, Homo sapien
tggctgagagagacccgtttccttt

SEQ ID NO: 71819 - DNA, 25 bp, Homo sapien
ccgtttcctttcagggatgtggaca

SEQ ID NO: 71820 - DNA, 25 bp, Homo sapien
gtaagggcagcaagcatggttctgt

SEQ ID NO: 71821 - DNA, 25 bp, Homo sapien
gaagactaaggacctgaccacccat

SEQ ID NO: 71822 - DNA, 25 bp, Homo sapien
ttcagcatcttcaatgtggagcagt

SEQ ID NO: 71823 - DNA, 25 bp, Homo sapien
ggagcagtgttctgaggactcttct

SEQ ID NO: 71824 - DNA, 25 bp, Homo sapien
gaggactcttctatcctaggactat

SEQ ID NO: 71825 - DNA, 25 bp, Homo sapien
tctatcctaggactatgacagtgtg

SEQ ID NO: 71826 - DNA, 25 bp, Homo sapien
tgggcctagcccagagtagtgcttg

SEQ ID NO: 71827 - DNA, 25 bp, Homo sapien
ctagcccagagtagtgcttgctccc

SEQ ID NO: 71828 - DNA, 25 bp, Homo sapien
gaggcagcagactcaggccctccat

SEQ ID NO: 71829 - DNA, 25 bp, Homo sapien
aggccctccatggtcctctttgtca

SEQ ID NO: 71830 - DNA, 25 bp, Homo sapien
gtcattttgttgacatgcattcctc

SEQ ID NO: 71831 - DNA, 25 bp, Homo sapien
gacatgcattcctccttttgtcatc

SEQ ID NO: 71832 - DNA, 25 bp, Homo sapien
ggattaaccaaaggccaccctgact

SEQ ID NO: 71833 - DNA, 25 bp, Homo sapien
aggccaccctgactttgtttttgtg

SEQ ID NO: 71834 - DNA, 25 bp, Homo sapien
tgtggacacacaataaaagccccgt

SEQ ID NO: 71835 - DNA, 25 bp, Homo sapien
gacacacaataaaagccccgtttat

SEQ ID NO: 71836 - DNA, 25 bp, Homo sapien
ttggggaagtcctggctgactgcct

SEQ ID NO: 71837 - DNA, 25 bp, Homo sapien
ttggcagggctgtggtccctttgaa

SEQ ID NO: 71838 - DNA, 25 bp, Homo sapien
agaatccttccttggctctttttag

SEQ ID NO: 71839 - DNA, 25 bp, Homo sapien
gaatccttccttggctctttttagc

SEQ ID NO: 71840 - DNA, 25 bp, Homo sapien
ccttggctctttttagcttgtggcg

SEQ ID NO: 71841 - DNA, 25 bp, Homo sapien
tggctctttttagcttgtggcggca

SEQ ID NO: 71842 - DNA, 25 bp, Homo sapien
gctctttttagcttgtggcggcagt

SEQ ID NO: 71843 - DNA, 25 bp, Homo sapien
ctctttttagcttgtggcggcagtg

SEQ ID NO: 71844 - DNA, 25 bp, Homo sapien
agcttgtggcggcagtgggcagtcc

SEQ ID NO: 71845 - DNA, 25 bp, Homo sapien
agtgggcagtccgtggcattcccca

SEQ ID NO: 71846 - DNA, 25 bp, Homo sapien
gtgggcagtccgtggcattccccag

SEQ ID NO: 71847 - DNA, 25 bp, Homo sapien
ttgatccttattaattaaacctgca

SEQ ID NO: 71848 - DNA, 25 bp, Homo sapien
caacagagtgagacttaatcttgaa

SEQ ID NO: 71849 - DNA, 25 bp, Homo sapien
aacagagtgagacttaatcttgaaa

SEQ ID NO: 71850 - DNA, 25 bp, Homo sapien
acagagtgagacttaatcttgaaaa

SEQ ID NO: 71851 - DNA, 25 bp, Homo sapien
cagagtgagacttaatcttgaaaaa

SEQ ID NO: 71852 - DNA, 25 bp, Homo sapien
agagtgagacttaatcttgaaaaat

SEQ ID NO: 71853 - DNA, 25 bp, Homo sapien
gagtgagacttaatcttgaaaaata

SEQ ID NO: 71854 - DNA, 25 bp, Homo sapien
agtgagacttaatcttgaaaaataa

SEQ ID NO: 71855 - DNA, 25 bp, Homo sapien
gtgagacttaatcttgaaaaataaa

SEQ ID NO: 71856 - DNA, 25 bp, Homo sapien
tgagacttaatcttgaaaaataaat

SEQ ID NO: 71857 - DNA, 25 bp, Homo sapien
gagacttaatcttgaaaaataaata

SEQ ID NO: 71858 - DNA, 25 bp, Homo sapien
gtacatggaggccaacaagaacata

SEQ ID NO: 71859 - DNA, 25 bp, Homo sapien
agaacataggcaagatcgtcctgga

SEQ ID NO: 71860 - DNA, 25 bp, Homo sapien
aggcaagatcgtcctggaactgccc

SEQ ID NO: 71861 - DNA, 25 bp, Homo sapien
gagaagattcacaatagacaggcca

SEQ ID NO: 71862 - DNA, 25 bp, Homo sapien
agacaggccaagaaacccggtgctt

SEQ ID NO: 71863 - DNA, 25 bp, Homo sapien
caagaaacccggtgcttcctccaga

SEQ ID NO: 71864 - DNA, 25 bp, Homo sapien
tcctccagagccgtttaaagctgat

SEQ ID NO: 71865 - DNA, 25 bp, Homo sapien
aaattctgcctcacttctccacgga

SEQ ID NO: 71866 - DNA, 25 bp, Homo sapien
gtctgctgccggttctggacagaat

SEQ ID NO: 71867 - DNA, 25 bp, Homo sapien
ggacagaatctacccagtgaccgaa

SEQ ID NO: 71868 - DNA, 25 bp, Homo sapien
acagaatctacccagtgaccgaaat

SEQ ID NO: 71869 - DNA, 25 bp, Homo sapien
ttacgcctgataggtaaacaaatca

SEQ ID NO: 71870 - DNA, 25 bp, Homo sapien
ggtaaacaaatcatactccccagtc

SEQ ID NO: 71871 - DNA, 25 bp, Homo sapien
aatcatactccccagtcaagacttc

SEQ ID NO: 71872 - DNA, 25 bp, Homo sapien
ctgacagtcccactacgagaaagct

SEQ ID NO: 71873 - DNA, 25 bp, Homo sapien
cactacgagaaagctgtggtgggac

SEQ ID NO: 71874 - DNA, 25 bp, Homo sapien
tggtgggacagccaagtactcgttt

SEQ ID NO: 71875 - DNA, 25 bp, Homo sapien
ggacagccaagtactcgtttccaca

SEQ ID NO: 71876 - DNA, 25 bp, Homo sapien
aagtactcgtttccacaccaagact

SEQ ID NO: 71877 - DNA, 25 bp, Homo sapien
ttccacaccaagactcagacttttt

SEQ ID NO: 71878 - DNA, 25 bp, Homo sapien
agactcagactttttgagccaaaaa

SEQ ID NO: 71879 - DNA, 25 bp, Homo sapien
ttgagccaaaaaaaagccacattct

SEQ ID NO: 71880 - DNA, 25 bp, Homo sapien
ggccgtgcggagattcaaggaccta

SEQ ID NO: 71881 - DNA, 25 bp, Homo sapien
gattcaaggacctaagcttccagga

SEQ ID NO: 71882 - DNA, 25 bp, Homo sapien
gacctaagcttccaggaggagtaca

SEQ ID NO: 71883 - DNA, 25 bp, Homo sapien
tgcagaggccggcagccctgtatca

SEQ ID NO: 71884 - DNA, 25 bp, Homo sapien
tatcacccctggcagtgaggtggca

SEQ ID NO: 71885 - DNA, 25 bp, Homo sapien
gcaggagcagcctagtgccagaaat

SEQ ID NO: 71886 - DNA, 25 bp, Homo sapien
agaaatgtccaagatgccagggcat

SEQ ID NO: 71887 - DNA, 25 bp, Homo sapien
gaaccaattcaggttctccactgac

SEQ ID NO: 71888 - DNA, 25 bp, Homo sapien
tcaggttctccactgactcattcat

SEQ ID NO: 71889 - DNA, 25 bp, Homo sapien
tccttcattgattcttcatgcgttc

SEQ ID NO: 71890 - DNA, 25 bp, Homo sapien
ttgattcttcatgcgttcattcatt

SEQ ID NO: 71891 - DNA, 25 bp, Homo sapien
tggagtgtttccagtgcacctgtag

SEQ ID NO: 71892 - DNA, 25 bp, Homo sapien
caactagacttctctcctggttagt

SEQ ID NO: 71893 - DNA, 25 bp, Homo sapien
tggttagtccagctctttactctaa

SEQ ID NO: 71894 - DNA, 25 bp, Homo sapien
cagctctttactctaaaccctttct

SEQ ID NO: 71895 - DNA, 25 bp, Homo sapien
ccctttctgtccaaaatgagtcatt

SEQ ID NO: 71896 - DNA, 25 bp, Homo sapien
attttcagttgtaccttagatgtct

SEQ ID NO: 71897 - DNA, 25 bp, Homo sapien
gttgtaccttagatgtctggtgttg

SEQ ID NO: 71898 - DNA, 25 bp, Homo sapien
ttgaggatcaagtgccatagccttt

SEQ ID NO: 71899 - DNA, 25 bp, Homo sapien
tcaagtgccatagcctttattcagg

SEQ ID NO: 71900 - DNA, 25 bp, Homo sapien
ggcctataaacccttccagttcttg

SEQ ID NO: 71901 - DNA, 25 bp, Homo sapien
agggctggcctgctagcgcttcaaa

SEQ ID NO: 71902 - DNA, 25 bp, Homo sapien
aggaacacagggacaaggtccggca

SEQ ID NO: 71903 - DNA, 25 bp, Homo sapien
acagggacaaggtccggcagagcct

SEQ ID NO: 71904 - DNA, 25 bp, Homo sapien
ggacaaggtccggcagagccttcag

SEQ ID NO: 71905 - DNA, 25 bp, Homo sapien
agcagcatcataaggaggcgaaggc

SEQ ID NO: 71906 - DNA, 25 bp, Homo sapien
agcatcataaggaggcgaaggccaa

SEQ ID NO: 71907 - DNA, 25 bp, Homo sapien
taaggaggcgaaggccaagcccacg

SEQ ID NO: 71908 - DNA, 25 bp, Homo sapien
agtctctccccaagatcacctgtag

SEQ ID NO: 71909 - DNA, 25 bp, Homo sapien
tctccccaagatcacctgtagggaa

SEQ ID NO: 71910 - DNA, 25 bp, Homo sapien
tccccaagatcacctgtagggaaat

SEQ ID NO: 71911 - DNA, 25 bp, Homo sapien
caagatcacctgtagggaaatgagt

SEQ ID NO: 71912 - DNA, 25 bp, Homo sapien
aactgggggtggacagctgtctcct

SEQ ID NO: 71913 - DNA, 25 bp, Homo sapien
ttggcaacttgcttcctctctgtca

SEQ ID NO: 71914 - DNA, 25 bp, Homo sapien
agagacatcctgaacctcacccaga

SEQ ID NO: 71915 - DNA, 25 bp, Homo sapien
ccagaccacacacttagtaggtgct

SEQ ID NO: 71916 - DNA, 25 bp, Homo sapien
cttagtaggtgctcagaagatgtac

SEQ ID NO: 71917 - DNA, 25 bp, Homo sapien
ggtgctcagaagatgtacctggaga

SEQ ID NO: 71918 - DNA, 25 bp, Homo sapien
gtacctggagagacaacaaccctat

SEQ ID NO: 71919 - DNA, 25 bp, Homo sapien
gagagacaacaaccctatccaacaa

SEQ ID NO: 71920 - DNA, 25 bp, Homo sapien
caacagctttcccagtgatgaaatc

SEQ ID NO: 71921 - DNA, 25 bp, Homo sapien
ttcccagtgatgaaatccagagatg

SEQ ID NO: 71922 - DNA, 25 bp, Homo sapien
tccagagatggcttgtatatgtgtg

SEQ ID NO: 71923 - DNA, 25 bp, Homo sapien
ataaaatatcagcagtagacacaaa

SEQ ID NO: 71924 - DNA, 25 bp, Homo sapien
gaaatgcattgtgctgatgttcttg

SEQ ID NO: 71925 - DNA, 25 bp, Homo sapien
gggcggagggatttctctttcctga

SEQ ID NO: 71926 - DNA, 25 bp, Homo sapien
tctttcctgagctcaccaaacttat

SEQ ID NO: 71927 - DNA, 25 bp, Homo sapien
gagctcaccaaacttattccagtgt

SEQ ID NO: 71928 - DNA, 25 bp, Homo sapien
attccagtgttgatcgcaagctgtt

SEQ ID NO: 71929 - DNA, 25 bp, Homo sapien
caagctgttgatgcacaggcgtctt

SEQ ID NO: 71930 - DNA, 25 bp, Homo sapien
acaggcgtcttgtggcaagcccagc

SEQ ID NO: 71931 - DNA, 25 bp, Homo sapien
gtacacatgctggtgtgttttccaa

SEQ ID NO: 71932 - DNA, 25 bp, Homo sapien
gtgtgttttccaatggccagtgata

SEQ ID NO: 71933 - DNA, 25 bp, Homo sapien
tgctgctgtgcttcatattgttgcc

SEQ ID NO: 71934 - DNA, 25 bp, Homo sapien
ttgccttatgggattatacttgaaa

SEQ ID NO: 71935 - DNA, 25 bp, Homo sapien
actgcttccacatgcattgcatcct

SEQ ID NO: 71936 - DNA, 25 bp, Homo sapien
acatgcattgcatcctcaagtggct

SEQ ID NO: 71937 - DNA, 25 bp, Homo sapien
tcaagtggctgcacgcacagcaggt

SEQ ID NO: 71938 - DNA, 25 bp, Homo sapien
aggtgcagcagcactgccccatgtg

SEQ ID NO: 71939 - DNA, 25 bp, Homo sapien
ttcaaggagtgaggcccgacctggc

SEQ ID NO: 71940 - DNA, 25 bp, Homo sapien
tccttcctcatgctggcgccgatgg

SEQ ID NO: 71941 - DNA, 25 bp, Homo sapien
agcgcccctgagctgcaacaaggtg

SEQ ID NO: 71942 - DNA, 25 bp, Homo sapien
acaagggctggagctgcgtttgttt

SEQ ID NO: 71943 - DNA, 25 bp, Homo sapien
agctgcgtttgttttgccatcacta

SEQ ID NO: 71944 - DNA, 25 bp, Homo sapien
gttttgccatcactatgttgacact

SEQ ID NO: 71945 - DNA, 25 bp, Homo sapien
tatgttgacacttttatccaataag

SEQ ID NO: 71946 - DNA, 25 bp, Homo sapien
ttcccctgccctgagtttgtggagg

SEQ ID NO: 71947 - DNA, 25 bp, Homo sapien
aggctgtcggaagtagggactctta

SEQ ID NO: 71948 - DNA, 25 bp, Homo sapien
ttaggagagcccgtgtgccctgttt

SEQ ID NO: 71949 - DNA, 25 bp, Homo sapien
gtgccctgtttggttcagctgtcag

SEQ ID NO: 71950 - DNA, 25 bp, Homo sapien
agctgtcaggcgtgtgccacacaca

SEQ ID NO: 71951 - DNA, 25 bp, Homo sapien
atcttctggtcccataattctccat

SEQ ID NO: 71952 - DNA, 25 bp, Homo sapien
aattctccatggatgggctgctttt

SEQ ID NO: 71953 - DNA, 25 bp, Homo sapien
tgcttttagctccagttttccagta

SEQ ID NO: 71954 - DNA, 25 bp, Homo sapien
gtagaatgcttgagttttccttttt

SEQ ID NO: 71955 - DNA, 25 bp, Homo sapien
aacctgtcatcatcagtactcactg

SEQ ID NO: 71956 - DNA, 25 bp, Homo sapien
cagtactcactgtgttttccacttt

SEQ ID NO: 71957 - DNA, 25 bp, Homo sapien
gaacttaaaaagacaagcgtggcca

SEQ ID NO: 71958 - DNA, 25 bp, Homo sapien
aacttaaaaagacaagcgtggccag

SEQ ID NO: 71959 - DNA, 25 bp, Homo sapien
acttaaaaagacaagcgtggccagg

SEQ ID NO: 71960 - DNA, 25 bp, Homo sapien
cttaaaaagacaagcgtggccaggc

SEQ ID NO: 71961 - DNA, 25 bp, Homo sapien
ttaaaaagacaagcgtggccaggca

SEQ ID NO: 71962 - DNA, 25 bp, Homo sapien
taaaaagacaagcgtggccaggcac

SEQ ID NO: 71963 - DNA, 25 bp, Homo sapien
aaaaagacaagcgtggccaggcaca

SEQ ID NO: 71964 - DNA, 25 bp, Homo sapien
aaaagacaagcgtggccaggcacag

SEQ ID NO: 71965 - DNA, 25 bp, Homo sapien
aaagacaagcgtggccaggcacagt

SEQ ID NO: 71966 - DNA, 25 bp, Homo sapien
aagacaagcgtggccaggcacagtg

SEQ ID NO: 71967 - DNA, 25 bp, Homo sapien
gtggtgagctaagatcacgccattg

SEQ ID NO: 71968 - DNA, 25 bp, Homo sapien
atggccacagctcgaaggggggctt

SEQ ID NO: 71969 - DNA, 25 bp, Homo sapien
tggccacagctcgaaggggggcttt

SEQ ID NO: 71970 - DNA, 25 bp, Homo sapien
ccctgttgtgacctgtccttccgta

SEQ ID NO: 71971 - DNA, 25 bp, Homo sapien
cctgttgtgacctgtccttccgtac

SEQ ID NO: 71972 - DNA, 25 bp, Homo sapien
ctgttgtgacctgtccttccgtact

SEQ ID NO: 71973 - DNA, 25 bp, Homo sapien
tgttgtgacctgtccttccgtactt

SEQ ID NO: 71974 - DNA, 25 bp, Homo sapien
gttgtgacctgtccttccgtactta

SEQ ID NO: 71975 - DNA, 25 bp, Homo sapien
ttgtgacctgtccttccgtacttaa

SEQ ID NO: 71976 - DNA, 25 bp, Homo sapien
tgtgacctgtccttccgtacttaat

SEQ ID NO: 71977 - DNA, 25 bp, Homo sapien
gtgacctgtccttccgtacttaata

SEQ ID NO: 71978 - DNA, 25 bp, Homo sapien
tgacctgtccttccgtacttaataa

SEQ ID NO: 71979 - DNA, 25 bp, Homo sapien
gatagcagcaaacaatcattggagc

SEQ ID NO: 71980 - DNA, 25 bp, Homo sapien
gcctcccttctacttgtgagttttg

SEQ ID NO: 71981 - DNA, 25 bp, Homo sapien
ctacttgtgagttttgaaattgttc

SEQ ID NO: 71982 - DNA, 25 bp, Homo sapien
attatatgatttgtctgcactcagt

SEQ ID NO: 71983 - DNA, 25 bp, Homo sapien
gcactcagtttattccctactcaaa

SEQ ID NO: 71984 - DNA, 25 bp, Homo sapien
agtttattccctactcaaatctcag

SEQ ID NO: 71985 - DNA, 25 bp, Homo sapien
tctttgttattgtcagaacctggtg

SEQ ID NO: 71986 - DNA, 25 bp, Homo sapien
agaacctggtgagttgttttgaaca

SEQ ID NO: 71987 - DNA, 25 bp, Homo sapien
ccccttcctgtaagacgatgtgact

SEQ ID NO: 71988 - DNA, 25 bp, Homo sapien
gacgatgtgactgcacaagagcact

SEQ ID NO: 71989 - DNA, 25 bp, Homo sapien
ctgcacaagagcactgcagtgtttt

SEQ ID NO: 71990 - DNA, 25 bp, Homo sapien
gaactcattttggtggtggcaagac

SEQ ID NO: 71991 - DNA, 25 bp, Homo sapien
tggtggtggcaagacaactggcttt

SEQ ID NO: 71992 - DNA, 25 bp, Homo sapien
gtggcaagacaactggctttggcat

SEQ ID NO: 71993 - DNA, 25 bp, Homo sapien
tttatgattccctggattatgcaaa

SEQ ID NO: 71994 - DNA, 25 bp, Homo sapien
gattccctggattatgcaaagaaaa

SEQ ID NO: 71995 - DNA, 25 bp, Homo sapien
aatgaacccaaacatagacttgcaa

SEQ ID NO: 71996 - DNA, 25 bp, Homo sapien
tagacttgcaagacatggcctgtat

SEQ ID NO: 71997 - DNA, 25 bp, Homo sapien
cttgcaagacatggcctgtatgaga

SEQ ID NO: 71998 - DNA, 25 bp, Homo sapien
agacatggcctgtatgagaagaaaa

SEQ ID NO: 71999 - DNA, 25 bp, Homo sapien
agacctcaagaaagcaacgaaagga

SEQ ID NO: 72000 - DNA, 25 bp, Homo sapien
gcaacgaaaggaacgcaagaacaga

SEQ ID NO: 72001 - DNA, 25 bp, Homo sapien
cccaagagcatcctaaacgaccagt

SEQ ID NO: 72002 - DNA, 25 bp, Homo sapien
gcatcctaaacgaccagtgctggga

SEQ ID NO: 72003 - DNA, 25 bp, Homo sapien
cagtgctgggactggagtgcccaca

SEQ ID NO: 72004 - DNA, 25 bp, Homo sapien
tgggactggagtgcccacagtcaga

SEQ ID NO: 72005 - DNA, 25 bp, Homo sapien
ggaccaagacaaagcatgggacatg

SEQ ID NO: 72006 - DNA, 25 bp, Homo sapien
tgaacttcttatgggaggctgcagc

SEQ ID NO: 72007 - DNA, 25 bp, Homo sapien
ctgcagctggatcagaggaaaaatc

SEQ ID NO: 72008 - DNA, 25 bp, Homo sapien
aaatccagtgtgacagagtgcaagt

SEQ ID NO: 72009 - DNA, 25 bp, Homo sapien
agtcagaagacctggcttttcatcc

SEQ ID NO: 72010 - DNA, 25 bp, Homo sapien
ggcttttcatcccagctttgaaact

SEQ ID NO: 72011 - DNA, 25 bp, Homo sapien
gaaacttggaactttttgattgaca

SEQ ID NO: 72012 - DNA, 25 bp, Homo sapien
gttctctcctcttttaacaacagtc

SEQ ID NO: 72013 - DNA, 25 bp, Homo sapien
ttctctcctcttttaacaacagtca

SEQ ID NO: 72014 - DNA, 25 bp, Homo sapien
gggcccaccctaatcctgtgtgatc

SEQ ID NO: 72015 - DNA, 25 bp, Homo sapien
ccaccctaatcctgtgtgatcttat

SEQ ID NO: 72016 - DNA, 25 bp, Homo sapien
accctaatcctgtgtgatcttatct

SEQ ID NO: 72017 - DNA, 25 bp, Homo sapien
cctaatcctgtgtgatcttatcttg

SEQ ID NO: 72018 - DNA, 25 bp, Homo sapien
taatcctgtgtgatcttatcttgat

SEQ ID NO: 72019 - DNA, 25 bp, Homo sapien
tcctgtgtgatcttatcttgatcct

SEQ ID NO: 72020 - DNA, 25 bp, Homo sapien
ctgtgtgatcttatcttgatcctta

SEQ ID NO: 72021 - DNA, 25 bp, Homo sapien
gtgtgatcttatcttgatccttatt

SEQ ID NO: 72022 - DNA, 25 bp, Homo sapien
gtgatcttatcttgatccttattaa

SEQ ID NO: 72023 - DNA, 25 bp, Homo sapien
gttactcagtgcaatgtatagcctg

SEQ ID NO: 72024 - DNA, 25 bp, Homo sapien
gtatagcctgagtctatccatgatg

SEQ ID NO: 72025 - DNA, 25 bp, Homo sapien
gagtctatccatgatggctatatcc

SEQ ID NO: 72026 - DNA, 25 bp, Homo sapien
ggctatatccaatttgacatcacgt

SEQ ID NO: 72027 - DNA, 25 bp, Homo sapien
caatttgacatcacgttatggatca

SEQ ID NO: 72028 - DNA, 25 bp, Homo sapien
gtatatcttattcttaacttttgta

SEQ ID NO: 72029 - DNA, 25 bp, Homo sapien
tgtaaaccatgttttatgggtaact

SEQ ID NO: 72030 - DNA, 25 bp, Homo sapien
atcattgttaattttgagttggcag

SEQ ID NO: 72031 - DNA, 25 bp, Homo sapien
ttgagttggcagaggtaaactaacc

SEQ ID NO: 72032 - DNA, 25 bp, Homo sapien
gtaaactaaccaactaccattatgt

SEQ ID NO: 72033 - DNA, 25 bp, Homo sapien
gtactaagggatatacctttcaata

SEQ ID NO: 72034 - DNA, 25 bp, Homo sapien
tcatggatgaggaacacagggacaa

SEQ ID NO: 72035 - DNA, 25 bp, Homo sapien
acagggacaaggtccggcagagcct

SEQ ID NO: 72036 - DNA, 25 bp, Homo sapien
aggtccggcagagccttcagcagca

SEQ ID NO: 72037 - DNA, 25 bp, Homo sapien
agcagcatcataaggaggcgaaggc

SEQ ID NO: 72038 - DNA, 25 bp, Homo sapien
taaggaggcgaaggccaagcccacg

SEQ ID NO: 72039 - DNA, 25 bp, Homo sapien
tgccctggacagatttgtgcgctga

SEQ ID NO: 72040 - DNA, 25 bp, Homo sapien
gtgcgctgagccagactccagggtt

SEQ ID NO: 72041 - DNA, 25 bp, Homo sapien
agtctctccccaagatcacctgtag

SEQ ID NO: 72042 - DNA, 25 bp, Homo sapien
tctccccaagatcacctgtagggaa

SEQ ID NO: 72043 - DNA, 25 bp, Homo sapien
caagatcacctgtagggaaatgagt

SEQ ID NO: 72044 - DNA, 25 bp, Homo sapien
aactgggggtggacagctgtctcct

SEQ ID NO: 72045 - DNA, 25 bp, Homo sapien
tgaaaccaaatccactcacatttcc

SEQ ID NO: 72046 - DNA, 25 bp, Homo sapien
ctcacatttcctatcgggtcttgaa

SEQ ID NO: 72047 - DNA, 25 bp, Homo sapien
tcctatcgggtcttgaaattcttgg

SEQ ID NO: 72048 - DNA, 25 bp, Homo sapien
cgggtcttgaaattcttggtggtgt

SEQ ID NO: 72049 - DNA, 25 bp, Homo sapien
ttggtggtgtgtcaccattccacta

SEQ ID NO: 72050 - DNA, 25 bp, Homo sapien
gtgtcaccattccactagatggcag

SEQ ID NO: 72051 - DNA, 25 bp, Homo sapien
actagatggcagtgttgcttactga

SEQ ID NO: 72052 - DNA, 25 bp, Homo sapien
ggcagtgttgcttactgagtgtcaa

SEQ ID NO: 72053 - DNA, 25 bp, Homo sapien
actgagtgtcaatggcttttttccc

SEQ ID NO: 72054 - DNA, 25 bp, Homo sapien
tttttccccgtaaatggaatcatgt

SEQ ID NO: 72055 - DNA, 25 bp, Homo sapien
aaagtacaataaagctgccttgtct

SEQ ID NO: 72056 - DNA, 25 bp, Homo sapien
gcgggcagtggatagtaagacttac

SEQ ID NO: 72057 - DNA, 25 bp, Homo sapien
acttactgcagtcgatttgggattt

SEQ ID NO: 72058 - DNA, 25 bp, Homo sapien
gatttgctaagtagttttacagagc

SEQ ID NO: 72059 - DNA, 25 bp, Homo sapien
tacagagctagatctgtgtgcatgt

SEQ ID NO: 72060 - DNA, 25 bp, Homo sapien
atatatacatatctagggctagtac

SEQ ID NO: 72061 - DNA, 25 bp, Homo sapien
ggctagtacttagtttcacacccgg

SEQ ID NO: 72062 - DNA, 25 bp, Homo sapien
acttagtttcacacccgggagctgg

SEQ ID NO: 72063 - DNA, 25 bp, Homo sapien
aaaacctgtacagttgtctttctct

SEQ ID NO: 72064 - DNA, 25 bp, Homo sapien
aaaaaatcagcgcacttgcgcgtcc

SEQ ID NO: 72065 - DNA, 25 bp, Homo sapien
caagtgttacttgtgccgggaaaat

SEQ ID NO: 72066 - DNA, 25 bp, Homo sapien
ttgtgccgggaaaattttgctgtct

SEQ ID NO: 72067 - DNA, 25 bp, Homo sapien
ctaaagaacttagatgtcagtgcat

SEQ ID NO: 72068 - DNA, 25 bp, Homo sapien
gtcagtgcataaagacatactccaa

SEQ ID NO: 72069 - DNA, 25 bp, Homo sapien
taaagacatactccaaacctttcca

SEQ ID NO: 72070 - DNA, 25 bp, Homo sapien
ttgagagtggaccacactgcgccaa

SEQ ID NO: 72071 - DNA, 25 bp, Homo sapien
accacactgcgccaacacagaaatt

SEQ ID NO: 72072 - DNA, 25 bp, Homo sapien
ctgcgccaacacagaaattattgta

SEQ ID NO: 72073 - DNA, 25 bp, Homo sapien
aattattgtaaagctttctgatgga

SEQ ID NO: 72074 - DNA, 25 bp, Homo sapien
gaccccaaggaaaactgggtgcaga

SEQ ID NO: 72075 - DNA, 25 bp, Homo sapien
ctctgtgtgaaggtgcagttttgcc

SEQ ID NO: 72076 - DNA, 25 bp, Homo sapien
tgcagttttgccaaggagtgctaaa

SEQ ID NO: 72077 - DNA, 25 bp, Homo sapien
tttgccaaggagtgctaaagaactt

SEQ ID NO: 72078 - DNA, 25 bp, Homo sapien
tctgatggcacttttgagctcctaa

SEQ ID NO: 72079 - DNA, 25 bp, Homo sapien
tttgagctcctaagctgccagcctt

SEQ ID NO: 72080 - DNA, 25 bp, Homo sapien
ttcccttcttttcctgggtgctcag

SEQ ID NO: 72081 - DNA, 25 bp, Homo sapien
ggtgctcagggcatgcttattagca

SEQ ID NO: 72082 - DNA, 25 bp, Homo sapien
ttattagcagctgggttggtatgga

SEQ ID NO: 72083 - DNA, 25 bp, Homo sapien
ttggcagacaggatgttcaacttaa

SEQ ID NO: 72084 - DNA, 25 bp, Homo sapien
gaaatacagctaaggccttgccagc

SEQ ID NO: 72085 - DNA, 25 bp, Homo sapien
ttgccagcaacacctgccgtaagtt

SEQ ID NO: 72086 - DNA, 25 bp, Homo sapien
acacctgccgtaagttactggctga

SEQ ID NO: 72087 - DNA, 25 bp, Homo sapien
aagttactggctgagtgagggcata

SEQ ID NO: 72088 - DNA, 25 bp, Homo sapien
ggttactgtttttatcctctatcct

SEQ ID NO: 72089 - DNA, 25 bp, Homo sapien
gctggtgtgttgacagatatggaaa

SEQ ID NO: 72090 - DNA, 25 bp, Homo sapien
ggaaatgaagtcatgggatccagaa

SEQ ID NO: 72091 - DNA, 25 bp, Homo sapien
gggatccagaataaatggtgttgca

SEQ ID NO: 72092 - DNA, 25 bp, Homo sapien
aatggtgttgcagattgtgctatag

SEQ ID NO: 72093 - DNA, 25 bp, Homo sapien
gctatagattttgagatctccggag

SEQ ID NO: 72094 - DNA, 25 bp, Homo sapien
gatctccggagattttgctagtggc

SEQ ID NO: 72095 - DNA, 25 bp, Homo sapien
gagattttgctagtggcgattttca

SEQ ID NO: 72096 - DNA, 25 bp, Homo sapien
gctagtggcgattttcatgaatgga

SEQ ID NO: 72097 - DNA, 25 bp, Homo sapien
gtggtgatgaccatgatgtatacat

SEQ ID NO: 72098 - DNA, 25 bp, Homo sapien
gaccatgatgtatacatttgattga

SEQ ID NO: 72099 - DNA, 25 bp, Homo sapien
tacatttgattgatgacagttgaaa

SEQ ID NO: 72100 - DNA, 25 bp, Homo sapien
cggttgggtctcttggctctggcct

SEQ ID NO: 72101 - DNA, 25 bp, Homo sapien
tggcctgctcagacgggaaagtact

SEQ ID NO: 72102 - DNA, 25 bp, Homo sapien
aagtactgctattcagtctacccca

SEQ ID NO: 72103 - DNA, 25 bp, Homo sapien
gtgaagcctgccatatataaggtac

SEQ ID NO: 72104 - DNA, 25 bp, Homo sapien
ggtacaatgtgtggcaactctgcag

SEQ ID NO: 72105 - DNA, 25 bp, Homo sapien
tatgcaagctacagacccctctgag

SEQ ID NO: 72106 - DNA, 25 bp, Homo sapien
cctctgagtgtggtcagtgccttag

SEQ ID NO: 72107 - DNA, 25 bp, Homo sapien
gtcagtgccttagcctggcctggat

SEQ ID NO: 72108 - DNA, 25 bp, Homo sapien
ttagcctggcctggatgcctaccag

SEQ ID NO: 72109 - DNA, 25 bp, Homo sapien
caccaacacctagctgctggatatt

SEQ ID NO: 72110 - DNA, 25 bp, Homo sapien
acctagctgctggatattataatgg

SEQ ID NO: 72111 - DNA, 25 bp, Homo sapien
aagacttgtgatgctctggggcttc

SEQ ID NO: 72112 - DNA, 25 bp, Homo sapien
tgctctggggcttctgtggccaagc

SEQ ID NO: 72113 - DNA, 25 bp, Homo sapien
tttcctggtcatggtacccgtacag

SEQ ID NO: 72114 - DNA, 25 bp, Homo sapien
acccgtacagcgttgatggccacag

SEQ ID NO: 72115 - DNA, 25 bp, Homo sapien
cgtgtccccctgtgcggtcagtgtt

SEQ ID NO: 72116 - DNA, 25 bp, Homo sapien
agtgttttcagtaccacctctctcc

SEQ ID NO: 72117 - DNA, 25 bp, Homo sapien
tctcccgtgcccacttggctattta

SEQ ID NO: 72118 - DNA, 25 bp, Homo sapien
ccgtgcccacttggctatttactta

SEQ ID NO: 72119 - DNA, 25 bp, Homo sapien
tatttattgtgtgccagtgatggtg

SEQ ID NO: 72120 - DNA, 25 bp, Homo sapien
ccgtacttaataaagtgcgcgtggg

SEQ ID NO: 72121 - DNA, 25 bp, Homo sapien
taaagtgcgcgtgggagtgttaaaa

SEQ ID NO: 72122 - DNA, 25 bp, Homo sapien
gcttgcccaaagcaataatctttcc

SEQ ID NO: 72123 - DNA, 25 bp, Homo sapien
tgcccaaagcaataatctttcctaa

SEQ ID NO: 72124 - DNA, 25 bp, Homo sapien
tctttcctaaagaagtgcttggctg

SEQ ID NO: 72125 - DNA, 25 bp, Homo sapien
tttcctaaagaagtgcttggctggg

SEQ ID NO: 72126 - DNA, 25 bp, Homo sapien
atatagtgaggctcccatctgtact

SEQ ID NO: 72127 - DNA, 25 bp, Homo sapien
tatagtgaggctcccatctgtacta

SEQ ID NO: 72128 - DNA, 25 bp, Homo sapien
tagtgaggctcccatctgtactaaa

SEQ ID NO: 72129 - DNA, 25 bp, Homo sapien
aaaaagttaggcgtggcgatgtgca

SEQ ID NO: 72130 - DNA, 25 bp, Homo sapien
aaagttaggcgtggcgatgtgcacc

SEQ ID NO: 72131 - DNA, 25 bp, Homo sapien
gttaggcgtggcgatgtgcacctgt

SEQ ID NO: 72132 - DNA, 25 bp, Homo sapien
ccaaacctggggagagagctagact

SEQ ID NO: 72133 - DNA, 25 bp, Homo sapien
ccttatttatcaacatctttttcct

SEQ ID NO: 72134 - DNA, 25 bp, Homo sapien
caatgtttcagaagccccatttgca

SEQ ID NO: 72135 - DNA, 25 bp, Homo sapien
gccccatttgcacaggttttcagca

SEQ ID NO: 72136 - DNA, 25 bp, Homo sapien
gcacaggttttcagcaactcagaat

SEQ ID NO: 72137 - DNA, 25 bp, Homo sapien
actcagaatgctctacttctttttc

SEQ ID NO: 72138 - DNA, 25 bp, Homo sapien
aggattaagatacactcctgctgtg

SEQ ID NO: 72139 - DNA, 25 bp, Homo sapien
gtgtttgtgtggatacccagtccca

SEQ ID NO: 72140 - DNA, 25 bp, Homo sapien
tgtgtggatacccagtcccagaacc

SEQ ID NO: 72141 - DNA, 25 bp, Homo sapien
cacactgttgagttggacacactgt

SEQ ID NO: 72142 - DNA, 25 bp, Homo sapien
gagttggacacactgtaaacccctg

SEQ ID NO: 72143 - DNA, 25 bp, Homo sapien
tggacacactgtaaacccctgggta

SEQ ID NO: 72144 - DNA, 25 bp, Homo sapien
tgcctctgccggttgtgagaacaaa

SEQ ID NO: 72145 - DNA, 25 bp, Homo sapien
aacaaatgactatcctgaacagggt

SEQ ID NO: 72146 - DNA, 25 bp, Homo sapien
gaaaccagccatattggttttggtt

SEQ ID NO: 72147 - DNA, 25 bp, Homo sapien
gatgaagggtctaatctcaaaaaac

SEQ ID NO: 72148 - DNA, 25 bp, Homo sapien
aacagaccaataagaaccgggtgca

SEQ ID NO: 72149 - DNA, 25 bp, Homo sapien
taagaaccgggtgcagtcaggcccc

SEQ ID NO: 72150 - DNA, 25 bp, Homo sapien
tatgcctcggacaacagcagcctca

SEQ ID NO: 72151 - DNA, 25 bp, Homo sapien
tcggacaacagcagcctcatgtttc

SEQ ID NO: 72152 - DNA, 25 bp, Homo sapien
agcctcatgtttcccatcctggtgg

SEQ ID NO: 72153 - DNA, 25 bp, Homo sapien
atcctggtggccttcggagtcttca

SEQ ID NO: 72154 - DNA, 25 bp, Homo sapien
tggccttcggagtcttcattccaac

SEQ ID NO: 72155 - DNA, 25 bp, Homo sapien
gcaaacttgagcagacggtctccat

SEQ ID NO: 72156 - DNA, 25 bp, Homo sapien
gagcagacggtctccatggcaacca

SEQ ID NO: 72157 - DNA, 25 bp, Homo sapien
atggcaaccacgacacagccaatga

SEQ ID NO: 72158 - DNA, 25 bp, Homo sapien
agccaatgactcagcatcttcacgt

SEQ ID NO: 72159 - DNA, 25 bp, Homo sapien
gcatcttcacgtcacctacaagaag

SEQ ID NO: 72160 - DNA, 25 bp, Homo sapien
gtgaccccgtaaacctagagcttct

SEQ ID NO: 72161 - DNA, 25 bp, Homo sapien
ctagagcttctggagccctcgggag

SEQ ID NO: 72162 - DNA, 25 bp, Homo sapien
gcctggctactgtgcctcaacggtt

SEQ ID NO: 72163 - DNA, 25 bp, Homo sapien
aacggttcggctcctcaacagacag

SEQ ID NO: 72164 - DNA, 25 bp, Homo sapien
tggccgtgagcctctgcaggctcaa

SEQ ID NO: 72165 - DNA, 25 bp, Homo sapien
gtccagatgtttctgtactggcata

SEQ ID NO: 72166 - DNA, 25 bp, Homo sapien
ccaggctgggccgtgagcaggtggg

SEQ ID NO: 72167 - DNA, 25 bp, Homo sapien
agcaggtgggccgttgagttacctc

SEQ ID NO: 72168 - DNA, 25 bp, Homo sapien
aggtgggccgttgagttacctctgt

SEQ ID NO: 72169 - DNA, 25 bp, Homo sapien
gtgggccgttgagttacctctgtgc

SEQ ID NO: 72170 - DNA, 25 bp, Homo sapien
ggccgttgagttacctctgtgctgg

SEQ ID NO: 72171 - DNA, 25 bp, Homo sapien
cctctgtcctgccttgttattgtaa

SEQ ID NO: 72172 - DNA, 25 bp, Homo sapien
tctgtcctgccttgttattgtaagt

SEQ ID NO: 72173 - DNA, 25 bp, Homo sapien
tgtcctgccttgttattgtaagtgc

SEQ ID NO: 72174 - DNA, 25 bp, Homo sapien
tcctgccttgttattgtaagtgcct

SEQ ID NO: 72175 - DNA, 25 bp, Homo sapien
ctgccttgttattgtaagtgccttc

SEQ ID NO: 72176 - DNA, 25 bp, Homo sapien
gccttgttattgtaagtgccttcaa

SEQ ID NO: 72177 - DNA, 25 bp, Homo sapien
acacaaaccagagaatgacatgaat

SEQ ID NO: 72178 - DNA, 25 bp, Homo sapien
cacaaaccagagaatgacatgaatc

SEQ ID NO: 72179 - DNA, 25 bp, Homo sapien
caaaccagagaatgacatgaatcca

SEQ ID NO: 72180 - DNA, 25 bp, Homo sapien
aaaccagagaatgacatgaatccag

SEQ ID NO: 72181 - DNA, 25 bp, Homo sapien
aaccagagaatgacatgaatccagc

SEQ ID NO: 72182 - DNA, 25 bp, Homo sapien
gaatgacatgaatccagcaaatagg

SEQ ID NO: 72183 - DNA, 25 bp, Homo sapien
aatgacatgaatccagcaaatagga

SEQ ID NO: 72184 - DNA, 25 bp, Homo sapien
atgacatgaatccagcaaataggat

SEQ ID NO: 72185 - DNA, 25 bp, Homo sapien
tgacatgaatccagcaaataggatc

SEQ ID NO: 72186 - DNA, 25 bp, Homo sapien
gacatgaatccagcaaataggatcc

SEQ ID NO: 72187 - DNA, 25 bp, Homo sapien
acatgaatccagcaaataggatcca

SEQ ID NO: 72188 - DNA, 25 bp, Homo sapien
cagagcctgtctgggaagtcgacac

SEQ ID NO: 72189 - DNA, 25 bp, Homo sapien
atcaggcaagacaacacccaacagc

SEQ ID NO: 72190 - DNA, 25 bp, Homo sapien
ccaacagcggcgacgtgcaggtgac

SEQ ID NO: 72191 - DNA, 25 bp, Homo sapien
tgaggatgccgtgcgccgctacctg

SEQ ID NO: 72192 - DNA, 25 bp, Homo sapien
gacacggaagcccatgaccactaag

SEQ ID NO: 72193 - DNA, 25 bp, Homo sapien
catgaccactaaggacctgctgaaa

SEQ ID NO: 72194 - DNA, 25 bp, Homo sapien
acagtgaacgtgttggcccagatcc

SEQ ID NO: 72195 - DNA, 25 bp, Homo sapien
gactcaaccccgagcgcaagatgat

SEQ ID NO: 72196 - DNA, 25 bp, Homo sapien
atcaacgacaaaatgcacttctccc

SEQ ID NO: 72197 - DNA, 25 bp, Homo sapien
atgcacttctccctcaaggagtgag

SEQ ID NO: 72198 - DNA, 25 bp, Homo sapien
aggcttggtccaatacatggctctg

SEQ ID NO: 72199 - DNA, 25 bp, Homo sapien
caaatgggcgagacacacctgcact

SEQ ID NO: 72200 - DNA, 25 bp, Homo sapien
atgggcgagacacacctgcactctt

SEQ ID NO: 72201 - DNA, 25 bp, Homo sapien
gagacacacctgcactcttcaactt

SEQ ID NO: 72202 - DNA, 25 bp, Homo sapien
cacaaatgccacagcagcgtcagat

SEQ ID NO: 72203 - DNA, 25 bp, Homo sapien
acaaatgccacagcagcgtcagatg

SEQ ID NO: 72204 - DNA, 25 bp, Homo sapien
cttctgcatcagcttccaactccac

SEQ ID NO: 72205 - DNA, 25 bp, Homo sapien
caggaaaaaccaccagttacttgag

SEQ ID NO: 72206 - DNA, 25 bp, Homo sapien
aaaaccaccagttacttgagtgtca

SEQ ID NO: 72207 - DNA, 25 bp, Homo sapien
ccaccagttacttgagtgtcactca

SEQ ID NO: 72208 - DNA, 25 bp, Homo sapien
accagttacttgagtgtcactcagc

SEQ ID NO: 72209 - DNA, 25 bp, Homo sapien
tacttgagtgtcactcagcaacact

SEQ ID NO: 72210 - DNA, 25 bp, Homo sapien
gggaagggcgtgcaaaaactaacat

SEQ ID NO: 72211 - DNA, 25 bp, Homo sapien
gggcgtgcaaaaactaacattgaaa

SEQ ID NO: 72212 - DNA, 25 bp, Homo sapien
acagcagcagagtgagtggatttta

SEQ ID NO: 72213 - DNA, 25 bp, Homo sapien
ccccatgtaattattgtgaacacct

SEQ ID NO: 72214 - DNA, 25 bp, Homo sapien
attgtgaacaccttgctttgtggtc

SEQ ID NO: 72215 - DNA, 25 bp, Homo sapien
tgaacaccttgctttgtggtcactg

SEQ ID NO: 72216 - DNA, 25 bp, Homo sapien
aacaccttgctttgtggtcactgta

SEQ ID NO: 72217 - DNA, 25 bp, Homo sapien
atgtccctggcatctgttcagagca

SEQ ID NO: 72218 - DNA, 25 bp, Homo sapien
ccctggcatctgttcagagcagtgt

SEQ ID NO: 72219 - DNA, 25 bp, Homo sapien
gcatctgttcagagcagtgtgcaga

SEQ ID NO: 72220 - DNA, 25 bp, Homo sapien
cagagcagtgtgcagaatgtaatgc

SEQ ID NO: 72221 - DNA, 25 bp, Homo sapien
tcacccttgcatactaaggcgaggc

SEQ ID NO: 72222 - DNA, 25 bp, Homo sapien
ggcgaggcagatacacctgtgttct

SEQ ID NO: 72223 - DNA, 25 bp, Homo sapien
tgtgttctcccaacccttggaggaa

SEQ ID NO: 72224 - DNA, 25 bp, Homo sapien
gaaattccttgagcagtctgagcct

SEQ ID NO: 72225 - DNA, 25 bp, Homo sapien
gactgattacagcatacatctgacc

SEQ ID NO: 72226 - DNA, 25 bp, Homo sapien
acatctgaccagttttggccagaag

SEQ ID NO: 72227 - DNA, 25 bp, Homo sapien
gaaggcttcccttcatggaaattct

SEQ ID NO: 72228 - DNA, 25 bp, Homo sapien
attcttgttttcacacaacacttgg

SEQ ID NO: 72229 - DNA, 25 bp, Homo sapien
caacacttggtagtttttccagcct

SEQ ID NO: 72230 - DNA, 25 bp, Homo sapien
aagtcaccacctagtaactggctgc

SEQ ID NO: 72231 - DNA, 25 bp, Homo sapien
acattgctctggtttgtgtggtaat

SEQ ID NO: 72232 - DNA, 25 bp, Homo sapien
ataaatatcgcttagaatgcaggag

SEQ ID NO: 72233 - DNA, 25 bp, Homo sapien
tgcttggtgccaaactgaaattcag

SEQ ID NO: 72234 - DNA, 25 bp, Homo sapien
atttctatgtgtaatttctgagcca

SEQ ID NO: 72235 - DNA, 25 bp, Homo sapien
aatttctgagccattgtactgtctg

SEQ ID NO: 72236 - DNA, 25 bp, Homo sapien
ctgagccattgtactgtctgggctg

SEQ ID NO: 72237 - DNA, 25 bp, Homo sapien
ggacactgtccaagggagtggcccc

SEQ ID NO: 72238 - DNA, 25 bp, Homo sapien
ggagtggcccctatgagtttatatt

SEQ ID NO: 72239 - DNA, 25 bp, Homo sapien
gagtttatattttaaccactgcttc

SEQ ID NO: 72240 - DNA, 25 bp, Homo sapien
taaccactgcttcaaatctcgattt

SEQ ID NO: 72241 - DNA, 25 bp, Homo sapien
gcttcaaatctcgatttcacttttt

SEQ ID NO: 72242 - DNA, 25 bp, Homo sapien
gttatatctacatatctgtcatcta

SEQ ID NO: 72243 - DNA, 25 bp, Homo sapien
tcattaacaatttttgggacgggag

SEQ ID NO: 72244 - DNA, 25 bp, Homo sapien
gggagacaccctaaaagccatcaca

SEQ ID NO: 72245 - DNA, 25 bp, Homo sapien
aagccatcacaatgactgctaatag

SEQ ID NO: 72246 - DNA, 25 bp, Homo sapien
ctaatagtggttttgtcagagctgc

SEQ ID NO: 72247 - DNA, 25 bp, Homo sapien
agtggttttgtcagagctgcaaaca

SEQ ID NO: 72248 - DNA, 25 bp, Homo sapien
ttagtgtgtttatccatcagcccag

SEQ ID NO: 72249 - DNA, 25 bp, Homo sapien
tgtgtttatccatcagcccagagca

SEQ ID NO: 72250 - DNA, 25 bp, Homo sapien
agcccagagcacttactgagagtaa

SEQ ID NO: 72251 - DNA, 25 bp, Homo sapien
taccaaaagactacacaactgacag

SEQ ID NO: 72252 - DNA, 25 bp, Homo sapien
tatttataccaaaggctgggtcttc

SEQ ID NO: 72253 - DNA, 25 bp, Homo sapien
tgggtcttcccatctaaactggtgg

SEQ ID NO: 72254 - DNA, 25 bp, Homo sapien
attttgacacgggagaaggcagctc

SEQ ID NO: 72255 - DNA, 25 bp, Homo sapien
gattaaggaagatagctcaaagcca

SEQ ID NO: 72256 - DNA, 25 bp, Homo sapien
aaagccaaagcagaccctccgtgtg

SEQ ID NO: 72257 - DNA, 25 bp, Homo sapien
gaccctccgtgtgaactttatactg

SEQ ID NO: 72258 - DNA, 25 bp, Homo sapien
aactttatactgctcacttccgtgt

SEQ ID NO: 72259 - DNA, 25 bp, Homo sapien
gaaactgtccaaccttgtcatgtgt

SEQ ID NO: 72260 - DNA, 25 bp, Homo sapien
gtgttgggacttactgcttgaggca

SEQ ID NO: 72261 - DNA, 25 bp, Homo sapien
ggcaaagcattcatcctacatcata

SEQ ID NO: 72262 - DNA, 25 bp, Homo sapien
ccaaagatctctttaagggctgggc

SEQ ID NO: 72263 - DNA, 25 bp, Homo sapien
agctcgggaagagaccagttcggtc

SEQ ID NO: 72264 - DNA, 25 bp, Homo sapien
gagaccagttcggtctctacaaaaa

SEQ ID NO: 72265 - DNA, 25 bp, Homo sapien
ctggacaaggaagacccttagggat

SEQ ID NO: 72266 - DNA, 25 bp, Homo sapien
ttagggatgacgtccccgctgcata

SEQ ID NO: 72267 - DNA, 25 bp, Homo sapien
atgacgtccccgctgcatatttatt

SEQ ID NO: 72268 - DNA, 25 bp, Homo sapien
cgtccccgctgcatatttattcaag

SEQ ID NO: 72269 - DNA, 25 bp, Homo sapien
attcaaggtgactcttgtacttggc

SEQ ID NO: 72270 - DNA, 25 bp, Homo sapien
aaggtgactcttgtacttggcaagg

SEQ ID NO: 72271 - DNA, 25 bp, Homo sapien
gtgactcttgtacttggcaagggaa

SEQ ID NO: 72272 - DNA, 25 bp, Homo sapien
acttggcaagggaagtccactgtgt

SEQ ID NO: 72273 - DNA, 25 bp, Homo sapien
ggaagtccactgtgtgattgtctgt

SEQ ID NO: 72274 - DNA, 25 bp, Homo sapien
gtccactgtgtgattgtctgtattc

SEQ ID NO: 72275 - DNA, 25 bp, Homo sapien
ccactgtgtgattgtctgtattctt

SEQ ID NO: 72276 - DNA, 25 bp, Homo sapien
cgaccggcaggagcgcgagagggca

SEQ ID NO: 72277 - DNA, 25 bp, Homo sapien
tcggaggccctggacgaggagagct

SEQ ID NO: 72278 - DNA, 25 bp, Homo sapien
gaggagagctgagccgcgggcagcc

SEQ ID NO: 72279 - DNA, 25 bp, Homo sapien
ttccccggctcgcaggagagcagag

SEQ ID NO: 72280 - DNA, 25 bp, Homo sapien
tcgcaggagagcagagcagagaact

SEQ ID NO: 72281 - DNA, 25 bp, Homo sapien
aactgtggggaacgctgtgctgttt

SEQ ID NO: 72282 - DNA, 25 bp, Homo sapien
aatttctgtgatttccaaccaacat

SEQ ID NO: 72283 - DNA, 25 bp, Homo sapien
atttctgtgatttccaaccaacatg

SEQ ID NO: 72284 - DNA, 25 bp, Homo sapien
ttctgtgatttccaaccaacatgaa

SEQ ID NO: 72285 - DNA, 25 bp, Homo sapien
gtgatttccaaccaacatgaaatga

SEQ ID NO: 72286 - DNA, 25 bp, Homo sapien
acatgaaatgactataaacggtttt

SEQ ID NO: 72287 - DNA, 25 bp, Homo sapien
agaggtcccaattatgacatgcagc

SEQ ID NO: 72288 - DNA, 25 bp, Homo sapien
tgacatgcagcaatgccaatacccc

SEQ ID NO: 72289 - DNA, 25 bp, Homo sapien
gccaataccccttctgtgaatacag

SEQ ID NO: 72290 - DNA, 25 bp, Homo sapien
tttcaagctttcgtcagtggcaacc

SEQ ID NO: 72291 - DNA, 25 bp, Homo sapien
agtggcaaccactcttaggcagcag

SEQ ID NO: 72292 - DNA, 25 bp, Homo sapien
cttaggcagcagcaactggttttgg

SEQ ID NO: 72293 - DNA, 25 bp, Homo sapien
aaatttccctgatgtcagtaccacc

SEQ ID NO: 72294 - DNA, 25 bp, Homo sapien
ggatgtggacctttgctacctgtat

SEQ ID NO: 72295 - DNA, 25 bp, Homo sapien
cctgtattaataccagtggcctcat

SEQ ID NO: 72296 - DNA, 25 bp, Homo sapien
gtggcctcattttgctgtatcatta

SEQ ID NO: 72297 - DNA, 25 bp, Homo sapien
acatgcccttcactggttgtgtaaa

SEQ ID NO: 72298 - DNA, 25 bp, Homo sapien
taaacaaccgatgtgtccgtgccaa

SEQ ID NO: 72299 - DNA, 25 bp, Homo sapien
accgatgtgtccgtgccaaaataaa

SEQ ID NO: 72300 - DNA, 25 bp, Homo sapien
aaatgttgctatgatttgtcaaacc

SEQ ID NO: 72301 - DNA, 25 bp, Homo sapien
gatttgtcaaaccttggtaagccca

SEQ ID NO: 72302 - DNA, 25 bp, Homo sapien
gtaagcccaccagagggaaaccagg

SEQ ID NO: 72303 - DNA, 25 bp, Homo sapien
ccaggaaattagcagggacaacatt

SEQ ID NO: 72304 - DNA, 25 bp, Homo sapien
cagggacaacattctatgcaagatt

SEQ ID NO: 72305 - DNA, 25 bp, Homo sapien
atatgtagctaatgtgaaccctgga

SEQ ID NO: 72306 - DNA, 25 bp, Homo sapien
tgtgaaccctggaggatgggcacca

SEQ ID NO: 72307 - DNA, 25 bp, Homo sapien
gtggcaaagcgagagtatcctaaat

SEQ ID NO: 72308 - DNA, 25 bp, Homo sapien
gcaggaaagcctattttgttctagt

SEQ ID NO: 72309 - DNA, 25 bp, Homo sapien
gattgtaggatcatatggcgtatat

SEQ ID NO: 72310 - DNA, 25 bp, Homo sapien
tggcgtatatcttggttcatcttca

SEQ ID NO: 72311 - DNA, 25 bp, Homo sapien
ggttcatcttcaaaatcagagactg

SEQ ID NO: 72312 - DNA, 25 bp, Homo sapien
tagtggtttttaatcaaagttggct

SEQ ID NO: 72313 - DNA, 25 bp, Homo sapien
caaagttggctttataggaggagta

SEQ ID NO: 72314 - DNA, 25 bp, Homo sapien
aatgtatgcactactgttttaaaag

SEQ ID NO: 72315 - DNA, 25 bp, Homo sapien
gaatgagcccattcatggtaagtct

SEQ ID NO: 72316 - DNA, 25 bp, Homo sapien
gcccattcatggtaagtcttaagct

SEQ ID NO: 72317 - DNA, 25 bp, Homo sapien
taagcttgttggaaataatgtaccc

SEQ ID NO: 72318 - DNA, 25 bp, Homo sapien
taatgtacccatgtagactagcaaa

SEQ ID NO: 72319 - DNA, 25 bp, Homo sapien
gtagatgtgatctcagttgtaaata

SEQ ID NO: 72320 - DNA, 25 bp, Homo sapien
tccaccaaggttcacacaccagatg

SEQ ID NO: 72321 - DNA, 25 bp, Homo sapien
ggttcacacaccagatgtaactgtt

SEQ ID NO: 72322 - DNA, 25 bp, Homo sapien
ttttcagctgagttgtatggattaa

SEQ ID NO: 72323 - DNA, 25 bp, Homo sapien
gtatggattaacttcagtccactgt

SEQ ID NO: 72324 - DNA, 25 bp, Homo sapien
ttcagtccactgtaaatacacctgg

SEQ ID NO: 72325 - DNA, 25 bp, Homo sapien
gtccactgtaaatacacctgggatg

SEQ ID NO: 72326 - DNA, 25 bp, Homo sapien
ttatgcaattttgagtggcctttca

SEQ ID NO: 72327 - DNA, 25 bp, Homo sapien
gcaattttgagtggcctttcaaccc

SEQ ID NO: 72328 - DNA, 25 bp, Homo sapien
ttgagtggcctttcaaccctaagat

SEQ ID NO: 72329 - DNA, 25 bp, Homo sapien
gcctttcaaccctaagatgaatggt

SEQ ID NO: 72330 - DNA, 25 bp, Homo sapien
gcctgtaaacacaacagtatttata

SEQ ID NO: 72331 - DNA, 25 bp, Homo sapien
cccagctcctttccctggaagagga

SEQ ID NO: 72332 - DNA, 25 bp, Homo sapien
tttccctggaagaggaatccagtga

SEQ ID NO: 72333 - DNA, 25 bp, Homo sapien
agtgaatgttcctgtttgatgtgac

SEQ ID NO: 72334 - DNA, 25 bp, Homo sapien
gaatgttcctgtttgatgtgacagg

SEQ ID NO: 72335 - DNA, 25 bp, Homo sapien
gtgacaggaattctccctggcattg

SEQ ID NO: 72336 - DNA, 25 bp, Homo sapien
aggaattctccctggcattgtttcc

SEQ ID NO: 72337 - DNA, 25 bp, Homo sapien
aattctccctggcattgtttccacc

SEQ ID NO: 72338 - DNA, 25 bp, Homo sapien
accacgggcgaggacgtgaagcctc

SEQ ID NO: 72339 - DNA, 25 bp, Homo sapien
gcctcccgaagacgcacagaaggaa

SEQ ID NO: 72340 - DNA, 25 bp, Homo sapien
gaagacgcacagaaggaaggagcca

SEQ ID NO: 72341 - DNA, 25 bp, Homo sapien
ccactcatcgcagggctcatgattt

SEQ ID NO: 72342 - DNA, 25 bp, Homo sapien
ttttttgcagttatccacactcaca

SEQ ID NO: 72343 - DNA, 25 bp, Homo sapien
cagttatccacactcacatttcaga

SEQ ID NO: 72344 - DNA, 25 bp, Homo sapien
actcacatttcagagtcctgactct

SEQ ID NO: 72345 - DNA, 25 bp, Homo sapien
gagtcctgactctcaaggaaccact

SEQ ID NO: 72346 - DNA, 25 bp, Homo sapien
tgactctcaaggaaccactggtttt

SEQ ID NO: 72347 - DNA, 25 bp, Homo sapien
ccactggtttttgggatagaacttg

SEQ ID NO: 72348 - DNA, 25 bp, Homo sapien
agggctaggaacacaggctccacgg

SEQ ID NO: 72349 - DNA, 25 bp, Homo sapien
aggaacacaggctccacggtgacat

SEQ ID NO: 72350 - DNA, 25 bp, Homo sapien
acaggctccacggtgacatgtcatt

SEQ ID NO: 72351 - DNA, 25 bp, Homo sapien
gctccacggtgacatgtcatttgat

SEQ ID NO: 72352 - DNA, 25 bp, Homo sapien
gggccacatgctctcaatggagaca

SEQ ID NO: 72353 - DNA, 25 bp, Homo sapien
tccagttcacagtggatgtcttcca

SEQ ID NO: 72354 - DNA, 25 bp, Homo sapien
ggatgtcttccactttgctaatgac

SEQ ID NO: 72355 - DNA, 25 bp, Homo sapien
tccactttgctaatgactccagaaa

SEQ ID NO: 72356 - DNA, 25 bp, Homo sapien
gggccactgatcttcctggacagga

SEQ ID NO: 72357 - DNA, 25 bp, Homo sapien
agtggtgaccatgaagtagagcagt

SEQ ID NO: 72358 - DNA, 25 bp, Homo sapien
agtgggctttgccttctgacacctc

SEQ ID NO: 72359 - DNA, 25 bp, Homo sapien
actctgactgctgttatcctggttc

SEQ ID NO: 72360 - DNA, 25 bp, Homo sapien
ctcaccaggaggtgtcgcactgcct

SEQ ID NO: 72361 - DNA, 25 bp, Homo sapien
ccaccctgtgtctgcttccgaataa

SEQ ID NO: 72362 - DNA, 25 bp, Homo sapien
gcattcaaagttcctcgacccgggc

SEQ ID NO: 72363 - DNA, 25 bp, Homo sapien
gggccagatacactccagttcacag

SEQ ID NO: 72364 - DNA, 25 bp, Homo sapien
gatccattaccgcaaatgagccaac

SEQ ID NO: 72365 - DNA, 25 bp, Homo sapien
attaccgcaaatgagccaacgtttt

SEQ ID NO: 72366 - DNA, 25 bp, Homo sapien
gagccaacgttttaacatccacaac

SEQ ID NO: 72367 - DNA, 25 bp, Homo sapien
acgttttaacatccacaacaacagg

SEQ ID NO: 72368 - DNA, 25 bp, Homo sapien
taacatccacaacaacaggaaacga

SEQ ID NO: 72369 - DNA, 25 bp, Homo sapien
atagtgatggagttgatggatttga

SEQ ID NO: 72370 - DNA, 25 bp, Homo sapien
aaaacagatgcccatttgttggctg

SEQ ID NO: 72371 - DNA, 25 bp, Homo sapien
gatgcccatttgttggctgtttttc

SEQ ID NO: 72372 - DNA, 25 bp, Homo sapien
gttggctgtttttcattcataataa

SEQ ID NO: 72373 - DNA, 25 bp, Homo sapien
ggaagaaccaagtttttctatgata

SEQ ID NO: 72374 - DNA, 25 bp, Homo sapien
gtacagtgttaggtattatttgaat

SEQ ID NO: 72375 - DNA, 25 bp, Homo sapien
gaaggagtacacaaaccagagaatg

SEQ ID NO: 72376 - DNA, 25 bp, Homo sapien
gaatgacatgaatccagcaaatagg

SEQ ID NO: 72377 - DNA, 25 bp, Homo sapien
aatattaatcggttagctgggtgga

SEQ ID NO: 72378 - DNA, 25 bp, Homo sapien
attaatcggttagctgggtggaatg

SEQ ID NO: 72379 - DNA, 25 bp, Homo sapien
ctcaggaggctcagcagcaggacga

SEQ ID NO: 72380 - DNA, 25 bp, Homo sapien
aggaggctcagcagcaggacgactt

SEQ ID NO: 72381 - DNA, 25 bp, Homo sapien
tcagcagcaggacgacttgagccca

SEQ ID NO: 72382 - DNA, 25 bp, Homo sapien
gcagcaggacgacttgagcccaaga

SEQ ID NO: 72383 - DNA, 25 bp, Homo sapien
cagcaggacgacttgagcccaagag

SEQ ID NO: 72384 - DNA, 25 bp, Homo sapien
accttagtgagatcccttctcttaa

SEQ ID NO: 72385 - DNA, 25 bp, Homo sapien
ataataacttattgccagatttggg

SEQ ID NO: 72386 - DNA, 25 bp, Homo sapien
aaggtctcccggctgccatactgca

SEQ ID NO: 72387 - DNA, 25 bp, Homo sapien
atgctgcaggctctgcctttcatga

SEQ ID NO: 72388 - DNA, 25 bp, Homo sapien
agggccccactcctgagagacactg

SEQ ID NO: 72389 - DNA, 25 bp, Homo sapien
cactcctgagagacactggcaacac

SEQ ID NO: 72390 - DNA, 25 bp, Homo sapien
gacactggcaacacctcttagttga

SEQ ID NO: 72391 - DNA, 25 bp, Homo sapien
tggcaacacctcttagttgatttct

SEQ ID NO: 72392 - DNA, 25 bp, Homo sapien
ctaccagggtagaggccatgttgaa

SEQ ID NO: 72393 - DNA, 25 bp, Homo sapien
ccatgttgaactggcctcttttcag

SEQ ID NO: 72394 - DNA, 25 bp, Homo sapien
tgaactggcctcttttcaggacttt

SEQ ID NO: 72395 - DNA, 25 bp, Homo sapien
tcaggacttttatttccccctggat

SEQ ID NO: 72396 - DNA, 25 bp, Homo sapien
gaaagtgttttctgaatggctatta

SEQ ID NO: 72397 - DNA, 25 bp, Homo sapien
cccagctcctttccctggaagagga

SEQ ID NO: 72398 - DNA, 25 bp, Homo sapien
tcctttccctggaagaggaatccag

SEQ ID NO: 72399 - DNA, 25 bp, Homo sapien
tttccctggaagaggaatccagtga

SEQ ID NO: 72400 - DNA, 25 bp, Homo sapien
ccagtgaatgttcctgtttgatgtg

SEQ ID NO: 72401 - DNA, 25 bp, Homo sapien
agtgaatgttcctgtttgatgtgac

SEQ ID NO: 72402 - DNA, 25 bp, Homo sapien
gtgaatgttcctgtttgatgtgaca

SEQ ID NO: 72403 - DNA, 25 bp, Homo sapien
tgaatgttcctgtttgatgtgacag

SEQ ID NO: 72404 - DNA, 25 bp, Homo sapien
aatgttcctgtttgatgtgacagga

SEQ ID NO: 72405 - DNA, 25 bp, Homo sapien
tcctgtttgatgtgacaggaattct

SEQ ID NO: 72406 - DNA, 25 bp, Homo sapien
attctccctggcattgtttccaccc

SEQ ID NO: 72407 - DNA, 25 bp, Homo sapien
cagcccactcatcgcagggctcatg

SEQ ID NO: 72408 - DNA, 25 bp, Homo sapien
tgtacaaccagcataacccgggcgc

SEQ ID NO: 72409 - DNA, 25 bp, Homo sapien
catcgtgtactacgtgggccgcaag

SEQ ID NO: 72410 - DNA, 25 bp, Homo sapien
tcgtgtactacgtgggccgcaagcc

SEQ ID NO: 72411 - DNA, 25 bp, Homo sapien
gccgcaagcccaaggtggagcagct

SEQ ID NO: 72412 - DNA, 25 bp, Homo sapien
ggagcagctgtccaacatgatcgtg

SEQ ID NO: 72413 - DNA, 25 bp, Homo sapien
gcagctgtccaacatgatcgtgcgc

SEQ ID NO: 72414 - DNA, 25 bp, Homo sapien
tgtccaacatgatcgtgcgctcctg

SEQ ID NO: 72415 - DNA, 25 bp, Homo sapien
caacatgatcgtgcgctcctgcaag

SEQ ID NO: 72416 - DNA, 25 bp, Homo sapien
tgatcgtgcgctcctgcaagtgcag

SEQ ID NO: 72417 - DNA, 25 bp, Homo sapien
gtgcgctcctgcaagtgcagctgag

SEQ ID NO: 72418 - DNA, 25 bp, Homo sapien
tcctgcaagtgcagctgaggtcccg

SEQ ID NO: 72419 - DNA, 25 bp, Homo sapien
gaaagaagttccacaggaccagcat

SEQ ID NO: 72420 - DNA, 25 bp, Homo sapien
ttccacaggaccagcatttggaggc

SEQ ID NO: 72421 - DNA, 25 bp, Homo sapien
atactgtgtatgctggcattcacac

SEQ ID NO: 72422 - DNA, 25 bp, Homo sapien
attcacactctactcactggctgaa

SEQ ID NO: 72423 - DNA, 25 bp, Homo sapien
actctactcactggctgaatgttga

SEQ ID NO: 72424 - DNA, 25 bp, Homo sapien
tgtgtaaatgtttcttgatctctaa

SEQ ID NO: 72425 - DNA, 25 bp, Homo sapien
cttctcttagttatttctgggttgt

SEQ ID NO: 72426 - DNA, 25 bp, Homo sapien
agttatttctgggttgtcacaaagc

SEQ ID NO: 72427 - DNA, 25 bp, Homo sapien
ctgggttgtcacaaagctcagtatc

SEQ ID NO: 72428 - DNA, 25 bp, Homo sapien
aagctcagtatcatggtttgacaga

SEQ ID NO: 72429 - DNA, 25 bp, Homo sapien
atcatggtttgacagaagcagttat

SEQ ID NO: 72430 - DNA, 25 bp, Homo sapien
acactagagtgtttggtcatctctt

SEQ ID NO: 72431 - DNA, 25 bp, Homo sapien
ttctgggaagatgcgatgaactcat

SEQ ID NO: 72432 - DNA, 25 bp, Homo sapien
gatgaactcatgtcccagtcagaaa

SEQ ID NO: 72433 - DNA, 25 bp, Homo sapien
aataagcattggttgccaggccaca

SEQ ID NO: 72434 - DNA, 25 bp, Homo sapien
ggttgccaggccacagttaggaatt

SEQ ID NO: 72435 - DNA, 25 bp, Homo sapien
gtattgtgatacatctagaggccaa

SEQ ID NO: 72436 - DNA, 25 bp, Homo sapien
gagagagctaccaacttacactgtg

SEQ ID NO: 72437 - DNA, 25 bp, Homo sapien
tgtggtttaagctaaatgaccgcac

SEQ ID NO: 72438 - DNA, 25 bp, Homo sapien
atgaccgcacagcatcatagcattg

SEQ ID NO: 72439 - DNA, 25 bp, Homo sapien
catagcattgcagtgttgttactaa

SEQ ID NO: 72440 - DNA, 25 bp, Homo sapien
ttactaaatctggaagtgacctgtg

SEQ ID NO: 72441 - DNA, 25 bp, Homo sapien
aaatattaatcggttagctgggtgg

SEQ ID NO: 72442 - DNA, 25 bp, Homo sapien
aatattaatcggttagctgggtgga

SEQ ID NO: 72443 - DNA, 25 bp, Homo sapien
atattaatcggttagctgggtggaa

SEQ ID NO: 72444 - DNA, 25 bp, Homo sapien
tattaatcggttagctgggtggaat

SEQ ID NO: 72445 - DNA, 25 bp, Homo sapien
attaatcggttagctgggtggaatg

SEQ ID NO: 72446 - DNA, 25 bp, Homo sapien
taatcggttagctgggtggaatggc

SEQ ID NO: 72447 - DNA, 25 bp, Homo sapien
aatcggttagctgggtggaatggcc

SEQ ID NO: 72448 - DNA, 25 bp, Homo sapien
atcggttagctgggtggaatggccc

SEQ ID NO: 72449 - DNA, 25 bp, Homo sapien
aggctcagcagcaggacgacttgag

SEQ ID NO: 72450 - DNA, 25 bp, Homo sapien
ggctcagcagcaggacgacttgagc

SEQ ID NO: 72451 - DNA, 25 bp, Homo sapien
gctcagcagcaggacgacttgagcc

SEQ ID NO: 72452 - DNA, 25 bp, Homo sapien
agcccgggaagctgcttgcctcggc

SEQ ID NO: 72453 - DNA, 25 bp, Homo sapien
tgcctcggcagccataggagcgaac

SEQ ID NO: 72454 - DNA, 25 bp, Homo sapien
ataggagcgaacactgctgctctct

SEQ ID NO: 72455 - DNA, 25 bp, Homo sapien
tgaacccgggtgatggctgaacgct

SEQ ID NO: 72456 - DNA, 25 bp, Homo sapien
gaacgctgcccagcgtgtcttctgg

SEQ ID NO: 72457 - DNA, 25 bp, Homo sapien
cgttgccagcctccctgtgacagag

SEQ ID NO: 72458 - DNA, 25 bp, Homo sapien
tgtgacagagcctggtgaacagtga

SEQ ID NO: 72459 - DNA, 25 bp, Homo sapien
gagcctggctcccacgcaagtggca

SEQ ID NO: 72460 - DNA, 25 bp, Homo sapien
gcaagtggcactttaagccctgcat

SEQ ID NO: 72461 - DNA, 25 bp, Homo sapien
taagccctgcatcctcggttgagag

SEQ ID NO: 72462 - DNA, 25 bp, Homo sapien
cctgcatcctcggttgagagtaaaa

SEQ ID NO: 72463 - DNA, 25 bp, Homo sapien
tgctgggtctggctgtcactgctat

SEQ ID NO: 72464 - DNA, 25 bp, Homo sapien
ggctgtcactgctatgaagtctcga

SEQ ID NO: 72465 - DNA, 25 bp, Homo sapien
atgaagtctcgaccctaagcccagg

SEQ ID NO: 72466 - DNA, 25 bp, Homo sapien
agggtctggccttgaaagctccgca

SEQ ID NO: 72467 - DNA, 25 bp, Homo sapien
gaaagctccgcagaaatgattccaa

SEQ ID NO: 72468 - DNA, 25 bp, Homo sapien
aatgattccaaaacccagggagcaa

SEQ ID NO: 72469 - DNA, 25 bp, Homo sapien
agggagcaaccactggccctaccgt

SEQ ID NO: 72470 - DNA, 25 bp, Homo sapien
tctcctttgagaggcccatgtgtcg

SEQ ID NO: 72471 - DNA, 25 bp, Homo sapien
gtgaccctttgtgtaactgtaaccg

SEQ ID NO: 72472 - DNA, 25 bp, Homo sapien
aaatcctagatgctgttgtttgaat

SEQ ID NO: 72473 - DNA, 25 bp, Homo sapien
catacttctatttgtgccacatctc

SEQ ID NO: 72474 - DNA, 25 bp, Homo sapien
ctctcacccagcctggtactgaagg

SEQ ID NO: 72475 - DNA, 25 bp, Homo sapien
tactgaaggtgccagacgtgctcct

SEQ ID NO: 72476 - DNA, 25 bp, Homo sapien
aaggtgccagacgtgctcctgctga

SEQ ID NO: 72477 - DNA, 25 bp, Homo sapien
gcggctccgggctgtgtcctaaatg

SEQ ID NO: 72478 - DNA, 25 bp, Homo sapien
tgtcctaaatgcaaagcacacctcg

SEQ ID NO: 72479 - DNA, 25 bp, Homo sapien
taacctctctgaactgcaacactgg

SEQ ID NO: 72480 - DNA, 25 bp, Homo sapien
tctctgaactgcaacactggattgt

SEQ ID NO: 72481 - DNA, 25 bp, Homo sapien
gcaacactggattgttcttttttaa

SEQ ID NO: 72482 - DNA, 25 bp, Homo sapien
ctgctttgagtgcacacactaccaa

SEQ ID NO: 72483 - DNA, 25 bp, Homo sapien
acacactaccaatcgttcctggaat

SEQ ID NO: 72484 - DNA, 25 bp, Homo sapien
ctaccaatcgttcctggaatacagg

SEQ ID NO: 72485 - DNA, 25 bp, Homo sapien
tgtcttttgggagagtacttttctc

SEQ ID NO: 72486 - DNA, 25 bp, Homo sapien
tttgggagagtacttttctccacga

SEQ ID NO: 72487 - DNA, 25 bp, Homo sapien
gggagagtacttttctccacgagcc

SEQ ID NO: 72488 - DNA, 25 bp, Homo sapien
gagagtacttttctccacgagccct

SEQ ID NO: 72489 - DNA, 25 bp, Homo sapien
agagtacttttctccacgagccctc

SEQ ID NO: 72490 - DNA, 25 bp, Homo sapien
gtacttttctccacgagccctctgg

SEQ ID NO: 72491 - DNA, 25 bp, Homo sapien
gaaatgtgaagggtcttggcctcat

SEQ ID NO: 72492 - DNA, 25 bp, Homo sapien
aatgtgaagggtcttggcctcatcc

SEQ ID NO: 72493 - DNA, 25 bp, Homo sapien
atgtgaagggtcttggcctcatccc

SEQ ID NO: 72494 - DNA, 25 bp, Homo sapien
gtgaagggtcttggcctcatccctc

SEQ ID NO: 72495 - DNA, 25 bp, Homo sapien
acagcacttcccactactgcttctg

SEQ ID NO: 72496 - DNA, 25 bp, Homo sapien
gggatatgcatccataccttgacaa

SEQ ID NO: 72497 - DNA, 25 bp, Homo sapien
agtgtagctttcagtcctgatggca

SEQ ID NO: 72498 - DNA, 25 bp, Homo sapien
gcaggtatctggcaagtggttcttt

SEQ ID NO: 72499 - DNA, 25 bp, Homo sapien
gtgtacacatctggaacacgcagac

SEQ ID NO: 72500 - DNA, 25 bp, Homo sapien
acacgcagacaggtgctctagttca

SEQ ID NO: 72501 - DNA, 25 bp, Homo sapien
ggtgctctagttcacagctataggg

SEQ ID NO: 72502 - DNA, 25 bp, Homo sapien
gacaaagttggagccagtgcatcag

SEQ ID NO: 72503 - DNA, 25 bp, Homo sapien
gtgcatcagatggttcagtttgtgt

SEQ ID NO: 72504 - DNA, 25 bp, Homo sapien
cagtttgtgtattagaccttcggaa

SEQ ID NO: 72505 - DNA, 25 bp, Homo sapien
gaccttcggaaatagcgctactagt

SEQ ID NO: 72506 - DNA, 25 bp, Homo sapien
gttggaagccatggaccgactatga

SEQ ID NO: 72507 - DNA, 25 bp, Homo sapien
tagggccgtttcctaacagtccttg

SEQ ID NO: 72508 - DNA, 25 bp, Homo sapien
ctaacagtccttgggctcagtgcca

SEQ ID NO: 72509 - DNA, 25 bp, Homo sapien
agtgccaggaggatgggccaactca

SEQ ID NO: 72510 - DNA, 25 bp, Homo sapien
ggatgggccaactcaaaatctgaag

SEQ ID NO: 72511 - DNA, 25 bp, Homo sapien
aaaatctgaagcctgatttgctctt

SEQ ID NO: 72512 - DNA, 25 bp, Homo sapien
atttgctctttacccaggactctga

SEQ ID NO: 72513 - DNA, 25 bp, Homo sapien
cccaggactctgaaggtaatcaagt

SEQ ID NO: 72514 - DNA, 25 bp, Homo sapien
aggtaatcaagttatcagacaccaa

SEQ ID NO: 72515 - DNA, 25 bp, Homo sapien
atcagacaccaattctaaatgtttg

SEQ ID NO: 72516 - DNA, 25 bp, Homo sapien
tgaagctttgtttctaaaagtacct

SEQ ID NO: 72517 - DNA, 25 bp, Homo sapien
gttgtcattactgagcatcttctct

SEQ ID NO: 72518 - DNA, 25 bp, Homo sapien
atcctgttctccatgatgctgatga

SEQ ID NO: 72519 - DNA, 25 bp, Homo sapien
tgatgctgatgacaggaatgcccca

SEQ ID NO: 72520 - DNA, 25 bp, Homo sapien
ggaatgccccagttaacaagcaaag

SEQ ID NO: 72521 - DNA, 25 bp, Homo sapien
gacattgaatatatccgggatgccc

SEQ ID NO: 72522 - DNA, 25 bp, Homo sapien
aagtattttcttgatcagatcgaag

SEQ ID NO: 72523 - DNA, 25 bp, Homo sapien
tgatcagatcgaagtttgcagagac

SEQ ID NO: 72524 - DNA, 25 bp, Homo sapien
agacaaaggatggactgtgcagttt

SEQ ID NO: 72525 - DNA, 25 bp, Homo sapien
gactgtgcagtttaattggtttcta

SEQ ID NO: 72526 - DNA, 25 bp, Homo sapien
ggtttctacatcttgttcttggcat

SEQ ID NO: 72527 - DNA, 25 bp, Homo sapien
ggagagaaacattcagcctaatact

SEQ ID NO: 72528 - DNA, 25 bp, Homo sapien
ttagcatagcaatcatcgaacttgg

SEQ ID NO: 72529 - DNA, 25 bp, Homo sapien
tggctctgcagctggccgagaagct

SEQ ID NO: 72530 - DNA, 25 bp, Homo sapien
tggccgagaagctgggcagcctggt

SEQ ID NO: 72531 - DNA, 25 bp, Homo sapien
ggcagcctggtggagaacaacgaac

SEQ ID NO: 72532 - DNA, 25 bp, Homo sapien
acgaacgggtgtttgaccacaagca

SEQ ID NO: 72533 - DNA, 25 bp, Homo sapien
gggtgtttgaccacaagcagggcac

SEQ ID NO: 72534 - DNA, 25 bp, Homo sapien
gagaccagaaggacggctaccgcaa

SEQ ID NO: 72535 - DNA, 25 bp, Homo sapien
accgcaaaaacgagggctacatgcg

SEQ ID NO: 72536 - DNA, 25 bp, Homo sapien
aaaacgagggctacatgcgccgcgg

SEQ ID NO: 72537 - DNA, 25 bp, Homo sapien
ggctaccgccagcagcagtctcaga

SEQ ID NO: 72538 - DNA, 25 bp, Homo sapien
gcagcagtctcagacggcctactga

SEQ ID NO: 72539 - DNA, 25 bp, Homo sapien
ctaaaccacacctcagtcactaaag

SEQ ID NO: 72540 - DNA, 25 bp, Homo sapien
ggtgactttgcagatctgctcaccc

SEQ ID NO: 72541 - DNA, 25 bp, Homo sapien
gtgactttgcagatctgctcaccct

SEQ ID NO: 72542 - DNA, 25 bp, Homo sapien
tgactttgcagatctgctcaccctc

SEQ ID NO: 72543 - DNA, 25 bp, Homo sapien
actttgcagatctgctcaccctcgg

SEQ ID NO: 72544 - DNA, 25 bp, Homo sapien
ctttgcagatctgctcaccctcggt

SEQ ID NO: 72545 - DNA, 25 bp, Homo sapien
tttgcagatctgctcaccctcggtg

SEQ ID NO: 72546 - DNA, 25 bp, Homo sapien
tgcagatctgctcaccctcggtgag

SEQ ID NO: 72547 - DNA, 25 bp, Homo sapien
gcagatctgctcaccctcggtgagc

SEQ ID NO: 72548 - DNA, 25 bp, Homo sapien
cagatctgctcaccctcggtgagca

SEQ ID NO: 72549 - DNA, 25 bp, Homo sapien
atcgagagcgtgacaggaaatccca

SEQ ID NO: 72550 - DNA, 25 bp, Homo sapien
ggaaatcccaagactgcttccgcct

SEQ ID NO: 72551 - DNA, 25 bp, Homo sapien
gcctcagaggcgtcccggctgcgat

SEQ ID NO: 72552 - DNA, 25 bp, Homo sapien
gattcgctgccctgttgtcagtgag

SEQ ID NO: 72553 - DNA, 25 bp, Homo sapien
tgttgtcagtgaggcctggctgtca

SEQ ID NO: 72554 - DNA, 25 bp, Homo sapien
agtgaggcctggctgtcaccgcaca

SEQ ID NO: 72555 - DNA, 25 bp, Homo sapien
ggttcctttcttctcacacgtcgcg

SEQ ID NO: 72556 - DNA, 25 bp, Homo sapien
acacgtcgcgtgtacccatagcact

SEQ ID NO: 72557 - DNA, 25 bp, Homo sapien
aatcacatccggttgtgtcctgtgg

SEQ ID NO: 72558 - DNA, 25 bp, Homo sapien
gagggtcagaggcagaatctactta

SEQ ID NO: 72559 - DNA, 25 bp, Homo sapien
ggcagaatctacttacagtggtgta

SEQ ID NO: 72560 - DNA, 25 bp, Homo sapien
tgagcccactgcccagcagaacctg

SEQ ID NO: 72561 - DNA, 25 bp, Homo sapien
acgaacgggtgtttgaccacaagca

SEQ ID NO: 72562 - DNA, 25 bp, Homo sapien
cgaacgggtgtttgaccacaagcag

SEQ ID NO: 72563 - DNA, 25 bp, Homo sapien
gaacgggtgtttgaccacaagcagg

SEQ ID NO: 72564 - DNA, 25 bp, Homo sapien
aacgggtgtttgaccacaagcaggg

SEQ ID NO: 72565 - DNA, 25 bp, Homo sapien
acgggtgtttgaccacaagcagggc

SEQ ID NO: 72566 - DNA, 25 bp, Homo sapien
gggtgtttgaccacaagcagggcac

SEQ ID NO: 72567 - DNA, 25 bp, Homo sapien
ggtgtttgaccacaagcagggcacc

SEQ ID NO: 72568 - DNA, 25 bp, Homo sapien
accgcaaaaacgagggctacatgcg

SEQ ID NO: 72569 - DNA, 25 bp, Homo sapien
ggctaccgccagcagcagtctcaga

SEQ ID NO: 72570 - DNA, 25 bp, Homo sapien
ctaccgccagcagcagtctcagacg

SEQ ID NO: 72571 - DNA, 25 bp, Homo sapien
gcacctgccgctggaagctattggg

SEQ ID NO: 72572 - DNA, 25 bp, Homo sapien
cctgccgctggaagctattgggctg

SEQ ID NO: 72573 - DNA, 25 bp, Homo sapien
agcaggacgactggctgtcctcctg

SEQ ID NO: 72574 - DNA, 25 bp, Homo sapien
aggcagctctaacagccctttcatg

SEQ ID NO: 72575 - DNA, 25 bp, Homo sapien
gctctaacagccctttcatgaaggt

SEQ ID NO: 72576 - DNA, 25 bp, Homo sapien
acagccctttcatgaaggtaatgct

SEQ ID NO: 72577 - DNA, 25 bp, Homo sapien
aggtaatgctagtcttctgtccatc

SEQ ID NO: 72578 - DNA, 25 bp, Homo sapien
gtaatgctagtcttctgtccatcag

SEQ ID NO: 72579 - DNA, 25 bp, Homo sapien
gtccatcagtgccatttcctgtaga

SEQ ID NO: 72580 - DNA, 25 bp, Homo sapien
cagtgccatttcctgtagaactaaa

SEQ ID NO: 72581 - DNA, 25 bp, Homo sapien
ttcctgtagaactaaaggctgttcc

SEQ ID NO: 72582 - DNA, 25 bp, Homo sapien
aaatgaccaggactttgccgtctcc

SEQ ID NO: 72583 - DNA, 25 bp, Homo sapien
tgccgtctcctttgcagaggatgca

SEQ ID NO: 72584 - DNA, 25 bp, Homo sapien
agaggatgcaagctcaagtcttaga

SEQ ID NO: 72585 - DNA, 25 bp, Homo sapien
gctttgggctcaacaagggctttca

SEQ ID NO: 72586 - DNA, 25 bp, Homo sapien
agggctttcacttgccattgcagaa

SEQ ID NO: 72587 - DNA, 25 bp, Homo sapien
ttgcagaaggtcctgttattcaaca

SEQ ID NO: 72588 - DNA, 25 bp, Homo sapien
gaatattcctatgggacctgcactg

SEQ ID NO: 72589 - DNA, 25 bp, Homo sapien
ggacctgcactgtcatgggtattaa

SEQ ID NO: 72590 - DNA, 25 bp, Homo sapien
gggtattaaccacagattctgctgc

SEQ ID NO: 72591 - DNA, 25 bp, Homo sapien
gaaactgtcgtgtgtcccatacatt

SEQ ID NO: 72592 - DNA, 25 bp, Homo sapien
attgccatcaactttgtttcctcat

SEQ ID NO: 72593 - DNA, 25 bp, Homo sapien
aaaatttagctaggcatggcggcgc

SEQ ID NO: 72594 - DNA, 25 bp, Homo sapien
ctcttccttttatataaatatcgtt

SEQ ID NO: 72595 - DNA, 25 bp, Homo sapien
ataaatatcgttagggtgaagcatt

SEQ ID NO: 72596 - DNA, 25 bp, Homo sapien
aatatcgttagggtgaagcattatg

SEQ ID NO: 72597 - DNA, 25 bp, Homo sapien
atcgttagggtgaagcattatggtc

SEQ ID NO: 72598 - DNA, 25 bp, Homo sapien
cgttagggtgaagcattatggtcca

SEQ ID NO: 72599 - DNA, 25 bp, Homo sapien
ttagggtgaagcattatggtccaat

SEQ ID NO: 72600 - DNA, 25 bp, Homo sapien
gggtgaagcattatggtccaatgat

SEQ ID NO: 72601 - DNA, 25 bp, Homo sapien
gtgaagcattatggtccaatgattc

SEQ ID NO: 72602 - DNA, 25 bp, Homo sapien
attatggtccaatgattcaaatgtt

SEQ ID NO: 72603 - DNA, 25 bp, Homo sapien
atgttttaaagtttaatgcctagca

SEQ ID NO: 72604 - DNA, 25 bp, Homo sapien
ggagaatgaggttctgtgttttgaa

SEQ ID NO: 72605 - DNA, 25 bp, Homo sapien
atgaggttctgtgttttgaagggaa

SEQ ID NO: 72606 - DNA, 25 bp, Homo sapien
gaagaatatcagaattggtagacat

SEQ ID NO: 72607 - DNA, 25 bp, Homo sapien
cagaattggtagacatttcaaactg

SEQ ID NO: 72608 - DNA, 25 bp, Homo sapien
caaactgtcacattagggatacaaa

SEQ ID NO: 72609 - DNA, 25 bp, Homo sapien
tacaaaaatgaacaggctgggagtg

SEQ ID NO: 72610 - DNA, 25 bp, Homo sapien
gggagtggtggctcagcctacaatc

SEQ ID NO: 72611 - DNA, 25 bp, Homo sapien
accaggagttcagtactaacctggg

SEQ ID NO: 72612 - DNA, 25 bp, Homo sapien
acaaagaggcccctgtctctgataa

SEQ ID NO: 72613 - DNA, 25 bp, Homo sapien
aaagaggcccctgtctctgataaaa

SEQ ID NO: 72614 - DNA, 25 bp, Homo sapien
gaggcccctgtctctgataaaaaga

SEQ ID NO: 72615 - DNA, 25 bp, Homo sapien
caaccagttactatgagtgaaaggg

SEQ ID NO: 72616 - DNA, 25 bp, Homo sapien
tactatgagtgaaagggagccagaa

SEQ ID NO: 72617 - DNA, 25 bp, Homo sapien
cagaagactgattggagggccctat

SEQ ID NO: 72618 - DNA, 25 bp, Homo sapien
agactgattggagggccctatcttg

SEQ ID NO: 72619 - DNA, 25 bp, Homo sapien
cctatcttgtgagtggggcatctgt

SEQ ID NO: 72620 - DNA, 25 bp, Homo sapien
gggcatctgttggactttccacctg

SEQ ID NO: 72621 - DNA, 25 bp, Homo sapien
gcatctgttggactttccacctggt

SEQ ID NO: 72622 - DNA, 25 bp, Homo sapien
tttccacctggtcatatactctgca

SEQ ID NO: 72623 - DNA, 25 bp, Homo sapien
cacctggtcatatactctgcagctg

SEQ ID NO: 72624 - DNA, 25 bp, Homo sapien
gctgttagaatgtgcaagcacttgg

SEQ ID NO: 72625 - DNA, 25 bp, Homo sapien
gcatgagcttgctgttgtacacagg

SEQ ID NO: 72626 - DNA, 25 bp, Homo sapien
ctcttccttttatataaatatcgtt

SEQ ID NO: 72627 - DNA, 25 bp, Homo sapien
cttccttttatataaatatcgttag

SEQ ID NO: 72628 - DNA, 25 bp, Homo sapien
atataaatatcgttagggtgaagca

SEQ ID NO: 72629 - DNA, 25 bp, Homo sapien
tataaatatcgttagggtgaagcat

SEQ ID NO: 72630 - DNA, 25 bp, Homo sapien
ataaatatcgttagggtgaagcatt

SEQ ID NO: 72631 - DNA, 25 bp, Homo sapien
taaatatcgttagggtgaagcatta

SEQ ID NO: 72632 - DNA, 25 bp, Homo sapien
aatatcgttagggtgaagcattatg

SEQ ID NO: 72633 - DNA, 25 bp, Homo sapien
atatcgttagggtgaagcattatgg

SEQ ID NO: 72634 - DNA, 25 bp, Homo sapien
tatcgttagggtgaagcattatggt

SEQ ID NO: 72635 - DNA, 25 bp, Homo sapien
atcgttagggtgaagcattatggtc

SEQ ID NO: 72636 - DNA, 25 bp, Homo sapien
atgttttaaagtttaatgcctagca

SEQ ID NO: 72637 - DNA, 25 bp, Homo sapien
gactctaacttccaaatcaaaatca

SEQ ID NO: 72638 - DNA, 25 bp, Homo sapien
aataatgctgattcctgagataaga

SEQ ID NO: 72639 - DNA, 25 bp, Homo sapien
aaagtggatttgatccccagtctca

SEQ ID NO: 72640 - DNA, 25 bp, Homo sapien
tgatccccagtctcattgcttagta

SEQ ID NO: 72641 - DNA, 25 bp, Homo sapien
ccccagtctcattgcttagtagaat

SEQ ID NO: 72642 - DNA, 25 bp, Homo sapien
cattgcttagtagaataaatcctgc

SEQ ID NO: 72643 - DNA, 25 bp, Homo sapien
tcctgcaccagcaacaacacttgta

SEQ ID NO: 72644 - DNA, 25 bp, Homo sapien
gcaccagcaacaacacttgtaaatt

SEQ ID NO: 72645 - DNA, 25 bp, Homo sapien
ttttaatccatcacacttttcttcc

SEQ ID NO: 72646 - DNA, 25 bp, Homo sapien
taatccatcacacttttcttcccta

SEQ ID NO: 72647 - DNA, 25 bp, Homo sapien
aatgagccagttatcaaagaagaac

SEQ ID NO: 72648 - DNA, 25 bp, Homo sapien
gctgtgataaagaagggcccatcct

SEQ ID NO: 72649 - DNA, 25 bp, Homo sapien
tatttcccctcatctagtccattta

SEQ ID NO: 72650 - DNA, 25 bp, Homo sapien
gtccatttacgattctcactgactc

SEQ ID NO: 72651 - DNA, 25 bp, Homo sapien
aaataaacccagtgtcaggtctagg

SEQ ID NO: 72652 - DNA, 25 bp, Homo sapien
cccagtgtcaggtctaggaaattaa

SEQ ID NO: 72653 - DNA, 25 bp, Homo sapien
ttaatggctattcttccccagatac

SEQ ID NO: 72654 - DNA, 25 bp, Homo sapien
gctattcttccccagatacattctg

SEQ ID NO: 72655 - DNA, 25 bp, Homo sapien
atacattctggcttatttgagatac

SEQ ID NO: 72656 - DNA, 25 bp, Homo sapien
attctcttagaatcctgtcccttgg

SEQ ID NO: 72657 - DNA, 25 bp, Homo sapien
gaatcctgtcccttggttcaggaaa

SEQ ID NO: 72658 - DNA, 25 bp, Homo sapien
gtcccttggttcaggaaagtagctt

SEQ ID NO: 72659 - DNA, 25 bp, Homo sapien
gtgatgccggtaaagaaaagttgcc

SEQ ID NO: 72660 - DNA, 25 bp, Homo sapien
ttgccgaagatgagactgcccacgc

SEQ ID NO: 72661 - DNA, 25 bp, Homo sapien
tgcccacgcgctcagacatgatatg

SEQ ID NO: 72662 - DNA, 25 bp, Homo sapien
tcagacatgatatgcggctatgcct

SEQ ID NO: 72663 - DNA, 25 bp, Homo sapien
atatgcggctatgcctgcctcaaag

SEQ ID NO: 72664 - DNA, 25 bp, Homo sapien
ctcaaagggactgccgccatgcgga

SEQ ID NO: 72665 - DNA, 25 bp, Homo sapien
gccatgcggaacaccaaacgaggtt

SEQ ID NO: 72666 - DNA, 25 bp, Homo sapien
acgaggttcctggtacatcgaggct

SEQ ID NO: 72667 - DNA, 25 bp, Homo sapien
atcgaggctcttgctcaagtgtttt

SEQ ID NO: 72668 - DNA, 25 bp, Homo sapien
aagtgttttctgagcgggcttgtga

SEQ ID NO: 72669 - DNA, 25 bp, Homo sapien
ctgagcgggcttgtgatatgcacgt

SEQ ID NO: 72670 - DNA, 25 bp, Homo sapien
atgcttcgggcattccatgcagcct

SEQ ID NO: 72671 - DNA, 25 bp, Homo sapien
attccatgcagccttgcggaactct

SEQ ID NO: 72672 - DNA, 25 bp, Homo sapien
gaactctcccgtcaacaccaagaat

SEQ ID NO: 72673 - DNA, 25 bp, Homo sapien
atcaagctgtgaaggagcgagccca

SEQ ID NO: 72674 - DNA, 25 bp, Homo sapien
tgaaagtgctcacaaacttcaagag

SEQ ID NO: 72675 - DNA, 25 bp, Homo sapien
cacaaacttcaagagcagtgagatt

SEQ ID NO: 72676 - DNA, 25 bp, Homo sapien
tgcagtcactggacagaaacggcgt

SEQ ID NO: 72677 - DNA, 25 bp, Homo sapien
gaaacggcgttgacttgttaatgaa

SEQ ID NO: 72678 - DNA, 25 bp, Homo sapien
aatagcagcgcagtgttactccagt

SEQ ID NO: 72679 - DNA, 25 bp, Homo sapien
gcagtgttactccagtggcacgaaa

SEQ ID NO: 72680 - DNA, 25 bp, Homo sapien
gtggcacgaaaaggccttagcagta

SEQ ID NO: 72681 - DNA, 25 bp, Homo sapien
aggatctttagcagtaccctagcct

SEQ ID NO: 72682 - DNA, 25 bp, Homo sapien
tagatgccaatgacataccttgctt

SEQ ID NO: 72683 - DNA, 25 bp, Homo sapien
taccttgcttcttcaccagttatga

SEQ ID NO: 72684 - DNA, 25 bp, Homo sapien
atgataaccaagaatgtctccattg

SEQ ID NO: 72685 - DNA, 25 bp, Homo sapien
gtctccattgttaaatgtcccctta

SEQ ID NO: 72686 - DNA, 25 bp, Homo sapien
atgtccccttaggagcaaaattgcc

SEQ ID NO: 72687 - DNA, 25 bp, Homo sapien
gagtatcatgtactacacttctgaa

SEQ ID NO: 72688 - DNA, 25 bp, Homo sapien
aacgtgatcatcaccactgacagat

SEQ ID NO: 72689 - DNA, 25 bp, Homo sapien
accactgacagatgattcacagaga

SEQ ID NO: 72690 - DNA, 25 bp, Homo sapien
aatcttgtctcactagtttttcctg

SEQ ID NO: 72691 - DNA, 25 bp, Homo sapien
gtctcactagtttttcctgtgcaaa

SEQ ID NO: 72692 - DNA, 25 bp, Homo sapien
tttctttatgtcgttagtccctgta

SEQ ID NO: 72693 - DNA, 25 bp, Homo sapien
gtcgttagtccctgtaaaatgttag

SEQ ID NO: 72694 - DNA, 25 bp, Homo sapien
ctgtaaaatgttaggtcacccaagg

SEQ ID NO: 72695 - DNA, 25 bp, Homo sapien
gaaatagcaatggttgttcctaagg

SEQ ID NO: 72696 - DNA, 25 bp, Homo sapien
tgttcctaaggtattgcttgccctc

SEQ ID NO: 72697 - DNA, 25 bp, Homo sapien
taaggtattgcttgccctccatgtc

SEQ ID NO: 72698 - DNA, 25 bp, Homo sapien
cctccatgtcttcctaaagagcaga

SEQ ID NO: 72699 - DNA, 25 bp, Homo sapien
agagcagaacttggagtttctcctt

SEQ ID NO: 72700 - DNA, 25 bp, Homo sapien
acttggagtttctcctttatgtaga

SEQ ID NO: 72701 - DNA, 25 bp, Homo sapien
aacttagggtgtatttgcaatgaaa

SEQ ID NO: 72702 - DNA, 25 bp, Homo sapien
tcctttttccaattctgtacattaa

SEQ ID NO: 72703 - DNA, 25 bp, Homo sapien
ccttgccatgggtcacactatgatg

SEQ ID NO: 72704 - DNA, 25 bp, Homo sapien
cactatgatgcatctggcaggatca

SEQ ID NO: 72705 - DNA, 25 bp, Homo sapien
caggatcagattgggtcctgctcct

SEQ ID NO: 72706 - DNA, 25 bp, Homo sapien
tcaaccttgaagtccccacgtatga

SEQ ID NO: 72707 - DNA, 25 bp, Homo sapien
aagtccccacgtatgagttcaccag

SEQ ID NO: 72708 - DNA, 25 bp, Homo sapien
atgagttcaccagtgacgatatggt

SEQ ID NO: 72709 - DNA, 25 bp, Homo sapien
tggactcaagtcataggcttctttc

SEQ ID NO: 72710 - DNA, 25 bp, Homo sapien
aggcttctttcagtctttatgtcac

SEQ ID NO: 72711 - DNA, 25 bp, Homo sapien
ctttatgtcacctcaggagacttat

SEQ ID NO: 72712 - DNA, 25 bp, Homo sapien
gagacttatttgagaggaagccttc

SEQ ID NO: 72713 - DNA, 25 bp, Homo sapien
ggaagccttctgtacttgaagttga

SEQ ID NO: 72714 - DNA, 25 bp, Homo sapien
gtgaggaaaagcacctggtttcggc

SEQ ID NO: 72715 - DNA, 25 bp, Homo sapien
tgaggaaaagcacctggtttcggcc

SEQ ID NO: 72716 - DNA, 25 bp, Homo sapien
gaggaaaagcacctggtttcggccg

SEQ ID NO: 72717 - DNA, 25 bp, Homo sapien
aagcacctggtttcggccgggcgcg

SEQ ID NO: 72718 - DNA, 25 bp, Homo sapien
catggcgaaaccctcgtccctacta

SEQ ID NO: 72719 - DNA, 25 bp, Homo sapien
agttgggcgtagtggtgggtgcctc

SEQ ID NO: 72720 - DNA, 25 bp, Homo sapien
ttgggcgtagtggtgggtgcctcta

SEQ ID NO: 72721 - DNA, 25 bp, Homo sapien
ctccagcctggcgacggaggaatgc

SEQ ID NO: 72722 - DNA, 25 bp, Homo sapien
tccagcctggcgacggaggaatgct

SEQ ID NO: 72723 - DNA, 25 bp, Homo sapien
ccagcctggcgacggaggaatgctg

SEQ ID NO: 72724 - DNA, 25 bp, Homo sapien
agcctggcgacggaggaatgctgtc

SEQ ID NO: 72725 - DNA, 25 bp, Homo sapien
cagtgcctagtgaagttaggtgact

SEQ ID NO: 72726 - DNA, 25 bp, Homo sapien
ttttacaccttttacgatgactact

SEQ ID NO: 72727 - DNA, 25 bp, Homo sapien
tacgatgactacttttggtggagtt

SEQ ID NO: 72728 - DNA, 25 bp, Homo sapien
ggtggagttgaaatgctgttttcat

SEQ ID NO: 72729 - DNA, 25 bp, Homo sapien
tcattctgcatttgtgtagtttggt

SEQ ID NO: 72730 - DNA, 25 bp, Homo sapien
gtagtttggtgctttgttccaagtt

SEQ ID NO: 72731 - DNA, 25 bp, Homo sapien
ttgactgctgagaagtttctattgt

SEQ ID NO: 72732 - DNA, 25 bp, Homo sapien
taaaaggtttttctactgaatccag

SEQ ID NO: 72733 - DNA, 25 bp, Homo sapien
tctactgaatccagggtattctgaa

SEQ ID NO: 72734 - DNA, 25 bp, Homo sapien
agatcgaagcctgtgtaaaatgcta

SEQ ID NO: 72735 - DNA, 25 bp, Homo sapien
gtgtaaaatgctaccaaatggcaaa

SEQ ID NO: 72736 - DNA, 25 bp, Homo sapien
agctgcatacgtgaggcttaccttc

SEQ ID NO: 72737 - DNA, 25 bp, Homo sapien
aggcttaccttcttcaggactagtt

SEQ ID NO: 72738 - DNA, 25 bp, Homo sapien
tcttcaggactagttaaccagaggg

SEQ ID NO: 72739 - DNA, 25 bp, Homo sapien
tttgtatgttacatgcctggttaca

SEQ ID NO: 72740 - DNA, 25 bp, Homo sapien
acatgcctggttacatgggcctgga

SEQ ID NO: 72741 - DNA, 25 bp, Homo sapien
ttacatgggcctggacagcatgtcc

SEQ ID NO: 72742 - DNA, 25 bp, Homo sapien
tggacagcatgtcctctacctgtga

SEQ ID NO: 72743 - DNA, 25 bp, Homo sapien
tcctctacctgtgacttctcatttt

SEQ ID NO: 72744 - DNA, 25 bp, Homo sapien
aaagtgaatgacctctgtccaccca

SEQ ID NO: 72745 - DNA, 25 bp, Homo sapien
cacccacttttttattgcactggct

SEQ ID NO: 72746 - DNA, 25 bp, Homo sapien
gcactggcttgaatacagtagcagt

SEQ ID NO: 72747 - DNA, 25 bp, Homo sapien
ggaaagtctctgtactcgttcatca

SEQ ID NO: 72748 - DNA, 25 bp, Homo sapien
gtactcgttcatcaagggtgacaca

SEQ ID NO: 72749 - DNA, 25 bp, Homo sapien
caagggtgacacatctggagactac

SEQ ID NO: 72750 - DNA, 25 bp, Homo sapien
aaagtactgcttgttctctgtggag

SEQ ID NO: 72751 - DNA, 25 bp, Homo sapien
ggacaggaggattctcaacactttg

SEQ ID NO: 72752 - DNA, 25 bp, Homo sapien
actgctattatcattatctcagaat

SEQ ID NO: 72753 - DNA, 25 bp, Homo sapien
atctcagaatgcttatttccaatta

SEQ ID NO: 72754 - DNA, 25 bp, Homo sapien
tttccaattaaaacgcctacagctg

SEQ ID NO: 72755 - DNA, 25 bp, Homo sapien
tgggcaccgatgataacaccctcat

SEQ ID NO: 72756 - DNA, 25 bp, Homo sapien
gacatgttggatatccgggcacact

SEQ ID NO: 72757 - DNA, 25 bp, Homo sapien
ccgggcacacttcaagagactctat

SEQ ID NO: 72758 - DNA, 25 bp, Homo sapien
tccagctggctaactctaaatatat

SEQ ID NO: 72759 - DNA, 25 bp, Homo sapien
gctggctaactctaaatatatgtgt

SEQ ID NO: 72760 - DNA, 25 bp, Homo sapien
taaatatatgtgtatcttttcagca

SEQ ID NO: 72761 - DNA, 25 bp, Homo sapien
tatatgtgtatcttttcagcataaa

SEQ ID NO: 72762 - DNA, 25 bp, Homo sapien
agaatcaaatctataagctttaaga

SEQ ID NO: 72763 - DNA, 25 bp, Homo sapien
tattagcttatttgactagaactca

SEQ ID NO: 72764 - DNA, 25 bp, Homo sapien
cttatttgactagaactcaagcaga

SEQ ID NO: 72765 - DNA, 25 bp, Homo sapien
agaactcaagcagaataggaattta

SEQ ID NO: 72766 - DNA, 25 bp, Homo sapien
gaataggaatttatgcttgttttat

SEQ ID NO: 72767 - DNA, 25 bp, Homo sapien
ttaactaagttttatccaaatcatg

SEQ ID NO: 72768 - DNA, 25 bp, Homo sapien
gttttatccaaatcatgttaactta

SEQ ID NO: 72769 - DNA, 25 bp, Homo sapien
acaaaacaagcacaggccaaggagt

SEQ ID NO: 72770 - DNA, 25 bp, Homo sapien
gccaaggagtgagatagccagcgct

SEQ ID NO: 72771 - DNA, 25 bp, Homo sapien
atagccagcgctgatggtatctgcc

SEQ ID NO: 72772 - DNA, 25 bp, Homo sapien
tggtatctgcctcgtagtgcatgaa

SEQ ID NO: 72773 - DNA, 25 bp, Homo sapien
agtgcatgaagtgcatgtcatacac

SEQ ID NO: 72774 - DNA, 25 bp, Homo sapien
atgtcatacactaagcagccagcca

SEQ ID NO: 72775 - DNA, 25 bp, Homo sapien
gccagtgttggctgtcagtgttatt

SEQ ID NO: 72776 - DNA, 25 bp, Homo sapien
gctgtcagtgttattactcacatgc

SEQ ID NO: 72777 - DNA, 25 bp, Homo sapien
gggtattattatcaatttccatttt

SEQ ID NO: 72778 - DNA, 25 bp, Homo sapien
cttcccaaggtcattgagctgttga

SEQ ID NO: 72779 - DNA, 25 bp, Homo sapien
agctcaggtctgtttgtaaatcttt

SEQ ID NO: 72780 - DNA, 25 bp, Homo sapien
ctccatccatgaagcagtcaccaaa

SEQ ID NO: 72781 - DNA, 25 bp, Homo sapien
agtgaagaaacaccacccgtccagt

SEQ ID NO: 72782 - DNA, 25 bp, Homo sapien
cgtccagtaccaccaaagtagttct

SEQ ID NO: 72783 - DNA, 25 bp, Homo sapien
accaaagtagttctctgtcatgtgt

SEQ ID NO: 72784 - DNA, 25 bp, Homo sapien
tgtcatgtgtgttccctgcctgcac

SEQ ID NO: 72785 - DNA, 25 bp, Homo sapien
tgcctgcacaaacctacatgtacat

SEQ ID NO: 72786 - DNA, 25 bp, Homo sapien
gtacataccatggattagagacact

SEQ ID NO: 72787 - DNA, 25 bp, Homo sapien
gattagagacacttgcaggactgaa

SEQ ID NO: 72788 - DNA, 25 bp, Homo sapien
tgcaggactgaaaggctgctctggt

SEQ ID NO: 72789 - DNA, 25 bp, Homo sapien
aaaccggccccacatgaagagaaca

SEQ ID NO: 72790 - DNA, 25 bp, Homo sapien
gagaacatcccttgagacgaatttg

SEQ ID NO: 72791 - DNA, 25 bp, Homo sapien
tcctttccttccccgttgtgaatct

SEQ ID NO: 72792 - DNA, 25 bp, Homo sapien
ctttccttccccgttgtgaatctca

SEQ ID NO: 72793 - DNA, 25 bp, Homo sapien
tttccttccccgttgtgaatctcag

SEQ ID NO: 72794 - DNA, 25 bp, Homo sapien
ttccttccccgttgtgaatctcagt

SEQ ID NO: 72795 - DNA, 25 bp, Homo sapien
tccttccccgttgtgaatctcagtt

SEQ ID NO: 72796 - DNA, 25 bp, Homo sapien
ccttccccgttgtgaatctcagttt

SEQ ID NO: 72797 - DNA, 25 bp, Homo sapien
gtgaatctcagttttgggacgggga

SEQ ID NO: 72798 - DNA, 25 bp, Homo sapien
tgaatctcagttttgggacggggag

SEQ ID NO: 72799 - DNA, 25 bp, Homo sapien
gaatctcagttttgggacggggagc

SEQ ID NO: 72800 - DNA, 25 bp, Homo sapien
aatctcagttttgggacggggagca

SEQ ID NO: 72801 - DNA, 25 bp, Homo sapien
atctcagttttgggacggggagcaa

SEQ ID NO: 72802 - DNA, 25 bp, Homo sapien
ggcgcacaccaccaatgcccagcta

SEQ ID NO: 72803 - DNA, 25 bp, Homo sapien
cacaccaccaatgcccagctagttt

SEQ ID NO: 72804 - DNA, 25 bp, Homo sapien
agctagtttttgtgtttttcataga

SEQ ID NO: 72805 - DNA, 25 bp, Homo sapien
agggtctcaccatgtcattcaagac

SEQ ID NO: 72806 - DNA, 25 bp, Homo sapien
gggtctcaccatgtcattcaagacc

SEQ ID NO: 72807 - DNA, 25 bp, Homo sapien
ggtctcaccatgtcattcaagacca

SEQ ID NO: 72808 - DNA, 25 bp, Homo sapien
gtctcaccatgtcattcaagaccag

SEQ ID NO: 72809 - DNA, 25 bp, Homo sapien
tctcaccatgtcattcaagaccagc

SEQ ID NO: 72810 - DNA, 25 bp, Homo sapien
ctcaccatgtcattcaagaccagcc

SEQ ID NO: 72811 - DNA, 25 bp, Homo sapien
tcaccatgtcattcaagaccagcct

SEQ ID NO: 72812 - DNA, 25 bp, Homo sapien
aatatataacaattagccaggcgtg

SEQ ID NO: 72813 - DNA, 25 bp, Homo sapien
tgattttctgttgcgtgttccttgt

SEQ ID NO: 72814 - DNA, 25 bp, Homo sapien
gcgtgttccttgtagccatagatgt

SEQ ID NO: 72815 - DNA, 25 bp, Homo sapien
gatgtgattatgtccacaccgggct

SEQ ID NO: 72816 - DNA, 25 bp, Homo sapien
attatgtccacaccgggctgcctta

SEQ ID NO: 72817 - DNA, 25 bp, Homo sapien
tgccttaatctgtcctgcttggaga

SEQ ID NO: 72818 - DNA, 25 bp, Homo sapien
gtcctgcttggagagtgacttgtaa

SEQ ID NO: 72819 - DNA, 25 bp, Homo sapien
aatgttctgggtccatgtactcaga

SEQ ID NO: 72820 - DNA, 25 bp, Homo sapien
tgggtccatgtactcagataaacat

SEQ ID NO: 72821 - DNA, 25 bp, Homo sapien
tggagactgggaaagcaaagctgtt

SEQ ID NO: 72822 - DNA, 25 bp, Homo sapien
agcaaagctgttttcatcctataat

SEQ ID NO: 72823 - DNA, 25 bp, Homo sapien
ggagcattaacttgtggatgattca

SEQ ID NO: 72824 - DNA, 25 bp, Homo sapien
tgtgttcagagagaatgaattgctt

SEQ ID NO: 72825 - DNA, 25 bp, Homo sapien
aaagtactaggttgcaatatgtgaa

SEQ ID NO: 72826 - DNA, 25 bp, Homo sapien
gcaatatgtgaaatcagaggaccaa

SEQ ID NO: 72827 - DNA, 25 bp, Homo sapien
gaaatcagaggaccaaagtacagat

SEQ ID NO: 72828 - DNA, 25 bp, Homo sapien
gaggaccaaagtacagatggaaacc

SEQ ID NO: 72829 - DNA, 25 bp, Homo sapien
gaaaccatttcctacatcacaaaaa

SEQ ID NO: 72830 - DNA, 25 bp, Homo sapien
atttcctacatcacaaaaacccaag

SEQ ID NO: 72831 - DNA, 25 bp, Homo sapien
ccaagtttacagcttgtactttact

SEQ ID NO: 72832 - DNA, 25 bp, Homo sapien
acagcttgtactttactttaatgtg

SEQ ID NO: 72833 - DNA, 25 bp, Homo sapien
actttaatgtgtaatactcaactca

SEQ ID NO: 72834 - DNA, 25 bp, Homo sapien
aagacaattgcatttaacattgtta

SEQ ID NO: 72835 - DNA, 25 bp, Homo sapien
ctcatgcctgtattctccaggaaac

SEQ ID NO: 72836 - DNA, 25 bp, Homo sapien
tcatgcctgtattctccaggaaact

SEQ ID NO: 72837 - DNA, 25 bp, Homo sapien
gaatgatatttctatatcgaagtga

SEQ ID NO: 72838 - DNA, 25 bp, Homo sapien
atcgaagtgaggtaggtgcggtatt

SEQ ID NO: 72839 - DNA, 25 bp, Homo sapien
gaagtgttagatggctaagtattaa

SEQ ID NO: 72840 - DNA, 25 bp, Homo sapien
tagcagtcagaacacttgcttcact

SEQ ID NO: 72841 - DNA, 25 bp, Homo sapien
gcagtcagaacacttgcttcactag

SEQ ID NO: 72842 - DNA, 25 bp, Homo sapien
gtcagaacacttgcttcactagaat

SEQ ID NO: 72843 - DNA, 25 bp, Homo sapien
gaacacttgcttcactagaatatgc

SEQ ID NO: 72844 - DNA, 25 bp, Homo sapien
cacttgcttcactagaatatgccaa

SEQ ID NO: 72845 - DNA, 25 bp, Homo sapien
gaatatgccaactgccaatcatgtt

SEQ ID NO: 72846 - DNA, 25 bp, Homo sapien
agtgggaacacagttccagctcggg

SEQ ID NO: 72847 - DNA, 25 bp, Homo sapien
ttcctatcacccagctcttcagaat

SEQ ID NO: 72848 - DNA, 25 bp, Homo sapien
agaatcctcaatcctaacaaggccc

SEQ ID NO: 72849 - DNA, 25 bp, Homo sapien
tgcggctaaagctgcgcctcaccta

SEQ ID NO: 72850 - DNA, 25 bp, Homo sapien
ctacgaccactttcaccagtcggtg

SEQ ID NO: 72851 - DNA, 25 bp, Homo sapien
cactttcaccagtcggtgcaggaga

SEQ ID NO: 72852 - DNA, 25 bp, Homo sapien
tcaccagtcggtgcaggagatcttt

SEQ ID NO: 72853 - DNA, 25 bp, Homo sapien
accagtcggtgcaggagatctttga

SEQ ID NO: 72854 - DNA, 25 bp, Homo sapien
cttgcctgtggaatcgtggcagtaa

SEQ ID NO: 72855 - DNA, 25 bp, Homo sapien
ggaatcgtggcagtaactgtctcca

SEQ ID NO: 72856 - DNA, 25 bp, Homo sapien
tcgtggcagtaactgtctccactca

SEQ ID NO: 72857 - DNA, 25 bp, Homo sapien
aaatgtactctccttttatgtggtc

SEQ ID NO: 72858 - DNA, 25 bp, Homo sapien
aatgtactctccttttatgtggtct

SEQ ID NO: 72859 - DNA, 25 bp, Homo sapien
atgtactctccttttatgtggtctc

SEQ ID NO: 72860 - DNA, 25 bp, Homo sapien
tgtactctccttttatgtggtctct

SEQ ID NO: 72861 - DNA, 25 bp, Homo sapien
gtactctccttttatgtggtctctt

SEQ ID NO: 72862 - DNA, 25 bp, Homo sapien
tactctccttttatgtggtctcttt

SEQ ID NO: 72863 - DNA, 25 bp, Homo sapien
actctccttttatgtggtctctttg

SEQ ID NO: 72864 - DNA, 25 bp, Homo sapien
tctccttttatgtggtctctttggg

SEQ ID NO: 72865 - DNA, 25 bp, Homo sapien
aagagaaatcaatagtgcaactgtt

SEQ ID NO: 72866 - DNA, 25 bp, Homo sapien
gagaaatcaatagtgcaactgtttt

SEQ ID NO: 72867 - DNA, 25 bp, Homo sapien
aaatcaatagtgcaactgttttgat

SEQ ID NO: 72868 - DNA, 25 bp, Homo sapien
ttttttcatgtatcgttcgttccat

SEQ ID NO: 72869 - DNA, 25 bp, Homo sapien
atgtatcgttcgttccattcatcca

SEQ ID NO: 72870 - DNA, 25 bp, Homo sapien
gttcgttccattcatccactctgtg

SEQ ID NO: 72871 - DNA, 25 bp, Homo sapien
ccactctgtgccttgtcagcctttg

SEQ ID NO: 72872 - DNA, 25 bp, Homo sapien
cctttgaaaggcttggttgctccca

SEQ ID NO: 72873 - DNA, 25 bp, Homo sapien
tgaaaggcttggttgctcccaggct

SEQ ID NO: 72874 - DNA, 25 bp, Homo sapien
ttggttgctcccaggctgctgttct

SEQ ID NO: 72875 - DNA, 25 bp, Homo sapien
gctgctgttctcagggaccttaaaa

SEQ ID NO: 72876 - DNA, 25 bp, Homo sapien
ggcagagagtatctacttgggcact

SEQ ID NO: 72877 - DNA, 25 bp, Homo sapien
gagtatctacttgggcactctcttc

SEQ ID NO: 72878 - DNA, 25 bp, Homo sapien
gggcactctcttccaagaaagacct

SEQ ID NO: 72879 - DNA, 25 bp, Homo sapien
ggaggtggacctggcttgcacaccc

SEQ ID NO: 72880 - DNA, 25 bp, Homo sapien
aggtggacctggcttgcacacccac

SEQ ID NO: 72881 - DNA, 25 bp, Homo sapien
accgacgtgcgggacgtggacatct

SEQ ID NO: 72882 - DNA, 25 bp, Homo sapien
tcctctccggagcattttgatacca

SEQ ID NO: 72883 - DNA, 25 bp, Homo sapien
tctccggagcattttgataccagaa

SEQ ID NO: 72884 - DNA, 25 bp, Homo sapien
ggagcattttgataccagaagggaa

SEQ ID NO: 72885 - DNA, 25 bp, Homo sapien
accagaagggaaagcttcattctcc

SEQ ID NO: 72886 - DNA, 25 bp, Homo sapien
tcattctccttgttgttggttgttt

SEQ ID NO: 72887 - DNA, 25 bp, Homo sapien
cattctccttgttgttggttgtttt

SEQ ID NO: 72888 - DNA, 25 bp, Homo sapien
ccttccatctctgacttaagcaaaa

SEQ ID NO: 72889 - DNA, 25 bp, Homo sapien
caggcccagcagaacatggacccca

SEQ ID NO: 72890 - DNA, 25 bp, Homo sapien
actgcttgctcacatccatatcaga

SEQ ID NO: 72891 - DNA, 25 bp, Homo sapien
cttgctcacatccatatcagaaggg

SEQ ID NO: 72892 - DNA, 25 bp, Homo sapien
ggaaaggaccacaaggcaatctggg

SEQ ID NO: 72893 - DNA, 25 bp, Homo sapien
ggtgtggacagacccagtagacaat

SEQ ID NO: 72894 - DNA, 25 bp, Homo sapien
cagacccagtagacaatggaagccc

SEQ ID NO: 72895 - DNA, 25 bp, Homo sapien
gacagtgaagctcaccagtgggctc

SEQ ID NO: 72896 - DNA, 25 bp, Homo sapien
cagtgggctcctttatggtactcta

SEQ ID NO: 72897 - DNA, 25 bp, Homo sapien
ggctcctttatggtactctatgcag

SEQ ID NO: 72898 - DNA, 25 bp, Homo sapien
ggtactctatgcagttaacatgtat

SEQ ID NO: 72899 - DNA, 25 bp, Homo sapien
ttaacatgtatctagctgcataggg

SEQ ID NO: 72900 - DNA, 25 bp, Homo sapien
tgcatagggacacccagcgcagcag

SEQ ID NO: 72901 - DNA, 25 bp, Homo sapien
tctgcagagctagttgagaactcaa

SEQ ID NO: 72902 - DNA, 25 bp, Homo sapien
aaaagtactgtccttgaaatagatt

SEQ ID NO: 72903 - DNA, 25 bp, Homo sapien
gggttctagttgagctctgtagata

SEQ ID NO: 72904 - DNA, 25 bp, Homo sapien
gagctctgtagataaatgccttgtt

SEQ ID NO: 72905 - DNA, 25 bp, Homo sapien
atgccttgtttcagtgtggttggag

SEQ ID NO: 72906 - DNA, 25 bp, Homo sapien
ccttgtttcagtgtggttggagacc

SEQ ID NO: 72907 - DNA, 25 bp, Homo sapien
ggttggagacctggtgtcagataaa

SEQ ID NO: 72908 - DNA, 25 bp, Homo sapien
acctggtgtcagataaaagaaactc

SEQ ID NO: 72909 - DNA, 25 bp, Homo sapien
taaaagaaactccatccgcacagac

SEQ ID NO: 72910 - DNA, 25 bp, Homo sapien
aactccatccgcacagacagatgca

SEQ ID NO: 72911 - DNA, 25 bp, Homo sapien
gacagatgcaaacagctcctctagt

SEQ ID NO: 72912 - DNA, 25 bp, Homo sapien
ctcctggcacagaattccaccggtg

SEQ ID NO: 72913 - DNA, 25 bp, Homo sapien
tggcacagaattccaccggtgcaag

SEQ ID NO: 72914 - DNA, 25 bp, Homo sapien
gcacagaattccaccggtgcaagga

SEQ ID NO: 72915 - DNA, 25 bp, Homo sapien
ggccgacatgctggttaaggtgaac

SEQ ID NO: 72916 - DNA, 25 bp, Homo sapien
gacatgctggttaaggtgaacgcac

SEQ ID NO: 72917 - DNA, 25 bp, Homo sapien
gctggttaaggtgaacgcacttatc

SEQ ID NO: 72918 - DNA, 25 bp, Homo sapien
aaggtgaacgcacttatcaaggatc

SEQ ID NO: 72919 - DNA, 25 bp, Homo sapien
gtgaacgcacttatcaaggatcggg

SEQ ID NO: 72920 - DNA, 25 bp, Homo sapien
gaacgcacttatcaaggatcgggaa

SEQ ID NO: 72921 - DNA, 25 bp, Homo sapien
gcacttatcaaggatcgggaaggtt

SEQ ID NO: 72922 - DNA, 25 bp, Homo sapien
atcgggaaggttatgctcctggcac

SEQ ID NO: 72923 - DNA, 25 bp, Homo sapien
aggagaagagtgaccgtctgctcaa

SEQ ID NO: 72924 - DNA, 25 bp, Homo sapien
aagagtgaccgtctgctcaaggtcc

SEQ ID NO: 72925 - DNA, 25 bp, Homo sapien
gtgaccgtctgctcaaggtcctctt

SEQ ID NO: 72926 - DNA, 25 bp, Homo sapien
ctggtgctgggctacaccgtcctgg

SEQ ID NO: 72927 - DNA, 25 bp, Homo sapien
gctacaccgtcctggccgggatggt

SEQ ID NO: 72928 - DNA, 25 bp, Homo sapien
gccgggatggtcttcctcaagtggt

SEQ ID NO: 72929 - DNA, 25 bp, Homo sapien
atggtcttcctcaagtggtgagcgg

SEQ ID NO: 72930 - DNA, 25 bp, Homo sapien
ctcaagtggtgagcggcctcgccat

SEQ ID NO: 72931 - DNA, 25 bp, Homo sapien
ccaagagcgagcactgtggccctgg

SEQ ID NO: 72932 - DNA, 25 bp, Homo sapien
tgagcctcagagcactgctactttt

SEQ ID NO: 72933 - DNA, 25 bp, Homo sapien
gcctcagagcactgctactttttaa

SEQ ID NO: 72934 - DNA, 25 bp, Homo sapien
ttctgctgggcctttagccctagaa

SEQ ID NO: 72935 - DNA, 25 bp, Homo sapien
tttagccctagaacctgcaggtggt

SEQ ID NO: 72936 - DNA, 25 bp, Homo sapien
ctgggtggtccagccctgatgattg

SEQ ID NO: 72937 - DNA, 25 bp, Homo sapien
ggtccagccctgatgattggcccca

SEQ ID NO: 72938 - DNA, 25 bp, Homo sapien
ataaccctctcttcatttcggcttt

SEQ ID NO: 72939 - DNA, 25 bp, Homo sapien
cctctcttcatttcggctttttcat

SEQ ID NO: 72940 - DNA, 25 bp, Homo sapien
tttcatttaccctcatttagagcca

SEQ ID NO: 72941 - DNA, 25 bp, Homo sapien
taccctcatttagagccatttgcag

SEQ ID NO: 72942 - DNA, 25 bp, Homo sapien
tagagccatttgcagagatttagaa

SEQ ID NO: 72943 - DNA, 25 bp, Homo sapien
gatttacagtaacgaatggattcct

SEQ ID NO: 72944 - DNA, 25 bp, Homo sapien
gtaatatttgtacagtgttcaagtg

SEQ ID NO: 72945 - DNA, 25 bp, Homo sapien
tatgatggtaacaactcctatgatg

SEQ ID NO: 72946 - DNA, 25 bp, Homo sapien
acataaagagccagttccttgacct

SEQ ID NO: 72947 - DNA, 25 bp, Homo sapien
agttccttgacctcaatatgcgaaa

SEQ ID NO: 72948 - DNA, 25 bp, Homo sapien
ttgacctcaatatgcgaaaagatgt

SEQ ID NO: 72949 - DNA, 25 bp, Homo sapien
agaaatctacagtcacatgacctgt

SEQ ID NO: 72950 - DNA, 25 bp, Homo sapien
gaatgtcaaatttgtgtttgatgca

SEQ ID NO: 72951 - DNA, 25 bp, Homo sapien
gtttgatgcagttacagatattatc

SEQ ID NO: 72952 - DNA, 25 bp, Homo sapien
agaaaacctcaaggactgcggcctc

SEQ ID NO: 72953 - DNA, 25 bp, Homo sapien
taatcctcaccattcctcaggtata

SEQ ID NO: 72954 - DNA, 25 bp, Homo sapien
ccattcctcaggtataagttctata

SEQ ID NO: 72955 - DNA, 25 bp, Homo sapien
agttctataaacaggcttggaatct

SEQ ID NO: 72956 - DNA, 25 bp, Homo sapien
tgctgtgccagaccagagtttcctg

SEQ ID NO: 72957 - DNA, 25 bp, Homo sapien
gtgccagaccagagtttcctgaggg

SEQ ID NO: 72958 - DNA, 25 bp, Homo sapien
gtacacctgaccctgtaaatgagtg

SEQ ID NO: 72959 - DNA, 25 bp, Homo sapien
ggtttgctgactgtaatccctgaca

SEQ ID NO: 72960 - DNA, 25 bp, Homo sapien
gactgtaatccctgacaccagtaaa

SEQ ID NO: 72961 - DNA, 25 bp, Homo sapien
cagtgtgagagccagggttacctac

SEQ ID NO: 72962 - DNA, 25 bp, Homo sapien
agggttacctactctgccaagtgag

SEQ ID NO: 72963 - DNA, 25 bp, Homo sapien
tctgccaagtgaggacaaactgcta

SEQ ID NO: 72964 - DNA, 25 bp, Homo sapien
ggacaaactgctaggctgtatccca

SEQ ID NO: 72965 - DNA, 25 bp, Homo sapien
actgctaggctgtatcccataattt

SEQ ID NO: 72966 - DNA, 25 bp, Homo sapien
ggctgtatcccataatttcaggatg

SEQ ID NO: 72967 - DNA, 25 bp, Homo sapien
gaattcatggacgacacgagccgat

SEQ ID NO: 72968 - DNA, 25 bp, Homo sapien
agccgatccatcatccgcaatgtaa

SEQ ID NO: 72969 - DNA, 25 bp, Homo sapien
cgagggcgacgtgctcacccttttg

SEQ ID NO: 72970 - DNA, 25 bp, Homo sapien
cacccttttggagtcagagcgagaa

SEQ ID NO: 72971 - DNA, 25 bp, Homo sapien
gttgcgctgagcttggctgctcgct

SEQ ID NO: 72972 - DNA, 25 bp, Homo sapien
ttggatgtcgggttcgaccacttgg

SEQ ID NO: 72973 - DNA, 25 bp, Homo sapien
ggttcgaccacttggccgatgggaa

SEQ ID NO: 72974 - DNA, 25 bp, Homo sapien
tggccgatgggaatggtctgtcaca

SEQ ID NO: 72975 - DNA, 25 bp, Homo sapien
ttttttgtccgccacacgtaactga

SEQ ID NO: 72976 - DNA, 25 bp, Homo sapien
gccacacgtaactgagatgctcctt

SEQ ID NO: 72977 - DNA, 25 bp, Homo sapien
gagatgctcctttaaataaagcgtt

SEQ ID NO: 72978 - DNA, 25 bp, Homo sapien
gcatacagcctgatctaggtgagtc

SEQ ID NO: 72979 - DNA, 25 bp, Homo sapien
gatctaggtgagtcgagttacatac

SEQ ID NO: 72980 - DNA, 25 bp, Homo sapien
gttacatactgagaatctgtgctgt

SEQ ID NO: 72981 - DNA, 25 bp, Homo sapien
tctgtgctgtacgatgtgaactcat

SEQ ID NO: 72982 - DNA, 25 bp, Homo sapien
gatgtgaactcatttttgcttgcaa

SEQ ID NO: 72983 - DNA, 25 bp, Homo sapien
atgtgaaacttgctcgtgtctttgc

SEQ ID NO: 72984 - DNA, 25 bp, Homo sapien
gtgtctttgcttgcccaggaagcaa

SEQ ID NO: 72985 - DNA, 25 bp, Homo sapien
ggaagcaaagaatctcttgtctatc

SEQ ID NO: 72986 - DNA, 25 bp, Homo sapien
atgtgcccttttcatttcattcgtt

SEQ ID NO: 72987 - DNA, 25 bp, Homo sapien
gaaaacgttgttaagcgtctggcat

SEQ ID NO: 72988 - DNA, 25 bp, Homo sapien
gagtgtatgatgaggtccctttcta

SEQ ID NO: 72989 - DNA, 25 bp, Homo sapien
ccctgctgcctctgatcgtaggaat

SEQ ID NO: 72990 - DNA, 25 bp, Homo sapien
cctgctgcctctgatcgtaggaatt

SEQ ID NO: 72991 - DNA, 25 bp, Homo sapien
ctgctgcctctgatcgtaggaattg

SEQ ID NO: 72992 - DNA, 25 bp, Homo sapien
tgctgcctctgatcgtaggaattga

SEQ ID NO: 72993 - DNA, 25 bp, Homo sapien
taggaattgaggagtgtcccgcctt

SEQ ID NO: 72994 - DNA, 25 bp, Homo sapien
aggaattgaggagtgtcccgccttg

SEQ ID NO: 72995 - DNA, 25 bp, Homo sapien
ggaattgaggagtgtcccgccttgt

SEQ ID NO: 72996 - DNA, 25 bp, Homo sapien
gaattgaggagtgtcccgccttgtg

SEQ ID NO: 72997 - DNA, 25 bp, Homo sapien
aattgaggagtgtcccgccttgtgg

SEQ ID NO: 72998 - DNA, 25 bp, Homo sapien
cgccttgtggctgagaactggacag

SEQ ID NO: 72999 - DNA, 25 bp, Homo sapien
ccttgtggctgagaactggacagtg

SEQ ID NO: 73000 - DNA, 25 bp, Homo sapien
atacagtggcatgatttcagttcac

SEQ ID NO: 73001 - DNA, 25 bp, Homo sapien
tacagtggcatgatttcagttcact

SEQ ID NO: 73002 - DNA, 25 bp, Homo sapien
atgatttcagttcactgcagcctcg

SEQ ID NO: 73003 - DNA, 25 bp, Homo sapien
aggcagtgtgccaccacatccagct

SEQ ID NO: 73004 - DNA, 25 bp, Homo sapien
ggcagtgtgccaccacatccagcta

SEQ ID NO: 73005 - DNA, 25 bp, Homo sapien
taaagttttttcatagagacaggga

SEQ ID NO: 73006 - DNA, 25 bp, Homo sapien
gttttttcatagagacagggactca

SEQ ID NO: 73007 - DNA, 25 bp, Homo sapien
ttttttcatagagacagggactcac

SEQ ID NO: 73008 - DNA, 25 bp, Homo sapien
tttttcatagagacagggactcact

SEQ ID NO: 73009 - DNA, 25 bp, Homo sapien
ttcatagagacagggactcactatg

SEQ ID NO: 73010 - DNA, 25 bp, Homo sapien
catagagacagggactcactatgtt

SEQ ID NO: 73011 - DNA, 25 bp, Homo sapien
gcaagtttcttagccgttctgagcc

SEQ ID NO: 73012 - DNA, 25 bp, Homo sapien
tcttagccgttctgagccttcattt

SEQ ID NO: 73013 - DNA, 25 bp, Homo sapien
aatagtacctatcatctaccttcag

SEQ ID NO: 73014 - DNA, 25 bp, Homo sapien
gtacctatcatctaccttcaggatt

SEQ ID NO: 73015 - DNA, 25 bp, Homo sapien
atctaccttcaggattgctgacaga

SEQ ID NO: 73016 - DNA, 25 bp, Homo sapien
aaaaatggtagccactcacccttca

SEQ ID NO: 73017 - DNA, 25 bp, Homo sapien
ttcacaaactgaagtccatggacca

SEQ ID NO: 73018 - DNA, 25 bp, Homo sapien
gtccatggaccacggaagtcgagaa

SEQ ID NO: 73019 - DNA, 25 bp, Homo sapien
gtcgagaattaatgtacacctgtat

SEQ ID NO: 73020 - DNA, 25 bp, Homo sapien
cacctgtatcatgtgtaggaaacca

SEQ ID NO: 73021 - DNA, 25 bp, Homo sapien
ttcccaaacaggattaactgtgaag

SEQ ID NO: 73022 - DNA, 25 bp, Homo sapien
gtgttgaatgtggttgagtttgtcc

SEQ ID NO: 73023 - DNA, 25 bp, Homo sapien
gagtttgtccattgctagggagaga

SEQ ID NO: 73024 - DNA, 25 bp, Homo sapien
gctagggagagacttccagtaataa

SEQ ID NO: 73025 - DNA, 25 bp, Homo sapien
aatttactattctagatgcttctac

SEQ ID NO: 73026 - DNA, 25 bp, Homo sapien
agatgcttctactgttatgttttat

SEQ ID NO: 73027 - DNA, 25 bp, Homo sapien
tctactgttatgttttatctgccca

SEQ ID NO: 73028 - DNA, 25 bp, Homo sapien
gttttatctgcccatttatctttct

SEQ ID NO: 73029 - DNA, 25 bp, Homo sapien
atctgcccatttatctttcttagtt

SEQ ID NO: 73030 - DNA, 25 bp, Homo sapien
ttatctttcttagttaccaggagaa

SEQ ID NO: 73031 - DNA, 25 bp, Homo sapien
ccaggagaaatgtgtgacacctata

SEQ ID NO: 73032 - DNA, 25 bp, Homo sapien
ttctttgatattgttgcttttgcaa

SEQ ID NO: 73033 - DNA, 25 bp, Homo sapien
tgacttctgccttcatctgcagtaa

SEQ ID NO: 73034 - DNA, 25 bp, Homo sapien
ttctgccttcatctgcagtaacggg

SEQ ID NO: 73035 - DNA, 25 bp, Homo sapien
tgacctcttccccagccatttagaa

SEQ ID NO: 73036 - DNA, 25 bp, Homo sapien
ctcttccccagccatttagaaacaa

SEQ ID NO: 73037 - DNA, 25 bp, Homo sapien
tccccagccatttagaaacaagttc

SEQ ID NO: 73038 - DNA, 25 bp, Homo sapien
tctagggtgggttggaaaatctcca

SEQ ID NO: 73039 - DNA, 25 bp, Homo sapien
tcagcaaccatgacctgaaacctca

SEQ ID NO: 73040 - DNA, 25 bp, Homo sapien
aaccatgacctgaaacctcagcgtg

SEQ ID NO: 73041 - DNA, 25 bp, Homo sapien
ttcagtggaacccttgcccccaaat

SEQ ID NO: 73042 - DNA, 25 bp, Homo sapien
accagcccccaaatgtcgaagaatt

SEQ ID NO: 73043 - DNA, 25 bp, Homo sapien
agaattttcttcttgccaattttgt

SEQ ID NO: 73044 - DNA, 25 bp, Homo sapien
catctggctgtgacagcctctgcag

SEQ ID NO: 73045 - DNA, 25 bp, Homo sapien
atctggctgtgacagcctctgcagt

SEQ ID NO: 73046 - DNA, 25 bp, Homo sapien
ggctgtgacagcctctgcagtccgt

SEQ ID NO: 73047 - DNA, 25 bp, Homo sapien
gctgtgacagcctctgcagtccgtg

SEQ ID NO: 73048 - DNA, 25 bp, Homo sapien
ctgtgacagcctctgcagtccgtgg

SEQ ID NO: 73049 - DNA, 25 bp, Homo sapien
tctgcagtccgtgggctggcagttt

SEQ ID NO: 73050 - DNA, 25 bp, Homo sapien
ccgtgggctggcagtttgttgatct

SEQ ID NO: 73051 - DNA, 25 bp, Homo sapien
tctggtaaggtttctaggaggtctg

SEQ ID NO: 73052 - DNA, 25 bp, Homo sapien
ctaggaggtctgttaggtgtacatc

SEQ ID NO: 73053 - DNA, 25 bp, Homo sapien
aaatgtactctccttttatgtggtc

SEQ ID NO: 73054 - DNA, 25 bp, Homo sapien
tctccttttatgtggtctctttggg

SEQ ID NO: 73055 - DNA, 25 bp, Homo sapien
tatcatcaacgggtacaaacgagtc

SEQ ID NO: 73056 - DNA, 25 bp, Homo sapien
tcaacgggtacaaacgagtcctggc

SEQ ID NO: 73057 - DNA, 25 bp, Homo sapien
gggtacaaacgagtcctggccttgt

SEQ ID NO: 73058 - DNA, 25 bp, Homo sapien
gtacaaacgagtcctggccttgtct

SEQ ID NO: 73059 - DNA, 25 bp, Homo sapien
caaacgagtcctggccttgtctgtg

SEQ ID NO: 73060 - DNA, 25 bp, Homo sapien
ctggccttgtctgtggagacggatt

SEQ ID NO: 73061 - DNA, 25 bp, Homo sapien
gccttgtctgtggagacggattaca

SEQ ID NO: 73062 - DNA, 25 bp, Homo sapien
tgtggagacggattacaccttccca

SEQ ID NO: 73063 - DNA, 25 bp, Homo sapien
tacaccttcccacttgctgaaaagg

SEQ ID NO: 73064 - DNA, 25 bp, Homo sapien
acaccttcccacttgctgaaaaggt

SEQ ID NO: 73065 - DNA, 25 bp, Homo sapien
ttcttggctgatccatctgcctttg

SEQ ID NO: 73066 - DNA, 25 bp, Homo sapien
tcttaagacccctctcagggtgcca

SEQ ID NO: 73067 - DNA, 25 bp, Homo sapien
ttaagacccctctcagggtgccact

SEQ ID NO: 73068 - DNA, 25 bp, Homo sapien
taagacccctctcagggtgccactg

SEQ ID NO: 73069 - DNA, 25 bp, Homo sapien
aagacccctctcagggtgccactga

SEQ ID NO: 73070 - DNA, 25 bp, Homo sapien
cccctctcagggtgccactgatggg

SEQ ID NO: 73071 - DNA, 25 bp, Homo sapien
gagggaaggccctctctctactcct

SEQ ID NO: 73072 - DNA, 25 bp, Homo sapien
ggaaggccctctctctactccttga

SEQ ID NO: 73073 - DNA, 25 bp, Homo sapien
caaaatcacaccattttcatgcctg

SEQ ID NO: 73074 - DNA, 25 bp, Homo sapien
aaaatcacaccattttcatgcctgt

SEQ ID NO: 73075 - DNA, 25 bp, Homo sapien
atcacaccattttcatgcctgtcaa

SEQ ID NO: 73076 - DNA, 25 bp, Homo sapien
attttcatgcctgtcaatccccacc

SEQ ID NO: 73077 - DNA, 25 bp, Homo sapien
tgtgagggacagtactgaagactct

SEQ ID NO: 73078 - DNA, 25 bp, Homo sapien
agggacagtactgaagactctgcag

SEQ ID NO: 73079 - DNA, 25 bp, Homo sapien
tgaagactctgcagccctcgggacc

SEQ ID NO: 73080 - DNA, 25 bp, Homo sapien
cactcggagggtgccctctgctcag

SEQ ID NO: 73081 - DNA, 25 bp, Homo sapien
taaccaaattctccctggaccccat

SEQ ID NO: 73082 - DNA, 25 bp, Homo sapien
tcaatctaaggccttccctgtcaga

SEQ ID NO: 73083 - DNA, 25 bp, Homo sapien
atctaaggccttccctgtcagaagg

SEQ ID NO: 73084 - DNA, 25 bp, Homo sapien
tggcaaaagccacattacaagctgc

SEQ ID NO: 73085 - DNA, 25 bp, Homo sapien
aaagccacattacaagctgccatcc

SEQ ID NO: 73086 - DNA, 25 bp, Homo sapien
ctgtggccaggtgcttttccctatc

SEQ ID NO: 73087 - DNA, 25 bp, Homo sapien
ccaggtgcttttccctatccacagg

SEQ ID NO: 73088 - DNA, 25 bp, Homo sapien
gagacactgggatggtccttgttaa

SEQ ID NO: 73089 - DNA, 25 bp, Homo sapien
ggatggtccttgttaaccccttctg

SEQ ID NO: 73090 - DNA, 25 bp, Homo sapien
taaccccttctgtcaagaaacactg

SEQ ID NO: 73091 - DNA, 25 bp, Homo sapien
aacactgtttgtgggaaacgatcaa

SEQ ID NO: 73092 - DNA, 25 bp, Homo sapien
gatctaactacagcaggcatcactt

SEQ ID NO: 73093 - DNA, 25 bp, Homo sapien
gcatcactttgccattccgtatttt

SEQ ID NO: 73094 - DNA, 25 bp, Homo sapien
gccattccgtatttttcgtctctaa

SEQ ID NO: 73095 - DNA, 25 bp, Homo sapien
tataacctttgtgtaaccctgactt

SEQ ID NO: 73096 - DNA, 25 bp, Homo sapien
gtaaccctgacttaatgagaaacat

SEQ ID NO: 73097 - DNA, 25 bp, Homo sapien
ttttcctatgaattgtcaacatctt

SEQ ID NO: 73098 - DNA, 25 bp, Homo sapien
cagaatgatctgtggctttataaaa

SEQ ID NO: 73099 - DNA, 25 bp, Homo sapien
tctccctggacatacgttagcacat

SEQ ID NO: 73100 - DNA, 25 bp, Homo sapien
ggacatacgttagcacattggcatt

SEQ ID NO: 73101 - DNA, 25 bp, Homo sapien
acgttagcacattggcattcagtat

SEQ ID NO: 73102 - DNA, 25 bp, Homo sapien
gcattcagtattggtggcctggcat

SEQ ID NO: 73103 - DNA, 25 bp, Homo sapien
ctggcatggtaggtactacccaatg

SEQ ID NO: 73104 - DNA, 25 bp, Homo sapien
gtaggtactacccaatgaagagtgt

SEQ ID NO: 73105 - DNA, 25 bp, Homo sapien
ctacccaatgaagagtgtactatat

SEQ ID NO: 73106 - DNA, 25 bp, Homo sapien
attttcattactataggccatactt

SEQ ID NO: 73107 - DNA, 25 bp, Homo sapien
ataggccatacttatacagacgtgt

SEQ ID NO: 73108 - DNA, 25 bp, Homo sapien
aagatctacctatcttaggatggaa

SEQ ID NO: 73109 - DNA, 25 bp, Homo sapien
acctatcttaggatggaaccttggg

SEQ ID NO: 73110 - DNA, 25 bp, Homo sapien
aagtgagagccttgtatacacttca

SEQ ID NO: 73111 - DNA, 25 bp, Homo sapien
aaaagtacccgtactcagtactcag

SEQ ID NO: 73112 - DNA, 25 bp, Homo sapien
tactcagtactcagccggcagcata

SEQ ID NO: 73113 - DNA, 25 bp, Homo sapien
gtactcagccggcagcataatgaaa

SEQ ID NO: 73114 - DNA, 25 bp, Homo sapien
tcagccggcagcataatgaaaagtg

SEQ ID NO: 73115 - DNA, 25 bp, Homo sapien
aagtgggactagacacggtgtccat

SEQ ID NO: 73116 - DNA, 25 bp, Homo sapien
ctagacacggtgtccatatggagag

SEQ ID NO: 73117 - DNA, 25 bp, Homo sapien
gaatccttctgtaactttggtaact

SEQ ID NO: 73118 - DNA, 25 bp, Homo sapien
gtaactttggtaactgcatacttgt

SEQ ID NO: 73119 - DNA, 25 bp, Homo sapien
gaaccagaggaggtataatactcta

SEQ ID NO: 73120 - DNA, 25 bp, Homo sapien
taatactctagaattgtgtaacatt

SEQ ID NO: 73121 - DNA, 25 bp, Homo sapien
catctggctgtgacagcctctgcag

SEQ ID NO: 73122 - DNA, 25 bp, Homo sapien
atctggctgtgacagcctctgcagt

SEQ ID NO: 73123 - DNA, 25 bp, Homo sapien
tctggctgtgacagcctctgcagtc

SEQ ID NO: 73124 - DNA, 25 bp, Homo sapien
ctggctgtgacagcctctgcagtcc

SEQ ID NO: 73125 - DNA, 25 bp, Homo sapien
tggctgtgacagcctctgcagtccg

SEQ ID NO: 73126 - DNA, 25 bp, Homo sapien
ggctgtgacagcctctgcagtccgt

SEQ ID NO: 73127 - DNA, 25 bp, Homo sapien
gctgtgacagcctctgcagtccgtg

SEQ ID NO: 73128 - DNA, 25 bp, Homo sapien
ctgtgacagcctctgcagtccgtgg

SEQ ID NO: 73129 - DNA, 25 bp, Homo sapien
agtgttcacatcttgttccccattt

SEQ ID NO: 73130 - DNA, 25 bp, Homo sapien
atttctcacttgtgtcaccagctgt

SEQ ID NO: 73131 - DNA, 25 bp, Homo sapien
gtcaccagctgtttgtgccattttt

SEQ ID NO: 73132 - DNA, 25 bp, Homo sapien
gtaaaagttgcagacctattagatc

SEQ ID NO: 73133 - DNA, 25 bp, Homo sapien
gatctgcagtttaagttgccatgct

SEQ ID NO: 73134 - DNA, 25 bp, Homo sapien
ttgccatgctgctaggaaattgtcc

SEQ ID NO: 73135 - DNA, 25 bp, Homo sapien
ctagctgttaacctacttcctggaa

SEQ ID NO: 73136 - DNA, 25 bp, Homo sapien
ttcctggaaaaagtagtagctctct

SEQ ID NO: 73137 - DNA, 25 bp, Homo sapien
gtagctctctgtagcattatggagt

SEQ ID NO: 73138 - DNA, 25 bp, Homo sapien
cagtggaaccaaatttttgccatta

SEQ ID NO: 73139 - DNA, 25 bp, Homo sapien
aaaaactggcattatactgaactat

SEQ ID NO: 73140 - DNA, 25 bp, Homo sapien
tctaaactcatcttctttcaatata

SEQ ID NO: 73141 - DNA, 25 bp, Homo sapien
attgatgctatctcctaattacttg

SEQ ID NO: 73142 - DNA, 25 bp, Homo sapien
tatctcctaattacttggtggctaa

SEQ ID NO: 73143 - DNA, 25 bp, Homo sapien
acttggtggctaataaatgttacat

SEQ ID NO: 73144 - DNA, 25 bp, Homo sapien
gttacattctttgttacttaaatgc

SEQ ID NO: 73145 - DNA, 25 bp, Homo sapien
aacccttggatttatgtgaggtcaa

SEQ ID NO: 73146 - DNA, 25 bp, Homo sapien
gtgaggtcaaaaccaaactcttatt

SEQ ID NO: 73147 - DNA, 25 bp, Homo sapien
aaccaaactcttattctcagtggaa

SEQ ID NO: 73148 - DNA, 25 bp, Homo sapien
ctcagtggaaaactccagttgtaat

SEQ ID NO: 73149 - DNA, 25 bp, Homo sapien
actccagttgtaatgcatattttta

SEQ ID NO: 73150 - DNA, 25 bp, Homo sapien
atgtatttcataattctcccataat

SEQ ID NO: 73151 - DNA, 25 bp, Homo sapien
tatggatagaagtacagaattttga

SEQ ID NO: 73152 - DNA, 25 bp, Homo sapien
aaaatgttcttatatatctgcttca

SEQ ID NO: 73153 - DNA, 25 bp, Homo sapien
atatctgcttcatcttaccttcata

SEQ ID NO: 73154 - DNA, 25 bp, Homo sapien
atctgcttcatcttaccttcatact

SEQ ID NO: 73155 - DNA, 25 bp, Homo sapien
tgcttcatcttaccttcatactctg

SEQ ID NO: 73156 - DNA, 25 bp, Homo sapien
cttcatcttaccttcatactctgaa

SEQ ID NO: 73157 - DNA, 25 bp, Homo sapien
tcttaccttcatactctgaaattcc

SEQ ID NO: 73158 - DNA, 25 bp, Homo sapien
tgaaattccctatagcagacagagc

SEQ ID NO: 73159 - DNA, 25 bp, Homo sapien
attccctatagcagacagagctagg

SEQ ID NO: 73160 - DNA, 25 bp, Homo sapien
ctatagcagacagagctagggaaat

SEQ ID NO: 73161 - DNA, 25 bp, Homo sapien
tatgagagtaatgggaactactgct

SEQ ID NO: 73162 - DNA, 25 bp, Homo sapien
atcctgcctttgctgagagagaggc

SEQ ID NO: 73163 - DNA, 25 bp, Homo sapien
gagaggctggatgctagacccaagt

SEQ ID NO: 73164 - DNA, 25 bp, Homo sapien
ggagcctttgtttaaatatgcctta

SEQ ID NO: 73165 - DNA, 25 bp, Homo sapien
tttaaatatgccttagccccagctg

SEQ ID NO: 73166 - DNA, 25 bp, Homo sapien
ccagctgcccatttttggttgacaa

SEQ ID NO: 73167 - DNA, 25 bp, Homo sapien
ggttgacaagcctttcagagccaga

SEQ ID NO: 73168 - DNA, 25 bp, Homo sapien
caagcctttcagagccagagtgggt

SEQ ID NO: 73169 - DNA, 25 bp, Homo sapien
agagtgggtatagatgtgccagcca

SEQ ID NO: 73170 - DNA, 25 bp, Homo sapien
tgccagccaggagatggcaccggat

SEQ ID NO: 73171 - DNA, 25 bp, Homo sapien
tggcaggtgtgcaaggtgacaacta

SEQ ID NO: 73172 - DNA, 25 bp, Homo sapien
gagtgctgcagtgatggcatgcctt

SEQ ID NO: 73173 - DNA, 25 bp, Homo sapien
ctcaaagtgtggaggagacgttgcc

SEQ ID NO: 73174 - DNA, 25 bp, Homo sapien
gacgttgccgtcaggcgggagccaa

SEQ ID NO: 73175 - DNA, 25 bp, Homo sapien
gccaagtgccgggaagatgtctatt

SEQ ID NO: 73176 - DNA, 25 bp, Homo sapien
agtgccgggaagatgtctatttttt

SEQ ID NO: 73177 - DNA, 25 bp, Homo sapien
aaatcatgatgtttgttatgactgc

SEQ ID NO: 73178 - DNA, 25 bp, Homo sapien
atgtttgttatgactgctgatgcga

SEQ ID NO: 73179 - DNA, 25 bp, Homo sapien
gttatgactgctgatgcgattgttt

SEQ ID NO: 73180 - DNA, 25 bp, Homo sapien
ctgctgatgcgattgtttttgtaaa

SEQ ID NO: 73181 - DNA, 25 bp, Homo sapien
ttattgtggcatatacagtattgtc

SEQ ID NO: 73182 - DNA, 25 bp, Homo sapien
gtattgtcatacagttgaagagaaa

SEQ ID NO: 73183 - DNA, 25 bp, Homo sapien
caatgtttcctaatgtaagtgctct

SEQ ID NO: 73184 - DNA, 25 bp, Homo sapien
ttttgaaaaggtgtgggtccctgtg

SEQ ID NO: 73185 - DNA, 25 bp, Homo sapien
gaaaaggtgtgggtccctgtgtcct

SEQ ID NO: 73186 - DNA, 25 bp, Homo sapien
aaaggtgtgggtccctgtgtcctct

SEQ ID NO: 73187 - DNA, 25 bp, Homo sapien
aggtcactgggcctgttttctccct

SEQ ID NO: 73188 - DNA, 25 bp, Homo sapien
gtatcatagggaactttcaccttaa

SEQ ID NO: 73189 - DNA, 25 bp, Homo sapien
aaatctttctaagcaaagtgtgaat

SEQ ID NO: 73190 - DNA, 25 bp, Homo sapien
gatttttactccctttgtacagtat

SEQ ID NO: 73191 - DNA, 25 bp, Homo sapien
tttactccctttgtacagtattctg

SEQ ID NO: 73192 - DNA, 25 bp, Homo sapien
tactccctttgtacagtattctgag

SEQ ID NO: 73193 - DNA, 25 bp, Homo sapien
ctccctttgtacagtattctgagaa

SEQ ID NO: 73194 - DNA, 25 bp, Homo sapien
gtacagtattctgagaaacgcaaat

SEQ ID NO: 73195 - DNA, 25 bp, Homo sapien
gttccccgaggccaagcagaaacgg

SEQ ID NO: 73196 - DNA, 25 bp, Homo sapien
gcagaaacggcttgccaagtctcca

SEQ ID NO: 73197 - DNA, 25 bp, Homo sapien
gtgaccagaagtttcccaagaccaa

SEQ ID NO: 73198 - DNA, 25 bp, Homo sapien
gaagtttcccaagaccaaggacaag

SEQ ID NO: 73199 - DNA, 25 bp, Homo sapien
gaccaaggacaagtcccgggatggt

SEQ ID NO: 73200 - DNA, 25 bp, Homo sapien
aagagagtggcctgagcccaagccg

SEQ ID NO: 73201 - DNA, 25 bp, Homo sapien
agcagcggctggattgaacgcccca

SEQ ID NO: 73202 - DNA, 25 bp, Homo sapien
cggctggattgaacgccccagattg

SEQ ID NO: 73203 - DNA, 25 bp, Homo sapien
gagatgtggcccttggtttcctttc

SEQ ID NO: 73204 - DNA, 25 bp, Homo sapien
tggcccttggtttcctttcataaag

SEQ ID NO: 73205 - DNA, 25 bp, Homo sapien
tcataaaggagttgtgtccccagcc

SEQ ID NO: 73206 - DNA, 25 bp, Homo sapien
atcttattttcacctctttagaaga

SEQ ID NO: 73207 - DNA, 25 bp, Homo sapien
aaagatgtttctcctatctcctttt

SEQ ID NO: 73208 - DNA, 25 bp, Homo sapien
tcctatctccttttctctagtattt

SEQ ID NO: 73209 - DNA, 25 bp, Homo sapien
tctccttttctctagtatttgactg

SEQ ID NO: 73210 - DNA, 25 bp, Homo sapien
tttgactgttactgtccttggcgaa

SEQ ID NO: 73211 - DNA, 25 bp, Homo sapien
gttactgtccttggcgaatcgataa

SEQ ID NO: 73212 - DNA, 25 bp, Homo sapien
ggcgaatcgataatcattgcatagt

SEQ ID NO: 73213 - DNA, 25 bp, Homo sapien
tagtgactgaaaagcctaagtgcaa

SEQ ID NO: 73214 - DNA, 25 bp, Homo sapien
ttcttgtttctgaacttcgtgccat

SEQ ID NO: 73215 - DNA, 25 bp, Homo sapien
acttcgtgccatattttgttcctga

SEQ ID NO: 73216 - DNA, 25 bp, Homo sapien
tgatgggatcaacttaatgtttaag

SEQ ID NO: 73217 - DNA, 25 bp, Homo sapien
cgaccggcaggagcgcgagagggca

SEQ ID NO: 73218 - DNA, 25 bp, Homo sapien
tcggaggccctggacgaggagagct

SEQ ID NO: 73219 - DNA, 25 bp, Homo sapien
gaggagagctgagccgcgggcagcc

SEQ ID NO: 73220 - DNA, 25 bp, Homo sapien
ttccccggctcgcaggagagcagag

SEQ ID NO: 73221 - DNA, 25 bp, Homo sapien
tcgcaggagagcagagcagagaact

SEQ ID NO: 73222 - DNA, 25 bp, Homo sapien
ggaacgctgtgctgtttgtatttgt

SEQ ID NO: 73223 - DNA, 25 bp, Homo sapien
aacgctgtgctgtttgtatttgttc

SEQ ID NO: 73224 - DNA, 25 bp, Homo sapien
aatttctgtgatttccaaccaacat

SEQ ID NO: 73225 - DNA, 25 bp, Homo sapien
ttctgtgatttccaaccaacatgaa

SEQ ID NO: 73226 - DNA, 25 bp, Homo sapien
gtgatttccaaccaacatgaaatga

SEQ ID NO: 73227 - DNA, 25 bp, Homo sapien
acatgaaatgactataaacggtttt

SEQ ID NO: 73228 - DNA, 25 bp, Homo sapien
gtgcagctgcatctgtttgagtgct

SEQ ID NO: 73229 - DNA, 25 bp, Homo sapien
atctgtttgagtgctgctttctggg

SEQ ID NO: 73230 - DNA, 25 bp, Homo sapien
ctttctccgctgctatagaccagtt

SEQ ID NO: 73231 - DNA, 25 bp, Homo sapien
ctggaagcggccttcccaggcggaa

SEQ ID NO: 73232 - DNA, 25 bp, Homo sapien
agcggccttcccaggcggaagagca

SEQ ID NO: 73233 - DNA, 25 bp, Homo sapien
aggcggaagagcaggccctctccat

SEQ ID NO: 73234 - DNA, 25 bp, Homo sapien
catggacttcaagacgctgacggag

SEQ ID NO: 73235 - DNA, 25 bp, Homo sapien
agatagccccggctcccagtgatgc

SEQ ID NO: 73236 - DNA, 25 bp, Homo sapien
tgcccctgctgaggcgtcttcagga

SEQ ID NO: 73237 - DNA, 25 bp, Homo sapien
tgaggcgtcttcaggactgcaggct

SEQ ID NO: 73238 - DNA, 25 bp, Homo sapien
ttcaggactgcaggctccggagagt

SEQ ID NO: 73239 - DNA, 25 bp, Homo sapien
gcaggggtcgcctttgtgaccagaa

SEQ ID NO: 73240 - DNA, 25 bp, Homo sapien
gtgaccagaagtttcccaagaccaa

SEQ ID NO: 73241 - DNA, 25 bp, Homo sapien
aagagagtggcctgagcccaagccg

SEQ ID NO: 73242 - DNA, 25 bp, Homo sapien
gagagtggcctgagcccaagccgca

SEQ ID NO: 73243 - DNA, 25 bp, Homo sapien
gagcagcggctggattgaacgcccc

SEQ ID NO: 73244 - DNA, 25 bp, Homo sapien
agcagcggctggattgaacgcccca

SEQ ID NO: 73245 - DNA, 25 bp, Homo sapien
agcggctggattgaacgccccagat

SEQ ID NO: 73246 - DNA, 25 bp, Homo sapien
gcggctggattgaacgccccagatt

SEQ ID NO: 73247 - DNA, 25 bp, Homo sapien
cggctggattgaacgccccagattg

SEQ ID NO: 73248 - DNA, 25 bp, Homo sapien
ctttcataaaggagttgtgtcccca

SEQ ID NO: 73249 - DNA, 25 bp, Homo sapien
tcataaaggagttgtgtccccagcc

SEQ ID NO: 73250 - DNA, 25 bp, Homo sapien
tcctgctatccctgctggtgatggt

SEQ ID NO: 73251 - DNA, 25 bp, Homo sapien
tggtgatggtgatcagtcctgtcat

SEQ ID NO: 73252 - DNA, 25 bp, Homo sapien
gatcagtcctgtcatccagctgcag

SEQ ID NO: 73253 - DNA, 25 bp, Homo sapien
tgcgggtcgcactggctggcacatt

SEQ ID NO: 73254 - DNA, 25 bp, Homo sapien
attccactactacagctgcgagaga

SEQ ID NO: 73255 - DNA, 25 bp, Homo sapien
gccaaaaaggccatgggctaccagc

SEQ ID NO: 73256 - DNA, 25 bp, Homo sapien
ctaccagccactagtgaccatggat

SEQ ID NO: 73257 - DNA, 25 bp, Homo sapien
agaggaccgtgcagagctttcgcca

SEQ ID NO: 73258 - DNA, 25 bp, Homo sapien
tcgccacctgcggagggtcaagtga

SEQ ID NO: 73259 - DNA, 25 bp, Homo sapien
gacactggaggctgggctctctcga

SEQ ID NO: 73260 - DNA, 25 bp, Homo sapien
tcgacacgttgctcagccagtcact

SEQ ID NO: 73261 - DNA, 25 bp, Homo sapien
cggctcccagtgatgcgcccggccg

SEQ ID NO: 73262 - DNA, 25 bp, Homo sapien
gttcgcggggtgtcttcttgcctgc

SEQ ID NO: 73263 - DNA, 25 bp, Homo sapien
tgcccctgctgaggcgtcttcagga

SEQ ID NO: 73264 - DNA, 25 bp, Homo sapien
ccctgctgaggcgtcttcaggactg

SEQ ID NO: 73265 - DNA, 25 bp, Homo sapien
ctgctgaggcgtcttcaggactgca

SEQ ID NO: 73266 - DNA, 25 bp, Homo sapien
tgctgaggcgtcttcaggactgcag

SEQ ID NO: 73267 - DNA, 25 bp, Homo sapien
tgaggcgtcttcaggactgcaggct

SEQ ID NO: 73268 - DNA, 25 bp, Homo sapien
gaggcgtcttcaggactgcaggctc

SEQ ID NO: 73269 - DNA, 25 bp, Homo sapien
aggcgtcttcaggactgcaggctcc

SEQ ID NO: 73270 - DNA, 25 bp, Homo sapien
ggactgcaggctccggagagtggct

SEQ ID NO: 73271 - DNA, 25 bp, Homo sapien
tgcaggctccggagagtggctctgg

SEQ ID NO: 73272 - DNA, 25 bp, Homo sapien
taagatccagtgtccatggaaacat

SEQ ID NO: 73273 - DNA, 25 bp, Homo sapien
tggaaacattcccacatgccgtgac

SEQ ID NO: 73274 - DNA, 25 bp, Homo sapien
acatgccgtgactctggactatatc

SEQ ID NO: 73275 - DNA, 25 bp, Homo sapien
ttggaaagcagggttcctctgcctg

SEQ ID NO: 73276 - DNA, 25 bp, Homo sapien
tgctaacaagcccacgtggaccagt

SEQ ID NO: 73277 - DNA, 25 bp, Homo sapien
ggaccagtctgaatgtctttccttt

SEQ ID NO: 73278 - DNA, 25 bp, Homo sapien
gaatgtctttcctttacacctatgt

SEQ ID NO: 73279 - DNA, 25 bp, Homo sapien
aacaagtttctgttgcatatgtgtt

SEQ ID NO: 73280 - DNA, 25 bp, Homo sapien
agtaggcttctatattgcatttaac

SEQ ID NO: 73281 - DNA, 25 bp, Homo sapien
gtttttgtaactcctgattcttcct

SEQ ID NO: 73282 - DNA, 25 bp, Homo sapien
taactcctgattcttccttttcgga

SEQ ID NO: 73283 - DNA, 25 bp, Homo sapien
tgagcgcacctaaccactggtcatg

SEQ ID NO: 73284 - DNA, 25 bp, Homo sapien
cctgctgcctctgatcgtaggaatt

SEQ ID NO: 73285 - DNA, 25 bp, Homo sapien
tgctgcctctgatcgtaggaattga

SEQ ID NO: 73286 - DNA, 25 bp, Homo sapien
taggaattgaggagtgtcccgcctt

SEQ ID NO: 73287 - DNA, 25 bp, Homo sapien
aattgaggagtgtcccgccttgtgg

SEQ ID NO: 73288 - DNA, 25 bp, Homo sapien
cgccttgtggctgagaactggacag

SEQ ID NO: 73289 - DNA, 25 bp, Homo sapien
ccttgtggctgagaactggacagtg

SEQ ID NO: 73290 - DNA, 25 bp, Homo sapien
gcgcgccagtgcaagaccgagattg

SEQ ID NO: 73291 - DNA, 25 bp, Homo sapien
caagaccgagattgagggaaagcat

SEQ ID NO: 73292 - DNA, 25 bp, Homo sapien
atgtctgctgggtgtgaccatgttt

SEQ ID NO: 73293 - DNA, 25 bp, Homo sapien
tgtttcctctcaataaagttcccct

SEQ ID NO: 73294 - DNA, 25 bp, Homo sapien
ccacgtgctggctgcggaacccagg

SEQ ID NO: 73295 - DNA, 25 bp, Homo sapien
gcctccagcactttttatatttacg

SEQ ID NO: 73296 - DNA, 25 bp, Homo sapien
tatatttacgtattctccaaagcag

SEQ ID NO: 73297 - DNA, 25 bp, Homo sapien
ttctccaaagcagtgttcacacggg

SEQ ID NO: 73298 - DNA, 25 bp, Homo sapien
caaagcagtgttcacacgggagcca

SEQ ID NO: 73299 - DNA, 25 bp, Homo sapien
aagcagtgttcacacgggagccagc

SEQ ID NO: 73300 - DNA, 25 bp, Homo sapien
tcttggcatcctggaggtggcccca

SEQ ID NO: 73301 - DNA, 25 bp, Homo sapien
aggtggccccactggtcctggtgct

SEQ ID NO: 73302 - DNA, 25 bp, Homo sapien
tcacctacattccatagtgggcccg

SEQ ID NO: 73303 - DNA, 25 bp, Homo sapien
ctacattccatagtgggcccgtggg

SEQ ID NO: 73304 - DNA, 25 bp, Homo sapien
gggctcctggtgcatcttaataaag

SEQ ID NO: 73305 - DNA, 25 bp, Homo sapien
ggtgaaggccaccaagcatggatta

SEQ ID NO: 73306 - DNA, 25 bp, Homo sapien
gaaggccaccaagcatggattattg

SEQ ID NO: 73307 - DNA, 25 bp, Homo sapien
gattgtagagaagggcaaccgcaca

SEQ ID NO: 73308 - DNA, 25 bp, Homo sapien
agagaagggcaaccgcacagccaga

SEQ ID NO: 73309 - DNA, 25 bp, Homo sapien
aaccgcacagccagaatcatagaca

SEQ ID NO: 73310 - DNA, 25 bp, Homo sapien
gaatcatagacaaaccccggatcat

SEQ ID NO: 73311 - DNA, 25 bp, Homo sapien
aaaccccggatcatcgaggtcgcac

SEQ ID NO: 73312 - DNA, 25 bp, Homo sapien
cggggccacctcttaatctagacag

SEQ ID NO: 73313 - DNA, 25 bp, Homo sapien
gatctatttcccttatcacttcaat

SEQ ID NO: 73314 - DNA, 25 bp, Homo sapien
aatctcattgtgtctacacatcggg

SEQ ID NO: 73315 - DNA, 25 bp, Homo sapien
ttaggtcggtttgtaagtggataca

SEQ ID NO: 73316 - DNA, 25 bp, Homo sapien
gctgtggatggctgcttttcctcaa

SEQ ID NO: 73317 - DNA, 25 bp, Homo sapien
caacctttcctaccagattccagga

SEQ ID NO: 73318 - DNA, 25 bp, Homo sapien
aagaaacttagacttcacccaccag

SEQ ID NO: 73319 - DNA, 25 bp, Homo sapien
agctggcacaggtgcacagattcat

SEQ ID NO: 73320 - DNA, 25 bp, Homo sapien
gattcataaattcccacacgtgtgt

SEQ ID NO: 73321 - DNA, 25 bp, Homo sapien
acacgtgtgtgttcaacatctgaaa

SEQ ID NO: 73322 - DNA, 25 bp, Homo sapien
acttaggccaagtagagagcatcag

SEQ ID NO: 73323 - DNA, 25 bp, Homo sapien
gagcatcagggtaaatggcgttcat

SEQ ID NO: 73324 - DNA, 25 bp, Homo sapien
aatggcgttcatttctctgttaaga

SEQ ID NO: 73325 - DNA, 25 bp, Homo sapien
tctctgttaagatgcagccatccat

SEQ ID NO: 73326 - DNA, 25 bp, Homo sapien
gaaatcagactcaaagttccaccaa

SEQ ID NO: 73327 - DNA, 25 bp, Homo sapien
atccacatccgagtcttcagggtca

SEQ ID NO: 73328 - DNA, 25 bp, Homo sapien
cagggtcacacccaagtaattgaaa

SEQ ID NO: 73329 - DNA, 25 bp, Homo sapien
ttgaaaagacactcctccacttatc

SEQ ID NO: 73330 - DNA, 25 bp, Homo sapien
gtgatatggctcttcgcatgctgag

SEQ ID NO: 73331 - DNA, 25 bp, Homo sapien
gcatgctgagtactggacctcggac

SEQ ID NO: 73332 - DNA, 25 bp, Homo sapien
gacctcggaccagagccatgtaaga

SEQ ID NO: 73333 - DNA, 25 bp, Homo sapien
taagaaaaggcctgttccctggaag

SEQ ID NO: 73334 - DNA, 25 bp, Homo sapien
ggaagcccaaaggactctgcattga

SEQ ID NO: 73335 - DNA, 25 bp, Homo sapien
agttagtgggccttcctgagtgtgt

SEQ ID NO: 73336 - DNA, 25 bp, Homo sapien
cctgagtgtgtgtatgcggtctgta

SEQ ID NO: 73337 - DNA, 25 bp, Homo sapien
gcggtctgtaactattgccatataa

SEQ ID NO: 73338 - DNA, 25 bp, Homo sapien
ttccaaagcagttaacccaactcct

SEQ ID NO: 73339 - DNA, 25 bp, Homo sapien
cagttaacccaactcctaacaacat

SEQ ID NO: 73340 - DNA, 25 bp, Homo sapien
ttaacacaccttccacaatcatttt

SEQ ID NO: 73341 - DNA, 25 bp, Homo sapien
aagagtcagcataacatagtggata

SEQ ID NO: 73342 - DNA, 25 bp, Homo sapien
gtgagatgtttaacctctcagtaac

SEQ ID NO: 73343 - DNA, 25 bp, Homo sapien
agtaactcggttctctcattataaa

SEQ ID NO: 73344 - DNA, 25 bp, Homo sapien
aatcagtacctgtttcatatgaagg

SEQ ID NO: 73345 - DNA, 25 bp, Homo sapien
catatgaaggtcgtttctgagaatt

SEQ ID NO: 73346 - DNA, 25 bp, Homo sapien
gactaatgtatgcaaaaagcctggc

SEQ ID NO: 73347 - DNA, 25 bp, Homo sapien
aagcctggcaaacaataaacactca

SEQ ID NO: 73348 - DNA, 25 bp, Homo sapien
aataaacactcatctgactttaaaa

SEQ ID NO: 73349 - DNA, 25 bp, Homo sapien
ttcagcggtttatcatgatcttgac

SEQ ID NO: 73350 - DNA, 25 bp, Homo sapien
atgatcttgaccgagcacctagtac

SEQ ID NO: 73351 - DNA, 25 bp, Homo sapien
gtacgatgcgaaactgatgggacca

SEQ ID NO: 73352 - DNA, 25 bp, Homo sapien
tgcagcagatcttcctacagcatca

SEQ ID NO: 73353 - DNA, 25 bp, Homo sapien
acagcatcaccaaataatccagcag

SEQ ID NO: 73354 - DNA, 25 bp, Homo sapien
aatccagcagtacatggtgaccctg

SEQ ID NO: 73355 - DNA, 25 bp, Homo sapien
accttctcttcactgctgaattaga

SEQ ID NO: 73356 - DNA, 25 bp, Homo sapien
gaattagaccctcatatcttggccg

SEQ ID NO: 73357 - DNA, 25 bp, Homo sapien
atatcttggccgtgttccagcagtt

SEQ ID NO: 73358 - DNA, 25 bp, Homo sapien
tgccctgcaggcctaagggtcattt

SEQ ID NO: 73359 - DNA, 25 bp, Homo sapien
agggtcattttttcctcatgtcaag

SEQ ID NO: 73360 - DNA, 25 bp, Homo sapien
tcttggtctggcactaaatttctca

SEQ ID NO: 73361 - DNA, 25 bp, Homo sapien
cttggtctggcactaaatttctcag

SEQ ID NO: 73362 - DNA, 25 bp, Homo sapien
taaatttctcagtcttttactatga

SEQ ID NO: 73363 - DNA, 25 bp, Homo sapien
tttctcagtcttttactatgagatt

SEQ ID NO: 73364 - DNA, 25 bp, Homo sapien
aggcctgtagcctggcaaaaacggc

SEQ ID NO: 73365 - DNA, 25 bp, Homo sapien
ggcctgtagcctggcaaaaacggca

SEQ ID NO: 73366 - DNA, 25 bp, Homo sapien
cctgtagcctggcaaaaacggcatt

SEQ ID NO: 73367 - DNA, 25 bp, Homo sapien
tgtagcctggcaaaaacggcatttg

SEQ ID NO: 73368 - DNA, 25 bp, Homo sapien
tagcctggcaaaaacggcatttgat

SEQ ID NO: 73369 - DNA, 25 bp, Homo sapien
gcctggcaaaaacggcatttgatga

SEQ ID NO: 73370 - DNA, 25 bp, Homo sapien
ggcaaaaacggcatttgatgaagca

SEQ ID NO: 73371 - DNA, 25 bp, Homo sapien
atagaagtagcatagattaaaaagt

SEQ ID NO: 73372 - DNA, 25 bp, Homo sapien
tagaagtagcatagattaaaaagtg

SEQ ID NO: 73373 - DNA, 25 bp, Homo sapien
agaagtagcatagattaaaaagtga

SEQ ID NO: 73374 - DNA, 25 bp, Homo sapien
gaagtagcatagattaaaaagtgat

SEQ ID NO: 73375 - DNA, 25 bp, Homo sapien
aagtgatggagggaggccgggcacg

SEQ ID NO: 73376 - DNA, 25 bp, Homo sapien
agtgatggagggaggccgggcacgg

SEQ ID NO: 73377 - DNA, 25 bp, Homo sapien
gtgatggagggaggccgggcacggt

SEQ ID NO: 73378 - DNA, 25 bp, Homo sapien
tgatggagggaggccgggcacggtg

SEQ ID NO: 73379 - DNA, 25 bp, Homo sapien
gatggagggaggccgggcacggtgg

SEQ ID NO: 73380 - DNA, 25 bp, Homo sapien
aatacaaaacaagccgggcacagtg

SEQ ID NO: 73381 - DNA, 25 bp, Homo sapien
atacaaaacaagccgggcacagtgg

SEQ ID NO: 73382 - DNA, 25 bp, Homo sapien
gtttgtgttgggattactgactcat

SEQ ID NO: 73383 - DNA, 25 bp, Homo sapien
gggattactgactcataaccaggtc

SEQ ID NO: 73384 - DNA, 25 bp, Homo sapien
gataatctgtacctcatcaatcaga

SEQ ID NO: 73385 - DNA, 25 bp, Homo sapien
gatgatgacaatttacttcccaggt

SEQ ID NO: 73386 - DNA, 25 bp, Homo sapien
aatttacttcccaggtctcatactc

SEQ ID NO: 73387 - DNA, 25 bp, Homo sapien
ggtctcatactcacttatgttggaa

SEQ ID NO: 73388 - DNA, 25 bp, Homo sapien
ggtgttaaaggacccaggcttcatt

SEQ ID NO: 73389 - DNA, 25 bp, Homo sapien
aggcttcattacacaggcttttcat

SEQ ID NO: 73390 - DNA, 25 bp, Homo sapien
taaagcccgagaaaccacacataat

SEQ ID NO: 73391 - DNA, 25 bp, Homo sapien
gatgagtttgctgtactgacgctgc

SEQ ID NO: 73392 - DNA, 25 bp, Homo sapien
tgtactgacgctgcactttgtaaac

SEQ ID NO: 73393 - DNA, 25 bp, Homo sapien
gaagaattcactactcagaatcaga

SEQ ID NO: 73394 - DNA, 25 bp, Homo sapien
actactcagaatcagaaatcccagg

SEQ ID NO: 73395 - DNA, 25 bp, Homo sapien
agaaatcccaggatgtggaactctg

SEQ ID NO: 73396 - DNA, 25 bp, Homo sapien
gacaaattgcaatgatgctgggcct

SEQ ID NO: 73397 - DNA, 25 bp, Homo sapien
aaattgcaatgatgctgggccttaa

SEQ ID NO: 73398 - DNA, 25 bp, Homo sapien
ttcatgttagtgttagcgagccact

SEQ ID NO: 73399 - DNA, 25 bp, Homo sapien
ttagtgttagcgagccactgccctt

SEQ ID NO: 73400 - DNA, 25 bp, Homo sapien
agccactgccctttgtcaaaatgtg

SEQ ID NO: 73401 - DNA, 25 bp, Homo sapien
gtgatgcacataagcaggtatccca

SEQ ID NO: 73402 - DNA, 25 bp, Homo sapien
gcacataagcaggtatcccagcatg

SEQ ID NO: 73403 - DNA, 25 bp, Homo sapien
ataagcaggtatcccagcatgaaat

SEQ ID NO: 73404 - DNA, 25 bp, Homo sapien
agccaagctctaaagcacatgtagc

SEQ ID NO: 73405 - DNA, 25 bp, Homo sapien
gctctaaagcacatgtagccgctga

SEQ ID NO: 73406 - DNA, 25 bp, Homo sapien
aaagcacatgtagccgctgagacct

SEQ ID NO: 73407 - DNA, 25 bp, Homo sapien
acatgtagccgctgagacctgctgt

SEQ ID NO: 73408 - DNA, 25 bp, Homo sapien
tagccgctgagacctgctgtttctg

SEQ ID NO: 73409 - DNA, 25 bp, Homo sapien
gccgctgagacctgctgtttctgct

SEQ ID NO: 73410 - DNA, 25 bp, Homo sapien
tgcagccccgacctctcaggttaga

SEQ ID NO: 73411 - DNA, 25 bp, Homo sapien
gacctctcaggttagaccctgggcc

SEQ ID NO: 73412 - DNA, 25 bp, Homo sapien
tgctccttccctaatgctttgaggt

SEQ ID NO: 73413 - DNA, 25 bp, Homo sapien
cttccctaatgctttgaggttttct

SEQ ID NO: 73414 - DNA, 25 bp, Homo sapien
gaggttttcttggttggaagctgca

SEQ ID NO: 73415 - DNA, 25 bp, Homo sapien
gattcagattgagtcctgaggcatt

SEQ ID NO: 73416 - DNA, 25 bp, Homo sapien
ctgaggcatttacttttgggtaaag

SEQ ID NO: 73417 - DNA, 25 bp, Homo sapien
agcctgaattaggaatgtgtacatt

SEQ ID NO: 73418 - DNA, 25 bp, Homo sapien
gtacattgtaggaatcctggttgtg

SEQ ID NO: 73419 - DNA, 25 bp, Homo sapien
gaccaggtctgtgggcctcaggtct

SEQ ID NO: 73420 - DNA, 25 bp, Homo sapien
tttcccttgctcactctggatccag

SEQ ID NO: 73421 - DNA, 25 bp, Homo sapien
tctggatccagtgacagcaggtgtc

SEQ ID NO: 73422 - DNA, 25 bp, Homo sapien
cagcaggtgtcatgggtcaagcata

SEQ ID NO: 73423 - DNA, 25 bp, Homo sapien
aatcatatatagcattttcaggcat

SEQ ID NO: 73424 - DNA, 25 bp, Homo sapien
aggcatgttcctggtagttcttttg

SEQ ID NO: 73425 - DNA, 25 bp, Homo sapien
ctggtagttcttttgagtctgacat

SEQ ID NO: 73426 - DNA, 25 bp, Homo sapien
gaatggtatgttttcttaactatag

SEQ ID NO: 73427 - DNA, 25 bp, Homo sapien
tcttacattatttcgtgagaacttt

SEQ ID NO: 73428 - DNA, 25 bp, Homo sapien
tcgtgagaactttgagaaatcattt

SEQ ID NO: 73429 - DNA, 25 bp, Homo sapien
attatttacaagaatactcctgaga

SEQ ID NO: 73430 - DNA, 25 bp, Homo sapien
aatactcctgagaatttacatgaaa

SEQ ID NO: 73431 - DNA, 25 bp, Homo sapien
atggctaaacataatctcttacttc

SEQ ID NO: 73432 - DNA, 25 bp, Homo sapien
acataatctcttacttcatttgaaa

SEQ ID NO: 73433 - DNA, 25 bp, Homo sapien
aaatatttagcaacacagatcctga

SEQ ID NO: 73434 - DNA, 25 bp, Homo sapien
ttagcaacacagatcctgacaagaa

SEQ ID NO: 73435 - DNA, 25 bp, Homo sapien
tcctgacaagaaatggaaagctcat

SEQ ID NO: 73436 - DNA, 25 bp, Homo sapien
ggaaagctcatctttagtttcagat

SEQ ID NO: 73437 - DNA, 25 bp, Homo sapien
atgttgctggcctgtcatgggtaaa

SEQ ID NO: 73438 - DNA, 25 bp, Homo sapien
tgtcatgggtaaagcctggctcagt

SEQ ID NO: 73439 - DNA, 25 bp, Homo sapien
acagtggcgacttaagagatggtga

SEQ ID NO: 73440 - DNA, 25 bp, Homo sapien
gtgaatctggtgcaccatgcacttt

SEQ ID NO: 73441 - DNA, 25 bp, Homo sapien
catgcactttcctgctagactctgg

SEQ ID NO: 73442 - DNA, 25 bp, Homo sapien
tagactctggcctagttcaagctga

SEQ ID NO: 73443 - DNA, 25 bp, Homo sapien
tcaagctgaccaatggcagaggact

SEQ ID NO: 73444 - DNA, 25 bp, Homo sapien
cagaggactgcctgaagagtaaaac

SEQ ID NO: 73445 - DNA, 25 bp, Homo sapien
gaagacccctatgcaattagctttt

SEQ ID NO: 73446 - DNA, 25 bp, Homo sapien
ggaatccttctgtacatgatgaagc

SEQ ID NO: 73447 - DNA, 25 bp, Homo sapien
aagtgttcatgttgctggcctgtca

SEQ ID NO: 73448 - DNA, 25 bp, Homo sapien
gggcaccttttctacgtgtgacaca

SEQ ID NO: 73449 - DNA, 25 bp, Homo sapien
gcaccttttctacgtgtgacacaaa

SEQ ID NO: 73450 - DNA, 25 bp, Homo sapien
acgtgtgacacaaaactcaagctgt

SEQ ID NO: 73451 - DNA, 25 bp, Homo sapien
gacacaaaactcaagctgtaacaga

SEQ ID NO: 73452 - DNA, 25 bp, Homo sapien
gctgtaacagaaaggtcaatggact

SEQ ID NO: 73453 - DNA, 25 bp, Homo sapien
tcaatggacttgacccaactgagaa

SEQ ID NO: 73454 - DNA, 25 bp, Homo sapien
aaacttctgtatggaggaaaagaca

SEQ ID NO: 73455 - DNA, 25 bp, Homo sapien
ggaaaagacagtaaacatgacagac

SEQ ID NO: 73456 - DNA, 25 bp, Homo sapien
aaagtattggcagaccaggcgtggt

SEQ ID NO: 73457 - DNA, 25 bp, Homo sapien
ttaaggttgtagtgcgctagacggc

SEQ ID NO: 73458 - DNA, 25 bp, Homo sapien
gcgctagacggcgcctgtgaatagc

SEQ ID NO: 73459 - DNA, 25 bp, Homo sapien
tctgtctccagtatcaccacaaaat

SEQ ID NO: 73460 - DNA, 25 bp, Homo sapien
accacaaaattgttcttccttggag

SEQ ID NO: 73461 - DNA, 25 bp, Homo sapien
ttccttggagtgtcttggctattct

SEQ ID NO: 73462 - DNA, 25 bp, Homo sapien
ttcttagccaactgttcctccatat

SEQ ID NO: 73463 - DNA, 25 bp, Homo sapien
actgttcctccatattacttctaga

SEQ ID NO: 73464 - DNA, 25 bp, Homo sapien
aacaaacccaagagcattgaaattt

SEQ ID NO: 73465 - DNA, 25 bp, Homo sapien
gattaatctggtaaaccatgtcatc

SEQ ID NO: 73466 - DNA, 25 bp, Homo sapien
ccatgtcatctttacaatgttgtct

SEQ ID NO: 73467 - DNA, 25 bp, Homo sapien
caatgttgtcttccaatacatgaat

SEQ ID NO: 73468 - DNA, 25 bp, Homo sapien
atacatgaatatggtacagctcttc

SEQ ID NO: 73469 - DNA, 25 bp, Homo sapien
agctcttcatttacttaggcctttg

SEQ ID NO: 73470 - DNA, 25 bp, Homo sapien
gatagcattctcactaagacacatg

SEQ ID NO: 73471 - DNA, 25 bp, Homo sapien
gaatttaactttataaccgcgtgag

SEQ ID NO: 73472 - DNA, 25 bp, Homo sapien
cataggttttgatgtcattgttgaa

SEQ ID NO: 73473 - DNA, 25 bp, Homo sapien
gtaattcagaaaccttgcttgtgtg

SEQ ID NO: 73474 - DNA, 25 bp, Homo sapien
gaaaccttgcttgtgtgatacatag

SEQ ID NO: 73475 - DNA, 25 bp, Homo sapien
gatacatagtaagtctcttcattta

SEQ ID NO: 73476 - DNA, 25 bp, Homo sapien
agcaatagtgcaccaattaagatgt

SEQ ID NO: 73477 - DNA, 25 bp, Homo sapien
aagatgtgctcaaatcaggacttaa

SEQ ID NO: 73478 - DNA, 25 bp, Homo sapien
aggacttaaatcataggcaccacat

SEQ ID NO: 73479 - DNA, 25 bp, Homo sapien
cataggcaccacatttttcatgtca

SEQ ID NO: 73480 - DNA, 25 bp, Homo sapien
agactagttactttgttgattctca

SEQ ID NO: 73481 - DNA, 25 bp, Homo sapien
acttgttcatattgtacttggcttt

SEQ ID NO: 73482 - DNA, 25 bp, Homo sapien
gtacttggctttgaaataccctgaa

SEQ ID NO: 73483 - DNA, 25 bp, Homo sapien
gaaataccctgaagcatctatggaa

SEQ ID NO: 73484 - DNA, 25 bp, Homo sapien
gaagtgctaccagaaaaccagttgt

SEQ ID NO: 73485 - DNA, 25 bp, Homo sapien
gaaaaccagttgttaagtctatctg

SEQ ID NO: 73486 - DNA, 25 bp, Homo sapien
aatagactgtgaagcacctcatctt

SEQ ID NO: 73487 - DNA, 25 bp, Homo sapien
agcacctcatcttcatttcaatagc

SEQ ID NO: 73488 - DNA, 25 bp, Homo sapien
atttcaatagcttcgctggaacctg

SEQ ID NO: 73489 - DNA, 25 bp, Homo sapien
aatagcttcgctggaacctggagcc

SEQ ID NO: 73490 - DNA, 25 bp, Homo sapien
ttcgctggaacctggagcctaaggg

SEQ ID NO: 73491 - DNA, 25 bp, Homo sapien
gacaacatttgttttgtcaactgat

SEQ ID NO: 73492 - DNA, 25 bp, Homo sapien
ggcagatcatgaggtgaagagatcg

SEQ ID NO: 73493 - DNA, 25 bp, Homo sapien
gcagatcatgaggtgaagagatcga

SEQ ID NO: 73494 - DNA, 25 bp, Homo sapien
cagatcatgaggtgaagagatcgag

SEQ ID NO: 73495 - DNA, 25 bp, Homo sapien
agatcatgaggtgaagagatcgaga

SEQ ID NO: 73496 - DNA, 25 bp, Homo sapien
atcctgaccaaaatggtgaaactct

SEQ ID NO: 73497 - DNA, 25 bp, Homo sapien
tcctgaccaaaatggtgaaactctg

SEQ ID NO: 73498 - DNA, 25 bp, Homo sapien
gtgtgccagtggtcccagctactag

SEQ ID NO: 73499 - DNA, 25 bp, Homo sapien
tgtgccagtggtcccagctactagg

SEQ ID NO: 73500 - DNA, 25 bp, Homo sapien
gccactgaattccagcctggcggca

SEQ ID NO: 73501 - DNA, 25 bp, Homo sapien
ctgaattccagcctggcggcagagt

SEQ ID NO: 73502 - DNA, 25 bp, Homo sapien
tgaattccagcctggcggcagagtg

SEQ ID NO: 73503 - DNA, 25 bp, Homo sapien
aaatctcgttttccgccgtgcgcgg

SEQ ID NO: 73504 - DNA, 25 bp, Homo sapien
aatctcgttttccgccgtgcgcggt

SEQ ID NO: 73505 - DNA, 25 bp, Homo sapien
atctcgttttccgccgtgcgcggtg

SEQ ID NO: 73506 - DNA, 25 bp, Homo sapien
tctcgttttccgccgtgcgcggtgg

SEQ ID NO: 73507 - DNA, 25 bp, Homo sapien
ctcgttttccgccgtgcgcggtggc

SEQ ID NO: 73508 - DNA, 25 bp, Homo sapien
tcgttttccgccgtgcgcggtggct

SEQ ID NO: 73509 - DNA, 25 bp, Homo sapien
tccatcctgggcgaaagagctagat

SEQ ID NO: 73510 - DNA, 25 bp, Homo sapien
ccatcctgggcgaaagagctagatt

SEQ ID NO: 73511 - DNA, 25 bp, Homo sapien
atcctgggcgaaagagctagattcc

SEQ ID NO: 73512 - DNA, 25 bp, Homo sapien
tcctgggcgaaagagctagattcca

SEQ ID NO: 73513 - DNA, 25 bp, Homo sapien
gcgaaagagctagattccatctcat

SEQ ID NO: 73514 - DNA, 25 bp, Homo sapien
gtttttgactaaaggccagaatgca

SEQ ID NO: 73515 - DNA, 25 bp, Homo sapien
gccagaatgcattggtagagctaca

SEQ ID NO: 73516 - DNA, 25 bp, Homo sapien
gtagagctacagacacaaagaccaa

SEQ ID NO: 73517 - DNA, 25 bp, Homo sapien
cacaaagaccaatagctcttgagct

SEQ ID NO: 73518 - DNA, 25 bp, Homo sapien
gaggttcatgctacgttacggtggt

SEQ ID NO: 73519 - DNA, 25 bp, Homo sapien
tgctacgttacggtggttctacaat

SEQ ID NO: 73520 - DNA, 25 bp, Homo sapien
gtggttctacaatagctgctggtgt

SEQ ID NO: 73521 - DNA, 25 bp, Homo sapien
gctgctggtgttgtcactgagataa

SEQ ID NO: 73522 - DNA, 25 bp, Homo sapien
agaatttctaccacgtttctggata

SEQ ID NO: 73523 - DNA, 25 bp, Homo sapien
gatacagtgaaatagctaacctctg

SEQ ID NO: 73524 - DNA, 25 bp, Homo sapien
agctaacctctgtttcaagaatgca

SEQ ID NO: 73525 - DNA, 25 bp, Homo sapien
tgctgatccagggtgtgtgtgagtt

SEQ ID NO: 73526 - DNA, 25 bp, Homo sapien
aatgtggccctgcagttgacctgag

SEQ ID NO: 73527 - DNA, 25 bp, Homo sapien
gtggccctgcagttgacctgagctg

SEQ ID NO: 73528 - DNA, 25 bp, Homo sapien
cctgcagttgacctgagctgcttca

SEQ ID NO: 73529 - DNA, 25 bp, Homo sapien
ctgagctgcttcacatggttgtcca

SEQ ID NO: 73530 - DNA, 25 bp, Homo sapien
atggttgtccattctggggcttaaa

SEQ ID NO: 73531 - DNA, 25 bp, Homo sapien
ggcttaaagaactgggaccagacca

SEQ ID NO: 73532 - DNA, 25 bp, Homo sapien
aagaactgggaccagaccaagtaga

SEQ ID NO: 73533 - DNA, 25 bp, Homo sapien
agaccaagtagaggccttggtgctg

SEQ ID NO: 73534 - DNA, 25 bp, Homo sapien
gggcctgcagagtcttagttactga

SEQ ID NO: 73535 - DNA, 25 bp, Homo sapien
gtcttagttactgatttcattttca

SEQ ID NO: 73536 - DNA, 25 bp, Homo sapien
tttttgactctaatcaacattcctt

SEQ ID NO: 73537 - DNA, 25 bp, Homo sapien
tcaacattccttttgttggtgacat

SEQ ID NO: 73538 - DNA, 25 bp, Homo sapien
ggtgacatttgtgattttcagtaat

SEQ ID NO: 73539 - DNA, 25 bp, Homo sapien
gatggccttttaaacaagactccag

SEQ ID NO: 73540 - DNA, 25 bp, Homo sapien
aagactccagtatgtgaaggttaat

SEQ ID NO: 73541 - DNA, 25 bp, Homo sapien
aaggttaattgctgtgctccacaga

SEQ ID NO: 73542 - DNA, 25 bp, Homo sapien
tgtgctccacagatcttgtctattg

SEQ ID NO: 73543 - DNA, 25 bp, Homo sapien
agatcttgtctattggcccctgtag

SEQ ID NO: 73544 - DNA, 25 bp, Homo sapien
gtctattggcccctgtagaaagtta

SEQ ID NO: 73545 - DNA, 25 bp, Homo sapien
cttattgcacaattgctttagggta

SEQ ID NO: 73546 - DNA, 25 bp, Homo sapien
gaaattatagcactccttgattaag

SEQ ID NO: 73547 - DNA, 25 bp, Homo sapien
ttttctctcagtgttctggccctct

SEQ ID NO: 73548 - DNA, 25 bp, Homo sapien
gaaagttctctgcttactttggttt

SEQ ID NO: 73549 - DNA, 25 bp, Homo sapien
tggttttccctctgcttgtaaaaca

SEQ ID NO: 73550 - DNA, 25 bp, Homo sapien
tttccctctgcttgtaaaacattga

SEQ ID NO: 73551 - DNA, 25 bp, Homo sapien
gatgcccgcttttacaattaaagga

SEQ ID NO: 73552 - DNA, 25 bp, Homo sapien
ttcagtgtcaccttgtcagcaacac

SEQ ID NO: 73553 - DNA, 25 bp, Homo sapien
gtcagcaacactgtgtcccttcgcc

SEQ ID NO: 73554 - DNA, 25 bp, Homo sapien
catcagccaaatttgaacccaatca

SEQ ID NO: 73555 - DNA, 25 bp, Homo sapien
gaacccaatcaaatataacgtgtct

SEQ ID NO: 73556 - DNA, 25 bp, Homo sapien
aatcaaatataacgtgtctgacact

SEQ ID NO: 73557 - DNA, 25 bp, Homo sapien
gtctgacactgattttgtttttact

SEQ ID NO: 73558 - DNA, 25 bp, Homo sapien
tctctctccctacacgatagaattt

SEQ ID NO: 73559 - DNA, 25 bp, Homo sapien
ctacacgatagaatttttgcggcat

SEQ ID NO: 73560 - DNA, 25 bp, Homo sapien
atttttgcggcatttgaagagcttt

SEQ ID NO: 73561 - DNA, 25 bp, Homo sapien
aattgaaaccaagccatgtggtgaa

SEQ ID NO: 73562 - DNA, 25 bp, Homo sapien
taaagtgctgatgacctgtgttggc

SEQ ID NO: 73563 - DNA, 25 bp, Homo sapien
acctgtgttggcattggtttctcca

SEQ ID NO: 73564 - DNA, 25 bp, Homo sapien
gcattggtttctccaaccttagcaa

SEQ ID NO: 73565 - DNA, 25 bp, Homo sapien
aaccttagcaagaccctcaagtgat

SEQ ID NO: 73566 - DNA, 25 bp, Homo sapien
agcagaagctgccacggacaccaat

SEQ ID NO: 73567 - DNA, 25 bp, Homo sapien
gacaccaatgggaccaagtccaaat

SEQ ID NO: 73568 - DNA, 25 bp, Homo sapien
tccaggacagaatagccacttgctt

SEQ ID NO: 73569 - DNA, 25 bp, Homo sapien
tctgggcagacccaagaaccatggg

SEQ ID NO: 73570 - DNA, 25 bp, Homo sapien
gttggtggcaccaatggcagccctc

SEQ ID NO: 73571 - DNA, 25 bp, Homo sapien
tctccttcaaggagggttcccgcag

SEQ ID NO: 73572 - DNA, 25 bp, Homo sapien
cttcaaggagggttcccgcagctgg

SEQ ID NO: 73573 - DNA, 25 bp, Homo sapien
ccgtgctgtgtttatggctggcaga

SEQ ID NO: 73574 - DNA, 25 bp, Homo sapien
gggattctgctgctcgctcacctgc

SEQ ID NO: 73575 - DNA, 25 bp, Homo sapien
tggctcgctggtctctcgaattttc

SEQ ID NO: 73576 - DNA, 25 bp, Homo sapien
gctggtctctcgaattttcttccct

SEQ ID NO: 73577 - DNA, 25 bp, Homo sapien
tcgaattttcttccctctgaaatcc

SEQ ID NO: 73578 - DNA, 25 bp, Homo sapien
aagaacttttggaagcttagccatt

SEQ ID NO: 73579 - DNA, 25 bp, Homo sapien
ggaagcttagccatttttacttatt

SEQ ID NO: 73580 - DNA, 25 bp, Homo sapien
aagacagagcctgtttactcattta

SEQ ID NO: 73581 - DNA, 25 bp, Homo sapien
attggtctaaaattgaacatcctag

SEQ ID NO: 73582 - DNA, 25 bp, Homo sapien
tgaacatcctagattcacactccca

SEQ ID NO: 73583 - DNA, 25 bp, Homo sapien
tagattcacactcccaagtcactta

SEQ ID NO: 73584 - DNA, 25 bp, Homo sapien
cacactcccaagtcacttaaggtga

SEQ ID NO: 73585 - DNA, 25 bp, Homo sapien
cttaaggtgatttgatggtgaggaa

SEQ ID NO: 73586 - DNA, 25 bp, Homo sapien
ggaaaatgattgacaaagcccaaca

SEQ ID NO: 73587 - DNA, 25 bp, Homo sapien
aagcccaacaatgatctcaggaatt

SEQ ID NO: 73588 - DNA, 25 bp, Homo sapien
aaatgttttcatgtagcagcaatgc

SEQ ID NO: 73589 - DNA, 25 bp, Homo sapien
gcagcaatgcagatttggtgaatat

SEQ ID NO: 73590 - DNA, 25 bp, Homo sapien
ttagtatgtatttcactttatgact

SEQ ID NO: 73591 - DNA, 25 bp, Homo sapien
atttttactcccaatattctgtaga

SEQ ID NO: 73592 - DNA, 25 bp, Homo sapien
ccaatattctgtagagagggagtca

SEQ ID NO: 73593 - DNA, 25 bp, Homo sapien
aggatgctgtcttcccacgaatagt

SEQ ID NO: 73594 - DNA, 25 bp, Homo sapien
gtcttcccacgaatagtactcagta

SEQ ID NO: 73595 - DNA, 25 bp, Homo sapien
gtactcagtaacaaaccaattgcat

SEQ ID NO: 73596 - DNA, 25 bp, Homo sapien
tttagttgggcagtgctcccaccca

SEQ ID NO: 73597 - DNA, 25 bp, Homo sapien
ttcgtttgttggactgttccactgc

SEQ ID NO: 73598 - DNA, 25 bp, Homo sapien
accctatcacccatggatcgtaatg

SEQ ID NO: 73599 - DNA, 25 bp, Homo sapien
atcacccatggatcgtaatgtaaaa

SEQ ID NO: 73600 - DNA, 25 bp, Homo sapien
gtaaaattcttttaccatgtcaaga

SEQ ID NO: 73601 - DNA, 25 bp, Homo sapien
aatacaggtactttgacctctttct

SEQ ID NO: 73602 - DNA, 25 bp, Homo sapien
ctgttaaacctttgcagtattatgt

SEQ ID NO: 73603 - DNA, 25 bp, Homo sapien
aacctttgcagtattatgtctctta

SEQ ID NO: 73604 - DNA, 25 bp, Homo sapien
tgcagtattatgtctcttatttatt

SEQ ID NO: 73605 - DNA, 25 bp, Homo sapien
atgacagatcttgtgaatcaaattc

SEQ ID NO: 73606 - DNA, 25 bp, Homo sapien
gaatcaaattcacaaacatcagctt

SEQ ID NO: 73607 - DNA, 25 bp, Homo sapien
attcacaaacatcagcttgttacaa

SEQ ID NO: 73608 - DNA, 25 bp, Homo sapien
acatcagcttgttacaaatcatttt

SEQ ID NO: 73609 - DNA, 25 bp, Homo sapien
attctttgaaaggatgtagtctata

SEQ ID NO: 73610 - DNA, 25 bp, Homo sapien
atattttctcattccatatgttgta

SEQ ID NO: 73611 - DNA, 25 bp, Homo sapien
aaggtactacttttatatatggaat

SEQ ID NO: 73612 - DNA, 25 bp, Homo sapien
gatgtacaaatctttttgacaggaa

SEQ ID NO: 73613 - DNA, 25 bp, Homo sapien
cagggctctccccatgagagaatca

SEQ ID NO: 73614 - DNA, 25 bp, Homo sapien
caggacgtggtctatggtgagccaa

SEQ ID NO: 73615 - DNA, 25 bp, Homo sapien
atggtgagccaacgacacagtgaga

SEQ ID NO: 73616 - DNA, 25 bp, Homo sapien
gttgctgtttctcctctgaccagcc

SEQ ID NO: 73617 - DNA, 25 bp, Homo sapien
cagcccacactgcaaaggaaacaga

SEQ ID NO: 73618 - DNA, 25 bp, Homo sapien
gaaacagacgccatcctacacctat

SEQ ID NO: 73619 - DNA, 25 bp, Homo sapien
aacagaacacactcctggtctggat

SEQ ID NO: 73620 - DNA, 25 bp, Homo sapien
tgcggtaggccctttgcaggagtca

SEQ ID NO: 73621 - DNA, 25 bp, Homo sapien
tttgcaggagtcaggtccctacact

SEQ ID NO: 73622 - DNA, 25 bp, Homo sapien
ggagtcaggtccctacacttggcct

SEQ ID NO: 73623 - DNA, 25 bp, Homo sapien
cacttggcctgtttttccaacctat

SEQ ID NO: 73624 - DNA, 25 bp, Homo sapien
ttgctgcactttgtggaccagtatc

SEQ ID NO: 73625 - DNA, 25 bp, Homo sapien
ttgtggaccagtatcgagagcagct

SEQ ID NO: 73626 - DNA, 25 bp, Homo sapien
gagcagctgatagcccgagtgacat

SEQ ID NO: 73627 - DNA, 25 bp, Homo sapien
acatcggtggaggttgtcttggaca

SEQ ID NO: 73628 - DNA, 25 bp, Homo sapien
aaactgcatggacaggtgctgagcc

SEQ ID NO: 73629 - DNA, 25 bp, Homo sapien
gtgctggctgagaacacgaggccca

SEQ ID NO: 73630 - DNA, 25 bp, Homo sapien
agccagatgcggaagctgttcagct

SEQ ID NO: 73631 - DNA, 25 bp, Homo sapien
tgttcagcttgagccagtcctggga

SEQ ID NO: 73632 - DNA, 25 bp, Homo sapien
aaagatggactctaccaagccctga

SEQ ID NO: 73633 - DNA, 25 bp, Homo sapien
acctcattatggaactctgggagaa

SEQ ID NO: 73634 - DNA, 25 bp, Homo sapien
caaaaagggactcctgccactcagc

SEQ ID NO: 73635 - DNA, 25 bp, Homo sapien
tcaacagcgtttcatactatatagt

SEQ ID NO: 73636 - DNA, 25 bp, Homo sapien
aacagcgtttcatactatatagtaa

SEQ ID NO: 73637 - DNA, 25 bp, Homo sapien
acaagtggaaacatgtatgccgcat

SEQ ID NO: 73638 - DNA, 25 bp, Homo sapien
tgtatgccgcataaacgataaagtt

SEQ ID NO: 73639 - DNA, 25 bp, Homo sapien
atgccgcataaacgataaagttatt

SEQ ID NO: 73640 - DNA, 25 bp, Homo sapien
ggctacttttataatacagttgact

SEQ ID NO: 73641 - DNA, 25 bp, Homo sapien
tacagttgactcgaacaatgcaggg

SEQ ID NO: 73642 - DNA, 25 bp, Homo sapien
tgtgctgatcccctgcgcagtcaaa

SEQ ID NO: 73643 - DNA, 25 bp, Homo sapien
tgctgatcccctgcgcagtcaaaaa

SEQ ID NO: 73644 - DNA, 25 bp, Homo sapien
cctacctactagtaaatagcctact

SEQ ID NO: 73645 - DNA, 25 bp, Homo sapien
cctactagtaaatagcctactattg

SEQ ID NO: 73646 - DNA, 25 bp, Homo sapien
tgtgtcagaggttccagaaagttcc

SEQ ID NO: 73647 - DNA, 25 bp, Homo sapien
atttggaatcaaacagtcctgaatt

SEQ ID NO: 73648 - DNA, 25 bp, Homo sapien
aaatccttgtttttgcacttattgt

SEQ ID NO: 73649 - DNA, 25 bp, Homo sapien
tgtttttgcacttattgtctggaga

SEQ ID NO: 73650 - DNA, 25 bp, Homo sapien
aatggcactgatgatgtctccctta

SEQ ID NO: 73651 - DNA, 25 bp, Homo sapien
gatgatgtctcccttacaagatggt

SEQ ID NO: 73652 - DNA, 25 bp, Homo sapien
gtctcccttacaagatggttgtgag

SEQ ID NO: 73653 - DNA, 25 bp, Homo sapien
gaggagtaaatgtgatcagcatgta

SEQ ID NO: 73654 - DNA, 25 bp, Homo sapien
gcatgtaaagtgtctggcgtgtagt

SEQ ID NO: 73655 - DNA, 25 bp, Homo sapien
gtctggcgtgtagtaggctcttaat

SEQ ID NO: 73656 - DNA, 25 bp, Homo sapien
agtaggctcttaataaacactggct

SEQ ID NO: 73657 - DNA, 25 bp, Homo sapien
acctaatgttcttaggtccctctgg

SEQ ID NO: 73658 - DNA, 25 bp, Homo sapien
ctaatgttcttaggtccctctggcc

SEQ ID NO: 73659 - DNA, 25 bp, Homo sapien
gaactccactgcaacagacgggcgc

SEQ ID NO: 73660 - DNA, 25 bp, Homo sapien
aacagacgggcgccaccaaagccag

SEQ ID NO: 73661 - DNA, 25 bp, Homo sapien
ctgggcccacctgctctgtgtaggg

SEQ ID NO: 73662 - DNA, 25 bp, Homo sapien
acctgctctgtgtagggctcgtcct

SEQ ID NO: 73663 - DNA, 25 bp, Homo sapien
ctgctctgtgtagggctcgtcctgc

SEQ ID NO: 73664 - DNA, 25 bp, Homo sapien
ctcgtcctgcggtgcccgagaatca

SEQ ID NO: 73665 - DNA, 25 bp, Homo sapien
gcggtgcccgagaatcactcgctaa

SEQ ID NO: 73666 - DNA, 25 bp, Homo sapien
gagaatcactcgctaacccctatgc

SEQ ID NO: 73667 - DNA, 25 bp, Homo sapien
ggaccgacatcctggagccgcctgt

SEQ ID NO: 73668 - DNA, 25 bp, Homo sapien
taaagttgttcaatgtgacataata

SEQ ID NO: 73669 - DNA, 25 bp, Homo sapien
gtattataattggttaagtagctta

SEQ ID NO: 73670 - DNA, 25 bp, Homo sapien
gtagcttaatgattaggcaaactag

SEQ ID NO: 73671 - DNA, 25 bp, Homo sapien
gattaggcaaactagatgaaaagat

SEQ ID NO: 73672 - DNA, 25 bp, Homo sapien
aaagattaggggcttccacactgca

SEQ ID NO: 73673 - DNA, 25 bp, Homo sapien
ttaggggcttccacactgcatagat

SEQ ID NO: 73674 - DNA, 25 bp, Homo sapien
acgcacatagccacgcatacacaca

SEQ ID NO: 73675 - DNA, 25 bp, Homo sapien
gaaacacattttctggctagcagaa

SEQ ID NO: 73676 - DNA, 25 bp, Homo sapien
tctttcttgctttgagagtgtacag

SEQ ID NO: 73677 - DNA, 25 bp, Homo sapien
tcttgctttgagagtgtacagtaaa

SEQ ID NO: 73678 - DNA, 25 bp, Homo sapien
gagagtgtacagtaaaagggatttt

SEQ ID NO: 73679 - DNA, 25 bp, Homo sapien
atgaattctcttgacttggcttata

SEQ ID NO: 73680 - DNA, 25 bp, Homo sapien
ctcttgacttggcttataatagttt

SEQ ID NO: 73681 - DNA, 25 bp, Homo sapien
gacttggcttataatagttttatga

SEQ ID NO: 73682 - DNA, 25 bp, Homo sapien
actacataggtagcacatttatcat

SEQ ID NO: 73683 - DNA, 25 bp, Homo sapien
gaaatagtatgcaagaaactcaggc

SEQ ID NO: 73684 - DNA, 25 bp, Homo sapien
tgcaagaaactcaggcattgaactt

SEQ ID NO: 73685 - DNA, 25 bp, Homo sapien
aactcaggcattgaacttgaagata

SEQ ID NO: 73686 - DNA, 25 bp, Homo sapien
gagtattattgctttaatccagtgt

SEQ ID NO: 73687 - DNA, 25 bp, Homo sapien
gctttaatccagtgtatttgtttat

SEQ ID NO: 73688 - DNA, 25 bp, Homo sapien
aaagaaaaacacaaaggcagactgt

SEQ ID NO: 73689 - DNA, 25 bp, Homo sapien
aaaggcagactgttgagtaaaaaat

SEQ ID NO: 73690 - DNA, 25 bp, Homo sapien
gcaaaggaaagaccaccaaatccca

SEQ ID NO: 73691 - DNA, 25 bp, Homo sapien
accaaatcccattgaatttctagca

SEQ ID NO: 73692 - DNA, 25 bp, Homo sapien
gaatttctagcatcttatcttttaa

SEQ ID NO: 73693 - DNA, 25 bp, Homo sapien
aacaaggcacagtttgaagatcgaa

SEQ ID NO: 73694 - DNA, 25 bp, Homo sapien
agatcgaaactgacttaatgggaag

SEQ ID NO: 73695 - DNA, 25 bp, Homo sapien
gaaaaatttagttgctactgtagat

SEQ ID NO: 73696 - DNA, 25 bp, Homo sapien
gttgctactgtagatttacatgatt

SEQ ID NO: 73697 - DNA, 25 bp, Homo sapien
gatttacatgattaagaggcagctt

SEQ ID NO: 73698 - DNA, 25 bp, Homo sapien
gatcattccctctttttggatgtat

SEQ ID NO: 73699 - DNA, 25 bp, Homo sapien
gaaccttccggacaacagaacctat

SEQ ID NO: 73700 - DNA, 25 bp, Homo sapien
cttccggacaacagaacctatttct

SEQ ID NO: 73701 - DNA, 25 bp, Homo sapien
cagggtgggcaggaatactgttatc

SEQ ID NO: 73702 - DNA, 25 bp, Homo sapien
ggaatactgttatctatgtgacggg

SEQ ID NO: 73703 - DNA, 25 bp, Homo sapien
aggctgagatgagaatgcggattaa

SEQ ID NO: 73704 - DNA, 25 bp, Homo sapien
tgcggattaaaatgcctggcgtgct

SEQ ID NO: 73705 - DNA, 25 bp, Homo sapien
tgagggcctagctcccaaatcctgc

SEQ ID NO: 73706 - DNA, 25 bp, Homo sapien
gaggcctggaaacgagagtcttaat

SEQ ID NO: 73707 - DNA, 25 bp, Homo sapien
gatgggagactcgaactctagccct

SEQ ID NO: 73708 - DNA, 25 bp, Homo sapien
ggagactcgaactctagccctggat

SEQ ID NO: 73709 - DNA, 25 bp, Homo sapien
gaactctagccctggatctgccttc

SEQ ID NO: 73710 - DNA, 25 bp, Homo sapien
tgccttcctgctgaaacttgttcca

SEQ ID NO: 73711 - DNA, 25 bp, Homo sapien
tcctgctgaaacttgttccacctca

SEQ ID NO: 73712 - DNA, 25 bp, Homo sapien
tctaatttccaatagtccgtgaaag

SEQ ID NO: 73713 - DNA, 25 bp, Homo sapien
ggctgaagtacctaagtgtgaatgt

SEQ ID NO: 73714 - DNA, 25 bp, Homo sapien
agtgtgaatgtctctcccgttaaac

SEQ ID NO: 73715 - DNA, 25 bp, Homo sapien
gtctctcccgttaaactgagtgtag

SEQ ID NO: 73716 - DNA, 25 bp, Homo sapien
agctgtaactagttgtaagtgctta

SEQ ID NO: 73717 - DNA, 25 bp, Homo sapien
gcttaggaagaaactttgcaaacat

SEQ ID NO: 73718 - DNA, 25 bp, Homo sapien
gaggatacactgttcatttttaaaa

SEQ ID NO: 73719 - DNA, 25 bp, Homo sapien
attccttcacactgtaatttaatgt

SEQ ID NO: 73720 - DNA, 25 bp, Homo sapien
aacaacataactcagatttctacag

SEQ ID NO: 73721 - DNA, 25 bp, Homo sapien
gatttctacaggagacagtggtttt

SEQ ID NO: 73722 - DNA, 25 bp, Homo sapien
tggattgtcttctgtaataggtttc

SEQ ID NO: 73723 - DNA, 25 bp, Homo sapien
aatggttatatggaacatgcctatt

SEQ ID NO: 73724 - DNA, 25 bp, Homo sapien
tatatggaacatgcctattaaacga

SEQ ID NO: 73725 - DNA, 25 bp, Homo sapien
atggacatttttggtgagaaagaac

SEQ ID NO: 73726 - DNA, 25 bp, Homo sapien
gaacaatagtcaaaactcacatgga

SEQ ID NO: 73727 - DNA, 25 bp, Homo sapien
actcacatggatagagtgtgtttgt

SEQ ID NO: 73728 - DNA, 25 bp, Homo sapien
ttgccaaaaatgccccagacctttt

SEQ ID NO: 73729 - DNA, 25 bp, Homo sapien
ctttaggatatttttgtctgacgta

SEQ ID NO: 73730 - DNA, 25 bp, Homo sapien
ttgtctgacgtattttgcttctagt

SEQ ID NO: 73731 - DNA, 25 bp, Homo sapien
gtattttgcttctagtatgtgccta

SEQ ID NO: 73732 - DNA, 25 bp, Homo sapien
gcttctagtatgtgcctactgtgat

SEQ ID NO: 73733 - DNA, 25 bp, Homo sapien
ctagtatgtgcctactgtgattttt

SEQ ID NO: 73734 - DNA, 25 bp, Homo sapien
tagaaaaccagcttgcgaataacag

SEQ ID NO: 73735 - DNA, 25 bp, Homo sapien
aaaccagcttgcgaataacagtccc

SEQ ID NO: 73736 - DNA, 25 bp, Homo sapien
aaccagcttgcgaataacagtcccc

SEQ ID NO: 73737 - DNA, 25 bp, Homo sapien
cagcttgcgaataacagtccccgtg

SEQ ID NO: 73738 - DNA, 25 bp, Homo sapien
agcttgcgaataacagtccccgtgg

SEQ ID NO: 73739 - DNA, 25 bp, Homo sapien
gcttgcgaataacagtccccgtggc

SEQ ID NO: 73740 - DNA, 25 bp, Homo sapien
ttgcgaataacagtccccgtggcca

SEQ ID NO: 73741 - DNA, 25 bp, Homo sapien
gcgaataacagtccccgtggccatc

SEQ ID NO: 73742 - DNA, 25 bp, Homo sapien
tggccatccctgtgagggtgacgtt

SEQ ID NO: 73743 - DNA, 25 bp, Homo sapien
gccatccctgtgagggtgacgttag

SEQ ID NO: 73744 - DNA, 25 bp, Homo sapien
ccatccctgtgagggtgacgttagc

SEQ ID NO: 73745 - DNA, 25 bp, Homo sapien
tttatttgtctattcatccattgat

SEQ ID NO: 73746 - DNA, 25 bp, Homo sapien
atttgtctattcatccattgataaa

SEQ ID NO: 73747 - DNA, 25 bp, Homo sapien
gtctattcatccattgataaacatt

SEQ ID NO: 73748 - DNA, 25 bp, Homo sapien
atccattgataaacatttggtttct

SEQ ID NO: 73749 - DNA, 25 bp, Homo sapien
ttgataaacatttggtttctatctt

SEQ ID NO: 73750 - DNA, 25 bp, Homo sapien
gaaattgaacgaatgcagattgctg

SEQ ID NO: 73751 - DNA, 25 bp, Homo sapien
aacgaatgcagattgctgggaagct

SEQ ID NO: 73752 - DNA, 25 bp, Homo sapien
gattgctgggaagctgacatcacag

SEQ ID NO: 73753 - DNA, 25 bp, Homo sapien
ttgctgggaagctgacatcacagag

SEQ ID NO: 73754 - DNA, 25 bp, Homo sapien
attccattgtatgcgtatgccatat

SEQ ID NO: 73755 - DNA, 25 bp, Homo sapien
cattgtatgcgtatgccatatttta

SEQ ID NO: 73756 - DNA, 25 bp, Homo sapien
gttgaaatgcaatgtgctgccctga

SEQ ID NO: 73757 - DNA, 25 bp, Homo sapien
gctgccctgagatccagtttcaaga

SEQ ID NO: 73758 - DNA, 25 bp, Homo sapien
gagaacttggtggttcaccgctgta

SEQ ID NO: 73759 - DNA, 25 bp, Homo sapien
tggttcaccgctgtactatttgtgt

SEQ ID NO: 73760 - DNA, 25 bp, Homo sapien
gttgcaatacccctaacagtcgagt

SEQ ID NO: 73761 - DNA, 25 bp, Homo sapien
agtcgagtagtagtctcccttacag

SEQ ID NO: 73762 - DNA, 25 bp, Homo sapien
gtctcccttacaggaatttttgacg

SEQ ID NO: 73763 - DNA, 25 bp, Homo sapien
ttgtcgctgtcctgtgcttttgcac

SEQ ID NO: 73764 - DNA, 25 bp, Homo sapien
gtgcttttgcaccattgagttgact

SEQ ID NO: 73765 - DNA, 25 bp, Homo sapien
cattgagttgactgcctctgagaag

SEQ ID NO: 73766 - DNA, 25 bp, Homo sapien
gaagcagcactaggcctgttgaaat

SEQ ID NO: 73767 - DNA, 25 bp, Homo sapien
tttagtaaccactctagcctcgtta

SEQ ID NO: 73768 - DNA, 25 bp, Homo sapien
actctagcctcgttaaacaccgaag

SEQ ID NO: 73769 - DNA, 25 bp, Homo sapien
aacaccgaagagttcataccggaga

SEQ ID NO: 73770 - DNA, 25 bp, Homo sapien
ttagccagagctctaacctcactaa

SEQ ID NO: 73771 - DNA, 25 bp, Homo sapien
taacctcactaatcaccagcgaatt

SEQ ID NO: 73772 - DNA, 25 bp, Homo sapien
tccaacctcctaaaacatcagaacg

SEQ ID NO: 73773 - DNA, 25 bp, Homo sapien
aaacatcagaacgttcacaagggat

SEQ ID NO: 73774 - DNA, 25 bp, Homo sapien
cagaacgttcacaagggataaaggt

SEQ ID NO: 73775 - DNA, 25 bp, Homo sapien
aggttaggtaacacacatagggctg

SEQ ID NO: 73776 - DNA, 25 bp, Homo sapien
cacacatagggctgttacggactga

SEQ ID NO: 73777 - DNA, 25 bp, Homo sapien
tacggactgagaagtgtccctgcaa

SEQ ID NO: 73778 - DNA, 25 bp, Homo sapien
ttctgaacaatgaggcacatgctat

SEQ ID NO: 73779 - DNA, 25 bp, Homo sapien
acatgctattactatgcaagtgaca

SEQ ID NO: 73780 - DNA, 25 bp, Homo sapien
gtgacaaagtccacgcagaactctt

SEQ ID NO: 73781 - DNA, 25 bp, Homo sapien
aagtccacgcagaactctttcaggg

SEQ ID NO: 73782 - DNA, 25 bp, Homo sapien
cacgcagaactctttcagggctgaa

SEQ ID NO: 73783 - DNA, 25 bp, Homo sapien
ttcagggctgaatcgtctcaaactt

SEQ ID NO: 73784 - DNA, 25 bp, Homo sapien
ggctgaatcgtctcaaacttgtcat

SEQ ID NO: 73785 - DNA, 25 bp, Homo sapien
atcgtctcaaacttgtcattctgaa

SEQ ID NO: 73786 - DNA, 25 bp, Homo sapien
aaaattcaggcaacttccagaagaa

SEQ ID NO: 73787 - DNA, 25 bp, Homo sapien
ccagaagaaggctgcaaacatgctt

SEQ ID NO: 73788 - DNA, 25 bp, Homo sapien
cgatgatgcctgatatgaatgttac

SEQ ID NO: 73789 - DNA, 25 bp, Homo sapien
gtatgagagaaagcaaggcccgtca

SEQ ID NO: 73790 - DNA, 25 bp, Homo sapien
aaagcaaggcccgtcatgctgtccg

SEQ ID NO: 73791 - DNA, 25 bp, Homo sapien
atgctgtccgtacactacgtatgct

SEQ ID NO: 73792 - DNA, 25 bp, Homo sapien
aattaattgtacgatatcattccag

SEQ ID NO: 73793 - DNA, 25 bp, Homo sapien
gatatcattccagtacgttttgttg

SEQ ID NO: 73794 - DNA, 25 bp, Homo sapien
cgttttgttgtacattttagtcttg

SEQ ID NO: 73795 - DNA, 25 bp, Homo sapien
ttaagaggatgcgaactgtacagtt

SEQ ID NO: 73796 - DNA, 25 bp, Homo sapien
cgaactgtacagtttccagctagtt

SEQ ID NO: 73797 - DNA, 25 bp, Homo sapien
tacagtttccagctagttacccata

SEQ ID NO: 73798 - DNA, 25 bp, Homo sapien
gtttccagctagttacccatattag

SEQ ID NO: 73799 - DNA, 25 bp, Homo sapien
cagctagttacccatattagagaag

SEQ ID NO: 73800 - DNA, 25 bp, Homo sapien
tgctctacaagctgaccagtgagaa

SEQ ID NO: 73801 - DNA, 25 bp, Homo sapien
tgagaactgcgagcactttgtgaat

SEQ ID NO: 73802 - DNA, 25 bp, Homo sapien
cactttgtgaatgagctgcgctatg

SEQ ID NO: 73803 - DNA, 25 bp, Homo sapien
aatgagctgcgctatggagtcgccc

SEQ ID NO: 73804 - DNA, 25 bp, Homo sapien
gagatgtcatcatcgctgcaagcgt

SEQ ID NO: 73805 - DNA, 25 bp, Homo sapien
aatgggcttggcagccatgagcctt

SEQ ID NO: 73806 - DNA, 25 bp, Homo sapien
gcagccatgagccttattggagtca

SEQ ID NO: 73807 - DNA, 25 bp, Homo sapien
gccttattggagtcatgttctcaag

SEQ ID NO: 73808 - DNA, 25 bp, Homo sapien
aaagactgtcctgtcagcgatgact

SEQ ID NO: 73809 - DNA, 25 bp, Homo sapien
gtcagcgatgactttatacatcaag

SEQ ID NO: 73810 - DNA, 25 bp, Homo sapien
gggtcttgttttgctagagagtttg

SEQ ID NO: 73811 - DNA, 25 bp, Homo sapien
gactgattgggctgcatacttgcga

SEQ ID NO: 73812 - DNA, 25 bp, Homo sapien
tgcatacttgcgaggtgggcaacgt

SEQ ID NO: 73813 - DNA, 25 bp, Homo sapien
gtgggcaacgtgttctgttaacaac

SEQ ID NO: 73814 - DNA, 25 bp, Homo sapien
aacagggaaccctcgtccacaggtg

SEQ ID NO: 73815 - DNA, 25 bp, Homo sapien
aggtggccaccccttgctcttgagt

SEQ ID NO: 73816 - DNA, 25 bp, Homo sapien
gagtcccacccaaaacctctagtag

SEQ ID NO: 73817 - DNA, 25 bp, Homo sapien
tctagtagggttttaataacgctca

SEQ ID NO: 73818 - DNA, 25 bp, Homo sapien
ataacgctcaccgtaaaggtgtctt

SEQ ID NO: 73819 - DNA, 25 bp, Homo sapien
aaaggtgtcttcataattactagtg

SEQ ID NO: 73820 - DNA, 25 bp, Homo sapien
gacaagttctcttgactctagcaag

SEQ ID NO: 73821 - DNA, 25 bp, Homo sapien
tctagcaaggttcccgtgtggtcat

SEQ ID NO: 73822 - DNA, 25 bp, Homo sapien
gaaattgaacgaatgcagattgctg

SEQ ID NO: 73823 - DNA, 25 bp, Homo sapien
aaattgaacgaatgcagattgctgg

SEQ ID NO: 73824 - DNA, 25 bp, Homo sapien
aattgaacgaatgcagattgctggg

SEQ ID NO: 73825 - DNA, 25 bp, Homo sapien
attgaacgaatgcagattgctggga

SEQ ID NO: 73826 - DNA, 25 bp, Homo sapien
ttgaacgaatgcagattgctgggaa

SEQ ID NO: 73827 - DNA, 25 bp, Homo sapien
tgaacgaatgcagattgctgggaag

SEQ ID NO: 73828 - DNA, 25 bp, Homo sapien
gaacgaatgcagattgctgggaagc

SEQ ID NO: 73829 - DNA, 25 bp, Homo sapien
aacgaatgcagattgctgggaagct

SEQ ID NO: 73830 - DNA, 25 bp, Homo sapien
acgaatgcagattgctgggaagctg

SEQ ID NO: 73831 - DNA, 25 bp, Homo sapien
cgaatgcagattgctgggaagctga

SEQ ID NO: 73832 - DNA, 25 bp, Homo sapien
gattgctgggaagctgacatcacag

SEQ ID NO: 73833 - DNA, 25 bp, Homo sapien
actcacttggatggtcacaaggtac

SEQ ID NO: 73834 - DNA, 25 bp, Homo sapien
cacaaggtacatatttcccgggata

SEQ ID NO: 73835 - DNA, 25 bp, Homo sapien
atttcccgggataagatcaccaggc

SEQ ID NO: 73836 - DNA, 25 bp, Homo sapien
ataagatcaccaggccaggagcgaa

SEQ ID NO: 73837 - DNA, 25 bp, Homo sapien
gccaggagcgaagctatggaagaaa

SEQ ID NO: 73838 - DNA, 25 bp, Homo sapien
gattttccaaaagaacagttaacag

SEQ ID NO: 73839 - DNA, 25 bp, Homo sapien
aacagttaacagaggaagcgagaga

SEQ ID NO: 73840 - DNA, 25 bp, Homo sapien
tcattagttgagtcactggttggct

SEQ ID NO: 73841 - DNA, 25 bp, Homo sapien
ttgagtcactggttggctttgagat

SEQ ID NO: 73842 - DNA, 25 bp, Homo sapien
ggctttgagatggatattactcact

SEQ ID NO: 73843 - DNA, 25 bp, Homo sapien
gatattactcacttggatggtcaca

SEQ ID NO: 73844 - DNA, 25 bp, Homo sapien
aaagaagttgccaaagcctcctgcc

SEQ ID NO: 73845 - DNA, 25 bp, Homo sapien
aaagcctcctgccaagcttccaaag

SEQ ID NO: 73846 - DNA, 25 bp, Homo sapien
ccagagcccaaagtctttaatggtg

SEQ ID NO: 73847 - DNA, 25 bp, Homo sapien
aagtctttaatggtggcttgggcag

SEQ ID NO: 73848 - DNA, 25 bp, Homo sapien
gaagctgccagtcagttcagcccag

SEQ ID NO: 73849 - DNA, 25 bp, Homo sapien
cacagccgggctggcagacatgacg

SEQ ID NO: 73850 - DNA, 25 bp, Homo sapien
tggcagacatgacggcagagctaca

SEQ ID NO: 73851 - DNA, 25 bp, Homo sapien
gggcactggagcactgattcggaca

SEQ ID NO: 73852 - DNA, 25 bp, Homo sapien
ggagcactgattcggacacaccagg

SEQ ID NO: 73853 - DNA, 25 bp, Homo sapien
gaccagcgggctagtcccagggcat

SEQ ID NO: 73854 - DNA, 25 bp, Homo sapien
gccagattctttttcccaggattaa

SEQ ID NO: 73855 - DNA, 25 bp, Homo sapien
gggccgctgacatctaggacttcat

SEQ ID NO: 73856 - DNA, 25 bp, Homo sapien
gccgctgacatctaggacttcatta

SEQ ID NO: 73857 - DNA, 25 bp, Homo sapien
gctgacatctaggacttcattattc

SEQ ID NO: 73858 - DNA, 25 bp, Homo sapien
cattattctataattcaggaccaca

SEQ ID NO: 73859 - DNA, 25 bp, Homo sapien
ggaccacagtggagtatgatcccta

SEQ ID NO: 73860 - DNA, 25 bp, Homo sapien
agtatgatccctaactcctgatttg

SEQ ID NO: 73861 - DNA, 25 bp, Homo sapien
tatgatccctaactcctgatttgga

SEQ ID NO: 73862 - DNA, 25 bp, Homo sapien
gatccctaactcctgatttggatgc

SEQ ID NO: 73863 - DNA, 25 bp, Homo sapien
ctaactcctgatttggatgcatctg

SEQ ID NO: 73864 - DNA, 25 bp, Homo sapien
tttggatgcatctgagggacaaggg

SEQ ID NO: 73865 - DNA, 25 bp, Homo sapien
ggcggtctccgaagtggaataaaat

SEQ ID NO: 73866 - DNA, 25 bp, Homo sapien
gtataccacgtcaacctagaaggag

SEQ ID NO: 73867 - DNA, 25 bp, Homo sapien
ttgaaacagctccagacagccaagc

SEQ ID NO: 73868 - DNA, 25 bp, Homo sapien
aagcctttggcacagttcatgtcta

SEQ ID NO: 73869 - DNA, 25 bp, Homo sapien
ggcacagttcatgtctatcctgaca

SEQ ID NO: 73870 - DNA, 25 bp, Homo sapien
gagaggcagagttccagatagaatt

SEQ ID NO: 73871 - DNA, 25 bp, Homo sapien
ggaagagccttccattgttagtcta

SEQ ID NO: 73872 - DNA, 25 bp, Homo sapien
aaatgagctttgtgtttgtccctcc

SEQ ID NO: 73873 - DNA, 25 bp, Homo sapien
gctttgtgtttgtccctcctaaaca

SEQ ID NO: 73874 - DNA, 25 bp, Homo sapien
ccatgatggtggctactctgaggat

SEQ ID NO: 73875 - DNA, 25 bp, Homo sapien
tggctactctgaggatccttttggt

SEQ ID NO: 73876 - DNA, 25 bp, Homo sapien
ggatccttttggtgtataccacgtc

SEQ ID NO: 73877 - DNA, 25 bp, Homo sapien
ttgggtgcccatataggaggtctgt

SEQ ID NO: 73878 - DNA, 25 bp, Homo sapien
ggaggtctgtatgttcaccaacagt

SEQ ID NO: 73879 - DNA, 25 bp, Homo sapien
gtatgttcaccaacagtgcggaggg

SEQ ID NO: 73880 - DNA, 25 bp, Homo sapien
gggtcacacattgcaaaacactgcc

SEQ ID NO: 73881 - DNA, 25 bp, Homo sapien
attcctgatatcttggatggcccgg

SEQ ID NO: 73882 - DNA, 25 bp, Homo sapien
gatatcttggatggcccggagctgc

SEQ ID NO: 73883 - DNA, 25 bp, Homo sapien
gagctgcatgacgtcctggagatcc

SEQ ID NO: 73884 - DNA, 25 bp, Homo sapien
acgtcctggagatccacttccagaa

SEQ ID NO: 73885 - DNA, 25 bp, Homo sapien
aggtagaggccctgacagtcgtacc

SEQ ID NO: 73886 - DNA, 25 bp, Homo sapien
acagtcgtaccccaaggacagcagg

SEQ ID NO: 73887 - DNA, 25 bp, Homo sapien
ggacagcagggcctagcagtcttca

SEQ ID NO: 73888 - DNA, 25 bp, Homo sapien
agacatggatgtagctacctttttt

SEQ ID NO: 73889 - DNA, 25 bp, Homo sapien
taagcaatcgtgttgaattaggagt

SEQ ID NO: 73890 - DNA, 25 bp, Homo sapien
aattaggagtatacttggtgtggaa

SEQ ID NO: 73891 - DNA, 25 bp, Homo sapien
ggaaagagtatgaatttgccatgtg

SEQ ID NO: 73892 - DNA, 25 bp, Homo sapien
gaagctactgtgagcgtgtgttttt

SEQ ID NO: 73893 - DNA, 25 bp, Homo sapien
ccaacgtcaagtttttaccttgcat

SEQ ID NO: 73894 - DNA, 25 bp, Homo sapien
aagtttttaccttgcatgtactgga

SEQ ID NO: 73895 - DNA, 25 bp, Homo sapien
ttaccttgcatgtactggagtattt

SEQ ID NO: 73896 - DNA, 25 bp, Homo sapien
gttacctcagttttcactccttaga

SEQ ID NO: 73897 - DNA, 25 bp, Homo sapien
ctcagttttcactccttagacatgg

SEQ ID NO: 73898 - DNA, 25 bp, Homo sapien
gttttcactccttagacatggatgt

SEQ ID NO: 73899 - DNA, 25 bp, Homo sapien
aaagattggccctgtgtactcctct

SEQ ID NO: 73900 - DNA, 25 bp, Homo sapien
tcctctgtctcgtctgaagcaagaa

SEQ ID NO: 73901 - DNA, 25 bp, Homo sapien
gcaagaagtagcaacattcagtcaa

SEQ ID NO: 73902 - DNA, 25 bp, Homo sapien
gcaacattcagtcaaagggcagtat

SEQ ID NO: 73903 - DNA, 25 bp, Homo sapien
agtcaaagggcagtatctgatacct

SEQ ID NO: 73904 - DNA, 25 bp, Homo sapien
gataccttgatgacaattaatcgga

SEQ ID NO: 73905 - DNA, 25 bp, Homo sapien
ttaatcggatggagcaggcacgcac

SEQ ID NO: 73906 - DNA, 25 bp, Homo sapien
agcaggcacgcacagaatacagagg

SEQ ID NO: 73907 - DNA, 25 bp, Homo sapien
cgcacagaatacagaggagctctac

SEQ ID NO: 73908 - DNA, 25 bp, Homo sapien
gatgtatcccaagagctggacccag

SEQ ID NO: 73909 - DNA, 25 bp, Homo sapien
tggacccagacaccttaaagcaaat

SEQ ID NO: 73910 - DNA, 25 bp, Homo sapien
agcagaagattgaggaccacttgtt

SEQ ID NO: 73911 - DNA, 25 bp, Homo sapien
ggaccacttgttgagctctggaaag

SEQ ID NO: 73912 - DNA, 25 bp, Homo sapien
gagctctggaaagttcatgtatcta

SEQ ID NO: 73913 - DNA, 25 bp, Homo sapien
ggaaagttcatgtatctagaaggta

SEQ ID NO: 73914 - DNA, 25 bp, Homo sapien
tctagaaggtaatgcagactctgcc

SEQ ID NO: 73915 - DNA, 25 bp, Homo sapien
agactctgccatgtcctaagtgtga

SEQ ID NO: 73916 - DNA, 25 bp, Homo sapien
tgtcctaagtgtgattctcttcagg

SEQ ID NO: 73917 - DNA, 25 bp, Homo sapien
ctaagtgtgattctcttcaggaagt

SEQ ID NO: 73918 - DNA, 25 bp, Homo sapien
tttctggaaaaagcccaactggact

SEQ ID NO: 73919 - DNA, 25 bp, Homo sapien
atgaccggtactggaagaaactctc

SEQ ID NO: 73920 - DNA, 25 bp, Homo sapien
gtactggaagaaactctcccatcca

SEQ ID NO: 73921 - DNA, 25 bp, Homo sapien
gaaggaggtatgaatcccagtcccc

SEQ ID NO: 73922 - DNA, 25 bp, Homo sapien
aggaggtatgaatcccagtccccag

SEQ ID NO: 73923 - DNA, 25 bp, Homo sapien
ggaggtatgaatcccagtccccagg

SEQ ID NO: 73924 - DNA, 25 bp, Homo sapien
aggtatgaatcccagtccccaggaa

SEQ ID NO: 73925 - DNA, 25 bp, Homo sapien
ggtatgaatcccagtccccaggaac

SEQ ID NO: 73926 - DNA, 25 bp, Homo sapien
atgaatcccagtccccaggaaccta

SEQ ID NO: 73927 - DNA, 25 bp, Homo sapien
cagtccccaggaacctagctcttta

SEQ ID NO: 73928 - DNA, 25 bp, Homo sapien
ccaggaacctagctctttaaactct

SEQ ID NO: 73929 - DNA, 25 bp, Homo sapien
ggaacctagctctttaaactctggg

SEQ ID NO: 73930 - DNA, 25 bp, Homo sapien
aactctggggagtcggattcaggaa

SEQ ID NO: 73931 - DNA, 25 bp, Homo sapien
gattcaggaaacacccccaggaggc

SEQ ID NO: 73932 - DNA, 25 bp, Homo sapien
cctcccaataatcaacagcaaaatt

SEQ ID NO: 73933 - DNA, 25 bp, Homo sapien
gcaaaattataggtctaacaatgtt

SEQ ID NO: 73934 - DNA, 25 bp, Homo sapien
acaatgttttatagacacccctcca

SEQ ID NO: 73935 - DNA, 25 bp, Homo sapien
aatgttttatagacacccctccatt

SEQ ID NO: 73936 - DNA, 25 bp, Homo sapien
gttttatagacacccctccatttat

SEQ ID NO: 73937 - DNA, 25 bp, Homo sapien
atagacacccctccatttatgtgat

SEQ ID NO: 73938 - DNA, 25 bp, Homo sapien
gacacccctccatttatgtgatggg

SEQ ID NO: 73939 - DNA, 25 bp, Homo sapien
atgtgatgggtttgcatcctgataa

SEQ ID NO: 73940 - DNA, 25 bp, Homo sapien
tgatgggtttgcatcctgataaacc

SEQ ID NO: 73941 - DNA, 25 bp, Homo sapien
tacagtgggcaaaactatccaacac

SEQ ID NO: 73942 - DNA, 25 bp, Homo sapien
gcaaaactatccaacacaaaatcta

SEQ ID NO: 73943 - DNA, 25 bp, Homo sapien
accgtgttgggcctttgcccagcta

SEQ ID NO: 73944 - DNA, 25 bp, Homo sapien
ttgcccagctattttgatgcccaga

SEQ ID NO: 73945 - DNA, 25 bp, Homo sapien
tattttgatgcccagacctgcttca

SEQ ID NO: 73946 - DNA, 25 bp, Homo sapien
gcttcacctttgtgtatgatgccag

SEQ ID NO: 73947 - DNA, 25 bp, Homo sapien
cctgagcttggtgtatttttgttgt

SEQ ID NO: 73948 - DNA, 25 bp, Homo sapien
gcttggtgtatttttgttgtgtgtt

SEQ ID NO: 73949 - DNA, 25 bp, Homo sapien
ttttctcctgacattcaatgccaga

SEQ ID NO: 73950 - DNA, 25 bp, Homo sapien
gacattcaatgccagacaacttata

SEQ ID NO: 73951 - DNA, 25 bp, Homo sapien
acttatatgcatccactagctaccc

SEQ ID NO: 73952 - DNA, 25 bp, Homo sapien
ctagctaccccggattgtaaatcct

SEQ ID NO: 73953 - DNA, 25 bp, Homo sapien
ttgtaaatcctaggttattcttggg

SEQ ID NO: 73954 - DNA, 25 bp, Homo sapien
tagaatgtgggttaccacaggttgg

SEQ ID NO: 73955 - DNA, 25 bp, Homo sapien
gagatgttggtcactgggtgaaaac

SEQ ID NO: 73956 - DNA, 25 bp, Homo sapien
gttggtcactgggtgaaaacattag

SEQ ID NO: 73957 - DNA, 25 bp, Homo sapien
aatgataggtttttgagatgactta

SEQ ID NO: 73958 - DNA, 25 bp, Homo sapien
atgacttatatggtaataggcttgt

SEQ ID NO: 73959 - DNA, 25 bp, Homo sapien
gtttccatcagtccatattgtatac

SEQ ID NO: 73960 - DNA, 25 bp, Homo sapien
catcagtccatattgtatacctata

SEQ ID NO: 73961 - DNA, 25 bp, Homo sapien
gtccatattgtatacctataacaga

SEQ ID NO: 73962 - DNA, 25 bp, Homo sapien
cagaatatcagtttgtttcctgtaa

SEQ ID NO: 73963 - DNA, 25 bp, Homo sapien
aaatcatattccagttcttattgtg

SEQ ID NO: 73964 - DNA, 25 bp, Homo sapien
cagttcttattgtgttggttctaaa

SEQ ID NO: 73965 - DNA, 25 bp, Homo sapien
aggaatccagatggttctctgcgcc

SEQ ID NO: 73966 - DNA, 25 bp, Homo sapien
agatggttctctgcgccatccaggt

SEQ ID NO: 73967 - DNA, 25 bp, Homo sapien
catccaggtggtcaatggcctcctg

SEQ ID NO: 73968 - DNA, 25 bp, Homo sapien
gacccgtttaaacctccgagatgag

SEQ ID NO: 73969 - DNA, 25 bp, Homo sapien
gatgagctgctcagactctacagca

SEQ ID NO: 73970 - DNA, 25 bp, Homo sapien
gactctacagcatgacgactacaat

SEQ ID NO: 73971 - DNA, 25 bp, Homo sapien
gacgactacaatttcttttcataaa

SEQ ID NO: 73972 - DNA, 25 bp, Homo sapien
tattaattcctatctgcttcctagc

SEQ ID NO: 73973 - DNA, 25 bp, Homo sapien
atctgcttcctagctgataaagctt

SEQ ID NO: 73974 - DNA, 25 bp, Homo sapien
ttattccttctttccaaccagcttt

SEQ ID NO: 73975 - DNA, 25 bp, Homo sapien
ttccaaccagctttgctcgagttag

SEQ ID NO: 73976 - DNA, 25 bp, Homo sapien
caagctagtgctttgtcttagtagt

SEQ ID NO: 73977 - DNA, 25 bp, Homo sapien
tagtgctttgtcttagtagttttaa

SEQ ID NO: 73978 - DNA, 25 bp, Homo sapien
gattgtatgttttgcattcctagaa

SEQ ID NO: 73979 - DNA, 25 bp, Homo sapien
tcctagaagtaggttaactgtgttt

SEQ ID NO: 73980 - DNA, 25 bp, Homo sapien
attgttataacttcacacctttttg

SEQ ID NO: 73981 - DNA, 25 bp, Homo sapien
acacctttttgaaatctgccctaca

SEQ ID NO: 73982 - DNA, 25 bp, Homo sapien
tctgccctacaaaatttgtttggct

SEQ ID NO: 73983 - DNA, 25 bp, Homo sapien
gcttaaacgtcaaaagccgtgacaa

SEQ ID NO: 73984 - DNA, 25 bp, Homo sapien
aagccgtgacaatttgttctttgat

SEQ ID NO: 73985 - DNA, 25 bp, Homo sapien
gttctttgatgtgattgtatttcca

SEQ ID NO: 73986 - DNA, 25 bp, Homo sapien
gtatttccaatttcttgttcatgta

SEQ ID NO: 73987 - DNA, 25 bp, Homo sapien
acatggggagacccagtctctacaa

SEQ ID NO: 73988 - DNA, 25 bp, Homo sapien
catggggagacccagtctctacaaa

SEQ ID NO: 73989 - DNA, 25 bp, Homo sapien
aaatttaaaaagccaggcattggtg

SEQ ID NO: 73990 - DNA, 25 bp, Homo sapien
aaaaagccaggcattggtggtgtgt

SEQ ID NO: 73991 - DNA, 25 bp, Homo sapien
caggcattggtggtgtgtgcctata

SEQ ID NO: 73992 - DNA, 25 bp, Homo sapien
aggcattggtggtgtgtgcctatag

SEQ ID NO: 73993 - DNA, 25 bp, Homo sapien
ggcattggtggtgtgtgcctatagt

SEQ ID NO: 73994 - DNA, 25 bp, Homo sapien
gcattggtggtgtgtgcctatagtc

SEQ ID NO: 73995 - DNA, 25 bp, Homo sapien
tcacttgagcctgggggactgaggc

SEQ ID NO: 73996 - DNA, 25 bp, Homo sapien
gcctgggggactgaggctgcagtga

SEQ ID NO: 73997 - DNA, 25 bp, Homo sapien
gctactgcactccaatctggcaaca

SEQ ID NO: 73998 - DNA, 25 bp, Homo sapien
tgtttctcatcttaactatccaagc

SEQ ID NO: 73999 - DNA, 25 bp, Homo sapien
atcttaactatccaagccacctatt

SEQ ID NO: 74000 - DNA, 25 bp, Homo sapien
aactatccaagccacctattttatt

SEQ ID NO: 74001 - DNA, 25 bp, Homo sapien
ttttatttgttctttcatctgtgac

SEQ ID NO: 74002 - DNA, 25 bp, Homo sapien
tctttcatctgtgactgcttgctga

SEQ ID NO: 74003 - DNA, 25 bp, Homo sapien
actgcttgctgactttatcataatt

SEQ ID NO: 74004 - DNA, 25 bp, Homo sapien
aaatcatgtctgtgacttcattttt

SEQ ID NO: 74005 - DNA, 25 bp, Homo sapien
tttttaaatgtacttgctcagctca

SEQ ID NO: 74006 - DNA, 25 bp, Homo sapien
ttgctcagctcaactgcatttcagt

SEQ ID NO: 74007 - DNA, 25 bp, Homo sapien
gcatttcagttgtattatagtccag

SEQ ID NO: 74008 - DNA, 25 bp, Homo sapien
ttatagtccagttcttatcaacatt

SEQ ID NO: 74009 - DNA, 25 bp, Homo sapien
caactggtaactgtcatggaggaac

SEQ ID NO: 74010 - DNA, 25 bp, Homo sapien
gaacaagtgagcctacccggtcatc

SEQ ID NO: 74011 - DNA, 25 bp, Homo sapien
aacaagtgagcctacccggtcatct

SEQ ID NO: 74012 - DNA, 25 bp, Homo sapien
caagtgagcctacccggtcatctct

SEQ ID NO: 74013 - DNA, 25 bp, Homo sapien
gagcctacccggtcatctctgttca

SEQ ID NO: 74014 - DNA, 25 bp, Homo sapien
tcacattccagctttaactccagtt

SEQ ID NO: 74015 - DNA, 25 bp, Homo sapien
actccagttttacatccctttattg

SEQ ID NO: 74016 - DNA, 25 bp, Homo sapien
ctccagttttacatccctttattgc

SEQ ID NO: 74017 - DNA, 25 bp, Homo sapien
tttacatccctttattgccattaac

SEQ ID NO: 74018 - DNA, 25 bp, Homo sapien
tacatccctttattgccattaactc

SEQ ID NO: 74019 - DNA, 25 bp, Homo sapien
attgccattaactcgttaacttatg

SEQ ID NO: 74020 - DNA, 25 bp, Homo sapien
aaacagatgccagtgcacaaatctt

SEQ ID NO: 74021 - DNA, 25 bp, Homo sapien
aacagatgccagtgcacaaatctta

SEQ ID NO: 74022 - DNA, 25 bp, Homo sapien
ttaaagaattataaggcctggtgcg

SEQ ID NO: 74023 - DNA, 25 bp, Homo sapien
taaagaattataaggcctggtgcga

SEQ ID NO: 74024 - DNA, 25 bp, Homo sapien
aaagaattataaggcctggtgcgat

SEQ ID NO: 74025 - DNA, 25 bp, Homo sapien
aagaattataaggcctggtgcgatg

SEQ ID NO: 74026 - DNA, 25 bp, Homo sapien
agaattataaggcctggtgcgatgg

SEQ ID NO: 74027 - DNA, 25 bp, Homo sapien
gaattataaggcctggtgcgatggc

SEQ ID NO: 74028 - DNA, 25 bp, Homo sapien
aattataaggcctggtgcgatggct

SEQ ID NO: 74029 - DNA, 25 bp, Homo sapien
attataaggcctggtgcgatggctc

SEQ ID NO: 74030 - DNA, 25 bp, Homo sapien
ttataaggcctggtgcgatggctca

SEQ ID NO: 74031 - DNA, 25 bp, Homo sapien
tcgactgcttaaaaaggaccttggt

SEQ ID NO: 74032 - DNA, 25 bp, Homo sapien
aagatttggctctgtctcatttgga

SEQ ID NO: 74033 - DNA, 25 bp, Homo sapien
agaagctgcaggcttattccccatg

SEQ ID NO: 74034 - DNA, 25 bp, Homo sapien
aggcttattccccatgcacttgctt

SEQ ID NO: 74035 - DNA, 25 bp, Homo sapien
tcctggctgcaaaccttaatacttt

SEQ ID NO: 74036 - DNA, 25 bp, Homo sapien
cttaatactttgtttctgctgtaga

SEQ ID NO: 74037 - DNA, 25 bp, Homo sapien
tttgttagcaaacagggagtcctga

SEQ ID NO: 74038 - DNA, 25 bp, Homo sapien
ttctccacatccacatgactggttt

SEQ ID NO: 74039 - DNA, 25 bp, Homo sapien
catgactggtttttaatgtagcact

SEQ ID NO: 74040 - DNA, 25 bp, Homo sapien
gtggtatacatgcaaacatccgttc

SEQ ID NO: 74041 - DNA, 25 bp, Homo sapien
aaacatccgttcaaaatctgagtcg

SEQ ID NO: 74042 - DNA, 25 bp, Homo sapien
agaagcccgtggccgactacttcct

SEQ ID NO: 74043 - DNA, 25 bp, Homo sapien
ttctggccctcgcaccactgtgact

SEQ ID NO: 74044 - DNA, 25 bp, Homo sapien
accactgtgactctgccatcttcct

SEQ ID NO: 74045 - DNA, 25 bp, Homo sapien
catcttcctcagacggaggctgggc

SEQ ID NO: 74046 - DNA, 25 bp, Homo sapien
tgtcccccaagagggtgcttcgagg

SEQ ID NO: 74047 - DNA, 25 bp, Homo sapien
gtgcttcgagggtgaggacttctct

SEQ ID NO: 74048 - DNA, 25 bp, Homo sapien
cttcgagggtgaggacttctctgga

SEQ ID NO: 74049 - DNA, 25 bp, Homo sapien
tctggagaggcctggagacctagct

SEQ ID NO: 74050 - DNA, 25 bp, Homo sapien
gagaggcctggagacctagctccat

SEQ ID NO: 74051 - DNA, 25 bp, Homo sapien
aggcctggagacctagctccatgtt

SEQ ID NO: 74052 - DNA, 25 bp, Homo sapien
ggagacctagctccatgttcctcct

SEQ ID NO: 74053 - DNA, 25 bp, Homo sapien
cccatctcttcctgtctaacttggg

SEQ ID NO: 74054 - DNA, 25 bp, Homo sapien
ggatggtttcacgagtgtagtcccg

SEQ ID NO: 74055 - DNA, 25 bp, Homo sapien
gtttcacgagtgtagtcccggaggc

SEQ ID NO: 74056 - DNA, 25 bp, Homo sapien
cacgagtgtagtcccggaggccttc

SEQ ID NO: 74057 - DNA, 25 bp, Homo sapien
cagccctgggcacatagcataggct

SEQ ID NO: 74058 - DNA, 25 bp, Homo sapien
ggacacaggatcctggcctgagaat

SEQ ID NO: 74059 - DNA, 25 bp, Homo sapien
acacaggatcctggcctgagaattg

SEQ ID NO: 74060 - DNA, 25 bp, Homo sapien
gggaggtggccagcccgcagaggtg

SEQ ID NO: 74061 - DNA, 25 bp, Homo sapien
ggctgcatgatttttgccctgcgtc

SEQ ID NO: 74062 - DNA, 25 bp, Homo sapien
atgatttttgccctgcgtcccttct

SEQ ID NO: 74063 - DNA, 25 bp, Homo sapien
tttgccctgcgtcccttctctttgg

SEQ ID NO: 74064 - DNA, 25 bp, Homo sapien
ttgagagggaaactttatggtacgt

SEQ ID NO: 74065 - DNA, 25 bp, Homo sapien
tacaaagttcagagagcggtacctt

SEQ ID NO: 74066 - DNA, 25 bp, Homo sapien
agagcggtacctttcctactgtctt

SEQ ID NO: 74067 - DNA, 25 bp, Homo sapien
tgtcttttctttgactccatggagg

SEQ ID NO: 74068 - DNA, 25 bp, Homo sapien
ctccatggaggaatttgtaacgatc

SEQ ID NO: 74069 - DNA, 25 bp, Homo sapien
atttgtaacgatcggtgtgacctga

SEQ ID NO: 74070 - DNA, 25 bp, Homo sapien
gaaagggtttgtgatacagcggtca

SEQ ID NO: 74071 - DNA, 25 bp, Homo sapien
gatacagcggtcactattttctctt

SEQ ID NO: 74072 - DNA, 25 bp, Homo sapien
gcggtcactattttctcttaacaca

SEQ ID NO: 74073 - DNA, 25 bp, Homo sapien
ggaaaaaagttcagacatcgctaca

SEQ ID NO: 74074 - DNA, 25 bp, Homo sapien
gacatcgctacaataaatgtgcttt

SEQ ID NO: 74075 - DNA, 25 bp, Homo sapien
tgtttaggccgggagcgatggctgt

SEQ ID NO: 74076 - DNA, 25 bp, Homo sapien
gtttaggccgggagcgatggctgta

SEQ ID NO: 74077 - DNA, 25 bp, Homo sapien
tttaggccgggagcgatggctgtaa

SEQ ID NO: 74078 - DNA, 25 bp, Homo sapien
taggccgggagcgatggctgtaatc

SEQ ID NO: 74079 - DNA, 25 bp, Homo sapien
aggccgggagcgatggctgtaatcc

SEQ ID NO: 74080 - DNA, 25 bp, Homo sapien
ggccgggagcgatggctgtaatccc

SEQ ID NO: 74081 - DNA, 25 bp, Homo sapien
gccgggagcgatggctgtaatccca

SEQ ID NO: 74082 - DNA, 25 bp, Homo sapien
ccgggcatggttgcgcgcacctata

SEQ ID NO: 74083 - DNA, 25 bp, Homo sapien
cgggcatggttgcgcgcacctatag

SEQ ID NO: 74084 - DNA, 25 bp, Homo sapien
gtcccagctatcctgaggcagggga

SEQ ID NO: 74085 - DNA, 25 bp, Homo sapien
tcccagctatcctgaggcaggggaa

SEQ ID NO: 74086 - DNA, 25 bp, Homo sapien
acacactgagttgcttatgccactt

SEQ ID NO: 74087 - DNA, 25 bp, Homo sapien
cttatgccacttccttgttcaaaat

SEQ ID NO: 74088 - DNA, 25 bp, Homo sapien
aatcaagactggtgggtccatggcc

SEQ ID NO: 74089 - DNA, 25 bp, Homo sapien
tggccctgtgttagttcatgcattc

SEQ ID NO: 74090 - DNA, 25 bp, Homo sapien
gttcatgcattcagttgagtcccaa

SEQ ID NO: 74091 - DNA, 25 bp, Homo sapien
gaaagtttcatctcccgaaatgcag

SEQ ID NO: 74092 - DNA, 25 bp, Homo sapien
aatgcagttccttagatgcccatct

SEQ ID NO: 74093 - DNA, 25 bp, Homo sapien
agatgcccatctggacgtgatgccg

SEQ ID NO: 74094 - DNA, 25 bp, Homo sapien
gatgccgcgcctgccgtgtaagaag

SEQ ID NO: 74095 - DNA, 25 bp, Homo sapien
ggtgcaatcctagataacacagcta

SEQ ID NO: 74096 - DNA, 25 bp, Homo sapien
cttttttctccaaaatgatgccttg

SEQ ID NO: 74097 - DNA, 25 bp, Homo sapien
gagaaacacgtttcggagtcgcagg

SEQ ID NO: 74098 - DNA, 25 bp, Homo sapien
ttcggagtcgcagggagctctgtct

SEQ ID NO: 74099 - DNA, 25 bp, Homo sapien
agctctgtctggcatcggtggcaca

SEQ ID NO: 74100 - DNA, 25 bp, Homo sapien
gtggcacagatggtgaacttgtttc

SEQ ID NO: 74101 - DNA, 25 bp, Homo sapien
tttcaggaagtgtgagcacgggcct

SEQ ID NO: 74102 - DNA, 25 bp, Homo sapien
tgaggacgtcgttatgatttgattt

SEQ ID NO: 74103 - DNA, 25 bp, Homo sapien
tttgatttgaccttggcacacactg

SEQ ID NO: 74104 - DNA, 25 bp, Homo sapien
cagagccacagggatgttgctgaat

SEQ ID NO: 74105 - DNA, 25 bp, Homo sapien
gaatttcaatcaccgatcagcaagg

SEQ ID NO: 74106 - DNA, 25 bp, Homo sapien
aggatgaaccttctcaacttcctag

SEQ ID NO: 74107 - DNA, 25 bp, Homo sapien
aacttcctaggaatgtttagcagca

SEQ ID NO: 74108 - DNA, 25 bp, Homo sapien
agtcttggcccaaagatgtcaccat

SEQ ID NO: 74109 - DNA, 25 bp, Homo sapien
agatgtcaccattcctagttatttg

SEQ ID NO: 74110 - DNA, 25 bp, Homo sapien
tagttatttgtcaccacataattgg

SEQ ID NO: 74111 - DNA, 25 bp, Homo sapien
agaactgctgggttgtctttttcca

SEQ ID NO: 74112 - DNA, 25 bp, Homo sapien
tgggttgtctttttccatgtaactt

SEQ ID NO: 74113 - DNA, 25 bp, Homo sapien
gaagagatccgaatctgtgcccagc

SEQ ID NO: 74114 - DNA, 25 bp, Homo sapien
gtgcccagcgctaaaggctcagtgt

SEQ ID NO: 74115 - DNA, 25 bp, Homo sapien
ggctcagtgttagcatggcttgtgc

SEQ ID NO: 74116 - DNA, 25 bp, Homo sapien
gccggtgtgccatattcttgttgga

SEQ ID NO: 74117 - DNA, 25 bp, Homo sapien
ggagatgaaccgtagcaccagagcc

SEQ ID NO: 74118 - DNA, 25 bp, Homo sapien
agcccattcttccttgtcagtcttg

SEQ ID NO: 74119 - DNA, 25 bp, Homo sapien
tgtcctgtctcaggccaggctaaat

SEQ ID NO: 74120 - DNA, 25 bp, Homo sapien
ctgtctcaggccaggctaaatatgt

SEQ ID NO: 74121 - DNA, 25 bp, Homo sapien
tctcaggccaggctaaatatgtgcc

SEQ ID NO: 74122 - DNA, 25 bp, Homo sapien
ggccaggctaaatatgtgccttcct

SEQ ID NO: 74123 - DNA, 25 bp, Homo sapien
ggctaaatatgtgccttcctcaggg

SEQ ID NO: 74124 - DNA, 25 bp, Homo sapien
ccaggatgacccactcttagggggg

SEQ ID NO: 74125 - DNA, 25 bp, Homo sapien
ggtggtggcatctggacaaatgcca

SEQ ID NO: 74126 - DNA, 25 bp, Homo sapien
gtggcaaagctacctggaatggatt

SEQ ID NO: 74127 - DNA, 25 bp, Homo sapien
acctggaatggatttgtgtgctgat

SEQ ID NO: 74128 - DNA, 25 bp, Homo sapien
gaatggatttgtgtgctgattttta

SEQ ID NO: 74129 - DNA, 25 bp, Homo sapien
ggatttgtgtgctgatttttaagga

SEQ ID NO: 74130 - DNA, 25 bp, Homo sapien
tggcttctcagatgtatttcaagga

SEQ ID NO: 74131 - DNA, 25 bp, Homo sapien
gcttctcagatgtatttcaaggact

SEQ ID NO: 74132 - DNA, 25 bp, Homo sapien
atttcaaggactaaagtgggctcta

SEQ ID NO: 74133 - DNA, 25 bp, Homo sapien
aaggactaaagtgggctctaagatc

SEQ ID NO: 74134 - DNA, 25 bp, Homo sapien
actaaagtgggctctaagatctaag

SEQ ID NO: 74135 - DNA, 25 bp, Homo sapien
gtgggctctaagatctaagatggcc

SEQ ID NO: 74136 - DNA, 25 bp, Homo sapien
ggctctaagatctaagatggcccgg

SEQ ID NO: 74137 - DNA, 25 bp, Homo sapien
tctaagatctaagatggcccggcgc

SEQ ID NO: 74138 - DNA, 25 bp, Homo sapien
taagatctaagatggcccggcgcgg

SEQ ID NO: 74139 - DNA, 25 bp, Homo sapien
aagatctaagatggcccggcgcggt

SEQ ID NO: 74140 - DNA, 25 bp, Homo sapien
gggagtttgagtccccgtctctact

SEQ ID NO: 74141 - DNA, 25 bp, Homo sapien
taataattacattgagctgcacctc

SEQ ID NO: 74142 - DNA, 25 bp, Homo sapien
tacattgagctgcacctcagtggtg

SEQ ID NO: 74143 - DNA, 25 bp, Homo sapien
gctgcacctcagtggtgtgtcatta

SEQ ID NO: 74144 - DNA, 25 bp, Homo sapien
gtggtgtgtcattaacatgcagtgg

SEQ ID NO: 74145 - DNA, 25 bp, Homo sapien
gggttaatatctgaggcctcagatg

SEQ ID NO: 74146 - DNA, 25 bp, Homo sapien
gcctcagatgactttgtgccttttg

SEQ ID NO: 74147 - DNA, 25 bp, Homo sapien
aagagctgtatcgtgaattgtcata

SEQ ID NO: 74148 - DNA, 25 bp, Homo sapien
gaattgtcatactaattattgaggg

SEQ ID NO: 74149 - DNA, 25 bp, Homo sapien
gggacttatgtgcttttattgaatg

SEQ ID NO: 74150 - DNA, 25 bp, Homo sapien
gaatggagtgctttacaatttttat

SEQ ID NO: 74151 - DNA, 25 bp, Homo sapien
gggttgggatccttggaatatttca

SEQ ID NO: 74152 - DNA, 25 bp, Homo sapien
caacattggtgtccctgtccccaga

SEQ ID NO: 74153 - DNA, 25 bp, Homo sapien
gaaggaggtatgaatcccagtcccc

SEQ ID NO: 74154 - DNA, 25 bp, Homo sapien
aggaggtatgaatcccagtccccag

SEQ ID NO: 74155 - DNA, 25 bp, Homo sapien
aggtatgaatcccagtccccaggaa

SEQ ID NO: 74156 - DNA, 25 bp, Homo sapien
atgaatcccagtccccaggaaccta

SEQ ID NO: 74157 - DNA, 25 bp, Homo sapien
cagtccccaggaacctagctcttta

SEQ ID NO: 74158 - DNA, 25 bp, Homo sapien
ggaacctagctctttaaactctggg

SEQ ID NO: 74159 - DNA, 25 bp, Homo sapien
aactctggggagtcggattcaggaa

SEQ ID NO: 74160 - DNA, 25 bp, Homo sapien
gattcaggaaacacccccaggaggc

SEQ ID NO: 74161 - DNA, 25 bp, Homo sapien
acagccctggtttcctgtcactcag

SEQ ID NO: 74162 - DNA, 25 bp, Homo sapien
tcctgtcactcagagctgattcaca

SEQ ID NO: 74163 - DNA, 25 bp, Homo sapien
gtaggaaagtgccacaattgtcaca

SEQ ID NO: 74164 - DNA, 25 bp, Homo sapien
agtgccacaattgtcacatgaccgg

SEQ ID NO: 74165 - DNA, 25 bp, Homo sapien
ccacaattgtcacatgaccggtact

SEQ ID NO: 74166 - DNA, 25 bp, Homo sapien
tccaacatcacccagtggatggaac

SEQ ID NO: 74167 - DNA, 25 bp, Homo sapien
catcacccagtggatggaacatcct

SEQ ID NO: 74168 - DNA, 25 bp, Homo sapien
tggatggaacatcctgtaacttttc

SEQ ID NO: 74169 - DNA, 25 bp, Homo sapien
ctgtaacttttcactgcacttggca

SEQ ID NO: 74170 - DNA, 25 bp, Homo sapien
gtaacttttcactgcacttggcatt

SEQ ID NO: 74171 - DNA, 25 bp, Homo sapien
aacttttcactgcacttggcattat

SEQ ID NO: 74172 - DNA, 25 bp, Homo sapien
ttcactgcacttggcattattttta

SEQ ID NO: 74173 - DNA, 25 bp, Homo sapien
tgcacttggcattatttttataagc

SEQ ID NO: 74174 - DNA, 25 bp, Homo sapien
gagagctaaacctcttccactagaa

SEQ ID NO: 74175 - DNA, 25 bp, Homo sapien
cactagaagattctcaactggagcc

SEQ ID NO: 74176 - DNA, 25 bp, Homo sapien
agccttcagactcagtggttgtttc

SEQ ID NO: 74177 - DNA, 25 bp, Homo sapien
gactcagtggttgtttcagaggact

SEQ ID NO: 74178 - DNA, 25 bp, Homo sapien
agatttcctcctacctaatggccta

SEQ ID NO: 74179 - DNA, 25 bp, Homo sapien
aatggcctactgacctcccctagag

SEQ ID NO: 74180 - DNA, 25 bp, Homo sapien
acctcccctagagggatgtctttgg

SEQ ID NO: 74181 - DNA, 25 bp, Homo sapien
gagaagggcctctctagcagtcaac

SEQ ID NO: 74182 - DNA, 25 bp, Homo sapien
tctctagcagtcaactccatttgta

SEQ ID NO: 74183 - DNA, 25 bp, Homo sapien
aactccatttgtaataaagccctag

SEQ ID NO: 74184 - DNA, 25 bp, Homo sapien
gtaataaagccctagcactctgaaa

SEQ ID NO: 74185 - DNA, 25 bp, Homo sapien
ggagctcctacatctatggctatgt

SEQ ID NO: 74186 - DNA, 25 bp, Homo sapien
acctaccgggaaggcatgaccaagg

SEQ ID NO: 74187 - DNA, 25 bp, Homo sapien
catgaccaaggaagagtgtctgcaa

SEQ ID NO: 74188 - DNA, 25 bp, Homo sapien
gtgtctgcaattcactgccaatgct

SEQ ID NO: 74189 - DNA, 25 bp, Homo sapien
caatgctctcgctttggccatggag

SEQ ID NO: 74190 - DNA, 25 bp, Homo sapien
gctccagtggaggagtgatccgcct

SEQ ID NO: 74191 - DNA, 25 bp, Homo sapien
agcggcaagtacttttgggagacca

SEQ ID NO: 74192 - DNA, 25 bp, Homo sapien
ggagaccagatacccaaattcgccg

SEQ ID NO: 74193 - DNA, 25 bp, Homo sapien
caaattcgccgttgccactttacca

SEQ ID NO: 74194 - DNA, 25 bp, Homo sapien
ttaccacccgcctgaatcctgggat

SEQ ID NO: 74195 - DNA, 25 bp, Homo sapien
aatcctgggattctagtatgcaata

SEQ ID NO: 74196 - DNA, 25 bp, Homo sapien
atgtattaaaatcttccctgctgta

SEQ ID NO: 74197 - DNA, 25 bp, Homo sapien
aatcttccctgctgtaataaaaaat

SEQ ID NO: 74198 - DNA, 25 bp, Homo sapien
aacatcgatttggtccatgatattg

SEQ ID NO: 74199 - DNA, 25 bp, Homo sapien
gtccatgatattgtgacctctaaaa

SEQ ID NO: 74200 - DNA, 25 bp, Homo sapien
gtgacctctaaaagatgtatctgta

SEQ ID NO: 74201 - DNA, 25 bp, Homo sapien
atgtttattaatgcctgacctccca

SEQ ID NO: 74202 - DNA, 25 bp, Homo sapien
gacctcccaccttgatgtttttgga

SEQ ID NO: 74203 - DNA, 25 bp, Homo sapien
tcccaccttgatgtttttggacagg

SEQ ID NO: 74204 - DNA, 25 bp, Homo sapien
gtgcagtatcttactttcaaagcat

SEQ ID NO: 74205 - DNA, 25 bp, Homo sapien
tcaaagcattgaaaacgatcgtttt

SEQ ID NO: 74206 - DNA, 25 bp, Homo sapien
cgatcgtttttacctgtataaatat

SEQ ID NO: 74207 - DNA, 25 bp, Homo sapien
atgtttctttgatcatgaataactg

SEQ ID NO: 74208 - DNA, 25 bp, Homo sapien
ataactgattagtaagtcttgccta

SEQ ID NO: 74209 - DNA, 25 bp, Homo sapien
gtaagtcttgcctatattttcctga

SEQ ID NO: 74210 - DNA, 25 bp, Homo sapien
gtcttgcctatattttcctgatagc

SEQ ID NO: 74211 - DNA, 25 bp, Homo sapien
tattttcctgatagcatatgacaaa

SEQ ID NO: 74212 - DNA, 25 bp, Homo sapien
agcatatgacaaatgtttctaaggt

SEQ ID NO: 74213 - DNA, 25 bp, Homo sapien
gtattcatatttgtactttctgtta

SEQ ID NO: 74214 - DNA, 25 bp, Homo sapien
gtactttctgttaaaatgcatgatt

SEQ ID NO: 74215 - DNA, 25 bp, Homo sapien
gcatgattgcagaattgtttagatt

SEQ ID NO: 74216 - DNA, 25 bp, Homo sapien
gtgtttattcttgatgaaaagcttt

SEQ ID NO: 74217 - DNA, 25 bp, Homo sapien
aagtttgcactcaaatcttaagaaa

SEQ ID NO: 74218 - DNA, 25 bp, Homo sapien
attgtttaggccgggagcgatggct

SEQ ID NO: 74219 - DNA, 25 bp, Homo sapien
ttgtttaggccgggagcgatggctg

SEQ ID NO: 74220 - DNA, 25 bp, Homo sapien
tgtttaggccgggagcgatggctgt

SEQ ID NO: 74221 - DNA, 25 bp, Homo sapien
gtttaggccgggagcgatggctgta

SEQ ID NO: 74222 - DNA, 25 bp, Homo sapien
tttaggccgggagcgatggctgtaa

SEQ ID NO: 74223 - DNA, 25 bp, Homo sapien
ttaggccgggagcgatggctgtaat

SEQ ID NO: 74224 - DNA, 25 bp, Homo sapien
taggccgggagcgatggctgtaatc

SEQ ID NO: 74225 - DNA, 25 bp, Homo sapien
aggccgggagcgatggctgtaatcc

SEQ ID NO: 74226 - DNA, 25 bp, Homo sapien
ggccgggagcgatggctgtaatccc

SEQ ID NO: 74227 - DNA, 25 bp, Homo sapien
gccgggagcgatggctgtaatccca

SEQ ID NO: 74228 - DNA, 25 bp, Homo sapien
gctggtgttggatgtcaatgatgat

SEQ ID NO: 74229 - DNA, 25 bp, Homo sapien
gatgatttttctgaggaagtaacca

SEQ ID NO: 74230 - DNA, 25 bp, Homo sapien
ggtaaacacctttgtaaagaatctg

SEQ ID NO: 74231 - DNA, 25 bp, Homo sapien
aaagaatctgtaaccaataccatga

SEQ ID NO: 74232 - DNA, 25 bp, Homo sapien
aggctgtgatctgggctccctgact

SEQ ID NO: 74233 - DNA, 25 bp, Homo sapien
tccctgactttctgaagctagaaaa

SEQ ID NO: 74234 - DNA, 25 bp, Homo sapien
gaaaaatgttgtgtctcccaaccac

SEQ ID NO: 74235 - DNA, 25 bp, Homo sapien
cctggagcactctgccgctcaagag

SEQ ID NO: 74236 - DNA, 25 bp, Homo sapien
gccgctcaagagctggtttgttaat

SEQ ID NO: 74237 - DNA, 25 bp, Homo sapien
aattattgttagactttgccattgt

SEQ ID NO: 74238 - DNA, 25 bp, Homo sapien
tgttttcttttgtacctgaagcatt

SEQ ID NO: 74239 - DNA, 25 bp, Homo sapien
gaacgccgcatgtttgtttctaatg

SEQ ID NO: 74240 - DNA, 25 bp, Homo sapien
gaattacggacaccgttgacctctg

SEQ ID NO: 74241 - DNA, 25 bp, Homo sapien
tgacctctgtgcgttcttatgttga

SEQ ID NO: 74242 - DNA, 25 bp, Homo sapien
gttcttatgttgatgcgttggctga

SEQ ID NO: 74243 - DNA, 25 bp, Homo sapien
gggcgattaatgacccagaaatggc

SEQ ID NO: 74244 - DNA, 25 bp, Homo sapien
actttttgggcgtggttcaggatga

SEQ ID NO: 74245 - DNA, 25 bp, Homo sapien
gaaacgcaacgtatgattcggatga

SEQ ID NO: 74246 - DNA, 25 bp, Homo sapien
taacgacctgttggagttatcccgt

SEQ ID NO: 74247 - DNA, 25 bp, Homo sapien
ggagttatcccgtttggatcaaggg

SEQ ID NO: 74248 - DNA, 25 bp, Homo sapien
aggtggtgaacctcaatagtctgtt

SEQ ID NO: 74249 - DNA, 25 bp, Homo sapien
aatagtctgttcaattttgtcttaa

SEQ ID NO: 74250 - DNA, 25 bp, Homo sapien
gaaaaatccaactctcatcctgggc

SEQ ID NO: 74251 - DNA, 25 bp, Homo sapien
aactctcatcctgggcagaggttgc

SEQ ID NO: 74252 - DNA, 25 bp, Homo sapien
cagaggttgcctagttggtatagaa

SEQ ID NO: 74253 - DNA, 25 bp, Homo sapien
gtttacctttgctttaggtcataag

SEQ ID NO: 74254 - DNA, 25 bp, Homo sapien
ggtcataagttccttatttgattgc

SEQ ID NO: 74255 - DNA, 25 bp, Homo sapien
atatggatacatggctgttcgtgac

SEQ ID NO: 74256 - DNA, 25 bp, Homo sapien
acatggctgttcgtgacattcttta

SEQ ID NO: 74257 - DNA, 25 bp, Homo sapien
acattctttatgtgcaaatttgtga

SEQ ID NO: 74258 - DNA, 25 bp, Homo sapien
gggtacattgtagagccgaactttg

SEQ ID NO: 74259 - DNA, 25 bp, Homo sapien
gagccgaactttgagttactgtgca

SEQ ID NO: 74260 - DNA, 25 bp, Homo sapien
tgtaatatgttttgtgagaatcctt

SEQ ID NO: 74261 - DNA, 25 bp, Homo sapien
ggcttccgcgctttctctggatctg

SEQ ID NO: 74262 - DNA, 25 bp, Homo sapien
cgcgctttctctggatctggcaata

SEQ ID NO: 74263 - DNA, 25 bp, Homo sapien
gcgctttctctggatctggcaatag

SEQ ID NO: 74264 - DNA, 25 bp, Homo sapien
gctttctctggatctggcaatagac

SEQ ID NO: 74265 - DNA, 25 bp, Homo sapien
ttctctggatctggcaatagactgg

SEQ ID NO: 74266 - DNA, 25 bp, Homo sapien
ctccccaatcaagcctggagatatt

SEQ ID NO: 74267 - DNA, 25 bp, Homo sapien
gagatattaaaagaggaattcccaa

SEQ ID NO: 74268 - DNA, 25 bp, Homo sapien
aagaggaattcccaattatgaattt

SEQ ID NO: 74269 - DNA, 25 bp, Homo sapien
aacttggtaagataactttcatcag

SEQ ID NO: 74270 - DNA, 25 bp, Homo sapien
aactttcatcagaaattcacgtccc

SEQ ID NO: 74271 - DNA, 25 bp, Homo sapien
tcacgtccccttgtcaaaaaggttg

SEQ ID NO: 74272 - DNA, 25 bp, Homo sapien
attacaaggccacagaacccgtcat

SEQ ID NO: 74273 - DNA, 25 bp, Homo sapien
ccgtcatcgccttctatgagaaacg

SEQ ID NO: 74274 - DNA, 25 bp, Homo sapien
aacgtggcattgtgcgcaaggtcaa

SEQ ID NO: 74275 - DNA, 25 bp, Homo sapien
caaggtcaacgctgagggctccgtg

SEQ ID NO: 74276 - DNA, 25 bp, Homo sapien
gagggctccgtggacagtgtcttct

SEQ ID NO: 74277 - DNA, 25 bp, Homo sapien
acctggacgccctaaagtagcaacg

SEQ ID NO: 74278 - DNA, 25 bp, Homo sapien
aaagtagcaacgctggagccgcttc

SEQ ID NO: 74279 - DNA, 25 bp, Homo sapien
ccgtcctgattagaggtcctcctgg

SEQ ID NO: 74280 - DNA, 25 bp, Homo sapien
gagcacagacggaggaagccgctta

SEQ ID NO: 74281 - DNA, 25 bp, Homo sapien
aagccgcttatcctgttttcatgga

SEQ ID NO: 74282 - DNA, 25 bp, Homo sapien
ttcatggacagctgagcactaaagg

SEQ ID NO: 74283 - DNA, 25 bp, Homo sapien
agacgatgcagatccactctgggct

SEQ ID NO: 74284 - DNA, 25 bp, Homo sapien
ctgctctttcctgggctgacgtaaa

SEQ ID NO: 74285 - DNA, 25 bp, Homo sapien
ggctgacgtaaagcgttctgctcat

SEQ ID NO: 74286 - DNA, 25 bp, Homo sapien
aaagcgttctgctcatttatagatg

SEQ ID NO: 74287 - DNA, 25 bp, Homo sapien
ttatagatgagagtcgtgccgtgca

SEQ ID NO: 74288 - DNA, 25 bp, Homo sapien
gtgccgtgcagaacccagcatgtca

SEQ ID NO: 74289 - DNA, 25 bp, Homo sapien
agcatgtcacccgtggtgctgctgc

SEQ ID NO: 74290 - DNA, 25 bp, Homo sapien
ggtgctgctgccatgcggcgcttct

SEQ ID NO: 74291 - DNA, 25 bp, Homo sapien
ggtttttgcatgaggccccttgaca

SEQ ID NO: 74292 - DNA, 25 bp, Homo sapien
aggccccttgacagggctgctctgg

SEQ ID NO: 74293 - DNA, 25 bp, Homo sapien
tggtcactttgggtgtgtacagtaa

SEQ ID NO: 74294 - DNA, 25 bp, Homo sapien
gactgcaagtggagccctactaccc

SEQ ID NO: 74295 - DNA, 25 bp, Homo sapien
tacccccgaagtctgcaggactggg

SEQ ID NO: 74296 - DNA, 25 bp, Homo sapien
tccctgaggaggtcagcggcgccct

SEQ ID NO: 74297 - DNA, 25 bp, Homo sapien
tgccgaggcccgatggctccatcat

SEQ ID NO: 74298 - DNA, 25 bp, Homo sapien
atcttcttccgagatgaccgctact

SEQ ID NO: 74299 - DNA, 25 bp, Homo sapien
gagatgaccgctactggcgcctcga

SEQ ID NO: 74300 - DNA, 25 bp, Homo sapien
gctgggccaccgagctgccctggat

SEQ ID NO: 74301 - DNA, 25 bp, Homo sapien
ggagcgccctgttctgaaggcacct

SEQ ID NO: 74302 - DNA, 25 bp, Homo sapien
acctcctcacctcagaaactggtgg

SEQ ID NO: 74303 - DNA, 25 bp, Homo sapien
acctcagaaactggtggtgctctca

SEQ ID NO: 74304 - DNA, 25 bp, Homo sapien
cagaaactggtggtgctctcagggc

SEQ ID NO: 74305 - DNA, 25 bp, Homo sapien
ctggactgtgactgcgcctggattc

SEQ ID NO: 74306 - DNA, 25 bp, Homo sapien
ctgtgactgcgcctggattctgcca

SEQ ID NO: 74307 - DNA, 25 bp, Homo sapien
ctgccattgcgacacttagcgacgc

SEQ ID NO: 74308 - DNA, 25 bp, Homo sapien
gccattgcgacacttagcgacgcca

SEQ ID NO: 74309 - DNA, 25 bp, Homo sapien
ttagcgacgccactggcggcacctt

SEQ ID NO: 74310 - DNA, 25 bp, Homo sapien
tgcgcccagtgatgtttccacggtg

SEQ ID NO: 74311 - DNA, 25 bp, Homo sapien
tttccacggtgcctgtacacagccg

SEQ ID NO: 74312 - DNA, 25 bp, Homo sapien
acggtgcctgtacacagccgagcag

SEQ ID NO: 74313 - DNA, 25 bp, Homo sapien
cacagccgagcagcatttccgttga

SEQ ID NO: 74314 - DNA, 25 bp, Homo sapien
gttgaaggacttgcatccccattgc

SEQ ID NO: 74315 - DNA, 25 bp, Homo sapien
ggttttctccgcaggttgaacatgg

SEQ ID NO: 74316 - DNA, 25 bp, Homo sapien
gggcgccggtgctagtggaacgccg

SEQ ID NO: 74317 - DNA, 25 bp, Homo sapien
agtggcggctggtatcccgcggcgg

SEQ ID NO: 74318 - DNA, 25 bp, Homo sapien
tatcccgcggcggctctggaagctg

SEQ ID NO: 74319 - DNA, 25 bp, Homo sapien
gctctggaagctggacgcggaccac

SEQ ID NO: 74320 - DNA, 25 bp, Homo sapien
accacggcccgggagctagaaactg

SEQ ID NO: 74321 - DNA, 25 bp, Homo sapien
cacggcccgggagctagaaactgaa

SEQ ID NO: 74322 - DNA, 25 bp, Homo sapien
ggcccgggagctagaaactgaacgc

SEQ ID NO: 74323 - DNA, 25 bp, Homo sapien
gagctagaaactgaacgcccgcata

SEQ ID NO: 74324 - DNA, 25 bp, Homo sapien
gctagaaactgaacgcccgcataat

SEQ ID NO: 74325 - DNA, 25 bp, Homo sapien
actgaacgcccgcataataaagact

SEQ ID NO: 74326 - DNA, 25 bp, Homo sapien
gaacgcccgcataataaagactgga

SEQ ID NO: 74327 - DNA, 25 bp, Homo sapien
atttatgctgtctgaaggtcacgat

SEQ ID NO: 74328 - DNA, 25 bp, Homo sapien
tatgctgtctgaaggtcacgatcat

SEQ ID NO: 74329 - DNA, 25 bp, Homo sapien
gctgtctgaaggtcacgatcatgtt

SEQ ID NO: 74330 - DNA, 25 bp, Homo sapien
gaaggtcacgatcatgttaccatat

SEQ ID NO: 74331 - DNA, 25 bp, Homo sapien
accactatctggagatttcgacgtg

SEQ ID NO: 74332 - DNA, 25 bp, Homo sapien
ctatctggagatttcgacgtgtttt

SEQ ID NO: 74333 - DNA, 25 bp, Homo sapien
tggagatttcgacgtgttttcctct

SEQ ID NO: 74334 - DNA, 25 bp, Homo sapien
agatttcgacgtgttttcctctctg

SEQ ID NO: 74335 - DNA, 25 bp, Homo sapien
tttcgacgtgttttcctctctgaat

SEQ ID NO: 74336 - DNA, 25 bp, Homo sapien
ctgttatgaacacgttggttggctg

SEQ ID NO: 74337 - DNA, 25 bp, Homo sapien
tgaacacgttggttggctggattca

SEQ ID NO: 74338 - DNA, 25 bp, Homo sapien
ctggactgtgactgcgcctggattc

SEQ ID NO: 74339 - DNA, 25 bp, Homo sapien
tggactgtgactgcgcctggattct

SEQ ID NO: 74340 - DNA, 25 bp, Homo sapien
ctgtgactgcgcctggattctgcca

SEQ ID NO: 74341 - DNA, 25 bp, Homo sapien
tttccacggtgcctgtacacagccg

SEQ ID NO: 74342 - DNA, 25 bp, Homo sapien
ttccacggtgcctgtacacagccga

SEQ ID NO: 74343 - DNA, 25 bp, Homo sapien
tccacggtgcctgtacacagccgag

SEQ ID NO: 74344 - DNA, 25 bp, Homo sapien
cacggtgcctgtacacagccgagca

SEQ ID NO: 74345 - DNA, 25 bp, Homo sapien
acggtgcctgtacacagccgagcag

SEQ ID NO: 74346 - DNA, 25 bp, Homo sapien
acagacctggtctagggctgacaaa

SEQ ID NO: 74347 - DNA, 25 bp, Homo sapien
tctagggctgacaaagacagggaca

SEQ ID NO: 74348 - DNA, 25 bp, Homo sapien
caaagacagggacagcctttgtttt

SEQ ID NO: 74349 - DNA, 25 bp, Homo sapien
tccctgcaatgtccttgccaaatga

SEQ ID NO: 74350 - DNA, 25 bp, Homo sapien
aatgtccttgccaaatgactgcctc

SEQ ID NO: 74351 - DNA, 25 bp, Homo sapien
cggaacgaggtagtggccatctcat

SEQ ID NO: 74352 - DNA, 25 bp, Homo sapien
gaggtagtggccatctcatacctac

SEQ ID NO: 74353 - DNA, 25 bp, Homo sapien
gccatctcatacctactctgaaatg

SEQ ID NO: 74354 - DNA, 25 bp, Homo sapien
atctcatacctactctgaaatgcaa

SEQ ID NO: 74355 - DNA, 25 bp, Homo sapien
gaaatgcaaaacttctattctgttg

SEQ ID NO: 74356 - DNA, 25 bp, Homo sapien
gcaaaacttctattctgttgagtga

SEQ ID NO: 74357 - DNA, 25 bp, Homo sapien
acagcagttcactttattgtgagtc

SEQ ID NO: 74358 - DNA, 25 bp, Homo sapien
ctttattgtgagtctttgccacatt

SEQ ID NO: 74359 - DNA, 25 bp, Homo sapien
ctgaattgagctgtcatttgtacat

SEQ ID NO: 74360 - DNA, 25 bp, Homo sapien
atacaagcacaacagggcttgcact

SEQ ID NO: 74361 - DNA, 25 bp, Homo sapien
gcacaacagggcttgcactaaagaa

SEQ ID NO: 74362 - DNA, 25 bp, Homo sapien
agggcttgcactaaagaattgtcat

SEQ ID NO: 74363 - DNA, 25 bp, Homo sapien
gtaataacactacttggtagcctaa

SEQ ID NO: 74364 - DNA, 25 bp, Homo sapien
cactacttggtagcctaacttcata

SEQ ID NO: 74365 - DNA, 25 bp, Homo sapien
ggtagcctaacttcatatatgtatt

SEQ ID NO: 74366 - DNA, 25 bp, Homo sapien
catatatgtattcttaattgcacaa

SEQ ID NO: 74367 - DNA, 25 bp, Homo sapien
aaagtcaataatttgtcaccttggg

SEQ ID NO: 74368 - DNA, 25 bp, Homo sapien
aattaattcctatcccgtgagtgga

SEQ ID NO: 74369 - DNA, 25 bp, Homo sapien
ttcctatcccgtgagtggattgtga

SEQ ID NO: 74370 - DNA, 25 bp, Homo sapien
gattgtgagaaattccacccacgtg

SEQ ID NO: 74371 - DNA, 25 bp, Homo sapien
acccacgtggagacagcttactgca

SEQ ID NO: 74372 - DNA, 25 bp, Homo sapien
cagcttactgcagcactgttggtgt

SEQ ID NO: 74373 - DNA, 25 bp, Homo sapien
gcactgttggtgttcggagctcttc

SEQ ID NO: 74374 - DNA, 25 bp, Homo sapien
ttggtgttcggagctcttctgtgcc

SEQ ID NO: 74375 - DNA, 25 bp, Homo sapien
ttcggagctcttctgtgccctggct

SEQ ID NO: 74376 - DNA, 25 bp, Homo sapien
ggagcgtgtggctgtgccccttctc

SEQ ID NO: 74377 - DNA, 25 bp, Homo sapien
ttattaaacatgctcagtacctgtg

SEQ ID NO: 74378 - DNA, 25 bp, Homo sapien
ttaaacatgctcagtacctgtgttg

SEQ ID NO: 74379 - DNA, 25 bp, Homo sapien
atcaggtggcctggctgtttctttg

SEQ ID NO: 74380 - DNA, 25 bp, Homo sapien
tggctgtttctttggatccctctgt

SEQ ID NO: 74381 - DNA, 25 bp, Homo sapien
gaaaacacccagaaaggccttaatg

SEQ ID NO: 74382 - DNA, 25 bp, Homo sapien
agaaaggccttaatgacctcatagg

SEQ ID NO: 74383 - DNA, 25 bp, Homo sapien
acctcataggcactcttccaaaaag

SEQ ID NO: 74384 - DNA, 25 bp, Homo sapien
gaatgagaggcctgggtctgtctcc

SEQ ID NO: 74385 - DNA, 25 bp, Homo sapien
tgggtctgtctcctgccttagcagg

SEQ ID NO: 74386 - DNA, 25 bp, Homo sapien
gccttagcaggcctatcaatttctt

SEQ ID NO: 74387 - DNA, 25 bp, Homo sapien
ttttttccttgctcacattaaaagg

SEQ ID NO: 74388 - DNA, 25 bp, Homo sapien
ggagttctaatgctcccataaacta

SEQ ID NO: 74389 - DNA, 25 bp, Homo sapien
ttggcaagacacttcactactccag

SEQ ID NO: 74390 - DNA, 25 bp, Homo sapien
aggcctgtgtatggagcctcgagat

SEQ ID NO: 74391 - DNA, 25 bp, Homo sapien
tatggagcctcgagatgcgccacct

SEQ ID NO: 74392 - DNA, 25 bp, Homo sapien
tcccagaaagccagcatctaacctg

SEQ ID NO: 74393 - DNA, 25 bp, Homo sapien
agcatctaacctggtggccgtccta

SEQ ID NO: 74394 - DNA, 25 bp, Homo sapien
tggccgtcctactgggactgctggt

SEQ ID NO: 74395 - DNA, 25 bp, Homo sapien
tggtggtcgtactactggccgtgac

SEQ ID NO: 74396 - DNA, 25 bp, Homo sapien
tggccgtgaccagagagtgcattta

SEQ ID NO: 74397 - DNA, 25 bp, Homo sapien
agtgcatttacagaacgaggaggaa

SEQ ID NO: 74398 - DNA, 25 bp, Homo sapien
acagatactgttctggactgtgcct

SEQ ID NO: 74399 - DNA, 25 bp, Homo sapien
tggactgtgcctgttaagttgctca

SEQ ID NO: 74400 - DNA, 25 bp, Homo sapien
ctcagttttgagctgtcttcagaca

SEQ ID NO: 74401 - DNA, 25 bp, Homo sapien
gataagtatgctgaagtgccccaat

SEQ ID NO: 74402 - DNA, 25 bp, Homo sapien
tgaagtgccccaattctgcaacatc

SEQ ID NO: 74403 - DNA, 25 bp, Homo sapien
aattctgcaacatctctgtcccagg

SEQ ID NO: 74404 - DNA, 25 bp, Homo sapien
gaattccttacaccctgagccaaac

SEQ ID NO: 74405 - DNA, 25 bp, Homo sapien
agccaaacccgggatgtctttgact

SEQ ID NO: 74406 - DNA, 25 bp, Homo sapien
gatgtctttgactgcactgctgaaa

SEQ ID NO: 74407 - DNA, 25 bp, Homo sapien
gactgcactgctgaaaatactctgt

SEQ ID NO: 74408 - DNA, 25 bp, Homo sapien
agcactctgtggttaacttccttaa

SEQ ID NO: 74409 - DNA, 25 bp, Homo sapien
taaatgcatgcctggatccgttcat

SEQ ID NO: 74410 - DNA, 25 bp, Homo sapien
tggatccgttcatctattttttcct

SEQ ID NO: 74411 - DNA, 25 bp, Homo sapien
ttcctttgcaagtccttcagaaatt

SEQ ID NO: 74412 - DNA, 25 bp, Homo sapien
aatcagaagctaaagtaaagttcct

SEQ ID NO: 74413 - DNA, 25 bp, Homo sapien
tcctttcctggtgctaactgtggtc

SEQ ID NO: 74414 - DNA, 25 bp, Homo sapien
gctaactgtggtcttcttgacacat

SEQ ID NO: 74415 - DNA, 25 bp, Homo sapien
gtggtcttcttgacacattaagatg

SEQ ID NO: 74416 - DNA, 25 bp, Homo sapien
tctaccattggaactagccagatgg

SEQ ID NO: 74417 - DNA, 25 bp, Homo sapien
tagccagatggccattattttgtat

SEQ ID NO: 74418 - DNA, 25 bp, Homo sapien
ccagatggccattattttgtatttt

SEQ ID NO: 74419 - DNA, 25 bp, Homo sapien
gaaatgaatctatatgttctgtata

SEQ ID NO: 74420 - DNA, 25 bp, Homo sapien
tatatgaatgactatcttgtttttg

SEQ ID NO: 74421 - DNA, 25 bp, Homo sapien
tttgctacttcttttgactgcttaa

SEQ ID NO: 74422 - DNA, 25 bp, Homo sapien
tacttcttttgactgcttaatttta

SEQ ID NO: 74423 - DNA, 25 bp, Homo sapien
tgtggacaactcgaataagtttgac

SEQ ID NO: 74424 - DNA, 25 bp, Homo sapien
tggacaactcgaataagtttgactt

SEQ ID NO: 74425 - DNA, 25 bp, Homo sapien
gacaactcgaataagtttgacttgt

SEQ ID NO: 74426 - DNA, 25 bp, Homo sapien
caactcgaataagtttgacttgtgt

SEQ ID NO: 74427 - DNA, 25 bp, Homo sapien
actcgaataagtttgacttgtgttt

SEQ ID NO: 74428 - DNA, 25 bp, Homo sapien
taaccaccagatcattccttctgta

SEQ ID NO: 74429 - DNA, 25 bp, Homo sapien
aaccaccagatcattccttctgtag

SEQ ID NO: 74430 - DNA, 25 bp, Homo sapien
accaccagatcattccttctgtagc

SEQ ID NO: 74431 - DNA, 25 bp, Homo sapien
ccaccagatcattccttctgtagct

SEQ ID NO: 74432 - DNA, 25 bp, Homo sapien
caccagatcattccttctgtagctc

SEQ ID NO: 74433 - DNA, 25 bp, Homo sapien
accagatcattccttctgtagctca

SEQ ID NO: 74434 - DNA, 25 bp, Homo sapien
tcaactgcactgtccttttctgctg

SEQ ID NO: 74435 - DNA, 25 bp, Homo sapien
ttttctgctgtctagtctgtgctaa

SEQ ID NO: 74436 - DNA, 25 bp, Homo sapien
tagtctgtgctaagggacactactt

SEQ ID NO: 74437 - DNA, 25 bp, Homo sapien
gggacactacttgtacacttttcaa

SEQ ID NO: 74438 - DNA, 25 bp, Homo sapien
tgtacacttttcaaacggtgcccta

SEQ ID NO: 74439 - DNA, 25 bp, Homo sapien
caaacggtgccctaaattggaagag

SEQ ID NO: 74440 - DNA, 25 bp, Homo sapien
accactcctgctctagacttcttgt

SEQ ID NO: 74441 - DNA, 25 bp, Homo sapien
gacttcttgtcttgcatctttgata

SEQ ID NO: 74442 - DNA, 25 bp, Homo sapien
gtcttgcatctttgataacttggag

SEQ ID NO: 74443 - DNA, 25 bp, Homo sapien
gataacttggagtcataaccgagtg

SEQ ID NO: 74444 - DNA, 25 bp, Homo sapien
gtcataaccgagtggatgtcggaat

SEQ ID NO: 74445 - DNA, 25 bp, Homo sapien
gaacaagtgagcctacccggtcatc

SEQ ID NO: 74446 - DNA, 25 bp, Homo sapien
aacaagtgagcctacccggtcatct

SEQ ID NO: 74447 - DNA, 25 bp, Homo sapien
acaagtgagcctacccggtcatctc

SEQ ID NO: 74448 - DNA, 25 bp, Homo sapien
caagtgagcctacccggtcatctct

SEQ ID NO: 74449 - DNA, 25 bp, Homo sapien
gagcctacccggtcatctctgttca

SEQ ID NO: 74450 - DNA, 25 bp, Homo sapien
cggtcatctctgttcacccacctca

SEQ ID NO: 74451 - DNA, 25 bp, Homo sapien
actccagttttacatccctttattg

SEQ ID NO: 74452 - DNA, 25 bp, Homo sapien
ctccagttttacatccctttattgc

SEQ ID NO: 74453 - DNA, 25 bp, Homo sapien
tttacatccctttattgccattaac

SEQ ID NO: 74454 - DNA, 25 bp, Homo sapien
ttacatccctttattgccattaact

SEQ ID NO: 74455 - DNA, 25 bp, Homo sapien
tacatccctttattgccattaactc

SEQ ID NO: 74456 - DNA, 25 bp, Homo sapien
gctttcagttttcaacatcctctgc

SEQ ID NO: 74457 - DNA, 25 bp, Homo sapien
ttcagttttcaacatcctctgctca

SEQ ID NO: 74458 - DNA, 25 bp, Homo sapien
gtccctttgtctgtgtaagaacgat

SEQ ID NO: 74459 - DNA, 25 bp, Homo sapien
taatatgctctttcttatttagatt

SEQ ID NO: 74460 - DNA, 25 bp, Homo sapien
aataaaactggctgtttctcctttg

SEQ ID NO: 74461 - DNA, 25 bp, Homo sapien
tagcatttgatacagtgtctgtgat

SEQ ID NO: 74462 - DNA, 25 bp, Homo sapien
cagtgtctgtgatgtttggaagcaa

SEQ ID NO: 74463 - DNA, 25 bp, Homo sapien
aagcaaagcaatgttgtgtgtcctt

SEQ ID NO: 74464 - DNA, 25 bp, Homo sapien
tgtgtcctttttgtttgcgcttaaa

SEQ ID NO: 74465 - DNA, 25 bp, Homo sapien
gtttgcgcttaaatatcttttagaa

SEQ ID NO: 74466 - DNA, 25 bp, Homo sapien
tataagcacaagtggctgccagttt

SEQ ID NO: 74467 - DNA, 25 bp, Homo sapien
cggacctgccggacgtggacaagct

SEQ ID NO: 74468 - DNA, 25 bp, Homo sapien
acgtggacaagctgcggccctacta

SEQ ID NO: 74469 - DNA, 25 bp, Homo sapien
ggctcattgacaagtactgccctgg

SEQ ID NO: 74470 - DNA, 25 bp, Homo sapien
tcattgacaagtactgccctggcat

SEQ ID NO: 74471 - DNA, 25 bp, Homo sapien
attgacaagtactgccctggcatcc

SEQ ID NO: 74472 - DNA, 25 bp, Homo sapien
cctggcatcctgagctggtgaccct

SEQ ID NO: 74473 - DNA, 25 bp, Homo sapien
ggcatcctgagctggtgaccctcct

SEQ ID NO: 74474 - DNA, 25 bp, Homo sapien
tgctgctggacctaggcctggccct

SEQ ID NO: 74475 - DNA, 25 bp, Homo sapien
cgccatcagggttcacctcggtggg

SEQ ID NO: 74476 - DNA, 25 bp, Homo sapien
ttgtgcctggcgtcaataaagacct

SEQ ID NO: 74477 - DNA, 25 bp, Homo sapien
gcctggcgtcaataaagacctggaa

SEQ ID NO: 74478 - DNA, 25 bp, Homo sapien
attaaccccataaaagcagaagacg

SEQ ID NO: 74479 - DNA, 25 bp, Homo sapien
taaccccataaaagcagaagacgtg

SEQ ID NO: 74480 - DNA, 25 bp, Homo sapien
gaagacgtgggctaccggtcttcct

SEQ ID NO: 74481 - DNA, 25 bp, Homo sapien
agacgtgggctaccggtcttcctca

SEQ ID NO: 74482 - DNA, 25 bp, Homo sapien
ggtcttcctcaaggtcggacctgtc

SEQ ID NO: 74483 - DNA, 25 bp, Homo sapien
acacgtcacaaaaaacagctgaaga

SEQ ID NO: 74484 - DNA, 25 bp, Homo sapien
gaaatgctctgtagattgagttgct

SEQ ID NO: 74485 - DNA, 25 bp, Homo sapien
ctctgtagattgagttgctggagga

SEQ ID NO: 74486 - DNA, 25 bp, Homo sapien
tggaggagtgacagccaggagccct

SEQ ID NO: 74487 - DNA, 25 bp, Homo sapien
gagccctgacttcacttcctttggt

SEQ ID NO: 74488 - DNA, 25 bp, Homo sapien
gcatgtagttaagccacattttaaa

SEQ ID NO: 74489 - DNA, 25 bp, Homo sapien
ttgggagggtgctgtttcccgccaa

SEQ ID NO: 74490 - DNA, 25 bp, Homo sapien
gctgtttcccgccaaaggaactggg

SEQ ID NO: 74491 - DNA, 25 bp, Homo sapien
ttccctggtgcgagggtcgctagaa

SEQ ID NO: 74492 - DNA, 25 bp, Homo sapien
gtcgctagaaagctccggtggtcct

SEQ ID NO: 74493 - DNA, 25 bp, Homo sapien
ggtggtcctcggtgattcatttgca

SEQ ID NO: 74494 - DNA, 25 bp, Homo sapien
gattcatttgcaactcaactcagct

SEQ ID NO: 74495 - DNA, 25 bp, Homo sapien
tcaactcagctttggaactcctcag

SEQ ID NO: 74496 - DNA, 25 bp, Homo sapien
tcagccctgagtttggtctttagtc

SEQ ID NO: 74497 - DNA, 25 bp, Homo sapien
ttggtctttagtcgcctctgagaac

SEQ ID NO: 74498 - DNA, 25 bp, Homo sapien
gtcgcctctgagaactttaattcct

SEQ ID NO: 74499 - DNA, 25 bp, Homo sapien
attaataatacccatctccaggagc

SEQ ID NO: 74500 - DNA, 25 bp, Homo sapien
acagttgtgtgtgcatataaaatac

SEQ ID NO: 74501 - DNA, 25 bp, Homo sapien
cagttgtgtgtgcatataaaataca

SEQ ID NO: 74502 - DNA, 25 bp, Homo sapien
agttgtgtgtgcatataaaatacat

SEQ ID NO: 74503 - DNA, 25 bp, Homo sapien
taaaatacatatttacgccaggcgt

SEQ ID NO: 74504 - DNA, 25 bp, Homo sapien
aaaatacatatttacgccaggcgtg

SEQ ID NO: 74505 - DNA, 25 bp, Homo sapien
aaatacatatttacgccaggcgtgg

SEQ ID NO: 74506 - DNA, 25 bp, Homo sapien
aatacatatttacgccaggcgtggt

SEQ ID NO: 74507 - DNA, 25 bp, Homo sapien
atacatatttacgccaggcgtggtg

SEQ ID NO: 74508 - DNA, 25 bp, Homo sapien
tacatatttacgccaggcgtggtgg

SEQ ID NO: 74509 - DNA, 25 bp, Homo sapien
acatatttacgccaggcgtggtggc

SEQ ID NO: 74510 - DNA, 25 bp, Homo sapien
catatttacgccaggcgtggtggct

SEQ ID NO: 74511 - DNA, 25 bp, Homo sapien
gacaggtgggcccagtgaacttttc

SEQ ID NO: 74512 - DNA, 25 bp, Homo sapien
caggtgggcccagtgaacttttcca

SEQ ID NO: 74513 - DNA, 25 bp, Homo sapien
agcaagcactgaataaaaacctcct

SEQ ID NO: 74514 - DNA, 25 bp, Homo sapien
gaacaaagatctacaggcaagcaag

SEQ ID NO: 74515 - DNA, 25 bp, Homo sapien
ggcaagcaagatgcccacacaacag

SEQ ID NO: 74516 - DNA, 25 bp, Homo sapien
aagcaagatgcccacacaacaggct

SEQ ID NO: 74517 - DNA, 25 bp, Homo sapien
aacaggcttattttctgtgaaggaa

SEQ ID NO: 74518 - DNA, 25 bp, Homo sapien
tgaaggaaccaactgatctccccca

SEQ ID NO: 74519 - DNA, 25 bp, Homo sapien
atctcccccacccttggattagagt

SEQ ID NO: 74520 - DNA, 25 bp, Homo sapien
ggattagagttcctgctctacctta

SEQ ID NO: 74521 - DNA, 25 bp, Homo sapien
tagagttcctgctctaccttaccca

SEQ ID NO: 74522 - DNA, 25 bp, Homo sapien
aggagatcgtgcaggtgtccttgct

SEQ ID NO: 74523 - DNA, 25 bp, Homo sapien
caggtgtccttgctggtcatgacaa

SEQ ID NO: 74524 - DNA, 25 bp, Homo sapien
cttgctggtcatgacaaccgtgtga

SEQ ID NO: 74525 - DNA, 25 bp, Homo sapien
tgacaaccgtgtgagctgcttaggt

SEQ ID NO: 74526 - DNA, 25 bp, Homo sapien
gagctgcttaggtgtaactgatgat

SEQ ID NO: 74527 - DNA, 25 bp, Homo sapien
gtgtaactgatgatggcatggctgt

SEQ ID NO: 74528 - DNA, 25 bp, Homo sapien
ggagaaatcaatgctacagcctata

SEQ ID NO: 74529 - DNA, 25 bp, Homo sapien
ttctaccttatatttgcaggtgaag

SEQ ID NO: 74530 - DNA, 25 bp, Homo sapien
tgttggctggttacgatgactttaa

SEQ ID NO: 74531 - DNA, 25 bp, Homo sapien
aattgtaatgtatgggacacgctaa

SEQ ID NO: 74532 - DNA, 25 bp, Homo sapien
gtatgggacacgctaaaaggagatc

SEQ ID NO: 74533 - DNA, 25 bp, Homo sapien
tccaccatccggaccagaaatgctg

SEQ ID NO: 74534 - DNA, 25 bp, Homo sapien
gaaatgctgccagagctggcgccag

SEQ ID NO: 74535 - DNA, 25 bp, Homo sapien
accgttgacgaactgcagcgatctt

SEQ ID NO: 74536 - DNA, 25 bp, Homo sapien
gaactgcagcgatcttactggccaa

SEQ ID NO: 74537 - DNA, 25 bp, Homo sapien
aagccagagcgcctcctctcagatt

SEQ ID NO: 74538 - DNA, 25 bp, Homo sapien
tctcagattccttctcgacacagca

SEQ ID NO: 74539 - DNA, 25 bp, Homo sapien
aggcggcttcttcctgtcagtcgga

SEQ ID NO: 74540 - DNA, 25 bp, Homo sapien
cctgtcagtcggaggtggcatgcaa

SEQ ID NO: 74541 - DNA, 25 bp, Homo sapien
aagatgaagctctctttgctcttcc

SEQ ID NO: 74542 - DNA, 25 bp, Homo sapien
tcattttgtgcttttccttgtgttt

SEQ ID NO: 74543 - DNA, 25 bp, Homo sapien
tgtgttttcatgttttgggtatcag

SEQ ID NO: 74544 - DNA, 25 bp, Homo sapien
ggccgagggtcccaggtgaagactg

SEQ ID NO: 74545 - DNA, 25 bp, Homo sapien
ggtgaagactggagggaccccaaca

SEQ ID NO: 74546 - DNA, 25 bp, Homo sapien
aagactggagggaccccaacagcca

SEQ ID NO: 74547 - DNA, 25 bp, Homo sapien
aggacgctgaggctcccttgcctga

SEQ ID NO: 74548 - DNA, 25 bp, Homo sapien
tcccttgcctgactgtgacttgtgc

SEQ ID NO: 74549 - DNA, 25 bp, Homo sapien
gcctgactgtgacttgtgcctctct

SEQ ID NO: 74550 - DNA, 25 bp, Homo sapien
gaacctttctgggaacaccttctcg

SEQ ID NO: 74551 - DNA, 25 bp, Homo sapien
tttctgggaacaccttctcgccggg

SEQ ID NO: 74552 - DNA, 25 bp, Homo sapien
ttctcgccgggctgggaacaataaa

SEQ ID NO: 74553 - DNA, 25 bp, Homo sapien
gaacaataaatgcagccatgtctct

SEQ ID NO: 74554 - DNA, 25 bp, Homo sapien
aatgcagccatgtctctgcaaaaaa

SEQ ID NO: 74555 - DNA, 25 bp, Homo sapien
caacttggggtacacaggatactgg

SEQ ID NO: 74556 - DNA, 25 bp, Homo sapien
aggatactgggggtgccgctcctca

SEQ ID NO: 74557 - DNA, 25 bp, Homo sapien
taggggtacacctgacccagctggc

SEQ ID NO: 74558 - DNA, 25 bp, Homo sapien
gggcaccttcggctggtcctgtggg

SEQ ID NO: 74559 - DNA, 25 bp, Homo sapien
tggacggtggcccagtggtggcagg

SEQ ID NO: 74560 - DNA, 25 bp, Homo sapien
tgctcctggctgtggttgtgcgccc

SEQ ID NO: 74561 - DNA, 25 bp, Homo sapien
tgggagcggccggtcacgctgctgt

SEQ ID NO: 74562 - DNA, 25 bp, Homo sapien
ggtcacgctgctgtgggcccgagtg

SEQ ID NO: 74563 - DNA, 25 bp, Homo sapien
gggcccgagtgtgttgcatgtccac

SEQ ID NO: 74564 - DNA, 25 bp, Homo sapien
gagtgtgttgcatgtccacgcacca

SEQ ID NO: 74565 - DNA, 25 bp, Homo sapien
gtgtgttgcatgtccacgcaccacc

SEQ ID NO: 74566 - DNA, 25 bp, Homo sapien
tgggttttttaggatgttgcatttc

SEQ ID NO: 74567 - DNA, 25 bp, Homo sapien
tgtgaattcaagtgcagctcaatac

SEQ ID NO: 74568 - DNA, 25 bp, Homo sapien
gtgcagctcaatactagcttcagta

SEQ ID NO: 74569 - DNA, 25 bp, Homo sapien
ttgtatagctgataagattctctgt

SEQ ID NO: 74570 - DNA, 25 bp, Homo sapien
tagctgataagattctctgtagaga

SEQ ID NO: 74571 - DNA, 25 bp, Homo sapien
aaaaaatgcaggttgtagctttttg

SEQ ID NO: 74572 - DNA, 25 bp, Homo sapien
tagctttttgatgggctactcatac

SEQ ID NO: 74573 - DNA, 25 bp, Homo sapien
gatgggctactcatacagttagatt

SEQ ID NO: 74574 - DNA, 25 bp, Homo sapien
acagttagattttacagcttctgat

SEQ ID NO: 74575 - DNA, 25 bp, Homo sapien
ttacagcttctgatgttgaatgttc

SEQ ID NO: 74576 - DNA, 25 bp, Homo sapien
tttaatttcttgtgtatggtagcac

SEQ ID NO: 74577 - DNA, 25 bp, Homo sapien
ggtgaggcagggaacccttttcact

SEQ ID NO: 74578 - DNA, 25 bp, Homo sapien
ttcactcccattccttagctttagt

SEQ ID NO: 74579 - DNA, 25 bp, Homo sapien
agctttagtctaatggagccaagga

SEQ ID NO: 74580 - DNA, 25 bp, Homo sapien
tgggaccttcaaccctgatcttttg

SEQ ID NO: 74581 - DNA, 25 bp, Homo sapien
tgatcttttgtcttccagtcttctc

SEQ ID NO: 74582 - DNA, 25 bp, Homo sapien
tgtcttccagtcttctcttagtgtc

SEQ ID NO: 74583 - DNA, 25 bp, Homo sapien
tcttagtgtcctgctcctaggtttc

SEQ ID NO: 74584 - DNA, 25 bp, Homo sapien
tggttcttctcccaggtattctctt

SEQ ID NO: 74585 - DNA, 25 bp, Homo sapien
tctggccactgctttgtatcagggt

SEQ ID NO: 74586 - DNA, 25 bp, Homo sapien
gtatcagggtttttcacgcttttgt

SEQ ID NO: 74587 - DNA, 25 bp, Homo sapien
cacgcttttgtagaactgaggtttc

SEQ ID NO: 74588 - DNA, 25 bp, Homo sapien
gaagctgagtaattttcggtcacag

SEQ ID NO: 74589 - DNA, 25 bp, Homo sapien
taattttcggtcacagggcaggccc

SEQ ID NO: 74590 - DNA, 25 bp, Homo sapien
tgttgaaatttcatttgtcctgctc

SEQ ID NO: 74591 - DNA, 25 bp, Homo sapien
gtttgggtcatcagaggactgcctg

SEQ ID NO: 74592 - DNA, 25 bp, Homo sapien
gatggccgcggaggtgcccttttcc

SEQ ID NO: 74593 - DNA, 25 bp, Homo sapien
tttcctggtgctttgtggtggctgc

SEQ ID NO: 74594 - DNA, 25 bp, Homo sapien
ggtggctgcagaagaccagttttgt

SEQ ID NO: 74595 - DNA, 25 bp, Homo sapien
ttcagcctggaatcagacatcttcc

SEQ ID NO: 74596 - DNA, 25 bp, Homo sapien
atcttccagatggtttggaccctgt

SEQ ID NO: 74597 - DNA, 25 bp, Homo sapien
gaccctgtccatgtgtaggtcatta

SEQ ID NO: 74598 - DNA, 25 bp, Homo sapien
tgtaggtcattatcacacaaagaga

SEQ ID NO: 74599 - DNA, 25 bp, Homo sapien
agtacaatatggctcattgactttt

SEQ ID NO: 74600 - DNA, 25 bp, Homo sapien
acatctgaggattccagagtcctct

SEQ ID NO: 74601 - DNA, 25 bp, Homo sapien
tctgaggattccagagtcctctgtt

SEQ ID NO: 74602 - DNA, 25 bp, Homo sapien
ttcatccctgggatagagtgagccc

SEQ ID NO: 74603 - DNA, 25 bp, Homo sapien
atccctgggatagagtgagccctct

SEQ ID NO: 74604 - DNA, 25 bp, Homo sapien
tgggatagagtgagccctcttgcgt

SEQ ID NO: 74605 - DNA, 25 bp, Homo sapien
atagagtgagccctcttgcgtcttc

SEQ ID NO: 74606 - DNA, 25 bp, Homo sapien
tcttgcgtcttccagggtagctcag

SEQ ID NO: 74607 - DNA, 25 bp, Homo sapien
gcgtcttccagggtagctcaggttg

SEQ ID NO: 74608 - DNA, 25 bp, Homo sapien
ttccagggtagctcaggttggccca

SEQ ID NO: 74609 - DNA, 25 bp, Homo sapien
agggtagctcaggttggcccagttt

SEQ ID NO: 74610 - DNA, 25 bp, Homo sapien
tgactccaggaaccattttcaccta

SEQ ID NO: 74611 - DNA, 25 bp, Homo sapien
ttttcacctattaccagtgttccct

SEQ ID NO: 74612 - DNA, 25 bp, Homo sapien
gggactcctcttaatgtttccaaat

SEQ ID NO: 74613 - DNA, 25 bp, Homo sapien
gttgatttccaacatgaggtttttt

SEQ ID NO: 74614 - DNA, 25 bp, Homo sapien
gcaaaactttccaactgagtggagt

SEQ ID NO: 74615 - DNA, 25 bp, Homo sapien
aaatggtgggattcattggcccata

SEQ ID NO: 74616 - DNA, 25 bp, Homo sapien
tcattggcccataggtacattggaa

SEQ ID NO: 74617 - DNA, 25 bp, Homo sapien
gaaaatgtatatctctccagctgta

SEQ ID NO: 74618 - DNA, 25 bp, Homo sapien
gtatatctctccagctgtactgtag

SEQ ID NO: 74619 - DNA, 25 bp, Homo sapien
gctgtactgtagtgccctgcaggct

SEQ ID NO: 74620 - DNA, 25 bp, Homo sapien
ccctgcaggctgtttatatgttcac

SEQ ID NO: 74621 - DNA, 25 bp, Homo sapien
agttgttaccattataaccctacag

SEQ ID NO: 74622 - DNA, 25 bp, Homo sapien
gttaccattataaccctacagaggt

SEQ ID NO: 74623 - DNA, 25 bp, Homo sapien
aaccctacagaggtggtgagcatgt

SEQ ID NO: 74624 - DNA, 25 bp, Homo sapien
cagaggtggtgagcatgtaacatga

SEQ ID NO: 74625 - DNA, 25 bp, Homo sapien
atgtaacatgagcttattgagacca

SEQ ID NO: 74626 - DNA, 25 bp, Homo sapien
gagcttattgagaccatcatagaga

SEQ ID NO: 74627 - DNA, 25 bp, Homo sapien
gagaccatcatagagatcgattctt

SEQ ID NO: 74628 - DNA, 25 bp, Homo sapien
ccatcatagagatcgattcttgtat

SEQ ID NO: 74629 - DNA, 25 bp, Homo sapien
aaatgttaggtgttgacattgagaa

SEQ ID NO: 74630 - DNA, 25 bp, Homo sapien
acattgagaaccctgaaaccccatt

SEQ ID NO: 74631 - DNA, 25 bp, Homo sapien
atctcttgagagatttagaatatct

SEQ ID NO: 74632 - DNA, 25 bp, Homo sapien
agagggtggtgcttccgacttgcca

SEQ ID NO: 74633 - DNA, 25 bp, Homo sapien
gacttgccagaagaccccgatgagg

SEQ ID NO: 74634 - DNA, 25 bp, Homo sapien
gaagaccccgatgaggatgcaattc

SEQ ID NO: 74635 - DNA, 25 bp, Homo sapien
ggatgcaattcccattacttaggtt

SEQ ID NO: 74636 - DNA, 25 bp, Homo sapien
attcaagtgtttcatctgtcgccag

SEQ ID NO: 74637 - DNA, 25 bp, Homo sapien
aaaacccagttgtcaccaagtgcag

SEQ ID NO: 74638 - DNA, 25 bp, Homo sapien
ccaagtgcaggcattatttctgcga

SEQ ID NO: 74639 - DNA, 25 bp, Homo sapien
atttctgcgagagctgtgcactgca

SEQ ID NO: 74640 - DNA, 25 bp, Homo sapien
agctgtgcactgcagcatttccgca

SEQ ID NO: 74641 - DNA, 25 bp, Homo sapien
gtgaccagcagaccaatggcgtctt

SEQ ID NO: 74642 - DNA, 25 bp, Homo sapien
aatggcgtcttcaatccagcgaaag

SEQ ID NO: 74643 - DNA, 25 bp, Homo sapien
aatcctcacaggattcctgtgggtc

SEQ ID NO: 74644 - DNA, 25 bp, Homo sapien
acaggattcctgtgggtccagcttt

SEQ ID NO: 74645 - DNA, 25 bp, Homo sapien
tgggaaacctttcttcggatccgca

SEQ ID NO: 74646 - DNA, 25 bp, Homo sapien
ggaaacctttcttcggatccgcact

SEQ ID NO: 74647 - DNA, 25 bp, Homo sapien
ttcggatccgcactcattccactga

SEQ ID NO: 74648 - DNA, 25 bp, Homo sapien
gcactcattccactgatgccagctg

SEQ ID NO: 74649 - DNA, 25 bp, Homo sapien
ctgaaggatgccagtactgtggtgt

SEQ ID NO: 74650 - DNA, 25 bp, Homo sapien
ccagtactgtggtgtgtgagtctca

SEQ ID NO: 74651 - DNA, 25 bp, Homo sapien
acacgctcctaactctgctgcatgg

SEQ ID NO: 74652 - DNA, 25 bp, Homo sapien
aactctgctgcatggcagatgccta

SEQ ID NO: 74653 - DNA, 25 bp, Homo sapien
tggcagatgcctaggtggaaatagc

SEQ ID NO: 74654 - DNA, 25 bp, Homo sapien
gaataaagcatgtcatttgctccta

SEQ ID NO: 74655 - DNA, 25 bp, Homo sapien
atgtcatttgctcctagatagattc

SEQ ID NO: 74656 - DNA, 25 bp, Homo sapien
tagattcattctatctagttgtggg

SEQ ID NO: 74657 - DNA, 25 bp, Homo sapien
gggatggagaaatctttaatggtat

SEQ ID NO: 74658 - DNA, 25 bp, Homo sapien
ttttgatacagtattctgtcagtaa

SEQ ID NO: 74659 - DNA, 25 bp, Homo sapien
agtaatttattagacctggcagctt

SEQ ID NO: 74660 - DNA, 25 bp, Homo sapien
ttagacctggcagctttgggtgagc

SEQ ID NO: 74661 - DNA, 25 bp, Homo sapien
gacctggcagctttgggtgagctta

SEQ ID NO: 74662 - DNA, 25 bp, Homo sapien
agctttgggtgagcttagatttttc

SEQ ID NO: 74663 - DNA, 25 bp, Homo sapien
tttcaccttcagtgttacattgtgt

SEQ ID NO: 74664 - DNA, 25 bp, Homo sapien
tcagtgttacattgtgtttgctttt

SEQ ID NO: 74665 - DNA, 25 bp, Homo sapien
ctgggctgcccacggacagggatct

SEQ ID NO: 74666 - DNA, 25 bp, Homo sapien
caccacaggaccacgacatgcaggg

SEQ ID NO: 74667 - DNA, 25 bp, Homo sapien
ctggcggagcgcatcagtgttctct

SEQ ID NO: 74668 - DNA, 25 bp, Homo sapien
gcggagcgcatcagtgttctctgag

SEQ ID NO: 74669 - DNA, 25 bp, Homo sapien
ggagcgcatcagtgttctctgaggt

SEQ ID NO: 74670 - DNA, 25 bp, Homo sapien
agcgcatcagtgttctctgaggtcc

SEQ ID NO: 74671 - DNA, 25 bp, Homo sapien
gcatcagtgttctctgaggtcctgt

SEQ ID NO: 74672 - DNA, 25 bp, Homo sapien
atcagtgttctctgaggtcctgtgc

SEQ ID NO: 74673 - DNA, 25 bp, Homo sapien
gaggtcctgtgccctcgtccagctg

SEQ ID NO: 74674 - DNA, 25 bp, Homo sapien
gttcttcacaggatcccagcaatga

SEQ ID NO: 74675 - DNA, 25 bp, Homo sapien
tcttcacaggatcccagcaatgaac

SEQ ID NO: 74676 - DNA, 25 bp, Homo sapien
ctcagcggaaatatattcagggatt

SEQ ID NO: 74677 - DNA, 25 bp, Homo sapien
gaggttaatgaccatttgccagaaa

SEQ ID NO: 74678 - DNA, 25 bp, Homo sapien
ttgccagaaacactttcctacagac

SEQ ID NO: 74679 - DNA, 25 bp, Homo sapien
gtggagtacaatgcactgtgagatc

SEQ ID NO: 74680 - DNA, 25 bp, Homo sapien
gtgagatctgtgtatggtgtgttaa

SEQ ID NO: 74681 - DNA, 25 bp, Homo sapien
aaacttagggaagcaggctgtggac

SEQ ID NO: 74682 - DNA, 25 bp, Homo sapien
gcaggctgtggacttctggaattac

SEQ ID NO: 74683 - DNA, 25 bp, Homo sapien
ggacttctggaattaccaacaggaa

SEQ ID NO: 74684 - DNA, 25 bp, Homo sapien
tctacctgatgtaactcttgattgg

SEQ ID NO: 74685 - DNA, 25 bp, Homo sapien
aagaactttgttggccttcatttca

SEQ ID NO: 74686 - DNA, 25 bp, Homo sapien
ttttaaatgacgaaactcagcggaa

SEQ ID NO: 74687 - DNA, 25 bp, Homo sapien
ggagaacaggaactgccagactttc

SEQ ID NO: 74688 - DNA, 25 bp, Homo sapien
gactttcaaccgcagactcctagga

SEQ ID NO: 74689 - DNA, 25 bp, Homo sapien
tttcaaccgcagactcctaggagag

SEQ ID NO: 74690 - DNA, 25 bp, Homo sapien
agactcctaggagagatctcaggga

SEQ ID NO: 74691 - DNA, 25 bp, Homo sapien
agatctcagggagagctctccagca

SEQ ID NO: 74692 - DNA, 25 bp, Homo sapien
tcagggagagctctccagcagagcc

SEQ ID NO: 74693 - DNA, 25 bp, Homo sapien
tcccaggcaggagcttatgaccggc

SEQ ID NO: 74694 - DNA, 25 bp, Homo sapien
aggagcttatgaccggctgagcccc

SEQ ID NO: 74695 - DNA, 25 bp, Homo sapien
gctgagcccccatcattgggagaaa

SEQ ID NO: 74696 - DNA, 25 bp, Homo sapien
atcattgggagaaatccccactcct

SEQ ID NO: 74697 - DNA, 25 bp, Homo sapien
caacccccaaattggctgggacaga

SEQ ID NO: 74698 - DNA, 25 bp, Homo sapien
tgaccctcagcccgcactgggagtg

SEQ ID NO: 74699 - DNA, 25 bp, Homo sapien
gggcccgtcttagtgttctgccgga

SEQ ID NO: 74700 - DNA, 25 bp, Homo sapien
gcccgtcttagtgttctgccggagg

SEQ ID NO: 74701 - DNA, 25 bp, Homo sapien
ccgtcttagtgttctgccggaggac

SEQ ID NO: 74702 - DNA, 25 bp, Homo sapien
gtcttagtgttctgccggaggaccc

SEQ ID NO: 74703 - DNA, 25 bp, Homo sapien
tcttagtgttctgccggaggaccca

SEQ ID NO: 74704 - DNA, 25 bp, Homo sapien
ttagtgttctgccggaggacccagc

SEQ ID NO: 74705 - DNA, 25 bp, Homo sapien
aatccctgacagctccttgggctga

SEQ ID NO: 74706 - DNA, 25 bp, Homo sapien
gggacgccaggtcggtgggaggctg

SEQ ID NO: 74707 - DNA, 25 bp, Homo sapien
ggagttccccggaacccgtgcagat

SEQ ID NO: 74708 - DNA, 25 bp, Homo sapien
gagttccccggaacccgtgcagatt

SEQ ID NO: 74709 - DNA, 25 bp, Homo sapien
ggcgctggcctcatgtgtcacattt

SEQ ID NO: 74710 - DNA, 25 bp, Homo sapien
gcgctggcctcatgtgtcacatttt

SEQ ID NO: 74711 - DNA, 25 bp, Homo sapien
gctggcctcatgtgtcacattttct

SEQ ID NO: 74712 - DNA, 25 bp, Homo sapien
tggcctcatgtgtcacattttctta

SEQ ID NO: 74713 - DNA, 25 bp, Homo sapien
cttaatccagtctatggctgatgga

SEQ ID NO: 74714 - DNA, 25 bp, Homo sapien
aatccagtctatggctgatggatat

SEQ ID NO: 74715 - DNA, 25 bp, Homo sapien
ttccagctgtcaaagcatcaggccc

SEQ ID NO: 74716 - DNA, 25 bp, Homo sapien
agctgtcaaagcatcaggcccggcc

SEQ ID NO: 74717 - DNA, 25 bp, Homo sapien
tgtcaaagcatcaggcccggccgcg

SEQ ID NO: 74718 - DNA, 25 bp, Homo sapien
ggaactcctcccgtgccggcttggc

SEQ ID NO: 74719 - DNA, 25 bp, Homo sapien
cggtagctcgcgtgctcgcccggtt

SEQ ID NO: 74720 - DNA, 25 bp, Homo sapien
tacaacttcaggttcaccacccaag

SEQ ID NO: 74721 - DNA, 25 bp, Homo sapien
acttcaggttcaccacccaagaaat

SEQ ID NO: 74722 - DNA, 25 bp, Homo sapien
tcaggttcaccacccaagaaatctt

SEQ ID NO: 74723 - DNA, 25 bp, Homo sapien
caagaaatcttcagcaggaccaaaa

SEQ ID NO: 74724 - DNA, 25 bp, Homo sapien
gaaatcttcagcaggaccaaaaaga

SEQ ID NO: 74725 - DNA, 25 bp, Homo sapien
caggcagatttataaccctcccagt

SEQ ID NO: 74726 - DNA, 25 bp, Homo sapien
gcagatttataaccctcccagtggg

SEQ ID NO: 74727 - DNA, 25 bp, Homo sapien
ttataaccctcccagtgggaaatat

SEQ ID NO: 74728 - DNA, 25 bp, Homo sapien
ctcccagtgggaaatatagcagcaa

SEQ ID NO: 74729 - DNA, 25 bp, Homo sapien
atatagcagcaatttgggcaacttt

SEQ ID NO: 74730 - DNA, 25 bp, Homo sapien
tagcagcaatttgggcaactttaat

SEQ ID NO: 74731 - DNA, 25 bp, Homo sapien
ctgctttgaaataaacggacgtttg

SEQ ID NO: 74732 - DNA, 25 bp, Homo sapien
aaacggacgtttgagctcacgtggc

SEQ ID NO: 74733 - DNA, 25 bp, Homo sapien
tttgagctcacgtggcggccatgca

SEQ ID NO: 74734 - DNA, 25 bp, Homo sapien
cacgtggcggccatgcatggtttgt

SEQ ID NO: 74735 - DNA, 25 bp, Homo sapien
ccatgcatggtttgtggcggaagac

SEQ ID NO: 74736 - DNA, 25 bp, Homo sapien
agtgctgcaggtgccgccaggacgg

SEQ ID NO: 74737 - DNA, 25 bp, Homo sapien
gccgcctccacgacccggagtaggg

SEQ ID NO: 74738 - DNA, 25 bp, Homo sapien
gggctcgggaccatgaggatgacca

SEQ ID NO: 74739 - DNA, 25 bp, Homo sapien
gaggatgaccagcaaaattcaagaa

SEQ ID NO: 74740 - DNA, 25 bp, Homo sapien
aattcaagaacaaaactgctccaac

SEQ ID NO: 74741 - DNA, 25 bp, Homo sapien
ctgctccaacagacttttttaaagg

SEQ ID NO: 74742 - DNA, 25 bp, Homo sapien
gctgctactagccaagacccaggag

SEQ ID NO: 74743 - DNA, 25 bp, Homo sapien
ctactagccaagacccaggagctgg

SEQ ID NO: 74744 - DNA, 25 bp, Homo sapien
aggaagcccatgaaaggagccagga

SEQ ID NO: 74745 - DNA, 25 bp, Homo sapien
ggagccaggagttaatacagctgaa

SEQ ID NO: 74746 - DNA, 25 bp, Homo sapien
gagttaatacagctgaagagtcaag

SEQ ID NO: 74747 - DNA, 25 bp, Homo sapien
gggatctggagaaggctgaacttca

SEQ ID NO: 74748 - DNA, 25 bp, Homo sapien
ctgaacttcaggaccgggtgaccga

SEQ ID NO: 74749 - DNA, 25 bp, Homo sapien
ttcaggaccgggtgaccgagctctc

SEQ ID NO: 74750 - DNA, 25 bp, Homo sapien
gtgaccgagctctctgctctgttga

SEQ ID NO: 74751 - DNA, 25 bp, Homo sapien
ctgctctgttgacccagtctcagaa

SEQ ID NO: 74752 - DNA, 25 bp, Homo sapien
tgctgctgctactagccaagaccca

SEQ ID NO: 74753 - DNA, 25 bp, Homo sapien
ctgtgtcctccctgtgtgggtgctg

SEQ ID NO: 74754 - DNA, 25 bp, Homo sapien
ctgtgtgggtgctggtgtccaaaat

SEQ ID NO: 74755 - DNA, 25 bp, Homo sapien
tttccccttttcgtagtgacaccag

SEQ ID NO: 74756 - DNA, 25 bp, Homo sapien
cttttcgtagtgacaccagctgtgt

SEQ ID NO: 74757 - DNA, 25 bp, Homo sapien
ctccagcatggcctaatcttaacta

SEQ ID NO: 74758 - DNA, 25 bp, Homo sapien
atttgcaaggatcttatgtccacaa

SEQ ID NO: 74759 - DNA, 25 bp, Homo sapien
tgtccacaaaagtcacagtctgagg

SEQ ID NO: 74760 - DNA, 25 bp, Homo sapien
tgcggttacacaattcaatccatga

SEQ ID NO: 74761 - DNA, 25 bp, Homo sapien
tcaatccatgacagaatccaaaggt

SEQ ID NO: 74762 - DNA, 25 bp, Homo sapien
gaatccaaaggtttactctggttat

SEQ ID NO: 74763 - DNA, 25 bp, Homo sapien
atattgtttatagccttccctgtaa

SEQ ID NO: 74764 - DNA, 25 bp, Homo sapien
ttgcagttgccatacagtgcctttc

SEQ ID NO: 74765 - DNA, 25 bp, Homo sapien
ccatacagtgcctttccatttattt

SEQ ID NO: 74766 - DNA, 25 bp, Homo sapien
acctgaacggcataaactgagtgtt

SEQ ID NO: 74767 - DNA, 25 bp, Homo sapien
gttcagctggtgttttttactgtaa

SEQ ID NO: 74768 - DNA, 25 bp, Homo sapien
ggagactttgctcttcatttaaacc

SEQ ID NO: 74769 - DNA, 25 bp, Homo sapien
atatttcatattttacgctcgaggg

SEQ ID NO: 74770 - DNA, 25 bp, Homo sapien
tcatattttacgctcgagggttttt

SEQ ID NO: 74771 - DNA, 25 bp, Homo sapien
ctttcctggcagcttttaacattat

SEQ ID NO: 74772 - DNA, 25 bp, Homo sapien
ggcagcttttaacattatagcaaat

SEQ ID NO: 74773 - DNA, 25 bp, Homo sapien
tgctggtcactgtttctcacagttg

SEQ ID NO: 74774 - DNA, 25 bp, Homo sapien
gtttctcacagttgcaaatcaaggc

SEQ ID NO: 74775 - DNA, 25 bp, Homo sapien
atgcatggtttgtggcggaagacgg

SEQ ID NO: 74776 - DNA, 25 bp, Homo sapien
tgcatggtttgtggcggaagacggg

SEQ ID NO: 74777 - DNA, 25 bp, Homo sapien
agcggctcccccagcgctgaagcac

SEQ ID NO: 74778 - DNA, 25 bp, Homo sapien
tgaagcacggggttcagcggctccc

SEQ ID NO: 74779 - DNA, 25 bp, Homo sapien
gggctcgggaccatgaggatgacca

SEQ ID NO: 74780 - DNA, 25 bp, Homo sapien
tgaggatgaccagcaaaattcaaga

SEQ ID NO: 74781 - DNA, 25 bp, Homo sapien
gaggatgaccagcaaaattcaagaa

SEQ ID NO: 74782 - DNA, 25 bp, Homo sapien
aggatgaccagcaaaattcaagaac

SEQ ID NO: 74783 - DNA, 25 bp, Homo sapien
ggatgaccagcaaaattcaagaaca

SEQ ID NO: 74784 - DNA, 25 bp, Homo sapien
gatgaccagcaaaattcaagaacaa

SEQ ID NO: 74785 - DNA, 25 bp, Homo sapien
gaccagcaaaattcaagaacaaaac

SEQ ID NO: 74786 - DNA, 25 bp, Homo sapien
tggtgccttcattcatgaaaagcat

SEQ ID NO: 74787 - DNA, 25 bp, Homo sapien
ggtgccttcattcatgaaaagcatg

SEQ ID NO: 74788 - DNA, 25 bp, Homo sapien
gtgccttcattcatgaaaagcatgc

SEQ ID NO: 74789 - DNA, 25 bp, Homo sapien
gccttcattcatgaaaagcatgccc

SEQ ID NO: 74790 - DNA, 25 bp, Homo sapien
ttcattcatgaaaagcatgcccata

SEQ ID NO: 74791 - DNA, 25 bp, Homo sapien
attcatgaaaagcatgcccatacga

SEQ ID NO: 74792 - DNA, 25 bp, Homo sapien
catgaaaagcatgcccatacgatta

SEQ ID NO: 74793 - DNA, 25 bp, Homo sapien
gaaaagcatgcccatacgattaaac

SEQ ID NO: 74794 - DNA, 25 bp, Homo sapien
aaaagcatgcccatacgattaaacc

SEQ ID NO: 74795 - DNA, 25 bp, Homo sapien
aagcatgcccatacgattaaacctg

SEQ ID NO: 74796 - DNA, 25 bp, Homo sapien
agcatgcccatacgattaaacctgc

SEQ ID NO: 74797 - DNA, 25 bp, Homo sapien
ataatcataatgtttacaatgcagc

SEQ ID NO: 74798 - DNA, 25 bp, Homo sapien
taatcataatgtttacaatgcagcc

SEQ ID NO: 74799 - DNA, 25 bp, Homo sapien
tttataaataggtaagccttacact

SEQ ID NO: 74800 - DNA, 25 bp, Homo sapien
ttacctctaatttcagtctcactaa

SEQ ID NO: 74801 - DNA, 25 bp, Homo sapien
tacctctaatttcagtctcactaat

SEQ ID NO: 74802 - DNA, 25 bp, Homo sapien
acctctaatttcagtctcactaatg

SEQ ID NO: 74803 - DNA, 25 bp, Homo sapien
cctctaatttcagtctcactaatgt

SEQ ID NO: 74804 - DNA, 25 bp, Homo sapien
tcagtcactaactgtacagttttat

SEQ ID NO: 74805 - DNA, 25 bp, Homo sapien
cagtcactaactgtacagttttatg

SEQ ID NO: 74806 - DNA, 25 bp, Homo sapien
tcactaactgtacagttttatgtgg

SEQ ID NO: 74807 - DNA, 25 bp, Homo sapien
cactaactgtacagttttatgtggg

SEQ ID NO: 74808 - DNA, 25 bp, Homo sapien
aatgtaaacaatcagctcacaggca

SEQ ID NO: 74809 - DNA, 25 bp, Homo sapien
gtaaacaatcagctcacaggcatca

SEQ ID NO: 74810 - DNA, 25 bp, Homo sapien
acaatcagctcacaggcatcaatac

SEQ ID NO: 74811 - DNA, 25 bp, Homo sapien
catcaatacaaccagatttgaagta

SEQ ID NO: 74812 - DNA, 25 bp, Homo sapien
aaaagtagatgagaggacacaagat

SEQ ID NO: 74813 - DNA, 25 bp, Homo sapien
ggacacaagatgtagtcgatcctta

SEQ ID NO: 74814 - DNA, 25 bp, Homo sapien
gatgtagtcgatccttatgcgatta

SEQ ID NO: 74815 - DNA, 25 bp, Homo sapien
gtcgatccttatgcgattatatcat

SEQ ID NO: 74816 - DNA, 25 bp, Homo sapien
gatccttatgcgattatatcattat

SEQ ID NO: 74817 - DNA, 25 bp, Homo sapien
atatcattatttacttaggaaagag

SEQ ID NO: 74818 - DNA, 25 bp, Homo sapien
tgtacaaatcgagataacatttaca

SEQ ID NO: 74819 - DNA, 25 bp, Homo sapien
gaagcaggcccagcaagtaatggaa

SEQ ID NO: 74820 - DNA, 25 bp, Homo sapien
gggacaggtgccagttagacgaaac

SEQ ID NO: 74821 - DNA, 25 bp, Homo sapien
gcatctctgttgtacgtgtcagtct

SEQ ID NO: 74822 - DNA, 25 bp, Homo sapien
tacgtgtcagtctagaggtctcact

SEQ ID NO: 74823 - DNA, 25 bp, Homo sapien
ggtctcactgcaccgagttcataaa

SEQ ID NO: 74824 - DNA, 25 bp, Homo sapien
ctgaagaatcctttcagctcttcct

SEQ ID NO: 74825 - DNA, 25 bp, Homo sapien
agccctttggtttgtgggtatctgc

SEQ ID NO: 74826 - DNA, 25 bp, Homo sapien
gggtatctgccccaactactgttgg

SEQ ID NO: 74827 - DNA, 25 bp, Homo sapien
aactactgttgggatcagcctcctg

SEQ ID NO: 74828 - DNA, 25 bp, Homo sapien
cctcctgtcttatgtgggcacgttc

SEQ ID NO: 74829 - DNA, 25 bp, Homo sapien
tgtgggcacgttccaaagtttaaat

SEQ ID NO: 74830 - DNA, 25 bp, Homo sapien
aggaacaactggtaactgtcatgga

SEQ ID NO: 74831 - DNA, 25 bp, Homo sapien
aacaactggtaactgtcatggagga

SEQ ID NO: 74832 - DNA, 25 bp, Homo sapien
acaactggtaactgtcatggaggaa

SEQ ID NO: 74833 - DNA, 25 bp, Homo sapien
caactggtaactgtcatggaggaac

SEQ ID NO: 74834 - DNA, 25 bp, Homo sapien
aactggtaactgtcatggaggaacg

SEQ ID NO: 74835 - DNA, 25 bp, Homo sapien
actggtaactgtcatggaggaacga

SEQ ID NO: 74836 - DNA, 25 bp, Homo sapien
ctgaaactagtgaaaaggcttcttc

SEQ ID NO: 74837 - DNA, 25 bp, Homo sapien
gaaactagtgaaaaggcttcttcaa

SEQ ID NO: 74838 - DNA, 25 bp, Homo sapien
aactagtgaaaaggcttcttcaaga

SEQ ID NO: 74839 - DNA, 25 bp, Homo sapien
ctagtgaaaaggcttcttcaagaga

SEQ ID NO: 74840 - DNA, 25 bp, Homo sapien
aaaaggcttcttcaagagaaagtga

SEQ ID NO: 74841 - DNA, 25 bp, Homo sapien
ctcctgcgctcagggtggcttgcag

SEQ ID NO: 74842 - DNA, 25 bp, Homo sapien
agggtggcttgcagtccctggccct

SEQ ID NO: 74843 - DNA, 25 bp, Homo sapien
cttctggtgggcatttggtatgtcc

SEQ ID NO: 74844 - DNA, 25 bp, Homo sapien
ggcatttggtatgtcctttctcttg

SEQ ID NO: 74845 - DNA, 25 bp, Homo sapien
tgatgtttttactctatatagtgaa

SEQ ID NO: 74846 - DNA, 25 bp, Homo sapien
aaagctagggagagcgggtcttctc

SEQ ID NO: 74847 - DNA, 25 bp, Homo sapien
agtcccctcacaatcccagatgggt

SEQ ID NO: 74848 - DNA, 25 bp, Homo sapien
aatcccagatgggttctaatgcagc

SEQ ID NO: 74849 - DNA, 25 bp, Homo sapien
agatgggttctaatgcagctgctgg

SEQ ID NO: 74850 - DNA, 25 bp, Homo sapien
gcctgatgccctgagttgtttgtga

SEQ ID NO: 74851 - DNA, 25 bp, Homo sapien
tgatgccctgagttgtttgtgattc

SEQ ID NO: 74852 - DNA, 25 bp, Homo sapien
agagatctcgtgatgacgcgttgtt

SEQ ID NO: 74853 - DNA, 25 bp, Homo sapien
gacgcgttgttttctgccatttatc

SEQ ID NO: 74854 - DNA, 25 bp, Homo sapien
gccatttatcccaaactttttcaga

SEQ ID NO: 74855 - DNA, 25 bp, Homo sapien
ctagaattcgagagtgtcatggaca

SEQ ID NO: 74856 - DNA, 25 bp, Homo sapien
atttcaccttgagattgagctttta

SEQ ID NO: 74857 - DNA, 25 bp, Homo sapien
ggatttgtctgttgaacttcatgct

SEQ ID NO: 74858 - DNA, 25 bp, Homo sapien
gaacttcatgctgtccaagtgttga

SEQ ID NO: 74859 - DNA, 25 bp, Homo sapien
ttacatagtgtcattccaaatccat

SEQ ID NO: 74860 - DNA, 25 bp, Homo sapien
tccatgcatgctgttgattttcctg

SEQ ID NO: 74861 - DNA, 25 bp, Homo sapien
tttctcttcttgttggtatttgttg

SEQ ID NO: 74862 - DNA, 25 bp, Homo sapien
gtatttgttgtgataaaccacctta

SEQ ID NO: 74863 - DNA, 25 bp, Homo sapien
gaagaatcacgctgtggtgtgtcaa

SEQ ID NO: 74864 - DNA, 25 bp, Homo sapien
aggatgccacaatgccatcgaccca

SEQ ID NO: 74865 - DNA, 25 bp, Homo sapien
tgccatcgacccagaagtgcagcgg

SEQ ID NO: 74866 - DNA, 25 bp, Homo sapien
gtgcagcgggtgacctataacaatt

SEQ ID NO: 74867 - DNA, 25 bp, Homo sapien
tggcatgcatccacagagtgctttc

SEQ ID NO: 74868 - DNA, 25 bp, Homo sapien
tgctgcagcaaatgcctcattgggc

SEQ ID NO: 74869 - DNA, 25 bp, Homo sapien
agaagttcatgccagtagaagggat

SEQ ID NO: 74870 - DNA, 25 bp, Homo sapien
aagggatggttttctgttcagtgga

SEQ ID NO: 74871 - DNA, 25 bp, Homo sapien
gagggcacccagaagtatcgagcca

SEQ ID NO: 74872 - DNA, 25 bp, Homo sapien
gtatcgagccatagctatccaaagt

SEQ ID NO: 74873 - DNA, 25 bp, Homo sapien
tatccaaagtggtctgcatttctac

SEQ ID NO: 74874 - DNA, 25 bp, Homo sapien
gcaagtggtttgtctttatccaccc

SEQ ID NO: 74875 - DNA, 25 bp, Homo sapien
cactgttgtggtcagccccagagaa

SEQ ID NO: 74876 - DNA, 25 bp, Homo sapien
ggtcagccccagagaattttatctt

SEQ ID NO: 74877 - DNA, 25 bp, Homo sapien
ttttatcttcttccttggcattggt

SEQ ID NO: 74878 - DNA, 25 bp, Homo sapien
ttggcattggttcactggacatttc

SEQ ID NO: 74879 - DNA, 25 bp, Homo sapien
tggacatttccacgtgagcggcctc

SEQ ID NO: 74880 - DNA, 25 bp, Homo sapien
acgtgagcggcctccgtagctaacc

SEQ ID NO: 74881 - DNA, 25 bp, Homo sapien
tctgaggagccatcttcctgaatcg

SEQ ID NO: 74882 - DNA, 25 bp, Homo sapien
ttcctgaatcgcattctctactgga

SEQ ID NO: 74883 - DNA, 25 bp, Homo sapien
aatcgcattctctactggactctgg

SEQ ID NO: 74884 - DNA, 25 bp, Homo sapien
agcaggcacctggtcttcagaaatt

SEQ ID NO: 74885 - DNA, 25 bp, Homo sapien
gttgcatttgtacttaagtcattcc

SEQ ID NO: 74886 - DNA, 25 bp, Homo sapien
aagtcattccatctttcactcagga

SEQ ID NO: 74887 - DNA, 25 bp, Homo sapien
aggatgaatgcgaaaagtgactgtt

SEQ ID NO: 74888 - DNA, 25 bp, Homo sapien
cacagacctcagtgatgtgagcact

SEQ ID NO: 74889 - DNA, 25 bp, Homo sapien
gttgctcaggagtgacaagttgcta

SEQ ID NO: 74890 - DNA, 25 bp, Homo sapien
agggatgggtgatacttcttgcttc

SEQ ID NO: 74891 - DNA, 25 bp, Homo sapien
cttcttgcttctcatgatgcatgtt

SEQ ID NO: 74892 - DNA, 25 bp, Homo sapien
catgatgcatgtttctgtatgttaa

SEQ ID NO: 74893 - DNA, 25 bp, Homo sapien
ctgtatgttaatgacttgttgggta

SEQ ID NO: 74894 - DNA, 25 bp, Homo sapien
cttgttgggtagctattaaggtact

SEQ ID NO: 74895 - DNA, 25 bp, Homo sapien
atgtgtacagggtccttttgcaata

SEQ ID NO: 74896 - DNA, 25 bp, Homo sapien
aatgaagccaagaactattttgcaa

SEQ ID NO: 74897 - DNA, 25 bp, Homo sapien
agaactattttgcaaaggttgactg

SEQ ID NO: 74898 - DNA, 25 bp, Homo sapien
aaggttgactgcaaagagcgcatca

SEQ ID NO: 74899 - DNA, 25 bp, Homo sapien
gagcgcatcagggacgtcgtttact

SEQ ID NO: 74900 - DNA, 25 bp, Homo sapien
aggccagactctaccataccctggg

SEQ ID NO: 74901 - DNA, 25 bp, Homo sapien
gggtacccttgataaaccatctcta

SEQ ID NO: 74902 - DNA, 25 bp, Homo sapien
tgctgggctgctgtgcagagtataa

SEQ ID NO: 74903 - DNA, 25 bp, Homo sapien
gctgctgtgcagagtataagatttt

SEQ ID NO: 74904 - DNA, 25 bp, Homo sapien
cccctctctccctataaatgatgta

SEQ ID NO: 74905 - DNA, 25 bp, Homo sapien
gatgtatttgtgacaccctatcttg

SEQ ID NO: 74906 - DNA, 25 bp, Homo sapien
gtgacaccctatcttgtcaataaac

SEQ ID NO: 74907 - DNA, 25 bp, Homo sapien
ggagatggcaactcacgtggtgccc

SEQ ID NO: 74908 - DNA, 25 bp, Homo sapien
aactcacgtggtgccctaggtgcag

SEQ ID NO: 74909 - DNA, 25 bp, Homo sapien
gctgcgtggtctggtatacatgctg

SEQ ID NO: 74910 - DNA, 25 bp, Homo sapien
gcgtggtctggtatacatgctgcaa

SEQ ID NO: 74911 - DNA, 25 bp, Homo sapien
ggtctggtatacatgctgcaaaatt

SEQ ID NO: 74912 - DNA, 25 bp, Homo sapien
aagacaaataatatcctctcccatt

SEQ ID NO: 74913 - DNA, 25 bp, Homo sapien
aatatcctctcccattattttcata

SEQ ID NO: 74914 - DNA, 25 bp, Homo sapien
atcctctcccattattttcataagt

SEQ ID NO: 74915 - DNA, 25 bp, Homo sapien
tttcataagtaacacagattccctg

SEQ ID NO: 74916 - DNA, 25 bp, Homo sapien
aaaatacagctaaacctttcttatg

SEQ ID NO: 74917 - DNA, 25 bp, Homo sapien
aagtatgcctatcatatacagggag

SEQ ID NO: 74918 - DNA, 25 bp, Homo sapien
gggtatggtgcctgtcatacccacc

SEQ ID NO: 74919 - DNA, 25 bp, Homo sapien
gtatggtgcctgtcatacccacctg

SEQ ID NO: 74920 - DNA, 25 bp, Homo sapien
tatggtgcctgtcatacccacctgc

SEQ ID NO: 74921 - DNA, 25 bp, Homo sapien
ctgggaacctcactgttctctcttt

SEQ ID NO: 74922 - DNA, 25 bp, Homo sapien
tgggaacctcactgttctctctttc

SEQ ID NO: 74923 - DNA, 25 bp, Homo sapien
ggaacctcactgttctctctttcag

SEQ ID NO: 74924 - DNA, 25 bp, Homo sapien
gaacctcactgttctctctttcagc

SEQ ID NO: 74925 - DNA, 25 bp, Homo sapien
tcactgttctctctttcagcctaga

SEQ ID NO: 74926 - DNA, 25 bp, Homo sapien
actgttctctctttcagcctagacc

SEQ ID NO: 74927 - DNA, 25 bp, Homo sapien
tgttctctctttcagcctagacctg

SEQ ID NO: 74928 - DNA, 25 bp, Homo sapien
gttctctctttcagcctagacctgc

SEQ ID NO: 74929 - DNA, 25 bp, Homo sapien
ctttggaccaaagcagacttctgta

SEQ ID NO: 74930 - DNA, 25 bp, Homo sapien
gcagacttctgtatacgcagctcag

SEQ ID NO: 74931 - DNA, 25 bp, Homo sapien
atacgcagctcagtttcccgggagt

SEQ ID NO: 74932 - DNA, 25 bp, Homo sapien
gggagtcgccacagatgtacccact

SEQ ID NO: 74933 - DNA, 25 bp, Homo sapien
acagatgtacccactagcccaggtt

SEQ ID NO: 74934 - DNA, 25 bp, Homo sapien
actagcccaggttgctgtgagtcag

SEQ ID NO: 74935 - DNA, 25 bp, Homo sapien
gtgagtcagcggaagctcccgttat

SEQ ID NO: 74936 - DNA, 25 bp, Homo sapien
gagtgagctccctgggttccagtat

SEQ ID NO: 74937 - DNA, 25 bp, Homo sapien
ctgggttccagtatttacttggtat

SEQ ID NO: 74938 - DNA, 25 bp, Homo sapien
tttacttggtatacctgagtttggg

SEQ ID NO: 74939 - DNA, 25 bp, Homo sapien
gaattactgtcaccttgatggacaa

SEQ ID NO: 74940 - DNA, 25 bp, Homo sapien
gcacacctgtcgtctcagctactcg

SEQ ID NO: 74941 - DNA, 25 bp, Homo sapien
cacacctgtcgtctcagctactcgg

SEQ ID NO: 74942 - DNA, 25 bp, Homo sapien
taataataaagctggagacttggcc

SEQ ID NO: 74943 - DNA, 25 bp, Homo sapien
aataataaagctggagacttggcca

SEQ ID NO: 74944 - DNA, 25 bp, Homo sapien
ataataaagctggagacttggccac

SEQ ID NO: 74945 - DNA, 25 bp, Homo sapien
taataaagctggagacttggccaca

SEQ ID NO: 74946 - DNA, 25 bp, Homo sapien
aataaagctggagacttggccacac

SEQ ID NO: 74947 - DNA, 25 bp, Homo sapien
ataaagctggagacttggccacacc

SEQ ID NO: 74948 - DNA, 25 bp, Homo sapien
taaagctggagacttggccacacct

SEQ ID NO: 74949 - DNA, 25 bp, Homo sapien
aaagctggagacttggccacacctg

SEQ ID NO: 74950 - DNA, 25 bp, Homo sapien
caggccatatcattaaccccataaa

SEQ ID NO: 74951 - DNA, 25 bp, Homo sapien
taaccccataaaagcagaagacgtg

SEQ ID NO: 74952 - DNA, 25 bp, Homo sapien
gaagacgtgggctaccggtcttcct

SEQ ID NO: 74953 - DNA, 25 bp, Homo sapien
ggtcttcctcaaggtcggacctgtc

SEQ ID NO: 74954 - DNA, 25 bp, Homo sapien
ggtcggacctgtctgtcatacagag

SEQ ID NO: 74955 - DNA, 25 bp, Homo sapien
acacgtcacaaaaaacagctgaaga

SEQ ID NO: 74956 - DNA, 25 bp, Homo sapien
gaaatgctctgtagattgagttgct

SEQ ID NO: 74957 - DNA, 25 bp, Homo sapien
gagccctgacttcacttcctttggt

SEQ ID NO: 74958 - DNA, 25 bp, Homo sapien
ttcctttggtccagttttactctga

SEQ ID NO: 74959 - DNA, 25 bp, Homo sapien
aaactggctcagtacattgcatgta

SEQ ID NO: 74960 - DNA, 25 bp, Homo sapien
gcatgtagttaagccacattttaaa

SEQ ID NO: 74961 - DNA, 25 bp, Homo sapien
acaaaaggaggccagccttcggtct

SEQ ID NO: 74962 - DNA, 25 bp, Homo sapien
aaggaggccagccttcggtcttcgt

SEQ ID NO: 74963 - DNA, 25 bp, Homo sapien
agccttcggtcttcgtcgatgcctg

SEQ ID NO: 74964 - DNA, 25 bp, Homo sapien
ggtcttcgtcgatgcctgactcagg

SEQ ID NO: 74965 - DNA, 25 bp, Homo sapien
cttcgtcgatgcctgactcaggcag

SEQ ID NO: 74966 - DNA, 25 bp, Homo sapien
tcaggcaggccagctttccgcgtgg

SEQ ID NO: 74967 - DNA, 25 bp, Homo sapien
gtggtggacaccgagttctaagcca

SEQ ID NO: 74968 - DNA, 25 bp, Homo sapien
ggacaccgagttctaagccacagac

SEQ ID NO: 74969 - DNA, 25 bp, Homo sapien
accgagttctaagccacagaccgag

SEQ ID NO: 74970 - DNA, 25 bp, Homo sapien
agttctaagccacagaccgaggccc

SEQ ID NO: 74971 - DNA, 25 bp, Homo sapien
caactacatcttccctgcttactct

SEQ ID NO: 74972 - DNA, 25 bp, Homo sapien
aagcatacaactggactcattatca

SEQ ID NO: 74973 - DNA, 25 bp, Homo sapien
agtgaatgcactgtgtgatcgccac

SEQ ID NO: 74974 - DNA, 25 bp, Homo sapien
gtgatcgccacataggtaaaaactg

SEQ ID NO: 74975 - DNA, 25 bp, Homo sapien
aaactggaatggtcgtaggcctctc

SEQ ID NO: 74976 - DNA, 25 bp, Homo sapien
atggtcgtaggcctctccatctgta

SEQ ID NO: 74977 - DNA, 25 bp, Homo sapien
tccatctgtacccttttccatcatg

SEQ ID NO: 74978 - DNA, 25 bp, Homo sapien
ttttccatcatgtcctattccctgt

SEQ ID NO: 74979 - DNA, 25 bp, Homo sapien
tattccctgtcactacacactaaaa

SEQ ID NO: 74980 - DNA, 25 bp, Homo sapien
cacactaaaactttcctgacttaca

SEQ ID NO: 74981 - DNA, 25 bp, Homo sapien
tttcctgacttacaataccatgggt

SEQ ID NO: 74982 - DNA, 25 bp, Homo sapien
taccatgggttatttatgcttgttt

SEQ ID NO: 74983 - DNA, 25 bp, Homo sapien
atattcctgagaaactggacttttt

SEQ ID NO: 74984 - DNA, 25 bp, Homo sapien
acaagtctttacaaaactgtcaata

SEQ ID NO: 74985 - DNA, 25 bp, Homo sapien
aatgtttacaatgcagcctactgga

SEQ ID NO: 74986 - DNA, 25 bp, Homo sapien
ctggattgtctctagatctgttttt

SEQ ID NO: 74987 - DNA, 25 bp, Homo sapien
ggattgtctctagatctgtttttct

SEQ ID NO: 74988 - DNA, 25 bp, Homo sapien
gattgtctctagatctgtttttctt

SEQ ID NO: 74989 - DNA, 25 bp, Homo sapien
ttgtctctagatctgtttttcttaa

SEQ ID NO: 74990 - DNA, 25 bp, Homo sapien
cttaaacactaacagaataattctt

SEQ ID NO: 74991 - DNA, 25 bp, Homo sapien
ctctaatttcagtctcactaatgta

SEQ ID NO: 74992 - DNA, 25 bp, Homo sapien
attcagtcactaactgtacagtttt

SEQ ID NO: 74993 - DNA, 25 bp, Homo sapien
ggaacaattcatgcaggctactgga

SEQ ID NO: 74994 - DNA, 25 bp, Homo sapien
gcagctggtgagtagcctgggatac

SEQ ID NO: 74995 - DNA, 25 bp, Homo sapien
ggtgagtagcctgggatacgtggga

SEQ ID NO: 74996 - DNA, 25 bp, Homo sapien
gggagacggtctccagaccctgctg

SEQ ID NO: 74997 - DNA, 25 bp, Homo sapien
agaccctgctgatgtgccacccctg

SEQ ID NO: 74998 - DNA, 25 bp, Homo sapien
ctgcaggccaatgactacacagtgg

SEQ ID NO: 74999 - DNA, 25 bp, Homo sapien
tacacagtggagataacccagcagc

SEQ ID NO: 75000 - DNA, 25 bp, Homo sapien
gataacccagcagcccgggctggag

SEQ ID NO: 75001 - DNA, 25 bp, Homo sapien
tggagatggccgtggacaccatgtc

SEQ ID NO: 75002 - DNA, 25 bp, Homo sapien
ctgagactgctcacgcaccagcgag

SEQ ID NO: 75003 - DNA, 25 bp, Homo sapien
agcgagcgcacaagcgcttccagac

SEQ ID NO: 75004 - DNA, 25 bp, Homo sapien
atgtgtactgaggagccgtgtgtct

SEQ ID NO: 75005 - DNA, 25 bp, Homo sapien
tgatgttgccttccactttaaccca

SEQ ID NO: 75006 - DNA, 25 bp, Homo sapien
cactttaacccacgcttcaatgaga

SEQ ID NO: 75007 - DNA, 25 bp, Homo sapien
aacccacgcttcaatgagaacaaca

SEQ ID NO: 75008 - DNA, 25 bp, Homo sapien
acaggagagtcattgtttgcaatac

SEQ ID NO: 75009 - DNA, 25 bp, Homo sapien
cattgtttgcaatacaaagctggat

SEQ ID NO: 75010 - DNA, 25 bp, Homo sapien
gaagaaagacagtcggttttcccat

SEQ ID NO: 75011 - DNA, 25 bp, Homo sapien
gacagtcggttttcccatttgaaag

SEQ ID NO: 75012 - DNA, 25 bp, Homo sapien
gtactggttgaacctgaccacttca

SEQ ID NO: 75013 - DNA, 25 bp, Homo sapien
gaacctgaccacttcaaggttgcag

SEQ ID NO: 75014 - DNA, 25 bp, Homo sapien
aatgatgctcacttgttgcagtaca

SEQ ID NO: 75015 - DNA, 25 bp, Homo sapien
gttgcagtacaatcatcgggttaaa

SEQ ID NO: 75016 - DNA, 25 bp, Homo sapien
ccttgcaagggcttggccacttggc

SEQ ID NO: 75017 - DNA, 25 bp, Homo sapien
ttgcaagggcttggccacttggccc

SEQ ID NO: 75018 - DNA, 25 bp, Homo sapien
tggcccttctggagcagacactttg

SEQ ID NO: 75019 - DNA, 25 bp, Homo sapien
gcccttctggagcagacactttgtg

SEQ ID NO: 75020 - DNA, 25 bp, Homo sapien
ttctggagcagacactttgtgcccc

SEQ ID NO: 75021 - DNA, 25 bp, Homo sapien
tcaatctcagcccagtatcagcccc

SEQ ID NO: 75022 - DNA, 25 bp, Homo sapien
cctccctggtacacaggcttctgtg

SEQ ID NO: 75023 - DNA, 25 bp, Homo sapien
ctcccatccatagtgcatggtgtgt

SEQ ID NO: 75024 - DNA, 25 bp, Homo sapien
gggctccaggacagatcaggcccca

SEQ ID NO: 75025 - DNA, 25 bp, Homo sapien
gatcaggccccaccttgtgtctacc

SEQ ID NO: 75026 - DNA, 25 bp, Homo sapien
gtgaacgtgccactgaataaagtcg

SEQ ID NO: 75027 - DNA, 25 bp, Homo sapien
aacctgagtttatatctggcatgaa

SEQ ID NO: 75028 - DNA, 25 bp, Homo sapien
gcatgaattcattatggtgatacac

SEQ ID NO: 75029 - DNA, 25 bp, Homo sapien
gaattcagtacattttgagacagta

SEQ ID NO: 75030 - DNA, 25 bp, Homo sapien
gagacagtattctaccattcagtaa

SEQ ID NO: 75031 - DNA, 25 bp, Homo sapien
gtattctaccattcagtaattttgg

SEQ ID NO: 75032 - DNA, 25 bp, Homo sapien
aatgattttaacacttctcagtgta

SEQ ID NO: 75033 - DNA, 25 bp, Homo sapien
tttaattggttttatgctgctttgt

SEQ ID NO: 75034 - DNA, 25 bp, Homo sapien
tatgctgctttgttaggacagatgt

SEQ ID NO: 75035 - DNA, 25 bp, Homo sapien
cagatgtgttttgaatgtaccatta

SEQ ID NO: 75036 - DNA, 25 bp, Homo sapien
gaattctatgtatcttaaactatga

SEQ ID NO: 75037 - DNA, 25 bp, Homo sapien
gtatcttaaactatgatcttctaaa

SEQ ID NO: 75038 - DNA, 25 bp, Homo sapien
tctaccgacatttctcttctaagag

SEQ ID NO: 75039 - DNA, 25 bp, Homo sapien
gaagtagtaaaaccagctgcagtgt

SEQ ID NO: 75040 - DNA, 25 bp, Homo sapien
ccagctgcagtgttatcaaagggtg

SEQ ID NO: 75041 - DNA, 25 bp, Homo sapien
aacccaaatgaatctgtaactgcta

SEQ ID NO: 75042 - DNA, 25 bp, Homo sapien
gtaactgctaatgccgctaccaatt

SEQ ID NO: 75043 - DNA, 25 bp, Homo sapien
ctaccaattctccttcatgtacaag

SEQ ID NO: 75044 - DNA, 25 bp, Homo sapien
gttagtataccatcttctgaagctt

SEQ ID NO: 75045 - DNA, 25 bp, Homo sapien
aagctttatcttcggatccttccta

SEQ ID NO: 75046 - DNA, 25 bp, Homo sapien
cttcggatccttcctacaacaaaga

SEQ ID NO: 75047 - DNA, 25 bp, Homo sapien
aaaacacattattcatcctacccaa

SEQ ID NO: 75048 - DNA, 25 bp, Homo sapien
atcctacccaaaagtctaaagcatc

SEQ ID NO: 75049 - DNA, 25 bp, Homo sapien
aggctaagaagtgccgcaaggtgta

SEQ ID NO: 75050 - DNA, 25 bp, Homo sapien
ccgcaaggtgtatggcatcgagcac

SEQ ID NO: 75051 - DNA, 25 bp, Homo sapien
atggcatcgagcaccgggaccagtg

SEQ ID NO: 75052 - DNA, 25 bp, Homo sapien
gaaggcctgccagcgctttctggac

SEQ ID NO: 75053 - DNA, 25 bp, Homo sapien
tttctggactgagctgtgctgcagg

SEQ ID NO: 75054 - DNA, 25 bp, Homo sapien
agctgtgctgcaggttctactctgt

SEQ ID NO: 75055 - DNA, 25 bp, Homo sapien
aggttctactctgttcctggccctg

SEQ ID NO: 75056 - DNA, 25 bp, Homo sapien
ccactgacaagaggccagtgtgtca

SEQ ID NO: 75057 - DNA, 25 bp, Homo sapien
accagccctcagcagaaaccgaaag

SEQ ID NO: 75058 - DNA, 25 bp, Homo sapien
gaaacacggagtttgggctctgttg

SEQ ID NO: 75059 - DNA, 25 bp, Homo sapien
ttgggctctgttggctaaggtgtaa

SEQ ID NO: 75060 - DNA, 25 bp, Homo sapien
gcatgataagctagttttattggtt

SEQ ID NO: 75061 - DNA, 25 bp, Homo sapien
agtattcttgttgtttacgcatgga

SEQ ID NO: 75062 - DNA, 25 bp, Homo sapien
gttgtttacgcatggaatcactatt

SEQ ID NO: 75063 - DNA, 25 bp, Homo sapien
aatcactattcctggttatctcacc

SEQ ID NO: 75064 - DNA, 25 bp, Homo sapien
ggttatctcaccaacgaaggctagg

SEQ ID NO: 75065 - DNA, 25 bp, Homo sapien
agccatgagccagccattttataag

SEQ ID NO: 75066 - DNA, 25 bp, Homo sapien
ttataagcactctgatttctaaaag

SEQ ID NO: 75067 - DNA, 25 bp, Homo sapien
gaaatctctgtagcctttagttatc

SEQ ID NO: 75068 - DNA, 25 bp, Homo sapien
gtagcctttagttatcagtacagat

SEQ ID NO: 75069 - DNA, 25 bp, Homo sapien
taacccagccttttccagtgtgtaa

SEQ ID NO: 75070 - DNA, 25 bp, Homo sapien
ttttccagtgtgtaacccagtttga

SEQ ID NO: 75071 - DNA, 25 bp, Homo sapien
aaacagatgccagtgcacaaatctt

SEQ ID NO: 75072 - DNA, 25 bp, Homo sapien
aacagatgccagtgcacaaatctta

SEQ ID NO: 75073 - DNA, 25 bp, Homo sapien
gatgccagtgcacaaatcttaaaga

SEQ ID NO: 75074 - DNA, 25 bp, Homo sapien
gccagtgcacaaatcttaaagaatt

SEQ ID NO: 75075 - DNA, 25 bp, Homo sapien
ttaaagaattataaggcctggtgcg

SEQ ID NO: 75076 - DNA, 25 bp, Homo sapien
taaagaattataaggcctggtgcga

SEQ ID NO: 75077 - DNA, 25 bp, Homo sapien
aaagaattataaggcctggtgcgat

SEQ ID NO: 75078 - DNA, 25 bp, Homo sapien
aattataaggcctggtgcgatggct

SEQ ID NO: 75079 - DNA, 25 bp, Homo sapien
attataaggcctggtgcgatggctc

SEQ ID NO: 75080 - DNA, 25 bp, Homo sapien
ttataaggcctggtgcgatggctca

SEQ ID NO: 75081 - DNA, 25 bp, Homo sapien
gatcatgccactgcaacaagcgtga

SEQ ID NO: 75082 - DNA, 25 bp, Homo sapien
actcctttcaggtttttgcaagtag

SEQ ID NO: 75083 - DNA, 25 bp, Homo sapien
atgtttgtgtatgcagccttgctgt

SEQ ID NO: 75084 - DNA, 25 bp, Homo sapien
cagccttgctgttgagtcagtccaa

SEQ ID NO: 75085 - DNA, 25 bp, Homo sapien
taggacaagttgtaccttgccctct

SEQ ID NO: 75086 - DNA, 25 bp, Homo sapien
agctctgctcccacattttcacata

SEQ ID NO: 75087 - DNA, 25 bp, Homo sapien
ttcacatacctagctgtttctacct

SEQ ID NO: 75088 - DNA, 25 bp, Homo sapien
gtttctacctcattgggtaactcat

SEQ ID NO: 75089 - DNA, 25 bp, Homo sapien
cattgggtaactcatttaccactct

SEQ ID NO: 75090 - DNA, 25 bp, Homo sapien
gcctcagtttactctgtagtttacc

SEQ ID NO: 75091 - DNA, 25 bp, Homo sapien
gggactttgtcataatcactgttac

SEQ ID NO: 75092 - DNA, 25 bp, Homo sapien
taatcactgttacatcccagtgcct

SEQ ID NO: 75093 - DNA, 25 bp, Homo sapien
gacagactgactgacagccatgggt

SEQ ID NO: 75094 - DNA, 25 bp, Homo sapien
gactgactgacagccatgggtggtc

SEQ ID NO: 75095 - DNA, 25 bp, Homo sapien
gactgacagccatgggtggtcagat

SEQ ID NO: 75096 - DNA, 25 bp, Homo sapien
agctgccccccaggatggatatgag

SEQ ID NO: 75097 - DNA, 25 bp, Homo sapien
tgcagtgtctgaagcgcctgcctcc

SEQ ID NO: 75098 - DNA, 25 bp, Homo sapien
accctccaatctgcactttgatttg

SEQ ID NO: 75099 - DNA, 25 bp, Homo sapien
aatctgcactttgatttgcttccta

SEQ ID NO: 75100 - DNA, 25 bp, Homo sapien
tgcactttgatttgcttcctaacag

SEQ ID NO: 75101 - DNA, 25 bp, Homo sapien
tttgatttgcttcctaacagctctg

SEQ ID NO: 75102 - DNA, 25 bp, Homo sapien
gatttgcttcctaacagctctgttc

SEQ ID NO: 75103 - DNA, 25 bp, Homo sapien
ttgcttcctaacagctctgttccct

SEQ ID NO: 75104 - DNA, 25 bp, Homo sapien
gttcaaaatgtcaacctgattaaca

SEQ ID NO: 75105 - DNA, 25 bp, Homo sapien
atgtctttttgtaaatggcttgcca

SEQ ID NO: 75106 - DNA, 25 bp, Homo sapien
tggcttgccatcttttaattttcta

SEQ ID NO: 75107 - DNA, 25 bp, Homo sapien
agcgaatggaagtatcagaagtacc

SEQ ID NO: 75108 - DNA, 25 bp, Homo sapien
gtatcagaagtaccaaataatgttg

SEQ ID NO: 75109 - DNA, 25 bp, Homo sapien
ataatgttggcttcatcagttttta

SEQ ID NO: 75110 - DNA, 25 bp, Homo sapien
atcagtttttatacactctcataag

SEQ ID NO: 75111 - DNA, 25 bp, Homo sapien
gatgaatttaatgtaggcttttatt

SEQ ID NO: 75112 - DNA, 25 bp, Homo sapien
aataacttgtgcagctattcatgtc

SEQ ID NO: 75113 - DNA, 25 bp, Homo sapien
tactctgccccttgttgtaaatagt

SEQ ID NO: 75114 - DNA, 25 bp, Homo sapien
tctgccccttgttgtaaatagtttg

SEQ ID NO: 75115 - DNA, 25 bp, Homo sapien
tctatcattccaggttaaaggagag

SEQ ID NO: 75116 - DNA, 25 bp, Homo sapien
gagaccatggattaatcaaccttag

SEQ ID NO: 75117 - DNA, 25 bp, Homo sapien
catggattaatcaaccttagaaagt

SEQ ID NO: 75118 - DNA, 25 bp, Homo sapien
gtttcaattaatggaacggcggtat

SEQ ID NO: 75119 - DNA, 25 bp, Homo sapien
aatggaacggcggtatcccaaggag

SEQ ID NO: 75120 - DNA, 25 bp, Homo sapien
acggcggtatcccaaggaggtccag

SEQ ID NO: 75121 - DNA, 25 bp, Homo sapien
ccaggacctgtatgaaacaatgagg

SEQ ID NO: 75122 - DNA, 25 bp, Homo sapien
aacaatgaggcgatttgcaagaatt

SEQ ID NO: 75123 - DNA, 25 bp, Homo sapien
atgaggcgatttgcaagaattgtgg

SEQ ID NO: 75124 - DNA, 25 bp, Homo sapien
gggccagtggaacatgacaaattca

SEQ ID NO: 75125 - DNA, 25 bp, Homo sapien
gacaaattcattgaaagccatgcat

SEQ ID NO: 75126 - DNA, 25 bp, Homo sapien
aaacctgcgagatcggagttcttta

SEQ ID NO: 75127 - DNA, 25 bp, Homo sapien
ggaatgcaacagatttggacaagtc

SEQ ID NO: 75128 - DNA, 25 bp, Homo sapien
ggacaagagctttagagagaccaaa

SEQ ID NO: 75129 - DNA, 25 bp, Homo sapien
agagaccaaagagtttttcactgtt

SEQ ID NO: 75130 - DNA, 25 bp, Homo sapien
taaagtgtccagtatgtagccgaga

SEQ ID NO: 75131 - DNA, 25 bp, Homo sapien
atgtagccgagaaccatatggagaa

SEQ ID NO: 75132 - DNA, 25 bp, Homo sapien
ggagaacatcaaatacagtggaaca

SEQ ID NO: 75133 - DNA, 25 bp, Homo sapien
atgtaactgctattgatgtcacact

SEQ ID NO: 75134 - DNA, 25 bp, Homo sapien
gtcacactttgtgaagtagtctttg

SEQ ID NO: 75135 - DNA, 25 bp, Homo sapien
gtgaagtagtctttgttgcttaaaa

SEQ ID NO: 75136 - DNA, 25 bp, Homo sapien
aaaaagggtgacatctagtggctaa

SEQ ID NO: 75137 - DNA, 25 bp, Homo sapien
agcagtcggcctgtactggaatcca

SEQ ID NO: 75138 - DNA, 25 bp, Homo sapien
tggaatccacaggacatccagctgt

SEQ ID NO: 75139 - DNA, 25 bp, Homo sapien
aggacatccagctgttcaccatgga

SEQ ID NO: 75140 - DNA, 25 bp, Homo sapien
ttcaccatggattccgactgagggc

SEQ ID NO: 75141 - DNA, 25 bp, Homo sapien
gactgagggcaggatgctctcccac

SEQ ID NO: 75142 - DNA, 25 bp, Homo sapien
agcccttcaagttcttttatttctg

SEQ ID NO: 75143 - DNA, 25 bp, Homo sapien
aggttacttggtgtatcttctgtta

SEQ ID NO: 75144 - DNA, 25 bp, Homo sapien
agaggattgcacgagtgtgttttcc

SEQ ID NO: 75145 - DNA, 25 bp, Homo sapien
gttttcctcacacactttgatttgg

SEQ ID NO: 75146 - DNA, 25 bp, Homo sapien
tttggagaattggtgctagttggca

SEQ ID NO: 75147 - DNA, 25 bp, Homo sapien
tggcaatagataactcagcgtagat

SEQ ID NO: 75148 - DNA, 25 bp, Homo sapien
acaatgtacccgtaatttgtaacat

SEQ ID NO: 75149 - DNA, 25 bp, Homo sapien
tagtaacaatcttgcagccttcctt

SEQ ID NO: 75150 - DNA, 25 bp, Homo sapien
cagccttcctttccaaagttcattt

SEQ ID NO: 75151 - DNA, 25 bp, Homo sapien
gatcagttcagtatattgcactaat

SEQ ID NO: 75152 - DNA, 25 bp, Homo sapien
ttatatgaaagctaccatgtgtcag

SEQ ID NO: 75153 - DNA, 25 bp, Homo sapien
agctaccatgtgtcagagatgattt

SEQ ID NO: 75154 - DNA, 25 bp, Homo sapien
tctatttaagtgttggactgctagg

SEQ ID NO: 75155 - DNA, 25 bp, Homo sapien
gtgttggactgctaggagaacttgt

SEQ ID NO: 75156 - DNA, 25 bp, Homo sapien
aggagaacttgtacatttatgataa

SEQ ID NO: 75157 - DNA, 25 bp, Homo sapien
gaattaggaaaacggttcaccagtg

SEQ ID NO: 75158 - DNA, 25 bp, Homo sapien
attgaggtgctcaggttggaataaa

SEQ ID NO: 75159 - DNA, 25 bp, Homo sapien
attcttgtacaattgaaggatacgc

SEQ ID NO: 75160 - DNA, 25 bp, Homo sapien
ggatacgcagaaggacatctttcta

SEQ ID NO: 75161 - DNA, 25 bp, Homo sapien
ggacatctttctagtctaacagtca

SEQ ID NO: 75162 - DNA, 25 bp, Homo sapien
tctaacagtcaggagctgctctggt

SEQ ID NO: 75163 - DNA, 25 bp, Homo sapien
attcccttgtatgaactggtctaaa

SEQ ID NO: 75164 - DNA, 25 bp, Homo sapien
tcttggctgacactactggtcaagt

SEQ ID NO: 75165 - DNA, 25 bp, Homo sapien
ggtatacagggaacagcactctaga

SEQ ID NO: 75166 - DNA, 25 bp, Homo sapien
gcactctagaagctatgactcaatt

SEQ ID NO: 75167 - DNA, 25 bp, Homo sapien
agactacaagtaccacggtgctact

SEQ ID NO: 75168 - DNA, 25 bp, Homo sapien
agtaccacggtgctacttgcacaga

SEQ ID NO: 75169 - DNA, 25 bp, Homo sapien
ttgcacagacccctttggttaaatg

SEQ ID NO: 75170 - DNA, 25 bp, Homo sapien
atgatgctacccaccttgtgaaatc

SEQ ID NO: 75171 - DNA, 25 bp, Homo sapien
acccaccttgtgaaatcctatccag

SEQ ID NO: 75172 - DNA, 25 bp, Homo sapien
tgaaatcctatccaggatctcagct

SEQ ID NO: 75173 - DNA, 25 bp, Homo sapien
ggatctcagctggacatactaattg

SEQ ID NO: 75174 - DNA, 25 bp, Homo sapien
gctggacatactaattgatcaaggg

SEQ ID NO: 75175 - DNA, 25 bp, Homo sapien
gatgaccagtttcttttagatggac

SEQ ID NO: 75176 - DNA, 25 bp, Homo sapien
tagatggacagttactccctgataa

SEQ ID NO: 75177 - DNA, 25 bp, Homo sapien
tccctgataacttcatagctgcctg

SEQ ID NO: 75178 - DNA, 25 bp, Homo sapien
aacttcatagctgcctgtacagaaa

SEQ ID NO: 75179 - DNA, 25 bp, Homo sapien
tgtacagaaaagaaaatccccgttg

SEQ ID NO: 75180 - DNA, 25 bp, Homo sapien
atccccgttgtttttcgattgcaag

SEQ ID NO: 75181 - DNA, 25 bp, Homo sapien
tattggcatgtttagatgtcaggtt

SEQ ID NO: 75182 - DNA, 25 bp, Homo sapien
gatgtcaggtttagtcttctgaaga

SEQ ID NO: 75183 - DNA, 25 bp, Homo sapien
gttcagccattttgtatcaaacagc

SEQ ID NO: 75184 - DNA, 25 bp, Homo sapien
gtatcaaacagcacaagcagtgtct

SEQ ID NO: 75185 - DNA, 25 bp, Homo sapien
gtcactttccatgcataaagtttag

SEQ ID NO: 75186 - DNA, 25 bp, Homo sapien
gatctgatttgctagttcttccttg

SEQ ID NO: 75187 - DNA, 25 bp, Homo sapien
gatttgctagttcttccttgtagag

SEQ ID NO: 75188 - DNA, 25 bp, Homo sapien
gctagttcttccttgtagagttata

SEQ ID NO: 75189 - DNA, 25 bp, Homo sapien
gaaagattacactatctgattaata

SEQ ID NO: 75190 - DNA, 25 bp, Homo sapien
ttaatagtttcttcatactctgcat

SEQ ID NO: 75191 - DNA, 25 bp, Homo sapien
tgtaatttgttgcacactatgtaac

SEQ ID NO: 75192 - DNA, 25 bp, Homo sapien
gggcacacgtgtttcacgttgacag

SEQ ID NO: 75193 - DNA, 25 bp, Homo sapien
tcacgttgacaggtttgcttgggac

SEQ ID NO: 75194 - DNA, 25 bp, Homo sapien
gacaggtttgcttgggacgctagta

SEQ ID NO: 75195 - DNA, 25 bp, Homo sapien
gtttgcttgggacgctagtaaccat

SEQ ID NO: 75196 - DNA, 25 bp, Homo sapien
acgctagtaaccatgggcttgctga

SEQ ID NO: 75197 - DNA, 25 bp, Homo sapien
cttgctgacttagccaaagaagagt

SEQ ID NO: 75198 - DNA, 25 bp, Homo sapien
tacacacaagtatacagactgttcc

SEQ ID NO: 75199 - DNA, 25 bp, Homo sapien
gtatacagactgttcctagtttctt

SEQ ID NO: 75200 - DNA, 25 bp, Homo sapien
gactgttcctagtttcttagactta

SEQ ID NO: 75201 - DNA, 25 bp, Homo sapien
gtttcttagacttatctgcatattg

SEQ ID NO: 75202 - DNA, 25 bp, Homo sapien
taaaataaatgcaattgtgctcttc

SEQ ID NO: 75203 - DNA, 25 bp, Homo sapien
aatggctgtgtctcaccagcctgga

SEQ ID NO: 75204 - DNA, 25 bp, Homo sapien
aaggtgatctcagtgtccagtggct

SEQ ID NO: 75205 - DNA, 25 bp, Homo sapien
ggtgatctcagtgtccagtggcttc

SEQ ID NO: 75206 - DNA, 25 bp, Homo sapien
ccccacactaacctgaagagtacag

SEQ ID NO: 75207 - DNA, 25 bp, Homo sapien
aagagtacagactacacttcaatga

SEQ ID NO: 75208 - DNA, 25 bp, Homo sapien
gactacacttcaatgatctcttact

SEQ ID NO: 75209 - DNA, 25 bp, Homo sapien
gatctcttacttgaatttgtattta

SEQ ID NO: 75210 - DNA, 25 bp, Homo sapien
tgtatttaacatccctatatagcat

SEQ ID NO: 75211 - DNA, 25 bp, Homo sapien
tagcatttataagaagggcccaagt

SEQ ID NO: 75212 - DNA, 25 bp, Homo sapien
gaagcactgctttctttcctcagga

SEQ ID NO: 75213 - DNA, 25 bp, Homo sapien
gctttctttcctcaggacctgatgg

SEQ ID NO: 75214 - DNA, 25 bp, Homo sapien
atctgcactgcagcggatgaccacc

SEQ ID NO: 75215 - DNA, 25 bp, Homo sapien
gagatcaacaatgtgcagtgggcat

SEQ ID NO: 75216 - DNA, 25 bp, Homo sapien
tgcagtgggcatcaactcagcccga

SEQ ID NO: 75217 - DNA, 25 bp, Homo sapien
gggcatcaactcagcccgactggat

SEQ ID NO: 75218 - DNA, 25 bp, Homo sapien
gactggatcgccatctgctacaaca

SEQ ID NO: 75219 - DNA, 25 bp, Homo sapien
catctgctacaacaactgcctggag

SEQ ID NO: 75220 - DNA, 25 bp, Homo sapien
tgctacaacaactgcctggagatac

SEQ ID NO: 75221 - DNA, 25 bp, Homo sapien
acaacaactgcctggagatactcag

SEQ ID NO: 75222 - DNA, 25 bp, Homo sapien
atactcagagtgtagtgttggtggc

SEQ ID NO: 75223 - DNA, 25 bp, Homo sapien
ttggtggcgctgtgcccacgaggca

SEQ ID NO: 75224 - DNA, 25 bp, Homo sapien
gggcttttgtatttcctgcctctgc

SEQ ID NO: 75225 - DNA, 25 bp, Homo sapien
tgtcaccgaagacagggtttcctta

SEQ ID NO: 75226 - DNA, 25 bp, Homo sapien
tcaccgaagacagggtttccttaat

SEQ ID NO: 75227 - DNA, 25 bp, Homo sapien
agtatttcatagagttgtgaaacca

SEQ ID NO: 75228 - DNA, 25 bp, Homo sapien
tgaaaccatcatcctaatctaattt

SEQ ID NO: 75229 - DNA, 25 bp, Homo sapien
accatcatcctaatctaattttaga

SEQ ID NO: 75230 - DNA, 25 bp, Homo sapien
tcaggcaaccactaagctaccttct

SEQ ID NO: 75231 - DNA, 25 bp, Homo sapien
ctaagctaccttctgtccctgtaga

SEQ ID NO: 75232 - DNA, 25 bp, Homo sapien
tgtccctgtagatttgcctttttga

SEQ ID NO: 75233 - DNA, 25 bp, Homo sapien
tttgcctttttgaacaccttcataa

SEQ ID NO: 75234 - DNA, 25 bp, Homo sapien
tgcctttttgaacaccttcataaat

SEQ ID NO: 75235 - DNA, 25 bp, Homo sapien
gaacaccttcataaataaagtcgta

SEQ ID NO: 75236 - DNA, 25 bp, Homo sapien
gatttaaagatctcatcttgtcttg

SEQ ID NO: 75237 - DNA, 25 bp, Homo sapien
gatctcatcttgtcttgtttttcta

SEQ ID NO: 75238 - DNA, 25 bp, Homo sapien
catcttgtcttgtttttctaaggca

SEQ ID NO: 75239 - DNA, 25 bp, Homo sapien
gtcttgtttttctaaggcaggagag

SEQ ID NO: 75240 - DNA, 25 bp, Homo sapien
tatccttaaggattcaaagaagcaa

SEQ ID NO: 75241 - DNA, 25 bp, Homo sapien
ttttttccctcattgacacagaaga

SEQ ID NO: 75242 - DNA, 25 bp, Homo sapien
tttccctcattgacacagaagacaa

SEQ ID NO: 75243 - DNA, 25 bp, Homo sapien
gacaaacacagaagtctttttaaag

SEQ ID NO: 75244 - DNA, 25 bp, Homo sapien
aatacatccaatacattatagagac

SEQ ID NO: 75245 - DNA, 25 bp, Homo sapien
catggagatggctggaataaacaat

SEQ ID NO: 75246 - DNA, 25 bp, Homo sapien
tgttagttcttctcatgcaaatgat

SEQ ID NO: 75247 - DNA, 25 bp, Homo sapien
ccattgctgaaatccgacgactacg

SEQ ID NO: 75248 - DNA, 25 bp, Homo sapien
gaaatccgacgactacgacccggct

SEQ ID NO: 75249 - DNA, 25 bp, Homo sapien
acccggctccatcgagacctatgag

SEQ ID NO: 75250 - DNA, 25 bp, Homo sapien
tccatcgagacctatgagcaggaga

SEQ ID NO: 75251 - DNA, 25 bp, Homo sapien
tatgagcaggagaaagcagtcttcc

SEQ ID NO: 75252 - DNA, 25 bp, Homo sapien
ccagttctaccagcgaacgaaataa

SEQ ID NO: 75253 - DNA, 25 bp, Homo sapien
aagtattaaaccctctagctcccat

SEQ ID NO: 75254 - DNA, 25 bp, Homo sapien
ctagctcccattggctgaagacact

SEQ ID NO: 75255 - DNA, 25 bp, Homo sapien
ggaggcttgtactgctttgttgaat

SEQ ID NO: 75256 - DNA, 25 bp, Homo sapien
ggcttgtactgctttgttgaataaa

SEQ ID NO: 75257 - DNA, 25 bp, Homo sapien
gaataaatgagttttacgaaccagg

SEQ ID NO: 75258 - DNA, 25 bp, Homo sapien
tgcttttccccacaggttgtcatta

SEQ ID NO: 75259 - DNA, 25 bp, Homo sapien
gcttttccccacaggttgtcattac

SEQ ID NO: 75260 - DNA, 25 bp, Homo sapien
ttttccccacaggttgtcattactt

SEQ ID NO: 75261 - DNA, 25 bp, Homo sapien
tttccccacaggttgtcattactta

SEQ ID NO: 75262 - DNA, 25 bp, Homo sapien
ttccccacaggttgtcattacttaa

SEQ ID NO: 75263 - DNA, 25 bp, Homo sapien
tccccacaggttgtcattacttaat

SEQ ID NO: 75264 - DNA, 25 bp, Homo sapien
cccacaggttgtcattacttaatta

SEQ ID NO: 75265 - DNA, 25 bp, Homo sapien
ccacaggttgtcattacttaattat

SEQ ID NO: 75266 - DNA, 25 bp, Homo sapien
caggttgtcattacttaattattta

SEQ ID NO: 75267 - DNA, 25 bp, Homo sapien
aattccacattgaagttgtgtgcag

SEQ ID NO: 75268 - DNA, 25 bp, Homo sapien
cacattgaagttgtgtgcagtggct

SEQ ID NO: 75269 - DNA, 25 bp, Homo sapien
tggatggcagctctggcccagacat

SEQ ID NO: 75270 - DNA, 25 bp, Homo sapien
agctctggcccagacatgaatacct

SEQ ID NO: 75271 - DNA, 25 bp, Homo sapien
ctggcccagacatgaatacctcgtg

SEQ ID NO: 75272 - DNA, 25 bp, Homo sapien
caccagagctgtcttagctcaaatc

SEQ ID NO: 75273 - DNA, 25 bp, Homo sapien
agctgtcttagctcaaatctgttgt

SEQ ID NO: 75274 - DNA, 25 bp, Homo sapien
gtcttagctcaaatctgttgtgttt

SEQ ID NO: 75275 - DNA, 25 bp, Homo sapien
ttagctcaaatctgttgtgtttctg

SEQ ID NO: 75276 - DNA, 25 bp, Homo sapien
ctgttgtgtttctgagtctagggtc

SEQ ID NO: 75277 - DNA, 25 bp, Homo sapien
gtgtttctgagtctagggtctgtac

SEQ ID NO: 75278 - DNA, 25 bp, Homo sapien
gtttctgagtctagggtctgtacac

SEQ ID NO: 75279 - DNA, 25 bp, Homo sapien
tctgagtctagggtctgtacacttg

SEQ ID NO: 75280 - DNA, 25 bp, Homo sapien
caagagccaatggagtagacccctg

SEQ ID NO: 75281 - DNA, 25 bp, Homo sapien
tagacccctggctggtaagggccaa

SEQ ID NO: 75282 - DNA, 25 bp, Homo sapien
taagggccaagtcccaccggttgct

SEQ ID NO: 75283 - DNA, 25 bp, Homo sapien
agtcccaccggttgcttctgggaag

SEQ ID NO: 75284 - DNA, 25 bp, Homo sapien
gggtttctaacactagtctgtgtgc

SEQ ID NO: 75285 - DNA, 25 bp, Homo sapien
cactgccctctgttcagtaacaggg

SEQ ID NO: 75286 - DNA, 25 bp, Homo sapien
gtaacagggccttgctaatcgggtt

SEQ ID NO: 75287 - DNA, 25 bp, Homo sapien
cttgctaatcgggttgtcactcaac

SEQ ID NO: 75288 - DNA, 25 bp, Homo sapien
gggttgtcactcaacaaaagtgctt

SEQ ID NO: 75289 - DNA, 25 bp, Homo sapien
ttaagttactatcctggctttgccc

SEQ ID NO: 75290 - DNA, 25 bp, Homo sapien
aacctcagcaacctgtaagactgat

SEQ ID NO: 75291 - DNA, 25 bp, Homo sapien
ggttaggatccggttggactctgac

SEQ ID NO: 75292 - DNA, 25 bp, Homo sapien
ttaggatccggttggactctgacat

SEQ ID NO: 75293 - DNA, 25 bp, Homo sapien
ccggttggactctgacatcggatgc

SEQ ID NO: 75294 - DNA, 25 bp, Homo sapien
ctgacatcggatgccctcaaacata

SEQ ID NO: 75295 - DNA, 25 bp, Homo sapien
catcggatgccctcaaacatacaga

SEQ ID NO: 75296 - DNA, 25 bp, Homo sapien
ggatgccctcaaacatacagaactt

SEQ ID NO: 75297 - DNA, 25 bp, Homo sapien
gccctcaaacatacagaacttccaa

SEQ ID NO: 75298 - DNA, 25 bp, Homo sapien
tcaaacatacagaacttccaaactc

SEQ ID NO: 75299 - DNA, 25 bp, Homo sapien
caaactcaagtccagccataagcta

SEQ ID NO: 75300 - DNA, 25 bp, Homo sapien
gtccagccataagctattttgccaa

SEQ ID NO: 75301 - DNA, 25 bp, Homo sapien
agccataagctattttgccaacatg

SEQ ID NO: 75302 - DNA, 25 bp, Homo sapien
ttctggacgacgtggacagcagcgt

SEQ ID NO: 75303 - DNA, 25 bp, Homo sapien
accttgacgtggtccgcaggatcat

SEQ ID NO: 75304 - DNA, 25 bp, Homo sapien
ggtccgcaggatcatctgcagtgca

SEQ ID NO: 75305 - DNA, 25 bp, Homo sapien
ggatcatctgcagtgcaggcctcag

SEQ ID NO: 75306 - DNA, 25 bp, Homo sapien
ggcaggagaacctccccgatgagat

SEQ ID NO: 75307 - DNA, 25 bp, Homo sapien
tccccgatgagatctaccatgtcta

SEQ ID NO: 75308 - DNA, 25 bp, Homo sapien
gagatctaccatgtctatagctttg

SEQ ID NO: 75309 - DNA, 25 bp, Homo sapien
atagctttgccctgagatgagccgg

SEQ ID NO: 75310 - DNA, 25 bp, Homo sapien
tgggcaagatccaggcgccacgctg

SEQ ID NO: 75311 - DNA, 25 bp, Homo sapien
cggttcgtgagtgtcgaggcaccac

SEQ ID NO: 75312 - DNA, 25 bp, Homo sapien
gaggcaccactaaatatagctgtct

SEQ ID NO: 75313 - DNA, 25 bp, Homo sapien
agagtaagtcgggtggcaattgtca

SEQ ID NO: 75314 - DNA, 25 bp, Homo sapien
gtggcaattgtcagggtgtgggaat

SEQ ID NO: 75315 - DNA, 25 bp, Homo sapien
gggagtaggcaaactactaatcagt

SEQ ID NO: 75316 - DNA, 25 bp, Homo sapien
ggcaaactactaatcagtttagctt

SEQ ID NO: 75317 - DNA, 25 bp, Homo sapien
agtttagctttgtgttgtatgctag

SEQ ID NO: 75318 - DNA, 25 bp, Homo sapien
gctttgtgttgtatgctagtttaaa

SEQ ID NO: 75319 - DNA, 25 bp, Homo sapien
tttgttacagggtgacctgttctct

SEQ ID NO: 75320 - DNA, 25 bp, Homo sapien
ttacagggtgacctgttctctagct

SEQ ID NO: 75321 - DNA, 25 bp, Homo sapien
cctgttctctagctgtgatcttacc

SEQ ID NO: 75322 - DNA, 25 bp, Homo sapien
tgtgatcttaccacttcaaatgggt

SEQ ID NO: 75323 - DNA, 25 bp, Homo sapien
tcttaccacttcaaatgggtgtaat

SEQ ID NO: 75324 - DNA, 25 bp, Homo sapien
ttgtctacattttttgggctctgga

SEQ ID NO: 75325 - DNA, 25 bp, Homo sapien
gtctacattttttgggctctggata

SEQ ID NO: 75326 - DNA, 25 bp, Homo sapien
cattttttgggctctggataaggaa

SEQ ID NO: 75327 - DNA, 25 bp, Homo sapien
ggaattaaaggagtgcagcaataac

SEQ ID NO: 75328 - DNA, 25 bp, Homo sapien
cagcaataactgcactgtctaaaag

SEQ ID NO: 75329 - DNA, 25 bp, Homo sapien
gtctaaaagtttgtgcttattttct

SEQ ID NO: 75330 - DNA, 25 bp, Homo sapien
gtttgtgcttattttcttgtaaatt

SEQ ID NO: 75331 - DNA, 25 bp, Homo sapien
gtttatgatctatgaatgtttttct

SEQ ID NO: 75332 - DNA, 25 bp, Homo sapien
aaatgccatttgtgcaagatttctc

SEQ ID NO: 75333 - DNA, 25 bp, Homo sapien
gtgcaagatttctcaaagattaggt

SEQ ID NO: 75334 - DNA, 25 bp, Homo sapien
acatttgaaccatgaaatttcatct

SEQ ID NO: 75335 - DNA, 25 bp, Homo sapien
tgcaaggctctgtgcaatgctcaat

SEQ ID NO: 75336 - DNA, 25 bp, Homo sapien
aaggctctgtgcaatgctcaatgtg

SEQ ID NO: 75337 - DNA, 25 bp, Homo sapien
tctgtgcaatgctcaatgtggtcat

SEQ ID NO: 75338 - DNA, 25 bp, Homo sapien
aatgctcaatgtggtcatactgcta

SEQ ID NO: 75339 - DNA, 25 bp, Homo sapien
gctcaatgtggtcatactgctaatt

SEQ ID NO: 75340 - DNA, 25 bp, Homo sapien
tgtggtcatactgctaattatacaa

SEQ ID NO: 75341 - DNA, 25 bp, Homo sapien
ttatacaatatgtcactgttccctg

SEQ ID NO: 75342 - DNA, 25 bp, Homo sapien
aatatgtcactgttccctgtgcata

SEQ ID NO: 75343 - DNA, 25 bp, Homo sapien
tgtcactgttccctgtgcatagtca

SEQ ID NO: 75344 - DNA, 25 bp, Homo sapien
tgttccctgtgcatagtcactggag

SEQ ID NO: 75345 - DNA, 25 bp, Homo sapien
ccctgtgcatagtcactggagatta

SEQ ID NO: 75346 - DNA, 25 bp, Homo sapien
gacgagaatgcaaccatacctagat

SEQ ID NO: 75347 - DNA, 25 bp, Homo sapien
atacctagatggacttttccacaag

SEQ ID NO: 75348 - DNA, 25 bp, Homo sapien
ggacttttccacaagctaaagctgg

SEQ ID NO: 75349 - DNA, 25 bp, Homo sapien
caagctaaagctggcctcttgatct

SEQ ID NO: 75350 - DNA, 25 bp, Homo sapien
agttaatttctgtctccttggtcca

SEQ ID NO: 75351 - DNA, 25 bp, Homo sapien
tggtccattccttctctctaataat

SEQ ID NO: 75352 - DNA, 25 bp, Homo sapien
tactgttcctcaaagaattgtctac

SEQ ID NO: 75353 - DNA, 25 bp, Homo sapien
attgtctacattacccatctcctct

SEQ ID NO: 75354 - DNA, 25 bp, Homo sapien
atctcctcttttgcctctgagaaag

SEQ ID NO: 75355 - DNA, 25 bp, Homo sapien
gggtaatattctgtggtcctcagcc

SEQ ID NO: 75356 - DNA, 25 bp, Homo sapien
tcctcagccctgtaccttaataaat

SEQ ID NO: 75357 - DNA, 25 bp, Homo sapien
acccaattcgtcttggtctggcact

SEQ ID NO: 75358 - DNA, 25 bp, Homo sapien
aattgctgaattggatacgctgaat

SEQ ID NO: 75359 - DNA, 25 bp, Homo sapien
gatacgctgaatgaagagtcttata

SEQ ID NO: 75360 - DNA, 25 bp, Homo sapien
agacagcactctgatcatgcagtta

SEQ ID NO: 75361 - DNA, 25 bp, Homo sapien
cactctgatcatgcagttacttagg

SEQ ID NO: 75362 - DNA, 25 bp, Homo sapien
gttacttagggacaatctcactctg

SEQ ID NO: 75363 - DNA, 25 bp, Homo sapien
aatctcactctgtggacatcggaaa

SEQ ID NO: 75364 - DNA, 25 bp, Homo sapien
gtggacatcggaaaaccagggagac

SEQ ID NO: 75365 - DNA, 25 bp, Homo sapien
gaactaatgtttctcgtgctttgtg

SEQ ID NO: 75366 - DNA, 25 bp, Homo sapien
aatgtttctcgtgctttgtgatctg

SEQ ID NO: 75367 - DNA, 25 bp, Homo sapien
tgtcactctgtaccctcaacatata

SEQ ID NO: 75368 - DNA, 25 bp, Homo sapien
gaaaccactgattccagccaaactg

SEQ ID NO: 75369 - DNA, 25 bp, Homo sapien
aactgcctgaagagcaactagctgt

SEQ ID NO: 75370 - DNA, 25 bp, Homo sapien
gcaactagctgtcatatcttatcaa

SEQ ID NO: 75371 - DNA, 25 bp, Homo sapien
tatatagtacattcgcagcctaccc

SEQ ID NO: 75372 - DNA, 25 bp, Homo sapien
ctttggcttcagtctcatactggtc

SEQ ID NO: 75373 - DNA, 25 bp, Homo sapien
tctcatactggtcaacttcacacat

SEQ ID NO: 75374 - DNA, 25 bp, Homo sapien
ggtgttgctgatgtgttttttcttc

SEQ ID NO: 75375 - DNA, 25 bp, Homo sapien
agtactgtattcttttccccttgtg

SEQ ID NO: 75376 - DNA, 25 bp, Homo sapien
ctcagccaagtgttgcttatgtgta

SEQ ID NO: 75377 - DNA, 25 bp, Homo sapien
gtgttaagtttgctctagttgacct

SEQ ID NO: 75378 - DNA, 25 bp, Homo sapien
ctagttgaccttttaccacagctac

SEQ ID NO: 75379 - DNA, 25 bp, Homo sapien
tgccaagccaaatgtgcttcctgca

SEQ ID NO: 75380 - DNA, 25 bp, Homo sapien
ccaagccaaatgtgcttcctgcagc

SEQ ID NO: 75381 - DNA, 25 bp, Homo sapien
ccaaatgtgcttcctgcagctcacg

SEQ ID NO: 75382 - DNA, 25 bp, Homo sapien
aaatgtgcttcctgcagctcacgcc

SEQ ID NO: 75383 - DNA, 25 bp, Homo sapien
caccagctactgaagggacccaagg

SEQ ID NO: 75384 - DNA, 25 bp, Homo sapien
accagctactgaagggacccaaggc

SEQ ID NO: 75385 - DNA, 25 bp, Homo sapien
gctactgaagggacccaaggcaccc

SEQ ID NO: 75386 - DNA, 25 bp, Homo sapien
tgaagccagcgatagagggtccctc

SEQ ID NO: 75387 - DNA, 25 bp, Homo sapien
gaagccagcgatagagggtccctct

SEQ ID NO: 75388 - DNA, 25 bp, Homo sapien
aagccagcgatagagggtccctctc

SEQ ID NO: 75389 - DNA, 25 bp, Homo sapien
agcgatagagggtccctctctgctc

SEQ ID NO: 75390 - DNA, 25 bp, Homo sapien
gtttctgatggatgttgaatggcgt

SEQ ID NO: 75391 - DNA, 25 bp, Homo sapien
gttgaatggcgtggactcgctactc

SEQ ID NO: 75392 - DNA, 25 bp, Homo sapien
tggactcgctactccgttcttcaca

SEQ ID NO: 75393 - DNA, 25 bp, Homo sapien
gacaagaaggagtgtatggcttata

SEQ ID NO: 75394 - DNA, 25 bp, Homo sapien
taaacaaactagacattttcttacg

SEQ ID NO: 75395 - DNA, 25 bp, Homo sapien
agcatattttatgttctcccattga

SEQ ID NO: 75396 - DNA, 25 bp, Homo sapien
ttatgttctcccattgactcaatca

SEQ ID NO: 75397 - DNA, 25 bp, Homo sapien
tgactcaatcatgacaatatttctg

SEQ ID NO: 75398 - DNA, 25 bp, Homo sapien
gacaatatttctgctttaacaccat

SEQ ID NO: 75399 - DNA, 25 bp, Homo sapien
gctttaacaccatctttcatgatta

SEQ ID NO: 75400 - DNA, 25 bp, Homo sapien
gttattggaaatgttacaccatgta

SEQ ID NO: 75401 - DNA, 25 bp, Homo sapien
attactgcctttgctgggcaaccaa

SEQ ID NO: 75402 - DNA, 25 bp, Homo sapien
gcttgggctgaaggagataacttat

SEQ ID NO: 75403 - DNA, 25 bp, Homo sapien
gataacttattaatctgtcgaaggc

SEQ ID NO: 75404 - DNA, 25 bp, Homo sapien
tattaatctgtcgaaggcttatgcc

SEQ ID NO: 75405 - DNA, 25 bp, Homo sapien
ggtctcatcccacactcttgagaag

SEQ ID NO: 75406 - DNA, 25 bp, Homo sapien
agccttggtcactacagtggtcgca

SEQ ID NO: 75407 - DNA, 25 bp, Homo sapien
ggtcactacagtggtcgcacatgtt

SEQ ID NO: 75408 - DNA, 25 bp, Homo sapien
tacagtggtcgcacatgttcctctt

SEQ ID NO: 75409 - DNA, 25 bp, Homo sapien
ctgttcctgttgacatgtcgttgtt

SEQ ID NO: 75410 - DNA, 25 bp, Homo sapien
gttcctgttgacatgtcgttgttta

SEQ ID NO: 75411 - DNA, 25 bp, Homo sapien
gttgacatgtcgttgtttaaataaa

SEQ ID NO: 75412 - DNA, 25 bp, Homo sapien
tcttaacggttgcagggtaaccgat

SEQ ID NO: 75413 - DNA, 25 bp, Homo sapien
caacttcaggttaactctgagagct

SEQ ID NO: 75414 - DNA, 25 bp, Homo sapien
ggttaactctgagagctatcaaact

SEQ ID NO: 75415 - DNA, 25 bp, Homo sapien
agctatcaaactatgggccaaacgc

SEQ ID NO: 75416 - DNA, 25 bp, Homo sapien
aactatgggccaaacgccacaacat

SEQ ID NO: 75417 - DNA, 25 bp, Homo sapien
tgggccaaacgccacaacatctatt

SEQ ID NO: 75418 - DNA, 25 bp, Homo sapien
aaacgccacaacatctattccaata

SEQ ID NO: 75419 - DNA, 25 bp, Homo sapien
acgccacaacatctattccaatata

SEQ ID NO: 75420 - DNA, 25 bp, Homo sapien
atgcaatagcatcaactcttgtaca

SEQ ID NO: 75421 - DNA, 25 bp, Homo sapien
aatagcatcaactcttgtacataaa

SEQ ID NO: 75422 - DNA, 25 bp, Homo sapien
tcaactcttgtacataaatttttct

SEQ ID NO: 75423 - DNA, 25 bp, Homo sapien
gcaactgtgagtccctgcttcccga

SEQ ID NO: 75424 - DNA, 25 bp, Homo sapien
cccgacaccagcctcatggaatatg

SEQ ID NO: 75425 - DNA, 25 bp, Homo sapien
gacaccagcctcatggaatatgcaa

SEQ ID NO: 75426 - DNA, 25 bp, Homo sapien
ggaatatgcaacaactcctgtaccc

SEQ ID NO: 75427 - DNA, 25 bp, Homo sapien
tatgcaacaactcctgtaccccagt

SEQ ID NO: 75428 - DNA, 25 bp, Homo sapien
tgtaccccagtccacggtgttctgg

SEQ ID NO: 75429 - DNA, 25 bp, Homo sapien
ccacggtgttctggcagcagggaca

SEQ ID NO: 75430 - DNA, 25 bp, Homo sapien
cggtgttctggcagcagggacacct

SEQ ID NO: 75431 - DNA, 25 bp, Homo sapien
ctggcagcagggacacctgggccaa

SEQ ID NO: 75432 - DNA, 25 bp, Homo sapien
gggccaatgggccatctggaccaaa

SEQ ID NO: 75433 - DNA, 25 bp, Homo sapien
attactgtttcaccagagctgtctt

SEQ ID NO: 75434 - DNA, 25 bp, Homo sapien
cagctctgttccatgtaagttgcca

SEQ ID NO: 75435 - DNA, 25 bp, Homo sapien
gctctgttccatgtaagttgccaac

SEQ ID NO: 75436 - DNA, 25 bp, Homo sapien
tgttccatgtaagttgccaacagtt

SEQ ID NO: 75437 - DNA, 25 bp, Homo sapien
gtaagttgccaacagtttcactgaa

SEQ ID NO: 75438 - DNA, 25 bp, Homo sapien
gttgccaacagtttcactgaacagt

SEQ ID NO: 75439 - DNA, 25 bp, Homo sapien
ggtatgtgatggttttggcatgaca

SEQ ID NO: 75440 - DNA, 25 bp, Homo sapien
ggttttggcatgacatcttcagtat

SEQ ID NO: 75441 - DNA, 25 bp, Homo sapien
gggacagtttgacttcactttgagg

SEQ ID NO: 75442 - DNA, 25 bp, Homo sapien
cagtttgacttcactttgagggtgt

SEQ ID NO: 75443 - DNA, 25 bp, Homo sapien
actttgagggtgtgatgtctgtagc

SEQ ID NO: 75444 - DNA, 25 bp, Homo sapien
gtgtgatgtctgtagctatgtggaa

SEQ ID NO: 75445 - DNA, 25 bp, Homo sapien
tcttaacggttgcagggtaaccgat

SEQ ID NO: 75446 - DNA, 25 bp, Homo sapien
caacttcaggttaactctgagagct

SEQ ID NO: 75447 - DNA, 25 bp, Homo sapien
ggttaactctgagagctatcaaact

SEQ ID NO: 75448 - DNA, 25 bp, Homo sapien
agctatcaaactatgggccaaacgc

SEQ ID NO: 75449 - DNA, 25 bp, Homo sapien
tgggccaaacgccacaacatctatt

SEQ ID NO: 75450 - DNA, 25 bp, Homo sapien
acgccacaacatctattccaatata

SEQ ID NO: 75451 - DNA, 25 bp, Homo sapien
caatatattaggtttcctcggtggt

SEQ ID NO: 75452 - DNA, 25 bp, Homo sapien
gtttcctgggctatgctagtagcaa

SEQ ID NO: 75453 - DNA, 25 bp, Homo sapien
agaacttgccagctttatccaaatg

SEQ ID NO: 75454 - DNA, 25 bp, Homo sapien
atgcaatagcatcaactcttgtaca

SEQ ID NO: 75455 - DNA, 25 bp, Homo sapien
gcatcaactcttgtacataaatttt

SEQ ID NO: 75456 - DNA, 25 bp, Homo sapien
cccgacaccagcctcatggaatatg

SEQ ID NO: 75457 - DNA, 25 bp, Homo sapien
ccgacaccagcctcatggaatatgc

SEQ ID NO: 75458 - DNA, 25 bp, Homo sapien
cgacaccagcctcatggaatatgca

SEQ ID NO: 75459 - DNA, 25 bp, Homo sapien
gacaccagcctcatggaatatgcaa

SEQ ID NO: 75460 - DNA, 25 bp, Homo sapien
acaccagcctcatggaatatgcaac

SEQ ID NO: 75461 - DNA, 25 bp, Homo sapien
caccagcctcatggaatatgcaaca

SEQ ID NO: 75462 - DNA, 25 bp, Homo sapien
accagcctcatggaatatgcaacaa

SEQ ID NO: 75463 - DNA, 25 bp, Homo sapien
ctgtaccccagtccacggtgttctg

SEQ ID NO: 75464 - DNA, 25 bp, Homo sapien
tgtaccccagtccacggtgttctgg

SEQ ID NO: 75465 - DNA, 25 bp, Homo sapien
ccacggtgttctggcagcagggaca

SEQ ID NO: 75466 - DNA, 25 bp, Homo sapien
cggtgttctggcagcagggacacct

SEQ ID NO: 75467 - DNA, 25 bp, Homo sapien
tgcgactgcgaaaagagaaccagat

SEQ ID NO: 75468 - DNA, 25 bp, Homo sapien
gagagaacaagattctggccagttt

SEQ ID NO: 75469 - DNA, 25 bp, Homo sapien
caagattctggccagttttcgagaa

SEQ ID NO: 75470 - DNA, 25 bp, Homo sapien
gattctggccagttttcgagaaatg

SEQ ID NO: 75471 - DNA, 25 bp, Homo sapien
gccagttttcgagaaatggtttaca

SEQ ID NO: 75472 - DNA, 25 bp, Homo sapien
aaagtctgggttccacacatacata

SEQ ID NO: 75473 - DNA, 25 bp, Homo sapien
gtctgggttccacacatacatagaa

SEQ ID NO: 75474 - DNA, 25 bp, Homo sapien
gttctgagaaagctttacagtgcta

SEQ ID NO: 75475 - DNA, 25 bp, Homo sapien
tacagtgctactgtgccttctattt

SEQ ID NO: 75476 - DNA, 25 bp, Homo sapien
cagtgctactgtgccttctatttaa

SEQ ID NO: 75477 - DNA, 25 bp, Homo sapien
atttaattctttcagtccttcaata

SEQ ID NO: 75478 - DNA, 25 bp, Homo sapien
gtgtcatgctaaagaatgactgctt

SEQ ID NO: 75479 - DNA, 25 bp, Homo sapien
gctaaagaatgactgctttcaggaa

SEQ ID NO: 75480 - DNA, 25 bp, Homo sapien
aagaatgactgctttcaggaatttt

SEQ ID NO: 75481 - DNA, 25 bp, Homo sapien
cagctcaactacctccaacacctat

SEQ ID NO: 75482 - DNA, 25 bp, Homo sapien
aacacctatcactcagtcggtgcta

SEQ ID NO: 75483 - DNA, 25 bp, Homo sapien
acctatcactcagtcggtgctatga

SEQ ID NO: 75484 - DNA, 25 bp, Homo sapien
atcactcagtcggtgctatgatata

SEQ ID NO: 75485 - DNA, 25 bp, Homo sapien
cactcagtcggtgctatgatataat

SEQ ID NO: 75486 - DNA, 25 bp, Homo sapien
gtcggtgctatgatataatacctga

SEQ ID NO: 75487 - DNA, 25 bp, Homo sapien
gtgctatgatataatacctgaaact

SEQ ID NO: 75488 - DNA, 25 bp, Homo sapien
atgatataatacctgaaactttact

SEQ ID NO: 75489 - DNA, 25 bp, Homo sapien
tctctcttgcctctatgcctgtatt

SEQ ID NO: 75490 - DNA, 25 bp, Homo sapien
atgcctgtatttctggcaatatgac

SEQ ID NO: 75491 - DNA, 25 bp, Homo sapien
tatttctggcaatatgacaggcctg

SEQ ID NO: 75492 - DNA, 25 bp, Homo sapien
aatatgacaggcctgcctacccaag

SEQ ID NO: 75493 - DNA, 25 bp, Homo sapien
tgcctacccaagatcagaactccaa

SEQ ID NO: 75494 - DNA, 25 bp, Homo sapien
aagatcagaactccaaaaccactcc

SEQ ID NO: 75495 - DNA, 25 bp, Homo sapien
aggtcctcagctccatgggaaataa

SEQ ID NO: 75496 - DNA, 25 bp, Homo sapien
gtcacttggagtcacagcaaagttc

SEQ ID NO: 75497 - DNA, 25 bp, Homo sapien
gagtcacagcaaagttctcttcctc

SEQ ID NO: 75498 - DNA, 25 bp, Homo sapien
ttgctgctccttggttatagaacat

SEQ ID NO: 75499 - DNA, 25 bp, Homo sapien
gctccttggttatagaacatggtaa

SEQ ID NO: 75500 - DNA, 25 bp, Homo sapien
caatcacgggcggtcctgcacagat

SEQ ID NO: 75501 - DNA, 25 bp, Homo sapien
aatcacgggcggtcctgcacagatt

SEQ ID NO: 75502 - DNA, 25 bp, Homo sapien
atcacgggcggtcctgcacagattc

SEQ ID NO: 75503 - DNA, 25 bp, Homo sapien
tcacgggcggtcctgcacagattcc

SEQ ID NO: 75504 - DNA, 25 bp, Homo sapien
cgggcggtcctgcacagattcccag

SEQ ID NO: 75505 - DNA, 25 bp, Homo sapien
gggcggtcctgcacagattcccagg

SEQ ID NO: 75506 - DNA, 25 bp, Homo sapien
ggcggtcctgcacagattcccaggc

SEQ ID NO: 75507 - DNA, 25 bp, Homo sapien
gcggtcctgcacagattcccaggcc

SEQ ID NO: 75508 - DNA, 25 bp, Homo sapien
aaggggaaacgtctcccagatcgct

SEQ ID NO: 75509 - DNA, 25 bp, Homo sapien
ggaaacgtctcccagatcgctccct

SEQ ID NO: 75510 - DNA, 25 bp, Homo sapien
ctcccagatcgctcccttggctttg

SEQ ID NO: 75511 - DNA, 25 bp, Homo sapien
ataactatcagcagagttgttccag

SEQ ID NO: 75512 - DNA, 25 bp, Homo sapien
tcagcagagttgttccagattaaaa

SEQ ID NO: 75513 - DNA, 25 bp, Homo sapien
ggagttaggacatgcaagctactga

SEQ ID NO: 75514 - DNA, 25 bp, Homo sapien
ggacatgcaagctactgagcataaa

SEQ ID NO: 75515 - DNA, 25 bp, Homo sapien
ttattccaagcgcagggcccaaatg

SEQ ID NO: 75516 - DNA, 25 bp, Homo sapien
gcagggcccaaatgttatagccaaa

SEQ ID NO: 75517 - DNA, 25 bp, Homo sapien
aagtgaggcaaatttcagccaagaa

SEQ ID NO: 75518 - DNA, 25 bp, Homo sapien
gaacaaattgtggatcatggtatat

SEQ ID NO: 75519 - DNA, 25 bp, Homo sapien
atcatggtatatgcaggctatcagc

SEQ ID NO: 75520 - DNA, 25 bp, Homo sapien
ggctatcagcagaaggatcagacaa

SEQ ID NO: 75521 - DNA, 25 bp, Homo sapien
gagttagtgcaaaccatttagtaaa

SEQ ID NO: 75522 - DNA, 25 bp, Homo sapien
aaccgtagttgcaagaatataccat

SEQ ID NO: 75523 - DNA, 25 bp, Homo sapien
gttgcaagaatataccatgaagatt

SEQ ID NO: 75524 - DNA, 25 bp, Homo sapien
aagattaaagtaggctgggtttcat

SEQ ID NO: 75525 - DNA, 25 bp, Homo sapien
aagtaggctgggtttcatttccatc

SEQ ID NO: 75526 - DNA, 25 bp, Homo sapien
ttcccacacatctcattgaatttga

SEQ ID NO: 75527 - DNA, 25 bp, Homo sapien
atctcattgaatttgatggttgact

SEQ ID NO: 75528 - DNA, 25 bp, Homo sapien
atttgatggttgacttaattggcac

SEQ ID NO: 75529 - DNA, 25 bp, Homo sapien
ggttgacttaattggcaccataact

SEQ ID NO: 75530 - DNA, 25 bp, Homo sapien
aattggcaccataactttgtatgat

SEQ ID NO: 75531 - DNA, 25 bp, Homo sapien
atatgaaatagcctgtacattttaa

SEQ ID NO: 75532 - DNA, 25 bp, Homo sapien
gttgtcaccaagttatataaatcca

SEQ ID NO: 75533 - DNA, 25 bp, Homo sapien
tggtataaggatcttctacccctct

SEQ ID NO: 75534 - DNA, 25 bp, Homo sapien
ccaggcaccattgctggtgaaatag

SEQ ID NO: 75535 - DNA, 25 bp, Homo sapien
gaatcaaaggctgcaaacctcaata

SEQ ID NO: 75536 - DNA, 25 bp, Homo sapien
ataatttggtagtggaagcctatca

SEQ ID NO: 75537 - DNA, 25 bp, Homo sapien
gaagcctatcagaagctcatttcag

SEQ ID NO: 75538 - DNA, 25 bp, Homo sapien
gaaaaccaggtacaaggcatctatt

SEQ ID NO: 75539 - DNA, 25 bp, Homo sapien
caggtacaaggcatctattttaaca

SEQ ID NO: 75540 - DNA, 25 bp, Homo sapien
attttaacattaccgccatctgtcc

SEQ ID NO: 75541 - DNA, 25 bp, Homo sapien
catctgtccagatgggtccagaaag

SEQ ID NO: 75542 - DNA, 25 bp, Homo sapien
atggaaggatgcagaaacgtgacga

SEQ ID NO: 75543 - DNA, 25 bp, Homo sapien
gaaacgtgacgagcaatgatgaagt

SEQ ID NO: 75544 - DNA, 25 bp, Homo sapien
actcactcactttgggcttctagcc

SEQ ID NO: 75545 - DNA, 25 bp, Homo sapien
ttctagcctcaccttttctttctgg

SEQ ID NO: 75546 - DNA, 25 bp, Homo sapien
tctttctggtttgaacttgctcgga

SEQ ID NO: 75547 - DNA, 25 bp, Homo sapien
gaacttgctcggaaagcgtaagaca

SEQ ID NO: 75548 - DNA, 25 bp, Homo sapien
gacaagatgaagagcaggcgccatt

SEQ ID NO: 75549 - DNA, 25 bp, Homo sapien
gagcaggcgccattataaatatcaa

SEQ ID NO: 75550 - DNA, 25 bp, Homo sapien
gatgatgagaccaattacaggccgt

SEQ ID NO: 75551 - DNA, 25 bp, Homo sapien
aattacaggccgtctctctgcacag

SEQ ID NO: 75552 - DNA, 25 bp, Homo sapien
ctctctgcacagcacagaaattctc

SEQ ID NO: 75553 - DNA, 25 bp, Homo sapien
atagttgattgtactgttctcatgc

SEQ ID NO: 75554 - DNA, 25 bp, Homo sapien
aagtggacaggtactctacaacaaa

SEQ ID NO: 75555 - DNA, 25 bp, Homo sapien
gttacttctgtatccagtgtcctaa

SEQ ID NO: 75556 - DNA, 25 bp, Homo sapien
tgtatccagtgtcctaaagttttag

SEQ ID NO: 75557 - DNA, 25 bp, Homo sapien
gtttgcttatatgagcttagcgtaa

SEQ ID NO: 75558 - DNA, 25 bp, Homo sapien
aaacttcgtgttttgtcatcagcat

SEQ ID NO: 75559 - DNA, 25 bp, Homo sapien
gttttgtcatcagcatcttttctat

SEQ ID NO: 75560 - DNA, 25 bp, Homo sapien
cagcatcttttctattaagaggtaa

SEQ ID NO: 75561 - DNA, 25 bp, Homo sapien
gaggtaaaatgtagtccttgtttga

SEQ ID NO: 75562 - DNA, 25 bp, Homo sapien
ccttgtttgactcttgacaatccag

SEQ ID NO: 75563 - DNA, 25 bp, Homo sapien
gactcttgacaatccagtgtgtttg

SEQ ID NO: 75564 - DNA, 25 bp, Homo sapien
ggaaggaaactgcaccagtgtctat

SEQ ID NO: 75565 - DNA, 25 bp, Homo sapien
gaaactgcaccagtgtctattcctg

SEQ ID NO: 75566 - DNA, 25 bp, Homo sapien
gggacactgtctgcctggacacgct

SEQ ID NO: 75567 - DNA, 25 bp, Homo sapien
gacactgtctgcctggacacgctgc

SEQ ID NO: 75568 - DNA, 25 bp, Homo sapien
ggccgccagggttacagcctcggca

SEQ ID NO: 75569 - DNA, 25 bp, Homo sapien
cagggttacagcctcggcagcctct

SEQ ID NO: 75570 - DNA, 25 bp, Homo sapien
tacttccgggcagagccaagcgcag

SEQ ID NO: 75571 - DNA, 25 bp, Homo sapien
caagcgcagcccactcagccgaggg

SEQ ID NO: 75572 - DNA, 25 bp, Homo sapien
agccgagggcgacgtgcacaccctg

SEQ ID NO: 75573 - DNA, 25 bp, Homo sapien
agctgctcgcctgggccgatgagca

SEQ ID NO: 75574 - DNA, 25 bp, Homo sapien
gtgggtgggcccacatcgagcccat

SEQ ID NO: 75575 - DNA, 25 bp, Homo sapien
ggtgggcccacatcgagcccatgta

SEQ ID NO: 75576 - DNA, 25 bp, Homo sapien
agcccatgtacttgccgcctgatga

SEQ ID NO: 75577 - DNA, 25 bp, Homo sapien
ctgctgcgccacaccagtgggctga

SEQ ID NO: 75578 - DNA, 25 bp, Homo sapien
tgagcaagttaagcctggagacgta

SEQ ID NO: 75579 - DNA, 25 bp, Homo sapien
gttaagcctggagacgtatcctgcc

SEQ ID NO: 75580 - DNA, 25 bp, Homo sapien
tggagacgtatcctgcccctgagga

SEQ ID NO: 75581 - DNA, 25 bp, Homo sapien
ctgcccctgaggagagtttgaattc

SEQ ID NO: 75582 - DNA, 25 bp, Homo sapien
agtttgaattccttggttcgtgtca

SEQ ID NO: 75583 - DNA, 25 bp, Homo sapien
ccttggttcgtgtcaattgggagat

SEQ ID NO: 75584 - DNA, 25 bp, Homo sapien
ggctcatcaccgtctgaggaactgg

SEQ ID NO: 75585 - DNA, 25 bp, Homo sapien
ggaactggagctccatctttgctgc

SEQ ID NO: 75586 - DNA, 25 bp, Homo sapien
tccatctttgctgctagggaaggcg

SEQ ID NO: 75587 - DNA, 25 bp, Homo sapien
tttgctgctagggaaggcgtgccca

SEQ ID NO: 75588 - DNA, 25 bp, Homo sapien
gagtaagagtcttgcttttcattta

SEQ ID NO: 75589 - DNA, 25 bp, Homo sapien
gtcttgcttttcatttatactggga

SEQ ID NO: 75590 - DNA, 25 bp, Homo sapien
tttcatttatactgggaaacccatg

SEQ ID NO: 75591 - DNA, 25 bp, Homo sapien
gggaaacccatgttatttcttgaat

SEQ ID NO: 75592 - DNA, 25 bp, Homo sapien
gttatttcttgaattcagacactac

SEQ ID NO: 75593 - DNA, 25 bp, Homo sapien
gaattcagacactacaagagcagag

SEQ ID NO: 75594 - DNA, 25 bp, Homo sapien
caagagcagaggattaaggtttttt

SEQ ID NO: 75595 - DNA, 25 bp, Homo sapien
ttaattcttgccttacctgtacctc

SEQ ID NO: 75596 - DNA, 25 bp, Homo sapien
gtacctcttagtgtaccctatgtac

SEQ ID NO: 75597 - DNA, 25 bp, Homo sapien
gtaccctatgtacctgaatttgctt

SEQ ID NO: 75598 - DNA, 25 bp, Homo sapien
tatgaataaataagtccccctgaaa

SEQ ID NO: 75599 - DNA, 25 bp, Homo sapien
gccagcaattttaatctagcagtgt

SEQ ID NO: 75600 - DNA, 25 bp, Homo sapien
ctagcagtgttgaagctgggaattt

SEQ ID NO: 75601 - DNA, 25 bp, Homo sapien
aattttttggcgcaatccatgtagc

SEQ ID NO: 75602 - DNA, 25 bp, Homo sapien
tttttggcgcaatccatgtagcagt

SEQ ID NO: 75603 - DNA, 25 bp, Homo sapien
ggcgcaatccatgtagcagtgaccc

SEQ ID NO: 75604 - DNA, 25 bp, Homo sapien
caatccatgtagcagtgacccaggc

SEQ ID NO: 75605 - DNA, 25 bp, Homo sapien
tgacccaggcttgggagccagaaac

SEQ ID NO: 75606 - DNA, 25 bp, Homo sapien
tgggagccagaaacaagtgtgacct

SEQ ID NO: 75607 - DNA, 25 bp, Homo sapien
cctgggattttatttaacacaactg

SEQ ID NO: 75608 - DNA, 25 bp, Homo sapien
gtggacaatgtaaccctaaacacat

SEQ ID NO: 75609 - DNA, 25 bp, Homo sapien
aatgtaaccctaaacacatcatgta

SEQ ID NO: 75610 - DNA, 25 bp, Homo sapien
atattgctgtttatgttatttagga

SEQ ID NO: 75611 - DNA, 25 bp, Homo sapien
gttatttaggagtaagattcttgct

SEQ ID NO: 75612 - DNA, 25 bp, Homo sapien
agattcttgcttttgagtcacatgg

SEQ ID NO: 75613 - DNA, 25 bp, Homo sapien
gattcttgcttttgagtcacatggg

SEQ ID NO: 75614 - DNA, 25 bp, Homo sapien
ttttgagtcacatggggaaatccct

SEQ ID NO: 75615 - DNA, 25 bp, Homo sapien
aaatccctgttattttgtgaattgg

SEQ ID NO: 75616 - DNA, 25 bp, Homo sapien
gtgaattgggacaagataacatagc

SEQ ID NO: 75617 - DNA, 25 bp, Homo sapien
tttttgaaacttgaacttagcagca

SEQ ID NO: 75618 - DNA, 25 bp, Homo sapien
aacttagcagcaaaatagagctcat

SEQ ID NO: 75619 - DNA, 25 bp, Homo sapien
atatacatgtatacctggatttgct

SEQ ID NO: 75620 - DNA, 25 bp, Homo sapien
catgtatacctggatttgcttggct

SEQ ID NO: 75621 - DNA, 25 bp, Homo sapien
tgcaaagaacacagtccaaggattt

SEQ ID NO: 75622 - DNA, 25 bp, Homo sapien
agtccaaggatttaaaagattccat

SEQ ID NO: 75623 - DNA, 25 bp, Homo sapien
gattccatggccgagcattctctga

SEQ ID NO: 75624 - DNA, 25 bp, Homo sapien
atggccgagcattctctgatccatt

SEQ ID NO: 75625 - DNA, 25 bp, Homo sapien
gagcattctctgatccatttgtgga

SEQ ID NO: 75626 - DNA, 25 bp, Homo sapien
gcattctctgatccatttgtggagg

SEQ ID NO: 75627 - DNA, 25 bp, Homo sapien
gaggcagaaaaatctaaccttgcat

SEQ ID NO: 75628 - DNA, 25 bp, Homo sapien
tctaaccttgcatatgatattgtgc

SEQ ID NO: 75629 - DNA, 25 bp, Homo sapien
aaccttgcatatgatattgtgcagt

SEQ ID NO: 75630 - DNA, 25 bp, Homo sapien
gcctacaggattaacaggtataaag

SEQ ID NO: 75631 - DNA, 25 bp, Homo sapien
gattaacaggtataaaggtgacata

SEQ ID NO: 75632 - DNA, 25 bp, Homo sapien
gggcccaatatctgctgcgcggaag

SEQ ID NO: 75633 - DNA, 25 bp, Homo sapien
gcccaatatctgctgcgcggaagag

SEQ ID NO: 75634 - DNA, 25 bp, Homo sapien
ccaatatctgctgcgcggaagagct

SEQ ID NO: 75635 - DNA, 25 bp, Homo sapien
aatatctgctgcgcggaagagctgg

SEQ ID NO: 75636 - DNA, 25 bp, Homo sapien
tgggcaccgccgaagcgctgcgctg

SEQ ID NO: 75637 - DNA, 25 bp, Homo sapien
cgctgcgcggtcttgggcctctgct

SEQ ID NO: 75638 - DNA, 25 bp, Homo sapien
gaccctgcctgcgacgcggaagcca

SEQ ID NO: 75639 - DNA, 25 bp, Homo sapien
ttctcccagcgctgaaacttgatgg

SEQ ID NO: 75640 - DNA, 25 bp, Homo sapien
gaaacttgatggctccgaacaccct

SEQ ID NO: 75641 - DNA, 25 bp, Homo sapien
ttgatggctccgaacaccctcgaag

SEQ ID NO: 75642 - DNA, 25 bp, Homo sapien
gatggctccgaacaccctcgaagcg

SEQ ID NO: 75643 - DNA, 25 bp, Homo sapien
ctataacaaaagtattaccttatct

SEQ ID NO: 75644 - DNA, 25 bp, Homo sapien
taagtgattctaaaactagcgattt

SEQ ID NO: 75645 - DNA, 25 bp, Homo sapien
ctagcgatttagttaattcatttaa

SEQ ID NO: 75646 - DNA, 25 bp, Homo sapien
aggttgaatcttattatgttttagg

SEQ ID NO: 75647 - DNA, 25 bp, Homo sapien
atgttttaggtttaactattgcatt

SEQ ID NO: 75648 - DNA, 25 bp, Homo sapien
ggtttaactattgcattattgtctt

SEQ ID NO: 75649 - DNA, 25 bp, Homo sapien
actattgcattattgtcttatttaa

SEQ ID NO: 75650 - DNA, 25 bp, Homo sapien
gtatcaacattaaagactattgtca

SEQ ID NO: 75651 - DNA, 25 bp, Homo sapien
gactattgtcacgagtattgaaatg

SEQ ID NO: 75652 - DNA, 25 bp, Homo sapien
ttcaataatcccaaatttgagttat

SEQ ID NO: 75653 - DNA, 25 bp, Homo sapien
aatcccaaatttgagttatttagtg

SEQ ID NO: 75654 - DNA, 25 bp, Homo sapien
acagcagtttgtaaactatgcaact

SEQ ID NO: 75655 - DNA, 25 bp, Homo sapien
aactgaggatgattgttagctccac

SEQ ID NO: 75656 - DNA, 25 bp, Homo sapien
atgattgttagctccacgagtgcaa

SEQ ID NO: 75657 - DNA, 25 bp, Homo sapien
tagctccacgagtgcaaactgcagt

SEQ ID NO: 75658 - DNA, 25 bp, Homo sapien
caaactgcagtcaccaagtaaaaca

SEQ ID NO: 75659 - DNA, 25 bp, Homo sapien
aacaacaaatagctaccacttttgc

SEQ ID NO: 75660 - DNA, 25 bp, Homo sapien
cgcctgtgccaacaagttgatatta

SEQ ID NO: 75661 - DNA, 25 bp, Homo sapien
gaagaaattgctagattacccaaag

SEQ ID NO: 75662 - DNA, 25 bp, Homo sapien
gctgttcaacttgaaaatgagctgg

SEQ ID NO: 75663 - DNA, 25 bp, Homo sapien
gaattttactaagcagtttctacct

SEQ ID NO: 75664 - DNA, 25 bp, Homo sapien
gcagtttctaccttcaagcaatgaa

SEQ ID NO: 75665 - DNA, 25 bp, Homo sapien
ggttattgaaaggactagccacata

SEQ ID NO: 75666 - DNA, 25 bp, Homo sapien
ggactagccacatactagcatctta

SEQ ID NO: 75667 - DNA, 25 bp, Homo sapien
gccacatactagcatcttagtgcct

SEQ ID NO: 75668 - DNA, 25 bp, Homo sapien
actagcatcttagtgcctttatctg

SEQ ID NO: 75669 - DNA, 25 bp, Homo sapien
catcttagtgcctttatctgtcttt

SEQ ID NO: 75670 - DNA, 25 bp, Homo sapien
ggtagataccaaatgaaacactttc

SEQ ID NO: 75671 - DNA, 25 bp, Homo sapien
ttcctcttgcagttgttctttaatc

SEQ ID NO: 75672 - DNA, 25 bp, Homo sapien
ttgcagttgttctttaatctccttt

SEQ ID NO: 75673 - DNA, 25 bp, Homo sapien
atttttctagtatataacgcaggcc

SEQ ID NO: 75674 - DNA, 25 bp, Homo sapien
ttctagtatataacgcaggcctttt

SEQ ID NO: 75675 - DNA, 25 bp, Homo sapien
tataacgcaggccttttattttcta

SEQ ID NO: 75676 - DNA, 25 bp, Homo sapien
tgaagtactcacacatgccacaaca

SEQ ID NO: 75677 - DNA, 25 bp, Homo sapien
agaagccaggtgcaaaagcccacat

SEQ ID NO: 75678 - DNA, 25 bp, Homo sapien
aagcccacatattgtctgactgcat

SEQ ID NO: 75679 - DNA, 25 bp, Homo sapien
atattgtctgactgcattgaaatgc

SEQ ID NO: 75680 - DNA, 25 bp, Homo sapien
gcaatgtctaaaatggacgaatcta

SEQ ID NO: 75681 - DNA, 25 bp, Homo sapien
tatagattagcgtttgccagggcct

SEQ ID NO: 75682 - DNA, 25 bp, Homo sapien
agattagcgtttgccagggcctgga

SEQ ID NO: 75683 - DNA, 25 bp, Homo sapien
gctgtgagagatgaggcatgactac

SEQ ID NO: 75684 - DNA, 25 bp, Homo sapien
atgaggcatgactactaagggtttg

SEQ ID NO: 75685 - DNA, 25 bp, Homo sapien
aaattagtggtgattgtgcacgatt

SEQ ID NO: 75686 - DNA, 25 bp, Homo sapien
gtgcacgattttgagaatgtactaa

SEQ ID NO: 75687 - DNA, 25 bp, Homo sapien
tgtattttgccctgcccacattgca

SEQ ID NO: 75688 - DNA, 25 bp, Homo sapien
gcccacattgcaggtgttttgtata

SEQ ID NO: 75689 - DNA, 25 bp, Homo sapien
ggaagaccgattttatttgcacaag

SEQ ID NO: 75690 - DNA, 25 bp, Homo sapien
atttgcacaaggtactgagattttt

SEQ ID NO: 75691 - DNA, 25 bp, Homo sapien
gctgtcaaatctcaaggtgaagaac

SEQ ID NO: 75692 - DNA, 25 bp, Homo sapien
agtttactaatgcactactgaagtt

SEQ ID NO: 75693 - DNA, 25 bp, Homo sapien
gaagttaaatctgtggccaatcaat

SEQ ID NO: 75694 - DNA, 25 bp, Homo sapien
tctgtggccaatcaatgtaagcatt

SEQ ID NO: 75695 - DNA, 25 bp, Homo sapien
gggttggttctctaaattgatttga

SEQ ID NO: 75696 - DNA, 25 bp, Homo sapien
gaatctgaaatactgacaactccta

SEQ ID NO: 75697 - DNA, 25 bp, Homo sapien
ctcctattcccattttgctaaactc

SEQ ID NO: 75698 - DNA, 25 bp, Homo sapien
gcagccaagtcatgtaattagtcat

SEQ ID NO: 75699 - DNA, 25 bp, Homo sapien
gagaattgcgggttctacccagtca

SEQ ID NO: 75700 - DNA, 25 bp, Homo sapien
tacccagtcagaagatcacaccatg

SEQ ID NO: 75701 - DNA, 25 bp, Homo sapien
gatcacaccatggagactttctact

SEQ ID NO: 75702 - DNA, 25 bp, Homo sapien
gagactttctactagaggacttgaa

SEQ ID NO: 75703 - DNA, 25 bp, Homo sapien
ttcaccttccattaagtgttcaagc

SEQ ID NO: 75704 - DNA, 25 bp, Homo sapien
gtgttcaagcatgtctgcaaattag

SEQ ID NO: 75705 - DNA, 25 bp, Homo sapien
atcctttgtgatgaagcctgaaatt

SEQ ID NO: 75706 - DNA, 25 bp, Homo sapien
aagcctgaaattgtgccgtgttgcc

SEQ ID NO: 75707 - DNA, 25 bp, Homo sapien
tgccgtgttgccttatatgaatatg

SEQ ID NO: 75708 - DNA, 25 bp, Homo sapien
gaatatgcagtatgggactttgaaa

SEQ ID NO: 75709 - DNA, 25 bp, Homo sapien
tactccaacgacttgaactccatgg

SEQ ID NO: 75710 - DNA, 25 bp, Homo sapien
aacgacttgaactccatggccggct

SEQ ID NO: 75711 - DNA, 25 bp, Homo sapien
actcgtcggacgagggctcttacga

SEQ ID NO: 75712 - DNA, 25 bp, Homo sapien
acgagggctcttacgacccgctcag

SEQ ID NO: 75713 - DNA, 25 bp, Homo sapien
ccgaggagcaggagcttctcgactt

SEQ ID NO: 75714 - DNA, 25 bp, Homo sapien
tctcgacttcaccaactggttctga

SEQ ID NO: 75715 - DNA, 25 bp, Homo sapien
tcaggccctggtgcgaatggacttt

SEQ ID NO: 75716 - DNA, 25 bp, Homo sapien
gccctggtgcgaatggactttggaa

SEQ ID NO: 75717 - DNA, 25 bp, Homo sapien
tggaagcagggtgatcgcacaacct

SEQ ID NO: 75718 - DNA, 25 bp, Homo sapien
tgatcgcacaacctgcatctttagt

SEQ ID NO: 75719 - DNA, 25 bp, Homo sapien
aacctgcatctttagtgctttcttg

SEQ ID NO: 75720 - DNA, 25 bp, Homo sapien
ggtgaagaacatcccaagccagaaa

SEQ ID NO: 75721 - DNA, 25 bp, Homo sapien
tgaagaacatcccaagccagaaaga

SEQ ID NO: 75722 - DNA, 25 bp, Homo sapien
gtgttttcctttgcaccgatcccca

SEQ ID NO: 75723 - DNA, 25 bp, Homo sapien
ttgtgaacacctcctagccacatca

SEQ ID NO: 75724 - DNA, 25 bp, Homo sapien
tcctagccacatcactacagtacag

SEQ ID NO: 75725 - DNA, 25 bp, Homo sapien
ctagccacatcactacagtacagtg

SEQ ID NO: 75726 - DNA, 25 bp, Homo sapien
gccacatcactacagtacagtgagt

SEQ ID NO: 75727 - DNA, 25 bp, Homo sapien
tcactacagtacagtgagtgacccc

SEQ ID NO: 75728 - DNA, 25 bp, Homo sapien
accctgaccgtgctaactgtgtgta

SEQ ID NO: 75729 - DNA, 25 bp, Homo sapien
cctgaccgtgctaactgtgtgtaca

SEQ ID NO: 75730 - DNA, 25 bp, Homo sapien
tgaccgtgctaactgtgtgtacata

SEQ ID NO: 75731 - DNA, 25 bp, Homo sapien
gaccgccaactttttccgcgtgttg

SEQ ID NO: 75732 - DNA, 25 bp, Homo sapien
aactttttccgcgtgttgctgcagc

SEQ ID NO: 75733 - DNA, 25 bp, Homo sapien
ttttccgcgtgttgctgcagcagct

SEQ ID NO: 75734 - DNA, 25 bp, Homo sapien
taggaatgccctcggcggccaccag

SEQ ID NO: 75735 - DNA, 25 bp, Homo sapien
aaaggcggtccgaggagcctcccat

SEQ ID NO: 75736 - DNA, 25 bp, Homo sapien
aagtcttggaaatggccagggccga

SEQ ID NO: 75737 - DNA, 25 bp, Homo sapien
atggccagggccgagcagttagcac

SEQ ID NO: 75738 - DNA, 25 bp, Homo sapien
cagggccgagcagttagcacagcaa

SEQ ID NO: 75739 - DNA, 25 bp, Homo sapien
agttagcacagcaagctcacagcaa

SEQ ID NO: 75740 - DNA, 25 bp, Homo sapien
acagcaagctcacagcaacaggaaa

SEQ ID NO: 75741 - DNA, 25 bp, Homo sapien
aaactcatggagattattgggaaat

SEQ ID NO: 75742 - DNA, 25 bp, Homo sapien
atgtggcactaaatgcagtttcaga

SEQ ID NO: 75743 - DNA, 25 bp, Homo sapien
attgtcaattgtgaggtgtgctttt

SEQ ID NO: 75744 - DNA, 25 bp, Homo sapien
gttggttatattgcacaattggtta

SEQ ID NO: 75745 - DNA, 25 bp, Homo sapien
atgacctgatattcaaagactctgg

SEQ ID NO: 75746 - DNA, 25 bp, Homo sapien
ttcaaagactctggcattgatagcc

SEQ ID NO: 75747 - DNA, 25 bp, Homo sapien
tgatagccagtgtgttttcttattt

SEQ ID NO: 75748 - DNA, 25 bp, Homo sapien
aactccgtttactacattctacatg

SEQ ID NO: 75749 - DNA, 25 bp, Homo sapien
attctacatggtgtttacgtgatcc

SEQ ID NO: 75750 - DNA, 25 bp, Homo sapien
ggtgtttacgtgatccacacttgaa

SEQ ID NO: 75751 - DNA, 25 bp, Homo sapien
cgtgatccacacttgaaatactaga

SEQ ID NO: 75752 - DNA, 25 bp, Homo sapien
actagatcagtagacattcactaat

SEQ ID NO: 75753 - DNA, 25 bp, Homo sapien
cagtatttcactgataccacgagga

SEQ ID NO: 75754 - DNA, 25 bp, Homo sapien
ttcactgataccacgaggaaaagaa

SEQ ID NO: 75755 - DNA, 25 bp, Homo sapien
agtattcatacaccttgctaaccta

SEQ ID NO: 75756 - DNA, 25 bp, Homo sapien
tacaccttgctaacctaaaagacag

SEQ ID NO: 75757 - DNA, 25 bp, Homo sapien
gcagggacaagatacatatgaggac

SEQ ID NO: 75758 - DNA, 25 bp, Homo sapien
catatgaggacaaggtatacaccca

SEQ ID NO: 75759 - DNA, 25 bp, Homo sapien
gacaaggtatacacccagttctgaa

SEQ ID NO: 75760 - DNA, 25 bp, Homo sapien
acacccagttctgaataacttgaag

SEQ ID NO: 75761 - DNA, 25 bp, Homo sapien
aacttgaagaacaggcttggcaaag

SEQ ID NO: 75762 - DNA, 25 bp, Homo sapien
acaggcttggcaaagaagtaagttt

SEQ ID NO: 75763 - DNA, 25 bp, Homo sapien
agtaagtttatccaaatcttgaatt

SEQ ID NO: 75764 - DNA, 25 bp, Homo sapien
cccagctagttcctcttttgataag

SEQ ID NO: 75765 - DNA, 25 bp, Homo sapien
taaggctgttaacattacaaggtca

SEQ ID NO: 75766 - DNA, 25 bp, Homo sapien
gagagaggaatggaatcgacagtat

SEQ ID NO: 75767 - DNA, 25 bp, Homo sapien
cgacagtataaattggttcctgaga

SEQ ID NO: 75768 - DNA, 25 bp, Homo sapien
tcctgagagggtttcctaacagctt

SEQ ID NO: 75769 - DNA, 25 bp, Homo sapien
gagagggtttcctaacagctttgta

SEQ ID NO: 75770 - DNA, 25 bp, Homo sapien
aatatggccttgatggtgtagtgca

SEQ ID NO: 75771 - DNA, 25 bp, Homo sapien
gtgtagtgcatggacatctacccag

SEQ ID NO: 75772 - DNA, 25 bp, Homo sapien
gtgcatggacatctacccagataaa

SEQ ID NO: 75773 - DNA, 25 bp, Homo sapien
ggacatctacccagataaacaaatt

SEQ ID NO: 75774 - DNA, 25 bp, Homo sapien
taaacaaattgttgactgctgaaaa

SEQ ID NO: 75775 - DNA, 25 bp, Homo sapien
gtggcctttggaagggcagccagct

SEQ ID NO: 75776 - DNA, 25 bp, Homo sapien
tccttcaccgggacctcattcaggt

SEQ ID NO: 75777 - DNA, 25 bp, Homo sapien
gggacctcattcaggtcgctgaggc

SEQ ID NO: 75778 - DNA, 25 bp, Homo sapien
ttcaggtcgctgaggctcaggtcca

SEQ ID NO: 75779 - DNA, 25 bp, Homo sapien
tcaggtccagttcgttgccgtccag

SEQ ID NO: 75780 - DNA, 25 bp, Homo sapien
ttgccgtccagcttgtcgcggaggt

SEQ ID NO: 75781 - DNA, 25 bp, Homo sapien
gtcgcggaggttcccgcccttgcta

SEQ ID NO: 75782 - DNA, 25 bp, Homo sapien
ttgctaccggccttggtcatggtaa

SEQ ID NO: 75783 - DNA, 25 bp, Homo sapien
ttggtcatggtaacgccggctgagc

SEQ ID NO: 75784 - DNA, 25 bp, Homo sapien
aaaggagctgaaatgtcgcttgtca

SEQ ID NO: 75785 - DNA, 25 bp, Homo sapien
aatgtcgcttgtcagttcagcggcc

SEQ ID NO: 75786 - DNA, 25 bp, Homo sapien
atattctctcaggaaggccgccatg

SEQ ID NO: 75787 - DNA, 25 bp, Homo sapien
aggaaggccgccatgctcattcggc

SEQ ID NO: 75788 - DNA, 25 bp, Homo sapien
ccctaggccctagaggacattggtc

SEQ ID NO: 75789 - DNA, 25 bp, Homo sapien
aggccctagaggacattggtcagca

SEQ ID NO: 75790 - DNA, 25 bp, Homo sapien
agcaggagcccaagttgttctggcc

SEQ ID NO: 75791 - DNA, 25 bp, Homo sapien
ggagcccaagttgttctggccacac

SEQ ID NO: 75792 - DNA, 25 bp, Homo sapien
ccctgggcgctgaaaatgggaccca

SEQ ID NO: 75793 - DNA, 25 bp, Homo sapien
atggctccccaaggtcattcatatc

SEQ ID NO: 75794 - DNA, 25 bp, Homo sapien
tccccaaggtcattcatatctcggt

SEQ ID NO: 75795 - DNA, 25 bp, Homo sapien
aggtcattcatatctcggtttgagc

SEQ ID NO: 75796 - DNA, 25 bp, Homo sapien
ttcatatctcggtttgagctcatat

SEQ ID NO: 75797 - DNA, 25 bp, Homo sapien
aatggtgcattcttaaaagccccag

SEQ ID NO: 75798 - DNA, 25 bp, Homo sapien
aaaagccccagtctctggagaaaag

SEQ ID NO: 75799 - DNA, 25 bp, Homo sapien
ggaagattccaaagccctgggaatg

SEQ ID NO: 75800 - DNA, 25 bp, Homo sapien
tcccatccctacctaatttgttaat

SEQ ID NO: 75801 - DNA, 25 bp, Homo sapien
attttccctgaaaaccttctgcagt

SEQ ID NO: 75802 - DNA, 25 bp, Homo sapien
aaccttctgcagtttgctcattgtt

SEQ ID NO: 75803 - DNA, 25 bp, Homo sapien
gctcattgttttagcgaggtcacga

SEQ ID NO: 75804 - DNA, 25 bp, Homo sapien
cgaggtcacgagagagtcacttcat

SEQ ID NO: 75805 - DNA, 25 bp, Homo sapien
gagagtcacttcatgactttcttgg

SEQ ID NO: 75806 - DNA, 25 bp, Homo sapien
tttcttggtgtgtgggtatatgccc

SEQ ID NO: 75807 - DNA, 25 bp, Homo sapien
gtatatgccctgacaacttctgtaa

SEQ ID NO: 75808 - DNA, 25 bp, Homo sapien
aaagctggtaccagagggctccagg

SEQ ID NO: 75809 - DNA, 25 bp, Homo sapien
agcaattcatgcttcttgtggtctg

SEQ ID NO: 75810 - DNA, 25 bp, Homo sapien
tcttgtggtctggactgaacttcca

SEQ ID NO: 75811 - DNA, 25 bp, Homo sapien
agccaagggcaaaacattcatgttt

SEQ ID NO: 75812 - DNA, 25 bp, Homo sapien
aacattcatgtttcttggtgcccgc

SEQ ID NO: 75813 - DNA, 25 bp, Homo sapien
ggtgcccgcttgactgtggagtttt

SEQ ID NO: 75814 - DNA, 25 bp, Homo sapien
ctgtggagttttggcttcatgtgaa

SEQ ID NO: 75815 - DNA, 25 bp, Homo sapien
gattcttagaatcctgagctgtggt

SEQ ID NO: 75816 - DNA, 25 bp, Homo sapien
ctgagctgtggtggcttcagtcctg

SEQ ID NO: 75817 - DNA, 25 bp, Homo sapien
gagcaagtccctcttgagtctgttt

SEQ ID NO: 75818 - DNA, 25 bp, Homo sapien
gaggctatgatgagcagtagtacca

SEQ ID NO: 75819 - DNA, 25 bp, Homo sapien
tggtcttgccccacttgagtctggc

SEQ ID NO: 75820 - DNA, 25 bp, Homo sapien
tgagtctggcctggactggatccca

SEQ ID NO: 75821 - DNA, 25 bp, Homo sapien
actggatcccagctgttctaggcag

SEQ ID NO: 75822 - DNA, 25 bp, Homo sapien
tcccagctgttctaggcagggccgg

SEQ ID NO: 75823 - DNA, 25 bp, Homo sapien
ccctgaagggcgagacccagtggct

SEQ ID NO: 75824 - DNA, 25 bp, Homo sapien
ggccgcctcttgagggtacacgcct

SEQ ID NO: 75825 - DNA, 25 bp, Homo sapien
gagggtacacgcctctggtcacatg

SEQ ID NO: 75826 - DNA, 25 bp, Homo sapien
cacatggccatggagccttgggtac

SEQ ID NO: 75827 - DNA, 25 bp, Homo sapien
gagccttgggtacccctgagttaag

SEQ ID NO: 75828 - DNA, 25 bp, Homo sapien
ttaagggaggacatttggccagctg

SEQ ID NO: 75829 - DNA, 25 bp, Homo sapien
gcttctcctgcctaataaacaggct

SEQ ID NO: 75830 - DNA, 25 bp, Homo sapien
tagggaagtctatgagaaagtagca

SEQ ID NO: 75831 - DNA, 25 bp, Homo sapien
agggaagtctatgagaaagtagcat

SEQ ID NO: 75832 - DNA, 25 bp, Homo sapien
gggaagtctatgagaaagtagcatt

SEQ ID NO: 75833 - DNA, 25 bp, Homo sapien
ggaagtctatgagaaagtagcattt

SEQ ID NO: 75834 - DNA, 25 bp, Homo sapien
gaagtctatgagaaagtagcattta

SEQ ID NO: 75835 - DNA, 25 bp, Homo sapien
aagtctatgagaaagtagcatttaa

SEQ ID NO: 75836 - DNA, 25 bp, Homo sapien
agtctatgagaaagtagcatttaat

SEQ ID NO: 75837 - DNA, 25 bp, Homo sapien
gtctatgagaaagtagcatttaatt

SEQ ID NO: 75838 - DNA, 25 bp, Homo sapien
gagaaagtagcatttaattaaagtt

SEQ ID NO: 75839 - DNA, 25 bp, Homo sapien
aaaaggttgggcgttgtggctcatg

SEQ ID NO: 75840 - DNA, 25 bp, Homo sapien
aaaggttgggcgttgtggctcatgc

SEQ ID NO: 75841 - DNA, 25 bp, Homo sapien
ttcaccaagcggtagtaattgttgt

SEQ ID NO: 75842 - DNA, 25 bp, Homo sapien
gaaaacacactctctaaagccactt

SEQ ID NO: 75843 - DNA, 25 bp, Homo sapien
aaagccacttccttgtgcacagagt

SEQ ID NO: 75844 - DNA, 25 bp, Homo sapien
gagagcacaggcatctccctggaaa

SEQ ID NO: 75845 - DNA, 25 bp, Homo sapien
aagcacctgccaatgacgaatttca

SEQ ID NO: 75846 - DNA, 25 bp, Homo sapien
gacacagtctctgagaggtgagcct

SEQ ID NO: 75847 - DNA, 25 bp, Homo sapien
gagaggtgagcctagctttgctctt

SEQ ID NO: 75848 - DNA, 25 bp, Homo sapien
tagctttgctcttcctacagggtat

SEQ ID NO: 75849 - DNA, 25 bp, Homo sapien
ttcctacagggtatgcttgggccat

SEQ ID NO: 75850 - DNA, 25 bp, Homo sapien
tatgcttgggccatacacaatgctc

SEQ ID NO: 75851 - DNA, 25 bp, Homo sapien
ttactttaaagctattttgccacag

SEQ ID NO: 75852 - DNA, 25 bp, Homo sapien
tgtgccatctccctgtgcgcctgag

SEQ ID NO: 75853 - DNA, 25 bp, Homo sapien
tgtgcgcctgagcagatcaatccac

SEQ ID NO: 75854 - DNA, 25 bp, Homo sapien
gagcagatcaatccaccagtgcaaa

SEQ ID NO: 75855 - DNA, 25 bp, Homo sapien
accagtgcaaaacagggctaacggc

SEQ ID NO: 75856 - DNA, 25 bp, Homo sapien
agggctaacggcacctgcaggacag

SEQ ID NO: 75857 - DNA, 25 bp, Homo sapien
ggttcccagggcaggctgactcagt

SEQ ID NO: 75858 - DNA, 25 bp, Homo sapien
ggcaggctgactcagttgactgctt

SEQ ID NO: 75859 - DNA, 25 bp, Homo sapien
gactcagttgactgcttggtccaag

SEQ ID NO: 75860 - DNA, 25 bp, Homo sapien
agttgactgcttggtccaagcctgg

SEQ ID NO: 75861 - DNA, 25 bp, Homo sapien
tggcacttgtcagggtcagcctaag

SEQ ID NO: 75862 - DNA, 25 bp, Homo sapien
gtcagcctaaggagatgggaataaa

SEQ ID NO: 75863 - DNA, 25 bp, Homo sapien
gagcagtgtgactgttgtgtcccag

SEQ ID NO: 75864 - DNA, 25 bp, Homo sapien
ctgttgtgtcccagtatgataacct

SEQ ID NO: 75865 - DNA, 25 bp, Homo sapien
taacctggaagattaccactccctg

SEQ ID NO: 75866 - DNA, 25 bp, Homo sapien
tcagcaccagcgaggagtctttgga

SEQ ID NO: 75867 - DNA, 25 bp, Homo sapien
catccacagagcaggacctatgcta

SEQ ID NO: 75868 - DNA, 25 bp, Homo sapien
caggacctatgctacagcgttgggt

SEQ ID NO: 75869 - DNA, 25 bp, Homo sapien
ctatgctacagcgttgggtcaaggg

SEQ ID NO: 75870 - DNA, 25 bp, Homo sapien
gcagagttgtccttgcagcatcctg

SEQ ID NO: 75871 - DNA, 25 bp, Homo sapien
gcagcatcctgaaacacagatccat

SEQ ID NO: 75872 - DNA, 25 bp, Homo sapien
aatgagccctgcgagcaatagagtt

SEQ ID NO: 75873 - DNA, 25 bp, Homo sapien
aatagagttgaagcagcctctgctg

SEQ ID NO: 75874 - DNA, 25 bp, Homo sapien
tgcgcttctgcgtcacgtggaacac

SEQ ID NO: 75875 - DNA, 25 bp, Homo sapien
gtggaacaccaactcgcggcactgc

SEQ ID NO: 75876 - DNA, 25 bp, Homo sapien
cccaggccgtgctgggtgtgctctt

SEQ ID NO: 75877 - DNA, 25 bp, Homo sapien
gtgtgctcttgaggcgagaggcccc

SEQ ID NO: 75878 - DNA, 25 bp, Homo sapien
ttgaggccctgctgccctacactga

SEQ ID NO: 75879 - DNA, 25 bp, Homo sapien
tacactgagcggcactttcagcggc

SEQ ID NO: 75880 - DNA, 25 bp, Homo sapien
gcggcactttcagcggctcagcagg

SEQ ID NO: 75881 - DNA, 25 bp, Homo sapien
tccaggccgccgctttcttggactt

SEQ ID NO: 75882 - DNA, 25 bp, Homo sapien
tcttggacttcctgtggcacaacat

SEQ ID NO: 75883 - DNA, 25 bp, Homo sapien
tgtggcacaacatgaagctccctgt

SEQ ID NO: 75884 - DNA, 25 bp, Homo sapien
ccataaaggcgcactgccctaaaaa

SEQ ID NO: 75885 - DNA, 25 bp, Homo sapien
ggcatcgttgagcattaacactctg

SEQ ID NO: 75886 - DNA, 25 bp, Homo sapien
tctgtgacagagctgcagacccctg

SEQ ID NO: 75887 - DNA, 25 bp, Homo sapien
tgccttgagtctcatctcagcaatg

SEQ ID NO: 75888 - DNA, 25 bp, Homo sapien
actccattctttgtgacacgagtca

SEQ ID NO: 75889 - DNA, 25 bp, Homo sapien
acacgagtcaagtggctcacaacct

SEQ ID NO: 75890 - DNA, 25 bp, Homo sapien
aggactcactcactggttgctgtga

SEQ ID NO: 75891 - DNA, 25 bp, Homo sapien
tgtgatgatatccagtgtccctctg

SEQ ID NO: 75892 - DNA, 25 bp, Homo sapien
tccccaaccacatttgactgtagca

SEQ ID NO: 75893 - DNA, 25 bp, Homo sapien
gactgtagcattgcatctgtgtcct

SEQ ID NO: 75894 - DNA, 25 bp, Homo sapien
gcatctgtgtcctgttgtcatttat

SEQ ID NO: 75895 - DNA, 25 bp, Homo sapien
tcaggtattaaacttgctgcatatc

SEQ ID NO: 75896 - DNA, 25 bp, Homo sapien
actgcggaatgtggcctctgcttcc

SEQ ID NO: 75897 - DNA, 25 bp, Homo sapien
ccaaggacgacgaggattgctccag

SEQ ID NO: 75898 - DNA, 25 bp, Homo sapien
acgacgaggattgctccagggctgc

SEQ ID NO: 75899 - DNA, 25 bp, Homo sapien
cagggctgctgggtagtttaccgtc

SEQ ID NO: 75900 - DNA, 25 bp, Homo sapien
ttaccgtcccttctataggcatgga

SEQ ID NO: 75901 - DNA, 25 bp, Homo sapien
ataggcatggagttggcactgacat

SEQ ID NO: 75902 - DNA, 25 bp, Homo sapien
tggcactgacatcacagcttcataa

SEQ ID NO: 75903 - DNA, 25 bp, Homo sapien
catccagtctgttcttgttcatagt

SEQ ID NO: 75904 - DNA, 25 bp, Homo sapien
gttcttgttcatagtgagaatcctg

SEQ ID NO: 75905 - DNA, 25 bp, Homo sapien
tgagaatcctgtgttcccacttcag

SEQ ID NO: 75906 - DNA, 25 bp, Homo sapien
ctgtgttcccacttcagtgacacct

SEQ ID NO: 75907 - DNA, 25 bp, Homo sapien
tgagcccagccctagttcagtatct

SEQ ID NO: 75908 - DNA, 25 bp, Homo sapien
gccctagttcagtatcttttatgta

SEQ ID NO: 75909 - DNA, 25 bp, Homo sapien
tgcagatacttattgcatttctttt

SEQ ID NO: 75910 - DNA, 25 bp, Homo sapien
gtgttctatgcatttattggctctt

SEQ ID NO: 75911 - DNA, 25 bp, Homo sapien
ttggctcttgaatttcctcatctat

SEQ ID NO: 75912 - DNA, 25 bp, Homo sapien
gaattgtcattcacacacctacttt

SEQ ID NO: 75913 - DNA, 25 bp, Homo sapien
ctacttttctgcttcgtttttacat

SEQ ID NO: 75914 - DNA, 25 bp, Homo sapien
tcgtttttacatatgtctttgccta

SEQ ID NO: 75915 - DNA, 25 bp, Homo sapien
tatccctctgttttatattttctct

SEQ ID NO: 75916 - DNA, 25 bp, Homo sapien
attttctctcattcttgtattgcct

SEQ ID NO: 75917 - DNA, 25 bp, Homo sapien
tctcattcttgtattgccttttaaa

SEQ ID NO: 75918 - DNA, 25 bp, Homo sapien
gcagtcacagtgagttctaataaga

SEQ ID NO: 75919 - DNA, 25 bp, Homo sapien
gagttctaataagagcatcacattt

SEQ ID NO: 75920 - DNA, 25 bp, Homo sapien
atttaggaagccaaattgctctgac

SEQ ID NO: 75921 - DNA, 25 bp, Homo sapien
ggaagccaaattgctctgactggtt

SEQ ID NO: 75922 - DNA, 25 bp, Homo sapien
caaattgctctgactggttacttat

SEQ ID NO: 75923 - DNA, 25 bp, Homo sapien
gctctgactggttacttatttactt

SEQ ID NO: 75924 - DNA, 25 bp, Homo sapien
tttctacatttgttatacacttaca

SEQ ID NO: 75925 - DNA, 25 bp, Homo sapien
acttacattacaaattccttttcat

SEQ ID NO: 75926 - DNA, 25 bp, Homo sapien
atcttgcttcatagtgaatgtttga

SEQ ID NO: 75927 - DNA, 25 bp, Homo sapien
gtggtttaatggtagatttgattct

SEQ ID NO: 75928 - DNA, 25 bp, Homo sapien
tttgattcttcaatatgtaacatag

SEQ ID NO: 75929 - DNA, 25 bp, Homo sapien
agtgaaagtactaaatgtctgatat

SEQ ID NO: 75930 - DNA, 25 bp, Homo sapien
gtgaaagtactaaatgtctgatatg

SEQ ID NO: 75931 - DNA, 25 bp, Homo sapien
tgaaagtactaaatgtctgatatgc

SEQ ID NO: 75932 - DNA, 25 bp, Homo sapien
gaaagtactaaatgtctgatatgca

SEQ ID NO: 75933 - DNA, 25 bp, Homo sapien
aaagtactaaatgtctgatatgcag

SEQ ID NO: 75934 - DNA, 25 bp, Homo sapien
aagtactaaatgtctgatatgcaga

SEQ ID NO: 75935 - DNA, 25 bp, Homo sapien
agtactaaatgtctgatatgcagaa

SEQ ID NO: 75936 - DNA, 25 bp, Homo sapien
gtactaaatgtctgatatgcagaaa

SEQ ID NO: 75937 - DNA, 25 bp, Homo sapien
tactaaatgtctgatatgcagaaat

SEQ ID NO: 75938 - DNA, 25 bp, Homo sapien
ttattggagatggttcacattcctt

SEQ ID NO: 75939 - DNA, 25 bp, Homo sapien
tattggagatggttcacattcctta

SEQ ID NO: 75940 - DNA, 25 bp, Homo sapien
caagaatagtcaagttttttggccg

SEQ ID NO: 75941 - DNA, 25 bp, Homo sapien
atagtcaagttttttggccgggcat

SEQ ID NO: 75942 - DNA, 25 bp, Homo sapien
tagtcaagttttttggccgggcatg

SEQ ID NO: 75943 - DNA, 25 bp, Homo sapien
agtcaagttttttggccgggcatgg

SEQ ID NO: 75944 - DNA, 25 bp, Homo sapien
gtcaagttttttggccgggcatggt

SEQ ID NO: 75945 - DNA, 25 bp, Homo sapien
cgagaccaacctggtcagcatggca

SEQ ID NO: 75946 - DNA, 25 bp, Homo sapien
aacctggtcagcatggcaaaacccc

SEQ ID NO: 75947 - DNA, 25 bp, Homo sapien
acctggtcagcatggcaaaaccccg

SEQ ID NO: 75948 - DNA, 25 bp, Homo sapien
aggcgtgatggcacgtgtctgtaat

SEQ ID NO: 75949 - DNA, 25 bp, Homo sapien
cgtgatggcacgtgtctgtaatccc

SEQ ID NO: 75950 - DNA, 25 bp, Homo sapien
gaaccgagatcatgccaccgcactt

SEQ ID NO: 75951 - DNA, 25 bp, Homo sapien
cctcctgagctgaatccttcaaagg

SEQ ID NO: 75952 - DNA, 25 bp, Homo sapien
tccttcaaaggcacagcaggcagaa

SEQ ID NO: 75953 - DNA, 25 bp, Homo sapien
gggcacactgcttaggagtcaacat

SEQ ID NO: 75954 - DNA, 25 bp, Homo sapien
tcatcattgggctttctttaaaacg

SEQ ID NO: 75955 - DNA, 25 bp, Homo sapien
tgggctttctttaaaacgtgcactt

SEQ ID NO: 75956 - DNA, 25 bp, Homo sapien
taaaacgtgcactttgtaatttgaa

SEQ ID NO: 75957 - DNA, 25 bp, Homo sapien
agccagctgtgcgtgctgtacggaa

SEQ ID NO: 75958 - DNA, 25 bp, Homo sapien
gtgcgtgctgtacggaaagcctccc

SEQ ID NO: 75959 - DNA, 25 bp, Homo sapien
ggctttgttgaagtggaactcccca

SEQ ID NO: 75960 - DNA, 25 bp, Homo sapien
aacctggtatggctccttctgcgaa

SEQ ID NO: 75961 - DNA, 25 bp, Homo sapien
ttctgcgaagggaagctgatcccag

SEQ ID NO: 75962 - DNA, 25 bp, Homo sapien
gaatggcttgttttcttagactcct

SEQ ID NO: 75963 - DNA, 25 bp, Homo sapien
gttttcttagactcctcctcagcta

SEQ ID NO: 75964 - DNA, 25 bp, Homo sapien
tcagctaccaaactgggactcacag

SEQ ID NO: 75965 - DNA, 25 bp, Homo sapien
gggactcacagctttattgggcttt

SEQ ID NO: 75966 - DNA, 25 bp, Homo sapien
ttattgggctttctttgtgtcttgt

SEQ ID NO: 75967 - DNA, 25 bp, Homo sapien
gctttctttgtgtcttgtgtgtttc

SEQ ID NO: 75968 - DNA, 25 bp, Homo sapien
gagagctaggccctgcatggcccca

SEQ ID NO: 75969 - DNA, 25 bp, Homo sapien
ctgcatggccccagcaatgcagtca

SEQ ID NO: 75970 - DNA, 25 bp, Homo sapien
acccagggcctggtgatatctgtgt

SEQ ID NO: 75971 - DNA, 25 bp, Homo sapien
gcctggtgatatctgtgtcctctca

SEQ ID NO: 75972 - DNA, 25 bp, Homo sapien
tctttcccagggatactgaggaatg

SEQ ID NO: 75973 - DNA, 25 bp, Homo sapien
ccaaatttgatagactgctgttttt

SEQ ID NO: 75974 - DNA, 25 bp, Homo sapien
atttgatagactgctgtttttctgg

SEQ ID NO: 75975 - DNA, 25 bp, Homo sapien
ttgatagactgctgtttttctggtc

SEQ ID NO: 75976 - DNA, 25 bp, Homo sapien
tcgcaaccctcatgaagtacaacca

SEQ ID NO: 75977 - DNA, 25 bp, Homo sapien
gcaaccctcatgaagtacaaccagc

SEQ ID NO: 75978 - DNA, 25 bp, Homo sapien
gcagatgagagagcacgagctaaag

SEQ ID NO: 75979 - DNA, 25 bp, Homo sapien
gagcacgagctaaagtaaaatatct

SEQ ID NO: 75980 - DNA, 25 bp, Homo sapien
tatctaacaggtgaaaaaggtgtga

SEQ ID NO: 75981 - DNA, 25 bp, Homo sapien
tagagcctttgatccagcaataccc

SEQ ID NO: 75982 - DNA, 25 bp, Homo sapien
gagcctttgatccagcaatacccca

SEQ ID NO: 75983 - DNA, 25 bp, Homo sapien
gcaataccccacttcacctacaata

SEQ ID NO: 75984 - DNA, 25 bp, Homo sapien
acaggtctcgcacccacaagtacta

SEQ ID NO: 75985 - DNA, 25 bp, Homo sapien
aggtctcgcacccacaagtactatc

SEQ ID NO: 75986 - DNA, 25 bp, Homo sapien
gtctcgcacccacaagtactatctg

SEQ ID NO: 75987 - DNA, 25 bp, Homo sapien
gcagagatcctctcatctgtggcca

SEQ ID NO: 75988 - DNA, 25 bp, Homo sapien
agagatcctctcatctgtggccagg

SEQ ID NO: 75989 - DNA, 25 bp, Homo sapien
gagatcctctcatctgtggccaggc

SEQ ID NO: 75990 - DNA, 25 bp, Homo sapien
agatcctctcatctgtggccaggca

SEQ ID NO: 75991 - DNA, 25 bp, Homo sapien
gatcctctcatctgtggccaggcac

SEQ ID NO: 75992 - DNA, 25 bp, Homo sapien
tcatctgtggccaggcacgcctgta

SEQ ID NO: 75993 - DNA, 25 bp, Homo sapien
catctgtggccaggcacgcctgtaa

SEQ ID NO: 75994 - DNA, 25 bp, Homo sapien
atctctacaaaatgtggtgacacat

SEQ ID NO: 75995 - DNA, 25 bp, Homo sapien
ggctagaccctaagaagtaattaag

SEQ ID NO: 75996 - DNA, 25 bp, Homo sapien
aatggaagttttcccatgaactaag

SEQ ID NO: 75997 - DNA, 25 bp, Homo sapien
tttattagttccctgattagactgg

SEQ ID NO: 75998 - DNA, 25 bp, Homo sapien
tagttccctgattagactggaagaa

SEQ ID NO: 75999 - DNA, 25 bp, Homo sapien
gaagaagaaaccactatttcatgaa

SEQ ID NO: 76000 - DNA, 25 bp, Homo sapien
taaacagtacatctgtgacaatcat

SEQ ID NO: 76001 - DNA, 25 bp, Homo sapien
gtgacaatcattttaaccaagctct

SEQ ID NO: 76002 - DNA, 25 bp, Homo sapien
aatcattttaaccaagctctacttg

SEQ ID NO: 76003 - DNA, 25 bp, Homo sapien
ggattttcagaaagcaaccacacaa

SEQ ID NO: 76004 - DNA, 25 bp, Homo sapien
aagcaaccacacaattaccaggttg

SEQ ID NO: 76005 - DNA, 25 bp, Homo sapien
caattaccaggttgaatcttgagaa

SEQ ID NO: 76006 - DNA, 25 bp, Homo sapien
agctgagcattctcgtgaagggctt

SEQ ID NO: 76007 - DNA, 25 bp, Homo sapien
tgaagggctttagccgccagtcttc

SEQ ID NO: 76008 - DNA, 25 bp, Homo sapien
agtcttcactcctgttcaagattct

SEQ ID NO: 76009 - DNA, 25 bp, Homo sapien
tcaagattctctccagtgttcggaa

SEQ ID NO: 76010 - DNA, 25 bp, Homo sapien
gtgttcggaatcatcagatcaactc

SEQ ID NO: 76011 - DNA, 25 bp, Homo sapien
gatcaactcagatttggctcaacta

SEQ ID NO: 76012 - DNA, 25 bp, Homo sapien
ggctcaactactgttacgactagat

SEQ ID NO: 76013 - DNA, 25 bp, Homo sapien
ataacaaatactatacccaggctgg

SEQ ID NO: 76014 - DNA, 25 bp, Homo sapien
actctgggcagtttcgggatgtgaa

SEQ ID NO: 76015 - DNA, 25 bp, Homo sapien
taacagccacgttcccaaggttgta

SEQ ID NO: 76016 - DNA, 25 bp, Homo sapien
ttcaaaacatcccattctagccaca

SEQ ID NO: 76017 - DNA, 25 bp, Homo sapien
gcttcgttttgcctttagagtcaca

SEQ ID NO: 76018 - DNA, 25 bp, Homo sapien
gcctttagagtcacatctttcagta

SEQ ID NO: 76019 - DNA, 25 bp, Homo sapien
gagggacgtgcaacatacagcttaa

SEQ ID NO: 76020 - DNA, 25 bp, Homo sapien
aaggctgttatgcttcagggttgct

SEQ ID NO: 76021 - DNA, 25 bp, Homo sapien
tcagcctgccatcgtctagaagaga

SEQ ID NO: 76022 - DNA, 25 bp, Homo sapien
aaattagcacctccagtgtagtcgc

SEQ ID NO: 76023 - DNA, 25 bp, Homo sapien
tggcactgcccatcatgctgaggga

SEQ ID NO: 76024 - DNA, 25 bp, Homo sapien
tgctgagggagcagattcttcccaa

SEQ ID NO: 76025 - DNA, 25 bp, Homo sapien
ttcttcccaaggcagcttcagctag

SEQ ID NO: 76026 - DNA, 25 bp, Homo sapien
ttgtgacacatttgtcccctggaac

SEQ ID NO: 76027 - DNA, 25 bp, Homo sapien
tgtcccctggaactgagccttttta

SEQ ID NO: 76028 - DNA, 25 bp, Homo sapien
tttggaagcaaattcatacgatcgt

SEQ ID NO: 76029 - DNA, 25 bp, Homo sapien
gaagcaaattcatacgatcgtgagt

SEQ ID NO: 76030 - DNA, 25 bp, Homo sapien
gcaaattcatacgatcgtgagtgat

SEQ ID NO: 76031 - DNA, 25 bp, Homo sapien
tcatacgatcgtgagtgatttctcc

SEQ ID NO: 76032 - DNA, 25 bp, Homo sapien
atacgatcgtgagtgatttctccaa

SEQ ID NO: 76033 - DNA, 25 bp, Homo sapien
tacgatcgtgagtgatttctccaaa

SEQ ID NO: 76034 - DNA, 25 bp, Homo sapien
acgatcgtgagtgatttctccaaag

SEQ ID NO: 76035 - DNA, 25 bp, Homo sapien
gatcgtgagtgatttctccaaagaa

SEQ ID NO: 76036 - DNA, 25 bp, Homo sapien
atcgtgagtgatttctccaaagaaa

SEQ ID NO: 76037 - DNA, 25 bp, Homo sapien
aaaaaagccttgtccagcctgacca

SEQ ID NO: 76038 - DNA, 25 bp, Homo sapien
aaaaagccttgtccagcctgaccaa

SEQ ID NO: 76039 - DNA, 25 bp, Homo sapien
gaatttgtttaaagatggatgaaag

SEQ ID NO: 76040 - DNA, 25 bp, Homo sapien
atttgtttaaagatggatgaaaggc

SEQ ID NO: 76041 - DNA, 25 bp, Homo sapien
tttgtttaaagatggatgaaaggcc

SEQ ID NO: 76042 - DNA, 25 bp, Homo sapien
ttgtttaaagatggatgaaaggcca

SEQ ID NO: 76043 - DNA, 25 bp, Homo sapien
tgtttaaagatggatgaaaggccag

SEQ ID NO: 76044 - DNA, 25 bp, Homo sapien
gtttaaagatggatgaaaggccagg

SEQ ID NO: 76045 - DNA, 25 bp, Homo sapien
tttaaagatggatgaaaggccaggc

SEQ ID NO: 76046 - DNA, 25 bp, Homo sapien
ttaaagatggatgaaaggccaggca

SEQ ID NO: 76047 - DNA, 25 bp, Homo sapien
ggctagaccctaagaagtaattaag

SEQ ID NO: 76048 - DNA, 25 bp, Homo sapien
accctaagaagtaattaagtcaatg

SEQ ID NO: 76049 - DNA, 25 bp, Homo sapien
aagtcaatgtaaatcaaatggaagt

SEQ ID NO: 76050 - DNA, 25 bp, Homo sapien
tttattagttccctgattagactgg

SEQ ID NO: 76051 - DNA, 25 bp, Homo sapien
ttattagttccctgattagactgga

SEQ ID NO: 76052 - DNA, 25 bp, Homo sapien
attagttccctgattagactggaag

SEQ ID NO: 76053 - DNA, 25 bp, Homo sapien
tagttccctgattagactggaagaa

SEQ ID NO: 76054 - DNA, 25 bp, Homo sapien
gaagaagaaaccactatttcatgaa

SEQ ID NO: 76055 - DNA, 25 bp, Homo sapien
agaagaaaccactatttcatgaaaa

SEQ ID NO: 76056 - DNA, 25 bp, Homo sapien
taaacagtacatctgtgacaatcat

SEQ ID NO: 76057 - DNA, 25 bp, Homo sapien
aacagtacatctgtgacaatcattt

SEQ ID NO: 76058 - DNA, 25 bp, Homo sapien
tcacactttgccatttgcttgtact

SEQ ID NO: 76059 - DNA, 25 bp, Homo sapien
actttgccatttgcttgtactggga

SEQ ID NO: 76060 - DNA, 25 bp, Homo sapien
tgccatttgcttgtactgggacatt

SEQ ID NO: 76061 - DNA, 25 bp, Homo sapien
gcttgtactgggacattgttctttc

SEQ ID NO: 76062 - DNA, 25 bp, Homo sapien
tactgggacattgttctttccggcc

SEQ ID NO: 76063 - DNA, 25 bp, Homo sapien
gagacacatacagagtgggccccgg

SEQ ID NO: 76064 - DNA, 25 bp, Homo sapien
acacatacagagtgggccccgggct

SEQ ID NO: 76065 - DNA, 25 bp, Homo sapien
ggccccgggctggagaaagagctgc

SEQ ID NO: 76066 - DNA, 25 bp, Homo sapien
gagcaggttccccaagggccctggc

SEQ ID NO: 76067 - DNA, 25 bp, Homo sapien
agggccatctgactgccaagccaga

SEQ ID NO: 76068 - DNA, 25 bp, Homo sapien
ccaagccagattctcttgaataaag

SEQ ID NO: 76069 - DNA, 25 bp, Homo sapien
tcactgacttctcccgggtcgtgtc

SEQ ID NO: 76070 - DNA, 25 bp, Homo sapien
actcctgttttcacaccttacaaag

SEQ ID NO: 76071 - DNA, 25 bp, Homo sapien
gttttcacaccttacaaagccagct

SEQ ID NO: 76072 - DNA, 25 bp, Homo sapien
accttacaaagccagctctgagcag

SEQ ID NO: 76073 - DNA, 25 bp, Homo sapien
acaaagccagctctgagcagacagg

SEQ ID NO: 76074 - DNA, 25 bp, Homo sapien
agcagacagggcgtcctctcgtaga

SEQ ID NO: 76075 - DNA, 25 bp, Homo sapien
gacagggcgtcctctcgtagaacct

SEQ ID NO: 76076 - DNA, 25 bp, Homo sapien
ggcgtcctctcgtagaacctgcgca

SEQ ID NO: 76077 - DNA, 25 bp, Homo sapien
gggccgcgagcttagcttagaccgt

SEQ ID NO: 76078 - DNA, 25 bp, Homo sapien
cgagcttagcttagaccgtggtgtc

SEQ ID NO: 76079 - DNA, 25 bp, Homo sapien
gcttagcttagaccgtggtgtcctc

SEQ ID NO: 76080 - DNA, 25 bp, Homo sapien
gcaggtgttgaaaattatagccagc

SEQ ID NO: 76081 - DNA, 25 bp, Homo sapien
ttatagccagctacaagcacaccac

SEQ ID NO: 76082 - DNA, 25 bp, Homo sapien
aagcacaccacttccatttttgatg

SEQ ID NO: 76083 - DNA, 25 bp, Homo sapien
tttgatgacttctcacactatgaga

SEQ ID NO: 76084 - DNA, 25 bp, Homo sapien
aaataaaaggcagttctacacagac

SEQ ID NO: 76085 - DNA, 25 bp, Homo sapien
aaggcagttctacacagactgcagc

SEQ ID NO: 76086 - DNA, 25 bp, Homo sapien
gttgcatctgcatatcctaagagga

SEQ ID NO: 76087 - DNA, 25 bp, Homo sapien
aaatgaccttcaagagaattaggac

SEQ ID NO: 76088 - DNA, 25 bp, Homo sapien
tgacttcagagacgattgcagactt

SEQ ID NO: 76089 - DNA, 25 bp, Homo sapien
gacgattgcagacttgcagtttaag

SEQ ID NO: 76090 - DNA, 25 bp, Homo sapien
gcagtttaagtattggaatttcaca

SEQ ID NO: 76091 - DNA, 25 bp, Homo sapien
acagcagcattgcaccccaggttga

SEQ ID NO: 76092 - DNA, 25 bp, Homo sapien
gttgaccttaaccagcagcagtaca

SEQ ID NO: 76093 - DNA, 25 bp, Homo sapien
gcagcagtacatcttccaacagtgt

SEQ ID NO: 76094 - DNA, 25 bp, Homo sapien
gtgaggctcctatggaaggtttcca

SEQ ID NO: 76095 - DNA, 25 bp, Homo sapien
ggaaggtttccagctttgaagcaat

SEQ ID NO: 76096 - DNA, 25 bp, Homo sapien
ctacccagtcgagtcctcttgtgga

SEQ ID NO: 76097 - DNA, 25 bp, Homo sapien
agtcctcatggagctaacttctcaa

SEQ ID NO: 76098 - DNA, 25 bp, Homo sapien
gctaacttctcaaatgttttccata

SEQ ID NO: 76099 - DNA, 25 bp, Homo sapien
ataatactgtttgcgctcatttgct

SEQ ID NO: 76100 - DNA, 25 bp, Homo sapien
acctgctctcttacacacatctgga

SEQ ID NO: 76101 - DNA, 25 bp, Homo sapien
gaaaacctccggctctctgtggtgg

SEQ ID NO: 76102 - DNA, 25 bp, Homo sapien
caacattatgaatggtgtgcccagt

SEQ ID NO: 76103 - DNA, 25 bp, Homo sapien
tggtgtgcccagtaaataattatgt

SEQ ID NO: 76104 - DNA, 25 bp, Homo sapien
taattatgttgtaagcaccctgtgc

SEQ ID NO: 76105 - DNA, 25 bp, Homo sapien
agcaccctgtgcacaactgtacata

SEQ ID NO: 76106 - DNA, 25 bp, Homo sapien
acaactgtacatatttgccctagtg

SEQ ID NO: 76107 - DNA, 25 bp, Homo sapien
acatatttgccctagtgtacactaa

SEQ ID NO: 76108 - DNA, 25 bp, Homo sapien
aataggttggaggtgtttgttcaat

SEQ ID NO: 76109 - DNA, 25 bp, Homo sapien
tatctcagagtacctgtataccagg

SEQ ID NO: 76110 - DNA, 25 bp, Homo sapien
atttgtgacagctgttttgccttct

SEQ ID NO: 76111 - DNA, 25 bp, Homo sapien
ggcttttctgctcatttccctatta

SEQ ID NO: 76112 - DNA, 25 bp, Homo sapien
tttccctattagagtagccagataa

SEQ ID NO: 76113 - DNA, 25 bp, Homo sapien
gatactggtgttagtgttgtaatca

SEQ ID NO: 76114 - DNA, 25 bp, Homo sapien
gtaatcaggttaaacccacttccat

SEQ ID NO: 76115 - DNA, 25 bp, Homo sapien
aacccacttccattaaacttgacag

SEQ ID NO: 76116 - DNA, 25 bp, Homo sapien
tttagttcatgaattctacttttca

SEQ ID NO: 76117 - DNA, 25 bp, Homo sapien
acatggattttttcgtgtccgctgt

SEQ ID NO: 76118 - DNA, 25 bp, Homo sapien
tccgctgtcttgtgtacttttgtac

SEQ ID NO: 76119 - DNA, 25 bp, Homo sapien
tgtgtacttttgtacttaaccttgt

SEQ ID NO: 76120 - DNA, 25 bp, Homo sapien
gtacagttattttcatctcttgaaa

SEQ ID NO: 76121 - DNA, 25 bp, Homo sapien
gatgttctttagaagatctggccat

SEQ ID NO: 76122 - DNA, 25 bp, Homo sapien
gaagatctggccatttggtacataa

SEQ ID NO: 76123 - DNA, 25 bp, Homo sapien
ggtacataatccagcacagataagc

SEQ ID NO: 76124 - DNA, 25 bp, Homo sapien
atcgtctcatagtcatgctttttgg

SEQ ID NO: 76125 - DNA, 25 bp, Homo sapien
ggaaatttacatcatcctcaagtaa

SEQ ID NO: 76126 - DNA, 25 bp, Homo sapien
gtaagattgattcagcattccatgc

SEQ ID NO: 76127 - DNA, 25 bp, Homo sapien
cagcattccatgcacttgctttaaa

SEQ ID NO: 76128 - DNA, 25 bp, Homo sapien
tttagtcctgtgcatactgtggtgt

SEQ ID NO: 76129 - DNA, 25 bp, Homo sapien
actgtggtgtttttactgtgcatat

SEQ ID NO: 76130 - DNA, 25 bp, Homo sapien
gcagtttttctagagcaataatcag

SEQ ID NO: 76131 - DNA, 25 bp, Homo sapien
aatcagtggtgcttttgtacctagg

SEQ ID NO: 76132 - DNA, 25 bp, Homo sapien
tgtacctaggttttatgtgatttta

SEQ ID NO: 76133 - DNA, 25 bp, Homo sapien
acatggatagttgtggccacctgct

SEQ ID NO: 76134 - DNA, 25 bp, Homo sapien
tgtggccacctgctgactatttgtg

SEQ ID NO: 76135 - DNA, 25 bp, Homo sapien
gaatactgtcacatggccaggcatg

SEQ ID NO: 76136 - DNA, 25 bp, Homo sapien
aatactgtcacatggccaggcatgg

SEQ ID NO: 76137 - DNA, 25 bp, Homo sapien
atactgtcacatggccaggcatggt

SEQ ID NO: 76138 - DNA, 25 bp, Homo sapien
tactgtcacatggccaggcatggtg

SEQ ID NO: 76139 - DNA, 25 bp, Homo sapien
actgtcacatggccaggcatggtgg

SEQ ID NO: 76140 - DNA, 25 bp, Homo sapien
ggtggatcacctgagttcgagacca

SEQ ID NO: 76141 - DNA, 25 bp, Homo sapien
gtggatcacctgagttcgagaccag

SEQ ID NO: 76142 - DNA, 25 bp, Homo sapien
tggatcacctgagttcgagaccagc

SEQ ID NO: 76143 - DNA, 25 bp, Homo sapien
gggcaacaagagcgagactctcaaa

SEQ ID NO: 76144 - DNA, 25 bp, Homo sapien
aggaccattgtcagaaaatgaatgg

SEQ ID NO: 76145 - DNA, 25 bp, Homo sapien
ggaccattgtcagaaaatgaatggc

SEQ ID NO: 76146 - DNA, 25 bp, Homo sapien
gaccattgtcagaaaatgaatggca

SEQ ID NO: 76147 - DNA, 25 bp, Homo sapien
gtcagaaaatgaatggcatggccgg

SEQ ID NO: 76148 - DNA, 25 bp, Homo sapien
tcagaaaatgaatggcatggccggg

SEQ ID NO: 76149 - DNA, 25 bp, Homo sapien
cagaaaatgaatggcatggccgggc

SEQ ID NO: 76150 - DNA, 25 bp, Homo sapien
agaaaatgaatggcatggccgggcg

SEQ ID NO: 76151 - DNA, 25 bp, Homo sapien
gaaaatgaatggcatggccgggcgc

SEQ ID NO: 76152 - DNA, 25 bp, Homo sapien
aagtttcctggcagtgtgtgatact

SEQ ID NO: 76153 - DNA, 25 bp, Homo sapien
gtttcctggcagtgtgtgatactga

SEQ ID NO: 76154 - DNA, 25 bp, Homo sapien
tcctggcagtgtgtgatactgagga

SEQ ID NO: 76155 - DNA, 25 bp, Homo sapien
agctgtcctcatttgtgactatgga

SEQ ID NO: 76156 - DNA, 25 bp, Homo sapien
tcctcatttgtgactatggacctat

SEQ ID NO: 76157 - DNA, 25 bp, Homo sapien
tcatttgtgactatggacctatgga

SEQ ID NO: 76158 - DNA, 25 bp, Homo sapien
ttgtgactatggacctatggagttg

SEQ ID NO: 76159 - DNA, 25 bp, Homo sapien
actatggacctatggagttgggaca

SEQ ID NO: 76160 - DNA, 25 bp, Homo sapien
tggacctatggagttgggacaatct

SEQ ID NO: 76161 - DNA, 25 bp, Homo sapien
gacctatggagttgggacaatctct

SEQ ID NO: 76162 - DNA, 25 bp, Homo sapien
tatggagttgggacaatctctatgg

SEQ ID NO: 76163 - DNA, 25 bp, Homo sapien
ttttttaccatatcgttcaagtttg

SEQ ID NO: 76164 - DNA, 25 bp, Homo sapien
agcagtgtttccttacatatgttct

SEQ ID NO: 76165 - DNA, 25 bp, Homo sapien
atgttctgtatagtgctagccctga

SEQ ID NO: 76166 - DNA, 25 bp, Homo sapien
gtgctagccctgataaattctctgt

SEQ ID NO: 76167 - DNA, 25 bp, Homo sapien
tagccctgataaattctctgtgaat

SEQ ID NO: 76168 - DNA, 25 bp, Homo sapien
gtttccagtgtcaaaacgtttctgt

SEQ ID NO: 76169 - DNA, 25 bp, Homo sapien
ttgaataaatgtttccaagggcaaa

SEQ ID NO: 76170 - DNA, 25 bp, Homo sapien
aaaattaagactccttgcacagtgg

SEQ ID NO: 76171 - DNA, 25 bp, Homo sapien
actccttgcacagtggatccatgta

SEQ ID NO: 76172 - DNA, 25 bp, Homo sapien
gatccatgtatcctaatatgcttgt

SEQ ID NO: 76173 - DNA, 25 bp, Homo sapien
tgtaactaggatgaagcaactttta

SEQ ID NO: 76174 - DNA, 25 bp, Homo sapien
gggcaggcggggtctttgttctcgg

SEQ ID NO: 76175 - DNA, 25 bp, Homo sapien
ggcaggcggggtctttgttctcggc

SEQ ID NO: 76176 - DNA, 25 bp, Homo sapien
ggactagacagaagtggggcggcct

SEQ ID NO: 76177 - DNA, 25 bp, Homo sapien
actagacagaagtggggcggcctga

SEQ ID NO: 76178 - DNA, 25 bp, Homo sapien
acagaagtggggcggcctgaaccct

SEQ ID NO: 76179 - DNA, 25 bp, Homo sapien
gaaccctgcttccagccatggccag

SEQ ID NO: 76180 - DNA, 25 bp, Homo sapien
aaccctgcttccagccatggccagg

SEQ ID NO: 76181 - DNA, 25 bp, Homo sapien
tggccaggggccacggaacccggca

SEQ ID NO: 76182 - DNA, 25 bp, Homo sapien
ggccaggggccacggaacccggcag

SEQ ID NO: 76183 - DNA, 25 bp, Homo sapien
acggaacccggcaggggtgtctgag

SEQ ID NO: 76184 - DNA, 25 bp, Homo sapien
tgtgtgtttatctaataaagtccca

SEQ ID NO: 76185 - DNA, 25 bp, Homo sapien
gcaaggcggccgacgaagctatgga

SEQ ID NO: 76186 - DNA, 25 bp, Homo sapien
gctatggaggagagacgcaggctgc

SEQ ID NO: 76187 - DNA, 25 bp, Homo sapien
aggagccgccggaagatgtggccca

SEQ ID NO: 76188 - DNA, 25 bp, Homo sapien
ccggctcaagacatttccttgcaag

SEQ ID NO: 76189 - DNA, 25 bp, Homo sapien
agacatttccttgcaagaggtttaa

SEQ ID NO: 76190 - DNA, 25 bp, Homo sapien
tgcaagaggtttaaggagggcacct

SEQ ID NO: 76191 - DNA, 25 bp, Homo sapien
agggcacctgtcaacgcggggacca

SEQ ID NO: 76192 - DNA, 25 bp, Homo sapien
gggaccagtgctgctactcccacag

SEQ ID NO: 76193 - DNA, 25 bp, Homo sapien
cgacacccagggtttctgctgatgc

SEQ ID NO: 76194 - DNA, 25 bp, Homo sapien
acacccagggtttctgctgatgctg

SEQ ID NO: 76195 - DNA, 25 bp, Homo sapien
tgaaccaataaagagatgtcacgtc

SEQ ID NO: 76196 - DNA, 25 bp, Homo sapien
tctcctcaaatcaagccctggacag

SEQ ID NO: 76197 - DNA, 25 bp, Homo sapien
tcctcaaatcaagccctggacaggt

SEQ ID NO: 76198 - DNA, 25 bp, Homo sapien
tcaaatcaagccctggacaggtctc

SEQ ID NO: 76199 - DNA, 25 bp, Homo sapien
caaatcaagccctggacaggtctcg

SEQ ID NO: 76200 - DNA, 25 bp, Homo sapien
aaatcaagccctggacaggtctcgc

SEQ ID NO: 76201 - DNA, 25 bp, Homo sapien
aatcaagccctggacaggtctcgca

SEQ ID NO: 76202 - DNA, 25 bp, Homo sapien
atcaagccctggacaggtctcgcac

SEQ ID NO: 76203 - DNA, 25 bp, Homo sapien
ggacaggtctcgcacccacaagtac

SEQ ID NO: 76204 - DNA, 25 bp, Homo sapien
cacccacaagtactatctgctgcag

SEQ ID NO: 76205 - DNA, 25 bp, Homo sapien
gctgcagagatcctctcatctgtgg

SEQ ID NO: 76206 - DNA, 25 bp, Homo sapien
tcatctgtggccaggcacgcctgta

SEQ ID NO: 76207 - DNA, 25 bp, Homo sapien
gattcggtcggtaaagacgtcttct

SEQ ID NO: 76208 - DNA, 25 bp, Homo sapien
ttcggtcggtaaagacgtcttctag

SEQ ID NO: 76209 - DNA, 25 bp, Homo sapien
tcggtcggtaaagacgtcttctaga

SEQ ID NO: 76210 - DNA, 25 bp, Homo sapien
cggtcggtaaagacgtcttctagag

SEQ ID NO: 76211 - DNA, 25 bp, Homo sapien
ggtcggtaaagacgtcttctagagc

SEQ ID NO: 76212 - DNA, 25 bp, Homo sapien
acttcacctacaatattgttaacta

SEQ ID NO: 76213 - DNA, 25 bp, Homo sapien
cttcacctacaatattgttaactat

SEQ ID NO: 76214 - DNA, 25 bp, Homo sapien
taactatttgttaacttgtgaatac

SEQ ID NO: 76215 - DNA, 25 bp, Homo sapien
aactatttgttaacttgtgaatacg

SEQ ID NO: 76216 - DNA, 25 bp, Homo sapien
gttgtcatagtttcagtaggtcata

SEQ ID NO: 76217 - DNA, 25 bp, Homo sapien
tagggagatgagtttgtatgctgta

SEQ ID NO: 76218 - DNA, 25 bp, Homo sapien
gtatgctgtactatgcagcgtttaa

SEQ ID NO: 76219 - DNA, 25 bp, Homo sapien
tgcagcgtttaaagttagtgggttt

SEQ ID NO: 76220 - DNA, 25 bp, Homo sapien
gaatattgctgtctgttacaaagtc

SEQ ID NO: 76221 - DNA, 25 bp, Homo sapien
aaatctgtatgtgcaattcaccggt

SEQ ID NO: 76222 - DNA, 25 bp, Homo sapien
atgtgcaattcaccggtattaccag

SEQ ID NO: 76223 - DNA, 25 bp, Homo sapien
caccggtattaccagtttattatgt

SEQ ID NO: 76224 - DNA, 25 bp, Homo sapien
gagatttggcatgacatgttctgta

SEQ ID NO: 76225 - DNA, 25 bp, Homo sapien
atgctttttcaagaactaacacagt

SEQ ID NO: 76226 - DNA, 25 bp, Homo sapien
gaactaacacagttattcctatact

SEQ ID NO: 76227 - DNA, 25 bp, Homo sapien
gtgaagcctacagtgagtctcggaa

SEQ ID NO: 76228 - DNA, 25 bp, Homo sapien
tgaagcctacagtgagtctcggaat

SEQ ID NO: 76229 - DNA, 25 bp, Homo sapien
aagcctacagtgagtctcggaattc

SEQ ID NO: 76230 - DNA, 25 bp, Homo sapien
gcctacagtgagtctcggaattcca

SEQ ID NO: 76231 - DNA, 25 bp, Homo sapien
ctacagtgagtctcggaattccaga

SEQ ID NO: 76232 - DNA, 25 bp, Homo sapien
gtgagtctcggaattccagaccacg

SEQ ID NO: 76233 - DNA, 25 bp, Homo sapien
gagtctcggaattccagaccacggg

SEQ ID NO: 76234 - DNA, 25 bp, Homo sapien
gtctcggaattccagaccacgggcc

SEQ ID NO: 76235 - DNA, 25 bp, Homo sapien
agaccacgggccaggtgctatggct

SEQ ID NO: 76236 - DNA, 25 bp, Homo sapien
gaccacgggccaggtgctatggctc

SEQ ID NO: 76237 - DNA, 25 bp, Homo sapien
acaaaaagtcgggagcggtggcaca

SEQ ID NO: 76238 - DNA, 25 bp, Homo sapien
gaagatactcattcctggagctaag

SEQ ID NO: 76239 - DNA, 25 bp, Homo sapien
agctaagggtagctttaggtatcta

SEQ ID NO: 76240 - DNA, 25 bp, Homo sapien
taggtatctagcttcatcaggcata

SEQ ID NO: 76241 - DNA, 25 bp, Homo sapien
ggactgcctaatatctatttaccta

SEQ ID NO: 76242 - DNA, 25 bp, Homo sapien
ttacttacccatcagtcctctagtc

SEQ ID NO: 76243 - DNA, 25 bp, Homo sapien
tctagtcctccaaactactgtagca

SEQ ID NO: 76244 - DNA, 25 bp, Homo sapien
tactgtagcagatactttgccacct

SEQ ID NO: 76245 - DNA, 25 bp, Homo sapien
gatactttgccaccttttaacttgt

SEQ ID NO: 76246 - DNA, 25 bp, Homo sapien
tgccaccttttaacttgtttgaaga

SEQ ID NO: 76247 - DNA, 25 bp, Homo sapien
gaccattttacttatgatgttcaga

SEQ ID NO: 76248 - DNA, 25 bp, Homo sapien
aatctatgatttcctacaaccagta

SEQ ID NO: 76249 - DNA, 25 bp, Homo sapien
tccatatccctttgcagtcagttca

SEQ ID NO: 76250 - DNA, 25 bp, Homo sapien
tttgcagtcagttcatccctaccct

SEQ ID NO: 76251 - DNA, 25 bp, Homo sapien
taccctggcccagatgatcactgat

SEQ ID NO: 76252 - DNA, 25 bp, Homo sapien
tgatcactgatcttgtcattataga

SEQ ID NO: 76253 - DNA, 25 bp, Homo sapien
tagatgagttttgccagttcaagaa

SEQ ID NO: 76254 - DNA, 25 bp, Homo sapien
gtaagcattcttgtgtaatacttca

SEQ ID NO: 76255 - DNA, 25 bp, Homo sapien
gtgtaatacttcattctctctcatt

SEQ ID NO: 76256 - DNA, 25 bp, Homo sapien
catccatattgttgaatgtttcact

SEQ ID NO: 76257 - DNA, 25 bp, Homo sapien
gaatgtttcactagttaatgtttat

SEQ ID NO: 76258 - DNA, 25 bp, Homo sapien
aagcctattcacttgctgatggatc

SEQ ID NO: 76259 - DNA, 25 bp, Homo sapien
tgctgatggatctttggtttgtttc

SEQ ID NO: 76260 - DNA, 25 bp, Homo sapien
aaacctctgtagcattccagcggct

SEQ ID NO: 76261 - DNA, 25 bp, Homo sapien
tgtagcattccagcggcttgaccaa

SEQ ID NO: 76262 - DNA, 25 bp, Homo sapien
cagcggcttgaccaatgacctatgt

SEQ ID NO: 76263 - DNA, 25 bp, Homo sapien
acctatgtcacaagaggtggcgtgt

SEQ ID NO: 76264 - DNA, 25 bp, Homo sapien
ctgaagacagcactacaagtctggg

SEQ ID NO: 76265 - DNA, 25 bp, Homo sapien
gggagccagttttaacatcagtgca

SEQ ID NO: 76266 - DNA, 25 bp, Homo sapien
tgctggtggccctgcagtgtacgtt

SEQ ID NO: 76267 - DNA, 25 bp, Homo sapien
tgcagtgtacgttctcacctcttat

SEQ ID NO: 76268 - DNA, 25 bp, Homo sapien
tcacctcttatgcttagttggaact

SEQ ID NO: 76269 - DNA, 25 bp, Homo sapien
gcagtttgtaaactttcatcctttt

SEQ ID NO: 76270 - DNA, 25 bp, Homo sapien
gtaaattcacaaagctttggaagga

SEQ ID NO: 76271 - DNA, 25 bp, Homo sapien
gctctctgcagctgtctcattcctt

SEQ ID NO: 76272 - DNA, 25 bp, Homo sapien
cattccttcccaacgatagtaacag

SEQ ID NO: 76273 - DNA, 25 bp, Homo sapien
ggaaatgactctttagcatcgatac

SEQ ID NO: 76274 - DNA, 25 bp, Homo sapien
actctttagcatcgatacctcaaca

SEQ ID NO: 76275 - DNA, 25 bp, Homo sapien
gagaactagggttaaccttgactat

SEQ ID NO: 76276 - DNA, 25 bp, Homo sapien
gggttaaccttgactatatttagag

SEQ ID NO: 76277 - DNA, 25 bp, Homo sapien
tatttagaggtctttttgcctcttt

SEQ ID NO: 76278 - DNA, 25 bp, Homo sapien
tgcctcttttccccttaacaaggat

SEQ ID NO: 76279 - DNA, 25 bp, Homo sapien
caaggatttcttatggtggtttcag

SEQ ID NO: 76280 - DNA, 25 bp, Homo sapien
ttgagagagctcatctaccctgtct

SEQ ID NO: 76281 - DNA, 25 bp, Homo sapien
tcatctaccctgtctgttggtcaga

SEQ ID NO: 76282 - DNA, 25 bp, Homo sapien
atgacactccttgcttgttgtgttg

SEQ ID NO: 76283 - DNA, 25 bp, Homo sapien
ttgttgtgttgcttcctattggcta

SEQ ID NO: 76284 - DNA, 25 bp, Homo sapien
ttcctattggctagcttcctaaggg

SEQ ID NO: 76285 - DNA, 25 bp, Homo sapien
agggaaccgagttatcaagatggga

SEQ ID NO: 76286 - DNA, 25 bp, Homo sapien
tttctctctgtctttaggagtaggg

SEQ ID NO: 76287 - DNA, 25 bp, Homo sapien
tgggcatcagggatcacatcactct

SEQ ID NO: 76288 - DNA, 25 bp, Homo sapien
gatcacatcactcttaacggctgtt

SEQ ID NO: 76289 - DNA, 25 bp, Homo sapien
taacggctgttacttaaacaactat

SEQ ID NO: 76290 - DNA, 25 bp, Homo sapien
agcgagggcggctgctcctgctaat

SEQ ID NO: 76291 - DNA, 25 bp, Homo sapien
gctgctcctgctaatgcagagccga

SEQ ID NO: 76292 - DNA, 25 bp, Homo sapien
taatgcagagccgacctgtggcttc

SEQ ID NO: 76293 - DNA, 25 bp, Homo sapien
tctatgcagccatgaaccgccaatt

SEQ ID NO: 76294 - DNA, 25 bp, Homo sapien
aattccgccaagcatatggctccat

SEQ ID NO: 76295 - DNA, 25 bp, Homo sapien
gagggccccggagtttccataggct

SEQ ID NO: 76296 - DNA, 25 bp, Homo sapien
ggctccattagaactgtgaccctag

SEQ ID NO: 76297 - DNA, 25 bp, Homo sapien
gtgaccctagtcaccagaattcagg

SEQ ID NO: 76298 - DNA, 25 bp, Homo sapien
agaattcaggactgtctcctccagg

SEQ ID NO: 76299 - DNA, 25 bp, Homo sapien
actgtctcctccaggaccaaagtgg

SEQ ID NO: 76300 - DNA, 25 bp, Homo sapien
acacatgtgggcattttcacaacaa

SEQ ID NO: 76301 - DNA, 25 bp, Homo sapien
aagtctctccatcacttgatcaatg

SEQ ID NO: 76302 - DNA, 25 bp, Homo sapien
ttgatcaatgtttcagccctagact

SEQ ID NO: 76303 - DNA, 25 bp, Homo sapien
cagccctagactgcccaaggagtat

SEQ ID NO: 76304 - DNA, 25 bp, Homo sapien
agttcaagttcacagttggcgccac

SEQ ID NO: 76305 - DNA, 25 bp, Homo sapien
agttggcgccacagccgtttgtcaa

SEQ ID NO: 76306 - DNA, 25 bp, Homo sapien
gtaagtttaaagcacctgattggga

SEQ ID NO: 76307 - DNA, 25 bp, Homo sapien
ctgattgggagtgttttgcgtgttc

SEQ ID NO: 76308 - DNA, 25 bp, Homo sapien
gtgttttgcgtgttcggaatcactt

SEQ ID NO: 76309 - DNA, 25 bp, Homo sapien
tcggaatcacttgtaatgttggctg

SEQ ID NO: 76310 - DNA, 25 bp, Homo sapien
atgttggctgagacaatccttcctt

SEQ ID NO: 76311 - DNA, 25 bp, Homo sapien
agacaatccttccttgcactttgaa

SEQ ID NO: 76312 - DNA, 25 bp, Homo sapien
caatccttccttgcactttgaaaca

SEQ ID NO: 76313 - DNA, 25 bp, Homo sapien
ttgaaacactttgagcctttaagag

SEQ ID NO: 76314 - DNA, 25 bp, Homo sapien
ctttgagcctttaagagatagcctg

SEQ ID NO: 76315 - DNA, 25 bp, Homo sapien
aaggaatctttgatgcgagtctgca

SEQ ID NO: 76316 - DNA, 25 bp, Homo sapien
tctttgatgcgagtctgcatttgaa

SEQ ID NO: 76317 - DNA, 25 bp, Homo sapien
gcccaagttgatcagcttaccggaa

SEQ ID NO: 76318 - DNA, 25 bp, Homo sapien
gttgatcagcttaccggaagaaatg

SEQ ID NO: 76319 - DNA, 25 bp, Homo sapien
gctcagggaatctcggaaagaggct

SEQ ID NO: 76320 - DNA, 25 bp, Homo sapien
attattcacagcagttggcaaaagc

SEQ ID NO: 76321 - DNA, 25 bp, Homo sapien
gaaactagtcttttacgacaatcag

SEQ ID NO: 76322 - DNA, 25 bp, Homo sapien
gtcttttacgacaatcagaaggatc

SEQ ID NO: 76323 - DNA, 25 bp, Homo sapien
cagaaggatcgaatgttgtttttaa

SEQ ID NO: 76324 - DNA, 25 bp, Homo sapien
aggaattgacttacctgatgggata

SEQ ID NO: 76325 - DNA, 25 bp, Homo sapien
gacttacctgatgggatagcaccat

SEQ ID NO: 76326 - DNA, 25 bp, Homo sapien
tctgagtaattcactggtttataat

SEQ ID NO: 76327 - DNA, 25 bp, Homo sapien
atgttttcgtggcatgtaaattttt

SEQ ID NO: 76328 - DNA, 25 bp, Homo sapien
ggtacagatagttatcatcagtctt

SEQ ID NO: 76329 - DNA, 25 bp, Homo sapien
atcatcagtctttgtatcaagtgct

SEQ ID NO: 76330 - DNA, 25 bp, Homo sapien
gtctttgtatcaagtgctgtaattt

SEQ ID NO: 76331 - DNA, 25 bp, Homo sapien
attattctaccctagtcatcttcac

SEQ ID NO: 76332 - DNA, 25 bp, Homo sapien
cctagtcatcttcactcgtgtatta

SEQ ID NO: 76333 - DNA, 25 bp, Homo sapien
tcactcgtgtattaagtcattcact

SEQ ID NO: 76334 - DNA, 25 bp, Homo sapien
gtcattcactttatatagggtttgc

SEQ ID NO: 76335 - DNA, 25 bp, Homo sapien
tagggtttgctataaatccctagaa

SEQ ID NO: 76336 - DNA, 25 bp, Homo sapien
agtgcacagtgtgattgtttacaaa

SEQ ID NO: 76337 - DNA, 25 bp, Homo sapien
gggcctgtctctgcaagtggagcca

SEQ ID NO: 76338 - DNA, 25 bp, Homo sapien
ctgtctctgcaagtggagccagagt

SEQ ID NO: 76339 - DNA, 25 bp, Homo sapien
gtggaggaatgagctctgaagacac

SEQ ID NO: 76340 - DNA, 25 bp, Homo sapien
tgagctctgaagacacagcacccag

SEQ ID NO: 76341 - DNA, 25 bp, Homo sapien
agccaagccttaactgcctgcctga

SEQ ID NO: 76342 - DNA, 25 bp, Homo sapien
tgaccctgaaccagaacccagctga

SEQ ID NO: 76343 - DNA, 25 bp, Homo sapien
tgaaccagaacccagctgaactgcc

SEQ ID NO: 76344 - DNA, 25 bp, Homo sapien
gaactgcccctccaagggacaggaa

SEQ ID NO: 76345 - DNA, 25 bp, Homo sapien
gagggagtttacaacccaagccatt

SEQ ID NO: 76346 - DNA, 25 bp, Homo sapien
ggagaatgacacatcaagctgctaa

SEQ ID NO: 76347 - DNA, 25 bp, Homo sapien
gacacatcaagctgctaacaattgg

SEQ ID NO: 76348 - DNA, 25 bp, Homo sapien
tttggaagcaaattcatacgatcgt

SEQ ID NO: 76349 - DNA, 25 bp, Homo sapien
ggaagcaaattcatacgatcgtgag

SEQ ID NO: 76350 - DNA, 25 bp, Homo sapien
gaagcaaattcatacgatcgtgagt

SEQ ID NO: 76351 - DNA, 25 bp, Homo sapien
gcaaattcatacgatcgtgagtgat

SEQ ID NO: 76352 - DNA, 25 bp, Homo sapien
tcatacgatcgtgagtgatttctcc

SEQ ID NO: 76353 - DNA, 25 bp, Homo sapien
atacgatcgtgagtgatttctccaa

SEQ ID NO: 76354 - DNA, 25 bp, Homo sapien
tacgatcgtgagtgatttctccaaa

SEQ ID NO: 76355 - DNA, 25 bp, Homo sapien
acgatcgtgagtgatttctccaaag

SEQ ID NO: 76356 - DNA, 25 bp, Homo sapien
cgatcgtgagtgatttctccaaaga

SEQ ID NO: 76357 - DNA, 25 bp, Homo sapien
gatcgtgagtgatttctccaaagaa

SEQ ID NO: 76358 - DNA, 25 bp, Homo sapien
atcgtgagtgatttctccaaagaaa

SEQ ID NO: 76359 - DNA, 25 bp, Homo sapien
gccctgatgcagtcactgaacatgc

SEQ ID NO: 76360 - DNA, 25 bp, Homo sapien
cctgatgcagtcactgaacatgctg

SEQ ID NO: 76361 - DNA, 25 bp, Homo sapien
gatgcagtcactgaacatgctggtg

SEQ ID NO: 76362 - DNA, 25 bp, Homo sapien
atgcagtcactgaacatgctggtgc

SEQ ID NO: 76363 - DNA, 25 bp, Homo sapien
gcagtcactgaacatgctggtgcag

SEQ ID NO: 76364 - DNA, 25 bp, Homo sapien
cagtcactgaacatgctggtgcaga

SEQ ID NO: 76365 - DNA, 25 bp, Homo sapien
agtcactgaacatgctggtgcagac

SEQ ID NO: 76366 - DNA, 25 bp, Homo sapien
gtcactgaacatgctggtgcagact

SEQ ID NO: 76367 - DNA, 25 bp, Homo sapien
tcactgaacatgctggtgcagactg

SEQ ID NO: 76368 - DNA, 25 bp, Homo sapien
ctggtgcagactgaaggcaaggagc

SEQ ID NO: 76369 - DNA, 25 bp, Homo sapien
agactgaaggcaaggagcggagcct

SEQ ID NO: 76370 - DNA, 25 bp, Homo sapien
gaacccagctgaactgcccctccaa

SEQ ID NO: 76371 - DNA, 25 bp, Homo sapien
ggagaatgacacatcaagctgctaa

SEQ ID NO: 76372 - DNA, 25 bp, Homo sapien
gagaatgacacatcaagctgctaac

SEQ ID NO: 76373 - DNA, 25 bp, Homo sapien
agaatgacacatcaagctgctaaca

SEQ ID NO: 76374 - DNA, 25 bp, Homo sapien
gaatgacacatcaagctgctaacaa

SEQ ID NO: 76375 - DNA, 25 bp, Homo sapien
aatgacacatcaagctgctaacaat

SEQ ID NO: 76376 - DNA, 25 bp, Homo sapien
atgacacatcaagctgctaacaatt

SEQ ID NO: 76377 - DNA, 25 bp, Homo sapien
tgacacatcaagctgctaacaattg

SEQ ID NO: 76378 - DNA, 25 bp, Homo sapien
gacacatcaagctgctaacaattgg

SEQ ID NO: 76379 - DNA, 25 bp, Homo sapien
acacatcaagctgctaacaattggg

SEQ ID NO: 76380 - DNA, 25 bp, Homo sapien
atcaagctgctaacaattgggggaa

SEQ ID NO: 76381 - DNA, 25 bp, Homo sapien
tttgtttaaagatggatgaaaggcc

SEQ ID NO: 76382 - DNA, 25 bp, Homo sapien
ttgtttaaagatggatgaaaggcca

SEQ ID NO: 76383 - DNA, 25 bp, Homo sapien
tgtttaaagatggatgaaaggccag

SEQ ID NO: 76384 - DNA, 25 bp, Homo sapien
gtttaaagatggatgaaaggccagg

SEQ ID NO: 76385 - DNA, 25 bp, Homo sapien
tttaaagatggatgaaaggccaggc

SEQ ID NO: 76386 - DNA, 25 bp, Homo sapien
ttaaagatggatgaaaggccaggca

SEQ ID NO: 76387 - DNA, 25 bp, Homo sapien
taaagatggatgaaaggccaggcat

SEQ ID NO: 76388 - DNA, 25 bp, Homo sapien
aaagatggatgaaaggccaggcatg

SEQ ID NO: 76389 - DNA, 25 bp, Homo sapien
aagatggatgaaaggccaggcatgg

SEQ ID NO: 76390 - DNA, 25 bp, Homo sapien
ttgcagttgagccaagatcacgaca

SEQ ID NO: 76391 - DNA, 25 bp, Homo sapien
agttgagccaagatcacgacactgc

SEQ ID NO: 76392 - DNA, 25 bp, Homo sapien
tagggcccaaggctcagctttcagg

SEQ ID NO: 76393 - DNA, 25 bp, Homo sapien
tttcaggcctgcagcttcagccatg

SEQ ID NO: 76394 - DNA, 25 bp, Homo sapien
ttcagccatgtctctacaagcgcag

SEQ ID NO: 76395 - DNA, 25 bp, Homo sapien
tacaagcgcaggtgacctctggatc

SEQ ID NO: 76396 - DNA, 25 bp, Homo sapien
gacctctggatcttccttgaaaggg

SEQ ID NO: 76397 - DNA, 25 bp, Homo sapien
aactccaggctcagaactgtgaaga

SEQ ID NO: 76398 - DNA, 25 bp, Homo sapien
gtggaccctgaggacaaagtgtgat

SEQ ID NO: 76399 - DNA, 25 bp, Homo sapien
caaagtgtgataaaacctctggctc

SEQ ID NO: 76400 - DNA, 25 bp, Homo sapien
aaaacctctggctcagacttgctct

SEQ ID NO: 76401 - DNA, 25 bp, Homo sapien
agacttgctctactgaaggcttctt

SEQ ID NO: 76402 - DNA, 25 bp, Homo sapien
gaaggcttcttggttataagatgca

SEQ ID NO: 76403 - DNA, 25 bp, Homo sapien
cggtctcgtgctatctggagtccta

SEQ ID NO: 76404 - DNA, 25 bp, Homo sapien
gtctcgtgctatctggagtcctaca

SEQ ID NO: 76405 - DNA, 25 bp, Homo sapien
tcgtgctatctggagtcctacacaa

SEQ ID NO: 76406 - DNA, 25 bp, Homo sapien
gtgctatctggagtcctacacaagg

SEQ ID NO: 76407 - DNA, 25 bp, Homo sapien
tgctatctggagtcctacacaaggc

SEQ ID NO: 76408 - DNA, 25 bp, Homo sapien
ccaccgctgtagtaggattcggatc

SEQ ID NO: 76409 - DNA, 25 bp, Homo sapien
cgctgtagtaggattcggatcatca

SEQ ID NO: 76410 - DNA, 25 bp, Homo sapien
tgtagtaggattcggatcatcacct

SEQ ID NO: 76411 - DNA, 25 bp, Homo sapien
tttggaaaatgttcacctgcagatg

SEQ ID NO: 76412 - DNA, 25 bp, Homo sapien
cgggagccgcggtctcgtgctatct

SEQ ID NO: 76413 - DNA, 25 bp, Homo sapien
agccgcggtctcgtgctatctggag

SEQ ID NO: 76414 - DNA, 25 bp, Homo sapien
tatcccctggagcttggatactgtc

SEQ ID NO: 76415 - DNA, 25 bp, Homo sapien
agcttggatactgtctgcacttcaa

SEQ ID NO: 76416 - DNA, 25 bp, Homo sapien
tgcacttcaaggcaggaattctcaa

SEQ ID NO: 76417 - DNA, 25 bp, Homo sapien
gaattctcaagggagacttgtttga

SEQ ID NO: 76418 - DNA, 25 bp, Homo sapien
acttgtttgaaaatgagtgtctcac

SEQ ID NO: 76419 - DNA, 25 bp, Homo sapien
tgaaattgaatccattacggttggg

SEQ ID NO: 76420 - DNA, 25 bp, Homo sapien
tgtgtcccgacacataatctctgtc

SEQ ID NO: 76421 - DNA, 25 bp, Homo sapien
acataatctctgtctcttggacctg

SEQ ID NO: 76422 - DNA, 25 bp, Homo sapien
caccatcactttctgggtcaggatt

SEQ ID NO: 76423 - DNA, 25 bp, Homo sapien
gggacagttgtctataaaactctag

SEQ ID NO: 76424 - DNA, 25 bp, Homo sapien
tagtgtaaatattagcactcccctc

SEQ ID NO: 76425 - DNA, 25 bp, Homo sapien
ttggttaagttcacaaagttagcag

SEQ ID NO: 76426 - DNA, 25 bp, Homo sapien
gttcacaaagttagcagaagattta

SEQ ID NO: 76427 - DNA, 25 bp, Homo sapien
ttacaggcttcacctgtactgtcag

SEQ ID NO: 76428 - DNA, 25 bp, Homo sapien
acaggcttcacctgtactgtcaggg

SEQ ID NO: 76429 - DNA, 25 bp, Homo sapien
gcttcacctgtactgtcagggcaag

SEQ ID NO: 76430 - DNA, 25 bp, Homo sapien
tcacctgtactgtcagggcaagaga

SEQ ID NO: 76431 - DNA, 25 bp, Homo sapien
acctgtactgtcagggcaagagaaa

SEQ ID NO: 76432 - DNA, 25 bp, Homo sapien
tacagcagtttaccagtgtgatggc

SEQ ID NO: 76433 - DNA, 25 bp, Homo sapien
gcagtttaccagtgtgatggctgtg

SEQ ID NO: 76434 - DNA, 25 bp, Homo sapien
atggctgtgacacagctccactcca

SEQ ID NO: 76435 - DNA, 25 bp, Homo sapien
tccactccacgggtggacacagcag

SEQ ID NO: 76436 - DNA, 25 bp, Homo sapien
aggcagagactcactcccgtttgta

SEQ ID NO: 76437 - DNA, 25 bp, Homo sapien
gactcactcccgtttgtattatgaa

SEQ ID NO: 76438 - DNA, 25 bp, Homo sapien
gaaaacacacgccaataggacataa

SEQ ID NO: 76439 - DNA, 25 bp, Homo sapien
gaagcaagagtactgggctttacca

SEQ ID NO: 76440 - DNA, 25 bp, Homo sapien
gagttcaaatctcatttctggcaat

SEQ ID NO: 76441 - DNA, 25 bp, Homo sapien
tctggcaattcctatgtctaaaaaa

SEQ ID NO: 76442 - DNA, 25 bp, Homo sapien
agcttcgtaatctcttttgagccct

SEQ ID NO: 76443 - DNA, 25 bp, Homo sapien
gtaatctcttttgagccctcacatt

SEQ ID NO: 76444 - DNA, 25 bp, Homo sapien
tatcttagagaatcaccttgaccag

SEQ ID NO: 76445 - DNA, 25 bp, Homo sapien
tgaccagaatgttcaacgccaagaa

SEQ ID NO: 76446 - DNA, 25 bp, Homo sapien
tattctttccagattccttaaaaat

SEQ ID NO: 76447 - DNA, 25 bp, Homo sapien
cgagctacggtcctcccggagtgcc

SEQ ID NO: 76448 - DNA, 25 bp, Homo sapien
tacggcccccccatgctgatgatgc

SEQ ID NO: 76449 - DNA, 25 bp, Homo sapien
gggccgcgacctggcctcagtgccc

SEQ ID NO: 76450 - DNA, 25 bp, Homo sapien
agcagacagtccttccgcatggcca

SEQ ID NO: 76451 - DNA, 25 bp, Homo sapien
ttccgcatggccatgggaaacccca

SEQ ID NO: 76452 - DNA, 25 bp, Homo sapien
gaaaccccagtgagttctttgtgga

SEQ ID NO: 76453 - DNA, 25 bp, Homo sapien
aaaccccagtgagttctttgtggat

SEQ ID NO: 76454 - DNA, 25 bp, Homo sapien
gatgtgatgtgagcagggcccctcc

SEQ ID NO: 76455 - DNA, 25 bp, Homo sapien
atgtgatgtgagcagggcccctccc

SEQ ID NO: 76456 - DNA, 25 bp, Homo sapien
tgtgatgtgagcagggcccctcccc

SEQ ID NO: 76457 - DNA, 25 bp, Homo sapien
tctctccatccgtccgtctttttta

SEQ ID NO: 76458 - DNA, 25 bp, Homo sapien
tttttctttacccatcttctgtgct

SEQ ID NO: 76459 - DNA, 25 bp, Homo sapien
atcttctgtgcttaatttcatcccc

SEQ ID NO: 76460 - DNA, 25 bp, Homo sapien
gtgcttaatttcatccccttctttt

SEQ ID NO: 76461 - DNA, 25 bp, Homo sapien
tcctactctggcctttagtccagtt

SEQ ID NO: 76462 - DNA, 25 bp, Homo sapien
tactctggcctttagtccagttcac

SEQ ID NO: 76463 - DNA, 25 bp, Homo sapien
tggcctttagtccagttcaccctgc

SEQ ID NO: 76464 - DNA, 25 bp, Homo sapien
ttcctcggagatccttttcttccaa

SEQ ID NO: 76465 - DNA, 25 bp, Homo sapien
tcggagatccttttcttccaatctt

SEQ ID NO: 76466 - DNA, 25 bp, Homo sapien
caccccttgtcttaaagcagctgga

SEQ ID NO: 76467 - DNA, 25 bp, Homo sapien
taaagcagctggagatgagcgccga

SEQ ID NO: 76468 - DNA, 25 bp, Homo sapien
gagcgccgaggagctgggtctagaa

SEQ ID NO: 76469 - DNA, 25 bp, Homo sapien
gcccagtccttgactcgtccatgga

SEQ ID NO: 76470 - DNA, 25 bp, Homo sapien
cccagtccttgactcgtccatggag

SEQ ID NO: 76471 - DNA, 25 bp, Homo sapien
gactcgtccatggagctgagggtcg

SEQ ID NO: 76472 - DNA, 25 bp, Homo sapien
ctcgtccatggagctgagggtcgga

SEQ ID NO: 76473 - DNA, 25 bp, Homo sapien
tccatggagctgagggtcggaggaa

SEQ ID NO: 76474 - DNA, 25 bp, Homo sapien
cacagcagaacccgtgggcgctcgt

SEQ ID NO: 76475 - DNA, 25 bp, Homo sapien
ggtgccgcatacaggaggtgcttaa

SEQ ID NO: 76476 - DNA, 25 bp, Homo sapien
gtgccgcatacaggaggtgcttaat

SEQ ID NO: 76477 - DNA, 25 bp, Homo sapien
tgccgcatacaggaggtgcttaata

SEQ ID NO: 76478 - DNA, 25 bp, Homo sapien
gccgcatacaggaggtgcttaataa

SEQ ID NO: 76479 - DNA, 25 bp, Homo sapien
gcatacaggaggtgcttaataaacg

SEQ ID NO: 76480 - DNA, 25 bp, Homo sapien
agagcttacaacctgccttaaaaat

SEQ ID NO: 76481 - DNA, 25 bp, Homo sapien
atacactgctatggaggacttggga

SEQ ID NO: 76482 - DNA, 25 bp, Homo sapien
agatcttgtcttgtagctgcttgtc

SEQ ID NO: 76483 - DNA, 25 bp, Homo sapien
ttgtctcctactatacctgtctgac

SEQ ID NO: 76484 - DNA, 25 bp, Homo sapien
gacacaatatcaccagagcaagcca

SEQ ID NO: 76485 - DNA, 25 bp, Homo sapien
gagcaagccatagacagcctgcgag

SEQ ID NO: 76486 - DNA, 25 bp, Homo sapien
gacagcctgcgagacctaagaggat

SEQ ID NO: 76487 - DNA, 25 bp, Homo sapien
gggcaatacagaccatcaagcaata

SEQ ID NO: 76488 - DNA, 25 bp, Homo sapien
aattatcttcatgagtttcgggaca

SEQ ID NO: 76489 - DNA, 25 bp, Homo sapien
gtttcgggacaaattagctgcacat

SEQ ID NO: 76490 - DNA, 25 bp, Homo sapien
attagctgcacatctatcatcaaga

SEQ ID NO: 76491 - DNA, 25 bp, Homo sapien
aaatcatgacatgtctggctcgaaa

SEQ ID NO: 76492 - DNA, 25 bp, Homo sapien
gacatgtctggctcgaaaggcaaga

SEQ ID NO: 76493 - DNA, 25 bp, Homo sapien
aaggcaagagcccagcatcggtttt

SEQ ID NO: 76494 - DNA, 25 bp, Homo sapien
aagagcccagcatcggttttcagaa

SEQ ID NO: 76495 - DNA, 25 bp, Homo sapien
gcatcggttttcagaacacctacat

SEQ ID NO: 76496 - DNA, 25 bp, Homo sapien
agaacacctacatctggacagtcag

SEQ ID NO: 76497 - DNA, 25 bp, Homo sapien
ggacagtcagtatctacttgctcct

SEQ ID NO: 76498 - DNA, 25 bp, Homo sapien
tacttgctcctcaaagaacaccagc

SEQ ID NO: 76499 - DNA, 25 bp, Homo sapien
gttacttagtcagaatgaatcccaa

SEQ ID NO: 76500 - DNA, 25 bp, Homo sapien
atcttctctgaaggtggacttttaa

SEQ ID NO: 76501 - DNA, 25 bp, Homo sapien
tgcctgatggcaattctgaaactaa

SEQ ID NO: 76502 - DNA, 25 bp, Homo sapien
agcctgccaaggacctcatttagtt

SEQ ID NO: 76503 - DNA, 25 bp, Homo sapien
acggtgaactgaagtccagtcccac

SEQ ID NO: 76504 - DNA, 25 bp, Homo sapien
gaactgaagtccagtcccaccagga

SEQ ID NO: 76505 - DNA, 25 bp, Homo sapien
gcctccctgggtggacagcaataga

SEQ ID NO: 76506 - DNA, 25 bp, Homo sapien
cagacgcccaggaagtgaccttctc

SEQ ID NO: 76507 - DNA, 25 bp, Homo sapien
gtgaccttctcctggatgagctctc

SEQ ID NO: 76508 - DNA, 25 bp, Homo sapien
tggatgagctctcctggcccgtctg

SEQ ID NO: 76509 - DNA, 25 bp, Homo sapien
actcccgagcccacgaggctgttga

SEQ ID NO: 76510 - DNA, 25 bp, Homo sapien
acgaggctgttgaggcccctgcagc

SEQ ID NO: 76511 - DNA, 25 bp, Homo sapien
tgtccttggccaccagagactgcag

SEQ ID NO: 76512 - DNA, 25 bp, Homo sapien
agactgcagcccacaacccttggag

SEQ ID NO: 76513 - DNA, 25 bp, Homo sapien
acggctcgtcctccctgctttttgt

SEQ ID NO: 76514 - DNA, 25 bp, Homo sapien
agaaatgtgaaacccggcagcggcc

SEQ ID NO: 76515 - DNA, 25 bp, Homo sapien
cagcggccgacctaggcggtcttgt

SEQ ID NO: 76516 - DNA, 25 bp, Homo sapien
acctaggcggtcttgtggcccggag

SEQ ID NO: 76517 - DNA, 25 bp, Homo sapien
ggcccgaaaaccatagacctggttg

SEQ ID NO: 76518 - DNA, 25 bp, Homo sapien
catagacctggttgtactgtagctt

SEQ ID NO: 76519 - DNA, 25 bp, Homo sapien
gacctggttgtactgtagcttgttg

SEQ ID NO: 76520 - DNA, 25 bp, Homo sapien
ggttgtactgtagcttgttgtttgg

SEQ ID NO: 76521 - DNA, 25 bp, Homo sapien
gggaccaaattttctagagagaact

SEQ ID NO: 76522 - DNA, 25 bp, Homo sapien
gagagaactagagcacttttgttgt

SEQ ID NO: 76523 - DNA, 25 bp, Homo sapien
aactagagcacttttgttgtgtttt

SEQ ID NO: 76524 - DNA, 25 bp, Homo sapien
cacctgcggatggatgggtttctct

SEQ ID NO: 76525 - DNA, 25 bp, Homo sapien
gggtttctctgtaggccatgcaggc

SEQ ID NO: 76526 - DNA, 25 bp, Homo sapien
gagccaagtaaaaccagcacaacca

SEQ ID NO: 76527 - DNA, 25 bp, Homo sapien
acaaccagccaccagtggttggtga

SEQ ID NO: 76528 - DNA, 25 bp, Homo sapien
atgagcctgcgggtttgcctcaaga

SEQ ID NO: 76529 - DNA, 25 bp, Homo sapien
gcgggtttgcctcaagaaacttcat

SEQ ID NO: 76530 - DNA, 25 bp, Homo sapien
gaaacttcatgagggtctcttacta

SEQ ID NO: 76531 - DNA, 25 bp, Homo sapien
agggtctcttactaactccattaca

SEQ ID NO: 76532 - DNA, 25 bp, Homo sapien
ttactaactccattacactctctct

SEQ ID NO: 76533 - DNA, 25 bp, Homo sapien
ccatgtcaagcaggagggtaaagaa

SEQ ID NO: 76534 - DNA, 25 bp, Homo sapien
aagagcaggtctttcaagccacacc

SEQ ID NO: 76535 - DNA, 25 bp, Homo sapien
gccagagaatacatctttctatcca

SEQ ID NO: 76536 - DNA, 25 bp, Homo sapien
catgattcatcctttgctaaacatc

SEQ ID NO: 76537 - DNA, 25 bp, Homo sapien
ttcagctgtagttcatcccttatta

SEQ ID NO: 76538 - DNA, 25 bp, Homo sapien
agctgtagttcatcccttattagac

SEQ ID NO: 76539 - DNA, 25 bp, Homo sapien
gttcatcccttattagacactgcaa

SEQ ID NO: 76540 - DNA, 25 bp, Homo sapien
tcatcccttattagacactgcaaaa

SEQ ID NO: 76541 - DNA, 25 bp, Homo sapien
aacacatttaagaaataccttcagc

SEQ ID NO: 76542 - DNA, 25 bp, Homo sapien
gaaataccttcagcaatgttgtgtg

SEQ ID NO: 76543 - DNA, 25 bp, Homo sapien
atcaaagaatctatgttggagcaca

SEQ ID NO: 76544 - DNA, 25 bp, Homo sapien
tctatgttggagcacaagattctaa

SEQ ID NO: 76545 - DNA, 25 bp, Homo sapien
aagattctaaatcagtggttccctg

SEQ ID NO: 76546 - DNA, 25 bp, Homo sapien
ccctggcaggaatggaactccatca

SEQ ID NO: 76547 - DNA, 25 bp, Homo sapien
ctccatcagggaacagggcagctct

SEQ ID NO: 76548 - DNA, 25 bp, Homo sapien
gaacagggcagctctgtttgaatgg

SEQ ID NO: 76549 - DNA, 25 bp, Homo sapien
aattcttagcaagctccttgttctc

SEQ ID NO: 76550 - DNA, 25 bp, Homo sapien
agcaagctccttgttctctactgtt

SEQ ID NO: 76551 - DNA, 25 bp, Homo sapien
tgttctctactgttcaccgggacct

SEQ ID NO: 76552 - DNA, 25 bp, Homo sapien
accgggacctggctggcaaatgact

SEQ ID NO: 76553 - DNA, 25 bp, Homo sapien
ctggctggcaaatgacttagctatt

SEQ ID NO: 76554 - DNA, 25 bp, Homo sapien
ttaactctttctgcttcccatagca

SEQ ID NO: 76555 - DNA, 25 bp, Homo sapien
gcttcccatagcaggtctggttcct

SEQ ID NO: 76556 - DNA, 25 bp, Homo sapien
ggacaggagctgtctggagctccac

SEQ ID NO: 76557 - DNA, 25 bp, Homo sapien
gagaattaaccattgatacctcctg

SEQ ID NO: 76558 - DNA, 25 bp, Homo sapien
agaattaaccattgatacctcctgg

SEQ ID NO: 76559 - DNA, 25 bp, Homo sapien
gaattaaccattgatacctcctggc

SEQ ID NO: 76560 - DNA, 25 bp, Homo sapien
aattaaccattgatacctcctggct

SEQ ID NO: 76561 - DNA, 25 bp, Homo sapien
attaaccattgatacctcctggctg

SEQ ID NO: 76562 - DNA, 25 bp, Homo sapien
ttaaccattgatacctcctggctgg

SEQ ID NO: 76563 - DNA, 25 bp, Homo sapien
taaccattgatacctcctggctggg

SEQ ID NO: 76564 - DNA, 25 bp, Homo sapien
aaccattgatacctcctggctgggt

SEQ ID NO: 76565 - DNA, 25 bp, Homo sapien
accattgatacctcctggctgggtg

SEQ ID NO: 76566 - DNA, 25 bp, Homo sapien
attggcaaagctgggttatttcaaa

SEQ ID NO: 76567 - DNA, 25 bp, Homo sapien
aggaactctgatgctctgcgtggga

SEQ ID NO: 76568 - DNA, 25 bp, Homo sapien
tctgcgtgggaccatgcctgaactc

SEQ ID NO: 76569 - DNA, 25 bp, Homo sapien
tgaactccccgaataactgaaaaat

SEQ ID NO: 76570 - DNA, 25 bp, Homo sapien
atatttatttccaaggagtgagcct

SEQ ID NO: 76571 - DNA, 25 bp, Homo sapien
caaggagtgagcctaagactttttt

SEQ ID NO: 76572 - DNA, 25 bp, Homo sapien
tttccccttttgcaaattgctctaa

SEQ ID NO: 76573 - DNA, 25 bp, Homo sapien
attgctctaagaagtaccatgattt

SEQ ID NO: 76574 - DNA, 25 bp, Homo sapien
aactgatctatgctgtgtttgctta

SEQ ID NO: 76575 - DNA, 25 bp, Homo sapien
gttgaacacactatgaagaattcca

SEQ ID NO: 76576 - DNA, 25 bp, Homo sapien
gaagaattccaggtgtactagtgaa

SEQ ID NO: 76577 - DNA, 25 bp, Homo sapien
aaaggtgttcatgcaggagttcaaa

SEQ ID NO: 76578 - DNA, 25 bp, Homo sapien
aaagaaggacgcagagccagccaca

SEQ ID NO: 76579 - DNA, 25 bp, Homo sapien
acaggtcctctttagccacagggaa

SEQ ID NO: 76580 - DNA, 25 bp, Homo sapien
ttagccacagggaacctcctctgga

SEQ ID NO: 76581 - DNA, 25 bp, Homo sapien
agggaacctcctctggagctgaaag

SEQ ID NO: 76582 - DNA, 25 bp, Homo sapien
acctcctctggagctgaaagacaca

SEQ ID NO: 76583 - DNA, 25 bp, Homo sapien
gagctgaaagacacagacgccgctg

SEQ ID NO: 76584 - DNA, 25 bp, Homo sapien
agacgccgctgtgggtgacaacatt

SEQ ID NO: 76585 - DNA, 25 bp, Homo sapien
gtgggtgacaacattggctacatta

SEQ ID NO: 76586 - DNA, 25 bp, Homo sapien
tgacaacattggctacattaccttt

SEQ ID NO: 76587 - DNA, 25 bp, Homo sapien
taaggcctatattcacacacgtatg

SEQ ID NO: 76588 - DNA, 25 bp, Homo sapien
gcaggcctgtaatctgagctacgcg

SEQ ID NO: 76589 - DNA, 25 bp, Homo sapien
caggcctgtaatctgagctacgcgg

SEQ ID NO: 76590 - DNA, 25 bp, Homo sapien
aggcctgtaatctgagctacgcggg

SEQ ID NO: 76591 - DNA, 25 bp, Homo sapien
ggcctgtaatctgagctacgcggga

SEQ ID NO: 76592 - DNA, 25 bp, Homo sapien
aggcagaggtgcaatgatcatgcca

SEQ ID NO: 76593 - DNA, 25 bp, Homo sapien
ggcagaggtgcaatgatcatgccat

SEQ ID NO: 76594 - DNA, 25 bp, Homo sapien
gcagaggtgcaatgatcatgccatt

SEQ ID NO: 76595 - DNA, 25 bp, Homo sapien
cagaggtgcaatgatcatgccattg

SEQ ID NO: 76596 - DNA, 25 bp, Homo sapien
agaggtgcaatgatcatgccattgc

SEQ ID NO: 76597 - DNA, 25 bp, Homo sapien
gaggtgcaatgatcatgccattgca

SEQ ID NO: 76598 - DNA, 25 bp, Homo sapien
actttggaggccgaagtgggcagat

SEQ ID NO: 76599 - DNA, 25 bp, Homo sapien
tgagccggcgggtcctcctgagcgc

SEQ ID NO: 76600 - DNA, 25 bp, Homo sapien
ctctctggaggcctttctaggggat

SEQ ID NO: 76601 - DNA, 25 bp, Homo sapien
tgtgtttcccctcatggtgacgtga

SEQ ID NO: 76602 - DNA, 25 bp, Homo sapien
tttcccctcatggtgacgtgaggca

SEQ ID NO: 76603 - DNA, 25 bp, Homo sapien
cccctcatggtgacgtgaggcagga

SEQ ID NO: 76604 - DNA, 25 bp, Homo sapien
aggcaggagcagtgcgttttacctc

SEQ ID NO: 76605 - DNA, 25 bp, Homo sapien
aggagcagtgcgttttacctcagcc

SEQ ID NO: 76606 - DNA, 25 bp, Homo sapien
agcagtgcgttttacctcagccagt

SEQ ID NO: 76607 - DNA, 25 bp, Homo sapien
agtgcgttttacctcagccagtcag

SEQ ID NO: 76608 - DNA, 25 bp, Homo sapien
tgcgttttacctcagccagtcagta

SEQ ID NO: 76609 - DNA, 25 bp, Homo sapien
cgttttacctcagccagtcagtatg

SEQ ID NO: 76610 - DNA, 25 bp, Homo sapien
tatttatgttgatgtcaaacagctg

SEQ ID NO: 76611 - DNA, 25 bp, Homo sapien
gtcaaacagctgagcaccgtagcat

SEQ ID NO: 76612 - DNA, 25 bp, Homo sapien
aacagctgagcaccgtagcatgcag

SEQ ID NO: 76613 - DNA, 25 bp, Homo sapien
gagcaccgtagcatgcagatgtcaa

SEQ ID NO: 76614 - DNA, 25 bp, Homo sapien
gtagcatgcagatgtcaaggcagtt

SEQ ID NO: 76615 - DNA, 25 bp, Homo sapien
cagatgtcaaggcagttaggaagta

SEQ ID NO: 76616 - DNA, 25 bp, Homo sapien
aaatggtgtcttgtagatatgtgca

SEQ ID NO: 76617 - DNA, 25 bp, Homo sapien
tgcaaggtagcatgatgagcaactt

SEQ ID NO: 76618 - DNA, 25 bp, Homo sapien
gagcaacttgagtttgttgccactg

SEQ ID NO: 76619 - DNA, 25 bp, Homo sapien
atgttgccaaggctcatcttgagaa

SEQ ID NO: 76620 - DNA, 25 bp, Homo sapien
ctcatcttgagaagcaggcgggttg

SEQ ID NO: 76621 - DNA, 25 bp, Homo sapien
attctttatcatcctgtgttctgtt

SEQ ID NO: 76622 - DNA, 25 bp, Homo sapien
catcctgtgttctgtttagttgcaa

SEQ ID NO: 76623 - DNA, 25 bp, Homo sapien
gttctgtttagttgcaacaatctct

SEQ ID NO: 76624 - DNA, 25 bp, Homo sapien
caacaatctcttgtgactaatgtca

SEQ ID NO: 76625 - DNA, 25 bp, Homo sapien
gactaatgtcactcaaagcatcttg

SEQ ID NO: 76626 - DNA, 25 bp, Homo sapien
ggcttcctggaagttagttgccaaa

SEQ ID NO: 76627 - DNA, 25 bp, Homo sapien
aagtcatgcaagcatcacctgtcat

SEQ ID NO: 76628 - DNA, 25 bp, Homo sapien
aagcatcacctgtcattcttgtgtt

SEQ ID NO: 76629 - DNA, 25 bp, Homo sapien
acctgtcattcttgtgttggagtta

SEQ ID NO: 76630 - DNA, 25 bp, Homo sapien
ggagttatagaattctacatcttat

SEQ ID NO: 76631 - DNA, 25 bp, Homo sapien
acatcttataaaacctaactggcat

SEQ ID NO: 76632 - DNA, 25 bp, Homo sapien
agcaaatttgtctcttacccgaagc

SEQ ID NO: 76633 - DNA, 25 bp, Homo sapien
taggaaagctttcctaccatttttg

SEQ ID NO: 76634 - DNA, 25 bp, Homo sapien
tgttttaagttaacctcagtcatga

SEQ ID NO: 76635 - DNA, 25 bp, Homo sapien
gtgatggtttcaatgcctaaggaca

SEQ ID NO: 76636 - DNA, 25 bp, Homo sapien
gacagtgaagtctggagcccaaagt

SEQ ID NO: 76637 - DNA, 25 bp, Homo sapien
ggagcccaaagtacagtttcagcaa

SEQ ID NO: 76638 - DNA, 25 bp, Homo sapien
gtttgaaactctccattccatttct

SEQ ID NO: 76639 - DNA, 25 bp, Homo sapien
attccatttctataccccacaagtt

SEQ ID NO: 76640 - DNA, 25 bp, Homo sapien
ctataccccacaagttttcactgaa

SEQ ID NO: 76641 - DNA, 25 bp, Homo sapien
tggcagtgccactcaagaaaatgaa

SEQ ID NO: 76642 - DNA, 25 bp, Homo sapien
tttctcagccaccaattctacaaaa

SEQ ID NO: 76643 - DNA, 25 bp, Homo sapien
cttagatggtgagggctctagaaac

SEQ ID NO: 76644 - DNA, 25 bp, Homo sapien
gatggtgagggctctagaaaccaag

SEQ ID NO: 76645 - DNA, 25 bp, Homo sapien
tggtgagggctctagaaaccaagcc

SEQ ID NO: 76646 - DNA, 25 bp, Homo sapien
tgagggctctagaaaccaagcccca

SEQ ID NO: 76647 - DNA, 25 bp, Homo sapien
ggaccccagtgagaggcggtgggct

SEQ ID NO: 76648 - DNA, 25 bp, Homo sapien
gtgagaggcggtgggctgactggga

SEQ ID NO: 76649 - DNA, 25 bp, Homo sapien
ggtgggctgactgggaaggagaggc

SEQ ID NO: 76650 - DNA, 25 bp, Homo sapien
ttggaggcagacagactgcaccacc

SEQ ID NO: 76651 - DNA, 25 bp, Homo sapien
aggcagacagactgcaccacccctt

SEQ ID NO: 76652 - DNA, 25 bp, Homo sapien
cccctgcatctcaagaataaagcaa

SEQ ID NO: 76653 - DNA, 25 bp, Homo sapien
gcatctcaagaataaagcaagctgc

SEQ ID NO: 76654 - DNA, 25 bp, Homo sapien
caaagcagtagccacatggtgctgg

SEQ ID NO: 76655 - DNA, 25 bp, Homo sapien
acatggtgctggctcctttgcagca

SEQ ID NO: 76656 - DNA, 25 bp, Homo sapien
ctttgcagcacaaacctggtcattt

SEQ ID NO: 76657 - DNA, 25 bp, Homo sapien
gacttgaaaaatcacgtggattcat

SEQ ID NO: 76658 - DNA, 25 bp, Homo sapien
tggattcatattaccaccgctctca

SEQ ID NO: 76659 - DNA, 25 bp, Homo sapien
gctctcatttcatggagtcttctga

SEQ ID NO: 76660 - DNA, 25 bp, Homo sapien
ttctgatcaaaaaagctcacgtcgt

SEQ ID NO: 76661 - DNA, 25 bp, Homo sapien
aagctcacgtcgtatttcttctttt

SEQ ID NO: 76662 - DNA, 25 bp, Homo sapien
agaaattgggtgtttgtaccagaat

SEQ ID NO: 76663 - DNA, 25 bp, Homo sapien
gaattttgcttctcggttatcctgt

SEQ ID NO: 76664 - DNA, 25 bp, Homo sapien
tcggttatcctgtgcttcagatgat

SEQ ID NO: 76665 - DNA, 25 bp, Homo sapien
agtggtattaaggaactgtgtcttc

SEQ ID NO: 76666 - DNA, 25 bp, Homo sapien
ctgtgtcttcaggatacagtgagct

SEQ ID NO: 76667 - DNA, 25 bp, Homo sapien
caagaacacggaaactatggtagac

SEQ ID NO: 76668 - DNA, 25 bp, Homo sapien
aaactatggtagacgaatgggctga

SEQ ID NO: 76669 - DNA, 25 bp, Homo sapien
atgggctgaggacacagttcatgaa

SEQ ID NO: 76670 - DNA, 25 bp, Homo sapien
tatactcaagatagaagaacctgct

SEQ ID NO: 76671 - DNA, 25 bp, Homo sapien
gaagaacctgcttcatcttagtggt

SEQ ID NO: 76672 - DNA, 25 bp, Homo sapien
cctgcttcatcttagtggtgatttt

SEQ ID NO: 76673 - DNA, 25 bp, Homo sapien
aatttaaaatattccccgatgctgg

SEQ ID NO: 76674 - DNA, 25 bp, Homo sapien
tattccccgatgctgggagctaagt

SEQ ID NO: 76675 - DNA, 25 bp, Homo sapien
gttttttctctatcaagtttataca

SEQ ID NO: 76676 - DNA, 25 bp, Homo sapien
atagttgcagatcctgacagaatca

SEQ ID NO: 76677 - DNA, 25 bp, Homo sapien
aatcaaaactctctgcctcaaacac

SEQ ID NO: 76678 - DNA, 25 bp, Homo sapien
cctggcatcgcactgttagcattta

SEQ ID NO: 76679 - DNA, 25 bp, Homo sapien
taacttcttgttaggattcagggaa

SEQ ID NO: 76680 - DNA, 25 bp, Homo sapien
tttaaacaagccaaccacctagctg

SEQ ID NO: 76681 - DNA, 25 bp, Homo sapien
tagctggtaattaatgaggttcact

SEQ ID NO: 76682 - DNA, 25 bp, Homo sapien
aaattcggtgcacacagactgacat

SEQ ID NO: 76683 - DNA, 25 bp, Homo sapien
agactgacatgaaacctgggtgcta

SEQ ID NO: 76684 - DNA, 25 bp, Homo sapien
agtccagtttgtgtctcttaatcgc

SEQ ID NO: 76685 - DNA, 25 bp, Homo sapien
tgtgtctcttaatcgctcacttcaa

SEQ ID NO: 76686 - DNA, 25 bp, Homo sapien
ctcacttcaactcatttcttctaaa

SEQ ID NO: 76687 - DNA, 25 bp, Homo sapien
cctggatggcgggtttcagatgcat

SEQ ID NO: 76688 - DNA, 25 bp, Homo sapien
ggcgggtttcagatgcattatgaga

SEQ ID NO: 76689 - DNA, 25 bp, Homo sapien
tttatcgaagagcttttttcactga

SEQ ID NO: 76690 - DNA, 25 bp, Homo sapien
tttcactgatggttgtcaatcgtct

SEQ ID NO: 76691 - DNA, 25 bp, Homo sapien
gatggttgtcaatcgtctgaccgaa

SEQ ID NO: 76692 - DNA, 25 bp, Homo sapien
tcgtctgaccgaagaactcggctgt

SEQ ID NO: 76693 - DNA, 25 bp, Homo sapien
agaactcggctgtgatgagattatt

SEQ ID NO: 76694 - DNA, 25 bp, Homo sapien
gagagtagttagatgctgttaaaag

SEQ ID NO: 76695 - DNA, 25 bp, Homo sapien
ttccgctatcttttgggttcattcc

SEQ ID NO: 76696 - DNA, 25 bp, Homo sapien
ggttcattccaaatagttttgtgcc

SEQ ID NO: 76697 - DNA, 25 bp, Homo sapien
ttgtgccattgaaaaacttgacctt

SEQ ID NO: 76698 - DNA, 25 bp, Homo sapien
cagctattaatcacagtgtattagt

SEQ ID NO: 76699 - DNA, 25 bp, Homo sapien
gtatttcactatctttatactatat

SEQ ID NO: 76700 - DNA, 25 bp, Homo sapien
tataatatggttacttgggtaccgg

SEQ ID NO: 76701 - DNA, 25 bp, Homo sapien
aaaagcctgaggtatgatatagcat

SEQ ID NO: 76702 - DNA, 25 bp, Homo sapien
gaaaatatatttccctgtaagctga

SEQ ID NO: 76703 - DNA, 25 bp, Homo sapien
ttccctgtaagctgaattactcatt

SEQ ID NO: 76704 - DNA, 25 bp, Homo sapien
tttaacttctatatgggacccgaat

SEQ ID NO: 76705 - DNA, 25 bp, Homo sapien
gggacccgaattagacactgctgaa

SEQ ID NO: 76706 - DNA, 25 bp, Homo sapien
cgaattagacactgctgaatcctgt

SEQ ID NO: 76707 - DNA, 25 bp, Homo sapien
gaatcctgtacagccttactcataa

SEQ ID NO: 76708 - DNA, 25 bp, Homo sapien
cctgtacagccttactcataaataa

SEQ ID NO: 76709 - DNA, 25 bp, Homo sapien
atcaacaacccctttggctatctac

SEQ ID NO: 76710 - DNA, 25 bp, Homo sapien
caacaacccctttggctatctactg

SEQ ID NO: 76711 - DNA, 25 bp, Homo sapien
ctactgagacatgactaggaagaaa

SEQ ID NO: 76712 - DNA, 25 bp, Homo sapien
acatgactttatcattttgttatag

SEQ ID NO: 76713 - DNA, 25 bp, Homo sapien
gaagctgatatataaggttacacat

SEQ ID NO: 76714 - DNA, 25 bp, Homo sapien
ataaggttacacattttcatttatt

SEQ ID NO: 76715 - DNA, 25 bp, Homo sapien
ttttctgatttgaaggtataacctt

SEQ ID NO: 76716 - DNA, 25 bp, Homo sapien
accttcatgatgaattacttcttca

SEQ ID NO: 76717 - DNA, 25 bp, Homo sapien
attacttcttcagggtgttaaggca

SEQ ID NO: 76718 - DNA, 25 bp, Homo sapien
cttcagggtgttaaggcagtgactt

SEQ ID NO: 76719 - DNA, 25 bp, Homo sapien
gtgttaaggcagtgactttagaaac

SEQ ID NO: 76720 - DNA, 25 bp, Homo sapien
gaaatccaaagcactgtcagaaatg

SEQ ID NO: 76721 - DNA, 25 bp, Homo sapien
gcactgtcagaaatggaagatcctc

SEQ ID NO: 76722 - DNA, 25 bp, Homo sapien
tgggaacactgatgtcttcttgcac

SEQ ID NO: 76723 - DNA, 25 bp, Homo sapien
tgatgtcttcttgcaccgagtctta

SEQ ID NO: 76724 - DNA, 25 bp, Homo sapien
cgagtcttactcaggtcacacatgc

SEQ ID NO: 76725 - DNA, 25 bp, Homo sapien
tcacacatgcaggagttgggagatt

SEQ ID NO: 76726 - DNA, 25 bp, Homo sapien
aatgttataacatcatcccacctgg

SEQ ID NO: 76727 - DNA, 25 bp, Homo sapien
atcccacctggctttatccattaac

SEQ ID NO: 76728 - DNA, 25 bp, Homo sapien
tatccattaacatctgctcatctct

SEQ ID NO: 76729 - DNA, 25 bp, Homo sapien
cagcagttttaatcacttatccaaa

SEQ ID NO: 76730 - DNA, 25 bp, Homo sapien
gggtacctgtgacaaaaccaatgaa

SEQ ID NO: 76731 - DNA, 25 bp, Homo sapien
gagacctcatatgacgtggccttcg

SEQ ID NO: 76732 - DNA, 25 bp, Homo sapien
cgtggccttcgtgttgtcagagagt

SEQ ID NO: 76733 - DNA, 25 bp, Homo sapien
tgtcagagagtgtctggaagctgct

SEQ ID NO: 76734 - DNA, 25 bp, Homo sapien
ggaagctgctgttgccatcttgaac

SEQ ID NO: 76735 - DNA, 25 bp, Homo sapien
ctgttgccatcttgaacaactcacc

SEQ ID NO: 76736 - DNA, 25 bp, Homo sapien
agagccccagtgagagaggagcatt

SEQ ID NO: 76737 - DNA, 25 bp, Homo sapien
gccgggctccattcccaaggaaaag

SEQ ID NO: 76738 - DNA, 25 bp, Homo sapien
agagaggagcttgggctcacagaaa

SEQ ID NO: 76739 - DNA, 25 bp, Homo sapien
ggccctatctttgggatttacatgg

SEQ ID NO: 76740 - DNA, 25 bp, Homo sapien
ttctacaagtttgaccttagccatg

SEQ ID NO: 76741 - DNA, 25 bp, Homo sapien
gaccttagccatggtttgcaagtga

SEQ ID NO: 76742 - DNA, 25 bp, Homo sapien
ttctaacaataaatgctccgtgttt

SEQ ID NO: 76743 - DNA, 25 bp, Homo sapien
aatacatttcgcctattgcgacttt

SEQ ID NO: 76744 - DNA, 25 bp, Homo sapien
tattgcgactttttccatttaccct

SEQ ID NO: 76745 - DNA, 25 bp, Homo sapien
ttccatttaccctgaagcctagaaa

SEQ ID NO: 76746 - DNA, 25 bp, Homo sapien
ggtggaactcacacaaatggcattc

SEQ ID NO: 76747 - DNA, 25 bp, Homo sapien
gaggaacttcaacttctacagggaa

SEQ ID NO: 76748 - DNA, 25 bp, Homo sapien
ttctacagggaacagtggttggcca

SEQ ID NO: 76749 - DNA, 25 bp, Homo sapien
gttggccaggctgcagtataactga

SEQ ID NO: 76750 - DNA, 25 bp, Homo sapien
gtataactgaagcatgccttggaga

SEQ ID NO: 76751 - DNA, 25 bp, Homo sapien
gccatctccctttaatgtgttcatg

SEQ ID NO: 76752 - DNA, 25 bp, Homo sapien
ttgagtgtaagacttgccctttcta

SEQ ID NO: 76753 - DNA, 25 bp, Homo sapien
gtatacacactggatgaagagcttc

SEQ ID NO: 76754 - DNA, 25 bp, Homo sapien
gagcttcccaagagagtcaaatcta

SEQ ID NO: 76755 - DNA, 25 bp, Homo sapien
aaatctagactgtcagtagcctcag

SEQ ID NO: 76756 - DNA, 25 bp, Homo sapien
agtagcctcagacatgcgcttcaat

SEQ ID NO: 76757 - DNA, 25 bp, Homo sapien
tgcgcttcaatgagattttcacaga

SEQ ID NO: 76758 - DNA, 25 bp, Homo sapien
gagttatcaactcaagataccggga

SEQ ID NO: 76759 - DNA, 25 bp, Homo sapien
tatattgagcctgcactataccggg

SEQ ID NO: 76760 - DNA, 25 bp, Homo sapien
taggtgcttccagggtccaagggat

SEQ ID NO: 76761 - DNA, 25 bp, Homo sapien
aagggattctcagccatccaggcaa

SEQ ID NO: 76762 - DNA, 25 bp, Homo sapien
gagcactctgggttccacagcacag

SEQ ID NO: 76763 - DNA, 25 bp, Homo sapien
acatggaacgctgaagtctctgaaa

SEQ ID NO: 76764 - DNA, 25 bp, Homo sapien
aaggaccctcttgattacagcacag

SEQ ID NO: 76765 - DNA, 25 bp, Homo sapien
tacagcacaggaacttgatcgttgg

SEQ ID NO: 76766 - DNA, 25 bp, Homo sapien
gaagacccgtgtttcctggaccgcg

SEQ ID NO: 76767 - DNA, 25 bp, Homo sapien
gacccgtgtttcctggaccgcgaat

SEQ ID NO: 76768 - DNA, 25 bp, Homo sapien
gaccgcgaatcagtgtgttgggcat

SEQ ID NO: 76769 - DNA, 25 bp, Homo sapien
agtgtgttgggcatcagtgttttct

SEQ ID NO: 76770 - DNA, 25 bp, Homo sapien
ggcatcagtgttttctgcaagggtt

SEQ ID NO: 76771 - DNA, 25 bp, Homo sapien
gcaagggttgtgacctgaaactttt

SEQ ID NO: 76772 - DNA, 25 bp, Homo sapien
ttctgaatttatccatcaccaacca

SEQ ID NO: 76773 - DNA, 25 bp, Homo sapien
ttggataccatcaagtaacagctat

SEQ ID NO: 76774 - DNA, 25 bp, Homo sapien
gctattatttgccaagtggagctgt

SEQ ID NO: 76775 - DNA, 25 bp, Homo sapien
tggcaaacaaggaccggccagcctt

SEQ ID NO: 76776 - DNA, 25 bp, Homo sapien
agccttgcagctgtatgatccagga

SEQ ID NO: 76777 - DNA, 25 bp, Homo sapien
tatgatccaggagctcgcttccgag

SEQ ID NO: 76778 - DNA, 25 bp, Homo sapien
aaacaggaggatctgcaaggcagaa

SEQ ID NO: 76779 - DNA, 25 bp, Homo sapien
cagagtgagtcactgcacgcacctg

SEQ ID NO: 76780 - DNA, 25 bp, Homo sapien
gcctccatggacgagcaagggcatc

SEQ ID NO: 76781 - DNA, 25 bp, Homo sapien
gggcatcccagaaacgtgtaaatga

SEQ ID NO: 76782 - DNA, 25 bp, Homo sapien
acgtgtaaatgaccccgagtgtgac

SEQ ID NO: 76783 - DNA, 25 bp, Homo sapien
aaatgaccccgagtgtgactgggaa

SEQ ID NO: 76784 - DNA, 25 bp, Homo sapien
gaaggagaacttattccttaccagg

SEQ ID NO: 76785 - DNA, 25 bp, Homo sapien
acagagggtgacgtagaaacacgca

SEQ ID NO: 76786 - DNA, 25 bp, Homo sapien
ggtaactaggttatgggctctacat

SEQ ID NO: 76787 - DNA, 25 bp, Homo sapien
ggttatgggctctacattgtcagct

SEQ ID NO: 76788 - DNA, 25 bp, Homo sapien
gggctctacattgtcagctacttgg

SEQ ID NO: 76789 - DNA, 25 bp, Homo sapien
aaacatgtaaaacctgcatagcagc

SEQ ID NO: 76790 - DNA, 25 bp, Homo sapien
tctttagttctttactgtcactgtc

SEQ ID NO: 76791 - DNA, 25 bp, Homo sapien
agttctttactgtcactgtcatgta

SEQ ID NO: 76792 - DNA, 25 bp, Homo sapien
gtcactgtcatgtaatcagctaatt

SEQ ID NO: 76793 - DNA, 25 bp, Homo sapien
gttgctgtaaagtatgcatgttcct

SEQ ID NO: 76794 - DNA, 25 bp, Homo sapien
gtatgcatgttcctttcatgtgtat

SEQ ID NO: 76795 - DNA, 25 bp, Homo sapien
aatcatgatgtttaattttgcacac

SEQ ID NO: 76796 - DNA, 25 bp, Homo sapien
tttgcacacttatttgtaatgtttc

SEQ ID NO: 76797 - DNA, 25 bp, Homo sapien
gaagtttatcttggatacccttgaa

SEQ ID NO: 76798 - DNA, 25 bp, Homo sapien
gaggctgggtctcttcacatgaaga

SEQ ID NO: 76799 - DNA, 25 bp, Homo sapien
atgaagatcgaaaagggaccctgct

SEQ ID NO: 76800 - DNA, 25 bp, Homo sapien
ctcgagctactccagggcttagaag

SEQ ID NO: 76801 - DNA, 25 bp, Homo sapien
aagaatgctcttggtctgtgggtcc

SEQ ID NO: 76802 - DNA, 25 bp, Homo sapien
ctgtcatccatttaagtgttcccac

SEQ ID NO: 76803 - DNA, 25 bp, Homo sapien
actttcaagtgacaatcctctcctt

SEQ ID NO: 76804 - DNA, 25 bp, Homo sapien
ttggccctgccatagggcagagcat

SEQ ID NO: 76805 - DNA, 25 bp, Homo sapien
gagcatgtctggcatagcagcctga

SEQ ID NO: 76806 - DNA, 25 bp, Homo sapien
atagcagcctgacttttatgcccta

SEQ ID NO: 76807 - DNA, 25 bp, Homo sapien
ttttatgccctaatcttgagttgag

SEQ ID NO: 76808 - DNA, 25 bp, Homo sapien
gggacatgtgtcaactacatctgct

SEQ ID NO: 76809 - DNA, 25 bp, Homo sapien
gtcaactacatctgctacttctagt

SEQ ID NO: 76810 - DNA, 25 bp, Homo sapien
ggagtatcgttcaagagcctgcaaa

SEQ ID NO: 76811 - DNA, 25 bp, Homo sapien
aaaattgaactcctctggccagagc

SEQ ID NO: 76812 - DNA, 25 bp, Homo sapien
tctggccagagcatctctaattaat

SEQ ID NO: 76813 - DNA, 25 bp, Homo sapien
caaggagaaagttttcacacttcca

SEQ ID NO: 76814 - DNA, 25 bp, Homo sapien
ttcacacttccagaacagcctgtga

SEQ ID NO: 76815 - DNA, 25 bp, Homo sapien
gaacagcctgtgaagttacattaat

SEQ ID NO: 76816 - DNA, 25 bp, Homo sapien
cattaattagtttagcagccattgt

SEQ ID NO: 76817 - DNA, 25 bp, Homo sapien
agccattgtttgtactctccttagt

SEQ ID NO: 76818 - DNA, 25 bp, Homo sapien
tctccttagttagggttttctcgct

SEQ ID NO: 76819 - DNA, 25 bp, Homo sapien
ttctttgtttatacttcccctgatg

SEQ ID NO: 76820 - DNA, 25 bp, Homo sapien
tatacttcccctgatgccactggtt

SEQ ID NO: 76821 - DNA, 25 bp, Homo sapien
actggttccgatgccactggctggg

SEQ ID NO: 76822 - DNA, 25 bp, Homo sapien
tgctttgaaatgcttgtctgcagag

SEQ ID NO: 76823 - DNA, 25 bp, Homo sapien
gtctgcagagtcacagcagccatga

SEQ ID NO: 76824 - DNA, 25 bp, Homo sapien
gcagccatgaaaaccttatgaccgt

SEQ ID NO: 76825 - DNA, 25 bp, Homo sapien
gaccgtgcaaatgagctctgctcta

SEQ ID NO: 76826 - DNA, 25 bp, Homo sapien
aattgttgacattcatgtctctgag

SEQ ID NO: 76827 - DNA, 25 bp, Homo sapien
gtctctgagttacaaaagtgctaat

SEQ ID NO: 76828 - DNA, 25 bp, Homo sapien
tgtgtaagtaaacattgtgccttta

SEQ ID NO: 76829 - DNA, 25 bp, Homo sapien
gtgcctttactacttctttatgtaa

SEQ ID NO: 76830 - DNA, 25 bp, Homo sapien
gaaaatatagtttgattcttcattt

SEQ ID NO: 76831 - DNA, 25 bp, Homo sapien
taaatttgcaaatctcaggataaag

SEQ ID NO: 76832 - DNA, 25 bp, Homo sapien
agtaatgtactatagatataactgt

SEQ ID NO: 76833 - DNA, 25 bp, Homo sapien
taactgtacaaaaattgttcaacct

SEQ ID NO: 76834 - DNA, 25 bp, Homo sapien
gttcaacctaaaacaatctgtaatt

SEQ ID NO: 76835 - DNA, 25 bp, Homo sapien
caatctgtaattgcttattgtttta

SEQ ID NO: 76836 - DNA, 25 bp, Homo sapien
attgttttattgtatactctttgtc

SEQ ID NO: 76837 - DNA, 25 bp, Homo sapien
tattgtatactctttgtcttttaag

SEQ ID NO: 76838 - DNA, 25 bp, Homo sapien
tgtcttttaagacccctaatagcct

SEQ ID NO: 76839 - DNA, 25 bp, Homo sapien
ccctaatagccttttgtaacttgat

SEQ ID NO: 76840 - DNA, 25 bp, Homo sapien
gccttttgtaacttgatggcttaaa

SEQ ID NO: 76841 - DNA, 25 bp, Homo sapien
cttagatggtgagggctctagaaac

SEQ ID NO: 76842 - DNA, 25 bp, Homo sapien
atggtgagggctctagaaaccaagc

SEQ ID NO: 76843 - DNA, 25 bp, Homo sapien
tgagggctctagaaaccaagcccca

SEQ ID NO: 76844 - DNA, 25 bp, Homo sapien
gcagcagtggaagacctcgggccat

SEQ ID NO: 76845 - DNA, 25 bp, Homo sapien
acttggtggcgatccgcaacctgga

SEQ ID NO: 76846 - DNA, 25 bp, Homo sapien
ggaccccagtgagaggcggtgggct

SEQ ID NO: 76847 - DNA, 25 bp, Homo sapien
acctcctcaggatttgcacgtgtga

SEQ ID NO: 76848 - DNA, 25 bp, Homo sapien
gcacgtgtgaactaggctgcctgtg

SEQ ID NO: 76849 - DNA, 25 bp, Homo sapien
ttggaggcagacagactgcaccacc

SEQ ID NO: 76850 - DNA, 25 bp, Homo sapien
cccctgcatctcaagaataaagcaa

SEQ ID NO: 76851 - DNA, 25 bp, Homo sapien
gcatctcaagaataaagcaagctgc

SEQ ID NO: 76852 - DNA, 25 bp, Homo sapien
tgcaggagagcacactgatagaaat

SEQ ID NO: 76853 - DNA, 25 bp, Homo sapien
gcaggagagcacactgatagaaatc

SEQ ID NO: 76854 - DNA, 25 bp, Homo sapien
caggagagcacactgatagaaatcc

SEQ ID NO: 76855 - DNA, 25 bp, Homo sapien
ggagagcacactgatagaaatcctt

SEQ ID NO: 76856 - DNA, 25 bp, Homo sapien
gagagcacactgatagaaatccttg

SEQ ID NO: 76857 - DNA, 25 bp, Homo sapien
cactgatagaaatccttgtgtccag

SEQ ID NO: 76858 - DNA, 25 bp, Homo sapien
actgatagaaatccttgtgtccagt

SEQ ID NO: 76859 - DNA, 25 bp, Homo sapien
ctgatagaaatccttgtgtccagtg

SEQ ID NO: 76860 - DNA, 25 bp, Homo sapien
tgatagaaatccttgtgtccagtgc

SEQ ID NO: 76861 - DNA, 25 bp, Homo sapien
gatagaaatccttgtgtccagtgcc

SEQ ID NO: 76862 - DNA, 25 bp, Homo sapien
atagaaatccttgtgtccagtgccc

SEQ ID NO: 76863 - DNA, 25 bp, Homo sapien
tcggatggtctttgtaactgattct

SEQ ID NO: 76864 - DNA, 25 bp, Homo sapien
aactgattctggacatatgcatcat

SEQ ID NO: 76865 - DNA, 25 bp, Homo sapien
gcatcattgatgttgcagtgttgaa

SEQ ID NO: 76866 - DNA, 25 bp, Homo sapien
aaactgaagatgtcgtctgcttacg

SEQ ID NO: 76867 - DNA, 25 bp, Homo sapien
gtcgtctgcttacggaagcgctgaa

SEQ ID NO: 76868 - DNA, 25 bp, Homo sapien
ggatgtgatttattaacgaccaact

SEQ ID NO: 76869 - DNA, 25 bp, Homo sapien
aacgaccaacttctgttattgtgtg

SEQ ID NO: 76870 - DNA, 25 bp, Homo sapien
gtttttcatctgtgcatcaaatcac

SEQ ID NO: 76871 - DNA, 25 bp, Homo sapien
tagagctttttcctttatcagtccc

SEQ ID NO: 76872 - DNA, 25 bp, Homo sapien
ttgggcacagcaggtcctgaacacc

SEQ ID NO: 76873 - DNA, 25 bp, Homo sapien
aacaccctgctctacaatgttgcat

SEQ ID NO: 76874 - DNA, 25 bp, Homo sapien
atcttctgtgcttaatttcatcccc

SEQ ID NO: 76875 - DNA, 25 bp, Homo sapien
ttctgtgcttaatttcatccccttc

SEQ ID NO: 76876 - DNA, 25 bp, Homo sapien
tgtgcttaatttcatccccttcttt

SEQ ID NO: 76877 - DNA, 25 bp, Homo sapien
gtgcttaatttcatccccttctttt

SEQ ID NO: 76878 - DNA, 25 bp, Homo sapien
tcctactctggcctttagtccagtt

SEQ ID NO: 76879 - DNA, 25 bp, Homo sapien
tactctggcctttagtccagttcac

SEQ ID NO: 76880 - DNA, 25 bp, Homo sapien
tggcctttagtccagttcaccctgc

SEQ ID NO: 76881 - DNA, 25 bp, Homo sapien
ttcctcggagatccttttcttccaa

SEQ ID NO: 76882 - DNA, 25 bp, Homo sapien
tcggagatccttttcttccaatctt

SEQ ID NO: 76883 - DNA, 25 bp, Homo sapien
gatgagcgccgaggagctgggtcta

SEQ ID NO: 76884 - DNA, 25 bp, Homo sapien
agcgccgaggagctgggtctagaag

SEQ ID NO: 76885 - DNA, 25 bp, Homo sapien
gaagggtcccagagctgaccccact

SEQ ID NO: 76886 - DNA, 25 bp, Homo sapien
agctgaccccactccaggacctagg

SEQ ID NO: 76887 - DNA, 25 bp, Homo sapien
tggagcccctgaagaccagtcccac

SEQ ID NO: 76888 - DNA, 25 bp, Homo sapien
tggcctcatctgacactgctccgca

SEQ ID NO: 76889 - DNA, 25 bp, Homo sapien
tgtgtgtcctgttccatgttccggt

SEQ ID NO: 76890 - DNA, 25 bp, Homo sapien
tgtcctgttccatgttccggttcca

SEQ ID NO: 76891 - DNA, 25 bp, Homo sapien
tccatgttccggttccatccaaata

SEQ ID NO: 76892 - DNA, 25 bp, Homo sapien
atgttccggttccatccaaatacac

SEQ ID NO: 76893 - DNA, 25 bp, Homo sapien
ttccggttccatccaaatacacttt

SEQ ID NO: 76894 - DNA, 25 bp, Homo sapien
cggttccatccaaatacactttctg

SEQ ID NO: 76895 - DNA, 25 bp, Homo sapien
ggttccatccaaatacactttctgg

SEQ ID NO: 76896 - DNA, 25 bp, Homo sapien
atttagtcatctatccgttcttcac

SEQ ID NO: 76897 - DNA, 25 bp, Homo sapien
tatccgttcttcacttagcaggaat

SEQ ID NO: 76898 - DNA, 25 bp, Homo sapien
ggcacatgtttaagaggaataccta

SEQ ID NO: 76899 - DNA, 25 bp, Homo sapien
aaaggcaattgtgggctatttttat

SEQ ID NO: 76900 - DNA, 25 bp, Homo sapien
taaagtttagtgtctagggctggga

SEQ ID NO: 76901 - DNA, 25 bp, Homo sapien
ctgggagccaggactgatcttccat

SEQ ID NO: 76902 - DNA, 25 bp, Homo sapien
gccaggactgatcttccatttcttt

SEQ ID NO: 76903 - DNA, 25 bp, Homo sapien
agccatgcttttgtaacttgccagg

SEQ ID NO: 76904 - DNA, 25 bp, Homo sapien
taacttgccaggtggacttgaccaa

SEQ ID NO: 76905 - DNA, 25 bp, Homo sapien
ggacttgaccaactacattaccatg

SEQ ID NO: 76906 - DNA, 25 bp, Homo sapien
tacattaccatgctgtgcctcagtt

SEQ ID NO: 76907 - DNA, 25 bp, Homo sapien
agaagcaagtaaatcatcctctttt

SEQ ID NO: 76908 - DNA, 25 bp, Homo sapien
tcttttcaagagcagtgtccgtggt

SEQ ID NO: 76909 - DNA, 25 bp, Homo sapien
gtggtgtgcagttcctctccaattg

SEQ ID NO: 76910 - DNA, 25 bp, Homo sapien
caattgctgcgtggtcgtggcccga

SEQ ID NO: 76911 - DNA, 25 bp, Homo sapien
gtcacccagcctgtgagggtcctga

SEQ ID NO: 76912 - DNA, 25 bp, Homo sapien
agggtcctgactggagcaccttcta

SEQ ID NO: 76913 - DNA, 25 bp, Homo sapien
gagcaccttctaaatctaagattct

SEQ ID NO: 76914 - DNA, 25 bp, Homo sapien
taaatctaagattctgctgaggagc

SEQ ID NO: 76915 - DNA, 25 bp, Homo sapien
tgggcatgctgtgctcggacggaaa

SEQ ID NO: 76916 - DNA, 25 bp, Homo sapien
ccttgtgtccctgccgctgaagaat

SEQ ID NO: 76917 - DNA, 25 bp, Homo sapien
tgctctgagggaaacgctgtctgct

SEQ ID NO: 76918 - DNA, 25 bp, Homo sapien
gatctgttttgtgctgatatagtag

SEQ ID NO: 76919 - DNA, 25 bp, Homo sapien
gctggaagctcaatatcaaggtgtt

SEQ ID NO: 76920 - DNA, 25 bp, Homo sapien
ggtgttggcatcttgcaagggcctc

SEQ ID NO: 76921 - DNA, 25 bp, Homo sapien
gcctccttgctgtgccatcatatgg

SEQ ID NO: 76922 - DNA, 25 bp, Homo sapien
catcatatggcagaacgcacagaga

SEQ ID NO: 76923 - DNA, 25 bp, Homo sapien
gagagaaccactccattaatcccac

SEQ ID NO: 76924 - DNA, 25 bp, Homo sapien
taatcccaccatgagggcagggctt

SEQ ID NO: 76925 - DNA, 25 bp, Homo sapien
cagggcttctgtggcctaacgacct

SEQ ID NO: 76926 - DNA, 25 bp, Homo sapien
tctgtggcctaacgacctcttaaaa

SEQ ID NO: 76927 - DNA, 25 bp, Homo sapien
aaagtctccctctaaatactgatgg

SEQ ID NO: 76928 - DNA, 25 bp, Homo sapien
ggaatgccaattaagactcatgtga

SEQ ID NO: 76929 - DNA, 25 bp, Homo sapien
tggcaggtacgtgtagtccctgcta

SEQ ID NO: 76930 - DNA, 25 bp, Homo sapien
ggcaggtacgtgtagtccctgctac

SEQ ID NO: 76931 - DNA, 25 bp, Homo sapien
ggaccattgtcagaaaatgaatggc

SEQ ID NO: 76932 - DNA, 25 bp, Homo sapien
gaccattgtcagaaaatgaatggca

SEQ ID NO: 76933 - DNA, 25 bp, Homo sapien
gtcagaaaatgaatggcatggccgg

SEQ ID NO: 76934 - DNA, 25 bp, Homo sapien
tcagaaaatgaatggcatggccggg

SEQ ID NO: 76935 - DNA, 25 bp, Homo sapien
cagaaaatgaatggcatggccgggc

SEQ ID NO: 76936 - DNA, 25 bp, Homo sapien
gaaaatgaatggcatggccgggcgc

SEQ ID NO: 76937 - DNA, 25 bp, Homo sapien
aaaatgaatggcatggccgggcgcg

SEQ ID NO: 76938 - DNA, 25 bp, Homo sapien
aaatgaatggcatggccgggcgcgg

SEQ ID NO: 76939 - DNA, 25 bp, Homo sapien
aatgaatggcatggccgggcgcggt

SEQ ID NO: 76940 - DNA, 25 bp, Homo sapien
tggatgggctgctggcatgccaact

SEQ ID NO: 76941 - DNA, 25 bp, Homo sapien
ggagcgccctgttctgaaggcacct

SEQ ID NO: 76942 - DNA, 25 bp, Homo sapien
acctcctcacctcagaaactggtgg

SEQ ID NO: 76943 - DNA, 25 bp, Homo sapien
gaaactggtggtgctctcagggcaa

SEQ ID NO: 76944 - DNA, 25 bp, Homo sapien
ggtggtgctctcagggcaaaatcat

SEQ ID NO: 76945 - DNA, 25 bp, Homo sapien
agaacccctcttagaagcctctgag

SEQ ID NO: 76946 - DNA, 25 bp, Homo sapien
gaagcctctgagtccctctgcagaa

SEQ ID NO: 76947 - DNA, 25 bp, Homo sapien
cctctgcagaagaccgggcagcaaa

SEQ ID NO: 76948 - DNA, 25 bp, Homo sapien
gggcagcaaagcctccatctggaag

SEQ ID NO: 76949 - DNA, 25 bp, Homo sapien
tccatctggaagtctgtctgccttt

SEQ ID NO: 76950 - DNA, 25 bp, Homo sapien
ctgtctgcctttgttccttgaaaaa

SEQ ID NO: 76951 - DNA, 25 bp, Homo sapien
aaggatcctgccagacagcacactt

SEQ ID NO: 76952 - DNA, 25 bp, Homo sapien
agcacactttggaggaaggtctgca

SEQ ID NO: 76953 - DNA, 25 bp, Homo sapien
gccatttgttcttgaactctgggag

SEQ ID NO: 76954 - DNA, 25 bp, Homo sapien
cacccatcatgcgtggactgatagg

SEQ ID NO: 76955 - DNA, 25 bp, Homo sapien
aggacatcttttcgtggtgtgcacc

SEQ ID NO: 76956 - DNA, 25 bp, Homo sapien
gtggtgtgcaccagtgctttccaca

SEQ ID NO: 76957 - DNA, 25 bp, Homo sapien
gtgctttccacacttgacagtggtt

SEQ ID NO: 76958 - DNA, 25 bp, Homo sapien
acttgacagtggttggctttgatga

SEQ ID NO: 76959 - DNA, 25 bp, Homo sapien
ggctttgatgaaccctcatgctgca

SEQ ID NO: 76960 - DNA, 25 bp, Homo sapien
atgctgcaccttcagagccagtcct

SEQ ID NO: 76961 - DNA, 25 bp, Homo sapien
gagccagtcctctagtttggaataa

SEQ ID NO: 76962 - DNA, 25 bp, Homo sapien
gatcgggttacagatgggcaccaac

SEQ ID NO: 76963 - DNA, 25 bp, Homo sapien
gtctcaggcaggcatgactggctac

SEQ ID NO: 76964 - DNA, 25 bp, Homo sapien
gcatgactggctacgggatgccacg

SEQ ID NO: 76965 - DNA, 25 bp, Homo sapien
gggatgccacgccagatcctctgat

SEQ ID NO: 76966 - DNA, 25 bp, Homo sapien
ctgccctcccacgaatggttaatat

SEQ ID NO: 76967 - DNA, 25 bp, Homo sapien
atattttagcagtgacattcccaga

SEQ ID NO: 76968 - DNA, 25 bp, Homo sapien
ttagcagtgacattcccagagagcc

SEQ ID NO: 76969 - DNA, 25 bp, Homo sapien
gtgacattcccagagagccccagag

SEQ ID NO: 76970 - DNA, 25 bp, Homo sapien
agagctctcaagctcctttctgtca

SEQ ID NO: 76971 - DNA, 25 bp, Homo sapien
tcacctctgaggtgcctgctggcat

SEQ ID NO: 76972 - DNA, 25 bp, Homo sapien
tctcccccatgcttactaatacatt

SEQ ID NO: 76973 - DNA, 25 bp, Homo sapien
tctctctcctttttgaccagtgtca

SEQ ID NO: 76974 - DNA, 25 bp, Homo sapien
aagaaatcttgtggctccttttatt

SEQ ID NO: 76975 - DNA, 25 bp, Homo sapien
atattcacctgcctgggtgcacctg

SEQ ID NO: 76976 - DNA, 25 bp, Homo sapien
tgggtgcacctgtacagtacttctc

SEQ ID NO: 76977 - DNA, 25 bp, Homo sapien
aagaaggaagtcttgatccctccct

SEQ ID NO: 76978 - DNA, 25 bp, Homo sapien
aatatgagctaccacccaagaggaa

SEQ ID NO: 76979 - DNA, 25 bp, Homo sapien
ggtcaactgggaacctgagcacata

SEQ ID NO: 76980 - DNA, 25 bp, Homo sapien
gagcacatataactgtcagctgcta

SEQ ID NO: 76981 - DNA, 25 bp, Homo sapien
tgtcagctgctaaaagcttccagca

SEQ ID NO: 76982 - DNA, 25 bp, Homo sapien
gcaagaaatgcatccctgatcctat

SEQ ID NO: 76983 - DNA, 25 bp, Homo sapien
atcctatagctattgcatctctctc

SEQ ID NO: 76984 - DNA, 25 bp, Homo sapien
atttctctttaagaaaatggccatt

SEQ ID NO: 76985 - DNA, 25 bp, Homo sapien
tttctctttaagaaaatggccatta

SEQ ID NO: 76986 - DNA, 25 bp, Homo sapien
ttctctttaagaaaatggccattaa

SEQ ID NO: 76987 - DNA, 25 bp, Homo sapien
tctctttaagaaaatggccattaag

SEQ ID NO: 76988 - DNA, 25 bp, Homo sapien
agaaaatggccattaaggccgggtg

SEQ ID NO: 76989 - DNA, 25 bp, Homo sapien
gaaaatggccattaaggccgggtgg

SEQ ID NO: 76990 - DNA, 25 bp, Homo sapien
ttaaggccgggtggggtggcacatg

SEQ ID NO: 76991 - DNA, 25 bp, Homo sapien
gccaggatcacaccattgctgtcca

SEQ ID NO: 76992 - DNA, 25 bp, Homo sapien
ccaggatcacaccattgctgtccag

SEQ ID NO: 76993 - DNA, 25 bp, Homo sapien
caggatcacaccattgctgtccagc

SEQ ID NO: 76994 - DNA, 25 bp, Homo sapien
aggatcacaccattgctgtccagcc

SEQ ID NO: 76995 - DNA, 25 bp, Homo sapien
gggagatccagttagactctcctgc

SEQ ID NO: 76996 - DNA, 25 bp, Homo sapien
tcagaccctctgctccaaactaaga

SEQ ID NO: 76997 - DNA, 25 bp, Homo sapien
accctctgctccaaactaagactga

SEQ ID NO: 76998 - DNA, 25 bp, Homo sapien
tctgctccaaactaagactgatgtt

SEQ ID NO: 76999 - DNA, 25 bp, Homo sapien
aactaagactgatgttggccttcca

SEQ ID NO: 77000 - DNA, 25 bp, Homo sapien
ctaagactgatgttggccttccagt

SEQ ID NO: 77001 - DNA, 25 bp, Homo sapien
aagactgatgttggccttccagtgt

SEQ ID NO: 77002 - DNA, 25 bp, Homo sapien
actgatgttggccttccagtgtgat

SEQ ID NO: 77003 - DNA, 25 bp, Homo sapien
tgatgttggccttccagtgtgattc

SEQ ID NO: 77004 - DNA, 25 bp, Homo sapien
atgttggccttccagtgtgattctg

SEQ ID NO: 77005 - DNA, 25 bp, Homo sapien
ttggccttccagtgtgattctgaaa

SEQ ID NO: 77006 - DNA, 25 bp, Homo sapien
atttcagaccctggaaggaaaatag

SEQ ID NO: 77007 - DNA, 25 bp, Homo sapien
gtataaaatcctctaagttggcaac

SEQ ID NO: 77008 - DNA, 25 bp, Homo sapien
gttggcaactgaatttttatcattg

SEQ ID NO: 77009 - DNA, 25 bp, Homo sapien
cattgatttgtgtgatgtctacatc

SEQ ID NO: 77010 - DNA, 25 bp, Homo sapien
tgtgatgtctacatcttttaacttc

SEQ ID NO: 77011 - DNA, 25 bp, Homo sapien
ttaacttctggttctgttataaaga

SEQ ID NO: 77012 - DNA, 25 bp, Homo sapien
tataaagagtacatgtcacggttca

SEQ ID NO: 77013 - DNA, 25 bp, Homo sapien
gtacatgtcacggttcataggcagt

SEQ ID NO: 77014 - DNA, 25 bp, Homo sapien
gtcacggttcataggcagtaacatt

SEQ ID NO: 77015 - DNA, 25 bp, Homo sapien
cataggcagtaacatttcagagaac

SEQ ID NO: 77016 - DNA, 25 bp, Homo sapien
cagagaactgacatgaacaagtagt

SEQ ID NO: 77017 - DNA, 25 bp, Homo sapien
ctcacctcctggatggggcagctgg

SEQ ID NO: 77018 - DNA, 25 bp, Homo sapien
tcacctcctggatggggcagctggc

SEQ ID NO: 77019 - DNA, 25 bp, Homo sapien
cacctcctggatggggcagctggcc

SEQ ID NO: 77020 - DNA, 25 bp, Homo sapien
gcagctggccgggtgggtggctgac

SEQ ID NO: 77021 - DNA, 25 bp, Homo sapien
cagctggccgggtgggtggctgacc

SEQ ID NO: 77022 - DNA, 25 bp, Homo sapien
agctggccgggtgggtggctgaccc

SEQ ID NO: 77023 - DNA, 25 bp, Homo sapien
cacctccctccaggacggggtggct

SEQ ID NO: 77024 - DNA, 25 bp, Homo sapien
acctccctccaggacggggtggctg

SEQ ID NO: 77025 - DNA, 25 bp, Homo sapien
cctccctccaggacggggtggctgg

SEQ ID NO: 77026 - DNA, 25 bp, Homo sapien
ctccctccaggacggggtggctggc

SEQ ID NO: 77027 - DNA, 25 bp, Homo sapien
tccctccaggacggggtggctggcc

SEQ ID NO: 77028 - DNA, 25 bp, Homo sapien
gggctagacagctcagttcaccatg

SEQ ID NO: 77029 - DNA, 25 bp, Homo sapien
atgattctcttctgtcacctctgct

SEQ ID NO: 77030 - DNA, 25 bp, Homo sapien
tctgctggcacaccagtggcaaggc

SEQ ID NO: 77031 - DNA, 25 bp, Homo sapien
aaggcccagaatggcgacctctctt

SEQ ID NO: 77032 - DNA, 25 bp, Homo sapien
acctctctttagctcaatttctggg

SEQ ID NO: 77033 - DNA, 25 bp, Homo sapien
aatttctgggcctgaggtgctcaga

SEQ ID NO: 77034 - DNA, 25 bp, Homo sapien
aagatcaaatctctcctggctgtag

SEQ ID NO: 77035 - DNA, 25 bp, Homo sapien
tggctgtagtaacccagtggaatga

SEQ ID NO: 77036 - DNA, 25 bp, Homo sapien
ggaatgaatttggacatgccccaat

SEQ ID NO: 77037 - DNA, 25 bp, Homo sapien
atgccccaatgcttctatatgctaa

SEQ ID NO: 77038 - DNA, 25 bp, Homo sapien
gctaagtgaaatctgtgtctgtaat

SEQ ID NO: 77039 - DNA, 25 bp, Homo sapien
tcagtccctcctgaagggatctaat

SEQ ID NO: 77040 - DNA, 25 bp, Homo sapien
gggattattgccatcttacaccata

SEQ ID NO: 77041 - DNA, 25 bp, Homo sapien
gattattgccatcttacaccatatt

SEQ ID NO: 77042 - DNA, 25 bp, Homo sapien
gcttaatcataatctcacactgaag

SEQ ID NO: 77043 - DNA, 25 bp, Homo sapien
cacactgaagattttgcatcacttt

SEQ ID NO: 77044 - DNA, 25 bp, Homo sapien
gcatcacttttgctattatcattct

SEQ ID NO: 77045 - DNA, 25 bp, Homo sapien
ttataagccaaaagaatttacgcct

SEQ ID NO: 77046 - DNA, 25 bp, Homo sapien
gaatttacgccttaatgtgtcatta

SEQ ID NO: 77047 - DNA, 25 bp, Homo sapien
gtaaatattggtgtttgtttctgac

SEQ ID NO: 77048 - DNA, 25 bp, Homo sapien
gtttgtttctgacattttaacttga

SEQ ID NO: 77049 - DNA, 25 bp, Homo sapien
tttaacttgaaagcgatatgctgca

SEQ ID NO: 77050 - DNA, 25 bp, Homo sapien
gaagttgaatctggttattatttaa

SEQ ID NO: 77051 - DNA, 25 bp, Homo sapien
cagatcttactgaagatgatgttcc

SEQ ID NO: 77052 - DNA, 25 bp, Homo sapien
agcagcagcgacttagccccaggag

SEQ ID NO: 77053 - DNA, 25 bp, Homo sapien
aggagcccagtttcaatggccttgc

SEQ ID NO: 77054 - DNA, 25 bp, Homo sapien
agtttcaatggccttgctgtgtggt

SEQ ID NO: 77055 - DNA, 25 bp, Homo sapien
atggccttgctgtgtggtgtttcaa

SEQ ID NO: 77056 - DNA, 25 bp, Homo sapien
gctgtgtggtgtttcaagtgcattt

SEQ ID NO: 77057 - DNA, 25 bp, Homo sapien
gtggtgtttcaagtgcatttaaaat

SEQ ID NO: 77058 - DNA, 25 bp, Homo sapien
gtgacacagaaacggcacactcttc

SEQ ID NO: 77059 - DNA, 25 bp, Homo sapien
cacactcttccacatgcttttgaag

SEQ ID NO: 77060 - DNA, 25 bp, Homo sapien
tacaaatttgtcttagctattagca

SEQ ID NO: 77061 - DNA, 25 bp, Homo sapien
ctgttcactctgactctgtgcaaat

SEQ ID NO: 77062 - DNA, 25 bp, Homo sapien
actctgactctgtgcaaattgtatt

SEQ ID NO: 77063 - DNA, 25 bp, Homo sapien
tattacagtagaccgctgacgttcc

SEQ ID NO: 77064 - DNA, 25 bp, Homo sapien
tgacgttcccaagtgacagatccag

SEQ ID NO: 77065 - DNA, 25 bp, Homo sapien
aagtgacagatccagggcctttcaa

SEQ ID NO: 77066 - DNA, 25 bp, Homo sapien
ttcaaacatccccaaagtcatggcc

SEQ ID NO: 77067 - DNA, 25 bp, Homo sapien
aagtcatggccatactcaccattag

SEQ ID NO: 77068 - DNA, 25 bp, Homo sapien
catactcaccattagccagtttcta

SEQ ID NO: 77069 - DNA, 25 bp, Homo sapien
atctgtttcagggtatccagctgta

SEQ ID NO: 77070 - DNA, 25 bp, Homo sapien
tccagctgtagatgttcttatcccc

SEQ ID NO: 77071 - DNA, 25 bp, Homo sapien
atttattctcttttgtaactgctgt

SEQ ID NO: 77072 - DNA, 25 bp, Homo sapien
ggcaggatagccaagttcagcaaag

SEQ ID NO: 77073 - DNA, 25 bp, Homo sapien
gcaaagtgaggaccattactacgag

SEQ ID NO: 77074 - DNA, 25 bp, Homo sapien
ggtcaaactccataaagcagggcaa

SEQ ID NO: 77075 - DNA, 25 bp, Homo sapien
gggcaaagaccagcattttcctgtc

SEQ ID NO: 77076 - DNA, 25 bp, Homo sapien
aggacatcttatggtgcactgaaat

SEQ ID NO: 77077 - DNA, 25 bp, Homo sapien
tatttggtttcccagtccactatac

SEQ ID NO: 77078 - DNA, 25 bp, Homo sapien
actatactgacgtctccaacatgag

SEQ ID NO: 77079 - DNA, 25 bp, Homo sapien
aacatgagccgcttggcgaggcaga

SEQ ID NO: 77080 - DNA, 25 bp, Homo sapien
gccggtcatggagcgtgccagtcat

SEQ ID NO: 77081 - DNA, 25 bp, Homo sapien
ctcttcgctccgctgaaggagtatt

SEQ ID NO: 77082 - DNA, 25 bp, Homo sapien
gaaggagtattttgcgtgtgtgtaa

SEQ ID NO: 77083 - DNA, 25 bp, Homo sapien
ctcatgtcagcttctagtgtttttc

SEQ ID NO: 77084 - DNA, 25 bp, Homo sapien
gtcagcttctagtgtttttcaaaca

SEQ ID NO: 77085 - DNA, 25 bp, Homo sapien
gtaagggattgacacccttctgttt

SEQ ID NO: 77086 - DNA, 25 bp, Homo sapien
tgttttatggaattgctgctgatca

SEQ ID NO: 77087 - DNA, 25 bp, Homo sapien
ttatggaattgctgctgatcatttt

SEQ ID NO: 77088 - DNA, 25 bp, Homo sapien
aagttacagtacctttgtggcttca

SEQ ID NO: 77089 - DNA, 25 bp, Homo sapien
gtacctttgtggcttcattgaatat

SEQ ID NO: 77090 - DNA, 25 bp, Homo sapien
ggagacttccataagtttgtgtatt

SEQ ID NO: 77091 - DNA, 25 bp, Homo sapien
ttgtgtattatgttagtctatgaaa

SEQ ID NO: 77092 - DNA, 25 bp, Homo sapien
gtctatgaaaacgtgcaaatgtatt

SEQ ID NO: 77093 - DNA, 25 bp, Homo sapien
cgtgcaaatgtattgtagagacttt

SEQ ID NO: 77094 - DNA, 25 bp, Homo sapien
taaatgtcaacattccaacaagtgg

SEQ ID NO: 77095 - DNA, 25 bp, Homo sapien
gtgcctttggaggagaaaagcacac

SEQ ID NO: 77096 - DNA, 25 bp, Homo sapien
actggtggtggcagggagtctggca

SEQ ID NO: 77097 - DNA, 25 bp, Homo sapien
agtctggcagtgatgcctggaaaca

SEQ ID NO: 77098 - DNA, 25 bp, Homo sapien
tgatgcctggaaacagtacatgaga

SEQ ID NO: 77099 - DNA, 25 bp, Homo sapien
tctacttgtactatcaactacagta

SEQ ID NO: 77100 - DNA, 25 bp, Homo sapien
tcctctggcccaaggaatcaagttt

SEQ ID NO: 77101 - DNA, 25 bp, Homo sapien
tggcccaaggaatcaagtttcagta

SEQ ID NO: 77102 - DNA, 25 bp, Homo sapien
acatcccttaatttgaggtgttcca

SEQ ID NO: 77103 - DNA, 25 bp, Homo sapien
cccttaatttgaggtgttccagcag

SEQ ID NO: 77104 - DNA, 25 bp, Homo sapien
aaagttttccctgaataaatgcatt

SEQ ID NO: 77105 - DNA, 25 bp, Homo sapien
gtcagagcttttagaattacttttt

SEQ ID NO: 77106 - DNA, 25 bp, Homo sapien
ttagaattacttttttaagcagctg

SEQ ID NO: 77107 - DNA, 25 bp, Homo sapien
tttttaagcagctgtcttctggctg

SEQ ID NO: 77108 - DNA, 25 bp, Homo sapien
ttttaagcagctgtcttctggctgg

SEQ ID NO: 77109 - DNA, 25 bp, Homo sapien
tttaagcagctgtcttctggctggg

SEQ ID NO: 77110 - DNA, 25 bp, Homo sapien
ttaagcagctgtcttctggctgggt

SEQ ID NO: 77111 - DNA, 25 bp, Homo sapien
taagcagctgtcttctggctgggtg

SEQ ID NO: 77112 - DNA, 25 bp, Homo sapien
aagcagctgtcttctggctgggtgc

SEQ ID NO: 77113 - DNA, 25 bp, Homo sapien
catggtgcaaccccgtcttagtaaa

SEQ ID NO: 77114 - DNA, 25 bp, Homo sapien
attggcctggcgtgagagcgggcac

SEQ ID NO: 77115 - DNA, 25 bp, Homo sapien
ggcctggcgtgagagcgggcacctg

SEQ ID NO: 77116 - DNA, 25 bp, Homo sapien
gggcattcctgttacagaccaagga

SEQ ID NO: 77117 - DNA, 25 bp, Homo sapien
attcctgttacagaccaaggagaac

SEQ ID NO: 77118 - DNA, 25 bp, Homo sapien
gttacagaccaaggagaactggaga

SEQ ID NO: 77119 - DNA, 25 bp, Homo sapien
gagaaaatcagttcgtggttgcatt

SEQ ID NO: 77120 - DNA, 25 bp, Homo sapien
aaatcagttcgtggttgcattgtgg

SEQ ID NO: 77121 - DNA, 25 bp, Homo sapien
cagttcgtggttgcattgtggatgc

SEQ ID NO: 77122 - DNA, 25 bp, Homo sapien
gtggatgcaaatctgagcgttctca

SEQ ID NO: 77123 - DNA, 25 bp, Homo sapien
aaatctgagcgttctcaacttggtt

SEQ ID NO: 77124 - DNA, 25 bp, Homo sapien
tcctggactgactgatactacagtg

SEQ ID NO: 77125 - DNA, 25 bp, Homo sapien
tgactgatactacagtgcctcgccg

SEQ ID NO: 77126 - DNA, 25 bp, Homo sapien
atactacagtgcctcgccgcctggg

SEQ ID NO: 77127 - DNA, 25 bp, Homo sapien
atctgtatttatgtaccttgtcagt

SEQ ID NO: 77128 - DNA, 25 bp, Homo sapien
tttatgtaccttgtcagtgttttgc

SEQ ID NO: 77129 - DNA, 25 bp, Homo sapien
tttgctgttggttttctaaaacaat

SEQ ID NO: 77130 - DNA, 25 bp, Homo sapien
gcatgccatatgatcaggacagctt

SEQ ID NO: 77131 - DNA, 25 bp, Homo sapien
gatcaggacagcttttccactttac

SEQ ID NO: 77132 - DNA, 25 bp, Homo sapien
gacagcttttccactttactcggtt

SEQ ID NO: 77133 - DNA, 25 bp, Homo sapien
ctttactcggtttcctacaagcaag

SEQ ID NO: 77134 - DNA, 25 bp, Homo sapien
tactcggtttcctacaagcaagtag

SEQ ID NO: 77135 - DNA, 25 bp, Homo sapien
gtaggaaatacagtgaatttaccct

SEQ ID NO: 77136 - DNA, 25 bp, Homo sapien
gtgaatttaccctaaaatgtccaat

SEQ ID NO: 77137 - DNA, 25 bp, Homo sapien
taccctaaaatgtccaatctgtatt

SEQ ID NO: 77138 - DNA, 25 bp, Homo sapien
aatgaatatgattcctttcttcctg

SEQ ID NO: 77139 - DNA, 25 bp, Homo sapien
tatttgatttcttaccggcttaggc

SEQ ID NO: 77140 - DNA, 25 bp, Homo sapien
gcttaggcaagtattcaaccacaat

SEQ ID NO: 77141 - DNA, 25 bp, Homo sapien
acgtgggtcattacaagcaccattt

SEQ ID NO: 77142 - DNA, 25 bp, Homo sapien
accattttgttttcagagggataag

SEQ ID NO: 77143 - DNA, 25 bp, Homo sapien
ggataagcttatttgttcaaggcat

SEQ ID NO: 77144 - DNA, 25 bp, Homo sapien
agactttgtcaagcccagatggttt

SEQ ID NO: 77145 - DNA, 25 bp, Homo sapien
gatggtttctagctacctgtttgca

SEQ ID NO: 77146 - DNA, 25 bp, Homo sapien
gctacctgtttgcatatttcaagtg

SEQ ID NO: 77147 - DNA, 25 bp, Homo sapien
agtggcaacgggaaccaacctcttg

SEQ ID NO: 77148 - DNA, 25 bp, Homo sapien
tggcgggtgctgaattccactctgt

SEQ ID NO: 77149 - DNA, 25 bp, Homo sapien
gctggcggcgcaactccgaagaaga

SEQ ID NO: 77150 - DNA, 25 bp, Homo sapien
cggcgcaactccgaagaagagcgct

SEQ ID NO: 77151 - DNA, 25 bp, Homo sapien
aagagcgctaagaaaacaccgaaga

SEQ ID NO: 77152 - DNA, 25 bp, Homo sapien
aacaccgaagaaagcgaagaagccg

SEQ ID NO: 77153 - DNA, 25 bp, Homo sapien
gaaagcgaagaagccggccgcggcc

SEQ ID NO: 77154 - DNA, 25 bp, Homo sapien
ggccgcggccactgtaaccaagaaa

SEQ ID NO: 77155 - DNA, 25 bp, Homo sapien
ccgcggccactgtaaccaagaaagt

SEQ ID NO: 77156 - DNA, 25 bp, Homo sapien
gaaagtggctaagagcccaaagaag

SEQ ID NO: 77157 - DNA, 25 bp, Homo sapien
gtcaagcctaagaaggcggcgccca

SEQ ID NO: 77158 - DNA, 25 bp, Homo sapien
aaggcggcgcccaagaagaaatagg

SEQ ID NO: 77159 - DNA, 25 bp, Homo sapien
gaaataggcgaacgcctacttctaa

SEQ ID NO: 77160 - DNA, 25 bp, Homo sapien
atcctcggttttcctactgacactt

SEQ ID NO: 77161 - DNA, 25 bp, Homo sapien
ttttcctactgacactttcgattgc

SEQ ID NO: 77162 - DNA, 25 bp, Homo sapien
gacactttcgattgctttcatttgt

SEQ ID NO: 77163 - DNA, 25 bp, Homo sapien
gattgctttcatttgttgtgctcag

SEQ ID NO: 77164 - DNA, 25 bp, Homo sapien
ttgttgtgctcaggtaaaagtttca

SEQ ID NO: 77165 - DNA, 25 bp, Homo sapien
tcaggtaaaagtttcacatctgctt

SEQ ID NO: 77166 - DNA, 25 bp, Homo sapien
aagtttcacatctgctttaaggaaa

SEQ ID NO: 77167 - DNA, 25 bp, Homo sapien
gttcactttctgttttagacttagg

SEQ ID NO: 77168 - DNA, 25 bp, Homo sapien
gttttagacttaggtcactgtcctt

SEQ ID NO: 77169 - DNA, 25 bp, Homo sapien
gtcactgtccttaagtatgtatttt

SEQ ID NO: 77170 - DNA, 25 bp, Homo sapien
caagtaattctgaagtcctttcaaa

SEQ ID NO: 77171 - DNA, 25 bp, Homo sapien
gatgagttattcactgtcacaactt

SEQ ID NO: 77172 - DNA, 25 bp, Homo sapien
aaactctcactatgggcactttacc

SEQ ID NO: 77173 - DNA, 25 bp, Homo sapien
ttaccaaaatacttccatatcaatt

SEQ ID NO: 77174 - DNA, 25 bp, Homo sapien
tgaactcggtagttgtttgacctag

SEQ ID NO: 77175 - DNA, 25 bp, Homo sapien
cctagttagatgtggtgtttattca

SEQ ID NO: 77176 - DNA, 25 bp, Homo sapien
aagtcttagcatcatcatattgtgc

SEQ ID NO: 77177 - DNA, 25 bp, Homo sapien
catcatattgtgctgttttggataa

SEQ ID NO: 77178 - DNA, 25 bp, Homo sapien
gataacacgtttgttacaagcattt

SEQ ID NO: 77179 - DNA, 25 bp, Homo sapien
ttgttacaagcatttaaactgtttc

SEQ ID NO: 77180 - DNA, 25 bp, Homo sapien
taaactgtttcatttggtagtacct

SEQ ID NO: 77181 - DNA, 25 bp, Homo sapien
tttggtagtacctttacattgaaat

SEQ ID NO: 77182 - DNA, 25 bp, Homo sapien
caggatccacgccaggaaactgagt

SEQ ID NO: 77183 - DNA, 25 bp, Homo sapien
gggacaagatcctcctgaatgcctg

SEQ ID NO: 77184 - DNA, 25 bp, Homo sapien
gtgagaactgacatggcgggaccca

SEQ ID NO: 77185 - DNA, 25 bp, Homo sapien
accaagagcccagaagaaggtgcag

SEQ ID NO: 77186 - DNA, 25 bp, Homo sapien
tgagggtccccatggacaatttgtt

SEQ ID NO: 77187 - DNA, 25 bp, Homo sapien
gtccccatggacaatttgtttcaga

SEQ ID NO: 77188 - DNA, 25 bp, Homo sapien
ttgaacagtggtgagctgggctcac

SEQ ID NO: 77189 - DNA, 25 bp, Homo sapien
ggtgagctgggctcacagctccatc

SEQ ID NO: 77190 - DNA, 25 bp, Homo sapien
cccattttgtaccttgtcctgagtt

SEQ ID NO: 77191 - DNA, 25 bp, Homo sapien
taccttgtcctgagttggtccaaag

SEQ ID NO: 77192 - DNA, 25 bp, Homo sapien
gagttggtccaaagggcatttacaa

SEQ ID NO: 77193 - DNA, 25 bp, Homo sapien
aatagtttcactcaagatgatattg

SEQ ID NO: 77194 - DNA, 25 bp, Homo sapien
aacaccagagtgatgcaggtttata

SEQ ID NO: 77195 - DNA, 25 bp, Homo sapien
attgtgccagtaattatttcctctt

SEQ ID NO: 77196 - DNA, 25 bp, Homo sapien
gtgccagtaattatttcctcttcca

SEQ ID NO: 77197 - DNA, 25 bp, Homo sapien
tcctcttccatcttattgcttggaa

SEQ ID NO: 77198 - DNA, 25 bp, Homo sapien
catcttattgcttggaacattatta

SEQ ID NO: 77199 - DNA, 25 bp, Homo sapien
tgggaagatgttccgaaccccaaga

SEQ ID NO: 77200 - DNA, 25 bp, Homo sapien
agatgttccgaaccccaagaattgt

SEQ ID NO: 77201 - DNA, 25 bp, Homo sapien
gaaccccaagaattgttcctgggca

SEQ ID NO: 77202 - DNA, 25 bp, Homo sapien
ccaagaattgttcctgggcacaagg

SEQ ID NO: 77203 - DNA, 25 bp, Homo sapien
gggcacaaggacttaattttcagaa

SEQ ID NO: 77204 - DNA, 25 bp, Homo sapien
ttggtgatggacgttgcttgattga

SEQ ID NO: 77205 - DNA, 25 bp, Homo sapien
gcttgattgagcttattactctcta

SEQ ID NO: 77206 - DNA, 25 bp, Homo sapien
gagcttattactctctattttgaga

SEQ ID NO: 77207 - DNA, 25 bp, Homo sapien
gtagaaggtaagagggcccatattc

SEQ ID NO: 77208 - DNA, 25 bp, Homo sapien
gagggcccatattcattctttgcca

SEQ ID NO: 77209 - DNA, 25 bp, Homo sapien
ggaagattgtatttacttaactgtt

SEQ ID NO: 77210 - DNA, 25 bp, Homo sapien
atagcctttccaaagaaatgagggc

SEQ ID NO: 77211 - DNA, 25 bp, Homo sapien
tgagggcatgattattgtacagtaa

SEQ ID NO: 77212 - DNA, 25 bp, Homo sapien
aagtacgtgactgatttaatttgat

SEQ ID NO: 77213 - DNA, 25 bp, Homo sapien
tttaatttgatttacagagcggagt

SEQ ID NO: 77214 - DNA, 25 bp, Homo sapien
cagagcggagtgtgttcttataaaa

SEQ ID NO: 77215 - DNA, 25 bp, Homo sapien
atcctcggttttcctactgacactt

SEQ ID NO: 77216 - DNA, 25 bp, Homo sapien
tcggttttcctactgacactttcga

SEQ ID NO: 77217 - DNA, 25 bp, Homo sapien
gttttcctactgacactttcgattg

SEQ ID NO: 77218 - DNA, 25 bp, Homo sapien
tttcctactgacactttcgattgct

SEQ ID NO: 77219 - DNA, 25 bp, Homo sapien
tcctactgacactttcgattgcttt

SEQ ID NO: 77220 - DNA, 25 bp, Homo sapien
tactgacactttcgattgctttcat

SEQ ID NO: 77221 - DNA, 25 bp, Homo sapien
gacactttcgattgctttcatttgt

SEQ ID NO: 77222 - DNA, 25 bp, Homo sapien
cactttcgattgctttcatttgttg

SEQ ID NO: 77223 - DNA, 25 bp, Homo sapien
ctttcgattgctttcatttgttgtg

SEQ ID NO: 77224 - DNA, 25 bp, Homo sapien
gattgctttcatttgttgtgctcag

SEQ ID NO: 77225 - DNA, 25 bp, Homo sapien
ttgctttcatttgttgtgctcaggt

SEQ ID NO: 77226 - DNA, 25 bp, Homo sapien
tttctatagaaaacaggggctgctt

SEQ ID NO: 77227 - DNA, 25 bp, Homo sapien
ttaccaaaatacttccatatcaatt

SEQ ID NO: 77228 - DNA, 25 bp, Homo sapien
aatacttccatatcaattatttgaa

SEQ ID NO: 77229 - DNA, 25 bp, Homo sapien
tcatgtttgacaatactgtaaatta

SEQ ID NO: 77230 - DNA, 25 bp, Homo sapien
gacaatactgtaaattaggttaatt

SEQ ID NO: 77231 - DNA, 25 bp, Homo sapien
aagtcttagcatcatcatattgtgc

SEQ ID NO: 77232 - DNA, 25 bp, Homo sapien
gtcttagcatcatcatattgtgctg

SEQ ID NO: 77233 - DNA, 25 bp, Homo sapien
cttagcatcatcatattgtgctgtt

SEQ ID NO: 77234 - DNA, 25 bp, Homo sapien
tagcatcatcatattgtgctgtttt

SEQ ID NO: 77235 - DNA, 25 bp, Homo sapien
catcatcatattgtgctgttttgga

SEQ ID NO: 77236 - DNA, 25 bp, Homo sapien
catcatattgtgctgttttggataa

SEQ ID NO: 77237 - DNA, 25 bp, Homo sapien
aaatgggcatctatgacgtggtcag

SEQ ID NO: 77238 - DNA, 25 bp, Homo sapien
acgtggtcagggtgtccattcctaa

SEQ ID NO: 77239 - DNA, 25 bp, Homo sapien
cagggtgtccattcctaatcatggg

SEQ ID NO: 77240 - DNA, 25 bp, Homo sapien
ggcagatgccacaagcattcagaaa

SEQ ID NO: 77241 - DNA, 25 bp, Homo sapien
gtctgaaagggtggccacagcccca

SEQ ID NO: 77242 - DNA, 25 bp, Homo sapien
ttggtctgaggttggcacctcaatc

SEQ ID NO: 77243 - DNA, 25 bp, Homo sapien
gttggcacctcaatctacaccagag

SEQ ID NO: 77244 - DNA, 25 bp, Homo sapien
gggagtcccagaggcaagtttcaca

SEQ ID NO: 77245 - DNA, 25 bp, Homo sapien
gcaagtttcacagaattgtcaaatg

SEQ ID NO: 77246 - DNA, 25 bp, Homo sapien
aaatgatcccatttccttgagtctg

SEQ ID NO: 77247 - DNA, 25 bp, Homo sapien
ttttggcagagataatcgtgtctta

SEQ ID NO: 77248 - DNA, 25 bp, Homo sapien
ttcttttttgtatattctatgggta

SEQ ID NO: 77249 - DNA, 25 bp, Homo sapien
tgatacatgatagttgtacattttt

SEQ ID NO: 77250 - DNA, 25 bp, Homo sapien
tgatatgtgcatacaatgtgtagca

SEQ ID NO: 77251 - DNA, 25 bp, Homo sapien
tgtgcatacaatgtgtagcaatcaa

SEQ ID NO: 77252 - DNA, 25 bp, Homo sapien
attcaaaccttttcttctagctatt

SEQ ID NO: 77253 - DNA, 25 bp, Homo sapien
tctagctatttatccattgttggat

SEQ ID NO: 77254 - DNA, 25 bp, Homo sapien
atccattgttggatacttatatcaa

SEQ ID NO: 77255 - DNA, 25 bp, Homo sapien
tatcaattctatatcttagctgttg

SEQ ID NO: 77256 - DNA, 25 bp, Homo sapien
aattctatatcttagctgttgtgaa

SEQ ID NO: 77257 - DNA, 25 bp, Homo sapien
agctgttgtgaatagagctgcaata

SEQ ID NO: 77258 - DNA, 25 bp, Homo sapien
gtgaatagagctgcaataaatgtag

SEQ ID NO: 77259 - DNA, 25 bp, Homo sapien
ccagagaacaggagacctgccagcc

SEQ ID NO: 77260 - DNA, 25 bp, Homo sapien
gtgcacgtggtcaatgtggacatcc

SEQ ID NO: 77261 - DNA, 25 bp, Homo sapien
aatgtggacatccaggacaaccacg

SEQ ID NO: 77262 - DNA, 25 bp, Homo sapien
gggcgtttctcatctgtgagctctg

SEQ ID NO: 77263 - DNA, 25 bp, Homo sapien
atctgtgagctctgccagtgtatcc

SEQ ID NO: 77264 - DNA, 25 bp, Homo sapien
gtgagctctgccagtgtatccagca

SEQ ID NO: 77265 - DNA, 25 bp, Homo sapien
ctgccagtgtatccagcacacggaa

SEQ ID NO: 77266 - DNA, 25 bp, Homo sapien
tgtatccagcacacggaagacatgg

SEQ ID NO: 77267 - DNA, 25 bp, Homo sapien
acatggagaacgagatcgacgagct

SEQ ID NO: 77268 - DNA, 25 bp, Homo sapien
agagtgggccgcacctttctgcaca

SEQ ID NO: 77269 - DNA, 25 bp, Homo sapien
tactgagcccagcgcccgcatggag

SEQ ID NO: 77270 - DNA, 25 bp, Homo sapien
atcagtcatgattacaaacctacag

SEQ ID NO: 77271 - DNA, 25 bp, Homo sapien
aacctacagaggtggcgagtatgta

SEQ ID NO: 77272 - DNA, 25 bp, Homo sapien
ggcgagtatgtaacacaagagctta

SEQ ID NO: 77273 - DNA, 25 bp, Homo sapien
aagagcttaataagaccctcataga

SEQ ID NO: 77274 - DNA, 25 bp, Homo sapien
agaccctcatagagcttgattcttg

SEQ ID NO: 77275 - DNA, 25 bp, Homo sapien
ccctcatagagcttgattcttgtat

SEQ ID NO: 77276 - DNA, 25 bp, Homo sapien
tcttgtatattgatgttgtcttttc

SEQ ID NO: 77277 - DNA, 25 bp, Homo sapien
aaaatgttaggtgtcagctttcagg

SEQ ID NO: 77278 - DNA, 25 bp, Homo sapien
tgttaggtgtcagctttcagggctc

SEQ ID NO: 77279 - DNA, 25 bp, Homo sapien
agctttcagggctctgaaaccccat

SEQ ID NO: 77280 - DNA, 25 bp, Homo sapien
ggagatttacaatatctgttctttt

SEQ ID NO: 77281 - DNA, 25 bp, Homo sapien
agctgtgacaaccaggagccctgtc

SEQ ID NO: 77282 - DNA, 25 bp, Homo sapien
aggagccctgtctgtgggttcgtct

SEQ ID NO: 77283 - DNA, 25 bp, Homo sapien
ggcctggagcccaagccctgtgttc

SEQ ID NO: 77284 - DNA, 25 bp, Homo sapien
gtgtgtcatgttgcgtgtgtctgtc

SEQ ID NO: 77285 - DNA, 25 bp, Homo sapien
tgtgtctgtctgtgagcctttcaca

SEQ ID NO: 77286 - DNA, 25 bp, Homo sapien
tgtgagcctttcacacctgtgctgg

SEQ ID NO: 77287 - DNA, 25 bp, Homo sapien
cctgtgctggcgctggaaaattatt

SEQ ID NO: 77288 - DNA, 25 bp, Homo sapien
ggaaaattatttgtgctcagctgac

SEQ ID NO: 77289 - DNA, 25 bp, Homo sapien
gctcagctgacatttaacacttcct

SEQ ID NO: 77290 - DNA, 25 bp, Homo sapien
gggttggaaacttagcactttatat

SEQ ID NO: 77291 - DNA, 25 bp, Homo sapien
cagaacattcaggatttgtcaataa

SEQ ID NO: 77292 - DNA, 25 bp, Homo sapien
aagatccggtcatacatccacatca

SEQ ID NO: 77293 - DNA, 25 bp, Homo sapien
ggtcatacatccacatcaggcctgg

SEQ ID NO: 77294 - DNA, 25 bp, Homo sapien
gcctggccagctggatgttcttaaa

SEQ ID NO: 77295 - DNA, 25 bp, Homo sapien
gttcttaaagagttccacaagcaga

SEQ ID NO: 77296 - DNA, 25 bp, Homo sapien
agcagattactgcacgggcaacaaa

SEQ ID NO: 77297 - DNA, 25 bp, Homo sapien
tgcacgggcaacaaaggatgggact

SEQ ID NO: 77298 - DNA, 25 bp, Homo sapien
agaaagaactcaagacactcctgct

SEQ ID NO: 77299 - DNA, 25 bp, Homo sapien
gacactcctgcttgatacagaacaa

SEQ ID NO: 77300 - DNA, 25 bp, Homo sapien
agcttaacaggaccaacagggctta

SEQ ID NO: 77301 - DNA, 25 bp, Homo sapien
gggcttaagcccagacttgacgtaa

SEQ ID NO: 77302 - DNA, 25 bp, Homo sapien
cttgacgtaacagaaatgtgccaat

SEQ ID NO: 77303 - DNA, 25 bp, Homo sapien
tttgaactcggtagttgtttgacct

SEQ ID NO: 77304 - DNA, 25 bp, Homo sapien
ttgaactcggtagttgtttgaccta

SEQ ID NO: 77305 - DNA, 25 bp, Homo sapien
tgaactcggtagttgtttgacctag

SEQ ID NO: 77306 - DNA, 25 bp, Homo sapien
gataacacgtttgttacaagcattt

SEQ ID NO: 77307 - DNA, 25 bp, Homo sapien
taacacgtttgttacaagcatttaa

SEQ ID NO: 77308 - DNA, 25 bp, Homo sapien
cacgtttgttacaagcatttaaact

SEQ ID NO: 77309 - DNA, 25 bp, Homo sapien
ttgttacaagcatttaaactgtttc

SEQ ID NO: 77310 - DNA, 25 bp, Homo sapien
taaactgtttcatttggtagtacct

SEQ ID NO: 77311 - DNA, 25 bp, Homo sapien
gtttcatttggtagtacctttacat

SEQ ID NO: 77312 - DNA, 25 bp, Homo sapien
tcatttggtagtacctttacattga

SEQ ID NO: 77313 - DNA, 25 bp, Homo sapien
tttggtagtacctttacattgaaat

SEQ ID NO: 77314 - DNA, 25 bp, Homo sapien
gtttgtctggtgtcagcacgaggca

SEQ ID NO: 77315 - DNA, 25 bp, Homo sapien
gtgtgctccatagcgtgtagcttta

SEQ ID NO: 77316 - DNA, 25 bp, Homo sapien
agcgtgtagctttagactcggagat

SEQ ID NO: 77317 - DNA, 25 bp, Homo sapien
ctcggagatgagtgctttgacccag

SEQ ID NO: 77318 - DNA, 25 bp, Homo sapien
atgagtgctttgacccagcgaggag

SEQ ID NO: 77319 - DNA, 25 bp, Homo sapien
gaggagctcagctaagtgtatccac

SEQ ID NO: 77320 - DNA, 25 bp, Homo sapien
agctaagtgtatccacgctgtggtt

SEQ ID NO: 77321 - DNA, 25 bp, Homo sapien
acgctgtggttcagcagcctttaga

SEQ ID NO: 77322 - DNA, 25 bp, Homo sapien
agcagcctttagatcatacggcatt

SEQ ID NO: 77323 - DNA, 25 bp, Homo sapien
tagatcatacggcattgtggttcat

SEQ ID NO: 77324 - DNA, 25 bp, Homo sapien
tacggcattgtggttcatgtttgaa

SEQ ID NO: 77325 - DNA, 25 bp, Homo sapien
aacctcagggtcacaagtttactgt

SEQ ID NO: 77326 - DNA, 25 bp, Homo sapien
tttccatccctacattggtctgctg

SEQ ID NO: 77327 - DNA, 25 bp, Homo sapien
gggctaggcatcactgacacacgca

SEQ ID NO: 77328 - DNA, 25 bp, Homo sapien
gacacacgcagactccgtggttgag

SEQ ID NO: 77329 - DNA, 25 bp, Homo sapien
gactccgtggttgaggcattttatt

SEQ ID NO: 77330 - DNA, 25 bp, Homo sapien
ggcattttattggacctttggcaat

SEQ ID NO: 77331 - DNA, 25 bp, Homo sapien
ctgcagatgggaccatctcaggctg

SEQ ID NO: 77332 - DNA, 25 bp, Homo sapien
gtagcccaggagcacagactggact

SEQ ID NO: 77333 - DNA, 25 bp, Homo sapien
acagactggactaagcctcctgggc

SEQ ID NO: 77334 - DNA, 25 bp, Homo sapien
gcctcctgggccttgtatgaaaaag

SEQ ID NO: 77335 - DNA, 25 bp, Homo sapien
gtacctggccgtttttgccagtaat

SEQ ID NO: 77336 - DNA, 25 bp, Homo sapien
gaccgctgagcccatgagtgaaagc

SEQ ID NO: 77337 - DNA, 25 bp, Homo sapien
gagcccatgagtgaaagcaagttga

SEQ ID NO: 77338 - DNA, 25 bp, Homo sapien
aagcaagttgaatacattggtgcag

SEQ ID NO: 77339 - DNA, 25 bp, Homo sapien
agaagcttcatgacttccttgcaca

SEQ ID NO: 77340 - DNA, 25 bp, Homo sapien
acttccttgcacactcatcagaaga

SEQ ID NO: 77341 - DNA, 25 bp, Homo sapien
aagaaacaagttctcctccacgact

SEQ ID NO: 77342 - DNA, 25 bp, Homo sapien
ttctcctccacgacttgcaatgaat

SEQ ID NO: 77343 - DNA, 25 bp, Homo sapien
cagtggttctggaagtaactctgat

SEQ ID NO: 77344 - DNA, 25 bp, Homo sapien
gagggaactagctcttcagaaaaat

SEQ ID NO: 77345 - DNA, 25 bp, Homo sapien
ccaagtcttcaggatcgtcacgatc

SEQ ID NO: 77346 - DNA, 25 bp, Homo sapien
ggatcgtcacgatcaaagaggaaac

SEQ ID NO: 77347 - DNA, 25 bp, Homo sapien
ctgtgtcgctgcctgggatcttggg

SEQ ID NO: 77348 - DNA, 25 bp, Homo sapien
gttggcctttgcatgggaggcaggt

SEQ ID NO: 77349 - DNA, 25 bp, Homo sapien
ggcttggatcagtaagtctggttcc

SEQ ID NO: 77350 - DNA, 25 bp, Homo sapien
tggatcagtaagtctggttcccgcc

SEQ ID NO: 77351 - DNA, 25 bp, Homo sapien
gatcagtaagtctggttcccgcctc

SEQ ID NO: 77352 - DNA, 25 bp, Homo sapien
ttcccgcctccctgtctgagagagg

SEQ ID NO: 77353 - DNA, 25 bp, Homo sapien
ccagggccggcttgtgtttgtacat

SEQ ID NO: 77354 - DNA, 25 bp, Homo sapien
ggccggcttgtgtttgtacattgca

SEQ ID NO: 77355 - DNA, 25 bp, Homo sapien
ggcttgtgtttgtacattgcacaga

SEQ ID NO: 77356 - DNA, 25 bp, Homo sapien
gtttgtacattgcacagaaacttgt

SEQ ID NO: 77357 - DNA, 25 bp, Homo sapien
agaaacttgtgtgggtgctttagta

SEQ ID NO: 77358 - DNA, 25 bp, Homo sapien
cagcatactcttaaactaatcactt

SEQ ID NO: 77359 - DNA, 25 bp, Homo sapien
atactcttaaactaatcacttatgt

SEQ ID NO: 77360 - DNA, 25 bp, Homo sapien
ggtgacaggtcctagaaggacaatg

SEQ ID NO: 77361 - DNA, 25 bp, Homo sapien
gtcctagaaggacaatgtgcatatt

SEQ ID NO: 77362 - DNA, 25 bp, Homo sapien
tgcatattacgacaaacacaaagaa

SEQ ID NO: 77363 - DNA, 25 bp, Homo sapien
gaaactataccataacccaaggctg

SEQ ID NO: 77364 - DNA, 25 bp, Homo sapien
tataccataacccaaggctgaaaat

SEQ ID NO: 77365 - DNA, 25 bp, Homo sapien
gtaaacaagagaataactgctgcta

SEQ ID NO: 77366 - DNA, 25 bp, Homo sapien
gagaataactgctgctaaatcaaga

SEQ ID NO: 77367 - DNA, 25 bp, Homo sapien
atcaagaactgttgcagcatctcct

SEQ ID NO: 77368 - DNA, 25 bp, Homo sapien
caagaactgttgcagcatctccttt

SEQ ID NO: 77369 - DNA, 25 bp, Homo sapien
ctggtcttgaagcctctggtgctgt

SEQ ID NO: 77370 - DNA, 25 bp, Homo sapien
tctggtgctgtttcaacctccgtcc

SEQ ID NO: 77371 - DNA, 25 bp, Homo sapien
cccacaggagggtggaactcccatt

SEQ ID NO: 77372 - DNA, 25 bp, Homo sapien
acaggagggtggaactcccattctc

SEQ ID NO: 77373 - DNA, 25 bp, Homo sapien
ggagggtggaactcccattctcaca

SEQ ID NO: 77374 - DNA, 25 bp, Homo sapien
tcccattctcacaggtttccagtca

SEQ ID NO: 77375 - DNA, 25 bp, Homo sapien
attctcacaggtttccagtcagctt

SEQ ID NO: 77376 - DNA, 25 bp, Homo sapien
aatttgctgataacaaatgttctga

SEQ ID NO: 77377 - DNA, 25 bp, Homo sapien
aaagaagtaaactagccgggcgcag

SEQ ID NO: 77378 - DNA, 25 bp, Homo sapien
agaagtaaactagccgggcgcagtg

SEQ ID NO: 77379 - DNA, 25 bp, Homo sapien
gagcccaagagttcatatctagcct

SEQ ID NO: 77380 - DNA, 25 bp, Homo sapien
tgatacatgatagttgtacattttt

SEQ ID NO: 77381 - DNA, 25 bp, Homo sapien
tctagctatttatccattgttggat

SEQ ID NO: 77382 - DNA, 25 bp, Homo sapien
gctatttatccattgttggatactt

SEQ ID NO: 77383 - DNA, 25 bp, Homo sapien
atccattgttggatacttatatcaa

SEQ ID NO: 77384 - DNA, 25 bp, Homo sapien
tatcaattctatatcttagctgttg

SEQ ID NO: 77385 - DNA, 25 bp, Homo sapien
tcaattctatatcttagctgttgtg

SEQ ID NO: 77386 - DNA, 25 bp, Homo sapien
caattctatatcttagctgttgtga

SEQ ID NO: 77387 - DNA, 25 bp, Homo sapien
aattctatatcttagctgttgtgaa

SEQ ID NO: 77388 - DNA, 25 bp, Homo sapien
attctatatcttagctgttgtgaat

SEQ ID NO: 77389 - DNA, 25 bp, Homo sapien
agctgttgtgaatagagctgcaata

SEQ ID NO: 77390 - DNA, 25 bp, Homo sapien
gtgaatagagctgcaataaatgtag

SEQ ID NO: 77391 - DNA, 25 bp, Homo sapien
gggatcctcttgcagaggatgcccc

SEQ ID NO: 77392 - DNA, 25 bp, Homo sapien
cccaggcctgaaccctctagtggat

SEQ ID NO: 77393 - DNA, 25 bp, Homo sapien
cctctagtggatccacagtttgtgg

SEQ ID NO: 77394 - DNA, 25 bp, Homo sapien
gccctgtccttgaccgagagtccag

SEQ ID NO: 77395 - DNA, 25 bp, Homo sapien
tccagcattttttcagttggcccct

SEQ ID NO: 77396 - DNA, 25 bp, Homo sapien
agttggcccctggttggctgcctca

SEQ ID NO: 77397 - DNA, 25 bp, Homo sapien
gaggaggcatccgaatccacaggga

SEQ ID NO: 77398 - DNA, 25 bp, Homo sapien
aatccacagggacggcacgtgccat

SEQ ID NO: 77399 - DNA, 25 bp, Homo sapien
attgcctgcccgtggcatcaactgg

SEQ ID NO: 77400 - DNA, 25 bp, Homo sapien
gccgctggcacttgtctaggatgga

SEQ ID NO: 77401 - DNA, 25 bp, Homo sapien
gtttctgtctgctctgttcagtgaa

SEQ ID NO: 77402 - DNA, 25 bp, Homo sapien
ggaagggtttctcctccatgatcga

SEQ ID NO: 77403 - DNA, 25 bp, Homo sapien
tcctcgtccacctacaaatcaggaa

SEQ ID NO: 77404 - DNA, 25 bp, Homo sapien
ggaacagaaagtctgtccactttga

SEQ ID NO: 77405 - DNA, 25 bp, Homo sapien
tgaaaatacctttccaggcagctcc

SEQ ID NO: 77406 - DNA, 25 bp, Homo sapien
ctgaccatttggacacattgccacg

SEQ ID NO: 77407 - DNA, 25 bp, Homo sapien
tttggacacattgccacgacaggag

SEQ ID NO: 77408 - DNA, 25 bp, Homo sapien
attgccacgacaggagcctccaagt

SEQ ID NO: 77409 - DNA, 25 bp, Homo sapien
gacgagcttggctgttctgctgcac

SEQ ID NO: 77410 - DNA, 25 bp, Homo sapien
ttggctgttctgctgcacctgaatg

SEQ ID NO: 77411 - DNA, 25 bp, Homo sapien
gcacctgaatgctttctgttatcct

SEQ ID NO: 77412 - DNA, 25 bp, Homo sapien
tgctttctgttatcctaattcttgt

SEQ ID NO: 77413 - DNA, 25 bp, Homo sapien
tatctatctgctttccttgtgtctc

SEQ ID NO: 77414 - DNA, 25 bp, Homo sapien
gggagatccagttagactctcctgc

SEQ ID NO: 77415 - DNA, 25 bp, Homo sapien
atccagttagactctcctgctcaga

SEQ ID NO: 77416 - DNA, 25 bp, Homo sapien
tcagaccctctgctccaaactaaga

SEQ ID NO: 77417 - DNA, 25 bp, Homo sapien
accctctgctccaaactaagactga

SEQ ID NO: 77418 - DNA, 25 bp, Homo sapien
tctgctccaaactaagactgatgtt

SEQ ID NO: 77419 - DNA, 25 bp, Homo sapien
aactaagactgatgttggccttcca

SEQ ID NO: 77420 - DNA, 25 bp, Homo sapien
aagactgatgttggccttccagtgt

SEQ ID NO: 77421 - DNA, 25 bp, Homo sapien
actgatgttggccttccagtgtgat

SEQ ID NO: 77422 - DNA, 25 bp, Homo sapien
gatgttggccttccagtgtgattct

SEQ ID NO: 77423 - DNA, 25 bp, Homo sapien
ttggccttccagtgtgattctgaaa

SEQ ID NO: 77424 - DNA, 25 bp, Homo sapien
gcagttgacttaataggatcatctt

SEQ ID NO: 77425 - DNA, 25 bp, Homo sapien
gaatttgtttacgtgatgccaagca

SEQ ID NO: 77426 - DNA, 25 bp, Homo sapien
atgccaagcatcaagtcatgttttc

SEQ ID NO: 77427 - DNA, 25 bp, Homo sapien
gtgtgtgcttacacaggtgttaaac

SEQ ID NO: 77428 - DNA, 25 bp, Homo sapien
tctattttaaactgagccttctttt

SEQ ID NO: 77429 - DNA, 25 bp, Homo sapien
aataagctctcagagtttctgtgat

SEQ ID NO: 77430 - DNA, 25 bp, Homo sapien
tgtgatgatttgttgagccttgctg

SEQ ID NO: 77431 - DNA, 25 bp, Homo sapien
gagccttgctggacaagtggtttgt

SEQ ID NO: 77432 - DNA, 25 bp, Homo sapien
aatagatttgtttgactgcttgtgt

SEQ ID NO: 77433 - DNA, 25 bp, Homo sapien
gtgtctttttatgacctgtttgcct

SEQ ID NO: 77434 - DNA, 25 bp, Homo sapien
tttttatgacctgtttgccttttag

SEQ ID NO: 77435 - DNA, 25 bp, Homo sapien
aaaatcgagtgagaggttccgggca

SEQ ID NO: 77436 - DNA, 25 bp, Homo sapien
gttccgggcagcaggatcgacgccc

SEQ ID NO: 77437 - DNA, 25 bp, Homo sapien
cagtccagccggcagagggaacaca

SEQ ID NO: 77438 - DNA, 25 bp, Homo sapien
cagagggaacacacgggtccttcat

SEQ ID NO: 77439 - DNA, 25 bp, Homo sapien
acacgggtccttcattgtcctgtaa

SEQ ID NO: 77440 - DNA, 25 bp, Homo sapien
cttcattgtcctgtaagggtgttga

SEQ ID NO: 77441 - DNA, 25 bp, Homo sapien
tcaccctgcatcactgaagagcggc

SEQ ID NO: 77442 - DNA, 25 bp, Homo sapien
gcatcactgaagagcggcgcctctg

SEQ ID NO: 77443 - DNA, 25 bp, Homo sapien
ctctgcagcaagcagggcttcagga

SEQ ID NO: 77444 - DNA, 25 bp, Homo sapien
gccacagccaggttttccctaagaa

SEQ ID NO: 77445 - DNA, 25 bp, Homo sapien
caggttttccctaagaagatgttat

SEQ ID NO: 77446 - DNA, 25 bp, Homo sapien
caggcaccaagaatctcctacagtt

SEQ ID NO: 77447 - DNA, 25 bp, Homo sapien
aagaatctcctacagttccccaaag

SEQ ID NO: 77448 - DNA, 25 bp, Homo sapien
cccattatctcaggtcactctgttt

SEQ ID NO: 77449 - DNA, 25 bp, Homo sapien
attatctcaggtcactctgtttccc

SEQ ID NO: 77450 - DNA, 25 bp, Homo sapien
ctcccatttgcttctgactctcatt

SEQ ID NO: 77451 - DNA, 25 bp, Homo sapien
tatgatgtttaccatttctcttctc

SEQ ID NO: 77452 - DNA, 25 bp, Homo sapien
agtgtccctctctgagtggtaagag

SEQ ID NO: 77453 - DNA, 25 bp, Homo sapien
aagagtatgttaataagccagtgct

SEQ ID NO: 77454 - DNA, 25 bp, Homo sapien
ataagccagtgctgagaccggagca

SEQ ID NO: 77455 - DNA, 25 bp, Homo sapien
tgagaccggagcacgaggcaactgc

SEQ ID NO: 77456 - DNA, 25 bp, Homo sapien
atgttggtcattgtcactgttatta

SEQ ID NO: 77457 - DNA, 25 bp, Homo sapien
tgtcattcataccattcacacctaa

SEQ ID NO: 77458 - DNA, 25 bp, Homo sapien
ataccattcacacctaaagactgaa

SEQ ID NO: 77459 - DNA, 25 bp, Homo sapien
aaaatgaacttctcccgctacacag

SEQ ID NO: 77460 - DNA, 25 bp, Homo sapien
gaacttctcccgctacacagaagta

SEQ ID NO: 77461 - DNA, 25 bp, Homo sapien
tctcccgctacacagaagtaacaaa

SEQ ID NO: 77462 - DNA, 25 bp, Homo sapien
tgtattggtagcagggatgttttca

SEQ ID NO: 77463 - DNA, 25 bp, Homo sapien
aattttcagagattatgcattcttc

SEQ ID NO: 77464 - DNA, 25 bp, Homo sapien
aatacttttgtattgctgcttgcaa

SEQ ID NO: 77465 - DNA, 25 bp, Homo sapien
gctgcttgcaaatatgcatttccaa

SEQ ID NO: 77466 - DNA, 25 bp, Homo sapien
tgcaaatatgcatttccaaacttga

SEQ ID NO: 77467 - DNA, 25 bp, Homo sapien
ccaaacttgaaatataggtgtgaac

SEQ ID NO: 77468 - DNA, 25 bp, Homo sapien
ggatacagataccagcttgccttga

SEQ ID NO: 77469 - DNA, 25 bp, Homo sapien
cagcttgccttgatgggattggtat

SEQ ID NO: 77470 - DNA, 25 bp, Homo sapien
gattggtattgctgtgtgcttccag

SEQ ID NO: 77471 - DNA, 25 bp, Homo sapien
aggttctcacactcaattccaaagc

SEQ ID NO: 77472 - DNA, 25 bp, Homo sapien
attccaaagccttcctattgggcga

SEQ ID NO: 77473 - DNA, 25 bp, Homo sapien
tgggcgaattccctcaaactctatt

SEQ ID NO: 77474 - DNA, 25 bp, Homo sapien
aactctatttgacctgacagccata

SEQ ID NO: 77475 - DNA, 25 bp, Homo sapien
agccatacgtattcccctctggtag

SEQ ID NO: 77476 - DNA, 25 bp, Homo sapien
atgctgtgtttaccaatgtttgctg

SEQ ID NO: 77477 - DNA, 25 bp, Homo sapien
gcatgttctaattccacgtattttc

SEQ ID NO: 77478 - DNA, 25 bp, Homo sapien
gtattttccagtctcttttataaag

SEQ ID NO: 77479 - DNA, 25 bp, Homo sapien
gatgccagacacaccaaggctattt

SEQ ID NO: 77480 - DNA, 25 bp, Homo sapien
aggctatttgcctatgagaatgtta

SEQ ID NO: 77481 - DNA, 25 bp, Homo sapien
tagacagcagtgcactgcccctaag

SEQ ID NO: 77482 - DNA, 25 bp, Homo sapien
tgcccctaagtctctgctcaaaaaa

SEQ ID NO: 77483 - DNA, 25 bp, Homo sapien
agtggacatttgtcgggaaactcct

SEQ ID NO: 77484 - DNA, 25 bp, Homo sapien
tgtcgggaaactcctaacatatgcc

SEQ ID NO: 77485 - DNA, 25 bp, Homo sapien
gaacacagagtacgacacaatccct

SEQ ID NO: 77486 - DNA, 25 bp, Homo sapien
gacacaatccctcacactaatagaa

SEQ ID NO: 77487 - DNA, 25 bp, Homo sapien
aaaggaagatccagcaaatacggtt

SEQ ID NO: 77488 - DNA, 25 bp, Homo sapien
gcaaatacggtttactccactgtgg

SEQ ID NO: 77489 - DNA, 25 bp, Homo sapien
tactccactgtggaaataccgaaaa

SEQ ID NO: 77490 - DNA, 25 bp, Homo sapien
attaaatttctgcagcatcccttta

SEQ ID NO: 77491 - DNA, 25 bp, Homo sapien
aaatttctgcagcatccctttagct

SEQ ID NO: 77492 - DNA, 25 bp, Homo sapien
tctgcagcatccctttagctttcaa

SEQ ID NO: 77493 - DNA, 25 bp, Homo sapien
cagcatccctttagctttcaatctc

SEQ ID NO: 77494 - DNA, 25 bp, Homo sapien
tgaacccggaaaaagcactcgctgc

SEQ ID NO: 77495 - DNA, 25 bp, Homo sapien
cggaaaaagcactcgctgcgcgata

SEQ ID NO: 77496 - DNA, 25 bp, Homo sapien
aaaaagcactcgctgcgcgatacac

SEQ ID NO: 77497 - DNA, 25 bp, Homo sapien
ctcgctgcgcgatacacccagaaga

SEQ ID NO: 77498 - DNA, 25 bp, Homo sapien
gaagaacctcacagccgagggtgcc

SEQ ID NO: 77499 - DNA, 25 bp, Homo sapien
cgagggtgcccctcctcggaggaca

SEQ ID NO: 77500 - DNA, 25 bp, Homo sapien
tcggaggacagccacgcgctacact

SEQ ID NO: 77501 - DNA, 25 bp, Homo sapien
attttccgtcttatttcatttctgt

SEQ ID NO: 77502 - DNA, 25 bp, Homo sapien
ttttccgtcttatttcatttctgta

SEQ ID NO: 77503 - DNA, 25 bp, Homo sapien
taatgcagagtgagaactttcccta

SEQ ID NO: 77504 - DNA, 25 bp, Homo sapien
atgcagagtgagaactttccctacc

SEQ ID NO: 77505 - DNA, 25 bp, Homo sapien
tgcagagtgagaactttccctaccg

SEQ ID NO: 77506 - DNA, 25 bp, Homo sapien
gcagagtgagaactttccctaccgt

SEQ ID NO: 77507 - DNA, 25 bp, Homo sapien
gccaagaatgtgttgtccaaaatgc

SEQ ID NO: 77508 - DNA, 25 bp, Homo sapien
ccaagaatgtgttgtccaaaatgcc

SEQ ID NO: 77509 - DNA, 25 bp, Homo sapien
taaagatggaactccaccctttgct

SEQ ID NO: 77510 - DNA, 25 bp, Homo sapien
aaagatggaactccaccctttgctt

SEQ ID NO: 77511 - DNA, 25 bp, Homo sapien
aagatggaactccaccctttgcttg

SEQ ID NO: 77512 - DNA, 25 bp, Homo sapien
actgggctgacagactttgctgacc

SEQ ID NO: 77513 - DNA, 25 bp, Homo sapien
tcttcatgatcagacataaacttag

SEQ ID NO: 77514 - DNA, 25 bp, Homo sapien
gacataaacttagcatcttaatgga

SEQ ID NO: 77515 - DNA, 25 bp, Homo sapien
aagacaatttctattacaccctcct

SEQ ID NO: 77516 - DNA, 25 bp, Homo sapien
atttctattacaccctcctttatga

SEQ ID NO: 77517 - DNA, 25 bp, Homo sapien
ccctcctttatgacaagtgacattt

SEQ ID NO: 77518 - DNA, 25 bp, Homo sapien
ttttttgttggcctaacattgaggc

SEQ ID NO: 77519 - DNA, 25 bp, Homo sapien
taacattgaggccttaaaacctgag

SEQ ID NO: 77520 - DNA, 25 bp, Homo sapien
aggctcctgtgcctgatggaattct

SEQ ID NO: 77521 - DNA, 25 bp, Homo sapien
gtgcctgatggaattcttgtaacat

SEQ ID NO: 77522 - DNA, 25 bp, Homo sapien
ggaattcttgtaacatacacttgtg

SEQ ID NO: 77523 - DNA, 25 bp, Homo sapien
gttttactgccctaatgggaatgtt

SEQ ID NO: 77524 - DNA, 25 bp, Homo sapien
gggaatgttcaattccatatttgat

SEQ ID NO: 77525 - DNA, 25 bp, Homo sapien
catatttgatggtagagtggtggca

SEQ ID NO: 77526 - DNA, 25 bp, Homo sapien
tagagtggtggcaaagcttcctttt

SEQ ID NO: 77527 - DNA, 25 bp, Homo sapien
gagtggtggcaaagcttccttttac

SEQ ID NO: 77528 - DNA, 25 bp, Homo sapien
tttacccctctttcttacatccaag

SEQ ID NO: 77529 - DNA, 25 bp, Homo sapien
ccctctttcttacatccaaggactg

SEQ ID NO: 77530 - DNA, 25 bp, Homo sapien
gaaatctgctgggagatgacaccac

SEQ ID NO: 77531 - DNA, 25 bp, Homo sapien
ggagatgacaccacagactgttcct

SEQ ID NO: 77532 - DNA, 25 bp, Homo sapien
gactgttccttcattttcctgtata

SEQ ID NO: 77533 - DNA, 25 bp, Homo sapien
gtcgattcgacagaacattcagaag

SEQ ID NO: 77534 - DNA, 25 bp, Homo sapien
agtcagctttgctgccttctgctgg

SEQ ID NO: 77535 - DNA, 25 bp, Homo sapien
gttatgaagcccctagaattcctcc

SEQ ID NO: 77536 - DNA, 25 bp, Homo sapien
gcccctagaattcctcctgaaaaga

SEQ ID NO: 77537 - DNA, 25 bp, Homo sapien
gagaatttttacaaccacccataca

SEQ ID NO: 77538 - DNA, 25 bp, Homo sapien
caaccacccatacaccaaattgttt

SEQ ID NO: 77539 - DNA, 25 bp, Homo sapien
agtcaggcgggcagcctttcgacta

SEQ ID NO: 77540 - DNA, 25 bp, Homo sapien
tttcgactattctcccattcggttt

SEQ ID NO: 77541 - DNA, 25 bp, Homo sapien
tttcgcgcccggaacggagagtaca

SEQ ID NO: 77542 - DNA, 25 bp, Homo sapien
gagtacatcacgttggacaccagct

SEQ ID NO: 77543 - DNA, 25 bp, Homo sapien
ggagcaggaaaatctccttcatcat

SEQ ID NO: 77544 - DNA, 25 bp, Homo sapien
tccttcatcattgggaggcacaaag

SEQ ID NO: 77545 - DNA, 25 bp, Homo sapien
tactgattattttaggttcttctcc

SEQ ID NO: 77546 - DNA, 25 bp, Homo sapien
tttaggttcttctccctactttcag

SEQ ID NO: 77547 - DNA, 25 bp, Homo sapien
gtgctctcttccactacagagaatc

SEQ ID NO: 77548 - DNA, 25 bp, Homo sapien
gtgtttcccatgatggtgaatgtca

SEQ ID NO: 77549 - DNA, 25 bp, Homo sapien
gtgaatgtcactgccatgaattcct

SEQ ID NO: 77550 - DNA, 25 bp, Homo sapien
gagtcagagtccaagcataacccgt

SEQ ID NO: 77551 - DNA, 25 bp, Homo sapien
gcataacccgtgtagcataaaagca

SEQ ID NO: 77552 - DNA, 25 bp, Homo sapien
ataaaagcagcgctgtagccctatt

SEQ ID NO: 77553 - DNA, 25 bp, Homo sapien
tgtagccctattccagtctttttcg

SEQ ID NO: 77554 - DNA, 25 bp, Homo sapien
tccagtctttttcgttaatgtccag

SEQ ID NO: 77555 - DNA, 25 bp, Homo sapien
aactgttgactgttgattctcataa

SEQ ID NO: 77556 - DNA, 25 bp, Homo sapien
gtttttctcgtcttgtagtctctat

SEQ ID NO: 77557 - DNA, 25 bp, Homo sapien
tgtagtctctatggcgtgtctttat

SEQ ID NO: 77558 - DNA, 25 bp, Homo sapien
ctatggcgtgtctttatggtgtaat

SEQ ID NO: 77559 - DNA, 25 bp, Homo sapien
ttatggtgtaataaggttctcacgg

SEQ ID NO: 77560 - DNA, 25 bp, Homo sapien
caatcttttgtgtttagagaggcca

SEQ ID NO: 77561 - DNA, 25 bp, Homo sapien
gaggccacggttcagacaatggtat

SEQ ID NO: 77562 - DNA, 25 bp, Homo sapien
caggtgcatgtctgtctgatttctt

SEQ ID NO: 77563 - DNA, 25 bp, Homo sapien
ttcctgttggactatgtttgtgaac

SEQ ID NO: 77564 - DNA, 25 bp, Homo sapien
gggaaatatttctacatgtgcttat

SEQ ID NO: 77565 - DNA, 25 bp, Homo sapien
ctacatgtgcttatagttttccaag

SEQ ID NO: 77566 - DNA, 25 bp, Homo sapien
tagttttccaagagtgtaccattaa

SEQ ID NO: 77567 - DNA, 25 bp, Homo sapien
agccgccttccggtggtttcagtga

SEQ ID NO: 77568 - DNA, 25 bp, Homo sapien
tgacggcggcggaacccaaagctgc

SEQ ID NO: 77569 - DNA, 25 bp, Homo sapien
gtgcaatgtcactgctcgtgtggtc

SEQ ID NO: 77570 - DNA, 25 bp, Homo sapien
tcgtgtggtctccagcaagggattc

SEQ ID NO: 77571 - DNA, 25 bp, Homo sapien
ttcgggcgaagacaaacggatgcac

SEQ ID NO: 77572 - DNA, 25 bp, Homo sapien
gatgcacccgtctttagaaccaaaa

SEQ ID NO: 77573 - DNA, 25 bp, Homo sapien
gaaccaaaaatattctctcacagat

SEQ ID NO: 77574 - DNA, 25 bp, Homo sapien
gttgtcgttttaacatctccacgtc

SEQ ID NO: 77575 - DNA, 25 bp, Homo sapien
aaaagaagccttccgctgctctgga

SEQ ID NO: 77576 - DNA, 25 bp, Homo sapien
ctgctctggagaaggtgatgcttcc

SEQ ID NO: 77577 - DNA, 25 bp, Homo sapien
gtgatgcttccgacgggagccgcct

SEQ ID NO: 77578 - DNA, 25 bp, Homo sapien
gtttgaacctctggacatgaagctc

SEQ ID NO: 77579 - DNA, 25 bp, Homo sapien
tgaagctcatgaggcgttacatagc

SEQ ID NO: 77580 - DNA, 25 bp, Homo sapien
gttacatagccatgtgccgcgagaa

SEQ ID NO: 77581 - DNA, 25 bp, Homo sapien
atgtgccgcgagaagcagcccatgg

SEQ ID NO: 77582 - DNA, 25 bp, Homo sapien
gcagcccatggtgccagagtctctg

SEQ ID NO: 77583 - DNA, 25 bp, Homo sapien
agagtctctggctgactacatcaca

SEQ ID NO: 77584 - DNA, 25 bp, Homo sapien
gactacatcacagcagcatacgtgg

SEQ ID NO: 77585 - DNA, 25 bp, Homo sapien
acagcagcatacgtggagatgaggc

SEQ ID NO: 77586 - DNA, 25 bp, Homo sapien
gcttgggctagtaaggatgccacct

SEQ ID NO: 77587 - DNA, 25 bp, Homo sapien
agtaaggatgccacctatacttctg

SEQ ID NO: 77588 - DNA, 25 bp, Homo sapien
actgctctggcacgtctgagaatgg

SEQ ID NO: 77589 - DNA, 25 bp, Homo sapien
acatggagtcccaggagcggatcaa

SEQ ID NO: 77590 - DNA, 25 bp, Homo sapien
aggaagcgcatgaggaaccgcatcg

SEQ ID NO: 77591 - DNA, 25 bp, Homo sapien
atcgctgcctccaagtgccgaaaaa

SEQ ID NO: 77592 - DNA, 25 bp, Homo sapien
gaaaaccttgaaagctcagaactcg

SEQ ID NO: 77593 - DNA, 25 bp, Homo sapien
gctcagaactcggagctggcgtcca

SEQ ID NO: 77594 - DNA, 25 bp, Homo sapien
gcgtccacggccaacatgctcaggg

SEQ ID NO: 77595 - DNA, 25 bp, Homo sapien
aacaggtggcacagcttaaacagaa

SEQ ID NO: 77596 - DNA, 25 bp, Homo sapien
aaagtcatgaaccacgttaacagtg

SEQ ID NO: 77597 - DNA, 25 bp, Homo sapien
ttaacagtgggtgccaactcatgct

SEQ ID NO: 77598 - DNA, 25 bp, Homo sapien
gtgccaactcatgctaacgcagcag

SEQ ID NO: 77599 - DNA, 25 bp, Homo sapien
aacgcagcagttgcaaacattttga

SEQ ID NO: 77600 - DNA, 25 bp, Homo sapien
caaacctgtactgtcccggaggagg

SEQ ID NO: 77601 - DNA, 25 bp, Homo sapien
aggtggaggcccagcatcccgcgca

SEQ ID NO: 77602 - DNA, 25 bp, Homo sapien
gaggcccagcatcccgcgcagatga

SEQ ID NO: 77603 - DNA, 25 bp, Homo sapien
actggcccactggtggctaggtctc

SEQ ID NO: 77604 - DNA, 25 bp, Homo sapien
cactggtggctaggtctccccttat

SEQ ID NO: 77605 - DNA, 25 bp, Homo sapien
ggtggctaggtctccccttatcctt

SEQ ID NO: 77606 - DNA, 25 bp, Homo sapien
ttatccttctggtccagcgcaagga

SEQ ID NO: 77607 - DNA, 25 bp, Homo sapien
tccttctggtccagcgcaaggaggg

SEQ ID NO: 77608 - DNA, 25 bp, Homo sapien
ctgcttctgaggtcggtggctgtct

SEQ ID NO: 77609 - DNA, 25 bp, Homo sapien
aggtcggtggctgtctttccattaa

SEQ ID NO: 77610 - DNA, 25 bp, Homo sapien
tcggtggctgtctttccattaaaga

SEQ ID NO: 77611 - DNA, 25 bp, Homo sapien
tgcaccagaccctggaagccttggc

SEQ ID NO: 77612 - DNA, 25 bp, Homo sapien
ggaagccttggccagagacctcacc

SEQ ID NO: 77613 - DNA, 25 bp, Homo sapien
cagagacctcaccaaactcgacttg

SEQ ID NO: 77614 - DNA, 25 bp, Homo sapien
accaaactcgacttgcggcgctggg

SEQ ID NO: 77615 - DNA, 25 bp, Homo sapien
acttgcggcgctgggccagcttcat

SEQ ID NO: 77616 - DNA, 25 bp, Homo sapien
gcacgatgacgtagcagagctgctg

SEQ ID NO: 77617 - DNA, 25 bp, Homo sapien
aggagctacaaagcctggcccagtg

SEQ ID NO: 77618 - DNA, 25 bp, Homo sapien
aagcctggcccagtgctaccagggt

SEQ ID NO: 77619 - DNA, 25 bp, Homo sapien
agggtggtgacagcctcgtggacta

SEQ ID NO: 77620 - DNA, 25 bp, Homo sapien
tcgtggactaaagttcccagtgtgg

SEQ ID NO: 77621 - DNA, 25 bp, Homo sapien
ggagaaaggagctagtttgcaataa

SEQ ID NO: 77622 - DNA, 25 bp, Homo sapien
ggtaagcatgcacagtttgcagtct

SEQ ID NO: 77623 - DNA, 25 bp, Homo sapien
tgtagcacaaaataggtgtaccttt

SEQ ID NO: 77624 - DNA, 25 bp, Homo sapien
ggtgtacctttataagtacattcaa

SEQ ID NO: 77625 - DNA, 25 bp, Homo sapien
aatccatctatctaggatatgttga

SEQ ID NO: 77626 - DNA, 25 bp, Homo sapien
ggatatgttgatacaaagtctgctt

SEQ ID NO: 77627 - DNA, 25 bp, Homo sapien
caaagtctgcttttgctattctttt

SEQ ID NO: 77628 - DNA, 25 bp, Homo sapien
attctttttgcttaaatactcctat

SEQ ID NO: 77629 - DNA, 25 bp, Homo sapien
aaatactcctatcattttctgaatt

SEQ ID NO: 77630 - DNA, 25 bp, Homo sapien
acttggtatttagaactcctagcac

SEQ ID NO: 77631 - DNA, 25 bp, Homo sapien
tatttagaactcctagcaccacggg

SEQ ID NO: 77632 - DNA, 25 bp, Homo sapien
gaggtatcatcaaacgtggcaaatt

SEQ ID NO: 77633 - DNA, 25 bp, Homo sapien
agaactaaatttagcatattgcaaa

SEQ ID NO: 77634 - DNA, 25 bp, Homo sapien
caaaaatattttgtgcggaattcga

SEQ ID NO: 77635 - DNA, 25 bp, Homo sapien
tgtgcggaattcgatataagtactt

SEQ ID NO: 77636 - DNA, 25 bp, Homo sapien
gcggaattcgatataagtactttta

SEQ ID NO: 77637 - DNA, 25 bp, Homo sapien
taaaatatttcagctgtcatttttg

SEQ ID NO: 77638 - DNA, 25 bp, Homo sapien
aaaattcttaggcttctctttgcga

SEQ ID NO: 77639 - DNA, 25 bp, Homo sapien
aattcttaggcttctctttgcgaaa

SEQ ID NO: 77640 - DNA, 25 bp, Homo sapien
ttcttaggcttctctttgcgaaata

SEQ ID NO: 77641 - DNA, 25 bp, Homo sapien
cttaggcttctctttgcgaaataaa

SEQ ID NO: 77642 - DNA, 25 bp, Homo sapien
taggcttctctttgcgaaataaaac

SEQ ID NO: 77643 - DNA, 25 bp, Homo sapien
gcttctctttgcgaaataaaactat

SEQ ID NO: 77644 - DNA, 25 bp, Homo sapien
tctcctcaaatcaagccctggacag

SEQ ID NO: 77645 - DNA, 25 bp, Homo sapien
ctcctcaaatcaagccctggacagg

SEQ ID NO: 77646 - DNA, 25 bp, Homo sapien
tcctcaaatcaagccctggacaggt

SEQ ID NO: 77647 - DNA, 25 bp, Homo sapien
cctcaaatcaagccctggacaggtc

SEQ ID NO: 77648 - DNA, 25 bp, Homo sapien
tcaaatcaagccctggacaggtctc

SEQ ID NO: 77649 - DNA, 25 bp, Homo sapien
caaatcaagccctggacaggtctcg

SEQ ID NO: 77650 - DNA, 25 bp, Homo sapien
aaatcaagccctggacaggtctcgc

SEQ ID NO: 77651 - DNA, 25 bp, Homo sapien
aatcaagccctggacaggtctcgca

SEQ ID NO: 77652 - DNA, 25 bp, Homo sapien
atcaagccctggacaggtctcgcac

SEQ ID NO: 77653 - DNA, 25 bp, Homo sapien
tcaagccctggacaggtctcgcacc

SEQ ID NO: 77654 - DNA, 25 bp, Homo sapien
caagccctggacaggtctcgcaccc

SEQ ID NO: 77655 - DNA, 25 bp, Homo sapien
ttggttaagttcacaaagttagcag

SEQ ID NO: 77656 - DNA, 25 bp, Homo sapien
gttcacaaagttagcagaagattta

SEQ ID NO: 77657 - DNA, 25 bp, Homo sapien
ttacaggcttcacctgtactgtcag

SEQ ID NO: 77658 - DNA, 25 bp, Homo sapien
acaggcttcacctgtactgtcaggg

SEQ ID NO: 77659 - DNA, 25 bp, Homo sapien
gcttcacctgtactgtcagggcaag

SEQ ID NO: 77660 - DNA, 25 bp, Homo sapien
tcacctgtactgtcagggcaagaga

SEQ ID NO: 77661 - DNA, 25 bp, Homo sapien
tacagcagtttaccagtgtgatggc

SEQ ID NO: 77662 - DNA, 25 bp, Homo sapien
gcagtttaccagtgtgatggctgtg

SEQ ID NO: 77663 - DNA, 25 bp, Homo sapien
atggctgtgacacagctccactcca

SEQ ID NO: 77664 - DNA, 25 bp, Homo sapien
actccacgggtggacacagcagagg

SEQ ID NO: 77665 - DNA, 25 bp, Homo sapien
agtgtgaatcaaaccgcttaaccca

SEQ ID NO: 77666 - DNA, 25 bp, Homo sapien
aatcacgggcggtcctgcacagatt

SEQ ID NO: 77667 - DNA, 25 bp, Homo sapien
tgcacagattcccaggccagggctg

SEQ ID NO: 77668 - DNA, 25 bp, Homo sapien
gccagggctgggtcacaggaaggaa

SEQ ID NO: 77669 - DNA, 25 bp, Homo sapien
agatcgctcccttggctttgaggcc

SEQ ID NO: 77670 - DNA, 25 bp, Homo sapien
ctttgaggccgaagctgctgtgact

SEQ ID NO: 77671 - DNA, 25 bp, Homo sapien
ggccgaagctgctgtgactgtgtcc

SEQ ID NO: 77672 - DNA, 25 bp, Homo sapien
ctgtgtccccttactgagcgcaagc

SEQ ID NO: 77673 - DNA, 25 bp, Homo sapien
acagcctgtcttgtcaggtggaccc

SEQ ID NO: 77674 - DNA, 25 bp, Homo sapien
ggtggaccctgtaaatacatccttt

SEQ ID NO: 77675 - DNA, 25 bp, Homo sapien
aatacatcctttttctgctaaccct

SEQ ID NO: 77676 - DNA, 25 bp, Homo sapien
tcgcctcctactctgagacaaaaaa

SEQ ID NO: 77677 - DNA, 25 bp, Homo sapien
agggtcagacccagccaggactcct

SEQ ID NO: 77678 - DNA, 25 bp, Homo sapien
cctcatttcatctcacagacacaat

SEQ ID NO: 77679 - DNA, 25 bp, Homo sapien
gcccaaccactctgtggtgaagcta

SEQ ID NO: 77680 - DNA, 25 bp, Homo sapien
cactctgtggtgaagctacgcaatg

SEQ ID NO: 77681 - DNA, 25 bp, Homo sapien
gtgaagctacgcaatgcaggccatg

SEQ ID NO: 77682 - DNA, 25 bp, Homo sapien
acaagccgcaagacttccaccttgt

SEQ ID NO: 77683 - DNA, 25 bp, Homo sapien
aagacttccaccttgtcctgcttgc

SEQ ID NO: 77684 - DNA, 25 bp, Homo sapien
tgtcctgcttgccttccttgaccat

SEQ ID NO: 77685 - DNA, 25 bp, Homo sapien
ttgaccatctaccttgaactaaccc

SEQ ID NO: 77686 - DNA, 25 bp, Homo sapien
ccagcctggcatgagcttggacagt

SEQ ID NO: 77687 - DNA, 25 bp, Homo sapien
acagcctctgggattggaggccaga

SEQ ID NO: 77688 - DNA, 25 bp, Homo sapien
acctcaggctgcaggatccagcaat

SEQ ID NO: 77689 - DNA, 25 bp, Homo sapien
tcaggctgcaggatccagcaatcag

SEQ ID NO: 77690 - DNA, 25 bp, Homo sapien
gctgcaggatccagcaatcagcctg

SEQ ID NO: 77691 - DNA, 25 bp, Homo sapien
tgcaggatccagcaatcagcctggc

SEQ ID NO: 77692 - DNA, 25 bp, Homo sapien
aggatccagcaatcagcctggcctt

SEQ ID NO: 77693 - DNA, 25 bp, Homo sapien
atccagcaatcagcctggcctttta

SEQ ID NO: 77694 - DNA, 25 bp, Homo sapien
agcaatcagcctggccttttagcca

SEQ ID NO: 77695 - DNA, 25 bp, Homo sapien
aatcagcctggccttttagccagtg

SEQ ID NO: 77696 - DNA, 25 bp, Homo sapien
tggccttttagccagtgttccccaa

SEQ ID NO: 77697 - DNA, 25 bp, Homo sapien
cacagcagacgccttctactcaggc

SEQ ID NO: 77698 - DNA, 25 bp, Homo sapien
gccttctactcaggcccagggtctg

SEQ ID NO: 77699 - DNA, 25 bp, Homo sapien
agtggtggcaaaggtttattccaga

SEQ ID NO: 77700 - DNA, 25 bp, Homo sapien
gagaagccaggaagccggtcatcac

SEQ ID NO: 77701 - DNA, 25 bp, Homo sapien
atcacccagcctctgagagcagtta

SEQ ID NO: 77702 - DNA, 25 bp, Homo sapien
gccactccccgctgtgtgactttgg

SEQ ID NO: 77703 - DNA, 25 bp, Homo sapien
gactttgggcaagccaagtgccctc

SEQ ID NO: 77704 - DNA, 25 bp, Homo sapien
gggcaagccaagtgccctctctgaa

SEQ ID NO: 77705 - DNA, 25 bp, Homo sapien
atgggaacaatgacgtgcctacctc

SEQ ID NO: 77706 - DNA, 25 bp, Homo sapien
gaacaatgacgtgcctacctcttag

SEQ ID NO: 77707 - DNA, 25 bp, Homo sapien
gtgcctacctcttagacatgttgtg

SEQ ID NO: 77708 - DNA, 25 bp, Homo sapien
cttagacatgttgtgaggagactat

SEQ ID NO: 77709 - DNA, 25 bp, Homo sapien
ggagactatgatataacatgtgtat

SEQ ID NO: 77710 - DNA, 25 bp, Homo sapien
tgggggtccacatccactccaaggg

SEQ ID NO: 77711 - DNA, 25 bp, Homo sapien
agatgaattcttgaattctgcctgc

SEQ ID NO: 77712 - DNA, 25 bp, Homo sapien
agtgccagaaaccagcactccatga

SEQ ID NO: 77713 - DNA, 25 bp, Homo sapien
gccagaaaccagcactccatgaaga

SEQ ID NO: 77714 - DNA, 25 bp, Homo sapien
gaaaccagcactccatgaagataaa

SEQ ID NO: 77715 - DNA, 25 bp, Homo sapien
atgaagataaactctgggcccgccc

SEQ ID NO: 77716 - DNA, 25 bp, Homo sapien
gaagataaactctgggcccgcccac

SEQ ID NO: 77717 - DNA, 25 bp, Homo sapien
accagcaggacctgtcgacctgagg

SEQ ID NO: 77718 - DNA, 25 bp, Homo sapien
gcaggacctgtcgacctgaggtgac

SEQ ID NO: 77719 - DNA, 25 bp, Homo sapien
aggacctgtcgacctgaggtgaccc

SEQ ID NO: 77720 - DNA, 25 bp, Homo sapien
acctgtcgacctgaggtgaccctgg

SEQ ID NO: 77721 - DNA, 25 bp, Homo sapien
tcaagatgctactgcagtggtccct

SEQ ID NO: 77722 - DNA, 25 bp, Homo sapien
agtggtccctccaatgtgtttgctg

SEQ ID NO: 77723 - DNA, 25 bp, Homo sapien
gtcatgactgcatttggaggcaaag

SEQ ID NO: 77724 - DNA, 25 bp, Homo sapien
gggtattttgtacaaacaccagaag

SEQ ID NO: 77725 - DNA, 25 bp, Homo sapien
aaatccctgaggcagagcctagcag

SEQ ID NO: 77726 - DNA, 25 bp, Homo sapien
gacacaactaaaccttctcttatca

SEQ ID NO: 77727 - DNA, 25 bp, Homo sapien
aacatcatgattgagccccaagcca

SEQ ID NO: 77728 - DNA, 25 bp, Homo sapien
attgagccccaagccacacggaagg

SEQ ID NO: 77729 - DNA, 25 bp, Homo sapien
aggcccaggattttcattggctgac

SEQ ID NO: 77730 - DNA, 25 bp, Homo sapien
tggctgacccgctctaatatgtaaa

SEQ ID NO: 77731 - DNA, 25 bp, Homo sapien
aaataaagacgccagttggtggtct

SEQ ID NO: 77732 - DNA, 25 bp, Homo sapien
tggaattaccccctagtgatggaat

SEQ ID NO: 77733 - DNA, 25 bp, Homo sapien
gggtcatagcttgggctgttccttc

SEQ ID NO: 77734 - DNA, 25 bp, Homo sapien
ggctgttccttctctgatacgggaa

SEQ ID NO: 77735 - DNA, 25 bp, Homo sapien
tacgggaagagaccccaatcagatt

SEQ ID NO: 77736 - DNA, 25 bp, Homo sapien
gagcctgctggctggaccaactgtc

SEQ ID NO: 77737 - DNA, 25 bp, Homo sapien
aaagacacagctggcttccctagta

SEQ ID NO: 77738 - DNA, 25 bp, Homo sapien
gctggcttccctagtacagagaaca

SEQ ID NO: 77739 - DNA, 25 bp, Homo sapien
agagaacagggcttgggccactttg

SEQ ID NO: 77740 - DNA, 25 bp, Homo sapien
gggccactttggagagacagaatct

SEQ ID NO: 77741 - DNA, 25 bp, Homo sapien
agaatctagtcctgggcaacttcac

SEQ ID NO: 77742 - DNA, 25 bp, Homo sapien
tagtcctgggcaacttcacatccgt

SEQ ID NO: 77743 - DNA, 25 bp, Homo sapien
cgcccctaaggtactatgagttctc

SEQ ID NO: 77744 - DNA, 25 bp, Homo sapien
cctaaggtactatgagttctcaggg

SEQ ID NO: 77745 - DNA, 25 bp, Homo sapien
ccacacgcccacaaagtggattgca

SEQ ID NO: 77746 - DNA, 25 bp, Homo sapien
gcccacaaagtggattgcacacaga

SEQ ID NO: 77747 - DNA, 25 bp, Homo sapien
cacaaagtggattgcacacagacaa

SEQ ID NO: 77748 - DNA, 25 bp, Homo sapien
gagggtccttgcaattccagcgaat

SEQ ID NO: 77749 - DNA, 25 bp, Homo sapien
actgttctgtgcactttttctacct

SEQ ID NO: 77750 - DNA, 25 bp, Homo sapien
tgttctgtgcactttttctacctac

SEQ ID NO: 77751 - DNA, 25 bp, Homo sapien
ctgtgcactttttctacctacataa

SEQ ID NO: 77752 - DNA, 25 bp, Homo sapien
gtgcactttttctacctacataaac

SEQ ID NO: 77753 - DNA, 25 bp, Homo sapien
ttctacctacataaacacacgcatt

SEQ ID NO: 77754 - DNA, 25 bp, Homo sapien
taattcttgtaaagtttcttaactg

SEQ ID NO: 77755 - DNA, 25 bp, Homo sapien
ttaaaccagattattcacagtagga

SEQ ID NO: 77756 - DNA, 25 bp, Homo sapien
ttaagtgaggactctctacccttgc

SEQ ID NO: 77757 - DNA, 25 bp, Homo sapien
tctacccttgccgtatctaaggagc

SEQ ID NO: 77758 - DNA, 25 bp, Homo sapien
acccttgccgtatctaaggagctga

SEQ ID NO: 77759 - DNA, 25 bp, Homo sapien
gagctgaggtaatacagatccaagg

SEQ ID NO: 77760 - DNA, 25 bp, Homo sapien
agctgaggtaatacagatccaagga

SEQ ID NO: 77761 - DNA, 25 bp, Homo sapien
gctgaggtaatacagatccaaggag

SEQ ID NO: 77762 - DNA, 25 bp, Homo sapien
gaggtaatacagatccaaggagaat

SEQ ID NO: 77763 - DNA, 25 bp, Homo sapien
tacagatccaaggagaattgtatag

SEQ ID NO: 77764 - DNA, 25 bp, Homo sapien
gtgacagtactttgatttctctcgg

SEQ ID NO: 77765 - DNA, 25 bp, Homo sapien
tccgataccaataagtcagcctgat

SEQ ID NO: 77766 - DNA, 25 bp, Homo sapien
aagtcagcctgatgctctaatggaa

SEQ ID NO: 77767 - DNA, 25 bp, Homo sapien
gctctaatggaaaaatggccctctt

SEQ ID NO: 77768 - DNA, 25 bp, Homo sapien
aaatgcttcagatgaggctccacct

SEQ ID NO: 77769 - DNA, 25 bp, Homo sapien
gatgaggctccaccttgttaaataa

SEQ ID NO: 77770 - DNA, 25 bp, Homo sapien
gggaactcatttagctcacgagtgg

SEQ ID NO: 77771 - DNA, 25 bp, Homo sapien
tcatttagctcacgagtggtcgagt

SEQ ID NO: 77772 - DNA, 25 bp, Homo sapien
tttagctcacgagtggtcgagtgaa

SEQ ID NO: 77773 - DNA, 25 bp, Homo sapien
acgagtggtcgagtgaagattgaaa

SEQ ID NO: 77774 - DNA, 25 bp, Homo sapien
aaattaacctctgagggccagcaca

SEQ ID NO: 77775 - DNA, 25 bp, Homo sapien
attaacctctgagggccagcacagc

SEQ ID NO: 77776 - DNA, 25 bp, Homo sapien
gagaacctgtacagctggaaacgct

SEQ ID NO: 77777 - DNA, 25 bp, Homo sapien
ggaaacgctgagtattcgaggaaat

SEQ ID NO: 77778 - DNA, 25 bp, Homo sapien
aacattcggtattttattctaccag

SEQ ID NO: 77779 - DNA, 25 bp, Homo sapien
agacagtttacctctggatacacta

SEQ ID NO: 77780 - DNA, 25 bp, Homo sapien
ttacctctggatacactacttgtgg

SEQ ID NO: 77781 - DNA, 25 bp, Homo sapien
ttgtggatgttgaacctaaggtgaa

SEQ ID NO: 77782 - DNA, 25 bp, Homo sapien
gggtcctaggcgataatgtctctca

SEQ ID NO: 77783 - DNA, 25 bp, Homo sapien
ggcgataatgtctctcaagatttca

SEQ ID NO: 77784 - DNA, 25 bp, Homo sapien
gtctctcaagatttcaaagtcatat

SEQ ID NO: 77785 - DNA, 25 bp, Homo sapien
tttgggatattttttgtacaggttg

SEQ ID NO: 77786 - DNA, 25 bp, Homo sapien
tgtacaggttgtgtttgtttatgtc

SEQ ID NO: 77787 - DNA, 25 bp, Homo sapien
ggaagcacgtggttgagaagcatca

SEQ ID NO: 77788 - DNA, 25 bp, Homo sapien
agcacgtggttgagaagcatcagaa

SEQ ID NO: 77789 - DNA, 25 bp, Homo sapien
agaagcatcagaatcgttcccacgg

SEQ ID NO: 77790 - DNA, 25 bp, Homo sapien
aagcatcagaatcgttcccacggac

SEQ ID NO: 77791 - DNA, 25 bp, Homo sapien
atcagaatcgttcccacggaccatg

SEQ ID NO: 77792 - DNA, 25 bp, Homo sapien
agaatcgttcccacggaccatgctc

SEQ ID NO: 77793 - DNA, 25 bp, Homo sapien
gttcccacggaccatgctccggagt

SEQ ID NO: 77794 - DNA, 25 bp, Homo sapien
gaccatgctccggagtctcagcagg

SEQ ID NO: 77795 - DNA, 25 bp, Homo sapien
agtctcagcaggctcctgcagtgtg

SEQ ID NO: 77796 - DNA, 25 bp, Homo sapien
agcaggctcctgcagtgtgtttatc

SEQ ID NO: 77797 - DNA, 25 bp, Homo sapien
caggctcctgcagtgtgtttatccg

SEQ ID NO: 77798 - DNA, 25 bp, Homo sapien
gtgtctggagacacagaccgtgacc

SEQ ID NO: 77799 - DNA, 25 bp, Homo sapien
gcagcggtgtgcatcagaggcgtgt

SEQ ID NO: 77800 - DNA, 25 bp, Homo sapien
taaatcagtgccaaagcttccctgc

SEQ ID NO: 77801 - DNA, 25 bp, Homo sapien
gcttccctgcgcatctgaatagaca

SEQ ID NO: 77802 - DNA, 25 bp, Homo sapien
ctgcgcatctgaatagacacaagtg

SEQ ID NO: 77803 - DNA, 25 bp, Homo sapien
gacacaagtgaagcccgtgtgcgca

SEQ ID NO: 77804 - DNA, 25 bp, Homo sapien
aagtgaagcccgtgtgcgcacagtg

SEQ ID NO: 77805 - DNA, 25 bp, Homo sapien
tgcgcacagtgcagaggccgagcct

SEQ ID NO: 77806 - DNA, 25 bp, Homo sapien
gaggccgagcctgtatttccaggta

SEQ ID NO: 77807 - DNA, 25 bp, Homo sapien
gtatttccaggtagacgtggacttt

SEQ ID NO: 77808 - DNA, 25 bp, Homo sapien
cgtggactttattgactgtgaattc

SEQ ID NO: 77809 - DNA, 25 bp, Homo sapien
agcaggtgcagagcactgcgctgtc

SEQ ID NO: 77810 - DNA, 25 bp, Homo sapien
gcgctgtcagcgatagcccagtgga

SEQ ID NO: 77811 - DNA, 25 bp, Homo sapien
agtggatggccattccagaccatgc

SEQ ID NO: 77812 - DNA, 25 bp, Homo sapien
agaccatgctcgacagctgaccaag

SEQ ID NO: 77813 - DNA, 25 bp, Homo sapien
ctgaccaaggccatgatgcgaaagg

SEQ ID NO: 77814 - DNA, 25 bp, Homo sapien
agcgcgatgcggacgtgcagaactt

SEQ ID NO: 77815 - DNA, 25 bp, Homo sapien
ttcgtcagcttcatctccaaagact

SEQ ID NO: 77816 - DNA, 25 bp, Homo sapien
atccagaagtccctgcagatgtact

SEQ ID NO: 77817 - DNA, 25 bp, Homo sapien
gcagatgtacttagagaggctcaaa

SEQ ID NO: 77818 - DNA, 25 bp, Homo sapien
aaaggctaacgattgggctgccaca

SEQ ID NO: 77819 - DNA, 25 bp, Homo sapien
gattgggctgccacaggcttacggc

SEQ ID NO: 77820 - DNA, 25 bp, Homo sapien
atggtcaggacctgggccattgcaa

SEQ ID NO: 77821 - DNA, 25 bp, Homo sapien
gacctgggccattgcaaccaaaatg

SEQ ID NO: 77822 - DNA, 25 bp, Homo sapien
gggtagggaggtcactccctctact

SEQ ID NO: 77823 - DNA, 25 bp, Homo sapien
tccctctactcactgagctaggatt

SEQ ID NO: 77824 - DNA, 25 bp, Homo sapien
ctactcactgagctaggattaggga

SEQ ID NO: 77825 - DNA, 25 bp, Homo sapien
tagggagggttattgccccaaccat

SEQ ID NO: 77826 - DNA, 25 bp, Homo sapien
gggttattgccccaaccattgcaat

SEQ ID NO: 77827 - DNA, 25 bp, Homo sapien
attgccccaaccattgcaatgggag

SEQ ID NO: 77828 - DNA, 25 bp, Homo sapien
aaatgtgtgaagtgcgatttctgct

SEQ ID NO: 77829 - DNA, 25 bp, Homo sapien
agtgcgatttctgcttttgtgtacc

SEQ ID NO: 77830 - DNA, 25 bp, Homo sapien
atttctgcttttgtgtaccccacca

SEQ ID NO: 77831 - DNA, 25 bp, Homo sapien
tccgataccaataagtcagcctgat

SEQ ID NO: 77832 - DNA, 25 bp, Homo sapien
gataccaataagtcagcctgatgct

SEQ ID NO: 77833 - DNA, 25 bp, Homo sapien
taccaataagtcagcctgatgctct

SEQ ID NO: 77834 - DNA, 25 bp, Homo sapien
caataagtcagcctgatgctctaat

SEQ ID NO: 77835 - DNA, 25 bp, Homo sapien
taagtcagcctgatgctctaatgga

SEQ ID NO: 77836 - DNA, 25 bp, Homo sapien
aagtcagcctgatgctctaatggaa

SEQ ID NO: 77837 - DNA, 25 bp, Homo sapien
agtcagcctgatgctctaatggaaa

SEQ ID NO: 77838 - DNA, 25 bp, Homo sapien
gtcagcctgatgctctaatggaaaa

SEQ ID NO: 77839 - DNA, 25 bp, Homo sapien
gcctgatgctctaatggaaaaatgg

SEQ ID NO: 77840 - DNA, 25 bp, Homo sapien
gatgctctaatggaaaaatggccct

SEQ ID NO: 77841 - DNA, 25 bp, Homo sapien
gctctaatggaaaaatggccctctt

SEQ ID NO: 77842 - DNA, 25 bp, Homo sapien
gaccgacattgccttggtttgttac

SEQ ID NO: 77843 - DNA, 25 bp, Homo sapien
tggtttgttacatgactatcgtgat

SEQ ID NO: 77844 - DNA, 25 bp, Homo sapien
ggaaatagtaatcacacctctctgt

SEQ ID NO: 77845 - DNA, 25 bp, Homo sapien
gaaagaatatatcagccttcggctc

SEQ ID NO: 77846 - DNA, 25 bp, Homo sapien
cagccttcggctcatcatatcagag

SEQ ID NO: 77847 - DNA, 25 bp, Homo sapien
gtcactctacatgacatgatcctga

SEQ ID NO: 77848 - DNA, 25 bp, Homo sapien
tatcgagaagatcaaacggccccgg

SEQ ID NO: 77849 - DNA, 25 bp, Homo sapien
aaacggccccggagcagcaatgcag

SEQ ID NO: 77850 - DNA, 25 bp, Homo sapien
ggagcagcaatgcagagactctgta

SEQ ID NO: 77851 - DNA, 25 bp, Homo sapien
agactctgtactgaggccagggcca

SEQ ID NO: 77852 - DNA, 25 bp, Homo sapien
ggactctgtgagtctggctcaagac

SEQ ID NO: 77853 - DNA, 25 bp, Homo sapien
gctttggtgtgtattgcagccacgg

SEQ ID NO: 77854 - DNA, 25 bp, Homo sapien
ggtgtgtattgcagccacggcacgt

SEQ ID NO: 77855 - DNA, 25 bp, Homo sapien
gccacggcacgtttaactggcagaa

SEQ ID NO: 77856 - DNA, 25 bp, Homo sapien
gaatcttttcagttatttccaagcc

SEQ ID NO: 77857 - DNA, 25 bp, Homo sapien
cttttcagttatttccaagccagga

SEQ ID NO: 77858 - DNA, 25 bp, Homo sapien
ttccaagccaggaaactcgctccgt

SEQ ID NO: 77859 - DNA, 25 bp, Homo sapien
aggaaactcgctccgtcacatgaag

SEQ ID NO: 77860 - DNA, 25 bp, Homo sapien
actcgctccgtcacatgaagttaga

SEQ ID NO: 77861 - DNA, 25 bp, Homo sapien
gtcacatgaagttagagcaggcctc

SEQ ID NO: 77862 - DNA, 25 bp, Homo sapien
ggcaacaagcgagacgccctattta

SEQ ID NO: 77863 - DNA, 25 bp, Homo sapien
agcgagacgccctatttaagaaata

SEQ ID NO: 77864 - DNA, 25 bp, Homo sapien
gaaaaggactaacaggcagtatgct

SEQ ID NO: 77865 - DNA, 25 bp, Homo sapien
aggactaacaggcagtatgctgtca

SEQ ID NO: 77866 - DNA, 25 bp, Homo sapien
ggactaacaggcagtatgctgtcat

SEQ ID NO: 77867 - DNA, 25 bp, Homo sapien
gactaacaggcagtatgctgtcatg

SEQ ID NO: 77868 - DNA, 25 bp, Homo sapien
ctaacaggcagtatgctgtcatgtt

SEQ ID NO: 77869 - DNA, 25 bp, Homo sapien
acaggcagtatgctgtcatgttaat

SEQ ID NO: 77870 - DNA, 25 bp, Homo sapien
caggcagtatgctgtcatgttaatg

SEQ ID NO: 77871 - DNA, 25 bp, Homo sapien
ggcagtatgctgtcatgttaatgtg

SEQ ID NO: 77872 - DNA, 25 bp, Homo sapien
cagtatgctgtcatgttaatgtggg

SEQ ID NO: 77873 - DNA, 25 bp, Homo sapien
tggaaaaattgtctgcattttttct

SEQ ID NO: 77874 - DNA, 25 bp, Homo sapien
aattgtctgcattttttctgcattt

SEQ ID NO: 77875 - DNA, 25 bp, Homo sapien
gaaaaggactaacaggcagtatgct

SEQ ID NO: 77876 - DNA, 25 bp, Homo sapien
aggactaacaggcagtatgctgtca

SEQ ID NO: 77877 - DNA, 25 bp, Homo sapien
ggactaacaggcagtatgctgtcat

SEQ ID NO: 77878 - DNA, 25 bp, Homo sapien
gactaacaggcagtatgctgtcatg

SEQ ID NO: 77879 - DNA, 25 bp, Homo sapien
ctaacaggcagtatgctgtcatgtt

SEQ ID NO: 77880 - DNA, 25 bp, Homo sapien
acaggcagtatgctgtcatgttaat

SEQ ID NO: 77881 - DNA, 25 bp, Homo sapien
caggcagtatgctgtcatgttaatg

SEQ ID NO: 77882 - DNA, 25 bp, Homo sapien
ggcagtatgctgtcatgttaatgtg

SEQ ID NO: 77883 - DNA, 25 bp, Homo sapien
cagtatgctgtcatgttaatgtggg

SEQ ID NO: 77884 - DNA, 25 bp, Homo sapien
tggaaaaattgtctgcattttttct

SEQ ID NO: 77885 - DNA, 25 bp, Homo sapien
aaaattccaacacaataaatacaat

SEQ ID NO: 77886 - DNA, 25 bp, Homo sapien
tgtgggccccagaaagccagcctgc

SEQ ID NO: 77887 - DNA, 25 bp, Homo sapien
cagcctgccttttagcacttggata

SEQ ID NO: 77888 - DNA, 25 bp, Homo sapien
gccttttagcacttggatacacaca

SEQ ID NO: 77889 - DNA, 25 bp, Homo sapien
ttggatacacacagacccacggagc

SEQ ID NO: 77890 - DNA, 25 bp, Homo sapien
agacccacggagctctctgtgtttg

SEQ ID NO: 77891 - DNA, 25 bp, Homo sapien
tctgtgtttggcctctcacacacac

SEQ ID NO: 77892 - DNA, 25 bp, Homo sapien
acacacaggcccatagacagatggg

SEQ ID NO: 77893 - DNA, 25 bp, Homo sapien
acagatgggcagatgcacccagagc

SEQ ID NO: 77894 - DNA, 25 bp, Homo sapien
ccatgcacagtgtcctgcgtgggaa

SEQ ID NO: 77895 - DNA, 25 bp, Homo sapien
tgcgtgggaaagagacacggtcccc

SEQ ID NO: 77896 - DNA, 25 bp, Homo sapien
gccaaatggagcatctctgttcttt

SEQ ID NO: 77897 - DNA, 25 bp, Homo sapien
gggtttacaggtgtgtaccgccaca

SEQ ID NO: 77898 - DNA, 25 bp, Homo sapien
ggtttacaggtgtgtaccgccacac

SEQ ID NO: 77899 - DNA, 25 bp, Homo sapien
gtttacaggtgtgtaccgccacacc

SEQ ID NO: 77900 - DNA, 25 bp, Homo sapien
acaggtgtgtaccgccacacccgtc

SEQ ID NO: 77901 - DNA, 25 bp, Homo sapien
aggtgtgtaccgccacacccgtctc

SEQ ID NO: 77902 - DNA, 25 bp, Homo sapien
ggtgtgtaccgccacacccgtctct

SEQ ID NO: 77903 - DNA, 25 bp, Homo sapien
gtgtgtaccgccacacccgtctcta

SEQ ID NO: 77904 - DNA, 25 bp, Homo sapien
tgtgtaccgccacacccgtctctac

SEQ ID NO: 77905 - DNA, 25 bp, Homo sapien
gtgtaccgccacacccgtctctact

SEQ ID NO: 77906 - DNA, 25 bp, Homo sapien
tgtaccgccacacccgtctctacta

SEQ ID NO: 77907 - DNA, 25 bp, Homo sapien
gtaccgccacacccgtctctactaa

SEQ ID NO: 77908 - DNA, 25 bp, Homo sapien
gaacaggagtactagaagcctatct

SEQ ID NO: 77909 - DNA, 25 bp, Homo sapien
gaagcctatctcatggattctgaca

SEQ ID NO: 77910 - DNA, 25 bp, Homo sapien
tccagattccagcatcagaagttct

SEQ ID NO: 77911 - DNA, 25 bp, Homo sapien
aagttctgatggatgatgaccttca

SEQ ID NO: 77912 - DNA, 25 bp, Homo sapien
catggatatgttttgtcctccagga

SEQ ID NO: 77913 - DNA, 25 bp, Homo sapien
aaattgatgcatatccgtggttgga

SEQ ID NO: 77914 - DNA, 25 bp, Homo sapien
atccgtggttggaatgcttcatcaa

SEQ ID NO: 77915 - DNA, 25 bp, Homo sapien
ggaatgcttcatcaagtcatacaat

SEQ ID NO: 77916 - DNA, 25 bp, Homo sapien
tttgctatcagatttttgacaccac

SEQ ID NO: 77917 - DNA, 25 bp, Homo sapien
gatttttgacaccacagttgcagaa

SEQ ID NO: 77918 - DNA, 25 bp, Homo sapien
tattgccatccaatttagcatacat

SEQ ID NO: 77919 - DNA, 25 bp, Homo sapien
tgtcgtgttcgggtttttcctctgt

SEQ ID NO: 77920 - DNA, 25 bp, Homo sapien
tcgtgttcgggtttttcctctgtga

SEQ ID NO: 77921 - DNA, 25 bp, Homo sapien
tgttcgggtttttcctctgtgactg

SEQ ID NO: 77922 - DNA, 25 bp, Homo sapien
tcgggtttttcctctgtgactgggc

SEQ ID NO: 77923 - DNA, 25 bp, Homo sapien
gggtttttcctctgtgactgggccg

SEQ ID NO: 77924 - DNA, 25 bp, Homo sapien
gtttttcctctgtgactgggccgtc

SEQ ID NO: 77925 - DNA, 25 bp, Homo sapien
ttttcctctgtgactgggccgtctt

SEQ ID NO: 77926 - DNA, 25 bp, Homo sapien
tcctctgtgactgggccgtcttggt

SEQ ID NO: 77927 - DNA, 25 bp, Homo sapien
acagtggtgctagtctgtttttaac

SEQ ID NO: 77928 - DNA, 25 bp, Homo sapien
agtggtgctagtctgtttttaacaa

SEQ ID NO: 77929 - DNA, 25 bp, Homo sapien
ggtgctagtctgtttttaacaaaag

SEQ ID NO: 77930 - DNA, 25 bp, Homo sapien
gttggtttggataaccggttgcact

SEQ ID NO: 77931 - DNA, 25 bp, Homo sapien
aaccggttgcactatatctgtgagc

SEQ ID NO: 77932 - DNA, 25 bp, Homo sapien
tgtgagctctcaaatgtcttcttcc

SEQ ID NO: 77933 - DNA, 25 bp, Homo sapien
atgtcttcttcccaaggcaagaggt

SEQ ID NO: 77934 - DNA, 25 bp, Homo sapien
gtttgtttaaagtcaggcagggctg

SEQ ID NO: 77935 - DNA, 25 bp, Homo sapien
gcagccagggccatgttgcacaagg

SEQ ID NO: 77936 - DNA, 25 bp, Homo sapien
catgttgcacaaggcctgagagacg

SEQ ID NO: 77937 - DNA, 25 bp, Homo sapien
gaaagggcccgatcgctctttcccg

SEQ ID NO: 77938 - DNA, 25 bp, Homo sapien
gcctctcactggtgcgatggaaggt

SEQ ID NO: 77939 - DNA, 25 bp, Homo sapien
atggaaggtggcctttctcccaagc

SEQ ID NO: 77940 - DNA, 25 bp, Homo sapien
gcctttctcccaagctggtggataa

SEQ ID NO: 77941 - DNA, 25 bp, Homo sapien
aggtgtttaagcacaggcttgataa

SEQ ID NO: 77942 - DNA, 25 bp, Homo sapien
gcacaggcttgataagtttggtttt

SEQ ID NO: 77943 - DNA, 25 bp, Homo sapien
gaggaaactgagcatttcttttgcc

SEQ ID NO: 77944 - DNA, 25 bp, Homo sapien
ggtgccaagaccctacatatgacag

SEQ ID NO: 77945 - DNA, 25 bp, Homo sapien
tacatatgacagaacccttggccct

SEQ ID NO: 77946 - DNA, 25 bp, Homo sapien
atgcctgtgggatctgtttctttaa

SEQ ID NO: 77947 - DNA, 25 bp, Homo sapien
ggatctgtttctttaaagcactttg

SEQ ID NO: 77948 - DNA, 25 bp, Homo sapien
agcactttgtactgttattcaggag

SEQ ID NO: 77949 - DNA, 25 bp, Homo sapien
gaggttgataatctccttgacccat

SEQ ID NO: 77950 - DNA, 25 bp, Homo sapien
taatctccttgacccatgtctttct

SEQ ID NO: 77951 - DNA, 25 bp, Homo sapien
ccacttccctgcagaatcaatctga

SEQ ID NO: 77952 - DNA, 25 bp, Homo sapien
agcccctatctccaagagacagagg

SEQ ID NO: 77953 - DNA, 25 bp, Homo sapien
gtcaggaggcactgctcatctgtac

SEQ ID NO: 77954 - DNA, 25 bp, Homo sapien
gaggcactgctcatctgtacatact

SEQ ID NO: 77955 - DNA, 25 bp, Homo sapien
atactgtttcctatgacattactgt

SEQ ID NO: 77956 - DNA, 25 bp, Homo sapien
tggagatgaaatgcctttgattttt

SEQ ID NO: 77957 - DNA, 25 bp, Homo sapien
gagggccctccaaacggcagaccaa

SEQ ID NO: 77958 - DNA, 25 bp, Homo sapien
aacggcagaccaatggctgtctcaa

SEQ ID NO: 77959 - DNA, 25 bp, Homo sapien
accaatggctgtctcaacggctaca

SEQ ID NO: 77960 - DNA, 25 bp, Homo sapien
tacaccccttcacgcaagaggcagg

SEQ ID NO: 77961 - DNA, 25 bp, Homo sapien
aagaggcaggcatcggagtccagca

SEQ ID NO: 77962 - DNA, 25 bp, Homo sapien
gagtccagcagcaggccgcattgac

SEQ ID NO: 77963 - DNA, 25 bp, Homo sapien
tgttttggtttgtcaccctcgataa

SEQ ID NO: 77964 - DNA, 25 bp, Homo sapien
tttggtttgtcaccctcgataaagg

SEQ ID NO: 77965 - DNA, 25 bp, Homo sapien
gtttgtcaccctcgataaaggaagt

SEQ ID NO: 77966 - DNA, 25 bp, Homo sapien
cagagcctggtatgtcttcatagtc

SEQ ID NO: 77967 - DNA, 25 bp, Homo sapien
gtatgtcttcatagtcattgagaat

SEQ ID NO: 77968 - DNA, 25 bp, Homo sapien
ctctccctgacttggtgctcacatg

SEQ ID NO: 77969 - DNA, 25 bp, Homo sapien
tgacttggtgctcacatgcacctca

SEQ ID NO: 77970 - DNA, 25 bp, Homo sapien
atgcacctcactagggtttgtgacc

SEQ ID NO: 77971 - DNA, 25 bp, Homo sapien
cactagggtttgtgaccagggtctg

SEQ ID NO: 77972 - DNA, 25 bp, Homo sapien
cagggtctggatgagcttgaatttg

SEQ ID NO: 77973 - DNA, 25 bp, Homo sapien
ttctagaaccctgggtttttacatg

SEQ ID NO: 77974 - DNA, 25 bp, Homo sapien
tctggctctcagatcgatgaccatg

SEQ ID NO: 77975 - DNA, 25 bp, Homo sapien
agatcgatgaccatgttccaaagcg

SEQ ID NO: 77976 - DNA, 25 bp, Homo sapien
caaagcgagcttcagctcggatcct

SEQ ID NO: 77977 - DNA, 25 bp, Homo sapien
gtcgagtggcatttggtaaaggcat

SEQ ID NO: 77978 - DNA, 25 bp, Homo sapien
tttggtaaaggcattgccaagcccc

SEQ ID NO: 77979 - DNA, 25 bp, Homo sapien
agccctccctatgtctgcaaagtga

SEQ ID NO: 77980 - DNA, 25 bp, Homo sapien
tccctatgtctgcaaagtgattcac

SEQ ID NO: 77981 - DNA, 25 bp, Homo sapien
agtgattcactgtgcttcgagccaa

SEQ ID NO: 77982 - DNA, 25 bp, Homo sapien
tgtgcttcgagccaactctaacagg

SEQ ID NO: 77983 - DNA, 25 bp, Homo sapien
gagccaactctaacaggcactttga

SEQ ID NO: 77984 - DNA, 25 bp, Homo sapien
ctaacaggcactttgagatgtgttc

SEQ ID NO: 77985 - DNA, 25 bp, Homo sapien
ctgctgaaagctggtgaggctgagc

SEQ ID NO: 77986 - DNA, 25 bp, Homo sapien
ccaacccaagctctgcggaaatcaa

SEQ ID NO: 77987 - DNA, 25 bp, Homo sapien
aacccaagctctgcggaaatcaaca

SEQ ID NO: 77988 - DNA, 25 bp, Homo sapien
aagctctgcggaaatcaacagcccc

SEQ ID NO: 77989 - DNA, 25 bp, Homo sapien
ttcaaggctatgacagtctgctacg

SEQ ID NO: 77990 - DNA, 25 bp, Homo sapien
aaggctatgacagtctgctacgcaa

SEQ ID NO: 77991 - DNA, 25 bp, Homo sapien
ggctatgacagtctgctacgcaaaa

SEQ ID NO: 77992 - DNA, 25 bp, Homo sapien
tatgacagtctgctacgcaaaacat

SEQ ID NO: 77993 - DNA, 25 bp, Homo sapien
gacagtctgctacgcaaaacatttt

SEQ ID NO: 77994 - DNA, 25 bp, Homo sapien
gtctgctacgcaaaacattttttca

SEQ ID NO: 77995 - DNA, 25 bp, Homo sapien
agccctgtgataccacagactgtgc

SEQ ID NO: 77996 - DNA, 25 bp, Homo sapien
agacagcatcggtgtctgctgctgt

SEQ ID NO: 77997 - DNA, 25 bp, Homo sapien
tgctgtgtccccaggtcttgtgtgg

SEQ ID NO: 77998 - DNA, 25 bp, Homo sapien
gtggcacagatctgggcagttagat

SEQ ID NO: 77999 - DNA, 25 bp, Homo sapien
gcagttagatagtgctctgtgccta

SEQ ID NO: 78000 - DNA, 25 bp, Homo sapien
tctgtgcctaaggtgaagccacact

SEQ ID NO: 78001 - DNA, 25 bp, Homo sapien
agccacactagggtgaagcctcact

SEQ ID NO: 78002 - DNA, 25 bp, Homo sapien
tcacttccctgtttgagcaatgcag

SEQ ID NO: 78003 - DNA, 25 bp, Homo sapien
tgctgcccgtgtgcatgaaggtaca

SEQ ID NO: 78004 - DNA, 25 bp, Homo sapien
gatttgcatttgtcaggcagacgtt

SEQ ID NO: 78005 - DNA, 25 bp, Homo sapien
ggcagacgtttatacaacaccacgg

SEQ ID NO: 78006 - DNA, 25 bp, Homo sapien
aacaccacggtgcttttatacattg

SEQ ID NO: 78007 - DNA, 25 bp, Homo sapien
tttaaatcaatgtctcgcggctggc

SEQ ID NO: 78008 - DNA, 25 bp, Homo sapien
cgcggctggcgtgaattgaacttaa

SEQ ID NO: 78009 - DNA, 25 bp, Homo sapien
agtactgtggctacattgtcttcat

SEQ ID NO: 78010 - DNA, 25 bp, Homo sapien
acattgtcttcattctcacttgacc

SEQ ID NO: 78011 - DNA, 25 bp, Homo sapien
acttgacctaacatcccattggcag

SEQ ID NO: 78012 - DNA, 25 bp, Homo sapien
atcccattggcagtaggcgcattta

SEQ ID NO: 78013 - DNA, 25 bp, Homo sapien
ggcgcatttactgtagatcacattt

SEQ ID NO: 78014 - DNA, 25 bp, Homo sapien
tggacttgagtcagaatcccatctc

SEQ ID NO: 78015 - DNA, 25 bp, Homo sapien
catctctgctattcactgggtgtgt

SEQ ID NO: 78016 - DNA, 25 bp, Homo sapien
gtgtgaacttatataccgagtctca

SEQ ID NO: 78017 - DNA, 25 bp, Homo sapien
cgagtctcagttccccattaaatga

SEQ ID NO: 78018 - DNA, 25 bp, Homo sapien
aatcacaagaagattcccacccctg

SEQ ID NO: 78019 - DNA, 25 bp, Homo sapien
atcacaagaagattcccacccctgc

SEQ ID NO: 78020 - DNA, 25 bp, Homo sapien
tcccatgcctggtcccaagacagtg

SEQ ID NO: 78021 - DNA, 25 bp, Homo sapien
cccatgcctggtcccaagacagtga

SEQ ID NO: 78022 - DNA, 25 bp, Homo sapien
catgcctggtcccaagacagtgaga

SEQ ID NO: 78023 - DNA, 25 bp, Homo sapien
atgcctggtcccaagacagtgagac

SEQ ID NO: 78024 - DNA, 25 bp, Homo sapien
tgcctggtcccaagacagtgagaca

SEQ ID NO: 78025 - DNA, 25 bp, Homo sapien
cagtctggaaagtgatgtcagaata

SEQ ID NO: 78026 - DNA, 25 bp, Homo sapien
ctggaaagtgatgtcagaatagctt

SEQ ID NO: 78027 - DNA, 25 bp, Homo sapien
ggcctgagtgatccacgtgaaaaaa

SEQ ID NO: 78028 - DNA, 25 bp, Homo sapien
gcctgagtgatccacgtgaaaaaaa

SEQ ID NO: 78029 - DNA, 25 bp, Homo sapien
gggccgcagcatgcctatggttccg

SEQ ID NO: 78030 - DNA, 25 bp, Homo sapien
tatggttccgcttccggccgggagc

SEQ ID NO: 78031 - DNA, 25 bp, Homo sapien
ccctgaacacgggtgtgcagactca

SEQ ID NO: 78032 - DNA, 25 bp, Homo sapien
gtgtgcagactcaccctaaagggcg

SEQ ID NO: 78033 - DNA, 25 bp, Homo sapien
acgctagaaggctggcgagaccgaa

SEQ ID NO: 78034 - DNA, 25 bp, Homo sapien
gaaggcagcatgtgaggcctctcct

SEQ ID NO: 78035 - DNA, 25 bp, Homo sapien
ggttgtgtttcccacagtggcctca

SEQ ID NO: 78036 - DNA, 25 bp, Homo sapien
cccgctcaggtgagcccgaaggcag

SEQ ID NO: 78037 - DNA, 25 bp, Homo sapien
caaacactccactcagaccataaag

SEQ ID NO: 78038 - DNA, 25 bp, Homo sapien
ctcagaccataaagcactcctgttt

SEQ ID NO: 78039 - DNA, 25 bp, Homo sapien
cataaagcactcctgtttcactctg

SEQ ID NO: 78040 - DNA, 25 bp, Homo sapien
tctgcccagggccagccaggttctg

SEQ ID NO: 78041 - DNA, 25 bp, Homo sapien
agggccagccaggttctgctgggaa

SEQ ID NO: 78042 - DNA, 25 bp, Homo sapien
agaagcaagcagtgtctgagcctca

SEQ ID NO: 78043 - DNA, 25 bp, Homo sapien
agcaagcagtgtctgagcctcagga

SEQ ID NO: 78044 - DNA, 25 bp, Homo sapien
agcagtgtctgagcctcaggagctt

SEQ ID NO: 78045 - DNA, 25 bp, Homo sapien
agctgttggcatgagacctccttct

SEQ ID NO: 78046 - DNA, 25 bp, Homo sapien
ttccttgagctgtcgctgtactctg

SEQ ID NO: 78047 - DNA, 25 bp, Homo sapien
cttgagctgtcgctgtactctgaag

SEQ ID NO: 78048 - DNA, 25 bp, Homo sapien
tgagctgtcgctgtactctgaagtt

SEQ ID NO: 78049 - DNA, 25 bp, Homo sapien
agctgtcgctgtactctgaagttca

SEQ ID NO: 78050 - DNA, 25 bp, Homo sapien
tcgctgtactctgaagttcagccag

SEQ ID NO: 78051 - DNA, 25 bp, Homo sapien
atgaagccacaccacgatacagtca

SEQ ID NO: 78052 - DNA, 25 bp, Homo sapien
tgaagccacaccacgatacagtcag

SEQ ID NO: 78053 - DNA, 25 bp, Homo sapien
gaagccacaccacgatacagtcagc

SEQ ID NO: 78054 - DNA, 25 bp, Homo sapien
aagccacaccacgatacagtcagca

SEQ ID NO: 78055 - DNA, 25 bp, Homo sapien
agccacaccacgatacagtcagcaa

SEQ ID NO: 78056 - DNA, 25 bp, Homo sapien
gccacaccacgatacagtcagcaag

SEQ ID NO: 78057 - DNA, 25 bp, Homo sapien
ttaggaaccccaccccttatgcctg

SEQ ID NO: 78058 - DNA, 25 bp, Homo sapien
aggaaccccaccccttatgcctgtg

SEQ ID NO: 78059 - DNA, 25 bp, Homo sapien
ctcgctctggccaaatgccttcaaa

SEQ ID NO: 78060 - DNA, 25 bp, Homo sapien
tcgctctggccaaatgccttcaaaa

SEQ ID NO: 78061 - DNA, 25 bp, Homo sapien
cgctctggccaaatgccttcaaaaa

SEQ ID NO: 78062 - DNA, 25 bp, Homo sapien
attcacaaattatgggagcagtttt

SEQ ID NO: 78063 - DNA, 25 bp, Homo sapien
aagtcttctttggttcagaacacag

SEQ ID NO: 78064 - DNA, 25 bp, Homo sapien
ggttcagaacacaggtttttgccta

SEQ ID NO: 78065 - DNA, 25 bp, Homo sapien
gtttttgcctaacccctggcatgat

SEQ ID NO: 78066 - DNA, 25 bp, Homo sapien
ggcatgattgcccataagaacatac

SEQ ID NO: 78067 - DNA, 25 bp, Homo sapien
gaacatacatgtacagttgaactgg

SEQ ID NO: 78068 - DNA, 25 bp, Homo sapien
gaactggtggttagctatacgggaa

SEQ ID NO: 78069 - DNA, 25 bp, Homo sapien
aaatggtaagtagtgttgtcttcag

SEQ ID NO: 78070 - DNA, 25 bp, Homo sapien
gttgtcttcagtatcttaatttgtt

SEQ ID NO: 78071 - DNA, 25 bp, Homo sapien
actgtgcactcctcccttggtggca

SEQ ID NO: 78072 - DNA, 25 bp, Homo sapien
gcaccctatgggtgtaggaaaacca

SEQ ID NO: 78073 - DNA, 25 bp, Homo sapien
gggccgcagcatgcctatggttccg

SEQ ID NO: 78074 - DNA, 25 bp, Homo sapien
agcatgcctatggttccgcttccgg

SEQ ID NO: 78075 - DNA, 25 bp, Homo sapien
tatggttccgcttccggccgggagc

SEQ ID NO: 78076 - DNA, 25 bp, Homo sapien
ggccgggagccctgaacacgggtgt

SEQ ID NO: 78077 - DNA, 25 bp, Homo sapien
ccctgaacacgggtgtgcagactca

SEQ ID NO: 78078 - DNA, 25 bp, Homo sapien
aacacgggtgtgcagactcacccta

SEQ ID NO: 78079 - DNA, 25 bp, Homo sapien
acgggtgtgcagactcaccctaaag

SEQ ID NO: 78080 - DNA, 25 bp, Homo sapien
gtgtgcagactcaccctaaagggcg

SEQ ID NO: 78081 - DNA, 25 bp, Homo sapien
tgtgcagactcaccctaaagggcgg

SEQ ID NO: 78082 - DNA, 25 bp, Homo sapien
acgctagaaggctggcgagaccgaa

SEQ ID NO: 78083 - DNA, 25 bp, Homo sapien
aaggctggcgagaccgaaggcagca

SEQ ID NO: 78084 - DNA, 25 bp, Homo sapien
gtgtcttccagctctaatcagaaag

SEQ ID NO: 78085 - DNA, 25 bp, Homo sapien
tctaatcagaaagctgcttgtcgag

SEQ ID NO: 78086 - DNA, 25 bp, Homo sapien
tctgcactgtggcaaaactgttatt

SEQ ID NO: 78087 - DNA, 25 bp, Homo sapien
gcactgtggcaaaactgttattttt

SEQ ID NO: 78088 - DNA, 25 bp, Homo sapien
tggattttactaaatggcgttacct

SEQ ID NO: 78089 - DNA, 25 bp, Homo sapien
tactaaatggcgttaccttttcaag

SEQ ID NO: 78090 - DNA, 25 bp, Homo sapien
taaatggcgttaccttttcaagatt

SEQ ID NO: 78091 - DNA, 25 bp, Homo sapien
ggcgttaccttttcaagatttatat

SEQ ID NO: 78092 - DNA, 25 bp, Homo sapien
agaaaattgagccattaaagccttg

SEQ ID NO: 78093 - DNA, 25 bp, Homo sapien
tgttgcccagactgttcggaaactc

SEQ ID NO: 78094 - DNA, 25 bp, Homo sapien
agactgttcggaaactcctgggctc

SEQ ID NO: 78095 - DNA, 25 bp, Homo sapien
gccaaagcagacattttcctcacac

SEQ ID NO: 78096 - DNA, 25 bp, Homo sapien
aaagcagacattttcctcacaccca

SEQ ID NO: 78097 - DNA, 25 bp, Homo sapien
acctgctgctgtatgaatagctgtg

SEQ ID NO: 78098 - DNA, 25 bp, Homo sapien
ccacctgttgtcctgaactgtgagt

SEQ ID NO: 78099 - DNA, 25 bp, Homo sapien
tgtcctgaactgtgagtcctgatcc

SEQ ID NO: 78100 - DNA, 25 bp, Homo sapien
tgaactgtgagtcctgatcctaacc

SEQ ID NO: 78101 - DNA, 25 bp, Homo sapien
tgagtcctgatcctaaccctgggct

SEQ ID NO: 78102 - DNA, 25 bp, Homo sapien
ggactctagaagctcaggttccctg

SEQ ID NO: 78103 - DNA, 25 bp, Homo sapien
aggttccctgccacactatttgagt

SEQ ID NO: 78104 - DNA, 25 bp, Homo sapien
ccacactatttgagttggccaagaa

SEQ ID NO: 78105 - DNA, 25 bp, Homo sapien
gagttggccaagaaataaattcaca

SEQ ID NO: 78106 - DNA, 25 bp, Homo sapien
cttgaggagggactcggctgagctc

SEQ ID NO: 78107 - DNA, 25 bp, Homo sapien
tcctgcacccagtgtttctgtcagt

SEQ ID NO: 78108 - DNA, 25 bp, Homo sapien
gcacccagtgtttctgtcagtcttt

SEQ ID NO: 78109 - DNA, 25 bp, Homo sapien
gatgataccggggactctccagagc

SEQ ID NO: 78110 - DNA, 25 bp, Homo sapien
tccagagccatgactagatccaatg

SEQ ID NO: 78111 - DNA, 25 bp, Homo sapien
gagccatgactagatccaatggatt

SEQ ID NO: 78112 - DNA, 25 bp, Homo sapien
atccaatggattctgcgatgctgtc

SEQ ID NO: 78113 - DNA, 25 bp, Homo sapien
atggattctgcgatgctgtctggac

SEQ ID NO: 78114 - DNA, 25 bp, Homo sapien
attctgcgatgctgtctggactttg

SEQ ID NO: 78115 - DNA, 25 bp, Homo sapien
gatgctgtctggactttgctgtctc

SEQ ID NO: 78116 - DNA, 25 bp, Homo sapien
gctgtctggactttgctgtctctga

SEQ ID NO: 78117 - DNA, 25 bp, Homo sapien
tgtgcagcctgcagatgtgaaggaa

SEQ ID NO: 78118 - DNA, 25 bp, Homo sapien
aagttgttgagaagggtgtacagac

SEQ ID NO: 78119 - DNA, 25 bp, Homo sapien
agttgttgagaagggtgtacagact

SEQ ID NO: 78120 - DNA, 25 bp, Homo sapien
ttgttgagaagggtgtacagactct

SEQ ID NO: 78121 - DNA, 25 bp, Homo sapien
tgttgagaagggtgtacagactctt

SEQ ID NO: 78122 - DNA, 25 bp, Homo sapien
gttgagaagggtgtacagactcttg

SEQ ID NO: 78123 - DNA, 25 bp, Homo sapien
ttgagaagggtgtacagactcttgt

SEQ ID NO: 78124 - DNA, 25 bp, Homo sapien
ttgtgattggccgagggatgagtga

SEQ ID NO: 78125 - DNA, 25 bp, Homo sapien
tgtgattggccgagggatgagtgag

SEQ ID NO: 78126 - DNA, 25 bp, Homo sapien
gtgattggccgagggatgagtgagg

SEQ ID NO: 78127 - DNA, 25 bp, Homo sapien
tgattggccgagggatgagtgaggc

SEQ ID NO: 78128 - DNA, 25 bp, Homo sapien
gacgaggtgcgcaacctgcgcaaga

SEQ ID NO: 78129 - DNA, 25 bp, Homo sapien
ttctccacgcgcttcatcacgcggc

SEQ ID NO: 78130 - DNA, 25 bp, Homo sapien
tcccagcaaccagggcccgcgggtg

SEQ ID NO: 78131 - DNA, 25 bp, Homo sapien
tggactctcctcagttctgtgtcgt

SEQ ID NO: 78132 - DNA, 25 bp, Homo sapien
gactctcctcagttctgtgtcgtgt

SEQ ID NO: 78133 - DNA, 25 bp, Homo sapien
actctcctcagttctgtgtcgtgtt

SEQ ID NO: 78134 - DNA, 25 bp, Homo sapien
tctcctcagttctgtgtcgtgttcg

SEQ ID NO: 78135 - DNA, 25 bp, Homo sapien
tcttggtgtctcgtggcacgcgtca

SEQ ID NO: 78136 - DNA, 25 bp, Homo sapien
ttggtgtctcgtggcacgcgtcaca

SEQ ID NO: 78137 - DNA, 25 bp, Homo sapien
gtgtctcgtggcacgcgtcacagtg

SEQ ID NO: 78138 - DNA, 25 bp, Homo sapien
gtctcgtggcacgcgtcacagtggt

SEQ ID NO: 78139 - DNA, 25 bp, Homo sapien
ggcagggcagaaatggactcctttt

SEQ ID NO: 78140 - DNA, 25 bp, Homo sapien
gcagaaatggactccttttgggtcc

SEQ ID NO: 78141 - DNA, 25 bp, Homo sapien
gccttgacccacaggacgtgtggtg

SEQ ID NO: 78142 - DNA, 25 bp, Homo sapien
acccacaggacgtgtggtggcgcct

SEQ ID NO: 78143 - DNA, 25 bp, Homo sapien
agccctggtctctggcgcatctctt

SEQ ID NO: 78144 - DNA, 25 bp, Homo sapien
atctcttccctcttgtcccgaagat

SEQ ID NO: 78145 - DNA, 25 bp, Homo sapien
ttgtcccgaagatctgcgcctctag

SEQ ID NO: 78146 - DNA, 25 bp, Homo sapien
aagatctgcgcctctagtgcctttt

SEQ ID NO: 78147 - DNA, 25 bp, Homo sapien
ctgcgcctctagtgccttttgaggg

SEQ ID NO: 78148 - DNA, 25 bp, Homo sapien
atcatccctccctgatattgtattg

SEQ ID NO: 78149 - DNA, 25 bp, Homo sapien
aatattatgcacactgttcatgctt

SEQ ID NO: 78150 - DNA, 25 bp, Homo sapien
gttgctccagggatggatgcactga

SEQ ID NO: 78151 - DNA, 25 bp, Homo sapien
gatgcactgaaaggcctgactttac

SEQ ID NO: 78152 - DNA, 25 bp, Homo sapien
cctgactttacaaggcaatatatca

SEQ ID NO: 78153 - DNA, 25 bp, Homo sapien
gtagtaaaattgcactggtactcca

SEQ ID NO: 78154 - DNA, 25 bp, Homo sapien
gtaaaattgcactggtactccatga

SEQ ID NO: 78155 - DNA, 25 bp, Homo sapien
aaaattgcactggtactccatgaat

SEQ ID NO: 78156 - DNA, 25 bp, Homo sapien
attgcactggtactccatgaatata

SEQ ID NO: 78157 - DNA, 25 bp, Homo sapien
gcactggtactccatgaatatatat

SEQ ID NO: 78158 - DNA, 25 bp, Homo sapien
ccagcctaatcactccagcaatggg

SEQ ID NO: 78159 - DNA, 25 bp, Homo sapien
gtatatatgtggacagtgaagactc

SEQ ID NO: 78160 - DNA, 25 bp, Homo sapien
tatgtggacagtgaagactcatggg

SEQ ID NO: 78161 - DNA, 25 bp, Homo sapien
catcatccctccctgatattgtatt

SEQ ID NO: 78162 - DNA, 25 bp, Homo sapien
atcatccctccctgatattgtattg

SEQ ID NO: 78163 - DNA, 25 bp, Homo sapien
tcatccctccctgatattgtattga

SEQ ID NO: 78164 - DNA, 25 bp, Homo sapien
catccctccctgatattgtattgaa

SEQ ID NO: 78165 - DNA, 25 bp, Homo sapien
atccctccctgatattgtattgaaa

SEQ ID NO: 78166 - DNA, 25 bp, Homo sapien
tccctccctgatattgtattgaaaa

SEQ ID NO: 78167 - DNA, 25 bp, Homo sapien
ccctccctgatattgtattgaaaat

SEQ ID NO: 78168 - DNA, 25 bp, Homo sapien
cctccctgatattgtattgaaaata

SEQ ID NO: 78169 - DNA, 25 bp, Homo sapien
ctccctgatattgtattgaaaatat

SEQ ID NO: 78170 - DNA, 25 bp, Homo sapien
tccctgatattgtattgaaaatatt

SEQ ID NO: 78171 - DNA, 25 bp, Homo sapien
ttgtattgaaaatattatgcacact

SEQ ID NO: 78172 - DNA, 25 bp, Homo sapien
catgtttccagcattcccaggtagg

SEQ ID NO: 78173 - DNA, 25 bp, Homo sapien
atgtttccagcattcccaggtaggc

SEQ ID NO: 78174 - DNA, 25 bp, Homo sapien
tgtttccagcattcccaggtaggcc

SEQ ID NO: 78175 - DNA, 25 bp, Homo sapien
gtttccagcattcccaggtaggcca

SEQ ID NO: 78176 - DNA, 25 bp, Homo sapien
ttccagcattcccaggtaggccaag

SEQ ID NO: 78177 - DNA, 25 bp, Homo sapien
ccaggtaggccaaggtgtcctacag

SEQ ID NO: 78178 - DNA, 25 bp, Homo sapien
caggtaggccaaggtgtcctacaga

SEQ ID NO: 78179 - DNA, 25 bp, Homo sapien
aggtaggccaaggtgtcctacagaa

SEQ ID NO: 78180 - DNA, 25 bp, Homo sapien
ggtaggccaaggtgtcctacagaaa

SEQ ID NO: 78181 - DNA, 25 bp, Homo sapien
taggccaaggtgtcctacagaaaaa

SEQ ID NO: 78182 - DNA, 25 bp, Homo sapien
gggtctggctggtgttaacagaagg

SEQ ID NO: 78183 - DNA, 25 bp, Homo sapien
acacagttcatcattgcttgcttgc

SEQ ID NO: 78184 - DNA, 25 bp, Homo sapien
tttttgtaccattaataagttatct

SEQ ID NO: 78185 - DNA, 25 bp, Homo sapien
ccttttaacaatatgcactgaataa

SEQ ID NO: 78186 - DNA, 25 bp, Homo sapien
aattcatctttgtgccaattcgtaa

SEQ ID NO: 78187 - DNA, 25 bp, Homo sapien
tgtgccaattcgtaaatattttgat

SEQ ID NO: 78188 - DNA, 25 bp, Homo sapien
ttgatataacaaagacttctgtcat

SEQ ID NO: 78189 - DNA, 25 bp, Homo sapien
gacttctgtcataaatagatttcct

SEQ ID NO: 78190 - DNA, 25 bp, Homo sapien
cttctgtcataaatagatttcctgt

SEQ ID NO: 78191 - DNA, 25 bp, Homo sapien
gatttcctgtgagtaatcttgcaaa

SEQ ID NO: 78192 - DNA, 25 bp, Homo sapien
tttcctgtgagtaatcttgcaaata

SEQ ID NO: 78193 - DNA, 25 bp, Homo sapien
cctgtgagtaatcttgcaaatattt

SEQ ID NO: 78194 - DNA, 25 bp, Homo sapien
actttagtatgacgctgatacataa

SEQ ID NO: 78195 - DNA, 25 bp, Homo sapien
gtatgacgctgatacataactaaat

SEQ ID NO: 78196 - DNA, 25 bp, Homo sapien
gacgctgatacataactaaatttga

SEQ ID NO: 78197 - DNA, 25 bp, Homo sapien
gagtagatattactttatcactttt

SEQ ID NO: 78198 - DNA, 25 bp, Homo sapien
gatattactttatcactttttgaac

SEQ ID NO: 78199 - DNA, 25 bp, Homo sapien
tactttatcactttttgaactaaga

SEQ ID NO: 78200 - DNA, 25 bp, Homo sapien
atatatgcctttttcctagcctgtt

SEQ ID NO: 78201 - DNA, 25 bp, Homo sapien
tatttgttcatgtttggtgcataga

SEQ ID NO: 78202 - DNA, 25 bp, Homo sapien
ttcatgtttggtgcatagaactggg

SEQ ID NO: 78203 - DNA, 25 bp, Homo sapien
aaatgtatatatttagtgctgcatc

SEQ ID NO: 78204 - DNA, 25 bp, Homo sapien
tgtatatatttagtgctgcatctta

SEQ ID NO: 78205 - DNA, 25 bp, Homo sapien
gatgcttattatgacctggaccaag

SEQ ID NO: 78206 - DNA, 25 bp, Homo sapien
tgacctggaccaagaagacccagat

SEQ ID NO: 78207 - DNA, 25 bp, Homo sapien
gacgacctggatatttgactggcca

SEQ ID NO: 78208 - DNA, 25 bp, Homo sapien
gggaagactttgggcccagaaccat

SEQ ID NO: 78209 - DNA, 25 bp, Homo sapien
cagaaccatctttctattgtttgtg

SEQ ID NO: 78210 - DNA, 25 bp, Homo sapien
attgtttgtgttagccttaccctgt

SEQ ID NO: 78211 - DNA, 25 bp, Homo sapien
accttggttccccttgtctatggag

SEQ ID NO: 78212 - DNA, 25 bp, Homo sapien
ggagccccgccttgtgagccaggaa

SEQ ID NO: 78213 - DNA, 25 bp, Homo sapien
gagccaggaagcagcgtctcatcag

SEQ ID NO: 78214 - DNA, 25 bp, Homo sapien
gcagcgtctcatcaggacagaaggt

SEQ ID NO: 78215 - DNA, 25 bp, Homo sapien
tgagagagtagaacacccccgtacc

SEQ ID NO: 78216 - DNA, 25 bp, Homo sapien
gctggcctagaccagctgctgaaag

SEQ ID NO: 78217 - DNA, 25 bp, Homo sapien
ctgctgaaagctggtgaggctgagc

SEQ ID NO: 78218 - DNA, 25 bp, Homo sapien
ccaacccaagctctgcggaaatcaa

SEQ ID NO: 78219 - DNA, 25 bp, Homo sapien
aagctctgcggaaatcaacagcccc

SEQ ID NO: 78220 - DNA, 25 bp, Homo sapien
aacagccccagagccacttggaggg

SEQ ID NO: 78221 - DNA, 25 bp, Homo sapien
ttcaaggctatgacagtctgctacg

SEQ ID NO: 78222 - DNA, 25 bp, Homo sapien
ggctatgacagtctgctacgcaaaa

SEQ ID NO: 78223 - DNA, 25 bp, Homo sapien
gacagtctgctacgcaaaacatttt

SEQ ID NO: 78224 - DNA, 25 bp, Homo sapien
gtctgctacgcaaaacattttttca

SEQ ID NO: 78225 - DNA, 25 bp, Homo sapien
agccctgtgataccacagactgtgc

SEQ ID NO: 78226 - DNA, 25 bp, Homo sapien
agactgtgctgaggtcttgccacca

SEQ ID NO: 78227 - DNA, 25 bp, Homo sapien
ggtcgtgcgtctgaagcctacaaga

SEQ ID NO: 78228 - DNA, 25 bp, Homo sapien
aagagaaagccaagatccactaccg

SEQ ID NO: 78229 - DNA, 25 bp, Homo sapien
gagaaagccaagatccactaccgga

SEQ ID NO: 78230 - DNA, 25 bp, Homo sapien
gaaagccaagatccactaccggaag

SEQ ID NO: 78231 - DNA, 25 bp, Homo sapien
aagccaagatccactaccggaagaa

SEQ ID NO: 78232 - DNA, 25 bp, Homo sapien
ccaagatccactaccggaagaagaa

SEQ ID NO: 78233 - DNA, 25 bp, Homo sapien
caagatccactaccggaagaagaaa

SEQ ID NO: 78234 - DNA, 25 bp, Homo sapien
gatccactaccggaagaagaaacag

SEQ ID NO: 78235 - DNA, 25 bp, Homo sapien
cactaccggaagaagaaacagctca

SEQ ID NO: 78236 - DNA, 25 bp, Homo sapien
agaaacagctcatgaggctacggaa

SEQ ID NO: 78237 - DNA, 25 bp, Homo sapien
ggactcctggtctgagcccaataaa

SEQ ID NO: 78238 - DNA, 25 bp, Homo sapien
gggtacagtggaacgaggctctttt

SEQ ID NO: 78239 - DNA, 25 bp, Homo sapien
gaacctcgagttccttttagacagt

SEQ ID NO: 78240 - DNA, 25 bp, Homo sapien
acagttccagatgaatgaccaagac

SEQ ID NO: 78241 - DNA, 25 bp, Homo sapien
atgtaccagcgattctaaggacccc

SEQ ID NO: 78242 - DNA, 25 bp, Homo sapien
gcccggctcagcctgtccgaaaagg

SEQ ID NO: 78243 - DNA, 25 bp, Homo sapien
gggcttcacagttcatgggaaatgt

SEQ ID NO: 78244 - DNA, 25 bp, Homo sapien
gggaaatgtataccacccacctaca

SEQ ID NO: 78245 - DNA, 25 bp, Homo sapien
ctacataccatgacatgcttcctgc

SEQ ID NO: 78246 - DNA, 25 bp, Homo sapien
ttcctgcttttatgtgttcgccgaa

SEQ ID NO: 78247 - DNA, 25 bp, Homo sapien
tgtgttcgccgaagtcatcagaaaa

SEQ ID NO: 78248 - DNA, 25 bp, Homo sapien
aagtcatcagaaaaccagggtacag

SEQ ID NO: 78249 - DNA, 25 bp, Homo sapien
gactttggagattaagaacttattt

SEQ ID NO: 78250 - DNA, 25 bp, Homo sapien
gaaaccgggaatgagttctattctt

SEQ ID NO: 78251 - DNA, 25 bp, Homo sapien
ttaatgttggatatacggcgaggta

SEQ ID NO: 78252 - DNA, 25 bp, Homo sapien
tacggcgaggtagagttggccatat

SEQ ID NO: 78253 - DNA, 25 bp, Homo sapien
gagttggccatatttcagagactta

SEQ ID NO: 78254 - DNA, 25 bp, Homo sapien
tggccatatttcagagacttagatt

SEQ ID NO: 78255 - DNA, 25 bp, Homo sapien
cagagacttagattgacgtatatgt

SEQ ID NO: 78256 - DNA, 25 bp, Homo sapien
gattgacgtatatgtttctgcatta

SEQ ID NO: 78257 - DNA, 25 bp, Homo sapien
caagtttgtgtatcagagcgggagt

SEQ ID NO: 78258 - DNA, 25 bp, Homo sapien
gaattgaataggcaagtgactgttt

SEQ ID NO: 78259 - DNA, 25 bp, Homo sapien
aggcaagtgactgttttaaagatta

SEQ ID NO: 78260 - DNA, 25 bp, Homo sapien
gagcgtgaacaacgcatgcggaatc

SEQ ID NO: 78261 - DNA, 25 bp, Homo sapien
aacgcatgcggaatcagttggagct

SEQ ID NO: 78262 - DNA, 25 bp, Homo sapien
gaatcagttggagctagcagccagg

SEQ ID NO: 78263 - DNA, 25 bp, Homo sapien
gcagccaggggtcctttacgacaga

SEQ ID NO: 78264 - DNA, 25 bp, Homo sapien
ccctctcctacaacctggaaaggat

SEQ ID NO: 78265 - DNA, 25 bp, Homo sapien
gctgacttatgttctgtgcgcattc

SEQ ID NO: 78266 - DNA, 25 bp, Homo sapien
atgttctgtgcgcattctggcagga

SEQ ID NO: 78267 - DNA, 25 bp, Homo sapien
ctgtgcgcattctggcaggaattct

SEQ ID NO: 78268 - DNA, 25 bp, Homo sapien
tctggcaggaattctgtctcttcag

SEQ ID NO: 78269 - DNA, 25 bp, Homo sapien
gaattctgtctcttcagagactcat

SEQ ID NO: 78270 - DNA, 25 bp, Homo sapien
tggcacacagagatgttcattttaa

SEQ ID NO: 78271 - DNA, 25 bp, Homo sapien
gccttcttaaggaaaccatttgata

SEQ ID NO: 78272 - DNA, 25 bp, Homo sapien
agatgaaccaaataactcaatgatg

SEQ ID NO: 78273 - DNA, 25 bp, Homo sapien
aatgatggatgagctggtagaaaaa

SEQ ID NO: 78274 - DNA, 25 bp, Homo sapien
aaagctggtggtgaaccaaggtcaa

SEQ ID NO: 78275 - DNA, 25 bp, Homo sapien
ggtgaaccaaggtcaaactggaaat

SEQ ID NO: 78276 - DNA, 25 bp, Homo sapien
gtcaaactggaaattatagtcacag

SEQ ID NO: 78277 - DNA, 25 bp, Homo sapien
aaatattacaaaccctaagatagct

SEQ ID NO: 78278 - DNA, 25 bp, Homo sapien
ggatataagagcactaatgccctct

SEQ ID NO: 78279 - DNA, 25 bp, Homo sapien
gcactaatgccctcttattttcata

SEQ ID NO: 78280 - DNA, 25 bp, Homo sapien
tattttcatagcagagacttgatac

SEQ ID NO: 78281 - DNA, 25 bp, Homo sapien
gacttgatactgtctcaactttttt

SEQ ID NO: 78282 - DNA, 25 bp, Homo sapien
aggacaatttcttgtttggccattt

SEQ ID NO: 78283 - DNA, 25 bp, Homo sapien
aggttggtaacattagaggctgtga

SEQ ID NO: 78284 - DNA, 25 bp, Homo sapien
tagaggctgtgagcttgtgttacat

SEQ ID NO: 78285 - DNA, 25 bp, Homo sapien
aggctgtgagcttgtgttacatggt

SEQ ID NO: 78286 - DNA, 25 bp, Homo sapien
gctgtgagcttgtgttacatggtaa

SEQ ID NO: 78287 - DNA, 25 bp, Homo sapien
tagaccccaagaggctcatgtgact

SEQ ID NO: 78288 - DNA, 25 bp, Homo sapien
ggctcatgtgactaagaggatctgt

SEQ ID NO: 78289 - DNA, 25 bp, Homo sapien
gtgactaagaggatctgtccacatt

SEQ ID NO: 78290 - DNA, 25 bp, Homo sapien
ctaagaggatctgtccacatttggg

SEQ ID NO: 78291 - DNA, 25 bp, Homo sapien
ggatctgtccacatttggggcctat

SEQ ID NO: 78292 - DNA, 25 bp, Homo sapien
tggggcctatccttacttgtttgaa

SEQ ID NO: 78293 - DNA, 25 bp, Homo sapien
tcttcggaggctgagtttgcccaac

SEQ ID NO: 78294 - DNA, 25 bp, Homo sapien
cttcggaggctgagtttgcccaact

SEQ ID NO: 78295 - DNA, 25 bp, Homo sapien
ttcggaggctgagtttgcccaactc

SEQ ID NO: 78296 - DNA, 25 bp, Homo sapien
tcggaggctgagtttgcccaactca

SEQ ID NO: 78297 - DNA, 25 bp, Homo sapien
cggaggctgagtttgcccaactcag

SEQ ID NO: 78298 - DNA, 25 bp, Homo sapien
ggaggctgagtttgcccaactcagg

SEQ ID NO: 78299 - DNA, 25 bp, Homo sapien
gaggctgagtttgcccaactcaggt

SEQ ID NO: 78300 - DNA, 25 bp, Homo sapien
gctgagtttgcccaactcaggttta

SEQ ID NO: 78301 - DNA, 25 bp, Homo sapien
ctgagtttgcccaactcaggtttaa

SEQ ID NO: 78302 - DNA, 25 bp, Homo sapien
tgagtttgcccaactcaggtttaac

SEQ ID NO: 78303 - DNA, 25 bp, Homo sapien
ttgcccaactcaggtttaaccacca

SEQ ID NO: 78304 - DNA, 25 bp, Homo sapien
ctcactccatctccacccaaagtct

SEQ ID NO: 78305 - DNA, 25 bp, Homo sapien
tcactccatctccacccaaagtcta

SEQ ID NO: 78306 - DNA, 25 bp, Homo sapien
cactccatctccacccaaagtctac

SEQ ID NO: 78307 - DNA, 25 bp, Homo sapien
actccatctccacccaaagtctaca

SEQ ID NO: 78308 - DNA, 25 bp, Homo sapien
ctccatctccacccaaagtctacaa

SEQ ID NO: 78309 - DNA, 25 bp, Homo sapien
tccatctccacccaaagtctacaat

SEQ ID NO: 78310 - DNA, 25 bp, Homo sapien
ccatctccacccaaagtctacaata

SEQ ID NO: 78311 - DNA, 25 bp, Homo sapien
catctccacccaaagtctacaataa

SEQ ID NO: 78312 - DNA, 25 bp, Homo sapien
gcccattgatgtaaactgtccctag

SEQ ID NO: 78313 - DNA, 25 bp, Homo sapien
taaactgtccctaggtcacgtgtat

SEQ ID NO: 78314 - DNA, 25 bp, Homo sapien
ggtcacgtgtatcttgaggtctaaa

SEQ ID NO: 78315 - DNA, 25 bp, Homo sapien
taaattgaaattcccatagccaatt

SEQ ID NO: 78316 - DNA, 25 bp, Homo sapien
gaaattgcatcaagcgtccgaacat

SEQ ID NO: 78317 - DNA, 25 bp, Homo sapien
aagcgtccgaacatgctgcttacaa

SEQ ID NO: 78318 - DNA, 25 bp, Homo sapien
gaacatgctgcttacaactttagaa

SEQ ID NO: 78319 - DNA, 25 bp, Homo sapien
acgcaaaatgcgttgttgtgggagt

SEQ ID NO: 78320 - DNA, 25 bp, Homo sapien
tgtgtaatttttagtaggtgctcaa

SEQ ID NO: 78321 - DNA, 25 bp, Homo sapien
tgctgaacttggtgtctatttttaa

SEQ ID NO: 78322 - DNA, 25 bp, Homo sapien
tatttttaagtcttgcccattgatg

SEQ ID NO: 78323 - DNA, 25 bp, Homo sapien
accccaccactgtactctgaaattg

SEQ ID NO: 78324 - DNA, 25 bp, Homo sapien
accactgtactctgaaattggcgag

SEQ ID NO: 78325 - DNA, 25 bp, Homo sapien
tgtgcctgccgttcatggtggtctt

SEQ ID NO: 78326 - DNA, 25 bp, Homo sapien
tgccgttcatggtggtctttcaggt

SEQ ID NO: 78327 - DNA, 25 bp, Homo sapien
cgttcatggtggtctttcaggttat

SEQ ID NO: 78328 - DNA, 25 bp, Homo sapien
tcatggtggtctttcaggttatctt

SEQ ID NO: 78329 - DNA, 25 bp, Homo sapien
gtggtctttcaggttatcttggcaa

SEQ ID NO: 78330 - DNA, 25 bp, Homo sapien
gtctttcaggttatcttggcaacat

SEQ ID NO: 78331 - DNA, 25 bp, Homo sapien
tcaggttatcttggcaacatgtaca

SEQ ID NO: 78332 - DNA, 25 bp, Homo sapien
ttctcttttgagttttatacctttg

SEQ ID NO: 78333 - DNA, 25 bp, Homo sapien
atgacattgtgtttgtactttgttg

SEQ ID NO: 78334 - DNA, 25 bp, Homo sapien
ctgaggccatcttgctggcagtcta

SEQ ID NO: 78335 - DNA, 25 bp, Homo sapien
tgaggccatcttgctggcagtctac

SEQ ID NO: 78336 - DNA, 25 bp, Homo sapien
aggccatcttgctggcagtctacct

SEQ ID NO: 78337 - DNA, 25 bp, Homo sapien
catcttgctggcagtctaccttgaa

SEQ ID NO: 78338 - DNA, 25 bp, Homo sapien
tcttgctggcagtctaccttgaact

SEQ ID NO: 78339 - DNA, 25 bp, Homo sapien
gatcatcaaaaggaatcagctgctc

SEQ ID NO: 78340 - DNA, 25 bp, Homo sapien
catcaaaaggaatcagctgctccct

SEQ ID NO: 78341 - DNA, 25 bp, Homo sapien
agaagccagtgtttcagcctgtcca

SEQ ID NO: 78342 - DNA, 25 bp, Homo sapien
gaagccagtgtttcagcctgtccac

SEQ ID NO: 78343 - DNA, 25 bp, Homo sapien
aagccagtgtttcagcctgtccacc

SEQ ID NO: 78344 - DNA, 25 bp, Homo sapien
agtgtttcagcctgtccacccgatc

SEQ ID NO: 78345 - DNA, 25 bp, Homo sapien
tacaataaaactcaggtcaccttcg

SEQ ID NO: 78346 - DNA, 25 bp, Homo sapien
ctcaggtcaccttcgaattaattaa

SEQ ID NO: 78347 - DNA, 25 bp, Homo sapien
gacttaattacccaaggtttggcat

SEQ ID NO: 78348 - DNA, 25 bp, Homo sapien
cccaaggtttggcatgtaaagatct

SEQ ID NO: 78349 - DNA, 25 bp, Homo sapien
taaagatcttaagagggtgcagaac

SEQ ID NO: 78350 - DNA, 25 bp, Homo sapien
gagggtgcagaacgaaccactcgaa

SEQ ID NO: 78351 - DNA, 25 bp, Homo sapien
gcagaacgaaccactcgaaaacgag

SEQ ID NO: 78352 - DNA, 25 bp, Homo sapien
ctcgaaaacgagtagcagtgtaatg

SEQ ID NO: 78353 - DNA, 25 bp, Homo sapien
gtagcagtgtaatgaaggcttcttt

SEQ ID NO: 78354 - DNA, 25 bp, Homo sapien
caataacaaatgcttcatcaatctg

SEQ ID NO: 78355 - DNA, 25 bp, Homo sapien
ttcatcaatctgagtgtggaaggtg

SEQ ID NO: 78356 - DNA, 25 bp, Homo sapien
ggcagaggctgtataaaacgcactt

SEQ ID NO: 78357 - DNA, 25 bp, Homo sapien
taaaacgcacttgttttcatgcagg

SEQ ID NO: 78358 - DNA, 25 bp, Homo sapien
gttgagcctgactgtaaacctagaa

SEQ ID NO: 78359 - DNA, 25 bp, Homo sapien
tgactgtaaacctagaactgcggaa

SEQ ID NO: 78360 - DNA, 25 bp, Homo sapien
gaactgcggaaggactgggactttt

SEQ ID NO: 78361 - DNA, 25 bp, Homo sapien
tcacatttattttacagcaatcatg

SEQ ID NO: 78362 - DNA, 25 bp, Homo sapien
atcatgctgcatttgtgttagtgtt

SEQ ID NO: 78363 - DNA, 25 bp, Homo sapien
ggctggctgtgttacaagtgactct

SEQ ID NO: 78364 - DNA, 25 bp, Homo sapien
aagtgactcttccttagacagctag

SEQ ID NO: 78365 - DNA, 25 bp, Homo sapien
gatgctgactttgtcaaacttgcat

SEQ ID NO: 78366 - DNA, 25 bp, Homo sapien
catttatatgaaaaccttctgtctc

SEQ ID NO: 78367 - DNA, 25 bp, Homo sapien
atgtgcatgttgtagtcctatgatg

SEQ ID NO: 78368 - DNA, 25 bp, Homo sapien
gtcctatgatgatgtaaacttggta

SEQ ID NO: 78369 - DNA, 25 bp, Homo sapien
gtaaacttggtactacataatgact

SEQ ID NO: 78370 - DNA, 25 bp, Homo sapien
actacataatgacttgctccacaca

SEQ ID NO: 78371 - DNA, 25 bp, Homo sapien
atgacttgctccacacatgcagtaa

SEQ ID NO: 78372 - DNA, 25 bp, Homo sapien
gctccacacatgcagtaaactacat

SEQ ID NO: 78373 - DNA, 25 bp, Homo sapien
aatgatgtactggtaaactagaaac

SEQ ID NO: 78374 - DNA, 25 bp, Homo sapien
gaatgcagcaggatctgtctagctt

SEQ ID NO: 78375 - DNA, 25 bp, Homo sapien
gcaggatctgtctagcttattaaag

SEQ ID NO: 78376 - DNA, 25 bp, Homo sapien
tgaattggaaaaatagctccatttt

SEQ ID NO: 78377 - DNA, 25 bp, Homo sapien
gaccaaaaaagttgtatggctgctt

SEQ ID NO: 78378 - DNA, 25 bp, Homo sapien
acctagaatattagaacatatgggc

SEQ ID NO: 78379 - DNA, 25 bp, Homo sapien
cctagaatattagaacatatgggcc

SEQ ID NO: 78380 - DNA, 25 bp, Homo sapien
ctagaatattagaacatatgggcca

SEQ ID NO: 78381 - DNA, 25 bp, Homo sapien
tagaatattagaacatatgggccag

SEQ ID NO: 78382 - DNA, 25 bp, Homo sapien
agaatattagaacatatgggccagg

SEQ ID NO: 78383 - DNA, 25 bp, Homo sapien
gaatattagaacatatgggccaggg

SEQ ID NO: 78384 - DNA, 25 bp, Homo sapien
atattagaacatatgggccaggggc

SEQ ID NO: 78385 - DNA, 25 bp, Homo sapien
tattagaacatatgggccaggggcg

SEQ ID NO: 78386 - DNA, 25 bp, Homo sapien
aacatatgggccaggggcggtcgct

SEQ ID NO: 78387 - DNA, 25 bp, Homo sapien
acatatgggccaggggcggtcgctc

SEQ ID NO: 78388 - DNA, 25 bp, Homo sapien
tatgggccaggggcggtcgctcacg

SEQ ID NO: 78389 - DNA, 25 bp, Homo sapien
gggctcatttaaaatttggaggctg

SEQ ID NO: 78390 - DNA, 25 bp, Homo sapien
ggctcatttaaaatttggaggctgg

SEQ ID NO: 78391 - DNA, 25 bp, Homo sapien
gctcatttaaaatttggaggctggg

SEQ ID NO: 78392 - DNA, 25 bp, Homo sapien
ctcatttaaaatttggaggctgggt

SEQ ID NO: 78393 - DNA, 25 bp, Homo sapien
tcatttaaaatttggaggctgggtg

SEQ ID NO: 78394 - DNA, 25 bp, Homo sapien
catttaaaatttggaggctgggtgc

SEQ ID NO: 78395 - DNA, 25 bp, Homo sapien
tttaaaatttggaggctgggtgctg

SEQ ID NO: 78396 - DNA, 25 bp, Homo sapien
ttaaaatttggaggctgggtgctgt

SEQ ID NO: 78397 - DNA, 25 bp, Homo sapien
taaaatttggaggctgggtgctgtg

SEQ ID NO: 78398 - DNA, 25 bp, Homo sapien
aaaatttggaggctgggtgctgtgg

SEQ ID NO: 78399 - DNA, 25 bp, Homo sapien
agaactgttcatccttcttcaagaa

SEQ ID NO: 78400 - DNA, 25 bp, Homo sapien
gaactgttcatccttcttcaagaag

SEQ ID NO: 78401 - DNA, 25 bp, Homo sapien
aactgttcatccttcttcaagaaga

SEQ ID NO: 78402 - DNA, 25 bp, Homo sapien
actgttcatccttcttcaagaagaa

SEQ ID NO: 78403 - DNA, 25 bp, Homo sapien
ctgttcatccttcttcaagaagaag

SEQ ID NO: 78404 - DNA, 25 bp, Homo sapien
ttcaagaagaagcttgccaggccgg

SEQ ID NO: 78405 - DNA, 25 bp, Homo sapien
tcaagaagaagcttgccaggccggg

SEQ ID NO: 78406 - DNA, 25 bp, Homo sapien
caagaagaagcttgccaggccgggc

SEQ ID NO: 78407 - DNA, 25 bp, Homo sapien
aagaagaagcttgccaggccgggca

SEQ ID NO: 78408 - DNA, 25 bp, Homo sapien
gaagaagcttgccaggccgggcacg

SEQ ID NO: 78409 - DNA, 25 bp, Homo sapien
aagaagcttgccaggccgggcacgg

SEQ ID NO: 78410 - DNA, 25 bp, Homo sapien
tggccaacgtcaggattcttacagg

SEQ ID NO: 78411 - DNA, 25 bp, Homo sapien
aacgtcaggattcttacaggttgaa

SEQ ID NO: 78412 - DNA, 25 bp, Homo sapien
acaggttgaatgttaagctcaccga

SEQ ID NO: 78413 - DNA, 25 bp, Homo sapien
gaatgttaagctcaccgatcttggc

SEQ ID NO: 78414 - DNA, 25 bp, Homo sapien
ttgcctgctcattttcacacgtgca

SEQ ID NO: 78415 - DNA, 25 bp, Homo sapien
ttttcacacgtgcagtggtgggtct

SEQ ID NO: 78416 - DNA, 25 bp, Homo sapien
cagtggtgggtctgtctcatagcac

SEQ ID NO: 78417 - DNA, 25 bp, Homo sapien
ctgtctcatagcacaggtgcagttt

SEQ ID NO: 78418 - DNA, 25 bp, Homo sapien
cacaggtgcagtttagtgcagccac

SEQ ID NO: 78419 - DNA, 25 bp, Homo sapien
ggcagtcccgttttgcagcgggatt

SEQ ID NO: 78420 - DNA, 25 bp, Homo sapien
tttgcagcgggatttggcaaacccc

SEQ ID NO: 78421 - DNA, 25 bp, Homo sapien
ctttccagccgtgttgtagctaatt

SEQ ID NO: 78422 - DNA, 25 bp, Homo sapien
tgaaaacctctttccaaaggctgtt

SEQ ID NO: 78423 - DNA, 25 bp, Homo sapien
gttttaacggcctgcatcattcttt

SEQ ID NO: 78424 - DNA, 25 bp, Homo sapien
attctttctgctatattaggcctgt

SEQ ID NO: 78425 - DNA, 25 bp, Homo sapien
ttaggcctgtgtgtaagctgactgg

SEQ ID NO: 78426 - DNA, 25 bp, Homo sapien
tggccccagggactcttgttaacag

SEQ ID NO: 78427 - DNA, 25 bp, Homo sapien
gccccagggactcttgttaacagta

SEQ ID NO: 78428 - DNA, 25 bp, Homo sapien
ccagggactcttgttaacagtaact

SEQ ID NO: 78429 - DNA, 25 bp, Homo sapien
gggactcttgttaacagtaacttag

SEQ ID NO: 78430 - DNA, 25 bp, Homo sapien
aacagtaacttaggagtcaggtctc

SEQ ID NO: 78431 - DNA, 25 bp, Homo sapien
gtgcagcccgccatggccgtgtaga

SEQ ID NO: 78432 - DNA, 25 bp, Homo sapien
gttttttttgtacgcaattctcgat

SEQ ID NO: 78433 - DNA, 25 bp, Homo sapien
tttgtacgcaattctcgattctttg

SEQ ID NO: 78434 - DNA, 25 bp, Homo sapien
ttgtacgcaattctcgattctttga

SEQ ID NO: 78435 - DNA, 25 bp, Homo sapien
tgtacgcaattctcgattctttgaa

SEQ ID NO: 78436 - DNA, 25 bp, Homo sapien
gtacgcaattctcgattctttgaag

SEQ ID NO: 78437 - DNA, 25 bp, Homo sapien
tacgcaattctcgattctttgaaga

SEQ ID NO: 78438 - DNA, 25 bp, Homo sapien
acgcaattctcgattctttgaagag

SEQ ID NO: 78439 - DNA, 25 bp, Homo sapien
cgcaattctcgattctttgaagaga

SEQ ID NO: 78440 - DNA, 25 bp, Homo sapien
tggtgtacctctcagtggcagaata

SEQ ID NO: 78441 - DNA, 25 bp, Homo sapien
agctcttcctgtcagggatcagggc

SEQ ID NO: 78442 - DNA, 25 bp, Homo sapien
atcagggcagcactaacaggcgcaa

SEQ ID NO: 78443 - DNA, 25 bp, Homo sapien
agctgtcaagatgggctagttttcc

SEQ ID NO: 78444 - DNA, 25 bp, Homo sapien
gctagttttccttgggttctgaaga

SEQ ID NO: 78445 - DNA, 25 bp, Homo sapien
aaaggcttggctccgctacttgtaa

SEQ ID NO: 78446 - DNA, 25 bp, Homo sapien
ttggctccgctacttgtaacaagct

SEQ ID NO: 78447 - DNA, 25 bp, Homo sapien
gtaacaagctccagcccttaaaatg

SEQ ID NO: 78448 - DNA, 25 bp, Homo sapien
cctgcttaggtgcacagctgttcaa

SEQ ID NO: 78449 - DNA, 25 bp, Homo sapien
ggtgcacagctgttcaatatacaca

SEQ ID NO: 78450 - DNA, 25 bp, Homo sapien
tactgtctttggaaaccctggtgta

SEQ ID NO: 78451 - DNA, 25 bp, Homo sapien
tggaccaaatccaagaccagtttaa

SEQ ID NO: 78452 - DNA, 25 bp, Homo sapien
agaccagtttaatgaccttgttatc

SEQ ID NO: 78453 - DNA, 25 bp, Homo sapien
tgttatcagtgatggctcttctctg

SEQ ID NO: 78454 - DNA, 25 bp, Homo sapien
cttctctggaagatcttgtggtcaa

SEQ ID NO: 78455 - DNA, 25 bp, Homo sapien
gtggtcaagagcaatctgaatccaa

SEQ ID NO: 78456 - DNA, 25 bp, Homo sapien
gggccctcttttggtggatgtagca

SEQ ID NO: 78457 - DNA, 25 bp, Homo sapien
ggatgtagcacaatttccacactgt

SEQ ID NO: 78458 - DNA, 25 bp, Homo sapien
agcacaatttccacactgtgaaggc

SEQ ID NO: 78459 - DNA, 25 bp, Homo sapien
aaaagctctcttgtcactgtgttac

SEQ ID NO: 78460 - DNA, 25 bp, Homo sapien
actgtgttacacttatgcattgcca

SEQ ID NO: 78461 - DNA, 25 bp, Homo sapien
gtttttgttagtcttgcatgcttaa

SEQ ID NO: 78462 - DNA, 25 bp, Homo sapien
tcagggccaccttgttttccatttt

SEQ ID NO: 78463 - DNA, 25 bp, Homo sapien
ttttccatttttgaacagcgctccc

SEQ ID NO: 78464 - DNA, 25 bp, Homo sapien
gaacagcgctccctgtggtttgtgc

SEQ ID NO: 78465 - DNA, 25 bp, Homo sapien
tggtttgtgcccactgctcaataca

SEQ ID NO: 78466 - DNA, 25 bp, Homo sapien
gatcctcactcttgaaagctccatg

SEQ ID NO: 78467 - DNA, 25 bp, Homo sapien
aagctccatgataagcacagagatg

SEQ ID NO: 78468 - DNA, 25 bp, Homo sapien
ggtgaatagatatcaaaacccctga

SEQ ID NO: 78469 - DNA, 25 bp, Homo sapien
aaacccctgatgtcattcttttgag

SEQ ID NO: 78470 - DNA, 25 bp, Homo sapien
tcagtacattcacatttctctcaca

SEQ ID NO: 78471 - DNA, 25 bp, Homo sapien
attcacatttctctcacatttgctg

SEQ ID NO: 78472 - DNA, 25 bp, Homo sapien
acatttctctcacatttgctgaatg

SEQ ID NO: 78473 - DNA, 25 bp, Homo sapien
tattctttaggtaatttcacttgga

SEQ ID NO: 78474 - DNA, 25 bp, Homo sapien
ctttaggtaatttcacttggacata

SEQ ID NO: 78475 - DNA, 25 bp, Homo sapien
ggtaatttcacttggacatattcat

SEQ ID NO: 78476 - DNA, 25 bp, Homo sapien
aatttcacttggacatattcatgta

SEQ ID NO: 78477 - DNA, 25 bp, Homo sapien
cacttggacatattcatgtatatgg

SEQ ID NO: 78478 - DNA, 25 bp, Homo sapien
gtcagctgactcaggcatttaccct

SEQ ID NO: 78479 - DNA, 25 bp, Homo sapien
agctgactcaggcatttaccctaaa

SEQ ID NO: 78480 - DNA, 25 bp, Homo sapien
ctgactcaggcatttaccctaaaga

SEQ ID NO: 78481 - DNA, 25 bp, Homo sapien
caggcatttaccctaaagatcaaat

SEQ ID NO: 78482 - DNA, 25 bp, Homo sapien
gcatttaccctaaagatcaaatctg

SEQ ID NO: 78483 - DNA, 25 bp, Homo sapien
taccctaaagatcaaatctgttttc

SEQ ID NO: 78484 - DNA, 25 bp, Homo sapien
gtatcactcagcctgtccttaaacg

SEQ ID NO: 78485 - DNA, 25 bp, Homo sapien
tatcactcagcctgtccttaaacgg

SEQ ID NO: 78486 - DNA, 25 bp, Homo sapien
cttaaacggcctcgccatgtgcatt

SEQ ID NO: 78487 - DNA, 25 bp, Homo sapien
aacggcctcgccatgtgcattgtca

SEQ ID NO: 78488 - DNA, 25 bp, Homo sapien
ggcctcgccatgtgcattgtcactt

SEQ ID NO: 78489 - DNA, 25 bp, Homo sapien
ctcgccatgtgcattgtcacttgtg

SEQ ID NO: 78490 - DNA, 25 bp, Homo sapien
gccatgtgcattgtcacttgtgctg

SEQ ID NO: 78491 - DNA, 25 bp, Homo sapien
catgtgcattgtcacttgtgctgtc

SEQ ID NO: 78492 - DNA, 25 bp, Homo sapien
tgtgcattgtcacttgtgctgtcca

SEQ ID NO: 78493 - DNA, 25 bp, Homo sapien
tgtgctgtccagatgggcacatgca

SEQ ID NO: 78494 - DNA, 25 bp, Homo sapien
agcatgctgtgctcacagcccgccg

SEQ ID NO: 78495 - DNA, 25 bp, Homo sapien
gaattctcaacatcatttttccctg

SEQ ID NO: 78496 - DNA, 25 bp, Homo sapien
atttttccctgtttgaatccagcaa

SEQ ID NO: 78497 - DNA, 25 bp, Homo sapien
atccagcaagtcagccattggtcac

SEQ ID NO: 78498 - DNA, 25 bp, Homo sapien
gccattggtcacttaagagcactaa

SEQ ID NO: 78499 - DNA, 25 bp, Homo sapien
ttaagagcactaacccctccctggt

SEQ ID NO: 78500 - DNA, 25 bp, Homo sapien
ccctggtttgaagatgttcttgact

SEQ ID NO: 78501 - DNA, 25 bp, Homo sapien
tgatattccagcttagactcctcca

SEQ ID NO: 78502 - DNA, 25 bp, Homo sapien
gcttagactcctccacaagaactag

SEQ ID NO: 78503 - DNA, 25 bp, Homo sapien
gagtgtcatcctattttggcttcca

SEQ ID NO: 78504 - DNA, 25 bp, Homo sapien
tcagtccctctgctacaagtcttga

SEQ ID NO: 78505 - DNA, 25 bp, Homo sapien
caagtcttgactccagaactctgtg

SEQ ID NO: 78506 - DNA, 25 bp, Homo sapien
ctatcaattgatttcaaaccttcag

SEQ ID NO: 78507 - DNA, 25 bp, Homo sapien
tcaattgatttcaaaccttcagaaa

SEQ ID NO: 78508 - DNA, 25 bp, Homo sapien
gatttcaaaccttcagaaatagaag

SEQ ID NO: 78509 - DNA, 25 bp, Homo sapien
aaccttcagaaatagaagttggagt

SEQ ID NO: 78510 - DNA, 25 bp, Homo sapien
gaagttggagtagtgacagttgaaa

SEQ ID NO: 78511 - DNA, 25 bp, Homo sapien
gttggagtagtgacagttgaaaatc

SEQ ID NO: 78512 - DNA, 25 bp, Homo sapien
gagtagtgacagttgaaaatcctaa

SEQ ID NO: 78513 - DNA, 25 bp, Homo sapien
gtagtgacagttgaaaatcctaaat

SEQ ID NO: 78514 - DNA, 25 bp, Homo sapien
agtgacagttgaaaatcctaaattc

SEQ ID NO: 78515 - DNA, 25 bp, Homo sapien
gacagttgaaaatcctaaattcagg

SEQ ID NO: 78516 - DNA, 25 bp, Homo sapien
tcctaaattcaggattcttacagaa

SEQ ID NO: 78517 - DNA, 25 bp, Homo sapien
ttaattgtgagaaacagggccgagc

SEQ ID NO: 78518 - DNA, 25 bp, Homo sapien
taattgtgagaaacagggccgagca

SEQ ID NO: 78519 - DNA, 25 bp, Homo sapien
aattgtgagaaacagggccgagcac

SEQ ID NO: 78520 - DNA, 25 bp, Homo sapien
attgtgagaaacagggccgagcaca

SEQ ID NO: 78521 - DNA, 25 bp, Homo sapien
ttgtgagaaacagggccgagcacag

SEQ ID NO: 78522 - DNA, 25 bp, Homo sapien
tgtgagaaacagggccgagcacagt

SEQ ID NO: 78523 - DNA, 25 bp, Homo sapien
taataccagcaccttagaggtcgag

SEQ ID NO: 78524 - DNA, 25 bp, Homo sapien
aataccagcaccttagaggtcgagg

SEQ ID NO: 78525 - DNA, 25 bp, Homo sapien
ataccagcaccttagaggtcgaggc

SEQ ID NO: 78526 - DNA, 25 bp, Homo sapien
taccagcaccttagaggtcgaggca

SEQ ID NO: 78527 - DNA, 25 bp, Homo sapien
cagcaccttagaggtcgaggcaggc

SEQ ID NO: 78528 - DNA, 25 bp, Homo sapien
attgcctgtgtatggaaaaaccatt

SEQ ID NO: 78529 - DNA, 25 bp, Homo sapien
aaccatttgaagtgtacctgtgtac

SEQ ID NO: 78530 - DNA, 25 bp, Homo sapien
tagacaatatacaagccaaagtggc

SEQ ID NO: 78531 - DNA, 25 bp, Homo sapien
gccaaagtggcatgttttgtgcatt

SEQ ID NO: 78532 - DNA, 25 bp, Homo sapien
gtggcatgttttgtgcatttgtaaa

SEQ ID NO: 78533 - DNA, 25 bp, Homo sapien
catttgtaaatgctgtgttgggtag

SEQ ID NO: 78534 - DNA, 25 bp, Homo sapien
tgctgtgttgggtagaataggtttt

SEQ ID NO: 78535 - DNA, 25 bp, Homo sapien
aatatggctatgcttaaaaggttgc

SEQ ID NO: 78536 - DNA, 25 bp, Homo sapien
taaaaggttgcatactgagccaagt

SEQ ID NO: 78537 - DNA, 25 bp, Homo sapien
ggttgcatactgagccaagtataat

SEQ ID NO: 78538 - DNA, 25 bp, Homo sapien
gatgccaattattgttacacattaa

SEQ ID NO: 78539 - DNA, 25 bp, Homo sapien
gggtttacaggtgtgtaccgccaca

SEQ ID NO: 78540 - DNA, 25 bp, Homo sapien
ggtttacaggtgtgtaccgccacac

SEQ ID NO: 78541 - DNA, 25 bp, Homo sapien
gtttacaggtgtgtaccgccacacc

SEQ ID NO: 78542 - DNA, 25 bp, Homo sapien
tacaggtgtgtaccgccacacccgt

SEQ ID NO: 78543 - DNA, 25 bp, Homo sapien
acaggtgtgtaccgccacacccgtc

SEQ ID NO: 78544 - DNA, 25 bp, Homo sapien
ggtgtgtaccgccacacccgtctct

SEQ ID NO: 78545 - DNA, 25 bp, Homo sapien
gtgtgtaccgccacacccgtctcta

SEQ ID NO: 78546 - DNA, 25 bp, Homo sapien
tgtgtaccgccacacccgtctctac

SEQ ID NO: 78547 - DNA, 25 bp, Homo sapien
gtgtaccgccacacccgtctctact

SEQ ID NO: 78548 - DNA, 25 bp, Homo sapien
tgtaccgccacacccgtctctacta

SEQ ID NO: 78549 - DNA, 25 bp, Homo sapien
gtaccgccacacccgtctctactaa

SEQ ID NO: 78550 - DNA, 25 bp, Homo sapien
atatttggtctgtttgtagttttat

SEQ ID NO: 78551 - DNA, 25 bp, Homo sapien
ggtctgtttgtagttttattactag

SEQ ID NO: 78552 - DNA, 25 bp, Homo sapien
tactagatgatttttccggttgtcc

SEQ ID NO: 78553 - DNA, 25 bp, Homo sapien
tagatgatttttccggttgtcctta

SEQ ID NO: 78554 - DNA, 25 bp, Homo sapien
ttttcttcctgactagccccaagtc

SEQ ID NO: 78555 - DNA, 25 bp, Homo sapien
aagtcccttcatttgcatctgctat

SEQ ID NO: 78556 - DNA, 25 bp, Homo sapien
gcatctgctatgcaatagtccctct

SEQ ID NO: 78557 - DNA, 25 bp, Homo sapien
tgctatgcaatagtccctctccttt

SEQ ID NO: 78558 - DNA, 25 bp, Homo sapien
ttccttcttcttccctcagatttag

SEQ ID NO: 78559 - DNA, 25 bp, Homo sapien
cttcttccctcagatttagctgatc

SEQ ID NO: 78560 - DNA, 25 bp, Homo sapien
agatttagctgatccttcctcccac

SEQ ID NO: 78561 - DNA, 25 bp, Homo sapien
tgtggtggtcactgtttttctctct

SEQ ID NO: 78562 - DNA, 25 bp, Homo sapien
tttctctcttgccaaatgaggcagt

SEQ ID NO: 78563 - DNA, 25 bp, Homo sapien
aatgaggcagtctctgagtgacggt

SEQ ID NO: 78564 - DNA, 25 bp, Homo sapien
tgacggtgactgtggccttgaagcc

SEQ ID NO: 78565 - DNA, 25 bp, Homo sapien
tgttgggcatgtagactggcacctt

SEQ ID NO: 78566 - DNA, 25 bp, Homo sapien
tagactggcaccttgaagattcacc

SEQ ID NO: 78567 - DNA, 25 bp, Homo sapien
ggcaccttgaagattcaccattgtt

SEQ ID NO: 78568 - DNA, 25 bp, Homo sapien
caaatgcttttttaccaagagcccg

SEQ ID NO: 78569 - DNA, 25 bp, Homo sapien
ttttttaccaagagcccgagcctcg

SEQ ID NO: 78570 - DNA, 25 bp, Homo sapien
actgtgggacgcacgtgcttctgat

SEQ ID NO: 78571 - DNA, 25 bp, Homo sapien
gacgcacgtgcttctgattaaagga

SEQ ID NO: 78572 - DNA, 25 bp, Homo sapien
gaacgttggtggtcttcgtgctgca

SEQ ID NO: 78573 - DNA, 25 bp, Homo sapien
ttcgtgctgcagtttacgttctgat

SEQ ID NO: 78574 - DNA, 25 bp, Homo sapien
gttctgatacgtacacctcaagctt

SEQ ID NO: 78575 - DNA, 25 bp, Homo sapien
acacctcaagcttttgttcatcctt

SEQ ID NO: 78576 - DNA, 25 bp, Homo sapien
gttcatccttcagaacaagacggag

SEQ ID NO: 78577 - DNA, 25 bp, Homo sapien
aaagaggaactctttggcaatgcaa

SEQ ID NO: 78578 - DNA, 25 bp, Homo sapien
aatagtacttgtacttcccaccact

SEQ ID NO: 78579 - DNA, 25 bp, Homo sapien
cccaccactggaaatgttagcataa

SEQ ID NO: 78580 - DNA, 25 bp, Homo sapien
agtctgcactctttaaacctgttta

SEQ ID NO: 78581 - DNA, 25 bp, Homo sapien
acctgtttaaggctcttcatcctgg

SEQ ID NO: 78582 - DNA, 25 bp, Homo sapien
cttcatcctggttagcaaaaggtgt

SEQ ID NO: 78583 - DNA, 25 bp, Homo sapien
atatttggtctgtttgtagttttat

SEQ ID NO: 78584 - DNA, 25 bp, Homo sapien
ttggtctgtttgtagttttattact

SEQ ID NO: 78585 - DNA, 25 bp, Homo sapien
gtctgtttgtagttttattactaga

SEQ ID NO: 78586 - DNA, 25 bp, Homo sapien
tattactagatgatttttccggttg

SEQ ID NO: 78587 - DNA, 25 bp, Homo sapien
ttactagatgatttttccggttgtc

SEQ ID NO: 78588 - DNA, 25 bp, Homo sapien
tactagatgatttttccggttgtcc

SEQ ID NO: 78589 - DNA, 25 bp, Homo sapien
actagatgatttttccggttgtcct

SEQ ID NO: 78590 - DNA, 25 bp, Homo sapien
ctagatgatttttccggttgtcctt

SEQ ID NO: 78591 - DNA, 25 bp, Homo sapien
tagatgatttttccggttgtcctta

SEQ ID NO: 78592 - DNA, 25 bp, Homo sapien
tgctatgcaatagtccctctccttt

SEQ ID NO: 78593 - DNA, 25 bp, Homo sapien
gctatgcaatagtccctctcctttc

SEQ ID NO: 78594 - DNA, 25 bp, Homo sapien
gtccctggtgggtaacaccctcaag

SEQ ID NO: 78595 - DNA, 25 bp, Homo sapien
tggtgggtaacaccctcaagtctct

SEQ ID NO: 78596 - DNA, 25 bp, Homo sapien
gtgaggccccaccacatcggtgtga

SEQ ID NO: 78597 - DNA, 25 bp, Homo sapien
cacatcggtgtgagttaggtttctc

SEQ ID NO: 78598 - DNA, 25 bp, Homo sapien
taggtttctcatctggagctgtttc

SEQ ID NO: 78599 - DNA, 25 bp, Homo sapien
tggagctgtttctcaggcattcttc

SEQ ID NO: 78600 - DNA, 25 bp, Homo sapien
tgtttctcaggcattcttcccaacc

SEQ ID NO: 78601 - DNA, 25 bp, Homo sapien
tttccccttcggtgtgcctcagtgg

SEQ ID NO: 78602 - DNA, 25 bp, Homo sapien
gcctcagtggtctccttcatagagt

SEQ ID NO: 78603 - DNA, 25 bp, Homo sapien
tccttcatagagtgagagggcttga

SEQ ID NO: 78604 - DNA, 25 bp, Homo sapien
agaaagacacttgtgttcccaagtg

SEQ ID NO: 78605 - DNA, 25 bp, Homo sapien
caagaaccagttgttttgtcttgcg

SEQ ID NO: 78606 - DNA, 25 bp, Homo sapien
tttgtcttgcgggtctgtcagggtt

SEQ ID NO: 78607 - DNA, 25 bp, Homo sapien
tggaaagtccaagccgtaggaccca

SEQ ID NO: 78608 - DNA, 25 bp, Homo sapien
gtctttggccagaacaccgtgggct

SEQ ID NO: 78609 - DNA, 25 bp, Homo sapien
ttggccagaacaccgtgggctgtta

SEQ ID NO: 78610 - DNA, 25 bp, Homo sapien
ggccagaacaccgtgggctgttact

SEQ ID NO: 78611 - DNA, 25 bp, Homo sapien
ccagaacaccgtgggctgttacttg

SEQ ID NO: 78612 - DNA, 25 bp, Homo sapien
gagttggaagcggtttgcatttacg

SEQ ID NO: 78613 - DNA, 25 bp, Homo sapien
cggtttgcatttacgcctgtaaatg

SEQ ID NO: 78614 - DNA, 25 bp, Homo sapien
gcatttacgcctgtaaatgtattca

SEQ ID NO: 78615 - DNA, 25 bp, Homo sapien
gtacgcaattctcgattctttgaag

SEQ ID NO: 78616 - DNA, 25 bp, Homo sapien
agcagtatcaaaatttcttcgggcg

SEQ ID NO: 78617 - DNA, 25 bp, Homo sapien
gtatcaaaatttcttcgggcgccag

SEQ ID NO: 78618 - DNA, 25 bp, Homo sapien
atcaaaatttcttcgggcgccagaa

SEQ ID NO: 78619 - DNA, 25 bp, Homo sapien
ttcgggcgccagaacgagcggcaaa

SEQ ID NO: 78620 - DNA, 25 bp, Homo sapien
acgagcggcaaagcttatgggagta

SEQ ID NO: 78621 - DNA, 25 bp, Homo sapien
gagtagggccgaggctaggacccgg

SEQ ID NO: 78622 - DNA, 25 bp, Homo sapien
acagccggccctctgagggtcacaa

SEQ ID NO: 78623 - DNA, 25 bp, Homo sapien
gggaaggtgtctgggatccacgccc

SEQ ID NO: 78624 - DNA, 25 bp, Homo sapien
atctaggcgaaggtgaaggccctta

SEQ ID NO: 78625 - DNA, 25 bp, Homo sapien
ggtgaaggcccttaccgcttgaaat

SEQ ID NO: 78626 - DNA, 25 bp, Homo sapien
tgaaggcccttaccgcttgaaatcc

SEQ ID NO: 78627 - DNA, 25 bp, Homo sapien
ggaaccatgggcagcaatgccctga

SEQ ID NO: 78628 - DNA, 25 bp, Homo sapien
tgggctcctgaaggcttattccatc

SEQ ID NO: 78629 - DNA, 25 bp, Homo sapien
gaccgcatccgccagtcgcaggagt

SEQ ID NO: 78630 - DNA, 25 bp, Homo sapien
cagtcgcaggagtgcccgcgactga

SEQ ID NO: 78631 - DNA, 25 bp, Homo sapien
aatcacaagaagattcccacccctg

SEQ ID NO: 78632 - DNA, 25 bp, Homo sapien
catgcctggtcccaagacagtgaga

SEQ ID NO: 78633 - DNA, 25 bp, Homo sapien
tgcctggtcccaagacagtgagaca

SEQ ID NO: 78634 - DNA, 25 bp, Homo sapien
ggtcccaagacagtgagacagtctg

SEQ ID NO: 78635 - DNA, 25 bp, Homo sapien
gagacagtctggaaagtgatgtcag

SEQ ID NO: 78636 - DNA, 25 bp, Homo sapien
gtgatgtcagaatagcttccaataa

SEQ ID NO: 78637 - DNA, 25 bp, Homo sapien
ggcctgagtgatccacgtgaaaaaa

SEQ ID NO: 78638 - DNA, 25 bp, Homo sapien
gcagaagcattgaccattttttccc

SEQ ID NO: 78639 - DNA, 25 bp, Homo sapien
agcattgaccattttttcccagaga

SEQ ID NO: 78640 - DNA, 25 bp, Homo sapien
tgaccattttttcccagagaagagg

SEQ ID NO: 78641 - DNA, 25 bp, Homo sapien
tgtagtgagcaaaggacagaccatg

SEQ ID NO: 78642 - DNA, 25 bp, Homo sapien
acagaccatgaatcctccttgagaa

SEQ ID NO: 78643 - DNA, 25 bp, Homo sapien
gaatcctccttgagaagtagtactc

SEQ ID NO: 78644 - DNA, 25 bp, Homo sapien
aaggagaagcgccactcaagttctt

SEQ ID NO: 78645 - DNA, 25 bp, Homo sapien
gaagcgccactcaagttcttttaac

SEQ ID NO: 78646 - DNA, 25 bp, Homo sapien
gccactcaagttcttttaacccaag

SEQ ID NO: 78647 - DNA, 25 bp, Homo sapien
agactttagagaaattaggtccaag

SEQ ID NO: 78648 - DNA, 25 bp, Homo sapien
taggtccaagatttttatatgttca

SEQ ID NO: 78649 - DNA, 25 bp, Homo sapien
gcatggaacagcattaccctcctct

SEQ ID NO: 78650 - DNA, 25 bp, Homo sapien
atggaacagcattaccctcctctct

SEQ ID NO: 78651 - DNA, 25 bp, Homo sapien
ctctccccagatgtgactactgagg

SEQ ID NO: 78652 - DNA, 25 bp, Homo sapien
gattttttcctctgcatttacacac

SEQ ID NO: 78653 - DNA, 25 bp, Homo sapien
acacacccaccaagtaccagtataa

SEQ ID NO: 78654 - DNA, 25 bp, Homo sapien
gtaccagtataagcatctgccatct

SEQ ID NO: 78655 - DNA, 25 bp, Homo sapien
agtataagcatctgccatctgcttt

SEQ ID NO: 78656 - DNA, 25 bp, Homo sapien
tgccatctgcttttcccattgccat

SEQ ID NO: 78657 - DNA, 25 bp, Homo sapien
attgccatgcgtcctggtcaagctc

SEQ ID NO: 78658 - DNA, 25 bp, Homo sapien
tgtttcctggtcagcatgtactccc

SEQ ID NO: 78659 - DNA, 25 bp, Homo sapien
cccctgtagcagtcactgacagtta

SEQ ID NO: 78660 - DNA, 25 bp, Homo sapien
aggagctgcggtacagcgtggccct

SEQ ID NO: 78661 - DNA, 25 bp, Homo sapien
agcgtggccctggtcctaaaggaga

SEQ ID NO: 78662 - DNA, 25 bp, Homo sapien
ggccctggtcctaaaggagatggca

SEQ ID NO: 78663 - DNA, 25 bp, Homo sapien
aggactgacccctcacttgaccagt

SEQ ID NO: 78664 - DNA, 25 bp, Homo sapien
tcacttgaccagtcccattcagatc

SEQ ID NO: 78665 - DNA, 25 bp, Homo sapien
cagtcccattcagatccggcttgga

SEQ ID NO: 78666 - DNA, 25 bp, Homo sapien
attcagatccggcttggacaggcac

SEQ ID NO: 78667 - DNA, 25 bp, Homo sapien
agatccggcttggacaggcacctga

SEQ ID NO: 78668 - DNA, 25 bp, Homo sapien
tccggcttggacaggcacctgagat

SEQ ID NO: 78669 - DNA, 25 bp, Homo sapien
gccaaagtgcagctgactcttccca

SEQ ID NO: 78670 - DNA, 25 bp, Homo sapien
gtgcagctgactcttcccacgacag

SEQ ID NO: 78671 - DNA, 25 bp, Homo sapien
tttgtcttgcgggtctgtcagggtt

SEQ ID NO: 78672 - DNA, 25 bp, Homo sapien
cggtttgcatttacgcctgtaaatg

SEQ ID NO: 78673 - DNA, 25 bp, Homo sapien
ggtttgcatttacgcctgtaaatgt

SEQ ID NO: 78674 - DNA, 25 bp, Homo sapien
gtttgcatttacgcctgtaaatgta

SEQ ID NO: 78675 - DNA, 25 bp, Homo sapien
tttgcatttacgcctgtaaatgtat

SEQ ID NO: 78676 - DNA, 25 bp, Homo sapien
ttgcatttacgcctgtaaatgtatt

SEQ ID NO: 78677 - DNA, 25 bp, Homo sapien
tgcatttacgcctgtaaatgtattc

SEQ ID NO: 78678 - DNA, 25 bp, Homo sapien
gcatttacgcctgtaaatgtattca

SEQ ID NO: 78679 - DNA, 25 bp, Homo sapien
acctgaagggttgtcgcctggcctg

SEQ ID NO: 78680 - DNA, 25 bp, Homo sapien
gcctgggagagcctcttccaggttt

SEQ ID NO: 78681 - DNA, 25 bp, Homo sapien
ttccaggttttgacctgcaggcagt

SEQ ID NO: 78682 - DNA, 25 bp, Homo sapien
tgcaggcagtgctctctaacaggac

SEQ ID NO: 78683 - DNA, 25 bp, Homo sapien
tctctaacaggaccatcacagcttc

SEQ ID NO: 78684 - DNA, 25 bp, Homo sapien
cacagcttctgaactgagccggaga

SEQ ID NO: 78685 - DNA, 25 bp, Homo sapien
ggaactggcgggtattctggtcatt

SEQ ID NO: 78686 - DNA, 25 bp, Homo sapien
gtattctggtcattgaggagacacc

SEQ ID NO: 78687 - DNA, 25 bp, Homo sapien
tgaggagacaccatagtggaaactg

SEQ ID NO: 78688 - DNA, 25 bp, Homo sapien
caggtgtggatagccatttctgctc

SEQ ID NO: 78689 - DNA, 25 bp, Homo sapien
tgctcaaccacacattctctaagaa

SEQ ID NO: 78690 - DNA, 25 bp, Homo sapien
gggaaggcaaatgatgccccagagc

SEQ ID NO: 78691 - DNA, 25 bp, Homo sapien
taaccaaaggttttgcagccgccga

SEQ ID NO: 78692 - DNA, 25 bp, Homo sapien
tttgcagccgccgaaaaacaggaaa

SEQ ID NO: 78693 - DNA, 25 bp, Homo sapien
gggtaggactacactgaatcattaa

SEQ ID NO: 78694 - DNA, 25 bp, Homo sapien
gtgctgtaaactaccatgtggccat

SEQ ID NO: 78695 - DNA, 25 bp, Homo sapien
gccattaacaatgacctttagggag

SEQ ID NO: 78696 - DNA, 25 bp, Homo sapien
gggagttttcctaaacgatcactct

SEQ ID NO: 78697 - DNA, 25 bp, Homo sapien
aaacgatcactctggtgcgggtgtt

SEQ ID NO: 78698 - DNA, 25 bp, Homo sapien
gaaagctttcatgaccatacaaatt

SEQ ID NO: 78699 - DNA, 25 bp, Homo sapien
tttttcttcctatttccttgtagag

SEQ ID NO: 78700 - DNA, 25 bp, Homo sapien
tttcctccttgtcttaaggtcataa

SEQ ID NO: 78701 - DNA, 25 bp, Homo sapien
aggaacaggagcaactactaaaaga

SEQ ID NO: 78702 - DNA, 25 bp, Homo sapien
gagcaactactaaaagagggatttc

SEQ ID NO: 78703 - DNA, 25 bp, Homo sapien
aatgagatacaggatctccagacga

SEQ ID NO: 78704 - DNA, 25 bp, Homo sapien
gatacaggatctccagacgaaaatg

SEQ ID NO: 78705 - DNA, 25 bp, Homo sapien
atctccagacgaaaatgagacgacg

SEQ ID NO: 78706 - DNA, 25 bp, Homo sapien
tgagacgacgaaaggcatgtaccat

SEQ ID NO: 78707 - DNA, 25 bp, Homo sapien
ggcatgtaccataagctaaagacca

SEQ ID NO: 78708 - DNA, 25 bp, Homo sapien
gctaaagaccagagccttcctgtca

SEQ ID NO: 78709 - DNA, 25 bp, Homo sapien
gtcacccctaaccaaggcataattg

SEQ ID NO: 78710 - DNA, 25 bp, Homo sapien
aaagtttataaaggcatgtggtaca

SEQ ID NO: 78711 - DNA, 25 bp, Homo sapien
aaggcatgtggtacaatgatcaaaa

SEQ ID NO: 78712 - DNA, 25 bp, Homo sapien
atgcctacgtggtggggtctccata

SEQ ID NO: 78713 - DNA, 25 bp, Homo sapien
ggtctccataaagatccctgaagtt

SEQ ID NO: 78714 - DNA, 25 bp, Homo sapien
tctccataaagatccctgaagttga

SEQ ID NO: 78715 - DNA, 25 bp, Homo sapien
gggtctggagattttctgggttgcc

SEQ ID NO: 78716 - DNA, 25 bp, Homo sapien
ttctgggttgccgacaacatccaca

SEQ ID NO: 78717 - DNA, 25 bp, Homo sapien
gacaacatccacatgccaggagagt

SEQ ID NO: 78718 - DNA, 25 bp, Homo sapien
acatgccaggagagttaccccaact

SEQ ID NO: 78719 - DNA, 25 bp, Homo sapien
ggagagttaccccaactccatgagg

SEQ ID NO: 78720 - DNA, 25 bp, Homo sapien
agttaccccaactccatgaggacag

SEQ ID NO: 78721 - DNA, 25 bp, Homo sapien
ggacccttccagattacttctttat

SEQ ID NO: 78722 - DNA, 25 bp, Homo sapien
attacttctttatctggctatttat

SEQ ID NO: 78723 - DNA, 25 bp, Homo sapien
gcctccaagttcaacctgcagggaa

SEQ ID NO: 78724 - DNA, 25 bp, Homo sapien
tccaagttcaacctgcagggaagcc

SEQ ID NO: 78725 - DNA, 25 bp, Homo sapien
aagttcaacctgcagggaagccctg

SEQ ID NO: 78726 - DNA, 25 bp, Homo sapien
agttcaacctgcagggaagccctgg

SEQ ID NO: 78727 - DNA, 25 bp, Homo sapien
ggaagccctggaaatcctgtctccc

SEQ ID NO: 78728 - DNA, 25 bp, Homo sapien
gaagccctggaaatcctgtctccct

SEQ ID NO: 78729 - DNA, 25 bp, Homo sapien
ccccaacaggctttcaaatgtctgc

SEQ ID NO: 78730 - DNA, 25 bp, Homo sapien
caacaggctttcaaatgtctgcctt

SEQ ID NO: 78731 - DNA, 25 bp, Homo sapien
tgccttccccaaaccaatctgtggt

SEQ ID NO: 78732 - DNA, 25 bp, Homo sapien
aagtaaggtcaggtacagtagctca

SEQ ID NO: 78733 - DNA, 25 bp, Homo sapien
gtaaggtcaggtacagtagctcatg

SEQ ID NO: 78734 - DNA, 25 bp, Homo sapien
tgggcaagttgtttattgtttatac

SEQ ID NO: 78735 - DNA, 25 bp, Homo sapien
tgtttattgtttatactccttcgta

SEQ ID NO: 78736 - DNA, 25 bp, Homo sapien
tatactccttcgtaaaatactgctg

SEQ ID NO: 78737 - DNA, 25 bp, Homo sapien
ttcgtaaaatactgctgacttctct

SEQ ID NO: 78738 - DNA, 25 bp, Homo sapien
cgtaaaatactgctgacttctctgc

SEQ ID NO: 78739 - DNA, 25 bp, Homo sapien
ctctgcattgttgggaatgagatgt

SEQ ID NO: 78740 - DNA, 25 bp, Homo sapien
gagatgtttgtcaaggatttagcat

SEQ ID NO: 78741 - DNA, 25 bp, Homo sapien
tttgtcaaggatttagcatgtggtg

SEQ ID NO: 78742 - DNA, 25 bp, Homo sapien
tttagcatgtggtgataaatcagta

SEQ ID NO: 78743 - DNA, 25 bp, Homo sapien
gtaaatgttgaatatttcctggtat

SEQ ID NO: 78744 - DNA, 25 bp, Homo sapien
gttgaatatttcctggtattaataa

SEQ ID NO: 78745 - DNA, 25 bp, Homo sapien
ttcctttgtggccttaacccttctg

SEQ ID NO: 78746 - DNA, 25 bp, Homo sapien
ggccttaacccttctgcatcaggga

SEQ ID NO: 78747 - DNA, 25 bp, Homo sapien
ggaccagaccccttgggaccacatg

SEQ ID NO: 78748 - DNA, 25 bp, Homo sapien
ggaccacatggcacaatgggacctc

SEQ ID NO: 78749 - DNA, 25 bp, Homo sapien
aatgggacctctgttgtacattccg

SEQ ID NO: 78750 - DNA, 25 bp, Homo sapien
acctctgttgtacattccggttggg

SEQ ID NO: 78751 - DNA, 25 bp, Homo sapien
gggatgagcgttgctatttaattac

SEQ ID NO: 78752 - DNA, 25 bp, Homo sapien
gagcgttgctatttaattactaata

SEQ ID NO: 78753 - DNA, 25 bp, Homo sapien
ggcgagcccggtgttctgaagacct

SEQ ID NO: 78754 - DNA, 25 bp, Homo sapien
ggtgttctgaagacctgtggcccag

SEQ ID NO: 78755 - DNA, 25 bp, Homo sapien
ctgaagacctgtggcccagcagagc

SEQ ID NO: 78756 - DNA, 25 bp, Homo sapien
aataatgctaatgaggtctgaaaaa

SEQ ID NO: 78757 - DNA, 25 bp, Homo sapien
aaacttatgacccaggcagaccgct

SEQ ID NO: 78758 - DNA, 25 bp, Homo sapien
aagcagatgtttgcagcgtttcccc

SEQ ID NO: 78759 - DNA, 25 bp, Homo sapien
agatgtgtgcggcaacctggactac

SEQ ID NO: 78760 - DNA, 25 bp, Homo sapien
gcaacctggactacagaaacctgtg

SEQ ID NO: 78761 - DNA, 25 bp, Homo sapien
agaaacctgtgctacgtcatcactc

SEQ ID NO: 78762 - DNA, 25 bp, Homo sapien
gctacgtcatcactcacggtgaaga

SEQ ID NO: 78763 - DNA, 25 bp, Homo sapien
ggatcacaagtctccccgacattca

SEQ ID NO: 78764 - DNA, 25 bp, Homo sapien
gtgtgacagggagctcttgcagcca

SEQ ID NO: 78765 - DNA, 25 bp, Homo sapien
gtgacagggagctcttgcagccaga

SEQ ID NO: 78766 - DNA, 25 bp, Homo sapien
gcaggaaaaaggcttcccttgtcct

SEQ ID NO: 78767 - DNA, 25 bp, Homo sapien
tgcatatttccttcattctaaagtt

SEQ ID NO: 78768 - DNA, 25 bp, Homo sapien
tccttcattctaaagttgttccctg

SEQ ID NO: 78769 - DNA, 25 bp, Homo sapien
ccttcattctaaagttgttccctgg

SEQ ID NO: 78770 - DNA, 25 bp, Homo sapien
tctaaagttgttccctggccgggag

SEQ ID NO: 78771 - DNA, 25 bp, Homo sapien
gggagcgttggctttcgcctgtaat

SEQ ID NO: 78772 - DNA, 25 bp, Homo sapien
ggagcgttggctttcgcctgtaatc

SEQ ID NO: 78773 - DNA, 25 bp, Homo sapien
gagcgttggctttcgcctgtaatcc

SEQ ID NO: 78774 - DNA, 25 bp, Homo sapien
acaaaaattatggtgacgcctgcct

SEQ ID NO: 78775 - DNA, 25 bp, Homo sapien
aaaattatggtgacgcctgcctgta

SEQ ID NO: 78776 - DNA, 25 bp, Homo sapien
aaattatggtgacgcctgcctgtag

SEQ ID NO: 78777 - DNA, 25 bp, Homo sapien
attatggtgacgcctgcctgtagtc

SEQ ID NO: 78778 - DNA, 25 bp, Homo sapien
atgactgtgtggatcccacccaaat

SEQ ID NO: 78779 - DNA, 25 bp, Homo sapien
gactgtgtggatcccacccaaatcc

SEQ ID NO: 78780 - DNA, 25 bp, Homo sapien
gtgtggatcccacccaaatccaact

SEQ ID NO: 78781 - DNA, 25 bp, Homo sapien
aactcatcctggtttgctgcacact

SEQ ID NO: 78782 - DNA, 25 bp, Homo sapien
tcatcctggtttgctgcacactggt

SEQ ID NO: 78783 - DNA, 25 bp, Homo sapien
ttcatcaaaagaaggttaccgaggg

SEQ ID NO: 78784 - DNA, 25 bp, Homo sapien
aggtgtttgcacttcatgttacttt

SEQ ID NO: 78785 - DNA, 25 bp, Homo sapien
atttacttctgttacagacctagtt

SEQ ID NO: 78786 - DNA, 25 bp, Homo sapien
tacttctgttacagacctagttact

SEQ ID NO: 78787 - DNA, 25 bp, Homo sapien
ggaattcattacttgccatggacta

SEQ ID NO: 78788 - DNA, 25 bp, Homo sapien
gccatggactacctttgctaagaaa

SEQ ID NO: 78789 - DNA, 25 bp, Homo sapien
gcttgtgaacttctactcatttcct

SEQ ID NO: 78790 - DNA, 25 bp, Homo sapien
agaggctggtagagtaactgtccga

SEQ ID NO: 78791 - DNA, 25 bp, Homo sapien
taactgtccgagatgggatgcctga

SEQ ID NO: 78792 - DNA, 25 bp, Homo sapien
ggatgcctgagctcttgaagctgcc

SEQ ID NO: 78793 - DNA, 25 bp, Homo sapien
tgaagctgccccttcgttgtcatga

SEQ ID NO: 78794 - DNA, 25 bp, Homo sapien
ttcgttgtcatgagtgccagcagct

SEQ ID NO: 78795 - DNA, 25 bp, Homo sapien
gccttccattcctcagctgaaagaa

SEQ ID NO: 78796 - DNA, 25 bp, Homo sapien
aacatctcaggaagcactggacaca

SEQ ID NO: 78797 - DNA, 25 bp, Homo sapien
gacacagtgattctgcagagcctga

SEQ ID NO: 78798 - DNA, 25 bp, Homo sapien
gtggtgtggcccactggagcaaact

SEQ ID NO: 78799 - DNA, 25 bp, Homo sapien
ggagcaaactgctggcacctattct

SEQ ID NO: 78800 - DNA, 25 bp, Homo sapien
gttccttttgtcacttagttactga

SEQ ID NO: 78801 - DNA, 25 bp, Homo sapien
tagttactgattttcctgggtttga

SEQ ID NO: 78802 - DNA, 25 bp, Homo sapien
cctgggtttgacataagtattctat

SEQ ID NO: 78803 - DNA, 25 bp, Homo sapien
gaattcaagtagctgagttccttta

SEQ ID NO: 78804 - DNA, 25 bp, Homo sapien
ttcctttatgtttcgtttattcact

SEQ ID NO: 78805 - DNA, 25 bp, Homo sapien
gtttattcactaaagtagctgacac

SEQ ID NO: 78806 - DNA, 25 bp, Homo sapien
agtagctgacacaaaacacaccaaa

SEQ ID NO: 78807 - DNA, 25 bp, Homo sapien
gcggtagttttatgtaaatgctcat

SEQ ID NO: 78808 - DNA, 25 bp, Homo sapien
aatgctcatgagtttgtatcaataa

SEQ ID NO: 78809 - DNA, 25 bp, Homo sapien
gttgatccacttataattcgtgcaa

SEQ ID NO: 78810 - DNA, 25 bp, Homo sapien
ataattcgtgcaatactgtatgtat

SEQ ID NO: 78811 - DNA, 25 bp, Homo sapien
agaaaaacttatgacccaggcagac

SEQ ID NO: 78812 - DNA, 25 bp, Homo sapien
aacttatgacccaggcagaccgctt

SEQ ID NO: 78813 - DNA, 25 bp, Homo sapien
aggcagaccgcttcagtgaggagga

SEQ ID NO: 78814 - DNA, 25 bp, Homo sapien
agatgtgtgcggcaacctggactac

SEQ ID NO: 78815 - DNA, 25 bp, Homo sapien
gcaacctggactacagaaacctgtg

SEQ ID NO: 78816 - DNA, 25 bp, Homo sapien
cagaaacctgtgctacgtcatcact

SEQ ID NO: 78817 - DNA, 25 bp, Homo sapien
gaaacctgtgctacgtcatcactca

SEQ ID NO: 78818 - DNA, 25 bp, Homo sapien
tgtgctacgtcatcactcacggtga

SEQ ID NO: 78819 - DNA, 25 bp, Homo sapien
gctacgtcatcactcacggtgaaga

SEQ ID NO: 78820 - DNA, 25 bp, Homo sapien
acgtcatcactcacggtgaagagaa

SEQ ID NO: 78821 - DNA, 25 bp, Homo sapien
tcactcacggtgaagagaaggatta

SEQ ID NO: 78822 - DNA, 25 bp, Homo sapien
gcctctgcttatttcttgttctgga

SEQ ID NO: 78823 - DNA, 25 bp, Homo sapien
cagaacttcaaatacttcctaccct

SEQ ID NO: 78824 - DNA, 25 bp, Homo sapien
ttcaaatacttcctaccctccaatt

SEQ ID NO: 78825 - DNA, 25 bp, Homo sapien
taccctccaattcagactcagctga

SEQ ID NO: 78826 - DNA, 25 bp, Homo sapien
aattcagactcagctgactgttgag

SEQ ID NO: 78827 - DNA, 25 bp, Homo sapien
gactgttgagagagcagcacatcat

SEQ ID NO: 78828 - DNA, 25 bp, Homo sapien
gagcagcacatcattttatcatttt

SEQ ID NO: 78829 - DNA, 25 bp, Homo sapien
taggatgctgattttcctacccgtg

SEQ ID NO: 78830 - DNA, 25 bp, Homo sapien
ttttcctacccgtggcccaggtctg

SEQ ID NO: 78831 - DNA, 25 bp, Homo sapien
catgccaaggactctaggtcaaatg

SEQ ID NO: 78832 - DNA, 25 bp, Homo sapien
ggactctaggtcaaatgtcaataaa

SEQ ID NO: 78833 - DNA, 25 bp, Homo sapien
cagttctcctctggatcgcagtcat

SEQ ID NO: 78834 - DNA, 25 bp, Homo sapien
tggatcgcagtcatccagagatgtg

SEQ ID NO: 78835 - DNA, 25 bp, Homo sapien
gccaaatccgcaccaaggtcatgga

SEQ ID NO: 78836 - DNA, 25 bp, Homo sapien
aaggtcatggatgtgcacgatggca

SEQ ID NO: 78837 - DNA, 25 bp, Homo sapien
gcacgatggcaaggtggtgtccacc

SEQ ID NO: 78838 - DNA, 25 bp, Homo sapien
aaggtggtgtccacccacgagcagg

SEQ ID NO: 78839 - DNA, 25 bp, Homo sapien
acgagcaggtccttcgcaccaagaa

SEQ ID NO: 78840 - DNA, 25 bp, Homo sapien
aggtccttcgcaccaagaactgagg

SEQ ID NO: 78841 - DNA, 25 bp, Homo sapien
ttcgcaccaagaactgaggctgccc

SEQ ID NO: 78842 - DNA, 25 bp, Homo sapien
gtgtggacacagatcccactggaag

SEQ ID NO: 78843 - DNA, 25 bp, Homo sapien
cctggcaatcaatacagcttcatta

SEQ ID NO: 78844 - DNA, 25 bp, Homo sapien
gaggccttgaaggtgccttcatcaa

SEQ ID NO: 78845 - DNA, 25 bp, Homo sapien
aaggtgccttcatcaactgtggagt

SEQ ID NO: 78846 - DNA, 25 bp, Homo sapien
gccttcatcaactgtggagtacctc

SEQ ID NO: 78847 - DNA, 25 bp, Homo sapien
acatggcattgatgtgcgggtcctc

SEQ ID NO: 78848 - DNA, 25 bp, Homo sapien
ttgatgtgcgggtcctccagacaga

SEQ ID NO: 78849 - DNA, 25 bp, Homo sapien
ggtcctccagacagagcaggcagtg

SEQ ID NO: 78850 - DNA, 25 bp, Homo sapien
aaggagtataatgccttggttgccc

SEQ ID NO: 78851 - DNA, 25 bp, Homo sapien
agggtgggaggtgtcttccattcca

SEQ ID NO: 78852 - DNA, 25 bp, Homo sapien
tgtcttccattccacctgctgatgg

SEQ ID NO: 78853 - DNA, 25 bp, Homo sapien
ccacctgctgatggagccttaagag

SEQ ID NO: 78854 - DNA, 25 bp, Homo sapien
agaggagaataaatcactaagtgcc

SEQ ID NO: 78855 - DNA, 25 bp, Homo sapien
tttctgcatgtgctggtcaaatcca

SEQ ID NO: 78856 - DNA, 25 bp, Homo sapien
tctgcatgtgctggtcaaatccaaa

SEQ ID NO: 78857 - DNA, 25 bp, Homo sapien
tgcatgtgctggtcaaatccaaacc

SEQ ID NO: 78858 - DNA, 25 bp, Homo sapien
aacccagagaacagaagcgctttct

SEQ ID NO: 78859 - DNA, 25 bp, Homo sapien
cagagaacagaagcgctttctaaga

SEQ ID NO: 78860 - DNA, 25 bp, Homo sapien
gaacagaagcgctttctaagaatga

SEQ ID NO: 78861 - DNA, 25 bp, Homo sapien
acagaagcgctttctaagaatgaac

SEQ ID NO: 78862 - DNA, 25 bp, Homo sapien
aaagcattcttgttacatactggtc

SEQ ID NO: 78863 - DNA, 25 bp, Homo sapien
gttacatactggtcaatttgtgata

SEQ ID NO: 78864 - DNA, 25 bp, Homo sapien
catactggtcaatttgtgatatgtt

SEQ ID NO: 78865 - DNA, 25 bp, Homo sapien
gtcaatttgtgatatgttttaactt

SEQ ID NO: 78866 - DNA, 25 bp, Homo sapien
ttgccagctctcattactgcagttc

SEQ ID NO: 78867 - DNA, 25 bp, Homo sapien
actgcagttctgaccaatcatcttg

SEQ ID NO: 78868 - DNA, 25 bp, Homo sapien
aatcatcttgcctgggttccaacag

SEQ ID NO: 78869 - DNA, 25 bp, Homo sapien
ctgggttccaacagtcatgccaaat

SEQ ID NO: 78870 - DNA, 25 bp, Homo sapien
gtcatgccaaatggacaaccaccta

SEQ ID NO: 78871 - DNA, 25 bp, Homo sapien
tctcagagtgtggacatgttggcaa

SEQ ID NO: 78872 - DNA, 25 bp, Homo sapien
gacatgttggcaaagactcatccat

SEQ ID NO: 78873 - DNA, 25 bp, Homo sapien
actcatccatataacccactttggg

SEQ ID NO: 78874 - DNA, 25 bp, Homo sapien
cactttgggcacaactgggtatgta

SEQ ID NO: 78875 - DNA, 25 bp, Homo sapien
gtaatctgacaactgttacactatg

SEQ ID NO: 78876 - DNA, 25 bp, Homo sapien
attagacttttttgtagctatctgt

SEQ ID NO: 78877 - DNA, 25 bp, Homo sapien
catgtgtgcagaggccactcttgaa

SEQ ID NO: 78878 - DNA, 25 bp, Homo sapien
tgcagaggccactcttgaagagcag

SEQ ID NO: 78879 - DNA, 25 bp, Homo sapien
cttgaagagcagactccctctgtgg

SEQ ID NO: 78880 - DNA, 25 bp, Homo sapien
tgtggctgatgggactaattattcc

SEQ ID NO: 78881 - DNA, 25 bp, Homo sapien
ggactaattattcccactagccagc

SEQ ID NO: 78882 - DNA, 25 bp, Homo sapien
aaggaagctgtgcagcatgctcctc

SEQ ID NO: 78883 - DNA, 25 bp, Homo sapien
tcgtccatgtgtgtcggcagtgctg

SEQ ID NO: 78884 - DNA, 25 bp, Homo sapien
agtgctggtgtctgtcgtctccgcg

SEQ ID NO: 78885 - DNA, 25 bp, Homo sapien
gtctccgcgagctgttactggaatg

SEQ ID NO: 78886 - DNA, 25 bp, Homo sapien
ctgttactggaatgagcccttgtgt

SEQ ID NO: 78887 - DNA, 25 bp, Homo sapien
ccttgtgttcatgggtatcgtcatg

SEQ ID NO: 78888 - DNA, 25 bp, Homo sapien
actatgctagtattttgcttgctga

SEQ ID NO: 78889 - DNA, 25 bp, Homo sapien
ggtaaaatcctgacatgccatttca

SEQ ID NO: 78890 - DNA, 25 bp, Homo sapien
gggatatccgtacttcattacagtc

SEQ ID NO: 78891 - DNA, 25 bp, Homo sapien
tacagtcatgattttggatcctaat

SEQ ID NO: 78892 - DNA, 25 bp, Homo sapien
cgcttttcaagtacatggacaatga

SEQ ID NO: 78893 - DNA, 25 bp, Homo sapien
ggacaatgattatgctaagctgggc

SEQ ID NO: 78894 - DNA, 25 bp, Homo sapien
ttatgctaagctgggcctgagtttg

SEQ ID NO: 78895 - DNA, 25 bp, Homo sapien
gggaatcaagaagaaatcacctgca

SEQ ID NO: 78896 - DNA, 25 bp, Homo sapien
agaaatcacctgcaacaccacaggc

SEQ ID NO: 78897 - DNA, 25 bp, Homo sapien
caggccaagcctgatggtgtcactg

SEQ ID NO: 78898 - DNA, 25 bp, Homo sapien
gatggtgtcactgccacggctgctg

SEQ ID NO: 78899 - DNA, 25 bp, Homo sapien
tacatgcctgtctactgttctatca

SEQ ID NO: 78900 - DNA, 25 bp, Homo sapien
gcctgtctactgttctatcaattga

SEQ ID NO: 78901 - DNA, 25 bp, Homo sapien
agattgatgctcaccttgttgctct

SEQ ID NO: 78902 - DNA, 25 bp, Homo sapien
gctcaccttgttgctctagcagaga

SEQ ID NO: 78903 - DNA, 25 bp, Homo sapien
acattgtcgttagtttaccagatcc

SEQ ID NO: 78904 - DNA, 25 bp, Homo sapien
tagtttaccagatccgtgatgccac

SEQ ID NO: 78905 - DNA, 25 bp, Homo sapien
cagatccgtgatgccacttacctgt

SEQ ID NO: 78906 - DNA, 25 bp, Homo sapien
cttacctgtgtgtttggtaacaaca

SEQ ID NO: 78907 - DNA, 25 bp, Homo sapien
aaaccaacatcatggaggtccctgg

SEQ ID NO: 78908 - DNA, 25 bp, Homo sapien
catcatggaggtccctggattgaaa

SEQ ID NO: 78909 - DNA, 25 bp, Homo sapien
gattgaaaaaggagcctctcccact

SEQ ID NO: 78910 - DNA, 25 bp, Homo sapien
ctgtagacttcagagagcacttctc

SEQ ID NO: 78911 - DNA, 25 bp, Homo sapien
tgtgacttgcttggtggcctcattc

SEQ ID NO: 78912 - DNA, 25 bp, Homo sapien
gggcatggactttgttaagcagagt

SEQ ID NO: 78913 - DNA, 25 bp, Homo sapien
gagtcagcagtgaggtcctcattct

SEQ ID NO: 78914 - DNA, 25 bp, Homo sapien
ctctgccctggagaatcatgtgcta

SEQ ID NO: 78915 - DNA, 25 bp, Homo sapien
gaatcatgtgctatgttctaagaat

SEQ ID NO: 78916 - DNA, 25 bp, Homo sapien
tgagaactagagtcctcatccccag

SEQ ID NO: 78917 - DNA, 25 bp, Homo sapien
tcatccccaggcttgaaggcacatg

SEQ ID NO: 78918 - DNA, 25 bp, Homo sapien
ggcttgaaggcacatggctttctca

SEQ ID NO: 78919 - DNA, 25 bp, Homo sapien
atggctttctcatgtagggctctct

SEQ ID NO: 78920 - DNA, 25 bp, Homo sapien
gtagggctctctgtggtatttgtta

SEQ ID NO: 78921 - DNA, 25 bp, Homo sapien
cccttgctggttatcttactctgag

SEQ ID NO: 78922 - DNA, 25 bp, Homo sapien
gctggttatcttactctgagtgtga

SEQ ID NO: 78923 - DNA, 25 bp, Homo sapien
tcagaggcacctgcgggttagccca

SEQ ID NO: 78924 - DNA, 25 bp, Homo sapien
caagccctggatttggcctgcggag

SEQ ID NO: 78925 - DNA, 25 bp, Homo sapien
gcctgcggaggagcttaggatcctc

SEQ ID NO: 78926 - DNA, 25 bp, Homo sapien
taggatcctcgttttctgggttttg

SEQ ID NO: 78927 - DNA, 25 bp, Homo sapien
tttgcttctggtttggagctccgga

SEQ ID NO: 78928 - DNA, 25 bp, Homo sapien
tggagctccggaccaggaccttcgt

SEQ ID NO: 78929 - DNA, 25 bp, Homo sapien
caggaccttcgtcctggtcagtttt

SEQ ID NO: 78930 - DNA, 25 bp, Homo sapien
gtaacttttaaacctgcgtgacatc

SEQ ID NO: 78931 - DNA, 25 bp, Homo sapien
gtgacatctacaaagcgcccaataa

SEQ ID NO: 78932 - DNA, 25 bp, Homo sapien
cgcttttcaagtacatggacaatga

SEQ ID NO: 78933 - DNA, 25 bp, Homo sapien
gcttttcaagtacatggacaatgat

SEQ ID NO: 78934 - DNA, 25 bp, Homo sapien
ggacaatgattatgctaagctgggc

SEQ ID NO: 78935 - DNA, 25 bp, Homo sapien
caatgattatgctaagctgggcctg

SEQ ID NO: 78936 - DNA, 25 bp, Homo sapien
agaaatcacctgcaacaccacaggc

SEQ ID NO: 78937 - DNA, 25 bp, Homo sapien
aacaccacaggccaagcctgatggt

SEQ ID NO: 78938 - DNA, 25 bp, Homo sapien
accacaggccaagcctgatggtgtc

SEQ ID NO: 78939 - DNA, 25 bp, Homo sapien
acaggccaagcctgatggtgtcact

SEQ ID NO: 78940 - DNA, 25 bp, Homo sapien
caggccaagcctgatggtgtcactg

SEQ ID NO: 78941 - DNA, 25 bp, Homo sapien
tgatggtgtcactgccacggctgct

SEQ ID NO: 78942 - DNA, 25 bp, Homo sapien
gatggtgtcactgccacggctgctg

SEQ ID NO: 78943 - DNA, 25 bp, Homo sapien
ggaatctctcgagtgcaaagactgt

SEQ ID NO: 78944 - DNA, 25 bp, Homo sapien
tctcgagtgcaaagactgtctagtt

SEQ ID NO: 78945 - DNA, 25 bp, Homo sapien
gactgtctagttatttatcaggcta

SEQ ID NO: 78946 - DNA, 25 bp, Homo sapien
ggctatttctactgatgaactgctt

SEQ ID NO: 78947 - DNA, 25 bp, Homo sapien
ctactgatgaactgcttcaggtggg

SEQ ID NO: 78948 - DNA, 25 bp, Homo sapien
agtgtctgagaaacaaatctttgtt

SEQ ID NO: 78949 - DNA, 25 bp, Homo sapien
ttctcttaggctgcaatggaacaac

SEQ ID NO: 78950 - DNA, 25 bp, Homo sapien
taggctgcaatggaacaactttacc

SEQ ID NO: 78951 - DNA, 25 bp, Homo sapien
aacatgctcagcaaactgcaccagt

SEQ ID NO: 78952 - DNA, 25 bp, Homo sapien
actgcaccagttaactacagtttgg

SEQ ID NO: 78953 - DNA, 25 bp, Homo sapien
tatgttaacaattatgacatctgca

SEQ ID NO: 78954 - DNA, 25 bp, Homo sapien
ctgttttaaccttcaggaagaattg

SEQ ID NO: 78955 - DNA, 25 bp, Homo sapien
gtaaagacctgtacatagcacaaca

SEQ ID NO: 78956 - DNA, 25 bp, Homo sapien
tgtacatagcacaacatgatccgga

SEQ ID NO: 78957 - DNA, 25 bp, Homo sapien
gatccggataatatatatactgttc

SEQ ID NO: 78958 - DNA, 25 bp, Homo sapien
tatactgttcatgtacatccacaaa

SEQ ID NO: 78959 - DNA, 25 bp, Homo sapien
atgtacatccacaaatacaccttgt

SEQ ID NO: 78960 - DNA, 25 bp, Homo sapien
tacaccttgtaccaaataatgcttt

SEQ ID NO: 78961 - DNA, 25 bp, Homo sapien
gtaccaaataatgctttcttgtagt

SEQ ID NO: 78962 - DNA, 25 bp, Homo sapien
ttctttcctattcattgtttcttat

SEQ ID NO: 78963 - DNA, 25 bp, Homo sapien
attcattgtttcttatcagtttaaa

SEQ ID NO: 78964 - DNA, 25 bp, Homo sapien
aaggattcctttaagcatgtcagat

SEQ ID NO: 78965 - DNA, 25 bp, Homo sapien
ttggtggcatcggaggccttaccac

SEQ ID NO: 78966 - DNA, 25 bp, Homo sapien
atcggaggccttaccactcctatga

SEQ ID NO: 78967 - DNA, 25 bp, Homo sapien
ttttctctctcacagatagtgaggg

SEQ ID NO: 78968 - DNA, 25 bp, Homo sapien
gtgagggtctgacatgcccatgcca

SEQ ID NO: 78969 - DNA, 25 bp, Homo sapien
tgccacctatgccacagtgcctaag

SEQ ID NO: 78970 - DNA, 25 bp, Homo sapien
ctatgccacagtgcctaagggctag

SEQ ID NO: 78971 - DNA, 25 bp, Homo sapien
taagggctaggccacccagagactg

SEQ ID NO: 78972 - DNA, 25 bp, Homo sapien
actgtgcccggagctggccgtgtct

SEQ ID NO: 78973 - DNA, 25 bp, Homo sapien
gagctggccgtgtctcccactcagg

SEQ ID NO: 78974 - DNA, 25 bp, Homo sapien
gagagtagctttgaggagcctcatt

SEQ ID NO: 78975 - DNA, 25 bp, Homo sapien
cgagggacttagtggagttctcatc

SEQ ID NO: 78976 - DNA, 25 bp, Homo sapien
tgagccaccaggagggctctgccac

SEQ ID NO: 78977 - DNA, 25 bp, Homo sapien
gagccaccaggagggctctgccacg

SEQ ID NO: 78978 - DNA, 25 bp, Homo sapien
agccaccaggagggctctgccacgg

SEQ ID NO: 78979 - DNA, 25 bp, Homo sapien
accaggagggctctgccacgggcac

SEQ ID NO: 78980 - DNA, 25 bp, Homo sapien
ccaggagggctctgccacgggcacc

SEQ ID NO: 78981 - DNA, 25 bp, Homo sapien
caggagggctctgccacgggcaccc

SEQ ID NO: 78982 - DNA, 25 bp, Homo sapien
gagggctctgccacgggcaccccca

SEQ ID NO: 78983 - DNA, 25 bp, Homo sapien
gtacagcgtccccacctatttcaaa

SEQ ID NO: 78984 - DNA, 25 bp, Homo sapien
tacagcgtccccacctatttcaaat

SEQ ID NO: 78985 - DNA, 25 bp, Homo sapien
agcgtccccacctatttcaaatctt

SEQ ID NO: 78986 - DNA, 25 bp, Homo sapien
gcgtccccacctatttcaaatctta

SEQ ID NO: 78987 - DNA, 25 bp, Homo sapien
gcaggttggggcgtcttccagaacc

SEQ ID NO: 78988 - DNA, 25 bp, Homo sapien
tctcccttctggagccactctgcac

SEQ ID NO: 78989 - DNA, 25 bp, Homo sapien
tcatgagcctgactgcctctcgcct

SEQ ID NO: 78990 - DNA, 25 bp, Homo sapien
atgagcctgactgcctctcgcctgc

SEQ ID NO: 78991 - DNA, 25 bp, Homo sapien
ctctcgcctgctctcagcaggaagg

SEQ ID NO: 78992 - DNA, 25 bp, Homo sapien
tggtgaagtagctggagcccgatca

SEQ ID NO: 78993 - DNA, 25 bp, Homo sapien
ggtgaagtagctggagcccgatcac

SEQ ID NO: 78994 - DNA, 25 bp, Homo sapien
gtgaagtagctggagcccgatcaca

SEQ ID NO: 78995 - DNA, 25 bp, Homo sapien
agtagctggagcccgatcacagtcc

SEQ ID NO: 78996 - DNA, 25 bp, Homo sapien
tagctggagcccgatcacagtcccg

SEQ ID NO: 78997 - DNA, 25 bp, Homo sapien
ctggagcccgatcacagtcccgcgg

SEQ ID NO: 78998 - DNA, 25 bp, Homo sapien
cacaaaaggaccatccccatgtttg

SEQ ID NO: 78999 - DNA, 25 bp, Homo sapien
caaaaggaccatccccatgtttgtc

SEQ ID NO: 79000 - DNA, 25 bp, Homo sapien
aaggaccatccccatgtttgtccca

SEQ ID NO: 79001 - DNA, 25 bp, Homo sapien
atccccatgtttgtcccagaatcta

SEQ ID NO: 79002 - DNA, 25 bp, Homo sapien
ccatgtttgtcccagaatctacgtc

SEQ ID NO: 79003 - DNA, 25 bp, Homo sapien
atgtttgtcccagaatctacgtcta

SEQ ID NO: 79004 - DNA, 25 bp, Homo sapien
gtttgtcccagaatctacgtctaaa

SEQ ID NO: 79005 - DNA, 25 bp, Homo sapien
tgtcccagaatctacgtctaaactg

SEQ ID NO: 79006 - DNA, 25 bp, Homo sapien
ccagaatctacgtctaaactgcaga

SEQ ID NO: 79007 - DNA, 25 bp, Homo sapien
gaatctacgtctaaactgcagaagt

SEQ ID NO: 79008 - DNA, 25 bp, Homo sapien
acgtctaaactgcagaagtttacaa

SEQ ID NO: 79009 - DNA, 25 bp, Homo sapien
aggtgggagccacaacacccgacca

SEQ ID NO: 79010 - DNA, 25 bp, Homo sapien
ggtgggagccacaacacccgaccat

SEQ ID NO: 79011 - DNA, 25 bp, Homo sapien
gtgggagccacaacacccgaccatg

SEQ ID NO: 79012 - DNA, 25 bp, Homo sapien
tgggagccacaacacccgaccatga

SEQ ID NO: 79013 - DNA, 25 bp, Homo sapien
gggagccacaacacccgaccatgaa

SEQ ID NO: 79014 - DNA, 25 bp, Homo sapien
ggagccacaacacccgaccatgaat

SEQ ID NO: 79015 - DNA, 25 bp, Homo sapien
gagccacaacacccgaccatgaatt

SEQ ID NO: 79016 - DNA, 25 bp, Homo sapien
cacaacacccgaccatgaattaact

SEQ ID NO: 79017 - DNA, 25 bp, Homo sapien
acaacacccgaccatgaattaactc

SEQ ID NO: 79018 - DNA, 25 bp, Homo sapien
aacacccgaccatgaattaactccg

SEQ ID NO: 79019 - DNA, 25 bp, Homo sapien
cacccgaccatgaattaactccgtt

SEQ ID NO: 79020 - DNA, 25 bp, Homo sapien
ggtttacccaagagaatggttctgt

SEQ ID NO: 79021 - DNA, 25 bp, Homo sapien
caagagaatggttctgttacccgtt

SEQ ID NO: 79022 - DNA, 25 bp, Homo sapien
gaatggttctgttacccgttatgaa

SEQ ID NO: 79023 - DNA, 25 bp, Homo sapien
tctgttacccgttatgaaatttcca

SEQ ID NO: 79024 - DNA, 25 bp, Homo sapien
gaaatttccaacatatcctgttccc

SEQ ID NO: 79025 - DNA, 25 bp, Homo sapien
aatttccaacatatcctgttcccca

SEQ ID NO: 79026 - DNA, 25 bp, Homo sapien
tgttccccactactcattcttttag

SEQ ID NO: 79027 - DNA, 25 bp, Homo sapien
ccccactactcattcttttagcaaa

SEQ ID NO: 79028 - DNA, 25 bp, Homo sapien
gcaaatgacagaagctaattcctat

SEQ ID NO: 79029 - DNA, 25 bp, Homo sapien
acaatacagtacaacacagaatgtt

SEQ ID NO: 79030 - DNA, 25 bp, Homo sapien
ctttctttgaacacatacttgatca

SEQ ID NO: 79031 - DNA, 25 bp, Homo sapien
ctgctgtatactgtactgagacatt

SEQ ID NO: 79032 - DNA, 25 bp, Homo sapien
ctgagacattacagtttggaagtgt

SEQ ID NO: 79033 - DNA, 25 bp, Homo sapien
atttaacctactagacaatgatgtg

SEQ ID NO: 79034 - DNA, 25 bp, Homo sapien
gacaatgatgtgagtacccaggatg

SEQ ID NO: 79035 - DNA, 25 bp, Homo sapien
atgtgagtacccaggatgatttcct

SEQ ID NO: 79036 - DNA, 25 bp, Homo sapien
gaaagggcacgagagagtcttccag

SEQ ID NO: 79037 - DNA, 25 bp, Homo sapien
gcacgagagagtcttccaggtactg

SEQ ID NO: 79038 - DNA, 25 bp, Homo sapien
aggtactgatcctgtttcttgctct

SEQ ID NO: 79039 - DNA, 25 bp, Homo sapien
tttcttgctctgagtgctagctagc

SEQ ID NO: 79040 - DNA, 25 bp, Homo sapien
ctagctagccagctgtgttcacact

SEQ ID NO: 79041 - DNA, 25 bp, Homo sapien
aagctgtacatttggtgcacttttc

SEQ ID NO: 79042 - DNA, 25 bp, Homo sapien
tcccagctagaaaagtatactcatt

SEQ ID NO: 79043 - DNA, 25 bp, Homo sapien
actcattctcatttaaactctctca

SEQ ID NO: 79044 - DNA, 25 bp, Homo sapien
tctcatttaaactctctcatttgga

SEQ ID NO: 79045 - DNA, 25 bp, Homo sapien
ctctcatttggagggatcatgtgag

SEQ ID NO: 79046 - DNA, 25 bp, Homo sapien
gggatcatgtgagttggcctactta

SEQ ID NO: 79047 - DNA, 25 bp, Homo sapien
atgtgagttggcctacttacaagta

SEQ ID NO: 79048 - DNA, 25 bp, Homo sapien
tacttacaagtagtgaaagttccct

SEQ ID NO: 79049 - DNA, 25 bp, Homo sapien
cactcagccaaatgtgaaagttgtg

SEQ ID NO: 79050 - DNA, 25 bp, Homo sapien
tgaagtgtgaatcttgttatcaaat

SEQ ID NO: 79051 - DNA, 25 bp, Homo sapien
tgttatcaaatttatttctctgatg

SEQ ID NO: 79052 - DNA, 25 bp, Homo sapien
ccttccttatccttgtagccaataa

SEQ ID NO: 79053 - DNA, 25 bp, Homo sapien
aggaataacggccttatattctgga

SEQ ID NO: 79054 - DNA, 25 bp, Homo sapien
agcattccctgccaatggagcactc

SEQ ID NO: 79055 - DNA, 25 bp, Homo sapien
aatggagcactctttttggcctacg

SEQ ID NO: 79056 - DNA, 25 bp, Homo sapien
agcactctttttggcctacgaatat

SEQ ID NO: 79057 - DNA, 25 bp, Homo sapien
atagcaggaagttgatgatgaacca

SEQ ID NO: 79058 - DNA, 25 bp, Homo sapien
ggactacagttcatctcagggtttc

SEQ ID NO: 79059 - DNA, 25 bp, Homo sapien
acagttcatctcagggtttcttgga

SEQ ID NO: 79060 - DNA, 25 bp, Homo sapien
catctcagggtttcttggagtacaa

SEQ ID NO: 79061 - DNA, 25 bp, Homo sapien
tggagtacaagaccagtgtgaagtt

SEQ ID NO: 79062 - DNA, 25 bp, Homo sapien
gaccagtgtgaagttattctgattt

SEQ ID NO: 79063 - DNA, 25 bp, Homo sapien
ttctaccctacatcttaaactttat

SEQ ID NO: 79064 - DNA, 25 bp, Homo sapien
gagaatgtagccattgtagcagctt

SEQ ID NO: 79065 - DNA, 25 bp, Homo sapien
tgtagcagcttgtgttgtcacgctt

SEQ ID NO: 79066 - DNA, 25 bp, Homo sapien
gcttgtgttgtcacgcttcttcttt

SEQ ID NO: 79067 - DNA, 25 bp, Homo sapien
cttttgagcaactttcttacactga

SEQ ID NO: 79068 - DNA, 25 bp, Homo sapien
gagtgcttcagaatgtgatttccta

SEQ ID NO: 79069 - DNA, 25 bp, Homo sapien
atgtgatttcctactaacctgttcc

SEQ ID NO: 79070 - DNA, 25 bp, Homo sapien
taacctgttccttggataggctttt

SEQ ID NO: 79071 - DNA, 25 bp, Homo sapien
tccatcagcaaccagggagactgca

SEQ ID NO: 79072 - DNA, 25 bp, Homo sapien
ggagactgcacctgatggaaaagat

SEQ ID NO: 79073 - DNA, 25 bp, Homo sapien
gactgcttcatgacattcctaaact

SEQ ID NO: 79074 - DNA, 25 bp, Homo sapien
atgacattcctaaactatctttttt

SEQ ID NO: 79075 - DNA, 25 bp, Homo sapien
tctactctgaacaaatacactgatg

SEQ ID NO: 79076 - DNA, 25 bp, Homo sapien
gaacaaatacactgatgagtcatca

SEQ ID NO: 79077 - DNA, 25 bp, Homo sapien
gagtcatcagtgaaatttgccttca

SEQ ID NO: 79078 - DNA, 25 bp, Homo sapien
tgaaatttgccttcacattttaaga

SEQ ID NO: 79079 - DNA, 25 bp, Homo sapien
ggagttatttaagccatctacagag

SEQ ID NO: 79080 - DNA, 25 bp, Homo sapien
gccatctacagagctgaggaaacag

SEQ ID NO: 79081 - DNA, 25 bp, Homo sapien
agtgtaatgtgtctctgccccattg

SEQ ID NO: 79082 - DNA, 25 bp, Homo sapien
cagtgacccccaggttattctaaag

SEQ ID NO: 79083 - DNA, 25 bp, Homo sapien
ttattctaaagcagagtccttccct

SEQ ID NO: 79084 - DNA, 25 bp, Homo sapien
gataagtctgggacactgtttcagt

SEQ ID NO: 79085 - DNA, 25 bp, Homo sapien
gggacactgtttcagttcaataaag

SEQ ID NO: 79086 - DNA, 25 bp, Homo sapien
taaagaggccttagtgcccgggatg

SEQ ID NO: 79087 - DNA, 25 bp, Homo sapien
cccgggatgggcacagtgttttgaa

SEQ ID NO: 79088 - DNA, 25 bp, Homo sapien
aaggtgaagctccatgcatgtgtgc

SEQ ID NO: 79089 - DNA, 25 bp, Homo sapien
tccatgcatgtgtgcgcgggtgtat

SEQ ID NO: 79090 - DNA, 25 bp, Homo sapien
gtgtatgtgcgctcagggtctctgt

SEQ ID NO: 79091 - DNA, 25 bp, Homo sapien
tgcgctcagggtctctgtttaagta

SEQ ID NO: 79092 - DNA, 25 bp, Homo sapien
gtatcagctaaagatgtgcttcctc

SEQ ID NO: 79093 - DNA, 25 bp, Homo sapien
tgtcatacactgagaccaacaggct

SEQ ID NO: 79094 - DNA, 25 bp, Homo sapien
gagaccaacaggctacagtgtccct

SEQ ID NO: 79095 - DNA, 25 bp, Homo sapien
gctacagtgtccctgattcttggaa

SEQ ID NO: 79096 - DNA, 25 bp, Homo sapien
ggctgtgttgagctgacattcaaat

SEQ ID NO: 79097 - DNA, 25 bp, Homo sapien
ggctgtacatgtggatatggacttg

SEQ ID NO: 79098 - DNA, 25 bp, Homo sapien
tggatatggacttgaggcccacctc

SEQ ID NO: 79099 - DNA, 25 bp, Homo sapien
atatggacttgaggcccacctctgt

SEQ ID NO: 79100 - DNA, 25 bp, Homo sapien
aggcccacctctgtgtccaagtgga

SEQ ID NO: 79101 - DNA, 25 bp, Homo sapien
acctctgtgtccaagtggattgagc

SEQ ID NO: 79102 - DNA, 25 bp, Homo sapien
ccaagtggattgagcatatatgcct

SEQ ID NO: 79103 - DNA, 25 bp, Homo sapien
ttgagcatatatgcctaggaggaga

SEQ ID NO: 79104 - DNA, 25 bp, Homo sapien
ggagatagactgttaatcgttggat

SEQ ID NO: 79105 - DNA, 25 bp, Homo sapien
gactgttaatcgttggattttgatt

SEQ ID NO: 79106 - DNA, 25 bp, Homo sapien
gtagcctaattttctgggagcaggt

SEQ ID NO: 79107 - DNA, 25 bp, Homo sapien
tgaggacagtcccagtctgctggga

SEQ ID NO: 79108 - DNA, 25 bp, Homo sapien
ggacgccacgtgccattcccatggg

SEQ ID NO: 79109 - DNA, 25 bp, Homo sapien
tcctgaggaggagcgccagttgccc

SEQ ID NO: 79110 - DNA, 25 bp, Homo sapien
aggaggagcgccagttgcccctcgc

SEQ ID NO: 79111 - DNA, 25 bp, Homo sapien
agaccccagctgtctgcgcgtctga

SEQ ID NO: 79112 - DNA, 25 bp, Homo sapien
agctgtctgcgcgtctgactcttgt

SEQ ID NO: 79113 - DNA, 25 bp, Homo sapien
tgtctgcgcgtctgactcttgtggc

SEQ ID NO: 79114 - DNA, 25 bp, Homo sapien
gcgtctgactcttgtggcctcagca

SEQ ID NO: 79115 - DNA, 25 bp, Homo sapien
cacagccaaggctggactgggttgg

SEQ ID NO: 79116 - DNA, 25 bp, Homo sapien
ctgcagtgtggtgtttagtggatac

SEQ ID NO: 79117 - DNA, 25 bp, Homo sapien
tagtggataccacatcggaagtgat

SEQ ID NO: 79118 - DNA, 25 bp, Homo sapien
ataccacatcggaagtgattttcta

SEQ ID NO: 79119 - DNA, 25 bp, Homo sapien
tcgtgaagaccctgaagtgagccgc

SEQ ID NO: 79120 - DNA, 25 bp, Homo sapien
tgaagaccctgaagtgagccgctgt

SEQ ID NO: 79121 - DNA, 25 bp, Homo sapien
aagaccctgaagtgagccgctgtga

SEQ ID NO: 79122 - DNA, 25 bp, Homo sapien
agaccctgaagtgagccgctgtgac

SEQ ID NO: 79123 - DNA, 25 bp, Homo sapien
catcatgtcactgcaaagccgttgc

SEQ ID NO: 79124 - DNA, 25 bp, Homo sapien
atgtcactgcaaagccgttgcagat

SEQ ID NO: 79125 - DNA, 25 bp, Homo sapien
ctgcaaagccgttgcagataaactt

SEQ ID NO: 79126 - DNA, 25 bp, Homo sapien
aagaacctgggcatcggcaaagtct

SEQ ID NO: 79127 - DNA, 25 bp, Homo sapien
agaacctgggcatcggcaaagtctc

SEQ ID NO: 79128 - DNA, 25 bp, Homo sapien
atcggcaaagtctcctcttttgagg

SEQ ID NO: 79129 - DNA, 25 bp, Homo sapien
aagatgatctcggatgccatccccg

SEQ ID NO: 79130 - DNA, 25 bp, Homo sapien
agccctttctgcacagctggtgtcg

SEQ ID NO: 79131 - DNA, 25 bp, Homo sapien
ttctgcacagctggtgtcggcatca

SEQ ID NO: 79132 - DNA, 25 bp, Homo sapien
cacagctggtgtcggcatcatacta

SEQ ID NO: 79133 - DNA, 25 bp, Homo sapien
agctggtgtcggcatcatactaaaa

SEQ ID NO: 79134 - DNA, 25 bp, Homo sapien
tggtgtcggcatcatactaaaagca

SEQ ID NO: 79135 - DNA, 25 bp, Homo sapien
aaattcgtttttgcaataatgacaa

SEQ ID NO: 79136 - DNA, 25 bp, Homo sapien
ataatgacaaatgccctgcacctac

SEQ ID NO: 79137 - DNA, 25 bp, Homo sapien
tacccacatgcactcgtgtgagaca

SEQ ID NO: 79138 - DNA, 25 bp, Homo sapien
gcactcgtgtgagacaaggcccata

SEQ ID NO: 79139 - DNA, 25 bp, Homo sapien
cgtgtgagacaaggcccataggtat

SEQ ID NO: 79140 - DNA, 25 bp, Homo sapien
agacaaggcccataggtatggcccc

SEQ ID NO: 79141 - DNA, 25 bp, Homo sapien
ctcttgggcccaaatgaacattgta

SEQ ID NO: 79142 - DNA, 25 bp, Homo sapien
gaacattgtaccatagtcttctgga

SEQ ID NO: 79143 - DNA, 25 bp, Homo sapien
gtaccatagtcttctggaaagcaaa

SEQ ID NO: 79144 - DNA, 25 bp, Homo sapien
agatgatgtgctgtagcttgatctt

SEQ ID NO: 79145 - DNA, 25 bp, Homo sapien
tagcttgatcttccttagcctactg

SEQ ID NO: 79146 - DNA, 25 bp, Homo sapien
tcttccttagcctactgccactgag

SEQ ID NO: 79147 - DNA, 25 bp, Homo sapien
taggttttaggtggtatcgtagtgc

SEQ ID NO: 79148 - DNA, 25 bp, Homo sapien
gtggtatcgtagtgccttttgatta

SEQ ID NO: 79149 - DNA, 25 bp, Homo sapien
tcatcttccttctttggatctattt

SEQ ID NO: 79150 - DNA, 25 bp, Homo sapien
tctttggatctatttggcctctcaa

SEQ ID NO: 79151 - DNA, 25 bp, Homo sapien
gatgttattgtctcttgtagaggaa

SEQ ID NO: 79152 - DNA, 25 bp, Homo sapien
gacagttgtttttagccataacaag

SEQ ID NO: 79153 - DNA, 25 bp, Homo sapien
gaatcagattcagcagttacaggtt

SEQ ID NO: 79154 - DNA, 25 bp, Homo sapien
gattcagcagttacaggttcctcaa

SEQ ID NO: 79155 - DNA, 25 bp, Homo sapien
ggttcctcaaagctgtagatatgtg

SEQ ID NO: 79156 - DNA, 25 bp, Homo sapien
gatatgtgtagcttgcacaacttaa

SEQ ID NO: 79157 - DNA, 25 bp, Homo sapien
aattgtgtagtttactgtcctctga

SEQ ID NO: 79158 - DNA, 25 bp, Homo sapien
tgtcctctgaattgtgaccacgtct

SEQ ID NO: 79159 - DNA, 25 bp, Homo sapien
tcttgctcacatagcagttacaaat

SEQ ID NO: 79160 - DNA, 25 bp, Homo sapien
gtgctgctgtgtatcctgtgaaaca

SEQ ID NO: 79161 - DNA, 25 bp, Homo sapien
atatgagcaactttgattactccac

SEQ ID NO: 79162 - DNA, 25 bp, Homo sapien
tgtcctctaactactgacagttgtt

SEQ ID NO: 79163 - DNA, 25 bp, Homo sapien
atgaagccacaccacgatacagtca

SEQ ID NO: 79164 - DNA, 25 bp, Homo sapien
tgaagccacaccacgatacagtcag

SEQ ID NO: 79165 - DNA, 25 bp, Homo sapien
gaagccacaccacgatacagtcagc

SEQ ID NO: 79166 - DNA, 25 bp, Homo sapien
agccacaccacgatacagtcagcaa

SEQ ID NO: 79167 - DNA, 25 bp, Homo sapien
gccacaccacgatacagtcagcaag

SEQ ID NO: 79168 - DNA, 25 bp, Homo sapien
acaccacgatacagtcagcaagagg

SEQ ID NO: 79169 - DNA, 25 bp, Homo sapien
atacagtcagcaagaggaagccggg

SEQ ID NO: 79170 - DNA, 25 bp, Homo sapien
ttaggaaccccaccccttatgcctg

SEQ ID NO: 79171 - DNA, 25 bp, Homo sapien
accccttatgcctgtggcggtggca

SEQ ID NO: 79172 - DNA, 25 bp, Homo sapien
tcgctctggccaaatgccttcaaaa

SEQ ID NO: 79173 - DNA, 25 bp, Homo sapien
cgctctggccaaatgccttcaaaaa

SEQ ID NO: 79174 - DNA, 25 bp, Homo sapien
ggcagggcagaaatggactcctttt

SEQ ID NO: 79175 - DNA, 25 bp, Homo sapien
gcagaaatggactccttttgggtcc

SEQ ID NO: 79176 - DNA, 25 bp, Homo sapien
gccttgacccacaggacgtgtggtg

SEQ ID NO: 79177 - DNA, 25 bp, Homo sapien
acccacaggacgtgtggtggcgcct

SEQ ID NO: 79178 - DNA, 25 bp, Homo sapien
agccctggtctctggcgcatctctt

SEQ ID NO: 79179 - DNA, 25 bp, Homo sapien
atctcttccctcttgtcccgaagat

SEQ ID NO: 79180 - DNA, 25 bp, Homo sapien
ttgtcccgaagatctgcgcctctag

SEQ ID NO: 79181 - DNA, 25 bp, Homo sapien
gaagatctgcgcctctagtgccttt

SEQ ID NO: 79182 - DNA, 25 bp, Homo sapien
atctgcgcctctagtgccttttgag

SEQ ID NO: 79183 - DNA, 25 bp, Homo sapien
ctgcgcctctagtgccttttgaggg

SEQ ID NO: 79184 - DNA, 25 bp, Homo sapien
agtgccttttgaggggttcccatca

SEQ ID NO: 79185 - DNA, 25 bp, Homo sapien
gattcctggatgtgatggaccagct

SEQ ID NO: 79186 - DNA, 25 bp, Homo sapien
attcctggatgtgatggaccagctc

SEQ ID NO: 79187 - DNA, 25 bp, Homo sapien
cccctctgcctcttgagtaccagac

SEQ ID NO: 79188 - DNA, 25 bp, Homo sapien
ccctctgcctcttgagtaccagacc

SEQ ID NO: 79189 - DNA, 25 bp, Homo sapien
ctgcctcttgagtaccagacctcat

SEQ ID NO: 79190 - DNA, 25 bp, Homo sapien
tgcctcttgagtaccagacctcatg

SEQ ID NO: 79191 - DNA, 25 bp, Homo sapien
gcctcttgagtaccagacctcatgg

SEQ ID NO: 79192 - DNA, 25 bp, Homo sapien
cctcttgagtaccagacctcatggg

SEQ ID NO: 79193 - DNA, 25 bp, Homo sapien
ctcttgagtaccagacctcatggga

SEQ ID NO: 79194 - DNA, 25 bp, Homo sapien
tcttgagtaccagacctcatgggac

SEQ ID NO: 79195 - DNA, 25 bp, Homo sapien
gccttagaggaggccgggcgagccc

SEQ ID NO: 79196 - DNA, 25 bp, Homo sapien
taggcctaataaagcaataatgttc

SEQ ID NO: 79197 - DNA, 25 bp, Homo sapien
gcaataatgttctagacatctgtct

SEQ ID NO: 79198 - DNA, 25 bp, Homo sapien
gacatctgtctaagtaatcagactc

SEQ ID NO: 79199 - DNA, 25 bp, Homo sapien
agtaatcagactcaggttccacaca

SEQ ID NO: 79200 - DNA, 25 bp, Homo sapien
atcagactcaggttccacacacaag

SEQ ID NO: 79201 - DNA, 25 bp, Homo sapien
acaagcaacaactcgtgggcctctt

SEQ ID NO: 79202 - DNA, 25 bp, Homo sapien
cgtgggcctcttttctatttcaatg

SEQ ID NO: 79203 - DNA, 25 bp, Homo sapien
atttcaatgtgctactaagaaccct

SEQ ID NO: 79204 - DNA, 25 bp, Homo sapien
gtgctactaagaacccttggatgta

SEQ ID NO: 79205 - DNA, 25 bp, Homo sapien
gaacccttggatgtaacatactagt

SEQ ID NO: 79206 - DNA, 25 bp, Homo sapien
acagctgtaaaagtgaccacaatga

SEQ ID NO: 79207 - DNA, 25 bp, Homo sapien
aataaatggcaacccctggtctaag

SEQ ID NO: 79208 - DNA, 25 bp, Homo sapien
aatggcaacccctggtctaagataa

SEQ ID NO: 79209 - DNA, 25 bp, Homo sapien
gcaacccctggtctaagataagaga

SEQ ID NO: 79210 - DNA, 25 bp, Homo sapien
agagataaaacatcaggtggtgagg

SEQ ID NO: 79211 - DNA, 25 bp, Homo sapien
ggcttggtagcagttgccccagtca

SEQ ID NO: 79212 - DNA, 25 bp, Homo sapien
agcagttgccccagtcatgagatga

SEQ ID NO: 79213 - DNA, 25 bp, Homo sapien
ccccagtcatgagatgactcactta

SEQ ID NO: 79214 - DNA, 25 bp, Homo sapien
tgactcacttaacccgtctccttta

SEQ ID NO: 79215 - DNA, 25 bp, Homo sapien
ttaacccgtctcctttaagtgagct

SEQ ID NO: 79216 - DNA, 25 bp, Homo sapien
acccgtctcctttaagtgagctggg

SEQ ID NO: 79217 - DNA, 25 bp, Homo sapien
gtctcctttaagtgagctgggctgg

SEQ ID NO: 79218 - DNA, 25 bp, Homo sapien
atgactgtgtggatcccacccaaat

SEQ ID NO: 79219 - DNA, 25 bp, Homo sapien
tgactgtgtggatcccacccaaatc

SEQ ID NO: 79220 - DNA, 25 bp, Homo sapien
gactgtgtggatcccacccaaatcc

SEQ ID NO: 79221 - DNA, 25 bp, Homo sapien
ctgtgtggatcccacccaaatccaa

SEQ ID NO: 79222 - DNA, 25 bp, Homo sapien
gtgtggatcccacccaaatccaact

SEQ ID NO: 79223 - DNA, 25 bp, Homo sapien
aactcatcctggtttgctgcacact

SEQ ID NO: 79224 - DNA, 25 bp, Homo sapien
actcatcctggtttgctgcacactg

SEQ ID NO: 79225 - DNA, 25 bp, Homo sapien
tcatcctggtttgctgcacactggt

SEQ ID NO: 79226 - DNA, 25 bp, Homo sapien
ttcatcaaaagaaggttaccgaggg

SEQ ID NO: 79227 - DNA, 25 bp, Homo sapien
atttacttctgttacagacctagtt

SEQ ID NO: 79228 - DNA, 25 bp, Homo sapien
tacttctgttacagacctagttact

SEQ ID NO: 79229 - DNA, 25 bp, Homo sapien
tgtaaagaactctcctcataggtga

SEQ ID NO: 79230 - DNA, 25 bp, Homo sapien
gtgagatcaagaggccaccagttgt

SEQ ID NO: 79231 - DNA, 25 bp, Homo sapien
aagaggccaccagttgtacttcagc

SEQ ID NO: 79232 - DNA, 25 bp, Homo sapien
agttgtacttcagcaccaatgtgtc

SEQ ID NO: 79233 - DNA, 25 bp, Homo sapien
agcaccaatgtgtcttactttatag

SEQ ID NO: 79234 - DNA, 25 bp, Homo sapien
cagctactgtccaaactcaaagtgg

SEQ ID NO: 79235 - DNA, 25 bp, Homo sapien
gtccaaactcaaagtggcagccagt

SEQ ID NO: 79236 - DNA, 25 bp, Homo sapien
cagccagttggttttgataggttgc

SEQ ID NO: 79237 - DNA, 25 bp, Homo sapien
gataggttgccttttggagatttct

SEQ ID NO: 79238 - DNA, 25 bp, Homo sapien
cttttggagatttctattactgcct

SEQ ID NO: 79239 - DNA, 25 bp, Homo sapien
tataaccctgttttatacaaactag

SEQ ID NO: 79240 - DNA, 25 bp, Homo sapien
taatctgggctggtacaggcctcag

SEQ ID NO: 79241 - DNA, 25 bp, Homo sapien
agccttgccctcaatgcacgaaagg

SEQ ID NO: 79242 - DNA, 25 bp, Homo sapien
cctcaatgcacgaaaggtggcccag

SEQ ID NO: 79243 - DNA, 25 bp, Homo sapien
gcccaggagagaggatcaatgccat

SEQ ID NO: 79244 - DNA, 25 bp, Homo sapien
gccataggaggcagaagtctggcct

SEQ ID NO: 79245 - DNA, 25 bp, Homo sapien
agaagtctggcctctgtgcctctat

SEQ ID NO: 79246 - DNA, 25 bp, Homo sapien
gcctctgtgcctctatggagactat

SEQ ID NO: 79247 - DNA, 25 bp, Homo sapien
atggagactatcttccagttgctgc

SEQ ID NO: 79248 - DNA, 25 bp, Homo sapien
tccagttgctgctcaacagagttgt

SEQ ID NO: 79249 - DNA, 25 bp, Homo sapien
cagagttgttggctgagacctgctt

SEQ ID NO: 79250 - DNA, 25 bp, Homo sapien
tggcccttcatctgttcaggaacac

SEQ ID NO: 79251 - DNA, 25 bp, Homo sapien
cgcccctaaggtactatgagttctc

SEQ ID NO: 79252 - DNA, 25 bp, Homo sapien
cctaaggtactatgagttctcaggg

SEQ ID NO: 79253 - DNA, 25 bp, Homo sapien
ccacacgcccacaaagtggattgca

SEQ ID NO: 79254 - DNA, 25 bp, Homo sapien
gcccacaaagtggattgcacacaga

SEQ ID NO: 79255 - DNA, 25 bp, Homo sapien
cacaaagtggattgcacacagacaa

SEQ ID NO: 79256 - DNA, 25 bp, Homo sapien
actgttctgtgcactttttctacct

SEQ ID NO: 79257 - DNA, 25 bp, Homo sapien
tgttctgtgcactttttctacctac

SEQ ID NO: 79258 - DNA, 25 bp, Homo sapien
ttctgtgcactttttctacctacat

SEQ ID NO: 79259 - DNA, 25 bp, Homo sapien
ctgtgcactttttctacctacataa

SEQ ID NO: 79260 - DNA, 25 bp, Homo sapien
gtgcactttttctacctacataaac

SEQ ID NO: 79261 - DNA, 25 bp, Homo sapien
ttctacctacataaacacacgcatt

SEQ ID NO: 79262 - DNA, 25 bp, Homo sapien
atagctccaggctatggaacaccat

SEQ ID NO: 79263 - DNA, 25 bp, Homo sapien
tagctccaggctatggaacaccata

SEQ ID NO: 79264 - DNA, 25 bp, Homo sapien
gctccaggctatggaacaccatatg

SEQ ID NO: 79265 - DNA, 25 bp, Homo sapien
tccaggctatggaacaccatatggt

SEQ ID NO: 79266 - DNA, 25 bp, Homo sapien
ggctatggaacaccatatggttaca

SEQ ID NO: 79267 - DNA, 25 bp, Homo sapien
atggaacaccatatggttacagcac

SEQ ID NO: 79268 - DNA, 25 bp, Homo sapien
acaccatatggttacagcacagctg

SEQ ID NO: 79269 - DNA, 25 bp, Homo sapien
caccatatggttacagcacagctgc

SEQ ID NO: 79270 - DNA, 25 bp, Homo sapien
ccatatggttacagcacagctgccc

SEQ ID NO: 79271 - DNA, 25 bp, Homo sapien
tgcccctgcctatggtttacccaag

SEQ ID NO: 79272 - DNA, 25 bp, Homo sapien
ccctgcctatggtttacccaagaga

SEQ ID NO: 79273 - DNA, 25 bp, Homo sapien
cacacccggccttttagctcaggtc

SEQ ID NO: 79274 - DNA, 25 bp, Homo sapien
tttagctcaggtccaccatggggga

SEQ ID NO: 79275 - DNA, 25 bp, Homo sapien
tgcactttcaaccaggccagtccgg

SEQ ID NO: 79276 - DNA, 25 bp, Homo sapien
tcaaccaggccagtccggctctggg

SEQ ID NO: 79277 - DNA, 25 bp, Homo sapien
gggcctccccggcaacagccccagg

SEQ ID NO: 79278 - DNA, 25 bp, Homo sapien
gggccttgagggtctgaggtcccag

SEQ ID NO: 79279 - DNA, 25 bp, Homo sapien
aggtcccagccctgttgccaagtga

SEQ ID NO: 79280 - DNA, 25 bp, Homo sapien
ggtcccagccctgttgccaagtgac

SEQ ID NO: 79281 - DNA, 25 bp, Homo sapien
cgagcttctatttcatattgcaaat

SEQ ID NO: 79282 - DNA, 25 bp, Homo sapien
gagcttctatttcatattgcaaata

SEQ ID NO: 79283 - DNA, 25 bp, Homo sapien
gcttctatttcatattgcaaatata

SEQ ID NO: 79284 - DNA, 25 bp, Homo sapien
agtcccaggtgcttcaagccatgag

SEQ ID NO: 79285 - DNA, 25 bp, Homo sapien
tggaagtgcaggacacgcccaatgc

SEQ ID NO: 79286 - DNA, 25 bp, Homo sapien
cttcctgtgtcatgaaggccgagta

SEQ ID NO: 79287 - DNA, 25 bp, Homo sapien
gagtaactggagctgctctcatccc

SEQ ID NO: 79288 - DNA, 25 bp, Homo sapien
caggagggacttcacttacatcttt

SEQ ID NO: 79289 - DNA, 25 bp, Homo sapien
tcacttacatctttgggccaagctg

SEQ ID NO: 79290 - DNA, 25 bp, Homo sapien
aagctgctcaatgaaccgccaggaa

SEQ ID NO: 79291 - DNA, 25 bp, Homo sapien
gccaggaactgacctgctgactgca

SEQ ID NO: 79292 - DNA, 25 bp, Homo sapien
ttcccaatgctttcactcttatcta

SEQ ID NO: 79293 - DNA, 25 bp, Homo sapien
ttatctaccctttggcacttatctt

SEQ ID NO: 79294 - DNA, 25 bp, Homo sapien
ggcacttatcttgcttatcaacata

SEQ ID NO: 79295 - DNA, 25 bp, Homo sapien
tagatcccaaagattcttggtgaat

SEQ ID NO: 79296 - DNA, 25 bp, Homo sapien
tgaagtcttcatcagtatatccata

SEQ ID NO: 79297 - DNA, 25 bp, Homo sapien
acgagatgacagaagccaaagtaat

SEQ ID NO: 79298 - DNA, 25 bp, Homo sapien
ggctgacaggacaactggatcagtt

SEQ ID NO: 79299 - DNA, 25 bp, Homo sapien
gataaatcttttgactccagctctt

SEQ ID NO: 79300 - DNA, 25 bp, Homo sapien
aaatcttttgactccagctctttag

SEQ ID NO: 79301 - DNA, 25 bp, Homo sapien
ggatctaaagtgaccttgatggaca

SEQ ID NO: 79302 - DNA, 25 bp, Homo sapien
gaccttgatggacagtggaagaaat

SEQ ID NO: 79303 - DNA, 25 bp, Homo sapien
gaaatcacaacatggaattcctcga

SEQ ID NO: 79304 - DNA, 25 bp, Homo sapien
ggaattcctcgaataacaatttatt

SEQ ID NO: 79305 - DNA, 25 bp, Homo sapien
tgtctaatgctacatatacacaatt

SEQ ID NO: 79306 - DNA, 25 bp, Homo sapien
tcgggccttccacctaaactgaatg

SEQ ID NO: 79307 - DNA, 25 bp, Homo sapien
taaactgaatgcctgccagtaccca

SEQ ID NO: 79308 - DNA, 25 bp, Homo sapien
cagtacccactgaagagccctttgg

SEQ ID NO: 79309 - DNA, 25 bp, Homo sapien
tgaagagccctttggaccttcctaa

SEQ ID NO: 79310 - DNA, 25 bp, Homo sapien
cttcctaaacccttgccatagtgga

SEQ ID NO: 79311 - DNA, 25 bp, Homo sapien
aaacccttgccatagtggaagctgt

SEQ ID NO: 79312 - DNA, 25 bp, Homo sapien
tggaagctgtggtcactttcgcagg

SEQ ID NO: 79313 - DNA, 25 bp, Homo sapien
caggagccagagttgatgagcagat

SEQ ID NO: 79314 - DNA, 25 bp, Homo sapien
atctgtggaagaacaatccagggct

SEQ ID NO: 79315 - DNA, 25 bp, Homo sapien
atccagggctgagaaatcgtagagc

SEQ ID NO: 79316 - DNA, 25 bp, Homo sapien
agcatggaggacagcttatggaaaa

SEQ ID NO: 79317 - DNA, 25 bp, Homo sapien
ccagcgcccagcgttagggctggaa

SEQ ID NO: 79318 - DNA, 25 bp, Homo sapien
ctggaagacggcagtgttcagaatt

SEQ ID NO: 79319 - DNA, 25 bp, Homo sapien
cacagaaggtgtgaactgacctcta

SEQ ID NO: 79320 - DNA, 25 bp, Homo sapien
gtgaactgacctctaaagcagcgtg

SEQ ID NO: 79321 - DNA, 25 bp, Homo sapien
ctgacctctaaagcagcgtgagatg

SEQ ID NO: 79322 - DNA, 25 bp, Homo sapien
taaagcagcgtgagatgggaatgat

SEQ ID NO: 79323 - DNA, 25 bp, Homo sapien
gggaatgatctagaaaactttggat

SEQ ID NO: 79324 - DNA, 25 bp, Homo sapien
aatgtcattgaaagccttattacgc

SEQ ID NO: 79325 - DNA, 25 bp, Homo sapien
gccttattacgcttttcagatcctt

SEQ ID NO: 79326 - DNA, 25 bp, Homo sapien
tacgcttttcagatcctttcaataa

SEQ ID NO: 79327 - DNA, 25 bp, Homo sapien
gatcctttcaataaacaagacttgt

SEQ ID NO: 79328 - DNA, 25 bp, Homo sapien
aagctggggagatgcggttcacaat

SEQ ID NO: 79329 - DNA, 25 bp, Homo sapien
gggagatgcggttcacaatgcctcg

SEQ ID NO: 79330 - DNA, 25 bp, Homo sapien
ggagatgcggttcacaatgcctcgg

SEQ ID NO: 79331 - DNA, 25 bp, Homo sapien
gagatgcggttcacaatgcctcggt

SEQ ID NO: 79332 - DNA, 25 bp, Homo sapien
agatgcggttcacaatgcctcggta

SEQ ID NO: 79333 - DNA, 25 bp, Homo sapien
gatgcggttcacaatgcctcggtat

SEQ ID NO: 79334 - DNA, 25 bp, Homo sapien
atgcggttcacaatgcctcggtata

SEQ ID NO: 79335 - DNA, 25 bp, Homo sapien
tgcggttcacaatgcctcggtatag

SEQ ID NO: 79336 - DNA, 25 bp, Homo sapien
gcggttcacaatgcctcggtatagg

SEQ ID NO: 79337 - DNA, 25 bp, Homo sapien
aaatcccaatcccaagtcgaaatca

SEQ ID NO: 79338 - DNA, 25 bp, Homo sapien
atcccaagtcgaaatcacctcttgt

SEQ ID NO: 79339 - DNA, 25 bp, Homo sapien
tcgaaatcacctcttgttttaaaca

SEQ ID NO: 79340 - DNA, 25 bp, Homo sapien
gaatcattactgtgtatgttagggt

SEQ ID NO: 79341 - DNA, 25 bp, Homo sapien
caccagtacagtgaaagttgtttca

SEQ ID NO: 79342 - DNA, 25 bp, Homo sapien
aacagtggttatagactctttcttt

SEQ ID NO: 79343 - DNA, 25 bp, Homo sapien
agactctttctttaaccattgtata

SEQ ID NO: 79344 - DNA, 25 bp, Homo sapien
tctttaaccattgtatattttcttc

SEQ ID NO: 79345 - DNA, 25 bp, Homo sapien
attttcttccattcttgtcattggt

SEQ ID NO: 79346 - DNA, 25 bp, Homo sapien
tcttccattcttgtcattggtcaat

SEQ ID NO: 79347 - DNA, 25 bp, Homo sapien
tccattcttgtcattggtcaatagg

SEQ ID NO: 79348 - DNA, 25 bp, Homo sapien
ctggatgccatggaatcactgtggc

SEQ ID NO: 79349 - DNA, 25 bp, Homo sapien
gatgccatggaatcactgtggctct

SEQ ID NO: 79350 - DNA, 25 bp, Homo sapien
atgccatggaatcactgtggctctt

SEQ ID NO: 79351 - DNA, 25 bp, Homo sapien
tgtggctcttgttgcagttttgtac

SEQ ID NO: 79352 - DNA, 25 bp, Homo sapien
tggctcttgttgcagttttgtactc

SEQ ID NO: 79353 - DNA, 25 bp, Homo sapien
gctcttgttgcagttttgtactcta

SEQ ID NO: 79354 - DNA, 25 bp, Homo sapien
cttgttgcagttttgtactctatac

SEQ ID NO: 79355 - DNA, 25 bp, Homo sapien
tttgtactctatacttggtttttca

SEQ ID NO: 79356 - DNA, 25 bp, Homo sapien
gtactctatacttggtttttcaatt

SEQ ID NO: 79357 - DNA, 25 bp, Homo sapien
ggtttttcaattaagcttaatggct

SEQ ID NO: 79358 - DNA, 25 bp, Homo sapien
tcaattaagcttaatggctttttta

SEQ ID NO: 79359 - DNA, 25 bp, Homo sapien
taccagaactgtgctctgctggcag

SEQ ID NO: 79360 - DNA, 25 bp, Homo sapien
tttgccaaacccagggcctcagcga

SEQ ID NO: 79361 - DNA, 25 bp, Homo sapien
ctcagcgaccatgacttctgctaaa

SEQ ID NO: 79362 - DNA, 25 bp, Homo sapien
gaccatgacttctgctaaaaagcaa

SEQ ID NO: 79363 - DNA, 25 bp, Homo sapien
aaagcaatcatgagtgcgtggctgg

SEQ ID NO: 79364 - DNA, 25 bp, Homo sapien
gggacagacctctctgaagtgtctc

SEQ ID NO: 79365 - DNA, 25 bp, Homo sapien
acctctctgaagtgtctcctgttgt

SEQ ID NO: 79366 - DNA, 25 bp, Homo sapien
ttggagccactgaagagccgactgt

SEQ ID NO: 79367 - DNA, 25 bp, Homo sapien
tgaagagccgactgtgccacccact

SEQ ID NO: 79368 - DNA, 25 bp, Homo sapien
tgggaattgtgtaaacacctctggg

SEQ ID NO: 79369 - DNA, 25 bp, Homo sapien
ggataagctgaggtgactaaatgat

SEQ ID NO: 79370 - DNA, 25 bp, Homo sapien
gcactaacatagctgcagctgccag

SEQ ID NO: 79371 - DNA, 25 bp, Homo sapien
cagtgagccacactcctgagacact

SEQ ID NO: 79372 - DNA, 25 bp, Homo sapien
gagacactctctaaattgctgcact

SEQ ID NO: 79373 - DNA, 25 bp, Homo sapien
ttgctgcactcctgtaacaaacatt

SEQ ID NO: 79374 - DNA, 25 bp, Homo sapien
gttgatttccctagatgtgagtctg

SEQ ID NO: 79375 - DNA, 25 bp, Homo sapien
gtgagtctgtttgttttcaattgtc

SEQ ID NO: 79376 - DNA, 25 bp, Homo sapien
gaaatgtgatacaacttgggcacta

SEQ ID NO: 79377 - DNA, 25 bp, Homo sapien
caggaagcggtcatgaaagtgccat

SEQ ID NO: 79378 - DNA, 25 bp, Homo sapien
gaaagtgccatggatgaacactgga

SEQ ID NO: 79379 - DNA, 25 bp, Homo sapien
aacactggaggtggcagtgcctgtt

SEQ ID NO: 79380 - DNA, 25 bp, Homo sapien
gtggcagtgcctgtttatgaactaa

SEQ ID NO: 79381 - DNA, 25 bp, Homo sapien
aactgtgtagctacctcacaaccag

SEQ ID NO: 79382 - DNA, 25 bp, Homo sapien
agtcctgtctgtttatagtgctggt

SEQ ID NO: 79383 - DNA, 25 bp, Homo sapien
atagtgctggtagtatcaccttttg

SEQ ID NO: 79384 - DNA, 25 bp, Homo sapien
gcctggctggctgtgacttaccata

SEQ ID NO: 79385 - DNA, 25 bp, Homo sapien
tgtgacttaccatagcagtgacaat

SEQ ID NO: 79386 - DNA, 25 bp, Homo sapien
cagtgacaatggcagtcttggcttt

SEQ ID NO: 79387 - DNA, 25 bp, Homo sapien
tgaccctttagtgagcttagcacag

SEQ ID NO: 79388 - DNA, 25 bp, Homo sapien
gtgagcttagcacagcgggattaaa

SEQ ID NO: 79389 - DNA, 25 bp, Homo sapien
taaacagtcctttaaccagcacagc

SEQ ID NO: 79390 - DNA, 25 bp, Homo sapien
aaaagatgcagcctcactgcttcaa

SEQ ID NO: 79391 - DNA, 25 bp, Homo sapien
taaacctggcactttacaaacaaat

SEQ ID NO: 79392 - DNA, 25 bp, Homo sapien
aagagactgatcatccaggcctcag

SEQ ID NO: 79393 - DNA, 25 bp, Homo sapien
acccctgtccaggatggagggtcca

SEQ ID NO: 79394 - DNA, 25 bp, Homo sapien
ggagggtccaatcctaggacagcct

SEQ ID NO: 79395 - DNA, 25 bp, Homo sapien
tcagcacccctagcatgaacttgtg

SEQ ID NO: 79396 - DNA, 25 bp, Homo sapien
ccctagcatgaacttgtgggatggt

SEQ ID NO: 79397 - DNA, 25 bp, Homo sapien
catgatggacaaaggcctggcgtcg

SEQ ID NO: 79398 - DNA, 25 bp, Homo sapien
gtagctagcgtgtgccaggcagatc

SEQ ID NO: 79399 - DNA, 25 bp, Homo sapien
agatcctctggacacgtaacctatg

SEQ ID NO: 79400 - DNA, 25 bp, Homo sapien
acacgtaacctatgtcagacactac

SEQ ID NO: 79401 - DNA, 25 bp, Homo sapien
tcagacactacatgatgactcaagg

SEQ ID NO: 79402 - DNA, 25 bp, Homo sapien
atgatgactcaaggccaataataaa

SEQ ID NO: 79403 - DNA, 25 bp, Homo sapien
gttagacaagacactgacgctgatt

SEQ ID NO: 79404 - DNA, 25 bp, Homo sapien
gacgctgattatggagggtctcctg

SEQ ID NO: 79405 - DNA, 25 bp, Homo sapien
gggctccttggcaaggccccaggct

SEQ ID NO: 79406 - DNA, 25 bp, Homo sapien
atcctgcccgctttgtggcgggtag

SEQ ID NO: 79407 - DNA, 25 bp, Homo sapien
gtcagtgacagggaggcagccctcc

SEQ ID NO: 79408 - DNA, 25 bp, Homo sapien
ggaggcagccctccttttgtgtata

SEQ ID NO: 79409 - DNA, 25 bp, Homo sapien
gctgatttgggctcaggaaaaccta

SEQ ID NO: 79410 - DNA, 25 bp, Homo sapien
aggaaaacctagtcgcttgttgctc

SEQ ID NO: 79411 - DNA, 25 bp, Homo sapien
gttgctctcgtctgtgacatttttg

SEQ ID NO: 79412 - DNA, 25 bp, Homo sapien
gacatttttgtacactggtttgcta

SEQ ID NO: 79413 - DNA, 25 bp, Homo sapien
gtacactggtttgctactcatggca

SEQ ID NO: 79414 - DNA, 25 bp, Homo sapien
gtgcctctcagaaacgcggccagaa

SEQ ID NO: 79415 - DNA, 25 bp, Homo sapien
acgcggccagaagacaagcagggaa

SEQ ID NO: 79416 - DNA, 25 bp, Homo sapien
attgcaggtggctcttacagctctc

SEQ ID NO: 79417 - DNA, 25 bp, Homo sapien
acagctctctggtgccagcacggga

SEQ ID NO: 79418 - DNA, 25 bp, Homo sapien
gtgccagcacgggatccctgaagtg

SEQ ID NO: 79419 - DNA, 25 bp, Homo sapien
acgggatccctgaagtgactcagcc

SEQ ID NO: 79420 - DNA, 25 bp, Homo sapien
tcagccaggcagacatgagacatgg

SEQ ID NO: 79421 - DNA, 25 bp, Homo sapien
ggcggagtgtccaaatggatccttt

SEQ ID NO: 79422 - DNA, 25 bp, Homo sapien
tggatcctttattggtggtagagca

SEQ ID NO: 79423 - DNA, 25 bp, Homo sapien
accagccctcacatgtgtatgcaca

SEQ ID NO: 79424 - DNA, 25 bp, Homo sapien
gtgtatgcacatttgccagaatata

SEQ ID NO: 79425 - DNA, 25 bp, Homo sapien
ttcctcccttctgtccgctcttact

SEQ ID NO: 79426 - DNA, 25 bp, Homo sapien
tttttgtaccattaataagttatct

SEQ ID NO: 79427 - DNA, 25 bp, Homo sapien
ccttttaacaatatgcactgaataa

SEQ ID NO: 79428 - DNA, 25 bp, Homo sapien
ttgatataacaaagacttctgtcat

SEQ ID NO: 79429 - DNA, 25 bp, Homo sapien
gacttctgtcataaatagatttcct

SEQ ID NO: 79430 - DNA, 25 bp, Homo sapien
cttctgtcataaatagatttcctgt

SEQ ID NO: 79431 - DNA, 25 bp, Homo sapien
gatttcctgtgagtaatcttgcaaa

SEQ ID NO: 79432 - DNA, 25 bp, Homo sapien
atttcctgtgagtaatcttgcaaat

SEQ ID NO: 79433 - DNA, 25 bp, Homo sapien
tttcctgtgagtaatcttgcaaata

SEQ ID NO: 79434 - DNA, 25 bp, Homo sapien
ttcctgtgagtaatcttgcaaatat

SEQ ID NO: 79435 - DNA, 25 bp, Homo sapien
cctgtgagtaatcttgcaaatattt

SEQ ID NO: 79436 - DNA, 25 bp, Homo sapien
atctcagtcaattttcagctgttac

SEQ ID NO: 79437 - DNA, 25 bp, Homo sapien
tgttacagttttccctgtctcacta

SEQ ID NO: 79438 - DNA, 25 bp, Homo sapien
tacagttttccctgtctcactatct

SEQ ID NO: 79439 - DNA, 25 bp, Homo sapien
gttttccctgtctcactatctccta

SEQ ID NO: 79440 - DNA, 25 bp, Homo sapien
tacgctcatccccataaagcctgta

SEQ ID NO: 79441 - DNA, 25 bp, Homo sapien
ctcatccccataaagcctgtagttt

SEQ ID NO: 79442 - DNA, 25 bp, Homo sapien
taaagcctgtagtttatcactgttt

SEQ ID NO: 79443 - DNA, 25 bp, Homo sapien
aagcctgtagtttatcactgttttt

SEQ ID NO: 79444 - DNA, 25 bp, Homo sapien
aagtgcctagcacaccatacatgct

SEQ ID NO: 79445 - DNA, 25 bp, Homo sapien
cctagcacaccatacatgctcaata

SEQ ID NO: 79446 - DNA, 25 bp, Homo sapien
tacatgctcaataaactcgaacaac

SEQ ID NO: 79447 - DNA, 25 bp, Homo sapien
agggtagccgacaaatccttccaga

SEQ ID NO: 79448 - DNA, 25 bp, Homo sapien
tccttccagagggaaagttctttgt

SEQ ID NO: 79449 - DNA, 25 bp, Homo sapien
gaaaaggtcaatcttcagggcttcc

SEQ ID NO: 79450 - DNA, 25 bp, Homo sapien
gaagtcaagtcagaggtaaaccggt

SEQ ID NO: 79451 - DNA, 25 bp, Homo sapien
gtaaaccggtcagttacagaagcag

SEQ ID NO: 79452 - DNA, 25 bp, Homo sapien
gaagcaggatttctaggatttctaa

SEQ ID NO: 79453 - DNA, 25 bp, Homo sapien
taggatttctaactccagctgttcc

SEQ ID NO: 79454 - DNA, 25 bp, Homo sapien
agctgttcccatactgtctagttta

SEQ ID NO: 79455 - DNA, 25 bp, Homo sapien
tactgtctagtttaaattatggctg

SEQ ID NO: 79456 - DNA, 25 bp, Homo sapien
aaattatggctgttaaggccgggcg

SEQ ID NO: 79457 - DNA, 25 bp, Homo sapien
gactcaggcaggtaatcccagaact

SEQ ID NO: 79458 - DNA, 25 bp, Homo sapien
gggaatgttgcagcgtaatccttca

SEQ ID NO: 79459 - DNA, 25 bp, Homo sapien
agcgtaatccttcataccacctggt

SEQ ID NO: 79460 - DNA, 25 bp, Homo sapien
cataccacctggttcttgatattct

SEQ ID NO: 79461 - DNA, 25 bp, Homo sapien
tattctgccgcctgttcaagttcaa

SEQ ID NO: 79462 - DNA, 25 bp, Homo sapien
gaataaaagcgacagcaggacccaa

SEQ ID NO: 79463 - DNA, 25 bp, Homo sapien
gcgacagcaggacccaaatgcagct

SEQ ID NO: 79464 - DNA, 25 bp, Homo sapien
actccccaggctagacatgcttgtg

SEQ ID NO: 79465 - DNA, 25 bp, Homo sapien
gctagacatgcttgtgtccacacag

SEQ ID NO: 79466 - DNA, 25 bp, Homo sapien
tgtccacacagcacaccaatgtgat

SEQ ID NO: 79467 - DNA, 25 bp, Homo sapien
aatgtgatacttccactgaccggct

SEQ ID NO: 79468 - DNA, 25 bp, Homo sapien
tgaccggctgcagctctgcatgaag

SEQ ID NO: 79469 - DNA, 25 bp, Homo sapien
ctgtgccacagctacagatgcagaa

SEQ ID NO: 79470 - DNA, 25 bp, Homo sapien
gctacagatgcagaaggtttctctg

SEQ ID NO: 79471 - DNA, 25 bp, Homo sapien
aggtttctctggatagcacacctct

SEQ ID NO: 79472 - DNA, 25 bp, Homo sapien
tctggatagcacacctctgaatgta

SEQ ID NO: 79473 - DNA, 25 bp, Homo sapien
gcacacctctgaatgtaaatcatga

SEQ ID NO: 79474 - DNA, 25 bp, Homo sapien
atggatatttggaaacttactccta

SEQ ID NO: 79475 - DNA, 25 bp, Homo sapien
tagggtgtatttctacttctggact

SEQ ID NO: 79476 - DNA, 25 bp, Homo sapien
tatttctacttctggactgcctcaa

SEQ ID NO: 79477 - DNA, 25 bp, Homo sapien
tacttctggactgcctcaatatcaa

SEQ ID NO: 79478 - DNA, 25 bp, Homo sapien
gcctcaatatcaagggctgagactt

SEQ ID NO: 79479 - DNA, 25 bp, Homo sapien
aatattcgttgggtttcatgttaag

SEQ ID NO: 79480 - DNA, 25 bp, Homo sapien
gctggccatggagaaagctgacttg

SEQ ID NO: 79481 - DNA, 25 bp, Homo sapien
catggagaaagctgacttggctggt

SEQ ID NO: 79482 - DNA, 25 bp, Homo sapien
ctggtgtggtacagagaagccagct

SEQ ID NO: 79483 - DNA, 25 bp, Homo sapien
gaagccagcttgtttacatgcttat

SEQ ID NO: 79484 - DNA, 25 bp, Homo sapien
gcttgtttacatgcttattccatga

SEQ ID NO: 79485 - DNA, 25 bp, Homo sapien
ttattccatgactgcttgccctaag

SEQ ID NO: 79486 - DNA, 25 bp, Homo sapien
gcttgccctaagcagaaagtgcctt

SEQ ID NO: 79487 - DNA, 25 bp, Homo sapien
gaaagtgcctttcaggatctatttt

SEQ ID NO: 79488 - DNA, 25 bp, Homo sapien
gaggtttattacgtatgtctggttc

SEQ ID NO: 79489 - DNA, 25 bp, Homo sapien
acgtatgtctggttctcaattccaa

SEQ ID NO: 79490 - DNA, 25 bp, Homo sapien
gttctcaattccaacagtttaatga

SEQ ID NO: 79491 - DNA, 25 bp, Homo sapien
ggcctcactgccattttatagatga

SEQ ID NO: 79492 - DNA, 25 bp, Homo sapien
tatagatgagaaagccaagttccag

SEQ ID NO: 79493 - DNA, 25 bp, Homo sapien
agccaagttccagaaaagttgtgaa

SEQ ID NO: 79494 - DNA, 25 bp, Homo sapien
aaaagttgtgaaatagacggtgaca

SEQ ID NO: 79495 - DNA, 25 bp, Homo sapien
aactgggactagagatagtatccta

SEQ ID NO: 79496 - DNA, 25 bp, Homo sapien
gagatagtatcctaatgcttgttga

SEQ ID NO: 79497 - DNA, 25 bp, Homo sapien
gtatcctaatgcttgttgattgttt

SEQ ID NO: 79498 - DNA, 25 bp, Homo sapien
gttgattgtttttgtccatactgat

SEQ ID NO: 79499 - DNA, 25 bp, Homo sapien
ttgtttttgtccatactgattgtca

SEQ ID NO: 79500 - DNA, 25 bp, Homo sapien
gtccatactgattgtcaacctacca

SEQ ID NO: 79501 - DNA, 25 bp, Homo sapien
tgattgtcaacctaccaatataatc

SEQ ID NO: 79502 - DNA, 25 bp, Homo sapien
aagacagtgcgtacgggagccagtc

SEQ ID NO: 79503 - DNA, 25 bp, Homo sapien
tgagccaccaggagggctctgccac

SEQ ID NO: 79504 - DNA, 25 bp, Homo sapien
caccaggagggctctgccacgggca

SEQ ID NO: 79505 - DNA, 25 bp, Homo sapien
caggagggctctgccacgggcaccc

SEQ ID NO: 79506 - DNA, 25 bp, Homo sapien
agcctcaggtgcactgacctgctgc

SEQ ID NO: 79507 - DNA, 25 bp, Homo sapien
gtacagcgtccccacctatttcaaa

SEQ ID NO: 79508 - DNA, 25 bp, Homo sapien
tacagcgtccccacctatttcaaat

SEQ ID NO: 79509 - DNA, 25 bp, Homo sapien
agcgtccccacctatttcaaatctt

SEQ ID NO: 79510 - DNA, 25 bp, Homo sapien
gcgtccccacctatttcaaatctta

SEQ ID NO: 79511 - DNA, 25 bp, Homo sapien
cgtccccacctatttcaaatcttat

SEQ ID NO: 79512 - DNA, 25 bp, Homo sapien
tcaaatcttatttaacaccccacac

SEQ ID NO: 79513 - DNA, 25 bp, Homo sapien
atcctgctcagggtctatggtaggc

SEQ ID NO: 79514 - DNA, 25 bp, Homo sapien
taggcagaataatgtcccccgaaat

SEQ ID NO: 79515 - DNA, 25 bp, Homo sapien
ccccgaaatatgtccacatcctaat

SEQ ID NO: 79516 - DNA, 25 bp, Homo sapien
aagatctgtgcatatgttaccatac

SEQ ID NO: 79517 - DNA, 25 bp, Homo sapien
catacatgtccaaagaggttttgca

SEQ ID NO: 79518 - DNA, 25 bp, Homo sapien
ggagacaatcctgggttatccttgt

SEQ ID NO: 79519 - DNA, 25 bp, Homo sapien
ggttatccttgtgggctcagtttaa

SEQ ID NO: 79520 - DNA, 25 bp, Homo sapien
tgggctcagtttaatcacaagaagg

SEQ ID NO: 79521 - DNA, 25 bp, Homo sapien
ggaagataccatgcttctaattttg

SEQ ID NO: 79522 - DNA, 25 bp, Homo sapien
gggccttgagccaacaaatgcaggt

SEQ ID NO: 79523 - DNA, 25 bp, Homo sapien
caaatgcaggtgtttttagaaggtg

SEQ ID NO: 79524 - DNA, 25 bp, Homo sapien
acagcatcctgaccgtgtccgaaga

SEQ ID NO: 79525 - DNA, 25 bp, Homo sapien
agcatcctgaccgtgtccgaagagg

SEQ ID NO: 79526 - DNA, 25 bp, Homo sapien
catcctgaccgtgtccgaagaggaa

SEQ ID NO: 79527 - DNA, 25 bp, Homo sapien
tcctgaccgtgtccgaagaggaatg

SEQ ID NO: 79528 - DNA, 25 bp, Homo sapien
gaccgtgtccgaagaggaatggaac

SEQ ID NO: 79529 - DNA, 25 bp, Homo sapien
acacgggggagacctacacctgcgt

SEQ ID NO: 79530 - DNA, 25 bp, Homo sapien
tgcccaacagggtcaccgagaggac

SEQ ID NO: 79531 - DNA, 25 bp, Homo sapien
ccaacagggtcaccgagaggaccgt

SEQ ID NO: 79532 - DNA, 25 bp, Homo sapien
gtcaccgagaggaccgtggacaagt

SEQ ID NO: 79533 - DNA, 25 bp, Homo sapien
tcaccgagaggaccgtggacaagtc

SEQ ID NO: 79534 - DNA, 25 bp, Homo sapien
cgagaggaccgtggacaagtccacc

SEQ ID NO: 79535 - DNA, 25 bp, Homo sapien
gcagcacctctgagccggagggcac

SEQ ID NO: 79536 - DNA, 25 bp, Homo sapien
gagggcaccagggactcggcccagg

SEQ ID NO: 79537 - DNA, 25 bp, Homo sapien
aaagggcagtggacgtgctgcgcat

SEQ ID NO: 79538 - DNA, 25 bp, Homo sapien
tgctgcgcatgttcgggagcgaact

SEQ ID NO: 79539 - DNA, 25 bp, Homo sapien
gaactcccccgaagaaggaccagtg

SEQ ID NO: 79540 - DNA, 25 bp, Homo sapien
aagaaggaccagtgaagacgtcagg

SEQ ID NO: 79541 - DNA, 25 bp, Homo sapien
gtccggaagggtgatcatcgacccc

SEQ ID NO: 79542 - DNA, 25 bp, Homo sapien
agggtgatcatcgacccccaaggga

SEQ ID NO: 79543 - DNA, 25 bp, Homo sapien
aatcacccacaaccctctggaagtg

SEQ ID NO: 79544 - DNA, 25 bp, Homo sapien
gcgaggtcggcaaagcaacatggca

SEQ ID NO: 79545 - DNA, 25 bp, Homo sapien
ggtcggcaaagcaacatggcagagc

SEQ ID NO: 79546 - DNA, 25 bp, Homo sapien
ggcgccggaaccagatcctatctgt

SEQ ID NO: 79547 - DNA, 25 bp, Homo sapien
agatcctatctgtgctggcaggact

SEQ ID NO: 79548 - DNA, 25 bp, Homo sapien
gccatggtgggctacgccttgctca

SEQ ID NO: 79549 - DNA, 25 bp, Homo sapien
tacgccttgctcagcggcattgtct

SEQ ID NO: 79550 - DNA, 25 bp, Homo sapien
ggcattgtctccatccagcgggcaa

SEQ ID NO: 79551 - DNA, 25 bp, Homo sapien
atccagcgggcaacgcctgctcggg

SEQ ID NO: 79552 - DNA, 25 bp, Homo sapien
gaggaatgatttgtcctcacgctcc

SEQ ID NO: 79553 - DNA, 25 bp, Homo sapien
cacgctcccaagactggtttttcta

SEQ ID NO: 79554 - DNA, 25 bp, Homo sapien
gactggtttttctactctcatgcat

SEQ ID NO: 79555 - DNA, 25 bp, Homo sapien
ccgtgcctcctcgttgttggtacag

SEQ ID NO: 79556 - DNA, 25 bp, Homo sapien
ctcgttgttggtacagccggacacg

SEQ ID NO: 79557 - DNA, 25 bp, Homo sapien
acgctgcgttcactgccaatgctgt

SEQ ID NO: 79558 - DNA, 25 bp, Homo sapien
gccaatgctgtactcacctccatca

SEQ ID NO: 79559 - DNA, 25 bp, Homo sapien
gggcccatgtcttccttgggccaag

SEQ ID NO: 79560 - DNA, 25 bp, Homo sapien
tcttccttgggccaaggtctcatgg

SEQ ID NO: 79561 - DNA, 25 bp, Homo sapien
gagaagatgcgcagttacctcatgt

SEQ ID NO: 79562 - DNA, 25 bp, Homo sapien
aagatgcgcagttacctcatgtcgg

SEQ ID NO: 79563 - DNA, 25 bp, Homo sapien
atgcgcagttacctcatgtcggtgc

SEQ ID NO: 79564 - DNA, 25 bp, Homo sapien
agttacctcatgtcggtgcccgctg

SEQ ID NO: 79565 - DNA, 25 bp, Homo sapien
ggtgcctggcgggtacttttctatc

SEQ ID NO: 79566 - DNA, 25 bp, Homo sapien
gcctggcgggtacttttctatcttt

SEQ ID NO: 79567 - DNA, 25 bp, Homo sapien
cttttctatcttttatttccagatt

SEQ ID NO: 79568 - DNA, 25 bp, Homo sapien
ggattgaaattaaaccctgagccac

SEQ ID NO: 79569 - DNA, 25 bp, Homo sapien
gaaattaaaccctgagccaccgtgt

SEQ ID NO: 79570 - DNA, 25 bp, Homo sapien
tgagccaccgtgtccttgtagagca

SEQ ID NO: 79571 - DNA, 25 bp, Homo sapien
atgtcattgcccacttctgtgtaga

SEQ ID NO: 79572 - DNA, 25 bp, Homo sapien
tcattgcccacttctgtgtagacat

SEQ ID NO: 79573 - DNA, 25 bp, Homo sapien
tgcccacttctgtgtagacatggtt

SEQ ID NO: 79574 - DNA, 25 bp, Homo sapien
ttctgtgtagacatggttctggttt

SEQ ID NO: 79575 - DNA, 25 bp, Homo sapien
catggttctggtttaactaatattt

SEQ ID NO: 79576 - DNA, 25 bp, Homo sapien
aactaatatttgtctgtgtgctact

SEQ ID NO: 79577 - DNA, 25 bp, Homo sapien
aatatttgtctgtgtgctactaaca

SEQ ID NO: 79578 - DNA, 25 bp, Homo sapien
gtctgtgtgctactaacagattata

SEQ ID NO: 79579 - DNA, 25 bp, Homo sapien
gtaagttgcacatgtgtggcctaca

SEQ ID NO: 79580 - DNA, 25 bp, Homo sapien
gttgcacatgtgtggcctacagtga

SEQ ID NO: 79581 - DNA, 25 bp, Homo sapien
tgtggcctacagtgacttccatgta

SEQ ID NO: 79582 - DNA, 25 bp, Homo sapien
acagtgacttccatgtagtaacagg

SEQ ID NO: 79583 - DNA, 25 bp, Homo sapien
ggcaggctctccaccagacttaaag

SEQ ID NO: 79584 - DNA, 25 bp, Homo sapien
cttaaagcattcaaccactctgccc

SEQ ID NO: 79585 - DNA, 25 bp, Homo sapien
aggccgacactgacatgtgttcact

SEQ ID NO: 79586 - DNA, 25 bp, Homo sapien
catgtgttcactgtcgctgccacag

SEQ ID NO: 79587 - DNA, 25 bp, Homo sapien
tgttcactgtcgctgccacagctgg

SEQ ID NO: 79588 - DNA, 25 bp, Homo sapien
cactgacatctccttggctacacaa

SEQ ID NO: 79589 - DNA, 25 bp, Homo sapien
gtgtctcttgtcaaagctaattttt

SEQ ID NO: 79590 - DNA, 25 bp, Homo sapien
ttttctacaagtattctgcctttgc

SEQ ID NO: 79591 - DNA, 25 bp, Homo sapien
tgcctttgcagaaacagatttggtg

SEQ ID NO: 79592 - DNA, 25 bp, Homo sapien
gagtaatctgatcgttctttctagc

SEQ ID NO: 79593 - DNA, 25 bp, Homo sapien
ctgatcgttctttctagctaatgga

SEQ ID NO: 79594 - DNA, 25 bp, Homo sapien
agcaatgttatcttggtgtgttaag

SEQ ID NO: 79595 - DNA, 25 bp, Homo sapien
ggttattttctcctgatatagatca

SEQ ID NO: 79596 - DNA, 25 bp, Homo sapien
atagatcacataacagaatgcacca

SEQ ID NO: 79597 - DNA, 25 bp, Homo sapien
cagtcatcagctattcagttggtaa

SEQ ID NO: 79598 - DNA, 25 bp, Homo sapien
attcagttggtaagcttccaggaaa

SEQ ID NO: 79599 - DNA, 25 bp, Homo sapien
gtttgagacctgaatagctcccaga

SEQ ID NO: 79600 - DNA, 25 bp, Homo sapien
atagctcccagatttcagtcttttc

SEQ ID NO: 79601 - DNA, 25 bp, Homo sapien
catctggcaaacagcccctgggctg

SEQ ID NO: 79602 - DNA, 25 bp, Homo sapien
cacccagtagtcctgcctgtctgca

SEQ ID NO: 79603 - DNA, 25 bp, Homo sapien
tgaactggaggctggttaagttgca

SEQ ID NO: 79604 - DNA, 25 bp, Homo sapien
ctggttaagttgcagccgctgggtc

SEQ ID NO: 79605 - DNA, 25 bp, Homo sapien
tgcactgcccagcagcccggttagg

SEQ ID NO: 79606 - DNA, 25 bp, Homo sapien
cagcagcccggttagggctcctgga

SEQ ID NO: 79607 - DNA, 25 bp, Homo sapien
ggctcctggagccaccttaggaaag

SEQ ID NO: 79608 - DNA, 25 bp, Homo sapien
gccaccttaggaaagggcttctcat

SEQ ID NO: 79609 - DNA, 25 bp, Homo sapien
ggaaagggcttctcatgagctctgc

SEQ ID NO: 79610 - DNA, 25 bp, Homo sapien
aaagggcttctcatgagctctgctg

SEQ ID NO: 79611 - DNA, 25 bp, Homo sapien
ggcttctcatgagctctgctgcggc

SEQ ID NO: 79612 - DNA, 25 bp, Homo sapien
ctttctttgggagcagtacagtgac

SEQ ID NO: 79613 - DNA, 25 bp, Homo sapien
tttgggagcagtacagtgaccgcga

SEQ ID NO: 79614 - DNA, 25 bp, Homo sapien
acagtgaccgcgatgggcgaggcat

SEQ ID NO: 79615 - DNA, 25 bp, Homo sapien
ggctggaccagccttgtcttactgg

SEQ ID NO: 79616 - DNA, 25 bp, Homo sapien
ccttgtcttactggccatggctgaa

SEQ ID NO: 79617 - DNA, 25 bp, Homo sapien
gggagccaagacactcatgccactc

SEQ ID NO: 79618 - DNA, 25 bp, Homo sapien
actcatgccactctggctctgaagg

SEQ ID NO: 79619 - DNA, 25 bp, Homo sapien
gggacaaaggcttctggcttttgcc

SEQ ID NO: 79620 - DNA, 25 bp, Homo sapien
cagccccttggataccagtaattca

SEQ ID NO: 79621 - DNA, 25 bp, Homo sapien
taccagtaattcaaaccttcctcat

SEQ ID NO: 79622 - DNA, 25 bp, Homo sapien
tgtgaatccagagtctatttttcta

SEQ ID NO: 79623 - DNA, 25 bp, Homo sapien
tggagatttctcctgtactgccact

SEQ ID NO: 79624 - DNA, 25 bp, Homo sapien
tcctgtactgccactgcgaagatgg

SEQ ID NO: 79625 - DNA, 25 bp, Homo sapien
gccactgcgaagatgggacacttaa

SEQ ID NO: 79626 - DNA, 25 bp, Homo sapien
ctgatggcccaagtgtaaatgtcta

SEQ ID NO: 79627 - DNA, 25 bp, Homo sapien
ccatgtttacctgccgtgaattaga

SEQ ID NO: 79628 - DNA, 25 bp, Homo sapien
ttacctgccgtgaattagatttttt

SEQ ID NO: 79629 - DNA, 25 bp, Homo sapien
tttttatggctgagcgcaccttcga

SEQ ID NO: 79630 - DNA, 25 bp, Homo sapien
gagcgcaccttcgagatgagacctt

SEQ ID NO: 79631 - DNA, 25 bp, Homo sapien
gatgagaccttcacttcaggtggta

SEQ ID NO: 79632 - DNA, 25 bp, Homo sapien
cacttcaggtggtaatgcgcctggt

SEQ ID NO: 79633 - DNA, 25 bp, Homo sapien
tgcggtgacggtggagatttctcct

SEQ ID NO: 79634 - DNA, 25 bp, Homo sapien
ggaagcacgtggttgagaagcatca

SEQ ID NO: 79635 - DNA, 25 bp, Homo sapien
agaagcatcagaatcgttcccacgg

SEQ ID NO: 79636 - DNA, 25 bp, Homo sapien
aagcatcagaatcgttcccacggac

SEQ ID NO: 79637 - DNA, 25 bp, Homo sapien
atcagaatcgttcccacggaccatg

SEQ ID NO: 79638 - DNA, 25 bp, Homo sapien
agaatcgttcccacggaccatgctc

SEQ ID NO: 79639 - DNA, 25 bp, Homo sapien
gaccatgctccggagtctcagcagg

SEQ ID NO: 79640 - DNA, 25 bp, Homo sapien
agtctcagcaggctcctgcagtgtg

SEQ ID NO: 79641 - DNA, 25 bp, Homo sapien
agcaggctcctgcagtgtgtttatc

SEQ ID NO: 79642 - DNA, 25 bp, Homo sapien
caggctcctgcagtgtgtttatccg

SEQ ID NO: 79643 - DNA, 25 bp, Homo sapien
tgaaggaccctcatacggctgacgt

SEQ ID NO: 79644 - DNA, 25 bp, Homo sapien
atttccttcagacgcatactcagag

SEQ ID NO: 79645 - DNA, 25 bp, Homo sapien
agagttcacttgcttcagcaactgt

SEQ ID NO: 79646 - DNA, 25 bp, Homo sapien
cttcagcaactgtttgtctgcacaa

SEQ ID NO: 79647 - DNA, 25 bp, Homo sapien
acaagcactcatgtgtcaccagcaa

SEQ ID NO: 79648 - DNA, 25 bp, Homo sapien
acgtcccaaagccaagacaggatca

SEQ ID NO: 79649 - DNA, 25 bp, Homo sapien
gacaggatcagtcatcaggcaactc

SEQ ID NO: 79650 - DNA, 25 bp, Homo sapien
aggcaactctgccaagtcctgtctg

SEQ ID NO: 79651 - DNA, 25 bp, Homo sapien
aagtcctgtctgcattgcatctgtg

SEQ ID NO: 79652 - DNA, 25 bp, Homo sapien
tgtctgcattgcatctgtgtggtgc

SEQ ID NO: 79653 - DNA, 25 bp, Homo sapien
gagtttacctctttagttgctttat

SEQ ID NO: 79654 - DNA, 25 bp, Homo sapien
tgctttatcaactcttgttactaaa

SEQ ID NO: 79655 - DNA, 25 bp, Homo sapien
tgaattaaagctccgtttctcctca

SEQ ID NO: 79656 - DNA, 25 bp, Homo sapien
gcccagccgtgggcttaggagagag

SEQ ID NO: 79657 - DNA, 25 bp, Homo sapien
cccagccgtgggcttaggagagagg

SEQ ID NO: 79658 - DNA, 25 bp, Homo sapien
ccagccgtgggcttaggagagaggg

SEQ ID NO: 79659 - DNA, 25 bp, Homo sapien
cagccgtgggcttaggagagaggga

SEQ ID NO: 79660 - DNA, 25 bp, Homo sapien
agccgtgggcttaggagagagggac

SEQ ID NO: 79661 - DNA, 25 bp, Homo sapien
gccgtgggcttaggagagagggacc

SEQ ID NO: 79662 - DNA, 25 bp, Homo sapien
ccgtgggcttaggagagagggacca

SEQ ID NO: 79663 - DNA, 25 bp, Homo sapien
cgtgggcttaggagagagggaccag

SEQ ID NO: 79664 - DNA, 25 bp, Homo sapien
gagagagggaccagcgcccagcgtt

SEQ ID NO: 79665 - DNA, 25 bp, Homo sapien
tttccaggcagctctattcttgcag

SEQ ID NO: 79666 - DNA, 25 bp, Homo sapien
ggcagctctattcttgcagagccat

SEQ ID NO: 79667 - DNA, 25 bp, Homo sapien
tattcttgcagagccatagcaggac

SEQ ID NO: 79668 - DNA, 25 bp, Homo sapien
gcagagccatagcaggacatgttaa

SEQ ID NO: 79669 - DNA, 25 bp, Homo sapien
gcaggacatgttaaaattccaatag

SEQ ID NO: 79670 - DNA, 25 bp, Homo sapien
gaaagtctgtggaatcactagtgac

SEQ ID NO: 79671 - DNA, 25 bp, Homo sapien
actagtgactaaatactgggaacct

SEQ ID NO: 79672 - DNA, 25 bp, Homo sapien
aatactgggaacctattttctcaat

SEQ ID NO: 79673 - DNA, 25 bp, Homo sapien
ctgggaacctattttctcaatcttc

SEQ ID NO: 79674 - DNA, 25 bp, Homo sapien
tctcaatcttcctccatgttgtgtt

SEQ ID NO: 79675 - DNA, 25 bp, Homo sapien
agtgtatgctgtattggtgcaataa

SEQ ID NO: 79676 - DNA, 25 bp, Homo sapien
aaatgtccttacctcttaaaatgtg

SEQ ID NO: 79677 - DNA, 25 bp, Homo sapien
atgtccttacctcttaaaatgtgaa

SEQ ID NO: 79678 - DNA, 25 bp, Homo sapien
gtccttacctcttaaaatgtgaatt

SEQ ID NO: 79679 - DNA, 25 bp, Homo sapien
ccttacctcttaaaatgtgaattca

SEQ ID NO: 79680 - DNA, 25 bp, Homo sapien
gaattcatctgttaagctaggggtg

SEQ ID NO: 79681 - DNA, 25 bp, Homo sapien
ttaagctaggggtgacacacgtcat

SEQ ID NO: 79682 - DNA, 25 bp, Homo sapien
aattgttggtgtgggaagatgctaa

SEQ ID NO: 79683 - DNA, 25 bp, Homo sapien
aagaatgcaaaactgatccatatct

SEQ ID NO: 79684 - DNA, 25 bp, Homo sapien
gatgtgggtatggaaattgactgtt

SEQ ID NO: 79685 - DNA, 25 bp, Homo sapien
gttacttcctttacagatctacaga

SEQ ID NO: 79686 - DNA, 25 bp, Homo sapien
cttcctttacagatctacagacagt

SEQ ID NO: 79687 - DNA, 25 bp, Homo sapien
tttgaagcctatacaattggtattg

SEQ ID NO: 79688 - DNA, 25 bp, Homo sapien
gaagcctatacaattggtattgttt

SEQ ID NO: 79689 - DNA, 25 bp, Homo sapien
gcctatacaattggtattgtttgac

SEQ ID NO: 79690 - DNA, 25 bp, Homo sapien
ttacatctcttagcatggaggacga

SEQ ID NO: 79691 - DNA, 25 bp, Homo sapien
acatctcttagcatggaggacgaag

SEQ ID NO: 79692 - DNA, 25 bp, Homo sapien
atctcttagcatggaggacgaagaa

SEQ ID NO: 79693 - DNA, 25 bp, Homo sapien
catggaggacgaagaaagctgtaca

SEQ ID NO: 79694 - DNA, 25 bp, Homo sapien
gctgtacattgttgcttgagagtct

SEQ ID NO: 79695 - DNA, 25 bp, Homo sapien
tacattgttgcttgagagtctgtac

SEQ ID NO: 79696 - DNA, 25 bp, Homo sapien
attgttgcttgagagtctgtacatt

SEQ ID NO: 79697 - DNA, 25 bp, Homo sapien
ttgttgcttgagagtctgtacattt

SEQ ID NO: 79698 - DNA, 25 bp, Homo sapien
ggtttttgaagcctatacaattggt

SEQ ID NO: 79699 - DNA, 25 bp, Homo sapien
gcctatacaattggtattgtttgac

SEQ ID NO: 79700 - DNA, 25 bp, Homo sapien
gtttgacccttaagcttttacatct

SEQ ID NO: 79701 - DNA, 25 bp, Homo sapien
ttacatctcttagcatggaggacga

SEQ ID NO: 79702 - DNA, 25 bp, Homo sapien
acatctcttagcatggaggacgaag

SEQ ID NO: 79703 - DNA, 25 bp, Homo sapien
catggaggacgaagaaagctgtaca

SEQ ID NO: 79704 - DNA, 25 bp, Homo sapien
gctgtacattgttgcttgagagtct

SEQ ID NO: 79705 - DNA, 25 bp, Homo sapien
tacattgttgcttgagagtctgtac

SEQ ID NO: 79706 - DNA, 25 bp, Homo sapien
ttgttgcttgagagtctgtacattt

SEQ ID NO: 79707 - DNA, 25 bp, Homo sapien
agatttgtatttgcactgtcagtat

SEQ ID NO: 79708 - DNA, 25 bp, Homo sapien
ttttttgattcagcttatacccggg

SEQ ID NO: 79709 - DNA, 25 bp, Homo sapien
taaaaattcaagttagctagctggg

SEQ ID NO: 79710 - DNA, 25 bp, Homo sapien
aaaaattcaagttagctagctgggc

SEQ ID NO: 79711 - DNA, 25 bp, Homo sapien
aaaattcaagttagctagctgggca

SEQ ID NO: 79712 - DNA, 25 bp, Homo sapien
aaattcaagttagctagctgggcat

SEQ ID NO: 79713 - DNA, 25 bp, Homo sapien
aattcaagttagctagctgggcatg

SEQ ID NO: 79714 - DNA, 25 bp, Homo sapien
ttcaagttagctagctgggcatggt

SEQ ID NO: 79715 - DNA, 25 bp, Homo sapien
gtgagccaagatggtaccagcctag

SEQ ID NO: 79716 - DNA, 25 bp, Homo sapien
tgagccaagatggtaccagcctagg

SEQ ID NO: 79717 - DNA, 25 bp, Homo sapien
gagccaagatggtaccagcctaggt

SEQ ID NO: 79718 - DNA, 25 bp, Homo sapien
ccaagatggtaccagcctaggtgac

SEQ ID NO: 79719 - DNA, 25 bp, Homo sapien
caagatggtaccagcctaggtgaca

SEQ ID NO: 79720 - DNA, 25 bp, Homo sapien
gctgaggcgggagagtggcgtgaaa

SEQ ID NO: 79721 - DNA, 25 bp, Homo sapien
ctgaggcgggagagtggcgtgaaac

SEQ ID NO: 79722 - DNA, 25 bp, Homo sapien
tgaggcgggagagtggcgtgaaact

SEQ ID NO: 79723 - DNA, 25 bp, Homo sapien
gaggcgggagagtggcgtgaaactg

SEQ ID NO: 79724 - DNA, 25 bp, Homo sapien
aggcgggagagtggcgtgaaactgg

SEQ ID NO: 79725 - DNA, 25 bp, Homo sapien
ggcgggagagtggcgtgaaactggg

SEQ ID NO: 79726 - DNA, 25 bp, Homo sapien
gcgggagagtggcgtgaaactggga

SEQ ID NO: 79727 - DNA, 25 bp, Homo sapien
cgggagagtggcgtgaaactgggag

SEQ ID NO: 79728 - DNA, 25 bp, Homo sapien
gggagagtggcgtgaaactgggagg

SEQ ID NO: 79729 - DNA, 25 bp, Homo sapien
gtctagttcagcaattcaccgtaat

SEQ ID NO: 79730 - DNA, 25 bp, Homo sapien
tctagttcagcaattcaccgtaata

SEQ ID NO: 79731 - DNA, 25 bp, Homo sapien
tagttcagcaattcaccgtaatagt

SEQ ID NO: 79732 - DNA, 25 bp, Homo sapien
agttcagcaattcaccgtaatagtt

SEQ ID NO: 79733 - DNA, 25 bp, Homo sapien
gttcagcaattcaccgtaatagttg

SEQ ID NO: 79734 - DNA, 25 bp, Homo sapien
ttcagcaattcaccgtaatagttga

SEQ ID NO: 79735 - DNA, 25 bp, Homo sapien
cagcaattcaccgtaatagttgaaa

SEQ ID NO: 79736 - DNA, 25 bp, Homo sapien
gcaattcaccgtaatagttgaaata

SEQ ID NO: 79737 - DNA, 25 bp, Homo sapien
caccgtaatagttgaaatatactgt

SEQ ID NO: 79738 - DNA, 25 bp, Homo sapien
aatatactgttatttggctgggcat

SEQ ID NO: 79739 - DNA, 25 bp, Homo sapien
atatactgttatttggctgggcatg

SEQ ID NO: 79740 - DNA, 25 bp, Homo sapien
catgattgaaagactatctcctggc

SEQ ID NO: 79741 - DNA, 25 bp, Homo sapien
atctcctggcactcgcaagattgag

SEQ ID NO: 79742 - DNA, 25 bp, Homo sapien
agattgagttatttggacgaccaca

SEQ ID NO: 79743 - DNA, 25 bp, Homo sapien
cacacaatgtgcaacccaactggat

SEQ ID NO: 79744 - DNA, 25 bp, Homo sapien
actggatcacccttggaaaccaact

SEQ ID NO: 79745 - DNA, 25 bp, Homo sapien
ggatccacctactagacccagatgt

SEQ ID NO: 79746 - DNA, 25 bp, Homo sapien
ccagatgtggttgcacggttcaagc

SEQ ID NO: 79747 - DNA, 25 bp, Homo sapien
gatggtatcatctctaaacctaaga

SEQ ID NO: 79748 - DNA, 25 bp, Homo sapien
gctaagaatccatagccatggctct

SEQ ID NO: 79749 - DNA, 25 bp, Homo sapien
gccatggctctgtaagctaaacctg

SEQ ID NO: 79750 - DNA, 25 bp, Homo sapien
atttgtacaatagctttcttcttta

SEQ ID NO: 79751 - DNA, 25 bp, Homo sapien
ttctgtgtctgaagtgtaagtgaac

SEQ ID NO: 79752 - DNA, 25 bp, Homo sapien
cagaagagtgacatgtttacaaacc

SEQ ID NO: 79753 - DNA, 25 bp, Homo sapien
atgtttacaaacctcaagccagcct

SEQ ID NO: 79754 - DNA, 25 bp, Homo sapien
gtttacaaacctcaagccagccttg

SEQ ID NO: 79755 - DNA, 25 bp, Homo sapien
gggcctgttgaagatgcttgtattt

SEQ ID NO: 79756 - DNA, 25 bp, Homo sapien
tatcgccatcacagctgaacttgtt

SEQ ID NO: 79757 - DNA, 25 bp, Homo sapien
agctgaacttgttgagatccccgtg

SEQ ID NO: 79758 - DNA, 25 bp, Homo sapien
tgaacttgttgagatccccgtgtta

SEQ ID NO: 79759 - DNA, 25 bp, Homo sapien
acttgttgagatccccgtgttactg

SEQ ID NO: 79760 - DNA, 25 bp, Homo sapien
ttgagatccccgtgttactgcctat

SEQ ID NO: 79761 - DNA, 25 bp, Homo sapien
atccccgtgttactgcctatcagca

SEQ ID NO: 79762 - DNA, 25 bp, Homo sapien
tggccccagggactcttgttaacag

SEQ ID NO: 79763 - DNA, 25 bp, Homo sapien
ggccccagggactcttgttaacagt

SEQ ID NO: 79764 - DNA, 25 bp, Homo sapien
gccccagggactcttgttaacagta

SEQ ID NO: 79765 - DNA, 25 bp, Homo sapien
ccagggactcttgttaacagtaact

SEQ ID NO: 79766 - DNA, 25 bp, Homo sapien
cagggactcttgttaacagtaactt

SEQ ID NO: 79767 - DNA, 25 bp, Homo sapien
gggactcttgttaacagtaacttag

SEQ ID NO: 79768 - DNA, 25 bp, Homo sapien
ggactcttgttaacagtaacttagg

SEQ ID NO: 79769 - DNA, 25 bp, Homo sapien
gactcttgttaacagtaacttagga

SEQ ID NO: 79770 - DNA, 25 bp, Homo sapien
cttgttaacagtaacttaggagtca

SEQ ID NO: 79771 - DNA, 25 bp, Homo sapien
tgttaacagtaacttaggagtcagg

SEQ ID NO: 79772 - DNA, 25 bp, Homo sapien
gtgcagcccgccatggccgtgtaga

SEQ ID NO: 79773 - DNA, 25 bp, Homo sapien
agcaaacagaacactccaacttaga

SEQ ID NO: 79774 - DNA, 25 bp, Homo sapien
gaacactccaacttagagcaataac

SEQ ID NO: 79775 - DNA, 25 bp, Homo sapien
agcagccagggaagaccttggtttg

SEQ ID NO: 79776 - DNA, 25 bp, Homo sapien
ggtttggtttatgtgtcagtttcac

SEQ ID NO: 79777 - DNA, 25 bp, Homo sapien
gtcagtttcacttttccgatagaaa

SEQ ID NO: 79778 - DNA, 25 bp, Homo sapien
gtaaggcttgaagtgatgaaaccca

SEQ ID NO: 79779 - DNA, 25 bp, Homo sapien
gtgatgaaacccacagatcctagca

SEQ ID NO: 79780 - DNA, 25 bp, Homo sapien
gatcctagcaaatgtgcccaaccag

SEQ ID NO: 79781 - DNA, 25 bp, Homo sapien
tgtgcccaaccagctttactaaagg

SEQ ID NO: 79782 - DNA, 25 bp, Homo sapien
gtacttgtccctttgttgtcgttgt

SEQ ID NO: 79783 - DNA, 25 bp, Homo sapien
tgttgtcgttgttgtagttaaagga

SEQ ID NO: 79784 - DNA, 25 bp, Homo sapien
cccttgccgtatctaaggagctgag

SEQ ID NO: 79785 - DNA, 25 bp, Homo sapien
ccttgccgtatctaaggagctgagg

SEQ ID NO: 79786 - DNA, 25 bp, Homo sapien
cttgccgtatctaaggagctgaggt

SEQ ID NO: 79787 - DNA, 25 bp, Homo sapien
ttgccgtatctaaggagctgaggta

SEQ ID NO: 79788 - DNA, 25 bp, Homo sapien
tgccgtatctaaggagctgaggtaa

SEQ ID NO: 79789 - DNA, 25 bp, Homo sapien
gccgtatctaaggagctgaggtaat

SEQ ID NO: 79790 - DNA, 25 bp, Homo sapien
ccgtatctaaggagctgaggtaata
